United States Patent 11,332,783 (SAMPLE ANALYSIS, PRESENCE DETERMINATION OF A TARGET SEQUENCE) - sequence listing, part 7

SEQ ID NO: 123786 - DNA, 75 bp, Artificial Sequence
  Synthetic
tccttctcaacaacaccagaccaccattgggcaactggtttggctgcacctggatgaattcatctggctatacca

SEQ ID NO: 123787 - DNA, 75 bp, Artificial Sequence
  Synthetic
tcgagcgtccacggtgcaggcgaagctcctatccatagaggaagcctgcgacctcacaccatcgcactcagcccg

SEQ ID NO: 123788 - DNA, 75 bp, Artificial Sequence
  Synthetic
gaagcgagcactttacgacgtcacgcgcaagcttcctgtggcagtaatgggaccatcatacggtttccagtactc

SEQ ID NO: 123789 - DNA, 75 bp, Artificial Sequence
  Synthetic
cacacggtgtggttccggcccttggctgaccccccggtgcatcgttgactacccttacaggctatggcactaccc

SEQ ID NO: 123790 - DNA, 75 bp, Artificial Sequence
  Synthetic
gaacgtgacatccgcactgaggagtccatctaccaatgctgtcagttagatccgacggcacggaaggccattaca

SEQ ID NO: 123791 - DNA, 75 bp, Artificial Sequence
  Synthetic
gctctggatgacagggacaggtctgagctcagcccattgctgctcaccaccacgcagtggcaggtgctcccatgc

SEQ ID NO: 123792 - DNA, 75 bp, Artificial Sequence
  Synthetic
ggggccccatgttcaactcccggggccaatcctgtggctaacgcaggtgccgagctagcggtgttctcaccacta

SEQ ID NO: 123793 - DNA, 75 bp, Artificial Sequence
  Synthetic
ggggccccatgttcaactcccggggccaatcctgtggctatcgcaggtgccgagctagcggtgttctcaccacta

SEQ ID NO: 123794 - DNA, 75 bp, Artificial Sequence
  Synthetic
ggggccccatgttcaactcccggggccaatcctgtggctaccgcaggtgccgagctagcggtgttctcaccacta

SEQ ID NO: 123795 - DNA, 75 bp, Artificial Sequence
  Synthetic
ggggccccatgttcaactcccggggccaatcctgtggctagcgcaggtgccgagctagcggtgttctcaccacta

SEQ ID NO: 123796 - DNA, 75 bp, Artificial Sequence
  Synthetic
cttgggcaatcaagtgggattacatcgtcctcctattcttgctgcttgcagacgcacgtgtctgcgcctgcctgt

SEQ ID NO: 123797 - DNA, 75 bp, Artificial Sequence
  Synthetic
cgtgattgcagagagcgcgggggttaccgaggatgcgagtgcactgcgagccttcacggaggctatgaccagata

SEQ ID NO: 123798 - DNA, 75 bp, Artificial Sequence
  Synthetic
cgtgattgcagagagcgcgggggtttccgaggatgcgagtgcactgcgagccttcacggaggctatgaccagata

SEQ ID NO: 123799 - DNA, 75 bp, Artificial Sequence
  Synthetic
cgtgattgcagagagcgcgggggttcccgaggatgcgagtgcactgcgagccttcacggaggctatgaccagata

SEQ ID NO: 123800 - DNA, 75 bp, Artificial Sequence
  Synthetic
cgtgattgcagagagcgcgggggttgccgaggatgcgagtgcactgcgagccttcacggaggctatgaccagata

SEQ ID NO: 123801 - DNA, 75 bp, Artificial Sequence
  Synthetic
taacatcttgctcgtccaacgtctccgtggcccacgacaacaacggacagagatactactacctcacacgtgacc

SEQ ID NO: 123802 - DNA, 75 bp, Artificial Sequence
  Synthetic
catattcttctgctttgcgtggtacctgaagggcagatgggtgcctggggccgcgtacgccatctacgggatgtg

SEQ ID NO: 123803 - DNA, 75 bp, Artificial Sequence
  Synthetic
agatactactacctcacacgtgaccccgtcacaccattgacacgagcagcttgggaaacagcccggcacactcca

SEQ ID NO: 123804 - DNA, 75 bp, Artificial Sequence
  Synthetic
ccggcataggtcgcgtaacttgggtaaggtcatcgataccctcacctgcggctttgccgacctcatggggtacat

SEQ ID NO: 123805 - DNA, 75 bp, Artificial Sequence
  Synthetic
aaggtcatcgataccctcacctgcggctttgccgacctcatggggtacatccccgtcgtcggcgcccctgttggt

SEQ ID NO: 123806 - DNA, 75 bp, Artificial Sequence
  Synthetic
gacgctgcgtcactgcgagcgttcacggacgctatgaccaggtactcagctccccctggagacgccccgcaacct

SEQ ID NO: 123807 - DNA, 75 bp, Artificial Sequence
  Synthetic
cgacgccatcatccttctcacgtgtgcggcccacccagagttaatctttgacatcaccaaactcctgctcgccat

SEQ ID NO: 123808 - DNA, 75 bp, Artificial Sequence
  Synthetic
gtactcacgctgtcgccacactataagtggtgcattgcccgctgtctttggtggctccaatacttcctgactaga

SEQ ID NO: 123809 - DNA, 75 bp, Artificial Sequence
  Synthetic
cactccgtaaagcgctcgacttcgatatgtacggggtcacctattcagtcactccacttgatctaccacagatca

SEQ ID NO: 123810 - DNA, 75 bp, Artificial Sequence
  Synthetic
tagctcttctctcctgcatcaccgtgccgacctctgcagctgaggtgaggaacatcagcggcctctacacggtaa

SEQ ID NO: 123811 - DNA, 75 bp, Artificial Sequence
  Synthetic
agccctagtggtatcgcagttactccggatcccacaagctgtcgtggacatggtggcgggggcccactggggagt

SEQ ID NO: 123812 - DNA, 75 bp, Artificial Sequence
  Synthetic
gttgagagcttggcgacaccgggccagagcggtcagagctaaactcattgcccagggggggaaagccgcaatttg

SEQ ID NO: 123813 - DNA, 75 bp, Artificial Sequence
  Synthetic
ttgacatcaccaagctgctgctggccattcttgggcctttgtgggtcctgcaggccagcctgctcagggtcccct

SEQ ID NO: 123814 - DNA, 75 bp, Artificial Sequence
  Synthetic
atgctggataccgatcacgcccaacgtggccgtcagccagcctggagcgcatacaaggggactgcgaacacacat

SEQ ID NO: 123815 - DNA, 75 bp, Artificial Sequence
  Synthetic
atgctggataccgatcacgcccaacgtggccgtcagccagcctggagcgcttacaaggggactgcgaacacacat

SEQ ID NO: 123816 - DNA, 75 bp, Artificial Sequence
  Synthetic
atgctggataccgatcacgcccaacgtggccgtcagccagcctggagcgcctacaaggggactgcgaacacacat

SEQ ID NO: 123817 - DNA, 75 bp, Artificial Sequence
  Synthetic
atgctggataccgatcacgcccaacgtggccgtcagccagcctggagcgcgtacaaggggactgcgaacacacat

SEQ ID NO: 123818 - DNA, 75 bp, Artificial Sequence
  Synthetic
tgctggcacctacatctacaaccacctcaccccgctacaggactgggcccacaacagcttgcgagatcttgcgac

SEQ ID NO: 123819 - DNA, 75 bp, Artificial Sequence
  Synthetic
gaacaccataagtttgtccagggttgtaactgctccatatacccgggtcatcttacaggacaccgtatggcatgg

SEQ ID NO: 123820 - DNA, 75 bp, Artificial Sequence
  Synthetic
gatcaccataagtttgtccagggttgtaactgctccatatacccgggtcatcttacaggacaccgtatggcatgg

SEQ ID NO: 123821 - DNA, 75 bp, Artificial Sequence
  Synthetic
gaccaccataagtttgtccagggttgtaactgctccatatacccgggtcatcttacaggacaccgtatggcatgg

SEQ ID NO: 123822 - DNA, 75 bp, Artificial Sequence
  Synthetic
gagcaccataagtttgtccagggttgtaactgctccatatacccgggtcatcttacaggacaccgtatggcatgg

SEQ ID NO: 123823 - DNA, 75 bp, Artificial Sequence
  Synthetic
gttactcctgtgcctactcctacttgccgtaggggtaggcattttcctgctccctgcccgataggcggggaggag

SEQ ID NO: 123824 - DNA, 75 bp, Artificial Sequence
  Synthetic
ggggggcggacaccgctgcgtgcggggatatcatcgacggtctgcccgtctccgcccgtaggggcagggagatat

SEQ ID NO: 123825 - DNA, 75 bp, Artificial Sequence
  Synthetic
gcgtgatgtttggcctagcctattttgctatgcaaggagcatgggcgaaagtcatcgtcattctcttgctgacct

SEQ ID NO: 123826 - DNA, 75 bp, Artificial Sequence
  Synthetic
caccagcctcactggccgggataagaaccaggtggagggtgagattcagatcgtgtccaccgccacccagacttt

SEQ ID NO: 123827 - DNA, 75 bp, Artificial Sequence
  Synthetic
actaggtactctgccccccccggggacccgccccagccagaatacgacttggagctgataacatcatgttcctcc

SEQ ID NO: 123828 - DNA, 75 bp, Artificial Sequence
  Synthetic
gctcattaagaccaatggtagctggcacatcaaccgcacagccttaaactgcaatgacagcttgaataccggctt

SEQ ID NO: 123829 - DNA, 75 bp, Artificial Sequence
  Synthetic
aatgttgaccaagacctcgtaggctggccggcacctcagggagcgcgctccctggtgccttgcacctgcggctcc

SEQ ID NO: 123830 - DNA, 75 bp, Artificial Sequence
  Synthetic
cccctgaggtatgaagagagtgtcactaatgatgaggacatgagaccctattgttggcattatccgcccaagcca

SEQ ID NO: 123831 - DNA, 75 bp, Artificial Sequence
  Synthetic
taaaaggttcctcgggcggtccgctactgtgtccctcgggtcacgctgtaggcatattcagagccgcagtgtgca

SEQ ID NO: 123832 - DNA, 75 bp, Artificial Sequence
  Synthetic
taaaaggttcctcgggcggtccgcttctgtgtccctcgggtcacgctgtaggcatattcagagccgcagtgtgca

SEQ ID NO: 123833 - DNA, 75 bp, Artificial Sequence
  Synthetic
taaaaggttcctcgggcggtccgctcctgtgtccctcgggtcacgctgtaggcatattcagagccgcagtgtgca

SEQ ID NO: 123834 - DNA, 75 bp, Artificial Sequence
  Synthetic
taaaaggttcctcgggcggtccgctgctgtgtccctcgggtcacgctgtaggcatattcagagccgcagtgtgca

SEQ ID NO: 123835 - DNA, 75 bp, Artificial Sequence
  Synthetic
actgtgtccctcgggtcacgctgtaggcatattcagagccgcagtgtgcactcggggagtcgccaaggcggtaga

SEQ ID NO: 123836 - DNA, 75 bp, Artificial Sequence
  Synthetic
actgtgtccctcgggtcacgctgtaggcatattcagagccgcagtgtgcactcggggtgtcgccaaggcggtaga

SEQ ID NO: 123837 - DNA, 75 bp, Artificial Sequence
  Synthetic
actgtgtccctcgggtcacgctgtaggcatattcagagccgcagtgtgcactcggggcgtcgccaaggcggtaga

SEQ ID NO: 123838 - DNA, 75 bp, Artificial Sequence
  Synthetic
actgtgtccctcgggtcacgctgtaggcatattcagagccgcagtgtgcactcggggggtcgccaaggcggtaga

SEQ ID NO: 123839 - DNA, 75 bp, Artificial Sequence
  Synthetic
tctgtgtccctcgggtcacgctgtaggcatattcagagccgcagtgtgcactcggggagtcgccaaggcggtaga

SEQ ID NO: 123840 - DNA, 75 bp, Artificial Sequence
  Synthetic
tctgtgtccctcgggtcacgctgtaggcatattcagagccgcagtgtgcactcggggtgtcgccaaggcggtaga

SEQ ID NO: 123841 - DNA, 75 bp, Artificial Sequence
  Synthetic
tctgtgtccctcgggtcacgctgtaggcatattcagagccgcagtgtgcactcggggcgtcgccaaggcggtaga

SEQ ID NO: 123842 - DNA, 75 bp, Artificial Sequence
  Synthetic
tctgtgtccctcgggtcacgctgtaggcatattcagagccgcagtgtgcactcggggggtcgccaaggcggtaga

SEQ ID NO: 123843 - DNA, 75 bp, Artificial Sequence
  Synthetic
cctgtgtccctcgggtcacgctgtaggcatattcagagccgcagtgtgcactcggggagtcgccaaggcggtaga

SEQ ID NO: 123844 - DNA, 75 bp, Artificial Sequence
  Synthetic
cctgtgtccctcgggtcacgctgtaggcatattcagagccgcagtgtgcactcggggtgtcgccaaggcggtaga

SEQ ID NO: 123845 - DNA, 75 bp, Artificial Sequence
  Synthetic
cctgtgtccctcgggtcacgctgtaggcatattcagagccgcagtgtgcactcggggcgtcgccaaggcggtaga

SEQ ID NO: 123846 - DNA, 75 bp, Artificial Sequence
  Synthetic
cctgtgtccctcgggtcacgctgtaggcatattcagagccgcagtgtgcactcggggggtcgccaaggcggtaga

SEQ ID NO: 123847 - DNA, 75 bp, Artificial Sequence
  Synthetic
gctgtgtccctcgggtcacgctgtaggcatattcagagccgcagtgtgcactcggggagtcgccaaggcggtaga

SEQ ID NO: 123848 - DNA, 75 bp, Artificial Sequence
  Synthetic
gctgtgtccctcgggtcacgctgtaggcatattcagagccgcagtgtgcactcggggtgtcgccaaggcggtaga

SEQ ID NO: 123849 - DNA, 75 bp, Artificial Sequence
  Synthetic
gctgtgtccctcgggtcacgctgtaggcatattcagagccgcagtgtgcactcggggcgtcgccaaggcggtaga

SEQ ID NO: 123850 - DNA, 75 bp, Artificial Sequence
  Synthetic
gctgtgtccctcgggtcacgctgtaggcatattcagagccgcagtgtgcactcggggggtcgccaaggcggtaga

SEQ ID NO: 123851 - DNA, 75 bp, Artificial Sequence
  Synthetic
tgatgatcgtgtcgcaggctctcatagtatcgccagaacgccacaacttcacccaagagtgcaactgttccatct

SEQ ID NO: 123852 - DNA, 75 bp, Artificial Sequence
  Synthetic
agtatcgccagaacgccacaacttcacccaagagtgcaactgttccatctaccaaggtcacatcaccggccatcg

SEQ ID NO: 123853 - DNA, 75 bp, Artificial Sequence
  Synthetic
acacctggggagagaatgagacggacgttttcgtgctgaacagcacccgccctcctcggggcgcgtggtttggat

SEQ ID NO: 123854 - DNA, 75 bp, Artificial Sequence
  Synthetic
cgcggctcaggggtataaagtactagtgcttaacccctccgtcgctgcaactctgggcttcggcgcctacatgtc

SEQ ID NO: 123855 - DNA, 75 bp, Artificial Sequence
  Synthetic
agactgcttcaggaaacaccctgatgcaacctacatcaggtgcggggccgggccctggctgacgccaaaatgctt

SEQ ID NO: 123856 - DNA, 75 bp, Artificial Sequence
  Synthetic
gctgcgtgcaatttcacccgtggggaccgctgtaacctagaagacagggatagagccctggtgagcccactactg

SEQ ID NO: 123857 - DNA, 75 bp, Artificial Sequence
  Synthetic
acattgaggaggttgctctgtcaaccaccggagagatccctttctatggcaaagccatccccctagaagtcatca

SEQ ID NO: 123858 - DNA, 75 bp, Artificial Sequence
  Synthetic
agcggagacgtcgttgtcgtggcaacggacgctctaatgacgggctttaccggcgactttgactcagtgatcgac

SEQ ID NO: 123859 - DNA, 75 bp, Artificial Sequence
  Synthetic
aatacttgtatggcctatcaccagccattacacactacatcgtcaggtgggagtgggtagtgctcctcttcttgc

SEQ ID NO: 123860 - DNA, 75 bp, Artificial Sequence
  Synthetic
aagatcgagctggtcaatgtcaacgacagttggcacatcaatagcacggccttaaactgtaatgagagcctcaac

SEQ ID NO: 123861 - DNA, 75 bp, Artificial Sequence
  Synthetic
tggccttgacgtgtccgtcataccgtccagcggcgatgttgtcgttgtggcgacagatgctctcatgaccggcta

SEQ ID NO: 123862 - DNA, 75 bp, Artificial Sequence
  Synthetic
tgccgccagctccaatggcgtcttgtacttcatcttgttcttcgtggctgcctggtacatcaagggcagggcggt

SEQ ID NO: 123863 - DNA, 75 bp, Artificial Sequence
  Synthetic
caccggagacttcgactcggtgatagactgcaatgtgtgtgtcactcagacggtcgatttcagtcttgaccccac

SEQ ID NO: 123864 - DNA, 75 bp, Artificial Sequence
  Synthetic
cagattggattggtgttgcctgcagttatctctagctccagcggcatcgcatactccatcttgttctttgtgacc

SEQ ID NO: 123865 - DNA, 75 bp, Artificial Sequence
  Synthetic
cgtagaggaagcttgcagcctgacgcccccacactcggccaagtccaagtttggctatggggcaaaggacgtccg

SEQ ID NO: 123866 - DNA, 75 bp, Artificial Sequence
  Synthetic
agcccgttgtcttttctgacatggagaccaagatcatcacctggggggcggacaccgcggcgtgtggggacatca

SEQ ID NO: 123867 - DNA, 75 bp, Artificial Sequence
  Synthetic
tatgagctcacacccgccgagaccacggttagactacgagcatacataaacacaccgggactacccgtgtgtcag

SEQ ID NO: 123868 - DNA, 75 bp, Artificial Sequence
  Synthetic
acgctttggatgtggcagagcaaggccagattggattggtgctgcttgcagttatctctgcctttacgcttaccc

SEQ ID NO: 123869 - DNA, 75 bp, Artificial Sequence
  Synthetic
agagtgccgtacttcgtgcgcgctcaagggctcatccgtgtgtgcatgttggtgcggaaggtcgctgggggtcat

SEQ ID NO: 123870 - DNA, 75 bp, Artificial Sequence
  Synthetic
aggggggggccgtgatggcatcatatgggctgctgccatgctctatccgggcgtggtatttgatataaccaagtg

SEQ ID NO: 123871 - DNA, 75 bp, Artificial Sequence
  Synthetic
actctgccagcgctgctagtgccaatgggccgttgtggttcttcatcttctttataacggcctggtatttaaagg

SEQ ID NO: 123872 - DNA, 75 bp, Artificial Sequence
  Synthetic
gtgaaacacctcgcggggggaaagtatgtccaactgatgttgctctatcttggcaggtggaccggtacatacatc

SEQ ID NO: 123873 - DNA, 75 bp, Artificial Sequence
  Synthetic
ggctgcgtggtcatagtgggcaggatcaatctctccggaaagccggcagttatacctgacagagaggtcctctac

SEQ ID NO: 123874 - DNA, 75 bp, Artificial Sequence
  Synthetic
tgtggaagtgtctcatacggctgaaacctacactgcacgggccaacacccctgctgtataggctaggagccgtcc

SEQ ID NO: 123875 - DNA, 75 bp, Artificial Sequence
  Synthetic
agggaattcgatgaaatggaggagtgctcagggcaccttccgtacatcgaacaggggatgcacattgcagagcag

SEQ ID NO: 123876 - DNA, 75 bp, Artificial Sequence
  Synthetic
aacaaattcaactcttcaggctgtcccgaaaggttggccagctgccgaccccttactgattttgcccagggctgg

SEQ ID NO: 123877 - DNA, 75 bp, Artificial Sequence
  Synthetic
tcattacttggggagcggagactgcggcatgtggtgatgtcatacatgggcttcctgtctccgcacgactcggcc

SEQ ID NO: 123878 - DNA, 75 bp, Artificial Sequence
  Synthetic
gcggccccgaccaacgcccctactgctggcactaccccccaaaaccttgcggtattgtgcctgcaaagagcgtgt

SEQ ID NO: 123879 - DNA, 75 bp, Artificial Sequence
  Synthetic
ggtattgtgcctgcaaagagcgtgtgtggcccggtatattgcttcactcccagccccgtggtggtgggaacgacc

SEQ ID NO: 123880 - DNA, 75 bp, Artificial Sequence
  Synthetic
tacgatagtggtgagcttgacggggcgcgataggacagagcaggccggagaggtccaggtcctgtcgacggtcac

SEQ ID NO: 123881 - DNA, 75 bp, Artificial Sequence
  Synthetic
tttggggcgtatatgtctaaggcacatggtgtcgaccctaacatcagaactggggtaaggaccatcaccacgggc

SEQ ID NO: 123882 - DNA, 75 bp, Artificial Sequence
  Synthetic
actcgccgcccccggcgccgccactgcttttgtaggcgccggattagccggcgccgccatcggcagcgtggggtt

SEQ ID NO: 123883 - DNA, 75 bp, Artificial Sequence
  Synthetic
actcgccgcccccggcgccgccactgcttttgtaggcgccggtttagccggcgccgccatcggcagcgtggggtt

SEQ ID NO: 123884 - DNA, 75 bp, Artificial Sequence
  Synthetic
actcgccgcccccggcgccgccactgcttttgtaggcgccggcttagccggcgccgccatcggcagcgtggggtt

SEQ ID NO: 123885 - DNA, 75 bp, Artificial Sequence
  Synthetic
actcgccgcccccggcgccgccactgcttttgtaggcgccgggttagccggcgccgccatcggcagcgtggggtt

SEQ ID NO: 123886 - DNA, 75 bp, Artificial Sequence
  Synthetic
gatcaccataggcaggtggactggcacctacatctatgaccacctctcccctttatcaacctgggcagcccaggg

SEQ ID NO: 123887 - DNA, 75 bp, Artificial Sequence
  Synthetic
atgtactctagtgccgagggagatctcgttgggtggcccagccctcctgggaccaaatccctagagccatgcaca

SEQ ID NO: 123888 - DNA, 75 bp, Artificial Sequence
  Synthetic
gcgggttacggcgcgggcgtggccggggctctcgtagcattcaagatcatgagcggcgaggccccttccattgag

SEQ ID NO: 123889 - DNA, 75 bp, Artificial Sequence
  Synthetic
gctcctgctggcattaccaccacgagcatacgccatggaccgggagatggctgcatcgtgcggaggcgcggtttt

SEQ ID NO: 123890 - DNA, 75 bp, Artificial Sequence
  Synthetic
taggaagacttccgagcggtcgcaacctcgtggaaggcgacaacctatccccaaggctcgccgacccgagggcag

SEQ ID NO: 123891 - DNA, 75 bp, Artificial Sequence
  Synthetic
tctcgtccctgaagggatcctcgggagggcctgttctctgtcctaggggccacgccgtcggaattttccgggcgg

SEQ ID NO: 123892 - DNA, 75 bp, Artificial Sequence
  Synthetic
gtgctgtgcagtggatgaaccggctgatagcgtttgcctcgaggggaaaccacgtctcccccacgcactacgtgc

SEQ ID NO: 123893 - DNA, 75 bp, Artificial Sequence
  Synthetic
cagactgggcgctgttcagaatgaagtcaccctgacgcacccagtcaccaaatacatcatgacatgcatgtcggc

SEQ ID NO: 123894 - DNA, 75 bp, Artificial Sequence
  Synthetic
tccggccgtaccccagacctaccaagtggggtatatgcatgccccaactggcagtgggaaaagtaccaaagtccc

SEQ ID NO: 123895 - DNA, 75 bp, Artificial Sequence
  Synthetic
tccggccgtaccccagacctaccaagtggggtatttgcatgccccaactggcagtgggaaaagtaccaaagtccc

SEQ ID NO: 123896 - DNA, 75 bp, Artificial Sequence
  Synthetic
tccggccgtaccccagacctaccaagtggggtatctgcatgccccaactggcagtgggaaaagtaccaaagtccc

SEQ ID NO: 123897 - DNA, 75 bp, Artificial Sequence
  Synthetic
tccggccgtaccccagacctaccaagtggggtatgtgcatgccccaactggcagtgggaaaagtaccaaagtccc

SEQ ID NO: 123898 - DNA, 75 bp, Artificial Sequence
  Synthetic
accagtggataagttctgattgctctaccccgtgcgccggctcctggttgaaagaaatctgggagtgggtgtgtg

SEQ ID NO: 123899 - DNA, 75 bp, Artificial Sequence
  Synthetic
agcagcgtacgccgctcagggctacaaagtcctggtactaaatccctctgtggctgcaaccttaggctttggatc

SEQ ID NO: 123900 - DNA, 75 bp, Artificial Sequence
  Synthetic
ctggaggacggcgtgaactacgcaacagggaatctgcccggttgctctttttctatcttcctcttggctttgctg

SEQ ID NO: 123901 - DNA, 75 bp, Artificial Sequence
  Synthetic
gcgaggggacggcataatgaacacccgctgtccatgtggagctgatataactggacatgtcaaaaacgggacgat

SEQ ID NO: 123902 - DNA, 75 bp, Artificial Sequence
  Synthetic
cgggactgggcccacgcgggcctgcgagaccttgcggtggcagttgagcccgtcgtcttctctgacatggagacc

SEQ ID NO: 123903 - DNA, 75 bp, Artificial Sequence
  Synthetic
ggaagagtgctctcagcacttaccgtacatcgaacaagggatgatgctcgccgagcagttcaagcagaaggccct

SEQ ID NO: 123904 - DNA, 75 bp, Artificial Sequence
  Synthetic
tacaagttcgcgctctggagggtgtctgcggaggagtacgtggaagtaaggcgagtgggggacttccactacata

SEQ ID NO: 123905 - DNA, 75 bp, Artificial Sequence
  Synthetic
acgtcttacagtcctggccacggcaacgccgcccgggtccgtgacgactccccactctaacattgaggaagtggc

SEQ ID NO: 123906 - DNA, 75 bp, Artificial Sequence
  Synthetic
atacgacgccatgtcgatttgctcgttggggcggctgctttctgttccgctatgtacgtgggggatctctgcgga

SEQ ID NO: 123907 - DNA, 75 bp, Artificial Sequence
  Synthetic
cctgcaaacccctattgcgggaggaggtcacgtttcaggttggactccacgaatacctggtggggtcgcagctac

SEQ ID NO: 123908 - DNA, 75 bp, Artificial Sequence
  Synthetic
gaatacctggtggggtcgcagctaccctgcgagcccgaaccagatgtggcagtgttgacgtccatgctcactgac

SEQ ID NO: 123909 - DNA, 75 bp, Artificial Sequence
  Synthetic
tcacccaggttgtcgacttcagtttagaccccacttttaccataacaacacagaccgtgccccaggacgccgtct

SEQ ID NO: 123910 - DNA, 75 bp, Artificial Sequence
  Synthetic
tcaaggcgacctgtacggccaaccatgactcccctgacgccgacctcatagaggccaacctcctgtggagacagg

SEQ ID NO: 123911 - DNA, 75 bp, Artificial Sequence
  Synthetic
aggtatgtctcttctggtgaacgtgcctcggggatgttcgactccgtagtgctctgtgagtgctatgactccggc

SEQ ID NO: 123912 - DNA, 75 bp, Artificial Sequence
  Synthetic
ccaacggcagctggcacatcaacaggactgccctgaactgcaatgactctctccagactgggttcattgccgcgc

SEQ ID NO: 123913 - DNA, 75 bp, Artificial Sequence
  Synthetic
gagacgtggtggttgtcgccaccgatgccctaatgactggatacaccggtgactttgactctgtcatcgactgca

SEQ ID NO: 123914 - DNA, 75 bp, Artificial Sequence
  Synthetic
tgtcccagcggagatcctgcggaagactaagaagttcccccccgccctacctatctgggcgagggaagactacaa

SEQ ID NO: 123915 - DNA, 75 bp, Artificial Sequence
  Synthetic
gtctggatgcccagagcgcatggctagctgccgccccattgacgagttcgctcaggggtggggtcccatcactca

SEQ ID NO: 123916 - DNA, 75 bp, Artificial Sequence
  Synthetic
gggaggcggttttcaccggcctcacgcacatagatgctcacttcctctcccagacaaagcaagcgggggacaact

SEQ ID NO: 123917 - DNA, 75 bp, Artificial Sequence
  Synthetic
cgaaggaagcgggtagtagcactgactgattcaaccatatcatctgccttggctgagctcgccgttaagaccttt

SEQ ID NO: 123918 - DNA, 75 bp, Artificial Sequence
  Synthetic
gatgaggatcgtcggtcctaagacctgcaggaacatgtggagtggaaccttccccattaatgcctacaccacggg

SEQ ID NO: 123919 - DNA, 75 bp, Artificial Sequence
  Synthetic
tacactcacaggtcccacgcctctgctttatcgtctgggtccagtcaccaatgatgtcaccctgacccaccccgt

SEQ ID NO: 123920 - DNA, 75 bp, Artificial Sequence
  Synthetic
ccatcacgtactccacctatggcaagttccttgccgatggtggttgctctgggggcgcctatgacatcataatat

SEQ ID NO: 123921 - DNA, 75 bp, Artificial Sequence
  Synthetic
caccaggccaccgctgggcaattggttcggttgcacctggatgaactcaactggattcaccaaagtgtgcggagc

SEQ ID NO: 123922 - DNA, 75 bp, Artificial Sequence
  Synthetic
tggagttctgggaagcggtcttcacaggtctcacacacattgatgcccacttcctctcccagacgaagcaaggag

SEQ ID NO: 123923 - DNA, 75 bp, Artificial Sequence
  Synthetic
acacgcggccgccgcaaggcaattggttcggctgtacatggatgaatagcaccgggttcaccaagacgtgcggag

SEQ ID NO: 123924 - DNA, 75 bp, Artificial Sequence
  Synthetic
cttgcaactggctgcgtatccatcatcggccgcatacacatcaatcagaggtcggtcgttgttccagacagggaa

SEQ ID NO: 123925 - DNA, 75 bp, Artificial Sequence
  Synthetic
tgcgctgagcaattccttgctgcgtcaccacaacttggtgtattccaccacgtcacgcagtgcagcacaaaggca

SEQ ID NO: 123926 - DNA, 75 bp, Artificial Sequence
  Synthetic
ggcatctacagatttgtggcaccgggggagcgcccctccggcatgtttgactcgtctgtcctctgtgagtgctat

SEQ ID NO: 123927 - DNA, 75 bp, Artificial Sequence
  Synthetic
aaggcctactgcaacaagcaacaaaacaagctcaggatgtacagcccgccgttcagacggcctggcctaagttag

SEQ ID NO: 123928 - DNA, 75 bp, Artificial Sequence
  Synthetic
ttggttcggttgtacctggatgaactcaactggattcaccaaagtgtgcggagcgcccccttgtgccatcggagg

SEQ ID NO: 123929 - DNA, 75 bp, Artificial Sequence
  Synthetic
ggcattcagcgccgctctcactagccctctgtccactagcaccacaatcctcctaaacgtcatggggggttggtt

SEQ ID NO: 123930 - DNA, 75 bp, Artificial Sequence
  Synthetic
tgaaaagggagggcgcaaaccagctcggctcatcgtgttccccgacctgggggtgcgcgtgtgcgagaagatggc

SEQ ID NO: 123931 - DNA, 75 bp, Artificial Sequence
  Synthetic
gggtgcgcgtgtgcgagaagatggccttgtatgacgtgatcaaaaaattgcccgtcgccgtgatgggcccctcct

SEQ ID NO: 123932 - DNA, 75 bp, Artificial Sequence
  Synthetic
cctgcaagctgacgcccccacattcggccaaatccaaatttggctatggggcaaaggacgtccggaacctatcca

SEQ ID NO: 123933 - DNA, 75 bp, Artificial Sequence
  Synthetic
gacatcttggccgggtacggggcaggcatttcaggggcccttgtcgcctttaaaatcatgtctggcgaaaagccc

SEQ ID NO: 123934 - DNA, 75 bp, Artificial Sequence
  Synthetic
gggcttacctaaatacaccagggttgcccgtctgccaggaccacctggagttctgggagagcgtcttcacaggcc

SEQ ID NO: 123935 - DNA, 75 bp, Artificial Sequence
  Synthetic
tctccttccttgtgttcttctgtgctgcctggtacatcaagggcaagctggtccccggggcggcatatgctttct

SEQ ID NO: 123936 - DNA, 75 bp, Artificial Sequence
  Synthetic
tccctcaccattaccaacctgctccggagactccatcactggatcactgaagactgccccgtcccatgctcgggc

SEQ ID NO: 123937 - DNA, 75 bp, Artificial Sequence
  Synthetic
ggcgttctgacgactagctgtggtaacaccctcacatgtttcatcaaggcaaccgcagcctgtcgagccgcaggg

SEQ ID NO: 123938 - DNA, 75 bp, Artificial Sequence
  Synthetic
gtcctattcttccatgcccccccttgagggggagcctggggatccggatctcagcgacgggtcgtggtcgacggt

SEQ ID NO: 123939 - DNA, 75 bp, Artificial Sequence
  Synthetic
caagtgtggatcccccccctcaacgttcgggggggccgcgatgccatcatcctcctcacgtgtgcggcccatccg

SEQ ID NO: 123940 - DNA, 75 bp, Artificial Sequence
  Synthetic
tcatctcttgccaaaaggggtataggggggtgtgggccggcactggcatcatgaccacacggtgctcttgcggtg

SEQ ID NO: 123941 - DNA, 75 bp, Artificial Sequence
  Synthetic
aagctatgaccaggtactccgcgccccccggagacccacctcagccagaatacgacctagagcatataacatcgt

SEQ ID NO: 123942 - DNA, 75 bp, Artificial Sequence
  Synthetic
aggggcgcttactggcacctatgtttacaaccatctcactcctcttcgggactgggcgcacaacggcctgcgaga

SEQ ID NO: 123943 - DNA, 75 bp, Artificial Sequence
  Synthetic
ggaaggccagtgcgtgccaaagccttcgcccaacttcaagaccgctatctggagggtggcggcgacggagtatgc

SEQ ID NO: 123944 - DNA, 75 bp, Artificial Sequence
  Synthetic
gtcttctcccagatggagaccaagctcatcacgtggggggcggacaccgccgcgtgcggtgacatcatcaacggc

SEQ ID NO: 123945 - DNA, 75 bp, Artificial Sequence
  Synthetic
gtggacggggtccagatccaccggcacgcccctcagccgaagccgtttttcagggatgaagtgtcgtttagcgtg

SEQ ID NO: 123946 - DNA, 75 bp, Artificial Sequence
  Synthetic
agccagctcgtctcatcgtgttccccgacctgggtgtgcgcgtgtgcgagaagatggccctgtacgacgtgatca

SEQ ID NO: 123947 - DNA, 75 bp, Artificial Sequence
  Synthetic
cagaggcggcagcgaggcgcttggcgcggggttcacctccgtctgaggctagctcctcagccagccagctgtcgg

SEQ ID NO: 123948 - DNA, 75 bp, Artificial Sequence
  Synthetic
ggagagctgccacatgtggcaagtatctctttaactgggcagtgaaaaccaagctccgactcactccaattgcgg

SEQ ID NO: 123949 - DNA, 75 bp, Artificial Sequence
  Synthetic
aactcgagttgagtctgagtccaaggtactcatcctagattcccttgacccggtggtcgagaaggagagtgagct

SEQ ID NO: 123950 - DNA, 75 bp, Artificial Sequence
  Synthetic
gtgcctactcctacttgctgtaggggtaggcatctacctgcttcccaaccgatgaaggttgggctaaacactccg

SEQ ID NO: 123951 - DNA, 75 bp, Artificial Sequence
  Synthetic
gaaacctggaagcggccagactataaaccaccagtggttgccggctgtgccctcccccctcctaagcaggcacca

SEQ ID NO: 123952 - DNA, 75 bp, Artificial Sequence
  Synthetic
ctagtggtgactcaggtcactcaccggggccgagcactgccggcatcacaggacagacacactcagacgggtctg

SEQ ID NO: 123953 - DNA, 75 bp, Artificial Sequence
  Synthetic
tttttttttttttttttttttttttttttttttttttttttttttttttttttttttttttttttttcttttttt

SEQ ID NO: 123954 - DNA, 75 bp, Artificial Sequence
  Synthetic
ttcggaggaggaggacgttcccgaccaaaactccgggtcgtggtccacgtgttccgatcagagtgatagcatcgt

SEQ ID NO: 123955 - DNA, 75 bp, Artificial Sequence
  Synthetic
ggctttgccgacctcatggggtacatacccgtcgtaggcgccccagtgggcggcgtggccagagccctcgcgcat

SEQ ID NO: 123956 - DNA, 75 bp, Artificial Sequence
  Synthetic
cggtttcacaacaaggtgtattgcactacatcaaagagtgctgtccagcgaatgaaaaaggtgacttttgacaga

SEQ ID NO: 123957 - DNA, 75 bp, Artificial Sequence
  Synthetic
aatgaaaaaggtgacttttgacagagtgcagcagctcgacacctactatgactcagtcttgaaggacgttaagct

SEQ ID NO: 123958 - DNA, 75 bp, Artificial Sequence
  Synthetic
ttacctggcaacttgatgaagcagtgcttcacgttcctggatgtgtcccctgtgtcaaagagggcaacacctcgc

SEQ ID NO: 123959 - DNA, 75 bp, Artificial Sequence
  Synthetic
gaggtacgcagcttgtccaggagggccattaaccacatcaagtccgtgtgggaggaccttctggaagaccatgac

SEQ ID NO: 123960 - DNA, 75 bp, Artificial Sequence
  Synthetic
gctttgttctgctctctacatcggggacgtttgcggcgcagttatgttagctgcccaagttgtcatagcgtcgcc

SEQ ID NO: 123961 - DNA, 75 bp, Artificial Sequence
  Synthetic
ggttccaatactctcctgcagaacgggtcgatttcctcctcaaagcttggggaagtaagaaggacccaatggggt

SEQ ID NO: 123962 - DNA, 75 bp, Artificial Sequence
  Synthetic
tcagcgtcagggtatgcgagaagatggccctttatgacatcacacagaaacttcccaaggcggtaatgggagaat

SEQ ID NO: 123963 - DNA, 75 bp, Artificial Sequence
  Synthetic
tcagcgtcagggtatgcgagaagatggccctttatgacatcacacagaaacttcccaaggcggtaatgggagtat

SEQ ID NO: 123964 - DNA, 75 bp, Artificial Sequence
  Synthetic
tcagcgtcagggtatgcgagaagatggccctttatgacatcacacagaaacttcccaaggcggtaatgggagcat

SEQ ID NO: 123965 - DNA, 75 bp, Artificial Sequence
  Synthetic
tcagcgtcagggtatgcgagaagatggccctttatgacatcacacagaaacttcccaaggcggtaatgggaggat

SEQ ID NO: 123966 - DNA, 75 bp, Artificial Sequence
  Synthetic
actgttactatgattctatcatacctgatgcgcgttcccgaggttatccttgagatcatcaccggggcgcactgg

SEQ ID NO: 123967 - DNA, 75 bp, Artificial Sequence
  Synthetic
aataccacctccacggaggaagaggacggtcgtcctgacagaatccaccgtgtcctctgccctggcggagctcgc

SEQ ID NO: 123968 - DNA, 75 bp, Artificial Sequence
  Synthetic
ttttgactcaacagtcacggagagggacatcaagaccgaggaatcaatataccttagctgctcccttcctgagca

SEQ ID NO: 123969 - DNA, 75 bp, Artificial Sequence
  Synthetic
ctgggtctgctctgtccaggcaaacggggggtattgtctcgctgttcacgccgggatctcagcagaacctccaac

SEQ ID NO: 123970 - DNA, 75 bp, Artificial Sequence
  Synthetic
gttgagtcgtactcctccatgcccccccttgagggggagccgggggaccccgacctcagcgacgggtcttggtct

SEQ ID NO: 123971 - DNA, 75 bp, Artificial Sequence
  Synthetic
tctcggtgcggctccggcccctggcttacacccaggtgcctggtcgactacccgtataggctttggcattacccc

SEQ ID NO: 123972 - DNA, 75 bp, Artificial Sequence
  Synthetic
agcggcgtgctcacaacaagtttggggaacaccctcacatgttatgtgaaggcgctagcagcctgtaaggcagcg

SEQ ID NO: 123973 - DNA, 75 bp, Artificial Sequence
  Synthetic
cacatggacaggcgccctgatcacgccatgcgccgcggaggaaagcaagctgcccatcaatgcattgagcaactc

SEQ ID NO: 123974 - DNA, 75 bp, Artificial Sequence
  Synthetic
acttgtggcaagtacctcttcaactgggcagtaaggaccaagctcaaactcactccaatcccggctgcgtcccag

SEQ ID NO: 123975 - DNA, 75 bp, Artificial Sequence
  Synthetic
gttcaactcttcggggtgtccagggcgaatgtccgcttgccgaagcatcgagtccttcgacataggttggggccc

SEQ ID NO: 123976 - DNA, 75 bp, Artificial Sequence
  Synthetic
cggaggccatgaccaggtattctgcccctcccggggaccccccaaaaccagaatatgacctagagctgataacat

SEQ ID NO: 123977 - DNA, 75 bp, Artificial Sequence
  Synthetic
gaacacacgtcgacatgatcgtaatggcagctacggtctgctcggccttgtacgtgggagatgtgtgcggagccg

SEQ ID NO: 123978 - DNA, 75 bp, Artificial Sequence
  Synthetic
tgcgggcccgtctactgcttcaccccctcaccggtggtggttggcacaaccgataagctcggagtgcccacctac

SEQ ID NO: 123979 - DNA, 75 bp, Artificial Sequence
  Synthetic
ccaagacttgcggggctcccccctgccgcataagaccagactttaatgccagcaaggacctgctatgccccacgg

SEQ ID NO: 123980 - DNA, 75 bp, Artificial Sequence
  Synthetic
ggtcctaatgacacatttcttcagcgtcttgtctgctcaggataccctgaatcagagtctcgactttgagatgta

SEQ ID NO: 123981 - DNA, 75 bp, Artificial Sequence
  Synthetic
caagatcatgagcggtgaggtcccctccacagaagacctggtcaatctactgcccgccatcctttcgcccggagc

SEQ ID NO: 123982 - DNA, 75 bp, Artificial Sequence
  Synthetic
gatgaatggcactgggttcaccaagacgtgcgggggccccccgtgtaacatcgggggggtcggcaacaacacctt

SEQ ID NO: 123983 - DNA, 75 bp, Artificial Sequence
  Synthetic
ctacccctgcactgtcaatttcactatcttcaaggtgaggatgtatgtgggaggagtcgagcatagactgcatgt

SEQ ID NO: 123984 - DNA, 75 bp, Artificial Sequence
  Synthetic
acaaagctcaaactcactccattgccggaggcgcgcctcctggacttgtccagttggttcaccgtcggcgctggc

SEQ ID NO: 123985 - DNA, 75 bp, Artificial Sequence
  Synthetic
cccggcatagatcacgcaatttgggtaaagtcatcgataccattacgtgtggttttgccgacctcatggggtaca

SEQ ID NO: 123986 - DNA, 75 bp, Artificial Sequence
  Synthetic
ccctgtaccttctccgacctgccagctttgtcaaccggccttctgcatctccaccagaacattgtggacgtgcag

SEQ ID NO: 123987 - DNA, 75 bp, Artificial Sequence
  Synthetic
ggaggacagggatagatcagagcttagcccgctgctgctgtctacaacagagtggcagatactgccctgttcctt

SEQ ID NO: 123988 - DNA, 75 bp, Artificial Sequence
  Synthetic
agcccgctgctgctgtctacaacagagtggcagatactgccctgttccttcaccaccctaccggccctgtccact

SEQ ID NO: 123989 - DNA, 75 bp, Artificial Sequence
  Synthetic
gcttgtggatgctcattttgctaggccaagctgaagcagcgctagaaaagctagtcaccttgcatgcggctagtg

SEQ ID NO: 123990 - DNA, 75 bp, Artificial Sequence
  Synthetic
tttttttttgttttttctttttttttttttttttttttttttttttccttttcctttctttccaatctccaattt

SEQ ID NO: 123991 - DNA, 75 bp, Artificial Sequence
  Synthetic
tatgtggtcctttgtcatgttactcctggcgttgccacggcaggcctacgccctcgacgctaccgaacaaggaca

SEQ ID NO: 123992 - DNA, 75 bp, Artificial Sequence
  Synthetic
ggactgggttcactaagacgtgcggagcaccaccttgccgcattaggagagacttcaacagcactctcgatttac

SEQ ID NO: 123993 - DNA, 75 bp, Artificial Sequence
  Synthetic
caaaacctgcagcaacacgtggcatggaacattccccatcaacgcatacaccacgggcccctgcacaccctcccc

SEQ ID NO: 123994 - DNA, 75 bp, Artificial Sequence
  Synthetic
gttctggcagaggccctgattcaagaatgggtaccccctctccaagcgagggggggccgtgatggtatcatatgg

SEQ ID NO: 123995 - DNA, 75 bp, Artificial Sequence
  Synthetic
agaacatcacaacttcacccaagagtgcaactgctccatctaccagggtcatatcaccggccaccgcatggcatg

SEQ ID NO: 123996 - DNA, 75 bp, Artificial Sequence
  Synthetic
tggaggtcacgcgggtgggggatttccactacgtgacgggcatgaccactgacaacgtaaaatgcccatgccagg

SEQ ID NO: 123997 - DNA, 75 bp, Artificial Sequence
  Synthetic
tgccgtacttcgtcagggctcaagctctgctgagggcgtgcgccctagtgaggagtctagtaggaggtcggtacg

SEQ ID NO: 123998 - DNA, 75 bp, Artificial Sequence
  Synthetic
tgggcggtgctaccgtgctctttctccgacctaccagcactatctactggcctattgcacctccaccaaaacatc

SEQ ID NO: 123999 - DNA, 75 bp, Artificial Sequence
  Synthetic
tctctatgcagggagcatgggccaaggtcctcgccatcctcctccttgtcgcgggagtggaagctgaaacccatg

SEQ ID NO: 124000 - DNA, 75 bp, Artificial Sequence
  Synthetic
tctctatgcagggagcatgggccaaggtcctcgccatcctcctccttgtcgcgggagtggaagctgtaacccatg

SEQ ID NO: 124001 - DNA, 75 bp, Artificial Sequence
  Synthetic
tctctatgcagggagcatgggccaaggtcctcgccatcctcctccttgtcgcgggagtggaagctgcaacccatg

SEQ ID NO: 124002 - DNA, 75 bp, Artificial Sequence
  Synthetic
tctctatgcagggagcatgggccaaggtcctcgccatcctcctccttgtcgcgggagtggaagctggaacccatg

SEQ ID NO: 124003 - DNA, 75 bp, Artificial Sequence
  Synthetic
agcggttgctgtagagcccattgtcttcagccctatggagaagaaggtcattgtttggggggcggagacagcagc

SEQ ID NO: 124004 - DNA, 75 bp, Artificial Sequence
  Synthetic
ttacagcgggggagacatatatcacagcgtgtctcgtgcccgaccccgctggttcatgttgtgcctactcctact

SEQ ID NO: 124005 - DNA, 75 bp, Artificial Sequence
  Synthetic
tttacagcggcctggtacttaaagggtagggtggtccccgtggccacgtactctgttcttggcttgtggtccttt

SEQ ID NO: 124006 - DNA, 75 bp, Artificial Sequence
  Synthetic
ctcgcgcccatcaccgcctatgctcagcagactcgaggcttgctgggcactatagtggtgagcctgacagggcgc

SEQ ID NO: 124007 - DNA, 75 bp, Artificial Sequence
  Synthetic
cggattacaacccaccactgctagagtcttggaaggacccggactacgtccctccggtggtacacgggtgcccat

SEQ ID NO: 124008 - DNA, 75 bp, Artificial Sequence
  Synthetic
gcgctggaaacaagacgctggctggaccacgtggcccagttacgcagatgtattccagtgcagagggagaccttg

SEQ ID NO: 124009 - DNA, 75 bp, Artificial Sequence
  Synthetic
attgcttcactcccagccctgtggtggtgggaacgaccgacaggtcgggcgcgcctacctacaactggggtgaaa

SEQ ID NO: 124010 - DNA, 75 bp, Artificial Sequence
  Synthetic
caccggcagcggtaagagcaccaaggtcccggccgcatacgcggctcagggctacaaggtgctggtgctcaaccc

SEQ ID NO: 124011 - DNA, 75 bp, Artificial Sequence
  Synthetic
ttaccaagacatgtggcgcaccaccgtgccgcattaggaaagatcacaacagtacccttgacctactgtgcccca

SEQ ID NO: 124012 - DNA, 75 bp, Artificial Sequence
  Synthetic
tcggagacgaggggataagcgaggtgcgctgctctccccgagacccctctccagcctgaaggggtcttctggagg

SEQ ID NO: 124013 - DNA, 75 bp, Artificial Sequence
  Synthetic
tcggagacgaggggatatgcgaggtgcgctgctctccccgagacccctctccagcctgaaggggtcttctggagg

SEQ ID NO: 124014 - DNA, 75 bp, Artificial Sequence
  Synthetic
tcggagacgaggggatacgcgaggtgcgctgctctccccgagacccctctccagcctgaaggggtcttctggagg

SEQ ID NO: 124015 - DNA, 75 bp, Artificial Sequence
  Synthetic
tcggagacgaggggataggcgaggtgcgctgctctccccgagacccctctccagcctgaaggggtcttctggagg

SEQ ID NO: 124016 - DNA, 75 bp, Artificial Sequence
  Synthetic
aatgagggctgcggttgggcgggatggctcctgtccccccgcggctctcgccctaattggggcccaaacgacccc

SEQ ID NO: 124017 - DNA, 75 bp, Artificial Sequence
  Synthetic
gggcctgcctacctccttaaagcgtctctgctacgggtaccatactttgtgagggctcacgctctgctacgagtg

SEQ ID NO: 124018 - DNA, 75 bp, Artificial Sequence
  Synthetic
cttcgccgacctcatggggtacatccctgtcatcggcgctcccctcgggggcgtcgcagcagccctggcgcatgg

SEQ ID NO: 124019 - DNA, 75 bp, Artificial Sequence
  Synthetic
cttgacattattaccagatcaccatcttttacagacaacagaacaccgccggctgtgccccaaacctatcaagtg

SEQ ID NO: 124020 - DNA, 75 bp, Artificial Sequence
  Synthetic
cttgacattattaccagatcaccatcttttacagacaacagtacaccgccggctgtgccccaaacctatcaagtg

SEQ ID NO: 124021 - DNA, 75 bp, Artificial Sequence
  Synthetic
cttgacattattaccagatcaccatcttttacagacaacagcacaccgccggctgtgccccaaacctatcaagtg

SEQ ID NO: 124022 - DNA, 75 bp, Artificial Sequence
  Synthetic
cttgacattattaccagatcaccatcttttacagacaacaggacaccgccggctgtgccccaaacctatcaagtg

SEQ ID NO: 124023 - DNA, 75 bp, Artificial Sequence
  Synthetic
cttgacatttttaccagatcaccatcttttacagacaacagaacaccgccggctgtgccccaaacctatcaagtg

SEQ ID NO: 124024 - DNA, 75 bp, Artificial Sequence
  Synthetic
cttgacatttttaccagatcaccatcttttacagacaacagtacaccgccggctgtgccccaaacctatcaagtg

SEQ ID NO: 124025 - DNA, 75 bp, Artificial Sequence
  Synthetic
cttgacatttttaccagatcaccatcttttacagacaacagcacaccgccggctgtgccccaaacctatcaagtg

SEQ ID NO: 124026 - DNA, 75 bp, Artificial Sequence
  Synthetic
cttgacatttttaccagatcaccatcttttacagacaacaggacaccgccggctgtgccccaaacctatcaagtg

SEQ ID NO: 124027 - DNA, 75 bp, Artificial Sequence
  Synthetic
cttgacattcttaccagatcaccatcttttacagacaacagaacaccgccggctgtgccccaaacctatcaagtg

SEQ ID NO: 124028 - DNA, 75 bp, Artificial Sequence
  Synthetic
cttgacattcttaccagatcaccatcttttacagacaacagtacaccgccggctgtgccccaaacctatcaagtg

SEQ ID NO: 124029 - DNA, 75 bp, Artificial Sequence
  Synthetic
cttgacattcttaccagatcaccatcttttacagacaacagcacaccgccggctgtgccccaaacctatcaagtg

SEQ ID NO: 124030 - DNA, 75 bp, Artificial Sequence
  Synthetic
cttgacattcttaccagatcaccatcttttacagacaacaggacaccgccggctgtgccccaaacctatcaagtg

SEQ ID NO: 124031 - DNA, 75 bp, Artificial Sequence
  Synthetic
cttgacattgttaccagatcaccatcttttacagacaacagaacaccgccggctgtgccccaaacctatcaagtg

SEQ ID NO: 124032 - DNA, 75 bp, Artificial Sequence
  Synthetic
cttgacattgttaccagatcaccatcttttacagacaacagtacaccgccggctgtgccccaaacctatcaagtg

SEQ ID NO: 124033 - DNA, 75 bp, Artificial Sequence
  Synthetic
cttgacattgttaccagatcaccatcttttacagacaacagcacaccgccggctgtgccccaaacctatcaagtg

SEQ ID NO: 124034 - DNA, 75 bp, Artificial Sequence
  Synthetic
cttgacattgttaccagatcaccatcttttacagacaacaggacaccgccggctgtgccccaaacctatcaagtg

SEQ ID NO: 124035 - DNA, 75 bp, Artificial Sequence
  Synthetic
cactgattgtttccgcaagcatccggaagccacgtactctcggtgcggctccggcccctggatcacacccaggtg

SEQ ID NO: 124036 - DNA, 75 bp, Artificial Sequence
  Synthetic
cctgcctcagcggtccactatgctaacaagtctgggatttaccacgtcaccaatgactgccccaacagcagcatt

SEQ ID NO: 124037 - DNA, 75 bp, Artificial Sequence
  Synthetic
ccgccaccctagggttcggggcatatatggccaaggcacacggcatcaatcccaatatcagaacaggggtgcgca

SEQ ID NO: 124038 - DNA, 75 bp, Artificial Sequence
  Synthetic
gtgtatgaggcttctgatattattctgcacctccctggatgcgtcccttgcacgaggtctggtaacacttccaag

SEQ ID NO: 124039 - DNA, 75 bp, Artificial Sequence
  Synthetic
aggctgggcaggtccaggttctgtcctccgtcacacaatctttcttggggacatctatttcgggggtcctctgga

SEQ ID NO: 124040 - DNA, 75 bp, Artificial Sequence
  Synthetic
ctcgccgcgctgttctacacacagaggttcaacgcgtccgggtgtccagagcgcttggccagctgccgttccatt

SEQ ID NO: 124041 - DNA, 75 bp, Artificial Sequence
  Synthetic
gtgccatgccttggatgcgacttctatcctcggtattggaacggtgcttgatcaggctgagactgcaggagccag

SEQ ID NO: 124042 - DNA, 75 bp, Artificial Sequence
  Synthetic
tttgctcggccatgtacgtaggggatctatgcgggggtgccttcctcgtcggccagctcttcatgttcagaccgc

SEQ ID NO: 124043 - DNA, 75 bp, Artificial Sequence
  Synthetic
gtgtattccaccacctcacgcagtgcttgccaaaggcagaagaaagtcacatttgacagactgcaagttctggac

SEQ ID NO: 124044 - DNA, 75 bp, Artificial Sequence
  Synthetic
gctagtagttctagctacggctacgcctcccgggtctgtcacaacccctcatcccaatatagaggaggtcgctct

SEQ ID NO: 124045 - DNA, 75 bp, Artificial Sequence
  Synthetic
gcatggtacttaaagggcagggtggtccccatggccacgtactctgttctcggcttgtggtcctttctcctccta

SEQ ID NO: 124046 - DNA, 75 bp, Artificial Sequence
  Synthetic
gcttggtacttaaagggcagggtggtccccatggccacgtactctgttctcggcttgtggtcctttctcctccta

SEQ ID NO: 124047 - DNA, 75 bp, Artificial Sequence
  Synthetic
gcctggtacttaaagggcagggtggtccccatggccacgtactctgttctcggcttgtggtcctttctcctccta

SEQ ID NO: 124048 - DNA, 75 bp, Artificial Sequence
  Synthetic
gcgtggtacttaaagggcagggtggtccccatggccacgtactctgttctcggcttgtggtcctttctcctccta

SEQ ID NO: 124049 - DNA, 75 bp, Artificial Sequence
  Synthetic
atcactggccatcgcatggcgtgggacatgatgatgaattggtccccgactgccaccctgattatgtcctacgtt

SEQ ID NO: 124050 - DNA, 75 bp, Artificial Sequence
  Synthetic
ctgggcagcgggtcgagttcctggtaaatgcctggaaatcaaagaaaagccccatgggcttcgcatatgacaccc

SEQ ID NO: 124051 - DNA, 75 bp, Artificial Sequence
  Synthetic
tcatcggcatcctcttcctgttcgctggtgtggacgctgaaacacatgttagcggcgccatcacaggccgaactc

SEQ ID NO: 124052 - DNA, 75 bp, Artificial Sequence
  Synthetic
cacaggttgcagacttcagtttagaccctactttttccataacaactcagaccgtccctcaggacgccgtctctc

SEQ ID NO: 124053 - DNA, 75 bp, Artificial Sequence
  Synthetic
caatgacagcctcaacaccgggttcattgcagctctattctatacccagaagttcaattcctctgggtgtgttga

SEQ ID NO: 124054 - DNA, 75 bp, Artificial Sequence
  Synthetic
ctgtgagtgctacgactcgggggctgcgtggtacgaactgacgccagcagaggtcactgtccggttgcgggcgta

SEQ ID NO: 124055 - DNA, 75 bp, Artificial Sequence
  Synthetic
tggcattacgcgcccaggccttgcgcaaccgtgcaggcccgtgacgtctgcggccctgtgtactgcttcacgccc

SEQ ID NO: 124056 - DNA, 75 bp, Artificial Sequence
  Synthetic
actaaacaggcaggggagaacttcgcgtaccttacggcttaccaagccacagtgtgcgctagagctaaagctcct

SEQ ID NO: 124057 - DNA, 75 bp, Artificial Sequence
  Synthetic
cgcacggcggttggtatggatgcacgtggatgaacggcactgggttcgtcaagacatgcggggcacctccttgcc

SEQ ID NO: 124058 - DNA, 75 bp, Artificial Sequence
  Synthetic
aggttaccctcacacaccccgtgaccaaatacatcgctacgtgcatgcaagctgatcttgagatcatgacaagca

SEQ ID NO: 124059 - DNA, 75 bp, Artificial Sequence
  Synthetic
cacgccaaggtgcttggttgactatccctacagactgtggcactacccatgcaccgtgaattataccatacacaa

SEQ ID NO: 124060 - DNA, 75 bp, Artificial Sequence
  Synthetic
cgttgttgtccccgatagggaggtcctatacgaagcgtttgatgagatggaggagtgcgcttccagggctgacct

SEQ ID NO: 124061 - DNA, 75 bp, Artificial Sequence
  Synthetic
gagcacaggttccaggcagcgtgcaactggacgcggggggagcggtgcgagttggaagaccgggacagggtcaac

SEQ ID NO: 124062 - DNA, 75 bp, Artificial Sequence
  Synthetic
gagcacaggttccaggctgcgtgcaactggacgcggggggagcggtgcgagttggaagaccgggacagggtcaac

SEQ ID NO: 124063 - DNA, 75 bp, Artificial Sequence
  Synthetic
gagcacaggttccaggccgcgtgcaactggacgcggggggagcggtgcgagttggaagaccgggacagggtcaac

SEQ ID NO: 124064 - DNA, 75 bp, Artificial Sequence
  Synthetic
gagcacaggttccaggcggcgtgcaactggacgcggggggagcggtgcgagttggaagaccgggacagggtcaac

SEQ ID NO: 124065 - DNA, 75 bp, Artificial Sequence
  Synthetic
atgccatcatcctcctcgtgtgcgtagtccacccagagctgatctttgacatcaccaaactcttgctagccataa

SEQ ID NO: 124066 - DNA, 75 bp, Artificial Sequence
  Synthetic
caagcctcctggcccaagatagaacaattttgggccaagcacatgtggaacttcatcagtggtatacagtacctt

SEQ ID NO: 124067 - DNA, 75 bp, Artificial Sequence
  Synthetic
acatcgtggacgtccagtacctctatggtgtgtctcccatgattacatcttgggctattaaatgggagtatgtgg

SEQ ID NO: 124068 - DNA, 75 bp, Artificial Sequence
  Synthetic
agaactggggtaaggaccatcaccacgggcgctcccatcacgtactccacctatggcaagttccttgccgacggt

SEQ ID NO: 124069 - DNA, 75 bp, Artificial Sequence
  Synthetic
ctatggcaagttccttgccgacggtggctgctctgggggcgcctatgacatcataatgtgtgatgagtgccactc

SEQ ID NO: 124070 - DNA, 75 bp, Artificial Sequence
  Synthetic
taaacatcatgggaggttggctggcttcccagattgctccccccgcgggggccactggcttcgtagtcagtggtc

SEQ ID NO: 124071 - DNA, 75 bp, Artificial Sequence
  Synthetic
taaacatcatgggaggttggctggcttcccagattgctccccccgcgggggccactggcttcgttgtcagtggtc

SEQ ID NO: 124072 - DNA, 75 bp, Artificial Sequence
  Synthetic
taaacatcatgggaggttggctggcttcccagattgctccccccgcgggggccactggcttcgtcgtcagtggtc

SEQ ID NO: 124073 - DNA, 75 bp, Artificial Sequence
  Synthetic
taaacatcatgggaggttggctggcttcccagattgctccccccgcgggggccactggcttcgtggtcagtggtc

SEQ ID NO: 124074 - DNA, 75 bp, Artificial Sequence
  Synthetic
ttgcaggggtggtggtgttgcatcgtctttgtctgttgcgcatggtacatcaaaggtcgggtggtgccaggtatg

SEQ ID NO: 124075 - DNA, 75 bp, Artificial Sequence
  Synthetic
aggccttggcaagatattagtggacgttctggccgggtatggtgcaggcatctccggggctctcgttgcttttaa

SEQ ID NO: 124076 - DNA, 75 bp, Artificial Sequence
  Synthetic
ttcctggttgctctttctctatcttcctcttggccctgctctcttgcctgactgtgcccgcgtcagcctaccaag

SEQ ID NO: 124077 - DNA, 75 bp, Artificial Sequence
  Synthetic
cacttactccacctatggcaagtttctcgcagatggaggctgctcggccggcgcctacgacgtcatcatatgcga

SEQ ID NO: 124078 - DNA, 75 bp, Artificial Sequence
  Synthetic
tggtcgtgcttgtggccatcaccctcttcaccctgaccccgcactacaagtggatgcttgtcaacttcttgtggt

SEQ ID NO: 124079 - DNA, 75 bp, Artificial Sequence
  Synthetic
atccttcgccgccacgtagggcaaggggaaggcgcggtccaatggatgaataggcttatcgcctttgcctccagg

SEQ ID NO: 124080 - DNA, 75 bp, Artificial Sequence
  Synthetic
ctcgtggcctttaaggtcatgagcggcgaggtgccctccactgaggacctggtcaacttactccctgccatcctc

SEQ ID NO: 124081 - DNA, 75 bp, Artificial Sequence
  Synthetic
gacaaggaaatcttatatgaggcctttgatgagatggaagagtgcgcctccaaagccgccctcattgaggaaggg

SEQ ID NO: 124082 - DNA, 75 bp, Artificial Sequence
  Synthetic
ggctccacacctggatctctgaagactgcccagttccatgcgctggctcatggctccataccatatgggactggg

SEQ ID NO: 124083 - DNA, 75 bp, Artificial Sequence
  Synthetic
tacgtgcgcgctcacgctctgctacgagcttgcatgttatttcgtcgcctgtgtggcggcaaatacgtgcaagca

SEQ ID NO: 124084 - DNA, 75 bp, Artificial Sequence
  Synthetic
tgcacccctttccacatgggctagtgacggattgcgtgacctggccatcgccgtggaaccaatcacgttctcgcc

SEQ ID NO: 124085 - DNA, 75 bp, Artificial Sequence
  Synthetic
atgaccggctataccggcgacttcgactcggtgatagactgcaacacgtgtgtcacccagacagtcgacttcagc

SEQ ID NO: 124086 - DNA, 75 bp, Artificial Sequence
  Synthetic
tgttaagccgcccagctcggaccagaagccctattgttggcactacgcaccccaaccgtgcggtattgtacctgc

SEQ ID NO: 124087 - DNA, 75 bp, Artificial Sequence
  Synthetic
cgtctgggccggtactggcatcatgaccacccgatgcccctgcggtgccaacatctccggccacgtccgcttggg

SEQ ID NO: 124088 - DNA, 75 bp, Artificial Sequence
  Synthetic
cccaacttcaaaactgctgtctggagagtagcagcatcggagtatgcggaggtgacgcagcatggctcttactcg

SEQ ID NO: 124089 - DNA, 75 bp, Artificial Sequence
  Synthetic
ctaggcccggcggatgacgtgaaggacaaaggttggaagttgctggcccctataacagcttattgccaacaaaca

SEQ ID NO: 124090 - DNA, 75 bp, Artificial Sequence
  Synthetic
ctgagactacagtgagactccgggcttatttcaacacgcctggtctgcccgtgtgtcaagaccacctggaattct

SEQ ID NO: 124091 - DNA, 75 bp, Artificial Sequence
  Synthetic
caccaccatgctcctggcgtacttggtacgtgttccagaggtcatcctggatataatcacaggaggtcagtgggg

SEQ ID NO: 124092 - DNA, 75 bp, Artificial Sequence
  Synthetic
caccaccatgctcctggcgtacttggtacgtgttccagaggtcatcctggatattatcacaggaggtcagtgggg

SEQ ID NO: 124093 - DNA, 75 bp, Artificial Sequence
  Synthetic
caccaccatgctcctggcgtacttggtacgtgttccagaggtcatcctggatatcatcacaggaggtcagtgggg

SEQ ID NO: 124094 - DNA, 75 bp, Artificial Sequence
  Synthetic
caccaccatgctcctggcgtacttggtacgtgttccagaggtcatcctggatatgatcacaggaggtcagtgggg

SEQ ID NO: 124095 - DNA, 75 bp, Artificial Sequence
  Synthetic
caccaccatgctcctggcgtacttggtacgtgttcctgaggtcatcctggatataatcacaggaggtcagtgggg

SEQ ID NO: 124096 - DNA, 75 bp, Artificial Sequence
  Synthetic
caccaccatgctcctggcgtacttggtacgtgttcctgaggtcatcctggatattatcacaggaggtcagtgggg

SEQ ID NO: 124097 - DNA, 75 bp, Artificial Sequence
  Synthetic
caccaccatgctcctggcgtacttggtacgtgttcctgaggtcatcctggatatcatcacaggaggtcagtgggg

SEQ ID NO: 124098 - DNA, 75 bp, Artificial Sequence
  Synthetic
caccaccatgctcctggcgtacttggtacgtgttcctgaggtcatcctggatatgatcacaggaggtcagtgggg

SEQ ID NO: 124099 - DNA, 75 bp, Artificial Sequence
  Synthetic
caccaccatgctcctggcgtacttggtacgtgttcccgaggtcatcctggatataatcacaggaggtcagtgggg

SEQ ID NO: 124100 - DNA, 75 bp, Artificial Sequence
  Synthetic
caccaccatgctcctggcgtacttggtacgtgttcccgaggtcatcctggatattatcacaggaggtcagtgggg

SEQ ID NO: 124101 - DNA, 75 bp, Artificial Sequence
  Synthetic
caccaccatgctcctggcgtacttggtacgtgttcccgaggtcatcctggatatcatcacaggaggtcagtgggg

SEQ ID NO: 124102 - DNA, 75 bp, Artificial Sequence
  Synthetic
caccaccatgctcctggcgtacttggtacgtgttcccgaggtcatcctggatatgatcacaggaggtcagtgggg

SEQ ID NO: 124103 - DNA, 75 bp, Artificial Sequence
  Synthetic
caccaccatgctcctggcgtacttggtacgtgttccggaggtcatcctggatataatcacaggaggtcagtgggg

SEQ ID NO: 124104 - DNA, 75 bp, Artificial Sequence
  Synthetic
caccaccatgctcctggcgtacttggtacgtgttccggaggtcatcctggatattatcacaggaggtcagtgggg

SEQ ID NO: 124105 - DNA, 75 bp, Artificial Sequence
  Synthetic
caccaccatgctcctggcgtacttggtacgtgttccggaggtcatcctggatatcatcacaggaggtcagtgggg

SEQ ID NO: 124106 - DNA, 75 bp, Artificial Sequence
  Synthetic
caccaccatgctcctggcgtacttggtacgtgttccggaggtcatcctggatatgatcacaggaggtcagtgggg

SEQ ID NO: 124107 - DNA, 75 bp, Artificial Sequence
  Synthetic
caccaccatgctcctggcgtacttggttcgtgttccagaggtcatcctggatataatcacaggaggtcagtgggg

SEQ ID NO: 124108 - DNA, 75 bp, Artificial Sequence
  Synthetic
caccaccatgctcctggcgtacttggttcgtgttccagaggtcatcctggatattatcacaggaggtcagtgggg

SEQ ID NO: 124109 - DNA, 75 bp, Artificial Sequence
  Synthetic
caccaccatgctcctggcgtacttggttcgtgttccagaggtcatcctggatatcatcacaggaggtcagtgggg

SEQ ID NO: 124110 - DNA, 75 bp, Artificial Sequence
  Synthetic
caccaccatgctcctggcgtacttggttcgtgttccagaggtcatcctggatatgatcacaggaggtcagtgggg

SEQ ID NO: 124111 - DNA, 75 bp, Artificial Sequence
  Synthetic
caccaccatgctcctggcgtacttggttcgtgttcctgaggtcatcctggatataatcacaggaggtcagtgggg

SEQ ID NO: 124112 - DNA, 75 bp, Artificial Sequence
  Synthetic
caccaccatgctcctggcgtacttggttcgtgttcctgaggtcatcctggatattatcacaggaggtcagtgggg

SEQ ID NO: 124113 - DNA, 75 bp, Artificial Sequence
  Synthetic
caccaccatgctcctggcgtacttggttcgtgttcctgaggtcatcctggatatcatcacaggaggtcagtgggg

SEQ ID NO: 124114 - DNA, 75 bp, Artificial Sequence
  Synthetic
caccaccatgctcctggcgtacttggttcgtgttcctgaggtcatcctggatatgatcacaggaggtcagtgggg

SEQ ID NO: 124115 - DNA, 75 bp, Artificial Sequence
  Synthetic
caccaccatgctcctggcgtacttggttcgtgttcccgaggtcatcctggatataatcacaggaggtcagtgggg

SEQ ID NO: 124116 - DNA, 75 bp, Artificial Sequence
  Synthetic
caccaccatgctcctggcgtacttggttcgtgttcccgaggtcatcctggatattatcacaggaggtcagtgggg

SEQ ID NO: 124117 - DNA, 75 bp, Artificial Sequence
  Synthetic
caccaccatgctcctggcgtacttggttcgtgttcccgaggtcatcctggatatcatcacaggaggtcagtgggg

SEQ ID NO: 124118 - DNA, 75 bp, Artificial Sequence
  Synthetic
caccaccatgctcctggcgtacttggttcgtgttcccgaggtcatcctggatatgatcacaggaggtcagtgggg

SEQ ID NO: 124119 - DNA, 75 bp, Artificial Sequence
  Synthetic
caccaccatgctcctggcgtacttggttcgtgttccggaggtcatcctggatataatcacaggaggtcagtgggg

SEQ ID NO: 124120 - DNA, 75 bp, Artificial Sequence
  Synthetic
caccaccatgctcctggcgtacttggttcgtgttccggaggtcatcctggatattatcacaggaggtcagtgggg

SEQ ID NO: 124121 - DNA, 75 bp, Artificial Sequence
  Synthetic
caccaccatgctcctggcgtacttggttcgtgttccggaggtcatcctggatatcatcacaggaggtcagtgggg

SEQ ID NO: 124122 - DNA, 75 bp, Artificial Sequence
  Synthetic
caccaccatgctcctggcgtacttggttcgtgttccggaggtcatcctggatatgatcacaggaggtcagtgggg

SEQ ID NO: 124123 - DNA, 75 bp, Artificial Sequence
  Synthetic
caccaccatgctcctggcgtacttggtccgtgttccagaggtcatcctggatataatcacaggaggtcagtgggg

SEQ ID NO: 124124 - DNA, 75 bp, Artificial Sequence
  Synthetic
caccaccatgctcctggcgtacttggtccgtgttccagaggtcatcctggatattatcacaggaggtcagtgggg

SEQ ID NO: 124125 - DNA, 75 bp, Artificial Sequence
  Synthetic
caccaccatgctcctggcgtacttggtccgtgttccagaggtcatcctggatatcatcacaggaggtcagtgggg

SEQ ID NO: 124126 - DNA, 75 bp, Artificial Sequence
  Synthetic
caccaccatgctcctggcgtacttggtccgtgttccagaggtcatcctggatatgatcacaggaggtcagtgggg

SEQ ID NO: 124127 - DNA, 75 bp, Artificial Sequence
  Synthetic
caccaccatgctcctggcgtacttggtccgtgttcctgaggtcatcctggatataatcacaggaggtcagtgggg

SEQ ID NO: 124128 - DNA, 75 bp, Artificial Sequence
  Synthetic
caccaccatgctcctggcgtacttggtccgtgttcctgaggtcatcctggatattatcacaggaggtcagtgggg

SEQ ID NO: 124129 - DNA, 75 bp, Artificial Sequence
  Synthetic
caccaccatgctcctggcgtacttggtccgtgttcctgaggtcatcctggatatcatcacaggaggtcagtgggg

SEQ ID NO: 124130 - DNA, 75 bp, Artificial Sequence
  Synthetic
caccaccatgctcctggcgtacttggtccgtgttcctgaggtcatcctggatatgatcacaggaggtcagtgggg

SEQ ID NO: 124131 - DNA, 75 bp, Artificial Sequence
  Synthetic
caccaccatgctcctggcgtacttggtccgtgttcccgaggtcatcctggatataatcacaggaggtcagtgggg

SEQ ID NO: 124132 - DNA, 75 bp, Artificial Sequence
  Synthetic
caccaccatgctcctggcgtacttggtccgtgttcccgaggtcatcctggatattatcacaggaggtcagtgggg

SEQ ID NO: 124133 - DNA, 75 bp, Artificial Sequence
  Synthetic
caccaccatgctcctggcgtacttggtccgtgttcccgaggtcatcctggatatcatcacaggaggtcagtgggg

SEQ ID NO: 124134 - DNA, 75 bp, Artificial Sequence
  Synthetic
caccaccatgctcctggcgtacttggtccgtgttcccgaggtcatcctggatatgatcacaggaggtcagtgggg

SEQ ID NO: 124135 - DNA, 75 bp, Artificial Sequence
  Synthetic
caccaccatgctcctggcgtacttggtccgtgttccggaggtcatcctggatataatcacaggaggtcagtgggg

SEQ ID NO: 124136 - DNA, 75 bp, Artificial Sequence
  Synthetic
caccaccatgctcctggcgtacttggtccgtgttccggaggtcatcctggatattatcacaggaggtcagtgggg

SEQ ID NO: 124137 - DNA, 75 bp, Artificial Sequence
  Synthetic
caccaccatgctcctggcgtacttggtccgtgttccggaggtcatcctggatatcatcacaggaggtcagtgggg

SEQ ID NO: 124138 - DNA, 75 bp, Artificial Sequence
  Synthetic
caccaccatgctcctggcgtacttggtccgtgttccggaggtcatcctggatatgatcacaggaggtcagtgggg

SEQ ID NO: 124139 - DNA, 75 bp, Artificial Sequence
  Synthetic
caccaccatgctcctggcgtacttggtgcgtgttccagaggtcatcctggatataatcacaggaggtcagtgggg

SEQ ID NO: 124140 - DNA, 75 bp, Artificial Sequence
  Synthetic
caccaccatgctcctggcgtacttggtgcgtgttccagaggtcatcctggatattatcacaggaggtcagtgggg

SEQ ID NO: 124141 - DNA, 75 bp, Artificial Sequence
  Synthetic
caccaccatgctcctggcgtacttggtgcgtgttccagaggtcatcctggatatcatcacaggaggtcagtgggg

SEQ ID NO: 124142 - DNA, 75 bp, Artificial Sequence
  Synthetic
caccaccatgctcctggcgtacttggtgcgtgttccagaggtcatcctggatatgatcacaggaggtcagtgggg

SEQ ID NO: 124143 - DNA, 75 bp, Artificial Sequence
  Synthetic
caccaccatgctcctggcgtacttggtgcgtgttcctgaggtcatcctggatataatcacaggaggtcagtgggg

SEQ ID NO: 124144 - DNA, 75 bp, Artificial Sequence
  Synthetic
caccaccatgctcctggcgtacttggtgcgtgttcctgaggtcatcctggatattatcacaggaggtcagtgggg

SEQ ID NO: 124145 - DNA, 75 bp, Artificial Sequence
  Synthetic
caccaccatgctcctggcgtacttggtgcgtgttcctgaggtcatcctggatatcatcacaggaggtcagtgggg

SEQ ID NO: 124146 - DNA, 75 bp, Artificial Sequence
  Synthetic
caccaccatgctcctggcgtacttggtgcgtgttcctgaggtcatcctggatatgatcacaggaggtcagtgggg

SEQ ID NO: 124147 - DNA, 75 bp, Artificial Sequence
  Synthetic
caccaccatgctcctggcgtacttggtgcgtgttcccgaggtcatcctggatataatcacaggaggtcagtgggg

SEQ ID NO: 124148 - DNA, 75 bp, Artificial Sequence
  Synthetic
caccaccatgctcctggcgtacttggtgcgtgttcccgaggtcatcctggatattatcacaggaggtcagtgggg

SEQ ID NO: 124149 - DNA, 75 bp, Artificial Sequence
  Synthetic
caccaccatgctcctggcgtacttggtgcgtgttcccgaggtcatcctggatatcatcacaggaggtcagtgggg

SEQ ID NO: 124150 - DNA, 75 bp, Artificial Sequence
  Synthetic
caccaccatgctcctggcgtacttggtgcgtgttcccgaggtcatcctggatatgatcacaggaggtcagtgggg

SEQ ID NO: 124151 - DNA, 75 bp, Artificial Sequence
  Synthetic
caccaccatgctcctggcgtacttggtgcgtgttccggaggtcatcctggatataatcacaggaggtcagtgggg

SEQ ID NO: 124152 - DNA, 75 bp, Artificial Sequence
  Synthetic
caccaccatgctcctggcgtacttggtgcgtgttccggaggtcatcctggatattatcacaggaggtcagtgggg

SEQ ID NO: 124153 - DNA, 75 bp, Artificial Sequence
  Synthetic
caccaccatgctcctggcgtacttggtgcgtgttccggaggtcatcctggatatcatcacaggaggtcagtgggg

SEQ ID NO: 124154 - DNA, 75 bp, Artificial Sequence
  Synthetic
caccaccatgctcctggcgtacttggtgcgtgttccggaggtcatcctggatatgatcacaggaggtcagtgggg

SEQ ID NO: 124155 - DNA, 75 bp, Artificial Sequence
  Synthetic
tagcaacaagcatcaatggggtaatgtggacagtctaccatggtgctggcagcaagacgctggctggcccgaaag

SEQ ID NO: 124156 - DNA, 75 bp, Artificial Sequence
  Synthetic
cccctgagccaaagccgttcatacgggacgaggtttcgtttagcgtgggcctcaattctttcgtagtcgggtccc

SEQ ID NO: 124157 - DNA, 75 bp, Artificial Sequence
  Synthetic
atctgtgcagcaatcctgcgccgccacgttggccagggagagggggcggtccagtggatgaacaggctgatcgcc

SEQ ID NO: 124158 - DNA, 75 bp, Artificial Sequence
  Synthetic
cctactcctgctcgctgcaggggtaggcatctacctcctccccaaccggtgaaggttggggtaaacactccggcc

SEQ ID NO: 124159 - DNA, 75 bp, Artificial Sequence
  Synthetic
cccctacccactacgtggcggagtctgacgcctcgcagcgcgtgacgcaggtgctaagctcactcacaattacca

SEQ ID NO: 124160 - DNA, 75 bp, Artificial Sequence
  Synthetic
accggagggactgcaggacaaaccgcaagaggcctttctggcctcttctctacgggtgctcaacaacgcattcag

SEQ ID NO: 124161 - DNA, 75 bp, Artificial Sequence
  Synthetic
accggagggactgcaggacaaaccgcaagaggcctttctggcctcttctctacgggtgctcaacaacgctttcag

SEQ ID NO: 124162 - DNA, 75 bp, Artificial Sequence
  Synthetic
accggagggactgcaggacaaaccgcaagaggcctttctggcctcttctctacgggtgctcaacaacgccttcag

SEQ ID NO: 124163 - DNA, 75 bp, Artificial Sequence
  Synthetic
accggagggactgcaggacaaaccgcaagaggcctttctggcctcttctctacgggtgctcaacaacgcgttcag

SEQ ID NO: 124164 - DNA, 75 bp, Artificial Sequence
  Synthetic
accggagggactgcaggacaaaccgcaagaggcctttctggcctcttctcttcgggtgctcaacaacgcattcag

SEQ ID NO: 124165 - DNA, 75 bp, Artificial Sequence
  Synthetic
accggagggactgcaggacaaaccgcaagaggcctttctggcctcttctcttcgggtgctcaacaacgctttcag

SEQ ID NO: 124166 - DNA, 75 bp, Artificial Sequence
  Synthetic
accggagggactgcaggacaaaccgcaagaggcctttctggcctcttctcttcgggtgctcaacaacgccttcag

SEQ ID NO: 124167 - DNA, 75 bp, Artificial Sequence
  Synthetic
accggagggactgcaggacaaaccgcaagaggcctttctggcctcttctcttcgggtgctcaacaacgcgttcag

SEQ ID NO: 124168 - DNA, 75 bp, Artificial Sequence
  Synthetic
accggagggactgcaggacaaaccgcaagaggcctttctggcctcttctctccgggtgctcaacaacgcattcag

SEQ ID NO: 124169 - DNA, 75 bp, Artificial Sequence
  Synthetic
accggagggactgcaggacaaaccgcaagaggcctttctggcctcttctctccgggtgctcaacaacgctttcag

SEQ ID NO: 124170 - DNA, 75 bp, Artificial Sequence
  Synthetic
accggagggactgcaggacaaaccgcaagaggcctttctggcctcttctctccgggtgctcaacaacgccttcag

SEQ ID NO: 124171 - DNA, 75 bp, Artificial Sequence
  Synthetic
accggagggactgcaggacaaaccgcaagaggcctttctggcctcttctctccgggtgctcaacaacgcgttcag

SEQ ID NO: 124172 - DNA, 75 bp, Artificial Sequence
  Synthetic
accggagggactgcaggacaaaccgcaagaggcctttctggcctcttctctgcgggtgctcaacaacgcattcag

SEQ ID NO: 124173 - DNA, 75 bp, Artificial Sequence
  Synthetic
accggagggactgcaggacaaaccgcaagaggcctttctggcctcttctctgcgggtgctcaacaacgctttcag

SEQ ID NO: 124174 - DNA, 75 bp, Artificial Sequence
  Synthetic
accggagggactgcaggacaaaccgcaagaggcctttctggcctcttctctgcgggtgctcaacaacgccttcag

SEQ ID NO: 124175 - DNA, 75 bp, Artificial Sequence
  Synthetic
accggagggactgcaggacaaaccgcaagaggcctttctggcctcttctctgcgggtgctcaacaacgcgttcag

SEQ ID NO: 124176 - DNA, 75 bp, Artificial Sequence
  Synthetic
accggagggactgcaggacataccgcaagaggcctttctggcctcttctctacgggtgctcaacaacgcattcag

SEQ ID NO: 124177 - DNA, 75 bp, Artificial Sequence
  Synthetic
accggagggactgcaggacataccgcaagaggcctttctggcctcttctctacgggtgctcaacaacgctttcag

SEQ ID NO: 124178 - DNA, 75 bp, Artificial Sequence
  Synthetic
accggagggactgcaggacataccgcaagaggcctttctggcctcttctctacgggtgctcaacaacgccttcag

SEQ ID NO: 124179 - DNA, 75 bp, Artificial Sequence
  Synthetic
accggagggactgcaggacataccgcaagaggcctttctggcctcttctctacgggtgctcaacaacgcgttcag

SEQ ID NO: 124180 - DNA, 75 bp, Artificial Sequence
  Synthetic
accggagggactgcaggacataccgcaagaggcctttctggcctcttctcttcgggtgctcaacaacgcattcag

SEQ ID NO: 124181 - DNA, 75 bp, Artificial Sequence
  Synthetic
accggagggactgcaggacataccgcaagaggcctttctggcctcttctcttcgggtgctcaacaacgctttcag

SEQ ID NO: 124182 - DNA, 75 bp, Artificial Sequence
  Synthetic
accggagggactgcaggacataccgcaagaggcctttctggcctcttctcttcgggtgctcaacaacgccttcag

SEQ ID NO: 124183 - DNA, 75 bp, Artificial Sequence
  Synthetic
accggagggactgcaggacataccgcaagaggcctttctggcctcttctcttcgggtgctcaacaacgcgttcag

SEQ ID NO: 124184 - DNA, 75 bp, Artificial Sequence
  Synthetic
accggagggactgcaggacataccgcaagaggcctttctggcctcttctctccgggtgctcaacaacgcattcag

SEQ ID NO: 124185 - DNA, 75 bp, Artificial Sequence
  Synthetic
accggagggactgcaggacataccgcaagaggcctttctggcctcttctctccgggtgctcaacaacgctttcag

SEQ ID NO: 124186 - DNA, 75 bp, Artificial Sequence
  Synthetic
accggagggactgcaggacataccgcaagaggcctttctggcctcttctctccgggtgctcaacaacgccttcag

SEQ ID NO: 124187 - DNA, 75 bp, Artificial Sequence
  Synthetic
accggagggactgcaggacataccgcaagaggcctttctggcctcttctctccgggtgctcaacaacgcgttcag

SEQ ID NO: 124188 - DNA, 75 bp, Artificial Sequence
  Synthetic
accggagggactgcaggacataccgcaagaggcctttctggcctcttctctgcgggtgctcaacaacgcattcag

SEQ ID NO: 124189 - DNA, 75 bp, Artificial Sequence
  Synthetic
accggagggactgcaggacataccgcaagaggcctttctggcctcttctctgcgggtgctcaacaacgctttcag

SEQ ID NO: 124190 - DNA, 75 bp, Artificial Sequence
  Synthetic
accggagggactgcaggacataccgcaagaggcctttctggcctcttctctgcgggtgctcaacaacgccttcag

SEQ ID NO: 124191 - DNA, 75 bp, Artificial Sequence
  Synthetic
accggagggactgcaggacataccgcaagaggcctttctggcctcttctctgcgggtgctcaacaacgcgttcag

SEQ ID NO: 124192 - DNA, 75 bp, Artificial Sequence
  Synthetic
accggagggactgcaggacacaccgcaagaggcctttctggcctcttctctacgggtgctcaacaacgcattcag

SEQ ID NO: 124193 - DNA, 75 bp, Artificial Sequence
  Synthetic
accggagggactgcaggacacaccgcaagaggcctttctggcctcttctctacgggtgctcaacaacgctttcag

SEQ ID NO: 124194 - DNA, 75 bp, Artificial Sequence
  Synthetic
accggagggactgcaggacacaccgcaagaggcctttctggcctcttctctacgggtgctcaacaacgccttcag

SEQ ID NO: 124195 - DNA, 75 bp, Artificial Sequence
  Synthetic
accggagggactgcaggacacaccgcaagaggcctttctggcctcttctctacgggtgctcaacaacgcgttcag

SEQ ID NO: 124196 - DNA, 75 bp, Artificial Sequence
  Synthetic
accggagggactgcaggacacaccgcaagaggcctttctggcctcttctcttcgggtgctcaacaacgcattcag

SEQ ID NO: 124197 - DNA, 75 bp, Artificial Sequence
  Synthetic
accggagggactgcaggacacaccgcaagaggcctttctggcctcttctcttcgggtgctcaacaacgctttcag

SEQ ID NO: 124198 - DNA, 75 bp, Artificial Sequence
  Synthetic
accggagggactgcaggacacaccgcaagaggcctttctggcctcttctcttcgggtgctcaacaacgccttcag

SEQ ID NO: 124199 - DNA, 75 bp, Artificial Sequence
  Synthetic
accggagggactgcaggacacaccgcaagaggcctttctggcctcttctcttcgggtgctcaacaacgcgttcag

SEQ ID NO: 124200 - DNA, 75 bp, Artificial Sequence
  Synthetic
accggagggactgcaggacacaccgcaagaggcctttctggcctcttctctccgggtgctcaacaacgcattcag

SEQ ID NO: 124201 - DNA, 75 bp, Artificial Sequence
  Synthetic
accggagggactgcaggacacaccgcaagaggcctttctggcctcttctctccgggtgctcaacaacgctttcag

SEQ ID NO: 124202 - DNA, 75 bp, Artificial Sequence
  Synthetic
accggagggactgcaggacacaccgcaagaggcctttctggcctcttctctccgggtgctcaacaacgccttcag

SEQ ID NO: 124203 - DNA, 75 bp, Artificial Sequence
  Synthetic
accggagggactgcaggacacaccgcaagaggcctttctggcctcttctctccgggtgctcaacaacgcgttcag

SEQ ID NO: 124204 - DNA, 75 bp, Artificial Sequence
  Synthetic
accggagggactgcaggacacaccgcaagaggcctttctggcctcttctctgcgggtgctcaacaacgcattcag

SEQ ID NO: 124205 - DNA, 75 bp, Artificial Sequence
  Synthetic
accggagggactgcaggacacaccgcaagaggcctttctggcctcttctctgcgggtgctcaacaacgctttcag

SEQ ID NO: 124206 - DNA, 75 bp, Artificial Sequence
  Synthetic
accggagggactgcaggacacaccgcaagaggcctttctggcctcttctctgcgggtgctcaacaacgccttcag

SEQ ID NO: 124207 - DNA, 75 bp, Artificial Sequence
  Synthetic
accggagggactgcaggacacaccgcaagaggcctttctggcctcttctctgcgggtgctcaacaacgcgttcag

SEQ ID NO: 124208 - DNA, 75 bp, Artificial Sequence
  Synthetic
accggagggactgcaggacagaccgcaagaggcctttctggcctcttctctacgggtgctcaacaacgcattcag

SEQ ID NO: 124209 - DNA, 75 bp, Artificial Sequence
  Synthetic
accggagggactgcaggacagaccgcaagaggcctttctggcctcttctctacgggtgctcaacaacgctttcag

SEQ ID NO: 124210 - DNA, 75 bp, Artificial Sequence
  Synthetic
accggagggactgcaggacagaccgcaagaggcctttctggcctcttctctacgggtgctcaacaacgccttcag

SEQ ID NO: 124211 - DNA, 75 bp, Artificial Sequence
  Synthetic
accggagggactgcaggacagaccgcaagaggcctttctggcctcttctctacgggtgctcaacaacgcgttcag

SEQ ID NO: 124212 - DNA, 75 bp, Artificial Sequence
  Synthetic
accggagggactgcaggacagaccgcaagaggcctttctggcctcttctcttcgggtgctcaacaacgcattcag

SEQ ID NO: 124213 - DNA, 75 bp, Artificial Sequence
  Synthetic
accggagggactgcaggacagaccgcaagaggcctttctggcctcttctcttcgggtgctcaacaacgctttcag

SEQ ID NO: 124214 - DNA, 75 bp, Artificial Sequence
  Synthetic
accggagggactgcaggacagaccgcaagaggcctttctggcctcttctcttcgggtgctcaacaacgccttcag

SEQ ID NO: 124215 - DNA, 75 bp, Artificial Sequence
  Synthetic
accggagggactgcaggacagaccgcaagaggcctttctggcctcttctcttcgggtgctcaacaacgcgttcag

SEQ ID NO: 124216 - DNA, 75 bp, Artificial Sequence
  Synthetic
accggagggactgcaggacagaccgcaagaggcctttctggcctcttctctccgggtgctcaacaacgcattcag

SEQ ID NO: 124217 - DNA, 75 bp, Artificial Sequence
  Synthetic
accggagggactgcaggacagaccgcaagaggcctttctggcctcttctctccgggtgctcaacaacgctttcag

SEQ ID NO: 124218 - DNA, 75 bp, Artificial Sequence
  Synthetic
accggagggactgcaggacagaccgcaagaggcctttctggcctcttctctccgggtgctcaacaacgccttcag

SEQ ID NO: 124219 - DNA, 75 bp, Artificial Sequence
  Synthetic
accggagggactgcaggacagaccgcaagaggcctttctggcctcttctctccgggtgctcaacaacgcgttcag

SEQ ID NO: 124220 - DNA, 75 bp, Artificial Sequence
  Synthetic
accggagggactgcaggacagaccgcaagaggcctttctggcctcttctctgcgggtgctcaacaacgcattcag

SEQ ID NO: 124221 - DNA, 75 bp, Artificial Sequence
  Synthetic
accggagggactgcaggacagaccgcaagaggcctttctggcctcttctctgcgggtgctcaacaacgctttcag

SEQ ID NO: 124222 - DNA, 75 bp, Artificial Sequence
  Synthetic
accggagggactgcaggacagaccgcaagaggcctttctggcctcttctctgcgggtgctcaacaacgccttcag

SEQ ID NO: 124223 - DNA, 75 bp, Artificial Sequence
  Synthetic
accggagggactgcaggacagaccgcaagaggcctttctggcctcttctctgcgggtgctcaacaacgcgttcag

SEQ ID NO: 124224 - DNA, 75 bp, Artificial Sequence
  Synthetic
gagcaattccccataggatggggatcccttaaatatgaggagaatgtcaccaatgatgcagaaatgagcccgtac

SEQ ID NO: 124225 - DNA, 75 bp, Artificial Sequence
  Synthetic
gagcaattccccataggatggggatcccttaaatatgaggagaatgtcaccaatgatgcagatatgagcccgtac

SEQ ID NO: 124226 - DNA, 75 bp, Artificial Sequence
  Synthetic
gagcaattccccataggatggggatcccttaaatatgaggagaatgtcaccaatgatgcagacatgagcccgtac

SEQ ID NO: 124227 - DNA, 75 bp, Artificial Sequence
  Synthetic
gagcaattccccataggatggggatcccttaaatatgaggagaatgtcaccaatgatgcagagatgagcccgtac

SEQ ID NO: 124228 - DNA, 75 bp, Artificial Sequence
  Synthetic
gagcaattccccataggatggggatcccttaattatgaggagaatgtcaccaatgatgcagaaatgagcccgtac

SEQ ID NO: 124229 - DNA, 75 bp, Artificial Sequence
  Synthetic
gagcaattccccataggatggggatcccttaattatgaggagaatgtcaccaatgatgcagatatgagcccgtac

SEQ ID NO: 124230 - DNA, 75 bp, Artificial Sequence
  Synthetic
gagcaattccccataggatggggatcccttaattatgaggagaatgtcaccaatgatgcagacatgagcccgtac

SEQ ID NO: 124231 - DNA, 75 bp, Artificial Sequence
  Synthetic
gagcaattccccataggatggggatcccttaattatgaggagaatgtcaccaatgatgcagagatgagcccgtac

SEQ ID NO: 124232 - DNA, 75 bp, Artificial Sequence
  Synthetic
gagcaattccccataggatggggatcccttaactatgaggagaatgtcaccaatgatgcagaaatgagcccgtac

SEQ ID NO: 124233 - DNA, 75 bp, Artificial Sequence
  Synthetic
gagcaattccccataggatggggatcccttaactatgaggagaatgtcaccaatgatgcagatatgagcccgtac

SEQ ID NO: 124234 - DNA, 75 bp, Artificial Sequence
  Synthetic
gagcaattccccataggatggggatcccttaactatgaggagaatgtcaccaatgatgcagacatgagcccgtac

SEQ ID NO: 124235 - DNA, 75 bp, Artificial Sequence
  Synthetic
gagcaattccccataggatggggatcccttaactatgaggagaatgtcaccaatgatgcagagatgagcccgtac

SEQ ID NO: 124236 - DNA, 75 bp, Artificial Sequence
  Synthetic
gagcaattccccataggatggggatcccttaagtatgaggagaatgtcaccaatgatgcagaaatgagcccgtac

SEQ ID NO: 124237 - DNA, 75 bp, Artificial Sequence
  Synthetic
gagcaattccccataggatggggatcccttaagtatgaggagaatgtcaccaatgatgcagatatgagcccgtac

SEQ ID NO: 124238 - DNA, 75 bp, Artificial Sequence
  Synthetic
gagcaattccccataggatggggatcccttaagtatgaggagaatgtcaccaatgatgcagacatgagcccgtac

SEQ ID NO: 124239 - DNA, 75 bp, Artificial Sequence
  Synthetic
gagcaattccccataggatggggatcccttaagtatgaggagaatgtcaccaatgatgcagagatgagcccgtac

SEQ ID NO: 124240 - DNA, 75 bp, Artificial Sequence
  Synthetic
gagcaattccccataggatggggttcccttaaatatgaggagaatgtcaccaatgatgcagaaatgagcccgtac

SEQ ID NO: 124241 - DNA, 75 bp, Artificial Sequence
  Synthetic
gagcaattccccataggatggggttcccttaaatatgaggagaatgtcaccaatgatgcagatatgagcccgtac

SEQ ID NO: 124242 - DNA, 75 bp, Artificial Sequence
  Synthetic
gagcaattccccataggatggggttcccttaaatatgaggagaatgtcaccaatgatgcagacatgagcccgtac

SEQ ID NO: 124243 - DNA, 75 bp, Artificial Sequence
  Synthetic
gagcaattccccataggatggggttcccttaaatatgaggagaatgtcaccaatgatgcagagatgagcccgtac

SEQ ID NO: 124244 - DNA, 75 bp, Artificial Sequence
  Synthetic
gagcaattccccataggatggggttcccttaattatgaggagaatgtcaccaatgatgcagaaatgagcccgtac

SEQ ID NO: 124245 - DNA, 75 bp, Artificial Sequence
  Synthetic
gagcaattccccataggatggggttcccttaattatgaggagaatgtcaccaatgatgcagatatgagcccgtac

SEQ ID NO: 124246 - DNA, 75 bp, Artificial Sequence
  Synthetic
gagcaattccccataggatggggttcccttaattatgaggagaatgtcaccaatgatgcagacatgagcccgtac

SEQ ID NO: 124247 - DNA, 75 bp, Artificial Sequence
  Synthetic
gagcaattccccataggatggggttcccttaattatgaggagaatgtcaccaatgatgcagagatgagcccgtac

SEQ ID NO: 124248 - DNA, 75 bp, Artificial Sequence
  Synthetic
gagcaattccccataggatggggttcccttaactatgaggagaatgtcaccaatgatgcagaaatgagcccgtac

SEQ ID NO: 124249 - DNA, 75 bp, Artificial Sequence
  Synthetic
gagcaattccccataggatggggttcccttaactatgaggagaatgtcaccaatgatgcagatatgagcccgtac

SEQ ID NO: 124250 - DNA, 75 bp, Artificial Sequence
  Synthetic
gagcaattccccataggatggggttcccttaactatgaggagaatgtcaccaatgatgcagacatgagcccgtac

SEQ ID NO: 124251 - DNA, 75 bp, Artificial Sequence
  Synthetic
gagcaattccccataggatggggttcccttaactatgaggagaatgtcaccaatgatgcagagatgagcccgtac

SEQ ID NO: 124252 - DNA, 75 bp, Artificial Sequence
  Synthetic
gagcaattccccataggatggggttcccttaagtatgaggagaatgtcaccaatgatgcagaaatgagcccgtac

SEQ ID NO: 124253 - DNA, 75 bp, Artificial Sequence
  Synthetic
gagcaattccccataggatggggttcccttaagtatgaggagaatgtcaccaatgatgcagatatgagcccgtac

SEQ ID NO: 124254 - DNA, 75 bp, Artificial Sequence
  Synthetic
gagcaattccccataggatggggttcccttaagtatgaggagaatgtcaccaatgatgcagacatgagcccgtac

SEQ ID NO: 124255 - DNA, 75 bp, Artificial Sequence
  Synthetic
gagcaattccccataggatggggttcccttaagtatgaggagaatgtcaccaatgatgcagagatgagcccgtac

SEQ ID NO: 124256 - DNA, 75 bp, Artificial Sequence
  Synthetic
gagcaattccccataggatggggctcccttaaatatgaggagaatgtcaccaatgatgcagaaatgagcccgtac

SEQ ID NO: 124257 - DNA, 75 bp, Artificial Sequence
  Synthetic
gagcaattccccataggatggggctcccttaaatatgaggagaatgtcaccaatgatgcagatatgagcccgtac

SEQ ID NO: 124258 - DNA, 75 bp, Artificial Sequence
  Synthetic
gagcaattccccataggatggggctcccttaaatatgaggagaatgtcaccaatgatgcagacatgagcccgtac

SEQ ID NO: 124259 - DNA, 75 bp, Artificial Sequence
  Synthetic
gagcaattccccataggatggggctcccttaaatatgaggagaatgtcaccaatgatgcagagatgagcccgtac

SEQ ID NO: 124260 - DNA, 75 bp, Artificial Sequence
  Synthetic
gagcaattccccataggatggggctcccttaattatgaggagaatgtcaccaatgatgcagaaatgagcccgtac

SEQ ID NO: 124261 - DNA, 75 bp, Artificial Sequence
  Synthetic
gagcaattccccataggatggggctcccttaattatgaggagaatgtcaccaatgatgcagatatgagcccgtac

SEQ ID NO: 124262 - DNA, 75 bp, Artificial Sequence
  Synthetic
gagcaattccccataggatggggctcccttaattatgaggagaatgtcaccaatgatgcagacatgagcccgtac

SEQ ID NO: 124263 - DNA, 75 bp, Artificial Sequence
  Synthetic
gagcaattccccataggatggggctcccttaattatgaggagaatgtcaccaatgatgcagagatgagcccgtac

SEQ ID NO: 124264 - DNA, 75 bp, Artificial Sequence
  Synthetic
gagcaattccccataggatggggctcccttaactatgaggagaatgtcaccaatgatgcagaaatgagcccgtac

SEQ ID NO: 124265 - DNA, 75 bp, Artificial Sequence
  Synthetic
gagcaattccccataggatggggctcccttaactatgaggagaatgtcaccaatgatgcagatatgagcccgtac

SEQ ID NO: 124266 - DNA, 75 bp, Artificial Sequence
  Synthetic
gagcaattccccataggatggggctcccttaactatgaggagaatgtcaccaatgatgcagacatgagcccgtac

SEQ ID NO: 124267 - DNA, 75 bp, Artificial Sequence
  Synthetic
gagcaattccccataggatggggctcccttaactatgaggagaatgtcaccaatgatgcagagatgagcccgtac

SEQ ID NO: 124268 - DNA, 75 bp, Artificial Sequence
  Synthetic
gagcaattccccataggatggggctcccttaagtatgaggagaatgtcaccaatgatgcagaaatgagcccgtac

SEQ ID NO: 124269 - DNA, 75 bp, Artificial Sequence
  Synthetic
gagcaattccccataggatggggctcccttaagtatgaggagaatgtcaccaatgatgcagatatgagcccgtac

SEQ ID NO: 124270 - DNA, 75 bp, Artificial Sequence
  Synthetic
gagcaattccccataggatggggctcccttaagtatgaggagaatgtcaccaatgatgcagacatgagcccgtac

SEQ ID NO: 124271 - DNA, 75 bp, Artificial Sequence
  Synthetic
gagcaattccccataggatggggctcccttaagtatgaggagaatgtcaccaatgatgcagagatgagcccgtac

SEQ ID NO: 124272 - DNA, 75 bp, Artificial Sequence
  Synthetic
gagcaattccccataggatgggggtcccttaaatatgaggagaatgtcaccaatgatgcagaaatgagcccgtac

SEQ ID NO: 124273 - DNA, 75 bp, Artificial Sequence
  Synthetic
gagcaattccccataggatgggggtcccttaaatatgaggagaatgtcaccaatgatgcagatatgagcccgtac

SEQ ID NO: 124274 - DNA, 75 bp, Artificial Sequence
  Synthetic
gagcaattccccataggatgggggtcccttaaatatgaggagaatgtcaccaatgatgcagacatgagcccgtac

SEQ ID NO: 124275 - DNA, 75 bp, Artificial Sequence
  Synthetic
gagcaattccccataggatgggggtcccttaaatatgaggagaatgtcaccaatgatgcagagatgagcccgtac

SEQ ID NO: 124276 - DNA, 75 bp, Artificial Sequence
  Synthetic
gagcaattccccataggatgggggtcccttaattatgaggagaatgtcaccaatgatgcagaaatgagcccgtac

SEQ ID NO: 124277 - DNA, 75 bp, Artificial Sequence
  Synthetic
gagcaattccccataggatgggggtcccttaattatgaggagaatgtcaccaatgatgcagatatgagcccgtac

SEQ ID NO: 124278 - DNA, 75 bp, Artificial Sequence
  Synthetic
gagcaattccccataggatgggggtcccttaattatgaggagaatgtcaccaatgatgcagacatgagcccgtac

SEQ ID NO: 124279 - DNA, 75 bp, Artificial Sequence
  Synthetic
gagcaattccccataggatgggggtcccttaattatgaggagaatgtcaccaatgatgcagagatgagcccgtac

SEQ ID NO: 124280 - DNA, 75 bp, Artificial Sequence
  Synthetic
gagcaattccccataggatgggggtcccttaactatgaggagaatgtcaccaatgatgcagaaatgagcccgtac

SEQ ID NO: 124281 - DNA, 75 bp, Artificial Sequence
  Synthetic
gagcaattccccataggatgggggtcccttaactatgaggagaatgtcaccaatgatgcagatatgagcccgtac

SEQ ID NO: 124282 - DNA, 75 bp, Artificial Sequence
  Synthetic
gagcaattccccataggatgggggtcccttaactatgaggagaatgtcaccaatgatgcagacatgagcccgtac

SEQ ID NO: 124283 - DNA, 75 bp, Artificial Sequence
  Synthetic
gagcaattccccataggatgggggtcccttaactatgaggagaatgtcaccaatgatgcagagatgagcccgtac

SEQ ID NO: 124284 - DNA, 75 bp, Artificial Sequence
  Synthetic
gagcaattccccataggatgggggtcccttaagtatgaggagaatgtcaccaatgatgcagaaatgagcccgtac

SEQ ID NO: 124285 - DNA, 75 bp, Artificial Sequence
  Synthetic
gagcaattccccataggatgggggtcccttaagtatgaggagaatgtcaccaatgatgcagatatgagcccgtac

SEQ ID NO: 124286 - DNA, 75 bp, Artificial Sequence
  Synthetic
gagcaattccccataggatgggggtcccttaagtatgaggagaatgtcaccaatgatgcagacatgagcccgtac

SEQ ID NO: 124287 - DNA, 75 bp, Artificial Sequence
  Synthetic
gagcaattccccataggatgggggtcccttaagtatgaggagaatgtcaccaatgatgcagagatgagcccgtac

SEQ ID NO: 124288 - DNA, 75 bp, Artificial Sequence
  Synthetic
cccagccctgtggtggtgggaacgaccgacaagttgggcgcgcctacctacaactggggtagcaatgacacggac

SEQ ID NO: 124289 - DNA, 75 bp, Artificial Sequence
  Synthetic
cgacctttacctcatcaccaggaatgccgacgtcattccggcaaggcgcaggggcgacacgcgggccggcttgct

SEQ ID NO: 124290 - DNA, 75 bp, Artificial Sequence
  Synthetic
aggttctcctccatcggaggctagctcctctgcaagccaactctctgcaccctcgctgcgggccacctgtaccac

SEQ ID NO: 124291 - DNA, 75 bp, Artificial Sequence
  Synthetic
ccgatagagccggggagcctacctacaattggggggagaaagagacagatgtcttcctgctcaacagcactcgcc

SEQ ID NO: 124292 - DNA, 75 bp, Artificial Sequence
  Synthetic
ccgatagagccggggagcctacctacaattggggggagaatgagacagatgtcttcctgctcaacagcactcgcc

SEQ ID NO: 124293 - DNA, 75 bp, Artificial Sequence
  Synthetic
ccgatagagccggggagcctacctacaattggggggagaacgagacagatgtcttcctgctcaacagcactcgcc

SEQ ID NO: 124294 - DNA, 75 bp, Artificial Sequence
  Synthetic
ccgatagagccggggagcctacctacaattggggggagaaggagacagatgtcttcctgctcaacagcactcgcc

SEQ ID NO: 124295 - DNA, 75 bp, Artificial Sequence
  Synthetic
ccgatagagccggggtgcctacctacaattggggggagaaagagacagatgtcttcctgctcaacagcactcgcc

SEQ ID NO: 124296 - DNA, 75 bp, Artificial Sequence
  Synthetic
ccgatagagccggggtgcctacctacaattggggggagaatgagacagatgtcttcctgctcaacagcactcgcc

SEQ ID NO: 124297 - DNA, 75 bp, Artificial Sequence
  Synthetic
ccgatagagccggggtgcctacctacaattggggggagaacgagacagatgtcttcctgctcaacagcactcgcc

SEQ ID NO: 124298 - DNA, 75 bp, Artificial Sequence
  Synthetic
ccgatagagccggggtgcctacctacaattggggggagaaggagacagatgtcttcctgctcaacagcactcgcc

SEQ ID NO: 124299 - DNA, 75 bp, Artificial Sequence
  Synthetic
ccgatagagccggggcgcctacctacaattggggggagaaagagacagatgtcttcctgctcaacagcactcgcc

SEQ ID NO: 124300 - DNA, 75 bp, Artificial Sequence
  Synthetic
ccgatagagccggggcgcctacctacaattggggggagaatgagacagatgtcttcctgctcaacagcactcgcc

SEQ ID NO: 124301 - DNA, 75 bp, Artificial Sequence
  Synthetic
ccgatagagccggggcgcctacctacaattggggggagaacgagacagatgtcttcctgctcaacagcactcgcc

SEQ ID NO: 124302 - DNA, 75 bp, Artificial Sequence
  Synthetic
ccgatagagccggggcgcctacctacaattggggggagaaggagacagatgtcttcctgctcaacagcactcgcc

SEQ ID NO: 124303 - DNA, 75 bp, Artificial Sequence
  Synthetic
ccgatagagccggggggcctacctacaattggggggagaaagagacagatgtcttcctgctcaacagcactcgcc

SEQ ID NO: 124304 - DNA, 75 bp, Artificial Sequence
  Synthetic
ccgatagagccggggggcctacctacaattggggggagaatgagacagatgtcttcctgctcaacagcactcgcc

SEQ ID NO: 124305 - DNA, 75 bp, Artificial Sequence
  Synthetic
ccgatagagccggggggcctacctacaattggggggagaacgagacagatgtcttcctgctcaacagcactcgcc

SEQ ID NO: 124306 - DNA, 75 bp, Artificial Sequence
  Synthetic
ccgatagagccggggggcctacctacaattggggggagaaggagacagatgtcttcctgctcaacagcactcgcc

SEQ ID NO: 124307 - DNA, 75 bp, Artificial Sequence
  Synthetic
aaagggtcatcgggagggccggtcatgtgcccatctggacacgcagtcgggctcttccgcgctgctgtgtgcacg

SEQ ID NO: 124308 - DNA, 75 bp, Artificial Sequence
  Synthetic
aaagggtcatcgggagggccggtcatgtgcccatctggacacgctgtcgggctcttccgcgctgctgtgtgcacg

SEQ ID NO: 124309 - DNA, 75 bp, Artificial Sequence
  Synthetic
aaagggtcatcgggagggccggtcatgtgcccatctggacacgccgtcgggctcttccgcgctgctgtgtgcacg

SEQ ID NO: 124310 - DNA, 75 bp, Artificial Sequence
  Synthetic
aaagggtcatcgggagggccggtcatgtgcccatctggacacgcggtcgggctcttccgcgctgctgtgtgcacg

SEQ ID NO: 124311 - DNA, 75 bp, Artificial Sequence
  Synthetic
tccctcgacacaatggtcgaggtggaggacgatcgtgagccttcaataccatcagagtacatgctgcctcgtaag

SEQ ID NO: 124312 - DNA, 75 bp, Artificial Sequence
  Synthetic
tccctcgacacaatggtcgaggtggaggacgatcgtgagccttcattaccatcagagtacatgctgcctcgtaag

SEQ ID NO: 124313 - DNA, 75 bp, Artificial Sequence
  Synthetic
tccctcgacacaatggtcgaggtggaggacgatcgtgagccttcactaccatcagagtacatgctgcctcgtaag

SEQ ID NO: 124314 - DNA, 75 bp, Artificial Sequence
  Synthetic
tccctcgacacaatggtcgaggtggaggacgatcgtgagccttcagtaccatcagagtacatgctgcctcgtaag

SEQ ID NO: 124315 - DNA, 75 bp, Artificial Sequence
  Synthetic
tccctcgactcaatggtcgaggtggaggacgatcgtgagccttcaataccatcagagtacatgctgcctcgtaag

SEQ ID NO: 124316 - DNA, 75 bp, Artificial Sequence
  Synthetic
tccctcgactcaatggtcgaggtggaggacgatcgtgagccttcattaccatcagagtacatgctgcctcgtaag

SEQ ID NO: 124317 - DNA, 75 bp, Artificial Sequence
  Synthetic
tccctcgactcaatggtcgaggtggaggacgatcgtgagccttcactaccatcagagtacatgctgcctcgtaag

SEQ ID NO: 124318 - DNA, 75 bp, Artificial Sequence
  Synthetic
tccctcgactcaatggtcgaggtggaggacgatcgtgagccttcagtaccatcagagtacatgctgcctcgtaag

SEQ ID NO: 124319 - DNA, 75 bp, Artificial Sequence
  Synthetic
tccctcgacccaatggtcgaggtggaggacgatcgtgagccttcaataccatcagagtacatgctgcctcgtaag

SEQ ID NO: 124320 - DNA, 75 bp, Artificial Sequence
  Synthetic
tccctcgacccaatggtcgaggtggaggacgatcgtgagccttcattaccatcagagtacatgctgcctcgtaag

SEQ ID NO: 124321 - DNA, 75 bp, Artificial Sequence
  Synthetic
tccctcgacccaatggtcgaggtggaggacgatcgtgagccttcactaccatcagagtacatgctgcctcgtaag

SEQ ID NO: 124322 - DNA, 75 bp, Artificial Sequence
  Synthetic
tccctcgacccaatggtcgaggtggaggacgatcgtgagccttcagtaccatcagagtacatgctgcctcgtaag

SEQ ID NO: 124323 - DNA, 75 bp, Artificial Sequence
  Synthetic
tccctcgacgcaatggtcgaggtggaggacgatcgtgagccttcaataccatcagagtacatgctgcctcgtaag

SEQ ID NO: 124324 - DNA, 75 bp, Artificial Sequence
  Synthetic
tccctcgacgcaatggtcgaggtggaggacgatcgtgagccttcattaccatcagagtacatgctgcctcgtaag

SEQ ID NO: 124325 - DNA, 75 bp, Artificial Sequence
  Synthetic
tccctcgacgcaatggtcgaggtggaggacgatcgtgagccttcactaccatcagagtacatgctgcctcgtaag

SEQ ID NO: 124326 - DNA, 75 bp, Artificial Sequence
  Synthetic
tccctcgacgcaatggtcgaggtggaggacgatcgtgagccttcagtaccatcagagtacatgctgcctcgtaag

SEQ ID NO: 124327 - DNA, 75 bp, Artificial Sequence
  Synthetic
caccaaagggagcttggtttgggtgtacgtggatgaacggcaccggatacaccaagacctgcggcgcgccaccct

SEQ ID NO: 124328 - DNA, 75 bp, Artificial Sequence
  Synthetic
caccaaagggagcttggtttgggtgtacgtggatgaacggcaccggattcaccaagacctgcggcgcgccaccct

SEQ ID NO: 124329 - DNA, 75 bp, Artificial Sequence
  Synthetic
caccaaagggagcttggtttgggtgtacgtggatgaacggcaccggatccaccaagacctgcggcgcgccaccct

SEQ ID NO: 124330 - DNA, 75 bp, Artificial Sequence
  Synthetic
caccaaagggagcttggtttgggtgtacgtggatgaacggcaccggatgcaccaagacctgcggcgcgccaccct

SEQ ID NO: 124331 - DNA, 75 bp, Artificial Sequence
  Synthetic
caccaaagggtgcttggtttgggtgtacgtggatgaacggcaccggatacaccaagacctgcggcgcgccaccct

SEQ ID NO: 124332 - DNA, 75 bp, Artificial Sequence
  Synthetic
caccaaagggtgcttggtttgggtgtacgtggatgaacggcaccggattcaccaagacctgcggcgcgccaccct

SEQ ID NO: 124333 - DNA, 75 bp, Artificial Sequence
  Synthetic
caccaaagggtgcttggtttgggtgtacgtggatgaacggcaccggatccaccaagacctgcggcgcgccaccct

SEQ ID NO: 124334 - DNA, 75 bp, Artificial Sequence
  Synthetic
caccaaagggtgcttggtttgggtgtacgtggatgaacggcaccggatgcaccaagacctgcggcgcgccaccct

SEQ ID NO: 124335 - DNA, 75 bp, Artificial Sequence
  Synthetic
caccaaagggcgcttggtttgggtgtacgtggatgaacggcaccggatacaccaagacctgcggcgcgccaccct

SEQ ID NO: 124336 - DNA, 75 bp, Artificial Sequence
  Synthetic
caccaaagggcgcttggtttgggtgtacgtggatgaacggcaccggattcaccaagacctgcggcgcgccaccct

SEQ ID NO: 124337 - DNA, 75 bp, Artificial Sequence
  Synthetic
caccaaagggcgcttggtttgggtgtacgtggatgaacggcaccggatccaccaagacctgcggcgcgccaccct

SEQ ID NO: 124338 - DNA, 75 bp, Artificial Sequence
  Synthetic
caccaaagggcgcttggtttgggtgtacgtggatgaacggcaccggatgcaccaagacctgcggcgcgccaccct

SEQ ID NO: 124339 - DNA, 75 bp, Artificial Sequence
  Synthetic
caccaaagggggcttggtttgggtgtacgtggatgaacggcaccggatacaccaagacctgcggcgcgccaccct

SEQ ID NO: 124340 - DNA, 75 bp, Artificial Sequence
  Synthetic
caccaaagggggcttggtttgggtgtacgtggatgaacggcaccggattcaccaagacctgcggcgcgccaccct

SEQ ID NO: 124341 - DNA, 75 bp, Artificial Sequence
  Synthetic
caccaaagggggcttggtttgggtgtacgtggatgaacggcaccggatccaccaagacctgcggcgcgccaccct

SEQ ID NO: 124342 - DNA, 75 bp, Artificial Sequence
  Synthetic
caccaaagggggcttggtttgggtgtacgtggatgaacggcaccggatgcaccaagacctgcggcgcgccaccct

SEQ ID NO: 124343 - DNA, 75 bp, Artificial Sequence
  Synthetic
ctccaaagggagcttggtttgggtgtacgtggatgaacggcaccggatacaccaagacctgcggcgcgccaccct

SEQ ID NO: 124344 - DNA, 75 bp, Artificial Sequence
  Synthetic
ctccaaagggagcttggtttgggtgtacgtggatgaacggcaccggattcaccaagacctgcggcgcgccaccct

SEQ ID NO: 124345 - DNA, 75 bp, Artificial Sequence
  Synthetic
ctccaaagggagcttggtttgggtgtacgtggatgaacggcaccggatccaccaagacctgcggcgcgccaccct

SEQ ID NO: 124346 - DNA, 75 bp, Artificial Sequence
  Synthetic
ctccaaagggagcttggtttgggtgtacgtggatgaacggcaccggatgcaccaagacctgcggcgcgccaccct

SEQ ID NO: 124347 - DNA, 75 bp, Artificial Sequence
  Synthetic
ctccaaagggtgcttggtttgggtgtacgtggatgaacggcaccggatacaccaagacctgcggcgcgccaccct

SEQ ID NO: 124348 - DNA, 75 bp, Artificial Sequence
  Synthetic
ctccaaagggtgcttggtttgggtgtacgtggatgaacggcaccggattcaccaagacctgcggcgcgccaccct

SEQ ID NO: 124349 - DNA, 75 bp, Artificial Sequence
  Synthetic
ctccaaagggtgcttggtttgggtgtacgtggatgaacggcaccggatccaccaagacctgcggcgcgccaccct

SEQ ID NO: 124350 - DNA, 75 bp, Artificial Sequence
  Synthetic
ctccaaagggtgcttggtttgggtgtacgtggatgaacggcaccggatgcaccaagacctgcggcgcgccaccct

SEQ ID NO: 124351 - DNA, 75 bp, Artificial Sequence
  Synthetic
ctccaaagggcgcttggtttgggtgtacgtggatgaacggcaccggatacaccaagacctgcggcgcgccaccct

SEQ ID NO: 124352 - DNA, 75 bp, Artificial Sequence
  Synthetic
ctccaaagggcgcttggtttgggtgtacgtggatgaacggcaccggattcaccaagacctgcggcgcgccaccct

SEQ ID NO: 124353 - DNA, 75 bp, Artificial Sequence
  Synthetic
ctccaaagggcgcttggtttgggtgtacgtggatgaacggcaccggatccaccaagacctgcggcgcgccaccct

SEQ ID NO: 124354 - DNA, 75 bp, Artificial Sequence
  Synthetic
ctccaaagggcgcttggtttgggtgtacgtggatgaacggcaccggatgcaccaagacctgcggcgcgccaccct

SEQ ID NO: 124355 - DNA, 75 bp, Artificial Sequence
  Synthetic
ctccaaagggggcttggtttgggtgtacgtggatgaacggcaccggatacaccaagacctgcggcgcgccaccct

SEQ ID NO: 124356 - DNA, 75 bp, Artificial Sequence
  Synthetic
ctccaaagggggcttggtttgggtgtacgtggatgaacggcaccggattcaccaagacctgcggcgcgccaccct

SEQ ID NO: 124357 - DNA, 75 bp, Artificial Sequence
  Synthetic
ctccaaagggggcttggtttgggtgtacgtggatgaacggcaccggatccaccaagacctgcggcgcgccaccct

SEQ ID NO: 124358 - DNA, 75 bp, Artificial Sequence
  Synthetic
ctccaaagggggcttggtttgggtgtacgtggatgaacggcaccggatgcaccaagacctgcggcgcgccaccct

SEQ ID NO: 124359 - DNA, 75 bp, Artificial Sequence
  Synthetic
ccccaaagggagcttggtttgggtgtacgtggatgaacggcaccggatacaccaagacctgcggcgcgccaccct

SEQ ID NO: 124360 - DNA, 75 bp, Artificial Sequence
  Synthetic
ccccaaagggagcttggtttgggtgtacgtggatgaacggcaccggattcaccaagacctgcggcgcgccaccct

SEQ ID NO: 124361 - DNA, 75 bp, Artificial Sequence
  Synthetic
ccccaaagggagcttggtttgggtgtacgtggatgaacggcaccggatccaccaagacctgcggcgcgccaccct

SEQ ID NO: 124362 - DNA, 75 bp, Artificial Sequence
  Synthetic
ccccaaagggagcttggtttgggtgtacgtggatgaacggcaccggatgcaccaagacctgcggcgcgccaccct

SEQ ID NO: 124363 - DNA, 75 bp, Artificial Sequence
  Synthetic
ccccaaagggtgcttggtttgggtgtacgtggatgaacggcaccggatacaccaagacctgcggcgcgccaccct

SEQ ID NO: 124364 - DNA, 75 bp, Artificial Sequence
  Synthetic
ccccaaagggtgcttggtttgggtgtacgtggatgaacggcaccggattcaccaagacctgcggcgcgccaccct

SEQ ID NO: 124365 - DNA, 75 bp, Artificial Sequence
  Synthetic
ccccaaagggtgcttggtttgggtgtacgtggatgaacggcaccggatccaccaagacctgcggcgcgccaccct

SEQ ID NO: 124366 - DNA, 75 bp, Artificial Sequence
  Synthetic
ccccaaagggtgcttggtttgggtgtacgtggatgaacggcaccggatgcaccaagacctgcggcgcgccaccct

SEQ ID NO: 124367 - DNA, 75 bp, Artificial Sequence
  Synthetic
ccccaaagggcgcttggtttgggtgtacgtggatgaacggcaccggatacaccaagacctgcggcgcgccaccct

SEQ ID NO: 124368 - DNA, 75 bp, Artificial Sequence
  Synthetic
ccccaaagggcgcttggtttgggtgtacgtggatgaacggcaccggattcaccaagacctgcggcgcgccaccct

SEQ ID NO: 124369 - DNA, 75 bp, Artificial Sequence
  Synthetic
ccccaaagggcgcttggtttgggtgtacgtggatgaacggcaccggatccaccaagacctgcggcgcgccaccct

SEQ ID NO: 124370 - DNA, 75 bp, Artificial Sequence
  Synthetic
ccccaaagggcgcttggtttgggtgtacgtggatgaacggcaccggatgcaccaagacctgcggcgcgccaccct

SEQ ID NO: 124371 - DNA, 75 bp, Artificial Sequence
  Synthetic
ccccaaagggggcttggtttgggtgtacgtggatgaacggcaccggatacaccaagacctgcggcgcgccaccct

SEQ ID NO: 124372 - DNA, 75 bp, Artificial Sequence
  Synthetic
ccccaaagggggcttggtttgggtgtacgtggatgaacggcaccggattcaccaagacctgcggcgcgccaccct

SEQ ID NO: 124373 - DNA, 75 bp, Artificial Sequence
  Synthetic
ccccaaagggggcttggtttgggtgtacgtggatgaacggcaccggatccaccaagacctgcggcgcgccaccct

SEQ ID NO: 124374 - DNA, 75 bp, Artificial Sequence
  Synthetic
ccccaaagggggcttggtttgggtgtacgtggatgaacggcaccggatgcaccaagacctgcggcgcgccaccct

SEQ ID NO: 124375 - DNA, 75 bp, Artificial Sequence
  Synthetic
cgccaaagggagcttggtttgggtgtacgtggatgaacggcaccggatacaccaagacctgcggcgcgccaccct

SEQ ID NO: 124376 - DNA, 75 bp, Artificial Sequence
  Synthetic
cgccaaagggagcttggtttgggtgtacgtggatgaacggcaccggattcaccaagacctgcggcgcgccaccct

SEQ ID NO: 124377 - DNA, 75 bp, Artificial Sequence
  Synthetic
cgccaaagggagcttggtttgggtgtacgtggatgaacggcaccggatccaccaagacctgcggcgcgccaccct

SEQ ID NO: 124378 - DNA, 75 bp, Artificial Sequence
  Synthetic
cgccaaagggagcttggtttgggtgtacgtggatgaacggcaccggatgcaccaagacctgcggcgcgccaccct

SEQ ID NO: 124379 - DNA, 75 bp, Artificial Sequence
  Synthetic
cgccaaagggtgcttggtttgggtgtacgtggatgaacggcaccggatacaccaagacctgcggcgcgccaccct

SEQ ID NO: 124380 - DNA, 75 bp, Artificial Sequence
  Synthetic
cgccaaagggtgcttggtttgggtgtacgtggatgaacggcaccggattcaccaagacctgcggcgcgccaccct

SEQ ID NO: 124381 - DNA, 75 bp, Artificial Sequence
  Synthetic
cgccaaagggtgcttggtttgggtgtacgtggatgaacggcaccggatccaccaagacctgcggcgcgccaccct

SEQ ID NO: 124382 - DNA, 75 bp, Artificial Sequence
  Synthetic
cgccaaagggtgcttggtttgggtgtacgtggatgaacggcaccggatgcaccaagacctgcggcgcgccaccct

SEQ ID NO: 124383 - DNA, 75 bp, Artificial Sequence
  Synthetic
cgccaaagggcgcttggtttgggtgtacgtggatgaacggcaccggatacaccaagacctgcggcgcgccaccct

SEQ ID NO: 124384 - DNA, 75 bp, Artificial Sequence
  Synthetic
cgccaaagggcgcttggtttgggtgtacgtggatgaacggcaccggattcaccaagacctgcggcgcgccaccct

SEQ ID NO: 124385 - DNA, 75 bp, Artificial Sequence
  Synthetic
cgccaaagggcgcttggtttgggtgtacgtggatgaacggcaccggatccaccaagacctgcggcgcgccaccct

SEQ ID NO: 124386 - DNA, 75 bp, Artificial Sequence
  Synthetic
cgccaaagggcgcttggtttgggtgtacgtggatgaacggcaccggatgcaccaagacctgcggcgcgccaccct

SEQ ID NO: 124387 - DNA, 75 bp, Artificial Sequence
  Synthetic
cgccaaagggggcttggtttgggtgtacgtggatgaacggcaccggatacaccaagacctgcggcgcgccaccct

SEQ ID NO: 124388 - DNA, 75 bp, Artificial Sequence
  Synthetic
cgccaaagggggcttggtttgggtgtacgtggatgaacggcaccggattcaccaagacctgcggcgcgccaccct

SEQ ID NO: 124389 - DNA, 75 bp, Artificial Sequence
  Synthetic
cgccaaagggggcttggtttgggtgtacgtggatgaacggcaccggatccaccaagacctgcggcgcgccaccct

SEQ ID NO: 124390 - DNA, 75 bp, Artificial Sequence
  Synthetic
cgccaaagggggcttggtttgggtgtacgtggatgaacggcaccggatgcaccaagacctgcggcgcgccaccct

SEQ ID NO: 124391 - DNA, 75 bp, Artificial Sequence
  Synthetic
cacagacataccaagtgggatacctccatgcgccgacgggtagtgggaaaagcacgaaagtgccagcttcctacg

SEQ ID NO: 124392 - DNA, 75 bp, Artificial Sequence
  Synthetic
ggtgtcctctccctccctcagactacaagccgacgcctcctccaaggaggcgtcgtgcggtggttctgagccagt

SEQ ID NO: 124393 - DNA, 75 bp, Artificial Sequence
  Synthetic
ctgcccaaggttatagcgtgttggtgttgaacccctctgtggccgctactctaggctttggcgcatatatgcgca

SEQ ID NO: 124394 - DNA, 75 bp, Artificial Sequence
  Synthetic
caagccgacgcctcctccaaggaggcgtcgtgcggtggttctgagccagtccaatgttggggaggcccttgcggc

SEQ ID NO: 124395 - DNA, 75 bp, Artificial Sequence
  Synthetic
catcttcaaaatacggatgttggtggggggtgttgaacacaggctcgaagcagcatgcaacttcactcgtggaga

SEQ ID NO: 124396 - DNA, 75 bp, Artificial Sequence
  Synthetic
catcttcaaaatacggatgttggtggggggtgttgaacacaggctcgaagcagcatgcaacttcactcgtggtga

SEQ ID NO: 124397 - DNA, 75 bp, Artificial Sequence
  Synthetic
catcttcaaaatacggatgttggtggggggtgttgaacacaggctcgaagcagcatgcaacttcactcgtggcga

SEQ ID NO: 124398 - DNA, 75 bp, Artificial Sequence
  Synthetic
catcttcaaaatacggatgttggtggggggtgttgaacacaggctcgaagcagcatgcaacttcactcgtgggga

SEQ ID NO: 124399 - DNA, 75 bp, Artificial Sequence
  Synthetic
catcttcaaaatacggatgttggtggggggtgttgaacacaggctcgaagcagcttgcaacttcactcgtggaga

SEQ ID NO: 124400 - DNA, 75 bp, Artificial Sequence
  Synthetic
catcttcaaaatacggatgttggtggggggtgttgaacacaggctcgaagcagcttgcaacttcactcgtggtga

SEQ ID NO: 124401 - DNA, 75 bp, Artificial Sequence
  Synthetic
catcttcaaaatacggatgttggtggggggtgttgaacacaggctcgaagcagcttgcaacttcactcgtggcga

SEQ ID NO: 124402 - DNA, 75 bp, Artificial Sequence
  Synthetic
catcttcaaaatacggatgttggtggggggtgttgaacacaggctcgaagcagcttgcaacttcactcgtgggga

SEQ ID NO: 124403 - DNA, 75 bp, Artificial Sequence
  Synthetic
catcttcaaaatacggatgttggtggggggtgttgaacacaggctcgaagcagcctgcaacttcactcgtggaga

SEQ ID NO: 124404 - DNA, 75 bp, Artificial Sequence
  Synthetic
catcttcaaaatacggatgttggtggggggtgttgaacacaggctcgaagcagcctgcaacttcactcgtggtga

SEQ ID NO: 124405 - DNA, 75 bp, Artificial Sequence
  Synthetic
catcttcaaaatacggatgttggtggggggtgttgaacacaggctcgaagcagcctgcaacttcactcgtggcga

SEQ ID NO: 124406 - DNA, 75 bp, Artificial Sequence
  Synthetic
catcttcaaaatacggatgttggtggggggtgttgaacacaggctcgaagcagcctgcaacttcactcgtgggga

SEQ ID NO: 124407 - DNA, 75 bp, Artificial Sequence
  Synthetic
catcttcaaaatacggatgttggtggggggtgttgaacacaggctcgaagcagcgtgcaacttcactcgtggaga

SEQ ID NO: 124408 - DNA, 75 bp, Artificial Sequence
  Synthetic
catcttcaaaatacggatgttggtggggggtgttgaacacaggctcgaagcagcgtgcaacttcactcgtggtga

SEQ ID NO: 124409 - DNA, 75 bp, Artificial Sequence
  Synthetic
catcttcaaaatacggatgttggtggggggtgttgaacacaggctcgaagcagcgtgcaacttcactcgtggcga

SEQ ID NO: 124410 - DNA, 75 bp, Artificial Sequence
  Synthetic
catcttcaaaatacggatgttggtggggggtgttgaacacaggctcgaagcagcgtgcaacttcactcgtgggga

SEQ ID NO: 124411 - DNA, 75 bp, Artificial Sequence
  Synthetic
catcttcaaaatacggatgttggtggggggtgttgatcacaggctcgaagcagcatgcaacttcactcgtggaga

SEQ ID NO: 124412 - DNA, 75 bp, Artificial Sequence
  Synthetic
catcttcaaaatacggatgttggtggggggtgttgatcacaggctcgaagcagcatgcaacttcactcgtggtga

SEQ ID NO: 124413 - DNA, 75 bp, Artificial Sequence
  Synthetic
catcttcaaaatacggatgttggtggggggtgttgatcacaggctcgaagcagcatgcaacttcactcgtggcga

SEQ ID NO: 124414 - DNA, 75 bp, Artificial Sequence
  Synthetic
catcttcaaaatacggatgttggtggggggtgttgatcacaggctcgaagcagcatgcaacttcactcgtgggga

SEQ ID NO: 124415 - DNA, 75 bp, Artificial Sequence
  Synthetic
catcttcaaaatacggatgttggtggggggtgttgatcacaggctcgaagcagcttgcaacttcactcgtggaga

SEQ ID NO: 124416 - DNA, 75 bp, Artificial Sequence
  Synthetic
catcttcaaaatacggatgttggtggggggtgttgatcacaggctcgaagcagcttgcaacttcactcgtggtga

SEQ ID NO: 124417 - DNA, 75 bp, Artificial Sequence
  Synthetic
catcttcaaaatacggatgttggtggggggtgttgatcacaggctcgaagcagcttgcaacttcactcgtggcga

SEQ ID NO: 124418 - DNA, 75 bp, Artificial Sequence
  Synthetic
catcttcaaaatacggatgttggtggggggtgttgatcacaggctcgaagcagcttgcaacttcactcgtgggga

SEQ ID NO: 124419 - DNA, 75 bp, Artificial Sequence
  Synthetic
catcttcaaaatacggatgttggtggggggtgttgatcacaggctcgaagcagcctgcaacttcactcgtggaga

SEQ ID NO: 124420 - DNA, 75 bp, Artificial Sequence
  Synthetic
catcttcaaaatacggatgttggtggggggtgttgatcacaggctcgaagcagcctgcaacttcactcgtggtga

SEQ ID NO: 124421 - DNA, 75 bp, Artificial Sequence
  Synthetic
catcttcaaaatacggatgttggtggggggtgttgatcacaggctcgaagcagcctgcaacttcactcgtggcga

SEQ ID NO: 124422 - DNA, 75 bp, Artificial Sequence
  Synthetic
catcttcaaaatacggatgttggtggggggtgttgatcacaggctcgaagcagcctgcaacttcactcgtgggga

SEQ ID NO: 124423 - DNA, 75 bp, Artificial Sequence
  Synthetic
catcttcaaaatacggatgttggtggggggtgttgatcacaggctcgaagcagcgtgcaacttcactcgtggaga

SEQ ID NO: 124424 - DNA, 75 bp, Artificial Sequence
  Synthetic
catcttcaaaatacggatgttggtggggggtgttgatcacaggctcgaagcagcgtgcaacttcactcgtggtga

SEQ ID NO: 124425 - DNA, 75 bp, Artificial Sequence
  Synthetic
catcttcaaaatacggatgttggtggggggtgttgatcacaggctcgaagcagcgtgcaacttcactcgtggcga

SEQ ID NO: 124426 - DNA, 75 bp, Artificial Sequence
  Synthetic
catcttcaaaatacggatgttggtggggggtgttgatcacaggctcgaagcagcgtgcaacttcactcgtgggga

SEQ ID NO: 124427 - DNA, 75 bp, Artificial Sequence
  Synthetic
catcttcaaaatacggatgttggtggggggtgttgaccacaggctcgaagcagcatgcaacttcactcgtggaga

SEQ ID NO: 124428 - DNA, 75 bp, Artificial Sequence
  Synthetic
catcttcaaaatacggatgttggtggggggtgttgaccacaggctcgaagcagcatgcaacttcactcgtggtga

SEQ ID NO: 124429 - DNA, 75 bp, Artificial Sequence
  Synthetic
catcttcaaaatacggatgttggtggggggtgttgaccacaggctcgaagcagcatgcaacttcactcgtggcga

SEQ ID NO: 124430 - DNA, 75 bp, Artificial Sequence
  Synthetic
catcttcaaaatacggatgttggtggggggtgttgaccacaggctcgaagcagcatgcaacttcactcgtgggga

SEQ ID NO: 124431 - DNA, 75 bp, Artificial Sequence
  Synthetic
catcttcaaaatacggatgttggtggggggtgttgaccacaggctcgaagcagcttgcaacttcactcgtggaga

SEQ ID NO: 124432 - DNA, 75 bp, Artificial Sequence
  Synthetic
catcttcaaaatacggatgttggtggggggtgttgaccacaggctcgaagcagcttgcaacttcactcgtggtga

SEQ ID NO: 124433 - DNA, 75 bp, Artificial Sequence
  Synthetic
catcttcaaaatacggatgttggtggggggtgttgaccacaggctcgaagcagcttgcaacttcactcgtggcga

SEQ ID NO: 124434 - DNA, 75 bp, Artificial Sequence
  Synthetic
catcttcaaaatacggatgttggtggggggtgttgaccacaggctcgaagcagcttgcaacttcactcgtgggga

SEQ ID NO: 124435 - DNA, 75 bp, Artificial Sequence
  Synthetic
catcttcaaaatacggatgttggtggggggtgttgaccacaggctcgaagcagcctgcaacttcactcgtggaga

SEQ ID NO: 124436 - DNA, 75 bp, Artificial Sequence
  Synthetic
catcttcaaaatacggatgttggtggggggtgttgaccacaggctcgaagcagcctgcaacttcactcgtggtga

SEQ ID NO: 124437 - DNA, 75 bp, Artificial Sequence
  Synthetic
catcttcaaaatacggatgttggtggggggtgttgaccacaggctcgaagcagcctgcaacttcactcgtggcga

SEQ ID NO: 124438 - DNA, 75 bp, Artificial Sequence
  Synthetic
catcttcaaaatacggatgttggtggggggtgttgaccacaggctcgaagcagcctgcaacttcactcgtgggga

SEQ ID NO: 124439 - DNA, 75 bp, Artificial Sequence
  Synthetic
catcttcaaaatacggatgttggtggggggtgttgaccacaggctcgaagcagcgtgcaacttcactcgtggaga

SEQ ID NO: 124440 - DNA, 75 bp, Artificial Sequence
  Synthetic
catcttcaaaatacggatgttggtggggggtgttgaccacaggctcgaagcagcgtgcaacttcactcgtggtga

SEQ ID NO: 124441 - DNA, 75 bp, Artificial Sequence
  Synthetic
catcttcaaaatacggatgttggtggggggtgttgaccacaggctcgaagcagcgtgcaacttcactcgtggcga

SEQ ID NO: 124442 - DNA, 75 bp, Artificial Sequence
  Synthetic
catcttcaaaatacggatgttggtggggggtgttgaccacaggctcgaagcagcgtgcaacttcactcgtgggga

SEQ ID NO: 124443 - DNA, 75 bp, Artificial Sequence
  Synthetic
catcttcaaaatacggatgttggtggggggtgttgagcacaggctcgaagcagcatgcaacttcactcgtggaga

SEQ ID NO: 124444 - DNA, 75 bp, Artificial Sequence
  Synthetic
catcttcaaaatacggatgttggtggggggtgttgagcacaggctcgaagcagcatgcaacttcactcgtggtga

SEQ ID NO: 124445 - DNA, 75 bp, Artificial Sequence
  Synthetic
catcttcaaaatacggatgttggtggggggtgttgagcacaggctcgaagcagcatgcaacttcactcgtggcga

SEQ ID NO: 124446 - DNA, 75 bp, Artificial Sequence
  Synthetic
catcttcaaaatacggatgttggtggggggtgttgagcacaggctcgaagcagcatgcaacttcactcgtgggga

SEQ ID NO: 124447 - DNA, 75 bp, Artificial Sequence
  Synthetic
catcttcaaaatacggatgttggtggggggtgttgagcacaggctcgaagcagcttgcaacttcactcgtggaga

SEQ ID NO: 124448 - DNA, 75 bp, Artificial Sequence
  Synthetic
catcttcaaaatacggatgttggtggggggtgttgagcacaggctcgaagcagcttgcaacttcactcgtggtga

SEQ ID NO: 124449 - DNA, 75 bp, Artificial Sequence
  Synthetic
catcttcaaaatacggatgttggtggggggtgttgagcacaggctcgaagcagcttgcaacttcactcgtggcga

SEQ ID NO: 124450 - DNA, 75 bp, Artificial Sequence
  Synthetic
catcttcaaaatacggatgttggtggggggtgttgagcacaggctcgaagcagcttgcaacttcactcgtgggga

SEQ ID NO: 124451 - DNA, 75 bp, Artificial Sequence
  Synthetic
catcttcaaaatacggatgttggtggggggtgttgagcacaggctcgaagcagcctgcaacttcactcgtggaga

SEQ ID NO: 124452 - DNA, 75 bp, Artificial Sequence
  Synthetic
catcttcaaaatacggatgttggtggggggtgttgagcacaggctcgaagcagcctgcaacttcactcgtggtga

SEQ ID NO: 124453 - DNA, 75 bp, Artificial Sequence
  Synthetic
catcttcaaaatacggatgttggtggggggtgttgagcacaggctcgaagcagcctgcaacttcactcgtggcga

SEQ ID NO: 124454 - DNA, 75 bp, Artificial Sequence
  Synthetic
catcttcaaaatacggatgttggtggggggtgttgagcacaggctcgaagcagcctgcaacttcactcgtgggga

SEQ ID NO: 124455 - DNA, 75 bp, Artificial Sequence
  Synthetic
catcttcaaaatacggatgttggtggggggtgttgagcacaggctcgaagcagcgtgcaacttcactcgtggaga

SEQ ID NO: 124456 - DNA, 75 bp, Artificial Sequence
  Synthetic
catcttcaaaatacggatgttggtggggggtgttgagcacaggctcgaagcagcgtgcaacttcactcgtggtga

SEQ ID NO: 124457 - DNA, 75 bp, Artificial Sequence
  Synthetic
catcttcaaaatacggatgttggtggggggtgttgagcacaggctcgaagcagcgtgcaacttcactcgtggcga

SEQ ID NO: 124458 - DNA, 75 bp, Artificial Sequence
  Synthetic
catcttcaaaatacggatgttggtggggggtgttgagcacaggctcgaagcagcgtgcaacttcactcgtgggga

SEQ ID NO: 124459 - DNA, 75 bp, Artificial Sequence
  Synthetic
aggtgtcaactaagcccattgctgcactccaccacagaatgggctatcctaccctgtacattctcagacctacca

SEQ ID NO: 124460 - DNA, 75 bp, Artificial Sequence
  Synthetic
aggtgtcaactaagcccattgctgcactccaccacagaatgggctatcctaccctgtactttctcagacctacca

SEQ ID NO: 124461 - DNA, 75 bp, Artificial Sequence
  Synthetic
aggtgtcaactaagcccattgctgcactccaccacagaatgggctatcctaccctgtaccttctcagacctacca

SEQ ID NO: 124462 - DNA, 75 bp, Artificial Sequence
  Synthetic
aggtgtcaactaagcccattgctgcactccaccacagaatgggctatcctaccctgtacgttctcagacctacca

SEQ ID NO: 124463 - DNA, 75 bp, Artificial Sequence
  Synthetic
aggtgtcaactaagcccattgctgcactccaccactgaatgggctatcctaccctgtacattctcagacctacca

SEQ ID NO: 124464 - DNA, 75 bp, Artificial Sequence
  Synthetic
aggtgtcaactaagcccattgctgcactccaccactgaatgggctatcctaccctgtactttctcagacctacca

SEQ ID NO: 124465 - DNA, 75 bp, Artificial Sequence
  Synthetic
aggtgtcaactaagcccattgctgcactccaccactgaatgggctatcctaccctgtaccttctcagacctacca

SEQ ID NO: 124466 - DNA, 75 bp, Artificial Sequence
  Synthetic
aggtgtcaactaagcccattgctgcactccaccactgaatgggctatcctaccctgtacgttctcagacctacca

SEQ ID NO: 124467 - DNA, 75 bp, Artificial Sequence
  Synthetic
aggtgtcaactaagcccattgctgcactccaccaccgaatgggctatcctaccctgtacattctcagacctacca

SEQ ID NO: 124468 - DNA, 75 bp, Artificial Sequence
  Synthetic
aggtgtcaactaagcccattgctgcactccaccaccgaatgggctatcctaccctgtactttctcagacctacca

SEQ ID NO: 124469 - DNA, 75 bp, Artificial Sequence
  Synthetic
aggtgtcaactaagcccattgctgcactccaccaccgaatgggctatcctaccctgtaccttctcagacctacca

SEQ ID NO: 124470 - DNA, 75 bp, Artificial Sequence
  Synthetic
aggtgtcaactaagcccattgctgcactccaccaccgaatgggctatcctaccctgtacgttctcagacctacca

SEQ ID NO: 124471 - DNA, 75 bp, Artificial Sequence
  Synthetic
aggtgtcaactaagcccattgctgcactccaccacggaatgggctatcctaccctgtacattctcagacctacca

SEQ ID NO: 124472 - DNA, 75 bp, Artificial Sequence
  Synthetic
aggtgtcaactaagcccattgctgcactccaccacggaatgggctatcctaccctgtactttctcagacctacca

SEQ ID NO: 124473 - DNA, 75 bp, Artificial Sequence
  Synthetic
aggtgtcaactaagcccattgctgcactccaccacggaatgggctatcctaccctgtaccttctcagacctacca

SEQ ID NO: 124474 - DNA, 75 bp, Artificial Sequence
  Synthetic
aggtgtcaactaagcccattgctgcactccaccacggaatgggctatcctaccctgtacgttctcagacctacca

SEQ ID NO: 124475 - DNA, 75 bp, Artificial Sequence
  Synthetic
aggtgtcatctaagcccattgctgcactccaccacagaatgggctatcctaccctgtacattctcagacctacca

SEQ ID NO: 124476 - DNA, 75 bp, Artificial Sequence
  Synthetic
aggtgtcatctaagcccattgctgcactccaccacagaatgggctatcctaccctgtactttctcagacctacca

SEQ ID NO: 124477 - DNA, 75 bp, Artificial Sequence
  Synthetic
aggtgtcatctaagcccattgctgcactccaccacagaatgggctatcctaccctgtaccttctcagacctacca

SEQ ID NO: 124478 - DNA, 75 bp, Artificial Sequence
  Synthetic
aggtgtcatctaagcccattgctgcactccaccacagaatgggctatcctaccctgtacgttctcagacctacca

SEQ ID NO: 124479 - DNA, 75 bp, Artificial Sequence
  Synthetic
aggtgtcatctaagcccattgctgcactccaccactgaatgggctatcctaccctgtacattctcagacctacca

SEQ ID NO: 124480 - DNA, 75 bp, Artificial Sequence
  Synthetic
aggtgtcatctaagcccattgctgcactccaccactgaatgggctatcctaccctgtactttctcagacctacca

SEQ ID NO: 124481 - DNA, 75 bp, Artificial Sequence
  Synthetic
aggtgtcatctaagcccattgctgcactccaccactgaatgggctatcctaccctgtaccttctcagacctacca

SEQ ID NO: 124482 - DNA, 75 bp, Artificial Sequence
  Synthetic
aggtgtcatctaagcccattgctgcactccaccactgaatgggctatcctaccctgtacgttctcagacctacca

SEQ ID NO: 124483 - DNA, 75 bp, Artificial Sequence
  Synthetic
aggtgtcatctaagcccattgctgcactccaccaccgaatgggctatcctaccctgtacattctcagacctacca

SEQ ID NO: 124484 - DNA, 75 bp, Artificial Sequence
  Synthetic
aggtgtcatctaagcccattgctgcactccaccaccgaatgggctatcctaccctgtactttctcagacctacca

SEQ ID NO: 124485 - DNA, 75 bp, Artificial Sequence
  Synthetic
aggtgtcatctaagcccattgctgcactccaccaccgaatgggctatcctaccctgtaccttctcagacctacca

SEQ ID NO: 124486 - DNA, 75 bp, Artificial Sequence
  Synthetic
aggtgtcatctaagcccattgctgcactccaccaccgaatgggctatcctaccctgtacgttctcagacctacca

SEQ ID NO: 124487 - DNA, 75 bp, Artificial Sequence
  Synthetic
aggtgtcatctaagcccattgctgcactccaccacggaatgggctatcctaccctgtacattctcagacctacca

SEQ ID NO: 124488 - DNA, 75 bp, Artificial Sequence
  Synthetic
aggtgtcatctaagcccattgctgcactccaccacggaatgggctatcctaccctgtactttctcagacctacca

SEQ ID NO: 124489 - DNA, 75 bp, Artificial Sequence
  Synthetic
aggtgtcatctaagcccattgctgcactccaccacggaatgggctatcctaccctgtaccttctcagacctacca

SEQ ID NO: 124490 - DNA, 75 bp, Artificial Sequence
  Synthetic
aggtgtcatctaagcccattgctgcactccaccacggaatgggctatcctaccctgtacgttctcagacctacca

SEQ ID NO: 124491 - DNA, 75 bp, Artificial Sequence
  Synthetic
aggtgtcacctaagcccattgctgcactccaccacagaatgggctatcctaccctgtacattctcagacctacca

SEQ ID NO: 124492 - DNA, 75 bp, Artificial Sequence
  Synthetic
aggtgtcacctaagcccattgctgcactccaccacagaatgggctatcctaccctgtactttctcagacctacca

SEQ ID NO: 124493 - DNA, 75 bp, Artificial Sequence
  Synthetic
aggtgtcacctaagcccattgctgcactccaccacagaatgggctatcctaccctgtaccttctcagacctacca

SEQ ID NO: 124494 - DNA, 75 bp, Artificial Sequence
  Synthetic
aggtgtcacctaagcccattgctgcactccaccacagaatgggctatcctaccctgtacgttctcagacctacca

SEQ ID NO: 124495 - DNA, 75 bp, Artificial Sequence
  Synthetic
aggtgtcacctaagcccattgctgcactccaccactgaatgggctatcctaccctgtacattctcagacctacca

SEQ ID NO: 124496 - DNA, 75 bp, Artificial Sequence
  Synthetic
aggtgtcacctaagcccattgctgcactccaccactgaatgggctatcctaccctgtactttctcagacctacca

SEQ ID NO: 124497 - DNA, 75 bp, Artificial Sequence
  Synthetic
aggtgtcacctaagcccattgctgcactccaccactgaatgggctatcctaccctgtaccttctcagacctacca

SEQ ID NO: 124498 - DNA, 75 bp, Artificial Sequence
  Synthetic
aggtgtcacctaagcccattgctgcactccaccactgaatgggctatcctaccctgtacgttctcagacctacca

SEQ ID NO: 124499 - DNA, 75 bp, Artificial Sequence
  Synthetic
aggtgtcacctaagcccattgctgcactccaccaccgaatgggctatcctaccctgtacattctcagacctacca

SEQ ID NO: 124500 - DNA, 75 bp, Artificial Sequence
  Synthetic
aggtgtcacctaagcccattgctgcactccaccaccgaatgggctatcctaccctgtactttctcagacctacca

SEQ ID NO: 124501 - DNA, 75 bp, Artificial Sequence
  Synthetic
aggtgtcacctaagcccattgctgcactccaccaccgaatgggctatcctaccctgtaccttctcagacctacca

SEQ ID NO: 124502 - DNA, 75 bp, Artificial Sequence
  Synthetic
aggtgtcacctaagcccattgctgcactccaccaccgaatgggctatcctaccctgtacgttctcagacctacca

SEQ ID NO: 124503 - DNA, 75 bp, Artificial Sequence
  Synthetic
aggtgtcacctaagcccattgctgcactccaccacggaatgggctatcctaccctgtacattctcagacctacca

SEQ ID NO: 124504 - DNA, 75 bp, Artificial Sequence
  Synthetic
aggtgtcacctaagcccattgctgcactccaccacggaatgggctatcctaccctgtactttctcagacctacca

SEQ ID NO: 124505 - DNA, 75 bp, Artificial Sequence
  Synthetic
aggtgtcacctaagcccattgctgcactccaccacggaatgggctatcctaccctgtaccttctcagacctacca

SEQ ID NO: 124506 - DNA, 75 bp, Artificial Sequence
  Synthetic
aggtgtcacctaagcccattgctgcactccaccacggaatgggctatcctaccctgtacgttctcagacctacca

SEQ ID NO: 124507 - DNA, 75 bp, Artificial Sequence
  Synthetic
aggtgtcagctaagcccattgctgcactccaccacagaatgggctatcctaccctgtacattctcagacctacca

SEQ ID NO: 124508 - DNA, 75 bp, Artificial Sequence
  Synthetic
aggtgtcagctaagcccattgctgcactccaccacagaatgggctatcctaccctgtactttctcagacctacca

SEQ ID NO: 124509 - DNA, 75 bp, Artificial Sequence
  Synthetic
aggtgtcagctaagcccattgctgcactccaccacagaatgggctatcctaccctgtaccttctcagacctacca

SEQ ID NO: 124510 - DNA, 75 bp, Artificial Sequence
  Synthetic
aggtgtcagctaagcccattgctgcactccaccacagaatgggctatcctaccctgtacgttctcagacctacca

SEQ ID NO: 124511 - DNA, 75 bp, Artificial Sequence
  Synthetic
aggtgtcagctaagcccattgctgcactccaccactgaatgggctatcctaccctgtacattctcagacctacca

SEQ ID NO: 124512 - DNA, 75 bp, Artificial Sequence
  Synthetic
aggtgtcagctaagcccattgctgcactccaccactgaatgggctatcctaccctgtactttctcagacctacca

SEQ ID NO: 124513 - DNA, 75 bp, Artificial Sequence
  Synthetic
aggtgtcagctaagcccattgctgcactccaccactgaatgggctatcctaccctgtaccttctcagacctacca

SEQ ID NO: 124514 - DNA, 75 bp, Artificial Sequence
  Synthetic
aggtgtcagctaagcccattgctgcactccaccactgaatgggctatcctaccctgtacgttctcagacctacca

SEQ ID NO: 124515 - DNA, 75 bp, Artificial Sequence
  Synthetic
aggtgtcagctaagcccattgctgcactccaccaccgaatgggctatcctaccctgtacattctcagacctacca

SEQ ID NO: 124516 - DNA, 75 bp, Artificial Sequence
  Synthetic
aggtgtcagctaagcccattgctgcactccaccaccgaatgggctatcctaccctgtactttctcagacctacca

SEQ ID NO: 124517 - DNA, 75 bp, Artificial Sequence
  Synthetic
aggtgtcagctaagcccattgctgcactccaccaccgaatgggctatcctaccctgtaccttctcagacctacca

SEQ ID NO: 124518 - DNA, 75 bp, Artificial Sequence
  Synthetic
aggtgtcagctaagcccattgctgcactccaccaccgaatgggctatcctaccctgtacgttctcagacctacca

SEQ ID NO: 124519 - DNA, 75 bp, Artificial Sequence
  Synthetic
aggtgtcagctaagcccattgctgcactccaccacggaatgggctatcctaccctgtacattctcagacctacca

SEQ ID NO: 124520 - DNA, 75 bp, Artificial Sequence
  Synthetic
aggtgtcagctaagcccattgctgcactccaccacggaatgggctatcctaccctgtactttctcagacctacca

SEQ ID NO: 124521 - DNA, 75 bp, Artificial Sequence
  Synthetic
aggtgtcagctaagcccattgctgcactccaccacggaatgggctatcctaccctgtaccttctcagacctacca

SEQ ID NO: 124522 - DNA, 75 bp, Artificial Sequence
  Synthetic
aggtgtcagctaagcccattgctgcactccaccacggaatgggctatcctaccctgtacgttctcagacctacca

SEQ ID NO: 124523 - DNA, 75 bp, Artificial Sequence
  Synthetic
gaggcggcggccgaggccgccatttcggaaacgagctccacttcttccatgcccccccttgagggggagccgggg

SEQ ID NO: 124524 - DNA, 75 bp, Artificial Sequence
  Synthetic
gaggcggcggccgaggccgccatttcggatacgagctccacttcttccatgcccccccttgagggggagccgggg

SEQ ID NO: 124525 - DNA, 75 bp, Artificial Sequence
  Synthetic
gaggcggcggccgaggccgccatttcggacacgagctccacttcttccatgcccccccttgagggggagccgggg

SEQ ID NO: 124526 - DNA, 75 bp, Artificial Sequence
  Synthetic
gaggcggcggccgaggccgccatttcggagacgagctccacttcttccatgcccccccttgagggggagccgggg

SEQ ID NO: 124527 - DNA, 75 bp, Artificial Sequence
  Synthetic
gggatgttctgggggggcttatgacatcattatatgtgatgaatgccattccacggatcccactacgatcctagg

SEQ ID NO: 124528 - DNA, 75 bp, Artificial Sequence
  Synthetic
aatggatagtcctcctattcctgctcttggcggaagccagggtctgcgcctgcctttggatgctcatactattgg

SEQ ID NO: 124529 - DNA, 75 bp, Artificial Sequence
  Synthetic
aatggatagtcctcctattcctgctcttggcggaagccagggtctgcgcctgcctttggatgctcattctattgg

SEQ ID NO: 124530 - DNA, 75 bp, Artificial Sequence
  Synthetic
aatggatagtcctcctattcctgctcttggcggaagccagggtctgcgcctgcctttggatgctcatcctattgg

SEQ ID NO: 124531 - DNA, 75 bp, Artificial Sequence
  Synthetic
aatggatagtcctcctattcctgctcttggcggaagccagggtctgcgcctgcctttggatgctcatgctattgg

SEQ ID NO: 124532 - DNA, 75 bp, Artificial Sequence
  Synthetic
aatggatagtcctcctattcctgctcttggcggatgccagggtctgcgcctgcctttggatgctcatactattgg

SEQ ID NO: 124533 - DNA, 75 bp, Artificial Sequence
  Synthetic
aatggatagtcctcctattcctgctcttggcggatgccagggtctgcgcctgcctttggatgctcattctattgg

SEQ ID NO: 124534 - DNA, 75 bp, Artificial Sequence
  Synthetic
aatggatagtcctcctattcctgctcttggcggatgccagggtctgcgcctgcctttggatgctcatcctattgg

SEQ ID NO: 124535 - DNA, 75 bp, Artificial Sequence
  Synthetic
aatggatagtcctcctattcctgctcttggcggatgccagggtctgcgcctgcctttggatgctcatgctattgg

SEQ ID NO: 124536 - DNA, 75 bp, Artificial Sequence
  Synthetic
aatggatagtcctcctattcctgctcttggcggacgccagggtctgcgcctgcctttggatgctcatactattgg

SEQ ID NO: 124537 - DNA, 75 bp, Artificial Sequence
  Synthetic
aatggatagtcctcctattcctgctcttggcggacgccagggtctgcgcctgcctttggatgctcattctattgg

SEQ ID NO: 124538 - DNA, 75 bp, Artificial Sequence
  Synthetic
aatggatagtcctcctattcctgctcttggcggacgccagggtctgcgcctgcctttggatgctcatcctattgg

SEQ ID NO: 124539 - DNA, 75 bp, Artificial Sequence
  Synthetic
aatggatagtcctcctattcctgctcttggcggacgccagggtctgcgcctgcctttggatgctcatgctattgg

SEQ ID NO: 124540 - DNA, 75 bp, Artificial Sequence
  Synthetic
aatggatagtcctcctattcctgctcttggcggaggccagggtctgcgcctgcctttggatgctcatactattgg

SEQ ID NO: 124541 - DNA, 75 bp, Artificial Sequence
  Synthetic
aatggatagtcctcctattcctgctcttggcggaggccagggtctgcgcctgcctttggatgctcattctattgg

SEQ ID NO: 124542 - DNA, 75 bp, Artificial Sequence
  Synthetic
aatggatagtcctcctattcctgctcttggcggaggccagggtctgcgcctgcctttggatgctcatcctattgg

SEQ ID NO: 124543 - DNA, 75 bp, Artificial Sequence
  Synthetic
aatggatagtcctcctattcctgctcttggcggaggccagggtctgcgcctgcctttggatgctcatgctattgg

SEQ ID NO: 124544 - DNA, 75 bp, Artificial Sequence
  Synthetic
aatggattgtcctcctattcctgctcttggcggaagccagggtctgcgcctgcctttggatgctcatactattgg

SEQ ID NO: 124545 - DNA, 75 bp, Artificial Sequence
  Synthetic
aatggattgtcctcctattcctgctcttggcggaagccagggtctgcgcctgcctttggatgctcattctattgg

SEQ ID NO: 124546 - DNA, 75 bp, Artificial Sequence
  Synthetic
aatggattgtcctcctattcctgctcttggcggaagccagggtctgcgcctgcctttggatgctcatcctattgg

SEQ ID NO: 124547 - DNA, 75 bp, Artificial Sequence
  Synthetic
aatggattgtcctcctattcctgctcttggcggaagccagggtctgcgcctgcctttggatgctcatgctattgg

SEQ ID NO: 124548 - DNA, 75 bp, Artificial Sequence
  Synthetic
aatggattgtcctcctattcctgctcttggcggatgccagggtctgcgcctgcctttggatgctcatactattgg

SEQ ID NO: 124549 - DNA, 75 bp, Artificial Sequence
  Synthetic
aatggattgtcctcctattcctgctcttggcggatgccagggtctgcgcctgcctttggatgctcattctattgg

SEQ ID NO: 124550 - DNA, 75 bp, Artificial Sequence
  Synthetic
aatggattgtcctcctattcctgctcttggcggatgccagggtctgcgcctgcctttggatgctcatcctattgg

SEQ ID NO: 124551 - DNA, 75 bp, Artificial Sequence
  Synthetic
aatggattgtcctcctattcctgctcttggcggatgccagggtctgcgcctgcctttggatgctcatgctattgg

SEQ ID NO: 124552 - DNA, 75 bp, Artificial Sequence
  Synthetic
aatggattgtcctcctattcctgctcttggcggacgccagggtctgcgcctgcctttggatgctcatactattgg

SEQ ID NO: 124553 - DNA, 75 bp, Artificial Sequence
  Synthetic
aatggattgtcctcctattcctgctcttggcggacgccagggtctgcgcctgcctttggatgctcattctattgg

SEQ ID NO: 124554 - DNA, 75 bp, Artificial Sequence
  Synthetic
aatggattgtcctcctattcctgctcttggcggacgccagggtctgcgcctgcctttggatgctcatcctattgg

SEQ ID NO: 124555 - DNA, 75 bp, Artificial Sequence
  Synthetic
aatggattgtcctcctattcctgctcttggcggacgccagggtctgcgcctgcctttggatgctcatgctattgg

SEQ ID NO: 124556 - DNA, 75 bp, Artificial Sequence
  Synthetic
aatggattgtcctcctattcctgctcttggcggaggccagggtctgcgcctgcctttggatgctcatactattgg

SEQ ID NO: 124557 - DNA, 75 bp, Artificial Sequence
  Synthetic
aatggattgtcctcctattcctgctcttggcggaggccagggtctgcgcctgcctttggatgctcattctattgg

SEQ ID NO: 124558 - DNA, 75 bp, Artificial Sequence
  Synthetic
aatggattgtcctcctattcctgctcttggcggaggccagggtctgcgcctgcctttggatgctcatcctattgg

SEQ ID NO: 124559 - DNA, 75 bp, Artificial Sequence
  Synthetic
aatggattgtcctcctattcctgctcttggcggaggccagggtctgcgcctgcctttggatgctcatgctattgg

SEQ ID NO: 124560 - DNA, 75 bp, Artificial Sequence
  Synthetic
aatggatcgtcctcctattcctgctcttggcggaagccagggtctgcgcctgcctttggatgctcatactattgg

SEQ ID NO: 124561 - DNA, 75 bp, Artificial Sequence
  Synthetic
aatggatcgtcctcctattcctgctcttggcggaagccagggtctgcgcctgcctttggatgctcattctattgg

SEQ ID NO: 124562 - DNA, 75 bp, Artificial Sequence
  Synthetic
aatggatcgtcctcctattcctgctcttggcggaagccagggtctgcgcctgcctttggatgctcatcctattgg

SEQ ID NO: 124563 - DNA, 75 bp, Artificial Sequence
  Synthetic
aatggatcgtcctcctattcctgctcttggcggaagccagggtctgcgcctgcctttggatgctcatgctattgg

SEQ ID NO: 124564 - DNA, 75 bp, Artificial Sequence
  Synthetic
aatggatcgtcctcctattcctgctcttggcggatgccagggtctgcgcctgcctttggatgctcatactattgg

SEQ ID NO: 124565 - DNA, 75 bp, Artificial Sequence
  Synthetic
aatggatcgtcctcctattcctgctcttggcggatgccagggtctgcgcctgcctttggatgctcattctattgg

SEQ ID NO: 124566 - DNA, 75 bp, Artificial Sequence
  Synthetic
aatggatcgtcctcctattcctgctcttggcggatgccagggtctgcgcctgcctttggatgctcatcctattgg

SEQ ID NO: 124567 - DNA, 75 bp, Artificial Sequence
  Synthetic
aatggatcgtcctcctattcctgctcttggcggatgccagggtctgcgcctgcctttggatgctcatgctattgg

SEQ ID NO: 124568 - DNA, 75 bp, Artificial Sequence
  Synthetic
aatggatcgtcctcctattcctgctcttggcggacgccagggtctgcgcctgcctttggatgctcatactattgg

SEQ ID NO: 124569 - DNA, 75 bp, Artificial Sequence
  Synthetic
aatggatcgtcctcctattcctgctcttggcggacgccagggtctgcgcctgcctttggatgctcattctattgg

SEQ ID NO: 124570 - DNA, 75 bp, Artificial Sequence
  Synthetic
aatggatcgtcctcctattcctgctcttggcggacgccagggtctgcgcctgcctttggatgctcatcctattgg

SEQ ID NO: 124571 - DNA, 75 bp, Artificial Sequence
  Synthetic
aatggatcgtcctcctattcctgctcttggcggacgccagggtctgcgcctgcctttggatgctcatgctattgg

SEQ ID NO: 124572 - DNA, 75 bp, Artificial Sequence
  Synthetic
aatggatcgtcctcctattcctgctcttggcggaggccagggtctgcgcctgcctttggatgctcatactattgg

SEQ ID NO: 124573 - DNA, 75 bp, Artificial Sequence
  Synthetic
aatggatcgtcctcctattcctgctcttggcggaggccagggtctgcgcctgcctttggatgctcattctattgg

SEQ ID NO: 124574 - DNA, 75 bp, Artificial Sequence
  Synthetic
aatggatcgtcctcctattcctgctcttggcggaggccagggtctgcgcctgcctttggatgctcatcctattgg

SEQ ID NO: 124575 - DNA, 75 bp, Artificial Sequence
  Synthetic
aatggatcgtcctcctattcctgctcttggcggaggccagggtctgcgcctgcctttggatgctcatgctattgg

SEQ ID NO: 124576 - DNA, 75 bp, Artificial Sequence
  Synthetic
aatggatggtcctcctattcctgctcttggcggaagccagggtctgcgcctgcctttggatgctcatactattgg

SEQ ID NO: 124577 - DNA, 75 bp, Artificial Sequence
  Synthetic
aatggatggtcctcctattcctgctcttggcggaagccagggtctgcgcctgcctttggatgctcattctattgg

SEQ ID NO: 124578 - DNA, 75 bp, Artificial Sequence
  Synthetic
aatggatggtcctcctattcctgctcttggcggaagccagggtctgcgcctgcctttggatgctcatcctattgg

SEQ ID NO: 124579 - DNA, 75 bp, Artificial Sequence
  Synthetic
aatggatggtcctcctattcctgctcttggcggaagccagggtctgcgcctgcctttggatgctcatgctattgg

SEQ ID NO: 124580 - DNA, 75 bp, Artificial Sequence
  Synthetic
aatggatggtcctcctattcctgctcttggcggatgccagggtctgcgcctgcctttggatgctcatactattgg

SEQ ID NO: 124581 - DNA, 75 bp, Artificial Sequence
  Synthetic
aatggatggtcctcctattcctgctcttggcggatgccagggtctgcgcctgcctttggatgctcattctattgg

SEQ ID NO: 124582 - DNA, 75 bp, Artificial Sequence
  Synthetic
aatggatggtcctcctattcctgctcttggcggatgccagggtctgcgcctgcctttggatgctcatcctattgg

SEQ ID NO: 124583 - DNA, 75 bp, Artificial Sequence
  Synthetic
aatggatggtcctcctattcctgctcttggcggatgccagggtctgcgcctgcctttggatgctcatgctattgg

SEQ ID NO: 124584 - DNA, 75 bp, Artificial Sequence
  Synthetic
aatggatggtcctcctattcctgctcttggcggacgccagggtctgcgcctgcctttggatgctcatactattgg

SEQ ID NO: 124585 - DNA, 75 bp, Artificial Sequence
  Synthetic
aatggatggtcctcctattcctgctcttggcggacgccagggtctgcgcctgcctttggatgctcattctattgg

SEQ ID NO: 124586 - DNA, 75 bp, Artificial Sequence
  Synthetic
aatggatggtcctcctattcctgctcttggcggacgccagggtctgcgcctgcctttggatgctcatcctattgg

SEQ ID NO: 124587 - DNA, 75 bp, Artificial Sequence
  Synthetic
aatggatggtcctcctattcctgctcttggcggacgccagggtctgcgcctgcctttggatgctcatgctattgg

SEQ ID NO: 124588 - DNA, 75 bp, Artificial Sequence
  Synthetic
aatggatggtcctcctattcctgctcttggcggaggccagggtctgcgcctgcctttggatgctcatactattgg

SEQ ID NO: 124589 - DNA, 75 bp, Artificial Sequence
  Synthetic
aatggatggtcctcctattcctgctcttggcggaggccagggtctgcgcctgcctttggatgctcattctattgg

SEQ ID NO: 124590 - DNA, 75 bp, Artificial Sequence
  Synthetic
aatggatggtcctcctattcctgctcttggcggaggccagggtctgcgcctgcctttggatgctcatcctattgg

SEQ ID NO: 124591 - DNA, 75 bp, Artificial Sequence
  Synthetic
aatggatggtcctcctattcctgctcttggcggaggccagggtctgcgcctgcctttggatgctcatgctattgg

SEQ ID NO: 124592 - DNA, 75 bp, Artificial Sequence
  Synthetic
atgaagacgactccgtcatatgctgttccatgtcgtactcctggaccggggctctaatcaccccttgtggaccgg

SEQ ID NO: 124593 - DNA, 75 bp, Artificial Sequence
  Synthetic
atcacagaagtagccctgcccacgacaggggagatccccttctatgggaaggggatcccgcttgattacatcaaa

SEQ ID NO: 124594 - DNA, 75 bp, Artificial Sequence
  Synthetic
atcacagaagttgccctgcccacgacaggggagatccccttctatgggaaggggatcccgcttgattacatcaaa

SEQ ID NO: 124595 - DNA, 75 bp, Artificial Sequence
  Synthetic
atcacagaagtcgccctgcccacgacaggggagatccccttctatgggaaggggatcccgcttgattacatcaaa

SEQ ID NO: 124596 - DNA, 75 bp, Artificial Sequence
  Synthetic
atcacagaagtggccctgcccacgacaggggagatccccttctatgggaaggggatcccgcttgattacatcaaa

SEQ ID NO: 124597 - DNA, 75 bp, Artificial Sequence
  Synthetic
gtggcaaatcaagggtcgcgcggtcccaatggcaacgtattccatgctaggatgctggtcatttgtcctgctact

SEQ ID NO: 124598 - DNA, 75 bp, Artificial Sequence
  Synthetic
gtggcaaatcaagggtcgcgcggtcccaatggcaacgtattccatgctaggatgctggtcttttgtcctgctact

SEQ ID NO: 124599 - DNA, 75 bp, Artificial Sequence
  Synthetic
gtggcaaatcaagggtcgcgcggtcccaatggcaacgtattccatgctaggatgctggtcctttgtcctgctact

SEQ ID NO: 124600 - DNA, 75 bp, Artificial Sequence
  Synthetic
gtggcaaatcaagggtcgcgcggtcccaatggcaacgtattccatgctaggatgctggtcgtttgtcctgctact

SEQ ID NO: 124601 - DNA, 75 bp, Artificial Sequence
  Synthetic
gtggcaaatcaagggtcgcgcggtcccaatggcaacgtattccttgctaggatgctggtcatttgtcctgctact

SEQ ID NO: 124602 - DNA, 75 bp, Artificial Sequence
  Synthetic
gtggcaaatcaagggtcgcgcggtcccaatggcaacgtattccttgctaggatgctggtcttttgtcctgctact

SEQ ID NO: 124603 - DNA, 75 bp, Artificial Sequence
  Synthetic
gtggcaaatcaagggtcgcgcggtcccaatggcaacgtattccttgctaggatgctggtcctttgtcctgctact

SEQ ID NO: 124604 - DNA, 75 bp, Artificial Sequence
  Synthetic
gtggcaaatcaagggtcgcgcggtcccaatggcaacgtattccttgctaggatgctggtcgtttgtcctgctact

SEQ ID NO: 124605 - DNA, 75 bp, Artificial Sequence
  Synthetic
gtggcaaatcaagggtcgcgcggtcccaatggcaacgtattccctgctaggatgctggtcatttgtcctgctact

SEQ ID NO: 124606 - DNA, 75 bp, Artificial Sequence
  Synthetic
gtggcaaatcaagggtcgcgcggtcccaatggcaacgtattccctgctaggatgctggtcttttgtcctgctact

SEQ ID NO: 124607 - DNA, 75 bp, Artificial Sequence
  Synthetic
gtggcaaatcaagggtcgcgcggtcccaatggcaacgtattccctgctaggatgctggtcctttgtcctgctact

SEQ ID NO: 124608 - DNA, 75 bp, Artificial Sequence
  Synthetic
gtggcaaatcaagggtcgcgcggtcccaatggcaacgtattccctgctaggatgctggtcgtttgtcctgctact

SEQ ID NO: 124609 - DNA, 75 bp, Artificial Sequence
  Synthetic
gtggcaaatcaagggtcgcgcggtcccaatggcaacgtattccgtgctaggatgctggtcatttgtcctgctact

SEQ ID NO: 124610 - DNA, 75 bp, Artificial Sequence
  Synthetic
gtggcaaatcaagggtcgcgcggtcccaatggcaacgtattccgtgctaggatgctggtcttttgtcctgctact

SEQ ID NO: 124611 - DNA, 75 bp, Artificial Sequence
  Synthetic
gtggcaaatcaagggtcgcgcggtcccaatggcaacgtattccgtgctaggatgctggtcctttgtcctgctact

SEQ ID NO: 124612 - DNA, 75 bp, Artificial Sequence
  Synthetic
gtggcaaatcaagggtcgcgcggtcccaatggcaacgtattccgtgctaggatgctggtcgtttgtcctgctact

SEQ ID NO: 124613 - DNA, 75 bp, Artificial Sequence
  Synthetic
gtggcatatcaagggtcgcgcggtcccaatggcaacgtattccatgctaggatgctggtcatttgtcctgctact

SEQ ID NO: 124614 - DNA, 75 bp, Artificial Sequence
  Synthetic
gtggcatatcaagggtcgcgcggtcccaatggcaacgtattccatgctaggatgctggtcttttgtcctgctact

SEQ ID NO: 124615 - DNA, 75 bp, Artificial Sequence
  Synthetic
gtggcatatcaagggtcgcgcggtcccaatggcaacgtattccatgctaggatgctggtcctttgtcctgctact

SEQ ID NO: 124616 - DNA, 75 bp, Artificial Sequence
  Synthetic
gtggcatatcaagggtcgcgcggtcccaatggcaacgtattccatgctaggatgctggtcgtttgtcctgctact

SEQ ID NO: 124617 - DNA, 75 bp, Artificial Sequence
  Synthetic
gtggcatatcaagggtcgcgcggtcccaatggcaacgtattccttgctaggatgctggtcatttgtcctgctact

SEQ ID NO: 124618 - DNA, 75 bp, Artificial Sequence
  Synthetic
gtggcatatcaagggtcgcgcggtcccaatggcaacgtattccttgctaggatgctggtcttttgtcctgctact

SEQ ID NO: 124619 - DNA, 75 bp, Artificial Sequence
  Synthetic
gtggcatatcaagggtcgcgcggtcccaatggcaacgtattccttgctaggatgctggtcctttgtcctgctact

SEQ ID NO: 124620 - DNA, 75 bp, Artificial Sequence
  Synthetic
gtggcatatcaagggtcgcgcggtcccaatggcaacgtattccttgctaggatgctggtcgtttgtcctgctact

SEQ ID NO: 124621 - DNA, 75 bp, Artificial Sequence
  Synthetic
gtggcatatcaagggtcgcgcggtcccaatggcaacgtattccctgctaggatgctggtcatttgtcctgctact

SEQ ID NO: 124622 - DNA, 75 bp, Artificial Sequence
  Synthetic
gtggcatatcaagggtcgcgcggtcccaatggcaacgtattccctgctaggatgctggtcttttgtcctgctact

SEQ ID NO: 124623 - DNA, 75 bp, Artificial Sequence
  Synthetic
gtggcatatcaagggtcgcgcggtcccaatggcaacgtattccctgctaggatgctggtcctttgtcctgctact

SEQ ID NO: 124624 - DNA, 75 bp, Artificial Sequence
  Synthetic
gtggcatatcaagggtcgcgcggtcccaatggcaacgtattccctgctaggatgctggtcgtttgtcctgctact

SEQ ID NO: 124625 - DNA, 75 bp, Artificial Sequence
  Synthetic
gtggcatatcaagggtcgcgcggtcccaatggcaacgtattccgtgctaggatgctggtcatttgtcctgctact

SEQ ID NO: 124626 - DNA, 75 bp, Artificial Sequence
  Synthetic
gtggcatatcaagggtcgcgcggtcccaatggcaacgtattccgtgctaggatgctggtcttttgtcctgctact

SEQ ID NO: 124627 - DNA, 75 bp, Artificial Sequence
  Synthetic
gtggcatatcaagggtcgcgcggtcccaatggcaacgtattccgtgctaggatgctggtcctttgtcctgctact

SEQ ID NO: 124628 - DNA, 75 bp, Artificial Sequence
  Synthetic
gtggcatatcaagggtcgcgcggtcccaatggcaacgtattccgtgctaggatgctggtcgtttgtcctgctact

SEQ ID NO: 124629 - DNA, 75 bp, Artificial Sequence
  Synthetic
gtggcacatcaagggtcgcgcggtcccaatggcaacgtattccatgctaggatgctggtcatttgtcctgctact

SEQ ID NO: 124630 - DNA, 75 bp, Artificial Sequence
  Synthetic
gtggcacatcaagggtcgcgcggtcccaatggcaacgtattccatgctaggatgctggtcttttgtcctgctact

SEQ ID NO: 124631 - DNA, 75 bp, Artificial Sequence
  Synthetic
gtggcacatcaagggtcgcgcggtcccaatggcaacgtattccatgctaggatgctggtcctttgtcctgctact

SEQ ID NO: 124632 - DNA, 75 bp, Artificial Sequence
  Synthetic
gtggcacatcaagggtcgcgcggtcccaatggcaacgtattccatgctaggatgctggtcgtttgtcctgctact

SEQ ID NO: 124633 - DNA, 75 bp, Artificial Sequence
  Synthetic
gtggcacatcaagggtcgcgcggtcccaatggcaacgtattccttgctaggatgctggtcatttgtcctgctact

SEQ ID NO: 124634 - DNA, 75 bp, Artificial Sequence
  Synthetic
gtggcacatcaagggtcgcgcggtcccaatggcaacgtattccttgctaggatgctggtcttttgtcctgctact

SEQ ID NO: 124635 - DNA, 75 bp, Artificial Sequence
  Synthetic
gtggcacatcaagggtcgcgcggtcccaatggcaacgtattccttgctaggatgctggtcctttgtcctgctact

SEQ ID NO: 124636 - DNA, 75 bp, Artificial Sequence
  Synthetic
gtggcacatcaagggtcgcgcggtcccaatggcaacgtattccttgctaggatgctggtcgtttgtcctgctact

SEQ ID NO: 124637 - DNA, 75 bp, Artificial Sequence
  Synthetic
gtggcacatcaagggtcgcgcggtcccaatggcaacgtattccctgctaggatgctggtcatttgtcctgctact

SEQ ID NO: 124638 - DNA, 75 bp, Artificial Sequence
  Synthetic
gtggcacatcaagggtcgcgcggtcccaatggcaacgtattccctgctaggatgctggtcttttgtcctgctact

SEQ ID NO: 124639 - DNA, 75 bp, Artificial Sequence
  Synthetic
gtggcacatcaagggtcgcgcggtcccaatggcaacgtattccctgctaggatgctggtcctttgtcctgctact

SEQ ID NO: 124640 - DNA, 75 bp, Artificial Sequence
  Synthetic
gtggcacatcaagggtcgcgcggtcccaatggcaacgtattccctgctaggatgctggtcgtttgtcctgctact

SEQ ID NO: 124641 - DNA, 75 bp, Artificial Sequence
  Synthetic
gtggcacatcaagggtcgcgcggtcccaatggcaacgtattccgtgctaggatgctggtcatttgtcctgctact

SEQ ID NO: 124642 - DNA, 75 bp, Artificial Sequence
  Synthetic
gtggcacatcaagggtcgcgcggtcccaatggcaacgtattccgtgctaggatgctggtcttttgtcctgctact

SEQ ID NO: 124643 - DNA, 75 bp, Artificial Sequence
  Synthetic
gtggcacatcaagggtcgcgcggtcccaatggcaacgtattccgtgctaggatgctggtcctttgtcctgctact

SEQ ID NO: 124644 - DNA, 75 bp, Artificial Sequence
  Synthetic
gtggcacatcaagggtcgcgcggtcccaatggcaacgtattccgtgctaggatgctggtcgtttgtcctgctact

SEQ ID NO: 124645 - DNA, 75 bp, Artificial Sequence
  Synthetic
gtggcagatcaagggtcgcgcggtcccaatggcaacgtattccatgctaggatgctggtcatttgtcctgctact

SEQ ID NO: 124646 - DNA, 75 bp, Artificial Sequence
  Synthetic
gtggcagatcaagggtcgcgcggtcccaatggcaacgtattccatgctaggatgctggtcttttgtcctgctact

SEQ ID NO: 124647 - DNA, 75 bp, Artificial Sequence
  Synthetic
gtggcagatcaagggtcgcgcggtcccaatggcaacgtattccatgctaggatgctggtcctttgtcctgctact

SEQ ID NO: 124648 - DNA, 75 bp, Artificial Sequence
  Synthetic
gtggcagatcaagggtcgcgcggtcccaatggcaacgtattccatgctaggatgctggtcgtttgtcctgctact

SEQ ID NO: 124649 - DNA, 75 bp, Artificial Sequence
  Synthetic
gtggcagatcaagggtcgcgcggtcccaatggcaacgtattccttgctaggatgctggtcatttgtcctgctact

SEQ ID NO: 124650 - DNA, 75 bp, Artificial Sequence
  Synthetic
gtggcagatcaagggtcgcgcggtcccaatggcaacgtattccttgctaggatgctggtcttttgtcctgctact

SEQ ID NO: 124651 - DNA, 75 bp, Artificial Sequence
  Synthetic
gtggcagatcaagggtcgcgcggtcccaatggcaacgtattccttgctaggatgctggtcctttgtcctgctact

SEQ ID NO: 124652 - DNA, 75 bp, Artificial Sequence
  Synthetic
gtggcagatcaagggtcgcgcggtcccaatggcaacgtattccttgctaggatgctggtcgtttgtcctgctact

SEQ ID NO: 124653 - DNA, 75 bp, Artificial Sequence
  Synthetic
gtggcagatcaagggtcgcgcggtcccaatggcaacgtattccctgctaggatgctggtcatttgtcctgctact

SEQ ID NO: 124654 - DNA, 75 bp, Artificial Sequence
  Synthetic
gtggcagatcaagggtcgcgcggtcccaatggcaacgtattccctgctaggatgctggtcttttgtcctgctact

SEQ ID NO: 124655 - DNA, 75 bp, Artificial Sequence
  Synthetic
gtggcagatcaagggtcgcgcggtcccaatggcaacgtattccctgctaggatgctggtcctttgtcctgctact

SEQ ID NO: 124656 - DNA, 75 bp, Artificial Sequence
  Synthetic
gtggcagatcaagggtcgcgcggtcccaatggcaacgtattccctgctaggatgctggtcgtttgtcctgctact

SEQ ID NO: 124657 - DNA, 75 bp, Artificial Sequence
  Synthetic
gtggcagatcaagggtcgcgcggtcccaatggcaacgtattccgtgctaggatgctggtcatttgtcctgctact

SEQ ID NO: 124658 - DNA, 75 bp, Artificial Sequence
  Synthetic
gtggcagatcaagggtcgcgcggtcccaatggcaacgtattccgtgctaggatgctggtcttttgtcctgctact

SEQ ID NO: 124659 - DNA, 75 bp, Artificial Sequence
  Synthetic
gtggcagatcaagggtcgcgcggtcccaatggcaacgtattccgtgctaggatgctggtcctttgtcctgctact

SEQ ID NO: 124660 - DNA, 75 bp, Artificial Sequence
  Synthetic
gtggcagatcaagggtcgcgcggtcccaatggcaacgtattccgtgctaggatgctggtcgtttgtcctgctact

SEQ ID NO: 124661 - DNA, 75 bp, Artificial Sequence
  Synthetic
aaaggtaacttttgacagggtacagctgcttgactctcactatgactcagtgctaaaggacattaagctagcggc

SEQ ID NO: 124662 - DNA, 75 bp, Artificial Sequence
  Synthetic
gcgtcgacgtggcagttattcctgcagatggcgacgtagttgtctgcgccacagatgccctcatgactgggtata

SEQ ID NO: 124663 - DNA, 75 bp, Artificial Sequence
  Synthetic
gcgtcgacgtggctgttattcctgcagatggcgacgtagttgtctgcgccacagatgccctcatgactgggtata

SEQ ID NO: 124664 - DNA, 75 bp, Artificial Sequence
  Synthetic
gcgtcgacgtggccgttattcctgcagatggcgacgtagttgtctgcgccacagatgccctcatgactgggtata

SEQ ID NO: 124665 - DNA, 75 bp, Artificial Sequence
  Synthetic
gcgtcgacgtggcggttattcctgcagatggcgacgtagttgtctgcgccacagatgccctcatgactgggtata

SEQ ID NO: 124666 - DNA, 75 bp, Artificial Sequence
  Synthetic
gccttctgtaccatcagagtacttgatcaggaggaggaagttcccaccggcactacctccctgggcccgtccaga

SEQ ID NO: 124667 - DNA, 75 bp, Artificial Sequence
  Synthetic
cgggcatacgcactggacacggaggtggccgcgtcgtgtggcggcgttgttcttgtcgggttaatggcgctgact

SEQ ID NO: 124668 - DNA, 75 bp, Artificial Sequence
  Synthetic
gcccttgagatggcagagcaaggccagataggcatggtgttaatagtcatcataaccgccttcacgatcacaccc

SEQ ID NO: 124669 - DNA, 75 bp, Artificial Sequence
  Synthetic
gcccttgagatggcagagcaaggccagataggcatggtgttaattgtcatcataaccgccttcacgatcacaccc

SEQ ID NO: 124670 - DNA, 75 bp, Artificial Sequence
  Synthetic
gcccttgagatggcagagcaaggccagataggcatggtgttaatcgtcatcataaccgccttcacgatcacaccc

SEQ ID NO: 124671 - DNA, 75 bp, Artificial Sequence
  Synthetic
gcccttgagatggcagagcaaggccagataggcatggtgttaatggtcatcataaccgccttcacgatcacaccc

SEQ ID NO: 124672 - DNA, 75 bp, Artificial Sequence
  Synthetic
gcccttgagatggcagagcaaggccagataggcttggtgttaatagtcatcataaccgccttcacgatcacaccc

SEQ ID NO: 124673 - DNA, 75 bp, Artificial Sequence
  Synthetic
gcccttgagatggcagagcaaggccagataggcttggtgttaattgtcatcataaccgccttcacgatcacaccc

SEQ ID NO: 124674 - DNA, 75 bp, Artificial Sequence
  Synthetic
gcccttgagatggcagagcaaggccagataggcttggtgttaatcgtcatcataaccgccttcacgatcacaccc

SEQ ID NO: 124675 - DNA, 75 bp, Artificial Sequence
  Synthetic
gcccttgagatggcagagcaaggccagataggcttggtgttaatggtcatcataaccgccttcacgatcacaccc

SEQ ID NO: 124676 - DNA, 75 bp, Artificial Sequence
  Synthetic
gcccttgagatggcagagcaaggccagataggcctggtgttaatagtcatcataaccgccttcacgatcacaccc

SEQ ID NO: 124677 - DNA, 75 bp, Artificial Sequence
  Synthetic
gcccttgagatggcagagcaaggccagataggcctggtgttaattgtcatcataaccgccttcacgatcacaccc

SEQ ID NO: 124678 - DNA, 75 bp, Artificial Sequence
  Synthetic
gcccttgagatggcagagcaaggccagataggcctggtgttaatcgtcatcataaccgccttcacgatcacaccc

SEQ ID NO: 124679 - DNA, 75 bp, Artificial Sequence
  Synthetic
gcccttgagatggcagagcaaggccagataggcctggtgttaatggtcatcataaccgccttcacgatcacaccc

SEQ ID NO: 124680 - DNA, 75 bp, Artificial Sequence
  Synthetic
gcccttgagatggcagagcaaggccagataggcgtggtgttaatagtcatcataaccgccttcacgatcacaccc

SEQ ID NO: 124681 - DNA, 75 bp, Artificial Sequence
  Synthetic
gcccttgagatggcagagcaaggccagataggcgtggtgttaattgtcatcataaccgccttcacgatcacaccc

SEQ ID NO: 124682 - DNA, 75 bp, Artificial Sequence
  Synthetic
gcccttgagatggcagagcaaggccagataggcgtggtgttaatcgtcatcataaccgccttcacgatcacaccc

SEQ ID NO: 124683 - DNA, 75 bp, Artificial Sequence
  Synthetic
gcccttgagatggcagagcaaggccagataggcgtggtgttaatggtcatcataaccgccttcacgatcacaccc

SEQ ID NO: 124684 - DNA, 75 bp, Artificial Sequence
  Synthetic
gcccttgagatggcagagcaaggccagattggcatggtgttaatagtcatcataaccgccttcacgatcacaccc

SEQ ID NO: 124685 - DNA, 75 bp, Artificial Sequence
  Synthetic
gcccttgagatggcagagcaaggccagattggcatggtgttaattgtcatcataaccgccttcacgatcacaccc

SEQ ID NO: 124686 - DNA, 75 bp, Artificial Sequence
  Synthetic
gcccttgagatggcagagcaaggccagattggcatggtgttaatcgtcatcataaccgccttcacgatcacaccc

SEQ ID NO: 124687 - DNA, 75 bp, Artificial Sequence
  Synthetic
gcccttgagatggcagagcaaggccagattggcatggtgttaatggtcatcataaccgccttcacgatcacaccc

SEQ ID NO: 124688 - DNA, 75 bp, Artificial Sequence
  Synthetic
gcccttgagatggcagagcaaggccagattggcttggtgttaatagtcatcataaccgccttcacgatcacaccc

SEQ ID NO: 124689 - DNA, 75 bp, Artificial Sequence
  Synthetic
gcccttgagatggcagagcaaggccagattggcttggtgttaattgtcatcataaccgccttcacgatcacaccc

SEQ ID NO: 124690 - DNA, 75 bp, Artificial Sequence
  Synthetic
gcccttgagatggcagagcaaggccagattggcttggtgttaatcgtcatcataaccgccttcacgatcacaccc

SEQ ID NO: 124691 - DNA, 75 bp, Artificial Sequence
  Synthetic
gcccttgagatggcagagcaaggccagattggcttggtgttaatggtcatcataaccgccttcacgatcacaccc

SEQ ID NO: 124692 - DNA, 75 bp, Artificial Sequence
  Synthetic
gcccttgagatggcagagcaaggccagattggcctggtgttaatagtcatcataaccgccttcacgatcacaccc

SEQ ID NO: 124693 - DNA, 75 bp, Artificial Sequence
  Synthetic
gcccttgagatggcagagcaaggccagattggcctggtgttaattgtcatcataaccgccttcacgatcacaccc

SEQ ID NO: 124694 - DNA, 75 bp, Artificial Sequence
  Synthetic
gcccttgagatggcagagcaaggccagattggcctggtgttaatcgtcatcataaccgccttcacgatcacaccc

SEQ ID NO: 124695 - DNA, 75 bp, Artificial Sequence
  Synthetic
gcccttgagatggcagagcaaggccagattggcctggtgttaatggtcatcataaccgccttcacgatcacaccc

SEQ ID NO: 124696 - DNA, 75 bp, Artificial Sequence
  Synthetic
gcccttgagatggcagagcaaggccagattggcgtggtgttaatagtcatcataaccgccttcacgatcacaccc

SEQ ID NO: 124697 - DNA, 75 bp, Artificial Sequence
  Synthetic
gcccttgagatggcagagcaaggccagattggcgtggtgttaattgtcatcataaccgccttcacgatcacaccc

SEQ ID NO: 124698 - DNA, 75 bp, Artificial Sequence
  Synthetic
gcccttgagatggcagagcaaggccagattggcgtggtgttaatcgtcatcataaccgccttcacgatcacaccc

SEQ ID NO: 124699 - DNA, 75 bp, Artificial Sequence
  Synthetic
gcccttgagatggcagagcaaggccagattggcgtggtgttaatggtcatcataaccgccttcacgatcacaccc

SEQ ID NO: 124700 - DNA, 75 bp, Artificial Sequence
  Synthetic
gcccttgagatggcagagcaaggccagatcggcatggtgttaatagtcatcataaccgccttcacgatcacaccc

SEQ ID NO: 124701 - DNA, 75 bp, Artificial Sequence
  Synthetic
gcccttgagatggcagagcaaggccagatcggcatggtgttaattgtcatcataaccgccttcacgatcacaccc

SEQ ID NO: 124702 - DNA, 75 bp, Artificial Sequence
  Synthetic
gcccttgagatggcagagcaaggccagatcggcatggtgttaatcgtcatcataaccgccttcacgatcacaccc

SEQ ID NO: 124703 - DNA, 75 bp, Artificial Sequence
  Synthetic
gcccttgagatggcagagcaaggccagatcggcatggtgttaatggtcatcataaccgccttcacgatcacaccc

SEQ ID NO: 124704 - DNA, 75 bp, Artificial Sequence
  Synthetic
gcccttgagatggcagagcaaggccagatcggcttggtgttaatagtcatcataaccgccttcacgatcacaccc

SEQ ID NO: 124705 - DNA, 75 bp, Artificial Sequence
  Synthetic
gcccttgagatggcagagcaaggccagatcggcttggtgttaattgtcatcataaccgccttcacgatcacaccc

SEQ ID NO: 124706 - DNA, 75 bp, Artificial Sequence
  Synthetic
gcccttgagatggcagagcaaggccagatcggcttggtgttaatcgtcatcataaccgccttcacgatcacaccc

SEQ ID NO: 124707 - DNA, 75 bp, Artificial Sequence
  Synthetic
gcccttgagatggcagagcaaggccagatcggcttggtgttaatggtcatcataaccgccttcacgatcacaccc

SEQ ID NO: 124708 - DNA, 75 bp, Artificial Sequence
  Synthetic
gcccttgagatggcagagcaaggccagatcggcctggtgttaatagtcatcataaccgccttcacgatcacaccc

SEQ ID NO: 124709 - DNA, 75 bp, Artificial Sequence
  Synthetic
gcccttgagatggcagagcaaggccagatcggcctggtgttaattgtcatcataaccgccttcacgatcacaccc

SEQ ID NO: 124710 - DNA, 75 bp, Artificial Sequence
  Synthetic
gcccttgagatggcagagcaaggccagatcggcctggtgttaatcgtcatcataaccgccttcacgatcacaccc

SEQ ID NO: 124711 - DNA, 75 bp, Artificial Sequence
  Synthetic
gcccttgagatggcagagcaaggccagatcggcctggtgttaatggtcatcataaccgccttcacgatcacaccc

SEQ ID NO: 124712 - DNA, 75 bp, Artificial Sequence
  Synthetic
gcccttgagatggcagagcaaggccagatcggcgtggtgttaatagtcatcataaccgccttcacgatcacaccc

SEQ ID NO: 124713 - DNA, 75 bp, Artificial Sequence
  Synthetic
gcccttgagatggcagagcaaggccagatcggcgtggtgttaattgtcatcataaccgccttcacgatcacaccc

SEQ ID NO: 124714 - DNA, 75 bp, Artificial Sequence
  Synthetic
gcccttgagatggcagagcaaggccagatcggcgtggtgttaatcgtcatcataaccgccttcacgatcacaccc

SEQ ID NO: 124715 - DNA, 75 bp, Artificial Sequence
  Synthetic
gcccttgagatggcagagcaaggccagatcggcgtggtgttaatggtcatcataaccgccttcacgatcacaccc

SEQ ID NO: 124716 - DNA, 75 bp, Artificial Sequence
  Synthetic
gcccttgagatggcagagcaaggccagatgggcatggtgttaatagtcatcataaccgccttcacgatcacaccc

SEQ ID NO: 124717 - DNA, 75 bp, Artificial Sequence
  Synthetic
gcccttgagatggcagagcaaggccagatgggcatggtgttaattgtcatcataaccgccttcacgatcacaccc

SEQ ID NO: 124718 - DNA, 75 bp, Artificial Sequence
  Synthetic
gcccttgagatggcagagcaaggccagatgggcatggtgttaatcgtcatcataaccgccttcacgatcacaccc

SEQ ID NO: 124719 - DNA, 75 bp, Artificial Sequence
  Synthetic
gcccttgagatggcagagcaaggccagatgggcatggtgttaatggtcatcataaccgccttcacgatcacaccc

SEQ ID NO: 124720 - DNA, 75 bp, Artificial Sequence
  Synthetic
gcccttgagatggcagagcaaggccagatgggcttggtgttaatagtcatcataaccgccttcacgatcacaccc

SEQ ID NO: 124721 - DNA, 75 bp, Artificial Sequence
  Synthetic
gcccttgagatggcagagcaaggccagatgggcttggtgttaattgtcatcataaccgccttcacgatcacaccc

SEQ ID NO: 124722 - DNA, 75 bp, Artificial Sequence
  Synthetic
gcccttgagatggcagagcaaggccagatgggcttggtgttaatcgtcatcataaccgccttcacgatcacaccc

SEQ ID NO: 124723 - DNA, 75 bp, Artificial Sequence
  Synthetic
gcccttgagatggcagagcaaggccagatgggcttggtgttaatggtcatcataaccgccttcacgatcacaccc

SEQ ID NO: 124724 - DNA, 75 bp, Artificial Sequence
  Synthetic
gcccttgagatggcagagcaaggccagatgggcctggtgttaatagtcatcataaccgccttcacgatcacaccc

SEQ ID NO: 124725 - DNA, 75 bp, Artificial Sequence
  Synthetic
gcccttgagatggcagagcaaggccagatgggcctggtgttaattgtcatcataaccgccttcacgatcacaccc

SEQ ID NO: 124726 - DNA, 75 bp, Artificial Sequence
  Synthetic
gcccttgagatggcagagcaaggccagatgggcctggtgttaatcgtcatcataaccgccttcacgatcacaccc

SEQ ID NO: 124727 - DNA, 75 bp, Artificial Sequence
  Synthetic
gcccttgagatggcagagcaaggccagatgggcctggtgttaatggtcatcataaccgccttcacgatcacaccc

SEQ ID NO: 124728 - DNA, 75 bp, Artificial Sequence
  Synthetic
gcccttgagatggcagagcaaggccagatgggcgtggtgttaatagtcatcataaccgccttcacgatcacaccc

SEQ ID NO: 124729 - DNA, 75 bp, Artificial Sequence
  Synthetic
gcccttgagatggcagagcaaggccagatgggcgtggtgttaattgtcatcataaccgccttcacgatcacaccc

SEQ ID NO: 124730 - DNA, 75 bp, Artificial Sequence
  Synthetic
gcccttgagatggcagagcaaggccagatgggcgtggtgttaatcgtcatcataaccgccttcacgatcacaccc

SEQ ID NO: 124731 - DNA, 75 bp, Artificial Sequence
  Synthetic
gcccttgagatggcagagcaaggccagatgggcgtggtgttaatggtcatcataaccgccttcacgatcacaccc

SEQ ID NO: 124732 - DNA, 75 bp, Artificial Sequence
  Synthetic
ggggcggccgtgacggtgtcatatgggccgcgaccatgatctaaccgggtgtggtgtttgatataaccaagtggc

SEQ ID NO: 124733 - DNA, 75 bp, Artificial Sequence
  Synthetic
ggggcggccgtgacggtgtcatatgggccgcgaccatgatctatccgggtgtggtgtttgatataaccaagtggc

SEQ ID NO: 124734 - DNA, 75 bp, Artificial Sequence
  Synthetic
ggggcggccgtgacggtgtcatatgggccgcgaccatgatctacccgggtgtggtgtttgatataaccaagtggc

SEQ ID NO: 124735 - DNA, 75 bp, Artificial Sequence
  Synthetic
ggggcggccgtgacggtgtcatatgggccgcgaccatgatctagccgggtgtggtgtttgatataaccaagtggc

SEQ ID NO: 124736 - DNA, 75 bp, Artificial Sequence
  Synthetic
ggggcggccgtgacggtgtcatatgggccgcgaccatgttctaaccgggtgtggtgtttgatataaccaagtggc

SEQ ID NO: 124737 - DNA, 75 bp, Artificial Sequence
  Synthetic
ggggcggccgtgacggtgtcatatgggccgcgaccatgttctatccgggtgtggtgtttgatataaccaagtggc

SEQ ID NO: 124738 - DNA, 75 bp, Artificial Sequence
  Synthetic
ggggcggccgtgacggtgtcatatgggccgcgaccatgttctacccgggtgtggtgtttgatataaccaagtggc

SEQ ID NO: 124739 - DNA, 75 bp, Artificial Sequence
  Synthetic
ggggcggccgtgacggtgtcatatgggccgcgaccatgttctagccgggtgtggtgtttgatataaccaagtggc

SEQ ID NO: 124740 - DNA, 75 bp, Artificial Sequence
  Synthetic
ggggcggccgtgacggtgtcatatgggccgcgaccatgctctaaccgggtgtggtgtttgatataaccaagtggc

SEQ ID NO: 124741 - DNA, 75 bp, Artificial Sequence
  Synthetic
ggggcggccgtgacggtgtcatatgggccgcgaccatgctctatccgggtgtggtgtttgatataaccaagtggc

SEQ ID NO: 124742 - DNA, 75 bp, Artificial Sequence
  Synthetic
ggggcggccgtgacggtgtcatatgggccgcgaccatgctctacccgggtgtggtgtttgatataaccaagtggc

SEQ ID NO: 124743 - DNA, 75 bp, Artificial Sequence
  Synthetic
ggggcggccgtgacggtgtcatatgggccgcgaccatgctctagccgggtgtggtgtttgatataaccaagtggc

SEQ ID NO: 124744 - DNA, 75 bp, Artificial Sequence
  Synthetic
ggggcggccgtgacggtgtcatatgggccgcgaccatggtctaaccgggtgtggtgtttgatataaccaagtggc

SEQ ID NO: 124745 - DNA, 75 bp, Artificial Sequence
  Synthetic
ggggcggccgtgacggtgtcatatgggccgcgaccatggtctatccgggtgtggtgtttgatataaccaagtggc

SEQ ID NO: 124746 - DNA, 75 bp, Artificial Sequence
  Synthetic
ggggcggccgtgacggtgtcatatgggccgcgaccatggtctacccgggtgtggtgtttgatataaccaagtggc

SEQ ID NO: 124747 - DNA, 75 bp, Artificial Sequence
  Synthetic
ggggcggccgtgacggtgtcatatgggccgcgaccatggtctagccgggtgtggtgtttgatataaccaagtggc

SEQ ID NO: 124748 - DNA, 75 bp, Artificial Sequence
  Synthetic
tgctaaaggacattaagctagcggcgtccaaagtcagcgccaggctcctctctatagaggaagcgtgtgcactga

SEQ ID NO: 124749 - DNA, 75 bp, Artificial Sequence
  Synthetic
gaagcatatcgtgggaggcaagtacgtccaggtagcactaatcacccttggcaagtggacaggcacgtacatata

SEQ ID NO: 124750 - DNA, 75 bp, Artificial Sequence
  Synthetic
gaagcatatcgtgggaggcaagtacgtccaggtagcactaatcacccttggcaagtggacaggcacgtacattta

SEQ ID NO: 124751 - DNA, 75 bp, Artificial Sequence
  Synthetic
gaagcatatcgtgggaggcaagtacgtccaggtagcactaatcacccttggcaagtggacaggcacgtacatcta

SEQ ID NO: 124752 - DNA, 75 bp, Artificial Sequence
  Synthetic
gaagcatatcgtgggaggcaagtacgtccaggtagcactaatcacccttggcaagtggacaggcacgtacatgta

SEQ ID NO: 124753 - DNA, 75 bp, Artificial Sequence
  Synthetic
gaagcatatcgtgggaggcaagtacgtccaggtagctctaatcacccttggcaagtggacaggcacgtacatata

SEQ ID NO: 124754 - DNA, 75 bp, Artificial Sequence
  Synthetic
gaagcatatcgtgggaggcaagtacgtccaggtagctctaatcacccttggcaagtggacaggcacgtacattta

SEQ ID NO: 124755 - DNA, 75 bp, Artificial Sequence
  Synthetic
gaagcatatcgtgggaggcaagtacgtccaggtagctctaatcacccttggcaagtggacaggcacgtacatcta

SEQ ID NO: 124756 - DNA, 75 bp, Artificial Sequence
  Synthetic
gaagcatatcgtgggaggcaagtacgtccaggtagctctaatcacccttggcaagtggacaggcacgtacatgta

SEQ ID NO: 124757 - DNA, 75 bp, Artificial Sequence
  Synthetic
gaagcatatcgtgggaggcaagtacgtccaggtagccctaatcacccttggcaagtggacaggcacgtacatata

SEQ ID NO: 124758 - DNA, 75 bp, Artificial Sequence
  Synthetic
gaagcatatcgtgggaggcaagtacgtccaggtagccctaatcacccttggcaagtggacaggcacgtacattta

SEQ ID NO: 124759 - DNA, 75 bp, Artificial Sequence
  Synthetic
gaagcatatcgtgggaggcaagtacgtccaggtagccctaatcacccttggcaagtggacaggcacgtacatcta

SEQ ID NO: 124760 - DNA, 75 bp, Artificial Sequence
  Synthetic
gaagcatatcgtgggaggcaagtacgtccaggtagccctaatcacccttggcaagtggacaggcacgtacatgta

SEQ ID NO: 124761 - DNA, 75 bp, Artificial Sequence
  Synthetic
gaagcatatcgtgggaggcaagtacgtccaggtagcgctaatcacccttggcaagtggacaggcacgtacatata

SEQ ID NO: 124762 - DNA, 75 bp, Artificial Sequence
  Synthetic
gaagcatatcgtgggaggcaagtacgtccaggtagcgctaatcacccttggcaagtggacaggcacgtacattta

SEQ ID NO: 124763 - DNA, 75 bp, Artificial Sequence
  Synthetic
gaagcatatcgtgggaggcaagtacgtccaggtagcgctaatcacccttggcaagtggacaggcacgtacatcta

SEQ ID NO: 124764 - DNA, 75 bp, Artificial Sequence
  Synthetic
gaagcatatcgtgggaggcaagtacgtccaggtagcgctaatcacccttggcaagtggacaggcacgtacatgta

SEQ ID NO: 124765 - DNA, 75 bp, Artificial Sequence
  Synthetic
gaagcatatcgtgggaggcaagtacgtccaggttgcactaatcacccttggcaagtggacaggcacgtacatata

SEQ ID NO: 124766 - DNA, 75 bp, Artificial Sequence
  Synthetic
gaagcatatcgtgggaggcaagtacgtccaggttgcactaatcacccttggcaagtggacaggcacgtacattta

SEQ ID NO: 124767 - DNA, 75 bp, Artificial Sequence
  Synthetic
gaagcatatcgtgggaggcaagtacgtccaggttgcactaatcacccttggcaagtggacaggcacgtacatcta

SEQ ID NO: 124768 - DNA, 75 bp, Artificial Sequence
  Synthetic
gaagcatatcgtgggaggcaagtacgtccaggttgcactaatcacccttggcaagtggacaggcacgtacatgta

SEQ ID NO: 124769 - DNA, 75 bp, Artificial Sequence
  Synthetic
gaagcatatcgtgggaggcaagtacgtccaggttgctctaatcacccttggcaagtggacaggcacgtacatata

SEQ ID NO: 124770 - DNA, 75 bp, Artificial Sequence
  Synthetic
gaagcatatcgtgggaggcaagtacgtccaggttgctctaatcacccttggcaagtggacaggcacgtacattta

SEQ ID NO: 124771 - DNA, 75 bp, Artificial Sequence
  Synthetic
gaagcatatcgtgggaggcaagtacgtccaggttgctctaatcacccttggcaagtggacaggcacgtacatcta

SEQ ID NO: 124772 - DNA, 75 bp, Artificial Sequence
  Synthetic
gaagcatatcgtgggaggcaagtacgtccaggttgctctaatcacccttggcaagtggacaggcacgtacatgta

SEQ ID NO: 124773 - DNA, 75 bp, Artificial Sequence
  Synthetic
gaagcatatcgtgggaggcaagtacgtccaggttgccctaatcacccttggcaagtggacaggcacgtacatata

SEQ ID NO: 124774 - DNA, 75 bp, Artificial Sequence
  Synthetic
gaagcatatcgtgggaggcaagtacgtccaggttgccctaatcacccttggcaagtggacaggcacgtacattta

SEQ ID NO: 124775 - DNA, 75 bp, Artificial Sequence
  Synthetic
gaagcatatcgtgggaggcaagtacgtccaggttgccctaatcacccttggcaagtggacaggcacgtacatcta

SEQ ID NO: 124776 - DNA, 75 bp, Artificial Sequence
  Synthetic
gaagcatatcgtgggaggcaagtacgtccaggttgccctaatcacccttggcaagtggacaggcacgtacatgta

SEQ ID NO: 124777 - DNA, 75 bp, Artificial Sequence
  Synthetic
gaagcatatcgtgggaggcaagtacgtccaggttgcgctaatcacccttggcaagtggacaggcacgtacatata

SEQ ID NO: 124778 - DNA, 75 bp, Artificial Sequence
  Synthetic
gaagcatatcgtgggaggcaagtacgtccaggttgcgctaatcacccttggcaagtggacaggcacgtacattta

SEQ ID NO: 124779 - DNA, 75 bp, Artificial Sequence
  Synthetic
gaagcatatcgtgggaggcaagtacgtccaggttgcgctaatcacccttggcaagtggacaggcacgtacatcta

SEQ ID NO: 124780 - DNA, 75 bp, Artificial Sequence
  Synthetic
gaagcatatcgtgggaggcaagtacgtccaggttgcgctaatcacccttggcaagtggacaggcacgtacatgta

SEQ ID NO: 124781 - DNA, 75 bp, Artificial Sequence
  Synthetic
gaagcatatcgtgggaggcaagtacgtccaggtcgcactaatcacccttggcaagtggacaggcacgtacatata

SEQ ID NO: 124782 - DNA, 75 bp, Artificial Sequence
  Synthetic
gaagcatatcgtgggaggcaagtacgtccaggtcgcactaatcacccttggcaagtggacaggcacgtacattta

SEQ ID NO: 124783 - DNA, 75 bp, Artificial Sequence
  Synthetic
gaagcatatcgtgggaggcaagtacgtccaggtcgcactaatcacccttggcaagtggacaggcacgtacatcta

SEQ ID NO: 124784 - DNA, 75 bp, Artificial Sequence
  Synthetic
gaagcatatcgtgggaggcaagtacgtccaggtcgcactaatcacccttggcaagtggacaggcacgtacatgta

SEQ ID NO: 124785 - DNA, 75 bp, Artificial Sequence
  Synthetic
gaagcatatcgtgggaggcaagtacgtccaggtcgctctaatcacccttggcaagtggacaggcacgtacatata

SEQ ID NO: 124786 - DNA, 75 bp, Artificial Sequence
  Synthetic
gaagcatatcgtgggaggcaagtacgtccaggtcgctctaatcacccttggcaagtggacaggcacgtacattta

SEQ ID NO: 124787 - DNA, 75 bp, Artificial Sequence
  Synthetic
gaagcatatcgtgggaggcaagtacgtccaggtcgctctaatcacccttggcaagtggacaggcacgtacatcta

SEQ ID NO: 124788 - DNA, 75 bp, Artificial Sequence
  Synthetic
gaagcatatcgtgggaggcaagtacgtccaggtcgctctaatcacccttggcaagtggacaggcacgtacatgta

SEQ ID NO: 124789 - DNA, 75 bp, Artificial Sequence
  Synthetic
gaagcatatcgtgggaggcaagtacgtccaggtcgccctaatcacccttggcaagtggacaggcacgtacatata

SEQ ID NO: 124790 - DNA, 75 bp, Artificial Sequence
  Synthetic
gaagcatatcgtgggaggcaagtacgtccaggtcgccctaatcacccttggcaagtggacaggcacgtacattta

SEQ ID NO: 124791 - DNA, 75 bp, Artificial Sequence
  Synthetic
gaagcatatcgtgggaggcaagtacgtccaggtcgccctaatcacccttggcaagtggacaggcacgtacatcta

SEQ ID NO: 124792 - DNA, 75 bp, Artificial Sequence
  Synthetic
gaagcatatcgtgggaggcaagtacgtccaggtcgccctaatcacccttggcaagtggacaggcacgtacatgta

SEQ ID NO: 124793 - DNA, 75 bp, Artificial Sequence
  Synthetic
gaagcatatcgtgggaggcaagtacgtccaggtcgcgctaatcacccttggcaagtggacaggcacgtacatata

SEQ ID NO: 124794 - DNA, 75 bp, Artificial Sequence
  Synthetic
gaagcatatcgtgggaggcaagtacgtccaggtcgcgctaatcacccttggcaagtggacaggcacgtacattta

SEQ ID NO: 124795 - DNA, 75 bp, Artificial Sequence
  Synthetic
gaagcatatcgtgggaggcaagtacgtccaggtcgcgctaatcacccttggcaagtggacaggcacgtacatcta

SEQ ID NO: 124796 - DNA, 75 bp, Artificial Sequence
  Synthetic
gaagcatatcgtgggaggcaagtacgtccaggtcgcgctaatcacccttggcaagtggacaggcacgtacatgta

SEQ ID NO: 124797 - DNA, 75 bp, Artificial Sequence
  Synthetic
gaagcatatcgtgggaggcaagtacgtccaggtggcactaatcacccttggcaagtggacaggcacgtacatata

SEQ ID NO: 124798 - DNA, 75 bp, Artificial Sequence
  Synthetic
gaagcatatcgtgggaggcaagtacgtccaggtggcactaatcacccttggcaagtggacaggcacgtacattta

SEQ ID NO: 124799 - DNA, 75 bp, Artificial Sequence
  Synthetic
gaagcatatcgtgggaggcaagtacgtccaggtggcactaatcacccttggcaagtggacaggcacgtacatcta

SEQ ID NO: 124800 - DNA, 75 bp, Artificial Sequence
  Synthetic
gaagcatatcgtgggaggcaagtacgtccaggtggcactaatcacccttggcaagtggacaggcacgtacatgta

SEQ ID NO: 124801 - DNA, 75 bp, Artificial Sequence
  Synthetic
gaagcatatcgtgggaggcaagtacgtccaggtggctctaatcacccttggcaagtggacaggcacgtacatata

SEQ ID NO: 124802 - DNA, 75 bp, Artificial Sequence
  Synthetic
gaagcatatcgtgggaggcaagtacgtccaggtggctctaatcacccttggcaagtggacaggcacgtacattta

SEQ ID NO: 124803 - DNA, 75 bp, Artificial Sequence
  Synthetic
gaagcatatcgtgggaggcaagtacgtccaggtggctctaatcacccttggcaagtggacaggcacgtacatcta

SEQ ID NO: 124804 - DNA, 75 bp, Artificial Sequence
  Synthetic
gaagcatatcgtgggaggcaagtacgtccaggtggctctaatcacccttggcaagtggacaggcacgtacatgta

SEQ ID NO: 124805 - DNA, 75 bp, Artificial Sequence
  Synthetic
gaagcatatcgtgggaggcaagtacgtccaggtggccctaatcacccttggcaagtggacaggcacgtacatata

SEQ ID NO: 124806 - DNA, 75 bp, Artificial Sequence
  Synthetic
gaagcatatcgtgggaggcaagtacgtccaggtggccctaatcacccttggcaagtggacaggcacgtacattta

SEQ ID NO: 124807 - DNA, 75 bp, Artificial Sequence
  Synthetic
gaagcatatcgtgggaggcaagtacgtccaggtggccctaatcacccttggcaagtggacaggcacgtacatcta

SEQ ID NO: 124808 - DNA, 75 bp, Artificial Sequence
  Synthetic
gaagcatatcgtgggaggcaagtacgtccaggtggccctaatcacccttggcaagtggacaggcacgtacatgta

SEQ ID NO: 124809 - DNA, 75 bp, Artificial Sequence
  Synthetic
gaagcatatcgtgggaggcaagtacgtccaggtggcgctaatcacccttggcaagtggacaggcacgtacatata

SEQ ID NO: 124810 - DNA, 75 bp, Artificial Sequence
  Synthetic
gaagcatatcgtgggaggcaagtacgtccaggtggcgctaatcacccttggcaagtggacaggcacgtacattta

SEQ ID NO: 124811 - DNA, 75 bp, Artificial Sequence
  Synthetic
gaagcatatcgtgggaggcaagtacgtccaggtggcgctaatcacccttggcaagtggacaggcacgtacatcta

SEQ ID NO: 124812 - DNA, 75 bp, Artificial Sequence
  Synthetic
gaagcatatcgtgggaggcaagtacgtccaggtggcgctaatcacccttggcaagtggacaggcacgtacatgta

SEQ ID NO: 124813 - DNA, 75 bp, Artificial Sequence
  Synthetic
tcaggatgctgtgtccagaagccagcggaggggacgtactggtagagggaagcccggaacatataggtacgtctc

SEQ ID NO: 124814 - DNA, 75 bp, Artificial Sequence
  Synthetic
ccccacacttcaagcgccagtgcccccgcctcggaggcgccgcgccaaagtcctgactcaggacaatgtggaggg

SEQ ID NO: 124815 - DNA, 75 bp, Artificial Sequence
  Synthetic
ccttctggaagaccaacaaacaccaattcctacaaccatcatggccaagaacgaggtgttctgtgtagaccctgc

SEQ ID NO: 124816 - DNA, 75 bp, Artificial Sequence
  Synthetic
tttgactccgtcgtcctctgcgaggcgtacgatacaggctgcgcttggtacgaactgacaccttctgagactacg

SEQ ID NO: 124817 - DNA, 75 bp, Artificial Sequence
  Synthetic
atcgtgtggggggcggagacagcggcatgtggtgacatcatacatgggctccccgtatccgcccggctaggccga

SEQ ID NO: 124818 - DNA, 75 bp, Artificial Sequence
  Synthetic
atcgtgtggggggcggagacagcggcatgtggtgacatcatacatgggctccccgtatccgcccggcttggccga

SEQ ID NO: 124819 - DNA, 75 bp, Artificial Sequence
  Synthetic
atcgtgtggggggcggagacagcggcatgtggtgacatcatacatgggctccccgtatccgcccggctcggccga

SEQ ID NO: 124820 - DNA, 75 bp, Artificial Sequence
  Synthetic
atcgtgtggggggcggagacagcggcatgtggtgacatcatacatgggctccccgtatccgcccggctgggccga

SEQ ID NO: 124821 - DNA, 75 bp, Artificial Sequence
  Synthetic
atcgtgtggggggcggagacagcggcatgtggtgacatcatacttgggctccccgtatccgcccggctaggccga

SEQ ID NO: 124822 - DNA, 75 bp, Artificial Sequence
  Synthetic
atcgtgtggggggcggagacagcggcatgtggtgacatcatacttgggctccccgtatccgcccggcttggccga

SEQ ID NO: 124823 - DNA, 75 bp, Artificial Sequence
  Synthetic
atcgtgtggggggcggagacagcggcatgtggtgacatcatacttgggctccccgtatccgcccggctcggccga

SEQ ID NO: 124824 - DNA, 75 bp, Artificial Sequence
  Synthetic
atcgtgtggggggcggagacagcggcatgtggtgacatcatacttgggctccccgtatccgcccggctgggccga

SEQ ID NO: 124825 - DNA, 75 bp, Artificial Sequence
  Synthetic
atcgtgtggggggcggagacagcggcatgtggtgacatcatacctgggctccccgtatccgcccggctaggccga

SEQ ID NO: 124826 - DNA, 75 bp, Artificial Sequence
  Synthetic
atcgtgtggggggcggagacagcggcatgtggtgacatcatacctgggctccccgtatccgcccggcttggccga

SEQ ID NO: 124827 - DNA, 75 bp, Artificial Sequence
  Synthetic
atcgtgtggggggcggagacagcggcatgtggtgacatcatacctgggctccccgtatccgcccggctcggccga

SEQ ID NO: 124828 - DNA, 75 bp, Artificial Sequence
  Synthetic
atcgtgtggggggcggagacagcggcatgtggtgacatcatacctgggctccccgtatccgcccggctgggccga

SEQ ID NO: 124829 - DNA, 75 bp, Artificial Sequence
  Synthetic
atcgtgtggggggcggagacagcggcatgtggtgacatcatacgtgggctccccgtatccgcccggctaggccga

SEQ ID NO: 124830 - DNA, 75 bp, Artificial Sequence
  Synthetic
atcgtgtggggggcggagacagcggcatgtggtgacatcatacgtgggctccccgtatccgcccggcttggccga

SEQ ID NO: 124831 - DNA, 75 bp, Artificial Sequence
  Synthetic
atcgtgtggggggcggagacagcggcatgtggtgacatcatacgtgggctccccgtatccgcccggctcggccga

SEQ ID NO: 124832 - DNA, 75 bp, Artificial Sequence
  Synthetic
atcgtgtggggggcggagacagcggcatgtggtgacatcatacgtgggctccccgtatccgcccggctgggccga

SEQ ID NO: 124833 - DNA, 75 bp, Artificial Sequence
  Synthetic
atcgtgtggggggcggagactgcggcatgtggtgacatcatacatgggctccccgtatccgcccggctaggccga

SEQ ID NO: 124834 - DNA, 75 bp, Artificial Sequence
  Synthetic
atcgtgtggggggcggagactgcggcatgtggtgacatcatacatgggctccccgtatccgcccggcttggccga

SEQ ID NO: 124835 - DNA, 75 bp, Artificial Sequence
  Synthetic
atcgtgtggggggcggagactgcggcatgtggtgacatcatacatgggctccccgtatccgcccggctcggccga

SEQ ID NO: 124836 - DNA, 75 bp, Artificial Sequence
  Synthetic
atcgtgtggggggcggagactgcggcatgtggtgacatcatacatgggctccccgtatccgcccggctgggccga

SEQ ID NO: 124837 - DNA, 75 bp, Artificial Sequence
  Synthetic
atcgtgtggggggcggagactgcggcatgtggtgacatcatacttgggctccccgtatccgcccggctaggccga

SEQ ID NO: 124838 - DNA, 75 bp, Artificial Sequence
  Synthetic
atcgtgtggggggcggagactgcggcatgtggtgacatcatacttgggctccccgtatccgcccggcttggccga

SEQ ID NO: 124839 - DNA, 75 bp, Artificial Sequence
  Synthetic
atcgtgtggggggcggagactgcggcatgtggtgacatcatacttgggctccccgtatccgcccggctcggccga

SEQ ID NO: 124840 - DNA, 75 bp, Artificial Sequence
  Synthetic
atcgtgtggggggcggagactgcggcatgtggtgacatcatacttgggctccccgtatccgcccggctgggccga

SEQ ID NO: 124841 - DNA, 75 bp, Artificial Sequence
  Synthetic
atcgtgtggggggcggagactgcggcatgtggtgacatcatacctgggctccccgtatccgcccggctaggccga

SEQ ID NO: 124842 - DNA, 75 bp, Artificial Sequence
  Synthetic
atcgtgtggggggcggagactgcggcatgtggtgacatcatacctgggctccccgtatccgcccggcttggccga

SEQ ID NO: 124843 - DNA, 75 bp, Artificial Sequence
  Synthetic
atcgtgtggggggcggagactgcggcatgtggtgacatcatacctgggctccccgtatccgcccggctcggccga

SEQ ID NO: 124844 - DNA, 75 bp, Artificial Sequence
  Synthetic
atcgtgtggggggcggagactgcggcatgtggtgacatcatacctgggctccccgtatccgcccggctgggccga

SEQ ID NO: 124845 - DNA, 75 bp, Artificial Sequence
  Synthetic
atcgtgtggggggcggagactgcggcatgtggtgacatcatacgtgggctccccgtatccgcccggctaggccga

SEQ ID NO: 124846 - DNA, 75 bp, Artificial Sequence
  Synthetic
atcgtgtggggggcggagactgcggcatgtggtgacatcatacgtgggctccccgtatccgcccggcttggccga

SEQ ID NO: 124847 - DNA, 75 bp, Artificial Sequence
  Synthetic
atcgtgtggggggcggagactgcggcatgtggtgacatcatacgtgggctccccgtatccgcccggctcggccga

SEQ ID NO: 124848 - DNA, 75 bp, Artificial Sequence
  Synthetic
atcgtgtggggggcggagactgcggcatgtggtgacatcatacgtgggctccccgtatccgcccggctgggccga

SEQ ID NO: 124849 - DNA, 75 bp, Artificial Sequence
  Synthetic
atcgtgtggggggcggagaccgcggcatgtggtgacatcatacatgggctccccgtatccgcccggctaggccga

SEQ ID NO: 124850 - DNA, 75 bp, Artificial Sequence
  Synthetic
atcgtgtggggggcggagaccgcggcatgtggtgacatcatacatgggctccccgtatccgcccggcttggccga

SEQ ID NO: 124851 - DNA, 75 bp, Artificial Sequence
  Synthetic
atcgtgtggggggcggagaccgcggcatgtggtgacatcatacatgggctccccgtatccgcccggctcggccga

SEQ ID NO: 124852 - DNA, 75 bp, Artificial Sequence
  Synthetic
atcgtgtggggggcggagaccgcggcatgtggtgacatcatacatgggctccccgtatccgcccggctgggccga

SEQ ID NO: 124853 - DNA, 75 bp, Artificial Sequence
  Synthetic
atcgtgtggggggcggagaccgcggcatgtggtgacatcatacttgggctccccgtatccgcccggctaggccga

SEQ ID NO: 124854 - DNA, 75 bp, Artificial Sequence
  Synthetic
atcgtgtggggggcggagaccgcggcatgtggtgacatcatacttgggctccccgtatccgcccggcttggccga

SEQ ID NO: 124855 - DNA, 75 bp, Artificial Sequence
  Synthetic
atcgtgtggggggcggagaccgcggcatgtggtgacatcatacttgggctccccgtatccgcccggctcggccga

SEQ ID NO: 124856 - DNA, 75 bp, Artificial Sequence
  Synthetic
atcgtgtggggggcggagaccgcggcatgtggtgacatcatacttgggctccccgtatccgcccggctgggccga

SEQ ID NO: 124857 - DNA, 75 bp, Artificial Sequence
  Synthetic
atcgtgtggggggcggagaccgcggcatgtggtgacatcatacctgggctccccgtatccgcccggctaggccga

SEQ ID NO: 124858 - DNA, 75 bp, Artificial Sequence
  Synthetic
atcgtgtggggggcggagaccgcggcatgtggtgacatcatacctgggctccccgtatccgcccggcttggccga

SEQ ID NO: 124859 - DNA, 75 bp, Artificial Sequence
  Synthetic
atcgtgtggggggcggagaccgcggcatgtggtgacatcatacctgggctccccgtatccgcccggctcggccga

SEQ ID NO: 124860 - DNA, 75 bp, Artificial Sequence
  Synthetic
atcgtgtggggggcggagaccgcggcatgtggtgacatcatacctgggctccccgtatccgcccggctgggccga

SEQ ID NO: 124861 - DNA, 75 bp, Artificial Sequence
  Synthetic
atcgtgtggggggcggagaccgcggcatgtggtgacatcatacgtgggctccccgtatccgcccggctaggccga

SEQ ID NO: 124862 - DNA, 75 bp, Artificial Sequence
  Synthetic
atcgtgtggggggcggagaccgcggcatgtggtgacatcatacgtgggctccccgtatccgcccggcttggccga

SEQ ID NO: 124863 - DNA, 75 bp, Artificial Sequence
  Synthetic
atcgtgtggggggcggagaccgcggcatgtggtgacatcatacgtgggctccccgtatccgcccggctcggccga

SEQ ID NO: 124864 - DNA, 75 bp, Artificial Sequence
  Synthetic
atcgtgtggggggcggagaccgcggcatgtggtgacatcatacgtgggctccccgtatccgcccggctgggccga

SEQ ID NO: 124865 - DNA, 75 bp, Artificial Sequence
  Synthetic
atcgtgtggggggcggagacggcggcatgtggtgacatcatacatgggctccccgtatccgcccggctaggccga

SEQ ID NO: 124866 - DNA, 75 bp, Artificial Sequence
  Synthetic
atcgtgtggggggcggagacggcggcatgtggtgacatcatacatgggctccccgtatccgcccggcttggccga

SEQ ID NO: 124867 - DNA, 75 bp, Artificial Sequence
  Synthetic
atcgtgtggggggcggagacggcggcatgtggtgacatcatacatgggctccccgtatccgcccggctcggccga

SEQ ID NO: 124868 - DNA, 75 bp, Artificial Sequence
  Synthetic
atcgtgtggggggcggagacggcggcatgtggtgacatcatacatgggctccccgtatccgcccggctgggccga

SEQ ID NO: 124869 - DNA, 75 bp, Artificial Sequence
  Synthetic
atcgtgtggggggcggagacggcggcatgtggtgacatcatacttgggctccccgtatccgcccggctaggccga

SEQ ID NO: 124870 - DNA, 75 bp, Artificial Sequence
  Synthetic
atcgtgtggggggcggagacggcggcatgtggtgacatcatacttgggctccccgtatccgcccggcttggccga

SEQ ID NO: 124871 - DNA, 75 bp, Artificial Sequence
  Synthetic
atcgtgtggggggcggagacggcggcatgtggtgacatcatacttgggctccccgtatccgcccggctcggccga

SEQ ID NO: 124872 - DNA, 75 bp, Artificial Sequence
  Synthetic
atcgtgtggggggcggagacggcggcatgtggtgacatcatacttgggctccccgtatccgcccggctgggccga

SEQ ID NO: 124873 - DNA, 75 bp, Artificial Sequence
  Synthetic
atcgtgtggggggcggagacggcggcatgtggtgacatcatacctgggctccccgtatccgcccggctaggccga

SEQ ID NO: 124874 - DNA, 75 bp, Artificial Sequence
  Synthetic
atcgtgtggggggcggagacggcggcatgtggtgacatcatacctgggctccccgtatccgcccggcttggccga

SEQ ID NO: 124875 - DNA, 75 bp, Artificial Sequence
  Synthetic
atcgtgtggggggcggagacggcggcatgtggtgacatcatacctgggctccccgtatccgcccggctcggccga

SEQ ID NO: 124876 - DNA, 75 bp, Artificial Sequence
  Synthetic
atcgtgtggggggcggagacggcggcatgtggtgacatcatacctgggctccccgtatccgcccggctgggccga

SEQ ID NO: 124877 - DNA, 75 bp, Artificial Sequence
  Synthetic
atcgtgtggggggcggagacggcggcatgtggtgacatcatacgtgggctccccgtatccgcccggctaggccga

SEQ ID NO: 124878 - DNA, 75 bp, Artificial Sequence
  Synthetic
atcgtgtggggggcggagacggcggcatgtggtgacatcatacgtgggctccccgtatccgcccggcttggccga

SEQ ID NO: 124879 - DNA, 75 bp, Artificial Sequence
  Synthetic
atcgtgtggggggcggagacggcggcatgtggtgacatcatacgtgggctccccgtatccgcccggctcggccga

SEQ ID NO: 124880 - DNA, 75 bp, Artificial Sequence
  Synthetic
atcgtgtggggggcggagacggcggcatgtggtgacatcatacgtgggctccccgtatccgcccggctgggccga

SEQ ID NO: 124881 - DNA, 75 bp, Artificial Sequence
  Synthetic
caggcagtgatgggggcttcgtatggattccagtactctccagcacaacgggtcgatttcctcttgcaagcttgg

SEQ ID NO: 124882 - DNA, 75 bp, Artificial Sequence
  Synthetic
cccacttcctctcacaaaccaagcaagggggggacaactttgcgtacttggtggcttaccaagctacggtgtgcg

SEQ ID NO: 124883 - DNA, 75 bp, Artificial Sequence
  Synthetic
caatagtggtgagaatgacggggcgcgacaagacagaccaggctggggaggttcaggttttgtccactgtcacac

SEQ ID NO: 124884 - DNA, 75 bp, Artificial Sequence
  Synthetic
caatagtggtgagtatgacggggcgcgacaagacagaccaggctggggaggttcaggttttgtccactgtcacac

SEQ ID NO: 124885 - DNA, 75 bp, Artificial Sequence
  Synthetic
caatagtggtgagcatgacggggcgcgacaagacagaccaggctggggaggttcaggttttgtccactgtcacac

SEQ ID NO: 124886 - DNA, 75 bp, Artificial Sequence
  Synthetic
caatagtggtgaggatgacggggcgcgacaagacagaccaggctggggaggttcaggttttgtccactgtcacac

SEQ ID NO: 124887 - DNA, 75 bp, Artificial Sequence
  Synthetic
ctatagtggtgagaatgacggggcgcgacaagacagaccaggctggggaggttcaggttttgtccactgtcacac

SEQ ID NO: 124888 - DNA, 75 bp, Artificial Sequence
  Synthetic
ctatagtggtgagtatgacggggcgcgacaagacagaccaggctggggaggttcaggttttgtccactgtcacac

SEQ ID NO: 124889 - DNA, 75 bp, Artificial Sequence
  Synthetic
ctatagtggtgagcatgacggggcgcgacaagacagaccaggctggggaggttcaggttttgtccactgtcacac

SEQ ID NO: 124890 - DNA, 75 bp, Artificial Sequence
  Synthetic
ctatagtggtgaggatgacggggcgcgacaagacagaccaggctggggaggttcaggttttgtccactgtcacac

SEQ ID NO: 124891 - DNA, 75 bp, Artificial Sequence
  Synthetic
ccatagtggtgagaatgacggggcgcgacaagacagaccaggctggggaggttcaggttttgtccactgtcacac

SEQ ID NO: 124892 - DNA, 75 bp, Artificial Sequence
  Synthetic
ccatagtggtgagtatgacggggcgcgacaagacagaccaggctggggaggttcaggttttgtccactgtcacac

SEQ ID NO: 124893 - DNA, 75 bp, Artificial Sequence
  Synthetic
ccatagtggtgagcatgacggggcgcgacaagacagaccaggctggggaggttcaggttttgtccactgtcacac

SEQ ID NO: 124894 - DNA, 75 bp, Artificial Sequence
  Synthetic
ccatagtggtgaggatgacggggcgcgacaagacagaccaggctggggaggttcaggttttgtccactgtcacac

SEQ ID NO: 124895 - DNA, 75 bp, Artificial Sequence
  Synthetic
cgatagtggtgagaatgacggggcgcgacaagacagaccaggctggggaggttcaggttttgtccactgtcacac

SEQ ID NO: 124896 - DNA, 75 bp, Artificial Sequence
  Synthetic
cgatagtggtgagtatgacggggcgcgacaagacagaccaggctggggaggttcaggttttgtccactgtcacac

SEQ ID NO: 124897 - DNA, 75 bp, Artificial Sequence
  Synthetic
cgatagtggtgagcatgacggggcgcgacaagacagaccaggctggggaggttcaggttttgtccactgtcacac

SEQ ID NO: 124898 - DNA, 75 bp, Artificial Sequence
  Synthetic
cgatagtggtgaggatgacggggcgcgacaagacagaccaggctggggaggttcaggttttgtccactgtcacac

SEQ ID NO: 124899 - DNA, 75 bp, Artificial Sequence
  Synthetic
cctgctcattacctgaggaggcccggactgccatacactcactcaccgagagactctacgtaggtggccctatgt

SEQ ID NO: 124900 - DNA, 75 bp, Artificial Sequence
  Synthetic
cctgctcattacctgaggaggcccggactgccatacactcactcaccgagagactctacgttggtggccctatgt

SEQ ID NO: 124901 - DNA, 75 bp, Artificial Sequence
  Synthetic
cctgctcattacctgaggaggcccggactgccatacactcactcaccgagagactctacgtcggtggccctatgt

SEQ ID NO: 124902 - DNA, 75 bp, Artificial Sequence
  Synthetic
cctgctcattacctgaggaggcccggactgccatacactcactcaccgagagactctacgtgggtggccctatgt

SEQ ID NO: 124903 - DNA, 75 bp, Artificial Sequence
  Synthetic
tggggggcggacaccgccgcgtgcggtgacatcatcgacggcttgcccgtctctgcccgtaggggccgggagata

SEQ ID NO: 124904 - DNA, 75 bp, Artificial Sequence
  Synthetic
cagcccagaccagaggccctattgctggcactacgcgcctcgacagtgtggtattgtacccgcgtcgaaggtgtg

SEQ ID NO: 124905 - DNA, 75 bp, Artificial Sequence
  Synthetic
tcaacagcaaagggcagtcctgcgggtacaggcgttgccgtgccagcggagttctcactactagcatgggtaaca

SEQ ID NO: 124906 - DNA, 75 bp, Artificial Sequence
  Synthetic
aggagccgttcagaatgagatcactaccacacacccagtcactaaatatatcatgacttgcatggccgctgacct

SEQ ID NO: 124907 - DNA, 75 bp, Artificial Sequence
  Synthetic
gtattccagcgccgacggagacctcgtggggtggccaagcccccccgggaccagatccctggagccatgcacttg

SEQ ID NO: 124908 - DNA, 75 bp, Artificial Sequence
  Synthetic
gtattccagcgccgacggagacctcgtggggtggccaagcccccccgggaccagatccctggagccttgcacttg

SEQ ID NO: 124909 - DNA, 75 bp, Artificial Sequence
  Synthetic
gtattccagcgccgacggagacctcgtggggtggccaagcccccccgggaccagatccctggagccctgcacttg

SEQ ID NO: 124910 - DNA, 75 bp, Artificial Sequence
  Synthetic
gtattccagcgccgacggagacctcgtggggtggccaagcccccccgggaccagatccctggagccgtgcacttg

SEQ ID NO: 124911 - DNA, 75 bp, Artificial Sequence
  Synthetic
gtattccagcgccgacggagacctcgtggggtggcctagcccccccgggaccagatccctggagccatgcacttg

SEQ ID NO: 124912 - DNA, 75 bp, Artificial Sequence
  Synthetic
gtattccagcgccgacggagacctcgtggggtggcctagcccccccgggaccagatccctggagccttgcacttg

SEQ ID NO: 124913 - DNA, 75 bp, Artificial Sequence
  Synthetic
gtattccagcgccgacggagacctcgtggggtggcctagcccccccgggaccagatccctggagccctgcacttg

SEQ ID NO: 124914 - DNA, 75 bp, Artificial Sequence
  Synthetic
gtattccagcgccgacggagacctcgtggggtggcctagcccccccgggaccagatccctggagccgtgcacttg

SEQ ID NO: 124915 - DNA, 75 bp, Artificial Sequence
  Synthetic
gtattccagcgccgacggagacctcgtggggtggcccagcccccccgggaccagatccctggagccatgcacttg

SEQ ID NO: 124916 - DNA, 75 bp, Artificial Sequence
  Synthetic
gtattccagcgccgacggagacctcgtggggtggcccagcccccccgggaccagatccctggagccttgcacttg

SEQ ID NO: 124917 - DNA, 75 bp, Artificial Sequence
  Synthetic
gtattccagcgccgacggagacctcgtggggtggcccagcccccccgggaccagatccctggagccctgcacttg

SEQ ID NO: 124918 - DNA, 75 bp, Artificial Sequence
  Synthetic
gtattccagcgccgacggagacctcgtggggtggcccagcccccccgggaccagatccctggagccgtgcacttg

SEQ ID NO: 124919 - DNA, 75 bp, Artificial Sequence
  Synthetic
gtattccagcgccgacggagacctcgtggggtggccgagcccccccgggaccagatccctggagccatgcacttg

SEQ ID NO: 124920 - DNA, 75 bp, Artificial Sequence
  Synthetic
gtattccagcgccgacggagacctcgtggggtggccgagcccccccgggaccagatccctggagccttgcacttg

SEQ ID NO: 124921 - DNA, 75 bp, Artificial Sequence
  Synthetic
gtattccagcgccgacggagacctcgtggggtggccgagcccccccgggaccagatccctggagccctgcacttg

SEQ ID NO: 124922 - DNA, 75 bp, Artificial Sequence
  Synthetic
gtattccagcgccgacggagacctcgtggggtggccgagcccccccgggaccagatccctggagccgtgcacttg

SEQ ID NO: 124923 - DNA, 75 bp, Artificial Sequence
  Synthetic
gtattccagcgccgacggtgacctcgtggggtggccaagcccccccgggaccagatccctggagccatgcacttg

SEQ ID NO: 124924 - DNA, 75 bp, Artificial Sequence
  Synthetic
gtattccagcgccgacggtgacctcgtggggtggccaagcccccccgggaccagatccctggagccttgcacttg

SEQ ID NO: 124925 - DNA, 75 bp, Artificial Sequence
  Synthetic
gtattccagcgccgacggtgacctcgtggggtggccaagcccccccgggaccagatccctggagccctgcacttg

SEQ ID NO: 124926 - DNA, 75 bp, Artificial Sequence
  Synthetic
gtattccagcgccgacggtgacctcgtggggtggccaagcccccccgggaccagatccctggagccgtgcacttg

SEQ ID NO: 124927 - DNA, 75 bp, Artificial Sequence
  Synthetic
gtattccagcgccgacggtgacctcgtggggtggcctagcccccccgggaccagatccctggagccatgcacttg

SEQ ID NO: 124928 - DNA, 75 bp, Artificial Sequence
  Synthetic
gtattccagcgccgacggtgacctcgtggggtggcctagcccccccgggaccagatccctggagccttgcacttg

SEQ ID NO: 124929 - DNA, 75 bp, Artificial Sequence
  Synthetic
gtattccagcgccgacggtgacctcgtggggtggcctagcccccccgggaccagatccctggagccctgcacttg

SEQ ID NO: 124930 - DNA, 75 bp, Artificial Sequence
  Synthetic
gtattccagcgccgacggtgacctcgtggggtggcctagcccccccgggaccagatccctggagccgtgcacttg

SEQ ID NO: 124931 - DNA, 75 bp, Artificial Sequence
  Synthetic
gtattccagcgccgacggtgacctcgtggggtggcccagcccccccgggaccagatccctggagccatgcacttg

SEQ ID NO: 124932 - DNA, 75 bp, Artificial Sequence
  Synthetic
gtattccagcgccgacggtgacctcgtggggtggcccagcccccccgggaccagatccctggagccttgcacttg

SEQ ID NO: 124933 - DNA, 75 bp, Artificial Sequence
  Synthetic
gtattccagcgccgacggtgacctcgtggggtggcccagcccccccgggaccagatccctggagccctgcacttg

SEQ ID NO: 124934 - DNA, 75 bp, Artificial Sequence
  Synthetic
gtattccagcgccgacggtgacctcgtggggtggcccagcccccccgggaccagatccctggagccgtgcacttg

SEQ ID NO: 124935 - DNA, 75 bp, Artificial Sequence
  Synthetic
gtattccagcgccgacggtgacctcgtggggtggccgagcccccccgggaccagatccctggagccatgcacttg

SEQ ID NO: 124936 - DNA, 75 bp, Artificial Sequence
  Synthetic
gtattccagcgccgacggtgacctcgtggggtggccgagcccccccgggaccagatccctggagccttgcacttg

SEQ ID NO: 124937 - DNA, 75 bp, Artificial Sequence
  Synthetic
gtattccagcgccgacggtgacctcgtggggtggccgagcccccccgggaccagatccctggagccctgcacttg

SEQ ID NO: 124938 - DNA, 75 bp, Artificial Sequence
  Synthetic
gtattccagcgccgacggtgacctcgtggggtggccgagcccccccgggaccagatccctggagccgtgcacttg

SEQ ID NO: 124939 - DNA, 75 bp, Artificial Sequence
  Synthetic
gtattccagcgccgacggcgacctcgtggggtggccaagcccccccgggaccagatccctggagccatgcacttg

SEQ ID NO: 124940 - DNA, 75 bp, Artificial Sequence
  Synthetic
gtattccagcgccgacggcgacctcgtggggtggccaagcccccccgggaccagatccctggagccttgcacttg

SEQ ID NO: 124941 - DNA, 75 bp, Artificial Sequence
  Synthetic
gtattccagcgccgacggcgacctcgtggggtggccaagcccccccgggaccagatccctggagccctgcacttg

SEQ ID NO: 124942 - DNA, 75 bp, Artificial Sequence
  Synthetic
gtattccagcgccgacggcgacctcgtggggtggccaagcccccccgggaccagatccctggagccgtgcacttg

SEQ ID NO: 124943 - DNA, 75 bp, Artificial Sequence
  Synthetic
gtattccagcgccgacggcgacctcgtggggtggcctagcccccccgggaccagatccctggagccatgcacttg

SEQ ID NO: 124944 - DNA, 75 bp, Artificial Sequence
  Synthetic
gtattccagcgccgacggcgacctcgtggggtggcctagcccccccgggaccagatccctggagccttgcacttg

SEQ ID NO: 124945 - DNA, 75 bp, Artificial Sequence
  Synthetic
gtattccagcgccgacggcgacctcgtggggtggcctagcccccccgggaccagatccctggagccctgcacttg

SEQ ID NO: 124946 - DNA, 75 bp, Artificial Sequence
  Synthetic
gtattccagcgccgacggcgacctcgtggggtggcctagcccccccgggaccagatccctggagccgtgcacttg

SEQ ID NO: 124947 - DNA, 75 bp, Artificial Sequence
  Synthetic
gtattccagcgccgacggcgacctcgtggggtggcccagcccccccgggaccagatccctggagccatgcacttg

SEQ ID NO: 124948 - DNA, 75 bp, Artificial Sequence
  Synthetic
gtattccagcgccgacggcgacctcgtggggtggcccagcccccccgggaccagatccctggagccttgcacttg

SEQ ID NO: 124949 - DNA, 75 bp, Artificial Sequence
  Synthetic
gtattccagcgccgacggcgacctcgtggggtggcccagcccccccgggaccagatccctggagccctgcacttg

SEQ ID NO: 124950 - DNA, 75 bp, Artificial Sequence
  Synthetic
gtattccagcgccgacggcgacctcgtggggtggcccagcccccccgggaccagatccctggagccgtgcacttg

SEQ ID NO: 124951 - DNA, 75 bp, Artificial Sequence
  Synthetic
gtattccagcgccgacggcgacctcgtggggtggccgagcccccccgggaccagatccctggagccatgcacttg

SEQ ID NO: 124952 - DNA, 75 bp, Artificial Sequence
  Synthetic
gtattccagcgccgacggcgacctcgtggggtggccgagcccccccgggaccagatccctggagccttgcacttg

SEQ ID NO: 124953 - DNA, 75 bp, Artificial Sequence
  Synthetic
gtattccagcgccgacggcgacctcgtggggtggccgagcccccccgggaccagatccctggagccctgcacttg

SEQ ID NO: 124954 - DNA, 75 bp, Artificial Sequence
  Synthetic
gtattccagcgccgacggcgacctcgtggggtggccgagcccccccgggaccagatccctggagccgtgcacttg

SEQ ID NO: 124955 - DNA, 75 bp, Artificial Sequence
  Synthetic
gtattccagcgccgacggggacctcgtggggtggccaagcccccccgggaccagatccctggagccatgcacttg

SEQ ID NO: 124956 - DNA, 75 bp, Artificial Sequence
  Synthetic
gtattccagcgccgacggggacctcgtggggtggccaagcccccccgggaccagatccctggagccttgcacttg

SEQ ID NO: 124957 - DNA, 75 bp, Artificial Sequence
  Synthetic
gtattccagcgccgacggggacctcgtggggtggccaagcccccccgggaccagatccctggagccctgcacttg

SEQ ID NO: 124958 - DNA, 75 bp, Artificial Sequence
  Synthetic
gtattccagcgccgacggggacctcgtggggtggccaagcccccccgggaccagatccctggagccgtgcacttg

SEQ ID NO: 124959 - DNA, 75 bp, Artificial Sequence
  Synthetic
gtattccagcgccgacggggacctcgtggggtggcctagcccccccgggaccagatccctggagccatgcacttg

SEQ ID NO: 124960 - DNA, 75 bp, Artificial Sequence
  Synthetic
gtattccagcgccgacggggacctcgtggggtggcctagcccccccgggaccagatccctggagccttgcacttg

SEQ ID NO: 124961 - DNA, 75 bp, Artificial Sequence
  Synthetic
gtattccagcgccgacggggacctcgtggggtggcctagcccccccgggaccagatccctggagccctgcacttg

SEQ ID NO: 124962 - DNA, 75 bp, Artificial Sequence
  Synthetic
gtattccagcgccgacggggacctcgtggggtggcctagcccccccgggaccagatccctggagccgtgcacttg

SEQ ID NO: 124963 - DNA, 75 bp, Artificial Sequence
  Synthetic
gtattccagcgccgacggggacctcgtggggtggcccagcccccccgggaccagatccctggagccatgcacttg

SEQ ID NO: 124964 - DNA, 75 bp, Artificial Sequence
  Synthetic
gtattccagcgccgacggggacctcgtggggtggcccagcccccccgggaccagatccctggagccttgcacttg

SEQ ID NO: 124965 - DNA, 75 bp, Artificial Sequence
  Synthetic
gtattccagcgccgacggggacctcgtggggtggcccagcccccccgggaccagatccctggagccctgcacttg

SEQ ID NO: 124966 - DNA, 75 bp, Artificial Sequence
  Synthetic
gtattccagcgccgacggggacctcgtggggtggcccagcccccccgggaccagatccctggagccgtgcacttg

SEQ ID NO: 124967 - DNA, 75 bp, Artificial Sequence
  Synthetic
gtattccagcgccgacggggacctcgtggggtggccgagcccccccgggaccagatccctggagccatgcacttg

SEQ ID NO: 124968 - DNA, 75 bp, Artificial Sequence
  Synthetic
gtattccagcgccgacggggacctcgtggggtggccgagcccccccgggaccagatccctggagccttgcacttg

SEQ ID NO: 124969 - DNA, 75 bp, Artificial Sequence
  Synthetic
gtattccagcgccgacggggacctcgtggggtggccgagcccccccgggaccagatccctggagccctgcacttg

SEQ ID NO: 124970 - DNA, 75 bp, Artificial Sequence
  Synthetic
gtattccagcgccgacggggacctcgtggggtggccgagcccccccgggaccagatccctggagccgtgcacttg

SEQ ID NO: 124971 - DNA, 75 bp, Artificial Sequence
  Synthetic
gtgctggacgcacactatgactcagtcttgcaggacattaagcgggccgcctctaaggttagtgcgaggctcctc

SEQ ID NO: 124972 - DNA, 75 bp, Artificial Sequence
  Synthetic
tcctctcttaaagggtcatcgggaggacctgtcctctgccctaggggccaagctgtcggaattttccgggcagcc

SEQ ID NO: 124973 - DNA, 75 bp, Artificial Sequence
  Synthetic
tcctctcttaaagggtcatcgggaggacctgtcctctgccctaggggccatgctgtcggaattttccgggcagcc

SEQ ID NO: 124974 - DNA, 75 bp, Artificial Sequence
  Synthetic
tcctctcttaaagggtcatcgggaggacctgtcctctgccctaggggccacgctgtcggaattttccgggcagcc

SEQ ID NO: 124975 - DNA, 75 bp, Artificial Sequence
  Synthetic
tcctctcttaaagggtcatcgggaggacctgtcctctgccctaggggccaggctgtcggaattttccgggcagcc

SEQ ID NO: 124976 - DNA, 75 bp, Artificial Sequence
  Synthetic
tcctctcttaaagggtcttcgggaggacctgtcctctgccctaggggccaagctgtcggaattttccgggcagcc

SEQ ID NO: 124977 - DNA, 75 bp, Artificial Sequence
  Synthetic
tcctctcttaaagggtcttcgggaggacctgtcctctgccctaggggccatgctgtcggaattttccgggcagcc

SEQ ID NO: 124978 - DNA, 75 bp, Artificial Sequence
  Synthetic
tcctctcttaaagggtcttcgggaggacctgtcctctgccctaggggccacgctgtcggaattttccgggcagcc

SEQ ID NO: 124979 - DNA, 75 bp, Artificial Sequence
  Synthetic
tcctctcttaaagggtcttcgggaggacctgtcctctgccctaggggccaggctgtcggaattttccgggcagcc

SEQ ID NO: 124980 - DNA, 75 bp, Artificial Sequence
  Synthetic
tcctctcttaaagggtcctcgggaggacctgtcctctgccctaggggccaagctgtcggaattttccgggcagcc

SEQ ID NO: 124981 - DNA, 75 bp, Artificial Sequence
  Synthetic
tcctctcttaaagggtcctcgggaggacctgtcctctgccctaggggccatgctgtcggaattttccgggcagcc

SEQ ID NO: 124982 - DNA, 75 bp, Artificial Sequence
  Synthetic
tcctctcttaaagggtcctcgggaggacctgtcctctgccctaggggccacgctgtcggaattttccgggcagcc

SEQ ID NO: 124983 - DNA, 75 bp, Artificial Sequence
  Synthetic
tcctctcttaaagggtcctcgggaggacctgtcctctgccctaggggccaggctgtcggaattttccgggcagcc

SEQ ID NO: 124984 - DNA, 75 bp, Artificial Sequence
  Synthetic
tcctctcttaaagggtcgtcgggaggacctgtcctctgccctaggggccaagctgtcggaattttccgggcagcc

SEQ ID NO: 124985 - DNA, 75 bp, Artificial Sequence
  Synthetic
tcctctcttaaagggtcgtcgggaggacctgtcctctgccctaggggccatgctgtcggaattttccgggcagcc

SEQ ID NO: 124986 - DNA, 75 bp, Artificial Sequence
  Synthetic
tcctctcttaaagggtcgtcgggaggacctgtcctctgccctaggggccacgctgtcggaattttccgggcagcc

SEQ ID NO: 124987 - DNA, 75 bp, Artificial Sequence
  Synthetic
tcctctcttaaagggtcgtcgggaggacctgtcctctgccctaggggccaggctgtcggaattttccgggcagcc

SEQ ID NO: 124988 - DNA, 75 bp, Artificial Sequence
  Synthetic
tcctctcttaatgggtcatcgggaggacctgtcctctgccctaggggccaagctgtcggaattttccgggcagcc

SEQ ID NO: 124989 - DNA, 75 bp, Artificial Sequence
  Synthetic
tcctctcttaatgggtcatcgggaggacctgtcctctgccctaggggccatgctgtcggaattttccgggcagcc

SEQ ID NO: 124990 - DNA, 75 bp, Artificial Sequence
  Synthetic
tcctctcttaatgggtcatcgggaggacctgtcctctgccctaggggccacgctgtcggaattttccgggcagcc

SEQ ID NO: 124991 - DNA, 75 bp, Artificial Sequence
  Synthetic
tcctctcttaatgggtcatcgggaggacctgtcctctgccctaggggccaggctgtcggaattttccgggcagcc

SEQ ID NO: 124992 - DNA, 75 bp, Artificial Sequence
  Synthetic
tcctctcttaatgggtcttcgggaggacctgtcctctgccctaggggccaagctgtcggaattttccgggcagcc

SEQ ID NO: 124993 - DNA, 75 bp, Artificial Sequence
  Synthetic
tcctctcttaatgggtcttcgggaggacctgtcctctgccctaggggccatgctgtcggaattttccgggcagcc

SEQ ID NO: 124994 - DNA, 75 bp, Artificial Sequence
  Synthetic
tcctctcttaatgggtcttcgggaggacctgtcctctgccctaggggccacgctgtcggaattttccgggcagcc

SEQ ID NO: 124995 - DNA, 75 bp, Artificial Sequence
  Synthetic
tcctctcttaatgggtcttcgggaggacctgtcctctgccctaggggccaggctgtcggaattttccgggcagcc

SEQ ID NO: 124996 - DNA, 75 bp, Artificial Sequence
  Synthetic
tcctctcttaatgggtcctcgggaggacctgtcctctgccctaggggccaagctgtcggaattttccgggcagcc

SEQ ID NO: 124997 - DNA, 75 bp, Artificial Sequence
  Synthetic
tcctctcttaatgggtcctcgggaggacctgtcctctgccctaggggccatgctgtcggaattttccgggcagcc

SEQ ID NO: 124998 - DNA, 75 bp, Artificial Sequence
  Synthetic
tcctctcttaatgggtcctcgggaggacctgtcctctgccctaggggccacgctgtcggaattttccgggcagcc

SEQ ID NO: 124999 - DNA, 75 bp, Artificial Sequence
  Synthetic
tcctctcttaatgggtcctcgggaggacctgtcctctgccctaggggccaggctgtcggaattttccgggcagcc

SEQ ID NO: 125000 - DNA, 75 bp, Artificial Sequence
  Synthetic
tcctctcttaatgggtcgtcgggaggacctgtcctctgccctaggggccaagctgtcggaattttccgggcagcc

SEQ ID NO: 125001 - DNA, 75 bp, Artificial Sequence
  Synthetic
tcctctcttaatgggtcgtcgggaggacctgtcctctgccctaggggccatgctgtcggaattttccgggcagcc

SEQ ID NO: 125002 - DNA, 75 bp, Artificial Sequence
  Synthetic
tcctctcttaatgggtcgtcgggaggacctgtcctctgccctaggggccacgctgtcggaattttccgggcagcc

SEQ ID NO: 125003 - DNA, 75 bp, Artificial Sequence
  Synthetic
tcctctcttaatgggtcgtcgggaggacctgtcctctgccctaggggccaggctgtcggaattttccgggcagcc

SEQ ID NO: 125004 - DNA, 75 bp, Artificial Sequence
  Synthetic
tcctctcttaacgggtcatcgggaggacctgtcctctgccctaggggccaagctgtcggaattttccgggcagcc

SEQ ID NO: 125005 - DNA, 75 bp, Artificial Sequence
  Synthetic
tcctctcttaacgggtcatcgggaggacctgtcctctgccctaggggccatgctgtcggaattttccgggcagcc

SEQ ID NO: 125006 - DNA, 75 bp, Artificial Sequence
  Synthetic
tcctctcttaacgggtcatcgggaggacctgtcctctgccctaggggccacgctgtcggaattttccgggcagcc

SEQ ID NO: 125007 - DNA, 75 bp, Artificial Sequence
  Synthetic
tcctctcttaacgggtcatcgggaggacctgtcctctgccctaggggccaggctgtcggaattttccgggcagcc

SEQ ID NO: 125008 - DNA, 75 bp, Artificial Sequence
  Synthetic
tcctctcttaacgggtcttcgggaggacctgtcctctgccctaggggccaagctgtcggaattttccgggcagcc

SEQ ID NO: 125009 - DNA, 75 bp, Artificial Sequence
  Synthetic
tcctctcttaacgggtcttcgggaggacctgtcctctgccctaggggccatgctgtcggaattttccgggcagcc

SEQ ID NO: 125010 - DNA, 75 bp, Artificial Sequence
  Synthetic
tcctctcttaacgggtcttcgggaggacctgtcctctgccctaggggccacgctgtcggaattttccgggcagcc

SEQ ID NO: 125011 - DNA, 75 bp, Artificial Sequence
  Synthetic
tcctctcttaacgggtcttcgggaggacctgtcctctgccctaggggccaggctgtcggaattttccgggcagcc

SEQ ID NO: 125012 - DNA, 75 bp, Artificial Sequence
  Synthetic
tcctctcttaacgggtcctcgggaggacctgtcctctgccctaggggccaagctgtcggaattttccgggcagcc

SEQ ID NO: 125013 - DNA, 75 bp, Artificial Sequence
  Synthetic
tcctctcttaacgggtcctcgggaggacctgtcctctgccctaggggccatgctgtcggaattttccgggcagcc

SEQ ID NO: 125014 - DNA, 75 bp, Artificial Sequence
  Synthetic
tcctctcttaacgggtcctcgggaggacctgtcctctgccctaggggccacgctgtcggaattttccgggcagcc

SEQ ID NO: 125015 - DNA, 75 bp, Artificial Sequence
  Synthetic
tcctctcttaacgggtcctcgggaggacctgtcctctgccctaggggccaggctgtcggaattttccgggcagcc

SEQ ID NO: 125016 - DNA, 75 bp, Artificial Sequence
  Synthetic
tcctctcttaacgggtcgtcgggaggacctgtcctctgccctaggggccaagctgtcggaattttccgggcagcc

SEQ ID NO: 125017 - DNA, 75 bp, Artificial Sequence
  Synthetic
tcctctcttaacgggtcgtcgggaggacctgtcctctgccctaggggccatgctgtcggaattttccgggcagcc

SEQ ID NO: 125018 - DNA, 75 bp, Artificial Sequence
  Synthetic
tcctctcttaacgggtcgtcgggaggacctgtcctctgccctaggggccacgctgtcggaattttccgggcagcc

SEQ ID NO: 125019 - DNA, 75 bp, Artificial Sequence
  Synthetic
tcctctcttaacgggtcgtcgggaggacctgtcctctgccctaggggccaggctgtcggaattttccgggcagcc

SEQ ID NO: 125020 - DNA, 75 bp, Artificial Sequence
  Synthetic
tcctctcttaaggggtcatcgggaggacctgtcctctgccctaggggccaagctgtcggaattttccgggcagcc

SEQ ID NO: 125021 - DNA, 75 bp, Artificial Sequence
  Synthetic
tcctctcttaaggggtcatcgggaggacctgtcctctgccctaggggccatgctgtcggaattttccgggcagcc

SEQ ID NO: 125022 - DNA, 75 bp, Artificial Sequence
  Synthetic
tcctctcttaaggggtcatcgggaggacctgtcctctgccctaggggccacgctgtcggaattttccgggcagcc

SEQ ID NO: 125023 - DNA, 75 bp, Artificial Sequence
  Synthetic
tcctctcttaaggggtcatcgggaggacctgtcctctgccctaggggccaggctgtcggaattttccgggcagcc

SEQ ID NO: 125024 - DNA, 75 bp, Artificial Sequence
  Synthetic
tcctctcttaaggggtcttcgggaggacctgtcctctgccctaggggccaagctgtcggaattttccgggcagcc

SEQ ID NO: 125025 - DNA, 75 bp, Artificial Sequence
  Synthetic
tcctctcttaaggggtcttcgggaggacctgtcctctgccctaggggccatgctgtcggaattttccgggcagcc

SEQ ID NO: 125026 - DNA, 75 bp, Artificial Sequence
  Synthetic
tcctctcttaaggggtcttcgggaggacctgtcctctgccctaggggccacgctgtcggaattttccgggcagcc

SEQ ID NO: 125027 - DNA, 75 bp, Artificial Sequence
  Synthetic
tcctctcttaaggggtcttcgggaggacctgtcctctgccctaggggccaggctgtcggaattttccgggcagcc

SEQ ID NO: 125028 - DNA, 75 bp, Artificial Sequence
  Synthetic
tcctctcttaaggggtcctcgggaggacctgtcctctgccctaggggccaagctgtcggaattttccgggcagcc

SEQ ID NO: 125029 - DNA, 75 bp, Artificial Sequence
  Synthetic
tcctctcttaaggggtcctcgggaggacctgtcctctgccctaggggccatgctgtcggaattttccgggcagcc

SEQ ID NO: 125030 - DNA, 75 bp, Artificial Sequence
  Synthetic
tcctctcttaaggggtcctcgggaggacctgtcctctgccctaggggccacgctgtcggaattttccgggcagcc

SEQ ID NO: 125031 - DNA, 75 bp, Artificial Sequence
  Synthetic
tcctctcttaaggggtcctcgggaggacctgtcctctgccctaggggccaggctgtcggaattttccgggcagcc

SEQ ID NO: 125032 - DNA, 75 bp, Artificial Sequence
  Synthetic
tcctctcttaaggggtcgtcgggaggacctgtcctctgccctaggggccaagctgtcggaattttccgggcagcc

SEQ ID NO: 125033 - DNA, 75 bp, Artificial Sequence
  Synthetic
tcctctcttaaggggtcgtcgggaggacctgtcctctgccctaggggccatgctgtcggaattttccgggcagcc

SEQ ID NO: 125034 - DNA, 75 bp, Artificial Sequence
  Synthetic
tcctctcttaaggggtcgtcgggaggacctgtcctctgccctaggggccacgctgtcggaattttccgggcagcc

SEQ ID NO: 125035 - DNA, 75 bp, Artificial Sequence
  Synthetic
tcctctcttaaggggtcgtcgggaggacctgtcctctgccctaggggccaggctgtcggaattttccgggcagcc

SEQ ID NO: 125036 - DNA, 75 bp, Artificial Sequence
  Synthetic
tctcgccatattccatacctggttgagggccaacagattgctgagcagttcaagcagaaaatcttgggcttaatg

SEQ ID NO: 125037 - DNA, 75 bp, Artificial Sequence
  Synthetic
ctgaccagagaccccaccactccaattgccagggctgcctgggaaacagcaagacacactcctgtcaattcatgg

SEQ ID NO: 125038 - DNA, 75 bp, Artificial Sequence
  Synthetic
ttgccagggctgcctgggaaacagcaagacacactcctgtcaattcatggctgggtaacatcatccaatacgccc

SEQ ID NO: 125039 - DNA, 75 bp, Artificial Sequence
  Synthetic
cagaggatgatcgcgagccctccgtaccatcggagtacttgatcaggaggaaaaagtttccaccggcgctacctc

SEQ ID NO: 125040 - DNA, 75 bp, Artificial Sequence
  Synthetic
cagaggatgatcgcgagccctccgtaccatcggagtacttgatcaggaggaataagtttccaccggcgctacctc

SEQ ID NO: 125041 - DNA, 75 bp, Artificial Sequence
  Synthetic
cagaggatgatcgcgagccctccgtaccatcggagtacttgatcaggaggaacaagtttccaccggcgctacctc

SEQ ID NO: 125042 - DNA, 75 bp, Artificial Sequence
  Synthetic
cagaggatgatcgcgagccctccgtaccatcggagtacttgatcaggaggaagaagtttccaccggcgctacctc

SEQ ID NO: 125043 - DNA, 75 bp, Artificial Sequence
  Synthetic
cagtggatgatcgcgagccctccgtaccatcggagtacttgatcaggaggaaaaagtttccaccggcgctacctc

SEQ ID NO: 125044 - DNA, 75 bp, Artificial Sequence
  Synthetic
cagtggatgatcgcgagccctccgtaccatcggagtacttgatcaggaggaataagtttccaccggcgctacctc

SEQ ID NO: 125045 - DNA, 75 bp, Artificial Sequence
  Synthetic
cagtggatgatcgcgagccctccgtaccatcggagtacttgatcaggaggaacaagtttccaccggcgctacctc

SEQ ID NO: 125046 - DNA, 75 bp, Artificial Sequence
  Synthetic
cagtggatgatcgcgagccctccgtaccatcggagtacttgatcaggaggaagaagtttccaccggcgctacctc

SEQ ID NO: 125047 - DNA, 75 bp, Artificial Sequence
  Synthetic
cagcggatgatcgcgagccctccgtaccatcggagtacttgatcaggaggaaaaagtttccaccggcgctacctc

SEQ ID NO: 125048 - DNA, 75 bp, Artificial Sequence
  Synthetic
cagcggatgatcgcgagccctccgtaccatcggagtacttgatcaggaggaataagtttccaccggcgctacctc

SEQ ID NO: 125049 - DNA, 75 bp, Artificial Sequence
  Synthetic
cagcggatgatcgcgagccctccgtaccatcggagtacttgatcaggaggaacaagtttccaccggcgctacctc

SEQ ID NO: 125050 - DNA, 75 bp, Artificial Sequence
  Synthetic
cagcggatgatcgcgagccctccgtaccatcggagtacttgatcaggaggaagaagtttccaccggcgctacctc

SEQ ID NO: 125051 - DNA, 75 bp, Artificial Sequence
  Synthetic
caggggatgatcgcgagccctccgtaccatcggagtacttgatcaggaggaaaaagtttccaccggcgctacctc

SEQ ID NO: 125052 - DNA, 75 bp, Artificial Sequence
  Synthetic
caggggatgatcgcgagccctccgtaccatcggagtacttgatcaggaggaataagtttccaccggcgctacctc

SEQ ID NO: 125053 - DNA, 75 bp, Artificial Sequence
  Synthetic
caggggatgatcgcgagccctccgtaccatcggagtacttgatcaggaggaacaagtttccaccggcgctacctc

SEQ ID NO: 125054 - DNA, 75 bp, Artificial Sequence
  Synthetic
caggggatgatcgcgagccctccgtaccatcggagtacttgatcaggaggaagaagtttccaccggcgctacctc

SEQ ID NO: 125055 - DNA, 75 bp, Artificial Sequence
  Synthetic
ctgaggatgatcgcgagccctccgtaccatcggagtacttgatcaggaggaaaaagtttccaccggcgctacctc

SEQ ID NO: 125056 - DNA, 75 bp, Artificial Sequence
  Synthetic
ctgaggatgatcgcgagccctccgtaccatcggagtacttgatcaggaggaataagtttccaccggcgctacctc

SEQ ID NO: 125057 - DNA, 75 bp, Artificial Sequence
  Synthetic
ctgaggatgatcgcgagccctccgtaccatcggagtacttgatcaggaggaacaagtttccaccggcgctacctc

SEQ ID NO: 125058 - DNA, 75 bp, Artificial Sequence
  Synthetic
ctgaggatgatcgcgagccctccgtaccatcggagtacttgatcaggaggaagaagtttccaccggcgctacctc

SEQ ID NO: 125059 - DNA, 75 bp, Artificial Sequence
  Synthetic
ctgtggatgatcgcgagccctccgtaccatcggagtacttgatcaggaggaaaaagtttccaccggcgctacctc

SEQ ID NO: 125060 - DNA, 75 bp, Artificial Sequence
  Synthetic
ctgtggatgatcgcgagccctccgtaccatcggagtacttgatcaggaggaataagtttccaccggcgctacctc

SEQ ID NO: 125061 - DNA, 75 bp, Artificial Sequence
  Synthetic
ctgtggatgatcgcgagccctccgtaccatcggagtacttgatcaggaggaacaagtttccaccggcgctacctc

SEQ ID NO: 125062 - DNA, 75 bp, Artificial Sequence
  Synthetic
ctgtggatgatcgcgagccctccgtaccatcggagtacttgatcaggaggaagaagtttccaccggcgctacctc

SEQ ID NO: 125063 - DNA, 75 bp, Artificial Sequence
  Synthetic
ctgcggatgatcgcgagccctccgtaccatcggagtacttgatcaggaggaaaaagtttccaccggcgctacctc

SEQ ID NO: 125064 - DNA, 75 bp, Artificial Sequence
  Synthetic
ctgcggatgatcgcgagccctccgtaccatcggagtacttgatcaggaggaataagtttccaccggcgctacctc

SEQ ID NO: 125065 - DNA, 75 bp, Artificial Sequence
  Synthetic
ctgcggatgatcgcgagccctccgtaccatcggagtacttgatcaggaggaacaagtttccaccggcgctacctc

SEQ ID NO: 125066 - DNA, 75 bp, Artificial Sequence
  Synthetic
ctgcggatgatcgcgagccctccgtaccatcggagtacttgatcaggaggaagaagtttccaccggcgctacctc

SEQ ID NO: 125067 - DNA, 75 bp, Artificial Sequence
  Synthetic
ctggggatgatcgcgagccctccgtaccatcggagtacttgatcaggaggaaaaagtttccaccggcgctacctc

SEQ ID NO: 125068 - DNA, 75 bp, Artificial Sequence
  Synthetic
ctggggatgatcgcgagccctccgtaccatcggagtacttgatcaggaggaataagtttccaccggcgctacctc

SEQ ID NO: 125069 - DNA, 75 bp, Artificial Sequence
  Synthetic
ctggggatgatcgcgagccctccgtaccatcggagtacttgatcaggaggaacaagtttccaccggcgctacctc

SEQ ID NO: 125070 - DNA, 75 bp, Artificial Sequence
  Synthetic
ctggggatgatcgcgagccctccgtaccatcggagtacttgatcaggaggaagaagtttccaccggcgctacctc

SEQ ID NO: 125071 - DNA, 75 bp, Artificial Sequence
  Synthetic
ccgaggatgatcgcgagccctccgtaccatcggagtacttgatcaggaggaaaaagtttccaccggcgctacctc

SEQ ID NO: 125072 - DNA, 75 bp, Artificial Sequence
  Synthetic
ccgaggatgatcgcgagccctccgtaccatcggagtacttgatcaggaggaataagtttccaccggcgctacctc

SEQ ID NO: 125073 - DNA, 75 bp, Artificial Sequence
  Synthetic
ccgaggatgatcgcgagccctccgtaccatcggagtacttgatcaggaggaacaagtttccaccggcgctacctc

SEQ ID NO: 125074 - DNA, 75 bp, Artificial Sequence
  Synthetic
ccgaggatgatcgcgagccctccgtaccatcggagtacttgatcaggaggaagaagtttccaccggcgctacctc

SEQ ID NO: 125075 - DNA, 75 bp, Artificial Sequence
  Synthetic
ccgtggatgatcgcgagccctccgtaccatcggagtacttgatcaggaggaaaaagtttccaccggcgctacctc

SEQ ID NO: 125076 - DNA, 75 bp, Artificial Sequence
  Synthetic
ccgtggatgatcgcgagccctccgtaccatcggagtacttgatcaggaggaataagtttccaccggcgctacctc

SEQ ID NO: 125077 - DNA, 75 bp, Artificial Sequence
  Synthetic
ccgtggatgatcgcgagccctccgtaccatcggagtacttgatcaggaggaacaagtttccaccggcgctacctc

SEQ ID NO: 125078 - DNA, 75 bp, Artificial Sequence
  Synthetic
ccgtggatgatcgcgagccctccgtaccatcggagtacttgatcaggaggaagaagtttccaccggcgctacctc

SEQ ID NO: 125079 - DNA, 75 bp, Artificial Sequence
  Synthetic
ccgcggatgatcgcgagccctccgtaccatcggagtacttgatcaggaggaaaaagtttccaccggcgctacctc

SEQ ID NO: 125080 - DNA, 75 bp, Artificial Sequence
  Synthetic
ccgcggatgatcgcgagccctccgtaccatcggagtacttgatcaggaggaataagtttccaccggcgctacctc

SEQ ID NO: 125081 - DNA, 75 bp, Artificial Sequence
  Synthetic
ccgcggatgatcgcgagccctccgtaccatcggagtacttgatcaggaggaacaagtttccaccggcgctacctc

SEQ ID NO: 125082 - DNA, 75 bp, Artificial Sequence
  Synthetic
ccgcggatgatcgcgagccctccgtaccatcggagtacttgatcaggaggaagaagtttccaccggcgctacctc

SEQ ID NO: 125083 - DNA, 75 bp, Artificial Sequence
  Synthetic
ccggggatgatcgcgagccctccgtaccatcggagtacttgatcaggaggaaaaagtttccaccggcgctacctc

SEQ ID NO: 125084 - DNA, 75 bp, Artificial Sequence
  Synthetic
ccggggatgatcgcgagccctccgtaccatcggagtacttgatcaggaggaataagtttccaccggcgctacctc

SEQ ID NO: 125085 - DNA, 75 bp, Artificial Sequence
  Synthetic
ccggggatgatcgcgagccctccgtaccatcggagtacttgatcaggaggaacaagtttccaccggcgctacctc

SEQ ID NO: 125086 - DNA, 75 bp, Artificial Sequence
  Synthetic
ccggggatgatcgcgagccctccgtaccatcggagtacttgatcaggaggaagaagtttccaccggcgctacctc

SEQ ID NO: 125087 - DNA, 75 bp, Artificial Sequence
  Synthetic
cggaggatgatcgcgagccctccgtaccatcggagtacttgatcaggaggaaaaagtttccaccggcgctacctc

SEQ ID NO: 125088 - DNA, 75 bp, Artificial Sequence
  Synthetic
cggaggatgatcgcgagccctccgtaccatcggagtacttgatcaggaggaataagtttccaccggcgctacctc

SEQ ID NO: 125089 - DNA, 75 bp, Artificial Sequence
  Synthetic
cggaggatgatcgcgagccctccgtaccatcggagtacttgatcaggaggaacaagtttccaccggcgctacctc

SEQ ID NO: 125090 - DNA, 75 bp, Artificial Sequence
  Synthetic
cggaggatgatcgcgagccctccgtaccatcggagtacttgatcaggaggaagaagtttccaccggcgctacctc

SEQ ID NO: 125091 - DNA, 75 bp, Artificial Sequence
  Synthetic
cggtggatgatcgcgagccctccgtaccatcggagtacttgatcaggaggaaaaagtttccaccggcgctacctc

SEQ ID NO: 125092 - DNA, 75 bp, Artificial Sequence
  Synthetic
cggtggatgatcgcgagccctccgtaccatcggagtacttgatcaggaggaataagtttccaccggcgctacctc

SEQ ID NO: 125093 - DNA, 75 bp, Artificial Sequence
  Synthetic
cggtggatgatcgcgagccctccgtaccatcggagtacttgatcaggaggaacaagtttccaccggcgctacctc

SEQ ID NO: 125094 - DNA, 75 bp, Artificial Sequence
  Synthetic
cggtggatgatcgcgagccctccgtaccatcggagtacttgatcaggaggaagaagtttccaccggcgctacctc

SEQ ID NO: 125095 - DNA, 75 bp, Artificial Sequence
  Synthetic
cggcggatgatcgcgagccctccgtaccatcggagtacttgatcaggaggaaaaagtttccaccggcgctacctc

SEQ ID NO: 125096 - DNA, 75 bp, Artificial Sequence
  Synthetic
cggcggatgatcgcgagccctccgtaccatcggagtacttgatcaggaggaataagtttccaccggcgctacctc

SEQ ID NO: 125097 - DNA, 75 bp, Artificial Sequence
  Synthetic
cggcggatgatcgcgagccctccgtaccatcggagtacttgatcaggaggaacaagtttccaccggcgctacctc

SEQ ID NO: 125098 - DNA, 75 bp, Artificial Sequence
  Synthetic
cggcggatgatcgcgagccctccgtaccatcggagtacttgatcaggaggaagaagtttccaccggcgctacctc

SEQ ID NO: 125099 - DNA, 75 bp, Artificial Sequence
  Synthetic
cgggggatgatcgcgagccctccgtaccatcggagtacttgatcaggaggaaaaagtttccaccggcgctacctc

SEQ ID NO: 125100 - DNA, 75 bp, Artificial Sequence
  Synthetic
cgggggatgatcgcgagccctccgtaccatcggagtacttgatcaggaggaataagtttccaccggcgctacctc

SEQ ID NO: 125101 - DNA, 75 bp, Artificial Sequence
  Synthetic
cgggggatgatcgcgagccctccgtaccatcggagtacttgatcaggaggaacaagtttccaccggcgctacctc

SEQ ID NO: 125102 - DNA, 75 bp, Artificial Sequence
  Synthetic
cgggggatgatcgcgagccctccgtaccatcggagtacttgatcaggaggaagaagtttccaccggcgctacctc

SEQ ID NO: 125103 - DNA, 75 bp, Artificial Sequence
  Synthetic
cagctgtgccccagacctaccaagtgggatacctccatgcccccactggtagcgggaagagcacaaaggtccctg

SEQ ID NO: 125104 - DNA, 75 bp, Artificial Sequence
  Synthetic
cagctgtgccccagacctaccaagtgggatacctccatgcccccactggtagcgggaagagcactaaggtccctg

SEQ ID NO: 125105 - DNA, 75 bp, Artificial Sequence
  Synthetic
cagctgtgccccagacctaccaagtgggatacctccatgcccccactggtagcgggaagagcaccaaggtccctg

SEQ ID NO: 125106 - DNA, 75 bp, Artificial Sequence
  Synthetic
cagctgtgccccagacctaccaagtgggatacctccatgcccccactggtagcgggaagagcacgaaggtccctg

SEQ ID NO: 125107 - DNA, 75 bp, Artificial Sequence
  Synthetic
gcggcattcaatacctcgcaggtctttcaaccttgcctgggaacccagctgtggcctctctgatgtctttctctg

SEQ ID NO: 125108 - DNA, 75 bp, Artificial Sequence
  Synthetic
cccagaggtaggcgccagcccataccaaaggcgcgcccgccaacgggccgtagctggggtcaacccggctacccc

SEQ ID NO: 125109 - DNA, 75 bp, Artificial Sequence
  Synthetic
acatgtcaaaagcgcatggaataaatcccaacataaggacgggggtccgcacagtgacaacaggagatgccatta

SEQ ID NO: 125110 - DNA, 75 bp, Artificial Sequence
  Synthetic
acatgtcaaaagcgcatggaataaatcccaacataaggacgggggtccgcacagtgacaactggagatgccatta

SEQ ID NO: 125111 - DNA, 75 bp, Artificial Sequence
  Synthetic
acatgtcaaaagcgcatggaataaatcccaacataaggacgggggtccgcacagtgacaaccggagatgccatta

SEQ ID NO: 125112 - DNA, 75 bp, Artificial Sequence
  Synthetic
acatgtcaaaagcgcatggaataaatcccaacataaggacgggggtccgcacagtgacaacgggagatgccatta

SEQ ID NO: 125113 - DNA, 75 bp, Artificial Sequence
  Synthetic
acatgtcaaaagcgcatggaataaatcccaacattaggacgggggtccgcacagtgacaacaggagatgccatta

SEQ ID NO: 125114 - DNA, 75 bp, Artificial Sequence
  Synthetic
acatgtcaaaagcgcatggaataaatcccaacattaggacgggggtccgcacagtgacaactggagatgccatta

SEQ ID NO: 125115 - DNA, 75 bp, Artificial Sequence
  Synthetic
acatgtcaaaagcgcatggaataaatcccaacattaggacgggggtccgcacagtgacaaccggagatgccatta

SEQ ID NO: 125116 - DNA, 75 bp, Artificial Sequence
  Synthetic
acatgtcaaaagcgcatggaataaatcccaacattaggacgggggtccgcacagtgacaacgggagatgccatta

SEQ ID NO: 125117 - DNA, 75 bp, Artificial Sequence
  Synthetic
acatgtcaaaagcgcatggaataaatcccaacatcaggacgggggtccgcacagtgacaacaggagatgccatta

SEQ ID NO: 125118 - DNA, 75 bp, Artificial Sequence
  Synthetic
acatgtcaaaagcgcatggaataaatcccaacatcaggacgggggtccgcacagtgacaactggagatgccatta

SEQ ID NO: 125119 - DNA, 75 bp, Artificial Sequence
  Synthetic
acatgtcaaaagcgcatggaataaatcccaacatcaggacgggggtccgcacagtgacaaccggagatgccatta

SEQ ID NO: 125120 - DNA, 75 bp, Artificial Sequence
  Synthetic
acatgtcaaaagcgcatggaataaatcccaacatcaggacgggggtccgcacagtgacaacgggagatgccatta

SEQ ID NO: 125121 - DNA, 75 bp, Artificial Sequence
  Synthetic
acatgtcaaaagcgcatggaataaatcccaacatgaggacgggggtccgcacagtgacaacaggagatgccatta

SEQ ID NO: 125122 - DNA, 75 bp, Artificial Sequence
  Synthetic
acatgtcaaaagcgcatggaataaatcccaacatgaggacgggggtccgcacagtgacaactggagatgccatta

SEQ ID NO: 125123 - DNA, 75 bp, Artificial Sequence
  Synthetic
acatgtcaaaagcgcatggaataaatcccaacatgaggacgggggtccgcacagtgacaaccggagatgccatta

SEQ ID NO: 125124 - DNA, 75 bp, Artificial Sequence
  Synthetic
acatgtcaaaagcgcatggaataaatcccaacatgaggacgggggtccgcacagtgacaacgggagatgccatta

SEQ ID NO: 125125 - DNA, 75 bp, Artificial Sequence
  Synthetic
acatgtcaaaagcgcatggaattaatcccaacataaggacgggggtccgcacagtgacaacaggagatgccatta

SEQ ID NO: 125126 - DNA, 75 bp, Artificial Sequence
  Synthetic
acatgtcaaaagcgcatggaattaatcccaacataaggacgggggtccgcacagtgacaactggagatgccatta

SEQ ID NO: 125127 - DNA, 75 bp, Artificial Sequence
  Synthetic
acatgtcaaaagcgcatggaattaatcccaacataaggacgggggtccgcacagtgacaaccggagatgccatta

SEQ ID NO: 125128 - DNA, 75 bp, Artificial Sequence
  Synthetic
acatgtcaaaagcgcatggaattaatcccaacataaggacgggggtccgcacagtgacaacgggagatgccatta

SEQ ID NO: 125129 - DNA, 75 bp, Artificial Sequence
  Synthetic
acatgtcaaaagcgcatggaattaatcccaacattaggacgggggtccgcacagtgacaacaggagatgccatta

SEQ ID NO: 125130 - DNA, 75 bp, Artificial Sequence
  Synthetic
acatgtcaaaagcgcatggaattaatcccaacattaggacgggggtccgcacagtgacaactggagatgccatta

SEQ ID NO: 125131 - DNA, 75 bp, Artificial Sequence
  Synthetic
acatgtcaaaagcgcatggaattaatcccaacattaggacgggggtccgcacagtgacaaccggagatgccatta

SEQ ID NO: 125132 - DNA, 75 bp, Artificial Sequence
  Synthetic
acatgtcaaaagcgcatggaattaatcccaacattaggacgggggtccgcacagtgacaacgggagatgccatta

SEQ ID NO: 125133 - DNA, 75 bp, Artificial Sequence
  Synthetic
acatgtcaaaagcgcatggaattaatcccaacatcaggacgggggtccgcacagtgacaacaggagatgccatta

SEQ ID NO: 125134 - DNA, 75 bp, Artificial Sequence
  Synthetic
acatgtcaaaagcgcatggaattaatcccaacatcaggacgggggtccgcacagtgacaactggagatgccatta

SEQ ID NO: 125135 - DNA, 75 bp, Artificial Sequence
  Synthetic
acatgtcaaaagcgcatggaattaatcccaacatcaggacgggggtccgcacagtgacaaccggagatgccatta

SEQ ID NO: 125136 - DNA, 75 bp, Artificial Sequence
  Synthetic
acatgtcaaaagcgcatggaattaatcccaacatcaggacgggggtccgcacagtgacaacgggagatgccatta

SEQ ID NO: 125137 - DNA, 75 bp, Artificial Sequence
  Synthetic
acatgtcaaaagcgcatggaattaatcccaacatgaggacgggggtccgcacagtgacaacaggagatgccatta

SEQ ID NO: 125138 - DNA, 75 bp, Artificial Sequence
  Synthetic
acatgtcaaaagcgcatggaattaatcccaacatgaggacgggggtccgcacagtgacaactggagatgccatta

SEQ ID NO: 125139 - DNA, 75 bp, Artificial Sequence
  Synthetic
acatgtcaaaagcgcatggaattaatcccaacatgaggacgggggtccgcacagtgacaaccggagatgccatta

SEQ ID NO: 125140 - DNA, 75 bp, Artificial Sequence
  Synthetic
acatgtcaaaagcgcatggaattaatcccaacatgaggacgggggtccgcacagtgacaacgggagatgccatta

SEQ ID NO: 125141 - DNA, 75 bp, Artificial Sequence
  Synthetic
acatgtcaaaagcgcatggaatcaatcccaacataaggacgggggtccgcacagtgacaacaggagatgccatta

SEQ ID NO: 125142 - DNA, 75 bp, Artificial Sequence
  Synthetic
acatgtcaaaagcgcatggaatcaatcccaacataaggacgggggtccgcacagtgacaactggagatgccatta

SEQ ID NO: 125143 - DNA, 75 bp, Artificial Sequence
  Synthetic
acatgtcaaaagcgcatggaatcaatcccaacataaggacgggggtccgcacagtgacaaccggagatgccatta

SEQ ID NO: 125144 - DNA, 75 bp, Artificial Sequence
  Synthetic
acatgtcaaaagcgcatggaatcaatcccaacataaggacgggggtccgcacagtgacaacgggagatgccatta

SEQ ID NO: 125145 - DNA, 75 bp, Artificial Sequence
  Synthetic
acatgtcaaaagcgcatggaatcaatcccaacattaggacgggggtccgcacagtgacaacaggagatgccatta

SEQ ID NO: 125146 - DNA, 75 bp, Artificial Sequence
  Synthetic
acatgtcaaaagcgcatggaatcaatcccaacattaggacgggggtccgcacagtgacaactggagatgccatta

SEQ ID NO: 125147 - DNA, 75 bp, Artificial Sequence
  Synthetic
acatgtcaaaagcgcatggaatcaatcccaacattaggacgggggtccgcacagtgacaaccggagatgccatta

SEQ ID NO: 125148 - DNA, 75 bp, Artificial Sequence
  Synthetic
acatgtcaaaagcgcatggaatcaatcccaacattaggacgggggtccgcacagtgacaacgggagatgccatta

SEQ ID NO: 125149 - DNA, 75 bp, Artificial Sequence
  Synthetic
acatgtcaaaagcgcatggaatcaatcccaacatcaggacgggggtccgcacagtgacaacaggagatgccatta

SEQ ID NO: 125150 - DNA, 75 bp, Artificial Sequence
  Synthetic
acatgtcaaaagcgcatggaatcaatcccaacatcaggacgggggtccgcacagtgacaactggagatgccatta

SEQ ID NO: 125151 - DNA, 75 bp, Artificial Sequence
  Synthetic
acatgtcaaaagcgcatggaatcaatcccaacatcaggacgggggtccgcacagtgacaaccggagatgccatta

SEQ ID NO: 125152 - DNA, 75 bp, Artificial Sequence
  Synthetic
acatgtcaaaagcgcatggaatcaatcccaacatcaggacgggggtccgcacagtgacaacgggagatgccatta

SEQ ID NO: 125153 - DNA, 75 bp, Artificial Sequence
  Synthetic
acatgtcaaaagcgcatggaatcaatcccaacatgaggacgggggtccgcacagtgacaacaggagatgccatta

SEQ ID NO: 125154 - DNA, 75 bp, Artificial Sequence
  Synthetic
acatgtcaaaagcgcatggaatcaatcccaacatgaggacgggggtccgcacagtgacaactggagatgccatta

SEQ ID NO: 125155 - DNA, 75 bp, Artificial Sequence
  Synthetic
acatgtcaaaagcgcatggaatcaatcccaacatgaggacgggggtccgcacagtgacaaccggagatgccatta

SEQ ID NO: 125156 - DNA, 75 bp, Artificial Sequence
  Synthetic
acatgtcaaaagcgcatggaatcaatcccaacatgaggacgggggtccgcacagtgacaacgggagatgccatta

SEQ ID NO: 125157 - DNA, 75 bp, Artificial Sequence
  Synthetic
acatgtcaaaagcgcatggaatgaatcccaacataaggacgggggtccgcacagtgacaacaggagatgccatta

SEQ ID NO: 125158 - DNA, 75 bp, Artificial Sequence
  Synthetic
acatgtcaaaagcgcatggaatgaatcccaacataaggacgggggtccgcacagtgacaactggagatgccatta

SEQ ID NO: 125159 - DNA, 75 bp, Artificial Sequence
  Synthetic
acatgtcaaaagcgcatggaatgaatcccaacataaggacgggggtccgcacagtgacaaccggagatgccatta

SEQ ID NO: 125160 - DNA, 75 bp, Artificial Sequence
  Synthetic
acatgtcaaaagcgcatggaatgaatcccaacataaggacgggggtccgcacagtgacaacgggagatgccatta

SEQ ID NO: 125161 - DNA, 75 bp, Artificial Sequence
  Synthetic
acatgtcaaaagcgcatggaatgaatcccaacattaggacgggggtccgcacagtgacaacaggagatgccatta

SEQ ID NO: 125162 - DNA, 75 bp, Artificial Sequence
  Synthetic
acatgtcaaaagcgcatggaatgaatcccaacattaggacgggggtccgcacagtgacaactggagatgccatta

SEQ ID NO: 125163 - DNA, 75 bp, Artificial Sequence
  Synthetic
acatgtcaaaagcgcatggaatgaatcccaacattaggacgggggtccgcacagtgacaaccggagatgccatta

SEQ ID NO: 125164 - DNA, 75 bp, Artificial Sequence
  Synthetic
acatgtcaaaagcgcatggaatgaatcccaacattaggacgggggtccgcacagtgacaacgggagatgccatta

SEQ ID NO: 125165 - DNA, 75 bp, Artificial Sequence
  Synthetic
acatgtcaaaagcgcatggaatgaatcccaacatcaggacgggggtccgcacagtgacaacaggagatgccatta

SEQ ID NO: 125166 - DNA, 75 bp, Artificial Sequence
  Synthetic
acatgtcaaaagcgcatggaatgaatcccaacatcaggacgggggtccgcacagtgacaactggagatgccatta

SEQ ID NO: 125167 - DNA, 75 bp, Artificial Sequence
  Synthetic
acatgtcaaaagcgcatggaatgaatcccaacatcaggacgggggtccgcacagtgacaaccggagatgccatta

SEQ ID NO: 125168 - DNA, 75 bp, Artificial Sequence
  Synthetic
acatgtcaaaagcgcatggaatgaatcccaacatcaggacgggggtccgcacagtgacaacgggagatgccatta

SEQ ID NO: 125169 - DNA, 75 bp, Artificial Sequence
  Synthetic
acatgtcaaaagcgcatggaatgaatcccaacatgaggacgggggtccgcacagtgacaacaggagatgccatta

SEQ ID NO: 125170 - DNA, 75 bp, Artificial Sequence
  Synthetic
acatgtcaaaagcgcatggaatgaatcccaacatgaggacgggggtccgcacagtgacaactggagatgccatta

SEQ ID NO: 125171 - DNA, 75 bp, Artificial Sequence
  Synthetic
acatgtcaaaagcgcatggaatgaatcccaacatgaggacgggggtccgcacagtgacaaccggagatgccatta

SEQ ID NO: 125172 - DNA, 75 bp, Artificial Sequence
  Synthetic
acatgtcaaaagcgcatggaatgaatcccaacatgaggacgggggtccgcacagtgacaacgggagatgccatta

SEQ ID NO: 125173 - DNA, 75 bp, Artificial Sequence
  Synthetic
gtttgttgtgagtgggctagcaggggctgctattggcagtataggcctgagcaaggtcattgttgacatcttggc

SEQ ID NO: 125174 - DNA, 75 bp, Artificial Sequence
  Synthetic
gaagagccgggcacgagcagtcagggcagccctcatctcccgtgggggaagggcggccatatgtggccgctacct

SEQ ID NO: 125175 - DNA, 75 bp, Artificial Sequence
  Synthetic
catcctcggcatcggaaccgtccttgaccaagctgagacagcaggagttaggttggtagtcttagccacggcgac

SEQ ID NO: 125176 - DNA, 75 bp, Artificial Sequence
  Synthetic
catcctcggcatcggtaccgtccttgaccaagctgagacagcaggagttaggttggtagtcttagccacggcgac

SEQ ID NO: 125177 - DNA, 75 bp, Artificial Sequence
  Synthetic
catcctcggcatcggcaccgtccttgaccaagctgagacagcaggagttaggttggtagtcttagccacggcgac

SEQ ID NO: 125178 - DNA, 75 bp, Artificial Sequence
  Synthetic
catcctcggcatcgggaccgtccttgaccaagctgagacagcaggagttaggttggtagtcttagccacggcgac

SEQ ID NO: 125179 - DNA, 75 bp, Artificial Sequence
  Synthetic
tggtctacagtctctgatcaagaggattctgtcatctgctgctccatgtcatactcctggacaggggccctcata

SEQ ID NO: 125180 - DNA, 75 bp, Artificial Sequence
  Synthetic
tgtatcacctacccactaagtgcccgagactaacgcttcccaagcagtgactgctatacttagctctctcaccat

SEQ ID NO: 125181 - DNA, 75 bp, Artificial Sequence
  Synthetic
tgtatcacctacccactatgtgcccgagactaacgcttcccaagcagtgactgctatacttagctctctcaccat

SEQ ID NO: 125182 - DNA, 75 bp, Artificial Sequence
  Synthetic
tgtatcacctacccactacgtgcccgagactaacgcttcccaagcagtgactgctatacttagctctctcaccat

SEQ ID NO: 125183 - DNA, 75 bp, Artificial Sequence
  Synthetic
tgtatcacctacccactaggtgcccgagactaacgcttcccaagcagtgactgctatacttagctctctcaccat

SEQ ID NO: 125184 - DNA, 75 bp, Artificial Sequence
  Synthetic
ttcatcaagggagggcgacacctaatcttctgccactcgaagaaaaaatgcgacgaacttgcggcggccctccga

SEQ ID NO: 125185 - DNA, 75 bp, Artificial Sequence
  Synthetic
ttcatcaagggagggcgacacctaatcttctgccactcgaagaaaaattgcgacgaacttgcggcggccctccga

SEQ ID NO: 125186 - DNA, 75 bp, Artificial Sequence
  Synthetic
ttcatcaagggagggcgacacctaatcttctgccactcgaagaaaaactgcgacgaacttgcggcggccctccga

SEQ ID NO: 125187 - DNA, 75 bp, Artificial Sequence
  Synthetic
ttcatcaagggagggcgacacctaatcttctgccactcgaagaaaaagtgcgacgaacttgcggcggccctccga

SEQ ID NO: 125188 - DNA, 75 bp, Artificial Sequence
  Synthetic
ttcatcaagggagggcgacacctaatcttctgccactcgaagaataaatgcgacgaacttgcggcggccctccga

SEQ ID NO: 125189 - DNA, 75 bp, Artificial Sequence
  Synthetic
ttcatcaagggagggcgacacctaatcttctgccactcgaagaataattgcgacgaacttgcggcggccctccga

SEQ ID NO: 125190 - DNA, 75 bp, Artificial Sequence
  Synthetic
ttcatcaagggagggcgacacctaatcttctgccactcgaagaataactgcgacgaacttgcggcggccctccga

SEQ ID NO: 125191 - DNA, 75 bp, Artificial Sequence
  Synthetic
ttcatcaagggagggcgacacctaatcttctgccactcgaagaataagtgcgacgaacttgcggcggccctccga

SEQ ID NO: 125192 - DNA, 75 bp, Artificial Sequence
  Synthetic
ttcatcaagggagggcgacacctaatcttctgccactcgaagaacaaatgcgacgaacttgcggcggccctccga

SEQ ID NO: 125193 - DNA, 75 bp, Artificial Sequence
  Synthetic
ttcatcaagggagggcgacacctaatcttctgccactcgaagaacaattgcgacgaacttgcggcggccctccga

SEQ ID NO: 125194 - DNA, 75 bp, Artificial Sequence
  Synthetic
ttcatcaagggagggcgacacctaatcttctgccactcgaagaacaactgcgacgaacttgcggcggccctccga

SEQ ID NO: 125195 - DNA, 75 bp, Artificial Sequence
  Synthetic
ttcatcaagggagggcgacacctaatcttctgccactcgaagaacaagtgcgacgaacttgcggcggccctccga

SEQ ID NO: 125196 - DNA, 75 bp, Artificial Sequence
  Synthetic
ttcatcaagggagggcgacacctaatcttctgccactcgaagaagaaatgcgacgaacttgcggcggccctccga

SEQ ID NO: 125197 - DNA, 75 bp, Artificial Sequence
  Synthetic
ttcatcaagggagggcgacacctaatcttctgccactcgaagaagaattgcgacgaacttgcggcggccctccga

SEQ ID NO: 125198 - DNA, 75 bp, Artificial Sequence
  Synthetic
ttcatcaagggagggcgacacctaatcttctgccactcgaagaagaactgcgacgaacttgcggcggccctccga

SEQ ID NO: 125199 - DNA, 75 bp, Artificial Sequence
  Synthetic
ttcatcaagggagggcgacacctaatcttctgccactcgaagaagaagtgcgacgaacttgcggcggccctccga

SEQ ID NO: 125200 - DNA, 75 bp, Artificial Sequence
  Synthetic
tttttttttttttttttttcctttccttttctctttcttaccttctacactcattttcttacttggtggctccat

SEQ ID NO: 125201 - DNA, 75 bp, Artificial Sequence
  Synthetic
ctggatatactggagacttagactcagtgattgactgcaacgtagcggtcactcaagtcgcggacttcagcttgg

SEQ ID NO: 125202 - DNA, 75 bp, Artificial Sequence
  Synthetic
ctggatatactggagacttagactcagtgattgactgcaacgttgcggtcactcaagtcgcggacttcagcttgg

SEQ ID NO: 125203 - DNA, 75 bp, Artificial Sequence
  Synthetic
ctggatatactggagacttagactcagtgattgactgcaacgtcgcggtcactcaagtcgcggacttcagcttgg

SEQ ID NO: 125204 - DNA, 75 bp, Artificial Sequence
  Synthetic
ctggatatactggagacttagactcagtgattgactgcaacgtggcggtcactcaagtcgcggacttcagcttgg

SEQ ID NO: 125205 - DNA, 75 bp, Artificial Sequence
  Synthetic
ctggatatactggagacttagactctgtgattgactgcaacgtagcggtcactcaagtcgcggacttcagcttgg

SEQ ID NO: 125206 - DNA, 75 bp, Artificial Sequence
  Synthetic
ctggatatactggagacttagactctgtgattgactgcaacgttgcggtcactcaagtcgcggacttcagcttgg

SEQ ID NO: 125207 - DNA, 75 bp, Artificial Sequence
  Synthetic
ctggatatactggagacttagactctgtgattgactgcaacgtcgcggtcactcaagtcgcggacttcagcttgg

SEQ ID NO: 125208 - DNA, 75 bp, Artificial Sequence
  Synthetic
ctggatatactggagacttagactctgtgattgactgcaacgtggcggtcactcaagtcgcggacttcagcttgg

SEQ ID NO: 125209 - DNA, 75 bp, Artificial Sequence
  Synthetic
ctggatatactggagacttagactccgtgattgactgcaacgtagcggtcactcaagtcgcggacttcagcttgg

SEQ ID NO: 125210 - DNA, 75 bp, Artificial Sequence
  Synthetic
ctggatatactggagacttagactccgtgattgactgcaacgttgcggtcactcaagtcgcggacttcagcttgg

SEQ ID NO: 125211 - DNA, 75 bp, Artificial Sequence
  Synthetic
ctggatatactggagacttagactccgtgattgactgcaacgtcgcggtcactcaagtcgcggacttcagcttgg

SEQ ID NO: 125212 - DNA, 75 bp, Artificial Sequence
  Synthetic
ctggatatactggagacttagactccgtgattgactgcaacgtggcggtcactcaagtcgcggacttcagcttgg

SEQ ID NO: 125213 - DNA, 75 bp, Artificial Sequence
  Synthetic
ctggatatactggagacttagactcggtgattgactgcaacgtagcggtcactcaagtcgcggacttcagcttgg

SEQ ID NO: 125214 - DNA, 75 bp, Artificial Sequence
  Synthetic
ctggatatactggagacttagactcggtgattgactgcaacgttgcggtcactcaagtcgcggacttcagcttgg

SEQ ID NO: 125215 - DNA, 75 bp, Artificial Sequence
  Synthetic
ctggatatactggagacttagactcggtgattgactgcaacgtcgcggtcactcaagtcgcggacttcagcttgg

SEQ ID NO: 125216 - DNA, 75 bp, Artificial Sequence
  Synthetic
ctggatatactggagacttagactcggtgattgactgcaacgtggcggtcactcaagtcgcggacttcagcttgg

SEQ ID NO: 125217 - DNA, 75 bp, Artificial Sequence
  Synthetic
ctggatatactggagactttgactcagtgattgactgcaacgtagcggtcactcaagtcgcggacttcagcttgg

SEQ ID NO: 125218 - DNA, 75 bp, Artificial Sequence
  Synthetic
ctggatatactggagactttgactcagtgattgactgcaacgttgcggtcactcaagtcgcggacttcagcttgg

SEQ ID NO: 125219 - DNA, 75 bp, Artificial Sequence
  Synthetic
ctggatatactggagactttgactcagtgattgactgcaacgtcgcggtcactcaagtcgcggacttcagcttgg

SEQ ID NO: 125220 - DNA, 75 bp, Artificial Sequence
  Synthetic
ctggatatactggagactttgactcagtgattgactgcaacgtggcggtcactcaagtcgcggacttcagcttgg

SEQ ID NO: 125221 - DNA, 75 bp, Artificial Sequence
  Synthetic
ctggatatactggagactttgactctgtgattgactgcaacgtagcggtcactcaagtcgcggacttcagcttgg

SEQ ID NO: 125222 - DNA, 75 bp, Artificial Sequence
  Synthetic
ctggatatactggagactttgactctgtgattgactgcaacgttgcggtcactcaagtcgcggacttcagcttgg

SEQ ID NO: 125223 - DNA, 75 bp, Artificial Sequence
  Synthetic
ctggatatactggagactttgactctgtgattgactgcaacgtcgcggtcactcaagtcgcggacttcagcttgg

SEQ ID NO: 125224 - DNA, 75 bp, Artificial Sequence
  Synthetic
ctggatatactggagactttgactctgtgattgactgcaacgtggcggtcactcaagtcgcggacttcagcttgg

SEQ ID NO: 125225 - DNA, 75 bp, Artificial Sequence
  Synthetic
ctggatatactggagactttgactccgtgattgactgcaacgtagcggtcactcaagtcgcggacttcagcttgg

SEQ ID NO: 125226 - DNA, 75 bp, Artificial Sequence
  Synthetic
ctggatatactggagactttgactccgtgattgactgcaacgttgcggtcactcaagtcgcggacttcagcttgg

SEQ ID NO: 125227 - DNA, 75 bp, Artificial Sequence
  Synthetic
ctggatatactggagactttgactccgtgattgactgcaacgtcgcggtcactcaagtcgcggacttcagcttgg

SEQ ID NO: 125228 - DNA, 75 bp, Artificial Sequence
  Synthetic
ctggatatactggagactttgactccgtgattgactgcaacgtggcggtcactcaagtcgcggacttcagcttgg

SEQ ID NO: 125229 - DNA, 75 bp, Artificial Sequence
  Synthetic
ctggatatactggagactttgactcggtgattgactgcaacgtagcggtcactcaagtcgcggacttcagcttgg

SEQ ID NO: 125230 - DNA, 75 bp, Artificial Sequence
  Synthetic
ctggatatactggagactttgactcggtgattgactgcaacgttgcggtcactcaagtcgcggacttcagcttgg

SEQ ID NO: 125231 - DNA, 75 bp, Artificial Sequence
  Synthetic
ctggatatactggagactttgactcggtgattgactgcaacgtcgcggtcactcaagtcgcggacttcagcttgg

SEQ ID NO: 125232 - DNA, 75 bp, Artificial Sequence
  Synthetic
ctggatatactggagactttgactcggtgattgactgcaacgtggcggtcactcaagtcgcggacttcagcttgg

SEQ ID NO: 125233 - DNA, 75 bp, Artificial Sequence
  Synthetic
ctggatatactggagacttcgactcagtgattgactgcaacgtagcggtcactcaagtcgcggacttcagcttgg

SEQ ID NO: 125234 - DNA, 75 bp, Artificial Sequence
  Synthetic
ctggatatactggagacttcgactcagtgattgactgcaacgttgcggtcactcaagtcgcggacttcagcttgg

SEQ ID NO: 125235 - DNA, 75 bp, Artificial Sequence
  Synthetic
ctggatatactggagacttcgactcagtgattgactgcaacgtcgcggtcactcaagtcgcggacttcagcttgg

SEQ ID NO: 125236 - DNA, 75 bp, Artificial Sequence
  Synthetic
ctggatatactggagacttcgactcagtgattgactgcaacgtggcggtcactcaagtcgcggacttcagcttgg

SEQ ID NO: 125237 - DNA, 75 bp, Artificial Sequence
  Synthetic
ctggatatactggagacttcgactctgtgattgactgcaacgtagcggtcactcaagtcgcggacttcagcttgg

SEQ ID NO: 125238 - DNA, 75 bp, Artificial Sequence
  Synthetic
ctggatatactggagacttcgactctgtgattgactgcaacgttgcggtcactcaagtcgcggacttcagcttgg

SEQ ID NO: 125239 - DNA, 75 bp, Artificial Sequence
  Synthetic
ctggatatactggagacttcgactctgtgattgactgcaacgtcgcggtcactcaagtcgcggacttcagcttgg

SEQ ID NO: 125240 - DNA, 75 bp, Artificial Sequence
  Synthetic
ctggatatactggagacttcgactctgtgattgactgcaacgtggcggtcactcaagtcgcggacttcagcttgg

SEQ ID NO: 125241 - DNA, 75 bp, Artificial Sequence
  Synthetic
ctggatatactggagacttcgactccgtgattgactgcaacgtagcggtcactcaagtcgcggacttcagcttgg

SEQ ID NO: 125242 - DNA, 75 bp, Artificial Sequence
  Synthetic
ctggatatactggagacttcgactccgtgattgactgcaacgttgcggtcactcaagtcgcggacttcagcttgg

SEQ ID NO: 125243 - DNA, 75 bp, Artificial Sequence
  Synthetic
ctggatatactggagacttcgactccgtgattgactgcaacgtcgcggtcactcaagtcgcggacttcagcttgg

SEQ ID NO: 125244 - DNA, 75 bp, Artificial Sequence
  Synthetic
ctggatatactggagacttcgactccgtgattgactgcaacgtggcggtcactcaagtcgcggacttcagcttgg

SEQ ID NO: 125245 - DNA, 75 bp, Artificial Sequence
  Synthetic
ctggatatactggagacttcgactcggtgattgactgcaacgtagcggtcactcaagtcgcggacttcagcttgg

SEQ ID NO: 125246 - DNA, 75 bp, Artificial Sequence
  Synthetic
ctggatatactggagacttcgactcggtgattgactgcaacgttgcggtcactcaagtcgcggacttcagcttgg

SEQ ID NO: 125247 - DNA, 75 bp, Artificial Sequence
  Synthetic
ctggatatactggagacttcgactcggtgattgactgcaacgtcgcggtcactcaagtcgcggacttcagcttgg

SEQ ID NO: 125248 - DNA, 75 bp, Artificial Sequence
  Synthetic
ctggatatactggagacttcgactcggtgattgactgcaacgtggcggtcactcaagtcgcggacttcagcttgg

SEQ ID NO: 125249 - DNA, 75 bp, Artificial Sequence
  Synthetic
ctggatatactggagacttggactcagtgattgactgcaacgtagcggtcactcaagtcgcggacttcagcttgg

SEQ ID NO: 125250 - DNA, 75 bp, Artificial Sequence
  Synthetic
ctggatatactggagacttggactcagtgattgactgcaacgttgcggtcactcaagtcgcggacttcagcttgg

SEQ ID NO: 125251 - DNA, 75 bp, Artificial Sequence
  Synthetic
ctggatatactggagacttggactcagtgattgactgcaacgtcgcggtcactcaagtcgcggacttcagcttgg

SEQ ID NO: 125252 - DNA, 75 bp, Artificial Sequence
  Synthetic
ctggatatactggagacttggactcagtgattgactgcaacgtggcggtcactcaagtcgcggacttcagcttgg

SEQ ID NO: 125253 - DNA, 75 bp, Artificial Sequence
  Synthetic
ctggatatactggagacttggactctgtgattgactgcaacgtagcggtcactcaagtcgcggacttcagcttgg

SEQ ID NO: 125254 - DNA, 75 bp, Artificial Sequence
  Synthetic
ctggatatactggagacttggactctgtgattgactgcaacgttgcggtcactcaagtcgcggacttcagcttgg

SEQ ID NO: 125255 - DNA, 75 bp, Artificial Sequence
  Synthetic
ctggatatactggagacttggactctgtgattgactgcaacgtcgcggtcactcaagtcgcggacttcagcttgg

SEQ ID NO: 125256 - DNA, 75 bp, Artificial Sequence
  Synthetic
ctggatatactggagacttggactctgtgattgactgcaacgtggcggtcactcaagtcgcggacttcagcttgg

SEQ ID NO: 125257 - DNA, 75 bp, Artificial Sequence
  Synthetic
ctggatatactggagacttggactccgtgattgactgcaacgtagcggtcactcaagtcgcggacttcagcttgg

SEQ ID NO: 125258 - DNA, 75 bp, Artificial Sequence
  Synthetic
ctggatatactggagacttggactccgtgattgactgcaacgttgcggtcactcaagtcgcggacttcagcttgg

SEQ ID NO: 125259 - DNA, 75 bp, Artificial Sequence
  Synthetic
ctggatatactggagacttggactccgtgattgactgcaacgtcgcggtcactcaagtcgcggacttcagcttgg

SEQ ID NO: 125260 - DNA, 75 bp, Artificial Sequence
  Synthetic
ctggatatactggagacttggactccgtgattgactgcaacgtggcggtcactcaagtcgcggacttcagcttgg

SEQ ID NO: 125261 - DNA, 75 bp, Artificial Sequence
  Synthetic
ctggatatactggagacttggactcggtgattgactgcaacgtagcggtcactcaagtcgcggacttcagcttgg

SEQ ID NO: 125262 - DNA, 75 bp, Artificial Sequence
  Synthetic
ctggatatactggagacttggactcggtgattgactgcaacgttgcggtcactcaagtcgcggacttcagcttgg

SEQ ID NO: 125263 - DNA, 75 bp, Artificial Sequence
  Synthetic
ctggatatactggagacttggactcggtgattgactgcaacgtcgcggtcactcaagtcgcggacttcagcttgg

SEQ ID NO: 125264 - DNA, 75 bp, Artificial Sequence
  Synthetic
ctggatatactggagacttggactcggtgattgactgcaacgtggcggtcactcaagtcgcggacttcagcttgg

SEQ ID NO: 125265 - DNA, 75 bp, Artificial Sequence
  Synthetic
gccgggtatccccttcctatcgtgccaacgagggtttcggggagtttggcggggggacggcgtgaacaacacaac

SEQ ID NO: 125266 - DNA, 75 bp, Artificial Sequence
  Synthetic
gagtgttcgtgcagcctccatgagtgtcgtgcagcctccatgagtgtcgtacagcctccatttgcaattgtggct

SEQ ID NO: 125267 - DNA, 75 bp, Artificial Sequence
  Synthetic
ctacaatctgggtccggatggtcataatgacccacttcttttccatactattggcccaggacactctgaaccaaa

SEQ ID NO: 125268 - DNA, 75 bp, Artificial Sequence
  Synthetic
gtatgtctataccggtgagagggcgtcggggatgttcgacaccgtggtgctctgtgagtgctatgaagccggcgc

SEQ ID NO: 125269 - DNA, 75 bp, Artificial Sequence
  Synthetic
gtatgtctataccggtgagagggcgtcggggatgttcgacaccgtggtgctctgtgagtgctatgatgccggcgc

SEQ ID NO: 125270 - DNA, 75 bp, Artificial Sequence
  Synthetic
gtatgtctataccggtgagagggcgtcggggatgttcgacaccgtggtgctctgtgagtgctatgacgccggcgc

SEQ ID NO: 125271 - DNA, 75 bp, Artificial Sequence
  Synthetic
gtatgtctataccggtgagagggcgtcggggatgttcgacaccgtggtgctctgtgagtgctatgaggccggcgc

SEQ ID NO: 125272 - DNA, 75 bp, Artificial Sequence
  Synthetic
gtatgtctattccggtgagagggcgtcggggatgttcgacaccgtggtgctctgtgagtgctatgaagccggcgc

SEQ ID NO: 125273 - DNA, 75 bp, Artificial Sequence
  Synthetic
gtatgtctattccggtgagagggcgtcggggatgttcgacaccgtggtgctctgtgagtgctatgatgccggcgc

SEQ ID NO: 125274 - DNA, 75 bp, Artificial Sequence
  Synthetic
gtatgtctattccggtgagagggcgtcggggatgttcgacaccgtggtgctctgtgagtgctatgacgccggcgc

SEQ ID NO: 125275 - DNA, 75 bp, Artificial Sequence
  Synthetic
gtatgtctattccggtgagagggcgtcggggatgttcgacaccgtggtgctctgtgagtgctatgaggccggcgc

SEQ ID NO: 125276 - DNA, 75 bp, Artificial Sequence
  Synthetic
gtatgtctatcccggtgagagggcgtcggggatgttcgacaccgtggtgctctgtgagtgctatgaagccggcgc

SEQ ID NO: 125277 - DNA, 75 bp, Artificial Sequence
  Synthetic
gtatgtctatcccggtgagagggcgtcggggatgttcgacaccgtggtgctctgtgagtgctatgatgccggcgc

SEQ ID NO: 125278 - DNA, 75 bp, Artificial Sequence
  Synthetic
gtatgtctatcccggtgagagggcgtcggggatgttcgacaccgtggtgctctgtgagtgctatgacgccggcgc

SEQ ID NO: 125279 - DNA, 75 bp, Artificial Sequence
  Synthetic
gtatgtctatcccggtgagagggcgtcggggatgttcgacaccgtggtgctctgtgagtgctatgaggccggcgc

SEQ ID NO: 125280 - DNA, 75 bp, Artificial Sequence
  Synthetic
gtatgtctatgccggtgagagggcgtcggggatgttcgacaccgtggtgctctgtgagtgctatgaagccggcgc

SEQ ID NO: 125281 - DNA, 75 bp, Artificial Sequence
  Synthetic
gtatgtctatgccggtgagagggcgtcggggatgttcgacaccgtggtgctctgtgagtgctatgatgccggcgc

SEQ ID NO: 125282 - DNA, 75 bp, Artificial Sequence
  Synthetic
gtatgtctatgccggtgagagggcgtcggggatgttcgacaccgtggtgctctgtgagtgctatgacgccggcgc

SEQ ID NO: 125283 - DNA, 75 bp, Artificial Sequence
  Synthetic
gtatgtctatgccggtgagagggcgtcggggatgttcgacaccgtggtgctctgtgagtgctatgaggccggcgc

SEQ ID NO: 125284 - DNA, 75 bp, Artificial Sequence
  Synthetic
gtatgtctttaccggtgagagggcgtcggggatgttcgacaccgtggtgctctgtgagtgctatgaagccggcgc

SEQ ID NO: 125285 - DNA, 75 bp, Artificial Sequence
  Synthetic
gtatgtctttaccggtgagagggcgtcggggatgttcgacaccgtggtgctctgtgagtgctatgatgccggcgc

SEQ ID NO: 125286 - DNA, 75 bp, Artificial Sequence
  Synthetic
gtatgtctttaccggtgagagggcgtcggggatgttcgacaccgtggtgctctgtgagtgctatgacgccggcgc

SEQ ID NO: 125287 - DNA, 75 bp, Artificial Sequence
  Synthetic
gtatgtctttaccggtgagagggcgtcggggatgttcgacaccgtggtgctctgtgagtgctatgaggccggcgc

SEQ ID NO: 125288 - DNA, 75 bp, Artificial Sequence
  Synthetic
gtatgtcttttccggtgagagggcgtcggggatgttcgacaccgtggtgctctgtgagtgctatgaagccggcgc

SEQ ID NO: 125289 - DNA, 75 bp, Artificial Sequence
  Synthetic
gtatgtcttttccggtgagagggcgtcggggatgttcgacaccgtggtgctctgtgagtgctatgatgccggcgc

SEQ ID NO: 125290 - DNA, 75 bp, Artificial Sequence
  Synthetic
gtatgtcttttccggtgagagggcgtcggggatgttcgacaccgtggtgctctgtgagtgctatgacgccggcgc

SEQ ID NO: 125291 - DNA, 75 bp, Artificial Sequence
  Synthetic
gtatgtcttttccggtgagagggcgtcggggatgttcgacaccgtggtgctctgtgagtgctatgaggccggcgc

SEQ ID NO: 125292 - DNA, 75 bp, Artificial Sequence
  Synthetic
gtatgtctttcccggtgagagggcgtcggggatgttcgacaccgtggtgctctgtgagtgctatgaagccggcgc

SEQ ID NO: 125293 - DNA, 75 bp, Artificial Sequence
  Synthetic
gtatgtctttcccggtgagagggcgtcggggatgttcgacaccgtggtgctctgtgagtgctatgatgccggcgc

SEQ ID NO: 125294 - DNA, 75 bp, Artificial Sequence
  Synthetic
gtatgtctttcccggtgagagggcgtcggggatgttcgacaccgtggtgctctgtgagtgctatgacgccggcgc

SEQ ID NO: 125295 - DNA, 75 bp, Artificial Sequence
  Synthetic
gtatgtctttcccggtgagagggcgtcggggatgttcgacaccgtggtgctctgtgagtgctatgaggccggcgc

SEQ ID NO: 125296 - DNA, 75 bp, Artificial Sequence
  Synthetic
gtatgtctttgccggtgagagggcgtcggggatgttcgacaccgtggtgctctgtgagtgctatgaagccggcgc

SEQ ID NO: 125297 - DNA, 75 bp, Artificial Sequence
  Synthetic
gtatgtctttgccggtgagagggcgtcggggatgttcgacaccgtggtgctctgtgagtgctatgatgccggcgc

SEQ ID NO: 125298 - DNA, 75 bp, Artificial Sequence
  Synthetic
gtatgtctttgccggtgagagggcgtcggggatgttcgacaccgtggtgctctgtgagtgctatgacgccggcgc

SEQ ID NO: 125299 - DNA, 75 bp, Artificial Sequence
  Synthetic
gtatgtctttgccggtgagagggcgtcggggatgttcgacaccgtggtgctctgtgagtgctatgaggccggcgc

SEQ ID NO: 125300 - DNA, 75 bp, Artificial Sequence
  Synthetic
gtatgtctctaccggtgagagggcgtcggggatgttcgacaccgtggtgctctgtgagtgctatgaagccggcgc

SEQ ID NO: 125301 - DNA, 75 bp, Artificial Sequence
  Synthetic
gtatgtctctaccggtgagagggcgtcggggatgttcgacaccgtggtgctctgtgagtgctatgatgccggcgc

SEQ ID NO: 125302 - DNA, 75 bp, Artificial Sequence
  Synthetic
gtatgtctctaccggtgagagggcgtcggggatgttcgacaccgtggtgctctgtgagtgctatgacgccggcgc

SEQ ID NO: 125303 - DNA, 75 bp, Artificial Sequence
  Synthetic
gtatgtctctaccggtgagagggcgtcggggatgttcgacaccgtggtgctctgtgagtgctatgaggccggcgc

SEQ ID NO: 125304 - DNA, 75 bp, Artificial Sequence
  Synthetic
gtatgtctcttccggtgagagggcgtcggggatgttcgacaccgtggtgctctgtgagtgctatgaagccggcgc

SEQ ID NO: 125305 - DNA, 75 bp, Artificial Sequence
  Synthetic
gtatgtctcttccggtgagagggcgtcggggatgttcgacaccgtggtgctctgtgagtgctatgatgccggcgc

SEQ ID NO: 125306 - DNA, 75 bp, Artificial Sequence
  Synthetic
gtatgtctcttccggtgagagggcgtcggggatgttcgacaccgtggtgctctgtgagtgctatgacgccggcgc

SEQ ID NO: 125307 - DNA, 75 bp, Artificial Sequence
  Synthetic
gtatgtctcttccggtgagagggcgtcggggatgttcgacaccgtggtgctctgtgagtgctatgaggccggcgc

SEQ ID NO: 125308 - DNA, 75 bp, Artificial Sequence
  Synthetic
gtatgtctctcccggtgagagggcgtcggggatgttcgacaccgtggtgctctgtgagtgctatgaagccggcgc

SEQ ID NO: 125309 - DNA, 75 bp, Artificial Sequence
  Synthetic
gtatgtctctcccggtgagagggcgtcggggatgttcgacaccgtggtgctctgtgagtgctatgatgccggcgc

SEQ ID NO: 125310 - DNA, 75 bp, Artificial Sequence
  Synthetic
gtatgtctctcccggtgagagggcgtcggggatgttcgacaccgtggtgctctgtgagtgctatgacgccggcgc

SEQ ID NO: 125311 - DNA, 75 bp, Artificial Sequence
  Synthetic
gtatgtctctcccggtgagagggcgtcggggatgttcgacaccgtggtgctctgtgagtgctatgaggccggcgc

SEQ ID NO: 125312 - DNA, 75 bp, Artificial Sequence
  Synthetic
gtatgtctctgccggtgagagggcgtcggggatgttcgacaccgtggtgctctgtgagtgctatgaagccggcgc

SEQ ID NO: 125313 - DNA, 75 bp, Artificial Sequence
  Synthetic
gtatgtctctgccggtgagagggcgtcggggatgttcgacaccgtggtgctctgtgagtgctatgatgccggcgc

SEQ ID NO: 125314 - DNA, 75 bp, Artificial Sequence
  Synthetic
gtatgtctctgccggtgagagggcgtcggggatgttcgacaccgtggtgctctgtgagtgctatgacgccggcgc

SEQ ID NO: 125315 - DNA, 75 bp, Artificial Sequence
  Synthetic
gtatgtctctgccggtgagagggcgtcggggatgttcgacaccgtggtgctctgtgagtgctatgaggccggcgc

SEQ ID NO: 125316 - DNA, 75 bp, Artificial Sequence
  Synthetic
gtatgtctgtaccggtgagagggcgtcggggatgttcgacaccgtggtgctctgtgagtgctatgaagccggcgc

SEQ ID NO: 125317 - DNA, 75 bp, Artificial Sequence
  Synthetic
gtatgtctgtaccggtgagagggcgtcggggatgttcgacaccgtggtgctctgtgagtgctatgatgccggcgc

SEQ ID NO: 125318 - DNA, 75 bp, Artificial Sequence
  Synthetic
gtatgtctgtaccggtgagagggcgtcggggatgttcgacaccgtggtgctctgtgagtgctatgacgccggcgc

SEQ ID NO: 125319 - DNA, 75 bp, Artificial Sequence
  Synthetic
gtatgtctgtaccggtgagagggcgtcggggatgttcgacaccgtggtgctctgtgagtgctatgaggccggcgc

SEQ ID NO: 125320 - DNA, 75 bp, Artificial Sequence
  Synthetic
gtatgtctgttccggtgagagggcgtcggggatgttcgacaccgtggtgctctgtgagtgctatgaagccggcgc

SEQ ID NO: 125321 - DNA, 75 bp, Artificial Sequence
  Synthetic
gtatgtctgttccggtgagagggcgtcggggatgttcgacaccgtggtgctctgtgagtgctatgatgccggcgc

SEQ ID NO: 125322 - DNA, 75 bp, Artificial Sequence
  Synthetic
gtatgtctgttccggtgagagggcgtcggggatgttcgacaccgtggtgctctgtgagtgctatgacgccggcgc

SEQ ID NO: 125323 - DNA, 75 bp, Artificial Sequence
  Synthetic
gtatgtctgttccggtgagagggcgtcggggatgttcgacaccgtggtgctctgtgagtgctatgaggccggcgc

SEQ ID NO: 125324 - DNA, 75 bp, Artificial Sequence
  Synthetic
gtatgtctgtcccggtgagagggcgtcggggatgttcgacaccgtggtgctctgtgagtgctatgaagccggcgc

SEQ ID NO: 125325 - DNA, 75 bp, Artificial Sequence
  Synthetic
gtatgtctgtcccggtgagagggcgtcggggatgttcgacaccgtggtgctctgtgagtgctatgatgccggcgc

SEQ ID NO: 125326 - DNA, 75 bp, Artificial Sequence
  Synthetic
gtatgtctgtcccggtgagagggcgtcggggatgttcgacaccgtggtgctctgtgagtgctatgacgccggcgc

SEQ ID NO: 125327 - DNA, 75 bp, Artificial Sequence
  Synthetic
gtatgtctgtcccggtgagagggcgtcggggatgttcgacaccgtggtgctctgtgagtgctatgaggccggcgc

SEQ ID NO: 125328 - DNA, 75 bp, Artificial Sequence
  Synthetic
gtatgtctgtgccggtgagagggcgtcggggatgttcgacaccgtggtgctctgtgagtgctatgaagccggcgc

SEQ ID NO: 125329 - DNA, 75 bp, Artificial Sequence
  Synthetic
gtatgtctgtgccggtgagagggcgtcggggatgttcgacaccgtggtgctctgtgagtgctatgatgccggcgc

SEQ ID NO: 125330 - DNA, 75 bp, Artificial Sequence
  Synthetic
gtatgtctgtgccggtgagagggcgtcggggatgttcgacaccgtggtgctctgtgagtgctatgacgccggcgc

SEQ ID NO: 125331 - DNA, 75 bp, Artificial Sequence
  Synthetic
gtatgtctgtgccggtgagagggcgtcggggatgttcgacaccgtggtgctctgtgagtgctatgaggccggcgc

SEQ ID NO: 125332 - DNA, 75 bp, Artificial Sequence
  Synthetic
ataaatgccaccacgactggacctagtgtgcctgtcccggggcccaactatcgcagggctctctggagggtatcc

SEQ ID NO: 125333 - DNA, 75 bp, Artificial Sequence
  Synthetic
gcagtggtgtactactgcatggtggcgaactgggccaaggtcatagtcgttctcctcatgtttgcgggggtggat

SEQ ID NO: 125334 - DNA, 75 bp, Artificial Sequence
  Synthetic
ggcaatttaccaatgttgtgacctggacccccaagcccgtgtggccatcaagtccctcactgagaggctttacgt

SEQ ID NO: 125335 - DNA, 75 bp, Artificial Sequence
  Synthetic
gggcggccatttgtggccgctacctcttcaactgggcggtgaggacaaagctcaaactcactccattgcccgagg

SEQ ID NO: 125336 - DNA, 75 bp, Artificial Sequence
  Synthetic
gaggccgtgtttactggcctcacacaaattgatgcccatttcctttcacagacgaagcaggcaggggagggtttt

SEQ ID NO: 125337 - DNA, 75 bp, Artificial Sequence
  Synthetic
gaggccgtgtttactggcctcacacaaattgatgcccatttcctttctcagacgaagcaggcaggggagggtttt

SEQ ID NO: 125338 - DNA, 75 bp, Artificial Sequence
  Synthetic
gaggccgtgtttactggcctcacacaaattgatgcccatttcctttcccagacgaagcaggcaggggagggtttt

SEQ ID NO: 125339 - DNA, 75 bp, Artificial Sequence
  Synthetic
gaggccgtgtttactggcctcacacaaattgatgcccatttcctttcgcagacgaagcaggcaggggagggtttt

SEQ ID NO: 125340 - DNA, 75 bp, Artificial Sequence
  Synthetic
gaggccgtgtttactggcctcacacatattgatgcccatttcctttcacagacgaagcaggcaggggagggtttt

SEQ ID NO: 125341 - DNA, 75 bp, Artificial Sequence
  Synthetic
gaggccgtgtttactggcctcacacatattgatgcccatttcctttctcagacgaagcaggcaggggagggtttt

SEQ ID NO: 125342 - DNA, 75 bp, Artificial Sequence
  Synthetic
gaggccgtgtttactggcctcacacatattgatgcccatttcctttcccagacgaagcaggcaggggagggtttt

SEQ ID NO: 125343 - DNA, 75 bp, Artificial Sequence
  Synthetic
gaggccgtgtttactggcctcacacatattgatgcccatttcctttcgcagacgaagcaggcaggggagggtttt

SEQ ID NO: 125344 - DNA, 75 bp, Artificial Sequence
  Synthetic
gaggccgtgtttactggcctcacacacattgatgcccatttcctttcacagacgaagcaggcaggggagggtttt

SEQ ID NO: 125345 - DNA, 75 bp, Artificial Sequence
  Synthetic
gaggccgtgtttactggcctcacacacattgatgcccatttcctttctcagacgaagcaggcaggggagggtttt

SEQ ID NO: 125346 - DNA, 75 bp, Artificial Sequence
  Synthetic
gaggccgtgtttactggcctcacacacattgatgcccatttcctttcccagacgaagcaggcaggggagggtttt

SEQ ID NO: 125347 - DNA, 75 bp, Artificial Sequence
  Synthetic
gaggccgtgtttactggcctcacacacattgatgcccatttcctttcgcagacgaagcaggcaggggagggtttt

SEQ ID NO: 125348 - DNA, 75 bp, Artificial Sequence
  Synthetic
gaggccgtgtttactggcctcacacagattgatgcccatttcctttcacagacgaagcaggcaggggagggtttt

SEQ ID NO: 125349 - DNA, 75 bp, Artificial Sequence
  Synthetic
gaggccgtgtttactggcctcacacagattgatgcccatttcctttctcagacgaagcaggcaggggagggtttt

SEQ ID NO: 125350 - DNA, 75 bp, Artificial Sequence
  Synthetic
gaggccgtgtttactggcctcacacagattgatgcccatttcctttcccagacgaagcaggcaggggagggtttt

SEQ ID NO: 125351 - DNA, 75 bp, Artificial Sequence
  Synthetic
gaggccgtgtttactggcctcacacagattgatgcccatttcctttcgcagacgaagcaggcaggggagggtttt

SEQ ID NO: 125352 - DNA, 75 bp, Artificial Sequence
  Synthetic
aaccagcctcttttcagtaggggcgcggcagaacttgcagctcatcaacaccaatggcagttggcatatcaaccg

SEQ ID NO: 125353 - DNA, 75 bp, Artificial Sequence
  Synthetic
cccctccaataccacctccacggagaaagaggacagttgtcctgacagagtccaccgtgtcttctgccctggcgg

SEQ ID NO: 125354 - DNA, 75 bp, Artificial Sequence
  Synthetic
ccgtacctggtggcctaacaggccacggtgtgcgccagagcaaaagctccccccccatcctgggacgttatgtgg

SEQ ID NO: 125355 - DNA, 75 bp, Artificial Sequence
  Synthetic
ccgtacctggtggcctaacaggccacggtgtgcgccagagcaaatgctccccccccatcctgggacgttatgtgg

SEQ ID NO: 125356 - DNA, 75 bp, Artificial Sequence
  Synthetic
ccgtacctggtggcctaacaggccacggtgtgcgccagagcaaacgctccccccccatcctgggacgttatgtgg

SEQ ID NO: 125357 - DNA, 75 bp, Artificial Sequence
  Synthetic
ccgtacctggtggcctaacaggccacggtgtgcgccagagcaaaggctccccccccatcctgggacgttatgtgg

SEQ ID NO: 125358 - DNA, 75 bp, Artificial Sequence
  Synthetic
ccgtacctggtggcctaacaggccacggtgtgcgccagagctaaagctccccccccatcctgggacgttatgtgg

SEQ ID NO: 125359 - DNA, 75 bp, Artificial Sequence
  Synthetic
ccgtacctggtggcctaacaggccacggtgtgcgccagagctaatgctccccccccatcctgggacgttatgtgg

SEQ ID NO: 125360 - DNA, 75 bp, Artificial Sequence
  Synthetic
ccgtacctggtggcctaacaggccacggtgtgcgccagagctaacgctccccccccatcctgggacgttatgtgg

SEQ ID NO: 125361 - DNA, 75 bp, Artificial Sequence
  Synthetic
ccgtacctggtggcctaacaggccacggtgtgcgccagagctaaggctccccccccatcctgggacgttatgtgg

SEQ ID NO: 125362 - DNA, 75 bp, Artificial Sequence
  Synthetic
ccgtacctggtggcctaacaggccacggtgtgcgccagagccaaagctccccccccatcctgggacgttatgtgg

SEQ ID NO: 125363 - DNA, 75 bp, Artificial Sequence
  Synthetic
ccgtacctggtggcctaacaggccacggtgtgcgccagagccaatgctccccccccatcctgggacgttatgtgg

SEQ ID NO: 125364 - DNA, 75 bp, Artificial Sequence
  Synthetic
ccgtacctggtggcctaacaggccacggtgtgcgccagagccaacgctccccccccatcctgggacgttatgtgg

SEQ ID NO: 125365 - DNA, 75 bp, Artificial Sequence
  Synthetic
ccgtacctggtggcctaacaggccacggtgtgcgccagagccaaggctccccccccatcctgggacgttatgtgg

SEQ ID NO: 125366 - DNA, 75 bp, Artificial Sequence
  Synthetic
ccgtacctggtggcctaacaggccacggtgtgcgccagagcgaaagctccccccccatcctgggacgttatgtgg

SEQ ID NO: 125367 - DNA, 75 bp, Artificial Sequence
  Synthetic
ccgtacctggtggcctaacaggccacggtgtgcgccagagcgaatgctccccccccatcctgggacgttatgtgg

SEQ ID NO: 125368 - DNA, 75 bp, Artificial Sequence
  Synthetic
ccgtacctggtggcctaacaggccacggtgtgcgccagagcgaacgctccccccccatcctgggacgttatgtgg

SEQ ID NO: 125369 - DNA, 75 bp, Artificial Sequence
  Synthetic
ccgtacctggtggcctaacaggccacggtgtgcgccagagcgaaggctccccccccatcctgggacgttatgtgg

SEQ ID NO: 125370 - DNA, 75 bp, Artificial Sequence
  Synthetic
ccgtacctggtggcctatcaggccacggtgtgcgccagagcaaaagctccccccccatcctgggacgttatgtgg

SEQ ID NO: 125371 - DNA, 75 bp, Artificial Sequence
  Synthetic
ccgtacctggtggcctatcaggccacggtgtgcgccagagcaaatgctccccccccatcctgggacgttatgtgg

SEQ ID NO: 125372 - DNA, 75 bp, Artificial Sequence
  Synthetic
ccgtacctggtggcctatcaggccacggtgtgcgccagagcaaacgctccccccccatcctgggacgttatgtgg

SEQ ID NO: 125373 - DNA, 75 bp, Artificial Sequence
  Synthetic
ccgtacctggtggcctatcaggccacggtgtgcgccagagcaaaggctccccccccatcctgggacgttatgtgg

SEQ ID NO: 125374 - DNA, 75 bp, Artificial Sequence
  Synthetic
ccgtacctggtggcctatcaggccacggtgtgcgccagagctaaagctccccccccatcctgggacgttatgtgg

SEQ ID NO: 125375 - DNA, 75 bp, Artificial Sequence
  Synthetic
ccgtacctggtggcctatcaggccacggtgtgcgccagagctaatgctccccccccatcctgggacgttatgtgg

SEQ ID NO: 125376 - DNA, 75 bp, Artificial Sequence
  Synthetic
ccgtacctggtggcctatcaggccacggtgtgcgccagagctaacgctccccccccatcctgggacgttatgtgg

SEQ ID NO: 125377 - DNA, 75 bp, Artificial Sequence
  Synthetic
ccgtacctggtggcctatcaggccacggtgtgcgccagagctaaggctccccccccatcctgggacgttatgtgg

SEQ ID NO: 125378 - DNA, 75 bp, Artificial Sequence
  Synthetic
ccgtacctggtggcctatcaggccacggtgtgcgccagagccaaagctccccccccatcctgggacgttatgtgg

SEQ ID NO: 125379 - DNA, 75 bp, Artificial Sequence
  Synthetic
ccgtacctggtggcctatcaggccacggtgtgcgccagagccaatgctccccccccatcctgggacgttatgtgg

SEQ ID NO: 125380 - DNA, 75 bp, Artificial Sequence
  Synthetic
ccgtacctggtggcctatcaggccacggtgtgcgccagagccaacgctccccccccatcctgggacgttatgtgg

SEQ ID NO: 125381 - DNA, 75 bp, Artificial Sequence
  Synthetic
ccgtacctggtggcctatcaggccacggtgtgcgccagagccaaggctccccccccatcctgggacgttatgtgg

SEQ ID NO: 125382 - DNA, 75 bp, Artificial Sequence
  Synthetic
ccgtacctggtggcctatcaggccacggtgtgcgccagagcgaaagctccccccccatcctgggacgttatgtgg

SEQ ID NO: 125383 - DNA, 75 bp, Artificial Sequence
  Synthetic
ccgtacctggtggcctatcaggccacggtgtgcgccagagcgaatgctccccccccatcctgggacgttatgtgg

SEQ ID NO: 125384 - DNA, 75 bp, Artificial Sequence
  Synthetic
ccgtacctggtggcctatcaggccacggtgtgcgccagagcgaacgctccccccccatcctgggacgttatgtgg

SEQ ID NO: 125385 - DNA, 75 bp, Artificial Sequence
  Synthetic
ccgtacctggtggcctatcaggccacggtgtgcgccagagcgaaggctccccccccatcctgggacgttatgtgg

SEQ ID NO: 125386 - DNA, 75 bp, Artificial Sequence
  Synthetic
ccgtacctggtggcctaccaggccacggtgtgcgccagagcaaaagctccccccccatcctgggacgttatgtgg

SEQ ID NO: 125387 - DNA, 75 bp, Artificial Sequence
  Synthetic
ccgtacctggtggcctaccaggccacggtgtgcgccagagcaaatgctccccccccatcctgggacgttatgtgg

SEQ ID NO: 125388 - DNA, 75 bp, Artificial Sequence
  Synthetic
ccgtacctggtggcctaccaggccacggtgtgcgccagagcaaacgctccccccccatcctgggacgttatgtgg

SEQ ID NO: 125389 - DNA, 75 bp, Artificial Sequence
  Synthetic
ccgtacctggtggcctaccaggccacggtgtgcgccagagcaaaggctccccccccatcctgggacgttatgtgg

SEQ ID NO: 125390 - DNA, 75 bp, Artificial Sequence
  Synthetic
ccgtacctggtggcctaccaggccacggtgtgcgccagagctaaagctccccccccatcctgggacgttatgtgg

SEQ ID NO: 125391 - DNA, 75 bp, Artificial Sequence
  Synthetic
ccgtacctggtggcctaccaggccacggtgtgcgccagagctaatgctccccccccatcctgggacgttatgtgg

SEQ ID NO: 125392 - DNA, 75 bp, Artificial Sequence
  Synthetic
ccgtacctggtggcctaccaggccacggtgtgcgccagagctaacgctccccccccatcctgggacgttatgtgg

SEQ ID NO: 125393 - DNA, 75 bp, Artificial Sequence
  Synthetic
ccgtacctggtggcctaccaggccacggtgtgcgccagagctaaggctccccccccatcctgggacgttatgtgg

SEQ ID NO: 125394 - DNA, 75 bp, Artificial Sequence
  Synthetic
ccgtacctggtggcctaccaggccacggtgtgcgccagagccaaagctccccccccatcctgggacgttatgtgg

SEQ ID NO: 125395 - DNA, 75 bp, Artificial Sequence
  Synthetic
ccgtacctggtggcctaccaggccacggtgtgcgccagagccaatgctccccccccatcctgggacgttatgtgg

SEQ ID NO: 125396 - DNA, 75 bp, Artificial Sequence
  Synthetic
ccgtacctggtggcctaccaggccacggtgtgcgccagagccaacgctccccccccatcctgggacgttatgtgg

SEQ ID NO: 125397 - DNA, 75 bp, Artificial Sequence
  Synthetic
ccgtacctggtggcctaccaggccacggtgtgcgccagagccaaggctccccccccatcctgggacgttatgtgg

SEQ ID NO: 125398 - DNA, 75 bp, Artificial Sequence
  Synthetic
ccgtacctggtggcctaccaggccacggtgtgcgccagagcgaaagctccccccccatcctgggacgttatgtgg

SEQ ID NO: 125399 - DNA, 75 bp, Artificial Sequence
  Synthetic
ccgtacctggtggcctaccaggccacggtgtgcgccagagcgaatgctccccccccatcctgggacgttatgtgg

SEQ ID NO: 125400 - DNA, 75 bp, Artificial Sequence
  Synthetic
ccgtacctggtggcctaccaggccacggtgtgcgccagagcgaacgctccccccccatcctgggacgttatgtgg

SEQ ID NO: 125401 - DNA, 75 bp, Artificial Sequence
  Synthetic
ccgtacctggtggcctaccaggccacggtgtgcgccagagcgaaggctccccccccatcctgggacgttatgtgg

SEQ ID NO: 125402 - DNA, 75 bp, Artificial Sequence
  Synthetic
ccgtacctggtggcctagcaggccacggtgtgcgccagagcaaaagctccccccccatcctgggacgttatgtgg

SEQ ID NO: 125403 - DNA, 75 bp, Artificial Sequence
  Synthetic
ccgtacctggtggcctagcaggccacggtgtgcgccagagcaaatgctccccccccatcctgggacgttatgtgg

SEQ ID NO: 125404 - DNA, 75 bp, Artificial Sequence
  Synthetic
ccgtacctggtggcctagcaggccacggtgtgcgccagagcaaacgctccccccccatcctgggacgttatgtgg

SEQ ID NO: 125405 - DNA, 75 bp, Artificial Sequence
  Synthetic
ccgtacctggtggcctagcaggccacggtgtgcgccagagcaaaggctccccccccatcctgggacgttatgtgg

SEQ ID NO: 125406 - DNA, 75 bp, Artificial Sequence
  Synthetic
ccgtacctggtggcctagcaggccacggtgtgcgccagagctaaagctccccccccatcctgggacgttatgtgg

SEQ ID NO: 125407 - DNA, 75 bp, Artificial Sequence
  Synthetic
ccgtacctggtggcctagcaggccacggtgtgcgccagagctaatgctccccccccatcctgggacgttatgtgg

SEQ ID NO: 125408 - DNA, 75 bp, Artificial Sequence
  Synthetic
ccgtacctggtggcctagcaggccacggtgtgcgccagagctaacgctccccccccatcctgggacgttatgtgg

SEQ ID NO: 125409 - DNA, 75 bp, Artificial Sequence
  Synthetic
ccgtacctggtggcctagcaggccacggtgtgcgccagagctaaggctccccccccatcctgggacgttatgtgg

SEQ ID NO: 125410 - DNA, 75 bp, Artificial Sequence
  Synthetic
ccgtacctggtggcctagcaggccacggtgtgcgccagagccaaagctccccccccatcctgggacgttatgtgg

SEQ ID NO: 125411 - DNA, 75 bp, Artificial Sequence
  Synthetic
ccgtacctggtggcctagcaggccacggtgtgcgccagagccaatgctccccccccatcctgggacgttatgtgg

SEQ ID NO: 125412 - DNA, 75 bp, Artificial Sequence
  Synthetic
ccgtacctggtggcctagcaggccacggtgtgcgccagagccaacgctccccccccatcctgggacgttatgtgg

SEQ ID NO: 125413 - DNA, 75 bp, Artificial Sequence
  Synthetic
ccgtacctggtggcctagcaggccacggtgtgcgccagagccaaggctccccccccatcctgggacgttatgtgg

SEQ ID NO: 125414 - DNA, 75 bp, Artificial Sequence
  Synthetic
ccgtacctggtggcctagcaggccacggtgtgcgccagagcgaaagctccccccccatcctgggacgttatgtgg

SEQ ID NO: 125415 - DNA, 75 bp, Artificial Sequence
  Synthetic
ccgtacctggtggcctagcaggccacggtgtgcgccagagcgaatgctccccccccatcctgggacgttatgtgg

SEQ ID NO: 125416 - DNA, 75 bp, Artificial Sequence
  Synthetic
ccgtacctggtggcctagcaggccacggtgtgcgccagagcgaacgctccccccccatcctgggacgttatgtgg

SEQ ID NO: 125417 - DNA, 75 bp, Artificial Sequence
  Synthetic
ccgtacctggtggcctagcaggccacggtgtgcgccagagcgaaggctccccccccatcctgggacgttatgtgg

SEQ ID NO: 125418 - DNA, 75 bp, Artificial Sequence
  Synthetic
gacatctttcacagcgtgtcgcatgcccgaccccgcctattactcctttgcctactcctacttagcgtaggagta

SEQ ID NO: 125419 - DNA, 75 bp, Artificial Sequence
  Synthetic
tcacattcagtgtggggctttccaactacgtcctggggtcccaactcccatgcgagccggaaccagacactgtgg

SEQ ID NO: 125420 - DNA, 75 bp, Artificial Sequence
  Synthetic
gcctcactcatcgctcagggagggagggcggccatttgtggccgctacctcttcaactgggcggtgaggacaaag

SEQ ID NO: 125421 - DNA, 75 bp, Artificial Sequence
  Synthetic
ctggtctaccgttagtgaggaagccagtgaggatgtcgtctgctgttcgatgtcctacacgtggacaggtgccct

SEQ ID NO: 125422 - DNA, 75 bp, Artificial Sequence
  Synthetic
agctgatcttgagatcatgacaagcacgtgggtccttgcggggggagttttggcagctatagctgcctaatgcct

SEQ ID NO: 125423 - DNA, 75 bp, Artificial Sequence
  Synthetic
agctgatcttgagatcatgacaagcacgtgggtccttgcggggggagttttggcagctatagctgcctattgcct

SEQ ID NO: 125424 - DNA, 75 bp, Artificial Sequence
  Synthetic
agctgatcttgagatcatgacaagcacgtgggtccttgcggggggagttttggcagctatagctgcctactgcct

SEQ ID NO: 125425 - DNA, 75 bp, Artificial Sequence
  Synthetic
agctgatcttgagatcatgacaagcacgtgggtccttgcggggggagttttggcagctatagctgcctagtgcct

SEQ ID NO: 125426 - DNA, 75 bp, Artificial Sequence
  Synthetic
agctgatcttgagatcatgacaagcacgtgggtccttgcggggggagttttggcagctttagctgcctaatgcct

SEQ ID NO: 125427 - DNA, 75 bp, Artificial Sequence
  Synthetic
agctgatcttgagatcatgacaagcacgtgggtccttgcggggggagttttggcagctttagctgcctattgcct

SEQ ID NO: 125428 - DNA, 75 bp, Artificial Sequence
  Synthetic
agctgatcttgagatcatgacaagcacgtgggtccttgcggggggagttttggcagctttagctgcctactgcct

SEQ ID NO: 125429 - DNA, 75 bp, Artificial Sequence
  Synthetic
agctgatcttgagatcatgacaagcacgtgggtccttgcggggggagttttggcagctttagctgcctagtgcct

SEQ ID NO: 125430 - DNA, 75 bp, Artificial Sequence
  Synthetic
agctgatcttgagatcatgacaagcacgtgggtccttgcggggggagttttggcagctctagctgcctaatgcct

SEQ ID NO: 125431 - DNA, 75 bp, Artificial Sequence
  Synthetic
agctgatcttgagatcatgacaagcacgtgggtccttgcggggggagttttggcagctctagctgcctattgcct

SEQ ID NO: 125432 - DNA, 75 bp, Artificial Sequence
  Synthetic
agctgatcttgagatcatgacaagcacgtgggtccttgcggggggagttttggcagctctagctgcctactgcct

SEQ ID NO: 125433 - DNA, 75 bp, Artificial Sequence
  Synthetic
agctgatcttgagatcatgacaagcacgtgggtccttgcggggggagttttggcagctctagctgcctagtgcct

SEQ ID NO: 125434 - DNA, 75 bp, Artificial Sequence
  Synthetic
agctgatcttgagatcatgacaagcacgtgggtccttgcggggggagttttggcagctgtagctgcctaatgcct

SEQ ID NO: 125435 - DNA, 75 bp, Artificial Sequence
  Synthetic
agctgatcttgagatcatgacaagcacgtgggtccttgcggggggagttttggcagctgtagctgcctattgcct

SEQ ID NO: 125436 - DNA, 75 bp, Artificial Sequence
  Synthetic
agctgatcttgagatcatgacaagcacgtgggtccttgcggggggagttttggcagctgtagctgcctactgcct

SEQ ID NO: 125437 - DNA, 75 bp, Artificial Sequence
  Synthetic
agctgatcttgagatcatgacaagcacgtgggtccttgcggggggagttttggcagctgtagctgcctagtgcct

SEQ ID NO: 125438 - DNA, 75 bp, Artificial Sequence
  Synthetic
tgctgatcttgagatcatgacaagcacgtgggtccttgcggggggagttttggcagctatagctgcctaatgcct

SEQ ID NO: 125439 - DNA, 75 bp, Artificial Sequence
  Synthetic
tgctgatcttgagatcatgacaagcacgtgggtccttgcggggggagttttggcagctatagctgcctattgcct

SEQ ID NO: 125440 - DNA, 75 bp, Artificial Sequence
  Synthetic
tgctgatcttgagatcatgacaagcacgtgggtccttgcggggggagttttggcagctatagctgcctactgcct

SEQ ID NO: 125441 - DNA, 75 bp, Artificial Sequence
  Synthetic
tgctgatcttgagatcatgacaagcacgtgggtccttgcggggggagttttggcagctatagctgcctagtgcct

SEQ ID NO: 125442 - DNA, 75 bp, Artificial Sequence
  Synthetic
tgctgatcttgagatcatgacaagcacgtgggtccttgcggggggagttttggcagctttagctgcctaatgcct

SEQ ID NO: 125443 - DNA, 75 bp, Artificial Sequence
  Synthetic
tgctgatcttgagatcatgacaagcacgtgggtccttgcggggggagttttggcagctttagctgcctattgcct

SEQ ID NO: 125444 - DNA, 75 bp, Artificial Sequence
  Synthetic
tgctgatcttgagatcatgacaagcacgtgggtccttgcggggggagttttggcagctttagctgcctactgcct

SEQ ID NO: 125445 - DNA, 75 bp, Artificial Sequence
  Synthetic
tgctgatcttgagatcatgacaagcacgtgggtccttgcggggggagttttggcagctttagctgcctagtgcct

SEQ ID NO: 125446 - DNA, 75 bp, Artificial Sequence
  Synthetic
tgctgatcttgagatcatgacaagcacgtgggtccttgcggggggagttttggcagctctagctgcctaatgcct

SEQ ID NO: 125447 - DNA, 75 bp, Artificial Sequence
  Synthetic
tgctgatcttgagatcatgacaagcacgtgggtccttgcggggggagttttggcagctctagctgcctattgcct

SEQ ID NO: 125448 - DNA, 75 bp, Artificial Sequence
  Synthetic
tgctgatcttgagatcatgacaagcacgtgggtccttgcggggggagttttggcagctctagctgcctactgcct

SEQ ID NO: 125449 - DNA, 75 bp, Artificial Sequence
  Synthetic
tgctgatcttgagatcatgacaagcacgtgggtccttgcggggggagttttggcagctctagctgcctagtgcct

SEQ ID NO: 125450 - DNA, 75 bp, Artificial Sequence
  Synthetic
tgctgatcttgagatcatgacaagcacgtgggtccttgcggggggagttttggcagctgtagctgcctaatgcct

SEQ ID NO: 125451 - DNA, 75 bp, Artificial Sequence
  Synthetic
tgctgatcttgagatcatgacaagcacgtgggtccttgcggggggagttttggcagctgtagctgcctattgcct

SEQ ID NO: 125452 - DNA, 75 bp, Artificial Sequence
  Synthetic
tgctgatcttgagatcatgacaagcacgtgggtccttgcggggggagttttggcagctgtagctgcctactgcct

SEQ ID NO: 125453 - DNA, 75 bp, Artificial Sequence
  Synthetic
tgctgatcttgagatcatgacaagcacgtgggtccttgcggggggagttttggcagctgtagctgcctagtgcct

SEQ ID NO: 125454 - DNA, 75 bp, Artificial Sequence
  Synthetic
cgctgatcttgagatcatgacaagcacgtgggtccttgcggggggagttttggcagctatagctgcctaatgcct

SEQ ID NO: 125455 - DNA, 75 bp, Artificial Sequence
  Synthetic
cgctgatcttgagatcatgacaagcacgtgggtccttgcggggggagttttggcagctatagctgcctattgcct

SEQ ID NO: 125456 - DNA, 75 bp, Artificial Sequence
  Synthetic
cgctgatcttgagatcatgacaagcacgtgggtccttgcggggggagttttggcagctatagctgcctactgcct

SEQ ID NO: 125457 - DNA, 75 bp, Artificial Sequence
  Synthetic
cgctgatcttgagatcatgacaagcacgtgggtccttgcggggggagttttggcagctatagctgcctagtgcct

SEQ ID NO: 125458 - DNA, 75 bp, Artificial Sequence
  Synthetic
cgctgatcttgagatcatgacaagcacgtgggtccttgcggggggagttttggcagctttagctgcctaatgcct

SEQ ID NO: 125459 - DNA, 75 bp, Artificial Sequence
  Synthetic
cgctgatcttgagatcatgacaagcacgtgggtccttgcggggggagttttggcagctttagctgcctattgcct

SEQ ID NO: 125460 - DNA, 75 bp, Artificial Sequence
  Synthetic
cgctgatcttgagatcatgacaagcacgtgggtccttgcggggggagttttggcagctttagctgcctactgcct

SEQ ID NO: 125461 - DNA, 75 bp, Artificial Sequence
  Synthetic
cgctgatcttgagatcatgacaagcacgtgggtccttgcggggggagttttggcagctttagctgcctagtgcct

SEQ ID NO: 125462 - DNA, 75 bp, Artificial Sequence
  Synthetic
cgctgatcttgagatcatgacaagcacgtgggtccttgcggggggagttttggcagctctagctgcctaatgcct

SEQ ID NO: 125463 - DNA, 75 bp, Artificial Sequence
  Synthetic
cgctgatcttgagatcatgacaagcacgtgggtccttgcggggggagttttggcagctctagctgcctattgcct

SEQ ID NO: 125464 - DNA, 75 bp, Artificial Sequence
  Synthetic
cgctgatcttgagatcatgacaagcacgtgggtccttgcggggggagttttggcagctctagctgcctactgcct

SEQ ID NO: 125465 - DNA, 75 bp, Artificial Sequence
  Synthetic
cgctgatcttgagatcatgacaagcacgtgggtccttgcggggggagttttggcagctctagctgcctagtgcct

SEQ ID NO: 125466 - DNA, 75 bp, Artificial Sequence
  Synthetic
cgctgatcttgagatcatgacaagcacgtgggtccttgcggggggagttttggcagctgtagctgcctaatgcct

SEQ ID NO: 125467 - DNA, 75 bp, Artificial Sequence
  Synthetic
cgctgatcttgagatcatgacaagcacgtgggtccttgcggggggagttttggcagctgtagctgcctattgcct

SEQ ID NO: 125468 - DNA, 75 bp, Artificial Sequence
  Synthetic
cgctgatcttgagatcatgacaagcacgtgggtccttgcggggggagttttggcagctgtagctgcctactgcct

SEQ ID NO: 125469 - DNA, 75 bp, Artificial Sequence
  Synthetic
cgctgatcttgagatcatgacaagcacgtgggtccttgcggggggagttttggcagctgtagctgcctagtgcct

SEQ ID NO: 125470 - DNA, 75 bp, Artificial Sequence
  Synthetic
ggctgatcttgagatcatgacaagcacgtgggtccttgcggggggagttttggcagctatagctgcctaatgcct

SEQ ID NO: 125471 - DNA, 75 bp, Artificial Sequence
  Synthetic
ggctgatcttgagatcatgacaagcacgtgggtccttgcggggggagttttggcagctatagctgcctattgcct

SEQ ID NO: 125472 - DNA, 75 bp, Artificial Sequence
  Synthetic
ggctgatcttgagatcatgacaagcacgtgggtccttgcggggggagttttggcagctatagctgcctactgcct

SEQ ID NO: 125473 - DNA, 75 bp, Artificial Sequence
  Synthetic
ggctgatcttgagatcatgacaagcacgtgggtccttgcggggggagttttggcagctatagctgcctagtgcct

SEQ ID NO: 125474 - DNA, 75 bp, Artificial Sequence
  Synthetic
ggctgatcttgagatcatgacaagcacgtgggtccttgcggggggagttttggcagctttagctgcctaatgcct

SEQ ID NO: 125475 - DNA, 75 bp, Artificial Sequence
  Synthetic
ggctgatcttgagatcatgacaagcacgtgggtccttgcggggggagttttggcagctttagctgcctattgcct

SEQ ID NO: 125476 - DNA, 75 bp, Artificial Sequence
  Synthetic
ggctgatcttgagatcatgacaagcacgtgggtccttgcggggggagttttggcagctttagctgcctactgcct

SEQ ID NO: 125477 - DNA, 75 bp, Artificial Sequence
  Synthetic
ggctgatcttgagatcatgacaagcacgtgggtccttgcggggggagttttggcagctttagctgcctagtgcct

SEQ ID NO: 125478 - DNA, 75 bp, Artificial Sequence
  Synthetic
ggctgatcttgagatcatgacaagcacgtgggtccttgcggggggagttttggcagctctagctgcctaatgcct

SEQ ID NO: 125479 - DNA, 75 bp, Artificial Sequence
  Synthetic
ggctgatcttgagatcatgacaagcacgtgggtccttgcggggggagttttggcagctctagctgcctattgcct

SEQ ID NO: 125480 - DNA, 75 bp, Artificial Sequence
  Synthetic
ggctgatcttgagatcatgacaagcacgtgggtccttgcggggggagttttggcagctctagctgcctactgcct

SEQ ID NO: 125481 - DNA, 75 bp, Artificial Sequence
  Synthetic
ggctgatcttgagatcatgacaagcacgtgggtccttgcggggggagttttggcagctctagctgcctagtgcct

SEQ ID NO: 125482 - DNA, 75 bp, Artificial Sequence
  Synthetic
ggctgatcttgagatcatgacaagcacgtgggtccttgcggggggagttttggcagctgtagctgcctaatgcct

SEQ ID NO: 125483 - DNA, 75 bp, Artificial Sequence
  Synthetic
ggctgatcttgagatcatgacaagcacgtgggtccttgcggggggagttttggcagctgtagctgcctattgcct

SEQ ID NO: 125484 - DNA, 75 bp, Artificial Sequence
  Synthetic
ggctgatcttgagatcatgacaagcacgtgggtccttgcggggggagttttggcagctgtagctgcctactgcct

SEQ ID NO: 125485 - DNA, 75 bp, Artificial Sequence
  Synthetic
ggctgatcttgagatcatgacaagcacgtgggtccttgcggggggagttttggcagctgtagctgcctagtgcct

SEQ ID NO: 125486 - DNA, 75 bp, Artificial Sequence
  Synthetic
cagccagctgtctgctccatctttgaaggccacatgcaccacgggcggcccacacccagacgccgagctcattga

SEQ ID NO: 125487 - DNA, 75 bp, Artificial Sequence
  Synthetic
tggcggcaggagatgggcgggaacatcacccgtgtggagtcagagaacaaggtagtaattctggactctttcgag

SEQ ID NO: 125488 - DNA, 75 bp, Artificial Sequence
  Synthetic
tactgctttacacctagtccggtagtcatcgggactaccgacagaaagggcctccccacgtacgattggggggag

SEQ ID NO: 125489 - DNA, 75 bp, Artificial Sequence
  Synthetic
gccctgttgtggtggggacaccgatccgcttcggtgtccctacgtatacgtggggggcgaatgagacagacgtac

SEQ ID NO: 125490 - DNA, 75 bp, Artificial Sequence
  Synthetic
gaggagtgtgcttctaggaccgccctcatcgaggagggacaacggatagccgagatgctaaagtccaaaatacag

SEQ ID NO: 125491 - DNA, 75 bp, Artificial Sequence
  Synthetic
gaggagtgtgcttctaggaccgccctcatcgaggagggacatcggatagccgagatgctaaagtccaaaatacag

SEQ ID NO: 125492 - DNA, 75 bp, Artificial Sequence
  Synthetic
gaggagtgtgcttctaggaccgccctcatcgaggagggacaccggatagccgagatgctaaagtccaaaatacag

SEQ ID NO: 125493 - DNA, 75 bp, Artificial Sequence
  Synthetic
gaggagtgtgcttctaggaccgccctcatcgaggagggacagcggatagccgagatgctaaagtccaaaatacag

SEQ ID NO: 125494 - DNA, 75 bp, Artificial Sequence
  Synthetic
gaggagtgtgcttctaggaccgccctcatcgaggagggtcaacggatagccgagatgctaaagtccaaaatacag

SEQ ID NO: 125495 - DNA, 75 bp, Artificial Sequence
  Synthetic
gaggagtgtgcttctaggaccgccctcatcgaggagggtcatcggatagccgagatgctaaagtccaaaatacag

SEQ ID NO: 125496 - DNA, 75 bp, Artificial Sequence
  Synthetic
gaggagtgtgcttctaggaccgccctcatcgaggagggtcaccggatagccgagatgctaaagtccaaaatacag

SEQ ID NO: 125497 - DNA, 75 bp, Artificial Sequence
  Synthetic
gaggagtgtgcttctaggaccgccctcatcgaggagggtcagcggatagccgagatgctaaagtccaaaatacag

SEQ ID NO: 125498 - DNA, 75 bp, Artificial Sequence
  Synthetic
gaggagtgtgcttctaggaccgccctcatcgaggagggccaacggatagccgagatgctaaagtccaaaatacag

SEQ ID NO: 125499 - DNA, 75 bp, Artificial Sequence
  Synthetic
gaggagtgtgcttctaggaccgccctcatcgaggagggccatcggatagccgagatgctaaagtccaaaatacag

SEQ ID NO: 125500 - DNA, 75 bp, Artificial Sequence
  Synthetic
gaggagtgtgcttctaggaccgccctcatcgaggagggccaccggatagccgagatgctaaagtccaaaatacag

SEQ ID NO: 125501 - DNA, 75 bp, Artificial Sequence
  Synthetic
gaggagtgtgcttctaggaccgccctcatcgaggagggccagcggatagccgagatgctaaagtccaaaatacag

SEQ ID NO: 125502 - DNA, 75 bp, Artificial Sequence
  Synthetic
gaggagtgtgcttctaggaccgccctcatcgaggaggggcaacggatagccgagatgctaaagtccaaaatacag

SEQ ID NO: 125503 - DNA, 75 bp, Artificial Sequence
  Synthetic
gaggagtgtgcttctaggaccgccctcatcgaggaggggcatcggatagccgagatgctaaagtccaaaatacag

SEQ ID NO: 125504 - DNA, 75 bp, Artificial Sequence
  Synthetic
gaggagtgtgcttctaggaccgccctcatcgaggaggggcaccggatagccgagatgctaaagtccaaaatacag

SEQ ID NO: 125505 - DNA, 75 bp, Artificial Sequence
  Synthetic
gaggagtgtgcttctaggaccgccctcatcgaggaggggcagcggatagccgagatgctaaagtccaaaatacag

SEQ ID NO: 125506 - DNA, 75 bp, Artificial Sequence
  Synthetic
gaggagtgtgcttcttggaccgccctcatcgaggagggacaacggatagccgagatgctaaagtccaaaatacag

SEQ ID NO: 125507 - DNA, 75 bp, Artificial Sequence
  Synthetic
gaggagtgtgcttcttggaccgccctcatcgaggagggacatcggatagccgagatgctaaagtccaaaatacag

SEQ ID NO: 125508 - DNA, 75 bp, Artificial Sequence
  Synthetic
gaggagtgtgcttcttggaccgccctcatcgaggagggacaccggatagccgagatgctaaagtccaaaatacag

SEQ ID NO: 125509 - DNA, 75 bp, Artificial Sequence
  Synthetic
gaggagtgtgcttcttggaccgccctcatcgaggagggacagcggatagccgagatgctaaagtccaaaatacag

SEQ ID NO: 125510 - DNA, 75 bp, Artificial Sequence
  Synthetic
gaggagtgtgcttcttggaccgccctcatcgaggagggtcaacggatagccgagatgctaaagtccaaaatacag

SEQ ID NO: 125511 - DNA, 75 bp, Artificial Sequence
  Synthetic
gaggagtgtgcttcttggaccgccctcatcgaggagggtcatcggatagccgagatgctaaagtccaaaatacag

SEQ ID NO: 125512 - DNA, 75 bp, Artificial Sequence
  Synthetic
gaggagtgtgcttcttggaccgccctcatcgaggagggtcaccggatagccgagatgctaaagtccaaaatacag

SEQ ID NO: 125513 - DNA, 75 bp, Artificial Sequence
  Synthetic
gaggagtgtgcttcttggaccgccctcatcgaggagggtcagcggatagccgagatgctaaagtccaaaatacag

SEQ ID NO: 125514 - DNA, 75 bp, Artificial Sequence
  Synthetic
gaggagtgtgcttcttggaccgccctcatcgaggagggccaacggatagccgagatgctaaagtccaaaatacag

SEQ ID NO: 125515 - DNA, 75 bp, Artificial Sequence
  Synthetic
gaggagtgtgcttcttggaccgccctcatcgaggagggccatcggatagccgagatgctaaagtccaaaatacag

SEQ ID NO: 125516 - DNA, 75 bp, Artificial Sequence
  Synthetic
gaggagtgtgcttcttggaccgccctcatcgaggagggccaccggatagccgagatgctaaagtccaaaatacag

SEQ ID NO: 125517 - DNA, 75 bp, Artificial Sequence
  Synthetic
gaggagtgtgcttcttggaccgccctcatcgaggagggccagcggatagccgagatgctaaagtccaaaatacag

SEQ ID NO: 125518 - DNA, 75 bp, Artificial Sequence
  Synthetic
gaggagtgtgcttcttggaccgccctcatcgaggaggggcaacggatagccgagatgctaaagtccaaaatacag

SEQ ID NO: 125519 - DNA, 75 bp, Artificial Sequence
  Synthetic
gaggagtgtgcttcttggaccgccctcatcgaggaggggcatcggatagccgagatgctaaagtccaaaatacag

SEQ ID NO: 125520 - DNA, 75 bp, Artificial Sequence
  Synthetic
gaggagtgtgcttcttggaccgccctcatcgaggaggggcaccggatagccgagatgctaaagtccaaaatacag

SEQ ID NO: 125521 - DNA, 75 bp, Artificial Sequence
  Synthetic
gaggagtgtgcttcttggaccgccctcatcgaggaggggcagcggatagccgagatgctaaagtccaaaatacag

SEQ ID NO: 125522 - DNA, 75 bp, Artificial Sequence
  Synthetic
gaggagtgtgcttctcggaccgccctcatcgaggagggacaacggatagccgagatgctaaagtccaaaatacag

SEQ ID NO: 125523 - DNA, 75 bp, Artificial Sequence
  Synthetic
gaggagtgtgcttctcggaccgccctcatcgaggagggacatcggatagccgagatgctaaagtccaaaatacag

SEQ ID NO: 125524 - DNA, 75 bp, Artificial Sequence
  Synthetic
gaggagtgtgcttctcggaccgccctcatcgaggagggacaccggatagccgagatgctaaagtccaaaatacag

SEQ ID NO: 125525 - DNA, 75 bp, Artificial Sequence
  Synthetic
gaggagtgtgcttctcggaccgccctcatcgaggagggacagcggatagccgagatgctaaagtccaaaatacag

SEQ ID NO: 125526 - DNA, 75 bp, Artificial Sequence
  Synthetic
gaggagtgtgcttctcggaccgccctcatcgaggagggtcaacggatagccgagatgctaaagtccaaaatacag

SEQ ID NO: 125527 - DNA, 75 bp, Artificial Sequence
  Synthetic
gaggagtgtgcttctcggaccgccctcatcgaggagggtcatcggatagccgagatgctaaagtccaaaatacag

SEQ ID NO: 125528 - DNA, 75 bp, Artificial Sequence
  Synthetic
gaggagtgtgcttctcggaccgccctcatcgaggagggtcaccggatagccgagatgctaaagtccaaaatacag

SEQ ID NO: 125529 - DNA, 75 bp, Artificial Sequence
  Synthetic
gaggagtgtgcttctcggaccgccctcatcgaggagggtcagcggatagccgagatgctaaagtccaaaatacag

SEQ ID NO: 125530 - DNA, 75 bp, Artificial Sequence
  Synthetic
gaggagtgtgcttctcggaccgccctcatcgaggagggccaacggatagccgagatgctaaagtccaaaatacag

SEQ ID NO: 125531 - DNA, 75 bp, Artificial Sequence
  Synthetic
gaggagtgtgcttctcggaccgccctcatcgaggagggccatcggatagccgagatgctaaagtccaaaatacag

SEQ ID NO: 125532 - DNA, 75 bp, Artificial Sequence
  Synthetic
gaggagtgtgcttctcggaccgccctcatcgaggagggccaccggatagccgagatgctaaagtccaaaatacag

SEQ ID NO: 125533 - DNA, 75 bp, Artificial Sequence
  Synthetic
gaggagtgtgcttctcggaccgccctcatcgaggagggccagcggatagccgagatgctaaagtccaaaatacag

SEQ ID NO: 125534 - DNA, 75 bp, Artificial Sequence
  Synthetic
gaggagtgtgcttctcggaccgccctcatcgaggaggggcaacggatagccgagatgctaaagtccaaaatacag

SEQ ID NO: 125535 - DNA, 75 bp, Artificial Sequence
  Synthetic
gaggagtgtgcttctcggaccgccctcatcgaggaggggcatcggatagccgagatgctaaagtccaaaatacag

SEQ ID NO: 125536 - DNA, 75 bp, Artificial Sequence
  Synthetic
gaggagtgtgcttctcggaccgccctcatcgaggaggggcaccggatagccgagatgctaaagtccaaaatacag

SEQ ID NO: 125537 - DNA, 75 bp, Artificial Sequence
  Synthetic
gaggagtgtgcttctcggaccgccctcatcgaggaggggcagcggatagccgagatgctaaagtccaaaatacag

SEQ ID NO: 125538 - DNA, 75 bp, Artificial Sequence
  Synthetic
gaggagtgtgcttctgggaccgccctcatcgaggagggacaacggatagccgagatgctaaagtccaaaatacag

SEQ ID NO: 125539 - DNA, 75 bp, Artificial Sequence
  Synthetic
gaggagtgtgcttctgggaccgccctcatcgaggagggacatcggatagccgagatgctaaagtccaaaatacag

SEQ ID NO: 125540 - DNA, 75 bp, Artificial Sequence
  Synthetic
gaggagtgtgcttctgggaccgccctcatcgaggagggacaccggatagccgagatgctaaagtccaaaatacag

SEQ ID NO: 125541 - DNA, 75 bp, Artificial Sequence
  Synthetic
gaggagtgtgcttctgggaccgccctcatcgaggagggacagcggatagccgagatgctaaagtccaaaatacag

SEQ ID NO: 125542 - DNA, 75 bp, Artificial Sequence
  Synthetic
gaggagtgtgcttctgggaccgccctcatcgaggagggtcaacggatagccgagatgctaaagtccaaaatacag

SEQ ID NO: 125543 - DNA, 75 bp, Artificial Sequence
  Synthetic
gaggagtgtgcttctgggaccgccctcatcgaggagggtcatcggatagccgagatgctaaagtccaaaatacag

SEQ ID NO: 125544 - DNA, 75 bp, Artificial Sequence
  Synthetic
gaggagtgtgcttctgggaccgccctcatcgaggagggtcaccggatagccgagatgctaaagtccaaaatacag

SEQ ID NO: 125545 - DNA, 75 bp, Artificial Sequence
  Synthetic
gaggagtgtgcttctgggaccgccctcatcgaggagggtcagcggatagccgagatgctaaagtccaaaatacag

SEQ ID NO: 125546 - DNA, 75 bp, Artificial Sequence
  Synthetic
gaggagtgtgcttctgggaccgccctcatcgaggagggccaacggatagccgagatgctaaagtccaaaatacag

SEQ ID NO: 125547 - DNA, 75 bp, Artificial Sequence
  Synthetic
gaggagtgtgcttctgggaccgccctcatcgaggagggccatcggatagccgagatgctaaagtccaaaatacag

SEQ ID NO: 125548 - DNA, 75 bp, Artificial Sequence
  Synthetic
gaggagtgtgcttctgggaccgccctcatcgaggagggccaccggatagccgagatgctaaagtccaaaatacag

SEQ ID NO: 125549 - DNA, 75 bp, Artificial Sequence
  Synthetic
gaggagtgtgcttctgggaccgccctcatcgaggagggccagcggatagccgagatgctaaagtccaaaatacag

SEQ ID NO: 125550 - DNA, 75 bp, Artificial Sequence
  Synthetic
gaggagtgtgcttctgggaccgccctcatcgaggaggggcaacggatagccgagatgctaaagtccaaaatacag

SEQ ID NO: 125551 - DNA, 75 bp, Artificial Sequence
  Synthetic
gaggagtgtgcttctgggaccgccctcatcgaggaggggcatcggatagccgagatgctaaagtccaaaatacag

SEQ ID NO: 125552 - DNA, 75 bp, Artificial Sequence
  Synthetic
gaggagtgtgcttctgggaccgccctcatcgaggaggggcaccggatagccgagatgctaaagtccaaaatacag

SEQ ID NO: 125553 - DNA, 75 bp, Artificial Sequence
  Synthetic
gaggagtgtgcttctgggaccgccctcatcgaggaggggcagcggatagccgagatgctaaagtccaaaatacag

SEQ ID NO: 125554 - DNA, 75 bp, Artificial Sequence
  Synthetic
tttgggtaaggtcatcgataccctaacatgcggctttgccgacctcatggggtacatacccgtcgtcggcgcccc

SEQ ID NO: 125555 - DNA, 75 bp, Artificial Sequence
  Synthetic
gagttcgacgacagggagctgtccgtggctgcggagtgtcataggcctcctaggcctaaatatcctccagcattg

SEQ ID NO: 125556 - DNA, 75 bp, Artificial Sequence
  Synthetic
cctccggtggtgcatgggtgcccattgccacctactaaggcccctccaataccacctccacggaggaaaaggacg

SEQ ID NO: 125557 - DNA, 75 bp, Artificial Sequence
  Synthetic
gggctcccccttgtgtgactcgacccacgaggggtaacaacaccctggtgtgccctaccgattgtttccgaaaac

SEQ ID NO: 125558 - DNA, 75 bp, Artificial Sequence
  Synthetic
cgttgggggcgttgccagagctctcgcccatggggtgagggttctggaggacgggataaattatgcaacagggaa

SEQ ID NO: 125559 - DNA, 75 bp, Artificial Sequence
  Synthetic
acgggataaattatgcaacagggaatttgcccggttgctctttctctatcttcctcttagccctcttgtcctgca

SEQ ID NO: 125560 - DNA, 75 bp, Artificial Sequence
  Synthetic
acttcatcagtggcatccagtacctcgcggggttgtccacactaccgggaaatcctgctgtggcctcgatgatgt

SEQ ID NO: 125561 - DNA, 75 bp, Artificial Sequence
  Synthetic
gggggttgccgccagtgccaccgccaagacggaagaagcttgtgaagctcgacgactcggcagcggcagcagcgc

SEQ ID NO: 125562 - DNA, 75 bp, Artificial Sequence
  Synthetic
tcatacggctaaagcctatgctcacagggcccactcccctgttgtataggctgggggccgtgcaaaatgaggtca

SEQ ID NO: 125563 - DNA, 75 bp, Artificial Sequence
  Synthetic
ctcaacatcatgggaggatggctagcttcccaaattgctccacctgcaggggctactggctttgttgtcagtggt

SEQ ID NO: 125564 - DNA, 75 bp, Artificial Sequence
  Synthetic
ctcaacatcatgggaggatggctagcttcccaaattgctcctcctgcaggggctactggctttgttgtcagtggt

SEQ ID NO: 125565 - DNA, 75 bp, Artificial Sequence
  Synthetic
ctcaacatcatgggaggatggctagcttcccaaattgctccccctgcaggggctactggctttgttgtcagtggt

SEQ ID NO: 125566 - DNA, 75 bp, Artificial Sequence
  Synthetic
ctcaacatcatgggaggatggctagcttcccaaattgctccgcctgcaggggctactggctttgttgtcagtggt

SEQ ID NO: 125567 - DNA, 75 bp, Artificial Sequence
  Synthetic
ctcaacatcatgggaggttggctagcttcccaaattgctccacctgcaggggctactggctttgttgtcagtggt

SEQ ID NO: 125568 - DNA, 75 bp, Artificial Sequence
  Synthetic
ctcaacatcatgggaggttggctagcttcccaaattgctcctcctgcaggggctactggctttgttgtcagtggt

SEQ ID NO: 125569 - DNA, 75 bp, Artificial Sequence
  Synthetic
ctcaacatcatgggaggttggctagcttcccaaattgctccccctgcaggggctactggctttgttgtcagtggt

SEQ ID NO: 125570 - DNA, 75 bp, Artificial Sequence
  Synthetic
ctcaacatcatgggaggttggctagcttcccaaattgctccgcctgcaggggctactggctttgttgtcagtggt

SEQ ID NO: 125571 - DNA, 75 bp, Artificial Sequence
  Synthetic
ctcaacatcatgggaggctggctagcttcccaaattgctccacctgcaggggctactggctttgttgtcagtggt

SEQ ID NO: 125572 - DNA, 75 bp, Artificial Sequence
  Synthetic
ctcaacatcatgggaggctggctagcttcccaaattgctcctcctgcaggggctactggctttgttgtcagtggt

SEQ ID NO: 125573 - DNA, 75 bp, Artificial Sequence
  Synthetic
ctcaacatcatgggaggctggctagcttcccaaattgctccccctgcaggggctactggctttgttgtcagtggt

SEQ ID NO: 125574 - DNA, 75 bp, Artificial Sequence
  Synthetic
ctcaacatcatgggaggctggctagcttcccaaattgctccgcctgcaggggctactggctttgttgtcagtggt

SEQ ID NO: 125575 - DNA, 75 bp, Artificial Sequence
  Synthetic
ctcaacatcatgggagggtggctagcttcccaaattgctccacctgcaggggctactggctttgttgtcagtggt

SEQ ID NO: 125576 - DNA, 75 bp, Artificial Sequence
  Synthetic
ctcaacatcatgggagggtggctagcttcccaaattgctcctcctgcaggggctactggctttgttgtcagtggt

SEQ ID NO: 125577 - DNA, 75 bp, Artificial Sequence
  Synthetic
ctcaacatcatgggagggtggctagcttcccaaattgctccccctgcaggggctactggctttgttgtcagtggt

SEQ ID NO: 125578 - DNA, 75 bp, Artificial Sequence
  Synthetic
ctcaacatcatgggagggtggctagcttcccaaattgctccgcctgcaggggctactggctttgttgtcagtggt

SEQ ID NO: 125579 - DNA, 75 bp, Artificial Sequence
  Synthetic
ctcaacatcatgggtggatggctagcttcccaaattgctccacctgcaggggctactggctttgttgtcagtggt

SEQ ID NO: 125580 - DNA, 75 bp, Artificial Sequence
  Synthetic
ctcaacatcatgggtggatggctagcttcccaaattgctcctcctgcaggggctactggctttgttgtcagtggt

SEQ ID NO: 125581 - DNA, 75 bp, Artificial Sequence
  Synthetic
ctcaacatcatgggtggatggctagcttcccaaattgctccccctgcaggggctactggctttgttgtcagtggt

SEQ ID NO: 125582 - DNA, 75 bp, Artificial Sequence
  Synthetic
ctcaacatcatgggtggatggctagcttcccaaattgctccgcctgcaggggctactggctttgttgtcagtggt

SEQ ID NO: 125583 - DNA, 75 bp, Artificial Sequence
  Synthetic
ctcaacatcatgggtggttggctagcttcccaaattgctccacctgcaggggctactggctttgttgtcagtggt

SEQ ID NO: 125584 - DNA, 75 bp, Artificial Sequence
  Synthetic
ctcaacatcatgggtggttggctagcttcccaaattgctcctcctgcaggggctactggctttgttgtcagtggt

SEQ ID NO: 125585 - DNA, 75 bp, Artificial Sequence
  Synthetic
ctcaacatcatgggtggttggctagcttcccaaattgctccccctgcaggggctactggctttgttgtcagtggt

SEQ ID NO: 125586 - DNA, 75 bp, Artificial Sequence
  Synthetic
ctcaacatcatgggtggttggctagcttcccaaattgctccgcctgcaggggctactggctttgttgtcagtggt

SEQ ID NO: 125587 - DNA, 75 bp, Artificial Sequence
  Synthetic
ctcaacatcatgggtggctggctagcttcccaaattgctccacctgcaggggctactggctttgttgtcagtggt

SEQ ID NO: 125588 - DNA, 75 bp, Artificial Sequence
  Synthetic
ctcaacatcatgggtggctggctagcttcccaaattgctcctcctgcaggggctactggctttgttgtcagtggt

SEQ ID NO: 125589 - DNA, 75 bp, Artificial Sequence
  Synthetic
ctcaacatcatgggtggctggctagcttcccaaattgctccccctgcaggggctactggctttgttgtcagtggt

SEQ ID NO: 125590 - DNA, 75 bp, Artificial Sequence
  Synthetic
ctcaacatcatgggtggctggctagcttcccaaattgctccgcctgcaggggctactggctttgttgtcagtggt

SEQ ID NO: 125591 - DNA, 75 bp, Artificial Sequence
  Synthetic
ctcaacatcatgggtgggtggctagcttcccaaattgctccacctgcaggggctactggctttgttgtcagtggt

SEQ ID NO: 125592 - DNA, 75 bp, Artificial Sequence
  Synthetic
ctcaacatcatgggtgggtggctagcttcccaaattgctcctcctgcaggggctactggctttgttgtcagtggt

SEQ ID NO: 125593 - DNA, 75 bp, Artificial Sequence
  Synthetic
ctcaacatcatgggtgggtggctagcttcccaaattgctccccctgcaggggctactggctttgttgtcagtggt

SEQ ID NO: 125594 - DNA, 75 bp, Artificial Sequence
  Synthetic
ctcaacatcatgggtgggtggctagcttcccaaattgctccgcctgcaggggctactggctttgttgtcagtggt

SEQ ID NO: 125595 - DNA, 75 bp, Artificial Sequence
  Synthetic
ctcaacatcatgggcggatggctagcttcccaaattgctccacctgcaggggctactggctttgttgtcagtggt

SEQ ID NO: 125596 - DNA, 75 bp, Artificial Sequence
  Synthetic
ctcaacatcatgggcggatggctagcttcccaaattgctcctcctgcaggggctactggctttgttgtcagtggt

SEQ ID NO: 125597 - DNA, 75 bp, Artificial Sequence
  Synthetic
ctcaacatcatgggcggatggctagcttcccaaattgctccccctgcaggggctactggctttgttgtcagtggt

SEQ ID NO: 125598 - DNA, 75 bp, Artificial Sequence
  Synthetic
ctcaacatcatgggcggatggctagcttcccaaattgctccgcctgcaggggctactggctttgttgtcagtggt

SEQ ID NO: 125599 - DNA, 75 bp, Artificial Sequence
  Synthetic
ctcaacatcatgggcggttggctagcttcccaaattgctccacctgcaggggctactggctttgttgtcagtggt

SEQ ID NO: 125600 - DNA, 75 bp, Artificial Sequence
  Synthetic
ctcaacatcatgggcggttggctagcttcccaaattgctcctcctgcaggggctactggctttgttgtcagtggt

SEQ ID NO: 125601 - DNA, 75 bp, Artificial Sequence
  Synthetic
ctcaacatcatgggcggttggctagcttcccaaattgctccccctgcaggggctactggctttgttgtcagtggt

SEQ ID NO: 125602 - DNA, 75 bp, Artificial Sequence
  Synthetic
ctcaacatcatgggcggttggctagcttcccaaattgctccgcctgcaggggctactggctttgttgtcagtggt

SEQ ID NO: 125603 - DNA, 75 bp, Artificial Sequence
  Synthetic
ctcaacatcatgggcggctggctagcttcccaaattgctccacctgcaggggctactggctttgttgtcagtggt

SEQ ID NO: 125604 - DNA, 75 bp, Artificial Sequence
  Synthetic
ctcaacatcatgggcggctggctagcttcccaaattgctcctcctgcaggggctactggctttgttgtcagtggt

SEQ ID NO: 125605 - DNA, 75 bp, Artificial Sequence
  Synthetic
ctcaacatcatgggcggctggctagcttcccaaattgctccccctgcaggggctactggctttgttgtcagtggt

SEQ ID NO: 125606 - DNA, 75 bp, Artificial Sequence
  Synthetic
ctcaacatcatgggcggctggctagcttcccaaattgctccgcctgcaggggctactggctttgttgtcagtggt

SEQ ID NO: 125607 - DNA, 75 bp, Artificial Sequence
  Synthetic
ctcaacatcatgggcgggtggctagcttcccaaattgctccacctgcaggggctactggctttgttgtcagtggt

SEQ ID NO: 125608 - DNA, 75 bp, Artificial Sequence
  Synthetic
ctcaacatcatgggcgggtggctagcttcccaaattgctcctcctgcaggggctactggctttgttgtcagtggt

SEQ ID NO: 125609 - DNA, 75 bp, Artificial Sequence
  Synthetic
ctcaacatcatgggcgggtggctagcttcccaaattgctccccctgcaggggctactggctttgttgtcagtggt

SEQ ID NO: 125610 - DNA, 75 bp, Artificial Sequence
  Synthetic
ctcaacatcatgggcgggtggctagcttcccaaattgctccgcctgcaggggctactggctttgttgtcagtggt

SEQ ID NO: 125611 - DNA, 75 bp, Artificial Sequence
  Synthetic
ctcaacatcatggggggatggctagcttcccaaattgctccacctgcaggggctactggctttgttgtcagtggt

SEQ ID NO: 125612 - DNA, 75 bp, Artificial Sequence
  Synthetic
ctcaacatcatggggggatggctagcttcccaaattgctcctcctgcaggggctactggctttgttgtcagtggt

SEQ ID NO: 125613 - DNA, 75 bp, Artificial Sequence
  Synthetic
ctcaacatcatggggggatggctagcttcccaaattgctccccctgcaggggctactggctttgttgtcagtggt

SEQ ID NO: 125614 - DNA, 75 bp, Artificial Sequence
  Synthetic
ctcaacatcatggggggatggctagcttcccaaattgctccgcctgcaggggctactggctttgttgtcagtggt

SEQ ID NO: 125615 - DNA, 75 bp, Artificial Sequence
  Synthetic
ctcaacatcatggggggttggctagcttcccaaattgctccacctgcaggggctactggctttgttgtcagtggt

SEQ ID NO: 125616 - DNA, 75 bp, Artificial Sequence
  Synthetic
ctcaacatcatggggggttggctagcttcccaaattgctcctcctgcaggggctactggctttgttgtcagtggt

SEQ ID NO: 125617 - DNA, 75 bp, Artificial Sequence
  Synthetic
ctcaacatcatggggggttggctagcttcccaaattgctccccctgcaggggctactggctttgttgtcagtggt

SEQ ID NO: 125618 - DNA, 75 bp, Artificial Sequence
  Synthetic
ctcaacatcatggggggttggctagcttcccaaattgctccgcctgcaggggctactggctttgttgtcagtggt

SEQ ID NO: 125619 - DNA, 75 bp, Artificial Sequence
  Synthetic
ctcaacatcatggggggctggctagcttcccaaattgctccacctgcaggggctactggctttgttgtcagtggt

SEQ ID NO: 125620 - DNA, 75 bp, Artificial Sequence
  Synthetic
ctcaacatcatggggggctggctagcttcccaaattgctcctcctgcaggggctactggctttgttgtcagtggt

SEQ ID NO: 125621 - DNA, 75 bp, Artificial Sequence
  Synthetic
ctcaacatcatggggggctggctagcttcccaaattgctccccctgcaggggctactggctttgttgtcagtggt

SEQ ID NO: 125622 - DNA, 75 bp, Artificial Sequence
  Synthetic
ctcaacatcatggggggctggctagcttcccaaattgctccgcctgcaggggctactggctttgttgtcagtggt

SEQ ID NO: 125623 - DNA, 75 bp, Artificial Sequence
  Synthetic
ctcaacatcatgggggggtggctagcttcccaaattgctccacctgcaggggctactggctttgttgtcagtggt

SEQ ID NO: 125624 - DNA, 75 bp, Artificial Sequence
  Synthetic
ctcaacatcatgggggggtggctagcttcccaaattgctcctcctgcaggggctactggctttgttgtcagtggt

SEQ ID NO: 125625 - DNA, 75 bp, Artificial Sequence
  Synthetic
ctcaacatcatgggggggtggctagcttcccaaattgctccccctgcaggggctactggctttgttgtcagtggt

SEQ ID NO: 125626 - DNA, 75 bp, Artificial Sequence
  Synthetic
ctcaacatcatgggggggtggctagcttcccaaattgctccgcctgcaggggctactggctttgttgtcagtggt

SEQ ID NO: 125627 - DNA, 75 bp, Artificial Sequence
  Synthetic
cgcagtgctccatacccctggatgtgtcccctgtgagcggaccggtaacaggtctcggtgttggctaccgatcac

SEQ ID NO: 125628 - DNA, 75 bp, Artificial Sequence
  Synthetic
aaggttggggtaaacactccggcctcttaggccatttcctgtttttttttttttttttttttttttttttttttt

SEQ ID NO: 125629 - DNA, 75 bp, Artificial Sequence
  Synthetic
tcaacaagaggacgactcaatttccaaccctgagtcgtatagctcgatgcctcccctcgagggggagccaggaga

SEQ ID NO: 125630 - DNA, 75 bp, Artificial Sequence
  Synthetic
cgcacatcgatgtcatcgtgacgtccgccacgctctgctctgccctttatatcggggacgtgtgtggcgcgttga

SEQ ID NO: 125631 - DNA, 75 bp, Artificial Sequence
  Synthetic
ccatgcgctgccgaagaagagaaattgcccatttcaccactgagcaatagtctcatacgccaccacaatctggtg

SEQ ID NO: 125632 - DNA, 75 bp, Artificial Sequence
  Synthetic
aggacgtcaagttcccgggtggcggccagatcgttggcggagtttacttgctgccgcgcaggggccccaggttgg

SEQ ID NO: 125633 - DNA, 75 bp, Artificial Sequence
  Synthetic
ggcttgggatatgatgatgaactggtcgcccaccaccaccatgctcctggcgtacttagtgcgcatcccggaggt

SEQ ID NO: 125634 - DNA, 75 bp, Artificial Sequence
  Synthetic
ataggctcatcgccttagcgtccagaggaaaccatgtcgccccgacacactacgtggcggagtcggaagcatcac

SEQ ID NO: 125635 - DNA, 75 bp, Artificial Sequence
  Synthetic
ataggctcatcgccttagcgtccagaggaaaccatgtcgccccgacacactacgtggcggagtcggaagcttcac

SEQ ID NO: 125636 - DNA, 75 bp, Artificial Sequence
  Synthetic
ataggctcatcgccttagcgtccagaggaaaccatgtcgccccgacacactacgtggcggagtcggaagcctcac

SEQ ID NO: 125637 - DNA, 75 bp, Artificial Sequence
  Synthetic
ataggctcatcgccttagcgtccagaggaaaccatgtcgccccgacacactacgtggcggagtcggaagcgtcac

SEQ ID NO: 125638 - DNA, 75 bp, Artificial Sequence
  Synthetic
ataggctcatcgccttagcgtccagaggaaaccatgtcgccccgacacactacgtggcggagtcggatgcatcac

SEQ ID NO: 125639 - DNA, 75 bp, Artificial Sequence
  Synthetic
ataggctcatcgccttagcgtccagaggaaaccatgtcgccccgacacactacgtggcggagtcggatgcttcac

SEQ ID NO: 125640 - DNA, 75 bp, Artificial Sequence
  Synthetic
ataggctcatcgccttagcgtccagaggaaaccatgtcgccccgacacactacgtggcggagtcggatgcctcac

SEQ ID NO: 125641 - DNA, 75 bp, Artificial Sequence
  Synthetic
ataggctcatcgccttagcgtccagaggaaaccatgtcgccccgacacactacgtggcggagtcggatgcgtcac

SEQ ID NO: 125642 - DNA, 75 bp, Artificial Sequence
  Synthetic
ataggctcatcgccttagcgtccagaggaaaccatgtcgccccgacacactacgtggcggagtcggacgcatcac

SEQ ID NO: 125643 - DNA, 75 bp, Artificial Sequence
  Synthetic
ataggctcatcgccttagcgtccagaggaaaccatgtcgccccgacacactacgtggcggagtcggacgcttcac

SEQ ID NO: 125644 - DNA, 75 bp, Artificial Sequence
  Synthetic
ataggctcatcgccttagcgtccagaggaaaccatgtcgccccgacacactacgtggcggagtcggacgcctcac

SEQ ID NO: 125645 - DNA, 75 bp, Artificial Sequence
  Synthetic
ataggctcatcgccttagcgtccagaggaaaccatgtcgccccgacacactacgtggcggagtcggacgcgtcac

SEQ ID NO: 125646 - DNA, 75 bp, Artificial Sequence
  Synthetic
ataggctcatcgccttagcgtccagaggaaaccatgtcgccccgacacactacgtggcggagtcggaggcatcac

SEQ ID NO: 125647 - DNA, 75 bp, Artificial Sequence
  Synthetic
ataggctcatcgccttagcgtccagaggaaaccatgtcgccccgacacactacgtggcggagtcggaggcttcac

SEQ ID NO: 125648 - DNA, 75 bp, Artificial Sequence
  Synthetic
ataggctcatcgccttagcgtccagaggaaaccatgtcgccccgacacactacgtggcggagtcggaggcctcac

SEQ ID NO: 125649 - DNA, 75 bp, Artificial Sequence
  Synthetic
ataggctcatcgccttagcgtccagaggaaaccatgtcgccccgacacactacgtggcggagtcggaggcgtcac

SEQ ID NO: 125650 - DNA, 75 bp, Artificial Sequence
  Synthetic
ataggctcatcgccttagcgtccagaggtaaccatgtcgccccgacacactacgtggcggagtcggaagcatcac

SEQ ID NO: 125651 - DNA, 75 bp, Artificial Sequence
  Synthetic
ataggctcatcgccttagcgtccagaggtaaccatgtcgccccgacacactacgtggcggagtcggaagcttcac

SEQ ID NO: 125652 - DNA, 75 bp, Artificial Sequence
  Synthetic
ataggctcatcgccttagcgtccagaggtaaccatgtcgccccgacacactacgtggcggagtcggaagcctcac

SEQ ID NO: 125653 - DNA, 75 bp, Artificial Sequence
  Synthetic
ataggctcatcgccttagcgtccagaggtaaccatgtcgccccgacacactacgtggcggagtcggaagcgtcac

SEQ ID NO: 125654 - DNA, 75 bp, Artificial Sequence
  Synthetic
ataggctcatcgccttagcgtccagaggtaaccatgtcgccccgacacactacgtggcggagtcggatgcatcac

SEQ ID NO: 125655 - DNA, 75 bp, Artificial Sequence
  Synthetic
ataggctcatcgccttagcgtccagaggtaaccatgtcgccccgacacactacgtggcggagtcggatgcttcac

SEQ ID NO: 125656 - DNA, 75 bp, Artificial Sequence
  Synthetic
ataggctcatcgccttagcgtccagaggtaaccatgtcgccccgacacactacgtggcggagtcggatgcctcac

SEQ ID NO: 125657 - DNA, 75 bp, Artificial Sequence
  Synthetic
ataggctcatcgccttagcgtccagaggtaaccatgtcgccccgacacactacgtggcggagtcggatgcgtcac

SEQ ID NO: 125658 - DNA, 75 bp, Artificial Sequence
  Synthetic
ataggctcatcgccttagcgtccagaggtaaccatgtcgccccgacacactacgtggcggagtcggacgcatcac

SEQ ID NO: 125659 - DNA, 75 bp, Artificial Sequence
  Synthetic
ataggctcatcgccttagcgtccagaggtaaccatgtcgccccgacacactacgtggcggagtcggacgcttcac

SEQ ID NO: 125660 - DNA, 75 bp, Artificial Sequence
  Synthetic
ataggctcatcgccttagcgtccagaggtaaccatgtcgccccgacacactacgtggcggagtcggacgcctcac

SEQ ID NO: 125661 - DNA, 75 bp, Artificial Sequence
  Synthetic
ataggctcatcgccttagcgtccagaggtaaccatgtcgccccgacacactacgtggcggagtcggacgcgtcac

SEQ ID NO: 125662 - DNA, 75 bp, Artificial Sequence
  Synthetic
ataggctcatcgccttagcgtccagaggtaaccatgtcgccccgacacactacgtggcggagtcggaggcatcac

SEQ ID NO: 125663 - DNA, 75 bp, Artificial Sequence
  Synthetic
ataggctcatcgccttagcgtccagaggtaaccatgtcgccccgacacactacgtggcggagtcggaggcttcac

SEQ ID NO: 125664 - DNA, 75 bp, Artificial Sequence
  Synthetic
ataggctcatcgccttagcgtccagaggtaaccatgtcgccccgacacactacgtggcggagtcggaggcctcac

SEQ ID NO: 125665 - DNA, 75 bp, Artificial Sequence
  Synthetic
ataggctcatcgccttagcgtccagaggtaaccatgtcgccccgacacactacgtggcggagtcggaggcgtcac

SEQ ID NO: 125666 - DNA, 75 bp, Artificial Sequence
  Synthetic
ataggctcatcgccttagcgtccagaggcaaccatgtcgccccgacacactacgtggcggagtcggaagcatcac

SEQ ID NO: 125667 - DNA, 75 bp, Artificial Sequence
  Synthetic
ataggctcatcgccttagcgtccagaggcaaccatgtcgccccgacacactacgtggcggagtcggaagcttcac

SEQ ID NO: 125668 - DNA, 75 bp, Artificial Sequence
  Synthetic
ataggctcatcgccttagcgtccagaggcaaccatgtcgccccgacacactacgtggcggagtcggaagcctcac

SEQ ID NO: 125669 - DNA, 75 bp, Artificial Sequence
  Synthetic
ataggctcatcgccttagcgtccagaggcaaccatgtcgccccgacacactacgtggcggagtcggaagcgtcac

SEQ ID NO: 125670 - DNA, 75 bp, Artificial Sequence
  Synthetic
ataggctcatcgccttagcgtccagaggcaaccatgtcgccccgacacactacgtggcggagtcggatgcatcac

SEQ ID NO: 125671 - DNA, 75 bp, Artificial Sequence
  Synthetic
ataggctcatcgccttagcgtccagaggcaaccatgtcgccccgacacactacgtggcggagtcggatgcttcac

SEQ ID NO: 125672 - DNA, 75 bp, Artificial Sequence
  Synthetic
ataggctcatcgccttagcgtccagaggcaaccatgtcgccccgacacactacgtggcggagtcggatgcctcac

SEQ ID NO: 125673 - DNA, 75 bp, Artificial Sequence
  Synthetic
ataggctcatcgccttagcgtccagaggcaaccatgtcgccccgacacactacgtggcggagtcggatgcgtcac

SEQ ID NO: 125674 - DNA, 75 bp, Artificial Sequence
  Synthetic
ataggctcatcgccttagcgtccagaggcaaccatgtcgccccgacacactacgtggcggagtcggacgcatcac

SEQ ID NO: 125675 - DNA, 75 bp, Artificial Sequence
  Synthetic
ataggctcatcgccttagcgtccagaggcaaccatgtcgccccgacacactacgtggcggagtcggacgcttcac

SEQ ID NO: 125676 - DNA, 75 bp, Artificial Sequence
  Synthetic
ataggctcatcgccttagcgtccagaggcaaccatgtcgccccgacacactacgtggcggagtcggacgcctcac

SEQ ID NO: 125677 - DNA, 75 bp, Artificial Sequence
  Synthetic
ataggctcatcgccttagcgtccagaggcaaccatgtcgccccgacacactacgtggcggagtcggacgcgtcac

SEQ ID NO: 125678 - DNA, 75 bp, Artificial Sequence
  Synthetic
ataggctcatcgccttagcgtccagaggcaaccatgtcgccccgacacactacgtggcggagtcggaggcatcac

SEQ ID NO: 125679 - DNA, 75 bp, Artificial Sequence
  Synthetic
ataggctcatcgccttagcgtccagaggcaaccatgtcgccccgacacactacgtggcggagtcggaggcttcac

SEQ ID NO: 125680 - DNA, 75 bp, Artificial Sequence
  Synthetic
ataggctcatcgccttagcgtccagaggcaaccatgtcgccccgacacactacgtggcggagtcggaggcctcac

SEQ ID NO: 125681 - DNA, 75 bp, Artificial Sequence
  Synthetic
ataggctcatcgccttagcgtccagaggcaaccatgtcgccccgacacactacgtggcggagtcggaggcgtcac

SEQ ID NO: 125682 - DNA, 75 bp, Artificial Sequence
  Synthetic
ataggctcatcgccttagcgtccagagggaaccatgtcgccccgacacactacgtggcggagtcggaagcatcac

SEQ ID NO: 125683 - DNA, 75 bp, Artificial Sequence
  Synthetic
ataggctcatcgccttagcgtccagagggaaccatgtcgccccgacacactacgtggcggagtcggaagcttcac

SEQ ID NO: 125684 - DNA, 75 bp, Artificial Sequence
  Synthetic
ataggctcatcgccttagcgtccagagggaaccatgtcgccccgacacactacgtggcggagtcggaagcctcac

SEQ ID NO: 125685 - DNA, 75 bp, Artificial Sequence
  Synthetic
ataggctcatcgccttagcgtccagagggaaccatgtcgccccgacacactacgtggcggagtcggaagcgtcac

SEQ ID NO: 125686 - DNA, 75 bp, Artificial Sequence
  Synthetic
ataggctcatcgccttagcgtccagagggaaccatgtcgccccgacacactacgtggcggagtcggatgcatcac

SEQ ID NO: 125687 - DNA, 75 bp, Artificial Sequence
  Synthetic
ataggctcatcgccttagcgtccagagggaaccatgtcgccccgacacactacgtggcggagtcggatgcttcac

SEQ ID NO: 125688 - DNA, 75 bp, Artificial Sequence
  Synthetic
ataggctcatcgccttagcgtccagagggaaccatgtcgccccgacacactacgtggcggagtcggatgcctcac

SEQ ID NO: 125689 - DNA, 75 bp, Artificial Sequence
  Synthetic
ataggctcatcgccttagcgtccagagggaaccatgtcgccccgacacactacgtggcggagtcggatgcgtcac

SEQ ID NO: 125690 - DNA, 75 bp, Artificial Sequence
  Synthetic
ataggctcatcgccttagcgtccagagggaaccatgtcgccccgacacactacgtggcggagtcggacgcatcac

SEQ ID NO: 125691 - DNA, 75 bp, Artificial Sequence
  Synthetic
ataggctcatcgccttagcgtccagagggaaccatgtcgccccgacacactacgtggcggagtcggacgcttcac

SEQ ID NO: 125692 - DNA, 75 bp, Artificial Sequence
  Synthetic
ataggctcatcgccttagcgtccagagggaaccatgtcgccccgacacactacgtggcggagtcggacgcctcac

SEQ ID NO: 125693 - DNA, 75 bp, Artificial Sequence
  Synthetic
ataggctcatcgccttagcgtccagagggaaccatgtcgccccgacacactacgtggcggagtcggacgcgtcac

SEQ ID NO: 125694 - DNA, 75 bp, Artificial Sequence
  Synthetic
ataggctcatcgccttagcgtccagagggaaccatgtcgccccgacacactacgtggcggagtcggaggcatcac

SEQ ID NO: 125695 - DNA, 75 bp, Artificial Sequence
  Synthetic
ataggctcatcgccttagcgtccagagggaaccatgtcgccccgacacactacgtggcggagtcggaggcttcac

SEQ ID NO: 125696 - DNA, 75 bp, Artificial Sequence
  Synthetic
ataggctcatcgccttagcgtccagagggaaccatgtcgccccgacacactacgtggcggagtcggaggcctcac

SEQ ID NO: 125697 - DNA, 75 bp, Artificial Sequence
  Synthetic
ataggctcatcgccttagcgtccagagggaaccatgtcgccccgacacactacgtggcggagtcggaggcgtcac

SEQ ID NO: 125698 - DNA, 75 bp, Artificial Sequence
  Synthetic
cactcttcctcaggccgtgatgggctcctcatacgggttccagtactctcctggacagcgggtcgagttcctggt

SEQ ID NO: 125699 - DNA, 75 bp, Artificial Sequence
  Synthetic
gcgcgcagtgaggaagacctctgaacgatcccagcctagaggcaggcgtcagcccataccaaaggcgcgccagcc

SEQ ID NO: 125700 - DNA, 75 bp, Artificial Sequence
  Synthetic
ttgactgccggggtagaggcgaacactcacaccaccggagggactgctgcacgccaagcatacacccttgccggt

SEQ ID NO: 125701 - DNA, 75 bp, Artificial Sequence
  Synthetic
gtggctccgagatgtgtgggactgggtatgttcaatcctgacagactttaaaaattggctatctgccaaattgtt

SEQ ID NO: 125702 - DNA, 75 bp, Artificial Sequence
  Synthetic
gtggctccgagatgtgtgggactgggtatgttcaatcctgacagactttaataattggctatctgccaaattgtt

SEQ ID NO: 125703 - DNA, 75 bp, Artificial Sequence
  Synthetic
gtggctccgagatgtgtgggactgggtatgttcaatcctgacagactttaacaattggctatctgccaaattgtt

SEQ ID NO: 125704 - DNA, 75 bp, Artificial Sequence
  Synthetic
gtggctccgagatgtgtgggactgggtatgttcaatcctgacagactttaagaattggctatctgccaaattgtt

SEQ ID NO: 125705 - DNA, 75 bp, Artificial Sequence
  Synthetic
gtggctccgagatgtgtgggactgggtatgttctatcctgacagactttaaaaattggctatctgccaaattgtt

SEQ ID NO: 125706 - DNA, 75 bp, Artificial Sequence
  Synthetic
gtggctccgagatgtgtgggactgggtatgttctatcctgacagactttaataattggctatctgccaaattgtt

SEQ ID NO: 125707 - DNA, 75 bp, Artificial Sequence
  Synthetic
gtggctccgagatgtgtgggactgggtatgttctatcctgacagactttaacaattggctatctgccaaattgtt

SEQ ID NO: 125708 - DNA, 75 bp, Artificial Sequence
  Synthetic
gtggctccgagatgtgtgggactgggtatgttctatcctgacagactttaagaattggctatctgccaaattgtt

SEQ ID NO: 125709 - DNA, 75 bp, Artificial Sequence
  Synthetic
gtggctccgagatgtgtgggactgggtatgttccatcctgacagactttaaaaattggctatctgccaaattgtt

SEQ ID NO: 125710 - DNA, 75 bp, Artificial Sequence
  Synthetic
gtggctccgagatgtgtgggactgggtatgttccatcctgacagactttaataattggctatctgccaaattgtt

SEQ ID NO: 125711 - DNA, 75 bp, Artificial Sequence
  Synthetic
gtggctccgagatgtgtgggactgggtatgttccatcctgacagactttaacaattggctatctgccaaattgtt

SEQ ID NO: 125712 - DNA, 75 bp, Artificial Sequence
  Synthetic
gtggctccgagatgtgtgggactgggtatgttccatcctgacagactttaagaattggctatctgccaaattgtt

SEQ ID NO: 125713 - DNA, 75 bp, Artificial Sequence
  Synthetic
gtggctccgagatgtgtgggactgggtatgttcgatcctgacagactttaaaaattggctatctgccaaattgtt

SEQ ID NO: 125714 - DNA, 75 bp, Artificial Sequence
  Synthetic
gtggctccgagatgtgtgggactgggtatgttcgatcctgacagactttaataattggctatctgccaaattgtt

SEQ ID NO: 125715 - DNA, 75 bp, Artificial Sequence
  Synthetic
gtggctccgagatgtgtgggactgggtatgttcgatcctgacagactttaacaattggctatctgccaaattgtt

SEQ ID NO: 125716 - DNA, 75 bp, Artificial Sequence
  Synthetic
gtggctccgagatgtgtgggactgggtatgttcgatcctgacagactttaagaattggctatctgccaaattgtt

SEQ ID NO: 125717 - DNA, 75 bp, Artificial Sequence
  Synthetic
gtggctccgagatgtgtgggactgggtttgttcaatcctgacagactttaaaaattggctatctgccaaattgtt

SEQ ID NO: 125718 - DNA, 75 bp, Artificial Sequence
  Synthetic
gtggctccgagatgtgtgggactgggtttgttcaatcctgacagactttaataattggctatctgccaaattgtt

SEQ ID NO: 125719 - DNA, 75 bp, Artificial Sequence
  Synthetic
gtggctccgagatgtgtgggactgggtttgttcaatcctgacagactttaacaattggctatctgccaaattgtt

SEQ ID NO: 125720 - DNA, 75 bp, Artificial Sequence
  Synthetic
gtggctccgagatgtgtgggactgggtttgttcaatcctgacagactttaagaattggctatctgccaaattgtt

SEQ ID NO: 125721 - DNA, 75 bp, Artificial Sequence
  Synthetic
gtggctccgagatgtgtgggactgggtttgttctatcctgacagactttaaaaattggctatctgccaaattgtt

SEQ ID NO: 125722 - DNA, 75 bp, Artificial Sequence
  Synthetic
gtggctccgagatgtgtgggactgggtttgttctatcctgacagactttaataattggctatctgccaaattgtt

SEQ ID NO: 125723 - DNA, 75 bp, Artificial Sequence
  Synthetic
gtggctccgagatgtgtgggactgggtttgttctatcctgacagactttaacaattggctatctgccaaattgtt

SEQ ID NO: 125724 - DNA, 75 bp, Artificial Sequence
  Synthetic
gtggctccgagatgtgtgggactgggtttgttctatcctgacagactttaagaattggctatctgccaaattgtt

SEQ ID NO: 125725 - DNA, 75 bp, Artificial Sequence
  Synthetic
gtggctccgagatgtgtgggactgggtttgttccatcctgacagactttaaaaattggctatctgccaaattgtt

SEQ ID NO: 125726 - DNA, 75 bp, Artificial Sequence
  Synthetic
gtggctccgagatgtgtgggactgggtttgttccatcctgacagactttaataattggctatctgccaaattgtt

SEQ ID NO: 125727 - DNA, 75 bp, Artificial Sequence
  Synthetic
gtggctccgagatgtgtgggactgggtttgttccatcctgacagactttaacaattggctatctgccaaattgtt

SEQ ID NO: 125728 - DNA, 75 bp, Artificial Sequence
  Synthetic
gtggctccgagatgtgtgggactgggtttgttccatcctgacagactttaagaattggctatctgccaaattgtt

SEQ ID NO: 125729 - DNA, 75 bp, Artificial Sequence
  Synthetic
gtggctccgagatgtgtgggactgggtttgttcgatcctgacagactttaaaaattggctatctgccaaattgtt

SEQ ID NO: 125730 - DNA, 75 bp, Artificial Sequence
  Synthetic
gtggctccgagatgtgtgggactgggtttgttcgatcctgacagactttaataattggctatctgccaaattgtt

SEQ ID NO: 125731 - DNA, 75 bp, Artificial Sequence
  Synthetic
gtggctccgagatgtgtgggactgggtttgttcgatcctgacagactttaacaattggctatctgccaaattgtt

SEQ ID NO: 125732 - DNA, 75 bp, Artificial Sequence
  Synthetic
gtggctccgagatgtgtgggactgggtttgttcgatcctgacagactttaagaattggctatctgccaaattgtt

SEQ ID NO: 125733 - DNA, 75 bp, Artificial Sequence
  Synthetic
gtggctccgagatgtgtgggactgggtctgttcaatcctgacagactttaaaaattggctatctgccaaattgtt

SEQ ID NO: 125734 - DNA, 75 bp, Artificial Sequence
  Synthetic
gtggctccgagatgtgtgggactgggtctgttcaatcctgacagactttaataattggctatctgccaaattgtt

SEQ ID NO: 125735 - DNA, 75 bp, Artificial Sequence
  Synthetic
gtggctccgagatgtgtgggactgggtctgttcaatcctgacagactttaacaattggctatctgccaaattgtt

SEQ ID NO: 125736 - DNA, 75 bp, Artificial Sequence
  Synthetic
gtggctccgagatgtgtgggactgggtctgttcaatcctgacagactttaagaattggctatctgccaaattgtt

SEQ ID NO: 125737 - DNA, 75 bp, Artificial Sequence
  Synthetic
gtggctccgagatgtgtgggactgggtctgttctatcctgacagactttaaaaattggctatctgccaaattgtt

SEQ ID NO: 125738 - DNA, 75 bp, Artificial Sequence
  Synthetic
gtggctccgagatgtgtgggactgggtctgttctatcctgacagactttaataattggctatctgccaaattgtt

SEQ ID NO: 125739 - DNA, 75 bp, Artificial Sequence
  Synthetic
gtggctccgagatgtgtgggactgggtctgttctatcctgacagactttaacaattggctatctgccaaattgtt

SEQ ID NO: 125740 - DNA, 75 bp, Artificial Sequence
  Synthetic
gtggctccgagatgtgtgggactgggtctgttctatcctgacagactttaagaattggctatctgccaaattgtt

SEQ ID NO: 125741 - DNA, 75 bp, Artificial Sequence
  Synthetic
gtggctccgagatgtgtgggactgggtctgttccatcctgacagactttaaaaattggctatctgccaaattgtt

SEQ ID NO: 125742 - DNA, 75 bp, Artificial Sequence
  Synthetic
gtggctccgagatgtgtgggactgggtctgttccatcctgacagactttaataattggctatctgccaaattgtt

SEQ ID NO: 125743 - DNA, 75 bp, Artificial Sequence
  Synthetic
gtggctccgagatgtgtgggactgggtctgttccatcctgacagactttaacaattggctatctgccaaattgtt

SEQ ID NO: 125744 - DNA, 75 bp, Artificial Sequence
  Synthetic
gtggctccgagatgtgtgggactgggtctgttccatcctgacagactttaagaattggctatctgccaaattgtt

SEQ ID NO: 125745 - DNA, 75 bp, Artificial Sequence
  Synthetic
gtggctccgagatgtgtgggactgggtctgttcgatcctgacagactttaaaaattggctatctgccaaattgtt

SEQ ID NO: 125746 - DNA, 75 bp, Artificial Sequence
  Synthetic
gtggctccgagatgtgtgggactgggtctgttcgatcctgacagactttaataattggctatctgccaaattgtt

SEQ ID NO: 125747 - DNA, 75 bp, Artificial Sequence
  Synthetic
gtggctccgagatgtgtgggactgggtctgttcgatcctgacagactttaacaattggctatctgccaaattgtt

SEQ ID NO: 125748 - DNA, 75 bp, Artificial Sequence
  Synthetic
gtggctccgagatgtgtgggactgggtctgttcgatcctgacagactttaagaattggctatctgccaaattgtt

SEQ ID NO: 125749 - DNA, 75 bp, Artificial Sequence
  Synthetic
gtggctccgagatgtgtgggactgggtgtgttcaatcctgacagactttaaaaattggctatctgccaaattgtt

SEQ ID NO: 125750 - DNA, 75 bp, Artificial Sequence
  Synthetic
gtggctccgagatgtgtgggactgggtgtgttcaatcctgacagactttaataattggctatctgccaaattgtt

SEQ ID NO: 125751 - DNA, 75 bp, Artificial Sequence
  Synthetic
gtggctccgagatgtgtgggactgggtgtgttcaatcctgacagactttaacaattggctatctgccaaattgtt

SEQ ID NO: 125752 - DNA, 75 bp, Artificial Sequence
  Synthetic
gtggctccgagatgtgtgggactgggtgtgttcaatcctgacagactttaagaattggctatctgccaaattgtt

SEQ ID NO: 125753 - DNA, 75 bp, Artificial Sequence
  Synthetic
gtggctccgagatgtgtgggactgggtgtgttctatcctgacagactttaaaaattggctatctgccaaattgtt

SEQ ID NO: 125754 - DNA, 75 bp, Artificial Sequence
  Synthetic
gtggctccgagatgtgtgggactgggtgtgttctatcctgacagactttaataattggctatctgccaaattgtt

SEQ ID NO: 125755 - DNA, 75 bp, Artificial Sequence
  Synthetic
gtggctccgagatgtgtgggactgggtgtgttctatcctgacagactttaacaattggctatctgccaaattgtt

SEQ ID NO: 125756 - DNA, 75 bp, Artificial Sequence
  Synthetic
gtggctccgagatgtgtgggactgggtgtgttctatcctgacagactttaagaattggctatctgccaaattgtt

SEQ ID NO: 125757 - DNA, 75 bp, Artificial Sequence
  Synthetic
gtggctccgagatgtgtgggactgggtgtgttccatcctgacagactttaaaaattggctatctgccaaattgtt

SEQ ID NO: 125758 - DNA, 75 bp, Artificial Sequence
  Synthetic
gtggctccgagatgtgtgggactgggtgtgttccatcctgacagactttaataattggctatctgccaaattgtt

SEQ ID NO: 125759 - DNA, 75 bp, Artificial Sequence
  Synthetic
gtggctccgagatgtgtgggactgggtgtgttccatcctgacagactttaacaattggctatctgccaaattgtt

SEQ ID NO: 125760 - DNA, 75 bp, Artificial Sequence
  Synthetic
gtggctccgagatgtgtgggactgggtgtgttccatcctgacagactttaagaattggctatctgccaaattgtt

SEQ ID NO: 125761 - DNA, 75 bp, Artificial Sequence
  Synthetic
gtggctccgagatgtgtgggactgggtgtgttcgatcctgacagactttaaaaattggctatctgccaaattgtt

SEQ ID NO: 125762 - DNA, 75 bp, Artificial Sequence
  Synthetic
gtggctccgagatgtgtgggactgggtgtgttcgatcctgacagactttaataattggctatctgccaaattgtt

SEQ ID NO: 125763 - DNA, 75 bp, Artificial Sequence
  Synthetic
gtggctccgagatgtgtgggactgggtgtgttcgatcctgacagactttaacaattggctatctgccaaattgtt

SEQ ID NO: 125764 - DNA, 75 bp, Artificial Sequence
  Synthetic
gtggctccgagatgtgtgggactgggtgtgttcgatcctgacagactttaagaattggctatctgccaaattgtt

SEQ ID NO: 125765 - DNA, 75 bp, Artificial Sequence
  Synthetic
acttggcatcattaccattttcactctcactccggcctataaacaacttcttgtaaatgtgctgtggtggaacca

SEQ ID NO: 125766 - DNA, 75 bp, Artificial Sequence
  Synthetic
gcttgtgatctcacacccccacattcggctcgctctaagttcggatatggggcgaaggaggtccgggcccacgcc

SEQ ID NO: 125767 - DNA, 75 bp, Artificial Sequence
  Synthetic
ccgtgtgggaggacttgctggaagacaattctacacctattccaacaaccatcatggcaaagaatgaggtatttt

SEQ ID NO: 125768 - DNA, 75 bp, Artificial Sequence
  Synthetic
atcatggcaaagaatgaggtattttgcgtagaccctcaaaagggtggccgcaagccagcgcgactcatcgtattc

SEQ ID NO: 125769 - DNA, 75 bp, Artificial Sequence
  Synthetic
ccggcttcctcgcgtctctgttctatgtcaggtccttcaactcctcagggtgcccccagcgcttgtcggcctgtc

SEQ ID NO: 125770 - DNA, 75 bp, Artificial Sequence
  Synthetic
aacatcacaggcaacgtacgcttgggcaccatgaggttatcagggcctaagacctgcttgaacacctggcagggg

SEQ ID NO: 125771 - DNA, 75 bp, Artificial Sequence
  Synthetic
aacatcacaggcaacgtacgcttgggcaccatgaggttatctgggcctaagacctgcttgaacacctggcagggg

SEQ ID NO: 125772 - DNA, 75 bp, Artificial Sequence
  Synthetic
aacatcacaggcaacgtacgcttgggcaccatgaggttatccgggcctaagacctgcttgaacacctggcagggg

SEQ ID NO: 125773 - DNA, 75 bp, Artificial Sequence
  Synthetic
aacatcacaggcaacgtacgcttgggcaccatgaggttatcggggcctaagacctgcttgaacacctggcagggg

SEQ ID NO: 125774 - DNA, 75 bp, Artificial Sequence
  Synthetic
aacatcacaggcaacgttcgcttgggcaccatgaggttatcagggcctaagacctgcttgaacacctggcagggg

SEQ ID NO: 125775 - DNA, 75 bp, Artificial Sequence
  Synthetic
aacatcacaggcaacgttcgcttgggcaccatgaggttatctgggcctaagacctgcttgaacacctggcagggg

SEQ ID NO: 125776 - DNA, 75 bp, Artificial Sequence
  Synthetic
aacatcacaggcaacgttcgcttgggcaccatgaggttatccgggcctaagacctgcttgaacacctggcagggg

SEQ ID NO: 125777 - DNA, 75 bp, Artificial Sequence
  Synthetic
aacatcacaggcaacgttcgcttgggcaccatgaggttatcggggcctaagacctgcttgaacacctggcagggg

SEQ ID NO: 125778 - DNA, 75 bp, Artificial Sequence
  Synthetic
aacatcacaggcaacgtccgcttgggcaccatgaggttatcagggcctaagacctgcttgaacacctggcagggg

SEQ ID NO: 125779 - DNA, 75 bp, Artificial Sequence
  Synthetic
aacatcacaggcaacgtccgcttgggcaccatgaggttatctgggcctaagacctgcttgaacacctggcagggg

SEQ ID NO: 125780 - DNA, 75 bp, Artificial Sequence
  Synthetic
aacatcacaggcaacgtccgcttgggcaccatgaggttatccgggcctaagacctgcttgaacacctggcagggg

SEQ ID NO: 125781 - DNA, 75 bp, Artificial Sequence
  Synthetic
aacatcacaggcaacgtccgcttgggcaccatgaggttatcggggcctaagacctgcttgaacacctggcagggg

SEQ ID NO: 125782 - DNA, 75 bp, Artificial Sequence
  Synthetic
aacatcacaggcaacgtgcgcttgggcaccatgaggttatcagggcctaagacctgcttgaacacctggcagggg

SEQ ID NO: 125783 - DNA, 75 bp, Artificial Sequence
  Synthetic
aacatcacaggcaacgtgcgcttgggcaccatgaggttatctgggcctaagacctgcttgaacacctggcagggg

SEQ ID NO: 125784 - DNA, 75 bp, Artificial Sequence
  Synthetic
aacatcacaggcaacgtgcgcttgggcaccatgaggttatccgggcctaagacctgcttgaacacctggcagggg

SEQ ID NO: 125785 - DNA, 75 bp, Artificial Sequence
  Synthetic
aacatcacaggcaacgtgcgcttgggcaccatgaggttatcggggcctaagacctgcttgaacacctggcagggg

SEQ ID NO: 125786 - DNA, 75 bp, Artificial Sequence
  Synthetic
aacatcactggcaacgtacgcttgggcaccatgaggttatcagggcctaagacctgcttgaacacctggcagggg

SEQ ID NO: 125787 - DNA, 75 bp, Artificial Sequence
  Synthetic
aacatcactggcaacgtacgcttgggcaccatgaggttatctgggcctaagacctgcttgaacacctggcagggg

SEQ ID NO: 125788 - DNA, 75 bp, Artificial Sequence
  Synthetic
aacatcactggcaacgtacgcttgggcaccatgaggttatccgggcctaagacctgcttgaacacctggcagggg

SEQ ID NO: 125789 - DNA, 75 bp, Artificial Sequence
  Synthetic
aacatcactggcaacgtacgcttgggcaccatgaggttatcggggcctaagacctgcttgaacacctggcagggg

SEQ ID NO: 125790 - DNA, 75 bp, Artificial Sequence
  Synthetic
aacatcactggcaacgttcgcttgggcaccatgaggttatcagggcctaagacctgcttgaacacctggcagggg

SEQ ID NO: 125791 - DNA, 75 bp, Artificial Sequence
  Synthetic
aacatcactggcaacgttcgcttgggcaccatgaggttatctgggcctaagacctgcttgaacacctggcagggg

SEQ ID NO: 125792 - DNA, 75 bp, Artificial Sequence
  Synthetic
aacatcactggcaacgttcgcttgggcaccatgaggttatccgggcctaagacctgcttgaacacctggcagggg

SEQ ID NO: 125793 - DNA, 75 bp, Artificial Sequence
  Synthetic
aacatcactggcaacgttcgcttgggcaccatgaggttatcggggcctaagacctgcttgaacacctggcagggg

SEQ ID NO: 125794 - DNA, 75 bp, Artificial Sequence
  Synthetic
aacatcactggcaacgtccgcttgggcaccatgaggttatcagggcctaagacctgcttgaacacctggcagggg

SEQ ID NO: 125795 - DNA, 75 bp, Artificial Sequence
  Synthetic
aacatcactggcaacgtccgcttgggcaccatgaggttatctgggcctaagacctgcttgaacacctggcagggg

SEQ ID NO: 125796 - DNA, 75 bp, Artificial Sequence
  Synthetic
aacatcactggcaacgtccgcttgggcaccatgaggttatccgggcctaagacctgcttgaacacctggcagggg

SEQ ID NO: 125797 - DNA, 75 bp, Artificial Sequence
  Synthetic
aacatcactggcaacgtccgcttgggcaccatgaggttatcggggcctaagacctgcttgaacacctggcagggg

SEQ ID NO: 125798 - DNA, 75 bp, Artificial Sequence
  Synthetic
aacatcactggcaacgtgcgcttgggcaccatgaggttatcagggcctaagacctgcttgaacacctggcagggg

SEQ ID NO: 125799 - DNA, 75 bp, Artificial Sequence
  Synthetic
aacatcactggcaacgtgcgcttgggcaccatgaggttatctgggcctaagacctgcttgaacacctggcagggg

SEQ ID NO: 125800 - DNA, 75 bp, Artificial Sequence
  Synthetic
aacatcactggcaacgtgcgcttgggcaccatgaggttatccgggcctaagacctgcttgaacacctggcagggg

SEQ ID NO: 125801 - DNA, 75 bp, Artificial Sequence
  Synthetic
aacatcactggcaacgtgcgcttgggcaccatgaggttatcggggcctaagacctgcttgaacacctggcagggg

SEQ ID NO: 125802 - DNA, 75 bp, Artificial Sequence
  Synthetic
aacatcaccggcaacgtacgcttgggcaccatgaggttatcagggcctaagacctgcttgaacacctggcagggg

SEQ ID NO: 125803 - DNA, 75 bp, Artificial Sequence
  Synthetic
aacatcaccggcaacgtacgcttgggcaccatgaggttatctgggcctaagacctgcttgaacacctggcagggg

SEQ ID NO: 125804 - DNA, 75 bp, Artificial Sequence
  Synthetic
aacatcaccggcaacgtacgcttgggcaccatgaggttatccgggcctaagacctgcttgaacacctggcagggg

SEQ ID NO: 125805 - DNA, 75 bp, Artificial Sequence
  Synthetic
aacatcaccggcaacgtacgcttgggcaccatgaggttatcggggcctaagacctgcttgaacacctggcagggg

SEQ ID NO: 125806 - DNA, 75 bp, Artificial Sequence
  Synthetic
aacatcaccggcaacgttcgcttgggcaccatgaggttatcagggcctaagacctgcttgaacacctggcagggg

SEQ ID NO: 125807 - DNA, 75 bp, Artificial Sequence
  Synthetic
aacatcaccggcaacgttcgcttgggcaccatgaggttatctgggcctaagacctgcttgaacacctggcagggg

SEQ ID NO: 125808 - DNA, 75 bp, Artificial Sequence
  Synthetic
aacatcaccggcaacgttcgcttgggcaccatgaggttatccgggcctaagacctgcttgaacacctggcagggg

SEQ ID NO: 125809 - DNA, 75 bp, Artificial Sequence
  Synthetic
aacatcaccggcaacgttcgcttgggcaccatgaggttatcggggcctaagacctgcttgaacacctggcagggg

SEQ ID NO: 125810 - DNA, 75 bp, Artificial Sequence
  Synthetic
aacatcaccggcaacgtccgcttgggcaccatgaggttatcagggcctaagacctgcttgaacacctggcagggg

SEQ ID NO: 125811 - DNA, 75 bp, Artificial Sequence
  Synthetic
aacatcaccggcaacgtccgcttgggcaccatgaggttatctgggcctaagacctgcttgaacacctggcagggg

SEQ ID NO: 125812 - DNA, 75 bp, Artificial Sequence
  Synthetic
aacatcaccggcaacgtccgcttgggcaccatgaggttatccgggcctaagacctgcttgaacacctggcagggg

SEQ ID NO: 125813 - DNA, 75 bp, Artificial Sequence
  Synthetic
aacatcaccggcaacgtccgcttgggcaccatgaggttatcggggcctaagacctgcttgaacacctggcagggg

SEQ ID NO: 125814 - DNA, 75 bp, Artificial Sequence
  Synthetic
aacatcaccggcaacgtgcgcttgggcaccatgaggttatcagggcctaagacctgcttgaacacctggcagggg

SEQ ID NO: 125815 - DNA, 75 bp, Artificial Sequence
  Synthetic
aacatcaccggcaacgtgcgcttgggcaccatgaggttatctgggcctaagacctgcttgaacacctggcagggg

SEQ ID NO: 125816 - DNA, 75 bp, Artificial Sequence
  Synthetic
aacatcaccggcaacgtgcgcttgggcaccatgaggttatccgggcctaagacctgcttgaacacctggcagggg

SEQ ID NO: 125817 - DNA, 75 bp, Artificial Sequence
  Synthetic
aacatcaccggcaacgtgcgcttgggcaccatgaggttatcggggcctaagacctgcttgaacacctggcagggg

SEQ ID NO: 125818 - DNA, 75 bp, Artificial Sequence
  Synthetic
aacatcacgggcaacgtacgcttgggcaccatgaggttatcagggcctaagacctgcttgaacacctggcagggg

SEQ ID NO: 125819 - DNA, 75 bp, Artificial Sequence
  Synthetic
aacatcacgggcaacgtacgcttgggcaccatgaggttatctgggcctaagacctgcttgaacacctggcagggg

SEQ ID NO: 125820 - DNA, 75 bp, Artificial Sequence
  Synthetic
aacatcacgggcaacgtacgcttgggcaccatgaggttatccgggcctaagacctgcttgaacacctggcagggg

SEQ ID NO: 125821 - DNA, 75 bp, Artificial Sequence
  Synthetic
aacatcacgggcaacgtacgcttgggcaccatgaggttatcggggcctaagacctgcttgaacacctggcagggg

SEQ ID NO: 125822 - DNA, 75 bp, Artificial Sequence
  Synthetic
aacatcacgggcaacgttcgcttgggcaccatgaggttatcagggcctaagacctgcttgaacacctggcagggg

SEQ ID NO: 125823 - DNA, 75 bp, Artificial Sequence
  Synthetic
aacatcacgggcaacgttcgcttgggcaccatgaggttatctgggcctaagacctgcttgaacacctggcagggg

SEQ ID NO: 125824 - DNA, 75 bp, Artificial Sequence
  Synthetic
aacatcacgggcaacgttcgcttgggcaccatgaggttatccgggcctaagacctgcttgaacacctggcagggg

SEQ ID NO: 125825 - DNA, 75 bp, Artificial Sequence
  Synthetic
aacatcacgggcaacgttcgcttgggcaccatgaggttatcggggcctaagacctgcttgaacacctggcagggg

SEQ ID NO: 125826 - DNA, 75 bp, Artificial Sequence
  Synthetic
aacatcacgggcaacgtccgcttgggcaccatgaggttatcagggcctaagacctgcttgaacacctggcagggg

SEQ ID NO: 125827 - DNA, 75 bp, Artificial Sequence
  Synthetic
aacatcacgggcaacgtccgcttgggcaccatgaggttatctgggcctaagacctgcttgaacacctggcagggg

SEQ ID NO: 125828 - DNA, 75 bp, Artificial Sequence
  Synthetic
aacatcacgggcaacgtccgcttgggcaccatgaggttatccgggcctaagacctgcttgaacacctggcagggg

SEQ ID NO: 125829 - DNA, 75 bp, Artificial Sequence
  Synthetic
aacatcacgggcaacgtccgcttgggcaccatgaggttatcggggcctaagacctgcttgaacacctggcagggg

SEQ ID NO: 125830 - DNA, 75 bp, Artificial Sequence
  Synthetic
aacatcacgggcaacgtgcgcttgggcaccatgaggttatcagggcctaagacctgcttgaacacctggcagggg

SEQ ID NO: 125831 - DNA, 75 bp, Artificial Sequence
  Synthetic
aacatcacgggcaacgtgcgcttgggcaccatgaggttatctgggcctaagacctgcttgaacacctggcagggg

SEQ ID NO: 125832 - DNA, 75 bp, Artificial Sequence
  Synthetic
aacatcacgggcaacgtgcgcttgggcaccatgaggttatccgggcctaagacctgcttgaacacctggcagggg

SEQ ID NO: 125833 - DNA, 75 bp, Artificial Sequence
  Synthetic
aacatcacgggcaacgtgcgcttgggcaccatgaggttatcggggcctaagacctgcttgaacacctggcagggg

SEQ ID NO: 125834 - DNA, 75 bp, Artificial Sequence
  Synthetic
gcggctctcgcccacattggggccccaatgacccccggcggaggtcccgcaatttgggtaaagtcatcgataccc

SEQ ID NO: 125835 - DNA, 75 bp, Artificial Sequence
  Synthetic
gccgggggccattatgtccaaatggccctcatgaagctggccgcactgacaggtacgtacgtttatgaccatctc

SEQ ID NO: 125836 - DNA, 75 bp, Artificial Sequence
  Synthetic
cccccaaggcacgcgtggattacctcctcaaaatgtggcgctcaaagaaaacccccatggggttttcctacgaca

SEQ ID NO: 125837 - DNA, 75 bp, Artificial Sequence
  Synthetic
caaaccatgcggcatagttccagcacggactgtgtgtggcccggtgtactgtttcacccccagcccagtcgtggt

SEQ ID NO: 125838 - DNA, 75 bp, Artificial Sequence
  Synthetic
agataacacagcacggcacccacgcgtatgtgacagggttgacagcagacaacctaaaggttccatgccagctac

SEQ ID NO: 125839 - DNA, 75 bp, Artificial Sequence
  Synthetic
agataacacagcacggcacccacgcgtatgtgacagggttgacagcagacaacctaaaggttccatgccagcttc

SEQ ID NO: 125840 - DNA, 75 bp, Artificial Sequence
  Synthetic
agataacacagcacggcacccacgcgtatgtgacagggttgacagcagacaacctaaaggttccatgccagctcc

SEQ ID NO: 125841 - DNA, 75 bp, Artificial Sequence
  Synthetic
agataacacagcacggcacccacgcgtatgtgacagggttgacagcagacaacctaaaggttccatgccagctgc

SEQ ID NO: 125842 - DNA, 75 bp, Artificial Sequence
  Synthetic
agataacacagcacggcacccacgcgtatgtgacagggttgacagcagacaacctaaaggttccttgccagctac

SEQ ID NO: 125843 - DNA, 75 bp, Artificial Sequence
  Synthetic
agataacacagcacggcacccacgcgtatgtgacagggttgacagcagacaacctaaaggttccttgccagcttc

SEQ ID NO: 125844 - DNA, 75 bp, Artificial Sequence
  Synthetic
agataacacagcacggcacccacgcgtatgtgacagggttgacagcagacaacctaaaggttccttgccagctcc

SEQ ID NO: 125845 - DNA, 75 bp, Artificial Sequence
  Synthetic
agataacacagcacggcacccacgcgtatgtgacagggttgacagcagacaacctaaaggttccttgccagctgc

SEQ ID NO: 125846 - DNA, 75 bp, Artificial Sequence
  Synthetic
agataacacagcacggcacccacgcgtatgtgacagggttgacagcagacaacctaaaggttccctgccagctac

SEQ ID NO: 125847 - DNA, 75 bp, Artificial Sequence
  Synthetic
agataacacagcacggcacccacgcgtatgtgacagggttgacagcagacaacctaaaggttccctgccagcttc

SEQ ID NO: 125848 - DNA, 75 bp, Artificial Sequence
  Synthetic
agataacacagcacggcacccacgcgtatgtgacagggttgacagcagacaacctaaaggttccctgccagctcc

SEQ ID NO: 125849 - DNA, 75 bp, Artificial Sequence
  Synthetic
agataacacagcacggcacccacgcgtatgtgacagggttgacagcagacaacctaaaggttccctgccagctgc

SEQ ID NO: 125850 - DNA, 75 bp, Artificial Sequence
  Synthetic
agataacacagcacggcacccacgcgtatgtgacagggttgacagcagacaacctaaaggttccgtgccagctac

SEQ ID NO: 125851 - DNA, 75 bp, Artificial Sequence
  Synthetic
agataacacagcacggcacccacgcgtatgtgacagggttgacagcagacaacctaaaggttccgtgccagcttc

SEQ ID NO: 125852 - DNA, 75 bp, Artificial Sequence
  Synthetic
agataacacagcacggcacccacgcgtatgtgacagggttgacagcagacaacctaaaggttccgtgccagctcc

SEQ ID NO: 125853 - DNA, 75 bp, Artificial Sequence
  Synthetic
agataacacagcacggcacccacgcgtatgtgacagggttgacagcagacaacctaaaggttccgtgccagctgc

SEQ ID NO: 125854 - DNA, 75 bp, Artificial Sequence
  Synthetic
agataacacagcacggctcccacgcgtatgtgacagggttgacagcagacaacctaaaggttccatgccagctac

SEQ ID NO: 125855 - DNA, 75 bp, Artificial Sequence
  Synthetic
agataacacagcacggctcccacgcgtatgtgacagggttgacagcagacaacctaaaggttccatgccagcttc

SEQ ID NO: 125856 - DNA, 75 bp, Artificial Sequence
  Synthetic
agataacacagcacggctcccacgcgtatgtgacagggttgacagcagacaacctaaaggttccatgccagctcc

SEQ ID NO: 125857 - DNA, 75 bp, Artificial Sequence
  Synthetic
agataacacagcacggctcccacgcgtatgtgacagggttgacagcagacaacctaaaggttccatgccagctgc

SEQ ID NO: 125858 - DNA, 75 bp, Artificial Sequence
  Synthetic
agataacacagcacggctcccacgcgtatgtgacagggttgacagcagacaacctaaaggttccttgccagctac

SEQ ID NO: 125859 - DNA, 75 bp, Artificial Sequence
  Synthetic
agataacacagcacggctcccacgcgtatgtgacagggttgacagcagacaacctaaaggttccttgccagcttc

SEQ ID NO: 125860 - DNA, 75 bp, Artificial Sequence
  Synthetic
agataacacagcacggctcccacgcgtatgtgacagggttgacagcagacaacctaaaggttccttgccagctcc

SEQ ID NO: 125861 - DNA, 75 bp, Artificial Sequence
  Synthetic
agataacacagcacggctcccacgcgtatgtgacagggttgacagcagacaacctaaaggttccttgccagctgc

SEQ ID NO: 125862 - DNA, 75 bp, Artificial Sequence
  Synthetic
agataacacagcacggctcccacgcgtatgtgacagggttgacagcagacaacctaaaggttccctgccagctac

SEQ ID NO: 125863 - DNA, 75 bp, Artificial Sequence
  Synthetic
agataacacagcacggctcccacgcgtatgtgacagggttgacagcagacaacctaaaggttccctgccagcttc

SEQ ID NO: 125864 - DNA, 75 bp, Artificial Sequence
  Synthetic
agataacacagcacggctcccacgcgtatgtgacagggttgacagcagacaacctaaaggttccctgccagctcc

SEQ ID NO: 125865 - DNA, 75 bp, Artificial Sequence
  Synthetic
agataacacagcacggctcccacgcgtatgtgacagggttgacagcagacaacctaaaggttccctgccagctgc

SEQ ID NO: 125866 - DNA, 75 bp, Artificial Sequence
  Synthetic
agataacacagcacggctcccacgcgtatgtgacagggttgacagcagacaacctaaaggttccgtgccagctac

SEQ ID NO: 125867 - DNA, 75 bp, Artificial Sequence
  Synthetic
agataacacagcacggctcccacgcgtatgtgacagggttgacagcagacaacctaaaggttccgtgccagcttc

SEQ ID NO: 125868 - DNA, 75 bp, Artificial Sequence
  Synthetic
agataacacagcacggctcccacgcgtatgtgacagggttgacagcagacaacctaaaggttccgtgccagctcc

SEQ ID NO: 125869 - DNA, 75 bp, Artificial Sequence
  Synthetic
agataacacagcacggctcccacgcgtatgtgacagggttgacagcagacaacctaaaggttccgtgccagctgc

SEQ ID NO: 125870 - DNA, 75 bp, Artificial Sequence
  Synthetic
agataacacagcacggcccccacgcgtatgtgacagggttgacagcagacaacctaaaggttccatgccagctac

SEQ ID NO: 125871 - DNA, 75 bp, Artificial Sequence
  Synthetic
agataacacagcacggcccccacgcgtatgtgacagggttgacagcagacaacctaaaggttccatgccagcttc

SEQ ID NO: 125872 - DNA, 75 bp, Artificial Sequence
  Synthetic
agataacacagcacggcccccacgcgtatgtgacagggttgacagcagacaacctaaaggttccatgccagctcc

SEQ ID NO: 125873 - DNA, 75 bp, Artificial Sequence
  Synthetic
agataacacagcacggcccccacgcgtatgtgacagggttgacagcagacaacctaaaggttccatgccagctgc

SEQ ID NO: 125874 - DNA, 75 bp, Artificial Sequence
  Synthetic
agataacacagcacggcccccacgcgtatgtgacagggttgacagcagacaacctaaaggttccttgccagctac

SEQ ID NO: 125875 - DNA, 75 bp, Artificial Sequence
  Synthetic
agataacacagcacggcccccacgcgtatgtgacagggttgacagcagacaacctaaaggttccttgccagcttc

SEQ ID NO: 125876 - DNA, 75 bp, Artificial Sequence
  Synthetic
agataacacagcacggcccccacgcgtatgtgacagggttgacagcagacaacctaaaggttccttgccagctcc

SEQ ID NO: 125877 - DNA, 75 bp, Artificial Sequence
  Synthetic
agataacacagcacggcccccacgcgtatgtgacagggttgacagcagacaacctaaaggttccttgccagctgc

SEQ ID NO: 125878 - DNA, 75 bp, Artificial Sequence
  Synthetic
agataacacagcacggcccccacgcgtatgtgacagggttgacagcagacaacctaaaggttccctgccagctac

SEQ ID NO: 125879 - DNA, 75 bp, Artificial Sequence
  Synthetic
agataacacagcacggcccccacgcgtatgtgacagggttgacagcagacaacctaaaggttccctgccagcttc

SEQ ID NO: 125880 - DNA, 75 bp, Artificial Sequence
  Synthetic
agataacacagcacggcccccacgcgtatgtgacagggttgacagcagacaacctaaaggttccctgccagctcc

SEQ ID NO: 125881 - DNA, 75 bp, Artificial Sequence
  Synthetic
agataacacagcacggcccccacgcgtatgtgacagggttgacagcagacaacctaaaggttccctgccagctgc

SEQ ID NO: 125882 - DNA, 75 bp, Artificial Sequence
  Synthetic
agataacacagcacggcccccacgcgtatgtgacagggttgacagcagacaacctaaaggttccgtgccagctac

SEQ ID NO: 125883 - DNA, 75 bp, Artificial Sequence
  Synthetic
agataacacagcacggcccccacgcgtatgtgacagggttgacagcagacaacctaaaggttccgtgccagcttc

SEQ ID NO: 125884 - DNA, 75 bp, Artificial Sequence
  Synthetic
agataacacagcacggcccccacgcgtatgtgacagggttgacagcagacaacctaaaggttccgtgccagctcc

SEQ ID NO: 125885 - DNA, 75 bp, Artificial Sequence
  Synthetic
agataacacagcacggcccccacgcgtatgtgacagggttgacagcagacaacctaaaggttccgtgccagctgc

SEQ ID NO: 125886 - DNA, 75 bp, Artificial Sequence
  Synthetic
agataacacagcacggcgcccacgcgtatgtgacagggttgacagcagacaacctaaaggttccatgccagctac

SEQ ID NO: 125887 - DNA, 75 bp, Artificial Sequence
  Synthetic
agataacacagcacggcgcccacgcgtatgtgacagggttgacagcagacaacctaaaggttccatgccagcttc

SEQ ID NO: 125888 - DNA, 75 bp, Artificial Sequence
  Synthetic
agataacacagcacggcgcccacgcgtatgtgacagggttgacagcagacaacctaaaggttccatgccagctcc

SEQ ID NO: 125889 - DNA, 75 bp, Artificial Sequence
  Synthetic
agataacacagcacggcgcccacgcgtatgtgacagggttgacagcagacaacctaaaggttccatgccagctgc

SEQ ID NO: 125890 - DNA, 75 bp, Artificial Sequence
  Synthetic
agataacacagcacggcgcccacgcgtatgtgacagggttgacagcagacaacctaaaggttccttgccagctac

SEQ ID NO: 125891 - DNA, 75 bp, Artificial Sequence
  Synthetic
agataacacagcacggcgcccacgcgtatgtgacagggttgacagcagacaacctaaaggttccttgccagcttc

SEQ ID NO: 125892 - DNA, 75 bp, Artificial Sequence
  Synthetic
agataacacagcacggcgcccacgcgtatgtgacagggttgacagcagacaacctaaaggttccttgccagctcc

SEQ ID NO: 125893 - DNA, 75 bp, Artificial Sequence
  Synthetic
agataacacagcacggcgcccacgcgtatgtgacagggttgacagcagacaacctaaaggttccttgccagctgc

SEQ ID NO: 125894 - DNA, 75 bp, Artificial Sequence
  Synthetic
agataacacagcacggcgcccacgcgtatgtgacagggttgacagcagacaacctaaaggttccctgccagctac

SEQ ID NO: 125895 - DNA, 75 bp, Artificial Sequence
  Synthetic
agataacacagcacggcgcccacgcgtatgtgacagggttgacagcagacaacctaaaggttccctgccagcttc

SEQ ID NO: 125896 - DNA, 75 bp, Artificial Sequence
  Synthetic
agataacacagcacggcgcccacgcgtatgtgacagggttgacagcagacaacctaaaggttccctgccagctcc

SEQ ID NO: 125897 - DNA, 75 bp, Artificial Sequence
  Synthetic
agataacacagcacggcgcccacgcgtatgtgacagggttgacagcagacaacctaaaggttccctgccagctgc

SEQ ID NO: 125898 - DNA, 75 bp, Artificial Sequence
  Synthetic
agataacacagcacggcgcccacgcgtatgtgacagggttgacagcagacaacctaaaggttccgtgccagctac

SEQ ID NO: 125899 - DNA, 75 bp, Artificial Sequence
  Synthetic
agataacacagcacggcgcccacgcgtatgtgacagggttgacagcagacaacctaaaggttccgtgccagcttc

SEQ ID NO: 125900 - DNA, 75 bp, Artificial Sequence
  Synthetic
agataacacagcacggcgcccacgcgtatgtgacagggttgacagcagacaacctaaaggttccgtgccagctcc

SEQ ID NO: 125901 - DNA, 75 bp, Artificial Sequence
  Synthetic
agataacacagcacggcgcccacgcgtatgtgacagggttgacagcagacaacctaaaggttccgtgccagctgc

SEQ ID NO: 125902 - DNA, 75 bp, Artificial Sequence
  Synthetic
cactaatgattgctcgaacaacagcatcacctggcagctcactgacgcagttctccaccttcccggatgtgtccc

SEQ ID NO: 125903 - DNA, 75 bp, Artificial Sequence
  Synthetic
acccccatggggttttcctacgacaccagatgctttgactcaacagtcacggagcgcgacatcaggactgagcat

SEQ ID NO: 125904 - DNA, 75 bp, Artificial Sequence
  Synthetic
tttatgaggcggatgatatcattctacaccttcctgggtgtgttccatgcgtcaccgctggaaatacatcacagt

SEQ ID NO: 125905 - DNA, 75 bp, Artificial Sequence
  Synthetic
tttgggtgcacgtggatgaacagctccgggttcaccaagacctgcggtgcgccgccttgccgcatcagggacgat

SEQ ID NO: 125906 - DNA, 75 bp, Artificial Sequence
  Synthetic
cagctcccttgcgagcctgagccggacacggaggtgttggcatccatgctgacggacccgtcccacatcacagcc

SEQ ID NO: 125907 - DNA, 75 bp, Artificial Sequence
  Synthetic
gtcagaagtgcggttaccgccggtgtcgagctagtggggttctcactaccagcttgggcaacactctcacctgct

SEQ ID NO: 125908 - DNA, 75 bp, Artificial Sequence
  Synthetic
gacggacccgtcccacatcacagccgaggcggcggcgagacgcctggccaggggatcacccccctctgaggctag

SEQ ID NO: 125909 - DNA, 75 bp, Artificial Sequence
  Synthetic
gacggacccgtcccacatcacagccgaggcggcggcgagacgcctggccaggggttcacccccctctgaggctag

SEQ ID NO: 125910 - DNA, 75 bp, Artificial Sequence
  Synthetic
gacggacccgtcccacatcacagccgaggcggcggcgagacgcctggccaggggctcacccccctctgaggctag

SEQ ID NO: 125911 - DNA, 75 bp, Artificial Sequence
  Synthetic
gacggacccgtcccacatcacagccgaggcggcggcgagacgcctggccagggggtcacccccctctgaggctag

SEQ ID NO: 125912 - DNA, 75 bp, Artificial Sequence
  Synthetic
gacggacccgtcccacatcacagccgaggcggcggcgagacgcctggcctggggatcacccccctctgaggctag

SEQ ID NO: 125913 - DNA, 75 bp, Artificial Sequence
  Synthetic
gacggacccgtcccacatcacagccgaggcggcggcgagacgcctggcctggggttcacccccctctgaggctag

SEQ ID NO: 125914 - DNA, 75 bp, Artificial Sequence
  Synthetic
gacggacccgtcccacatcacagccgaggcggcggcgagacgcctggcctggggctcacccccctctgaggctag

SEQ ID NO: 125915 - DNA, 75 bp, Artificial Sequence
  Synthetic
gacggacccgtcccacatcacagccgaggcggcggcgagacgcctggcctgggggtcacccccctctgaggctag

SEQ ID NO: 125916 - DNA, 75 bp, Artificial Sequence
  Synthetic
gacggacccgtcccacatcacagccgaggcggcggcgagacgcctggcccggggatcacccccctctgaggctag

SEQ ID NO: 125917 - DNA, 75 bp, Artificial Sequence
  Synthetic
gacggacccgtcccacatcacagccgaggcggcggcgagacgcctggcccggggttcacccccctctgaggctag

SEQ ID NO: 125918 - DNA, 75 bp, Artificial Sequence
  Synthetic
gacggacccgtcccacatcacagccgaggcggcggcgagacgcctggcccggggctcacccccctctgaggctag

SEQ ID NO: 125919 - DNA, 75 bp, Artificial Sequence
  Synthetic
gacggacccgtcccacatcacagccgaggcggcggcgagacgcctggcccgggggtcacccccctctgaggctag

SEQ ID NO: 125920 - DNA, 75 bp, Artificial Sequence
  Synthetic
gacggacccgtcccacatcacagccgaggcggcggcgagacgcctggccgggggatcacccccctctgaggctag

SEQ ID NO: 125921 - DNA, 75 bp, Artificial Sequence
  Synthetic
gacggacccgtcccacatcacagccgaggcggcggcgagacgcctggccgggggttcacccccctctgaggctag

SEQ ID NO: 125922 - DNA, 75 bp, Artificial Sequence
  Synthetic
gacggacccgtcccacatcacagccgaggcggcggcgagacgcctggccgggggctcacccccctctgaggctag

SEQ ID NO: 125923 - DNA, 75 bp, Artificial Sequence
  Synthetic
gacggacccgtcccacatcacagccgaggcggcggcgagacgcctggccggggggtcacccccctctgaggctag

SEQ ID NO: 125924 - DNA, 75 bp, Artificial Sequence
  Synthetic
ggtgtctggtcgactacccctatagactgtggcattatccgtgcacggtcaactataccatcttcaaaatacggt

SEQ ID NO: 125925 - DNA, 75 bp, Artificial Sequence
  Synthetic
tgccgaggacgccgccaacctgagagccttcacggaggccatgaccaggtattcggcacctcccggcgatgatcc

SEQ ID NO: 125926 - DNA, 75 bp, Artificial Sequence
  Synthetic
ggaggagatgtgactcgcatagagtcccagtctaaggtgctcgtcctcgactccatcgatcccgtggtcgatgag

SEQ ID NO: 125927 - DNA, 75 bp, Artificial Sequence
  Synthetic
ggaggagatgtgactcgcatagagtcccagtctaaggtgctcgtcctcgactccttcgatcccgtggtcgatgag

SEQ ID NO: 125928 - DNA, 75 bp, Artificial Sequence
  Synthetic
ggaggagatgtgactcgcatagagtcccagtctaaggtgctcgtcctcgactccctcgatcccgtggtcgatgag

SEQ ID NO: 125929 - DNA, 75 bp, Artificial Sequence
  Synthetic
ggaggagatgtgactcgcatagagtcccagtctaaggtgctcgtcctcgactccgtcgatcccgtggtcgatgag

SEQ ID NO: 125930 - DNA, 75 bp, Artificial Sequence
  Synthetic
ggaggtgatgtgactcgcatagagtcccagtctaaggtgctcgtcctcgactccatcgatcccgtggtcgatgag

SEQ ID NO: 125931 - DNA, 75 bp, Artificial Sequence
  Synthetic
ggaggtgatgtgactcgcatagagtcccagtctaaggtgctcgtcctcgactccttcgatcccgtggtcgatgag

SEQ ID NO: 125932 - DNA, 75 bp, Artificial Sequence
  Synthetic
ggaggtgatgtgactcgcatagagtcccagtctaaggtgctcgtcctcgactccctcgatcccgtggtcgatgag

SEQ ID NO: 125933 - DNA, 75 bp, Artificial Sequence
  Synthetic
ggaggtgatgtgactcgcatagagtcccagtctaaggtgctcgtcctcgactccgtcgatcccgtggtcgatgag

SEQ ID NO: 125934 - DNA, 75 bp, Artificial Sequence
  Synthetic
ggaggcgatgtgactcgcatagagtcccagtctaaggtgctcgtcctcgactccatcgatcccgtggtcgatgag

SEQ ID NO: 125935 - DNA, 75 bp, Artificial Sequence
  Synthetic
ggaggcgatgtgactcgcatagagtcccagtctaaggtgctcgtcctcgactccttcgatcccgtggtcgatgag

SEQ ID NO: 125936 - DNA, 75 bp, Artificial Sequence
  Synthetic
ggaggcgatgtgactcgcatagagtcccagtctaaggtgctcgtcctcgactccctcgatcccgtggtcgatgag

SEQ ID NO: 125937 - DNA, 75 bp, Artificial Sequence
  Synthetic
ggaggcgatgtgactcgcatagagtcccagtctaaggtgctcgtcctcgactccgtcgatcccgtggtcgatgag

SEQ ID NO: 125938 - DNA, 75 bp, Artificial Sequence
  Synthetic
ggaggggatgtgactcgcatagagtcccagtctaaggtgctcgtcctcgactccatcgatcccgtggtcgatgag

SEQ ID NO: 125939 - DNA, 75 bp, Artificial Sequence
  Synthetic
ggaggggatgtgactcgcatagagtcccagtctaaggtgctcgtcctcgactccttcgatcccgtggtcgatgag

SEQ ID NO: 125940 - DNA, 75 bp, Artificial Sequence
  Synthetic
ggaggggatgtgactcgcatagagtcccagtctaaggtgctcgtcctcgactccctcgatcccgtggtcgatgag

SEQ ID NO: 125941 - DNA, 75 bp, Artificial Sequence
  Synthetic
ggaggggatgtgactcgcatagagtcccagtctaaggtgctcgtcctcgactccgtcgatcccgtggtcgatgag

SEQ ID NO: 125942 - DNA, 75 bp, Artificial Sequence
  Synthetic
ggtggagatgtgactcgcatagagtcccagtctaaggtgctcgtcctcgactccatcgatcccgtggtcgatgag

SEQ ID NO: 125943 - DNA, 75 bp, Artificial Sequence
  Synthetic
ggtggagatgtgactcgcatagagtcccagtctaaggtgctcgtcctcgactccttcgatcccgtggtcgatgag

SEQ ID NO: 125944 - DNA, 75 bp, Artificial Sequence
  Synthetic
ggtggagatgtgactcgcatagagtcccagtctaaggtgctcgtcctcgactccctcgatcccgtggtcgatgag

SEQ ID NO: 125945 - DNA, 75 bp, Artificial Sequence
  Synthetic
ggtggagatgtgactcgcatagagtcccagtctaaggtgctcgtcctcgactccgtcgatcccgtggtcgatgag

SEQ ID NO: 125946 - DNA, 75 bp, Artificial Sequence
  Synthetic
ggtggtgatgtgactcgcatagagtcccagtctaaggtgctcgtcctcgactccatcgatcccgtggtcgatgag

SEQ ID NO: 125947 - DNA, 75 bp, Artificial Sequence
  Synthetic
ggtggtgatgtgactcgcatagagtcccagtctaaggtgctcgtcctcgactccttcgatcccgtggtcgatgag

SEQ ID NO: 125948 - DNA, 75 bp, Artificial Sequence
  Synthetic
ggtggtgatgtgactcgcatagagtcccagtctaaggtgctcgtcctcgactccctcgatcccgtggtcgatgag

SEQ ID NO: 125949 - DNA, 75 bp, Artificial Sequence
  Synthetic
ggtggtgatgtgactcgcatagagtcccagtctaaggtgctcgtcctcgactccgtcgatcccgtggtcgatgag

SEQ ID NO: 125950 - DNA, 75 bp, Artificial Sequence
  Synthetic
ggtggcgatgtgactcgcatagagtcccagtctaaggtgctcgtcctcgactccatcgatcccgtggtcgatgag

SEQ ID NO: 125951 - DNA, 75 bp, Artificial Sequence
  Synthetic
ggtggcgatgtgactcgcatagagtcccagtctaaggtgctcgtcctcgactccttcgatcccgtggtcgatgag

SEQ ID NO: 125952 - DNA, 75 bp, Artificial Sequence
  Synthetic
ggtggcgatgtgactcgcatagagtcccagtctaaggtgctcgtcctcgactccctcgatcccgtggtcgatgag

SEQ ID NO: 125953 - DNA, 75 bp, Artificial Sequence
  Synthetic
ggtggcgatgtgactcgcatagagtcccagtctaaggtgctcgtcctcgactccgtcgatcccgtggtcgatgag

SEQ ID NO: 125954 - DNA, 75 bp, Artificial Sequence
  Synthetic
ggtggggatgtgactcgcatagagtcccagtctaaggtgctcgtcctcgactccatcgatcccgtggtcgatgag

SEQ ID NO: 125955 - DNA, 75 bp, Artificial Sequence
  Synthetic
ggtggggatgtgactcgcatagagtcccagtctaaggtgctcgtcctcgactccttcgatcccgtggtcgatgag

SEQ ID NO: 125956 - DNA, 75 bp, Artificial Sequence
  Synthetic
ggtggggatgtgactcgcatagagtcccagtctaaggtgctcgtcctcgactccctcgatcccgtggtcgatgag

SEQ ID NO: 125957 - DNA, 75 bp, Artificial Sequence
  Synthetic
ggtggggatgtgactcgcatagagtcccagtctaaggtgctcgtcctcgactccgtcgatcccgtggtcgatgag

SEQ ID NO: 125958 - DNA, 75 bp, Artificial Sequence
  Synthetic
ggcggagatgtgactcgcatagagtcccagtctaaggtgctcgtcctcgactccatcgatcccgtggtcgatgag

SEQ ID NO: 125959 - DNA, 75 bp, Artificial Sequence
  Synthetic
ggcggagatgtgactcgcatagagtcccagtctaaggtgctcgtcctcgactccttcgatcccgtggtcgatgag

SEQ ID NO: 125960 - DNA, 75 bp, Artificial Sequence
  Synthetic
ggcggagatgtgactcgcatagagtcccagtctaaggtgctcgtcctcgactccctcgatcccgtggtcgatgag

SEQ ID NO: 125961 - DNA, 75 bp, Artificial Sequence
  Synthetic
ggcggagatgtgactcgcatagagtcccagtctaaggtgctcgtcctcgactccgtcgatcccgtggtcgatgag

SEQ ID NO: 125962 - DNA, 75 bp, Artificial Sequence
  Synthetic
ggcggtgatgtgactcgcatagagtcccagtctaaggtgctcgtcctcgactccatcgatcccgtggtcgatgag

SEQ ID NO: 125963 - DNA, 75 bp, Artificial Sequence
  Synthetic
ggcggtgatgtgactcgcatagagtcccagtctaaggtgctcgtcctcgactccttcgatcccgtggtcgatgag

SEQ ID NO: 125964 - DNA, 75 bp, Artificial Sequence
  Synthetic
ggcggtgatgtgactcgcatagagtcccagtctaaggtgctcgtcctcgactccctcgatcccgtggtcgatgag

SEQ ID NO: 125965 - DNA, 75 bp, Artificial Sequence
  Synthetic
ggcggtgatgtgactcgcatagagtcccagtctaaggtgctcgtcctcgactccgtcgatcccgtggtcgatgag

SEQ ID NO: 125966 - DNA, 75 bp, Artificial Sequence
  Synthetic
ggcggcgatgtgactcgcatagagtcccagtctaaggtgctcgtcctcgactccatcgatcccgtggtcgatgag

SEQ ID NO: 125967 - DNA, 75 bp, Artificial Sequence
  Synthetic
ggcggcgatgtgactcgcatagagtcccagtctaaggtgctcgtcctcgactccttcgatcccgtggtcgatgag

SEQ ID NO: 125968 - DNA, 75 bp, Artificial Sequence
  Synthetic
ggcggcgatgtgactcgcatagagtcccagtctaaggtgctcgtcctcgactccctcgatcccgtggtcgatgag

SEQ ID NO: 125969 - DNA, 75 bp, Artificial Sequence
  Synthetic
ggcggcgatgtgactcgcatagagtcccagtctaaggtgctcgtcctcgactccgtcgatcccgtggtcgatgag

SEQ ID NO: 125970 - DNA, 75 bp, Artificial Sequence
  Synthetic
ggcggggatgtgactcgcatagagtcccagtctaaggtgctcgtcctcgactccatcgatcccgtggtcgatgag

SEQ ID NO: 125971 - DNA, 75 bp, Artificial Sequence
  Synthetic
ggcggggatgtgactcgcatagagtcccagtctaaggtgctcgtcctcgactccttcgatcccgtggtcgatgag

SEQ ID NO: 125972 - DNA, 75 bp, Artificial Sequence
  Synthetic
ggcggggatgtgactcgcatagagtcccagtctaaggtgctcgtcctcgactccctcgatcccgtggtcgatgag

SEQ ID NO: 125973 - DNA, 75 bp, Artificial Sequence
  Synthetic
ggcggggatgtgactcgcatagagtcccagtctaaggtgctcgtcctcgactccgtcgatcccgtggtcgatgag

SEQ ID NO: 125974 - DNA, 75 bp, Artificial Sequence
  Synthetic
gggggagatgtgactcgcatagagtcccagtctaaggtgctcgtcctcgactccatcgatcccgtggtcgatgag

SEQ ID NO: 125975 - DNA, 75 bp, Artificial Sequence
  Synthetic
gggggagatgtgactcgcatagagtcccagtctaaggtgctcgtcctcgactccttcgatcccgtggtcgatgag

SEQ ID NO: 125976 - DNA, 75 bp, Artificial Sequence
  Synthetic
gggggagatgtgactcgcatagagtcccagtctaaggtgctcgtcctcgactccctcgatcccgtggtcgatgag

SEQ ID NO: 125977 - DNA, 75 bp, Artificial Sequence
  Synthetic
gggggagatgtgactcgcatagagtcccagtctaaggtgctcgtcctcgactccgtcgatcccgtggtcgatgag

SEQ ID NO: 125978 - DNA, 75 bp, Artificial Sequence
  Synthetic
gggggtgatgtgactcgcatagagtcccagtctaaggtgctcgtcctcgactccatcgatcccgtggtcgatgag

SEQ ID NO: 125979 - DNA, 75 bp, Artificial Sequence
  Synthetic
gggggtgatgtgactcgcatagagtcccagtctaaggtgctcgtcctcgactccttcgatcccgtggtcgatgag

SEQ ID NO: 125980 - DNA, 75 bp, Artificial Sequence
  Synthetic
gggggtgatgtgactcgcatagagtcccagtctaaggtgctcgtcctcgactccctcgatcccgtggtcgatgag

SEQ ID NO: 125981 - DNA, 75 bp, Artificial Sequence
  Synthetic
gggggtgatgtgactcgcatagagtcccagtctaaggtgctcgtcctcgactccgtcgatcccgtggtcgatgag

SEQ ID NO: 125982 - DNA, 75 bp, Artificial Sequence
  Synthetic
gggggcgatgtgactcgcatagagtcccagtctaaggtgctcgtcctcgactccatcgatcccgtggtcgatgag

SEQ ID NO: 125983 - DNA, 75 bp, Artificial Sequence
  Synthetic
gggggcgatgtgactcgcatagagtcccagtctaaggtgctcgtcctcgactccttcgatcccgtggtcgatgag

SEQ ID NO: 125984 - DNA, 75 bp, Artificial Sequence
  Synthetic
gggggcgatgtgactcgcatagagtcccagtctaaggtgctcgtcctcgactccctcgatcccgtggtcgatgag

SEQ ID NO: 125985 - DNA, 75 bp, Artificial Sequence
  Synthetic
gggggcgatgtgactcgcatagagtcccagtctaaggtgctcgtcctcgactccgtcgatcccgtggtcgatgag

SEQ ID NO: 125986 - DNA, 75 bp, Artificial Sequence
  Synthetic
gggggggatgtgactcgcatagagtcccagtctaaggtgctcgtcctcgactccatcgatcccgtggtcgatgag

SEQ ID NO: 125987 - DNA, 75 bp, Artificial Sequence
  Synthetic
gggggggatgtgactcgcatagagtcccagtctaaggtgctcgtcctcgactccttcgatcccgtggtcgatgag

SEQ ID NO: 125988 - DNA, 75 bp, Artificial Sequence
  Synthetic
gggggggatgtgactcgcatagagtcccagtctaaggtgctcgtcctcgactccctcgatcccgtggtcgatgag

SEQ ID NO: 125989 - DNA, 75 bp, Artificial Sequence
  Synthetic
gggggggatgtgactcgcatagagtcccagtctaaggtgctcgtcctcgactccgtcgatcccgtggtcgatgag

SEQ ID NO: 125990 - DNA, 75 bp, Artificial Sequence
  Synthetic
ttcgccatgcagggagcatgggccaaggtctttgccatcctcctccttgtcgcaggagtagacgcatcaacccac

SEQ ID NO: 125991 - DNA, 75 bp, Artificial Sequence
  Synthetic
catcaacgcccgcacgggggtttcgcggtcacgtagacctcctagtaggcacagctgcgttctgctcagccatgt

SEQ ID NO: 125992 - DNA, 75 bp, Artificial Sequence
  Synthetic
catcaacgcccgcacgggggtttcgcggtcacgtagacctcctagtaggcacagctgcgttctgctctgccatgt

SEQ ID NO: 125993 - DNA, 75 bp, Artificial Sequence
  Synthetic
catcaacgcccgcacgggggtttcgcggtcacgtagacctcctagtaggcacagctgcgttctgctccgccatgt

SEQ ID NO: 125994 - DNA, 75 bp, Artificial Sequence
  Synthetic
catcaacgcccgcacgggggtttcgcggtcacgtagacctcctagtaggcacagctgcgttctgctcggccatgt

SEQ ID NO: 125995 - DNA, 75 bp, Artificial Sequence
  Synthetic
gccttcacggaggccatgaccaggtattcggcacctcccggcgatgatccacgcccggagtacgaacttgagctg

SEQ ID NO: 125996 - DNA, 75 bp, Artificial Sequence
  Synthetic
gccttcacggaggccatgaccaggtattcggcacctcccggcgatgatccacgcccggagtacgatcttgagctg

SEQ ID NO: 125997 - DNA, 75 bp, Artificial Sequence
  Synthetic
gccttcacggaggccatgaccaggtattcggcacctcccggcgatgatccacgcccggagtacgaccttgagctg

SEQ ID NO: 125998 - DNA, 75 bp, Artificial Sequence
  Synthetic
gccttcacggaggccatgaccaggtattcggcacctcccggcgatgatccacgcccggagtacgagcttgagctg

SEQ ID NO: 125999 - DNA, 75 bp, Artificial Sequence
  Synthetic
ggcactaccccccaaaaccttgcggtattgtgcccgcgaagagtgtgtgtggtccggtatattgcttcactccca

SEQ ID NO: 126000 - DNA, 75 bp, Artificial Sequence
  Synthetic
ttaacaccaaaggcagttggcacattaataggactgcccttaactgcaatgattccctgcaaacgggtttcatag

SEQ ID NO: 126001 - DNA, 75 bp, Artificial Sequence
  Synthetic
ttaacaccaatggcagttggcacattaataggactgcccttaactgcaatgattccctgcaaacgggtttcatag

SEQ ID NO: 126002 - DNA, 75 bp, Artificial Sequence
  Synthetic
ttaacaccaacggcagttggcacattaataggactgcccttaactgcaatgattccctgcaaacgggtttcatag

SEQ ID NO: 126003 - DNA, 75 bp, Artificial Sequence
  Synthetic
ttaacaccaagggcagttggcacattaataggactgcccttaactgcaatgattccctgcaaacgggtttcatag

SEQ ID NO: 126004 - DNA, 75 bp, Artificial Sequence
  Synthetic
ttatcaccaaaggcagttggcacattaataggactgcccttaactgcaatgattccctgcaaacgggtttcatag

SEQ ID NO: 126005 - DNA, 75 bp, Artificial Sequence
  Synthetic
ttatcaccaatggcagttggcacattaataggactgcccttaactgcaatgattccctgcaaacgggtttcatag

SEQ ID NO: 126006 - DNA, 75 bp, Artificial Sequence
  Synthetic
ttatcaccaacggcagttggcacattaataggactgcccttaactgcaatgattccctgcaaacgggtttcatag

SEQ ID NO: 126007 - DNA, 75 bp, Artificial Sequence
  Synthetic
ttatcaccaagggcagttggcacattaataggactgcccttaactgcaatgattccctgcaaacgggtttcatag

SEQ ID NO: 126008 - DNA, 75 bp, Artificial Sequence
  Synthetic
ttaccaccaaaggcagttggcacattaataggactgcccttaactgcaatgattccctgcaaacgggtttcatag

SEQ ID NO: 126009 - DNA, 75 bp, Artificial Sequence
  Synthetic
ttaccaccaatggcagttggcacattaataggactgcccttaactgcaatgattccctgcaaacgggtttcatag

SEQ ID NO: 126010 - DNA, 75 bp, Artificial Sequence
  Synthetic
ttaccaccaacggcagttggcacattaataggactgcccttaactgcaatgattccctgcaaacgggtttcatag

SEQ ID NO: 126011 - DNA, 75 bp, Artificial Sequence
  Synthetic
ttaccaccaagggcagttggcacattaataggactgcccttaactgcaatgattccctgcaaacgggtttcatag

SEQ ID NO: 126012 - DNA, 75 bp, Artificial Sequence
  Synthetic
ttagcaccaaaggcagttggcacattaataggactgcccttaactgcaatgattccctgcaaacgggtttcatag

SEQ ID NO: 126013 - DNA, 75 bp, Artificial Sequence
  Synthetic
ttagcaccaatggcagttggcacattaataggactgcccttaactgcaatgattccctgcaaacgggtttcatag

SEQ ID NO: 126014 - DNA, 75 bp, Artificial Sequence
  Synthetic
ttagcaccaacggcagttggcacattaataggactgcccttaactgcaatgattccctgcaaacgggtttcatag

SEQ ID NO: 126015 - DNA, 75 bp, Artificial Sequence
  Synthetic
ttagcaccaagggcagttggcacattaataggactgcccttaactgcaatgattccctgcaaacgggtttcatag

SEQ ID NO: 126016 - DNA, 75 bp, Artificial Sequence
  Synthetic
cttgggaaacagctcgccacactccagtgaaatcatggctgggtaacatcatcatgtacgcgcccactatatggg

SEQ ID NO: 126017 - DNA, 75 bp, Artificial Sequence
  Synthetic
cttgggaaacagctcgccacactccagtgaattcatggctgggtaacatcatcatgtacgcgcccactatatggg

SEQ ID NO: 126018 - DNA, 75 bp, Artificial Sequence
  Synthetic
cttgggaaacagctcgccacactccagtgaactcatggctgggtaacatcatcatgtacgcgcccactatatggg

SEQ ID NO: 126019 - DNA, 75 bp, Artificial Sequence
  Synthetic
cttgggaaacagctcgccacactccagtgaagtcatggctgggtaacatcatcatgtacgcgcccactatatggg

SEQ ID NO: 126020 - DNA, 75 bp, Artificial Sequence
  Synthetic
gttgctgcactccaccactgaattcgccatcttgccctgtacgttctcagacctaccagccctgtcaaccggcct

SEQ ID NO: 126021 - DNA, 75 bp, Artificial Sequence
  Synthetic
cactcctggagacttggaaaaaaccagattaccaaccaccagtggtcgccgggtgagcgctccccccttctggta

SEQ ID NO: 126022 - DNA, 75 bp, Artificial Sequence
  Synthetic
cactcctggagacttggaaaaaaccagattaccaaccaccagtggtcgccgggtgtgcgctccccccttctggta

SEQ ID NO: 126023 - DNA, 75 bp, Artificial Sequence
  Synthetic
cactcctggagacttggaaaaaaccagattaccaaccaccagtggtcgccgggtgcgcgctccccccttctggta

SEQ ID NO: 126024 - DNA, 75 bp, Artificial Sequence
  Synthetic
cactcctggagacttggaaaaaaccagattaccaaccaccagtggtcgccgggtgggcgctccccccttctggta

SEQ ID NO: 126025 - DNA, 75 bp, Artificial Sequence
  Synthetic
cactcctggagacttggaaaataccagattaccaaccaccagtggtcgccgggtgagcgctccccccttctggta

SEQ ID NO: 126026 - DNA, 75 bp, Artificial Sequence
  Synthetic
cactcctggagacttggaaaataccagattaccaaccaccagtggtcgccgggtgtgcgctccccccttctggta

SEQ ID NO: 126027 - DNA, 75 bp, Artificial Sequence
  Synthetic
cactcctggagacttggaaaataccagattaccaaccaccagtggtcgccgggtgcgcgctccccccttctggta

SEQ ID NO: 126028 - DNA, 75 bp, Artificial Sequence
  Synthetic
cactcctggagacttggaaaataccagattaccaaccaccagtggtcgccgggtgggcgctccccccttctggta

SEQ ID NO: 126029 - DNA, 75 bp, Artificial Sequence
  Synthetic
cactcctggagacttggaaaacaccagattaccaaccaccagtggtcgccgggtgagcgctccccccttctggta

SEQ ID NO: 126030 - DNA, 75 bp, Artificial Sequence
  Synthetic
cactcctggagacttggaaaacaccagattaccaaccaccagtggtcgccgggtgtgcgctccccccttctggta

SEQ ID NO: 126031 - DNA, 75 bp, Artificial Sequence
  Synthetic
cactcctggagacttggaaaacaccagattaccaaccaccagtggtcgccgggtgcgcgctccccccttctggta

SEQ ID NO: 126032 - DNA, 75 bp, Artificial Sequence
  Synthetic
cactcctggagacttggaaaacaccagattaccaaccaccagtggtcgccgggtgggcgctccccccttctggta

SEQ ID NO: 126033 - DNA, 75 bp, Artificial Sequence
  Synthetic
cactcctggagacttggaaaagaccagattaccaaccaccagtggtcgccgggtgagcgctccccccttctggta

SEQ ID NO: 126034 - DNA, 75 bp, Artificial Sequence
  Synthetic
cactcctggagacttggaaaagaccagattaccaaccaccagtggtcgccgggtgtgcgctccccccttctggta

SEQ ID NO: 126035 - DNA, 75 bp, Artificial Sequence
  Synthetic
cactcctggagacttggaaaagaccagattaccaaccaccagtggtcgccgggtgcgcgctccccccttctggta

SEQ ID NO: 126036 - DNA, 75 bp, Artificial Sequence
  Synthetic
cactcctggagacttggaaaagaccagattaccaaccaccagtggtcgccgggtgggcgctccccccttctggta

SEQ ID NO: 126037 - DNA, 75 bp, Artificial Sequence
  Synthetic
ctctcctggagacttggaaaaaaccagattaccaaccaccagtggtcgccgggtgagcgctccccccttctggta

SEQ ID NO: 126038 - DNA, 75 bp, Artificial Sequence
  Synthetic
ctctcctggagacttggaaaaaaccagattaccaaccaccagtggtcgccgggtgtgcgctccccccttctggta

SEQ ID NO: 126039 - DNA, 75 bp, Artificial Sequence
  Synthetic
ctctcctggagacttggaaaaaaccagattaccaaccaccagtggtcgccgggtgcgcgctccccccttctggta

SEQ ID NO: 126040 - DNA, 75 bp, Artificial Sequence
  Synthetic
ctctcctggagacttggaaaaaaccagattaccaaccaccagtggtcgccgggtgggcgctccccccttctggta

SEQ ID NO: 126041 - DNA, 75 bp, Artificial Sequence
  Synthetic
ctctcctggagacttggaaaataccagattaccaaccaccagtggtcgccgggtgagcgctccccccttctggta

SEQ ID NO: 126042 - DNA, 75 bp, Artificial Sequence
  Synthetic
ctctcctggagacttggaaaataccagattaccaaccaccagtggtcgccgggtgtgcgctccccccttctggta

SEQ ID NO: 126043 - DNA, 75 bp, Artificial Sequence
  Synthetic
ctctcctggagacttggaaaataccagattaccaaccaccagtggtcgccgggtgcgcgctccccccttctggta

SEQ ID NO: 126044 - DNA, 75 bp, Artificial Sequence
  Synthetic
ctctcctggagacttggaaaataccagattaccaaccaccagtggtcgccgggtgggcgctccccccttctggta

SEQ ID NO: 126045 - DNA, 75 bp, Artificial Sequence
  Synthetic
ctctcctggagacttggaaaacaccagattaccaaccaccagtggtcgccgggtgagcgctccccccttctggta

SEQ ID NO: 126046 - DNA, 75 bp, Artificial Sequence
  Synthetic
ctctcctggagacttggaaaacaccagattaccaaccaccagtggtcgccgggtgtgcgctccccccttctggta

SEQ ID NO: 126047 - DNA, 75 bp, Artificial Sequence
  Synthetic
ctctcctggagacttggaaaacaccagattaccaaccaccagtggtcgccgggtgcgcgctccccccttctggta

SEQ ID NO: 126048 - DNA, 75 bp, Artificial Sequence
  Synthetic
ctctcctggagacttggaaaacaccagattaccaaccaccagtggtcgccgggtgggcgctccccccttctggta

SEQ ID NO: 126049 - DNA, 75 bp, Artificial Sequence
  Synthetic
ctctcctggagacttggaaaagaccagattaccaaccaccagtggtcgccgggtgagcgctccccccttctggta

SEQ ID NO: 126050 - DNA, 75 bp, Artificial Sequence
  Synthetic
ctctcctggagacttggaaaagaccagattaccaaccaccagtggtcgccgggtgtgcgctccccccttctggta

SEQ ID NO: 126051 - DNA, 75 bp, Artificial Sequence
  Synthetic
ctctcctggagacttggaaaagaccagattaccaaccaccagtggtcgccgggtgcgcgctccccccttctggta

SEQ ID NO: 126052 - DNA, 75 bp, Artificial Sequence
  Synthetic
ctctcctggagacttggaaaagaccagattaccaaccaccagtggtcgccgggtgggcgctccccccttctggta

SEQ ID NO: 126053 - DNA, 75 bp, Artificial Sequence
  Synthetic
ccctcctggagacttggaaaaaaccagattaccaaccaccagtggtcgccgggtgagcgctccccccttctggta

SEQ ID NO: 126054 - DNA, 75 bp, Artificial Sequence
  Synthetic
ccctcctggagacttggaaaaaaccagattaccaaccaccagtggtcgccgggtgtgcgctccccccttctggta

SEQ ID NO: 126055 - DNA, 75 bp, Artificial Sequence
  Synthetic
ccctcctggagacttggaaaaaaccagattaccaaccaccagtggtcgccgggtgcgcgctccccccttctggta

SEQ ID NO: 126056 - DNA, 75 bp, Artificial Sequence
  Synthetic
ccctcctggagacttggaaaaaaccagattaccaaccaccagtggtcgccgggtgggcgctccccccttctggta

SEQ ID NO: 126057 - DNA, 75 bp, Artificial Sequence
  Synthetic
ccctcctggagacttggaaaataccagattaccaaccaccagtggtcgccgggtgagcgctccccccttctggta

SEQ ID NO: 126058 - DNA, 75 bp, Artificial Sequence
  Synthetic
ccctcctggagacttggaaaataccagattaccaaccaccagtggtcgccgggtgtgcgctccccccttctggta

SEQ ID NO: 126059 - DNA, 75 bp, Artificial Sequence
  Synthetic
ccctcctggagacttggaaaataccagattaccaaccaccagtggtcgccgggtgcgcgctccccccttctggta

SEQ ID NO: 126060 - DNA, 75 bp, Artificial Sequence
  Synthetic
ccctcctggagacttggaaaataccagattaccaaccaccagtggtcgccgggtgggcgctccccccttctggta

SEQ ID NO: 126061 - DNA, 75 bp, Artificial Sequence
  Synthetic
ccctcctggagacttggaaaacaccagattaccaaccaccagtggtcgccgggtgagcgctccccccttctggta

SEQ ID NO: 126062 - DNA, 75 bp, Artificial Sequence
  Synthetic
ccctcctggagacttggaaaacaccagattaccaaccaccagtggtcgccgggtgtgcgctccccccttctggta

SEQ ID NO: 126063 - DNA, 75 bp, Artificial Sequence
  Synthetic
ccctcctggagacttggaaaacaccagattaccaaccaccagtggtcgccgggtgcgcgctccccccttctggta

SEQ ID NO: 126064 - DNA, 75 bp, Artificial Sequence
  Synthetic
ccctcctggagacttggaaaacaccagattaccaaccaccagtggtcgccgggtgggcgctccccccttctggta

SEQ ID NO: 126065 - DNA, 75 bp, Artificial Sequence
  Synthetic
ccctcctggagacttggaaaagaccagattaccaaccaccagtggtcgccgggtgagcgctccccccttctggta

SEQ ID NO: 126066 - DNA, 75 bp, Artificial Sequence
  Synthetic
ccctcctggagacttggaaaagaccagattaccaaccaccagtggtcgccgggtgtgcgctccccccttctggta

SEQ ID NO: 126067 - DNA, 75 bp, Artificial Sequence
  Synthetic
ccctcctggagacttggaaaagaccagattaccaaccaccagtggtcgccgggtgcgcgctccccccttctggta

SEQ ID NO: 126068 - DNA, 75 bp, Artificial Sequence
  Synthetic
ccctcctggagacttggaaaagaccagattaccaaccaccagtggtcgccgggtgggcgctccccccttctggta

SEQ ID NO: 126069 - DNA, 75 bp, Artificial Sequence
  Synthetic
cgctcctggagacttggaaaaaaccagattaccaaccaccagtggtcgccgggtgagcgctccccccttctggta

SEQ ID NO: 126070 - DNA, 75 bp, Artificial Sequence
  Synthetic
cgctcctggagacttggaaaaaaccagattaccaaccaccagtggtcgccgggtgtgcgctccccccttctggta

SEQ ID NO: 126071 - DNA, 75 bp, Artificial Sequence
  Synthetic
cgctcctggagacttggaaaaaaccagattaccaaccaccagtggtcgccgggtgcgcgctccccccttctggta

SEQ ID NO: 126072 - DNA, 75 bp, Artificial Sequence
  Synthetic
cgctcctggagacttggaaaaaaccagattaccaaccaccagtggtcgccgggtgggcgctccccccttctggta

SEQ ID NO: 126073 - DNA, 75 bp, Artificial Sequence
  Synthetic
cgctcctggagacttggaaaataccagattaccaaccaccagtggtcgccgggtgagcgctccccccttctggta

SEQ ID NO: 126074 - DNA, 75 bp, Artificial Sequence
  Synthetic
cgctcctggagacttggaaaataccagattaccaaccaccagtggtcgccgggtgtgcgctccccccttctggta

SEQ ID NO: 126075 - DNA, 75 bp, Artificial Sequence
  Synthetic
cgctcctggagacttggaaaataccagattaccaaccaccagtggtcgccgggtgcgcgctccccccttctggta

SEQ ID NO: 126076 - DNA, 75 bp, Artificial Sequence
  Synthetic
cgctcctggagacttggaaaataccagattaccaaccaccagtggtcgccgggtgggcgctccccccttctggta

SEQ ID NO: 126077 - DNA, 75 bp, Artificial Sequence
  Synthetic
cgctcctggagacttggaaaacaccagattaccaaccaccagtggtcgccgggtgagcgctccccccttctggta

SEQ ID NO: 126078 - DNA, 75 bp, Artificial Sequence
  Synthetic
cgctcctggagacttggaaaacaccagattaccaaccaccagtggtcgccgggtgtgcgctccccccttctggta

SEQ ID NO: 126079 - DNA, 75 bp, Artificial Sequence
  Synthetic
cgctcctggagacttggaaaacaccagattaccaaccaccagtggtcgccgggtgcgcgctccccccttctggta

SEQ ID NO: 126080 - DNA, 75 bp, Artificial Sequence
  Synthetic
cgctcctggagacttggaaaacaccagattaccaaccaccagtggtcgccgggtgggcgctccccccttctggta

SEQ ID NO: 126081 - DNA, 75 bp, Artificial Sequence
  Synthetic
cgctcctggagacttggaaaagaccagattaccaaccaccagtggtcgccgggtgagcgctccccccttctggta

SEQ ID NO: 126082 - DNA, 75 bp, Artificial Sequence
  Synthetic
cgctcctggagacttggaaaagaccagattaccaaccaccagtggtcgccgggtgtgcgctccccccttctggta

SEQ ID NO: 126083 - DNA, 75 bp, Artificial Sequence
  Synthetic
cgctcctggagacttggaaaagaccagattaccaaccaccagtggtcgccgggtgcgcgctccccccttctggta

SEQ ID NO: 126084 - DNA, 75 bp, Artificial Sequence
  Synthetic
cgctcctggagacttggaaaagaccagattaccaaccaccagtggtcgccgggtgggcgctccccccttctggta

SEQ ID NO: 126085 - DNA, 75 bp, Artificial Sequence
  Synthetic
caactccacggggtgccccagtcgcttaagctggtgcaggccactgcgcatgtttgaccagggctggggtcccat

SEQ ID NO: 126086 - DNA, 75 bp, Artificial Sequence
  Synthetic
gcggcgaactgtcgtgctggaccagagtaacgtgggagaggctctcaaagcccttgccatgaagagctttggctg

SEQ ID NO: 126087 - DNA, 75 bp, Artificial Sequence
  Synthetic
gcggcgaactgtcgtgctggaccagagtaacgtgggagaggctctcaatgcccttgccatgaagagctttggctg

SEQ ID NO: 126088 - DNA, 75 bp, Artificial Sequence
  Synthetic
gcggcgaactgtcgtgctggaccagagtaacgtgggagaggctctcaacgcccttgccatgaagagctttggctg

SEQ ID NO: 126089 - DNA, 75 bp, Artificial Sequence
  Synthetic
gcggcgaactgtcgtgctggaccagagtaacgtgggagaggctctcaaggcccttgccatgaagagctttggctg

SEQ ID NO: 126090 - DNA, 75 bp, Artificial Sequence
  Synthetic
gcggcgaactgtcgtgctggaccagagtaacgtgggtgaggctctcaaagcccttgccatgaagagctttggctg

SEQ ID NO: 126091 - DNA, 75 bp, Artificial Sequence
  Synthetic
gcggcgaactgtcgtgctggaccagagtaacgtgggtgaggctctcaatgcccttgccatgaagagctttggctg

SEQ ID NO: 126092 - DNA, 75 bp, Artificial Sequence
  Synthetic
gcggcgaactgtcgtgctggaccagagtaacgtgggtgaggctctcaacgcccttgccatgaagagctttggctg

SEQ ID NO: 126093 - DNA, 75 bp, Artificial Sequence
  Synthetic
gcggcgaactgtcgtgctggaccagagtaacgtgggtgaggctctcaaggcccttgccatgaagagctttggctg

SEQ ID NO: 126094 - DNA, 75 bp, Artificial Sequence
  Synthetic
gcggcgaactgtcgtgctggaccagagtaacgtgggcgaggctctcaaagcccttgccatgaagagctttggctg

SEQ ID NO: 126095 - DNA, 75 bp, Artificial Sequence
  Synthetic
gcggcgaactgtcgtgctggaccagagtaacgtgggcgaggctctcaatgcccttgccatgaagagctttggctg

SEQ ID NO: 126096 - DNA, 75 bp, Artificial Sequence
  Synthetic
gcggcgaactgtcgtgctggaccagagtaacgtgggcgaggctctcaacgcccttgccatgaagagctttggctg

SEQ ID NO: 126097 - DNA, 75 bp, Artificial Sequence
  Synthetic
gcggcgaactgtcgtgctggaccagagtaacgtgggcgaggctctcaaggcccttgccatgaagagctttggctg

SEQ ID NO: 126098 - DNA, 75 bp, Artificial Sequence
  Synthetic
gcggcgaactgtcgtgctggaccagagtaacgtgggggaggctctcaaagcccttgccatgaagagctttggctg

SEQ ID NO: 126099 - DNA, 75 bp, Artificial Sequence
  Synthetic
gcggcgaactgtcgtgctggaccagagtaacgtgggggaggctctcaatgcccttgccatgaagagctttggctg

SEQ ID NO: 126100 - DNA, 75 bp, Artificial Sequence
  Synthetic
gcggcgaactgtcgtgctggaccagagtaacgtgggggaggctctcaacgcccttgccatgaagagctttggctg

SEQ ID NO: 126101 - DNA, 75 bp, Artificial Sequence
  Synthetic
gcggcgaactgtcgtgctggaccagagtaacgtgggggaggctctcaaggcccttgccatgaagagctttggctg

SEQ ID NO: 126102 - DNA, 75 bp, Artificial Sequence
  Synthetic
gcggcgatctgtcgtgctggaccagagtaacgtgggagaggctctcaaagcccttgccatgaagagctttggctg

SEQ ID NO: 126103 - DNA, 75 bp, Artificial Sequence
  Synthetic
gcggcgatctgtcgtgctggaccagagtaacgtgggagaggctctcaatgcccttgccatgaagagctttggctg

SEQ ID NO: 126104 - DNA, 75 bp, Artificial Sequence
  Synthetic
gcggcgatctgtcgtgctggaccagagtaacgtgggagaggctctcaacgcccttgccatgaagagctttggctg

SEQ ID NO: 126105 - DNA, 75 bp, Artificial Sequence
  Synthetic
gcggcgatctgtcgtgctggaccagagtaacgtgggagaggctctcaaggcccttgccatgaagagctttggctg

SEQ ID NO: 126106 - DNA, 75 bp, Artificial Sequence
  Synthetic
gcggcgatctgtcgtgctggaccagagtaacgtgggtgaggctctcaaagcccttgccatgaagagctttggctg

SEQ ID NO: 126107 - DNA, 75 bp, Artificial Sequence
  Synthetic
gcggcgatctgtcgtgctggaccagagtaacgtgggtgaggctctcaatgcccttgccatgaagagctttggctg

SEQ ID NO: 126108 - DNA, 75 bp, Artificial Sequence
  Synthetic
gcggcgatctgtcgtgctggaccagagtaacgtgggtgaggctctcaacgcccttgccatgaagagctttggctg

SEQ ID NO: 126109 - DNA, 75 bp, Artificial Sequence
  Synthetic
gcggcgatctgtcgtgctggaccagagtaacgtgggtgaggctctcaaggcccttgccatgaagagctttggctg

SEQ ID NO: 126110 - DNA, 75 bp, Artificial Sequence
  Synthetic
gcggcgatctgtcgtgctggaccagagtaacgtgggcgaggctctcaaagcccttgccatgaagagctttggctg

SEQ ID NO: 126111 - DNA, 75 bp, Artificial Sequence
  Synthetic
gcggcgatctgtcgtgctggaccagagtaacgtgggcgaggctctcaatgcccttgccatgaagagctttggctg

SEQ ID NO: 126112 - DNA, 75 bp, Artificial Sequence
  Synthetic
gcggcgatctgtcgtgctggaccagagtaacgtgggcgaggctctcaacgcccttgccatgaagagctttggctg

SEQ ID NO: 126113 - DNA, 75 bp, Artificial Sequence
  Synthetic
gcggcgatctgtcgtgctggaccagagtaacgtgggcgaggctctcaaggcccttgccatgaagagctttggctg

SEQ ID NO: 126114 - DNA, 75 bp, Artificial Sequence
  Synthetic
gcggcgatctgtcgtgctggaccagagtaacgtgggggaggctctcaaagcccttgccatgaagagctttggctg

SEQ ID NO: 126115 - DNA, 75 bp, Artificial Sequence
  Synthetic
gcggcgatctgtcgtgctggaccagagtaacgtgggggaggctctcaatgcccttgccatgaagagctttggctg

SEQ ID NO: 126116 - DNA, 75 bp, Artificial Sequence
  Synthetic
gcggcgatctgtcgtgctggaccagagtaacgtgggggaggctctcaacgcccttgccatgaagagctttggctg

SEQ ID NO: 126117 - DNA, 75 bp, Artificial Sequence
  Synthetic
gcggcgatctgtcgtgctggaccagagtaacgtgggggaggctctcaaggcccttgccatgaagagctttggctg

SEQ ID NO: 126118 - DNA, 75 bp, Artificial Sequence
  Synthetic
gcggcgacctgtcgtgctggaccagagtaacgtgggagaggctctcaaagcccttgccatgaagagctttggctg

SEQ ID NO: 126119 - DNA, 75 bp, Artificial Sequence
  Synthetic
gcggcgacctgtcgtgctggaccagagtaacgtgggagaggctctcaatgcccttgccatgaagagctttggctg

SEQ ID NO: 126120 - DNA, 75 bp, Artificial Sequence
  Synthetic
gcggcgacctgtcgtgctggaccagagtaacgtgggagaggctctcaacgcccttgccatgaagagctttggctg

SEQ ID NO: 126121 - DNA, 75 bp, Artificial Sequence
  Synthetic
gcggcgacctgtcgtgctggaccagagtaacgtgggagaggctctcaaggcccttgccatgaagagctttggctg

SEQ ID NO: 126122 - DNA, 75 bp, Artificial Sequence
  Synthetic
gcggcgacctgtcgtgctggaccagagtaacgtgggtgaggctctcaaagcccttgccatgaagagctttggctg

SEQ ID NO: 126123 - DNA, 75 bp, Artificial Sequence
  Synthetic
gcggcgacctgtcgtgctggaccagagtaacgtgggtgaggctctcaatgcccttgccatgaagagctttggctg

SEQ ID NO: 126124 - DNA, 75 bp, Artificial Sequence
  Synthetic
gcggcgacctgtcgtgctggaccagagtaacgtgggtgaggctctcaacgcccttgccatgaagagctttggctg

SEQ ID NO: 126125 - DNA, 75 bp, Artificial Sequence
  Synthetic
gcggcgacctgtcgtgctggaccagagtaacgtgggtgaggctctcaaggcccttgccatgaagagctttggctg

SEQ ID NO: 126126 - DNA, 75 bp, Artificial Sequence
  Synthetic
gcggcgacctgtcgtgctggaccagagtaacgtgggcgaggctctcaaagcccttgccatgaagagctttggctg

SEQ ID NO: 126127 - DNA, 75 bp, Artificial Sequence
  Synthetic
gcggcgacctgtcgtgctggaccagagtaacgtgggcgaggctctcaatgcccttgccatgaagagctttggctg

SEQ ID NO: 126128 - DNA, 75 bp, Artificial Sequence
  Synthetic
gcggcgacctgtcgtgctggaccagagtaacgtgggcgaggctctcaacgcccttgccatgaagagctttggctg

SEQ ID NO: 126129 - DNA, 75 bp, Artificial Sequence
  Synthetic
gcggcgacctgtcgtgctggaccagagtaacgtgggcgaggctctcaaggcccttgccatgaagagctttggctg

SEQ ID NO: 126130 - DNA, 75 bp, Artificial Sequence
  Synthetic
gcggcgacctgtcgtgctggaccagagtaacgtgggggaggctctcaaagcccttgccatgaagagctttggctg

SEQ ID NO: 126131 - DNA, 75 bp, Artificial Sequence
  Synthetic
gcggcgacctgtcgtgctggaccagagtaacgtgggggaggctctcaatgcccttgccatgaagagctttggctg

SEQ ID NO: 126132 - DNA, 75 bp, Artificial Sequence
  Synthetic
gcggcgacctgtcgtgctggaccagagtaacgtgggggaggctctcaacgcccttgccatgaagagctttggctg

SEQ ID NO: 126133 - DNA, 75 bp, Artificial Sequence
  Synthetic
gcggcgacctgtcgtgctggaccagagtaacgtgggggaggctctcaaggcccttgccatgaagagctttggctg

SEQ ID NO: 126134 - DNA, 75 bp, Artificial Sequence
  Synthetic
gcggcgagctgtcgtgctggaccagagtaacgtgggagaggctctcaaagcccttgccatgaagagctttggctg

SEQ ID NO: 126135 - DNA, 75 bp, Artificial Sequence
  Synthetic
gcggcgagctgtcgtgctggaccagagtaacgtgggagaggctctcaatgcccttgccatgaagagctttggctg

SEQ ID NO: 126136 - DNA, 75 bp, Artificial Sequence
  Synthetic
gcggcgagctgtcgtgctggaccagagtaacgtgggagaggctctcaacgcccttgccatgaagagctttggctg

SEQ ID NO: 126137 - DNA, 75 bp, Artificial Sequence
  Synthetic
gcggcgagctgtcgtgctggaccagagtaacgtgggagaggctctcaaggcccttgccatgaagagctttggctg

SEQ ID NO: 126138 - DNA, 75 bp, Artificial Sequence
  Synthetic
gcggcgagctgtcgtgctggaccagagtaacgtgggtgaggctctcaaagcccttgccatgaagagctttggctg

SEQ ID NO: 126139 - DNA, 75 bp, Artificial Sequence
  Synthetic
gcggcgagctgtcgtgctggaccagagtaacgtgggtgaggctctcaatgcccttgccatgaagagctttggctg

SEQ ID NO: 126140 - DNA, 75 bp, Artificial Sequence
  Synthetic
gcggcgagctgtcgtgctggaccagagtaacgtgggtgaggctctcaacgcccttgccatgaagagctttggctg

SEQ ID NO: 126141 - DNA, 75 bp, Artificial Sequence
  Synthetic
gcggcgagctgtcgtgctggaccagagtaacgtgggtgaggctctcaaggcccttgccatgaagagctttggctg

SEQ ID NO: 126142 - DNA, 75 bp, Artificial Sequence
  Synthetic
gcggcgagctgtcgtgctggaccagagtaacgtgggcgaggctctcaaagcccttgccatgaagagctttggctg

SEQ ID NO: 126143 - DNA, 75 bp, Artificial Sequence
  Synthetic
gcggcgagctgtcgtgctggaccagagtaacgtgggcgaggctctcaatgcccttgccatgaagagctttggctg

SEQ ID NO: 126144 - DNA, 75 bp, Artificial Sequence
  Synthetic
gcggcgagctgtcgtgctggaccagagtaacgtgggcgaggctctcaacgcccttgccatgaagagctttggctg

SEQ ID NO: 126145 - DNA, 75 bp, Artificial Sequence
  Synthetic
gcggcgagctgtcgtgctggaccagagtaacgtgggcgaggctctcaaggcccttgccatgaagagctttggctg

SEQ ID NO: 126146 - DNA, 75 bp, Artificial Sequence
  Synthetic
gcggcgagctgtcgtgctggaccagagtaacgtgggggaggctctcaaagcccttgccatgaagagctttggctg

SEQ ID NO: 126147 - DNA, 75 bp, Artificial Sequence
  Synthetic
gcggcgagctgtcgtgctggaccagagtaacgtgggggaggctctcaatgcccttgccatgaagagctttggctg

SEQ ID NO: 126148 - DNA, 75 bp, Artificial Sequence
  Synthetic
gcggcgagctgtcgtgctggaccagagtaacgtgggggaggctctcaacgcccttgccatgaagagctttggctg

SEQ ID NO: 126149 - DNA, 75 bp, Artificial Sequence
  Synthetic
gcggcgagctgtcgtgctggaccagagtaacgtgggggaggctctcaaggcccttgccatgaagagctttggctg

SEQ ID NO: 126150 - DNA, 75 bp, Artificial Sequence
  Synthetic
ggtcacctaccgccacgttggtcacatcgtacgtgctgcgcattccccaagtgatcatcgacattttcgtcggag

SEQ ID NO: 126151 - DNA, 75 bp, Artificial Sequence
  Synthetic
tttctgctcttggcagacgccagggtctgtgcctgcctttggatgctcatcctattgggtcaggccgaagcagcc

SEQ ID NO: 126152 - DNA, 75 bp, Artificial Sequence
  Synthetic
cactccattggacctaccggttatcatccaacggttacatggtatggccgctttttccctccatgggtactctcc

SEQ ID NO: 126153 - DNA, 75 bp, Artificial Sequence
  Synthetic
tccatgtcttccatgccccccctagagggggagcctggagacccggacctagagtcagagcaggtagagcaccaa

SEQ ID NO: 126154 - DNA, 75 bp, Artificial Sequence
  Synthetic
tccatgtcttccatgccccccctagagggggagcctggagacccggacctagagtcagagcaggtagagcaccat

SEQ ID NO: 126155 - DNA, 75 bp, Artificial Sequence
  Synthetic
tccatgtcttccatgccccccctagagggggagcctggagacccggacctagagtcagagcaggtagagcaccac

SEQ ID NO: 126156 - DNA, 75 bp, Artificial Sequence
  Synthetic
tccatgtcttccatgccccccctagagggggagcctggagacccggacctagagtcagagcaggtagagcaccag

SEQ ID NO: 126157 - DNA, 75 bp, Artificial Sequence
  Synthetic
tccatgtcttccatgccccccctagagggggagcctggagacccggacctagagtcagagcaggtagagctccaa

SEQ ID NO: 126158 - DNA, 75 bp, Artificial Sequence
  Synthetic
tccatgtcttccatgccccccctagagggggagcctggagacccggacctagagtcagagcaggtagagctccat

SEQ ID NO: 126159 - DNA, 75 bp, Artificial Sequence
  Synthetic
tccatgtcttccatgccccccctagagggggagcctggagacccggacctagagtcagagcaggtagagctccac

SEQ ID NO: 126160 - DNA, 75 bp, Artificial Sequence
  Synthetic
tccatgtcttccatgccccccctagagggggagcctggagacccggacctagagtcagagcaggtagagctccag

SEQ ID NO: 126161 - DNA, 75 bp, Artificial Sequence
  Synthetic
tccatgtcttccatgccccccctagagggggagcctggagacccggacctagagtcagagcaggtagagccccaa

SEQ ID NO: 126162 - DNA, 75 bp, Artificial Sequence
  Synthetic
tccatgtcttccatgccccccctagagggggagcctggagacccggacctagagtcagagcaggtagagccccat

SEQ ID NO: 126163 - DNA, 75 bp, Artificial Sequence
  Synthetic
tccatgtcttccatgccccccctagagggggagcctggagacccggacctagagtcagagcaggtagagccccac

SEQ ID NO: 126164 - DNA, 75 bp, Artificial Sequence
  Synthetic
tccatgtcttccatgccccccctagagggggagcctggagacccggacctagagtcagagcaggtagagccccag

SEQ ID NO: 126165 - DNA, 75 bp, Artificial Sequence
  Synthetic
tccatgtcttccatgccccccctagagggggagcctggagacccggacctagagtcagagcaggtagagcgccaa

SEQ ID NO: 126166 - DNA, 75 bp, Artificial Sequence
  Synthetic
tccatgtcttccatgccccccctagagggggagcctggagacccggacctagagtcagagcaggtagagcgccat

SEQ ID NO: 126167 - DNA, 75 bp, Artificial Sequence
  Synthetic
tccatgtcttccatgccccccctagagggggagcctggagacccggacctagagtcagagcaggtagagcgccac

SEQ ID NO: 126168 - DNA, 75 bp, Artificial Sequence
  Synthetic
tccatgtcttccatgccccccctagagggggagcctggagacccggacctagagtcagagcaggtagagcgccag

SEQ ID NO: 126169 - DNA, 75 bp, Artificial Sequence
  Synthetic
tccatgtcttccatgcccccccttgagggggagcctggagacccggacctagagtcagagcaggtagagcaccaa

SEQ ID NO: 126170 - DNA, 75 bp, Artificial Sequence
  Synthetic
tccatgtcttccatgcccccccttgagggggagcctggagacccggacctagagtcagagcaggtagagcaccat

SEQ ID NO: 126171 - DNA, 75 bp, Artificial Sequence
  Synthetic
tccatgtcttccatgcccccccttgagggggagcctggagacccggacctagagtcagagcaggtagagcaccac

SEQ ID NO: 126172 - DNA, 75 bp, Artificial Sequence
  Synthetic
tccatgtcttccatgcccccccttgagggggagcctggagacccggacctagagtcagagcaggtagagcaccag

SEQ ID NO: 126173 - DNA, 75 bp, Artificial Sequence
  Synthetic
tccatgtcttccatgcccccccttgagggggagcctggagacccggacctagagtcagagcaggtagagctccaa

SEQ ID NO: 126174 - DNA, 75 bp, Artificial Sequence
  Synthetic
tccatgtcttccatgcccccccttgagggggagcctggagacccggacctagagtcagagcaggtagagctccat

SEQ ID NO: 126175 - DNA, 75 bp, Artificial Sequence
  Synthetic
tccatgtcttccatgcccccccttgagggggagcctggagacccggacctagagtcagagcaggtagagctccac

SEQ ID NO: 126176 - DNA, 75 bp, Artificial Sequence
  Synthetic
tccatgtcttccatgcccccccttgagggggagcctggagacccggacctagagtcagagcaggtagagctccag

SEQ ID NO: 126177 - DNA, 75 bp, Artificial Sequence
  Synthetic
tccatgtcttccatgcccccccttgagggggagcctggagacccggacctagagtcagagcaggtagagccccaa

SEQ ID NO: 126178 - DNA, 75 bp, Artificial Sequence
  Synthetic
tccatgtcttccatgcccccccttgagggggagcctggagacccggacctagagtcagagcaggtagagccccat

SEQ ID NO: 126179 - DNA, 75 bp, Artificial Sequence
  Synthetic
tccatgtcttccatgcccccccttgagggggagcctggagacccggacctagagtcagagcaggtagagccccac

SEQ ID NO: 126180 - DNA, 75 bp, Artificial Sequence
  Synthetic
tccatgtcttccatgcccccccttgagggggagcctggagacccggacctagagtcagagcaggtagagccccag

SEQ ID NO: 126181 - DNA, 75 bp, Artificial Sequence
  Synthetic
tccatgtcttccatgcccccccttgagggggagcctggagacccggacctagagtcagagcaggtagagcgccaa

SEQ ID NO: 126182 - DNA, 75 bp, Artificial Sequence
  Synthetic
tccatgtcttccatgcccccccttgagggggagcctggagacccggacctagagtcagagcaggtagagcgccat

SEQ ID NO: 126183 - DNA, 75 bp, Artificial Sequence
  Synthetic
tccatgtcttccatgcccccccttgagggggagcctggagacccggacctagagtcagagcaggtagagcgccac

SEQ ID NO: 126184 - DNA, 75 bp, Artificial Sequence
  Synthetic
tccatgtcttccatgcccccccttgagggggagcctggagacccggacctagagtcagagcaggtagagcgccag

SEQ ID NO: 126185 - DNA, 75 bp, Artificial Sequence
  Synthetic
tccatgtcttccatgccccccctcgagggggagcctggagacccggacctagagtcagagcaggtagagcaccaa

SEQ ID NO: 126186 - DNA, 75 bp, Artificial Sequence
  Synthetic
tccatgtcttccatgccccccctcgagggggagcctggagacccggacctagagtcagagcaggtagagcaccat

SEQ ID NO: 126187 - DNA, 75 bp, Artificial Sequence
  Synthetic
tccatgtcttccatgccccccctcgagggggagcctggagacccggacctagagtcagagcaggtagagcaccac

SEQ ID NO: 126188 - DNA, 75 bp, Artificial Sequence
  Synthetic
tccatgtcttccatgccccccctcgagggggagcctggagacccggacctagagtcagagcaggtagagcaccag

SEQ ID NO: 126189 - DNA, 75 bp, Artificial Sequence
  Synthetic
tccatgtcttccatgccccccctcgagggggagcctggagacccggacctagagtcagagcaggtagagctccaa

SEQ ID NO: 126190 - DNA, 75 bp, Artificial Sequence
  Synthetic
tccatgtcttccatgccccccctcgagggggagcctggagacccggacctagagtcagagcaggtagagctccat

SEQ ID NO: 126191 - DNA, 75 bp, Artificial Sequence
  Synthetic
tccatgtcttccatgccccccctcgagggggagcctggagacccggacctagagtcagagcaggtagagctccac

SEQ ID NO: 126192 - DNA, 75 bp, Artificial Sequence
  Synthetic
tccatgtcttccatgccccccctcgagggggagcctggagacccggacctagagtcagagcaggtagagctccag

SEQ ID NO: 126193 - DNA, 75 bp, Artificial Sequence
  Synthetic
tccatgtcttccatgccccccctcgagggggagcctggagacccggacctagagtcagagcaggtagagccccaa

SEQ ID NO: 126194 - DNA, 75 bp, Artificial Sequence
  Synthetic
tccatgtcttccatgccccccctcgagggggagcctggagacccggacctagagtcagagcaggtagagccccat

SEQ ID NO: 126195 - DNA, 75 bp, Artificial Sequence
  Synthetic
tccatgtcttccatgccccccctcgagggggagcctggagacccggacctagagtcagagcaggtagagccccac

SEQ ID NO: 126196 - DNA, 75 bp, Artificial Sequence
  Synthetic
tccatgtcttccatgccccccctcgagggggagcctggagacccggacctagagtcagagcaggtagagccccag

SEQ ID NO: 126197 - DNA, 75 bp, Artificial Sequence
  Synthetic
tccatgtcttccatgccccccctcgagggggagcctggagacccggacctagagtcagagcaggtagagcgccaa

SEQ ID NO: 126198 - DNA, 75 bp, Artificial Sequence
  Synthetic
tccatgtcttccatgccccccctcgagggggagcctggagacccggacctagagtcagagcaggtagagcgccat

SEQ ID NO: 126199 - DNA, 75 bp, Artificial Sequence
  Synthetic
tccatgtcttccatgccccccctcgagggggagcctggagacccggacctagagtcagagcaggtagagcgccac

SEQ ID NO: 126200 - DNA, 75 bp, Artificial Sequence
  Synthetic
tccatgtcttccatgccccccctcgagggggagcctggagacccggacctagagtcagagcaggtagagcgccag

SEQ ID NO: 126201 - DNA, 75 bp, Artificial Sequence
  Synthetic
tccatgtcttccatgccccccctggagggggagcctggagacccggacctagagtcagagcaggtagagcaccaa

SEQ ID NO: 126202 - DNA, 75 bp, Artificial Sequence
  Synthetic
tccatgtcttccatgccccccctggagggggagcctggagacccggacctagagtcagagcaggtagagcaccat

SEQ ID NO: 126203 - DNA, 75 bp, Artificial Sequence
  Synthetic
tccatgtcttccatgccccccctggagggggagcctggagacccggacctagagtcagagcaggtagagcaccac

SEQ ID NO: 126204 - DNA, 75 bp, Artificial Sequence
  Synthetic
tccatgtcttccatgccccccctggagggggagcctggagacccggacctagagtcagagcaggtagagcaccag

SEQ ID NO: 126205 - DNA, 75 bp, Artificial Sequence
  Synthetic
tccatgtcttccatgccccccctggagggggagcctggagacccggacctagagtcagagcaggtagagctccaa

SEQ ID NO: 126206 - DNA, 75 bp, Artificial Sequence
  Synthetic
tccatgtcttccatgccccccctggagggggagcctggagacccggacctagagtcagagcaggtagagctccat

SEQ ID NO: 126207 - DNA, 75 bp, Artificial Sequence
  Synthetic
tccatgtcttccatgccccccctggagggggagcctggagacccggacctagagtcagagcaggtagagctccac

SEQ ID NO: 126208 - DNA, 75 bp, Artificial Sequence
  Synthetic
tccatgtcttccatgccccccctggagggggagcctggagacccggacctagagtcagagcaggtagagctccag

SEQ ID NO: 126209 - DNA, 75 bp, Artificial Sequence
  Synthetic
tccatgtcttccatgccccccctggagggggagcctggagacccggacctagagtcagagcaggtagagccccaa

SEQ ID NO: 126210 - DNA, 75 bp, Artificial Sequence
  Synthetic
tccatgtcttccatgccccccctggagggggagcctggagacccggacctagagtcagagcaggtagagccccat

SEQ ID NO: 126211 - DNA, 75 bp, Artificial Sequence
  Synthetic
tccatgtcttccatgccccccctggagggggagcctggagacccggacctagagtcagagcaggtagagccccac

SEQ ID NO: 126212 - DNA, 75 bp, Artificial Sequence
  Synthetic
tccatgtcttccatgccccccctggagggggagcctggagacccggacctagagtcagagcaggtagagccccag

SEQ ID NO: 126213 - DNA, 75 bp, Artificial Sequence
  Synthetic
tccatgtcttccatgccccccctggagggggagcctggagacccggacctagagtcagagcaggtagagcgccaa

SEQ ID NO: 126214 - DNA, 75 bp, Artificial Sequence
  Synthetic
tccatgtcttccatgccccccctggagggggagcctggagacccggacctagagtcagagcaggtagagcgccat

SEQ ID NO: 126215 - DNA, 75 bp, Artificial Sequence
  Synthetic
tccatgtcttccatgccccccctggagggggagcctggagacccggacctagagtcagagcaggtagagcgccac

SEQ ID NO: 126216 - DNA, 75 bp, Artificial Sequence
  Synthetic
tccatgtcttccatgccccccctggagggggagcctggagacccggacctagagtcagagcaggtagagcgccag

SEQ ID NO: 126217 - DNA, 75 bp, Artificial Sequence
  Synthetic
aacccgtatcagcggggcgactgcgggcagtgcaacacaagggctcacggctctcttcaggccaggatcgcagca

SEQ ID NO: 126218 - DNA, 75 bp, Artificial Sequence
  Synthetic
aacccgtatcagcggggcgactgcgggctgtgcaacacaagggctcacggctctcttcaggccaggatcgcagca

SEQ ID NO: 126219 - DNA, 75 bp, Artificial Sequence
  Synthetic
aacccgtatcagcggggcgactgcgggccgtgcaacacaagggctcacggctctcttcaggccaggatcgcagca

SEQ ID NO: 126220 - DNA, 75 bp, Artificial Sequence
  Synthetic
aacccgtatcagcggggcgactgcgggcggtgcaacacaagggctcacggctctcttcaggccaggatcgcagca

SEQ ID NO: 126221 - DNA, 75 bp, Artificial Sequence
  Synthetic
cctgtttactgttttactcccagcccagtagtcatcggcactaccgacaggaagggcctccccacctacaactgg

SEQ ID NO: 126222 - DNA, 75 bp, Artificial Sequence
  Synthetic
tcggtgcggctccggtccctggatcacacccaggtgcctggtcgactacccgtataggctttggcattatccttg

SEQ ID NO: 126223 - DNA, 75 bp, Artificial Sequence
  Synthetic
cgctaagagcctggagacatcgggccagggcggtcagagccaagctcattgcccaaggggggaaagccgctatat

SEQ ID NO: 126224 - DNA, 75 bp, Artificial Sequence
  Synthetic
gtgtggtcccgatggcaacatactccctgttaggatgttggtcctttgttttgctactcgtggcgttgccccaac

SEQ ID NO: 126225 - DNA, 75 bp, Artificial Sequence
  Synthetic
actcctggacaggggcgttaataactccctgtagtccagaggaggaaaagttgccaattaaccctctgagaaact

SEQ ID NO: 126226 - DNA, 75 bp, Artificial Sequence
  Synthetic
actcctggacaggggcgttaataactccctgtagtccagaggaggaaaagttgccaattaaccctctgagtaact

SEQ ID NO: 126227 - DNA, 75 bp, Artificial Sequence
  Synthetic
actcctggacaggggcgttaataactccctgtagtccagaggaggaaaagttgccaattaaccctctgagcaact

SEQ ID NO: 126228 - DNA, 75 bp, Artificial Sequence
  Synthetic
actcctggacaggggcgttaataactccctgtagtccagaggaggaaaagttgccaattaaccctctgaggaact

SEQ ID NO: 126229 - DNA, 75 bp, Artificial Sequence
  Synthetic
actcctggacaggggcgttaataactccctgtagtccagaggaggaaaagttgcctattaaccctctgagaaact

SEQ ID NO: 126230 - DNA, 75 bp, Artificial Sequence
  Synthetic
actcctggacaggggcgttaataactccctgtagtccagaggaggaaaagttgcctattaaccctctgagtaact

SEQ ID NO: 126231 - DNA, 75 bp, Artificial Sequence
  Synthetic
actcctggacaggggcgttaataactccctgtagtccagaggaggaaaagttgcctattaaccctctgagcaact

SEQ ID NO: 126232 - DNA, 75 bp, Artificial Sequence
  Synthetic
actcctggacaggggcgttaataactccctgtagtccagaggaggaaaagttgcctattaaccctctgaggaact

SEQ ID NO: 126233 - DNA, 75 bp, Artificial Sequence
  Synthetic
actcctggacaggggcgttaataactccctgtagtccagaggaggaaaagttgcccattaaccctctgagaaact

SEQ ID NO: 126234 - DNA, 75 bp, Artificial Sequence
  Synthetic
actcctggacaggggcgttaataactccctgtagtccagaggaggaaaagttgcccattaaccctctgagtaact

SEQ ID NO: 126235 - DNA, 75 bp, Artificial Sequence
  Synthetic
actcctggacaggggcgttaataactccctgtagtccagaggaggaaaagttgcccattaaccctctgagcaact

SEQ ID NO: 126236 - DNA, 75 bp, Artificial Sequence
  Synthetic
actcctggacaggggcgttaataactccctgtagtccagaggaggaaaagttgcccattaaccctctgaggaact

SEQ ID NO: 126237 - DNA, 75 bp, Artificial Sequence
  Synthetic
actcctggacaggggcgttaataactccctgtagtccagaggaggaaaagttgccgattaaccctctgagaaact

SEQ ID NO: 126238 - DNA, 75 bp, Artificial Sequence
  Synthetic
actcctggacaggggcgttaataactccctgtagtccagaggaggaaaagttgccgattaaccctctgagtaact

SEQ ID NO: 126239 - DNA, 75 bp, Artificial Sequence
  Synthetic
actcctggacaggggcgttaataactccctgtagtccagaggaggaaaagttgccgattaaccctctgagcaact

SEQ ID NO: 126240 - DNA, 75 bp, Artificial Sequence
  Synthetic
actcctggacaggggcgttaataactccctgtagtccagaggaggaaaagttgccgattaaccctctgaggaact

SEQ ID NO: 126241 - DNA, 75 bp, Artificial Sequence
  Synthetic
actcctggactggggcgttaataactccctgtagtccagaggaggaaaagttgccaattaaccctctgagaaact

SEQ ID NO: 126242 - DNA, 75 bp, Artificial Sequence
  Synthetic
actcctggactggggcgttaataactccctgtagtccagaggaggaaaagttgccaattaaccctctgagtaact

SEQ ID NO: 126243 - DNA, 75 bp, Artificial Sequence
  Synthetic
actcctggactggggcgttaataactccctgtagtccagaggaggaaaagttgccaattaaccctctgagcaact

SEQ ID NO: 126244 - DNA, 75 bp, Artificial Sequence
  Synthetic
actcctggactggggcgttaataactccctgtagtccagaggaggaaaagttgccaattaaccctctgaggaact

SEQ ID NO: 126245 - DNA, 75 bp, Artificial Sequence
  Synthetic
actcctggactggggcgttaataactccctgtagtccagaggaggaaaagttgcctattaaccctctgagaaact

SEQ ID NO: 126246 - DNA, 75 bp, Artificial Sequence
  Synthetic
actcctggactggggcgttaataactccctgtagtccagaggaggaaaagttgcctattaaccctctgagtaact

SEQ ID NO: 126247 - DNA, 75 bp, Artificial Sequence
  Synthetic
actcctggactggggcgttaataactccctgtagtccagaggaggaaaagttgcctattaaccctctgagcaact

SEQ ID NO: 126248 - DNA, 75 bp, Artificial Sequence
  Synthetic
actcctggactggggcgttaataactccctgtagtccagaggaggaaaagttgcctattaaccctctgaggaact

SEQ ID NO: 126249 - DNA, 75 bp, Artificial Sequence
  Synthetic
actcctggactggggcgttaataactccctgtagtccagaggaggaaaagttgcccattaaccctctgagaaact

SEQ ID NO: 126250 - DNA, 75 bp, Artificial Sequence
  Synthetic
actcctggactggggcgttaataactccctgtagtccagaggaggaaaagttgcccattaaccctctgagtaact

SEQ ID NO: 126251 - DNA, 75 bp, Artificial Sequence
  Synthetic
actcctggactggggcgttaataactccctgtagtccagaggaggaaaagttgcccattaaccctctgagcaact

SEQ ID NO: 126252 - DNA, 75 bp, Artificial Sequence
  Synthetic
actcctggactggggcgttaataactccctgtagtccagaggaggaaaagttgcccattaaccctctgaggaact

SEQ ID NO: 126253 - DNA, 75 bp, Artificial Sequence
  Synthetic
actcctggactggggcgttaataactccctgtagtccagaggaggaaaagttgccgattaaccctctgagaaact

SEQ ID NO: 126254 - DNA, 75 bp, Artificial Sequence
  Synthetic
actcctggactggggcgttaataactccctgtagtccagaggaggaaaagttgccgattaaccctctgagtaact

SEQ ID NO: 126255 - DNA, 75 bp, Artificial Sequence
  Synthetic
actcctggactggggcgttaataactccctgtagtccagaggaggaaaagttgccgattaaccctctgagcaact

SEQ ID NO: 126256 - DNA, 75 bp, Artificial Sequence
  Synthetic
actcctggactggggcgttaataactccctgtagtccagaggaggaaaagttgccgattaaccctctgaggaact

SEQ ID NO: 126257 - DNA, 75 bp, Artificial Sequence
  Synthetic
actcctggaccggggcgttaataactccctgtagtccagaggaggaaaagttgccaattaaccctctgagaaact

SEQ ID NO: 126258 - DNA, 75 bp, Artificial Sequence
  Synthetic
actcctggaccggggcgttaataactccctgtagtccagaggaggaaaagttgccaattaaccctctgagtaact

SEQ ID NO: 126259 - DNA, 75 bp, Artificial Sequence
  Synthetic
actcctggaccggggcgttaataactccctgtagtccagaggaggaaaagttgccaattaaccctctgagcaact

SEQ ID NO: 126260 - DNA, 75 bp, Artificial Sequence
  Synthetic
actcctggaccggggcgttaataactccctgtagtccagaggaggaaaagttgccaattaaccctctgaggaact

SEQ ID NO: 126261 - DNA, 75 bp, Artificial Sequence
  Synthetic
actcctggaccggggcgttaataactccctgtagtccagaggaggaaaagttgcctattaaccctctgagaaact

SEQ ID NO: 126262 - DNA, 75 bp, Artificial Sequence
  Synthetic
actcctggaccggggcgttaataactccctgtagtccagaggaggaaaagttgcctattaaccctctgagtaact

SEQ ID NO: 126263 - DNA, 75 bp, Artificial Sequence
  Synthetic
actcctggaccggggcgttaataactccctgtagtccagaggaggaaaagttgcctattaaccctctgagcaact

SEQ ID NO: 126264 - DNA, 75 bp, Artificial Sequence
  Synthetic
actcctggaccggggcgttaataactccctgtagtccagaggaggaaaagttgcctattaaccctctgaggaact

SEQ ID NO: 126265 - DNA, 75 bp, Artificial Sequence
  Synthetic
actcctggaccggggcgttaataactccctgtagtccagaggaggaaaagttgcccattaaccctctgagaaact

SEQ ID NO: 126266 - DNA, 75 bp, Artificial Sequence
  Synthetic
actcctggaccggggcgttaataactccctgtagtccagaggaggaaaagttgcccattaaccctctgagtaact

SEQ ID NO: 126267 - DNA, 75 bp, Artificial Sequence
  Synthetic
actcctggaccggggcgttaataactccctgtagtccagaggaggaaaagttgcccattaaccctctgagcaact

SEQ ID NO: 126268 - DNA, 75 bp, Artificial Sequence
  Synthetic
actcctggaccggggcgttaataactccctgtagtccagaggaggaaaagttgcccattaaccctctgaggaact

SEQ ID NO: 126269 - DNA, 75 bp, Artificial Sequence
  Synthetic
actcctggaccggggcgttaataactccctgtagtccagaggaggaaaagttgccgattaaccctctgagaaact

SEQ ID NO: 126270 - DNA, 75 bp, Artificial Sequence
  Synthetic
actcctggaccggggcgttaataactccctgtagtccagaggaggaaaagttgccgattaaccctctgagtaact

SEQ ID NO: 126271 - DNA, 75 bp, Artificial Sequence
  Synthetic
actcctggaccggggcgttaataactccctgtagtccagaggaggaaaagttgccgattaaccctctgagcaact

SEQ ID NO: 126272 - DNA, 75 bp, Artificial Sequence
  Synthetic
actcctggaccggggcgttaataactccctgtagtccagaggaggaaaagttgccgattaaccctctgaggaact

SEQ ID NO: 126273 - DNA, 75 bp, Artificial Sequence
  Synthetic
actcctggacgggggcgttaataactccctgtagtccagaggaggaaaagttgccaattaaccctctgagaaact

SEQ ID NO: 126274 - DNA, 75 bp, Artificial Sequence
  Synthetic
actcctggacgggggcgttaataactccctgtagtccagaggaggaaaagttgccaattaaccctctgagtaact

SEQ ID NO: 126275 - DNA, 75 bp, Artificial Sequence
  Synthetic
actcctggacgggggcgttaataactccctgtagtccagaggaggaaaagttgccaattaaccctctgagcaact

SEQ ID NO: 126276 - DNA, 75 bp, Artificial Sequence
  Synthetic
actcctggacgggggcgttaataactccctgtagtccagaggaggaaaagttgccaattaaccctctgaggaact

SEQ ID NO: 126277 - DNA, 75 bp, Artificial Sequence
  Synthetic
actcctggacgggggcgttaataactccctgtagtccagaggaggaaaagttgcctattaaccctctgagaaact

SEQ ID NO: 126278 - DNA, 75 bp, Artificial Sequence
  Synthetic
actcctggacgggggcgttaataactccctgtagtccagaggaggaaaagttgcctattaaccctctgagtaact

SEQ ID NO: 126279 - DNA, 75 bp, Artificial Sequence
  Synthetic
actcctggacgggggcgttaataactccctgtagtccagaggaggaaaagttgcctattaaccctctgagcaact

SEQ ID NO: 126280 - DNA, 75 bp, Artificial Sequence
  Synthetic
actcctggacgggggcgttaataactccctgtagtccagaggaggaaaagttgcctattaaccctctgaggaact

SEQ ID NO: 126281 - DNA, 75 bp, Artificial Sequence
  Synthetic
actcctggacgggggcgttaataactccctgtagtccagaggaggaaaagttgcccattaaccctctgagaaact

SEQ ID NO: 126282 - DNA, 75 bp, Artificial Sequence
  Synthetic
actcctggacgggggcgttaataactccctgtagtccagaggaggaaaagttgcccattaaccctctgagtaact

SEQ ID NO: 126283 - DNA, 75 bp, Artificial Sequence
  Synthetic
actcctggacgggggcgttaataactccctgtagtccagaggaggaaaagttgcccattaaccctctgagcaact

SEQ ID NO: 126284 - DNA, 75 bp, Artificial Sequence
  Synthetic
actcctggacgggggcgttaataactccctgtagtccagaggaggaaaagttgcccattaaccctctgaggaact

SEQ ID NO: 126285 - DNA, 75 bp, Artificial Sequence
  Synthetic
actcctggacgggggcgttaataactccctgtagtccagaggaggaaaagttgccgattaaccctctgagaaact

SEQ ID NO: 126286 - DNA, 75 bp, Artificial Sequence
  Synthetic
actcctggacgggggcgttaataactccctgtagtccagaggaggaaaagttgccgattaaccctctgagtaact

SEQ ID NO: 126287 - DNA, 75 bp, Artificial Sequence
  Synthetic
actcctggacgggggcgttaataactccctgtagtccagaggaggaaaagttgccgattaaccctctgagcaact

SEQ ID NO: 126288 - DNA, 75 bp, Artificial Sequence
  Synthetic
actcctggacgggggcgttaataactccctgtagtccagaggaggaaaagttgccgattaaccctctgaggaact

SEQ ID NO: 126289 - DNA, 75 bp, Artificial Sequence
  Synthetic
ttactatgactcagtcttgaaggacgtaaagcaggctgcatccaaggtaagtgctaggctcctctccattgagga

SEQ ID NO: 126290 - DNA, 75 bp, Artificial Sequence
  Synthetic
ttactatgactcagtcttgaaggacgtaaagcaggctgcatccaaggttagtgctaggctcctctccattgagga

SEQ ID NO: 126291 - DNA, 75 bp, Artificial Sequence
  Synthetic
ttactatgactcagtcttgaaggacgtaaagcaggctgcatccaaggtcagtgctaggctcctctccattgagga

SEQ ID NO: 126292 - DNA, 75 bp, Artificial Sequence
  Synthetic
ttactatgactcagtcttgaaggacgtaaagcaggctgcatccaaggtgagtgctaggctcctctccattgagga

SEQ ID NO: 126293 - DNA, 75 bp, Artificial Sequence
  Synthetic
ttactatgactcagtcttgaaggacgtaaagcaggctgcttccaaggtaagtgctaggctcctctccattgagga

SEQ ID NO: 126294 - DNA, 75 bp, Artificial Sequence
  Synthetic
ttactatgactcagtcttgaaggacgtaaagcaggctgcttccaaggttagtgctaggctcctctccattgagga

SEQ ID NO: 126295 - DNA, 75 bp, Artificial Sequence
  Synthetic
ttactatgactcagtcttgaaggacgtaaagcaggctgcttccaaggtcagtgctaggctcctctccattgagga

SEQ ID NO: 126296 - DNA, 75 bp, Artificial Sequence
  Synthetic
ttactatgactcagtcttgaaggacgtaaagcaggctgcttccaaggtgagtgctaggctcctctccattgagga

SEQ ID NO: 126297 - DNA, 75 bp, Artificial Sequence
  Synthetic
ttactatgactcagtcttgaaggacgtaaagcaggctgcctccaaggtaagtgctaggctcctctccattgagga

SEQ ID NO: 126298 - DNA, 75 bp, Artificial Sequence
  Synthetic
ttactatgactcagtcttgaaggacgtaaagcaggctgcctccaaggttagtgctaggctcctctccattgagga

SEQ ID NO: 126299 - DNA, 75 bp, Artificial Sequence
  Synthetic
ttactatgactcagtcttgaaggacgtaaagcaggctgcctccaaggtcagtgctaggctcctctccattgagga

SEQ ID NO: 126300 - DNA, 75 bp, Artificial Sequence
  Synthetic
ttactatgactcagtcttgaaggacgtaaagcaggctgcctccaaggtgagtgctaggctcctctccattgagga

SEQ ID NO: 126301 - DNA, 75 bp, Artificial Sequence
  Synthetic
ttactatgactcagtcttgaaggacgtaaagcaggctgcgtccaaggtaagtgctaggctcctctccattgagga

SEQ ID NO: 126302 - DNA, 75 bp, Artificial Sequence
  Synthetic
ttactatgactcagtcttgaaggacgtaaagcaggctgcgtccaaggttagtgctaggctcctctccattgagga

SEQ ID NO: 126303 - DNA, 75 bp, Artificial Sequence
  Synthetic
ttactatgactcagtcttgaaggacgtaaagcaggctgcgtccaaggtcagtgctaggctcctctccattgagga

SEQ ID NO: 126304 - DNA, 75 bp, Artificial Sequence
  Synthetic
ttactatgactcagtcttgaaggacgtaaagcaggctgcgtccaaggtgagtgctaggctcctctccattgagga

SEQ ID NO: 126305 - DNA, 75 bp, Artificial Sequence
  Synthetic
ttactatgactcagtcttgaaggacgttaagcaggctgcatccaaggtaagtgctaggctcctctccattgagga

SEQ ID NO: 126306 - DNA, 75 bp, Artificial Sequence
  Synthetic
ttactatgactcagtcttgaaggacgttaagcaggctgcatccaaggttagtgctaggctcctctccattgagga

SEQ ID NO: 126307 - DNA, 75 bp, Artificial Sequence
  Synthetic
ttactatgactcagtcttgaaggacgttaagcaggctgcatccaaggtcagtgctaggctcctctccattgagga

SEQ ID NO: 126308 - DNA, 75 bp, Artificial Sequence
  Synthetic
ttactatgactcagtcttgaaggacgttaagcaggctgcatccaaggtgagtgctaggctcctctccattgagga

SEQ ID NO: 126309 - DNA, 75 bp, Artificial Sequence
  Synthetic
ttactatgactcagtcttgaaggacgttaagcaggctgcttccaaggtaagtgctaggctcctctccattgagga

SEQ ID NO: 126310 - DNA, 75 bp, Artificial Sequence
  Synthetic
ttactatgactcagtcttgaaggacgttaagcaggctgcttccaaggttagtgctaggctcctctccattgagga

SEQ ID NO: 126311 - DNA, 75 bp, Artificial Sequence
  Synthetic
ttactatgactcagtcttgaaggacgttaagcaggctgcttccaaggtcagtgctaggctcctctccattgagga

SEQ ID NO: 126312 - DNA, 75 bp, Artificial Sequence
  Synthetic
ttactatgactcagtcttgaaggacgttaagcaggctgcttccaaggtgagtgctaggctcctctccattgagga

SEQ ID NO: 126313 - DNA, 75 bp, Artificial Sequence
  Synthetic
ttactatgactcagtcttgaaggacgttaagcaggctgcctccaaggtaagtgctaggctcctctccattgagga

SEQ ID NO: 126314 - DNA, 75 bp, Artificial Sequence
  Synthetic
ttactatgactcagtcttgaaggacgttaagcaggctgcctccaaggttagtgctaggctcctctccattgagga

SEQ ID NO: 126315 - DNA, 75 bp, Artificial Sequence
  Synthetic
ttactatgactcagtcttgaaggacgttaagcaggctgcctccaaggtcagtgctaggctcctctccattgagga

SEQ ID NO: 126316 - DNA, 75 bp, Artificial Sequence
  Synthetic
ttactatgactcagtcttgaaggacgttaagcaggctgcctccaaggtgagtgctaggctcctctccattgagga

SEQ ID NO: 126317 - DNA, 75 bp, Artificial Sequence
  Synthetic
ttactatgactcagtcttgaaggacgttaagcaggctgcgtccaaggtaagtgctaggctcctctccattgagga

SEQ ID NO: 126318 - DNA, 75 bp, Artificial Sequence
  Synthetic
ttactatgactcagtcttgaaggacgttaagcaggctgcgtccaaggttagtgctaggctcctctccattgagga

SEQ ID NO: 126319 - DNA, 75 bp, Artificial Sequence
  Synthetic
ttactatgactcagtcttgaaggacgttaagcaggctgcgtccaaggtcagtgctaggctcctctccattgagga

SEQ ID NO: 126320 - DNA, 75 bp, Artificial Sequence
  Synthetic
ttactatgactcagtcttgaaggacgttaagcaggctgcgtccaaggtgagtgctaggctcctctccattgagga

SEQ ID NO: 126321 - DNA, 75 bp, Artificial Sequence
  Synthetic
ttactatgactcagtcttgaaggacgtcaagcaggctgcatccaaggtaagtgctaggctcctctccattgagga

SEQ ID NO: 126322 - DNA, 75 bp, Artificial Sequence
  Synthetic
ttactatgactcagtcttgaaggacgtcaagcaggctgcatccaaggttagtgctaggctcctctccattgagga

SEQ ID NO: 126323 - DNA, 75 bp, Artificial Sequence
  Synthetic
ttactatgactcagtcttgaaggacgtcaagcaggctgcatccaaggtcagtgctaggctcctctccattgagga

SEQ ID NO: 126324 - DNA, 75 bp, Artificial Sequence
  Synthetic
ttactatgactcagtcttgaaggacgtcaagcaggctgcatccaaggtgagtgctaggctcctctccattgagga

SEQ ID NO: 126325 - DNA, 75 bp, Artificial Sequence
  Synthetic
ttactatgactcagtcttgaaggacgtcaagcaggctgcttccaaggtaagtgctaggctcctctccattgagga

SEQ ID NO: 126326 - DNA, 75 bp, Artificial Sequence
  Synthetic
ttactatgactcagtcttgaaggacgtcaagcaggctgcttccaaggttagtgctaggctcctctccattgagga

SEQ ID NO: 126327 - DNA, 75 bp, Artificial Sequence
  Synthetic
ttactatgactcagtcttgaaggacgtcaagcaggctgcttccaaggtcagtgctaggctcctctccattgagga

SEQ ID NO: 126328 - DNA, 75 bp, Artificial Sequence
  Synthetic
ttactatgactcagtcttgaaggacgtcaagcaggctgcttccaaggtgagtgctaggctcctctccattgagga

SEQ ID NO: 126329 - DNA, 75 bp, Artificial Sequence
  Synthetic
ttactatgactcagtcttgaaggacgtcaagcaggctgcctccaaggtaagtgctaggctcctctccattgagga

SEQ ID NO: 126330 - DNA, 75 bp, Artificial Sequence
  Synthetic
ttactatgactcagtcttgaaggacgtcaagcaggctgcctccaaggttagtgctaggctcctctccattgagga

SEQ ID NO: 126331 - DNA, 75 bp, Artificial Sequence
  Synthetic
ttactatgactcagtcttgaaggacgtcaagcaggctgcctccaaggtcagtgctaggctcctctccattgagga

SEQ ID NO: 126332 - DNA, 75 bp, Artificial Sequence
  Synthetic
ttactatgactcagtcttgaaggacgtcaagcaggctgcctccaaggtgagtgctaggctcctctccattgagga

SEQ ID NO: 126333 - DNA, 75 bp, Artificial Sequence
  Synthetic
ttactatgactcagtcttgaaggacgtcaagcaggctgcgtccaaggtaagtgctaggctcctctccattgagga

SEQ ID NO: 126334 - DNA, 75 bp, Artificial Sequence
  Synthetic
ttactatgactcagtcttgaaggacgtcaagcaggctgcgtccaaggttagtgctaggctcctctccattgagga

SEQ ID NO: 126335 - DNA, 75 bp, Artificial Sequence
  Synthetic
ttactatgactcagtcttgaaggacgtcaagcaggctgcgtccaaggtcagtgctaggctcctctccattgagga

SEQ ID NO: 126336 - DNA, 75 bp, Artificial Sequence
  Synthetic
ttactatgactcagtcttgaaggacgtcaagcaggctgcgtccaaggtgagtgctaggctcctctccattgagga

SEQ ID NO: 126337 - DNA, 75 bp, Artificial Sequence
  Synthetic
ttactatgactcagtcttgaaggacgtgaagcaggctgcatccaaggtaagtgctaggctcctctccattgagga

SEQ ID NO: 126338 - DNA, 75 bp, Artificial Sequence
  Synthetic
ttactatgactcagtcttgaaggacgtgaagcaggctgcatccaaggttagtgctaggctcctctccattgagga

SEQ ID NO: 126339 - DNA, 75 bp, Artificial Sequence
  Synthetic
ttactatgactcagtcttgaaggacgtgaagcaggctgcatccaaggtcagtgctaggctcctctccattgagga

SEQ ID NO: 126340 - DNA, 75 bp, Artificial Sequence
  Synthetic
ttactatgactcagtcttgaaggacgtgaagcaggctgcatccaaggtgagtgctaggctcctctccattgagga

SEQ ID NO: 126341 - DNA, 75 bp, Artificial Sequence
  Synthetic
ttactatgactcagtcttgaaggacgtgaagcaggctgcttccaaggtaagtgctaggctcctctccattgagga

SEQ ID NO: 126342 - DNA, 75 bp, Artificial Sequence
  Synthetic
ttactatgactcagtcttgaaggacgtgaagcaggctgcttccaaggttagtgctaggctcctctccattgagga

SEQ ID NO: 126343 - DNA, 75 bp, Artificial Sequence
  Synthetic
ttactatgactcagtcttgaaggacgtgaagcaggctgcttccaaggtcagtgctaggctcctctccattgagga

SEQ ID NO: 126344 - DNA, 75 bp, Artificial Sequence
  Synthetic
ttactatgactcagtcttgaaggacgtgaagcaggctgcttccaaggtgagtgctaggctcctctccattgagga

SEQ ID NO: 126345 - DNA, 75 bp, Artificial Sequence
  Synthetic
ttactatgactcagtcttgaaggacgtgaagcaggctgcctccaaggtaagtgctaggctcctctccattgagga

SEQ ID NO: 126346 - DNA, 75 bp, Artificial Sequence
  Synthetic
ttactatgactcagtcttgaaggacgtgaagcaggctgcctccaaggttagtgctaggctcctctccattgagga

SEQ ID NO: 126347 - DNA, 75 bp, Artificial Sequence
  Synthetic
ttactatgactcagtcttgaaggacgtgaagcaggctgcctccaaggtcagtgctaggctcctctccattgagga

SEQ ID NO: 126348 - DNA, 75 bp, Artificial Sequence
  Synthetic
ttactatgactcagtcttgaaggacgtgaagcaggctgcctccaaggtgagtgctaggctcctctccattgagga

SEQ ID NO: 126349 - DNA, 75 bp, Artificial Sequence
  Synthetic
ttactatgactcagtcttgaaggacgtgaagcaggctgcgtccaaggtaagtgctaggctcctctccattgagga

SEQ ID NO: 126350 - DNA, 75 bp, Artificial Sequence
  Synthetic
ttactatgactcagtcttgaaggacgtgaagcaggctgcgtccaaggttagtgctaggctcctctccattgagga

SEQ ID NO: 126351 - DNA, 75 bp, Artificial Sequence
  Synthetic
ttactatgactcagtcttgaaggacgtgaagcaggctgcgtccaaggtcagtgctaggctcctctccattgagga

SEQ ID NO: 126352 - DNA, 75 bp, Artificial Sequence
  Synthetic
ttactatgactcagtcttgaaggacgtgaagcaggctgcgtccaaggtgagtgctaggctcctctccattgagga

SEQ ID NO: 126353 - DNA, 75 bp, Artificial Sequence
  Synthetic
tacaccaatcgcttcgattcctctggttgtcctgagcgcttaacatcttgcaaaccgctcactgagttcgaccag

SEQ ID NO: 126354 - DNA, 75 bp, Artificial Sequence
  Synthetic
gatgtcttcctgctaaacagcacaagacccccgcaaggagcttggtttggctgcacttggatgaacgggactggg

SEQ ID NO: 126355 - DNA, 75 bp, Artificial Sequence
  Synthetic
ctggtcatcataaccgccttcacgatcacgccggcatataaaatcctcctcacccgacttgtgtggtggacgtgc

SEQ ID NO: 126356 - DNA, 75 bp, Artificial Sequence
  Synthetic
ggatggggccctataacatatgccaatataagcgggtcgtcgcaagacaagccgtattgatggcactatgcccca

SEQ ID NO: 126357 - DNA, 75 bp, Artificial Sequence
  Synthetic
ggatggggccctataacatatgccaatataagcgggtcgtcgcaagacaagccgtattgttggcactatgcccca

SEQ ID NO: 126358 - DNA, 75 bp, Artificial Sequence
  Synthetic
ggatggggccctataacatatgccaatataagcgggtcgtcgcaagacaagccgtattgctggcactatgcccca

SEQ ID NO: 126359 - DNA, 75 bp, Artificial Sequence
  Synthetic
ggatggggccctataacatatgccaatataagcgggtcgtcgcaagacaagccgtattggtggcactatgcccca

SEQ ID NO: 126360 - DNA, 75 bp, Artificial Sequence
  Synthetic
agcgtgtcccgggcccgaccccgcgtgttactcctttgcctactcctactaacagtaggagtaggcatcttcctg

SEQ ID NO: 126361 - DNA, 75 bp, Artificial Sequence
  Synthetic
ttcactaagacatgcggtgcgccaccttgccgcattaggagggatcacaacagtacctccgatctattgtgcccc

SEQ ID NO: 126362 - DNA, 75 bp, Artificial Sequence
  Synthetic
tgtgagaactaagctcaaactcactccattgcgtgatgcagccaatctggatctttcagaatggtttgtgtcagg

SEQ ID NO: 126363 - DNA, 75 bp, Artificial Sequence
  Synthetic
acccgggtgtggtgtttgacataaccaagtggctgttggcgatccttggacccggctacctccttagagctgcct

SEQ ID NO: 126364 - DNA, 75 bp, Artificial Sequence
  Synthetic
attccatggtggggaactgggctaaggtgttgatcgtgatgctgctcttcgccggcgttgacgggaggataggct

SEQ ID NO: 126365 - DNA, 75 bp, Artificial Sequence
  Synthetic
ggggttcaccaagacgtgcggggcacctccctgtatcattgggccaagaggcaacaagtccctcacctgccctac

SEQ ID NO: 126366 - DNA, 75 bp, Artificial Sequence
  Synthetic
tacccttggcaagtggacaggcacgtacatttatgaccatctatcccccatgtcggactgggctgccgatggcct

SEQ ID NO: 126367 - DNA, 75 bp, Artificial Sequence
  Synthetic
gcacatcaacaggactgctctggactgcaaagcctccctccagactgggtttcttgctgggctgctctacgcgaa

SEQ ID NO: 126368 - DNA, 75 bp, Artificial Sequence
  Synthetic
tcctacaagcctggaaggaaaagaagacccctatgggcttatcctatgacacccgctgatttgactctacagtca

SEQ ID NO: 126369 - DNA, 75 bp, Artificial Sequence
  Synthetic
tcctacaagcctggaaggaaaagaagacccctatgggcttatcctatgacacccgctgttttgactctacagtca

SEQ ID NO: 126370 - DNA, 75 bp, Artificial Sequence
  Synthetic
tcctacaagcctggaaggaaaagaagacccctatgggcttatcctatgacacccgctgctttgactctacagtca

SEQ ID NO: 126371 - DNA, 75 bp, Artificial Sequence
  Synthetic
tcctacaagcctggaaggaaaagaagacccctatgggcttatcctatgacacccgctggtttgactctacagtca

SEQ ID NO: 126372 - DNA, 75 bp, Artificial Sequence
  Synthetic
tcctacaagcctggaaggaaaagaagtcccctatgggcttatcctatgacacccgctgatttgactctacagtca

SEQ ID NO: 126373 - DNA, 75 bp, Artificial Sequence
  Synthetic
tcctacaagcctggaaggaaaagaagtcccctatgggcttatcctatgacacccgctgttttgactctacagtca

SEQ ID NO: 126374 - DNA, 75 bp, Artificial Sequence
  Synthetic
tcctacaagcctggaaggaaaagaagtcccctatgggcttatcctatgacacccgctgctttgactctacagtca

SEQ ID NO: 126375 - DNA, 75 bp, Artificial Sequence
  Synthetic
tcctacaagcctggaaggaaaagaagtcccctatgggcttatcctatgacacccgctggtttgactctacagtca

SEQ ID NO: 126376 - DNA, 75 bp, Artificial Sequence
  Synthetic
tcctacaagcctggaaggaaaagaagccccctatgggcttatcctatgacacccgctgatttgactctacagtca

SEQ ID NO: 126377 - DNA, 75 bp, Artificial Sequence
  Synthetic
tcctacaagcctggaaggaaaagaagccccctatgggcttatcctatgacacccgctgttttgactctacagtca

SEQ ID NO: 126378 - DNA, 75 bp, Artificial Sequence
  Synthetic
tcctacaagcctggaaggaaaagaagccccctatgggcttatcctatgacacccgctgctttgactctacagtca

SEQ ID NO: 126379 - DNA, 75 bp, Artificial Sequence
  Synthetic
tcctacaagcctggaaggaaaagaagccccctatgggcttatcctatgacacccgctggtttgactctacagtca

SEQ ID NO: 126380 - DNA, 75 bp, Artificial Sequence
  Synthetic
tcctacaagcctggaaggaaaagaaggcccctatgggcttatcctatgacacccgctgatttgactctacagtca

SEQ ID NO: 126381 - DNA, 75 bp, Artificial Sequence
  Synthetic
tcctacaagcctggaaggaaaagaaggcccctatgggcttatcctatgacacccgctgttttgactctacagtca

SEQ ID NO: 126382 - DNA, 75 bp, Artificial Sequence
  Synthetic
tcctacaagcctggaaggaaaagaaggcccctatgggcttatcctatgacacccgctgctttgactctacagtca

SEQ ID NO: 126383 - DNA, 75 bp, Artificial Sequence
  Synthetic
tcctacaagcctggaaggaaaagaaggcccctatgggcttatcctatgacacccgctggtttgactctacagtca

SEQ ID NO: 126384 - DNA, 75 bp, Artificial Sequence
  Synthetic
tcctacaagcctggaaggataagaagacccctatgggcttatcctatgacacccgctgatttgactctacagtca

SEQ ID NO: 126385 - DNA, 75 bp, Artificial Sequence
  Synthetic
tcctacaagcctggaaggataagaagacccctatgggcttatcctatgacacccgctgttttgactctacagtca

SEQ ID NO: 126386 - DNA, 75 bp, Artificial Sequence
  Synthetic
tcctacaagcctggaaggataagaagacccctatgggcttatcctatgacacccgctgctttgactctacagtca

SEQ ID NO: 126387 - DNA, 75 bp, Artificial Sequence
  Synthetic
tcctacaagcctggaaggataagaagacccctatgggcttatcctatgacacccgctggtttgactctacagtca

SEQ ID NO: 126388 - DNA, 75 bp, Artificial Sequence
  Synthetic
tcctacaagcctggaaggataagaagtcccctatgggcttatcctatgacacccgctgatttgactctacagtca

SEQ ID NO: 126389 - DNA, 75 bp, Artificial Sequence
  Synthetic
tcctacaagcctggaaggataagaagtcccctatgggcttatcctatgacacccgctgttttgactctacagtca

SEQ ID NO: 126390 - DNA, 75 bp, Artificial Sequence
  Synthetic
tcctacaagcctggaaggataagaagtcccctatgggcttatcctatgacacccgctgctttgactctacagtca

SEQ ID NO: 126391 - DNA, 75 bp, Artificial Sequence
  Synthetic
tcctacaagcctggaaggataagaagtcccctatgggcttatcctatgacacccgctggtttgactctacagtca

SEQ ID NO: 126392 - DNA, 75 bp, Artificial Sequence
  Synthetic
tcctacaagcctggaaggataagaagccccctatgggcttatcctatgacacccgctgatttgactctacagtca

SEQ ID NO: 126393 - DNA, 75 bp, Artificial Sequence
  Synthetic
tcctacaagcctggaaggataagaagccccctatgggcttatcctatgacacccgctgttttgactctacagtca

SEQ ID NO: 126394 - DNA, 75 bp, Artificial Sequence
  Synthetic
tcctacaagcctggaaggataagaagccccctatgggcttatcctatgacacccgctgctttgactctacagtca

SEQ ID NO: 126395 - DNA, 75 bp, Artificial Sequence
  Synthetic
tcctacaagcctggaaggataagaagccccctatgggcttatcctatgacacccgctggtttgactctacagtca

SEQ ID NO: 126396 - DNA, 75 bp, Artificial Sequence
  Synthetic
tcctacaagcctggaaggataagaaggcccctatgggcttatcctatgacacccgctgatttgactctacagtca

SEQ ID NO: 126397 - DNA, 75 bp, Artificial Sequence
  Synthetic
tcctacaagcctggaaggataagaaggcccctatgggcttatcctatgacacccgctgttttgactctacagtca

SEQ ID NO: 126398 - DNA, 75 bp, Artificial Sequence
  Synthetic
tcctacaagcctggaaggataagaaggcccctatgggcttatcctatgacacccgctgctttgactctacagtca

SEQ ID NO: 126399 - DNA, 75 bp, Artificial Sequence
  Synthetic
tcctacaagcctggaaggataagaaggcccctatgggcttatcctatgacacccgctggtttgactctacagtca

SEQ ID NO: 126400 - DNA, 75 bp, Artificial Sequence
  Synthetic
tcctacaagcctggaaggacaagaagacccctatgggcttatcctatgacacccgctgatttgactctacagtca

SEQ ID NO: 126401 - DNA, 75 bp, Artificial Sequence
  Synthetic
tcctacaagcctggaaggacaagaagacccctatgggcttatcctatgacacccgctgttttgactctacagtca

SEQ ID NO: 126402 - DNA, 75 bp, Artificial Sequence
  Synthetic
tcctacaagcctggaaggacaagaagacccctatgggcttatcctatgacacccgctgctttgactctacagtca

SEQ ID NO: 126403 - DNA, 75 bp, Artificial Sequence
  Synthetic
tcctacaagcctggaaggacaagaagacccctatgggcttatcctatgacacccgctggtttgactctacagtca

SEQ ID NO: 126404 - DNA, 75 bp, Artificial Sequence
  Synthetic
tcctacaagcctggaaggacaagaagtcccctatgggcttatcctatgacacccgctgatttgactctacagtca

SEQ ID NO: 126405 - DNA, 75 bp, Artificial Sequence
  Synthetic
tcctacaagcctggaaggacaagaagtcccctatgggcttatcctatgacacccgctgttttgactctacagtca

SEQ ID NO: 126406 - DNA, 75 bp, Artificial Sequence
  Synthetic
tcctacaagcctggaaggacaagaagtcccctatgggcttatcctatgacacccgctgctttgactctacagtca

SEQ ID NO: 126407 - DNA, 75 bp, Artificial Sequence
  Synthetic
tcctacaagcctggaaggacaagaagtcccctatgggcttatcctatgacacccgctggtttgactctacagtca

SEQ ID NO: 126408 - DNA, 75 bp, Artificial Sequence
  Synthetic
tcctacaagcctggaaggacaagaagccccctatgggcttatcctatgacacccgctgatttgactctacagtca

SEQ ID NO: 126409 - DNA, 75 bp, Artificial Sequence
  Synthetic
tcctacaagcctggaaggacaagaagccccctatgggcttatcctatgacacccgctgttttgactctacagtca

SEQ ID NO: 126410 - DNA, 75 bp, Artificial Sequence
  Synthetic
tcctacaagcctggaaggacaagaagccccctatgggcttatcctatgacacccgctgctttgactctacagtca

SEQ ID NO: 126411 - DNA, 75 bp, Artificial Sequence
  Synthetic
tcctacaagcctggaaggacaagaagccccctatgggcttatcctatgacacccgctggtttgactctacagtca

SEQ ID NO: 126412 - DNA, 75 bp, Artificial Sequence
  Synthetic
tcctacaagcctggaaggacaagaaggcccctatgggcttatcctatgacacccgctgatttgactctacagtca

SEQ ID NO: 126413 - DNA, 75 bp, Artificial Sequence
  Synthetic
tcctacaagcctggaaggacaagaaggcccctatgggcttatcctatgacacccgctgttttgactctacagtca

SEQ ID NO: 126414 - DNA, 75 bp, Artificial Sequence
  Synthetic
tcctacaagcctggaaggacaagaaggcccctatgggcttatcctatgacacccgctgctttgactctacagtca

SEQ ID NO: 126415 - DNA, 75 bp, Artificial Sequence
  Synthetic
tcctacaagcctggaaggacaagaaggcccctatgggcttatcctatgacacccgctggtttgactctacagtca

SEQ ID NO: 126416 - DNA, 75 bp, Artificial Sequence
  Synthetic
tcctacaagcctggaaggagaagaagacccctatgggcttatcctatgacacccgctgatttgactctacagtca

SEQ ID NO: 126417 - DNA, 75 bp, Artificial Sequence
  Synthetic
tcctacaagcctggaaggagaagaagacccctatgggcttatcctatgacacccgctgttttgactctacagtca

SEQ ID NO: 126418 - DNA, 75 bp, Artificial Sequence
  Synthetic
tcctacaagcctggaaggagaagaagacccctatgggcttatcctatgacacccgctgctttgactctacagtca

SEQ ID NO: 126419 - DNA, 75 bp, Artificial Sequence
  Synthetic
tcctacaagcctggaaggagaagaagacccctatgggcttatcctatgacacccgctggtttgactctacagtca

SEQ ID NO: 126420 - DNA, 75 bp, Artificial Sequence
  Synthetic
tcctacaagcctggaaggagaagaagtcccctatgggcttatcctatgacacccgctgatttgactctacagtca

SEQ ID NO: 126421 - DNA, 75 bp, Artificial Sequence
  Synthetic
tcctacaagcctggaaggagaagaagtcccctatgggcttatcctatgacacccgctgttttgactctacagtca

SEQ ID NO: 126422 - DNA, 75 bp, Artificial Sequence
  Synthetic
tcctacaagcctggaaggagaagaagtcccctatgggcttatcctatgacacccgctgctttgactctacagtca

SEQ ID NO: 126423 - DNA, 75 bp, Artificial Sequence
  Synthetic
tcctacaagcctggaaggagaagaagtcccctatgggcttatcctatgacacccgctggtttgactctacagtca

SEQ ID NO: 126424 - DNA, 75 bp, Artificial Sequence
  Synthetic
tcctacaagcctggaaggagaagaagccccctatgggcttatcctatgacacccgctgatttgactctacagtca

SEQ ID NO: 126425 - DNA, 75 bp, Artificial Sequence
  Synthetic
tcctacaagcctggaaggagaagaagccccctatgggcttatcctatgacacccgctgttttgactctacagtca

SEQ ID NO: 126426 - DNA, 75 bp, Artificial Sequence
  Synthetic
tcctacaagcctggaaggagaagaagccccctatgggcttatcctatgacacccgctgctttgactctacagtca

SEQ ID NO: 126427 - DNA, 75 bp, Artificial Sequence
  Synthetic
tcctacaagcctggaaggagaagaagccccctatgggcttatcctatgacacccgctggtttgactctacagtca

SEQ ID NO: 126428 - DNA, 75 bp, Artificial Sequence
  Synthetic
tcctacaagcctggaaggagaagaaggcccctatgggcttatcctatgacacccgctgatttgactctacagtca

SEQ ID NO: 126429 - DNA, 75 bp, Artificial Sequence
  Synthetic
tcctacaagcctggaaggagaagaaggcccctatgggcttatcctatgacacccgctgttttgactctacagtca

SEQ ID NO: 126430 - DNA, 75 bp, Artificial Sequence
  Synthetic
tcctacaagcctggaaggagaagaaggcccctatgggcttatcctatgacacccgctgctttgactctacagtca

SEQ ID NO: 126431 - DNA, 75 bp, Artificial Sequence
  Synthetic
tcctacaagcctggaaggagaagaaggcccctatgggcttatcctatgacacccgctggtttgactctacagtca

SEQ ID NO: 126432 - DNA, 75 bp, Artificial Sequence
  Synthetic
gctgccatgctccttctccgacctaccggcaatatctactggtctattgcacctccaccaaaacatcgtggacgt

SEQ ID NO: 126433 - DNA, 75 bp, Artificial Sequence
  Synthetic
gctgccatgctccttctccgacctaccggcattatctactggtctattgcacctccaccaaaacatcgtggacgt

SEQ ID NO: 126434 - DNA, 75 bp, Artificial Sequence
  Synthetic
gctgccatgctccttctccgacctaccggcactatctactggtctattgcacctccaccaaaacatcgtggacgt

SEQ ID NO: 126435 - DNA, 75 bp, Artificial Sequence
  Synthetic
gctgccatgctccttctccgacctaccggcagtatctactggtctattgcacctccaccaaaacatcgtggacgt

SEQ ID NO: 126436 - DNA, 75 bp, Artificial Sequence
  Synthetic
agtcttagctttcctggtgttggccgatgcgcgcatttgtgcctgcttgtggttaatgtttttggtgggtcaagc

SEQ ID NO: 126437 - DNA, 75 bp, Artificial Sequence
  Synthetic
ttcttgctgggctgctctacgcgaaaaagttcaacacgtccggatgcttggagcgtatggccagttgtcgcccca

SEQ ID NO: 126438 - DNA, 75 bp, Artificial Sequence
  Synthetic
cacgggctccctgtctccgcccggctcggccgggagatcctactgggtcccgctgatggatacacttccaagggt

SEQ ID NO: 126439 - DNA, 75 bp, Artificial Sequence
  Synthetic
ccctcaggccgtgatgggaagctcctacggatttcaatactcaccaggacagcgggttgaattcctcgtgcaagc

SEQ ID NO: 126440 - DNA, 75 bp, Artificial Sequence
  Synthetic
tgcaattgctccatctaccctggtaccatcactggacaccgcatggcatgggacatgatgatgaactggtcgccc

SEQ ID NO: 126441 - DNA, 75 bp, Artificial Sequence
  Synthetic
gccagtttgcttaaagtaccctactttgtgcgcgtccaaggccttctccggttctgcgcgttagcgcggaagatg

SEQ ID NO: 126442 - DNA, 75 bp, Artificial Sequence
  Synthetic
ggttcaacgcgtccgggtgcccagagcgtatggccagatgtcgccgcattgatgagttcagtcaggggtggggtc

SEQ ID NO: 126443 - DNA, 75 bp, Artificial Sequence
  Synthetic
ccggggaggtccagattttgtccaccgttacacaatctttccttggaacatcaatctctggggtcatgtggaccg

SEQ ID NO: 126444 - DNA, 75 bp, Artificial Sequence
  Synthetic
ttcgccgacctcatggggtacattcccgtcgtgggggcgccgcttggcggtgtcgcggctgccttagcacacggt

SEQ ID NO: 126445 - DNA, 75 bp, Artificial Sequence
  Synthetic
cgttacacaatctttccttggaacatcaatctctggggtcatgtggaccgtctttcacggcgccggaaacaaaac

SEQ ID NO: 126446 - DNA, 75 bp, Artificial Sequence
  Synthetic
gttcagtgtggtggctgtcctacatgctggtcttggccgaggcccagattcagcaatgggttccccccctggagg

SEQ ID NO: 126447 - DNA, 75 bp, Artificial Sequence
  Synthetic
tgctggctgacgcgcgtgtgtgcgcgtgtctttggctgatgttactcataggccaggcggaggcggcgctggaga

SEQ ID NO: 126448 - DNA, 75 bp, Artificial Sequence
  Synthetic
ttgctccttttctatcttcctcttggcacttctctcgtgcctcactacacctgcctcggcagtccattataggaa

SEQ ID NO: 126449 - DNA, 75 bp, Artificial Sequence
  Synthetic
actacgcaacagggaatcttcctggttgctccttttctatcttcctcttggcacttctctcgtgcctcactacac

SEQ ID NO: 126450 - DNA, 75 bp, Artificial Sequence
  Synthetic
tgcacctgcggggcagttgacctctaccttgtcactcgaaacgccgatgtcatcccggcccgaagacggggggac

SEQ ID NO: 126451 - DNA, 75 bp, Artificial Sequence
  Synthetic
agcagccagtaagtgtggctggggttggtgtcttgtatttttgtgttgtgcatggtacatcaagggtaggctcgt

SEQ ID NO: 126452 - DNA, 75 bp, Artificial Sequence
  Synthetic
cttcctccttaaagcgtccctgctacgggtgccatactttgtgagggctcacgccctgttaagagtgtgcaccct

SEQ ID NO: 126453 - DNA, 75 bp, Artificial Sequence
  Synthetic
cagttgtggccgctcctgctccttatattggcgttgcctcaccgggccttcgcctttgatcgtgagcaggcagct

SEQ ID NO: 126454 - DNA, 75 bp, Artificial Sequence
  Synthetic
gtcaagactggcaataagtcgcagtgttgggtgccagtagcacccacccttgctgtcgcgaacgcctctgttcct

SEQ ID NO: 126455 - DNA, 75 bp, Artificial Sequence
  Synthetic
gtgcgcatggtactaatgacacactttttctccgtcttgatggaccaggacgccttggaccaggatctcaacttc

SEQ ID NO: 126456 - DNA, 75 bp, Artificial Sequence
  Synthetic
gtgcgcatggtactaatgacacactttttctccgtcttgatggtccaggacgccttggaccaggatctcaacttc

SEQ ID NO: 126457 - DNA, 75 bp, Artificial Sequence
  Synthetic
gtgcgcatggtactaatgacacactttttctccgtcttgatggcccaggacgccttggaccaggatctcaacttc

SEQ ID NO: 126458 - DNA, 75 bp, Artificial Sequence
  Synthetic
gtgcgcatggtactaatgacacactttttctccgtcttgatgggccaggacgccttggaccaggatctcaacttc

SEQ ID NO: 126459 - DNA, 75 bp, Artificial Sequence
  Synthetic
gtgcgcatggtacttatgacacactttttctccgtcttgatggaccaggacgccttggaccaggatctcaacttc

SEQ ID NO: 126460 - DNA, 75 bp, Artificial Sequence
  Synthetic
gtgcgcatggtacttatgacacactttttctccgtcttgatggtccaggacgccttggaccaggatctcaacttc

SEQ ID NO: 126461 - DNA, 75 bp, Artificial Sequence
  Synthetic
gtgcgcatggtacttatgacacactttttctccgtcttgatggcccaggacgccttggaccaggatctcaacttc

SEQ ID NO: 126462 - DNA, 75 bp, Artificial Sequence
  Synthetic
gtgcgcatggtacttatgacacactttttctccgtcttgatgggccaggacgccttggaccaggatctcaacttc

SEQ ID NO: 126463 - DNA, 75 bp, Artificial Sequence
  Synthetic
gtgcgcatggtactcatgacacactttttctccgtcttgatggaccaggacgccttggaccaggatctcaacttc

SEQ ID NO: 126464 - DNA, 75 bp, Artificial Sequence
  Synthetic
gtgcgcatggtactcatgacacactttttctccgtcttgatggtccaggacgccttggaccaggatctcaacttc

SEQ ID NO: 126465 - DNA, 75 bp, Artificial Sequence
  Synthetic
gtgcgcatggtactcatgacacactttttctccgtcttgatggcccaggacgccttggaccaggatctcaacttc

SEQ ID NO: 126466 - DNA, 75 bp, Artificial Sequence
  Synthetic
gtgcgcatggtactcatgacacactttttctccgtcttgatgggccaggacgccttggaccaggatctcaacttc

SEQ ID NO: 126467 - DNA, 75 bp, Artificial Sequence
  Synthetic
gtgcgcatggtactgatgacacactttttctccgtcttgatggaccaggacgccttggaccaggatctcaacttc

SEQ ID NO: 126468 - DNA, 75 bp, Artificial Sequence
  Synthetic
gtgcgcatggtactgatgacacactttttctccgtcttgatggtccaggacgccttggaccaggatctcaacttc

SEQ ID NO: 126469 - DNA, 75 bp, Artificial Sequence
  Synthetic
gtgcgcatggtactgatgacacactttttctccgtcttgatggcccaggacgccttggaccaggatctcaacttc

SEQ ID NO: 126470 - DNA, 75 bp, Artificial Sequence
  Synthetic
gtgcgcatggtactgatgacacactttttctccgtcttgatgggccaggacgccttggaccaggatctcaacttc

SEQ ID NO: 126471 - DNA, 75 bp, Artificial Sequence
  Synthetic
gtgcgcatggttctaatgacacactttttctccgtcttgatggaccaggacgccttggaccaggatctcaacttc

SEQ ID NO: 126472 - DNA, 75 bp, Artificial Sequence
  Synthetic
gtgcgcatggttctaatgacacactttttctccgtcttgatggtccaggacgccttggaccaggatctcaacttc

SEQ ID NO: 126473 - DNA, 75 bp, Artificial Sequence
  Synthetic
gtgcgcatggttctaatgacacactttttctccgtcttgatggcccaggacgccttggaccaggatctcaacttc

SEQ ID NO: 126474 - DNA, 75 bp, Artificial Sequence
  Synthetic
gtgcgcatggttctaatgacacactttttctccgtcttgatgggccaggacgccttggaccaggatctcaacttc

SEQ ID NO: 126475 - DNA, 75 bp, Artificial Sequence
  Synthetic
gtgcgcatggttcttatgacacactttttctccgtcttgatggaccaggacgccttggaccaggatctcaacttc

SEQ ID NO: 126476 - DNA, 75 bp, Artificial Sequence
  Synthetic
gtgcgcatggttcttatgacacactttttctccgtcttgatggtccaggacgccttggaccaggatctcaacttc

SEQ ID NO: 126477 - DNA, 75 bp, Artificial Sequence
  Synthetic
gtgcgcatggttcttatgacacactttttctccgtcttgatggcccaggacgccttggaccaggatctcaacttc

SEQ ID NO: 126478 - DNA, 75 bp, Artificial Sequence
  Synthetic
gtgcgcatggttcttatgacacactttttctccgtcttgatgggccaggacgccttggaccaggatctcaacttc

SEQ ID NO: 126479 - DNA, 75 bp, Artificial Sequence
  Synthetic
gtgcgcatggttctcatgacacactttttctccgtcttgatggaccaggacgccttggaccaggatctcaacttc

SEQ ID NO: 126480 - DNA, 75 bp, Artificial Sequence
  Synthetic
gtgcgcatggttctcatgacacactttttctccgtcttgatggtccaggacgccttggaccaggatctcaacttc

SEQ ID NO: 126481 - DNA, 75 bp, Artificial Sequence
  Synthetic
gtgcgcatggttctcatgacacactttttctccgtcttgatggcccaggacgccttggaccaggatctcaacttc

SEQ ID NO: 126482 - DNA, 75 bp, Artificial Sequence
  Synthetic
gtgcgcatggttctcatgacacactttttctccgtcttgatgggccaggacgccttggaccaggatctcaacttc

SEQ ID NO: 126483 - DNA, 75 bp, Artificial Sequence
  Synthetic
gtgcgcatggttctgatgacacactttttctccgtcttgatggaccaggacgccttggaccaggatctcaacttc

SEQ ID NO: 126484 - DNA, 75 bp, Artificial Sequence
  Synthetic
gtgcgcatggttctgatgacacactttttctccgtcttgatggtccaggacgccttggaccaggatctcaacttc

SEQ ID NO: 126485 - DNA, 75 bp, Artificial Sequence
  Synthetic
gtgcgcatggttctgatgacacactttttctccgtcttgatggcccaggacgccttggaccaggatctcaacttc

SEQ ID NO: 126486 - DNA, 75 bp, Artificial Sequence
  Synthetic
gtgcgcatggttctgatgacacactttttctccgtcttgatgggccaggacgccttggaccaggatctcaacttc

SEQ ID NO: 126487 - DNA, 75 bp, Artificial Sequence
  Synthetic
gtgcgcatggtcctaatgacacactttttctccgtcttgatggaccaggacgccttggaccaggatctcaacttc

SEQ ID NO: 126488 - DNA, 75 bp, Artificial Sequence
  Synthetic
gtgcgcatggtcctaatgacacactttttctccgtcttgatggtccaggacgccttggaccaggatctcaacttc

SEQ ID NO: 126489 - DNA, 75 bp, Artificial Sequence
  Synthetic
gtgcgcatggtcctaatgacacactttttctccgtcttgatggcccaggacgccttggaccaggatctcaacttc

SEQ ID NO: 126490 - DNA, 75 bp, Artificial Sequence
  Synthetic
gtgcgcatggtcctaatgacacactttttctccgtcttgatgggccaggacgccttggaccaggatctcaacttc

SEQ ID NO: 126491 - DNA, 75 bp, Artificial Sequence
  Synthetic
gtgcgcatggtccttatgacacactttttctccgtcttgatggaccaggacgccttggaccaggatctcaacttc

SEQ ID NO: 126492 - DNA, 75 bp, Artificial Sequence
  Synthetic
gtgcgcatggtccttatgacacactttttctccgtcttgatggtccaggacgccttggaccaggatctcaacttc

SEQ ID NO: 126493 - DNA, 75 bp, Artificial Sequence
  Synthetic
gtgcgcatggtccttatgacacactttttctccgtcttgatggcccaggacgccttggaccaggatctcaacttc

SEQ ID NO: 126494 - DNA, 75 bp, Artificial Sequence
  Synthetic
gtgcgcatggtccttatgacacactttttctccgtcttgatgggccaggacgccttggaccaggatctcaacttc

SEQ ID NO: 126495 - DNA, 75 bp, Artificial Sequence
  Synthetic
gtgcgcatggtcctcatgacacactttttctccgtcttgatggaccaggacgccttggaccaggatctcaacttc

SEQ ID NO: 126496 - DNA, 75 bp, Artificial Sequence
  Synthetic
gtgcgcatggtcctcatgacacactttttctccgtcttgatggtccaggacgccttggaccaggatctcaacttc

SEQ ID NO: 126497 - DNA, 75 bp, Artificial Sequence
  Synthetic
gtgcgcatggtcctcatgacacactttttctccgtcttgatggcccaggacgccttggaccaggatctcaacttc

SEQ ID NO: 126498 - DNA, 75 bp, Artificial Sequence
  Synthetic
gtgcgcatggtcctcatgacacactttttctccgtcttgatgggccaggacgccttggaccaggatctcaacttc

SEQ ID NO: 126499 - DNA, 75 bp, Artificial Sequence
  Synthetic
gtgcgcatggtcctgatgacacactttttctccgtcttgatggaccaggacgccttggaccaggatctcaacttc

SEQ ID NO: 126500 - DNA, 75 bp, Artificial Sequence
  Synthetic
gtgcgcatggtcctgatgacacactttttctccgtcttgatggtccaggacgccttggaccaggatctcaacttc

SEQ ID NO: 126501 - DNA, 75 bp, Artificial Sequence
  Synthetic
gtgcgcatggtcctgatgacacactttttctccgtcttgatggcccaggacgccttggaccaggatctcaacttc

SEQ ID NO: 126502 - DNA, 75 bp, Artificial Sequence
  Synthetic
gtgcgcatggtcctgatgacacactttttctccgtcttgatgggccaggacgccttggaccaggatctcaacttc

SEQ ID NO: 126503 - DNA, 75 bp, Artificial Sequence
  Synthetic
gtgcgcatggtgctaatgacacactttttctccgtcttgatggaccaggacgccttggaccaggatctcaacttc

SEQ ID NO: 126504 - DNA, 75 bp, Artificial Sequence
  Synthetic
gtgcgcatggtgctaatgacacactttttctccgtcttgatggtccaggacgccttggaccaggatctcaacttc

SEQ ID NO: 126505 - DNA, 75 bp, Artificial Sequence
  Synthetic
gtgcgcatggtgctaatgacacactttttctccgtcttgatggcccaggacgccttggaccaggatctcaacttc

SEQ ID NO: 126506 - DNA, 75 bp, Artificial Sequence
  Synthetic
gtgcgcatggtgctaatgacacactttttctccgtcttgatgggccaggacgccttggaccaggatctcaacttc

SEQ ID NO: 126507 - DNA, 75 bp, Artificial Sequence
  Synthetic
gtgcgcatggtgcttatgacacactttttctccgtcttgatggaccaggacgccttggaccaggatctcaacttc

SEQ ID NO: 126508 - DNA, 75 bp, Artificial Sequence
  Synthetic
gtgcgcatggtgcttatgacacactttttctccgtcttgatggtccaggacgccttggaccaggatctcaacttc

SEQ ID NO: 126509 - DNA, 75 bp, Artificial Sequence
  Synthetic
gtgcgcatggtgcttatgacacactttttctccgtcttgatggcccaggacgccttggaccaggatctcaacttc

SEQ ID NO: 126510 - DNA, 75 bp, Artificial Sequence
  Synthetic
gtgcgcatggtgcttatgacacactttttctccgtcttgatgggccaggacgccttggaccaggatctcaacttc

SEQ ID NO: 126511 - DNA, 75 bp, Artificial Sequence
  Synthetic
gtgcgcatggtgctcatgacacactttttctccgtcttgatggaccaggacgccttggaccaggatctcaacttc

SEQ ID NO: 126512 - DNA, 75 bp, Artificial Sequence
  Synthetic
gtgcgcatggtgctcatgacacactttttctccgtcttgatggtccaggacgccttggaccaggatctcaacttc

SEQ ID NO: 126513 - DNA, 75 bp, Artificial Sequence
  Synthetic
gtgcgcatggtgctcatgacacactttttctccgtcttgatggcccaggacgccttggaccaggatctcaacttc

SEQ ID NO: 126514 - DNA, 75 bp, Artificial Sequence
  Synthetic
gtgcgcatggtgctcatgacacactttttctccgtcttgatgggccaggacgccttggaccaggatctcaacttc

SEQ ID NO: 126515 - DNA, 75 bp, Artificial Sequence
  Synthetic
gtgcgcatggtgctgatgacacactttttctccgtcttgatggaccaggacgccttggaccaggatctcaacttc

SEQ ID NO: 126516 - DNA, 75 bp, Artificial Sequence
  Synthetic
gtgcgcatggtgctgatgacacactttttctccgtcttgatggtccaggacgccttggaccaggatctcaacttc

SEQ ID NO: 126517 - DNA, 75 bp, Artificial Sequence
  Synthetic
gtgcgcatggtgctgatgacacactttttctccgtcttgatggcccaggacgccttggaccaggatctcaacttc

SEQ ID NO: 126518 - DNA, 75 bp, Artificial Sequence
  Synthetic
gtgcgcatggtgctgatgacacactttttctccgtcttgatgggccaggacgccttggaccaggatctcaacttc

SEQ ID NO: 126519 - DNA, 75 bp, Artificial Sequence
  Synthetic
tattggcgttgcctcaccgggccttcgcctttgatcgtgagcaggcagcttccatgggagcggcggtcttggctg

SEQ ID NO: 126520 - DNA, 75 bp, Artificial Sequence
  Synthetic
ctcttgtggtggacccaatacttcatagcgcggctagaagccatgctacatgtatgggtcccgggcctctccgtg

SEQ ID NO: 126521 - DNA, 75 bp, Artificial Sequence
  Synthetic
gacagctcttcactttccgacctcggcaacacactaccgtccaggagtgtaactgttccatctacaccgggcata

SEQ ID NO: 126522 - DNA, 75 bp, Artificial Sequence
  Synthetic
ctcttggcccttttagggccactgtaccttttccaggccagcttactccgcataccatattacgtgcgagctcat

SEQ ID NO: 126523 - DNA, 75 bp, Artificial Sequence
  Synthetic
gattgcccttgaggggcattggggtgtcatcggtgccttgctgtactacagcatggttgcgaactgggccaaggt

SEQ ID NO: 126524 - DNA, 75 bp, Artificial Sequence
  Synthetic
tccggcggcgcctacgacatcataatatgcgacgaatgccattcggtggattccacaaccattctcggtatcggg

SEQ ID NO: 126525 - DNA, 75 bp, Artificial Sequence
  Synthetic
atgaccacctagcacccctctctgactgggccagcgatggtttgcgcgagcttgccgttgccgttgagccagtca

SEQ ID NO: 126526 - DNA, 75 bp, Artificial Sequence
  Synthetic
ggtaggcatctacctccttcccaaccgatgaaggttgggataaacactccggcctcttaggccattcctgttttt

SEQ ID NO: 126527 - DNA, 75 bp, Artificial Sequence
  Synthetic
gggtccaagcaaaatgtccagctgattaagactaatggtagttggcatatcaacaggacagcactcaattgtaat

SEQ ID NO: 126528 - DNA, 75 bp, Artificial Sequence
  Synthetic
ttttttttttttttttttttttttttttcctcctttactttctctaacctattttctaacttggtggctccatct

SEQ ID NO: 126529 - DNA, 75 bp, Artificial Sequence
  Synthetic
gtggaagtcaggaacaccagcaattcctacatggagaccaacgattgctccaactccagcatcgtctggcagatt

SEQ ID NO: 126530 - DNA, 75 bp, Artificial Sequence
  Synthetic
gtggaagtcaggaacaccagcaattcctacatggagaccaacgattgctccaactccagcatcgtctggcagttt

SEQ ID NO: 126531 - DNA, 75 bp, Artificial Sequence
  Synthetic
gtggaagtcaggaacaccagcaattcctacatggagaccaacgattgctccaactccagcatcgtctggcagctt

SEQ ID NO: 126532 - DNA, 75 bp, Artificial Sequence
  Synthetic
gtggaagtcaggaacaccagcaattcctacatggagaccaacgattgctccaactccagcatcgtctggcaggtt

SEQ ID NO: 126533 - DNA, 75 bp, Artificial Sequence
  Synthetic
gtggaagtcaggaacaccagcaattcctacatggtgaccaacgattgctccaactccagcatcgtctggcagatt

SEQ ID NO: 126534 - DNA, 75 bp, Artificial Sequence
  Synthetic
gtggaagtcaggaacaccagcaattcctacatggtgaccaacgattgctccaactccagcatcgtctggcagttt

SEQ ID NO: 126535 - DNA, 75 bp, Artificial Sequence
  Synthetic
gtggaagtcaggaacaccagcaattcctacatggtgaccaacgattgctccaactccagcatcgtctggcagctt

SEQ ID NO: 126536 - DNA, 75 bp, Artificial Sequence
  Synthetic
gtggaagtcaggaacaccagcaattcctacatggtgaccaacgattgctccaactccagcatcgtctggcaggtt

SEQ ID NO: 126537 - DNA, 75 bp, Artificial Sequence
  Synthetic
gtggaagtcaggaacaccagcaattcctacatggcgaccaacgattgctccaactccagcatcgtctggcagatt

SEQ ID NO: 126538 - DNA, 75 bp, Artificial Sequence
  Synthetic
gtggaagtcaggaacaccagcaattcctacatggcgaccaacgattgctccaactccagcatcgtctggcagttt

SEQ ID NO: 126539 - DNA, 75 bp, Artificial Sequence
  Synthetic
gtggaagtcaggaacaccagcaattcctacatggcgaccaacgattgctccaactccagcatcgtctggcagctt

SEQ ID NO: 126540 - DNA, 75 bp, Artificial Sequence
  Synthetic
gtggaagtcaggaacaccagcaattcctacatggcgaccaacgattgctccaactccagcatcgtctggcaggtt

SEQ ID NO: 126541 - DNA, 75 bp, Artificial Sequence
  Synthetic
gtggaagtcaggaacaccagcaattcctacatggggaccaacgattgctccaactccagcatcgtctggcagatt

SEQ ID NO: 126542 - DNA, 75 bp, Artificial Sequence
  Synthetic
gtggaagtcaggaacaccagcaattcctacatggggaccaacgattgctccaactccagcatcgtctggcagttt

SEQ ID NO: 126543 - DNA, 75 bp, Artificial Sequence
  Synthetic
gtggaagtcaggaacaccagcaattcctacatggggaccaacgattgctccaactccagcatcgtctggcagctt

SEQ ID NO: 126544 - DNA, 75 bp, Artificial Sequence
  Synthetic
gtggaagtcaggaacaccagcaattcctacatggggaccaacgattgctccaactccagcatcgtctggcaggtt

SEQ ID NO: 126545 - DNA, 75 bp, Artificial Sequence
  Synthetic
gtggaagtcaggaacaccagcatttcctacatggagaccaacgattgctccaactccagcatcgtctggcagatt

SEQ ID NO: 126546 - DNA, 75 bp, Artificial Sequence
  Synthetic
gtggaagtcaggaacaccagcatttcctacatggagaccaacgattgctccaactccagcatcgtctggcagttt

SEQ ID NO: 126547 - DNA, 75 bp, Artificial Sequence
  Synthetic
gtggaagtcaggaacaccagcatttcctacatggagaccaacgattgctccaactccagcatcgtctggcagctt

SEQ ID NO: 126548 - DNA, 75 bp, Artificial Sequence
  Synthetic
gtggaagtcaggaacaccagcatttcctacatggagaccaacgattgctccaactccagcatcgtctggcaggtt

SEQ ID NO: 126549 - DNA, 75 bp, Artificial Sequence
  Synthetic
gtggaagtcaggaacaccagcatttcctacatggtgaccaacgattgctccaactccagcatcgtctggcagatt

SEQ ID NO: 126550 - DNA, 75 bp, Artificial Sequence
  Synthetic
gtggaagtcaggaacaccagcatttcctacatggtgaccaacgattgctccaactccagcatcgtctggcagttt

SEQ ID NO: 126551 - DNA, 75 bp, Artificial Sequence
  Synthetic
gtggaagtcaggaacaccagcatttcctacatggtgaccaacgattgctccaactccagcatcgtctggcagctt

SEQ ID NO: 126552 - DNA, 75 bp, Artificial Sequence
  Synthetic
gtggaagtcaggaacaccagcatttcctacatggtgaccaacgattgctccaactccagcatcgtctggcaggtt

SEQ ID NO: 126553 - DNA, 75 bp, Artificial Sequence
  Synthetic
gtggaagtcaggaacaccagcatttcctacatggcgaccaacgattgctccaactccagcatcgtctggcagatt

SEQ ID NO: 126554 - DNA, 75 bp, Artificial Sequence
  Synthetic
gtggaagtcaggaacaccagcatttcctacatggcgaccaacgattgctccaactccagcatcgtctggcagttt

SEQ ID NO: 126555 - DNA, 75 bp, Artificial Sequence
  Synthetic
gtggaagtcaggaacaccagcatttcctacatggcgaccaacgattgctccaactccagcatcgtctggcagctt

SEQ ID NO: 126556 - DNA, 75 bp, Artificial Sequence
  Synthetic
gtggaagtcaggaacaccagcatttcctacatggcgaccaacgattgctccaactccagcatcgtctggcaggtt

SEQ ID NO: 126557 - DNA, 75 bp, Artificial Sequence
  Synthetic
gtggaagtcaggaacaccagcatttcctacatggggaccaacgattgctccaactccagcatcgtctggcagatt

SEQ ID NO: 126558 - DNA, 75 bp, Artificial Sequence
  Synthetic
gtggaagtcaggaacaccagcatttcctacatggggaccaacgattgctccaactccagcatcgtctggcagttt

SEQ ID NO: 126559 - DNA, 75 bp, Artificial Sequence
  Synthetic
gtggaagtcaggaacaccagcatttcctacatggggaccaacgattgctccaactccagcatcgtctggcagctt

SEQ ID NO: 126560 - DNA, 75 bp, Artificial Sequence
  Synthetic
gtggaagtcaggaacaccagcatttcctacatggggaccaacgattgctccaactccagcatcgtctggcaggtt

SEQ ID NO: 126561 - DNA, 75 bp, Artificial Sequence
  Synthetic
gtggaagtcaggaacaccagcacttcctacatggagaccaacgattgctccaactccagcatcgtctggcagatt

SEQ ID NO: 126562 - DNA, 75 bp, Artificial Sequence
  Synthetic
gtggaagtcaggaacaccagcacttcctacatggagaccaacgattgctccaactccagcatcgtctggcagttt

SEQ ID NO: 126563 - DNA, 75 bp, Artificial Sequence
  Synthetic
gtggaagtcaggaacaccagcacttcctacatggagaccaacgattgctccaactccagcatcgtctggcagctt

SEQ ID NO: 126564 - DNA, 75 bp, Artificial Sequence
  Synthetic
gtggaagtcaggaacaccagcacttcctacatggagaccaacgattgctccaactccagcatcgtctggcaggtt

SEQ ID NO: 126565 - DNA, 75 bp, Artificial Sequence
  Synthetic
gtggaagtcaggaacaccagcacttcctacatggtgaccaacgattgctccaactccagcatcgtctggcagatt

SEQ ID NO: 126566 - DNA, 75 bp, Artificial Sequence
  Synthetic
gtggaagtcaggaacaccagcacttcctacatggtgaccaacgattgctccaactccagcatcgtctggcagttt

SEQ ID NO: 126567 - DNA, 75 bp, Artificial Sequence
  Synthetic
gtggaagtcaggaacaccagcacttcctacatggtgaccaacgattgctccaactccagcatcgtctggcagctt

SEQ ID NO: 126568 - DNA, 75 bp, Artificial Sequence
  Synthetic
gtggaagtcaggaacaccagcacttcctacatggtgaccaacgattgctccaactccagcatcgtctggcaggtt

SEQ ID NO: 126569 - DNA, 75 bp, Artificial Sequence
  Synthetic
gtggaagtcaggaacaccagcacttcctacatggcgaccaacgattgctccaactccagcatcgtctggcagatt

SEQ ID NO: 126570 - DNA, 75 bp, Artificial Sequence
  Synthetic
gtggaagtcaggaacaccagcacttcctacatggcgaccaacgattgctccaactccagcatcgtctggcagttt

SEQ ID NO: 126571 - DNA, 75 bp, Artificial Sequence
  Synthetic
gtggaagtcaggaacaccagcacttcctacatggcgaccaacgattgctccaactccagcatcgtctggcagctt

SEQ ID NO: 126572 - DNA, 75 bp, Artificial Sequence
  Synthetic
gtggaagtcaggaacaccagcacttcctacatggcgaccaacgattgctccaactccagcatcgtctggcaggtt

SEQ ID NO: 126573 - DNA, 75 bp, Artificial Sequence
  Synthetic
gtggaagtcaggaacaccagcacttcctacatggggaccaacgattgctccaactccagcatcgtctggcagatt

SEQ ID NO: 126574 - DNA, 75 bp, Artificial Sequence
  Synthetic
gtggaagtcaggaacaccagcacttcctacatggggaccaacgattgctccaactccagcatcgtctggcagttt

SEQ ID NO: 126575 - DNA, 75 bp, Artificial Sequence
  Synthetic
gtggaagtcaggaacaccagcacttcctacatggggaccaacgattgctccaactccagcatcgtctggcagctt

SEQ ID NO: 126576 - DNA, 75 bp, Artificial Sequence
  Synthetic
gtggaagtcaggaacaccagcacttcctacatggggaccaacgattgctccaactccagcatcgtctggcaggtt

SEQ ID NO: 126577 - DNA, 75 bp, Artificial Sequence
  Synthetic
gtggaagtcaggaacaccagcagttcctacatggagaccaacgattgctccaactccagcatcgtctggcagatt

SEQ ID NO: 126578 - DNA, 75 bp, Artificial Sequence
  Synthetic
gtggaagtcaggaacaccagcagttcctacatggagaccaacgattgctccaactccagcatcgtctggcagttt

SEQ ID NO: 126579 - DNA, 75 bp, Artificial Sequence
  Synthetic
gtggaagtcaggaacaccagcagttcctacatggagaccaacgattgctccaactccagcatcgtctggcagctt

SEQ ID NO: 126580 - DNA, 75 bp, Artificial Sequence
  Synthetic
gtggaagtcaggaacaccagcagttcctacatggagaccaacgattgctccaactccagcatcgtctggcaggtt

SEQ ID NO: 126581 - DNA, 75 bp, Artificial Sequence
  Synthetic
gtggaagtcaggaacaccagcagttcctacatggtgaccaacgattgctccaactccagcatcgtctggcagatt

SEQ ID NO: 126582 - DNA, 75 bp, Artificial Sequence
  Synthetic
gtggaagtcaggaacaccagcagttcctacatggtgaccaacgattgctccaactccagcatcgtctggcagttt

SEQ ID NO: 126583 - DNA, 75 bp, Artificial Sequence
  Synthetic
gtggaagtcaggaacaccagcagttcctacatggtgaccaacgattgctccaactccagcatcgtctggcagctt

SEQ ID NO: 126584 - DNA, 75 bp, Artificial Sequence
  Synthetic
gtggaagtcaggaacaccagcagttcctacatggtgaccaacgattgctccaactccagcatcgtctggcaggtt

SEQ ID NO: 126585 - DNA, 75 bp, Artificial Sequence
  Synthetic
gtggaagtcaggaacaccagcagttcctacatggcgaccaacgattgctccaactccagcatcgtctggcagatt

SEQ ID NO: 126586 - DNA, 75 bp, Artificial Sequence
  Synthetic
gtggaagtcaggaacaccagcagttcctacatggcgaccaacgattgctccaactccagcatcgtctggcagttt

SEQ ID NO: 126587 - DNA, 75 bp, Artificial Sequence
  Synthetic
gtggaagtcaggaacaccagcagttcctacatggcgaccaacgattgctccaactccagcatcgtctggcagctt

SEQ ID NO: 126588 - DNA, 75 bp, Artificial Sequence
  Synthetic
gtggaagtcaggaacaccagcagttcctacatggcgaccaacgattgctccaactccagcatcgtctggcaggtt

SEQ ID NO: 126589 - DNA, 75 bp, Artificial Sequence
  Synthetic
gtggaagtcaggaacaccagcagttcctacatggggaccaacgattgctccaactccagcatcgtctggcagatt

SEQ ID NO: 126590 - DNA, 75 bp, Artificial Sequence
  Synthetic
gtggaagtcaggaacaccagcagttcctacatggggaccaacgattgctccaactccagcatcgtctggcagttt

SEQ ID NO: 126591 - DNA, 75 bp, Artificial Sequence
  Synthetic
gtggaagtcaggaacaccagcagttcctacatggggaccaacgattgctccaactccagcatcgtctggcagctt

SEQ ID NO: 126592 - DNA, 75 bp, Artificial Sequence
  Synthetic
gtggaagtcaggaacaccagcagttcctacatggggaccaacgattgctccaactccagcatcgtctggcaggtt

SEQ ID NO: 126593 - DNA, 75 bp, Artificial Sequence
  Synthetic
agggattgcgagcgcacatcgatatcatcgtgatgtcagccacgctctgttctgccctttacgtgggggatatat

SEQ ID NO: 126594 - DNA, 75 bp, Artificial Sequence
  Synthetic
agggattgcgagcgcacatcgatatcatcgtgatgtcagccacgctctgttctgccctttacgtgggggatttat

SEQ ID NO: 126595 - DNA, 75 bp, Artificial Sequence
  Synthetic
agggattgcgagcgcacatcgatatcatcgtgatgtcagccacgctctgttctgccctttacgtgggggatctat

SEQ ID NO: 126596 - DNA, 75 bp, Artificial Sequence
  Synthetic
agggattgcgagcgcacatcgatatcatcgtgatgtcagccacgctctgttctgccctttacgtgggggatgtat

SEQ ID NO: 126597 - DNA, 75 bp, Artificial Sequence
  Synthetic
agggattgcgagcgcacatcgatatcatcgtgatgtctgccacgctctgttctgccctttacgtgggggatatat

SEQ ID NO: 126598 - DNA, 75 bp, Artificial Sequence
  Synthetic
agggattgcgagcgcacatcgatatcatcgtgatgtctgccacgctctgttctgccctttacgtgggggatttat

SEQ ID NO: 126599 - DNA, 75 bp, Artificial Sequence
  Synthetic
agggattgcgagcgcacatcgatatcatcgtgatgtctgccacgctctgttctgccctttacgtgggggatctat

SEQ ID NO: 126600 - DNA, 75 bp, Artificial Sequence
  Synthetic
agggattgcgagcgcacatcgatatcatcgtgatgtctgccacgctctgttctgccctttacgtgggggatgtat

SEQ ID NO: 126601 - DNA, 75 bp, Artificial Sequence
  Synthetic
agggattgcgagcgcacatcgatatcatcgtgatgtccgccacgctctgttctgccctttacgtgggggatatat

SEQ ID NO: 126602 - DNA, 75 bp, Artificial Sequence
  Synthetic
agggattgcgagcgcacatcgatatcatcgtgatgtccgccacgctctgttctgccctttacgtgggggatttat

SEQ ID NO: 126603 - DNA, 75 bp, Artificial Sequence
  Synthetic
agggattgcgagcgcacatcgatatcatcgtgatgtccgccacgctctgttctgccctttacgtgggggatctat

SEQ ID NO: 126604 - DNA, 75 bp, Artificial Sequence
  Synthetic
agggattgcgagcgcacatcgatatcatcgtgatgtccgccacgctctgttctgccctttacgtgggggatgtat

SEQ ID NO: 126605 - DNA, 75 bp, Artificial Sequence
  Synthetic
agggattgcgagcgcacatcgatatcatcgtgatgtcggccacgctctgttctgccctttacgtgggggatatat

SEQ ID NO: 126606 - DNA, 75 bp, Artificial Sequence
  Synthetic
agggattgcgagcgcacatcgatatcatcgtgatgtcggccacgctctgttctgccctttacgtgggggatttat

SEQ ID NO: 126607 - DNA, 75 bp, Artificial Sequence
  Synthetic
agggattgcgagcgcacatcgatatcatcgtgatgtcggccacgctctgttctgccctttacgtgggggatctat

SEQ ID NO: 126608 - DNA, 75 bp, Artificial Sequence
  Synthetic
agggattgcgagcgcacatcgatatcatcgtgatgtcggccacgctctgttctgccctttacgtgggggatgtat

SEQ ID NO: 126609 - DNA, 75 bp, Artificial Sequence
  Synthetic
agggattgcgagcgcacatcgatttcatcgtgatgtcagccacgctctgttctgccctttacgtgggggatatat

SEQ ID NO: 126610 - DNA, 75 bp, Artificial Sequence
  Synthetic
agggattgcgagcgcacatcgatttcatcgtgatgtcagccacgctctgttctgccctttacgtgggggatttat

SEQ ID NO: 126611 - DNA, 75 bp, Artificial Sequence
  Synthetic
agggattgcgagcgcacatcgatttcatcgtgatgtcagccacgctctgttctgccctttacgtgggggatctat

SEQ ID NO: 126612 - DNA, 75 bp, Artificial Sequence
  Synthetic
agggattgcgagcgcacatcgatttcatcgtgatgtcagccacgctctgttctgccctttacgtgggggatgtat

SEQ ID NO: 126613 - DNA, 75 bp, Artificial Sequence
  Synthetic
agggattgcgagcgcacatcgatttcatcgtgatgtctgccacgctctgttctgccctttacgtgggggatatat

SEQ ID NO: 126614 - DNA, 75 bp, Artificial Sequence
  Synthetic
agggattgcgagcgcacatcgatttcatcgtgatgtctgccacgctctgttctgccctttacgtgggggatttat

SEQ ID NO: 126615 - DNA, 75 bp, Artificial Sequence
  Synthetic
agggattgcgagcgcacatcgatttcatcgtgatgtctgccacgctctgttctgccctttacgtgggggatctat

SEQ ID NO: 126616 - DNA, 75 bp, Artificial Sequence
  Synthetic
agggattgcgagcgcacatcgatttcatcgtgatgtctgccacgctctgttctgccctttacgtgggggatgtat

SEQ ID NO: 126617 - DNA, 75 bp, Artificial Sequence
  Synthetic
agggattgcgagcgcacatcgatttcatcgtgatgtccgccacgctctgttctgccctttacgtgggggatatat

SEQ ID NO: 126618 - DNA, 75 bp, Artificial Sequence
  Synthetic
agggattgcgagcgcacatcgatttcatcgtgatgtccgccacgctctgttctgccctttacgtgggggatttat

SEQ ID NO: 126619 - DNA, 75 bp, Artificial Sequence
  Synthetic
agggattgcgagcgcacatcgatttcatcgtgatgtccgccacgctctgttctgccctttacgtgggggatctat

SEQ ID NO: 126620 - DNA, 75 bp, Artificial Sequence
  Synthetic
agggattgcgagcgcacatcgatttcatcgtgatgtccgccacgctctgttctgccctttacgtgggggatgtat

SEQ ID NO: 126621 - DNA, 75 bp, Artificial Sequence
  Synthetic
agggattgcgagcgcacatcgatttcatcgtgatgtcggccacgctctgttctgccctttacgtgggggatatat

SEQ ID NO: 126622 - DNA, 75 bp, Artificial Sequence
  Synthetic
agggattgcgagcgcacatcgatttcatcgtgatgtcggccacgctctgttctgccctttacgtgggggatttat

SEQ ID NO: 126623 - DNA, 75 bp, Artificial Sequence
  Synthetic
agggattgcgagcgcacatcgatttcatcgtgatgtcggccacgctctgttctgccctttacgtgggggatctat

SEQ ID NO: 126624 - DNA, 75 bp, Artificial Sequence
  Synthetic
agggattgcgagcgcacatcgatttcatcgtgatgtcggccacgctctgttctgccctttacgtgggggatgtat

SEQ ID NO: 126625 - DNA, 75 bp, Artificial Sequence
  Synthetic
agggattgcgagcgcacatcgatctcatcgtgatgtcagccacgctctgttctgccctttacgtgggggatatat

SEQ ID NO: 126626 - DNA, 75 bp, Artificial Sequence
  Synthetic
agggattgcgagcgcacatcgatctcatcgtgatgtcagccacgctctgttctgccctttacgtgggggatttat

SEQ ID NO: 126627 - DNA, 75 bp, Artificial Sequence
  Synthetic
agggattgcgagcgcacatcgatctcatcgtgatgtcagccacgctctgttctgccctttacgtgggggatctat

SEQ ID NO: 126628 - DNA, 75 bp, Artificial Sequence
  Synthetic
agggattgcgagcgcacatcgatctcatcgtgatgtcagccacgctctgttctgccctttacgtgggggatgtat

SEQ ID NO: 126629 - DNA, 75 bp, Artificial Sequence
  Synthetic
agggattgcgagcgcacatcgatctcatcgtgatgtctgccacgctctgttctgccctttacgtgggggatatat

SEQ ID NO: 126630 - DNA, 75 bp, Artificial Sequence
  Synthetic
agggattgcgagcgcacatcgatctcatcgtgatgtctgccacgctctgttctgccctttacgtgggggatttat

SEQ ID NO: 126631 - DNA, 75 bp, Artificial Sequence
  Synthetic
agggattgcgagcgcacatcgatctcatcgtgatgtctgccacgctctgttctgccctttacgtgggggatctat

SEQ ID NO: 126632 - DNA, 75 bp, Artificial Sequence
  Synthetic
agggattgcgagcgcacatcgatctcatcgtgatgtctgccacgctctgttctgccctttacgtgggggatgtat

SEQ ID NO: 126633 - DNA, 75 bp, Artificial Sequence
  Synthetic
agggattgcgagcgcacatcgatctcatcgtgatgtccgccacgctctgttctgccctttacgtgggggatatat

SEQ ID NO: 126634 - DNA, 75 bp, Artificial Sequence
  Synthetic
agggattgcgagcgcacatcgatctcatcgtgatgtccgccacgctctgttctgccctttacgtgggggatttat

SEQ ID NO: 126635 - DNA, 75 bp, Artificial Sequence
  Synthetic
agggattgcgagcgcacatcgatctcatcgtgatgtccgccacgctctgttctgccctttacgtgggggatctat

SEQ ID NO: 126636 - DNA, 75 bp, Artificial Sequence
  Synthetic
agggattgcgagcgcacatcgatctcatcgtgatgtccgccacgctctgttctgccctttacgtgggggatgtat

SEQ ID NO: 126637 - DNA, 75 bp, Artificial Sequence
  Synthetic
agggattgcgagcgcacatcgatctcatcgtgatgtcggccacgctctgttctgccctttacgtgggggatatat

SEQ ID NO: 126638 - DNA, 75 bp, Artificial Sequence
  Synthetic
agggattgcgagcgcacatcgatctcatcgtgatgtcggccacgctctgttctgccctttacgtgggggatttat

SEQ ID NO: 126639 - DNA, 75 bp, Artificial Sequence
  Synthetic
agggattgcgagcgcacatcgatctcatcgtgatgtcggccacgctctgttctgccctttacgtgggggatctat

SEQ ID NO: 126640 - DNA, 75 bp, Artificial Sequence
  Synthetic
agggattgcgagcgcacatcgatctcatcgtgatgtcggccacgctctgttctgccctttacgtgggggatgtat

SEQ ID NO: 126641 - DNA, 75 bp, Artificial Sequence
  Synthetic
agggattgcgagcgcacatcgatgtcatcgtgatgtcagccacgctctgttctgccctttacgtgggggatatat

SEQ ID NO: 126642 - DNA, 75 bp, Artificial Sequence
  Synthetic
agggattgcgagcgcacatcgatgtcatcgtgatgtcagccacgctctgttctgccctttacgtgggggatttat

SEQ ID NO: 126643 - DNA, 75 bp, Artificial Sequence
  Synthetic
agggattgcgagcgcacatcgatgtcatcgtgatgtcagccacgctctgttctgccctttacgtgggggatctat

SEQ ID NO: 126644 - DNA, 75 bp, Artificial Sequence
  Synthetic
agggattgcgagcgcacatcgatgtcatcgtgatgtcagccacgctctgttctgccctttacgtgggggatgtat

SEQ ID NO: 126645 - DNA, 75 bp, Artificial Sequence
  Synthetic
agggattgcgagcgcacatcgatgtcatcgtgatgtctgccacgctctgttctgccctttacgtgggggatatat

SEQ ID NO: 126646 - DNA, 75 bp, Artificial Sequence
  Synthetic
agggattgcgagcgcacatcgatgtcatcgtgatgtctgccacgctctgttctgccctttacgtgggggatttat

SEQ ID NO: 126647 - DNA, 75 bp, Artificial Sequence
  Synthetic
agggattgcgagcgcacatcgatgtcatcgtgatgtctgccacgctctgttctgccctttacgtgggggatctat

SEQ ID NO: 126648 - DNA, 75 bp, Artificial Sequence
  Synthetic
agggattgcgagcgcacatcgatgtcatcgtgatgtctgccacgctctgttctgccctttacgtgggggatgtat

SEQ ID NO: 126649 - DNA, 75 bp, Artificial Sequence
  Synthetic
agggattgcgagcgcacatcgatgtcatcgtgatgtccgccacgctctgttctgccctttacgtgggggatatat

SEQ ID NO: 126650 - DNA, 75 bp, Artificial Sequence
  Synthetic
agggattgcgagcgcacatcgatgtcatcgtgatgtccgccacgctctgttctgccctttacgtgggggatttat

SEQ ID NO: 126651 - DNA, 75 bp, Artificial Sequence
  Synthetic
agggattgcgagcgcacatcgatgtcatcgtgatgtccgccacgctctgttctgccctttacgtgggggatctat

SEQ ID NO: 126652 - DNA, 75 bp, Artificial Sequence
  Synthetic
agggattgcgagcgcacatcgatgtcatcgtgatgtccgccacgctctgttctgccctttacgtgggggatgtat

SEQ ID NO: 126653 - DNA, 75 bp, Artificial Sequence
  Synthetic
agggattgcgagcgcacatcgatgtcatcgtgatgtcggccacgctctgttctgccctttacgtgggggatatat

SEQ ID NO: 126654 - DNA, 75 bp, Artificial Sequence
  Synthetic
agggattgcgagcgcacatcgatgtcatcgtgatgtcggccacgctctgttctgccctttacgtgggggatttat

SEQ ID NO: 126655 - DNA, 75 bp, Artificial Sequence
  Synthetic
agggattgcgagcgcacatcgatgtcatcgtgatgtcggccacgctctgttctgccctttacgtgggggatctat

SEQ ID NO: 126656 - DNA, 75 bp, Artificial Sequence
  Synthetic
agggattgcgagcgcacatcgatgtcatcgtgatgtcggccacgctctgttctgccctttacgtgggggatgtat

SEQ ID NO: 126657 - DNA, 75 bp, Artificial Sequence
  Synthetic
cattcgagcagggttggggtcctctcacatacgctaacatcagcggaccatccaacgataagccatattgttggc

SEQ ID NO: 126658 - DNA, 75 bp, Artificial Sequence
  Synthetic
tccacgacaacggcagttggcacatcaatcgtacggcactgaactgcaatgatagcgtacaaaccggcttcttcg

SEQ ID NO: 126659 - DNA, 75 bp, Artificial Sequence
  Synthetic
tccacgacaacggcagttggcacatcaatcgtacggcactgaactgcaatgatagcgtacataccggcttcttcg

SEQ ID NO: 126660 - DNA, 75 bp, Artificial Sequence
  Synthetic
tccacgacaacggcagttggcacatcaatcgtacggcactgaactgcaatgatagcgtacacaccggcttcttcg

SEQ ID NO: 126661 - DNA, 75 bp, Artificial Sequence
  Synthetic
tccacgacaacggcagttggcacatcaatcgtacggcactgaactgcaatgatagcgtacagaccggcttcttcg

SEQ ID NO: 126662 - DNA, 75 bp, Artificial Sequence
  Synthetic
tccacgacaacggcagttggcacatcaatcgtacggctctgaactgcaatgatagcgtacaaaccggcttcttcg

SEQ ID NO: 126663 - DNA, 75 bp, Artificial Sequence
  Synthetic
tccacgacaacggcagttggcacatcaatcgtacggctctgaactgcaatgatagcgtacataccggcttcttcg

SEQ ID NO: 126664 - DNA, 75 bp, Artificial Sequence
  Synthetic
tccacgacaacggcagttggcacatcaatcgtacggctctgaactgcaatgatagcgtacacaccggcttcttcg

SEQ ID NO: 126665 - DNA, 75 bp, Artificial Sequence
  Synthetic
tccacgacaacggcagttggcacatcaatcgtacggctctgaactgcaatgatagcgtacagaccggcttcttcg

SEQ ID NO: 126666 - DNA, 75 bp, Artificial Sequence
  Synthetic
tccacgacaacggcagttggcacatcaatcgtacggccctgaactgcaatgatagcgtacaaaccggcttcttcg

SEQ ID NO: 126667 - DNA, 75 bp, Artificial Sequence
  Synthetic
tccacgacaacggcagttggcacatcaatcgtacggccctgaactgcaatgatagcgtacataccggcttcttcg

SEQ ID NO: 126668 - DNA, 75 bp, Artificial Sequence
  Synthetic
tccacgacaacggcagttggcacatcaatcgtacggccctgaactgcaatgatagcgtacacaccggcttcttcg

SEQ ID NO: 126669 - DNA, 75 bp, Artificial Sequence
  Synthetic
tccacgacaacggcagttggcacatcaatcgtacggccctgaactgcaatgatagcgtacagaccggcttcttcg

SEQ ID NO: 126670 - DNA, 75 bp, Artificial Sequence
  Synthetic
tccacgacaacggcagttggcacatcaatcgtacggcgctgaactgcaatgatagcgtacaaaccggcttcttcg

SEQ ID NO: 126671 - DNA, 75 bp, Artificial Sequence
  Synthetic
tccacgacaacggcagttggcacatcaatcgtacggcgctgaactgcaatgatagcgtacataccggcttcttcg

SEQ ID NO: 126672 - DNA, 75 bp, Artificial Sequence
  Synthetic
tccacgacaacggcagttggcacatcaatcgtacggcgctgaactgcaatgatagcgtacacaccggcttcttcg

SEQ ID NO: 126673 - DNA, 75 bp, Artificial Sequence
  Synthetic
tccacgacaacggcagttggcacatcaatcgtacggcgctgaactgcaatgatagcgtacagaccggcttcttcg

SEQ ID NO: 126674 - DNA, 75 bp, Artificial Sequence
  Synthetic
tccacgtcaacggcagttggcacatcaatcgtacggcactgaactgcaatgatagcgtacaaaccggcttcttcg

SEQ ID NO: 126675 - DNA, 75 bp, Artificial Sequence
  Synthetic
tccacgtcaacggcagttggcacatcaatcgtacggcactgaactgcaatgatagcgtacataccggcttcttcg

SEQ ID NO: 126676 - DNA, 75 bp, Artificial Sequence
  Synthetic
tccacgtcaacggcagttggcacatcaatcgtacggcactgaactgcaatgatagcgtacacaccggcttcttcg

SEQ ID NO: 126677 - DNA, 75 bp, Artificial Sequence
  Synthetic
tccacgtcaacggcagttggcacatcaatcgtacggcactgaactgcaatgatagcgtacagaccggcttcttcg

SEQ ID NO: 126678 - DNA, 75 bp, Artificial Sequence
  Synthetic
tccacgtcaacggcagttggcacatcaatcgtacggctctgaactgcaatgatagcgtacaaaccggcttcttcg

SEQ ID NO: 126679 - DNA, 75 bp, Artificial Sequence
  Synthetic
tccacgtcaacggcagttggcacatcaatcgtacggctctgaactgcaatgatagcgtacataccggcttcttcg

SEQ ID NO: 126680 - DNA, 75 bp, Artificial Sequence
  Synthetic
tccacgtcaacggcagttggcacatcaatcgtacggctctgaactgcaatgatagcgtacacaccggcttcttcg

SEQ ID NO: 126681 - DNA, 75 bp, Artificial Sequence
  Synthetic
tccacgtcaacggcagttggcacatcaatcgtacggctctgaactgcaatgatagcgtacagaccggcttcttcg

SEQ ID NO: 126682 - DNA, 75 bp, Artificial Sequence
  Synthetic
tccacgtcaacggcagttggcacatcaatcgtacggccctgaactgcaatgatagcgtacaaaccggcttcttcg

SEQ ID NO: 126683 - DNA, 75 bp, Artificial Sequence
  Synthetic
tccacgtcaacggcagttggcacatcaatcgtacggccctgaactgcaatgatagcgtacataccggcttcttcg

SEQ ID NO: 126684 - DNA, 75 bp, Artificial Sequence
  Synthetic
tccacgtcaacggcagttggcacatcaatcgtacggccctgaactgcaatgatagcgtacacaccggcttcttcg

SEQ ID NO: 126685 - DNA, 75 bp, Artificial Sequence
  Synthetic
tccacgtcaacggcagttggcacatcaatcgtacggccctgaactgcaatgatagcgtacagaccggcttcttcg

SEQ ID NO: 126686 - DNA, 75 bp, Artificial Sequence
  Synthetic
tccacgtcaacggcagttggcacatcaatcgtacggcgctgaactgcaatgatagcgtacaaaccggcttcttcg

SEQ ID NO: 126687 - DNA, 75 bp, Artificial Sequence
  Synthetic
tccacgtcaacggcagttggcacatcaatcgtacggcgctgaactgcaatgatagcgtacataccggcttcttcg

SEQ ID NO: 126688 - DNA, 75 bp, Artificial Sequence
  Synthetic
tccacgtcaacggcagttggcacatcaatcgtacggcgctgaactgcaatgatagcgtacacaccggcttcttcg

SEQ ID NO: 126689 - DNA, 75 bp, Artificial Sequence
  Synthetic
tccacgtcaacggcagttggcacatcaatcgtacggcgctgaactgcaatgatagcgtacagaccggcttcttcg

SEQ ID NO: 126690 - DNA, 75 bp, Artificial Sequence
  Synthetic
tccacgccaacggcagttggcacatcaatcgtacggcactgaactgcaatgatagcgtacaaaccggcttcttcg

SEQ ID NO: 126691 - DNA, 75 bp, Artificial Sequence
  Synthetic
tccacgccaacggcagttggcacatcaatcgtacggcactgaactgcaatgatagcgtacataccggcttcttcg

SEQ ID NO: 126692 - DNA, 75 bp, Artificial Sequence
  Synthetic
tccacgccaacggcagttggcacatcaatcgtacggcactgaactgcaatgatagcgtacacaccggcttcttcg

SEQ ID NO: 126693 - DNA, 75 bp, Artificial Sequence
  Synthetic
tccacgccaacggcagttggcacatcaatcgtacggcactgaactgcaatgatagcgtacagaccggcttcttcg

SEQ ID NO: 126694 - DNA, 75 bp, Artificial Sequence
  Synthetic
tccacgccaacggcagttggcacatcaatcgtacggctctgaactgcaatgatagcgtacaaaccggcttcttcg

SEQ ID NO: 126695 - DNA, 75 bp, Artificial Sequence
  Synthetic
tccacgccaacggcagttggcacatcaatcgtacggctctgaactgcaatgatagcgtacataccggcttcttcg

SEQ ID NO: 126696 - DNA, 75 bp, Artificial Sequence
  Synthetic
tccacgccaacggcagttggcacatcaatcgtacggctctgaactgcaatgatagcgtacacaccggcttcttcg

SEQ ID NO: 126697 - DNA, 75 bp, Artificial Sequence
  Synthetic
tccacgccaacggcagttggcacatcaatcgtacggctctgaactgcaatgatagcgtacagaccggcttcttcg

SEQ ID NO: 126698 - DNA, 75 bp, Artificial Sequence
  Synthetic
tccacgccaacggcagttggcacatcaatcgtacggccctgaactgcaatgatagcgtacaaaccggcttcttcg

SEQ ID NO: 126699 - DNA, 75 bp, Artificial Sequence
  Synthetic
tccacgccaacggcagttggcacatcaatcgtacggccctgaactgcaatgatagcgtacataccggcttcttcg

SEQ ID NO: 126700 - DNA, 75 bp, Artificial Sequence
  Synthetic
tccacgccaacggcagttggcacatcaatcgtacggccctgaactgcaatgatagcgtacacaccggcttcttcg

SEQ ID NO: 126701 - DNA, 75 bp, Artificial Sequence
  Synthetic
tccacgccaacggcagttggcacatcaatcgtacggccctgaactgcaatgatagcgtacagaccggcttcttcg

SEQ ID NO: 126702 - DNA, 75 bp, Artificial Sequence
  Synthetic
tccacgccaacggcagttggcacatcaatcgtacggcgctgaactgcaatgatagcgtacaaaccggcttcttcg

SEQ ID NO: 126703 - DNA, 75 bp, Artificial Sequence
  Synthetic
tccacgccaacggcagttggcacatcaatcgtacggcgctgaactgcaatgatagcgtacataccggcttcttcg

SEQ ID NO: 126704 - DNA, 75 bp, Artificial Sequence
  Synthetic
tccacgccaacggcagttggcacatcaatcgtacggcgctgaactgcaatgatagcgtacacaccggcttcttcg

SEQ ID NO: 126705 - DNA, 75 bp, Artificial Sequence
  Synthetic
tccacgccaacggcagttggcacatcaatcgtacggcgctgaactgcaatgatagcgtacagaccggcttcttcg

SEQ ID NO: 126706 - DNA, 75 bp, Artificial Sequence
  Synthetic
tccacggcaacggcagttggcacatcaatcgtacggcactgaactgcaatgatagcgtacaaaccggcttcttcg

SEQ ID NO: 126707 - DNA, 75 bp, Artificial Sequence
  Synthetic
tccacggcaacggcagttggcacatcaatcgtacggcactgaactgcaatgatagcgtacataccggcttcttcg

SEQ ID NO: 126708 - DNA, 75 bp, Artificial Sequence
  Synthetic
tccacggcaacggcagttggcacatcaatcgtacggcactgaactgcaatgatagcgtacacaccggcttcttcg

SEQ ID NO: 126709 - DNA, 75 bp, Artificial Sequence
  Synthetic
tccacggcaacggcagttggcacatcaatcgtacggcactgaactgcaatgatagcgtacagaccggcttcttcg

SEQ ID NO: 126710 - DNA, 75 bp, Artificial Sequence
  Synthetic
tccacggcaacggcagttggcacatcaatcgtacggctctgaactgcaatgatagcgtacaaaccggcttcttcg

SEQ ID NO: 126711 - DNA, 75 bp, Artificial Sequence
  Synthetic
tccacggcaacggcagttggcacatcaatcgtacggctctgaactgcaatgatagcgtacataccggcttcttcg

SEQ ID NO: 126712 - DNA, 75 bp, Artificial Sequence
  Synthetic
tccacggcaacggcagttggcacatcaatcgtacggctctgaactgcaatgatagcgtacacaccggcttcttcg

SEQ ID NO: 126713 - DNA, 75 bp, Artificial Sequence
  Synthetic
tccacggcaacggcagttggcacatcaatcgtacggctctgaactgcaatgatagcgtacagaccggcttcttcg

SEQ ID NO: 126714 - DNA, 75 bp, Artificial Sequence
  Synthetic
tccacggcaacggcagttggcacatcaatcgtacggccctgaactgcaatgatagcgtacaaaccggcttcttcg

SEQ ID NO: 126715 - DNA, 75 bp, Artificial Sequence
  Synthetic
tccacggcaacggcagttggcacatcaatcgtacggccctgaactgcaatgatagcgtacataccggcttcttcg

SEQ ID NO: 126716 - DNA, 75 bp, Artificial Sequence
  Synthetic
tccacggcaacggcagttggcacatcaatcgtacggccctgaactgcaatgatagcgtacacaccggcttcttcg

SEQ ID NO: 126717 - DNA, 75 bp, Artificial Sequence
  Synthetic
tccacggcaacggcagttggcacatcaatcgtacggccctgaactgcaatgatagcgtacagaccggcttcttcg

SEQ ID NO: 126718 - DNA, 75 bp, Artificial Sequence
  Synthetic
tccacggcaacggcagttggcacatcaatcgtacggcgctgaactgcaatgatagcgtacaaaccggcttcttcg

SEQ ID NO: 126719 - DNA, 75 bp, Artificial Sequence
  Synthetic
tccacggcaacggcagttggcacatcaatcgtacggcgctgaactgcaatgatagcgtacataccggcttcttcg

SEQ ID NO: 126720 - DNA, 75 bp, Artificial Sequence
  Synthetic
tccacggcaacggcagttggcacatcaatcgtacggcgctgaactgcaatgatagcgtacacaccggcttcttcg

SEQ ID NO: 126721 - DNA, 75 bp, Artificial Sequence
  Synthetic
tccacggcaacggcagttggcacatcaatcgtacggcgctgaactgcaatgatagcgtacagaccggcttcttcg

SEQ ID NO: 126722 - DNA, 75 bp, Artificial Sequence
  Synthetic
cttagtccacggcccattagcaccctgaaagggtcatcgggaggccccatactatgcccatccggccacgctgtg

SEQ ID NO: 126723 - DNA, 75 bp, Artificial Sequence
  Synthetic
cagggccatggttaacaccccggtgcctggtccactacccctacagactgtggcattacccatgcacagtcaatt

SEQ ID NO: 126724 - DNA, 75 bp, Artificial Sequence
  Synthetic
cagggccatggttaacaccccggtgcctggtccactacccctacagactgtggcattacccttgcacagtcaatt

SEQ ID NO: 126725 - DNA, 75 bp, Artificial Sequence
  Synthetic
cagggccatggttaacaccccggtgcctggtccactacccctacagactgtggcattacccctgcacagtcaatt

SEQ ID NO: 126726 - DNA, 75 bp, Artificial Sequence
  Synthetic
cagggccatggttaacaccccggtgcctggtccactacccctacagactgtggcattacccgtgcacagtcaatt

SEQ ID NO: 126727 - DNA, 75 bp, Artificial Sequence
  Synthetic
cagggccatggttaactccccggtgcctggtccactacccctacagactgtggcattacccatgcacagtcaatt

SEQ ID NO: 126728 - DNA, 75 bp, Artificial Sequence
  Synthetic
cagggccatggttaactccccggtgcctggtccactacccctacagactgtggcattacccttgcacagtcaatt

SEQ ID NO: 126729 - DNA, 75 bp, Artificial Sequence
  Synthetic
cagggccatggttaactccccggtgcctggtccactacccctacagactgtggcattacccctgcacagtcaatt

SEQ ID NO: 126730 - DNA, 75 bp, Artificial Sequence
  Synthetic
cagggccatggttaactccccggtgcctggtccactacccctacagactgtggcattacccgtgcacagtcaatt

SEQ ID NO: 126731 - DNA, 75 bp, Artificial Sequence
  Synthetic
cagggccatggttaaccccccggtgcctggtccactacccctacagactgtggcattacccatgcacagtcaatt

SEQ ID NO: 126732 - DNA, 75 bp, Artificial Sequence
  Synthetic
cagggccatggttaaccccccggtgcctggtccactacccctacagactgtggcattacccttgcacagtcaatt

SEQ ID NO: 126733 - DNA, 75 bp, Artificial Sequence
  Synthetic
cagggccatggttaaccccccggtgcctggtccactacccctacagactgtggcattacccctgcacagtcaatt

SEQ ID NO: 126734 - DNA, 75 bp, Artificial Sequence
  Synthetic
cagggccatggttaaccccccggtgcctggtccactacccctacagactgtggcattacccgtgcacagtcaatt

SEQ ID NO: 126735 - DNA, 75 bp, Artificial Sequence
  Synthetic
cagggccatggttaacgccccggtgcctggtccactacccctacagactgtggcattacccatgcacagtcaatt

SEQ ID NO: 126736 - DNA, 75 bp, Artificial Sequence
  Synthetic
cagggccatggttaacgccccggtgcctggtccactacccctacagactgtggcattacccttgcacagtcaatt

SEQ ID NO: 126737 - DNA, 75 bp, Artificial Sequence
  Synthetic
cagggccatggttaacgccccggtgcctggtccactacccctacagactgtggcattacccctgcacagtcaatt

SEQ ID NO: 126738 - DNA, 75 bp, Artificial Sequence
  Synthetic
cagggccatggttaacgccccggtgcctggtccactacccctacagactgtggcattacccgtgcacagtcaatt

SEQ ID NO: 126739 - DNA, 75 bp, Artificial Sequence
  Synthetic
ctgggccatggttaacaccccggtgcctggtccactacccctacagactgtggcattacccatgcacagtcaatt

SEQ ID NO: 126740 - DNA, 75 bp, Artificial Sequence
  Synthetic
ctgggccatggttaacaccccggtgcctggtccactacccctacagactgtggcattacccttgcacagtcaatt

SEQ ID NO: 126741 - DNA, 75 bp, Artificial Sequence
  Synthetic
ctgggccatggttaacaccccggtgcctggtccactacccctacagactgtggcattacccctgcacagtcaatt

SEQ ID NO: 126742 - DNA, 75 bp, Artificial Sequence
  Synthetic
ctgggccatggttaacaccccggtgcctggtccactacccctacagactgtggcattacccgtgcacagtcaatt

SEQ ID NO: 126743 - DNA, 75 bp, Artificial Sequence
  Synthetic
ctgggccatggttaactccccggtgcctggtccactacccctacagactgtggcattacccatgcacagtcaatt

SEQ ID NO: 126744 - DNA, 75 bp, Artificial Sequence
  Synthetic
ctgggccatggttaactccccggtgcctggtccactacccctacagactgtggcattacccttgcacagtcaatt

SEQ ID NO: 126745 - DNA, 75 bp, Artificial Sequence
  Synthetic
ctgggccatggttaactccccggtgcctggtccactacccctacagactgtggcattacccctgcacagtcaatt

SEQ ID NO: 126746 - DNA, 75 bp, Artificial Sequence
  Synthetic
ctgggccatggttaactccccggtgcctggtccactacccctacagactgtggcattacccgtgcacagtcaatt

SEQ ID NO: 126747 - DNA, 75 bp, Artificial Sequence
  Synthetic
ctgggccatggttaaccccccggtgcctggtccactacccctacagactgtggcattacccatgcacagtcaatt

SEQ ID NO: 126748 - DNA, 75 bp, Artificial Sequence
  Synthetic
ctgggccatggttaaccccccggtgcctggtccactacccctacagactgtggcattacccttgcacagtcaatt

SEQ ID NO: 126749 - DNA, 75 bp, Artificial Sequence
  Synthetic
ctgggccatggttaaccccccggtgcctggtccactacccctacagactgtggcattacccctgcacagtcaatt

SEQ ID NO: 126750 - DNA, 75 bp, Artificial Sequence
  Synthetic
ctgggccatggttaaccccccggtgcctggtccactacccctacagactgtggcattacccgtgcacagtcaatt

SEQ ID NO: 126751 - DNA, 75 bp, Artificial Sequence
  Synthetic
ctgggccatggttaacgccccggtgcctggtccactacccctacagactgtggcattacccatgcacagtcaatt

SEQ ID NO: 126752 - DNA, 75 bp, Artificial Sequence
  Synthetic
ctgggccatggttaacgccccggtgcctggtccactacccctacagactgtggcattacccttgcacagtcaatt

SEQ ID NO: 126753 - DNA, 75 bp, Artificial Sequence
  Synthetic
ctgggccatggttaacgccccggtgcctggtccactacccctacagactgtggcattacccctgcacagtcaatt

SEQ ID NO: 126754 - DNA, 75 bp, Artificial Sequence
  Synthetic
ctgggccatggttaacgccccggtgcctggtccactacccctacagactgtggcattacccgtgcacagtcaatt

SEQ ID NO: 126755 - DNA, 75 bp, Artificial Sequence
  Synthetic
ccgggccatggttaacaccccggtgcctggtccactacccctacagactgtggcattacccatgcacagtcaatt

SEQ ID NO: 126756 - DNA, 75 bp, Artificial Sequence
  Synthetic
ccgggccatggttaacaccccggtgcctggtccactacccctacagactgtggcattacccttgcacagtcaatt

SEQ ID NO: 126757 - DNA, 75 bp, Artificial Sequence
  Synthetic
ccgggccatggttaacaccccggtgcctggtccactacccctacagactgtggcattacccctgcacagtcaatt

SEQ ID NO: 126758 - DNA, 75 bp, Artificial Sequence
  Synthetic
ccgggccatggttaacaccccggtgcctggtccactacccctacagactgtggcattacccgtgcacagtcaatt

SEQ ID NO: 126759 - DNA, 75 bp, Artificial Sequence
  Synthetic
ccgggccatggttaactccccggtgcctggtccactacccctacagactgtggcattacccatgcacagtcaatt

SEQ ID NO: 126760 - DNA, 75 bp, Artificial Sequence
  Synthetic
ccgggccatggttaactccccggtgcctggtccactacccctacagactgtggcattacccttgcacagtcaatt

SEQ ID NO: 126761 - DNA, 75 bp, Artificial Sequence
  Synthetic
ccgggccatggttaactccccggtgcctggtccactacccctacagactgtggcattacccctgcacagtcaatt

SEQ ID NO: 126762 - DNA, 75 bp, Artificial Sequence
  Synthetic
ccgggccatggttaactccccggtgcctggtccactacccctacagactgtggcattacccgtgcacagtcaatt

SEQ ID NO: 126763 - DNA, 75 bp, Artificial Sequence
  Synthetic
ccgggccatggttaaccccccggtgcctggtccactacccctacagactgtggcattacccatgcacagtcaatt

SEQ ID NO: 126764 - DNA, 75 bp, Artificial Sequence
  Synthetic
ccgggccatggttaaccccccggtgcctggtccactacccctacagactgtggcattacccttgcacagtcaatt

SEQ ID NO: 126765 - DNA, 75 bp, Artificial Sequence
  Synthetic
ccgggccatggttaaccccccggtgcctggtccactacccctacagactgtggcattacccctgcacagtcaatt

SEQ ID NO: 126766 - DNA, 75 bp, Artificial Sequence
  Synthetic
ccgggccatggttaaccccccggtgcctggtccactacccctacagactgtggcattacccgtgcacagtcaatt

SEQ ID NO: 126767 - DNA, 75 bp, Artificial Sequence
  Synthetic
ccgggccatggttaacgccccggtgcctggtccactacccctacagactgtggcattacccatgcacagtcaatt

SEQ ID NO: 126768 - DNA, 75 bp, Artificial Sequence
  Synthetic
ccgggccatggttaacgccccggtgcctggtccactacccctacagactgtggcattacccttgcacagtcaatt

SEQ ID NO: 126769 - DNA, 75 bp, Artificial Sequence
  Synthetic
ccgggccatggttaacgccccggtgcctggtccactacccctacagactgtggcattacccctgcacagtcaatt

SEQ ID NO: 126770 - DNA, 75 bp, Artificial Sequence
  Synthetic
ccgggccatggttaacgccccggtgcctggtccactacccctacagactgtggcattacccgtgcacagtcaatt

SEQ ID NO: 126771 - DNA, 75 bp, Artificial Sequence
  Synthetic
cggggccatggttaacaccccggtgcctggtccactacccctacagactgtggcattacccatgcacagtcaatt

SEQ ID NO: 126772 - DNA, 75 bp, Artificial Sequence
  Synthetic
cggggccatggttaacaccccggtgcctggtccactacccctacagactgtggcattacccttgcacagtcaatt

SEQ ID NO: 126773 - DNA, 75 bp, Artificial Sequence
  Synthetic
cggggccatggttaacaccccggtgcctggtccactacccctacagactgtggcattacccctgcacagtcaatt

SEQ ID NO: 126774 - DNA, 75 bp, Artificial Sequence
  Synthetic
cggggccatggttaacaccccggtgcctggtccactacccctacagactgtggcattacccgtgcacagtcaatt

SEQ ID NO: 126775 - DNA, 75 bp, Artificial Sequence
  Synthetic
cggggccatggttaactccccggtgcctggtccactacccctacagactgtggcattacccatgcacagtcaatt

SEQ ID NO: 126776 - DNA, 75 bp, Artificial Sequence
  Synthetic
cggggccatggttaactccccggtgcctggtccactacccctacagactgtggcattacccttgcacagtcaatt

SEQ ID NO: 126777 - DNA, 75 bp, Artificial Sequence
  Synthetic
cggggccatggttaactccccggtgcctggtccactacccctacagactgtggcattacccctgcacagtcaatt

SEQ ID NO: 126778 - DNA, 75 bp, Artificial Sequence
  Synthetic
cggggccatggttaactccccggtgcctggtccactacccctacagactgtggcattacccgtgcacagtcaatt

SEQ ID NO: 126779 - DNA, 75 bp, Artificial Sequence
  Synthetic
cggggccatggttaaccccccggtgcctggtccactacccctacagactgtggcattacccatgcacagtcaatt

SEQ ID NO: 126780 - DNA, 75 bp, Artificial Sequence
  Synthetic
cggggccatggttaaccccccggtgcctggtccactacccctacagactgtggcattacccttgcacagtcaatt

SEQ ID NO: 126781 - DNA, 75 bp, Artificial Sequence
  Synthetic
cggggccatggttaaccccccggtgcctggtccactacccctacagactgtggcattacccctgcacagtcaatt

SEQ ID NO: 126782 - DNA, 75 bp, Artificial Sequence
  Synthetic
cggggccatggttaaccccccggtgcctggtccactacccctacagactgtggcattacccgtgcacagtcaatt

SEQ ID NO: 126783 - DNA, 75 bp, Artificial Sequence
  Synthetic
cggggccatggttaacgccccggtgcctggtccactacccctacagactgtggcattacccatgcacagtcaatt

SEQ ID NO: 126784 - DNA, 75 bp, Artificial Sequence
  Synthetic
cggggccatggttaacgccccggtgcctggtccactacccctacagactgtggcattacccttgcacagtcaatt

SEQ ID NO: 126785 - DNA, 75 bp, Artificial Sequence
  Synthetic
cggggccatggttaacgccccggtgcctggtccactacccctacagactgtggcattacccctgcacagtcaatt

SEQ ID NO: 126786 - DNA, 75 bp, Artificial Sequence
  Synthetic
cggggccatggttaacgccccggtgcctggtccactacccctacagactgtggcattacccgtgcacagtcaatt

SEQ ID NO: 126787 - DNA, 75 bp, Artificial Sequence
  Synthetic
gaaagggctccccacatacacctggggggcaaatgagtctgatgtgttcctgctgcggagcaccaggccccctcg

SEQ ID NO: 126788 - DNA, 75 bp, Artificial Sequence
  Synthetic
gtggcggtcactcaggtcgtggatttcagtctggaccctacttttaccataactacacagactgtcccccaggac

SEQ ID NO: 126789 - DNA, 75 bp, Artificial Sequence
  Synthetic
ggtggggtggccggctccaccgggtgccaagtccctgacgccttgcacttgcggtgggtgcgacctttatctggt

SEQ ID NO: 126790 - DNA, 75 bp, Artificial Sequence
  Synthetic
agtggatgaacaggctcatagcctttgcctctaggggcaaccacgtgtctccgacgcactacgtccctgagactg

SEQ ID NO: 126791 - DNA, 75 bp, Artificial Sequence
  Synthetic
accttggtgtgtcctaccgactgtttccggaagcacccagaagccacatatgcgaggtgtgggtcaggcccttgg

SEQ ID NO: 126792 - DNA, 75 bp, Artificial Sequence
  Synthetic
ccgtggtgctctgtgagtgctacgacgccggcgcggcctggtacgagctcaccccggcagaaaccaccgtcaggc

SEQ ID NO: 126793 - DNA, 75 bp, Artificial Sequence
  Synthetic
accccggcagaaaccaccgtcaggctgcgggcatacttcaacacacctggattgcccgtgtgccaagaccacctg

SEQ ID NO: 126794 - DNA, 75 bp, Artificial Sequence
  Synthetic
cgtgtgcacccgaggtgttgctaaggcaattgacttcgtgcctgtggagaatatggagaccacaatgaggtctcc

SEQ ID NO: 126795 - DNA, 75 bp, Artificial Sequence
  Synthetic
gcgggtgggggatttccactacgtgacgggcatgaccactgacaacgtaaagtgcccatgccaggttccggcccc

SEQ ID NO: 126796 - DNA, 75 bp, Artificial Sequence
  Synthetic
cagacttcaaaacctggctcaaagcaaaactcgttccagcgctgccaggcgtcccctttttctcgtgccaacgag

SEQ ID NO: 126797 - DNA, 75 bp, Artificial Sequence
  Synthetic
ttgagcatcggtttgaagctgcttgcaactggactcgtggggaacggtgcgagctggatgatagagacagggttg

SEQ ID NO: 126798 - DNA, 75 bp, Artificial Sequence
  Synthetic
cccgcagtgccacaaacataccaggtggggtatttacatgccccgactggtagcgggaagagcacgaaagtgcca

SEQ ID NO: 126799 - DNA, 75 bp, Artificial Sequence
  Synthetic
atcaggccacggtgtgcgccagagccaaagctccccccccatcctgggatgttatgtggaagtgcctgatccggc

SEQ ID NO: 126800 - DNA, 75 bp, Artificial Sequence
  Synthetic
cacggcctattcccaacagacgcggggcctacttggctgtatcatcactagcctcacaggccgagacaagaacca

SEQ ID NO: 126801 - DNA, 75 bp, Artificial Sequence
  Synthetic
gaacattgtagacgttcagtatctctatggagtctcttcggccgtagtgtcgtgggctgtgaagtgggaatacat

SEQ ID NO: 126802 - DNA, 75 bp, Artificial Sequence
  Synthetic
tacatgagcaaggcccacgggatagacccaaacatcagaaccggtgtcaggaccatcacgaccggaggggccatt

SEQ ID NO: 126803 - DNA, 75 bp, Artificial Sequence
  Synthetic
tcgactcgtccgtcctctgtgagtgctatgacgcaggctgtgcttggtatgagctcacgcccgccgagactacag

SEQ ID NO: 126804 - DNA, 75 bp, Artificial Sequence
  Synthetic
gtcaccaatgaggtcaccctcactcaccccgtaaccaaatacattgccacatgcatgcaagcagatctcgagatc

SEQ ID NO: 126805 - DNA, 75 bp, Artificial Sequence
  Synthetic
acatattcaacatatggcaaattcctagcagatggggggtgctccggaggggcttatgacatcatcatatgtgac

SEQ ID NO: 126806 - DNA, 75 bp, Artificial Sequence
  Synthetic
gttctcaatgccacttccgccgctggtagtcagggatgggtttggggggtggtctttatctgtgccgcctggtac

SEQ ID NO: 126807 - DNA, 75 bp, Artificial Sequence
  Synthetic
cactcttgagagacgagatcacattctccgtaggtatgtcctcctacgcgatggggtctcagctcccgtgcgagc

SEQ ID NO: 126808 - DNA, 75 bp, Artificial Sequence
  Synthetic
ggctcagcccggatacccttggcccctttatggaaacgagggctgtgggtgggcaggttggctcctgtccccccg

SEQ ID NO: 126809 - DNA, 75 bp, Artificial Sequence
  Synthetic
cctctaagcaggcacaggaaatacaacctgctgttcaagggacatggcccaagctggaacagttttgggccaagc

SEQ ID NO: 126810 - DNA, 75 bp, Artificial Sequence
  Synthetic
atggagaggaggcagcctcacttggaatgttggcaattgtcattatcaccatatttactcttactccagcataca

SEQ ID NO: 126811 - DNA, 75 bp, Artificial Sequence
  Synthetic
accgcagacattccaagtggcccatctacacgctcccactggcagcggcaagagcaccaaagtgccggctgcata

SEQ ID NO: 126812 - DNA, 75 bp, Artificial Sequence
  Synthetic
tgcagcccaagggtacaaggtactagtcctgaacccgtccgttgccgccaccttaagttttggggcgtatatgtc

SEQ ID NO: 126813 - DNA, 75 bp, Artificial Sequence
  Synthetic
acgcgatgctgtcatactgcttacctgtttgttgcacccacaactggggtttgaggtcaccaaagccatcttagc

SEQ ID NO: 126814 - DNA, 75 bp, Artificial Sequence
  Synthetic
gacgggatcaattatgcaacagggaatcttcccggttgctctttctctatcttccttttggcactgctctcgtgc

SEQ ID NO: 126815 - DNA, 75 bp, Artificial Sequence
  Synthetic
accatcctcctcaacatcatgggagggtggctggcttcccaaatcgccccccctgcaggggccactggcttcgtt

SEQ ID NO: 126816 - DNA, 75 bp, Artificial Sequence
  Synthetic
ctcacacaccccataaccaaatacatcatgacatgcatgtcggctgacctggaggtcgtcactagcacctgggtg

SEQ ID NO: 126817 - DNA, 75 bp, Artificial Sequence
  Synthetic
ccactgtcccacaagacgccgtggttagaagccaacggcgcggtcgcacgggcagaggaaaacccggggtataca

SEQ ID NO: 126818 - DNA, 75 bp, Artificial Sequence
  Synthetic
ccatctcacaaatgattgccccaactccagcatcgtgctggaggcggatgctatgatcctgcatttgcctggatg

SEQ ID NO: 126819 - DNA, 75 bp, Artificial Sequence
  Synthetic
actggtggatgtgttggccgggtatggcgcgggtatctcgggggctctcgtcgctttcaagatcatgtctggcga

SEQ ID NO: 126820 - DNA, 75 bp, Artificial Sequence
  Synthetic
tcacgaggcacgccgatgtcattcccgtgcgccggcgaggtgatagcaggggtagcctgctttcgccccggccca

SEQ ID NO: 126821 - DNA, 75 bp, Artificial Sequence
  Synthetic
gtcgcaggcggaaaatacgtccaggccgcgctattgcgcttaggtgcatggactggtacatacatctatgaccac

SEQ ID NO: 126822 - DNA, 75 bp, Artificial Sequence
  Synthetic
gggctaggcccgactacaatccacctattttggaaccttggaagtctcctgactataatccaccaatggtccacg

SEQ ID NO: 126823 - DNA, 75 bp, Artificial Sequence
  Synthetic
aaagccatccccattgaggccatcaaggggggaaggcatctcatcttctgccactccaagaagaagtgtgacgag

SEQ ID NO: 126824 - DNA, 75 bp, Artificial Sequence
  Synthetic
ggggtgccgacacggtcgcgtgcggcgatattatatctgggctcccagtatcagccaggagaggtaacttgattt

SEQ ID NO: 126825 - DNA, 75 bp, Artificial Sequence
  Synthetic
catcggggatctatgcggctctctctttttggcgggacaactattcaccttccagccccgccgtcattggactgt

SEQ ID NO: 126826 - DNA, 75 bp, Artificial Sequence
  Synthetic
accagcagtgccccagagcttccaggtggcccacctgcatgctcccaccggcagcggtaagagcaccaaggtccc

SEQ ID NO: 126827 - DNA, 75 bp, Artificial Sequence
  Synthetic
gagcggtatacagtacctggctggcctttcaaccttaccaggcaacccggctgttgcctccctaatgtctttttc

SEQ ID NO: 126828 - DNA, 75 bp, Artificial Sequence
  Synthetic
atgcgtcgcagcgggtcacccagctactcagctccctcaccataaccagcctgcttaggagactccaccaatgga

SEQ ID NO: 126829 - DNA, 75 bp, Artificial Sequence
  Synthetic
cacattgatgcccacttcctctcacaaacaaaacaggggggggaaaattttgcatacttggttgcttatcaggcg

SEQ ID NO: 126830 - DNA, 75 bp, Artificial Sequence
  Synthetic
tggcttgggacatgatgatgaactggtcacccacaaccactctggtcctatctagcatcttgagggtacctgaga

SEQ ID NO: 126831 - DNA, 75 bp, Artificial Sequence
  Synthetic
caccagcctcacgggccgcgacaaaaatgaggtggagggggaaattcaggtcgtgtccactgccacgcaatcttt

SEQ ID NO: 126832 - DNA, 75 bp, Artificial Sequence
  Synthetic
tcacggaagattgccccgtcccctgctccagctcatggctccgagacgtgtgggactgggtttgttcgatcctga

SEQ ID NO: 126833 - DNA, 75 bp, Artificial Sequence
  Synthetic
tgtacagacttggagccgtacagaatgagattaccaccacacacccaatcacaaaatacatcatgacctgtatgt

SEQ ID NO: 126834 - DNA, 75 bp, Artificial Sequence
  Synthetic
acctccacaaccctcctacttaacatcttaggggggtgggtcgcttcgcagttggctaatcctactgcatctacg

SEQ ID NO: 126835 - DNA, 75 bp, Artificial Sequence
  Synthetic
aatgttgaccaggacctggtgggttggccagcgccacctggggcccgttcactcactccatgcacttgtggctca

SEQ ID NO: 126836 - DNA, 75 bp, Artificial Sequence
  Synthetic
tgaaagggtcatctggaggtcctatgctgtgtccctcgggtcatgttgctgggatcttccgcgcagcagtgtgca

SEQ ID NO: 126837 - DNA, 75 bp, Artificial Sequence
  Synthetic
ttgaccacatcaactccgtgtgggaggacttgctggaagacacccaaacaccaatccctacaaccatcatggcaa

SEQ ID NO: 126838 - DNA, 75 bp, Artificial Sequence
  Synthetic
gccagctgccgtgtccggagttcttctcctgggtggacggggtccagatccatcggttcgcccccacaccgaagg

SEQ ID NO: 126839 - DNA, 75 bp, Artificial Sequence
  Synthetic
acagttctggcagaagcacctgtggaacttcgtcagcgggatacagtatctcgccggcctgtcgacactgccagg

SEQ ID NO: 126840 - DNA, 75 bp, Artificial Sequence
  Synthetic
gacatctgggactggatatgcgaggtgttgagcgactttaagacctggctaaaagctaagctcatgccacagctg

SEQ ID NO: 126841 - DNA, 75 bp, Artificial Sequence
  Synthetic
gccacagacataccaagtggggtacctccacgcgcctacgggcagcggtaaaagcactaaagtcccagcggcata

SEQ ID NO: 126842 - DNA, 75 bp, Artificial Sequence
  Synthetic
ctgagccggacacagaggtcttggcatctatgctaacggacccatcccacattacagccgaggcggcggcgagac

SEQ ID NO: 126843 - DNA, 75 bp, Artificial Sequence
  Synthetic
atccgtactggggttaggactatcaccacgggcggtgcaattacctactctacatatggcaagtttctcgcggat

SEQ ID NO: 126844 - DNA, 75 bp, Artificial Sequence
  Synthetic
tgacatcgacatggtggacgccagcctctttatgggaggcagtgtgactcgtatagagtcccaatccaaggtcct

SEQ ID NO: 126845 - DNA, 75 bp, Artificial Sequence
  Synthetic
cgtcctcgactccttcgaccccgtggtcgatgaggaggacgagcgcgagccctcaataccatcagagtacttgct

SEQ ID NO: 126846 - DNA, 75 bp, Artificial Sequence
  Synthetic
cggagacggccggcgtcagactcacagtgctcgcaacggccactccccctggctcagtaacggtccctcatccaa

SEQ ID NO: 126847 - DNA, 75 bp, Artificial Sequence
  Synthetic
gtggtcgccgggtgtgccctccccccttctggaaccaccccagtgccgccccctaggaggcgacgagctgtggtg

SEQ ID NO: 126848 - DNA, 75 bp, Artificial Sequence
  Synthetic
cccttactatcaccagcttacttcgcaggcttcatgaatggatcagcggagactggaccacaccatgtgctacat

SEQ ID NO: 126849 - DNA, 75 bp, Artificial Sequence
  Synthetic
ccactctaaaaagaagtgcgacgagcttgccaagcagctcacatctcttggccttaatgctgtcgcattctacag

SEQ ID NO: 126850 - DNA, 75 bp, Artificial Sequence
  Synthetic
ctggaccagagtaacgtgggagaggctctcaaagagctcgccatcaaaagctttggctgccccccccctagcggt

SEQ ID NO: 126851 - DNA, 75 bp, Artificial Sequence
  Synthetic
gcctcatccacctgcatcagaacatagtggacgtgcagtacctctacggagtctcctcgagcgtcacctcgtggg

SEQ ID NO: 126852 - DNA, 75 bp, Artificial Sequence
  Synthetic
cttggctgagggacatctgggattgggtttgcaccgtactctctgactttaagacctggctcaaagccaagctcg

SEQ ID NO: 126853 - DNA, 75 bp, Artificial Sequence
  Synthetic
aagacctggctcaaagccaagctcgtgccctccctgccaggcattcccttcctctcgtgccagcgggggtttagg

SEQ ID NO: 126854 - DNA, 75 bp, Artificial Sequence
  Synthetic
agtggacgtgcagtacctctacggagtctcctcgagcgtcacctcgtgggtagtgaagtgggagtacattgtcct

SEQ ID NO: 126855 - DNA, 75 bp, Artificial Sequence
  Synthetic
gactgtaatgtttctgtcactcaggttgttgatttcagccttgacccaacttttaccatagagaccaccactatg

SEQ ID NO: 126856 - DNA, 75 bp, Artificial Sequence
  Synthetic
gagcgccatgcccctccacaagagggggaggctgctcccgattcggactccaggtcctggtccacgtgctccgag

SEQ ID NO: 126857 - DNA, 75 bp, Artificial Sequence
  Synthetic
ccggctggtggtgggcggtgcttttcctgtgctgtgtttggtatgtgaaaggccgccttgtgcctgcgtgtacct

SEQ ID NO: 126858 - DNA, 75 bp, Artificial Sequence
  Synthetic
ggacctgcagaaacgtctggcatggcaggtttcccatcaacgctaccacgaccggtcctagcgtacccatccccg

SEQ ID NO: 126859 - DNA, 75 bp, Artificial Sequence
  Synthetic
ggacctgcagtaacgtctggcatggcaggtttcccatcaacgctaccacgaccggtcctagcgtacccatccccg

SEQ ID NO: 126860 - DNA, 75 bp, Artificial Sequence
  Synthetic
ggacctgcagcaacgtctggcatggcaggtttcccatcaacgctaccacgaccggtcctagcgtacccatccccg

SEQ ID NO: 126861 - DNA, 75 bp, Artificial Sequence
  Synthetic
ggacctgcaggaacgtctggcatggcaggtttcccatcaacgctaccacgaccggtcctagcgtacccatccccg

SEQ ID NO: 126862 - DNA, 75 bp, Artificial Sequence
  Synthetic
tcttcgacaccgttgttctgtgcgaggcgtacgacacaggttgcgcatggtatgaactgactccatctgagacga

SEQ ID NO: 126863 - DNA, 75 bp, Artificial Sequence
  Synthetic
gtcccctcctgtgcctccgcctcggaagaagcggacggtggtcctcactgaatcaaccctatctactgccttggc

SEQ ID NO: 126864 - DNA, 75 bp, Artificial Sequence
  Synthetic
gaggttatgcgtattaatgactgccattacgtggtaggggctacagctgacaacttgaagtgcccctgccaggta

SEQ ID NO: 126865 - DNA, 75 bp, Artificial Sequence
  Synthetic
tgagtaactcattgttgcggtaccacaacaaagtgtactgcaccacatcaaggagtgcctcacaacgggcgaaaa

SEQ ID NO: 126866 - DNA, 75 bp, Artificial Sequence
  Synthetic
caacttgaagtgcccctgccaggtaccagcgccagaattcttcaccatggtggatggcgtgcgactgcacaggta

SEQ ID NO: 126867 - DNA, 75 bp, Artificial Sequence
  Synthetic
aacttggggctccccctttgagagcctggagacatcgagcccgagcggtcagagcccagctgatcacccgggggg

SEQ ID NO: 126868 - DNA, 75 bp, Artificial Sequence
  Synthetic
ctgtgagactacgtgcctacctgaatactccggggctccccgtctgtcaagatcatctggaattttgggagggcg

SEQ ID NO: 126869 - DNA, 75 bp, Artificial Sequence
  Synthetic
cttggcacaactggccgagaagacttttccagcgtcttcgctgccctcgaccgaccaggattctgggtgcccaaa

SEQ ID NO: 126870 - DNA, 75 bp, Artificial Sequence
  Synthetic
cgcgagagccaaagctccccccccctcctgggatacaatgtggaaatgtcttatccgcctcaagcccatgcttac

SEQ ID NO: 126871 - DNA, 75 bp, Artificial Sequence
  Synthetic
cgaccccgcatgttactcctgtgcctactcctacttaccgtaggggtaggcatctttttgctcccagctcgatag

SEQ ID NO: 126872 - DNA, 75 bp, Artificial Sequence
  Synthetic
gcgccgaactataagttcgcgctgtggagggtgtctgcagaggaatacgtggagataaggcgggtgggggacttc

SEQ ID NO: 126873 - DNA, 75 bp, Artificial Sequence
  Synthetic
ttggaagttataaccagtacctgggttctggtgggtggggtcctcgcggcattagcagcctactgcctgtcagtg

SEQ ID NO: 126874 - DNA, 75 bp, Artificial Sequence
  Synthetic
accgccggagtccatccggacgcggagctaatcgaggccaacctgctttggcgccaggaggtcgggggcaacatc

SEQ ID NO: 126875 - DNA, 75 bp, Artificial Sequence
  Synthetic
gttccagacacatcccctacctcgtcgaaggtcaacaccttgcagagcagttcaaacaaaaagtccttggcctca

SEQ ID NO: 126876 - DNA, 75 bp, Artificial Sequence
  Synthetic
tcttatgacacccgctgttttgactccacagtcacggagagggacatcagaaccgaggagtccatctatttgtcc

SEQ ID NO: 126877 - DNA, 75 bp, Artificial Sequence
  Synthetic
gtaaggccattaaccacatcaactccgtgtgggaggacttgctggaagacaatcaaacaccaatccctacaacca

SEQ ID NO: 126878 - DNA, 75 bp, Artificial Sequence
  Synthetic
taccaccaccgcggaggaagaaggttgtgcaacttgatgactcagctgctgcggctgcgctcgcagagcttgctc

SEQ ID NO: 126879 - DNA, 75 bp, Artificial Sequence
  Synthetic
gagtggcatacaatatttggctggcctatccacgctaccaggcaacccggcggtagcttcactgatgtcattctc

SEQ ID NO: 126880 - DNA, 75 bp, Artificial Sequence
  Synthetic
gcaaaagctttccaccagaacccttagactcacaggggggctctgcaaccggcccctctactctaagttccgacg

SEQ ID NO: 126881 - DNA, 75 bp, Artificial Sequence
  Synthetic
gcttttgtagtaagcggtttggcaggcgccacagtcggcagtattggccttgggagagtcctagtggacataatt

SEQ ID NO: 126882 - DNA, 75 bp, Artificial Sequence
  Synthetic
cttggagctaataacatcttgctcctccaacgtatccgtggcgctggacccgcgaggccgccgcaggtactacct

SEQ ID NO: 126883 - DNA, 75 bp, Artificial Sequence
  Synthetic
tgttatcgcctggcgcactggtggtgggtgtggtgtgtgcggctatattgagacgccacgccgggcccgctgagg

SEQ ID NO: 126884 - DNA, 75 bp, Artificial Sequence
  Synthetic
ggcccaggacaccttggaccaagatctcaactttgagatgtacggagcagtgtactcggtcagtcctttggacct

SEQ ID NO: 126885 - DNA, 75 bp, Artificial Sequence
  Synthetic
aagcagaacatccagctgatcaacaccaacggcagttggcacatcaatagaacggccctgaactgcaatgaaagc

SEQ ID NO: 126886 - DNA, 75 bp, Artificial Sequence
  Synthetic
catggccatactcagttcccttactgtgaccagcctcctacggaagttgcatgagtggatcaactctgattggtc

SEQ ID NO: 126887 - DNA, 75 bp, Artificial Sequence
  Synthetic
ccagggctacaaggtgttggtcttgaacccatcggtggcggcaacgcttagctttggctcttatatgaggcaagc

SEQ ID NO: 126888 - DNA, 75 bp, Artificial Sequence
  Synthetic
ctgcctggagtacctttcctctcttgccagcggggcttccgtggcgtatggagaggtgacggtatctgccgcacc

SEQ ID NO: 126889 - DNA, 75 bp, Artificial Sequence
  Synthetic
ggcggttatgggactatcatatgggttccaatactcgccgaaacaacgggtggattacctcctgggcgtatggcg

SEQ ID NO: 126890 - DNA, 75 bp, Artificial Sequence
  Synthetic
ccatcaacgcgacaacgactggtcctagcgtgcccatcccagagcccaactacaagagggctctttggcgggtgt

SEQ ID NO: 126891 - DNA, 75 bp, Artificial Sequence
  Synthetic
catatatcacagcgtgtcgcgagctcgaccccgcctcttactccttggcctactcctactttgcgtaggggtagg

SEQ ID NO: 126892 - DNA, 75 bp, Artificial Sequence
  Synthetic
agaaataccattttatggaaaggctatcccccttgagtacatcaaagggggaagacacctcatattctgtcactc

SEQ ID NO: 126893 - DNA, 75 bp, Artificial Sequence
  Synthetic
tgcaaactagaccccgcagcacgcaaagccatcacagcactcaccgagcggctgtattgcggcggtcctatgttc

SEQ ID NO: 126894 - DNA, 75 bp, Artificial Sequence
  Synthetic
agaattcttcactgaagtagacggcgtacggttgcaccgtttcgcacctgcctgcaagcctctcctgagagatga

SEQ ID NO: 126895 - DNA, 75 bp, Artificial Sequence
  Synthetic
ccatcgcacttaactgcagaggctgctgctcgccgccttgcgcgtgggtcccccccgtcctgtgctagctcatta

SEQ ID NO: 126896 - DNA, 75 bp, Artificial Sequence
  Synthetic
aagtaggaggcaatatcacccgggtggagtctgagaacaaagtcatcgttctcgactcttttgaccctctggtgc

SEQ ID NO: 126897 - DNA, 75 bp, Artificial Sequence
  Synthetic
caaccctcctctgcttgagacttggaagaaaccagactatgccccaccgctggttcacgggtgcgctttgccctc

SEQ ID NO: 126898 - DNA, 75 bp, Artificial Sequence
  Synthetic
gcggtcgcaacctcgcggacggcggcagcctatccccaaggcgcgccagcgcgagggccggtcctgggcccagcc

SEQ ID NO: 126899 - DNA, 75 bp, Artificial Sequence
  Synthetic
catactccatcactccattggacttaccgcaaatcatccagcggttacatggcatggccgccttttcactccacg

SEQ ID NO: 126900 - DNA, 75 bp, Artificial Sequence
  Synthetic
cagagaacaaggtagtaattctggactctttcgagccgcttcaagcggaggaggatgagagggaagtatccgttc

SEQ ID NO: 126901 - DNA, 75 bp, Artificial Sequence
  Synthetic
ggctcctgtccccccgcggctcccgccctagttggggcccaaatgacccccggcgtaggtcacgcaatttgggca

SEQ ID NO: 126902 - DNA, 75 bp, Artificial Sequence
  Synthetic
ggggccccacccttgagagcctggagacatcgggccagggcggtcagagctaagcttatcgctcagggggggaaa

SEQ ID NO: 126903 - DNA, 75 bp, Artificial Sequence
  Synthetic
cccatccaataaccaaatacatcatgacctgtatgtctgcggacttggaggttatcaccagcacatgggtcctcg

SEQ ID NO: 126904 - DNA, 75 bp, Artificial Sequence
  Synthetic
acaattgcttttacagatgcacatatcgaggtggacatcacttacgctgagtacttcgaaatgtccgttcggttg

SEQ ID NO: 126905 - DNA, 75 bp, Artificial Sequence
  Synthetic
ttcccgacgcagccggcctccacacctgactcggactcaggtcacccgaccaccagcaagagctcagaccaagca

SEQ ID NO: 126906 - DNA, 75 bp, Artificial Sequence
  Synthetic
cgtgagggccctcgaggacggaataaactttgcaacagggaatttgcccggttgctctttctctatcttccttct

SEQ ID NO: 126907 - DNA, 75 bp, Artificial Sequence
  Synthetic
tgactggcaagcctgctgttgtccctgatcgcgagatcttataccagcaatttgacgagatggaggagtgctcta

SEQ ID NO: 126908 - DNA, 75 bp, Artificial Sequence
  Synthetic
atcaccaaatacctgcttgccgtactcggtccgctcatggtactccaggccggcataaccaaagtgccgtacttt

SEQ ID NO: 126909 - DNA, 75 bp, Artificial Sequence
  Synthetic
ttatcggagttgcagttgcgcccgcgaacgacatttataatgaacgtgaattgctcaacagtatgggcatttcgc

SEQ ID NO: 126910 - DNA, 75 bp, Artificial Sequence
  Synthetic
ctacagtcagtgaggaaggcgacagcgtcgtgtgttgttccatgtcttacagctggacaggagcccttgtcacac

SEQ ID NO: 126911 - DNA, 75 bp, Artificial Sequence
  Synthetic
tcgtggccggcggaagcgggggggacgtatttcacagcgcgccccaggcccgaccccgcatgttactcctgtgcc

SEQ ID NO: 126912 - DNA, 75 bp, Artificial Sequence
  Synthetic
caacgactgttctaatgacagcatcgtgtacgaggctgatgatgtgatcctacatatgcctggctgtgtgccttg

SEQ ID NO: 126913 - DNA, 75 bp, Artificial Sequence
  Synthetic
cactgggggagctgccgctcacgccgtatcaggattcgccggcctcctcacgcagggctccaagcagaacatcca

SEQ ID NO: 126914 - DNA, 75 bp, Artificial Sequence
  Synthetic
gaagcctgctgtccattccgcgtggcctagggtggaggagttttggaggaagcacatgtggaactttgtcagcgg

SEQ ID NO: 126915 - DNA, 75 bp, Artificial Sequence
  Synthetic
gatgcggcaaaagaaggtcactttcgaccgattacagattctggaccaacactacaacaatgtagtgaaggaggt

SEQ ID NO: 126916 - DNA, 75 bp, Artificial Sequence
  Synthetic
aacggattaccagggatttcagtcgatgtacacgttcgtcacatctcatctacctcccggttttaatgaatacga

SEQ ID NO: 126917 - DNA, 75 bp, Artificial Sequence
  Synthetic
gatctgttggttggtgcggccacgctttgctcggctctttatgttggcgacctgtgtggagctgtgttccttgtg

SEQ ID NO: 126918 - DNA, 75 bp, Artificial Sequence
  Synthetic
gccccgaccatcgcccctactgctggcactaccccccaaaaccttgtggtattgtgcccgcacggagcgtctgcg

SEQ ID NO: 126919 - DNA, 75 bp, Artificial Sequence
  Synthetic
cggccattggggtgtgatgtttggtttggcctatttctcccatgcaggggagcgtgggccaaagtcattgtcatc

SEQ ID NO: 126920 - DNA, 75 bp, Artificial Sequence
  Synthetic
ggctttgctgtcctgcttgaccatcccagcttccgcttatgaagtgcgcaacgtgtccggggtgtaccatgtcac

SEQ ID NO: 126921 - DNA, 75 bp, Artificial Sequence
  Synthetic
atggcgtgagggtcctggaggacgggataaattatgcaacagggaatttacccggttgctctttttctatcttcc

SEQ ID NO: 126922 - DNA, 75 bp, Artificial Sequence
  Synthetic
ggcgccaagcagaacatccagctgatcaacaccaacggcagctggcacatcaaccgcacggccttgaactgcaat

SEQ ID NO: 126923 - DNA, 75 bp, Artificial Sequence
  Synthetic
aatcattccggatactgcgattttaagtgttgttccattccatcacggttttggaatgtttactacactcggata

SEQ ID NO: 126924 - DNA, 75 bp, Artificial Sequence
  Synthetic
actgcctgcgtgagattctcgcatgccagagatcctatttttggcaatcaaatcattccggatactgcgatttta

SEQ ID NO: 126925 - DNA, 75 bp, Artificial Sequence
  Synthetic
tgtaccagtatccgctgtggaggtcaagaacaccagtcagacctacatggccaccaatgattgctctaacagcag

SEQ ID NO: 126926 - DNA, 75 bp, Artificial Sequence
  Synthetic
gttacagggcatcgtatggcctgggatatgatgatgaattggtctccagcagttggtctggtggtggcgcaccta

SEQ ID NO: 126927 - DNA, 75 bp, Artificial Sequence
  Synthetic
aaagagagctctctacgacgtcacgcgcaaactaccaacagccatcatgggagatgcctacggctttcaatactc

SEQ ID NO: 126928 - DNA, 75 bp, Artificial Sequence
  Synthetic
catacccgtcgttggcgccccagttggtggcgtcgccagagcactcgcgcatggcgtgagggtcctggaggacgg

SEQ ID NO: 126929 - DNA, 75 bp, Artificial Sequence
  Synthetic
aagaacaccagtcagacctacatggccaccaatgattgctctaacagcagcatcacgtggcaactcgagggtgcg

SEQ ID NO: 126930 - DNA, 75 bp, Artificial Sequence
  Synthetic
ccaaccctattctccttcttcgccaaaagcactctgattgacaaatacgatttatctaatttacacgaaattgct

SEQ ID NO: 126931 - DNA, 75 bp, Artificial Sequence
  Synthetic
tcatcattgtcctgatcatgttctcgggggtggacgcatccacatacaccacaggtggcgccaccggccaatcaa

SEQ ID NO: 126932 - DNA, 75 bp, Artificial Sequence
  Synthetic
aacgtcgccgtgagagagcgcggggcgcttactaagggtctgcggacgcatatcgatttgatcgtggtgtccgct

SEQ ID NO: 126933 - DNA, 75 bp, Artificial Sequence
  Synthetic
cgcttactaagggtctgcggacgcatatcgatttgatcgtggtgtccgctacgctttgctccgccctttacatag

SEQ ID NO: 126934 - DNA, 75 bp, Artificial Sequence
  Synthetic
ctccaatggggttctcctacgacaccaggtgctttgactcaacagttactgagcacgacatcaagactgagcggg

SEQ ID NO: 126935 - DNA, 75 bp, Artificial Sequence
  Synthetic
tatcgatttgatcgtggtgtccgctacgctttgctccgccctttacataggggatgtttgtggcgcggccatgat

SEQ ID NO: 126936 - DNA, 75 bp, Artificial Sequence
  Synthetic
cagctattctgattacacccgagggggatgataaaccgggcgcggtcggtaaagttgttccattttttgaagcga

SEQ ID NO: 126937 - DNA, 75 bp, Artificial Sequence
  Synthetic
taatgattccctaaataccgggttcatcgctggcctgttctattaccacaggttcaactcttcagggtgtccgca

SEQ ID NO: 126938 - DNA, 75 bp, Artificial Sequence
  Synthetic
actgcaactgttccatttacccgggccacattacaggacaccgcatggcatgggatatgatgatgaactggtccc

SEQ ID NO: 126939 - DNA, 75 bp, Artificial Sequence
  Synthetic
gcggcaggccttaccaactatgacatgttggtctgcggagacgacttagtagtcattgctgagagcgccggagtt

SEQ ID NO: 126940 - DNA, 75 bp, Artificial Sequence
  Synthetic
ggaagcgaccaacgccttgattgacaaggatggatggctacattctggagacatagcttactgggacgaagacga

SEQ ID NO: 126941 - DNA, 75 bp, Artificial Sequence
  Synthetic
tggcactacccacccagaccctgtggagttgtcccagcaaggaatatctgcgggcctgtctactgtttcacgccc

SEQ ID NO: 126942 - DNA, 75 bp, Artificial Sequence
  Synthetic
ggggcgtaatgttcggcctagcctacttctctatgcagggggcgtgggccaaggtcgtcgtcatcctcctattga

SEQ ID NO: 126943 - DNA, 75 bp, Artificial Sequence
  Synthetic
caactacaccatattcaaagtcaggatgtacgtgggaggggtcgagcacaggctggacgctgcctgcaactggac

SEQ ID NO: 126944 - DNA, 75 bp, Artificial Sequence
  Synthetic
atcttcgacgcaggtgtcgcaggtcttcccgacgatgacgccggtgaacttcccgccgccgttgttgttttggag

SEQ ID NO: 126945 - DNA, 75 bp, Artificial Sequence
  Synthetic
tcaactcatcaacaccaacggcagctggcacatcaaccgcactgccttgaattgcaatgattcattgcaaacggg

SEQ ID NO: 126946 - DNA, 75 bp, Artificial Sequence
  Synthetic
cccatggacgttggttcgggtgtgtgtggatgaacgccacggggtttgtgaaaacgtgtggggctcccccttgtg

SEQ ID NO: 126947 - DNA, 75 bp, Artificial Sequence
  Synthetic
gtaaattcctggttggggaacataatcatgtacgctcctgcaatctgggtacgtatggtgctcatgacccacttc

SEQ ID NO: 126948 - DNA, 75 bp, Artificial Sequence
  Synthetic
cctactgctggcactaccccccaaagccttgtggtatcgtgccagcacggaacgtgtgtggcccagtgtattgct

SEQ ID NO: 126949 - DNA, 75 bp, Artificial Sequence
  Synthetic
taccgaaaggtcttaccggaaaactcgacgcaagaaaaatcagagagatcctcataaaggccaagaagggcggaa

SEQ ID NO: 126950 - DNA, 75 bp, Artificial Sequence
  Synthetic
cgggtccgggccctggctcacgccacgatgtctggtcgactacccgtatcggctgtggcattacccctgtactgt

SEQ ID NO: 126951 - DNA, 75 bp, Artificial Sequence
  Synthetic
catcgtgaagtgggaatgggtggtcctccttttcttgttgttggcagacgccagggtctgtgcatgcctctggat

SEQ ID NO: 126952 - DNA, 75 bp, Artificial Sequence
  Synthetic
tgaacaagatggattgcacgcaggttctccggccgcttgggtggagaggctattcggctatgactgggcacaaca

SEQ ID NO: 126953 - DNA, 75 bp, Artificial Sequence
  Synthetic
agccagagcctgacgtgaccgtagtcacctcaatgctcacagaccccacgcacatcaccgcagagacggcggcac

SEQ ID NO: 126954 - DNA, 75 bp, Artificial Sequence
  Synthetic
gacaatcggctgctctgatgccgccgtgttccggctgtcagcgcaggggcgcccggttctttttgtcaagaccga

SEQ ID NO: 126955 - DNA, 75 bp, Artificial Sequence
  Synthetic
cctacacctggggggagaatgaaacggatgtgttcttactaaacagcacgcggcctccgcggggcgcttggtttg

SEQ ID NO: 126956 - DNA, 75 bp, Artificial Sequence
  Synthetic
ggcgattgaagagggggtcccccccctccttagccagctcttcggccagccagctgtctgcaccgtccctcaagg

SEQ ID NO: 126957 - DNA, 75 bp, Artificial Sequence
  Synthetic
gaccgtgatcgcagtgaacaacatccactgctccactcaaccaccgagctcgctatactaccatgctccttcact

SEQ ID NO: 126958 - DNA, 75 bp, Artificial Sequence
  Synthetic
agggcagggtggtccccgtggccacgtactctgttctcggcttgtggtcctttctcctcctagtcctggccttac

SEQ ID NO: 126959 - DNA, 75 bp, Artificial Sequence
  Synthetic
gaagcgggaagggactggctgctattgggcgaagtgccggggcaggatctcctgtcatctcaccttgctcctgcc

SEQ ID NO: 126960 - DNA, 75 bp, Artificial Sequence
  Synthetic
tgaagtgggaggttgttgtcctcgtgttcctccttttggcggatgcccgcgtgtgcgtcgctctctggatgatgc

SEQ ID NO: 126961 - DNA, 75 bp, Artificial Sequence
  Synthetic
tgcaccctggtgagacaccttgcaggagctaggtacatccagatgctgttgatcaccataggcaggtggaccggc

SEQ ID NO: 126962 - DNA, 75 bp, Artificial Sequence
  Synthetic
cacgtactcggatggaagccggtcttgtcgatcaggatgatctggacgaagagcatcaggggctcgcgccagccg

SEQ ID NO: 126963 - DNA, 75 bp, Artificial Sequence
  Synthetic
ttgcgccgcgtggcatgtgcggggaaagctcgtcccgctggtagcctacggtttgacaggcctctggtcgttggc

SEQ ID NO: 126964 - DNA, 75 bp, Artificial Sequence
  Synthetic
aacgcggcgtgcaattttacccgtggggaccgttgcaatctggaagaccgggataggagtcagctcagccccttg

SEQ ID NO: 126965 - DNA, 75 bp, Artificial Sequence
  Synthetic
ggccattacgtgcaaatggccatcatcaagttaggggcgcttactggcacctatgtttataaccatctcactcct

SEQ ID NO: 126966 - DNA, 75 bp, Artificial Sequence
  Synthetic
gccggctttatctaccggtctcttacacctccaccaaaacattgtggacgtgcagtacctgtatggcctatcgcc

SEQ ID NO: 126967 - DNA, 75 bp, Artificial Sequence
  Synthetic
cttttctggattcatcgactgtggccggctgggtgtggcggaccgctatcaggacatagcgttggctacccgtga

SEQ ID NO: 126968 - DNA, 75 bp, Artificial Sequence
  Synthetic
gttcagactcgggactatcaataaccagtcccgttccacctgccccatcaacaccggacgacgcctgctcagaag

SEQ ID NO: 126969 - DNA, 75 bp, Artificial Sequence
  Synthetic
ttgtcaccatggtataaacattggatcgctcgcctcatatggtggaaccaatacatgatatgtagatgtgaggct

SEQ ID NO: 126970 - DNA, 75 bp, Artificial Sequence
  Synthetic
cacctccaccaaaacattgtggacgtgcagtacctgtatggcctatcgccggctattaccaagttcattgtcaag

SEQ ID NO: 126971 - DNA, 75 bp, Artificial Sequence
  Synthetic
tgggctgaccgcttcctcgtgctttacggtatcgccgctcccgattcgcagcgcatcgccttctatcgccttctt

SEQ ID NO: 126972 - DNA, 75 bp, Artificial Sequence
  Synthetic
gacctaagctcaggctcttggtccactgtgagcgatcaggacgacgtcgtgtgttgttccatgtcctattcctgg

SEQ ID NO: 126973 - DNA, 75 bp, Artificial Sequence
  Synthetic
ctggggcaagccgaggcggcgctggagaagctagtcattttgcatgcggccagcgccgcaagctttaatggcata

SEQ ID NO: 126974 - DNA, 75 bp, Artificial Sequence
  Synthetic
ctaagctattgattgctgtccttggtccactatacttgatacaagctgctttggtcagtaccccctacttcgtac

SEQ ID NO: 126975 - DNA, 75 bp, Artificial Sequence
  Synthetic
ctattacttacagtgagcctagcagctcggaccagaggccctattgctggcattacgcgcctcggcggtgtggcg

SEQ ID NO: 126976 - DNA, 75 bp, Artificial Sequence
  Synthetic
ctgcggaggaggagaagcttccaataaatcctttgagcaactccctcataagacaccataacatggtgtattcca

SEQ ID NO: 126977 - DNA, 75 bp, Artificial Sequence
  Synthetic
cccccctaacgttactggccgaagccgcttggaataaggccggtgtgcgtttgtctatatgttattttccaccat

SEQ ID NO: 126978 - DNA, 75 bp, Artificial Sequence
  Synthetic
tgggaatgggtggtcctcttgtttctgctccttgcggacgccagagtctgcgcgtgcttgtggatgcttcttctg

SEQ ID NO: 126979 - DNA, 75 bp, Artificial Sequence
  Synthetic
tcactgcttacactcagcagactcgcggtctcctgggtgccatcgtggtcagcctaacgggccgcgacaaaaatg

SEQ ID NO: 126980 - DNA, 75 bp, Artificial Sequence
  Synthetic
ttacctgtatgatcacctctcaccaatgtcggactgggccgctagcggtcttaaagacctagcagtggccacaga

SEQ ID NO: 126981 - DNA, 75 bp, Artificial Sequence
  Synthetic
ccatcgcatcacccaagggtcctgttatccagatgtacaccaatgtggacaaagacctcgtgggctggcccgctc

SEQ ID NO: 126982 - DNA, 75 bp, Artificial Sequence
  Synthetic
ctgttgaatgtcgtgaaggaagcagttcctctggaagcttcttgaagacaaacaacgtctgtagcgaccctttgc

SEQ ID NO: 126983 - DNA, 75 bp, Artificial Sequence
  Synthetic
cgcagcctatggtggctgtcctatctattggtccgagcggaagctttgatccaagagtgggtaccgcccttgcag

SEQ ID NO: 126984 - DNA, 75 bp, Artificial Sequence
  Synthetic
ccgttgaccacatccgctccgtgtgggaggacttgctagaagactctgataccccaattcccacgaccatcatgc

SEQ ID NO: 126985 - DNA, 75 bp, Artificial Sequence
  Synthetic
cgggggcgggaagtgctattgggtccagctgacaactataaaacaatgggctggcggttgctgtctccgatcacg

SEQ ID NO: 126986 - DNA, 75 bp, Artificial Sequence
  Synthetic
gggcatagtgtttgacataaccaagtggctcctggcagtcttaggacctggtcacctccttaggagtgtcctaac

SEQ ID NO: 126987 - DNA, 75 bp, Artificial Sequence
  Synthetic
tgagttggatagttgtggaaagagtcaaatggctctcctcaagcgtattcaacaaggggctgaaggatgcccaga

SEQ ID NO: 126988 - DNA, 75 bp, Artificial Sequence
  Synthetic
aggtaccccattgtatgggatctgatctggggcctcggtgcacatgctttacatgtgtttagtcgaggttaaaaa

SEQ ID NO: 126989 - DNA, 75 bp, Artificial Sequence
  Synthetic
cggctactcagaccttcctaggcacgacagtcgggggggtcatgtggacagtctaccacggagctgggtcgagga

SEQ ID NO: 126990 - DNA, 75 bp, Artificial Sequence
  Synthetic
tgggcgtgcgggtctgcgagaaaatggccctatacgacgtgacgcggaagttaccacaggccgtgatgggttcag

SEQ ID NO: 126991 - DNA, 75 bp, Artificial Sequence
  Synthetic
ccggagtacggactgtgaccaccggggactctatcacctactccacttatggcaagtttatcgcagatggaggct

SEQ ID NO: 126992 - DNA, 75 bp, Artificial Sequence
  Synthetic
ctgcacgtgcggttcgtccgacctgtatttggttacacgcgaggctgatgtcctccctgcccgccgtagaggtga

SEQ ID NO: 126993 - DNA, 75 bp, Artificial Sequence
  Synthetic
agggcagctgtgtgcacgaggggcgttgcaaaatctctacagttcataccagtagaggccctgaattcacagacc

SEQ ID NO: 126994 - DNA, 75 bp, Artificial Sequence
  Synthetic
aggtctccatcctttagtgacaactccacccccccagccgtcccagagtcctatcaggtggggtatctccatgct

SEQ ID NO: 126995 - DNA, 75 bp, Artificial Sequence
  Synthetic
gacattgcgtcactgcgagcattcacggatgctatgaccaggtactcagctccccctggagacgccccgcaacct

SEQ ID NO: 126996 - DNA, 75 bp, Artificial Sequence
  Synthetic
tcggcatgtatatgtcgaaggcctatgggattgaccctaatatccgcactgggaacagaaccattacaactggtg

SEQ ID NO: 126997 - DNA, 75 bp, Artificial Sequence
  Synthetic
ggtacttacaggtatgtttcgtcaggcgagaggccctctgggatgttcgacggcataatactctgccagtgctat

SEQ ID NO: 126998 - DNA, 75 bp, Artificial Sequence
  Synthetic
ctccacttgcgcgggctgcctgggagacagcccgccacactccagtcaattcgtggttgggcaacatcattatgt

SEQ ID NO: 126999 - DNA, 75 bp, Artificial Sequence
  Synthetic
ccggtgcgccggcggggcgacagcagggggagcctactctcccccaggcccatctcctacttgaagggttcttcg

SEQ ID NO: 127000 - DNA, 75 bp, Artificial Sequence
  Synthetic
caaattccttgccgatgggggatgttctgggggtgcatatgatgtgatcatttgtgatgagtgccatgcccagga

SEQ ID NO: 127001 - DNA, 75 bp, Artificial Sequence
  Synthetic
ggtccatccagagctaatctttgacatcaccaaactcttgctcgccatactcggtccgctcatggtgctccaggc

SEQ ID NO: 127002 - DNA, 75 bp, Artificial Sequence
  Synthetic
accgtcccacattccaacatagaggaggtggccctgactaatgacggggaaatcccattctacggcaaggccatc

SEQ ID NO: 127003 - DNA, 75 bp, Artificial Sequence
  Synthetic
gacgcacccaatcaccaaatacatcatgacatgcatgtcggctgacctggaagtcgtcacgagcacctgggtgct

SEQ ID NO: 127004 - DNA, 75 bp, Artificial Sequence
  Synthetic
ccgtgaccaacgaggttaccctgacgcaccccgtgacgaaatacatcgccacgtgcatgcaagctgacctcgaga

SEQ ID NO: 127005 - DNA, 75 bp, Artificial Sequence
  Synthetic
gtcagagccaaactcattgcccagggggggaaagccgctatatgcggtaagtacctcttcaactgggcggtgaag

SEQ ID NO: 127006 - DNA, 75 bp, Artificial Sequence
  Synthetic
cggtggccttctacagaggcctggacgtgtccataataccaacgtcgggagacgtcgtagtatgtgccaccgacg

SEQ ID NO: 127007 - DNA, 75 bp, Artificial Sequence
  Synthetic
ccagattgtgtcaactgctgcccaaactttcctggcaacgtgcatcaatggggtatgctggactgtctaccacgg

SEQ ID NO: 127008 - DNA, 75 bp, Artificial Sequence
  Synthetic
ctttgactctgtgatagactgtaacgtagctgtggaacagtacgttgatttcagtctagaccccactttctccat

SEQ ID NO: 127009 - DNA, 75 bp, Artificial Sequence
  Synthetic
gagcggccctcgggtatgtttgactcggtggtgctttgcgagtgctacgacgcaggttgcgcttggtacgagctg

SEQ ID NO: 127010 - DNA, 75 bp, Artificial Sequence
  Synthetic
cggtggtgctttgcgagtgctacgacgcaggttgcgcttggtacgagctggcgccttcagaaaccacagtaaggc

SEQ ID NO: 127011 - DNA, 75 bp, Artificial Sequence
  Synthetic
cctgtcgcagacaaaacagcagggtcttaacttcccatacttggtggcgtatcaagccactgtctgcgcccgcgc

SEQ ID NO: 127012 - DNA, 75 bp, Artificial Sequence
  Synthetic
cttaacttcccatacttggtggcgtatcaagccactgtctgcgcccgcgcgcaggcacccccaccaagttgggat

SEQ ID NO: 127013 - DNA, 75 bp, Artificial Sequence
  Synthetic
cctttgatgagatggaagaatgcgcctccaaagccgccctcattgaggaagggcagcggatggcggagatgctca

SEQ ID NO: 127014 - DNA, 75 bp, Artificial Sequence
  Synthetic
acccagtcactaaatacatcatggcctgcatgtctgccgacttagaggtcaccacaagcacctgggtgatactcg

SEQ ID NO: 127015 - DNA, 75 bp, Artificial Sequence
  Synthetic
caaacaagtgttataccaacaatttgacgagatggaggagtgctcccaggctgccccctacatcgagcaagtaca

SEQ ID NO: 127016 - DNA, 75 bp, Artificial Sequence
  Synthetic
aaattggaagctttctggcacaagcacctgtggaactttgtcagtgggatccaatacctggctgggctctccaca

SEQ ID NO: 127017 - DNA, 75 bp, Artificial Sequence
  Synthetic
atgacagcttgaacactgggttcttggctagcttgttctacacccacaagttcaacagctcagggtgtcccgaac

SEQ ID NO: 127018 - DNA, 75 bp, Artificial Sequence
  Synthetic
gctgggtagccacccacttggcgagccccgcagcatcttccgcctttgtggtgagtggcttggcgggagccgccg

SEQ ID NO: 127019 - DNA, 75 bp, Artificial Sequence
  Synthetic
ggagccggggtctccggtgctctcgtcgccttcaagatcatgggcggggagctccccactacagaagacatggtc

SEQ ID NO: 127020 - DNA, 75 bp, Artificial Sequence
  Synthetic
agtggatgaacagactcatagcgttcgcttcacggggtaaccacgtgtcaccaacacactatgtccctgagagcg

SEQ ID NO: 127021 - DNA, 75 bp, Artificial Sequence
  Synthetic
cgcttcacggggtaaccacgtgtcaccaacacactatgtccctgagagcgacgcagcagcaaaagtaacaacttt

SEQ ID NO: 127022 - DNA, 75 bp, Artificial Sequence
  Synthetic
tgggactgggtctgtacagtgcttagcgatttcaagacctggctctccgctaagatcatgccaaaagtgccaggc

SEQ ID NO: 127023 - DNA, 75 bp, Artificial Sequence
  Synthetic
gcgatttcaagacctggctctccgctaagatcatgccaaaagtgccaggcatacctttcatctcttgccaaaagg

SEQ ID NO: 127024 - DNA, 75 bp, Artificial Sequence
  Synthetic
agggccgcgtctctgtgcaaacatgtggcacggcaccttccccatcaatgaatacaccacaggacccagcacccc

SEQ ID NO: 127025 - DNA, 75 bp, Artificial Sequence
  Synthetic
tccctttcctctcatgccaacgtgggtacaagggagtctggcggggggacggcatcatgcacaccacctgcccat

SEQ ID NO: 127026 - DNA, 75 bp, Artificial Sequence
  Synthetic
atgactccggtcactccactggagcggataccggaggagacagcgtccagcagccctctgacgagactgccgctt

SEQ ID NO: 127027 - DNA, 75 bp, Artificial Sequence
  Synthetic
acagatgatggtctgaagtgcccgtgtcaggtacccgcaccagaatttttcaccgaattggacggagtgaggctc

SEQ ID NO: 127028 - DNA, 75 bp, Artificial Sequence
  Synthetic
ccgagcctgatgtggcagtactaacatcaatgttgcgggatccttcccatataacggcccaaacagcagctagac

SEQ ID NO: 127029 - DNA, 75 bp, Artificial Sequence
  Synthetic
tcctgtgcctccgccccggaagaagcggacggtggtcctcaccgaatcaaccctatctactgccttggccgagct

SEQ ID NO: 127030 - DNA, 75 bp, Artificial Sequence
  Synthetic
tgacgctgaactagtagatgccaatttactttggcgtcaagagatgggcagtaatatcaccagagtggaatctga

SEQ ID NO: 127031 - DNA, 75 bp, Artificial Sequence
  Synthetic
tatccaccagcgcttcccatctgggctaggccagactacaatcctccactactagagacgtggaaagatccggat

SEQ ID NO: 127032 - DNA, 75 bp, Artificial Sequence
  Synthetic
ctgcatctacggcgctcttggagctggcaaagaaatcttttccatcatcaaagccccaggaagcagacagcacat

SEQ ID NO: 127033 - DNA, 75 bp, Artificial Sequence
  Synthetic
gggggagccgggtgatccagacttaagttgcgactcctggtctactgtgagtgatagcgaggaacaaagtgtggt

SEQ ID NO: 127034 - DNA, 75 bp, Artificial Sequence
  Synthetic
agttgcgactcctggtctactgtgagtgatagcgaggaacaaagtgtggtttgctgttccatgtcctactcctgg

SEQ ID NO: 127035 - DNA, 75 bp, Artificial Sequence
  Synthetic
cgtcatctcgaagcgctgctctacgtcagaagaaagtcacttttgacaggatgcaagtgctcgatgaccattaca

SEQ ID NO: 127036 - DNA, 75 bp, Artificial Sequence
  Synthetic
tcagaagaaagtcacttttgacaggatgcaagtgctcgatgaccattacaagagtacacttaaggaggtcaagga

SEQ ID NO: 127037 - DNA, 75 bp, Artificial Sequence
  Synthetic
agtcctggcgggccttgcctactattccatggtggggaactgggctaaggttttgattgtgatgctactctttgc

SEQ ID NO: 127038 - DNA, 75 bp, Artificial Sequence
  Synthetic
gaccggccgggacaaaaaccaggtggagggtgaggtccagattgtgtcaactgctgcccagaccttcctggcaac

SEQ ID NO: 127039 - DNA, 75 bp, Artificial Sequence
  Synthetic
gggtggccgcatgcctcaggaaacttggggtcccgcccttgcgagcttggagacaccgggcccggagtgtccgcg

SEQ ID NO: 127040 - DNA, 75 bp, Artificial Sequence
  Synthetic
ggttcaactcgtccggatgccctgagcgcatggccagctgccgccccgtcgacgacttcgcccaggggtggggtc

SEQ ID NO: 127041 - DNA, 75 bp, Artificial Sequence
  Synthetic
gctcgccttatagtctaccctgatctgggagtacgggtctgtgagaaacgtgctctatatgacgtgatacagcag

SEQ ID NO: 127042 - DNA, 75 bp, Artificial Sequence
  Synthetic
tgggagtacgggtctgtgagaaacgtgctctatatgacgtgatacagcagttgtcactggcgataatgggacctg

SEQ ID NO: 127043 - DNA, 75 bp, Artificial Sequence
  Synthetic
gggcggccatctgtggccgctacctcttcaactgggcggtgaaaacaaagctcaaactcactccattgcccgagg

SEQ ID NO: 127044 - DNA, 75 bp, Artificial Sequence
  Synthetic
tgctctatatgacgtgatacagcagttgtcactggcgataatgggacctgcctacgggttccagtattcgcctaa

SEQ ID NO: 127045 - DNA, 75 bp, Artificial Sequence
  Synthetic
ctttggcattatccttgtaccatcaactacaccatattcaaagtcaggatgtacgtgggaggggtcgagcacagg

SEQ ID NO: 127046 - DNA, 75 bp, Artificial Sequence
  Synthetic
ctgcaagctgacgcccccacattcggccagatctaaatttggctatggggcgaaggacgtccggaacctatccag

SEQ ID NO: 127047 - DNA, 75 bp, Artificial Sequence
  Synthetic
gacatcagggtggaagaggaaatataccaatgttgtgaccttgagccagaagctaggaaggcaatcagctctctc

SEQ ID NO: 127048 - DNA, 75 bp, Artificial Sequence
  Synthetic
ggttcggcgtccctacgtacaggtggggggcgaatgagacggacgtgctgctccttaacaacacgcggccgccgc

SEQ ID NO: 127049 - DNA, 75 bp, Artificial Sequence
  Synthetic
aaccgccgcccacaggacgtcaagttcccgggtggcggtcagatcgttggtggagtttacttgttgccgcgcagg

SEQ ID NO: 127050 - DNA, 75 bp, Artificial Sequence
  Synthetic
gcaatacagtaacttgctacatcaaggcaactgcggctgctaaagcggcaggcctccaagacccatccttccttg

SEQ ID NO: 127051 - DNA, 75 bp, Artificial Sequence
  Synthetic
tccccccggcgacatgccccagcctacttacgacttggaactaattacatcatgttcctctaacgtctccgtagc

SEQ ID NO: 127052 - DNA, 75 bp, Artificial Sequence
  Synthetic
tccccctggcccgtgcggcttgggaaacagcacgtcacactccagttaactcctggttgggaaacattatcatgt

SEQ ID NO: 127053 - DNA, 75 bp, Artificial Sequence
  Synthetic
tgctcttccttctcctggcggacgcgcgcgtctgtgcctgcttgtggatgatgctgctgatagcccaggctgagg

SEQ ID NO: 127054 - DNA, 75 bp, Artificial Sequence
  Synthetic
gtacgcgccaagcttatcgcccagggcgggaaggccagaatatgtggcctgtacctctttaactgggcggtacgc

SEQ ID NO: 127055 - DNA, 75 bp, Artificial Sequence
  Synthetic
gcaacagggaaccttcctggttgctctttctctatcttccttctggccctgctctcttgcctgactgtgcccgca

SEQ ID NO: 127056 - DNA, 75 bp, Artificial Sequence
  Synthetic
gtacctctttaactgggcggtacgcaccaaaataaaactcactccattgccgtctgcaggccgcctggacttgtc

SEQ ID NO: 127057 - DNA, 75 bp, Artificial Sequence
  Synthetic
gcgtccgggttctggaagacggcgtgaactatgcaacagggaatcttcccggttgctctttctctatcttccttc

SEQ ID NO: 127058 - DNA, 75 bp, Artificial Sequence
  Synthetic
ccgaattcgagcatagtgtatgagaccgagcatcacatcttgcacctcccgggatgcgttccttgtgtgagggcc

SEQ ID NO: 127059 - DNA, 75 bp, Artificial Sequence
  Synthetic
atccggattcaccaaagtgtgcggagcgcccccctgcgtcatcggaggggtgggcaacaacaccttgcgctgccc

SEQ ID NO: 127060 - DNA, 75 bp, Artificial Sequence
  Synthetic
tggggagtcctagcgggcatagcgtatttctccatggtggggaactgggcgaaggtcttagtggtgctgttgctg

SEQ ID NO: 127061 - DNA, 75 bp, Artificial Sequence
  Synthetic
tctcgtggacatccttgcggggtatggcgcgggcgtggcaggcgctctcgtggcattcaagatcatgagcggtga

SEQ ID NO: 127062 - DNA, 75 bp, Artificial Sequence
  Synthetic
tccagctgatcaacaccaacggcagttggcacatcaatcgcacggccttgaactgtaatgcgagcctcgacactg

SEQ ID NO: 127063 - DNA, 75 bp, Artificial Sequence
  Synthetic
caaccgatgaaggttggggtaaacactccggcctattaggccatttccctttttgttgttttttttttttttttc

SEQ ID NO: 127064 - DNA, 75 bp, Artificial Sequence
  Synthetic
ggcgtagcgtacttcagcatgcaggccaattgggccaaggttatcctggtcctgtttctttttgctggagtcgac

SEQ ID NO: 127065 - DNA, 75 bp, Artificial Sequence
  Synthetic
agctgcagcagccttgacagcctcccacagggctggggcccccttgggatttatcagcctaatgtgcccgacaca

SEQ ID NO: 127066 - DNA, 75 bp, Artificial Sequence
  Synthetic
accttgcactgccccactgactgtttccgcaagcatccggaagccacatactctcggtgtggctccggtccctgg

SEQ ID NO: 127067 - DNA, 75 bp, Artificial Sequence
  Synthetic
cgcagcatgcaacttcacgcgcggagatcgctgcagactggaagatagggataggggtcagcagagtccactgct

SEQ ID NO: 127068 - DNA, 75 bp, Artificial Sequence
  Synthetic
cttgcaccaccaaccacgactcccctgacgccgagctcatagaggctaacctcctgtggaggcaggagatgggcg

SEQ ID NO: 127069 - DNA, 75 bp, Artificial Sequence
  Synthetic
ttggcacgttaagggcaggttcccagctgctgcaacatacgccgcgtgcgggttgtggcccctactgctcctggt

SEQ ID NO: 127070 - DNA, 75 bp, Artificial Sequence
  Synthetic
ttggcacgttaagggcaggttcccagctgctgctacatacgccgcgtgcgggttgtggcccctactgctcctggt

SEQ ID NO: 127071 - DNA, 75 bp, Artificial Sequence
  Synthetic
ttggcacgttaagggcaggttcccagctgctgccacatacgccgcgtgcgggttgtggcccctactgctcctggt

SEQ ID NO: 127072 - DNA, 75 bp, Artificial Sequence
  Synthetic
ttggcacgttaagggcaggttcccagctgctgcgacatacgccgcgtgcgggttgtggcccctactgctcctggt

SEQ ID NO: 127073 - DNA, 75 bp, Artificial Sequence
  Synthetic
cgtcttcggacccctttggattcttcaaaccagtctgctcaaagtgccctacttcgtgcgcgtccaaggccttct

SEQ ID NO: 127074 - DNA, 75 bp, Artificial Sequence
  Synthetic
gacttcaagacctggctgaaagccaagctcatgccacaactgcctgggattcccttcgtgtcctgccagcgcggg

SEQ ID NO: 127075 - DNA, 75 bp, Artificial Sequence
  Synthetic
ccgcgtattgcctgacaacaggcagcgtggtcattgtgggcaggatcatcttgtccgggaagccggctgttattc

SEQ ID NO: 127076 - DNA, 75 bp, Artificial Sequence
  Synthetic
gtatttggtggctgcaatacttcattgccagagccgaggctatcatccacgtctatgtgccatccctagacgtgc

SEQ ID NO: 127077 - DNA, 75 bp, Artificial Sequence
  Synthetic
ctccaaggggtggaggttgctggcgcccatcacggcgtatgcccagcagacaaggggcctcttgggatgcataat

SEQ ID NO: 127078 - DNA, 75 bp, Artificial Sequence
  Synthetic
caaggggcctcttgggatgcataattaccagcctgaccggccgggacaaaaaccaggtggagggtgaggttcaga

SEQ ID NO: 127079 - DNA, 75 bp, Artificial Sequence
  Synthetic
ttgtcgggttaatggcgctgactctgtcaccatattacaagcgctatatcagctggtgcttgtggtggcttcagt

SEQ ID NO: 127080 - DNA, 75 bp, Artificial Sequence
  Synthetic
caaagggcccaatcacccaaatgtacaccaatgtggaccaggacctcgtcggctggcaagcgccccccggggcgc

SEQ ID NO: 127081 - DNA, 75 bp, Artificial Sequence
  Synthetic
cagctcggacctttacttggtcacgaggcatgccgatgtcattccggtgcgccggcggggcgacagcagggggag

SEQ ID NO: 127082 - DNA, 75 bp, Artificial Sequence
  Synthetic
tgcgcagaagaggcgacactcgcggcgccctcataagccccaggccgatttcgacccttaagggatcatccggcg

SEQ ID NO: 127083 - DNA, 75 bp, Artificial Sequence
  Synthetic
ccaaatacatcatgacatgcatgtcggccgacctggaggtcgttacgagcacctgggtgctcgttggcggcgtcc

SEQ ID NO: 127084 - DNA, 75 bp, Artificial Sequence
  Synthetic
acatgtccaaggcacatggcattgatcccaatatacgatcaggggtcagaactattaccacaggcgcgcctatca

SEQ ID NO: 127085 - DNA, 75 bp, Artificial Sequence
  Synthetic
acaccatgcacctgcggcagctcggacctttatttggtcacgagacatgctgatgttattccggtgcgccggcgg

SEQ ID NO: 127086 - DNA, 75 bp, Artificial Sequence
  Synthetic
attgacaagtttgctcaggggtggggccccatcacttacgctgagcctggccacttggaccagaagccctactgc

SEQ ID NO: 127087 - DNA, 75 bp, Artificial Sequence
  Synthetic
gacaaaccgaaaaccccggaaccccgcctggccggccccccaaccccaacccaacccgggccgggaaaaacccca

SEQ ID NO: 127088 - DNA, 75 bp, Artificial Sequence
  Synthetic
cttctgtccagaggaggcagggctgccatatgtggcaagtacctcttcaattgggcagtaagaacaaagctcaaa

SEQ ID NO: 127089 - DNA, 75 bp, Artificial Sequence
  Synthetic
caggcttcaccggtgactttgactcagtgatagactgcaacacgtctgtcatacaaacagttgacttcagcctag

SEQ ID NO: 127090 - DNA, 75 bp, Artificial Sequence
  Synthetic
cctgacagggaggtcctctaccaagagttcgatgagatggaagagtgctctcagcacttaccgtacatcgagcaa

SEQ ID NO: 127091 - DNA, 75 bp, Artificial Sequence
  Synthetic
ctgtatctactgccttggccgagcttgccaccaaaagttttggcagctcctcaacttccggtatcacgggcgaca

SEQ ID NO: 127092 - DNA, 75 bp, Artificial Sequence
  Synthetic
cgccgatcttgaggttgtgaccagcacgtgggtcatggtaggcggccttctggcggccctcgctgcctactgctt

SEQ ID NO: 127093 - DNA, 75 bp, Artificial Sequence
  Synthetic
gccctatcagctatgccaacggaagtggctcagaacatcgcccttattgctggcactaccccccaaagccttgcg

SEQ ID NO: 127094 - DNA, 75 bp, Artificial Sequence
  Synthetic
tttaacatcttggggggttgggtagcctcacagatcgcgacccccacggcctccactgcttttgtcataagcggc

SEQ ID NO: 127095 - DNA, 75 bp, Artificial Sequence
  Synthetic
tcatcggagggacgggcaacaacaccttgcactgccccactgactgcttccgcaagcatccggaagccacatact

SEQ ID NO: 127096 - DNA, 75 bp, Artificial Sequence
  Synthetic
gctcgatgaggatcgtcgggcccaagacctgcagcaatacctggcatgggactttccccatcaatgcatacacca

SEQ ID NO: 127097 - DNA, 75 bp, Artificial Sequence
  Synthetic
gctcgatgaggatcgtcgggcccaagacctgcagcaatacctggcatgggactttccccatcaatgcttacacca

SEQ ID NO: 127098 - DNA, 75 bp, Artificial Sequence
  Synthetic
gctcgatgaggatcgtcgggcccaagacctgcagcaatacctggcatgggactttccccatcaatgcctacacca

SEQ ID NO: 127099 - DNA, 75 bp, Artificial Sequence
  Synthetic
gctcgatgaggatcgtcgggcccaagacctgcagcaatacctggcatgggactttccccatcaatgcgtacacca

SEQ ID NO: 127100 - DNA, 75 bp, Artificial Sequence
  Synthetic
gcatcttggttgaaggccaaggtacttcccagccttccagggatcccattcctatcctgtcagaaagggtataaa

SEQ ID NO: 127101 - DNA, 75 bp, Artificial Sequence
  Synthetic
agacctgccgaaacacctggtggggaaccttccctattaattcccataccacgggaccaagttctcctgtaccct

SEQ ID NO: 127102 - DNA, 75 bp, Artificial Sequence
  Synthetic
ggacctcaagtgcccgtgtcaggttccttcccccgaattcttcagctttgtggacggggtgcggatacacagatt

SEQ ID NO: 127103 - DNA, 75 bp, Artificial Sequence
  Synthetic
ctctcattgagacgtggaaacaaccagactacgaaccaccagttgttcatggctgcgcactgcccccggacaaac

SEQ ID NO: 127104 - DNA, 75 bp, Artificial Sequence
  Synthetic
catgccccccctggagggggagcctggggatccggatctcagcgacggatcatggtcgacggtcagtagtgaggc

SEQ ID NO: 127105 - DNA, 75 bp, Artificial Sequence
  Synthetic
gacgtccaaactgtctcgcagctcctaaccgacccctcacacatcaccgcagaaaccgcggctagaaggctcagg

SEQ ID NO: 127106 - DNA, 75 bp, Artificial Sequence
  Synthetic
gtatggtgctgatgacccatttctttggaatactccagtcccaagagacactccataaagtacttgacttcgaca

SEQ ID NO: 127107 - DNA, 75 bp, Artificial Sequence
  Synthetic
tccaatatctcagaggcactggcgagcttggcagacaagaccttcggccagccagctgccagctccgattccgga

SEQ ID NO: 127108 - DNA, 75 bp, Artificial Sequence
  Synthetic
cgctgagtcctattcctccatgccccccctagagggggagcctggggatccggatctcagcgacgggtcatggtc

SEQ ID NO: 127109 - DNA, 75 bp, Artificial Sequence
  Synthetic
aactgatagaggccaacctcatgtgggaacataaggttggtgccatcagaaggatggagacagacaccaaagtca

SEQ ID NO: 127110 - DNA, 75 bp, Artificial Sequence
  Synthetic
gcaattgttccatctatcccggccacataacgggtcaccgcatggcatgggatatgatgatgaactggtccccta

SEQ ID NO: 127111 - DNA, 75 bp, Artificial Sequence
  Synthetic
catgcccatatgggcgaggccagactacaatcctcctgttgtggagaattggaaggaccccgagtacgcacctcc

SEQ ID NO: 127112 - DNA, 75 bp, Artificial Sequence
  Synthetic
acggcactggcggaactcgctgagaggtccttcccaaaggaggaggcaccccccagcgactccgccattagtctg

SEQ ID NO: 127113 - DNA, 75 bp, Artificial Sequence
  Synthetic
acttgtctgatggctcttggtcaacagtcagcaccagatctgacgtgatttgctgttccatgtcatactcctgga

SEQ ID NO: 127114 - DNA, 75 bp, Artificial Sequence
  Synthetic
ccatcgcgtcatccaagggtcctgttatccagatgtacaccaatgtagaccaagacctcgtaggctggcccgctc

SEQ ID NO: 127115 - DNA, 75 bp, Artificial Sequence
  Synthetic
caagacctcgtaggctggcccgctccccaaggtgcccgctcattgacaccctgcacttgcggctcctcggacctt

SEQ ID NO: 127116 - DNA, 75 bp, Artificial Sequence
  Synthetic
ctggcacatggtgttagggtcctggaagacgggataaattatgcaacagggaacctgcctggttgctctttttct

SEQ ID NO: 127117 - DNA, 75 bp, Artificial Sequence
  Synthetic
tgccctcggagccttcacggaggctatgacgaggtactcagccccccccggagacgccccgcaaccagcatatga

SEQ ID NO: 127118 - DNA, 75 bp, Artificial Sequence
  Synthetic
ggctgatagcgttcgcttcgcggggtaaccacgtctcccccacgcactatgtgcctgagagcgacgccgcagctc

SEQ ID NO: 127119 - DNA, 75 bp, Artificial Sequence
  Synthetic
cgtggcgcactcacccacaacctgcgaacacatatcgacgtgatcgtaatggcagctacggcctgctcggccttg

SEQ ID NO: 127120 - DNA, 75 bp, Artificial Sequence
  Synthetic
gcccgagggcaggtcctgggcgcagcccgggtacccttggcctctttatggcaatgagggctgtgggtgggcagg

SEQ ID NO: 127121 - DNA, 75 bp, Artificial Sequence
  Synthetic
ccggcggaggtctcgcaacctgggtaaggtcatcgataccctaacttgcggcttcgccgacctcatgggatacat

SEQ ID NO: 127122 - DNA, 75 bp, Artificial Sequence
  Synthetic
tagcctacttctccatgcaaggagcgtgggccaaagtcgctgccatcctcctcctcgtcgcaggagtggacgcaa

SEQ ID NO: 127123 - DNA, 75 bp, Artificial Sequence
  Synthetic
catgagacacgctgtgataaatgtctcccccgctgtagccagccgtaaaccagccggacaaatccagccggctag

SEQ ID NO: 127124 - DNA, 75 bp, Artificial Sequence
  Synthetic
ccaacgactgcccgaattcaagcatagtctatgaagccgatcaccacatcttgcacctcccgggatgcgttcctt

SEQ ID NO: 127125 - DNA, 75 bp, Artificial Sequence
  Synthetic
catcaccaaactgctgctggccatcttcggacccctttggattcttcaaaccagtttgctcaaagtcccctactt

SEQ ID NO: 127126 - DNA, 75 bp, Artificial Sequence
  Synthetic
tatacatctaccagggtgtgtgccctgtgtgaggactgggaaccagtctcggtgctgggtggcgttaacccccac

SEQ ID NO: 127127 - DNA, 75 bp, Artificial Sequence
  Synthetic
ggtgctgggtggcgttaacccccactgtggcggcgcctagcgtcaatgctcctactgactccttgcggcgtcatg

SEQ ID NO: 127128 - DNA, 75 bp, Artificial Sequence
  Synthetic
cgaccccgctatttactcctgtgcctactcctactttctgtaggggtaggcatcttcctgctgcctgctcggtag

SEQ ID NO: 127129 - DNA, 75 bp, Artificial Sequence
  Synthetic
ccaacctgctgtcatccccgatcgagaggtgctgtaccgacagttcgacgaaatggaagagtgctctaagcacct

SEQ ID NO: 127130 - DNA, 75 bp, Artificial Sequence
  Synthetic
atttgtgtgggggcgtgttcttagtcggtcagctgttaaccttccaaccccgccgtcactggactactcaagact

SEQ ID NO: 127131 - DNA, 75 bp, Artificial Sequence
  Synthetic
atttgtgtgggggcgtgttcttagtcggtcagctgtttaccttccaaccccgccgtcactggactactcaagact

SEQ ID NO: 127132 - DNA, 75 bp, Artificial Sequence
  Synthetic
atttgtgtgggggcgtgttcttagtcggtcagctgttcaccttccaaccccgccgtcactggactactcaagact

SEQ ID NO: 127133 - DNA, 75 bp, Artificial Sequence
  Synthetic
atttgtgtgggggcgtgttcttagtcggtcagctgttgaccttccaaccccgccgtcactggactactcaagact

SEQ ID NO: 127134 - DNA, 75 bp, Artificial Sequence
  Synthetic
actaatgtcaccaatgatgaggacatgcgaccatactgctggcattaccctccaaagccctgcggcatcgtcccg

SEQ ID NO: 127135 - DNA, 75 bp, Artificial Sequence
  Synthetic
ctggcaaaaactcgagaccttctgggcgaagcatatgtggaacttcatcagtgggatacaatatctggcgggcct

SEQ ID NO: 127136 - DNA, 75 bp, Artificial Sequence
  Synthetic
tccaaagccctgcggcatcgtcccggctgggacggtttgtgggccggtctattgctttactcctagtcctgttgt

SEQ ID NO: 127137 - DNA, 75 bp, Artificial Sequence
  Synthetic
cgggcgccaagcaggatatccagctgatcaacaccaacggcagttggcacatcaaccgcacggccttgaactgta

SEQ ID NO: 127138 - DNA, 75 bp, Artificial Sequence
  Synthetic
catgaggattccaggcgccatcgtcgacctgcttgcaggcggccattggggtatcctggctggtctagcgtactt

SEQ ID NO: 127139 - DNA, 75 bp, Artificial Sequence
  Synthetic
ggcgtgctcgtggggcttgcgtactacagtatgcaggccaactgggctaaagttctcctggtcctgtttctcttt

SEQ ID NO: 127140 - DNA, 75 bp, Artificial Sequence
  Synthetic
ggactgggttcactaagacgtgcggcgcaccaccatgccgcattaggagggatttcaacagcaccctcgatttat

SEQ ID NO: 127141 - DNA, 75 bp, Artificial Sequence
  Synthetic
gccccaagcagaacatccagctgatcaacaccaacggcagttggcacatcaatcgcacggccttgaactgtaatg

SEQ ID NO: 127142 - DNA, 75 bp, Artificial Sequence
  Synthetic
gtgtaagggctctcctcatttttcaccccgggttccaagcagaacatacagctcatcaacaccaacgggagctgg

SEQ ID NO: 127143 - DNA, 75 bp, Artificial Sequence
  Synthetic
gtgtatgggctctcctcatttttcaccccgggttccaagcagaacatacagctcatcaacaccaacgggagctgg

SEQ ID NO: 127144 - DNA, 75 bp, Artificial Sequence
  Synthetic
gtgtacgggctctcctcatttttcaccccgggttccaagcagaacatacagctcatcaacaccaacgggagctgg

SEQ ID NO: 127145 - DNA, 75 bp, Artificial Sequence
  Synthetic
gtgtaggggctctcctcatttttcaccccgggttccaagcagaacatacagctcatcaacaccaacgggagctgg

SEQ ID NO: 127146 - DNA, 75 bp, Artificial Sequence
  Synthetic
agctcatcaacaccaatggaagctggcatatcaacaggacagctctcaactgcaacgacagccttaacacgggat

SEQ ID NO: 127147 - DNA, 75 bp, Artificial Sequence
  Synthetic
aactcttcaggctgtcccgagaggctggccagctgccgacgccttaccgattttgaccagggctggggccctatc

SEQ ID NO: 127148 - DNA, 75 bp, Artificial Sequence
  Synthetic
agaggcttgccagctgcagtggcctcgacagcctcccacagggctggggccccctgggggcctaccaggccaatg

SEQ ID NO: 127149 - DNA, 75 bp, Artificial Sequence
  Synthetic
gccactcaaagccggtaatgtcacgccttccggcgaaaggccctactgctggcactatgcgccccaaccatgcgg

SEQ ID NO: 127150 - DNA, 75 bp, Artificial Sequence
  Synthetic
tgggcagtgttgccatgctctttctccgacctaccggcgctatccactggtctgttgcacctccaccaaaacacc

SEQ ID NO: 127151 - DNA, 75 bp, Artificial Sequence
  Synthetic
aatactttatcaccagagccgaggcgcatttgcaagtgtgggtcccccccctcaacgttcgggggggccgcgatg

SEQ ID NO: 127152 - DNA, 75 bp, Artificial Sequence
  Synthetic
tggggggcgaacgggacagacgtgtttatcctcaactcaactaggccccccggaggggcatggtttgggtgtgtt

SEQ ID NO: 127153 - DNA, 75 bp, Artificial Sequence
  Synthetic
tggggggcgaacgggacagacgtgtttatcctcaactcaactaggccccccggtggggcatggtttgggtgtgtt

SEQ ID NO: 127154 - DNA, 75 bp, Artificial Sequence
  Synthetic
tggggggcgaacgggacagacgtgtttatcctcaactcaactaggccccccggcggggcatggtttgggtgtgtt

SEQ ID NO: 127155 - DNA, 75 bp, Artificial Sequence
  Synthetic
tggggggcgaacgggacagacgtgtttatcctcaactcaactaggccccccgggggggcatggtttgggtgtgtt

SEQ ID NO: 127156 - DNA, 75 bp, Artificial Sequence
  Synthetic
cggggtgcttggttcggctgcacgtggatgaacggcacagggttcacaaagtcctgcggcggccccccctgcagt

SEQ ID NO: 127157 - DNA, 75 bp, Artificial Sequence
  Synthetic
tgtggctctgggccttggcttacgccaagatgcctagtcgattatccttaccggctgtggcactatccgtgcaca

SEQ ID NO: 127158 - DNA, 75 bp, Artificial Sequence
  Synthetic
aacatccagacgccacctacaccaagtgtggctcggggccctggctaacaccgaggtgcatggttcactatgcgt

SEQ ID NO: 127159 - DNA, 75 bp, Artificial Sequence
  Synthetic
aacatccagacgccacctacaccaagtgtggctcggggccctggcttacaccgaggtgcatggttcactatgcgt

SEQ ID NO: 127160 - DNA, 75 bp, Artificial Sequence
  Synthetic
aacatccagacgccacctacaccaagtgtggctcggggccctggctcacaccgaggtgcatggttcactatgcgt

SEQ ID NO: 127161 - DNA, 75 bp, Artificial Sequence
  Synthetic
aacatccagacgccacctacaccaagtgtggctcggggccctggctgacaccgaggtgcatggttcactatgcgt

SEQ ID NO: 127162 - DNA, 75 bp, Artificial Sequence
  Synthetic
gtcaactacaccatctttaaggtcaggatgtatatcggcgggatagagcatcggctggacgcggcctgcaactgg

SEQ ID NO: 127163 - DNA, 75 bp, Artificial Sequence
  Synthetic
gtcaactacaccatctttaaggtcaggatgtatttcggcgggatagagcatcggctggacgcggcctgcaactgg

SEQ ID NO: 127164 - DNA, 75 bp, Artificial Sequence
  Synthetic
gtcaactacaccatctttaaggtcaggatgtatctcggcgggatagagcatcggctggacgcggcctgcaactgg

SEQ ID NO: 127165 - DNA, 75 bp, Artificial Sequence
  Synthetic
gtcaactacaccatctttaaggtcaggatgtatgtcggcgggatagagcatcggctggacgcggcctgcaactgg

SEQ ID NO: 127166 - DNA, 75 bp, Artificial Sequence
  Synthetic
gaccagaggagaaccctgtggcttggagcatagagatcgctcagagctatcgcccctgcacctttccaccacgca

SEQ ID NO: 127167 - DNA, 75 bp, Artificial Sequence
  Synthetic
gaccagaggagaaccctgtggcttggagcatagagatcgctcagagctatcgcccctgctcctttccaccacgca

SEQ ID NO: 127168 - DNA, 75 bp, Artificial Sequence
  Synthetic
gaccagaggagaaccctgtggcttggagcatagagatcgctcagagctatcgcccctgcccctttccaccacgca

SEQ ID NO: 127169 - DNA, 75 bp, Artificial Sequence
  Synthetic
gaccagaggagaaccctgtggcttggagcatagagatcgctcagagctatcgcccctgcgcctttccaccacgca

SEQ ID NO: 127170 - DNA, 75 bp, Artificial Sequence
  Synthetic
ccacgctgcccgccctctcgactggcttgatacacctccaccaaaacatcgttgacgtccaatacctttacggtg

SEQ ID NO: 127171 - DNA, 75 bp, Artificial Sequence
  Synthetic
ccacgctgcccgccctctcgactggcttgattcacctccaccaaaacatcgttgacgtccaatacctttacggtg

SEQ ID NO: 127172 - DNA, 75 bp, Artificial Sequence
  Synthetic
ccacgctgcccgccctctcgactggcttgatccacctccaccaaaacatcgttgacgtccaatacctttacggtg

SEQ ID NO: 127173 - DNA, 75 bp, Artificial Sequence
  Synthetic
ccacgctgcccgccctctcgactggcttgatgcacctccaccaaaacatcgttgacgtccaatacctttacggtg

SEQ ID NO: 127174 - DNA, 75 bp, Artificial Sequence
  Synthetic
cagctggcacatcaacaggactgccctgaactgcaatgactccctccacactgggttccttgctgcgctgttcta

SEQ ID NO: 127175 - DNA, 75 bp, Artificial Sequence
  Synthetic
ataggctcagtggtggtctcgtgggcgctcaaatgggagtacatagtgctcgcattcttgctgctcgcggatgcc

SEQ ID NO: 127176 - DNA, 75 bp, Artificial Sequence
  Synthetic
ataggctcagtggtggtctcgtgggcgctcaattgggagtacatagtgctcgcattcttgctgctcgcggatgcc

SEQ ID NO: 127177 - DNA, 75 bp, Artificial Sequence
  Synthetic
ataggctcagtggtggtctcgtgggcgctcaactgggagtacatagtgctcgcattcttgctgctcgcggatgcc

SEQ ID NO: 127178 - DNA, 75 bp, Artificial Sequence
  Synthetic
ataggctcagtggtggtctcgtgggcgctcaagtgggagtacatagtgctcgcattcttgctgctcgcggatgcc

SEQ ID NO: 127179 - DNA, 75 bp, Artificial Sequence
  Synthetic
ctgggttccttgctgcgctgttctacacacacaagttcaacgcgtcaggatgcccagagcgcatggccagctgcc

SEQ ID NO: 127180 - DNA, 75 bp, Artificial Sequence
  Synthetic
ctctgtcaccgcattacaagcgctatatcagctggtgcttatggtggcttcagtatttcctgaccagagtagaag

SEQ ID NO: 127181 - DNA, 75 bp, Artificial Sequence
  Synthetic
acggttggctttacgccattctcttcatctgcgtggtttggcacatcaaaggcaggctccccgctgctgcagctt

SEQ ID NO: 127182 - DNA, 75 bp, Artificial Sequence
  Synthetic
acggttggctttacgccattctcttcatctgcgtggtttggcacatcaaaggcaggctccccgctgctgctgctt

SEQ ID NO: 127183 - DNA, 75 bp, Artificial Sequence
  Synthetic
acggttggctttacgccattctcttcatctgcgtggtttggcacatcaaaggcaggctccccgctgctgccgctt

SEQ ID NO: 127184 - DNA, 75 bp, Artificial Sequence
  Synthetic
acggttggctttacgccattctcttcatctgcgtggtttggcacatcaaaggcaggctccccgctgctgcggctt

SEQ ID NO: 127185 - DNA, 75 bp, Artificial Sequence
  Synthetic
cccgcggcacaggtgtgcggtccagtgtattgcttcactccaagccctgtcgtggtggggacgaccgaccggttc

SEQ ID NO: 127186 - DNA, 75 bp, Artificial Sequence
  Synthetic
agtagcggggtctgttggtggtggtgtcctagtcctgctaactttgctgactttgtctccgcactacaaactgtg

SEQ ID NO: 127187 - DNA, 75 bp, Artificial Sequence
  Synthetic
cgtcttgatcctactgactgtcttaacgctatccccgcattacaagcggtggttagcgcggggggtgtggtgggt

SEQ ID NO: 127188 - DNA, 75 bp, Artificial Sequence
  Synthetic
cagtacttcattgctagagccgaggccagtatccatgtctttgtgccacctctggacgtgcgcgggcctcgcgat

SEQ ID NO: 127189 - DNA, 75 bp, Artificial Sequence
  Synthetic
cccctctggattcttcaagccagtttgcttaaagtgccctactttgtgcgcgtccaaggccttctccggatctgc

SEQ ID NO: 127190 - DNA, 75 bp, Artificial Sequence
  Synthetic
gcccacccccctctggtttttgagatcaccaaacacttacttgccttactgggccctctatacatacttcaggcc

SEQ ID NO: 127191 - DNA, 75 bp, Artificial Sequence
  Synthetic
cactcctgcgcgtcccttacttcgtgagagcgcacgcgctggtcaagatatgcagcctagtccgtggggtggtgt

SEQ ID NO: 127192 - DNA, 75 bp, Artificial Sequence
  Synthetic
agaccaagctcatcacgtggggggcagacactgccgcatgtggtgacatcatcgacggcttgcccgtctctgccc

SEQ ID NO: 127193 - DNA, 75 bp, Artificial Sequence
  Synthetic
tactcaagatgggtgccctaaccggcacctacgtctacaaccacctcaccccgctgtcggactgggctgctgacg

SEQ ID NO: 127194 - DNA, 75 bp, Artificial Sequence
  Synthetic
gcttagtgacctggcagtggcacttgaaccggtcgtgtttacgcccatggagaagaaaatcataacctggggcgc

SEQ ID NO: 127195 - DNA, 75 bp, Artificial Sequence
  Synthetic
caaggcctctctcaaccctcaagggctcatctggaggacccgtgctctgccccagaggacacgctgtgggcctgt

SEQ ID NO: 127196 - DNA, 75 bp, Artificial Sequence
  Synthetic
caggtattgccctgttccttcaccaccctaccggctctgtccactggtttgatccatctccatcgaaacatcgtg

SEQ ID NO: 127197 - DNA, 75 bp, Artificial Sequence
  Synthetic
catcaggggcttgcccgtgtcggctaggttgggcaatgagatcctgctcggccctgctgacgcggaattagtcaa

SEQ ID NO: 127198 - DNA, 75 bp, Artificial Sequence
  Synthetic
aactgtggcgaggtccaggtgctatccactgccacgcagtccttcctggggactgcggtaaacggcgttatgtgg

SEQ ID NO: 127199 - DNA, 75 bp, Artificial Sequence
  Synthetic
tccccccggagtgaagtccttgaccccgtgcacctgtggctcgtcggacttgttcctggtaaccaggcatgccga

SEQ ID NO: 127200 - DNA, 75 bp, Artificial Sequence
  Synthetic
cgccgccaggagtgaagtccctcgtaccgtgcacctgcggcgcgtcagacctgttcctggtcaccagacatgcgg

SEQ ID NO: 127201 - DNA, 75 bp, Artificial Sequence
  Synthetic
ccccttggtcacgccgccggcatcttccgagcagcggtgtgtacccggggtgtggctaaagcggtggaattcgtg

SEQ ID NO: 127202 - DNA, 75 bp, Artificial Sequence
  Synthetic
ccccttggtcacgccgccggcatcttccgagcagcggtgtgtacccggggtgtggctaaagcggtggatttcgtg

SEQ ID NO: 127203 - DNA, 75 bp, Artificial Sequence
  Synthetic
ccccttggtcacgccgccggcatcttccgagcagcggtgtgtacccggggtgtggctaaagcggtggacttcgtg

SEQ ID NO: 127204 - DNA, 75 bp, Artificial Sequence
  Synthetic
ccccttggtcacgccgccggcatcttccgagcagcggtgtgtacccggggtgtggctaaagcggtggagttcgtg

SEQ ID NO: 127205 - DNA, 75 bp, Artificial Sequence
  Synthetic
ccccttggtcacgccgccggcatcttccgagctgcggtgtgtacccggggtgtggctaaagcggtggaattcgtg

SEQ ID NO: 127206 - DNA, 75 bp, Artificial Sequence
  Synthetic
ccccttggtcacgccgccggcatcttccgagctgcggtgtgtacccggggtgtggctaaagcggtggatttcgtg

SEQ ID NO: 127207 - DNA, 75 bp, Artificial Sequence
  Synthetic
ccccttggtcacgccgccggcatcttccgagctgcggtgtgtacccggggtgtggctaaagcggtggacttcgtg

SEQ ID NO: 127208 - DNA, 75 bp, Artificial Sequence
  Synthetic
ccccttggtcacgccgccggcatcttccgagctgcggtgtgtacccggggtgtggctaaagcggtggagttcgtg

SEQ ID NO: 127209 - DNA, 75 bp, Artificial Sequence
  Synthetic
ccccttggtcacgccgccggcatcttccgagccgcggtgtgtacccggggtgtggctaaagcggtggaattcgtg

SEQ ID NO: 127210 - DNA, 75 bp, Artificial Sequence
  Synthetic
ccccttggtcacgccgccggcatcttccgagccgcggtgtgtacccggggtgtggctaaagcggtggatttcgtg

SEQ ID NO: 127211 - DNA, 75 bp, Artificial Sequence
  Synthetic
ccccttggtcacgccgccggcatcttccgagccgcggtgtgtacccggggtgtggctaaagcggtggacttcgtg

SEQ ID NO: 127212 - DNA, 75 bp, Artificial Sequence
  Synthetic
ccccttggtcacgccgccggcatcttccgagccgcggtgtgtacccggggtgtggctaaagcggtggagttcgtg

SEQ ID NO: 127213 - DNA, 75 bp, Artificial Sequence
  Synthetic
ccccttggtcacgccgccggcatcttccgagcggcggtgtgtacccggggtgtggctaaagcggtggaattcgtg

SEQ ID NO: 127214 - DNA, 75 bp, Artificial Sequence
  Synthetic
ccccttggtcacgccgccggcatcttccgagcggcggtgtgtacccggggtgtggctaaagcggtggatttcgtg

SEQ ID NO: 127215 - DNA, 75 bp, Artificial Sequence
  Synthetic
ccccttggtcacgccgccggcatcttccgagcggcggtgtgtacccggggtgtggctaaagcggtggacttcgtg

SEQ ID NO: 127216 - DNA, 75 bp, Artificial Sequence
  Synthetic
ccccttggtcacgccgccggcatcttccgagcggcggtgtgtacccggggtgtggctaaagcggtggagttcgtg

SEQ ID NO: 127217 - DNA, 75 bp, Artificial Sequence
  Synthetic
ccccctgggtcacgctgtcggaatattccgagctgcggtgtgtacccggggcgtggctaaagcggtggactttgt

SEQ ID NO: 127218 - DNA, 75 bp, Artificial Sequence
  Synthetic
gctggcgcccatcacggcgtatgcccagcagacaaggggcctcctagggtgtataatcaccagcctgaccggccg

SEQ ID NO: 127219 - DNA, 75 bp, Artificial Sequence
  Synthetic
atgaggtcccctgtgttcaccgacaattccacccctcctgcggtgccccagacctatcaggtcgcccacttgcac

SEQ ID NO: 127220 - DNA, 75 bp, Artificial Sequence
  Synthetic
gcttcggggcgtatatgtccaaggcatacggcatcgacccgaacatacggtcgggtgtcagaaccatcactacag

SEQ ID NO: 127221 - DNA, 75 bp, Artificial Sequence
  Synthetic
cgactctacaacgatcctcggtataggcaccgtcttggaccaagcagagactgctggagcgcgccttgtcgtgct

SEQ ID NO: 127222 - DNA, 75 bp, Artificial Sequence
  Synthetic
ggaggtcgctttgccgacgacgggagagatacccttctatggcaaggcgatccccctatctttgatcaagggggg

SEQ ID NO: 127223 - DNA, 75 bp, Artificial Sequence
  Synthetic
tgatggcattcagtgccgccctcaccagtccgttgtcgaccagtaccaccatccttctcaacatcatgggaggct

SEQ ID NO: 127224 - DNA, 75 bp, Artificial Sequence
  Synthetic
atccctctggccctaatcaaggggggcagacatctcatcttttgccattccaaaaagaagtgtgacgagttggcc

SEQ ID NO: 127225 - DNA, 75 bp, Artificial Sequence
  Synthetic
gcagacatctcatcttttgccattccaaaaagaagtgtgacgagttggccaagcagctatcgggccttggcctca

SEQ ID NO: 127226 - DNA, 75 bp, Artificial Sequence
  Synthetic
gacgtctcagtgataccattatctggtgacgtcgtggtttgcgccacagaagccctcatgacaggcttcaccggt

SEQ ID NO: 127227 - DNA, 75 bp, Artificial Sequence
  Synthetic
gacgtctcagtgataccattatctggtgacgtcgtggtttgcgccacagatgccctcatgacaggcttcaccggt

SEQ ID NO: 127228 - DNA, 75 bp, Artificial Sequence
  Synthetic
gacgtctcagtgataccattatctggtgacgtcgtggtttgcgccacagacgccctcatgacaggcttcaccggt

SEQ ID NO: 127229 - DNA, 75 bp, Artificial Sequence
  Synthetic
gacgtctcagtgataccattatctggtgacgtcgtggtttgcgccacagaggccctcatgacaggcttcaccggt

SEQ ID NO: 127230 - DNA, 75 bp, Artificial Sequence
  Synthetic
agacttcgactcagttatagactgcaacacctccgtcatacagactgttgacttcagcctagacccgaccttctc

SEQ ID NO: 127231 - DNA, 75 bp, Artificial Sequence
  Synthetic
acatcaccggccatagaatggcatgggacatgatgatgaactggtcacctaccaccaccttggtcctgtcaagcg

SEQ ID NO: 127232 - DNA, 75 bp, Artificial Sequence
  Synthetic
ttgggcgcggccggactataaccccccgctgatagagacgtggaaaaagcctgactacgaaccacctgtggtcca

SEQ ID NO: 127233 - DNA, 75 bp, Artificial Sequence
  Synthetic
ggggagaggccatccggcatatttgacacctcggtgctctgtgagtgctaagatgccgggtgcgcttggtacgaa

SEQ ID NO: 127234 - DNA, 75 bp, Artificial Sequence
  Synthetic
ggggagaggccatccggcatatttgacacctcggtgctctgtgagtgctatgatgccgggtgcgcttggtacgaa

SEQ ID NO: 127235 - DNA, 75 bp, Artificial Sequence
  Synthetic
ggggagaggccatccggcatatttgacacctcggtgctctgtgagtgctacgatgccgggtgcgcttggtacgaa

SEQ ID NO: 127236 - DNA, 75 bp, Artificial Sequence
  Synthetic
ggggagaggccatccggcatatttgacacctcggtgctctgtgagtgctaggatgccgggtgcgcttggtacgaa

SEQ ID NO: 127237 - DNA, 75 bp, Artificial Sequence
  Synthetic
gagcggtcgcaacctcgtgggaggcgccaacctatccccaaggcgcgccgacccgagggcaggtcctgggcgcag

SEQ ID NO: 127238 - DNA, 75 bp, Artificial Sequence
  Synthetic
agtcctagctgtgctgttcctgttcgcaggagtggaggcaaccaccacggtcgccagcgccgtgggccagcagac

SEQ ID NO: 127239 - DNA, 75 bp, Artificial Sequence
  Synthetic
ctggcttgaccaatatagatggccacttattgtcccagaccaagcaggcaggcgagaactacccatacttggtgg

SEQ ID NO: 127240 - DNA, 75 bp, Artificial Sequence
  Synthetic
ctggcttgaccaatatagatggccactttttgtcccagaccaagcaggcaggcgagaactacccatacttggtgg

SEQ ID NO: 127241 - DNA, 75 bp, Artificial Sequence
  Synthetic
ctggcttgaccaatatagatggccacttcttgtcccagaccaagcaggcaggcgagaactacccatacttggtgg

SEQ ID NO: 127242 - DNA, 75 bp, Artificial Sequence
  Synthetic
ctggcttgaccaatatagatggccacttgttgtcccagaccaagcaggcaggcgagaactacccatacttggtgg

SEQ ID NO: 127243 - DNA, 75 bp, Artificial Sequence
  Synthetic
aacgacagtctcaacaccgggttcatagctgggctcttctacatgaacaggtttaattccacgggctgaccacag

SEQ ID NO: 127244 - DNA, 75 bp, Artificial Sequence
  Synthetic
aacgacagtctcaacaccgggttcatagctgggctcttctacatgaacaggtttaattccacgggctgtccacag

SEQ ID NO: 127245 - DNA, 75 bp, Artificial Sequence
  Synthetic
aacgacagtctcaacaccgggttcatagctgggctcttctacatgaacaggtttaattccacgggctgcccacag

SEQ ID NO: 127246 - DNA, 75 bp, Artificial Sequence
  Synthetic
aacgacagtctcaacaccgggttcatagctgggctcttctacatgaacaggtttaattccacgggctggccacag

SEQ ID NO: 127247 - DNA, 75 bp, Artificial Sequence
  Synthetic
aacgacagtctcaacaccgggttcatagctgggctcttctacatgtacaggtttaattccacgggctgaccacag

SEQ ID NO: 127248 - DNA, 75 bp, Artificial Sequence
  Synthetic
aacgacagtctcaacaccgggttcatagctgggctcttctacatgtacaggtttaattccacgggctgtccacag

SEQ ID NO: 127249 - DNA, 75 bp, Artificial Sequence
  Synthetic
aacgacagtctcaacaccgggttcatagctgggctcttctacatgtacaggtttaattccacgggctgcccacag

SEQ ID NO: 127250 - DNA, 75 bp, Artificial Sequence
  Synthetic
aacgacagtctcaacaccgggttcatagctgggctcttctacatgtacaggtttaattccacgggctggccacag

SEQ ID NO: 127251 - DNA, 75 bp, Artificial Sequence
  Synthetic
aacgacagtctcaacaccgggttcatagctgggctcttctacatgcacaggtttaattccacgggctgaccacag

SEQ ID NO: 127252 - DNA, 75 bp, Artificial Sequence
  Synthetic
aacgacagtctcaacaccgggttcatagctgggctcttctacatgcacaggtttaattccacgggctgtccacag

SEQ ID NO: 127253 - DNA, 75 bp, Artificial Sequence
  Synthetic
aacgacagtctcaacaccgggttcatagctgggctcttctacatgcacaggtttaattccacgggctgcccacag

SEQ ID NO: 127254 - DNA, 75 bp, Artificial Sequence
  Synthetic
aacgacagtctcaacaccgggttcatagctgggctcttctacatgcacaggtttaattccacgggctggccacag

SEQ ID NO: 127255 - DNA, 75 bp, Artificial Sequence
  Synthetic
aacgacagtctcaacaccgggttcatagctgggctcttctacatggacaggtttaattccacgggctgaccacag

SEQ ID NO: 127256 - DNA, 75 bp, Artificial Sequence
  Synthetic
aacgacagtctcaacaccgggttcatagctgggctcttctacatggacaggtttaattccacgggctgtccacag

SEQ ID NO: 127257 - DNA, 75 bp, Artificial Sequence
  Synthetic
aacgacagtctcaacaccgggttcatagctgggctcttctacatggacaggtttaattccacgggctgcccacag

SEQ ID NO: 127258 - DNA, 75 bp, Artificial Sequence
  Synthetic
aacgacagtctcaacaccgggttcatagctgggctcttctacatggacaggtttaattccacgggctggccacag

SEQ ID NO: 127259 - DNA, 75 bp, Artificial Sequence
  Synthetic
gacaccacatggaaatgcctaattcgcctcaaacccacgttacacgggcccactcctcttctctacaggttaggg

SEQ ID NO: 127260 - DNA, 75 bp, Artificial Sequence
  Synthetic
gacaccacatggaaatgccttattcgcctcaaacccacgttacacgggcccactcctcttctctacaggttaggg

SEQ ID NO: 127261 - DNA, 75 bp, Artificial Sequence
  Synthetic
gacaccacatggaaatgcctcattcgcctcaaacccacgttacacgggcccactcctcttctctacaggttaggg

SEQ ID NO: 127262 - DNA, 75 bp, Artificial Sequence
  Synthetic
gacaccacatggaaatgcctgattcgcctcaaacccacgttacacgggcccactcctcttctctacaggttaggg

SEQ ID NO: 127263 - DNA, 75 bp, Artificial Sequence
  Synthetic
tggtgatcattggaagggtcgttctatcaggccaacctgctatcattcccgatcgggaggtgctatacaaacagt

SEQ ID NO: 127264 - DNA, 75 bp, Artificial Sequence
  Synthetic
ttccagcctccgcctatgaagttcgcaatgactcgggcatctaccacgtcaccaacgactgtggcaactccagca

SEQ ID NO: 127265 - DNA, 75 bp, Artificial Sequence
  Synthetic
ttccagcctccgcctatgaagttcgcaatgtctcgggcatctaccacgtcaccaacgactgtggcaactccagca

SEQ ID NO: 127266 - DNA, 75 bp, Artificial Sequence
  Synthetic
ttccagcctccgcctatgaagttcgcaatgcctcgggcatctaccacgtcaccaacgactgtggcaactccagca

SEQ ID NO: 127267 - DNA, 75 bp, Artificial Sequence
  Synthetic
ttccagcctccgcctatgaagttcgcaatggctcgggcatctaccacgtcaccaacgactgtggcaactccagca

SEQ ID NO: 127268 - DNA, 75 bp, Artificial Sequence
  Synthetic
tgggcggcatcctggcggccctagctgcgtactgcttgtcggtgggcagcgtagtgatcgtcgggagagtcgtcc

SEQ ID NO: 127269 - DNA, 75 bp, Artificial Sequence
  Synthetic
gttggcattacgctcctagggaatgcagtgtggtaccggcacaatcagtgtgtggcccggtctattgcttcacac

SEQ ID NO: 127270 - DNA, 75 bp, Artificial Sequence
  Synthetic
gttggcattacgctcctagggaatgcagtgtggttccggcacaatcagtgtgtggcccggtctattgcttcacac

SEQ ID NO: 127271 - DNA, 75 bp, Artificial Sequence
  Synthetic
gttggcattacgctcctagggaatgcagtgtggtcccggcacaatcagtgtgtggcccggtctattgcttcacac

SEQ ID NO: 127272 - DNA, 75 bp, Artificial Sequence
  Synthetic
gttggcattacgctcctagggaatgcagtgtggtgccggcacaatcagtgtgtggcccggtctattgcttcacac

SEQ ID NO: 127273 - DNA, 75 bp, Artificial Sequence
  Synthetic
cgctagcaagcaggcccaggaagcagcaccagtggtccagtcaaattttgccaaacttgaacaattttgggcgaa

SEQ ID NO: 127274 - DNA, 75 bp, Artificial Sequence
  Synthetic
cccgcagggagggtggtttggatgcacatggatgaactcttcaggctacaccaagacatgtggtgctccgccctg

SEQ ID NO: 127275 - DNA, 75 bp, Artificial Sequence
  Synthetic
cctacaattggcagaccagttcaagaagaaagccctcggcctcctaggtgttgccggcaagcaggcacaagaagc

SEQ ID NO: 127276 - DNA, 75 bp, Artificial Sequence
  Synthetic
cctacaattggcagaccagttcaagtagaaagccctcggcctcctaggtgttgccggcaagcaggcacaagaagc

SEQ ID NO: 127277 - DNA, 75 bp, Artificial Sequence
  Synthetic
cctacaattggcagaccagttcaagcagaaagccctcggcctcctaggtgttgccggcaagcaggcacaagaagc

SEQ ID NO: 127278 - DNA, 75 bp, Artificial Sequence
  Synthetic
cctacaattggcagaccagttcaaggagaaagccctcggcctcctaggtgttgccggcaagcaggcacaagaagc

SEQ ID NO: 127279 - DNA, 75 bp, Artificial Sequence
  Synthetic
ccttcaattggcagaccagttcaagaagaaagccctcggcctcctaggtgttgccggcaagcaggcacaagaagc

SEQ ID NO: 127280 - DNA, 75 bp, Artificial Sequence
  Synthetic
ccttcaattggcagaccagttcaagtagaaagccctcggcctcctaggtgttgccggcaagcaggcacaagaagc

SEQ ID NO: 127281 - DNA, 75 bp, Artificial Sequence
  Synthetic
ccttcaattggcagaccagttcaagcagaaagccctcggcctcctaggtgttgccggcaagcaggcacaagaagc

SEQ ID NO: 127282 - DNA, 75 bp, Artificial Sequence
  Synthetic
ccttcaattggcagaccagttcaaggagaaagccctcggcctcctaggtgttgccggcaagcaggcacaagaagc

SEQ ID NO: 127283 - DNA, 75 bp, Artificial Sequence
  Synthetic
cctccaattggcagaccagttcaagaagaaagccctcggcctcctaggtgttgccggcaagcaggcacaagaagc

SEQ ID NO: 127284 - DNA, 75 bp, Artificial Sequence
  Synthetic
cctccaattggcagaccagttcaagtagaaagccctcggcctcctaggtgttgccggcaagcaggcacaagaagc

SEQ ID NO: 127285 - DNA, 75 bp, Artificial Sequence
  Synthetic
cctccaattggcagaccagttcaagcagaaagccctcggcctcctaggtgttgccggcaagcaggcacaagaagc

SEQ ID NO: 127286 - DNA, 75 bp, Artificial Sequence
  Synthetic
cctccaattggcagaccagttcaaggagaaagccctcggcctcctaggtgttgccggcaagcaggcacaagaagc

SEQ ID NO: 127287 - DNA, 75 bp, Artificial Sequence
  Synthetic
cctgcaattggcagaccagttcaagaagaaagccctcggcctcctaggtgttgccggcaagcaggcacaagaagc

SEQ ID NO: 127288 - DNA, 75 bp, Artificial Sequence
  Synthetic
cctgcaattggcagaccagttcaagtagaaagccctcggcctcctaggtgttgccggcaagcaggcacaagaagc

SEQ ID NO: 127289 - DNA, 75 bp, Artificial Sequence
  Synthetic
cctgcaattggcagaccagttcaagcagaaagccctcggcctcctaggtgttgccggcaagcaggcacaagaagc

SEQ ID NO: 127290 - DNA, 75 bp, Artificial Sequence
  Synthetic
cctgcaattggcagaccagttcaaggagaaagccctcggcctcctaggtgttgccggcaagcaggcacaagaagc

SEQ ID NO: 127291 - DNA, 75 bp, Artificial Sequence
  Synthetic
cctcgcggcgcgaaacgtcagcttccctgtccagacgatcaggcgtcatgtcgatctgatggtgggggctgctgt

SEQ ID NO: 127292 - DNA, 75 bp, Artificial Sequence
  Synthetic
tcgggaccctggttgacccccaggtgtctcgtggactatccttacaggttatggcactatccatgcactgtcaac

SEQ ID NO: 127293 - DNA, 75 bp, Artificial Sequence
  Synthetic
accctgccaggtaatcccgccattgcttccctcatgtctttcactgcagctgtcacaagtcctctgaccactcag

SEQ ID NO: 127294 - DNA, 75 bp, Artificial Sequence
  Synthetic
aacggccctcgggcatgttcgattcctcggtcctgtgcgagtgctatgacgcgggctgtgcttggtatgagctca

SEQ ID NO: 127295 - DNA, 75 bp, Artificial Sequence
  Synthetic
tgcaattgctccatctacgcaggtcacgtcaccggccaccgtatggcatgggacatgatgatgaactggtctcct

SEQ ID NO: 127296 - DNA, 75 bp, Artificial Sequence
  Synthetic
gggacagggtagagatgagcccactacttttctcaactacacaacttgccatcctaccttgttctttcaccacca

SEQ ID NO: 127297 - DNA, 75 bp, Artificial Sequence
  Synthetic
cgattggcagcgtgggcctaggaaaggtcctggtcgacattctcgccggatacggcgccggcgtcgcaggcgctg

SEQ ID NO: 127298 - DNA, 75 bp, Artificial Sequence
  Synthetic
tcggtgatagactgcaacacgtgtgtcacccagacagtcgatttcagccttgaccctaccttcaccattgagaca

SEQ ID NO: 127299 - DNA, 75 bp, Artificial Sequence
  Synthetic
tttccatggcgggcaattgggccaaggtggtggtcgtgctgctcctcttcgctggcgttgacgcggccacttata

SEQ ID NO: 127300 - DNA, 75 bp, Artificial Sequence
  Synthetic
ggtcctggtcgacattctcgccggatacggcgccggcgtcgcaggcgctgtggtcacctttaaaatcatgagcgg

SEQ ID NO: 127301 - DNA, 75 bp, Artificial Sequence
  Synthetic
ccagtggatgaaccgcttgatcgcgttcgcgtcaaggggcaaccacgtggctcccacgcactacgtccccgagtc

SEQ ID NO: 127302 - DNA, 75 bp, Artificial Sequence
  Synthetic
gtgggagtacgtcgtcctcatgttcttagtcctggcggacgctcgaatatgcacctgcctctggctgatgctact

SEQ ID NO: 127303 - DNA, 75 bp, Artificial Sequence
  Synthetic
gcacataaatcgcactgccctgaattgcaatgacagcctcagcaccggctttctggttagcctgttctacaccca

SEQ ID NO: 127304 - DNA, 75 bp, Artificial Sequence
  Synthetic
cttcgcttcgcgtggcaatcacgtgtctcctacgcactacgtccctgagtccgacgcggcggcccgcgtaacagc

SEQ ID NO: 127305 - DNA, 75 bp, Artificial Sequence
  Synthetic
tgcgcttggtacgtgaagggccgacttgtgccctcgtgcacctatgtagcattaggcatgtggccactcctcctg

SEQ ID NO: 127306 - DNA, 75 bp, Artificial Sequence
  Synthetic
cacgagccggaggccgaggaccagcgaccatactgctggcattatgccccacgcccctgcggggtggtgagagcg

SEQ ID NO: 127307 - DNA, 75 bp, Artificial Sequence
  Synthetic
tatcgtgccagcacagaacgtatgtggcccagtgtattgcttcacccctagccccgtggtggtgggaacgaccga

SEQ ID NO: 127308 - DNA, 75 bp, Artificial Sequence
  Synthetic
atctgggactgggtttgcaccgtactgagtgacttcaaaacgtggcttaaagctaagctgctgccccgcatgcct

SEQ ID NO: 127309 - DNA, 75 bp, Artificial Sequence
  Synthetic
cacctgtaccacccataagatggcatatgattgtgacatggtggatgccaaccttttcatgggaggtgatgtgac

SEQ ID NO: 127310 - DNA, 75 bp, Artificial Sequence
  Synthetic
cccccatttacaagctgttgctcatgcaggctatttggtggaaccaatacatgctagcccgagccgaggctatgg

SEQ ID NO: 127311 - DNA, 75 bp, Artificial Sequence
  Synthetic
agaccgatgtcttcattctaaacagcaccagaccacccgctggaggttggttcggttgtacatggatgaacggca

SEQ ID NO: 127312 - DNA, 75 bp, Artificial Sequence
  Synthetic
cccgtggtggaatccaagtggcgggccctcgaagccttctgggcgaagcacatgtggaacttcatcagcgggata

SEQ ID NO: 127313 - DNA, 75 bp, Artificial Sequence
  Synthetic
acatcaaaaatggctcaatgagaatcgtcgggccaaagacatgtagcaacacctggcatggaacgttccccatca

SEQ ID NO: 127314 - DNA, 75 bp, Artificial Sequence
  Synthetic
tgaccgaggtagaggacgatcgtgagccttctgttccatcggagtacttgatcaggaggaaaaagttcccaccag

SEQ ID NO: 127315 - DNA, 75 bp, Artificial Sequence
  Synthetic
catcggaggggtgggcaacaacaccctgcactgccccactgactgtttccgcaagcatccggaagccacatactc

SEQ ID NO: 127316 - DNA, 75 bp, Artificial Sequence
  Synthetic
gatcttgttggccatcttagcccccctgcacatcctccaacacagtttgctcaaggtgccttactttgtgcgtgc

SEQ ID NO: 127317 - DNA, 75 bp, Artificial Sequence
  Synthetic
tctgtggccagctcctcggccagccagctgtccgctccatctctcaaggcaacttgcactaccaaccatgactcc

SEQ ID NO: 127318 - DNA, 75 bp, Artificial Sequence
  Synthetic
gaggacgtcgtctgctgctcgatgtcctacacatggacaggcgccctgatcacgccatgcgctgcggaggaaagc

SEQ ID NO: 127319 - DNA, 75 bp, Artificial Sequence
  Synthetic
agccacctacgctaagtgtggctccggcccgtggctcactccgagatgcctggtgcactatgaatacagactatg

SEQ ID NO: 127320 - DNA, 75 bp, Artificial Sequence
  Synthetic
gggtgacttccattatatcaccggggtgacacaggataacatcaaatgcccctgccaggtgcctgcacctgagtt

SEQ ID NO: 127321 - DNA, 75 bp, Artificial Sequence
  Synthetic
caaattcaacagatctggttgccccgagcgcttgtcttcatgccgcaggttggatgatttccgcatcgggtgggg

SEQ ID NO: 127322 - DNA, 75 bp, Artificial Sequence
  Synthetic
caaattcaacagatctggttgccccgagcgcttgtcttcttgccgcaggttggatgatttccgcatcgggtgggg

SEQ ID NO: 127323 - DNA, 75 bp, Artificial Sequence
  Synthetic
caaattcaacagatctggttgccccgagcgcttgtcttcctgccgcaggttggatgatttccgcatcgggtgggg

SEQ ID NO: 127324 - DNA, 75 bp, Artificial Sequence
  Synthetic
caaattcaacagatctggttgccccgagcgcttgtcttcgtgccgcaggttggatgatttccgcatcgggtgggg

SEQ ID NO: 127325 - DNA, 75 bp, Artificial Sequence
  Synthetic
caaattcaacagttctggttgccccgagcgcttgtcttcatgccgcaggttggatgatttccgcatcgggtgggg

SEQ ID NO: 127326 - DNA, 75 bp, Artificial Sequence
  Synthetic
caaattcaacagttctggttgccccgagcgcttgtcttcttgccgcaggttggatgatttccgcatcgggtgggg

SEQ ID NO: 127327 - DNA, 75 bp, Artificial Sequence
  Synthetic
caaattcaacagttctggttgccccgagcgcttgtcttcctgccgcaggttggatgatttccgcatcgggtgggg

SEQ ID NO: 127328 - DNA, 75 bp, Artificial Sequence
  Synthetic
caaattcaacagttctggttgccccgagcgcttgtcttcgtgccgcaggttggatgatttccgcatcgggtgggg

SEQ ID NO: 127329 - DNA, 75 bp, Artificial Sequence
  Synthetic
caaattcaacagctctggttgccccgagcgcttgtcttcatgccgcaggttggatgatttccgcatcgggtgggg

SEQ ID NO: 127330 - DNA, 75 bp, Artificial Sequence
  Synthetic
caaattcaacagctctggttgccccgagcgcttgtcttcttgccgcaggttggatgatttccgcatcgggtgggg

SEQ ID NO: 127331 - DNA, 75 bp, Artificial Sequence
  Synthetic
caaattcaacagctctggttgccccgagcgcttgtcttcctgccgcaggttggatgatttccgcatcgggtgggg

SEQ ID NO: 127332 - DNA, 75 bp, Artificial Sequence
  Synthetic
caaattcaacagctctggttgccccgagcgcttgtcttcgtgccgcaggttggatgatttccgcatcgggtgggg

SEQ ID NO: 127333 - DNA, 75 bp, Artificial Sequence
  Synthetic
caaattcaacaggtctggttgccccgagcgcttgtcttcatgccgcaggttggatgatttccgcatcgggtgggg

SEQ ID NO: 127334 - DNA, 75 bp, Artificial Sequence
  Synthetic
caaattcaacaggtctggttgccccgagcgcttgtcttcttgccgcaggttggatgatttccgcatcgggtgggg

SEQ ID NO: 127335 - DNA, 75 bp, Artificial Sequence
  Synthetic
caaattcaacaggtctggttgccccgagcgcttgtcttcctgccgcaggttggatgatttccgcatcgggtgggg

SEQ ID NO: 127336 - DNA, 75 bp, Artificial Sequence
  Synthetic
caaattcaacaggtctggttgccccgagcgcttgtcttcgtgccgcaggttggatgatttccgcatcgggtgggg

SEQ ID NO: 127337 - DNA, 75 bp, Artificial Sequence
  Synthetic
caatttcaacagatctggttgccccgagcgcttgtcttcatgccgcaggttggatgatttccgcatcgggtgggg

SEQ ID NO: 127338 - DNA, 75 bp, Artificial Sequence
  Synthetic
caatttcaacagatctggttgccccgagcgcttgtcttcttgccgcaggttggatgatttccgcatcgggtgggg

SEQ ID NO: 127339 - DNA, 75 bp, Artificial Sequence
  Synthetic
caatttcaacagatctggttgccccgagcgcttgtcttcctgccgcaggttggatgatttccgcatcgggtgggg

SEQ ID NO: 127340 - DNA, 75 bp, Artificial Sequence
  Synthetic
caatttcaacagatctggttgccccgagcgcttgtcttcgtgccgcaggttggatgatttccgcatcgggtgggg

SEQ ID NO: 127341 - DNA, 75 bp, Artificial Sequence
  Synthetic
caatttcaacagttctggttgccccgagcgcttgtcttcatgccgcaggttggatgatttccgcatcgggtgggg

SEQ ID NO: 127342 - DNA, 75 bp, Artificial Sequence
  Synthetic
caatttcaacagttctggttgccccgagcgcttgtcttcttgccgcaggttggatgatttccgcatcgggtgggg

SEQ ID NO: 127343 - DNA, 75 bp, Artificial Sequence
  Synthetic
caatttcaacagttctggttgccccgagcgcttgtcttcctgccgcaggttggatgatttccgcatcgggtgggg

SEQ ID NO: 127344 - DNA, 75 bp, Artificial Sequence
  Synthetic
caatttcaacagttctggttgccccgagcgcttgtcttcgtgccgcaggttggatgatttccgcatcgggtgggg

SEQ ID NO: 127345 - DNA, 75 bp, Artificial Sequence
  Synthetic
caatttcaacagctctggttgccccgagcgcttgtcttcatgccgcaggttggatgatttccgcatcgggtgggg

SEQ ID NO: 127346 - DNA, 75 bp, Artificial Sequence
  Synthetic
caatttcaacagctctggttgccccgagcgcttgtcttcttgccgcaggttggatgatttccgcatcgggtgggg

SEQ ID NO: 127347 - DNA, 75 bp, Artificial Sequence
  Synthetic
caatttcaacagctctggttgccccgagcgcttgtcttcctgccgcaggttggatgatttccgcatcgggtgggg

SEQ ID NO: 127348 - DNA, 75 bp, Artificial Sequence
  Synthetic
caatttcaacagctctggttgccccgagcgcttgtcttcgtgccgcaggttggatgatttccgcatcgggtgggg

SEQ ID NO: 127349 - DNA, 75 bp, Artificial Sequence
  Synthetic
caatttcaacaggtctggttgccccgagcgcttgtcttcatgccgcaggttggatgatttccgcatcgggtgggg

SEQ ID NO: 127350 - DNA, 75 bp, Artificial Sequence
  Synthetic
caatttcaacaggtctggttgccccgagcgcttgtcttcttgccgcaggttggatgatttccgcatcgggtgggg

SEQ ID NO: 127351 - DNA, 75 bp, Artificial Sequence
  Synthetic
caatttcaacaggtctggttgccccgagcgcttgtcttcctgccgcaggttggatgatttccgcatcgggtgggg

SEQ ID NO: 127352 - DNA, 75 bp, Artificial Sequence
  Synthetic
caatttcaacaggtctggttgccccgagcgcttgtcttcgtgccgcaggttggatgatttccgcatcgggtgggg

SEQ ID NO: 127353 - DNA, 75 bp, Artificial Sequence
  Synthetic
caacttcaacagatctggttgccccgagcgcttgtcttcatgccgcaggttggatgatttccgcatcgggtgggg

SEQ ID NO: 127354 - DNA, 75 bp, Artificial Sequence
  Synthetic
caacttcaacagatctggttgccccgagcgcttgtcttcttgccgcaggttggatgatttccgcatcgggtgggg

SEQ ID NO: 127355 - DNA, 75 bp, Artificial Sequence
  Synthetic
caacttcaacagatctggttgccccgagcgcttgtcttcctgccgcaggttggatgatttccgcatcgggtgggg

SEQ ID NO: 127356 - DNA, 75 bp, Artificial Sequence
  Synthetic
caacttcaacagatctggttgccccgagcgcttgtcttcgtgccgcaggttggatgatttccgcatcgggtgggg

SEQ ID NO: 127357 - DNA, 75 bp, Artificial Sequence
  Synthetic
caacttcaacagttctggttgccccgagcgcttgtcttcatgccgcaggttggatgatttccgcatcgggtgggg

SEQ ID NO: 127358 - DNA, 75 bp, Artificial Sequence
  Synthetic
caacttcaacagttctggttgccccgagcgcttgtcttcttgccgcaggttggatgatttccgcatcgggtgggg

SEQ ID NO: 127359 - DNA, 75 bp, Artificial Sequence
  Synthetic
caacttcaacagttctggttgccccgagcgcttgtcttcctgccgcaggttggatgatttccgcatcgggtgggg

SEQ ID NO: 127360 - DNA, 75 bp, Artificial Sequence
  Synthetic
caacttcaacagttctggttgccccgagcgcttgtcttcgtgccgcaggttggatgatttccgcatcgggtgggg

SEQ ID NO: 127361 - DNA, 75 bp, Artificial Sequence
  Synthetic
caacttcaacagctctggttgccccgagcgcttgtcttcatgccgcaggttggatgatttccgcatcgggtgggg

SEQ ID NO: 127362 - DNA, 75 bp, Artificial Sequence
  Synthetic
caacttcaacagctctggttgccccgagcgcttgtcttcttgccgcaggttggatgatttccgcatcgggtgggg

SEQ ID NO: 127363 - DNA, 75 bp, Artificial Sequence
  Synthetic
caacttcaacagctctggttgccccgagcgcttgtcttcctgccgcaggttggatgatttccgcatcgggtgggg

SEQ ID NO: 127364 - DNA, 75 bp, Artificial Sequence
  Synthetic
caacttcaacagctctggttgccccgagcgcttgtcttcgtgccgcaggttggatgatttccgcatcgggtgggg

SEQ ID NO: 127365 - DNA, 75 bp, Artificial Sequence
  Synthetic
caacttcaacaggtctggttgccccgagcgcttgtcttcatgccgcaggttggatgatttccgcatcgggtgggg

SEQ ID NO: 127366 - DNA, 75 bp, Artificial Sequence
  Synthetic
caacttcaacaggtctggttgccccgagcgcttgtcttcttgccgcaggttggatgatttccgcatcgggtgggg

SEQ ID NO: 127367 - DNA, 75 bp, Artificial Sequence
  Synthetic
caacttcaacaggtctggttgccccgagcgcttgtcttcctgccgcaggttggatgatttccgcatcgggtgggg

SEQ ID NO: 127368 - DNA, 75 bp, Artificial Sequence
  Synthetic
caacttcaacaggtctggttgccccgagcgcttgtcttcgtgccgcaggttggatgatttccgcatcgggtgggg

SEQ ID NO: 127369 - DNA, 75 bp, Artificial Sequence
  Synthetic
caagttcaacagatctggttgccccgagcgcttgtcttcatgccgcaggttggatgatttccgcatcgggtgggg

SEQ ID NO: 127370 - DNA, 75 bp, Artificial Sequence
  Synthetic
caagttcaacagatctggttgccccgagcgcttgtcttcttgccgcaggttggatgatttccgcatcgggtgggg

SEQ ID NO: 127371 - DNA, 75 bp, Artificial Sequence
  Synthetic
caagttcaacagatctggttgccccgagcgcttgtcttcctgccgcaggttggatgatttccgcatcgggtgggg

SEQ ID NO: 127372 - DNA, 75 bp, Artificial Sequence
  Synthetic
caagttcaacagatctggttgccccgagcgcttgtcttcgtgccgcaggttggatgatttccgcatcgggtgggg

SEQ ID NO: 127373 - DNA, 75 bp, Artificial Sequence
  Synthetic
caagttcaacagttctggttgccccgagcgcttgtcttcatgccgcaggttggatgatttccgcatcgggtgggg

SEQ ID NO: 127374 - DNA, 75 bp, Artificial Sequence
  Synthetic
caagttcaacagttctggttgccccgagcgcttgtcttcttgccgcaggttggatgatttccgcatcgggtgggg

SEQ ID NO: 127375 - DNA, 75 bp, Artificial Sequence
  Synthetic
caagttcaacagttctggttgccccgagcgcttgtcttcctgccgcaggttggatgatttccgcatcgggtgggg

SEQ ID NO: 127376 - DNA, 75 bp, Artificial Sequence
  Synthetic
caagttcaacagttctggttgccccgagcgcttgtcttcgtgccgcaggttggatgatttccgcatcgggtgggg

SEQ ID NO: 127377 - DNA, 75 bp, Artificial Sequence
  Synthetic
caagttcaacagctctggttgccccgagcgcttgtcttcatgccgcaggttggatgatttccgcatcgggtgggg

SEQ ID NO: 127378 - DNA, 75 bp, Artificial Sequence
  Synthetic
caagttcaacagctctggttgccccgagcgcttgtcttcttgccgcaggttggatgatttccgcatcgggtgggg

SEQ ID NO: 127379 - DNA, 75 bp, Artificial Sequence
  Synthetic
caagttcaacagctctggttgccccgagcgcttgtcttcctgccgcaggttggatgatttccgcatcgggtgggg

SEQ ID NO: 127380 - DNA, 75 bp, Artificial Sequence
  Synthetic
caagttcaacagctctggttgccccgagcgcttgtcttcgtgccgcaggttggatgatttccgcatcgggtgggg

SEQ ID NO: 127381 - DNA, 75 bp, Artificial Sequence
  Synthetic
caagttcaacaggtctggttgccccgagcgcttgtcttcatgccgcaggttggatgatttccgcatcgggtgggg

SEQ ID NO: 127382 - DNA, 75 bp, Artificial Sequence
  Synthetic
caagttcaacaggtctggttgccccgagcgcttgtcttcttgccgcaggttggatgatttccgcatcgggtgggg

SEQ ID NO: 127383 - DNA, 75 bp, Artificial Sequence
  Synthetic
caagttcaacaggtctggttgccccgagcgcttgtcttcctgccgcaggttggatgatttccgcatcgggtgggg

SEQ ID NO: 127384 - DNA, 75 bp, Artificial Sequence
  Synthetic
caagttcaacaggtctggttgccccgagcgcttgtcttcgtgccgcaggttggatgatttccgcatcgggtgggg

SEQ ID NO: 127385 - DNA, 75 bp, Artificial Sequence
  Synthetic
ggcccgtggctcactccgagatgcctggtgcactatgaatacagactatggcactacccctgcactgtcaacttc

SEQ ID NO: 127386 - DNA, 75 bp, Artificial Sequence
  Synthetic
ctgtatgaccatctcagtcccctctccgattgggccagcgacggcttacgcgatctagctgtggccgttgagccg

SEQ ID NO: 127387 - DNA, 75 bp, Artificial Sequence
  Synthetic
acatctatgctgacagatccatctcacatcacagcggaggcggcacgtcgtaggctgggaagggggtcaccgccc

SEQ ID NO: 127388 - DNA, 75 bp, Artificial Sequence
  Synthetic
gtggtggggtcccagctcccctgtgagccagagccagacgtagcagtgttgacatctatgataacagacccatct

SEQ ID NO: 127389 - DNA, 75 bp, Artificial Sequence
  Synthetic
gtggtggggtcccagctcccctgtgagccagagccagacgtagcagtgttgacatctatgttaacagacccatct

SEQ ID NO: 127390 - DNA, 75 bp, Artificial Sequence
  Synthetic
gtggtggggtcccagctcccctgtgagccagagccagacgtagcagtgttgacatctatgctaacagacccatct

SEQ ID NO: 127391 - DNA, 75 bp, Artificial Sequence
  Synthetic
gtggtggggtcccagctcccctgtgagccagagccagacgtagcagtgttgacatctatggtaacagacccatct

SEQ ID NO: 127392 - DNA, 75 bp, Artificial Sequence
  Synthetic
ggaatttggtgctgttaggacccgcagatgacatgcgtcgcggaggttggaggctcttggctccaatcacagctt

SEQ ID NO: 127393 - DNA, 75 bp, Artificial Sequence
  Synthetic
ggaatttggtgctgttaggacccgcagatgacatgcgtcgcggaggttggaggctcttggctccaatcactgctt

SEQ ID NO: 127394 - DNA, 75 bp, Artificial Sequence
  Synthetic
ggaatttggtgctgttaggacccgcagatgacatgcgtcgcggaggttggaggctcttggctccaatcaccgctt

SEQ ID NO: 127395 - DNA, 75 bp, Artificial Sequence
  Synthetic
ggaatttggtgctgttaggacccgcagatgacatgcgtcgcggaggttggaggctcttggctccaatcacggctt

SEQ ID NO: 127396 - DNA, 75 bp, Artificial Sequence
  Synthetic
ggaatttggtgctgttaggacccgcagatgacatgcgtcgcggaggttggaggctcttggctcctatcacagctt

SEQ ID NO: 127397 - DNA, 75 bp, Artificial Sequence
  Synthetic
ggaatttggtgctgttaggacccgcagatgacatgcgtcgcggaggttggaggctcttggctcctatcactgctt

SEQ ID NO: 127398 - DNA, 75 bp, Artificial Sequence
  Synthetic
ggaatttggtgctgttaggacccgcagatgacatgcgtcgcggaggttggaggctcttggctcctatcaccgctt

SEQ ID NO: 127399 - DNA, 75 bp, Artificial Sequence
  Synthetic
ggaatttggtgctgttaggacccgcagatgacatgcgtcgcggaggttggaggctcttggctcctatcacggctt

SEQ ID NO: 127400 - DNA, 75 bp, Artificial Sequence
  Synthetic
ggaatttggtgctgttaggacccgcagatgacatgcgtcgcggaggttggaggctcttggctcccatcacagctt

SEQ ID NO: 127401 - DNA, 75 bp, Artificial Sequence
  Synthetic
ggaatttggtgctgttaggacccgcagatgacatgcgtcgcggaggttggaggctcttggctcccatcactgctt

SEQ ID NO: 127402 - DNA, 75 bp, Artificial Sequence
  Synthetic
ggaatttggtgctgttaggacccgcagatgacatgcgtcgcggaggttggaggctcttggctcccatcaccgctt

SEQ ID NO: 127403 - DNA, 75 bp, Artificial Sequence
  Synthetic
ggaatttggtgctgttaggacccgcagatgacatgcgtcgcggaggttggaggctcttggctcccatcacggctt

SEQ ID NO: 127404 - DNA, 75 bp, Artificial Sequence
  Synthetic
ggaatttggtgctgttaggacccgcagatgacatgcgtcgcggaggttggaggctcttggctccgatcacagctt

SEQ ID NO: 127405 - DNA, 75 bp, Artificial Sequence
  Synthetic
ggaatttggtgctgttaggacccgcagatgacatgcgtcgcggaggttggaggctcttggctccgatcactgctt

SEQ ID NO: 127406 - DNA, 75 bp, Artificial Sequence
  Synthetic
ggaatttggtgctgttaggacccgcagatgacatgcgtcgcggaggttggaggctcttggctccgatcaccgctt

SEQ ID NO: 127407 - DNA, 75 bp, Artificial Sequence
  Synthetic
ggaatttggtgctgttaggacccgcagatgacatgcgtcgcggaggttggaggctcttggctccgatcacggctt

SEQ ID NO: 127408 - DNA, 75 bp, Artificial Sequence
  Synthetic
ggaatttggtgctgttaggtcccgcagatgacatgcgtcgcggaggttggaggctcttggctccaatcacagctt

SEQ ID NO: 127409 - DNA, 75 bp, Artificial Sequence
  Synthetic
ggaatttggtgctgttaggtcccgcagatgacatgcgtcgcggaggttggaggctcttggctccaatcactgctt

SEQ ID NO: 127410 - DNA, 75 bp, Artificial Sequence
  Synthetic
ggaatttggtgctgttaggtcccgcagatgacatgcgtcgcggaggttggaggctcttggctccaatcaccgctt

SEQ ID NO: 127411 - DNA, 75 bp, Artificial Sequence
  Synthetic
ggaatttggtgctgttaggtcccgcagatgacatgcgtcgcggaggttggaggctcttggctccaatcacggctt

SEQ ID NO: 127412 - DNA, 75 bp, Artificial Sequence
  Synthetic
ggaatttggtgctgttaggtcccgcagatgacatgcgtcgcggaggttggaggctcttggctcctatcacagctt

SEQ ID NO: 127413 - DNA, 75 bp, Artificial Sequence
  Synthetic
ggaatttggtgctgttaggtcccgcagatgacatgcgtcgcggaggttggaggctcttggctcctatcactgctt

SEQ ID NO: 127414 - DNA, 75 bp, Artificial Sequence
  Synthetic
ggaatttggtgctgttaggtcccgcagatgacatgcgtcgcggaggttggaggctcttggctcctatcaccgctt

SEQ ID NO: 127415 - DNA, 75 bp, Artificial Sequence
  Synthetic
ggaatttggtgctgttaggtcccgcagatgacatgcgtcgcggaggttggaggctcttggctcctatcacggctt

SEQ ID NO: 127416 - DNA, 75 bp, Artificial Sequence
  Synthetic
ggaatttggtgctgttaggtcccgcagatgacatgcgtcgcggaggttggaggctcttggctcccatcacagctt

SEQ ID NO: 127417 - DNA, 75 bp, Artificial Sequence
  Synthetic
ggaatttggtgctgttaggtcccgcagatgacatgcgtcgcggaggttggaggctcttggctcccatcactgctt

SEQ ID NO: 127418 - DNA, 75 bp, Artificial Sequence
  Synthetic
ggaatttggtgctgttaggtcccgcagatgacatgcgtcgcggaggttggaggctcttggctcccatcaccgctt

SEQ ID NO: 127419 - DNA, 75 bp, Artificial Sequence
  Synthetic
ggaatttggtgctgttaggtcccgcagatgacatgcgtcgcggaggttggaggctcttggctcccatcacggctt

SEQ ID NO: 127420 - DNA, 75 bp, Artificial Sequence
  Synthetic
ggaatttggtgctgttaggtcccgcagatgacatgcgtcgcggaggttggaggctcttggctccgatcacagctt

SEQ ID NO: 127421 - DNA, 75 bp, Artificial Sequence
  Synthetic
ggaatttggtgctgttaggtcccgcagatgacatgcgtcgcggaggttggaggctcttggctccgatcactgctt

SEQ ID NO: 127422 - DNA, 75 bp, Artificial Sequence
  Synthetic
ggaatttggtgctgttaggtcccgcagatgacatgcgtcgcggaggttggaggctcttggctccgatcaccgctt

SEQ ID NO: 127423 - DNA, 75 bp, Artificial Sequence
  Synthetic
ggaatttggtgctgttaggtcccgcagatgacatgcgtcgcggaggttggaggctcttggctccgatcacggctt

SEQ ID NO: 127424 - DNA, 75 bp, Artificial Sequence
  Synthetic
ggaatttggtgctgttaggccccgcagatgacatgcgtcgcggaggttggaggctcttggctccaatcacagctt

SEQ ID NO: 127425 - DNA, 75 bp, Artificial Sequence
  Synthetic
ggaatttggtgctgttaggccccgcagatgacatgcgtcgcggaggttggaggctcttggctccaatcactgctt

SEQ ID NO: 127426 - DNA, 75 bp, Artificial Sequence
  Synthetic
ggaatttggtgctgttaggccccgcagatgacatgcgtcgcggaggttggaggctcttggctccaatcaccgctt

SEQ ID NO: 127427 - DNA, 75 bp, Artificial Sequence
  Synthetic
ggaatttggtgctgttaggccccgcagatgacatgcgtcgcggaggttggaggctcttggctccaatcacggctt

SEQ ID NO: 127428 - DNA, 75 bp, Artificial Sequence
  Synthetic
ggaatttggtgctgttaggccccgcagatgacatgcgtcgcggaggttggaggctcttggctcctatcacagctt

SEQ ID NO: 127429 - DNA, 75 bp, Artificial Sequence
  Synthetic
ggaatttggtgctgttaggccccgcagatgacatgcgtcgcggaggttggaggctcttggctcctatcactgctt

SEQ ID NO: 127430 - DNA, 75 bp, Artificial Sequence
  Synthetic
ggaatttggtgctgttaggccccgcagatgacatgcgtcgcggaggttggaggctcttggctcctatcaccgctt

SEQ ID NO: 127431 - DNA, 75 bp, Artificial Sequence
  Synthetic
ggaatttggtgctgttaggccccgcagatgacatgcgtcgcggaggttggaggctcttggctcctatcacggctt

SEQ ID NO: 127432 - DNA, 75 bp, Artificial Sequence
  Synthetic
ggaatttggtgctgttaggccccgcagatgacatgcgtcgcggaggttggaggctcttggctcccatcacagctt

SEQ ID NO: 127433 - DNA, 75 bp, Artificial Sequence
  Synthetic
ggaatttggtgctgttaggccccgcagatgacatgcgtcgcggaggttggaggctcttggctcccatcactgctt

SEQ ID NO: 127434 - DNA, 75 bp, Artificial Sequence
  Synthetic
ggaatttggtgctgttaggccccgcagatgacatgcgtcgcggaggttggaggctcttggctcccatcaccgctt

SEQ ID NO: 127435 - DNA, 75 bp, Artificial Sequence
  Synthetic
ggaatttggtgctgttaggccccgcagatgacatgcgtcgcggaggttggaggctcttggctcccatcacggctt

SEQ ID NO: 127436 - DNA, 75 bp, Artificial Sequence
  Synthetic
ggaatttggtgctgttaggccccgcagatgacatgcgtcgcggaggttggaggctcttggctccgatcacagctt

SEQ ID NO: 127437 - DNA, 75 bp, Artificial Sequence
  Synthetic
ggaatttggtgctgttaggccccgcagatgacatgcgtcgcggaggttggaggctcttggctccgatcactgctt

SEQ ID NO: 127438 - DNA, 75 bp, Artificial Sequence
  Synthetic
ggaatttggtgctgttaggccccgcagatgacatgcgtcgcggaggttggaggctcttggctccgatcaccgctt

SEQ ID NO: 127439 - DNA, 75 bp, Artificial Sequence
  Synthetic
ggaatttggtgctgttaggccccgcagatgacatgcgtcgcggaggttggaggctcttggctccgatcacggctt

SEQ ID NO: 127440 - DNA, 75 bp, Artificial Sequence
  Synthetic
ggaatttggtgctgttagggcccgcagatgacatgcgtcgcggaggttggaggctcttggctccaatcacagctt

SEQ ID NO: 127441 - DNA, 75 bp, Artificial Sequence
  Synthetic
ggaatttggtgctgttagggcccgcagatgacatgcgtcgcggaggttggaggctcttggctccaatcactgctt

SEQ ID NO: 127442 - DNA, 75 bp, Artificial Sequence
  Synthetic
ggaatttggtgctgttagggcccgcagatgacatgcgtcgcggaggttggaggctcttggctccaatcaccgctt

SEQ ID NO: 127443 - DNA, 75 bp, Artificial Sequence
  Synthetic
ggaatttggtgctgttagggcccgcagatgacatgcgtcgcggaggttggaggctcttggctccaatcacggctt

SEQ ID NO: 127444 - DNA, 75 bp, Artificial Sequence
  Synthetic
ggaatttggtgctgttagggcccgcagatgacatgcgtcgcggaggttggaggctcttggctcctatcacagctt

SEQ ID NO: 127445 - DNA, 75 bp, Artificial Sequence
  Synthetic
ggaatttggtgctgttagggcccgcagatgacatgcgtcgcggaggttggaggctcttggctcctatcactgctt

SEQ ID NO: 127446 - DNA, 75 bp, Artificial Sequence
  Synthetic
ggaatttggtgctgttagggcccgcagatgacatgcgtcgcggaggttggaggctcttggctcctatcaccgctt

SEQ ID NO: 127447 - DNA, 75 bp, Artificial Sequence
  Synthetic
ggaatttggtgctgttagggcccgcagatgacatgcgtcgcggaggttggaggctcttggctcctatcacggctt

SEQ ID NO: 127448 - DNA, 75 bp, Artificial Sequence
  Synthetic
ggaatttggtgctgttagggcccgcagatgacatgcgtcgcggaggttggaggctcttggctcccatcacagctt

SEQ ID NO: 127449 - DNA, 75 bp, Artificial Sequence
  Synthetic
ggaatttggtgctgttagggcccgcagatgacatgcgtcgcggaggttggaggctcttggctcccatcactgctt

SEQ ID NO: 127450 - DNA, 75 bp, Artificial Sequence
  Synthetic
ggaatttggtgctgttagggcccgcagatgacatgcgtcgcggaggttggaggctcttggctcccatcaccgctt

SEQ ID NO: 127451 - DNA, 75 bp, Artificial Sequence
  Synthetic
ggaatttggtgctgttagggcccgcagatgacatgcgtcgcggaggttggaggctcttggctcccatcacggctt

SEQ ID NO: 127452 - DNA, 75 bp, Artificial Sequence
  Synthetic
ggaatttggtgctgttagggcccgcagatgacatgcgtcgcggaggttggaggctcttggctccgatcacagctt

SEQ ID NO: 127453 - DNA, 75 bp, Artificial Sequence
  Synthetic
ggaatttggtgctgttagggcccgcagatgacatgcgtcgcggaggttggaggctcttggctccgatcactgctt

SEQ ID NO: 127454 - DNA, 75 bp, Artificial Sequence
  Synthetic
ggaatttggtgctgttagggcccgcagatgacatgcgtcgcggaggttggaggctcttggctccgatcaccgctt

SEQ ID NO: 127455 - DNA, 75 bp, Artificial Sequence
  Synthetic
ggaatttggtgctgttagggcccgcagatgacatgcgtcgcggaggttggaggctcttggctccgatcacggctt

SEQ ID NO: 127456 - DNA, 75 bp, Artificial Sequence
  Synthetic
ggagtacgtggtgcttctgttcctgctgcttgcggacgctcgcgtctgcgcttgcctgtggatggcgttcctcgt

SEQ ID NO: 127457 - DNA, 75 bp, Artificial Sequence
  Synthetic
cctggaacagacctcatcgaggctaatctcctctggggtgctaacgcaaccagggttgagtcggatgataaggtg

SEQ ID NO: 127458 - DNA, 75 bp, Artificial Sequence
  Synthetic
cctggaacagacctcatcgaggctaatctcctctggggtgctaacgctaccagggttgagtcggatgataaggtg

SEQ ID NO: 127459 - DNA, 75 bp, Artificial Sequence
  Synthetic
cctggaacagacctcatcgaggctaatctcctctggggtgctaacgccaccagggttgagtcggatgataaggtg

SEQ ID NO: 127460 - DNA, 75 bp, Artificial Sequence
  Synthetic
cctggaacagacctcatcgaggctaatctcctctggggtgctaacgcgaccagggttgagtcggatgataaggtg

SEQ ID NO: 127461 - DNA, 75 bp, Artificial Sequence
  Synthetic
agatgacatgcgtcgcggaggttggaggctcttggctccgatcacagcatacgcacaacacacgcggggattggt

SEQ ID NO: 127462 - DNA, 75 bp, Artificial Sequence
  Synthetic
agatgacatgcgtcgcggaggttggaggctcttggctccgatcacagcatacgcacaacacacgcggggtttggt

SEQ ID NO: 127463 - DNA, 75 bp, Artificial Sequence
  Synthetic
agatgacatgcgtcgcggaggttggaggctcttggctccgatcacagcatacgcacaacacacgcggggcttggt

SEQ ID NO: 127464 - DNA, 75 bp, Artificial Sequence
  Synthetic
agatgacatgcgtcgcggaggttggaggctcttggctccgatcacagcatacgcacaacacacgcgggggttggt

SEQ ID NO: 127465 - DNA, 75 bp, Artificial Sequence
  Synthetic
agatgacatgcgtcgcggaggttggaggctcttggctccgatcacagcatacgctcaacacacgcggggattggt

SEQ ID NO: 127466 - DNA, 75 bp, Artificial Sequence
  Synthetic
agatgacatgcgtcgcggaggttggaggctcttggctccgatcacagcatacgctcaacacacgcggggtttggt

SEQ ID NO: 127467 - DNA, 75 bp, Artificial Sequence
  Synthetic
agatgacatgcgtcgcggaggttggaggctcttggctccgatcacagcatacgctcaacacacgcggggcttggt

SEQ ID NO: 127468 - DNA, 75 bp, Artificial Sequence
  Synthetic
agatgacatgcgtcgcggaggttggaggctcttggctccgatcacagcatacgctcaacacacgcgggggttggt

SEQ ID NO: 127469 - DNA, 75 bp, Artificial Sequence
  Synthetic
agatgacatgcgtcgcggaggttggaggctcttggctccgatcacagcatacgcccaacacacgcggggattggt

SEQ ID NO: 127470 - DNA, 75 bp, Artificial Sequence
  Synthetic
agatgacatgcgtcgcggaggttggaggctcttggctccgatcacagcatacgcccaacacacgcggggtttggt

SEQ ID NO: 127471 - DNA, 75 bp, Artificial Sequence
  Synthetic
agatgacatgcgtcgcggaggttggaggctcttggctccgatcacagcatacgcccaacacacgcggggcttggt

SEQ ID NO: 127472 - DNA, 75 bp, Artificial Sequence
  Synthetic
agatgacatgcgtcgcggaggttggaggctcttggctccgatcacagcatacgcccaacacacgcgggggttggt

SEQ ID NO: 127473 - DNA, 75 bp, Artificial Sequence
  Synthetic
agatgacatgcgtcgcggaggttggaggctcttggctccgatcacagcatacgcgcaacacacgcggggattggt

SEQ ID NO: 127474 - DNA, 75 bp, Artificial Sequence
  Synthetic
agatgacatgcgtcgcggaggttggaggctcttggctccgatcacagcatacgcgcaacacacgcggggtttggt

SEQ ID NO: 127475 - DNA, 75 bp, Artificial Sequence
  Synthetic
agatgacatgcgtcgcggaggttggaggctcttggctccgatcacagcatacgcgcaacacacgcggggcttggt

SEQ ID NO: 127476 - DNA, 75 bp, Artificial Sequence
  Synthetic
agatgacatgcgtcgcggaggttggaggctcttggctccgatcacagcatacgcgcaacacacgcgggggttggt

SEQ ID NO: 127477 - DNA, 75 bp, Artificial Sequence
  Synthetic
agatgacatgcgtcgcggaggttggaggctcttggctccgatcactgcatacgcacaacacacgcggggattggt

SEQ ID NO: 127478 - DNA, 75 bp, Artificial Sequence
  Synthetic
agatgacatgcgtcgcggaggttggaggctcttggctccgatcactgcatacgcacaacacacgcggggtttggt

SEQ ID NO: 127479 - DNA, 75 bp, Artificial Sequence
  Synthetic
agatgacatgcgtcgcggaggttggaggctcttggctccgatcactgcatacgcacaacacacgcggggcttggt

SEQ ID NO: 127480 - DNA, 75 bp, Artificial Sequence
  Synthetic
agatgacatgcgtcgcggaggttggaggctcttggctccgatcactgcatacgcacaacacacgcgggggttggt

SEQ ID NO: 127481 - DNA, 75 bp, Artificial Sequence
  Synthetic
agatgacatgcgtcgcggaggttggaggctcttggctccgatcactgcatacgctcaacacacgcggggattggt

SEQ ID NO: 127482 - DNA, 75 bp, Artificial Sequence
  Synthetic
agatgacatgcgtcgcggaggttggaggctcttggctccgatcactgcatacgctcaacacacgcggggtttggt

SEQ ID NO: 127483 - DNA, 75 bp, Artificial Sequence
  Synthetic
agatgacatgcgtcgcggaggttggaggctcttggctccgatcactgcatacgctcaacacacgcggggcttggt

SEQ ID NO: 127484 - DNA, 75 bp, Artificial Sequence
  Synthetic
agatgacatgcgtcgcggaggttggaggctcttggctccgatcactgcatacgctcaacacacgcgggggttggt

SEQ ID NO: 127485 - DNA, 75 bp, Artificial Sequence
  Synthetic
agatgacatgcgtcgcggaggttggaggctcttggctccgatcactgcatacgcccaacacacgcggggattggt

SEQ ID NO: 127486 - DNA, 75 bp, Artificial Sequence
  Synthetic
agatgacatgcgtcgcggaggttggaggctcttggctccgatcactgcatacgcccaacacacgcggggtttggt

SEQ ID NO: 127487 - DNA, 75 bp, Artificial Sequence
  Synthetic
agatgacatgcgtcgcggaggttggaggctcttggctccgatcactgcatacgcccaacacacgcggggcttggt

SEQ ID NO: 127488 - DNA, 75 bp, Artificial Sequence
  Synthetic
agatgacatgcgtcgcggaggttggaggctcttggctccgatcactgcatacgcccaacacacgcgggggttggt

SEQ ID NO: 127489 - DNA, 75 bp, Artificial Sequence
  Synthetic
agatgacatgcgtcgcggaggttggaggctcttggctccgatcactgcatacgcgcaacacacgcggggattggt

SEQ ID NO: 127490 - DNA, 75 bp, Artificial Sequence
  Synthetic
agatgacatgcgtcgcggaggttggaggctcttggctccgatcactgcatacgcgcaacacacgcggggtttggt

SEQ ID NO: 127491 - DNA, 75 bp, Artificial Sequence
  Synthetic
agatgacatgcgtcgcggaggttggaggctcttggctccgatcactgcatacgcgcaacacacgcggggcttggt

SEQ ID NO: 127492 - DNA, 75 bp, Artificial Sequence
  Synthetic
agatgacatgcgtcgcggaggttggaggctcttggctccgatcactgcatacgcgcaacacacgcgggggttggt

SEQ ID NO: 127493 - DNA, 75 bp, Artificial Sequence
  Synthetic
agatgacatgcgtcgcggaggttggaggctcttggctccgatcaccgcatacgcacaacacacgcggggattggt

SEQ ID NO: 127494 - DNA, 75 bp, Artificial Sequence
  Synthetic
agatgacatgcgtcgcggaggttggaggctcttggctccgatcaccgcatacgcacaacacacgcggggtttggt

SEQ ID NO: 127495 - DNA, 75 bp, Artificial Sequence
  Synthetic
agatgacatgcgtcgcggaggttggaggctcttggctccgatcaccgcatacgcacaacacacgcggggcttggt

SEQ ID NO: 127496 - DNA, 75 bp, Artificial Sequence
  Synthetic
agatgacatgcgtcgcggaggttggaggctcttggctccgatcaccgcatacgcacaacacacgcgggggttggt

SEQ ID NO: 127497 - DNA, 75 bp, Artificial Sequence
  Synthetic
agatgacatgcgtcgcggaggttggaggctcttggctccgatcaccgcatacgctcaacacacgcggggattggt

SEQ ID NO: 127498 - DNA, 75 bp, Artificial Sequence
  Synthetic
agatgacatgcgtcgcggaggttggaggctcttggctccgatcaccgcatacgctcaacacacgcggggtttggt

SEQ ID NO: 127499 - DNA, 75 bp, Artificial Sequence
  Synthetic
agatgacatgcgtcgcggaggttggaggctcttggctccgatcaccgcatacgctcaacacacgcggggcttggt

SEQ ID NO: 127500 - DNA, 75 bp, Artificial Sequence
  Synthetic
agatgacatgcgtcgcggaggttggaggctcttggctccgatcaccgcatacgctcaacacacgcgggggttggt

SEQ ID NO: 127501 - DNA, 75 bp, Artificial Sequence
  Synthetic
agatgacatgcgtcgcggaggttggaggctcttggctccgatcaccgcatacgcccaacacacgcggggattggt

SEQ ID NO: 127502 - DNA, 75 bp, Artificial Sequence
  Synthetic
agatgacatgcgtcgcggaggttggaggctcttggctccgatcaccgcatacgcccaacacacgcggggtttggt

SEQ ID NO: 127503 - DNA, 75 bp, Artificial Sequence
  Synthetic
agatgacatgcgtcgcggaggttggaggctcttggctccgatcaccgcatacgcccaacacacgcggggcttggt

SEQ ID NO: 127504 - DNA, 75 bp, Artificial Sequence
  Synthetic
agatgacatgcgtcgcggaggttggaggctcttggctccgatcaccgcatacgcccaacacacgcgggggttggt

SEQ ID NO: 127505 - DNA, 75 bp, Artificial Sequence
  Synthetic
agatgacatgcgtcgcggaggttggaggctcttggctccgatcaccgcatacgcgcaacacacgcggggattggt

SEQ ID NO: 127506 - DNA, 75 bp, Artificial Sequence
  Synthetic
agatgacatgcgtcgcggaggttggaggctcttggctccgatcaccgcatacgcgcaacacacgcggggtttggt

SEQ ID NO: 127507 - DNA, 75 bp, Artificial Sequence
  Synthetic
agatgacatgcgtcgcggaggttggaggctcttggctccgatcaccgcatacgcgcaacacacgcggggcttggt

SEQ ID NO: 127508 - DNA, 75 bp, Artificial Sequence
  Synthetic
agatgacatgcgtcgcggaggttggaggctcttggctccgatcaccgcatacgcgcaacacacgcgggggttggt

SEQ ID NO: 127509 - DNA, 75 bp, Artificial Sequence
  Synthetic
agatgacatgcgtcgcggaggttggaggctcttggctccgatcacggcatacgcacaacacacgcggggattggt

SEQ ID NO: 127510 - DNA, 75 bp, Artificial Sequence
  Synthetic
agatgacatgcgtcgcggaggttggaggctcttggctccgatcacggcatacgcacaacacacgcggggtttggt

SEQ ID NO: 127511 - DNA, 75 bp, Artificial Sequence
  Synthetic
agatgacatgcgtcgcggaggttggaggctcttggctccgatcacggcatacgcacaacacacgcggggcttggt

SEQ ID NO: 127512 - DNA, 75 bp, Artificial Sequence
  Synthetic
agatgacatgcgtcgcggaggttggaggctcttggctccgatcacggcatacgcacaacacacgcgggggttggt

SEQ ID NO: 127513 - DNA, 75 bp, Artificial Sequence
  Synthetic
agatgacatgcgtcgcggaggttggaggctcttggctccgatcacggcatacgctcaacacacgcggggattggt

SEQ ID NO: 127514 - DNA, 75 bp, Artificial Sequence
  Synthetic
agatgacatgcgtcgcggaggttggaggctcttggctccgatcacggcatacgctcaacacacgcggggtttggt

SEQ ID NO: 127515 - DNA, 75 bp, Artificial Sequence
  Synthetic
agatgacatgcgtcgcggaggttggaggctcttggctccgatcacggcatacgctcaacacacgcggggcttggt

SEQ ID NO: 127516 - DNA, 75 bp, Artificial Sequence
  Synthetic
agatgacatgcgtcgcggaggttggaggctcttggctccgatcacggcatacgctcaacacacgcgggggttggt

SEQ ID NO: 127517 - DNA, 75 bp, Artificial Sequence
  Synthetic
agatgacatgcgtcgcggaggttggaggctcttggctccgatcacggcatacgcccaacacacgcggggattggt

SEQ ID NO: 127518 - DNA, 75 bp, Artificial Sequence
  Synthetic
agatgacatgcgtcgcggaggttggaggctcttggctccgatcacggcatacgcccaacacacgcggggtttggt

SEQ ID NO: 127519 - DNA, 75 bp, Artificial Sequence
  Synthetic
agatgacatgcgtcgcggaggttggaggctcttggctccgatcacggcatacgcccaacacacgcggggcttggt

SEQ ID NO: 127520 - DNA, 75 bp, Artificial Sequence
  Synthetic
agatgacatgcgtcgcggaggttggaggctcttggctccgatcacggcatacgcccaacacacgcgggggttggt

SEQ ID NO: 127521 - DNA, 75 bp, Artificial Sequence
  Synthetic
agatgacatgcgtcgcggaggttggaggctcttggctccgatcacggcatacgcgcaacacacgcggggattggt

SEQ ID NO: 127522 - DNA, 75 bp, Artificial Sequence
  Synthetic
agatgacatgcgtcgcggaggttggaggctcttggctccgatcacggcatacgcgcaacacacgcggggtttggt

SEQ ID NO: 127523 - DNA, 75 bp, Artificial Sequence
  Synthetic
agatgacatgcgtcgcggaggttggaggctcttggctccgatcacggcatacgcgcaacacacgcggggcttggt

SEQ ID NO: 127524 - DNA, 75 bp, Artificial Sequence
  Synthetic
agatgacatgcgtcgcggaggttggaggctcttggctccgatcacggcatacgcgcaacacacgcgggggttggt

SEQ ID NO: 127525 - DNA, 75 bp, Artificial Sequence
  Synthetic
ccacctgcacccaacaccacgactctcctggcaccgacctcattgaggccaacctcttgtggggtgccggcgtca

SEQ ID NO: 127526 - DNA, 75 bp, Artificial Sequence
  Synthetic
gcatggtacatcaagggcaagtgtgtccccatgactgcgtatgccctctacgggatgtggccgctcctcctcctt

SEQ ID NO: 127527 - DNA, 75 bp, Artificial Sequence
  Synthetic
ccataccaatttgggctcagccggcttataacccgcctcttattgagacgtggaaacagccaggctatcaaccac

SEQ ID NO: 127528 - DNA, 75 bp, Artificial Sequence
  Synthetic
gcgtccttcaagaaagaagttcccgccagccatacctgtttgggctcgggctgattacaacccgcccttggtcga

SEQ ID NO: 127529 - DNA, 75 bp, Artificial Sequence
  Synthetic
cagatgtacacaaatgtggaccaagacttggtggggtggccagctccccagggggctaggtcatttactccatgt

SEQ ID NO: 127530 - DNA, 75 bp, Artificial Sequence
  Synthetic
agcattggcgagcttggcagacaagacctttagccaaccagatgccagctccgattcaggggcggcccttaccac

SEQ ID NO: 127531 - DNA, 75 bp, Artificial Sequence
  Synthetic
ctgcctacaaacgcctgatcatctttgtcatctggtggctccagtacttcctggccagggcggaagctatgatac

SEQ ID NO: 127532 - DNA, 75 bp, Artificial Sequence
  Synthetic
ctcaacttgccagcctcttcagtcgaggcgcccagcagaagatccagctggttaacgccagcggcagttggcaca

SEQ ID NO: 127533 - DNA, 75 bp, Artificial Sequence
  Synthetic
gtcgtcctcaccgagtccaaagtcgccgaagctctgtcggacctggctgcaaagaccttcagccaggcagagtca

SEQ ID NO: 127534 - DNA, 75 bp, Artificial Sequence
  Synthetic
atgacgagtcctactcgtcaatgcctccacttgagggggagcctggcgatccggacttgtcttcaggttcctggt

SEQ ID NO: 127535 - DNA, 75 bp, Artificial Sequence
  Synthetic
tccccggcgccaaattattccagggcgctgtggcgggtggctgctgaggagtacgtggaggttacgcgggtgggg

SEQ ID NO: 127536 - DNA, 75 bp, Artificial Sequence
  Synthetic
cctgctagccattttggggcccgcttggcttttgcaggccagcctcctgaaggtaccatacttcgtgcgcgccca

SEQ ID NO: 127537 - DNA, 75 bp, Artificial Sequence
  Synthetic
ggaccccattatagtggaagacgcgtcggacgacggatcctactcgtcaatgcctccacttgagggggagcccgg

SEQ ID NO: 127538 - DNA, 75 bp, Artificial Sequence
  Synthetic
ggaccccattatagtggatgacgcgtcggacgacggatcctactcgtcaatgcctccacttgagggggagcccgg

SEQ ID NO: 127539 - DNA, 75 bp, Artificial Sequence
  Synthetic
ggaccccattatagtggacgacgcgtcggacgacggatcctactcgtcaatgcctccacttgagggggagcccgg

SEQ ID NO: 127540 - DNA, 75 bp, Artificial Sequence
  Synthetic
ggaccccattatagtggaggacgcgtcggacgacggatcctactcgtcaatgcctccacttgagggggagcccgg

SEQ ID NO: 127541 - DNA, 75 bp, Artificial Sequence
  Synthetic
caaaggcgggaagaagccagctcgcctcatcgtgtaccctgacctcggggtcagggtgtgcgagaagatggccct

SEQ ID NO: 127542 - DNA, 75 bp, Artificial Sequence
  Synthetic
taaggccctggattttgtccctgtggaaaacatggagacaaccatgcggtcccctgtgtttactgacaattcctc

SEQ ID NO: 127543 - DNA, 75 bp, Artificial Sequence
  Synthetic
tacaaggtgttggtcctaaatccatccgtagcggcgacgctgagtttcggggcctatatgagcaaggctcatggt

SEQ ID NO: 127544 - DNA, 75 bp, Artificial Sequence
  Synthetic
tatgaccatttgtcaccactacacacctgggcccataacgggctgcatgacctcgcggttgcggtagagcccgtg

SEQ ID NO: 127545 - DNA, 75 bp, Artificial Sequence
  Synthetic
tcgtgtgctgctcaatgtcttacacctggacaggcgcacttatcaccccgtgcgccgcggaagaacaaaaattgc

SEQ ID NO: 127546 - DNA, 75 bp, Artificial Sequence
  Synthetic
gcggagcctatgatattatcatttgtgatgagtgtcactctacggaccccactacagtgcttggtatcggcactg

SEQ ID NO: 127547 - DNA, 75 bp, Artificial Sequence
  Synthetic
gctatgcagggggcgtgggcaaaagtcgccgttatcctcctgctggccgctggagtggacgcgggcacccgcatc

SEQ ID NO: 127548 - DNA, 75 bp, Artificial Sequence
  Synthetic
gggaggtcctcttagggccagccgacggccttacagataagggttggaggctcctggcgccgataacagcgtatg

SEQ ID NO: 127549 - DNA, 75 bp, Artificial Sequence
  Synthetic
ggttaccttcgaccgcttgcaggtagtggacaagcattaccatgatgtactacaggagattaaggcacgagcatc

SEQ ID NO: 127550 - DNA, 75 bp, Artificial Sequence
  Synthetic
cttatcaacaccaatggcagctggcacctcaaccgcaccgccctgaactgcaatgactcattgaacaccggcttc

SEQ ID NO: 127551 - DNA, 75 bp, Artificial Sequence
  Synthetic
agctctcccgaccaccggggagataccattttatggcaaggctatccccctcgagttcatcaaggggggaaggca

SEQ ID NO: 127552 - DNA, 75 bp, Artificial Sequence
  Synthetic
tcagacgtttctaggaacaactgtcaacggcgtcttgtggtccgtctaccatggtgctgggacgaggttccttgc

SEQ ID NO: 127553 - DNA, 75 bp, Artificial Sequence
  Synthetic
acctgggggtacgggtgtgcgagaagagggctctatatgacgccgtcaaacaactatctttggcagtgatgggag

SEQ ID NO: 127554 - DNA, 75 bp, Artificial Sequence
  Synthetic
acctgggggtacgggtgtgcgagaagagggctctatatgacgccgtcaaacaactatctttggctgtgatgggag

SEQ ID NO: 127555 - DNA, 75 bp, Artificial Sequence
  Synthetic
acctgggggtacgggtgtgcgagaagagggctctatatgacgccgtcaaacaactatctttggccgtgatgggag

SEQ ID NO: 127556 - DNA, 75 bp, Artificial Sequence
  Synthetic
acctgggggtacgggtgtgcgagaagagggctctatatgacgccgtcaaacaactatctttggcggtgatgggag

SEQ ID NO: 127557 - DNA, 75 bp, Artificial Sequence
  Synthetic
acctgggggtacgggtgtgcgagaagagggctctatatgacgccgtcaaacaactttctttggcagtgatgggag

SEQ ID NO: 127558 - DNA, 75 bp, Artificial Sequence
  Synthetic
acctgggggtacgggtgtgcgagaagagggctctatatgacgccgtcaaacaactttctttggctgtgatgggag

SEQ ID NO: 127559 - DNA, 75 bp, Artificial Sequence
  Synthetic
acctgggggtacgggtgtgcgagaagagggctctatatgacgccgtcaaacaactttctttggccgtgatgggag

SEQ ID NO: 127560 - DNA, 75 bp, Artificial Sequence
  Synthetic
acctgggggtacgggtgtgcgagaagagggctctatatgacgccgtcaaacaactttctttggcggtgatgggag

SEQ ID NO: 127561 - DNA, 75 bp, Artificial Sequence
  Synthetic
acctgggggtacgggtgtgcgagaagagggctctatatgacgccgtcaaacaactctctttggcagtgatgggag

SEQ ID NO: 127562 - DNA, 75 bp, Artificial Sequence
  Synthetic
acctgggggtacgggtgtgcgagaagagggctctatatgacgccgtcaaacaactctctttggctgtgatgggag

SEQ ID NO: 127563 - DNA, 75 bp, Artificial Sequence
  Synthetic
acctgggggtacgggtgtgcgagaagagggctctatatgacgccgtcaaacaactctctttggccgtgatgggag

SEQ ID NO: 127564 - DNA, 75 bp, Artificial Sequence
  Synthetic
acctgggggtacgggtgtgcgagaagagggctctatatgacgccgtcaaacaactctctttggcggtgatgggag

SEQ ID NO: 127565 - DNA, 75 bp, Artificial Sequence
  Synthetic
acctgggggtacgggtgtgcgagaagagggctctatatgacgccgtcaaacaactgtctttggcagtgatgggag

SEQ ID NO: 127566 - DNA, 75 bp, Artificial Sequence
  Synthetic
acctgggggtacgggtgtgcgagaagagggctctatatgacgccgtcaaacaactgtctttggctgtgatgggag

SEQ ID NO: 127567 - DNA, 75 bp, Artificial Sequence
  Synthetic
acctgggggtacgggtgtgcgagaagagggctctatatgacgccgtcaaacaactgtctttggccgtgatgggag

SEQ ID NO: 127568 - DNA, 75 bp, Artificial Sequence
  Synthetic
acctgggggtacgggtgtgcgagaagagggctctatatgacgccgtcaaacaactgtctttggcggtgatgggag

SEQ ID NO: 127569 - DNA, 75 bp, Artificial Sequence
  Synthetic
acctgggggttcgggtgtgcgagaagagggctctatatgacgccgtcaaacaactatctttggcagtgatgggag

SEQ ID NO: 127570 - DNA, 75 bp, Artificial Sequence
  Synthetic
acctgggggttcgggtgtgcgagaagagggctctatatgacgccgtcaaacaactatctttggctgtgatgggag

SEQ ID NO: 127571 - DNA, 75 bp, Artificial Sequence
  Synthetic
acctgggggttcgggtgtgcgagaagagggctctatatgacgccgtcaaacaactatctttggccgtgatgggag

SEQ ID NO: 127572 - DNA, 75 bp, Artificial Sequence
  Synthetic
acctgggggttcgggtgtgcgagaagagggctctatatgacgccgtcaaacaactatctttggcggtgatgggag

SEQ ID NO: 127573 - DNA, 75 bp, Artificial Sequence
  Synthetic
acctgggggttcgggtgtgcgagaagagggctctatatgacgccgtcaaacaactttctttggcagtgatgggag

SEQ ID NO: 127574 - DNA, 75 bp, Artificial Sequence
  Synthetic
acctgggggttcgggtgtgcgagaagagggctctatatgacgccgtcaaacaactttctttggctgtgatgggag

SEQ ID NO: 127575 - DNA, 75 bp, Artificial Sequence
  Synthetic
acctgggggttcgggtgtgcgagaagagggctctatatgacgccgtcaaacaactttctttggccgtgatgggag

SEQ ID NO: 127576 - DNA, 75 bp, Artificial Sequence
  Synthetic
acctgggggttcgggtgtgcgagaagagggctctatatgacgccgtcaaacaactttctttggcggtgatgggag

SEQ ID NO: 127577 - DNA, 75 bp, Artificial Sequence
  Synthetic
acctgggggttcgggtgtgcgagaagagggctctatatgacgccgtcaaacaactctctttggcagtgatgggag

SEQ ID NO: 127578 - DNA, 75 bp, Artificial Sequence
  Synthetic
acctgggggttcgggtgtgcgagaagagggctctatatgacgccgtcaaacaactctctttggctgtgatgggag

SEQ ID NO: 127579 - DNA, 75 bp, Artificial Sequence
  Synthetic
acctgggggttcgggtgtgcgagaagagggctctatatgacgccgtcaaacaactctctttggccgtgatgggag

SEQ ID NO: 127580 - DNA, 75 bp, Artificial Sequence
  Synthetic
acctgggggttcgggtgtgcgagaagagggctctatatgacgccgtcaaacaactctctttggcggtgatgggag

SEQ ID NO: 127581 - DNA, 75 bp, Artificial Sequence
  Synthetic
acctgggggttcgggtgtgcgagaagagggctctatatgacgccgtcaaacaactgtctttggcagtgatgggag

SEQ ID NO: 127582 - DNA, 75 bp, Artificial Sequence
  Synthetic
acctgggggttcgggtgtgcgagaagagggctctatatgacgccgtcaaacaactgtctttggctgtgatgggag

SEQ ID NO: 127583 - DNA, 75 bp, Artificial Sequence
  Synthetic
acctgggggttcgggtgtgcgagaagagggctctatatgacgccgtcaaacaactgtctttggccgtgatgggag

SEQ ID NO: 127584 - DNA, 75 bp, Artificial Sequence
  Synthetic
acctgggggttcgggtgtgcgagaagagggctctatatgacgccgtcaaacaactgtctttggcggtgatgggag

SEQ ID NO: 127585 - DNA, 75 bp, Artificial Sequence
  Synthetic
acctgggggtccgggtgtgcgagaagagggctctatatgacgccgtcaaacaactatctttggcagtgatgggag

SEQ ID NO: 127586 - DNA, 75 bp, Artificial Sequence
  Synthetic
acctgggggtccgggtgtgcgagaagagggctctatatgacgccgtcaaacaactatctttggctgtgatgggag

SEQ ID NO: 127587 - DNA, 75 bp, Artificial Sequence
  Synthetic
acctgggggtccgggtgtgcgagaagagggctctatatgacgccgtcaaacaactatctttggccgtgatgggag

SEQ ID NO: 127588 - DNA, 75 bp, Artificial Sequence
  Synthetic
acctgggggtccgggtgtgcgagaagagggctctatatgacgccgtcaaacaactatctttggcggtgatgggag

SEQ ID NO: 127589 - DNA, 75 bp, Artificial Sequence
  Synthetic
acctgggggtccgggtgtgcgagaagagggctctatatgacgccgtcaaacaactttctttggcagtgatgggag

SEQ ID NO: 127590 - DNA, 75 bp, Artificial Sequence
  Synthetic
acctgggggtccgggtgtgcgagaagagggctctatatgacgccgtcaaacaactttctttggctgtgatgggag

SEQ ID NO: 127591 - DNA, 75 bp, Artificial Sequence
  Synthetic
acctgggggtccgggtgtgcgagaagagggctctatatgacgccgtcaaacaactttctttggccgtgatgggag

SEQ ID NO: 127592 - DNA, 75 bp, Artificial Sequence
  Synthetic
acctgggggtccgggtgtgcgagaagagggctctatatgacgccgtcaaacaactttctttggcggtgatgggag

SEQ ID NO: 127593 - DNA, 75 bp, Artificial Sequence
  Synthetic
acctgggggtccgggtgtgcgagaagagggctctatatgacgccgtcaaacaactctctttggcagtgatgggag

SEQ ID NO: 127594 - DNA, 75 bp, Artificial Sequence
  Synthetic
acctgggggtccgggtgtgcgagaagagggctctatatgacgccgtcaaacaactctctttggctgtgatgggag

SEQ ID NO: 127595 - DNA, 75 bp, Artificial Sequence
  Synthetic
acctgggggtccgggtgtgcgagaagagggctctatatgacgccgtcaaacaactctctttggccgtgatgggag

SEQ ID NO: 127596 - DNA, 75 bp, Artificial Sequence
  Synthetic
acctgggggtccgggtgtgcgagaagagggctctatatgacgccgtcaaacaactctctttggcggtgatgggag

SEQ ID NO: 127597 - DNA, 75 bp, Artificial Sequence
  Synthetic
acctgggggtccgggtgtgcgagaagagggctctatatgacgccgtcaaacaactgtctttggcagtgatgggag

SEQ ID NO: 127598 - DNA, 75 bp, Artificial Sequence
  Synthetic
acctgggggtccgggtgtgcgagaagagggctctatatgacgccgtcaaacaactgtctttggctgtgatgggag

SEQ ID NO: 127599 - DNA, 75 bp, Artificial Sequence
  Synthetic
acctgggggtccgggtgtgcgagaagagggctctatatgacgccgtcaaacaactgtctttggccgtgatgggag

SEQ ID NO: 127600 - DNA, 75 bp, Artificial Sequence
  Synthetic
acctgggggtccgggtgtgcgagaagagggctctatatgacgccgtcaaacaactgtctttggcggtgatgggag

SEQ ID NO: 127601 - DNA, 75 bp, Artificial Sequence
  Synthetic
acctgggggtgcgggtgtgcgagaagagggctctatatgacgccgtcaaacaactatctttggcagtgatgggag

SEQ ID NO: 127602 - DNA, 75 bp, Artificial Sequence
  Synthetic
acctgggggtgcgggtgtgcgagaagagggctctatatgacgccgtcaaacaactatctttggctgtgatgggag

SEQ ID NO: 127603 - DNA, 75 bp, Artificial Sequence
  Synthetic
acctgggggtgcgggtgtgcgagaagagggctctatatgacgccgtcaaacaactatctttggccgtgatgggag

SEQ ID NO: 127604 - DNA, 75 bp, Artificial Sequence
  Synthetic
acctgggggtgcgggtgtgcgagaagagggctctatatgacgccgtcaaacaactatctttggcggtgatgggag

SEQ ID NO: 127605 - DNA, 75 bp, Artificial Sequence
  Synthetic
acctgggggtgcgggtgtgcgagaagagggctctatatgacgccgtcaaacaactttctttggcagtgatgggag

SEQ ID NO: 127606 - DNA, 75 bp, Artificial Sequence
  Synthetic
acctgggggtgcgggtgtgcgagaagagggctctatatgacgccgtcaaacaactttctttggctgtgatgggag

SEQ ID NO: 127607 - DNA, 75 bp, Artificial Sequence
  Synthetic
acctgggggtgcgggtgtgcgagaagagggctctatatgacgccgtcaaacaactttctttggccgtgatgggag

SEQ ID NO: 127608 - DNA, 75 bp, Artificial Sequence
  Synthetic
acctgggggtgcgggtgtgcgagaagagggctctatatgacgccgtcaaacaactttctttggcggtgatgggag

SEQ ID NO: 127609 - DNA, 75 bp, Artificial Sequence
  Synthetic
acctgggggtgcgggtgtgcgagaagagggctctatatgacgccgtcaaacaactctctttggcagtgatgggag

SEQ ID NO: 127610 - DNA, 75 bp, Artificial Sequence
  Synthetic
acctgggggtgcgggtgtgcgagaagagggctctatatgacgccgtcaaacaactctctttggctgtgatgggag

SEQ ID NO: 127611 - DNA, 75 bp, Artificial Sequence
  Synthetic
acctgggggtgcgggtgtgcgagaagagggctctatatgacgccgtcaaacaactctctttggccgtgatgggag

SEQ ID NO: 127612 - DNA, 75 bp, Artificial Sequence
  Synthetic
acctgggggtgcgggtgtgcgagaagagggctctatatgacgccgtcaaacaactctctttggcggtgatgggag

SEQ ID NO: 127613 - DNA, 75 bp, Artificial Sequence
  Synthetic
acctgggggtgcgggtgtgcgagaagagggctctatatgacgccgtcaaacaactgtctttggcagtgatgggag

SEQ ID NO: 127614 - DNA, 75 bp, Artificial Sequence
  Synthetic
acctgggggtgcgggtgtgcgagaagagggctctatatgacgccgtcaaacaactgtctttggctgtgatgggag

SEQ ID NO: 127615 - DNA, 75 bp, Artificial Sequence
  Synthetic
acctgggggtgcgggtgtgcgagaagagggctctatatgacgccgtcaaacaactgtctttggccgtgatgggag

SEQ ID NO: 127616 - DNA, 75 bp, Artificial Sequence
  Synthetic
acctgggggtgcgggtgtgcgagaagagggctctatatgacgccgtcaaacaactgtctttggcggtgatgggag

SEQ ID NO: 127617 - DNA, 75 bp, Artificial Sequence
  Synthetic
tcgagttcatcaaggggggaaggcacctcatattctgtcattctaaaaagaaatgcgacgagctggccaagcagc

SEQ ID NO: 127618 - DNA, 75 bp, Artificial Sequence
  Synthetic
ctttgcaatacgaggacaatgtcaccaacccggaggatatgagaccatattgctggcactacccgccaaagcagt

SEQ ID NO: 127619 - DNA, 75 bp, Artificial Sequence
  Synthetic
gggtgtgcgagaagagagcgctgtatgaagtcgtccaaaacctccctcgcgccgtgatgggagcagcttatggct

SEQ ID NO: 127620 - DNA, 75 bp, Artificial Sequence
  Synthetic
gggtgtgcgagaagagagcgctgtatgaagtcgtccaaaacctccctcgcgccgtgatgggagctgcttatggct

SEQ ID NO: 127621 - DNA, 75 bp, Artificial Sequence
  Synthetic
gggtgtgcgagaagagagcgctgtatgaagtcgtccaaaacctccctcgcgccgtgatgggagccgcttatggct

SEQ ID NO: 127622 - DNA, 75 bp, Artificial Sequence
  Synthetic
gggtgtgcgagaagagagcgctgtatgaagtcgtccaaaacctccctcgcgccgtgatgggagcggcttatggct

SEQ ID NO: 127623 - DNA, 75 bp, Artificial Sequence
  Synthetic
tgcgggtctgcggacctgtaccttgtcacaaggcacgctgatgttgtccctgtccgccggcggggcgacactaga

SEQ ID NO: 127624 - DNA, 75 bp, Artificial Sequence
  Synthetic
ctgctttgactccactgtaaccgaaaaggacatcagggtcgaggaggaggtctatcagtgttgtgacctagagcc

SEQ ID NO: 127625 - DNA, 75 bp, Artificial Sequence
  Synthetic
cgaatatttgttggccgcatggcgatcaaagaaaacccctatggggttctcgtatgacacccgctgttttgactc

SEQ ID NO: 127626 - DNA, 75 bp, Artificial Sequence
  Synthetic
cggtgtgcacgcgtggggtcgcaaaggcgatcgactttgtgcccgtggagagcctagaaaccaccatgaggtccc

SEQ ID NO: 127627 - DNA, 75 bp, Artificial Sequence
  Synthetic
cggtgtgcacgcgtggggtcgcaaaggcgatcgactttgtgcccgtggagagccttgaaaccaccatgaggtccc

SEQ ID NO: 127628 - DNA, 75 bp, Artificial Sequence
  Synthetic
cggtgtgcacgcgtggggtcgcaaaggcgatcgactttgtgcccgtggagagcctcgaaaccaccatgaggtccc

SEQ ID NO: 127629 - DNA, 75 bp, Artificial Sequence
  Synthetic
cggtgtgcacgcgtggggtcgcaaaggcgatcgactttgtgcccgtggagagcctggaaaccaccatgaggtccc

SEQ ID NO: 127630 - DNA, 75 bp, Artificial Sequence
  Synthetic
acgttgagtcgtactcctccatgccccccctcgagggagagccgggggatcccgacctcagcgacgggtcttggt

SEQ ID NO: 127631 - DNA, 75 bp, Artificial Sequence
  Synthetic
ggccttcgggcatgttcgacaccgtcgtgctctgtgaagcatacgacacggggtgcgcttggtacgagctatccc

SEQ ID NO: 127632 - DNA, 75 bp, Artificial Sequence
  Synthetic
gccggctgtgccccagacctaccaggtggcacacctacacgctcctacggggagcggaaaaagcaccaaggtgcc

SEQ ID NO: 127633 - DNA, 75 bp, Artificial Sequence
  Synthetic
gccggctgtgccccagacctaccaggtggctcacctacacgctcctacggggagcggaaaaagcaccaaggtgcc

SEQ ID NO: 127634 - DNA, 75 bp, Artificial Sequence
  Synthetic
gccggctgtgccccagacctaccaggtggcccacctacacgctcctacggggagcggaaaaagcaccaaggtgcc

SEQ ID NO: 127635 - DNA, 75 bp, Artificial Sequence
  Synthetic
gccggctgtgccccagacctaccaggtggcgcacctacacgctcctacggggagcggaaaaagcaccaaggtgcc

SEQ ID NO: 127636 - DNA, 75 bp, Artificial Sequence
  Synthetic
ggactataaccccccgctggtggagacgtggaaaaagcctgactacgaaccacctgtggtccatggctgcccgct

SEQ ID NO: 127637 - DNA, 75 bp, Artificial Sequence
  Synthetic
ttcacaaccagtctcgggaacacactcacgtgctacctgaaggccaccgctgccaccagggcggcaggcctgaag

SEQ ID NO: 127638 - DNA, 75 bp, Artificial Sequence
  Synthetic
ttcactaccagtctcgggaacacactcacgtgctacctgaaggccaccgctgccaccagggcggcaggcctgaag

SEQ ID NO: 127639 - DNA, 75 bp, Artificial Sequence
  Synthetic
ttcaccaccagtctcgggaacacactcacgtgctacctgaaggccaccgctgccaccagggcggcaggcctgaag

SEQ ID NO: 127640 - DNA, 75 bp, Artificial Sequence
  Synthetic
ttcacgaccagtctcgggaacacactcacgtgctacctgaaggccaccgctgccaccagggcggcaggcctgaag

SEQ ID NO: 127641 - DNA, 75 bp, Artificial Sequence
  Synthetic
gccctggctcacgccgaggtgcctggttcactacccctacaggctctggcattatccctgcacagtgaattttac

SEQ ID NO: 127642 - DNA, 75 bp, Artificial Sequence
  Synthetic
gacccacatagacgcccactttctatctcagactaagcaggggggcgagaacttcgcctacctcgtggcctacca

SEQ ID NO: 127643 - DNA, 75 bp, Artificial Sequence
  Synthetic
gatcctaacatcaggactggggtgcggaccattacaacagggtcccccattacatattctacctacggcaagttt

SEQ ID NO: 127644 - DNA, 75 bp, Artificial Sequence
  Synthetic
caccttccagataaggatgtacgtgggggggattgagcacaggctcatggccgcgtgcaacttcactcgtgggga

SEQ ID NO: 127645 - DNA, 75 bp, Artificial Sequence
  Synthetic
cttctgtatcgcctgggggctgtccaaaatgagataataacaactcacccgatcacaaaatacatcatgacctgc

SEQ ID NO: 127646 - DNA, 75 bp, Artificial Sequence
  Synthetic
tggaccaagcggaaacggctggagcgcgtcttaccgtgctcgccaccgccacaccacctggatcagtcaccgtgc

SEQ ID NO: 127647 - DNA, 75 bp, Artificial Sequence
  Synthetic
tgcaggcaaacgggtctactatctgacccgggacccagaaactcccttggcacgtgctgcctgggagacagctcg

SEQ ID NO: 127648 - DNA, 75 bp, Artificial Sequence
  Synthetic
gctttgtcgactggtcttctccacctccaccaaaacaccgtggacgtgcaatacttgtatggcctgacacccgcc

SEQ ID NO: 127649 - DNA, 75 bp, Artificial Sequence
  Synthetic
ttctatggcaaggccatacccctagcagtcatcaagggcgggaggcacctcattttttgtcattcaaaaagaaaa

SEQ ID NO: 127650 - DNA, 75 bp, Artificial Sequence
  Synthetic
tctgtggcaggatcataaccaccggcaagcccgcggtcatccccgaccgggaggtcatgtaccagcagtttgacg

SEQ ID NO: 127651 - DNA, 75 bp, Artificial Sequence
  Synthetic
gccaagctgaggcagcactagagaaactggtcaccttacacgccgcgagcgcagctagctgtaacggcttcctgt

SEQ ID NO: 127652 - DNA, 75 bp, Artificial Sequence
  Synthetic
agccaggaagcccttgaaaaagcactggacttcgacatgtacggagtcacatactcaatcactccgctggacctg

SEQ ID NO: 127653 - DNA, 75 bp, Artificial Sequence
  Synthetic
tgagggtcctggaggacgggataaattatgcaacagggaacctacccggttgctctttctctatcttcctactag

SEQ ID NO: 127654 - DNA, 75 bp, Artificial Sequence
  Synthetic
cccggtcggaggcgtcgccagagctctggcacacggtgttagggtcctggaagacgggataaattacgcaacagg

SEQ ID NO: 127655 - DNA, 75 bp, Artificial Sequence
  Synthetic
gaccaagctcatcacgtggggggcagacaccgccgcatgcggtgacatcatcaacggcttgcccgtctccgcccg

SEQ ID NO: 127656 - DNA, 75 bp, Artificial Sequence
  Synthetic
caaacaagcggaagaactcaagcccgctatccattccacgtggcccagagtggaggagttctggaagaaacacat

SEQ ID NO: 127657 - DNA, 75 bp, Artificial Sequence
  Synthetic
cctggtgttgccccgacaggcttacgcctatgatgcgtctgtgcatggacaggttggcgcggtcttgttgacact

SEQ ID NO: 127658 - DNA, 75 bp, Artificial Sequence
  Synthetic
aggttggcgcggtcttgttgacactgctcactctctttacactgaccccggggtataagacccttctcagccgga

SEQ ID NO: 127659 - DNA, 75 bp, Artificial Sequence
  Synthetic
agccctctaagaacctcccagacacttttgctcaacatcttaggtggctggatagcctcccagatggcccccccc

SEQ ID NO: 127660 - DNA, 75 bp, Artificial Sequence
  Synthetic
ctatgacgcgggctgtgcttggtatgagctcacacccgccgagaccacagttaggctacgagcatacatgaacac

SEQ ID NO: 127661 - DNA, 75 bp, Artificial Sequence
  Synthetic
gaccccgctatttactcctgtgcctactcctactttccgtaggggtaggcatctttttgctgcctgctcggtagg

SEQ ID NO: 127662 - DNA, 75 bp, Artificial Sequence
  Synthetic
ttttttttttttttttttttttttttttttttttttccttccttctttccttctttccttctttttcttccttag

SEQ ID NO: 127663 - DNA, 75 bp, Artificial Sequence
  Synthetic
gcggcctagcaggtgctgcggtgggcagcattggactggggaaggtcatagttgacgttctcgctgggtacggtg

SEQ ID NO: 127664 - DNA, 75 bp, Artificial Sequence
  Synthetic
atgtgagagtgaaggtgtccaggaggatgtggccgccttgcgagcatttacagatgctatgaccaggtattcggc

SEQ ID NO: 127665 - DNA, 75 bp, Artificial Sequence
  Synthetic
agttcactcaccatcaccagcttactacgtaggctgcaccagtggatcaatgaggatgcgtccactccttgctcg

SEQ ID NO: 127666 - DNA, 75 bp, Artificial Sequence
  Synthetic
agttcactcaccatcaccagcttacttcgtaggctgcaccagtggatcaatgaggatgcgtccactccttgctcg

SEQ ID NO: 127667 - DNA, 75 bp, Artificial Sequence
  Synthetic
agttcactcaccatcaccagcttactccgtaggctgcaccagtggatcaatgaggatgcgtccactccttgctcg

SEQ ID NO: 127668 - DNA, 75 bp, Artificial Sequence
  Synthetic
agttcactcaccatcaccagcttactgcgtaggctgcaccagtggatcaatgaggatgcgtccactccttgctcg

SEQ ID NO: 127669 - DNA, 75 bp, Artificial Sequence
  Synthetic
ccgggcccaggcaaaacattcaactcatcaacaccaacggcagctggcacatcaacagtactgccttgaattgca

SEQ ID NO: 127670 - DNA, 75 bp, Artificial Sequence
  Synthetic
agcctggagacatcgggccagagcggtcagagcaaagctcattgcccagggggggaaagccgctatctgcggtaa

SEQ ID NO: 127671 - DNA, 75 bp, Artificial Sequence
  Synthetic
cccttatatcctgccagccaggctatgggggagtttgggctggcgacgggatatgtcacaccacctgcgcttgcg

SEQ ID NO: 127672 - DNA, 75 bp, Artificial Sequence
  Synthetic
ggggtttaggatagggtggggcagtctagagtatgaggagaatgttaccaacgacgaggacatgaggccctattg

SEQ ID NO: 127673 - DNA, 75 bp, Artificial Sequence
  Synthetic
ctggcgcatggcgtcagggctgtggaggacgggattaactacgcaacagggaaccttcctggttgctccttttct

SEQ ID NO: 127674 - DNA, 75 bp, Artificial Sequence
  Synthetic
cgtaccgtgtcgggattctcaggcctcttcacatcgggccccaagcagaacatccacctggtcaactctaatggt

SEQ ID NO: 127675 - DNA, 75 bp, Artificial Sequence
  Synthetic
ggcattgttcctgctcggaccgtgtgtggcccagtgtattgtttcacccccagtccagtcgtggtgggcaccacc

SEQ ID NO: 127676 - DNA, 75 bp, Artificial Sequence
  Synthetic
gacaactggccccagcgtgccggtcccagctcctaactataagcgcgctctctggcgggtatccgccgaggaata

SEQ ID NO: 127677 - DNA, 75 bp, Artificial Sequence
  Synthetic
ggccgcccagctcgcggccccgggtgctgcctcggctttcgtgggcgccggcatcgtcggcgccgcagtcggtag

SEQ ID NO: 127678 - DNA, 75 bp, Artificial Sequence
  Synthetic
atgagaccgatgtcttcctgctaaatagcacaagacccccgcgaggagcttggttcggctgcacttggatgaacg

SEQ ID NO: 127679 - DNA, 75 bp, Artificial Sequence
  Synthetic
taagacttgcggcgctccaccttgccgcataagaccagacttcaactccaccgaggacttgctgtgccccactga

SEQ ID NO: 127680 - DNA, 75 bp, Artificial Sequence
  Synthetic
gacccccacgttggccgcgccatacgctggcgctccacttgagtccatgcggcgtcatgtggatttgatggtggg

SEQ ID NO: 127681 - DNA, 75 bp, Artificial Sequence
  Synthetic
gaagtggatgggataaggctgcatcgttatgcaccaccttgtaagcccctactcagagatgaggtatgttttaca

SEQ ID NO: 127682 - DNA, 75 bp, Artificial Sequence
  Synthetic
cattggcgttggtaagatgcttgtggatattcttgcagggtacggtgctggggtggcgggggctctcgtcgcttt

SEQ ID NO: 127683 - DNA, 75 bp, Artificial Sequence
  Synthetic
tacccgtgtaccgtcaactttaccatcttcaaagtacggatgttcatagggggagtcgagcataggctcgaagcg

SEQ ID NO: 127684 - DNA, 75 bp, Artificial Sequence
  Synthetic
ccgcagagacggccgcccggcgcttgaagagggggtcgcccccttccctggctagctcttcagctagccagttgt

SEQ ID NO: 127685 - DNA, 75 bp, Artificial Sequence
  Synthetic
tcgcatacgcctctcaggggtataaagtactagtcctcaatccctcggtggctgccaccttggggtttggagcgt

SEQ ID NO: 127686 - DNA, 75 bp, Artificial Sequence
  Synthetic
gggagtcgagcataggctcgaagcggcgtgcaatttttcccgtggggaccgttgcaacctggaagaccgggatag

SEQ ID NO: 127687 - DNA, 75 bp, Artificial Sequence
  Synthetic
gagtcagctcagccccttgctgcattccactactgagtgggctattctaccttgcacctactctgacatgccggc

SEQ ID NO: 127688 - DNA, 75 bp, Artificial Sequence
  Synthetic
atggcagttggcacatcaataggacgtccctgaactgcgatgacagccttagcaccggctggatagcagggcttt

SEQ ID NO: 127689 - DNA, 75 bp, Artificial Sequence
  Synthetic
cattacccgtgttgagtcagagaacaaggtcatcgtccttgactcatttgacccactggttccggagtatgacga

SEQ ID NO: 127690 - DNA, 75 bp, Artificial Sequence
  Synthetic
ggtcactggggcgtcctggccggcatagcctttttcagcatgcaggctaactgggcgaaagtcatcctgatctta

SEQ ID NO: 127691 - DNA, 75 bp, Artificial Sequence
  Synthetic
tgggtggtcctcttgttcctactccttgcggacgccagagtctgcgcgtgcttgtggatgctcctcttgctgggg

SEQ ID NO: 127692 - DNA, 75 bp, Artificial Sequence
  Synthetic
ttgcggacgccagagtctgcgcgtgcttgtggatgctcctcttgctggggcaagccgaggcggcactggagaagc

SEQ ID NO: 127693 - DNA, 75 bp, Artificial Sequence
  Synthetic
agaacctccagcttatcaacaccaatgggagctggcacatcaacaggacagctcttaattgcaatgacagcttgc

SEQ ID NO: 127694 - DNA, 75 bp, Artificial Sequence
  Synthetic
catcccaatatagaggaggtagccctcgggcaggagggcgagatccccttctatgggaaggcgctccccctgtct

SEQ ID NO: 127695 - DNA, 75 bp, Artificial Sequence
  Synthetic
ctacagaaatggcagatgcctggatacgagcctcccatcgtgtccggatgtgcgctacctccaaccaaacaagca

SEQ ID NO: 127696 - DNA, 75 bp, Artificial Sequence
  Synthetic
cttgtggatgctcctcttgctggggcaagccgaggcggcactggagaagctagtcattttgcatgcggctagtgc

SEQ ID NO: 127697 - DNA, 75 bp, Artificial Sequence
  Synthetic
ctaccgcaacaaattcaacagttccgggtgcccggagaggctttccagatgcaaacgcctcgacgaccttgcgca

SEQ ID NO: 127698 - DNA, 75 bp, Artificial Sequence
  Synthetic
aggtcatcgatacccttacttgcggcttcaccgacctcatggggtacatcccgctcgtcggcgctcctgtaggag

SEQ ID NO: 127699 - DNA, 75 bp, Artificial Sequence
  Synthetic
aaaacctgcagtaacacatggcacgggaccttccctataaacacctacaccacgggcccatgtacacccgctcct

SEQ ID NO: 127700 - DNA, 75 bp, Artificial Sequence
  Synthetic
ctagcactccggcaccaagctccggcttggggggatcgctcgctagcccataagcatctgaaccagccacggcag

SEQ ID NO: 127701 - DNA, 75 bp, Artificial Sequence
  Synthetic
ctagcactccggcaccaagctccggcttggggggatcgctcgctagcccataagcttctgaaccagccacggcag

SEQ ID NO: 127702 - DNA, 75 bp, Artificial Sequence
  Synthetic
ctagcactccggcaccaagctccggcttggggggatcgctcgctagcccataagcctctgaaccagccacggcag

SEQ ID NO: 127703 - DNA, 75 bp, Artificial Sequence
  Synthetic
ctagcactccggcaccaagctccggcttggggggatcgctcgctagcccataagcgtctgaaccagccacggcag

SEQ ID NO: 127704 - DNA, 75 bp, Artificial Sequence
  Synthetic
ctagcactccggcaccaagctccggcttggggggatcgctcgctagcccattagcatctgaaccagccacggcag

SEQ ID NO: 127705 - DNA, 75 bp, Artificial Sequence
  Synthetic
ctagcactccggcaccaagctccggcttggggggatcgctcgctagcccattagcttctgaaccagccacggcag

SEQ ID NO: 127706 - DNA, 75 bp, Artificial Sequence
  Synthetic
ctagcactccggcaccaagctccggcttggggggatcgctcgctagcccattagcctctgaaccagccacggcag

SEQ ID NO: 127707 - DNA, 75 bp, Artificial Sequence
  Synthetic
ctagcactccggcaccaagctccggcttggggggatcgctcgctagcccattagcgtctgaaccagccacggcag

SEQ ID NO: 127708 - DNA, 75 bp, Artificial Sequence
  Synthetic
ctagcactccggcaccaagctccggcttggggggatcgctcgctagcccatcagcatctgaaccagccacggcag

SEQ ID NO: 127709 - DNA, 75 bp, Artificial Sequence
  Synthetic
ctagcactccggcaccaagctccggcttggggggatcgctcgctagcccatcagcttctgaaccagccacggcag

SEQ ID NO: 127710 - DNA, 75 bp, Artificial Sequence
  Synthetic
ctagcactccggcaccaagctccggcttggggggatcgctcgctagcccatcagcctctgaaccagccacggcag

SEQ ID NO: 127711 - DNA, 75 bp, Artificial Sequence
  Synthetic
ctagcactccggcaccaagctccggcttggggggatcgctcgctagcccatcagcgtctgaaccagccacggcag

SEQ ID NO: 127712 - DNA, 75 bp, Artificial Sequence
  Synthetic
ctagcactccggcaccaagctccggcttggggggatcgctcgctagcccatgagcatctgaaccagccacggcag

SEQ ID NO: 127713 - DNA, 75 bp, Artificial Sequence
  Synthetic
ctagcactccggcaccaagctccggcttggggggatcgctcgctagcccatgagcttctgaaccagccacggcag

SEQ ID NO: 127714 - DNA, 75 bp, Artificial Sequence
  Synthetic
ctagcactccggcaccaagctccggcttggggggatcgctcgctagcccatgagcctctgaaccagccacggcag

SEQ ID NO: 127715 - DNA, 75 bp, Artificial Sequence
  Synthetic
ctagcactccggcaccaagctccggcttggggggatcgctcgctagcccatgagcgtctgaaccagccacggcag

SEQ ID NO: 127716 - DNA, 75 bp, Artificial Sequence
  Synthetic
ctagcactccggcaccaagctccggcttggggggttcgctcgctagcccataagcatctgaaccagccacggcag

SEQ ID NO: 127717 - DNA, 75 bp, Artificial Sequence
  Synthetic
ctagcactccggcaccaagctccggcttggggggttcgctcgctagcccataagcttctgaaccagccacggcag

SEQ ID NO: 127718 - DNA, 75 bp, Artificial Sequence
  Synthetic
ctagcactccggcaccaagctccggcttggggggttcgctcgctagcccataagcctctgaaccagccacggcag

SEQ ID NO: 127719 - DNA, 75 bp, Artificial Sequence
  Synthetic
ctagcactccggcaccaagctccggcttggggggttcgctcgctagcccataagcgtctgaaccagccacggcag

SEQ ID NO: 127720 - DNA, 75 bp, Artificial Sequence
  Synthetic
ctagcactccggcaccaagctccggcttggggggttcgctcgctagcccattagcatctgaaccagccacggcag

SEQ ID NO: 127721 - DNA, 75 bp, Artificial Sequence
  Synthetic
ctagcactccggcaccaagctccggcttggggggttcgctcgctagcccattagcttctgaaccagccacggcag

SEQ ID NO: 127722 - DNA, 75 bp, Artificial Sequence
  Synthetic
ctagcactccggcaccaagctccggcttggggggttcgctcgctagcccattagcctctgaaccagccacggcag

SEQ ID NO: 127723 - DNA, 75 bp, Artificial Sequence
  Synthetic
ctagcactccggcaccaagctccggcttggggggttcgctcgctagcccattagcgtctgaaccagccacggcag

SEQ ID NO: 127724 - DNA, 75 bp, Artificial Sequence
  Synthetic
ctagcactccggcaccaagctccggcttggggggttcgctcgctagcccatcagcatctgaaccagccacggcag

SEQ ID NO: 127725 - DNA, 75 bp, Artificial Sequence
  Synthetic
ctagcactccggcaccaagctccggcttggggggttcgctcgctagcccatcagcttctgaaccagccacggcag

SEQ ID NO: 127726 - DNA, 75 bp, Artificial Sequence
  Synthetic
ctagcactccggcaccaagctccggcttggggggttcgctcgctagcccatcagcctctgaaccagccacggcag

SEQ ID NO: 127727 - DNA, 75 bp, Artificial Sequence
  Synthetic
ctagcactccggcaccaagctccggcttggggggttcgctcgctagcccatcagcgtctgaaccagccacggcag

SEQ ID NO: 127728 - DNA, 75 bp, Artificial Sequence
  Synthetic
ctagcactccggcaccaagctccggcttggggggttcgctcgctagcccatgagcatctgaaccagccacggcag

SEQ ID NO: 127729 - DNA, 75 bp, Artificial Sequence
  Synthetic
ctagcactccggcaccaagctccggcttggggggttcgctcgctagcccatgagcttctgaaccagccacggcag

SEQ ID NO: 127730 - DNA, 75 bp, Artificial Sequence
  Synthetic
ctagcactccggcaccaagctccggcttggggggttcgctcgctagcccatgagcctctgaaccagccacggcag

SEQ ID NO: 127731 - DNA, 75 bp, Artificial Sequence
  Synthetic
ctagcactccggcaccaagctccggcttggggggttcgctcgctagcccatgagcgtctgaaccagccacggcag

SEQ ID NO: 127732 - DNA, 75 bp, Artificial Sequence
  Synthetic
ctagcactccggcaccaagctccggcttggggggctcgctcgctagcccataagcatctgaaccagccacggcag

SEQ ID NO: 127733 - DNA, 75 bp, Artificial Sequence
  Synthetic
ctagcactccggcaccaagctccggcttggggggctcgctcgctagcccataagcttctgaaccagccacggcag

SEQ ID NO: 127734 - DNA, 75 bp, Artificial Sequence
  Synthetic
ctagcactccggcaccaagctccggcttggggggctcgctcgctagcccataagcctctgaaccagccacggcag

SEQ ID NO: 127735 - DNA, 75 bp, Artificial Sequence
  Synthetic
ctagcactccggcaccaagctccggcttggggggctcgctcgctagcccataagcgtctgaaccagccacggcag

SEQ ID NO: 127736 - DNA, 75 bp, Artificial Sequence
  Synthetic
ctagcactccggcaccaagctccggcttggggggctcgctcgctagcccattagcatctgaaccagccacggcag

SEQ ID NO: 127737 - DNA, 75 bp, Artificial Sequence
  Synthetic
ctagcactccggcaccaagctccggcttggggggctcgctcgctagcccattagcttctgaaccagccacggcag

SEQ ID NO: 127738 - DNA, 75 bp, Artificial Sequence
  Synthetic
ctagcactccggcaccaagctccggcttggggggctcgctcgctagcccattagcctctgaaccagccacggcag

SEQ ID NO: 127739 - DNA, 75 bp, Artificial Sequence
  Synthetic
ctagcactccggcaccaagctccggcttggggggctcgctcgctagcccattagcgtctgaaccagccacggcag

SEQ ID NO: 127740 - DNA, 75 bp, Artificial Sequence
  Synthetic
ctagcactccggcaccaagctccggcttggggggctcgctcgctagcccatcagcatctgaaccagccacggcag

SEQ ID NO: 127741 - DNA, 75 bp, Artificial Sequence
  Synthetic
ctagcactccggcaccaagctccggcttggggggctcgctcgctagcccatcagcttctgaaccagccacggcag

SEQ ID NO: 127742 - DNA, 75 bp, Artificial Sequence
  Synthetic
ctagcactccggcaccaagctccggcttggggggctcgctcgctagcccatcagcctctgaaccagccacggcag

SEQ ID NO: 127743 - DNA, 75 bp, Artificial Sequence
  Synthetic
ctagcactccggcaccaagctccggcttggggggctcgctcgctagcccatcagcgtctgaaccagccacggcag

SEQ ID NO: 127744 - DNA, 75 bp, Artificial Sequence
  Synthetic
ctagcactccggcaccaagctccggcttggggggctcgctcgctagcccatgagcatctgaaccagccacggcag

SEQ ID NO: 127745 - DNA, 75 bp, Artificial Sequence
  Synthetic
ctagcactccggcaccaagctccggcttggggggctcgctcgctagcccatgagcttctgaaccagccacggcag

SEQ ID NO: 127746 - DNA, 75 bp, Artificial Sequence
  Synthetic
ctagcactccggcaccaagctccggcttggggggctcgctcgctagcccatgagcctctgaaccagccacggcag

SEQ ID NO: 127747 - DNA, 75 bp, Artificial Sequence
  Synthetic
ctagcactccggcaccaagctccggcttggggggctcgctcgctagcccatgagcgtctgaaccagccacggcag

SEQ ID NO: 127748 - DNA, 75 bp, Artificial Sequence
  Synthetic
ctagcactccggcaccaagctccggcttgggggggtcgctcgctagcccataagcatctgaaccagccacggcag

SEQ ID NO: 127749 - DNA, 75 bp, Artificial Sequence
  Synthetic
ctagcactccggcaccaagctccggcttgggggggtcgctcgctagcccataagcttctgaaccagccacggcag

SEQ ID NO: 127750 - DNA, 75 bp, Artificial Sequence
  Synthetic
ctagcactccggcaccaagctccggcttgggggggtcgctcgctagcccataagcctctgaaccagccacggcag

SEQ ID NO: 127751 - DNA, 75 bp, Artificial Sequence
  Synthetic
ctagcactccggcaccaagctccggcttgggggggtcgctcgctagcccataagcgtctgaaccagccacggcag

SEQ ID NO: 127752 - DNA, 75 bp, Artificial Sequence
  Synthetic
ctagcactccggcaccaagctccggcttgggggggtcgctcgctagcccattagcatctgaaccagccacggcag

SEQ ID NO: 127753 - DNA, 75 bp, Artificial Sequence
  Synthetic
ctagcactccggcaccaagctccggcttgggggggtcgctcgctagcccattagcttctgaaccagccacggcag

SEQ ID NO: 127754 - DNA, 75 bp, Artificial Sequence
  Synthetic
ctagcactccggcaccaagctccggcttgggggggtcgctcgctagcccattagcctctgaaccagccacggcag

SEQ ID NO: 127755 - DNA, 75 bp, Artificial Sequence
  Synthetic
ctagcactccggcaccaagctccggcttgggggggtcgctcgctagcccattagcgtctgaaccagccacggcag

SEQ ID NO: 127756 - DNA, 75 bp, Artificial Sequence
  Synthetic
ctagcactccggcaccaagctccggcttgggggggtcgctcgctagcccatcagcatctgaaccagccacggcag

SEQ ID NO: 127757 - DNA, 75 bp, Artificial Sequence
  Synthetic
ctagcactccggcaccaagctccggcttgggggggtcgctcgctagcccatcagcttctgaaccagccacggcag

SEQ ID NO: 127758 - DNA, 75 bp, Artificial Sequence
  Synthetic
ctagcactccggcaccaagctccggcttgggggggtcgctcgctagcccatcagcctctgaaccagccacggcag

SEQ ID NO: 127759 - DNA, 75 bp, Artificial Sequence
  Synthetic
ctagcactccggcaccaagctccggcttgggggggtcgctcgctagcccatcagcgtctgaaccagccacggcag

SEQ ID NO: 127760 - DNA, 75 bp, Artificial Sequence
  Synthetic
ctagcactccggcaccaagctccggcttgggggggtcgctcgctagcccatgagcatctgaaccagccacggcag

SEQ ID NO: 127761 - DNA, 75 bp, Artificial Sequence
  Synthetic
ctagcactccggcaccaagctccggcttgggggggtcgctcgctagcccatgagcttctgaaccagccacggcag

SEQ ID NO: 127762 - DNA, 75 bp, Artificial Sequence
  Synthetic
ctagcactccggcaccaagctccggcttgggggggtcgctcgctagcccatgagcctctgaaccagccacggcag

SEQ ID NO: 127763 - DNA, 75 bp, Artificial Sequence
  Synthetic
ctagcactccggcaccaagctccggcttgggggggtcgctcgctagcccatgagcgtctgaaccagccacggcag

SEQ ID NO: 127764 - DNA, 75 bp, Artificial Sequence
  Synthetic
tggcacttccccagcaggcctatgcccttgatgcaacgggacaggggcaaatgggcttggttcttctggtggtca

SEQ ID NO: 127765 - DNA, 75 bp, Artificial Sequence
  Synthetic
tcggaagtgtgtggccctgtctactgtttcacgccgagtcctgtggcggtgggcaccaccgacaggctcggcgtc

SEQ ID NO: 127766 - DNA, 75 bp, Artificial Sequence
  Synthetic
cactacgtaacgggcatgacatcagataacatcaaatgcccatgccaggtcccgttgcccgaattcttcaccgag

SEQ ID NO: 127767 - DNA, 75 bp, Artificial Sequence
  Synthetic
tggggaggatgacgtcgtttgctgttccatgtcctattcctggacgggggccttgatcacaccgtgtgccgctga

SEQ ID NO: 127768 - DNA, 75 bp, Artificial Sequence
  Synthetic
ggcggccgtgacggcatcatatgggccgccgccatactctgtccgggcatagtgtttgacataaccaagtggctc

SEQ ID NO: 127769 - DNA, 75 bp, Artificial Sequence
  Synthetic
cggggttcacgaaaacctgcggggctccgccatgccaagtgcaggcgtcggttgccaatcagagctggagctgcc

SEQ ID NO: 127770 - DNA, 75 bp, Artificial Sequence
  Synthetic
aggaccatcaccacgggtgcccccattacgtactccacctatggcaagttccttgccgacggtggttgctctggg

SEQ ID NO: 127771 - DNA, 75 bp, Artificial Sequence
  Synthetic
aaagtcacatttgacaggctccaggtagttgaccaacactaccaagatgtccttaaggagattaagctccgagca

SEQ ID NO: 127772 - DNA, 75 bp, Artificial Sequence
  Synthetic
ccaccgattgcttcaggaaacacccagaaacaacctacaccaaatgtggttcaggcccctggctcacgccgcggt

SEQ ID NO: 127773 - DNA, 75 bp, Artificial Sequence
  Synthetic
tacacccacgccttgtgtttgaggtcacgaaatggttgctagcaatcctggggtctgcttacctccttaaagcat

SEQ ID NO: 127774 - DNA, 75 bp, Artificial Sequence
  Synthetic
tatgggtatggagcacgggatgttaggagccacactagcaaggccattaaccacatcaactccgtgtgggaggac

SEQ ID NO: 127775 - DNA, 75 bp, Artificial Sequence
  Synthetic
gatcaccataggcaggtggactggcacttacatctatgaccacctctcccccttatcaacttgggcagcccaggg

SEQ ID NO: 127776 - DNA, 75 bp, Artificial Sequence
  Synthetic
agaggcagcatgcaattggaccaggggagaaccttgcgggttggagcacagggaccgcgcagaactgtcgccctt

SEQ ID NO: 127777 - DNA, 75 bp, Artificial Sequence
  Synthetic
ggaggcaggagatgggcggaaacatcaccagggtagagtcggagaacaaggtcgtcattctggactctttcgacc

SEQ ID NO: 127778 - DNA, 75 bp, Artificial Sequence
  Synthetic
tgatagtctacccggacctgtccgtgcgggtctgcgagaaaatggccctctatgaggtcacgcagaaactcccta

SEQ ID NO: 127779 - DNA, 75 bp, Artificial Sequence
  Synthetic
ggactacaacccaccattattggagacatggaagaagcccgactacgaaccacccgtggtccacggatgtcctct

SEQ ID NO: 127780 - DNA, 75 bp, Artificial Sequence
  Synthetic
ccaacggcagctggcacatcaacaggactgccctgaattgtaatgactccctcaacaccgggttcattgccgcgc

SEQ ID NO: 127781 - DNA, 75 bp, Artificial Sequence
  Synthetic
gtgggagtatgttgtgctagccttcctgctactagcagacgccagagtctgtgcatgtctttggatgatgctgct

SEQ ID NO: 127782 - DNA, 75 bp, Artificial Sequence
  Synthetic
ccacctccaaggaggagaaagcaggtcatcctgacagagtccaccgtgtcagcagctctagccgagcttgcgacg

SEQ ID NO: 127783 - DNA, 75 bp, Artificial Sequence
  Synthetic
ttcatacgacaccaggtgctttgactcgacagtcaccgagcgggatatccggactgaggaggacatttaccaatc

SEQ ID NO: 127784 - DNA, 75 bp, Artificial Sequence
  Synthetic
tcgacagtcaccgagcgggatatccggactgaggaggacatttaccaatcttgccaactggatcctacaatgagg

SEQ ID NO: 127785 - DNA, 75 bp, Artificial Sequence
  Synthetic
atgttgtcccggcatcgagtgtctgcggtcccgtgtactgcttcacaccatcgccggtggtcgtaggcaccactg

SEQ ID NO: 127786 - DNA, 75 bp, Artificial Sequence
  Synthetic
ttgcggaatgtggcctttgctcctcctgctcctcgcgttgcccgaacgggcttacgcgtacgaccaggaagtagc

SEQ ID NO: 127787 - DNA, 75 bp, Artificial Sequence
  Synthetic
ctggggtgcgaatgaatcggatgtgttcctgctgcagtccctgcggcctcctaatggccggtggtttgggtgcac

SEQ ID NO: 127788 - DNA, 75 bp, Artificial Sequence
  Synthetic
tttacctggtcacccgaaacgctgatgttattccggtccggaggaaagatgaccgacggggtgcactactctcgc

SEQ ID NO: 127789 - DNA, 75 bp, Artificial Sequence
  Synthetic
agaactttgacatgttggtgtgcggagatgatctagtggtcatatgtgaaagtgcaggcacacaggaggacgctg

SEQ ID NO: 127790 - DNA, 75 bp, Artificial Sequence
  Synthetic
ttcatagctagagtggaggccgcgctgcatgtttatgcgccatcattcgagccacgtggcccccgggactctgta

SEQ ID NO: 127791 - DNA, 75 bp, Artificial Sequence
  Synthetic
ctcaacatcttggggggctggctagcgtcccatatcgcgccgcccgcgggagccactggctttgtcgtcagcggc

SEQ ID NO: 127792 - DNA, 75 bp, Artificial Sequence
  Synthetic
gacagagtgcaggtccttgatgatcactacaaggacgtgctaaaggaggtaaaggcaaaagcgtccacagtcaag

SEQ ID NO: 127793 - DNA, 75 bp, Artificial Sequence
  Synthetic
cccacctagcctttgacattgcaaaatacatcctggcccttttggggcccctctacatacttcaggcttcgctgc

SEQ ID NO: 127794 - DNA, 75 bp, Artificial Sequence
  Synthetic
atccaacgtctccgtagcccacgatgccaccggacagaggtactactacctcactcgtgactgcaccactccaca

SEQ ID NO: 127795 - DNA, 75 bp, Artificial Sequence
  Synthetic
atccaacgtctccgtagcccacgatgccaccggacagaggtactactacctcactcgtgactgcaccactccact

SEQ ID NO: 127796 - DNA, 75 bp, Artificial Sequence
  Synthetic
atccaacgtctccgtagcccacgatgccaccggacagaggtactactacctcactcgtgactgcaccactccacc

SEQ ID NO: 127797 - DNA, 75 bp, Artificial Sequence
  Synthetic
atccaacgtctccgtagcccacgatgccaccggacagaggtactactacctcactcgtgactgcaccactccacg

SEQ ID NO: 127798 - DNA, 75 bp, Artificial Sequence
  Synthetic
tttggcactacccatgtacagtcaatttcacattgttcaaggtgaggatgtttgtgggtgggtttgaacaccggt

SEQ ID NO: 127799 - DNA, 75 bp, Artificial Sequence
  Synthetic
tgcgcgagctgcttgggagacagctcgccacaccccagtcaattcatggctgggcaacatcattatgtatgcccc

SEQ ID NO: 127800 - DNA, 75 bp, Artificial Sequence
  Synthetic
tttgtgggtgggtttgaacaccggttttccgccgcttgcaactggaccaggggggagcgctgcaatatcgaggat

SEQ ID NO: 127801 - DNA, 75 bp, Artificial Sequence
  Synthetic
acctactccatcactccacttgatctcccagcaatcattcaaagactccatggcatggcagcattttcactccat

SEQ ID NO: 127802 - DNA, 75 bp, Artificial Sequence
  Synthetic
acctactccatcactccacttgatctcccagcaatcattcaatgactccatggcatggcagcattttcactccat

SEQ ID NO: 127803 - DNA, 75 bp, Artificial Sequence
  Synthetic
acctactccatcactccacttgatctcccagcaatcattcaacgactccatggcatggcagcattttcactccat

SEQ ID NO: 127804 - DNA, 75 bp, Artificial Sequence
  Synthetic
acctactccatcactccacttgatctcccagcaatcattcaaggactccatggcatggcagcattttcactccat

SEQ ID NO: 127805 - DNA, 75 bp, Artificial Sequence
  Synthetic
tgccactcaactgactcgacttccatcttgggcatcggtacagttttggaccaggcggagacggctggagcgcgg

SEQ ID NO: 127806 - DNA, 75 bp, Artificial Sequence
  Synthetic
tcccagcaatcattcaaagactccatggcatggcagcattttcactccatggatactctccaaccgaaactaata

SEQ ID NO: 127807 - DNA, 75 bp, Artificial Sequence
  Synthetic
tcccagcaatcattcaatgactccatggcatggcagcattttcactccatggatactctccaaccgaaactaata

SEQ ID NO: 127808 - DNA, 75 bp, Artificial Sequence
  Synthetic
tcccagcaatcattcaacgactccatggcatggcagcattttcactccatggatactctccaaccgaaactaata

SEQ ID NO: 127809 - DNA, 75 bp, Artificial Sequence
  Synthetic
tcccagcaatcattcaaggactccatggcatggcagcattttcactccatggatactctccaaccgaaactaata

SEQ ID NO: 127810 - DNA, 75 bp, Artificial Sequence
  Synthetic
tgacactgaggtgtcgggggggtggaggcttctcgcccccattaccgcctatgcgcagcaaactcgaggcttgtt

SEQ ID NO: 127811 - DNA, 75 bp, Artificial Sequence
  Synthetic
aggcttctcgcccccattaccgcctatgcgcagcaaactcgaggcttgttaggcaccatcgtgacgagcctcact

SEQ ID NO: 127812 - DNA, 75 bp, Artificial Sequence
  Synthetic
aatatctctggcaatgtccgcctgggctctatgagaatcacagggcccaaaacctgcatgaacacctggcagggg

SEQ ID NO: 127813 - DNA, 75 bp, Artificial Sequence
  Synthetic
agcagcctgtcgagccgcagggctccgggactgcaccatgctcgtgtgtggcgacgacttagtcgttatctgtga

SEQ ID NO: 127814 - DNA, 75 bp, Artificial Sequence
  Synthetic
agggtggcggcctcggagtacgctgaggtgacgcggcacgggccatactcctacataacaggactaaccactgac

SEQ ID NO: 127815 - DNA, 75 bp, Artificial Sequence
  Synthetic
caatatccacccttaaaggctcttctggtggtccactgttatgcccctcggggcacgctgttggcatctttcgag

SEQ ID NO: 127816 - DNA, 75 bp, Artificial Sequence
  Synthetic
aggcaggactggtaggggcaggagaggcatctacaggtttgtgactccaggggaacggccctcgggcatgttcga

SEQ ID NO: 127817 - DNA, 75 bp, Artificial Sequence
  Synthetic
ggcatttacaggtatgtctcgtcaggcgagaggccgtctgggatgttcgacagcgtagtgctctgcgagtgctat

SEQ ID NO: 127818 - DNA, 75 bp, Artificial Sequence
  Synthetic
ctcctcagcgagccagctatcagcgccatcgctgcgagccacctgcaccacccactgcaaggccttcggcgtaga

SEQ ID NO: 127819 - DNA, 75 bp, Artificial Sequence
  Synthetic
ggcatacatgtccaaggcgcatggcatcgacccgaacatacggtcgggtgtcagaaccatctcaacaggcgcgcc

SEQ ID NO: 127820 - DNA, 75 bp, Artificial Sequence
  Synthetic
agaagcgaccacgagccttcgatcccatcagagtatatgctccccaagaggaggttcccaccagccttaccagtc

SEQ ID NO: 127821 - DNA, 75 bp, Artificial Sequence
  Synthetic
cctgtcaaactggttcacagctggatacagcgggggggacatatatcacagcgtgtcctacgcccggccccgctg

SEQ ID NO: 127822 - DNA, 75 bp, Artificial Sequence
  Synthetic
cctgtctaactggttcacagctggatacagcgggggggacatatatcacagcgtgtcctacgcccggccccgctg

SEQ ID NO: 127823 - DNA, 75 bp, Artificial Sequence
  Synthetic
cctgtccaactggttcacagctggatacagcgggggggacatatatcacagcgtgtcctacgcccggccccgctg

SEQ ID NO: 127824 - DNA, 75 bp, Artificial Sequence
  Synthetic
cctgtcgaactggttcacagctggatacagcgggggggacatatatcacagcgtgtcctacgcccggccccgctg

SEQ ID NO: 127825 - DNA, 75 bp, Artificial Sequence
  Synthetic
aggccccgacgccccccccaagaagacgccggacggtgggtctgagcgagagcaccataggggaagtcctccaac

SEQ ID NO: 127826 - DNA, 75 bp, Artificial Sequence
  Synthetic
aaatgtgatgagttggccaaaaacttgtcagctcttggactcaatgcagtggcctattacagggggttagacgtg

SEQ ID NO: 127827 - DNA, 75 bp, Artificial Sequence
  Synthetic
ctgcggcagctcggacctttatctggtcacgaggcatgctgatgtcattccggtgcgccggcggggcgacagcag

SEQ ID NO: 127828 - DNA, 75 bp, Artificial Sequence
  Synthetic
actccggcagtcaggcgtcccctgatgagctggccctctcggagacagattccatctcctccatgccccccctcg

SEQ ID NO: 127829 - DNA, 75 bp, Artificial Sequence
  Synthetic
catgactggctacactggtgactttgactcggtgatagactgcaacacgtctgtcatacagactgttgacttcag

SEQ ID NO: 127830 - DNA, 75 bp, Artificial Sequence
  Synthetic
ggaaacccttagcacacaggctaggtctccatctttctctgacaattcaactcctcctgctgttccacagagcta

SEQ ID NO: 127831 - DNA, 75 bp, Artificial Sequence
  Synthetic
cgacgcggacacccacgtcaccgggggaactgccggccgcgacgtggctggatttactagtctcttcagtagagg

SEQ ID NO: 127832 - DNA, 75 bp, Artificial Sequence
  Synthetic
tcccggccgcttatgtggcacaaggatacaatgttctcgtgctgaatccatcagtggcggccacactaggcttcg

SEQ ID NO: 127833 - DNA, 75 bp, Artificial Sequence
  Synthetic
gctcttacatgtcgcgtgcctatgggatcgaccccaacgtccgcactgggaaccgcaccgttacaactggtgcta

SEQ ID NO: 127834 - DNA, 75 bp, Artificial Sequence
  Synthetic
gtgtgcgcagcaatactgcgtcggcatgtgggcccgggagagggggctgtgcagtggatgaaccggctgatagcg

SEQ ID NO: 127835 - DNA, 75 bp, Artificial Sequence
  Synthetic
actatccatacctggtagcttatcaggccacagtttgcgcgagggcgctcgcgcctccacccagctgggacacta

SEQ ID NO: 127836 - DNA, 75 bp, Artificial Sequence
  Synthetic
ccaacgcccctactgctggcactaccccccaaaaccttgtggtattgtgcccgcaaagagcgtgtgtggcccggt

SEQ ID NO: 127837 - DNA, 75 bp, Artificial Sequence
  Synthetic
ttggggtaaacactccggccctttaggccattttccgtttttttttttccccttttttttttttttccccttttt

SEQ ID NO: 127838 - DNA, 75 bp, Artificial Sequence
  Synthetic
agaatgaagtgacactcacccatcctataaccaaatacatcatggcctgcatgtcagcagaccttgaagtggtga

SEQ ID NO: 127839 - DNA, 75 bp, Artificial Sequence
  Synthetic
acgggagtcatgactactcggtgtccatgcggagcaaacatctcgggccatgtccgcatgggtaccatgaaaata

SEQ ID NO: 127840 - DNA, 75 bp, Artificial Sequence
  Synthetic
cgattctgtcatagattgcaacgtggctgtcgaacagtacgttgacttcagcctggaccccaccttttccatcga

SEQ ID NO: 127841 - DNA, 75 bp, Artificial Sequence
  Synthetic
ccctcgggcatgttcgattcttcggtcctgtgtgagtgctatgacgcgggctgtgcttggtacgagctcacgccc

SEQ ID NO: 127842 - DNA, 75 bp, Artificial Sequence
  Synthetic
tcccttctttcgggatgaggtaacgttcaccgtaggcctcaattcctttgtggtcggctctcagctcccttgcga

SEQ ID NO: 127843 - DNA, 75 bp, Artificial Sequence
  Synthetic
ttgagcagttctgggcaaagcacatgtggaacttcattagcggcatccaatatcttgctgggttatccaccttac

SEQ ID NO: 127844 - DNA, 75 bp, Artificial Sequence
  Synthetic
atgccaggttccggcccccgaatttttcacggaggtggatggggtgcgactgcacaggtacgctccggtgtgcaa

SEQ ID NO: 127845 - DNA, 75 bp, Artificial Sequence
  Synthetic
tgaggccgtactgctggcattaccccccgaagccttgcggtatcgtcccggctaggacggtttgcgggccggtct

SEQ ID NO: 127846 - DNA, 75 bp, Artificial Sequence
  Synthetic
cccgctgagaccacagtcagactgagagcttacttatccacgccggggttacctgtctgccaagaccatctagac

SEQ ID NO: 127847 - DNA, 75 bp, Artificial Sequence
  Synthetic
cgtgggcaccactgacaggcagggcgtacccacctatagctggggggaaaatgagaccgatgtcttcctgctaaa

SEQ ID NO: 127848 - DNA, 75 bp, Artificial Sequence
  Synthetic
cagcgtcggcttgggaagagtcctggtcgacattctcgccggctacggcgccggagtggccggcgctgtggtcac

SEQ ID NO: 127849 - DNA, 75 bp, Artificial Sequence
  Synthetic
agcaggacatccagctgattaacaccaacggcagttggcacatcaatcgtacggccttgaactgcaacgacagcc

SEQ ID NO: 127850 - DNA, 75 bp, Artificial Sequence
  Synthetic
tagactgtggcattatccgtgcactgtaaattttaccatcttcaaggtgcggatgtatgtagggggggtggagca

SEQ ID NO: 127851 - DNA, 75 bp, Artificial Sequence
  Synthetic
ctattgccccggatgcccggcatcccctttttctcctgtcaaaaggggtataagggggaatggcggggggacggg

SEQ ID NO: 127852 - DNA, 75 bp, Artificial Sequence
  Synthetic
ccagcgccaaactactcgtttgcgctttggagggtgtccgccgaggagtatgtgcaggttcgcagagtgggtgat

SEQ ID NO: 127853 - DNA, 75 bp, Artificial Sequence
  Synthetic
cctcctctggctgccccccagactccgacgctgagtcctattcttccatgccccccctggagggggagcctgggg

SEQ ID NO: 127854 - DNA, 75 bp, Artificial Sequence
  Synthetic
caagttccttgccgacggtggctgctctgggggcgcctatgacatcataatatgtgatgagtgccattcaactga

SEQ ID NO: 127855 - DNA, 75 bp, Artificial Sequence
  Synthetic
atgcttacagacccatcccacatcaccgcggagactgcaagacgcaggctgggcaggggatcacccccctcgcta

SEQ ID NO: 127856 - DNA, 75 bp, Artificial Sequence
  Synthetic
aagaagttcccgccggccataccaatctgggcccggccagactacaacccgcctctggttgagtcgtggaaacaa

SEQ ID NO: 127857 - DNA, 75 bp, Artificial Sequence
  Synthetic
aggaagaagaagacggtcgtgctctccgaggccaccgtttcagatgccttggcggacttggcggcaaagtccttt

SEQ ID NO: 127858 - DNA, 75 bp, Artificial Sequence
  Synthetic
gacgggataaatttcgcaacagggaacttgcccggttgctccttttctatcttccttcttgctctattctcttgc

SEQ ID NO: 127859 - DNA, 75 bp, Artificial Sequence
  Synthetic
cacggtactttccccatcaatgagtacaccaccggacccagcacaccttgcccaccacccaactacacccgcgca

SEQ ID NO: 127860 - DNA, 75 bp, Artificial Sequence
  Synthetic
cacctacagtagcagtcaggtacgtcggagcaaccaccgcttcgatacgcagtcatgtggacctattagtgggcg

SEQ ID NO: 127861 - DNA, 75 bp, Artificial Sequence
  Synthetic
cggagcaaccaccgcttcgatacgcagtcatgtggacctattagtgggcgcggccacgatgtgctctgcgctcta

SEQ ID NO: 127862 - DNA, 75 bp, Artificial Sequence
  Synthetic
cagctcttcagctagtcagttgtctgcgccttccttgaaggcaacatgcactacccatcatgactccccagacgc

SEQ ID NO: 127863 - DNA, 75 bp, Artificial Sequence
  Synthetic
agaccaggaccttgtcggctggcaggcgccccctggggcgcgctccctgacaccatgcacctgcggtagctcgga

SEQ ID NO: 127864 - DNA, 75 bp, Artificial Sequence
  Synthetic
ggtagtaattctggactcttttgacccactccgagcagaggaggatgagagggaggtatccgttgaggcggagat

SEQ ID NO: 127865 - DNA, 75 bp, Artificial Sequence
  Synthetic
ttaaccacatcaactccgtgtgggaggacttgctggaagacaacacaacccctattccgacaacaatcatggcca

SEQ ID NO: 127866 - DNA, 75 bp, Artificial Sequence
  Synthetic
gaatgtctgcggccctgtgtactgcttcacaccatcgccagtggttgtgggcactaccgatcgcaagggcgtgcc

SEQ ID NO: 127867 - DNA, 75 bp, Artificial Sequence
  Synthetic
cgggtaccgcagatgccgcgcgagcggcgtctacaccacaagcttcgggaacacactgacgtgcttcctcaaggc

SEQ ID NO: 127868 - DNA, 75 bp, Artificial Sequence
  Synthetic
tcagatgtgttcctgctggagtccctgaggcctcccagtggtcggtggtttgggtgtgcgtggatgaattccacg

SEQ ID NO: 127869 - DNA, 75 bp, Artificial Sequence
  Synthetic
cgaaagcgatggtgtcgacgaggaccgccgagccctcggagctttcacggaagctatgacgaggtattcggctcc

SEQ ID NO: 127870 - DNA, 75 bp, Artificial Sequence
  Synthetic
tacatgacccgcgaccctgaaactcccctcgccagagctgcgtgggagacagccagacacactccagtcaactcc

SEQ ID NO: 127871 - DNA, 75 bp, Artificial Sequence
  Synthetic
tggcagttggcacatcaacagcacggccttgaactgcaataccagcctcgagaccggctggttagctgggctctt

SEQ ID NO: 127872 - DNA, 75 bp, Artificial Sequence
  Synthetic
gctgggcaggatggctcctgtccccccgaggctctcgcccctcctggggccccactgacccccggcataggtcgc

SEQ ID NO: 127873 - DNA, 75 bp, Artificial Sequence
  Synthetic
cgcctcattgtgtaccctgacctgggggtgcgtgtctgtgagaaacgcgccctatatgacgtgatacagaagttg

SEQ ID NO: 127874 - DNA, 75 bp, Artificial Sequence
  Synthetic
ccaagcttgaacaattttgggccaaacacatgtggaacttcatcagtggtatacagtacctggcgggactctcca

SEQ ID NO: 127875 - DNA, 75 bp, Artificial Sequence
  Synthetic
gtagagccagaatatgtggcatatatctctttaactgggcgacaaaaaccaaagccagactcactccattgcccg

SEQ ID NO: 127876 - DNA, 75 bp, Artificial Sequence
  Synthetic
gtagagccagaatttgtggcatatatctctttaactgggcgacaaaaaccaaagccagactcactccattgcccg

SEQ ID NO: 127877 - DNA, 75 bp, Artificial Sequence
  Synthetic
gtagagccagaatctgtggcatatatctctttaactgggcgacaaaaaccaaagccagactcactccattgcccg

SEQ ID NO: 127878 - DNA, 75 bp, Artificial Sequence
  Synthetic
gtagagccagaatgtgtggcatatatctctttaactgggcgacaaaaaccaaagccagactcactccattgcccg

SEQ ID NO: 127879 - DNA, 75 bp, Artificial Sequence
  Synthetic
agccttttgcgcggcgtggcacgtgcggggtaaacttgtcccgctggtgacctacagcctgacgggtctttggtc

SEQ ID NO: 127880 - DNA, 75 bp, Artificial Sequence
  Synthetic
aatgctgtaaccttgaaccggaggccaggaaagtgatctcctccctcacggagcggctttactgcgggggcccta

SEQ ID NO: 127881 - DNA, 75 bp, Artificial Sequence
  Synthetic
caggaaagtgatctcctccctcacggagcggctttactgcgggggccctatgttcaacagcaagggggcccagtg

SEQ ID NO: 127882 - DNA, 75 bp, Artificial Sequence
  Synthetic
ccccctgccggagccactggctttgttgtcagcggtctagtgggggcggccgtcggaagtataggcctgggtaag

SEQ ID NO: 127883 - DNA, 75 bp, Artificial Sequence
  Synthetic
atacaatcacttgttacatcaaggccacagcggctgcgaaggccgcaggcctccggaacccggactttcttgtct

SEQ ID NO: 127884 - DNA, 75 bp, Artificial Sequence
  Synthetic
gaggggtcgagcacaggctggacgctgcctgcaactggacacggggcgaacgttgtgatctggaagacagggaca

SEQ ID NO: 127885 - DNA, 75 bp, Artificial Sequence
  Synthetic
gcgcgcctacctacaactggggtgaaaatgatacggacgtcttcgtccttaacaacaccaggccaccgctgggca

SEQ ID NO: 127886 - DNA, 75 bp, Artificial Sequence
  Synthetic
ttgcctactcctactaacagtaggggtaggcatcttcctcctgccagctcggtgagctggtaggataacactcca

SEQ ID NO: 127887 - DNA, 75 bp, Artificial Sequence
  Synthetic
gagaccatagtggtctgcggaaccggtgagtacaccggaaatgccaagacgaccgggtcctttcttggatcaagc

SEQ ID NO: 127888 - DNA, 75 bp, Artificial Sequence
  Synthetic
tgtttgggactggatatgcacggtgttgactgatttcaagacctggctccagtccaagctcctaccacggttacc

SEQ ID NO: 127889 - DNA, 75 bp, Artificial Sequence
  Synthetic
catgtcaaaaacggttccatgaggatcgttgggcctaaaacctgcagcaacacgtggcatggaacattccccatc

SEQ ID NO: 127890 - DNA, 75 bp, Artificial Sequence
  Synthetic
ctctttcgacccactccgagcagaggaggatgagagggaaatatccgttccagcggagatcctgcggaaatccag

SEQ ID NO: 127891 - DNA, 75 bp, Artificial Sequence
  Synthetic
cactcagccaaatctaagtttggctatggggcaaaagacgtccgttgccatgccagaaaggccataacccacatc

SEQ ID NO: 127892 - DNA, 75 bp, Artificial Sequence
  Synthetic
gccaatggaagcggccccgaccatcgcccctactgctggcactaccctccaagaccttgtggtattgtgcccgcg

SEQ ID NO: 127893 - DNA, 75 bp, Artificial Sequence
  Synthetic
gatctacagcccgctgagaccacagtcagactgagagcttacttgtccacgccggggttacctgtctgccaagac

SEQ ID NO: 127894 - DNA, 75 bp, Artificial Sequence
  Synthetic
gggcctgtccaaaatgaaacctgcttgacacaccccgtcacaaaatacatcatggcatgcatgtcagctgatctg

SEQ ID NO: 127895 - DNA, 75 bp, Artificial Sequence
  Synthetic
cctaactggccgggataaaaaccaagtggagggtgaggtccagattgtgtcaaccgctgcccaaactttcctggc

SEQ ID NO: 127896 - DNA, 75 bp, Artificial Sequence
  Synthetic
agcgagccacccaacaacaagctgtcattgagcccatagtagctaccaactggcaaaagcttgaggccttctggc

SEQ ID NO: 127897 - DNA, 75 bp, Artificial Sequence
  Synthetic
cggagcgcccccttgtgtcatcggaggggtgggcaacaacaccttgcactgccccactgattgtttccgcaagca

SEQ ID NO: 127898 - DNA, 75 bp, Artificial Sequence
  Synthetic
tcagtcttaaaggacatcaagctagcggcttccaaggtcagcgcaaggctcctcaccttggaggaggcgtgccag

SEQ ID NO: 127899 - DNA, 75 bp, Artificial Sequence
  Synthetic
cagggaatctgcccggttgctccttttctatcttcttacttgctcttctgtcttgcgttacagtgccagtgtctg

SEQ ID NO: 127900 - DNA, 75 bp, Artificial Sequence
  Synthetic
tggatgcgtcccatgtgagaatgataatggcaccttgcgctgctggatacaagtaacacctaatgtggctgtgaa

SEQ ID NO: 127901 - DNA, 75 bp, Artificial Sequence
  Synthetic
acaccgcggtgcactcactcacaacctgcgaacacacgtcgacatgatcgtaatggcagctacggtctgctcggc

SEQ ID NO: 127902 - DNA, 75 bp, Artificial Sequence
  Synthetic
gtccgtgccaagtgccggctgctgagttctttactgaagtggatggggtgagactccaccgttacgcccctccat

SEQ ID NO: 127903 - DNA, 75 bp, Artificial Sequence
  Synthetic
ggggccacagaagatgagctcaagtgtccgtgccaagtgccggctgctgagttctttactgaagtggatggggtg

SEQ ID NO: 127904 - DNA, 75 bp, Artificial Sequence
  Synthetic
ggcttggcctatttctccatgcagggagcgtgggccaaagtcatcgccattctccttcttgtcgcgggagtggat

SEQ ID NO: 127905 - DNA, 75 bp, Artificial Sequence
  Synthetic
gccaacttgttatggcggcaagagatgggcagcaacattacacgggtggagtctgaaacaaaggttgtgattctt

SEQ ID NO: 127906 - DNA, 75 bp, Artificial Sequence
  Synthetic
cagtggcctctttgcccctggtcccaggcagagaatccatttaatcaacaccaatggcagctggcacatcaaccg

SEQ ID NO: 127907 - DNA, 75 bp, Artificial Sequence
  Synthetic
caactcgtccggatgcccagagcgcatggccagctgccgctccatcaatgagttcgctcaggggtggggtcccat

SEQ ID NO: 127908 - DNA, 75 bp, Artificial Sequence
  Synthetic
cgagaccaatgtcaccaacgatgaggacatgaggccgtactgctggcattaccctccgaagccttgcggtatcgt

SEQ ID NO: 127909 - DNA, 75 bp, Artificial Sequence
  Synthetic
tcaccaggcgccaagcagaacatccagctggtcaacaccaacggcagttggcacatcaatagcacggccttgaac

SEQ ID NO: 127910 - DNA, 75 bp, Artificial Sequence
  Synthetic
agctggtcaacaccaacggcagttggcacatcaatagcacggccttgaactgcaatgacagcctcaacaccggct

SEQ ID NO: 127911 - DNA, 75 bp, Artificial Sequence
  Synthetic
cggagtcatgctcgtccatgcctcctctcgagggggagccgggcgatccagacttgagttgcgactcttggtcca

SEQ ID NO: 127912 - DNA, 75 bp, Artificial Sequence
  Synthetic
gcccagggctggggccctatcagttatgccaacggaagtggccccgaccaacgcccctactgctggcactacccc

SEQ ID NO: 127913 - DNA, 75 bp, Artificial Sequence
  Synthetic
cttatagattgtggcattatccgtgcactgtgaattttaccatcttcaaggtgcggatgtatgtagggggggtgg

SEQ ID NO: 127914 - DNA, 75 bp, Artificial Sequence
  Synthetic
cactgtgaattttaccatcttcaaggtgcggatgtatgtagggggggtggagcatcgattgtccgcagcatgtaa

SEQ ID NO: 127915 - DNA, 75 bp, Artificial Sequence
  Synthetic
accttgggccgtctcagaaaatccagcttgtaaacaccaacggcagctggcatatcaacaggaccgccctgaact

SEQ ID NO: 127916 - DNA, 75 bp, Artificial Sequence
  Synthetic
ggacgtgcaatacctgtacggcatagggtcagcagtcgtctcctttgcaatcaaatgggagtatgtcgtgttgct

SEQ ID NO: 127917 - DNA, 75 bp, Artificial Sequence
  Synthetic
gccagggtctgtgcatgcctttggatgctcatcatactgggccaagccgaggcggcgcttgagaagctcatcatc

SEQ ID NO: 127918 - DNA, 75 bp, Artificial Sequence
  Synthetic
ggccattggggtgtggtgtttggcttggcctatttctccctgcagggagcatgggccaaagtcattgccatcctc

SEQ ID NO: 127919 - DNA, 75 bp, Artificial Sequence
  Synthetic
caaggccttctccggatctgcgcgctagcgcggaagatggccggaggccattacgtgcaaatggctgtcatcaag

SEQ ID NO: 127920 - DNA, 75 bp, Artificial Sequence
  Synthetic
cgggaagccggcaattatacctgacagggaagtcctctaccgggagttcgatgagatggaagagtgctctcagca

SEQ ID NO: 127921 - DNA, 75 bp, Artificial Sequence
  Synthetic
ttcttctgtgctgcctggtacatcaagggcaggctggtccctggggcggcatatgctctctatggcgtatggccg

SEQ ID NO: 127922 - DNA, 75 bp, Artificial Sequence
  Synthetic
tcgtcttttcccgaatggagaccaagctcatcacgtggggggcagacaccgctgcatgcggtgacatcatcaacg

SEQ ID NO: 127923 - DNA, 75 bp, Artificial Sequence
  Synthetic
cctacgagcttggagacatcgggcacgagcagtgcgcgccaagcttatcgcccagggagggaaggccaaaatatg

SEQ ID NO: 127924 - DNA, 75 bp, Artificial Sequence
  Synthetic
ccgatttaccggcactgtctactggtctattgcacctccaccaaaacatagtggacgtgcagtacctctatggac

SEQ ID NO: 127925 - DNA, 75 bp, Artificial Sequence
  Synthetic
cccattgagaccatcaagggggggagacacctcattttctgtcattccaagaagaaatgtgacgagctcgctgca

SEQ ID NO: 127926 - DNA, 75 bp, Artificial Sequence
  Synthetic
ctacaccacgggcccctgtactccccttcctgcgccgaactatacgttcgcgctgtggagggtgtctgcagagga

SEQ ID NO: 127927 - DNA, 75 bp, Artificial Sequence
  Synthetic
cgggcgccaggcagaacgtccagctcatcaactccaatggcagttggcacatcaatagcacggccttgaactgta

SEQ ID NO: 127928 - DNA, 75 bp, Artificial Sequence
  Synthetic
catcaactccaatggcagttggcacatcaatagcacggccttgaactgtaacgccagcctcgacaccggctggtt

SEQ ID NO: 127929 - DNA, 75 bp, Artificial Sequence
  Synthetic
aacttgctatccgtggaggaagcttgtagcctgacgcccccgcactcagccagatccaaatttggctatggggca

SEQ ID NO: 127930 - DNA, 75 bp, Artificial Sequence
  Synthetic
tggcagggggggtgctagccgccgtggcagcttactgcctggcgaccggctgcatttccatcattggccgcatac

SEQ ID NO: 127931 - DNA, 75 bp, Artificial Sequence
  Synthetic
gcagggctccgggactccacacatgagttcagggtgcagcagaggtcctgatactagaaaagaccaggagatcca

SEQ ID NO: 127932 - DNA, 75 bp, Artificial Sequence
  Synthetic
caaggtccctgctgcatatgccagtcaggggtacaaagtactcgtgctaaatccctctgtcgcggccacacttgg

SEQ ID NO: 127933 - DNA, 75 bp, Artificial Sequence
  Synthetic
caggggtacaaagtactcgtgctaaatccctctgtcgcggccacacttggttttggggcttacatgtccaaagcc

SEQ ID NO: 127934 - DNA, 75 bp, Artificial Sequence
  Synthetic
ttcctcccgctgctgggtagcgctcactcccacgctcgcggccaggaacagcagcatccccactacgacaatacg

SEQ ID NO: 127935 - DNA, 75 bp, Artificial Sequence
  Synthetic
gttcagctggcgcctatgacatcatcatatgcgacgaatgccattcagtggacgctactaccatccttggcattg

SEQ ID NO: 127936 - DNA, 75 bp, Artificial Sequence
  Synthetic
tgggctaaggtcttgattgtgatgctactctttgccggcgttgacgggactacctacgtgtcagtggggcatgca

SEQ ID NO: 127937 - DNA, 75 bp, Artificial Sequence
  Synthetic
agttcgatgagatggaagagtgcgcctcacaccttccctacatcgaacagggaatgcagctcgccgagcagttca

SEQ ID NO: 127938 - DNA, 75 bp, Artificial Sequence
  Synthetic
ccctgaattgcaacgagtccatcaacactgggttctttgccgcgctgttctacgtaaagaagttcaactcgtctg

SEQ ID NO: 127939 - DNA, 75 bp, Artificial Sequence
  Synthetic
gggtggggtcccatcacccatgctgagtctcgcagctcggaccaaaggccttactgctggcactacgcacctcaa

SEQ ID NO: 127940 - DNA, 75 bp, Artificial Sequence
  Synthetic
gggctaaccagtgacaaccttaaggtcccttgccaggtaccagctccagaattcttctcttgggtggacggggtg

SEQ ID NO: 127941 - DNA, 75 bp, Artificial Sequence
  Synthetic
tgggcgcacaacggcctacgagatctggccgtggctgtagagccagtcgtcttttcccagatggagaccaagctc

SEQ ID NO: 127942 - DNA, 75 bp, Artificial Sequence
  Synthetic
cggtgtattgcttcactcccagccccgtggtggtgggaacgaccgacaagtcgggcgcgcctacctacaactggg

SEQ ID NO: 127943 - DNA, 75 bp, Artificial Sequence
  Synthetic
gcgaccctgagccggacaccgaggtattggcctccatgttgacagacccgtcccacattactgcggaggcggcag

SEQ ID NO: 127944 - DNA, 75 bp, Artificial Sequence
  Synthetic
ggcgcatggcgtccgggttctggaggacggcgtgaactatgcaacagggaatctgcccggttgctccttttctat

SEQ ID NO: 127945 - DNA, 75 bp, Artificial Sequence
  Synthetic
ccacccactgtcctaggctgtgcccttccccccacacctcaaacgccggtgcccccacctcggaggcgccgcgcc

SEQ ID NO: 127946 - DNA, 75 bp, Artificial Sequence
  Synthetic
ccgctggttctggttttgcctactcctgctcgctgcaggggtaggcatctacctcctccccaaccgatgaaggtt

SEQ ID NO: 127947 - DNA, 75 bp, Artificial Sequence
  Synthetic
tggcgttaccaccacgggcatacgccatggaccgggagatggccgcatcgtgcggaggcgcggttttcgtaggtc

SEQ ID NO: 127948 - DNA, 75 bp, Artificial Sequence
  Synthetic
catggaccgggagatggccgcatcgtgcggaggcgcggttttcgtaggtctagcactcttgaccttgtcaccaca

SEQ ID NO: 127949 - DNA, 75 bp, Artificial Sequence
  Synthetic
ccctccttggccagctcttcggctagccagttgtctgcgccttccttgaaggcgacatgcactacccgtcatgac

SEQ ID NO: 127950 - DNA, 75 bp, Artificial Sequence
  Synthetic
tatcagctggtgcttatggtggcttcagtattttctgaccagagtagaagcgcaactgcacgtgtgggttccccc

SEQ ID NO: 127951 - DNA, 75 bp, Artificial Sequence
  Synthetic
caaagaaggtgacctttgacagggtgcaggtgctggacgcacactatgactcagtcttgcaggacgttaagcggg

SEQ ID NO: 127952 - DNA, 75 bp, Artificial Sequence
  Synthetic
gggaggcatctcattttctgccattccaagaagaaatgtgacgagctcgccgcaaagctgtcgggcctcggactc

SEQ ID NO: 127953 - DNA, 75 bp, Artificial Sequence
  Synthetic
actctttcgagccgcttcgggcggaggaggatgagagggaagtgtccgttccggcggaggtcctgcggaaatcca

SEQ ID NO: 127954 - DNA, 75 bp, Artificial Sequence
  Synthetic
catcctaacatcgaggaggttgctctgtccaccaccggagagatccccttttacggcaaggctatccccctcgag

SEQ ID NO: 127955 - DNA, 75 bp, Artificial Sequence
  Synthetic
ggtgcgcagcttatccaggagggccgtcaaccacatccggtccgtgtgggaggacctcctggaagaccaacatac

SEQ ID NO: 127956 - DNA, 75 bp, Artificial Sequence
  Synthetic
atgacaaacagcaaagggcaatcctgcggttacaggcgttgccgcgcaagcggtgttttcactaccagcatgggg

SEQ ID NO: 127957 - DNA, 75 bp, Artificial Sequence
  Synthetic
agaggttggccagctgccgaccccttaccgattttgaccaaggctggggccccatcagctatgccaacggaagcg

SEQ ID NO: 127958 - DNA, 75 bp, Artificial Sequence
  Synthetic
atcgttctcgactccctcgattccatgaccgaggtagaggatgatcgtgagccttctgtaccatcagagtacttg

SEQ ID NO: 127959 - DNA, 75 bp, Artificial Sequence
  Synthetic
ggcatctacctcctccccaaccgatgaaggttggggtaaacactccggcctcttaggccatttcctgtttttttt

SEQ ID NO: 127960 - DNA, 75 bp, Artificial Sequence
  Synthetic
gcctccccttgagggagagccgggggaccctgacctggactttgaaccagcgggatccgctcccccttctgaggg

SEQ ID NO: 127961 - DNA, 75 bp, Artificial Sequence
  Synthetic
ggtaacaccctcacttgctacatcaaggcccaagcagcctgtcgagccgcagggctccgggactgcaccatgctc

SEQ ID NO: 127962 - DNA, 75 bp, Artificial Sequence
  Synthetic
cctcggggtcaatgctgtagcgtactaccggggccttgatgtgtccgtcataccgacaagcggagacgtcgttgt

SEQ ID NO: 127963 - DNA, 75 bp, Artificial Sequence
  Synthetic
ttcttctgctttgcgtggtatctgaagggtaagtgggtgcccggagcggtctacgccttctacgggatgtggcct

SEQ ID NO: 127964 - DNA, 75 bp, Artificial Sequence
  Synthetic
aattcatctggtctctacacacttaccaacgactgcgccaacagcagcatcgtgtatgaggccgatgacgttatc

SEQ ID NO: 127965 - DNA, 75 bp, Artificial Sequence
  Synthetic
cggcgtagatctcgcaacctgggtaaggtcatcgataccctaacgtgcggattcgccgacctcatggggtacatt

SEQ ID NO: 127966 - DNA, 75 bp, Artificial Sequence
  Synthetic
cacgagcgtgtcctacatggtgaccaacgattgctccaacagtagcatcgtttggcagttgcaggatgctgttct

SEQ ID NO: 127967 - DNA, 75 bp, Artificial Sequence
  Synthetic
aactatgcaacagggaatcttcctggttgctccttttctatctttctcctcgctctcttctcctgcttgacttgc

SEQ ID NO: 127968 - DNA, 75 bp, Artificial Sequence
  Synthetic
acacgagggctacggacgcacatcgacgtcatcgtgatgtctgccacgctctgctctgccctctacatcggggac

SEQ ID NO: 127969 - DNA, 75 bp, Artificial Sequence
  Synthetic
tgcacttacccggatgtgtgccttgcatcaaaaccggcaaccagacatcgtgctggacaccagtgtcaccaacag

SEQ ID NO: 127970 - DNA, 75 bp, Artificial Sequence
  Synthetic
tcacaggacatcgtatggcatgggatatgatgatgaactggtcgccgactgccactatgattctggcatatctgc

SEQ ID NO: 127971 - DNA, 75 bp, Artificial Sequence
  Synthetic
gttggtcaacaccaatgggtcatggcacataaaccgcacagccctaaactgcgatgatgctttagagactggttt

SEQ ID NO: 127972 - DNA, 75 bp, Artificial Sequence
  Synthetic
cgcttgcggggccgtgttccttgtggggcaagcattcaccttcaggcctcgtcaacacacgtccgtacagacgtg

SEQ ID NO: 127973 - DNA, 75 bp, Artificial Sequence
  Synthetic
cattgtcatcctgctcctgaccgcgggggtggaggcccatacgcgcaccgttgcaggctcggtggcgcggactgc

SEQ ID NO: 127974 - DNA, 75 bp, Artificial Sequence
  Synthetic
ctacacacatagtttcaactcgtccgggtgcccagagcgcatggccagctgccgcaccattgacaagttcgacca

SEQ ID NO: 127975 - DNA, 75 bp, Artificial Sequence
  Synthetic
gggagatggctgcatcgtgcggaggcgcggtttttgtaggtctaatactcttgaccttgtcaccacactataaag

SEQ ID NO: 127976 - DNA, 75 bp, Artificial Sequence
  Synthetic
ctgcggttgccccaaaccttccttgacctggtcacaggggcccactggggcgtgatggcaggcctcgcttatttt

SEQ ID NO: 127977 - DNA, 75 bp, Artificial Sequence
  Synthetic
gaggcgcacttgcatgtgtggatcccccccctcaacgttcgggggggccgcgatgccatcattctcctcacgtgt

SEQ ID NO: 127978 - DNA, 75 bp, Artificial Sequence
  Synthetic
aatgacagtctgcaaactggcttcctcgcggccttgttctacgcgaacaaattcaattcttcagggtgccccgag

SEQ ID NO: 127979 - DNA, 75 bp, Artificial Sequence
  Synthetic
ctggcactacccccctaagccttgtgaaaccatcgcagcacagaacgtctgtggaccggtctactgttttacacc

SEQ ID NO: 127980 - DNA, 75 bp, Artificial Sequence
  Synthetic
cctacgggcttgcggggctgttcgcccggggcccgcaacagaacctgcaattggtgaattccaacgggtcgtggc

SEQ ID NO: 127981 - DNA, 75 bp, Artificial Sequence
  Synthetic
gctggcattacccacctaaaccgtgtggcatagtgcctgcacggtctgtctgtggccctgtgtactgtttcaccc

SEQ ID NO: 127982 - DNA, 75 bp, Artificial Sequence
  Synthetic
ggttgctccttttctatcttccttctcgcacttctctcgtgcttgacaacacctgcatctgcggtgcactacagg

SEQ ID NO: 127983 - DNA, 75 bp, Artificial Sequence
  Synthetic
tcgcatatccacatgcaagcccatcacagccttcaagcaggggtggggtccactgacagatgtcaacatttctgg

SEQ ID NO: 127984 - DNA, 75 bp, Artificial Sequence
  Synthetic
accacggggcgcttggttcgggtgtacgtggatgaatgccaccgggttcaccaagacctgcggcgcaccaccctg

SEQ ID NO: 127985 - DNA, 75 bp, Artificial Sequence
  Synthetic
cactgacagatgtcaacatttctggctccagtgaggacagaccatactgctggcactacccacccaggccctgcg

SEQ ID NO: 127986 - DNA, 75 bp, Artificial Sequence
  Synthetic
gtgtcaaaacagggaacgcgtccagctgctgggtggccctgacccccactgtagccgccccttatctcaacgcgc

SEQ ID NO: 127987 - DNA, 75 bp, Artificial Sequence
  Synthetic
ctttggtgagaatgagactgatgtgttcttgctgaactccttgaggcccccccaaggccggtggtttggatgtgt

SEQ ID NO: 127988 - DNA, 75 bp, Artificial Sequence
  Synthetic
ccctggttgacacctaagtgtttggttgactacccctacagactgtggcactacccgtgcacggttaattacacc

SEQ ID NO: 127989 - DNA, 75 bp, Artificial Sequence
  Synthetic
aggccaacttttctccttccggccacgcttgcattggactacccaagactgtaactgttccatctactctggcca

SEQ ID NO: 127990 - DNA, 75 bp, Artificial Sequence
  Synthetic
gtccggaatcgtgggttgggcgttaaagtgggagtttgtcgtcctcatattcctgctcttggcggatgcacgtgt

SEQ ID NO: 127991 - DNA, 75 bp, Artificial Sequence
  Synthetic
actgctggcattaccctccgaagccttgcggtatcgtctcggctaggacggtttgcgggccggtctactgtttca

SEQ ID NO: 127992 - DNA, 75 bp, Artificial Sequence
  Synthetic
tgtcctaccgattgttttagaaagcaccccgctgccacgtacactcgctgcgggtctggaccctggctcacgcca

SEQ ID NO: 127993 - DNA, 75 bp, Artificial Sequence
  Synthetic
ggagtcagctgagcccactgttgcacagcactacagagtgggctatcctaccctgcacattttcggatttaccgg

SEQ ID NO: 127994 - DNA, 75 bp, Artificial Sequence
  Synthetic
gatttactcgtagggggtcactggggggtcctagctggtatagccttcttcagcatgcaggctaactgggcaaag

SEQ ID NO: 127995 - DNA, 75 bp, Artificial Sequence
  Synthetic
tctacctctaccccaaccgatgaaggttgggataaacactccggccttctaggccttttcctttttttttttttg

SEQ ID NO: 127996 - DNA, 75 bp, Artificial Sequence
  Synthetic
ggctgtggcattatccttgcaccatgaacttcaccatattcaaagtcagaatgtttgtgggaggagtggagcacc

SEQ ID NO: 127997 - DNA, 75 bp, Artificial Sequence
  Synthetic
tctcactcggaccccggcaaaacctccaacttataaataccaatgggagttggcacatcaacaggaccgccctca

SEQ ID NO: 127998 - DNA, 75 bp, Artificial Sequence
  Synthetic
tctcactcggaccccggcataacctccaacttataaataccaatgggagttggcacatcaacaggaccgccctca

SEQ ID NO: 127999 - DNA, 75 bp, Artificial Sequence
  Synthetic
tctcactcggaccccggcacaacctccaacttataaataccaatgggagttggcacatcaacaggaccgccctca

SEQ ID NO: 128000 - DNA, 75 bp, Artificial Sequence
  Synthetic
tctcactcggaccccggcagaacctccaacttataaataccaatgggagttggcacatcaacaggaccgccctca

SEQ ID NO: 128001 - DNA, 75 bp, Artificial Sequence
  Synthetic
gtgggtagtcctcctatttttgctgctagcagacgccagggtctgcgcttgcctgtggatgctcctcttgctcgg

SEQ ID NO: 128002 - DNA, 75 bp, Artificial Sequence
  Synthetic
tggcacatcaacaggaccgccctcaattgtaatgagagcttgaacgcgggcatcatggccggtttgttctatgcg

SEQ ID NO: 128003 - DNA, 75 bp, Artificial Sequence
  Synthetic
tggcacatcaacaggaccgccctcaattgtaatgagagcttgaacgcgggcatcttggccggtttgttctatgcg

SEQ ID NO: 128004 - DNA, 75 bp, Artificial Sequence
  Synthetic
tggcacatcaacaggaccgccctcaattgtaatgagagcttgaacgcgggcatcctggccggtttgttctatgcg

SEQ ID NO: 128005 - DNA, 75 bp, Artificial Sequence
  Synthetic
tggcacatcaacaggaccgccctcaattgtaatgagagcttgaacgcgggcatcgtggccggtttgttctatgcg

SEQ ID NO: 128006 - DNA, 75 bp, Artificial Sequence
  Synthetic
tggcacatcaacaggaccgccctcaattgtaatgagagcttgaacgcgggcttcatggccggtttgttctatgcg

SEQ ID NO: 128007 - DNA, 75 bp, Artificial Sequence
  Synthetic
tggcacatcaacaggaccgccctcaattgtaatgagagcttgaacgcgggcttcttggccggtttgttctatgcg

SEQ ID NO: 128008 - DNA, 75 bp, Artificial Sequence
  Synthetic
tggcacatcaacaggaccgccctcaattgtaatgagagcttgaacgcgggcttcctggccggtttgttctatgcg

SEQ ID NO: 128009 - DNA, 75 bp, Artificial Sequence
  Synthetic
tggcacatcaacaggaccgccctcaattgtaatgagagcttgaacgcgggcttcgtggccggtttgttctatgcg

SEQ ID NO: 128010 - DNA, 75 bp, Artificial Sequence
  Synthetic
tggcacatcaacaggaccgccctcaattgtaatgagagcttgaacgcgggcctcatggccggtttgttctatgcg

SEQ ID NO: 128011 - DNA, 75 bp, Artificial Sequence
  Synthetic
tggcacatcaacaggaccgccctcaattgtaatgagagcttgaacgcgggcctcttggccggtttgttctatgcg

SEQ ID NO: 128012 - DNA, 75 bp, Artificial Sequence
  Synthetic
tggcacatcaacaggaccgccctcaattgtaatgagagcttgaacgcgggcctcctggccggtttgttctatgcg

SEQ ID NO: 128013 - DNA, 75 bp, Artificial Sequence
  Synthetic
tggcacatcaacaggaccgccctcaattgtaatgagagcttgaacgcgggcctcgtggccggtttgttctatgcg

SEQ ID NO: 128014 - DNA, 75 bp, Artificial Sequence
  Synthetic
tggcacatcaacaggaccgccctcaattgtaatgagagcttgaacgcgggcgtcatggccggtttgttctatgcg

SEQ ID NO: 128015 - DNA, 75 bp, Artificial Sequence
  Synthetic
tggcacatcaacaggaccgccctcaattgtaatgagagcttgaacgcgggcgtcttggccggtttgttctatgcg

SEQ ID NO: 128016 - DNA, 75 bp, Artificial Sequence
  Synthetic
tggcacatcaacaggaccgccctcaattgtaatgagagcttgaacgcgggcgtcctggccggtttgttctatgcg

SEQ ID NO: 128017 - DNA, 75 bp, Artificial Sequence
  Synthetic
tggcacatcaacaggaccgccctcaattgtaatgagagcttgaacgcgggcgtcgtggccggtttgttctatgcg

SEQ ID NO: 128018 - DNA, 75 bp, Artificial Sequence
  Synthetic
cgccatactaccatgctcatttacgcccatgcctgctctgtcaacagggctcatacacctccaccagaacattgt

SEQ ID NO: 128019 - DNA, 75 bp, Artificial Sequence
  Synthetic
ccggcccgtccgacgacaaaccctactgctggcactatccgccgcgcccatgcgggatcgtaccggcgtcaaccg

SEQ ID NO: 128020 - DNA, 75 bp, Artificial Sequence
  Synthetic
ccggcccgtccgacgacaaaccctactgctggcactatccgccgcgcccatgcgggttcgtaccggcgtcaaccg

SEQ ID NO: 128021 - DNA, 75 bp, Artificial Sequence
  Synthetic
ccggcccgtccgacgacaaaccctactgctggcactatccgccgcgcccatgcgggctcgtaccggcgtcaaccg

SEQ ID NO: 128022 - DNA, 75 bp, Artificial Sequence
  Synthetic
ccggcccgtccgacgacaaaccctactgctggcactatccgccgcgcccatgcggggtcgtaccggcgtcaaccg

SEQ ID NO: 128023 - DNA, 75 bp, Artificial Sequence
  Synthetic
gacaagttcgatcaggggtggggtcccatcacttacgctgagccgagcagctcggaccagaggccctactgttgg

SEQ ID NO: 128024 - DNA, 75 bp, Artificial Sequence
  Synthetic
tggtacatcaaaggccgggtggttccccttaccacttattctttactaggtgtatggccatttaccctgctgctc

SEQ ID NO: 128025 - DNA, 75 bp, Artificial Sequence
  Synthetic
tcaagtgggagttcgttgtcctcgtgttcctccttctagcggacgcacgcgtatgcgtagccctctggatgatgc

SEQ ID NO: 128026 - DNA, 75 bp, Artificial Sequence
  Synthetic
accatcttcaaggtacggatgtatgtggggggggtggagcaccggttgtctgcagcatgtaacttcacgcgtggg

SEQ ID NO: 128027 - DNA, 75 bp, Artificial Sequence
  Synthetic
ccctcgatacagctgagcagggccaggttggcctcgtgcttctggtggtcatttctgtcatcacgctcaccccgg

SEQ ID NO: 128028 - DNA, 75 bp, Artificial Sequence
  Synthetic
catctttttgttgaactcgacgaggccccccggcggaggatggttcgggtgcacgtggatgaacgccaccgggtt

SEQ ID NO: 128029 - DNA, 75 bp, Artificial Sequence
  Synthetic
cactgggaccccttactttgtgcgcgcccacgctttgattcgtctctgcatgttggtgcgctcggtggcgggggg

SEQ ID NO: 128030 - DNA, 75 bp, Artificial Sequence
  Synthetic
tccctccctgatatttgacatcaccaagttgctaattgccatcttagggccaatgtacttagtacaggctgccct

SEQ ID NO: 128031 - DNA, 75 bp, Artificial Sequence
  Synthetic
ctgcgctgcgtggcacatccgggggaagcttgttccgctgataacctatggtctgacaggcctgtggcccctggc

SEQ ID NO: 128032 - DNA, 75 bp, Artificial Sequence
  Synthetic
aggcggtcgcgacggcatcatatgggctgcaaccatgctttgcccaggcgtggtgttcgacgtaaccaaatggct

SEQ ID NO: 128033 - DNA, 75 bp, Artificial Sequence
  Synthetic
accaggtgtggatcaggtccatggctcacgcccagatgtatggtccactatccttatcggctgtggcactacccg

SEQ ID NO: 128034 - DNA, 75 bp, Artificial Sequence
  Synthetic
gatgccattctacactctccggggtgtgtcccttgcgttcgcgagggtaacgcctcgaagtgttgggtgccggtg

SEQ ID NO: 128035 - DNA, 75 bp, Artificial Sequence
  Synthetic
taaagtcatcacctggggtgccgacacagcagcctgcggggacatcctgtgcgggttgcctgtctcggcgcgcct

SEQ ID NO: 128036 - DNA, 75 bp, Artificial Sequence
  Synthetic
gttgcccatatgggcacgcccgagctacaacccaccactcctagagtcttggaaggacccggactacgtccctcc

SEQ ID NO: 128037 - DNA, 75 bp, Artificial Sequence
  Synthetic
atctacaccatcgagatcgcgcggagttatcgcccttgctcttgtccactacgcagtggcaggtgctcccctgct

SEQ ID NO: 128038 - DNA, 75 bp, Artificial Sequence
  Synthetic
tccagatggcactaatcgccatcggcaactggactggcacttacatctatgaccatctctccccgatgaccaact

SEQ ID NO: 128039 - DNA, 75 bp, Artificial Sequence
  Synthetic
tccctgtggccacgtactctgttctcggcttgtggtcctttctcctcttagtcttggccctaccacagcaggctt

SEQ ID NO: 128040 - DNA, 75 bp, Artificial Sequence
  Synthetic
ctaggaaccatagtcaccagcttgacaggcagagacaacaatatagtgactggtgaggtgcaggtactatccaca

SEQ ID NO: 128041 - DNA, 75 bp, Artificial Sequence
  Synthetic
tatccctctctgatctttgacatcacaaagctgctgatagctgtccttgggccgatgtacctaatacaagctgca

SEQ ID NO: 128042 - DNA, 75 bp, Artificial Sequence
  Synthetic
aacagacgcggggcctacttggttgcatcatcactagccttacaggccgggacaagaaccaggtcgagggagagg

SEQ ID NO: 128043 - DNA, 75 bp, Artificial Sequence
  Synthetic
gccgatgtacctaatacaagctgcactcaccaataccccctactttgtacgcgctcacgtattgattcgtatctg

SEQ ID NO: 128044 - DNA, 75 bp, Artificial Sequence
  Synthetic
ctgggccctcaagtgggagtatgttgtgcttgctttcctgctgctcgcagacgctagagtttgcgcgtgcctctg

SEQ ID NO: 128045 - DNA, 75 bp, Artificial Sequence
  Synthetic
gtacgtctccagggggtggagccttcttgcccccatcaccgcttatgctcagcagactcgtggcctgctgggtac

SEQ ID NO: 128046 - DNA, 75 bp, Artificial Sequence
  Synthetic
gcagggactaagtcccttgacccctgcacgtgcggctcttccgacttatacctggtgacacgtgaagctgatgtc

SEQ ID NO: 128047 - DNA, 75 bp, Artificial Sequence
  Synthetic
atgagggactgggctgccgcgggtctcgaagaactggcagtggccacagagcccgttatcttcagtcctatggag

SEQ ID NO: 128048 - DNA, 75 bp, Artificial Sequence
  Synthetic
atctttttctgctttgcatggtacatcaaaggcagatttccagcagcatgcacgtacgcgatctgcgggatgtgg

SEQ ID NO: 128049 - DNA, 75 bp, Artificial Sequence
  Synthetic
atctttttctgctttgcatggtacatcaaaggcagatttccagcagcatgcacgtacgcgttctgcgggatgtgg

SEQ ID NO: 128050 - DNA, 75 bp, Artificial Sequence
  Synthetic
atctttttctgctttgcatggtacatcaaaggcagatttccagcagcatgcacgtacgcgctctgcgggatgtgg

SEQ ID NO: 128051 - DNA, 75 bp, Artificial Sequence
  Synthetic
atctttttctgctttgcatggtacatcaaaggcagatttccagcagcatgcacgtacgcggtctgcgggatgtgg

SEQ ID NO: 128052 - DNA, 75 bp, Artificial Sequence
  Synthetic
ataccggcacgccgtagaggggactctaccgcgagcctgctcagtcccagacccatctcctgcctcaaaggctct

SEQ ID NO: 128053 - DNA, 75 bp, Artificial Sequence
  Synthetic
cagctgacagttacaagacgatggggtggcgcctattgtccccaatctcagcatacgcccaacagacccgaggac

SEQ ID NO: 128054 - DNA, 75 bp, Artificial Sequence
  Synthetic
ttgtcacactgtctccgcattacaagagctggcttgcccggataatatggtggctacagtactttttagccaggg

SEQ ID NO: 128055 - DNA, 75 bp, Artificial Sequence
  Synthetic
tgctcggaaccattgttaccagcttgacaggtagggataaaaatgtggtgaccggtgaggtgcaggtgctgtcca

SEQ ID NO: 128056 - DNA, 75 bp, Artificial Sequence
  Synthetic
tacaatattttatcaccagagccgaggcgcatttacaagtgtggatcccccctctcaacgttcgggggggccgcg

SEQ ID NO: 128057 - DNA, 75 bp, Artificial Sequence
  Synthetic
tgagatcactaagcacttcatagccatcctggggccactttacatcttgcgagcctcactcctgaacatccccta

SEQ ID NO: 128058 - DNA, 75 bp, Artificial Sequence
  Synthetic
tgtgctccaggggggtggcgaagtctatcgactttatccccgtcgaggcgctcgacgtcgtcgctaggtccccca

SEQ ID NO: 128059 - DNA, 75 bp, Artificial Sequence
  Synthetic
caggacctggtgggttggccagcgcctgcgggaacgaagtctctcgacccttgcacgtgcgggtcctccgacctg

SEQ ID NO: 128060 - DNA, 75 bp, Artificial Sequence
  Synthetic
gcgtcgcaagagctcttgcgcatggcgtaagggcccttgaagacgggataaacttcgcaacagggaacttgcccg

SEQ ID NO: 128061 - DNA, 75 bp, Artificial Sequence
  Synthetic
actggtacctatgtatacaatcacctcaccccattatctgactgggccgccgacggcctcaaagatctggctgtg

SEQ ID NO: 128062 - DNA, 75 bp, Artificial Sequence
  Synthetic
ggcatacgccgcccaggggtacaaggtgctagtgctgaacccctccgtggccgccaccttgggatttggggctta

SEQ ID NO: 128063 - DNA, 75 bp, Artificial Sequence
  Synthetic
ggcctacgagaccttgcggtggcagtagagcccgtcgtcttctctgacatggagaccaagatcatcacctggggg

SEQ ID NO: 128064 - DNA, 75 bp, Artificial Sequence
  Synthetic
agtagaaactctgagcacgcaggtcaggtctccgactttcagtgacaattccaccccccccgctgtaccagagtc

SEQ ID NO: 128065 - DNA, 75 bp, Artificial Sequence
  Synthetic
cggccaggttgggtaatgaggtgttgctcggccctgctgacgtagagggcgcgaaggggtggagactcctcgctc

SEQ ID NO: 128066 - DNA, 75 bp, Artificial Sequence
  Synthetic
gactaagtctttagacccctgtacctgcggggccgtggacctctacttggtcacccgaaacgctgatgtcattcc

SEQ ID NO: 128067 - DNA, 75 bp, Artificial Sequence
  Synthetic
cacctagtgttttgccattcaaagaaaaagtgtgatgagctagcctccaagctcagggctatggggctaaacgca

SEQ ID NO: 128068 - DNA, 75 bp, Artificial Sequence
  Synthetic
ccatcagtagcggctaccctgggcttcggcatgtacatgtcgaaggcctatgggattgatcccaacattcgcacg

SEQ ID NO: 128069 - DNA, 75 bp, Artificial Sequence
  Synthetic
gctatccacagccacacaatctttccttggtactgcggtgaacggagtcctatggactgtgtaccacggagccgg

SEQ ID NO: 128070 - DNA, 75 bp, Artificial Sequence
  Synthetic
ccacccggctccgtggccactccacacccgaatatagaggaagtggctctcggccacgagggggagatccccttc

SEQ ID NO: 128071 - DNA, 75 bp, Artificial Sequence
  Synthetic
agacacgcactgccccccaggacgcggtgtcccgcagtcaacgcaggggccgcacgggccgcggtaggcagggta

SEQ ID NO: 128072 - DNA, 75 bp, Artificial Sequence
  Synthetic
ttgacaccatgcacctgcggcgcctcggacctatttctggtgaccaggcgcgccgatgtaatccctgtcagaagg

SEQ ID NO: 128073 - DNA, 75 bp, Artificial Sequence
  Synthetic
gcatgggtctcaacgcagtggcatactacagagggctagacgtctccgtgatcccaacccaaggagatgtggtgg

SEQ ID NO: 128074 - DNA, 75 bp, Artificial Sequence
  Synthetic
gcgaccatctggtatgttcgacacagtcgtactttgtgagtgctatgacgcgggctgcgcctggtatggcttaac

SEQ ID NO: 128075 - DNA, 75 bp, Artificial Sequence
  Synthetic
aacagcgaccccccccggcagtatcaccgtaccgcaccccaacatagaggaagtggccctcgccagcgacggaga

SEQ ID NO: 128076 - DNA, 75 bp, Artificial Sequence
  Synthetic
ttgtcgctaccgacgccctcatgacggggtacactggtgacttcgactctgtggtcgattgcaatgtagcagtca

SEQ ID NO: 128077 - DNA, 75 bp, Artificial Sequence
  Synthetic
ggatattccgtgctgcggtgtgtacccggggtgtggctaaagcattggacttcgtgccagtggagtctcttgaga

SEQ ID NO: 128078 - DNA, 75 bp, Artificial Sequence
  Synthetic
ggggttgcgaaggcggtggacttcatacccgttgagtccatggaaactaccatgcggtccccggtcttcacggac

SEQ ID NO: 128079 - DNA, 75 bp, Artificial Sequence
  Synthetic
cacctactccacttatggcaagtttctcgcagacggaggctgctcagcaggcgcctatgacgtcattatatgcga

SEQ ID NO: 128080 - DNA, 75 bp, Artificial Sequence
  Synthetic
gcgcctatgacgtcattatatgcgatgaatgccattccgtggactccactaccatcctcggcattgggacggtcc

SEQ ID NO: 128081 - DNA, 75 bp, Artificial Sequence
  Synthetic
cagggggcgcatgggtatatacaggtatgtctcttccggtgagaggccctcaggaatgtttgactccgtagtgct

SEQ ID NO: 128082 - DNA, 75 bp, Artificial Sequence
  Synthetic
gagcactaaagtgccctcagcatatgctgctcagggctacaaagtgctcgtgctcaacccttcggtcgcagcgac

SEQ ID NO: 128083 - DNA, 75 bp, Artificial Sequence
  Synthetic
ggggggcgcgacgccgtcatcctactcatgtgtgttgtacacccggccttggtatttgacatcaccaagctgctg

SEQ ID NO: 128084 - DNA, 75 bp, Artificial Sequence
  Synthetic
gcttgacagatgctaacatcactggtccttctgaggatagaccgtactgctggcactacgcacctagaccttgtg

SEQ ID NO: 128085 - DNA, 75 bp, Artificial Sequence
  Synthetic
ttagtctagaccccaccttctccattgagacacgcacgattccccaggacgctgtgtcccgtagtcaacgcaggg

SEQ ID NO: 128086 - DNA, 75 bp, Artificial Sequence
  Synthetic
tgtcaagatcatctggagttctgggaggctgtctttaccggtcttacacacattgatgcccacttcctctctcag

SEQ ID NO: 128087 - DNA, 75 bp, Artificial Sequence
  Synthetic
tctcctcctgtgcctccgcctcggaagaagcggacggtggtcctcaccgaatcaaccgtatctactgccttggcc

SEQ ID NO: 128088 - DNA, 75 bp, Artificial Sequence
  Synthetic
acctatgggaagttcctggcagacggaggctgcgcaggaggggcatatgacatcatcatctgtgacgaatgccac

SEQ ID NO: 128089 - DNA, 75 bp, Artificial Sequence
  Synthetic
aggtgcttgtggacatcctggcgggttatggagcaggggtggcaggcgcgctcgtggcctttaaggtcatgagcg

SEQ ID NO: 128090 - DNA, 75 bp, Artificial Sequence
  Synthetic
agaagcggacggtggtcctcaccgaatcaaccgtatctactgccttggccgagcttgccaccaaaagctttggca

SEQ ID NO: 128091 - DNA, 75 bp, Artificial Sequence
  Synthetic
cgcaggctgttcctggtacgacctacagcctgctgagaccacagtacgactgagagcatacctgtccaccccagg

SEQ ID NO: 128092 - DNA, 75 bp, Artificial Sequence
  Synthetic
gacttctgggagagcgtgttcaccggactgactcatatagatgcccacttcttgtcacagacaaaacagcagggc

SEQ ID NO: 128093 - DNA, 75 bp, Artificial Sequence
  Synthetic
tcatagcccaacagttcaaggacaaggttctcggcttgctacagcgggctaaccaacaacaagctgacatccagc

SEQ ID NO: 128094 - DNA, 75 bp, Artificial Sequence
  Synthetic
gatcagtgaccacacctcactccaacatcgaggagatcgccttgtccacgacgggggaagtacccttctacggga

SEQ ID NO: 128095 - DNA, 75 bp, Artificial Sequence
  Synthetic
aaccaacaacaagctgacatccagcccctgataacatccaagtggcaaaagctggaagttttctggcacaaacat

SEQ ID NO: 128096 - DNA, 75 bp, Artificial Sequence
  Synthetic
atcaagccactgtttgtgctcgtgcacaggcgagcccaccatcttgggatgagatgtggaaatgtctcatacgcc

SEQ ID NO: 128097 - DNA, 75 bp, Artificial Sequence
  Synthetic
tctcaacgcggtggcttactacagaggcttggaagtcgcagtgataccaactgaaggggacgtggtggtttgcgc

SEQ ID NO: 128098 - DNA, 75 bp, Artificial Sequence
  Synthetic
tctcaacgcggtggcttactacagaggcttggatgtcgcagtgataccaactgaaggggacgtggtggtttgcgc

SEQ ID NO: 128099 - DNA, 75 bp, Artificial Sequence
  Synthetic
tctcaacgcggtggcttactacagaggcttggacgtcgcagtgataccaactgaaggggacgtggtggtttgcgc

SEQ ID NO: 128100 - DNA, 75 bp, Artificial Sequence
  Synthetic
tctcaacgcggtggcttactacagaggcttggaggtcgcagtgataccaactgaaggggacgtggtggtttgcgc

SEQ ID NO: 128101 - DNA, 75 bp, Artificial Sequence
  Synthetic
tgtcgaggaggggcatcgaatagttgagatgctaaagtccaagatccaaggcctattacaacaggcctcgaggca

SEQ ID NO: 128102 - DNA, 75 bp, Artificial Sequence
  Synthetic
ttgcatgtcagccgacctggaagtcacaacaagcgcctgggtactggtcggtggtgtcctagcagccctcacagc

SEQ ID NO: 128103 - DNA, 75 bp, Artificial Sequence
  Synthetic
ttttctatagagactacaactgtgccccaggatgcagtgtctcggagccagcgcaggggtcgcactggcagggga

SEQ ID NO: 128104 - DNA, 75 bp, Artificial Sequence
  Synthetic
ttttctatagagactacaactgtgccccaggatgctgtgtctcggagccagcgcaggggtcgcactggcagggga

SEQ ID NO: 128105 - DNA, 75 bp, Artificial Sequence
  Synthetic
ttttctatagagactacaactgtgccccaggatgccgtgtctcggagccagcgcaggggtcgcactggcagggga

SEQ ID NO: 128106 - DNA, 75 bp, Artificial Sequence
  Synthetic
ttttctatagagactacaactgtgccccaggatgcggtgtctcggagccagcgcaggggtcgcactggcagggga

SEQ ID NO: 128107 - DNA, 75 bp, Artificial Sequence
  Synthetic
aggttgggaatctatcggtatgtcaccccaggagaacggccatccggtatgtttgactcctctgtgctctgtgag

SEQ ID NO: 128108 - DNA, 75 bp, Artificial Sequence
  Synthetic
ggccattgctcaacagttcaaggacaaggtcctcggcttgttgcaaagggcgagccagcaagaggccgacatccg

SEQ ID NO: 128109 - DNA, 75 bp, Artificial Sequence
  Synthetic
accatctcgagttctgggaaagcgtctttacggggttaacccatatagacgcccacttcctctctcagacgaagc

SEQ ID NO: 128110 - DNA, 75 bp, Artificial Sequence
  Synthetic
ctgccgggtaaccccgctgtggcttccctcatggcctttaccgcctctgtaaccagccccctcacaaccaaccaa

SEQ ID NO: 128111 - DNA, 75 bp, Artificial Sequence
  Synthetic
gatcatgtcaggcgagaaaccctccgtagaggatgtcgtcaatttgttacctggtatcctttctcccggtgccct

SEQ ID NO: 128112 - DNA, 75 bp, Artificial Sequence
  Synthetic
tatccgcctcaaacccaccttacatggccccacccccctcctttacaggttgggggctgtgcaaaatgaaatcac

SEQ ID NO: 128113 - DNA, 75 bp, Artificial Sequence
  Synthetic
gggaaccacgtcgccccgacccactatgtggcggagtcggacgcgtcgcagcgagtcactcagatgttgagctct

SEQ ID NO: 128114 - DNA, 75 bp, Artificial Sequence
  Synthetic
ggagctggagtctccggcgccctagtggcctttaaaatcatgggaggggagctccctaccacagaggatgtgatt

SEQ ID NO: 128115 - DNA, 75 bp, Artificial Sequence
  Synthetic
ctagctgcttactgcctatcgatgggtagtgtggtggtgaccgggagggtcatactatcaggccagcctgccatc

SEQ ID NO: 128116 - DNA, 75 bp, Artificial Sequence
  Synthetic
ctagctgcttactgcctatcgttgggtagtgtggtggtgaccgggagggtcatactatcaggccagcctgccatc

SEQ ID NO: 128117 - DNA, 75 bp, Artificial Sequence
  Synthetic
ctagctgcttactgcctatcgctgggtagtgtggtggtgaccgggagggtcatactatcaggccagcctgccatc

SEQ ID NO: 128118 - DNA, 75 bp, Artificial Sequence
  Synthetic
ctagctgcttactgcctatcggtgggtagtgtggtggtgaccgggagggtcatactatcaggccagcctgccatc

SEQ ID NO: 128119 - DNA, 75 bp, Artificial Sequence
  Synthetic
cactctgcctgggaaccccgcaatagcatcactgatggcattcacagcctctatcaccagcccgctcaccaccca

SEQ ID NO: 128120 - DNA, 75 bp, Artificial Sequence
  Synthetic
tttccaccatcctaactgactttaagaattggctgtcgtccaaattgttccccaaaatgccgggtatcccctttg

SEQ ID NO: 128121 - DNA, 75 bp, Artificial Sequence
  Synthetic
tcaaacagaaggctcttggcgctctgcaattcgctggtaaacaggcagaagttgccgcaccagttgttcaatcca

SEQ ID NO: 128122 - DNA, 75 bp, Artificial Sequence
  Synthetic
ggctggaagttgcttgcaactggacgcggggcgagcgttgtgatctggacgacagggacaggtccgagctcagcc

SEQ ID NO: 128123 - DNA, 75 bp, Artificial Sequence
  Synthetic
tggtggtggggacgaccgacaggtcgggcgcgcctacctacaactggggtgagaatgacacggacgttttcgtcc

SEQ ID NO: 128124 - DNA, 75 bp, Artificial Sequence
  Synthetic
ttgcttcgccgattacatcagtggatcaacgaggactatccaagtccttgtaacggtgactggttacatgacatt

SEQ ID NO: 128125 - DNA, 75 bp, Artificial Sequence
  Synthetic
tcgctatgcccctccatgcagacctctgctgcgagatgagatctccttttccgtcgggctgcattcctatgcaat

SEQ ID NO: 128126 - DNA, 75 bp, Artificial Sequence
  Synthetic
tgttctacacacacaggtttaactcgtccggatgtccggagcgcttagccagctgccgctccattgacacgttcg

SEQ ID NO: 128127 - DNA, 75 bp, Artificial Sequence
  Synthetic
catagcctccctgatgtccttcactgccgccgtcacaagccctctctccacacagcagaccctcctatttaacat

SEQ ID NO: 128128 - DNA, 75 bp, Artificial Sequence
  Synthetic
aggagtgggcaacaagaccttgtactgtcccacagattgtttccgcaaacatccggacgccacatactctcgatg

SEQ ID NO: 128129 - DNA, 75 bp, Artificial Sequence
  Synthetic
ggtacaagggggtatggcgaggggatggagtgataacaacacgctgcccttgcggaaaggagataacaggacaca

SEQ ID NO: 128130 - DNA, 75 bp, Artificial Sequence
  Synthetic
tatgtgacagggttgacaaccgacaaccttaaggttccctgccaactaccagctcctgagtttttctcctgggtg

SEQ ID NO: 128131 - DNA, 75 bp, Artificial Sequence
  Synthetic
gggaggattctggttgacattctcgctggctacggcgccggcgtggctggcgccgtggtcactttcaagatcatg

SEQ ID NO: 128132 - DNA, 75 bp, Artificial Sequence
  Synthetic
agggtcagccctctgcgccaacgtgtggtacggcacctttcccatcaatgaatacaccaccgggccaggcacgcc

SEQ ID NO: 128133 - DNA, 75 bp, Artificial Sequence
  Synthetic
agcttccttgtgaacctgagcctgacacggaggtgctggcatccatgctgacggacccgtcccacatcacggcag

SEQ ID NO: 128134 - DNA, 75 bp, Artificial Sequence
  Synthetic
ggcaggagatgggcgggaacatcacccgcgtggagtcggagaacaaggtggtagtcctggactctttcgacccgc

SEQ ID NO: 128135 - DNA, 75 bp, Artificial Sequence
  Synthetic
acgaatgatggtctaaagatcccatgtcaggtgccggcgccagagttcttcaccgagttggacggggtgaggctc

SEQ ID NO: 128136 - DNA, 75 bp, Artificial Sequence
  Synthetic
ggctgtgcagtggatgaaccgcctcattgctttcgcatcgcgaggcaatcatgtgtcccccacgcactacgtccc

SEQ ID NO: 128137 - DNA, 75 bp, Artificial Sequence
  Synthetic
acacggcagaggccccgacattgacatggtggatgccaaccttttcatgggaggcgacgtgacccgggtggagtc

SEQ ID NO: 128138 - DNA, 75 bp, Artificial Sequence
  Synthetic
caacgctaaagtgctcatcctagactcccttgacccaatggtcgaggaggaggacgagcgcgagccttcggtgcc

SEQ ID NO: 128139 - DNA, 75 bp, Artificial Sequence
  Synthetic
accccgtgtgacacgagctggttgcgagacatctgggactgggtctgcactgtcctggctgactttaagatctgg

SEQ ID NO: 128140 - DNA, 75 bp, Artificial Sequence
  Synthetic
accccgtgtgacacgagctggttgcgagacatctgggactgggtctgcactgtcctggctgactttaagttctgg

SEQ ID NO: 128141 - DNA, 75 bp, Artificial Sequence
  Synthetic
accccgtgtgacacgagctggttgcgagacatctgggactgggtctgcactgtcctggctgactttaagctctgg

SEQ ID NO: 128142 - DNA, 75 bp, Artificial Sequence
  Synthetic
accccgtgtgacacgagctggttgcgagacatctgggactgggtctgcactgtcctggctgactttaaggtctgg

SEQ ID NO: 128143 - DNA, 75 bp, Artificial Sequence
  Synthetic
ccgagccagacgtcgaagtgttgacctcgatgttgcgagaccctgctcacatcacagctgaaacggcggcccgac

SEQ ID NO: 128144 - DNA, 75 bp, Artificial Sequence
  Synthetic
gacagttcagcttgatgggtcgaacgtatctgcagcgcttcgagcgctcgcagagaaatccttcccgtcatctgg

SEQ ID NO: 128145 - DNA, 75 bp, Artificial Sequence
  Synthetic
ccacttcctatctcagacaaagcagagtggggagaactttccttacctggtagcgtaccaagccaccgtgtgcgc

SEQ ID NO: 128146 - DNA, 75 bp, Artificial Sequence
  Synthetic
ggaagctagctcctcagccagccagctctcagctgcgtcgttgaaggccacttgtcacacgcataggctacatcc

SEQ ID NO: 128147 - DNA, 75 bp, Artificial Sequence
  Synthetic
ggtgcacctgcggcgcagagctggccggtcacatcaaaaacggttcgatgaggatcgttgggcctaagacttgca

SEQ ID NO: 128148 - DNA, 75 bp, Artificial Sequence
  Synthetic
ttcgagcccctgagggctgaggaagacgatactgagctctcggtaccggcggagtgtttcaagaaaccacccaag

SEQ ID NO: 128149 - DNA, 75 bp, Artificial Sequence
  Synthetic
gctccgtgggggaagctcttaaggagttggccataaaaagctttggccagccaccccccagtgacgactccggtc

SEQ ID NO: 128150 - DNA, 75 bp, Artificial Sequence
  Synthetic
gtccactcagcaattctttgctgagacaccacaatctagtatattcaacgtcatctcgaagcgctgctctacgcc

SEQ ID NO: 128151 - DNA, 75 bp, Artificial Sequence
  Synthetic
ccagaccagactacaaccctccattgctccctccatggaaggacccaacctacgaaccacccgtggtccacgggt

SEQ ID NO: 128152 - DNA, 75 bp, Artificial Sequence
  Synthetic
cgccgaggaatacgtggaagtgaggagggtaggtgactctcattacgtcgttggcgtaacgcaagacaacatcaa

SEQ ID NO: 128153 - DNA, 75 bp, Artificial Sequence
  Synthetic
gggggagcctggagatcctgacctggagcatgagacggtagagcgccaacccccccctcaggagggggaagcagc

SEQ ID NO: 128154 - DNA, 75 bp, Artificial Sequence
  Synthetic
gagcatgagacggtagagcgccaacccccccctcaggagggggaagcagctcccggctcggactccggttcttgg

SEQ ID NO: 128155 - DNA, 75 bp, Artificial Sequence
  Synthetic
ctggtccctccccactctgcccgttcaaaatacgggtatagtgcaaaagatgttcgctccttagccagcaaggcc

SEQ ID NO: 128156 - DNA, 75 bp, Artificial Sequence
  Synthetic
gtaagctacagcgtagggcttaacaccttcgtagtggggtctcaactcccctgcgagcctgaaccagacgtgcaa

SEQ ID NO: 128157 - DNA, 75 bp, Artificial Sequence
  Synthetic
ggcggaaaaatccttcccgtcgacgaaaccggaggggacgggcacatcctcctcaggagccggtacggagtccac

SEQ ID NO: 128158 - DNA, 75 bp, Artificial Sequence
  Synthetic
tgcctatcaatcccttgagtaattcgctattgcgattccacaacaaggtgtattgcacaacatctaaaagcgcct

SEQ ID NO: 128159 - DNA, 75 bp, Artificial Sequence
  Synthetic
cccctccaataccacctccacggaggaaaaggacggttgtcctgacagaatccactgtgtcttctgccttggcgg

SEQ ID NO: 128160 - DNA, 75 bp, Artificial Sequence
  Synthetic
cgagccaattatctgctccatcactcaaagccacctgcaccgcccaccatgcctcccctgacgctgacctcattg

SEQ ID NO: 128161 - DNA, 75 bp, Artificial Sequence
  Synthetic
tccactgtgtcttctgccttggcggagctcgccacaaagaccttcggcagctccgaatcgtcggccgtcgacagc

SEQ ID NO: 128162 - DNA, 75 bp, Artificial Sequence
  Synthetic
aggacaatgtagagggggtcctcagggagatggcggacaatgtgctcagccctctccaagattgcaatgactccg

SEQ ID NO: 128163 - DNA, 75 bp, Artificial Sequence
  Synthetic
aagggctcatccgtgcgtgtatgctggtgcggaaagttgccgggggccattacatccaaatggccttcgtgaaac

SEQ ID NO: 128164 - DNA, 75 bp, Artificial Sequence
  Synthetic
tgagccagaagacggcgagatttctgtcccggcagagattctccgtcgctcaaagaaattccctccggccatgcc

SEQ ID NO: 128165 - DNA, 75 bp, Artificial Sequence
  Synthetic
ggctcctgtcaccccgtggctctcggcctagttggggccccacagacccccggcgtaggtcgcgtaatttgggta

SEQ ID NO: 128166 - DNA, 75 bp, Artificial Sequence
  Synthetic
gggttttcgtatgacactcgatgcttcgactccactgtcactgaacaggatatcagggtggaagaggaaatttac

SEQ ID NO: 128167 - DNA, 75 bp, Artificial Sequence
  Synthetic
ctgcaagtgctcgatgaccattacaagaatgtacttaaggaggtgaaggagcgagcgtcaggggtgaagggccgc

SEQ ID NO: 128168 - DNA, 75 bp, Artificial Sequence
  Synthetic
gaaggcggcccgactcatcgtataccccgacctcggcgtcagggtctgcgagaaagtcgccctttatgatatcac

SEQ ID NO: 128169 - DNA, 75 bp, Artificial Sequence
  Synthetic
aagccgactcccgtccctccacctaggaggaagcgggtagtcgtgctggatgagtcaaacgtctctcaggcgttg

SEQ ID NO: 128170 - DNA, 75 bp, Artificial Sequence
  Synthetic
ccatgaaccagatccgctccgtctgggaggacttgctggaagacaatactaccccaatctccaccaccattatgg

SEQ ID NO: 128171 - DNA, 75 bp, Artificial Sequence
  Synthetic
gaccccatgggtttttcatatgacacccgctgtttcgactctacagtgacggagagggacatcagaaccgaggag

SEQ ID NO: 128172 - DNA, 75 bp, Artificial Sequence
  Synthetic
tcgaggacgacaagtctgaagatgggtctttctcatcaatgcctcccttggagggggagccgggcgatcctgact

SEQ ID NO: 128173 - DNA, 75 bp, Artificial Sequence
  Synthetic
tcgaggacgacatgtctgaagatgggtctttctcatcaatgcctcccttggagggggagccgggcgatcctgact

SEQ ID NO: 128174 - DNA, 75 bp, Artificial Sequence
  Synthetic
tcgaggacgacacgtctgaagatgggtctttctcatcaatgcctcccttggagggggagccgggcgatcctgact

SEQ ID NO: 128175 - DNA, 75 bp, Artificial Sequence
  Synthetic
tcgaggacgacaggtctgaagatgggtctttctcatcaatgcctcccttggagggggagccgggcgatcctgact

SEQ ID NO: 128176 - DNA, 75 bp, Artificial Sequence
  Synthetic
agaagagccgaaactaccgatcagtccactgagcaactccttgttgcgccaccacaacatggtgtactccacgac

SEQ ID NO: 128177 - DNA, 75 bp, Artificial Sequence
  Synthetic
ctttgactctactgtcaccgaacatgacatcaggatggaggaggagatataccaatgctgtgaccttgaaccaga

SEQ ID NO: 128178 - DNA, 75 bp, Artificial Sequence
  Synthetic
cccctcgcccgtgcggcctgggagactgctcgccacactccggtaaactcctggttggggaacattatcatgtac

SEQ ID NO: 128179 - DNA, 75 bp, Artificial Sequence
  Synthetic
aagaaggtcaccttcgatcgtcttcaagtgcttgacgaccactaccagactgttctaaaggaggttaaagctcgg

SEQ ID NO: 128180 - DNA, 75 bp, Artificial Sequence
  Synthetic
tcgtcatctcagagagtcagggggctgaggaggacgagcggaacctgagagtcttcacggaggctatgaccaggt

SEQ ID NO: 128181 - DNA, 75 bp, Artificial Sequence
  Synthetic
gtgcggctatcgccgctgccgcgctagcggcgtcttgcctaccagctttggcaatacaataacctgttacatcaa

SEQ ID NO: 128182 - DNA, 75 bp, Artificial Sequence
  Synthetic
aagtttggctatggggcaaaagatgtccgagccctatcccgcaaggccgttaaccacatcaactccgtgtgggag

SEQ ID NO: 128183 - DNA, 75 bp, Artificial Sequence
  Synthetic
tccgagccctatcccgcaaggccgttaaccacatcaactccgtgtgggaggacttgctggaggactctgtgacac

SEQ ID NO: 128184 - DNA, 75 bp, Artificial Sequence
  Synthetic
cggcctcatccacctccaccagaacatcgtggacgtgcaatatttgtacggggtggggtcaagcattgtgtcctg

SEQ ID NO: 128185 - DNA, 75 bp, Artificial Sequence
  Synthetic
gacagatcagctctgcgagccttcacggaggctatgaccaggtattctgcccctcccggggacgctccacagccc

SEQ ID NO: 128186 - DNA, 75 bp, Artificial Sequence
  Synthetic
ggtacgggtatgcgagaagcgggcactctacaacattgtccagggactcccccaggtcataatgggggattccta

SEQ ID NO: 128187 - DNA, 75 bp, Artificial Sequence
  Synthetic
ctcccttggcccgtgcggcttgggagactgctcgccacactccagtcaactcctggttggggaatatcatcatgt

SEQ ID NO: 128188 - DNA, 75 bp, Artificial Sequence
  Synthetic
cgtgcccggtcccgccatttgctgctttgcctactcctactcaccgtgggggtaggcatctttttactaccggcc

SEQ ID NO: 128189 - DNA, 75 bp, Artificial Sequence
  Synthetic
cttttcttatgacacccgctgctttgactcaacagtgactgaaagagacattcaagttgaggaagaaatctacca

SEQ ID NO: 128190 - DNA, 75 bp, Artificial Sequence
  Synthetic
gctctcagaaagcttggagcgccgcccttgagggcatggaagagtcgggctcgtgcagtgagggcatccctcatc

SEQ ID NO: 128191 - DNA, 75 bp, Artificial Sequence
  Synthetic
gggtaccggcggtgccgcgcaagcggcgtgttcaccaccagcttcgggaacacactgacgtgctacatcaaagcc

SEQ ID NO: 128192 - DNA, 75 bp, Artificial Sequence
  Synthetic
cacgtaggtcctggggagggggcggtgcagtggatgaacaggctcatcgcgttcgcatcccggggcaaccacgtc

SEQ ID NO: 128193 - DNA, 75 bp, Artificial Sequence
  Synthetic
gaggaagggccagaatatgtggcctatacctctttaactgggcagtgcgcaccaaaaccagactcactccattgc

SEQ ID NO: 128194 - DNA, 75 bp, Artificial Sequence
  Synthetic
gccaggccctccgagctttcacggaagctatgacgaggtactcggccccccccggcgacgccccacaaccaacgt

SEQ ID NO: 128195 - DNA, 75 bp, Artificial Sequence
  Synthetic
gacgggacggggaaacgggtgtactacctcacccgtgaccccgagatccctctggcgcgagctgcttgggaaact

SEQ ID NO: 128196 - DNA, 75 bp, Artificial Sequence
  Synthetic
cctaaacctcaaagaaaaaccaaaagaaacaccaaccgtcgcccacaggacgtcaagttcccgggcggcggtcag

SEQ ID NO: 128197 - DNA, 75 bp, Artificial Sequence
  Synthetic
gtagagccagtcgtcttttcccagatggagaccaagctcattacgtggggggcggacaccgccgcatgcggtgac

SEQ ID NO: 128198 - DNA, 75 bp, Artificial Sequence
  Synthetic
gcgcgtctgtgcctgcttgtggatgatgctgctgatagctcaggccgaggccgccttagagaacctggtggtcct

SEQ ID NO: 128199 - DNA, 75 bp, Artificial Sequence
  Synthetic
cggtcccagcccagaggtagacgccagcccataccaaaggcgcgtcaccaaacgggccgtacctgggctcaaccc

SEQ ID NO: 128200 - DNA, 75 bp, Artificial Sequence
  Synthetic
gggcaggctggtccctggggcggcatatgctctctatggcgtatggccgctgctcctgctcctgctggcgttacc

SEQ ID NO: 128201 - DNA, 75 bp, Artificial Sequence
  Synthetic
gcttggggcgcctccattgagggcgtggagacatcgggccaggttggtacgcgccaagctcatcgctcagggggg

SEQ ID NO: 128202 - DNA, 75 bp, Artificial Sequence
  Synthetic
catcgcagcagcgctggctcatggagtcagggttgtagaggacgggatcaattatgcaaccgggaatcttcctgg

SEQ ID NO: 128203 - DNA, 75 bp, Artificial Sequence
  Synthetic
tggtttacggtgggcgccggcgggggggacatttatcacagcgtgtcccaggcccgaccccgctacttactcctg

SEQ ID NO: 128204 - DNA, 75 bp, Artificial Sequence
  Synthetic
aacgactgctctaatagcagtatcgtgtatgaagcaccaactgtcatcatgcaccttcctgggtgcgtcccctgt

SEQ ID NO: 128205 - DNA, 75 bp, Artificial Sequence
  Synthetic
gcctaattggggccccaacgacccccggcgaaggtcacgcaacttgggtaaggtcatcgataccctcacgtgtgg

SEQ ID NO: 128206 - DNA, 75 bp, Artificial Sequence
  Synthetic
ttttttttttttttttttttttcattttttttttttaaatcttcttcctttttccttttctttttcctatctttg

SEQ ID NO: 128207 - DNA, 75 bp, Artificial Sequence
  Synthetic
ttttttttttttttttttttttctttttttttttttaaatcttcttcctttttccttttctttttcctatctttg

SEQ ID NO: 128208 - DNA, 75 bp, Artificial Sequence
  Synthetic
ttttttttttttttttttttttccttttttttttttaaatcttcttcctttttccttttctttttcctatctttg

SEQ ID NO: 128209 - DNA, 75 bp, Artificial Sequence
  Synthetic
ttttttttttttttttttttttcgttttttttttttaaatcttcttcctttttccttttctttttcctatctttg

SEQ ID NO: 128210 - DNA, 75 bp, Artificial Sequence
  Synthetic
acctcatggtaggcgctgccgtcttctgttcggctatgtatgtgggtgatatatgcggtggactgttcctaattg

SEQ ID NO: 128211 - DNA, 75 bp, Artificial Sequence
  Synthetic
tatcgtacccgcgtcgcaggtgtgtggtccagtgtattgcttcaccccaagccccgttgtggtggggacgaccga

SEQ ID NO: 128212 - DNA, 75 bp, Artificial Sequence
  Synthetic
ctcccgggatgcgttccgtgtgtgaggaaagggaaccagtctacatgctgggtggctctaacccccactgtggct

SEQ ID NO: 128213 - DNA, 75 bp, Artificial Sequence
  Synthetic
tatgatgatgaactggtctccgaccgtgactctcgtcgtgtcctacgccttgcgtgttccccagttgatcatcga

SEQ ID NO: 128214 - DNA, 75 bp, Artificial Sequence
  Synthetic
tccgccctctacgtcggagacttgtgtgggggtgtgttcttggtcggtcaactgttcaccttccaacatcgccgc

SEQ ID NO: 128215 - DNA, 75 bp, Artificial Sequence
  Synthetic
cgtcaaggtggggaacgggtcacgttgttggctccctgtctcgcctaccttagccgtccccaactcatcagtgcc

SEQ ID NO: 128216 - DNA, 75 bp, Artificial Sequence
  Synthetic
ggccctgcccatttgggcacggccggactacaaccccccgttgctggagacgtggaaaaagccggactacgaacc

SEQ ID NO: 128217 - DNA, 75 bp, Artificial Sequence
  Synthetic
tgttggctccctgtctcgcctaccttagccgtccccaactcatcagtgccaatccacgggtttcgccgacacgta

SEQ ID NO: 128218 - DNA, 75 bp, Artificial Sequence
  Synthetic
gcatggtagccaactgggccaaggtaattggcatcctccttttgttcgcgggggtggacgcgaccacgtactcca

SEQ ID NO: 128219 - DNA, 75 bp, Artificial Sequence
  Synthetic
cgctggtcctcgcccaactcatgaggatcccaaccgccatggtcgacctgcttgcaggcggccattggggtatcc

SEQ ID NO: 128220 - DNA, 75 bp, Artificial Sequence
  Synthetic
cttgcaggcggccattggggtatcctggttggcattgcgtacttcagcatgcaggctaactgggccaaggtcatc

SEQ ID NO: 128221 - DNA, 75 bp, Artificial Sequence
  Synthetic
agcaccatcagatcacacaggattgtaactgctctatatatgctggccacgtctcgggacacaggatggcatggg

SEQ ID NO: 128222 - DNA, 75 bp, Artificial Sequence
  Synthetic
agcaccatcagatcacacaggattgtaactgctctatatatgctggccacgtctcgggacacaggatggcttggg

SEQ ID NO: 128223 - DNA, 75 bp, Artificial Sequence
  Synthetic
agcaccatcagatcacacaggattgtaactgctctatatatgctggccacgtctcgggacacaggatggcctggg

SEQ ID NO: 128224 - DNA, 75 bp, Artificial Sequence
  Synthetic
agcaccatcagatcacacaggattgtaactgctctatatatgctggccacgtctcgggacacaggatggcgtggg

SEQ ID NO: 128225 - DNA, 75 bp, Artificial Sequence
  Synthetic
agcaccatcagatcactcaggattgtaactgctctatatatgctggccacgtctcgggacacaggatggcatggg

SEQ ID NO: 128226 - DNA, 75 bp, Artificial Sequence
  Synthetic
agcaccatcagatcactcaggattgtaactgctctatatatgctggccacgtctcgggacacaggatggcttggg

SEQ ID NO: 128227 - DNA, 75 bp, Artificial Sequence
  Synthetic
agcaccatcagatcactcaggattgtaactgctctatatatgctggccacgtctcgggacacaggatggcctggg

SEQ ID NO: 128228 - DNA, 75 bp, Artificial Sequence
  Synthetic
agcaccatcagatcactcaggattgtaactgctctatatatgctggccacgtctcgggacacaggatggcgtggg

SEQ ID NO: 128229 - DNA, 75 bp, Artificial Sequence
  Synthetic
agcaccatcagatcacccaggattgtaactgctctatatatgctggccacgtctcgggacacaggatggcatggg

SEQ ID NO: 128230 - DNA, 75 bp, Artificial Sequence
  Synthetic
agcaccatcagatcacccaggattgtaactgctctatatatgctggccacgtctcgggacacaggatggcttggg

SEQ ID NO: 128231 - DNA, 75 bp, Artificial Sequence
  Synthetic
agcaccatcagatcacccaggattgtaactgctctatatatgctggccacgtctcgggacacaggatggcctggg

SEQ ID NO: 128232 - DNA, 75 bp, Artificial Sequence
  Synthetic
agcaccatcagatcacccaggattgtaactgctctatatatgctggccacgtctcgggacacaggatggcgtggg

SEQ ID NO: 128233 - DNA, 75 bp, Artificial Sequence
  Synthetic
agcaccatcagatcacgcaggattgtaactgctctatatatgctggccacgtctcgggacacaggatggcatggg

SEQ ID NO: 128234 - DNA, 75 bp, Artificial Sequence
  Synthetic
agcaccatcagatcacgcaggattgtaactgctctatatatgctggccacgtctcgggacacaggatggcttggg

SEQ ID NO: 128235 - DNA, 75 bp, Artificial Sequence
  Synthetic
agcaccatcagatcacgcaggattgtaactgctctatatatgctggccacgtctcgggacacaggatggcctggg

SEQ ID NO: 128236 - DNA, 75 bp, Artificial Sequence
  Synthetic
agcaccatcagatcacgcaggattgtaactgctctatatatgctggccacgtctcgggacacaggatggcgtggg

SEQ ID NO: 128237 - DNA, 75 bp, Artificial Sequence
  Synthetic
cattaacaggacggctcttaactgcaatgacactttgcagactggattcatagctgccctgttttatgtgcacca

SEQ ID NO: 128238 - DNA, 75 bp, Artificial Sequence
  Synthetic
gttccaagcaaaacatacagctcatcaacaccaatgggagctggcacatcaacagaactgccctcaactgtaacg

SEQ ID NO: 128239 - DNA, 75 bp, Artificial Sequence
  Synthetic
cgttttgggggcgctactgtattacagaatggtggcgaactgggcgaaggtattcgcggtccttctactttttgc

SEQ ID NO: 128240 - DNA, 75 bp, Artificial Sequence
  Synthetic
cgttttgggggcgctactgtattacagaatggtggcgaactgggcgaaggtattcgcggtccttcttctttttgc

SEQ ID NO: 128241 - DNA, 75 bp, Artificial Sequence
  Synthetic
cgttttgggggcgctactgtattacagaatggtggcgaactgggcgaaggtattcgcggtccttctcctttttgc

SEQ ID NO: 128242 - DNA, 75 bp, Artificial Sequence
  Synthetic
cgttttgggggcgctactgtattacagaatggtggcgaactgggcgaaggtattcgcggtccttctgctttttgc

SEQ ID NO: 128243 - DNA, 75 bp, Artificial Sequence
  Synthetic
cgttttgggggcgctactgtattacagaatggtggcgaactgggcgaaggttttcgcggtccttctactttttgc

SEQ ID NO: 128244 - DNA, 75 bp, Artificial Sequence
  Synthetic
cgttttgggggcgctactgtattacagaatggtggcgaactgggcgaaggttttcgcggtccttcttctttttgc

SEQ ID NO: 128245 - DNA, 75 bp, Artificial Sequence
  Synthetic
cgttttgggggcgctactgtattacagaatggtggcgaactgggcgaaggttttcgcggtccttctcctttttgc

SEQ ID NO: 128246 - DNA, 75 bp, Artificial Sequence
  Synthetic
cgttttgggggcgctactgtattacagaatggtggcgaactgggcgaaggttttcgcggtccttctgctttttgc

SEQ ID NO: 128247 - DNA, 75 bp, Artificial Sequence
  Synthetic
cgttttgggggcgctactgtattacagaatggtggcgaactgggcgaaggtcttcgcggtccttctactttttgc

SEQ ID NO: 128248 - DNA, 75 bp, Artificial Sequence
  Synthetic
cgttttgggggcgctactgtattacagaatggtggcgaactgggcgaaggtcttcgcggtccttcttctttttgc

SEQ ID NO: 128249 - DNA, 75 bp, Artificial Sequence
  Synthetic
cgttttgggggcgctactgtattacagaatggtggcgaactgggcgaaggtcttcgcggtccttctcctttttgc

SEQ ID NO: 128250 - DNA, 75 bp, Artificial Sequence
  Synthetic
cgttttgggggcgctactgtattacagaatggtggcgaactgggcgaaggtcttcgcggtccttctgctttttgc

SEQ ID NO: 128251 - DNA, 75 bp, Artificial Sequence
  Synthetic
cgttttgggggcgctactgtattacagaatggtggcgaactgggcgaaggtgttcgcggtccttctactttttgc

SEQ ID NO: 128252 - DNA, 75 bp, Artificial Sequence
  Synthetic
cgttttgggggcgctactgtattacagaatggtggcgaactgggcgaaggtgttcgcggtccttcttctttttgc

SEQ ID NO: 128253 - DNA, 75 bp, Artificial Sequence
  Synthetic
cgttttgggggcgctactgtattacagaatggtggcgaactgggcgaaggtgttcgcggtccttctcctttttgc

SEQ ID NO: 128254 - DNA, 75 bp, Artificial Sequence
  Synthetic
cgttttgggggcgctactgtattacagaatggtggcgaactgggcgaaggtgttcgcggtccttctgctttttgc

SEQ ID NO: 128255 - DNA, 75 bp, Artificial Sequence
  Synthetic
cgttttgggggcgctactgtattacagtatggtggcgaactgggcgaaggtattcgcggtccttctactttttgc

SEQ ID NO: 128256 - DNA, 75 bp, Artificial Sequence
  Synthetic
cgttttgggggcgctactgtattacagtatggtggcgaactgggcgaaggtattcgcggtccttcttctttttgc

SEQ ID NO: 128257 - DNA, 75 bp, Artificial Sequence
  Synthetic
cgttttgggggcgctactgtattacagtatggtggcgaactgggcgaaggtattcgcggtccttctcctttttgc

SEQ ID NO: 128258 - DNA, 75 bp, Artificial Sequence
  Synthetic
cgttttgggggcgctactgtattacagtatggtggcgaactgggcgaaggtattcgcggtccttctgctttttgc

SEQ ID NO: 128259 - DNA, 75 bp, Artificial Sequence
  Synthetic
cgttttgggggcgctactgtattacagtatggtggcgaactgggcgaaggttttcgcggtccttctactttttgc

SEQ ID NO: 128260 - DNA, 75 bp, Artificial Sequence
  Synthetic
cgttttgggggcgctactgtattacagtatggtggcgaactgggcgaaggttttcgcggtccttcttctttttgc

SEQ ID NO: 128261 - DNA, 75 bp, Artificial Sequence
  Synthetic
cgttttgggggcgctactgtattacagtatggtggcgaactgggcgaaggttttcgcggtccttctcctttttgc

SEQ ID NO: 128262 - DNA, 75 bp, Artificial Sequence
  Synthetic
cgttttgggggcgctactgtattacagtatggtggcgaactgggcgaaggttttcgcggtccttctgctttttgc

SEQ ID NO: 128263 - DNA, 75 bp, Artificial Sequence
  Synthetic
cgttttgggggcgctactgtattacagtatggtggcgaactgggcgaaggtcttcgcggtccttctactttttgc

SEQ ID NO: 128264 - DNA, 75 bp, Artificial Sequence
  Synthetic
cgttttgggggcgctactgtattacagtatggtggcgaactgggcgaaggtcttcgcggtccttcttctttttgc

SEQ ID NO: 128265 - DNA, 75 bp, Artificial Sequence
  Synthetic
cgttttgggggcgctactgtattacagtatggtggcgaactgggcgaaggtcttcgcggtccttctcctttttgc

SEQ ID NO: 128266 - DNA, 75 bp, Artificial Sequence
  Synthetic
cgttttgggggcgctactgtattacagtatggtggcgaactgggcgaaggtcttcgcggtccttctgctttttgc

SEQ ID NO: 128267 - DNA, 75 bp, Artificial Sequence
  Synthetic
cgttttgggggcgctactgtattacagtatggtggcgaactgggcgaaggtgttcgcggtccttctactttttgc

SEQ ID NO: 128268 - DNA, 75 bp, Artificial Sequence
  Synthetic
cgttttgggggcgctactgtattacagtatggtggcgaactgggcgaaggtgttcgcggtccttcttctttttgc

SEQ ID NO: 128269 - DNA, 75 bp, Artificial Sequence
  Synthetic
cgttttgggggcgctactgtattacagtatggtggcgaactgggcgaaggtgttcgcggtccttctcctttttgc

SEQ ID NO: 128270 - DNA, 75 bp, Artificial Sequence
  Synthetic
cgttttgggggcgctactgtattacagtatggtggcgaactgggcgaaggtgttcgcggtccttctgctttttgc

SEQ ID NO: 128271 - DNA, 75 bp, Artificial Sequence
  Synthetic
cgttttgggggcgctactgtattacagcatggtggcgaactgggcgaaggtattcgcggtccttctactttttgc

SEQ ID NO: 128272 - DNA, 75 bp, Artificial Sequence
  Synthetic
cgttttgggggcgctactgtattacagcatggtggcgaactgggcgaaggtattcgcggtccttcttctttttgc

SEQ ID NO: 128273 - DNA, 75 bp, Artificial Sequence
  Synthetic
cgttttgggggcgctactgtattacagcatggtggcgaactgggcgaaggtattcgcggtccttctcctttttgc

SEQ ID NO: 128274 - DNA, 75 bp, Artificial Sequence
  Synthetic
cgttttgggggcgctactgtattacagcatggtggcgaactgggcgaaggtattcgcggtccttctgctttttgc

SEQ ID NO: 128275 - DNA, 75 bp, Artificial Sequence
  Synthetic
cgttttgggggcgctactgtattacagcatggtggcgaactgggcgaaggttttcgcggtccttctactttttgc

SEQ ID NO: 128276 - DNA, 75 bp, Artificial Sequence
  Synthetic
cgttttgggggcgctactgtattacagcatggtggcgaactgggcgaaggttttcgcggtccttcttctttttgc

SEQ ID NO: 128277 - DNA, 75 bp, Artificial Sequence
  Synthetic
cgttttgggggcgctactgtattacagcatggtggcgaactgggcgaaggttttcgcggtccttctcctttttgc

SEQ ID NO: 128278 - DNA, 75 bp, Artificial Sequence
  Synthetic
cgttttgggggcgctactgtattacagcatggtggcgaactgggcgaaggttttcgcggtccttctgctttttgc

SEQ ID NO: 128279 - DNA, 75 bp, Artificial Sequence
  Synthetic
cgttttgggggcgctactgtattacagcatggtggcgaactgggcgaaggtcttcgcggtccttctactttttgc

SEQ ID NO: 128280 - DNA, 75 bp, Artificial Sequence
  Synthetic
cgttttgggggcgctactgtattacagcatggtggcgaactgggcgaaggtcttcgcggtccttcttctttttgc

SEQ ID NO: 128281 - DNA, 75 bp, Artificial Sequence
  Synthetic
cgttttgggggcgctactgtattacagcatggtggcgaactgggcgaaggtcttcgcggtccttctcctttttgc

SEQ ID NO: 128282 - DNA, 75 bp, Artificial Sequence
  Synthetic
cgttttgggggcgctactgtattacagcatggtggcgaactgggcgaaggtcttcgcggtccttctgctttttgc

SEQ ID NO: 128283 - DNA, 75 bp, Artificial Sequence
  Synthetic
cgttttgggggcgctactgtattacagcatggtggcgaactgggcgaaggtgttcgcggtccttctactttttgc

SEQ ID NO: 128284 - DNA, 75 bp, Artificial Sequence
  Synthetic
cgttttgggggcgctactgtattacagcatggtggcgaactgggcgaaggtgttcgcggtccttcttctttttgc

SEQ ID NO: 128285 - DNA, 75 bp, Artificial Sequence
  Synthetic
cgttttgggggcgctactgtattacagcatggtggcgaactgggcgaaggtgttcgcggtccttctcctttttgc

SEQ ID NO: 128286 - DNA, 75 bp, Artificial Sequence
  Synthetic
cgttttgggggcgctactgtattacagcatggtggcgaactgggcgaaggtgttcgcggtccttctgctttttgc

SEQ ID NO: 128287 - DNA, 75 bp, Artificial Sequence
  Synthetic
cgttttgggggcgctactgtattacaggatggtggcgaactgggcgaaggtattcgcggtccttctactttttgc

SEQ ID NO: 128288 - DNA, 75 bp, Artificial Sequence
  Synthetic
cgttttgggggcgctactgtattacaggatggtggcgaactgggcgaaggtattcgcggtccttcttctttttgc

SEQ ID NO: 128289 - DNA, 75 bp, Artificial Sequence
  Synthetic
cgttttgggggcgctactgtattacaggatggtggcgaactgggcgaaggtattcgcggtccttctcctttttgc

SEQ ID NO: 128290 - DNA, 75 bp, Artificial Sequence
  Synthetic
cgttttgggggcgctactgtattacaggatggtggcgaactgggcgaaggtattcgcggtccttctgctttttgc

SEQ ID NO: 128291 - DNA, 75 bp, Artificial Sequence
  Synthetic
cgttttgggggcgctactgtattacaggatggtggcgaactgggcgaaggttttcgcggtccttctactttttgc

SEQ ID NO: 128292 - DNA, 75 bp, Artificial Sequence
  Synthetic
cgttttgggggcgctactgtattacaggatggtggcgaactgggcgaaggttttcgcggtccttcttctttttgc

SEQ ID NO: 128293 - DNA, 75 bp, Artificial Sequence
  Synthetic
cgttttgggggcgctactgtattacaggatggtggcgaactgggcgaaggttttcgcggtccttctcctttttgc

SEQ ID NO: 128294 - DNA, 75 bp, Artificial Sequence
  Synthetic
cgttttgggggcgctactgtattacaggatggtggcgaactgggcgaaggttttcgcggtccttctgctttttgc

SEQ ID NO: 128295 - DNA, 75 bp, Artificial Sequence
  Synthetic
cgttttgggggcgctactgtattacaggatggtggcgaactgggcgaaggtcttcgcggtccttctactttttgc

SEQ ID NO: 128296 - DNA, 75 bp, Artificial Sequence
  Synthetic
cgttttgggggcgctactgtattacaggatggtggcgaactgggcgaaggtcttcgcggtccttcttctttttgc

SEQ ID NO: 128297 - DNA, 75 bp, Artificial Sequence
  Synthetic
cgttttgggggcgctactgtattacaggatggtggcgaactgggcgaaggtcttcgcggtccttctcctttttgc

SEQ ID NO: 128298 - DNA, 75 bp, Artificial Sequence
  Synthetic
cgttttgggggcgctactgtattacaggatggtggcgaactgggcgaaggtcttcgcggtccttctgctttttgc

SEQ ID NO: 128299 - DNA, 75 bp, Artificial Sequence
  Synthetic
cgttttgggggcgctactgtattacaggatggtggcgaactgggcgaaggtgttcgcggtccttctactttttgc

SEQ ID NO: 128300 - DNA, 75 bp, Artificial Sequence
  Synthetic
cgttttgggggcgctactgtattacaggatggtggcgaactgggcgaaggtgttcgcggtccttcttctttttgc

SEQ ID NO: 128301 - DNA, 75 bp, Artificial Sequence
  Synthetic
cgttttgggggcgctactgtattacaggatggtggcgaactgggcgaaggtgttcgcggtccttctcctttttgc

SEQ ID NO: 128302 - DNA, 75 bp, Artificial Sequence
  Synthetic
cgttttgggggcgctactgtattacaggatggtggcgaactgggcgaaggtgttcgcggtccttctgctttttgc

SEQ ID NO: 128303 - DNA, 75 bp, Artificial Sequence
  Synthetic
acagtcgccaccagggacggcaaactccccacgacacagcttcgacgtcacatcgatctgctcgtcgggagcgcc

SEQ ID NO: 128304 - DNA, 75 bp, Artificial Sequence
  Synthetic
tagctgccctgttttatgtgcaccatttcaactctacaggatgcccagagcggatgtcgtcatgcaagcccctca

SEQ ID NO: 128305 - DNA, 75 bp, Artificial Sequence
  Synthetic
ggcagtacagctgctcggcaaatcagcgggtttgctggcctcttcagcgccggttccaagcagaatctgcagctt

SEQ ID NO: 128306 - DNA, 75 bp, Artificial Sequence
  Synthetic
ggcagtactgctgctcggcaaatcagcgggtttgctggcctcttcagcgccggttccaagcagaatctgcagctt

SEQ ID NO: 128307 - DNA, 75 bp, Artificial Sequence
  Synthetic
ggcagtaccgctgctcggcaaatcagcgggtttgctggcctcttcagcgccggttccaagcagaatctgcagctt

SEQ ID NO: 128308 - DNA, 75 bp, Artificial Sequence
  Synthetic
ggcagtacggctgctcggcaaatcagcgggtttgctggcctcttcagcgccggttccaagcagaatctgcagctt

SEQ ID NO: 128309 - DNA, 75 bp, Artificial Sequence
  Synthetic
ggcagttcagctgctcggcaaatcagcgggtttgctggcctcttcagcgccggttccaagcagaatctgcagctt

SEQ ID NO: 128310 - DNA, 75 bp, Artificial Sequence
  Synthetic
ggcagttctgctgctcggcaaatcagcgggtttgctggcctcttcagcgccggttccaagcagaatctgcagctt

SEQ ID NO: 128311 - DNA, 75 bp, Artificial Sequence
  Synthetic
ggcagttccgctgctcggcaaatcagcgggtttgctggcctcttcagcgccggttccaagcagaatctgcagctt

SEQ ID NO: 128312 - DNA, 75 bp, Artificial Sequence
  Synthetic
ggcagttcggctgctcggcaaatcagcgggtttgctggcctcttcagcgccggttccaagcagaatctgcagctt

SEQ ID NO: 128313 - DNA, 75 bp, Artificial Sequence
  Synthetic
ggcagtccagctgctcggcaaatcagcgggtttgctggcctcttcagcgccggttccaagcagaatctgcagctt

SEQ ID NO: 128314 - DNA, 75 bp, Artificial Sequence
  Synthetic
ggcagtcctgctgctcggcaaatcagcgggtttgctggcctcttcagcgccggttccaagcagaatctgcagctt

SEQ ID NO: 128315 - DNA, 75 bp, Artificial Sequence
  Synthetic
ggcagtcccgctgctcggcaaatcagcgggtttgctggcctcttcagcgccggttccaagcagaatctgcagctt

SEQ ID NO: 128316 - DNA, 75 bp, Artificial Sequence
  Synthetic
ggcagtccggctgctcggcaaatcagcgggtttgctggcctcttcagcgccggttccaagcagaatctgcagctt

SEQ ID NO: 128317 - DNA, 75 bp, Artificial Sequence
  Synthetic
ggcagtgcagctgctcggcaaatcagcgggtttgctggcctcttcagcgccggttccaagcagaatctgcagctt

SEQ ID NO: 128318 - DNA, 75 bp, Artificial Sequence
  Synthetic
ggcagtgctgctgctcggcaaatcagcgggtttgctggcctcttcagcgccggttccaagcagaatctgcagctt

SEQ ID NO: 128319 - DNA, 75 bp, Artificial Sequence
  Synthetic
ggcagtgccgctgctcggcaaatcagcgggtttgctggcctcttcagcgccggttccaagcagaatctgcagctt

SEQ ID NO: 128320 - DNA, 75 bp, Artificial Sequence
  Synthetic
ggcagtgcggctgctcggcaaatcagcgggtttgctggcctcttcagcgccggttccaagcagaatctgcagctt

SEQ ID NO: 128321 - DNA, 75 bp, Artificial Sequence
  Synthetic
aacagctccgggtgtccggagaggcttgccggctgcagcagccttgacagcctcccacagggttggggccctctt

SEQ ID NO: 128322 - DNA, 75 bp, Artificial Sequence
  Synthetic
aattgtgccagcctcgcaggtatgtggtcccgtctactgctttacaccaagccccgtggtcatagggactacgga

SEQ ID NO: 128323 - DNA, 75 bp, Artificial Sequence
  Synthetic
tcaattccacggggtgcccggagcggatgagcaaatgtagaccattgcactcattcgaccagggctggggtccta

SEQ ID NO: 128324 - DNA, 75 bp, Artificial Sequence
  Synthetic
tcaattccacggggtgcccggagcggatgagcaaatgtagaccattgcactctttcgaccagggctggggtccta

SEQ ID NO: 128325 - DNA, 75 bp, Artificial Sequence
  Synthetic
tcaattccacggggtgcccggagcggatgagcaaatgtagaccattgcactccttcgaccagggctggggtccta

SEQ ID NO: 128326 - DNA, 75 bp, Artificial Sequence
  Synthetic
tcaattccacggggtgcccggagcggatgagcaaatgtagaccattgcactcgttcgaccagggctggggtccta

SEQ ID NO: 128327 - DNA, 75 bp, Artificial Sequence
  Synthetic
tatattgttttacacccagccctgtggtggtcgggacaaccgaccgccttggggttccaacatacacgtggggcg

SEQ ID NO: 128328 - DNA, 75 bp, Artificial Sequence
  Synthetic
tagcggcggttggtttggatgcacctggatgaattccaccggattcgtcaagacgtgcggtgctcctccatgcaa

SEQ ID NO: 128329 - DNA, 75 bp, Artificial Sequence
  Synthetic
gatgagcaaatgtagaccattgcactcattcgaccagggctggggtcctatttcgtatgctaacatctctggtcc

SEQ ID NO: 128330 - DNA, 75 bp, Artificial Sequence
  Synthetic
gatgagcaaatgtagaccattgcactctttcgaccagggctggggtcctatttcgtatgctaacatctctggtcc

SEQ ID NO: 128331 - DNA, 75 bp, Artificial Sequence
  Synthetic
gatgagcaaatgtagaccattgcactccttcgaccagggctggggtcctatttcgtatgctaacatctctggtcc

SEQ ID NO: 128332 - DNA, 75 bp, Artificial Sequence
  Synthetic
gatgagcaaatgtagaccattgcactcgttcgaccagggctggggtcctatttcgtatgctaacatctctggtcc

SEQ ID NO: 128333 - DNA, 75 bp, Artificial Sequence
  Synthetic
gaacacaaccaggcctccccgaggcgcttggtttggttgcacgtggatgaacagcacagggttcacaaaatcctg

SEQ ID NO: 128334 - DNA, 75 bp, Artificial Sequence
  Synthetic
tggatcactccacgatgtctcgttgattacccctacagactgtggcattacccctgtacggtgaactataccatt

SEQ ID NO: 128335 - DNA, 75 bp, Artificial Sequence
  Synthetic
gagagatccccttctatggcaaagccatccccatcgagaccatcaaggggggaaggcatctcattttctgccatt

SEQ ID NO: 128336 - DNA, 75 bp, Artificial Sequence
  Synthetic
cagatgttttctttccggccacgacgccactggactacccaggagtgcaattgttccatctacacagggcacatc

SEQ ID NO: 128337 - DNA, 75 bp, Artificial Sequence
  Synthetic
actatgcaacagggaatcttcccggttgctctttttctatcttcatcttggcacttctttcgtgcctcaccaccc

SEQ ID NO: 128338 - DNA, 75 bp, Artificial Sequence
  Synthetic
ctgcaactggactcgtggggacccctgtaacctggaagatcgtggcagggttgagatgagcccgctcttgttctc

SEQ ID NO: 128339 - DNA, 75 bp, Artificial Sequence
  Synthetic
gctctccgacccctctcacattacagcggagacggccaggcgtaggctagccagagggtctcccccctctttggc

SEQ ID NO: 128340 - DNA, 75 bp, Artificial Sequence
  Synthetic
tgctcattcaccacaatgccagcactctctacaggcctgatacacttgcaccagaacatagtggacgtccagtac

SEQ ID NO: 128341 - DNA, 75 bp, Artificial Sequence
  Synthetic
tctcgtgggagtggcctatttcagcatgcaagccaattgggccaaagtcatcttggtcctattcctctttgcagg

SEQ ID NO: 128342 - DNA, 75 bp, Artificial Sequence
  Synthetic
acatcttccggggtgcgtcccgtgtgtcaaaacgggtaacgcgtcgcagtgctggcttcctgtttcaccgacgtt

SEQ ID NO: 128343 - DNA, 75 bp, Artificial Sequence
  Synthetic
catcgctggtcatcagatgggagtatgtggtgcttgccttcttgttgttggctgacgcgcgtatttgtgcctgcc

SEQ ID NO: 128344 - DNA, 75 bp, Artificial Sequence
  Synthetic
ccactccgaacagaggaggacgagagggaagtgtccgttccggcggagatcctgcggaagaccaggaagttcccc

SEQ ID NO: 128345 - DNA, 75 bp, Artificial Sequence
  Synthetic
ctttgaggcggtgttttccttgtggggcaagtattcacctttagacctaggttccacgaaaccgtacaggagtgt

SEQ ID NO: 128346 - DNA, 75 bp, Artificial Sequence
  Synthetic
ctttgaggcggtgttttccttgtggggcaagttttcacctttagacctaggttccacgaaaccgtacaggagtgt

SEQ ID NO: 128347 - DNA, 75 bp, Artificial Sequence
  Synthetic
ctttgaggcggtgttttccttgtggggcaagtcttcacctttagacctaggttccacgaaaccgtacaggagtgt

SEQ ID NO: 128348 - DNA, 75 bp, Artificial Sequence
  Synthetic
ctttgaggcggtgttttccttgtggggcaagtgttcacctttagacctaggttccacgaaaccgtacaggagtgt

SEQ ID NO: 128349 - DNA, 75 bp, Artificial Sequence
  Synthetic
ctttgtggcggtgttttccttgtggggcaagtattcacctttagacctaggttccacgaaaccgtacaggagtgt

SEQ ID NO: 128350 - DNA, 75 bp, Artificial Sequence
  Synthetic
ctttgtggcggtgttttccttgtggggcaagttttcacctttagacctaggttccacgaaaccgtacaggagtgt

SEQ ID NO: 128351 - DNA, 75 bp, Artificial Sequence
  Synthetic
ctttgtggcggtgttttccttgtggggcaagtcttcacctttagacctaggttccacgaaaccgtacaggagtgt

SEQ ID NO: 128352 - DNA, 75 bp, Artificial Sequence
  Synthetic
ctttgtggcggtgttttccttgtggggcaagtgttcacctttagacctaggttccacgaaaccgtacaggagtgt

SEQ ID NO: 128353 - DNA, 75 bp, Artificial Sequence
  Synthetic
ctttgcggcggtgttttccttgtggggcaagtattcacctttagacctaggttccacgaaaccgtacaggagtgt

SEQ ID NO: 128354 - DNA, 75 bp, Artificial Sequence
  Synthetic
ctttgcggcggtgttttccttgtggggcaagttttcacctttagacctaggttccacgaaaccgtacaggagtgt

SEQ ID NO: 128355 - DNA, 75 bp, Artificial Sequence
  Synthetic
ctttgcggcggtgttttccttgtggggcaagtcttcacctttagacctaggttccacgaaaccgtacaggagtgt

SEQ ID NO: 128356 - DNA, 75 bp, Artificial Sequence
  Synthetic
ctttgcggcggtgttttccttgtggggcaagtgttcacctttagacctaggttccacgaaaccgtacaggagtgt

SEQ ID NO: 128357 - DNA, 75 bp, Artificial Sequence
  Synthetic
ctttggggcggtgttttccttgtggggcaagtattcacctttagacctaggttccacgaaaccgtacaggagtgt

SEQ ID NO: 128358 - DNA, 75 bp, Artificial Sequence
  Synthetic
ctttggggcggtgttttccttgtggggcaagttttcacctttagacctaggttccacgaaaccgtacaggagtgt

SEQ ID NO: 128359 - DNA, 75 bp, Artificial Sequence
  Synthetic
ctttggggcggtgttttccttgtggggcaagtcttcacctttagacctaggttccacgaaaccgtacaggagtgt

SEQ ID NO: 128360 - DNA, 75 bp, Artificial Sequence
  Synthetic
ctttggggcggtgttttccttgtggggcaagtgttcacctttagacctaggttccacgaaaccgtacaggagtgt

SEQ ID NO: 128361 - DNA, 75 bp, Artificial Sequence
  Synthetic
tctcgtcttcctgtgctgtgcttggtatgtcaagggtcgcttagttcccgctgctacttacgggcttctgcagtt

SEQ ID NO: 128362 - DNA, 75 bp, Artificial Sequence
  Synthetic
ctgcatgcttgtggatgatgctgatggtttcgcaggtcgaagcagcgctcgccaacttggttaccatcaatgctg

SEQ ID NO: 128363 - DNA, 75 bp, Artificial Sequence
  Synthetic
tcaacagctcagggtgtcccgaacgactcgcacgctgcagaagccttgatacattcgaccaaggctggggcccac

SEQ ID NO: 128364 - DNA, 75 bp, Artificial Sequence
  Synthetic
actcgcacgctgcagaagccttgatacattcgaccaaggctggggcccacttggggtcgctaacatcagcgggcc

SEQ ID NO: 128365 - DNA, 75 bp, Artificial Sequence
  Synthetic
gcgctgccccaacgggcgtttgcctacgaccaggagcaggcagcatccatcggtgctgcagtgatagtggccatc

SEQ ID NO: 128366 - DNA, 75 bp, Artificial Sequence
  Synthetic
tgaggataccgcaattgctcctcgagatcttcctgggagcacattggggcgttcttggagccgtggtatactact

SEQ ID NO: 128367 - DNA, 75 bp, Artificial Sequence
  Synthetic
taatctccatctgctgcgcttggcatatacggggccgagctgtccccgtgaccacctacgcgttgctgcagcttt

SEQ ID NO: 128368 - DNA, 75 bp, Artificial Sequence
  Synthetic
gggtgccgtatttgagggtccggggaggtcgtgatgctgtcatcttgctcacatgcttgttccatccctccctcg

SEQ ID NO: 128369 - DNA, 75 bp, Artificial Sequence
  Synthetic
ctccatactacaaacagtggctagctcgaggtatttggtggctgcaatacttcattgccagagccgaggctgtca

SEQ ID NO: 128370 - DNA, 75 bp, Artificial Sequence
  Synthetic
gaggagccttgacagtctcttttccccaggggcacagcagaacctgcagctcatcaattccaacggtagctggca

SEQ ID NO: 128371 - DNA, 75 bp, Artificial Sequence
  Synthetic
gaggagccttgtcagtctcttttccccaggggcacagcagaacctgcagctcatcaattccaacggtagctggca

SEQ ID NO: 128372 - DNA, 75 bp, Artificial Sequence
  Synthetic
gaggagccttgccagtctcttttccccaggggcacagcagaacctgcagctcatcaattccaacggtagctggca

SEQ ID NO: 128373 - DNA, 75 bp, Artificial Sequence
  Synthetic
gaggagccttggcagtctcttttccccaggggcacagcagaacctgcagctcatcaattccaacggtagctggca

SEQ ID NO: 128374 - DNA, 75 bp, Artificial Sequence
  Synthetic
aacatcgtggacgtgcaatatttgtacggagtggggtcgagcatcgtgtcctgggccatcaagtgggagtatgtc

SEQ ID NO: 128375 - DNA, 75 bp, Artificial Sequence
  Synthetic
ctacaggccagccttctgcaagtaccgtactatgtgcgggcacatgctttgttgcgagcctgcttgctcgtacgg

SEQ ID NO: 128376 - DNA, 75 bp, Artificial Sequence
  Synthetic
tatctttactcttactccagcttataaacaacttcttgtaggcatgctctggtggatacagtatttcattgcact

SEQ ID NO: 128377 - DNA, 75 bp, Artificial Sequence
  Synthetic
tatctttactcttactccagcttataatcaacttcttgtaggcatgctctggtggatacagtatttcattgcact

SEQ ID NO: 128378 - DNA, 75 bp, Artificial Sequence
  Synthetic
tatctttactcttactccagcttataaccaacttcttgtaggcatgctctggtggatacagtatttcattgcact

SEQ ID NO: 128379 - DNA, 75 bp, Artificial Sequence
  Synthetic
tatctttactcttactccagcttataagcaacttcttgtaggcatgctctggtggatacagtatttcattgcact

SEQ ID NO: 128380 - DNA, 75 bp, Artificial Sequence
  Synthetic
tacgggcgcccaacagaaactgcagctggtcaacaccaatggctcgtggcacatcaacaggactgccctgaactg

SEQ ID NO: 128381 - DNA, 75 bp, Artificial Sequence
  Synthetic
ttgtacatactccaggcctcactcttgcgcgtcccttacttcgtgagagcgcacgcgctaatcaagatatgcagc

SEQ ID NO: 128382 - DNA, 75 bp, Artificial Sequence
  Synthetic
acatcaacaggactgccctgaactgcaatgagtccataaacaccgggttcatagctgggttgttttattatcata

SEQ ID NO: 128383 - DNA, 75 bp, Artificial Sequence
  Synthetic
cgtatggctagttgcaaacctctgcatctctttgaccagggttgggggcctatctcatatgtcaacaagagtggt

SEQ ID NO: 128384 - DNA, 75 bp, Artificial Sequence
  Synthetic
ctagcgaaggactgcgtgatctcgccgtggccgtggagccaattgtgttctcgcctatggagaagaaggttatca

SEQ ID NO: 128385 - DNA, 75 bp, Artificial Sequence
  Synthetic
cagactgggcggctgagggccttagtgacctagcggtggcacttgagccggtcgtgtttacggctatggagaaga

SEQ ID NO: 128386 - DNA, 75 bp, Artificial Sequence
  Synthetic
gtccagtagtcatcggcaccactgacaagaagggcctgcctacatatacttggggggtaaatgaaactgacgtgt

SEQ ID NO: 128387 - DNA, 75 bp, Artificial Sequence
  Synthetic
acctggacccccaagcccgcgtggctatcaagtccctcactgagaggctttatgttgggggccctcttaccaatt

SEQ ID NO: 128388 - DNA, 75 bp, Artificial Sequence
  Synthetic
tactttgtccgcgcgcatatcttattgcgcgcatgcatggtcttgcgcggcatggcccgtggcagatatgctcaa

SEQ ID NO: 128389 - DNA, 75 bp, Artificial Sequence
  Synthetic
gggcgataaaggctggaggttactcgcccccatcaccgcatatcatcagaaaacccgcggtctactgggaacgat

SEQ ID NO: 128390 - DNA, 75 bp, Artificial Sequence
  Synthetic
gcccccatcaccgcatatcatcagaaaacccgcggtctactgggaacgatagtcaccagtttgactggcagggac

SEQ ID NO: 128391 - DNA, 75 bp, Artificial Sequence
  Synthetic
tgacctagcggtggcacttgagccggtcgtgtttacggctatggagaagaaagtcataacctggggtgctgacac

SEQ ID NO: 128392 - DNA, 75 bp, Artificial Sequence
  Synthetic
tggatctgcagtggtatcttgggccctcaagtgggaatatgtggtgctcgcgttcctgcttcttgcagacgcgag

SEQ ID NO: 128393 - DNA, 75 bp, Artificial Sequence
  Synthetic
tcgctgttgagcccgtcatcttctccccaatggagaagaaggtcgtcacatggggtgctgataccgctgcctgcg

SEQ ID NO: 128394 - DNA, 75 bp, Artificial Sequence
  Synthetic
gattagacccggaaagtccaataataccttggaatgtcctactgattgcttccgaaaacacccggaagccacttt

SEQ ID NO: 128395 - DNA, 75 bp, Artificial Sequence
  Synthetic
gatttgacccggaaagtccaataataccttggaatgtcctactgattgcttccgaaaacacccggaagccacttt

SEQ ID NO: 128396 - DNA, 75 bp, Artificial Sequence
  Synthetic
gattcgacccggaaagtccaataataccttggaatgtcctactgattgcttccgaaaacacccggaagccacttt

SEQ ID NO: 128397 - DNA, 75 bp, Artificial Sequence
  Synthetic
gattggacccggaaagtccaataataccttggaatgtcctactgattgcttccgaaaacacccggaagccacttt

SEQ ID NO: 128398 - DNA, 75 bp, Artificial Sequence
  Synthetic
ctggctccaagactttagctggccccaaaggccccgtctgccagatgtacaccaatgttgaccaagaccttgtgg

SEQ ID NO: 128399 - DNA, 75 bp, Artificial Sequence
  Synthetic
aaggtcaggatgtttgtgggcggcgttgagcacaggtttgatgccgcttgcaactggactcggggggagaggtgc

SEQ ID NO: 128400 - DNA, 75 bp, Artificial Sequence
  Synthetic
cccaatcacagcatatgcccaacaaactcgaggcatagtgggtaccatcgtcactagcctcactggccgggacaa

SEQ ID NO: 128401 - DNA, 75 bp, Artificial Sequence
  Synthetic
gcgcaggggcgacacccgtgctgggctccttagccctaggcccttggcgactctcaagggttcttccggcggccc

SEQ ID NO: 128402 - DNA, 75 bp, Artificial Sequence
  Synthetic
gggagtgaagtccttgaccccatgcacctgtggctcgtcggacctgttcctggttaccaggaatgccgacgtggt

SEQ ID NO: 128403 - DNA, 75 bp, Artificial Sequence
  Synthetic
attgtctccccactacaagtcatggctggctaagggactatggtggattcaatattttatagctagggctgaggc

SEQ ID NO: 128404 - DNA, 75 bp, Artificial Sequence
  Synthetic
caaccggcttgattcatcttcaccagaacatcgtggacgtgcaatacctctatggagtgtccactgccattgtgt

SEQ ID NO: 128405 - DNA, 75 bp, Artificial Sequence
  Synthetic
gaaaccacgatgaggtctccagtcttcactgacaattcaacaccacccgttgtaccacagacctaccaggttgga

SEQ ID NO: 128406 - DNA, 75 bp, Artificial Sequence
  Synthetic
ggccatgccgccggcatcttccgagccgcggtgtgtacccggggtgtggctaaagcagtggatttcgtgccagtt

SEQ ID NO: 128407 - DNA, 75 bp, Artificial Sequence
  Synthetic
tctggcatggtgggatgggcgttgaaatgggagttcgtcatcctcgttttcctcctcctagcagacgcacgcgtg

SEQ ID NO: 128408 - DNA, 75 bp, Artificial Sequence
  Synthetic
ggaggctgctttggaaaacttggttgtcctcaatgcagcttccgccgccagctgtcaaggcataatttggggggt

SEQ ID NO: 128409 - DNA, 75 bp, Artificial Sequence
  Synthetic
ggttcaagactggcaaacacaatttatatgctggaccccagtaacacctccagtggcagtcagcggcgtcggggc

SEQ ID NO: 128410 - DNA, 75 bp, Artificial Sequence
  Synthetic
tatctccatgctccaacgggcagcgggaagagcacgaaggtcccggccgcgtacgcctcgcaaggctacaaggtg

SEQ ID NO: 128411 - DNA, 75 bp, Artificial Sequence
  Synthetic
tcctcctgccgtgccccagacctaccaagtagcccatttgcacgcgccgacgggaagcggcaaaagcacgaaagt

SEQ ID NO: 128412 - DNA, 75 bp, Artificial Sequence
  Synthetic
gtcgctgctgccgggacacatggtatcggctggtacctggtagctttttgcgcggcgtggtacgtgcggggtaaa

SEQ ID NO: 128413 - DNA, 75 bp, Artificial Sequence
  Synthetic
ttaggaggggaccggcgtttccccccgccctgccagtatgggcaaggccggggtatgacccacccctcctggaga

SEQ ID NO: 128414 - DNA, 75 bp, Artificial Sequence
  Synthetic
taacaacaggaggtcctatcacatactctacttatggcaagtttctggctgacggtggatgctctggaggggcgt

SEQ ID NO: 128415 - DNA, 75 bp, Artificial Sequence
  Synthetic
tcagataacaccactcctcctgcggtgccacaaacctatcaggtgggatacctccacgctcctacagggagcggg

SEQ ID NO: 128416 - DNA, 75 bp, Artificial Sequence
  Synthetic
ctaccccggagggcctacgcccaggatgctgagcaagcggcatcagtgggtcttttggctctgggtgttatcacc

SEQ ID NO: 128417 - DNA, 75 bp, Artificial Sequence
  Synthetic
tgccacaaacctatcaggtgggatacctccacgctcctacagggagcgggaagagcactaaggtccctgccgctt

SEQ ID NO: 128418 - DNA, 75 bp, Artificial Sequence
  Synthetic
ccactccacggaccctacaacgatcttggggataggtaccgtcttggaccaggctgagacggcgggtgcacgcct

SEQ ID NO: 128419 - DNA, 75 bp, Artificial Sequence
  Synthetic
gaggcgcgtatgatatcatcatctgtgatgaatgccattccactgatgcaacaacggtcctgggtataggcacgg

SEQ ID NO: 128420 - DNA, 75 bp, Artificial Sequence
  Synthetic
cgccatcactcagggtcaggggtggccgtgatgcaatcatcttgctcacctgcttgttacatcctcagcttgggt

SEQ ID NO: 128421 - DNA, 75 bp, Artificial Sequence
  Synthetic
acaacggtcctgggtataggcacggtcctagaccaagcggaaaccgctggagcgcgtcttgtcgtgctcgcgacc

SEQ ID NO: 128422 - DNA, 75 bp, Artificial Sequence
  Synthetic
gggagagccattcccctcgagtacatcaagggtggtaggcatctcatcttttgccattcaaagaagaagtgcgac

SEQ ID NO: 128423 - DNA, 75 bp, Artificial Sequence
  Synthetic
cgcatgtactggtccgcctttgcatgctcgtgcgctccgtgatggggggaaaatacttccagatgatcatattga

SEQ ID NO: 128424 - DNA, 75 bp, Artificial Sequence
  Synthetic
gcgggcctgcatgtttttccgtggcatagcttgcggcaaatatgctcaagccatcttgctacgtcttggagcctg

SEQ ID NO: 128425 - DNA, 75 bp, Artificial Sequence
  Synthetic
caactggtcaacaccaatggctcgtggcacattaatagcactgccctgaactgtaatgattccataaacaccggg

SEQ ID NO: 128426 - DNA, 75 bp, Artificial Sequence
  Synthetic
cagggaatttgcccggttgctctttctctatcttcctcttggctttgctgtcctgtttgaccatcccagcttccg

SEQ ID NO: 128427 - DNA, 75 bp, Artificial Sequence
  Synthetic
tgctttgccgacgacgggagagatacccttctacggcaaggcaatccccctatctttggtcaaagggggcagaca

SEQ ID NO: 128428 - DNA, 75 bp, Artificial Sequence
  Synthetic
gcgccactgacgccctcatgactggttttacaggtgatttcgactccgtcatagactgcaatgtaactgtgacgc

SEQ ID NO: 128429 - DNA, 75 bp, Artificial Sequence
  Synthetic
ataagttcaactctaccgggtgtccccaaaggctcagtagctgcagacctatcactgacttcaagcaggggtggg

SEQ ID NO: 128430 - DNA, 75 bp, Artificial Sequence
  Synthetic
ccgatggaaaagaaggtcatcacctggggcgctgacacagccgcttgtggagacatcatcgctggccttcccgtt

SEQ ID NO: 128431 - DNA, 75 bp, Artificial Sequence
  Synthetic
ccgatggaaaagaaggtcatcacctggggcgctgacacagccgcttgtggtgacatcatcgctggccttcccgtt

SEQ ID NO: 128432 - DNA, 75 bp, Artificial Sequence
  Synthetic
ccgatggaaaagaaggtcatcacctggggcgctgacacagccgcttgtggcgacatcatcgctggccttcccgtt

SEQ ID NO: 128433 - DNA, 75 bp, Artificial Sequence
  Synthetic
ccgatggaaaagaaggtcatcacctggggcgctgacacagccgcttgtggggacatcatcgctggccttcccgtt

SEQ ID NO: 128434 - DNA, 75 bp, Artificial Sequence
  Synthetic
tcccgacagggaagtcctctaccaggagttcgatgagatggaagagtgcgcctcacacctcccttacatcgaaca

SEQ ID NO: 128435 - DNA, 75 bp, Artificial Sequence
  Synthetic
cacctttacaattgagaccactaccgtcccacaagatgccgtgtctagaagccaacggcgcggacgcacaggcag

SEQ ID NO: 128436 - DNA, 75 bp, Artificial Sequence
  Synthetic
cactggtagggggaggttaggcatataccggtatgtcaccccaggagaaaggccatccggcatatttgacacctc

SEQ ID NO: 128437 - DNA, 75 bp, Artificial Sequence
  Synthetic
tggtatgagctgacaccatcggagaccacggtcaggctgcgcgcatacctgaatacccctgggctgcctgtatgt

SEQ ID NO: 128438 - DNA, 75 bp, Artificial Sequence
  Synthetic
ctcgaggtttggtaggcaccatcatcaccagcctcacagggcgcgacaagaatgtggtggaaggtgagatccagg

SEQ ID NO: 128439 - DNA, 75 bp, Artificial Sequence
  Synthetic
cgtgtggatgaactccacggggtttgtcaagacgtgtggagctcccccttgcaacatctatgggggtggggagaa

SEQ ID NO: 128440 - DNA, 75 bp, Artificial Sequence
  Synthetic
cggccatcttggggccctaatgatccccggcgaaggtcccgcaacctgggtaaagtcatcgataccctaacttgc

SEQ ID NO: 128441 - DNA, 75 bp, Artificial Sequence
  Synthetic
caagaccacctcgagttttgggagggagtttttactgggcttactcacatcgatgctcacttcctctcacagact

SEQ ID NO: 128442 - DNA, 75 bp, Artificial Sequence
  Synthetic
gggccccgtttgccagatgtacaccaatgttgaacaggacctcgtgggttggcctgcacctcccggatcacgttc

SEQ ID NO: 128443 - DNA, 75 bp, Artificial Sequence
  Synthetic
gggccccgtttgccagatgtacaccaatgttgatcaggacctcgtgggttggcctgcacctcccggatcacgttc

SEQ ID NO: 128444 - DNA, 75 bp, Artificial Sequence
  Synthetic
gggccccgtttgccagatgtacaccaatgttgaccaggacctcgtgggttggcctgcacctcccggatcacgttc

SEQ ID NO: 128445 - DNA, 75 bp, Artificial Sequence
  Synthetic
gggccccgtttgccagatgtacaccaatgttgagcaggacctcgtgggttggcctgcacctcccggatcacgttc

SEQ ID NO: 128446 - DNA, 75 bp, Artificial Sequence
  Synthetic
cacccatatagacggccacttcctatcccagaccaaacaggcgggtgacaacttcccttacctggtcgcctacca

SEQ ID NO: 128447 - DNA, 75 bp, Artificial Sequence
  Synthetic
gcctcatacggctaaagcctatgcttacagggcctactcccctgttgtataggctgggggccgtgcaaaatgaga

SEQ ID NO: 128448 - DNA, 75 bp, Artificial Sequence
  Synthetic
ataccccggggcttccagtctgccaggaccatcttgagttttgggagggggtcttcacaggcctgacacacatag

SEQ ID NO: 128449 - DNA, 75 bp, Artificial Sequence
  Synthetic
ataccccggggcttccagtctgccaggaccatcttgagttttgggagggggtcttcacaggcctgacacacattg

SEQ ID NO: 128450 - DNA, 75 bp, Artificial Sequence
  Synthetic
ataccccggggcttccagtctgccaggaccatcttgagttttgggagggggtcttcacaggcctgacacacatcg

SEQ ID NO: 128451 - DNA, 75 bp, Artificial Sequence
  Synthetic
ataccccggggcttccagtctgccaggaccatcttgagttttgggagggggtcttcacaggcctgacacacatgg

SEQ ID NO: 128452 - DNA, 75 bp, Artificial Sequence
  Synthetic
ataccccggggcttccagtctgccaggaccatcttgagttttgggagggggtcttcacaggcctgactcacatag

SEQ ID NO: 128453 - DNA, 75 bp, Artificial Sequence
  Synthetic
ataccccggggcttccagtctgccaggaccatcttgagttttgggagggggtcttcacaggcctgactcacattg

SEQ ID NO: 128454 - DNA, 75 bp, Artificial Sequence
  Synthetic
ataccccggggcttccagtctgccaggaccatcttgagttttgggagggggtcttcacaggcctgactcacatcg

SEQ ID NO: 128455 - DNA, 75 bp, Artificial Sequence
  Synthetic
ataccccggggcttccagtctgccaggaccatcttgagttttgggagggggtcttcacaggcctgactcacatgg

SEQ ID NO: 128456 - DNA, 75 bp, Artificial Sequence
  Synthetic
ataccccggggcttccagtctgccaggaccatcttgagttttgggagggggtcttcacaggcctgacccacatag

SEQ ID NO: 128457 - DNA, 75 bp, Artificial Sequence
  Synthetic
ataccccggggcttccagtctgccaggaccatcttgagttttgggagggggtcttcacaggcctgacccacattg

SEQ ID NO: 128458 - DNA, 75 bp, Artificial Sequence
  Synthetic
ataccccggggcttccagtctgccaggaccatcttgagttttgggagggggtcttcacaggcctgacccacatcg

SEQ ID NO: 128459 - DNA, 75 bp, Artificial Sequence
  Synthetic
ataccccggggcttccagtctgccaggaccatcttgagttttgggagggggtcttcacaggcctgacccacatgg

SEQ ID NO: 128460 - DNA, 75 bp, Artificial Sequence
  Synthetic
ataccccggggcttccagtctgccaggaccatcttgagttttgggagggggtcttcacaggcctgacgcacatag

SEQ ID NO: 128461 - DNA, 75 bp, Artificial Sequence
  Synthetic
ataccccggggcttccagtctgccaggaccatcttgagttttgggagggggtcttcacaggcctgacgcacattg

SEQ ID NO: 128462 - DNA, 75 bp, Artificial Sequence
  Synthetic
ataccccggggcttccagtctgccaggaccatcttgagttttgggagggggtcttcacaggcctgacgcacatcg

SEQ ID NO: 128463 - DNA, 75 bp, Artificial Sequence
  Synthetic
ataccccggggcttccagtctgccaggaccatcttgagttttgggagggggtcttcacaggcctgacgcacatgg

SEQ ID NO: 128464 - DNA, 75 bp, Artificial Sequence
  Synthetic
ctcagcccgcggcccataagtaccctcaaagggtcttctggcggccctatgctgtgtccctctggtcatgtcgca

SEQ ID NO: 128465 - DNA, 75 bp, Artificial Sequence
  Synthetic
atacatcatgacctgcatgtcggcggacctggaagtggtcaccagcacttgggtacttgcagggggggtcctcgc

SEQ ID NO: 128466 - DNA, 75 bp, Artificial Sequence
  Synthetic
caaaagccctacagttcataccagtggaaacccttagcacacaggctaggtctccatccttctctgacaattcaa

SEQ ID NO: 128467 - DNA, 75 bp, Artificial Sequence
  Synthetic
cggttgctctttttctatcttccttctggcactcatctcgtgcctgactgtccccgcctcggccatccactatcg

SEQ ID NO: 128468 - DNA, 75 bp, Artificial Sequence
  Synthetic
cggttgctctttttctatcttccttctggcactcttctcgtgcctgactgtccccgcctcggccatccactatcg

SEQ ID NO: 128469 - DNA, 75 bp, Artificial Sequence
  Synthetic
cggttgctctttttctatcttccttctggcactcctctcgtgcctgactgtccccgcctcggccatccactatcg

SEQ ID NO: 128470 - DNA, 75 bp, Artificial Sequence
  Synthetic
cggttgctctttttctatcttccttctggcactcgtctcgtgcctgactgtccccgcctcggccatccactatcg

SEQ ID NO: 128471 - DNA, 75 bp, Artificial Sequence
  Synthetic
gcacccccacccagttgggacaccatgtggaaatgcctcctccgcctcaaaccaacgttgcgggggccgacccct

SEQ ID NO: 128472 - DNA, 75 bp, Artificial Sequence
  Synthetic
tcaccactacacatcctatcacaaaatacatcatgacctgcatgtcggcggacctggaagtggtcaccagcactt

SEQ ID NO: 128473 - DNA, 75 bp, Artificial Sequence
  Synthetic
ccagcacgtgggtcatggtaggcggcctcctggcggctcttgctgcctactgcttgtcagtgggcagtgtggtaa

SEQ ID NO: 128474 - DNA, 75 bp, Artificial Sequence
  Synthetic
ctgataattcatcaccacctgctgttccacaaacctatcaagtggggtacctacacgcacctacgggaagcggga

SEQ ID NO: 128475 - DNA, 75 bp, Artificial Sequence
  Synthetic
ctgataattcatcaccacctgctgttccacaaacctatcaagtggggtacctacacgcacctacgggtagcggga

SEQ ID NO: 128476 - DNA, 75 bp, Artificial Sequence
  Synthetic
ctgataattcatcaccacctgctgttccacaaacctatcaagtggggtacctacacgcacctacgggcagcggga

SEQ ID NO: 128477 - DNA, 75 bp, Artificial Sequence
  Synthetic
ctgataattcatcaccacctgctgttccacaaacctatcaagtggggtacctacacgcacctacggggagcggga

SEQ ID NO: 128478 - DNA, 75 bp, Artificial Sequence
  Synthetic
ctgataattcatcaccacctgctgttccacaaacctatcaagtggggtaccttcacgcacctacgggaagcggga

SEQ ID NO: 128479 - DNA, 75 bp, Artificial Sequence
  Synthetic
ctgataattcatcaccacctgctgttccacaaacctatcaagtggggtaccttcacgcacctacgggtagcggga

SEQ ID NO: 128480 - DNA, 75 bp, Artificial Sequence
  Synthetic
ctgataattcatcaccacctgctgttccacaaacctatcaagtggggtaccttcacgcacctacgggcagcggga

SEQ ID NO: 128481 - DNA, 75 bp, Artificial Sequence
  Synthetic
ctgataattcatcaccacctgctgttccacaaacctatcaagtggggtaccttcacgcacctacggggagcggga

SEQ ID NO: 128482 - DNA, 75 bp, Artificial Sequence
  Synthetic
ctgataattcatcaccacctgctgttccacaaacctatcaagtggggtacctccacgcacctacgggaagcggga

SEQ ID NO: 128483 - DNA, 75 bp, Artificial Sequence
  Synthetic
ctgataattcatcaccacctgctgttccacaaacctatcaagtggggtacctccacgcacctacgggtagcggga

SEQ ID NO: 128484 - DNA, 75 bp, Artificial Sequence
  Synthetic
ctgataattcatcaccacctgctgttccacaaacctatcaagtggggtacctccacgcacctacgggcagcggga

SEQ ID NO: 128485 - DNA, 75 bp, Artificial Sequence
  Synthetic
ctgataattcatcaccacctgctgttccacaaacctatcaagtggggtacctccacgcacctacggggagcggga

SEQ ID NO: 128486 - DNA, 75 bp, Artificial Sequence
  Synthetic
ctgataattcatcaccacctgctgttccacaaacctatcaagtggggtacctgcacgcacctacgggaagcggga

SEQ ID NO: 128487 - DNA, 75 bp, Artificial Sequence
  Synthetic
ctgataattcatcaccacctgctgttccacaaacctatcaagtggggtacctgcacgcacctacgggtagcggga

SEQ ID NO: 128488 - DNA, 75 bp, Artificial Sequence
  Synthetic
ctgataattcatcaccacctgctgttccacaaacctatcaagtggggtacctgcacgcacctacgggcagcggga

SEQ ID NO: 128489 - DNA, 75 bp, Artificial Sequence
  Synthetic
ctgataattcatcaccacctgctgttccacaaacctatcaagtggggtacctgcacgcacctacggggagcggga

SEQ ID NO: 128490 - DNA, 75 bp, Artificial Sequence
  Synthetic
taccaacagttcgacgagatggaagagtgctcacaacgcattccttatcttgttgaaggccaacaacttgccgag

SEQ ID NO: 128491 - DNA, 75 bp, Artificial Sequence
  Synthetic
tgtgtgagatccggaaatgtctcgcgctgctgggtgcccctaacccccaccgtggcagcgccgtacgtcaacgct

SEQ ID NO: 128492 - DNA, 75 bp, Artificial Sequence
  Synthetic
gatcgaccccaacatccgcactgggaaccgcaccgttacaactggtgctaaactgacctattccacctacggtaa

SEQ ID NO: 128493 - DNA, 75 bp, Artificial Sequence
  Synthetic
tcgtcgggagggtcgtcctatcaggccaacctgccgtcattcctgatcgggaggtgctgtacaaacagttcgacg

SEQ ID NO: 128494 - DNA, 75 bp, Artificial Sequence
  Synthetic
tggggacgaccgatcgtttcggcgtccctacgtatagctggggggagaatgagacggacgtgctgcttctcaaca

SEQ ID NO: 128495 - DNA, 75 bp, Artificial Sequence
  Synthetic
tgggccagctgttcaccttccaaccgcggcgccactggaccgtccaagagtgcaactgttccatctactccggac

SEQ ID NO: 128496 - DNA, 75 bp, Artificial Sequence
  Synthetic
caaagctcatggcatagatcccaacatccgcaccggggtgagaaccatcaccacaggtggaaaaatcacctattc

SEQ ID NO: 128497 - DNA, 75 bp, Artificial Sequence
  Synthetic
caaagctcatggcatagatcccaacatccgcaccggggtgagaaccatcaccactggtggaaaaatcacctattc

SEQ ID NO: 128498 - DNA, 75 bp, Artificial Sequence
  Synthetic
caaagctcatggcatagatcccaacatccgcaccggggtgagaaccatcaccaccggtggaaaaatcacctattc

SEQ ID NO: 128499 - DNA, 75 bp, Artificial Sequence
  Synthetic
caaagctcatggcatagatcccaacatccgcaccggggtgagaaccatcaccacgggtggaaaaatcacctattc

SEQ ID NO: 128500 - DNA, 75 bp, Artificial Sequence
  Synthetic
caatgctcatggcatagatcccaacatccgcaccggggtgagaaccatcaccacaggtggaaaaatcacctattc

SEQ ID NO: 128501 - DNA, 75 bp, Artificial Sequence
  Synthetic
caatgctcatggcatagatcccaacatccgcaccggggtgagaaccatcaccactggtggaaaaatcacctattc

SEQ ID NO: 128502 - DNA, 75 bp, Artificial Sequence
  Synthetic
caatgctcatggcatagatcccaacatccgcaccggggtgagaaccatcaccaccggtggaaaaatcacctattc

SEQ ID NO: 128503 - DNA, 75 bp, Artificial Sequence
  Synthetic
caatgctcatggcatagatcccaacatccgcaccggggtgagaaccatcaccacgggtggaaaaatcacctattc

SEQ ID NO: 128504 - DNA, 75 bp, Artificial Sequence
  Synthetic
caacgctcatggcatagatcccaacatccgcaccggggtgagaaccatcaccacaggtggaaaaatcacctattc

SEQ ID NO: 128505 - DNA, 75 bp, Artificial Sequence
  Synthetic
caacgctcatggcatagatcccaacatccgcaccggggtgagaaccatcaccactggtggaaaaatcacctattc

SEQ ID NO: 128506 - DNA, 75 bp, Artificial Sequence
  Synthetic
caacgctcatggcatagatcccaacatccgcaccggggtgagaaccatcaccaccggtggaaaaatcacctattc

SEQ ID NO: 128507 - DNA, 75 bp, Artificial Sequence
  Synthetic
caacgctcatggcatagatcccaacatccgcaccggggtgagaaccatcaccacgggtggaaaaatcacctattc

SEQ ID NO: 128508 - DNA, 75 bp, Artificial Sequence
  Synthetic
caaggctcatggcatagatcccaacatccgcaccggggtgagaaccatcaccacaggtggaaaaatcacctattc

SEQ ID NO: 128509 - DNA, 75 bp, Artificial Sequence
  Synthetic
caaggctcatggcatagatcccaacatccgcaccggggtgagaaccatcaccactggtggaaaaatcacctattc

SEQ ID NO: 128510 - DNA, 75 bp, Artificial Sequence
  Synthetic
caaggctcatggcatagatcccaacatccgcaccggggtgagaaccatcaccaccggtggaaaaatcacctattc

SEQ ID NO: 128511 - DNA, 75 bp, Artificial Sequence
  Synthetic
caaggctcatggcatagatcccaacatccgcaccggggtgagaaccatcaccacgggtggaaaaatcacctattc

SEQ ID NO: 128512 - DNA, 75 bp, Artificial Sequence
  Synthetic
tctggcagaaacatctgtggaacttcgtcagcggaatacaatatcttgctggcctttccacactgcctggaaatc

SEQ ID NO: 128513 - DNA, 75 bp, Artificial Sequence
  Synthetic
agatgtccaatacctttatggtgttggagctggtgtggtggggtgggcgttgaaatgggagttcgtcatcctcgt

SEQ ID NO: 128514 - DNA, 75 bp, Artificial Sequence
  Synthetic
ttgaacaattttgggcgaagcatatgtggaacttcatcagtggcatccaataccttgccgggctgtctaccttgc

SEQ ID NO: 128515 - DNA, 75 bp, Artificial Sequence
  Synthetic
gtgccacattctaacatcgaagaagtggctctgggctccgaaggtgagatccctttctatggtaaggctataccg

SEQ ID NO: 128516 - DNA, 75 bp, Artificial Sequence
  Synthetic
tgacttgctctccggcgggcattggggtatccttgttggggtagcgtacttttgtatgcaaaccaactgggctaa

SEQ ID NO: 128517 - DNA, 75 bp, Artificial Sequence
  Synthetic
ggtatagggaccgttctcgaccaggcagagactagcggagtgagacttacggttctcgcgaccgccaccccccct

SEQ ID NO: 128518 - DNA, 75 bp, Artificial Sequence
  Synthetic
cgcggtatcccgcagccagcggagaggccgtactggtagggggaggttgggcatataccggtatgtcaccccagg

SEQ ID NO: 128519 - DNA, 75 bp, Artificial Sequence
  Synthetic
aggagctaaagccggcagtccacgcagcctggccgaagcttgaacagttttggcaaaagcatttgtggaattttg

SEQ ID NO: 128520 - DNA, 75 bp, Artificial Sequence
  Synthetic
ttctgccgccttgactagtcctttgtcgacttctaccacccttctccttaacatactaggaggatgggtagcatc

SEQ ID NO: 128521 - DNA, 75 bp, Artificial Sequence
  Synthetic
ctagcggggtacggggcaggtgtgtctggtgcacttgtcgctttcaagatcatgagcggcgaagcccccgcgcta

SEQ ID NO: 128522 - DNA, 75 bp, Artificial Sequence
  Synthetic
gcacctggggcccagcagaacatacggctcatccataccaatgggagttggcatatcaacagtactgctctcaat

SEQ ID NO: 128523 - DNA, 75 bp, Artificial Sequence
  Synthetic
gcacctggggcccagcagaacatacggctcatccatacctatgggagttggcatatcaacagtactgctctcaat

SEQ ID NO: 128524 - DNA, 75 bp, Artificial Sequence
  Synthetic
gcacctggggcccagcagaacatacggctcatccatacccatgggagttggcatatcaacagtactgctctcaat

SEQ ID NO: 128525 - DNA, 75 bp, Artificial Sequence
  Synthetic
gcacctggggcccagcagaacatacggctcatccataccgatgggagttggcatatcaacagtactgctctcaat

SEQ ID NO: 128526 - DNA, 75 bp, Artificial Sequence
  Synthetic
agggcaatcccccttgaagtcatcaaagggggaagacaccttatcttttgccattctaaaaagaaatgcgacgag

SEQ ID NO: 128527 - DNA, 75 bp, Artificial Sequence
  Synthetic
ctgcttctctcaccagcccattgccaacctctacgaccctcctattgaacatcttggggggatgggtggcgtcac

SEQ ID NO: 128528 - DNA, 75 bp, Artificial Sequence
  Synthetic
agggcgccaatcaatggatgaaccggctcatagcgtttgcgtcgcggggcaatcatgtgtcccctacgcactacg

SEQ ID NO: 128529 - DNA, 75 bp, Artificial Sequence
  Synthetic
ttgatgacttctcccagggctggggaccgctaacttataacagttcttccacggccgggatcaacaggccttatt

SEQ ID NO: 128530 - DNA, 75 bp, Artificial Sequence
  Synthetic
ggaaaatacttccagatggtcatactaagcattggcagatggttcaacacctacctgtacgatcaccttgcacca

SEQ ID NO: 128531 - DNA, 75 bp, Artificial Sequence
  Synthetic
tggggtaccgcccttgcgagcttggagacaccgggcccggagcgttcgcgctaagctcctgtccagaggaggcag

SEQ ID NO: 128532 - DNA, 75 bp, Artificial Sequence
  Synthetic
gacaacaccatgcgccctgagctggcttagggacgtttgggactgggtatgcacagtcttatctgacttcaagac

SEQ ID NO: 128533 - DNA, 75 bp, Artificial Sequence
  Synthetic
tcatccctgactgtgacttcccttctcagacgcctccacaagtggatcaacgaggactgctccactccttgtgat

SEQ ID NO: 128534 - DNA, 75 bp, Artificial Sequence
  Synthetic
gaaacatggggtatacaggtacgtctcgctgggggaacggccgtcggggttgttcgacaccatcaccctgtgcga

SEQ ID NO: 128535 - DNA, 75 bp, Artificial Sequence
  Synthetic
cgactcccgcggggtcccgacatacaactggggggaaaacgagactgatgtcatcatcttgaactcgaccaggcc

SEQ ID NO: 128536 - DNA, 75 bp, Artificial Sequence
  Synthetic
tcagacgcctccacaagtggatcaacgaggactgctccactccttgtgatcgctcttggctatgggagatctggg

SEQ ID NO: 128537 - DNA, 75 bp, Artificial Sequence
  Synthetic
ttggcttaaggctaagctagtgccttccctgccgggcatccccttcttctcatgccagaggggattcaggggtac

SEQ ID NO: 128538 - DNA, 75 bp, Artificial Sequence
  Synthetic
tcgggccaacctgctatcattcctgaccgcgaggtgctctaccaacagttcgacgaaatggaggagtgctccaaa

SEQ ID NO: 128539 - DNA, 75 bp, Artificial Sequence
  Synthetic
gatcacctcgagttttgggagggagtgttcaccgggctcacccacattgacgcccatttcctctcgcaaacaaaa

SEQ ID NO: 128540 - DNA, 75 bp, Artificial Sequence
  Synthetic
cagaggagtatggcggggagacggggtaatgcacacaacatgcacatgcggcgcagagctggccggccacgtcaa

SEQ ID NO: 128541 - DNA, 75 bp, Artificial Sequence
  Synthetic
tgcaatgtctggcatggcacgttccccataaacgcttcaacaacaggccccagcgtgcccgtcccggaacctaac

SEQ ID NO: 128542 - DNA, 75 bp, Artificial Sequence
  Synthetic
accggtgaagtccaggtgctttctacggctacccaaaccttcctaggtacaacagtgggaggggttatgtggact

SEQ ID NO: 128543 - DNA, 75 bp, Artificial Sequence
  Synthetic
tggccctgcccctccgattgcttcaggaagcacccagagacgacttatgccaagtgtggttccgggccctggctc

SEQ ID NO: 128544 - DNA, 75 bp, Artificial Sequence
  Synthetic
cccaagacctgtagcaatacctggcacgggactttccccatcaacgcctacaccacgggtcctagcgtgcccatc

SEQ ID NO: 128545 - DNA, 75 bp, Artificial Sequence
  Synthetic
ccgcagaagactacgttgaggtcatccgcgtcaaggactgccattacgtagtgggggctactgctgacaatctga

SEQ ID NO: 128546 - DNA, 75 bp, Artificial Sequence
  Synthetic
ttatacggcttaagccaatgctcacggggcccacccccctgttgtataggctggggccagtacagaatgagataa

SEQ ID NO: 128547 - DNA, 75 bp, Artificial Sequence
  Synthetic
agcaccgtctgaacgcagcgtgcaattggactaggggggagccttgcgacctcgagcacagagatcgcgcggagc

SEQ ID NO: 128548 - DNA, 75 bp, Artificial Sequence
  Synthetic
ttcaatatctcgctggactgtctaccctgccaggcaatcctgccattgcttccctcatgtcttttactgccgccg

SEQ ID NO: 128549 - DNA, 75 bp, Artificial Sequence
  Synthetic
gctacctggaatcccctttctctcgtgtcagcgagggtttcgagggacgtggcgtggggacggcatctgccatac

SEQ ID NO: 128550 - DNA, 75 bp, Artificial Sequence
  Synthetic
gtgggggctactgctgacaatctgaaatgcccctgccaggtgcccgcacctgagttcttcacagaggtggatggc

SEQ ID NO: 128551 - DNA, 75 bp, Artificial Sequence
  Synthetic
gtgcacctgcggatctgcagacttatacttggttacccgcgaagccgatgtcatccctgcgcgacgcaggggaga

SEQ ID NO: 128552 - DNA, 75 bp, Artificial Sequence
  Synthetic
ccttgcagcctactgcttgtcggtgggctgcgtggtcatttgaggcaggatctctaccagtggtcaaccagtgct

SEQ ID NO: 128553 - DNA, 75 bp, Artificial Sequence
  Synthetic
ccttgcagcctactgcttgtcggtgggctgcgtggtcatttgtggcaggatctctaccagtggtcaaccagtgct

SEQ ID NO: 128554 - DNA, 75 bp, Artificial Sequence
  Synthetic
ccttgcagcctactgcttgtcggtgggctgcgtggtcatttgcggcaggatctctaccagtggtcaaccagtgct

SEQ ID NO: 128555 - DNA, 75 bp, Artificial Sequence
  Synthetic
ccttgcagcctactgcttgtcggtgggctgcgtggtcatttggggcaggatctctaccagtggtcaaccagtgct

SEQ ID NO: 128556 - DNA, 75 bp, Artificial Sequence
  Synthetic
cgtgtgagcccgagcctgacgagatgacacttacatccatgttgactgacccatcacacataacagcagagacgg

SEQ ID NO: 128557 - DNA, 75 bp, Artificial Sequence
  Synthetic
catcgtcgatgtccaatacctctatggtgttggatcggcagtggtgtcatgggccctcaaatgggagtacattgt

SEQ ID NO: 128558 - DNA, 75 bp, Artificial Sequence
  Synthetic
ggtgggcgccactacggacaatctgaagtgcccgtgccaggttccagctcccgagtttttcactgaggttgatgg

SEQ ID NO: 128559 - DNA, 75 bp, Artificial Sequence
  Synthetic
ggtcccagctcccctgcgagcccgagccagacgtcgcagtgttaacatctatgctgacagatccatctcacatca

SEQ ID NO: 128560 - DNA, 75 bp, Artificial Sequence
  Synthetic
ttcaagcagaaggtccttggcctaattcaaacttcggccagacaggcggaggagttgaagccagcggtcaacgcg

SEQ ID NO: 128561 - DNA, 75 bp, Artificial Sequence
  Synthetic
ttcaagcagaaggtccttggccttattcaaacttcggccagacaggcggaggagttgaagccagcggtcaacgcg

SEQ ID NO: 128562 - DNA, 75 bp, Artificial Sequence
  Synthetic
ttcaagcagaaggtccttggcctcattcaaacttcggccagacaggcggaggagttgaagccagcggtcaacgcg

SEQ ID NO: 128563 - DNA, 75 bp, Artificial Sequence
  Synthetic
ttcaagcagaaggtccttggcctgattcaaacttcggccagacaggcggaggagttgaagccagcggtcaacgcg

SEQ ID NO: 128564 - DNA, 75 bp, Artificial Sequence
  Synthetic
aggtcaccctgatgctgagttgcttgaggccaacctcctatgggggaaggaactcgggggtaacataacaagagt

SEQ ID NO: 128565 - DNA, 75 bp, Artificial Sequence
  Synthetic
ctcaatgctatgtcggccgctggcacgcatggcttattgtatgccattcttttcatctgcgtggcttggcacgtt

SEQ ID NO: 128566 - DNA, 75 bp, Artificial Sequence
  Synthetic
gtggacctcatcgagtccaatcttctctggggcgccaacgctaccagggttgagtcagaggataaggtgctgatc

SEQ ID NO: 128567 - DNA, 75 bp, Artificial Sequence
  Synthetic
tctggggcgccaacgctaccagggttgagtcagaggataaggtgctgatcttggactctttcgagccccttgtgg

SEQ ID NO: 128568 - DNA, 75 bp, Artificial Sequence
  Synthetic
aacagctgctgaatgccatcggccacccaggccgaaattcccgccagctctaccgatatgggcacgacctgatta

SEQ ID NO: 128569 - DNA, 75 bp, Artificial Sequence
  Synthetic
caatagcctccctcatgtcattctcagcctcgcttacgagcccgctctccacctccacgaccctgctattaaaca

SEQ ID NO: 128570 - DNA, 75 bp, Artificial Sequence
  Synthetic
ggccctggcgcatggcgtccgggttctggaagacggcgtgaactatgcaacagggaatctgcccggttgctcttt

SEQ ID NO: 128571 - DNA, 75 bp, Artificial Sequence
  Synthetic
gggaggtagcgggggcgttgggtggcggcgttgtcatcttgctcgctatcctaaccatatctccctattataagc

SEQ ID NO: 128572 - DNA, 75 bp, Artificial Sequence
  Synthetic
gggaggtagcgggggcgttgggtggcggcgttgtcatcttgctcgctatcctaaccttatctccctattataagc

SEQ ID NO: 128573 - DNA, 75 bp, Artificial Sequence
  Synthetic
gggaggtagcgggggcgttgggtggcggcgttgtcatcttgctcgctatcctaaccctatctccctattataagc

SEQ ID NO: 128574 - DNA, 75 bp, Artificial Sequence
  Synthetic
gggaggtagcgggggcgttgggtggcggcgttgtcatcttgctcgctatcctaaccgtatctccctattataagc

SEQ ID NO: 128575 - DNA, 75 bp, Artificial Sequence
  Synthetic
acttccaggaagttcccgagggccataccaatttgggctcagccagcttacaacccacctcttattgagacgtgg

SEQ ID NO: 128576 - DNA, 75 bp, Artificial Sequence
  Synthetic
ctgtgtcgggatgtgcgctccccccaaaggggctaccacccgtgcctccgcctaggcggaagaaggtcgtacagc

SEQ ID NO: 128577 - DNA, 75 bp, Artificial Sequence
  Synthetic
gcttgacattctggcaggatacggagctggtgtctcaggtgccttggtggcttttaagatcatgggaggagaact

SEQ ID NO: 128578 - DNA, 75 bp, Artificial Sequence
  Synthetic
tggaaaggtcattgtggacgttctcgcgggatacggagcaggcatatctggggcacttgtcgggtttaaaatcat

SEQ ID NO: 128579 - DNA, 75 bp, Artificial Sequence
  Synthetic
tggaaaggtcattgtggacgttctcgcgggttacggagcaggcatatctggggcacttgtcgggtttaaaatcat

SEQ ID NO: 128580 - DNA, 75 bp, Artificial Sequence
  Synthetic
tggaaaggtcattgtggacgttctcgcgggctacggagcaggcatatctggggcacttgtcgggtttaaaatcat

SEQ ID NO: 128581 - DNA, 75 bp, Artificial Sequence
  Synthetic
tggaaaggtcattgtggacgttctcgcggggtacggagcaggcatatctggggcacttgtcgggtttaaaatcat

SEQ ID NO: 128582 - DNA, 75 bp, Artificial Sequence
  Synthetic
agactccatcatcattcttgcagccattacttggcctcacgtggtgtttgaggtgacaaaacatctgctggctat

SEQ ID NO: 128583 - DNA, 75 bp, Artificial Sequence
  Synthetic
cctaggcggaagaaggtcgtacagctcgacgagtcgactgcgtccgcagcactcgctgagctggcccggaagcta

SEQ ID NO: 128584 - DNA, 75 bp, Artificial Sequence
  Synthetic
tctcggagtccaacatctcggctgcattggcaagcttggcagacaagaccttcagccaaccgggtgtcagctccg

SEQ ID NO: 128585 - DNA, 75 bp, Artificial Sequence
  Synthetic
tcgcaggcccaagttcccaccagcgctgcctatatgggctaggccagactacaatccacccgtactcgagacttg

SEQ ID NO: 128586 - DNA, 75 bp, Artificial Sequence
  Synthetic
acttctggcgagcacgacgcacagtccgacgctggctcctacagctccatgccccctcttgagggtgagcctgga

SEQ ID NO: 128587 - DNA, 75 bp, Artificial Sequence
  Synthetic
cgacgccacgctgggccctccgagggagcaaaccagtggatgaacaggctgatagcctttgcctctaggggcaac

SEQ ID NO: 128588 - DNA, 75 bp, Artificial Sequence
  Synthetic
ccgatagcccttgtcaaaggagggaggcacctcgtcttttgccattccaaaaagaaatgtgatgagttagcatcc

SEQ ID NO: 128589 - DNA, 75 bp, Artificial Sequence
  Synthetic
gtccttggaaagtacgtgcaaatggccatcctgagggtaggcgccctgaccggcacttatgtttacaaccacctg

SEQ ID NO: 128590 - DNA, 75 bp, Artificial Sequence
  Synthetic
tgcgctttggagggtgtccgccgaggagtacgtggaggttcgcagagtgggtgatttccattacgtcaccggggt

SEQ ID NO: 128591 - DNA, 75 bp, Artificial Sequence
  Synthetic
gacttgacatcagattcttggtccaccgtcagcggatcggaggatgtagtgtgctgctcaatgtcctactcatgg

SEQ ID NO: 128592 - DNA, 75 bp, Artificial Sequence
  Synthetic
caccgtgtgctgctgaggaggagaaattgcctatcagtcctctaagcaactctctcattaggcaccacaacatgg

SEQ ID NO: 128593 - DNA, 75 bp, Artificial Sequence
  Synthetic
ggggcatcaatagccggtcatgtgaagaatgggtccatgcggcttgcagggccgcgtacatgtgctaacatgtgg

SEQ ID NO: 128594 - DNA, 75 bp, Artificial Sequence
  Synthetic
gtgcgtggatcaacggtgattggtctaccccatgctctggttcttggttacgcgacatctgggactgggtctgca

SEQ ID NO: 128595 - DNA, 75 bp, Artificial Sequence
  Synthetic
gagctgatacggcagcatgcggtgacatcattaaagggttgcccgtttcggctaggctaggcagcgaaatcttgc

SEQ ID NO: 128596 - DNA, 75 bp, Artificial Sequence
  Synthetic
tttgatagagtccaggtgctggaccagcactatcaggatgtactcaaggagataaaggctcaggcgtctaaagtg

SEQ ID NO: 128597 - DNA, 75 bp, Artificial Sequence
  Synthetic
gcgaggcgatggcatctgcactaccacatgcccctgcggggcagacatcaccggccatgtgaggaacgggtccat

SEQ ID NO: 128598 - DNA, 75 bp, Artificial Sequence
  Synthetic
tagctggacaggggcgctcgttacaccatgcgccgctgaggaggaaaaactgcccatcaatcctctaagcaactc

SEQ ID NO: 128599 - DNA, 75 bp, Artificial Sequence
  Synthetic
gagcctcaccggcagggacaccaatgagaactgtggcgaggtccaagtgttgtctacggccacgcagtccttttt

SEQ ID NO: 128600 - DNA, 75 bp, Artificial Sequence
  Synthetic
ggaactgggctaaggtgttgattgtgatgctactctttgccggcgttgacggggacacctacacgacaggggggg

SEQ ID NO: 128601 - DNA, 75 bp, Artificial Sequence
  Synthetic
tctcagaatatccagcttattaacaccaacggcagctggcacattaacaggactgccctgaactgcaatgactcc

SEQ ID NO: 128602 - DNA, 75 bp, Artificial Sequence
  Synthetic
tacaccagggccctatggagggtatccgctgaggaatacgtcgagatcaagagggtgggggacggccactttgtg

SEQ ID NO: 128603 - DNA, 75 bp, Artificial Sequence
  Synthetic
gtggaccaggatttggtgggctggcctgcccctccgggggtcaaatccctctcaccatgcacttgcggcgcgtcg

SEQ ID NO: 128604 - DNA, 75 bp, Artificial Sequence
  Synthetic
gtccggatgcccacagcgcttggccagctgccgctccattgacaagttcgctcaggggtggggtcctatcaccta

SEQ ID NO: 128605 - DNA, 75 bp, Artificial Sequence
  Synthetic
tgggagccgcgtacggtttccagtactcgcccaagcagcgcgtggaacgtctccttcaaatgtggcgctcaaaga

SEQ ID NO: 128606 - DNA, 75 bp, Artificial Sequence
  Synthetic
agtgcaaacctctcttgagggacgagattactttctctgtgggcttgtcaacctacgcactagggtcccaactcc

SEQ ID NO: 128607 - DNA, 75 bp, Artificial Sequence
  Synthetic
aggggtcctcaggaggcccgcttttgtgccctttgggccacgccgtcggtatattccgagcggcagtgtgcaccc

SEQ ID NO: 128608 - DNA, 75 bp, Artificial Sequence
  Synthetic
tgcgtccgaccaagaagtttcccccagctctaccgatctgggctcgaccagattacaatccacctcttaccgaga

SEQ ID NO: 128609 - DNA, 75 bp, Artificial Sequence
  Synthetic
caccagatgcttcgactcgacggtcacggagcgcgacatccaaacagaacactcaatttaccagtgctgccaatt

SEQ ID NO: 128610 - DNA, 75 bp, Artificial Sequence
  Synthetic
taagccggctcgcctaatcgtgtacccggacctcggggtccgggtgtgcgagaagcgggcgctttttgatgtcac

SEQ ID NO: 128611 - DNA, 75 bp, Artificial Sequence
  Synthetic
ccctccctcactcgcgagttcgtccgcgagccaactctcagcgccatcacttaaggccacgtgcacaacgcacgg

SEQ ID NO: 128612 - DNA, 75 bp, Artificial Sequence
  Synthetic
ccagacctaccaagtcgcccatctgcatgcgccaacgggaagcggcaagagcactaaggtcccggcagcttatgc

SEQ ID NO: 128613 - DNA, 75 bp, Artificial Sequence
  Synthetic
gccattaagtgggattacgtcgttctcctgttccttctgcttgcagacgcgcgcgtctgctcctgcttgtggatg

SEQ ID NO: 128614 - DNA, 75 bp, Artificial Sequence
  Synthetic
tgcagagccagtggtgtattgaccaccagcttgggcaatactctcacatgctacctgaaggctcaggcggcgtgc

SEQ ID NO: 128615 - DNA, 75 bp, Artificial Sequence
  Synthetic
ccgccccatatatcgaacaagctcaggtgatagcccaccagttcaaggagaaagtccttggactgctgcagcgag

SEQ ID NO: 128616 - DNA, 75 bp, Artificial Sequence
  Synthetic
agcggcgtgtttaccaccagctttgggaacacactgacgtgctatcttaaggccagcgcagccatcagggctgca

SEQ ID NO: 128617 - DNA, 75 bp, Artificial Sequence
  Synthetic
ctagattccttcgatcccatctacccggagtacgacgacagagaaccatcggtgccagccgagtgccaccggccg

SEQ ID NO: 128618 - DNA, 75 bp, Artificial Sequence
  Synthetic
aggtccggtgccagaaccatcaccacgggtgcgcctattacgtactccacctatggaaaattcctagcggatgga

SEQ ID NO: 128619 - DNA, 75 bp, Artificial Sequence
  Synthetic
aggtccggtgccagtaccatcaccacgggtgcgcctattacgtactccacctatggaaaattcctagcggatgga

SEQ ID NO: 128620 - DNA, 75 bp, Artificial Sequence
  Synthetic
aggtccggtgccagcaccatcaccacgggtgcgcctattacgtactccacctatggaaaattcctagcggatgga

SEQ ID NO: 128621 - DNA, 75 bp, Artificial Sequence
  Synthetic
aggtccggtgccaggaccatcaccacgggtgcgcctattacgtactccacctatggaaaattcctagcggatgga

SEQ ID NO: 128622 - DNA, 75 bp, Artificial Sequence
  Synthetic
agagctgccaggctcacagattttgacatgttggtctgcggagacgatctcgtcgtcatttcggaaagtttggga

SEQ ID NO: 128623 - DNA, 75 bp, Artificial Sequence
  Synthetic
ggattacatcttgctcatccaacgtatccgtggcccacgaccacaatggacagagatactactacctcaccagag

SEQ ID NO: 128624 - DNA, 75 bp, Artificial Sequence
  Synthetic
tggtccatggctgcgccctgccttccccgactacgacccctattcctcctcctcggaggaaaaaggtggttcagc

SEQ ID NO: 128625 - DNA, 75 bp, Artificial Sequence
  Synthetic
agactgctggagagcgcctcaccgtgctcgccaccgctacaccaccgggatccgtcaccacccctcattacaaca

SEQ ID NO: 128626 - DNA, 75 bp, Artificial Sequence
  Synthetic
agactgctggagagcgcctcaccgtgctcgccaccgctacaccaccgggatccgtcaccacccctcatttcaaca

SEQ ID NO: 128627 - DNA, 75 bp, Artificial Sequence
  Synthetic
agactgctggagagcgcctcaccgtgctcgccaccgctacaccaccgggatccgtcaccacccctcattccaaca

SEQ ID NO: 128628 - DNA, 75 bp, Artificial Sequence
  Synthetic
agactgctggagagcgcctcaccgtgctcgccaccgctacaccaccgggatccgtcaccacccctcattgcaaca

SEQ ID NO: 128629 - DNA, 75 bp, Artificial Sequence
  Synthetic
agactgctggagtgcgcctcaccgtgctcgccaccgctacaccaccgggatccgtcaccacccctcattacaaca

SEQ ID NO: 128630 - DNA, 75 bp, Artificial Sequence
  Synthetic
agactgctggagtgcgcctcaccgtgctcgccaccgctacaccaccgggatccgtcaccacccctcatttcaaca

SEQ ID NO: 128631 - DNA, 75 bp, Artificial Sequence
  Synthetic
agactgctggagtgcgcctcaccgtgctcgccaccgctacaccaccgggatccgtcaccacccctcattccaaca

SEQ ID NO: 128632 - DNA, 75 bp, Artificial Sequence
  Synthetic
agactgctggagtgcgcctcaccgtgctcgccaccgctacaccaccgggatccgtcaccacccctcattgcaaca

SEQ ID NO: 128633 - DNA, 75 bp, Artificial Sequence
  Synthetic
agactgctggagcgcgcctcaccgtgctcgccaccgctacaccaccgggatccgtcaccacccctcattacaaca

SEQ ID NO: 128634 - DNA, 75 bp, Artificial Sequence
  Synthetic
agactgctggagcgcgcctcaccgtgctcgccaccgctacaccaccgggatccgtcaccacccctcatttcaaca

SEQ ID NO: 128635 - DNA, 75 bp, Artificial Sequence
  Synthetic
agactgctggagcgcgcctcaccgtgctcgccaccgctacaccaccgggatccgtcaccacccctcattccaaca

SEQ ID NO: 128636 - DNA, 75 bp, Artificial Sequence
  Synthetic
agactgctggagcgcgcctcaccgtgctcgccaccgctacaccaccgggatccgtcaccacccctcattgcaaca

SEQ ID NO: 128637 - DNA, 75 bp, Artificial Sequence
  Synthetic
agactgctggagggcgcctcaccgtgctcgccaccgctacaccaccgggatccgtcaccacccctcattacaaca

SEQ ID NO: 128638 - DNA, 75 bp, Artificial Sequence
  Synthetic
agactgctggagggcgcctcaccgtgctcgccaccgctacaccaccgggatccgtcaccacccctcatttcaaca

SEQ ID NO: 128639 - DNA, 75 bp, Artificial Sequence
  Synthetic
agactgctggagggcgcctcaccgtgctcgccaccgctacaccaccgggatccgtcaccacccctcattccaaca

SEQ ID NO: 128640 - DNA, 75 bp, Artificial Sequence
  Synthetic
agactgctggagggcgcctcaccgtgctcgccaccgctacaccaccgggatccgtcaccacccctcattgcaaca

SEQ ID NO: 128641 - DNA, 75 bp, Artificial Sequence
  Synthetic
atccgtggcccacgaccacaatggacagagatactactacctcaccagagacccaaccacacctctcgcccgggc

SEQ ID NO: 128642 - DNA, 75 bp, Artificial Sequence
  Synthetic
gtgagcggcttggccggcgctgccatagggggcataggcctgggtagggtcttgcttgacatcctagcaggatat

SEQ ID NO: 128643 - DNA, 75 bp, Artificial Sequence
  Synthetic
tactacctgacccgtgaccctgagactcccctggcacgcgctgcctgggagacagctcgacacactccagttaac

SEQ ID NO: 128644 - DNA, 75 bp, Artificial Sequence
  Synthetic
gcaatacctgtacggtgtagggtcagcggttgtctccttcgcaatcaaatgggagtatgtcctgttgcttttcct

SEQ ID NO: 128645 - DNA, 75 bp, Artificial Sequence
  Synthetic
atccaaaaagaaatgtgacgagttggccaagcagctgtcatctctcggcttgaacgccgtggcctattatagggg

SEQ ID NO: 128646 - DNA, 75 bp, Artificial Sequence
  Synthetic
ttccaaaaagaaatgtgacgagttggccaagcagctgtcatctctcggcttgaacgccgtggcctattatagggg

SEQ ID NO: 128647 - DNA, 75 bp, Artificial Sequence
  Synthetic
ctccaaaaagaaatgtgacgagttggccaagcagctgtcatctctcggcttgaacgccgtggcctattatagggg

SEQ ID NO: 128648 - DNA, 75 bp, Artificial Sequence
  Synthetic
gtccaaaaagaaatgtgacgagttggccaagcagctgtcatctctcggcttgaacgccgtggcctattatagggg

SEQ ID NO: 128649 - DNA, 75 bp, Artificial Sequence
  Synthetic
ttgtagttcggggtcaggagaacaatctgaggatgatggcgcagcctctgaggctggttcctacagttccatgcc

SEQ ID NO: 128650 - DNA, 75 bp, Artificial Sequence
  Synthetic
ttctttggaatactccagtcccaggaaatgctccataaagcgcttgacttcgatatgtacggagtcacgtactcc

SEQ ID NO: 128651 - DNA, 75 bp, Artificial Sequence
  Synthetic
atactccagagccaggaggcccttgaaaaagcactggacttcgacatgtacggagtcacatactctatcactccg

SEQ ID NO: 128652 - DNA, 75 bp, Artificial Sequence
  Synthetic
cgggcgctctcgtcgtcggtgtgatatgcgctgccatattacgtcggcacgtaggacctggggagggggcggtac

SEQ ID NO: 128653 - DNA, 75 bp, Artificial Sequence
  Synthetic
tgcaatgtgtctgttgtgcagaccattgatttcagtctagaccccacattctccctggagactacaaccgtgcca

SEQ ID NO: 128654 - DNA, 75 bp, Artificial Sequence
  Synthetic
ttgatttcagtctagaccccacattctccctggagactacaaccgtgccacaggacgcggtatcccgtagtcagc

SEQ ID NO: 128655 - DNA, 75 bp, Artificial Sequence
  Synthetic
caagactcaggttgcttggggctccaccgttgagagcctggagacatcgagccagggcagtcagggcgaagctca

SEQ ID NO: 128656 - DNA, 75 bp, Artificial Sequence
  Synthetic
caagtctcaggttgcttggggctccaccgttgagagcctggagacatcgagccagggcagtcagggcgaagctca

SEQ ID NO: 128657 - DNA, 75 bp, Artificial Sequence
  Synthetic
caagcctcaggttgcttggggctccaccgttgagagcctggagacatcgagccagggcagtcagggcgaagctca

SEQ ID NO: 128658 - DNA, 75 bp, Artificial Sequence
  Synthetic
caaggctcaggttgcttggggctccaccgttgagagcctggagacatcgagccagggcagtcagggcgaagctca

SEQ ID NO: 128659 - DNA, 75 bp, Artificial Sequence
  Synthetic
agctggacaggggcacttatcacaccatgtgccgccgaagaggagaagcttcctataaatcctctgagcaattcc

SEQ ID NO: 128660 - DNA, 75 bp, Artificial Sequence
  Synthetic
tacgcatggtactcatgacccatttctttcagatactccaagcacaggagactttagatagggcacttgacttcg

SEQ ID NO: 128661 - DNA, 75 bp, Artificial Sequence
  Synthetic
tggcagctggcacatcaacagaaccgctctgaactgcaatgattccctcaagaccgggtttcttgccgcgctgtt

SEQ ID NO: 128662 - DNA, 75 bp, Artificial Sequence
  Synthetic
accgttgagagcctggagacatcgagccagggcagtcagggcgaagctcattgcacagggggggaaagctgctat

SEQ ID NO: 128663 - DNA, 75 bp, Artificial Sequence
  Synthetic
accgttgagagcctggagacatcgagccagggcagtcagggcgaagctcattgctcagggggggaaagctgctat

SEQ ID NO: 128664 - DNA, 75 bp, Artificial Sequence
  Synthetic
accgttgagagcctggagacatcgagccagggcagtcagggcgaagctcattgcccagggggggaaagctgctat

SEQ ID NO: 128665 - DNA, 75 bp, Artificial Sequence
  Synthetic
accgttgagagcctggagacatcgagccagggcagtcagggcgaagctcattgcgcagggggggaaagctgctat

SEQ ID NO: 128666 - DNA, 75 bp, Artificial Sequence
  Synthetic
ctatgatgctggatgtgcttggtacgaactgacaccagccgagaccacagccaggctgagggcttatttcaacac

SEQ ID NO: 128667 - DNA, 75 bp, Artificial Sequence
  Synthetic
actatcatgacaccctaaaggagattaagctccgagcctcacaagtccgggctagactcctcaccactgaggagg

SEQ ID NO: 128668 - DNA, 75 bp, Artificial Sequence
  Synthetic
ggcggacgcgggggggacatatttcacagcgtgtcccaggctcgaccccgcatgttactcctgtgcctactccta

SEQ ID NO: 128669 - DNA, 75 bp, Artificial Sequence
  Synthetic
gctagactcctcaccactgaggaggcctgtgacctgacccctccacactccgtccgttccaaatttggatatggg

SEQ ID NO: 128670 - DNA, 75 bp, Artificial Sequence
  Synthetic
cgaccccgcatgttactcctgtgcctactcctacttaccgtaggggtaggcatcttccttcttcccgctcggtag

SEQ ID NO: 128671 - DNA, 75 bp, Artificial Sequence
  Synthetic
tcgggcgagacctatccctacctggtagcttatcaggctacagtgtgtgccagagcgctggcgcctccaccaagc

SEQ ID NO: 128672 - DNA, 75 bp, Artificial Sequence
  Synthetic
ccgctattgcttcattgatggcttttacagctgctgtcaccagcccactaaccactagccaaaccctcctcttca

SEQ ID NO: 128673 - DNA, 75 bp, Artificial Sequence
  Synthetic
ctccggaacccggactttcttgtctgcggagatgatctggtcgtggtggctgagagtgatggcgtcgatgaggat

SEQ ID NO: 128674 - DNA, 75 bp, Artificial Sequence
  Synthetic
gagctaatctttgacatcaccaaaattatgctcgccatactcggcccgctcatggtgctccaggctggtatagca

SEQ ID NO: 128675 - DNA, 75 bp, Artificial Sequence
  Synthetic
tcacccatcctattacaaaatatatcatggcttgcatgtcagcagatctcgaggtggtgaccagcacgtgggtct

SEQ ID NO: 128676 - DNA, 75 bp, Artificial Sequence
  Synthetic
tcacccatcctattacaaaatatatcatggcttgcatgtctgcagatctcgaggtggtgaccagcacgtgggtct

SEQ ID NO: 128677 - DNA, 75 bp, Artificial Sequence
  Synthetic
tcacccatcctattacaaaatatatcatggcttgcatgtccgcagatctcgaggtggtgaccagcacgtgggtct

SEQ ID NO: 128678 - DNA, 75 bp, Artificial Sequence
  Synthetic
tcacccatcctattacaaaatatatcatggcttgcatgtcggcagatctcgaggtggtgaccagcacgtgggtct

SEQ ID NO: 128679 - DNA, 75 bp, Artificial Sequence
  Synthetic
tggccgaattgaaaggtacgtccgtctatgaccacctcactccactgcaggactgggcccacacaggtctacgag

SEQ ID NO: 128680 - DNA, 75 bp, Artificial Sequence
  Synthetic
agctcaaactcactccaatagcggccgctagccagctggatttatccggctggtttacggctggctacagcgggg

SEQ ID NO: 128681 - DNA, 75 bp, Artificial Sequence
  Synthetic
gcctcagcagcgagtggagcgtttgctcaaaatgtggaagtctaagaagaccccaatgggattttcctatgacac

SEQ ID NO: 128682 - DNA, 75 bp, Artificial Sequence
  Synthetic
aaacactccactctgttttcctttgttttttttttttttttttttttttttttttttttctttttcctttttttt

SEQ ID NO: 128683 - DNA, 75 bp, Artificial Sequence
  Synthetic
ccccgaccgagaggtgctttacaaacagttcgatgagatggaggagtgtgcccaacatctcccctacatcgagca

SEQ ID NO: 128684 - DNA, 75 bp, Artificial Sequence
  Synthetic
tctacctgtctccgcccgaagggggagggagatactcctaggaccagccgacagtcttgaggggcaggggtggcg

SEQ ID NO: 128685 - DNA, 75 bp, Artificial Sequence
  Synthetic
gtcaagtgccggctgctgagttctttactgaagtggatggggtgaggcttcaccgttacgcccctccatgcaagc

SEQ ID NO: 128686 - DNA, 75 bp, Artificial Sequence
  Synthetic
cagctcttcggctagccagttgtctgcgccttccttgaaagcgacatgcactacccgtcatgactccccagatgc

SEQ ID NO: 128687 - DNA, 75 bp, Artificial Sequence
  Synthetic
ctcgatgttgagagacccttcccatatcaccgccgagacggcagcgcgccgccttgcgcgcgggtcccctccatc

SEQ ID NO: 128688 - DNA, 75 bp, Artificial Sequence
  Synthetic
tctctcacagagaggctttacgttggggggcccatgtacaactctaagggccaactctgcggtcaacgcagatgc

SEQ ID NO: 128689 - DNA, 75 bp, Artificial Sequence
  Synthetic
tctctcactgagaggctttacgttggggggcccatgtacaactctaagggccaactctgcggtcaacgcagatgc

SEQ ID NO: 128690 - DNA, 75 bp, Artificial Sequence
  Synthetic
tctctcaccgagaggctttacgttggggggcccatgtacaactctaagggccaactctgcggtcaacgcagatgc

SEQ ID NO: 128691 - DNA, 75 bp, Artificial Sequence
  Synthetic
tctctcacggagaggctttacgttggggggcccatgtacaactctaagggccaactctgcggtcaacgcagatgc

SEQ ID NO: 128692 - DNA, 75 bp, Artificial Sequence
  Synthetic
ccaactctgcggtcaacgcagatgccgggcaagcggggtgctccccaccagtgcgggtaacaccctgacatgttt

SEQ ID NO: 128693 - DNA, 75 bp, Artificial Sequence
  Synthetic
tctcaatactccaaagccaggaagcccttgagaaagcactcgacttcgacatgtacggagtcacatactctatca

SEQ ID NO: 128694 - DNA, 75 bp, Artificial Sequence
  Synthetic
cttgccaagctcgagcaattttgggcgaagcatatgtggaacttcattagcggtatccaatacctagccgattta

SEQ ID NO: 128695 - DNA, 75 bp, Artificial Sequence
  Synthetic
agatcatcacctggggggcagacaccgcggcgtgtggggacatcatcttgggtctacccgtctccgcccgaaggg

SEQ ID NO: 128696 - DNA, 75 bp, Artificial Sequence
  Synthetic
cccacgggccggtcctggggtcaacccgggtacccttggcccctttatgccaatgagggcctcgggtgggcaggg

SEQ ID NO: 128697 - DNA, 75 bp, Artificial Sequence
  Synthetic
taggggggtgggtggcatcgcagatcgcgacccccacagcttccacagcttttgtcgtgagcggcctcgcagggg

SEQ ID NO: 128698 - DNA, 75 bp, Artificial Sequence
  Synthetic
ttgagagcgtggagacatcgggcccgagcagtccgcgctaagcttatcgctcagggaggtaaagccaaaatctgt

SEQ ID NO: 128699 - DNA, 75 bp, Artificial Sequence
  Synthetic
cacctggcaacttgccgacgcagtcctccaccttcctggatgcgtcccatgtgaaaataacaatggcaccccgcg

SEQ ID NO: 128700 - DNA, 75 bp, Artificial Sequence
  Synthetic
ttacatcgtgctcctccaacgtttccgtggcccacgatggagatggcagaagatactactacctcactcgtgacc

SEQ ID NO: 128701 - DNA, 75 bp, Artificial Sequence
  Synthetic
gattcgccgacctcatggggtacatcccgctcgtaggcggccccgttgggggcgtcgcaagggctctcgcacacg

SEQ ID NO: 128702 - DNA, 75 bp, Artificial Sequence
  Synthetic
tggcgaaacaccgtccacagaagaccttgtaaatcttctccctgccatattgtcaccgggagccctagtagtggg

SEQ ID NO: 128703 - DNA, 75 bp, Artificial Sequence
  Synthetic
tcatgtacgcccccgccatttgggtccgtatggtgctaatgacccatttctttcaaatactccaagcgcaggaga

SEQ ID NO: 128704 - DNA, 75 bp, Artificial Sequence
  Synthetic
tcatgtacgcccccgccatttgggtccgtatggtgcttatgacccatttctttcaaatactccaagcgcaggaga

SEQ ID NO: 128705 - DNA, 75 bp, Artificial Sequence
  Synthetic
tcatgtacgcccccgccatttgggtccgtatggtgctcatgacccatttctttcaaatactccaagcgcaggaga

SEQ ID NO: 128706 - DNA, 75 bp, Artificial Sequence
  Synthetic
tcatgtacgcccccgccatttgggtccgtatggtgctgatgacccatttctttcaaatactccaagcgcaggaga

SEQ ID NO: 128707 - DNA, 75 bp, Artificial Sequence
  Synthetic
ttgcacttctttcatgcctgactgtcccgacctctgccgttccctaccgaaatgcctctggggtttatcatgtca

SEQ ID NO: 128708 - DNA, 75 bp, Artificial Sequence
  Synthetic
gtgtctcccacgcactatgtccccgagaccgacgccgctgcccgcgtgacagccatcctgtcatctctcactgtg

SEQ ID NO: 128709 - DNA, 75 bp, Artificial Sequence
  Synthetic
catcaccggccaccgcatggcatgggacatgatgctaaactggtcaccaactctcaccatgattcttgcctatgc

SEQ ID NO: 128710 - DNA, 75 bp, Artificial Sequence
  Synthetic
gtgctgggtccagatcacccccacactgtcagccccgagcctcggagcggtcacggctcctcttcggagggccgt

SEQ ID NO: 128711 - DNA, 75 bp, Artificial Sequence
  Synthetic
cttgagagcttggagacatcgagcccgagcggtcagagccaagcttatcgcccagggagggaaagctgcaatatg

SEQ ID NO: 128712 - DNA, 75 bp, Artificial Sequence
  Synthetic
gtcgttgccatcctccttcttgtagcaggagtggatgcacacactcagctcaccggcacaaacgtgggtcggacc

SEQ ID NO: 128713 - DNA, 75 bp, Artificial Sequence
  Synthetic
tgttgagtgacttcaagacatggctcaagaccaagctgctgccccgcttgcctggcatcccctttctttcctgcc

SEQ ID NO: 128714 - DNA, 75 bp, Artificial Sequence
  Synthetic
caccggcacaaacgtgggtcggaccaccgcaggctttgctagtttgtttgctcctggcgcccggcaggaaatcag

SEQ ID NO: 128715 - DNA, 75 bp, Artificial Sequence
  Synthetic
gattacagggccgaagacctgcagcaacacctggcacggcactttccccatcaatgcttacactacggggcccag

SEQ ID NO: 128716 - DNA, 75 bp, Artificial Sequence
  Synthetic
gggtcttgttcgccgccgcatactacgcgtcggcggctaactgggccaaggttgtgctggtcctgtttctgtttg

SEQ ID NO: 128717 - DNA, 75 bp, Artificial Sequence
  Synthetic
tggtccatggctgcccgcttccacctccacagtcccctcctgtgcctccgcctcggaagaagcggacggtggtcc

SEQ ID NO: 128718 - DNA, 75 bp, Artificial Sequence
  Synthetic
atcagtcatgccaacggaagcggccccgaccaacggccctactgctggcactaccctccaaaaccttgtggtatt

SEQ ID NO: 128719 - DNA, 75 bp, Artificial Sequence
  Synthetic
gggatgactcgagatcacctcaagtgcccctgtcaggtcccggctcctgagttcttcacggaagtggacggtgtc

SEQ ID NO: 128720 - DNA, 75 bp, Artificial Sequence
  Synthetic
ctgctggcactaccctccgaagccttgcggtattgtctcggctaagacagtgtgcgggccagtctactgttttac

SEQ ID NO: 128721 - DNA, 75 bp, Artificial Sequence
  Synthetic
gcgagcctgagccagacgtagccgtgttgacatcaatgttcactgatccaggacacatgacggctgagacggcca

SEQ ID NO: 128722 - DNA, 75 bp, Artificial Sequence
  Synthetic
cccccgcaaggagcttggttcggctgcacttggatgaatgggactgggttcactaagacatgcggcgcaccacct

SEQ ID NO: 128723 - DNA, 75 bp, Artificial Sequence
  Synthetic
actatcagctatgccgccgtgtcgggccccagtgatgacaagccctattgctggcactaccccccacgcccgtgc

SEQ ID NO: 128724 - DNA, 75 bp, Artificial Sequence
  Synthetic
gccccagtgatgacaagccctattgctggcactaccccccacgcccgtgcggaatagtgccagcgcgaggtgtct

SEQ ID NO: 128725 - DNA, 75 bp, Artificial Sequence
  Synthetic
gtcgccgacctcatggggtacatccccgtcctaggggcgccgcttggcggcgtcgcggctgccctcgcacatggt

SEQ ID NO: 128726 - DNA, 75 bp, Artificial Sequence
  Synthetic
ctcccccgataccgacctcattgagggaaacctcttatggggtcttggtgtcacaagggttgagtcggaatcaaa

SEQ ID NO: 128727 - DNA, 75 bp, Artificial Sequence
  Synthetic
ctcccccgataccgacctcattgagggaaacctcttatggggtcttggtgtcactagggttgagtcggaatcaaa

SEQ ID NO: 128728 - DNA, 75 bp, Artificial Sequence
  Synthetic
ctcccccgataccgacctcattgagggaaacctcttatggggtcttggtgtcaccagggttgagtcggaatcaaa

SEQ ID NO: 128729 - DNA, 75 bp, Artificial Sequence
  Synthetic
ctcccccgataccgacctcattgagggaaacctcttatggggtcttggtgtcacgagggttgagtcggaatcaaa

SEQ ID NO: 128730 - DNA, 75 bp, Artificial Sequence
  Synthetic
gatagattacccttacagattgtggcattatccgtgcactgtaaattttaccatcttcaaggtgcggatgtatgt

SEQ ID NO: 128731 - DNA, 75 bp, Artificial Sequence
  Synthetic
ccatcttcaaggtgcggatgtatgttgggggggtagagcaccgcttggacgcggcgtgcaacttcacgcgtgggg

SEQ ID NO: 128732 - DNA, 75 bp, Artificial Sequence
  Synthetic
gccttgccgatctgggcgaggccagactacaacccacctttaatcgaggtgtggaagcagccagaatacagtcct

SEQ ID NO: 128733 - DNA, 75 bp, Artificial Sequence
  Synthetic
gccttgccgatctgggcgaggccagactacaacccacctttaatcgaggtgtggaagcagcctgaatacagtcct

SEQ ID NO: 128734 - DNA, 75 bp, Artificial Sequence
  Synthetic
gccttgccgatctgggcgaggccagactacaacccacctttaatcgaggtgtggaagcagcccgaatacagtcct

SEQ ID NO: 128735 - DNA, 75 bp, Artificial Sequence
  Synthetic
gccttgccgatctgggcgaggccagactacaacccacctttaatcgaggtgtggaagcagccggaatacagtcct

SEQ ID NO: 128736 - DNA, 75 bp, Artificial Sequence
  Synthetic
gccttaagtgtcctactgattgcttccgcaagcacccagacgccacctacaccaagtgtgggtcaggaccctggc

SEQ ID NO: 128737 - DNA, 75 bp, Artificial Sequence
  Synthetic
accaagacaggcaatacatcgcaatgctggttacccgttgctcccacactcgctgtcccgaatgccaccgtgccg

SEQ ID NO: 128738 - DNA, 75 bp, Artificial Sequence
  Synthetic
gcgctctagcgagcctggctgagaagaccttctgcaaatcggaggcggaaacggattcggggaaagggctcacct

SEQ ID NO: 128739 - DNA, 75 bp, Artificial Sequence
  Synthetic
cccttaccggttgtggcattacccgtgcaccctaaattacaccatcttcaaggtgcgcatgtacattgggggcct

SEQ ID NO: 128740 - DNA, 75 bp, Artificial Sequence
  Synthetic
cgagcacaggctcgaggtggcatgcaactggacccgtggtgagcggtgtgatcttgaagacagggatagggccga

SEQ ID NO: 128741 - DNA, 75 bp, Artificial Sequence
  Synthetic
ccgctgggcaattggttcggttgtacctggatgaactcaactggattcaccaaagtgtgcggagcgcccccctgt

SEQ ID NO: 128742 - DNA, 75 bp, Artificial Sequence
  Synthetic
agcttatcatcttgcactccgctagcgctgctagtgccaatgggccgctatggttcttcatcttctttatagcgg

SEQ ID NO: 128743 - DNA, 75 bp, Artificial Sequence
  Synthetic
cctggtacttaaagggcagggtggtccccgcggccacatactctgttctcggcttgtggtcctttctcctcctag

SEQ ID NO: 128744 - DNA, 75 bp, Artificial Sequence
  Synthetic
ccctgacctgacagatggctcttggtccaccgttagcgaatcgggtgacgtcgtgtgttgctcaatgtcatactc

SEQ ID NO: 128745 - DNA, 75 bp, Artificial Sequence
  Synthetic
aatatagtagacacccagtatctttacggtctgagctccagcatcgtctcgtgggccgttaagtgggagtacata

SEQ ID NO: 128746 - DNA, 75 bp, Artificial Sequence
  Synthetic
tccacgacctctcgttccgccgcggccaggcaaaagaaagtcacctttgaccgcatgcaggtggtagacagccat

SEQ ID NO: 128747 - DNA, 75 bp, Artificial Sequence
  Synthetic
ccaggcaaaagaaagtcacctttgaccgcatgcaggtggtagacagccattacaatgaagttctaaaggagatta

SEQ ID NO: 128748 - DNA, 75 bp, Artificial Sequence
  Synthetic
ctcgtcatctgcttcgcctggcacttcaagggcaggttggtccctggggccacctacctttgcttgggcatttgg

SEQ ID NO: 128749 - DNA, 75 bp, Artificial Sequence
  Synthetic
gggcagctgtcattctacacccacgccttgtgtttgagatcacgaagtggttactggcaatcctggggcctgcct

SEQ ID NO: 128750 - DNA, 75 bp, Artificial Sequence
  Synthetic
tcaagggcaggttggtccctggggccacctacctttgcttgggcatttggccattactcttactccttttcctcc

SEQ ID NO: 128751 - DNA, 75 bp, Artificial Sequence
  Synthetic
atgagcagttgcaagccactacatgcatttgaccaaggctgggggcctctctcatatgccaacataagtggttcg

SEQ ID NO: 128752 - DNA, 75 bp, Artificial Sequence
  Synthetic
tcttcacactcacccccgggtacaagaagatggtagtgttggtcatatggtggcttcagtatttcatagcccggg

SEQ ID NO: 128753 - DNA, 75 bp, Artificial Sequence
  Synthetic
ggcaggtggaccggcacttacatctatgaccacctctcccctttgtcaacttgggcagcccagggtttacgggac

SEQ ID NO: 128754 - DNA, 75 bp, Artificial Sequence
  Synthetic
ggtgtggtgtttggcttggcctatttctccatgcaaggagcgtgggccaaagtcatcgccatcctccttcttgtt

SEQ ID NO: 128755 - DNA, 75 bp, Artificial Sequence
  Synthetic
cctgtctactgcttcacccctagtcctgtagtaattggcaccactgacaggaaggggcttcccacgtacgcttgg

SEQ ID NO: 128756 - DNA, 75 bp, Artificial Sequence
  Synthetic
gatctgtcggtccaggtgtgcgagaagagggcgctttatgacgtcgtcaagcaacttccagaggccgtgatggga

SEQ ID NO: 128757 - DNA, 75 bp, Artificial Sequence
  Synthetic
gatctgtcggtcctggtgtgcgagaagagggcgctttatgacgtcgtcaagcaacttccagaggccgtgatggga

SEQ ID NO: 128758 - DNA, 75 bp, Artificial Sequence
  Synthetic
gatctgtcggtcccggtgtgcgagaagagggcgctttatgacgtcgtcaagcaacttccagaggccgtgatggga

SEQ ID NO: 128759 - DNA, 75 bp, Artificial Sequence
  Synthetic
gatctgtcggtccgggtgtgcgagaagagggcgctttatgacgtcgtcaagcaacttccagaggccgtgatggga

SEQ ID NO: 128760 - DNA, 75 bp, Artificial Sequence
  Synthetic
agagggcgctttatgacgtcgtcaagcaacttccagaggccgtgatgggagccgcatacggcttccagtactctc

SEQ ID NO: 128761 - DNA, 75 bp, Artificial Sequence
  Synthetic
tgaggtcacgaaaatcctcctcgggatactaggtcctttgtacctgctgcagtactcgctcatcaagctgcctta

SEQ ID NO: 128762 - DNA, 75 bp, Artificial Sequence
  Synthetic
atgaactccacggggttcgtaaagacatgcggcgcccccccctgtaacatcacaccagggggcagtggcaacagc

SEQ ID NO: 128763 - DNA, 75 bp, Artificial Sequence
  Synthetic
aaaggacattagggttgaggaagaggtctatcagtgttgtaacctggagccggaggcccgtagggtgataacagc

SEQ ID NO: 128764 - DNA, 75 bp, Artificial Sequence
  Synthetic
caagttcaacagctctggctgccccgagcgcttgtcttcctgccgcgggctggacgattttcgcatcggctgggg

SEQ ID NO: 128765 - DNA, 75 bp, Artificial Sequence
  Synthetic
ttgcccccatgaaggattgggcagcgtccgggctgcgcgacttagcagtggccacggagcccatcatattctccc

SEQ ID NO: 128766 - DNA, 75 bp, Artificial Sequence
  Synthetic
ttcgggaacacactaacatgctaccttaaggcttcggctgctgttagggccgcaggcctaaagggctgcaccatg

SEQ ID NO: 128767 - DNA, 75 bp, Artificial Sequence
  Synthetic
cggctcctcctggagacgtcccgcaaccagcatatgacctggagctcataacatcatgctcatccaatgtctcgg

SEQ ID NO: 128768 - DNA, 75 bp, Artificial Sequence
  Synthetic
ggctgatgtttctcattggccaagtggaagccgccttggagaaccttatcgttcttaacgccacatccgctgcta

SEQ ID NO: 128769 - DNA, 75 bp, Artificial Sequence
  Synthetic
gccatactcggtccgctcatggtgctccaggctggcataactagagtgccgtacttcgtgcgcgctcaagggctc

SEQ ID NO: 128770 - DNA, 75 bp, Artificial Sequence
  Synthetic
cagaacgccacaacttcacccaagagtgcaactgttccatctaccaaggtcatatcaccggccaccgcatggcat

SEQ ID NO: 128771 - DNA, 75 bp, Artificial Sequence
  Synthetic
tacgggaggaggtcacattccaggtcgggctcaaccaatacctggttgggtcacagctcccatgcgagcccgaac

SEQ ID NO: 128772 - DNA, 75 bp, Artificial Sequence
  Synthetic
tccaggctggcataactagagtgccgtacttcgtgcgcgctcaagggctcattcgtgcatgcatgttggtgcgga

SEQ ID NO: 128773 - DNA, 75 bp, Artificial Sequence
  Synthetic
ggacgggattaattatgcaacagggaaccttcccggttgctctttctctatcttccttctggcacttctctcgtg

SEQ ID NO: 128774 - DNA, 75 bp, Artificial Sequence
  Synthetic
tggctgtgaaataccacggagcactcacccacaacctgcgaacgcatgtcgacatgatcgtaatggctgctacgg

SEQ ID NO: 128775 - DNA, 75 bp, Artificial Sequence
  Synthetic
tgtgtcaactgctgcccaaaccttcctggcaacgtgcatcaatggggtatgctggactgtctatcacggggccgg

SEQ ID NO: 128776 - DNA, 75 bp, Artificial Sequence
  Synthetic
cattatcacaacacctcgggcatctatcacatcactaatgattgccctaactctagcatagtctttgagtcagac

SEQ ID NO: 128777 - DNA, 75 bp, Artificial Sequence
  Synthetic
ccgcgcgtggccttactagcttgtttaccaatggccccagccagcgcatcaatttaatcaacaccaatggcagct

SEQ ID NO: 128778 - DNA, 75 bp, Artificial Sequence
  Synthetic
ccgcgcgtggccttactagcttgtttaccattggccccagccagcgcatcaatttaatcaacaccaatggcagct

SEQ ID NO: 128779 - DNA, 75 bp, Artificial Sequence
  Synthetic
ccgcgcgtggccttactagcttgtttaccactggccccagccagcgcatcaatttaatcaacaccaatggcagct

SEQ ID NO: 128780 - DNA, 75 bp, Artificial Sequence
  Synthetic
ccgcgcgtggccttactagcttgtttaccagtggccccagccagcgcatcaatttaatcaacaccaatggcagct

SEQ ID NO: 128781 - DNA, 75 bp, Artificial Sequence
  Synthetic
ccgcgcgtggccttacttgcttgtttaccaatggccccagccagcgcatcaatttaatcaacaccaatggcagct

SEQ ID NO: 128782 - DNA, 75 bp, Artificial Sequence
  Synthetic
ccgcgcgtggccttacttgcttgtttaccattggccccagccagcgcatcaatttaatcaacaccaatggcagct

SEQ ID NO: 128783 - DNA, 75 bp, Artificial Sequence
  Synthetic
ccgcgcgtggccttacttgcttgtttaccactggccccagccagcgcatcaatttaatcaacaccaatggcagct

SEQ ID NO: 128784 - DNA, 75 bp, Artificial Sequence
  Synthetic
ccgcgcgtggccttacttgcttgtttaccagtggccccagccagcgcatcaatttaatcaacaccaatggcagct

SEQ ID NO: 128785 - DNA, 75 bp, Artificial Sequence
  Synthetic
ccgcgcgtggccttactcgcttgtttaccaatggccccagccagcgcatcaatttaatcaacaccaatggcagct

SEQ ID NO: 128786 - DNA, 75 bp, Artificial Sequence
  Synthetic
ccgcgcgtggccttactcgcttgtttaccattggccccagccagcgcatcaatttaatcaacaccaatggcagct

SEQ ID NO: 128787 - DNA, 75 bp, Artificial Sequence
  Synthetic
ccgcgcgtggccttactcgcttgtttaccactggccccagccagcgcatcaatttaatcaacaccaatggcagct

SEQ ID NO: 128788 - DNA, 75 bp, Artificial Sequence
  Synthetic
ccgcgcgtggccttactcgcttgtttaccagtggccccagccagcgcatcaatttaatcaacaccaatggcagct

SEQ ID NO: 128789 - DNA, 75 bp, Artificial Sequence
  Synthetic
ccgcgcgtggccttactggcttgtttaccaatggccccagccagcgcatcaatttaatcaacaccaatggcagct

SEQ ID NO: 128790 - DNA, 75 bp, Artificial Sequence
  Synthetic
ccgcgcgtggccttactggcttgtttaccattggccccagccagcgcatcaatttaatcaacaccaatggcagct

SEQ ID NO: 128791 - DNA, 75 bp, Artificial Sequence
  Synthetic
ccgcgcgtggccttactggcttgtttaccactggccccagccagcgcatcaatttaatcaacaccaatggcagct

SEQ ID NO: 128792 - DNA, 75 bp, Artificial Sequence
  Synthetic
ccgcgcgtggccttactggcttgtttaccagtggccccagccagcgcatcaatttaatcaacaccaatggcagct

SEQ ID NO: 128793 - DNA, 75 bp, Artificial Sequence
  Synthetic
ccgcgcgtggcctttctagcttgtttaccaatggccccagccagcgcatcaatttaatcaacaccaatggcagct

SEQ ID NO: 128794 - DNA, 75 bp, Artificial Sequence
  Synthetic
ccgcgcgtggcctttctagcttgtttaccattggccccagccagcgcatcaatttaatcaacaccaatggcagct

SEQ ID NO: 128795 - DNA, 75 bp, Artificial Sequence
  Synthetic
ccgcgcgtggcctttctagcttgtttaccactggccccagccagcgcatcaatttaatcaacaccaatggcagct

SEQ ID NO: 128796 - DNA, 75 bp, Artificial Sequence
  Synthetic
ccgcgcgtggcctttctagcttgtttaccagtggccccagccagcgcatcaatttaatcaacaccaatggcagct

SEQ ID NO: 128797 - DNA, 75 bp, Artificial Sequence
  Synthetic
ccgcgcgtggcctttcttgcttgtttaccaatggccccagccagcgcatcaatttaatcaacaccaatggcagct

SEQ ID NO: 128798 - DNA, 75 bp, Artificial Sequence
  Synthetic
ccgcgcgtggcctttcttgcttgtttaccattggccccagccagcgcatcaatttaatcaacaccaatggcagct

SEQ ID NO: 128799 - DNA, 75 bp, Artificial Sequence
  Synthetic
ccgcgcgtggcctttcttgcttgtttaccactggccccagccagcgcatcaatttaatcaacaccaatggcagct

SEQ ID NO: 128800 - DNA, 75 bp, Artificial Sequence
  Synthetic
ccgcgcgtggcctttcttgcttgtttaccagtggccccagccagcgcatcaatttaatcaacaccaatggcagct

SEQ ID NO: 128801 - DNA, 75 bp, Artificial Sequence
  Synthetic
ccgcgcgtggcctttctcgcttgtttaccaatggccccagccagcgcatcaatttaatcaacaccaatggcagct

SEQ ID NO: 128802 - DNA, 75 bp, Artificial Sequence
  Synthetic
ccgcgcgtggcctttctcgcttgtttaccattggccccagccagcgcatcaatttaatcaacaccaatggcagct

SEQ ID NO: 128803 - DNA, 75 bp, Artificial Sequence
  Synthetic
ccgcgcgtggcctttctcgcttgtttaccactggccccagccagcgcatcaatttaatcaacaccaatggcagct

SEQ ID NO: 128804 - DNA, 75 bp, Artificial Sequence
  Synthetic
ccgcgcgtggcctttctcgcttgtttaccagtggccccagccagcgcatcaatttaatcaacaccaatggcagct

SEQ ID NO: 128805 - DNA, 75 bp, Artificial Sequence
  Synthetic
ccgcgcgtggcctttctggcttgtttaccaatggccccagccagcgcatcaatttaatcaacaccaatggcagct

SEQ ID NO: 128806 - DNA, 75 bp, Artificial Sequence
  Synthetic
ccgcgcgtggcctttctggcttgtttaccattggccccagccagcgcatcaatttaatcaacaccaatggcagct

SEQ ID NO: 128807 - DNA, 75 bp, Artificial Sequence
  Synthetic
ccgcgcgtggcctttctggcttgtttaccactggccccagccagcgcatcaatttaatcaacaccaatggcagct

SEQ ID NO: 128808 - DNA, 75 bp, Artificial Sequence
  Synthetic
ccgcgcgtggcctttctggcttgtttaccagtggccccagccagcgcatcaatttaatcaacaccaatggcagct

SEQ ID NO: 128809 - DNA, 75 bp, Artificial Sequence
  Synthetic
ccgcgcgtggccttcctagcttgtttaccaatggccccagccagcgcatcaatttaatcaacaccaatggcagct

SEQ ID NO: 128810 - DNA, 75 bp, Artificial Sequence
  Synthetic
ccgcgcgtggccttcctagcttgtttaccattggccccagccagcgcatcaatttaatcaacaccaatggcagct

SEQ ID NO: 128811 - DNA, 75 bp, Artificial Sequence
  Synthetic
ccgcgcgtggccttcctagcttgtttaccactggccccagccagcgcatcaatttaatcaacaccaatggcagct

SEQ ID NO: 128812 - DNA, 75 bp, Artificial Sequence
  Synthetic
ccgcgcgtggccttcctagcttgtttaccagtggccccagccagcgcatcaatttaatcaacaccaatggcagct

SEQ ID NO: 128813 - DNA, 75 bp, Artificial Sequence
  Synthetic
ccgcgcgtggccttccttgcttgtttaccaatggccccagccagcgcatcaatttaatcaacaccaatggcagct

SEQ ID NO: 128814 - DNA, 75 bp, Artificial Sequence
  Synthetic
ccgcgcgtggccttccttgcttgtttaccattggccccagccagcgcatcaatttaatcaacaccaatggcagct

SEQ ID NO: 128815 - DNA, 75 bp, Artificial Sequence
  Synthetic
ccgcgcgtggccttccttgcttgtttaccactggccccagccagcgcatcaatttaatcaacaccaatggcagct

SEQ ID NO: 128816 - DNA, 75 bp, Artificial Sequence
  Synthetic
ccgcgcgtggccttccttgcttgtttaccagtggccccagccagcgcatcaatttaatcaacaccaatggcagct

SEQ ID NO: 128817 - DNA, 75 bp, Artificial Sequence
  Synthetic
ccgcgcgtggccttcctcgcttgtttaccaatggccccagccagcgcatcaatttaatcaacaccaatggcagct

SEQ ID NO: 128818 - DNA, 75 bp, Artificial Sequence
  Synthetic
ccgcgcgtggccttcctcgcttgtttaccattggccccagccagcgcatcaatttaatcaacaccaatggcagct

SEQ ID NO: 128819 - DNA, 75 bp, Artificial Sequence
  Synthetic
ccgcgcgtggccttcctcgcttgtttaccactggccccagccagcgcatcaatttaatcaacaccaatggcagct

SEQ ID NO: 128820 - DNA, 75 bp, Artificial Sequence
  Synthetic
ccgcgcgtggccttcctcgcttgtttaccagtggccccagccagcgcatcaatttaatcaacaccaatggcagct

SEQ ID NO: 128821 - DNA, 75 bp, Artificial Sequence
  Synthetic
ccgcgcgtggccttcctggcttgtttaccaatggccccagccagcgcatcaatttaatcaacaccaatggcagct

SEQ ID NO: 128822 - DNA, 75 bp, Artificial Sequence
  Synthetic
ccgcgcgtggccttcctggcttgtttaccattggccccagccagcgcatcaatttaatcaacaccaatggcagct

SEQ ID NO: 128823 - DNA, 75 bp, Artificial Sequence
  Synthetic
ccgcgcgtggccttcctggcttgtttaccactggccccagccagcgcatcaatttaatcaacaccaatggcagct

SEQ ID NO: 128824 - DNA, 75 bp, Artificial Sequence
  Synthetic
ccgcgcgtggccttcctggcttgtttaccagtggccccagccagcgcatcaatttaatcaacaccaatggcagct

SEQ ID NO: 128825 - DNA, 75 bp, Artificial Sequence
  Synthetic
ccgcgcgtggccttgctagcttgtttaccaatggccccagccagcgcatcaatttaatcaacaccaatggcagct

SEQ ID NO: 128826 - DNA, 75 bp, Artificial Sequence
  Synthetic
ccgcgcgtggccttgctagcttgtttaccattggccccagccagcgcatcaatttaatcaacaccaatggcagct

SEQ ID NO: 128827 - DNA, 75 bp, Artificial Sequence
  Synthetic
ccgcgcgtggccttgctagcttgtttaccactggccccagccagcgcatcaatttaatcaacaccaatggcagct

SEQ ID NO: 128828 - DNA, 75 bp, Artificial Sequence
  Synthetic
ccgcgcgtggccttgctagcttgtttaccagtggccccagccagcgcatcaatttaatcaacaccaatggcagct

SEQ ID NO: 128829 - DNA, 75 bp, Artificial Sequence
  Synthetic
ccgcgcgtggccttgcttgcttgtttaccaatggccccagccagcgcatcaatttaatcaacaccaatggcagct

SEQ ID NO: 128830 - DNA, 75 bp, Artificial Sequence
  Synthetic
ccgcgcgtggccttgcttgcttgtttaccattggccccagccagcgcatcaatttaatcaacaccaatggcagct

SEQ ID NO: 128831 - DNA, 75 bp, Artificial Sequence
  Synthetic
ccgcgcgtggccttgcttgcttgtttaccactggccccagccagcgcatcaatttaatcaacaccaatggcagct

SEQ ID NO: 128832 - DNA, 75 bp, Artificial Sequence
  Synthetic
ccgcgcgtggccttgcttgcttgtttaccagtggccccagccagcgcatcaatttaatcaacaccaatggcagct

SEQ ID NO: 128833 - DNA, 75 bp, Artificial Sequence
  Synthetic
ccgcgcgtggccttgctcgcttgtttaccaatggccccagccagcgcatcaatttaatcaacaccaatggcagct

SEQ ID NO: 128834 - DNA, 75 bp, Artificial Sequence
  Synthetic
ccgcgcgtggccttgctcgcttgtttaccattggccccagccagcgcatcaatttaatcaacaccaatggcagct

SEQ ID NO: 128835 - DNA, 75 bp, Artificial Sequence
  Synthetic
ccgcgcgtggccttgctcgcttgtttaccactggccccagccagcgcatcaatttaatcaacaccaatggcagct

SEQ ID NO: 128836 - DNA, 75 bp, Artificial Sequence
  Synthetic
ccgcgcgtggccttgctcgcttgtttaccagtggccccagccagcgcatcaatttaatcaacaccaatggcagct

SEQ ID NO: 128837 - DNA, 75 bp, Artificial Sequence
  Synthetic
ccgcgcgtggccttgctggcttgtttaccaatggccccagccagcgcatcaatttaatcaacaccaatggcagct

SEQ ID NO: 128838 - DNA, 75 bp, Artificial Sequence
  Synthetic
ccgcgcgtggccttgctggcttgtttaccattggccccagccagcgcatcaatttaatcaacaccaatggcagct

SEQ ID NO: 128839 - DNA, 75 bp, Artificial Sequence
  Synthetic
ccgcgcgtggccttgctggcttgtttaccactggccccagccagcgcatcaatttaatcaacaccaatggcagct

SEQ ID NO: 128840 - DNA, 75 bp, Artificial Sequence
  Synthetic
ccgcgcgtggccttgctggcttgtttaccagtggccccagccagcgcatcaatttaatcaacaccaatggcagct

SEQ ID NO: 128841 - DNA, 75 bp, Artificial Sequence
  Synthetic
tcggtgctccacttgagtccatgcggcgtcatgtggacatgatggtgggcgctgccacattgtgctccgcacttt

SEQ ID NO: 128842 - DNA, 75 bp, Artificial Sequence
  Synthetic
tcggtgctccacttgagtccatgcggcgtcatgtggacttgatggtgggcgctgccacattgtgctccgcacttt

SEQ ID NO: 128843 - DNA, 75 bp, Artificial Sequence
  Synthetic
tcggtgctccacttgagtccatgcggcgtcatgtggacctgatggtgggcgctgccacattgtgctccgcacttt

SEQ ID NO: 128844 - DNA, 75 bp, Artificial Sequence
  Synthetic
tcggtgctccacttgagtccatgcggcgtcatgtggacgtgatggtgggcgctgccacattgtgctccgcacttt

SEQ ID NO: 128845 - DNA, 75 bp, Artificial Sequence
  Synthetic
ttactcacttccctgttttatgtcaacaacttcaacagctctggctgtcctgcacgcctgtcctcctgccgtacg

SEQ ID NO: 128846 - DNA, 75 bp, Artificial Sequence
  Synthetic
ttactctcttccctgttttatgtcaacaacttcaacagctctggctgtcctgcacgcctgtcctcctgccgtacg

SEQ ID NO: 128847 - DNA, 75 bp, Artificial Sequence
  Synthetic
ttactcccttccctgttttatgtcaacaacttcaacagctctggctgtcctgcacgcctgtcctcctgccgtacg

SEQ ID NO: 128848 - DNA, 75 bp, Artificial Sequence
  Synthetic
ttactcgcttccctgttttatgtcaacaacttcaacagctctggctgtcctgcacgcctgtcctcctgccgtacg

SEQ ID NO: 128849 - DNA, 75 bp, Artificial Sequence
  Synthetic
tttctcacttccctgttttatgtcaacaacttcaacagctctggctgtcctgcacgcctgtcctcctgccgtacg

SEQ ID NO: 128850 - DNA, 75 bp, Artificial Sequence
  Synthetic
tttctctcttccctgttttatgtcaacaacttcaacagctctggctgtcctgcacgcctgtcctcctgccgtacg

SEQ ID NO: 128851 - DNA, 75 bp, Artificial Sequence
  Synthetic
tttctcccttccctgttttatgtcaacaacttcaacagctctggctgtcctgcacgcctgtcctcctgccgtacg

SEQ ID NO: 128852 - DNA, 75 bp, Artificial Sequence
  Synthetic
tttctcgcttccctgttttatgtcaacaacttcaacagctctggctgtcctgcacgcctgtcctcctgccgtacg

SEQ ID NO: 128853 - DNA, 75 bp, Artificial Sequence
  Synthetic
ttcctcacttccctgttttatgtcaacaacttcaacagctctggctgtcctgcacgcctgtcctcctgccgtacg

SEQ ID NO: 128854 - DNA, 75 bp, Artificial Sequence
  Synthetic
ttcctctcttccctgttttatgtcaacaacttcaacagctctggctgtcctgcacgcctgtcctcctgccgtacg

SEQ ID NO: 128855 - DNA, 75 bp, Artificial Sequence
  Synthetic
ttcctcccttccctgttttatgtcaacaacttcaacagctctggctgtcctgcacgcctgtcctcctgccgtacg

SEQ ID NO: 128856 - DNA, 75 bp, Artificial Sequence
  Synthetic
ttcctcgcttccctgttttatgtcaacaacttcaacagctctggctgtcctgcacgcctgtcctcctgccgtacg

SEQ ID NO: 128857 - DNA, 75 bp, Artificial Sequence
  Synthetic
ttgctcacttccctgttttatgtcaacaacttcaacagctctggctgtcctgcacgcctgtcctcctgccgtacg

SEQ ID NO: 128858 - DNA, 75 bp, Artificial Sequence
  Synthetic
ttgctctcttccctgttttatgtcaacaacttcaacagctctggctgtcctgcacgcctgtcctcctgccgtacg

SEQ ID NO: 128859 - DNA, 75 bp, Artificial Sequence
  Synthetic
ttgctcccttccctgttttatgtcaacaacttcaacagctctggctgtcctgcacgcctgtcctcctgccgtacg

SEQ ID NO: 128860 - DNA, 75 bp, Artificial Sequence
  Synthetic
ttgctcgcttccctgttttatgtcaacaacttcaacagctctggctgtcctgcacgcctgtcctcctgccgtacg

SEQ ID NO: 128861 - DNA, 75 bp, Artificial Sequence
  Synthetic
aaccaggtggagggtgagatccagattgtgtccaccgcgacgcaaaccttcctggcaacctgcgtcaatggcgtg

SEQ ID NO: 128862 - DNA, 75 bp, Artificial Sequence
  Synthetic
ccgcgcatgcatgacccttcggggtattgcaggcgggaagtacgctcaagctttattgctaaagctgggtgcatg

SEQ ID NO: 128863 - DNA, 75 bp, Artificial Sequence
  Synthetic
ctcgggccatatcacaggtcatagaatggcgtgggacatgatgatgaactggagccctaccaccgctctggtaat

SEQ ID NO: 128864 - DNA, 75 bp, Artificial Sequence
  Synthetic
ctcgggccatatcacaggtcatagaatggcgtgggacatgatgatgaactggagccctaccaccgctctggttat

SEQ ID NO: 128865 - DNA, 75 bp, Artificial Sequence
  Synthetic
ctcgggccatatcacaggtcatagaatggcgtgggacatgatgatgaactggagccctaccaccgctctggtcat

SEQ ID NO: 128866 - DNA, 75 bp, Artificial Sequence
  Synthetic
ctcgggccatatcacaggtcatagaatggcgtgggacatgatgatgaactggagccctaccaccgctctggtgat

SEQ ID NO: 128867 - DNA, 75 bp, Artificial Sequence
  Synthetic
tgtaggggtaggcgtcttcctgctgcctgctcggtaggcggcttaacactccgaccttaggtcatccttacgttt

SEQ ID NO: 128868 - DNA, 75 bp, Artificial Sequence
  Synthetic
tgtaggggtaggcgtcttcctgctgcctgctcggttggcggcttaacactccgaccttaggtcatccttacgttt

SEQ ID NO: 128869 - DNA, 75 bp, Artificial Sequence
  Synthetic
tgtaggggtaggcgtcttcctgctgcctgctcggtcggcggcttaacactccgaccttaggtcatccttacgttt

SEQ ID NO: 128870 - DNA, 75 bp, Artificial Sequence
  Synthetic
tgtaggggtaggcgtcttcctgctgcctgctcggtgggcggcttaacactccgaccttaggtcatccttacgttt

SEQ ID NO: 128871 - DNA, 75 bp, Artificial Sequence
  Synthetic
gggccgtgcagctgcggggttcactggcttatttaccactggtgccaagcagaacatccaattgattaacaccaa

SEQ ID NO: 128872 - DNA, 75 bp, Artificial Sequence
  Synthetic
cagcatacaagatcctcctgagccgttcagtgtggtggctgtcctacatgctggtcttggccgaggcccagattc

SEQ ID NO: 128873 - DNA, 75 bp, Artificial Sequence
  Synthetic
tgggctaaagtcatcctgattttattcatctttgccggggtcgacgcgaacacgcagatcactggaggcgccgct

SEQ ID NO: 128874 - DNA, 75 bp, Artificial Sequence
  Synthetic
tgggctaaagtcatcctgattttattcatctttgccggggtcgacgcgaacacgcagatcactggtggcgccgct

SEQ ID NO: 128875 - DNA, 75 bp, Artificial Sequence
  Synthetic
tgggctaaagtcatcctgattttattcatctttgccggggtcgacgcgaacacgcagatcactggcggcgccgct

SEQ ID NO: 128876 - DNA, 75 bp, Artificial Sequence
  Synthetic
tgggctaaagtcatcctgattttattcatctttgccggggtcgacgcgaacacgcagatcactgggggcgccgct

SEQ ID NO: 128877 - DNA, 75 bp, Artificial Sequence
  Synthetic
tgggctaaagtcatcctgattttattcttctttgccggggtcgacgcgaacacgcagatcactggaggcgccgct

SEQ ID NO: 128878 - DNA, 75 bp, Artificial Sequence
  Synthetic
tgggctaaagtcatcctgattttattcttctttgccggggtcgacgcgaacacgcagatcactggtggcgccgct

SEQ ID NO: 128879 - DNA, 75 bp, Artificial Sequence
  Synthetic
tgggctaaagtcatcctgattttattcttctttgccggggtcgacgcgaacacgcagatcactggcggcgccgct

SEQ ID NO: 128880 - DNA, 75 bp, Artificial Sequence
  Synthetic
tgggctaaagtcatcctgattttattcttctttgccggggtcgacgcgaacacgcagatcactgggggcgccgct

SEQ ID NO: 128881 - DNA, 75 bp, Artificial Sequence
  Synthetic
tgggctaaagtcatcctgattttattcctctttgccggggtcgacgcgaacacgcagatcactggaggcgccgct

SEQ ID NO: 128882 - DNA, 75 bp, Artificial Sequence
  Synthetic
tgggctaaagtcatcctgattttattcctctttgccggggtcgacgcgaacacgcagatcactggtggcgccgct

SEQ ID NO: 128883 - DNA, 75 bp, Artificial Sequence
  Synthetic
tgggctaaagtcatcctgattttattcctctttgccggggtcgacgcgaacacgcagatcactggcggcgccgct

SEQ ID NO: 128884 - DNA, 75 bp, Artificial Sequence
  Synthetic
tgggctaaagtcatcctgattttattcctctttgccggggtcgacgcgaacacgcagatcactgggggcgccgct

SEQ ID NO: 128885 - DNA, 75 bp, Artificial Sequence
  Synthetic
tgggctaaagtcatcctgattttattcgtctttgccggggtcgacgcgaacacgcagatcactggaggcgccgct

SEQ ID NO: 128886 - DNA, 75 bp, Artificial Sequence
  Synthetic
tgggctaaagtcatcctgattttattcgtctttgccggggtcgacgcgaacacgcagatcactggtggcgccgct

SEQ ID NO: 128887 - DNA, 75 bp, Artificial Sequence
  Synthetic
tgggctaaagtcatcctgattttattcgtctttgccggggtcgacgcgaacacgcagatcactggcggcgccgct

SEQ ID NO: 128888 - DNA, 75 bp, Artificial Sequence
  Synthetic
tgggctaaagtcatcctgattttattcgtctttgccggggtcgacgcgaacacgcagatcactgggggcgccgct

SEQ ID NO: 128889 - DNA, 75 bp, Artificial Sequence
  Synthetic
ccgaggggggcgtgacgggatcatctgggtggctgtcattctacacccacgccttgtgtttgaggtcacgaaatg

SEQ ID NO: 128890 - DNA, 75 bp, Artificial Sequence
  Synthetic
ccctcagttgtgatgatagcttgcagacaggattcattgccggcctgttctaccgccataaattcaacagctccg

SEQ ID NO: 128891 - DNA, 75 bp, Artificial Sequence
  Synthetic
ctggtggattacccctatagattgtggcactatccgtgaactgtgaattttaccatcttcaaagtgcggatgtac

SEQ ID NO: 128892 - DNA, 75 bp, Artificial Sequence
  Synthetic
ctggtggattacccctatagattgtggcactatccgtgtactgtgaattttaccatcttcaaagtgcggatgtac

SEQ ID NO: 128893 - DNA, 75 bp, Artificial Sequence
  Synthetic
ctggtggattacccctatagattgtggcactatccgtgcactgtgaattttaccatcttcaaagtgcggatgtac

SEQ ID NO: 128894 - DNA, 75 bp, Artificial Sequence
  Synthetic
ctggtggattacccctatagattgtggcactatccgtggactgtgaattttaccatcttcaaagtgcggatgtac

SEQ ID NO: 128895 - DNA, 75 bp, Artificial Sequence
  Synthetic
caggccaataggccatcctgttttttttttttttttttttttttttttttttttttttttttttttttttttttt

SEQ ID NO: 128896 - DNA, 75 bp, Artificial Sequence
  Synthetic
tagcacaagacccccgcaaggagcttggttcggctgcacttggatgaacgggactgggttcactaagacgtgcgg

SEQ ID NO: 128897 - DNA, 75 bp, Artificial Sequence
  Synthetic
tggttcggctgcacttggatgaacgggactgggttcactaagacgtgcggagcaccaccttgccgcattaggagg

SEQ ID NO: 128898 - DNA, 75 bp, Artificial Sequence
  Synthetic
tacgcagcccaagggtacaaggtacttgtcctgaacccgtccgttgccgccaccttaggttttggggcgtatatg

SEQ ID NO: 128899 - DNA, 75 bp, Artificial Sequence
  Synthetic
accttactgctggcactaagcgcctcgccaatgcggggtagtgcctgcatccacagtgtgtggccctgtttactg

SEQ ID NO: 128900 - DNA, 75 bp, Artificial Sequence
  Synthetic
accttactgctggcactatgcgcctcgccaatgcggggtagtgcctgcatccacagtgtgtggccctgtttactg

SEQ ID NO: 128901 - DNA, 75 bp, Artificial Sequence
  Synthetic
accttactgctggcactacgcgcctcgccaatgcggggtagtgcctgcatccacagtgtgtggccctgtttactg

SEQ ID NO: 128902 - DNA, 75 bp, Artificial Sequence
  Synthetic
accttactgctggcactaggcgcctcgccaatgcggggtagtgcctgcatccacagtgtgtggccctgtttactg

SEQ ID NO: 128903 - DNA, 75 bp, Artificial Sequence
  Synthetic
gggggggagacatctcatcttctgtcactcaaagaagaagtgtgacgagctcgccgcgaagctggtcgcattggg

SEQ ID NO: 128904 - DNA, 75 bp, Artificial Sequence
  Synthetic
gacagaggtcaacagagtccactattgcattccaccactgaatgggcggtattaccatgctctttctctgacttg

SEQ ID NO: 128905 - DNA, 75 bp, Artificial Sequence
  Synthetic
gacagaggtcatcagagtccactattgcattccaccactgaatgggcggtattaccatgctctttctctgacttg

SEQ ID NO: 128906 - DNA, 75 bp, Artificial Sequence
  Synthetic
gacagaggtcaccagagtccactattgcattccaccactgaatgggcggtattaccatgctctttctctgacttg

SEQ ID NO: 128907 - DNA, 75 bp, Artificial Sequence
  Synthetic
gacagaggtcagcagagtccactattgcattccaccactgaatgggcggtattaccatgctctttctctgacttg

SEQ ID NO: 128908 - DNA, 75 bp, Artificial Sequence
  Synthetic
cacttggatgaatgggactgggttcactaagacatgcggcgcaccaccttgccgcattaggagggattacaacag

SEQ ID NO: 128909 - DNA, 75 bp, Artificial Sequence
  Synthetic
accaggcctccacaaggcgcatggtttgggtgtacatggatgaaaagcactgggttcacgaagacctgcggggcc

SEQ ID NO: 128910 - DNA, 75 bp, Artificial Sequence
  Synthetic
accaggcctccacaaggcgcatggtttgggtgtacatggatgaatagcactgggttcacgaagacctgcggggcc

SEQ ID NO: 128911 - DNA, 75 bp, Artificial Sequence
  Synthetic
accaggcctccacaaggcgcatggtttgggtgtacatggatgaacagcactgggttcacgaagacctgcggggcc

SEQ ID NO: 128912 - DNA, 75 bp, Artificial Sequence
  Synthetic
accaggcctccacaaggcgcatggtttgggtgtacatggatgaagagcactgggttcacgaagacctgcggggcc

SEQ ID NO: 128913 - DNA, 75 bp, Artificial Sequence
  Synthetic
gtagactacccttatagattgtggcattatccgtgcactgtgaattttaccatcttcaaggtgcggatgtatgta

SEQ ID NO: 128914 - DNA, 75 bp, Artificial Sequence
  Synthetic
atcatcaccagcctcacaggccgggacaggaaccaggtcgagggggaggtccaagtggtctccaccgcaacacaa

SEQ ID NO: 128915 - DNA, 75 bp, Artificial Sequence
  Synthetic
ggactgggttcactaagacgtgcggagcaccaccttgccgcattaggagggaccataacagcaccctcgacctat

SEQ ID NO: 128916 - DNA, 75 bp, Artificial Sequence
  Synthetic
gaaacaacctacaccaagtgtggctcaagtccctggctcacgccacggtgcttgatcgactacccatatcggctg

SEQ ID NO: 128917 - DNA, 75 bp, Artificial Sequence
  Synthetic
gaaacaacctacaccaagtgtggctcatgtccctggctcacgccacggtgcttgatcgactacccatatcggctg

SEQ ID NO: 128918 - DNA, 75 bp, Artificial Sequence
  Synthetic
gaaacaacctacaccaagtgtggctcacgtccctggctcacgccacggtgcttgatcgactacccatatcggctg

SEQ ID NO: 128919 - DNA, 75 bp, Artificial Sequence
  Synthetic
gaaacaacctacaccaagtgtggctcaggtccctggctcacgccacggtgcttgatcgactacccatatcggctg

SEQ ID NO: 128920 - DNA, 75 bp, Artificial Sequence
  Synthetic
gtggacgtgcagtacctttatggactcactccggccattacaagatacatcgtgaagtgggaatgggtggtcctt

SEQ ID NO: 128921 - DNA, 75 bp, Artificial Sequence
  Synthetic
gagaaccttgcggcttggagcatagggaccgcacagaactgtcgcccttgctcttgtccaccacccaatggcagg

SEQ ID NO: 128922 - DNA, 75 bp, Artificial Sequence
  Synthetic
caaagcccacggtattgacccaaacatccgcaccggggtgaggaccattaccactggtggagctatcacctattc

SEQ ID NO: 128923 - DNA, 75 bp, Artificial Sequence
  Synthetic
cgtgaagtgggaatgggtggtccttcttttcttgctgttggcagacgccagggtctgtgcatgcctttggatgct

SEQ ID NO: 128924 - DNA, 75 bp, Artificial Sequence
  Synthetic
ggaccgcacagaactgtcgcccttgctcttgtccaccacccaatggcaggtccttccctgttcttttacacccct

SEQ ID NO: 128925 - DNA, 75 bp, Artificial Sequence
  Synthetic
tgcggtggtgtcttgggcgcttaagtgggagtatgttgtgctggccttcttgctgttggcagacgctagggtttg

SEQ ID NO: 128926 - DNA, 75 bp, Artificial Sequence
  Synthetic
ctggtacttgaagggtagagtggtccccgtggccacgtactctgttcttggcttgtggtcctttctccttctagt

SEQ ID NO: 128927 - DNA, 75 bp, Artificial Sequence
  Synthetic
tgcatgtctctggatgatgctgctggtggcgcaagttgaggcagctctggccaatctgattaccatcaatgctac

SEQ ID NO: 128928 - DNA, 75 bp, Artificial Sequence
  Synthetic
tgcatgtctctggatgatgctgctggtggcgcatgttgaggcagctctggccaatctgattaccatcaatgctac

SEQ ID NO: 128929 - DNA, 75 bp, Artificial Sequence
  Synthetic
tgcatgtctctggatgatgctgctggtggcgcacgttgaggcagctctggccaatctgattaccatcaatgctac

SEQ ID NO: 128930 - DNA, 75 bp, Artificial Sequence
  Synthetic
tgcatgtctctggatgatgctgctggtggcgcaggttgaggcagctctggccaatctgattaccatcaatgctac

SEQ ID NO: 128931 - DNA, 75 bp, Artificial Sequence
  Synthetic
ggttctgtcacggttccacacccaaacattactgagtcagctttgcccactaccggcgagatacccttctatggg

SEQ ID NO: 128932 - DNA, 75 bp, Artificial Sequence
  Synthetic
aaagtactcgtactaaatccctctgtcgcggccacacttggttttggggcctacatgtccaaagcccacgggatc

SEQ ID NO: 128933 - DNA, 75 bp, Artificial Sequence
  Synthetic
taggcaggtggaccggtacttacatttatgatcacctctcccctttatcaacctgggcagcccagggtttgcggg

SEQ ID NO: 128934 - DNA, 75 bp, Artificial Sequence
  Synthetic
tgcggaatgtggcccttgctcctcctgctcctcgcgttgcccgaacgagcttacgcgtacgaccaggaagtacct

SEQ ID NO: 128935 - DNA, 75 bp, Artificial Sequence
  Synthetic
tgcggaatgtggcccttgctcctcctgctcctcgcgttgcccgaacgtgcttacgcgtacgaccaggaagtacct

SEQ ID NO: 128936 - DNA, 75 bp, Artificial Sequence
  Synthetic
tgcggaatgtggcccttgctcctcctgctcctcgcgttgcccgaacgcgcttacgcgtacgaccaggaagtacct

SEQ ID NO: 128937 - DNA, 75 bp, Artificial Sequence
  Synthetic
tgcggaatgtggcccttgctcctcctgctcctcgcgttgcccgaacgggcttacgcgtacgaccaggaagtacct

SEQ ID NO: 128938 - DNA, 75 bp, Artificial Sequence
  Synthetic
gaggggggcgtgatgggatcatttgggcggctgtcattctacatccacgccttgtgtttgagatcacaaaatggt

SEQ ID NO: 128939 - DNA, 75 bp, Artificial Sequence
  Synthetic
tcatagctagagtggaggctgcgctgcatgtctatgttccatcattcgagccgcgtggctcacgggacgctttga

SEQ ID NO: 128940 - DNA, 75 bp, Artificial Sequence
  Synthetic
tctcatacggctaaagcctacgctgcacgggccaacacccctgttgtataggctaggagccgtccaaaacgaggt

SEQ ID NO: 128941 - DNA, 75 bp, Artificial Sequence
  Synthetic
ctacctcctccccaaccgatgaaggttggggtaaacactccggcctcttaggccattcctgtttttttttttttt

SEQ ID NO: 128942 - DNA, 75 bp, Artificial Sequence
  Synthetic
tttttgataccgttgtcctctgcgaggcgtacgatacaggatgcgcgtggtacgaactgactcctgcagaaacaa

SEQ ID NO: 128943 - DNA, 75 bp, Artificial Sequence
  Synthetic
gcgtgtgccttactttgtgagggctcaagcgctacttaagatctgcagcttggtaagaggggtcacgcatggcag

SEQ ID NO: 128944 - DNA, 75 bp, Artificial Sequence
  Synthetic
tcttgggacacaatgtggaaatgccttatccggctcaagcccatgctcacggggcccactcccctgttgtatagg

SEQ ID NO: 128945 - DNA, 75 bp, Artificial Sequence
  Synthetic
tactatgccactaatgattgctcgaacaacagcatcacctggcagctcactaacgcagttctccaccttcctgga

SEQ ID NO: 128946 - DNA, 75 bp, Artificial Sequence
  Synthetic
cgcgcagcaaactcgaggcttgtttagcaccatcgtgacgagcctcaccggcagggataccaatgagaactgtgg

SEQ ID NO: 128947 - DNA, 75 bp, Artificial Sequence
  Synthetic
agatgtacaccaatgttgatcaagacctagtgggatggccggcgcctcctggggtcaagtctcttgtgccgtgca

SEQ ID NO: 128948 - DNA, 75 bp, Artificial Sequence
  Synthetic
tgcagatccataggtttgcacccacaccaaagccgtttttccgggatgaggtctcgttctgcgttgggcttaatt

SEQ ID NO: 128949 - DNA, 75 bp, Artificial Sequence
  Synthetic
ggcatcccttacaagcccactgtcaacctccacgaccctcctacttaacatcttgggggggtgggtggcctcaca

SEQ ID NO: 128950 - DNA, 75 bp, Artificial Sequence
  Synthetic
aggtcgtgccactgcggggttcgctggcctctttaccactggtcccagacagaacatccagctaattaacactaa

SEQ ID NO: 128951 - DNA, 75 bp, Artificial Sequence
  Synthetic
tgctctttctctatcttccttttggcacttctttcgtgcctcactgtcccagcgtcagctgagcactaccggaat

SEQ ID NO: 128952 - DNA, 75 bp, Artificial Sequence
  Synthetic
tgaggactgggaacatgtcgcgttgctggacgccggtaacacctacggtggccatcgaatacgcaggcgctccgc

SEQ ID NO: 128953 - DNA, 75 bp, Artificial Sequence
  Synthetic
tctccccccccccaagaaggccccgacgcctcccccaaggagacgccggacagtgggtctgagcgagagcaccat

SEQ ID NO: 128954 - DNA, 75 bp, Artificial Sequence
  Synthetic
ggagccactggcttcgttgtcagtggtctagtgggggcggccgtcggaagcataggcctgggtaagatactggtg

SEQ ID NO: 128955 - DNA, 75 bp, Artificial Sequence
  Synthetic
ttgagtctttccggcgacatgtggacctaatggtaggtgcggccactttgtgctctgccctatatgttggggacc

SEQ ID NO: 128956 - DNA, 75 bp, Artificial Sequence
  Synthetic
gggtgcggttgcacaggtacgctccggcgtgcaaacctctcctacgggatgaggtcacattccaggtcgggctca

SEQ ID NO: 128957 - DNA, 75 bp, Artificial Sequence
  Synthetic
cgctgtcatcaagggagggaggcacctaatattctgtcattccaagaaaaagtgcgatgagctggccaaaaacct

SEQ ID NO: 128958 - DNA, 75 bp, Artificial Sequence
  Synthetic
cactggccataggatggcgtgggacatgatgatgaactggagccccaccaccactctgctcctcgcccagatcat

SEQ ID NO: 128959 - DNA, 75 bp, Artificial Sequence
  Synthetic
tgggccacgtgaagaacgggtccatgaggatctcaggatcgcggtggtgcagcaacatgtggcacggtaccttcc

SEQ ID NO: 128960 - DNA, 75 bp, Artificial Sequence
  Synthetic
acgcgcggagaccgctgcaggttggaagatagggataggggtcagcaaagtccactgctgcattccaccactgag

SEQ ID NO: 128961 - DNA, 75 bp, Artificial Sequence
  Synthetic
ttggaccctactttctcaatagagaccacaactgtcccccaggacgcggtttcccgctctcagcggagaggccgc

SEQ ID NO: 128962 - DNA, 75 bp, Artificial Sequence
  Synthetic
cgggggcaccgcgggccacacagcttttagccttgccaacatgttcacacctggggccaggcaaaatctccagct

SEQ ID NO: 128963 - DNA, 75 bp, Artificial Sequence
  Synthetic
gccatccggcatgtttgacacctcagtgctctgtgagtgctatgatgccgggtgtgcttggtatgaactgacacc

SEQ ID NO: 128964 - DNA, 75 bp, Artificial Sequence
  Synthetic
ggtgtgcttggtatgaactgacaccggctgaaacaacaaccaggctgagagcttacttcaacacaccaggcctcc

SEQ ID NO: 128965 - DNA, 75 bp, Artificial Sequence
  Synthetic
tttaacagctcgggatgtccggagaggcttgcctcgtgtaagcgcttggaggattttctgcagggctggggccgg

SEQ ID NO: 128966 - DNA, 75 bp, Artificial Sequence
  Synthetic
ccccccctctcttgccagctcatcagcgagtcagctctcagctccgtcgttgaaggcgacgtgtaccacgcacgg

SEQ ID NO: 128967 - DNA, 75 bp, Artificial Sequence
  Synthetic
gccccgtgtactgcttcacgcccagccccgtggtcgtcggcacgaccgacatgctcggtgcacccacctacagct

SEQ ID NO: 128968 - DNA, 75 bp, Artificial Sequence
  Synthetic
agtctgcggggcccccccttgccaggtgcaaacttccaacgggtcctggccatgccctaccgactgcttccggaa

SEQ ID NO: 128969 - DNA, 75 bp, Artificial Sequence
  Synthetic
gtcaattacacaagattcaagaccagaatgtacattggtggcattgaacatcgggtggacgtggcctgcaattgg

SEQ ID NO: 128970 - DNA, 75 bp, Artificial Sequence
  Synthetic
tgggctaaggtcttgattgtgatgctactctttgccggcgtcgacgggagaacccaagtgacgggagcacaggca

SEQ ID NO: 128971 - DNA, 75 bp, Artificial Sequence
  Synthetic
cggtcccagcccagaggcaggcgtcaacctatacctaagacgcgccgccaaacgggccgtacctgggctcagccc

SEQ ID NO: 128972 - DNA, 75 bp, Artificial Sequence
  Synthetic
acgtggaatcctatagctctatgccaccacttgagggggaaccgggagatccggacctcagttcgggatcctggt

SEQ ID NO: 128973 - DNA, 75 bp, Artificial Sequence
  Synthetic
atactggtggacgttttggccgggtacggcgcaggcatttcaggggccctcgtagcttttaagatcatgagcggc

SEQ ID NO: 128974 - DNA, 75 bp, Artificial Sequence
  Synthetic
gagcctgtggtgttcagcccaatggagaagaaggtcattgtgtggggagctgagacagtggcatgtggagacatc

SEQ ID NO: 128975 - DNA, 75 bp, Artificial Sequence
  Synthetic
cgaccctacccgctctctcaactggcctgatccacctccaccagaatatcgtggatgtccagtatctttatggta

SEQ ID NO: 128976 - DNA, 75 bp, Artificial Sequence
  Synthetic
ccctgagttgcaacgactccctcaaaactggcttccttgccgcgctgttctacacacataagttcaacgcggctg

SEQ ID NO: 128977 - DNA, 75 bp, Artificial Sequence
  Synthetic
cgtcgggagtataggcctgggcaagatactggtggacgttttggccgggtacggcgcaggcatttcaggggccct

SEQ ID NO: 128978 - DNA, 75 bp, Artificial Sequence
  Synthetic
agaagaaggtcattgtgtggggagctgagacagtggcatgtggagacatcttgcatggcctcccggtctccgcaa

SEQ ID NO: 128979 - DNA, 75 bp, Artificial Sequence
  Synthetic
ttgcatggcctcccggtctccgcaaggctaggtagagaagttctcctcggccctgctgatagctacacctcgaag

SEQ ID NO: 128980 - DNA, 75 bp, Artificial Sequence
  Synthetic
cctgatccacctccaccagaatatcgtggatgtccagtatctttatggtataggatccgccgtggtgtcatgggc

SEQ ID NO: 128981 - DNA, 75 bp, Artificial Sequence
  Synthetic
ggcggagatcccgcaatttgggtaaggtcatcgatacccttacttgtggcttcgccgacctcatggggtacatcc

SEQ ID NO: 128982 - DNA, 75 bp, Artificial Sequence
  Synthetic
gcacttgccaacttggtcactatcaatgccatctcggcggttggcactcatgggttccattacgccatccttttc

SEQ ID NO: 128983 - DNA, 75 bp, Artificial Sequence
  Synthetic
ttgctccttttctatcttcattttggcgcttctctcgtgcctcaccgtccctgcctcggcgctcaattatgtcaa

SEQ ID NO: 128984 - DNA, 75 bp, Artificial Sequence
  Synthetic
ctcctcctcctccttgcgatgcccgagagggcgttcgcttttgatggggaggtagcggggtctctgggaggcggc

SEQ ID NO: 128985 - DNA, 75 bp, Artificial Sequence
  Synthetic
gttcaggttggcaaccagtctacttgctggttggcagcctcgcctaccttggctgttccgaacgcgacgacgcct

SEQ ID NO: 128986 - DNA, 75 bp, Artificial Sequence
  Synthetic
ttggctccgggacatttgggattgggtttgttccattctcacagactttaagaactggctgtcttcaaaattgct

SEQ ID NO: 128987 - DNA, 75 bp, Artificial Sequence
  Synthetic
gccttcccttcatctcttgccaaaagggatacaggggtgtatgggctggcacgggagtcatgactactcggtgtc

SEQ ID NO: 128988 - DNA, 75 bp, Artificial Sequence
  Synthetic
ctcccccttctgagggggagtgtgaggtcattgattcggactctaagtcgtggtccacagtctctgatcaagagg

SEQ ID NO: 128989 - DNA, 75 bp, Artificial Sequence
  Synthetic
ggctgttccgaacgcgacgacgcctctcacggggttccgcaagcatgtggacctcatggtgggcgctgccgcttt

SEQ ID NO: 128990 - DNA, 75 bp, Artificial Sequence
  Synthetic
ccgtggcgcattgttatgttccatccttgagggtcaggggtccccgagactccgtagttttccttatggcccttt

SEQ ID NO: 128991 - DNA, 75 bp, Artificial Sequence
  Synthetic
aattgctccatctacacaggccgcattactgggcatcgcatggcgtgggaaatgatgatgaactggtctccgacc

SEQ ID NO: 128992 - DNA, 75 bp, Artificial Sequence
  Synthetic
aattgctccatctacacaggccgcattactgggcatcgcatggcgtgggatatgatgatgaactggtctccgacc

SEQ ID NO: 128993 - DNA, 75 bp, Artificial Sequence
  Synthetic
aattgctccatctacacaggccgcattactgggcatcgcatggcgtgggacatgatgatgaactggtctccgacc

SEQ ID NO: 128994 - DNA, 75 bp, Artificial Sequence
  Synthetic
aattgctccatctacacaggccgcattactgggcatcgcatggcgtgggagatgatgatgaactggtctccgacc

SEQ ID NO: 128995 - DNA, 75 bp, Artificial Sequence
  Synthetic
gcccaaacaacgggtggatcgattgctcagcatgtggcgctctaagaagacacccatgggtttttcctatgacac

SEQ ID NO: 128996 - DNA, 75 bp, Artificial Sequence
  Synthetic
gtgtactccacaacctcgaggagtgcctctctgagggcaaagaaggtgacttttgacagggtgcaggtgctggac

SEQ ID NO: 128997 - DNA, 75 bp, Artificial Sequence
  Synthetic
gagggcccacgcgctaatcagagcctgcacacttgtgcgcgggctgctgtacggcaagtacatccaaatggccct

SEQ ID NO: 128998 - DNA, 75 bp, Artificial Sequence
  Synthetic
cagatgctttgactcaacggtcactgagcatgacatcaagactgagcgggacgtttacctatcctgcaagctgga

SEQ ID NO: 128999 - DNA, 75 bp, Artificial Sequence
  Synthetic
ttgaaggttggggtaaacactccgcctcttaggccatttccgttttttttgtttttttcctttttttttcttttt

SEQ ID NO: 129000 - DNA, 75 bp, Artificial Sequence
  Synthetic
gcatggttgccaactgggccaaagtcatcggcattctgctcctgttcgcaggggtagacgcggagacctatacca

SEQ ID NO: 129001 - DNA, 75 bp, Artificial Sequence
  Synthetic
gtggtcctatgtacaactcacggggccaattgtgcgggatgcgcaggtgccgagctagtggggttctcactacta

SEQ ID NO: 129002 - DNA, 75 bp, Artificial Sequence
  Synthetic
ccttagagacctggcagtcgccatcgagcctgtcatattcacccctatggagaagaaggtgattacctggggtgc

SEQ ID NO: 129003 - DNA, 75 bp, Artificial Sequence
  Synthetic
ccaggacttgcagcaacacctggcacgggaccttccccattaacgcgtacaccactgggcccggcgtacccatcc

SEQ ID NO: 129004 - DNA, 75 bp, Artificial Sequence
  Synthetic
ttcactgtgggcctcaattcctttgtggtcggctctcagctcccttgtgatcctgagccagacactgaggtatta

SEQ ID NO: 129005 - DNA, 75 bp, Artificial Sequence
  Synthetic
agaagaaggtgattacctggggtgctgatacagccgcgtgcggtgacatcatcggaggcttaccggtttcggcta

SEQ ID NO: 129006 - DNA, 75 bp, Artificial Sequence
  Synthetic
tatcaacaggacagccctcaattgcaatgacagcttgaacaccggctttattgccgctctgttctataccaacag

SEQ ID NO: 129007 - DNA, 75 bp, Artificial Sequence
  Synthetic
ctcagcacctcccggtgacgaaccgcgcccggaatatgacttggagctgataacatcgtgctcctcgaacgtctc

SEQ ID NO: 129008 - DNA, 75 bp, Artificial Sequence
  Synthetic
cttgcttggcaccattgtgaccagccttaccggcagagacaaaaatgagaactgcggcgaggtgcaagtcctatc

SEQ ID NO: 129009 - DNA, 75 bp, Artificial Sequence
  Synthetic
atggatgaatagcactgggttcaccaagacgtgtgggggccccccgtgtaacatcgggggggccggcaacaacac

SEQ ID NO: 129010 - DNA, 75 bp, Artificial Sequence
  Synthetic
ccatcagaagatagaccgtactgctggcactaccctccgagaccttgtggggtggtgtcggcctccacagtgtgc

SEQ ID NO: 129011 - DNA, 75 bp, Artificial Sequence
  Synthetic
actgggataaatggtgtgatgtggactgtgtaccatggggctggcagtaagaccatctgcggcccaaaaggccct

SEQ ID NO: 129012 - DNA, 75 bp, Artificial Sequence
  Synthetic
ctcttcagcgagccagctctccgccccgtccttgaaggctacctgtaccacccataagatggcatacgattgtga

SEQ ID NO: 129013 - DNA, 75 bp, Artificial Sequence
  Synthetic
gccaggggatcacccccctcgctagccagctcctctgctagtcagctttccgcgccatccttgaaagccacatgt

SEQ ID NO: 129014 - DNA, 75 bp, Artificial Sequence
  Synthetic
ctcgccgacctcatggggtacatccccgtcataggcggccccttagggggcgtcgcagcagctctggcgcatggc

SEQ ID NO: 129015 - DNA, 75 bp, Artificial Sequence
  Synthetic
ccccccgggggtcaagtctttgacaccatgcacctgcggcgcctctgaccttttcctgattacccggcacgcaga

SEQ ID NO: 129016 - DNA, 75 bp, Artificial Sequence
  Synthetic
tcttattggagagcttacgaccacccatcggcggctggtacgggtgcacatggatgaactccactgggttcgtca

SEQ ID NO: 129017 - DNA, 75 bp, Artificial Sequence
  Synthetic
aggacctcattgaagccaatcttttatggggtaccagtgccaccagggttgagctgggtgacaaggtaatggtgc

SEQ ID NO: 129018 - DNA, 75 bp, Artificial Sequence
  Synthetic
taagagcggcatctaccatcttaccaatgactgcccaaacagcagcatggtgtacgaggccgaggcaatcatcct

SEQ ID NO: 129019 - DNA, 75 bp, Artificial Sequence
  Synthetic
cctatggggcatgcagtaggcatattccgggccgcggtgtgcacgcgtggagtggcaaaggcagtggatttcgtg

SEQ ID NO: 129020 - DNA, 75 bp, Artificial Sequence
  Synthetic
ggaagcgacgtacagtaagtgtggttcagggccttggctaacccccaggtgccttgtccactacccctataggtt

SEQ ID NO: 129021 - DNA, 75 bp, Artificial Sequence
  Synthetic
gcgtgtcccgggctcgaccccgcatgttactcctgtgcctactcctactttccgtaggggtaggcatctttttgc

SEQ ID NO: 129022 - DNA, 75 bp, Artificial Sequence
  Synthetic
ccggttgaatcccttgagaccacaatgcggtctcccgttttcacagacaattccacgcccccagttgtgccccag

SEQ ID NO: 129023 - DNA, 75 bp, Artificial Sequence
  Synthetic
gctagcgggttccgccagcacatcgacctcatggttggcgctgccgcactctgttcggctatgtatttgggcgat

SEQ ID NO: 129024 - DNA, 75 bp, Artificial Sequence
  Synthetic
cgcgcgcgtctgtgcctgcttgtggatgatgctgctgatagctcaggctgaggccgccttagagaacctggtggt

SEQ ID NO: 129025 - DNA, 75 bp, Artificial Sequence
  Synthetic
ggagagcgctgcgagctggaagatcgtgacagggttgaaatgagtcctctgttgttttcaacaactgagctctcg

SEQ ID NO: 129026 - DNA, 75 bp, Artificial Sequence
  Synthetic
acccttcggtcgctgcgacactgggcttcggaagctacatgtccaaggcgcacggcatcgacccaaacatccggt

SEQ ID NO: 129027 - DNA, 75 bp, Artificial Sequence
  Synthetic
cttcggaagctacatgtccaaggcgcacggcatcgacccaaacatccggtccggtgttagaaccatcaccacagg

SEQ ID NO: 129028 - DNA, 75 bp, Artificial Sequence
  Synthetic
aattgctccatctacaccggccatgttacggggcacaggatggcgtgggacatgatgatgaattggtcgccaacc

SEQ ID NO: 129029 - DNA, 75 bp, Artificial Sequence
  Synthetic
ccggtgttagaaccatcaccacaggtgcgccaatcacatactccacatatgggaagttcctagctgacgggggct

SEQ ID NO: 129030 - DNA, 75 bp, Artificial Sequence
  Synthetic
cgggtcctactcgtccatgcctccgcttgaaggggagcccggtgatccagacctcacatcggactcttggtccac

SEQ ID NO: 129031 - DNA, 75 bp, Artificial Sequence
  Synthetic
cgtcagtcacctcgtgggtcatcaggtgggagtatgtagtcctcgctttcttgttcctggcagacgcgcgcattt

SEQ ID NO: 129032 - DNA, 75 bp, Artificial Sequence
  Synthetic
gggaagttcctagctgacgggggctgcggagggggggcatatgacattatcatctgtgacgaatgccactctact

SEQ ID NO: 129033 - DNA, 75 bp, Artificial Sequence
  Synthetic
tgcacttctctcgtgcttgaccgtcccgacctcagcagttccctaccgaaatgcctccggagtttatcacgtcac

SEQ ID NO: 129034 - DNA, 75 bp, Artificial Sequence
  Synthetic
atcataggggcgttgctgtactacagcacggccgctaattgggctaaggtcatcatagtcctactcctgttcgca

SEQ ID NO: 129035 - DNA, 75 bp, Artificial Sequence
  Synthetic
gacgccacgacaatcctcggcataggcacggtcctagaccaagcagaaactgccggggcgcgcctcgtcgtgctc

SEQ ID NO: 129036 - DNA, 75 bp, Artificial Sequence
  Synthetic
gggatgggcccttgtctttgtatgctgtgcctggtacatcaaaggccgcgtggtccctgccaccacttatggact

SEQ ID NO: 129037 - DNA, 75 bp, Artificial Sequence
  Synthetic
caaaagaaggtcaccttcgaccgcatacaggtgctggacaaccattaccatgagacacttaaggagattaaggca

SEQ ID NO: 129038 - DNA, 75 bp, Artificial Sequence
  Synthetic
tccccctggaagtcatcaaggggggtagacaccttatcttttgtcactcaaagaagaagtgcgacgagctggcca

SEQ ID NO: 129039 - DNA, 75 bp, Artificial Sequence
  Synthetic
tcaacaccaacggaagctggcatatcaacaggaccgcgcttaactgtaacgactcattacagactggtttcatcg

SEQ ID NO: 129040 - DNA, 75 bp, Artificial Sequence
  Synthetic
tggcactacgcgcctaaaccgtgtggtattgtacccgcgtcgcaggtgtgtggtccggtgtactgcttcacccca

SEQ ID NO: 129041 - DNA, 75 bp, Artificial Sequence
  Synthetic
gtattgtacccgcgtcgcaggtgtgtggtccggtgtactgcttcaccccaagcccggttgtggtggggacgaccg

SEQ ID NO: 129042 - DNA, 75 bp, Artificial Sequence
  Synthetic
gtaggtattaccatcttcacactcacaccgcactataggtggttgcttgtgcagttgatatggtggtgacaatac

SEQ ID NO: 129043 - DNA, 75 bp, Artificial Sequence
  Synthetic
gtaggtattaccatcttcacactcacaccgcactataggtggttgcttgtgcagttgatatggtggtgacattac

SEQ ID NO: 129044 - DNA, 75 bp, Artificial Sequence
  Synthetic
gtaggtattaccatcttcacactcacaccgcactataggtggttgcttgtgcagttgatatggtggtgacactac

SEQ ID NO: 129045 - DNA, 75 bp, Artificial Sequence
  Synthetic
gtaggtattaccatcttcacactcacaccgcactataggtggttgcttgtgcagttgatatggtggtgacagtac

SEQ ID NO: 129046 - DNA, 75 bp, Artificial Sequence
  Synthetic
gtaggtattaccatcttcacactcacaccgcactataggtggttgcttgtgcagttgatatggtggtgtcaatac

SEQ ID NO: 129047 - DNA, 75 bp, Artificial Sequence
  Synthetic
gtaggtattaccatcttcacactcacaccgcactataggtggttgcttgtgcagttgatatggtggtgtcattac

SEQ ID NO: 129048 - DNA, 75 bp, Artificial Sequence
  Synthetic
gtaggtattaccatcttcacactcacaccgcactataggtggttgcttgtgcagttgatatggtggtgtcactac

SEQ ID NO: 129049 - DNA, 75 bp, Artificial Sequence
  Synthetic
gtaggtattaccatcttcacactcacaccgcactataggtggttgcttgtgcagttgatatggtggtgtcagtac

SEQ ID NO: 129050 - DNA, 75 bp, Artificial Sequence
  Synthetic
gtaggtattaccatcttcacactcacaccgcactataggtggttgcttgtgcagttgatatggtggtgccaatac

SEQ ID NO: 129051 - DNA, 75 bp, Artificial Sequence
  Synthetic
gtaggtattaccatcttcacactcacaccgcactataggtggttgcttgtgcagttgatatggtggtgccattac

SEQ ID NO: 129052 - DNA, 75 bp, Artificial Sequence
  Synthetic
gtaggtattaccatcttcacactcacaccgcactataggtggttgcttgtgcagttgatatggtggtgccactac

SEQ ID NO: 129053 - DNA, 75 bp, Artificial Sequence
  Synthetic
gtaggtattaccatcttcacactcacaccgcactataggtggttgcttgtgcagttgatatggtggtgccagtac

SEQ ID NO: 129054 - DNA, 75 bp, Artificial Sequence
  Synthetic
gtaggtattaccatcttcacactcacaccgcactataggtggttgcttgtgcagttgatatggtggtggcaatac

SEQ ID NO: 129055 - DNA, 75 bp, Artificial Sequence
  Synthetic
gtaggtattaccatcttcacactcacaccgcactataggtggttgcttgtgcagttgatatggtggtggcattac

SEQ ID NO: 129056 - DNA, 75 bp, Artificial Sequence
  Synthetic
gtaggtattaccatcttcacactcacaccgcactataggtggttgcttgtgcagttgatatggtggtggcactac

SEQ ID NO: 129057 - DNA, 75 bp, Artificial Sequence
  Synthetic
gtaggtattaccatcttcacactcacaccgcactataggtggttgcttgtgcagttgatatggtggtggcagtac

SEQ ID NO: 129058 - DNA, 75 bp, Artificial Sequence
  Synthetic
caactgttccatttacagtggccatatcaccggccaccggatggcatgggacatgatgatgaattggtcacccac

SEQ ID NO: 129059 - DNA, 75 bp, Artificial Sequence
  Synthetic
tacgtatgccaacatcagtggtcccgctgtggaaaagccttactgctggcactacccgcctagaccatgtgaggt

SEQ ID NO: 129060 - DNA, 75 bp, Artificial Sequence
  Synthetic
acttagcgtaggagtaggcatctttttactccccgctcggtagagcggcaaaccctagctacactccatagctag

SEQ ID NO: 129061 - DNA, 75 bp, Artificial Sequence
  Synthetic
cctctctcgggtttgatgttaccaaaatcctcttagccatcattggccctctctaccttatgcaggccagcctct

SEQ ID NO: 129062 - DNA, 75 bp, Artificial Sequence
  Synthetic
gcgtcggcggccaactgggctaaggtagcgctggtcttgttcttgtttgccggggtcgatgccgagacccaggtt

SEQ ID NO: 129063 - DNA, 75 bp, Artificial Sequence
  Synthetic
gggagtccgggtgtgcgagaagagggcgcttcatgacgtcgtcaaaaaacttcctgaggccgtgatgggagccgc

SEQ ID NO: 129064 - DNA, 75 bp, Artificial Sequence
  Synthetic
ggggccaatgaaaccgacgtctttatgatgtcgagcttgcgacccccagcgggagggtggtatgggtgcacatgg

SEQ ID NO: 129065 - DNA, 75 bp, Artificial Sequence
  Synthetic
aggccggactggcagggggaggctaggcatttaccgatatgtcactccgggtgagagaccgtctggcatgtttga

SEQ ID NO: 129066 - DNA, 75 bp, Artificial Sequence
  Synthetic
gcgcttcatgacgtcgtcaaaaaacttcctgaggccgtgatgggagccgcttatggcttccaatactccccagcg

SEQ ID NO: 129067 - DNA, 75 bp, Artificial Sequence
  Synthetic
ctcatcaacaccaacgggagctggcacatcaacaggactgccctcaattgcaatgacagtctccagactgggttt

SEQ ID NO: 129068 - DNA, 75 bp, Artificial Sequence
  Synthetic
gattggggcatggacgggcacttacatctatgaccatttggctcctcttcagacttgggctagtgacgggctccg

SEQ ID NO: 129069 - DNA, 75 bp, Artificial Sequence
  Synthetic
gctgcgagcttatttcaacacacctggtctccctgtctgccaggaccaccttgagttttgggaaagcgtttttac

SEQ ID NO: 129070 - DNA, 75 bp, Artificial Sequence
  Synthetic
ggtctccctgtctgccaggaccaccttgagttttgggaaagcgtttttacgggcttgacccatatcgacgctcac

SEQ ID NO: 129071 - DNA, 75 bp, Artificial Sequence
  Synthetic
attgcttccggaagcacccgggcgccacttatgcaaaatgtgggtcggggccgtggctcacccctaggtgtttgg

SEQ ID NO: 129072 - DNA, 75 bp, Artificial Sequence
  Synthetic
agcttgtgaacaccaatggcagctggcatatcaacaggactgccctgaactgcaatgactccctcaacactgggt

SEQ ID NO: 129073 - DNA, 75 bp, Artificial Sequence
  Synthetic
ctatcagctacgccaacatatcgggccccagtgatgacaagccatattgctggcactatccaccacgaccgtgtg

SEQ ID NO: 129074 - DNA, 75 bp, Artificial Sequence
  Synthetic
ggcctaccggtttcagctagtcgcggtaagctcgtcatgctggggccagctgatgacatgcgcgggagtggctgg

SEQ ID NO: 129075 - DNA, 75 bp, Artificial Sequence
  Synthetic
ggcctaccggtttcagcttgtcgcggtaagctcgtcatgctggggccagctgatgacatgcgcgggagtggctgg

SEQ ID NO: 129076 - DNA, 75 bp, Artificial Sequence
  Synthetic
ggcctaccggtttcagctcgtcgcggtaagctcgtcatgctggggccagctgatgacatgcgcgggagtggctgg

SEQ ID NO: 129077 - DNA, 75 bp, Artificial Sequence
  Synthetic
ggcctaccggtttcagctggtcgcggtaagctcgtcatgctggggccagctgatgacatgcgcgggagtggctgg

SEQ ID NO: 129078 - DNA, 75 bp, Artificial Sequence
  Synthetic
gagacaacttcgcttacctagttgcctaccaggctacggtctgtgccagggctaaagcccccccaccagcgtggg

SEQ ID NO: 129079 - DNA, 75 bp, Artificial Sequence
  Synthetic
ctacacaaggtcaggatgtacatagctggcagtgagcataggttcacggctgcctgcaactggaccaggggggaa

SEQ ID NO: 129080 - DNA, 75 bp, Artificial Sequence
  Synthetic
tttgcctccagaggaaaccatgttgcccctacccactacgtggcagaatctgacgcctcgcagcgcgtgacgcag

SEQ ID NO: 129081 - DNA, 75 bp, Artificial Sequence
  Synthetic
ctaccaggctacggtctgtgccagggctaaagcccccccaccagcgtgggacaacatgtggaagtgcctcatccg

SEQ ID NO: 129082 - DNA, 75 bp, Artificial Sequence
  Synthetic
agcccggaccagaggccttactgctggcactacgcacctgagcagtgtggcattgtgcccgcgtcgacagtgtgt

SEQ ID NO: 129083 - DNA, 75 bp, Artificial Sequence
  Synthetic
tggccctgttgtcttgcatcactgttccggtctccgctgcccaagtgaagaacactagaagcggttacatggtga

SEQ ID NO: 129084 - DNA, 75 bp, Artificial Sequence
  Synthetic
tggccctgttgtcttgcatcactgttccggtctccgctgcccaagtgaagaacactagtagcggttacatggtga

SEQ ID NO: 129085 - DNA, 75 bp, Artificial Sequence
  Synthetic
tggccctgttgtcttgcatcactgttccggtctccgctgcccaagtgaagaacactagcagcggttacatggtga

SEQ ID NO: 129086 - DNA, 75 bp, Artificial Sequence
  Synthetic
tggccctgttgtcttgcatcactgttccggtctccgctgcccaagtgaagaacactaggagcggttacatggtga

SEQ ID NO: 129087 - DNA, 75 bp, Artificial Sequence
  Synthetic
gcatgcatgtctgcagatcttgaggtggtgaccagcacgtgggtcttggtgggaggcatcgtggccgccctggct

SEQ ID NO: 129088 - DNA, 75 bp, Artificial Sequence
  Synthetic
gtgagatacaggtgatctctacggctacacaaacattcctagccactaccatcaacggggtgttgtggactgtct

SEQ ID NO: 129089 - DNA, 75 bp, Artificial Sequence
  Synthetic
gtgagatacaggtgttctctacggctacacaaacattcctagccactaccatcaacggggtgttgtggactgtct

SEQ ID NO: 129090 - DNA, 75 bp, Artificial Sequence
  Synthetic
gtgagatacaggtgctctctacggctacacaaacattcctagccactaccatcaacggggtgttgtggactgtct

SEQ ID NO: 129091 - DNA, 75 bp, Artificial Sequence
  Synthetic
gtgagatacaggtggtctctacggctacacaaacattcctagccactaccatcaacggggtgttgtggactgtct

SEQ ID NO: 129092 - DNA, 75 bp, Artificial Sequence
  Synthetic
ctctgtccaccggcctgatacatctacaccagaacgtggtggatgtccaatacttgtatgggctctcgacttcca

SEQ ID NO: 129093 - DNA, 75 bp, Artificial Sequence
  Synthetic
gtgttggataccggtctcaccaaacgtggctgtgcggcagcccggcgccctcacgcaaggcctgcggacgcacct

SEQ ID NO: 129094 - DNA, 75 bp, Artificial Sequence
  Synthetic
accgtagagggtatcccacttataactggggcgagaatgagactgacatcttactcttgaacaacacaaggcccc

SEQ ID NO: 129095 - DNA, 75 bp, Artificial Sequence
  Synthetic
atccgggcagcctgcagtcatccctgatcgggaggtgctataccggcagtttgacgagatggaagaatgctcgaa

SEQ ID NO: 129096 - DNA, 75 bp, Artificial Sequence
  Synthetic
gtggctgtgcggcagcccggcgccctcacgcaaggcctgcggacgcacctagacatggttgtgatgtccgccacg

SEQ ID NO: 129097 - DNA, 75 bp, Artificial Sequence
  Synthetic
gtggctgtgcggcagcccggcgccctcacgcaaggcctgcggacgcaccttgacatggttgtgatgtccgccacg

SEQ ID NO: 129098 - DNA, 75 bp, Artificial Sequence
  Synthetic
gtggctgtgcggcagcccggcgccctcacgcaaggcctgcggacgcacctcgacatggttgtgatgtccgccacg

SEQ ID NO: 129099 - DNA, 75 bp, Artificial Sequence
  Synthetic
gtggctgtgcggcagcccggcgccctcacgcaaggcctgcggacgcacctggacatggttgtgatgtccgccacg

SEQ ID NO: 129100 - DNA, 75 bp, Artificial Sequence
  Synthetic
gggtgccaagtctttgacgccttgcacctgcggtgctagcgatctttacctggtgacccggaatgctgacgtcat

SEQ ID NO: 129101 - DNA, 75 bp, Artificial Sequence
  Synthetic
tcaggccgaggcggcgctagagaacctaatagtcctcaacgccgcttcggccgcagccactcgtggctgggagtg

SEQ ID NO: 129102 - DNA, 75 bp, Artificial Sequence
  Synthetic
cactccccggtgtttggtggactacccctaccggttgtggcattacccgtgcaccgtgaattacaccatctttaa

SEQ ID NO: 129103 - DNA, 75 bp, Artificial Sequence
  Synthetic
ccctaccggttgtggcattacccgtgcaccgtgaattacaccatctttaaggtgcgcatgtttattgggggccta

SEQ ID NO: 129104 - DNA, 75 bp, Artificial Sequence
  Synthetic
ggccggcaggcaggctcaggaagcagctcctgtagtccaatcaaactttgccaagcttgaacaattctgggcgaa

SEQ ID NO: 129105 - DNA, 75 bp, Artificial Sequence
  Synthetic
ggacatgccgtcgggatgttccgggccgccgtttgtacgcgaggcgtcgccaaggcgattgacttcataccagtg

SEQ ID NO: 129106 - DNA, 75 bp, Artificial Sequence
  Synthetic
ggacatgccgtcgggatgttccgggccgccgtttgtacgcgaggcgtcgccaaggcgattgacttcattccagtg

SEQ ID NO: 129107 - DNA, 75 bp, Artificial Sequence
  Synthetic
ggacatgccgtcgggatgttccgggccgccgtttgtacgcgaggcgtcgccaaggcgattgacttcatcccagtg

SEQ ID NO: 129108 - DNA, 75 bp, Artificial Sequence
  Synthetic
ggacatgccgtcgggatgttccgggccgccgtttgtacgcgaggcgtcgccaaggcgattgacttcatgccagtg

SEQ ID NO: 129109 - DNA, 75 bp, Artificial Sequence
  Synthetic
ggacatgccgtcgggttgttccgggccgccgtttgtacgcgaggcgtcgccaaggcgattgacttcataccagtg

SEQ ID NO: 129110 - DNA, 75 bp, Artificial Sequence
  Synthetic
ggacatgccgtcgggttgttccgggccgccgtttgtacgcgaggcgtcgccaaggcgattgacttcattccagtg

SEQ ID NO: 129111 - DNA, 75 bp, Artificial Sequence
  Synthetic
ggacatgccgtcgggttgttccgggccgccgtttgtacgcgaggcgtcgccaaggcgattgacttcatcccagtg

SEQ ID NO: 129112 - DNA, 75 bp, Artificial Sequence
  Synthetic
ggacatgccgtcgggttgttccgggccgccgtttgtacgcgaggcgtcgccaaggcgattgacttcatgccagtg

SEQ ID NO: 129113 - DNA, 75 bp, Artificial Sequence
  Synthetic
ggacatgccgtcgggctgttccgggccgccgtttgtacgcgaggcgtcgccaaggcgattgacttcataccagtg

SEQ ID NO: 129114 - DNA, 75 bp, Artificial Sequence
  Synthetic
ggacatgccgtcgggctgttccgggccgccgtttgtacgcgaggcgtcgccaaggcgattgacttcattccagtg

SEQ ID NO: 129115 - DNA, 75 bp, Artificial Sequence
  Synthetic
ggacatgccgtcgggctgttccgggccgccgtttgtacgcgaggcgtcgccaaggcgattgacttcatcccagtg

SEQ ID NO: 129116 - DNA, 75 bp, Artificial Sequence
  Synthetic
ggacatgccgtcgggctgttccgggccgccgtttgtacgcgaggcgtcgccaaggcgattgacttcatgccagtg

SEQ ID NO: 129117 - DNA, 75 bp, Artificial Sequence
  Synthetic
ggacatgccgtcggggtgttccgggccgccgtttgtacgcgaggcgtcgccaaggcgattgacttcataccagtg

SEQ ID NO: 129118 - DNA, 75 bp, Artificial Sequence
  Synthetic
ggacatgccgtcggggtgttccgggccgccgtttgtacgcgaggcgtcgccaaggcgattgacttcattccagtg

SEQ ID NO: 129119 - DNA, 75 bp, Artificial Sequence
  Synthetic
ggacatgccgtcggggtgttccgggccgccgtttgtacgcgaggcgtcgccaaggcgattgacttcatcccagtg

SEQ ID NO: 129120 - DNA, 75 bp, Artificial Sequence
  Synthetic
ggacatgccgtcggggtgttccgggccgccgtttgtacgcgaggcgtcgccaaggcgattgacttcatgccagtg

SEQ ID NO: 129121 - DNA, 75 bp, Artificial Sequence
  Synthetic
ctattgttaccccatcgggcgtacgcctacgacggcgttcaggccgggtcgatcggcgctgcggttatagccgcc

SEQ ID NO: 129122 - DNA, 75 bp, Artificial Sequence
  Synthetic
gggatgggtcgcctcccaaattgcaacccccacggcctctacggcttttgtcgtgagtggcctcgctggagctgc

SEQ ID NO: 129123 - DNA, 75 bp, Artificial Sequence
  Synthetic
caggtagagggaagagtaccaaagtgccagcagcctatgcctcgcagggctataaggtactggtgctcaacccgt

SEQ ID NO: 129124 - DNA, 75 bp, Artificial Sequence
  Synthetic
caggtagtgggaagagtaccaaagtgccagcagcctatgcctcgcagggctataaggtactggtgctcaacccgt

SEQ ID NO: 129125 - DNA, 75 bp, Artificial Sequence
  Synthetic
caggtagcgggaagagtaccaaagtgccagcagcctatgcctcgcagggctataaggtactggtgctcaacccgt

SEQ ID NO: 129126 - DNA, 75 bp, Artificial Sequence
  Synthetic
caggtagggggaagagtaccaaagtgccagcagcctatgcctcgcagggctataaggtactggtgctcaacccgt

SEQ ID NO: 129127 - DNA, 75 bp, Artificial Sequence
  Synthetic
aatacgtctggcctctatgtccttaccaacgactgttccaatagcagtattgtgtatgaggccgatgacgtcatt

SEQ ID NO: 129128 - DNA, 75 bp, Artificial Sequence
  Synthetic
gcttccatgctgacagacccgtcccacatcaccgcggaggcggcagccaggcgattggcaaggggatctccccct

SEQ ID NO: 129129 - DNA, 75 bp, Artificial Sequence
  Synthetic
gaagcttggggtgcccccgttgagagcgtggagacatcgggcccgagcagtccgcgccaagcttatcgcccaggg

SEQ ID NO: 129130 - DNA, 75 bp, Artificial Sequence
  Synthetic
cgctgggggtcactatgtccagatggccttcatgaagctggccgcactgacaggcacgtacgtttatgaccatct

SEQ ID NO: 129131 - DNA, 75 bp, Artificial Sequence
  Synthetic
cctgtggtggacccagtacttcatagcacacattgaagccaagctacatgtttgggtccccttcctccgggtgcg

SEQ ID NO: 129132 - DNA, 75 bp, Artificial Sequence
  Synthetic
atccttgtcgatatcctcgccggctatggcgccggcgtggccggcgccgtggtcacatttaagatcatgagtggc

SEQ ID NO: 129133 - DNA, 75 bp, Artificial Sequence
  Synthetic
catcacatactctacttatggcaaatttctggctgacggggggtgctctgggggggcgtatgatatcatcatatg

SEQ ID NO: 129134 - DNA, 75 bp, Artificial Sequence
  Synthetic
gctcattcgcatatgcgcgcttgtgcagaacgtagcagggggaaagtacgttcaagcggcaatcttgagagctgg

SEQ ID NO: 129135 - DNA, 75 bp, Artificial Sequence
  Synthetic
caagggcaggttggtccccggggccacctacttctgcttgggcatttggccactactcttactccttcttttcct

SEQ ID NO: 129136 - DNA, 75 bp, Artificial Sequence
  Synthetic
acgtgggacccggtgagggggccgtgcagtggatgaaccgcttgatcgcttttgcatcgcgaggcaaccacgtgg

SEQ ID NO: 129137 - DNA, 75 bp, Artificial Sequence
  Synthetic
gcagtggatgaaccgcttgatcgcttttgcatcgcgaggcaaccacgtggctcctacacactatgtccctgagaa

SEQ ID NO: 129138 - DNA, 75 bp, Artificial Sequence
  Synthetic
gcaacaccccctgggtcagtcactgtccctcatccaaacatttcagaagtcgcgctgcccacgacaggggaaatc

SEQ ID NO: 129139 - DNA, 75 bp, Artificial Sequence
  Synthetic
cactacctccctgggcccgtccagactacaaccctcctgtgatcgagacatggaagaggccggactatgaaccac

SEQ ID NO: 129140 - DNA, 75 bp, Artificial Sequence
  Synthetic
ttttcgcctatggagaagaaagttatcacgtggggggcggacactgcagcctgcggggacattctcgcaggtctc

SEQ ID NO: 129141 - DNA, 75 bp, Artificial Sequence
  Synthetic
gatcaacgaggattgttccgccccctgcgactcgtcgtggctgagggaggtctgggaatgggtctgcaccgtact

SEQ ID NO: 129142 - DNA, 75 bp, Artificial Sequence
  Synthetic
aagatgatagtgctagtcatgtggtggcttcagtatttcatagcccggttggaggctcttatccatgtgtgggtg

SEQ ID NO: 129143 - DNA, 75 bp, Artificial Sequence
  Synthetic
cccttctatggaagggctattcccctggagttcatcaagggcggcagacatctaatgttttgccattcaaagaag

SEQ ID NO: 129144 - DNA, 75 bp, Artificial Sequence
  Synthetic
tctgggaatgggtctgcaccgtactgactgactttaagacatggctcaaggctaagctcatgcctcgcttgcccg

SEQ ID NO: 129145 - DNA, 75 bp, Artificial Sequence
  Synthetic
tcacgtggggggcggacactgcagcctgcggggacattctcgcaggtctccctgtttccgccagacgaggcaact

SEQ ID NO: 129146 - DNA, 75 bp, Artificial Sequence
  Synthetic
tacttggccctttgtacttgctgcagtattcgctcactaatatgccttacttcgtcagggcgcgtgccctgctga

SEQ ID NO: 129147 - DNA, 75 bp, Artificial Sequence
  Synthetic
aatagttaccagcctcaccggccgtgacaagaatgaggcagctggcgagatacaaatcctctcaacggccactca

SEQ ID NO: 129148 - DNA, 75 bp, Artificial Sequence
  Synthetic
ttcgtcagggcgcgtgccctgctgaggatgtgcttgctagtgaagcacctggcctgtggtaagtacgtccaggca

SEQ ID NO: 129149 - DNA, 75 bp, Artificial Sequence
  Synthetic
ggggggagttgagcacaggctcacggccgcgtgtaacttcactcgcggggaccgttgcgacttggaggacagaga

SEQ ID NO: 129150 - DNA, 75 bp, Artificial Sequence
  Synthetic
tgtcaaaaacggttcaatgaggatcgtcggccctaagacctgcagcaatgtgtggcatggaacctttcccatcaa

SEQ ID NO: 129151 - DNA, 75 bp, Artificial Sequence
  Synthetic
ggtgtgtgctggactgtctaccatggtgcagggtcgaagaccttggcagggcccagggggcccgtctgccagatg

SEQ ID NO: 129152 - DNA, 75 bp, Artificial Sequence
  Synthetic
cacgggtagaggcaagccagggatatacaggtatgtctcgcagggggagcgaccgtctgggatgttcgactctgt

SEQ ID NO: 129153 - DNA, 75 bp, Artificial Sequence
  Synthetic
ggagagtaccattatgtaacgggagtaacgcaggacaacatcaagtgcccctgtcaggttccatcgcccgagttt

SEQ ID NO: 129154 - DNA, 75 bp, Artificial Sequence
  Synthetic
cgcggcaagctgatgtcatcccagcacgtcgtcgcggcgataatcgagccggtcttatcagcccacggccgatat

SEQ ID NO: 129155 - DNA, 75 bp, Artificial Sequence
  Synthetic
ggggctgacacggccgcgtgtggggacatacttgctggcctcccggtatcagctagacggggccgcgagatcttc

SEQ ID NO: 129156 - DNA, 75 bp, Artificial Sequence
  Synthetic
tctcagagaatccagcttataaacaccaatggcagttggcacatcaacaggactgccctgaactgcaatgactcc

SEQ ID NO: 129157 - DNA, 75 bp, Artificial Sequence
  Synthetic
cccgtatgccaggaccatcttgaattttgggagggggtctttactgggctcacacatattgatgctcactttctc

SEQ ID NO: 129158 - DNA, 75 bp, Artificial Sequence
  Synthetic
tggtaggatcccagctcccttgtgagcctgaacccgatgtgtcagtcctaacatcgatgcttaccgatccatctc

SEQ ID NO: 129159 - DNA, 75 bp, Artificial Sequence
  Synthetic
gcttgattttgtgccttgtgaggccatggacgcgaccacgcggtctcccaccttcactgacaactccacaccgcc

SEQ ID NO: 129160 - DNA, 75 bp, Artificial Sequence
  Synthetic
atggacgcgaccacgcggtctcccaccttcactgacaactccacaccgccagctgtgcctcaggcctaccaagtt

SEQ ID NO: 129161 - DNA, 75 bp, Artificial Sequence
  Synthetic
ggagtcctggcgggccttgcttactattccatggtggggaattgggctaagcttttggttgtgatgctgcttttt

SEQ ID NO: 129162 - DNA, 75 bp, Artificial Sequence
  Synthetic
gccgcggcattttgttcggccatgtacatcggagatctttgtggtagcatattcttggtagggcaattgttcacc

SEQ ID NO: 129163 - DNA, 75 bp, Artificial Sequence
  Synthetic
tgtggaagtgcctcttgcggcttaagcccatgctcacaggtcctacccccctgttgtataggctaggggccgtgc

SEQ ID NO: 129164 - DNA, 75 bp, Artificial Sequence
  Synthetic
ccccaccgactgcttcaggaaacatcctgaggccacatacagccggtgtggtgcggggccctggttgacacctcg

SEQ ID NO: 129165 - DNA, 75 bp, Artificial Sequence
  Synthetic
aacctgcaccatccaccacgactcccctgatgctgacctaattgaagccaacctcttgtggaggcaagagatggg

SEQ ID NO: 129166 - DNA, 75 bp, Artificial Sequence
  Synthetic
ctgcaaccctgtcctttggttcatacctcagcagagcccacggcattgaccctaacatcaggactggggttagga

SEQ ID NO: 129167 - DNA, 75 bp, Artificial Sequence
  Synthetic
ccttccccccctggaacgcgctcgctcaccccgtgtacctgcggatcggcggatctgtacctggttaccaggcat

SEQ ID NO: 129168 - DNA, 75 bp, Artificial Sequence
  Synthetic
ggtcgcctacaatgagctatatggtctctagcgctctgagaataccccagttgctcttagaggttttcatggggg

SEQ ID NO: 129169 - DNA, 75 bp, Artificial Sequence
  Synthetic
cattcttgccgctttggcagcttactgcttaacagtgggcagcgctgtcatctgtggcaggatcgtaacctcagg

SEQ ID NO: 129170 - DNA, 75 bp, Artificial Sequence
  Synthetic
acctcttgtggaggcaagagatgggaggtaacattaccagggtagagtctgagaacaaagtggtggttttggact

SEQ ID NO: 129171 - DNA, 75 bp, Artificial Sequence
  Synthetic
tgtgcccctctgggcatgtggtaggtgttttcagggctgccgtgtgcacgcggggtgtcgcgaaagcgctcgagt

SEQ ID NO: 129172 - DNA, 75 bp, Artificial Sequence
  Synthetic
ttgggcgcgccctgattacaacccgcctctactcgaaacatggaagaggcaagactacgaccccccggtcgtaca

SEQ ID NO: 129173 - DNA, 75 bp, Artificial Sequence
  Synthetic
gtgccactctacagatcccactacagtcctgggaataggtaccgtgctcgaccaggcggagacagcaggctgccg

SEQ ID NO: 129174 - DNA, 75 bp, Artificial Sequence
  Synthetic
aacccatgtaggtagtgctgttgctcaaaccactaggaggtttgtcgggctcttcagccccggccctagccagga

SEQ ID NO: 129175 - DNA, 75 bp, Artificial Sequence
  Synthetic
aacccatgtaggtagtgctgttgctcaaaccacttggaggtttgtcgggctcttcagccccggccctagccagga

SEQ ID NO: 129176 - DNA, 75 bp, Artificial Sequence
  Synthetic
aacccatgtaggtagtgctgttgctcaaaccactcggaggtttgtcgggctcttcagccccggccctagccagga

SEQ ID NO: 129177 - DNA, 75 bp, Artificial Sequence
  Synthetic
aacccatgtaggtagtgctgttgctcaaaccactgggaggtttgtcgggctcttcagccccggccctagccagga

SEQ ID NO: 129178 - DNA, 75 bp, Artificial Sequence
  Synthetic
tacccatgtaggtagtgctgttgctcaaaccactaggaggtttgtcgggctcttcagccccggccctagccagga

SEQ ID NO: 129179 - DNA, 75 bp, Artificial Sequence
  Synthetic
tacccatgtaggtagtgctgttgctcaaaccacttggaggtttgtcgggctcttcagccccggccctagccagga

SEQ ID NO: 129180 - DNA, 75 bp, Artificial Sequence
  Synthetic
tacccatgtaggtagtgctgttgctcaaaccactcggaggtttgtcgggctcttcagccccggccctagccagga

SEQ ID NO: 129181 - DNA, 75 bp, Artificial Sequence
  Synthetic
tacccatgtaggtagtgctgttgctcaaaccactgggaggtttgtcgggctcttcagccccggccctagccagga

SEQ ID NO: 129182 - DNA, 75 bp, Artificial Sequence
  Synthetic
cacccatgtaggtagtgctgttgctcaaaccactaggaggtttgtcgggctcttcagccccggccctagccagga

SEQ ID NO: 129183 - DNA, 75 bp, Artificial Sequence
  Synthetic
cacccatgtaggtagtgctgttgctcaaaccacttggaggtttgtcgggctcttcagccccggccctagccagga

SEQ ID NO: 129184 - DNA, 75 bp, Artificial Sequence
  Synthetic
cacccatgtaggtagtgctgttgctcaaaccactcggaggtttgtcgggctcttcagccccggccctagccagga

SEQ ID NO: 129185 - DNA, 75 bp, Artificial Sequence
  Synthetic
cacccatgtaggtagtgctgttgctcaaaccactgggaggtttgtcgggctcttcagccccggccctagccagga

SEQ ID NO: 129186 - DNA, 75 bp, Artificial Sequence
  Synthetic
gacccatgtaggtagtgctgttgctcaaaccactaggaggtttgtcgggctcttcagccccggccctagccagga

SEQ ID NO: 129187 - DNA, 75 bp, Artificial Sequence
  Synthetic
gacccatgtaggtagtgctgttgctcaaaccacttggaggtttgtcgggctcttcagccccggccctagccagga

SEQ ID NO: 129188 - DNA, 75 bp, Artificial Sequence
  Synthetic
gacccatgtaggtagtgctgttgctcaaaccactcggaggtttgtcgggctcttcagccccggccctagccagga

SEQ ID NO: 129189 - DNA, 75 bp, Artificial Sequence
  Synthetic
gacccatgtaggtagtgctgttgctcaaaccactgggaggtttgtcgggctcttcagccccggccctagccagga

SEQ ID NO: 129190 - DNA, 75 bp, Artificial Sequence
  Synthetic
cttgccgagcaattcaagcagaaggtcctaggtctgctgcagaacaccgctaaacaagcagaggaacttaagcca

SEQ ID NO: 129191 - DNA, 75 bp, Artificial Sequence
  Synthetic
gcttgatcaacaccaacggcagttggcacgtgaaccggaccgccctcaattgcaatgacagtttgagaacgggtt

SEQ ID NO: 129192 - DNA, 75 bp, Artificial Sequence
  Synthetic
gcttgatcaacaccaacggcagttggcacgtgaaccggaccgccctcaattgcaatgacagtttgagtacgggtt

SEQ ID NO: 129193 - DNA, 75 bp, Artificial Sequence
  Synthetic
gcttgatcaacaccaacggcagttggcacgtgaaccggaccgccctcaattgcaatgacagtttgagcacgggtt

SEQ ID NO: 129194 - DNA, 75 bp, Artificial Sequence
  Synthetic
gcttgatcaacaccaacggcagttggcacgtgaaccggaccgccctcaattgcaatgacagtttgaggacgggtt

SEQ ID NO: 129195 - DNA, 75 bp, Artificial Sequence
  Synthetic
acccaaacatacaggagacggcacttcccctaacgggagaggtgccgttttatgggaaggccatccctctagaat

SEQ ID NO: 129196 - DNA, 75 bp, Artificial Sequence
  Synthetic
acatgcgcctaccggaagtgggaagagcacaaaggtacccgctgcttaagcggcccaggggtacaaggtgctggt

SEQ ID NO: 129197 - DNA, 75 bp, Artificial Sequence
  Synthetic
acatgcgcctaccggaagtgggaagagcacaaaggtacccgctgcttatgcggcccaggggtacaaggtgctggt

SEQ ID NO: 129198 - DNA, 75 bp, Artificial Sequence
  Synthetic
acatgcgcctaccggaagtgggaagagcacaaaggtacccgctgcttacgcggcccaggggtacaaggtgctggt

SEQ ID NO: 129199 - DNA, 75 bp, Artificial Sequence
  Synthetic
acatgcgcctaccggaagtgggaagagcacaaaggtacccgctgcttaggcggcccaggggtacaaggtgctggt

SEQ ID NO: 129200 - DNA, 75 bp, Artificial Sequence
  Synthetic
tcatgcgcctaccggaagtgggaagagcacaaaggtacccgctgcttaagcggcccaggggtacaaggtgctggt

SEQ ID NO: 129201 - DNA, 75 bp, Artificial Sequence
  Synthetic
tcatgcgcctaccggaagtgggaagagcacaaaggtacccgctgcttatgcggcccaggggtacaaggtgctggt

SEQ ID NO: 129202 - DNA, 75 bp, Artificial Sequence
  Synthetic
tcatgcgcctaccggaagtgggaagagcacaaaggtacccgctgcttacgcggcccaggggtacaaggtgctggt

SEQ ID NO: 129203 - DNA, 75 bp, Artificial Sequence
  Synthetic
tcatgcgcctaccggaagtgggaagagcacaaaggtacccgctgcttaggcggcccaggggtacaaggtgctggt

SEQ ID NO: 129204 - DNA, 75 bp, Artificial Sequence
  Synthetic
ccatgcgcctaccggaagtgggaagagcacaaaggtacccgctgcttaagcggcccaggggtacaaggtgctggt

SEQ ID NO: 129205 - DNA, 75 bp, Artificial Sequence
  Synthetic
ccatgcgcctaccggaagtgggaagagcacaaaggtacccgctgcttatgcggcccaggggtacaaggtgctggt

SEQ ID NO: 129206 - DNA, 75 bp, Artificial Sequence
  Synthetic
ccatgcgcctaccggaagtgggaagagcacaaaggtacccgctgcttacgcggcccaggggtacaaggtgctggt

SEQ ID NO: 129207 - DNA, 75 bp, Artificial Sequence
  Synthetic
ccatgcgcctaccggaagtgggaagagcacaaaggtacccgctgcttaggcggcccaggggtacaaggtgctggt

SEQ ID NO: 129208 - DNA, 75 bp, Artificial Sequence
  Synthetic
gcatgcgcctaccggaagtgggaagagcacaaaggtacccgctgcttaagcggcccaggggtacaaggtgctggt

SEQ ID NO: 129209 - DNA, 75 bp, Artificial Sequence
  Synthetic
gcatgcgcctaccggaagtgggaagagcacaaaggtacccgctgcttatgcggcccaggggtacaaggtgctggt

SEQ ID NO: 129210 - DNA, 75 bp, Artificial Sequence
  Synthetic
gcatgcgcctaccggaagtgggaagagcacaaaggtacccgctgcttacgcggcccaggggtacaaggtgctggt

SEQ ID NO: 129211 - DNA, 75 bp, Artificial Sequence
  Synthetic
gcatgcgcctaccggaagtgggaagagcacaaaggtacccgctgcttaggcggcccaggggtacaaggtgctggt

SEQ ID NO: 129212 - DNA, 75 bp, Artificial Sequence
  Synthetic
gagctggcagttaaatcctttggccggtccgaaccagacaccgattccgggaccggtctaacctccccaaccgac

SEQ ID NO: 129213 - DNA, 75 bp, Artificial Sequence
  Synthetic
cggcccaggggtacaaggtgctggtgttaaacccgtctgtcgcagcgacgctcgggtttggggcgtacatgtcga

SEQ ID NO: 129214 - DNA, 75 bp, Artificial Sequence
  Synthetic
acacataagttcaattctacggggtgcccagagcggatgagcgaatgtaaaccattggcctttttcgatcagggt

SEQ ID NO: 129215 - DNA, 75 bp, Artificial Sequence
  Synthetic
tcacataagttcaattctacggggtgcccagagcggatgagcgaatgtaaaccattggcctttttcgatcagggt

SEQ ID NO: 129216 - DNA, 75 bp, Artificial Sequence
  Synthetic
ccacataagttcaattctacggggtgcccagagcggatgagcgaatgtaaaccattggcctttttcgatcagggt

SEQ ID NO: 129217 - DNA, 75 bp, Artificial Sequence
  Synthetic
gcacataagttcaattctacggggtgcccagagcggatgagcgaatgtaaaccattggcctttttcgatcagggt

SEQ ID NO: 129218 - DNA, 75 bp, Artificial Sequence
  Synthetic
ccgggaatccagcggtggcctctctaatgtctttctccgccgcactcacctgcccattgtcgacgtctgctaccc

SEQ ID NO: 129219 - DNA, 75 bp, Artificial Sequence
  Synthetic
ggagatcctccttggcccagctgatggctacacctccaaggggtggaggcttcttgcccccatcaccgcttacgc

SEQ ID NO: 129220 - DNA, 75 bp, Artificial Sequence
  Synthetic
ctacagaggcgtggacgtctccgtcatccccacctcgggtgacgtagtcgtctgtgccacagatgctctcatgac

SEQ ID NO: 129221 - DNA, 75 bp, Artificial Sequence
  Synthetic
ggtccgaaccagacaccgattccgggaccggtctaacctccccaaccgacatttcacagccaggcccctccacga

SEQ ID NO: 129222 - DNA, 75 bp, Artificial Sequence
  Synthetic
cagcagtgatgacgtcgtgtgctgctctatgtcctactcttggacgggggccttggttacgccatgcgcagccga

SEQ ID NO: 129223 - DNA, 75 bp, Artificial Sequence
  Synthetic
ctgacgggtctttggtccctagcattgcttgtcctcttgctcccccaacgggcgtatgcttggtcgggtgaagac

SEQ ID NO: 129224 - DNA, 75 bp, Artificial Sequence
  Synthetic
tagcatcggtttaggtaaggtcattgttgacatcttggcggggtatggggctggtgtgtctggcgctctcgttgc

SEQ ID NO: 129225 - DNA, 75 bp, Artificial Sequence
  Synthetic
ccgtctgtgggcccgtctactgcttcacacccagccctgtggtagtgggaactactgatcggaaaggcaacccca

SEQ ID NO: 129226 - DNA, 75 bp, Artificial Sequence
  Synthetic
actgttccccaagatgcagtggcccgcagtcaacgtcgtggccggactggtagggggaagcctggggtgtataga

SEQ ID NO: 129227 - DNA, 75 bp, Artificial Sequence
  Synthetic
acaatttggtgtacgccacgacctcccgctctgcgaccgcccggcagaagaaggtcactttcgaccgtctccagg

SEQ ID NO: 129228 - DNA, 75 bp, Artificial Sequence
  Synthetic
tagggggaagcctggggtgtatagatatgtctcacaaggagaacggccgtcgggaatgttcgacacggttgtcct

SEQ ID NO: 129229 - DNA, 75 bp, Artificial Sequence
  Synthetic
gggccttggctaacccctagatgcctggtggattacccttatagattgtggcattatccgtgcactgtgaatttt

SEQ ID NO: 129230 - DNA, 75 bp, Artificial Sequence
  Synthetic
gtttgtgaagacgtgcggggccccaccttgtctgataggccccgctaccaacaacagcataaagtgccccactga

SEQ ID NO: 129231 - DNA, 75 bp, Artificial Sequence
  Synthetic
gcagccattttgcggcgccacgttggcccctctgagggtgccaaccagtggatgaacaggcttatagcgtttgcc

SEQ ID NO: 129232 - DNA, 75 bp, Artificial Sequence
  Synthetic
ggtggtaggcatctcatcttctgccactctaagaaaaaatgtgatgaacttgccaagcaattgaccagccagggc

SEQ ID NO: 129233 - DNA, 75 bp, Artificial Sequence
  Synthetic
actctaagaaaaaatgtgatgaacttgccaagcaattgaccagccagggcgtgaacgccgtggcatattacagag

SEQ ID NO: 129234 - DNA, 75 bp, Artificial Sequence
  Synthetic
gcccccccattctgccagatccaaatttggctacggggcaaaggatgtccggagcttgtcccgcaaggccgttaa

SEQ ID NO: 129235 - DNA, 75 bp, Artificial Sequence
  Synthetic
tgccaggatcatctagagttctgggaggcagttttcactggacttacacatatagacgcccacttcctttcccaa

SEQ ID NO: 129236 - DNA, 75 bp, Artificial Sequence
  Synthetic
ttgcttccggaagcatccagaagccacatttgagagatgcgggtcaggcccttggcttaccccccgctgtctggt

SEQ ID NO: 129237 - DNA, 75 bp, Artificial Sequence
  Synthetic
ttgcttccggaagcatccagatgccacatttgagagatgcgggtcaggcccttggcttaccccccgctgtctggt

SEQ ID NO: 129238 - DNA, 75 bp, Artificial Sequence
  Synthetic
ttgcttccggaagcatccagacgccacatttgagagatgcgggtcaggcccttggcttaccccccgctgtctggt

SEQ ID NO: 129239 - DNA, 75 bp, Artificial Sequence
  Synthetic
ttgcttccggaagcatccagaggccacatttgagagatgcgggtcaggcccttggcttaccccccgctgtctggt

SEQ ID NO: 129240 - DNA, 75 bp, Artificial Sequence
  Synthetic
tgatgctgctggtagcccaggctgaggccgccttagagaacttggtggtcctcaatgcggcgtccgtggccggag

SEQ ID NO: 129241 - DNA, 75 bp, Artificial Sequence
  Synthetic
tccgcaagctccatgagtggatcagcggggattggacatcgccatgcggcaccagctggttaagggatgtgtggg

SEQ ID NO: 129242 - DNA, 75 bp, Artificial Sequence
  Synthetic
gcattccaccactgagtgggcggtgttaccatgctctttctccgacctaccagcactatctactggtctactgca

SEQ ID NO: 129243 - DNA, 75 bp, Artificial Sequence
  Synthetic
gcttgcaactggacccggggcgagcggtgcgagcttgaggacagagacaggttcgagatgagcccgctcttgttc

SEQ ID NO: 129244 - DNA, 75 bp, Artificial Sequence
  Synthetic
aaaggaggccggaagccagctcgcttaatcgtgtacccagacttgggtgtgcgagtttgcgagaaaagggcgctc

SEQ ID NO: 129245 - DNA, 75 bp, Artificial Sequence
  Synthetic
agtgtctactcaggcttaagcccaccctgaccggacctactcctctgttgtataggctgggtgctgttcaaaatg

SEQ ID NO: 129246 - DNA, 75 bp, Artificial Sequence
  Synthetic
gtggacttcagtctggatcccaccttcaccattgagactactacggtgccccaggacgcagtgtccagaagccag

SEQ ID NO: 129247 - DNA, 75 bp, Artificial Sequence
  Synthetic
ccaggacgcagtgtccagaagccagcgtaggggccgcacgggaagaggtaggcacggcatataccggtatgtttc

SEQ ID NO: 129248 - DNA, 75 bp, Artificial Sequence
  Synthetic
caagggggtctggcgtggtgatggtatctactacaccacctgcccctgtggggggcagatcacaggtcacgtgaa

SEQ ID NO: 129249 - DNA, 75 bp, Artificial Sequence
  Synthetic
attccagtactccccagcacagcgggtcgagttcctcttgaagtcgtggaattcaaagagggtacccatggggtt

SEQ ID NO: 129250 - DNA, 75 bp, Artificial Sequence
  Synthetic
acctctacggattatccacggtagttgtgtcgtgggcaatgaagtgggagtacatagtccttgcatttctggtac

SEQ ID NO: 129251 - DNA, 75 bp, Artificial Sequence
  Synthetic
acctctacggattatccacggtagttgtgtcgtgggcaatgaagtgggagtacatagtccttgcatttctggttc

SEQ ID NO: 129252 - DNA, 75 bp, Artificial Sequence
  Synthetic
acctctacggattatccacggtagttgtgtcgtgggcaatgaagtgggagtacatagtccttgcatttctggtcc

SEQ ID NO: 129253 - DNA, 75 bp, Artificial Sequence
  Synthetic
acctctacggattatccacggtagttgtgtcgtgggcaatgaagtgggagtacatagtccttgcatttctggtgc

SEQ ID NO: 129254 - DNA, 75 bp, Artificial Sequence
  Synthetic
caagtacatcatggcctgcatgtctgccgatctggaggtcatcaccagcacctgggtggtagccggtggcatcct

SEQ ID NO: 129255 - DNA, 75 bp, Artificial Sequence
  Synthetic
acagtgggtagcgttgtcatctgcgggaggatcaccacgtctagcaggcctgcagtcatacctgacagggaggtg

SEQ ID NO: 129256 - DNA, 75 bp, Artificial Sequence
  Synthetic
ccggaccctaactacaagaaagccttgtggagggtatctgcggaggactacgttgaggtcattcgcgctaaggac

SEQ ID NO: 129257 - DNA, 75 bp, Artificial Sequence
  Synthetic
cggcttgtggtcctttctccttctaatcctggctttaccacagcaggcatacgccctggaccctgttgaacaagg

SEQ ID NO: 129258 - DNA, 75 bp, Artificial Sequence
  Synthetic
cggcttgtggtcctttctccttctaatcctggctttaccacagcaggcttacgccctggaccctgttgaacaagg

SEQ ID NO: 129259 - DNA, 75 bp, Artificial Sequence
  Synthetic
cggcttgtggtcctttctccttctaatcctggctttaccacagcaggcctacgccctggaccctgttgaacaagg

SEQ ID NO: 129260 - DNA, 75 bp, Artificial Sequence
  Synthetic
cggcttgtggtcctttctccttctaatcctggctttaccacagcaggcgtacgccctggaccctgttgaacaagg

SEQ ID NO: 129261 - DNA, 75 bp, Artificial Sequence
  Synthetic
ggccagctgccaggggtttctatgcggcctaatcttcatctgctgcgcttggcacgtgcggggccggattgtccc

SEQ ID NO: 129262 - DNA, 75 bp, Artificial Sequence
  Synthetic
cctggttgaaggacagcaattagctgagcaattcaaacaaaatgtgctcggcttgatccaggtcacgacgaagca

SEQ ID NO: 129263 - DNA, 75 bp, Artificial Sequence
  Synthetic
tatcggagatgccgcgcaagcggcgtctacaccacaagcttcgggaacacagtgacgtgctaccttaaggccacg

SEQ ID NO: 129264 - DNA, 75 bp, Artificial Sequence
  Synthetic
gcttgatccaggtcacgacgaagcaggcggaagaacttaaaccagccgtccactctgcttggcctaagctcgaac

SEQ ID NO: 129265 - DNA, 75 bp, Artificial Sequence
  Synthetic
ggactctttcgagccgcttcgagcggaggaggatgagagggaagtatccgttccggcggagatcctgcggaaatc

SEQ ID NO: 129266 - DNA, 75 bp, Artificial Sequence
  Synthetic
ctgggacacaatgtggaagtgcatgctccgtctcaaaccgactttaactggccccactcccctcctgtacaggct

SEQ ID NO: 129267 - DNA, 75 bp, Artificial Sequence
  Synthetic
ggttcgcacctatgtgccggccgcttctcagggacgaagtatcatttagcgtcgggctccacagctacgtcttgg

SEQ ID NO: 129268 - DNA, 75 bp, Artificial Sequence
  Synthetic
gccccactcccctcctgtacaggctgggggccgtccagaatgagaccacattgacgcaccccatcaccaagtaca

SEQ ID NO: 129269 - DNA, 75 bp, Artificial Sequence
  Synthetic
ttaccatctttactctcactccagcttataaacaacttctcataggcatgctctggtggatacagtacttcattg

SEQ ID NO: 129270 - DNA, 75 bp, Artificial Sequence
  Synthetic
acgccctggaccctgttgaacaaggggaattagggctgggcatattagtaattatatccatcttcacacttactc

SEQ ID NO: 129271 - DNA, 75 bp, Artificial Sequence
  Synthetic
acgccctggaccctgttgaacaaggggaattagggctgggcatattagtatttatatccatcttcacacttactc

SEQ ID NO: 129272 - DNA, 75 bp, Artificial Sequence
  Synthetic
acgccctggaccctgttgaacaaggggaattagggctgggcatattagtacttatatccatcttcacacttactc

SEQ ID NO: 129273 - DNA, 75 bp, Artificial Sequence
  Synthetic
acgccctggaccctgttgaacaaggggaattagggctgggcatattagtagttatatccatcttcacacttactc

SEQ ID NO: 129274 - DNA, 75 bp, Artificial Sequence
  Synthetic
attctcagcctccttaaccagcccactgacaacagcgcaaaccctcctcctcaacgtgttgggggggtgggtagc

SEQ ID NO: 129275 - DNA, 75 bp, Artificial Sequence
  Synthetic
tatgacgaggtactcagctccccccggagacgccccgcaaccagcatacgatctggagctgataacatcctgctc

SEQ ID NO: 129276 - DNA, 75 bp, Artificial Sequence
  Synthetic
cgccagaggctcccccccgtcgttggccagctcatccgccagtcaactctcagctccatctctcaaggcgacatg

SEQ ID NO: 129277 - DNA, 75 bp, Artificial Sequence
  Synthetic
atctcaactggccactccggtcccagctacagcttttgtggttagcggcttagccggcgctgctattggtagcat

SEQ ID NO: 129278 - DNA, 75 bp, Artificial Sequence
  Synthetic
gagccctccgagccttcacggaggctatgacgaggtactcagctccccccggagacgccccgcaaccagcatacg

SEQ ID NO: 129279 - DNA, 75 bp, Artificial Sequence
  Synthetic
agggtttgaggtaactaagatcttgctggctttgatcggtccgctctacctactgcagtacagcttgctcaagac

SEQ ID NO: 129280 - DNA, 75 bp, Artificial Sequence
  Synthetic
taacccgtgaccctgagatccccctggccagagctgcctgggagacagctcgacacactccagtcaattcctggt

SEQ ID NO: 129281 - DNA, 75 bp, Artificial Sequence
  Synthetic
ttacccgtgaccctgagatccccctggccagagctgcctgggagacagctcgacacactccagtcaattcctggt

SEQ ID NO: 129282 - DNA, 75 bp, Artificial Sequence
  Synthetic
tcacccgtgaccctgagatccccctggccagagctgcctgggagacagctcgacacactccagtcaattcctggt

SEQ ID NO: 129283 - DNA, 75 bp, Artificial Sequence
  Synthetic
tgacccgtgaccctgagatccccctggccagagctgcctgggagacagctcgacacactccagtcaattcctggt

SEQ ID NO: 129284 - DNA, 75 bp, Artificial Sequence
  Synthetic
aagaccatagttttggactcattcgacccgctggtggctgagacggacgatagggaaatctccgtgccggctgag

SEQ ID NO: 129285 - DNA, 75 bp, Artificial Sequence
  Synthetic
gtcgaggacatggtgaacctactccccgcccttctgtcaccaggggcactggtagtgggggttgttcgtgctgcc

SEQ ID NO: 129286 - DNA, 75 bp, Artificial Sequence
  Synthetic
ggcatgtggggatatcctgcatggcctcccggtttccgcgaggctgggtagggaggtcttgctcggccccgccga

SEQ ID NO: 129287 - DNA, 75 bp, Artificial Sequence
  Synthetic
acgaccctcctacggtatcgggatgtgctctccctcccaagggactgccgcccgtgcctccacctaggcggaaga

SEQ ID NO: 129288 - DNA, 75 bp, Artificial Sequence
  Synthetic
atgtgcctgagacagatgcatctcgggcagtgaccaacatacttagttcccttaccatcactagtctcttgcgta

SEQ ID NO: 129289 - DNA, 75 bp, Artificial Sequence
  Synthetic
ggatattctccaggagaactcaatcgggtggccgcaaccctcagaaaacttggggtgcccccattgagggcctgg

SEQ ID NO: 129290 - DNA, 75 bp, Artificial Sequence
  Synthetic
ggatattctccaggtgaactcaatcgggtggccgcaaccctcagaaaacttggggtgcccccattgagggcctgg

SEQ ID NO: 129291 - DNA, 75 bp, Artificial Sequence
  Synthetic
ggatattctccaggcgaactcaatcgggtggccgcaaccctcagaaaacttggggtgcccccattgagggcctgg

SEQ ID NO: 129292 - DNA, 75 bp, Artificial Sequence
  Synthetic
ggatattctccaggggaactcaatcgggtggccgcaaccctcagaaaacttggggtgcccccattgagggcctgg

SEQ ID NO: 129293 - DNA, 75 bp, Artificial Sequence
  Synthetic
cgcgacaaaaaccaggttgagggggaggtgcaagtggtctctaccgcgacacagtctttcctggcgacctgcatc

SEQ ID NO: 129294 - DNA, 75 bp, Artificial Sequence
  Synthetic
cgcgacaaaaaccaggttgagggggaggtgcaagtggtctctaccgcgacacagtctttcctggcgacctgcttc

SEQ ID NO: 129295 - DNA, 75 bp, Artificial Sequence
  Synthetic
cgcgacaaaaaccaggttgagggggaggtgcaagtggtctctaccgcgacacagtctttcctggcgacctgcctc

SEQ ID NO: 129296 - DNA, 75 bp, Artificial Sequence
  Synthetic
cgcgacaaaaaccaggttgagggggaggtgcaagtggtctctaccgcgacacagtctttcctggcgacctgcgtc

SEQ ID NO: 129297 - DNA, 75 bp, Artificial Sequence
  Synthetic
cttaccatcactagtctcttgcgtaaactccatcactggattaccgaggactatgccacaccatgtgggtcaaca

SEQ ID NO: 129298 - DNA, 75 bp, Artificial Sequence
  Synthetic
ggtgggagcctctattccctcctctgagtcaggacctgtctctgacgaggtggatgcacaatctgacgcaggatc

SEQ ID NO: 129299 - DNA, 75 bp, Artificial Sequence
  Synthetic
tctcgtgtcagcgaggctacagggggacctggagaggcgatgggatttgcaacactacgtgcccctgcggtgcca

SEQ ID NO: 129300 - DNA, 75 bp, Artificial Sequence
  Synthetic
ctgtgcctactcctactcagtgtaggggtaggcatattcctgctgcctgctcggtaggcagcttaacactccgac

SEQ ID NO: 129301 - DNA, 75 bp, Artificial Sequence
  Synthetic
cccctactgctggcactaccctccaagaccttgtggtattgtgcccgcaaagaacgtgtgtggcccggtatattg

SEQ ID NO: 129302 - DNA, 75 bp, Artificial Sequence
  Synthetic
tgttccatgtcatactcctggacgggggctttgattacaccatgcgctgccgaagaggagaagctgccaatcagc

SEQ ID NO: 129303 - DNA, 75 bp, Artificial Sequence
  Synthetic
gctcaagtgatctttatctggtcacaagaaatgctgatgtcattccggcgcgacgcaggggagacaaccgtgctg

SEQ ID NO: 129304 - DNA, 75 bp, Artificial Sequence
  Synthetic
cggtccaagcatacccatcccggcgccaaactacaaaaaagcgctgtggagggtaagtgctactgaatacgtcga

SEQ ID NO: 129305 - DNA, 75 bp, Artificial Sequence
  Synthetic
gagacggacgcgtcggccaaggtcacacagctactcagctccctcacagtgacatctcttctgaaaaggctccat

SEQ ID NO: 129306 - DNA, 75 bp, Artificial Sequence
  Synthetic
aggtattggatcagcactatcaggatgttcttaaggagatgaaggatcgggcttctaaggtaagtgccaggctcc

SEQ ID NO: 129307 - DNA, 75 bp, Artificial Sequence
  Synthetic
acaccaagtgcccctgtcaggtgccggctccagagttcttcacggaggtggatggcgtgaggttacacaggtacg

SEQ ID NO: 129308 - DNA, 75 bp, Artificial Sequence
  Synthetic
aattaccctgtgagcctgagccagacgtgctggtggtgacatcaatgttaagggaccctgaccacatcaccgcag

SEQ ID NO: 129309 - DNA, 75 bp, Artificial Sequence
  Synthetic
cgtgctggtggtgacatcaatgttaagggaccctgaccacatcaccgcagaggaggcatctcgccgccttaagag

SEQ ID NO: 129310 - DNA, 75 bp, Artificial Sequence
  Synthetic
ggtcacgtgaagaacggaaccatgagaatcgtcggcccgaagatgtgcagtaacacctggcacggaaccttccca

SEQ ID NO: 129311 - DNA, 75 bp, Artificial Sequence
  Synthetic
taaccacatcaactccgtgtgggaggacttgctagaagacaacactacacctatccctactaccatcatggccaa

SEQ ID NO: 129312 - DNA, 75 bp, Artificial Sequence
  Synthetic
atcaacgccacaacaacagggcccagtgtacctgccccggctcccaactacaagtttgctttgtggagggtgggc

SEQ ID NO: 129313 - DNA, 75 bp, Artificial Sequence
  Synthetic
ctttacgacatcacgtgcaagctgcccattgcggtaatgggacctgcttacgggttccagtactcgccaaagcag

SEQ ID NO: 129314 - DNA, 75 bp, Artificial Sequence
  Synthetic
ctcgtggaagcaaatctcttatggaggcaggaaatggggggaaacatcacgagggtggagtcagaaaataagatc

SEQ ID NO: 129315 - DNA, 75 bp, Artificial Sequence
  Synthetic
cgctcacccccacgctcgcagccaggaacatcagtgtccctactacgacaatacgacgccacgtcgacttgctcg

SEQ ID NO: 129316 - DNA, 75 bp, Artificial Sequence
  Synthetic
tcctgggaatagggaccgttcttgaccaggcggaaactagcggagtgagactgacggtcctcgcgaccgccactc

SEQ ID NO: 129317 - DNA, 75 bp, Artificial Sequence
  Synthetic
ctgacggtcctcgcgaccgccactccgcccggttcagttacggtcccccatccaaacataacggagtcagcactg

SEQ ID NO: 129318 - DNA, 75 bp, Artificial Sequence
  Synthetic
tccaaactgaacattctatttaccagtgctgccagttggagccagcggcacggaaggccattacatccctcactg

SEQ ID NO: 129319 - DNA, 75 bp, Artificial Sequence
  Synthetic
ctgctcttcccgtgtgggctcgacctgattataacccgcctttacttgagacctggaaggcaccagattatgacc

SEQ ID NO: 129320 - DNA, 75 bp, Artificial Sequence
  Synthetic
tgtgagccagaacctgacgtgaccgtcctgacgtcaatgctgtcagaccctgctcatatcacagcagaaacggcc

SEQ ID NO: 129321 - DNA, 75 bp, Artificial Sequence
  Synthetic
tgtgagccagaacctgacgtgaccgtcctgacgtcaatgctgtctgaccctgctcatatcacagcagaaacggcc

SEQ ID NO: 129322 - DNA, 75 bp, Artificial Sequence
  Synthetic
tgtgagccagaacctgacgtgaccgtcctgacgtcaatgctgtccgaccctgctcatatcacagcagaaacggcc

SEQ ID NO: 129323 - DNA, 75 bp, Artificial Sequence
  Synthetic
tgtgagccagaacctgacgtgaccgtcctgacgtcaatgctgtcggaccctgctcatatcacagcagaaacggcc

SEQ ID NO: 129324 - DNA, 75 bp, Artificial Sequence
  Synthetic
accgactgtactgtggcggccccatgttcaactcgaaagggcaagcgtgtgggactcgcaggtgcagggccagtg

SEQ ID NO: 129325 - DNA, 75 bp, Artificial Sequence
  Synthetic
gggggcccactggggagtcctagcgggccttgcctactattccatggtggggaactgggctaaggttttgattgt

SEQ ID NO: 129326 - DNA, 75 bp, Artificial Sequence
  Synthetic
agcgtaggctggccagggggtctcccccctccttggccagctcctcagctagccagctgtctgcgccttccctga

SEQ ID NO: 129327 - DNA, 75 bp, Artificial Sequence
  Synthetic
acatgtactggctcagctagctgaaaagagtttcccagccacaccggaccaaccccaaaccaattcagactctgg

SEQ ID NO: 129328 - DNA, 75 bp, Artificial Sequence
  Synthetic
tcacccagacagtcgatttcagcttggaccctaccttcaccattgagacgacaaccgtgccccaagacgcggtgt

SEQ ID NO: 129329 - DNA, 75 bp, Artificial Sequence
  Synthetic
catggctccgcgatgtgtgggactgggtttgcaccatcctaacagactttaaaaactggctgacctccaagttgt

SEQ ID NO: 129330 - DNA, 75 bp, Artificial Sequence
  Synthetic
cttggctccgcgatgtgtgggactgggtttgcaccatcctaacagactttaaaaactggctgacctccaagttgt

SEQ ID NO: 129331 - DNA, 75 bp, Artificial Sequence
  Synthetic
cctggctccgcgatgtgtgggactgggtttgcaccatcctaacagactttaaaaactggctgacctccaagttgt

SEQ ID NO: 129332 - DNA, 75 bp, Artificial Sequence
  Synthetic
cgtggctccgcgatgtgtgggactgggtttgcaccatcctaacagactttaaaaactggctgacctccaagttgt

SEQ ID NO: 129333 - DNA, 75 bp, Artificial Sequence
  Synthetic
ctaccatcagctgaagatgacgatgcctcagatgcagactcgtatagttctatgccgcctcttgagggcgagcct

SEQ ID NO: 129334 - DNA, 75 bp, Artificial Sequence
  Synthetic
aagtcgggcgcgcctacctacaactggggtgagaatgatacggacgtcttcgtccttaacaacaccaggccaccg

SEQ ID NO: 129335 - DNA, 75 bp, Artificial Sequence
  Synthetic
gactgccctgaactgcaatgactccctccagactgggttccttgccgcgctgttctacacacacaggttcaacgc

SEQ ID NO: 129336 - DNA, 75 bp, Artificial Sequence
  Synthetic
ctcgtcgaacgtatccgtagcccatgacaatactggacagagatattactacctcacaagagacccaaccatacc

SEQ ID NO: 129337 - DNA, 75 bp, Artificial Sequence
  Synthetic
tgtccgctgactgctttaggaggggaccggcgtttcctcccgccctgccggtatgggcaaggccggggtatgacc

SEQ ID NO: 129338 - DNA, 75 bp, Artificial Sequence
  Synthetic
cgggggctctcatcactccatgcgctgctgaggaggaaaagttgccaattagtcctttgagcaacactctgatcc

SEQ ID NO: 129339 - DNA, 75 bp, Artificial Sequence
  Synthetic
gaccttccctatcaattgttacacggagggccagtgcgtgccaaaacccgcgccaaacttcaaaaccgccatctg

SEQ ID NO: 129340 - DNA, 75 bp, Artificial Sequence
  Synthetic
ctgatgacacacttctttggaatactccagtcccaagaaacactccacaaagcgctggactttgatatgtatgga

SEQ ID NO: 129341 - DNA, 75 bp, Artificial Sequence
  Synthetic
tacatcacgtagcgcagctctccgccagaaaaaagtaacctttgacagacagcaggtcgttgaccaacattatta

SEQ ID NO: 129342 - DNA, 75 bp, Artificial Sequence
  Synthetic
gaggaagaggaagccaatggaactatctgattctactgtgtcccaagtcctggccgacttggcgcaagccaggtt

SEQ ID NO: 129343 - DNA, 75 bp, Artificial Sequence
  Synthetic
catggttactctcccggcgaactcaatagagtggcatcaagcctcaggaaacttggggccccacctttgagagcc

SEQ ID NO: 129344 - DNA, 75 bp, Artificial Sequence
  Synthetic
atagagtggcatcaagcctcaggaaacttggggccccacctttgagagcctggaggcatcgggcccgagcggtca

SEQ ID NO: 129345 - DNA, 75 bp, Artificial Sequence
  Synthetic
tccaagtttggatacggtgcgaaggacgtccgaggccgcactagcaaagcccttaaccacatcaactccgtgtgg

SEQ ID NO: 129346 - DNA, 75 bp, Artificial Sequence
  Synthetic
cgggatgaggtctcgttctgcgttgggcttaattcatttgtcgtcgggtctcagcttccttgtgaccctgaaccc

SEQ ID NO: 129347 - DNA, 75 bp, Artificial Sequence
  Synthetic
gaggatctgctagaagacaatgtgacacctattcctactactataatggcaaagaatgaggtgttttgtgtggac

SEQ ID NO: 129348 - DNA, 75 bp, Artificial Sequence
  Synthetic
gacaagttcgcccaggggtggggacccatcacttacaccgagcctcacgacttggaccagaggccctactgctgg

SEQ ID NO: 129349 - DNA, 75 bp, Artificial Sequence
  Synthetic
accgtcagtgacgacgacaatctggtgtgttgctccatgtcatacagctggactggggcactcatcactccttgc

SEQ ID NO: 129350 - DNA, 75 bp, Artificial Sequence
  Synthetic
ggactgcacgatgctcgtgtgcggagacgaccttgtcgttatctgtgaaagcgcgggaacccaggaggacgcggc

SEQ ID NO: 129351 - DNA, 75 bp, Artificial Sequence
  Synthetic
ggcagaagaaggtcacctttgacaggctacaagttctagatgaccactacagagaggttgtggacgagatgaagc

SEQ ID NO: 129352 - DNA, 75 bp, Artificial Sequence
  Synthetic
ggcagaagaaggtcacctttgacaggctacaagttcttgatgaccactacagagaggttgtggacgagatgaagc

SEQ ID NO: 129353 - DNA, 75 bp, Artificial Sequence
  Synthetic
ggcagaagaaggtcacctttgacaggctacaagttctcgatgaccactacagagaggttgtggacgagatgaagc

SEQ ID NO: 129354 - DNA, 75 bp, Artificial Sequence
  Synthetic
ggcagaagaaggtcacctttgacaggctacaagttctggatgaccactacagagaggttgtggacgagatgaagc

SEQ ID NO: 129355 - DNA, 75 bp, Artificial Sequence
  Synthetic
tgcccgtagccgtgatgggagcagcatatggcttccagtactcacccagtcaacgggtagagtacctcctcaaga

SEQ ID NO: 129356 - DNA, 75 bp, Artificial Sequence
  Synthetic
acatggtggatgccaacctgttcatggggggcgatgtgactcggatagagtctgagtccaaagtggtcgttctgg

SEQ ID NO: 129357 - DNA, 75 bp, Artificial Sequence
  Synthetic
tttggcgctcgaagaagacacctatggggttctcctatgataccaggtgttttgattcaacagtgactgagcgtg

SEQ ID NO: 129358 - DNA, 75 bp, Artificial Sequence
  Synthetic
tgcctactcctactatccgtaggggtaggcattttcctgctccccgctcggtaagcagggagcacaaagctacac

SEQ ID NO: 129359 - DNA, 75 bp, Artificial Sequence
  Synthetic
gggttgacaccgccccattccgcccgttccaaatacggatacggcgcgaaggaagttcgctctctcgacaagaaa

SEQ ID NO: 129360 - DNA, 75 bp, Artificial Sequence
  Synthetic
gtggagtccaagtggcgggcccttgagaccttttgggcaaagcacatgtggaacttcatcagtgggatacagtac

SEQ ID NO: 129361 - DNA, 75 bp, Artificial Sequence
  Synthetic
ccatcggagtatatgctccccaggaacaggttcccaccagccttaccggcctgggcacggcctgactacaaccct

SEQ ID NO: 129362 - DNA, 75 bp, Artificial Sequence
  Synthetic
aaaccaaacgtaacaccaaccgccgcccacaggacgttaagttcccgggcggtggtcagatcgtcggtggagttt

SEQ ID NO: 129363 - DNA, 75 bp, Artificial Sequence
  Synthetic
tatgtacaattcacagggtcaatcctgcggctaccgccggtgtagggccagcggggtcctccccacgagcatggg

SEQ ID NO: 129364 - DNA, 75 bp, Artificial Sequence
  Synthetic
ttctctgcctctctcactagcccgttgccgacttctacgaccctcctattaaacatcttaggagggtgggtggcg

SEQ ID NO: 129365 - DNA, 75 bp, Artificial Sequence
  Synthetic
aaggctccgacgccccccccaaggagacgtcggacggtgggtttgagtgagagcaccataggagatgctctccaa

SEQ ID NO: 129366 - DNA, 75 bp, Artificial Sequence
  Synthetic
gcctcaaaaactttgacatgttggtctgcggagacgatttggtggtcatctctgagagtttgggggtctcggagg

SEQ ID NO: 129367 - DNA, 75 bp, Artificial Sequence
  Synthetic
ggtgttcacggacaactcctctccaccagcagtgccccagagcttccaggtggcccacttgcatgctcccaccgg

SEQ ID NO: 129368 - DNA, 75 bp, Artificial Sequence
  Synthetic
cctggttgggcaacatcattatgtacgcgcccactatatgggtgcgtatggtgctgatgacgcacttctttggga

SEQ ID NO: 129369 - DNA, 75 bp, Artificial Sequence
  Synthetic
ggcaacaccatgacgtgctatattaaggctttagcctcctgtagagctgcaaagctccgggactgcacgctcctg

SEQ ID NO: 129370 - DNA, 75 bp, Artificial Sequence
  Synthetic
caaatcatggccatactctcttccctgactgtaaccagccttctacgcaagttgcacgagtggatcaacactgac

SEQ ID NO: 129371 - DNA, 75 bp, Artificial Sequence
  Synthetic
aacacgtggcacggaacattccccatcaacgcatacaccacgggcccctgcacaccctccccggcgcccaactat

SEQ ID NO: 129372 - DNA, 75 bp, Artificial Sequence
  Synthetic
cccgcgatgcttcaggcaacagagtttactacctcacacgtgacccccaagtaccacttgcgagggccgcgtggg

SEQ ID NO: 129373 - DNA, 75 bp, Artificial Sequence
  Synthetic
ttcgccccgccgacataagacggtgcaggaatgcaattgttccatatatcccggccacgtgtcaggtcatcgcat

SEQ ID NO: 129374 - DNA, 75 bp, Artificial Sequence
  Synthetic
gtaccacttgcgagggccgcgtgggaaactgccagacactccccagttaactcctggttagggaacatcatcatg

SEQ ID NO: 129375 - DNA, 75 bp, Artificial Sequence
  Synthetic
cgacgctcaccgcctcgacttatctgggtggtttgtggcgggctacagcgggggggacatatttcacagcgtgtc

SEQ ID NO: 129376 - DNA, 75 bp, Artificial Sequence
  Synthetic
ggggggacatatttcacagcgtgtcccatgcccgaccccgcgtattactcctgtgcctactcctacttacagtag

SEQ ID NO: 129377 - DNA, 75 bp, Artificial Sequence
  Synthetic
ctgtgcctactcctacttacagtaggggtaggcatcttttttctccccccccgataaacgggcggcctcaagcaa

SEQ ID NO: 129378 - DNA, 75 bp, Artificial Sequence
  Synthetic
cgagaagatggccctttatgatgtcacacaaaagcttcctcaggcggtgatgggggcttcttatggattccagta

SEQ ID NO: 129379 - DNA, 75 bp, Artificial Sequence
  Synthetic
tcgtagtgggtgccactacggataacctaaagtgtccgtgccaggttccagctcccgaattcttcactgaggtag

SEQ ID NO: 129380 - DNA, 75 bp, Artificial Sequence
  Synthetic
aatcaatagggtggctagttgcctcaggaagcttggggtaccccctttgagagcttggagacatcgggcccgcgc

SEQ ID NO: 129381 - DNA, 75 bp, Artificial Sequence
  Synthetic
agaatatccagcttgtaaacaggaacggcagctggcatatcaacaggactgccctgaactgtaatgaatccctcc

SEQ ID NO: 129382 - DNA, 75 bp, Artificial Sequence
  Synthetic
acttccatgcgagccggaaccagacgtcgtggttgcgacgtccatgctcaccgacccctcacatataactgctga

SEQ ID NO: 129383 - DNA, 75 bp, Artificial Sequence
  Synthetic
ctactcaaaaaagttcaactcgtctgggtgcctagagcgcatggccagctgccgccccattgataagttcagtca

SEQ ID NO: 129384 - DNA, 75 bp, Artificial Sequence
  Synthetic
gagccttcacggaggctatgaccaggtattctgcccctcctggtgacccccccagaccggaatatgacctggagc

SEQ ID NO: 129385 - DNA, 75 bp, Artificial Sequence
  Synthetic
atgtctgtgcccgctgaatgccatcggcctcgcaggcccaaattcccgccagcgctgcctatatgggctaggcca

SEQ ID NO: 129386 - DNA, 75 bp, Artificial Sequence
  Synthetic
tgaactatgcaacagggaatcttcccggttgctctttctctatcttcctcttggctctgttctcatgtctgacgg

SEQ ID NO: 129387 - DNA, 75 bp, Artificial Sequence
  Synthetic
tcgtcctgacagaatctactgtgacttctgccctggcggagctcgctgcaaagacctttggcagccccgaatcgt

SEQ ID NO: 129388 - DNA, 75 bp, Artificial Sequence
  Synthetic
tcgtcctgacagaatctactgtgacttctgccctggcggagctcgctgcaaagacctttggctgccccgaatcgt

SEQ ID NO: 129389 - DNA, 75 bp, Artificial Sequence
  Synthetic
tcgtcctgacagaatctactgtgacttctgccctggcggagctcgctgcaaagacctttggccgccccgaatcgt

SEQ ID NO: 129390 - DNA, 75 bp, Artificial Sequence
  Synthetic
tcgtcctgacagaatctactgtgacttctgccctggcggagctcgctgcaaagacctttggcggccccgaatcgt

SEQ ID NO: 129391 - DNA, 75 bp, Artificial Sequence
  Synthetic
tcgtcctgacagaatctactgtgtcttctgccctggcggagctcgctgcaaagacctttggcagccccgaatcgt

SEQ ID NO: 129392 - DNA, 75 bp, Artificial Sequence
  Synthetic
tcgtcctgacagaatctactgtgtcttctgccctggcggagctcgctgcaaagacctttggctgccccgaatcgt

SEQ ID NO: 129393 - DNA, 75 bp, Artificial Sequence
  Synthetic
tcgtcctgacagaatctactgtgtcttctgccctggcggagctcgctgcaaagacctttggccgccccgaatcgt

SEQ ID NO: 129394 - DNA, 75 bp, Artificial Sequence
  Synthetic
tcgtcctgacagaatctactgtgtcttctgccctggcggagctcgctgcaaagacctttggcggccccgaatcgt

SEQ ID NO: 129395 - DNA, 75 bp, Artificial Sequence
  Synthetic
tcgtcctgacagaatctactgtgccttctgccctggcggagctcgctgcaaagacctttggcagccccgaatcgt

SEQ ID NO: 129396 - DNA, 75 bp, Artificial Sequence
  Synthetic
tcgtcctgacagaatctactgtgccttctgccctggcggagctcgctgcaaagacctttggctgccccgaatcgt

SEQ ID NO: 129397 - DNA, 75 bp, Artificial Sequence
  Synthetic
tcgtcctgacagaatctactgtgccttctgccctggcggagctcgctgcaaagacctttggccgccccgaatcgt

SEQ ID NO: 129398 - DNA, 75 bp, Artificial Sequence
  Synthetic
tcgtcctgacagaatctactgtgccttctgccctggcggagctcgctgcaaagacctttggcggccccgaatcgt

SEQ ID NO: 129399 - DNA, 75 bp, Artificial Sequence
  Synthetic
tcgtcctgacagaatctactgtggcttctgccctggcggagctcgctgcaaagacctttggcagccccgaatcgt

SEQ ID NO: 129400 - DNA, 75 bp, Artificial Sequence
  Synthetic
tcgtcctgacagaatctactgtggcttctgccctggcggagctcgctgcaaagacctttggctgccccgaatcgt

SEQ ID NO: 129401 - DNA, 75 bp, Artificial Sequence
  Synthetic
tcgtcctgacagaatctactgtggcttctgccctggcggagctcgctgcaaagacctttggccgccccgaatcgt

SEQ ID NO: 129402 - DNA, 75 bp, Artificial Sequence
  Synthetic
tcgtcctgacagaatctactgtggcttctgccctggcggagctcgctgcaaagacctttggcggccccgaatcgt

SEQ ID NO: 129403 - DNA, 75 bp, Artificial Sequence
  Synthetic
cctccatctgccaggttgcgtgccctgtgtccgcgagggtaacacctcgaggtgttgggtgtctcttactcccac

SEQ ID NO: 129404 - DNA, 75 bp, Artificial Sequence
  Synthetic
atgcccccccttgagggcgaaccgggagatcctgaccttagttcaggatcctggtccacagtcagcgaggaggga

SEQ ID NO: 129405 - DNA, 75 bp, Artificial Sequence
  Synthetic
gacctttgcggatctatctttctggtaggtcagctcttcaccttctcgccccgtactcacaccacagagcagacg

SEQ ID NO: 129406 - DNA, 75 bp, Artificial Sequence
  Synthetic
tcctccggatcccacaagccatcgtggacatgatagttggtgcccactggggtatcctagcgggcctagcttact

SEQ ID NO: 129407 - DNA, 75 bp, Artificial Sequence
  Synthetic
caggagcactttcggtctgaccgcgttgttcagtccgggcgctcaacaacagctccagctggtaaactccaacgg

SEQ ID NO: 129408 - DNA, 75 bp, Artificial Sequence
  Synthetic
acggggcaaaggacgttcggagccatgccagtaaggccattaaccacatcaactccgtgtgggaggacttgctgg

SEQ ID NO: 129409 - DNA, 75 bp, Artificial Sequence
  Synthetic
gggtgcgtggaacggctgagcccctgccacccgatcacccacttcgaccaggggtacggtcctgtcacctacaat

SEQ ID NO: 129410 - DNA, 75 bp, Artificial Sequence
  Synthetic
ggccggtgttctgtttcacccccagccccgtggtggtaggggtgactgacgtcacgggcatgcctacctacacct

SEQ ID NO: 129411 - DNA, 75 bp, Artificial Sequence
  Synthetic
gacgtgcggcgcacccccttgtaacatcgggggcagtggtaacaaacccttacgctgcactacagattgcttccg

SEQ ID NO: 129412 - DNA, 75 bp, Artificial Sequence
  Synthetic
actgtcaactacaccgtgaccaaggtccggacgtatgtgggagggatagagcacaggttcgatgtcgcctgtaac

SEQ ID NO: 129413 - DNA, 75 bp, Artificial Sequence
  Synthetic
gagtcaacgaggatatcgccagcctgcgagccttcacggaggctatgaccaggtattcggcgacccccggagatg

SEQ ID NO: 129414 - DNA, 75 bp, Artificial Sequence
  Synthetic
gcatcatgcacactcgctgccactgtggagctgagatcactggacatgtcaagaacgggacgatgaggatcgtcg

SEQ ID NO: 129415 - DNA, 75 bp, Artificial Sequence
  Synthetic
cgccgagcaattcaaacagaaagcgctcgggttgctgcaaacagccaccaagcaagcggaggctgctgctcccgt

SEQ ID NO: 129416 - DNA, 75 bp, Artificial Sequence
  Synthetic
gtctctgtagcccatgatggagacggcagaaaatattactacctcactcgtgaccctactactccactggcaagg

SEQ ID NO: 129417 - DNA, 75 bp, Artificial Sequence
  Synthetic
gcgccggctcaaagaccctagccggcccaaaggggccaatcacccaaatgtacaccaatgtagaccaggacctcg

SEQ ID NO: 129418 - DNA, 75 bp, Artificial Sequence
  Synthetic
ttacacccatgcctgccctatcaacagggctgatccacctccaccaaaacatcgtggacgtgcaatacatctatg

SEQ ID NO: 129419 - DNA, 75 bp, Artificial Sequence
  Synthetic
ccgcgtattgcctgacaacaggcagtgtggtcattgtgggcagaatcatcttgtccgggaagccggctgttattc

SEQ ID NO: 129420 - DNA, 75 bp, Artificial Sequence
  Synthetic
cagggctgtggaggacgggattaactatgcaacagggaaccttcctggttgctccttttctatcttccttctggc

SEQ ID NO: 129421 - DNA, 75 bp, Artificial Sequence
  Synthetic
gcctcggctgtgcattatcacaacacctcgggcatctatcacatcactaatgactgccctaactccagcatagtc

SEQ ID NO: 129422 - DNA, 75 bp, Artificial Sequence
  Synthetic
ggtcctgttgatatctcaggtggaagcggctttggagaacctgatcgtgctcaatgccgcctctcttgctgggac

SEQ ID NO: 129423 - DNA, 75 bp, Artificial Sequence
  Synthetic
caatcactccgcttgatctcccagtgatcattcaaagactccacggcatggccgcattttcactccatgggtact

SEQ ID NO: 129424 - DNA, 75 bp, Artificial Sequence
  Synthetic
gcataggtcttgggaaggtgcttgtggacatcctggcgggctatggggcaggggtggctggcgcactcgtggctt

SEQ ID NO: 129425 - DNA, 75 bp, Artificial Sequence
  Synthetic
ccgcgccatatcttggcgctccacttgagtccatgcggcgtcatgtggatttgatggtgggcgctgccacactgt

SEQ ID NO: 129426 - DNA, 75 bp, Artificial Sequence
  Synthetic
ctgctcttgctactcctagcgttgccccaacgggcatacgccatggaccgcgagaccgccgcgtcgtgtgggggc

SEQ ID NO: 129427 - DNA, 75 bp, Artificial Sequence
  Synthetic
ctgctcttgctactcctagcgttgccccatcgggcatacgccatggaccgcgagaccgccgcgtcgtgtgggggc

SEQ ID NO: 129428 - DNA, 75 bp, Artificial Sequence
  Synthetic
ctgctcttgctactcctagcgttgccccaccgggcatacgccatggaccgcgagaccgccgcgtcgtgtgggggc

SEQ ID NO: 129429 - DNA, 75 bp, Artificial Sequence
  Synthetic
ctgctcttgctactcctagcgttgccccagcgggcatacgccatggaccgcgagaccgccgcgtcgtgtgggggc

SEQ ID NO: 129430 - DNA, 75 bp, Artificial Sequence
  Synthetic
gcccatctacacgctcccaccggcagcggcaagagcaccaaggtgccggctgcatatgcagcccaagggtacaag

SEQ ID NO: 129431 - DNA, 75 bp, Artificial Sequence
  Synthetic
ttgttccatctatccgggccatatcacgggtcacagaatggcgtgggacatgatgatgaactggagccctaccgt

SEQ ID NO: 129432 - DNA, 75 bp, Artificial Sequence
  Synthetic
aggcccttctgcaggtatgggtcccccccctggatgtccggggagggcgggatgccatcatcctgcttacatgct

SEQ ID NO: 129433 - DNA, 75 bp, Artificial Sequence
  Synthetic
atgcaagctaactgggctaaggtcatcctgattttattcgtctttgctggggtcgacgcgaacacgcacgtctct

SEQ ID NO: 129434 - DNA, 75 bp, Artificial Sequence
  Synthetic
tgtgcgtgcgcacgtcctcctccgcatatgcatgctagtgcgaagggcggcggggggccagtacgtgcaaatggc

SEQ ID NO: 129435 - DNA, 75 bp, Artificial Sequence
  Synthetic
caaaggcagaagaaagtcacatttgacagactgcaagtcctggacagccattaccaggacgtgctcaaggaggtt

SEQ ID NO: 129436 - DNA, 75 bp, Artificial Sequence
  Synthetic
atgagggcctcggctgggcagggtggctcctgtccccccgcggttctcgcccttcatggggccccactgaccccc

SEQ ID NO: 129437 - DNA, 75 bp, Artificial Sequence
  Synthetic
tcaacaggacagccctaaattgcaatgacagcttgcagacaggattcatcgccggcctgttctaccgccataaat

SEQ ID NO: 129438 - DNA, 75 bp, Artificial Sequence
  Synthetic
gttgaacccgtcatcttctcttctatggagacaaaggtcattacctacggtgcggacaccgcggcatgtggagac

SEQ ID NO: 129439 - DNA, 75 bp, Artificial Sequence
  Synthetic
gccggcctgttctaccgccataaattcaatagctctgggtgtccggagaggctttctagctgcaaacgccttgat

SEQ ID NO: 129440 - DNA, 75 bp, Artificial Sequence
  Synthetic
tatggcaaagctatccccatcgagaccattaagggggggaggcatctcattttttgccattccaagaagaaatgt

SEQ ID NO: 129441 - DNA, 75 bp, Artificial Sequence
  Synthetic
ccacgggcccctgcacaccctccccggcgccaaactattccagggcgctgtggcgggtggctgctgaggagtacg

SEQ ID NO: 129442 - DNA, 75 bp, Artificial Sequence
  Synthetic
tggcgggtggctgctgaggagtacgtggaggttacgcgggtgggggatttccactacgtgacgggcatgaccact

SEQ ID NO: 129443 - DNA, 75 bp, Artificial Sequence
  Synthetic
gaatgagggcctaggctgggcagggtggctcctgtccccccgaggttctcgcccttcatggggccccactgaccc

SEQ ID NO: 129444 - DNA, 75 bp, Artificial Sequence
  Synthetic
tcacagcctatgctcagcagacgcgggggctcctggggtgcatcatcaccagcctcacaggccgggacaagaacc

SEQ ID NO: 129445 - DNA, 75 bp, Artificial Sequence
  Synthetic
tggtacccgcatccgaagtgtgtggccctgtctactgtttcacgcctagtcctgtagcggtgggtaccaccgaca

SEQ ID NO: 129446 - DNA, 75 bp, Artificial Sequence
  Synthetic
ggccccgatcaacgcccctactgctggcactaccccccaagaccttgtggtattgtgcccgcaaagagcgtgtgt

SEQ ID NO: 129447 - DNA, 75 bp, Artificial Sequence
  Synthetic
gtgagagtcctggaggacgggataaattatgcaacggggaatttgcccggttgctccttttctatctttctttta

SEQ ID NO: 129448 - DNA, 75 bp, Artificial Sequence
  Synthetic
ggcgttgccagagctctcgctcatggggtgagagttctggaggacgggataaactatgcaacagggaacttgccc

SEQ ID NO: 129449 - DNA, 75 bp, Artificial Sequence
  Synthetic
ggcgttgccagagctctcgctcatggggtgagagttctggaggacgggattaactatgcaacagggaacttgccc

SEQ ID NO: 129450 - DNA, 75 bp, Artificial Sequence
  Synthetic
ggcgttgccagagctctcgctcatggggtgagagttctggaggacgggatcaactatgcaacagggaacttgccc

SEQ ID NO: 129451 - DNA, 75 bp, Artificial Sequence
  Synthetic
ggcgttgccagagctctcgctcatggggtgagagttctggaggacgggatgaactatgcaacagggaacttgccc

SEQ ID NO: 129452 - DNA, 75 bp, Artificial Sequence
  Synthetic
tttggcaacttgaaggcgcagtgctccatattcctggatgcgtcccttgtgaactgatcggcaacacgtctcggt

SEQ ID NO: 129453 - DNA, 75 bp, Artificial Sequence
  Synthetic
gatgaacagcactggtttcacgaaaacttgcggggccccgccatgccaagtgcagacaacacctgacaatcaaac

SEQ ID NO: 129454 - DNA, 75 bp, Artificial Sequence
  Synthetic
ccggtatctcgccgggcccaagggtcccgttacacagatgtacaccaatgtggaccaggatctcgttgggtggcc

SEQ ID NO: 129455 - DNA, 75 bp, Artificial Sequence
  Synthetic
gacccgcggatgatatgcagcgcggaggttggaagcttttggctcccatcaccgcgtatgcacagcagacgaggg

SEQ ID NO: 129456 - DNA, 75 bp, Artificial Sequence
  Synthetic
ggccataaagcagcccggcgctctcaccaagggcctgcgagcgcacatcgatgccatcgtggtgtccgctacgct

SEQ ID NO: 129457 - DNA, 75 bp, Artificial Sequence
  Synthetic
ccaatgactgctccaatagcagcatcacttggcaacttgacgaggcagtgcttcacgttcctgggtgcgtccctt

SEQ ID NO: 129458 - DNA, 75 bp, Artificial Sequence
  Synthetic
ggggacacccggggcgctctcctgtctcccaggcccatttcctatctcaagggctcttcgggaggcccgctgctc

SEQ ID NO: 129459 - DNA, 75 bp, Artificial Sequence
  Synthetic
ccataccggttgtggcactacccatgctctgtcaactataccatcttcaaggtgaggatgtatgtcggtggcgtg

SEQ ID NO: 129460 - DNA, 75 bp, Artificial Sequence
  Synthetic
aattgttccatatacccgggccacattacaggacatcgtatggcttgggatatgatgatgaactggtcgcccact

SEQ ID NO: 129461 - DNA, 75 bp, Artificial Sequence
  Synthetic
tcactagaggcttgcgggctcacatcgatgtggttgtgatgtccgctacactctgttcagctctttatgtgggag

SEQ ID NO: 129462 - DNA, 75 bp, Artificial Sequence
  Synthetic
ccatgaggtccccggtcttctctgacaactccacgccgcccgcggtgccccagacataccaagtggcccatctac

SEQ ID NO: 129463 - DNA, 75 bp, Artificial Sequence
  Synthetic
ctcaatggcaagtccttccctgctctttcacacctctccctgccctctccactggcctgatccatctccatcaga

SEQ ID NO: 129464 - DNA, 75 bp, Artificial Sequence
  Synthetic
ccatgcagggagcatgggcaaaggtcatcgtcatcctcttgttgaccgctggggtggaggcggaaacccacacca

SEQ ID NO: 129465 - DNA, 75 bp, Artificial Sequence
  Synthetic
cggcttcggggcctacatgtccaaggcctatggcattgaccctaacatcaggactggtgtaaggaccatcactac

SEQ ID NO: 129466 - DNA, 75 bp, Artificial Sequence
  Synthetic
tgccagggtctgcgcatgtctctggatgatgctgctggtgtcgcaggttgaggcagccttagctaatttgattac

SEQ ID NO: 129467 - DNA, 75 bp, Artificial Sequence
  Synthetic
catcaaccgcacggctctgaactgcaatgatagtctgcacaccggcttcatcgcatccctgttctatgccacctc

SEQ ID NO: 129468 - DNA, 75 bp, Artificial Sequence
  Synthetic
actgattcaacatcaatactaggcatcggtacggtccttgatcaagcggagacggctggagctcgactcgtcgtg

SEQ ID NO: 129469 - DNA, 75 bp, Artificial Sequence
  Synthetic
gcatatgtggcctgcggaatgtggcctatgctcctcctgctcctcgcgttgcctgaacgggcttacgcgtacgac

SEQ ID NO: 129470 - DNA, 75 bp, Artificial Sequence
  Synthetic
attggtcaataccaatggcagttggcacataaaccgtactgccctcaattgtaacgacagtttgaacgctgggtt

SEQ ID NO: 129471 - DNA, 75 bp, Artificial Sequence
  Synthetic
tccgtcaccgtgccccatcccaacatcgaggaggttgctctgtccaccaccggagagatccctttttacggcaag

SEQ ID NO: 129472 - DNA, 75 bp, Artificial Sequence
  Synthetic
cctcgagtatgaggagaatgtcaccaatgatgcagacatgagaccctactgctggcattatcctcctaaaccatg

SEQ ID NO: 129473 - DNA, 75 bp, Artificial Sequence
  Synthetic
tttcatcagcgggatacagtacttagcaggcttatccactctgcctgggaaccccgcaatagcatcactgatggc

SEQ ID NO: 129474 - DNA, 75 bp, Artificial Sequence
  Synthetic
caataccgctcgatgtcatcaagggcgggaggcatctgatcttctgtcattctaagaagaagtgcgacgagcttg

SEQ ID NO: 129475 - DNA, 75 bp, Artificial Sequence
  Synthetic
ggctgcaatatttcatagctagagtggaggccattctgcacgtctatgttccatcatttgagccgcgcggccctc

SEQ ID NO: 129476 - DNA, 75 bp, Artificial Sequence
  Synthetic
aactggggggagaatgagacagatgtcttcctgctcaacagcacccgcccaccgaggggcgcttggtttgggtgt

SEQ ID NO: 129477 - DNA, 75 bp, Artificial Sequence
  Synthetic
tcttcctgctcaacagcacccgcccaccgaggggcgcttggtttgggtgtacgtggatgaatggcaccgggttca

SEQ ID NO: 129478 - DNA, 75 bp, Artificial Sequence
  Synthetic
cctgtttcatccccacctagcctttgacatcacaaaatacatcttggccatcttggggcccctctacatacttca

SEQ ID NO: 129479 - DNA, 75 bp, Artificial Sequence
  Synthetic
ggacgccctaatgaccggctacaccggtgacttcgactcagtgatagactgcaatacttctgtcacccagacggt

SEQ ID NO: 129480 - DNA, 75 bp, Artificial Sequence
  Synthetic
ccagatccaaatttggctatggggcaaaggacgtccggagcctatccagcaaggccgtcaaccacatccgctccg

SEQ ID NO: 129481 - DNA, 75 bp, Artificial Sequence
  Synthetic
acacctggggggagaatgagacggacgtttttctcctaaacagcacgcgaccaccgcaaggagcatggttcgggt

SEQ ID NO: 129482 - DNA, 75 bp, Artificial Sequence
  Synthetic
gtcttacatcaaatgtggggccgggccgtggttaacaccccggtgcctggtccattacccctacagattgtggca

SEQ ID NO: 129483 - DNA, 75 bp, Artificial Sequence
  Synthetic
ctggtacttacatctatgaccacctttctcccttgtccgactgggccgccgacggccttaaggacttagcagtag

SEQ ID NO: 129484 - DNA, 75 bp, Artificial Sequence
  Synthetic
agaagaagtgtgacgagctcgccgcaaagctggtcgcattgggcgtcaatgccgtggcctactaccgcggtcttg

SEQ ID NO: 129485 - DNA, 75 bp, Artificial Sequence
  Synthetic
ccaggcatctacagattcgtagcacctggagagcggccatctgggatgtttgactcatcggtcctatgtgagtgc

SEQ ID NO: 129486 - DNA, 75 bp, Artificial Sequence
  Synthetic
agactgcttcagaaaacatcctgaggccagctacaagaagtgtggagctggcccttggctaacgcccagatgcct

SEQ ID NO: 129487 - DNA, 75 bp, Artificial Sequence
  Synthetic
cgctgtaatctcgaggacagggataggagccaactcagcccgttactgcactccaccactgaatgggctacccta

SEQ ID NO: 129488 - DNA, 75 bp, Artificial Sequence
  Synthetic
acttagaattttgggagggcgtctttacgggtctcacccacattgatgcccatttcctgtctcagacaaaacagg

SEQ ID NO: 129489 - DNA, 75 bp, Artificial Sequence
  Synthetic
gcagcatgcaacttcacccgtggggatcgctgcaacttggaagacagggatagaagccagctgagccctctgttg

SEQ ID NO: 129490 - DNA, 75 bp, Artificial Sequence
  Synthetic
tcacaaagtacgtcgtcaagtgggagtggatcgttctcctattcctgcttttggcggacgccagggtttgcgcct

SEQ ID NO: 129491 - DNA, 75 bp, Artificial Sequence
  Synthetic
cgagcctcactggcaaggacactaacgagaattgtggtgagatccaggtgctgtccactgccacgcagtccttcc

SEQ ID NO: 129492 - DNA, 75 bp, Artificial Sequence
  Synthetic
aaggctaaaacccaccctgcacggccctactcccctgctttacagactgggtgctgtccagaatgaggtcacctt

SEQ ID NO: 129493 - DNA, 75 bp, Artificial Sequence
  Synthetic
cttcatcctcttcttcatagctgcctggtgcattaaaggccgtgtggtcccgatggcaacgtattccttgctggg

SEQ ID NO: 129494 - DNA, 75 bp, Artificial Sequence
  Synthetic
gagtgggtggtcctccttttcctgctcctcgcggacgccagagtttgcgcctgcctgtggatgcttatcctgcta

SEQ ID NO: 129495 - DNA, 75 bp, Artificial Sequence
  Synthetic
gccgcatattgcttgtctacaggctgtgtggtcatagtgggcaggatcaccctctctgggaaaccggcaatcata

SEQ ID NO: 129496 - DNA, 75 bp, Artificial Sequence
  Synthetic
gcagacgttgtgcctgtacgtaggaggggagacacccggggtgctcttttgagccccaggccgatatccgtcctt

SEQ ID NO: 129497 - DNA, 75 bp, Artificial Sequence
  Synthetic
gattggcatggcgctactggtcatcataaccgccttcacaatcacaccggcatacaaaatcctcctcactcgagt

SEQ ID NO: 129498 - DNA, 75 bp, Artificial Sequence
  Synthetic
cttggtacatcaaaggtagggcagttcccatggccacctactccttcctaggcatgtggtccttcttactgctgc

SEQ ID NO: 129499 - DNA, 75 bp, Artificial Sequence
  Synthetic
cttggtacatcaaaggtagggcagttcccatggccacctactccttcctaggcatgtggtccttctttctgctgc

SEQ ID NO: 129500 - DNA, 75 bp, Artificial Sequence
  Synthetic
cttggtacatcaaaggtagggcagttcccatggccacctactccttcctaggcatgtggtccttcttcctgctgc

SEQ ID NO: 129501 - DNA, 75 bp, Artificial Sequence
  Synthetic
cttggtacatcaaaggtagggcagttcccatggccacctactccttcctaggcatgtggtccttcttgctgctgc

SEQ ID NO: 129502 - DNA, 75 bp, Artificial Sequence
  Synthetic
agcagaaagccctcgggctgctgcaaacggcctccaaacaagccgaagtggccgcacccaccgtccaatcttgct

SEQ ID NO: 129503 - DNA, 75 bp, Artificial Sequence
  Synthetic
accatgaggtccccggtgttcacggacaactcctctccaccagcagtgccccagagcttccaggtggctcacctg

SEQ ID NO: 129504 - DNA, 75 bp, Artificial Sequence
  Synthetic
tgaggaactactgtcttcacgcagaaagcgtctagccatggcgttagtatgagtgtcgtacagcctccaggaccc

SEQ ID NO: 129505 - DNA, 75 bp, Artificial Sequence
  Synthetic
tttgacgagatggaggagtgctctaggcacatcccctacctcgctgagggccagcagatcgccgaacagttcaga

SEQ ID NO: 129506 - DNA, 75 bp, Artificial Sequence
  Synthetic
ggatgattctgatgactcacttcttctccatccttctagcccaggagcaacttgaaaaagccctagattgtcaga

SEQ ID NO: 129507 - DNA, 75 bp, Artificial Sequence
  Synthetic
agactgggttcattgccgcgctgttctacacacacaagttcaactcgtccggatgcccagagcgcatggccagct

SEQ ID NO: 129508 - DNA, 75 bp, Artificial Sequence
  Synthetic
tgcatcattgatggcatttacagctgccgtcaccagcccactcactacgcagcaaaccctcctctttaacatctt

SEQ ID NO: 129509 - DNA, 75 bp, Artificial Sequence
  Synthetic
agcctacaaaattctcctctgtcgctgcttgtggtggttgtgctatttcctggtcctggcggaagccctgattca

SEQ ID NO: 129510 - DNA, 75 bp, Artificial Sequence
  Synthetic
caccatacttcgttagagcgcatgcccttctgaggatgtgtgcaatggtaaagcagctcgtggggggcaagtatg

SEQ ID NO: 129511 - DNA, 75 bp, Artificial Sequence
  Synthetic
ctccatccttctagcccaggagcaacttgaaaaagccctagattgtcagatctacggggcctgttactccattga

SEQ ID NO: 129512 - DNA, 75 bp, Artificial Sequence
  Synthetic
ctcctggcgatccttggacccggctacctcctcaaggaagacttgctacggacaccatacttcgttagggcccac

SEQ ID NO: 129513 - DNA, 75 bp, Artificial Sequence
  Synthetic
cttattgctggcactacgcacctcaaccgtgcggtactatacccgcggcgcaggtgtgcggtccggtgtattgct

SEQ ID NO: 129514 - DNA, 75 bp, Artificial Sequence
  Synthetic
gcatgcgccgacagggagcggcaagagcaccaaggtcccggctgcatacgcggcccagggctacaaggtgctagt

SEQ ID NO: 129515 - DNA, 75 bp, Artificial Sequence
  Synthetic
aagatgctcgtagacatactggctggctatggggcgggggtagcgggcgctctcgtggctttcaaggtcatgagt

SEQ ID NO: 129516 - DNA, 75 bp, Artificial Sequence
  Synthetic
gccttgctgagggtgtgcgccctggtgaagcaccttgcggggggtagatacgtccagatggcgttactcaccctc

SEQ ID NO: 129517 - DNA, 75 bp, Artificial Sequence
  Synthetic
ttacaaccctccactgctagagtcctggaaggacccggactacgtccctccggtggtgcacgggtgcccattgcc

SEQ ID NO: 129518 - DNA, 75 bp, Artificial Sequence
  Synthetic
gtccgtgacgaccccccatcccaacatagaggaagtcgccttgccgacgacgggagaggtacccttctacggcag

SEQ ID NO: 129519 - DNA, 75 bp, Artificial Sequence
  Synthetic
gccatgtgggcccaggtgagggtgctgttcagtggatgaaccggctgattgcattcgcatctcgagggaatcacg

SEQ ID NO: 129520 - DNA, 75 bp, Artificial Sequence
  Synthetic
gtcttttcttggaacatcaatctcaggggttttgtggaccgtctttcatggtgccggaaacaagacgctggctgg

SEQ ID NO: 129521 - DNA, 75 bp, Artificial Sequence
  Synthetic
ctcaatgcagtagcctattatagggggctggacgtgtcagtgattccgacgtccggagacgtcgtggtatgcgcg

SEQ ID NO: 129522 - DNA, 75 bp, Artificial Sequence
  Synthetic
atggattaatgaggactgctccactccgtgtgccggctcctggttaagagacatctgggattgggtgtgcgaggt

SEQ ID NO: 129523 - DNA, 75 bp, Artificial Sequence
  Synthetic
ctgctgctcgatgtcctacacatggacaggcgccctgatcacaccatgcgccgcggaggaaagcaagctgcccat

SEQ ID NO: 129524 - DNA, 75 bp, Artificial Sequence
  Synthetic
ggggacggtgttatgaacaccgtctgcccctgcggggctcagatagctggacatgtgaaaaacgggacaatgagg

SEQ ID NO: 129525 - DNA, 75 bp, Artificial Sequence
  Synthetic
gctcctgtccccccgtggctctcggcctagttggggccccacagacccccggcgtaggtcgcgcaatttgggtaa

SEQ ID NO: 129526 - DNA, 75 bp, Artificial Sequence
  Synthetic
tgaactgacaccagctgagacaacaactaggttaagagcctatttcaacacaccaggcctccccgtctgccaaga

SEQ ID NO: 129527 - DNA, 75 bp, Artificial Sequence
  Synthetic
tgaactgacaccagctgagacaacaactaggtttagagcctatttcaacacaccaggcctccccgtctgccaaga

SEQ ID NO: 129528 - DNA, 75 bp, Artificial Sequence
  Synthetic
tgaactgacaccagctgagacaacaactaggttcagagcctatttcaacacaccaggcctccccgtctgccaaga

SEQ ID NO: 129529 - DNA, 75 bp, Artificial Sequence
  Synthetic
tgaactgacaccagctgagacaacaactaggttgagagcctatttcaacacaccaggcctccccgtctgccaaga

SEQ ID NO: 129530 - DNA, 75 bp, Artificial Sequence
  Synthetic
gcttgtggatgatgctgctgatagctcaggctgaggccgccttagagaacttggtggtcctcaatgcggcgtccg

SEQ ID NO: 129531 - DNA, 75 bp, Artificial Sequence
  Synthetic
gtcgtgcgctgtggcgggtatccgctgaggagtacgtcgaaatcaggcgagtgggtgagcaccattatgtaacag

SEQ ID NO: 129532 - DNA, 75 bp, Artificial Sequence
  Synthetic
gggcactgctctctccgaggcctatctcaactttgaaaggatcttcggggggtccggtgctctgccccaggggac

SEQ ID NO: 129533 - DNA, 75 bp, Artificial Sequence
  Synthetic
agctgtgccccagacctaccaagtgggatacctccatgcccccactggcagtgggaagagtactaaggtccccgc

SEQ ID NO: 129534 - DNA, 75 bp, Artificial Sequence
  Synthetic
ctcaactttgaaaggatcttcggggggtccggtgctctgccccaggggacacgttgtgggaattttccgagcagc

SEQ ID NO: 129535 - DNA, 75 bp, Artificial Sequence
  Synthetic
gtagcttatcaggccacggtttgcgcgagggcgcttgcgcctccgcccagctgggacaccatgtggaaatgcctg

SEQ ID NO: 129536 - DNA, 75 bp, Artificial Sequence
  Synthetic
caaacctctcttacgggatgaggtcagtttccaggtcgggctccactcttatgtggtggggtcgcagttaccctg

SEQ ID NO: 129537 - DNA, 75 bp, Artificial Sequence
  Synthetic
ccagagcgcatggccagctgccgccccatcgacgagttcgatcaggggtggggtcccatcacttacgctgagccg

SEQ ID NO: 129538 - DNA, 75 bp, Artificial Sequence
  Synthetic
cctatgacatcataatatgcgacgaatgccattcagtggattccacaaccatccttggcattgggaccgtgcttg

SEQ ID NO: 129539 - DNA, 75 bp, Artificial Sequence
  Synthetic
ccctctttagctagttcgtcggctagccagctatcagccccctcgctgagggcgacatgcaccaccaaccataac

SEQ ID NO: 129540 - DNA, 75 bp, Artificial Sequence
  Synthetic
ctcacccatcctataaccaaatacatcatggcctgcatgtcagcagacctcgaagtggtgaccagcacatgggtc

SEQ ID NO: 129541 - DNA, 75 bp, Artificial Sequence
  Synthetic
tgccgtacttcgtgcgcgctcaagggctcattcgtgcatgcatgctggtgcggaaagccgctgggggccattatg

SEQ ID NO: 129542 - DNA, 75 bp, Artificial Sequence
  Synthetic
actcgttcgagccccttgtggctgagccaaacgacgaccgggagatctcggttcccgctgagatattgcggaaga

SEQ ID NO: 129543 - DNA, 75 bp, Artificial Sequence
  Synthetic
ccacggctgtcctcttccaccccaggggcaacctccgataccaccaccacggaggaagaagacggtggtactcac

SEQ ID NO: 129544 - DNA, 75 bp, Artificial Sequence
  Synthetic
cctcctatggaggcaggagatgggcggcaacatcaccagggttgagtcagagaacaaagtggtgattctggactc

SEQ ID NO: 129545 - DNA, 75 bp, Artificial Sequence
  Synthetic
tgatcaacaccaacggcagttggcacatcaatcgcacggccttgaactgcaacgcgagccttgacaccggctggc

SEQ ID NO: 129546 - DNA, 75 bp, Artificial Sequence
  Synthetic
gcagtcagcgccgaggcaggacagggagggggaggttgggcatatataggtatgtctcctccggtgagagggcgt

SEQ ID NO: 129547 - DNA, 75 bp, Artificial Sequence
  Synthetic
gaaccgccctcttgcgatgatggtaccgggtccgatgctgagtcgtggtcctccatgcccccccttgagggggaa

SEQ ID NO: 129548 - DNA, 75 bp, Artificial Sequence
  Synthetic
tgataccagcccagggagacgtcgtagtcgtcgctacagatgccctcatgacggggtacactggagactttgact

SEQ ID NO: 129549 - DNA, 75 bp, Artificial Sequence
  Synthetic
attcaactcttcaggctgttctgagaggttggccagctgcaaacccctcgccgctttcgcccagggctggggccc

SEQ ID NO: 129550 - DNA, 75 bp, Artificial Sequence
  Synthetic
cttcaatacgccaggattgcccgtatgccaagaccacctagaattctgggaggccgtgttcactggcctcacaca

SEQ ID NO: 129551 - DNA, 75 bp, Artificial Sequence
  Synthetic
gggccctggtgaccccgtgcgctccagaggagactagcttgcccatcaacgcgctgagcaattcactcttgcgcc

SEQ ID NO: 129552 - DNA, 75 bp, Artificial Sequence
  Synthetic
ttgcgttcgcatcgcgaggcaatcacgtgtctcctacgcactacgtccccgagtccgacgcggccgctcgcgtaa

SEQ ID NO: 129553 - DNA, 75 bp, Artificial Sequence
  Synthetic
cccccatcctgggacgttatgtggaagtgcctgattcggctcaaacccacacttgtgggccccacacctctgcta

SEQ ID NO: 129554 - DNA, 75 bp, Artificial Sequence
  Synthetic
tgtgcttaaggaggctaaggctaaggcatctactgtgaaggcgaacatgctgaccgtcgaggaagcgtgtgacct

SEQ ID NO: 129555 - DNA, 75 bp, Artificial Sequence
  Synthetic
aggtcacccttactcaccccgtaaccaagtacatcgctacgtgcatgcaagctgaccttgaggttatgacaagca

SEQ ID NO: 129556 - DNA, 75 bp, Artificial Sequence
  Synthetic
ggagatctgggattgggtctgcaccgtattgtctgacttcaagacctggctgaaggctaaactattgccccagat

SEQ ID NO: 129557 - DNA, 75 bp, Artificial Sequence
  Synthetic
gacctgttagaggacagtgtgacacccattgacacgacaatcatggcaaagaacgaagtgttctgcgtcgcccct

SEQ ID NO: 129558 - DNA, 75 bp, Artificial Sequence
  Synthetic
acgaagtacatcgctacctgcatgcaagctgatcttgagatcatgacgagcacgtgggttctcgcggggggagtt

SEQ ID NO: 129559 - DNA, 75 bp, Artificial Sequence
  Synthetic
gccgaggcgcatttgcaagtgtgggtcccccctctcaacgttcgggggggccgcgatgccatcatcctcctcacg

SEQ ID NO: 129560 - DNA, 75 bp, Artificial Sequence
  Synthetic
ggccatatcaaaaatggttcgatgaggatagtcgggcctaagacttgcagcaacacctggcacgggaccttcccc

SEQ ID NO: 129561 - DNA, 75 bp, Artificial Sequence
  Synthetic
ccattgccgtgatggggtccgcctacgggttccaatactcgcctgggcagcgggttgagttcctggtgaacacct

SEQ ID NO: 129562 - DNA, 75 bp, Artificial Sequence
  Synthetic
gtggcaggtcctcccatgctccttcacgacccttccagccttgtctaccggcctcatccatctccaccagaatat

SEQ ID NO: 129563 - DNA, 75 bp, Artificial Sequence
  Synthetic
tcgtgcatgcatgctggtgcggaaggtcgctgggggtcattatgtccaaatggctttcatgaaactggccgcgct

SEQ ID NO: 129564 - DNA, 75 bp, Artificial Sequence
  Synthetic
tgtccatgccaagttcctgcccctgagttcttcactgaggtggatggcgttagaattcaccgccacgcgcctagg

SEQ ID NO: 129565 - DNA, 75 bp, Artificial Sequence
  Synthetic
atgttgtgacctggcccccgaggcccgtgtggccataaggtctctcacagagaggctttacgttgggggccccct

SEQ ID NO: 129566 - DNA, 75 bp, Artificial Sequence
  Synthetic
tgcaagcccttgctaacggatgaagttacgttctccgtgggcctcaactcgtttgtggtaggatcccaacttccc

SEQ ID NO: 129567 - DNA, 75 bp, Artificial Sequence
  Synthetic
gtgtcctaaccactagctgcggcaacaccctcacatgctaccttaaggctgctgcagcctgtcgagccgccgggc

SEQ ID NO: 129568 - DNA, 75 bp, Artificial Sequence
  Synthetic
aggtgatggtgctggaatctttcgagccacttgtggccgaagaggacaaggaggtttctgtcgcggcagagatct

SEQ ID NO: 129569 - DNA, 75 bp, Artificial Sequence
  Synthetic
aggtgatggtgctggattctttcgagccacttgtggccgaagaggacaaggaggtttctgtcgcggcagagatct

SEQ ID NO: 129570 - DNA, 75 bp, Artificial Sequence
  Synthetic
aggtgatggtgctggactctttcgagccacttgtggccgaagaggacaaggaggtttctgtcgcggcagagatct

SEQ ID NO: 129571 - DNA, 75 bp, Artificial Sequence
  Synthetic
aggtgatggtgctggagtctttcgagccacttgtggccgaagaggacaaggaggtttctgtcgcggcagagatct

SEQ ID NO: 129572 - DNA, 75 bp, Artificial Sequence
  Synthetic
gtgatcgactgtaacacatgtgtcacccagacggtcgatttcagcttggaccctaccttcaccattgagacgacg

SEQ ID NO: 129573 - DNA, 75 bp, Artificial Sequence
  Synthetic
ccctaccttcaccattgagacgacgaccgtgccccaagacgcggtgtcgcgctcgcagcggcgaggcaggactgg

SEQ ID NO: 129574 - DNA, 75 bp, Artificial Sequence
  Synthetic
ctcactataactagcctgctccggagactccaccaatggattacagaggagtgccctgtcccctgctctggctcg

SEQ ID NO: 129575 - DNA, 75 bp, Artificial Sequence
  Synthetic
ggctaggcaacatcatcatgtacgcccccacattgtgggcaaggatggttttaatgacccatttcttttccatcc

SEQ ID NO: 129576 - DNA, 75 bp, Artificial Sequence
  Synthetic
ctgcgcgctagcgcgcaagatggtcggaggccagtacacgcaaatgatcatcatcaagttgggggcgctctttgg

SEQ ID NO: 129577 - DNA, 75 bp, Artificial Sequence
  Synthetic
ggttgtactctccgagtccaccgtctcagaagccttagcggacttggcggcaaagtcctttggccaccctgagtc

SEQ ID NO: 129578 - DNA, 75 bp, Artificial Sequence
  Synthetic
acttggggtcccgcccttgcgcgtctggagacaccgggcccgtagtgtccgcgctaggctcatagcccttggggg

SEQ ID NO: 129579 - DNA, 75 bp, Artificial Sequence
  Synthetic
caccttgagattatcaggacctaagacctgcctaaacacctggcaggggacatttcccatcaattgttacacgga

SEQ ID NO: 129580 - DNA, 75 bp, Artificial Sequence
  Synthetic
attcatggacgggggcgcttgtaacacctagcgcagctgaggagtccaagctgcccatcaaccccctgagcaact

SEQ ID NO: 129581 - DNA, 75 bp, Artificial Sequence
  Synthetic
gctgcacgggccaacacccctgctgtataggctgggagccgtccaaaatgaggtcatcctcacacaccccataac

SEQ ID NO: 129582 - DNA, 75 bp, Artificial Sequence
  Synthetic
agacatgcatgaacacctggcaaggggctttccccatcaactcctacacggagggccagtgcgtgccaaagcctt

SEQ ID NO: 129583 - DNA, 75 bp, Artificial Sequence
  Synthetic
tgcccggccccgctggtttttaggtctcctactcctactctctgtaggggtaggcatctacctcctccctaaccg

SEQ ID NO: 129584 - DNA, 75 bp, Artificial Sequence
  Synthetic
gacgggatcaattatgcaacagggaatcttcctggttgctccttttctatcttcctcttggcacttctctcgtgc

SEQ ID NO: 129585 - DNA, 75 bp, Artificial Sequence
  Synthetic
ggatgatgtatcgttttgtgtggggctcaactcctacgtgatcgggtcacagctcccttgtgatcctgagcctga

SEQ ID NO: 129586 - DNA, 75 bp, Artificial Sequence
  Synthetic
caacttgaaagtcccctgccaattgcccgctccagagttcttttcgtgggtggacggggtccaaatccacaggtt

SEQ ID NO: 129587 - DNA, 75 bp, Artificial Sequence
  Synthetic
tcctcggctagccagctgtcagcgccgtcgttgcgggccacctgtaccacccacgccaaaggtcctgacattgac

SEQ ID NO: 129588 - DNA, 75 bp, Artificial Sequence
  Synthetic
tgtaccgtgtgtgagaagtgggaacacatcgaggtgttgggcggctttgactcccacagtggcggccccgtacgt

SEQ ID NO: 129589 - DNA, 75 bp, Artificial Sequence
  Synthetic
aatgcggttcggggccttggttgacacctaggtgcttggttgactatccatacaggctttggcactacccctgca

SEQ ID NO: 129590 - DNA, 75 bp, Artificial Sequence
  Synthetic
acatcgaggtgttgggcggctttgactcccacagtggcggccccgtacgtcggtgctccagttgagtccctacga

SEQ ID NO: 129591 - DNA, 75 bp, Artificial Sequence
  Synthetic
taggatgtatgtggggggcgtggagcacaggctcaacgccgcatgcaattggactcgaggagagcgttgtgactt

SEQ ID NO: 129592 - DNA, 75 bp, Artificial Sequence
  Synthetic
gacacggaggtgttggcgtcaatgctgacagacccatcacacatcacagcggaagcggcagcgcgacgcttgaga

SEQ ID NO: 129593 - DNA, 75 bp, Artificial Sequence
  Synthetic
tcctttgaccccatggtcgatgaggaggacgagcgcgagccttcaataccatcagagtacctgctccccaagcgc

SEQ ID NO: 129594 - DNA, 75 bp, Artificial Sequence
  Synthetic
tccgccctcgcctccactggaccacccaggactgtaactgctcaatctactctgggcatgtcacaggacacagga

SEQ ID NO: 129595 - DNA, 75 bp, Artificial Sequence
  Synthetic
acatggtagatgccaatctcttcatgggaggtgatgtgacacgggtggaatctgagtccaaagtgctcatcctcg

SEQ ID NO: 129596 - DNA, 75 bp, Artificial Sequence
  Synthetic
tggcttgggacatgatgatgaactggagccccaccacgacgctgctccttgcccaagtcatgaggatccctggca

SEQ ID NO: 129597 - DNA, 75 bp, Artificial Sequence
  Synthetic
cctcatggggtacattccgctcgtcggcgcccccctagggggcgctgccagggccctggcgcatggcgtccgggt

SEQ ID NO: 129598 - DNA, 75 bp, Artificial Sequence
  Synthetic
cccgagaggttggccagttgccgacccctcacccattttgaccagggctggggctccatcagctatgccaatgga

SEQ ID NO: 129599 - DNA, 75 bp, Artificial Sequence
  Synthetic
ggaggacgagcgcgaaccctcaattccttcagaatatctgcttcccggaaagaagagattcccaccagcactacc

SEQ ID NO: 129600 - DNA, 75 bp, Artificial Sequence
  Synthetic
gcttcggcttttgtcggcgccggcatcgctggcgccgctgttggcagcataggccttgggaaggtgcttgtggac

SEQ ID NO: 129601 - DNA, 75 bp, Artificial Sequence
  Synthetic
ggtgtgccctccccccttctggaaccgccccagtaccgccccctaggaggcgccgagctgtggtgtcgacccaga

SEQ ID NO: 129602 - DNA, 75 bp, Artificial Sequence
  Synthetic
cctcttcgccggagttgaagctcaaacccacgtgactggaggagcgacggcccaacagacctacggcttaaccag

SEQ ID NO: 129603 - DNA, 75 bp, Artificial Sequence
  Synthetic
tgtggtccggtatattgcttcacccctagccccgtggtggtggggacgaccgacaggtggggcgtgcctacctat

SEQ ID NO: 129604 - DNA, 75 bp, Artificial Sequence
  Synthetic
accgcggctccgacgccccctcccaggaggcgccgagctgtggtcttagaccagagcaatgtgggggaagccctc

SEQ ID NO: 129605 - DNA, 75 bp, Artificial Sequence
  Synthetic
cgagaccagcatatcaccgccggacgagtctggtgattcggagacgggatctgtgtcctccatgcccccccttga

SEQ ID NO: 129606 - DNA, 75 bp, Artificial Sequence
  Synthetic
ggaggcgccgagctgtggtcttagaccagagcaatgtgggggaagccctcaaggcgctggccgtcaagagcttcg

SEQ ID NO: 129607 - DNA, 75 bp, Artificial Sequence
  Synthetic
tgctcctgctcctgctggcgttaccaccacgagcgtacgccatggaccgggagatggctgcatcgtgcggaggcg

SEQ ID NO: 129608 - DNA, 75 bp, Artificial Sequence
  Synthetic
acggggtttttggccgcactcttttacgtcaacaaattcaacagctccgggtgtgccgagagattgtcgtcgtgt

SEQ ID NO: 129609 - DNA, 75 bp, Artificial Sequence
  Synthetic
tggtagcataccaggccacggtgtgcgccagggctcaggctccacctccatcgtgggaccaaatgtggaagtgtc

SEQ ID NO: 129610 - DNA, 75 bp, Artificial Sequence
  Synthetic
gggctccatctcctccatgccgcccctcgaaggcgagccgggggatcctgacttggagcctgcgtcggctgacca

SEQ ID NO: 129611 - DNA, 75 bp, Artificial Sequence
  Synthetic
tccacgtgttccgaggaggacgactctgtggtgtgttgctccatgtcgtactcctggaccggggcgttgataact

SEQ ID NO: 129612 - DNA, 75 bp, Artificial Sequence
  Synthetic
gatcaacggctcctctgacgctaggccatattgctgggactacgcgccgcggccctgcggggtcgtgccggcttc

SEQ ID NO: 129613 - DNA, 75 bp, Artificial Sequence
  Synthetic
ctcgaaggcgagccgggggatcctgacttggagcctgcgtcggctgaccaccaatccgcctcgcaagaagtggag

SEQ ID NO: 129614 - DNA, 75 bp, Artificial Sequence
  Synthetic
tactgcactacatcaaagagtgcctcacaacgggcgaagaaggtgaccttcgacagggtgcaactactagactct

SEQ ID NO: 129615 - DNA, 75 bp, Artificial Sequence
  Synthetic
tcaccccttgcagtcgtgaagaggagaagttaccaataaaccctctgagcaattcgctgctgcggtatcacaaca

SEQ ID NO: 129616 - DNA, 75 bp, Artificial Sequence
  Synthetic
cattatgactcagtcttgaaggacgtcaagcaggcagcctccaaggtcagtgctaggctcctctccatcgaggag

SEQ ID NO: 129617 - DNA, 75 bp, Artificial Sequence
  Synthetic
accgacgtgtttatcctgaattcgactaggccgcctaatggcgcttggttcggatgcgtgtggatgaacagtacc

SEQ ID NO: 129618 - DNA, 75 bp, Artificial Sequence
  Synthetic
gacatgtacggagtcacatactctatcactccgctggacctgccagccataatccaaagactccatggcttgagc

SEQ ID NO: 129619 - DNA, 75 bp, Artificial Sequence
  Synthetic
ctcgggccggccgatggaatggtctccaaggggtggaggttgctggcgcccatcacggcgtatgcccagcagaca

SEQ ID NO: 129620 - DNA, 75 bp, Artificial Sequence
  Synthetic
ttcatgaagctggccgcactgacaggcacgtacgtgtatgaccatcttactccactgcgggactgggcccacgcg

SEQ ID NO: 129621 - DNA, 75 bp, Artificial Sequence
  Synthetic
gttagcgcgcggctcctcacagtagaggaagcatgctcgctgaccccgccccattccgccaggtcaaaatacgga

SEQ ID NO: 129622 - DNA, 75 bp, Artificial Sequence
  Synthetic
ttgatctacgcacacaagttcaactcgtccgggtgcttggaacgcatgtccagctgccgccccatcaacgagttc

SEQ ID NO: 129623 - DNA, 75 bp, Artificial Sequence
  Synthetic
tgccgcaggcattgttgctcccaccatgctggtgtgcggcgacgacctagtcgtcatctcagagagtcaaggggc

SEQ ID NO: 129624 - DNA, 75 bp, Artificial Sequence
  Synthetic
tgtggcccctgctcctcctactcttagcgttgcccgaaagggcttacgctcatgaccgggagacggcagggtccc

SEQ ID NO: 129625 - DNA, 75 bp, Artificial Sequence
  Synthetic
aaggatcgaggccgtcctacacgtgtatgttccatcattcgatgtgcgcggcccccgagattctatcattatcct

SEQ ID NO: 129626 - DNA, 75 bp, Artificial Sequence
  Synthetic
tactgccctgctccttcaccaccctaccggctctgtccactggcttgatccatctccatcagaacatcgtggacg

SEQ ID NO: 129627 - DNA, 75 bp, Artificial Sequence
  Synthetic
atcttggaccaaaatctcaacttcgaaatgtacggagcagtgtactcagtcagtcctttggacctcccagccata

SEQ ID NO: 129628 - DNA, 75 bp, Artificial Sequence
  Synthetic
ggctgcctgggaaacagctagacactcccctgtcaattcatggttgggaaacatcatccagtacgccccaacaat

SEQ ID NO: 129629 - DNA, 75 bp, Artificial Sequence
  Synthetic
ccttacttcgtgagggcgcgtgcgttagtacaggcctgcagcttggtgcggggagtcatatatggcaagtatgtc

SEQ ID NO: 129630 - DNA, 75 bp, Artificial Sequence
  Synthetic
gggagtcatatatggcaagtatgtccagatggccttgctcaagataggggccttgaccggcacctacatttatga

SEQ ID NO: 129631 - DNA, 75 bp, Artificial Sequence
  Synthetic
tcgtagcattcaagatcatgagcggcgaagtcccctccacggaggacctggtcaatctgctgcccgccatcctct

SEQ ID NO: 129632 - DNA, 75 bp, Artificial Sequence
  Synthetic
tcagtaagtcctctggacctcccagccataattgaacggttgcatgggcttgaggccttctcactgcacacatac

SEQ ID NO: 129633 - DNA, 75 bp, Artificial Sequence
  Synthetic
gagagatccccttctatggcaaggccatccccatcgaggccatcaagggggggagacatctcatcttctgccatt

SEQ ID NO: 129634 - DNA, 75 bp, Artificial Sequence
  Synthetic
gttctgctcggaccagccgatgcggaaacggcaaggggttggaggcttctcgcccccatcaccgcgtacgcgcag

SEQ ID NO: 129635 - DNA, 75 bp, Artificial Sequence
  Synthetic
tcatcgctcggggagggaaggcggccacatgtggccgctatctcttcaactgggcggtgagaaccaagctcaaac

SEQ ID NO: 129636 - DNA, 75 bp, Artificial Sequence
  Synthetic
agtgctcacttccatgctcaccgacccctcccacattacagcagagacggctaagcgtaggctggccagggggtc

SEQ ID NO: 129637 - DNA, 75 bp, Artificial Sequence
  Synthetic
gcgggtagcaagaccatctgtggcccgaaagggcccgtcaaccaaatgtacaccaatgttgaccaggacctagtg

SEQ ID NO: 129638 - DNA, 75 bp, Artificial Sequence
  Synthetic
accagagccgaggcgcacttgcaagtgtgggtcccccctctcaatgttcggggaggccgcgatgccatcatcctc

SEQ ID NO: 129639 - DNA, 75 bp, Artificial Sequence
  Synthetic
tgcgtcggacttgttcctggtcactcggaacgcagatgtgattcccgtgcgcagaaggggtgatacccggggtgc

SEQ ID NO: 129640 - DNA, 75 bp, Artificial Sequence
  Synthetic
ccctacgtatagctggggggagaatgagacggacgtgctgctccttaacaacacgcggccgccgcaaggcaactg

SEQ ID NO: 129641 - DNA, 75 bp, Artificial Sequence
  Synthetic
tgtacccggggcgtggccaaggcggtcgacttcgtgccagtggagtctcttgagaccaccatgaggtccccggtc

SEQ ID NO: 129642 - DNA, 75 bp, Artificial Sequence
  Synthetic
ggctgcatcatcaccagcctcacaggccgggacaagaaccaggtcgagggagaggttcaagtggtctccaccgca

SEQ ID NO: 129643 - DNA, 75 bp, Artificial Sequence
  Synthetic
tatcaacaggctgcgtggtcatagtgggcagggttgtcttgtccgggaagccggcaattatacctgacagggaag

SEQ ID NO: 129644 - DNA, 75 bp, Artificial Sequence
  Synthetic
cggcaaggctatccccttagcttatgtaaagggggggagacacctcattttttgtcactcaaaaaagaagtgcga

SEQ ID NO: 129645 - DNA, 75 bp, Artificial Sequence
  Synthetic
tgcgccactgatgccctcatgactggctacaccggcgactttgactcagtgatagactgtaacacgtctgtcata

SEQ ID NO: 129646 - DNA, 75 bp, Artificial Sequence
  Synthetic
gcaacaccacacttttgttcaggactgcaattgttccatttacccgggccacgtcacaggacaccgtatggcatg

SEQ ID NO: 129647 - DNA, 75 bp, Artificial Sequence
  Synthetic
atggcgtatggccgctgctcctgctcctgctggcactaccaccacgagcttatgctatggaccgggagatggctg

SEQ ID NO: 129648 - DNA, 75 bp, Artificial Sequence
  Synthetic
ggacatcatcactggagcgcactggggcgtaatgttcggcctagcctacttctccatgcagggggcgtgggccaa

SEQ ID NO: 129649 - DNA, 75 bp, Artificial Sequence
  Synthetic
gtgagtgctacgacgccgggtgcgcctggtacgagctgacgccagccgagacaaccactaggctgagggcctatt

SEQ ID NO: 129650 - DNA, 75 bp, Artificial Sequence
  Synthetic
cctcctcgcgtgcgtggtccacccagagctaatctttgatatcaccaaactcctgctcgccgtactcggcccgct

SEQ ID NO: 129651 - DNA, 75 bp, Artificial Sequence
  Synthetic
acccctgggtcccaacaaaacatccaacttgttaacaccaacggcagttggcatattaaccgcacggccttgaat

SEQ ID NO: 129652 - DNA, 75 bp, Artificial Sequence
  Synthetic
tcaagaccacctcgaattctgggagagtatctttactggccttgtccacatagatggccatttcctatcccagac

SEQ ID NO: 129653 - DNA, 75 bp, Artificial Sequence
  Synthetic
taaatttaactcctcgggttgtcctcaacgaatgtcctcctgccgctccatcgaggagtttaggataggatgggg

SEQ ID NO: 129654 - DNA, 75 bp, Artificial Sequence
  Synthetic
cagtggcaggtccttccgtgttccttcacgaccttgccagccttgactaccggcctcatccacctccaccagaac

SEQ ID NO: 129655 - DNA, 75 bp, Artificial Sequence
  Synthetic
cgcaacagggaatcttcccggttgctctttctctatcttcctcttggcacttctctcgtgcctgactgtccccgc

SEQ ID NO: 129656 - DNA, 75 bp, Artificial Sequence
  Synthetic
agtcggcagcgtggtgatcgttgggagggtcgtcttatcgggtaagcccgtcatcattcccgaccgagagaccct

SEQ ID NO: 129657 - DNA, 75 bp, Artificial Sequence
  Synthetic
gcgccatacatcggcgcgccacttgagtctctacggagtcatgtggatttgatggtgggagccgccactgcttgt

SEQ ID NO: 129658 - DNA, 75 bp, Artificial Sequence
  Synthetic
gcgccatacatcggcgcgccacttgagtctctacggagtcatgtggatttgatggtgggtgccgccactgcttgt

SEQ ID NO: 129659 - DNA, 75 bp, Artificial Sequence
  Synthetic
gcgccatacatcggcgcgccacttgagtctctacggagtcatgtggatttgatggtgggcgccgccactgcttgt

SEQ ID NO: 129660 - DNA, 75 bp, Artificial Sequence
  Synthetic
gcgccatacatcggcgcgccacttgagtctctacggagtcatgtggatttgatggtgggggccgccactgcttgt

SEQ ID NO: 129661 - DNA, 75 bp, Artificial Sequence
  Synthetic
ttaacatcttggggggatgggtggctgcccaactcgctccccccagcgctgcttcggctttcgtgggcgccggca

SEQ ID NO: 129662 - DNA, 75 bp, Artificial Sequence
  Synthetic
ggaccatggttaactcccaaatgcctatttcattacccctacaggctgtggcattacccgtgtaccatcaacttc

SEQ ID NO: 129663 - DNA, 75 bp, Artificial Sequence
  Synthetic
attctggcgggctatggggcgggggtggctggcgcactcgtggcctttaaggtcatgagcggcgagatgccctcc

SEQ ID NO: 129664 - DNA, 75 bp, Artificial Sequence
  Synthetic
aaacgaggtcaccctcacacaccccataaccaaatacatcatggcatgcatgtcggccgacctggaggtcgtcac

SEQ ID NO: 129665 - DNA, 75 bp, Artificial Sequence
  Synthetic
tcacgcagtgcttgccagaggcagaagaaagtcacatttgacagactgcaggttctggacagccactaccaggac

SEQ ID NO: 129666 - DNA, 75 bp, Artificial Sequence
  Synthetic
gcaggctaattgggccaaagtcatcctggtcctattcctctttgcaggggtggatgccgaaacctatgtgactgg

SEQ ID NO: 129667 - DNA, 75 bp, Artificial Sequence
  Synthetic
cggcggagatcctgcggaaatccaggaaatttcccccagcgatgcccatatgggcacgcccggattacaaccctc

SEQ ID NO: 129668 - DNA, 75 bp, Artificial Sequence
  Synthetic
aacaggaccgccctcaactgcaatgacagcttgaacaccgggttcttggctggcttgttctaccgctacaagttt

SEQ ID NO: 129669 - DNA, 75 bp, Artificial Sequence
  Synthetic
gggacaagctgaggcagcgctggagaagctagtcatcctgcatgcggccagtgccgcaagctctcatggcatgct

SEQ ID NO: 129670 - DNA, 75 bp, Artificial Sequence
  Synthetic
gagggggcggtccagtggatgaaccgcctcatcgccttcgcgtcgcggggcaatcatgtatcccccacgcattat

SEQ ID NO: 129671 - DNA, 75 bp, Artificial Sequence
  Synthetic
ccgaagaaaggccttattgctggcactatccgccgcggccatgcggactcgtgtcggcatccattgtgtgtggtc

SEQ ID NO: 129672 - DNA, 75 bp, Artificial Sequence
  Synthetic
ctcctggcacttccccaacaggcctatgcccttgatacaactgagcaggggcaaataggcctggtccttctagtg

SEQ ID NO: 129673 - DNA, 75 bp, Artificial Sequence
  Synthetic
gttttgggagatctgggattgggtctgcaccgtactgagtgacttcaagacgtggctaaaggccaagcttatgcc

SEQ ID NO: 129674 - DNA, 75 bp, Artificial Sequence
  Synthetic
tgcaccgtactgagtgacttcaagacgtggctaaaggccaagcttatgcccaccatgccaggcatcccctttctc

SEQ ID NO: 129675 - DNA, 75 bp, Artificial Sequence
  Synthetic
gggggaatgagactgatgtcttccttttgaactctacgagaccgccgcatggtgcatggtttggttgcgtgtgga

SEQ ID NO: 129676 - DNA, 75 bp, Artificial Sequence
  Synthetic
aagattgggtgccaccttggcaggcccgaggcggccgcgatggcatcatatgggccgccaccatattctgtccgg

SEQ ID NO: 129677 - DNA, 75 bp, Artificial Sequence
  Synthetic
gtccatgctcactgatccctcccacataacagcagaggcggccgggagaaggttggcgaggggatcacccccctc

SEQ ID NO: 129678 - DNA, 75 bp, Artificial Sequence
  Synthetic
tgggccgccaccatattctgtccgggtgtattgtttgacataaccaattggctcctggcaatcttaggacctggt

SEQ ID NO: 129679 - DNA, 75 bp, Artificial Sequence
  Synthetic
ggagaccacctacgccaagtgcgggtcaggcccttggatcacaccacggtgcttgattgattacccgtaccggct

SEQ ID NO: 129680 - DNA, 75 bp, Artificial Sequence
  Synthetic
ttgtcggcggcatagagcatcggatggacgcggcatgcaactggaccagaggagaagtctgtagcttggagcaca

SEQ ID NO: 129681 - DNA, 75 bp, Artificial Sequence
  Synthetic
ttgtcggcggcatagagcatcggatggacgcggcatgcaactggaccagaggagaagtctgttgcttggagcaca

SEQ ID NO: 129682 - DNA, 75 bp, Artificial Sequence
  Synthetic
ttgtcggcggcatagagcatcggatggacgcggcatgcaactggaccagaggagaagtctgtcgcttggagcaca

SEQ ID NO: 129683 - DNA, 75 bp, Artificial Sequence
  Synthetic
ttgtcggcggcatagagcatcggatggacgcggcatgcaactggaccagaggagaagtctgtggcttggagcaca

SEQ ID NO: 129684 - DNA, 75 bp, Artificial Sequence
  Synthetic
ttgtcggcggcatagagcatcggatggacgcggcatgcaactggaccagtggagaagtctgtagcttggagcaca

SEQ ID NO: 129685 - DNA, 75 bp, Artificial Sequence
  Synthetic
ttgtcggcggcatagagcatcggatggacgcggcatgcaactggaccagtggagaagtctgttgcttggagcaca

SEQ ID NO: 129686 - DNA, 75 bp, Artificial Sequence
  Synthetic
ttgtcggcggcatagagcatcggatggacgcggcatgcaactggaccagtggagaagtctgtcgcttggagcaca

SEQ ID NO: 129687 - DNA, 75 bp, Artificial Sequence
  Synthetic
ttgtcggcggcatagagcatcggatggacgcggcatgcaactggaccagtggagaagtctgtggcttggagcaca

SEQ ID NO: 129688 - DNA, 75 bp, Artificial Sequence
  Synthetic
ttgtcggcggcatagagcatcggatggacgcggcatgcaactggaccagcggagaagtctgtagcttggagcaca

SEQ ID NO: 129689 - DNA, 75 bp, Artificial Sequence
  Synthetic
ttgtcggcggcatagagcatcggatggacgcggcatgcaactggaccagcggagaagtctgttgcttggagcaca

SEQ ID NO: 129690 - DNA, 75 bp, Artificial Sequence
  Synthetic
ttgtcggcggcatagagcatcggatggacgcggcatgcaactggaccagcggagaagtctgtcgcttggagcaca

SEQ ID NO: 129691 - DNA, 75 bp, Artificial Sequence
  Synthetic
ttgtcggcggcatagagcatcggatggacgcggcatgcaactggaccagcggagaagtctgtggcttggagcaca

SEQ ID NO: 129692 - DNA, 75 bp, Artificial Sequence
  Synthetic
ttgtcggcggcatagagcatcggatggacgcggcatgcaactggaccaggggagaagtctgtagcttggagcaca

SEQ ID NO: 129693 - DNA, 75 bp, Artificial Sequence
  Synthetic
ttgtcggcggcatagagcatcggatggacgcggcatgcaactggaccaggggagaagtctgttgcttggagcaca

SEQ ID NO: 129694 - DNA, 75 bp, Artificial Sequence
  Synthetic
ttgtcggcggcatagagcatcggatggacgcggcatgcaactggaccaggggagaagtctgtcgcttggagcaca

SEQ ID NO: 129695 - DNA, 75 bp, Artificial Sequence
  Synthetic
ttgtcggcggcatagagcatcggatggacgcggcatgcaactggaccaggggagaagtctgtggcttggagcaca

SEQ ID NO: 129696 - DNA, 75 bp, Artificial Sequence
  Synthetic
cctcgcggttgctgtagaacccattgttttcagcccaatggagaaaaaagtcattgtgtggggagcggagacggc

SEQ ID NO: 129697 - DNA, 75 bp, Artificial Sequence
  Synthetic
agcttgtaaacatcaacggcagctggcacatcaacaggacagccctgaactgcaacgattccctcaacaccgggt

SEQ ID NO: 129698 - DNA, 75 bp, Artificial Sequence
  Synthetic
caactcgtttgtagtggggtcccagctcccttgtgagcctgaaccggacgtggttgtggtaacatccatgctgac

SEQ ID NO: 129699 - DNA, 75 bp, Artificial Sequence
  Synthetic
gtccaatacctctacggtgttggatctgcattggtgtcttgggcccttaagtgggaatatgtggtactcgcgttc

SEQ ID NO: 129700 - DNA, 75 bp, Artificial Sequence
  Synthetic
cgagtacacttccaaggggtggaaacttcttgcgcccatcaccgcttatgcccagcagacgcgtggtttgctggg

SEQ ID NO: 129701 - DNA, 75 bp, Artificial Sequence
  Synthetic
cctccacggaggaagaggacggttgtcctgacagagtccaccgtgtcttctgccttggcggagctcgctactaag

SEQ ID NO: 129702 - DNA, 75 bp, Artificial Sequence
  Synthetic
cttcggctgctggcacccacggcttctggtatgctatcctcttcatctgcattgtctggtatgtcaagggtcggc

SEQ ID NO: 129703 - DNA, 75 bp, Artificial Sequence
  Synthetic
cttcggctgctggcacccacggcttctggtatgctatcctcttcatctgcattgtctggtatgtcatgggtcggc

SEQ ID NO: 129704 - DNA, 75 bp, Artificial Sequence
  Synthetic
cttcggctgctggcacccacggcttctggtatgctatcctcttcatctgcattgtctggtatgtcacgggtcggc

SEQ ID NO: 129705 - DNA, 75 bp, Artificial Sequence
  Synthetic
cttcggctgctggcacccacggcttctggtatgctatcctcttcatctgcattgtctggtatgtcaggggtcggc

SEQ ID NO: 129706 - DNA, 75 bp, Artificial Sequence
  Synthetic
tcgggaatcctgtggacggtcttccacggcgctgggaacaaaacgctagctggctcacgagggcctgttacgcag

SEQ ID NO: 129707 - DNA, 75 bp, Artificial Sequence
  Synthetic
aacggttccatgaggatcgttgggcctaagacctgcagcaacacgtggcatgggacgttccccatcaacgcgtac

SEQ ID NO: 129708 - DNA, 75 bp, Artificial Sequence
  Synthetic
tgaagcaaatcttctctggggttccaacgtcacccggatcgagtcggaaaccaaggtggtaacattggactcttt

SEQ ID NO: 129709 - DNA, 75 bp, Artificial Sequence
  Synthetic
ctgcgggatgtggcccctgcttctcctacttctaatgctgcccgagagggcctatgcatatgatcgggaggtggc

SEQ ID NO: 129710 - DNA, 75 bp, Artificial Sequence
  Synthetic
cggccggagtacaatcctcctctggtcgacacttggaagcggccggactaccagcccccggtcgttcacggttgc

SEQ ID NO: 129711 - DNA, 75 bp, Artificial Sequence
  Synthetic
tcacccggaacgctgatgtcatcccggctcggagacagggagaccgacgaggggcattgctctccccaaggcctc

SEQ ID NO: 129712 - DNA, 75 bp, Artificial Sequence
  Synthetic
ctccacactacaagtcatggctggctaggggactgtggtggattcaatattttatagctaggaccgaggctacgc

SEQ ID NO: 129713 - DNA, 75 bp, Artificial Sequence
  Synthetic
tttcaagtttgaaggggtcctcgggggggccagtgctttgccctagaggtcatgctgtggggattttccgagcag

SEQ ID NO: 129714 - DNA, 75 bp, Artificial Sequence
  Synthetic
gacggtggtacttgacgagtctacggtctccaacgtgttggcaggcctggccgagaaaacctttggcaggcccga

SEQ ID NO: 129715 - DNA, 75 bp, Artificial Sequence
  Synthetic
atatctcctggccatcttagggcccctctacatactccaggtctcactcctacgcgtcccttactttgtgagggc

SEQ ID NO: 129716 - DNA, 75 bp, Artificial Sequence
  Synthetic
ccctgctgtgcctcagacctaccaggtgggatatttacatgcccctaccggtagtgggaagagcactaaggtgcc

SEQ ID NO: 129717 - DNA, 75 bp, Artificial Sequence
  Synthetic
acaagcgctggtcaagatctgcagcttgttgcgtggggtaatttacggcaagtattgccaaatggccatgcttaa

SEQ ID NO: 129718 - DNA, 75 bp, Artificial Sequence
  Synthetic
acaagcgctggtcaagatctgcagcttgttgcgtggggtattttacggcaagtattgccaaatggccatgcttaa

SEQ ID NO: 129719 - DNA, 75 bp, Artificial Sequence
  Synthetic
acaagcgctggtcaagatctgcagcttgttgcgtggggtactttacggcaagtattgccaaatggccatgcttaa

SEQ ID NO: 129720 - DNA, 75 bp, Artificial Sequence
  Synthetic
acaagcgctggtcaagatctgcagcttgttgcgtggggtagtttacggcaagtattgccaaatggccatgcttaa

SEQ ID NO: 129721 - DNA, 75 bp, Artificial Sequence
  Synthetic
acatgcgctggtcaagatctgcagcttgttgcgtggggtaatttacggcaagtattgccaaatggccatgcttaa

SEQ ID NO: 129722 - DNA, 75 bp, Artificial Sequence
  Synthetic
acatgcgctggtcaagatctgcagcttgttgcgtggggtattttacggcaagtattgccaaatggccatgcttaa

SEQ ID NO: 129723 - DNA, 75 bp, Artificial Sequence
  Synthetic
acatgcgctggtcaagatctgcagcttgttgcgtggggtactttacggcaagtattgccaaatggccatgcttaa

SEQ ID NO: 129724 - DNA, 75 bp, Artificial Sequence
  Synthetic
acatgcgctggtcaagatctgcagcttgttgcgtggggtagtttacggcaagtattgccaaatggccatgcttaa

SEQ ID NO: 129725 - DNA, 75 bp, Artificial Sequence
  Synthetic
acacgcgctggtcaagatctgcagcttgttgcgtggggtaatttacggcaagtattgccaaatggccatgcttaa

SEQ ID NO: 129726 - DNA, 75 bp, Artificial Sequence
  Synthetic
acacgcgctggtcaagatctgcagcttgttgcgtggggtattttacggcaagtattgccaaatggccatgcttaa

SEQ ID NO: 129727 - DNA, 75 bp, Artificial Sequence
  Synthetic
acacgcgctggtcaagatctgcagcttgttgcgtggggtactttacggcaagtattgccaaatggccatgcttaa

SEQ ID NO: 129728 - DNA, 75 bp, Artificial Sequence
  Synthetic
acacgcgctggtcaagatctgcagcttgttgcgtggggtagtttacggcaagtattgccaaatggccatgcttaa

SEQ ID NO: 129729 - DNA, 75 bp, Artificial Sequence
  Synthetic
acaggcgctggtcaagatctgcagcttgttgcgtggggtaatttacggcaagtattgccaaatggccatgcttaa

SEQ ID NO: 129730 - DNA, 75 bp, Artificial Sequence
  Synthetic
acaggcgctggtcaagatctgcagcttgttgcgtggggtattttacggcaagtattgccaaatggccatgcttaa

SEQ ID NO: 129731 - DNA, 75 bp, Artificial Sequence
  Synthetic
acaggcgctggtcaagatctgcagcttgttgcgtggggtactttacggcaagtattgccaaatggccatgcttaa

SEQ ID NO: 129732 - DNA, 75 bp, Artificial Sequence
  Synthetic
acaggcgctggtcaagatctgcagcttgttgcgtggggtagtttacggcaagtattgccaaatggccatgcttaa

SEQ ID NO: 129733 - DNA, 75 bp, Artificial Sequence
  Synthetic
gtagtgggaagagcactaaggtgcccgcctcttacgctgctcaggggtacaaggtattggtgctaaacccttctg

SEQ ID NO: 129734 - DNA, 75 bp, Artificial Sequence
  Synthetic
cactcctggagtcatggaagaacccggactatgtccctccagtggtacatgggtgtccattaccacccgctaagg

SEQ ID NO: 129735 - DNA, 75 bp, Artificial Sequence
  Synthetic
cccctccagtgccacctccaaggagaaagaggacgattgccttgacagagtccacagtatcttctgccctggcag

SEQ ID NO: 129736 - DNA, 75 bp, Artificial Sequence
  Synthetic
gcgtaggccttgggaaggtgcttgtggacatcctggcgggctatggagcaggggtggctggcgcactcgtagcct

SEQ ID NO: 129737 - DNA, 75 bp, Artificial Sequence
  Synthetic
ccggattacaaccctccactggtagagtcctggaaagacccggactatgtccctccggtggtacatgggtgccca

SEQ ID NO: 129738 - DNA, 75 bp, Artificial Sequence
  Synthetic
taggttgacagtcttagccacggccacgcctcctgggtctgtaacgactccccaccccaacatagaggaagtagc

SEQ ID NO: 129739 - DNA, 75 bp, Artificial Sequence
  Synthetic
agcaatactgcgtcggcatgtgggcccgggagagggggctgtgcaatggatgaaccggctgatagcgttcgcttc

SEQ ID NO: 129740 - DNA, 75 bp, Artificial Sequence
  Synthetic
tactatcatggccaaaaacgaagttttctccgttaaaccggagaaggggggccgaaagtctgcgcgcctgatcgt

SEQ ID NO: 129741 - DNA, 75 bp, Artificial Sequence
  Synthetic
gcccgtgcgcaggagaggagacactagaggagctctcttgagccctagaccaatatccactcttaaggggtcttc

SEQ ID NO: 129742 - DNA, 75 bp, Artificial Sequence
  Synthetic
tcacacagaccgtcgacttcagtttggaccccacttttactgtgaccacacaaactgttccccaagacgctgtgt

SEQ ID NO: 129743 - DNA, 75 bp, Artificial Sequence
  Synthetic
gacacccgctgttttgactctactgtgactgaaaaggacattggggtcgaggaagaggtctaccagtgttgtgat

SEQ ID NO: 129744 - DNA, 75 bp, Artificial Sequence
  Synthetic
cacgcagccagcgtagagggcgaacgggtaggggtaggttgggcatatataggtatgtctcctctggagagcgag

SEQ ID NO: 129745 - DNA, 75 bp, Artificial Sequence
  Synthetic
caaagcagtggactttgtcccggttgagtcccttgagactaccatgagatcaccagtattcactgacaattcaac

SEQ ID NO: 129746 - DNA, 75 bp, Artificial Sequence
  Synthetic
caaagctgtggactttgtcccggttgagtcccttgagactaccatgagatcaccagtattcactgacaattcaac

SEQ ID NO: 129747 - DNA, 75 bp, Artificial Sequence
  Synthetic
caaagccgtggactttgtcccggttgagtcccttgagactaccatgagatcaccagtattcactgacaattcaac

SEQ ID NO: 129748 - DNA, 75 bp, Artificial Sequence
  Synthetic
caaagcggtggactttgtcccggttgagtcccttgagactaccatgagatcaccagtattcactgacaattcaac

SEQ ID NO: 129749 - DNA, 75 bp, Artificial Sequence
  Synthetic
gcagcctggtatgagctcacgccagcggagaccactgtcaggctccgggcatacttcaacacgcctggattaccc

SEQ ID NO: 129750 - DNA, 75 bp, Artificial Sequence
  Synthetic
gatgccgcgcaagtggcgtcttcaccaccagtttcgtaaacacactgacgtgctatcttaaggccacagccgcca

SEQ ID NO: 129751 - DNA, 75 bp, Artificial Sequence
  Synthetic
tgctatcttaaggccacagccgccactagggcagctggcctaagggactgcaccatgctggtctgcggagacgat

SEQ ID NO: 129752 - DNA, 75 bp, Artificial Sequence
  Synthetic
tgctatcttaaggccacagccgccactagggcagctggcctaagggactgcaccatgctggtctgcggtgacgat

SEQ ID NO: 129753 - DNA, 75 bp, Artificial Sequence
  Synthetic
tgctatcttaaggccacagccgccactagggcagctggcctaagggactgcaccatgctggtctgcggcgacgat

SEQ ID NO: 129754 - DNA, 75 bp, Artificial Sequence
  Synthetic
tgctatcttaaggccacagccgccactagggcagctggcctaagggactgcaccatgctggtctgcggggacgat

SEQ ID NO: 129755 - DNA, 75 bp, Artificial Sequence
  Synthetic
aaacagacgcacaaaaccaagttcaatagaagggggtacaaaccagtaccaccacgaacaagcacttctgtttcc

SEQ ID NO: 129756 - DNA, 75 bp, Artificial Sequence
  Synthetic
tcccgtacctggtggcatatcaggctacggtgtgtgctagagctaaagccccccccccgtcttgggatgtcatgt

SEQ ID NO: 129757 - DNA, 75 bp, Artificial Sequence
  Synthetic
ctccacaaccagcatatgacctggagcaaataacatcatgctcatccaacgtttccgtagcacatgacgggaacg

SEQ ID NO: 129758 - DNA, 75 bp, Artificial Sequence
  Synthetic
ctccacaaccagcatatgacctggagcaaataacatcatgctcatccaacgtttccgtagctcatgacgggaacg

SEQ ID NO: 129759 - DNA, 75 bp, Artificial Sequence
  Synthetic
ctccacaaccagcatatgacctggagcaaataacatcatgctcatccaacgtttccgtagcccatgacgggaacg

SEQ ID NO: 129760 - DNA, 75 bp, Artificial Sequence
  Synthetic
ctccacaaccagcatatgacctggagcaaataacatcatgctcatccaacgtttccgtagcgcatgacgggaacg

SEQ ID NO: 129761 - DNA, 75 bp, Artificial Sequence
  Synthetic
ctccacaaccagcatatgacctggagcaaataacatcatgctcatccaacgtttccgttgcacatgacgggaacg

SEQ ID NO: 129762 - DNA, 75 bp, Artificial Sequence
  Synthetic
ctccacaaccagcatatgacctggagcaaataacatcatgctcatccaacgtttccgttgctcatgacgggaacg

SEQ ID NO: 129763 - DNA, 75 bp, Artificial Sequence
  Synthetic
ctccacaaccagcatatgacctggagcaaataacatcatgctcatccaacgtttccgttgcccatgacgggaacg

SEQ ID NO: 129764 - DNA, 75 bp, Artificial Sequence
  Synthetic
ctccacaaccagcatatgacctggagcaaataacatcatgctcatccaacgtttccgttgcgcatgacgggaacg

SEQ ID NO: 129765 - DNA, 75 bp, Artificial Sequence
  Synthetic
ctccacaaccagcatatgacctggagcaaataacatcatgctcatccaacgtttccgtcgcacatgacgggaacg

SEQ ID NO: 129766 - DNA, 75 bp, Artificial Sequence
  Synthetic
ctccacaaccagcatatgacctggagcaaataacatcatgctcatccaacgtttccgtcgctcatgacgggaacg

SEQ ID NO: 129767 - DNA, 75 bp, Artificial Sequence
  Synthetic
ctccacaaccagcatatgacctggagcaaataacatcatgctcatccaacgtttccgtcgcccatgacgggaacg

SEQ ID NO: 129768 - DNA, 75 bp, Artificial Sequence
  Synthetic
ctccacaaccagcatatgacctggagcaaataacatcatgctcatccaacgtttccgtcgcgcatgacgggaacg

SEQ ID NO: 129769 - DNA, 75 bp, Artificial Sequence
  Synthetic
ctccacaaccagcatatgacctggagcaaataacatcatgctcatccaacgtttccgtggcacatgacgggaacg

SEQ ID NO: 129770 - DNA, 75 bp, Artificial Sequence
  Synthetic
ctccacaaccagcatatgacctggagcaaataacatcatgctcatccaacgtttccgtggctcatgacgggaacg

SEQ ID NO: 129771 - DNA, 75 bp, Artificial Sequence
  Synthetic
ctccacaaccagcatatgacctggagcaaataacatcatgctcatccaacgtttccgtggcccatgacgggaacg

SEQ ID NO: 129772 - DNA, 75 bp, Artificial Sequence
  Synthetic
ctccacaaccagcatatgacctggagcaaataacatcatgctcatccaacgtttccgtggcgcatgacgggaacg

SEQ ID NO: 129773 - DNA, 75 bp, Artificial Sequence
  Synthetic
ctccacaaccagcatatgacctggagcatataacatcatgctcatccaacgtttccgtagcacatgacgggaacg

SEQ ID NO: 129774 - DNA, 75 bp, Artificial Sequence
  Synthetic
ctccacaaccagcatatgacctggagcatataacatcatgctcatccaacgtttccgtagctcatgacgggaacg

SEQ ID NO: 129775 - DNA, 75 bp, Artificial Sequence
  Synthetic
ctccacaaccagcatatgacctggagcatataacatcatgctcatccaacgtttccgtagcccatgacgggaacg

SEQ ID NO: 129776 - DNA, 75 bp, Artificial Sequence
  Synthetic
ctccacaaccagcatatgacctggagcatataacatcatgctcatccaacgtttccgtagcgcatgacgggaacg

SEQ ID NO: 129777 - DNA, 75 bp, Artificial Sequence
  Synthetic
ctccacaaccagcatatgacctggagcatataacatcatgctcatccaacgtttccgttgcacatgacgggaacg

SEQ ID NO: 129778 - DNA, 75 bp, Artificial Sequence
  Synthetic
ctccacaaccagcatatgacctggagcatataacatcatgctcatccaacgtttccgttgctcatgacgggaacg

SEQ ID NO: 129779 - DNA, 75 bp, Artificial Sequence
  Synthetic
ctccacaaccagcatatgacctggagcatataacatcatgctcatccaacgtttccgttgcccatgacgggaacg

SEQ ID NO: 129780 - DNA, 75 bp, Artificial Sequence
  Synthetic
ctccacaaccagcatatgacctggagcatataacatcatgctcatccaacgtttccgttgcgcatgacgggaacg

SEQ ID NO: 129781 - DNA, 75 bp, Artificial Sequence
  Synthetic
ctccacaaccagcatatgacctggagcatataacatcatgctcatccaacgtttccgtcgcacatgacgggaacg

SEQ ID NO: 129782 - DNA, 75 bp, Artificial Sequence
  Synthetic
ctccacaaccagcatatgacctggagcatataacatcatgctcatccaacgtttccgtcgctcatgacgggaacg

SEQ ID NO: 129783 - DNA, 75 bp, Artificial Sequence
  Synthetic
ctccacaaccagcatatgacctggagcatataacatcatgctcatccaacgtttccgtcgcccatgacgggaacg

SEQ ID NO: 129784 - DNA, 75 bp, Artificial Sequence
  Synthetic
ctccacaaccagcatatgacctggagcatataacatcatgctcatccaacgtttccgtcgcgcatgacgggaacg

SEQ ID NO: 129785 - DNA, 75 bp, Artificial Sequence
  Synthetic
ctccacaaccagcatatgacctggagcatataacatcatgctcatccaacgtttccgtggcacatgacgggaacg

SEQ ID NO: 129786 - DNA, 75 bp, Artificial Sequence
  Synthetic
ctccacaaccagcatatgacctggagcatataacatcatgctcatccaacgtttccgtggctcatgacgggaacg

SEQ ID NO: 129787 - DNA, 75 bp, Artificial Sequence
  Synthetic
ctccacaaccagcatatgacctggagcatataacatcatgctcatccaacgtttccgtggcccatgacgggaacg

SEQ ID NO: 129788 - DNA, 75 bp, Artificial Sequence
  Synthetic
ctccacaaccagcatatgacctggagcatataacatcatgctcatccaacgtttccgtggcgcatgacgggaacg

SEQ ID NO: 129789 - DNA, 75 bp, Artificial Sequence
  Synthetic
ctccacaaccagcatatgacctggagcacataacatcatgctcatccaacgtttccgtagcacatgacgggaacg

SEQ ID NO: 129790 - DNA, 75 bp, Artificial Sequence
  Synthetic
ctccacaaccagcatatgacctggagcacataacatcatgctcatccaacgtttccgtagctcatgacgggaacg

SEQ ID NO: 129791 - DNA, 75 bp, Artificial Sequence
  Synthetic
ctccacaaccagcatatgacctggagcacataacatcatgctcatccaacgtttccgtagcccatgacgggaacg

SEQ ID NO: 129792 - DNA, 75 bp, Artificial Sequence
  Synthetic
ctccacaaccagcatatgacctggagcacataacatcatgctcatccaacgtttccgtagcgcatgacgggaacg

SEQ ID NO: 129793 - DNA, 75 bp, Artificial Sequence
  Synthetic
ctccacaaccagcatatgacctggagcacataacatcatgctcatccaacgtttccgttgcacatgacgggaacg

SEQ ID NO: 129794 - DNA, 75 bp, Artificial Sequence
  Synthetic
ctccacaaccagcatatgacctggagcacataacatcatgctcatccaacgtttccgttgctcatgacgggaacg

SEQ ID NO: 129795 - DNA, 75 bp, Artificial Sequence
  Synthetic
ctccacaaccagcatatgacctggagcacataacatcatgctcatccaacgtttccgttgcccatgacgggaacg

SEQ ID NO: 129796 - DNA, 75 bp, Artificial Sequence
  Synthetic
ctccacaaccagcatatgacctggagcacataacatcatgctcatccaacgtttccgttgcgcatgacgggaacg

SEQ ID NO: 129797 - DNA, 75 bp, Artificial Sequence
  Synthetic
ctccacaaccagcatatgacctggagcacataacatcatgctcatccaacgtttccgtcgcacatgacgggaacg

SEQ ID NO: 129798 - DNA, 75 bp, Artificial Sequence
  Synthetic
ctccacaaccagcatatgacctggagcacataacatcatgctcatccaacgtttccgtcgctcatgacgggaacg

SEQ ID NO: 129799 - DNA, 75 bp, Artificial Sequence
  Synthetic
ctccacaaccagcatatgacctggagcacataacatcatgctcatccaacgtttccgtcgcccatgacgggaacg

SEQ ID NO: 129800 - DNA, 75 bp, Artificial Sequence
  Synthetic
ctccacaaccagcatatgacctggagcacataacatcatgctcatccaacgtttccgtcgcgcatgacgggaacg

SEQ ID NO: 129801 - DNA, 75 bp, Artificial Sequence
  Synthetic
ctccacaaccagcatatgacctggagcacataacatcatgctcatccaacgtttccgtggcacatgacgggaacg

SEQ ID NO: 129802 - DNA, 75 bp, Artificial Sequence
  Synthetic
ctccacaaccagcatatgacctggagcacataacatcatgctcatccaacgtttccgtggctcatgacgggaacg

SEQ ID NO: 129803 - DNA, 75 bp, Artificial Sequence
  Synthetic
ctccacaaccagcatatgacctggagcacataacatcatgctcatccaacgtttccgtggcccatgacgggaacg

SEQ ID NO: 129804 - DNA, 75 bp, Artificial Sequence
  Synthetic
ctccacaaccagcatatgacctggagcacataacatcatgctcatccaacgtttccgtggcgcatgacgggaacg

SEQ ID NO: 129805 - DNA, 75 bp, Artificial Sequence
  Synthetic
ctccacaaccagcatatgacctggagcagataacatcatgctcatccaacgtttccgtagcacatgacgggaacg

SEQ ID NO: 129806 - DNA, 75 bp, Artificial Sequence
  Synthetic
ctccacaaccagcatatgacctggagcagataacatcatgctcatccaacgtttccgtagctcatgacgggaacg

SEQ ID NO: 129807 - DNA, 75 bp, Artificial Sequence
  Synthetic
ctccacaaccagcatatgacctggagcagataacatcatgctcatccaacgtttccgtagcccatgacgggaacg

SEQ ID NO: 129808 - DNA, 75 bp, Artificial Sequence
  Synthetic
ctccacaaccagcatatgacctggagcagataacatcatgctcatccaacgtttccgtagcgcatgacgggaacg

SEQ ID NO: 129809 - DNA, 75 bp, Artificial Sequence
  Synthetic
ctccacaaccagcatatgacctggagcagataacatcatgctcatccaacgtttccgttgcacatgacgggaacg

SEQ ID NO: 129810 - DNA, 75 bp, Artificial Sequence
  Synthetic
ctccacaaccagcatatgacctggagcagataacatcatgctcatccaacgtttccgttgctcatgacgggaacg

SEQ ID NO: 129811 - DNA, 75 bp, Artificial Sequence
  Synthetic
ctccacaaccagcatatgacctggagcagataacatcatgctcatccaacgtttccgttgcccatgacgggaacg

SEQ ID NO: 129812 - DNA, 75 bp, Artificial Sequence
  Synthetic
ctccacaaccagcatatgacctggagcagataacatcatgctcatccaacgtttccgttgcgcatgacgggaacg

SEQ ID NO: 129813 - DNA, 75 bp, Artificial Sequence
  Synthetic
ctccacaaccagcatatgacctggagcagataacatcatgctcatccaacgtttccgtcgcacatgacgggaacg

SEQ ID NO: 129814 - DNA, 75 bp, Artificial Sequence
  Synthetic
ctccacaaccagcatatgacctggagcagataacatcatgctcatccaacgtttccgtcgctcatgacgggaacg

SEQ ID NO: 129815 - DNA, 75 bp, Artificial Sequence
  Synthetic
ctccacaaccagcatatgacctggagcagataacatcatgctcatccaacgtttccgtcgcccatgacgggaacg

SEQ ID NO: 129816 - DNA, 75 bp, Artificial Sequence
  Synthetic
ctccacaaccagcatatgacctggagcagataacatcatgctcatccaacgtttccgtcgcgcatgacgggaacg

SEQ ID NO: 129817 - DNA, 75 bp, Artificial Sequence
  Synthetic
ctccacaaccagcatatgacctggagcagataacatcatgctcatccaacgtttccgtggcacatgacgggaacg

SEQ ID NO: 129818 - DNA, 75 bp, Artificial Sequence
  Synthetic
ctccacaaccagcatatgacctggagcagataacatcatgctcatccaacgtttccgtggctcatgacgggaacg

SEQ ID NO: 129819 - DNA, 75 bp, Artificial Sequence
  Synthetic
ctccacaaccagcatatgacctggagcagataacatcatgctcatccaacgtttccgtggcccatgacgggaacg

SEQ ID NO: 129820 - DNA, 75 bp, Artificial Sequence
  Synthetic
ctccacaaccagcatatgacctggagcagataacatcatgctcatccaacgtttccgtggcgcatgacgggaacg

SEQ ID NO: 129821 - DNA, 75 bp, Artificial Sequence
  Synthetic
gtgcatcaatggggtatgctggaccgtctaccatggggccggaacgaggaccatcgcatcacccaagggtcctgt

SEQ ID NO: 129822 - DNA, 75 bp, Artificial Sequence
  Synthetic
cgttgcgctcagcactcaaccccagagtgtagcttaggctgatgagtctggacatccctcaccggtgacggtggt

SEQ ID NO: 129823 - DNA, 75 bp, Artificial Sequence
  Synthetic
tcacagctcccatgtgagcccgagccggatgtagcagtgctcacttccatgctcaccgacccctcccacattaca

SEQ ID NO: 129824 - DNA, 75 bp, Artificial Sequence
  Synthetic
atgagaccactctcacacaccccgtaaccaaatacatcgccacgtgcatgcaagctgaccttgagatcatgacga

SEQ ID NO: 129825 - DNA, 75 bp, Artificial Sequence
  Synthetic
acaacgatccttggcataggcacggtcctggatcaagcggagaccgctggagcgcgactcgtcgtgctcgcgacc

SEQ ID NO: 129826 - DNA, 75 bp, Artificial Sequence
  Synthetic
ggaaaagggtatactacctgacccgcgaacccgagacccccctggcacgagctgcctgggaaacagtccgacaca

SEQ ID NO: 129827 - DNA, 75 bp, Artificial Sequence
  Synthetic
ggaaaagggtatactacctgacccgcgatcccgagacccccctggcacgagctgcctgggaaacagtccgacaca

SEQ ID NO: 129828 - DNA, 75 bp, Artificial Sequence
  Synthetic
ggaaaagggtatactacctgacccgcgaccccgagacccccctggcacgagctgcctgggaaacagtccgacaca

SEQ ID NO: 129829 - DNA, 75 bp, Artificial Sequence
  Synthetic
ggaaaagggtatactacctgacccgcgagcccgagacccccctggcacgagctgcctgggaaacagtccgacaca

SEQ ID NO: 129830 - DNA, 75 bp, Artificial Sequence
  Synthetic
ggaatagggtatactacctgacccgcgaacccgagacccccctggcacgagctgcctgggaaacagtccgacaca

SEQ ID NO: 129831 - DNA, 75 bp, Artificial Sequence
  Synthetic
ggaatagggtatactacctgacccgcgatcccgagacccccctggcacgagctgcctgggaaacagtccgacaca

SEQ ID NO: 129832 - DNA, 75 bp, Artificial Sequence
  Synthetic
ggaatagggtatactacctgacccgcgaccccgagacccccctggcacgagctgcctgggaaacagtccgacaca

SEQ ID NO: 129833 - DNA, 75 bp, Artificial Sequence
  Synthetic
ggaatagggtatactacctgacccgcgagcccgagacccccctggcacgagctgcctgggaaacagtccgacaca

SEQ ID NO: 129834 - DNA, 75 bp, Artificial Sequence
  Synthetic
ggaacagggtatactacctgacccgcgaacccgagacccccctggcacgagctgcctgggaaacagtccgacaca

SEQ ID NO: 129835 - DNA, 75 bp, Artificial Sequence
  Synthetic
ggaacagggtatactacctgacccgcgatcccgagacccccctggcacgagctgcctgggaaacagtccgacaca

SEQ ID NO: 129836 - DNA, 75 bp, Artificial Sequence
  Synthetic
ggaacagggtatactacctgacccgcgaccccgagacccccctggcacgagctgcctgggaaacagtccgacaca

SEQ ID NO: 129837 - DNA, 75 bp, Artificial Sequence
  Synthetic
ggaacagggtatactacctgacccgcgagcccgagacccccctggcacgagctgcctgggaaacagtccgacaca

SEQ ID NO: 129838 - DNA, 75 bp, Artificial Sequence
  Synthetic
ggaagagggtatactacctgacccgcgaacccgagacccccctggcacgagctgcctgggaaacagtccgacaca

SEQ ID NO: 129839 - DNA, 75 bp, Artificial Sequence
  Synthetic
ggaagagggtatactacctgacccgcgatcccgagacccccctggcacgagctgcctgggaaacagtccgacaca

SEQ ID NO: 129840 - DNA, 75 bp, Artificial Sequence
  Synthetic
ggaagagggtatactacctgacccgcgaccccgagacccccctggcacgagctgcctgggaaacagtccgacaca

SEQ ID NO: 129841 - DNA, 75 bp, Artificial Sequence
  Synthetic
ggaagagggtatactacctgacccgcgagcccgagacccccctggcacgagctgcctgggaaacagtccgacaca

SEQ ID NO: 129842 - DNA, 75 bp, Artificial Sequence
  Synthetic
tcctggatcaagcggagaccgctggagcgcgactcgtcgtgctcgcgaccgctacaccaccaggatcagtgacca

SEQ ID NO: 129843 - DNA, 75 bp, Artificial Sequence
  Synthetic
tcctggatcaagcggagaccgctggagcgcgactcgtcgtgctcgcgaccgctacaccaccaggttcagtgacca

SEQ ID NO: 129844 - DNA, 75 bp, Artificial Sequence
  Synthetic
tcctggatcaagcggagaccgctggagcgcgactcgtcgtgctcgcgaccgctacaccaccaggctcagtgacca

SEQ ID NO: 129845 - DNA, 75 bp, Artificial Sequence
  Synthetic
tcctggatcaagcggagaccgctggagcgcgactcgtcgtgctcgcgaccgctacaccaccagggtcagtgacca

SEQ ID NO: 129846 - DNA, 75 bp, Artificial Sequence
  Synthetic
ctgaatgcggctaatcccaacctcggagcaggtggtcacaaaccagtgattggcctgtcgtaacgcgcaagtccg

SEQ ID NO: 129847 - DNA, 75 bp, Artificial Sequence
  Synthetic
cctacttgaggaggggcaacgaatagcggaaatgctgaagtccaaaatccaaggcttgctacaacaagccacgaa

SEQ ID NO: 129848 - DNA, 75 bp, Artificial Sequence
  Synthetic
gctgcttatggtgacaatcacagattgttatcataaagcgaattggattggccatccggtgaaagtgagactcat

SEQ ID NO: 129849 - DNA, 75 bp, Artificial Sequence
  Synthetic
aagcagaaggcgctcgggttgctgcaaacagccaccaagcaagcggaggctgctgctcccgtggtggagtccaag

SEQ ID NO: 129850 - DNA, 75 bp, Artificial Sequence
  Synthetic
ggaatcctgccgtggctgcaatgatggcgttcagcgccgcactcactagcccgctgcccaccagtactaccatcc

SEQ ID NO: 129851 - DNA, 75 bp, Artificial Sequence
  Synthetic
agaagacgccaaaaacataaagaaaggcccggcgccattctatcctctagaggatggaaccgctggagagcaact

SEQ ID NO: 129852 - DNA, 75 bp, Artificial Sequence
  Synthetic
accgtatggcttgggatatgatgatgaactggtcgcctacaacagccctagtggtatcgcagttgctccggatcc

SEQ ID NO: 129853 - DNA, 75 bp, Artificial Sequence
  Synthetic
cccacaacgcagcttcgacgtcacatcgatctgcttgtcgggagcgccaccctctgctcggccctctacgtgggg

SEQ ID NO: 129854 - DNA, 75 bp, Artificial Sequence
  Synthetic
tataggtctgggtaaaatattggtggacgtcttggcaggctatggtgctggcatctcgggggccctcgtcgcttt

SEQ ID NO: 129855 - DNA, 75 bp, Artificial Sequence
  Synthetic
tccgacgttgagtcgtactcctccatgcctccccttgaaggagagccgggggaccccgatctcagcgacgggtct

SEQ ID NO: 129856 - DNA, 75 bp, Artificial Sequence
  Synthetic
actcactccaatcccggccgcgtcccagctggacttgtccggctggttcgttgctggttacagcgggggagacat

SEQ ID NO: 129857 - DNA, 75 bp, Artificial Sequence
  Synthetic
tcccagacaaagcaatcgggtgaaaatttcccataccttgtagcttatcaagcaacggtgtgtgccagagctctg

SEQ ID NO: 129858 - DNA, 75 bp, Artificial Sequence
  Synthetic
tcccagacaaagcaatcgggtgaaaatttcccataccttgtagcttatcaagcaacggtgtgtgccagtgctctg

SEQ ID NO: 129859 - DNA, 75 bp, Artificial Sequence
  Synthetic
tcccagacaaagcaatcgggtgaaaatttcccataccttgtagcttatcaagcaacggtgtgtgccagcgctctg

SEQ ID NO: 129860 - DNA, 75 bp, Artificial Sequence
  Synthetic
tcccagacaaagcaatcgggtgaaaatttcccataccttgtagcttatcaagcaacggtgtgtgccagggctctg

SEQ ID NO: 129861 - DNA, 75 bp, Artificial Sequence
  Synthetic
tcccagacaaagcaatcgggtgaaaatttcccataccttgtagcttatcaagctacggtgtgtgccagagctctg

SEQ ID NO: 129862 - DNA, 75 bp, Artificial Sequence
  Synthetic
tcccagacaaagcaatcgggtgaaaatttcccataccttgtagcttatcaagctacggtgtgtgccagtgctctg

SEQ ID NO: 129863 - DNA, 75 bp, Artificial Sequence
  Synthetic
tcccagacaaagcaatcgggtgaaaatttcccataccttgtagcttatcaagctacggtgtgtgccagcgctctg

SEQ ID NO: 129864 - DNA, 75 bp, Artificial Sequence
  Synthetic
tcccagacaaagcaatcgggtgaaaatttcccataccttgtagcttatcaagctacggtgtgtgccagggctctg

SEQ ID NO: 129865 - DNA, 75 bp, Artificial Sequence
  Synthetic
tcccagacaaagcaatcgggtgaaaatttcccataccttgtagcttatcaagccacggtgtgtgccagagctctg

SEQ ID NO: 129866 - DNA, 75 bp, Artificial Sequence
  Synthetic
tcccagacaaagcaatcgggtgaaaatttcccataccttgtagcttatcaagccacggtgtgtgccagtgctctg

SEQ ID NO: 129867 - DNA, 75 bp, Artificial Sequence
  Synthetic
tcccagacaaagcaatcgggtgaaaatttcccataccttgtagcttatcaagccacggtgtgtgccagcgctctg

SEQ ID NO: 129868 - DNA, 75 bp, Artificial Sequence
  Synthetic
tcccagacaaagcaatcgggtgaaaatttcccataccttgtagcttatcaagccacggtgtgtgccagggctctg

SEQ ID NO: 129869 - DNA, 75 bp, Artificial Sequence
  Synthetic
tcccagacaaagcaatcgggtgaaaatttcccataccttgtagcttatcaagcgacggtgtgtgccagagctctg

SEQ ID NO: 129870 - DNA, 75 bp, Artificial Sequence
  Synthetic
tcccagacaaagcaatcgggtgaaaatttcccataccttgtagcttatcaagcgacggtgtgtgccagtgctctg

SEQ ID NO: 129871 - DNA, 75 bp, Artificial Sequence
  Synthetic
tcccagacaaagcaatcgggtgaaaatttcccataccttgtagcttatcaagcgacggtgtgtgccagcgctctg

SEQ ID NO: 129872 - DNA, 75 bp, Artificial Sequence
  Synthetic
tcccagacaaagcaatcgggtgaaaatttcccataccttgtagcttatcaagcgacggtgtgtgccagggctctg

SEQ ID NO: 129873 - DNA, 75 bp, Artificial Sequence
  Synthetic
tcccagactaagcaatcgggtgaaaatttcccataccttgtagcttatcaagcaacggtgtgtgccagagctctg

SEQ ID NO: 129874 - DNA, 75 bp, Artificial Sequence
  Synthetic
tcccagactaagcaatcgggtgaaaatttcccataccttgtagcttatcaagcaacggtgtgtgccagtgctctg

SEQ ID NO: 129875 - DNA, 75 bp, Artificial Sequence
  Synthetic
tcccagactaagcaatcgggtgaaaatttcccataccttgtagcttatcaagcaacggtgtgtgccagcgctctg

SEQ ID NO: 129876 - DNA, 75 bp, Artificial Sequence
  Synthetic
tcccagactaagcaatcgggtgaaaatttcccataccttgtagcttatcaagcaacggtgtgtgccagggctctg

SEQ ID NO: 129877 - DNA, 75 bp, Artificial Sequence
  Synthetic
tcccagactaagcaatcgggtgaaaatttcccataccttgtagcttatcaagctacggtgtgtgccagagctctg

SEQ ID NO: 129878 - DNA, 75 bp, Artificial Sequence
  Synthetic
tcccagactaagcaatcgggtgaaaatttcccataccttgtagcttatcaagctacggtgtgtgccagtgctctg

SEQ ID NO: 129879 - DNA, 75 bp, Artificial Sequence
  Synthetic
tcccagactaagcaatcgggtgaaaatttcccataccttgtagcttatcaagctacggtgtgtgccagcgctctg

SEQ ID NO: 129880 - DNA, 75 bp, Artificial Sequence
  Synthetic
tcccagactaagcaatcgggtgaaaatttcccataccttgtagcttatcaagctacggtgtgtgccagggctctg

SEQ ID NO: 129881 - DNA, 75 bp, Artificial Sequence
  Synthetic
tcccagactaagcaatcgggtgaaaatttcccataccttgtagcttatcaagccacggtgtgtgccagagctctg

SEQ ID NO: 129882 - DNA, 75 bp, Artificial Sequence
  Synthetic
tcccagactaagcaatcgggtgaaaatttcccataccttgtagcttatcaagccacggtgtgtgccagtgctctg

SEQ ID NO: 129883 - DNA, 75 bp, Artificial Sequence
  Synthetic
tcccagactaagcaatcgggtgaaaatttcccataccttgtagcttatcaagccacggtgtgtgccagcgctctg

SEQ ID NO: 129884 - DNA, 75 bp, Artificial Sequence
  Synthetic
tcccagactaagcaatcgggtgaaaatttcccataccttgtagcttatcaagccacggtgtgtgccagggctctg

SEQ ID NO: 129885 - DNA, 75 bp, Artificial Sequence
  Synthetic
tcccagactaagcaatcgggtgaaaatttcccataccttgtagcttatcaagcgacggtgtgtgccagagctctg

SEQ ID NO: 129886 - DNA, 75 bp, Artificial Sequence
  Synthetic
tcccagactaagcaatcgggtgaaaatttcccataccttgtagcttatcaagcgacggtgtgtgccagtgctctg

SEQ ID NO: 129887 - DNA, 75 bp, Artificial Sequence
  Synthetic
tcccagactaagcaatcgggtgaaaatttcccataccttgtagcttatcaagcgacggtgtgtgccagcgctctg

SEQ ID NO: 129888 - DNA, 75 bp, Artificial Sequence
  Synthetic
tcccagactaagcaatcgggtgaaaatttcccataccttgtagcttatcaagcgacggtgtgtgccagggctctg

SEQ ID NO: 129889 - DNA, 75 bp, Artificial Sequence
  Synthetic
tcccagaccaagcaatcgggtgaaaatttcccataccttgtagcttatcaagcaacggtgtgtgccagagctctg

SEQ ID NO: 129890 - DNA, 75 bp, Artificial Sequence
  Synthetic
tcccagaccaagcaatcgggtgaaaatttcccataccttgtagcttatcaagcaacggtgtgtgccagtgctctg

SEQ ID NO: 129891 - DNA, 75 bp, Artificial Sequence
  Synthetic
tcccagaccaagcaatcgggtgaaaatttcccataccttgtagcttatcaagcaacggtgtgtgccagcgctctg

SEQ ID NO: 129892 - DNA, 75 bp, Artificial Sequence
  Synthetic
tcccagaccaagcaatcgggtgaaaatttcccataccttgtagcttatcaagcaacggtgtgtgccagggctctg

SEQ ID NO: 129893 - DNA, 75 bp, Artificial Sequence
  Synthetic
tcccagaccaagcaatcgggtgaaaatttcccataccttgtagcttatcaagctacggtgtgtgccagagctctg

SEQ ID NO: 129894 - DNA, 75 bp, Artificial Sequence
  Synthetic
tcccagaccaagcaatcgggtgaaaatttcccataccttgtagcttatcaagctacggtgtgtgccagtgctctg

SEQ ID NO: 129895 - DNA, 75 bp, Artificial Sequence
  Synthetic
tcccagaccaagcaatcgggtgaaaatttcccataccttgtagcttatcaagctacggtgtgtgccagcgctctg

SEQ ID NO: 129896 - DNA, 75 bp, Artificial Sequence
  Synthetic
tcccagaccaagcaatcgggtgaaaatttcccataccttgtagcttatcaagctacggtgtgtgccagggctctg

SEQ ID NO: 129897 - DNA, 75 bp, Artificial Sequence
  Synthetic
tcccagaccaagcaatcgggtgaaaatttcccataccttgtagcttatcaagccacggtgtgtgccagagctctg

SEQ ID NO: 129898 - DNA, 75 bp, Artificial Sequence
  Synthetic
tcccagaccaagcaatcgggtgaaaatttcccataccttgtagcttatcaagccacggtgtgtgccagtgctctg

SEQ ID NO: 129899 - DNA, 75 bp, Artificial Sequence
  Synthetic
tcccagaccaagcaatcgggtgaaaatttcccataccttgtagcttatcaagccacggtgtgtgccagcgctctg

SEQ ID NO: 129900 - DNA, 75 bp, Artificial Sequence
  Synthetic
tcccagaccaagcaatcgggtgaaaatttcccataccttgtagcttatcaagccacggtgtgtgccagggctctg

SEQ ID NO: 129901 - DNA, 75 bp, Artificial Sequence
  Synthetic
tcccagaccaagcaatcgggtgaaaatttcccataccttgtagcttatcaagcgacggtgtgtgccagagctctg

SEQ ID NO: 129902 - DNA, 75 bp, Artificial Sequence
  Synthetic
tcccagaccaagcaatcgggtgaaaatttcccataccttgtagcttatcaagcgacggtgtgtgccagtgctctg

SEQ ID NO: 129903 - DNA, 75 bp, Artificial Sequence
  Synthetic
tcccagaccaagcaatcgggtgaaaatttcccataccttgtagcttatcaagcgacggtgtgtgccagcgctctg

SEQ ID NO: 129904 - DNA, 75 bp, Artificial Sequence
  Synthetic
tcccagaccaagcaatcgggtgaaaatttcccataccttgtagcttatcaagcgacggtgtgtgccagggctctg

SEQ ID NO: 129905 - DNA, 75 bp, Artificial Sequence
  Synthetic
tcccagacgaagcaatcgggtgaaaatttcccataccttgtagcttatcaagcaacggtgtgtgccagagctctg

SEQ ID NO: 129906 - DNA, 75 bp, Artificial Sequence
  Synthetic
tcccagacgaagcaatcgggtgaaaatttcccataccttgtagcttatcaagcaacggtgtgtgccagtgctctg

SEQ ID NO: 129907 - DNA, 75 bp, Artificial Sequence
  Synthetic
tcccagacgaagcaatcgggtgaaaatttcccataccttgtagcttatcaagcaacggtgtgtgccagcgctctg

SEQ ID NO: 129908 - DNA, 75 bp, Artificial Sequence
  Synthetic
tcccagacgaagcaatcgggtgaaaatttcccataccttgtagcttatcaagcaacggtgtgtgccagggctctg

SEQ ID NO: 129909 - DNA, 75 bp, Artificial Sequence
  Synthetic
tcccagacgaagcaatcgggtgaaaatttcccataccttgtagcttatcaagctacggtgtgtgccagagctctg

SEQ ID NO: 129910 - DNA, 75 bp, Artificial Sequence
  Synthetic
tcccagacgaagcaatcgggtgaaaatttcccataccttgtagcttatcaagctacggtgtgtgccagtgctctg

SEQ ID NO: 129911 - DNA, 75 bp, Artificial Sequence
  Synthetic
tcccagacgaagcaatcgggtgaaaatttcccataccttgtagcttatcaagctacggtgtgtgccagcgctctg

SEQ ID NO: 129912 - DNA, 75 bp, Artificial Sequence
  Synthetic
tcccagacgaagcaatcgggtgaaaatttcccataccttgtagcttatcaagctacggtgtgtgccagggctctg

SEQ ID NO: 129913 - DNA, 75 bp, Artificial Sequence
  Synthetic
tcccagacgaagcaatcgggtgaaaatttcccataccttgtagcttatcaagccacggtgtgtgccagagctctg

SEQ ID NO: 129914 - DNA, 75 bp, Artificial Sequence
  Synthetic
tcccagacgaagcaatcgggtgaaaatttcccataccttgtagcttatcaagccacggtgtgtgccagtgctctg

SEQ ID NO: 129915 - DNA, 75 bp, Artificial Sequence
  Synthetic
tcccagacgaagcaatcgggtgaaaatttcccataccttgtagcttatcaagccacggtgtgtgccagcgctctg

SEQ ID NO: 129916 - DNA, 75 bp, Artificial Sequence
  Synthetic
tcccagacgaagcaatcgggtgaaaatttcccataccttgtagcttatcaagccacggtgtgtgccagggctctg

SEQ ID NO: 129917 - DNA, 75 bp, Artificial Sequence
  Synthetic
tcccagacgaagcaatcgggtgaaaatttcccataccttgtagcttatcaagcgacggtgtgtgccagagctctg

SEQ ID NO: 129918 - DNA, 75 bp, Artificial Sequence
  Synthetic
tcccagacgaagcaatcgggtgaaaatttcccataccttgtagcttatcaagcgacggtgtgtgccagtgctctg

SEQ ID NO: 129919 - DNA, 75 bp, Artificial Sequence
  Synthetic
tcccagacgaagcaatcgggtgaaaatttcccataccttgtagcttatcaagcgacggtgtgtgccagcgctctg

SEQ ID NO: 129920 - DNA, 75 bp, Artificial Sequence
  Synthetic
tcccagacgaagcaatcgggtgaaaatttcccataccttgtagcttatcaagcgacggtgtgtgccagggctctg

SEQ ID NO: 129921 - DNA, 75 bp, Artificial Sequence
  Synthetic
gccatcttacgccgccacgtgggacaaggggaaggcgcggtccagtggatgaataggctcatagcctttgcttcc

SEQ ID NO: 129922 - DNA, 75 bp, Artificial Sequence
  Synthetic
ccctactttgtgcgcgttcaaggcctcctccggatctgcgcgctagcgcggaaggtggccggaggtcattacgtg

SEQ ID NO: 129923 - DNA, 75 bp, Artificial Sequence
  Synthetic
agctgatcaacaccaacggcagttggcacatcaatagcacggccttgaactgcaatgatagccttaacaccggct

SEQ ID NO: 129924 - DNA, 75 bp, Artificial Sequence
  Synthetic
gaaggctccatacctggattaccgaagactgccctgttccatgcgccggctcttggcttcgcgacatatgggact

SEQ ID NO: 129925 - DNA, 75 bp, Artificial Sequence
  Synthetic
aggggcttggactggcactggcatcatgacaacacggtgcccatgcggagctgtcgtttcgggcaatgtccgtca

SEQ ID NO: 129926 - DNA, 75 bp, Artificial Sequence
  Synthetic
acggactgcttccggaagcaccccgaggccacttacacaaaatgtggctcggggccttggttgacacctaggtgc

SEQ ID NO: 129927 - DNA, 75 bp, Artificial Sequence
  Synthetic
ggcactacccctgcactgtcaactttaccatcttcaaggttaggatgtatgtggggggcgtggagcacaggctcg

SEQ ID NO: 129928 - DNA, 75 bp, Artificial Sequence
  Synthetic
acacataactacaaaaccgctatatggaaggtggcagcagcggaatatgcggaggtgacacgacatggttcctat

SEQ ID NO: 129929 - DNA, 75 bp, Artificial Sequence
  Synthetic
ctttcctggcaacgtgcatcaacggggtatgctggactgtctaccatggggccggaacgaggaccatcgcatcac

SEQ ID NO: 129930 - DNA, 75 bp, Artificial Sequence
  Synthetic
tccttttcaaaatcttgggggggtgggtagcctcgcagattgcaactccgacggcatctacagcatttgtcttga

SEQ ID NO: 129931 - DNA, 75 bp, Artificial Sequence
  Synthetic
tccttttcaaaatcttgggggggtgggtagcctcgcagattgctactccgacggcatctacagcatttgtcttga

SEQ ID NO: 129932 - DNA, 75 bp, Artificial Sequence
  Synthetic
tccttttcaaaatcttgggggggtgggtagcctcgcagattgccactccgacggcatctacagcatttgtcttga

SEQ ID NO: 129933 - DNA, 75 bp, Artificial Sequence
  Synthetic
tccttttcaaaatcttgggggggtgggtagcctcgcagattgcgactccgacggcatctacagcatttgtcttga

SEQ ID NO: 129934 - DNA, 75 bp, Artificial Sequence
  Synthetic
tccttttcaaaatcttgggggggtgggttgcctcgcagattgcaactccgacggcatctacagcatttgtcttga

SEQ ID NO: 129935 - DNA, 75 bp, Artificial Sequence
  Synthetic
tccttttcaaaatcttgggggggtgggttgcctcgcagattgctactccgacggcatctacagcatttgtcttga

SEQ ID NO: 129936 - DNA, 75 bp, Artificial Sequence
  Synthetic
tccttttcaaaatcttgggggggtgggttgcctcgcagattgccactccgacggcatctacagcatttgtcttga

SEQ ID NO: 129937 - DNA, 75 bp, Artificial Sequence
  Synthetic
tccttttcaaaatcttgggggggtgggttgcctcgcagattgcgactccgacggcatctacagcatttgtcttga

SEQ ID NO: 129938 - DNA, 75 bp, Artificial Sequence
  Synthetic
tccttttcaaaatcttgggggggtgggtcgcctcgcagattgcaactccgacggcatctacagcatttgtcttga

SEQ ID NO: 129939 - DNA, 75 bp, Artificial Sequence
  Synthetic
tccttttcaaaatcttgggggggtgggtcgcctcgcagattgctactccgacggcatctacagcatttgtcttga

SEQ ID NO: 129940 - DNA, 75 bp, Artificial Sequence
  Synthetic
tccttttcaaaatcttgggggggtgggtcgcctcgcagattgccactccgacggcatctacagcatttgtcttga

SEQ ID NO: 129941 - DNA, 75 bp, Artificial Sequence
  Synthetic
tccttttcaaaatcttgggggggtgggtcgcctcgcagattgcgactccgacggcatctacagcatttgtcttga

SEQ ID NO: 129942 - DNA, 75 bp, Artificial Sequence
  Synthetic
tccttttcaaaatcttgggggggtgggtggcctcgcagattgcaactccgacggcatctacagcatttgtcttga

SEQ ID NO: 129943 - DNA, 75 bp, Artificial Sequence
  Synthetic
tccttttcaaaatcttgggggggtgggtggcctcgcagattgctactccgacggcatctacagcatttgtcttga

SEQ ID NO: 129944 - DNA, 75 bp, Artificial Sequence
  Synthetic
tccttttcaaaatcttgggggggtgggtggcctcgcagattgccactccgacggcatctacagcatttgtcttga

SEQ ID NO: 129945 - DNA, 75 bp, Artificial Sequence
  Synthetic
tccttttcaaaatcttgggggggtgggtggcctcgcagattgcgactccgacggcatctacagcatttgtcttga

SEQ ID NO: 129946 - DNA, 75 bp, Artificial Sequence
  Synthetic
tccttttcaatatcttgggggggtgggtagcctcgcagattgcaactccgacggcatctacagcatttgtcttga

SEQ ID NO: 129947 - DNA, 75 bp, Artificial Sequence
  Synthetic
tccttttcaatatcttgggggggtgggtagcctcgcagattgctactccgacggcatctacagcatttgtcttga

SEQ ID NO: 129948 - DNA, 75 bp, Artificial Sequence
  Synthetic
tccttttcaatatcttgggggggtgggtagcctcgcagattgccactccgacggcatctacagcatttgtcttga

SEQ ID NO: 129949 - DNA, 75 bp, Artificial Sequence
  Synthetic
tccttttcaatatcttgggggggtgggtagcctcgcagattgcgactccgacggcatctacagcatttgtcttga

SEQ ID NO: 129950 - DNA, 75 bp, Artificial Sequence
  Synthetic
tccttttcaatatcttgggggggtgggttgcctcgcagattgcaactccgacggcatctacagcatttgtcttga

SEQ ID NO: 129951 - DNA, 75 bp, Artificial Sequence
  Synthetic
tccttttcaatatcttgggggggtgggttgcctcgcagattgctactccgacggcatctacagcatttgtcttga

SEQ ID NO: 129952 - DNA, 75 bp, Artificial Sequence
  Synthetic
tccttttcaatatcttgggggggtgggttgcctcgcagattgccactccgacggcatctacagcatttgtcttga

SEQ ID NO: 129953 - DNA, 75 bp, Artificial Sequence
  Synthetic
tccttttcaatatcttgggggggtgggttgcctcgcagattgcgactccgacggcatctacagcatttgtcttga

SEQ ID NO: 129954 - DNA, 75 bp, Artificial Sequence
  Synthetic
tccttttcaatatcttgggggggtgggtcgcctcgcagattgcaactccgacggcatctacagcatttgtcttga

SEQ ID NO: 129955 - DNA, 75 bp, Artificial Sequence
  Synthetic
tccttttcaatatcttgggggggtgggtcgcctcgcagattgctactccgacggcatctacagcatttgtcttga

SEQ ID NO: 129956 - DNA, 75 bp, Artificial Sequence
  Synthetic
tccttttcaatatcttgggggggtgggtcgcctcgcagattgccactccgacggcatctacagcatttgtcttga

SEQ ID NO: 129957 - DNA, 75 bp, Artificial Sequence
  Synthetic
tccttttcaatatcttgggggggtgggtcgcctcgcagattgcgactccgacggcatctacagcatttgtcttga

SEQ ID NO: 129958 - DNA, 75 bp, Artificial Sequence
  Synthetic
tccttttcaatatcttgggggggtgggtggcctcgcagattgcaactccgacggcatctacagcatttgtcttga

SEQ ID NO: 129959 - DNA, 75 bp, Artificial Sequence
  Synthetic
tccttttcaatatcttgggggggtgggtggcctcgcagattgctactccgacggcatctacagcatttgtcttga

SEQ ID NO: 129960 - DNA, 75 bp, Artificial Sequence
  Synthetic
tccttttcaatatcttgggggggtgggtggcctcgcagattgccactccgacggcatctacagcatttgtcttga

SEQ ID NO: 129961 - DNA, 75 bp, Artificial Sequence
  Synthetic
tccttttcaatatcttgggggggtgggtggcctcgcagattgcgactccgacggcatctacagcatttgtcttga

SEQ ID NO: 129962 - DNA, 75 bp, Artificial Sequence
  Synthetic
tccttttcaacatcttgggggggtgggtagcctcgcagattgcaactccgacggcatctacagcatttgtcttga

SEQ ID NO: 129963 - DNA, 75 bp, Artificial Sequence
  Synthetic
tccttttcaacatcttgggggggtgggtagcctcgcagattgctactccgacggcatctacagcatttgtcttga

SEQ ID NO: 129964 - DNA, 75 bp, Artificial Sequence
  Synthetic
tccttttcaacatcttgggggggtgggtagcctcgcagattgccactccgacggcatctacagcatttgtcttga

SEQ ID NO: 129965 - DNA, 75 bp, Artificial Sequence
  Synthetic
tccttttcaacatcttgggggggtgggtagcctcgcagattgcgactccgacggcatctacagcatttgtcttga

SEQ ID NO: 129966 - DNA, 75 bp, Artificial Sequence
  Synthetic
tccttttcaacatcttgggggggtgggttgcctcgcagattgcaactccgacggcatctacagcatttgtcttga

SEQ ID NO: 129967 - DNA, 75 bp, Artificial Sequence
  Synthetic
tccttttcaacatcttgggggggtgggttgcctcgcagattgctactccgacggcatctacagcatttgtcttga

SEQ ID NO: 129968 - DNA, 75 bp, Artificial Sequence
  Synthetic
tccttttcaacatcttgggggggtgggttgcctcgcagattgccactccgacggcatctacagcatttgtcttga

SEQ ID NO: 129969 - DNA, 75 bp, Artificial Sequence
  Synthetic
tccttttcaacatcttgggggggtgggttgcctcgcagattgcgactccgacggcatctacagcatttgtcttga

SEQ ID NO: 129970 - DNA, 75 bp, Artificial Sequence
  Synthetic
tccttttcaacatcttgggggggtgggtcgcctcgcagattgcaactccgacggcatctacagcatttgtcttga

SEQ ID NO: 129971 - DNA, 75 bp, Artificial Sequence
  Synthetic
tccttttcaacatcttgggggggtgggtcgcctcgcagattgctactccgacggcatctacagcatttgtcttga

SEQ ID NO: 129972 - DNA, 75 bp, Artificial Sequence
  Synthetic
tccttttcaacatcttgggggggtgggtcgcctcgcagattgccactccgacggcatctacagcatttgtcttga

SEQ ID NO: 129973 - DNA, 75 bp, Artificial Sequence
  Synthetic
tccttttcaacatcttgggggggtgggtcgcctcgcagattgcgactccgacggcatctacagcatttgtcttga

SEQ ID NO: 129974 - DNA, 75 bp, Artificial Sequence
  Synthetic
tccttttcaacatcttgggggggtgggtggcctcgcagattgcaactccgacggcatctacagcatttgtcttga

SEQ ID NO: 129975 - DNA, 75 bp, Artificial Sequence
  Synthetic
tccttttcaacatcttgggggggtgggtggcctcgcagattgctactccgacggcatctacagcatttgtcttga

SEQ ID NO: 129976 - DNA, 75 bp, Artificial Sequence
  Synthetic
tccttttcaacatcttgggggggtgggtggcctcgcagattgccactccgacggcatctacagcatttgtcttga

SEQ ID NO: 129977 - DNA, 75 bp, Artificial Sequence
  Synthetic
tccttttcaacatcttgggggggtgggtggcctcgcagattgcgactccgacggcatctacagcatttgtcttga

SEQ ID NO: 129978 - DNA, 75 bp, Artificial Sequence
  Synthetic
tccttttcaagatcttgggggggtgggtagcctcgcagattgcaactccgacggcatctacagcatttgtcttga

SEQ ID NO: 129979 - DNA, 75 bp, Artificial Sequence
  Synthetic
tccttttcaagatcttgggggggtgggtagcctcgcagattgctactccgacggcatctacagcatttgtcttga

SEQ ID NO: 129980 - DNA, 75 bp, Artificial Sequence
  Synthetic
tccttttcaagatcttgggggggtgggtagcctcgcagattgccactccgacggcatctacagcatttgtcttga

SEQ ID NO: 129981 - DNA, 75 bp, Artificial Sequence
  Synthetic
tccttttcaagatcttgggggggtgggtagcctcgcagattgcgactccgacggcatctacagcatttgtcttga

SEQ ID NO: 129982 - DNA, 75 bp, Artificial Sequence
  Synthetic
tccttttcaagatcttgggggggtgggttgcctcgcagattgcaactccgacggcatctacagcatttgtcttga

SEQ ID NO: 129983 - DNA, 75 bp, Artificial Sequence
  Synthetic
tccttttcaagatcttgggggggtgggttgcctcgcagattgctactccgacggcatctacagcatttgtcttga

SEQ ID NO: 129984 - DNA, 75 bp, Artificial Sequence
  Synthetic
tccttttcaagatcttgggggggtgggttgcctcgcagattgccactccgacggcatctacagcatttgtcttga

SEQ ID NO: 129985 - DNA, 75 bp, Artificial Sequence
  Synthetic
tccttttcaagatcttgggggggtgggttgcctcgcagattgcgactccgacggcatctacagcatttgtcttga

SEQ ID NO: 129986 - DNA, 75 bp, Artificial Sequence
  Synthetic
tccttttcaagatcttgggggggtgggtcgcctcgcagattgcaactccgacggcatctacagcatttgtcttga

SEQ ID NO: 129987 - DNA, 75 bp, Artificial Sequence
  Synthetic
tccttttcaagatcttgggggggtgggtcgcctcgcagattgctactccgacggcatctacagcatttgtcttga

SEQ ID NO: 129988 - DNA, 75 bp, Artificial Sequence
  Synthetic
tccttttcaagatcttgggggggtgggtcgcctcgcagattgccactccgacggcatctacagcatttgtcttga

SEQ ID NO: 129989 - DNA, 75 bp, Artificial Sequence
  Synthetic
tccttttcaagatcttgggggggtgggtcgcctcgcagattgcgactccgacggcatctacagcatttgtcttga

SEQ ID NO: 129990 - DNA, 75 bp, Artificial Sequence
  Synthetic
tccttttcaagatcttgggggggtgggtggcctcgcagattgcaactccgacggcatctacagcatttgtcttga

SEQ ID NO: 129991 - DNA, 75 bp, Artificial Sequence
  Synthetic
tccttttcaagatcttgggggggtgggtggcctcgcagattgctactccgacggcatctacagcatttgtcttga

SEQ ID NO: 129992 - DNA, 75 bp, Artificial Sequence
  Synthetic
tccttttcaagatcttgggggggtgggtggcctcgcagattgccactccgacggcatctacagcatttgtcttga

SEQ ID NO: 129993 - DNA, 75 bp, Artificial Sequence
  Synthetic
tccttttcaagatcttgggggggtgggtggcctcgcagattgcgactccgacggcatctacagcatttgtcttga

SEQ ID NO: 129994 - DNA, 75 bp, Artificial Sequence
  Synthetic
tcgctcccacaccaaagccgttcattagggatgaggtctcgttcaccgtgggcctcaactcttttgtggtggggt

SEQ ID NO: 129995 - DNA, 75 bp, Artificial Sequence
  Synthetic
agagtgccgtacttcgtgcgcgctcaagggctcattcgtgcatgcatgttagtgcggaaagtcgccgggggtcat

SEQ ID NO: 129996 - DNA, 75 bp, Artificial Sequence
  Synthetic
gcgaggctcgcctccatccgaggccagctcttctgcgagtcaactctcagcgccgtcgttgcgagctacctgtac

SEQ ID NO: 129997 - DNA, 75 bp, Artificial Sequence
  Synthetic
gactctctcgacccttcggttgaagaggaggacgagcgcgaaccttcagtgccatcagagtatctcctccccaag

SEQ ID NO: 129998 - DNA, 75 bp, Artificial Sequence
  Synthetic
cggcgtgtggggacatcatctcgggcctacccgtctccgcccgaaggggaagggagatacttctgggaccggccg

SEQ ID NO: 129999 - DNA, 75 bp, Artificial Sequence
  Synthetic
agggagatacttctgggaccggccgatagtcttgaagggcaggggtggcgactcctcgcgcccatcacggcctac

SEQ ID NO: 130000 - DNA, 75 bp, Artificial Sequence
  Synthetic
ccaatggcagctggcacatcaacaggactgccttgaactgcaatgacaccctccagactgggttccttgccgcgc

SEQ ID NO: 130001 - DNA, 75 bp, Artificial Sequence
  Synthetic
ccgggtgtgctcttcccccccgtgttacagccccaacgcccccacccaggaggcgacgggcgttagtcctgagtc

SEQ ID NO: 130002 - DNA, 75 bp, Artificial Sequence
  Synthetic
tatgggcacgcccggattacaatccaccacttttacagccctggaaggacccggactacgtccctccggtagtac

SEQ ID NO: 130003 - DNA, 75 bp, Artificial Sequence
  Synthetic
tgttctacacacacaggttcaacgattccggatgcccagagcgtatggccagctgtcggcccattgacaagtttg

SEQ ID NO: 130004 - DNA, 75 bp, Artificial Sequence
  Synthetic
cgatgctactgaccaaccagccttaaaggaatctactgactcggaagcaggctctgattcctccatgcctcccct

SEQ ID NO: 130005 - DNA, 75 bp, Artificial Sequence
  Synthetic
aaggaatctactgactcggaagcaggctctgattcctccatgcctcccctcgagggggagccgggggaccctgac

SEQ ID NO: 130006 - DNA, 75 bp, Artificial Sequence
  Synthetic
accaactgtccatggatgtgccttaccaccacggggcgctccaccggtgcctcctcctcggaggaaaagaacaat

SEQ ID NO: 130007 - DNA, 75 bp, Artificial Sequence
  Synthetic
ttccattatgtcaccggggtaacacaagacaacatcaagtgtccctgccaagttccagccccagagttcttcaca

SEQ ID NO: 130008 - DNA, 75 bp, Artificial Sequence
  Synthetic
ttccattatgtcaccggggtaacacaagacaacatcaagtgtccctgccaagttcctgccccagagttcttcaca

SEQ ID NO: 130009 - DNA, 75 bp, Artificial Sequence
  Synthetic
ttccattatgtcaccggggtaacacaagacaacatcaagtgtccctgccaagttcccgccccagagttcttcaca

SEQ ID NO: 130010 - DNA, 75 bp, Artificial Sequence
  Synthetic
ttccattatgtcaccggggtaacacaagacaacatcaagtgtccctgccaagttccggccccagagttcttcaca

SEQ ID NO: 130011 - DNA, 75 bp, Artificial Sequence
  Synthetic
ttccattttgtcaccggggtaacacaagacaacatcaagtgtccctgccaagttccagccccagagttcttcaca

SEQ ID NO: 130012 - DNA, 75 bp, Artificial Sequence
  Synthetic
ttccattttgtcaccggggtaacacaagacaacatcaagtgtccctgccaagttcctgccccagagttcttcaca

SEQ ID NO: 130013 - DNA, 75 bp, Artificial Sequence
  Synthetic
ttccattttgtcaccggggtaacacaagacaacatcaagtgtccctgccaagttcccgccccagagttcttcaca

SEQ ID NO: 130014 - DNA, 75 bp, Artificial Sequence
  Synthetic
ttccattttgtcaccggggtaacacaagacaacatcaagtgtccctgccaagttccggccccagagttcttcaca

SEQ ID NO: 130015 - DNA, 75 bp, Artificial Sequence
  Synthetic
ttccattctgtcaccggggtaacacaagacaacatcaagtgtccctgccaagttccagccccagagttcttcaca

SEQ ID NO: 130016 - DNA, 75 bp, Artificial Sequence
  Synthetic
ttccattctgtcaccggggtaacacaagacaacatcaagtgtccctgccaagttcctgccccagagttcttcaca

SEQ ID NO: 130017 - DNA, 75 bp, Artificial Sequence
  Synthetic
ttccattctgtcaccggggtaacacaagacaacatcaagtgtccctgccaagttcccgccccagagttcttcaca

SEQ ID NO: 130018 - DNA, 75 bp, Artificial Sequence
  Synthetic
ttccattctgtcaccggggtaacacaagacaacatcaagtgtccctgccaagttccggccccagagttcttcaca

SEQ ID NO: 130019 - DNA, 75 bp, Artificial Sequence
  Synthetic
ttccattgtgtcaccggggtaacacaagacaacatcaagtgtccctgccaagttccagccccagagttcttcaca

SEQ ID NO: 130020 - DNA, 75 bp, Artificial Sequence
  Synthetic
ttccattgtgtcaccggggtaacacaagacaacatcaagtgtccctgccaagttcctgccccagagttcttcaca

SEQ ID NO: 130021 - DNA, 75 bp, Artificial Sequence
  Synthetic
ttccattgtgtcaccggggtaacacaagacaacatcaagtgtccctgccaagttcccgccccagagttcttcaca

SEQ ID NO: 130022 - DNA, 75 bp, Artificial Sequence
  Synthetic
ttccattgtgtcaccggggtaacacaagacaacatcaagtgtccctgccaagttccggccccagagttcttcaca

SEQ ID NO: 130023 - DNA, 75 bp, Artificial Sequence
  Synthetic
tcttggtctactgtgagcgaggaggctagtgaggacgtcgtctgttgttcgatgtcctacacatggacaggcgcc

SEQ ID NO: 130024 - DNA, 75 bp, Artificial Sequence
  Synthetic
gttctgaagtttgttgctccatgtcctactcctggaccggggcgctgataactccatgcggcccggaagaggaaa

SEQ ID NO: 130025 - DNA, 75 bp, Artificial Sequence
  Synthetic
gctgcatcatcactagcctcacaggccgggacaggaaccaggtcgagggggaggttcaagtggtctccaccgcaa

SEQ ID NO: 130026 - DNA, 75 bp, Artificial Sequence
  Synthetic
ctttgacagggtgcaactacttgactctcattatgaccaagtcttaaaggacattaagctggctgcttccaaagt

SEQ ID NO: 130027 - DNA, 75 bp, Artificial Sequence
  Synthetic
gacgctctaatgacgggctttaccggcgactttgactcagtgatcgactgtaacacatgtgtcacccagacggtc

SEQ ID NO: 130028 - DNA, 75 bp, Artificial Sequence
  Synthetic
tctgcatcgacccgacgaaaggcgggaagaaggctgctcgcctcatcgtattccctgatcttggcgtcagggttt

SEQ ID NO: 130029 - DNA, 75 bp, Artificial Sequence
  Synthetic
ccgaccaagaagttccctccagctttgccaatctgggctcgaccagattaaaatccacctcttacagagaagtgg

SEQ ID NO: 130030 - DNA, 75 bp, Artificial Sequence
  Synthetic
ccgaccaagaagttccctccagctttgccaatctgggctcgaccagattaaaatccacctcttactgagaagtgg

SEQ ID NO: 130031 - DNA, 75 bp, Artificial Sequence
  Synthetic
ccgaccaagaagttccctccagctttgccaatctgggctcgaccagattaaaatccacctcttaccgagaagtgg

SEQ ID NO: 130032 - DNA, 75 bp, Artificial Sequence
  Synthetic
ccgaccaagaagttccctccagctttgccaatctgggctcgaccagattaaaatccacctcttacggagaagtgg

SEQ ID NO: 130033 - DNA, 75 bp, Artificial Sequence
  Synthetic
ccgaccaagaagttccctccagctttgccaatctgggctcgaccagattataatccacctcttacagagaagtgg

SEQ ID NO: 130034 - DNA, 75 bp, Artificial Sequence
  Synthetic
ccgaccaagaagttccctccagctttgccaatctgggctcgaccagattataatccacctcttactgagaagtgg

SEQ ID NO: 130035 - DNA, 75 bp, Artificial Sequence
  Synthetic
ccgaccaagaagttccctccagctttgccaatctgggctcgaccagattataatccacctcttaccgagaagtgg

SEQ ID NO: 130036 - DNA, 75 bp, Artificial Sequence
  Synthetic
ccgaccaagaagttccctccagctttgccaatctgggctcgaccagattataatccacctcttacggagaagtgg

SEQ ID NO: 130037 - DNA, 75 bp, Artificial Sequence
  Synthetic
ccgaccaagaagttccctccagctttgccaatctgggctcgaccagattacaatccacctcttacagagaagtgg

SEQ ID NO: 130038 - DNA, 75 bp, Artificial Sequence
  Synthetic
ccgaccaagaagttccctccagctttgccaatctgggctcgaccagattacaatccacctcttactgagaagtgg

SEQ ID NO: 130039 - DNA, 75 bp, Artificial Sequence
  Synthetic
ccgaccaagaagttccctccagctttgccaatctgggctcgaccagattacaatccacctcttaccgagaagtgg

SEQ ID NO: 130040 - DNA, 75 bp, Artificial Sequence
  Synthetic
ccgaccaagaagttccctccagctttgccaatctgggctcgaccagattacaatccacctcttacggagaagtgg

SEQ ID NO: 130041 - DNA, 75 bp, Artificial Sequence
  Synthetic
ccgaccaagaagttccctccagctttgccaatctgggctcgaccagattagaatccacctcttacagagaagtgg

SEQ ID NO: 130042 - DNA, 75 bp, Artificial Sequence
  Synthetic
ccgaccaagaagttccctccagctttgccaatctgggctcgaccagattagaatccacctcttactgagaagtgg

SEQ ID NO: 130043 - DNA, 75 bp, Artificial Sequence
  Synthetic
ccgaccaagaagttccctccagctttgccaatctgggctcgaccagattagaatccacctcttaccgagaagtgg

SEQ ID NO: 130044 - DNA, 75 bp, Artificial Sequence
  Synthetic
ccgaccaagaagttccctccagctttgccaatctgggctcgaccagattagaatccacctcttacggagaagtgg

SEQ ID NO: 130045 - DNA, 75 bp, Artificial Sequence
  Synthetic
ccgaccaagaagttccctccagctttgccaatctgggctcgacctgattaaaatccacctcttacagagaagtgg

SEQ ID NO: 130046 - DNA, 75 bp, Artificial Sequence
  Synthetic
ccgaccaagaagttccctccagctttgccaatctgggctcgacctgattaaaatccacctcttactgagaagtgg

SEQ ID NO: 130047 - DNA, 75 bp, Artificial Sequence
  Synthetic
ccgaccaagaagttccctccagctttgccaatctgggctcgacctgattaaaatccacctcttaccgagaagtgg

SEQ ID NO: 130048 - DNA, 75 bp, Artificial Sequence
  Synthetic
ccgaccaagaagttccctccagctttgccaatctgggctcgacctgattaaaatccacctcttacggagaagtgg

SEQ ID NO: 130049 - DNA, 75 bp, Artificial Sequence
  Synthetic
ccgaccaagaagttccctccagctttgccaatctgggctcgacctgattataatccacctcttacagagaagtgg

SEQ ID NO: 130050 - DNA, 75 bp, Artificial Sequence
  Synthetic
ccgaccaagaagttccctccagctttgccaatctgggctcgacctgattataatccacctcttactgagaagtgg

SEQ ID NO: 130051 - DNA, 75 bp, Artificial Sequence
  Synthetic
ccgaccaagaagttccctccagctttgccaatctgggctcgacctgattataatccacctcttaccgagaagtgg

SEQ ID NO: 130052 - DNA, 75 bp, Artificial Sequence
  Synthetic
ccgaccaagaagttccctccagctttgccaatctgggctcgacctgattataatccacctcttacggagaagtgg

SEQ ID NO: 130053 - DNA, 75 bp, Artificial Sequence
  Synthetic
ccgaccaagaagttccctccagctttgccaatctgggctcgacctgattacaatccacctcttacagagaagtgg

SEQ ID NO: 130054 - DNA, 75 bp, Artificial Sequence
  Synthetic
ccgaccaagaagttccctccagctttgccaatctgggctcgacctgattacaatccacctcttactgagaagtgg

SEQ ID NO: 130055 - DNA, 75 bp, Artificial Sequence
  Synthetic
ccgaccaagaagttccctccagctttgccaatctgggctcgacctgattacaatccacctcttaccgagaagtgg

SEQ ID NO: 130056 - DNA, 75 bp, Artificial Sequence
  Synthetic
ccgaccaagaagttccctccagctttgccaatctgggctcgacctgattacaatccacctcttacggagaagtgg

SEQ ID NO: 130057 - DNA, 75 bp, Artificial Sequence
  Synthetic
ccgaccaagaagttccctccagctttgccaatctgggctcgacctgattagaatccacctcttacagagaagtgg

SEQ ID NO: 130058 - DNA, 75 bp, Artificial Sequence
  Synthetic
ccgaccaagaagttccctccagctttgccaatctgggctcgacctgattagaatccacctcttactgagaagtgg

SEQ ID NO: 130059 - DNA, 75 bp, Artificial Sequence
  Synthetic
ccgaccaagaagttccctccagctttgccaatctgggctcgacctgattagaatccacctcttaccgagaagtgg

SEQ ID NO: 130060 - DNA, 75 bp, Artificial Sequence
  Synthetic
ccgaccaagaagttccctccagctttgccaatctgggctcgacctgattagaatccacctcttacggagaagtgg

SEQ ID NO: 130061 - DNA, 75 bp, Artificial Sequence
  Synthetic
ccgaccaagaagttccctccagctttgccaatctgggctcgacccgattaaaatccacctcttacagagaagtgg

SEQ ID NO: 130062 - DNA, 75 bp, Artificial Sequence
  Synthetic
ccgaccaagaagttccctccagctttgccaatctgggctcgacccgattaaaatccacctcttactgagaagtgg

SEQ ID NO: 130063 - DNA, 75 bp, Artificial Sequence
  Synthetic
ccgaccaagaagttccctccagctttgccaatctgggctcgacccgattaaaatccacctcttaccgagaagtgg

SEQ ID NO: 130064 - DNA, 75 bp, Artificial Sequence
  Synthetic
ccgaccaagaagttccctccagctttgccaatctgggctcgacccgattaaaatccacctcttacggagaagtgg

SEQ ID NO: 130065 - DNA, 75 bp, Artificial Sequence
  Synthetic
ccgaccaagaagttccctccagctttgccaatctgggctcgacccgattataatccacctcttacagagaagtgg

SEQ ID NO: 130066 - DNA, 75 bp, Artificial Sequence
  Synthetic
ccgaccaagaagttccctccagctttgccaatctgggctcgacccgattataatccacctcttactgagaagtgg

SEQ ID NO: 130067 - DNA, 75 bp, Artificial Sequence
  Synthetic
ccgaccaagaagttccctccagctttgccaatctgggctcgacccgattataatccacctcttaccgagaagtgg

SEQ ID NO: 130068 - DNA, 75 bp, Artificial Sequence
  Synthetic
ccgaccaagaagttccctccagctttgccaatctgggctcgacccgattataatccacctcttacggagaagtgg

SEQ ID NO: 130069 - DNA, 75 bp, Artificial Sequence
  Synthetic
ccgaccaagaagttccctccagctttgccaatctgggctcgacccgattacaatccacctcttacagagaagtgg

SEQ ID NO: 130070 - DNA, 75 bp, Artificial Sequence
  Synthetic
ccgaccaagaagttccctccagctttgccaatctgggctcgacccgattacaatccacctcttactgagaagtgg

SEQ ID NO: 130071 - DNA, 75 bp, Artificial Sequence
  Synthetic
ccgaccaagaagttccctccagctttgccaatctgggctcgacccgattacaatccacctcttaccgagaagtgg

SEQ ID NO: 130072 - DNA, 75 bp, Artificial Sequence
  Synthetic
ccgaccaagaagttccctccagctttgccaatctgggctcgacccgattacaatccacctcttacggagaagtgg

SEQ ID NO: 130073 - DNA, 75 bp, Artificial Sequence
  Synthetic
ccgaccaagaagttccctccagctttgccaatctgggctcgacccgattagaatccacctcttacagagaagtgg

SEQ ID NO: 130074 - DNA, 75 bp, Artificial Sequence
  Synthetic
ccgaccaagaagttccctccagctttgccaatctgggctcgacccgattagaatccacctcttactgagaagtgg

SEQ ID NO: 130075 - DNA, 75 bp, Artificial Sequence
  Synthetic
ccgaccaagaagttccctccagctttgccaatctgggctcgacccgattagaatccacctcttaccgagaagtgg

SEQ ID NO: 130076 - DNA, 75 bp, Artificial Sequence
  Synthetic
ccgaccaagaagttccctccagctttgccaatctgggctcgacccgattagaatccacctcttacggagaagtgg

SEQ ID NO: 130077 - DNA, 75 bp, Artificial Sequence
  Synthetic
ccgaccaagaagttccctccagctttgccaatctgggctcgaccggattaaaatccacctcttacagagaagtgg

SEQ ID NO: 130078 - DNA, 75 bp, Artificial Sequence
  Synthetic
ccgaccaagaagttccctccagctttgccaatctgggctcgaccggattaaaatccacctcttactgagaagtgg

SEQ ID NO: 130079 - DNA, 75 bp, Artificial Sequence
  Synthetic
ccgaccaagaagttccctccagctttgccaatctgggctcgaccggattaaaatccacctcttaccgagaagtgg

SEQ ID NO: 130080 - DNA, 75 bp, Artificial Sequence
  Synthetic
ccgaccaagaagttccctccagctttgccaatctgggctcgaccggattaaaatccacctcttacggagaagtgg

SEQ ID NO: 130081 - DNA, 75 bp, Artificial Sequence
  Synthetic
ccgaccaagaagttccctccagctttgccaatctgggctcgaccggattataatccacctcttacagagaagtgg

SEQ ID NO: 130082 - DNA, 75 bp, Artificial Sequence
  Synthetic
ccgaccaagaagttccctccagctttgccaatctgggctcgaccggattataatccacctcttactgagaagtgg

SEQ ID NO: 130083 - DNA, 75 bp, Artificial Sequence
  Synthetic
ccgaccaagaagttccctccagctttgccaatctgggctcgaccggattataatccacctcttaccgagaagtgg

SEQ ID NO: 130084 - DNA, 75 bp, Artificial Sequence
  Synthetic
ccgaccaagaagttccctccagctttgccaatctgggctcgaccggattataatccacctcttacggagaagtgg

SEQ ID NO: 130085 - DNA, 75 bp, Artificial Sequence
  Synthetic
ccgaccaagaagttccctccagctttgccaatctgggctcgaccggattacaatccacctcttacagagaagtgg

SEQ ID NO: 130086 - DNA, 75 bp, Artificial Sequence
  Synthetic
ccgaccaagaagttccctccagctttgccaatctgggctcgaccggattacaatccacctcttactgagaagtgg

SEQ ID NO: 130087 - DNA, 75 bp, Artificial Sequence
  Synthetic
ccgaccaagaagttccctccagctttgccaatctgggctcgaccggattacaatccacctcttaccgagaagtgg

SEQ ID NO: 130088 - DNA, 75 bp, Artificial Sequence
  Synthetic
ccgaccaagaagttccctccagctttgccaatctgggctcgaccggattacaatccacctcttacggagaagtgg

SEQ ID NO: 130089 - DNA, 75 bp, Artificial Sequence
  Synthetic
ccgaccaagaagttccctccagctttgccaatctgggctcgaccggattagaatccacctcttacagagaagtgg

SEQ ID NO: 130090 - DNA, 75 bp, Artificial Sequence
  Synthetic
ccgaccaagaagttccctccagctttgccaatctgggctcgaccggattagaatccacctcttactgagaagtgg

SEQ ID NO: 130091 - DNA, 75 bp, Artificial Sequence
  Synthetic
ccgaccaagaagttccctccagctttgccaatctgggctcgaccggattagaatccacctcttaccgagaagtgg

SEQ ID NO: 130092 - DNA, 75 bp, Artificial Sequence
  Synthetic
ccgaccaagaagttccctccagctttgccaatctgggctcgaccggattagaatccacctcttacggagaagtgg

SEQ ID NO: 130093 - DNA, 75 bp, Artificial Sequence
  Synthetic
gggagtatgtcctgttgctcttcctcctcctggcggacgcgcgcgtctgcgcctgcttatggatgatgctgctga

SEQ ID NO: 130094 - DNA, 75 bp, Artificial Sequence
  Synthetic
actctcccgcacagcgtgttgatttcctgctgcgagcttggaaagaaaagaaagaccctatgggtttttcgtatg

SEQ ID NO: 130095 - DNA, 75 bp, Artificial Sequence
  Synthetic
ccaaggaggaagcggacggtccagctcacagagtccgttgtttctaccgccttggcagagctggccgcgaagacc

SEQ ID NO: 130096 - DNA, 75 bp, Artificial Sequence
  Synthetic
cctaggaggaagcggacggtccagctcacagagtccgttgtttctaccgccttggcagagctggccgcgaagacc

SEQ ID NO: 130097 - DNA, 75 bp, Artificial Sequence
  Synthetic
cccaggaggaagcggacggtccagctcacagagtccgttgtttctaccgccttggcagagctggccgcgaagacc

SEQ ID NO: 130098 - DNA, 75 bp, Artificial Sequence
  Synthetic
ccgaggaggaagcggacggtccagctcacagagtccgttgtttctaccgccttggcagagctggccgcgaagacc

SEQ ID NO: 130099 - DNA, 75 bp, Artificial Sequence
  Synthetic
gctgctggtgatcgccgtggttactatcttcaccctcaccccggcatacaaaccacttctcataagcacgctctg

SEQ ID NO: 130100 - DNA, 75 bp, Artificial Sequence
  Synthetic
tcctgtgtgagtgctatgacgcgggttgtgcttggtatgagctcacgcccgctgagacctcggttaggttgcggg

SEQ ID NO: 130101 - DNA, 75 bp, Artificial Sequence
  Synthetic
cttacctgaatacaccagggttgcccgtctgccaggaccatctggagttctgggagagtgtcttcacaggcctca

SEQ ID NO: 130102 - DNA, 75 bp, Artificial Sequence
  Synthetic
cgtctgccaggaccatctggagttctgggagagtgtcttcacaggcctcacccacatagatgctcacttcttgtc

SEQ ID NO: 130103 - DNA, 75 bp, Artificial Sequence
  Synthetic
gctcgccactgctacccctccgggctccgtcactgtgccccaccccaacatcgaggaggttgctctgtccaccac

SEQ ID NO: 130104 - DNA, 75 bp, Artificial Sequence
  Synthetic
gatgttcgcagccattcccgcaaggccattaaccacatcaactccgtgtgggaggacttgctggaggacaacaat

SEQ ID NO: 130105 - DNA, 75 bp, Artificial Sequence
  Synthetic
gggtgcgcatggtcctcatgacacactttttctccgtcctaatggcccaggaaaccctggatcaagacctaaact

SEQ ID NO: 130106 - DNA, 75 bp, Artificial Sequence
  Synthetic
cagttactccggatcccacaagctgtcgtggacatggtggcgggggcccactggggagtcctggcgggcctcgcc

SEQ ID NO: 130107 - DNA, 75 bp, Artificial Sequence
  Synthetic
tcccaccgaactcactcgggtggcagcagctctcagaaaacttggagcgcctcccctcagagcgtggaagagccg

SEQ ID NO: 130108 - DNA, 75 bp, Artificial Sequence
  Synthetic
agtcctctaccaggagttcgatgagatggaagagtgtgcctcacacctcccttacatcgagcaggggatgcagct

SEQ ID NO: 130109 - DNA, 75 bp, Artificial Sequence
  Synthetic
gggttccttgccgcgctgttctacacatcgcgcttcaacgcgtccggatgtccagagcgcatggccagctgccgc

SEQ ID NO: 130110 - DNA, 75 bp, Artificial Sequence
  Synthetic
gtaggcatctttttactccccgctcggtagagcggcacaccttagctacactccatagctaactgtttttttttt

SEQ ID NO: 130111 - DNA, 75 bp, Artificial Sequence
  Synthetic
agtggcgtctacaccaccagcttcggaaacacactaacgtgctatctcaaagctacagccgctattaaagcggcg

SEQ ID NO: 130112 - DNA, 75 bp, Artificial Sequence
  Synthetic
agtggcgtctacaccaccagcttcggaaacacactaacgtgctatctcaaagcttcagccgctattaaagcggcg

SEQ ID NO: 130113 - DNA, 75 bp, Artificial Sequence
  Synthetic
agtggcgtctacaccaccagcttcggaaacacactaacgtgctatctcaaagctccagccgctattaaagcggcg

SEQ ID NO: 130114 - DNA, 75 bp, Artificial Sequence
  Synthetic
agtggcgtctacaccaccagcttcggaaacacactaacgtgctatctcaaagctgcagccgctattaaagcggcg

SEQ ID NO: 130115 - DNA, 75 bp, Artificial Sequence
  Synthetic
gtggtatcgtacccgcggcgcaggtgtgtggtccagtgtattgcttcaccccaagccctgttgtggtggggacga

SEQ ID NO: 130116 - DNA, 75 bp, Artificial Sequence
  Synthetic
aggaccatctggagttctgggagagcgtctttacaggcctcacccacatagacgcccatttcttgtcccagacta

SEQ ID NO: 130117 - DNA, 75 bp, Artificial Sequence
  Synthetic
tgcgccagggctcaggctccacctccatcgtgggaccaaatgtggaagtgtctcatacggctaaagcctacgctg

SEQ ID NO: 130118 - DNA, 75 bp, Artificial Sequence
  Synthetic
gacagtccgacacactccagtcaattcctggttgggaaacatcatagtctacgcgcccacaatatgggtgcgcat

SEQ ID NO: 130119 - DNA, 75 bp, Artificial Sequence
  Synthetic
cctaattggggccccaatgacccccggcggaggtcacgcaacctgggtaagatcatcgataccctgacttgcgga

SEQ ID NO: 130120 - DNA, 75 bp, Artificial Sequence
  Synthetic
cctaattggggccccaatgacccccggcggaggtctcgcaacctgggtaagatcatcgataccctgacttgcgga

SEQ ID NO: 130121 - DNA, 75 bp, Artificial Sequence
  Synthetic
cctaattggggccccaatgacccccggcggaggtcccgcaacctgggtaagatcatcgataccctgacttgcgga

SEQ ID NO: 130122 - DNA, 75 bp, Artificial Sequence
  Synthetic
cctaattggggccccaatgacccccggcggaggtcgcgcaacctgggtaagatcatcgataccctgacttgcgga

SEQ ID NO: 130123 - DNA, 75 bp, Artificial Sequence
  Synthetic
cgccgagcaattcaagcagaaggcgctcgggttgctgcaaacggccaccaagcaagcggaggctgctgctcccgt

SEQ ID NO: 130124 - DNA, 75 bp, Artificial Sequence
  Synthetic
gctggaagacactgagacaccaattgacaccaccatcatggcaaaaaatgaggttttctgcgtccaaccagagaa

SEQ ID NO: 130125 - DNA, 75 bp, Artificial Sequence
  Synthetic
tggccgtgttgacgtccatgctcactgacccctcccatataacagcagagacggccgggagaaggttggcgaggg

SEQ ID NO: 130126 - DNA, 75 bp, Artificial Sequence
  Synthetic
cccgctcaccacccaacacaccctcctgtttaacatcttggggggatgggtggccgcccagctcgctccccccag

SEQ ID NO: 130127 - DNA, 75 bp, Artificial Sequence
  Synthetic
gcattctcccggctgcatcccctgcgtgaaaaccaacaacagcacatctaagtgctgggtgcctgtcacgcctac

SEQ ID NO: 130128 - DNA, 75 bp, Artificial Sequence
  Synthetic
ggctcaacgcagtagcattctacaggggcgttgatgtggcggttattccaacctcaggtgacgtcgtcgtgtgtg

SEQ ID NO: 130129 - DNA, 75 bp, Artificial Sequence
  Synthetic
gacttgtgtggaggagccttccttgtggggcaactcttcacgtttagaccccgcgtgcacacgacagtgcaggat

SEQ ID NO: 130130 - DNA, 75 bp, Artificial Sequence
  Synthetic
acgtcaagttcccaggcggcggtcagatcgttggtggagtttacgtactaccacgcaggggccccaggttgggtg

SEQ ID NO: 130131 - DNA, 75 bp, Artificial Sequence
  Synthetic
tgctcagaataccccaactgatcgtcgacatttttgttggcggtcactggggtgtgctggccgggatcctgtact

SEQ ID NO: 130132 - DNA, 75 bp, Artificial Sequence
  Synthetic
ggcagctggcacatcaacaggactgccctgaactgcaatgactccctcaacaccgggttccttgccgcgctgttc

SEQ ID NO: 130133 - DNA, 75 bp, Artificial Sequence
  Synthetic
cggcgttgacgggaccacccgcacggtgggggggtcgacggcccaaaccactttcgcggtcgcgggcctgtttag

SEQ ID NO: 130134 - DNA, 75 bp, Artificial Sequence
  Synthetic
cgccggcgcttttgtcggcctctttaggccaggatccaagcagaacctccagttgattaacaccaacggaagctg

SEQ ID NO: 130135 - DNA, 75 bp, Artificial Sequence
  Synthetic
gagcgcatgcggtcctgcaagccgctcgaagcgtttgaccagggatggggcccgttatcttatgccaacatttcc

SEQ ID NO: 130136 - DNA, 75 bp, Artificial Sequence
  Synthetic
gagcgcatgcggtcctgcaagccgctcgatgcgtttgaccagggatggggcccgttatcttatgccaacatttcc

SEQ ID NO: 130137 - DNA, 75 bp, Artificial Sequence
  Synthetic
gagcgcatgcggtcctgcaagccgctcgacgcgtttgaccagggatggggcccgttatcttatgccaacatttcc

SEQ ID NO: 130138 - DNA, 75 bp, Artificial Sequence
  Synthetic
gagcgcatgcggtcctgcaagccgctcgaggcgtttgaccagggatggggcccgttatcttatgccaacatttcc

SEQ ID NO: 130139 - DNA, 75 bp, Artificial Sequence
  Synthetic
tccacctccatcgtgggatcaaatgtggaaatgtctcatacggctaaagcctacgttgcacgggccaacacccct

SEQ ID NO: 130140 - DNA, 75 bp, Artificial Sequence
  Synthetic
ggctttgctctcatgcttgcttacacccacagccgggctggagtaccgtaatgcctctggactctacatggtgac

SEQ ID NO: 130141 - DNA, 75 bp, Artificial Sequence
  Synthetic
atgcctctggactctacatggtgaccaacgactgtagcaacagtagcatcgtgtatgaggccggggatattatcc

SEQ ID NO: 130142 - DNA, 75 bp, Artificial Sequence
  Synthetic
cctccggtggtacacgggtgcccattgccacctaccaaggcccctccaataccacctccacggagaaagaggacg

SEQ ID NO: 130143 - DNA, 75 bp, Artificial Sequence
  Synthetic
cgagccctgttgtcatagggaccacggaccgcaggggttaccccacgtacaactggggtgccaatgaaaccgatg

SEQ ID NO: 130144 - DNA, 75 bp, Artificial Sequence
  Synthetic
tccttgcagctctggccgcgtactgcctgacaacgggcagcgtggtcattgtgggcaggatcatcttgtccggga

SEQ ID NO: 130145 - DNA, 75 bp, Artificial Sequence
  Synthetic
caccgcctctctccgcacgcacgtggatatgatggtgggagcggccaccctatgctcagctctctacgtaggaga

SEQ ID NO: 130146 - DNA, 75 bp, Artificial Sequence
  Synthetic
gcccatcacggcttacgcccaacagacgcggggcctacttggctgcatcgtcaccagcctcacaggccgggacaa

SEQ ID NO: 130147 - DNA, 75 bp, Artificial Sequence
  Synthetic
taagaccttcggcagctccggatcgtcggccgtcgacagcggtacggcgaccgcccctcctgaccaggcctccga

SEQ ID NO: 130148 - DNA, 75 bp, Artificial Sequence
  Synthetic
taacatcggttctcctggcaacaactcactgacatgcccgaccgatcgcttccgaaaacacccagaagcgacata

SEQ ID NO: 130149 - DNA, 75 bp, Artificial Sequence
  Synthetic
gagtcgtactcctccatgcccccccttgagggagagccgggggaccccgatctcagcgacgggtcttggtctacc

SEQ ID NO: 130150 - DNA, 75 bp, Artificial Sequence
  Synthetic
ttcaaacaaaaggttctcggcctcatccaaactactactaagcaggccgaagagcttaagcctgctgtccattct

SEQ ID NO: 130151 - DNA, 75 bp, Artificial Sequence
  Synthetic
caactgttcgatataccctggacatctgacaggccatcgtatggcttgggacatgatgatgaattggtcccctgc

SEQ ID NO: 130152 - DNA, 75 bp, Artificial Sequence
  Synthetic
caactgttcgatttaccctggacatctgacaggccatcgtatggcttgggacatgatgatgaattggtcccctgc

SEQ ID NO: 130153 - DNA, 75 bp, Artificial Sequence
  Synthetic
caactgttcgatctaccctggacatctgacaggccatcgtatggcttgggacatgatgatgaattggtcccctgc

SEQ ID NO: 130154 - DNA, 75 bp, Artificial Sequence
  Synthetic
caactgttcgatgtaccctggacatctgacaggccatcgtatggcttgggacatgatgatgaattggtcccctgc

SEQ ID NO: 130155 - DNA, 75 bp, Artificial Sequence
  Synthetic
cgggttcgcatgtacgtaggtggggtggagcacaggtttgaagcggcgtgcaactggacgcgggggcagaagtgt

SEQ ID NO: 130156 - DNA, 75 bp, Artificial Sequence
  Synthetic
cgggttcgcatgtacgtaggtggggtggagcacaggtttgaagcggcgtgcaactggacgcgggggcagatgtgt

SEQ ID NO: 130157 - DNA, 75 bp, Artificial Sequence
  Synthetic
cgggttcgcatgtacgtaggtggggtggagcacaggtttgaagcggcgtgcaactggacgcgggggcagacgtgt

SEQ ID NO: 130158 - DNA, 75 bp, Artificial Sequence
  Synthetic
cgggttcgcatgtacgtaggtggggtggagcacaggtttgaagcggcgtgcaactggacgcgggggcagaggtgt

SEQ ID NO: 130159 - DNA, 75 bp, Artificial Sequence
  Synthetic
cgggttcgcatgtacgtaggtggggtggagcacaggtttgatgcggcgtgcaactggacgcgggggcagaagtgt

SEQ ID NO: 130160 - DNA, 75 bp, Artificial Sequence
  Synthetic
cgggttcgcatgtacgtaggtggggtggagcacaggtttgatgcggcgtgcaactggacgcgggggcagatgtgt

SEQ ID NO: 130161 - DNA, 75 bp, Artificial Sequence
  Synthetic
cgggttcgcatgtacgtaggtggggtggagcacaggtttgatgcggcgtgcaactggacgcgggggcagacgtgt

SEQ ID NO: 130162 - DNA, 75 bp, Artificial Sequence
  Synthetic
cgggttcgcatgtacgtaggtggggtggagcacaggtttgatgcggcgtgcaactggacgcgggggcagaggtgt

SEQ ID NO: 130163 - DNA, 75 bp, Artificial Sequence
  Synthetic
cgggttcgcatgtacgtaggtggggtggagcacaggtttgacgcggcgtgcaactggacgcgggggcagaagtgt

SEQ ID NO: 130164 - DNA, 75 bp, Artificial Sequence
  Synthetic
cgggttcgcatgtacgtaggtggggtggagcacaggtttgacgcggcgtgcaactggacgcgggggcagatgtgt

SEQ ID NO: 130165 - DNA, 75 bp, Artificial Sequence
  Synthetic
cgggttcgcatgtacgtaggtggggtggagcacaggtttgacgcggcgtgcaactggacgcgggggcagacgtgt

SEQ ID NO: 130166 - DNA, 75 bp, Artificial Sequence
  Synthetic
cgggttcgcatgtacgtaggtggggtggagcacaggtttgacgcggcgtgcaactggacgcgggggcagaggtgt

SEQ ID NO: 130167 - DNA, 75 bp, Artificial Sequence
  Synthetic
cgggttcgcatgtacgtaggtggggtggagcacaggtttgaggcggcgtgcaactggacgcgggggcagaagtgt

SEQ ID NO: 130168 - DNA, 75 bp, Artificial Sequence
  Synthetic
cgggttcgcatgtacgtaggtggggtggagcacaggtttgaggcggcgtgcaactggacgcgggggcagatgtgt

SEQ ID NO: 130169 - DNA, 75 bp, Artificial Sequence
  Synthetic
cgggttcgcatgtacgtaggtggggtggagcacaggtttgaggcggcgtgcaactggacgcgggggcagacgtgt

SEQ ID NO: 130170 - DNA, 75 bp, Artificial Sequence
  Synthetic
cgggttcgcatgtacgtaggtggggtggagcacaggtttgaggcggcgtgcaactggacgcgggggcagaggtgt

SEQ ID NO: 130171 - DNA, 75 bp, Artificial Sequence
  Synthetic
cgggttcgcatgtacgttggtggggtggagcacaggtttgaagcggcgtgcaactggacgcgggggcagaagtgt

SEQ ID NO: 130172 - DNA, 75 bp, Artificial Sequence
  Synthetic
cgggttcgcatgtacgttggtggggtggagcacaggtttgaagcggcgtgcaactggacgcgggggcagatgtgt

SEQ ID NO: 130173 - DNA, 75 bp, Artificial Sequence
  Synthetic
cgggttcgcatgtacgttggtggggtggagcacaggtttgaagcggcgtgcaactggacgcgggggcagacgtgt

SEQ ID NO: 130174 - DNA, 75 bp, Artificial Sequence
  Synthetic
cgggttcgcatgtacgttggtggggtggagcacaggtttgaagcggcgtgcaactggacgcgggggcagaggtgt

SEQ ID NO: 130175 - DNA, 75 bp, Artificial Sequence
  Synthetic
cgggttcgcatgtacgttggtggggtggagcacaggtttgatgcggcgtgcaactggacgcgggggcagaagtgt

SEQ ID NO: 130176 - DNA, 75 bp, Artificial Sequence
  Synthetic
cgggttcgcatgtacgttggtggggtggagcacaggtttgatgcggcgtgcaactggacgcgggggcagatgtgt

SEQ ID NO: 130177 - DNA, 75 bp, Artificial Sequence
  Synthetic
cgggttcgcatgtacgttggtggggtggagcacaggtttgatgcggcgtgcaactggacgcgggggcagacgtgt

SEQ ID NO: 130178 - DNA, 75 bp, Artificial Sequence
  Synthetic
cgggttcgcatgtacgttggtggggtggagcacaggtttgatgcggcgtgcaactggacgcgggggcagaggtgt

SEQ ID NO: 130179 - DNA, 75 bp, Artificial Sequence
  Synthetic
cgggttcgcatgtacgttggtggggtggagcacaggtttgacgcggcgtgcaactggacgcgggggcagaagtgt

SEQ ID NO: 130180 - DNA, 75 bp, Artificial Sequence
  Synthetic
cgggttcgcatgtacgttggtggggtggagcacaggtttgacgcggcgtgcaactggacgcgggggcagatgtgt

SEQ ID NO: 130181 - DNA, 75 bp, Artificial Sequence
  Synthetic
cgggttcgcatgtacgttggtggggtggagcacaggtttgacgcggcgtgcaactggacgcgggggcagacgtgt

SEQ ID NO: 130182 - DNA, 75 bp, Artificial Sequence
  Synthetic
cgggttcgcatgtacgttggtggggtggagcacaggtttgacgcggcgtgcaactggacgcgggggcagaggtgt

SEQ ID NO: 130183 - DNA, 75 bp, Artificial Sequence
  Synthetic
cgggttcgcatgtacgttggtggggtggagcacaggtttgaggcggcgtgcaactggacgcgggggcagaagtgt

SEQ ID NO: 130184 - DNA, 75 bp, Artificial Sequence
  Synthetic
cgggttcgcatgtacgttggtggggtggagcacaggtttgaggcggcgtgcaactggacgcgggggcagatgtgt

SEQ ID NO: 130185 - DNA, 75 bp, Artificial Sequence
  Synthetic
cgggttcgcatgtacgttggtggggtggagcacaggtttgaggcggcgtgcaactggacgcgggggcagacgtgt

SEQ ID NO: 130186 - DNA, 75 bp, Artificial Sequence
  Synthetic
cgggttcgcatgtacgttggtggggtggagcacaggtttgaggcggcgtgcaactggacgcgggggcagaggtgt

SEQ ID NO: 130187 - DNA, 75 bp, Artificial Sequence
  Synthetic
cgggttcgcatgtacgtcggtggggtggagcacaggtttgaagcggcgtgcaactggacgcgggggcagaagtgt

SEQ ID NO: 130188 - DNA, 75 bp, Artificial Sequence
  Synthetic
cgggttcgcatgtacgtcggtggggtggagcacaggtttgaagcggcgtgcaactggacgcgggggcagatgtgt

SEQ ID NO: 130189 - DNA, 75 bp, Artificial Sequence
  Synthetic
cgggttcgcatgtacgtcggtggggtggagcacaggtttgaagcggcgtgcaactggacgcgggggcagacgtgt

SEQ ID NO: 130190 - DNA, 75 bp, Artificial Sequence
  Synthetic
cgggttcgcatgtacgtcggtggggtggagcacaggtttgaagcggcgtgcaactggacgcgggggcagaggtgt

SEQ ID NO: 130191 - DNA, 75 bp, Artificial Sequence
  Synthetic
cgggttcgcatgtacgtcggtggggtggagcacaggtttgatgcggcgtgcaactggacgcgggggcagaagtgt

SEQ ID NO: 130192 - DNA, 75 bp, Artificial Sequence
  Synthetic
cgggttcgcatgtacgtcggtggggtggagcacaggtttgatgcggcgtgcaactggacgcgggggcagatgtgt

SEQ ID NO: 130193 - DNA, 75 bp, Artificial Sequence
  Synthetic
cgggttcgcatgtacgtcggtggggtggagcacaggtttgatgcggcgtgcaactggacgcgggggcagacgtgt

SEQ ID NO: 130194 - DNA, 75 bp, Artificial Sequence
  Synthetic
cgggttcgcatgtacgtcggtggggtggagcacaggtttgatgcggcgtgcaactggacgcgggggcagaggtgt

SEQ ID NO: 130195 - DNA, 75 bp, Artificial Sequence
  Synthetic
cgggttcgcatgtacgtcggtggggtggagcacaggtttgacgcggcgtgcaactggacgcgggggcagaagtgt

SEQ ID NO: 130196 - DNA, 75 bp, Artificial Sequence
  Synthetic
cgggttcgcatgtacgtcggtggggtggagcacaggtttgacgcggcgtgcaactggacgcgggggcagatgtgt

SEQ ID NO: 130197 - DNA, 75 bp, Artificial Sequence
  Synthetic
cgggttcgcatgtacgtcggtggggtggagcacaggtttgacgcggcgtgcaactggacgcgggggcagacgtgt

SEQ ID NO: 130198 - DNA, 75 bp, Artificial Sequence
  Synthetic
cgggttcgcatgtacgtcggtggggtggagcacaggtttgacgcggcgtgcaactggacgcgggggcagaggtgt

SEQ ID NO: 130199 - DNA, 75 bp, Artificial Sequence
  Synthetic
cgggttcgcatgtacgtcggtggggtggagcacaggtttgaggcggcgtgcaactggacgcgggggcagaagtgt

SEQ ID NO: 130200 - DNA, 75 bp, Artificial Sequence
  Synthetic
cgggttcgcatgtacgtcggtggggtggagcacaggtttgaggcggcgtgcaactggacgcgggggcagatgtgt

SEQ ID NO: 130201 - DNA, 75 bp, Artificial Sequence
  Synthetic
cgggttcgcatgtacgtcggtggggtggagcacaggtttgaggcggcgtgcaactggacgcgggggcagacgtgt

SEQ ID NO: 130202 - DNA, 75 bp, Artificial Sequence
  Synthetic
cgggttcgcatgtacgtcggtggggtggagcacaggtttgaggcggcgtgcaactggacgcgggggcagaggtgt

SEQ ID NO: 130203 - DNA, 75 bp, Artificial Sequence
  Synthetic
cgggttcgcatgtacgtgggtggggtggagcacaggtttgaagcggcgtgcaactggacgcgggggcagaagtgt

SEQ ID NO: 130204 - DNA, 75 bp, Artificial Sequence
  Synthetic
cgggttcgcatgtacgtgggtggggtggagcacaggtttgaagcggcgtgcaactggacgcgggggcagatgtgt

SEQ ID NO: 130205 - DNA, 75 bp, Artificial Sequence
  Synthetic
cgggttcgcatgtacgtgggtggggtggagcacaggtttgaagcggcgtgcaactggacgcgggggcagacgtgt

SEQ ID NO: 130206 - DNA, 75 bp, Artificial Sequence
  Synthetic
cgggttcgcatgtacgtgggtggggtggagcacaggtttgaagcggcgtgcaactggacgcgggggcagaggtgt

SEQ ID NO: 130207 - DNA, 75 bp, Artificial Sequence
  Synthetic
cgggttcgcatgtacgtgggtggggtggagcacaggtttgatgcggcgtgcaactggacgcgggggcagaagtgt

SEQ ID NO: 130208 - DNA, 75 bp, Artificial Sequence
  Synthetic
cgggttcgcatgtacgtgggtggggtggagcacaggtttgatgcggcgtgcaactggacgcgggggcagatgtgt

SEQ ID NO: 130209 - DNA, 75 bp, Artificial Sequence
  Synthetic
cgggttcgcatgtacgtgggtggggtggagcacaggtttgatgcggcgtgcaactggacgcgggggcagacgtgt

SEQ ID NO: 130210 - DNA, 75 bp, Artificial Sequence
  Synthetic
cgggttcgcatgtacgtgggtggggtggagcacaggtttgatgcggcgtgcaactggacgcgggggcagaggtgt

SEQ ID NO: 130211 - DNA, 75 bp, Artificial Sequence
  Synthetic
cgggttcgcatgtacgtgggtggggtggagcacaggtttgacgcggcgtgcaactggacgcgggggcagaagtgt

SEQ ID NO: 130212 - DNA, 75 bp, Artificial Sequence
  Synthetic
cgggttcgcatgtacgtgggtggggtggagcacaggtttgacgcggcgtgcaactggacgcgggggcagatgtgt

SEQ ID NO: 130213 - DNA, 75 bp, Artificial Sequence
  Synthetic
cgggttcgcatgtacgtgggtggggtggagcacaggtttgacgcggcgtgcaactggacgcgggggcagacgtgt

SEQ ID NO: 130214 - DNA, 75 bp, Artificial Sequence
  Synthetic
cgggttcgcatgtacgtgggtggggtggagcacaggtttgacgcggcgtgcaactggacgcgggggcagaggtgt

SEQ ID NO: 130215 - DNA, 75 bp, Artificial Sequence
  Synthetic
cgggttcgcatgtacgtgggtggggtggagcacaggtttgaggcggcgtgcaactggacgcgggggcagaagtgt

SEQ ID NO: 130216 - DNA, 75 bp, Artificial Sequence
  Synthetic
cgggttcgcatgtacgtgggtggggtggagcacaggtttgaggcggcgtgcaactggacgcgggggcagatgtgt

SEQ ID NO: 130217 - DNA, 75 bp, Artificial Sequence
  Synthetic
cgggttcgcatgtacgtgggtggggtggagcacaggtttgaggcggcgtgcaactggacgcgggggcagacgtgt

SEQ ID NO: 130218 - DNA, 75 bp, Artificial Sequence
  Synthetic
cgggttcgcatgtacgtgggtggggtggagcacaggtttgaggcggcgtgcaactggacgcgggggcagaggtgt

SEQ ID NO: 130219 - DNA, 75 bp, Artificial Sequence
  Synthetic
cgtgatggccggcgtggcttactattccatgcaagggaattgggctaaggtgtttctcgttttgtgtctattctc

SEQ ID NO: 130220 - DNA, 75 bp, Artificial Sequence
  Synthetic
ccactggtatgatacacctacaccaaaacatagtggacgtccaatacctgtatgggatctccccagccatcacct

SEQ ID NO: 130221 - DNA, 75 bp, Artificial Sequence
  Synthetic
ccactggtatgatacacctacaccaaaacattgtggacgtccaatacctgtatgggatctccccagccatcacct

SEQ ID NO: 130222 - DNA, 75 bp, Artificial Sequence
  Synthetic
ccactggtatgatacacctacaccaaaacatcgtggacgtccaatacctgtatgggatctccccagccatcacct

SEQ ID NO: 130223 - DNA, 75 bp, Artificial Sequence
  Synthetic
ccactggtatgatacacctacaccaaaacatggtggacgtccaatacctgtatgggatctccccagccatcacct

SEQ ID NO: 130224 - DNA, 75 bp, Artificial Sequence
  Synthetic
ccactggtttgatacacctacaccaaaacatagtggacgtccaatacctgtatgggatctccccagccatcacct

SEQ ID NO: 130225 - DNA, 75 bp, Artificial Sequence
  Synthetic
ccactggtttgatacacctacaccaaaacattgtggacgtccaatacctgtatgggatctccccagccatcacct

SEQ ID NO: 130226 - DNA, 75 bp, Artificial Sequence
  Synthetic
ccactggtttgatacacctacaccaaaacatcgtggacgtccaatacctgtatgggatctccccagccatcacct

SEQ ID NO: 130227 - DNA, 75 bp, Artificial Sequence
  Synthetic
ccactggtttgatacacctacaccaaaacatggtggacgtccaatacctgtatgggatctccccagccatcacct

SEQ ID NO: 130228 - DNA, 75 bp, Artificial Sequence
  Synthetic
ccactggtctgatacacctacaccaaaacatagtggacgtccaatacctgtatgggatctccccagccatcacct

SEQ ID NO: 130229 - DNA, 75 bp, Artificial Sequence
  Synthetic
ccactggtctgatacacctacaccaaaacattgtggacgtccaatacctgtatgggatctccccagccatcacct

SEQ ID NO: 130230 - DNA, 75 bp, Artificial Sequence
  Synthetic
ccactggtctgatacacctacaccaaaacatcgtggacgtccaatacctgtatgggatctccccagccatcacct

SEQ ID NO: 130231 - DNA, 75 bp, Artificial Sequence
  Synthetic
ccactggtctgatacacctacaccaaaacatggtggacgtccaatacctgtatgggatctccccagccatcacct

SEQ ID NO: 130232 - DNA, 75 bp, Artificial Sequence
  Synthetic
ccactggtgtgatacacctacaccaaaacatagtggacgtccaatacctgtatgggatctccccagccatcacct

SEQ ID NO: 130233 - DNA, 75 bp, Artificial Sequence
  Synthetic
ccactggtgtgatacacctacaccaaaacattgtggacgtccaatacctgtatgggatctccccagccatcacct

SEQ ID NO: 130234 - DNA, 75 bp, Artificial Sequence
  Synthetic
ccactggtgtgatacacctacaccaaaacatcgtggacgtccaatacctgtatgggatctccccagccatcacct

SEQ ID NO: 130235 - DNA, 75 bp, Artificial Sequence
  Synthetic
ccactggtgtgatacacctacaccaaaacatggtggacgtccaatacctgtatgggatctccccagccatcacct

SEQ ID NO: 130236 - DNA, 75 bp, Artificial Sequence
  Synthetic
ttgatcaacaccaatggctcgtggcacataaaccgcacagccctgaattgcaatgattccctaaacaccgggttt

SEQ ID NO: 130237 - DNA, 75 bp, Artificial Sequence
  Synthetic
ttgctctttctctatcttcctcttggcactactctcgtgcctgactgtgcccgcctctgcggcgcactatgccaa

SEQ ID NO: 130238 - DNA, 75 bp, Artificial Sequence
  Synthetic
cgaggcagcgctagagaacctaatagttctcaacgcagcttcggccgctagcctccaagggtggtggtggggtct

SEQ ID NO: 130239 - DNA, 75 bp, Artificial Sequence
  Synthetic
catggaccgggagatggctgcatcgtgcggaggcgcggttttcgtaggtctggtactcttgaccttgtcaccaca

SEQ ID NO: 130240 - DNA, 75 bp, Artificial Sequence
  Synthetic
cgttgggacctgctaacatcagcggctcttcgtctgaaaagccgtactgctggcattatgcgcccaggccttgcc

SEQ ID NO: 130241 - DNA, 75 bp, Artificial Sequence
  Synthetic
gtcaaggtcggtaacacgtctacatgctgggtgcccgcatcacctacactggccgtcccaaacgcgacaaccccc

SEQ ID NO: 130242 - DNA, 75 bp, Artificial Sequence
  Synthetic
gggcaggctggtccctggagcggcttatgccctttatggtgtgtggccactgctcctgctcctgctggcgctgcc

SEQ ID NO: 130243 - DNA, 75 bp, Artificial Sequence
  Synthetic
ctgccccaccgggcgtacgcttttgatcaggagcaggcggcctctattggagcagtcgtgctcgcggctctcacc

SEQ ID NO: 130244 - DNA, 75 bp, Artificial Sequence
  Synthetic
ctggggggagaatgagtcagacgtattcctgctggaatcagtaaggccccctacgggcccctggttcgggtgcac

SEQ ID NO: 130245 - DNA, 75 bp, Artificial Sequence
  Synthetic
ggcaactcttcactttcacgccccgcttgcaccagaccgttcaggaatgcaactgctccatctactcagggcgaa

SEQ ID NO: 130246 - DNA, 75 bp, Artificial Sequence
  Synthetic
tccccagcttgagggtgcgaggaggccgtgacgcggtgttactgctcacctgcttactgcacccctcccttggct

SEQ ID NO: 130247 - DNA, 75 bp, Artificial Sequence
  Synthetic
catgcacaccatctgcccctgtggagcacaaatcgccggacatttcaaaaatggttccatgaagatcgtcgggcc

SEQ ID NO: 130248 - DNA, 75 bp, Artificial Sequence
  Synthetic
ggggccccactgacccccggcataggtcgcgcaacgtgggtaaggtcatcgataccctaacgtgcggctttgccg

SEQ ID NO: 130249 - DNA, 75 bp, Artificial Sequence
  Synthetic
gtcgcgcaacgtgggtaaggtcatcgataccctaacgtgcggctttgccgacctcatggggtacatccccgtcgt

SEQ ID NO: 130250 - DNA, 75 bp, Artificial Sequence
  Synthetic
acggactgtttcaggaaacaccccgatgccacttacagtcgttgcggtgccggcccgtggttgacgccgagatgt

SEQ ID NO: 130251 - DNA, 75 bp, Artificial Sequence
  Synthetic
catctttgttggtggtcactggggcgtgcttgctggactgctgtactacagcatggtggctaactgggcgaaggt

SEQ ID NO: 130252 - DNA, 75 bp, Artificial Sequence
  Synthetic
acgcgcgtgtatgcttgtccgccacttctgtggcggcaagtatgtgcaggcgggcctcctgcgacttggagcttg

SEQ ID NO: 130253 - DNA, 75 bp, Artificial Sequence
  Synthetic
acgcgcgtgtatgcttgtccgccacttctgtggcggcaagtatgtgcaggcgggcctcctgcgacttggtgcttg

SEQ ID NO: 130254 - DNA, 75 bp, Artificial Sequence
  Synthetic
acgcgcgtgtatgcttgtccgccacttctgtggcggcaagtatgtgcaggcgggcctcctgcgacttggcgcttg

SEQ ID NO: 130255 - DNA, 75 bp, Artificial Sequence
  Synthetic
acgcgcgtgtatgcttgtccgccacttctgtggcggcaagtatgtgcaggcgggcctcctgcgacttggggcttg

SEQ ID NO: 130256 - DNA, 75 bp, Artificial Sequence
  Synthetic
tacaaaagggccctgtggcgggtgtccgcagaggagtacgtcgaggtggtgaggatgggcgatgcccatttcgtg

SEQ ID NO: 130257 - DNA, 75 bp, Artificial Sequence
  Synthetic
ccgccgcctgcaactggaccagaggagagcgttgcaacttggaggaccgggatcgcagcgagctatatcctctac

SEQ ID NO: 130258 - DNA, 75 bp, Artificial Sequence
  Synthetic
aacagggaacttacctggttgctccttttctatcttcttgctggccctactgtcctgcatcaccattccggtctc

SEQ ID NO: 130259 - DNA, 75 bp, Artificial Sequence
  Synthetic
ccggggcccagccagaacctccatctgatcaacaccaatgggagttggcatctcaacaggacggctctgaattgc

SEQ ID NO: 130260 - DNA, 75 bp, Artificial Sequence
  Synthetic
tgcattcaaccacagaacaagcgatactaccttgctcttttgcgccgataccagccctatcaacaggcctcatac

SEQ ID NO: 130261 - DNA, 75 bp, Artificial Sequence
  Synthetic
cccatggaaaagaaggtcattacctggggagcagacactgctgcatgtggcgacatcttggacggcctgcccgtc

SEQ ID NO: 130262 - DNA, 75 bp, Artificial Sequence
  Synthetic
gttccaatggcagcatcacctggcaactccaggccgcggtcctccacgtccccgggtgcgtcccgtgcgagaaag

SEQ ID NO: 130263 - DNA, 75 bp, Artificial Sequence
  Synthetic
cagatttcgatcaggggtggggccctatcacctatgtcaacatctctgggccccaggatgataaaccctactgct

SEQ ID NO: 130264 - DNA, 75 bp, Artificial Sequence
  Synthetic
gcttgcgagtgccccgggaggtctcgtagaccgtgcatcatgagcacacttcctaaacctcaaagaaaaaccaaa

SEQ ID NO: 130265 - DNA, 75 bp, Artificial Sequence
  Synthetic
cctactggcagatgcaagagtgtgtgtcgtcttgtggatgatgctgttgatatcacaagctgaagctgctttgga

SEQ ID NO: 130266 - DNA, 75 bp, Artificial Sequence
  Synthetic
tcacagctcccatgtgagcccgaaccggatgtggcagtgctcacttccatgctcaccgacccctcccacattaca

SEQ ID NO: 130267 - DNA, 75 bp, Artificial Sequence
  Synthetic
cgcgggggcttctggggacgatcgtcactagccttaccgggcgggacaagaacgaggtcgagggtgaggtgcaag

SEQ ID NO: 130268 - DNA, 75 bp, Artificial Sequence
  Synthetic
tccgctgcgggcacacatgggatctggtggtcccttgttgccttctgcgttgcttggcacattcggggcaggatt

SEQ ID NO: 130269 - DNA, 75 bp, Artificial Sequence
  Synthetic
cagaaagggactcccaacctacgggtggggagaaaatgaaaccgatgttttcttgctggcatcccaacggccgcc

SEQ ID NO: 130270 - DNA, 75 bp, Artificial Sequence
  Synthetic
ctacccaccatgactccccagatgccgacctcatcgaggccaacctcctgtggagacaggagatgggcgggaaca

SEQ ID NO: 130271 - DNA, 75 bp, Artificial Sequence
  Synthetic
cgggtacccttggcccctctatggtaacgagggctgcgggtgggcagggtggctcctgtccccccgcggctcccg

SEQ ID NO: 130272 - DNA, 75 bp, Artificial Sequence
  Synthetic
agggccgatctgtcagatgtacactaatgttgaccaagacatggtaggatggcccgcgccacagggttcaagatc

SEQ ID NO: 130273 - DNA, 75 bp, Artificial Sequence
  Synthetic
ccaccttgggtgtcggagtgctgagcttgtttgcccttttcactttgtccccctggtacaagcactggatagccc

SEQ ID NO: 130274 - DNA, 75 bp, Artificial Sequence
  Synthetic
ctagattgccccactgactgcttccgaaaacatccggaggcgacgtacgccaaatgtggttcagggccatggttg

SEQ ID NO: 130275 - DNA, 75 bp, Artificial Sequence
  Synthetic
cagtcacccaaatgtacaccaatgtagaccaggacctcgtcggctggcaggcgccccccggggcgcgctccctga

SEQ ID NO: 130276 - DNA, 75 bp, Artificial Sequence
  Synthetic
tcggcttagcctacttctctatgcagggagcctgggcaaaagtcgttgtcatcctcctgctgaccgctggggtgg

SEQ ID NO: 130277 - DNA, 75 bp, Artificial Sequence
  Synthetic
ctcagcccgaggcccttgagcaccctcaagggctcgtcaggaggacccgtcatgtgctcgtcagggcacgctgtg

SEQ ID NO: 130278 - DNA, 75 bp, Artificial Sequence
  Synthetic
tctgcttgctggcttgttttatcccgctctagtctttgacatcactaaactcttgttagcaatactagggcctct

SEQ ID NO: 130279 - DNA, 75 bp, Artificial Sequence
  Synthetic
aacacaggctggaggccgcgtgcaactggactcgcggggagcgctgtgagctggacgatcgagacagagccgacc

SEQ ID NO: 130280 - DNA, 75 bp, Artificial Sequence
  Synthetic
gctctagtctttgacatcactaaactcttgttagcaatactagggcctctttacatcttacaggccagccttgtc

SEQ ID NO: 130281 - DNA, 75 bp, Artificial Sequence
  Synthetic
caccaatggcagttggcacatcaaccgtactgccctgaattgcaatgaatccctgaacaccggctttctcgcgtc

SEQ ID NO: 130282 - DNA, 75 bp, Artificial Sequence
  Synthetic
tcttgttagcaatactagggcctctttacatcttacaggccagccttgtccgcgtcccctattttgtgcgggcgc

SEQ ID NO: 130283 - DNA, 75 bp, Artificial Sequence
  Synthetic
cggtccacctgctggcatgctgtgtcccccaccctagccataccaaatgcttccacgcccgcaacggggttccgc

SEQ ID NO: 130284 - DNA, 75 bp, Artificial Sequence
  Synthetic
ctgacaattcggctccacctgctgtaccacagacctaccaggtgggttacctccatgctccaacaggcagtggga

SEQ ID NO: 130285 - DNA, 75 bp, Artificial Sequence
  Synthetic
tatagtggatgtccagtatctgtacggtatctctacctccattgtgacatgggccataaagtgggagtatgttgt

SEQ ID NO: 130286 - DNA, 75 bp, Artificial Sequence
  Synthetic
acacgtccggcctccatgtcctcaccaacgactgttccaacagcagcattgtgtatgaggctgatgacgttattc

SEQ ID NO: 130287 - DNA, 75 bp, Artificial Sequence
  Synthetic
gtatgaccatctctcacccatgactgattgggcggctgagggcttgaaagacctagccgtggccgtcgagcctgt

SEQ ID NO: 130288 - DNA, 75 bp, Artificial Sequence
  Synthetic
aagatatgagaccatattgctggcactacccaccaaaacagtgcggcatagtccccgcgaggtctgtatgtggcc

SEQ ID NO: 130289 - DNA, 75 bp, Artificial Sequence
  Synthetic
caaggcccatggcattgaccccaacattaggaccggggtcagaactatcacaacaggaggccccatcacctactc

SEQ ID NO: 130290 - DNA, 75 bp, Artificial Sequence
  Synthetic
ctcaatgcagcttctgctgccagtctccagggatgggggtggtgtctgctctatttgtgctgcgcctggtacatt

SEQ ID NO: 130291 - DNA, 75 bp, Artificial Sequence
  Synthetic
aaggaggtgctactaggccctgcggataattaccgctccatggggtggaggttgctggcgccgataacagctcac

SEQ ID NO: 130292 - DNA, 75 bp, Artificial Sequence
  Synthetic
ggcatcggtacagtgctggaccaagctgaaactgcaggtgtgcggcttaccgtactggccacggcaacaccccct

SEQ ID NO: 130293 - DNA, 75 bp, Artificial Sequence
  Synthetic
ggcatcggtacagtgctggaccaagctgaaactgcaggtgtgcggcttaccgttctggccacggcaacaccccct

SEQ ID NO: 130294 - DNA, 75 bp, Artificial Sequence
  Synthetic
ggcatcggtacagtgctggaccaagctgaaactgcaggtgtgcggcttaccgtcctggccacggcaacaccccct

SEQ ID NO: 130295 - DNA, 75 bp, Artificial Sequence
  Synthetic
ggcatcggtacagtgctggaccaagctgaaactgcaggtgtgcggcttaccgtgctggccacggcaacaccccct

SEQ ID NO: 130296 - DNA, 75 bp, Artificial Sequence
  Synthetic
ggcatcggtacagtgctggaccaagctgaaactgctggtgtgcggcttaccgtactggccacggcaacaccccct

SEQ ID NO: 130297 - DNA, 75 bp, Artificial Sequence
  Synthetic
ggcatcggtacagtgctggaccaagctgaaactgctggtgtgcggcttaccgttctggccacggcaacaccccct

SEQ ID NO: 130298 - DNA, 75 bp, Artificial Sequence
  Synthetic
ggcatcggtacagtgctggaccaagctgaaactgctggtgtgcggcttaccgtcctggccacggcaacaccccct

SEQ ID NO: 130299 - DNA, 75 bp, Artificial Sequence
  Synthetic
ggcatcggtacagtgctggaccaagctgaaactgctggtgtgcggcttaccgtgctggccacggcaacaccccct

SEQ ID NO: 130300 - DNA, 75 bp, Artificial Sequence
  Synthetic
ggcatcggtacagtgctggaccaagctgaaactgccggtgtgcggcttaccgtactggccacggcaacaccccct

SEQ ID NO: 130301 - DNA, 75 bp, Artificial Sequence
  Synthetic
ggcatcggtacagtgctggaccaagctgaaactgccggtgtgcggcttaccgttctggccacggcaacaccccct

SEQ ID NO: 130302 - DNA, 75 bp, Artificial Sequence
  Synthetic
ggcatcggtacagtgctggaccaagctgaaactgccggtgtgcggcttaccgtcctggccacggcaacaccccct

SEQ ID NO: 130303 - DNA, 75 bp, Artificial Sequence
  Synthetic
ggcatcggtacagtgctggaccaagctgaaactgccggtgtgcggcttaccgtgctggccacggcaacaccccct

SEQ ID NO: 130304 - DNA, 75 bp, Artificial Sequence
  Synthetic
ggcatcggtacagtgctggaccaagctgaaactgcgggtgtgcggcttaccgtactggccacggcaacaccccct

SEQ ID NO: 130305 - DNA, 75 bp, Artificial Sequence
  Synthetic
ggcatcggtacagtgctggaccaagctgaaactgcgggtgtgcggcttaccgttctggccacggcaacaccccct

SEQ ID NO: 130306 - DNA, 75 bp, Artificial Sequence
  Synthetic
ggcatcggtacagtgctggaccaagctgaaactgcgggtgtgcggcttaccgtcctggccacggcaacaccccct

SEQ ID NO: 130307 - DNA, 75 bp, Artificial Sequence
  Synthetic
ggcatcggtacagtgctggaccaagctgaaactgcgggtgtgcggcttaccgtgctggccacggcaacaccccct

SEQ ID NO: 130308 - DNA, 75 bp, Artificial Sequence
  Synthetic
ggcatcggtactgtgctggaccaagctgaaactgcaggtgtgcggcttaccgtactggccacggcaacaccccct

SEQ ID NO: 130309 - DNA, 75 bp, Artificial Sequence
  Synthetic
ggcatcggtactgtgctggaccaagctgaaactgcaggtgtgcggcttaccgttctggccacggcaacaccccct

SEQ ID NO: 130310 - DNA, 75 bp, Artificial Sequence
  Synthetic
ggcatcggtactgtgctggaccaagctgaaactgcaggtgtgcggcttaccgtcctggccacggcaacaccccct

SEQ ID NO: 130311 - DNA, 75 bp, Artificial Sequence
  Synthetic
ggcatcggtactgtgctggaccaagctgaaactgcaggtgtgcggcttaccgtgctggccacggcaacaccccct

SEQ ID NO: 130312 - DNA, 75 bp, Artificial Sequence
  Synthetic
ggcatcggtactgtgctggaccaagctgaaactgctggtgtgcggcttaccgtactggccacggcaacaccccct

SEQ ID NO: 130313 - DNA, 75 bp, Artificial Sequence
  Synthetic
ggcatcggtactgtgctggaccaagctgaaactgctggtgtgcggcttaccgttctggccacggcaacaccccct

SEQ ID NO: 130314 - DNA, 75 bp, Artificial Sequence
  Synthetic
ggcatcggtactgtgctggaccaagctgaaactgctggtgtgcggcttaccgtcctggccacggcaacaccccct

SEQ ID NO: 130315 - DNA, 75 bp, Artificial Sequence
  Synthetic
ggcatcggtactgtgctggaccaagctgaaactgctggtgtgcggcttaccgtgctggccacggcaacaccccct

SEQ ID NO: 130316 - DNA, 75 bp, Artificial Sequence
  Synthetic
ggcatcggtactgtgctggaccaagctgaaactgccggtgtgcggcttaccgtactggccacggcaacaccccct

SEQ ID NO: 130317 - DNA, 75 bp, Artificial Sequence
  Synthetic
ggcatcggtactgtgctggaccaagctgaaactgccggtgtgcggcttaccgttctggccacggcaacaccccct

SEQ ID NO: 130318 - DNA, 75 bp, Artificial Sequence
  Synthetic
ggcatcggtactgtgctggaccaagctgaaactgccggtgtgcggcttaccgtcctggccacggcaacaccccct

SEQ ID NO: 130319 - DNA, 75 bp, Artificial Sequence
  Synthetic
ggcatcggtactgtgctggaccaagctgaaactgccggtgtgcggcttaccgtgctggccacggcaacaccccct

SEQ ID NO: 130320 - DNA, 75 bp, Artificial Sequence
  Synthetic
ggcatcggtactgtgctggaccaagctgaaactgcgggtgtgcggcttaccgtactggccacggcaacaccccct

SEQ ID NO: 130321 - DNA, 75 bp, Artificial Sequence
  Synthetic
ggcatcggtactgtgctggaccaagctgaaactgcgggtgtgcggcttaccgttctggccacggcaacaccccct

SEQ ID NO: 130322 - DNA, 75 bp, Artificial Sequence
  Synthetic
ggcatcggtactgtgctggaccaagctgaaactgcgggtgtgcggcttaccgtcctggccacggcaacaccccct

SEQ ID NO: 130323 - DNA, 75 bp, Artificial Sequence
  Synthetic
ggcatcggtactgtgctggaccaagctgaaactgcgggtgtgcggcttaccgtgctggccacggcaacaccccct

SEQ ID NO: 130324 - DNA, 75 bp, Artificial Sequence
  Synthetic
ggcatcggtaccgtgctggaccaagctgaaactgcaggtgtgcggcttaccgtactggccacggcaacaccccct

SEQ ID NO: 130325 - DNA, 75 bp, Artificial Sequence
  Synthetic
ggcatcggtaccgtgctggaccaagctgaaactgcaggtgtgcggcttaccgttctggccacggcaacaccccct

SEQ ID NO: 130326 - DNA, 75 bp, Artificial Sequence
  Synthetic
ggcatcggtaccgtgctggaccaagctgaaactgcaggtgtgcggcttaccgtcctggccacggcaacaccccct

SEQ ID NO: 130327 - DNA, 75 bp, Artificial Sequence
  Synthetic
ggcatcggtaccgtgctggaccaagctgaaactgcaggtgtgcggcttaccgtgctggccacggcaacaccccct

SEQ ID NO: 130328 - DNA, 75 bp, Artificial Sequence
  Synthetic
ggcatcggtaccgtgctggaccaagctgaaactgctggtgtgcggcttaccgtactggccacggcaacaccccct

SEQ ID NO: 130329 - DNA, 75 bp, Artificial Sequence
  Synthetic
ggcatcggtaccgtgctggaccaagctgaaactgctggtgtgcggcttaccgttctggccacggcaacaccccct

SEQ ID NO: 130330 - DNA, 75 bp, Artificial Sequence
  Synthetic
ggcatcggtaccgtgctggaccaagctgaaactgctggtgtgcggcttaccgtcctggccacggcaacaccccct

SEQ ID NO: 130331 - DNA, 75 bp, Artificial Sequence
  Synthetic
ggcatcggtaccgtgctggaccaagctgaaactgctggtgtgcggcttaccgtgctggccacggcaacaccccct

SEQ ID NO: 130332 - DNA, 75 bp, Artificial Sequence
  Synthetic
ggcatcggtaccgtgctggaccaagctgaaactgccggtgtgcggcttaccgtactggccacggcaacaccccct

SEQ ID NO: 130333 - DNA, 75 bp, Artificial Sequence
  Synthetic
ggcatcggtaccgtgctggaccaagctgaaactgccggtgtgcggcttaccgttctggccacggcaacaccccct

SEQ ID NO: 130334 - DNA, 75 bp, Artificial Sequence
  Synthetic
ggcatcggtaccgtgctggaccaagctgaaactgccggtgtgcggcttaccgtcctggccacggcaacaccccct

SEQ ID NO: 130335 - DNA, 75 bp, Artificial Sequence
  Synthetic
ggcatcggtaccgtgctggaccaagctgaaactgccggtgtgcggcttaccgtgctggccacggcaacaccccct

SEQ ID NO: 130336 - DNA, 75 bp, Artificial Sequence
  Synthetic
ggcatcggtaccgtgctggaccaagctgaaactgcgggtgtgcggcttaccgtactggccacggcaacaccccct

SEQ ID NO: 130337 - DNA, 75 bp, Artificial Sequence
  Synthetic
ggcatcggtaccgtgctggaccaagctgaaactgcgggtgtgcggcttaccgttctggccacggcaacaccccct

SEQ ID NO: 130338 - DNA, 75 bp, Artificial Sequence
  Synthetic
ggcatcggtaccgtgctggaccaagctgaaactgcgggtgtgcggcttaccgtcctggccacggcaacaccccct

SEQ ID NO: 130339 - DNA, 75 bp, Artificial Sequence
  Synthetic
ggcatcggtaccgtgctggaccaagctgaaactgcgggtgtgcggcttaccgtgctggccacggcaacaccccct

SEQ ID NO: 130340 - DNA, 75 bp, Artificial Sequence
  Synthetic
ggcatcggtacggtgctggaccaagctgaaactgcaggtgtgcggcttaccgtactggccacggcaacaccccct

SEQ ID NO: 130341 - DNA, 75 bp, Artificial Sequence
  Synthetic
ggcatcggtacggtgctggaccaagctgaaactgcaggtgtgcggcttaccgttctggccacggcaacaccccct

SEQ ID NO: 130342 - DNA, 75 bp, Artificial Sequence
  Synthetic
ggcatcggtacggtgctggaccaagctgaaactgcaggtgtgcggcttaccgtcctggccacggcaacaccccct

SEQ ID NO: 130343 - DNA, 75 bp, Artificial Sequence
  Synthetic
ggcatcggtacggtgctggaccaagctgaaactgcaggtgtgcggcttaccgtgctggccacggcaacaccccct

SEQ ID NO: 130344 - DNA, 75 bp, Artificial Sequence
  Synthetic
ggcatcggtacggtgctggaccaagctgaaactgctggtgtgcggcttaccgtactggccacggcaacaccccct

SEQ ID NO: 130345 - DNA, 75 bp, Artificial Sequence
  Synthetic
ggcatcggtacggtgctggaccaagctgaaactgctggtgtgcggcttaccgttctggccacggcaacaccccct

SEQ ID NO: 130346 - DNA, 75 bp, Artificial Sequence
  Synthetic
ggcatcggtacggtgctggaccaagctgaaactgctggtgtgcggcttaccgtcctggccacggcaacaccccct

SEQ ID NO: 130347 - DNA, 75 bp, Artificial Sequence
  Synthetic
ggcatcggtacggtgctggaccaagctgaaactgctggtgtgcggcttaccgtgctggccacggcaacaccccct

SEQ ID NO: 130348 - DNA, 75 bp, Artificial Sequence
  Synthetic
ggcatcggtacggtgctggaccaagctgaaactgccggtgtgcggcttaccgtactggccacggcaacaccccct

SEQ ID NO: 130349 - DNA, 75 bp, Artificial Sequence
  Synthetic
ggcatcggtacggtgctggaccaagctgaaactgccggtgtgcggcttaccgttctggccacggcaacaccccct

SEQ ID NO: 130350 - DNA, 75 bp, Artificial Sequence
  Synthetic
ggcatcggtacggtgctggaccaagctgaaactgccggtgtgcggcttaccgtcctggccacggcaacaccccct

SEQ ID NO: 130351 - DNA, 75 bp, Artificial Sequence
  Synthetic
ggcatcggtacggtgctggaccaagctgaaactgccggtgtgcggcttaccgtgctggccacggcaacaccccct

SEQ ID NO: 130352 - DNA, 75 bp, Artificial Sequence
  Synthetic
ggcatcggtacggtgctggaccaagctgaaactgcgggtgtgcggcttaccgtactggccacggcaacaccccct

SEQ ID NO: 130353 - DNA, 75 bp, Artificial Sequence
  Synthetic
ggcatcggtacggtgctggaccaagctgaaactgcgggtgtgcggcttaccgttctggccacggcaacaccccct

SEQ ID NO: 130354 - DNA, 75 bp, Artificial Sequence
  Synthetic
ggcatcggtacggtgctggaccaagctgaaactgcgggtgtgcggcttaccgtcctggccacggcaacaccccct

SEQ ID NO: 130355 - DNA, 75 bp, Artificial Sequence
  Synthetic
ggcatcggtacggtgctggaccaagctgaaactgcgggtgtgcggcttaccgtgctggccacggcaacaccccct

SEQ ID NO: 130356 - DNA, 75 bp, Artificial Sequence
  Synthetic
atgaacaagcagcttgcatcggggtatcagtcatcatagtccttactatttttactctcaccccccactacaagt

SEQ ID NO: 130357 - DNA, 75 bp, Artificial Sequence
  Synthetic
cacagacattcctgggtacttcagtagggggggtcatgtggaccgtctaccatggagctggctccaggacactgg

SEQ ID NO: 130358 - DNA, 75 bp, Artificial Sequence
  Synthetic
aagggggcagacacctgatattctgtcactccaagaagaagtgcgaggagctggccaagcagttaacatcactag

SEQ ID NO: 130359 - DNA, 75 bp, Artificial Sequence
  Synthetic
ctggtaacaagaggccagctctgcagatgtacacgaacgttaaccaggacctagtcggctggccctctccacccg

SEQ ID NO: 130360 - DNA, 75 bp, Artificial Sequence
  Synthetic
agactcggtcatactccttacgtgcttgttacatccatcccttgggtttgacatcactaaggtgctattggcctt

SEQ ID NO: 130361 - DNA, 75 bp, Artificial Sequence
  Synthetic
tccgggcgccagacagaaattgcagctggtcaacaccaatggctcgtggcatatcaacagcaccgccttgaactg

SEQ ID NO: 130362 - DNA, 75 bp, Artificial Sequence
  Synthetic
ctggtcaacaccaatggctcgtggcatatcaacagcaccgccttgaactgtaacgagtccataaataccgggttc

SEQ ID NO: 130363 - DNA, 75 bp, Artificial Sequence
  Synthetic
ggccagcttgctcagtcctagacctatagcatgcttaaaaggctcttcgggcggtcccatcatgtgcccctctgg

SEQ ID NO: 130364 - DNA, 75 bp, Artificial Sequence
  Synthetic
caccggtgactttgacaccgtcatcgactgtaatgtggcagtgacacaggtggttgacttcagcttggatcccac

SEQ ID NO: 130365 - DNA, 75 bp, Artificial Sequence
  Synthetic
ctttctcagacttgcccgctttgtcgactggtcttctccacctccaccaaaacatcgtggacgtgcaatacatgt

SEQ ID NO: 130366 - DNA, 75 bp, Artificial Sequence
  Synthetic
gttggtgcaaaatacatccaggcttgtctgctgaaactcggagcatggaccgggacatacatctatgatcatctc

SEQ ID NO: 130367 - DNA, 75 bp, Artificial Sequence
  Synthetic
ccctgacagacgccaacatcactggcccttctgatgaaagaccgtactgctggcactacgcacctagaccttgtg

SEQ ID NO: 130368 - DNA, 75 bp, Artificial Sequence
  Synthetic
atagcatgcttaaaaggctcttcgggcggtcccatcatgtgcccctctggtcatgtcgccggcatcttcagagca

SEQ ID NO: 130369 - DNA, 75 bp, Artificial Sequence
  Synthetic
aaatggccctttacgacgtggtctccactcttcctcaggccgtgatgggctcctcatacggattccagtactctc

SEQ ID NO: 130370 - DNA, 75 bp, Artificial Sequence
  Synthetic
tcacaaggcgaacgaccatcaggtatgtttgataccgtcgtcctatgtgaggcatacgatataggctgcgcttgg

SEQ ID NO: 130371 - DNA, 75 bp, Artificial Sequence
  Synthetic
caccagcagtgccgcagtcttttcaagtgggttatctccatgcgcccaccggcagcggtaagagtacaaaagtgc

SEQ ID NO: 130372 - DNA, 75 bp, Artificial Sequence
  Synthetic
gggcggatacagccgcctgtggggacatccttgacggccttccggtttccgcccgcaagggacgcctccttctcc

SEQ ID NO: 130373 - DNA, 75 bp, Artificial Sequence
  Synthetic
gaagcagcactagagaagctggtcgtcttgcacgctgcgagcgcagctagctgcaatggcttcctatactttgtc

SEQ ID NO: 130374 - DNA, 75 bp, Artificial Sequence
  Synthetic
acaggctgtggcactacccctgcactgtcaacttcaccttgcataaagtcaggatgttcgtgggaggcattgagc

SEQ ID NO: 130375 - DNA, 75 bp, Artificial Sequence
  Synthetic
gaaccgtctcggcatcaacagtctgtggccctgtatactgcttcacaccatcgccggtggtcgtaggcactactg

SEQ ID NO: 130376 - DNA, 75 bp, Artificial Sequence
  Synthetic
gaccatcttgaattctgggagggggtgttcactggtctaacacagatagatgcccaattactgtcacaaaccaag

SEQ ID NO: 130377 - DNA, 75 bp, Artificial Sequence
  Synthetic
gaccatcttgaattctgggagggggtgttcactggtctaacacagatagatgcccaatttctgtcacaaaccaag

SEQ ID NO: 130378 - DNA, 75 bp, Artificial Sequence
  Synthetic
gaccatcttgaattctgggagggggtgttcactggtctaacacagatagatgcccaattcctgtcacaaaccaag

SEQ ID NO: 130379 - DNA, 75 bp, Artificial Sequence
  Synthetic
gaccatcttgaattctgggagggggtgttcactggtctaacacagatagatgcccaattgctgtcacaaaccaag

SEQ ID NO: 130380 - DNA, 75 bp, Artificial Sequence
  Synthetic
gaccatcttgaattctgggagggggtgttcactggtctaacacagatagatgcccatttactgtcacaaaccaag

SEQ ID NO: 130381 - DNA, 75 bp, Artificial Sequence
  Synthetic
gaccatcttgaattctgggagggggtgttcactggtctaacacagatagatgcccattttctgtcacaaaccaag

SEQ ID NO: 130382 - DNA, 75 bp, Artificial Sequence
  Synthetic
gaccatcttgaattctgggagggggtgttcactggtctaacacagatagatgcccatttcctgtcacaaaccaag

SEQ ID NO: 130383 - DNA, 75 bp, Artificial Sequence
  Synthetic
gaccatcttgaattctgggagggggtgttcactggtctaacacagatagatgcccatttgctgtcacaaaccaag

SEQ ID NO: 130384 - DNA, 75 bp, Artificial Sequence
  Synthetic
gaccatcttgaattctgggagggggtgttcactggtctaacacagatagatgcccacttactgtcacaaaccaag

SEQ ID NO: 130385 - DNA, 75 bp, Artificial Sequence
  Synthetic
gaccatcttgaattctgggagggggtgttcactggtctaacacagatagatgcccactttctgtcacaaaccaag

SEQ ID NO: 130386 - DNA, 75 bp, Artificial Sequence
  Synthetic
gaccatcttgaattctgggagggggtgttcactggtctaacacagatagatgcccacttcctgtcacaaaccaag

SEQ ID NO: 130387 - DNA, 75 bp, Artificial Sequence
  Synthetic
gaccatcttgaattctgggagggggtgttcactggtctaacacagatagatgcccacttgctgtcacaaaccaag

SEQ ID NO: 130388 - DNA, 75 bp, Artificial Sequence
  Synthetic
gaccatcttgaattctgggagggggtgttcactggtctaacacagatagatgcccagttactgtcacaaaccaag

SEQ ID NO: 130389 - DNA, 75 bp, Artificial Sequence
  Synthetic
gaccatcttgaattctgggagggggtgttcactggtctaacacagatagatgcccagtttctgtcacaaaccaag

SEQ ID NO: 130390 - DNA, 75 bp, Artificial Sequence
  Synthetic
gaccatcttgaattctgggagggggtgttcactggtctaacacagatagatgcccagttcctgtcacaaaccaag

SEQ ID NO: 130391 - DNA, 75 bp, Artificial Sequence
  Synthetic
gaccatcttgaattctgggagggggtgttcactggtctaacacagatagatgcccagttgctgtcacaaaccaag

SEQ ID NO: 130392 - DNA, 75 bp, Artificial Sequence
  Synthetic
gaccatcttgaattctgggagggggtgttcactggtcttacacagatagatgcccaattactgtcacaaaccaag

SEQ ID NO: 130393 - DNA, 75 bp, Artificial Sequence
  Synthetic
gaccatcttgaattctgggagggggtgttcactggtcttacacagatagatgcccaatttctgtcacaaaccaag

SEQ ID NO: 130394 - DNA, 75 bp, Artificial Sequence
  Synthetic
gaccatcttgaattctgggagggggtgttcactggtcttacacagatagatgcccaattcctgtcacaaaccaag

SEQ ID NO: 130395 - DNA, 75 bp, Artificial Sequence
  Synthetic
gaccatcttgaattctgggagggggtgttcactggtcttacacagatagatgcccaattgctgtcacaaaccaag

SEQ ID NO: 130396 - DNA, 75 bp, Artificial Sequence
  Synthetic
gaccatcttgaattctgggagggggtgttcactggtcttacacagatagatgcccatttactgtcacaaaccaag

SEQ ID NO: 130397 - DNA, 75 bp, Artificial Sequence
  Synthetic
gaccatcttgaattctgggagggggtgttcactggtcttacacagatagatgcccattttctgtcacaaaccaag

SEQ ID NO: 130398 - DNA, 75 bp, Artificial Sequence
  Synthetic
gaccatcttgaattctgggagggggtgttcactggtcttacacagatagatgcccatttcctgtcacaaaccaag

SEQ ID NO: 130399 - DNA, 75 bp, Artificial Sequence
  Synthetic
gaccatcttgaattctgggagggggtgttcactggtcttacacagatagatgcccatttgctgtcacaaaccaag

SEQ ID NO: 130400 - DNA, 75 bp, Artificial Sequence
  Synthetic
gaccatcttgaattctgggagggggtgttcactggtcttacacagatagatgcccacttactgtcacaaaccaag

SEQ ID NO: 130401 - DNA, 75 bp, Artificial Sequence
  Synthetic
gaccatcttgaattctgggagggggtgttcactggtcttacacagatagatgcccactttctgtcacaaaccaag

SEQ ID NO: 130402 - DNA, 75 bp, Artificial Sequence
  Synthetic
gaccatcttgaattctgggagggggtgttcactggtcttacacagatagatgcccacttcctgtcacaaaccaag

SEQ ID NO: 130403 - DNA, 75 bp, Artificial Sequence
  Synthetic
gaccatcttgaattctgggagggggtgttcactggtcttacacagatagatgcccacttgctgtcacaaaccaag

SEQ ID NO: 130404 - DNA, 75 bp, Artificial Sequence
  Synthetic
gaccatcttgaattctgggagggggtgttcactggtcttacacagatagatgcccagttactgtcacaaaccaag

SEQ ID NO: 130405 - DNA, 75 bp, Artificial Sequence
  Synthetic
gaccatcttgaattctgggagggggtgttcactggtcttacacagatagatgcccagtttctgtcacaaaccaag

SEQ ID NO: 130406 - DNA, 75 bp, Artificial Sequence
  Synthetic
gaccatcttgaattctgggagggggtgttcactggtcttacacagatagatgcccagttcctgtcacaaaccaag

SEQ ID NO: 130407 - DNA, 75 bp, Artificial Sequence
  Synthetic
gaccatcttgaattctgggagggggtgttcactggtcttacacagatagatgcccagttgctgtcacaaaccaag

SEQ ID NO: 130408 - DNA, 75 bp, Artificial Sequence
  Synthetic
gaccatcttgaattctgggagggggtgttcactggtctcacacagatagatgcccaattactgtcacaaaccaag

SEQ ID NO: 130409 - DNA, 75 bp, Artificial Sequence
  Synthetic
gaccatcttgaattctgggagggggtgttcactggtctcacacagatagatgcccaatttctgtcacaaaccaag

SEQ ID NO: 130410 - DNA, 75 bp, Artificial Sequence
  Synthetic
gaccatcttgaattctgggagggggtgttcactggtctcacacagatagatgcccaattcctgtcacaaaccaag

SEQ ID NO: 130411 - DNA, 75 bp, Artificial Sequence
  Synthetic
gaccatcttgaattctgggagggggtgttcactggtctcacacagatagatgcccaattgctgtcacaaaccaag

SEQ ID NO: 130412 - DNA, 75 bp, Artificial Sequence
  Synthetic
gaccatcttgaattctgggagggggtgttcactggtctcacacagatagatgcccatttactgtcacaaaccaag

SEQ ID NO: 130413 - DNA, 75 bp, Artificial Sequence
  Synthetic
gaccatcttgaattctgggagggggtgttcactggtctcacacagatagatgcccattttctgtcacaaaccaag

SEQ ID NO: 130414 - DNA, 75 bp, Artificial Sequence
  Synthetic
gaccatcttgaattctgggagggggtgttcactggtctcacacagatagatgcccatttcctgtcacaaaccaag

SEQ ID NO: 130415 - DNA, 75 bp, Artificial Sequence
  Synthetic
gaccatcttgaattctgggagggggtgttcactggtctcacacagatagatgcccatttgctgtcacaaaccaag

SEQ ID NO: 130416 - DNA, 75 bp, Artificial Sequence
  Synthetic
gaccatcttgaattctgggagggggtgttcactggtctcacacagatagatgcccacttactgtcacaaaccaag

SEQ ID NO: 130417 - DNA, 75 bp, Artificial Sequence
  Synthetic
gaccatcttgaattctgggagggggtgttcactggtctcacacagatagatgcccactttctgtcacaaaccaag

SEQ ID NO: 130418 - DNA, 75 bp, Artificial Sequence
  Synthetic
gaccatcttgaattctgggagggggtgttcactggtctcacacagatagatgcccacttcctgtcacaaaccaag

SEQ ID NO: 130419 - DNA, 75 bp, Artificial Sequence
  Synthetic
gaccatcttgaattctgggagggggtgttcactggtctcacacagatagatgcccacttgctgtcacaaaccaag

SEQ ID NO: 130420 - DNA, 75 bp, Artificial Sequence
  Synthetic
gaccatcttgaattctgggagggggtgttcactggtctcacacagatagatgcccagttactgtcacaaaccaag

SEQ ID NO: 130421 - DNA, 75 bp, Artificial Sequence
  Synthetic
gaccatcttgaattctgggagggggtgttcactggtctcacacagatagatgcccagtttctgtcacaaaccaag

SEQ ID NO: 130422 - DNA, 75 bp, Artificial Sequence
  Synthetic
gaccatcttgaattctgggagggggtgttcactggtctcacacagatagatgcccagttcctgtcacaaaccaag

SEQ ID NO: 130423 - DNA, 75 bp, Artificial Sequence
  Synthetic
gaccatcttgaattctgggagggggtgttcactggtctcacacagatagatgcccagttgctgtcacaaaccaag

SEQ ID NO: 130424 - DNA, 75 bp, Artificial Sequence
  Synthetic
gaccatcttgaattctgggagggggtgttcactggtctgacacagatagatgcccaattactgtcacaaaccaag

SEQ ID NO: 130425 - DNA, 75 bp, Artificial Sequence
  Synthetic
gaccatcttgaattctgggagggggtgttcactggtctgacacagatagatgcccaatttctgtcacaaaccaag

SEQ ID NO: 130426 - DNA, 75 bp, Artificial Sequence
  Synthetic
gaccatcttgaattctgggagggggtgttcactggtctgacacagatagatgcccaattcctgtcacaaaccaag

SEQ ID NO: 130427 - DNA, 75 bp, Artificial Sequence
  Synthetic
gaccatcttgaattctgggagggggtgttcactggtctgacacagatagatgcccaattgctgtcacaaaccaag

SEQ ID NO: 130428 - DNA, 75 bp, Artificial Sequence
  Synthetic
gaccatcttgaattctgggagggggtgttcactggtctgacacagatagatgcccatttactgtcacaaaccaag

SEQ ID NO: 130429 - DNA, 75 bp, Artificial Sequence
  Synthetic
gaccatcttgaattctgggagggggtgttcactggtctgacacagatagatgcccattttctgtcacaaaccaag

SEQ ID NO: 130430 - DNA, 75 bp, Artificial Sequence
  Synthetic
gaccatcttgaattctgggagggggtgttcactggtctgacacagatagatgcccatttcctgtcacaaaccaag

SEQ ID NO: 130431 - DNA, 75 bp, Artificial Sequence
  Synthetic
gaccatcttgaattctgggagggggtgttcactggtctgacacagatagatgcccatttgctgtcacaaaccaag

SEQ ID NO: 130432 - DNA, 75 bp, Artificial Sequence
  Synthetic
gaccatcttgaattctgggagggggtgttcactggtctgacacagatagatgcccacttactgtcacaaaccaag

SEQ ID NO: 130433 - DNA, 75 bp, Artificial Sequence
  Synthetic
gaccatcttgaattctgggagggggtgttcactggtctgacacagatagatgcccactttctgtcacaaaccaag

SEQ ID NO: 130434 - DNA, 75 bp, Artificial Sequence
  Synthetic
gaccatcttgaattctgggagggggtgttcactggtctgacacagatagatgcccacttcctgtcacaaaccaag

SEQ ID NO: 130435 - DNA, 75 bp, Artificial Sequence
  Synthetic
gaccatcttgaattctgggagggggtgttcactggtctgacacagatagatgcccacttgctgtcacaaaccaag

SEQ ID NO: 130436 - DNA, 75 bp, Artificial Sequence
  Synthetic
gaccatcttgaattctgggagggggtgttcactggtctgacacagatagatgcccagttactgtcacaaaccaag

SEQ ID NO: 130437 - DNA, 75 bp, Artificial Sequence
  Synthetic
gaccatcttgaattctgggagggggtgttcactggtctgacacagatagatgcccagtttctgtcacaaaccaag

SEQ ID NO: 130438 - DNA, 75 bp, Artificial Sequence
  Synthetic
gaccatcttgaattctgggagggggtgttcactggtctgacacagatagatgcccagttcctgtcacaaaccaag

SEQ ID NO: 130439 - DNA, 75 bp, Artificial Sequence
  Synthetic
gaccatcttgaattctgggagggggtgttcactggtctgacacagatagatgcccagttgctgtcacaaaccaag

SEQ ID NO: 130440 - DNA, 75 bp, Artificial Sequence
  Synthetic
cctttttttttcctctttttttccttttctttcctttggtggctccatcttagccctagtcacggctagctgtga

SEQ ID NO: 130441 - DNA, 75 bp, Artificial Sequence
  Synthetic
tgaccctaacgtgcgcactggcacccgcaccataaccaccggtgcgaagcttacatactcaacatatggaaagtt

SEQ ID NO: 130442 - DNA, 75 bp, Artificial Sequence
  Synthetic
tgaccctaacgtgcgcactggcacccgcaccataaccaccggtgcgaagcttacatactcaacttatggaaagtt

SEQ ID NO: 130443 - DNA, 75 bp, Artificial Sequence
  Synthetic
tgaccctaacgtgcgcactggcacccgcaccataaccaccggtgcgaagcttacatactcaacctatggaaagtt

SEQ ID NO: 130444 - DNA, 75 bp, Artificial Sequence
  Synthetic
tgaccctaacgtgcgcactggcacccgcaccataaccaccggtgcgaagcttacatactcaacgtatggaaagtt

SEQ ID NO: 130445 - DNA, 75 bp, Artificial Sequence
  Synthetic
tgaccctaacgtgcgcactggcacccgcaccataaccaccggtgcgaagcttacttactcaacatatggaaagtt

SEQ ID NO: 130446 - DNA, 75 bp, Artificial Sequence
  Synthetic
tgaccctaacgtgcgcactggcacccgcaccataaccaccggtgcgaagcttacttactcaacttatggaaagtt

SEQ ID NO: 130447 - DNA, 75 bp, Artificial Sequence
  Synthetic
tgaccctaacgtgcgcactggcacccgcaccataaccaccggtgcgaagcttacttactcaacctatggaaagtt

SEQ ID NO: 130448 - DNA, 75 bp, Artificial Sequence
  Synthetic
tgaccctaacgtgcgcactggcacccgcaccataaccaccggtgcgaagcttacttactcaacgtatggaaagtt

SEQ ID NO: 130449 - DNA, 75 bp, Artificial Sequence
  Synthetic
tgaccctaacgtgcgcactggcacccgcaccataaccaccggtgcgaagcttacctactcaacatatggaaagtt

SEQ ID NO: 130450 - DNA, 75 bp, Artificial Sequence
  Synthetic
tgaccctaacgtgcgcactggcacccgcaccataaccaccggtgcgaagcttacctactcaacttatggaaagtt

SEQ ID NO: 130451 - DNA, 75 bp, Artificial Sequence
  Synthetic
tgaccctaacgtgcgcactggcacccgcaccataaccaccggtgcgaagcttacctactcaacctatggaaagtt

SEQ ID NO: 130452 - DNA, 75 bp, Artificial Sequence
  Synthetic
tgaccctaacgtgcgcactggcacccgcaccataaccaccggtgcgaagcttacctactcaacgtatggaaagtt

SEQ ID NO: 130453 - DNA, 75 bp, Artificial Sequence
  Synthetic
tgaccctaacgtgcgcactggcacccgcaccataaccaccggtgcgaagcttacgtactcaacatatggaaagtt

SEQ ID NO: 130454 - DNA, 75 bp, Artificial Sequence
  Synthetic
tgaccctaacgtgcgcactggcacccgcaccataaccaccggtgcgaagcttacgtactcaacttatggaaagtt

SEQ ID NO: 130455 - DNA, 75 bp, Artificial Sequence
  Synthetic
tgaccctaacgtgcgcactggcacccgcaccataaccaccggtgcgaagcttacgtactcaacctatggaaagtt

SEQ ID NO: 130456 - DNA, 75 bp, Artificial Sequence
  Synthetic
tgaccctaacgtgcgcactggcacccgcaccataaccaccggtgcgaagcttacgtactcaacgtatggaaagtt

SEQ ID NO: 130457 - DNA, 75 bp, Artificial Sequence
  Synthetic
cagcctcaccgggcgggacaagaatgaggtcgagggagaaatacaaataatctctacagcaactcaaaccttctt

SEQ ID NO: 130458 - DNA, 75 bp, Artificial Sequence
  Synthetic
cagcctcaccgggcgggacaagaatgaggtcgagggagaaatacaaataatctctacagctactcaaaccttctt

SEQ ID NO: 130459 - DNA, 75 bp, Artificial Sequence
  Synthetic
cagcctcaccgggcgggacaagaatgaggtcgagggagaaatacaaataatctctacagccactcaaaccttctt

SEQ ID NO: 130460 - DNA, 75 bp, Artificial Sequence
  Synthetic
cagcctcaccgggcgggacaagaatgaggtcgagggagaaatacaaataatctctacagcgactcaaaccttctt

SEQ ID NO: 130461 - DNA, 75 bp, Artificial Sequence
  Synthetic
ataatggtttcttagacgtcaggtggcacttttcggggaaatgtgcgcggaacccctatttgtttatttttctaa

SEQ ID NO: 130462 - DNA, 75 bp, Artificial Sequence
  Synthetic
ggtcattgctgagagtgctggagtccaggaggacgcctctaacctgcgagctttcacggaagccatgaccaggta

SEQ ID NO: 130463 - DNA, 75 bp, Artificial Sequence
  Synthetic
tgccccaacaggcttatgcctatgacgcatctgtgcacgggcagataggcgctgttttgttgatactagtaaccc

SEQ ID NO: 130464 - DNA, 75 bp, Artificial Sequence
  Synthetic
tgccccaacaggcttatgcctatgacgcatctgtgcacgggcagataggcgctgttttgttgatactagttaccc

SEQ ID NO: 130465 - DNA, 75 bp, Artificial Sequence
  Synthetic
tgccccaacaggcttatgcctatgacgcatctgtgcacgggcagataggcgctgttttgttgatactagtcaccc

SEQ ID NO: 130466 - DNA, 75 bp, Artificial Sequence
  Synthetic
tgccccaacaggcttatgcctatgacgcatctgtgcacgggcagataggcgctgttttgttgatactagtgaccc

SEQ ID NO: 130467 - DNA, 75 bp, Artificial Sequence
  Synthetic
ttacatactcaacatatggaaagtttctagcagatggggggtgttcgggtggtgcttatgatgttatcatttgtg

SEQ ID NO: 130468 - DNA, 75 bp, Artificial Sequence
  Synthetic
ttacatactcaacatatggaaagtttctagctgatggggggtgttcgggtggtgcttatgatgttatcatttgtg

SEQ ID NO: 130469 - DNA, 75 bp, Artificial Sequence
  Synthetic
ttacatactcaacatatggaaagtttctagccgatggggggtgttcgggtggtgcttatgatgttatcatttgtg

SEQ ID NO: 130470 - DNA, 75 bp, Artificial Sequence
  Synthetic
ttacatactcaacatatggaaagtttctagcggatggggggtgttcgggtggtgcttatgatgttatcatttgtg

SEQ ID NO: 130471 - DNA, 75 bp, Artificial Sequence
  Synthetic
ttacatactcaacttatggaaagtttctagcagatggggggtgttcgggtggtgcttatgatgttatcatttgtg

SEQ ID NO: 130472 - DNA, 75 bp, Artificial Sequence
  Synthetic
ttacatactcaacttatggaaagtttctagctgatggggggtgttcgggtggtgcttatgatgttatcatttgtg

SEQ ID NO: 130473 - DNA, 75 bp, Artificial Sequence
  Synthetic
ttacatactcaacttatggaaagtttctagccgatggggggtgttcgggtggtgcttatgatgttatcatttgtg

SEQ ID NO: 130474 - DNA, 75 bp, Artificial Sequence
  Synthetic
ttacatactcaacttatggaaagtttctagcggatggggggtgttcgggtggtgcttatgatgttatcatttgtg

SEQ ID NO: 130475 - DNA, 75 bp, Artificial Sequence
  Synthetic
ttacatactcaacctatggaaagtttctagcagatggggggtgttcgggtggtgcttatgatgttatcatttgtg

SEQ ID NO: 130476 - DNA, 75 bp, Artificial Sequence
  Synthetic
ttacatactcaacctatggaaagtttctagctgatggggggtgttcgggtggtgcttatgatgttatcatttgtg

SEQ ID NO: 130477 - DNA, 75 bp, Artificial Sequence
  Synthetic
ttacatactcaacctatggaaagtttctagccgatggggggtgttcgggtggtgcttatgatgttatcatttgtg

SEQ ID NO: 130478 - DNA, 75 bp, Artificial Sequence
  Synthetic
ttacatactcaacctatggaaagtttctagcggatggggggtgttcgggtggtgcttatgatgttatcatttgtg

SEQ ID NO: 130479 - DNA, 75 bp, Artificial Sequence
  Synthetic
ttacatactcaacgtatggaaagtttctagcagatggggggtgttcgggtggtgcttatgatgttatcatttgtg

SEQ ID NO: 130480 - DNA, 75 bp, Artificial Sequence
  Synthetic
ttacatactcaacgtatggaaagtttctagctgatggggggtgttcgggtggtgcttatgatgttatcatttgtg

SEQ ID NO: 130481 - DNA, 75 bp, Artificial Sequence
  Synthetic
ttacatactcaacgtatggaaagtttctagccgatggggggtgttcgggtggtgcttatgatgttatcatttgtg

SEQ ID NO: 130482 - DNA, 75 bp, Artificial Sequence
  Synthetic
ttacatactcaacgtatggaaagtttctagcggatggggggtgttcgggtggtgcttatgatgttatcatttgtg

SEQ ID NO: 130483 - DNA, 75 bp, Artificial Sequence
  Synthetic
ttacttactcaacatatggaaagtttctagcagatggggggtgttcgggtggtgcttatgatgttatcatttgtg

SEQ ID NO: 130484 - DNA, 75 bp, Artificial Sequence
  Synthetic
ttacttactcaacatatggaaagtttctagctgatggggggtgttcgggtggtgcttatgatgttatcatttgtg

SEQ ID NO: 130485 - DNA, 75 bp, Artificial Sequence
  Synthetic
ttacttactcaacatatggaaagtttctagccgatggggggtgttcgggtggtgcttatgatgttatcatttgtg

SEQ ID NO: 130486 - DNA, 75 bp, Artificial Sequence
  Synthetic
ttacttactcaacatatggaaagtttctagcggatggggggtgttcgggtggtgcttatgatgttatcatttgtg

SEQ ID NO: 130487 - DNA, 75 bp, Artificial Sequence
  Synthetic
ttacttactcaacttatggaaagtttctagcagatggggggtgttcgggtggtgcttatgatgttatcatttgtg

SEQ ID NO: 130488 - DNA, 75 bp, Artificial Sequence
  Synthetic
ttacttactcaacttatggaaagtttctagctgatggggggtgttcgggtggtgcttatgatgttatcatttgtg

SEQ ID NO: 130489 - DNA, 75 bp, Artificial Sequence
  Synthetic
ttacttactcaacttatggaaagtttctagccgatggggggtgttcgggtggtgcttatgatgttatcatttgtg

SEQ ID NO: 130490 - DNA, 75 bp, Artificial Sequence
  Synthetic
ttacttactcaacttatggaaagtttctagcggatggggggtgttcgggtggtgcttatgatgttatcatttgtg

SEQ ID NO: 130491 - DNA, 75 bp, Artificial Sequence
  Synthetic
ttacttactcaacctatggaaagtttctagcagatggggggtgttcgggtggtgcttatgatgttatcatttgtg

SEQ ID NO: 130492 - DNA, 75 bp, Artificial Sequence
  Synthetic
ttacttactcaacctatggaaagtttctagctgatggggggtgttcgggtggtgcttatgatgttatcatttgtg

SEQ ID NO: 130493 - DNA, 75 bp, Artificial Sequence
  Synthetic
ttacttactcaacctatggaaagtttctagccgatggggggtgttcgggtggtgcttatgatgttatcatttgtg

SEQ ID NO: 130494 - DNA, 75 bp, Artificial Sequence
  Synthetic
ttacttactcaacctatggaaagtttctagcggatggggggtgttcgggtggtgcttatgatgttatcatttgtg

SEQ ID NO: 130495 - DNA, 75 bp, Artificial Sequence
  Synthetic
ttacttactcaacgtatggaaagtttctagcagatggggggtgttcgggtggtgcttatgatgttatcatttgtg

SEQ ID NO: 130496 - DNA, 75 bp, Artificial Sequence
  Synthetic
ttacttactcaacgtatggaaagtttctagctgatggggggtgttcgggtggtgcttatgatgttatcatttgtg

SEQ ID NO: 130497 - DNA, 75 bp, Artificial Sequence
  Synthetic
ttacttactcaacgtatggaaagtttctagccgatggggggtgttcgggtggtgcttatgatgttatcatttgtg

SEQ ID NO: 130498 - DNA, 75 bp, Artificial Sequence
  Synthetic
ttacttactcaacgtatggaaagtttctagcggatggggggtgttcgggtggtgcttatgatgttatcatttgtg

SEQ ID NO: 130499 - DNA, 75 bp, Artificial Sequence
  Synthetic
ttacctactcaacatatggaaagtttctagcagatggggggtgttcgggtggtgcttatgatgttatcatttgtg

SEQ ID NO: 130500 - DNA, 75 bp, Artificial Sequence
  Synthetic
ttacctactcaacatatggaaagtttctagctgatggggggtgttcgggtggtgcttatgatgttatcatttgtg

SEQ ID NO: 130501 - DNA, 75 bp, Artificial Sequence
  Synthetic
ttacctactcaacatatggaaagtttctagccgatggggggtgttcgggtggtgcttatgatgttatcatttgtg

SEQ ID NO: 130502 - DNA, 75 bp, Artificial Sequence
  Synthetic
ttacctactcaacatatggaaagtttctagcggatggggggtgttcgggtggtgcttatgatgttatcatttgtg

SEQ ID NO: 130503 - DNA, 75 bp, Artificial Sequence
  Synthetic
ttacctactcaacttatggaaagtttctagcagatggggggtgttcgggtggtgcttatgatgttatcatttgtg

SEQ ID NO: 130504 - DNA, 75 bp, Artificial Sequence
  Synthetic
ttacctactcaacttatggaaagtttctagctgatggggggtgttcgggtggtgcttatgatgttatcatttgtg

SEQ ID NO: 130505 - DNA, 75 bp, Artificial Sequence
  Synthetic
ttacctactcaacttatggaaagtttctagccgatggggggtgttcgggtggtgcttatgatgttatcatttgtg

SEQ ID NO: 130506 - DNA, 75 bp, Artificial Sequence
  Synthetic
ttacctactcaacttatggaaagtttctagcggatggggggtgttcgggtggtgcttatgatgttatcatttgtg

SEQ ID NO: 130507 - DNA, 75 bp, Artificial Sequence
  Synthetic
ttacctactcaacctatggaaagtttctagcagatggggggtgttcgggtggtgcttatgatgttatcatttgtg

SEQ ID NO: 130508 - DNA, 75 bp, Artificial Sequence
  Synthetic
ttacctactcaacctatggaaagtttctagctgatggggggtgttcgggtggtgcttatgatgttatcatttgtg

SEQ ID NO: 130509 - DNA, 75 bp, Artificial Sequence
  Synthetic
ttacctactcaacctatggaaagtttctagccgatggggggtgttcgggtggtgcttatgatgttatcatttgtg

SEQ ID NO: 130510 - DNA, 75 bp, Artificial Sequence
  Synthetic
ttacctactcaacctatggaaagtttctagcggatggggggtgttcgggtggtgcttatgatgttatcatttgtg

SEQ ID NO: 130511 - DNA, 75 bp, Artificial Sequence
  Synthetic
ttacctactcaacgtatggaaagtttctagcagatggggggtgttcgggtggtgcttatgatgttatcatttgtg

SEQ ID NO: 130512 - DNA, 75 bp, Artificial Sequence
  Synthetic
ttacctactcaacgtatggaaagtttctagctgatggggggtgttcgggtggtgcttatgatgttatcatttgtg

SEQ ID NO: 130513 - DNA, 75 bp, Artificial Sequence
  Synthetic
ttacctactcaacgtatggaaagtttctagccgatggggggtgttcgggtggtgcttatgatgttatcatttgtg

SEQ ID NO: 130514 - DNA, 75 bp, Artificial Sequence
  Synthetic
ttacctactcaacgtatggaaagtttctagcggatggggggtgttcgggtggtgcttatgatgttatcatttgtg

SEQ ID NO: 130515 - DNA, 75 bp, Artificial Sequence
  Synthetic
ttacgtactcaacatatggaaagtttctagcagatggggggtgttcgggtggtgcttatgatgttatcatttgtg

SEQ ID NO: 130516 - DNA, 75 bp, Artificial Sequence
  Synthetic
ttacgtactcaacatatggaaagtttctagctgatggggggtgttcgggtggtgcttatgatgttatcatttgtg

SEQ ID NO: 130517 - DNA, 75 bp, Artificial Sequence
  Synthetic
ttacgtactcaacatatggaaagtttctagccgatggggggtgttcgggtggtgcttatgatgttatcatttgtg

SEQ ID NO: 130518 - DNA, 75 bp, Artificial Sequence
  Synthetic
ttacgtactcaacatatggaaagtttctagcggatggggggtgttcgggtggtgcttatgatgttatcatttgtg

SEQ ID NO: 130519 - DNA, 75 bp, Artificial Sequence
  Synthetic
ttacgtactcaacttatggaaagtttctagcagatggggggtgttcgggtggtgcttatgatgttatcatttgtg

SEQ ID NO: 130520 - DNA, 75 bp, Artificial Sequence
  Synthetic
ttacgtactcaacttatggaaagtttctagctgatggggggtgttcgggtggtgcttatgatgttatcatttgtg

SEQ ID NO: 130521 - DNA, 75 bp, Artificial Sequence
  Synthetic
ttacgtactcaacttatggaaagtttctagccgatggggggtgttcgggtggtgcttatgatgttatcatttgtg

SEQ ID NO: 130522 - DNA, 75 bp, Artificial Sequence
  Synthetic
ttacgtactcaacttatggaaagtttctagcggatggggggtgttcgggtggtgcttatgatgttatcatttgtg

SEQ ID NO: 130523 - DNA, 75 bp, Artificial Sequence
  Synthetic
ttacgtactcaacctatggaaagtttctagcagatggggggtgttcgggtggtgcttatgatgttatcatttgtg

SEQ ID NO: 130524 - DNA, 75 bp, Artificial Sequence
  Synthetic
ttacgtactcaacctatggaaagtttctagctgatggggggtgttcgggtggtgcttatgatgttatcatttgtg

SEQ ID NO: 130525 - DNA, 75 bp, Artificial Sequence
  Synthetic
ttacgtactcaacctatggaaagtttctagccgatggggggtgttcgggtggtgcttatgatgttatcatttgtg

SEQ ID NO: 130526 - DNA, 75 bp, Artificial Sequence
  Synthetic
ttacgtactcaacctatggaaagtttctagcggatggggggtgttcgggtggtgcttatgatgttatcatttgtg

SEQ ID NO: 130527 - DNA, 75 bp, Artificial Sequence
  Synthetic
ttacgtactcaacgtatggaaagtttctagcagatggggggtgttcgggtggtgcttatgatgttatcatttgtg

SEQ ID NO: 130528 - DNA, 75 bp, Artificial Sequence
  Synthetic
ttacgtactcaacgtatggaaagtttctagctgatggggggtgttcgggtggtgcttatgatgttatcatttgtg

SEQ ID NO: 130529 - DNA, 75 bp, Artificial Sequence
  Synthetic
ttacgtactcaacgtatggaaagtttctagccgatggggggtgttcgggtggtgcttatgatgttatcatttgtg

SEQ ID NO: 130530 - DNA, 75 bp, Artificial Sequence
  Synthetic
ttacgtactcaacgtatggaaagtttctagcggatggggggtgttcgggtggtgcttatgatgttatcatttgtg

SEQ ID NO: 130531 - DNA, 75 bp, Artificial Sequence
  Synthetic
cctcggtgcatggtcaactacccttacaggctttggcattacccgtgcactctcaattttacagtgtttaaggtg

SEQ ID NO: 130532 - DNA, 75 bp, Artificial Sequence
  Synthetic
gtggatgaactccacggggttcctcaagacgtgcggggctcccccttgtaacatctatgggggtgagaagaggga

SEQ ID NO: 130533 - DNA, 75 bp, Artificial Sequence
  Synthetic
gtagatcaggacatggtaggatggccagcgccacaaggtgctaggtccctaacaccctgcacttgtggcgctagc

SEQ ID NO: 130534 - DNA, 75 bp, Artificial Sequence
  Synthetic
gtagatcaggacatggtaggatggcctgcgccacaaggtgctaggtccctaacaccctgcacttgtggcgctagc

SEQ ID NO: 130535 - DNA, 75 bp, Artificial Sequence
  Synthetic
gtagatcaggacatggtaggatggcccgcgccacaaggtgctaggtccctaacaccctgcacttgtggcgctagc

SEQ ID NO: 130536 - DNA, 75 bp, Artificial Sequence
  Synthetic
gtagatcaggacatggtaggatggccggcgccacaaggtgctaggtccctaacaccctgcacttgtggcgctagc

SEQ ID NO: 130537 - DNA, 75 bp, Artificial Sequence
  Synthetic
cccttattcccttttttgcggcattttgccttcctgtttttgctcacccagaaacgctggtgaaagtaaaagatg

SEQ ID NO: 130538 - DNA, 75 bp, Artificial Sequence
  Synthetic
aaccccgcctggtagcatcactgtcccacactctaacatcgaggaggtagcccttaccggtgaaggggaaatccc

SEQ ID NO: 130539 - DNA, 75 bp, Artificial Sequence
  Synthetic
actggcggcgtactgcctaacagttggcagcgtcgtcatctgcggcaggattgtaacaacggggaagcccgcaat

SEQ ID NO: 130540 - DNA, 75 bp, Artificial Sequence
  Synthetic
atcggtttgaagccgcttgcaattggaccaggggggaatgctgcaatatcgaagaccgcgaccgcagcgagcagc

SEQ ID NO: 130541 - DNA, 75 bp, Artificial Sequence
  Synthetic
aaggatcttcaggggggcccatcttgtgcccgtcgggccatgctgtcgggcttttccgcgcagcagtttgcacca

SEQ ID NO: 130542 - DNA, 75 bp, Artificial Sequence
  Synthetic
gagcacttttaaagttctgctatgtggcgcggtattatcccgtgttgacgccgggcaagagcaactcggtcgccg

SEQ ID NO: 130543 - DNA, 75 bp, Artificial Sequence
  Synthetic
acatctctgggcgtcaacgctgtagctttctacaggggtcttgatgtgtccgtgataccaactcagggagaagtc

SEQ ID NO: 130544 - DNA, 75 bp, Artificial Sequence
  Synthetic
acatctctgggcgtcaacgctgtagctttctacaggggtcttgatgtgtccgtgataccaactcagggagatgtc

SEQ ID NO: 130545 - DNA, 75 bp, Artificial Sequence
  Synthetic
acatctctgggcgtcaacgctgtagctttctacaggggtcttgatgtgtccgtgataccaactcagggagacgtc

SEQ ID NO: 130546 - DNA, 75 bp, Artificial Sequence
  Synthetic
acatctctgggcgtcaacgctgtagctttctacaggggtcttgatgtgtccgtgataccaactcagggagaggtc

SEQ ID NO: 130547 - DNA, 75 bp, Artificial Sequence
  Synthetic
gaatgcagctcgccgagcagttcaagcagaaggcgctcgggttgctgcaaacagccaccaagcaagcggaggctg

SEQ ID NO: 130548 - DNA, 75 bp, Artificial Sequence
  Synthetic
ttcaagcagaagatcctcggactattacaacatactgctaagcaagcagaagagctcaaaccagcagctcacgct

SEQ ID NO: 130549 - DNA, 75 bp, Artificial Sequence
  Synthetic
gcagacttaccaagtaggttaccttcatgcccccaccggtagcggcaagagcaccaaggtccccgcagcgtacgc

SEQ ID NO: 130550 - DNA, 75 bp, Artificial Sequence
  Synthetic
accatgagtgataacactgcggccaacttacttctgacaacgatcggaggaccgaaggagctaaccgcttttttg

SEQ ID NO: 130551 - DNA, 75 bp, Artificial Sequence
  Synthetic
ttgaccctacattttccattgagacccacacaaccccacaagatgcggtgtccagaagtcagagacggggccgca

SEQ ID NO: 130552 - DNA, 75 bp, Artificial Sequence
  Synthetic
cagtggcctccctcatggccttttctgctgccttgactagcccattgaccacctcgacaactctcctcctaaaca

SEQ ID NO: 130553 - DNA, 75 bp, Artificial Sequence
  Synthetic
tccagaagtcagagacggggccgcaccggtcgtggcaaaagtggcatttaccgctacgttgcgcccggtgaacgg

SEQ ID NO: 130554 - DNA, 75 bp, Artificial Sequence
  Synthetic
tgctgatgatatcacaagcagaagcagccttggagaaccttgtcacactgaacgccgttgctgctgctggtacac

SEQ ID NO: 130555 - DNA, 75 bp, Artificial Sequence
  Synthetic
agcattacttgtcctcttgctcccccaacgagcgtacgcttggtcgggtgaagacagtgctaccatcggtgccgg

SEQ ID NO: 130556 - DNA, 75 bp, Artificial Sequence
  Synthetic
tggcaacaacgttgcgcaaactattaactggcgaactacttactctagcttcccggcaacaattaatagactgga

SEQ ID NO: 130557 - DNA, 75 bp, Artificial Sequence
  Synthetic
aggaccggcgtcagaaccatcacgacgggagggccaattacatattctacttatggcaaatttcttgctgatggg

SEQ ID NO: 130558 - DNA, 75 bp, Artificial Sequence
  Synthetic
catatttatcaacacctggactacccgtctgccaagaccatctggagttctgggaaggtgtgtttactggattga

SEQ ID NO: 130559 - DNA, 75 bp, Artificial Sequence
  Synthetic
gggaaaggtcattgtagacatcttggccggatatggggcaggtgtgtctggcgctctcgtgtgctttaagatcat

SEQ ID NO: 130560 - DNA, 75 bp, Artificial Sequence
  Synthetic
agacagctggcgtgcggcttaccgtgcttgccaccgcaactcccccgggttcagtgactgttcctcatcctaata

SEQ ID NO: 130561 - DNA, 75 bp, Artificial Sequence
  Synthetic
tatcattgcagcactggggccagatggtaagccctcccgtatcgtagttatctacacgacggggagtcaggcaac

SEQ ID NO: 130562 - DNA, 75 bp, Artificial Sequence
  Synthetic
gtgccgagggggacttggtagggtggcccagccctcctgggaccaaatctttggagccgtgcacgtgtggagcgg

SEQ ID NO: 130563 - DNA, 75 bp, Artificial Sequence
  Synthetic
tcccccacctagctgggacgagatgtggaaatgtctcatccggctcaaaccaactctacatgggcccacacccct

SEQ ID NO: 130564 - DNA, 75 bp, Artificial Sequence
  Synthetic
cgccggcacgttgggccgtctgaaggagcggcacaatggatgaacaggctgatagcattcgcttcgaggggtaac

SEQ ID NO: 130565 - DNA, 75 bp, Artificial Sequence
  Synthetic
ttcaaagaagaaatgtgacgagctggccaagcagctacgaacgcttggacttaacgccgtcgcgttctatcgggg

SEQ ID NO: 130566 - DNA, 75 bp, Artificial Sequence
  Synthetic
ttaaaacttcatttttaatttaaaaggatctaggtgaagatcctttttgataatctcatgaccaaaatcccttaa

SEQ ID NO: 130567 - DNA, 75 bp, Artificial Sequence
  Synthetic
ttgcatgctcgtgcgcactgtgacggggggaaaatacttccaaatggtcatgctgaccattggtaggtggtgcaa

SEQ ID NO: 130568 - DNA, 75 bp, Artificial Sequence
  Synthetic
tctccccgagacccctttcgaccttgaaggggtcctcggggggaccggtgctttgccctaggggccacgctgtcg

SEQ ID NO: 130569 - DNA, 75 bp, Artificial Sequence
  Synthetic
agcgcctgggtgttgcttggtggggtgatggcggcgttagcagcctactgtttgtcagtgggtagcgtcgtcatc

SEQ ID NO: 130570 - DNA, 75 bp, Artificial Sequence
  Synthetic
acgagtggatcaacggggattggtcaacaccgtgtggctccacctggttgagagacatctgggactgggtctgta

SEQ ID NO: 130571 - DNA, 75 bp, Artificial Sequence
  Synthetic
aagacggcgtgaactatgcaacagggaaccttcccggttgctccttttctatcttccttctggccctgctctctt

SEQ ID NO: 130572 - DNA, 75 bp, Artificial Sequence
  Synthetic
tcgtcacgcggtctcccacctttagtgacaacagcacaccaccggctgtgccccagacctatcaggtcgggtact

SEQ ID NO: 130573 - DNA, 75 bp, Artificial Sequence
  Synthetic
aaaaaccaccgctaccagcggtggtttgtttgccggatcaagagctaccaactctttttccgaaggtaactggct

SEQ ID NO: 130574 - DNA, 75 bp, Artificial Sequence
  Synthetic
tgtaatgtggcggtgacccaggtggtggacttcagtttagaccccacattctcaattgagaccaccactgtccca

SEQ ID NO: 130575 - DNA, 75 bp, Artificial Sequence
  Synthetic
cttacatcgagcaagcccaagggatagcccaacaatttaaggagaaggtcgtcggccttctcgcacaagctgacc

SEQ ID NO: 130576 - DNA, 75 bp, Artificial Sequence
  Synthetic
gcgaggagatggcatcaataccaccacatgcccctgtggggcgtgtattgcaggccacgtgaaaaacgggaccat

SEQ ID NO: 130577 - DNA, 75 bp, Artificial Sequence
  Synthetic
ccccagacctatcaggtcgggtacttacatgccccaactggcagtggaaagagcaccaaagtccctgtcgcctac

SEQ ID NO: 130578 - DNA, 75 bp, Artificial Sequence
  Synthetic
ttcatccccgttgagacacttgacatcgtcacgcggtctcccacctttagtgacaacagcacaccaccggctgtg

SEQ ID NO: 130579 - DNA, 75 bp, Artificial Sequence
  Synthetic
aatttggctatggggcaaaggacgtccggaacctatccagcaaggccgttaaccacatccgctccgtgtgggagg

SEQ ID NO: 130580 - DNA, 75 bp, Artificial Sequence
  Synthetic
aatcctgttaccagtggctgctgccagtggcgataagtcgtgtcttaccgggttggactcaagacgatagttacc

SEQ ID NO: 130581 - DNA, 75 bp, Artificial Sequence
  Synthetic
tctggccgggttgtccactttacccggtaatcctgctatagcatctcttatggcattcactgcatctgtgaccag

SEQ ID NO: 130582 - DNA, 75 bp, Artificial Sequence
  Synthetic
tcgacacggttgtcctctgtgaggcgtacgacactggatgcgcgtggtatgagttgacaccctcagaaacaactg

SEQ ID NO: 130583 - DNA, 75 bp, Artificial Sequence
  Synthetic
tatcataaggcactgtggagggtgtccgctgaggaatacattgaggttgtgcgtgtgagggactgccaatatgtg

SEQ ID NO: 130584 - DNA, 75 bp, Artificial Sequence
  Synthetic
tatcataaggcactgtggagggtgtccgctgaggaatacattgaggttgtgcgtgtgagggactgccattatgtg

SEQ ID NO: 130585 - DNA, 75 bp, Artificial Sequence
  Synthetic
tatcataaggcactgtggagggtgtccgctgaggaatacattgaggttgtgcgtgtgagggactgccactatgtg

SEQ ID NO: 130586 - DNA, 75 bp, Artificial Sequence
  Synthetic
tatcataaggcactgtggagggtgtccgctgaggaatacattgaggttgtgcgtgtgagggactgccagtatgtg

SEQ ID NO: 130587 - DNA, 75 bp, Artificial Sequence
  Synthetic
acagcatacgcccagcaaactaggggcctttttgggactattgtgaccagcttaactggcagggataagaacgtg

SEQ ID NO: 130588 - DNA, 75 bp, Artificial Sequence
  Synthetic
cgattaggccatgaggtgttgttggggcctgctgacaactatcgggagatgggttggcgcctgttggctccgatc

SEQ ID NO: 130589 - DNA, 75 bp, Artificial Sequence
  Synthetic
ggcatggccggtgcagctgtgggaagcatcggcctgggcaaggtcttactggacatactggcaggttatggggct

SEQ ID NO: 130590 - DNA, 75 bp, Artificial Sequence
  Synthetic
ggcatggccggtgctgctgtgggaagcatcggcctgggcaaggtcttactggacatactggcaggttatggggct

SEQ ID NO: 130591 - DNA, 75 bp, Artificial Sequence
  Synthetic
ggcatggccggtgccgctgtgggaagcatcggcctgggcaaggtcttactggacatactggcaggttatggggct

SEQ ID NO: 130592 - DNA, 75 bp, Artificial Sequence
  Synthetic
ggcatggccggtgcggctgtgggaagcatcggcctgggcaaggtcttactggacatactggcaggttatggggct

SEQ ID NO: 130593 - DNA, 75 bp, Artificial Sequence
  Synthetic
tgagaaagcgccacgcttcccgaagggagaaaggcggacaggtatccggtaagcggcagggtcggaacaggagag

SEQ ID NO: 130594 - DNA, 75 bp, Artificial Sequence
  Synthetic
ccatttcctctcgcagaccaagcaggggggggagaatttcgcatatttggttgcctaccaagccacagtgtgcgc

SEQ ID NO: 130595 - DNA, 75 bp, Artificial Sequence
  Synthetic
catgccgtccgctcatcagggacgagatatcctttagcgtggggctccatagctacgttctgggatcccagcttc

SEQ ID NO: 130596 - DNA, 75 bp, Artificial Sequence
  Synthetic
ttgcctgccatcttatcccccggtgctctagtggttggcgtgatctgcgcagccatcctgcgccggcacgttgga

SEQ ID NO: 130597 - DNA, 75 bp, Artificial Sequence
  Synthetic
gggccggtgcaaaatgagatcaccaccacacacccaatcacaaaatacatcatgacttgcatgtctgctgacctg

SEQ ID NO: 130598 - DNA, 75 bp, Artificial Sequence
  Synthetic
gggggcggagcctatggaaaaacgccagcaacgcggcctttttacggttcctggccttttgctggccttttgctc

SEQ ID NO: 130599 - DNA, 75 bp, Artificial Sequence
  Synthetic
gcccccctcgcaggcgagttcatctgccagccagctgtctgctccctctttgagggctacgtgtaccactggcgg

SEQ ID NO: 130600 - DNA, 75 bp, Artificial Sequence
  Synthetic
tcgcggcggcccttcggggcatgggcttgaacgctgtggcatactacagagggttggacgtctccgtaataccaa

SEQ ID NO: 130601 - DNA, 75 bp, Artificial Sequence
  Synthetic
cagcgaaagtaacagcattgctaagctccctgacagtcacacagctcctccgccggctccaccagtggatcaatg

SEQ ID NO: 130602 - DNA, 75 bp, Artificial Sequence
  Synthetic
cagcgaaagtaacagcattgctaagctccctgactgtcacacagctcctccgccggctccaccagtggatcaatg

SEQ ID NO: 130603 - DNA, 75 bp, Artificial Sequence
  Synthetic
cagcgaaagtaacagcattgctaagctccctgaccgtcacacagctcctccgccggctccaccagtggatcaatg

SEQ ID NO: 130604 - DNA, 75 bp, Artificial Sequence
  Synthetic
cagcgaaagtaacagcattgctaagctccctgacggtcacacagctcctccgccggctccaccagtggatcaatg

SEQ ID NO: 130605 - DNA, 75 bp, Artificial Sequence
  Synthetic
cagcgaaagtaactgcattgctaagctccctgacagtcacacagctcctccgccggctccaccagtggatcaatg

SEQ ID NO: 130606 - DNA, 75 bp, Artificial Sequence
  Synthetic
cagcgaaagtaactgcattgctaagctccctgactgtcacacagctcctccgccggctccaccagtggatcaatg

SEQ ID NO: 130607 - DNA, 75 bp, Artificial Sequence
  Synthetic
cagcgaaagtaactgcattgctaagctccctgaccgtcacacagctcctccgccggctccaccagtggatcaatg

SEQ ID NO: 130608 - DNA, 75 bp, Artificial Sequence
  Synthetic
cagcgaaagtaactgcattgctaagctccctgacggtcacacagctcctccgccggctccaccagtggatcaatg

SEQ ID NO: 130609 - DNA, 75 bp, Artificial Sequence
  Synthetic
cagcgaaagtaaccgcattgctaagctccctgacagtcacacagctcctccgccggctccaccagtggatcaatg

SEQ ID NO: 130610 - DNA, 75 bp, Artificial Sequence
  Synthetic
cagcgaaagtaaccgcattgctaagctccctgactgtcacacagctcctccgccggctccaccagtggatcaatg

SEQ ID NO: 130611 - DNA, 75 bp, Artificial Sequence
  Synthetic
cagcgaaagtaaccgcattgctaagctccctgaccgtcacacagctcctccgccggctccaccagtggatcaatg

SEQ ID NO: 130612 - DNA, 75 bp, Artificial Sequence
  Synthetic
cagcgaaagtaaccgcattgctaagctccctgacggtcacacagctcctccgccggctccaccagtggatcaatg

SEQ ID NO: 130613 - DNA, 75 bp, Artificial Sequence
  Synthetic
cagcgaaagtaacggcattgctaagctccctgacagtcacacagctcctccgccggctccaccagtggatcaatg

SEQ ID NO: 130614 - DNA, 75 bp, Artificial Sequence
  Synthetic
cagcgaaagtaacggcattgctaagctccctgactgtcacacagctcctccgccggctccaccagtggatcaatg

SEQ ID NO: 130615 - DNA, 75 bp, Artificial Sequence
  Synthetic
cagcgaaagtaacggcattgctaagctccctgaccgtcacacagctcctccgccggctccaccagtggatcaatg

SEQ ID NO: 130616 - DNA, 75 bp, Artificial Sequence
  Synthetic
cagcgaaagtaacggcattgctaagctccctgacggtcacacagctcctccgccggctccaccagtggatcaatg

SEQ ID NO: 130617 - DNA, 75 bp, Artificial Sequence
  Synthetic
cagcgaaagttacagcattgctaagctccctgacagtcacacagctcctccgccggctccaccagtggatcaatg

SEQ ID NO: 130618 - DNA, 75 bp, Artificial Sequence
  Synthetic
cagcgaaagttacagcattgctaagctccctgactgtcacacagctcctccgccggctccaccagtggatcaatg

SEQ ID NO: 130619 - DNA, 75 bp, Artificial Sequence
  Synthetic
cagcgaaagttacagcattgctaagctccctgaccgtcacacagctcctccgccggctccaccagtggatcaatg

SEQ ID NO: 130620 - DNA, 75 bp, Artificial Sequence
  Synthetic
cagcgaaagttacagcattgctaagctccctgacggtcacacagctcctccgccggctccaccagtggatcaatg

SEQ ID NO: 130621 - DNA, 75 bp, Artificial Sequence
  Synthetic
cagcgaaagttactgcattgctaagctccctgacagtcacacagctcctccgccggctccaccagtggatcaatg

SEQ ID NO: 130622 - DNA, 75 bp, Artificial Sequence
  Synthetic
cagcgaaagttactgcattgctaagctccctgactgtcacacagctcctccgccggctccaccagtggatcaatg

SEQ ID NO: 130623 - DNA, 75 bp, Artificial Sequence
  Synthetic
cagcgaaagttactgcattgctaagctccctgaccgtcacacagctcctccgccggctccaccagtggatcaatg

SEQ ID NO: 130624 - DNA, 75 bp, Artificial Sequence
  Synthetic
cagcgaaagttactgcattgctaagctccctgacggtcacacagctcctccgccggctccaccagtggatcaatg

SEQ ID NO: 130625 - DNA, 75 bp, Artificial Sequence
  Synthetic
cagcgaaagttaccgcattgctaagctccctgacagtcacacagctcctccgccggctccaccagtggatcaatg

SEQ ID NO: 130626 - DNA, 75 bp, Artificial Sequence
  Synthetic
cagcgaaagttaccgcattgctaagctccctgactgtcacacagctcctccgccggctccaccagtggatcaatg

SEQ ID NO: 130627 - DNA, 75 bp, Artificial Sequence
  Synthetic
cagcgaaagttaccgcattgctaagctccctgaccgtcacacagctcctccgccggctccaccagtggatcaatg

SEQ ID NO: 130628 - DNA, 75 bp, Artificial Sequence
  Synthetic
cagcgaaagttaccgcattgctaagctccctgacggtcacacagctcctccgccggctccaccagtggatcaatg

SEQ ID NO: 130629 - DNA, 75 bp, Artificial Sequence
  Synthetic
cagcgaaagttacggcattgctaagctccctgacagtcacacagctcctccgccggctccaccagtggatcaatg

SEQ ID NO: 130630 - DNA, 75 bp, Artificial Sequence
  Synthetic
cagcgaaagttacggcattgctaagctccctgactgtcacacagctcctccgccggctccaccagtggatcaatg

SEQ ID NO: 130631 - DNA, 75 bp, Artificial Sequence
  Synthetic
cagcgaaagttacggcattgctaagctccctgaccgtcacacagctcctccgccggctccaccagtggatcaatg

SEQ ID NO: 130632 - DNA, 75 bp, Artificial Sequence
  Synthetic
cagcgaaagttacggcattgctaagctccctgacggtcacacagctcctccgccggctccaccagtggatcaatg

SEQ ID NO: 130633 - DNA, 75 bp, Artificial Sequence
  Synthetic
cagcgaaagtcacagcattgctaagctccctgacagtcacacagctcctccgccggctccaccagtggatcaatg

SEQ ID NO: 130634 - DNA, 75 bp, Artificial Sequence
  Synthetic
cagcgaaagtcacagcattgctaagctccctgactgtcacacagctcctccgccggctccaccagtggatcaatg

SEQ ID NO: 130635 - DNA, 75 bp, Artificial Sequence
  Synthetic
cagcgaaagtcacagcattgctaagctccctgaccgtcacacagctcctccgccggctccaccagtggatcaatg

SEQ ID NO: 130636 - DNA, 75 bp, Artificial Sequence
  Synthetic
cagcgaaagtcacagcattgctaagctccctgacggtcacacagctcctccgccggctccaccagtggatcaatg

SEQ ID NO: 130637 - DNA, 75 bp, Artificial Sequence
  Synthetic
cagcgaaagtcactgcattgctaagctccctgacagtcacacagctcctccgccggctccaccagtggatcaatg

SEQ ID NO: 130638 - DNA, 75 bp, Artificial Sequence
  Synthetic
cagcgaaagtcactgcattgctaagctccctgactgtcacacagctcctccgccggctccaccagtggatcaatg

SEQ ID NO: 130639 - DNA, 75 bp, Artificial Sequence
  Synthetic
cagcgaaagtcactgcattgctaagctccctgaccgtcacacagctcctccgccggctccaccagtggatcaatg

SEQ ID NO: 130640 - DNA, 75 bp, Artificial Sequence
  Synthetic
cagcgaaagtcactgcattgctaagctccctgacggtcacacagctcctccgccggctccaccagtggatcaatg

SEQ ID NO: 130641 - DNA, 75 bp, Artificial Sequence
  Synthetic
cagcgaaagtcaccgcattgctaagctccctgacagtcacacagctcctccgccggctccaccagtggatcaatg

SEQ ID NO: 130642 - DNA, 75 bp, Artificial Sequence
  Synthetic
cagcgaaagtcaccgcattgctaagctccctgactgtcacacagctcctccgccggctccaccagtggatcaatg

SEQ ID NO: 130643 - DNA, 75 bp, Artificial Sequence
  Synthetic
cagcgaaagtcaccgcattgctaagctccctgaccgtcacacagctcctccgccggctccaccagtggatcaatg

SEQ ID NO: 130644 - DNA, 75 bp, Artificial Sequence
  Synthetic
cagcgaaagtcaccgcattgctaagctccctgacggtcacacagctcctccgccggctccaccagtggatcaatg

SEQ ID NO: 130645 - DNA, 75 bp, Artificial Sequence
  Synthetic
cagcgaaagtcacggcattgctaagctccctgacagtcacacagctcctccgccggctccaccagtggatcaatg

SEQ ID NO: 130646 - DNA, 75 bp, Artificial Sequence
  Synthetic
cagcgaaagtcacggcattgctaagctccctgactgtcacacagctcctccgccggctccaccagtggatcaatg

SEQ ID NO: 130647 - DNA, 75 bp, Artificial Sequence
  Synthetic
cagcgaaagtcacggcattgctaagctccctgaccgtcacacagctcctccgccggctccaccagtggatcaatg

SEQ ID NO: 130648 - DNA, 75 bp, Artificial Sequence
  Synthetic
cagcgaaagtcacggcattgctaagctccctgacggtcacacagctcctccgccggctccaccagtggatcaatg

SEQ ID NO: 130649 - DNA, 75 bp, Artificial Sequence
  Synthetic
cagcgaaagtgacagcattgctaagctccctgacagtcacacagctcctccgccggctccaccagtggatcaatg

SEQ ID NO: 130650 - DNA, 75 bp, Artificial Sequence
  Synthetic
cagcgaaagtgacagcattgctaagctccctgactgtcacacagctcctccgccggctccaccagtggatcaatg

SEQ ID NO: 130651 - DNA, 75 bp, Artificial Sequence
  Synthetic
cagcgaaagtgacagcattgctaagctccctgaccgtcacacagctcctccgccggctccaccagtggatcaatg

SEQ ID NO: 130652 - DNA, 75 bp, Artificial Sequence
  Synthetic
cagcgaaagtgacagcattgctaagctccctgacggtcacacagctcctccgccggctccaccagtggatcaatg

SEQ ID NO: 130653 - DNA, 75 bp, Artificial Sequence
  Synthetic
cagcgaaagtgactgcattgctaagctccctgacagtcacacagctcctccgccggctccaccagtggatcaatg

SEQ ID NO: 130654 - DNA, 75 bp, Artificial Sequence
  Synthetic
cagcgaaagtgactgcattgctaagctccctgactgtcacacagctcctccgccggctccaccagtggatcaatg

SEQ ID NO: 130655 - DNA, 75 bp, Artificial Sequence
  Synthetic
cagcgaaagtgactgcattgctaagctccctgaccgtcacacagctcctccgccggctccaccagtggatcaatg

SEQ ID NO: 130656 - DNA, 75 bp, Artificial Sequence
  Synthetic
cagcgaaagtgactgcattgctaagctccctgacggtcacacagctcctccgccggctccaccagtggatcaatg

SEQ ID NO: 130657 - DNA, 75 bp, Artificial Sequence
  Synthetic
cagcgaaagtgaccgcattgctaagctccctgacagtcacacagctcctccgccggctccaccagtggatcaatg

SEQ ID NO: 130658 - DNA, 75 bp, Artificial Sequence
  Synthetic
cagcgaaagtgaccgcattgctaagctccctgactgtcacacagctcctccgccggctccaccagtggatcaatg

SEQ ID NO: 130659 - DNA, 75 bp, Artificial Sequence
  Synthetic
cagcgaaagtgaccgcattgctaagctccctgaccgtcacacagctcctccgccggctccaccagtggatcaatg

SEQ ID NO: 130660 - DNA, 75 bp, Artificial Sequence
  Synthetic
cagcgaaagtgaccgcattgctaagctccctgacggtcacacagctcctccgccggctccaccagtggatcaatg

SEQ ID NO: 130661 - DNA, 75 bp, Artificial Sequence
  Synthetic
cagcgaaagtgacggcattgctaagctccctgacagtcacacagctcctccgccggctccaccagtggatcaatg

SEQ ID NO: 130662 - DNA, 75 bp, Artificial Sequence
  Synthetic
cagcgaaagtgacggcattgctaagctccctgactgtcacacagctcctccgccggctccaccagtggatcaatg

SEQ ID NO: 130663 - DNA, 75 bp, Artificial Sequence
  Synthetic
cagcgaaagtgacggcattgctaagctccctgaccgtcacacagctcctccgccggctccaccagtggatcaatg

SEQ ID NO: 130664 - DNA, 75 bp, Artificial Sequence
  Synthetic
cagcgaaagtgacggcattgctaagctccctgacggtcacacagctcctccgccggctccaccagtggatcaatg

SEQ ID NO: 130665 - DNA, 75 bp, Artificial Sequence
  Synthetic
ttacttccgggaagccggctgtattgccggaccgagaagtactgtaccaacaattcgatgagatggaggagtgct

SEQ ID NO: 130666 - DNA, 75 bp, Artificial Sequence
  Synthetic
cgagtcagtgagcgaggaagcggaagagcgcctgatgcggtattttctccttacgcatctgtgcggtatttcaca

SEQ ID NO: 130667 - DNA, 75 bp, Artificial Sequence
  Synthetic
ggcgggaacatcacccgtgtggagtcggagaagaaggtagtaatcctggattccttcgaaccgcttcgagcagag

SEQ ID NO: 130668 - DNA, 75 bp, Artificial Sequence
  Synthetic
ctagactccttcgaccccctagttgcagaaactgatgacagggaggtctctgtacccgcggagtgccacaggccc

SEQ ID NO: 130669 - DNA, 75 bp, Artificial Sequence
  Synthetic
gctaggtctccatcattttctgacaattcaacccctcctgctgtcccacagagctatcaagtggggtatcttcat

SEQ ID NO: 130670 - DNA, 75 bp, Artificial Sequence
  Synthetic
cggcagttggcacatcaatcgcacggccttgaactgtaatgcgagcctcgacaccggctgggtagcggggctctt

SEQ ID NO: 130671 - DNA, 75 bp, Artificial Sequence
  Synthetic
catgcccaagatgccaggtatccccttcctttcttgtcaaaagggatacaagggtgcttggcgaggcgatggagt

SEQ ID NO: 130672 - DNA, 75 bp, Artificial Sequence
  Synthetic
tcttaagcctgctgttcggtcggcatggccaaagctcgagcagttctggcagaaacacctctggaactttgtcag

SEQ ID NO: 130673 - DNA, 75 bp, Artificial Sequence
  Synthetic
gacacccgccaacacccgctgacgcgccctgacgggcttgtctgctcccggcatccgcttacagacaagctgtga

SEQ ID NO: 130674 - DNA, 75 bp, Artificial Sequence
  Synthetic
cagtcgcaggctgcgcgcttcctccggcaggaatgccgccggtgcctccgcctagacggaagagagtcgtccagc

SEQ ID NO: 130675 - DNA, 75 bp, Artificial Sequence
  Synthetic
cagtcgcaggctgcgcgcttcctccggcaggattgccgccggtgcctccgcctagacggaagagagtcgtccagc

SEQ ID NO: 130676 - DNA, 75 bp, Artificial Sequence
  Synthetic
cagtcgcaggctgcgcgcttcctccggcaggactgccgccggtgcctccgcctagacggaagagagtcgtccagc

SEQ ID NO: 130677 - DNA, 75 bp, Artificial Sequence
  Synthetic
cagtcgcaggctgcgcgcttcctccggcaggagtgccgccggtgcctccgcctagacggaagagagtcgtccagc

SEQ ID NO: 130678 - DNA, 75 bp, Artificial Sequence
  Synthetic
ctgtcgcaggctgcgcgcttcctccggcaggaatgccgccggtgcctccgcctagacggaagagagtcgtccagc

SEQ ID NO: 130679 - DNA, 75 bp, Artificial Sequence
  Synthetic
ctgtcgcaggctgcgcgcttcctccggcaggattgccgccggtgcctccgcctagacggaagagagtcgtccagc

SEQ ID NO: 130680 - DNA, 75 bp, Artificial Sequence
  Synthetic
ctgtcgcaggctgcgcgcttcctccggcaggactgccgccggtgcctccgcctagacggaagagagtcgtccagc

SEQ ID NO: 130681 - DNA, 75 bp, Artificial Sequence
  Synthetic
ctgtcgcaggctgcgcgcttcctccggcaggagtgccgccggtgcctccgcctagacggaagagagtcgtccagc

SEQ ID NO: 130682 - DNA, 75 bp, Artificial Sequence
  Synthetic
ccgtcgcaggctgcgcgcttcctccggcaggaatgccgccggtgcctccgcctagacggaagagagtcgtccagc

SEQ ID NO: 130683 - DNA, 75 bp, Artificial Sequence
  Synthetic
ccgtcgcaggctgcgcgcttcctccggcaggattgccgccggtgcctccgcctagacggaagagagtcgtccagc

SEQ ID NO: 130684 - DNA, 75 bp, Artificial Sequence
  Synthetic
ccgtcgcaggctgcgcgcttcctccggcaggactgccgccggtgcctccgcctagacggaagagagtcgtccagc

SEQ ID NO: 130685 - DNA, 75 bp, Artificial Sequence
  Synthetic
ccgtcgcaggctgcgcgcttcctccggcaggagtgccgccggtgcctccgcctagacggaagagagtcgtccagc

SEQ ID NO: 130686 - DNA, 75 bp, Artificial Sequence
  Synthetic
cggtcgcaggctgcgcgcttcctccggcaggaatgccgccggtgcctccgcctagacggaagagagtcgtccagc

SEQ ID NO: 130687 - DNA, 75 bp, Artificial Sequence
  Synthetic
cggtcgcaggctgcgcgcttcctccggcaggattgccgccggtgcctccgcctagacggaagagagtcgtccagc

SEQ ID NO: 130688 - DNA, 75 bp, Artificial Sequence
  Synthetic
cggtcgcaggctgcgcgcttcctccggcaggactgccgccggtgcctccgcctagacggaagagagtcgtccagc

SEQ ID NO: 130689 - DNA, 75 bp, Artificial Sequence
  Synthetic
cggtcgcaggctgcgcgcttcctccggcaggagtgccgccggtgcctccgcctagacggaagagagtcgtccagc

SEQ ID NO: 130690 - DNA, 75 bp, Artificial Sequence
  Synthetic
ctccacggaggaagaggacggttgtcctgacagaatccaccgtgtcttctgccttggcggagcttgccacaaaga

SEQ ID NO: 130691 - DNA, 75 bp, Artificial Sequence
  Synthetic
ggtaccttccctatcaatgagtacaccactggtcctagtacaccagccccctcttatgcttactcgcgcgccttg

SEQ ID NO: 130692 - DNA, 75 bp, Artificial Sequence
  Synthetic
tcaaccaccctccttcttaacatcttaggggggtgggtagcctctcagctagcaccacccactgcgtcaacggca

SEQ ID NO: 130693 - DNA, 75 bp, Artificial Sequence
  Synthetic
acagatgtctgcctgttcatccgcgtccagctcgttgagtttctccagaagcgttaatgtctggcttctgataaa

SEQ ID NO: 130694 - DNA, 75 bp, Artificial Sequence
  Synthetic
taccgcaggttccggagctgcgttaaactccgatgaggatgatgctgagtccgatccgggttcttacagctcaat

SEQ ID NO: 130695 - DNA, 75 bp, Artificial Sequence
  Synthetic
ttccgcaggttccggagctgcgttaaactccgatgaggatgatgctgagtccgatccgggttcttacagctcaat

SEQ ID NO: 130696 - DNA, 75 bp, Artificial Sequence
  Synthetic
tcccgcaggttccggagctgcgttaaactccgatgaggatgatgctgagtccgatccgggttcttacagctcaat

SEQ ID NO: 130697 - DNA, 75 bp, Artificial Sequence
  Synthetic
tgccgcaggttccggagctgcgttaaactccgatgaggatgatgctgagtccgatccgggttcttacagctcaat

SEQ ID NO: 130698 - DNA, 75 bp, Artificial Sequence
  Synthetic
tcgaggtacgcaaagtgggggacttccactatgtcacagggacgactgatgacgggttgaaatgcccatgtcagg

SEQ ID NO: 130699 - DNA, 75 bp, Artificial Sequence
  Synthetic
gatataccaaagtgtgcggagcgcctccttgtgtcatcggaggggcgggcaacaacaccttgcattgccccactg

SEQ ID NO: 130700 - DNA, 75 bp, Artificial Sequence
  Synthetic
cccttgtggccttcaagatcatgagcggggaggcccctgccttagaagacatggttaatctcctgcccgccctct

SEQ ID NO: 130701 - DNA, 75 bp, Artificial Sequence
  Synthetic
aggatgctcacgatacgggttactgatgatgaacatgcccggttactggaacgttgtgagggtaaacaactggcg

SEQ ID NO: 130702 - DNA, 75 bp, Artificial Sequence
  Synthetic
cctcacacatcctgtgacgaaatacatcgccacatgcatgcaagctgaccttgaggtcatgaccagcacgtgggt

SEQ ID NO: 130703 - DNA, 75 bp, Artificial Sequence
  Synthetic
ggggctgaactcctacatagtaggatcacagctcccttgtgagcccgagccggatgtctcggtactgacctcaat

SEQ ID NO: 130704 - DNA, 75 bp, Artificial Sequence
  Synthetic
tactcatggacaggagctcttgtcactccttgcgctggagaagaagagaagttacctatctctccgctcagcaac

SEQ ID NO: 130705 - DNA, 75 bp, Artificial Sequence
  Synthetic
ggaggcacctcatcttttgccattccaaaaagaaatgtgacgagttagcatccaaactcaggggcatggggctca

SEQ ID NO: 130706 - DNA, 75 bp, Artificial Sequence
  Synthetic
agcatttgcctcacgtggcaatcatgtgtcacctacacattatgtgcctgagactgacgcttccaaagctgtcac

SEQ ID NO: 130707 - DNA, 75 bp, Artificial Sequence
  Synthetic
cgatgcagatccggaacataatggtgcagggcgctgacttccgcgtttccagactttacgaaacacggaaaccga

SEQ ID NO: 130708 - DNA, 75 bp, Artificial Sequence
  Synthetic
agcactaccaagatgtccttaaggagatcaaggctcgggcctccacagtagcagcaaagcccctcactactgagg

SEQ ID NO: 130709 - DNA, 75 bp, Artificial Sequence
  Synthetic
gctccgtcaaggaaagctacgtgtaccacacacggacagcatccagatgctgagcttcttgaagccaacctgttg

SEQ ID NO: 130710 - DNA, 75 bp, Artificial Sequence
  Synthetic
gatatatgggactgggtctgcaccgtgctgtccgacttcaaagtctggctgaaaaccaaactcatgccaccaatg

SEQ ID NO: 130711 - DNA, 75 bp, Artificial Sequence
  Synthetic
accccgccagcctagccgggtcctcaacgacaggagcacgatcatgcgcacccgtggccaggacccaacgctgcc

SEQ ID NO: 130712 - DNA, 75 bp, Artificial Sequence
  Synthetic
ctccgtgtgggaggacttgttggaagacaactctacacctattgcgactaccatcatggcaaaaaatgaggtctt

SEQ ID NO: 130713 - DNA, 75 bp, Artificial Sequence
  Synthetic
cccgtggccaggacccaacgctgcccgagatgcgccgcgtgcggctgctggagatggcggacgcgatggatatgt

SEQ ID NO: 130714 - DNA, 75 bp, Artificial Sequence
  Synthetic
acgagctctcagtggctgctgagtgtttcaagaagccaccaaagtatcccccggcccttcccatctgggccagac

SEQ ID NO: 130715 - DNA, 75 bp, Artificial Sequence
  Synthetic
ttcagccttgaccccactttcaccattgagacaaccacgcttccccaggacgctgtctcccgcactcaacgtcgg

SEQ ID NO: 130716 - DNA, 75 bp, Artificial Sequence
  Synthetic
ggcatgtgaagaatgggactatgaaactccatggccccaagacgtgcagtaacatctggcatggcacttttccaa

SEQ ID NO: 130717 - DNA, 75 bp, Artificial Sequence
  Synthetic
acgcgcaagttgccagaggcagtcatggggccatcttatggcttccaatactctcccaaagctcgggtagactac

SEQ ID NO: 130718 - DNA, 75 bp, Artificial Sequence
  Synthetic
ggactcaacttctcgtacctaactgcttaccaagccactgtgtgcgctcgcgcgcaggctcctcccccgagttgg

SEQ ID NO: 130719 - DNA, 75 bp, Artificial Sequence
  Synthetic
accgcctccgcgcaggaagaagaccatcgttctcagcgagtctacagtgtcagatgcactggcaagcttagctga

SEQ ID NO: 130720 - DNA, 75 bp, Artificial Sequence
  Synthetic
accgcctccgcgcaggaagaagaccatcgttctcagcgagtctacagtgtcagatgcactggctagcttagctga

SEQ ID NO: 130721 - DNA, 75 bp, Artificial Sequence
  Synthetic
accgcctccgcgcaggaagaagaccatcgttctcagcgagtctacagtgtcagatgcactggccagcttagctga

SEQ ID NO: 130722 - DNA, 75 bp, Artificial Sequence
  Synthetic
accgcctccgcgcaggaagaagaccatcgttctcagcgagtctacagtgtcagatgcactggcgagcttagctga

SEQ ID NO: 130723 - DNA, 75 bp, Artificial Sequence
  Synthetic
cgtgctttcagcttcgatgtaggagggcgtggatatgtcctgcgggtaaatagctgcgccgatggtttctacaaa

SEQ ID NO: 130724 - DNA, 75 bp, Artificial Sequence
  Synthetic
ggcttaagccaacgctgcatggacccacgcctcttctataccggttggggcccgtccaaaatgaaacctgcttga

SEQ ID NO: 130725 - DNA, 75 bp, Artificial Sequence
  Synthetic
agtgcatgactcccattacatagtgggggcaacagctgacaatctaaaatgcccctgtcaggtaccggccccaga

SEQ ID NO: 130726 - DNA, 75 bp, Artificial Sequence
  Synthetic
atgacatctaccaatgttgccagctagatcctacgacccgcaaggccatatcgtcactcaccgagcgactatatt

SEQ ID NO: 130727 - DNA, 75 bp, Artificial Sequence
  Synthetic
atgacatctaccaatgttgccagctagatcctacgacccgcaaggccatatcgtcactcaccgagcgtctatatt

SEQ ID NO: 130728 - DNA, 75 bp, Artificial Sequence
  Synthetic
atgacatctaccaatgttgccagctagatcctacgacccgcaaggccatatcgtcactcaccgagcgcctatatt

SEQ ID NO: 130729 - DNA, 75 bp, Artificial Sequence
  Synthetic
atgacatctaccaatgttgccagctagatcctacgacccgcaaggccatatcgtcactcaccgagcggctatatt

SEQ ID NO: 130730 - DNA, 75 bp, Artificial Sequence
  Synthetic
gaagactcagacaacgagtctcaatcatccatgccccctcttgaaggagagccgggcgatccagacttaagttcg

SEQ ID NO: 130731 - DNA, 75 bp, Artificial Sequence
  Synthetic
gaagactcagacaacgagtctcattcatccatgccccctcttgaaggagagccgggcgatccagacttaagttcg

SEQ ID NO: 130732 - DNA, 75 bp, Artificial Sequence
  Synthetic
gaagactcagacaacgagtctcactcatccatgccccctcttgaaggagagccgggcgatccagacttaagttcg

SEQ ID NO: 130733 - DNA, 75 bp, Artificial Sequence
  Synthetic
gaagactcagacaacgagtctcagtcatccatgccccctcttgaaggagagccgggcgatccagacttaagttcg

SEQ ID NO: 130734 - DNA, 75 bp, Artificial Sequence
  Synthetic
catccatgccccctcttgaaggagagccgggcgatccagacttaagttcgggttcttggtccacggtcagcgagg

SEQ ID NO: 130735 - DNA, 75 bp, Artificial Sequence
  Synthetic
catccatgccccctcttgaaggagagccgggcgatccagacttaagttcgggttcttggtccacggtctgcgagg

SEQ ID NO: 130736 - DNA, 75 bp, Artificial Sequence
  Synthetic
catccatgccccctcttgaaggagagccgggcgatccagacttaagttcgggttcttggtccacggtccgcgagg

SEQ ID NO: 130737 - DNA, 75 bp, Artificial Sequence
  Synthetic
catccatgccccctcttgaaggagagccgggcgatccagacttaagttcgggttcttggtccacggtcggcgagg

SEQ ID NO: 130738 - DNA, 75 bp, Artificial Sequence
  Synthetic
gccgtgcacagggtgtcacgttgcaagacctgcctgaaaccgaactgcccgctgttctgcagccggtcgcggagg

SEQ ID NO: 130739 - DNA, 75 bp, Artificial Sequence
  Synthetic
ttggaggggtcctcgcggccctagcggcctactgcttatcagttggctgcgttgtgattgtgggtcacattgagc

SEQ ID NO: 130740 - DNA, 75 bp, Artificial Sequence
  Synthetic
tatgtcatcgggtctcagctcccatgcgagccggaaccagatgtgatggtactcacgtctatgctgactgatcca

SEQ ID NO: 130741 - DNA, 75 bp, Artificial Sequence
  Synthetic
ctatataaaagctcaagcggcctgtagagccgctaagcttaaagactttgatatgctggtctgtggggacgactt

SEQ ID NO: 130742 - DNA, 75 bp, Artificial Sequence
  Synthetic
cagcaactcgttgctgaggcaccacaaccttgtctactccacgtcatcacgtagcgctgcccaacggcagaagaa

SEQ ID NO: 130743 - DNA, 75 bp, Artificial Sequence
  Synthetic
ccttctccggctctgcgcgctagtgcgcaagatggccggaggccattacgtgcagatggccatcatcaaggtggg

SEQ ID NO: 130744 - DNA, 75 bp, Artificial Sequence
  Synthetic
tcaggtgatagcccaccagtttaaggggaaagttcttgggctgctgcagcgggctacccagcaacaggctgtcat

SEQ ID NO: 130745 - DNA, 75 bp, Artificial Sequence
  Synthetic
aggcgacatgcaccacagctgctcaccatcccgacgcggagttgttggaggccaatctcctatggagacaggaag

SEQ ID NO: 130746 - DNA, 75 bp, Artificial Sequence
  Synthetic
ccacatccggagtacgatctcgagctaataacatcttgctcgtcgaatgtgtcagtcgcccacgaccacactgga

SEQ ID NO: 130747 - DNA, 75 bp, Artificial Sequence
  Synthetic
atgcgcgattgctgatccccatgtgtatcactggcaaactgtgatggacgacaccgtcagtgcgtccgtcgcgca

SEQ ID NO: 130748 - DNA, 75 bp, Artificial Sequence
  Synthetic
aaccttgtctactccacgtcatcacgtagcgctgcccaacggcagaagaaggtcaccttcgacaggctacaagtg

SEQ ID NO: 130749 - DNA, 75 bp, Artificial Sequence
  Synthetic
tgcctggcctcccctttatctcttgccaaaaggggtacaagggtgtgtgggccggcactggtatcatgaccacac

SEQ ID NO: 130750 - DNA, 75 bp, Artificial Sequence
  Synthetic
cccctcactccgccaaatcaaaatttggctatggagcgaaggaggtgcggtccttgtccagcaaggccattaacc

SEQ ID NO: 130751 - DNA, 75 bp, Artificial Sequence
  Synthetic
cgcataacagcggtcattgactggagcgaggcgatgttcggggattcccaatacgaggtcgccaacatcttcttc

SEQ ID NO: 130752 - DNA, 75 bp, Artificial Sequence
  Synthetic
agctgctgaatgccacaggccacctaggccaaagtatccacctgccctgcctatttgggcacggcccgactacaa

SEQ ID NO: 130753 - DNA, 75 bp, Artificial Sequence
  Synthetic
atatcaactccgtatgggaggacttgctggaagacaacaatacacctataccaaccactatcatggcaaagaacg

SEQ ID NO: 130754 - DNA, 75 bp, Artificial Sequence
  Synthetic
atatcaactccgtatgggaggacttgctggaagacaacattacacctataccaaccactatcatggcaaagaacg

SEQ ID NO: 130755 - DNA, 75 bp, Artificial Sequence
  Synthetic
atatcaactccgtatgggaggacttgctggaagacaacactacacctataccaaccactatcatggcaaagaacg

SEQ ID NO: 130756 - DNA, 75 bp, Artificial Sequence
  Synthetic
atatcaactccgtatgggaggacttgctggaagacaacagtacacctataccaaccactatcatggcaaagaacg

SEQ ID NO: 130757 - DNA, 75 bp, Artificial Sequence
  Synthetic
gcttcgggtgtctaccacatcaccaacgactgcccgaattccagcatagtgtacgaggctgatcaccacatcctg

SEQ ID NO: 130758 - DNA, 75 bp, Artificial Sequence
  Synthetic
ccaaccactatcatggcaaagaacgaggtctttgctgtagccccccataagggaggccgcaagccagcccgcctg

SEQ ID NO: 130759 - DNA, 75 bp, Artificial Sequence
  Synthetic
ccaaccactatcatggcaaagaacgaggtctttgctgtagccccccataagggtggccgcaagccagcccgcctg

SEQ ID NO: 130760 - DNA, 75 bp, Artificial Sequence
  Synthetic
ccaaccactatcatggcaaagaacgaggtctttgctgtagccccccataagggcggccgcaagccagcccgcctg

SEQ ID NO: 130761 - DNA, 75 bp, Artificial Sequence
  Synthetic
ccaaccactatcatggcaaagaacgaggtctttgctgtagccccccataaggggggccgcaagccagcccgcctg

SEQ ID NO: 130762 - DNA, 75 bp, Artificial Sequence
  Synthetic
gtcagtcgcccacgaccacactggacagagatattactacctcactagggaccctgagatacccttgtcccgggc

SEQ ID NO: 130763 - DNA, 75 bp, Artificial Sequence
  Synthetic
gcattggtcttgaccaactctatcagagcttggttgacggcaatttcgatgatgcagcttgggcgcagggtcgat

SEQ ID NO: 130764 - DNA, 75 bp, Artificial Sequence
  Synthetic
ttttttggaatactccagtcccaagagatactccacaaagcacttgacttcgatatgtacggagtcacttactct

SEQ ID NO: 130765 - DNA, 75 bp, Artificial Sequence
  Synthetic
aggaggaagagggtcgtacagctcgatgagtcatcggctgcagcggctctcgcagcgctggctgagaagactttt

SEQ ID NO: 130766 - DNA, 75 bp, Artificial Sequence
  Synthetic
ccagctattcacatttcagccgcgtcgccattggaccacgcaggattgcaactgttccatctatactggtcacat

SEQ ID NO: 130767 - DNA, 75 bp, Artificial Sequence
  Synthetic
tccaatattcgcccaagcagagggtcgactatcttctcaagatgtggaactcaaagaagacacctttgggtttct

SEQ ID NO: 130768 - DNA, 75 bp, Artificial Sequence
  Synthetic
tccattattcgcccaagcagagggtcgactatcttctcaagatgtggaactcaaagaagacacctttgggtttct

SEQ ID NO: 130769 - DNA, 75 bp, Artificial Sequence
  Synthetic
tccactattcgcccaagcagagggtcgactatcttctcaagatgtggaactcaaagaagacacctttgggtttct

SEQ ID NO: 130770 - DNA, 75 bp, Artificial Sequence
  Synthetic
tccagtattcgcccaagcagagggtcgactatcttctcaagatgtggaactcaaagaagacacctttgggtttct

SEQ ID NO: 130771 - DNA, 75 bp, Artificial Sequence
  Synthetic
catgcctcagaaagcttggggctccaccgttgagagcttggagacatcgggctagagcggtcagagccaagctca

SEQ ID NO: 130772 - DNA, 75 bp, Artificial Sequence
  Synthetic
ccgatggctgtgtagaagttctcgccgatagtggaaaccgacgccccagcactcgtccggatcgggagatggggg

SEQ ID NO: 130773 - DNA, 75 bp, Artificial Sequence
  Synthetic
ttgcccagggaggaagggcagccatttgtggcacatacctcttcaactgggcagtgagaactaagctcaaactca

SEQ ID NO: 130774 - DNA, 75 bp, Artificial Sequence
  Synthetic
aagcagactcttacagctccatgccccctcttgagggggagcctggagatcctgacctgagctctgggtcatggt

SEQ ID NO: 130775 - DNA, 75 bp, Artificial Sequence
  Synthetic
gtctcgttttatgttgggctcaattcgtttgtcgtagggtctcagctcccctgtgatcctgagcccgatacagat

SEQ ID NO: 130776 - DNA, 75 bp, Artificial Sequence
  Synthetic
cacatacgctcggtgtggctccggtccttggatcacgcccaggtgcctggtccactatccttacaggctttggca

SEQ ID NO: 130777 - DNA, 75 bp, Artificial Sequence
  Synthetic
ggtgatagcttcactcacggagcggctttactgtggtggtcctatgttcaacagcaaaggacaacactgcggtta

SEQ ID NO: 130778 - DNA, 75 bp, Artificial Sequence
  Synthetic
ttactctcaggggggcattggggtatcctggctggtgtggcgtatttcagcatgcaggcaaactgggccaaggta

SEQ ID NO: 130779 - DNA, 75 bp, Artificial Sequence
  Synthetic
catgcaggcaaactgggccaaggtaatcttggtcttattcctgtttgctggggttgacgcagaaacccaggtcac

SEQ ID NO: 130780 - DNA, 75 bp, Artificial Sequence
  Synthetic
gcccatcagtgcgctgagcaattcgctcttgcgccaccacaacttggtatactctaccacaacgcgcagcgcttc

SEQ ID NO: 130781 - DNA, 75 bp, Artificial Sequence
  Synthetic
cgagccagctatcagcaccatcgctgcgagccacctgcaccacccacggcaaggcttatgatgtggacatggtgg

SEQ ID NO: 130782 - DNA, 75 bp, Artificial Sequence
  Synthetic
aatccatcattccttgtctgcggagacgacttggtcgtgattgctgagagtgcagggatcgatgaggacaaaagt

SEQ ID NO: 130783 - DNA, 75 bp, Artificial Sequence
  Synthetic
atcaatagaacctctctcaattgcaatgacagcctgcacacgggattcatagctggcctcctctattacaacaaa

SEQ ID NO: 130784 - DNA, 75 bp, Artificial Sequence
  Synthetic
actaccaaaatgttctcaaggaggttaaggctcgggcatcgggggtgagcgccagactcctctccgtcgaggagg

SEQ ID NO: 130785 - DNA, 75 bp, Artificial Sequence
  Synthetic
tgtccgacttcaagacatggctctccgctaagatcatgccagcactccccggactgccctttatttcctgtcaaa

SEQ ID NO: 130786 - DNA, 75 bp, Artificial Sequence
  Synthetic
cgccagccttaccggcctgggcacggcctgattacaacccaccgcttgtggaatcgtggaagaggccagattacc

SEQ ID NO: 130787 - DNA, 75 bp, Artificial Sequence
  Synthetic
caaacgtctctgtagcccatgacggtgcggggaaaagatattactatcttacccgcgacccggagactcccctag

SEQ ID NO: 130788 - DNA, 75 bp, Artificial Sequence
  Synthetic
gcctgattacaacccaccgcttgtggaatcgtggaagaggccagattaccaaccgcccactgttgcgggctgtgc

SEQ ID NO: 130789 - DNA, 75 bp, Artificial Sequence
  Synthetic
atagcgaccagaggccttattgctggaactactcgccgcttccatgcggagtggtaccggcggcaaaagtctgtg

SEQ ID NO: 130790 - DNA, 75 bp, Artificial Sequence
  Synthetic
cccgcgcggcctgggagactgctcgccacactccagttaactcctggttgggaaatatcattatgtacgcaccca

SEQ ID NO: 130791 - DNA, 75 bp, Artificial Sequence
  Synthetic
aaaccagcccgactcatcgtctacccggacctgggggtaagggtgtgcgagaaaagggctctttacgatataacg

SEQ ID NO: 130792 - DNA, 75 bp, Artificial Sequence
  Synthetic
aggggatttccattacatcacgggggctacggaggacggactcaagtgtccgtgccaagtgccagctgctgagtt

SEQ ID NO: 130793 - DNA, 75 bp, Artificial Sequence
  Synthetic
cattctgaactcaaccagacccccgggaggagcgtggttcggatgcacatggatgaacggtacaggtttcaccaa

SEQ ID NO: 130794 - DNA, 75 bp, Artificial Sequence
  Synthetic
ttattctgtcactccactggacttaccagctatcattgaacgactccatggcctaagcgcgttctcgctccacag

SEQ ID NO: 130795 - DNA, 75 bp, Artificial Sequence
  Synthetic
ccagctatcattgaacgactccatggcctaagcgcgttctcgctccacagttactctccagttgagctcaatagg

SEQ ID NO: 130796 - DNA, 75 bp, Artificial Sequence
  Synthetic
acgatagggtctcaactcccctgcgagcctgaaccagatgtctctgtgctgacctcgatgttgagagacccctcc

SEQ ID NO: 130797 - DNA, 75 bp, Artificial Sequence
  Synthetic
ccccaatggggttctcctatgacaccaggtgttttgattccaccgtcacggagcgcgacatacagacagagcact

SEQ ID NO: 130798 - DNA, 75 bp, Artificial Sequence
  Synthetic
ggatccggcccttggctcacgccaaggtgcctggttgactatccataccgcttgtggcattacccctgcactgtc

SEQ ID NO: 130799 - DNA, 75 bp, Artificial Sequence
  Synthetic
ccaaaatttgcggcctttacctcttcaattgggcagtgcgcacaaaggcaaaactcactccattgcctcaagcgg

SEQ ID NO: 130800 - DNA, 75 bp, Artificial Sequence
  Synthetic
aactacaccatctttaaggtcaggatgtacgtcggtgggattgaacaccggctaaatgccgcatgcaattggacc

SEQ ID NO: 130801 - DNA, 75 bp, Artificial Sequence
  Synthetic
ccagtcctgcgggatccggagatgcagggctagtggtgtcctcactactagtctcggcaatactctgacctgttt

SEQ ID NO: 130802 - DNA, 75 bp, Artificial Sequence
  Synthetic
aacttgctatggcggcaagagatgggtagcaacatcacacgggtagagtctgaaactaaggttgtgattctcgat

SEQ ID NO: 130803 - DNA, 75 bp, Artificial Sequence
  Synthetic
gatcccgccatttactccttggcctactcctactcacaataggggtaggcatcttcctgttaccagctcgatagg

SEQ ID NO: 130804 - DNA, 75 bp, Artificial Sequence
  Synthetic
tagcgggcatagcgtatttctccatggcggggaactgggcgaaggtcctggtagtgctgttgctgtttgccggcg

SEQ ID NO: 130805 - DNA, 75 bp, Artificial Sequence
  Synthetic
tctgaggatattggagcactgcgagccttaacggaggctatgaccaggtattccgcacctccaggcgacgaaccg

SEQ ID NO: 130806 - DNA, 75 bp, Artificial Sequence
  Synthetic
tctgaggatattggagcactgcgagcctttacggaggctatgaccaggtattccgcacctccaggcgacgaaccg

SEQ ID NO: 130807 - DNA, 75 bp, Artificial Sequence
  Synthetic
tctgaggatattggagcactgcgagccttcacggaggctatgaccaggtattccgcacctccaggcgacgaaccg

SEQ ID NO: 130808 - DNA, 75 bp, Artificial Sequence
  Synthetic
tctgaggatattggagcactgcgagccttgacggaggctatgaccaggtattccgcacctccaggcgacgaaccg

SEQ ID NO: 130809 - DNA, 75 bp, Artificial Sequence
  Synthetic
ggtcttcggtggtgtcgtgggctctcaaatgggagtacgtcgtgcttgcattcctcctgctcgcagacgctagag

SEQ ID NO: 130810 - DNA, 75 bp, Artificial Sequence
  Synthetic
atgcggcgatatcatcgatggcttgcccgtctctgcccgtaggggccgggagatactgcttggaccggctgatag

SEQ ID NO: 130811 - DNA, 75 bp, Artificial Sequence
  Synthetic
caacaccaacggcagctggcacatcaaccgcacggccttgaattgcaatgcgagcctcgacactggctgggtagc

SEQ ID NO: 130812 - DNA, 75 bp, Artificial Sequence
  Synthetic
tccaccggtgcctcctcctcggaggaagagaacagtccagctggatagctccaatgtgtctgtggcgctagctgc

SEQ ID NO: 130813 - DNA, 75 bp, Artificial Sequence
  Synthetic
caaccacgccactagcccgagctgcctgggaaacggctaggcacactccagtcaattcatggttgggtaacatca

SEQ ID NO: 130814 - DNA, 75 bp, Artificial Sequence
  Synthetic
ctgcttcagccgctggcactcacggcttcttccttgccattcttttcatctgtatagtctggcacatcaaaggta

SEQ ID NO: 130815 - DNA, 75 bp, Artificial Sequence
  Synthetic
ttcagtatactccagtcccaggagacactccataaagcacttgacttcgatatgtacggggtcacttactctatc

SEQ ID NO: 130816 - DNA, 75 bp, Artificial Sequence
  Synthetic
tgcagcgtcgcttggtggcggcatcgcggccttcctctgcatactgacattgtccccacattacaagcagtggct

SEQ ID NO: 130817 - DNA, 75 bp, Artificial Sequence
  Synthetic
gcctcaggaaacttggggttccaccgttgagagcctggagacatcgggccagggcggtcagagctaagctcatcg

SEQ ID NO: 130818 - DNA, 75 bp, Artificial Sequence
  Synthetic
ccaatgatacggacgtcttcgtcctcaataacaccaggccaccgttgggcaattggttcggttgcacctggatga

SEQ ID NO: 130819 - DNA, 75 bp, Artificial Sequence
  Synthetic
attatcattctcacagccttggcccatccccacctggcttttgacatcacaaaatacctcctaaccatccttggt

SEQ ID NO: 130820 - DNA, 75 bp, Artificial Sequence
  Synthetic
cacaaggagggaaagctgcagagtgtggcaagtacctcttcaattgggcggtgaagactaagctcaaactcactc

SEQ ID NO: 130821 - DNA, 75 bp, Artificial Sequence
  Synthetic
cgcgcaggggcccccggttgggtgtgcgcgcgacgaggaagacttctgaacgatcccagcccagaggtaggcgcc

SEQ ID NO: 130822 - DNA, 75 bp, Artificial Sequence
  Synthetic
ctgcgggtacaggcgttgccgcgccagcggagtgctcaccactagcatggggaacaccatcacatgctatgtgaa

SEQ ID NO: 130823 - DNA, 75 bp, Artificial Sequence
  Synthetic
ggcaggagacaacttcccctacctggtagcataccaggctacggtgtgcgccagggctcaggctccacctccatc

SEQ ID NO: 130824 - DNA, 75 bp, Artificial Sequence
  Synthetic
gacgagcggaacctgagagccttcacggaggctatgaccaggtattctgcccctcctggtgaccctcccagaccg

SEQ ID NO: 130825 - DNA, 75 bp, Artificial Sequence
  Synthetic
tttcctcttgttcctactcctactttcggtaggggtagggatctttttgctccctgctcggtaggcagggggcct

SEQ ID NO: 130826 - DNA, 75 bp, Artificial Sequence
  Synthetic
gtaagtactgtcagatggtcctactcaaggccggtgctttaactggcacatacatatatgaccatctcgccccgc

SEQ ID NO: 130827 - DNA, 75 bp, Artificial Sequence
  Synthetic
caaggccggtgctttaactggcacatacatatatgaccatctcgccccgctgtcaggctgggccgctaccggcct

SEQ ID NO: 130828 - DNA, 75 bp, Artificial Sequence
  Synthetic
aagccattaaccagatccgctccgtctgggaggacttgctggaagacacaacaactccaattccaaccaccatca

SEQ ID NO: 130829 - DNA, 75 bp, Artificial Sequence
  Synthetic
gcacttctttcgtgcctcactacccctgcctcggcggcgcactatgccaacaagtccggcgtctaccatctgacc

SEQ ID NO: 130830 - DNA, 75 bp, Artificial Sequence
  Synthetic
aggggcctcccagtttctgctaggaggggcaatgaaatcttgctcggtccggctgactcagaggcaacgggaggt

SEQ ID NO: 130831 - DNA, 75 bp, Artificial Sequence
  Synthetic
gttcagcaccatcgtgacaagccttaccggcaaagacaccaatgagaattgtggcgaggtccaagtgctatccac

SEQ ID NO: 130832 - DNA, 75 bp, Artificial Sequence
  Synthetic
ttggacctcccagccataattgaaaggctacacgggcttgacgctttctctctgcacacatactctccccacgaa

SEQ ID NO: 130833 - DNA, 75 bp, Artificial Sequence
  Synthetic
tgtcagatgtacaccaacgtcgaccaagacctggtgggatggcctgcccccccgggggttaagtccttggccccc

SEQ ID NO: 130834 - DNA, 75 bp, Artificial Sequence
  Synthetic
gtatctcttcaactgggcggtgaagaccaagctcaaactcactccattgccggaggcacgcctcctggatttatc

SEQ ID NO: 130835 - DNA, 75 bp, Artificial Sequence
  Synthetic
ggccgatatccacccttaaggggtcctcaggcggtccgctgctgtgccccctgggtcacgccgtcggcatattcc

SEQ ID NO: 130836 - DNA, 75 bp, Artificial Sequence
  Synthetic
ggtctccggtgttcactgacaattccaccccccccgctgtgccccagacctatcaagtagcccacttgcatgcac

SEQ ID NO: 130837 - DNA, 75 bp, Artificial Sequence
  Synthetic
ttaccggcctgctctactatcacaagattaatgcctccggctgtccgcagcgcatgagttcgtgcaggcctatta

SEQ ID NO: 130838 - DNA, 75 bp, Artificial Sequence
  Synthetic
aagttccttgcggacggaggttgcgggggaggagcatatgacatcataatctgtgatgagtgccactctacagat

SEQ ID NO: 130839 - DNA, 75 bp, Artificial Sequence
  Synthetic
ctacaccccacgccaacatagaggaggtcgccctgccaacgacgggggaaatccctttctatggtagggcgatcc

SEQ ID NO: 130840 - DNA, 75 bp, Artificial Sequence
  Synthetic
acatctcatattctgtcattccaagaagaaatgtgacgagctggccaaacagctgtcatctcttggcctgaatgc

SEQ ID NO: 130841 - DNA, 75 bp, Artificial Sequence
  Synthetic
acgttgtggtctgtgccacggacgccctcatgacgggcttcactggtgactttgactccgtgatagactgtaata

SEQ ID NO: 130842 - DNA, 75 bp, Artificial Sequence
  Synthetic
aagggatgatgctcgccgagcagttcaagcagaaggccctcggcctcctgcagaccgcgtcccgccaggcagagg

SEQ ID NO: 130843 - DNA, 75 bp, Artificial Sequence
  Synthetic
ccgcactgggagagggaagctagggacataccggtttgtcaccccgggggagagaccgtctggtatctttgacac

SEQ ID NO: 130844 - DNA, 75 bp, Artificial Sequence
  Synthetic
acataccggtttgtcaccccgggggagagaccgtctggtatctttgacacgtcggtgttgtgtgagtgctacgac

SEQ ID NO: 130845 - DNA, 75 bp, Artificial Sequence
  Synthetic
ccgccccggaagaagcggacggtggtcctcaccgagtcaactgtatctactgccttggccgagcttgccaccaag

SEQ ID NO: 130846 - DNA, 75 bp, Artificial Sequence
  Synthetic
ctcccggtgtgccaagaccatcttgaattctgggagagcgtctttacgggtttgacccatatagacggccacttt

SEQ ID NO: 130847 - DNA, 75 bp, Artificial Sequence
  Synthetic
ccacagcgggcatacgcgtatgaccgggagcaagcagcttctattggatgcgcggtaatcatcgttgttacggtg

SEQ ID NO: 130848 - DNA, 75 bp, Artificial Sequence
  Synthetic
ttcaaaatgaagtgacactaactcatccagtcaccaagtacatcatggcctgcatgtctgccgacctagaggtgg

SEQ ID NO: 130849 - DNA, 75 bp, Artificial Sequence
  Synthetic
tgaccagcacgtgggtcttggtgggtggcatcctggcagccttagctgcatactgtttgtcagtgggcagcgtag

SEQ ID NO: 130850 - DNA, 75 bp, Artificial Sequence
  Synthetic
tggccaacctgccgtcgtcccagaccgagaggcattgtaccaacagtttgatgagatggaagaatgttccaaaca

SEQ ID NO: 130851 - DNA, 75 bp, Artificial Sequence
  Synthetic
acggcttgcgtgatcttgctgttgccgtggagcccatcatattctcacccatggagaagaagttgatcacctggg

SEQ ID NO: 130852 - DNA, 75 bp, Artificial Sequence
  Synthetic
tcggcttgcgtgatcttgctgttgccgtggagcccatcatattctcacccatggagaagaagttgatcacctggg

SEQ ID NO: 130853 - DNA, 75 bp, Artificial Sequence
  Synthetic
ccggcttgcgtgatcttgctgttgccgtggagcccatcatattctcacccatggagaagaagttgatcacctggg

SEQ ID NO: 130854 - DNA, 75 bp, Artificial Sequence
  Synthetic
gcggcttgcgtgatcttgctgttgccgtggagcccatcatattctcacccatggagaagaagttgatcacctggg

SEQ ID NO: 130855 - DNA, 75 bp, Artificial Sequence
  Synthetic
ccagtggtcaagaccaactttgagaagcttgagcagttctgggcgaaacacatgtggaactttgtcagtggtatt

SEQ ID NO: 130856 - DNA, 75 bp, Artificial Sequence
  Synthetic
ggcgtcgacgcggaaacccacgtcaccggggggagtgccgctcgctccacgctcgcactcactagcctcttcaca

SEQ ID NO: 130857 - DNA, 75 bp, Artificial Sequence
  Synthetic
acaagccctctgaccacccagcaaaccctcctatttaacatcttgggaggatgggttgcctcgcagattgcttcc

SEQ ID NO: 130858 - DNA, 75 bp, Artificial Sequence
  Synthetic
tgtcgttcagagtaggactacacgattacccggtggggtcgcaattaccttgcgagcctgaaccggacgtggccg

SEQ ID NO: 130859 - DNA, 75 bp, Artificial Sequence
  Synthetic
aggtggcccacctgcatgctcccaccggcagcggtaagagtaccaaggtcccggccgcatacgcggctcagggct

SEQ ID NO: 130860 - DNA, 75 bp, Artificial Sequence
  Synthetic
tgcgagcctgaaccggacgtggccgtgttaacgtccatgctcactgatccctcccatataacagcagaggcggct

SEQ ID NO: 130861 - DNA, 75 bp, Artificial Sequence
  Synthetic
ctgagaggttggccagctgccgactccttaccgattttgaccagggctggggccctatcagccatgccaacggaa

SEQ ID NO: 130862 - DNA, 75 bp, Artificial Sequence
  Synthetic
gtggatgaaccgactcatcgcgttcgcgtcacgaggcaatcatgtctcacccacgcactacgtccccgaaaccga

SEQ ID NO: 130863 - DNA, 75 bp, Artificial Sequence
  Synthetic
gtggcccggtatattgcttcactcccagccccgtggtggtgggaacgaccgacaggtcgggcgcgcctacctaca

SEQ ID NO: 130864 - DNA, 75 bp, Artificial Sequence
  Synthetic
gatcgatcttggctgtgggaggtctgggattgggtctgcaccgtcttaagtgacttcaagacgtggctcaaagcc

SEQ ID NO: 130865 - DNA, 75 bp, Artificial Sequence
  Synthetic
aagctgctgcccagcatgcccggcgtccccttcctctcctgtcagaaggggtataagggggaatggcgcggggac

SEQ ID NO: 130866 - DNA, 75 bp, Artificial Sequence
  Synthetic
tcaactcttcaggctgccccgagaggatggccagctgcagaccccttgccgatttcgaccagggctggggcccta

SEQ ID NO: 130867 - DNA, 75 bp, Artificial Sequence
  Synthetic
ctacggggcctgctactccatagaaccactagacctacctccaatcattcaaagactccacggccttagcgcgtt

SEQ ID NO: 130868 - DNA, 75 bp, Artificial Sequence
  Synthetic
tgcggagcgcctccttgtgtcatcggagggacgggcaacaacaccttgcactgccctactgactgtttccgcaag

SEQ ID NO: 130869 - DNA, 75 bp, Artificial Sequence
  Synthetic
tctgctgagggatgaggttaccttcacggtgggcctcaactcttttgtggtcgggtctcagctcccatgtgagcc

SEQ ID NO: 130870 - DNA, 75 bp, Artificial Sequence
  Synthetic
ctagccagctcatcggcgagccagctgtcggccccatcactgaaggccacctgccctgctggtcacgactccccc

SEQ ID NO: 130871 - DNA, 75 bp, Artificial Sequence
  Synthetic
gggccgaggcagatgacagagaggtctccgtcgctgcggagattctccgcccctcaaagcgattcccgcccgcct

SEQ ID NO: 130872 - DNA, 75 bp, Artificial Sequence
  Synthetic
cagtaagccgacccccgtgcccccccctaggaggaagcgggcagtcgtgctttctgaatctgtcatctccagcgc

SEQ ID NO: 130873 - DNA, 75 bp, Artificial Sequence
  Synthetic
cctaggaggaagcgggcagtcgtgctttctgaatctgtcatctccagcgctttggcagatctggcagcaaagagc

SEQ ID NO: 130874 - DNA, 75 bp, Artificial Sequence
  Synthetic
cgatccgcttgtggcggaggaggatgagcgggagatctccgtgcccgcagaaatcctgcggaagtctcggagatt

SEQ ID NO: 130875 - DNA, 75 bp, Artificial Sequence
  Synthetic
gtgctgctcaatgtcctactcatggacgggggctctcgtaacaccttgcgcagccgaggaaacgaagctgccgat

SEQ ID NO: 130876 - DNA, 75 bp, Artificial Sequence
  Synthetic
cacgagtacccggtggggtcgcagttaccttgcgagcccgaaccggatgtggccgtgttgacgtccatgctcacc

SEQ ID NO: 130877 - DNA, 75 bp, Artificial Sequence
  Synthetic
ctcgacacatcccctatctcgtcgagggacagcacctagccgaacagttcaagcaaaaagtcctcgggctactcc

SEQ ID NO: 130878 - DNA, 75 bp, Artificial Sequence
  Synthetic
ctcgacacatcccctatctcgtcgagggacagcacctagccgaacagttcaagcaaaaagtcctcgggcttctcc

SEQ ID NO: 130879 - DNA, 75 bp, Artificial Sequence
  Synthetic
ctcgacacatcccctatctcgtcgagggacagcacctagccgaacagttcaagcaaaaagtcctcgggctcctcc

SEQ ID NO: 130880 - DNA, 75 bp, Artificial Sequence
  Synthetic
ctcgacacatcccctatctcgtcgagggacagcacctagccgaacagttcaagcaaaaagtcctcgggctgctcc

SEQ ID NO: 130881 - DNA, 75 bp, Artificial Sequence
  Synthetic
ctcgcaagagctgcgtgggagacagcaagacacactccaatcaattcctggctaggcaacataatcatgtttgcc

SEQ ID NO: 130882 - DNA, 75 bp, Artificial Sequence
  Synthetic
ggcgctttatgacgtcgtccagaaacttcctaaggccgtgatgggagctgcttacggcttccaatactcgcctca

SEQ ID NO: 130883 - DNA, 75 bp, Artificial Sequence
  Synthetic
tccatgcgccacttcctggttaagggatatctgggactgggtttgcattgtcctgagcgacttcaaggagtggct

SEQ ID NO: 130884 - DNA, 75 bp, Artificial Sequence
  Synthetic
cgctgagagcgggggcgtagaggaggacaaacgagctctcggagccttcacggaggctatgacgagatactcggc

SEQ ID NO: 130885 - DNA, 75 bp, Artificial Sequence
  Synthetic
gcccttgccaagtgccggcccccgaatttttcactgaggtggacggcgtcagaccgcataggtacgcgccgtttt

SEQ ID NO: 130886 - DNA, 75 bp, Artificial Sequence
  Synthetic
ctggatctgccagccataattcaaagactccacggcttaagcgcatttacgctgcacggatactctccgcacgaa

SEQ ID NO: 130887 - DNA, 75 bp, Artificial Sequence
  Synthetic
ctacgagatctggccgtggctgtagagccagtcgtcttttcccagatggagaccaagctcattacgtggggggcg

SEQ ID NO: 130888 - DNA, 75 bp, Artificial Sequence
  Synthetic
gtaagccagctcgtctcatcgtgttccccgacctgggtgtacgcgtgtgcgagaagatggccctgtacgacgtgg

SEQ ID NO: 130889 - DNA, 75 bp, Artificial Sequence
  Synthetic
ctacttcgtgcgcgtccaaggccttctccggatctgcgcgctagcgcgcaagatggccggaggccattacgtgca

SEQ ID NO: 130890 - DNA, 75 bp, Artificial Sequence
  Synthetic
ccggcataagtcacgcaacttgggtaaggtcatcgataccctcacgtgtggctttgccgacctcatggggtacat

SEQ ID NO: 130891 - DNA, 75 bp, Artificial Sequence
  Synthetic
ggcgttgccagggctctcgcacatggtgtgagagttctggaggacgggataaactatgcaacagggaatctgccc

SEQ ID NO: 130892 - DNA, 75 bp, Artificial Sequence
  Synthetic
ccaatgattgctcgaatggcagtatcgtctggcagctcgagggagctgttcttcacgtccctgggtgcattccct

SEQ ID NO: 130893 - DNA, 75 bp, Artificial Sequence
  Synthetic
tgacatcatcgttgcgtccgccacgttttgctctgccttgtatgtgggcgatgcctgcggtgcgctgatgatagt

SEQ ID NO: 130894 - DNA, 75 bp, Artificial Sequence
  Synthetic
gaacaccaccagttcgttcaggactgcaattgctccatatacccaggtcacatctcggggcatcggatggcgtgg

SEQ ID NO: 130895 - DNA, 75 bp, Artificial Sequence
  Synthetic
tgaccatcccagcttccgcttatgaagtgcgcaacgtgtccggggtgtaccatgtcacgaacgactgctccaact

SEQ ID NO: 130896 - DNA, 75 bp, Artificial Sequence
  Synthetic
gcgtgatgttcggcctggcttacttctctatgcagggagcgtgggcgaaggtcatcgtcattctcctattgacag

SEQ ID NO: 130897 - DNA, 75 bp, Artificial Sequence
  Synthetic
gctcgttcacaccaacgggagctggcatatcaaccgcacggctctgaactgcaatgacagcctgaatactggctt

SEQ ID NO: 130898 - DNA, 75 bp, Artificial Sequence
  Synthetic
gctcgttctcaccaacgggagctggcatatcaaccgcacggctctgaactgcaatgacagcctgaatactggctt

SEQ ID NO: 130899 - DNA, 75 bp, Artificial Sequence
  Synthetic
gctcgttcccaccaacgggagctggcatatcaaccgcacggctctgaactgcaatgacagcctgaatactggctt

SEQ ID NO: 130900 - DNA, 75 bp, Artificial Sequence
  Synthetic
gctcgttcgcaccaacgggagctggcatatcaaccgcacggctctgaactgcaatgacagcctgaatactggctt

SEQ ID NO: 130901 - DNA, 75 bp, Artificial Sequence
  Synthetic
gacttggagtacgaggagaatgtcaccaaccccgagaatatgaggccctattgctggcactacccgcccaaaccg

SEQ ID NO: 130902 - DNA, 75 bp, Artificial Sequence
  Synthetic
cgcagttgctccggatcccacaagctgtcgtggatatggtggcgggggcccactggggagtcctggcgggccttg

SEQ ID NO: 130903 - DNA, 75 bp, Artificial Sequence
  Synthetic
ccccggcgtaggtcgcgcaatttgggtaaagtcatcgataccctcacgtgcggcttcgccgacctcatggggtac

SEQ ID NO: 130904 - DNA, 75 bp, Artificial Sequence
  Synthetic
actcctgggggggtggtgataaggatgtcttcctgctaaatagcacccggccaccgaaaggcgcctggtttgggt

SEQ ID NO: 130905 - DNA, 75 bp, Artificial Sequence
  Synthetic
ccgcaccacctccggttttgtgggcctcttctcacctggggcgtctcagaaaatccaacttataaataccaacgg

SEQ ID NO: 130906 - DNA, 75 bp, Artificial Sequence
  Synthetic
ccagcgaagacctgctttgccccactgactgcttcagaaaacatcctgacgcgacttacattaagtgtggggccg

SEQ ID NO: 130907 - DNA, 75 bp, Artificial Sequence
  Synthetic
agggggggtcgagcacaggctccaggctgcgtgcaacttcactcgtggagatcgctgcaacctggaggataggga

SEQ ID NO: 130908 - DNA, 75 bp, Artificial Sequence
  Synthetic
ccctcctgtgcctccgcctcggaagaagcggacggtggtcctcaccgaatcaaccgtatctactgccttggccga

SEQ ID NO: 130909 - DNA, 75 bp, Artificial Sequence
  Synthetic
ggtggcttcagtatttcctgaccagagcagaagcgcaactgcacgtgtgggttccccccctcaacgtccgagggg

SEQ ID NO: 130910 - DNA, 75 bp, Artificial Sequence
  Synthetic
gctgtaggggtaggcatcttcctgctccccgcccgataggcggggagaagaaataacactccactttcatttttt

SEQ ID NO: 130911 - DNA, 75 bp, Artificial Sequence
  Synthetic
ctccaccaaaacatcgtggacgtgcagtatttgtatggtctgtcaccagctctcacgaaatacgtcgtcaagtgg

SEQ ID NO: 130912 - DNA, 75 bp, Artificial Sequence
  Synthetic
agttgatcatcgtccatgctgctagcgctgctagctgcaacggtcttcaatatttcatcttattcttcatggcag

SEQ ID NO: 130913 - DNA, 75 bp, Artificial Sequence
  Synthetic
cgctttggatgcggccgagcagggccacattggctttgcactgctagtagtggtatgtgttttcacgctcactcc

SEQ ID NO: 130914 - DNA, 75 bp, Artificial Sequence
  Synthetic
cgcggcggccgcgaaggcatcgtgtgggccgcggtcatgtttcgtccggacgtggtgtatgacataaccaaatgg

SEQ ID NO: 130915 - DNA, 75 bp, Artificial Sequence
  Synthetic
cgcggcggccgcgaaggcatcgtgtgggccgcggtcatgtttcgtccggacgtggtgtttgacataaccaaatgg

SEQ ID NO: 130916 - DNA, 75 bp, Artificial Sequence
  Synthetic
cgcggcggccgcgaaggcatcgtgtgggccgcggtcatgtttcgtccggacgtggtgtctgacataaccaaatgg

SEQ ID NO: 130917 - DNA, 75 bp, Artificial Sequence
  Synthetic
cgcggcggccgcgaaggcatcgtgtgggccgcggtcatgtttcgtccggacgtggtgtgtgacataaccaaatgg

SEQ ID NO: 130918 - DNA, 75 bp, Artificial Sequence
  Synthetic
tgaattatgcaacagggaatctgcccggttgctctttctctatcttcctcttggctttgctctcttgcttgacgg

SEQ ID NO: 130919 - DNA, 75 bp, Artificial Sequence
  Synthetic
cgaggcacctagcgggaggtaagtatgtccagtggttgctgatcaccctcggcaggtggacgggcacttacatct

SEQ ID NO: 130920 - DNA, 75 bp, Artificial Sequence
  Synthetic
gctccacaccccggggtgcgtgccttgcattcgcgagggcaacgcctcacggtgttggataccgcttactcccac

SEQ ID NO: 130921 - DNA, 75 bp, Artificial Sequence
  Synthetic
cagtggatgaaccggttgatagccttcgcctcccgggggaaccatgtttcccccacgcactatgtgccggagagc

SEQ ID NO: 130922 - DNA, 75 bp, Artificial Sequence
  Synthetic
catctgttggggggcggagacggcagcctgtggcgacatcatacacgggcttcccgtctcagcccggttggggcg

SEQ ID NO: 130923 - DNA, 75 bp, Artificial Sequence
  Synthetic
catctgttggggggcggagacggctgcctgtggcgacatcatacacgggcttcccgtctcagcccggttggggcg

SEQ ID NO: 130924 - DNA, 75 bp, Artificial Sequence
  Synthetic
catctgttggggggcggagacggccgcctgtggcgacatcatacacgggcttcccgtctcagcccggttggggcg

SEQ ID NO: 130925 - DNA, 75 bp, Artificial Sequence
  Synthetic
catctgttggggggcggagacggcggcctgtggcgacatcatacacgggcttcccgtctcagcccggttggggcg

SEQ ID NO: 130926 - DNA, 75 bp, Artificial Sequence
  Synthetic
gacctttgcggggctgtcttcttaactagccagctgtttgttctctctcctagacaccattggaccacgcaggat

SEQ ID NO: 130927 - DNA, 75 bp, Artificial Sequence
  Synthetic
gtgtgaggagcgggaacgtgtcgcgatgctgggtgtccttaacccccaccctggcagcgccacaacttaacgcac

SEQ ID NO: 130928 - DNA, 75 bp, Artificial Sequence
  Synthetic
tactccggatcccacaagccatcgtggatatgattgccggggcccactggggagtcctagcgggcctggcgtatt

SEQ ID NO: 130929 - DNA, 75 bp, Artificial Sequence
  Synthetic
actatagtggtgagcctgacagggcgcgacagaaccgcgcaggccggggaggtccaagtcttgtccacggtcacc

SEQ ID NO: 130930 - DNA, 75 bp, Artificial Sequence
  Synthetic
ggtacgtacgtctatgaccatcttactccactgcgggactgggcccacgcgggcctacgggaccttgcggtggca

SEQ ID NO: 130931 - DNA, 75 bp, Artificial Sequence
  Synthetic
ggctaccgcaggtgccgcgcgagcggcgtactgacaactagctgtggtaacaccctcacttgctacatcaaggcc

SEQ ID NO: 130932 - DNA, 75 bp, Artificial Sequence
  Synthetic
tgtataccagcgcggagggggatctcgtggggtggtctagccctccagggaccaagtcgctggagccatgtactt

SEQ ID NO: 130933 - DNA, 75 bp, Artificial Sequence
  Synthetic
cgtcagtggcgttgccagcttcttcacccgggggccttctcaacgcatccagctcatcaacaccaatggcagctg

SEQ ID NO: 130934 - DNA, 75 bp, Artificial Sequence
  Synthetic
aggccaggccttcactttccaaccacgccgccacttgactactcaggattgcaattgctccatctattcaggcca

SEQ ID NO: 130935 - DNA, 75 bp, Artificial Sequence
  Synthetic
cacccggaacgcggacgtcatcccagcacggaggcgcggggatcgacggggagctttgctctccccgaggcctct

SEQ ID NO: 130936 - DNA, 75 bp, Artificial Sequence
  Synthetic
gaccttctatctgggggccattggggcattctcgtcggcgtggcctacttcagcatgcaaggacattgggccaaa

SEQ ID NO: 130937 - DNA, 75 bp, Artificial Sequence
  Synthetic
gaccttctttctgggggccattggggcattctcgtcggcgtggcctacttcagcatgcaaggacattgggccaaa

SEQ ID NO: 130938 - DNA, 75 bp, Artificial Sequence
  Synthetic
gaccttctctctgggggccattggggcattctcgtcggcgtggcctacttcagcatgcaaggacattgggccaaa

SEQ ID NO: 130939 - DNA, 75 bp, Artificial Sequence
  Synthetic
gaccttctgtctgggggccattggggcattctcgtcggcgtggcctacttcagcatgcaaggacattgggccaaa

SEQ ID NO: 130940 - DNA, 75 bp, Artificial Sequence
  Synthetic
gagagactggccgactgcaagcccctctcctacttttcccagggctggggccccatcagttacaccaatggcacc

SEQ ID NO: 130941 - DNA, 75 bp, Artificial Sequence
  Synthetic
tcacggcctactcccaacagacacggggcctacttggctgcattatcactagcctcacaggccgggacaagaacc

SEQ ID NO: 130942 - DNA, 75 bp, Artificial Sequence
  Synthetic
agcagcgaccaccgcccttattgctggcactactccccaaaacaatgtggtgttgtgcccgccaagcaggtgtgc

SEQ ID NO: 130943 - DNA, 75 bp, Artificial Sequence
  Synthetic
tctatagacttcatccccgtcgagtcactcgacattgtcaccagatctccctccttttctgacaacagcacccca

SEQ ID NO: 130944 - DNA, 75 bp, Artificial Sequence
  Synthetic
tctcttcaggggccaagcagaacctacagcttatacataccaacggaagctggcaaatcaacaggactgctctca

SEQ ID NO: 130945 - DNA, 75 bp, Artificial Sequence
  Synthetic
tctcttcaggggccaagcagaacctacagcttatacataccaacggaagctggcatatcaacaggactgctctca

SEQ ID NO: 130946 - DNA, 75 bp, Artificial Sequence
  Synthetic
tctcttcaggggccaagcagaacctacagcttatacataccaacggaagctggcacatcaacaggactgctctca

SEQ ID NO: 130947 - DNA, 75 bp, Artificial Sequence
  Synthetic
tctcttcaggggccaagcagaacctacagcttatacataccaacggaagctggcagatcaacaggactgctctca

SEQ ID NO: 130948 - DNA, 75 bp, Artificial Sequence
  Synthetic
tcatcctcaacaacactaggccgccgctgggcaattggttcggctgcacctggatgaactcaactggatttacaa

SEQ ID NO: 130949 - DNA, 75 bp, Artificial Sequence
  Synthetic
aggtacttgtactaaatccctctgtggccgccacgctgggttttggagcttacatggccaaggcatatggaataa

SEQ ID NO: 130950 - DNA, 75 bp, Artificial Sequence
  Synthetic
tcttgatgacttccgccagggctggggagcactcggggttgccaacaacagcggcccctccgatgacaggccata

SEQ ID NO: 130951 - DNA, 75 bp, Artificial Sequence
  Synthetic
tcttgatgacttccgccagggctggggtgcactcggggttgccaacaacagcggcccctccgatgacaggccata

SEQ ID NO: 130952 - DNA, 75 bp, Artificial Sequence
  Synthetic
tcttgatgacttccgccagggctggggcgcactcggggttgccaacaacagcggcccctccgatgacaggccata

SEQ ID NO: 130953 - DNA, 75 bp, Artificial Sequence
  Synthetic
tcttgatgacttccgccagggctggggggcactcggggttgccaacaacagcggcccctccgatgacaggccata

SEQ ID NO: 130954 - DNA, 75 bp, Artificial Sequence
  Synthetic
aaagtgcggctctggcccttggctcacccccagatgccttgtccactatccttacaggctgtggcattatccctg

SEQ ID NO: 130955 - DNA, 75 bp, Artificial Sequence
  Synthetic
aaagtgcggctctggcccttggctcacccccagttgccttgtccactatccttacaggctgtggcattatccctg

SEQ ID NO: 130956 - DNA, 75 bp, Artificial Sequence
  Synthetic
aaagtgcggctctggcccttggctcacccccagctgccttgtccactatccttacaggctgtggcattatccctg

SEQ ID NO: 130957 - DNA, 75 bp, Artificial Sequence
  Synthetic
aaagtgcggctctggcccttggctcacccccaggtgccttgtccactatccttacaggctgtggcattatccctg

SEQ ID NO: 130958 - DNA, 75 bp, Artificial Sequence
  Synthetic
ggcctatgacatcattatatgcgatgaatgccactctgtggactctaccaccatccttggtattggaacagtcct

SEQ ID NO: 130959 - DNA, 75 bp, Artificial Sequence
  Synthetic
acggatcgccgcggtatccctacttacacctggggagagaatgagaccgatgtctttatccttaattcgactagg

SEQ ID NO: 130960 - DNA, 75 bp, Artificial Sequence
  Synthetic
tgtctttatccttaattcgactaggcccccgaaaggggcctggttcggatgtgtttggatgaatggcactggctt

SEQ ID NO: 130961 - DNA, 75 bp, Artificial Sequence
  Synthetic
tgtctttatccttaattcgactaggcccccgaaaggggcctggttcggttgtgtttggatgaatggcactggctt

SEQ ID NO: 130962 - DNA, 75 bp, Artificial Sequence
  Synthetic
tgtctttatccttaattcgactaggcccccgaaaggggcctggttcggctgtgtttggatgaatggcactggctt

SEQ ID NO: 130963 - DNA, 75 bp, Artificial Sequence
  Synthetic
tgtctttatccttaattcgactaggcccccgaaaggggcctggttcgggtgtgtttggatgaatggcactggctt

SEQ ID NO: 130964 - DNA, 75 bp, Artificial Sequence
  Synthetic
ctggaggacagggacaggtctgagcttagcccgctgctgttgtccaccacacagtggcaggtcctcccatgctcc

SEQ ID NO: 130965 - DNA, 75 bp, Artificial Sequence
  Synthetic
ctcggtcacgagggcgagatccccttctacgggaaagccatcccccttgccaacatcaaaggggggaggcacctg

SEQ ID NO: 130966 - DNA, 75 bp, Artificial Sequence
  Synthetic
ccccctctgcctgccccccagactccgacgctgagtcctactcttccatgccccccctggagggggagcctgggg

SEQ ID NO: 130967 - DNA, 75 bp, Artificial Sequence
  Synthetic
atgaaatgtggttccgggccctggcttacgccgcggtgcctagtcgattacccatatcggctgtggcactacccg

SEQ ID NO: 130968 - DNA, 75 bp, Artificial Sequence
  Synthetic
tccgtgcccgcagagatcctgcggaagtctcggaaattcgccccggccttgcccatttgggcacggccggactac

SEQ ID NO: 130969 - DNA, 75 bp, Artificial Sequence
  Synthetic
gggccattaagtgggaatacattgtcctcctgtttctattgctggcagacgcccgcgtttgtgcttgcctgtgga

SEQ ID NO: 130970 - DNA, 75 bp, Artificial Sequence
  Synthetic
tcataccaacacaaggagacgtggtggttgttgccactgacgctctcatgactgggtacactggtgatttcgact

SEQ ID NO: 130971 - DNA, 75 bp, Artificial Sequence
  Synthetic
ggccctatcagctacgccaacggaaccgactccgaccaccgcccctactgctggcactacgccccaaggccttgt

SEQ ID NO: 130972 - DNA, 75 bp, Artificial Sequence
  Synthetic
acctagaacatagggaccgcacagaaatatcccccttgctactgtccacaacgcagtggcaagtactcccctgct

SEQ ID NO: 130973 - DNA, 75 bp, Artificial Sequence
  Synthetic
acctagaacatagggaccgcacagaaatatcccccttgctactgtccactacgcagtggcaagtactcccctgct

SEQ ID NO: 130974 - DNA, 75 bp, Artificial Sequence
  Synthetic
acctagaacatagggaccgcacagaaatatcccccttgctactgtccaccacgcagtggcaagtactcccctgct

SEQ ID NO: 130975 - DNA, 75 bp, Artificial Sequence
  Synthetic
acctagaacatagggaccgcacagaaatatcccccttgctactgtccacgacgcagtggcaagtactcccctgct

SEQ ID NO: 130976 - DNA, 75 bp, Artificial Sequence
  Synthetic
cacccaggtcgtagatttcagcttggaccccacatttgcaataaccacacaaaccgttccccaggacgccgtatc

SEQ ID NO: 130977 - DNA, 75 bp, Artificial Sequence
  Synthetic
ggtcttctgctttgcatggtatctgaaaggcagatgggtgcccggagccgtttacaccgtttatgggatgtggcc

SEQ ID NO: 130978 - DNA, 75 bp, Artificial Sequence
  Synthetic
ctctgtgagtgttatgacgcaggcgctgcttggtacgagctaacgccggctgaaaccactgtcagactgcgggca

SEQ ID NO: 130979 - DNA, 75 bp, Artificial Sequence
  Synthetic
atgggccctcaagtgggaatacatagtgcttgtgttccttctcttggcagatgccagggtctgtgcttgtctttg

SEQ ID NO: 130980 - DNA, 75 bp, Artificial Sequence
  Synthetic
atgggccctcaagtgggaatacattgtgcttgtgttccttctcttggcagatgccagggtctgtgcttgtctttg

SEQ ID NO: 130981 - DNA, 75 bp, Artificial Sequence
  Synthetic
atgggccctcaagtgggaatacatcgtgcttgtgttccttctcttggcagatgccagggtctgtgcttgtctttg

SEQ ID NO: 130982 - DNA, 75 bp, Artificial Sequence
  Synthetic
atgggccctcaagtgggaatacatggtgcttgtgttccttctcttggcagatgccagggtctgtgcttgtctttg

SEQ ID NO: 130983 - DNA, 75 bp, Artificial Sequence
  Synthetic
tttacactgtcaccgcactacaagcggaccatcgcctatgtcctatggtggctccaataccttctgacaagggcg

SEQ ID NO: 130984 - DNA, 75 bp, Artificial Sequence
  Synthetic
ctctttgtctgcgtggcgtggcatattaaaggaaggttgccagcagcattcacttacgcatcatgtggcatgtgg

SEQ ID NO: 130985 - DNA, 75 bp, Artificial Sequence
  Synthetic
ctctttgtctgcgtggcgtggcatattaaaggaaggttgccagctgcattcacttacgcatcatgtggcatgtgg

SEQ ID NO: 130986 - DNA, 75 bp, Artificial Sequence
  Synthetic
ctctttgtctgcgtggcgtggcatattaaaggaaggttgccagccgcattcacttacgcatcatgtggcatgtgg

SEQ ID NO: 130987 - DNA, 75 bp, Artificial Sequence
  Synthetic
ctctttgtctgcgtggcgtggcatattaaaggaaggttgccagcggcattcacttacgcatcatgtggcatgtgg

SEQ ID NO: 130988 - DNA, 75 bp, Artificial Sequence
  Synthetic
agacaaagcaagctggagagaacttcccatatctggtggcctaccaggccaccgtgtgtgccagggctaaggccc

SEQ ID NO: 130989 - DNA, 75 bp, Artificial Sequence
  Synthetic
acatcacaaaactgttgttggccatcctggggcccctatgggtcctccaggctaacctgcagaaggtgccatact

SEQ ID NO: 130990 - DNA, 75 bp, Artificial Sequence
  Synthetic
gcgaggcaggactggtaggggcagggcaggcatctacaggtttgtgactccaggagaacggccctcgggcatgtt

SEQ ID NO: 130991 - DNA, 75 bp, Artificial Sequence
  Synthetic
gaagtgtttaatccggcttaagcccacacttgtaggccccacgcccctgttgtaccgcctgggcgcggtcagcaa

SEQ ID NO: 130992 - DNA, 75 bp, Artificial Sequence
  Synthetic
gctcttctgtcctgcgtcactgtgcctgtgtctgccgtggagattaggaacaccagctcgagctacatggtgacc

SEQ ID NO: 130993 - DNA, 75 bp, Artificial Sequence
  Synthetic
tcttaaccctgtcgccgtactacaagcggtggttggctcgggtagtctggtggctgcagtatttcatagccagga

SEQ ID NO: 130994 - DNA, 75 bp, Artificial Sequence
  Synthetic
cggcacttatctctatgaccacctcaccccgctgcgggactgggcccacaacggcctcagagatcttgcggctgc

SEQ ID NO: 130995 - DNA, 75 bp, Artificial Sequence
  Synthetic
tgagtgctatgacgcgggctgtgcttggtacgagctcacgcccgccgagacctcagttaggttgcgggcttacct

SEQ ID NO: 130996 - DNA, 75 bp, Artificial Sequence
  Synthetic
ctggccgctgtggccgcctattgcctcgcaaccggctgtgtgtgtatcatcgggcgcatccacatcaatcaaagg

SEQ ID NO: 130997 - DNA, 75 bp, Artificial Sequence
  Synthetic
cgcggtgttggattccggtcacgccaaacctggccgtgaaacacaccggagctcttacccgcaacataagaactc

SEQ ID NO: 130998 - DNA, 75 bp, Artificial Sequence
  Synthetic
tgaggttacaaagcacctccttgccattatcggccccctttacctactccagacctcgctcttgcacgtccctta

SEQ ID NO: 130999 - DNA, 75 bp, Artificial Sequence
  Synthetic
catcatcaacggcctaccagtgtcagctcgcagggggaacgagatactgctagggcctgctgacaagatggtctc

SEQ ID NO: 131000 - DNA, 75 bp, Artificial Sequence
  Synthetic
catcatcaacggccttccagtgtcagctcgcagggggaacgagatactgctagggcctgctgacaagatggtctc

SEQ ID NO: 131001 - DNA, 75 bp, Artificial Sequence
  Synthetic
catcatcaacggcctcccagtgtcagctcgcagggggaacgagatactgctagggcctgctgacaagatggtctc

SEQ ID NO: 131002 - DNA, 75 bp, Artificial Sequence
  Synthetic
catcatcaacggcctgccagtgtcagctcgcagggggaacgagatactgctagggcctgctgacaagatggtctc

SEQ ID NO: 131003 - DNA, 75 bp, Artificial Sequence
  Synthetic
tcttgtacgaggccttcgatgagatggaggaatgcgcctccaaagccgctcttctcgaagaggggcaacgcatag

SEQ ID NO: 131004 - DNA, 75 bp, Artificial Sequence
  Synthetic
gccgcagcatcaccacttcacacaagactgcaactgctccatctaccaaggacatctcactggccatcgaatggc

SEQ ID NO: 131005 - DNA, 75 bp, Artificial Sequence
  Synthetic
gttggcacattaacaggacggccttgaactgtaacaccagcctcgagaccggctggctagcagggctcatctacc

SEQ ID NO: 131006 - DNA, 75 bp, Artificial Sequence
  Synthetic
ggagcgcccctccggcatgttcgactcgtccgtcctctgtgagtgctatgacgcgggctgcgcttggtatgagct

SEQ ID NO: 131007 - DNA, 75 bp, Artificial Sequence
  Synthetic
acagttctgggccaagcacatgtggaacttcatcagtggtatccagtacctcgcaggactatccacattgccggg

SEQ ID NO: 131008 - DNA, 75 bp, Artificial Sequence
  Synthetic
accggcacctacatttacgaccacctaacaccgatgtcatcttgggccgcaagcggcctcaaagatctcgcggtg

SEQ ID NO: 131009 - DNA, 75 bp, Artificial Sequence
  Synthetic
gctcttgagccagtcatatttacacccatggagaaaaaggtgatagtttggggagccgatactgcggcgtgcggt

SEQ ID NO: 131010 - DNA, 75 bp, Artificial Sequence
  Synthetic
caagtggagggtgaagtccagattgtgtctaccgcaacccagaccttcctggcaacatgcatcaatggggtgtgc

SEQ ID NO: 131011 - DNA, 75 bp, Artificial Sequence
  Synthetic
tggggtgtgatctttggcctggcctacttctccatgcaaggggcgtgggccaaggtcgccgtcatactcatgctg

SEQ ID NO: 131012 - DNA, 75 bp, Artificial Sequence
  Synthetic
gcgttcagcgccgccctcacaagcccgttgtctactagcaccaccatcctcctgaacatcatggggggttggttg

SEQ ID NO: 131013 - DNA, 75 bp, Artificial Sequence
  Synthetic
cagcacccgctggagcgcgctctctggtaccttgcacctgtggctcctcggacctatatttggtcacgaggcacg

SEQ ID NO: 131014 - DNA, 75 bp, Artificial Sequence
  Synthetic
ccatcaccgcgtacgcgcagcagactcgaggcttgtgcagcaccatcgtgacaagcctcaccggcagggacacca

SEQ ID NO: 131015 - DNA, 75 bp, Artificial Sequence
  Synthetic
acatcctggctgggtacggcgctggcatatcgggggcactcgtcgcttttaagatcatgtccggcgagaagcctt

SEQ ID NO: 131016 - DNA, 75 bp, Artificial Sequence
  Synthetic
acatcctggctgggtacggcgctggcatttcgggggcactcgtcgcttttaagatcatgtccggcgagaagcctt

SEQ ID NO: 131017 - DNA, 75 bp, Artificial Sequence
  Synthetic
acatcctggctgggtacggcgctggcatctcgggggcactcgtcgcttttaagatcatgtccggcgagaagcctt

SEQ ID NO: 131018 - DNA, 75 bp, Artificial Sequence
  Synthetic
acatcctggctgggtacggcgctggcatgtcgggggcactcgtcgcttttaagatcatgtccggcgagaagcctt

SEQ ID NO: 131019 - DNA, 75 bp, Artificial Sequence
  Synthetic
tcatgctcatgaagaccaacggtagctggcacattaataggacagctctgaattgcaatgactccctgcacacgg

SEQ ID NO: 131020 - DNA, 75 bp, Artificial Sequence
  Synthetic
ttgtcccctgggacacgccgtaggcatattcagggctgcggtgtgtactcgcggggtcgccaaggcggtagactt

SEQ ID NO: 131021 - DNA, 75 bp, Artificial Sequence
  Synthetic
cagcaagactctctgcggcccaaaggggcctgtctgccagatgtacaccaatgttgaccaggacctcgtggggtg

SEQ ID NO: 131022 - DNA, 75 bp, Artificial Sequence
  Synthetic
gggcagcttagagtatgagaataatgtcaccaatgatgaagatatgagaccttactgttggcactatccaccaaa

SEQ ID NO: 131023 - DNA, 75 bp, Artificial Sequence
  Synthetic
aggggaaggcgcggtccaatggatgaatcggctcatagcctttgcatccagaggcaaccaagtagccccgacaca

SEQ ID NO: 131024 - DNA, 75 bp, Artificial Sequence
  Synthetic
aggggaaggcgcggtccaatggatgaatcggctcatagcctttgcatccagaggcaaccaagtagccccgactca

SEQ ID NO: 131025 - DNA, 75 bp, Artificial Sequence
  Synthetic
aggggaaggcgcggtccaatggatgaatcggctcatagcctttgcatccagaggcaaccaagtagccccgaccca

SEQ ID NO: 131026 - DNA, 75 bp, Artificial Sequence
  Synthetic
aggggaaggcgcggtccaatggatgaatcggctcatagcctttgcatccagaggcaaccaagtagccccgacgca

SEQ ID NO: 131027 - DNA, 75 bp, Artificial Sequence
  Synthetic
aggggaaggcgcggtccaatggatgaatcggctcatagcctttgcatccagaggcaaccaagttgccccgacaca

SEQ ID NO: 131028 - DNA, 75 bp, Artificial Sequence
  Synthetic
aggggaaggcgcggtccaatggatgaatcggctcatagcctttgcatccagaggcaaccaagttgccccgactca

SEQ ID NO: 131029 - DNA, 75 bp, Artificial Sequence
  Synthetic
aggggaaggcgcggtccaatggatgaatcggctcatagcctttgcatccagaggcaaccaagttgccccgaccca

SEQ ID NO: 131030 - DNA, 75 bp, Artificial Sequence
  Synthetic
aggggaaggcgcggtccaatggatgaatcggctcatagcctttgcatccagaggcaaccaagttgccccgacgca

SEQ ID NO: 131031 - DNA, 75 bp, Artificial Sequence
  Synthetic
aggggaaggcgcggtccaatggatgaatcggctcatagcctttgcatccagaggcaaccaagtcgccccgacaca

SEQ ID NO: 131032 - DNA, 75 bp, Artificial Sequence
  Synthetic
aggggaaggcgcggtccaatggatgaatcggctcatagcctttgcatccagaggcaaccaagtcgccccgactca

SEQ ID NO: 131033 - DNA, 75 bp, Artificial Sequence
  Synthetic
aggggaaggcgcggtccaatggatgaatcggctcatagcctttgcatccagaggcaaccaagtcgccccgaccca

SEQ ID NO: 131034 - DNA, 75 bp, Artificial Sequence
  Synthetic
aggggaaggcgcggtccaatggatgaatcggctcatagcctttgcatccagaggcaaccaagtcgccccgacgca

SEQ ID NO: 131035 - DNA, 75 bp, Artificial Sequence
  Synthetic
aggggaaggcgcggtccaatggatgaatcggctcatagcctttgcatccagaggcaaccaagtggccccgacaca

SEQ ID NO: 131036 - DNA, 75 bp, Artificial Sequence
  Synthetic
aggggaaggcgcggtccaatggatgaatcggctcatagcctttgcatccagaggcaaccaagtggccccgactca

SEQ ID NO: 131037 - DNA, 75 bp, Artificial Sequence
  Synthetic
aggggaaggcgcggtccaatggatgaatcggctcatagcctttgcatccagaggcaaccaagtggccccgaccca

SEQ ID NO: 131038 - DNA, 75 bp, Artificial Sequence
  Synthetic
aggggaaggcgcggtccaatggatgaatcggctcatagcctttgcatccagaggcaaccaagtggccccgacgca

SEQ ID NO: 131039 - DNA, 75 bp, Artificial Sequence
  Synthetic
aggggaaggcgcggtccaatggatgaatcggctcatagcctttgcatccagaggcaaccatgtagccccgacaca

SEQ ID NO: 131040 - DNA, 75 bp, Artificial Sequence
  Synthetic
aggggaaggcgcggtccaatggatgaatcggctcatagcctttgcatccagaggcaaccatgtagccccgactca

SEQ ID NO: 131041 - DNA, 75 bp, Artificial Sequence
  Synthetic
aggggaaggcgcggtccaatggatgaatcggctcatagcctttgcatccagaggcaaccatgtagccccgaccca

SEQ ID NO: 131042 - DNA, 75 bp, Artificial Sequence
  Synthetic
aggggaaggcgcggtccaatggatgaatcggctcatagcctttgcatccagaggcaaccatgtagccccgacgca

SEQ ID NO: 131043 - DNA, 75 bp, Artificial Sequence
  Synthetic
aggggaaggcgcggtccaatggatgaatcggctcatagcctttgcatccagaggcaaccatgttgccccgacaca

SEQ ID NO: 131044 - DNA, 75 bp, Artificial Sequence
  Synthetic
aggggaaggcgcggtccaatggatgaatcggctcatagcctttgcatccagaggcaaccatgttgccccgactca

SEQ ID NO: 131045 - DNA, 75 bp, Artificial Sequence
  Synthetic
aggggaaggcgcggtccaatggatgaatcggctcatagcctttgcatccagaggcaaccatgttgccccgaccca

SEQ ID NO: 131046 - DNA, 75 bp, Artificial Sequence
  Synthetic
aggggaaggcgcggtccaatggatgaatcggctcatagcctttgcatccagaggcaaccatgttgccccgacgca

SEQ ID NO: 131047 - DNA, 75 bp, Artificial Sequence
  Synthetic
aggggaaggcgcggtccaatggatgaatcggctcatagcctttgcatccagaggcaaccatgtcgccccgacaca

SEQ ID NO: 131048 - DNA, 75 bp, Artificial Sequence
  Synthetic
aggggaaggcgcggtccaatggatgaatcggctcatagcctttgcatccagaggcaaccatgtcgccccgactca

SEQ ID NO: 131049 - DNA, 75 bp, Artificial Sequence
  Synthetic
aggggaaggcgcggtccaatggatgaatcggctcatagcctttgcatccagaggcaaccatgtcgccccgaccca

SEQ ID NO: 131050 - DNA, 75 bp, Artificial Sequence
  Synthetic
aggggaaggcgcggtccaatggatgaatcggctcatagcctttgcatccagaggcaaccatgtcgccccgacgca

SEQ ID NO: 131051 - DNA, 75 bp, Artificial Sequence
  Synthetic
aggggaaggcgcggtccaatggatgaatcggctcatagcctttgcatccagaggcaaccatgtggccccgacaca

SEQ ID NO: 131052 - DNA, 75 bp, Artificial Sequence
  Synthetic
aggggaaggcgcggtccaatggatgaatcggctcatagcctttgcatccagaggcaaccatgtggccccgactca

SEQ ID NO: 131053 - DNA, 75 bp, Artificial Sequence
  Synthetic
aggggaaggcgcggtccaatggatgaatcggctcatagcctttgcatccagaggcaaccatgtggccccgaccca

SEQ ID NO: 131054 - DNA, 75 bp, Artificial Sequence
  Synthetic
aggggaaggcgcggtccaatggatgaatcggctcatagcctttgcatccagaggcaaccatgtggccccgacgca

SEQ ID NO: 131055 - DNA, 75 bp, Artificial Sequence
  Synthetic
aggggaaggcgcggtccaatggatgaatcggctcatagcctttgcatccagaggcaaccacgtagccccgacaca

SEQ ID NO: 131056 - DNA, 75 bp, Artificial Sequence
  Synthetic
aggggaaggcgcggtccaatggatgaatcggctcatagcctttgcatccagaggcaaccacgtagccccgactca

SEQ ID NO: 131057 - DNA, 75 bp, Artificial Sequence
  Synthetic
aggggaaggcgcggtccaatggatgaatcggctcatagcctttgcatccagaggcaaccacgtagccccgaccca

SEQ ID NO: 131058 - DNA, 75 bp, Artificial Sequence
  Synthetic
aggggaaggcgcggtccaatggatgaatcggctcatagcctttgcatccagaggcaaccacgtagccccgacgca

SEQ ID NO: 131059 - DNA, 75 bp, Artificial Sequence
  Synthetic
aggggaaggcgcggtccaatggatgaatcggctcatagcctttgcatccagaggcaaccacgttgccccgacaca

SEQ ID NO: 131060 - DNA, 75 bp, Artificial Sequence
  Synthetic
aggggaaggcgcggtccaatggatgaatcggctcatagcctttgcatccagaggcaaccacgttgccccgactca

SEQ ID NO: 131061 - DNA, 75 bp, Artificial Sequence
  Synthetic
aggggaaggcgcggtccaatggatgaatcggctcatagcctttgcatccagaggcaaccacgttgccccgaccca

SEQ ID NO: 131062 - DNA, 75 bp, Artificial Sequence
  Synthetic
aggggaaggcgcggtccaatggatgaatcggctcatagcctttgcatccagaggcaaccacgttgccccgacgca

SEQ ID NO: 131063 - DNA, 75 bp, Artificial Sequence
  Synthetic
aggggaaggcgcggtccaatggatgaatcggctcatagcctttgcatccagaggcaaccacgtcgccccgacaca

SEQ ID NO: 131064 - DNA, 75 bp, Artificial Sequence
  Synthetic
aggggaaggcgcggtccaatggatgaatcggctcatagcctttgcatccagaggcaaccacgtcgccccgactca

SEQ ID NO: 131065 - DNA, 75 bp, Artificial Sequence
  Synthetic
aggggaaggcgcggtccaatggatgaatcggctcatagcctttgcatccagaggcaaccacgtcgccccgaccca

SEQ ID NO: 131066 - DNA, 75 bp, Artificial Sequence
  Synthetic
aggggaaggcgcggtccaatggatgaatcggctcatagcctttgcatccagaggcaaccacgtcgccccgacgca

SEQ ID NO: 131067 - DNA, 75 bp, Artificial Sequence
  Synthetic
aggggaaggcgcggtccaatggatgaatcggctcatagcctttgcatccagaggcaaccacgtggccccgacaca

SEQ ID NO: 131068 - DNA, 75 bp, Artificial Sequence
  Synthetic
aggggaaggcgcggtccaatggatgaatcggctcatagcctttgcatccagaggcaaccacgtggccccgactca

SEQ ID NO: 131069 - DNA, 75 bp, Artificial Sequence
  Synthetic
aggggaaggcgcggtccaatggatgaatcggctcatagcctttgcatccagaggcaaccacgtggccccgaccca

SEQ ID NO: 131070 - DNA, 75 bp, Artificial Sequence
  Synthetic
aggggaaggcgcggtccaatggatgaatcggctcatagcctttgcatccagaggcaaccacgtggccccgacgca

SEQ ID NO: 131071 - DNA, 75 bp, Artificial Sequence
  Synthetic
aggggaaggcgcggtccaatggatgaatcggctcatagcctttgcatccagaggcaaccaggtagccccgacaca

SEQ ID NO: 131072 - DNA, 75 bp, Artificial Sequence
  Synthetic
aggggaaggcgcggtccaatggatgaatcggctcatagcctttgcatccagaggcaaccaggtagccccgactca

SEQ ID NO: 131073 - DNA, 75 bp, Artificial Sequence
  Synthetic
aggggaaggcgcggtccaatggatgaatcggctcatagcctttgcatccagaggcaaccaggtagccccgaccca

SEQ ID NO: 131074 - DNA, 75 bp, Artificial Sequence
  Synthetic
aggggaaggcgcggtccaatggatgaatcggctcatagcctttgcatccagaggcaaccaggtagccccgacgca

SEQ ID NO: 131075 - DNA, 75 bp, Artificial Sequence
  Synthetic
aggggaaggcgcggtccaatggatgaatcggctcatagcctttgcatccagaggcaaccaggttgccccgacaca

SEQ ID NO: 131076 - DNA, 75 bp, Artificial Sequence
  Synthetic
aggggaaggcgcggtccaatggatgaatcggctcatagcctttgcatccagaggcaaccaggttgccccgactca

SEQ ID NO: 131077 - DNA, 75 bp, Artificial Sequence
  Synthetic
aggggaaggcgcggtccaatggatgaatcggctcatagcctttgcatccagaggcaaccaggttgccccgaccca

SEQ ID NO: 131078 - DNA, 75 bp, Artificial Sequence
  Synthetic
aggggaaggcgcggtccaatggatgaatcggctcatagcctttgcatccagaggcaaccaggttgccccgacgca

SEQ ID NO: 131079 - DNA, 75 bp, Artificial Sequence
  Synthetic
aggggaaggcgcggtccaatggatgaatcggctcatagcctttgcatccagaggcaaccaggtcgccccgacaca

SEQ ID NO: 131080 - DNA, 75 bp, Artificial Sequence
  Synthetic
aggggaaggcgcggtccaatggatgaatcggctcatagcctttgcatccagaggcaaccaggtcgccccgactca

SEQ ID NO: 131081 - DNA, 75 bp, Artificial Sequence
  Synthetic
aggggaaggcgcggtccaatggatgaatcggctcatagcctttgcatccagaggcaaccaggtcgccccgaccca

SEQ ID NO: 131082 - DNA, 75 bp, Artificial Sequence
  Synthetic
aggggaaggcgcggtccaatggatgaatcggctcatagcctttgcatccagaggcaaccaggtcgccccgacgca

SEQ ID NO: 131083 - DNA, 75 bp, Artificial Sequence
  Synthetic
aggggaaggcgcggtccaatggatgaatcggctcatagcctttgcatccagaggcaaccaggtggccccgacaca

SEQ ID NO: 131084 - DNA, 75 bp, Artificial Sequence
  Synthetic
aggggaaggcgcggtccaatggatgaatcggctcatagcctttgcatccagaggcaaccaggtggccccgactca

SEQ ID NO: 131085 - DNA, 75 bp, Artificial Sequence
  Synthetic
aggggaaggcgcggtccaatggatgaatcggctcatagcctttgcatccagaggcaaccaggtggccccgaccca

SEQ ID NO: 131086 - DNA, 75 bp, Artificial Sequence
  Synthetic
aggggaaggcgcggtccaatggatgaatcggctcatagcctttgcatccagaggcaaccaggtggccccgacgca

SEQ ID NO: 131087 - DNA, 75 bp, Artificial Sequence
  Synthetic
gccggctcctcctggagttaagtccctctcgccatgcacttgtggagcatcagatctgttcctagtcacccgaca

SEQ ID NO: 131088 - DNA, 75 bp, Artificial Sequence
  Synthetic
catgctcccaccggcagtggcaagagcaccagggtgccagctgcctatgcagcgcaagggtacaaggtgctggta

SEQ ID NO: 131089 - DNA, 75 bp, Artificial Sequence
  Synthetic
cacttgccgtacatcgagcaagggatgatgctcgccgagcagttcaagcagaaagccctcggcctcttgcagacc

SEQ ID NO: 131090 - DNA, 75 bp, Artificial Sequence
  Synthetic
gcttatacctggggggagaatgagacagatgtcttcttgctgaacagcactaggcccccccaaggggcctggttt

SEQ ID NO: 131091 - DNA, 75 bp, Artificial Sequence
  Synthetic
ctctgccctctgggccatgccgtaggtttattccgcgcagcggtgtgcactcgcggcgtggccaaagcggtagac

SEQ ID NO: 131092 - DNA, 75 bp, Artificial Sequence
  Synthetic
gactgccccgttccatgctccgggtcgtggctccgggacgtatgggactgggtttgttccatcttgacggacttc

SEQ ID NO: 131093 - DNA, 75 bp, Artificial Sequence
  Synthetic
tgacaattccacaccccccgctgtgccccaaacctatcaggttgcccacttgcatgcgccgacggggagcggcaa

SEQ ID NO: 131094 - DNA, 75 bp, Artificial Sequence
  Synthetic
ccacggattgctttagaaagcatcccgacacaacctaccttaagtgtggtgctggcccctggttgacccccaagt

SEQ ID NO: 131095 - DNA, 75 bp, Artificial Sequence
  Synthetic
tgaccacgcggtgcccgtgcggggctaacatctctggccatgtccgcctaggcaccatgagaataacaggaccca

SEQ ID NO: 131096 - DNA, 75 bp, Artificial Sequence
  Synthetic
ataggcaccgtccttgaccaggcagagactgctggggcgaggttggtggttcttgctacggctacaccaccaggg

SEQ ID NO: 131097 - DNA, 75 bp, Artificial Sequence
  Synthetic
cttgggatttggggcttacatgtctaaggcgtatggcatcgacccgaacatacggtcaggtgtcagaaccattac

SEQ ID NO: 131098 - DNA, 75 bp, Artificial Sequence
  Synthetic
cttgggttttggggcttacatgtctaaggcgtatggcatcgacccgaacatacggtcaggtgtcagaaccattac

SEQ ID NO: 131099 - DNA, 75 bp, Artificial Sequence
  Synthetic
cttgggctttggggcttacatgtctaaggcgtatggcatcgacccgaacatacggtcaggtgtcagaaccattac

SEQ ID NO: 131100 - DNA, 75 bp, Artificial Sequence
  Synthetic
cttggggtttggggcttacatgtctaaggcgtatggcatcgacccgaacatacggtcaggtgtcagaaccattac

SEQ ID NO: 131101 - DNA, 75 bp, Artificial Sequence
  Synthetic
aaggcgtatggcatcgacccgaacatacggtcaggtgtcagaaccattaccaccggtgcgccgatcacatactcc

SEQ ID NO: 131102 - DNA, 75 bp, Artificial Sequence
  Synthetic
tgaagcggcgtgcaacttctcccgaggtgatcgctgcgccctagaagacagggacagaagccaacaaagcccact

SEQ ID NO: 131103 - DNA, 75 bp, Artificial Sequence
  Synthetic
gagggtagcggcggcggagtatgcggaggtgacaatgcgcggccagagcgcgtttgtgacggggttgacgactga

SEQ ID NO: 131104 - DNA, 75 bp, Artificial Sequence
  Synthetic
gatctggccgtggctgtggagccagtcgtcttctcccgaatggagaccaagctcatcacgtggggggcagacacc

SEQ ID NO: 131105 - DNA, 75 bp, Artificial Sequence
  Synthetic
gtatcggcacggtcttagaccaggcagagactgctggggcgcgccttgtcgtgctcgcaactgccacgccaccag

SEQ ID NO: 131106 - DNA, 75 bp, Artificial Sequence
  Synthetic
gtgcagtacttatatggcctaacaccagcaattacaaaatatgctgtgaagtgggagtgggtagtcctcctattt

SEQ ID NO: 131107 - DNA, 75 bp, Artificial Sequence
  Synthetic
agagatgaggtttcgttcagcgtgggcctcaactcctacgtagtcgggtccaggctcccttgcgagcctgagccg

SEQ ID NO: 131108 - DNA, 75 bp, Artificial Sequence
  Synthetic
agagatgaggtttcgttcagcgtgggcctcaactcctacgtagtcgggtcctggctcccttgcgagcctgagccg

SEQ ID NO: 131109 - DNA, 75 bp, Artificial Sequence
  Synthetic
agagatgaggtttcgttcagcgtgggcctcaactcctacgtagtcgggtcccggctcccttgcgagcctgagccg

SEQ ID NO: 131110 - DNA, 75 bp, Artificial Sequence
  Synthetic
agagatgaggtttcgttcagcgtgggcctcaactcctacgtagtcgggtccgggctcccttgcgagcctgagccg

SEQ ID NO: 131111 - DNA, 75 bp, Artificial Sequence
  Synthetic
agagatgaggtttcgttcagcgtgggcctcaactcctacgttgtcgggtccaggctcccttgcgagcctgagccg

SEQ ID NO: 131112 - DNA, 75 bp, Artificial Sequence
  Synthetic
agagatgaggtttcgttcagcgtgggcctcaactcctacgttgtcgggtcctggctcccttgcgagcctgagccg

SEQ ID NO: 131113 - DNA, 75 bp, Artificial Sequence
  Synthetic
agagatgaggtttcgttcagcgtgggcctcaactcctacgttgtcgggtcccggctcccttgcgagcctgagccg

SEQ ID NO: 131114 - DNA, 75 bp, Artificial Sequence
  Synthetic
agagatgaggtttcgttcagcgtgggcctcaactcctacgttgtcgggtccgggctcccttgcgagcctgagccg

SEQ ID NO: 131115 - DNA, 75 bp, Artificial Sequence
  Synthetic
agagatgaggtttcgttcagcgtgggcctcaactcctacgtcgtcgggtccaggctcccttgcgagcctgagccg

SEQ ID NO: 131116 - DNA, 75 bp, Artificial Sequence
  Synthetic
agagatgaggtttcgttcagcgtgggcctcaactcctacgtcgtcgggtcctggctcccttgcgagcctgagccg

SEQ ID NO: 131117 - DNA, 75 bp, Artificial Sequence
  Synthetic
agagatgaggtttcgttcagcgtgggcctcaactcctacgtcgtcgggtcccggctcccttgcgagcctgagccg

SEQ ID NO: 131118 - DNA, 75 bp, Artificial Sequence
  Synthetic
agagatgaggtttcgttcagcgtgggcctcaactcctacgtcgtcgggtccgggctcccttgcgagcctgagccg

SEQ ID NO: 131119 - DNA, 75 bp, Artificial Sequence
  Synthetic
agagatgaggtttcgttcagcgtgggcctcaactcctacgtggtcgggtccaggctcccttgcgagcctgagccg

SEQ ID NO: 131120 - DNA, 75 bp, Artificial Sequence
  Synthetic
agagatgaggtttcgttcagcgtgggcctcaactcctacgtggtcgggtcctggctcccttgcgagcctgagccg

SEQ ID NO: 131121 - DNA, 75 bp, Artificial Sequence
  Synthetic
agagatgaggtttcgttcagcgtgggcctcaactcctacgtggtcgggtcccggctcccttgcgagcctgagccg

SEQ ID NO: 131122 - DNA, 75 bp, Artificial Sequence
  Synthetic
agagatgaggtttcgttcagcgtgggcctcaactcctacgtggtcgggtccgggctcccttgcgagcctgagccg

SEQ ID NO: 131123 - DNA, 75 bp, Artificial Sequence
  Synthetic
tgcaacacgtgtgtcacccagacggtcgacttcagccttgaccccaccttcaccatcgagacgaccacaatgccc

SEQ ID NO: 131124 - DNA, 75 bp, Artificial Sequence
  Synthetic
ctagtgctgccagcgccaacgggctgccatgcttcatcatctttttcatagcagcctggtacttcaagggtagga

SEQ ID NO: 131125 - DNA, 75 bp, Artificial Sequence
  Synthetic
tgcagaagcagctatcgtctcttggcctaaacgctgtagcctactataggggcttggacgtctcagtaataccaa

SEQ ID NO: 131126 - DNA, 75 bp, Artificial Sequence
  Synthetic
gctcctcagctagtcagctgtcagcgccatccctatatgccacctgcaccgcccatggtgcaacccctgacgttg

SEQ ID NO: 131127 - DNA, 75 bp, Artificial Sequence
  Synthetic
gctcctctgctagtcagctgtcagcgccatccctatatgccacctgcaccgcccatggtgcaacccctgacgttg

SEQ ID NO: 131128 - DNA, 75 bp, Artificial Sequence
  Synthetic
gctcctccgctagtcagctgtcagcgccatccctatatgccacctgcaccgcccatggtgcaacccctgacgttg

SEQ ID NO: 131129 - DNA, 75 bp, Artificial Sequence
  Synthetic
gctcctcggctagtcagctgtcagcgccatccctatatgccacctgcaccgcccatggtgcaacccctgacgttg

SEQ ID NO: 131130 - DNA, 75 bp, Artificial Sequence
  Synthetic
ttgactcggttgttctatgtgagtgctatgacgcaggctgtgcttggtatgagctcacgcccgctgagactactg

SEQ ID NO: 131131 - DNA, 75 bp, Artificial Sequence
  Synthetic
cctaaacgctgtagcctactataggggcttggacgtctcagtaataccaacatctggggacgtcgtggtttgtgc

SEQ ID NO: 131132 - DNA, 75 bp, Artificial Sequence
  Synthetic
ggcgcaactgggtctagctctactagtaattatatctatcttcacgcttaccccagcgtacaaatcttttctcag

SEQ ID NO: 131133 - DNA, 75 bp, Artificial Sequence
  Synthetic
ggaggacgagcgagagccttccataccatcagagtacttgctccccaagaagaggttcccgccagcattaccacc

SEQ ID NO: 131134 - DNA, 75 bp, Artificial Sequence
  Synthetic
ccacttcctgtcccagacgaagcaaagcggggaaaacttcccctacctggtagcataccaagccaccgtgtgcgc

SEQ ID NO: 131135 - DNA, 75 bp, Artificial Sequence
  Synthetic
tgtcgatttcagcctggacccgaccttctccatagagaccataaccctgccccaggacgcggtatctcgcagcca

SEQ ID NO: 131136 - DNA, 75 bp, Artificial Sequence
  Synthetic
atctgggccgctgttatgttccatccgcgcctgatttttgacatcaccaagtggctgttggcaattctcggccct

SEQ ID NO: 131137 - DNA, 75 bp, Artificial Sequence
  Synthetic
aacaccccagtgccgcctccaaggaggcgccgaactgtggtcttggaccagagtaccgtgggtgaagcactaagg

SEQ ID NO: 131138 - DNA, 75 bp, Artificial Sequence
  Synthetic
aacaccccagtgccgcctccaaggaggcgccgaactgtggtcttggaccagagtaccgtgggtgaagcacttagg

SEQ ID NO: 131139 - DNA, 75 bp, Artificial Sequence
  Synthetic
aacaccccagtgccgcctccaaggaggcgccgaactgtggtcttggaccagagtaccgtgggtgaagcactcagg

SEQ ID NO: 131140 - DNA, 75 bp, Artificial Sequence
  Synthetic
aacaccccagtgccgcctccaaggaggcgccgaactgtggtcttggaccagagtaccgtgggtgaagcactgagg

SEQ ID NO: 131141 - DNA, 75 bp, Artificial Sequence
  Synthetic
aactccccagtgccgcctccaaggaggcgccgaactgtggtcttggaccagagtaccgtgggtgaagcactaagg

SEQ ID NO: 131142 - DNA, 75 bp, Artificial Sequence
  Synthetic
aactccccagtgccgcctccaaggaggcgccgaactgtggtcttggaccagagtaccgtgggtgaagcacttagg

SEQ ID NO: 131143 - DNA, 75 bp, Artificial Sequence
  Synthetic
aactccccagtgccgcctccaaggaggcgccgaactgtggtcttggaccagagtaccgtgggtgaagcactcagg

SEQ ID NO: 131144 - DNA, 75 bp, Artificial Sequence
  Synthetic
aactccccagtgccgcctccaaggaggcgccgaactgtggtcttggaccagagtaccgtgggtgaagcactgagg

SEQ ID NO: 131145 - DNA, 75 bp, Artificial Sequence
  Synthetic
aaccccccagtgccgcctccaaggaggcgccgaactgtggtcttggaccagagtaccgtgggtgaagcactaagg

SEQ ID NO: 131146 - DNA, 75 bp, Artificial Sequence
  Synthetic
aaccccccagtgccgcctccaaggaggcgccgaactgtggtcttggaccagagtaccgtgggtgaagcacttagg

SEQ ID NO: 131147 - DNA, 75 bp, Artificial Sequence
  Synthetic
aaccccccagtgccgcctccaaggaggcgccgaactgtggtcttggaccagagtaccgtgggtgaagcactcagg

SEQ ID NO: 131148 - DNA, 75 bp, Artificial Sequence
  Synthetic
aaccccccagtgccgcctccaaggaggcgccgaactgtggtcttggaccagagtaccgtgggtgaagcactgagg

SEQ ID NO: 131149 - DNA, 75 bp, Artificial Sequence
  Synthetic
aacgccccagtgccgcctccaaggaggcgccgaactgtggtcttggaccagagtaccgtgggtgaagcactaagg

SEQ ID NO: 131150 - DNA, 75 bp, Artificial Sequence
  Synthetic
aacgccccagtgccgcctccaaggaggcgccgaactgtggtcttggaccagagtaccgtgggtgaagcacttagg

SEQ ID NO: 131151 - DNA, 75 bp, Artificial Sequence
  Synthetic
aacgccccagtgccgcctccaaggaggcgccgaactgtggtcttggaccagagtaccgtgggtgaagcactcagg

SEQ ID NO: 131152 - DNA, 75 bp, Artificial Sequence
  Synthetic
aacgccccagtgccgcctccaaggaggcgccgaactgtggtcttggaccagagtaccgtgggtgaagcactgagg

SEQ ID NO: 131153 - DNA, 75 bp, Artificial Sequence
  Synthetic
ggtgccgttcagaatgagatcaccctaacgcacccaataactaaatacatcatgacatgcatgtctgccgacctg

SEQ ID NO: 131154 - DNA, 75 bp, Artificial Sequence
  Synthetic
tgctatgacgcgggatgcgcctggtacgaactgactccggcagaaacgactactaggttgagggcttatttcaac

SEQ ID NO: 131155 - DNA, 75 bp, Artificial Sequence
  Synthetic
tactaggttgagggcttatttcaacactccaggtctccctgtgtgccaagaccatcttgagttctgggaaagcgt

SEQ ID NO: 131156 - DNA, 75 bp, Artificial Sequence
  Synthetic
ggtacgttcaggcagcagtgcttaccctcggaaggtggactggcacttacatctatgaccacctctcccccatga

SEQ ID NO: 131157 - DNA, 75 bp, Artificial Sequence
  Synthetic
aagagctcgctgattcggagacgggttccatgtcttccatgccccccctcgagggggagcctggggatcctgacc

SEQ ID NO: 131158 - DNA, 75 bp, Artificial Sequence
  Synthetic
ttctttccgggaaaccggccgtcatacctgacagggaggtcctctatagggagtttgacgagatggaggaatgtt

SEQ ID NO: 131159 - DNA, 75 bp, Artificial Sequence
  Synthetic
gccagggccctagctcctccaccgagttgggataccatgtggaagtgtttaattcgccttaagcctacattgcat

SEQ ID NO: 131160 - DNA, 75 bp, Artificial Sequence
  Synthetic
gttgggataccatgtggaagtgtttaattcgccttaagcctacattgcatgggcccacacccctcctctatagat

SEQ ID NO: 131161 - DNA, 75 bp, Artificial Sequence
  Synthetic
caacaggactgccctaaactgtaatgattccctccagactgggttcattgccgcgttgttctacgcacacagttt

SEQ ID NO: 131162 - DNA, 75 bp, Artificial Sequence
  Synthetic
agtggcgtgcggggacatcctgcacggacttccagtgtccgcacgattaggcagggaggtcttgctgggcccggc

SEQ ID NO: 131163 - DNA, 75 bp, Artificial Sequence
  Synthetic
ttccgttgtctgttgctccatgtcttactcctggaccggggcgttgataacgccttgtagtccagaggaggaaaa

SEQ ID NO: 131164 - DNA, 75 bp, Artificial Sequence
  Synthetic
catctctccggcggtccagaccaactggcagaagcttgaagctttttgggcaaagcacatgtggaactttgtcag

SEQ ID NO: 131165 - DNA, 75 bp, Artificial Sequence
  Synthetic
tcgaggtggtgactagcacgtgggtgctggtaggcggtctcctggcggccctagctgcgtactgcttgtcagtgg

SEQ ID NO: 131166 - DNA, 75 bp, Artificial Sequence
  Synthetic
ttcgacagggtgcagctattagactcttactatgactcaaccttaaaggacatcaagctagcggcctccaaggtt

SEQ ID NO: 131167 - DNA, 75 bp, Artificial Sequence
  Synthetic
ggccgtgataagaacgaggtatcgggagaagtccaggtcctctcctctgtcacccaatccttcctaggaacatcc

SEQ ID NO: 131168 - DNA, 75 bp, Artificial Sequence
  Synthetic
agccagaccctcctcttcaacatcttgggagggtggtttgccgcccagattgccgcccccagcgccgctacggcc

SEQ ID NO: 131169 - DNA, 75 bp, Artificial Sequence
  Synthetic
aacagttcgacgagatggaggagtgctctaagcacctcccactagtcgagcatggtttgcagctagcagagcaat

SEQ ID NO: 131170 - DNA, 75 bp, Artificial Sequence
  Synthetic
tacagttcgacgagatggaggagtgctctaagcacctcccactagtcgagcatggtttgcagctagcagagcaat

SEQ ID NO: 131171 - DNA, 75 bp, Artificial Sequence
  Synthetic
cacagttcgacgagatggaggagtgctctaagcacctcccactagtcgagcatggtttgcagctagcagagcaat

SEQ ID NO: 131172 - DNA, 75 bp, Artificial Sequence
  Synthetic
gacagttcgacgagatggaggagtgctctaagcacctcccactagtcgagcatggtttgcagctagcagagcaat

SEQ ID NO: 131173 - DNA, 75 bp, Artificial Sequence
  Synthetic
tttgtgggcgccggtataaccggcgccgccattggcagcgtggggctggggaaggttctcgtggacatcctagca

SEQ ID NO: 131174 - DNA, 75 bp, Artificial Sequence
  Synthetic
ctctgcaagatccaaatacggatttggggccaaggaggtccgtagcttgtctaggagggccgtcaaccacatcca

SEQ ID NO: 131175 - DNA, 75 bp, Artificial Sequence
  Synthetic
acctcgtggggtggccttccccccccggtggaaagtccttagatccctgcacctgcggagcggtcgacctttacc

SEQ ID NO: 131176 - DNA, 75 bp, Artificial Sequence
  Synthetic
gtccgtgtgggaggacctcttagaagaccaagagacacctatcccgacaaccatcatggccaagaacgaggtgtt

SEQ ID NO: 131177 - DNA, 75 bp, Artificial Sequence
  Synthetic
gtccaaacatatgtggaacttcatcagtggcatccaataccttgccgggttatccaccttgcctggcaatcctgc

SEQ ID NO: 131178 - DNA, 75 bp, Artificial Sequence
  Synthetic
ccatcatggccaagaacgaggtgttctgcgtagatcccaccaagggtgggaagaaaccagctcgcctcatagtct

SEQ ID NO: 131179 - DNA, 75 bp, Artificial Sequence
  Synthetic
ctgcgtagatcccaccaagggtgggaagaaaccagctcgcctcatagtctatccagaccttggtgtccgagtctg

SEQ ID NO: 131180 - DNA, 75 bp, Artificial Sequence
  Synthetic
agtggcatccaataccttgccgggttatccaccttgcctggcaatcctgctatagcctccctcatgtccttcact

SEQ ID NO: 131181 - DNA, 75 bp, Artificial Sequence
  Synthetic
gccgcagtcacaagccccctgaccacccagcaaaccctcctatttaacatcttggggggatgggtggcgtcgcaa

SEQ ID NO: 131182 - DNA, 75 bp, Artificial Sequence
  Synthetic
cggcgggccagtgttatgcaccaggggacacgcagtggggatcttcagagcggctgtatgctccaggggtgtggc

SEQ ID NO: 131183 - DNA, 75 bp, Artificial Sequence
  Synthetic
ctgtacagtggatgaaccggctaatagcctttgcctcacggggcaaccacgtctctcccacacattacgtgcctg

SEQ ID NO: 131184 - DNA, 75 bp, Artificial Sequence
  Synthetic
ctgctgcgtgcgtggaaagaaaagaaggaacctatggggttctcttatgacacccgttgctttgactcaacagtc

SEQ ID NO: 131185 - DNA, 75 bp, Artificial Sequence
  Synthetic
aaattttgcaacagggaacttacccggttgctctttctctatcttcttgcttgctttgctctcttgcttggtctg

SEQ ID NO: 131186 - DNA, 75 bp, Artificial Sequence
  Synthetic
ccggctacggcgctggcgtagctggtgctgtggtcaccttcaaaatcatgagtggtgagatgccgaccacagagg

SEQ ID NO: 131187 - DNA, 75 bp, Artificial Sequence
  Synthetic
caagtgggctacctgcacgcccccacgggcagcgggaagagcaccaaggttcctgccgcatatgctgcacaggga

SEQ ID NO: 131188 - DNA, 75 bp, Artificial Sequence
  Synthetic
tgctgtggtcaccttcaaaatcatgagtggtgagatgccgaccacagaggacttggtgaacctgctgccggccat

SEQ ID NO: 131189 - DNA, 75 bp, Artificial Sequence
  Synthetic
tgggagggcccatgatgaacagcaaagggcaatcctgcggatacaggcgttgccgcgccagcggagtgctcacca

SEQ ID NO: 131190 - DNA, 75 bp, Artificial Sequence
  Synthetic
ttgcatttgccaggttgtgtgccctgcgttcaatcaggcaactcctcgcaatgctggattccggtggcaccaaca

SEQ ID NO: 131191 - DNA, 75 bp, Artificial Sequence
  Synthetic
taaggactgtgactaccggggaccccatcacctactccacgtacggcaaatttctcgcggacggaggttgctcat

SEQ ID NO: 131192 - DNA, 75 bp, Artificial Sequence
  Synthetic
tgcccgtgtggagctgaaatagctggacatgtcaagaacgggacgatgaggatcgttggtcccaaaacctgtagg

SEQ ID NO: 131193 - DNA, 75 bp, Artificial Sequence
  Synthetic
agttgtcatctcagagagtcaggggaccgacgaggatgaacggaacctgagagccttcacggaggctatgaccag

SEQ ID NO: 131194 - DNA, 75 bp, Artificial Sequence
  Synthetic
tgttgtcatctcagagagtcaggggaccgacgaggatgaacggaacctgagagccttcacggaggctatgaccag

SEQ ID NO: 131195 - DNA, 75 bp, Artificial Sequence
  Synthetic
cgttgtcatctcagagagtcaggggaccgacgaggatgaacggaacctgagagccttcacggaggctatgaccag

SEQ ID NO: 131196 - DNA, 75 bp, Artificial Sequence
  Synthetic
ggttgtcatctcagagagtcaggggaccgacgaggatgaacggaacctgagagccttcacggaggctatgaccag

SEQ ID NO: 131197 - DNA, 75 bp, Artificial Sequence
  Synthetic
atatgtgtggagccgtcttcttggtgggacaggctttcaccttcaggcctcgccagcacaacacggtgcagacct

SEQ ID NO: 131198 - DNA, 75 bp, Artificial Sequence
  Synthetic
gatccgacttgtggtgctagccacggctacgccccctggctcggtcacaaccccccaccccaacatagaggagtc

SEQ ID NO: 131199 - DNA, 75 bp, Artificial Sequence
  Synthetic
cagaggagtacgtggaggtaaggcgggtgggggacttccactatgtcacaggtatgaccagcgacaacatcaaat

SEQ ID NO: 131200 - DNA, 75 bp, Artificial Sequence
  Synthetic
gttgcggctgccccagaccatttttgacatcattgctggagctcactggggtatcatggccggtctggcctacta

SEQ ID NO: 131201 - DNA, 75 bp, Artificial Sequence
  Synthetic
tgcctgggagacagtaagacactcccctgtcaattcatggttgggaaacatcatccagtacgctccaacactatg

SEQ ID NO: 131202 - DNA, 75 bp, Artificial Sequence
  Synthetic
aagtgcgatgagctggcccccgcccttcggggcatgggccttaacgctgtcgcgtattacagaggtcttgacgtc

SEQ ID NO: 131203 - DNA, 75 bp, Artificial Sequence
  Synthetic
cacgttttcagtgggactccaccaatacccggtgggatcgcagctaccatgcgagcccgaaccggacgtagcggt

SEQ ID NO: 131204 - DNA, 75 bp, Artificial Sequence
  Synthetic
tggccacatcaagaacggctccatgaggatcgttgggccgaaaacctgcagcaacacttggcatggaacgtttcc

SEQ ID NO: 131205 - DNA, 75 bp, Artificial Sequence
  Synthetic
gtatcatggccggtctggcctactactctatgcagactaactgggctaaagtcttcattatcatcgtcatgttct

SEQ ID NO: 131206 - DNA, 75 bp, Artificial Sequence
  Synthetic
gctaattaacaccaacgggtcgtggcatatcaacagcactgccctgaactgcaaagactccctaaacaccggatt

SEQ ID NO: 131207 - DNA, 75 bp, Artificial Sequence
  Synthetic
gctaattaacaccaacgggtcgtggcatatcaacagcactgccctgaactgcaaagactcccttaacaccggatt

SEQ ID NO: 131208 - DNA, 75 bp, Artificial Sequence
  Synthetic
gctaattaacaccaacgggtcgtggcatatcaacagcactgccctgaactgcaaagactccctcaacaccggatt

SEQ ID NO: 131209 - DNA, 75 bp, Artificial Sequence
  Synthetic
gctaattaacaccaacgggtcgtggcatatcaacagcactgccctgaactgcaaagactccctgaacaccggatt

SEQ ID NO: 131210 - DNA, 75 bp, Artificial Sequence
  Synthetic
gtgaacccattggatctcccggccataattgagaggctacacgggcttgacgccttctcactgcacacatactct

SEQ ID NO: 131211 - DNA, 75 bp, Artificial Sequence
  Synthetic
cagtcacacagacagttgacttcagtctggatcctaccttcacaataaccacccaaacggttcctcaggactccg

SEQ ID NO: 131212 - DNA, 75 bp, Artificial Sequence
  Synthetic
agccaactgtctgctccatctctcaaggcaacctgtaccaccaaccacaactcccccgacgccgacctcatagag

SEQ ID NO: 131213 - DNA, 75 bp, Artificial Sequence
  Synthetic
cctttggggagtgctaacatctcaggcagctcagaggaccgaccatactgctggcactatccacccaggccttgc

SEQ ID NO: 131214 - DNA, 75 bp, Artificial Sequence
  Synthetic
tcaggctccatcggttcgctcccccacgcaaacccttgctaagggatgaggtgacattcgctgtaggtctcaaca

SEQ ID NO: 131215 - DNA, 75 bp, Artificial Sequence
  Synthetic
gactgggaggggtaggttgggcatctacaggttcgtctccgcgagtgagagaccatcgggcatgttcgattccgt

SEQ ID NO: 131216 - DNA, 75 bp, Artificial Sequence
  Synthetic
aggaggatgagcgggaaatatcaattccatcagaaatactgcaaccatctaagaggttcccctcggccttacccg

SEQ ID NO: 131217 - DNA, 75 bp, Artificial Sequence
  Synthetic
cccgtgtgtcaggaccatctggagttctgggaggcagtcttcaccggcctcacacacatagatgcccacttcctc

SEQ ID NO: 131218 - DNA, 75 bp, Artificial Sequence
  Synthetic
gggtcgccggttggccagggggtcaccaccttccctggccagttcctctgcgagccaattgtctgctccatctct

SEQ ID NO: 131219 - DNA, 75 bp, Artificial Sequence
  Synthetic
actttggcgagaacgaaacagacgtgttcctgcttgattcacaacgaccgccttcgggtaggtggttcgggtgcg

SEQ ID NO: 131220 - DNA, 75 bp, Artificial Sequence
  Synthetic
tctttggcgagaacgaaacagacgtgttcctgcttgattcacaacgaccgccttcgggtaggtggttcgggtgcg

SEQ ID NO: 131221 - DNA, 75 bp, Artificial Sequence
  Synthetic
cctttggcgagaacgaaacagacgtgttcctgcttgattcacaacgaccgccttcgggtaggtggttcgggtgcg

SEQ ID NO: 131222 - DNA, 75 bp, Artificial Sequence
  Synthetic
gctttggcgagaacgaaacagacgtgttcctgcttgattcacaacgaccgccttcgggtaggtggttcgggtgcg

SEQ ID NO: 131223 - DNA, 75 bp, Artificial Sequence
  Synthetic
tctgggaggcagtcttcaccggcctcacacacatagatgcccacttcctctcccaaaccaagcaagcaggagaga

SEQ ID NO: 131224 - DNA, 75 bp, Artificial Sequence
  Synthetic
tcctcctcccgtgccgccgcctcggaagaggcgcactgtggcgctgagcgagtcgaccgtgtccactgcccttgc

SEQ ID NO: 131225 - DNA, 75 bp, Artificial Sequence
  Synthetic
agtccaacctcttgtggggtacaggtgttaccagggttgagtctgaagagaaagtgatggtgctcgattctttcg

SEQ ID NO: 131226 - DNA, 75 bp, Artificial Sequence
  Synthetic
agtccaacctcttgtggggtactggtgttaccagggttgagtctgaagagaaagtgatggtgctcgattctttcg

SEQ ID NO: 131227 - DNA, 75 bp, Artificial Sequence
  Synthetic
agtccaacctcttgtggggtaccggtgttaccagggttgagtctgaagagaaagtgatggtgctcgattctttcg

SEQ ID NO: 131228 - DNA, 75 bp, Artificial Sequence
  Synthetic
agtccaacctcttgtggggtacgggtgttaccagggttgagtctgaagagaaagtgatggtgctcgattctttcg

SEQ ID NO: 131229 - DNA, 75 bp, Artificial Sequence
  Synthetic
acagcgtgtcgcgagctcgaccccgcttcttactcctttgcctactcctactcagcgtaggggtaggcatctttt

SEQ ID NO: 131230 - DNA, 75 bp, Artificial Sequence
  Synthetic
ccccactgactgcttcaggaagcaccccgatgcaacttaaggccggtgcggatccgggccctggcttacgccgag

SEQ ID NO: 131231 - DNA, 75 bp, Artificial Sequence
  Synthetic
ccccactgactgcttcaggaagcaccccgatgcaacttatggccggtgcggatccgggccctggcttacgccgag

SEQ ID NO: 131232 - DNA, 75 bp, Artificial Sequence
  Synthetic
ccccactgactgcttcaggaagcaccccgatgcaacttacggccggtgcggatccgggccctggcttacgccgag

SEQ ID NO: 131233 - DNA, 75 bp, Artificial Sequence
  Synthetic
ccccactgactgcttcaggaagcaccccgatgcaacttagggccggtgcggatccgggccctggcttacgccgag

SEQ ID NO: 131234 - DNA, 75 bp, Artificial Sequence
  Synthetic
ccccactgactgcttcaggaagcaccccgatgctacttaaggccggtgcggatccgggccctggcttacgccgag

SEQ ID NO: 131235 - DNA, 75 bp, Artificial Sequence
  Synthetic
ccccactgactgcttcaggaagcaccccgatgctacttatggccggtgcggatccgggccctggcttacgccgag

SEQ ID NO: 131236 - DNA, 75 bp, Artificial Sequence
  Synthetic
ccccactgactgcttcaggaagcaccccgatgctacttacggccggtgcggatccgggccctggcttacgccgag

SEQ ID NO: 131237 - DNA, 75 bp, Artificial Sequence
  Synthetic
ccccactgactgcttcaggaagcaccccgatgctacttagggccggtgcggatccgggccctggcttacgccgag

SEQ ID NO: 131238 - DNA, 75 bp, Artificial Sequence
  Synthetic
ccccactgactgcttcaggaagcaccccgatgccacttaaggccggtgcggatccgggccctggcttacgccgag

SEQ ID NO: 131239 - DNA, 75 bp, Artificial Sequence
  Synthetic
ccccactgactgcttcaggaagcaccccgatgccacttatggccggtgcggatccgggccctggcttacgccgag

SEQ ID NO: 131240 - DNA, 75 bp, Artificial Sequence
  Synthetic
ccccactgactgcttcaggaagcaccccgatgccacttacggccggtgcggatccgggccctggcttacgccgag

SEQ ID NO: 131241 - DNA, 75 bp, Artificial Sequence
  Synthetic
ccccactgactgcttcaggaagcaccccgatgccacttagggccggtgcggatccgggccctggcttacgccgag

SEQ ID NO: 131242 - DNA, 75 bp, Artificial Sequence
  Synthetic
ccccactgactgcttcaggaagcaccccgatgcgacttaaggccggtgcggatccgggccctggcttacgccgag

SEQ ID NO: 131243 - DNA, 75 bp, Artificial Sequence
  Synthetic
ccccactgactgcttcaggaagcaccccgatgcgacttatggccggtgcggatccgggccctggcttacgccgag

SEQ ID NO: 131244 - DNA, 75 bp, Artificial Sequence
  Synthetic
ccccactgactgcttcaggaagcaccccgatgcgacttacggccggtgcggatccgggccctggcttacgccgag

SEQ ID NO: 131245 - DNA, 75 bp, Artificial Sequence
  Synthetic
ccccactgactgcttcaggaagcaccccgatgcgacttagggccggtgcggatccgggccctggcttacgccgag

SEQ ID NO: 131246 - DNA, 75 bp, Artificial Sequence
  Synthetic
acccacactgactggccccactcctctcctataccgtctcggtgcggtgagcaatgaggtcacattaacacatcc

SEQ ID NO: 131247 - DNA, 75 bp, Artificial Sequence
  Synthetic
gaatccgacgctgggtcttactcctccatgcccccccttgagggggagcctggggatcctgacctcagtgatgga

SEQ ID NO: 131248 - DNA, 75 bp, Artificial Sequence
  Synthetic
gccagattacaacccacccttggttgacaggtggaagcagccgagctacgaccccccggtcgttcacggctgcgc

SEQ ID NO: 131249 - DNA, 75 bp, Artificial Sequence
  Synthetic
ttcacggctgcctgtaactggactagaggagagcgctgcgatattgaggaccgggatcgtagtgagcagcatccg

SEQ ID NO: 131250 - DNA, 75 bp, Artificial Sequence
  Synthetic
tgcctagcaacgggctgcgtggtcatcattggccgcgtatgtgtgaatcaacggacggtagtggctcctgacaag

SEQ ID NO: 131251 - DNA, 75 bp, Artificial Sequence
  Synthetic
tctaccgcccaagaagccgacccccgtcccccctcctaggaggaaacggacggtcgtgctttccgagtcgacggt

SEQ ID NO: 131252 - DNA, 75 bp, Artificial Sequence
  Synthetic
aggaagaaaaactacccatcaatgctttaagcaactcgctgctgcgccaccataatctggtgtacgccaccactt

SEQ ID NO: 131253 - DNA, 75 bp, Artificial Sequence
  Synthetic
acgtccaatacctctatggtgttgggtctggcttggtgggctgggctttaaagtgggagttcgtcgtactcatat

SEQ ID NO: 131254 - DNA, 75 bp, Artificial Sequence
  Synthetic
ccagaccctgtcattgtggacgatcgatctgaagatggatcattttcatcaatgcctccactggaaggggagccc

SEQ ID NO: 131255 - DNA, 75 bp, Artificial Sequence
  Synthetic
ttcaaggcctattacaacaggcctcgaagcaagcacaggacatacagcctgccatccagtcatcgtggcctaagc

SEQ ID NO: 131256 - DNA, 75 bp, Artificial Sequence
  Synthetic
gaaagtgacgtttgacagaatgcaagttctagacagtcactacaatgatgtcctaaaggaggtgaaggctaaggc

SEQ ID NO: 131257 - DNA, 75 bp, Artificial Sequence
  Synthetic
gatctgaagatggatcattttcatcaatgcctccactggaaggggagcccggagacccagacctgactgcagact

SEQ ID NO: 131258 - DNA, 75 bp, Artificial Sequence
  Synthetic
gtgtcccttgcgttcgcgagggtaatgcctcgaggtgttgggtggcggtaacccccacggtggccaccagggacg

SEQ ID NO: 131259 - DNA, 75 bp, Artificial Sequence
  Synthetic
tgtctccgtcgccggaacgcacggagtcggctggtacttagtggttttctgtgctgcgtggcatgtgcggggcaa

SEQ ID NO: 131260 - DNA, 75 bp, Artificial Sequence
  Synthetic
gatggcgttcagcgccgcattaaccagccccctacccactagcaccaccatcctcctaaacatcatggggggttg

SEQ ID NO: 131261 - DNA, 75 bp, Artificial Sequence
  Synthetic
accacatcaactccgtgtggcaagaccttctggaagacaatgtaacaccaattgacactaccatcatggcaaaga

SEQ ID NO: 131262 - DNA, 75 bp, Artificial Sequence
  Synthetic
ttcgaccgactccaggtggttgacagtcattattatggtgttctaaaggagattaaggcccgagcgtccaccgtg

SEQ ID NO: 131263 - DNA, 75 bp, Artificial Sequence
  Synthetic
agtgctacccttggagccgggttactggctattttagggttttttaccttgtcaccttggtaaaagcactggata

SEQ ID NO: 131264 - DNA, 75 bp, Artificial Sequence
  Synthetic
agtgctacccttggagccgggttactggctattttagggttttttaccttgtcaccttggtataagcactggata

SEQ ID NO: 131265 - DNA, 75 bp, Artificial Sequence
  Synthetic
agtgctacccttggagccgggttactggctattttagggttttttaccttgtcaccttggtacaagcactggata

SEQ ID NO: 131266 - DNA, 75 bp, Artificial Sequence
  Synthetic
agtgctacccttggagccgggttactggctattttagggttttttaccttgtcaccttggtagaagcactggata

SEQ ID NO: 131267 - DNA, 75 bp, Artificial Sequence
  Synthetic
agtgctacccttggagccgggttactggctatttttgggttttttaccttgtcaccttggtaaaagcactggata

SEQ ID NO: 131268 - DNA, 75 bp, Artificial Sequence
  Synthetic
agtgctacccttggagccgggttactggctatttttgggttttttaccttgtcaccttggtataagcactggata

SEQ ID NO: 131269 - DNA, 75 bp, Artificial Sequence
  Synthetic
agtgctacccttggagccgggttactggctatttttgggttttttaccttgtcaccttggtacaagcactggata

SEQ ID NO: 131270 - DNA, 75 bp, Artificial Sequence
  Synthetic
agtgctacccttggagccgggttactggctatttttgggttttttaccttgtcaccttggtagaagcactggata

SEQ ID NO: 131271 - DNA, 75 bp, Artificial Sequence
  Synthetic
agtgctacccttggagccgggttactggctattttcgggttttttaccttgtcaccttggtaaaagcactggata

SEQ ID NO: 131272 - DNA, 75 bp, Artificial Sequence
  Synthetic
agtgctacccttggagccgggttactggctattttcgggttttttaccttgtcaccttggtataagcactggata

SEQ ID NO: 131273 - DNA, 75 bp, Artificial Sequence
  Synthetic
agtgctacccttggagccgggttactggctattttcgggttttttaccttgtcaccttggtacaagcactggata

SEQ ID NO: 131274 - DNA, 75 bp, Artificial Sequence
  Synthetic
agtgctacccttggagccgggttactggctattttcgggttttttaccttgtcaccttggtagaagcactggata

SEQ ID NO: 131275 - DNA, 75 bp, Artificial Sequence
  Synthetic
agtgctacccttggagccgggttactggctattttggggttttttaccttgtcaccttggtaaaagcactggata

SEQ ID NO: 131276 - DNA, 75 bp, Artificial Sequence
  Synthetic
agtgctacccttggagccgggttactggctattttggggttttttaccttgtcaccttggtataagcactggata

SEQ ID NO: 131277 - DNA, 75 bp, Artificial Sequence
  Synthetic
agtgctacccttggagccgggttactggctattttggggttttttaccttgtcaccttggtacaagcactggata

SEQ ID NO: 131278 - DNA, 75 bp, Artificial Sequence
  Synthetic
agtgctacccttggagccgggttactggctattttggggttttttaccttgtcaccttggtagaagcactggata

SEQ ID NO: 131279 - DNA, 75 bp, Artificial Sequence
  Synthetic
agtgctacccttggagccgggttactggcttttttagggttttttaccttgtcaccttggtaaaagcactggata

SEQ ID NO: 131280 - DNA, 75 bp, Artificial Sequence
  Synthetic
agtgctacccttggagccgggttactggcttttttagggttttttaccttgtcaccttggtataagcactggata

SEQ ID NO: 131281 - DNA, 75 bp, Artificial Sequence
  Synthetic
agtgctacccttggagccgggttactggcttttttagggttttttaccttgtcaccttggtacaagcactggata

SEQ ID NO: 131282 - DNA, 75 bp, Artificial Sequence
  Synthetic
agtgctacccttggagccgggttactggcttttttagggttttttaccttgtcaccttggtagaagcactggata

SEQ ID NO: 131283 - DNA, 75 bp, Artificial Sequence
  Synthetic
agtgctacccttggagccgggttactggctttttttgggttttttaccttgtcaccttggtaaaagcactggata

SEQ ID NO: 131284 - DNA, 75 bp, Artificial Sequence
  Synthetic
agtgctacccttggagccgggttactggctttttttgggttttttaccttgtcaccttggtataagcactggata

SEQ ID NO: 131285 - DNA, 75 bp, Artificial Sequence
  Synthetic
agtgctacccttggagccgggttactggctttttttgggttttttaccttgtcaccttggtacaagcactggata

SEQ ID NO: 131286 - DNA, 75 bp, Artificial Sequence
  Synthetic
agtgctacccttggagccgggttactggctttttttgggttttttaccttgtcaccttggtagaagcactggata

SEQ ID NO: 131287 - DNA, 75 bp, Artificial Sequence
  Synthetic
agtgctacccttggagccgggttactggcttttttcgggttttttaccttgtcaccttggtaaaagcactggata

SEQ ID NO: 131288 - DNA, 75 bp, Artificial Sequence
  Synthetic
agtgctacccttggagccgggttactggcttttttcgggttttttaccttgtcaccttggtataagcactggata

SEQ ID NO: 131289 - DNA, 75 bp, Artificial Sequence
  Synthetic
agtgctacccttggagccgggttactggcttttttcgggttttttaccttgtcaccttggtacaagcactggata

SEQ ID NO: 131290 - DNA, 75 bp, Artificial Sequence
  Synthetic
agtgctacccttggagccgggttactggcttttttcgggttttttaccttgtcaccttggtagaagcactggata

SEQ ID NO: 131291 - DNA, 75 bp, Artificial Sequence
  Synthetic
agtgctacccttggagccgggttactggcttttttggggttttttaccttgtcaccttggtaaaagcactggata

SEQ ID NO: 131292 - DNA, 75 bp, Artificial Sequence
  Synthetic
agtgctacccttggagccgggttactggcttttttggggttttttaccttgtcaccttggtataagcactggata

SEQ ID NO: 131293 - DNA, 75 bp, Artificial Sequence
  Synthetic
agtgctacccttggagccgggttactggcttttttggggttttttaccttgtcaccttggtacaagcactggata

SEQ ID NO: 131294 - DNA, 75 bp, Artificial Sequence
  Synthetic
agtgctacccttggagccgggttactggcttttttggggttttttaccttgtcaccttggtagaagcactggata

SEQ ID NO: 131295 - DNA, 75 bp, Artificial Sequence
  Synthetic
agtgctacccttggagccgggttactggctcttttagggttttttaccttgtcaccttggtaaaagcactggata

SEQ ID NO: 131296 - DNA, 75 bp, Artificial Sequence
  Synthetic
agtgctacccttggagccgggttactggctcttttagggttttttaccttgtcaccttggtataagcactggata

SEQ ID NO: 131297 - DNA, 75 bp, Artificial Sequence
  Synthetic
agtgctacccttggagccgggttactggctcttttagggttttttaccttgtcaccttggtacaagcactggata

SEQ ID NO: 131298 - DNA, 75 bp, Artificial Sequence
  Synthetic
agtgctacccttggagccgggttactggctcttttagggttttttaccttgtcaccttggtagaagcactggata

SEQ ID NO: 131299 - DNA, 75 bp, Artificial Sequence
  Synthetic
agtgctacccttggagccgggttactggctctttttgggttttttaccttgtcaccttggtaaaagcactggata

SEQ ID NO: 131300 - DNA, 75 bp, Artificial Sequence
  Synthetic
agtgctacccttggagccgggttactggctctttttgggttttttaccttgtcaccttggtataagcactggata

SEQ ID NO: 131301 - DNA, 75 bp, Artificial Sequence
  Synthetic
agtgctacccttggagccgggttactggctctttttgggttttttaccttgtcaccttggtacaagcactggata

SEQ ID NO: 131302 - DNA, 75 bp, Artificial Sequence
  Synthetic
agtgctacccttggagccgggttactggctctttttgggttttttaccttgtcaccttggtagaagcactggata

SEQ ID NO: 131303 - DNA, 75 bp, Artificial Sequence
  Synthetic
agtgctacccttggagccgggttactggctcttttcgggttttttaccttgtcaccttggtaaaagcactggata

SEQ ID NO: 131304 - DNA, 75 bp, Artificial Sequence
  Synthetic
agtgctacccttggagccgggttactggctcttttcgggttttttaccttgtcaccttggtataagcactggata

SEQ ID NO: 131305 - DNA, 75 bp, Artificial Sequence
  Synthetic
agtgctacccttggagccgggttactggctcttttcgggttttttaccttgtcaccttggtacaagcactggata

SEQ ID NO: 131306 - DNA, 75 bp, Artificial Sequence
  Synthetic
agtgctacccttggagccgggttactggctcttttcgggttttttaccttgtcaccttggtagaagcactggata

SEQ ID NO: 131307 - DNA, 75 bp, Artificial Sequence
  Synthetic
agtgctacccttggagccgggttactggctcttttggggttttttaccttgtcaccttggtaaaagcactggata

SEQ ID NO: 131308 - DNA, 75 bp, Artificial Sequence
  Synthetic
agtgctacccttggagccgggttactggctcttttggggttttttaccttgtcaccttggtataagcactggata

SEQ ID NO: 131309 - DNA, 75 bp, Artificial Sequence
  Synthetic
agtgctacccttggagccgggttactggctcttttggggttttttaccttgtcaccttggtacaagcactggata

SEQ ID NO: 131310 - DNA, 75 bp, Artificial Sequence
  Synthetic
agtgctacccttggagccgggttactggctcttttggggttttttaccttgtcaccttggtagaagcactggata

SEQ ID NO: 131311 - DNA, 75 bp, Artificial Sequence
  Synthetic
agtgctacccttggagccgggttactggctgttttagggttttttaccttgtcaccttggtaaaagcactggata

SEQ ID NO: 131312 - DNA, 75 bp, Artificial Sequence
  Synthetic
agtgctacccttggagccgggttactggctgttttagggttttttaccttgtcaccttggtataagcactggata

SEQ ID NO: 131313 - DNA, 75 bp, Artificial Sequence
  Synthetic
agtgctacccttggagccgggttactggctgttttagggttttttaccttgtcaccttggtacaagcactggata

SEQ ID NO: 131314 - DNA, 75 bp, Artificial Sequence
  Synthetic
agtgctacccttggagccgggttactggctgttttagggttttttaccttgtcaccttggtagaagcactggata

SEQ ID NO: 131315 - DNA, 75 bp, Artificial Sequence
  Synthetic
agtgctacccttggagccgggttactggctgtttttgggttttttaccttgtcaccttggtaaaagcactggata

SEQ ID NO: 131316 - DNA, 75 bp, Artificial Sequence
  Synthetic
agtgctacccttggagccgggttactggctgtttttgggttttttaccttgtcaccttggtataagcactggata

SEQ ID NO: 131317 - DNA, 75 bp, Artificial Sequence
  Synthetic
agtgctacccttggagccgggttactggctgtttttgggttttttaccttgtcaccttggtacaagcactggata

SEQ ID NO: 131318 - DNA, 75 bp, Artificial Sequence
  Synthetic
agtgctacccttggagccgggttactggctgtttttgggttttttaccttgtcaccttggtagaagcactggata

SEQ ID NO: 131319 - DNA, 75 bp, Artificial Sequence
  Synthetic
agtgctacccttggagccgggttactggctgttttcgggttttttaccttgtcaccttggtaaaagcactggata

SEQ ID NO: 131320 - DNA, 75 bp, Artificial Sequence
  Synthetic
agtgctacccttggagccgggttactggctgttttcgggttttttaccttgtcaccttggtataagcactggata

SEQ ID NO: 131321 - DNA, 75 bp, Artificial Sequence
  Synthetic
agtgctacccttggagccgggttactggctgttttcgggttttttaccttgtcaccttggtacaagcactggata

SEQ ID NO: 131322 - DNA, 75 bp, Artificial Sequence
  Synthetic
agtgctacccttggagccgggttactggctgttttcgggttttttaccttgtcaccttggtagaagcactggata

SEQ ID NO: 131323 - DNA, 75 bp, Artificial Sequence
  Synthetic
agtgctacccttggagccgggttactggctgttttggggttttttaccttgtcaccttggtaaaagcactggata

SEQ ID NO: 131324 - DNA, 75 bp, Artificial Sequence
  Synthetic
agtgctacccttggagccgggttactggctgttttggggttttttaccttgtcaccttggtataagcactggata

SEQ ID NO: 131325 - DNA, 75 bp, Artificial Sequence
  Synthetic
agtgctacccttggagccgggttactggctgttttggggttttttaccttgtcaccttggtacaagcactggata

SEQ ID NO: 131326 - DNA, 75 bp, Artificial Sequence
  Synthetic
agtgctacccttggagccgggttactggctgttttggggttttttaccttgtcaccttggtagaagcactggata

SEQ ID NO: 131327 - DNA, 75 bp, Artificial Sequence
  Synthetic
gtggatgtgctggctggctatggcgccggaatatcaggcgccctcgtcgcttttaagatcatgagcggcgagaag

SEQ ID NO: 131328 - DNA, 75 bp, Artificial Sequence
  Synthetic
gtacaatgtggtgaaaaagcttcccatagccgtgatgggatctgcctacggtttccagtactcgccatcgcagcg

SEQ ID NO: 131329 - DNA, 75 bp, Artificial Sequence
  Synthetic
ccattctgctagtcagtctactacatccatccttggtattagaaatcaccaagatactgatagctgtgatgggac

SEQ ID NO: 131330 - DNA, 75 bp, Artificial Sequence
  Synthetic
ccattctgctagtcagtctactacatccatccttggtattagaaatcaccaagatactgatagctgtgttgggac

SEQ ID NO: 131331 - DNA, 75 bp, Artificial Sequence
  Synthetic
ccattctgctagtcagtctactacatccatccttggtattagaaatcaccaagatactgatagctgtgctgggac

SEQ ID NO: 131332 - DNA, 75 bp, Artificial Sequence
  Synthetic
ccattctgctagtcagtctactacatccatccttggtattagaaatcaccaagatactgatagctgtggtgggac

SEQ ID NO: 131333 - DNA, 75 bp, Artificial Sequence
  Synthetic
ccattctgctagtcagtctactacatccatccttggtattagatatcaccaagatactgatagctgtgatgggac

SEQ ID NO: 131334 - DNA, 75 bp, Artificial Sequence
  Synthetic
ccattctgctagtcagtctactacatccatccttggtattagatatcaccaagatactgatagctgtgttgggac

SEQ ID NO: 131335 - DNA, 75 bp, Artificial Sequence
  Synthetic
ccattctgctagtcagtctactacatccatccttggtattagatatcaccaagatactgatagctgtgctgggac

SEQ ID NO: 131336 - DNA, 75 bp, Artificial Sequence
  Synthetic
ccattctgctagtcagtctactacatccatccttggtattagatatcaccaagatactgatagctgtggtgggac

SEQ ID NO: 131337 - DNA, 75 bp, Artificial Sequence
  Synthetic
ccattctgctagtcagtctactacatccatccttggtattagacatcaccaagatactgatagctgtgatgggac

SEQ ID NO: 131338 - DNA, 75 bp, Artificial Sequence
  Synthetic
ccattctgctagtcagtctactacatccatccttggtattagacatcaccaagatactgatagctgtgttgggac

SEQ ID NO: 131339 - DNA, 75 bp, Artificial Sequence
  Synthetic
ccattctgctagtcagtctactacatccatccttggtattagacatcaccaagatactgatagctgtgctgggac

SEQ ID NO: 131340 - DNA, 75 bp, Artificial Sequence
  Synthetic
ccattctgctagtcagtctactacatccatccttggtattagacatcaccaagatactgatagctgtggtgggac

SEQ ID NO: 131341 - DNA, 75 bp, Artificial Sequence
  Synthetic
ccattctgctagtcagtctactacatccatccttggtattagagatcaccaagatactgatagctgtgatgggac

SEQ ID NO: 131342 - DNA, 75 bp, Artificial Sequence
  Synthetic
ccattctgctagtcagtctactacatccatccttggtattagagatcaccaagatactgatagctgtgttgggac

SEQ ID NO: 131343 - DNA, 75 bp, Artificial Sequence
  Synthetic
ccattctgctagtcagtctactacatccatccttggtattagagatcaccaagatactgatagctgtgctgggac

SEQ ID NO: 131344 - DNA, 75 bp, Artificial Sequence
  Synthetic
ccattctgctagtcagtctactacatccatccttggtattagagatcaccaagatactgatagctgtggtgggac

SEQ ID NO: 131345 - DNA, 75 bp, Artificial Sequence
  Synthetic
ccattctgctagtcagtctactacatccatccttggtatttgaaatcaccaagatactgatagctgtgatgggac

SEQ ID NO: 131346 - DNA, 75 bp, Artificial Sequence
  Synthetic
ccattctgctagtcagtctactacatccatccttggtatttgaaatcaccaagatactgatagctgtgttgggac

SEQ ID NO: 131347 - DNA, 75 bp, Artificial Sequence
  Synthetic
ccattctgctagtcagtctactacatccatccttggtatttgaaatcaccaagatactgatagctgtgctgggac

SEQ ID NO: 131348 - DNA, 75 bp, Artificial Sequence
  Synthetic
ccattctgctagtcagtctactacatccatccttggtatttgaaatcaccaagatactgatagctgtggtgggac

SEQ ID NO: 131349 - DNA, 75 bp, Artificial Sequence
  Synthetic
ccattctgctagtcagtctactacatccatccttggtatttgatatcaccaagatactgatagctgtgatgggac

SEQ ID NO: 131350 - DNA, 75 bp, Artificial Sequence
  Synthetic
ccattctgctagtcagtctactacatccatccttggtatttgatatcaccaagatactgatagctgtgttgggac

SEQ ID NO: 131351 - DNA, 75 bp, Artificial Sequence
  Synthetic
ccattctgctagtcagtctactacatccatccttggtatttgatatcaccaagatactgatagctgtgctgggac

SEQ ID NO: 131352 - DNA, 75 bp, Artificial Sequence
  Synthetic
ccattctgctagtcagtctactacatccatccttggtatttgatatcaccaagatactgatagctgtggtgggac

SEQ ID NO: 131353 - DNA, 75 bp, Artificial Sequence
  Synthetic
ccattctgctagtcagtctactacatccatccttggtatttgacatcaccaagatactgatagctgtgatgggac

SEQ ID NO: 131354 - DNA, 75 bp, Artificial Sequence
  Synthetic
ccattctgctagtcagtctactacatccatccttggtatttgacatcaccaagatactgatagctgtgttgggac

SEQ ID NO: 131355 - DNA, 75 bp, Artificial Sequence
  Synthetic
ccattctgctagtcagtctactacatccatccttggtatttgacatcaccaagatactgatagctgtgctgggac

SEQ ID NO: 131356 - DNA, 75 bp, Artificial Sequence
  Synthetic
ccattctgctagtcagtctactacatccatccttggtatttgacatcaccaagatactgatagctgtggtgggac

SEQ ID NO: 131357 - DNA, 75 bp, Artificial Sequence
  Synthetic
ccattctgctagtcagtctactacatccatccttggtatttgagatcaccaagatactgatagctgtgatgggac

SEQ ID NO: 131358 - DNA, 75 bp, Artificial Sequence
  Synthetic
ccattctgctagtcagtctactacatccatccttggtatttgagatcaccaagatactgatagctgtgttgggac

SEQ ID NO: 131359 - DNA, 75 bp, Artificial Sequence
  Synthetic
ccattctgctagtcagtctactacatccatccttggtatttgagatcaccaagatactgatagctgtgctgggac

SEQ ID NO: 131360 - DNA, 75 bp, Artificial Sequence
  Synthetic
ccattctgctagtcagtctactacatccatccttggtatttgagatcaccaagatactgatagctgtggtgggac

SEQ ID NO: 131361 - DNA, 75 bp, Artificial Sequence
  Synthetic
ccattctgctagtcagtctactacatccatccttggtattcgaaatcaccaagatactgatagctgtgatgggac

SEQ ID NO: 131362 - DNA, 75 bp, Artificial Sequence
  Synthetic
ccattctgctagtcagtctactacatccatccttggtattcgaaatcaccaagatactgatagctgtgttgggac

SEQ ID NO: 131363 - DNA, 75 bp, Artificial Sequence
  Synthetic
ccattctgctagtcagtctactacatccatccttggtattcgaaatcaccaagatactgatagctgtgctgggac

SEQ ID NO: 131364 - DNA, 75 bp, Artificial Sequence
  Synthetic
ccattctgctagtcagtctactacatccatccttggtattcgaaatcaccaagatactgatagctgtggtgggac

SEQ ID NO: 131365 - DNA, 75 bp, Artificial Sequence
  Synthetic
ccattctgctagtcagtctactacatccatccttggtattcgatatcaccaagatactgatagctgtgatgggac

SEQ ID NO: 131366 - DNA, 75 bp, Artificial Sequence
  Synthetic
ccattctgctagtcagtctactacatccatccttggtattcgatatcaccaagatactgatagctgtgttgggac

SEQ ID NO: 131367 - DNA, 75 bp, Artificial Sequence
  Synthetic
ccattctgctagtcagtctactacatccatccttggtattcgatatcaccaagatactgatagctgtgctgggac

SEQ ID NO: 131368 - DNA, 75 bp, Artificial Sequence
  Synthetic
ccattctgctagtcagtctactacatccatccttggtattcgatatcaccaagatactgatagctgtggtgggac

SEQ ID NO: 131369 - DNA, 75 bp, Artificial Sequence
  Synthetic
ccattctgctagtcagtctactacatccatccttggtattcgacatcaccaagatactgatagctgtgatgggac

SEQ ID NO: 131370 - DNA, 75 bp, Artificial Sequence
  Synthetic
ccattctgctagtcagtctactacatccatccttggtattcgacatcaccaagatactgatagctgtgttgggac

SEQ ID NO: 131371 - DNA, 75 bp, Artificial Sequence
  Synthetic
ccattctgctagtcagtctactacatccatccttggtattcgacatcaccaagatactgatagctgtgctgggac

SEQ ID NO: 131372 - DNA, 75 bp, Artificial Sequence
  Synthetic
ccattctgctagtcagtctactacatccatccttggtattcgacatcaccaagatactgatagctgtggtgggac

SEQ ID NO: 131373 - DNA, 75 bp, Artificial Sequence
  Synthetic
ccattctgctagtcagtctactacatccatccttggtattcgagatcaccaagatactgatagctgtgatgggac

SEQ ID NO: 131374 - DNA, 75 bp, Artificial Sequence
  Synthetic
ccattctgctagtcagtctactacatccatccttggtattcgagatcaccaagatactgatagctgtgttgggac

SEQ ID NO: 131375 - DNA, 75 bp, Artificial Sequence
  Synthetic
ccattctgctagtcagtctactacatccatccttggtattcgagatcaccaagatactgatagctgtgctgggac

SEQ ID NO: 131376 - DNA, 75 bp, Artificial Sequence
  Synthetic
ccattctgctagtcagtctactacatccatccttggtattcgagatcaccaagatactgatagctgtggtgggac

SEQ ID NO: 131377 - DNA, 75 bp, Artificial Sequence
  Synthetic
ccattctgctagtcagtctactacatccatccttggtattggaaatcaccaagatactgatagctgtgatgggac

SEQ ID NO: 131378 - DNA, 75 bp, Artificial Sequence
  Synthetic
ccattctgctagtcagtctactacatccatccttggtattggaaatcaccaagatactgatagctgtgttgggac

SEQ ID NO: 131379 - DNA, 75 bp, Artificial Sequence
  Synthetic
ccattctgctagtcagtctactacatccatccttggtattggaaatcaccaagatactgatagctgtgctgggac

SEQ ID NO: 131380 - DNA, 75 bp, Artificial Sequence
  Synthetic
ccattctgctagtcagtctactacatccatccttggtattggaaatcaccaagatactgatagctgtggtgggac

SEQ ID NO: 131381 - DNA, 75 bp, Artificial Sequence
  Synthetic
ccattctgctagtcagtctactacatccatccttggtattggatatcaccaagatactgatagctgtgatgggac

SEQ ID NO: 131382 - DNA, 75 bp, Artificial Sequence
  Synthetic
ccattctgctagtcagtctactacatccatccttggtattggatatcaccaagatactgatagctgtgttgggac

SEQ ID NO: 131383 - DNA, 75 bp, Artificial Sequence
  Synthetic
ccattctgctagtcagtctactacatccatccttggtattggatatcaccaagatactgatagctgtgctgggac

SEQ ID NO: 131384 - DNA, 75 bp, Artificial Sequence
  Synthetic
ccattctgctagtcagtctactacatccatccttggtattggatatcaccaagatactgatagctgtggtgggac

SEQ ID NO: 131385 - DNA, 75 bp, Artificial Sequence
  Synthetic
ccattctgctagtcagtctactacatccatccttggtattggacatcaccaagatactgatagctgtgatgggac

SEQ ID NO: 131386 - DNA, 75 bp, Artificial Sequence
  Synthetic
ccattctgctagtcagtctactacatccatccttggtattggacatcaccaagatactgatagctgtgttgggac

SEQ ID NO: 131387 - DNA, 75 bp, Artificial Sequence
  Synthetic
ccattctgctagtcagtctactacatccatccttggtattggacatcaccaagatactgatagctgtgctgggac

SEQ ID NO: 131388 - DNA, 75 bp, Artificial Sequence
  Synthetic
ccattctgctagtcagtctactacatccatccttggtattggacatcaccaagatactgatagctgtggtgggac

SEQ ID NO: 131389 - DNA, 75 bp, Artificial Sequence
  Synthetic
ccattctgctagtcagtctactacatccatccttggtattggagatcaccaagatactgatagctgtgatgggac

SEQ ID NO: 131390 - DNA, 75 bp, Artificial Sequence
  Synthetic
ccattctgctagtcagtctactacatccatccttggtattggagatcaccaagatactgatagctgtgttgggac

SEQ ID NO: 131391 - DNA, 75 bp, Artificial Sequence
  Synthetic
ccattctgctagtcagtctactacatccatccttggtattggagatcaccaagatactgatagctgtgctgggac

SEQ ID NO: 131392 - DNA, 75 bp, Artificial Sequence
  Synthetic
ccattctgctagtcagtctactacatccatccttggtattggagatcaccaagatactgatagctgtggtgggac

SEQ ID NO: 131393 - DNA, 75 bp, Artificial Sequence
  Synthetic
gccagggggaaggcgcggtccagtggatgaacaggctgatcgcctttgcgtccagagggaaccacgtcgccccca

SEQ ID NO: 131394 - DNA, 75 bp, Artificial Sequence
  Synthetic
cgtacggaagaggcagtttaccaatgttgtgacttggacccccaggcccgcaaggccataaggtcgctcaccgag

SEQ ID NO: 131395 - DNA, 75 bp, Artificial Sequence
  Synthetic
gatgaacaggctgatcgcctttgcgtccagagggaaccacgtcgcccccactcattacgtggtggagtcagatgc

SEQ ID NO: 131396 - DNA, 75 bp, Artificial Sequence
  Synthetic
cgaaagtcagcccgcctgatcgtatatccggatctaggggtccgggtttgcgagaagcgagcgctttatgacgtc

SEQ ID NO: 131397 - DNA, 75 bp, Artificial Sequence
  Synthetic
aagtggtgattctggactccttcgatccgcttgtagcggaggaggacgagcgggagatctccgtacccgcagaga

SEQ ID NO: 131398 - DNA, 75 bp, Artificial Sequence
  Synthetic
taagagcggcatttaccaccttaccaatgactgcccaaacagcagcatcgtgtacgaggctgagacagttatcct

SEQ ID NO: 131399 - DNA, 75 bp, Artificial Sequence
  Synthetic
aaaatactgccaactaatcatactgagtgtcggccggtggtttaacacctacctctatgaccaccttacgccgat

SEQ ID NO: 131400 - DNA, 75 bp, Artificial Sequence
  Synthetic
caccggctggatagcagggcttttctattacaacaaattcaattcttcaggctgtcccgagaggttggccagctg

SEQ ID NO: 131401 - DNA, 75 bp, Artificial Sequence
  Synthetic
ggatcatggcttcgagacatctgggactggatttgttccattcttgcagactttaagaactggttatctgcaaag

SEQ ID NO: 131402 - DNA, 75 bp, Artificial Sequence
  Synthetic
gggtccccatgggattctcatatgacacccgctgctttgactctactgtgactgagaaagacatcagggtcgagg

SEQ ID NO: 131403 - DNA, 75 bp, Artificial Sequence
  Synthetic
actggatttgttccattcttgcagactttaagaactggttatctgcaaagcttctcccgaagctgcccggcatcc

SEQ ID NO: 131404 - DNA, 75 bp, Artificial Sequence
  Synthetic
acggcggcctgcggagatatcttgtgcgggctgcctgtatctgcgcggttagggcgggaactactcttgggccct

SEQ ID NO: 131405 - DNA, 75 bp, Artificial Sequence
  Synthetic
tgccgcgcgagcggggtttttaccaccagcttcgggaacacactgacgtgcttccctaaggccacggccgctacc

SEQ ID NO: 131406 - DNA, 75 bp, Artificial Sequence
  Synthetic
ctggcagagacaagaacgtggtgtctggtgagatccaggtgctttcaacaaccactcagaccttcctgggtacga

SEQ ID NO: 131407 - DNA, 75 bp, Artificial Sequence
  Synthetic
gttatgggggctttgctgtactacagcatggctactaattgggctaaggtcatcatagtcctactcatgttcgca

SEQ ID NO: 131408 - DNA, 75 bp, Artificial Sequence
  Synthetic
aatgcttatgtgacagggttgaccactgacaacctaaatgtcccttgccaattgccagccccggagttcttttca

SEQ ID NO: 131409 - DNA, 75 bp, Artificial Sequence
  Synthetic
gagctttcacggaagctatgacgaggtactcggcgccccccggagacgccccgcagccagcgtatgacttagagc

SEQ ID NO: 131410 - DNA, 75 bp, Artificial Sequence
  Synthetic
ggaccttgttgggtggccagctccccctggagccaagtccctggagccgtgcacgtgcggatccacggatttgta

SEQ ID NO: 131411 - DNA, 75 bp, Artificial Sequence
  Synthetic
accaggctacagtgtgcgccagggctcaggctccacctccatcgtgggatcaaatgtggaagtgtctcatacggc

SEQ ID NO: 131412 - DNA, 75 bp, Artificial Sequence
  Synthetic
gcatatcaatagcacggccttgaactgtaacgcgagccttgaggccagctggctggcagggctcttctatgccag

SEQ ID NO: 131413 - DNA, 75 bp, Artificial Sequence
  Synthetic
gatctcagctcccatgtgagcctgaaccggaccccgaggtattggcctccatgcttacaggcccgtcccacataa

SEQ ID NO: 131414 - DNA, 75 bp, Artificial Sequence
  Synthetic
agcctgggagacagtccgacacactccagtcaactcctggttgggtaacatcatactttacgcgcccacgatctg

SEQ ID NO: 131415 - DNA, 75 bp, Artificial Sequence
  Synthetic
tccggaggccccgtcatgtgcccatcgggccatgtggcggggatttttagggctgctgtatgcactaggggtgtt

SEQ ID NO: 131416 - DNA, 75 bp, Artificial Sequence
  Synthetic
cacgtatgccaacatcagtggtcccgctatggacaagccctactgctggcattactcgcccaggccatgcgaggt

SEQ ID NO: 131417 - DNA, 75 bp, Artificial Sequence
  Synthetic
caccagccataagggaacttatgacatagacatggtggatgcttctctcttcatgggaggcgacgtgacccggat

SEQ ID NO: 131418 - DNA, 75 bp, Artificial Sequence
  Synthetic
gtcattgtgggcaggatcatcttgtccgggaagccggctgttattcccgacagggaagttctctaccaggagttc

SEQ ID NO: 131419 - DNA, 75 bp, Artificial Sequence
  Synthetic
accaggtgggatacttacatgctcccaccggcagcggcaagagcacaaaggtccctgccgcttacgtagcgcaag

SEQ ID NO: 131420 - DNA, 75 bp, Artificial Sequence
  Synthetic
cccggccccgctggtttctctgttgcctactactacttgcagtaggggtaggcgtctacctcctccccaaccgat

SEQ ID NO: 131421 - DNA, 75 bp, Artificial Sequence
  Synthetic
cccggccccgctggtttctctgttgcctactactacttgctgtaggggtaggcgtctacctcctccccaaccgat

SEQ ID NO: 131422 - DNA, 75 bp, Artificial Sequence
  Synthetic
cccggccccgctggtttctctgttgcctactactacttgccgtaggggtaggcgtctacctcctccccaaccgat

SEQ ID NO: 131423 - DNA, 75 bp, Artificial Sequence
  Synthetic
cccggccccgctggtttctctgttgcctactactacttgcggtaggggtaggcgtctacctcctccccaaccgat

SEQ ID NO: 131424 - DNA, 75 bp, Artificial Sequence
  Synthetic
cccggccccgctggtttctctgttgcctacttctacttgcagtaggggtaggcgtctacctcctccccaaccgat

SEQ ID NO: 131425 - DNA, 75 bp, Artificial Sequence
  Synthetic
cccggccccgctggtttctctgttgcctacttctacttgctgtaggggtaggcgtctacctcctccccaaccgat

SEQ ID NO: 131426 - DNA, 75 bp, Artificial Sequence
  Synthetic
cccggccccgctggtttctctgttgcctacttctacttgccgtaggggtaggcgtctacctcctccccaaccgat

SEQ ID NO: 131427 - DNA, 75 bp, Artificial Sequence
  Synthetic
cccggccccgctggtttctctgttgcctacttctacttgcggtaggggtaggcgtctacctcctccccaaccgat

SEQ ID NO: 131428 - DNA, 75 bp, Artificial Sequence
  Synthetic
cccggccccgctggtttctctgttgcctactcctacttgcagtaggggtaggcgtctacctcctccccaaccgat

SEQ ID NO: 131429 - DNA, 75 bp, Artificial Sequence
  Synthetic
cccggccccgctggtttctctgttgcctactcctacttgctgtaggggtaggcgtctacctcctccccaaccgat

SEQ ID NO: 131430 - DNA, 75 bp, Artificial Sequence
  Synthetic
cccggccccgctggtttctctgttgcctactcctacttgccgtaggggtaggcgtctacctcctccccaaccgat

SEQ ID NO: 131431 - DNA, 75 bp, Artificial Sequence
  Synthetic
cccggccccgctggtttctctgttgcctactcctacttgcggtaggggtaggcgtctacctcctccccaaccgat

SEQ ID NO: 131432 - DNA, 75 bp, Artificial Sequence
  Synthetic
cccggccccgctggtttctctgttgcctactgctacttgcagtaggggtaggcgtctacctcctccccaaccgat

SEQ ID NO: 131433 - DNA, 75 bp, Artificial Sequence
  Synthetic
cccggccccgctggtttctctgttgcctactgctacttgctgtaggggtaggcgtctacctcctccccaaccgat

SEQ ID NO: 131434 - DNA, 75 bp, Artificial Sequence
  Synthetic
cccggccccgctggtttctctgttgcctactgctacttgccgtaggggtaggcgtctacctcctccccaaccgat

SEQ ID NO: 131435 - DNA, 75 bp, Artificial Sequence
  Synthetic
cccggccccgctggtttctctgttgcctactgctacttgcggtaggggtaggcgtctacctcctccccaaccgat

SEQ ID NO: 131436 - DNA, 75 bp, Artificial Sequence
  Synthetic
aggagagcctttccacctgcattgcctgtctgggctaggccagactataaccctcccacagtagaaacatggaag

SEQ ID NO: 131437 - DNA, 75 bp, Artificial Sequence
  Synthetic
aagcaggactatcacgactggtgctaagcttacttattccacctatggtaagtttcttgctgacgggggctgctc

SEQ ID NO: 131438 - DNA, 75 bp, Artificial Sequence
  Synthetic
aataggacggccttgaactgcaatgagagcatcaacactggctgggtagcggggctcttctactaccataaattc

SEQ ID NO: 131439 - DNA, 75 bp, Artificial Sequence
  Synthetic
actgcttccggaagcacccaggcgctacttatgccaagtgcgggtcggggccgtggctcacccctaggtgtttgg

SEQ ID NO: 131440 - DNA, 75 bp, Artificial Sequence
  Synthetic
ctgagagcaacgtagggggagttctgaaagatcttgccgataaggcgtttggcacctcacaggactgtggtgact

SEQ ID NO: 131441 - DNA, 75 bp, Artificial Sequence
  Synthetic
ggcgtaagactaacagtcttagcaacagcaacccccccaggtagcattactgtgccacatgctaacatcgaggaa

SEQ ID NO: 131442 - DNA, 75 bp, Artificial Sequence
  Synthetic
ctacacaaggtccggatgtatgtggctggcggtgagcataggttcatggctgcctgcaactggaccaggggagag

SEQ ID NO: 131443 - DNA, 75 bp, Artificial Sequence
  Synthetic
cctggagggagagccaggagacccagacctggagctcgaggcggcaggacatggtcctcccagcgatggggggtc

SEQ ID NO: 131444 - DNA, 75 bp, Artificial Sequence
  Synthetic
aaaagtgcgacgagctgtcaaccaagctcaggggaatgggtcttaacgctgttcaattctacagagggctagatg

SEQ ID NO: 131445 - DNA, 75 bp, Artificial Sequence
  Synthetic
ataacaccaagtagccccgaggaggaaaagttaccaataaacccgctgagtaactcgcttatgcgataccacaac

SEQ ID NO: 131446 - DNA, 75 bp, Artificial Sequence
  Synthetic
cgctgtggaacagtacgttgacttcagcttagacccaactttctccattgaaactcgcactgtcccccaggatgc

SEQ ID NO: 131447 - DNA, 75 bp, Artificial Sequence
  Synthetic
cgctgtggaacagtacgttgacttcagcttagaccctactttctccattgaaactcgcactgtcccccaggatgc

SEQ ID NO: 131448 - DNA, 75 bp, Artificial Sequence
  Synthetic
cgctgtggaacagtacgttgacttcagcttagaccccactttctccattgaaactcgcactgtcccccaggatgc

SEQ ID NO: 131449 - DNA, 75 bp, Artificial Sequence
  Synthetic
cgctgtggaacagtacgttgacttcagcttagacccgactttctccattgaaactcgcactgtcccccaggatgc

SEQ ID NO: 131450 - DNA, 75 bp, Artificial Sequence
  Synthetic
gtgctgctcttagggcgaagaaggtgaccttcgacagggtacagctattggacatgcactatgattcagtcttaa

SEQ ID NO: 131451 - DNA, 75 bp, Artificial Sequence
  Synthetic
ttctatcttcttgcttgctcttctgtcatgcgtcacagtgccagtgtctgcagtggaagtcaggaacatcagttc

SEQ ID NO: 131452 - DNA, 75 bp, Artificial Sequence
  Synthetic
ttttggggcgaaagaagttcgcagcttatctaggagggccgttaaccacatcaagtccgtgtgggaggacctctt

SEQ ID NO: 131453 - DNA, 75 bp, Artificial Sequence
  Synthetic
ttgttgttaccccatcgggcgtacgcctatgacggcgttcaggctgggtcgattggcgccgcggtcattatcgcc

SEQ ID NO: 131454 - DNA, 75 bp, Artificial Sequence
  Synthetic
gtcgtgctttgtgagtgctatgacgccggatgcgcttggtatgacctgcagccggctgagaccacagtacgattg

SEQ ID NO: 131455 - DNA, 75 bp, Artificial Sequence
  Synthetic
gtcgtgctttgtgagtgctatgacgccggatgcgcttggtatgacctgctgccggctgagaccacagtacgattg

SEQ ID NO: 131456 - DNA, 75 bp, Artificial Sequence
  Synthetic
gtcgtgctttgtgagtgctatgacgccggatgcgcttggtatgacctgccgccggctgagaccacagtacgattg

SEQ ID NO: 131457 - DNA, 75 bp, Artificial Sequence
  Synthetic
gtcgtgctttgtgagtgctatgacgccggatgcgcttggtatgacctgcggccggctgagaccacagtacgattg

SEQ ID NO: 131458 - DNA, 75 bp, Artificial Sequence
  Synthetic
gccggctgagaccacagtacgattgagggcttacttgtccaccccaggcttgcctgtttgccaagatcaccttga

SEQ ID NO: 131459 - DNA, 75 bp, Artificial Sequence
  Synthetic
cttgtggtggactcagtacttcatagcacatattgaggccaagctacatgtttggatccctcccctccgggtacg

SEQ ID NO: 131460 - DNA, 75 bp, Artificial Sequence
  Synthetic
caggctactgtgtgcgcacgcgcactagcgcctccaccaagttgggaagagatgtggaaatgtattgtgcggctc

SEQ ID NO: 131461 - DNA, 75 bp, Artificial Sequence
  Synthetic
caggctactgtgtgcgcacgcgcactagcgcctccaccaagttgggatgagatgtggaaatgtattgtgcggctc

SEQ ID NO: 131462 - DNA, 75 bp, Artificial Sequence
  Synthetic
caggctactgtgtgcgcacgcgcactagcgcctccaccaagttgggacgagatgtggaaatgtattgtgcggctc

SEQ ID NO: 131463 - DNA, 75 bp, Artificial Sequence
  Synthetic
caggctactgtgtgcgcacgcgcactagcgcctccaccaagttgggaggagatgtggaaatgtattgtgcggctc

SEQ ID NO: 131464 - DNA, 75 bp, Artificial Sequence
  Synthetic
gtgtaccctgacctgggggtcagggtgtgcgaaaagatggccctttatgacttggcacaaaagctacctaaggca

SEQ ID NO: 131465 - DNA, 75 bp, Artificial Sequence
  Synthetic
caacactaacggcagttggcacatcaacagcacggccttgaactgcaatgatagccttaacaccggctggatagc

SEQ ID NO: 131466 - DNA, 75 bp, Artificial Sequence
  Synthetic
atcctgcatgccagcctcctgcgggtgccatactacgtacgagcacatgcgctcattcgcatatgcgcgctcgtg

SEQ ID NO: 131467 - DNA, 75 bp, Artificial Sequence
  Synthetic
gcatgtcagctgatctggaagtgactaccagcacttgggtactccttggcggggtgttggctgccttagcggcct

SEQ ID NO: 131468 - DNA, 75 bp, Artificial Sequence
  Synthetic
cgccggcggggtgatagcaggggcagcctgctttcgccccggcccatttcctacttgaaaggctcctcggggggt

SEQ ID NO: 131469 - DNA, 75 bp, Artificial Sequence
  Synthetic
atgatacccgttgttttgattcaacagtcacggagagagacattagaacagaggagtccatatatctatcctgct

SEQ ID NO: 131470 - DNA, 75 bp, Artificial Sequence
  Synthetic
gctcattcgcatatgcgcgctcgtgcagaatgtagcagggggaaaatatgttcaagcagcaattttgagagtcgg

SEQ ID NO: 131471 - DNA, 75 bp, Artificial Sequence
  Synthetic
cctccccaaccgatgaaggttggggtaaacactccggcctcttaggccatctcccgagttttttttttccctttt

SEQ ID NO: 131472 - DNA, 75 bp, Artificial Sequence
  Synthetic
ggcttggcctatttctccatgcagggagcgtgggccaaagtcattgccatcctccttcttgtcgcgggagtggat

SEQ ID NO: 131473 - DNA, 75 bp, Artificial Sequence
  Synthetic
cgagatggaagaatgctcccaagctgctccatacatcgagcaagcccaggtcatcgcccaccagttcaaggagaa

SEQ ID NO: 131474 - DNA, 75 bp, Artificial Sequence
  Synthetic
gcgctgccgcgccagtggagttttcactaccagcatgggaaacaccatcacgtgctatatcaaagccctttccgc

SEQ ID NO: 131475 - DNA, 75 bp, Artificial Sequence
  Synthetic
cactggcatctttagccctggtgctcagcagaacatccagttaatcaataccaatggcagctggcacataaacag

SEQ ID NO: 131476 - DNA, 75 bp, Artificial Sequence
  Synthetic
atgtggaacttagtcagtgggatacaatatctggcaggcctgtcaacactgcctggcaaccctgctgtggcctcc

SEQ ID NO: 131477 - DNA, 75 bp, Artificial Sequence
  Synthetic
atgtggaactttgtcagtgggatacaatatctggcaggcctgtcaacactgcctggcaaccctgctgtggcctcc

SEQ ID NO: 131478 - DNA, 75 bp, Artificial Sequence
  Synthetic
atgtggaacttcgtcagtgggatacaatatctggcaggcctgtcaacactgcctggcaaccctgctgtggcctcc

SEQ ID NO: 131479 - DNA, 75 bp, Artificial Sequence
  Synthetic
atgtggaacttggtcagtgggatacaatatctggcaggcctgtcaacactgcctggcaaccctgctgtggcctcc

SEQ ID NO: 131480 - DNA, 75 bp, Artificial Sequence
  Synthetic
ctgagagctttcacggaagctatgaccaggtactcagctcctcccggtgatccccccaaaccagaatatgacttg

SEQ ID NO: 131481 - DNA, 75 bp, Artificial Sequence
  Synthetic
gcatcgggtggggaactttggaatacgagaccaatgtcaccaatgatgaggacatgaggccgtactgctggcatt

SEQ ID NO: 131482 - DNA, 75 bp, Artificial Sequence
  Synthetic
cgagaccaatgtcaccaatgatgaggacatgaggccgtactgctggcattaccctccgaagccttgcggtatcgt

SEQ ID NO: 131483 - DNA, 75 bp, Artificial Sequence
  Synthetic
cgcaggcctcttccgcattcgtggtgagtggcctagccggtgccgcaatagggggcataggcctaggtagagtgc

SEQ ID NO: 131484 - DNA, 75 bp, Artificial Sequence
  Synthetic
gagctgcctgggaaacagcgaaacactcccctgtcaattcctggctgggaaacatcatctcatacgcccctacaa

SEQ ID NO: 131485 - DNA, 75 bp, Artificial Sequence
  Synthetic
ccacttcttctccacattactggcccaagatattttagatcaaaatctaaattttgagatgtacggggcagtata

SEQ ID NO: 131486 - DNA, 75 bp, Artificial Sequence
  Synthetic
caccgccgcgtgcggtgacatcatcaacggcttgcccgtctccgcccgtaggggccgggagatactgctcggacc

SEQ ID NO: 131487 - DNA, 75 bp, Artificial Sequence
  Synthetic
tctgctgcctgccatactgtccccgggcgcccttgtcgtcggtgtaatatgcgcagccgtgttacgccggcacgt

SEQ ID NO: 131488 - DNA, 75 bp, Artificial Sequence
  Synthetic
tctgctgcctgccatactgtccccgggcgcccttgtcgtcggtgtaatatgcgcagccgtgtttcgccggcacgt

SEQ ID NO: 131489 - DNA, 75 bp, Artificial Sequence
  Synthetic
tctgctgcctgccatactgtccccgggcgcccttgtcgtcggtgtaatatgcgcagccgtgttccgccggcacgt

SEQ ID NO: 131490 - DNA, 75 bp, Artificial Sequence
  Synthetic
tctgctgcctgccatactgtccccgggcgcccttgtcgtcggtgtaatatgcgcagccgtgttgcgccggcacgt

SEQ ID NO: 131491 - DNA, 75 bp, Artificial Sequence
  Synthetic
tctgctgcctgccatactgtccccgggcgcccttgtcgtcggtgttatatgcgcagccgtgttacgccggcacgt

SEQ ID NO: 131492 - DNA, 75 bp, Artificial Sequence
  Synthetic
tctgctgcctgccatactgtccccgggcgcccttgtcgtcggtgttatatgcgcagccgtgtttcgccggcacgt

SEQ ID NO: 131493 - DNA, 75 bp, Artificial Sequence
  Synthetic
tctgctgcctgccatactgtccccgggcgcccttgtcgtcggtgttatatgcgcagccgtgttccgccggcacgt

SEQ ID NO: 131494 - DNA, 75 bp, Artificial Sequence
  Synthetic
tctgctgcctgccatactgtccccgggcgcccttgtcgtcggtgttatatgcgcagccgtgttgcgccggcacgt

SEQ ID NO: 131495 - DNA, 75 bp, Artificial Sequence
  Synthetic
tctgctgcctgccatactgtccccgggcgcccttgtcgtcggtgtcatatgcgcagccgtgttacgccggcacgt

SEQ ID NO: 131496 - DNA, 75 bp, Artificial Sequence
  Synthetic
tctgctgcctgccatactgtccccgggcgcccttgtcgtcggtgtcatatgcgcagccgtgtttcgccggcacgt

SEQ ID NO: 131497 - DNA, 75 bp, Artificial Sequence
  Synthetic
tctgctgcctgccatactgtccccgggcgcccttgtcgtcggtgtcatatgcgcagccgtgttccgccggcacgt

SEQ ID NO: 131498 - DNA, 75 bp, Artificial Sequence
  Synthetic
tctgctgcctgccatactgtccccgggcgcccttgtcgtcggtgtcatatgcgcagccgtgttgcgccggcacgt

SEQ ID NO: 131499 - DNA, 75 bp, Artificial Sequence
  Synthetic
tctgctgcctgccatactgtccccgggcgcccttgtcgtcggtgtgatatgcgcagccgtgttacgccggcacgt

SEQ ID NO: 131500 - DNA, 75 bp, Artificial Sequence
  Synthetic
tctgctgcctgccatactgtccccgggcgcccttgtcgtcggtgtgatatgcgcagccgtgtttcgccggcacgt

SEQ ID NO: 131501 - DNA, 75 bp, Artificial Sequence
  Synthetic
tctgctgcctgccatactgtccccgggcgcccttgtcgtcggtgtgatatgcgcagccgtgttccgccggcacgt

SEQ ID NO: 131502 - DNA, 75 bp, Artificial Sequence
  Synthetic
tctgctgcctgccatactgtccccgggcgcccttgtcgtcggtgtgatatgcgcagccgtgttgcgccggcacgt

SEQ ID NO: 131503 - DNA, 75 bp, Artificial Sequence
  Synthetic
gcttgagtttgtgccttgtgaggccatggaatcgaccacgcggtcccccaccttcactgacaactccacaccacc

SEQ ID NO: 131504 - DNA, 75 bp, Artificial Sequence
  Synthetic
gctgcagcgagggttacgtcactcctgagttccttgaccgtcacgcggttgctccggcggctgcaccaatggatc

SEQ ID NO: 131505 - DNA, 75 bp, Artificial Sequence
  Synthetic
atggaatcgaccacgcggtcccccaccttcactgacaactccacaccaccagctgtgccccaggtttaccaagtt

SEQ ID NO: 131506 - DNA, 75 bp, Artificial Sequence
  Synthetic
ccatctgtggtcgctatctcttcaactgggcggtgaagaccaagctcaaactcactccattgccagaggcacgcc

SEQ ID NO: 131507 - DNA, 75 bp, Artificial Sequence
  Synthetic
ctgggcggtgaagaccaagctcaaactcactccattgccagaggcacgccgcctggacttgtccagttggtttac

SEQ ID NO: 131508 - DNA, 75 bp, Artificial Sequence
  Synthetic
agatcatgcccaaaatgccaggcatcccctttctctcttgccagaagggatataagggtgtttggcgaggggatg

SEQ ID NO: 131509 - DNA, 75 bp, Artificial Sequence
  Synthetic
gggaacagccgcctacaccgcgcgggggtttactaatctcttcacattaggcccccagcagaagatccagctggt

SEQ ID NO: 131510 - DNA, 75 bp, Artificial Sequence
  Synthetic
tggcatgttcgactcatctgtcctctgtgagtgctatgacgcgggctgtgcttggtacgagctcacgcccgccga

SEQ ID NO: 131511 - DNA, 75 bp, Artificial Sequence
  Synthetic
tgctcctgctcctgttggcattaccaccacgagcttacgccatggaccgggagatggctgcatcgtgcggaggcg

SEQ ID NO: 131512 - DNA, 75 bp, Artificial Sequence
  Synthetic
tgctcatcatactgggccaagccgaggcggcgcttgagaagctcatcatcttgcactccgctagcgccgctagtg

SEQ ID NO: 131513 - DNA, 75 bp, Artificial Sequence
  Synthetic
aagaatgggtccatgaggatagcgggaccgcgcacgtgcgccaacatgtggcacggtacctttccaatcaatgaa

SEQ ID NO: 131514 - DNA, 75 bp, Artificial Sequence
  Synthetic
gtgccactccacggaccctactacggttctgggaataggtaccgtgctcgaccaggcggagacagcgggctgccg

SEQ ID NO: 131515 - DNA, 75 bp, Artificial Sequence
  Synthetic
cctccttttcttgttgttggcagacgccagggtctgtgcatgcctttggatgctcatcatactgggccaagccga

SEQ ID NO: 131516 - DNA, 75 bp, Artificial Sequence
  Synthetic
cctacttactgtaggggtaggcatctttttactccccgcccgatagggcggcacaccttagctacactccatagc

SEQ ID NO: 131517 - DNA, 75 bp, Artificial Sequence
  Synthetic
ggcgcacttgcaagtgtgggtcccccccctcaacgttcggggaggccgcgatgccatcatcctcctcacatgtgc

SEQ ID NO: 131518 - DNA, 75 bp, Artificial Sequence
  Synthetic
atccaaacatacaagagatagcgcttcccttgacgggagagataccgttctatgggaaagccatccctctagaat

SEQ ID NO: 131519 - DNA, 75 bp, Artificial Sequence
  Synthetic
acttccactacatcacaggggcaacggaagatgagctcaagtgtccgtgccaggtgccagcgccggagtttttca

SEQ ID NO: 131520 - DNA, 75 bp, Artificial Sequence
  Synthetic
agggtcacagctcccatgtgagccagaaccagacgtcgctgtgctaacttcaatgttaagggacccttctcacat

SEQ ID NO: 131521 - DNA, 75 bp, Artificial Sequence
  Synthetic
tgccggacacacagacaacaccctgatgtggaattgatagacgccaatttgctttggcgacaggagatgggtagt

SEQ ID NO: 131522 - DNA, 75 bp, Artificial Sequence
  Synthetic
agtgtgcaccctggtgagacacctcgcaggagctaggtacatccagatgctgttgatcaccataggcaggtggac

SEQ ID NO: 131523 - DNA, 75 bp, Artificial Sequence
  Synthetic
gcaggagctaggtacatccagatgctgttgatcaccataggcaggtggaccggcacttacatctatgaccacctc

SEQ ID NO: 131524 - DNA, 75 bp, Artificial Sequence
  Synthetic
ggagaccaagatcatcacctggggggcagacaccgcggcgtgtggggacatcatcctgggcctacccgtctccgc

SEQ ID NO: 131525 - DNA, 75 bp, Artificial Sequence
  Synthetic
agtgtttcaggaaaccccctaagtatcctcccgctctgcccatctgggccaggcctgactacaacccaccattac

SEQ ID NO: 131526 - DNA, 75 bp, Artificial Sequence
  Synthetic
catccacctccaccagaacattgtggacgtgcagtacctgtacggggtggggtcaagcatcgcgtcctgggccat

SEQ ID NO: 131527 - DNA, 75 bp, Artificial Sequence
  Synthetic
gacagtccaactcgatgggtcgaatgtatctgctgcgcttgctgcgctggcggagaagtctttcccatcttcaaa

SEQ ID NO: 131528 - DNA, 75 bp, Artificial Sequence
  Synthetic
cttgcacttctgtcatgcgttacagtgccagtatctggagtggaaattaggaacatcagtactagatactacgcc

SEQ ID NO: 131529 - DNA, 75 bp, Artificial Sequence
  Synthetic
cttgcacttctgtcatgcgttacagtgccagtatctggagtggaaattaggaacatcagtactagttactacgcc

SEQ ID NO: 131530 - DNA, 75 bp, Artificial Sequence
  Synthetic
cttgcacttctgtcatgcgttacagtgccagtatctggagtggaaattaggaacatcagtactagctactacgcc

SEQ ID NO: 131531 - DNA, 75 bp, Artificial Sequence
  Synthetic
cttgcacttctgtcatgcgttacagtgccagtatctggagtggaaattaggaacatcagtactaggtactacgcc

SEQ ID NO: 131532 - DNA, 75 bp, Artificial Sequence
  Synthetic
cttgctcttctgtcatgcgttacagtgccagtatctggagtggaaattaggaacatcagtactagatactacgcc

SEQ ID NO: 131533 - DNA, 75 bp, Artificial Sequence
  Synthetic
cttgctcttctgtcatgcgttacagtgccagtatctggagtggaaattaggaacatcagtactagttactacgcc

SEQ ID NO: 131534 - DNA, 75 bp, Artificial Sequence
  Synthetic
cttgctcttctgtcatgcgttacagtgccagtatctggagtggaaattaggaacatcagtactagctactacgcc

SEQ ID NO: 131535 - DNA, 75 bp, Artificial Sequence
  Synthetic
cttgctcttctgtcatgcgttacagtgccagtatctggagtggaaattaggaacatcagtactaggtactacgcc

SEQ ID NO: 131536 - DNA, 75 bp, Artificial Sequence
  Synthetic
cttgcccttctgtcatgcgttacagtgccagtatctggagtggaaattaggaacatcagtactagatactacgcc

SEQ ID NO: 131537 - DNA, 75 bp, Artificial Sequence
  Synthetic
cttgcccttctgtcatgcgttacagtgccagtatctggagtggaaattaggaacatcagtactagttactacgcc

SEQ ID NO: 131538 - DNA, 75 bp, Artificial Sequence
  Synthetic
cttgcccttctgtcatgcgttacagtgccagtatctggagtggaaattaggaacatcagtactagctactacgcc

SEQ ID NO: 131539 - DNA, 75 bp, Artificial Sequence
  Synthetic
cttgcccttctgtcatgcgttacagtgccagtatctggagtggaaattaggaacatcagtactaggtactacgcc

SEQ ID NO: 131540 - DNA, 75 bp, Artificial Sequence
  Synthetic
cttgcgcttctgtcatgcgttacagtgccagtatctggagtggaaattaggaacatcagtactagatactacgcc

SEQ ID NO: 131541 - DNA, 75 bp, Artificial Sequence
  Synthetic
cttgcgcttctgtcatgcgttacagtgccagtatctggagtggaaattaggaacatcagtactagttactacgcc

SEQ ID NO: 131542 - DNA, 75 bp, Artificial Sequence
  Synthetic
cttgcgcttctgtcatgcgttacagtgccagtatctggagtggaaattaggaacatcagtactagctactacgcc

SEQ ID NO: 131543 - DNA, 75 bp, Artificial Sequence
  Synthetic
cttgcgcttctgtcatgcgttacagtgccagtatctggagtggaaattaggaacatcagtactaggtactacgcc

SEQ ID NO: 131544 - DNA, 75 bp, Artificial Sequence
  Synthetic
ggttgggtcacagctcccatgcgagcccgaaccggacgtagcagtgctcacttccatgctcaccgacccctccca

SEQ ID NO: 131545 - DNA, 75 bp, Artificial Sequence
  Synthetic
tgttcatccatgcccccccttgagggggagccgggtgaccccgacttgagctgtgactcctggtccaccgtcagc

SEQ ID NO: 131546 - DNA, 75 bp, Artificial Sequence
  Synthetic
gtccactcagtaattcgttgctgaggcatcacaatcttgtctactcaacgtcatctaaaagcgctggtctgcgcc

SEQ ID NO: 131547 - DNA, 75 bp, Artificial Sequence
  Synthetic
agaagaaagtaactttcgacaggctgcaagtgcttgatgaccattataaaagtgtcttaaaggaggtgaaggaga

SEQ ID NO: 131548 - DNA, 75 bp, Artificial Sequence
  Synthetic
agaagaaagtaactttcgacaggctgcaagtgcttgatgaccattataaaagtgtcttaaaggaggtgaaggagt

SEQ ID NO: 131549 - DNA, 75 bp, Artificial Sequence
  Synthetic
agaagaaagtaactttcgacaggctgcaagtgcttgatgaccattataaaagtgtcttaaaggaggtgaaggagc

SEQ ID NO: 131550 - DNA, 75 bp, Artificial Sequence
  Synthetic
agaagaaagtaactttcgacaggctgcaagtgcttgatgaccattataaaagtgtcttaaaggaggtgaaggagg

SEQ ID NO: 131551 - DNA, 75 bp, Artificial Sequence
  Synthetic
agaagaaagttactttcgacaggctgcaagtgcttgatgaccattataaaagtgtcttaaaggaggtgaaggaga

SEQ ID NO: 131552 - DNA, 75 bp, Artificial Sequence
  Synthetic
agaagaaagttactttcgacaggctgcaagtgcttgatgaccattataaaagtgtcttaaaggaggtgaaggagt

SEQ ID NO: 131553 - DNA, 75 bp, Artificial Sequence
  Synthetic
agaagaaagttactttcgacaggctgcaagtgcttgatgaccattataaaagtgtcttaaaggaggtgaaggagc

SEQ ID NO: 131554 - DNA, 75 bp, Artificial Sequence
  Synthetic
agaagaaagttactttcgacaggctgcaagtgcttgatgaccattataaaagtgtcttaaaggaggtgaaggagg

SEQ ID NO: 131555 - DNA, 75 bp, Artificial Sequence
  Synthetic
agaagaaagtcactttcgacaggctgcaagtgcttgatgaccattataaaagtgtcttaaaggaggtgaaggaga

SEQ ID NO: 131556 - DNA, 75 bp, Artificial Sequence
  Synthetic
agaagaaagtcactttcgacaggctgcaagtgcttgatgaccattataaaagtgtcttaaaggaggtgaaggagt

SEQ ID NO: 131557 - DNA, 75 bp, Artificial Sequence
  Synthetic
agaagaaagtcactttcgacaggctgcaagtgcttgatgaccattataaaagtgtcttaaaggaggtgaaggagc

SEQ ID NO: 131558 - DNA, 75 bp, Artificial Sequence
  Synthetic
agaagaaagtcactttcgacaggctgcaagtgcttgatgaccattataaaagtgtcttaaaggaggtgaaggagg

SEQ ID NO: 131559 - DNA, 75 bp, Artificial Sequence
  Synthetic
agaagaaagtgactttcgacaggctgcaagtgcttgatgaccattataaaagtgtcttaaaggaggtgaaggaga

SEQ ID NO: 131560 - DNA, 75 bp, Artificial Sequence
  Synthetic
agaagaaagtgactttcgacaggctgcaagtgcttgatgaccattataaaagtgtcttaaaggaggtgaaggagt

SEQ ID NO: 131561 - DNA, 75 bp, Artificial Sequence
  Synthetic
agaagaaagtgactttcgacaggctgcaagtgcttgatgaccattataaaagtgtcttaaaggaggtgaaggagc

SEQ ID NO: 131562 - DNA, 75 bp, Artificial Sequence
  Synthetic
agaagaaagtgactttcgacaggctgcaagtgcttgatgaccattataaaagtgtcttaaaggaggtgaaggagg

SEQ ID NO: 131563 - DNA, 75 bp, Artificial Sequence
  Synthetic
catcgcaggcctttataatatcaccagagcgccacaatttcacccaagagtgcaattgttccatctatcagggac

SEQ ID NO: 131564 - DNA, 75 bp, Artificial Sequence
  Synthetic
catcgcaggcctttataatatcaccagagcgccacaatttcacccaagagtgcaattgttccatctatcagggtc

SEQ ID NO: 131565 - DNA, 75 bp, Artificial Sequence
  Synthetic
catcgcaggcctttataatatcaccagagcgccacaatttcacccaagagtgcaattgttccatctatcagggcc

SEQ ID NO: 131566 - DNA, 75 bp, Artificial Sequence
  Synthetic
catcgcaggcctttataatatcaccagagcgccacaatttcacccaagagtgcaattgttccatctatcaggggc

SEQ ID NO: 131567 - DNA, 75 bp, Artificial Sequence
  Synthetic
gcttgatccaggttacgacgaagcaggcagaagaactcaaaccagccgtccacactgcttggcctaaactcgaac

SEQ ID NO: 131568 - DNA, 75 bp, Artificial Sequence
  Synthetic
agagcgccacaatttcacccaagagtgcaattgttccatctatcagggacaaatcactggtcatcgcatggcatg

SEQ ID NO: 131569 - DNA, 75 bp, Artificial Sequence
  Synthetic
agagcgccacaatttcacccaagagtgcaattgttccatctatcagggacatatcactggtcatcgcatggcatg

SEQ ID NO: 131570 - DNA, 75 bp, Artificial Sequence
  Synthetic
agagcgccacaatttcacccaagagtgcaattgttccatctatcagggacacatcactggtcatcgcatggcatg

SEQ ID NO: 131571 - DNA, 75 bp, Artificial Sequence
  Synthetic
agagcgccacaatttcacccaagagtgcaattgttccatctatcagggacagatcactggtcatcgcatggcatg

SEQ ID NO: 131572 - DNA, 75 bp, Artificial Sequence
  Synthetic
agagcgccacaatttcacccaagagtgcaattgttccatctatcagggtcaaatcactggtcatcgcatggcatg

SEQ ID NO: 131573 - DNA, 75 bp, Artificial Sequence
  Synthetic
agagcgccacaatttcacccaagagtgcaattgttccatctatcagggtcatatcactggtcatcgcatggcatg

SEQ ID NO: 131574 - DNA, 75 bp, Artificial Sequence
  Synthetic
agagcgccacaatttcacccaagagtgcaattgttccatctatcagggtcacatcactggtcatcgcatggcatg

SEQ ID NO: 131575 - DNA, 75 bp, Artificial Sequence
  Synthetic
agagcgccacaatttcacccaagagtgcaattgttccatctatcagggtcagatcactggtcatcgcatggcatg

SEQ ID NO: 131576 - DNA, 75 bp, Artificial Sequence
  Synthetic
agagcgccacaatttcacccaagagtgcaattgttccatctatcagggccaaatcactggtcatcgcatggcatg

SEQ ID NO: 131577 - DNA, 75 bp, Artificial Sequence
  Synthetic
agagcgccacaatttcacccaagagtgcaattgttccatctatcagggccatatcactggtcatcgcatggcatg

SEQ ID NO: 131578 - DNA, 75 bp, Artificial Sequence
  Synthetic
agagcgccacaatttcacccaagagtgcaattgttccatctatcagggccacatcactggtcatcgcatggcatg

SEQ ID NO: 131579 - DNA, 75 bp, Artificial Sequence
  Synthetic
agagcgccacaatttcacccaagagtgcaattgttccatctatcagggccagatcactggtcatcgcatggcatg

SEQ ID NO: 131580 - DNA, 75 bp, Artificial Sequence
  Synthetic
agagcgccacaatttcacccaagagtgcaattgttccatctatcaggggcaaatcactggtcatcgcatggcatg

SEQ ID NO: 131581 - DNA, 75 bp, Artificial Sequence
  Synthetic
agagcgccacaatttcacccaagagtgcaattgttccatctatcaggggcatatcactggtcatcgcatggcatg

SEQ ID NO: 131582 - DNA, 75 bp, Artificial Sequence
  Synthetic
agagcgccacaatttcacccaagagtgcaattgttccatctatcaggggcacatcactggtcatcgcatggcatg

SEQ ID NO: 131583 - DNA, 75 bp, Artificial Sequence
  Synthetic
agagcgccacaatttcacccaagagtgcaattgttccatctatcaggggcagatcactggtcatcgcatggcatg

SEQ ID NO: 131584 - DNA, 75 bp, Artificial Sequence
  Synthetic
gccacgcggacgcccagcttctctgacaacagcacgccaccagctgtgccccagtcttaccaggtgggctacttg

SEQ ID NO: 131585 - DNA, 75 bp, Artificial Sequence
  Synthetic
ggtgtggtgtttggcttggcctatttctccatgcagggagcatgggctaaagtctttgcaatcctactccttgtc

SEQ ID NO: 131586 - DNA, 75 bp, Artificial Sequence
  Synthetic
ggtgtggtgtttggcttggcctatttctccatgcagggagcatgggctaaagtctttgctatcctactccttgtc

SEQ ID NO: 131587 - DNA, 75 bp, Artificial Sequence
  Synthetic
ggtgtggtgtttggcttggcctatttctccatgcagggagcatgggctaaagtctttgccatcctactccttgtc

SEQ ID NO: 131588 - DNA, 75 bp, Artificial Sequence
  Synthetic
ggtgtggtgtttggcttggcctatttctccatgcagggagcatgggctaaagtctttgcgatcctactccttgtc

SEQ ID NO: 131589 - DNA, 75 bp, Artificial Sequence
  Synthetic
acttgattaacaccaatgggagttggcacataaaccggaccgccctcaattgcaatgacagcttgcagacgggtt

SEQ ID NO: 131590 - DNA, 75 bp, Artificial Sequence
  Synthetic
tcttgattaacaccaatgggagttggcacataaaccggaccgccctcaattgcaatgacagcttgcagacgggtt

SEQ ID NO: 131591 - DNA, 75 bp, Artificial Sequence
  Synthetic
ccttgattaacaccaatgggagttggcacataaaccggaccgccctcaattgcaatgacagcttgcagacgggtt

SEQ ID NO: 131592 - DNA, 75 bp, Artificial Sequence
  Synthetic
gcttgattaacaccaatgggagttggcacataaaccggaccgccctcaattgcaatgacagcttgcagacgggtt

SEQ ID NO: 131593 - DNA, 75 bp, Artificial Sequence
  Synthetic
gaggcatcaaaccacccaggattgtaactgctctatctacactggtcacattacaggacacaggatggcttggga

SEQ ID NO: 131594 - DNA, 75 bp, Artificial Sequence
  Synthetic
gtcccagctggccgccccggttccagctacagctttcgtggttagcggcttagccggtgctgccatcggtagcat

SEQ ID NO: 131595 - DNA, 75 bp, Artificial Sequence
  Synthetic
cctgctgtccagaccaactggcaaaaactcgaggccttctgggcgaagcacatgtggaatttcatcagtgggata

SEQ ID NO: 131596 - DNA, 75 bp, Artificial Sequence
  Synthetic
ggagtgcgtgtctgtgagaaacgcgctctgtatgacgtgatacagaagttgtcaaccgcgacgatgggttccgca

SEQ ID NO: 131597 - DNA, 75 bp, Artificial Sequence
  Synthetic
ggagtgcgtgtctgtgagaaacgcgctctgtatgacgtgatacagaagttgtcaaccgcgacgatgggttccgct

SEQ ID NO: 131598 - DNA, 75 bp, Artificial Sequence
  Synthetic
ggagtgcgtgtctgtgagaaacgcgctctgtatgacgtgatacagaagttgtcaaccgcgacgatgggttccgcc

SEQ ID NO: 131599 - DNA, 75 bp, Artificial Sequence
  Synthetic
ggagtgcgtgtctgtgagaaacgcgctctgtatgacgtgatacagaagttgtcaaccgcgacgatgggttccgcg

SEQ ID NO: 131600 - DNA, 75 bp, Artificial Sequence
  Synthetic
ttgactccactgtcaccgaacaggacatcaggacggaagcggagatataccaatgttgtgaccttgaaccggaag

SEQ ID NO: 131601 - DNA, 75 bp, Artificial Sequence
  Synthetic
gaacgactgctccaactcaagcattgtgtatgaggcagcggacatgatcatgcacgcccccgggtgcgtgccctg

SEQ ID NO: 131602 - DNA, 75 bp, Artificial Sequence
  Synthetic
tggggttctgcctaccagcttcggtaacaccatcacctgttacatcaaggctatggcagcttccaaagcagccgg

SEQ ID NO: 131603 - DNA, 75 bp, Artificial Sequence
  Synthetic
tagggcggccctgagagccttcacggaggctatgaccaggtattccgccccacccggcgacgcgccacagcccac

SEQ ID NO: 131604 - DNA, 75 bp, Artificial Sequence
  Synthetic
cgcggcatgcaacttcacgcgcggggaccgctgcaggttggatgaaagggataggggccagcagagtccactgct

SEQ ID NO: 131605 - DNA, 75 bp, Artificial Sequence
  Synthetic
cgcggcatgcaacttcacgcgcggggaccgctgcaggttggatgatagggataggggccagcagagtccactgct

SEQ ID NO: 131606 - DNA, 75 bp, Artificial Sequence
  Synthetic
cgcggcatgcaacttcacgcgcggggaccgctgcaggttggatgacagggataggggccagcagagtccactgct

SEQ ID NO: 131607 - DNA, 75 bp, Artificial Sequence
  Synthetic
cgcggcatgcaacttcacgcgcggggaccgctgcaggttggatgagagggataggggccagcagagtccactgct

SEQ ID NO: 131608 - DNA, 75 bp, Artificial Sequence
  Synthetic
ctccatggtcttagcgcgttctcgctccacagttactctccaactgagctcaacagagttgcgggggctctcagg

SEQ ID NO: 131609 - DNA, 75 bp, Artificial Sequence
  Synthetic
cgtgctggtagtgacatcaatgttgagggatcctgaccacatcaccgcggaggaagcatctcgccgccttaagag

SEQ ID NO: 131610 - DNA, 75 bp, Artificial Sequence
  Synthetic
cctggagacatcgggcacgagcagtgcgcgctaagcttatagctcaggggggaaaggccaaaatctgtggccttt

SEQ ID NO: 131611 - DNA, 75 bp, Artificial Sequence
  Synthetic
gtcctggccttaccacagcgggcctatgccatggaagcagtggaccaaggagaactggggctgaatgtattggca

SEQ ID NO: 131612 - DNA, 75 bp, Artificial Sequence
  Synthetic
gtcctggccttaccacagcgggcctatgccatggaagcagtggaccaaggagaactggggctgattgtattggca

SEQ ID NO: 131613 - DNA, 75 bp, Artificial Sequence
  Synthetic
gtcctggccttaccacagcgggcctatgccatggaagcagtggaccaaggagaactggggctgactgtattggca

SEQ ID NO: 131614 - DNA, 75 bp, Artificial Sequence
  Synthetic
gtcctggccttaccacagcgggcctatgccatggaagcagtggaccaaggagaactggggctgagtgtattggca

SEQ ID NO: 131615 - DNA, 75 bp, Artificial Sequence
  Synthetic
gtcctggccttaccacagcgggcctatgccatggatgcagtggaccaaggagaactggggctgaatgtattggca

SEQ ID NO: 131616 - DNA, 75 bp, Artificial Sequence
  Synthetic
gtcctggccttaccacagcgggcctatgccatggatgcagtggaccaaggagaactggggctgattgtattggca

SEQ ID NO: 131617 - DNA, 75 bp, Artificial Sequence
  Synthetic
gtcctggccttaccacagcgggcctatgccatggatgcagtggaccaaggagaactggggctgactgtattggca

SEQ ID NO: 131618 - DNA, 75 bp, Artificial Sequence
  Synthetic
gtcctggccttaccacagcgggcctatgccatggatgcagtggaccaaggagaactggggctgagtgtattggca

SEQ ID NO: 131619 - DNA, 75 bp, Artificial Sequence
  Synthetic
gtcctggccttaccacagcgggcctatgccatggacgcagtggaccaaggagaactggggctgaatgtattggca

SEQ ID NO: 131620 - DNA, 75 bp, Artificial Sequence
  Synthetic
gtcctggccttaccacagcgggcctatgccatggacgcagtggaccaaggagaactggggctgattgtattggca

SEQ ID NO: 131621 - DNA, 75 bp, Artificial Sequence
  Synthetic
gtcctggccttaccacagcgggcctatgccatggacgcagtggaccaaggagaactggggctgactgtattggca

SEQ ID NO: 131622 - DNA, 75 bp, Artificial Sequence
  Synthetic
gtcctggccttaccacagcgggcctatgccatggacgcagtggaccaaggagaactggggctgagtgtattggca

SEQ ID NO: 131623 - DNA, 75 bp, Artificial Sequence
  Synthetic
gtcctggccttaccacagcgggcctatgccatggaggcagtggaccaaggagaactggggctgaatgtattggca

SEQ ID NO: 131624 - DNA, 75 bp, Artificial Sequence
  Synthetic
gtcctggccttaccacagcgggcctatgccatggaggcagtggaccaaggagaactggggctgattgtattggca

SEQ ID NO: 131625 - DNA, 75 bp, Artificial Sequence
  Synthetic
gtcctggccttaccacagcgggcctatgccatggaggcagtggaccaaggagaactggggctgactgtattggca

SEQ ID NO: 131626 - DNA, 75 bp, Artificial Sequence
  Synthetic
gtcctggccttaccacagcgggcctatgccatggaggcagtggaccaaggagaactggggctgagtgtattggca

SEQ ID NO: 131627 - DNA, 75 bp, Artificial Sequence
  Synthetic
gtcctggccttaccacagcgggcctatgccttggaagcagtggaccaaggagaactggggctgaatgtattggca

SEQ ID NO: 131628 - DNA, 75 bp, Artificial Sequence
  Synthetic
gtcctggccttaccacagcgggcctatgccttggaagcagtggaccaaggagaactggggctgattgtattggca

SEQ ID NO: 131629 - DNA, 75 bp, Artificial Sequence
  Synthetic
gtcctggccttaccacagcgggcctatgccttggaagcagtggaccaaggagaactggggctgactgtattggca

SEQ ID NO: 131630 - DNA, 75 bp, Artificial Sequence
  Synthetic
gtcctggccttaccacagcgggcctatgccttggaagcagtggaccaaggagaactggggctgagtgtattggca

SEQ ID NO: 131631 - DNA, 75 bp, Artificial Sequence
  Synthetic
gtcctggccttaccacagcgggcctatgccttggatgcagtggaccaaggagaactggggctgaatgtattggca

SEQ ID NO: 131632 - DNA, 75 bp, Artificial Sequence
  Synthetic
gtcctggccttaccacagcgggcctatgccttggatgcagtggaccaaggagaactggggctgattgtattggca

SEQ ID NO: 131633 - DNA, 75 bp, Artificial Sequence
  Synthetic
gtcctggccttaccacagcgggcctatgccttggatgcagtggaccaaggagaactggggctgactgtattggca

SEQ ID NO: 131634 - DNA, 75 bp, Artificial Sequence
  Synthetic
gtcctggccttaccacagcgggcctatgccttggatgcagtggaccaaggagaactggggctgagtgtattggca

SEQ ID NO: 131635 - DNA, 75 bp, Artificial Sequence
  Synthetic
gtcctggccttaccacagcgggcctatgccttggacgcagtggaccaaggagaactggggctgaatgtattggca

SEQ ID NO: 131636 - DNA, 75 bp, Artificial Sequence
  Synthetic
gtcctggccttaccacagcgggcctatgccttggacgcagtggaccaaggagaactggggctgattgtattggca

SEQ ID NO: 131637 - DNA, 75 bp, Artificial Sequence
  Synthetic
gtcctggccttaccacagcgggcctatgccttggacgcagtggaccaaggagaactggggctgactgtattggca

SEQ ID NO: 131638 - DNA, 75 bp, Artificial Sequence
  Synthetic
gtcctggccttaccacagcgggcctatgccttggacgcagtggaccaaggagaactggggctgagtgtattggca

SEQ ID NO: 131639 - DNA, 75 bp, Artificial Sequence
  Synthetic
gtcctggccttaccacagcgggcctatgccttggaggcagtggaccaaggagaactggggctgaatgtattggca

SEQ ID NO: 131640 - DNA, 75 bp, Artificial Sequence
  Synthetic
gtcctggccttaccacagcgggcctatgccttggaggcagtggaccaaggagaactggggctgattgtattggca

SEQ ID NO: 131641 - DNA, 75 bp, Artificial Sequence
  Synthetic
gtcctggccttaccacagcgggcctatgccttggaggcagtggaccaaggagaactggggctgactgtattggca

SEQ ID NO: 131642 - DNA, 75 bp, Artificial Sequence
  Synthetic
gtcctggccttaccacagcgggcctatgccttggaggcagtggaccaaggagaactggggctgagtgtattggca

SEQ ID NO: 131643 - DNA, 75 bp, Artificial Sequence
  Synthetic
gtcctggccttaccacagcgggcctatgccctggaagcagtggaccaaggagaactggggctgaatgtattggca

SEQ ID NO: 131644 - DNA, 75 bp, Artificial Sequence
  Synthetic
gtcctggccttaccacagcgggcctatgccctggaagcagtggaccaaggagaactggggctgattgtattggca

SEQ ID NO: 131645 - DNA, 75 bp, Artificial Sequence
  Synthetic
gtcctggccttaccacagcgggcctatgccctggaagcagtggaccaaggagaactggggctgactgtattggca

SEQ ID NO: 131646 - DNA, 75 bp, Artificial Sequence
  Synthetic
gtcctggccttaccacagcgggcctatgccctggaagcagtggaccaaggagaactggggctgagtgtattggca

SEQ ID NO: 131647 - DNA, 75 bp, Artificial Sequence
  Synthetic
gtcctggccttaccacagcgggcctatgccctggatgcagtggaccaaggagaactggggctgaatgtattggca

SEQ ID NO: 131648 - DNA, 75 bp, Artificial Sequence
  Synthetic
gtcctggccttaccacagcgggcctatgccctggatgcagtggaccaaggagaactggggctgattgtattggca

SEQ ID NO: 131649 - DNA, 75 bp, Artificial Sequence
  Synthetic
gtcctggccttaccacagcgggcctatgccctggatgcagtggaccaaggagaactggggctgactgtattggca

SEQ ID NO: 131650 - DNA, 75 bp, Artificial Sequence
  Synthetic
gtcctggccttaccacagcgggcctatgccctggatgcagtggaccaaggagaactggggctgagtgtattggca

SEQ ID NO: 131651 - DNA, 75 bp, Artificial Sequence
  Synthetic
gtcctggccttaccacagcgggcctatgccctggacgcagtggaccaaggagaactggggctgaatgtattggca

SEQ ID NO: 131652 - DNA, 75 bp, Artificial Sequence
  Synthetic
gtcctggccttaccacagcgggcctatgccctggacgcagtggaccaaggagaactggggctgattgtattggca

SEQ ID NO: 131653 - DNA, 75 bp, Artificial Sequence
  Synthetic
gtcctggccttaccacagcgggcctatgccctggacgcagtggaccaaggagaactggggctgactgtattggca

SEQ ID NO: 131654 - DNA, 75 bp, Artificial Sequence
  Synthetic
gtcctggccttaccacagcgggcctatgccctggacgcagtggaccaaggagaactggggctgagtgtattggca

SEQ ID NO: 131655 - DNA, 75 bp, Artificial Sequence
  Synthetic
gtcctggccttaccacagcgggcctatgccctggaggcagtggaccaaggagaactggggctgaatgtattggca

SEQ ID NO: 131656 - DNA, 75 bp, Artificial Sequence
  Synthetic
gtcctggccttaccacagcgggcctatgccctggaggcagtggaccaaggagaactggggctgattgtattggca

SEQ ID NO: 131657 - DNA, 75 bp, Artificial Sequence
  Synthetic
gtcctggccttaccacagcgggcctatgccctggaggcagtggaccaaggagaactggggctgactgtattggca

SEQ ID NO: 131658 - DNA, 75 bp, Artificial Sequence
  Synthetic
gtcctggccttaccacagcgggcctatgccctggaggcagtggaccaaggagaactggggctgagtgtattggca

SEQ ID NO: 131659 - DNA, 75 bp, Artificial Sequence
  Synthetic
gtcctggccttaccacagcgggcctatgccgtggaagcagtggaccaaggagaactggggctgaatgtattggca

SEQ ID NO: 131660 - DNA, 75 bp, Artificial Sequence
  Synthetic
gtcctggccttaccacagcgggcctatgccgtggaagcagtggaccaaggagaactggggctgattgtattggca

SEQ ID NO: 131661 - DNA, 75 bp, Artificial Sequence
  Synthetic
gtcctggccttaccacagcgggcctatgccgtggaagcagtggaccaaggagaactggggctgactgtattggca

SEQ ID NO: 131662 - DNA, 75 bp, Artificial Sequence
  Synthetic
gtcctggccttaccacagcgggcctatgccgtggaagcagtggaccaaggagaactggggctgagtgtattggca

SEQ ID NO: 131663 - DNA, 75 bp, Artificial Sequence
  Synthetic
gtcctggccttaccacagcgggcctatgccgtggatgcagtggaccaaggagaactggggctgaatgtattggca

SEQ ID NO: 131664 - DNA, 75 bp, Artificial Sequence
  Synthetic
gtcctggccttaccacagcgggcctatgccgtggatgcagtggaccaaggagaactggggctgattgtattggca

SEQ ID NO: 131665 - DNA, 75 bp, Artificial Sequence
  Synthetic
gtcctggccttaccacagcgggcctatgccgtggatgcagtggaccaaggagaactggggctgactgtattggca

SEQ ID NO: 131666 - DNA, 75 bp, Artificial Sequence
  Synthetic
gtcctggccttaccacagcgggcctatgccgtggatgcagtggaccaaggagaactggggctgagtgtattggca

SEQ ID NO: 131667 - DNA, 75 bp, Artificial Sequence
  Synthetic
gtcctggccttaccacagcgggcctatgccgtggacgcagtggaccaaggagaactggggctgaatgtattggca

SEQ ID NO: 131668 - DNA, 75 bp, Artificial Sequence
  Synthetic
gtcctggccttaccacagcgggcctatgccgtggacgcagtggaccaaggagaactggggctgattgtattggca

SEQ ID NO: 131669 - DNA, 75 bp, Artificial Sequence
  Synthetic
gtcctggccttaccacagcgggcctatgccgtggacgcagtggaccaaggagaactggggctgactgtattggca

SEQ ID NO: 131670 - DNA, 75 bp, Artificial Sequence
  Synthetic
gtcctggccttaccacagcgggcctatgccgtggacgcagtggaccaaggagaactggggctgagtgtattggca

SEQ ID NO: 131671 - DNA, 75 bp, Artificial Sequence
  Synthetic
gtcctggccttaccacagcgggcctatgccgtggaggcagtggaccaaggagaactggggctgaatgtattggca

SEQ ID NO: 131672 - DNA, 75 bp, Artificial Sequence
  Synthetic
gtcctggccttaccacagcgggcctatgccgtggaggcagtggaccaaggagaactggggctgattgtattggca

SEQ ID NO: 131673 - DNA, 75 bp, Artificial Sequence
  Synthetic
gtcctggccttaccacagcgggcctatgccgtggaggcagtggaccaaggagaactggggctgactgtattggca

SEQ ID NO: 131674 - DNA, 75 bp, Artificial Sequence
  Synthetic
gtcctggccttaccacagcgggcctatgccgtggaggcagtggaccaaggagaactggggctgagtgtattggca

SEQ ID NO: 131675 - DNA, 75 bp, Artificial Sequence
  Synthetic
ccacggagaaagaggacgattgtcctaacagagtccactgtgtcctctgccctggcggagctcgctactaagacc

SEQ ID NO: 131676 - DNA, 75 bp, Artificial Sequence
  Synthetic
ccggggggggcgtgacgggatcatctgggtggctgtcatactacacccacgcctcgtgtttgagatcacgaaatg

SEQ ID NO: 131677 - DNA, 75 bp, Artificial Sequence
  Synthetic
ccggggggggcgtgacgggatcatctgggtggctgtcatactacacccacgcctcgtgtttgagatcacgaattg

SEQ ID NO: 131678 - DNA, 75 bp, Artificial Sequence
  Synthetic
ccggggggggcgtgacgggatcatctgggtggctgtcatactacacccacgcctcgtgtttgagatcacgaactg

SEQ ID NO: 131679 - DNA, 75 bp, Artificial Sequence
  Synthetic
ccggggggggcgtgacgggatcatctgggtggctgtcatactacacccacgcctcgtgtttgagatcacgaagtg

SEQ ID NO: 131680 - DNA, 75 bp, Artificial Sequence
  Synthetic
ccggggggggcgtgacgggatcatctgggtggctgtcatacttcacccacgcctcgtgtttgagatcacgaaatg

SEQ ID NO: 131681 - DNA, 75 bp, Artificial Sequence
  Synthetic
ccggggggggcgtgacgggatcatctgggtggctgtcatacttcacccacgcctcgtgtttgagatcacgaattg

SEQ ID NO: 131682 - DNA, 75 bp, Artificial Sequence
  Synthetic
ccggggggggcgtgacgggatcatctgggtggctgtcatacttcacccacgcctcgtgtttgagatcacgaactg

SEQ ID NO: 131683 - DNA, 75 bp, Artificial Sequence
  Synthetic
ccggggggggcgtgacgggatcatctgggtggctgtcatacttcacccacgcctcgtgtttgagatcacgaagtg

SEQ ID NO: 131684 - DNA, 75 bp, Artificial Sequence
  Synthetic
ccggggggggcgtgacgggatcatctgggtggctgtcatactccacccacgcctcgtgtttgagatcacgaaatg

SEQ ID NO: 131685 - DNA, 75 bp, Artificial Sequence
  Synthetic
ccggggggggcgtgacgggatcatctgggtggctgtcatactccacccacgcctcgtgtttgagatcacgaattg

SEQ ID NO: 131686 - DNA, 75 bp, Artificial Sequence
  Synthetic
ccggggggggcgtgacgggatcatctgggtggctgtcatactccacccacgcctcgtgtttgagatcacgaactg

SEQ ID NO: 131687 - DNA, 75 bp, Artificial Sequence
  Synthetic
ccggggggggcgtgacgggatcatctgggtggctgtcatactccacccacgcctcgtgtttgagatcacgaagtg

SEQ ID NO: 131688 - DNA, 75 bp, Artificial Sequence
  Synthetic
ccggggggggcgtgacgggatcatctgggtggctgtcatactgcacccacgcctcgtgtttgagatcacgaaatg

SEQ ID NO: 131689 - DNA, 75 bp, Artificial Sequence
  Synthetic
ccggggggggcgtgacgggatcatctgggtggctgtcatactgcacccacgcctcgtgtttgagatcacgaattg

SEQ ID NO: 131690 - DNA, 75 bp, Artificial Sequence
  Synthetic
ccggggggggcgtgacgggatcatctgggtggctgtcatactgcacccacgcctcgtgtttgagatcacgaactg

SEQ ID NO: 131691 - DNA, 75 bp, Artificial Sequence
  Synthetic
ccggggggggcgtgacgggatcatctgggtggctgtcatactgcacccacgcctcgtgtttgagatcacgaagtg

SEQ ID NO: 131692 - DNA, 75 bp, Artificial Sequence
  Synthetic
ccggggggggcgtgacgggatcatctgggtggctgtcattctacacccacgcctcgtgtttgagatcacgaaatg

SEQ ID NO: 131693 - DNA, 75 bp, Artificial Sequence
  Synthetic
ccggggggggcgtgacgggatcatctgggtggctgtcattctacacccacgcctcgtgtttgagatcacgaattg

SEQ ID NO: 131694 - DNA, 75 bp, Artificial Sequence
  Synthetic
ccggggggggcgtgacgggatcatctgggtggctgtcattctacacccacgcctcgtgtttgagatcacgaactg

SEQ ID NO: 131695 - DNA, 75 bp, Artificial Sequence
  Synthetic
ccggggggggcgtgacgggatcatctgggtggctgtcattctacacccacgcctcgtgtttgagatcacgaagtg

SEQ ID NO: 131696 - DNA, 75 bp, Artificial Sequence
  Synthetic
ccggggggggcgtgacgggatcatctgggtggctgtcattcttcacccacgcctcgtgtttgagatcacgaaatg

SEQ ID NO: 131697 - DNA, 75 bp, Artificial Sequence
  Synthetic
ccggggggggcgtgacgggatcatctgggtggctgtcattcttcacccacgcctcgtgtttgagatcacgaattg

SEQ ID NO: 131698 - DNA, 75 bp, Artificial Sequence
  Synthetic
ccggggggggcgtgacgggatcatctgggtggctgtcattcttcacccacgcctcgtgtttgagatcacgaactg

SEQ ID NO: 131699 - DNA, 75 bp, Artificial Sequence
  Synthetic
ccggggggggcgtgacgggatcatctgggtggctgtcattcttcacccacgcctcgtgtttgagatcacgaagtg

SEQ ID NO: 131700 - DNA, 75 bp, Artificial Sequence
  Synthetic
ccggggggggcgtgacgggatcatctgggtggctgtcattctccacccacgcctcgtgtttgagatcacgaaatg

SEQ ID NO: 131701 - DNA, 75 bp, Artificial Sequence
  Synthetic
ccggggggggcgtgacgggatcatctgggtggctgtcattctccacccacgcctcgtgtttgagatcacgaattg

SEQ ID NO: 131702 - DNA, 75 bp, Artificial Sequence
  Synthetic
ccggggggggcgtgacgggatcatctgggtggctgtcattctccacccacgcctcgtgtttgagatcacgaactg

SEQ ID NO: 131703 - DNA, 75 bp, Artificial Sequence
  Synthetic
ccggggggggcgtgacgggatcatctgggtggctgtcattctccacccacgcctcgtgtttgagatcacgaagtg

SEQ ID NO: 131704 - DNA, 75 bp, Artificial Sequence
  Synthetic
ccggggggggcgtgacgggatcatctgggtggctgtcattctgcacccacgcctcgtgtttgagatcacgaaatg

SEQ ID NO: 131705 - DNA, 75 bp, Artificial Sequence
  Synthetic
ccggggggggcgtgacgggatcatctgggtggctgtcattctgcacccacgcctcgtgtttgagatcacgaattg

SEQ ID NO: 131706 - DNA, 75 bp, Artificial Sequence
  Synthetic
ccggggggggcgtgacgggatcatctgggtggctgtcattctgcacccacgcctcgtgtttgagatcacgaactg

SEQ ID NO: 131707 - DNA, 75 bp, Artificial Sequence
  Synthetic
ccggggggggcgtgacgggatcatctgggtggctgtcattctgcacccacgcctcgtgtttgagatcacgaagtg

SEQ ID NO: 131708 - DNA, 75 bp, Artificial Sequence
  Synthetic
ccggggggggcgtgacgggatcatctgggtggctgtcatcctacacccacgcctcgtgtttgagatcacgaaatg

SEQ ID NO: 131709 - DNA, 75 bp, Artificial Sequence
  Synthetic
ccggggggggcgtgacgggatcatctgggtggctgtcatcctacacccacgcctcgtgtttgagatcacgaattg

SEQ ID NO: 131710 - DNA, 75 bp, Artificial Sequence
  Synthetic
ccggggggggcgtgacgggatcatctgggtggctgtcatcctacacccacgcctcgtgtttgagatcacgaactg

SEQ ID NO: 131711 - DNA, 75 bp, Artificial Sequence
  Synthetic
ccggggggggcgtgacgggatcatctgggtggctgtcatcctacacccacgcctcgtgtttgagatcacgaagtg

SEQ ID NO: 131712 - DNA, 75 bp, Artificial Sequence
  Synthetic
ccggggggggcgtgacgggatcatctgggtggctgtcatccttcacccacgcctcgtgtttgagatcacgaaatg

SEQ ID NO: 131713 - DNA, 75 bp, Artificial Sequence
  Synthetic
ccggggggggcgtgacgggatcatctgggtggctgtcatccttcacccacgcctcgtgtttgagatcacgaattg

SEQ ID NO: 131714 - DNA, 75 bp, Artificial Sequence
  Synthetic
ccggggggggcgtgacgggatcatctgggtggctgtcatccttcacccacgcctcgtgtttgagatcacgaactg

SEQ ID NO: 131715 - DNA, 75 bp, Artificial Sequence
  Synthetic
ccggggggggcgtgacgggatcatctgggtggctgtcatccttcacccacgcctcgtgtttgagatcacgaagtg

SEQ ID NO: 131716 - DNA, 75 bp, Artificial Sequence
  Synthetic
ccggggggggcgtgacgggatcatctgggtggctgtcatcctccacccacgcctcgtgtttgagatcacgaaatg

SEQ ID NO: 131717 - DNA, 75 bp, Artificial Sequence
  Synthetic
ccggggggggcgtgacgggatcatctgggtggctgtcatcctccacccacgcctcgtgtttgagatcacgaattg

SEQ ID NO: 131718 - DNA, 75 bp, Artificial Sequence
  Synthetic
ccggggggggcgtgacgggatcatctgggtggctgtcatcctccacccacgcctcgtgtttgagatcacgaactg

SEQ ID NO: 131719 - DNA, 75 bp, Artificial Sequence
  Synthetic
ccggggggggcgtgacgggatcatctgggtggctgtcatcctccacccacgcctcgtgtttgagatcacgaagtg

SEQ ID NO: 131720 - DNA, 75 bp, Artificial Sequence
  Synthetic
ccggggggggcgtgacgggatcatctgggtggctgtcatcctgcacccacgcctcgtgtttgagatcacgaaatg

SEQ ID NO: 131721 - DNA, 75 bp, Artificial Sequence
  Synthetic
ccggggggggcgtgacgggatcatctgggtggctgtcatcctgcacccacgcctcgtgtttgagatcacgaattg

SEQ ID NO: 131722 - DNA, 75 bp, Artificial Sequence
  Synthetic
ccggggggggcgtgacgggatcatctgggtggctgtcatcctgcacccacgcctcgtgtttgagatcacgaactg

SEQ ID NO: 131723 - DNA, 75 bp, Artificial Sequence
  Synthetic
ccggggggggcgtgacgggatcatctgggtggctgtcatcctgcacccacgcctcgtgtttgagatcacgaagtg

SEQ ID NO: 131724 - DNA, 75 bp, Artificial Sequence
  Synthetic
ccggggggggcgtgacgggatcatctgggtggctgtcatgctacacccacgcctcgtgtttgagatcacgaaatg

SEQ ID NO: 131725 - DNA, 75 bp, Artificial Sequence
  Synthetic
ccggggggggcgtgacgggatcatctgggtggctgtcatgctacacccacgcctcgtgtttgagatcacgaattg

SEQ ID NO: 131726 - DNA, 75 bp, Artificial Sequence
  Synthetic
ccggggggggcgtgacgggatcatctgggtggctgtcatgctacacccacgcctcgtgtttgagatcacgaactg

SEQ ID NO: 131727 - DNA, 75 bp, Artificial Sequence
  Synthetic
ccggggggggcgtgacgggatcatctgggtggctgtcatgctacacccacgcctcgtgtttgagatcacgaagtg

SEQ ID NO: 131728 - DNA, 75 bp, Artificial Sequence
  Synthetic
ccggggggggcgtgacgggatcatctgggtggctgtcatgcttcacccacgcctcgtgtttgagatcacgaaatg

SEQ ID NO: 131729 - DNA, 75 bp, Artificial Sequence
  Synthetic
ccggggggggcgtgacgggatcatctgggtggctgtcatgcttcacccacgcctcgtgtttgagatcacgaattg

SEQ ID NO: 131730 - DNA, 75 bp, Artificial Sequence
  Synthetic
ccggggggggcgtgacgggatcatctgggtggctgtcatgcttcacccacgcctcgtgtttgagatcacgaactg

SEQ ID NO: 131731 - DNA, 75 bp, Artificial Sequence
  Synthetic
ccggggggggcgtgacgggatcatctgggtggctgtcatgcttcacccacgcctcgtgtttgagatcacgaagtg

SEQ ID NO: 131732 - DNA, 75 bp, Artificial Sequence
  Synthetic
ccggggggggcgtgacgggatcatctgggtggctgtcatgctccacccacgcctcgtgtttgagatcacgaaatg

SEQ ID NO: 131733 - DNA, 75 bp, Artificial Sequence
  Synthetic
ccggggggggcgtgacgggatcatctgggtggctgtcatgctccacccacgcctcgtgtttgagatcacgaattg

SEQ ID NO: 131734 - DNA, 75 bp, Artificial Sequence
  Synthetic
ccggggggggcgtgacgggatcatctgggtggctgtcatgctccacccacgcctcgtgtttgagatcacgaactg

SEQ ID NO: 131735 - DNA, 75 bp, Artificial Sequence
  Synthetic
ccggggggggcgtgacgggatcatctgggtggctgtcatgctccacccacgcctcgtgtttgagatcacgaagtg

SEQ ID NO: 131736 - DNA, 75 bp, Artificial Sequence
  Synthetic
ccggggggggcgtgacgggatcatctgggtggctgtcatgctgcacccacgcctcgtgtttgagatcacgaaatg

SEQ ID NO: 131737 - DNA, 75 bp, Artificial Sequence
  Synthetic
ccggggggggcgtgacgggatcatctgggtggctgtcatgctgcacccacgcctcgtgtttgagatcacgaattg

SEQ ID NO: 131738 - DNA, 75 bp, Artificial Sequence
  Synthetic
ccggggggggcgtgacgggatcatctgggtggctgtcatgctgcacccacgcctcgtgtttgagatcacgaactg

SEQ ID NO: 131739 - DNA, 75 bp, Artificial Sequence
  Synthetic
ccggggggggcgtgacgggatcatctgggtggctgtcatgctgcacccacgcctcgtgtttgagatcacgaagtg

SEQ ID NO: 131740 - DNA, 75 bp, Artificial Sequence
  Synthetic
ccgctctgcctgtgtgggcccgacctgattataacccgcctttgcttgagtcttggaaggcaccagactatgacc

SEQ ID NO: 131741 - DNA, 75 bp, Artificial Sequence
  Synthetic
aactcctcaacttctggcattacgagcgacaatgcgacaccatcctctgagcttgtctcctctggccgcccccca

SEQ ID NO: 131742 - DNA, 75 bp, Artificial Sequence
  Synthetic
acacgtactggctcagctagctgaaaagagttttccagccacaccggaccaaccccacaccaattcagactctgg

SEQ ID NO: 131743 - DNA, 75 bp, Artificial Sequence
  Synthetic
gtgttcagcccaatggagaggaaggtcattgtgtggggggctgaaacggtggcatgtggagatatcctgcacggc

SEQ ID NO: 131744 - DNA, 75 bp, Artificial Sequence
  Synthetic
gtgttcagcccaatggagaggaaggtcattgtgtggggggctgaaacggtggcatgtggtgatatcctgcacggc

SEQ ID NO: 131745 - DNA, 75 bp, Artificial Sequence
  Synthetic
gtgttcagcccaatggagaggaaggtcattgtgtggggggctgaaacggtggcatgtggcgatatcctgcacggc

SEQ ID NO: 131746 - DNA, 75 bp, Artificial Sequence
  Synthetic
gtgttcagcccaatggagaggaaggtcattgtgtggggggctgaaacggtggcatgtggggatatcctgcacggc

SEQ ID NO: 131747 - DNA, 75 bp, Artificial Sequence
  Synthetic
cccgcttccacctccacagtcccctcctgtgcctccgcctcgaaagaagcggacggtggtcctcaccgaatcaac

SEQ ID NO: 131748 - DNA, 75 bp, Artificial Sequence
  Synthetic
ctaccatcagctgaagatgatgacgcctcagacgcagactcatatagctctatgccgcctcttgagggcgaaccc

SEQ ID NO: 131749 - DNA, 75 bp, Artificial Sequence
  Synthetic
ggcttgatccatctccatcagaacatcgtggacgtgcaatacttgtacggtatagggtcagcggttgtctccttt

SEQ ID NO: 131750 - DNA, 75 bp, Artificial Sequence
  Synthetic
ggcgcatttgcaagtgtgggtcccccccctcaacgttcgggggggccgcgatgccatcatcctcctcacgtgcgc

SEQ ID NO: 131751 - DNA, 75 bp, Artificial Sequence
  Synthetic
tgtccatgcggagcaaacatctcgggccatgtccgcatgggtaccatgaaaataacaggcccgaagacctgcttg

SEQ ID NO: 131752 - DNA, 75 bp, Artificial Sequence
  Synthetic
cggtcttcacggacaactcgtcccctccggccgtaccgcagacattacaagtggcacatctacatgcccccaccg

SEQ ID NO: 131753 - DNA, 75 bp, Artificial Sequence
  Synthetic
cggtcttcacggacaactcgtcccctccggccgtaccgcagacattacaagtggctcatctacatgcccccaccg

SEQ ID NO: 131754 - DNA, 75 bp, Artificial Sequence
  Synthetic
cggtcttcacggacaactcgtcccctccggccgtaccgcagacattacaagtggcccatctacatgcccccaccg

SEQ ID NO: 131755 - DNA, 75 bp, Artificial Sequence
  Synthetic
cggtcttcacggacaactcgtcccctccggccgtaccgcagacattacaagtggcgcatctacatgcccccaccg

SEQ ID NO: 131756 - DNA, 75 bp, Artificial Sequence
  Synthetic
cggtcttcacggacaactcgtcccctccggccgtaccgcagacatttcaagtggcacatctacatgcccccaccg

SEQ ID NO: 131757 - DNA, 75 bp, Artificial Sequence
  Synthetic
cggtcttcacggacaactcgtcccctccggccgtaccgcagacatttcaagtggctcatctacatgcccccaccg

SEQ ID NO: 131758 - DNA, 75 bp, Artificial Sequence
  Synthetic
cggtcttcacggacaactcgtcccctccggccgtaccgcagacatttcaagtggcccatctacatgcccccaccg

SEQ ID NO: 131759 - DNA, 75 bp, Artificial Sequence
  Synthetic
cggtcttcacggacaactcgtcccctccggccgtaccgcagacatttcaagtggcgcatctacatgcccccaccg

SEQ ID NO: 131760 - DNA, 75 bp, Artificial Sequence
  Synthetic
cggtcttcacggacaactcgtcccctccggccgtaccgcagacattccaagtggcacatctacatgcccccaccg

SEQ ID NO: 131761 - DNA, 75 bp, Artificial Sequence
  Synthetic
cggtcttcacggacaactcgtcccctccggccgtaccgcagacattccaagtggctcatctacatgcccccaccg

SEQ ID NO: 131762 - DNA, 75 bp, Artificial Sequence
  Synthetic
cggtcttcacggacaactcgtcccctccggccgtaccgcagacattccaagtggcccatctacatgcccccaccg

SEQ ID NO: 131763 - DNA, 75 bp, Artificial Sequence
  Synthetic
cggtcttcacggacaactcgtcccctccggccgtaccgcagacattccaagtggcgcatctacatgcccccaccg

SEQ ID NO: 131764 - DNA, 75 bp, Artificial Sequence
  Synthetic
cggtcttcacggacaactcgtcccctccggccgtaccgcagacattgcaagtggcacatctacatgcccccaccg

SEQ ID NO: 131765 - DNA, 75 bp, Artificial Sequence
  Synthetic
cggtcttcacggacaactcgtcccctccggccgtaccgcagacattgcaagtggctcatctacatgcccccaccg

SEQ ID NO: 131766 - DNA, 75 bp, Artificial Sequence
  Synthetic
cggtcttcacggacaactcgtcccctccggccgtaccgcagacattgcaagtggcccatctacatgcccccaccg

SEQ ID NO: 131767 - DNA, 75 bp, Artificial Sequence
  Synthetic
cggtcttcacggacaactcgtcccctccggccgtaccgcagacattgcaagtggcgcatctacatgcccccaccg

SEQ ID NO: 131768 - DNA, 75 bp, Artificial Sequence
  Synthetic
cctggcgctcgaagaagacacctatgggattttcctatgatactagctgctttgactccacagtgactgagcgtg

SEQ ID NO: 131769 - DNA, 75 bp, Artificial Sequence
  Synthetic
gcatggctctttctcgtacgtaacggggttaaccagtgacaaccttaaggtcccttgccaggtaccagctccaga

SEQ ID NO: 131770 - DNA, 75 bp, Artificial Sequence
  Synthetic
tgtgatgaactcgccgcaaagctgtcgggcctcggactcaacgctgtagcgtattaccggggacttgacgtgtcc

SEQ ID NO: 131771 - DNA, 75 bp, Artificial Sequence
  Synthetic
tgtgatgaactcgccgcaaagctgtcgggcctcggactcaacgctgtagcgtattaccggggtcttgacgtgtcc

SEQ ID NO: 131772 - DNA, 75 bp, Artificial Sequence
  Synthetic
tgtgatgaactcgccgcaaagctgtcgggcctcggactcaacgctgtagcgtattaccggggccttgacgtgtcc

SEQ ID NO: 131773 - DNA, 75 bp, Artificial Sequence
  Synthetic
tgtgatgaactcgccgcaaagctgtcgggcctcggactcaacgctgtagcgtattaccgggggcttgacgtgtcc

SEQ ID NO: 131774 - DNA, 75 bp, Artificial Sequence
  Synthetic
gacgggctttaccggcgactttgaatcagtgatcgactgtaacacatgtgtcacacaaacagtcgatttcagctt

SEQ ID NO: 131775 - DNA, 75 bp, Artificial Sequence
  Synthetic
gacgggctttaccggcgactttgaatcagtgatcgactgtaacacatgtgtcacacaatcagtcgatttcagctt

SEQ ID NO: 131776 - DNA, 75 bp, Artificial Sequence
  Synthetic
gacgggctttaccggcgactttgaatcagtgatcgactgtaacacatgtgtcacacaaccagtcgatttcagctt

SEQ ID NO: 131777 - DNA, 75 bp, Artificial Sequence
  Synthetic
gacgggctttaccggcgactttgaatcagtgatcgactgtaacacatgtgtcacacaagcagtcgatttcagctt

SEQ ID NO: 131778 - DNA, 75 bp, Artificial Sequence
  Synthetic
gacgggctttaccggcgactttgaatcagtgatcgactgtaacacatgtgtcactcaaacagtcgatttcagctt

SEQ ID NO: 131779 - DNA, 75 bp, Artificial Sequence
  Synthetic
gacgggctttaccggcgactttgaatcagtgatcgactgtaacacatgtgtcactcaatcagtcgatttcagctt

SEQ ID NO: 131780 - DNA, 75 bp, Artificial Sequence
  Synthetic
gacgggctttaccggcgactttgaatcagtgatcgactgtaacacatgtgtcactcaaccagtcgatttcagctt

SEQ ID NO: 131781 - DNA, 75 bp, Artificial Sequence
  Synthetic
gacgggctttaccggcgactttgaatcagtgatcgactgtaacacatgtgtcactcaagcagtcgatttcagctt

SEQ ID NO: 131782 - DNA, 75 bp, Artificial Sequence
  Synthetic
gacgggctttaccggcgactttgaatcagtgatcgactgtaacacatgtgtcacccaaacagtcgatttcagctt

SEQ ID NO: 131783 - DNA, 75 bp, Artificial Sequence
  Synthetic
gacgggctttaccggcgactttgaatcagtgatcgactgtaacacatgtgtcacccaatcagtcgatttcagctt

SEQ ID NO: 131784 - DNA, 75 bp, Artificial Sequence
  Synthetic
gacgggctttaccggcgactttgaatcagtgatcgactgtaacacatgtgtcacccaaccagtcgatttcagctt

SEQ ID NO: 131785 - DNA, 75 bp, Artificial Sequence
  Synthetic
gacgggctttaccggcgactttgaatcagtgatcgactgtaacacatgtgtcacccaagcagtcgatttcagctt

SEQ ID NO: 131786 - DNA, 75 bp, Artificial Sequence
  Synthetic
gacgggctttaccggcgactttgaatcagtgatcgactgtaacacatgtgtcacgcaaacagtcgatttcagctt

SEQ ID NO: 131787 - DNA, 75 bp, Artificial Sequence
  Synthetic
gacgggctttaccggcgactttgaatcagtgatcgactgtaacacatgtgtcacgcaatcagtcgatttcagctt

SEQ ID NO: 131788 - DNA, 75 bp, Artificial Sequence
  Synthetic
gacgggctttaccggcgactttgaatcagtgatcgactgtaacacatgtgtcacgcaaccagtcgatttcagctt

SEQ ID NO: 131789 - DNA, 75 bp, Artificial Sequence
  Synthetic
gacgggctttaccggcgactttgaatcagtgatcgactgtaacacatgtgtcacgcaagcagtcgatttcagctt

SEQ ID NO: 131790 - DNA, 75 bp, Artificial Sequence
  Synthetic
gacgggctttaccggcgactttgattcagtgatcgactgtaacacatgtgtcacacaaacagtcgatttcagctt

SEQ ID NO: 131791 - DNA, 75 bp, Artificial Sequence
  Synthetic
gacgggctttaccggcgactttgattcagtgatcgactgtaacacatgtgtcacacaatcagtcgatttcagctt

SEQ ID NO: 131792 - DNA, 75 bp, Artificial Sequence
  Synthetic
gacgggctttaccggcgactttgattcagtgatcgactgtaacacatgtgtcacacaaccagtcgatttcagctt

SEQ ID NO: 131793 - DNA, 75 bp, Artificial Sequence
  Synthetic
gacgggctttaccggcgactttgattcagtgatcgactgtaacacatgtgtcacacaagcagtcgatttcagctt

SEQ ID NO: 131794 - DNA, 75 bp, Artificial Sequence
  Synthetic
gacgggctttaccggcgactttgattcagtgatcgactgtaacacatgtgtcactcaaacagtcgatttcagctt

SEQ ID NO: 131795 - DNA, 75 bp, Artificial Sequence
  Synthetic
gacgggctttaccggcgactttgattcagtgatcgactgtaacacatgtgtcactcaatcagtcgatttcagctt

SEQ ID NO: 131796 - DNA, 75 bp, Artificial Sequence
  Synthetic
gacgggctttaccggcgactttgattcagtgatcgactgtaacacatgtgtcactcaaccagtcgatttcagctt

SEQ ID NO: 131797 - DNA, 75 bp, Artificial Sequence
  Synthetic
gacgggctttaccggcgactttgattcagtgatcgactgtaacacatgtgtcactcaagcagtcgatttcagctt

SEQ ID NO: 131798 - DNA, 75 bp, Artificial Sequence
  Synthetic
gacgggctttaccggcgactttgattcagtgatcgactgtaacacatgtgtcacccaaacagtcgatttcagctt

SEQ ID NO: 131799 - DNA, 75 bp, Artificial Sequence
  Synthetic
gacgggctttaccggcgactttgattcagtgatcgactgtaacacatgtgtcacccaatcagtcgatttcagctt

SEQ ID NO: 131800 - DNA, 75 bp, Artificial Sequence
  Synthetic
gacgggctttaccggcgactttgattcagtgatcgactgtaacacatgtgtcacccaaccagtcgatttcagctt

SEQ ID NO: 131801 - DNA, 75 bp, Artificial Sequence
  Synthetic
gacgggctttaccggcgactttgattcagtgatcgactgtaacacatgtgtcacccaagcagtcgatttcagctt

SEQ ID NO: 131802 - DNA, 75 bp, Artificial Sequence
  Synthetic
gacgggctttaccggcgactttgattcagtgatcgactgtaacacatgtgtcacgcaaacagtcgatttcagctt

SEQ ID NO: 131803 - DNA, 75 bp, Artificial Sequence
  Synthetic
gacgggctttaccggcgactttgattcagtgatcgactgtaacacatgtgtcacgcaatcagtcgatttcagctt

SEQ ID NO: 131804 - DNA, 75 bp, Artificial Sequence
  Synthetic
gacgggctttaccggcgactttgattcagtgatcgactgtaacacatgtgtcacgcaaccagtcgatttcagctt

SEQ ID NO: 131805 - DNA, 75 bp, Artificial Sequence
  Synthetic
gacgggctttaccggcgactttgattcagtgatcgactgtaacacatgtgtcacgcaagcagtcgatttcagctt

SEQ ID NO: 131806 - DNA, 75 bp, Artificial Sequence
  Synthetic
gacgggctttaccggcgactttgactcagtgatcgactgtaacacatgtgtcacacaaacagtcgatttcagctt

SEQ ID NO: 131807 - DNA, 75 bp, Artificial Sequence
  Synthetic
gacgggctttaccggcgactttgactcagtgatcgactgtaacacatgtgtcacacaatcagtcgatttcagctt

SEQ ID NO: 131808 - DNA, 75 bp, Artificial Sequence
  Synthetic
gacgggctttaccggcgactttgactcagtgatcgactgtaacacatgtgtcacacaaccagtcgatttcagctt

SEQ ID NO: 131809 - DNA, 75 bp, Artificial Sequence
  Synthetic
gacgggctttaccggcgactttgactcagtgatcgactgtaacacatgtgtcacacaagcagtcgatttcagctt

SEQ ID NO: 131810 - DNA, 75 bp, Artificial Sequence
  Synthetic
gacgggctttaccggcgactttgactcagtgatcgactgtaacacatgtgtcactcaaacagtcgatttcagctt

SEQ ID NO: 131811 - DNA, 75 bp, Artificial Sequence
  Synthetic
gacgggctttaccggcgactttgactcagtgatcgactgtaacacatgtgtcactcaatcagtcgatttcagctt

SEQ ID NO: 131812 - DNA, 75 bp, Artificial Sequence
  Synthetic
gacgggctttaccggcgactttgactcagtgatcgactgtaacacatgtgtcactcaaccagtcgatttcagctt

SEQ ID NO: 131813 - DNA, 75 bp, Artificial Sequence
  Synthetic
gacgggctttaccggcgactttgactcagtgatcgactgtaacacatgtgtcactcaagcagtcgatttcagctt

SEQ ID NO: 131814 - DNA, 75 bp, Artificial Sequence
  Synthetic
gacgggctttaccggcgactttgactcagtgatcgactgtaacacatgtgtcacccaaacagtcgatttcagctt

SEQ ID NO: 131815 - DNA, 75 bp, Artificial Sequence
  Synthetic
gacgggctttaccggcgactttgactcagtgatcgactgtaacacatgtgtcacccaatcagtcgatttcagctt

SEQ ID NO: 131816 - DNA, 75 bp, Artificial Sequence
  Synthetic
gacgggctttaccggcgactttgactcagtgatcgactgtaacacatgtgtcacccaaccagtcgatttcagctt

SEQ ID NO: 131817 - DNA, 75 bp, Artificial Sequence
  Synthetic
gacgggctttaccggcgactttgactcagtgatcgactgtaacacatgtgtcacccaagcagtcgatttcagctt

SEQ ID NO: 131818 - DNA, 75 bp, Artificial Sequence
  Synthetic
gacgggctttaccggcgactttgactcagtgatcgactgtaacacatgtgtcacgcaaacagtcgatttcagctt

SEQ ID NO: 131819 - DNA, 75 bp, Artificial Sequence
  Synthetic
gacgggctttaccggcgactttgactcagtgatcgactgtaacacatgtgtcacgcaatcagtcgatttcagctt

SEQ ID NO: 131820 - DNA, 75 bp, Artificial Sequence
  Synthetic
gacgggctttaccggcgactttgactcagtgatcgactgtaacacatgtgtcacgcaaccagtcgatttcagctt

SEQ ID NO: 131821 - DNA, 75 bp, Artificial Sequence
  Synthetic
gacgggctttaccggcgactttgactcagtgatcgactgtaacacatgtgtcacgcaagcagtcgatttcagctt

SEQ ID NO: 131822 - DNA, 75 bp, Artificial Sequence
  Synthetic
gacgggctttaccggcgactttgagtcagtgatcgactgtaacacatgtgtcacacaaacagtcgatttcagctt

SEQ ID NO: 131823 - DNA, 75 bp, Artificial Sequence
  Synthetic
gacgggctttaccggcgactttgagtcagtgatcgactgtaacacatgtgtcacacaatcagtcgatttcagctt

SEQ ID NO: 131824 - DNA, 75 bp, Artificial Sequence
  Synthetic
gacgggctttaccggcgactttgagtcagtgatcgactgtaacacatgtgtcacacaaccagtcgatttcagctt

SEQ ID NO: 131825 - DNA, 75 bp, Artificial Sequence
  Synthetic
gacgggctttaccggcgactttgagtcagtgatcgactgtaacacatgtgtcacacaagcagtcgatttcagctt

SEQ ID NO: 131826 - DNA, 75 bp, Artificial Sequence
  Synthetic
gacgggctttaccggcgactttgagtcagtgatcgactgtaacacatgtgtcactcaaacagtcgatttcagctt

SEQ ID NO: 131827 - DNA, 75 bp, Artificial Sequence
  Synthetic
gacgggctttaccggcgactttgagtcagtgatcgactgtaacacatgtgtcactcaatcagtcgatttcagctt

SEQ ID NO: 131828 - DNA, 75 bp, Artificial Sequence
  Synthetic
gacgggctttaccggcgactttgagtcagtgatcgactgtaacacatgtgtcactcaaccagtcgatttcagctt

SEQ ID NO: 131829 - DNA, 75 bp, Artificial Sequence
  Synthetic
gacgggctttaccggcgactttgagtcagtgatcgactgtaacacatgtgtcactcaagcagtcgatttcagctt

SEQ ID NO: 131830 - DNA, 75 bp, Artificial Sequence
  Synthetic
gacgggctttaccggcgactttgagtcagtgatcgactgtaacacatgtgtcacccaaacagtcgatttcagctt

SEQ ID NO: 131831 - DNA, 75 bp, Artificial Sequence
  Synthetic
gacgggctttaccggcgactttgagtcagtgatcgactgtaacacatgtgtcacccaatcagtcgatttcagctt

SEQ ID NO: 131832 - DNA, 75 bp, Artificial Sequence
  Synthetic
gacgggctttaccggcgactttgagtcagtgatcgactgtaacacatgtgtcacccaaccagtcgatttcagctt

SEQ ID NO: 131833 - DNA, 75 bp, Artificial Sequence
  Synthetic
gacgggctttaccggcgactttgagtcagtgatcgactgtaacacatgtgtcacccaagcagtcgatttcagctt

SEQ ID NO: 131834 - DNA, 75 bp, Artificial Sequence
  Synthetic
gacgggctttaccggcgactttgagtcagtgatcgactgtaacacatgtgtcacgcaaacagtcgatttcagctt

SEQ ID NO: 131835 - DNA, 75 bp, Artificial Sequence
  Synthetic
gacgggctttaccggcgactttgagtcagtgatcgactgtaacacatgtgtcacgcaatcagtcgatttcagctt

SEQ ID NO: 131836 - DNA, 75 bp, Artificial Sequence
  Synthetic
gacgggctttaccggcgactttgagtcagtgatcgactgtaacacatgtgtcacgcaaccagtcgatttcagctt

SEQ ID NO: 131837 - DNA, 75 bp, Artificial Sequence
  Synthetic
gacgggctttaccggcgactttgagtcagtgatcgactgtaacacatgtgtcacgcaagcagtcgatttcagctt

SEQ ID NO: 131838 - DNA, 75 bp, Artificial Sequence
  Synthetic
ccacccactgtcctaggctgtgccctcccccccacacctcaagcgccggtgcccccacctcggaggcgccgcgcc

SEQ ID NO: 131839 - DNA, 75 bp, Artificial Sequence
  Synthetic
ttgatctaccccagatcattcaacgccttcatggcatggctgccttttcactccatggttactctccaggtgagc

SEQ ID NO: 131840 - DNA, 75 bp, Artificial Sequence
  Synthetic
ccagcagccctctgacgagactgccgcttcagaaacgggatcactgtcctccatgcctccccttgagggagagcc

SEQ ID NO: 131841 - DNA, 75 bp, Artificial Sequence
  Synthetic
ctgtgcctactcctactcacagtaggggtaggcatctttttgctccccgcccgataaacgggcggccttaagcaa

SEQ ID NO: 131842 - DNA, 75 bp, Artificial Sequence
  Synthetic
gaggaggtggccctgtccaacattggagaggtccccttctatggcaaagccatcccccttgagactatcaagggg

SEQ ID NO: 131843 - DNA, 75 bp, Artificial Sequence
  Synthetic
gttaaccacatccggtccgtgtgggaggacctcctggaagaccaacatactccaattgacacaaccatcatggcc

SEQ ID NO: 131844 - DNA, 75 bp, Artificial Sequence
  Synthetic
gtcctctaccgggagttcgatgagatggaagagtgcgcatcacacctcccttacatcgaacagggaatgcagctc

SEQ ID NO: 131845 - DNA, 75 bp, Artificial Sequence
  Synthetic
gtcctctaccgggagttcgatgagatggaagagtgcgcatcacacctcccttacatcgatcagggaatgcagctc

SEQ ID NO: 131846 - DNA, 75 bp, Artificial Sequence
  Synthetic
gtcctctaccgggagttcgatgagatggaagagtgcgcatcacacctcccttacatcgaccagggaatgcagctc

SEQ ID NO: 131847 - DNA, 75 bp, Artificial Sequence
  Synthetic
gtcctctaccgggagttcgatgagatggaagagtgcgcatcacacctcccttacatcgagcagggaatgcagctc

SEQ ID NO: 131848 - DNA, 75 bp, Artificial Sequence
  Synthetic
gtcctctaccgggagttcgatgagatggaagagtgcgcttcacacctcccttacatcgaacagggaatgcagctc

SEQ ID NO: 131849 - DNA, 75 bp, Artificial Sequence
  Synthetic
gtcctctaccgggagttcgatgagatggaagagtgcgcttcacacctcccttacatcgatcagggaatgcagctc

SEQ ID NO: 131850 - DNA, 75 bp, Artificial Sequence
  Synthetic
gtcctctaccgggagttcgatgagatggaagagtgcgcttcacacctcccttacatcgaccagggaatgcagctc

SEQ ID NO: 131851 - DNA, 75 bp, Artificial Sequence
  Synthetic
gtcctctaccgggagttcgatgagatggaagagtgcgcttcacacctcccttacatcgagcagggaatgcagctc

SEQ ID NO: 131852 - DNA, 75 bp, Artificial Sequence
  Synthetic
gtcctctaccgggagttcgatgagatggaagagtgcgcctcacacctcccttacatcgaacagggaatgcagctc

SEQ ID NO: 131853 - DNA, 75 bp, Artificial Sequence
  Synthetic
gtcctctaccgggagttcgatgagatggaagagtgcgcctcacacctcccttacatcgatcagggaatgcagctc

SEQ ID NO: 131854 - DNA, 75 bp, Artificial Sequence
  Synthetic
gtcctctaccgggagttcgatgagatggaagagtgcgcctcacacctcccttacatcgaccagggaatgcagctc

SEQ ID NO: 131855 - DNA, 75 bp, Artificial Sequence
  Synthetic
gtcctctaccgggagttcgatgagatggaagagtgcgcctcacacctcccttacatcgagcagggaatgcagctc

SEQ ID NO: 131856 - DNA, 75 bp, Artificial Sequence
  Synthetic
gtcctctaccgggagttcgatgagatggaagagtgcgcgtcacacctcccttacatcgaacagggaatgcagctc

SEQ ID NO: 131857 - DNA, 75 bp, Artificial Sequence
  Synthetic
gtcctctaccgggagttcgatgagatggaagagtgcgcgtcacacctcccttacatcgatcagggaatgcagctc

SEQ ID NO: 131858 - DNA, 75 bp, Artificial Sequence
  Synthetic
gtcctctaccgggagttcgatgagatggaagagtgcgcgtcacacctcccttacatcgaccagggaatgcagctc

SEQ ID NO: 131859 - DNA, 75 bp, Artificial Sequence
  Synthetic
gtcctctaccgggagttcgatgagatggaagagtgcgcgtcacacctcccttacatcgagcagggaatgcagctc

SEQ ID NO: 131860 - DNA, 75 bp, Artificial Sequence
  Synthetic
agagcttttgggcgaagcacatgtggaacttcatcagcgggatacaatacttagcgggcttgtccactctgcccg

SEQ ID NO: 131861 - DNA, 75 bp, Artificial Sequence
  Synthetic
ttagcgggcttgtccactctgcccgggaaccccgcaatagcatccctaatgtcattaacagcctccatcacaagc

SEQ ID NO: 131862 - DNA, 75 bp, Artificial Sequence
  Synthetic
ttagcgggcttgtccactctgcccgggaaccccgcaatagcatccctaatgtcattaacagcctccatcactagc

SEQ ID NO: 131863 - DNA, 75 bp, Artificial Sequence
  Synthetic
ttagcgggcttgtccactctgcccgggaaccccgcaatagcatccctaatgtcattaacagcctccatcaccagc

SEQ ID NO: 131864 - DNA, 75 bp, Artificial Sequence
  Synthetic
ttagcgggcttgtccactctgcccgggaaccccgcaatagcatccctaatgtcattaacagcctccatcacgagc

SEQ ID NO: 131865 - DNA, 75 bp, Artificial Sequence
  Synthetic
ttagcgggcttgtccactctgcccgggaaccccgcaatagcatccctaatgtcatttacagcctccatcacaagc

SEQ ID NO: 131866 - DNA, 75 bp, Artificial Sequence
  Synthetic
ttagcgggcttgtccactctgcccgggaaccccgcaatagcatccctaatgtcatttacagcctccatcactagc

SEQ ID NO: 131867 - DNA, 75 bp, Artificial Sequence
  Synthetic
ttagcgggcttgtccactctgcccgggaaccccgcaatagcatccctaatgtcatttacagcctccatcaccagc

SEQ ID NO: 131868 - DNA, 75 bp, Artificial Sequence
  Synthetic
ttagcgggcttgtccactctgcccgggaaccccgcaatagcatccctaatgtcatttacagcctccatcacgagc

SEQ ID NO: 131869 - DNA, 75 bp, Artificial Sequence
  Synthetic
ttagcgggcttgtccactctgcccgggaaccccgcaatagcatccctaatgtcattcacagcctccatcacaagc

SEQ ID NO: 131870 - DNA, 75 bp, Artificial Sequence
  Synthetic
ttagcgggcttgtccactctgcccgggaaccccgcaatagcatccctaatgtcattcacagcctccatcactagc

SEQ ID NO: 131871 - DNA, 75 bp, Artificial Sequence
  Synthetic
ttagcgggcttgtccactctgcccgggaaccccgcaatagcatccctaatgtcattcacagcctccatcaccagc

SEQ ID NO: 131872 - DNA, 75 bp, Artificial Sequence
  Synthetic
ttagcgggcttgtccactctgcccgggaaccccgcaatagcatccctaatgtcattcacagcctccatcacgagc

SEQ ID NO: 131873 - DNA, 75 bp, Artificial Sequence
  Synthetic
ttagcgggcttgtccactctgcccgggaaccccgcaatagcatccctaatgtcattgacagcctccatcacaagc

SEQ ID NO: 131874 - DNA, 75 bp, Artificial Sequence
  Synthetic
ttagcgggcttgtccactctgcccgggaaccccgcaatagcatccctaatgtcattgacagcctccatcactagc

SEQ ID NO: 131875 - DNA, 75 bp, Artificial Sequence
  Synthetic
ttagcgggcttgtccactctgcccgggaaccccgcaatagcatccctaatgtcattgacagcctccatcaccagc

SEQ ID NO: 131876 - DNA, 75 bp, Artificial Sequence
  Synthetic
ttagcgggcttgtccactctgcccgggaaccccgcaatagcatccctaatgtcattgacagcctccatcacgagc

SEQ ID NO: 131877 - DNA, 75 bp, Artificial Sequence
  Synthetic
ggtctacttgctccgaggaggacgactccgtcgtgtgctgctccatgtcatactcctggaccggggctctaataa

SEQ ID NO: 131878 - DNA, 75 bp, Artificial Sequence
  Synthetic
tgagagactttacgtaggagggcccatgataaacagcaaagggcaatcctgcggttacaggcgttgccgcgcaag

SEQ ID NO: 131879 - DNA, 75 bp, Artificial Sequence
  Synthetic
accaaggtcatatcaccggccaccgtatggcatgggacatgatgctaaactggtcaccaactctcaccatgatcc

SEQ ID NO: 131880 - DNA, 75 bp, Artificial Sequence
  Synthetic
tatggcatgggacatgatgctaaactggtcaccaactctcaccatgatcctcgcctacgctgctcgtgttcctga

SEQ ID NO: 131881 - DNA, 75 bp, Artificial Sequence
  Synthetic
caacaggactgccctgaactgcaatgactccctcaacactgggtttcttgccgcgctgttctacacacacaggtt

SEQ ID NO: 131882 - DNA, 75 bp, Artificial Sequence
  Synthetic
tggcctatttctccatgcagggagcgtgggccaaagtcattgccatcctccttcttgtcgcaggagtggatgcac

SEQ ID NO: 131883 - DNA, 75 bp, Artificial Sequence
  Synthetic
agggctccagattatgaaccaccacaggtccatggatgtgcccttcccccccccgggaacactcctgttccacca

SEQ ID NO: 131884 - DNA, 75 bp, Artificial Sequence
  Synthetic
tcgacgcggggacttacattaccgggggaactgccggccactccgtgtctggacttgctagcctcttcgtacaag

SEQ ID NO: 131885 - DNA, 75 bp, Artificial Sequence
  Synthetic
atgagggctgcggctgggcagggtggctcctgtccccccgcggctctcgccctaattggggccccaatgaccccc

SEQ ID NO: 131886 - DNA, 75 bp, Artificial Sequence
  Synthetic
gctcctgtccccccgcggctctcgccctaattggggccccaatgacccccggcgaaggtcccgcaacttgggtaa

SEQ ID NO: 131887 - DNA, 75 bp, Artificial Sequence
  Synthetic
ttgctccttttctatcttccttctggcactgctctcgtgcctcaccacacccgcttcggccctgcattatgccaa

SEQ ID NO: 131888 - DNA, 75 bp, Artificial Sequence
  Synthetic
gcagctggcacatcaacaggactgccctgaactgcaatgactccctccacactgggtttcttgctggtgttttct

SEQ ID NO: 131889 - DNA, 75 bp, Artificial Sequence
  Synthetic
gtcaaggttggcaatcagtccacatgctggttgcaggcctcgcccacgatagctgtcccgaatgcgtcaacgcct

SEQ ID NO: 131890 - DNA, 75 bp, Artificial Sequence
  Synthetic
gcccgttgtcttctctgacatggagaccaagatcatcacctggggggcagacaccgcagcgtgtggggacatcat

SEQ ID NO: 131891 - DNA, 75 bp, Artificial Sequence
  Synthetic
gcatgggcaataccatcacatgttacttgaaagcgcaggcagcctgccgtgcagcaggcctcaccaattctgaca

SEQ ID NO: 131892 - DNA, 75 bp, Artificial Sequence
  Synthetic
tagtggcaactcggaccagaagccttattgctggcactacgcgcctcgacagtgcggtatcgtacccgcgtcgga

SEQ ID NO: 131893 - DNA, 75 bp, Artificial Sequence
  Synthetic
gacaagtcgtcatgatcaggccccgtatacatcagaccgtccaggaatgcaactgttccatctacacgggccgta

SEQ ID NO: 131894 - DNA, 75 bp, Artificial Sequence
  Synthetic
ggtcatcactgagagtgctggagtccccgaggatgcggctaagctgcgagctttcacggaagctatgaccagata

SEQ ID NO: 131895 - DNA, 75 bp, Artificial Sequence
  Synthetic
tatacatcagaccgtccaggaatgcaactgttccatctacacgggccgtattactggtcaccgcatggcgtggga

SEQ ID NO: 131896 - DNA, 75 bp, Artificial Sequence
  Synthetic
gtacacctggggtgagaatgagacggacgtgctgctcctcaacaataccaggccgccgcatggtaattggtttgg

SEQ ID NO: 131897 - DNA, 75 bp, Artificial Sequence
  Synthetic
taacatcttgctcctccaatgtctccgtagcccacgatgggactggacagagatattactacctcacacgtgacc

SEQ ID NO: 131898 - DNA, 75 bp, Artificial Sequence
  Synthetic
cgagaatgtcaaggccaagatccaagacaaggaaggcatcccacctgaccagcagaggctgatattcgcgggcaa

SEQ ID NO: 131899 - DNA, 75 bp, Artificial Sequence
  Synthetic
ttgtgaacagcaacgggagttggcatatcaataggactgccttaaactgtaatgacagcttacagacgggcttca

SEQ ID NO: 131900 - DNA, 75 bp, Artificial Sequence
  Synthetic
tatcaataggactgccttaaactgtaatgacagcttacagacgggcttcatagcttccctgttctacacctacaa

SEQ ID NO: 131901 - DNA, 75 bp, Artificial Sequence
  Synthetic
tatcaataggactgccttaaactgtaatgacagcttacagacgggcttcatagcttccctgttctacacctacat

SEQ ID NO: 131902 - DNA, 75 bp, Artificial Sequence
  Synthetic
tatcaataggactgccttaaactgtaatgacagcttacagacgggcttcatagcttccctgttctacacctacac

SEQ ID NO: 131903 - DNA, 75 bp, Artificial Sequence
  Synthetic
tatcaataggactgccttaaactgtaatgacagcttacagacgggcttcatagcttccctgttctacacctacag

SEQ ID NO: 131904 - DNA, 75 bp, Artificial Sequence
  Synthetic
ccagctcgccttatcgtgttcccagacttgggggtccgtgtgtgcgagaaaatggccctttacgacgtggtctcc

SEQ ID NO: 131905 - DNA, 75 bp, Artificial Sequence
  Synthetic
tctttcttgtcggtcagctgtttaccttctctcccaggcgccactggacgacgcaagactgcaattgttctatgt

SEQ ID NO: 131906 - DNA, 75 bp, Artificial Sequence
  Synthetic
agctcggaagataagccctattgctggcactacccgccaagaccctgcggggtggtgccggcctcacaggtgtgc

SEQ ID NO: 131907 - DNA, 75 bp, Artificial Sequence
  Synthetic
gaggatgagagggaagtatccgttccggcggagatcctgcggaaatccaggaagttccccccggcgatgcccata

SEQ ID NO: 131908 - DNA, 75 bp, Artificial Sequence
  Synthetic
gccctgtggttgtggggactacagacaagaagggactgccaacttatacctggggtgagaatgagtctgacgtgt

SEQ ID NO: 131909 - DNA, 75 bp, Artificial Sequence
  Synthetic
cataagccctgacaacaataaaacggacaccaccttgacttgtcctaccgattgctttcggaaacatcctgaggc

SEQ ID NO: 131910 - DNA, 75 bp, Artificial Sequence
  Synthetic
ccttggctaactccacggtgcctagttgactatccttataggctgtggcactatccttgcactcagaactacact

SEQ ID NO: 131911 - DNA, 75 bp, Artificial Sequence
  Synthetic
cccctcgaggtcatcaaggggggaaggcatctcattttctgccattccaagaagaagtgtgacgagctcgccgca

SEQ ID NO: 131912 - DNA, 75 bp, Artificial Sequence
  Synthetic
ttccacaactgagctagcgattctcccctgttcattcacgacgatgccagcgctttctacggggctaatacactt

SEQ ID NO: 131913 - DNA, 75 bp, Artificial Sequence
  Synthetic
gagtggctaaggcggtggactttatccccgtagagagcctagagacaaccatgaggtccccggtgttcacagaca

SEQ ID NO: 131914 - DNA, 75 bp, Artificial Sequence
  Synthetic
gtacgtagtgctcgccttcttattgctggctgatgcgcgcatttgcgcgtgtctttggcttatgttactcattgg

SEQ ID NO: 131915 - DNA, 75 bp, Artificial Sequence
  Synthetic
gtacgtagtgctcgccttcttattgctggctgatgcgcgcttttgcgcgtgtctttggcttatgttactcattgg

SEQ ID NO: 131916 - DNA, 75 bp, Artificial Sequence
  Synthetic
gtacgtagtgctcgccttcttattgctggctgatgcgcgcctttgcgcgtgtctttggcttatgttactcattgg

SEQ ID NO: 131917 - DNA, 75 bp, Artificial Sequence
  Synthetic
gtacgtagtgctcgccttcttattgctggctgatgcgcgcgtttgcgcgtgtctttggcttatgttactcattgg

SEQ ID NO: 131918 - DNA, 75 bp, Artificial Sequence
  Synthetic
tcttcagcccgggccccaagcaaaacctccggctggtcaactccaacggcagttggcacatcaatagcacggcct

SEQ ID NO: 131919 - DNA, 75 bp, Artificial Sequence
  Synthetic
gtctttggcttatgttactcattggccaagccgaggccgcattggagaacttgatcgtcctcaatgccgcctcgg

SEQ ID NO: 131920 - DNA, 75 bp, Artificial Sequence
  Synthetic
ggaggtggcccttggtcatgagggcgagatccctttttatggcaaggctatccctctagctttcatcaagggggg

SEQ ID NO: 131921 - DNA, 75 bp, Artificial Sequence
  Synthetic
ccgctactacctatgggctcctggggctatggccactcctgctgctcctattggcgttgccccaacgggcgttcg

SEQ ID NO: 131922 - DNA, 75 bp, Artificial Sequence
  Synthetic
gctatggccactcctgctgctcctattggcgttgccccaacgggcgttcgcatacgatcaagagcaagcagcctc

SEQ ID NO: 131923 - DNA, 75 bp, Artificial Sequence
  Synthetic
tgtgtggcccggtatattgcttcactcctagccccgtggtggtgggaacgaccgacgagcggggcgcgcctacct

SEQ ID NO: 131924 - DNA, 75 bp, Artificial Sequence
  Synthetic
attactgtcttcacacttacaccgcactacaaaaggatgcttgttcatttgttgtggtggtgccagtatttcata

SEQ ID NO: 131925 - DNA, 75 bp, Artificial Sequence
  Synthetic
gactttgattctgtcatcgactgcaacgttgcagtcactcaaattgttgatttcagcctagacccaacctttacc

SEQ ID NO: 131926 - DNA, 75 bp, Artificial Sequence
  Synthetic
atcaccactcaaaccgtccctcaagacgctgtctcccgtagtcaacgtagagggagaactgggagggggcgactg

SEQ ID NO: 131927 - DNA, 75 bp, Artificial Sequence
  Synthetic
ttggatttgacatcaccaaggtgctcttggcaatcattggccccctataccttctgcaggccagccttttacatg

SEQ ID NO: 131928 - DNA, 75 bp, Artificial Sequence
  Synthetic
ttggatttgacatcaccaaggtgctcttggcaatcattggccccctttaccttctgcaggccagccttttacatg

SEQ ID NO: 131929 - DNA, 75 bp, Artificial Sequence
  Synthetic
ttggatttgacatcaccaaggtgctcttggcaatcattggccccctctaccttctgcaggccagccttttacatg

SEQ ID NO: 131930 - DNA, 75 bp, Artificial Sequence
  Synthetic
ttggatttgacatcaccaaggtgctcttggcaatcattggccccctgtaccttctgcaggccagccttttacatg

SEQ ID NO: 131931 - DNA, 75 bp, Artificial Sequence
  Synthetic
cactagtgtggaccaggacctcgtcggctggtgggagcgccccggtgcgcgttccctgacaccaggcacctgtgg

SEQ ID NO: 131932 - DNA, 75 bp, Artificial Sequence
  Synthetic
atgccccccctagagggggagccgggggaccccgatctcagcgacgggtcatggtctaccgtgggcgaggagacc

SEQ ID NO: 131933 - DNA, 75 bp, Artificial Sequence
  Synthetic
atgccccccctagagggggagccgggggaccccgatctcagcgacgggtcttggtctaccgtgggcgaggagacc

SEQ ID NO: 131934 - DNA, 75 bp, Artificial Sequence
  Synthetic
atgccccccctagagggggagccgggggaccccgatctcagcgacgggtcctggtctaccgtgggcgaggagacc

SEQ ID NO: 131935 - DNA, 75 bp, Artificial Sequence
  Synthetic
atgccccccctagagggggagccgggggaccccgatctcagcgacgggtcgtggtctaccgtgggcgaggagacc

SEQ ID NO: 131936 - DNA, 75 bp, Artificial Sequence
  Synthetic
atgcccccccttgagggggagccgggggaccccgatctcagcgacgggtcatggtctaccgtgggcgaggagacc

SEQ ID NO: 131937 - DNA, 75 bp, Artificial Sequence
  Synthetic
atgcccccccttgagggggagccgggggaccccgatctcagcgacgggtcttggtctaccgtgggcgaggagacc

SEQ ID NO: 131938 - DNA, 75 bp, Artificial Sequence
  Synthetic
atgcccccccttgagggggagccgggggaccccgatctcagcgacgggtcctggtctaccgtgggcgaggagacc

SEQ ID NO: 131939 - DNA, 75 bp, Artificial Sequence
  Synthetic
atgcccccccttgagggggagccgggggaccccgatctcagcgacgggtcgtggtctaccgtgggcgaggagacc

SEQ ID NO: 131940 - DNA, 75 bp, Artificial Sequence
  Synthetic
atgccccccctcgagggggagccgggggaccccgatctcagcgacgggtcatggtctaccgtgggcgaggagacc

SEQ ID NO: 131941 - DNA, 75 bp, Artificial Sequence
  Synthetic
atgccccccctcgagggggagccgggggaccccgatctcagcgacgggtcttggtctaccgtgggcgaggagacc

SEQ ID NO: 131942 - DNA, 75 bp, Artificial Sequence
  Synthetic
atgccccccctcgagggggagccgggggaccccgatctcagcgacgggtcctggtctaccgtgggcgaggagacc

SEQ ID NO: 131943 - DNA, 75 bp, Artificial Sequence
  Synthetic
atgccccccctcgagggggagccgggggaccccgatctcagcgacgggtcgtggtctaccgtgggcgaggagacc

SEQ ID NO: 131944 - DNA, 75 bp, Artificial Sequence
  Synthetic
atgccccccctggagggggagccgggggaccccgatctcagcgacgggtcatggtctaccgtgggcgaggagacc

SEQ ID NO: 131945 - DNA, 75 bp, Artificial Sequence
  Synthetic
atgccccccctggagggggagccgggggaccccgatctcagcgacgggtcttggtctaccgtgggcgaggagacc

SEQ ID NO: 131946 - DNA, 75 bp, Artificial Sequence
  Synthetic
atgccccccctggagggggagccgggggaccccgatctcagcgacgggtcctggtctaccgtgggcgaggagacc

SEQ ID NO: 131947 - DNA, 75 bp, Artificial Sequence
  Synthetic
atgccccccctggagggggagccgggggaccccgatctcagcgacgggtcgtggtctaccgtgggcgaggagacc

SEQ ID NO: 131948 - DNA, 75 bp, Artificial Sequence
  Synthetic
tatgcaagatcagggctggaggctactcgcccctatcactgcataccatcagcaaacccgtggcctgctggggac

SEQ ID NO: 131949 - DNA, 75 bp, Artificial Sequence
  Synthetic
acgtgcatgcaagctgacctcgagatcatgacaagcacatgggtcttggcagggggggtgctagccgccgtggca

SEQ ID NO: 131950 - DNA, 75 bp, Artificial Sequence
  Synthetic
tccaggtggtctctacagccacacaaacattcctggctaccaccatcaatggagtgctatggactgtttatcacg

SEQ ID NO: 131951 - DNA, 75 bp, Artificial Sequence
  Synthetic
ggcgccggcatcgccggcgcggctgttggcagcataggccttgggaaggtgctcgtggacatcctggcgggctat

SEQ ID NO: 131952 - DNA, 75 bp, Artificial Sequence
  Synthetic
aacattcctggctaccaccatcaatggagtgctatggactgtttatcacggtgctggctccaagaccttagccgg

SEQ ID NO: 131953 - DNA, 75 bp, Artificial Sequence
  Synthetic
ggtgctagtgatctctacttggtaacccggaatgccgatgtcatccccgctagacgcaggggagacactcgagca

SEQ ID NO: 131954 - DNA, 75 bp, Artificial Sequence
  Synthetic
agtggatgaaccggctgatagcgttcgcttcgcgaggcaaccacgtctcccccacgcactatgtgcctgagagcg

SEQ ID NO: 131955 - DNA, 75 bp, Artificial Sequence
  Synthetic
ccaccatcctcttgaacatcatggggggatggttggcctcccagattgccccccctgccggagccactggcttcg

SEQ ID NO: 131956 - DNA, 75 bp, Artificial Sequence
  Synthetic
tttgtaccaggggagtcgccaaggcaatagactttgtgccagtagagaacatggaaaccacgatgcggtccccat

SEQ ID NO: 131957 - DNA, 75 bp, Artificial Sequence
  Synthetic
tttgtaccaggggagtcgccaaggcaatagactttgtgcctgtagagaacatggaaaccacgatgcggtccccat

SEQ ID NO: 131958 - DNA, 75 bp, Artificial Sequence
  Synthetic
tttgtaccaggggagtcgccaaggcaatagactttgtgcccgtagagaacatggaaaccacgatgcggtccccat

SEQ ID NO: 131959 - DNA, 75 bp, Artificial Sequence
  Synthetic
tttgtaccaggggagtcgccaaggcaatagactttgtgccggtagagaacatggaaaccacgatgcggtccccat

SEQ ID NO: 131960 - DNA, 75 bp, Artificial Sequence
  Synthetic
ggcgtacgcctctcagggctacaaagtgcttgtgctcaatccatctgtggctgctacccttgggttcggcagcta

SEQ ID NO: 131961 - DNA, 75 bp, Artificial Sequence
  Synthetic
ggcgtacgcctctcagggctacaatgtgcttgtgctcaatccatctgtggctgctacccttgggttcggcagcta

SEQ ID NO: 131962 - DNA, 75 bp, Artificial Sequence
  Synthetic
ggcgtacgcctctcagggctacaacgtgcttgtgctcaatccatctgtggctgctacccttgggttcggcagcta

SEQ ID NO: 131963 - DNA, 75 bp, Artificial Sequence
  Synthetic
ggcgtacgcctctcagggctacaaggtgcttgtgctcaatccatctgtggctgctacccttgggttcggcagcta

SEQ ID NO: 131964 - DNA, 75 bp, Artificial Sequence
  Synthetic
gatggagaccaagctcatcacgtggggggcagacaccgccgcgtgcggtgacatcatcaacggcttgcccgtctc

SEQ ID NO: 131965 - DNA, 75 bp, Artificial Sequence
  Synthetic
cctggaggtcgtcacgagcacctgggtgctcgttggcggcgtcctggctgctttggctgcgtattgcctgtccac

SEQ ID NO: 131966 - DNA, 75 bp, Artificial Sequence
  Synthetic
catgagcaaggcatatggggtagaccctaacatcaggactggcgtcaggactataacaacaggaggtcctatcac

SEQ ID NO: 131967 - DNA, 75 bp, Artificial Sequence
  Synthetic
catgagcaaggcatatggggtagaccctaacatcaggactggcgtcaggactataacaacaggtggtcctatcac

SEQ ID NO: 131968 - DNA, 75 bp, Artificial Sequence
  Synthetic
catgagcaaggcatatggggtagaccctaacatcaggactggcgtcaggactataacaacaggcggtcctatcac

SEQ ID NO: 131969 - DNA, 75 bp, Artificial Sequence
  Synthetic
catgagcaaggcatatggggtagaccctaacatcaggactggcgtcaggactataacaacagggggtcctatcac

SEQ ID NO: 131970 - DNA, 75 bp, Artificial Sequence
  Synthetic
ggcatgttcgactcctcggtcctgtgtgagtgctatgacgcgggttgtgcttggtatgagctcacacccgctgag

SEQ ID NO: 131971 - DNA, 75 bp, Artificial Sequence
  Synthetic
gttttgggaataggcaccgttctggaccaggctgagacggctggcgtacgcctcactgtcttagccacggccaca

SEQ ID NO: 131972 - DNA, 75 bp, Artificial Sequence
  Synthetic
tggcctatttctccttgcagggggcatgggccaaagtcgtcgctatcctccttcttgtcgcaggagtggacgcaa

SEQ ID NO: 131973 - DNA, 75 bp, Artificial Sequence
  Synthetic
tacgggaaaggtattccccttgaatacatcaagggtggtaggcacctgatcttctgtcactcgaagaagaagtgc

SEQ ID NO: 131974 - DNA, 75 bp, Artificial Sequence
  Synthetic
cgctcggcctcaacgccgttgcgttctatagaggcatcgatgtggcagtaatccccacccaaggggatgtggtca

SEQ ID NO: 131975 - DNA, 75 bp, Artificial Sequence
  Synthetic
cgctcggcctcaacgccgttgcgttctatagaggcttcgatgtggcagtaatccccacccaaggggatgtggtca

SEQ ID NO: 131976 - DNA, 75 bp, Artificial Sequence
  Synthetic
cgctcggcctcaacgccgttgcgttctatagaggcctcgatgtggcagtaatccccacccaaggggatgtggtca

SEQ ID NO: 131977 - DNA, 75 bp, Artificial Sequence
  Synthetic
cgctcggcctcaacgccgttgcgttctatagaggcgtcgatgtggcagtaatccccacccaaggggatgtggtca

SEQ ID NO: 131978 - DNA, 75 bp, Artificial Sequence
  Synthetic
atccccacccaaggggatgtggtcatctgcgccactgatgcccttatgactggttacacaggcgacttcgactct

SEQ ID NO: 131979 - DNA, 75 bp, Artificial Sequence
  Synthetic
gctgcgtgggagacagcaagacacactccagtcaactcctggctaggcaacataatcatgtttgcccccacattg

SEQ ID NO: 131980 - DNA, 75 bp, Artificial Sequence
  Synthetic
gtcatagactgcaatgtggctgtgacgcaagtagttgatttcagcctggatcccacctttacaattgagaccact

SEQ ID NO: 131981 - DNA, 75 bp, Artificial Sequence
  Synthetic
gtcatagactgcaatgtggctgtgacgcaagtagttgatttcagcctggatcccacctttactattgagaccact

SEQ ID NO: 131982 - DNA, 75 bp, Artificial Sequence
  Synthetic
gtcatagactgcaatgtggctgtgacgcaagtagttgatttcagcctggatcccacctttaccattgagaccact

SEQ ID NO: 131983 - DNA, 75 bp, Artificial Sequence
  Synthetic
gtcatagactgcaatgtggctgtgacgcaagtagttgatttcagcctggatcccacctttacgattgagaccact

SEQ ID NO: 131984 - DNA, 75 bp, Artificial Sequence
  Synthetic
tcccacctttacaattgagaccactactgtcccacaagacgctgtggctagaagccagcggcgtgggcgtacggg

SEQ ID NO: 131985 - DNA, 75 bp, Artificial Sequence
  Synthetic
tcccacctttactattgagaccactactgtcccacaagacgctgtggctagaagccagcggcgtgggcgtacggg

SEQ ID NO: 131986 - DNA, 75 bp, Artificial Sequence
  Synthetic
tcccacctttaccattgagaccactactgtcccacaagacgctgtggctagaagccagcggcgtgggcgtacggg

SEQ ID NO: 131987 - DNA, 75 bp, Artificial Sequence
  Synthetic
tcccacctttacgattgagaccactactgtcccacaagacgctgtggctagaagccagcggcgtgggcgtacggg

SEQ ID NO: 131988 - DNA, 75 bp, Artificial Sequence
  Synthetic
gaagccagcggcgtgggcgtacgggtagagggaaaccagggatatacagatatgtctcgcaaggagaacgaccat

SEQ ID NO: 131989 - DNA, 75 bp, Artificial Sequence
  Synthetic
cctgaatacccctgggctacctgtatgccaagaccaccttgagttctgggagggggtgtttactgggctcaccca

SEQ ID NO: 131990 - DNA, 75 bp, Artificial Sequence
  Synthetic
catgccaggtcccatcgcccgaatttttcacagaactagacggggtgcgcctgcataggtttgcgcccccttgca

SEQ ID NO: 131991 - DNA, 75 bp, Artificial Sequence
  Synthetic
cttatctagtggcctaccaagctacggtgtgtgcccgagctaaagccccccctccatcatgggacaatatgtgga

SEQ ID NO: 131992 - DNA, 75 bp, Artificial Sequence
  Synthetic
aggtcactaccacacacccaattacaaagtacatcatgacctgtatgtcagctgacctagaggtaatcactagca

SEQ ID NO: 131993 - DNA, 75 bp, Artificial Sequence
  Synthetic
cgcagtgatgcccgacagagaagtgctctaccaacaattcgacgagatggaggaatgctcacaccacatccccta

SEQ ID NO: 131994 - DNA, 75 bp, Artificial Sequence
  Synthetic
gactattgcagacaaccgcaaagcaggctgaggacctgaaaccagctgttcaatcggcatggccaaagctcgagg

SEQ ID NO: 131995 - DNA, 75 bp, Artificial Sequence
  Synthetic
gtctattgcagacaaccgcaaagcaggctgaggacctgaaaccagctgttcaatcggcatggccaaagctcgagg

SEQ ID NO: 131996 - DNA, 75 bp, Artificial Sequence
  Synthetic
gcctattgcagacaaccgcaaagcaggctgaggacctgaaaccagctgttcaatcggcatggccaaagctcgagg

SEQ ID NO: 131997 - DNA, 75 bp, Artificial Sequence
  Synthetic
ggctattgcagacaaccgcaaagcaggctgaggacctgaaaccagctgttcaatcggcatggccaaagctcgagg

SEQ ID NO: 131998 - DNA, 75 bp, Artificial Sequence
  Synthetic
gctaagggatgtttgggactggatatgcacggtgttgactgacttcaagacctggctccagtccaagctcctgcc

SEQ ID NO: 131999 - DNA, 75 bp, Artificial Sequence
  Synthetic
gtctcggagattcaccccggccctgcccatttgggcgcggccggactacaaccccccgctagtggagacgtggaa

SEQ ID NO: 132000 - DNA, 75 bp, Artificial Sequence
  Synthetic
ctttcaacttccaccactcttctccttaacatactaggagggtgggtggcctcccaagtagcgccgccaacagcg

SEQ ID NO: 132001 - DNA, 75 bp, Artificial Sequence
  Synthetic
tcaacagcgtttgttgtgagcggtattgccggagctgccgtgggcagcatcggtttgggcagggtcattgttgac

SEQ ID NO: 132002 - DNA, 75 bp, Artificial Sequence
  Synthetic
gctgctggatacaagtaacacctaatgtggctgtgaaataccgcggcgcactcactcacaacctgcggacacatg

SEQ ID NO: 132003 - DNA, 75 bp, Artificial Sequence
  Synthetic
gtcctgaggcgccacgtaggaccatcggaaggcgccgctcaatggatgaacaggctcatagcatttgcatcacgg

SEQ ID NO: 132004 - DNA, 75 bp, Artificial Sequence
  Synthetic
aactccataattggattaacggggattggacaacaccatgtgctacaagctggttgagggacgtgtgggactggg

SEQ ID NO: 132005 - DNA, 75 bp, Artificial Sequence
  Synthetic
ttggacaacaccatgtgctacaagctggttgagggacgtgtgggactgggtgtgtacagttctatctgactttaa

SEQ ID NO: 132006 - DNA, 75 bp, Artificial Sequence
  Synthetic
tctccatgcagggagcttgggccaaagtctttgccatcctcctccttgtcgcgggagtcgatgcagcgaccacct

SEQ ID NO: 132007 - DNA, 75 bp, Artificial Sequence
  Synthetic
tctcatgtcagagagggttcaggggcacttggcgtggtgatggcatatgttgtactacatgcccttgtggagcaa

SEQ ID NO: 132008 - DNA, 75 bp, Artificial Sequence
  Synthetic
cacacaatctttcttggggacatctatttcgggggtcctctggacagtatatcatggggctggcaacaagacctt

SEQ ID NO: 132009 - DNA, 75 bp, Artificial Sequence
  Synthetic
cagatgtactccagcgcagagggggacctcgtggggtggcctagcccccccgggactaagtctttagacccctgt

SEQ ID NO: 132010 - DNA, 75 bp, Artificial Sequence
  Synthetic
tacgtagtgggggcaacagctgacaacctcaagtgcccatgccaagtgccagcgcccgagttcttaacggaggtt

SEQ ID NO: 132011 - DNA, 75 bp, Artificial Sequence
  Synthetic
tacgtagtgggggcaacagctgacaacctcaagtgcccatgccaagtgccagcgcccgagttctttacggaggtt

SEQ ID NO: 132012 - DNA, 75 bp, Artificial Sequence
  Synthetic
tacgtagtgggggcaacagctgacaacctcaagtgcccatgccaagtgccagcgcccgagttcttcacggaggtt

SEQ ID NO: 132013 - DNA, 75 bp, Artificial Sequence
  Synthetic
tacgtagtgggggcaacagctgacaacctcaagtgcccatgccaagtgccagcgcccgagttcttgacggaggtt

SEQ ID NO: 132014 - DNA, 75 bp, Artificial Sequence
  Synthetic
tacgtagtgggggcaactgctgacaacctcaagtgcccatgccaagtgccagcgcccgagttcttaacggaggtt

SEQ ID NO: 132015 - DNA, 75 bp, Artificial Sequence
  Synthetic
tacgtagtgggggcaactgctgacaacctcaagtgcccatgccaagtgccagcgcccgagttctttacggaggtt

SEQ ID NO: 132016 - DNA, 75 bp, Artificial Sequence
  Synthetic
tacgtagtgggggcaactgctgacaacctcaagtgcccatgccaagtgccagcgcccgagttcttcacggaggtt

SEQ ID NO: 132017 - DNA, 75 bp, Artificial Sequence
  Synthetic
tacgtagtgggggcaactgctgacaacctcaagtgcccatgccaagtgccagcgcccgagttcttgacggaggtt

SEQ ID NO: 132018 - DNA, 75 bp, Artificial Sequence
  Synthetic
tacgtagtgggggcaaccgctgacaacctcaagtgcccatgccaagtgccagcgcccgagttcttaacggaggtt

SEQ ID NO: 132019 - DNA, 75 bp, Artificial Sequence
  Synthetic
tacgtagtgggggcaaccgctgacaacctcaagtgcccatgccaagtgccagcgcccgagttctttacggaggtt

SEQ ID NO: 132020 - DNA, 75 bp, Artificial Sequence
  Synthetic
tacgtagtgggggcaaccgctgacaacctcaagtgcccatgccaagtgccagcgcccgagttcttcacggaggtt

SEQ ID NO: 132021 - DNA, 75 bp, Artificial Sequence
  Synthetic
tacgtagtgggggcaaccgctgacaacctcaagtgcccatgccaagtgccagcgcccgagttcttgacggaggtt

SEQ ID NO: 132022 - DNA, 75 bp, Artificial Sequence
  Synthetic
tacgtagtgggggcaacggctgacaacctcaagtgcccatgccaagtgccagcgcccgagttcttaacggaggtt

SEQ ID NO: 132023 - DNA, 75 bp, Artificial Sequence
  Synthetic
tacgtagtgggggcaacggctgacaacctcaagtgcccatgccaagtgccagcgcccgagttctttacggaggtt

SEQ ID NO: 132024 - DNA, 75 bp, Artificial Sequence
  Synthetic
tacgtagtgggggcaacggctgacaacctcaagtgcccatgccaagtgccagcgcccgagttcttcacggaggtt

SEQ ID NO: 132025 - DNA, 75 bp, Artificial Sequence
  Synthetic
tacgtagtgggggcaacggctgacaacctcaagtgcccatgccaagtgccagcgcccgagttcttgacggaggtt

SEQ ID NO: 132026 - DNA, 75 bp, Artificial Sequence
  Synthetic
ggacacgccgtgggcttgttcagagcggccgtgtgcaccaggggtgtggccaaatctattgacttcattcctgtt

SEQ ID NO: 132027 - DNA, 75 bp, Artificial Sequence
  Synthetic
aacttccgtgtgagcccgagcctgatgtaatggtactaacatccatgctatctgacccaacacacataaccgcag

SEQ ID NO: 132028 - DNA, 75 bp, Artificial Sequence
  Synthetic
tctgacccaacacacataaccgcagaaacggcgggtcgacgcctcggaaggggctcccctccgtcactggccagc

SEQ ID NO: 132029 - DNA, 75 bp, Artificial Sequence
  Synthetic
gggctcccctccgtcactggccagctcttcagctagtcagctttctgcgccatccttaaaggcaacatgcaccat

SEQ ID NO: 132030 - DNA, 75 bp, Artificial Sequence
  Synthetic
gggctcccctccgtcactggccagctcttcagctagtcagctttctgcgccttccttaaaggcaacatgcaccat

SEQ ID NO: 132031 - DNA, 75 bp, Artificial Sequence
  Synthetic
gggctcccctccgtcactggccagctcttcagctagtcagctttctgcgccctccttaaaggcaacatgcaccat

SEQ ID NO: 132032 - DNA, 75 bp, Artificial Sequence
  Synthetic
gggctcccctccgtcactggccagctcttcagctagtcagctttctgcgccgtccttaaaggcaacatgcaccat

SEQ ID NO: 132033 - DNA, 75 bp, Artificial Sequence
  Synthetic
gggtgcgtgccctgcgttcgggagaacaactcctcccgctgctgggtagcgctcactcccacgctcgcggccagg

SEQ ID NO: 132034 - DNA, 75 bp, Artificial Sequence
  Synthetic
atagtcctcgactcttttgacccgctagtggccgaaacggacgacagggaaatatcagtggccgcagagtgtcac

SEQ ID NO: 132035 - DNA, 75 bp, Artificial Sequence
  Synthetic
ctggcgcctatgacatcatcatatgcgacgaatgccattcagtggacgccactaccatccttggcattggaacag

SEQ ID NO: 132036 - DNA, 75 bp, Artificial Sequence
  Synthetic
gcccccaaaggggttgccacctgtacccccgcctcggcggaagagggtcatacagcttgacgagtcagctgctgt

SEQ ID NO: 132037 - DNA, 75 bp, Artificial Sequence
  Synthetic
tcctcaccgaatcaaccgtatctactgccttggccgaacttgccaccaaaagttttggcagctcctcaacttccg

SEQ ID NO: 132038 - DNA, 75 bp, Artificial Sequence
  Synthetic
gcaggggtggcgactccttgcgcccatcacggcctactcccaacagacgcggggcctacttggttgcatcatcac

SEQ ID NO: 132039 - DNA, 75 bp, Artificial Sequence
  Synthetic
ccaacctctgacaagccagacgcacactccgatgctggttcgtacagctctatgcccccccttgagggcgagcct

SEQ ID NO: 132040 - DNA, 75 bp, Artificial Sequence
  Synthetic
acatcaacaggactgccctgaactgcaatgactccctcaacactgggttccttgccgcgctgttctacacacaca

SEQ ID NO: 132041 - DNA, 75 bp, Artificial Sequence
  Synthetic
cccagaaaatccagcttgtaaacaccaacggcagctggcacatcaacaggactgccctgaactgcaatgactccc

SEQ ID NO: 132042 - DNA, 75 bp, Artificial Sequence
  Synthetic
tgttgctccctgtcatattcttggacgggggcccttataacaccgtgtgctgctgaggaagagaagatgcccatc

SEQ ID NO: 132043 - DNA, 75 bp, Artificial Sequence
  Synthetic
tgttgctccctgtcatattcttggacgggggcccttataacaccgtgtgctgctgaggaagagaagttgcccatc

SEQ ID NO: 132044 - DNA, 75 bp, Artificial Sequence
  Synthetic
tgttgctccctgtcatattcttggacgggggcccttataacaccgtgtgctgctgaggaagagaagctgcccatc

SEQ ID NO: 132045 - DNA, 75 bp, Artificial Sequence
  Synthetic
tgttgctccctgtcatattcttggacgggggcccttataacaccgtgtgctgctgaggaagagaaggtgcccatc

SEQ ID NO: 132046 - DNA, 75 bp, Artificial Sequence
  Synthetic
ttagggcaatcgaggacggggttaattatgcaacagggaatcttcctggttgctccttttctatcttcctcttgg

SEQ ID NO: 132047 - DNA, 75 bp, Artificial Sequence
  Synthetic
ggccgtctgggatgttcgacagcgtagtgctctgtgagtgctatgatgccggggcagcctggtacgagctcacgc

SEQ ID NO: 132048 - DNA, 75 bp, Artificial Sequence
  Synthetic
cccgtgtgtcaagaccacctggaattctgggaggcggtcttcacaggtcttacacacattgatgcccacttcctc

SEQ ID NO: 132049 - DNA, 75 bp, Artificial Sequence
  Synthetic
gcctctgggatctaccaccttaccaatgactgctcgaacaacagcatcgtctttgaggcagaggccatgatactg

SEQ ID NO: 132050 - DNA, 75 bp, Artificial Sequence
  Synthetic
gcctctgggatctaccaccttaccaatgtctgctcgaacaacagcatcgtctttgaggcagaggccatgatactg

SEQ ID NO: 132051 - DNA, 75 bp, Artificial Sequence
  Synthetic
gcctctgggatctaccaccttaccaatgcctgctcgaacaacagcatcgtctttgaggcagaggccatgatactg

SEQ ID NO: 132052 - DNA, 75 bp, Artificial Sequence
  Synthetic
gcctctgggatctaccaccttaccaatggctgctcgaacaacagcatcgtctttgaggcagaggccatgatactg

SEQ ID NO: 132053 - DNA, 75 bp, Artificial Sequence
  Synthetic
agggcaactggttcggctgtacatggatgaatggcactgggttcaccaagacgtgtgggggccccccgtgtaaca

SEQ ID NO: 132054 - DNA, 75 bp, Artificial Sequence
  Synthetic
taagaatgaagtgttctgtgtggacacccggaaaggtggccggaagccagcccgactcatcgtgtatccagacct

SEQ ID NO: 132055 - DNA, 75 bp, Artificial Sequence
  Synthetic
acccggaaaggtggccggaagccagcccgactcatcgtgtatccagaccttggggtaagggtatgcgagaagagg

SEQ ID NO: 132056 - DNA, 75 bp, Artificial Sequence
  Synthetic
cccgactcatcgtgtatccagaccttggggtaagggtatgcgagaagagggcgctttaagacatcacatgcaagc

SEQ ID NO: 132057 - DNA, 75 bp, Artificial Sequence
  Synthetic
cccgactcatcgtgtatccagaccttggggtaagggtatgcgagaagagggcgctttatgacatcacatgcaagc

SEQ ID NO: 132058 - DNA, 75 bp, Artificial Sequence
  Synthetic
cccgactcatcgtgtatccagaccttggggtaagggtatgcgagaagagggcgctttacgacatcacatgcaagc

SEQ ID NO: 132059 - DNA, 75 bp, Artificial Sequence
  Synthetic
cccgactcatcgtgtatccagaccttggggtaagggtatgcgagaagagggcgctttaggacatcacatgcaagc

SEQ ID NO: 132060 - DNA, 75 bp, Artificial Sequence
  Synthetic
ttacggtttccaatactcaccaaagcagcgcgtggaccacctcctccggatgtggcgctccaagaagacccctat

SEQ ID NO: 132061 - DNA, 75 bp, Artificial Sequence
  Synthetic
tacgggacacaggatggcatgggacatgatgctcaactggtcgcctacggtgagctatgtggtttctagcgccct

SEQ ID NO: 132062 - DNA, 75 bp, Artificial Sequence
  Synthetic
acatccagacagagcgcgacatctaccaatgctgccagttggagcccgcagcacggaaagccattacatcgctca

SEQ ID NO: 132063 - DNA, 75 bp, Artificial Sequence
  Synthetic
ggccgtgagccaacctggtgccctaaccgcgggcctgcgatcgcacgtcgacgccatcgtggcgtcggcaacctt

SEQ ID NO: 132064 - DNA, 75 bp, Artificial Sequence
  Synthetic
ccaatgctgccagttggagcccgcagcacggaaagccattacatcgctcactgaccggctgtactgcggtggccc

SEQ ID NO: 132065 - DNA, 75 bp, Artificial Sequence
  Synthetic
aagctcctggctcccatcactgcctatgctcaacagactcgtggtctcttgggcgccatcgtggttagcctaacg

SEQ ID NO: 132066 - DNA, 75 bp, Artificial Sequence
  Synthetic
attgcggtcctcctcctttttgcaggagttgatgctacgccccatgtggccgtctcctctgctcgcgctgccaat

SEQ ID NO: 132067 - DNA, 75 bp, Artificial Sequence
  Synthetic
cgtctcctctgctcgcgctgccaatggcatcgttgggtggttctctcaaggctctcgacagaatctacagctcat

SEQ ID NO: 132068 - DNA, 75 bp, Artificial Sequence
  Synthetic
aattgttccatctacccgggccatataactggacaccgcatggcttgggatatgatgatgaactggtcgccgacg

SEQ ID NO: 132069 - DNA, 75 bp, Artificial Sequence
  Synthetic
agcccgctgcccaccagcactaccatcctcttgaacatcatggggggatggttggcctctcagatcgccccccct

SEQ ID NO: 132070 - DNA, 75 bp, Artificial Sequence
  Synthetic
ccatgcaaggagcgtgggcaaaggtcgtcgtcattctcctgctgtgcgccggggtggacgcgcaaacgcgcactg

SEQ ID NO: 132071 - DNA, 75 bp, Artificial Sequence
  Synthetic
aattccacggggtgcccggagcggatgagtagatgtagaccattgcactcgttcgatcagggctggggtcctatc

SEQ ID NO: 132072 - DNA, 75 bp, Artificial Sequence
  Synthetic
ttgctcttcaaacgtgtccgtagcccacgacaacaatggacagagatactactacctcacaagagacccgaccac

SEQ ID NO: 132073 - DNA, 75 bp, Artificial Sequence
  Synthetic
tgcagtatttcatcaccagagccgaggcgcatttgcaagtgtggatcccccccctcaacgttcgggggggccgcg

SEQ ID NO: 132074 - DNA, 75 bp, Artificial Sequence
  Synthetic
actacctcacaagagacccgaccacacctatttctcgagcggcctgggaaaccgcccgacacactccggtgaatt

SEQ ID NO: 132075 - DNA, 75 bp, Artificial Sequence
  Synthetic
ccgtctactgttttacacccagccccgtggtagtgggaactactgatcggaaaggcttccccacctacagctggg

SEQ ID NO: 132076 - DNA, 75 bp, Artificial Sequence
  Synthetic
cattaaccgcacggctcttaactgcaacgactccctgaacactggctttcttgcgtccttgttctacacccacaa

SEQ ID NO: 132077 - DNA, 75 bp, Artificial Sequence
  Synthetic
tataaagtacttgtactaaatccctctgtcgcggccacactcggttttggggcctacatgtccaaagcccacggg

SEQ ID NO: 132078 - DNA, 75 bp, Artificial Sequence
  Synthetic
aatgaggaggacatgaggccctactgctggcactatccacctaagccgtgtggtgtggttcccgcccggaacgtg

SEQ ID NO: 132079 - DNA, 75 bp, Artificial Sequence
  Synthetic
ccctagtgtgtcccactgattgcttccggaagcatccagacgccacatttgagagatgcgggtcgggtccctggc

SEQ ID NO: 132080 - DNA, 75 bp, Artificial Sequence
  Synthetic
agttcactcacaattaccagcttacttaggagactacatgcctggatcactgaagattgcccagtcccgtgctcg

SEQ ID NO: 132081 - DNA, 75 bp, Artificial Sequence
  Synthetic
tacaggctttggcactacccctgcactgtcaattttaccatcttcaaggtcaggatgtatgtggggggcgtggag

SEQ ID NO: 132082 - DNA, 75 bp, Artificial Sequence
  Synthetic
attgcttggggcgccaccgttgagagcctggagacatcgggccagggcggtcagagcaaagctcattgcccaggg

SEQ ID NO: 132083 - DNA, 75 bp, Artificial Sequence
  Synthetic
tcttcctcctaaacagcacccggcctcctaagggagcctggtttggatgcacatggatgaacaacaccggattca

SEQ ID NO: 132084 - DNA, 75 bp, Artificial Sequence
  Synthetic
cgagcataggtttgacgctgcttgcaactggacccggggcgagcggtgcgagcttgaggacagagacaggttcga

SEQ ID NO: 132085 - DNA, 75 bp, Artificial Sequence
  Synthetic
ccaaaacatgcggcgcgccaccatgccgcatcaggcgagatttcaacgccagcgtggacctgctgtgccccacag

SEQ ID NO: 132086 - DNA, 75 bp, Artificial Sequence
  Synthetic
ctgtgcctactcctactttccgtaggggtaggcatcttccttcttcccgctcggtaagcgggaagcccaaagcta

SEQ ID NO: 132087 - DNA, 75 bp, Artificial Sequence
  Synthetic
catgggcaccatgaaaataacaggcccaaagacctgcttgaacatgtggcaggggaccttccccatcaattgtta

SEQ ID NO: 132088 - DNA, 75 bp, Artificial Sequence
  Synthetic
tggatgaaccggctaatagccttcgcctcccgggggaaccatgtttcccccacgcactacgtgccggagagcgat

SEQ ID NO: 132089 - DNA, 75 bp, Artificial Sequence
  Synthetic
ctacccgtgcaccgtcaattattccatctttaagataaggatgttcgtagggggaattgagcacaggttcgatgc

SEQ ID NO: 132090 - DNA, 75 bp, Artificial Sequence
  Synthetic
cggacgtcttcgtccttaataacaccaggccaccgttgggcaattggttcggttgcacctggatgaactcatctg

SEQ ID NO: 132091 - DNA, 75 bp, Artificial Sequence
  Synthetic
attttcatctgctgcgcttggcacgtgcggggccgggttgtccccatgaccacctatgcgttgctgcagctttgg

SEQ ID NO: 132092 - DNA, 75 bp, Artificial Sequence
  Synthetic
ccctgcacttttccagacttgccagccctttcttcgggactcatccaccttcaccagaacattgtcgacgtccag

SEQ ID NO: 132093 - DNA, 75 bp, Artificial Sequence
  Synthetic
tgcggggccgggttgtccccatgaccacctatgcgttgctgcagctttggccactcctgttattaatactagcct

SEQ ID NO: 132094 - DNA, 75 bp, Artificial Sequence
  Synthetic
cttccgggctgctgtgtgcacccggggggttgcgaaggcggtggactttgtacccgttgagtctatggaaactac

SEQ ID NO: 132095 - DNA, 75 bp, Artificial Sequence
  Synthetic
gcctatggatgctcatcctgatgggccaggccgaagcagcattagagaagctgattgtactgcacgctgccagcg

SEQ ID NO: 132096 - DNA, 75 bp, Artificial Sequence
  Synthetic
ggtgcgccggcggggcgacagcagggggagcctactctcccccaggcccgtctcctacttgaagggctcttcggg

SEQ ID NO: 132097 - DNA, 75 bp, Artificial Sequence
  Synthetic
acaacttcttataggcatgctctggtgggtacagtatttcattgcactcactgaggcccaacttcatcagtgggt

SEQ ID NO: 132098 - DNA, 75 bp, Artificial Sequence
  Synthetic
ccaatggcccttcttcctgcttctcctggcattgcctcatcaggcctacgcccttgacacgggcgaacaaggcca

SEQ ID NO: 132099 - DNA, 75 bp, Artificial Sequence
  Synthetic
ctggggggagaatgagacggacgtgctgcttctcaacaacacgcggccgccgcaaggcaactggttcggctgtac

SEQ ID NO: 132100 - DNA, 75 bp, Artificial Sequence
  Synthetic
tgaggtaactaagatcttgctggctttgattggtccgctctacctactgcagtacagcatgctcaagactccata

SEQ ID NO: 132101 - DNA, 75 bp, Artificial Sequence
  Synthetic
gcttggccttgtgctgctggtgattatatctgtttttacactcacccctgcatataagacccttcttagtcggtg

SEQ ID NO: 132102 - DNA, 75 bp, Artificial Sequence
  Synthetic
ttgattggtccgctctacctactgcagtacagcatgctcaagactccatactttgtccgcgcgcacatcctcttg

SEQ ID NO: 132103 - DNA, 75 bp, Artificial Sequence
  Synthetic
caattgctcgatctatcccggccacgtaacaggtcaccgcatggcctgggatatgatgatgaactggtcgcctac

SEQ ID NO: 132104 - DNA, 75 bp, Artificial Sequence
  Synthetic
gccgcaaccatgttctgcccgggtgtagtgtttgacataaccaagtggctcctggcgatcctcgggcctggctac

SEQ ID NO: 132105 - DNA, 75 bp, Artificial Sequence
  Synthetic
ttgcttccgcaaacatccggaagccacgtactcccggtgcggctccggtccctggatcacacccaggtgtctggt

SEQ ID NO: 132106 - DNA, 75 bp, Artificial Sequence
  Synthetic
gggtgctgatactgctgcctgcggcgacattatcgccggtcttcctgtctcagccaggcgggggaacttactgtt

SEQ ID NO: 132107 - DNA, 75 bp, Artificial Sequence
  Synthetic
tccagcttgtgaacaccaatggcagctggcacatcaacaggaccgccctgaactgcaatgactcccttcagactg

SEQ ID NO: 132108 - DNA, 75 bp, Artificial Sequence
  Synthetic
gggaaggggtggagacttctcgccccgatcacagcatacgcccaacagactcgaggtgtagtgggcaccattgtc

SEQ ID NO: 132109 - DNA, 75 bp, Artificial Sequence
  Synthetic
tgtggactgtctatcacggcgctggctccaagacacttgctggccccaaaggacccgtgtgccaaatgtacacca

SEQ ID NO: 132110 - DNA, 75 bp, Artificial Sequence
  Synthetic
ccatcacctactccaagtctggcggctcggatcagaggccctattgctggcactacgctccttcaccgtgtggta

SEQ ID NO: 132111 - DNA, 75 bp, Artificial Sequence
  Synthetic
ctacacatccaaagggtggagccttctcgctcccatcactgcttacgcccagcagacacgtggtctgctgggcgc

SEQ ID NO: 132112 - DNA, 75 bp, Artificial Sequence
  Synthetic
ggggttctctggaccgtgttccatggcgctggcaacaagacgctggctggatctcgcggcccagtcacgcagatg

SEQ ID NO: 132113 - DNA, 75 bp, Artificial Sequence
  Synthetic
tttggtgcttacatgtccaaggcccatggggtcgatcctaacatcaggaccggggtgagaacaattaccactggc

SEQ ID NO: 132114 - DNA, 75 bp, Artificial Sequence
  Synthetic
agcagacgagaggcctcttgggatgcatagttaccagcttgaccggccgggacaaaaaccaggtggagggtgaga

SEQ ID NO: 132115 - DNA, 75 bp, Artificial Sequence
  Synthetic
ggaagaccaacataccccaattgacacaaccatcatggccaaaaacgaggtgttctgcgttgatcccgctaaagg

SEQ ID NO: 132116 - DNA, 75 bp, Artificial Sequence
  Synthetic
tccacgctcctacagggagcgggaagagcaccaaggtccccgctgcttacgcagctcaggggtacaaggtcctgg

SEQ ID NO: 132117 - DNA, 75 bp, Artificial Sequence
  Synthetic
cccggaacgccgacgtcattccggcccggagacggggagaccggcgagcggcactgctctccccgcggccccttt

SEQ ID NO: 132118 - DNA, 75 bp, Artificial Sequence
  Synthetic
gtataccccgaccttggggtcagggtgtgcgaaaaaatggccctctatgacattgcacaaaagcttcccaaggca

SEQ ID NO: 132119 - DNA, 75 bp, Artificial Sequence
  Synthetic
cctaggcttcggtagttacatgtctacatcacatggcatagaccctaacatccgtaccggagtgaggactatcac

SEQ ID NO: 132120 - DNA, 75 bp, Artificial Sequence
  Synthetic
gcctgtcctctgccctagggcccacgccgtcgggatcttccgtgcggccgcatgctctaggggagtggcaaagtc

SEQ ID NO: 132121 - DNA, 75 bp, Artificial Sequence
  Synthetic
agcccgctgctgctgtctacgacagagtggcagatattgccctgttccttcaccaccctgccggctctgtccact

SEQ ID NO: 132122 - DNA, 75 bp, Artificial Sequence
  Synthetic
ccgtgacgaccggagagtccatcacttattccacgtatggcaaatttctcgcagatggaggctgcgcaggcggag

SEQ ID NO: 132123 - DNA, 75 bp, Artificial Sequence
  Synthetic
cattccaagaagaagtgtgacgagctcgccaaacagctcgtgtcattaggcctgaatgccgtggcattttatcgg

SEQ ID NO: 132124 - DNA, 75 bp, Artificial Sequence
  Synthetic
catcacggcctacgcccaacagacgcggggcctgcttggctgcatcatcactagcctcacaggccgggacaagaa

SEQ ID NO: 132125 - DNA, 75 bp, Artificial Sequence
  Synthetic
ttaccgccacgagcttacgccatggaccgggagatggctgcatcgtgtggaggcgcggtttttataggtctggca

SEQ ID NO: 132126 - DNA, 75 bp, Artificial Sequence
  Synthetic
ctcttgaccttgtcaccatactataaagtgttcctcgctaggctcatatggtggttacaatatttcatcaccaga

SEQ ID NO: 132127 - DNA, 75 bp, Artificial Sequence
  Synthetic
gttgacggtcctggcgacagcaacgccgcctggatccgttacaacgccccactccaacattgaggaggtagccct

SEQ ID NO: 132128 - DNA, 75 bp, Artificial Sequence
  Synthetic
acaggtgactttgactccgtaatagactgcaatgtttctgtcacacaggtcgtggatttcagtctcgacccaaca

SEQ ID NO: 132129 - DNA, 75 bp, Artificial Sequence
  Synthetic
cccagggggaacggccgtcgggtatattcgacaccgtcgtcctctgcgaggcgtacgatacggggtgcgcgtggt

SEQ ID NO: 132130 - DNA, 75 bp, Artificial Sequence
  Synthetic
acttcgtacgcgctcaagggctcattcgtgcatgcatgttagtgcggaaagccgccgggggtcattatatccaaa

SEQ ID NO: 132131 - DNA, 75 bp, Artificial Sequence
  Synthetic
tggccttcgtgaagctggccgcactgacaggtacgtacgtttatgaccatcttgccccactgcagcattgggccc

SEQ ID NO: 132132 - DNA, 75 bp, Artificial Sequence
  Synthetic
accccggggctcccagtctgccaagaccaccttgagttttgggagggggtcttcacaggcctgactcacatcgac

SEQ ID NO: 132133 - DNA, 75 bp, Artificial Sequence
  Synthetic
aggtagaggacgatcgtgagccttctataccatcagagtacttgatcaagaggagaaagttcccaccggcactac

SEQ ID NO: 132134 - DNA, 75 bp, Artificial Sequence
  Synthetic
tcgaggaagacatggcatatacaggtatgtttcctccggtgagcgaccatcaggaatgtttgactcggtagtgct

SEQ ID NO: 132135 - DNA, 75 bp, Artificial Sequence
  Synthetic
ctcatcgcccagggagggaaggcagccatttgtggccgctacctcttcaactgggcggtgaagacaaagctcaaa

SEQ ID NO: 132136 - DNA, 75 bp, Artificial Sequence
  Synthetic
ctgctcccgtggtggagtccaagtggcgagcccttgaggccttctgggcgaagcacatgtggaacttcatcagcg

SEQ ID NO: 132137 - DNA, 75 bp, Artificial Sequence
  Synthetic
actaagcaggcgggggaaaatttcccatacctagtggcctatcaggccacggtatgtgctagggcgaaagccccc

SEQ ID NO: 132138 - DNA, 75 bp, Artificial Sequence
  Synthetic
ggtcgagggggaggttcaagtggtttctaccgcaacacaatccttcctggcgacctgcgtcaacggcgtatgttg

SEQ ID NO: 132139 - DNA, 75 bp, Artificial Sequence
  Synthetic
attcctgacagggaagtattgtaccaacagttcgacgagatggaggagtgttctaggcacatcccctatctcgcc

SEQ ID NO: 132140 - DNA, 75 bp, Artificial Sequence
  Synthetic
aggtcacccttacccaccccgtgaccaagtacatctccacatgtatgcaggcagatcttgagatcatgaccagca

SEQ ID NO: 132141 - DNA, 75 bp, Artificial Sequence
  Synthetic
agtcatcgcccctgacaaggaggtcctctatgaggcttttgatgagatggaggaatgtgcttccaaagccgccct

SEQ ID NO: 132142 - DNA, 75 bp, Artificial Sequence
  Synthetic
gcctccctcaccagtccgctgccgacttctacgaccctcctattaaatatcttgggagggtgggtggcgtcgcaa

SEQ ID NO: 132143 - DNA, 75 bp, Artificial Sequence
  Synthetic
gcctactgcagcaagctacgcaacaggcccaaagtgtgcagcctgccgtccaggcaacttggcctaaactggaac

SEQ ID NO: 132144 - DNA, 75 bp, Artificial Sequence
  Synthetic
cgctcccactggcagcggcaagagcactaaggtgccggctgcatacgcagcccaagggtacaaggtactcgtctt

SEQ ID NO: 132145 - DNA, 75 bp, Artificial Sequence
  Synthetic
ccaagtggagggtgaggtccagattgtgtcaaccgctgcccagaccttcctggcaacatgcatcaatggggtgtg

SEQ ID NO: 132146 - DNA, 75 bp, Artificial Sequence
  Synthetic
ttttacagctgccgtcaccagcccactaaccaccagccaaaccctcctcttcaacattttgggggggtgggtggc

SEQ ID NO: 132147 - DNA, 75 bp, Artificial Sequence
  Synthetic
acggcaagttcctcgccgacggtggttgctctgggggcgcctatgacatcataatgtgtgatgagtgccactcaa

SEQ ID NO: 132148 - DNA, 75 bp, Artificial Sequence
  Synthetic
gccactggcttcgttgtcagcggcctggtaggagctgccgtgggcagtataggcctaggcaagatactggtggac

SEQ ID NO: 132149 - DNA, 75 bp, Artificial Sequence
  Synthetic
gcgacatttgggattgggtgtgtgaagtactctctgatttcaagacctggctcaaagcgaagctcgttccagcgc

SEQ ID NO: 132150 - DNA, 75 bp, Artificial Sequence
  Synthetic
catattcagggctgcggtgtgcacccgtggagtggctaaggcggtggactttatccccgtggagagcctagagac

SEQ ID NO: 132151 - DNA, 75 bp, Artificial Sequence
  Synthetic
aagatctccgggtctcgttggtgcagcaacgtctggcacggcacttttcccatcaatgctaccacgacaggtcct

SEQ ID NO: 132152 - DNA, 75 bp, Artificial Sequence
  Synthetic
tggtcaacaaagacggcagttggcacatcaatagcacggccttgaactgcaatgcaagccttgacgccggctggc

SEQ ID NO: 132153 - DNA, 75 bp, Artificial Sequence
  Synthetic
acaccagggctctctggagggtttctgctgaggagtatgtcgaggttaagagggtgggggatagccatttcgtag

SEQ ID NO: 132154 - DNA, 75 bp, Artificial Sequence
  Synthetic
gagtttttcactgaggtcgatggggtgagaatacatcggtacgcgccccactgcaaacccctcttgagggacgag

SEQ ID NO: 132155 - DNA, 75 bp, Artificial Sequence
  Synthetic
agtcctggcgggccttgcctactactccatggtggggaactgggctaaggtgttgattgtgatgctactctttgc

SEQ ID NO: 132156 - DNA, 75 bp, Artificial Sequence
  Synthetic
gtgcgagccggaaccagacgtagtggttgtgacgtccatgctcaccgatccctcacatgtaactgctgaggccgc

SEQ ID NO: 132157 - DNA, 75 bp, Artificial Sequence
  Synthetic
gtgcgagccggaaccagacgtagtggttgtgacgtccatgctcaccgatccctcacatgttactgctgaggccgc

SEQ ID NO: 132158 - DNA, 75 bp, Artificial Sequence
  Synthetic
gtgcgagccggaaccagacgtagtggttgtgacgtccatgctcaccgatccctcacatgtcactgctgaggccgc

SEQ ID NO: 132159 - DNA, 75 bp, Artificial Sequence
  Synthetic
gtgcgagccggaaccagacgtagtggttgtgacgtccatgctcaccgatccctcacatgtgactgctgaggccgc

SEQ ID NO: 132160 - DNA, 75 bp, Artificial Sequence
  Synthetic
gtgcgagccggaaccagacgttgtggttgtgacgtccatgctcaccgatccctcacatgtaactgctgaggccgc

SEQ ID NO: 132161 - DNA, 75 bp, Artificial Sequence
  Synthetic
gtgcgagccggaaccagacgttgtggttgtgacgtccatgctcaccgatccctcacatgttactgctgaggccgc

SEQ ID NO: 132162 - DNA, 75 bp, Artificial Sequence
  Synthetic
gtgcgagccggaaccagacgttgtggttgtgacgtccatgctcaccgatccctcacatgtcactgctgaggccgc

SEQ ID NO: 132163 - DNA, 75 bp, Artificial Sequence
  Synthetic
gtgcgagccggaaccagacgttgtggttgtgacgtccatgctcaccgatccctcacatgtgactgctgaggccgc

SEQ ID NO: 132164 - DNA, 75 bp, Artificial Sequence
  Synthetic
gtgcgagccggaaccagacgtcgtggttgtgacgtccatgctcaccgatccctcacatgtaactgctgaggccgc

SEQ ID NO: 132165 - DNA, 75 bp, Artificial Sequence
  Synthetic
gtgcgagccggaaccagacgtcgtggttgtgacgtccatgctcaccgatccctcacatgttactgctgaggccgc

SEQ ID NO: 132166 - DNA, 75 bp, Artificial Sequence
  Synthetic
gtgcgagccggaaccagacgtcgtggttgtgacgtccatgctcaccgatccctcacatgtcactgctgaggccgc

SEQ ID NO: 132167 - DNA, 75 bp, Artificial Sequence
  Synthetic
gtgcgagccggaaccagacgtcgtggttgtgacgtccatgctcaccgatccctcacatgtgactgctgaggccgc

SEQ ID NO: 132168 - DNA, 75 bp, Artificial Sequence
  Synthetic
gtgcgagccggaaccagacgtggtggttgtgacgtccatgctcaccgatccctcacatgtaactgctgaggccgc

SEQ ID NO: 132169 - DNA, 75 bp, Artificial Sequence
  Synthetic
gtgcgagccggaaccagacgtggtggttgtgacgtccatgctcaccgatccctcacatgttactgctgaggccgc

SEQ ID NO: 132170 - DNA, 75 bp, Artificial Sequence
  Synthetic
gtgcgagccggaaccagacgtggtggttgtgacgtccatgctcaccgatccctcacatgtcactgctgaggccgc

SEQ ID NO: 132171 - DNA, 75 bp, Artificial Sequence
  Synthetic
gtgcgagccggaaccagacgtggtggttgtgacgtccatgctcaccgatccctcacatgtgactgctgaggccgc

SEQ ID NO: 132172 - DNA, 75 bp, Artificial Sequence
  Synthetic
gtcgggcgcgcccacatacaactggggcgaaaatgaaacggacgtcttcatcctcaacaacaccaggccaccgct

SEQ ID NO: 132173 - DNA, 75 bp, Artificial Sequence
  Synthetic
ggcacgacgcttagctcgagggtcgccgccctctcttgctagctcatcagcaagccagctctctgcgccctcatt

SEQ ID NO: 132174 - DNA, 75 bp, Artificial Sequence
  Synthetic
ggcacgacgcttagctcgtgggtcgccgccctctcttgctagctcatcagcaagccagctctctgcgccctcatt

SEQ ID NO: 132175 - DNA, 75 bp, Artificial Sequence
  Synthetic
ggcacgacgcttagctcgcgggtcgccgccctctcttgctagctcatcagcaagccagctctctgcgccctcatt

SEQ ID NO: 132176 - DNA, 75 bp, Artificial Sequence
  Synthetic
ggcacgacgcttagctcgggggtcgccgccctctcttgctagctcatcagcaagccagctctctgcgccctcatt

SEQ ID NO: 132177 - DNA, 75 bp, Artificial Sequence
  Synthetic
gcccatcccgatgctgagctcattgaagctaacttgctatggaggcaggagatgggtggcaacataacccgcgtg

SEQ ID NO: 132178 - DNA, 75 bp, Artificial Sequence
  Synthetic
gcaggcccaaattcccaccagcactgcccatatgggccaggccagattacaatccacctgtactcgagacttgga

SEQ ID NO: 132179 - DNA, 75 bp, Artificial Sequence
  Synthetic
gcaggcccaaattcccaccagctctgcccatatgggccaggccagattacaatccacctgtactcgagacttgga

SEQ ID NO: 132180 - DNA, 75 bp, Artificial Sequence
  Synthetic
gcaggcccaaattcccaccagccctgcccatatgggccaggccagattacaatccacctgtactcgagacttgga

SEQ ID NO: 132181 - DNA, 75 bp, Artificial Sequence
  Synthetic
gcaggcccaaattcccaccagcgctgcccatatgggccaggccagattacaatccacctgtactcgagacttgga

SEQ ID NO: 132182 - DNA, 75 bp, Artificial Sequence
  Synthetic
gcaggcccaatttcccaccagcactgcccatatgggccaggccagattacaatccacctgtactcgagacttgga

SEQ ID NO: 132183 - DNA, 75 bp, Artificial Sequence
  Synthetic
gcaggcccaatttcccaccagctctgcccatatgggccaggccagattacaatccacctgtactcgagacttgga

SEQ ID NO: 132184 - DNA, 75 bp, Artificial Sequence
  Synthetic
gcaggcccaatttcccaccagccctgcccatatgggccaggccagattacaatccacctgtactcgagacttgga

SEQ ID NO: 132185 - DNA, 75 bp, Artificial Sequence
  Synthetic
gcaggcccaatttcccaccagcgctgcccatatgggccaggccagattacaatccacctgtactcgagacttgga

SEQ ID NO: 132186 - DNA, 75 bp, Artificial Sequence
  Synthetic
gcaggcccaacttcccaccagcactgcccatatgggccaggccagattacaatccacctgtactcgagacttgga

SEQ ID NO: 132187 - DNA, 75 bp, Artificial Sequence
  Synthetic
gcaggcccaacttcccaccagctctgcccatatgggccaggccagattacaatccacctgtactcgagacttgga

SEQ ID NO: 132188 - DNA, 75 bp, Artificial Sequence
  Synthetic
gcaggcccaacttcccaccagccctgcccatatgggccaggccagattacaatccacctgtactcgagacttgga

SEQ ID NO: 132189 - DNA, 75 bp, Artificial Sequence
  Synthetic
gcaggcccaacttcccaccagcgctgcccatatgggccaggccagattacaatccacctgtactcgagacttgga

SEQ ID NO: 132190 - DNA, 75 bp, Artificial Sequence
  Synthetic
gcaggcccaagttcccaccagcactgcccatatgggccaggccagattacaatccacctgtactcgagacttgga

SEQ ID NO: 132191 - DNA, 75 bp, Artificial Sequence
  Synthetic
gcaggcccaagttcccaccagctctgcccatatgggccaggccagattacaatccacctgtactcgagacttgga

SEQ ID NO: 132192 - DNA, 75 bp, Artificial Sequence
  Synthetic
gcaggcccaagttcccaccagccctgcccatatgggccaggccagattacaatccacctgtactcgagacttgga

SEQ ID NO: 132193 - DNA, 75 bp, Artificial Sequence
  Synthetic
gcaggcccaagttcccaccagcgctgcccatatgggccaggccagattacaatccacctgtactcgagacttgga

SEQ ID NO: 132194 - DNA, 75 bp, Artificial Sequence
  Synthetic
cgattcttccaacgtttcggccgcccttgcgcagttggctgcaaagacttttgacacgcccagttcctcttccac

SEQ ID NO: 132195 - DNA, 75 bp, Artificial Sequence
  Synthetic
cgagctcacgcccgccgagaccacagttaggctgcgagcgtacatgaacaccccggggcttcccgtgtgccagga

SEQ ID NO: 132196 - DNA, 75 bp, Artificial Sequence
  Synthetic
ccggcggaggtcccgcaatctgggtaaggtcatcgataccctgacttgcggcttcgccgacctcatgggatacat

SEQ ID NO: 132197 - DNA, 75 bp, Artificial Sequence
  Synthetic
agctgagtcctacagctctatgcctcccctcgagggcgaaccgggagatcctgaccttagttcagggtcctggtc

SEQ ID NO: 132198 - DNA, 75 bp, Artificial Sequence
  Synthetic
ggatcgttgggcccaaaacctgcagcaacacgtggcatggaacattccccatcaacgcatacaccacgggcccct

SEQ ID NO: 132199 - DNA, 75 bp, Artificial Sequence
  Synthetic
acaaaccccggtgcccccccctaggaggcggcgcgccgtggtgttggaccagaacaccgtgggggaggctctcag

SEQ ID NO: 132200 - DNA, 75 bp, Artificial Sequence
  Synthetic
ggttgctctttttctatcttccttttggcacttctctcgtgcctcactgttcccgcttcagccatacactatcgc

SEQ ID NO: 132201 - DNA, 75 bp, Artificial Sequence
  Synthetic
acgcgccagaagaaggtgacatttgaccgagtgcaacttctggatcagcactattatgacactgtaaaggagata

SEQ ID NO: 132202 - DNA, 75 bp, Artificial Sequence
  Synthetic
caccaccctaccggctctgtccactggtttgatccatctccaccagaacatcgtggacgtgcaatacctgtacgg

SEQ ID NO: 132203 - DNA, 75 bp, Artificial Sequence
  Synthetic
gatgagtccgttgattcggaaacgggttccatgagctccatgcccccccttgagggggagcctggagacccagac

SEQ ID NO: 132204 - DNA, 75 bp, Artificial Sequence
  Synthetic
gtgtgaaaagcgggaactcctcgcggtgctgggtggcgctaacccccactgtggcggcgccttatctcaacgctc

SEQ ID NO: 132205 - DNA, 75 bp, Artificial Sequence
  Synthetic
attccgtcatctgctgttccatgtcgtattcctggactggggctttaatcaccccctgcagtccggaggaagaaa

SEQ ID NO: 132206 - DNA, 75 bp, Artificial Sequence
  Synthetic
gggccagctcttcaccttccggccgcgccgtcattggacaacccaggactgtaactgctctatctacacaggaca

SEQ ID NO: 132207 - DNA, 75 bp, Artificial Sequence
  Synthetic
agccggctcgcttaatcgtatacccggaccttggggtccgggtgtgtgagaagcgagcgctttttgatgtcactc

SEQ ID NO: 132208 - DNA, 75 bp, Artificial Sequence
  Synthetic
gaccttatcaccggcggtcattggggtatccttgtgggtgtcgcgtacttcagcatgcaaacgaattgggccaaa

SEQ ID NO: 132209 - DNA, 75 bp, Artificial Sequence
  Synthetic
ttttgacagggtgcagctacttgactcacactatgacacagtcttgaaggacgtcaagcttgccgcctccaaggt

SEQ ID NO: 132210 - DNA, 75 bp, Artificial Sequence
  Synthetic
ggccaacctcctgtggcggcaggagatgggcgggaacatcacccgcgtggagtcagagaacaaggtagtgattct

SEQ ID NO: 132211 - DNA, 75 bp, Artificial Sequence
  Synthetic
actgcccgaattcgagcatagtgtatgaggccgaccatcatatcatgcaccttccaggttgcgtgccctgtgtgg

SEQ ID NO: 132212 - DNA, 75 bp, Artificial Sequence
  Synthetic
gaccctgtcaccatactacaaagagttcctcgccaagctcatatggtggttgcaatatcttatcaccagagccga

SEQ ID NO: 132213 - DNA, 75 bp, Artificial Sequence
  Synthetic
ctttgtgggcgctggtttagctggcgccgccatcggcagtgttggactggggaaggttctcgtggacatccttgc

SEQ ID NO: 132214 - DNA, 75 bp, Artificial Sequence
  Synthetic
agcaacacgtggcatggaacattccccatcaacgcgtacaccacgggcccctgcacaccctccccggcgccaaac

SEQ ID NO: 132215 - DNA, 75 bp, Artificial Sequence
  Synthetic
cccttggccctcgacagaaactgcagcttatccacaccaacggaagctggcacatcaacaggaccgcactcaact

SEQ ID NO: 132216 - DNA, 75 bp, Artificial Sequence
  Synthetic
gaagaaggcagctcgcctcatcgtataccctgatcttggtgtcagggtctgcgagaagatggccctttatgacat

SEQ ID NO: 132217 - DNA, 75 bp, Artificial Sequence
  Synthetic
tggagattttccccagggccatgggcagcttaaagcagccactatcaacggctcctccgatgacaggccctactg

SEQ ID NO: 132218 - DNA, 75 bp, Artificial Sequence
  Synthetic
atgatgaactggagtccaacaaccaccttggttctcgcccaggtcatgaggatcccgagcactctggtagactta

SEQ ID NO: 132219 - DNA, 75 bp, Artificial Sequence
  Synthetic
cgagatccaatggggttctcatatgacacccgctgctttgactcaacagttactgaacgggacatcaggactgag

SEQ ID NO: 132220 - DNA, 75 bp, Artificial Sequence
  Synthetic
ggcctacgagaccttgcggtggcagttgagcccgtcgtcttctctgacatggagaccaaggtcatcacctggggg

SEQ ID NO: 132221 - DNA, 75 bp, Artificial Sequence
  Synthetic
gatcaccgcggccatcctacatataactggggggaaaatgagacagatgtgctcatcctcaactcgaccaggccc

SEQ ID NO: 132222 - DNA, 75 bp, Artificial Sequence
  Synthetic
ttgacgctgagacttacacatctgggggtgcggccgcccaaactacccgtggcttggttagcctatttggccctg

SEQ ID NO: 132223 - DNA, 75 bp, Artificial Sequence
  Synthetic
ggccctgccccactgactgcttcaggaaacatccagaaaccacctacatcaagtgtggttcagggccttggctta

SEQ ID NO: 132224 - DNA, 75 bp, Artificial Sequence
  Synthetic
cagtttgttctacacccacaggtttaacagctcaggatgccccgaacggctcgcaagttgcaagagccttgacac

SEQ ID NO: 132225 - DNA, 75 bp, Artificial Sequence
  Synthetic
tcgcaagttgcaagagccttgacacttttgaccaaggctggggcccacttggggttgctaacatcagtggctcgt

SEQ ID NO: 132226 - DNA, 75 bp, Artificial Sequence
  Synthetic
gcatcggctagaggcagcgtgcaactggactaggggggaacgctgcgaactggaggatagggaccgcgcggagct

SEQ ID NO: 132227 - DNA, 75 bp, Artificial Sequence
  Synthetic
attgttgacgtacaatacctctatggtgttgggtccgcagtggtgtcgtgggcacttaagtgggagtacattgtg

SEQ ID NO: 132228 - DNA, 75 bp, Artificial Sequence
  Synthetic
ctgtggcgctcctccatgcaaggtccaaacccataataaaacctgggactgccccaccgattgtttcaggaagca

SEQ ID NO: 132229 - DNA, 75 bp, Artificial Sequence
  Synthetic
cgcgtcccgggctcgaccccgctttttactcctgtgcctactcctactctccgtaggggtaggcattttcctgct

SEQ ID NO: 132230 - DNA, 75 bp, Artificial Sequence
  Synthetic
tcaacgcggcatcagccgcaagcacgcacggctttttctttgccattcttttcatctgtgcggcttggcatgtaa

SEQ ID NO: 132231 - DNA, 75 bp, Artificial Sequence
  Synthetic
ggagctggcagggtcccttggcggcggcattgccatcttgcttaccgtcataacattgtccccatattacaagtt

SEQ ID NO: 132232 - DNA, 75 bp, Artificial Sequence
  Synthetic
ggctcagcccgggtacccttggcccctctatggcaatgagggcatggggtgggcaggatggctcctgtcaccccg

SEQ ID NO: 132233 - DNA, 75 bp, Artificial Sequence
  Synthetic
gcttcttactccttagcctactcctactctgtgtgggggtaggcatctttttactccccgctcggtagagcggca

SEQ ID NO: 132234 - DNA, 75 bp, Artificial Sequence
  Synthetic
gattctatcatcattctcgcgattctcgtccaccctcacctgatctttgagattaccaagctcctcctggccatt

SEQ ID NO: 132235 - DNA, 75 bp, Artificial Sequence
  Synthetic
tctctgcttgcctgtggatgatgtttatggtatctcaagttgaggcagctctgtccaacctaatcaacatcaacg

SEQ ID NO: 132236 - DNA, 75 bp, Artificial Sequence
  Synthetic
tccaatgtgtcggtcgcgcacgatgcatctggcaaaagggtgtactacctcacccgtgaccccaccacccccctt

SEQ ID NO: 132237 - DNA, 75 bp, Artificial Sequence
  Synthetic
tgtgcggtaaatactgccagatggcacttcttaaagtgggctcttggacaggcacctacatctataatcacctca

SEQ ID NO: 132238 - DNA, 75 bp, Artificial Sequence
  Synthetic
tgctgacactgccgcgtgcggtgacatccttagaggtcttccggtgtcggccaggttaggcaatgagatcttgct

SEQ ID NO: 132239 - DNA, 75 bp, Artificial Sequence
  Synthetic
cacatcggttcaacgcgtccggatgtccagagcgcttggccagatgtcgccccattagtgagttcgaccagggtt

SEQ ID NO: 132240 - DNA, 75 bp, Artificial Sequence
  Synthetic
ggctagaggactatggtggattcaatattttatagctaggatcgaggccatggtgcatgtctacgttccatcctt

SEQ ID NO: 132241 - DNA, 75 bp, Artificial Sequence
  Synthetic
agcctcaccggcagagacaagaatgagaactgcggcgaggtccaggtgctatctacggttacgcagtccttcttg

SEQ ID NO: 132242 - DNA, 75 bp, Artificial Sequence
  Synthetic
cccctctacatactccagacctcgctcctacgcgtcccttactttgtgagggcacaagcgctgattaagatctgc

SEQ ID NO: 132243 - DNA, 75 bp, Artificial Sequence
  Synthetic
cccctctacatactccagacctcgctcctacgcgtcccttactttgtgagggcacatgcgctgattaagatctgc

SEQ ID NO: 132244 - DNA, 75 bp, Artificial Sequence
  Synthetic
cccctctacatactccagacctcgctcctacgcgtcccttactttgtgagggcacacgcgctgattaagatctgc

SEQ ID NO: 132245 - DNA, 75 bp, Artificial Sequence
  Synthetic
cccctctacatactccagacctcgctcctacgcgtcccttactttgtgagggcacaggcgctgattaagatctgc

SEQ ID NO: 132246 - DNA, 75 bp, Artificial Sequence
  Synthetic
tggcttgggatatgatgatgaactggtcacctacaacagccctagtagtatcgcagttactccggatcccacaag

SEQ ID NO: 132247 - DNA, 75 bp, Artificial Sequence
  Synthetic
ttgaccaagaccttgtggggtggcctgcgcctccgggagtcaagtctttggcaccgtgcaattgcggcgcgtcag

SEQ ID NO: 132248 - DNA, 75 bp, Artificial Sequence
  Synthetic
gccacgtctgcactcgtcaaccttttcaacgttggccccaagcaaaacatccagctgatcaacaccaacggcact

SEQ ID NO: 132249 - DNA, 75 bp, Artificial Sequence
  Synthetic
ccggttgtgttcacgcccatggagaagaaagtcatcacctggggcgctgacactgctgcgtgtggtgacatcata

SEQ ID NO: 132250 - DNA, 75 bp, Artificial Sequence
  Synthetic
ggggtcctcaggaggtccattgctctgccccttgagtcatgcagtcggcatattccgtgcggccgtatgtacccg

SEQ ID NO: 132251 - DNA, 75 bp, Artificial Sequence
  Synthetic
cagaggccctactgttggcactacgcacctcgaccgtgcggcattgtgcccgcgtcgcagatatgtggtccagtg

SEQ ID NO: 132252 - DNA, 75 bp, Artificial Sequence
  Synthetic
ctggcactaccccccaaagccttgtggtatcgtgccagcacggagcgtatgtggcccagtgtattgcttcactcc

SEQ ID NO: 132253 - DNA, 75 bp, Artificial Sequence
  Synthetic
cgggtgcccagagcgcatggccagctgccgctccatcgacaggttcgatcaggggtggggtcccatcacctacgc

SEQ ID NO: 132254 - DNA, 75 bp, Artificial Sequence
  Synthetic
gtggcccagtgtattgcttcactcccagccccgtggtggtgggaacgaccgacaagttgggcgcgcctacctaca

SEQ ID NO: 132255 - DNA, 75 bp, Artificial Sequence
  Synthetic
cagacttaccaggttgcccacttgcatgcaccgacgggtagcggcaagagcaccaaggtcccagccgcgtatgcg

SEQ ID NO: 132256 - DNA, 75 bp, Artificial Sequence
  Synthetic
gacaagttgggcgcgcctacctacaattggggtagcagtgataaggatgtcctcattcttaacaacaccaggcca

SEQ ID NO: 132257 - DNA, 75 bp, Artificial Sequence
  Synthetic
aatcaaatgtacaccaatgttgaccaagacatggtggggtggccagtgccttccggagtcaaatctcttgctccg

SEQ ID NO: 132258 - DNA, 75 bp, Artificial Sequence
  Synthetic
aatcaaatgtacaccaatgttgaccaagacatggtggggtggccagtgccttccggagtcaattctcttgctccg

SEQ ID NO: 132259 - DNA, 75 bp, Artificial Sequence
  Synthetic
aatcaaatgtacaccaatgttgaccaagacatggtggggtggccagtgccttccggagtcaactctcttgctccg

SEQ ID NO: 132260 - DNA, 75 bp, Artificial Sequence
  Synthetic
aatcaaatgtacaccaatgttgaccaagacatggtggggtggccagtgccttccggagtcaagtctcttgctccg

SEQ ID NO: 132261 - DNA, 75 bp, Artificial Sequence
  Synthetic
ggggccccccgtgtaacatcgggggggccggtaacaacaccttaacctgccccacggactgcttccgaaagcacc

SEQ ID NO: 132262 - DNA, 75 bp, Artificial Sequence
  Synthetic
ggtcaggtgtcaggaccatcaccaccggtgcgccgatcacatactccacctatgggaagttcctagcggatggag

SEQ ID NO: 132263 - DNA, 75 bp, Artificial Sequence
  Synthetic
gaccgctggagcgcgccttgtcgtgctcgcgactgctacgccaccagggtcggtgtctaccccccaccccaacat

SEQ ID NO: 132264 - DNA, 75 bp, Artificial Sequence
  Synthetic
agccaaagcagtggacttcgtcccagtcgaatctcttgagactactatgagatcaccagtgtttactgacaactc

SEQ ID NO: 132265 - DNA, 75 bp, Artificial Sequence
  Synthetic
tgccaaagcagtggacttcgtcccagtcgaatctcttgagactactatgagatcaccagtgtttactgacaactc

SEQ ID NO: 132266 - DNA, 75 bp, Artificial Sequence
  Synthetic
cgccaaagcagtggacttcgtcccagtcgaatctcttgagactactatgagatcaccagtgtttactgacaactc

SEQ ID NO: 132267 - DNA, 75 bp, Artificial Sequence
  Synthetic
ggccaaagcagtggacttcgtcccagtcgaatctcttgagactactatgagatcaccagtgtttactgacaactc

SEQ ID NO: 132268 - DNA, 75 bp, Artificial Sequence
  Synthetic
gttaccgccacgagcatacgccatggaccgggagatggctgcatcatgcggaggcgcggtttttgtaggtctggt

SEQ ID NO: 132269 - DNA, 75 bp, Artificial Sequence
  Synthetic
tccaaaaagaaatgtgatgagttggccaaacagttaacatctcttggccttaatgcggtcgccttttataggggc

SEQ ID NO: 132270 - DNA, 75 bp, Artificial Sequence
  Synthetic
ccgcatgcaactggactcgaggagagcgttgtgacttggaggacagggatagatcagagcttagcccgctgctgc

SEQ ID NO: 132271 - DNA, 75 bp, Artificial Sequence
  Synthetic
gccctgctccttcaccaccctaccggctctgtccactggtttaatccatctccatcagaacatcgtggacgtgca

SEQ ID NO: 132272 - DNA, 75 bp, Artificial Sequence
  Synthetic
gcaacacctccgtcgtgcagaccgtcgatttcagcctcgaccctacattttccatcgagaccacgacattgcctc

SEQ ID NO: 132273 - DNA, 75 bp, Artificial Sequence
  Synthetic
tgacacatcagtgctctgtgagtgctatgacaccgggtgtgcttggtacgaactgacaccggcagaaacaactgt

SEQ ID NO: 132274 - DNA, 75 bp, Artificial Sequence
  Synthetic
tccagctgatcaacaccaacggcagctggcacatcaatcgcacggccttgaattgcaatgcaagcctcgacactg

SEQ ID NO: 132275 - DNA, 75 bp, Artificial Sequence
  Synthetic
cattttttgtcccagaccaaacaagcaggtgaaaacttcccatacttgacagcctaccaggctacagtttgcgcg

SEQ ID NO: 132276 - DNA, 75 bp, Artificial Sequence
  Synthetic
ttgctcgttggggcggctgctttctgctccgctatgtacgtgggagatctctgcggatctgttttccttgtctcc

SEQ ID NO: 132277 - DNA, 75 bp, Artificial Sequence
  Synthetic
ccacaaattcaactcttcaggctgccccgagaggatggccagctgtagaccccttgccgatttcgaccagggctg

SEQ ID NO: 132278 - DNA, 75 bp, Artificial Sequence
  Synthetic
gggccgtgcagaacgaagtgtcgcttacccaccccataacaaaatacatcatggcctgcatgtcggctgacctcg

SEQ ID NO: 132279 - DNA, 75 bp, Artificial Sequence
  Synthetic
cccacgggctcattcgtgcatgcatgctggtgcggaaagtcgccgggggtcattatgtccaaatggctctcatga

SEQ ID NO: 132280 - DNA, 75 bp, Artificial Sequence
  Synthetic
gtgccgtacttcgtgcgcgctcaagggctcattcgtgcatgcatgttggtgcggaaagtcgctgggggtcattat

SEQ ID NO: 132281 - DNA, 75 bp, Artificial Sequence
  Synthetic
ggctcattcgtgcatgcatgttggtgcggaaagtcgctgggggtcattatgtccaaatggctttcatgaggctgg

SEQ ID NO: 132282 - DNA, 75 bp, Artificial Sequence
  Synthetic
cctatcagggcagcctgctgtcattcccgaccgggaggctctctaccagcagttcgacgaaatggaagagtgttc

SEQ ID NO: 132283 - DNA, 75 bp, Artificial Sequence
  Synthetic
agttcgacgaaatggaagagtgttccaaacacttaccaattgttgaacacggattgcagctggcggaacaattca

SEQ ID NO: 132284 - DNA, 75 bp, Artificial Sequence
  Synthetic
tgctctgcccctcggggcacgctgtaggcatcttccgggctgctgtatgcacccggggggttgccaaggcggtgg

SEQ ID NO: 132285 - DNA, 75 bp, Artificial Sequence
  Synthetic
cgcccatcacggcgtatgcccagcagacaaggggcctcttgggatgcataattaccagcctgaccggccgggaca

SEQ ID NO: 132286 - DNA, 75 bp, Artificial Sequence
  Synthetic
ctatcccagaccaaacaagcgggcgagaacttcccataccttgttgcctaccaggccacagtatgcgccagagct

SEQ ID NO: 132287 - DNA, 75 bp, Artificial Sequence
  Synthetic
ctatcccagaccaaacaagcgggcgagaacttcccataccttgttgcctaccaggccacagtttgcgccagagct

SEQ ID NO: 132288 - DNA, 75 bp, Artificial Sequence
  Synthetic
ctatcccagaccaaacaagcgggcgagaacttcccataccttgttgcctaccaggccacagtctgcgccagagct

SEQ ID NO: 132289 - DNA, 75 bp, Artificial Sequence
  Synthetic
ctatcccagaccaaacaagcgggcgagaacttcccataccttgttgcctaccaggccacagtgtgcgccagagct

SEQ ID NO: 132290 - DNA, 75 bp, Artificial Sequence
  Synthetic
aggccgggacaagaaccaggtcgagggggaggttcaagtggtttccaccgcaacacaatctttcctggcgacctg

SEQ ID NO: 132291 - DNA, 75 bp, Artificial Sequence
  Synthetic
aaagcatatgtggaatttcatcagcggcatccagtaccttgctggtttgtccaccttgcccggcaatcctgcgat

SEQ ID NO: 132292 - DNA, 75 bp, Artificial Sequence
  Synthetic
tgcatgtcagctgacctcgaggtagtgacgagcacgtgggtcttggtgggcggcgtcctggcagctctagctgct

SEQ ID NO: 132293 - DNA, 75 bp, Artificial Sequence
  Synthetic
gcaactcccaccgcctcgacggctttcgtcgtgagcggtctcgctgggacggcagtcggcagtgtaggcctgggt

SEQ ID NO: 132294 - DNA, 75 bp, Artificial Sequence
  Synthetic
gcaactcccaccgcctcgacggctttcgtcgtgagcggtctcgctgggtcggcagtcggcagtgtaggcctgggt

SEQ ID NO: 132295 - DNA, 75 bp, Artificial Sequence
  Synthetic
gcaactcccaccgcctcgacggctttcgtcgtgagcggtctcgctgggccggcagtcggcagtgtaggcctgggt

SEQ ID NO: 132296 - DNA, 75 bp, Artificial Sequence
  Synthetic
gcaactcccaccgcctcgacggctttcgtcgtgagcggtctcgctggggcggcagtcggcagtgtaggcctgggt

SEQ ID NO: 132297 - DNA, 75 bp, Artificial Sequence
  Synthetic
gtcgtggtggggacgaccgatcggttcggcgtccctacgtacagttggggggagaatgagacggacgtgctgctt

SEQ ID NO: 132298 - DNA, 75 bp, Artificial Sequence
  Synthetic
cgcgaggtgctctacaaacagttcgacgaaatggaggaatgttccaaacatcttccattagtcgagcatggaata

SEQ ID NO: 132299 - DNA, 75 bp, Artificial Sequence
  Synthetic
cgcgaggtgctctacaaacagttcgacgaaatggaggaatgttccaaacatcttccattagtcgagcatggatta

SEQ ID NO: 132300 - DNA, 75 bp, Artificial Sequence
  Synthetic
cgcgaggtgctctacaaacagttcgacgaaatggaggaatgttccaaacatcttccattagtcgagcatggacta

SEQ ID NO: 132301 - DNA, 75 bp, Artificial Sequence
  Synthetic
cgcgaggtgctctacaaacagttcgacgaaatggaggaatgttccaaacatcttccattagtcgagcatggagta

SEQ ID NO: 132302 - DNA, 75 bp, Artificial Sequence
  Synthetic
cgcgaggtgctctacaaacagttcgacgaaatggaggaatgttccaaacatcttcctttagtcgagcatggaata

SEQ ID NO: 132303 - DNA, 75 bp, Artificial Sequence
  Synthetic
cgcgaggtgctctacaaacagttcgacgaaatggaggaatgttccaaacatcttcctttagtcgagcatggatta

SEQ ID NO: 132304 - DNA, 75 bp, Artificial Sequence
  Synthetic
cgcgaggtgctctacaaacagttcgacgaaatggaggaatgttccaaacatcttcctttagtcgagcatggacta

SEQ ID NO: 132305 - DNA, 75 bp, Artificial Sequence
  Synthetic
cgcgaggtgctctacaaacagttcgacgaaatggaggaatgttccaaacatcttcctttagtcgagcatggagta

SEQ ID NO: 132306 - DNA, 75 bp, Artificial Sequence
  Synthetic
cgcgaggtgctctacaaacagttcgacgaaatggaggaatgttccaaacatcttcccttagtcgagcatggaata

SEQ ID NO: 132307 - DNA, 75 bp, Artificial Sequence
  Synthetic
cgcgaggtgctctacaaacagttcgacgaaatggaggaatgttccaaacatcttcccttagtcgagcatggatta

SEQ ID NO: 132308 - DNA, 75 bp, Artificial Sequence
  Synthetic
cgcgaggtgctctacaaacagttcgacgaaatggaggaatgttccaaacatcttcccttagtcgagcatggacta

SEQ ID NO: 132309 - DNA, 75 bp, Artificial Sequence
  Synthetic
cgcgaggtgctctacaaacagttcgacgaaatggaggaatgttccaaacatcttcccttagtcgagcatggagta

SEQ ID NO: 132310 - DNA, 75 bp, Artificial Sequence
  Synthetic
cgcgaggtgctctacaaacagttcgacgaaatggaggaatgttccaaacatcttccgttagtcgagcatggaata

SEQ ID NO: 132311 - DNA, 75 bp, Artificial Sequence
  Synthetic
cgcgaggtgctctacaaacagttcgacgaaatggaggaatgttccaaacatcttccgttagtcgagcatggatta

SEQ ID NO: 132312 - DNA, 75 bp, Artificial Sequence
  Synthetic
cgcgaggtgctctacaaacagttcgacgaaatggaggaatgttccaaacatcttccgttagtcgagcatggacta

SEQ ID NO: 132313 - DNA, 75 bp, Artificial Sequence
  Synthetic
cgcgaggtgctctacaaacagttcgacgaaatggaggaatgttccaaacatcttccgttagtcgagcatggagta

SEQ ID NO: 132314 - DNA, 75 bp, Artificial Sequence
  Synthetic
cgcgaggtgctctacaatcagttcgacgaaatggaggaatgttccaaacatcttccattagtcgagcatggaata

SEQ ID NO: 132315 - DNA, 75 bp, Artificial Sequence
  Synthetic
cgcgaggtgctctacaatcagttcgacgaaatggaggaatgttccaaacatcttccattagtcgagcatggatta

SEQ ID NO: 132316 - DNA, 75 bp, Artificial Sequence
  Synthetic
cgcgaggtgctctacaatcagttcgacgaaatggaggaatgttccaaacatcttccattagtcgagcatggacta

SEQ ID NO: 132317 - DNA, 75 bp, Artificial Sequence
  Synthetic
cgcgaggtgctctacaatcagttcgacgaaatggaggaatgttccaaacatcttccattagtcgagcatggagta

SEQ ID NO: 132318 - DNA, 75 bp, Artificial Sequence
  Synthetic
cgcgaggtgctctacaatcagttcgacgaaatggaggaatgttccaaacatcttcctttagtcgagcatggaata

SEQ ID NO: 132319 - DNA, 75 bp, Artificial Sequence
  Synthetic
cgcgaggtgctctacaatcagttcgacgaaatggaggaatgttccaaacatcttcctttagtcgagcatggatta

SEQ ID NO: 132320 - DNA, 75 bp, Artificial Sequence
  Synthetic
cgcgaggtgctctacaatcagttcgacgaaatggaggaatgttccaaacatcttcctttagtcgagcatggacta

SEQ ID NO: 132321 - DNA, 75 bp, Artificial Sequence
  Synthetic
cgcgaggtgctctacaatcagttcgacgaaatggaggaatgttccaaacatcttcctttagtcgagcatggagta

SEQ ID NO: 132322 - DNA, 75 bp, Artificial Sequence
  Synthetic
cgcgaggtgctctacaatcagttcgacgaaatggaggaatgttccaaacatcttcccttagtcgagcatggaata

SEQ ID NO: 132323 - DNA, 75 bp, Artificial Sequence
  Synthetic
cgcgaggtgctctacaatcagttcgacgaaatggaggaatgttccaaacatcttcccttagtcgagcatggatta

SEQ ID NO: 132324 - DNA, 75 bp, Artificial Sequence
  Synthetic
cgcgaggtgctctacaatcagttcgacgaaatggaggaatgttccaaacatcttcccttagtcgagcatggacta

SEQ ID NO: 132325 - DNA, 75 bp, Artificial Sequence
  Synthetic
cgcgaggtgctctacaatcagttcgacgaaatggaggaatgttccaaacatcttcccttagtcgagcatggagta

SEQ ID NO: 132326 - DNA, 75 bp, Artificial Sequence
  Synthetic
cgcgaggtgctctacaatcagttcgacgaaatggaggaatgttccaaacatcttccgttagtcgagcatggaata

SEQ ID NO: 132327 - DNA, 75 bp, Artificial Sequence
  Synthetic
cgcgaggtgctctacaatcagttcgacgaaatggaggaatgttccaaacatcttccgttagtcgagcatggatta

SEQ ID NO: 132328 - DNA, 75 bp, Artificial Sequence
  Synthetic
cgcgaggtgctctacaatcagttcgacgaaatggaggaatgttccaaacatcttccgttagtcgagcatggacta

SEQ ID NO: 132329 - DNA, 75 bp, Artificial Sequence
  Synthetic
cgcgaggtgctctacaatcagttcgacgaaatggaggaatgttccaaacatcttccgttagtcgagcatggagta

SEQ ID NO: 132330 - DNA, 75 bp, Artificial Sequence
  Synthetic
cgcgaggtgctctacaaccagttcgacgaaatggaggaatgttccaaacatcttccattagtcgagcatggaata

SEQ ID NO: 132331 - DNA, 75 bp, Artificial Sequence
  Synthetic
cgcgaggtgctctacaaccagttcgacgaaatggaggaatgttccaaacatcttccattagtcgagcatggatta

SEQ ID NO: 132332 - DNA, 75 bp, Artificial Sequence
  Synthetic
cgcgaggtgctctacaaccagttcgacgaaatggaggaatgttccaaacatcttccattagtcgagcatggacta

SEQ ID NO: 132333 - DNA, 75 bp, Artificial Sequence
  Synthetic
cgcgaggtgctctacaaccagttcgacgaaatggaggaatgttccaaacatcttccattagtcgagcatggagta

SEQ ID NO: 132334 - DNA, 75 bp, Artificial Sequence
  Synthetic
cgcgaggtgctctacaaccagttcgacgaaatggaggaatgttccaaacatcttcctttagtcgagcatggaata

SEQ ID NO: 132335 - DNA, 75 bp, Artificial Sequence
  Synthetic
cgcgaggtgctctacaaccagttcgacgaaatggaggaatgttccaaacatcttcctttagtcgagcatggatta

SEQ ID NO: 132336 - DNA, 75 bp, Artificial Sequence
  Synthetic
cgcgaggtgctctacaaccagttcgacgaaatggaggaatgttccaaacatcttcctttagtcgagcatggacta

SEQ ID NO: 132337 - DNA, 75 bp, Artificial Sequence
  Synthetic
cgcgaggtgctctacaaccagttcgacgaaatggaggaatgttccaaacatcttcctttagtcgagcatggagta

SEQ ID NO: 132338 - DNA, 75 bp, Artificial Sequence
  Synthetic
cgcgaggtgctctacaaccagttcgacgaaatggaggaatgttccaaacatcttcccttagtcgagcatggaata

SEQ ID NO: 132339 - DNA, 75 bp, Artificial Sequence
  Synthetic
cgcgaggtgctctacaaccagttcgacgaaatggaggaatgttccaaacatcttcccttagtcgagcatggatta

SEQ ID NO: 132340 - DNA, 75 bp, Artificial Sequence
  Synthetic
cgcgaggtgctctacaaccagttcgacgaaatggaggaatgttccaaacatcttcccttagtcgagcatggacta

SEQ ID NO: 132341 - DNA, 75 bp, Artificial Sequence
  Synthetic
cgcgaggtgctctacaaccagttcgacgaaatggaggaatgttccaaacatcttcccttagtcgagcatggagta

SEQ ID NO: 132342 - DNA, 75 bp, Artificial Sequence
  Synthetic
cgcgaggtgctctacaaccagttcgacgaaatggaggaatgttccaaacatcttccgttagtcgagcatggaata

SEQ ID NO: 132343 - DNA, 75 bp, Artificial Sequence
  Synthetic
cgcgaggtgctctacaaccagttcgacgaaatggaggaatgttccaaacatcttccgttagtcgagcatggatta

SEQ ID NO: 132344 - DNA, 75 bp, Artificial Sequence
  Synthetic
cgcgaggtgctctacaaccagttcgacgaaatggaggaatgttccaaacatcttccgttagtcgagcatggacta

SEQ ID NO: 132345 - DNA, 75 bp, Artificial Sequence
  Synthetic
cgcgaggtgctctacaaccagttcgacgaaatggaggaatgttccaaacatcttccgttagtcgagcatggagta

SEQ ID NO: 132346 - DNA, 75 bp, Artificial Sequence
  Synthetic
cgcgaggtgctctacaagcagttcgacgaaatggaggaatgttccaaacatcttccattagtcgagcatggaata

SEQ ID NO: 132347 - DNA, 75 bp, Artificial Sequence
  Synthetic
cgcgaggtgctctacaagcagttcgacgaaatggaggaatgttccaaacatcttccattagtcgagcatggatta

SEQ ID NO: 132348 - DNA, 75 bp, Artificial Sequence
  Synthetic
cgcgaggtgctctacaagcagttcgacgaaatggaggaatgttccaaacatcttccattagtcgagcatggacta

SEQ ID NO: 132349 - DNA, 75 bp, Artificial Sequence
  Synthetic
cgcgaggtgctctacaagcagttcgacgaaatggaggaatgttccaaacatcttccattagtcgagcatggagta

SEQ ID NO: 132350 - DNA, 75 bp, Artificial Sequence
  Synthetic
cgcgaggtgctctacaagcagttcgacgaaatggaggaatgttccaaacatcttcctttagtcgagcatggaata

SEQ ID NO: 132351 - DNA, 75 bp, Artificial Sequence
  Synthetic
cgcgaggtgctctacaagcagttcgacgaaatggaggaatgttccaaacatcttcctttagtcgagcatggatta

SEQ ID NO: 132352 - DNA, 75 bp, Artificial Sequence
  Synthetic
cgcgaggtgctctacaagcagttcgacgaaatggaggaatgttccaaacatcttcctttagtcgagcatggacta

SEQ ID NO: 132353 - DNA, 75 bp, Artificial Sequence
  Synthetic
cgcgaggtgctctacaagcagttcgacgaaatggaggaatgttccaaacatcttcctttagtcgagcatggagta

SEQ ID NO: 132354 - DNA, 75 bp, Artificial Sequence
  Synthetic
cgcgaggtgctctacaagcagttcgacgaaatggaggaatgttccaaacatcttcccttagtcgagcatggaata

SEQ ID NO: 132355 - DNA, 75 bp, Artificial Sequence
  Synthetic
cgcgaggtgctctacaagcagttcgacgaaatggaggaatgttccaaacatcttcccttagtcgagcatggatta

SEQ ID NO: 132356 - DNA, 75 bp, Artificial Sequence
  Synthetic
cgcgaggtgctctacaagcagttcgacgaaatggaggaatgttccaaacatcttcccttagtcgagcatggacta

SEQ ID NO: 132357 - DNA, 75 bp, Artificial Sequence
  Synthetic
cgcgaggtgctctacaagcagttcgacgaaatggaggaatgttccaaacatcttcccttagtcgagcatggagta

SEQ ID NO: 132358 - DNA, 75 bp, Artificial Sequence
  Synthetic
cgcgaggtgctctacaagcagttcgacgaaatggaggaatgttccaaacatcttccgttagtcgagcatggaata

SEQ ID NO: 132359 - DNA, 75 bp, Artificial Sequence
  Synthetic
cgcgaggtgctctacaagcagttcgacgaaatggaggaatgttccaaacatcttccgttagtcgagcatggatta

SEQ ID NO: 132360 - DNA, 75 bp, Artificial Sequence
  Synthetic
cgcgaggtgctctacaagcagttcgacgaaatggaggaatgttccaaacatcttccgttagtcgagcatggacta

SEQ ID NO: 132361 - DNA, 75 bp, Artificial Sequence
  Synthetic
cgcgaggtgctctacaagcagttcgacgaaatggaggaatgttccaaacatcttccgttagtcgagcatggagta

SEQ ID NO: 132362 - DNA, 75 bp, Artificial Sequence
  Synthetic
tagtgaacctactcccggccatactatcgcctggagctttagtagtgggcgtggtctgcgccgctattttgcggc

SEQ ID NO: 132363 - DNA, 75 bp, Artificial Sequence
  Synthetic
atcgcctggagctttagtagtgggcgtggtctgcgccgctattttgcggcgccatgtaggacccggcgaaggagc

SEQ ID NO: 132364 - DNA, 75 bp, Artificial Sequence
  Synthetic
gccattccaagaaaaagtgtgacgagctcgctgcaaaactgtcgggcctcggactcaatgctgtagcgtattacc

SEQ ID NO: 132365 - DNA, 75 bp, Artificial Sequence
  Synthetic
cctcatgtctttcactgcagccgtcacaagccctctgaccacccagcaaaccctcctgttaaaaatcgtaggggg

SEQ ID NO: 132366 - DNA, 75 bp, Artificial Sequence
  Synthetic
cctcatgtctttcactgcagccgtcacaagccctctgaccacccagcaaaccctcctgttaaatatcgtaggggg

SEQ ID NO: 132367 - DNA, 75 bp, Artificial Sequence
  Synthetic
cctcatgtctttcactgcagccgtcacaagccctctgaccacccagcaaaccctcctgttaaacatcgtaggggg

SEQ ID NO: 132368 - DNA, 75 bp, Artificial Sequence
  Synthetic
cctcatgtctttcactgcagccgtcacaagccctctgaccacccagcaaaccctcctgttaaagatcgtaggggg

SEQ ID NO: 132369 - DNA, 75 bp, Artificial Sequence
  Synthetic
cctcatgtctttcactgcagccgtcacaagccctctgaccacccagcaaaccctcctgtttaaaatcgtaggggg

SEQ ID NO: 132370 - DNA, 75 bp, Artificial Sequence
  Synthetic
cctcatgtctttcactgcagccgtcacaagccctctgaccacccagcaaaccctcctgtttaatatcgtaggggg

SEQ ID NO: 132371 - DNA, 75 bp, Artificial Sequence
  Synthetic
cctcatgtctttcactgcagccgtcacaagccctctgaccacccagcaaaccctcctgtttaacatcgtaggggg

SEQ ID NO: 132372 - DNA, 75 bp, Artificial Sequence
  Synthetic
cctcatgtctttcactgcagccgtcacaagccctctgaccacccagcaaaccctcctgtttaagatcgtaggggg

SEQ ID NO: 132373 - DNA, 75 bp, Artificial Sequence
  Synthetic
cctcatgtctttcactgcagccgtcacaagccctctgaccacccagcaaaccctcctgttcaaaatcgtaggggg

SEQ ID NO: 132374 - DNA, 75 bp, Artificial Sequence
  Synthetic
cctcatgtctttcactgcagccgtcacaagccctctgaccacccagcaaaccctcctgttcaatatcgtaggggg

SEQ ID NO: 132375 - DNA, 75 bp, Artificial Sequence
  Synthetic
cctcatgtctttcactgcagccgtcacaagccctctgaccacccagcaaaccctcctgttcaacatcgtaggggg

SEQ ID NO: 132376 - DNA, 75 bp, Artificial Sequence
  Synthetic
cctcatgtctttcactgcagccgtcacaagccctctgaccacccagcaaaccctcctgttcaagatcgtaggggg

SEQ ID NO: 132377 - DNA, 75 bp, Artificial Sequence
  Synthetic
cctcatgtctttcactgcagccgtcacaagccctctgaccacccagcaaaccctcctgttgaaaatcgtaggggg

SEQ ID NO: 132378 - DNA, 75 bp, Artificial Sequence
  Synthetic
cctcatgtctttcactgcagccgtcacaagccctctgaccacccagcaaaccctcctgttgaatatcgtaggggg

SEQ ID NO: 132379 - DNA, 75 bp, Artificial Sequence
  Synthetic
cctcatgtctttcactgcagccgtcacaagccctctgaccacccagcaaaccctcctgttgaacatcgtaggggg

SEQ ID NO: 132380 - DNA, 75 bp, Artificial Sequence
  Synthetic
cctcatgtctttcactgcagccgtcacaagccctctgaccacccagcaaaccctcctgttgaagatcgtaggggg

SEQ ID NO: 132381 - DNA, 75 bp, Artificial Sequence
  Synthetic
cctcatgtctttcactgctgccgtcacaagccctctgaccacccagcaaaccctcctgttaaaaatcgtaggggg

SEQ ID NO: 132382 - DNA, 75 bp, Artificial Sequence
  Synthetic
cctcatgtctttcactgctgccgtcacaagccctctgaccacccagcaaaccctcctgttaaatatcgtaggggg

SEQ ID NO: 132383 - DNA, 75 bp, Artificial Sequence
  Synthetic
cctcatgtctttcactgctgccgtcacaagccctctgaccacccagcaaaccctcctgttaaacatcgtaggggg

SEQ ID NO: 132384 - DNA, 75 bp, Artificial Sequence
  Synthetic
cctcatgtctttcactgctgccgtcacaagccctctgaccacccagcaaaccctcctgttaaagatcgtaggggg

SEQ ID NO: 132385 - DNA, 75 bp, Artificial Sequence
  Synthetic
cctcatgtctttcactgctgccgtcacaagccctctgaccacccagcaaaccctcctgtttaaaatcgtaggggg

SEQ ID NO: 132386 - DNA, 75 bp, Artificial Sequence
  Synthetic
cctcatgtctttcactgctgccgtcacaagccctctgaccacccagcaaaccctcctgtttaatatcgtaggggg

SEQ ID NO: 132387 - DNA, 75 bp, Artificial Sequence
  Synthetic
cctcatgtctttcactgctgccgtcacaagccctctgaccacccagcaaaccctcctgtttaacatcgtaggggg

SEQ ID NO: 132388 - DNA, 75 bp, Artificial Sequence
  Synthetic
cctcatgtctttcactgctgccgtcacaagccctctgaccacccagcaaaccctcctgtttaagatcgtaggggg

SEQ ID NO: 132389 - DNA, 75 bp, Artificial Sequence
  Synthetic
cctcatgtctttcactgctgccgtcacaagccctctgaccacccagcaaaccctcctgttcaaaatcgtaggggg

SEQ ID NO: 132390 - DNA, 75 bp, Artificial Sequence
  Synthetic
cctcatgtctttcactgctgccgtcacaagccctctgaccacccagcaaaccctcctgttcaatatcgtaggggg

SEQ ID NO: 132391 - DNA, 75 bp, Artificial Sequence
  Synthetic
cctcatgtctttcactgctgccgtcacaagccctctgaccacccagcaaaccctcctgttcaacatcgtaggggg

SEQ ID NO: 132392 - DNA, 75 bp, Artificial Sequence
  Synthetic
cctcatgtctttcactgctgccgtcacaagccctctgaccacccagcaaaccctcctgttcaagatcgtaggggg

SEQ ID NO: 132393 - DNA, 75 bp, Artificial Sequence
  Synthetic
cctcatgtctttcactgctgccgtcacaagccctctgaccacccagcaaaccctcctgttgaaaatcgtaggggg

SEQ ID NO: 132394 - DNA, 75 bp, Artificial Sequence
  Synthetic
cctcatgtctttcactgctgccgtcacaagccctctgaccacccagcaaaccctcctgttgaatatcgtaggggg

SEQ ID NO: 132395 - DNA, 75 bp, Artificial Sequence
  Synthetic
cctcatgtctttcactgctgccgtcacaagccctctgaccacccagcaaaccctcctgttgaacatcgtaggggg

SEQ ID NO: 132396 - DNA, 75 bp, Artificial Sequence
  Synthetic
cctcatgtctttcactgctgccgtcacaagccctctgaccacccagcaaaccctcctgttgaagatcgtaggggg

SEQ ID NO: 132397 - DNA, 75 bp, Artificial Sequence
  Synthetic
cctcatgtctttcactgccgccgtcacaagccctctgaccacccagcaaaccctcctgttaaaaatcgtaggggg

SEQ ID NO: 132398 - DNA, 75 bp, Artificial Sequence
  Synthetic
cctcatgtctttcactgccgccgtcacaagccctctgaccacccagcaaaccctcctgttaaatatcgtaggggg

SEQ ID NO: 132399 - DNA, 75 bp, Artificial Sequence
  Synthetic
cctcatgtctttcactgccgccgtcacaagccctctgaccacccagcaaaccctcctgttaaacatcgtaggggg

SEQ ID NO: 132400 - DNA, 75 bp, Artificial Sequence
  Synthetic
cctcatgtctttcactgccgccgtcacaagccctctgaccacccagcaaaccctcctgttaaagatcgtaggggg

SEQ ID NO: 132401 - DNA, 75 bp, Artificial Sequence
  Synthetic
cctcatgtctttcactgccgccgtcacaagccctctgaccacccagcaaaccctcctgtttaaaatcgtaggggg

SEQ ID NO: 132402 - DNA, 75 bp, Artificial Sequence
  Synthetic
cctcatgtctttcactgccgccgtcacaagccctctgaccacccagcaaaccctcctgtttaatatcgtaggggg

SEQ ID NO: 132403 - DNA, 75 bp, Artificial Sequence
  Synthetic
cctcatgtctttcactgccgccgtcacaagccctctgaccacccagcaaaccctcctgtttaacatcgtaggggg

SEQ ID NO: 132404 - DNA, 75 bp, Artificial Sequence
  Synthetic
cctcatgtctttcactgccgccgtcacaagccctctgaccacccagcaaaccctcctgtttaagatcgtaggggg

SEQ ID NO: 132405 - DNA, 75 bp, Artificial Sequence
  Synthetic
cctcatgtctttcactgccgccgtcacaagccctctgaccacccagcaaaccctcctgttcaaaatcgtaggggg

SEQ ID NO: 132406 - DNA, 75 bp, Artificial Sequence
  Synthetic
cctcatgtctttcactgccgccgtcacaagccctctgaccacccagcaaaccctcctgttcaatatcgtaggggg

SEQ ID NO: 132407 - DNA, 75 bp, Artificial Sequence
  Synthetic
cctcatgtctttcactgccgccgtcacaagccctctgaccacccagcaaaccctcctgttcaacatcgtaggggg

SEQ ID NO: 132408 - DNA, 75 bp, Artificial Sequence
  Synthetic
cctcatgtctttcactgccgccgtcacaagccctctgaccacccagcaaaccctcctgttcaagatcgtaggggg

SEQ ID NO: 132409 - DNA, 75 bp, Artificial Sequence
  Synthetic
cctcatgtctttcactgccgccgtcacaagccctctgaccacccagcaaaccctcctgttgaaaatcgtaggggg

SEQ ID NO: 132410 - DNA, 75 bp, Artificial Sequence
  Synthetic
cctcatgtctttcactgccgccgtcacaagccctctgaccacccagcaaaccctcctgttgaatatcgtaggggg

SEQ ID NO: 132411 - DNA, 75 bp, Artificial Sequence
  Synthetic
cctcatgtctttcactgccgccgtcacaagccctctgaccacccagcaaaccctcctgttgaacatcgtaggggg

SEQ ID NO: 132412 - DNA, 75 bp, Artificial Sequence
  Synthetic
cctcatgtctttcactgccgccgtcacaagccctctgaccacccagcaaaccctcctgttgaagatcgtaggggg

SEQ ID NO: 132413 - DNA, 75 bp, Artificial Sequence
  Synthetic
cctcatgtctttcactgcggccgtcacaagccctctgaccacccagcaaaccctcctgttaaaaatcgtaggggg

SEQ ID NO: 132414 - DNA, 75 bp, Artificial Sequence
  Synthetic
cctcatgtctttcactgcggccgtcacaagccctctgaccacccagcaaaccctcctgttaaatatcgtaggggg

SEQ ID NO: 132415 - DNA, 75 bp, Artificial Sequence
  Synthetic
cctcatgtctttcactgcggccgtcacaagccctctgaccacccagcaaaccctcctgttaaacatcgtaggggg

SEQ ID NO: 132416 - DNA, 75 bp, Artificial Sequence
  Synthetic
cctcatgtctttcactgcggccgtcacaagccctctgaccacccagcaaaccctcctgttaaagatcgtaggggg

SEQ ID NO: 132417 - DNA, 75 bp, Artificial Sequence
  Synthetic
cctcatgtctttcactgcggccgtcacaagccctctgaccacccagcaaaccctcctgtttaaaatcgtaggggg

SEQ ID NO: 132418 - DNA, 75 bp, Artificial Sequence
  Synthetic
cctcatgtctttcactgcggccgtcacaagccctctgaccacccagcaaaccctcctgtttaatatcgtaggggg

SEQ ID NO: 132419 - DNA, 75 bp, Artificial Sequence
  Synthetic
cctcatgtctttcactgcggccgtcacaagccctctgaccacccagcaaaccctcctgtttaacatcgtaggggg

SEQ ID NO: 132420 - DNA, 75 bp, Artificial Sequence
  Synthetic
cctcatgtctttcactgcggccgtcacaagccctctgaccacccagcaaaccctcctgtttaagatcgtaggggg

SEQ ID NO: 132421 - DNA, 75 bp, Artificial Sequence
  Synthetic
cctcatgtctttcactgcggccgtcacaagccctctgaccacccagcaaaccctcctgttcaaaatcgtaggggg

SEQ ID NO: 132422 - DNA, 75 bp, Artificial Sequence
  Synthetic
cctcatgtctttcactgcggccgtcacaagccctctgaccacccagcaaaccctcctgttcaatatcgtaggggg

SEQ ID NO: 132423 - DNA, 75 bp, Artificial Sequence
  Synthetic
cctcatgtctttcactgcggccgtcacaagccctctgaccacccagcaaaccctcctgttcaacatcgtaggggg

SEQ ID NO: 132424 - DNA, 75 bp, Artificial Sequence
  Synthetic
cctcatgtctttcactgcggccgtcacaagccctctgaccacccagcaaaccctcctgttcaagatcgtaggggg

SEQ ID NO: 132425 - DNA, 75 bp, Artificial Sequence
  Synthetic
cctcatgtctttcactgcggccgtcacaagccctctgaccacccagcaaaccctcctgttgaaaatcgtaggggg

SEQ ID NO: 132426 - DNA, 75 bp, Artificial Sequence
  Synthetic
cctcatgtctttcactgcggccgtcacaagccctctgaccacccagcaaaccctcctgttgaatatcgtaggggg

SEQ ID NO: 132427 - DNA, 75 bp, Artificial Sequence
  Synthetic
cctcatgtctttcactgcggccgtcacaagccctctgaccacccagcaaaccctcctgttgaacatcgtaggggg

SEQ ID NO: 132428 - DNA, 75 bp, Artificial Sequence
  Synthetic
cctcatgtctttcactgcggccgtcacaagccctctgaccacccagcaaaccctcctgttgaagatcgtaggggg

SEQ ID NO: 132429 - DNA, 75 bp, Artificial Sequence
  Synthetic
ccggcatccccttcctctcctgtcagagaggttacaagggggaatggcgaggcgacggggtaatgcataccacct

SEQ ID NO: 132430 - DNA, 75 bp, Artificial Sequence
  Synthetic
gcgcgacgctgtcatcctactcatgtgtgttgtacacccggccttggtatttgacatcaccaagctgctgctggc

SEQ ID NO: 132431 - DNA, 75 bp, Artificial Sequence
  Synthetic
ttagtggaaatactcgccggttacggcgcaggcgtagctggcgctgtggttacattcaagatcatgagcggcgag

SEQ ID NO: 132432 - DNA, 75 bp, Artificial Sequence
  Synthetic
ttagtggaaatactcgccggttacggcgcaggcgtagctggcgctgtggttactttcaagatcatgagcggcgag

SEQ ID NO: 132433 - DNA, 75 bp, Artificial Sequence
  Synthetic
ttagtggaaatactcgccggttacggcgcaggcgtagctggcgctgtggttaccttcaagatcatgagcggcgag

SEQ ID NO: 132434 - DNA, 75 bp, Artificial Sequence
  Synthetic
ttagtggaaatactcgccggttacggcgcaggcgtagctggcgctgtggttacgttcaagatcatgagcggcgag

SEQ ID NO: 132435 - DNA, 75 bp, Artificial Sequence
  Synthetic
ttagtggaaatactcgccggttacggcgctggcgtagctggcgctgtggttacattcaagatcatgagcggcgag

SEQ ID NO: 132436 - DNA, 75 bp, Artificial Sequence
  Synthetic
ttagtggaaatactcgccggttacggcgctggcgtagctggcgctgtggttactttcaagatcatgagcggcgag

SEQ ID NO: 132437 - DNA, 75 bp, Artificial Sequence
  Synthetic
ttagtggaaatactcgccggttacggcgctggcgtagctggcgctgtggttaccttcaagatcatgagcggcgag

SEQ ID NO: 132438 - DNA, 75 bp, Artificial Sequence
  Synthetic
ttagtggaaatactcgccggttacggcgctggcgtagctggcgctgtggttacgttcaagatcatgagcggcgag

SEQ ID NO: 132439 - DNA, 75 bp, Artificial Sequence
  Synthetic
ttagtggaaatactcgccggttacggcgccggcgtagctggcgctgtggttacattcaagatcatgagcggcgag

SEQ ID NO: 132440 - DNA, 75 bp, Artificial Sequence
  Synthetic
ttagtggaaatactcgccggttacggcgccggcgtagctggcgctgtggttactttcaagatcatgagcggcgag

SEQ ID NO: 132441 - DNA, 75 bp, Artificial Sequence
  Synthetic
ttagtggaaatactcgccggttacggcgccggcgtagctggcgctgtggttaccttcaagatcatgagcggcgag

SEQ ID NO: 132442 - DNA, 75 bp, Artificial Sequence
  Synthetic
ttagtggaaatactcgccggttacggcgccggcgtagctggcgctgtggttacgttcaagatcatgagcggcgag

SEQ ID NO: 132443 - DNA, 75 bp, Artificial Sequence
  Synthetic
ttagtggaaatactcgccggttacggcgcgggcgtagctggcgctgtggttacattcaagatcatgagcggcgag

SEQ ID NO: 132444 - DNA, 75 bp, Artificial Sequence
  Synthetic
ttagtggaaatactcgccggttacggcgcgggcgtagctggcgctgtggttactttcaagatcatgagcggcgag

SEQ ID NO: 132445 - DNA, 75 bp, Artificial Sequence
  Synthetic
ttagtggaaatactcgccggttacggcgcgggcgtagctggcgctgtggttaccttcaagatcatgagcggcgag

SEQ ID NO: 132446 - DNA, 75 bp, Artificial Sequence
  Synthetic
ttagtggaaatactcgccggttacggcgcgggcgtagctggcgctgtggttacgttcaagatcatgagcggcgag

SEQ ID NO: 132447 - DNA, 75 bp, Artificial Sequence
  Synthetic
ttagtggatatactcgccggttacggcgcaggcgtagctggcgctgtggttacattcaagatcatgagcggcgag

SEQ ID NO: 132448 - DNA, 75 bp, Artificial Sequence
  Synthetic
ttagtggatatactcgccggttacggcgcaggcgtagctggcgctgtggttactttcaagatcatgagcggcgag

SEQ ID NO: 132449 - DNA, 75 bp, Artificial Sequence
  Synthetic
ttagtggatatactcgccggttacggcgcaggcgtagctggcgctgtggttaccttcaagatcatgagcggcgag

SEQ ID NO: 132450 - DNA, 75 bp, Artificial Sequence
  Synthetic
ttagtggatatactcgccggttacggcgcaggcgtagctggcgctgtggttacgttcaagatcatgagcggcgag

SEQ ID NO: 132451 - DNA, 75 bp, Artificial Sequence
  Synthetic
ttagtggatatactcgccggttacggcgctggcgtagctggcgctgtggttacattcaagatcatgagcggcgag

SEQ ID NO: 132452 - DNA, 75 bp, Artificial Sequence
  Synthetic
ttagtggatatactcgccggttacggcgctggcgtagctggcgctgtggttactttcaagatcatgagcggcgag

SEQ ID NO: 132453 - DNA, 75 bp, Artificial Sequence
  Synthetic
ttagtggatatactcgccggttacggcgctggcgtagctggcgctgtggttaccttcaagatcatgagcggcgag

SEQ ID NO: 132454 - DNA, 75 bp, Artificial Sequence
  Synthetic
ttagtggatatactcgccggttacggcgctggcgtagctggcgctgtggttacgttcaagatcatgagcggcgag

SEQ ID NO: 132455 - DNA, 75 bp, Artificial Sequence
  Synthetic
ttagtggatatactcgccggttacggcgccggcgtagctggcgctgtggttacattcaagatcatgagcggcgag

SEQ ID NO: 132456 - DNA, 75 bp, Artificial Sequence
  Synthetic
ttagtggatatactcgccggttacggcgccggcgtagctggcgctgtggttactttcaagatcatgagcggcgag

SEQ ID NO: 132457 - DNA, 75 bp, Artificial Sequence
  Synthetic
ttagtggatatactcgccggttacggcgccggcgtagctggcgctgtggttaccttcaagatcatgagcggcgag

SEQ ID NO: 132458 - DNA, 75 bp, Artificial Sequence
  Synthetic
ttagtggatatactcgccggttacggcgccggcgtagctggcgctgtggttacgttcaagatcatgagcggcgag

SEQ ID NO: 132459 - DNA, 75 bp, Artificial Sequence
  Synthetic
ttagtggatatactcgccggttacggcgcgggcgtagctggcgctgtggttacattcaagatcatgagcggcgag

SEQ ID NO: 132460 - DNA, 75 bp, Artificial Sequence
  Synthetic
ttagtggatatactcgccggttacggcgcgggcgtagctggcgctgtggttactttcaagatcatgagcggcgag

SEQ ID NO: 132461 - DNA, 75 bp, Artificial Sequence
  Synthetic
ttagtggatatactcgccggttacggcgcgggcgtagctggcgctgtggttaccttcaagatcatgagcggcgag

SEQ ID NO: 132462 - DNA, 75 bp, Artificial Sequence
  Synthetic
ttagtggatatactcgccggttacggcgcgggcgtagctggcgctgtggttacgttcaagatcatgagcggcgag

SEQ ID NO: 132463 - DNA, 75 bp, Artificial Sequence
  Synthetic
ttagtggacatactcgccggttacggcgcaggcgtagctggcgctgtggttacattcaagatcatgagcggcgag

SEQ ID NO: 132464 - DNA, 75 bp, Artificial Sequence
  Synthetic
ttagtggacatactcgccggttacggcgcaggcgtagctggcgctgtggttactttcaagatcatgagcggcgag

SEQ ID NO: 132465 - DNA, 75 bp, Artificial Sequence
  Synthetic
ttagtggacatactcgccggttacggcgcaggcgtagctggcgctgtggttaccttcaagatcatgagcggcgag

SEQ ID NO: 132466 - DNA, 75 bp, Artificial Sequence
  Synthetic
ttagtggacatactcgccggttacggcgcaggcgtagctggcgctgtggttacgttcaagatcatgagcggcgag

SEQ ID NO: 132467 - DNA, 75 bp, Artificial Sequence
  Synthetic
ttagtggacatactcgccggttacggcgctggcgtagctggcgctgtggttacattcaagatcatgagcggcgag

SEQ ID NO: 132468 - DNA, 75 bp, Artificial Sequence
  Synthetic
ttagtggacatactcgccggttacggcgctggcgtagctggcgctgtggttactttcaagatcatgagcggcgag

SEQ ID NO: 132469 - DNA, 75 bp, Artificial Sequence
  Synthetic
ttagtggacatactcgccggttacggcgctggcgtagctggcgctgtggttaccttcaagatcatgagcggcgag

SEQ ID NO: 132470 - DNA, 75 bp, Artificial Sequence
  Synthetic
ttagtggacatactcgccggttacggcgctggcgtagctggcgctgtggttacgttcaagatcatgagcggcgag

SEQ ID NO: 132471 - DNA, 75 bp, Artificial Sequence
  Synthetic
ttagtggacatactcgccggttacggcgccggcgtagctggcgctgtggttacattcaagatcatgagcggcgag

SEQ ID NO: 132472 - DNA, 75 bp, Artificial Sequence
  Synthetic
ttagtggacatactcgccggttacggcgccggcgtagctggcgctgtggttactttcaagatcatgagcggcgag

SEQ ID NO: 132473 - DNA, 75 bp, Artificial Sequence
  Synthetic
ttagtggacatactcgccggttacggcgccggcgtagctggcgctgtggttaccttcaagatcatgagcggcgag

SEQ ID NO: 132474 - DNA, 75 bp, Artificial Sequence
  Synthetic
ttagtggacatactcgccggttacggcgccggcgtagctggcgctgtggttacgttcaagatcatgagcggcgag

SEQ ID NO: 132475 - DNA, 75 bp, Artificial Sequence
  Synthetic
ttagtggacatactcgccggttacggcgcgggcgtagctggcgctgtggttacattcaagatcatgagcggcgag

SEQ ID NO: 132476 - DNA, 75 bp, Artificial Sequence
  Synthetic
ttagtggacatactcgccggttacggcgcgggcgtagctggcgctgtggttactttcaagatcatgagcggcgag

SEQ ID NO: 132477 - DNA, 75 bp, Artificial Sequence
  Synthetic
ttagtggacatactcgccggttacggcgcgggcgtagctggcgctgtggttaccttcaagatcatgagcggcgag

SEQ ID NO: 132478 - DNA, 75 bp, Artificial Sequence
  Synthetic
ttagtggacatactcgccggttacggcgcgggcgtagctggcgctgtggttacgttcaagatcatgagcggcgag

SEQ ID NO: 132479 - DNA, 75 bp, Artificial Sequence
  Synthetic
ttagtggagatactcgccggttacggcgcaggcgtagctggcgctgtggttacattcaagatcatgagcggcgag

SEQ ID NO: 132480 - DNA, 75 bp, Artificial Sequence
  Synthetic
ttagtggagatactcgccggttacggcgcaggcgtagctggcgctgtggttactttcaagatcatgagcggcgag

SEQ ID NO: 132481 - DNA, 75 bp, Artificial Sequence
  Synthetic
ttagtggagatactcgccggttacggcgcaggcgtagctggcgctgtggttaccttcaagatcatgagcggcgag

SEQ ID NO: 132482 - DNA, 75 bp, Artificial Sequence
  Synthetic
ttagtggagatactcgccggttacggcgcaggcgtagctggcgctgtggttacgttcaagatcatgagcggcgag

SEQ ID NO: 132483 - DNA, 75 bp, Artificial Sequence
  Synthetic
ttagtggagatactcgccggttacggcgctggcgtagctggcgctgtggttacattcaagatcatgagcggcgag

SEQ ID NO: 132484 - DNA, 75 bp, Artificial Sequence
  Synthetic
ttagtggagatactcgccggttacggcgctggcgtagctggcgctgtggttactttcaagatcatgagcggcgag

SEQ ID NO: 132485 - DNA, 75 bp, Artificial Sequence
  Synthetic
ttagtggagatactcgccggttacggcgctggcgtagctggcgctgtggttaccttcaagatcatgagcggcgag

SEQ ID NO: 132486 - DNA, 75 bp, Artificial Sequence
  Synthetic
ttagtggagatactcgccggttacggcgctggcgtagctggcgctgtggttacgttcaagatcatgagcggcgag

SEQ ID NO: 132487 - DNA, 75 bp, Artificial Sequence
  Synthetic
ttagtggagatactcgccggttacggcgccggcgtagctggcgctgtggttacattcaagatcatgagcggcgag

SEQ ID NO: 132488 - DNA, 75 bp, Artificial Sequence
  Synthetic
ttagtggagatactcgccggttacggcgccggcgtagctggcgctgtggttactttcaagatcatgagcggcgag

SEQ ID NO: 132489 - DNA, 75 bp, Artificial Sequence
  Synthetic
ttagtggagatactcgccggttacggcgccggcgtagctggcgctgtggttaccttcaagatcatgagcggcgag

SEQ ID NO: 132490 - DNA, 75 bp, Artificial Sequence
  Synthetic
ttagtggagatactcgccggttacggcgccggcgtagctggcgctgtggttacgttcaagatcatgagcggcgag

SEQ ID NO: 132491 - DNA, 75 bp, Artificial Sequence
  Synthetic
ttagtggagatactcgccggttacggcgcgggcgtagctggcgctgtggttacattcaagatcatgagcggcgag

SEQ ID NO: 132492 - DNA, 75 bp, Artificial Sequence
  Synthetic
ttagtggagatactcgccggttacggcgcgggcgtagctggcgctgtggttactttcaagatcatgagcggcgag

SEQ ID NO: 132493 - DNA, 75 bp, Artificial Sequence
  Synthetic
ttagtggagatactcgccggttacggcgcgggcgtagctggcgctgtggttaccttcaagatcatgagcggcgag

SEQ ID NO: 132494 - DNA, 75 bp, Artificial Sequence
  Synthetic
ttagtggagatactcgccggttacggcgcgggcgtagctggcgctgtggttacgttcaagatcatgagcggcgag

SEQ ID NO: 132495 - DNA, 75 bp, Artificial Sequence
  Synthetic
gcgccggcgtagctggcgctgtggttacattgaagatcatgagcggcgagatgccatccacagaggacttagtaa

SEQ ID NO: 132496 - DNA, 75 bp, Artificial Sequence
  Synthetic
gcgccggcgtagctggcgctgtggttacattgaagatcatgagcggcgagatgccatccacagaggacttagtta

SEQ ID NO: 132497 - DNA, 75 bp, Artificial Sequence
  Synthetic
gcgccggcgtagctggcgctgtggttacattgaagatcatgagcggcgagatgccatccacagaggacttagtca

SEQ ID NO: 132498 - DNA, 75 bp, Artificial Sequence
  Synthetic
gcgccggcgtagctggcgctgtggttacattgaagatcatgagcggcgagatgccatccacagaggacttagtga

SEQ ID NO: 132499 - DNA, 75 bp, Artificial Sequence
  Synthetic
gcgccggcgtagctggcgctgtggttacattgaagatcatgagcggcgagttgccatccacagaggacttagtaa

SEQ ID NO: 132500 - DNA, 75 bp, Artificial Sequence
  Synthetic
gcgccggcgtagctggcgctgtggttacattgaagatcatgagcggcgagttgccatccacagaggacttagtta

SEQ ID NO: 132501 - DNA, 75 bp, Artificial Sequence
  Synthetic
gcgccggcgtagctggcgctgtggttacattgaagatcatgagcggcgagttgccatccacagaggacttagtca

SEQ ID NO: 132502 - DNA, 75 bp, Artificial Sequence
  Synthetic
gcgccggcgtagctggcgctgtggttacattgaagatcatgagcggcgagttgccatccacagaggacttagtga

SEQ ID NO: 132503 - DNA, 75 bp, Artificial Sequence
  Synthetic
gcgccggcgtagctggcgctgtggttacattgaagatcatgagcggcgagctgccatccacagaggacttagtaa

SEQ ID NO: 132504 - DNA, 75 bp, Artificial Sequence
  Synthetic
gcgccggcgtagctggcgctgtggttacattgaagatcatgagcggcgagctgccatccacagaggacttagtta

SEQ ID NO: 132505 - DNA, 75 bp, Artificial Sequence
  Synthetic
gcgccggcgtagctggcgctgtggttacattgaagatcatgagcggcgagctgccatccacagaggacttagtca

SEQ ID NO: 132506 - DNA, 75 bp, Artificial Sequence
  Synthetic
gcgccggcgtagctggcgctgtggttacattgaagatcatgagcggcgagctgccatccacagaggacttagtga

SEQ ID NO: 132507 - DNA, 75 bp, Artificial Sequence
  Synthetic
gcgccggcgtagctggcgctgtggttacattgaagatcatgagcggcgaggtgccatccacagaggacttagtaa

SEQ ID NO: 132508 - DNA, 75 bp, Artificial Sequence
  Synthetic
gcgccggcgtagctggcgctgtggttacattgaagatcatgagcggcgaggtgccatccacagaggacttagtta

SEQ ID NO: 132509 - DNA, 75 bp, Artificial Sequence
  Synthetic
gcgccggcgtagctggcgctgtggttacattgaagatcatgagcggcgaggtgccatccacagaggacttagtca

SEQ ID NO: 132510 - DNA, 75 bp, Artificial Sequence
  Synthetic
gcgccggcgtagctggcgctgtggttacattgaagatcatgagcggcgaggtgccatccacagaggacttagtga

SEQ ID NO: 132511 - DNA, 75 bp, Artificial Sequence
  Synthetic
gcgccggcgtagctggcgctgtggttactttgaagatcatgagcggcgagatgccatccacagaggacttagtaa

SEQ ID NO: 132512 - DNA, 75 bp, Artificial Sequence
  Synthetic
gcgccggcgtagctggcgctgtggttactttgaagatcatgagcggcgagatgccatccacagaggacttagtta

SEQ ID NO: 132513 - DNA, 75 bp, Artificial Sequence
  Synthetic
gcgccggcgtagctggcgctgtggttactttgaagatcatgagcggcgagatgccatccacagaggacttagtca

SEQ ID NO: 132514 - DNA, 75 bp, Artificial Sequence
  Synthetic
gcgccggcgtagctggcgctgtggttactttgaagatcatgagcggcgagatgccatccacagaggacttagtga

SEQ ID NO: 132515 - DNA, 75 bp, Artificial Sequence
  Synthetic
gcgccggcgtagctggcgctgtggttactttgaagatcatgagcggcgagttgccatccacagaggacttagtaa

SEQ ID NO: 132516 - DNA, 75 bp, Artificial Sequence
  Synthetic
gcgccggcgtagctggcgctgtggttactttgaagatcatgagcggcgagttgccatccacagaggacttagtta

SEQ ID NO: 132517 - DNA, 75 bp, Artificial Sequence
  Synthetic
gcgccggcgtagctggcgctgtggttactttgaagatcatgagcggcgagttgccatccacagaggacttagtca

SEQ ID NO: 132518 - DNA, 75 bp, Artificial Sequence
  Synthetic
gcgccggcgtagctggcgctgtggttactttgaagatcatgagcggcgagttgccatccacagaggacttagtga

SEQ ID NO: 132519 - DNA, 75 bp, Artificial Sequence
  Synthetic
gcgccggcgtagctggcgctgtggttactttgaagatcatgagcggcgagctgccatccacagaggacttagtaa

SEQ ID NO: 132520 - DNA, 75 bp, Artificial Sequence
  Synthetic
gcgccggcgtagctggcgctgtggttactttgaagatcatgagcggcgagctgccatccacagaggacttagtta

SEQ ID NO: 132521 - DNA, 75 bp, Artificial Sequence
  Synthetic
gcgccggcgtagctggcgctgtggttactttgaagatcatgagcggcgagctgccatccacagaggacttagtca

SEQ ID NO: 132522 - DNA, 75 bp, Artificial Sequence
  Synthetic
gcgccggcgtagctggcgctgtggttactttgaagatcatgagcggcgagctgccatccacagaggacttagtga

SEQ ID NO: 132523 - DNA, 75 bp, Artificial Sequence
  Synthetic
gcgccggcgtagctggcgctgtggttactttgaagatcatgagcggcgaggtgccatccacagaggacttagtaa

SEQ ID NO: 132524 - DNA, 75 bp, Artificial Sequence
  Synthetic
gcgccggcgtagctggcgctgtggttactttgaagatcatgagcggcgaggtgccatccacagaggacttagtta

SEQ ID NO: 132525 - DNA, 75 bp, Artificial Sequence
  Synthetic
gcgccggcgtagctggcgctgtggttactttgaagatcatgagcggcgaggtgccatccacagaggacttagtca

SEQ ID NO: 132526 - DNA, 75 bp, Artificial Sequence
  Synthetic
gcgccggcgtagctggcgctgtggttactttgaagatcatgagcggcgaggtgccatccacagaggacttagtga

SEQ ID NO: 132527 - DNA, 75 bp, Artificial Sequence
  Synthetic
gcgccggcgtagctggcgctgtggttaccttgaagatcatgagcggcgagatgccatccacagaggacttagtaa

SEQ ID NO: 132528 - DNA, 75 bp, Artificial Sequence
  Synthetic
gcgccggcgtagctggcgctgtggttaccttgaagatcatgagcggcgagatgccatccacagaggacttagtta

SEQ ID NO: 132529 - DNA, 75 bp, Artificial Sequence
  Synthetic
gcgccggcgtagctggcgctgtggttaccttgaagatcatgagcggcgagatgccatccacagaggacttagtca

SEQ ID NO: 132530 - DNA, 75 bp, Artificial Sequence
  Synthetic
gcgccggcgtagctggcgctgtggttaccttgaagatcatgagcggcgagatgccatccacagaggacttagtga

SEQ ID NO: 132531 - DNA, 75 bp, Artificial Sequence
  Synthetic
gcgccggcgtagctggcgctgtggttaccttgaagatcatgagcggcgagttgccatccacagaggacttagtaa

SEQ ID NO: 132532 - DNA, 75 bp, Artificial Sequence
  Synthetic
gcgccggcgtagctggcgctgtggttaccttgaagatcatgagcggcgagttgccatccacagaggacttagtta

SEQ ID NO: 132533 - DNA, 75 bp, Artificial Sequence
  Synthetic
gcgccggcgtagctggcgctgtggttaccttgaagatcatgagcggcgagttgccatccacagaggacttagtca

SEQ ID NO: 132534 - DNA, 75 bp, Artificial Sequence
  Synthetic
gcgccggcgtagctggcgctgtggttaccttgaagatcatgagcggcgagttgccatccacagaggacttagtga

SEQ ID NO: 132535 - DNA, 75 bp, Artificial Sequence
  Synthetic
gcgccggcgtagctggcgctgtggttaccttgaagatcatgagcggcgagctgccatccacagaggacttagtaa

SEQ ID NO: 132536 - DNA, 75 bp, Artificial Sequence
  Synthetic
gcgccggcgtagctggcgctgtggttaccttgaagatcatgagcggcgagctgccatccacagaggacttagtta

SEQ ID NO: 132537 - DNA, 75 bp, Artificial Sequence
  Synthetic
gcgccggcgtagctggcgctgtggttaccttgaagatcatgagcggcgagctgccatccacagaggacttagtca

SEQ ID NO: 132538 - DNA, 75 bp, Artificial Sequence
  Synthetic
gcgccggcgtagctggcgctgtggttaccttgaagatcatgagcggcgagctgccatccacagaggacttagtga

SEQ ID NO: 132539 - DNA, 75 bp, Artificial Sequence
  Synthetic
gcgccggcgtagctggcgctgtggttaccttgaagatcatgagcggcgaggtgccatccacagaggacttagtaa

SEQ ID NO: 132540 - DNA, 75 bp, Artificial Sequence
  Synthetic
gcgccggcgtagctggcgctgtggttaccttgaagatcatgagcggcgaggtgccatccacagaggacttagtta

SEQ ID NO: 132541 - DNA, 75 bp, Artificial Sequence
  Synthetic
gcgccggcgtagctggcgctgtggttaccttgaagatcatgagcggcgaggtgccatccacagaggacttagtca

SEQ ID NO: 132542 - DNA, 75 bp, Artificial Sequence
  Synthetic
gcgccggcgtagctggcgctgtggttaccttgaagatcatgagcggcgaggtgccatccacagaggacttagtga

SEQ ID NO: 132543 - DNA, 75 bp, Artificial Sequence
  Synthetic
gcgccggcgtagctggcgctgtggttacgttgaagatcatgagcggcgagatgccatccacagaggacttagtaa

SEQ ID NO: 132544 - DNA, 75 bp, Artificial Sequence
  Synthetic
gcgccggcgtagctggcgctgtggttacgttgaagatcatgagcggcgagatgccatccacagaggacttagtta

SEQ ID NO: 132545 - DNA, 75 bp, Artificial Sequence
  Synthetic
gcgccggcgtagctggcgctgtggttacgttgaagatcatgagcggcgagatgccatccacagaggacttagtca

SEQ ID NO: 132546 - DNA, 75 bp, Artificial Sequence
  Synthetic
gcgccggcgtagctggcgctgtggttacgttgaagatcatgagcggcgagatgccatccacagaggacttagtga

SEQ ID NO: 132547 - DNA, 75 bp, Artificial Sequence
  Synthetic
gcgccggcgtagctggcgctgtggttacgttgaagatcatgagcggcgagttgccatccacagaggacttagtaa

SEQ ID NO: 132548 - DNA, 75 bp, Artificial Sequence
  Synthetic
gcgccggcgtagctggcgctgtggttacgttgaagatcatgagcggcgagttgccatccacagaggacttagtta

SEQ ID NO: 132549 - DNA, 75 bp, Artificial Sequence
  Synthetic
gcgccggcgtagctggcgctgtggttacgttgaagatcatgagcggcgagttgccatccacagaggacttagtca

SEQ ID NO: 132550 - DNA, 75 bp, Artificial Sequence
  Synthetic
gcgccggcgtagctggcgctgtggttacgttgaagatcatgagcggcgagttgccatccacagaggacttagtga

SEQ ID NO: 132551 - DNA, 75 bp, Artificial Sequence
  Synthetic
gcgccggcgtagctggcgctgtggttacgttgaagatcatgagcggcgagctgccatccacagaggacttagtaa

SEQ ID NO: 132552 - DNA, 75 bp, Artificial Sequence
  Synthetic
gcgccggcgtagctggcgctgtggttacgttgaagatcatgagcggcgagctgccatccacagaggacttagtta

SEQ ID NO: 132553 - DNA, 75 bp, Artificial Sequence
  Synthetic
gcgccggcgtagctggcgctgtggttacgttgaagatcatgagcggcgagctgccatccacagaggacttagtca

SEQ ID NO: 132554 - DNA, 75 bp, Artificial Sequence
  Synthetic
gcgccggcgtagctggcgctgtggttacgttgaagatcatgagcggcgagctgccatccacagaggacttagtga

SEQ ID NO: 132555 - DNA, 75 bp, Artificial Sequence
  Synthetic
gcgccggcgtagctggcgctgtggttacgttgaagatcatgagcggcgaggtgccatccacagaggacttagtaa

SEQ ID NO: 132556 - DNA, 75 bp, Artificial Sequence
  Synthetic
gcgccggcgtagctggcgctgtggttacgttgaagatcatgagcggcgaggtgccatccacagaggacttagtta

SEQ ID NO: 132557 - DNA, 75 bp, Artificial Sequence
  Synthetic
gcgccggcgtagctggcgctgtggttacgttgaagatcatgagcggcgaggtgccatccacagaggacttagtca

SEQ ID NO: 132558 - DNA, 75 bp, Artificial Sequence
  Synthetic
gcgccggcgtagctggcgctgtggttacgttgaagatcatgagcggcgaggtgccatccacagaggacttagtga

SEQ ID NO: 132559 - DNA, 75 bp, Artificial Sequence
  Synthetic
ccttagagaacttggtggtcctcaatgcggcatccgtggccggagcgcatggcatcctctccttccttgtgttct

SEQ ID NO: 132560 - DNA, 75 bp, Artificial Sequence
  Synthetic
caatgcttacaccacgggacccggcgtgcctatcccagctccagactaccagtttgcgctgtggagggtttcagc

SEQ ID NO: 132561 - DNA, 75 bp, Artificial Sequence
  Synthetic
caatgcttacaccacgggtcccggcgtgcctatcccagctccagactaccagtttgcgctgtggagggtttcagc

SEQ ID NO: 132562 - DNA, 75 bp, Artificial Sequence
  Synthetic
caatgcttacaccacgggccccggcgtgcctatcccagctccagactaccagtttgcgctgtggagggtttcagc

SEQ ID NO: 132563 - DNA, 75 bp, Artificial Sequence
  Synthetic
caatgcttacaccacggggcccggcgtgcctatcccagctccagactaccagtttgcgctgtggagggtttcagc

SEQ ID NO: 132564 - DNA, 75 bp, Artificial Sequence
  Synthetic
ttcttcactgaggtggatggcgtcaggctccatcggtacgctcccccacgcaagcccttgttaagggaagaggtt

SEQ ID NO: 132565 - DNA, 75 bp, Artificial Sequence
  Synthetic
ctcatatcacggcggaaactgcaggccgaaggttggccagggggtctccaccctcgctggctagctcttcggcca

SEQ ID NO: 132566 - DNA, 75 bp, Artificial Sequence
  Synthetic
gtcgtggcaacagacgctctaatgacgggcttcaccggcgactttgactcagtgatcgactgtaatacatgtgtc

SEQ ID NO: 132567 - DNA, 75 bp, Artificial Sequence
  Synthetic
ggcgtaatgcacaccaaatgcccctgaggagcagagctggcaggccatatcaagaacggctcgatgaggatcact

SEQ ID NO: 132568 - DNA, 75 bp, Artificial Sequence
  Synthetic
ggcgtaatgcacaccaaatgcccctgaggagctgagctggcaggccatatcaagaacggctcgatgaggatcact

SEQ ID NO: 132569 - DNA, 75 bp, Artificial Sequence
  Synthetic
ggcgtaatgcacaccaaatgcccctgaggagccgagctggcaggccatatcaagaacggctcgatgaggatcact

SEQ ID NO: 132570 - DNA, 75 bp, Artificial Sequence
  Synthetic
ggcgtaatgcacaccaaatgcccctgaggagcggagctggcaggccatatcaagaacggctcgatgaggatcact

SEQ ID NO: 132571 - DNA, 75 bp, Artificial Sequence
  Synthetic
ggcgtaatgcacaccaaatgcccctgaggtgcagagctggcaggccatatcaagaacggctcgatgaggatcact

SEQ ID NO: 132572 - DNA, 75 bp, Artificial Sequence
  Synthetic
ggcgtaatgcacaccaaatgcccctgaggtgctgagctggcaggccatatcaagaacggctcgatgaggatcact

SEQ ID NO: 132573 - DNA, 75 bp, Artificial Sequence
  Synthetic
ggcgtaatgcacaccaaatgcccctgaggtgccgagctggcaggccatatcaagaacggctcgatgaggatcact

SEQ ID NO: 132574 - DNA, 75 bp, Artificial Sequence
  Synthetic
ggcgtaatgcacaccaaatgcccctgaggtgcggagctggcaggccatatcaagaacggctcgatgaggatcact

SEQ ID NO: 132575 - DNA, 75 bp, Artificial Sequence
  Synthetic
ggcgtaatgcacaccaaatgcccctgaggcgcagagctggcaggccatatcaagaacggctcgatgaggatcact

SEQ ID NO: 132576 - DNA, 75 bp, Artificial Sequence
  Synthetic
ggcgtaatgcacaccaaatgcccctgaggcgctgagctggcaggccatatcaagaacggctcgatgaggatcact

SEQ ID NO: 132577 - DNA, 75 bp, Artificial Sequence
  Synthetic
ggcgtaatgcacaccaaatgcccctgaggcgccgagctggcaggccatatcaagaacggctcgatgaggatcact

SEQ ID NO: 132578 - DNA, 75 bp, Artificial Sequence
  Synthetic
ggcgtaatgcacaccaaatgcccctgaggcgcggagctggcaggccatatcaagaacggctcgatgaggatcact

SEQ ID NO: 132579 - DNA, 75 bp, Artificial Sequence
  Synthetic
ggcgtaatgcacaccaaatgcccctgaggggcagagctggcaggccatatcaagaacggctcgatgaggatcact

SEQ ID NO: 132580 - DNA, 75 bp, Artificial Sequence
  Synthetic
ggcgtaatgcacaccaaatgcccctgaggggctgagctggcaggccatatcaagaacggctcgatgaggatcact

SEQ ID NO: 132581 - DNA, 75 bp, Artificial Sequence
  Synthetic
ggcgtaatgcacaccaaatgcccctgaggggccgagctggcaggccatatcaagaacggctcgatgaggatcact

SEQ ID NO: 132582 - DNA, 75 bp, Artificial Sequence
  Synthetic
ggcgtaatgcacaccaaatgcccctgaggggcggagctggcaggccatatcaagaacggctcgatgaggatcact

SEQ ID NO: 132583 - DNA, 75 bp, Artificial Sequence
  Synthetic
ggcgtaatgcacaccatatgcccctgaggagcagagctggcaggccatatcaagaacggctcgatgaggatcact

SEQ ID NO: 132584 - DNA, 75 bp, Artificial Sequence
  Synthetic
ggcgtaatgcacaccatatgcccctgaggagctgagctggcaggccatatcaagaacggctcgatgaggatcact

SEQ ID NO: 132585 - DNA, 75 bp, Artificial Sequence
  Synthetic
ggcgtaatgcacaccatatgcccctgaggagccgagctggcaggccatatcaagaacggctcgatgaggatcact

SEQ ID NO: 132586 - DNA, 75 bp, Artificial Sequence
  Synthetic
ggcgtaatgcacaccatatgcccctgaggagcggagctggcaggccatatcaagaacggctcgatgaggatcact

SEQ ID NO: 132587 - DNA, 75 bp, Artificial Sequence
  Synthetic
ggcgtaatgcacaccatatgcccctgaggtgcagagctggcaggccatatcaagaacggctcgatgaggatcact

SEQ ID NO: 132588 - DNA, 75 bp, Artificial Sequence
  Synthetic
ggcgtaatgcacaccatatgcccctgaggtgctgagctggcaggccatatcaagaacggctcgatgaggatcact

SEQ ID NO: 132589 - DNA, 75 bp, Artificial Sequence
  Synthetic
ggcgtaatgcacaccatatgcccctgaggtgccgagctggcaggccatatcaagaacggctcgatgaggatcact

SEQ ID NO: 132590 - DNA, 75 bp, Artificial Sequence
  Synthetic
ggcgtaatgcacaccatatgcccctgaggtgcggagctggcaggccatatcaagaacggctcgatgaggatcact

SEQ ID NO: 132591 - DNA, 75 bp, Artificial Sequence
  Synthetic
ggcgtaatgcacaccatatgcccctgaggcgcagagctggcaggccatatcaagaacggctcgatgaggatcact

SEQ ID NO: 132592 - DNA, 75 bp, Artificial Sequence
  Synthetic
ggcgtaatgcacaccatatgcccctgaggcgctgagctggcaggccatatcaagaacggctcgatgaggatcact

SEQ ID NO: 132593 - DNA, 75 bp, Artificial Sequence
  Synthetic
ggcgtaatgcacaccatatgcccctgaggcgccgagctggcaggccatatcaagaacggctcgatgaggatcact

SEQ ID NO: 132594 - DNA, 75 bp, Artificial Sequence
  Synthetic
ggcgtaatgcacaccatatgcccctgaggcgcggagctggcaggccatatcaagaacggctcgatgaggatcact

SEQ ID NO: 132595 - DNA, 75 bp, Artificial Sequence
  Synthetic
ggcgtaatgcacaccatatgcccctgaggggcagagctggcaggccatatcaagaacggctcgatgaggatcact

SEQ ID NO: 132596 - DNA, 75 bp, Artificial Sequence
  Synthetic
ggcgtaatgcacaccatatgcccctgaggggctgagctggcaggccatatcaagaacggctcgatgaggatcact

SEQ ID NO: 132597 - DNA, 75 bp, Artificial Sequence
  Synthetic
ggcgtaatgcacaccatatgcccctgaggggccgagctggcaggccatatcaagaacggctcgatgaggatcact

SEQ ID NO: 132598 - DNA, 75 bp, Artificial Sequence
  Synthetic
ggcgtaatgcacaccatatgcccctgaggggcggagctggcaggccatatcaagaacggctcgatgaggatcact

SEQ ID NO: 132599 - DNA, 75 bp, Artificial Sequence
  Synthetic
ggcgtaatgcacaccacatgcccctgaggagcagagctggcaggccatatcaagaacggctcgatgaggatcact

SEQ ID NO: 132600 - DNA, 75 bp, Artificial Sequence
  Synthetic
ggcgtaatgcacaccacatgcccctgaggagctgagctggcaggccatatcaagaacggctcgatgaggatcact

SEQ ID NO: 132601 - DNA, 75 bp, Artificial Sequence
  Synthetic
ggcgtaatgcacaccacatgcccctgaggagccgagctggcaggccatatcaagaacggctcgatgaggatcact

SEQ ID NO: 132602 - DNA, 75 bp, Artificial Sequence
  Synthetic
ggcgtaatgcacaccacatgcccctgaggagcggagctggcaggccatatcaagaacggctcgatgaggatcact

SEQ ID NO: 132603 - DNA, 75 bp, Artificial Sequence
  Synthetic
ggcgtaatgcacaccacatgcccctgaggtgcagagctggcaggccatatcaagaacggctcgatgaggatcact

SEQ ID NO: 132604 - DNA, 75 bp, Artificial Sequence
  Synthetic
ggcgtaatgcacaccacatgcccctgaggtgctgagctggcaggccatatcaagaacggctcgatgaggatcact

SEQ ID NO: 132605 - DNA, 75 bp, Artificial Sequence
  Synthetic
ggcgtaatgcacaccacatgcccctgaggtgccgagctggcaggccatatcaagaacggctcgatgaggatcact

SEQ ID NO: 132606 - DNA, 75 bp, Artificial Sequence
  Synthetic
ggcgtaatgcacaccacatgcccctgaggtgcggagctggcaggccatatcaagaacggctcgatgaggatcact

SEQ ID NO: 132607 - DNA, 75 bp, Artificial Sequence
  Synthetic
ggcgtaatgcacaccacatgcccctgaggcgcagagctggcaggccatatcaagaacggctcgatgaggatcact

SEQ ID NO: 132608 - DNA, 75 bp, Artificial Sequence
  Synthetic
ggcgtaatgcacaccacatgcccctgaggcgctgagctggcaggccatatcaagaacggctcgatgaggatcact

SEQ ID NO: 132609 - DNA, 75 bp, Artificial Sequence
  Synthetic
ggcgtaatgcacaccacatgcccctgaggcgccgagctggcaggccatatcaagaacggctcgatgaggatcact

SEQ ID NO: 132610 - DNA, 75 bp, Artificial Sequence
  Synthetic
ggcgtaatgcacaccacatgcccctgaggcgcggagctggcaggccatatcaagaacggctcgatgaggatcact

SEQ ID NO: 132611 - DNA, 75 bp, Artificial Sequence
  Synthetic
ggcgtaatgcacaccacatgcccctgaggggcagagctggcaggccatatcaagaacggctcgatgaggatcact

SEQ ID NO: 132612 - DNA, 75 bp, Artificial Sequence
  Synthetic
ggcgtaatgcacaccacatgcccctgaggggctgagctggcaggccatatcaagaacggctcgatgaggatcact

SEQ ID NO: 132613 - DNA, 75 bp, Artificial Sequence
  Synthetic
ggcgtaatgcacaccacatgcccctgaggggccgagctggcaggccatatcaagaacggctcgatgaggatcact

SEQ ID NO: 132614 - DNA, 75 bp, Artificial Sequence
  Synthetic
ggcgtaatgcacaccacatgcccctgaggggcggagctggcaggccatatcaagaacggctcgatgaggatcact

SEQ ID NO: 132615 - DNA, 75 bp, Artificial Sequence
  Synthetic
ggcgtaatgcacaccagatgcccctgaggagcagagctggcaggccatatcaagaacggctcgatgaggatcact

SEQ ID NO: 132616 - DNA, 75 bp, Artificial Sequence
  Synthetic
ggcgtaatgcacaccagatgcccctgaggagctgagctggcaggccatatcaagaacggctcgatgaggatcact

SEQ ID NO: 132617 - DNA, 75 bp, Artificial Sequence
  Synthetic
ggcgtaatgcacaccagatgcccctgaggagccgagctggcaggccatatcaagaacggctcgatgaggatcact

SEQ ID NO: 132618 - DNA, 75 bp, Artificial Sequence
  Synthetic
ggcgtaatgcacaccagatgcccctgaggagcggagctggcaggccatatcaagaacggctcgatgaggatcact

SEQ ID NO: 132619 - DNA, 75 bp, Artificial Sequence
  Synthetic
ggcgtaatgcacaccagatgcccctgaggtgcagagctggcaggccatatcaagaacggctcgatgaggatcact

SEQ ID NO: 132620 - DNA, 75 bp, Artificial Sequence
  Synthetic
ggcgtaatgcacaccagatgcccctgaggtgctgagctggcaggccatatcaagaacggctcgatgaggatcact

SEQ ID NO: 132621 - DNA, 75 bp, Artificial Sequence
  Synthetic
ggcgtaatgcacaccagatgcccctgaggtgccgagctggcaggccatatcaagaacggctcgatgaggatcact

SEQ ID NO: 132622 - DNA, 75 bp, Artificial Sequence
  Synthetic
ggcgtaatgcacaccagatgcccctgaggtgcggagctggcaggccatatcaagaacggctcgatgaggatcact

SEQ ID NO: 132623 - DNA, 75 bp, Artificial Sequence
  Synthetic
ggcgtaatgcacaccagatgcccctgaggcgcagagctggcaggccatatcaagaacggctcgatgaggatcact

SEQ ID NO: 132624 - DNA, 75 bp, Artificial Sequence
  Synthetic
ggcgtaatgcacaccagatgcccctgaggcgctgagctggcaggccatatcaagaacggctcgatgaggatcact

SEQ ID NO: 132625 - DNA, 75 bp, Artificial Sequence
  Synthetic
ggcgtaatgcacaccagatgcccctgaggcgccgagctggcaggccatatcaagaacggctcgatgaggatcact

SEQ ID NO: 132626 - DNA, 75 bp, Artificial Sequence
  Synthetic
ggcgtaatgcacaccagatgcccctgaggcgcggagctggcaggccatatcaagaacggctcgatgaggatcact

SEQ ID NO: 132627 - DNA, 75 bp, Artificial Sequence
  Synthetic
ggcgtaatgcacaccagatgcccctgaggggcagagctggcaggccatatcaagaacggctcgatgaggatcact

SEQ ID NO: 132628 - DNA, 75 bp, Artificial Sequence
  Synthetic
ggcgtaatgcacaccagatgcccctgaggggctgagctggcaggccatatcaagaacggctcgatgaggatcact

SEQ ID NO: 132629 - DNA, 75 bp, Artificial Sequence
  Synthetic
ggcgtaatgcacaccagatgcccctgaggggccgagctggcaggccatatcaagaacggctcgatgaggatcact

SEQ ID NO: 132630 - DNA, 75 bp, Artificial Sequence
  Synthetic
ggcgtaatgcacaccagatgcccctgaggggcggagctggcaggccatatcaagaacggctcgatgaggatcact

SEQ ID NO: 132631 - DNA, 75 bp, Artificial Sequence
  Synthetic
acatgatgatgaactggtcgcccacggccaccatgatcctggcgtacgtgatgcgcgtccccgaggtcatcatag

SEQ ID NO: 132632 - DNA, 75 bp, Artificial Sequence
  Synthetic
cctgtcgagctgcgaagctccaggactgcacgatgctcgtgtgcggagacgaccttgtcgttatctgtgagagcg

SEQ ID NO: 132633 - DNA, 75 bp, Artificial Sequence
  Synthetic
cagggttgagacgggcactaaagtgatgatacttgactccttcgagccgcttgtggccgaaccagatgacagaga

SEQ ID NO: 132634 - DNA, 75 bp, Artificial Sequence
  Synthetic
attgctgcgggacgaagtgtcgttctctgtaggactcaattcgttcgtagtgggatcacagctcccatgcgagcc

SEQ ID NO: 132635 - DNA, 75 bp, Artificial Sequence
  Synthetic
attgctgcgggacgaagtgtcgttctctgttggactcaattcgttcgtagtgggatcacagctcccatgcgagcc

SEQ ID NO: 132636 - DNA, 75 bp, Artificial Sequence
  Synthetic
attgctgcgggacgaagtgtcgttctctgtcggactcaattcgttcgtagtgggatcacagctcccatgcgagcc

SEQ ID NO: 132637 - DNA, 75 bp, Artificial Sequence
  Synthetic
attgctgcgggacgaagtgtcgttctctgtgggactcaattcgttcgtagtgggatcacagctcccatgcgagcc

SEQ ID NO: 132638 - DNA, 75 bp, Artificial Sequence
  Synthetic
tttgctgcgggacgaagtgtcgttctctgtaggactcaattcgttcgtagtgggatcacagctcccatgcgagcc

SEQ ID NO: 132639 - DNA, 75 bp, Artificial Sequence
  Synthetic
tttgctgcgggacgaagtgtcgttctctgttggactcaattcgttcgtagtgggatcacagctcccatgcgagcc

SEQ ID NO: 132640 - DNA, 75 bp, Artificial Sequence
  Synthetic
tttgctgcgggacgaagtgtcgttctctgtcggactcaattcgttcgtagtgggatcacagctcccatgcgagcc

SEQ ID NO: 132641 - DNA, 75 bp, Artificial Sequence
  Synthetic
tttgctgcgggacgaagtgtcgttctctgtgggactcaattcgttcgtagtgggatcacagctcccatgcgagcc

SEQ ID NO: 132642 - DNA, 75 bp, Artificial Sequence
  Synthetic
cttgctgcgggacgaagtgtcgttctctgtaggactcaattcgttcgtagtgggatcacagctcccatgcgagcc

SEQ ID NO: 132643 - DNA, 75 bp, Artificial Sequence
  Synthetic
cttgctgcgggacgaagtgtcgttctctgttggactcaattcgttcgtagtgggatcacagctcccatgcgagcc

SEQ ID NO: 132644 - DNA, 75 bp, Artificial Sequence
  Synthetic
cttgctgcgggacgaagtgtcgttctctgtcggactcaattcgttcgtagtgggatcacagctcccatgcgagcc

SEQ ID NO: 132645 - DNA, 75 bp, Artificial Sequence
  Synthetic
cttgctgcgggacgaagtgtcgttctctgtgggactcaattcgttcgtagtgggatcacagctcccatgcgagcc

SEQ ID NO: 132646 - DNA, 75 bp, Artificial Sequence
  Synthetic
gttgctgcgggacgaagtgtcgttctctgtaggactcaattcgttcgtagtgggatcacagctcccatgcgagcc

SEQ ID NO: 132647 - DNA, 75 bp, Artificial Sequence
  Synthetic
gttgctgcgggacgaagtgtcgttctctgttggactcaattcgttcgtagtgggatcacagctcccatgcgagcc

SEQ ID NO: 132648 - DNA, 75 bp, Artificial Sequence
  Synthetic
gttgctgcgggacgaagtgtcgttctctgtcggactcaattcgttcgtagtgggatcacagctcccatgcgagcc

SEQ ID NO: 132649 - DNA, 75 bp, Artificial Sequence
  Synthetic
gttgctgcgggacgaagtgtcgttctctgtgggactcaattcgttcgtagtgggatcacagctcccatgcgagcc

SEQ ID NO: 132650 - DNA, 75 bp, Artificial Sequence
  Synthetic
tggaagcagcctgagtacgaaccaccggtcgttcacggttgcgccttacctcccagcaagccgactcccgttcct

SEQ ID NO: 132651 - DNA, 75 bp, Artificial Sequence
  Synthetic
actggcccgagggtcaccgccctcgatagctagttcttcggctagccagttgtccgccccgtctctcaaagccac

SEQ ID NO: 132652 - DNA, 75 bp, Artificial Sequence
  Synthetic
actggcccgagggtcaccgccctcgattgctagttcttcggctagccagttgtccgccccgtctctcaaagccac

SEQ ID NO: 132653 - DNA, 75 bp, Artificial Sequence
  Synthetic
actggcccgagggtcaccgccctcgatcgctagttcttcggctagccagttgtccgccccgtctctcaaagccac

SEQ ID NO: 132654 - DNA, 75 bp, Artificial Sequence
  Synthetic
actggcccgagggtcaccgccctcgatggctagttcttcggctagccagttgtccgccccgtctctcaaagccac

SEQ ID NO: 132655 - DNA, 75 bp, Artificial Sequence
  Synthetic
actggcccgagggtcaccgccctcgttagctagttcttcggctagccagttgtccgccccgtctctcaaagccac

SEQ ID NO: 132656 - DNA, 75 bp, Artificial Sequence
  Synthetic
actggcccgagggtcaccgccctcgtttgctagttcttcggctagccagttgtccgccccgtctctcaaagccac

SEQ ID NO: 132657 - DNA, 75 bp, Artificial Sequence
  Synthetic
actggcccgagggtcaccgccctcgttcgctagttcttcggctagccagttgtccgccccgtctctcaaagccac

SEQ ID NO: 132658 - DNA, 75 bp, Artificial Sequence
  Synthetic
actggcccgagggtcaccgccctcgttggctagttcttcggctagccagttgtccgccccgtctctcaaagccac

SEQ ID NO: 132659 - DNA, 75 bp, Artificial Sequence
  Synthetic
actggcccgagggtcaccgccctcgctagctagttcttcggctagccagttgtccgccccgtctctcaaagccac

SEQ ID NO: 132660 - DNA, 75 bp, Artificial Sequence
  Synthetic
actggcccgagggtcaccgccctcgcttgctagttcttcggctagccagttgtccgccccgtctctcaaagccac

SEQ ID NO: 132661 - DNA, 75 bp, Artificial Sequence
  Synthetic
actggcccgagggtcaccgccctcgctcgctagttcttcggctagccagttgtccgccccgtctctcaaagccac

SEQ ID NO: 132662 - DNA, 75 bp, Artificial Sequence
  Synthetic
actggcccgagggtcaccgccctcgctggctagttcttcggctagccagttgtccgccccgtctctcaaagccac

SEQ ID NO: 132663 - DNA, 75 bp, Artificial Sequence
  Synthetic
actggcccgagggtcaccgccctcggtagctagttcttcggctagccagttgtccgccccgtctctcaaagccac

SEQ ID NO: 132664 - DNA, 75 bp, Artificial Sequence
  Synthetic
actggcccgagggtcaccgccctcggttgctagttcttcggctagccagttgtccgccccgtctctcaaagccac

SEQ ID NO: 132665 - DNA, 75 bp, Artificial Sequence
  Synthetic
actggcccgagggtcaccgccctcggtcgctagttcttcggctagccagttgtccgccccgtctctcaaagccac

SEQ ID NO: 132666 - DNA, 75 bp, Artificial Sequence
  Synthetic
actggcccgagggtcaccgccctcggtggctagttcttcggctagccagttgtccgccccgtctctcaaagccac

SEQ ID NO: 132667 - DNA, 75 bp, Artificial Sequence
  Synthetic
tctggcccgagggtcaccgccctcgatagctagttcttcggctagccagttgtccgccccgtctctcaaagccac

SEQ ID NO: 132668 - DNA, 75 bp, Artificial Sequence
  Synthetic
tctggcccgagggtcaccgccctcgattgctagttcttcggctagccagttgtccgccccgtctctcaaagccac

SEQ ID NO: 132669 - DNA, 75 bp, Artificial Sequence
  Synthetic
tctggcccgagggtcaccgccctcgatcgctagttcttcggctagccagttgtccgccccgtctctcaaagccac

SEQ ID NO: 132670 - DNA, 75 bp, Artificial Sequence
  Synthetic
tctggcccgagggtcaccgccctcgatggctagttcttcggctagccagttgtccgccccgtctctcaaagccac

SEQ ID NO: 132671 - DNA, 75 bp, Artificial Sequence
  Synthetic
tctggcccgagggtcaccgccctcgttagctagttcttcggctagccagttgtccgccccgtctctcaaagccac

SEQ ID NO: 132672 - DNA, 75 bp, Artificial Sequence
  Synthetic
tctggcccgagggtcaccgccctcgtttgctagttcttcggctagccagttgtccgccccgtctctcaaagccac

SEQ ID NO: 132673 - DNA, 75 bp, Artificial Sequence
  Synthetic
tctggcccgagggtcaccgccctcgttcgctagttcttcggctagccagttgtccgccccgtctctcaaagccac

SEQ ID NO: 132674 - DNA, 75 bp, Artificial Sequence
  Synthetic
tctggcccgagggtcaccgccctcgttggctagttcttcggctagccagttgtccgccccgtctctcaaagccac

SEQ ID NO: 132675 - DNA, 75 bp, Artificial Sequence
  Synthetic
tctggcccgagggtcaccgccctcgctagctagttcttcggctagccagttgtccgccccgtctctcaaagccac

SEQ ID NO: 132676 - DNA, 75 bp, Artificial Sequence
  Synthetic
tctggcccgagggtcaccgccctcgcttgctagttcttcggctagccagttgtccgccccgtctctcaaagccac

SEQ ID NO: 132677 - DNA, 75 bp, Artificial Sequence
  Synthetic
tctggcccgagggtcaccgccctcgctcgctagttcttcggctagccagttgtccgccccgtctctcaaagccac

SEQ ID NO: 132678 - DNA, 75 bp, Artificial Sequence
  Synthetic
tctggcccgagggtcaccgccctcgctggctagttcttcggctagccagttgtccgccccgtctctcaaagccac

SEQ ID NO: 132679 - DNA, 75 bp, Artificial Sequence
  Synthetic
tctggcccgagggtcaccgccctcggtagctagttcttcggctagccagttgtccgccccgtctctcaaagccac

SEQ ID NO: 132680 - DNA, 75 bp, Artificial Sequence
  Synthetic
tctggcccgagggtcaccgccctcggttgctagttcttcggctagccagttgtccgccccgtctctcaaagccac

SEQ ID NO: 132681 - DNA, 75 bp, Artificial Sequence
  Synthetic
tctggcccgagggtcaccgccctcggtcgctagttcttcggctagccagttgtccgccccgtctctcaaagccac

SEQ ID NO: 132682 - DNA, 75 bp, Artificial Sequence
  Synthetic
tctggcccgagggtcaccgccctcggtggctagttcttcggctagccagttgtccgccccgtctctcaaagccac

SEQ ID NO: 132683 - DNA, 75 bp, Artificial Sequence
  Synthetic
cctggcccgagggtcaccgccctcgatagctagttcttcggctagccagttgtccgccccgtctctcaaagccac

SEQ ID NO: 132684 - DNA, 75 bp, Artificial Sequence
  Synthetic
cctggcccgagggtcaccgccctcgattgctagttcttcggctagccagttgtccgccccgtctctcaaagccac

SEQ ID NO: 132685 - DNA, 75 bp, Artificial Sequence
  Synthetic
cctggcccgagggtcaccgccctcgatcgctagttcttcggctagccagttgtccgccccgtctctcaaagccac

SEQ ID NO: 132686 - DNA, 75 bp, Artificial Sequence
  Synthetic
cctggcccgagggtcaccgccctcgatggctagttcttcggctagccagttgtccgccccgtctctcaaagccac

SEQ ID NO: 132687 - DNA, 75 bp, Artificial Sequence
  Synthetic
cctggcccgagggtcaccgccctcgttagctagttcttcggctagccagttgtccgccccgtctctcaaagccac

SEQ ID NO: 132688 - DNA, 75 bp, Artificial Sequence
  Synthetic
cctggcccgagggtcaccgccctcgtttgctagttcttcggctagccagttgtccgccccgtctctcaaagccac

SEQ ID NO: 132689 - DNA, 75 bp, Artificial Sequence
  Synthetic
cctggcccgagggtcaccgccctcgttcgctagttcttcggctagccagttgtccgccccgtctctcaaagccac

SEQ ID NO: 132690 - DNA, 75 bp, Artificial Sequence
  Synthetic
cctggcccgagggtcaccgccctcgttggctagttcttcggctagccagttgtccgccccgtctctcaaagccac

SEQ ID NO: 132691 - DNA, 75 bp, Artificial Sequence
  Synthetic
cctggcccgagggtcaccgccctcgctagctagttcttcggctagccagttgtccgccccgtctctcaaagccac

SEQ ID NO: 132692 - DNA, 75 bp, Artificial Sequence
  Synthetic
cctggcccgagggtcaccgccctcgcttgctagttcttcggctagccagttgtccgccccgtctctcaaagccac

SEQ ID NO: 132693 - DNA, 75 bp, Artificial Sequence
  Synthetic
cctggcccgagggtcaccgccctcgctcgctagttcttcggctagccagttgtccgccccgtctctcaaagccac

SEQ ID NO: 132694 - DNA, 75 bp, Artificial Sequence
  Synthetic
cctggcccgagggtcaccgccctcgctggctagttcttcggctagccagttgtccgccccgtctctcaaagccac

SEQ ID NO: 132695 - DNA, 75 bp, Artificial Sequence
  Synthetic
cctggcccgagggtcaccgccctcggtagctagttcttcggctagccagttgtccgccccgtctctcaaagccac

SEQ ID NO: 132696 - DNA, 75 bp, Artificial Sequence
  Synthetic
cctggcccgagggtcaccgccctcggttgctagttcttcggctagccagttgtccgccccgtctctcaaagccac

SEQ ID NO: 132697 - DNA, 75 bp, Artificial Sequence
  Synthetic
cctggcccgagggtcaccgccctcggtcgctagttcttcggctagccagttgtccgccccgtctctcaaagccac

SEQ ID NO: 132698 - DNA, 75 bp, Artificial Sequence
  Synthetic
cctggcccgagggtcaccgccctcggtggctagttcttcggctagccagttgtccgccccgtctctcaaagccac

SEQ ID NO: 132699 - DNA, 75 bp, Artificial Sequence
  Synthetic
gctggcccgagggtcaccgccctcgatagctagttcttcggctagccagttgtccgccccgtctctcaaagccac

SEQ ID NO: 132700 - DNA, 75 bp, Artificial Sequence
  Synthetic
gctggcccgagggtcaccgccctcgattgctagttcttcggctagccagttgtccgccccgtctctcaaagccac

SEQ ID NO: 132701 - DNA, 75 bp, Artificial Sequence
  Synthetic
gctggcccgagggtcaccgccctcgatcgctagttcttcggctagccagttgtccgccccgtctctcaaagccac

SEQ ID NO: 132702 - DNA, 75 bp, Artificial Sequence
  Synthetic
gctggcccgagggtcaccgccctcgatggctagttcttcggctagccagttgtccgccccgtctctcaaagccac

SEQ ID NO: 132703 - DNA, 75 bp, Artificial Sequence
  Synthetic
gctggcccgagggtcaccgccctcgttagctagttcttcggctagccagttgtccgccccgtctctcaaagccac

SEQ ID NO: 132704 - DNA, 75 bp, Artificial Sequence
  Synthetic
gctggcccgagggtcaccgccctcgtttgctagttcttcggctagccagttgtccgccccgtctctcaaagccac

SEQ ID NO: 132705 - DNA, 75 bp, Artificial Sequence
  Synthetic
gctggcccgagggtcaccgccctcgttcgctagttcttcggctagccagttgtccgccccgtctctcaaagccac

SEQ ID NO: 132706 - DNA, 75 bp, Artificial Sequence
  Synthetic
gctggcccgagggtcaccgccctcgttggctagttcttcggctagccagttgtccgccccgtctctcaaagccac

SEQ ID NO: 132707 - DNA, 75 bp, Artificial Sequence
  Synthetic
gctggcccgagggtcaccgccctcgctagctagttcttcggctagccagttgtccgccccgtctctcaaagccac

SEQ ID NO: 132708 - DNA, 75 bp, Artificial Sequence
  Synthetic
gctggcccgagggtcaccgccctcgcttgctagttcttcggctagccagttgtccgccccgtctctcaaagccac

SEQ ID NO: 132709 - DNA, 75 bp, Artificial Sequence
  Synthetic
gctggcccgagggtcaccgccctcgctcgctagttcttcggctagccagttgtccgccccgtctctcaaagccac

SEQ ID NO: 132710 - DNA, 75 bp, Artificial Sequence
  Synthetic
gctggcccgagggtcaccgccctcgctggctagttcttcggctagccagttgtccgccccgtctctcaaagccac

SEQ ID NO: 132711 - DNA, 75 bp, Artificial Sequence
  Synthetic
gctggcccgagggtcaccgccctcggtagctagttcttcggctagccagttgtccgccccgtctctcaaagccac

SEQ ID NO: 132712 - DNA, 75 bp, Artificial Sequence
  Synthetic
gctggcccgagggtcaccgccctcggttgctagttcttcggctagccagttgtccgccccgtctctcaaagccac

SEQ ID NO: 132713 - DNA, 75 bp, Artificial Sequence
  Synthetic
gctggcccgagggtcaccgccctcggtcgctagttcttcggctagccagttgtccgccccgtctctcaaagccac

SEQ ID NO: 132714 - DNA, 75 bp, Artificial Sequence
  Synthetic
gctggcccgagggtcaccgccctcggtggctagttcttcggctagccagttgtccgccccgtctctcaaagccac

SEQ ID NO: 132715 - DNA, 75 bp, Artificial Sequence
  Synthetic
atcttggggggatgggtggccgcccaacttgctccccccagcgcagcttcggctttcgtgggcgccggcatcgct

SEQ ID NO: 132716 - DNA, 75 bp, Artificial Sequence
  Synthetic
gcgactccggggcagacctcatttcgccaaccgagtcttccgatcagagctcccccgctgtagatgatgtgtcag

SEQ ID NO: 132717 - DNA, 75 bp, Artificial Sequence
  Synthetic
atactggactcttttgagccatgtgtggctgaaccagaagaagacagggaggtctcggtcgccgcagaagttctg

SEQ ID NO: 132718 - DNA, 75 bp, Artificial Sequence
  Synthetic
atactggactcttttgagccatgtgtggctgaaccagaagaagacagggaggtctcggtcgccgcagatgttctg

SEQ ID NO: 132719 - DNA, 75 bp, Artificial Sequence
  Synthetic
atactggactcttttgagccatgtgtggctgaaccagaagaagacagggaggtctcggtcgccgcagacgttctg

SEQ ID NO: 132720 - DNA, 75 bp, Artificial Sequence
  Synthetic
atactggactcttttgagccatgtgtggctgaaccagaagaagacagggaggtctcggtcgccgcagaggttctg

SEQ ID NO: 132721 - DNA, 75 bp, Artificial Sequence
  Synthetic
atactggactcttttgagccatgtgtggctgaaccagatgaagacagggaggtctcggtcgccgcagaagttctg

SEQ ID NO: 132722 - DNA, 75 bp, Artificial Sequence
  Synthetic
atactggactcttttgagccatgtgtggctgaaccagatgaagacagggaggtctcggtcgccgcagatgttctg

SEQ ID NO: 132723 - DNA, 75 bp, Artificial Sequence
  Synthetic
atactggactcttttgagccatgtgtggctgaaccagatgaagacagggaggtctcggtcgccgcagacgttctg

SEQ ID NO: 132724 - DNA, 75 bp, Artificial Sequence
  Synthetic
atactggactcttttgagccatgtgtggctgaaccagatgaagacagggaggtctcggtcgccgcagaggttctg

SEQ ID NO: 132725 - DNA, 75 bp, Artificial Sequence
  Synthetic
atactggactcttttgagccatgtgtggctgaaccagacgaagacagggaggtctcggtcgccgcagaagttctg

SEQ ID NO: 132726 - DNA, 75 bp, Artificial Sequence
  Synthetic
atactggactcttttgagccatgtgtggctgaaccagacgaagacagggaggtctcggtcgccgcagatgttctg

SEQ ID NO: 132727 - DNA, 75 bp, Artificial Sequence
  Synthetic
atactggactcttttgagccatgtgtggctgaaccagacgaagacagggaggtctcggtcgccgcagacgttctg

SEQ ID NO: 132728 - DNA, 75 bp, Artificial Sequence
  Synthetic
atactggactcttttgagccatgtgtggctgaaccagacgaagacagggaggtctcggtcgccgcagaggttctg

SEQ ID NO: 132729 - DNA, 75 bp, Artificial Sequence
  Synthetic
atactggactcttttgagccatgtgtggctgaaccagaggaagacagggaggtctcggtcgccgcagaagttctg

SEQ ID NO: 132730 - DNA, 75 bp, Artificial Sequence
  Synthetic
atactggactcttttgagccatgtgtggctgaaccagaggaagacagggaggtctcggtcgccgcagatgttctg

SEQ ID NO: 132731 - DNA, 75 bp, Artificial Sequence
  Synthetic
atactggactcttttgagccatgtgtggctgaaccagaggaagacagggaggtctcggtcgccgcagacgttctg

SEQ ID NO: 132732 - DNA, 75 bp, Artificial Sequence
  Synthetic
atactggactcttttgagccatgtgtggctgaaccagaggaagacagggaggtctcggtcgccgcagaggttctg

SEQ ID NO: 132733 - DNA, 75 bp, Artificial Sequence
  Synthetic
tatgtctgacaacgcatcctattcgtctgtaccaccatccgagggggggcttggagacccaaacccgacatcaga

SEQ ID NO: 132734 - DNA, 75 bp, Artificial Sequence
  Synthetic
caacagtccatggatgtgctttgcctcccagcaagcaaaccccagttcctcctcctagaaggaagcggacggttc

SEQ ID NO: 132735 - DNA, 75 bp, Artificial Sequence
  Synthetic
caacagtccatggatgtgctttgcctcccagcaagcaaaccccagttcctcctcctagtaggaagcggacggttc

SEQ ID NO: 132736 - DNA, 75 bp, Artificial Sequence
  Synthetic
caacagtccatggatgtgctttgcctcccagcaagcaaaccccagttcctcctcctagcaggaagcggacggttc

SEQ ID NO: 132737 - DNA, 75 bp, Artificial Sequence
  Synthetic
caacagtccatggatgtgctttgcctcccagcaagcaaaccccagttcctcctcctaggaggaagcggacggttc

SEQ ID NO: 132738 - DNA, 75 bp, Artificial Sequence
  Synthetic
caacagtccatggatgtgctttgcctcccagcaagcaaacccctgttcctcctcctagaaggaagcggacggttc

SEQ ID NO: 132739 - DNA, 75 bp, Artificial Sequence
  Synthetic
caacagtccatggatgtgctttgcctcccagcaagcaaacccctgttcctcctcctagtaggaagcggacggttc

SEQ ID NO: 132740 - DNA, 75 bp, Artificial Sequence
  Synthetic
caacagtccatggatgtgctttgcctcccagcaagcaaacccctgttcctcctcctagcaggaagcggacggttc

SEQ ID NO: 132741 - DNA, 75 bp, Artificial Sequence
  Synthetic
caacagtccatggatgtgctttgcctcccagcaagcaaacccctgttcctcctcctaggaggaagcggacggttc

SEQ ID NO: 132742 - DNA, 75 bp, Artificial Sequence
  Synthetic
caacagtccatggatgtgctttgcctcccagcaagcaaacccccgttcctcctcctagaaggaagcggacggttc

SEQ ID NO: 132743 - DNA, 75 bp, Artificial Sequence
  Synthetic
caacagtccatggatgtgctttgcctcccagcaagcaaacccccgttcctcctcctagtaggaagcggacggttc

SEQ ID NO: 132744 - DNA, 75 bp, Artificial Sequence
  Synthetic
caacagtccatggatgtgctttgcctcccagcaagcaaacccccgttcctcctcctagcaggaagcggacggttc

SEQ ID NO: 132745 - DNA, 75 bp, Artificial Sequence
  Synthetic
caacagtccatggatgtgctttgcctcccagcaagcaaacccccgttcctcctcctaggaggaagcggacggttc

SEQ ID NO: 132746 - DNA, 75 bp, Artificial Sequence
  Synthetic
caacagtccatggatgtgctttgcctcccagcaagcaaaccccggttcctcctcctagaaggaagcggacggttc

SEQ ID NO: 132747 - DNA, 75 bp, Artificial Sequence
  Synthetic
caacagtccatggatgtgctttgcctcccagcaagcaaaccccggttcctcctcctagtaggaagcggacggttc

SEQ ID NO: 132748 - DNA, 75 bp, Artificial Sequence
  Synthetic
caacagtccatggatgtgctttgcctcccagcaagcaaaccccggttcctcctcctagcaggaagcggacggttc

SEQ ID NO: 132749 - DNA, 75 bp, Artificial Sequence
  Synthetic
caacagtccatggatgtgctttgcctcccagcaagcaaaccccggttcctcctcctaggaggaagcggacggttc

SEQ ID NO: 132750 - DNA, 75 bp, Artificial Sequence
  Synthetic
caactgtccatggatgtgctttgcctcccagcaagcaaaccccagttcctcctcctagaaggaagcggacggttc

SEQ ID NO: 132751 - DNA, 75 bp, Artificial Sequence
  Synthetic
caactgtccatggatgtgctttgcctcccagcaagcaaaccccagttcctcctcctagtaggaagcggacggttc

SEQ ID NO: 132752 - DNA, 75 bp, Artificial Sequence
  Synthetic
caactgtccatggatgtgctttgcctcccagcaagcaaaccccagttcctcctcctagcaggaagcggacggttc

SEQ ID NO: 132753 - DNA, 75 bp, Artificial Sequence
  Synthetic
caactgtccatggatgtgctttgcctcccagcaagcaaaccccagttcctcctcctaggaggaagcggacggttc

SEQ ID NO: 132754 - DNA, 75 bp, Artificial Sequence
  Synthetic
caactgtccatggatgtgctttgcctcccagcaagcaaacccctgttcctcctcctagaaggaagcggacggttc

SEQ ID NO: 132755 - DNA, 75 bp, Artificial Sequence
  Synthetic
caactgtccatggatgtgctttgcctcccagcaagcaaacccctgttcctcctcctagtaggaagcggacggttc

SEQ ID NO: 132756 - DNA, 75 bp, Artificial Sequence
  Synthetic
caactgtccatggatgtgctttgcctcccagcaagcaaacccctgttcctcctcctagcaggaagcggacggttc

SEQ ID NO: 132757 - DNA, 75 bp, Artificial Sequence
  Synthetic
caactgtccatggatgtgctttgcctcccagcaagcaaacccctgttcctcctcctaggaggaagcggacggttc

SEQ ID NO: 132758 - DNA, 75 bp, Artificial Sequence
  Synthetic
caactgtccatggatgtgctttgcctcccagcaagcaaacccccgttcctcctcctagaaggaagcggacggttc

SEQ ID NO: 132759 - DNA, 75 bp, Artificial Sequence
  Synthetic
caactgtccatggatgtgctttgcctcccagcaagcaaacccccgttcctcctcctagtaggaagcggacggttc

SEQ ID NO: 132760 - DNA, 75 bp, Artificial Sequence
  Synthetic
caactgtccatggatgtgctttgcctcccagcaagcaaacccccgttcctcctcctagcaggaagcggacggttc

SEQ ID NO: 132761 - DNA, 75 bp, Artificial Sequence
  Synthetic
caactgtccatggatgtgctttgcctcccagcaagcaaacccccgttcctcctcctaggaggaagcggacggttc

SEQ ID NO: 132762 - DNA, 75 bp, Artificial Sequence
  Synthetic
caactgtccatggatgtgctttgcctcccagcaagcaaaccccggttcctcctcctagaaggaagcggacggttc

SEQ ID NO: 132763 - DNA, 75 bp, Artificial Sequence
  Synthetic
caactgtccatggatgtgctttgcctcccagcaagcaaaccccggttcctcctcctagtaggaagcggacggttc

SEQ ID NO: 132764 - DNA, 75 bp, Artificial Sequence
  Synthetic
caactgtccatggatgtgctttgcctcccagcaagcaaaccccggttcctcctcctagcaggaagcggacggttc

SEQ ID NO: 132765 - DNA, 75 bp, Artificial Sequence
  Synthetic
caactgtccatggatgtgctttgcctcccagcaagcaaaccccggttcctcctcctaggaggaagcggacggttc

SEQ ID NO: 132766 - DNA, 75 bp, Artificial Sequence
  Synthetic
caaccgtccatggatgtgctttgcctcccagcaagcaaaccccagttcctcctcctagaaggaagcggacggttc

SEQ ID NO: 132767 - DNA, 75 bp, Artificial Sequence
  Synthetic
caaccgtccatggatgtgctttgcctcccagcaagcaaaccccagttcctcctcctagtaggaagcggacggttc

SEQ ID NO: 132768 - DNA, 75 bp, Artificial Sequence
  Synthetic
caaccgtccatggatgtgctttgcctcccagcaagcaaaccccagttcctcctcctagcaggaagcggacggttc

SEQ ID NO: 132769 - DNA, 75 bp, Artificial Sequence
  Synthetic
caaccgtccatggatgtgctttgcctcccagcaagcaaaccccagttcctcctcctaggaggaagcggacggttc

SEQ ID NO: 132770 - DNA, 75 bp, Artificial Sequence
  Synthetic
caaccgtccatggatgtgctttgcctcccagcaagcaaacccctgttcctcctcctagaaggaagcggacggttc

SEQ ID NO: 132771 - DNA, 75 bp, Artificial Sequence
  Synthetic
caaccgtccatggatgtgctttgcctcccagcaagcaaacccctgttcctcctcctagtaggaagcggacggttc

SEQ ID NO: 132772 - DNA, 75 bp, Artificial Sequence
  Synthetic
caaccgtccatggatgtgctttgcctcccagcaagcaaacccctgttcctcctcctagcaggaagcggacggttc

SEQ ID NO: 132773 - DNA, 75 bp, Artificial Sequence
  Synthetic
caaccgtccatggatgtgctttgcctcccagcaagcaaacccctgttcctcctcctaggaggaagcggacggttc

SEQ ID NO: 132774 - DNA, 75 bp, Artificial Sequence
  Synthetic
caaccgtccatggatgtgctttgcctcccagcaagcaaacccccgttcctcctcctagaaggaagcggacggttc

SEQ ID NO: 132775 - DNA, 75 bp, Artificial Sequence
  Synthetic
caaccgtccatggatgtgctttgcctcccagcaagcaaacccccgttcctcctcctagtaggaagcggacggttc

SEQ ID NO: 132776 - DNA, 75 bp, Artificial Sequence
  Synthetic
caaccgtccatggatgtgctttgcctcccagcaagcaaacccccgttcctcctcctagcaggaagcggacggttc

SEQ ID NO: 132777 - DNA, 75 bp, Artificial Sequence
  Synthetic
caaccgtccatggatgtgctttgcctcccagcaagcaaacccccgttcctcctcctaggaggaagcggacggttc

SEQ ID NO: 132778 - DNA, 75 bp, Artificial Sequence
  Synthetic
caaccgtccatggatgtgctttgcctcccagcaagcaaaccccggttcctcctcctagaaggaagcggacggttc

SEQ ID NO: 132779 - DNA, 75 bp, Artificial Sequence
  Synthetic
caaccgtccatggatgtgctttgcctcccagcaagcaaaccccggttcctcctcctagtaggaagcggacggttc

SEQ ID NO: 132780 - DNA, 75 bp, Artificial Sequence
  Synthetic
caaccgtccatggatgtgctttgcctcccagcaagcaaaccccggttcctcctcctagcaggaagcggacggttc

SEQ ID NO: 132781 - DNA, 75 bp, Artificial Sequence
  Synthetic
caaccgtccatggatgtgctttgcctcccagcaagcaaaccccggttcctcctcctaggaggaagcggacggttc

SEQ ID NO: 132782 - DNA, 75 bp, Artificial Sequence
  Synthetic
caacggtccatggatgtgctttgcctcccagcaagcaaaccccagttcctcctcctagaaggaagcggacggttc

SEQ ID NO: 132783 - DNA, 75 bp, Artificial Sequence
  Synthetic
caacggtccatggatgtgctttgcctcccagcaagcaaaccccagttcctcctcctagtaggaagcggacggttc

SEQ ID NO: 132784 - DNA, 75 bp, Artificial Sequence
  Synthetic
caacggtccatggatgtgctttgcctcccagcaagcaaaccccagttcctcctcctagcaggaagcggacggttc

SEQ ID NO: 132785 - DNA, 75 bp, Artificial Sequence
  Synthetic
caacggtccatggatgtgctttgcctcccagcaagcaaaccccagttcctcctcctaggaggaagcggacggttc

SEQ ID NO: 132786 - DNA, 75 bp, Artificial Sequence
  Synthetic
caacggtccatggatgtgctttgcctcccagcaagcaaacccctgttcctcctcctagaaggaagcggacggttc

SEQ ID NO: 132787 - DNA, 75 bp, Artificial Sequence
  Synthetic
caacggtccatggatgtgctttgcctcccagcaagcaaacccctgttcctcctcctagtaggaagcggacggttc

SEQ ID NO: 132788 - DNA, 75 bp, Artificial Sequence
  Synthetic
caacggtccatggatgtgctttgcctcccagcaagcaaacccctgttcctcctcctagcaggaagcggacggttc

SEQ ID NO: 132789 - DNA, 75 bp, Artificial Sequence
  Synthetic
caacggtccatggatgtgctttgcctcccagcaagcaaacccctgttcctcctcctaggaggaagcggacggttc

SEQ ID NO: 132790 - DNA, 75 bp, Artificial Sequence
  Synthetic
caacggtccatggatgtgctttgcctcccagcaagcaaacccccgttcctcctcctagaaggaagcggacggttc

SEQ ID NO: 132791 - DNA, 75 bp, Artificial Sequence
  Synthetic
caacggtccatggatgtgctttgcctcccagcaagcaaacccccgttcctcctcctagtaggaagcggacggttc

SEQ ID NO: 132792 - DNA, 75 bp, Artificial Sequence
  Synthetic
caacggtccatggatgtgctttgcctcccagcaagcaaacccccgttcctcctcctagcaggaagcggacggttc

SEQ ID NO: 132793 - DNA, 75 bp, Artificial Sequence
  Synthetic
caacggtccatggatgtgctttgcctcccagcaagcaaacccccgttcctcctcctaggaggaagcggacggttc

SEQ ID NO: 132794 - DNA, 75 bp, Artificial Sequence
  Synthetic
caacggtccatggatgtgctttgcctcccagcaagcaaaccccggttcctcctcctagaaggaagcggacggttc

SEQ ID NO: 132795 - DNA, 75 bp, Artificial Sequence
  Synthetic
caacggtccatggatgtgctttgcctcccagcaagcaaaccccggttcctcctcctagtaggaagcggacggttc

SEQ ID NO: 132796 - DNA, 75 bp, Artificial Sequence
  Synthetic
caacggtccatggatgtgctttgcctcccagcaagcaaaccccggttcctcctcctagcaggaagcggacggttc

SEQ ID NO: 132797 - DNA, 75 bp, Artificial Sequence
  Synthetic
caacggtccatggatgtgctttgcctcccagcaagcaaaccccggttcctcctcctaggaggaagcggacggttc

SEQ ID NO: 132798 - DNA, 75 bp, Artificial Sequence
  Synthetic
aagctgccaataagtcccttgagcaactcactattacgccaccacaacatggtgtatgccacgacttcccgttct

SEQ ID NO: 132799 - DNA, 75 bp, Artificial Sequence
  Synthetic
ggagtccaagtggcaagcccttgaggccttctgggcgaagcacatgtggaacttcatcagcgggatacagtactt

SEQ ID NO: 132800 - DNA, 75 bp, Artificial Sequence
  Synthetic
gccgtcactcggcagaaaaaggtgaccttcgaccgcgtacaactgttggacaatcattacaatgaagtcttaaag

SEQ ID NO: 132801 - DNA, 75 bp, Artificial Sequence
  Synthetic
cccatctgagacaacagactcgcgccccataatcgtggatgacgcatcagatgaaggatcttattcgtcaatgcc

SEQ ID NO: 132802 - DNA, 75 bp, Artificial Sequence
  Synthetic
cccatctgagacaacagactcgcgccccataatcgtggatgacgcatctgatgaaggatcttattcgtcaatgcc

SEQ ID NO: 132803 - DNA, 75 bp, Artificial Sequence
  Synthetic
cccatctgagacaacagactcgcgccccataatcgtggatgacgcatccgatgaaggatcttattcgtcaatgcc

SEQ ID NO: 132804 - DNA, 75 bp, Artificial Sequence
  Synthetic
cccatctgagacaacagactcgcgccccataatcgtggatgacgcatcggatgaaggatcttattcgtcaatgcc

SEQ ID NO: 132805 - DNA, 75 bp, Artificial Sequence
  Synthetic
cccatctgagacaacagactcgcgccccattatcgtggatgacgcatcagatgaaggatcttattcgtcaatgcc

SEQ ID NO: 132806 - DNA, 75 bp, Artificial Sequence
  Synthetic
cccatctgagacaacagactcgcgccccattatcgtggatgacgcatctgatgaaggatcttattcgtcaatgcc

SEQ ID NO: 132807 - DNA, 75 bp, Artificial Sequence
  Synthetic
cccatctgagacaacagactcgcgccccattatcgtggatgacgcatccgatgaaggatcttattcgtcaatgcc

SEQ ID NO: 132808 - DNA, 75 bp, Artificial Sequence
  Synthetic
cccatctgagacaacagactcgcgccccattatcgtggatgacgcatcggatgaaggatcttattcgtcaatgcc

SEQ ID NO: 132809 - DNA, 75 bp, Artificial Sequence
  Synthetic
cccatctgagacaacagactcgcgccccatcatcgtggatgacgcatcagatgaaggatcttattcgtcaatgcc

SEQ ID NO: 132810 - DNA, 75 bp, Artificial Sequence
  Synthetic
cccatctgagacaacagactcgcgccccatcatcgtggatgacgcatctgatgaaggatcttattcgtcaatgcc

SEQ ID NO: 132811 - DNA, 75 bp, Artificial Sequence
  Synthetic
cccatctgagacaacagactcgcgccccatcatcgtggatgacgcatccgatgaaggatcttattcgtcaatgcc

SEQ ID NO: 132812 - DNA, 75 bp, Artificial Sequence
  Synthetic
cccatctgagacaacagactcgcgccccatcatcgtggatgacgcatcggatgaaggatcttattcgtcaatgcc

SEQ ID NO: 132813 - DNA, 75 bp, Artificial Sequence
  Synthetic
cccatctgagacaacagactcgcgccccatgatcgtggatgacgcatcagatgaaggatcttattcgtcaatgcc

SEQ ID NO: 132814 - DNA, 75 bp, Artificial Sequence
  Synthetic
cccatctgagacaacagactcgcgccccatgatcgtggatgacgcatctgatgaaggatcttattcgtcaatgcc

SEQ ID NO: 132815 - DNA, 75 bp, Artificial Sequence
  Synthetic
cccatctgagacaacagactcgcgccccatgatcgtggatgacgcatccgatgaaggatcttattcgtcaatgcc

SEQ ID NO: 132816 - DNA, 75 bp, Artificial Sequence
  Synthetic
cccatctgagacaacagactcgcgccccatgatcgtggatgacgcatcggatgaaggatcttattcgtcaatgcc

SEQ ID NO: 132817 - DNA, 75 bp, Artificial Sequence
  Synthetic
cccatctgagactacagactcgcgccccataatcgtggatgacgcatcagatgaaggatcttattcgtcaatgcc

SEQ ID NO: 132818 - DNA, 75 bp, Artificial Sequence
  Synthetic
cccatctgagactacagactcgcgccccataatcgtggatgacgcatctgatgaaggatcttattcgtcaatgcc

SEQ ID NO: 132819 - DNA, 75 bp, Artificial Sequence
  Synthetic
cccatctgagactacagactcgcgccccataatcgtggatgacgcatccgatgaaggatcttattcgtcaatgcc

SEQ ID NO: 132820 - DNA, 75 bp, Artificial Sequence
  Synthetic
cccatctgagactacagactcgcgccccataatcgtggatgacgcatcggatgaaggatcttattcgtcaatgcc

SEQ ID NO: 132821 - DNA, 75 bp, Artificial Sequence
  Synthetic
cccatctgagactacagactcgcgccccattatcgtggatgacgcatcagatgaaggatcttattcgtcaatgcc

SEQ ID NO: 132822 - DNA, 75 bp, Artificial Sequence
  Synthetic
cccatctgagactacagactcgcgccccattatcgtggatgacgcatctgatgaaggatcttattcgtcaatgcc

SEQ ID NO: 132823 - DNA, 75 bp, Artificial Sequence
  Synthetic
cccatctgagactacagactcgcgccccattatcgtggatgacgcatccgatgaaggatcttattcgtcaatgcc

SEQ ID NO: 132824 - DNA, 75 bp, Artificial Sequence
  Synthetic
cccatctgagactacagactcgcgccccattatcgtggatgacgcatcggatgaaggatcttattcgtcaatgcc

SEQ ID NO: 132825 - DNA, 75 bp, Artificial Sequence
  Synthetic
cccatctgagactacagactcgcgccccatcatcgtggatgacgcatcagatgaaggatcttattcgtcaatgcc

SEQ ID NO: 132826 - DNA, 75 bp, Artificial Sequence
  Synthetic
cccatctgagactacagactcgcgccccatcatcgtggatgacgcatctgatgaaggatcttattcgtcaatgcc

SEQ ID NO: 132827 - DNA, 75 bp, Artificial Sequence
  Synthetic
cccatctgagactacagactcgcgccccatcatcgtggatgacgcatccgatgaaggatcttattcgtcaatgcc

SEQ ID NO: 132828 - DNA, 75 bp, Artificial Sequence
  Synthetic
cccatctgagactacagactcgcgccccatcatcgtggatgacgcatcggatgaaggatcttattcgtcaatgcc

SEQ ID NO: 132829 - DNA, 75 bp, Artificial Sequence
  Synthetic
cccatctgagactacagactcgcgccccatgatcgtggatgacgcatcagatgaaggatcttattcgtcaatgcc

SEQ ID NO: 132830 - DNA, 75 bp, Artificial Sequence
  Synthetic
cccatctgagactacagactcgcgccccatgatcgtggatgacgcatctgatgaaggatcttattcgtcaatgcc

SEQ ID NO: 132831 - DNA, 75 bp, Artificial Sequence
  Synthetic
cccatctgagactacagactcgcgccccatgatcgtggatgacgcatccgatgaaggatcttattcgtcaatgcc

SEQ ID NO: 132832 - DNA, 75 bp, Artificial Sequence
  Synthetic
cccatctgagactacagactcgcgccccatgatcgtggatgacgcatcggatgaaggatcttattcgtcaatgcc

SEQ ID NO: 132833 - DNA, 75 bp, Artificial Sequence
  Synthetic
cccatctgagaccacagactcgcgccccataatcgtggatgacgcatcagatgaaggatcttattcgtcaatgcc

SEQ ID NO: 132834 - DNA, 75 bp, Artificial Sequence
  Synthetic
cccatctgagaccacagactcgcgccccataatcgtggatgacgcatctgatgaaggatcttattcgtcaatgcc

SEQ ID NO: 132835 - DNA, 75 bp, Artificial Sequence
  Synthetic
cccatctgagaccacagactcgcgccccataatcgtggatgacgcatccgatgaaggatcttattcgtcaatgcc

SEQ ID NO: 132836 - DNA, 75 bp, Artificial Sequence
  Synthetic
cccatctgagaccacagactcgcgccccataatcgtggatgacgcatcggatgaaggatcttattcgtcaatgcc

SEQ ID NO: 132837 - DNA, 75 bp, Artificial Sequence
  Synthetic
cccatctgagaccacagactcgcgccccattatcgtggatgacgcatcagatgaaggatcttattcgtcaatgcc

SEQ ID NO: 132838 - DNA, 75 bp, Artificial Sequence
  Synthetic
cccatctgagaccacagactcgcgccccattatcgtggatgacgcatctgatgaaggatcttattcgtcaatgcc

SEQ ID NO: 132839 - DNA, 75 bp, Artificial Sequence
  Synthetic
cccatctgagaccacagactcgcgccccattatcgtggatgacgcatccgatgaaggatcttattcgtcaatgcc

SEQ ID NO: 132840 - DNA, 75 bp, Artificial Sequence
  Synthetic
cccatctgagaccacagactcgcgccccattatcgtggatgacgcatcggatgaaggatcttattcgtcaatgcc

SEQ ID NO: 132841 - DNA, 75 bp, Artificial Sequence
  Synthetic
cccatctgagaccacagactcgcgccccatcatcgtggatgacgcatcagatgaaggatcttattcgtcaatgcc

SEQ ID NO: 132842 - DNA, 75 bp, Artificial Sequence
  Synthetic
cccatctgagaccacagactcgcgccccatcatcgtggatgacgcatctgatgaaggatcttattcgtcaatgcc

SEQ ID NO: 132843 - DNA, 75 bp, Artificial Sequence
  Synthetic
cccatctgagaccacagactcgcgccccatcatcgtggatgacgcatccgatgaaggatcttattcgtcaatgcc

SEQ ID NO: 132844 - DNA, 75 bp, Artificial Sequence
  Synthetic
cccatctgagaccacagactcgcgccccatcatcgtggatgacgcatcggatgaaggatcttattcgtcaatgcc

SEQ ID NO: 132845 - DNA, 75 bp, Artificial Sequence
  Synthetic
cccatctgagaccacagactcgcgccccatgatcgtggatgacgcatcagatgaaggatcttattcgtcaatgcc

SEQ ID NO: 132846 - DNA, 75 bp, Artificial Sequence
  Synthetic
cccatctgagaccacagactcgcgccccatgatcgtggatgacgcatctgatgaaggatcttattcgtcaatgcc

SEQ ID NO: 132847 - DNA, 75 bp, Artificial Sequence
  Synthetic
cccatctgagaccacagactcgcgccccatgatcgtggatgacgcatccgatgaaggatcttattcgtcaatgcc

SEQ ID NO: 132848 - DNA, 75 bp, Artificial Sequence
  Synthetic
cccatctgagaccacagactcgcgccccatgatcgtggatgacgcatcggatgaaggatcttattcgtcaatgcc

SEQ ID NO: 132849 - DNA, 75 bp, Artificial Sequence
  Synthetic
cccatctgagacgacagactcgcgccccataatcgtggatgacgcatcagatgaaggatcttattcgtcaatgcc

SEQ ID NO: 132850 - DNA, 75 bp, Artificial Sequence
  Synthetic
cccatctgagacgacagactcgcgccccataatcgtggatgacgcatctgatgaaggatcttattcgtcaatgcc

SEQ ID NO: 132851 - DNA, 75 bp, Artificial Sequence
  Synthetic
cccatctgagacgacagactcgcgccccataatcgtggatgacgcatccgatgaaggatcttattcgtcaatgcc

SEQ ID NO: 132852 - DNA, 75 bp, Artificial Sequence
  Synthetic
cccatctgagacgacagactcgcgccccataatcgtggatgacgcatcggatgaaggatcttattcgtcaatgcc

SEQ ID NO: 132853 - DNA, 75 bp, Artificial Sequence
  Synthetic
cccatctgagacgacagactcgcgccccattatcgtggatgacgcatcagatgaaggatcttattcgtcaatgcc

SEQ ID NO: 132854 - DNA, 75 bp, Artificial Sequence
  Synthetic
cccatctgagacgacagactcgcgccccattatcgtggatgacgcatctgatgaaggatcttattcgtcaatgcc

SEQ ID NO: 132855 - DNA, 75 bp, Artificial Sequence
  Synthetic
cccatctgagacgacagactcgcgccccattatcgtggatgacgcatccgatgaaggatcttattcgtcaatgcc

SEQ ID NO: 132856 - DNA, 75 bp, Artificial Sequence
  Synthetic
cccatctgagacgacagactcgcgccccattatcgtggatgacgcatcggatgaaggatcttattcgtcaatgcc

SEQ ID NO: 132857 - DNA, 75 bp, Artificial Sequence
  Synthetic
cccatctgagacgacagactcgcgccccatcatcgtggatgacgcatcagatgaaggatcttattcgtcaatgcc

SEQ ID NO: 132858 - DNA, 75 bp, Artificial Sequence
  Synthetic
cccatctgagacgacagactcgcgccccatcatcgtggatgacgcatctgatgaaggatcttattcgtcaatgcc

SEQ ID NO: 132859 - DNA, 75 bp, Artificial Sequence
  Synthetic
cccatctgagacgacagactcgcgccccatcatcgtggatgacgcatccgatgaaggatcttattcgtcaatgcc

SEQ ID NO: 132860 - DNA, 75 bp, Artificial Sequence
  Synthetic
cccatctgagacgacagactcgcgccccatcatcgtggatgacgcatcggatgaaggatcttattcgtcaatgcc

SEQ ID NO: 132861 - DNA, 75 bp, Artificial Sequence
  Synthetic
cccatctgagacgacagactcgcgccccatgatcgtggatgacgcatcagatgaaggatcttattcgtcaatgcc

SEQ ID NO: 132862 - DNA, 75 bp, Artificial Sequence
  Synthetic
cccatctgagacgacagactcgcgccccatgatcgtggatgacgcatctgatgaaggatcttattcgtcaatgcc

SEQ ID NO: 132863 - DNA, 75 bp, Artificial Sequence
  Synthetic
cccatctgagacgacagactcgcgccccatgatcgtggatgacgcatccgatgaaggatcttattcgtcaatgcc

SEQ ID NO: 132864 - DNA, 75 bp, Artificial Sequence
  Synthetic
cccatctgagacgacagactcgcgccccatgatcgtggatgacgcatcggatgaaggatcttattcgtcaatgcc

SEQ ID NO: 132865 - DNA, 75 bp, Artificial Sequence
  Synthetic
tgctgggtagcgctcactcccacgctcgcggccaggaacgccagcgtccccactacgacaatacgacgccatgtc

SEQ ID NO: 132866 - DNA, 75 bp, Artificial Sequence
  Synthetic
tgcgaaaagagagcgcttcatgacgccgtcaagaacctatctacagccgtgatgggagcctcatacggcttccaa

SEQ ID NO: 132867 - DNA, 75 bp, Artificial Sequence
  Synthetic
gagagtccctatggggttctcatatgacactcgctgttttgactccactgttactgaaagagacatcaggactga

SEQ ID NO: 132868 - DNA, 75 bp, Artificial Sequence
  Synthetic
gagtgtccctatggggttctcatatgacactcgctgttttgactccactgttactgaaagagacatcaggactga

SEQ ID NO: 132869 - DNA, 75 bp, Artificial Sequence
  Synthetic
gagcgtccctatggggttctcatatgacactcgctgttttgactccactgttactgaaagagacatcaggactga

SEQ ID NO: 132870 - DNA, 75 bp, Artificial Sequence
  Synthetic
gagggtccctatggggttctcatatgacactcgctgttttgactccactgttactgaaagagacatcaggactga

SEQ ID NO: 132871 - DNA, 75 bp, Artificial Sequence
  Synthetic
gtgtatgaagccgatgacgttattctgcacacacccggctgtataccttgtgttcaggacggcaatacatctacg

SEQ ID NO: 132872 - DNA, 75 bp, Artificial Sequence
  Synthetic
agtcctagcgggccttgcctactattccatggtggggaactgggctaaggttctgattgtgatgctactttttgc

SEQ ID NO: 132873 - DNA, 75 bp, Artificial Sequence
  Synthetic
aagggggacctatgcgggtaccgcaggtgccgcgcaagcggcgtattcaccaccagcttcgggaacacactgacg

SEQ ID NO: 132874 - DNA, 75 bp, Artificial Sequence
  Synthetic
tgcgcccccttgcaagcccttgctgcgggaggaggtatcattcagagtaggactccacgagtacccggtggggtc

SEQ ID NO: 132875 - DNA, 75 bp, Artificial Sequence
  Synthetic
ggtgccgcgcaagcggcgtattcaccaccagcttcgggaacacactgacgtgctacctcaaggccacagccgcta

SEQ ID NO: 132876 - DNA, 75 bp, Artificial Sequence
  Synthetic
cccttgcaagcccttgctacgagaggaggtgtcattcagagtaggactacacgattacccggtggggtcgcaatt

SEQ ID NO: 132877 - DNA, 75 bp, Artificial Sequence
  Synthetic
ctcacagaaagactctaagtgggcggccccatgcacaacagcaagggagacctttgtgggtatcggagatgccgc

SEQ ID NO: 132878 - DNA, 75 bp, Artificial Sequence
  Synthetic
ctcacagaaagactctatgtgggcggccccatgcacaacagcaagggagacctttgtgggtatcggagatgccgc

SEQ ID NO: 132879 - DNA, 75 bp, Artificial Sequence
  Synthetic
ctcacagaaagactctacgtgggcggccccatgcacaacagcaagggagacctttgtgggtatcggagatgccgc

SEQ ID NO: 132880 - DNA, 75 bp, Artificial Sequence
  Synthetic
ctcacagaaagactctaggtgggcggccccatgcacaacagcaagggagacctttgtgggtatcggagatgccgc

SEQ ID NO: 132881 - DNA, 75 bp, Artificial Sequence
  Synthetic
gattgccttcacggaggctatgacgaggtattcggctccccccggagacgccccgcagccagcatatgatctgga

SEQ ID NO: 132882 - DNA, 75 bp, Artificial Sequence
  Synthetic
gaggcaggagatgggcggcaacatcaccagggttgagtcagagaacaaagtggtgattctggactccttcgatcc

SEQ ID NO: 132883 - DNA, 75 bp, Artificial Sequence
  Synthetic
gtctcggtcgcgcacgacgcgacgggcaagagggtatactacctgacccgggaccccgagacccccctagcccgt

SEQ ID NO: 132884 - DNA, 75 bp, Artificial Sequence
  Synthetic
tggccagggggtctcccccctccttggccagctcttcagctagccagttgtctgcgccttccttgaaggcgacat

SEQ ID NO: 132885 - DNA, 75 bp, Artificial Sequence
  Synthetic
actgccttggccgagcttgccaccaaaagttttggcagctcctcaacttccggcattacgggcgacaatacgaca

SEQ ID NO: 132886 - DNA, 75 bp, Artificial Sequence
  Synthetic
gggggtctcccccctccttggccagttcttcagccagccagttgtctgcgccttctttgaaggcgacatgcacta

SEQ ID NO: 132887 - DNA, 75 bp, Artificial Sequence
  Synthetic
ggtttaactctactggatgtcctcaaaggctcagcagctgcaggcccatcactttcttcgggcaggggtggggcc

SEQ ID NO: 132888 - DNA, 75 bp, Artificial Sequence
  Synthetic
ccaaatgtggaagtgtctcatacggctaaagcctacgctgcacgggccaacacccctgctgtataggctaggagc

SEQ ID NO: 132889 - DNA, 75 bp, Artificial Sequence
  Synthetic
agtgtgggtcggggccttggttgacacctaggtgcttggttgattacccatacagactctggcactacccctgca

SEQ ID NO: 132890 - DNA, 75 bp, Artificial Sequence
  Synthetic
gggcccgagcagtccgcgccaagcttatcgcccaaggggggagagctaagatctgcggcatctacctcttcaact

SEQ ID NO: 132891 - DNA, 75 bp, Artificial Sequence
  Synthetic
tggcactacgcacctagaccttgtgacactgtcccggcatcgagtgtctgcggccctgtgtactgcttcacacca

SEQ ID NO: 132892 - DNA, 75 bp, Artificial Sequence
  Synthetic
ctggggcgagaatgagacagacgtgtttctgttgcagtcccagcggcctcccagtggtcggtggtttgggtgtac

SEQ ID NO: 132893 - DNA, 75 bp, Artificial Sequence
  Synthetic
gtttgggagacggaaggactcatcctgcacacacccgggtgcgtgccctgcgtccgagagggtaacacttctcgg

SEQ ID NO: 132894 - DNA, 75 bp, Artificial Sequence
  Synthetic
acagtcgaagcccagaggaaggcgccagcccataccaaaggcgcgccgccaaacgggccgtacctgggctcagcc

SEQ ID NO: 132895 - DNA, 75 bp, Artificial Sequence
  Synthetic
acagtcgaagcccagaggtaggcgccagcccataccaaaggcgcgccgccaaacgggccgtacctgggctcagcc

SEQ ID NO: 132896 - DNA, 75 bp, Artificial Sequence
  Synthetic
acagtcgaagcccagaggcaggcgccagcccataccaaaggcgcgccgccaaacgggccgtacctgggctcagcc

SEQ ID NO: 132897 - DNA, 75 bp, Artificial Sequence
  Synthetic
acagtcgaagcccagagggaggcgccagcccataccaaaggcgcgccgccaaacgggccgtacctgggctcagcc

SEQ ID NO: 132898 - DNA, 75 bp, Artificial Sequence
  Synthetic
acagtcgtagcccagaggaaggcgccagcccataccaaaggcgcgccgccaaacgggccgtacctgggctcagcc

SEQ ID NO: 132899 - DNA, 75 bp, Artificial Sequence
  Synthetic
acagtcgtagcccagaggtaggcgccagcccataccaaaggcgcgccgccaaacgggccgtacctgggctcagcc

SEQ ID NO: 132900 - DNA, 75 bp, Artificial Sequence
  Synthetic
acagtcgtagcccagaggcaggcgccagcccataccaaaggcgcgccgccaaacgggccgtacctgggctcagcc

SEQ ID NO: 132901 - DNA, 75 bp, Artificial Sequence
  Synthetic
acagtcgtagcccagagggaggcgccagcccataccaaaggcgcgccgccaaacgggccgtacctgggctcagcc

SEQ ID NO: 132902 - DNA, 75 bp, Artificial Sequence
  Synthetic
acagtcgcagcccagaggaaggcgccagcccataccaaaggcgcgccgccaaacgggccgtacctgggctcagcc

SEQ ID NO: 132903 - DNA, 75 bp, Artificial Sequence
  Synthetic
acagtcgcagcccagaggtaggcgccagcccataccaaaggcgcgccgccaaacgggccgtacctgggctcagcc

SEQ ID NO: 132904 - DNA, 75 bp, Artificial Sequence
  Synthetic
acagtcgcagcccagaggcaggcgccagcccataccaaaggcgcgccgccaaacgggccgtacctgggctcagcc

SEQ ID NO: 132905 - DNA, 75 bp, Artificial Sequence
  Synthetic
acagtcgcagcccagagggaggcgccagcccataccaaaggcgcgccgccaaacgggccgtacctgggctcagcc

SEQ ID NO: 132906 - DNA, 75 bp, Artificial Sequence
  Synthetic
acagtcggagcccagaggaaggcgccagcccataccaaaggcgcgccgccaaacgggccgtacctgggctcagcc

SEQ ID NO: 132907 - DNA, 75 bp, Artificial Sequence
  Synthetic
acagtcggagcccagaggtaggcgccagcccataccaaaggcgcgccgccaaacgggccgtacctgggctcagcc

SEQ ID NO: 132908 - DNA, 75 bp, Artificial Sequence
  Synthetic
acagtcggagcccagaggcaggcgccagcccataccaaaggcgcgccgccaaacgggccgtacctgggctcagcc

SEQ ID NO: 132909 - DNA, 75 bp, Artificial Sequence
  Synthetic
acagtcggagcccagagggaggcgccagcccataccaaaggcgcgccgccaaacgggccgtacctgggctcagcc

SEQ ID NO: 132910 - DNA, 75 bp, Artificial Sequence
  Synthetic
actgtcgaagcccagaggaaggcgccagcccataccaaaggcgcgccgccaaacgggccgtacctgggctcagcc

SEQ ID NO: 132911 - DNA, 75 bp, Artificial Sequence
  Synthetic
actgtcgaagcccagaggtaggcgccagcccataccaaaggcgcgccgccaaacgggccgtacctgggctcagcc

SEQ ID NO: 132912 - DNA, 75 bp, Artificial Sequence
  Synthetic
actgtcgaagcccagaggcaggcgccagcccataccaaaggcgcgccgccaaacgggccgtacctgggctcagcc

SEQ ID NO: 132913 - DNA, 75 bp, Artificial Sequence
  Synthetic
actgtcgaagcccagagggaggcgccagcccataccaaaggcgcgccgccaaacgggccgtacctgggctcagcc

SEQ ID NO: 132914 - DNA, 75 bp, Artificial Sequence
  Synthetic
actgtcgtagcccagaggaaggcgccagcccataccaaaggcgcgccgccaaacgggccgtacctgggctcagcc

SEQ ID NO: 132915 - DNA, 75 bp, Artificial Sequence
  Synthetic
actgtcgtagcccagaggtaggcgccagcccataccaaaggcgcgccgccaaacgggccgtacctgggctcagcc

SEQ ID NO: 132916 - DNA, 75 bp, Artificial Sequence
  Synthetic
actgtcgtagcccagaggcaggcgccagcccataccaaaggcgcgccgccaaacgggccgtacctgggctcagcc

SEQ ID NO: 132917 - DNA, 75 bp, Artificial Sequence
  Synthetic
actgtcgtagcccagagggaggcgccagcccataccaaaggcgcgccgccaaacgggccgtacctgggctcagcc

SEQ ID NO: 132918 - DNA, 75 bp, Artificial Sequence
  Synthetic
actgtcgcagcccagaggaaggcgccagcccataccaaaggcgcgccgccaaacgggccgtacctgggctcagcc

SEQ ID NO: 132919 - DNA, 75 bp, Artificial Sequence
  Synthetic
actgtcgcagcccagaggtaggcgccagcccataccaaaggcgcgccgccaaacgggccgtacctgggctcagcc

SEQ ID NO: 132920 - DNA, 75 bp, Artificial Sequence
  Synthetic
actgtcgcagcccagaggcaggcgccagcccataccaaaggcgcgccgccaaacgggccgtacctgggctcagcc

SEQ ID NO: 132921 - DNA, 75 bp, Artificial Sequence
  Synthetic
actgtcgcagcccagagggaggcgccagcccataccaaaggcgcgccgccaaacgggccgtacctgggctcagcc

SEQ ID NO: 132922 - DNA, 75 bp, Artificial Sequence
  Synthetic
actgtcggagcccagaggaaggcgccagcccataccaaaggcgcgccgccaaacgggccgtacctgggctcagcc

SEQ ID NO: 132923 - DNA, 75 bp, Artificial Sequence
  Synthetic
actgtcggagcccagaggtaggcgccagcccataccaaaggcgcgccgccaaacgggccgtacctgggctcagcc

SEQ ID NO: 132924 - DNA, 75 bp, Artificial Sequence
  Synthetic
actgtcggagcccagaggcaggcgccagcccataccaaaggcgcgccgccaaacgggccgtacctgggctcagcc

SEQ ID NO: 132925 - DNA, 75 bp, Artificial Sequence
  Synthetic
actgtcggagcccagagggaggcgccagcccataccaaaggcgcgccgccaaacgggccgtacctgggctcagcc

SEQ ID NO: 132926 - DNA, 75 bp, Artificial Sequence
  Synthetic
accgtcgaagcccagaggaaggcgccagcccataccaaaggcgcgccgccaaacgggccgtacctgggctcagcc

SEQ ID NO: 132927 - DNA, 75 bp, Artificial Sequence
  Synthetic
accgtcgaagcccagaggtaggcgccagcccataccaaaggcgcgccgccaaacgggccgtacctgggctcagcc

SEQ ID NO: 132928 - DNA, 75 bp, Artificial Sequence
  Synthetic
accgtcgaagcccagaggcaggcgccagcccataccaaaggcgcgccgccaaacgggccgtacctgggctcagcc

SEQ ID NO: 132929 - DNA, 75 bp, Artificial Sequence
  Synthetic
accgtcgaagcccagagggaggcgccagcccataccaaaggcgcgccgccaaacgggccgtacctgggctcagcc

SEQ ID NO: 132930 - DNA, 75 bp, Artificial Sequence
  Synthetic
accgtcgtagcccagaggaaggcgccagcccataccaaaggcgcgccgccaaacgggccgtacctgggctcagcc

SEQ ID NO: 132931 - DNA, 75 bp, Artificial Sequence
  Synthetic
accgtcgtagcccagaggtaggcgccagcccataccaaaggcgcgccgccaaacgggccgtacctgggctcagcc

SEQ ID NO: 132932 - DNA, 75 bp, Artificial Sequence
  Synthetic
accgtcgtagcccagaggcaggcgccagcccataccaaaggcgcgccgccaaacgggccgtacctgggctcagcc

SEQ ID NO: 132933 - DNA, 75 bp, Artificial Sequence
  Synthetic
accgtcgtagcccagagggaggcgccagcccataccaaaggcgcgccgccaaacgggccgtacctgggctcagcc

SEQ ID NO: 132934 - DNA, 75 bp, Artificial Sequence
  Synthetic
accgtcgcagcccagaggaaggcgccagcccataccaaaggcgcgccgccaaacgggccgtacctgggctcagcc

SEQ ID NO: 132935 - DNA, 75 bp, Artificial Sequence
  Synthetic
accgtcgcagcccagaggtaggcgccagcccataccaaaggcgcgccgccaaacgggccgtacctgggctcagcc

SEQ ID NO: 132936 - DNA, 75 bp, Artificial Sequence
  Synthetic
accgtcgcagcccagaggcaggcgccagcccataccaaaggcgcgccgccaaacgggccgtacctgggctcagcc

SEQ ID NO: 132937 - DNA, 75 bp, Artificial Sequence
  Synthetic
accgtcgcagcccagagggaggcgccagcccataccaaaggcgcgccgccaaacgggccgtacctgggctcagcc

SEQ ID NO: 132938 - DNA, 75 bp, Artificial Sequence
  Synthetic
accgtcggagcccagaggaaggcgccagcccataccaaaggcgcgccgccaaacgggccgtacctgggctcagcc

SEQ ID NO: 132939 - DNA, 75 bp, Artificial Sequence
  Synthetic
accgtcggagcccagaggtaggcgccagcccataccaaaggcgcgccgccaaacgggccgtacctgggctcagcc

SEQ ID NO: 132940 - DNA, 75 bp, Artificial Sequence
  Synthetic
accgtcggagcccagaggcaggcgccagcccataccaaaggcgcgccgccaaacgggccgtacctgggctcagcc

SEQ ID NO: 132941 - DNA, 75 bp, Artificial Sequence
  Synthetic
accgtcggagcccagagggaggcgccagcccataccaaaggcgcgccgccaaacgggccgtacctgggctcagcc

SEQ ID NO: 132942 - DNA, 75 bp, Artificial Sequence
  Synthetic
acggtcgaagcccagaggaaggcgccagcccataccaaaggcgcgccgccaaacgggccgtacctgggctcagcc

SEQ ID NO: 132943 - DNA, 75 bp, Artificial Sequence
  Synthetic
acggtcgaagcccagaggtaggcgccagcccataccaaaggcgcgccgccaaacgggccgtacctgggctcagcc

SEQ ID NO: 132944 - DNA, 75 bp, Artificial Sequence
  Synthetic
acggtcgaagcccagaggcaggcgccagcccataccaaaggcgcgccgccaaacgggccgtacctgggctcagcc

SEQ ID NO: 132945 - DNA, 75 bp, Artificial Sequence
  Synthetic
acggtcgaagcccagagggaggcgccagcccataccaaaggcgcgccgccaaacgggccgtacctgggctcagcc

SEQ ID NO: 132946 - DNA, 75 bp, Artificial Sequence
  Synthetic
acggtcgtagcccagaggaaggcgccagcccataccaaaggcgcgccgccaaacgggccgtacctgggctcagcc

SEQ ID NO: 132947 - DNA, 75 bp, Artificial Sequence
  Synthetic
acggtcgtagcccagaggtaggcgccagcccataccaaaggcgcgccgccaaacgggccgtacctgggctcagcc

SEQ ID NO: 132948 - DNA, 75 bp, Artificial Sequence
  Synthetic
acggtcgtagcccagaggcaggcgccagcccataccaaaggcgcgccgccaaacgggccgtacctgggctcagcc

SEQ ID NO: 132949 - DNA, 75 bp, Artificial Sequence
  Synthetic
acggtcgtagcccagagggaggcgccagcccataccaaaggcgcgccgccaaacgggccgtacctgggctcagcc

SEQ ID NO: 132950 - DNA, 75 bp, Artificial Sequence
  Synthetic
acggtcgcagcccagaggaaggcgccagcccataccaaaggcgcgccgccaaacgggccgtacctgggctcagcc

SEQ ID NO: 132951 - DNA, 75 bp, Artificial Sequence
  Synthetic
acggtcgcagcccagaggtaggcgccagcccataccaaaggcgcgccgccaaacgggccgtacctgggctcagcc

SEQ ID NO: 132952 - DNA, 75 bp, Artificial Sequence
  Synthetic
acggtcgcagcccagaggcaggcgccagcccataccaaaggcgcgccgccaaacgggccgtacctgggctcagcc

SEQ ID NO: 132953 - DNA, 75 bp, Artificial Sequence
  Synthetic
acggtcgcagcccagagggaggcgccagcccataccaaaggcgcgccgccaaacgggccgtacctgggctcagcc

SEQ ID NO: 132954 - DNA, 75 bp, Artificial Sequence
  Synthetic
acggtcggagcccagaggaaggcgccagcccataccaaaggcgcgccgccaaacgggccgtacctgggctcagcc

SEQ ID NO: 132955 - DNA, 75 bp, Artificial Sequence
  Synthetic
acggtcggagcccagaggtaggcgccagcccataccaaaggcgcgccgccaaacgggccgtacctgggctcagcc

SEQ ID NO: 132956 - DNA, 75 bp, Artificial Sequence
  Synthetic
acggtcggagcccagaggcaggcgccagcccataccaaaggcgcgccgccaaacgggccgtacctgggctcagcc

SEQ ID NO: 132957 - DNA, 75 bp, Artificial Sequence
  Synthetic
acggtcggagcccagagggaggcgccagcccataccaaaggcgcgccgccaaacgggccgtacctgggctcagcc

SEQ ID NO: 132958 - DNA, 75 bp, Artificial Sequence
  Synthetic
cgatctcagcgacgggtcttggtctaccgtgagcgaggaggctagtgaggacgtcgtctgctgctcgatgtccta

SEQ ID NO: 132959 - DNA, 75 bp, Artificial Sequence
  Synthetic
tctgttctgctatgtacgtgggggacctttgcggatccgttttcctagttggccagctatttgttttctcgcccc

SEQ ID NO: 132960 - DNA, 75 bp, Artificial Sequence
  Synthetic
ggccagctatttgttttctcgccccgtcaccattggacgacgcaagactgcaattgttcactctacccaggccac

SEQ ID NO: 132961 - DNA, 75 bp, Artificial Sequence
  Synthetic
gacaggcgccctgatcacaccatgcgccgcggaggagagcaagctgcccatcaatgcgttgagcaactctttgct

SEQ ID NO: 132962 - DNA, 75 bp, Artificial Sequence
  Synthetic
gaccttgtcaccatactataaagtgttcctcgccaggctcatatggtggttacaatactttatcaccagagccga

SEQ ID NO: 132963 - DNA, 75 bp, Artificial Sequence
  Synthetic
taccatgtcaccaatgattgccctaactcgagtattgtgtacgagacggccgacaccatcctgcacactccgggg

SEQ ID NO: 132964 - DNA, 75 bp, Artificial Sequence
  Synthetic
aaaagtctggtctctatcatctgaccaacgactgccccaactccagcatcgtgtatgaggaagacacagtgatcc

SEQ ID NO: 132965 - DNA, 75 bp, Artificial Sequence
  Synthetic
aaaagtctggtctctatcatctgaccaacgactgccccaactccagcatcgtgtatgaggaagacactgtgatcc

SEQ ID NO: 132966 - DNA, 75 bp, Artificial Sequence
  Synthetic
aaaagtctggtctctatcatctgaccaacgactgccccaactccagcatcgtgtatgaggaagacaccgtgatcc

SEQ ID NO: 132967 - DNA, 75 bp, Artificial Sequence
  Synthetic
aaaagtctggtctctatcatctgaccaacgactgccccaactccagcatcgtgtatgaggaagacacggtgatcc

SEQ ID NO: 132968 - DNA, 75 bp, Artificial Sequence
  Synthetic
aaaagtctggtctctatcatctgaccaacgactgccccaactccagcatcgtgtatgaggtagacacagtgatcc

SEQ ID NO: 132969 - DNA, 75 bp, Artificial Sequence
  Synthetic
aaaagtctggtctctatcatctgaccaacgactgccccaactccagcatcgtgtatgaggtagacactgtgatcc

SEQ ID NO: 132970 - DNA, 75 bp, Artificial Sequence
  Synthetic
aaaagtctggtctctatcatctgaccaacgactgccccaactccagcatcgtgtatgaggtagacaccgtgatcc

SEQ ID NO: 132971 - DNA, 75 bp, Artificial Sequence
  Synthetic
aaaagtctggtctctatcatctgaccaacgactgccccaactccagcatcgtgtatgaggtagacacggtgatcc

SEQ ID NO: 132972 - DNA, 75 bp, Artificial Sequence
  Synthetic
aaaagtctggtctctatcatctgaccaacgactgccccaactccagcatcgtgtatgaggcagacacagtgatcc

SEQ ID NO: 132973 - DNA, 75 bp, Artificial Sequence
  Synthetic
aaaagtctggtctctatcatctgaccaacgactgccccaactccagcatcgtgtatgaggcagacactgtgatcc

SEQ ID NO: 132974 - DNA, 75 bp, Artificial Sequence
  Synthetic
aaaagtctggtctctatcatctgaccaacgactgccccaactccagcatcgtgtatgaggcagacaccgtgatcc

SEQ ID NO: 132975 - DNA, 75 bp, Artificial Sequence
  Synthetic
aaaagtctggtctctatcatctgaccaacgactgccccaactccagcatcgtgtatgaggcagacacggtgatcc

SEQ ID NO: 132976 - DNA, 75 bp, Artificial Sequence
  Synthetic
aaaagtctggtctctatcatctgaccaacgactgccccaactccagcatcgtgtatgagggagacacagtgatcc

SEQ ID NO: 132977 - DNA, 75 bp, Artificial Sequence
  Synthetic
aaaagtctggtctctatcatctgaccaacgactgccccaactccagcatcgtgtatgagggagacactgtgatcc

SEQ ID NO: 132978 - DNA, 75 bp, Artificial Sequence
  Synthetic
aaaagtctggtctctatcatctgaccaacgactgccccaactccagcatcgtgtatgagggagacaccgtgatcc

SEQ ID NO: 132979 - DNA, 75 bp, Artificial Sequence
  Synthetic
aaaagtctggtctctatcatctgaccaacgactgccccaactccagcatcgtgtatgagggagacacggtgatcc

SEQ ID NO: 132980 - DNA, 75 bp, Artificial Sequence
  Synthetic
ataagtctggtctctatcatctgaccaacgactgccccaactccagcatcgtgtatgaggaagacacagtgatcc

SEQ ID NO: 132981 - DNA, 75 bp, Artificial Sequence
  Synthetic
ataagtctggtctctatcatctgaccaacgactgccccaactccagcatcgtgtatgaggaagacactgtgatcc

SEQ ID NO: 132982 - DNA, 75 bp, Artificial Sequence
  Synthetic
ataagtctggtctctatcatctgaccaacgactgccccaactccagcatcgtgtatgaggaagacaccgtgatcc

SEQ ID NO: 132983 - DNA, 75 bp, Artificial Sequence
  Synthetic
ataagtctggtctctatcatctgaccaacgactgccccaactccagcatcgtgtatgaggaagacacggtgatcc

SEQ ID NO: 132984 - DNA, 75 bp, Artificial Sequence
  Synthetic
ataagtctggtctctatcatctgaccaacgactgccccaactccagcatcgtgtatgaggtagacacagtgatcc

SEQ ID NO: 132985 - DNA, 75 bp, Artificial Sequence
  Synthetic
ataagtctggtctctatcatctgaccaacgactgccccaactccagcatcgtgtatgaggtagacactgtgatcc

SEQ ID NO: 132986 - DNA, 75 bp, Artificial Sequence
  Synthetic
ataagtctggtctctatcatctgaccaacgactgccccaactccagcatcgtgtatgaggtagacaccgtgatcc

SEQ ID NO: 132987 - DNA, 75 bp, Artificial Sequence
  Synthetic
ataagtctggtctctatcatctgaccaacgactgccccaactccagcatcgtgtatgaggtagacacggtgatcc

SEQ ID NO: 132988 - DNA, 75 bp, Artificial Sequence
  Synthetic
ataagtctggtctctatcatctgaccaacgactgccccaactccagcatcgtgtatgaggcagacacagtgatcc

SEQ ID NO: 132989 - DNA, 75 bp, Artificial Sequence
  Synthetic
ataagtctggtctctatcatctgaccaacgactgccccaactccagcatcgtgtatgaggcagacactgtgatcc

SEQ ID NO: 132990 - DNA, 75 bp, Artificial Sequence
  Synthetic
ataagtctggtctctatcatctgaccaacgactgccccaactccagcatcgtgtatgaggcagacaccgtgatcc

SEQ ID NO: 132991 - DNA, 75 bp, Artificial Sequence
  Synthetic
ataagtctggtctctatcatctgaccaacgactgccccaactccagcatcgtgtatgaggcagacacggtgatcc

SEQ ID NO: 132992 - DNA, 75 bp, Artificial Sequence
  Synthetic
ataagtctggtctctatcatctgaccaacgactgccccaactccagcatcgtgtatgagggagacacagtgatcc

SEQ ID NO: 132993 - DNA, 75 bp, Artificial Sequence
  Synthetic
ataagtctggtctctatcatctgaccaacgactgccccaactccagcatcgtgtatgagggagacactgtgatcc

SEQ ID NO: 132994 - DNA, 75 bp, Artificial Sequence
  Synthetic
ataagtctggtctctatcatctgaccaacgactgccccaactccagcatcgtgtatgagggagacaccgtgatcc

SEQ ID NO: 132995 - DNA, 75 bp, Artificial Sequence
  Synthetic
ataagtctggtctctatcatctgaccaacgactgccccaactccagcatcgtgtatgagggagacacggtgatcc

SEQ ID NO: 132996 - DNA, 75 bp, Artificial Sequence
  Synthetic
acaagtctggtctctatcatctgaccaacgactgccccaactccagcatcgtgtatgaggaagacacagtgatcc

SEQ ID NO: 132997 - DNA, 75 bp, Artificial Sequence
  Synthetic
acaagtctggtctctatcatctgaccaacgactgccccaactccagcatcgtgtatgaggaagacactgtgatcc

SEQ ID NO: 132998 - DNA, 75 bp, Artificial Sequence
  Synthetic
acaagtctggtctctatcatctgaccaacgactgccccaactccagcatcgtgtatgaggaagacaccgtgatcc

SEQ ID NO: 132999 - DNA, 75 bp, Artificial Sequence
  Synthetic
acaagtctggtctctatcatctgaccaacgactgccccaactccagcatcgtgtatgaggaagacacggtgatcc

SEQ ID NO: 133000 - DNA, 75 bp, Artificial Sequence
  Synthetic
acaagtctggtctctatcatctgaccaacgactgccccaactccagcatcgtgtatgaggtagacacagtgatcc

SEQ ID NO: 133001 - DNA, 75 bp, Artificial Sequence
  Synthetic
acaagtctggtctctatcatctgaccaacgactgccccaactccagcatcgtgtatgaggtagacactgtgatcc

SEQ ID NO: 133002 - DNA, 75 bp, Artificial Sequence
  Synthetic
acaagtctggtctctatcatctgaccaacgactgccccaactccagcatcgtgtatgaggtagacaccgtgatcc

SEQ ID NO: 133003 - DNA, 75 bp, Artificial Sequence
  Synthetic
acaagtctggtctctatcatctgaccaacgactgccccaactccagcatcgtgtatgaggtagacacggtgatcc

SEQ ID NO: 133004 - DNA, 75 bp, Artificial Sequence
  Synthetic
acaagtctggtctctatcatctgaccaacgactgccccaactccagcatcgtgtatgaggcagacacagtgatcc

SEQ ID NO: 133005 - DNA, 75 bp, Artificial Sequence
  Synthetic
acaagtctggtctctatcatctgaccaacgactgccccaactccagcatcgtgtatgaggcagacactgtgatcc

SEQ ID NO: 133006 - DNA, 75 bp, Artificial Sequence
  Synthetic
acaagtctggtctctatcatctgaccaacgactgccccaactccagcatcgtgtatgaggcagacaccgtgatcc

SEQ ID NO: 133007 - DNA, 75 bp, Artificial Sequence
  Synthetic
acaagtctggtctctatcatctgaccaacgactgccccaactccagcatcgtgtatgaggcagacacggtgatcc

SEQ ID NO: 133008 - DNA, 75 bp, Artificial Sequence
  Synthetic
acaagtctggtctctatcatctgaccaacgactgccccaactccagcatcgtgtatgagggagacacagtgatcc

SEQ ID NO: 133009 - DNA, 75 bp, Artificial Sequence
  Synthetic
acaagtctggtctctatcatctgaccaacgactgccccaactccagcatcgtgtatgagggagacactgtgatcc

SEQ ID NO: 133010 - DNA, 75 bp, Artificial Sequence
  Synthetic
acaagtctggtctctatcatctgaccaacgactgccccaactccagcatcgtgtatgagggagacaccgtgatcc

SEQ ID NO: 133011 - DNA, 75 bp, Artificial Sequence
  Synthetic
acaagtctggtctctatcatctgaccaacgactgccccaactccagcatcgtgtatgagggagacacggtgatcc

SEQ ID NO: 133012 - DNA, 75 bp, Artificial Sequence
  Synthetic
agaagtctggtctctatcatctgaccaacgactgccccaactccagcatcgtgtatgaggaagacacagtgatcc

SEQ ID NO: 133013 - DNA, 75 bp, Artificial Sequence
  Synthetic
agaagtctggtctctatcatctgaccaacgactgccccaactccagcatcgtgtatgaggaagacactgtgatcc

SEQ ID NO: 133014 - DNA, 75 bp, Artificial Sequence
  Synthetic
agaagtctggtctctatcatctgaccaacgactgccccaactccagcatcgtgtatgaggaagacaccgtgatcc

SEQ ID NO: 133015 - DNA, 75 bp, Artificial Sequence
  Synthetic
agaagtctggtctctatcatctgaccaacgactgccccaactccagcatcgtgtatgaggaagacacggtgatcc

SEQ ID NO: 133016 - DNA, 75 bp, Artificial Sequence
  Synthetic
agaagtctggtctctatcatctgaccaacgactgccccaactccagcatcgtgtatgaggtagacacagtgatcc

SEQ ID NO: 133017 - DNA, 75 bp, Artificial Sequence
  Synthetic
agaagtctggtctctatcatctgaccaacgactgccccaactccagcatcgtgtatgaggtagacactgtgatcc

SEQ ID NO: 133018 - DNA, 75 bp, Artificial Sequence
  Synthetic
agaagtctggtctctatcatctgaccaacgactgccccaactccagcatcgtgtatgaggtagacaccgtgatcc

SEQ ID NO: 133019 - DNA, 75 bp, Artificial Sequence
  Synthetic
agaagtctggtctctatcatctgaccaacgactgccccaactccagcatcgtgtatgaggtagacacggtgatcc

SEQ ID NO: 133020 - DNA, 75 bp, Artificial Sequence
  Synthetic
agaagtctggtctctatcatctgaccaacgactgccccaactccagcatcgtgtatgaggcagacacagtgatcc

SEQ ID NO: 133021 - DNA, 75 bp, Artificial Sequence
  Synthetic
agaagtctggtctctatcatctgaccaacgactgccccaactccagcatcgtgtatgaggcagacactgtgatcc

SEQ ID NO: 133022 - DNA, 75 bp, Artificial Sequence
  Synthetic
agaagtctggtctctatcatctgaccaacgactgccccaactccagcatcgtgtatgaggcagacaccgtgatcc

SEQ ID NO: 133023 - DNA, 75 bp, Artificial Sequence
  Synthetic
agaagtctggtctctatcatctgaccaacgactgccccaactccagcatcgtgtatgaggcagacacggtgatcc

SEQ ID NO: 133024 - DNA, 75 bp, Artificial Sequence
  Synthetic
agaagtctggtctctatcatctgaccaacgactgccccaactccagcatcgtgtatgagggagacacagtgatcc

SEQ ID NO: 133025 - DNA, 75 bp, Artificial Sequence
  Synthetic
agaagtctggtctctatcatctgaccaacgactgccccaactccagcatcgtgtatgagggagacactgtgatcc

SEQ ID NO: 133026 - DNA, 75 bp, Artificial Sequence
  Synthetic
agaagtctggtctctatcatctgaccaacgactgccccaactccagcatcgtgtatgagggagacaccgtgatcc

SEQ ID NO: 133027 - DNA, 75 bp, Artificial Sequence
  Synthetic
agaagtctggtctctatcatctgaccaacgactgccccaactccagcatcgtgtatgagggagacacggtgatcc

SEQ ID NO: 133028 - DNA, 75 bp, Artificial Sequence
  Synthetic
tcctggatcacagcagaacatccagctcatcaacaccaatggcagctggcacattaatcgcactgccttgaattg

SEQ ID NO: 133029 - DNA, 75 bp, Artificial Sequence
  Synthetic
cgtccatgggttccgcagacatgtggacctcatggtgggggcggctacattttgctctgctatgtacgtgggtga

SEQ ID NO: 133030 - DNA, 75 bp, Artificial Sequence
  Synthetic
cgtccatgggttccgcagacatgtggacctcatggtgggggcggctactttttgctctgctatgtacgtgggtga

SEQ ID NO: 133031 - DNA, 75 bp, Artificial Sequence
  Synthetic
cgtccatgggttccgcagacatgtggacctcatggtgggggcggctaccttttgctctgctatgtacgtgggtga

SEQ ID NO: 133032 - DNA, 75 bp, Artificial Sequence
  Synthetic
cgtccatgggttccgcagacatgtggacctcatggtgggggcggctacgttttgctctgctatgtacgtgggtga

SEQ ID NO: 133033 - DNA, 75 bp, Artificial Sequence
  Synthetic
accgacttcgatcaagggtgggggcctatcacctatgccaccgacaactcaggaccccgtgatcaaaggccttac

SEQ ID NO: 133034 - DNA, 75 bp, Artificial Sequence
  Synthetic
atcactggacatcgcatggcatgggatatgatgatgaactggtctccgaccacgacgttgatcctgtcctacgtc

SEQ ID NO: 133035 - DNA, 75 bp, Artificial Sequence
  Synthetic
atcactggacatcgcatggcttgggatatgatgatgaactggtctccgaccacgacgttgatcctgtcctacgtc

SEQ ID NO: 133036 - DNA, 75 bp, Artificial Sequence
  Synthetic
atcactggacatcgcatggcctgggatatgatgatgaactggtctccgaccacgacgttgatcctgtcctacgtc

SEQ ID NO: 133037 - DNA, 75 bp, Artificial Sequence
  Synthetic
atcactggacatcgcatggcgtgggatatgatgatgaactggtctccgaccacgacgttgatcctgtcctacgtc

SEQ ID NO: 133038 - DNA, 75 bp, Artificial Sequence
  Synthetic
gcagacaccgcggcgtgcggggacatcatcttgggtctacccgtctccgcccgaagggggagggagatactcctg

SEQ ID NO: 133039 - DNA, 75 bp, Artificial Sequence
  Synthetic
ggaagttaggaacatcagttctagctactacgccaccaatgattgctcgaacagcagcatcacctggcagcttac

SEQ ID NO: 133040 - DNA, 75 bp, Artificial Sequence
  Synthetic
atattaacaggactgctctgaactgcaacgagtccatcaacaccgggttcctcgccgcgctgttctacgtacgga

SEQ ID NO: 133041 - DNA, 75 bp, Artificial Sequence
  Synthetic
ccgactcgttgggcgtccctacctacagctggggggagaacgagacagacgtgctgctcctcaacaacacacggc

SEQ ID NO: 133042 - DNA, 75 bp, Artificial Sequence
  Synthetic
tcctcgctgtcatcctcctatttgcaggggtagatgcacacaccaacatcaccggaggatcggctgctcacacaa

SEQ ID NO: 133043 - DNA, 75 bp, Artificial Sequence
  Synthetic
tcctcgctgtcatcctcctatttgcaggggtagatgcacacaccaacatcaccggaggatcggctgctcactcaa

SEQ ID NO: 133044 - DNA, 75 bp, Artificial Sequence
  Synthetic
tcctcgctgtcatcctcctatttgcaggggtagatgcacacaccaacatcaccggaggatcggctgctcacccaa

SEQ ID NO: 133045 - DNA, 75 bp, Artificial Sequence
  Synthetic
tcctcgctgtcatcctcctatttgcaggggtagatgcacacaccaacatcaccggaggatcggctgctcacgcaa

SEQ ID NO: 133046 - DNA, 75 bp, Artificial Sequence
  Synthetic
tcctcgctgtcatcctcctatttgcaggggtagatgcacacaccaacatcaccggaggatcggctgctctcacaa

SEQ ID NO: 133047 - DNA, 75 bp, Artificial Sequence
  Synthetic
tcctcgctgtcatcctcctatttgcaggggtagatgcacacaccaacatcaccggaggatcggctgctctctcaa

SEQ ID NO: 133048 - DNA, 75 bp, Artificial Sequence
  Synthetic
tcctcgctgtcatcctcctatttgcaggggtagatgcacacaccaacatcaccggaggatcggctgctctcccaa

SEQ ID NO: 133049 - DNA, 75 bp, Artificial Sequence
  Synthetic
tcctcgctgtcatcctcctatttgcaggggtagatgcacacaccaacatcaccggaggatcggctgctctcgcaa

SEQ ID NO: 133050 - DNA, 75 bp, Artificial Sequence
  Synthetic
tcctcgctgtcatcctcctatttgcaggggtagatgcacacaccaacatcaccggaggatcggctgctcccacaa

SEQ ID NO: 133051 - DNA, 75 bp, Artificial Sequence
  Synthetic
tcctcgctgtcatcctcctatttgcaggggtagatgcacacaccaacatcaccggaggatcggctgctccctcaa

SEQ ID NO: 133052 - DNA, 75 bp, Artificial Sequence
  Synthetic
tcctcgctgtcatcctcctatttgcaggggtagatgcacacaccaacatcaccggaggatcggctgctcccccaa

SEQ ID NO: 133053 - DNA, 75 bp, Artificial Sequence
  Synthetic
tcctcgctgtcatcctcctatttgcaggggtagatgcacacaccaacatcaccggaggatcggctgctcccgcaa

SEQ ID NO: 133054 - DNA, 75 bp, Artificial Sequence
  Synthetic
tcctcgctgtcatcctcctatttgcaggggtagatgcacacaccaacatcaccggaggatcggctgctcgcacaa

SEQ ID NO: 133055 - DNA, 75 bp, Artificial Sequence
  Synthetic
tcctcgctgtcatcctcctatttgcaggggtagatgcacacaccaacatcaccggaggatcggctgctcgctcaa

SEQ ID NO: 133056 - DNA, 75 bp, Artificial Sequence
  Synthetic
tcctcgctgtcatcctcctatttgcaggggtagatgcacacaccaacatcaccggaggatcggctgctcgcccaa

SEQ ID NO: 133057 - DNA, 75 bp, Artificial Sequence
  Synthetic
tcctcgctgtcatcctcctatttgcaggggtagatgcacacaccaacatcaccggaggatcggctgctcgcgcaa

SEQ ID NO: 133058 - DNA, 75 bp, Artificial Sequence
  Synthetic
tcctcgctgtcatcctcctatttgcaggggtagatgcacacaccaacatcaccggtggatcggctgctcacacaa

SEQ ID NO: 133059 - DNA, 75 bp, Artificial Sequence
  Synthetic
tcctcgctgtcatcctcctatttgcaggggtagatgcacacaccaacatcaccggtggatcggctgctcactcaa

SEQ ID NO: 133060 - DNA, 75 bp, Artificial Sequence
  Synthetic
tcctcgctgtcatcctcctatttgcaggggtagatgcacacaccaacatcaccggtggatcggctgctcacccaa

SEQ ID NO: 133061 - DNA, 75 bp, Artificial Sequence
  Synthetic
tcctcgctgtcatcctcctatttgcaggggtagatgcacacaccaacatcaccggtggatcggctgctcacgcaa

SEQ ID NO: 133062 - DNA, 75 bp, Artificial Sequence
  Synthetic
tcctcgctgtcatcctcctatttgcaggggtagatgcacacaccaacatcaccggtggatcggctgctctcacaa

SEQ ID NO: 133063 - DNA, 75 bp, Artificial Sequence
  Synthetic
tcctcgctgtcatcctcctatttgcaggggtagatgcacacaccaacatcaccggtggatcggctgctctctcaa

SEQ ID NO: 133064 - DNA, 75 bp, Artificial Sequence
  Synthetic
tcctcgctgtcatcctcctatttgcaggggtagatgcacacaccaacatcaccggtggatcggctgctctcccaa

SEQ ID NO: 133065 - DNA, 75 bp, Artificial Sequence
  Synthetic
tcctcgctgtcatcctcctatttgcaggggtagatgcacacaccaacatcaccggtggatcggctgctctcgcaa

SEQ ID NO: 133066 - DNA, 75 bp, Artificial Sequence
  Synthetic
tcctcgctgtcatcctcctatttgcaggggtagatgcacacaccaacatcaccggtggatcggctgctcccacaa

SEQ ID NO: 133067 - DNA, 75 bp, Artificial Sequence
  Synthetic
tcctcgctgtcatcctcctatttgcaggggtagatgcacacaccaacatcaccggtggatcggctgctccctcaa

SEQ ID NO: 133068 - DNA, 75 bp, Artificial Sequence
  Synthetic
tcctcgctgtcatcctcctatttgcaggggtagatgcacacaccaacatcaccggtggatcggctgctcccccaa

SEQ ID NO: 133069 - DNA, 75 bp, Artificial Sequence
  Synthetic
tcctcgctgtcatcctcctatttgcaggggtagatgcacacaccaacatcaccggtggatcggctgctcccgcaa

SEQ ID NO: 133070 - DNA, 75 bp, Artificial Sequence
  Synthetic
tcctcgctgtcatcctcctatttgcaggggtagatgcacacaccaacatcaccggtggatcggctgctcgcacaa

SEQ ID NO: 133071 - DNA, 75 bp, Artificial Sequence
  Synthetic
tcctcgctgtcatcctcctatttgcaggggtagatgcacacaccaacatcaccggtggatcggctgctcgctcaa

SEQ ID NO: 133072 - DNA, 75 bp, Artificial Sequence
  Synthetic
tcctcgctgtcatcctcctatttgcaggggtagatgcacacaccaacatcaccggtggatcggctgctcgcccaa

SEQ ID NO: 133073 - DNA, 75 bp, Artificial Sequence
  Synthetic
tcctcgctgtcatcctcctatttgcaggggtagatgcacacaccaacatcaccggtggatcggctgctcgcgcaa

SEQ ID NO: 133074 - DNA, 75 bp, Artificial Sequence
  Synthetic
tcctcgctgtcatcctcctatttgcaggggtagatgcacacaccaacatcaccggcggatcggctgctcacacaa

SEQ ID NO: 133075 - DNA, 75 bp, Artificial Sequence
  Synthetic
tcctcgctgtcatcctcctatttgcaggggtagatgcacacaccaacatcaccggcggatcggctgctcactcaa

SEQ ID NO: 133076 - DNA, 75 bp, Artificial Sequence
  Synthetic
tcctcgctgtcatcctcctatttgcaggggtagatgcacacaccaacatcaccggcggatcggctgctcacccaa

SEQ ID NO: 133077 - DNA, 75 bp, Artificial Sequence
  Synthetic
tcctcgctgtcatcctcctatttgcaggggtagatgcacacaccaacatcaccggcggatcggctgctcacgcaa

SEQ ID NO: 133078 - DNA, 75 bp, Artificial Sequence
  Synthetic
tcctcgctgtcatcctcctatttgcaggggtagatgcacacaccaacatcaccggcggatcggctgctctcacaa

SEQ ID NO: 133079 - DNA, 75 bp, Artificial Sequence
  Synthetic
tcctcgctgtcatcctcctatttgcaggggtagatgcacacaccaacatcaccggcggatcggctgctctctcaa

SEQ ID NO: 133080 - DNA, 75 bp, Artificial Sequence
  Synthetic
tcctcgctgtcatcctcctatttgcaggggtagatgcacacaccaacatcaccggcggatcggctgctctcccaa

SEQ ID NO: 133081 - DNA, 75 bp, Artificial Sequence
  Synthetic
tcctcgctgtcatcctcctatttgcaggggtagatgcacacaccaacatcaccggcggatcggctgctctcgcaa

SEQ ID NO: 133082 - DNA, 75 bp, Artificial Sequence
  Synthetic
tcctcgctgtcatcctcctatttgcaggggtagatgcacacaccaacatcaccggcggatcggctgctcccacaa

SEQ ID NO: 133083 - DNA, 75 bp, Artificial Sequence
  Synthetic
tcctcgctgtcatcctcctatttgcaggggtagatgcacacaccaacatcaccggcggatcggctgctccctcaa

SEQ ID NO: 133084 - DNA, 75 bp, Artificial Sequence
  Synthetic
tcctcgctgtcatcctcctatttgcaggggtagatgcacacaccaacatcaccggcggatcggctgctcccccaa

SEQ ID NO: 133085 - DNA, 75 bp, Artificial Sequence
  Synthetic
tcctcgctgtcatcctcctatttgcaggggtagatgcacacaccaacatcaccggcggatcggctgctcccgcaa

SEQ ID NO: 133086 - DNA, 75 bp, Artificial Sequence
  Synthetic
tcctcgctgtcatcctcctatttgcaggggtagatgcacacaccaacatcaccggcggatcggctgctcgcacaa

SEQ ID NO: 133087 - DNA, 75 bp, Artificial Sequence
  Synthetic
tcctcgctgtcatcctcctatttgcaggggtagatgcacacaccaacatcaccggcggatcggctgctcgctcaa

SEQ ID NO: 133088 - DNA, 75 bp, Artificial Sequence
  Synthetic
tcctcgctgtcatcctcctatttgcaggggtagatgcacacaccaacatcaccggcggatcggctgctcgcccaa

SEQ ID NO: 133089 - DNA, 75 bp, Artificial Sequence
  Synthetic
tcctcgctgtcatcctcctatttgcaggggtagatgcacacaccaacatcaccggcggatcggctgctcgcgcaa

SEQ ID NO: 133090 - DNA, 75 bp, Artificial Sequence
  Synthetic
tcctcgctgtcatcctcctatttgcaggggtagatgcacacaccaacatcaccgggggatcggctgctcacacaa

SEQ ID NO: 133091 - DNA, 75 bp, Artificial Sequence
  Synthetic
tcctcgctgtcatcctcctatttgcaggggtagatgcacacaccaacatcaccgggggatcggctgctcactcaa

SEQ ID NO: 133092 - DNA, 75 bp, Artificial Sequence
  Synthetic
tcctcgctgtcatcctcctatttgcaggggtagatgcacacaccaacatcaccgggggatcggctgctcacccaa

SEQ ID NO: 133093 - DNA, 75 bp, Artificial Sequence
  Synthetic
tcctcgctgtcatcctcctatttgcaggggtagatgcacacaccaacatcaccgggggatcggctgctcacgcaa

SEQ ID NO: 133094 - DNA, 75 bp, Artificial Sequence
  Synthetic
tcctcgctgtcatcctcctatttgcaggggtagatgcacacaccaacatcaccgggggatcggctgctctcacaa

SEQ ID NO: 133095 - DNA, 75 bp, Artificial Sequence
  Synthetic
tcctcgctgtcatcctcctatttgcaggggtagatgcacacaccaacatcaccgggggatcggctgctctctcaa

SEQ ID NO: 133096 - DNA, 75 bp, Artificial Sequence
  Synthetic
tcctcgctgtcatcctcctatttgcaggggtagatgcacacaccaacatcaccgggggatcggctgctctcccaa

SEQ ID NO: 133097 - DNA, 75 bp, Artificial Sequence
  Synthetic
tcctcgctgtcatcctcctatttgcaggggtagatgcacacaccaacatcaccgggggatcggctgctctcgcaa

SEQ ID NO: 133098 - DNA, 75 bp, Artificial Sequence
  Synthetic
tcctcgctgtcatcctcctatttgcaggggtagatgcacacaccaacatcaccgggggatcggctgctcccacaa

SEQ ID NO: 133099 - DNA, 75 bp, Artificial Sequence
  Synthetic
tcctcgctgtcatcctcctatttgcaggggtagatgcacacaccaacatcaccgggggatcggctgctccctcaa

SEQ ID NO: 133100 - DNA, 75 bp, Artificial Sequence
  Synthetic
tcctcgctgtcatcctcctatttgcaggggtagatgcacacaccaacatcaccgggggatcggctgctcccccaa

SEQ ID NO: 133101 - DNA, 75 bp, Artificial Sequence
  Synthetic
tcctcgctgtcatcctcctatttgcaggggtagatgcacacaccaacatcaccgggggatcggctgctcccgcaa

SEQ ID NO: 133102 - DNA, 75 bp, Artificial Sequence
  Synthetic
tcctcgctgtcatcctcctatttgcaggggtagatgcacacaccaacatcaccgggggatcggctgctcgcacaa

SEQ ID NO: 133103 - DNA, 75 bp, Artificial Sequence
  Synthetic
tcctcgctgtcatcctcctatttgcaggggtagatgcacacaccaacatcaccgggggatcggctgctcgctcaa

SEQ ID NO: 133104 - DNA, 75 bp, Artificial Sequence
  Synthetic
tcctcgctgtcatcctcctatttgcaggggtagatgcacacaccaacatcaccgggggatcggctgctcgcccaa

SEQ ID NO: 133105 - DNA, 75 bp, Artificial Sequence
  Synthetic
tcctcgctgtcatcctcctatttgcaggggtagatgcacacaccaacatcaccgggggatcggctgctcgcgcaa

SEQ ID NO: 133106 - DNA, 75 bp, Artificial Sequence
  Synthetic
accgggggatcggctgctcccccaaccggtggcctcaccggtctcttctccaccgggcctaagcagcacatccag

SEQ ID NO: 133107 - DNA, 75 bp, Artificial Sequence
  Synthetic
accgggggatcggctgctcccccaaccggtggcctcaccggtctcttctccaccgggcctatgcagcacatccag

SEQ ID NO: 133108 - DNA, 75 bp, Artificial Sequence
  Synthetic
accgggggatcggctgctcccccaaccggtggcctcaccggtctcttctccaccgggcctacgcagcacatccag

SEQ ID NO: 133109 - DNA, 75 bp, Artificial Sequence
  Synthetic
accgggggatcggctgctcccccaaccggtggcctcaccggtctcttctccaccgggcctaggcagcacatccag

SEQ ID NO: 133110 - DNA, 75 bp, Artificial Sequence
  Synthetic
accgggggatcggctgctcccccaaccggtggcctctccggtctcttctccaccgggcctaagcagcacatccag

SEQ ID NO: 133111 - DNA, 75 bp, Artificial Sequence
  Synthetic
accgggggatcggctgctcccccaaccggtggcctctccggtctcttctccaccgggcctatgcagcacatccag

SEQ ID NO: 133112 - DNA, 75 bp, Artificial Sequence
  Synthetic
accgggggatcggctgctcccccaaccggtggcctctccggtctcttctccaccgggcctacgcagcacatccag

SEQ ID NO: 133113 - DNA, 75 bp, Artificial Sequence
  Synthetic
accgggggatcggctgctcccccaaccggtggcctctccggtctcttctccaccgggcctaggcagcacatccag

SEQ ID NO: 133114 - DNA, 75 bp, Artificial Sequence
  Synthetic
accgggggatcggctgctcccccaaccggtggcctccccggtctcttctccaccgggcctaagcagcacatccag

SEQ ID NO: 133115 - DNA, 75 bp, Artificial Sequence
  Synthetic
accgggggatcggctgctcccccaaccggtggcctccccggtctcttctccaccgggcctatgcagcacatccag

SEQ ID NO: 133116 - DNA, 75 bp, Artificial Sequence
  Synthetic
accgggggatcggctgctcccccaaccggtggcctccccggtctcttctccaccgggcctacgcagcacatccag

SEQ ID NO: 133117 - DNA, 75 bp, Artificial Sequence
  Synthetic
accgggggatcggctgctcccccaaccggtggcctccccggtctcttctccaccgggcctaggcagcacatccag

SEQ ID NO: 133118 - DNA, 75 bp, Artificial Sequence
  Synthetic
accgggggatcggctgctcccccaaccggtggcctcgccggtctcttctccaccgggcctaagcagcacatccag

SEQ ID NO: 133119 - DNA, 75 bp, Artificial Sequence
  Synthetic
accgggggatcggctgctcccccaaccggtggcctcgccggtctcttctccaccgggcctatgcagcacatccag

SEQ ID NO: 133120 - DNA, 75 bp, Artificial Sequence
  Synthetic
accgggggatcggctgctcccccaaccggtggcctcgccggtctcttctccaccgggcctacgcagcacatccag

SEQ ID NO: 133121 - DNA, 75 bp, Artificial Sequence
  Synthetic
accgggggatcggctgctcccccaaccggtggcctcgccggtctcttctccaccgggcctaggcagcacatccag

SEQ ID NO: 133122 - DNA, 75 bp, Artificial Sequence
  Synthetic
accgggggttcggctgctcccccaaccggtggcctcaccggtctcttctccaccgggcctaagcagcacatccag

SEQ ID NO: 133123 - DNA, 75 bp, Artificial Sequence
  Synthetic
accgggggttcggctgctcccccaaccggtggcctcaccggtctcttctccaccgggcctatgcagcacatccag

SEQ ID NO: 133124 - DNA, 75 bp, Artificial Sequence
  Synthetic
accgggggttcggctgctcccccaaccggtggcctcaccggtctcttctccaccgggcctacgcagcacatccag

SEQ ID NO: 133125 - DNA, 75 bp, Artificial Sequence
  Synthetic
accgggggttcggctgctcccccaaccggtggcctcaccggtctcttctccaccgggcctaggcagcacatccag

SEQ ID NO: 133126 - DNA, 75 bp, Artificial Sequence
  Synthetic
accgggggttcggctgctcccccaaccggtggcctctccggtctcttctccaccgggcctaagcagcacatccag

SEQ ID NO: 133127 - DNA, 75 bp, Artificial Sequence
  Synthetic
accgggggttcggctgctcccccaaccggtggcctctccggtctcttctccaccgggcctatgcagcacatccag

SEQ ID NO: 133128 - DNA, 75 bp, Artificial Sequence
  Synthetic
accgggggttcggctgctcccccaaccggtggcctctccggtctcttctccaccgggcctacgcagcacatccag

SEQ ID NO: 133129 - DNA, 75 bp, Artificial Sequence
  Synthetic
accgggggttcggctgctcccccaaccggtggcctctccggtctcttctccaccgggcctaggcagcacatccag

SEQ ID NO: 133130 - DNA, 75 bp, Artificial Sequence
  Synthetic
accgggggttcggctgctcccccaaccggtggcctccccggtctcttctccaccgggcctaagcagcacatccag

SEQ ID NO: 133131 - DNA, 75 bp, Artificial Sequence
  Synthetic
accgggggttcggctgctcccccaaccggtggcctccccggtctcttctccaccgggcctatgcagcacatccag

SEQ ID NO: 133132 - DNA, 75 bp, Artificial Sequence
  Synthetic
accgggggttcggctgctcccccaaccggtggcctccccggtctcttctccaccgggcctacgcagcacatccag

SEQ ID NO: 133133 - DNA, 75 bp, Artificial Sequence
  Synthetic
accgggggttcggctgctcccccaaccggtggcctccccggtctcttctccaccgggcctaggcagcacatccag

SEQ ID NO: 133134 - DNA, 75 bp, Artificial Sequence
  Synthetic
accgggggttcggctgctcccccaaccggtggcctcgccggtctcttctccaccgggcctaagcagcacatccag

SEQ ID NO: 133135 - DNA, 75 bp, Artificial Sequence
  Synthetic
accgggggttcggctgctcccccaaccggtggcctcgccggtctcttctccaccgggcctatgcagcacatccag

SEQ ID NO: 133136 - DNA, 75 bp, Artificial Sequence
  Synthetic
accgggggttcggctgctcccccaaccggtggcctcgccggtctcttctccaccgggcctacgcagcacatccag

SEQ ID NO: 133137 - DNA, 75 bp, Artificial Sequence
  Synthetic
accgggggttcggctgctcccccaaccggtggcctcgccggtctcttctccaccgggcctaggcagcacatccag

SEQ ID NO: 133138 - DNA, 75 bp, Artificial Sequence
  Synthetic
accgggggctcggctgctcccccaaccggtggcctcaccggtctcttctccaccgggcctaagcagcacatccag

SEQ ID NO: 133139 - DNA, 75 bp, Artificial Sequence
  Synthetic
accgggggctcggctgctcccccaaccggtggcctcaccggtctcttctccaccgggcctatgcagcacatccag

SEQ ID NO: 133140 - DNA, 75 bp, Artificial Sequence
  Synthetic
accgggggctcggctgctcccccaaccggtggcctcaccggtctcttctccaccgggcctacgcagcacatccag

SEQ ID NO: 133141 - DNA, 75 bp, Artificial Sequence
  Synthetic
accgggggctcggctgctcccccaaccggtggcctcaccggtctcttctccaccgggcctaggcagcacatccag

SEQ ID NO: 133142 - DNA, 75 bp, Artificial Sequence
  Synthetic
accgggggctcggctgctcccccaaccggtggcctctccggtctcttctccaccgggcctaagcagcacatccag

SEQ ID NO: 133143 - DNA, 75 bp, Artificial Sequence
  Synthetic
accgggggctcggctgctcccccaaccggtggcctctccggtctcttctccaccgggcctatgcagcacatccag

SEQ ID NO: 133144 - DNA, 75 bp, Artificial Sequence
  Synthetic
accgggggctcggctgctcccccaaccggtggcctctccggtctcttctccaccgggcctacgcagcacatccag

SEQ ID NO: 133145 - DNA, 75 bp, Artificial Sequence
  Synthetic
accgggggctcggctgctcccccaaccggtggcctctccggtctcttctccaccgggcctaggcagcacatccag

SEQ ID NO: 133146 - DNA, 75 bp, Artificial Sequence
  Synthetic
accgggggctcggctgctcccccaaccggtggcctccccggtctcttctccaccgggcctaagcagcacatccag

SEQ ID NO: 133147 - DNA, 75 bp, Artificial Sequence
  Synthetic
accgggggctcggctgctcccccaaccggtggcctccccggtctcttctccaccgggcctatgcagcacatccag

SEQ ID NO: 133148 - DNA, 75 bp, Artificial Sequence
  Synthetic
accgggggctcggctgctcccccaaccggtggcctccccggtctcttctccaccgggcctacgcagcacatccag

SEQ ID NO: 133149 - DNA, 75 bp, Artificial Sequence
  Synthetic
accgggggctcggctgctcccccaaccggtggcctccccggtctcttctccaccgggcctaggcagcacatccag

SEQ ID NO: 133150 - DNA, 75 bp, Artificial Sequence
  Synthetic
accgggggctcggctgctcccccaaccggtggcctcgccggtctcttctccaccgggcctaagcagcacatccag

SEQ ID NO: 133151 - DNA, 75 bp, Artificial Sequence
  Synthetic
accgggggctcggctgctcccccaaccggtggcctcgccggtctcttctccaccgggcctatgcagcacatccag

SEQ ID NO: 133152 - DNA, 75 bp, Artificial Sequence
  Synthetic
accgggggctcggctgctcccccaaccggtggcctcgccggtctcttctccaccgggcctacgcagcacatccag

SEQ ID NO: 133153 - DNA, 75 bp, Artificial Sequence
  Synthetic
accgggggctcggctgctcccccaaccggtggcctcgccggtctcttctccaccgggcctaggcagcacatccag

SEQ ID NO: 133154 - DNA, 75 bp, Artificial Sequence
  Synthetic
accggggggtcggctgctcccccaaccggtggcctcaccggtctcttctccaccgggcctaagcagcacatccag

SEQ ID NO: 133155 - DNA, 75 bp, Artificial Sequence
  Synthetic
accggggggtcggctgctcccccaaccggtggcctcaccggtctcttctccaccgggcctatgcagcacatccag

SEQ ID NO: 133156 - DNA, 75 bp, Artificial Sequence
  Synthetic
accggggggtcggctgctcccccaaccggtggcctcaccggtctcttctccaccgggcctacgcagcacatccag

SEQ ID NO: 133157 - DNA, 75 bp, Artificial Sequence
  Synthetic
accggggggtcggctgctcccccaaccggtggcctcaccggtctcttctccaccgggcctaggcagcacatccag

SEQ ID NO: 133158 - DNA, 75 bp, Artificial Sequence
  Synthetic
accggggggtcggctgctcccccaaccggtggcctctccggtctcttctccaccgggcctaagcagcacatccag

SEQ ID NO: 133159 - DNA, 75 bp, Artificial Sequence
  Synthetic
accggggggtcggctgctcccccaaccggtggcctctccggtctcttctccaccgggcctatgcagcacatccag

SEQ ID NO: 133160 - DNA, 75 bp, Artificial Sequence
  Synthetic
accggggggtcggctgctcccccaaccggtggcctctccggtctcttctccaccgggcctacgcagcacatccag

SEQ ID NO: 133161 - DNA, 75 bp, Artificial Sequence
  Synthetic
accggggggtcggctgctcccccaaccggtggcctctccggtctcttctccaccgggcctaggcagcacatccag

SEQ ID NO: 133162 - DNA, 75 bp, Artificial Sequence
  Synthetic
accggggggtcggctgctcccccaaccggtggcctccccggtctcttctccaccgggcctaagcagcacatccag

SEQ ID NO: 133163 - DNA, 75 bp, Artificial Sequence
  Synthetic
accggggggtcggctgctcccccaaccggtggcctccccggtctcttctccaccgggcctatgcagcacatccag

SEQ ID NO: 133164 - DNA, 75 bp, Artificial Sequence
  Synthetic
accggggggtcggctgctcccccaaccggtggcctccccggtctcttctccaccgggcctacgcagcacatccag

SEQ ID NO: 133165 - DNA, 75 bp, Artificial Sequence
  Synthetic
accggggggtcggctgctcccccaaccggtggcctccccggtctcttctccaccgggcctaggcagcacatccag

SEQ ID NO: 133166 - DNA, 75 bp, Artificial Sequence
  Synthetic
accggggggtcggctgctcccccaaccggtggcctcgccggtctcttctccaccgggcctaagcagcacatccag

SEQ ID NO: 133167 - DNA, 75 bp, Artificial Sequence
  Synthetic
accggggggtcggctgctcccccaaccggtggcctcgccggtctcttctccaccgggcctatgcagcacatccag

SEQ ID NO: 133168 - DNA, 75 bp, Artificial Sequence
  Synthetic
accggggggtcggctgctcccccaaccggtggcctcgccggtctcttctccaccgggcctacgcagcacatccag

SEQ ID NO: 133169 - DNA, 75 bp, Artificial Sequence
  Synthetic
accggggggtcggctgctcccccaaccggtggcctcgccggtctcttctccaccgggcctaggcagcacatccag

SEQ ID NO: 133170 - DNA, 75 bp, Artificial Sequence
  Synthetic
gttggtgtgccctactgactgcttccgaaaacatccggaagccacttacgccaaatgtgggtctggcccatggct

SEQ ID NO: 133171 - DNA, 75 bp, Artificial Sequence
  Synthetic
gattcaactcctcggggtgcttagaccgcatgagctcgtgaagccctcttgccgcctttgatcaaggctggggcc

SEQ ID NO: 133172 - DNA, 75 bp, Artificial Sequence
  Synthetic
gattcaactcctcggggtgcttagaccgcatgagctcgtgtagccctcttgccgcctttgatcaaggctggggcc

SEQ ID NO: 133173 - DNA, 75 bp, Artificial Sequence
  Synthetic
gattcaactcctcggggtgcttagaccgcatgagctcgtgcagccctcttgccgcctttgatcaaggctggggcc

SEQ ID NO: 133174 - DNA, 75 bp, Artificial Sequence
  Synthetic
gattcaactcctcggggtgcttagaccgcatgagctcgtggagccctcttgccgcctttgatcaaggctggggcc

SEQ ID NO: 133175 - DNA, 75 bp, Artificial Sequence
  Synthetic
gattcaactcctcggggtgctttgaccgcatgagctcgtgaagccctcttgccgcctttgatcaaggctggggcc

SEQ ID NO: 133176 - DNA, 75 bp, Artificial Sequence
  Synthetic
gattcaactcctcggggtgctttgaccgcatgagctcgtgtagccctcttgccgcctttgatcaaggctggggcc

SEQ ID NO: 133177 - DNA, 75 bp, Artificial Sequence
  Synthetic
gattcaactcctcggggtgctttgaccgcatgagctcgtgcagccctcttgccgcctttgatcaaggctggggcc

SEQ ID NO: 133178 - DNA, 75 bp, Artificial Sequence
  Synthetic
gattcaactcctcggggtgctttgaccgcatgagctcgtggagccctcttgccgcctttgatcaaggctggggcc

SEQ ID NO: 133179 - DNA, 75 bp, Artificial Sequence
  Synthetic
gattcaactcctcggggtgcttcgaccgcatgagctcgtgaagccctcttgccgcctttgatcaaggctggggcc

SEQ ID NO: 133180 - DNA, 75 bp, Artificial Sequence
  Synthetic
gattcaactcctcggggtgcttcgaccgcatgagctcgtgtagccctcttgccgcctttgatcaaggctggggcc

SEQ ID NO: 133181 - DNA, 75 bp, Artificial Sequence
  Synthetic
gattcaactcctcggggtgcttcgaccgcatgagctcgtgcagccctcttgccgcctttgatcaaggctggggcc

SEQ ID NO: 133182 - DNA, 75 bp, Artificial Sequence
  Synthetic
gattcaactcctcggggtgcttcgaccgcatgagctcgtggagccctcttgccgcctttgatcaaggctggggcc

SEQ ID NO: 133183 - DNA, 75 bp, Artificial Sequence
  Synthetic
gattcaactcctcggggtgcttggaccgcatgagctcgtgaagccctcttgccgcctttgatcaaggctggggcc

SEQ ID NO: 133184 - DNA, 75 bp, Artificial Sequence
  Synthetic
gattcaactcctcggggtgcttggaccgcatgagctcgtgtagccctcttgccgcctttgatcaaggctggggcc

SEQ ID NO: 133185 - DNA, 75 bp, Artificial Sequence
  Synthetic
gattcaactcctcggggtgcttggaccgcatgagctcgtgcagccctcttgccgcctttgatcaaggctggggcc

SEQ ID NO: 133186 - DNA, 75 bp, Artificial Sequence
  Synthetic
gattcaactcctcggggtgcttggaccgcatgagctcgtggagccctcttgccgcctttgatcaaggctggggcc

SEQ ID NO: 133187 - DNA, 75 bp, Artificial Sequence
  Synthetic
gtttcaactcctcggggtgcttagaccgcatgagctcgtgaagccctcttgccgcctttgatcaaggctggggcc

SEQ ID NO: 133188 - DNA, 75 bp, Artificial Sequence
  Synthetic
gtttcaactcctcggggtgcttagaccgcatgagctcgtgtagccctcttgccgcctttgatcaaggctggggcc

SEQ ID NO: 133189 - DNA, 75 bp, Artificial Sequence
  Synthetic
gtttcaactcctcggggtgcttagaccgcatgagctcgtgcagccctcttgccgcctttgatcaaggctggggcc

SEQ ID NO: 133190 - DNA, 75 bp, Artificial Sequence
  Synthetic
gtttcaactcctcggggtgcttagaccgcatgagctcgtggagccctcttgccgcctttgatcaaggctggggcc

SEQ ID NO: 133191 - DNA, 75 bp, Artificial Sequence
  Synthetic
gtttcaactcctcggggtgctttgaccgcatgagctcgtgaagccctcttgccgcctttgatcaaggctggggcc

SEQ ID NO: 133192 - DNA, 75 bp, Artificial Sequence
  Synthetic
gtttcaactcctcggggtgctttgaccgcatgagctcgtgtagccctcttgccgcctttgatcaaggctggggcc

SEQ ID NO: 133193 - DNA, 75 bp, Artificial Sequence
  Synthetic
gtttcaactcctcggggtgctttgaccgcatgagctcgtgcagccctcttgccgcctttgatcaaggctggggcc

SEQ ID NO: 133194 - DNA, 75 bp, Artificial Sequence
  Synthetic
gtttcaactcctcggggtgctttgaccgcatgagctcgtggagccctcttgccgcctttgatcaaggctggggcc

SEQ ID NO: 133195 - DNA, 75 bp, Artificial Sequence
  Synthetic
gtttcaactcctcggggtgcttcgaccgcatgagctcgtgaagccctcttgccgcctttgatcaaggctggggcc

SEQ ID NO: 133196 - DNA, 75 bp, Artificial Sequence
  Synthetic
gtttcaactcctcggggtgcttcgaccgcatgagctcgtgtagccctcttgccgcctttgatcaaggctggggcc

SEQ ID NO: 133197 - DNA, 75 bp, Artificial Sequence
  Synthetic
gtttcaactcctcggggtgcttcgaccgcatgagctcgtgcagccctcttgccgcctttgatcaaggctggggcc

SEQ ID NO: 133198 - DNA, 75 bp, Artificial Sequence
  Synthetic
gtttcaactcctcggggtgcttcgaccgcatgagctcgtggagccctcttgccgcctttgatcaaggctggggcc

SEQ ID NO: 133199 - DNA, 75 bp, Artificial Sequence
  Synthetic
gtttcaactcctcggggtgcttggaccgcatgagctcgtgaagccctcttgccgcctttgatcaaggctggggcc

SEQ ID NO: 133200 - DNA, 75 bp, Artificial Sequence
  Synthetic
gtttcaactcctcggggtgcttggaccgcatgagctcgtgtagccctcttgccgcctttgatcaaggctggggcc

SEQ ID NO: 133201 - DNA, 75 bp, Artificial Sequence
  Synthetic
gtttcaactcctcggggtgcttggaccgcatgagctcgtgcagccctcttgccgcctttgatcaaggctggggcc

SEQ ID NO: 133202 - DNA, 75 bp, Artificial Sequence
  Synthetic
gtttcaactcctcggggtgcttggaccgcatgagctcgtggagccctcttgccgcctttgatcaaggctggggcc

SEQ ID NO: 133203 - DNA, 75 bp, Artificial Sequence
  Synthetic
gcttcaactcctcggggtgcttagaccgcatgagctcgtgaagccctcttgccgcctttgatcaaggctggggcc

SEQ ID NO: 133204 - DNA, 75 bp, Artificial Sequence
  Synthetic
gcttcaactcctcggggtgcttagaccgcatgagctcgtgtagccctcttgccgcctttgatcaaggctggggcc

SEQ ID NO: 133205 - DNA, 75 bp, Artificial Sequence
  Synthetic
gcttcaactcctcggggtgcttagaccgcatgagctcgtgcagccctcttgccgcctttgatcaaggctggggcc

SEQ ID NO: 133206 - DNA, 75 bp, Artificial Sequence
  Synthetic
gcttcaactcctcggggtgcttagaccgcatgagctcgtggagccctcttgccgcctttgatcaaggctggggcc

SEQ ID NO: 133207 - DNA, 75 bp, Artificial Sequence
  Synthetic
gcttcaactcctcggggtgctttgaccgcatgagctcgtgaagccctcttgccgcctttgatcaaggctggggcc

SEQ ID NO: 133208 - DNA, 75 bp, Artificial Sequence
  Synthetic
gcttcaactcctcggggtgctttgaccgcatgagctcgtgtagccctcttgccgcctttgatcaaggctggggcc

SEQ ID NO: 133209 - DNA, 75 bp, Artificial Sequence
  Synthetic
gcttcaactcctcggggtgctttgaccgcatgagctcgtgcagccctcttgccgcctttgatcaaggctggggcc

SEQ ID NO: 133210 - DNA, 75 bp, Artificial Sequence
  Synthetic
gcttcaactcctcggggtgctttgaccgcatgagctcgtggagccctcttgccgcctttgatcaaggctggggcc

SEQ ID NO: 133211 - DNA, 75 bp, Artificial Sequence
  Synthetic
gcttcaactcctcggggtgcttcgaccgcatgagctcgtgaagccctcttgccgcctttgatcaaggctggggcc

SEQ ID NO: 133212 - DNA, 75 bp, Artificial Sequence
  Synthetic
gcttcaactcctcggggtgcttcgaccgcatgagctcgtgtagccctcttgccgcctttgatcaaggctggggcc

SEQ ID NO: 133213 - DNA, 75 bp, Artificial Sequence
  Synthetic
gcttcaactcctcggggtgcttcgaccgcatgagctcgtgcagccctcttgccgcctttgatcaaggctggggcc

SEQ ID NO: 133214 - DNA, 75 bp, Artificial Sequence
  Synthetic
gcttcaactcctcggggtgcttcgaccgcatgagctcgtggagccctcttgccgcctttgatcaaggctggggcc

SEQ ID NO: 133215 - DNA, 75 bp, Artificial Sequence
  Synthetic
gcttcaactcctcggggtgcttggaccgcatgagctcgtgaagccctcttgccgcctttgatcaaggctggggcc

SEQ ID NO: 133216 - DNA, 75 bp, Artificial Sequence
  Synthetic
gcttcaactcctcggggtgcttggaccgcatgagctcgtgtagccctcttgccgcctttgatcaaggctggggcc

SEQ ID NO: 133217 - DNA, 75 bp, Artificial Sequence
  Synthetic
gcttcaactcctcggggtgcttggaccgcatgagctcgtgcagccctcttgccgcctttgatcaaggctggggcc

SEQ ID NO: 133218 - DNA, 75 bp, Artificial Sequence
  Synthetic
gcttcaactcctcggggtgcttggaccgcatgagctcgtggagccctcttgccgcctttgatcaaggctggggcc

SEQ ID NO: 133219 - DNA, 75 bp, Artificial Sequence
  Synthetic
ggttcaactcctcggggtgcttagaccgcatgagctcgtgaagccctcttgccgcctttgatcaaggctggggcc

SEQ ID NO: 133220 - DNA, 75 bp, Artificial Sequence
  Synthetic
ggttcaactcctcggggtgcttagaccgcatgagctcgtgtagccctcttgccgcctttgatcaaggctggggcc

SEQ ID NO: 133221 - DNA, 75 bp, Artificial Sequence
  Synthetic
ggttcaactcctcggggtgcttagaccgcatgagctcgtgcagccctcttgccgcctttgatcaaggctggggcc

SEQ ID NO: 133222 - DNA, 75 bp, Artificial Sequence
  Synthetic
ggttcaactcctcggggtgcttagaccgcatgagctcgtggagccctcttgccgcctttgatcaaggctggggcc

SEQ ID NO: 133223 - DNA, 75 bp, Artificial Sequence
  Synthetic
ggttcaactcctcggggtgctttgaccgcatgagctcgtgaagccctcttgccgcctttgatcaaggctggggcc

SEQ ID NO: 133224 - DNA, 75 bp, Artificial Sequence
  Synthetic
ggttcaactcctcggggtgctttgaccgcatgagctcgtgtagccctcttgccgcctttgatcaaggctggggcc

SEQ ID NO: 133225 - DNA, 75 bp, Artificial Sequence
  Synthetic
ggttcaactcctcggggtgctttgaccgcatgagctcgtgcagccctcttgccgcctttgatcaaggctggggcc

SEQ ID NO: 133226 - DNA, 75 bp, Artificial Sequence
  Synthetic
ggttcaactcctcggggtgctttgaccgcatgagctcgtggagccctcttgccgcctttgatcaaggctggggcc

SEQ ID NO: 133227 - DNA, 75 bp, Artificial Sequence
  Synthetic
ggttcaactcctcggggtgcttcgaccgcatgagctcgtgaagccctcttgccgcctttgatcaaggctggggcc

SEQ ID NO: 133228 - DNA, 75 bp, Artificial Sequence
  Synthetic
ggttcaactcctcggggtgcttcgaccgcatgagctcgtgtagccctcttgccgcctttgatcaaggctggggcc

SEQ ID NO: 133229 - DNA, 75 bp, Artificial Sequence
  Synthetic
ggttcaactcctcggggtgcttcgaccgcatgagctcgtgcagccctcttgccgcctttgatcaaggctggggcc

SEQ ID NO: 133230 - DNA, 75 bp, Artificial Sequence
  Synthetic
ggttcaactcctcggggtgcttcgaccgcatgagctcgtggagccctcttgccgcctttgatcaaggctggggcc

SEQ ID NO: 133231 - DNA, 75 bp, Artificial Sequence
  Synthetic
ggttcaactcctcggggtgcttggaccgcatgagctcgtgaagccctcttgccgcctttgatcaaggctggggcc

SEQ ID NO: 133232 - DNA, 75 bp, Artificial Sequence
  Synthetic
ggttcaactcctcggggtgcttggaccgcatgagctcgtgtagccctcttgccgcctttgatcaaggctggggcc

SEQ ID NO: 133233 - DNA, 75 bp, Artificial Sequence
  Synthetic
ggttcaactcctcggggtgcttggaccgcatgagctcgtgcagccctcttgccgcctttgatcaaggctggggcc

SEQ ID NO: 133234 - DNA, 75 bp, Artificial Sequence
  Synthetic
ggttcaactcctcggggtgcttggaccgcatgagctcgtggagccctcttgccgcctttgatcaaggctggggcc

SEQ ID NO: 133235 - DNA, 75 bp, Artificial Sequence
  Synthetic
aggcccggtgtactgctttaccccgagcccggtggttgtgggaaccaccgacagcaagggcaacccaacatacac

SEQ ID NO: 133236 - DNA, 75 bp, Artificial Sequence
  Synthetic
aggcccggtgtactgctttaccccgagcccggtggttgtgggaaccaccgacagcaagggctacccaacatacac

SEQ ID NO: 133237 - DNA, 75 bp, Artificial Sequence
  Synthetic
aggcccggtgtactgctttaccccgagcccggtggttgtgggaaccaccgacagcaagggccacccaacatacac

SEQ ID NO: 133238 - DNA, 75 bp, Artificial Sequence
  Synthetic
aggcccggtgtactgctttaccccgagcccggtggttgtgggaaccaccgacagcaagggcgacccaacatacac

SEQ ID NO: 133239 - DNA, 75 bp, Artificial Sequence
  Synthetic
aggcccggtgtactgctttaccccgagcccggtggttgtgggaaccaccgacagcatgggcaacccaacatacac

SEQ ID NO: 133240 - DNA, 75 bp, Artificial Sequence
  Synthetic
aggcccggtgtactgctttaccccgagcccggtggttgtgggaaccaccgacagcatgggctacccaacatacac

SEQ ID NO: 133241 - DNA, 75 bp, Artificial Sequence
  Synthetic
aggcccggtgtactgctttaccccgagcccggtggttgtgggaaccaccgacagcatgggccacccaacatacac

SEQ ID NO: 133242 - DNA, 75 bp, Artificial Sequence
  Synthetic
aggcccggtgtactgctttaccccgagcccggtggttgtgggaaccaccgacagcatgggcgacccaacatacac

SEQ ID NO: 133243 - DNA, 75 bp, Artificial Sequence
  Synthetic
aggcccggtgtactgctttaccccgagcccggtggttgtgggaaccaccgacagcacgggcaacccaacatacac

SEQ ID NO: 133244 - DNA, 75 bp, Artificial Sequence
  Synthetic
aggcccggtgtactgctttaccccgagcccggtggttgtgggaaccaccgacagcacgggctacccaacatacac

SEQ ID NO: 133245 - DNA, 75 bp, Artificial Sequence
  Synthetic
aggcccggtgtactgctttaccccgagcccggtggttgtgggaaccaccgacagcacgggccacccaacatacac

SEQ ID NO: 133246 - DNA, 75 bp, Artificial Sequence
  Synthetic
aggcccggtgtactgctttaccccgagcccggtggttgtgggaaccaccgacagcacgggcgacccaacatacac

SEQ ID NO: 133247 - DNA, 75 bp, Artificial Sequence
  Synthetic
aggcccggtgtactgctttaccccgagcccggtggttgtgggaaccaccgacagcaggggcaacccaacatacac

SEQ ID NO: 133248 - DNA, 75 bp, Artificial Sequence
  Synthetic
aggcccggtgtactgctttaccccgagcccggtggttgtgggaaccaccgacagcaggggctacccaacatacac

SEQ ID NO: 133249 - DNA, 75 bp, Artificial Sequence
  Synthetic
aggcccggtgtactgctttaccccgagcccggtggttgtgggaaccaccgacagcaggggccacccaacatacac

SEQ ID NO: 133250 - DNA, 75 bp, Artificial Sequence
  Synthetic
aggcccggtgtactgctttaccccgagcccggtggttgtgggaaccaccgacagcaggggcgacccaacatacac

SEQ ID NO: 133251 - DNA, 75 bp, Artificial Sequence
  Synthetic
tggcccggtgtactgctttaccccgagcccggtggttgtgggaaccaccgacagcaagggcaacccaacatacac

SEQ ID NO: 133252 - DNA, 75 bp, Artificial Sequence
  Synthetic
tggcccggtgtactgctttaccccgagcccggtggttgtgggaaccaccgacagcaagggctacccaacatacac

SEQ ID NO: 133253 - DNA, 75 bp, Artificial Sequence
  Synthetic
tggcccggtgtactgctttaccccgagcccggtggttgtgggaaccaccgacagcaagggccacccaacatacac

SEQ ID NO: 133254 - DNA, 75 bp, Artificial Sequence
  Synthetic
tggcccggtgtactgctttaccccgagcccggtggttgtgggaaccaccgacagcaagggcgacccaacatacac

SEQ ID NO: 133255 - DNA, 75 bp, Artificial Sequence
  Synthetic
tggcccggtgtactgctttaccccgagcccggtggttgtgggaaccaccgacagcatgggcaacccaacatacac

SEQ ID NO: 133256 - DNA, 75 bp, Artificial Sequence
  Synthetic
tggcccggtgtactgctttaccccgagcccggtggttgtgggaaccaccgacagcatgggctacccaacatacac

SEQ ID NO: 133257 - DNA, 75 bp, Artificial Sequence
  Synthetic
tggcccggtgtactgctttaccccgagcccggtggttgtgggaaccaccgacagcatgggccacccaacatacac

SEQ ID NO: 133258 - DNA, 75 bp, Artificial Sequence
  Synthetic
tggcccggtgtactgctttaccccgagcccggtggttgtgggaaccaccgacagcatgggcgacccaacatacac

SEQ ID NO: 133259 - DNA, 75 bp, Artificial Sequence
  Synthetic
tggcccggtgtactgctttaccccgagcccggtggttgtgggaaccaccgacagcacgggcaacccaacatacac

SEQ ID NO: 133260 - DNA, 75 bp, Artificial Sequence
  Synthetic
tggcccggtgtactgctttaccccgagcccggtggttgtgggaaccaccgacagcacgggctacccaacatacac

SEQ ID NO: 133261 - DNA, 75 bp, Artificial Sequence
  Synthetic
tggcccggtgtactgctttaccccgagcccggtggttgtgggaaccaccgacagcacgggccacccaacatacac

SEQ ID NO: 133262 - DNA, 75 bp, Artificial Sequence
  Synthetic
tggcccggtgtactgctttaccccgagcccggtggttgtgggaaccaccgacagcacgggcgacccaacatacac

SEQ ID NO: 133263 - DNA, 75 bp, Artificial Sequence
  Synthetic
tggcccggtgtactgctttaccccgagcccggtggttgtgggaaccaccgacagcaggggcaacccaacatacac

SEQ ID NO: 133264 - DNA, 75 bp, Artificial Sequence
  Synthetic
tggcccggtgtactgctttaccccgagcccggtggttgtgggaaccaccgacagcaggggctacccaacatacac

SEQ ID NO: 133265 - DNA, 75 bp, Artificial Sequence
  Synthetic
tggcccggtgtactgctttaccccgagcccggtggttgtgggaaccaccgacagcaggggccacccaacatacac

SEQ ID NO: 133266 - DNA, 75 bp, Artificial Sequence
  Synthetic
tggcccggtgtactgctttaccccgagcccggtggttgtgggaaccaccgacagcaggggcgacccaacatacac

SEQ ID NO: 133267 - DNA, 75 bp, Artificial Sequence
  Synthetic
cggcccggtgtactgctttaccccgagcccggtggttgtgggaaccaccgacagcaagggcaacccaacatacac

SEQ ID NO: 133268 - DNA, 75 bp, Artificial Sequence
  Synthetic
cggcccggtgtactgctttaccccgagcccggtggttgtgggaaccaccgacagcaagggctacccaacatacac

SEQ ID NO: 133269 - DNA, 75 bp, Artificial Sequence
  Synthetic
cggcccggtgtactgctttaccccgagcccggtggttgtgggaaccaccgacagcaagggccacccaacatacac

SEQ ID NO: 133270 - DNA, 75 bp, Artificial Sequence
  Synthetic
cggcccggtgtactgctttaccccgagcccggtggttgtgggaaccaccgacagcaagggcgacccaacatacac

SEQ ID NO: 133271 - DNA, 75 bp, Artificial Sequence
  Synthetic
cggcccggtgtactgctttaccccgagcccggtggttgtgggaaccaccgacagcatgggcaacccaacatacac

SEQ ID NO: 133272 - DNA, 75 bp, Artificial Sequence
  Synthetic
cggcccggtgtactgctttaccccgagcccggtggttgtgggaaccaccgacagcatgggctacccaacatacac

SEQ ID NO: 133273 - DNA, 75 bp, Artificial Sequence
  Synthetic
cggcccggtgtactgctttaccccgagcccggtggttgtgggaaccaccgacagcatgggccacccaacatacac

SEQ ID NO: 133274 - DNA, 75 bp, Artificial Sequence
  Synthetic
cggcccggtgtactgctttaccccgagcccggtggttgtgggaaccaccgacagcatgggcgacccaacatacac

SEQ ID NO: 133275 - DNA, 75 bp, Artificial Sequence
  Synthetic
cggcccggtgtactgctttaccccgagcccggtggttgtgggaaccaccgacagcacgggcaacccaacatacac

SEQ ID NO: 133276 - DNA, 75 bp, Artificial Sequence
  Synthetic
cggcccggtgtactgctttaccccgagcccggtggttgtgggaaccaccgacagcacgggctacccaacatacac

SEQ ID NO: 133277 - DNA, 75 bp, Artificial Sequence
  Synthetic
cggcccggtgtactgctttaccccgagcccggtggttgtgggaaccaccgacagcacgggccacccaacatacac

SEQ ID NO: 133278 - DNA, 75 bp, Artificial Sequence
  Synthetic
cggcccggtgtactgctttaccccgagcccggtggttgtgggaaccaccgacagcacgggcgacccaacatacac

SEQ ID NO: 133279 - DNA, 75 bp, Artificial Sequence
  Synthetic
cggcccggtgtactgctttaccccgagcccggtggttgtgggaaccaccgacagcaggggcaacccaacatacac

SEQ ID NO: 133280 - DNA, 75 bp, Artificial Sequence
  Synthetic
cggcccggtgtactgctttaccccgagcccggtggttgtgggaaccaccgacagcaggggctacccaacatacac

SEQ ID NO: 133281 - DNA, 75 bp, Artificial Sequence
  Synthetic
cggcccggtgtactgctttaccccgagcccggtggttgtgggaaccaccgacagcaggggccacccaacatacac

SEQ ID NO: 133282 - DNA, 75 bp, Artificial Sequence
  Synthetic
cggcccggtgtactgctttaccccgagcccggtggttgtgggaaccaccgacagcaggggcgacccaacatacac

SEQ ID NO: 133283 - DNA, 75 bp, Artificial Sequence
  Synthetic
gggcccggtgtactgctttaccccgagcccggtggttgtgggaaccaccgacagcaagggcaacccaacatacac

SEQ ID NO: 133284 - DNA, 75 bp, Artificial Sequence
  Synthetic
gggcccggtgtactgctttaccccgagcccggtggttgtgggaaccaccgacagcaagggctacccaacatacac

SEQ ID NO: 133285 - DNA, 75 bp, Artificial Sequence
  Synthetic
gggcccggtgtactgctttaccccgagcccggtggttgtgggaaccaccgacagcaagggccacccaacatacac

SEQ ID NO: 133286 - DNA, 75 bp, Artificial Sequence
  Synthetic
gggcccggtgtactgctttaccccgagcccggtggttgtgggaaccaccgacagcaagggcgacccaacatacac

SEQ ID NO: 133287 - DNA, 75 bp, Artificial Sequence
  Synthetic
gggcccggtgtactgctttaccccgagcccggtggttgtgggaaccaccgacagcatgggcaacccaacatacac

SEQ ID NO: 133288 - DNA, 75 bp, Artificial Sequence
  Synthetic
gggcccggtgtactgctttaccccgagcccggtggttgtgggaaccaccgacagcatgggctacccaacatacac

SEQ ID NO: 133289 - DNA, 75 bp, Artificial Sequence
  Synthetic
gggcccggtgtactgctttaccccgagcccggtggttgtgggaaccaccgacagcatgggccacccaacatacac

SEQ ID NO: 133290 - DNA, 75 bp, Artificial Sequence
  Synthetic
gggcccggtgtactgctttaccccgagcccggtggttgtgggaaccaccgacagcatgggcgacccaacatacac

SEQ ID NO: 133291 - DNA, 75 bp, Artificial Sequence
  Synthetic
gggcccggtgtactgctttaccccgagcccggtggttgtgggaaccaccgacagcacgggcaacccaacatacac

SEQ ID NO: 133292 - DNA, 75 bp, Artificial Sequence
  Synthetic
gggcccggtgtactgctttaccccgagcccggtggttgtgggaaccaccgacagcacgggctacccaacatacac

SEQ ID NO: 133293 - DNA, 75 bp, Artificial Sequence
  Synthetic
gggcccggtgtactgctttaccccgagcccggtggttgtgggaaccaccgacagcacgggccacccaacatacac

SEQ ID NO: 133294 - DNA, 75 bp, Artificial Sequence
  Synthetic
gggcccggtgtactgctttaccccgagcccggtggttgtgggaaccaccgacagcacgggcgacccaacatacac

SEQ ID NO: 133295 - DNA, 75 bp, Artificial Sequence
  Synthetic
gggcccggtgtactgctttaccccgagcccggtggttgtgggaaccaccgacagcaggggcaacccaacatacac

SEQ ID NO: 133296 - DNA, 75 bp, Artificial Sequence
  Synthetic
gggcccggtgtactgctttaccccgagcccggtggttgtgggaaccaccgacagcaggggctacccaacatacac

SEQ ID NO: 133297 - DNA, 75 bp, Artificial Sequence
  Synthetic
gggcccggtgtactgctttaccccgagcccggtggttgtgggaaccaccgacagcaggggccacccaacatacac

SEQ ID NO: 133298 - DNA, 75 bp, Artificial Sequence
  Synthetic
gggcccggtgtactgctttaccccgagcccggtggttgtgggaaccaccgacagcaggggcgacccaacatacac

SEQ ID NO: 133299 - DNA, 75 bp, Artificial Sequence
  Synthetic
gagcacaggcttgaggccgcgtgcaactggacccggggggaacgctgcgacctggaggacagggaccggtctgag

SEQ ID NO: 133300 - DNA, 75 bp, Artificial Sequence
  Synthetic
aaaacgtgtggggctcccccctgcacgtttgcgtcatctgggaacagatctctgacctgacctactgaatgcttc

SEQ ID NO: 133301 - DNA, 75 bp, Artificial Sequence
  Synthetic
aaaacgtgtggggctcccccctgcacgtttgcgtcatctgggaacagatctctgacctgacctactgattgcttc

SEQ ID NO: 133302 - DNA, 75 bp, Artificial Sequence
  Synthetic
aaaacgtgtggggctcccccctgcacgtttgcgtcatctgggaacagatctctgacctgacctactgactgcttc

SEQ ID NO: 133303 - DNA, 75 bp, Artificial Sequence
  Synthetic
aaaacgtgtggggctcccccctgcacgtttgcgtcatctgggaacagatctctgacctgacctactgagtgcttc

SEQ ID NO: 133304 - DNA, 75 bp, Artificial Sequence
  Synthetic
aaaacgtgtggggctcccccctgcacgtttgcgtcatctgggaacagatctctgacctgtcctactgaatgcttc

SEQ ID NO: 133305 - DNA, 75 bp, Artificial Sequence
  Synthetic
aaaacgtgtggggctcccccctgcacgtttgcgtcatctgggaacagatctctgacctgtcctactgattgcttc

SEQ ID NO: 133306 - DNA, 75 bp, Artificial Sequence
  Synthetic
aaaacgtgtggggctcccccctgcacgtttgcgtcatctgggaacagatctctgacctgtcctactgactgcttc

SEQ ID NO: 133307 - DNA, 75 bp, Artificial Sequence
  Synthetic
aaaacgtgtggggctcccccctgcacgtttgcgtcatctgggaacagatctctgacctgtcctactgagtgcttc

SEQ ID NO: 133308 - DNA, 75 bp, Artificial Sequence
  Synthetic
aaaacgtgtggggctcccccctgcacgtttgcgtcatctgggaacagatctctgacctgccctactgaatgcttc

SEQ ID NO: 133309 - DNA, 75 bp, Artificial Sequence
  Synthetic
aaaacgtgtggggctcccccctgcacgtttgcgtcatctgggaacagatctctgacctgccctactgattgcttc

SEQ ID NO: 133310 - DNA, 75 bp, Artificial Sequence
  Synthetic
aaaacgtgtggggctcccccctgcacgtttgcgtcatctgggaacagatctctgacctgccctactgactgcttc

SEQ ID NO: 133311 - DNA, 75 bp, Artificial Sequence
  Synthetic
aaaacgtgtggggctcccccctgcacgtttgcgtcatctgggaacagatctctgacctgccctactgagtgcttc

SEQ ID NO: 133312 - DNA, 75 bp, Artificial Sequence
  Synthetic
aaaacgtgtggggctcccccctgcacgtttgcgtcatctgggaacagatctctgacctggcctactgaatgcttc

SEQ ID NO: 133313 - DNA, 75 bp, Artificial Sequence
  Synthetic
aaaacgtgtggggctcccccctgcacgtttgcgtcatctgggaacagatctctgacctggcctactgattgcttc

SEQ ID NO: 133314 - DNA, 75 bp, Artificial Sequence
  Synthetic
aaaacgtgtggggctcccccctgcacgtttgcgtcatctgggaacagatctctgacctggcctactgactgcttc

SEQ ID NO: 133315 - DNA, 75 bp, Artificial Sequence
  Synthetic
aaaacgtgtggggctcccccctgcacgtttgcgtcatctgggaacagatctctgacctggcctactgagtgcttc

SEQ ID NO: 133316 - DNA, 75 bp, Artificial Sequence
  Synthetic
aatacgtgtggggctcccccctgcacgtttgcgtcatctgggaacagatctctgacctgacctactgaatgcttc

SEQ ID NO: 133317 - DNA, 75 bp, Artificial Sequence
  Synthetic
aatacgtgtggggctcccccctgcacgtttgcgtcatctgggaacagatctctgacctgacctactgattgcttc

SEQ ID NO: 133318 - DNA, 75 bp, Artificial Sequence
  Synthetic
aatacgtgtggggctcccccctgcacgtttgcgtcatctgggaacagatctctgacctgacctactgactgcttc

SEQ ID NO: 133319 - DNA, 75 bp, Artificial Sequence
  Synthetic
aatacgtgtggggctcccccctgcacgtttgcgtcatctgggaacagatctctgacctgacctactgagtgcttc

SEQ ID NO: 133320 - DNA, 75 bp, Artificial Sequence
  Synthetic
aatacgtgtggggctcccccctgcacgtttgcgtcatctgggaacagatctctgacctgtcctactgaatgcttc

SEQ ID NO: 133321 - DNA, 75 bp, Artificial Sequence
  Synthetic
aatacgtgtggggctcccccctgcacgtttgcgtcatctgggaacagatctctgacctgtcctactgattgcttc

SEQ ID NO: 133322 - DNA, 75 bp, Artificial Sequence
  Synthetic
aatacgtgtggggctcccccctgcacgtttgcgtcatctgggaacagatctctgacctgtcctactgactgcttc

SEQ ID NO: 133323 - DNA, 75 bp, Artificial Sequence
  Synthetic
aatacgtgtggggctcccccctgcacgtttgcgtcatctgggaacagatctctgacctgtcctactgagtgcttc

SEQ ID NO: 133324 - DNA, 75 bp, Artificial Sequence
  Synthetic
aatacgtgtggggctcccccctgcacgtttgcgtcatctgggaacagatctctgacctgccctactgaatgcttc

SEQ ID NO: 133325 - DNA, 75 bp, Artificial Sequence
  Synthetic
aatacgtgtggggctcccccctgcacgtttgcgtcatctgggaacagatctctgacctgccctactgattgcttc

SEQ ID NO: 133326 - DNA, 75 bp, Artificial Sequence
  Synthetic
aatacgtgtggggctcccccctgcacgtttgcgtcatctgggaacagatctctgacctgccctactgactgcttc

SEQ ID NO: 133327 - DNA, 75 bp, Artificial Sequence
  Synthetic
aatacgtgtggggctcccccctgcacgtttgcgtcatctgggaacagatctctgacctgccctactgagtgcttc

SEQ ID NO: 133328 - DNA, 75 bp, Artificial Sequence
  Synthetic
aatacgtgtggggctcccccctgcacgtttgcgtcatctgggaacagatctctgacctggcctactgaatgcttc

SEQ ID NO: 133329 - DNA, 75 bp, Artificial Sequence
  Synthetic
aatacgtgtggggctcccccctgcacgtttgcgtcatctgggaacagatctctgacctggcctactgattgcttc

SEQ ID NO: 133330 - DNA, 75 bp, Artificial Sequence
  Synthetic
aatacgtgtggggctcccccctgcacgtttgcgtcatctgggaacagatctctgacctggcctactgactgcttc

SEQ ID NO: 133331 - DNA, 75 bp, Artificial Sequence
  Synthetic
aatacgtgtggggctcccccctgcacgtttgcgtcatctgggaacagatctctgacctggcctactgagtgcttc

SEQ ID NO: 133332 - DNA, 75 bp, Artificial Sequence
  Synthetic
aacacgtgtggggctcccccctgcacgtttgcgtcatctgggaacagatctctgacctgacctactgaatgcttc

SEQ ID NO: 133333 - DNA, 75 bp, Artificial Sequence
  Synthetic
aacacgtgtggggctcccccctgcacgtttgcgtcatctgggaacagatctctgacctgacctactgattgcttc

SEQ ID NO: 133334 - DNA, 75 bp, Artificial Sequence
  Synthetic
aacacgtgtggggctcccccctgcacgtttgcgtcatctgggaacagatctctgacctgacctactgactgcttc

SEQ ID NO: 133335 - DNA, 75 bp, Artificial Sequence
  Synthetic
aacacgtgtggggctcccccctgcacgtttgcgtcatctgggaacagatctctgacctgacctactgagtgcttc

SEQ ID NO: 133336 - DNA, 75 bp, Artificial Sequence
  Synthetic
aacacgtgtggggctcccccctgcacgtttgcgtcatctgggaacagatctctgacctgtcctactgaatgcttc

SEQ ID NO: 133337 - DNA, 75 bp, Artificial Sequence
  Synthetic
aacacgtgtggggctcccccctgcacgtttgcgtcatctgggaacagatctctgacctgtcctactgattgcttc

SEQ ID NO: 133338 - DNA, 75 bp, Artificial Sequence
  Synthetic
aacacgtgtggggctcccccctgcacgtttgcgtcatctgggaacagatctctgacctgtcctactgactgcttc

SEQ ID NO: 133339 - DNA, 75 bp, Artificial Sequence
  Synthetic
aacacgtgtggggctcccccctgcacgtttgcgtcatctgggaacagatctctgacctgtcctactgagtgcttc

SEQ ID NO: 133340 - DNA, 75 bp, Artificial Sequence
  Synthetic
aacacgtgtggggctcccccctgcacgtttgcgtcatctgggaacagatctctgacctgccctactgaatgcttc

SEQ ID NO: 133341 - DNA, 75 bp, Artificial Sequence
  Synthetic
aacacgtgtggggctcccccctgcacgtttgcgtcatctgggaacagatctctgacctgccctactgattgcttc

SEQ ID NO: 133342 - DNA, 75 bp, Artificial Sequence
  Synthetic
aacacgtgtggggctcccccctgcacgtttgcgtcatctgggaacagatctctgacctgccctactgactgcttc

SEQ ID NO: 133343 - DNA, 75 bp, Artificial Sequence
  Synthetic
aacacgtgtggggctcccccctgcacgtttgcgtcatctgggaacagatctctgacctgccctactgagtgcttc

SEQ ID NO: 133344 - DNA, 75 bp, Artificial Sequence
  Synthetic
aacacgtgtggggctcccccctgcacgtttgcgtcatctgggaacagatctctgacctggcctactgaatgcttc

SEQ ID NO: 133345 - DNA, 75 bp, Artificial Sequence
  Synthetic
aacacgtgtggggctcccccctgcacgtttgcgtcatctgggaacagatctctgacctggcctactgattgcttc

SEQ ID NO: 133346 - DNA, 75 bp, Artificial Sequence
  Synthetic
aacacgtgtggggctcccccctgcacgtttgcgtcatctgggaacagatctctgacctggcctactgactgcttc

SEQ ID NO: 133347 - DNA, 75 bp, Artificial Sequence
  Synthetic
aacacgtgtggggctcccccctgcacgtttgcgtcatctgggaacagatctctgacctggcctactgagtgcttc

SEQ ID NO: 133348 - DNA, 75 bp, Artificial Sequence
  Synthetic
aagacgtgtggggctcccccctgcacgtttgcgtcatctgggaacagatctctgacctgacctactgaatgcttc

SEQ ID NO: 133349 - DNA, 75 bp, Artificial Sequence
  Synthetic
aagacgtgtggggctcccccctgcacgtttgcgtcatctgggaacagatctctgacctgacctactgattgcttc

SEQ ID NO: 133350 - DNA, 75 bp, Artificial Sequence
  Synthetic
aagacgtgtggggctcccccctgcacgtttgcgtcatctgggaacagatctctgacctgacctactgactgcttc

SEQ ID NO: 133351 - DNA, 75 bp, Artificial Sequence
  Synthetic
aagacgtgtggggctcccccctgcacgtttgcgtcatctgggaacagatctctgacctgacctactgagtgcttc

SEQ ID NO: 133352 - DNA, 75 bp, Artificial Sequence
  Synthetic
aagacgtgtggggctcccccctgcacgtttgcgtcatctgggaacagatctctgacctgtcctactgaatgcttc

SEQ ID NO: 133353 - DNA, 75 bp, Artificial Sequence
  Synthetic
aagacgtgtggggctcccccctgcacgtttgcgtcatctgggaacagatctctgacctgtcctactgattgcttc

SEQ ID NO: 133354 - DNA, 75 bp, Artificial Sequence
  Synthetic
aagacgtgtggggctcccccctgcacgtttgcgtcatctgggaacagatctctgacctgtcctactgactgcttc

SEQ ID NO: 133355 - DNA, 75 bp, Artificial Sequence
  Synthetic
aagacgtgtggggctcccccctgcacgtttgcgtcatctgggaacagatctctgacctgtcctactgagtgcttc

SEQ ID NO: 133356 - DNA, 75 bp, Artificial Sequence
  Synthetic
aagacgtgtggggctcccccctgcacgtttgcgtcatctgggaacagatctctgacctgccctactgaatgcttc

SEQ ID NO: 133357 - DNA, 75 bp, Artificial Sequence
  Synthetic
aagacgtgtggggctcccccctgcacgtttgcgtcatctgggaacagatctctgacctgccctactgattgcttc

SEQ ID NO: 133358 - DNA, 75 bp, Artificial Sequence
  Synthetic
aagacgtgtggggctcccccctgcacgtttgcgtcatctgggaacagatctctgacctgccctactgactgcttc

SEQ ID NO: 133359 - DNA, 75 bp, Artificial Sequence
  Synthetic
aagacgtgtggggctcccccctgcacgtttgcgtcatctgggaacagatctctgacctgccctactgagtgcttc

SEQ ID NO: 133360 - DNA, 75 bp, Artificial Sequence
  Synthetic
aagacgtgtggggctcccccctgcacgtttgcgtcatctgggaacagatctctgacctggcctactgaatgcttc

SEQ ID NO: 133361 - DNA, 75 bp, Artificial Sequence
  Synthetic
aagacgtgtggggctcccccctgcacgtttgcgtcatctgggaacagatctctgacctggcctactgattgcttc

SEQ ID NO: 133362 - DNA, 75 bp, Artificial Sequence
  Synthetic
aagacgtgtggggctcccccctgcacgtttgcgtcatctgggaacagatctctgacctggcctactgactgcttc

SEQ ID NO: 133363 - DNA, 75 bp, Artificial Sequence
  Synthetic
aagacgtgtggggctcccccctgcacgtttgcgtcatctgggaacagatctctgacctggcctactgagtgcttc

SEQ ID NO: 133364 - DNA, 75 bp, Artificial Sequence
  Synthetic
ttgggactattgtaaccagcttgactggtagggataagaatgtggtgaccggtgaagtgcaggtgctctctacag

SEQ ID NO: 133365 - DNA, 75 bp, Artificial Sequence
  Synthetic
acatcgtggacgtgcaatacttgtacggaatagggtccgcagttgtgtccttctccatcaaatgggagtacatcg

SEQ ID NO: 133366 - DNA, 75 bp, Artificial Sequence
  Synthetic
gcaccgttaatttcaccattcaaaaggtgcgcatgtttgtggggggggtagagcacaggttgaaggccgcatgca

SEQ ID NO: 133367 - DNA, 75 bp, Artificial Sequence
  Synthetic
gcaccgttaatttcaccattcaaaaggtgcgcatgtttgtggggggggtagagcacaggttgtaggccgcatgca

SEQ ID NO: 133368 - DNA, 75 bp, Artificial Sequence
  Synthetic
gcaccgttaatttcaccattcaaaaggtgcgcatgtttgtggggggggtagagcacaggttgcaggccgcatgca

SEQ ID NO: 133369 - DNA, 75 bp, Artificial Sequence
  Synthetic
gcaccgttaatttcaccattcaaaaggtgcgcatgtttgtggggggggtagagcacaggttggaggccgcatgca

SEQ ID NO: 133370 - DNA, 75 bp, Artificial Sequence
  Synthetic
gcaccgttaatttcaccattcataaggtgcgcatgtttgtggggggggtagagcacaggttgaaggccgcatgca

SEQ ID NO: 133371 - DNA, 75 bp, Artificial Sequence
  Synthetic
gcaccgttaatttcaccattcataaggtgcgcatgtttgtggggggggtagagcacaggttgtaggccgcatgca

SEQ ID NO: 133372 - DNA, 75 bp, Artificial Sequence
  Synthetic
gcaccgttaatttcaccattcataaggtgcgcatgtttgtggggggggtagagcacaggttgcaggccgcatgca

SEQ ID NO: 133373 - DNA, 75 bp, Artificial Sequence
  Synthetic
gcaccgttaatttcaccattcataaggtgcgcatgtttgtggggggggtagagcacaggttggaggccgcatgca

SEQ ID NO: 133374 - DNA, 75 bp, Artificial Sequence
  Synthetic
gcaccgttaatttcaccattcacaaggtgcgcatgtttgtggggggggtagagcacaggttgaaggccgcatgca

SEQ ID NO: 133375 - DNA, 75 bp, Artificial Sequence
  Synthetic
gcaccgttaatttcaccattcacaaggtgcgcatgtttgtggggggggtagagcacaggttgtaggccgcatgca

SEQ ID NO: 133376 - DNA, 75 bp, Artificial Sequence
  Synthetic
gcaccgttaatttcaccattcacaaggtgcgcatgtttgtggggggggtagagcacaggttgcaggccgcatgca

SEQ ID NO: 133377 - DNA, 75 bp, Artificial Sequence
  Synthetic
gcaccgttaatttcaccattcacaaggtgcgcatgtttgtggggggggtagagcacaggttggaggccgcatgca

SEQ ID NO: 133378 - DNA, 75 bp, Artificial Sequence
  Synthetic
gcaccgttaatttcaccattcagaaggtgcgcatgtttgtggggggggtagagcacaggttgaaggccgcatgca

SEQ ID NO: 133379 - DNA, 75 bp, Artificial Sequence
  Synthetic
gcaccgttaatttcaccattcagaaggtgcgcatgtttgtggggggggtagagcacaggttgtaggccgcatgca

SEQ ID NO: 133380 - DNA, 75 bp, Artificial Sequence
  Synthetic
gcaccgttaatttcaccattcagaaggtgcgcatgtttgtggggggggtagagcacaggttgcaggccgcatgca

SEQ ID NO: 133381 - DNA, 75 bp, Artificial Sequence
  Synthetic
gcaccgttaatttcaccattcagaaggtgcgcatgtttgtggggggggtagagcacaggttggaggccgcatgca

SEQ ID NO: 133382 - DNA, 75 bp, Artificial Sequence
  Synthetic
agaaaatcaatttgatcaacaccaatggcagttggcacataaaccggaccgccctcaactgcaatgacagcctga

SEQ ID NO: 133383 - DNA, 75 bp, Artificial Sequence
  Synthetic
ggactcgaggagagcgttgtgacttggaggacagggatagatcagagctcagcccgctgctgctgtctacaacag

SEQ ID NO: 133384 - DNA, 75 bp, Artificial Sequence
  Synthetic
tttcaccactatgccagccctgtcaactgggcttatacacttgcatcaaaatatagtggatgtccaatacctgta

SEQ ID NO: 133385 - DNA, 75 bp, Artificial Sequence
  Synthetic
tttcaccactatgcctgccctgtcaactgggcttatacacttgcatcaaaatatagtggatgtccaatacctgta

SEQ ID NO: 133386 - DNA, 75 bp, Artificial Sequence
  Synthetic
tttcaccactatgcccgccctgtcaactgggcttatacacttgcatcaaaatatagtggatgtccaatacctgta

SEQ ID NO: 133387 - DNA, 75 bp, Artificial Sequence
  Synthetic
tttcaccactatgccggccctgtcaactgggcttatacacttgcatcaaaatatagtggatgtccaatacctgta

SEQ ID NO: 133388 - DNA, 75 bp, Artificial Sequence
  Synthetic
ccttaatgccgcgtcccttgcagggacgcacgggcttctctctttccttgtgttcttctgtgccgcgtggtacat

SEQ ID NO: 133389 - DNA, 75 bp, Artificial Sequence
  Synthetic
cgggtggggagctttggaatacgaaaccaatgtcaccaacgacgaggacatgaggccgtactgctggcattaccc

SEQ ID NO: 133390 - DNA, 75 bp, Artificial Sequence
  Synthetic
cttatgctactcataggccaggcggaggctgcgctagagaacctaatcgtcctcaacgcggcttccgccgccagt

SEQ ID NO: 133391 - DNA, 75 bp, Artificial Sequence
  Synthetic
cttatgctactcataggccaggcggaggctgcgcttgagaacctaatcgtcctcaacgcggcttccgccgccagt

SEQ ID NO: 133392 - DNA, 75 bp, Artificial Sequence
  Synthetic
cttatgctactcataggccaggcggaggctgcgctcgagaacctaatcgtcctcaacgcggcttccgccgccagt

SEQ ID NO: 133393 - DNA, 75 bp, Artificial Sequence
  Synthetic
cttatgctactcataggccaggcggaggctgcgctggagaacctaatcgtcctcaacgcggcttccgccgccagt

SEQ ID NO: 133394 - DNA, 75 bp, Artificial Sequence
  Synthetic
cacgaagctgccgcgtcgtgtgggggcgctgtcctcgtctgcttgacagttctgaccttgtcaccgcattacaag

SEQ ID NO: 133395 - DNA, 75 bp, Artificial Sequence
  Synthetic
ataatatgtgatgagtgccactcaactgactcgacttccatcttgggtattggcacagtcctggaccaagcggag

SEQ ID NO: 133396 - DNA, 75 bp, Artificial Sequence
  Synthetic
cgctcctgctactggtacttgctcttccgccacgtgcttttgcccaggaccaggagcaggcagcttgcatcgggg

SEQ ID NO: 133397 - DNA, 75 bp, Artificial Sequence
  Synthetic
cgctcctgctactggtacttgctcttccgcctcgtgcttttgcccaggaccaggagcaggcagcttgcatcgggg

SEQ ID NO: 133398 - DNA, 75 bp, Artificial Sequence
  Synthetic
cgctcctgctactggtacttgctcttccgccccgtgcttttgcccaggaccaggagcaggcagcttgcatcgggg

SEQ ID NO: 133399 - DNA, 75 bp, Artificial Sequence
  Synthetic
cgctcctgctactggtacttgctcttccgccgcgtgcttttgcccaggaccaggagcaggcagcttgcatcgggg

SEQ ID NO: 133400 - DNA, 75 bp, Artificial Sequence
  Synthetic
cgctcctgctactggttcttgctcttccgccacgtgcttttgcccaggaccaggagcaggcagcttgcatcgggg

SEQ ID NO: 133401 - DNA, 75 bp, Artificial Sequence
  Synthetic
cgctcctgctactggttcttgctcttccgcctcgtgcttttgcccaggaccaggagcaggcagcttgcatcgggg

SEQ ID NO: 133402 - DNA, 75 bp, Artificial Sequence
  Synthetic
cgctcctgctactggttcttgctcttccgccccgtgcttttgcccaggaccaggagcaggcagcttgcatcgggg

SEQ ID NO: 133403 - DNA, 75 bp, Artificial Sequence
  Synthetic
cgctcctgctactggttcttgctcttccgccgcgtgcttttgcccaggaccaggagcaggcagcttgcatcgggg

SEQ ID NO: 133404 - DNA, 75 bp, Artificial Sequence
  Synthetic
cgctcctgctactggtccttgctcttccgccacgtgcttttgcccaggaccaggagcaggcagcttgcatcgggg

SEQ ID NO: 133405 - DNA, 75 bp, Artificial Sequence
  Synthetic
cgctcctgctactggtccttgctcttccgcctcgtgcttttgcccaggaccaggagcaggcagcttgcatcgggg

SEQ ID NO: 133406 - DNA, 75 bp, Artificial Sequence
  Synthetic
cgctcctgctactggtccttgctcttccgccccgtgcttttgcccaggaccaggagcaggcagcttgcatcgggg

SEQ ID NO: 133407 - DNA, 75 bp, Artificial Sequence
  Synthetic
cgctcctgctactggtccttgctcttccgccgcgtgcttttgcccaggaccaggagcaggcagcttgcatcgggg

SEQ ID NO: 133408 - DNA, 75 bp, Artificial Sequence
  Synthetic
cgctcctgctactggtgcttgctcttccgccacgtgcttttgcccaggaccaggagcaggcagcttgcatcgggg

SEQ ID NO: 133409 - DNA, 75 bp, Artificial Sequence
  Synthetic
cgctcctgctactggtgcttgctcttccgcctcgtgcttttgcccaggaccaggagcaggcagcttgcatcgggg

SEQ ID NO: 133410 - DNA, 75 bp, Artificial Sequence
  Synthetic
cgctcctgctactggtgcttgctcttccgccccgtgcttttgcccaggaccaggagcaggcagcttgcatcgggg

SEQ ID NO: 133411 - DNA, 75 bp, Artificial Sequence
  Synthetic
cgctcctgctactggtgcttgctcttccgccgcgtgcttttgcccaggaccaggagcaggcagcttgcatcgggg

SEQ ID NO: 133412 - DNA, 75 bp, Artificial Sequence
  Synthetic
cgctcctgcttctggtacttgctcttccgccacgtgcttttgcccaggaccaggagcaggcagcttgcatcgggg

SEQ ID NO: 133413 - DNA, 75 bp, Artificial Sequence
  Synthetic
cgctcctgcttctggtacttgctcttccgcctcgtgcttttgcccaggaccaggagcaggcagcttgcatcgggg

SEQ ID NO: 133414 - DNA, 75 bp, Artificial Sequence
  Synthetic
cgctcctgcttctggtacttgctcttccgccccgtgcttttgcccaggaccaggagcaggcagcttgcatcgggg

SEQ ID NO: 133415 - DNA, 75 bp, Artificial Sequence
  Synthetic
cgctcctgcttctggtacttgctcttccgccgcgtgcttttgcccaggaccaggagcaggcagcttgcatcgggg

SEQ ID NO: 133416 - DNA, 75 bp, Artificial Sequence
  Synthetic
cgctcctgcttctggttcttgctcttccgccacgtgcttttgcccaggaccaggagcaggcagcttgcatcgggg

SEQ ID NO: 133417 - DNA, 75 bp, Artificial Sequence
  Synthetic
cgctcctgcttctggttcttgctcttccgcctcgtgcttttgcccaggaccaggagcaggcagcttgcatcgggg

SEQ ID NO: 133418 - DNA, 75 bp, Artificial Sequence
  Synthetic
cgctcctgcttctggttcttgctcttccgccccgtgcttttgcccaggaccaggagcaggcagcttgcatcgggg

SEQ ID NO: 133419 - DNA, 75 bp, Artificial Sequence
  Synthetic
cgctcctgcttctggttcttgctcttccgccgcgtgcttttgcccaggaccaggagcaggcagcttgcatcgggg

SEQ ID NO: 133420 - DNA, 75 bp, Artificial Sequence
  Synthetic
cgctcctgcttctggtccttgctcttccgccacgtgcttttgcccaggaccaggagcaggcagcttgcatcgggg

SEQ ID NO: 133421 - DNA, 75 bp, Artificial Sequence
  Synthetic
cgctcctgcttctggtccttgctcttccgcctcgtgcttttgcccaggaccaggagcaggcagcttgcatcgggg

SEQ ID NO: 133422 - DNA, 75 bp, Artificial Sequence
  Synthetic
cgctcctgcttctggtccttgctcttccgccccgtgcttttgcccaggaccaggagcaggcagcttgcatcgggg

SEQ ID NO: 133423 - DNA, 75 bp, Artificial Sequence
  Synthetic
cgctcctgcttctggtccttgctcttccgccgcgtgcttttgcccaggaccaggagcaggcagcttgcatcgggg

SEQ ID NO: 133424 - DNA, 75 bp, Artificial Sequence
  Synthetic
cgctcctgcttctggtgcttgctcttccgccacgtgcttttgcccaggaccaggagcaggcagcttgcatcgggg

SEQ ID NO: 133425 - DNA, 75 bp, Artificial Sequence
  Synthetic
cgctcctgcttctggtgcttgctcttccgcctcgtgcttttgcccaggaccaggagcaggcagcttgcatcgggg

SEQ ID NO: 133426 - DNA, 75 bp, Artificial Sequence
  Synthetic
cgctcctgcttctggtgcttgctcttccgccccgtgcttttgcccaggaccaggagcaggcagcttgcatcgggg

SEQ ID NO: 133427 - DNA, 75 bp, Artificial Sequence
  Synthetic
cgctcctgcttctggtgcttgctcttccgccgcgtgcttttgcccaggaccaggagcaggcagcttgcatcgggg

SEQ ID NO: 133428 - DNA, 75 bp, Artificial Sequence
  Synthetic
cgctcctgctcctggtacttgctcttccgccacgtgcttttgcccaggaccaggagcaggcagcttgcatcgggg

SEQ ID NO: 133429 - DNA, 75 bp, Artificial Sequence
  Synthetic
cgctcctgctcctggtacttgctcttccgcctcgtgcttttgcccaggaccaggagcaggcagcttgcatcgggg

SEQ ID NO: 133430 - DNA, 75 bp, Artificial Sequence
  Synthetic
cgctcctgctcctggtacttgctcttccgccccgtgcttttgcccaggaccaggagcaggcagcttgcatcgggg

SEQ ID NO: 133431 - DNA, 75 bp, Artificial Sequence
  Synthetic
cgctcctgctcctggtacttgctcttccgccgcgtgcttttgcccaggaccaggagcaggcagcttgcatcgggg

SEQ ID NO: 133432 - DNA, 75 bp, Artificial Sequence
  Synthetic
cgctcctgctcctggttcttgctcttccgccacgtgcttttgcccaggaccaggagcaggcagcttgcatcgggg

SEQ ID NO: 133433 - DNA, 75 bp, Artificial Sequence
  Synthetic
cgctcctgctcctggttcttgctcttccgcctcgtgcttttgcccaggaccaggagcaggcagcttgcatcgggg

SEQ ID NO: 133434 - DNA, 75 bp, Artificial Sequence
  Synthetic
cgctcctgctcctggttcttgctcttccgccccgtgcttttgcccaggaccaggagcaggcagcttgcatcgggg

SEQ ID NO: 133435 - DNA, 75 bp, Artificial Sequence
  Synthetic
cgctcctgctcctggttcttgctcttccgccgcgtgcttttgcccaggaccaggagcaggcagcttgcatcgggg

SEQ ID NO: 133436 - DNA, 75 bp, Artificial Sequence
  Synthetic
cgctcctgctcctggtccttgctcttccgccacgtgcttttgcccaggaccaggagcaggcagcttgcatcgggg

SEQ ID NO: 133437 - DNA, 75 bp, Artificial Sequence
  Synthetic
cgctcctgctcctggtccttgctcttccgcctcgtgcttttgcccaggaccaggagcaggcagcttgcatcgggg

SEQ ID NO: 133438 - DNA, 75 bp, Artificial Sequence
  Synthetic
cgctcctgctcctggtccttgctcttccgccccgtgcttttgcccaggaccaggagcaggcagcttgcatcgggg

SEQ ID NO: 133439 - DNA, 75 bp, Artificial Sequence
  Synthetic
cgctcctgctcctggtccttgctcttccgccgcgtgcttttgcccaggaccaggagcaggcagcttgcatcgggg

SEQ ID NO: 133440 - DNA, 75 bp, Artificial Sequence
  Synthetic
cgctcctgctcctggtgcttgctcttccgccacgtgcttttgcccaggaccaggagcaggcagcttgcatcgggg

SEQ ID NO: 133441 - DNA, 75 bp, Artificial Sequence
  Synthetic
cgctcctgctcctggtgcttgctcttccgcctcgtgcttttgcccaggaccaggagcaggcagcttgcatcgggg

SEQ ID NO: 133442 - DNA, 75 bp, Artificial Sequence
  Synthetic
cgctcctgctcctggtgcttgctcttccgccccgtgcttttgcccaggaccaggagcaggcagcttgcatcgggg

SEQ ID NO: 133443 - DNA, 75 bp, Artificial Sequence
  Synthetic
cgctcctgctcctggtgcttgctcttccgccgcgtgcttttgcccaggaccaggagcaggcagcttgcatcgggg

SEQ ID NO: 133444 - DNA, 75 bp, Artificial Sequence
  Synthetic
cgctcctgctgctggtacttgctcttccgccacgtgcttttgcccaggaccaggagcaggcagcttgcatcgggg

SEQ ID NO: 133445 - DNA, 75 bp, Artificial Sequence
  Synthetic
cgctcctgctgctggtacttgctcttccgcctcgtgcttttgcccaggaccaggagcaggcagcttgcatcgggg

SEQ ID NO: 133446 - DNA, 75 bp, Artificial Sequence
  Synthetic
cgctcctgctgctggtacttgctcttccgccccgtgcttttgcccaggaccaggagcaggcagcttgcatcgggg

SEQ ID NO: 133447 - DNA, 75 bp, Artificial Sequence
  Synthetic
cgctcctgctgctggtacttgctcttccgccgcgtgcttttgcccaggaccaggagcaggcagcttgcatcgggg

SEQ ID NO: 133448 - DNA, 75 bp, Artificial Sequence
  Synthetic
cgctcctgctgctggttcttgctcttccgccacgtgcttttgcccaggaccaggagcaggcagcttgcatcgggg

SEQ ID NO: 133449 - DNA, 75 bp, Artificial Sequence
  Synthetic
cgctcctgctgctggttcttgctcttccgcctcgtgcttttgcccaggaccaggagcaggcagcttgcatcgggg

SEQ ID NO: 133450 - DNA, 75 bp, Artificial Sequence
  Synthetic
cgctcctgctgctggttcttgctcttccgccccgtgcttttgcccaggaccaggagcaggcagcttgcatcgggg

SEQ ID NO: 133451 - DNA, 75 bp, Artificial Sequence
  Synthetic
cgctcctgctgctggttcttgctcttccgccgcgtgcttttgcccaggaccaggagcaggcagcttgcatcgggg

SEQ ID NO: 133452 - DNA, 75 bp, Artificial Sequence
  Synthetic
cgctcctgctgctggtccttgctcttccgccacgtgcttttgcccaggaccaggagcaggcagcttgcatcgggg

SEQ ID NO: 133453 - DNA, 75 bp, Artificial Sequence
  Synthetic
cgctcctgctgctggtccttgctcttccgcctcgtgcttttgcccaggaccaggagcaggcagcttgcatcgggg

SEQ ID NO: 133454 - DNA, 75 bp, Artificial Sequence
  Synthetic
cgctcctgctgctggtccttgctcttccgccccgtgcttttgcccaggaccaggagcaggcagcttgcatcgggg

SEQ ID NO: 133455 - DNA, 75 bp, Artificial Sequence
  Synthetic
cgctcctgctgctggtccttgctcttccgccgcgtgcttttgcccaggaccaggagcaggcagcttgcatcgggg

SEQ ID NO: 133456 - DNA, 75 bp, Artificial Sequence
  Synthetic
cgctcctgctgctggtgcttgctcttccgccacgtgcttttgcccaggaccaggagcaggcagcttgcatcgggg

SEQ ID NO: 133457 - DNA, 75 bp, Artificial Sequence
  Synthetic
cgctcctgctgctggtgcttgctcttccgcctcgtgcttttgcccaggaccaggagcaggcagcttgcatcgggg

SEQ ID NO: 133458 - DNA, 75 bp, Artificial Sequence
  Synthetic
cgctcctgctgctggtgcttgctcttccgccccgtgcttttgcccaggaccaggagcaggcagcttgcatcgggg

SEQ ID NO: 133459 - DNA, 75 bp, Artificial Sequence
  Synthetic
cgctcctgctgctggtgcttgctcttccgccgcgtgcttttgcccaggaccaggagcaggcagcttgcatcgggg

SEQ ID NO: 133460 - DNA, 75 bp, Artificial Sequence
  Synthetic
gggacgccgtcatcattcttacatgtgcagcctacccggagctgatatttgacatcaccaagctcctgcttgcca

SEQ ID NO: 133461 - DNA, 75 bp, Artificial Sequence
  Synthetic
agaggccatgcttcacgtgtgggttcccaatctctcagttagggggggtcgtgatgccatcatactcatcacctg

SEQ ID NO: 133462 - DNA, 75 bp, Artificial Sequence
  Synthetic
agaggccatgcttcacgtgtgggttcccaatctctctgttagggggggtcgtgatgccatcatactcatcacctg

SEQ ID NO: 133463 - DNA, 75 bp, Artificial Sequence
  Synthetic
agaggccatgcttcacgtgtgggttcccaatctctccgttagggggggtcgtgatgccatcatactcatcacctg

SEQ ID NO: 133464 - DNA, 75 bp, Artificial Sequence
  Synthetic
agaggccatgcttcacgtgtgggttcccaatctctcggttagggggggtcgtgatgccatcatactcatcacctg

SEQ ID NO: 133465 - DNA, 75 bp, Artificial Sequence
  Synthetic
ggcgggtggccactacatccaaatggcccttattaaactgggtgccctttcgggcacctatatatataaccatct

SEQ ID NO: 133466 - DNA, 75 bp, Artificial Sequence
  Synthetic
cccaatctctcagttagggggggtcgtgatgccatcatactcatcacctgtttattgcatccatctctcgggtta

SEQ ID NO: 133467 - DNA, 75 bp, Artificial Sequence
  Synthetic
cccaatctctcagttagggggggtcgtgatgccatcatactcatcacctgtttattgcatccatctctcgggttt

SEQ ID NO: 133468 - DNA, 75 bp, Artificial Sequence
  Synthetic
cccaatctctcagttagggggggtcgtgatgccatcatactcatcacctgtttattgcatccatctctcgggttc

SEQ ID NO: 133469 - DNA, 75 bp, Artificial Sequence
  Synthetic
cccaatctctcagttagggggggtcgtgatgccatcatactcatcacctgtttattgcatccatctctcgggttg

SEQ ID NO: 133470 - DNA, 75 bp, Artificial Sequence
  Synthetic
cccaatctctcagttagggggggtcgtgatgccatcatactcatcacctgttttttgcatccatctctcgggtta

SEQ ID NO: 133471 - DNA, 75 bp, Artificial Sequence
  Synthetic
cccaatctctcagttagggggggtcgtgatgccatcatactcatcacctgttttttgcatccatctctcgggttt

SEQ ID NO: 133472 - DNA, 75 bp, Artificial Sequence
  Synthetic
cccaatctctcagttagggggggtcgtgatgccatcatactcatcacctgttttttgcatccatctctcgggttc

SEQ ID NO: 133473 - DNA, 75 bp, Artificial Sequence
  Synthetic
cccaatctctcagttagggggggtcgtgatgccatcatactcatcacctgttttttgcatccatctctcgggttg

SEQ ID NO: 133474 - DNA, 75 bp, Artificial Sequence
  Synthetic
cccaatctctcagttagggggggtcgtgatgccatcatactcatcacctgtttcttgcatccatctctcgggtta

SEQ ID NO: 133475 - DNA, 75 bp, Artificial Sequence
  Synthetic
cccaatctctcagttagggggggtcgtgatgccatcatactcatcacctgtttcttgcatccatctctcgggttt

SEQ ID NO: 133476 - DNA, 75 bp, Artificial Sequence
  Synthetic
cccaatctctcagttagggggggtcgtgatgccatcatactcatcacctgtttcttgcatccatctctcgggttc

SEQ ID NO: 133477 - DNA, 75 bp, Artificial Sequence
  Synthetic
cccaatctctcagttagggggggtcgtgatgccatcatactcatcacctgtttcttgcatccatctctcgggttg

SEQ ID NO: 133478 - DNA, 75 bp, Artificial Sequence
  Synthetic
cccaatctctcagttagggggggtcgtgatgccatcatactcatcacctgtttgttgcatccatctctcgggtta

SEQ ID NO: 133479 - DNA, 75 bp, Artificial Sequence
  Synthetic
cccaatctctcagttagggggggtcgtgatgccatcatactcatcacctgtttgttgcatccatctctcgggttt

SEQ ID NO: 133480 - DNA, 75 bp, Artificial Sequence
  Synthetic
cccaatctctcagttagggggggtcgtgatgccatcatactcatcacctgtttgttgcatccatctctcgggttc

SEQ ID NO: 133481 - DNA, 75 bp, Artificial Sequence
  Synthetic
cccaatctctcagttagggggggtcgtgatgccatcatactcatcacctgtttgttgcatccatctctcgggttg

SEQ ID NO: 133482 - DNA, 75 bp, Artificial Sequence
  Synthetic
cccaatctctctgttagggggggtcgtgatgccatcatactcatcacctgtttattgcatccatctctcgggtta

SEQ ID NO: 133483 - DNA, 75 bp, Artificial Sequence
  Synthetic
cccaatctctctgttagggggggtcgtgatgccatcatactcatcacctgtttattgcatccatctctcgggttt

SEQ ID NO: 133484 - DNA, 75 bp, Artificial Sequence
  Synthetic
cccaatctctctgttagggggggtcgtgatgccatcatactcatcacctgtttattgcatccatctctcgggttc

SEQ ID NO: 133485 - DNA, 75 bp, Artificial Sequence
  Synthetic
cccaatctctctgttagggggggtcgtgatgccatcatactcatcacctgtttattgcatccatctctcgggttg

SEQ ID NO: 133486 - DNA, 75 bp, Artificial Sequence
  Synthetic
cccaatctctctgttagggggggtcgtgatgccatcatactcatcacctgttttttgcatccatctctcgggtta

SEQ ID NO: 133487 - DNA, 75 bp, Artificial Sequence
  Synthetic
cccaatctctctgttagggggggtcgtgatgccatcatactcatcacctgttttttgcatccatctctcgggttt

SEQ ID NO: 133488 - DNA, 75 bp, Artificial Sequence
  Synthetic
cccaatctctctgttagggggggtcgtgatgccatcatactcatcacctgttttttgcatccatctctcgggttc

SEQ ID NO: 133489 - DNA, 75 bp, Artificial Sequence
  Synthetic
cccaatctctctgttagggggggtcgtgatgccatcatactcatcacctgttttttgcatccatctctcgggttg

SEQ ID NO: 133490 - DNA, 75 bp, Artificial Sequence
  Synthetic
cccaatctctctgttagggggggtcgtgatgccatcatactcatcacctgtttcttgcatccatctctcgggtta

SEQ ID NO: 133491 - DNA, 75 bp, Artificial Sequence
  Synthetic
cccaatctctctgttagggggggtcgtgatgccatcatactcatcacctgtttcttgcatccatctctcgggttt

SEQ ID NO: 133492 - DNA, 75 bp, Artificial Sequence
  Synthetic
cccaatctctctgttagggggggtcgtgatgccatcatactcatcacctgtttcttgcatccatctctcgggttc

SEQ ID NO: 133493 - DNA, 75 bp, Artificial Sequence
  Synthetic
cccaatctctctgttagggggggtcgtgatgccatcatactcatcacctgtttcttgcatccatctctcgggttg

SEQ ID NO: 133494 - DNA, 75 bp, Artificial Sequence
  Synthetic
cccaatctctctgttagggggggtcgtgatgccatcatactcatcacctgtttgttgcatccatctctcgggtta

SEQ ID NO: 133495 - DNA, 75 bp, Artificial Sequence
  Synthetic
cccaatctctctgttagggggggtcgtgatgccatcatactcatcacctgtttgttgcatccatctctcgggttt

SEQ ID NO: 133496 - DNA, 75 bp, Artificial Sequence
  Synthetic
cccaatctctctgttagggggggtcgtgatgccatcatactcatcacctgtttgttgcatccatctctcgggttc

SEQ ID NO: 133497 - DNA, 75 bp, Artificial Sequence
  Synthetic
cccaatctctctgttagggggggtcgtgatgccatcatactcatcacctgtttgttgcatccatctctcgggttg

SEQ ID NO: 133498 - DNA, 75 bp, Artificial Sequence
  Synthetic
cccaatctctccgttagggggggtcgtgatgccatcatactcatcacctgtttattgcatccatctctcgggtta

SEQ ID NO: 133499 - DNA, 75 bp, Artificial Sequence
  Synthetic
cccaatctctccgttagggggggtcgtgatgccatcatactcatcacctgtttattgcatccatctctcgggttt

SEQ ID NO: 133500 - DNA, 75 bp, Artificial Sequence
  Synthetic
cccaatctctccgttagggggggtcgtgatgccatcatactcatcacctgtttattgcatccatctctcgggttc

SEQ ID NO: 133501 - DNA, 75 bp, Artificial Sequence
  Synthetic
cccaatctctccgttagggggggtcgtgatgccatcatactcatcacctgtttattgcatccatctctcgggttg

SEQ ID NO: 133502 - DNA, 75 bp, Artificial Sequence
  Synthetic
cccaatctctccgttagggggggtcgtgatgccatcatactcatcacctgttttttgcatccatctctcgggtta

SEQ ID NO: 133503 - DNA, 75 bp, Artificial Sequence
  Synthetic
cccaatctctccgttagggggggtcgtgatgccatcatactcatcacctgttttttgcatccatctctcgggttt

SEQ ID NO: 133504 - DNA, 75 bp, Artificial Sequence
  Synthetic
cccaatctctccgttagggggggtcgtgatgccatcatactcatcacctgttttttgcatccatctctcgggttc

SEQ ID NO: 133505 - DNA, 75 bp, Artificial Sequence
  Synthetic
cccaatctctccgttagggggggtcgtgatgccatcatactcatcacctgttttttgcatccatctctcgggttg

SEQ ID NO: 133506 - DNA, 75 bp, Artificial Sequence
  Synthetic
cccaatctctccgttagggggggtcgtgatgccatcatactcatcacctgtttcttgcatccatctctcgggtta

SEQ ID NO: 133507 - DNA, 75 bp, Artificial Sequence
  Synthetic
cccaatctctccgttagggggggtcgtgatgccatcatactcatcacctgtttcttgcatccatctctcgggttt

SEQ ID NO: 133508 - DNA, 75 bp, Artificial Sequence
  Synthetic
cccaatctctccgttagggggggtcgtgatgccatcatactcatcacctgtttcttgcatccatctctcgggttc

SEQ ID NO: 133509 - DNA, 75 bp, Artificial Sequence
  Synthetic
cccaatctctccgttagggggggtcgtgatgccatcatactcatcacctgtttcttgcatccatctctcgggttg

SEQ ID NO: 133510 - DNA, 75 bp, Artificial Sequence
  Synthetic
cccaatctctccgttagggggggtcgtgatgccatcatactcatcacctgtttgttgcatccatctctcgggtta

SEQ ID NO: 133511 - DNA, 75 bp, Artificial Sequence
  Synthetic
cccaatctctccgttagggggggtcgtgatgccatcatactcatcacctgtttgttgcatccatctctcgggttt

SEQ ID NO: 133512 - DNA, 75 bp, Artificial Sequence
  Synthetic
cccaatctctccgttagggggggtcgtgatgccatcatactcatcacctgtttgttgcatccatctctcgggttc

SEQ ID NO: 133513 - DNA, 75 bp, Artificial Sequence
  Synthetic
cccaatctctccgttagggggggtcgtgatgccatcatactcatcacctgtttgttgcatccatctctcgggttg

SEQ ID NO: 133514 - DNA, 75 bp, Artificial Sequence
  Synthetic
cccaatctctcggttagggggggtcgtgatgccatcatactcatcacctgtttattgcatccatctctcgggtta

SEQ ID NO: 133515 - DNA, 75 bp, Artificial Sequence
  Synthetic
cccaatctctcggttagggggggtcgtgatgccatcatactcatcacctgtttattgcatccatctctcgggttt

SEQ ID NO: 133516 - DNA, 75 bp, Artificial Sequence
  Synthetic
cccaatctctcggttagggggggtcgtgatgccatcatactcatcacctgtttattgcatccatctctcgggttc

SEQ ID NO: 133517 - DNA, 75 bp, Artificial Sequence
  Synthetic
cccaatctctcggttagggggggtcgtgatgccatcatactcatcacctgtttattgcatccatctctcgggttg

SEQ ID NO: 133518 - DNA, 75 bp, Artificial Sequence
  Synthetic
cccaatctctcggttagggggggtcgtgatgccatcatactcatcacctgttttttgcatccatctctcgggtta

SEQ ID NO: 133519 - DNA, 75 bp, Artificial Sequence
  Synthetic
cccaatctctcggttagggggggtcgtgatgccatcatactcatcacctgttttttgcatccatctctcgggttt

SEQ ID NO: 133520 - DNA, 75 bp, Artificial Sequence
  Synthetic
cccaatctctcggttagggggggtcgtgatgccatcatactcatcacctgttttttgcatccatctctcgggttc

SEQ ID NO: 133521 - DNA, 75 bp, Artificial Sequence
  Synthetic
cccaatctctcggttagggggggtcgtgatgccatcatactcatcacctgttttttgcatccatctctcgggttg

SEQ ID NO: 133522 - DNA, 75 bp, Artificial Sequence
  Synthetic
cccaatctctcggttagggggggtcgtgatgccatcatactcatcacctgtttcttgcatccatctctcgggtta

SEQ ID NO: 133523 - DNA, 75 bp, Artificial Sequence
  Synthetic
cccaatctctcggttagggggggtcgtgatgccatcatactcatcacctgtttcttgcatccatctctcgggttt

SEQ ID NO: 133524 - DNA, 75 bp, Artificial Sequence
  Synthetic
cccaatctctcggttagggggggtcgtgatgccatcatactcatcacctgtttcttgcatccatctctcgggttc

SEQ ID NO: 133525 - DNA, 75 bp, Artificial Sequence
  Synthetic
cccaatctctcggttagggggggtcgtgatgccatcatactcatcacctgtttcttgcatccatctctcgggttg

SEQ ID NO: 133526 - DNA, 75 bp, Artificial Sequence
  Synthetic
cccaatctctcggttagggggggtcgtgatgccatcatactcatcacctgtttgttgcatccatctctcgggtta

SEQ ID NO: 133527 - DNA, 75 bp, Artificial Sequence
  Synthetic
cccaatctctcggttagggggggtcgtgatgccatcatactcatcacctgtttgttgcatccatctctcgggttt

SEQ ID NO: 133528 - DNA, 75 bp, Artificial Sequence
  Synthetic
cccaatctctcggttagggggggtcgtgatgccatcatactcatcacctgtttgttgcatccatctctcgggttc

SEQ ID NO: 133529 - DNA, 75 bp, Artificial Sequence
  Synthetic
cccaatctctcggttagggggggtcgtgatgccatcatactcatcacctgtttgttgcatccatctctcgggttg

SEQ ID NO: 133530 - DNA, 75 bp, Artificial Sequence
  Synthetic
ttaatggcgctgactctgtcaccgcattacaagcgctatatcagctggtgcttttggtggcttcagtatttcctg

SEQ ID NO: 133531 - DNA, 75 bp, Artificial Sequence
  Synthetic
gatgatgtttgctggtacgccaactagccggagcaaagtacattcaggcctgtttgctgagagttggagcatgga

SEQ ID NO: 133532 - DNA, 75 bp, Artificial Sequence
  Synthetic
gatgatgtttgctggtacgccaactagccggagcaaagtacattcaggcctgtttgctgagtgttggagcatgga

SEQ ID NO: 133533 - DNA, 75 bp, Artificial Sequence
  Synthetic
gatgatgtttgctggtacgccaactagccggagcaaagtacattcaggcctgtttgctgagcgttggagcatgga

SEQ ID NO: 133534 - DNA, 75 bp, Artificial Sequence
  Synthetic
gatgatgtttgctggtacgccaactagccggagcaaagtacattcaggcctgtttgctgagggttggagcatgga

SEQ ID NO: 133535 - DNA, 75 bp, Artificial Sequence
  Synthetic
gatgttgtttgctggtacgccaactagccggagcaaagtacattcaggcctgtttgctgagagttggagcatgga

SEQ ID NO: 133536 - DNA, 75 bp, Artificial Sequence
  Synthetic
gatgttgtttgctggtacgccaactagccggagcaaagtacattcaggcctgtttgctgagtgttggagcatgga

SEQ ID NO: 133537 - DNA, 75 bp, Artificial Sequence
  Synthetic
gatgttgtttgctggtacgccaactagccggagcaaagtacattcaggcctgtttgctgagcgttggagcatgga

SEQ ID NO: 133538 - DNA, 75 bp, Artificial Sequence
  Synthetic
gatgttgtttgctggtacgccaactagccggagcaaagtacattcaggcctgtttgctgagggttggagcatgga

SEQ ID NO: 133539 - DNA, 75 bp, Artificial Sequence
  Synthetic
gatgctgtttgctggtacgccaactagccggagcaaagtacattcaggcctgtttgctgagagttggagcatgga

SEQ ID NO: 133540 - DNA, 75 bp, Artificial Sequence
  Synthetic
gatgctgtttgctggtacgccaactagccggagcaaagtacattcaggcctgtttgctgagtgttggagcatgga

SEQ ID NO: 133541 - DNA, 75 bp, Artificial Sequence
  Synthetic
gatgctgtttgctggtacgccaactagccggagcaaagtacattcaggcctgtttgctgagcgttggagcatgga

SEQ ID NO: 133542 - DNA, 75 bp, Artificial Sequence
  Synthetic
gatgctgtttgctggtacgccaactagccggagcaaagtacattcaggcctgtttgctgagggttggagcatgga

SEQ ID NO: 133543 - DNA, 75 bp, Artificial Sequence
  Synthetic
gatggtgtttgctggtacgccaactagccggagcaaagtacattcaggcctgtttgctgagagttggagcatgga

SEQ ID NO: 133544 - DNA, 75 bp, Artificial Sequence
  Synthetic
gatggtgtttgctggtacgccaactagccggagcaaagtacattcaggcctgtttgctgagtgttggagcatgga

SEQ ID NO: 133545 - DNA, 75 bp, Artificial Sequence
  Synthetic
gatggtgtttgctggtacgccaactagccggagcaaagtacattcaggcctgtttgctgagcgttggagcatgga

SEQ ID NO: 133546 - DNA, 75 bp, Artificial Sequence
  Synthetic
gatggtgtttgctggtacgccaactagccggagcaaagtacattcaggcctgtttgctgagggttggagcatgga

SEQ ID NO: 133547 - DNA, 75 bp, Artificial Sequence
  Synthetic
ggggcagacaccgcggcgtgcggggatattatctctggactacctgtctccgctcggagggggagggagatcctc

SEQ ID NO: 133548 - DNA, 75 bp, Artificial Sequence
  Synthetic
tatggagaagaaggttatcacctggggagcggatacagccgcatgtggcgacatccttgctggcctcccagtctc

SEQ ID NO: 133549 - DNA, 75 bp, Artificial Sequence
  Synthetic
ccagcctgacaggccgcgacaagaaccaggttgagggggaagttcagatcgtctccaccacgtctcagaccttcc

SEQ ID NO: 133550 - DNA, 75 bp, Artificial Sequence
  Synthetic
cgcggtctgatagggacgattgtcacaagcctcactgggcgcgacaaaaacgaggttgagggtgaggtacaagta

SEQ ID NO: 133551 - DNA, 75 bp, Artificial Sequence
  Synthetic
cgcggtctgatagggacgattgtcactagcctcactgggcgcgacaaaaacgaggttgagggtgaggtacaagta

SEQ ID NO: 133552 - DNA, 75 bp, Artificial Sequence
  Synthetic
cgcggtctgatagggacgattgtcaccagcctcactgggcgcgacaaaaacgaggttgagggtgaggtacaagta

SEQ ID NO: 133553 - DNA, 75 bp, Artificial Sequence
  Synthetic
cgcggtctgatagggacgattgtcacgagcctcactgggcgcgacaaaaacgaggttgagggtgaggtacaagta

SEQ ID NO: 133554 - DNA, 75 bp, Artificial Sequence
  Synthetic
cgcggtctgttagggacgattgtcacaagcctcactgggcgcgacaaaaacgaggttgagggtgaggtacaagta

SEQ ID NO: 133555 - DNA, 75 bp, Artificial Sequence
  Synthetic
cgcggtctgttagggacgattgtcactagcctcactgggcgcgacaaaaacgaggttgagggtgaggtacaagta

SEQ ID NO: 133556 - DNA, 75 bp, Artificial Sequence
  Synthetic
cgcggtctgttagggacgattgtcaccagcctcactgggcgcgacaaaaacgaggttgagggtgaggtacaagta

SEQ ID NO: 133557 - DNA, 75 bp, Artificial Sequence
  Synthetic
cgcggtctgttagggacgattgtcacgagcctcactgggcgcgacaaaaacgaggttgagggtgaggtacaagta

SEQ ID NO: 133558 - DNA, 75 bp, Artificial Sequence
  Synthetic
cgcggtctgctagggacgattgtcacaagcctcactgggcgcgacaaaaacgaggttgagggtgaggtacaagta

SEQ ID NO: 133559 - DNA, 75 bp, Artificial Sequence
  Synthetic
cgcggtctgctagggacgattgtcactagcctcactgggcgcgacaaaaacgaggttgagggtgaggtacaagta

SEQ ID NO: 133560 - DNA, 75 bp, Artificial Sequence
  Synthetic
cgcggtctgctagggacgattgtcaccagcctcactgggcgcgacaaaaacgaggttgagggtgaggtacaagta

SEQ ID NO: 133561 - DNA, 75 bp, Artificial Sequence
  Synthetic
cgcggtctgctagggacgattgtcacgagcctcactgggcgcgacaaaaacgaggttgagggtgaggtacaagta

SEQ ID NO: 133562 - DNA, 75 bp, Artificial Sequence
  Synthetic
cgcggtctggtagggacgattgtcacaagcctcactgggcgcgacaaaaacgaggttgagggtgaggtacaagta

SEQ ID NO: 133563 - DNA, 75 bp, Artificial Sequence
  Synthetic
cgcggtctggtagggacgattgtcactagcctcactgggcgcgacaaaaacgaggttgagggtgaggtacaagta

SEQ ID NO: 133564 - DNA, 75 bp, Artificial Sequence
  Synthetic
cgcggtctggtagggacgattgtcaccagcctcactgggcgcgacaaaaacgaggttgagggtgaggtacaagta

SEQ ID NO: 133565 - DNA, 75 bp, Artificial Sequence
  Synthetic
cgcggtctggtagggacgattgtcacgagcctcactgggcgcgacaaaaacgaggttgagggtgaggtacaagta

SEQ ID NO: 133566 - DNA, 75 bp, Artificial Sequence
  Synthetic
ctggactgtctaccacggcgccggagcgaagtctctggctgggccgaaaggccccatcctccagatgtataccaa

SEQ ID NO: 133567 - DNA, 75 bp, Artificial Sequence
  Synthetic
gggctcaggctccacctccatcatgggatcaaatgtggaagtgtctcatacggctcaagcctacgctgcacgggc

SEQ ID NO: 133568 - DNA, 75 bp, Artificial Sequence
  Synthetic
ggcccatctgccagatgtacaccaatgtagatcaagacatggtaggatggccggcaccaacaggtgccaggtctt

SEQ ID NO: 133569 - DNA, 75 bp, Artificial Sequence
  Synthetic
ggcccatctgccagatgtacaccaatgtagatcaagacatggtaggatggccggcacctacaggtgccaggtctt

SEQ ID NO: 133570 - DNA, 75 bp, Artificial Sequence
  Synthetic
ggcccatctgccagatgtacaccaatgtagatcaagacatggtaggatggccggcacccacaggtgccaggtctt

SEQ ID NO: 133571 - DNA, 75 bp, Artificial Sequence
  Synthetic
ggcccatctgccagatgtacaccaatgtagatcaagacatggtaggatggccggcaccgacaggtgccaggtctt

SEQ ID NO: 133572 - DNA, 75 bp, Artificial Sequence
  Synthetic
ggcccttctgccagatgtacaccaatgtagatcaagacatggtaggatggccggcaccaacaggtgccaggtctt

SEQ ID NO: 133573 - DNA, 75 bp, Artificial Sequence
  Synthetic
ggcccttctgccagatgtacaccaatgtagatcaagacatggtaggatggccggcacctacaggtgccaggtctt

SEQ ID NO: 133574 - DNA, 75 bp, Artificial Sequence
  Synthetic
ggcccttctgccagatgtacaccaatgtagatcaagacatggtaggatggccggcacccacaggtgccaggtctt

SEQ ID NO: 133575 - DNA, 75 bp, Artificial Sequence
  Synthetic
ggcccttctgccagatgtacaccaatgtagatcaagacatggtaggatggccggcaccgacaggtgccaggtctt

SEQ ID NO: 133576 - DNA, 75 bp, Artificial Sequence
  Synthetic
ggcccctctgccagatgtacaccaatgtagatcaagacatggtaggatggccggcaccaacaggtgccaggtctt

SEQ ID NO: 133577 - DNA, 75 bp, Artificial Sequence
  Synthetic
ggcccctctgccagatgtacaccaatgtagatcaagacatggtaggatggccggcacctacaggtgccaggtctt

SEQ ID NO: 133578 - DNA, 75 bp, Artificial Sequence
  Synthetic
ggcccctctgccagatgtacaccaatgtagatcaagacatggtaggatggccggcacccacaggtgccaggtctt

SEQ ID NO: 133579 - DNA, 75 bp, Artificial Sequence
  Synthetic
ggcccctctgccagatgtacaccaatgtagatcaagacatggtaggatggccggcaccgacaggtgccaggtctt

SEQ ID NO: 133580 - DNA, 75 bp, Artificial Sequence
  Synthetic
ggcccgtctgccagatgtacaccaatgtagatcaagacatggtaggatggccggcaccaacaggtgccaggtctt

SEQ ID NO: 133581 - DNA, 75 bp, Artificial Sequence
  Synthetic
ggcccgtctgccagatgtacaccaatgtagatcaagacatggtaggatggccggcacctacaggtgccaggtctt

SEQ ID NO: 133582 - DNA, 75 bp, Artificial Sequence
  Synthetic
ggcccgtctgccagatgtacaccaatgtagatcaagacatggtaggatggccggcacccacaggtgccaggtctt

SEQ ID NO: 133583 - DNA, 75 bp, Artificial Sequence
  Synthetic
ggcccgtctgccagatgtacaccaatgtagatcaagacatggtaggatggccggcaccgacaggtgccaggtctt

SEQ ID NO: 133584 - DNA, 75 bp, Artificial Sequence
  Synthetic
gctgatgtcatcccagtgcgccggcggggcgacaccagggggagcctgctttccccccgtcccatctcatacttg

SEQ ID NO: 133585 - DNA, 75 bp, Artificial Sequence
  Synthetic
tacacccacgccttgtgtttgagatcacgaaatggttattggcagtcctggggcctgcctacctccttaaagcgt

SEQ ID NO: 133586 - DNA, 75 bp, Artificial Sequence
  Synthetic
tcgtgcccgtagagtctatggagaccgttatgcgctctcctaccttcactgacaattcaaccccaccagctgtgc

SEQ ID NO: 133587 - DNA, 75 bp, Artificial Sequence
  Synthetic
cagtcccagaccaatgagaaccctcaaagggtcatcgggagggcccgtcctgtgctcagcagggcatgccgtcgg

SEQ ID NO: 133588 - DNA, 75 bp, Artificial Sequence
  Synthetic
cagtcccagaccaatgagtaccctcaaagggtcatcgggagggcccgtcctgtgctcagcagggcatgccgtcgg

SEQ ID NO: 133589 - DNA, 75 bp, Artificial Sequence
  Synthetic
cagtcccagaccaatgagcaccctcaaagggtcatcgggagggcccgtcctgtgctcagcagggcatgccgtcgg

SEQ ID NO: 133590 - DNA, 75 bp, Artificial Sequence
  Synthetic
cagtcccagaccaatgaggaccctcaaagggtcatcgggagggcccgtcctgtgctcagcagggcatgccgtcgg

SEQ ID NO: 133591 - DNA, 75 bp, Artificial Sequence
  Synthetic
cagtcccagaccattgagaaccctcaaagggtcatcgggagggcccgtcctgtgctcagcagggcatgccgtcgg

SEQ ID NO: 133592 - DNA, 75 bp, Artificial Sequence
  Synthetic
cagtcccagaccattgagtaccctcaaagggtcatcgggagggcccgtcctgtgctcagcagggcatgccgtcgg

SEQ ID NO: 133593 - DNA, 75 bp, Artificial Sequence
  Synthetic
cagtcccagaccattgagcaccctcaaagggtcatcgggagggcccgtcctgtgctcagcagggcatgccgtcgg

SEQ ID NO: 133594 - DNA, 75 bp, Artificial Sequence
  Synthetic
cagtcccagaccattgaggaccctcaaagggtcatcgggagggcccgtcctgtgctcagcagggcatgccgtcgg

SEQ ID NO: 133595 - DNA, 75 bp, Artificial Sequence
  Synthetic
cagtcccagaccactgagaaccctcaaagggtcatcgggagggcccgtcctgtgctcagcagggcatgccgtcgg

SEQ ID NO: 133596 - DNA, 75 bp, Artificial Sequence
  Synthetic
cagtcccagaccactgagtaccctcaaagggtcatcgggagggcccgtcctgtgctcagcagggcatgccgtcgg

SEQ ID NO: 133597 - DNA, 75 bp, Artificial Sequence
  Synthetic
cagtcccagaccactgagcaccctcaaagggtcatcgggagggcccgtcctgtgctcagcagggcatgccgtcgg

SEQ ID NO: 133598 - DNA, 75 bp, Artificial Sequence
  Synthetic
cagtcccagaccactgaggaccctcaaagggtcatcgggagggcccgtcctgtgctcagcagggcatgccgtcgg

SEQ ID NO: 133599 - DNA, 75 bp, Artificial Sequence
  Synthetic
cagtcccagaccagtgagaaccctcaaagggtcatcgggagggcccgtcctgtgctcagcagggcatgccgtcgg

SEQ ID NO: 133600 - DNA, 75 bp, Artificial Sequence
  Synthetic
cagtcccagaccagtgagtaccctcaaagggtcatcgggagggcccgtcctgtgctcagcagggcatgccgtcgg

SEQ ID NO: 133601 - DNA, 75 bp, Artificial Sequence
  Synthetic
cagtcccagaccagtgagcaccctcaaagggtcatcgggagggcccgtcctgtgctcagcagggcatgccgtcgg

SEQ ID NO: 133602 - DNA, 75 bp, Artificial Sequence
  Synthetic
cagtcccagaccagtgaggaccctcaaagggtcatcgggagggcccgtcctgtgctcagcagggcatgccgtcgg

SEQ ID NO: 133603 - DNA, 75 bp, Artificial Sequence
  Synthetic
gttgaatccctctgtcgccgccactctggggttcggggcatacatgtccaaggcacatgggatcgaccctaacat

SEQ ID NO: 133604 - DNA, 75 bp, Artificial Sequence
  Synthetic
gataactcatatccacccgccgtgccgcagacctaccaagtgggatatctacacgcacccactggcagtggtaag

SEQ ID NO: 133605 - DNA, 75 bp, Artificial Sequence
  Synthetic
gataactcatttccacccgccgtgccgcagacctaccaagtgggatatctacacgcacccactggcagtggtaag

SEQ ID NO: 133606 - DNA, 75 bp, Artificial Sequence
  Synthetic
gataactcatctccacccgccgtgccgcagacctaccaagtgggatatctacacgcacccactggcagtggtaag

SEQ ID NO: 133607 - DNA, 75 bp, Artificial Sequence
  Synthetic
gataactcatgtccacccgccgtgccgcagacctaccaagtgggatatctacacgcacccactggcagtggtaag

SEQ ID NO: 133608 - DNA, 75 bp, Artificial Sequence
  Synthetic
acaacgccaggggccttgtgtccctcttctcaccaggggcgtctcagaaaatccaactagtaaataccaacggca

SEQ ID NO: 133609 - DNA, 75 bp, Artificial Sequence
  Synthetic
atcataatatgtgacgaatgtcactcgactgatgcaacttcaatcctgggtatcggcactgtcttggatcaggcg

SEQ ID NO: 133610 - DNA, 75 bp, Artificial Sequence
  Synthetic
aagcacatggaatagacccaaacatcaggacaggtgtaagaaccatcaaaacgggagggccgattacatactgca

SEQ ID NO: 133611 - DNA, 75 bp, Artificial Sequence
  Synthetic
aagcacatggaatagacccaaacatcaggacaggtgtaagaaccatcataacgggagggccgattacatactgca

SEQ ID NO: 133612 - DNA, 75 bp, Artificial Sequence
  Synthetic
aagcacatggaatagacccaaacatcaggacaggtgtaagaaccatcacaacgggagggccgattacatactgca

SEQ ID NO: 133613 - DNA, 75 bp, Artificial Sequence
  Synthetic
aagcacatggaatagacccaaacatcaggacaggtgtaagaaccatcagaacgggagggccgattacatactgca

SEQ ID NO: 133614 - DNA, 75 bp, Artificial Sequence
  Synthetic
aagcacatggaatagacccaaacatcaggactggtgtaagaaccatcaaaacgggagggccgattacatactgca

SEQ ID NO: 133615 - DNA, 75 bp, Artificial Sequence
  Synthetic
aagcacatggaatagacccaaacatcaggactggtgtaagaaccatcataacgggagggccgattacatactgca

SEQ ID NO: 133616 - DNA, 75 bp, Artificial Sequence
  Synthetic
aagcacatggaatagacccaaacatcaggactggtgtaagaaccatcacaacgggagggccgattacatactgca

SEQ ID NO: 133617 - DNA, 75 bp, Artificial Sequence
  Synthetic
aagcacatggaatagacccaaacatcaggactggtgtaagaaccatcagaacgggagggccgattacatactgca

SEQ ID NO: 133618 - DNA, 75 bp, Artificial Sequence
  Synthetic
aagcacatggaatagacccaaacatcaggaccggtgtaagaaccatcaaaacgggagggccgattacatactgca

SEQ ID NO: 133619 - DNA, 75 bp, Artificial Sequence
  Synthetic
aagcacatggaatagacccaaacatcaggaccggtgtaagaaccatcataacgggagggccgattacatactgca

SEQ ID NO: 133620 - DNA, 75 bp, Artificial Sequence
  Synthetic
aagcacatggaatagacccaaacatcaggaccggtgtaagaaccatcacaacgggagggccgattacatactgca

SEQ ID NO: 133621 - DNA, 75 bp, Artificial Sequence
  Synthetic
aagcacatggaatagacccaaacatcaggaccggtgtaagaaccatcagaacgggagggccgattacatactgca

SEQ ID NO: 133622 - DNA, 75 bp, Artificial Sequence
  Synthetic
aagcacatggaatagacccaaacatcaggacgggtgtaagaaccatcaaaacgggagggccgattacatactgca

SEQ ID NO: 133623 - DNA, 75 bp, Artificial Sequence
  Synthetic
aagcacatggaatagacccaaacatcaggacgggtgtaagaaccatcataacgggagggccgattacatactgca

SEQ ID NO: 133624 - DNA, 75 bp, Artificial Sequence
  Synthetic
aagcacatggaatagacccaaacatcaggacgggtgtaagaaccatcacaacgggagggccgattacatactgca

SEQ ID NO: 133625 - DNA, 75 bp, Artificial Sequence
  Synthetic
aagcacatggaatagacccaaacatcaggacgggtgtaagaaccatcagaacgggagggccgattacatactgca

SEQ ID NO: 133626 - DNA, 75 bp, Artificial Sequence
  Synthetic
aagcacatggaatagaccctaacatcaggacaggtgtaagaaccatcaaaacgggagggccgattacatactgca

SEQ ID NO: 133627 - DNA, 75 bp, Artificial Sequence
  Synthetic
aagcacatggaatagaccctaacatcaggacaggtgtaagaaccatcataacgggagggccgattacatactgca

SEQ ID NO: 133628 - DNA, 75 bp, Artificial Sequence
  Synthetic
aagcacatggaatagaccctaacatcaggacaggtgtaagaaccatcacaacgggagggccgattacatactgca

SEQ ID NO: 133629 - DNA, 75 bp, Artificial Sequence
  Synthetic
aagcacatggaatagaccctaacatcaggacaggtgtaagaaccatcagaacgggagggccgattacatactgca

SEQ ID NO: 133630 - DNA, 75 bp, Artificial Sequence
  Synthetic
aagcacatggaatagaccctaacatcaggactggtgtaagaaccatcaaaacgggagggccgattacatactgca

SEQ ID NO: 133631 - DNA, 75 bp, Artificial Sequence
  Synthetic
aagcacatggaatagaccctaacatcaggactggtgtaagaaccatcataacgggagggccgattacatactgca

SEQ ID NO: 133632 - DNA, 75 bp, Artificial Sequence
  Synthetic
aagcacatggaatagaccctaacatcaggactggtgtaagaaccatcacaacgggagggccgattacatactgca

SEQ ID NO: 133633 - DNA, 75 bp, Artificial Sequence
  Synthetic
aagcacatggaatagaccctaacatcaggactggtgtaagaaccatcagaacgggagggccgattacatactgca

SEQ ID NO: 133634 - DNA, 75 bp, Artificial Sequence
  Synthetic
aagcacatggaatagaccctaacatcaggaccggtgtaagaaccatcaaaacgggagggccgattacatactgca

SEQ ID NO: 133635 - DNA, 75 bp, Artificial Sequence
  Synthetic
aagcacatggaatagaccctaacatcaggaccggtgtaagaaccatcataacgggagggccgattacatactgca

SEQ ID NO: 133636 - DNA, 75 bp, Artificial Sequence
  Synthetic
aagcacatggaatagaccctaacatcaggaccggtgtaagaaccatcacaacgggagggccgattacatactgca

SEQ ID NO: 133637 - DNA, 75 bp, Artificial Sequence
  Synthetic
aagcacatggaatagaccctaacatcaggaccggtgtaagaaccatcagaacgggagggccgattacatactgca

SEQ ID NO: 133638 - DNA, 75 bp, Artificial Sequence
  Synthetic
aagcacatggaatagaccctaacatcaggacgggtgtaagaaccatcaaaacgggagggccgattacatactgca

SEQ ID NO: 133639 - DNA, 75 bp, Artificial Sequence
  Synthetic
aagcacatggaatagaccctaacatcaggacgggtgtaagaaccatcataacgggagggccgattacatactgca

SEQ ID NO: 133640 - DNA, 75 bp, Artificial Sequence
  Synthetic
aagcacatggaatagaccctaacatcaggacgggtgtaagaaccatcacaacgggagggccgattacatactgca

SEQ ID NO: 133641 - DNA, 75 bp, Artificial Sequence
  Synthetic
aagcacatggaatagaccctaacatcaggacgggtgtaagaaccatcagaacgggagggccgattacatactgca

SEQ ID NO: 133642 - DNA, 75 bp, Artificial Sequence
  Synthetic
aagcacatggaatagaccccaacatcaggacaggtgtaagaaccatcaaaacgggagggccgattacatactgca

SEQ ID NO: 133643 - DNA, 75 bp, Artificial Sequence
  Synthetic
aagcacatggaatagaccccaacatcaggacaggtgtaagaaccatcataacgggagggccgattacatactgca

SEQ ID NO: 133644 - DNA, 75 bp, Artificial Sequence
  Synthetic
aagcacatggaatagaccccaacatcaggacaggtgtaagaaccatcacaacgggagggccgattacatactgca

SEQ ID NO: 133645 - DNA, 75 bp, Artificial Sequence
  Synthetic
aagcacatggaatagaccccaacatcaggacaggtgtaagaaccatcagaacgggagggccgattacatactgca

SEQ ID NO: 133646 - DNA, 75 bp, Artificial Sequence
  Synthetic
aagcacatggaatagaccccaacatcaggactggtgtaagaaccatcaaaacgggagggccgattacatactgca

SEQ ID NO: 133647 - DNA, 75 bp, Artificial Sequence
  Synthetic
aagcacatggaatagaccccaacatcaggactggtgtaagaaccatcataacgggagggccgattacatactgca

SEQ ID NO: 133648 - DNA, 75 bp, Artificial Sequence
  Synthetic
aagcacatggaatagaccccaacatcaggactggtgtaagaaccatcacaacgggagggccgattacatactgca

SEQ ID NO: 133649 - DNA, 75 bp, Artificial Sequence
  Synthetic
aagcacatggaatagaccccaacatcaggactggtgtaagaaccatcagaacgggagggccgattacatactgca

SEQ ID NO: 133650 - DNA, 75 bp, Artificial Sequence
  Synthetic
aagcacatggaatagaccccaacatcaggaccggtgtaagaaccatcaaaacgggagggccgattacatactgca

SEQ ID NO: 133651 - DNA, 75 bp, Artificial Sequence
  Synthetic
aagcacatggaatagaccccaacatcaggaccggtgtaagaaccatcataacgggagggccgattacatactgca

SEQ ID NO: 133652 - DNA, 75 bp, Artificial Sequence
  Synthetic
aagcacatggaatagaccccaacatcaggaccggtgtaagaaccatcacaacgggagggccgattacatactgca

SEQ ID NO: 133653 - DNA, 75 bp, Artificial Sequence
  Synthetic
aagcacatggaatagaccccaacatcaggaccggtgtaagaaccatcagaacgggagggccgattacatactgca

SEQ ID NO: 133654 - DNA, 75 bp, Artificial Sequence
  Synthetic
aagcacatggaatagaccccaacatcaggacgggtgtaagaaccatcaaaacgggagggccgattacatactgca

SEQ ID NO: 133655 - DNA, 75 bp, Artificial Sequence
  Synthetic
aagcacatggaatagaccccaacatcaggacgggtgtaagaaccatcataacgggagggccgattacatactgca

SEQ ID NO: 133656 - DNA, 75 bp, Artificial Sequence
  Synthetic
aagcacatggaatagaccccaacatcaggacgggtgtaagaaccatcacaacgggagggccgattacatactgca

SEQ ID NO: 133657 - DNA, 75 bp, Artificial Sequence
  Synthetic
aagcacatggaatagaccccaacatcaggacgggtgtaagaaccatcagaacgggagggccgattacatactgca

SEQ ID NO: 133658 - DNA, 75 bp, Artificial Sequence
  Synthetic
aagcacatggaatagacccgaacatcaggacaggtgtaagaaccatcaaaacgggagggccgattacatactgca

SEQ ID NO: 133659 - DNA, 75 bp, Artificial Sequence
  Synthetic
aagcacatggaatagacccgaacatcaggacaggtgtaagaaccatcataacgggagggccgattacatactgca

SEQ ID NO: 133660 - DNA, 75 bp, Artificial Sequence
  Synthetic
aagcacatggaatagacccgaacatcaggacaggtgtaagaaccatcacaacgggagggccgattacatactgca

SEQ ID NO: 133661 - DNA, 75 bp, Artificial Sequence
  Synthetic
aagcacatggaatagacccgaacatcaggacaggtgtaagaaccatcagaacgggagggccgattacatactgca

SEQ ID NO: 133662 - DNA, 75 bp, Artificial Sequence
  Synthetic
aagcacatggaatagacccgaacatcaggactggtgtaagaaccatcaaaacgggagggccgattacatactgca

SEQ ID NO: 133663 - DNA, 75 bp, Artificial Sequence
  Synthetic
aagcacatggaatagacccgaacatcaggactggtgtaagaaccatcataacgggagggccgattacatactgca

SEQ ID NO: 133664 - DNA, 75 bp, Artificial Sequence
  Synthetic
aagcacatggaatagacccgaacatcaggactggtgtaagaaccatcacaacgggagggccgattacatactgca

SEQ ID NO: 133665 - DNA, 75 bp, Artificial Sequence
  Synthetic
aagcacatggaatagacccgaacatcaggactggtgtaagaaccatcagaacgggagggccgattacatactgca

SEQ ID NO: 133666 - DNA, 75 bp, Artificial Sequence
  Synthetic
aagcacatggaatagacccgaacatcaggaccggtgtaagaaccatcaaaacgggagggccgattacatactgca

SEQ ID NO: 133667 - DNA, 75 bp, Artificial Sequence
  Synthetic
aagcacatggaatagacccgaacatcaggaccggtgtaagaaccatcataacgggagggccgattacatactgca

SEQ ID NO: 133668 - DNA, 75 bp, Artificial Sequence
  Synthetic
aagcacatggaatagacccgaacatcaggaccggtgtaagaaccatcacaacgggagggccgattacatactgca

SEQ ID NO: 133669 - DNA, 75 bp, Artificial Sequence
  Synthetic
aagcacatggaatagacccgaacatcaggaccggtgtaagaaccatcagaacgggagggccgattacatactgca

SEQ ID NO: 133670 - DNA, 75 bp, Artificial Sequence
  Synthetic
aagcacatggaatagacccgaacatcaggacgggtgtaagaaccatcaaaacgggagggccgattacatactgca

SEQ ID NO: 133671 - DNA, 75 bp, Artificial Sequence
  Synthetic
aagcacatggaatagacccgaacatcaggacgggtgtaagaaccatcataacgggagggccgattacatactgca

SEQ ID NO: 133672 - DNA, 75 bp, Artificial Sequence
  Synthetic
aagcacatggaatagacccgaacatcaggacgggtgtaagaaccatcacaacgggagggccgattacatactgca

SEQ ID NO: 133673 - DNA, 75 bp, Artificial Sequence
  Synthetic
aagcacatggaatagacccgaacatcaggacgggtgtaagaaccatcagaacgggagggccgattacatactgca

SEQ ID NO: 133674 - DNA, 75 bp, Artificial Sequence
  Synthetic
gtctggatgcccggagcgcatggccagctgccgctccattgacaagttcgatcaggggtggggtcccatcactta

SEQ ID NO: 133675 - DNA, 75 bp, Artificial Sequence
  Synthetic
ttggagagatccccttctacggcaaggccattcctctcgaggtaatcaaaggggggaggcacctcatcttctgcc

SEQ ID NO: 133676 - DNA, 75 bp, Artificial Sequence
  Synthetic
gattggcaccgtgttggaccaggcggagacagctggcgtacggctcaccgtactggccactgcgactcctcctgg

SEQ ID NO: 133677 - DNA, 75 bp, Artificial Sequence
  Synthetic
gaacatcgtggacgtgcaatacctgtacggtatagggtcagcggttgtctcctttgcaatcaaatgggagtatgt

SEQ ID NO: 133678 - DNA, 75 bp, Artificial Sequence
  Synthetic
cagtggggacgtcgttgtcgtatcaactgatgccctaatgacgggcttcacaggggactttgactccgtgataga

SEQ ID NO: 133679 - DNA, 75 bp, Artificial Sequence
  Synthetic
ggaggcagacatctgatcttttgtcactcaaagaagaagtgcgatgagttggccggccagctccggacgcttgga

SEQ ID NO: 133680 - DNA, 75 bp, Artificial Sequence
  Synthetic
cgttcgcttcgcggggtaaccatgtttcccccacgcactatgtgcccgagagcgacgccgcagcgcgtgtcacgc

SEQ ID NO: 133681 - DNA, 75 bp, Artificial Sequence
  Synthetic
ctgcaatgtgtgtgtcacccaaacagttgactttagccttgaccccacttttaccatcgagacaaccaccctgcc

SEQ ID NO: 133682 - DNA, 75 bp, Artificial Sequence
  Synthetic
tgaacctagtcacggatacttcggactcctaagccatttcctgatttttttttttcccttttttttttttttttt

SEQ ID NO: 133683 - DNA, 75 bp, Artificial Sequence
  Synthetic
caggggactttgactctgtcatagactgcaacgtggcggtaactcaggtggtggatttcagcctagaccccacat

SEQ ID NO: 133684 - DNA, 75 bp, Artificial Sequence
  Synthetic
ggtctgcaccgtgctgagtgacttcaagacgtggctaaaagccaagttgctgcccctcatgccaggcatcccctt

SEQ ID NO: 133685 - DNA, 75 bp, Artificial Sequence
  Synthetic
gcagggggaacgaccgtctggtatgttcgattccatcgtcctttgcgaggcgtacgatactggttgtgcgtggta

SEQ ID NO: 133686 - DNA, 75 bp, Artificial Sequence
  Synthetic
gcgctggtagtagctcagctgctcagggtcccgcaagccatcttggacatgatcgctggtgcccactggggagtc

SEQ ID NO: 133687 - DNA, 75 bp, Artificial Sequence
  Synthetic
gtggcgtaccaggctactgtgtgcgctagggcgtccgcgccgcccccgtcttgggaccagatgtggaagtgcctt

SEQ ID NO: 133688 - DNA, 75 bp, Artificial Sequence
  Synthetic
ttcacaggcctcactcacatcgacgcccacttcctttcacaaaccaaacaggggggggagaacttcgcatacctg

SEQ ID NO: 133689 - DNA, 75 bp, Artificial Sequence
  Synthetic
cggcgattggctgcgagacatctgggactgggtttgcacagtgttgtccgacttcaaaacatggctctctgctaa

SEQ ID NO: 133690 - DNA, 75 bp, Artificial Sequence
  Synthetic
cgccgaactacaagttcgcgctttggagggtgtccgccgaggactacgtggaggttcgcagagtgggtgatttcc

SEQ ID NO: 133691 - DNA, 75 bp, Artificial Sequence
  Synthetic
taccttccccatcaatgcttacaccacaggccctggtgtacccatcccggcgccgaactacaagttcgcgctttg

SEQ ID NO: 133692 - DNA, 75 bp, Artificial Sequence
  Synthetic
tcatggcctgcatgtcagcagacttggaggtcgtcaccagcacctgggtgctggtgggcggcatcctagctgctc

SEQ ID NO: 133693 - DNA, 75 bp, Artificial Sequence
  Synthetic
gcccaacgcccttgttgtacaggcttggggccgtgcaaaatgagatcaccaccacacatccaatcacaaaataca

SEQ ID NO: 133694 - DNA, 75 bp, Artificial Sequence
  Synthetic
cgccccgaagtgcaaacccttgctgcgggacgaagtgtcgttctcagtaggactcaattcgttcgtagtgggatc

SEQ ID NO: 133695 - DNA, 75 bp, Artificial Sequence
  Synthetic
ggctcatatggtggttacaatattttatcaccagagccgaggcgcacttgcaagtgtggatcccccccctcaacg

SEQ ID NO: 133696 - DNA, 75 bp, Artificial Sequence
  Synthetic
ggagtttgatgaaatggaggagtgtgcatcacaccttccatacatcgaacaggggatgcagcttgcggaacagtt

SEQ ID NO: 133697 - DNA, 75 bp, Artificial Sequence
  Synthetic
cagcgcagtcatctgcggccgaatcataacttccgggaaaccggcggtgatgccggaccgggagatcttgtatca

SEQ ID NO: 133698 - DNA, 75 bp, Artificial Sequence
  Synthetic
acgttgaggtgcgccgggtgggagacttccactacatcacgggggccacagaagatgagctcaagtgtccgtgcc

SEQ ID NO: 133699 - DNA, 75 bp, Artificial Sequence
  Synthetic
caacctcctgtggcggcaggagatgggcgggaacatcacccgcgtggagtcagagaataaggtagtagttctgga

SEQ ID NO: 133700 - DNA, 75 bp, Artificial Sequence
  Synthetic
gcaaagcacatgtggaacttcattagtggcatccaatacctggcaggactgtcgacgctgccggggaacccggca

SEQ ID NO: 133701 - DNA, 75 bp, Artificial Sequence
  Synthetic
agaaactcaatttaatcaagaccaacggcagctggcatataaaccggactgccctcaactgcaatgacaccttga

SEQ ID NO: 133702 - DNA, 75 bp, Artificial Sequence
  Synthetic
cagaacactgcaaagcaggctgaagagctcaagccggcggttcagtcggcatggccaaagctcgagcagttttgg

SEQ ID NO: 133703 - DNA, 75 bp, Artificial Sequence
  Synthetic
tggctgcgccgagcgccgccacagccttcgtgggctctggcatagtaggcgcagccgtcggcagtgtggggattg

SEQ ID NO: 133704 - DNA, 75 bp, Artificial Sequence
  Synthetic
gatctgggcccggccggattacaatccacctcttaccgagacgtggaagcagcaggactacaagcctccgaccgt

SEQ ID NO: 133705 - DNA, 75 bp, Artificial Sequence
  Synthetic
ccgctttaaccagcccactgtctacgtcaaccaccctcatactcaacatcctgggggggtgggtagcgtctcagt

SEQ ID NO: 133706 - DNA, 75 bp, Artificial Sequence
  Synthetic
ccgctttaaccagcccactgtctacgtcaaccaccctcttactcaacatcctgggggggtgggtagcgtctcagt

SEQ ID NO: 133707 - DNA, 75 bp, Artificial Sequence
  Synthetic
ccgctttaaccagcccactgtctacgtcaaccaccctcctactcaacatcctgggggggtgggtagcgtctcagt

SEQ ID NO: 133708 - DNA, 75 bp, Artificial Sequence
  Synthetic
ccgctttaaccagcccactgtctacgtcaaccaccctcgtactcaacatcctgggggggtgggtagcgtctcagt

SEQ ID NO: 133709 - DNA, 75 bp, Artificial Sequence
  Synthetic
ctctcccccaggcctgtctcctacttgaagggctcttcgggtggcccactgctctgcccttcggggcacgctgtg

SEQ ID NO: 133710 - DNA, 75 bp, Artificial Sequence
  Synthetic
cccctccaataccacctccacggagaaagaggacgattgtcctgacagagtccactgtgtcttctgccctggcgg

SEQ ID NO: 133711 - DNA, 75 bp, Artificial Sequence
  Synthetic
tctagtcaacctgctgcccgccatcctctcacccggcgccctggttgttggcatcgtatgcgctgcaatactacg

SEQ ID NO: 133712 - DNA, 75 bp, Artificial Sequence
  Synthetic
tgggtacggagcgggcgtgtctggcgcgcttgtggctttcaaaatcatgagcggggaggctcctgccctagagga

SEQ ID NO: 133713 - DNA, 75 bp, Artificial Sequence
  Synthetic
tgggtacggagcgggcgtgtctggcgcgcttgtggctttcaaaatcatgagcggggaggctcctgcccttgagga

SEQ ID NO: 133714 - DNA, 75 bp, Artificial Sequence
  Synthetic
tgggtacggagcgggcgtgtctggcgcgcttgtggctttcaaaatcatgagcggggaggctcctgccctcgagga

SEQ ID NO: 133715 - DNA, 75 bp, Artificial Sequence
  Synthetic
tgggtacggagcgggcgtgtctggcgcgcttgtggctttcaaaatcatgagcggggaggctcctgccctggagga

SEQ ID NO: 133716 - DNA, 75 bp, Artificial Sequence
  Synthetic
tgggtacggagcgggcgtgtctggcgcgcttgtggctttcaatatcatgagcggggaggctcctgccctagagga

SEQ ID NO: 133717 - DNA, 75 bp, Artificial Sequence
  Synthetic
tgggtacggagcgggcgtgtctggcgcgcttgtggctttcaatatcatgagcggggaggctcctgcccttgagga

SEQ ID NO: 133718 - DNA, 75 bp, Artificial Sequence
  Synthetic
tgggtacggagcgggcgtgtctggcgcgcttgtggctttcaatatcatgagcggggaggctcctgccctcgagga

SEQ ID NO: 133719 - DNA, 75 bp, Artificial Sequence
  Synthetic
tgggtacggagcgggcgtgtctggcgcgcttgtggctttcaatatcatgagcggggaggctcctgccctggagga

SEQ ID NO: 133720 - DNA, 75 bp, Artificial Sequence
  Synthetic
tgggtacggagcgggcgtgtctggcgcgcttgtggctttcaacatcatgagcggggaggctcctgccctagagga

SEQ ID NO: 133721 - DNA, 75 bp, Artificial Sequence
  Synthetic
tgggtacggagcgggcgtgtctggcgcgcttgtggctttcaacatcatgagcggggaggctcctgcccttgagga

SEQ ID NO: 133722 - DNA, 75 bp, Artificial Sequence
  Synthetic
tgggtacggagcgggcgtgtctggcgcgcttgtggctttcaacatcatgagcggggaggctcctgccctcgagga

SEQ ID NO: 133723 - DNA, 75 bp, Artificial Sequence
  Synthetic
tgggtacggagcgggcgtgtctggcgcgcttgtggctttcaacatcatgagcggggaggctcctgccctggagga

SEQ ID NO: 133724 - DNA, 75 bp, Artificial Sequence
  Synthetic
tgggtacggagcgggcgtgtctggcgcgcttgtggctttcaagatcatgagcggggaggctcctgccctagagga

SEQ ID NO: 133725 - DNA, 75 bp, Artificial Sequence
  Synthetic
tgggtacggagcgggcgtgtctggcgcgcttgtggctttcaagatcatgagcggggaggctcctgcccttgagga

SEQ ID NO: 133726 - DNA, 75 bp, Artificial Sequence
  Synthetic
tgggtacggagcgggcgtgtctggcgcgcttgtggctttcaagatcatgagcggggaggctcctgccctcgagga

SEQ ID NO: 133727 - DNA, 75 bp, Artificial Sequence
  Synthetic
tgggtacggagcgggcgtgtctggcgcgcttgtggctttcaagatcatgagcggggaggctcctgccctggagga

SEQ ID NO: 133728 - DNA, 75 bp, Artificial Sequence
  Synthetic
gagagcgacgctgcagctcgtgtcacccagattctcagtagcctaaccatcacccacctgctgaagagacttcac

SEQ ID NO: 133729 - DNA, 75 bp, Artificial Sequence
  Synthetic
gcacccaggtgctacctaccttaaatgcggggcagggccttggttgacccccaggtgcctgatagattaccctta

SEQ ID NO: 133730 - DNA, 75 bp, Artificial Sequence
  Synthetic
gccaaccagtggatgaacaggctcatagcgtttgcctcacgtggaaatcacgtatcacccacgcactatgtgcct

SEQ ID NO: 133731 - DNA, 75 bp, Artificial Sequence
  Synthetic
tcaaagccaagctcctcccgagcgtgccaggaattccgttcctgtcatgccaacgcgggtacaggggagtatggc

SEQ ID NO: 133732 - DNA, 75 bp, Artificial Sequence
  Synthetic
caccatgtgctacgtcatggttgagggacatctgggattgggtttgcactgtgctgtctgacttcaagacctggc

SEQ ID NO: 133733 - DNA, 75 bp, Artificial Sequence
  Synthetic
ctcggacctttacttggtcacgaggcacgctgatgtcattccggtgcgccggcggggcgacagcagggggagcct

SEQ ID NO: 133734 - DNA, 75 bp, Artificial Sequence
  Synthetic
ggaggggtgtccgactcggagtcatgctcgtccatgcctcctctcgagggagagccgggcgatccagacttgagt

SEQ ID NO: 133735 - DNA, 75 bp, Artificial Sequence
  Synthetic
ggacatgttaagaacggatccatgcggatcgtcggtccgagagcttgcagcaacacgtggcacggaacattcccc

SEQ ID NO: 133736 - DNA, 75 bp, Artificial Sequence
  Synthetic
gtgcccttgtggagcaaacattacgggtcatgtgaagcatgggaccatgaagatccacggtcccaagacatgtag

SEQ ID NO: 133737 - DNA, 75 bp, Artificial Sequence
  Synthetic
gagtgggggatttccactacgtgacgggcatgaccactgacaacctgaaatgcccatgccaagtcccatcacctg

SEQ ID NO: 133738 - DNA, 75 bp, Artificial Sequence
  Synthetic
gctgaggaatatgtcgaggtcgcccgtgtcaatgactgccattacatagtaggggcaacagctgacaatctaaag

SEQ ID NO: 133739 - DNA, 75 bp, Artificial Sequence
  Synthetic
ctatgtggtcggatcacagttgccatgcgagcccgaaccagacgtggcggtgctaacgtccatgctcaccgaccc

SEQ ID NO: 133740 - DNA, 75 bp, Artificial Sequence
  Synthetic
tcacctttactgtggggttgtccagctacgtcatggggtcccaactcccatgcgagccagaacctgatgtgatgg

SEQ ID NO: 133741 - DNA, 75 bp, Artificial Sequence
  Synthetic
aaagcaacatgcacgacacaccacgattctcccgacgcggacctcattgaggccaatctcttgtggagacaggag

SEQ ID NO: 133742 - DNA, 75 bp, Artificial Sequence
  Synthetic
gggatcggtcactgtgccacaccccaatatcgaggaggtggccttgtccaacactggagagatccccttctatgg

SEQ ID NO: 133743 - DNA, 75 bp, Artificial Sequence
  Synthetic
aagccagctttccgccccatcactgaaggcgacctgtacaacggacgcccaacatcctgacgcggagctgctgga

SEQ ID NO: 133744 - DNA, 75 bp, Artificial Sequence
  Synthetic
tccccgcagagattttgcggaaatcaaagtccttccctccggcgatgcccgtatgggcgaggccagactacaatc

SEQ ID NO: 133745 - DNA, 75 bp, Artificial Sequence
  Synthetic
gaggtggatgacagagaaatctcaacggctgctgagtgtcaccgcccgccgagacaaaaatatccacccgccttg

SEQ ID NO: 133746 - DNA, 75 bp, Artificial Sequence
  Synthetic
cgggctgcgtgggagacagctagacacactccagttaactcctggctaggcaacatcatcatgtatgcgcccacc

SEQ ID NO: 133747 - DNA, 75 bp, Artificial Sequence
  Synthetic
gaggaagaagaccgttgtccttacggagtctactgtgtccactgccctggctgatcttgcggcgaaaacctttag

SEQ ID NO: 133748 - DNA, 75 bp, Artificial Sequence
  Synthetic
aaggactgccacccgtgccgccccctaggaggaagaaggtcgtgcagctggatgagtcgtcggcgtcagcggctc

SEQ ID NO: 133749 - DNA, 75 bp, Artificial Sequence
  Synthetic
tccatgccccccctcgagggggagcctggggatcctgatctcagcgacggctcctggtccaccgtcagtgaggaa

SEQ ID NO: 133750 - DNA, 75 bp, Artificial Sequence
  Synthetic
tggtcggctctcagctcccttgtgaccctgagccggacaccgaggtgttggcctccatgttgacagacccgtccc

SEQ ID NO: 133751 - DNA, 75 bp, Artificial Sequence
  Synthetic
acctgatgacgaggacgccacgtccgaagccggctcttacagctctatgccccccctagagggggagcttggaga

SEQ ID NO: 133752 - DNA, 75 bp, Artificial Sequence
  Synthetic
taagcaactcactgctgcgccaccacaacatggtgtacgccactacctcgcgcagtgcgagccagaggcagaaaa

SEQ ID NO: 133753 - DNA, 75 bp, Artificial Sequence
  Synthetic
cgtgtgctgctcgatgtcttattcctggacaggcgcgcttgtcaccccgtgcgccgcggaagaacaaaaattgcc

SEQ ID NO: 133754 - DNA, 75 bp, Artificial Sequence
  Synthetic
tgcgctgccgaagaggaaaagctgcccattagcacgctgagtaaatctctcatacgccatcacaacttggtgtat

SEQ ID NO: 133755 - DNA, 75 bp, Artificial Sequence
  Synthetic
tgcgctgccgaagaggaaaagctgcccattagcacgctgagtaattctctcatacgccatcacaacttggtgtat

SEQ ID NO: 133756 - DNA, 75 bp, Artificial Sequence
  Synthetic
tgcgctgccgaagaggaaaagctgcccattagcacgctgagtaactctctcatacgccatcacaacttggtgtat

SEQ ID NO: 133757 - DNA, 75 bp, Artificial Sequence
  Synthetic
tgcgctgccgaagaggaaaagctgcccattagcacgctgagtaagtctctcatacgccatcacaacttggtgtat

SEQ ID NO: 133758 - DNA, 75 bp, Artificial Sequence
  Synthetic
tgcgccagaaaaaagtgacttttgaccggctccaggtgatggaccaacattaccaagatgttcttaaggagatta

SEQ ID NO: 133759 - DNA, 75 bp, Artificial Sequence
  Synthetic
tgcgccagaaaaaagtgacttttgaccggctccaggtgttggaccaacattaccaagatgttcttaaggagatta

SEQ ID NO: 133760 - DNA, 75 bp, Artificial Sequence
  Synthetic
tgcgccagaaaaaagtgacttttgaccggctccaggtgctggaccaacattaccaagatgttcttaaggagatta

SEQ ID NO: 133761 - DNA, 75 bp, Artificial Sequence
  Synthetic
tgcgccagaaaaaagtgacttttgaccggctccaggtggtggaccaacattaccaagatgttcttaaggagatta

SEQ ID NO: 133762 - DNA, 75 bp, Artificial Sequence
  Synthetic
ccacctcggaggcgccgcgccaaagtcctgactcaggacaatgtggagggggtcctcagggagatggcggacaaa

SEQ ID NO: 133763 - DNA, 75 bp, Artificial Sequence
  Synthetic
gaggttttctgtgtccaaccagagaaggggggccggaagccagctcgccttatcgtgtaccccgatctgggagtg

SEQ ID NO: 133764 - DNA, 75 bp, Artificial Sequence
  Synthetic
aaggccattaaccacatcaactccgtgtgggaggacttgctggaggacagttctacaccaattcctacaacaatc

SEQ ID NO: 133765 - DNA, 75 bp, Artificial Sequence
  Synthetic
gtaacccgctcaatgcccggaaatttgggcgtgcccccgcgagatcactagccgagtagtgttgggtcgcgaaag

SEQ ID NO: 133766 - DNA, 75 bp, Artificial Sequence
  Synthetic
gtagaccgtgcaacatgagcacacttcctaaacctcaaagacaaaccaaaagaaacacaccccgtcgcccacaga

SEQ ID NO: 133767 - DNA, 75 bp, Artificial Sequence
  Synthetic
tggacccgcgaaagggaggtcgcaagccggctcgactaatcgtgtatccagacctaggggtgagggtatgcgaga

SEQ ID NO: 133768 - DNA, 75 bp, Artificial Sequence
  Synthetic
tggacccgcgaaagggaggtcgcaagccggctcgactaatcgtgtatccagaccttggggtgagggtatgcgaga

SEQ ID NO: 133769 - DNA, 75 bp, Artificial Sequence
  Synthetic
tggacccgcgaaagggaggtcgcaagccggctcgactaatcgtgtatccagacctcggggtgagggtatgcgaga

SEQ ID NO: 133770 - DNA, 75 bp, Artificial Sequence
  Synthetic
tggacccgcgaaagggaggtcgcaagccggctcgactaatcgtgtatccagacctgggggtgagggtatgcgaga

SEQ ID NO: 133771 - DNA, 75 bp, Artificial Sequence
  Synthetic
tggacccgcgaaagggaggtcgcaagccggctcgacttatcgtgtatccagacctaggggtgagggtatgcgaga

SEQ ID NO: 133772 - DNA, 75 bp, Artificial Sequence
  Synthetic
tggacccgcgaaagggaggtcgcaagccggctcgacttatcgtgtatccagaccttggggtgagggtatgcgaga

SEQ ID NO: 133773 - DNA, 75 bp, Artificial Sequence
  Synthetic
tggacccgcgaaagggaggtcgcaagccggctcgacttatcgtgtatccagacctcggggtgagggtatgcgaga

SEQ ID NO: 133774 - DNA, 75 bp, Artificial Sequence
  Synthetic
tggacccgcgaaagggaggtcgcaagccggctcgacttatcgtgtatccagacctgggggtgagggtatgcgaga

SEQ ID NO: 133775 - DNA, 75 bp, Artificial Sequence
  Synthetic
tggacccgcgaaagggaggtcgcaagccggctcgactcatcgtgtatccagacctaggggtgagggtatgcgaga

SEQ ID NO: 133776 - DNA, 75 bp, Artificial Sequence
  Synthetic
tggacccgcgaaagggaggtcgcaagccggctcgactcatcgtgtatccagaccttggggtgagggtatgcgaga

SEQ ID NO: 133777 - DNA, 75 bp, Artificial Sequence
  Synthetic
tggacccgcgaaagggaggtcgcaagccggctcgactcatcgtgtatccagacctcggggtgagggtatgcgaga

SEQ ID NO: 133778 - DNA, 75 bp, Artificial Sequence
  Synthetic
tggacccgcgaaagggaggtcgcaagccggctcgactcatcgtgtatccagacctgggggtgagggtatgcgaga

SEQ ID NO: 133779 - DNA, 75 bp, Artificial Sequence
  Synthetic
tggacccgcgaaagggaggtcgcaagccggctcgactgatcgtgtatccagacctaggggtgagggtatgcgaga

SEQ ID NO: 133780 - DNA, 75 bp, Artificial Sequence
  Synthetic
tggacccgcgaaagggaggtcgcaagccggctcgactgatcgtgtatccagaccttggggtgagggtatgcgaga

SEQ ID NO: 133781 - DNA, 75 bp, Artificial Sequence
  Synthetic
tggacccgcgaaagggaggtcgcaagccggctcgactgatcgtgtatccagacctcggggtgagggtatgcgaga

SEQ ID NO: 133782 - DNA, 75 bp, Artificial Sequence
  Synthetic
tggacccgcgaaagggaggtcgcaagccggctcgactgatcgtgtatccagacctgggggtgagggtatgcgaga

SEQ ID NO: 133783 - DNA, 75 bp, Artificial Sequence
  Synthetic
tggacccgcgtaagggaggtcgcaagccggctcgactaatcgtgtatccagacctaggggtgagggtatgcgaga

SEQ ID NO: 133784 - DNA, 75 bp, Artificial Sequence
  Synthetic
tggacccgcgtaagggaggtcgcaagccggctcgactaatcgtgtatccagaccttggggtgagggtatgcgaga

SEQ ID NO: 133785 - DNA, 75 bp, Artificial Sequence
  Synthetic
tggacccgcgtaagggaggtcgcaagccggctcgactaatcgtgtatccagacctcggggtgagggtatgcgaga

SEQ ID NO: 133786 - DNA, 75 bp, Artificial Sequence
  Synthetic
tggacccgcgtaagggaggtcgcaagccggctcgactaatcgtgtatccagacctgggggtgagggtatgcgaga

SEQ ID NO: 133787 - DNA, 75 bp, Artificial Sequence
  Synthetic
tggacccgcgtaagggaggtcgcaagccggctcgacttatcgtgtatccagacctaggggtgagggtatgcgaga

SEQ ID NO: 133788 - DNA, 75 bp, Artificial Sequence
  Synthetic
tggacccgcgtaagggaggtcgcaagccggctcgacttatcgtgtatccagaccttggggtgagggtatgcgaga

SEQ ID NO: 133789 - DNA, 75 bp, Artificial Sequence
  Synthetic
tggacccgcgtaagggaggtcgcaagccggctcgacttatcgtgtatccagacctcggggtgagggtatgcgaga

SEQ ID NO: 133790 - DNA, 75 bp, Artificial Sequence
  Synthetic
tggacccgcgtaagggaggtcgcaagccggctcgacttatcgtgtatccagacctgggggtgagggtatgcgaga

SEQ ID NO: 133791 - DNA, 75 bp, Artificial Sequence
  Synthetic
tggacccgcgtaagggaggtcgcaagccggctcgactcatcgtgtatccagacctaggggtgagggtatgcgaga

SEQ ID NO: 133792 - DNA, 75 bp, Artificial Sequence
  Synthetic
tggacccgcgtaagggaggtcgcaagccggctcgactcatcgtgtatccagaccttggggtgagggtatgcgaga

SEQ ID NO: 133793 - DNA, 75 bp, Artificial Sequence
  Synthetic
tggacccgcgtaagggaggtcgcaagccggctcgactcatcgtgtatccagacctcggggtgagggtatgcgaga

SEQ ID NO: 133794 - DNA, 75 bp, Artificial Sequence
  Synthetic
tggacccgcgtaagggaggtcgcaagccggctcgactcatcgtgtatccagacctgggggtgagggtatgcgaga

SEQ ID NO: 133795 - DNA, 75 bp, Artificial Sequence
  Synthetic
tggacccgcgtaagggaggtcgcaagccggctcgactgatcgtgtatccagacctaggggtgagggtatgcgaga

SEQ ID NO: 133796 - DNA, 75 bp, Artificial Sequence
  Synthetic
tggacccgcgtaagggaggtcgcaagccggctcgactgatcgtgtatccagaccttggggtgagggtatgcgaga

SEQ ID NO: 133797 - DNA, 75 bp, Artificial Sequence
  Synthetic
tggacccgcgtaagggaggtcgcaagccggctcgactgatcgtgtatccagacctcggggtgagggtatgcgaga

SEQ ID NO: 133798 - DNA, 75 bp, Artificial Sequence
  Synthetic
tggacccgcgtaagggaggtcgcaagccggctcgactgatcgtgtatccagacctgggggtgagggtatgcgaga

SEQ ID NO: 133799 - DNA, 75 bp, Artificial Sequence
  Synthetic
tggacccgcgcaagggaggtcgcaagccggctcgactaatcgtgtatccagacctaggggtgagggtatgcgaga

SEQ ID NO: 133800 - DNA, 75 bp, Artificial Sequence
  Synthetic
tggacccgcgcaagggaggtcgcaagccggctcgactaatcgtgtatccagaccttggggtgagggtatgcgaga

SEQ ID NO: 133801 - DNA, 75 bp, Artificial Sequence
  Synthetic
tggacccgcgcaagggaggtcgcaagccggctcgactaatcgtgtatccagacctcggggtgagggtatgcgaga

SEQ ID NO: 133802 - DNA, 75 bp, Artificial Sequence
  Synthetic
tggacccgcgcaagggaggtcgcaagccggctcgactaatcgtgtatccagacctgggggtgagggtatgcgaga

SEQ ID NO: 133803 - DNA, 75 bp, Artificial Sequence
  Synthetic
tggacccgcgcaagggaggtcgcaagccggctcgacttatcgtgtatccagacctaggggtgagggtatgcgaga

SEQ ID NO: 133804 - DNA, 75 bp, Artificial Sequence
  Synthetic
tggacccgcgcaagggaggtcgcaagccggctcgacttatcgtgtatccagaccttggggtgagggtatgcgaga

SEQ ID NO: 133805 - DNA, 75 bp, Artificial Sequence
  Synthetic
tggacccgcgcaagggaggtcgcaagccggctcgacttatcgtgtatccagacctcggggtgagggtatgcgaga

SEQ ID NO: 133806 - DNA, 75 bp, Artificial Sequence
  Synthetic
tggacccgcgcaagggaggtcgcaagccggctcgacttatcgtgtatccagacctgggggtgagggtatgcgaga

SEQ ID NO: 133807 - DNA, 75 bp, Artificial Sequence
  Synthetic
tggacccgcgcaagggaggtcgcaagccggctcgactcatcgtgtatccagacctaggggtgagggtatgcgaga

SEQ ID NO: 133808 - DNA, 75 bp, Artificial Sequence
  Synthetic
tggacccgcgcaagggaggtcgcaagccggctcgactcatcgtgtatccagaccttggggtgagggtatgcgaga

SEQ ID NO: 133809 - DNA, 75 bp, Artificial Sequence
  Synthetic
tggacccgcgcaagggaggtcgcaagccggctcgactcatcgtgtatccagacctcggggtgagggtatgcgaga

SEQ ID NO: 133810 - DNA, 75 bp, Artificial Sequence
  Synthetic
tggacccgcgcaagggaggtcgcaagccggctcgactcatcgtgtatccagacctgggggtgagggtatgcgaga

SEQ ID NO: 133811 - DNA, 75 bp, Artificial Sequence
  Synthetic
tggacccgcgcaagggaggtcgcaagccggctcgactgatcgtgtatccagacctaggggtgagggtatgcgaga

SEQ ID NO: 133812 - DNA, 75 bp, Artificial Sequence
  Synthetic
tggacccgcgcaagggaggtcgcaagccggctcgactgatcgtgtatccagaccttggggtgagggtatgcgaga

SEQ ID NO: 133813 - DNA, 75 bp, Artificial Sequence
  Synthetic
tggacccgcgcaagggaggtcgcaagccggctcgactgatcgtgtatccagacctcggggtgagggtatgcgaga

SEQ ID NO: 133814 - DNA, 75 bp, Artificial Sequence
  Synthetic
tggacccgcgcaagggaggtcgcaagccggctcgactgatcgtgtatccagacctgggggtgagggtatgcgaga

SEQ ID NO: 133815 - DNA, 75 bp, Artificial Sequence
  Synthetic
tggacccgcggaagggaggtcgcaagccggctcgactaatcgtgtatccagacctaggggtgagggtatgcgaga

SEQ ID NO: 133816 - DNA, 75 bp, Artificial Sequence
  Synthetic
tggacccgcggaagggaggtcgcaagccggctcgactaatcgtgtatccagaccttggggtgagggtatgcgaga

SEQ ID NO: 133817 - DNA, 75 bp, Artificial Sequence
  Synthetic
tggacccgcggaagggaggtcgcaagccggctcgactaatcgtgtatccagacctcggggtgagggtatgcgaga

SEQ ID NO: 133818 - DNA, 75 bp, Artificial Sequence
  Synthetic
tggacccgcggaagggaggtcgcaagccggctcgactaatcgtgtatccagacctgggggtgagggtatgcgaga

SEQ ID NO: 133819 - DNA, 75 bp, Artificial Sequence
  Synthetic
tggacccgcggaagggaggtcgcaagccggctcgacttatcgtgtatccagacctaggggtgagggtatgcgaga

SEQ ID NO: 133820 - DNA, 75 bp, Artificial Sequence
  Synthetic
tggacccgcggaagggaggtcgcaagccggctcgacttatcgtgtatccagaccttggggtgagggtatgcgaga

SEQ ID NO: 133821 - DNA, 75 bp, Artificial Sequence
  Synthetic
tggacccgcggaagggaggtcgcaagccggctcgacttatcgtgtatccagacctcggggtgagggtatgcgaga

SEQ ID NO: 133822 - DNA, 75 bp, Artificial Sequence
  Synthetic
tggacccgcggaagggaggtcgcaagccggctcgacttatcgtgtatccagacctgggggtgagggtatgcgaga

SEQ ID NO: 133823 - DNA, 75 bp, Artificial Sequence
  Synthetic
tggacccgcggaagggaggtcgcaagccggctcgactcatcgtgtatccagacctaggggtgagggtatgcgaga

SEQ ID NO: 133824 - DNA, 75 bp, Artificial Sequence
  Synthetic
tggacccgcggaagggaggtcgcaagccggctcgactcatcgtgtatccagaccttggggtgagggtatgcgaga

SEQ ID NO: 133825 - DNA, 75 bp, Artificial Sequence
  Synthetic
tggacccgcggaagggaggtcgcaagccggctcgactcatcgtgtatccagacctcggggtgagggtatgcgaga

SEQ ID NO: 133826 - DNA, 75 bp, Artificial Sequence
  Synthetic
tggacccgcggaagggaggtcgcaagccggctcgactcatcgtgtatccagacctgggggtgagggtatgcgaga

SEQ ID NO: 133827 - DNA, 75 bp, Artificial Sequence
  Synthetic
tggacccgcggaagggaggtcgcaagccggctcgactgatcgtgtatccagacctaggggtgagggtatgcgaga

SEQ ID NO: 133828 - DNA, 75 bp, Artificial Sequence
  Synthetic
tggacccgcggaagggaggtcgcaagccggctcgactgatcgtgtatccagaccttggggtgagggtatgcgaga

SEQ ID NO: 133829 - DNA, 75 bp, Artificial Sequence
  Synthetic
tggacccgcggaagggaggtcgcaagccggctcgactgatcgtgtatccagacctcggggtgagggtatgcgaga

SEQ ID NO: 133830 - DNA, 75 bp, Artificial Sequence
  Synthetic
tggacccgcggaagggaggtcgcaagccggctcgactgatcgtgtatccagacctgggggtgagggtatgcgaga

SEQ ID NO: 133831 - DNA, 75 bp, Artificial Sequence
  Synthetic
tcgaattcctagtgcaagcttggaagtctaagaagaaccctatggggttctcgtatgacacccgctgcttcgact

SEQ ID NO: 133832 - DNA, 75 bp, Artificial Sequence
  Synthetic
aacgacatttatcacagcgtgtcacgtgcccgaacccgccatttgctgctttgcctactcctactagcggtaggg

SEQ ID NO: 133833 - DNA, 75 bp, Artificial Sequence
  Synthetic
gtaggcatttttctcctgccagcgcggtaagctggtaggataacactccatttcccttcgtttctccgccttttt

SEQ ID NO: 133834 - DNA, 75 bp, Artificial Sequence
  Synthetic
caaaatgtggcgctcaaagaagacccctatggggttctcctatgacaccaggtgttttgactcaacagtcacgga

SEQ ID NO: 133835 - DNA, 75 bp, Artificial Sequence
  Synthetic
caaaatgtggcgctcaaagaagacccctatggggttctcctatgacaccaggtgttttgactctacagtcacgga

SEQ ID NO: 133836 - DNA, 75 bp, Artificial Sequence
  Synthetic
caaaatgtggcgctcaaagaagacccctatggggttctcctatgacaccaggtgttttgactccacagtcacgga

SEQ ID NO: 133837 - DNA, 75 bp, Artificial Sequence
  Synthetic
caaaatgtggcgctcaaagaagacccctatggggttctcctatgacaccaggtgttttgactcgacagtcacgga

SEQ ID NO: 133838 - DNA, 75 bp, Artificial Sequence
  Synthetic
gctttacatcgggggccccctcacaaactcaaaaggacagagctgcggctatcgcaggtgccgcgcaagcggcgt

SEQ ID NO: 133839 - DNA, 75 bp, Artificial Sequence
  Synthetic
cggcgtagatcccgcaatttgggtaaggtcatcgataccctaacgtgcggattcgccgatctcatggggtacatt

SEQ ID NO: 133840 - DNA, 75 bp, Artificial Sequence
  Synthetic
ggccctatgtacaactctcgaggccaagcatgcgggacgcggagatgcagggccagtggtgttcttaccactagc

SEQ ID NO: 133841 - DNA, 75 bp, Artificial Sequence
  Synthetic
gacgatctcgtggtgatctgcgagagcgcgggagtcgaggatgacgcggcgaacctgcgagtcttcacggaggct

SEQ ID NO: 133842 - DNA, 75 bp, Artificial Sequence
  Synthetic
gaacctgcgagtcttcacggaggctatgaccaggtattccgccccacccggagacccgccgcagccagaatacga

SEQ ID NO: 133843 - DNA, 75 bp, Artificial Sequence
  Synthetic
gaacctgcgagtcttcacggaggctatgaccaggtattccgccccacccggtgacccgccgcagccagaatacga

SEQ ID NO: 133844 - DNA, 75 bp, Artificial Sequence
  Synthetic
gaacctgcgagtcttcacggaggctatgaccaggtattccgccccacccggcgacccgccgcagccagaatacga

SEQ ID NO: 133845 - DNA, 75 bp, Artificial Sequence
  Synthetic
gaacctgcgagtcttcacggaggctatgaccaggtattccgccccacccggggacccgccgcagccagaatacga

SEQ ID NO: 133846 - DNA, 75 bp, Artificial Sequence
  Synthetic
gttgctccttttctatcttcctccttgctctcttctcctgcttgacttgccctgcgtctagtctggagtacagga

SEQ ID NO: 133847 - DNA, 75 bp, Artificial Sequence
  Synthetic
tcatctcagagagtgtgggcgtgtccgaggacattggagcactgcgagccttcacggaggctatgacaagataat

SEQ ID NO: 133848 - DNA, 75 bp, Artificial Sequence
  Synthetic
tcatctcagagagtgtgggcgtgtccgaggacattggagcactgcgagccttcacggaggctatgacaagatatt

SEQ ID NO: 133849 - DNA, 75 bp, Artificial Sequence
  Synthetic
tcatctcagagagtgtgggcgtgtccgaggacattggagcactgcgagccttcacggaggctatgacaagatact

SEQ ID NO: 133850 - DNA, 75 bp, Artificial Sequence
  Synthetic
tcatctcagagagtgtgggcgtgtccgaggacattggagcactgcgagccttcacggaggctatgacaagatagt

SEQ ID NO: 133851 - DNA, 75 bp, Artificial Sequence
  Synthetic
tcatctcagagagtgtgggcgtgtccgaggacattggagcactgcgagccttcacggaggctatgacaagttaat

SEQ ID NO: 133852 - DNA, 75 bp, Artificial Sequence
  Synthetic
tcatctcagagagtgtgggcgtgtccgaggacattggagcactgcgagccttcacggaggctatgacaagttatt

SEQ ID NO: 133853 - DNA, 75 bp, Artificial Sequence
  Synthetic
tcatctcagagagtgtgggcgtgtccgaggacattggagcactgcgagccttcacggaggctatgacaagttact

SEQ ID NO: 133854 - DNA, 75 bp, Artificial Sequence
  Synthetic
tcatctcagagagtgtgggcgtgtccgaggacattggagcactgcgagccttcacggaggctatgacaagttagt

SEQ ID NO: 133855 - DNA, 75 bp, Artificial Sequence
  Synthetic
tcatctcagagagtgtgggcgtgtccgaggacattggagcactgcgagccttcacggaggctatgacaagctaat

SEQ ID NO: 133856 - DNA, 75 bp, Artificial Sequence
  Synthetic
tcatctcagagagtgtgggcgtgtccgaggacattggagcactgcgagccttcacggaggctatgacaagctatt

SEQ ID NO: 133857 - DNA, 75 bp, Artificial Sequence
  Synthetic
tcatctcagagagtgtgggcgtgtccgaggacattggagcactgcgagccttcacggaggctatgacaagctact

SEQ ID NO: 133858 - DNA, 75 bp, Artificial Sequence
  Synthetic
tcatctcagagagtgtgggcgtgtccgaggacattggagcactgcgagccttcacggaggctatgacaagctagt

SEQ ID NO: 133859 - DNA, 75 bp, Artificial Sequence
  Synthetic
tcatctcagagagtgtgggcgtgtccgaggacattggagcactgcgagccttcacggaggctatgacaaggtaat

SEQ ID NO: 133860 - DNA, 75 bp, Artificial Sequence
  Synthetic
tcatctcagagagtgtgggcgtgtccgaggacattggagcactgcgagccttcacggaggctatgacaaggtatt

SEQ ID NO: 133861 - DNA, 75 bp, Artificial Sequence
  Synthetic
tcatctcagagagtgtgggcgtgtccgaggacattggagcactgcgagccttcacggaggctatgacaaggtact

SEQ ID NO: 133862 - DNA, 75 bp, Artificial Sequence
  Synthetic
tcatctcagagagtgtgggcgtgtccgaggacattggagcactgcgagccttcacggaggctatgacaaggtagt

SEQ ID NO: 133863 - DNA, 75 bp, Artificial Sequence
  Synthetic
tcatctcagagagtgtgggcgtgtccgaggacattggagcactgcgagccttcacggaggctatgactagataat

SEQ ID NO: 133864 - DNA, 75 bp, Artificial Sequence
  Synthetic
tcatctcagagagtgtgggcgtgtccgaggacattggagcactgcgagccttcacggaggctatgactagatatt

SEQ ID NO: 133865 - DNA, 75 bp, Artificial Sequence
  Synthetic
tcatctcagagagtgtgggcgtgtccgaggacattggagcactgcgagccttcacggaggctatgactagatact

SEQ ID NO: 133866 - DNA, 75 bp, Artificial Sequence
  Synthetic
tcatctcagagagtgtgggcgtgtccgaggacattggagcactgcgagccttcacggaggctatgactagatagt

SEQ ID NO: 133867 - DNA, 75 bp, Artificial Sequence
  Synthetic
tcatctcagagagtgtgggcgtgtccgaggacattggagcactgcgagccttcacggaggctatgactagttaat

SEQ ID NO: 133868 - DNA, 75 bp, Artificial Sequence
  Synthetic
tcatctcagagagtgtgggcgtgtccgaggacattggagcactgcgagccttcacggaggctatgactagttatt

SEQ ID NO: 133869 - DNA, 75 bp, Artificial Sequence
  Synthetic
tcatctcagagagtgtgggcgtgtccgaggacattggagcactgcgagccttcacggaggctatgactagttact

SEQ ID NO: 133870 - DNA, 75 bp, Artificial Sequence
  Synthetic
tcatctcagagagtgtgggcgtgtccgaggacattggagcactgcgagccttcacggaggctatgactagttagt

SEQ ID NO: 133871 - DNA, 75 bp, Artificial Sequence
  Synthetic
tcatctcagagagtgtgggcgtgtccgaggacattggagcactgcgagccttcacggaggctatgactagctaat

SEQ ID NO: 133872 - DNA, 75 bp, Artificial Sequence
  Synthetic
tcatctcagagagtgtgggcgtgtccgaggacattggagcactgcgagccttcacggaggctatgactagctatt

SEQ ID NO: 133873 - DNA, 75 bp, Artificial Sequence
  Synthetic
tcatctcagagagtgtgggcgtgtccgaggacattggagcactgcgagccttcacggaggctatgactagctact

SEQ ID NO: 133874 - DNA, 75 bp, Artificial Sequence
  Synthetic
tcatctcagagagtgtgggcgtgtccgaggacattggagcactgcgagccttcacggaggctatgactagctagt

SEQ ID NO: 133875 - DNA, 75 bp, Artificial Sequence
  Synthetic
tcatctcagagagtgtgggcgtgtccgaggacattggagcactgcgagccttcacggaggctatgactaggtaat

SEQ ID NO: 133876 - DNA, 75 bp, Artificial Sequence
  Synthetic
tcatctcagagagtgtgggcgtgtccgaggacattggagcactgcgagccttcacggaggctatgactaggtatt

SEQ ID NO: 133877 - DNA, 75 bp, Artificial Sequence
  Synthetic
tcatctcagagagtgtgggcgtgtccgaggacattggagcactgcgagccttcacggaggctatgactaggtact

SEQ ID NO: 133878 - DNA, 75 bp, Artificial Sequence
  Synthetic
tcatctcagagagtgtgggcgtgtccgaggacattggagcactgcgagccttcacggaggctatgactaggtagt

SEQ ID NO: 133879 - DNA, 75 bp, Artificial Sequence
  Synthetic
tcatctcagagagtgtgggcgtgtccgaggacattggagcactgcgagccttcacggaggctatgaccagataat

SEQ ID NO: 133880 - DNA, 75 bp, Artificial Sequence
  Synthetic
tcatctcagagagtgtgggcgtgtccgaggacattggagcactgcgagccttcacggaggctatgaccagatatt

SEQ ID NO: 133881 - DNA, 75 bp, Artificial Sequence
  Synthetic
tcatctcagagagtgtgggcgtgtccgaggacattggagcactgcgagccttcacggaggctatgaccagatact

SEQ ID NO: 133882 - DNA, 75 bp, Artificial Sequence
  Synthetic
tcatctcagagagtgtgggcgtgtccgaggacattggagcactgcgagccttcacggaggctatgaccagatagt

SEQ ID NO: 133883 - DNA, 75 bp, Artificial Sequence
  Synthetic
tcatctcagagagtgtgggcgtgtccgaggacattggagcactgcgagccttcacggaggctatgaccagttaat

SEQ ID NO: 133884 - DNA, 75 bp, Artificial Sequence
  Synthetic
tcatctcagagagtgtgggcgtgtccgaggacattggagcactgcgagccttcacggaggctatgaccagttatt

SEQ ID NO: 133885 - DNA, 75 bp, Artificial Sequence
  Synthetic
tcatctcagagagtgtgggcgtgtccgaggacattggagcactgcgagccttcacggaggctatgaccagttact

SEQ ID NO: 133886 - DNA, 75 bp, Artificial Sequence
  Synthetic
tcatctcagagagtgtgggcgtgtccgaggacattggagcactgcgagccttcacggaggctatgaccagttagt

SEQ ID NO: 133887 - DNA, 75 bp, Artificial Sequence
  Synthetic
tcatctcagagagtgtgggcgtgtccgaggacattggagcactgcgagccttcacggaggctatgaccagctaat

SEQ ID NO: 133888 - DNA, 75 bp, Artificial Sequence
  Synthetic
tcatctcagagagtgtgggcgtgtccgaggacattggagcactgcgagccttcacggaggctatgaccagctatt

SEQ ID NO: 133889 - DNA, 75 bp, Artificial Sequence
  Synthetic
tcatctcagagagtgtgggcgtgtccgaggacattggagcactgcgagccttcacggaggctatgaccagctact

SEQ ID NO: 133890 - DNA, 75 bp, Artificial Sequence
  Synthetic
tcatctcagagagtgtgggcgtgtccgaggacattggagcactgcgagccttcacggaggctatgaccagctagt

SEQ ID NO: 133891 - DNA, 75 bp, Artificial Sequence
  Synthetic
tcatctcagagagtgtgggcgtgtccgaggacattggagcactgcgagccttcacggaggctatgaccaggtaat

SEQ ID NO: 133892 - DNA, 75 bp, Artificial Sequence
  Synthetic
tcatctcagagagtgtgggcgtgtccgaggacattggagcactgcgagccttcacggaggctatgaccaggtatt

SEQ ID NO: 133893 - DNA, 75 bp, Artificial Sequence
  Synthetic
tcatctcagagagtgtgggcgtgtccgaggacattggagcactgcgagccttcacggaggctatgaccaggtact

SEQ ID NO: 133894 - DNA, 75 bp, Artificial Sequence
  Synthetic
tcatctcagagagtgtgggcgtgtccgaggacattggagcactgcgagccttcacggaggctatgaccaggtagt

SEQ ID NO: 133895 - DNA, 75 bp, Artificial Sequence
  Synthetic
tcatctcagagagtgtgggcgtgtccgaggacattggagcactgcgagccttcacggaggctatgacgagataat

SEQ ID NO: 133896 - DNA, 75 bp, Artificial Sequence
  Synthetic
tcatctcagagagtgtgggcgtgtccgaggacattggagcactgcgagccttcacggaggctatgacgagatatt

SEQ ID NO: 133897 - DNA, 75 bp, Artificial Sequence
  Synthetic
tcatctcagagagtgtgggcgtgtccgaggacattggagcactgcgagccttcacggaggctatgacgagatact

SEQ ID NO: 133898 - DNA, 75 bp, Artificial Sequence
  Synthetic
tcatctcagagagtgtgggcgtgtccgaggacattggagcactgcgagccttcacggaggctatgacgagatagt

SEQ ID NO: 133899 - DNA, 75 bp, Artificial Sequence
  Synthetic
tcatctcagagagtgtgggcgtgtccgaggacattggagcactgcgagccttcacggaggctatgacgagttaat

SEQ ID NO: 133900 - DNA, 75 bp, Artificial Sequence
  Synthetic
tcatctcagagagtgtgggcgtgtccgaggacattggagcactgcgagccttcacggaggctatgacgagttatt

SEQ ID NO: 133901 - DNA, 75 bp, Artificial Sequence
  Synthetic
tcatctcagagagtgtgggcgtgtccgaggacattggagcactgcgagccttcacggaggctatgacgagttact

SEQ ID NO: 133902 - DNA, 75 bp, Artificial Sequence
  Synthetic
tcatctcagagagtgtgggcgtgtccgaggacattggagcactgcgagccttcacggaggctatgacgagttagt

SEQ ID NO: 133903 - DNA, 75 bp, Artificial Sequence
  Synthetic
tcatctcagagagtgtgggcgtgtccgaggacattggagcactgcgagccttcacggaggctatgacgagctaat

SEQ ID NO: 133904 - DNA, 75 bp, Artificial Sequence
  Synthetic
tcatctcagagagtgtgggcgtgtccgaggacattggagcactgcgagccttcacggaggctatgacgagctatt

SEQ ID NO: 133905 - DNA, 75 bp, Artificial Sequence
  Synthetic
tcatctcagagagtgtgggcgtgtccgaggacattggagcactgcgagccttcacggaggctatgacgagctact

SEQ ID NO: 133906 - DNA, 75 bp, Artificial Sequence
  Synthetic
tcatctcagagagtgtgggcgtgtccgaggacattggagcactgcgagccttcacggaggctatgacgagctagt

SEQ ID NO: 133907 - DNA, 75 bp, Artificial Sequence
  Synthetic
tcatctcagagagtgtgggcgtgtccgaggacattggagcactgcgagccttcacggaggctatgacgaggtaat

SEQ ID NO: 133908 - DNA, 75 bp, Artificial Sequence
  Synthetic
tcatctcagagagtgtgggcgtgtccgaggacattggagcactgcgagccttcacggaggctatgacgaggtatt

SEQ ID NO: 133909 - DNA, 75 bp, Artificial Sequence
  Synthetic
tcatctcagagagtgtgggcgtgtccgaggacattggagcactgcgagccttcacggaggctatgacgaggtact

SEQ ID NO: 133910 - DNA, 75 bp, Artificial Sequence
  Synthetic
tcatctcagagagtgtgggcgtgtccgaggacattggagcactgcgagccttcacggaggctatgacgaggtagt

SEQ ID NO: 133911 - DNA, 75 bp, Artificial Sequence
  Synthetic
cgtcgcagatggcaatcaaacattgtgctggacaccagtgtcaccgacggtggccgtaaggtatcccggtgcgac

SEQ ID NO: 133912 - DNA, 75 bp, Artificial Sequence
  Synthetic
aggcaacattatcatgtatgcccccacattgtgggcgaggatgatcctgatgacccatttcttcagcatcctcct

SEQ ID NO: 133913 - DNA, 75 bp, Artificial Sequence
  Synthetic
atactactacctcacaagagaccctaccacaccattggtccgagctgcttgggaaacagcgcggcatactccagt

SEQ ID NO: 133914 - DNA, 75 bp, Artificial Sequence
  Synthetic
cctctgcggggccgtgttccttatgggacaagccttcaccttcaggcctcgtcgacacacgaccgtgcaaacctg

SEQ ID NO: 133915 - DNA, 75 bp, Artificial Sequence
  Synthetic
ctccacagagtgcttgacttcgacatatacggagtcacttactctatcactccactggacttgccacggatcatc

SEQ ID NO: 133916 - DNA, 75 bp, Artificial Sequence
  Synthetic
atgcggttgccccaaactttctttgacctggtcgtgggggcccattggggcgtgatggcaggcctcgcctacttt

SEQ ID NO: 133917 - DNA, 75 bp, Artificial Sequence
  Synthetic
cgtgatggcaggcctcgcctacttttccatgcaaggcaactgggccaaggtcggcatcgtgctgatcatgttctc

SEQ ID NO: 133918 - DNA, 75 bp, Artificial Sequence
  Synthetic
tgagagcttggaggcatcgggccagagcggtcagggctaaactcatcgcccaagggggaaaagccgctgaatgcg

SEQ ID NO: 133919 - DNA, 75 bp, Artificial Sequence
  Synthetic
tccatgcaaggcaactgggccaaggtcggcatcgtgctgatcatgttctcgggagtggatgcggagacatacacc

SEQ ID NO: 133920 - DNA, 75 bp, Artificial Sequence
  Synthetic
tggtggggaactgggctaaggtcttgattgtgatgctactttttgccggcgttgacgggactaccagcgtgacgg

SEQ ID NO: 133921 - DNA, 75 bp, Artificial Sequence
  Synthetic
tctgttttcctcgtctcccagctgttcaccttctcgcctcgccggcatgagacggtacaggactgcaattgttca

SEQ ID NO: 133922 - DNA, 75 bp, Artificial Sequence
  Synthetic
acatcaacagcactgccttgaattgcaacgattccctaaacaccgggttcatagcagggcttatgtactatcgca

SEQ ID NO: 133923 - DNA, 75 bp, Artificial Sequence
  Synthetic
gcactacgcgccccgaccgtgtggtactgtgcccgcgtcggaggtgtgtggtccagtgtactgtttcaccccgag

SEQ ID NO: 133924 - DNA, 75 bp, Artificial Sequence
  Synthetic
agtaggggtagggatctttttgctccctgctcggtaggcagggggcctaaagctacgctccattagcttttcatt

SEQ ID NO: 133925 - DNA, 75 bp, Artificial Sequence
  Synthetic
caactcgtccggatgctcagagcgcatggccagctgccgccccattgaccagttcgatcaggggtggggtcccat

SEQ ID NO: 133926 - DNA, 75 bp, Artificial Sequence
  Synthetic
ttccaatgaggacaggccatattgctggcactacccgcccagaccctgcaacacagtcaaggcgtcggaggtctg

SEQ ID NO: 133927 - DNA, 75 bp, Artificial Sequence
  Synthetic
ttccattgaggacaggccatattgctggcactacccgcccagaccctgcaacacagtcaaggcgtcggaggtctg

SEQ ID NO: 133928 - DNA, 75 bp, Artificial Sequence
  Synthetic
ttccactgaggacaggccatattgctggcactacccgcccagaccctgcaacacagtcaaggcgtcggaggtctg

SEQ ID NO: 133929 - DNA, 75 bp, Artificial Sequence
  Synthetic
ttccagtgaggacaggccatattgctggcactacccgcccagaccctgcaacacagtcaaggcgtcggaggtctg

SEQ ID NO: 133930 - DNA, 75 bp, Artificial Sequence
  Synthetic
ttcttgctgacctccttgaggcccccccaaggccggtggtttggttgtgtgtggatgaacagtacggggtttgtg

SEQ ID NO: 133931 - DNA, 75 bp, Artificial Sequence
  Synthetic
ccgttgcggcggagatcctgcggaaaaccaggaaatttcccccagcgatacccatatgggcacgcccggactaca

SEQ ID NO: 133932 - DNA, 75 bp, Artificial Sequence
  Synthetic
caactggttcggctgtacatggatgaatagcactgggttcaccaagacgtgtgggggccccccgtgtaacatcgg

SEQ ID NO: 133933 - DNA, 75 bp, Artificial Sequence
  Synthetic
tggggacgaccgatcgttctggcgcccctacgtatagctggggggagaatgagacggacgtgctgctcctcaaca

SEQ ID NO: 133934 - DNA, 75 bp, Artificial Sequence
  Synthetic
cccaccgactgctttaggaagcaccccgctgccacgtatggtcgctgcgggtccggaccctggcttacgccaagg

SEQ ID NO: 133935 - DNA, 75 bp, Artificial Sequence
  Synthetic
tggcggagcttgctacgaagaccttcagcagctccgtatcatcggccgtcgacagcggcacagcgaccgcccctc

SEQ ID NO: 133936 - DNA, 75 bp, Artificial Sequence
  Synthetic
tctcagctgcatgcaactggacgaggggagagcgctgtgatcttgaagatcgtgaccgcagcgagcaacaaccat

SEQ ID NO: 133937 - DNA, 75 bp, Artificial Sequence
  Synthetic
ccatgcaaggagcgtgggtcaaagtcgctgttatcctccttcttgtcgcaggagtggatgcaaccacttactcct

SEQ ID NO: 133938 - DNA, 75 bp, Artificial Sequence
  Synthetic
cgccaagcaggacgtccagctgatcaacaccaacggcagttggcacatcaatagcacggccttgaactgcaatga

SEQ ID NO: 133939 - DNA, 75 bp, Artificial Sequence
  Synthetic
tctggtgtagtgggctgggctctcaagtgggagttcgtcgtcctcgtgttcctccttctagcggacgcacgcgtg

SEQ ID NO: 133940 - DNA, 75 bp, Artificial Sequence
  Synthetic
ggacgtgcaatacctgtacggtatagggtcagtggttgtctcctttgcaatcaagtgggagtatatcgtgttgct

SEQ ID NO: 133941 - DNA, 75 bp, Artificial Sequence
  Synthetic
caagttcaactcgtccggatgcccagagcgcatggccagctgcagctccattgacaagttcgctcagggatgggg

SEQ ID NO: 133942 - DNA, 75 bp, Artificial Sequence
  Synthetic
tccaaccagagaaaggaggccgcaagccagcccgccttatcgtattcccagacctgggggttcgtgtatgcgaga

SEQ ID NO: 133943 - DNA, 75 bp, Artificial Sequence
  Synthetic
tcatctggtaccttgtcgtgttctgcgctgcgtggcatatccgggggaagctagtcccactagtgacctatggta

SEQ ID NO: 133944 - DNA, 75 bp, Artificial Sequence
  Synthetic
tatcgtacccgcgtcgcaggtgtgtggtccagtgtactgtttcaccccaagccctgttgtagtggggacgaccga

SEQ ID NO: 133945 - DNA, 75 bp, Artificial Sequence
  Synthetic
gtcttaggtgccatcttatacttcagcatggtggccaactgggcaaaagtcgctgcggtcttgattttgttcgct

SEQ ID NO: 133946 - DNA, 75 bp, Artificial Sequence
  Synthetic
gctggcattaccctccgaaaccctgcggtatcgtctcggctaggacagtgtgcgggccagtctactgctttaccc

SEQ ID NO: 133947 - DNA, 75 bp, Artificial Sequence
  Synthetic
cctgctcttcgggttctttaccttgtcaccatggtataaacactggattagccgtctcatctggtggaaccagta

SEQ ID NO: 133948 - DNA, 75 bp, Artificial Sequence
  Synthetic
ccagggtcagcccaaaacctgcagcttattaacaccaatggtagctggcacatcaacaggacagctttgaactgc

SEQ ID NO: 133949 - DNA, 75 bp, Artificial Sequence
  Synthetic
ctgggggtcattatgtccaaatggctttcatgaagctggccgcactgacgggtacgtacgtttatgaccatctta

SEQ ID NO: 133950 - DNA, 75 bp, Artificial Sequence
  Synthetic
ccctctctgatctttgacatcacaaaactgctgatagctgtccttgggccactgtacttaatacaagctgcactt

SEQ ID NO: 133951 - DNA, 75 bp, Artificial Sequence
  Synthetic
ccctctctgatctttgacatcacaaaactgctgatagctgtccttgggcctctgtacttaatacaagctgcactt

SEQ ID NO: 133952 - DNA, 75 bp, Artificial Sequence
  Synthetic
ccctctctgatctttgacatcacaaaactgctgatagctgtccttgggcccctgtacttaatacaagctgcactt

SEQ ID NO: 133953 - DNA, 75 bp, Artificial Sequence
  Synthetic
ccctctctgatctttgacatcacaaaactgctgatagctgtccttgggccgctgtacttaatacaagctgcactt

SEQ ID NO: 133954 - DNA, 75 bp, Artificial Sequence
  Synthetic
atcagaaccccctattttgtgcgcgcccacgtgctgatccgtatctgcatgatggtgcgctctgcagtgggcggg

SEQ ID NO: 133955 - DNA, 75 bp, Artificial Sequence
  Synthetic
gggcctgcctgctaaggaggtatgtggccccgtgtactgcttcacgcccagccccgtagtcgttggcacgacgga

SEQ ID NO: 133956 - DNA, 75 bp, Artificial Sequence
  Synthetic
aagaactggcagtggccacggagcccgtcatcttcagtcctatggagattaaggttatcacctggggtgcggaca

SEQ ID NO: 133957 - DNA, 75 bp, Artificial Sequence
  Synthetic
aaggttatcacctggggtgcggacacagcagcctgcggagacatcctatgcgggctgcccgtttcagcacgattg

SEQ ID NO: 133958 - DNA, 75 bp, Artificial Sequence
  Synthetic
ttggaactattgtcaccagcttgacaggtagggataaaaatgtagtgactggtgaggtgcaggtactgtccactg

SEQ ID NO: 133959 - DNA, 75 bp, Artificial Sequence
  Synthetic
ccagatgtacacaaacgtggaccaggacctggtgggttggccggcgcctgcgggggctaagtctctcgacccctg

SEQ ID NO: 133960 - DNA, 75 bp, Artificial Sequence
  Synthetic
cttgtggtcctttctcctcctagtcctagccttgcctcggcaggcttatgccttggacaccattgaacaaggaga

SEQ ID NO: 133961 - DNA, 75 bp, Artificial Sequence
  Synthetic
cttgtggtcctttctcctcctagtccttgccttgcctcggcaggcttatgccttggacaccattgaacaaggaga

SEQ ID NO: 133962 - DNA, 75 bp, Artificial Sequence
  Synthetic
cttgtggtcctttctcctcctagtcctcgccttgcctcggcaggcttatgccttggacaccattgaacaaggaga

SEQ ID NO: 133963 - DNA, 75 bp, Artificial Sequence
  Synthetic
cttgtggtcctttctcctcctagtcctggccttgcctcggcaggcttatgccttggacaccattgaacaaggaga

SEQ ID NO: 133964 - DNA, 75 bp, Artificial Sequence
  Synthetic
ctagccttgcctcggcaggcttatgccttggacaccattgaacaaggagaactggggctggtcatattggcaatt

SEQ ID NO: 133965 - DNA, 75 bp, Artificial Sequence
  Synthetic
cttgccttgcctcggcaggcttatgccttggacaccattgaacaaggagaactggggctggtcatattggcaatt

SEQ ID NO: 133966 - DNA, 75 bp, Artificial Sequence
  Synthetic
ctcgccttgcctcggcaggcttatgccttggacaccattgaacaaggagaactggggctggtcatattggcaatt

SEQ ID NO: 133967 - DNA, 75 bp, Artificial Sequence
  Synthetic
ctggccttgcctcggcaggcttatgccttggacaccattgaacaaggagaactggggctggtcatattggcaatt

SEQ ID NO: 133968 - DNA, 75 bp, Artificial Sequence
  Synthetic
ccattgtcctgtctcaaaggctcctccgggggtcccgtcatgtgcccctcgggacacgtggtgggggtcttcaga

SEQ ID NO: 133969 - DNA, 75 bp, Artificial Sequence
  Synthetic
gggggggcgtgacgggatcatctgggtggctgtcattctacacccacgccttgtgtttgagatcacgaagtggtt

SEQ ID NO: 133970 - DNA, 75 bp, Artificial Sequence
  Synthetic
taggtatctacctcctccccaaccgataaaggttggggttaacactccggcctcttaggccatttttcctggttt

SEQ ID NO: 133971 - DNA, 75 bp, Artificial Sequence
  Synthetic
ccccccctgccgtgccggaatcttaccaggtgggatatcttcacgctcccaccgggagcggtaaaagcaccaagg

SEQ ID NO: 133972 - DNA, 75 bp, Artificial Sequence
  Synthetic
tctgtagcggctactctaggcttcggcacgtacatgtcgaaagcctatgggattgaccccaacatccgcacaggg

SEQ ID NO: 133973 - DNA, 75 bp, Artificial Sequence
  Synthetic
gggtgaggctaacagtgctggcgactgcgactccccccggcagcattaccgtgccacatcctaacatcgaggagg

SEQ ID NO: 133974 - DNA, 75 bp, Artificial Sequence
  Synthetic
attgcgaaatctacggagcctgctactccatagaaccactggatctacctccaatcattcaaagactccatggcc

SEQ ID NO: 133975 - DNA, 75 bp, Artificial Sequence
  Synthetic
taatggcagctacggtctgctcggccttgtacgtgggagatgtgtgcggggccgtgatgatcgtgtcgcaggctc

SEQ ID NO: 133976 - DNA, 75 bp, Artificial Sequence
  Synthetic
gaaatgtgacgagctggccagcaagctcagagggatgggggtcaacgctgtggcgttttacagaggcctcgacgt

SEQ ID NO: 133977 - DNA, 75 bp, Artificial Sequence
  Synthetic
ctcagagggatgggggtcaacgctgtggcgttttacagaggcctcgacgtgtccgtgataccaacatctggagac

SEQ ID NO: 133978 - DNA, 75 bp, Artificial Sequence
  Synthetic
gctgtggaacagtacgttgacttcagtctagaccccactttttccattgagacacgcacgattcctcaggacgcg

SEQ ID NO: 133979 - DNA, 75 bp, Artificial Sequence
  Synthetic
gtctagaccccactttttccattgagacacgcacgattcctcaggacgcggtatcccggagtcagcgcaggggcc

SEQ ID NO: 133980 - DNA, 75 bp, Artificial Sequence
  Synthetic
cctataacagcttatgcgcagcagacacgggggcttctcggcaccattgtaacaagcctcactggccgggacagg

SEQ ID NO: 133981 - DNA, 75 bp, Artificial Sequence
  Synthetic
tgcacttctctcatgcctgactgtcccggcctctgcagttccataccgaaatgcttctggggtttatcatgtcac

SEQ ID NO: 133982 - DNA, 75 bp, Artificial Sequence
  Synthetic
aagcagaacatccagttaatcaacaccaacggcagctggcacataaaccggaccgccctcaattgcaatgacagc

SEQ ID NO: 133983 - DNA, 75 bp, Artificial Sequence
  Synthetic
ccaacggcagctggcacataaaccggaccgccctcaattgcaatgacagcttacagacgggtttccttgcttccc

SEQ ID NO: 133984 - DNA, 75 bp, Artificial Sequence
  Synthetic
caatgactccctcaagactgggtttgtggcttcgctgttctacgctcacaggttcaacgcgtctggatgcccaga

SEQ ID NO: 133985 - DNA, 75 bp, Artificial Sequence
  Synthetic
ggcccgcaccgactggatctcggtcactcacgccatgcacgtgtggcgcatcagatctctatctagtgaccagac

SEQ ID NO: 133986 - DNA, 75 bp, Artificial Sequence
  Synthetic
atgtggaaatgtctcatacgcctgaaaccaactctgcaaggccctactcctctcctgtacaggttaggagcaatc

SEQ ID NO: 133987 - DNA, 75 bp, Artificial Sequence
  Synthetic
atgtggaaatgtctcatacgcctgaatccaactctgcaaggccctactcctctcctgtacaggttaggagcaatc

SEQ ID NO: 133988 - DNA, 75 bp, Artificial Sequence
  Synthetic
atgtggaaatgtctcatacgcctgaacccaactctgcaaggccctactcctctcctgtacaggttaggagcaatc

SEQ ID NO: 133989 - DNA, 75 bp, Artificial Sequence
  Synthetic
atgtggaaatgtctcatacgcctgaagccaactctgcaaggccctactcctctcctgtacaggttaggagcaatc

SEQ ID NO: 133990 - DNA, 75 bp, Artificial Sequence
  Synthetic
tctgtgtcaatcgggccatgtagtagggctgttccgtgccgcagtctgcactcgtggggtggcgaaagcacttga

SEQ ID NO: 133991 - DNA, 75 bp, Artificial Sequence
  Synthetic
tctgtgtctatcgggccatgtagtagggctgttccgtgccgcagtctgcactcgtggggtggcgaaagcacttga

SEQ ID NO: 133992 - DNA, 75 bp, Artificial Sequence
  Synthetic
tctgtgtccatcgggccatgtagtagggctgttccgtgccgcagtctgcactcgtggggtggcgaaagcacttga

SEQ ID NO: 133993 - DNA, 75 bp, Artificial Sequence
  Synthetic
tctgtgtcgatcgggccatgtagtagggctgttccgtgccgcagtctgcactcgtggggtggcgaaagcacttga

SEQ ID NO: 133994 - DNA, 75 bp, Artificial Sequence
  Synthetic
acattgttgccgggggccactggggggtcttgtttgctgccgcttacttcgcatcagcggctaactgggctaaag

SEQ ID NO: 133995 - DNA, 75 bp, Artificial Sequence
  Synthetic
ggtcttgtttgctgccgcttacttcgcatcagcggctaactgggctaaagttgtgctggtcttgtttctgtttgc

SEQ ID NO: 133996 - DNA, 75 bp, Artificial Sequence
  Synthetic
gtgtcctagcagccctcgcagcctactgtttatcggtcggctgcgtcgtcatcgtagggcacattgagctagggg

SEQ ID NO: 133997 - DNA, 75 bp, Artificial Sequence
  Synthetic
gcaagtgctgtatcaacaatatgatgagatggaagaatgctcccagtctgctccttacatcgagcaagcacaggc

SEQ ID NO: 133998 - DNA, 75 bp, Artificial Sequence
  Synthetic
tcgactcggtgatagactgtaacacgtgtgtcacccagacagtcgatttcagccttgaccctaccttcaccattg

SEQ ID NO: 133999 - DNA, 75 bp, Artificial Sequence
  Synthetic
gacaacaagaagccgtaatccagcctgtggtgcaatcacattggcagaaagtggaagcgttttggtacaagtaca

SEQ ID NO: 134000 - DNA, 75 bp, Artificial Sequence
  Synthetic
gacaacaagaagccgtaatcctgcctgtggtgcaatcacattggcagaaagtggaagcgttttggtacaagtaca

SEQ ID NO: 134001 - DNA, 75 bp, Artificial Sequence
  Synthetic
gacaacaagaagccgtaatcccgcctgtggtgcaatcacattggcagaaagtggaagcgttttggtacaagtaca

SEQ ID NO: 134002 - DNA, 75 bp, Artificial Sequence
  Synthetic
gacaacaagaagccgtaatccggcctgtggtgcaatcacattggcagaaagtggaagcgttttggtacaagtaca

SEQ ID NO: 134003 - DNA, 75 bp, Artificial Sequence
  Synthetic
gtcaacaagaagccgtaatccagcctgtggtgcaatcacattggcagaaagtggaagcgttttggtacaagtaca

SEQ ID NO: 134004 - DNA, 75 bp, Artificial Sequence
  Synthetic
gtcaacaagaagccgtaatcctgcctgtggtgcaatcacattggcagaaagtggaagcgttttggtacaagtaca

SEQ ID NO: 134005 - DNA, 75 bp, Artificial Sequence
  Synthetic
gtcaacaagaagccgtaatcccgcctgtggtgcaatcacattggcagaaagtggaagcgttttggtacaagtaca

SEQ ID NO: 134006 - DNA, 75 bp, Artificial Sequence
  Synthetic
gtcaacaagaagccgtaatccggcctgtggtgcaatcacattggcagaaagtggaagcgttttggtacaagtaca

SEQ ID NO: 134007 - DNA, 75 bp, Artificial Sequence
  Synthetic
gccaacaagaagccgtaatccagcctgtggtgcaatcacattggcagaaagtggaagcgttttggtacaagtaca

SEQ ID NO: 134008 - DNA, 75 bp, Artificial Sequence
  Synthetic
gccaacaagaagccgtaatcctgcctgtggtgcaatcacattggcagaaagtggaagcgttttggtacaagtaca

SEQ ID NO: 134009 - DNA, 75 bp, Artificial Sequence
  Synthetic
gccaacaagaagccgtaatcccgcctgtggtgcaatcacattggcagaaagtggaagcgttttggtacaagtaca

SEQ ID NO: 134010 - DNA, 75 bp, Artificial Sequence
  Synthetic
gccaacaagaagccgtaatccggcctgtggtgcaatcacattggcagaaagtggaagcgttttggtacaagtaca

SEQ ID NO: 134011 - DNA, 75 bp, Artificial Sequence
  Synthetic
ggcaacaagaagccgtaatccagcctgtggtgcaatcacattggcagaaagtggaagcgttttggtacaagtaca

SEQ ID NO: 134012 - DNA, 75 bp, Artificial Sequence
  Synthetic
ggcaacaagaagccgtaatcctgcctgtggtgcaatcacattggcagaaagtggaagcgttttggtacaagtaca

SEQ ID NO: 134013 - DNA, 75 bp, Artificial Sequence
  Synthetic
ggcaacaagaagccgtaatcccgcctgtggtgcaatcacattggcagaaagtggaagcgttttggtacaagtaca

SEQ ID NO: 134014 - DNA, 75 bp, Artificial Sequence
  Synthetic
ggcaacaagaagccgtaatccggcctgtggtgcaatcacattggcagaaagtggaagcgttttggtacaagtaca

SEQ ID NO: 134015 - DNA, 75 bp, Artificial Sequence
  Synthetic
tgagtgggcggtgttgccatgctccttctccgacctaccggcactatccactggcctattgcacctccaccaaaa

SEQ ID NO: 134016 - DNA, 75 bp, Artificial Sequence
  Synthetic
ctatcagctatgccgacatatcaggccccagtgatgacaagccatattgctggcactatcctccgcggccgtgcg

SEQ ID NO: 134017 - DNA, 75 bp, Artificial Sequence
  Synthetic
tggcactatcctccgcggccgtgcggagtggtgccagcccgagatgtctgtggtcctgtctactgttttacacct

SEQ ID NO: 134018 - DNA, 75 bp, Artificial Sequence
  Synthetic
cagccccctcacaaccaaccaaactatgttctttaacatccttgggggttgggtggccacacacctagcgggtcc

SEQ ID NO: 134019 - DNA, 75 bp, Artificial Sequence
  Synthetic
caccagcccgctcaccacccaaagtaccctcctgtttaacatcttggggggatgggtggccgcccaactcgctcc

SEQ ID NO: 134020 - DNA, 75 bp, Artificial Sequence
  Synthetic
ttgccggcgtcgacgcgaaaaccaccgtcaccgggggaactgccgcccacaccacgtctgggattgctggccttt

SEQ ID NO: 134021 - DNA, 75 bp, Artificial Sequence
  Synthetic
gcttgatgtgctcgccgggtacggagctggggtctctggcgccctagtggccttcaaaatcatgggaggggagct

SEQ ID NO: 134022 - DNA, 75 bp, Artificial Sequence
  Synthetic
gcttgtggacatcttggcgggttatggagcaggggtggctggcgcactcgtggcctttaaggtcatgagcggcga

SEQ ID NO: 134023 - DNA, 75 bp, Artificial Sequence
  Synthetic
ggatgaacagactcatagcgttcgcatctcggggcaaccatgtgtcaccaacacactatgtccctgagagcgacg

SEQ ID NO: 134024 - DNA, 75 bp, Artificial Sequence
  Synthetic
cctccttcgtgggacataatgtggaaatgtctaactaggctcaaacctacactgactggtcctacccccctcctg

SEQ ID NO: 134025 - DNA, 75 bp, Artificial Sequence
  Synthetic
actgactggtcctacccccctcctgtaccgcttgggtgccgtgaccaacgaggttaccctgacacaccccgtgac

SEQ ID NO: 134026 - DNA, 75 bp, Artificial Sequence
  Synthetic
tgtacccgcgtcgcaggtgtgtggtccagtgtattgcttcaccccaagccctgttgtggtggggacgaccgatcg

SEQ ID NO: 134027 - DNA, 75 bp, Artificial Sequence
  Synthetic
cggtgactggttacatgatatctgggactgggtctgtactgtgctcagtgacttcagaacttggctttcggctaa

SEQ ID NO: 134028 - DNA, 75 bp, Artificial Sequence
  Synthetic
gcgtctctgctacggataccatactttgtgagggcccacgctctgctacgagtgtgtaccctggtgagacgcctt

SEQ ID NO: 134029 - DNA, 75 bp, Artificial Sequence
  Synthetic
tggcgtccgggttctggaagacggcgtgaactatgcaacagggaatcttcctggttgctctttctctatcttcct

SEQ ID NO: 134030 - DNA, 75 bp, Artificial Sequence
  Synthetic
gggaaggaactgacaggacacgtgaaaaacgggtccatgaggatagcagggtcaagcctctgtgccaacatgtgg

SEQ ID NO: 134031 - DNA, 75 bp, Artificial Sequence
  Synthetic
acaccaccgggccaggtacgcccgtccccgctctcaattactcgcgcgctctgtggcgcgtggcctctgacagtt

SEQ ID NO: 134032 - DNA, 75 bp, Artificial Sequence
  Synthetic
tcgagcccgttgtcttctccgacatggagaccaagatcatcacctggggggcggacaccgcggcgtgtggggaca

SEQ ID NO: 134033 - DNA, 75 bp, Artificial Sequence
  Synthetic
cgttactcttactcctcttgttcctgcctcacagggctttggccctggactcaaccgatggcgggaccgtgggtt

SEQ ID NO: 134034 - DNA, 75 bp, Artificial Sequence
  Synthetic
tcaaccgatggcgggaccgtgggttgtcttgtgctaatcatccttacaatcttcacactcacccctggttacaag

SEQ ID NO: 134035 - DNA, 75 bp, Artificial Sequence
  Synthetic
cgagttggacggagtgaggctccaccgctatgctcctccctgtaaacccctactgagggacgagatcaccttcag

SEQ ID NO: 134036 - DNA, 75 bp, Artificial Sequence
  Synthetic
cgctatgctcctccctgtaaacccctactgagggacgagatcaccttcagtgtaggattgcattcatatgcaatt

SEQ ID NO: 134037 - DNA, 75 bp, Artificial Sequence
  Synthetic
tgtgccggaccgagaggtcttgtaccaacagtttgatgagatggaggaatgtgcccacaacataccctatctcgt

SEQ ID NO: 134038 - DNA, 75 bp, Artificial Sequence
  Synthetic
tggacagtatatcatggggctggtaataagaccttggctggccccaaaggaccagtcactcagatgtacaccagc

SEQ ID NO: 134039 - DNA, 75 bp, Artificial Sequence
  Synthetic
gtgatgctatcatcttgctcacatgcctctttcatcctgccctggggtttgagatcacaaaaatcctcctcggga

SEQ ID NO: 134040 - DNA, 75 bp, Artificial Sequence
  Synthetic
acggccgccacggcggcccggcgccttgcacgcggttcccctccatcagaagccagctcctctgccagccagctc

SEQ ID NO: 134041 - DNA, 75 bp, Artificial Sequence
  Synthetic
atatcacccgggtagagtctgaaacaaaggtggtgatccttgattcgttcgaacccctgagagctgaggaagacg

SEQ ID NO: 134042 - DNA, 75 bp, Artificial Sequence
  Synthetic
ttatcaggctacggtctgcgccaaagcgctggcccctccaccgagctgggacgccatgtggaagtgcctgatccg

SEQ ID NO: 134043 - DNA, 75 bp, Artificial Sequence
  Synthetic
ctacagaacccatcatattctccgctatggagacaaaggtcatcacgtggggggctgacacggccgcgtgtgggg

SEQ ID NO: 134044 - DNA, 75 bp, Artificial Sequence
  Synthetic
ccctccgtggaaggacccagcctacgagccacccgtagtccacgggtgtgccctgccatcaactcgtcccacgcc

SEQ ID NO: 134045 - DNA, 75 bp, Artificial Sequence
  Synthetic
acaacagtacgccaccagctgtgccccagtcttaccaggtgggctacttgcatgcaccaacaggcagcgggaaga

SEQ ID NO: 134046 - DNA, 75 bp, Artificial Sequence
  Synthetic
ctctgttgcactctaccacggaatgggccatcctgccctgcacctactcagacttacccgctttgtcaactggtc

SEQ ID NO: 134047 - DNA, 75 bp, Artificial Sequence
  Synthetic
ggagaaatccttcccgtcggcgaaatcggaggggacaggtacttcttcctcgggagtcggtacagaatccactgc

SEQ ID NO: 134048 - DNA, 75 bp, Artificial Sequence
  Synthetic
ccccgatctcagcgacgggtcttggtctaccgtgagcgaggaggctagtgaggacgtcgtctgctgctcgatgtc

SEQ ID NO: 134049 - DNA, 75 bp, Artificial Sequence
  Synthetic
tcactccgtgtacctgcggatcggcggatctgtacctggttaccaggcatgcagacgtcattcccgctcgtagac

SEQ ID NO: 134050 - DNA, 75 bp, Artificial Sequence
  Synthetic
ggatctgtacctggttaccaggcatgcagacgtcattcccgctcgtagacggggcgacactcgcgcctccctgct

SEQ ID NO: 134051 - DNA, 75 bp, Artificial Sequence
  Synthetic
caccacaatcttgtctactcaacgtcatctcgcagcgctgctgcacgtcagaagaaggttaccttcgacagactg

SEQ ID NO: 134052 - DNA, 75 bp, Artificial Sequence
  Synthetic
gaagaaggttaccttcgacagactgcaagtgctcgatgaccattacaagaatgtacttaaggaggtaaaggagcg

SEQ ID NO: 134053 - DNA, 75 bp, Artificial Sequence
  Synthetic
cggggcgtcgcgaaggcactcgagttcgttccggtcgaaagcctggagaccacagcacgttcgcccgtgttcacc

SEQ ID NO: 134054 - DNA, 75 bp, Artificial Sequence
  Synthetic
gaagtacgggtatagtgcaaaggatgttcgttctttgtccagcaaggccatgaaccagatccgctccgtctggga

SEQ ID NO: 134055 - DNA, 75 bp, Artificial Sequence
  Synthetic
cggcccaggggtataaggtgctggtgctcaacccgtctgtcgcagcgacgctcgggttcggagcatacatgtcaa

SEQ ID NO: 134056 - DNA, 75 bp, Artificial Sequence
  Synthetic
tcaggcgagaggccgtctgggatgttcgacagcgtagtgctctgcgagtgctatgatgccggggcagcctggtac

SEQ ID NO: 134057 - DNA, 75 bp, Artificial Sequence
  Synthetic
cgtctcatcgtctatcctgatctgggggtgcgggtctgtgagaaacgcgccctgtatgacgtgatacagaagttg

SEQ ID NO: 134058 - DNA, 75 bp, Artificial Sequence
  Synthetic
accttcgcagtgggatcacagttgccctgcgagccagagccagacgtggtggctctcacctccatgctgacagac

SEQ ID NO: 134059 - DNA, 75 bp, Artificial Sequence
  Synthetic
tgcgcgacttagcggtcgccgtggaacccatcatcttcagtccgatggagaagaaggtcatcgtctggggagcgg

SEQ ID NO: 134060 - DNA, 75 bp, Artificial Sequence
  Synthetic
ggctatgaaccacccactgtcctaggctgtgcccttccccccacacctcaagcaccagtgcccccacctcggagg

SEQ ID NO: 134061 - DNA, 75 bp, Artificial Sequence
  Synthetic
gagacggctggagctaggctcgtcgtcttggccacggccaccccccccggcagtgtgacaacgccccaccccaac

SEQ ID NO: 134062 - DNA, 75 bp, Artificial Sequence
  Synthetic
ggttttcgtacgacacccgttgctttgactctactgtcactgaacatgacatcagggtggaggaggagatatacc

SEQ ID NO: 134063 - DNA, 75 bp, Artificial Sequence
  Synthetic
taaaagggacatgtacaacgcacagtccccatccggatgcggaattgcttgaggccaatctcttatggaggcagg

SEQ ID NO: 134064 - DNA, 75 bp, Artificial Sequence
  Synthetic
taaaagggacatgtacaacgcactgtccccatccggatgcggaattgcttgaggccaatctcttatggaggcagg

SEQ ID NO: 134065 - DNA, 75 bp, Artificial Sequence
  Synthetic
taaaagggacatgtacaacgcaccgtccccatccggatgcggaattgcttgaggccaatctcttatggaggcagg

SEQ ID NO: 134066 - DNA, 75 bp, Artificial Sequence
  Synthetic
taaaagggacatgtacaacgcacggtccccatccggatgcggaattgcttgaggccaatctcttatggaggcagg

SEQ ID NO: 134067 - DNA, 75 bp, Artificial Sequence
  Synthetic
cggctatcgccgctgccgcgccagcggcgtcttgcctaccagctttggcaatacagttacctgttacatcaaggc

SEQ ID NO: 134068 - DNA, 75 bp, Artificial Sequence
  Synthetic
ggaaaatgcctacccctacggtaagtaggagtaggcaaagcagcaaatggcgggttcgggcacgcgacacgctgt

SEQ ID NO: 134069 - DNA, 75 bp, Artificial Sequence
  Synthetic
cactatcctccatgcctccccttgggggagagcctggggaccctgacctggagtttgaaccggttggatccgctc

SEQ ID NO: 134070 - DNA, 75 bp, Artificial Sequence
  Synthetic
ggaacagctctgcgagccttcacggaggctatgaccagatactctgctcctcctggggacgtcccacaacccacc

SEQ ID NO: 134071 - DNA, 75 bp, Artificial Sequence
  Synthetic
ccagttaaagaggtatagaccgcatattctggcctttcctccttgggcaatgagtttggcgcgtactgctcgtgc

SEQ ID NO: 134072 - DNA, 75 bp, Artificial Sequence
  Synthetic
ggcacggcatataccggtatgtctcgcccggggaaaggccgtctggcattttcgactccgtggttctctgtgagt

SEQ ID NO: 134073 - DNA, 75 bp, Artificial Sequence
  Synthetic
agagatccccttctatggcaaagccatccccatcgagaccatcaagggggggaggcatctcattttctgccattc

SEQ ID NO: 134074 - DNA, 75 bp, Artificial Sequence
  Synthetic
cgacggagtgggtaaaaggtactattaccttacccgagacccggaaactcccttagcccgcgcggcttgggagac

SEQ ID NO: 134075 - DNA, 75 bp, Artificial Sequence
  Synthetic
ctcaaaccatggagtctttcaatgatagctggtaagtccagtggagtgactgagtaggtagccccgtacatttca

SEQ ID NO: 134076 - DNA, 75 bp, Artificial Sequence
  Synthetic
tatttcccaaccaggagttaactggagtgtggcgagcagtctcccaagccgcacgggctaagggagtctctgggt

SEQ ID NO: 134077 - DNA, 75 bp, Artificial Sequence
  Synthetic
aacagagtggcgggggctctcaggaagcttgggatcccccccctacgagcgtggagacatcgggcacgagcagtg

SEQ ID NO: 134078 - DNA, 75 bp, Artificial Sequence
  Synthetic
gggtacggtgcaggcatttcaggggccctcgtagcttttaagatcatgagcggcgagaagccctcggtagaagat

SEQ ID NO: 134079 - DNA, 75 bp, Artificial Sequence
  Synthetic
agcttgggatcccccccctacgagcgtggagacatcgggcacgagcagtgcgcgccaaactcatcgcccaagggg

SEQ ID NO: 134080 - DNA, 75 bp, Artificial Sequence
  Synthetic
ggcgtctccagggggagcagaatatctggtcatggcctccgtgaaggctcgcagggctgttctgtcttcctcgac

SEQ ID NO: 134081 - DNA, 75 bp, Artificial Sequence
  Synthetic
ctacctaaccagagaccctaccactccaatcacccgagctgcttgggaaacagtaagacactcccctgtcaattc

SEQ ID NO: 134082 - DNA, 75 bp, Artificial Sequence
  Synthetic
cgcctttgcctccagaggaaaccatgttgcccctacccactacgtgacggagtctgacgcctcgcagcgcgtgat

SEQ ID NO: 134083 - DNA, 75 bp, Artificial Sequence
  Synthetic
gtgcccgaacccgccatttactcctttgcctactcctactcaccgtaggggtaggcattttcctcctacctgctc

SEQ ID NO: 134084 - DNA, 75 bp, Artificial Sequence
  Synthetic
caggttattgtgttgccaaagctggtaggcaagacgccgctagcgcggcagcggcgataaccgcattggagtcct

SEQ ID NO: 134085 - DNA, 75 bp, Artificial Sequence
  Synthetic
ttgcctactcctactcaccgtaggggtaggcattttcctcctacctgctcgataagctggtaggttaacactcca

SEQ ID NO: 134086 - DNA, 75 bp, Artificial Sequence
  Synthetic
cctccgtcctgatgtcatgttcggtgacagtagagtcaaagcaacgagtgtcgtatgaaaaccctaagggggtct

SEQ ID NO: 134087 - DNA, 75 bp, Artificial Sequence
  Synthetic
ggttgcgccttttctatcttcttactggccctactctcctgcatcaccgtgccggcctctgccgtgcaagttgcg

SEQ ID NO: 134088 - DNA, 75 bp, Artificial Sequence
  Synthetic
cacgtcatatagggcgcgtttctcacagacccgcacccccagatcaggatagacgatgagacgggcaggtttgcg

SEQ ID NO: 134089 - DNA, 75 bp, Artificial Sequence
  Synthetic
gtgagagtcctggaggacgggataaactatgcgacagggaaccttcccggttgctctttctctatctttttgcta

SEQ ID NO: 134090 - DNA, 75 bp, Artificial Sequence
  Synthetic
actatgcgacagggaaccttcccggttgctctttctctatctttttgctagctcttttgtcctgcctcaccgtgc

SEQ ID NO: 134091 - DNA, 75 bp, Artificial Sequence
  Synthetic
gtgagcgtaaggacaacgccacccgctgctggataccagtcacctctaacatcgctgtgagccaacctggtgcac

SEQ ID NO: 134092 - DNA, 75 bp, Artificial Sequence
  Synthetic
cggatctggttcatggctttgctggacaaggaacgaacatcctttgcactatacccgtacttcgaccggccggag

SEQ ID NO: 134093 - DNA, 75 bp, Artificial Sequence
  Synthetic
cctggcagcttaaggacgcggtgcttcatgttcctggatgcgtcccctgtgaacgggtggaaagcaacaacaaat

SEQ ID NO: 134094 - DNA, 75 bp, Artificial Sequence
  Synthetic
caggaggatgtggctgccctgcgagcatttacagatgctatgaccaggtattctgccccccctggggatgaacca

SEQ ID NO: 134095 - DNA, 75 bp, Artificial Sequence
  Synthetic
cgcccaggctttcatcatctcgccggaacaccaccttttcgtccaagactgcaactgctccatatacccaggtca

SEQ ID NO: 134096 - DNA, 75 bp, Artificial Sequence
  Synthetic
catcgagcacttgcagtctgtcgaaggtaaccttcttctgacgtgcggcggcgcttcgagatgacgtagagtaga

SEQ ID NO: 134097 - DNA, 75 bp, Artificial Sequence
  Synthetic
caacgtggccgtgcgccagcctggcgccctaaccgctggtttgcgattgcacatcgacaccatcgtggcgtctgc

SEQ ID NO: 134098 - DNA, 75 bp, Artificial Sequence
  Synthetic
gaacaccaccttttcgtccaagactgcaactgctccatatacccaggtcatatctcggggcaccggatggcgtgg

SEQ ID NO: 134099 - DNA, 75 bp, Artificial Sequence
  Synthetic
cgccctgtgatggcacatggcttagggccatttgggattgggtctgcacggcactaacagacttcaaagcctggc

SEQ ID NO: 134100 - DNA, 75 bp, Artificial Sequence
  Synthetic
gactgcaattgttccatctacccgggccatataagtggacaccgtatggcatgggacatgatgatgaactggtcg

SEQ ID NO: 134101 - DNA, 75 bp, Artificial Sequence
  Synthetic
tgacatagaacagcaaaccacgctctgctcttcggagtcactgacggtggaccaagagtcagcatccaggtccgg

SEQ ID NO: 134102 - DNA, 75 bp, Artificial Sequence
  Synthetic
ttacacccacaggttcaacagctctggctgccccgagcgcttgtcatcctgccgcacgctggacgatttccgcat

SEQ ID NO: 134103 - DNA, 75 bp, Artificial Sequence
  Synthetic
catcaccggccatcgcatggcatgggacatgatgctgaactggtctccaactcttgccatgatcctcgcctacgc

SEQ ID NO: 134104 - DNA, 75 bp, Artificial Sequence
  Synthetic
atttctccatgcaaggggcgtgggcaaaggtcgtcgtcatccttctgctgttcgctggggtggacgcaaacacgc

SEQ ID NO: 134105 - DNA, 75 bp, Artificial Sequence
  Synthetic
gctcatctacaccaacgggagctggcacatcaaccgcacagctctgaattgcaatgacagcttgaatactggctt

SEQ ID NO: 134106 - DNA, 75 bp, Artificial Sequence
  Synthetic
gtacctactcctgaggaggatgtgcctgtcccttccggtttcgtcgacgggaaagatctctctgccagggcaagg

SEQ ID NO: 134107 - DNA, 75 bp, Artificial Sequence
  Synthetic
ctccatgcaaggagcgtgggccaaagtcattgccatcctccttcttgttgcgggagtggatgcaaccacctattc

SEQ ID NO: 134108 - DNA, 75 bp, Artificial Sequence
  Synthetic
ctggcacattaaccgcacggccctcaactgcaatgactccctgaacaccggctttcttgcagccttgttctacgt

SEQ ID NO: 134109 - DNA, 75 bp, Artificial Sequence
  Synthetic
agttcttcacggagctggacggcgtgaggattcaccgcttcgcgccaccctgcaaccctctcctaagggatgagg

SEQ ID NO: 134110 - DNA, 75 bp, Artificial Sequence
  Synthetic
gctataattgtcagcctaaccggccgggacaaaaatgaagccgagggtgaggtgcaggtcctatccacggcaaca

SEQ ID NO: 134111 - DNA, 75 bp, Artificial Sequence
  Synthetic
ccggtggggtcgcaattaccttgcgagcctgaaccggacgtggctgtgctgacgtccatgctcactgatccctcc

SEQ ID NO: 134112 - DNA, 75 bp, Artificial Sequence
  Synthetic
tttaatcaacaccaatggcagctggcacataaaccggactgccctcaattgcaatgacagcttacagacgggttt

SEQ ID NO: 134113 - DNA, 75 bp, Artificial Sequence
  Synthetic
gaactacagtatgaggagaatgtcaccaacagcgaggacatgaggccctactgttggcactacccgcccaaaccg

SEQ ID NO: 134114 - DNA, 75 bp, Artificial Sequence
  Synthetic
ctgcgggcggctcgtaggttgggtccttccatgaagggagcaaaggagggttgtagtccggtctggcccagatag

SEQ ID NO: 134115 - DNA, 75 bp, Artificial Sequence
  Synthetic
gtcaccaatgtggaggacatgaggccttactgctggcattatccacctaagccgtgtggtgtggtccctgcacgg

SEQ ID NO: 134116 - DNA, 75 bp, Artificial Sequence
  Synthetic
acacctggggggagaatgagacggatttcttgctgttaaatagcacccgcccaccgagaggcgcctggttcgggt

SEQ ID NO: 134117 - DNA, 75 bp, Artificial Sequence
  Synthetic
acacctggggggagaatgagacggatttcttgctgttaaatagcacccgcccaccgagtggcgcctggttcgggt

SEQ ID NO: 134118 - DNA, 75 bp, Artificial Sequence
  Synthetic
acacctggggggagaatgagacggatttcttgctgttaaatagcacccgcccaccgagcggcgcctggttcgggt

SEQ ID NO: 134119 - DNA, 75 bp, Artificial Sequence
  Synthetic
acacctggggggagaatgagacggatttcttgctgttaaatagcacccgcccaccgaggggcgcctggttcgggt

SEQ ID NO: 134120 - DNA, 75 bp, Artificial Sequence
  Synthetic
acacctggggggagaatgagacggatttcttgctgttaaatagcacccgcccaccgtgaggcgcctggttcgggt

SEQ ID NO: 134121 - DNA, 75 bp, Artificial Sequence
  Synthetic
acacctggggggagaatgagacggatttcttgctgttaaatagcacccgcccaccgtgtggcgcctggttcgggt

SEQ ID NO: 134122 - DNA, 75 bp, Artificial Sequence
  Synthetic
acacctggggggagaatgagacggatttcttgctgttaaatagcacccgcccaccgtgcggcgcctggttcgggt

SEQ ID NO: 134123 - DNA, 75 bp, Artificial Sequence
  Synthetic
acacctggggggagaatgagacggatttcttgctgttaaatagcacccgcccaccgtggggcgcctggttcgggt

SEQ ID NO: 134124 - DNA, 75 bp, Artificial Sequence
  Synthetic
acacctggggggagaatgagacggatttcttgctgttaaatagcacccgcccaccgcgaggcgcctggttcgggt

SEQ ID NO: 134125 - DNA, 75 bp, Artificial Sequence
  Synthetic
acacctggggggagaatgagacggatttcttgctgttaaatagcacccgcccaccgcgtggcgcctggttcgggt

SEQ ID NO: 134126 - DNA, 75 bp, Artificial Sequence
  Synthetic
acacctggggggagaatgagacggatttcttgctgttaaatagcacccgcccaccgcgcggcgcctggttcgggt

SEQ ID NO: 134127 - DNA, 75 bp, Artificial Sequence
  Synthetic
acacctggggggagaatgagacggatttcttgctgttaaatagcacccgcccaccgcggggcgcctggttcgggt

SEQ ID NO: 134128 - DNA, 75 bp, Artificial Sequence
  Synthetic
acacctggggggagaatgagacggatttcttgctgttaaatagcacccgcccaccgggaggcgcctggttcgggt

SEQ ID NO: 134129 - DNA, 75 bp, Artificial Sequence
  Synthetic
acacctggggggagaatgagacggatttcttgctgttaaatagcacccgcccaccgggtggcgcctggttcgggt

SEQ ID NO: 134130 - DNA, 75 bp, Artificial Sequence
  Synthetic
acacctggggggagaatgagacggatttcttgctgttaaatagcacccgcccaccgggcggcgcctggttcgggt

SEQ ID NO: 134131 - DNA, 75 bp, Artificial Sequence
  Synthetic
acacctggggggagaatgagacggatttcttgctgttaaatagcacccgcccaccggggggcgcctggttcgggt

SEQ ID NO: 134132 - DNA, 75 bp, Artificial Sequence
  Synthetic
acacctggggggagaatgagacggatttcttgctgtttaatagcacccgcccaccgagaggcgcctggttcgggt

SEQ ID NO: 134133 - DNA, 75 bp, Artificial Sequence
  Synthetic
acacctggggggagaatgagacggatttcttgctgtttaatagcacccgcccaccgagtggcgcctggttcgggt

SEQ ID NO: 134134 - DNA, 75 bp, Artificial Sequence
  Synthetic
acacctggggggagaatgagacggatttcttgctgtttaatagcacccgcccaccgagcggcgcctggttcgggt

SEQ ID NO: 134135 - DNA, 75 bp, Artificial Sequence
  Synthetic
acacctggggggagaatgagacggatttcttgctgtttaatagcacccgcccaccgaggggcgcctggttcgggt

SEQ ID NO: 134136 - DNA, 75 bp, Artificial Sequence
  Synthetic
acacctggggggagaatgagacggatttcttgctgtttaatagcacccgcccaccgtgaggcgcctggttcgggt

SEQ ID NO: 134137 - DNA, 75 bp, Artificial Sequence
  Synthetic
acacctggggggagaatgagacggatttcttgctgtttaatagcacccgcccaccgtgtggcgcctggttcgggt

SEQ ID NO: 134138 - DNA, 75 bp, Artificial Sequence
  Synthetic
acacctggggggagaatgagacggatttcttgctgtttaatagcacccgcccaccgtgcggcgcctggttcgggt

SEQ ID NO: 134139 - DNA, 75 bp, Artificial Sequence
  Synthetic
acacctggggggagaatgagacggatttcttgctgtttaatagcacccgcccaccgtggggcgcctggttcgggt

SEQ ID NO: 134140 - DNA, 75 bp, Artificial Sequence
  Synthetic
acacctggggggagaatgagacggatttcttgctgtttaatagcacccgcccaccgcgaggcgcctggttcgggt

SEQ ID NO: 134141 - DNA, 75 bp, Artificial Sequence
  Synthetic
acacctggggggagaatgagacggatttcttgctgtttaatagcacccgcccaccgcgtggcgcctggttcgggt

SEQ ID NO: 134142 - DNA, 75 bp, Artificial Sequence
  Synthetic
acacctggggggagaatgagacggatttcttgctgtttaatagcacccgcccaccgcgcggcgcctggttcgggt

SEQ ID NO: 134143 - DNA, 75 bp, Artificial Sequence
  Synthetic
acacctggggggagaatgagacggatttcttgctgtttaatagcacccgcccaccgcggggcgcctggttcgggt

SEQ ID NO: 134144 - DNA, 75 bp, Artificial Sequence
  Synthetic
acacctggggggagaatgagacggatttcttgctgtttaatagcacccgcccaccgggaggcgcctggttcgggt

SEQ ID NO: 134145 - DNA, 75 bp, Artificial Sequence
  Synthetic
acacctggggggagaatgagacggatttcttgctgtttaatagcacccgcccaccgggtggcgcctggttcgggt

SEQ ID NO: 134146 - DNA, 75 bp, Artificial Sequence
  Synthetic
acacctggggggagaatgagacggatttcttgctgtttaatagcacccgcccaccgggcggcgcctggttcgggt

SEQ ID NO: 134147 - DNA, 75 bp, Artificial Sequence
  Synthetic
acacctggggggagaatgagacggatttcttgctgtttaatagcacccgcccaccggggggcgcctggttcgggt

SEQ ID NO: 134148 - DNA, 75 bp, Artificial Sequence
  Synthetic
acacctggggggagaatgagacggatttcttgctgttcaatagcacccgcccaccgagaggcgcctggttcgggt

SEQ ID NO: 134149 - DNA, 75 bp, Artificial Sequence
  Synthetic
acacctggggggagaatgagacggatttcttgctgttcaatagcacccgcccaccgagtggcgcctggttcgggt

SEQ ID NO: 134150 - DNA, 75 bp, Artificial Sequence
  Synthetic
acacctggggggagaatgagacggatttcttgctgttcaatagcacccgcccaccgagcggcgcctggttcgggt

SEQ ID NO: 134151 - DNA, 75 bp, Artificial Sequence
  Synthetic
acacctggggggagaatgagacggatttcttgctgttcaatagcacccgcccaccgaggggcgcctggttcgggt

SEQ ID NO: 134152 - DNA, 75 bp, Artificial Sequence
  Synthetic
acacctggggggagaatgagacggatttcttgctgttcaatagcacccgcccaccgtgaggcgcctggttcgggt

SEQ ID NO: 134153 - DNA, 75 bp, Artificial Sequence
  Synthetic
acacctggggggagaatgagacggatttcttgctgttcaatagcacccgcccaccgtgtggcgcctggttcgggt

SEQ ID NO: 134154 - DNA, 75 bp, Artificial Sequence
  Synthetic
acacctggggggagaatgagacggatttcttgctgttcaatagcacccgcccaccgtgcggcgcctggttcgggt

SEQ ID NO: 134155 - DNA, 75 bp, Artificial Sequence
  Synthetic
acacctggggggagaatgagacggatttcttgctgttcaatagcacccgcccaccgtggggcgcctggttcgggt

SEQ ID NO: 134156 - DNA, 75 bp, Artificial Sequence
  Synthetic
acacctggggggagaatgagacggatttcttgctgttcaatagcacccgcccaccgcgaggcgcctggttcgggt

SEQ ID NO: 134157 - DNA, 75 bp, Artificial Sequence
  Synthetic
acacctggggggagaatgagacggatttcttgctgttcaatagcacccgcccaccgcgtggcgcctggttcgggt

SEQ ID NO: 134158 - DNA, 75 bp, Artificial Sequence
  Synthetic
acacctggggggagaatgagacggatttcttgctgttcaatagcacccgcccaccgcgcggcgcctggttcgggt

SEQ ID NO: 134159 - DNA, 75 bp, Artificial Sequence
  Synthetic
acacctggggggagaatgagacggatttcttgctgttcaatagcacccgcccaccgcggggcgcctggttcgggt

SEQ ID NO: 134160 - DNA, 75 bp, Artificial Sequence
  Synthetic
acacctggggggagaatgagacggatttcttgctgttcaatagcacccgcccaccgggaggcgcctggttcgggt

SEQ ID NO: 134161 - DNA, 75 bp, Artificial Sequence
  Synthetic
acacctggggggagaatgagacggatttcttgctgttcaatagcacccgcccaccgggtggcgcctggttcgggt

SEQ ID NO: 134162 - DNA, 75 bp, Artificial Sequence
  Synthetic
acacctggggggagaatgagacggatttcttgctgttcaatagcacccgcccaccgggcggcgcctggttcgggt

SEQ ID NO: 134163 - DNA, 75 bp, Artificial Sequence
  Synthetic
acacctggggggagaatgagacggatttcttgctgttcaatagcacccgcccaccggggggcgcctggttcgggt

SEQ ID NO: 134164 - DNA, 75 bp, Artificial Sequence
  Synthetic
acacctggggggagaatgagacggatttcttgctgttgaatagcacccgcccaccgagaggcgcctggttcgggt

SEQ ID NO: 134165 - DNA, 75 bp, Artificial Sequence
  Synthetic
acacctggggggagaatgagacggatttcttgctgttgaatagcacccgcccaccgagtggcgcctggttcgggt

SEQ ID NO: 134166 - DNA, 75 bp, Artificial Sequence
  Synthetic
acacctggggggagaatgagacggatttcttgctgttgaatagcacccgcccaccgagcggcgcctggttcgggt

SEQ ID NO: 134167 - DNA, 75 bp, Artificial Sequence
  Synthetic
acacctggggggagaatgagacggatttcttgctgttgaatagcacccgcccaccgaggggcgcctggttcgggt

SEQ ID NO: 134168 - DNA, 75 bp, Artificial Sequence
  Synthetic
acacctggggggagaatgagacggatttcttgctgttgaatagcacccgcccaccgtgaggcgcctggttcgggt

SEQ ID NO: 134169 - DNA, 75 bp, Artificial Sequence
  Synthetic
acacctggggggagaatgagacggatttcttgctgttgaatagcacccgcccaccgtgtggcgcctggttcgggt

SEQ ID NO: 134170 - DNA, 75 bp, Artificial Sequence
  Synthetic
acacctggggggagaatgagacggatttcttgctgttgaatagcacccgcccaccgtgcggcgcctggttcgggt

SEQ ID NO: 134171 - DNA, 75 bp, Artificial Sequence
  Synthetic
acacctggggggagaatgagacggatttcttgctgttgaatagcacccgcccaccgtggggcgcctggttcgggt

SEQ ID NO: 134172 - DNA, 75 bp, Artificial Sequence
  Synthetic
acacctggggggagaatgagacggatttcttgctgttgaatagcacccgcccaccgcgaggcgcctggttcgggt

SEQ ID NO: 134173 - DNA, 75 bp, Artificial Sequence
  Synthetic
acacctggggggagaatgagacggatttcttgctgttgaatagcacccgcccaccgcgtggcgcctggttcgggt

SEQ ID NO: 134174 - DNA, 75 bp, Artificial Sequence
  Synthetic
acacctggggggagaatgagacggatttcttgctgttgaatagcacccgcccaccgcgcggcgcctggttcgggt

SEQ ID NO: 134175 - DNA, 75 bp, Artificial Sequence
  Synthetic
acacctggggggagaatgagacggatttcttgctgttgaatagcacccgcccaccgcggggcgcctggttcgggt

SEQ ID NO: 134176 - DNA, 75 bp, Artificial Sequence
  Synthetic
acacctggggggagaatgagacggatttcttgctgttgaatagcacccgcccaccgggaggcgcctggttcgggt

SEQ ID NO: 134177 - DNA, 75 bp, Artificial Sequence
  Synthetic
acacctggggggagaatgagacggatttcttgctgttgaatagcacccgcccaccgggtggcgcctggttcgggt

SEQ ID NO: 134178 - DNA, 75 bp, Artificial Sequence
  Synthetic
acacctggggggagaatgagacggatttcttgctgttgaatagcacccgcccaccgggcggcgcctggttcgggt

SEQ ID NO: 134179 - DNA, 75 bp, Artificial Sequence
  Synthetic
acacctggggggagaatgagacggatttcttgctgttgaatagcacccgcccaccggggggcgcctggttcgggt

SEQ ID NO: 134180 - DNA, 75 bp, Artificial Sequence
  Synthetic
gatcaccaccttcgtctcggactctacccgagtgatattgctacccatctcttgcctccatagaaggttagcgtc

SEQ ID NO: 134181 - DNA, 75 bp, Artificial Sequence
  Synthetic
tcagtaggggtaggcatcttcctgcttccagcccgataggctggaagctaaacactccataccattaggtcattt

SEQ ID NO: 134182 - DNA, 75 bp, Artificial Sequence
  Synthetic
tgtgagccagaacctgatgtgactgtcttaacatcaatgctgtcagatcccgcccacatcacggctgagacggcc

SEQ ID NO: 134183 - DNA, 75 bp, Artificial Sequence
  Synthetic
gccgtgtggtgtggtccctgcacggtccgtgtgtggtccagtctactgcttcaccccctccccggtggtagtggg

SEQ ID NO: 134184 - DNA, 75 bp, Artificial Sequence
  Synthetic
gaaccgcgcgcaaggcgccgggccgctgtggcggcggtgatgtgagcaggatctcgcaacatcgaggttaacact

SEQ ID NO: 134185 - DNA, 75 bp, Artificial Sequence
  Synthetic
caagcactgagctgctgtgtcccactgactgtttcagaaaacaccctgacgcgacctacagaaagtgcggggccg

SEQ ID NO: 134186 - DNA, 75 bp, Artificial Sequence
  Synthetic
caagcactgagctgctgtgtcccactgactgtttcagaaaacaccctgacgcgacctacagtaagtgcggggccg

SEQ ID NO: 134187 - DNA, 75 bp, Artificial Sequence
  Synthetic
caagcactgagctgctgtgtcccactgactgtttcagaaaacaccctgacgcgacctacagcaagtgcggggccg

SEQ ID NO: 134188 - DNA, 75 bp, Artificial Sequence
  Synthetic
caagcactgagctgctgtgtcccactgactgtttcagaaaacaccctgacgcgacctacaggaagtgcggggccg

SEQ ID NO: 134189 - DNA, 75 bp, Artificial Sequence
  Synthetic
caagctctgagctgctgtgtcccactgactgtttcagaaaacaccctgacgcgacctacagaaagtgcggggccg

SEQ ID NO: 134190 - DNA, 75 bp, Artificial Sequence
  Synthetic
caagctctgagctgctgtgtcccactgactgtttcagaaaacaccctgacgcgacctacagtaagtgcggggccg

SEQ ID NO: 134191 - DNA, 75 bp, Artificial Sequence
  Synthetic
caagctctgagctgctgtgtcccactgactgtttcagaaaacaccctgacgcgacctacagcaagtgcggggccg

SEQ ID NO: 134192 - DNA, 75 bp, Artificial Sequence
  Synthetic
caagctctgagctgctgtgtcccactgactgtttcagaaaacaccctgacgcgacctacaggaagtgcggggccg

SEQ ID NO: 134193 - DNA, 75 bp, Artificial Sequence
  Synthetic
caagccctgagctgctgtgtcccactgactgtttcagaaaacaccctgacgcgacctacagaaagtgcggggccg

SEQ ID NO: 134194 - DNA, 75 bp, Artificial Sequence
  Synthetic
caagccctgagctgctgtgtcccactgactgtttcagaaaacaccctgacgcgacctacagtaagtgcggggccg

SEQ ID NO: 134195 - DNA, 75 bp, Artificial Sequence
  Synthetic
caagccctgagctgctgtgtcccactgactgtttcagaaaacaccctgacgcgacctacagcaagtgcggggccg

SEQ ID NO: 134196 - DNA, 75 bp, Artificial Sequence
  Synthetic
caagccctgagctgctgtgtcccactgactgtttcagaaaacaccctgacgcgacctacaggaagtgcggggccg

SEQ ID NO: 134197 - DNA, 75 bp, Artificial Sequence
  Synthetic
caagcgctgagctgctgtgtcccactgactgtttcagaaaacaccctgacgcgacctacagaaagtgcggggccg

SEQ ID NO: 134198 - DNA, 75 bp, Artificial Sequence
  Synthetic
caagcgctgagctgctgtgtcccactgactgtttcagaaaacaccctgacgcgacctacagtaagtgcggggccg

SEQ ID NO: 134199 - DNA, 75 bp, Artificial Sequence
  Synthetic
caagcgctgagctgctgtgtcccactgactgtttcagaaaacaccctgacgcgacctacagcaagtgcggggccg

SEQ ID NO: 134200 - DNA, 75 bp, Artificial Sequence
  Synthetic
caagcgctgagctgctgtgtcccactgactgtttcagaaaacaccctgacgcgacctacaggaagtgcggggccg

SEQ ID NO: 134201 - DNA, 75 bp, Artificial Sequence
  Synthetic
ctagcactgagctgctgtgtcccactgactgtttcagaaaacaccctgacgcgacctacagaaagtgcggggccg

SEQ ID NO: 134202 - DNA, 75 bp, Artificial Sequence
  Synthetic
ctagcactgagctgctgtgtcccactgactgtttcagaaaacaccctgacgcgacctacagtaagtgcggggccg

SEQ ID NO: 134203 - DNA, 75 bp, Artificial Sequence
  Synthetic
ctagcactgagctgctgtgtcccactgactgtttcagaaaacaccctgacgcgacctacagcaagtgcggggccg

SEQ ID NO: 134204 - DNA, 75 bp, Artificial Sequence
  Synthetic
ctagcactgagctgctgtgtcccactgactgtttcagaaaacaccctgacgcgacctacaggaagtgcggggccg

SEQ ID NO: 134205 - DNA, 75 bp, Artificial Sequence
  Synthetic
ctagctctgagctgctgtgtcccactgactgtttcagaaaacaccctgacgcgacctacagaaagtgcggggccg

SEQ ID NO: 134206 - DNA, 75 bp, Artificial Sequence
  Synthetic
ctagctctgagctgctgtgtcccactgactgtttcagaaaacaccctgacgcgacctacagtaagtgcggggccg

SEQ ID NO: 134207 - DNA, 75 bp, Artificial Sequence
  Synthetic
ctagctctgagctgctgtgtcccactgactgtttcagaaaacaccctgacgcgacctacagcaagtgcggggccg

SEQ ID NO: 134208 - DNA, 75 bp, Artificial Sequence
  Synthetic
ctagctctgagctgctgtgtcccactgactgtttcagaaaacaccctgacgcgacctacaggaagtgcggggccg

SEQ ID NO: 134209 - DNA, 75 bp, Artificial Sequence
  Synthetic
ctagccctgagctgctgtgtcccactgactgtttcagaaaacaccctgacgcgacctacagaaagtgcggggccg

SEQ ID NO: 134210 - DNA, 75 bp, Artificial Sequence
  Synthetic
ctagccctgagctgctgtgtcccactgactgtttcagaaaacaccctgacgcgacctacagtaagtgcggggccg

SEQ ID NO: 134211 - DNA, 75 bp, Artificial Sequence
  Synthetic
ctagccctgagctgctgtgtcccactgactgtttcagaaaacaccctgacgcgacctacagcaagtgcggggccg

SEQ ID NO: 134212 - DNA, 75 bp, Artificial Sequence
  Synthetic
ctagccctgagctgctgtgtcccactgactgtttcagaaaacaccctgacgcgacctacaggaagtgcggggccg

SEQ ID NO: 134213 - DNA, 75 bp, Artificial Sequence
  Synthetic
ctagcgctgagctgctgtgtcccactgactgtttcagaaaacaccctgacgcgacctacagaaagtgcggggccg

SEQ ID NO: 134214 - DNA, 75 bp, Artificial Sequence
  Synthetic
ctagcgctgagctgctgtgtcccactgactgtttcagaaaacaccctgacgcgacctacagtaagtgcggggccg

SEQ ID NO: 134215 - DNA, 75 bp, Artificial Sequence
  Synthetic
ctagcgctgagctgctgtgtcccactgactgtttcagaaaacaccctgacgcgacctacagcaagtgcggggccg

SEQ ID NO: 134216 - DNA, 75 bp, Artificial Sequence
  Synthetic
ctagcgctgagctgctgtgtcccactgactgtttcagaaaacaccctgacgcgacctacaggaagtgcggggccg

SEQ ID NO: 134217 - DNA, 75 bp, Artificial Sequence
  Synthetic
ccagcactgagctgctgtgtcccactgactgtttcagaaaacaccctgacgcgacctacagaaagtgcggggccg

SEQ ID NO: 134218 - DNA, 75 bp, Artificial Sequence
  Synthetic
ccagcactgagctgctgtgtcccactgactgtttcagaaaacaccctgacgcgacctacagtaagtgcggggccg

SEQ ID NO: 134219 - DNA, 75 bp, Artificial Sequence
  Synthetic
ccagcactgagctgctgtgtcccactgactgtttcagaaaacaccctgacgcgacctacagcaagtgcggggccg

SEQ ID NO: 134220 - DNA, 75 bp, Artificial Sequence
  Synthetic
ccagcactgagctgctgtgtcccactgactgtttcagaaaacaccctgacgcgacctacaggaagtgcggggccg

SEQ ID NO: 134221 - DNA, 75 bp, Artificial Sequence
  Synthetic
ccagctctgagctgctgtgtcccactgactgtttcagaaaacaccctgacgcgacctacagaaagtgcggggccg

SEQ ID NO: 134222 - DNA, 75 bp, Artificial Sequence
  Synthetic
ccagctctgagctgctgtgtcccactgactgtttcagaaaacaccctgacgcgacctacagtaagtgcggggccg

SEQ ID NO: 134223 - DNA, 75 bp, Artificial Sequence
  Synthetic
ccagctctgagctgctgtgtcccactgactgtttcagaaaacaccctgacgcgacctacagcaagtgcggggccg

SEQ ID NO: 134224 - DNA, 75 bp, Artificial Sequence
  Synthetic
ccagctctgagctgctgtgtcccactgactgtttcagaaaacaccctgacgcgacctacaggaagtgcggggccg

SEQ ID NO: 134225 - DNA, 75 bp, Artificial Sequence
  Synthetic
ccagccctgagctgctgtgtcccactgactgtttcagaaaacaccctgacgcgacctacagaaagtgcggggccg

SEQ ID NO: 134226 - DNA, 75 bp, Artificial Sequence
  Synthetic
ccagccctgagctgctgtgtcccactgactgtttcagaaaacaccctgacgcgacctacagtaagtgcggggccg

SEQ ID NO: 134227 - DNA, 75 bp, Artificial Sequence
  Synthetic
ccagccctgagctgctgtgtcccactgactgtttcagaaaacaccctgacgcgacctacagcaagtgcggggccg

SEQ ID NO: 134228 - DNA, 75 bp, Artificial Sequence
  Synthetic
ccagccctgagctgctgtgtcccactgactgtttcagaaaacaccctgacgcgacctacaggaagtgcggggccg

SEQ ID NO: 134229 - DNA, 75 bp, Artificial Sequence
  Synthetic
ccagcgctgagctgctgtgtcccactgactgtttcagaaaacaccctgacgcgacctacagaaagtgcggggccg

SEQ ID NO: 134230 - DNA, 75 bp, Artificial Sequence
  Synthetic
ccagcgctgagctgctgtgtcccactgactgtttcagaaaacaccctgacgcgacctacagtaagtgcggggccg

SEQ ID NO: 134231 - DNA, 75 bp, Artificial Sequence
  Synthetic
ccagcgctgagctgctgtgtcccactgactgtttcagaaaacaccctgacgcgacctacagcaagtgcggggccg

SEQ ID NO: 134232 - DNA, 75 bp, Artificial Sequence
  Synthetic
ccagcgctgagctgctgtgtcccactgactgtttcagaaaacaccctgacgcgacctacaggaagtgcggggccg

SEQ ID NO: 134233 - DNA, 75 bp, Artificial Sequence
  Synthetic
cgagcactgagctgctgtgtcccactgactgtttcagaaaacaccctgacgcgacctacagaaagtgcggggccg

SEQ ID NO: 134234 - DNA, 75 bp, Artificial Sequence
  Synthetic
cgagcactgagctgctgtgtcccactgactgtttcagaaaacaccctgacgcgacctacagtaagtgcggggccg

SEQ ID NO: 134235 - DNA, 75 bp, Artificial Sequence
  Synthetic
cgagcactgagctgctgtgtcccactgactgtttcagaaaacaccctgacgcgacctacagcaagtgcggggccg

SEQ ID NO: 134236 - DNA, 75 bp, Artificial Sequence
  Synthetic
cgagcactgagctgctgtgtcccactgactgtttcagaaaacaccctgacgcgacctacaggaagtgcggggccg

SEQ ID NO: 134237 - DNA, 75 bp, Artificial Sequence
  Synthetic
cgagctctgagctgctgtgtcccactgactgtttcagaaaacaccctgacgcgacctacagaaagtgcggggccg

SEQ ID NO: 134238 - DNA, 75 bp, Artificial Sequence
  Synthetic
cgagctctgagctgctgtgtcccactgactgtttcagaaaacaccctgacgcgacctacagtaagtgcggggccg

SEQ ID NO: 134239 - DNA, 75 bp, Artificial Sequence
  Synthetic
cgagctctgagctgctgtgtcccactgactgtttcagaaaacaccctgacgcgacctacagcaagtgcggggccg

SEQ ID NO: 134240 - DNA, 75 bp, Artificial Sequence
  Synthetic
cgagctctgagctgctgtgtcccactgactgtttcagaaaacaccctgacgcgacctacaggaagtgcggggccg

SEQ ID NO: 134241 - DNA, 75 bp, Artificial Sequence
  Synthetic
cgagccctgagctgctgtgtcccactgactgtttcagaaaacaccctgacgcgacctacagaaagtgcggggccg

SEQ ID NO: 134242 - DNA, 75 bp, Artificial Sequence
  Synthetic
cgagccctgagctgctgtgtcccactgactgtttcagaaaacaccctgacgcgacctacagtaagtgcggggccg

SEQ ID NO: 134243 - DNA, 75 bp, Artificial Sequence
  Synthetic
cgagccctgagctgctgtgtcccactgactgtttcagaaaacaccctgacgcgacctacagcaagtgcggggccg

SEQ ID NO: 134244 - DNA, 75 bp, Artificial Sequence
  Synthetic
cgagccctgagctgctgtgtcccactgactgtttcagaaaacaccctgacgcgacctacaggaagtgcggggccg

SEQ ID NO: 134245 - DNA, 75 bp, Artificial Sequence
  Synthetic
cgagcgctgagctgctgtgtcccactgactgtttcagaaaacaccctgacgcgacctacagaaagtgcggggccg

SEQ ID NO: 134246 - DNA, 75 bp, Artificial Sequence
  Synthetic
cgagcgctgagctgctgtgtcccactgactgtttcagaaaacaccctgacgcgacctacagtaagtgcggggccg

SEQ ID NO: 134247 - DNA, 75 bp, Artificial Sequence
  Synthetic
cgagcgctgagctgctgtgtcccactgactgtttcagaaaacaccctgacgcgacctacagcaagtgcggggccg

SEQ ID NO: 134248 - DNA, 75 bp, Artificial Sequence
  Synthetic
cgagcgctgagctgctgtgtcccactgactgtttcagaaaacaccctgacgcgacctacaggaagtgcggggccg

SEQ ID NO: 134249 - DNA, 75 bp, Artificial Sequence
  Synthetic
gaggagcatagcggtggagcctcactccgtctaactcggtgaagaactctggcgctggcacctggcatgggattt

SEQ ID NO: 134250 - DNA, 75 bp, Artificial Sequence
  Synthetic
tcaggctgcccgctaccacctgcgggcctcccgcctgtcccgcctccgcggaggaagaggaagccagtggaatta

SEQ ID NO: 134251 - DNA, 75 bp, Artificial Sequence
  Synthetic
gtggcactacccgtgcaccgtcaactataccatctttaagataaggatgtttgtaggggggatcgagcacaggct

SEQ ID NO: 134252 - DNA, 75 bp, Artificial Sequence
  Synthetic
ctccaccaaaacatagtggacgtgcagtaattgtatggtctgtcaccagcactcacgaagtacgtcgtcaagtgg

SEQ ID NO: 134253 - DNA, 75 bp, Artificial Sequence
  Synthetic
ctccaccaaaacatagtggacgtgcagtaattgtatggtctgtcaccagctctcacgaagtacgtcgtcaagtgg

SEQ ID NO: 134254 - DNA, 75 bp, Artificial Sequence
  Synthetic
ctccaccaaaacatagtggacgtgcagtaattgtatggtctgtcaccagccctcacgaagtacgtcgtcaagtgg

SEQ ID NO: 134255 - DNA, 75 bp, Artificial Sequence
  Synthetic
ctccaccaaaacatagtggacgtgcagtaattgtatggtctgtcaccagcgctcacgaagtacgtcgtcaagtgg

SEQ ID NO: 134256 - DNA, 75 bp, Artificial Sequence
  Synthetic
ctccaccaaaacatagtggacgtgcagtatttgtatggtctgtcaccagcactcacgaagtacgtcgtcaagtgg

SEQ ID NO: 134257 - DNA, 75 bp, Artificial Sequence
  Synthetic
ctccaccaaaacatagtggacgtgcagtatttgtatggtctgtcaccagctctcacgaagtacgtcgtcaagtgg

SEQ ID NO: 134258 - DNA, 75 bp, Artificial Sequence
  Synthetic
ctccaccaaaacatagtggacgtgcagtatttgtatggtctgtcaccagccctcacgaagtacgtcgtcaagtgg

SEQ ID NO: 134259 - DNA, 75 bp, Artificial Sequence
  Synthetic
ctccaccaaaacatagtggacgtgcagtatttgtatggtctgtcaccagcgctcacgaagtacgtcgtcaagtgg

SEQ ID NO: 134260 - DNA, 75 bp, Artificial Sequence
  Synthetic
ctccaccaaaacatagtggacgtgcagtacttgtatggtctgtcaccagcactcacgaagtacgtcgtcaagtgg

SEQ ID NO: 134261 - DNA, 75 bp, Artificial Sequence
  Synthetic
ctccaccaaaacatagtggacgtgcagtacttgtatggtctgtcaccagctctcacgaagtacgtcgtcaagtgg

SEQ ID NO: 134262 - DNA, 75 bp, Artificial Sequence
  Synthetic
ctccaccaaaacatagtggacgtgcagtacttgtatggtctgtcaccagccctcacgaagtacgtcgtcaagtgg

SEQ ID NO: 134263 - DNA, 75 bp, Artificial Sequence
  Synthetic
ctccaccaaaacatagtggacgtgcagtacttgtatggtctgtcaccagcgctcacgaagtacgtcgtcaagtgg

SEQ ID NO: 134264 - DNA, 75 bp, Artificial Sequence
  Synthetic
ctccaccaaaacatagtggacgtgcagtagttgtatggtctgtcaccagcactcacgaagtacgtcgtcaagtgg

SEQ ID NO: 134265 - DNA, 75 bp, Artificial Sequence
  Synthetic
ctccaccaaaacatagtggacgtgcagtagttgtatggtctgtcaccagctctcacgaagtacgtcgtcaagtgg

SEQ ID NO: 134266 - DNA, 75 bp, Artificial Sequence
  Synthetic
ctccaccaaaacatagtggacgtgcagtagttgtatggtctgtcaccagccctcacgaagtacgtcgtcaagtgg

SEQ ID NO: 134267 - DNA, 75 bp, Artificial Sequence
  Synthetic
ctccaccaaaacatagtggacgtgcagtagttgtatggtctgtcaccagcgctcacgaagtacgtcgtcaagtgg

SEQ ID NO: 134268 - DNA, 75 bp, Artificial Sequence
  Synthetic
ctccaccaaaacattgtggacgtgcagtaattgtatggtctgtcaccagcactcacgaagtacgtcgtcaagtgg

SEQ ID NO: 134269 - DNA, 75 bp, Artificial Sequence
  Synthetic
ctccaccaaaacattgtggacgtgcagtaattgtatggtctgtcaccagctctcacgaagtacgtcgtcaagtgg

SEQ ID NO: 134270 - DNA, 75 bp, Artificial Sequence
  Synthetic
ctccaccaaaacattgtggacgtgcagtaattgtatggtctgtcaccagccctcacgaagtacgtcgtcaagtgg

SEQ ID NO: 134271 - DNA, 75 bp, Artificial Sequence
  Synthetic
ctccaccaaaacattgtggacgtgcagtaattgtatggtctgtcaccagcgctcacgaagtacgtcgtcaagtgg

SEQ ID NO: 134272 - DNA, 75 bp, Artificial Sequence
  Synthetic
ctccaccaaaacattgtggacgtgcagtatttgtatggtctgtcaccagcactcacgaagtacgtcgtcaagtgg

SEQ ID NO: 134273 - DNA, 75 bp, Artificial Sequence
  Synthetic
ctccaccaaaacattgtggacgtgcagtatttgtatggtctgtcaccagctctcacgaagtacgtcgtcaagtgg

SEQ ID NO: 134274 - DNA, 75 bp, Artificial Sequence
  Synthetic
ctccaccaaaacattgtggacgtgcagtatttgtatggtctgtcaccagccctcacgaagtacgtcgtcaagtgg

SEQ ID NO: 134275 - DNA, 75 bp, Artificial Sequence
  Synthetic
ctccaccaaaacattgtggacgtgcagtatttgtatggtctgtcaccagcgctcacgaagtacgtcgtcaagtgg

SEQ ID NO: 134276 - DNA, 75 bp, Artificial Sequence
  Synthetic
ctccaccaaaacattgtggacgtgcagtacttgtatggtctgtcaccagcactcacgaagtacgtcgtcaagtgg

SEQ ID NO: 134277 - DNA, 75 bp, Artificial Sequence
  Synthetic
ctccaccaaaacattgtggacgtgcagtacttgtatggtctgtcaccagctctcacgaagtacgtcgtcaagtgg

SEQ ID NO: 134278 - DNA, 75 bp, Artificial Sequence
  Synthetic
ctccaccaaaacattgtggacgtgcagtacttgtatggtctgtcaccagccctcacgaagtacgtcgtcaagtgg

SEQ ID NO: 134279 - DNA, 75 bp, Artificial Sequence
  Synthetic
ctccaccaaaacattgtggacgtgcagtacttgtatggtctgtcaccagcgctcacgaagtacgtcgtcaagtgg

SEQ ID NO: 134280 - DNA, 75 bp, Artificial Sequence
  Synthetic
ctccaccaaaacattgtggacgtgcagtagttgtatggtctgtcaccagcactcacgaagtacgtcgtcaagtgg

SEQ ID NO: 134281 - DNA, 75 bp, Artificial Sequence
  Synthetic
ctccaccaaaacattgtggacgtgcagtagttgtatggtctgtcaccagctctcacgaagtacgtcgtcaagtgg

SEQ ID NO: 134282 - DNA, 75 bp, Artificial Sequence
  Synthetic
ctccaccaaaacattgtggacgtgcagtagttgtatggtctgtcaccagccctcacgaagtacgtcgtcaagtgg

SEQ ID NO: 134283 - DNA, 75 bp, Artificial Sequence
  Synthetic
ctccaccaaaacattgtggacgtgcagtagttgtatggtctgtcaccagcgctcacgaagtacgtcgtcaagtgg

SEQ ID NO: 134284 - DNA, 75 bp, Artificial Sequence
  Synthetic
ctccaccaaaacatcgtggacgtgcagtaattgtatggtctgtcaccagcactcacgaagtacgtcgtcaagtgg

SEQ ID NO: 134285 - DNA, 75 bp, Artificial Sequence
  Synthetic
ctccaccaaaacatcgtggacgtgcagtaattgtatggtctgtcaccagctctcacgaagtacgtcgtcaagtgg

SEQ ID NO: 134286 - DNA, 75 bp, Artificial Sequence
  Synthetic
ctccaccaaaacatcgtggacgtgcagtaattgtatggtctgtcaccagccctcacgaagtacgtcgtcaagtgg

SEQ ID NO: 134287 - DNA, 75 bp, Artificial Sequence
  Synthetic
ctccaccaaaacatcgtggacgtgcagtaattgtatggtctgtcaccagcgctcacgaagtacgtcgtcaagtgg

SEQ ID NO: 134288 - DNA, 75 bp, Artificial Sequence
  Synthetic
ctccaccaaaacatcgtggacgtgcagtatttgtatggtctgtcaccagcactcacgaagtacgtcgtcaagtgg

SEQ ID NO: 134289 - DNA, 75 bp, Artificial Sequence
  Synthetic
ctccaccaaaacatcgtggacgtgcagtatttgtatggtctgtcaccagctctcacgaagtacgtcgtcaagtgg

SEQ ID NO: 134290 - DNA, 75 bp, Artificial Sequence
  Synthetic
ctccaccaaaacatcgtggacgtgcagtatttgtatggtctgtcaccagccctcacgaagtacgtcgtcaagtgg

SEQ ID NO: 134291 - DNA, 75 bp, Artificial Sequence
  Synthetic
ctccaccaaaacatcgtggacgtgcagtatttgtatggtctgtcaccagcgctcacgaagtacgtcgtcaagtgg

SEQ ID NO: 134292 - DNA, 75 bp, Artificial Sequence
  Synthetic
ctccaccaaaacatcgtggacgtgcagtacttgtatggtctgtcaccagcactcacgaagtacgtcgtcaagtgg

SEQ ID NO: 134293 - DNA, 75 bp, Artificial Sequence
  Synthetic
ctccaccaaaacatcgtggacgtgcagtacttgtatggtctgtcaccagctctcacgaagtacgtcgtcaagtgg

SEQ ID NO: 134294 - DNA, 75 bp, Artificial Sequence
  Synthetic
ctccaccaaaacatcgtggacgtgcagtacttgtatggtctgtcaccagccctcacgaagtacgtcgtcaagtgg

SEQ ID NO: 134295 - DNA, 75 bp, Artificial Sequence
  Synthetic
ctccaccaaaacatcgtggacgtgcagtacttgtatggtctgtcaccagcgctcacgaagtacgtcgtcaagtgg

SEQ ID NO: 134296 - DNA, 75 bp, Artificial Sequence
  Synthetic
ctccaccaaaacatcgtggacgtgcagtagttgtatggtctgtcaccagcactcacgaagtacgtcgtcaagtgg

SEQ ID NO: 134297 - DNA, 75 bp, Artificial Sequence
  Synthetic
ctccaccaaaacatcgtggacgtgcagtagttgtatggtctgtcaccagctctcacgaagtacgtcgtcaagtgg

SEQ ID NO: 134298 - DNA, 75 bp, Artificial Sequence
  Synthetic
ctccaccaaaacatcgtggacgtgcagtagttgtatggtctgtcaccagccctcacgaagtacgtcgtcaagtgg

SEQ ID NO: 134299 - DNA, 75 bp, Artificial Sequence
  Synthetic
ctccaccaaaacatcgtggacgtgcagtagttgtatggtctgtcaccagcgctcacgaagtacgtcgtcaagtgg

SEQ ID NO: 134300 - DNA, 75 bp, Artificial Sequence
  Synthetic
ctccaccaaaacatggtggacgtgcagtaattgtatggtctgtcaccagcactcacgaagtacgtcgtcaagtgg

SEQ ID NO: 134301 - DNA, 75 bp, Artificial Sequence
  Synthetic
ctccaccaaaacatggtggacgtgcagtaattgtatggtctgtcaccagctctcacgaagtacgtcgtcaagtgg

SEQ ID NO: 134302 - DNA, 75 bp, Artificial Sequence
  Synthetic
ctccaccaaaacatggtggacgtgcagtaattgtatggtctgtcaccagccctcacgaagtacgtcgtcaagtgg

SEQ ID NO: 134303 - DNA, 75 bp, Artificial Sequence
  Synthetic
ctccaccaaaacatggtggacgtgcagtaattgtatggtctgtcaccagcgctcacgaagtacgtcgtcaagtgg

SEQ ID NO: 134304 - DNA, 75 bp, Artificial Sequence
  Synthetic
ctccaccaaaacatggtggacgtgcagtatttgtatggtctgtcaccagcactcacgaagtacgtcgtcaagtgg

SEQ ID NO: 134305 - DNA, 75 bp, Artificial Sequence
  Synthetic
ctccaccaaaacatggtggacgtgcagtatttgtatggtctgtcaccagctctcacgaagtacgtcgtcaagtgg

SEQ ID NO: 134306 - DNA, 75 bp, Artificial Sequence
  Synthetic
ctccaccaaaacatggtggacgtgcagtatttgtatggtctgtcaccagccctcacgaagtacgtcgtcaagtgg

SEQ ID NO: 134307 - DNA, 75 bp, Artificial Sequence
  Synthetic
ctccaccaaaacatggtggacgtgcagtatttgtatggtctgtcaccagcgctcacgaagtacgtcgtcaagtgg

SEQ ID NO: 134308 - DNA, 75 bp, Artificial Sequence
  Synthetic
ctccaccaaaacatggtggacgtgcagtacttgtatggtctgtcaccagcactcacgaagtacgtcgtcaagtgg

SEQ ID NO: 134309 - DNA, 75 bp, Artificial Sequence
  Synthetic
ctccaccaaaacatggtggacgtgcagtacttgtatggtctgtcaccagctctcacgaagtacgtcgtcaagtgg

SEQ ID NO: 134310 - DNA, 75 bp, Artificial Sequence
  Synthetic
ctccaccaaaacatggtggacgtgcagtacttgtatggtctgtcaccagccctcacgaagtacgtcgtcaagtgg

SEQ ID NO: 134311 - DNA, 75 bp, Artificial Sequence
  Synthetic
ctccaccaaaacatggtggacgtgcagtacttgtatggtctgtcaccagcgctcacgaagtacgtcgtcaagtgg

SEQ ID NO: 134312 - DNA, 75 bp, Artificial Sequence
  Synthetic
ctccaccaaaacatggtggacgtgcagtagttgtatggtctgtcaccagcactcacgaagtacgtcgtcaagtgg

SEQ ID NO: 134313 - DNA, 75 bp, Artificial Sequence
  Synthetic
ctccaccaaaacatggtggacgtgcagtagttgtatggtctgtcaccagctctcacgaagtacgtcgtcaagtgg

SEQ ID NO: 134314 - DNA, 75 bp, Artificial Sequence
  Synthetic
ctccaccaaaacatggtggacgtgcagtagttgtatggtctgtcaccagccctcacgaagtacgtcgtcaagtgg

SEQ ID NO: 134315 - DNA, 75 bp, Artificial Sequence
  Synthetic
ctccaccaaaacatggtggacgtgcagtagttgtatggtctgtcaccagcgctcacgaagtacgtcgtcaagtgg

SEQ ID NO: 134316 - DNA, 75 bp, Artificial Sequence
  Synthetic
attgtgcgcggggacgggtgtactcggcccagtggtgtattcattgatggggaaggtgccatgccacatgttagc

SEQ ID NO: 134317 - DNA, 75 bp, Artificial Sequence
  Synthetic
attttgccctgcactttttcggacctgccagccctctctacgggactcatccacctccaccagaacattgttgac

SEQ ID NO: 134318 - DNA, 75 bp, Artificial Sequence
  Synthetic
gactgatcaccgtccatgcagctagcgcttctagctgcaacggcctccaatacttcatcctatttttcctggcag

SEQ ID NO: 134319 - DNA, 75 bp, Artificial Sequence
  Synthetic
catactcccttgtaccccttttgacatgagagaaagggtatgcctggcaccttgggcatgatcttggccgaaagc

SEQ ID NO: 134320 - DNA, 75 bp, Artificial Sequence
  Synthetic
gcgcatgcttgtggatgctcatcctgctgggccaggccgaggcagcactggaaaagctgatcgtcctgcacgctg

SEQ ID NO: 134321 - DNA, 75 bp, Artificial Sequence
  Synthetic
gatcgtggaccctattatgctggtgtgtggagacgacctggtcgtcatctcagagagccaaggcaacgaggagga

SEQ ID NO: 134322 - DNA, 75 bp, Artificial Sequence
  Synthetic
cgctctggatgcggtggagcagggccacgttggctttgcactgctggcgatgatttgcgttttcacgctcactcc

SEQ ID NO: 134323 - DNA, 75 bp, Artificial Sequence
  Synthetic
gtaaccggcgaagcaatcgggtgacggttagagagctcagcaatgctgttacttttgctgccgcgtcgctctcgg

SEQ ID NO: 134324 - DNA, 75 bp, Artificial Sequence
  Synthetic
ttccatgccccccctcgagggggagcctggggatccggatcttagcgacgggtcgtggtcgacggtcagtagtga

SEQ ID NO: 134325 - DNA, 75 bp, Artificial Sequence
  Synthetic
tcttggccattggcccttcctcctgcttcttttggcgttgcctcaacaggcctacgcccttgacgcggctgaaca

SEQ ID NO: 134326 - DNA, 75 bp, Artificial Sequence
  Synthetic
gatcagcttccaaggtcaaggccaggcaactgtccttagaggaagcttgtgtgttaacaccaccccattccgccc

SEQ ID NO: 134327 - DNA, 75 bp, Artificial Sequence
  Synthetic
ggcagaagaaggtcacctttgacaggcttcaagtcctcgacgaccactacagagaggttgtggacgagatgaagc

SEQ ID NO: 134328 - DNA, 75 bp, Artificial Sequence
  Synthetic
cgcggcggccgcgacggcatcgtgtgggccgcgatcatgttctgcccggatgtggtgtttgacataaccaagtgg

SEQ ID NO: 134329 - DNA, 75 bp, Artificial Sequence
  Synthetic
caacactgcagcacatatcacgccaacaaccaacgctccaggggataagatggcaggcagaagattgaccatgtc

SEQ ID NO: 134330 - DNA, 75 bp, Artificial Sequence
  Synthetic
gtggttatatctgttttcacactcaccccggcatataaaacccttctcagtcggtgcctgtggtggttatgctat

SEQ ID NO: 134331 - DNA, 75 bp, Artificial Sequence
  Synthetic
ggcttatggtccttcctcctcctagtcctggccttaccacagcaggcttatgccttggacgctgctgaacaaggg

SEQ ID NO: 134332 - DNA, 75 bp, Artificial Sequence
  Synthetic
atggtctacgccacaacatcccgcagcgcaagccagcggcagaagaaggtcacctttgacagactgcaagtcctg

SEQ ID NO: 134333 - DNA, 75 bp, Artificial Sequence
  Synthetic
tgaggcatcttgtgggaggtaagtacatccagtggctgctgatcaccctcggcaggtggacgggcacttacatct

SEQ ID NO: 134334 - DNA, 75 bp, Artificial Sequence
  Synthetic
atgcctatgcctcccacagcggcgccagccaagccgcttaccacaaacgcggaagatgctgcaggtcccgctagg

SEQ ID NO: 134335 - DNA, 75 bp, Artificial Sequence
  Synthetic
tcagtgtggtggctgtcctacatgctggtcttggccgaggcccagattcagcaatgggttccccccctggaggtc

SEQ ID NO: 134336 - DNA, 75 bp, Artificial Sequence
  Synthetic
gggtggctgtcattctacacccacgccttgtgtttgaggtcacgaaatggttgttagcaatcctggggcctgcct

SEQ ID NO: 134337 - DNA, 75 bp, Artificial Sequence
  Synthetic
ccttgtgtttgaggtcacgaaatggttgttagcaatcctggggcctgcctacctccttaaagcgtctctgctacg

SEQ ID NO: 134338 - DNA, 75 bp, Artificial Sequence
  Synthetic
agtatgttcagatggcactgctcgccctcggtaggtggttcggcatatacatctacgaccacctcacccccatgt

SEQ ID NO: 134339 - DNA, 75 bp, Artificial Sequence
  Synthetic
catagtctggggggcagagtcggcagcctgtggtgacatcatacatgggcttcccgtctccgctcgattgggccg

SEQ ID NO: 134340 - DNA, 75 bp, Artificial Sequence
  Synthetic
cattgtctggggggcagagtcggcagcctgtggtgacatcatacatgggcttcccgtctccgctcgattgggccg

SEQ ID NO: 134341 - DNA, 75 bp, Artificial Sequence
  Synthetic
catcgtctggggggcagagtcggcagcctgtggtgacatcatacatgggcttcccgtctccgctcgattgggccg

SEQ ID NO: 134342 - DNA, 75 bp, Artificial Sequence
  Synthetic
catggtctggggggcagagtcggcagcctgtggtgacatcatacatgggcttcccgtctccgctcgattgggccg

SEQ ID NO: 134343 - DNA, 75 bp, Artificial Sequence
  Synthetic
gctttgactcgaccgttaccgaacatgacataatgactgaagagtccatttaccaatcatgtgacttgcagcctg

SEQ ID NO: 134344 - DNA, 75 bp, Artificial Sequence
  Synthetic
cagggttgcctggcagtgtggagagaccggccaggtactggatcccgctcacaaagttccacatgtgctgttgcc

SEQ ID NO: 134345 - DNA, 75 bp, Artificial Sequence
  Synthetic
ggacctagcggtcgccgtagagcccatcatcttcagcccgatggagaagaaagtcatcacgtggggggcagagac

SEQ ID NO: 134346 - DNA, 75 bp, Artificial Sequence
  Synthetic
actatagtggtgagtttgacggggcgcgacaaaacggagcaggccggagagatccaggttctgtccacggtcacc

SEQ ID NO: 134347 - DNA, 75 bp, Artificial Sequence
  Synthetic
ttgctgagcgatagcctgtgcttgctcgatgtaaggagcagactgggaacattcttccatctcatcatattgttg

SEQ ID NO: 134348 - DNA, 75 bp, Artificial Sequence
  Synthetic
tgttcagcccaatggagaagaaggtcattgtgtggggggctgagacagtggcgtgtggagacatcctgcatggcc

SEQ ID NO: 134349 - DNA, 75 bp, Artificial Sequence
  Synthetic
agacttctcgctcccatcactgcatacgcccagcagacacgcggtctgctgggcgctatagtagtgagtctgacg

SEQ ID NO: 134350 - DNA, 75 bp, Artificial Sequence
  Synthetic
tgtataccagcgctgagggagatcttgtggggtggcctagtcccccagggactaagtcgctggagctatgcacgt

SEQ ID NO: 134351 - DNA, 75 bp, Artificial Sequence
  Synthetic
gctgctagaacaccaccaaccagcacccaggcgctcgtggtgacttccaagtcagctgacatgcaagccatgatg

SEQ ID NO: 134352 - DNA, 75 bp, Artificial Sequence
  Synthetic
ctcccccgggtgatcccccggttcctgcttatgacctggagctcgtaacatcttgctcctcaaatgtgtccgtcg

SEQ ID NO: 134353 - DNA, 75 bp, Artificial Sequence
  Synthetic
cacccggaatgcagatgtcatcccagcgcggagacgcggggaccggcggggggctttgctctccccaaggcctct

SEQ ID NO: 134354 - DNA, 75 bp, Artificial Sequence
  Synthetic
ccatacaggctttggcactacccttgcactgtcaactttaccatctttaaggttaggatgtatgtgggaggtgtg

SEQ ID NO: 134355 - DNA, 75 bp, Artificial Sequence
  Synthetic
gtgccacttgcgagggctgcgtgggaaactgccaaacactccccggttaactcctggttagggaacatcatcatg

SEQ ID NO: 134356 - DNA, 75 bp, Artificial Sequence
  Synthetic
gacatttccacatctcatcccaacatggtgggctcgcctttgcacgagcgcagacagtggcttgatatgccacca

SEQ ID NO: 134357 - DNA, 75 bp, Artificial Sequence
  Synthetic
caggggtataaagtacttgtactgaatccctctgtcgcggccacacttggttttggggcctacatgtccaaagcc

SEQ ID NO: 134358 - DNA, 75 bp, Artificial Sequence
  Synthetic
cacgggatcaaccccaacatcagaaccggagtacggactgtgaccactggggactctatcacctactctacttat

SEQ ID NO: 134359 - DNA, 75 bp, Artificial Sequence
  Synthetic
tcgtcacccggaacgctgacgtcatcccagctcggagacggggagaccggcgagcggcgttgctctccccgcggc

SEQ ID NO: 134360 - DNA, 75 bp, Artificial Sequence
  Synthetic
ttggcagacaggtagccccggggtggacaggtatgctctcagtcgcactgtggtctcagcaggttgtaggtcata

SEQ ID NO: 134361 - DNA, 75 bp, Artificial Sequence
  Synthetic
aaagtcgattgacttcatcccagtcgagtcgctcgatattgttgctcggtcccccagcttcaccgataatggcac

SEQ ID NO: 134362 - DNA, 75 bp, Artificial Sequence
  Synthetic
aggtacttgtactaaacccctctgtggccgctacgctaggatttggggcttacatggccaaggcatatggaataa

SEQ ID NO: 134363 - DNA, 75 bp, Artificial Sequence
  Synthetic
ctggccgtcttcggacccctttggattcttcaagccagtttgcttaaagtaccctacttcgtgcgcgttcaaggc

SEQ ID NO: 134364 - DNA, 75 bp, Artificial Sequence
  Synthetic
ccccggcccgtacggcccctgcgttgacttcgggacaccgcgtcctggggaaccgtgcgtgtctcaatggagaaa

SEQ ID NO: 134365 - DNA, 75 bp, Artificial Sequence
  Synthetic
tacaaagtactagtactaaacccctcagtggccgccaccttagggtttggggcgtatatgtccaaggcacatgga

SEQ ID NO: 134366 - DNA, 75 bp, Artificial Sequence
  Synthetic
agcctatgacatcatcatatgcgacgaatgtcattccgtggactctactaccatcctcggcatcgggacagtcct

SEQ ID NO: 134367 - DNA, 75 bp, Artificial Sequence
  Synthetic
cacatactaccacgtctccggatacaggtatcacggacacgtcgaggcctctataaaacgctacagcgttgaccc

SEQ ID NO: 134368 - DNA, 75 bp, Artificial Sequence
  Synthetic
cgccctaatgactggatacaccggtgactttgactctgtcatcgactgcaacgttgcagtcactcagattgttga

SEQ ID NO: 134369 - DNA, 75 bp, Artificial Sequence
  Synthetic
cacgtggggggcagacaccgctgcgtgcggtgacatcatcaacggcttgcccgtctccgcccgtaggggccggga

SEQ ID NO: 134370 - DNA, 75 bp, Artificial Sequence
  Synthetic
ctcggtcacgagggcgagatccccttttatgggaaagccattcccctcgccaacatcaagggggggagacacctc

SEQ ID NO: 134371 - DNA, 75 bp, Artificial Sequence
  Synthetic
agcggtcacaacctcgtggcaggcgccagcctatccccaaggcgcgccggtccgagggcaggtcctgggctcagc

SEQ ID NO: 134372 - DNA, 75 bp, Artificial Sequence
  Synthetic
gcggagcctatgacatcataatatgcgatgaatgccattccgtggactcaacaaccatccttggcattgggactg

SEQ ID NO: 134373 - DNA, 75 bp, Artificial Sequence
  Synthetic
gccataaaaggggatttctccgtcactggtgaggcccacctcctcgatattaggatgcggcaccgtgatgctgcc

SEQ ID NO: 134374 - DNA, 75 bp, Artificial Sequence
  Synthetic
cgccccaccccaacattgaggaggtagccctaggccacgagggcgagatccccttctatgggaaggccatccccc

SEQ ID NO: 134375 - DNA, 75 bp, Artificial Sequence
  Synthetic
tgataccggcacaaggagacgtggtggttgttgccaccgacgccctcatgactgggtacactggtgatttcgact

SEQ ID NO: 134376 - DNA, 75 bp, Artificial Sequence
  Synthetic
tgacattcatcgcagatgatcacgtcataggcgcctccagaacaacccccatcggcgaggaacttgccgtatgtg

SEQ ID NO: 134377 - DNA, 75 bp, Artificial Sequence
  Synthetic
tacccaggccgtagacttcagtctggaccccacgtttgaaataaccacacaaactgttccccaggacgccgtgtc

SEQ ID NO: 134378 - DNA, 75 bp, Artificial Sequence
  Synthetic
cttctccatggtggggaactgggcgaaggtcctggtagtgctgctgctattcgccggcgttgacgcggagaccca

SEQ ID NO: 134379 - DNA, 75 bp, Artificial Sequence
  Synthetic
tagccgctaccgatggatttagcactaggacagaatatccctgtgcaacataagcggcggggactttggtgcttt

SEQ ID NO: 134380 - DNA, 75 bp, Artificial Sequence
  Synthetic
ggggcgggcaacaacaccttgcactgccccactgattgcttccgcaagcatccggaagccacgtactctcggtgc

SEQ ID NO: 134381 - DNA, 75 bp, Artificial Sequence
  Synthetic
gccccactgattgcttccgcaagcatccggaagccacgtactctcggtgcggctccggtccctggatcacaccca

SEQ ID NO: 134382 - DNA, 75 bp, Artificial Sequence
  Synthetic
ccaatgattgccctaacaccagcatagtgtacgagtcagaccaccatatcatgcacttgccggggtgtgttcctt

SEQ ID NO: 134383 - DNA, 75 bp, Artificial Sequence
  Synthetic
tgtgccaggaccatctggagttctgggaggcagtcttcacaggcctcacacacattgacgcccacttcctctccc

SEQ ID NO: 134384 - DNA, 75 bp, Artificial Sequence
  Synthetic
actcagagtttccactggtatgaactgcagggcttttgcgacacctctggtgcacactgccgccctgaagatccc

SEQ ID NO: 134385 - DNA, 75 bp, Artificial Sequence
  Synthetic
cgcgtgggccgtctcaggaaatccagcttataaacaccaacggcagctggcacatcaacagaactgccctaaact

SEQ ID NO: 134386 - DNA, 75 bp, Artificial Sequence
  Synthetic
agacttgatggtgggtgcggcgaccatgtgttccgccttctacattggagatctgtgtggaggcgtcttcctagt

SEQ ID NO: 134387 - DNA, 75 bp, Artificial Sequence
  Synthetic
cccgtatgccaagaccatctggaattttgggaggcggtcttcactggcctaacccacatggatgcccacttcctc

SEQ ID NO: 134388 - DNA, 75 bp, Artificial Sequence
  Synthetic
gtttccaccgcaacgcaatctttcctggcgacctgcatcaacggcgtgtgttggactgtctatcatggcgccggc

SEQ ID NO: 134389 - DNA, 75 bp, Artificial Sequence
  Synthetic
cggcgggcggggaggacgtcggcctcacgcgtcaccaggtacaggtcggaagaaccgcacgtgcaggggtcaagg

SEQ ID NO: 134390 - DNA, 75 bp, Artificial Sequence
  Synthetic
gacatgatgatgaactggagccccaccagcgcgctgatcgtagctcagatcatgcggatcccttccgccctaggt

SEQ ID NO: 134391 - DNA, 75 bp, Artificial Sequence
  Synthetic
gacatgatgatgaactggagccccaccagcgcgctgatcgtagctcagatcatgcggttcccttccgccctaggt

SEQ ID NO: 134392 - DNA, 75 bp, Artificial Sequence
  Synthetic
gacatgatgatgaactggagccccaccagcgcgctgatcgtagctcagatcatgcggctcccttccgccctaggt

SEQ ID NO: 134393 - DNA, 75 bp, Artificial Sequence
  Synthetic
gacatgatgatgaactggagccccaccagcgcgctgatcgtagctcagatcatgcgggtcccttccgccctaggt

SEQ ID NO: 134394 - DNA, 75 bp, Artificial Sequence
  Synthetic
ctggccgctgtggccgcctactgcctcgcaaccggctgtgtgtgtaccatcgggcgcatccacatcaatcagaag

SEQ ID NO: 134395 - DNA, 75 bp, Artificial Sequence
  Synthetic
cgtgaccaaatacatctccacatgcatgcaggcagatcttgagatcatgaccagcacatgggtgctcgcgggggg

SEQ ID NO: 134396 - DNA, 75 bp, Artificial Sequence
  Synthetic
cagcaccatggtaaacagtccacatgaccccccctactgtcgtacccaagaaggtctgggtggccgtggacagca

SEQ ID NO: 134397 - DNA, 75 bp, Artificial Sequence
  Synthetic
ccggggtcgatggatcaacgcacctcgctggcagcgcagccggctacaccaccgccggcttcaccagcatattca

SEQ ID NO: 134398 - DNA, 75 bp, Artificial Sequence
  Synthetic
tcttgtatgaggccttcgatgagatggaggaatgcgcttccaaagccgccctcctcgaggaggggcagcgcatag

SEQ ID NO: 134399 - DNA, 75 bp, Artificial Sequence
  Synthetic
ggacagtaggcgccatcccatcttcttgtaatcgtcagccggacccagcaacaactcgcggcccaaccgcgccga

SEQ ID NO: 134400 - DNA, 75 bp, Artificial Sequence
  Synthetic
gaggtcctctatgaggcatttgatgagatggaggagtgtgcctccaaggcctccctcatcgcggaagggcaacgg

SEQ ID NO: 134401 - DNA, 75 bp, Artificial Sequence
  Synthetic
cattgccggtctgttctacgcccacaagtttaacagttcggggtgccccgagaggctcgcctcgtgcaagcgcct

SEQ ID NO: 134402 - DNA, 75 bp, Artificial Sequence
  Synthetic
gtggtggtgggaacgaccgacaagtcgggcgcgcctacctacaactggggtgaaaatgaaacggacgtcttcgtc

SEQ ID NO: 134403 - DNA, 75 bp, Artificial Sequence
  Synthetic
tccagggcctgctgcagcaagccacgcagcaagctcagaatgtgcagcccgccgtccagacaacctggcccaaac

SEQ ID NO: 134404 - DNA, 75 bp, Artificial Sequence
  Synthetic
cgctgtccactagcaccaccatcctcctgaacatcatgggtggctggttggcctcacaaatagctccccccgcgg

SEQ ID NO: 134405 - DNA, 75 bp, Artificial Sequence
  Synthetic
accgccagtcctttgagaccctcggcagcccagtcctgtatgggggacaggtggtcatacagataggtgttaaac

SEQ ID NO: 134406 - DNA, 75 bp, Artificial Sequence
  Synthetic
ggggtcgtaccggcatcgaaggtgtgcggacccgtgtactgtttctcgcccagccccctggtggtcggtaccacc

SEQ ID NO: 134407 - DNA, 75 bp, Artificial Sequence
  Synthetic
acccgaccctggtatttgacatcaccaaactactgctggccgtcttcggacccctttggattcttcaagccagtt

SEQ ID NO: 134408 - DNA, 75 bp, Artificial Sequence
  Synthetic
gatggcgttcagcgccgccctcaccagcccgctgtccactagcactaccatcctccttaacatcatgggaggttg

SEQ ID NO: 134409 - DNA, 75 bp, Artificial Sequence
  Synthetic
cagtccgctgctgctgtctacaacagagtggcagatactgccctgctccttcactaccctaccggctctgtccac

SEQ ID NO: 134410 - DNA, 75 bp, Artificial Sequence
  Synthetic
tcctccttaacatcatgggaggttggttggcctcacaaattgctcctccagcaagctccactggcttcgtcgtca

SEQ ID NO: 134411 - DNA, 75 bp, Artificial Sequence
  Synthetic
gctcttttgtcatgcatttcggtgccagtctccgctgtgcaagtcaaaaataccaccaccagctacatggcaacc

SEQ ID NO: 134412 - DNA, 75 bp, Artificial Sequence
  Synthetic
agggggtgctggtgagtgcggcttgtattaaatacagtggcccaaggacggctatcagcagctttgtgatgtcaa

SEQ ID NO: 134413 - DNA, 75 bp, Artificial Sequence
  Synthetic
cttggatgaacagctccgggttcgtaaaaacgtgcggggttgctccttgccaggtatcagctggtaacgcctctt

SEQ ID NO: 134414 - DNA, 75 bp, Artificial Sequence
  Synthetic
aggggaaggcgcggtccaatggatgaatcggctcatagcctttgcatccagaggtaaccatgtcgccccgaccca

SEQ ID NO: 134415 - DNA, 75 bp, Artificial Sequence
  Synthetic
gttggattccggtcacccctaacgtagctgtgaagcgcagaggtgctctcactagcgggttgagggctcacatag

SEQ ID NO: 134416 - DNA, 75 bp, Artificial Sequence
  Synthetic
cctgcatatggcatactggttccaccagataagacggccaatccagtgcttataccatggtgataaggtaaagaa

SEQ ID NO: 134417 - DNA, 75 bp, Artificial Sequence
  Synthetic
atatcggttgtggcactacccatgcactgtcaattacactattttcaaagtcaggatgtacgttggcgggatcga

SEQ ID NO: 134418 - DNA, 75 bp, Artificial Sequence
  Synthetic
gactgccctgtcccatgctccgggtcgtggctccgggacgtgtgggactgggtatcttccatcctgacagacttc

SEQ ID NO: 134419 - DNA, 75 bp, Artificial Sequence
  Synthetic
gactgccctgtcccatgctccgggtcgtggctccgggacgtgtgggactgggtttcttccatcctgacagacttc

SEQ ID NO: 134420 - DNA, 75 bp, Artificial Sequence
  Synthetic
gactgccctgtcccatgctccgggtcgtggctccgggacgtgtgggactgggtctcttccatcctgacagacttc

SEQ ID NO: 134421 - DNA, 75 bp, Artificial Sequence
  Synthetic
gactgccctgtcccatgctccgggtcgtggctccgggacgtgtgggactgggtgtcttccatcctgacagacttc

SEQ ID NO: 134422 - DNA, 75 bp, Artificial Sequence
  Synthetic
acgccacaacttcgtccaggactgtaactgctccatctacccagggcacatcacggggcatcgtatggcgtggga

SEQ ID NO: 134423 - DNA, 75 bp, Artificial Sequence
  Synthetic
cacaggcctgtcaaaccataggttatcagcggaacgagcttcccccggatgtgccatgcggcgcagaatgcaacc

SEQ ID NO: 134424 - DNA, 75 bp, Artificial Sequence
  Synthetic
cagtggcaggtgctaccctgctccttcacgcctctcccagctttgtccactggcctgatccatcttcaccagaac

SEQ ID NO: 134425 - DNA, 75 bp, Artificial Sequence
  Synthetic
cgaggactatcctgtcccatgcgccgggtcttggctttgggacgtgtgggactggatctgctctattctggcaga

SEQ ID NO: 134426 - DNA, 75 bp, Artificial Sequence
  Synthetic
tgacaacacggtgcccgtgtggggctaacatctccggccatgtccgcctgggcaccatgagaatcacaggaccca

SEQ ID NO: 134427 - DNA, 75 bp, Artificial Sequence
  Synthetic
gtgatgtttggcatgcattactttgctatgcagggggcatgggccaaggtcgttgttattatcatgttaacagcg

SEQ ID NO: 134428 - DNA, 75 bp, Artificial Sequence
  Synthetic
agagggccacacacacgcgtgcgtccgccagaacgaggatcacctcctgcagcttgtcccacttgagagcccagc

SEQ ID NO: 134429 - DNA, 75 bp, Artificial Sequence
  Synthetic
ctagagtctgcgcgtgcctctggatgatgctgctcgtgtcgcaagttgaagcagcactagccaacatgattacca

SEQ ID NO: 134430 - DNA, 75 bp, Artificial Sequence
  Synthetic
atctggccgtggctgtagagccagtcgtcttctcccaaatggagaccaaactcatcacgtggggggcagacaccg

SEQ ID NO: 134431 - DNA, 75 bp, Artificial Sequence
  Synthetic
atcatgaccacacgatgcccatgcggtgccaacatttctggcaacgtccgcctgggttccatgaggattacagga

SEQ ID NO: 134432 - DNA, 75 bp, Artificial Sequence
  Synthetic
tcctgagccggacaccgaggtattggcttccatgttgacagatccgaaccacattaccgcggaggcggctgccag

SEQ ID NO: 134433 - DNA, 75 bp, Artificial Sequence
  Synthetic
gagggtggcggcggcggagtatgcggaggtgacgatgcatggccagtgtgcgtacgtgacagggttgacaactga

SEQ ID NO: 134434 - DNA, 75 bp, Artificial Sequence
  Synthetic
tggtgaacagcaatgggagctggcacatcaatcgcacggccttgaactgcaatgacagcctaaacaccggcttta

SEQ ID NO: 134435 - DNA, 75 bp, Artificial Sequence
  Synthetic
cgttggcataatatcgctctgtcagcttgaatggagcagtggttgaacgagactgccctctgctagatgttctac

SEQ ID NO: 134436 - DNA, 75 bp, Artificial Sequence
  Synthetic
ttacgcagcctgtgggctgtggcccctgctcctcctactccttgcgttgcccgagagggcgtacgcgtatgatgg

SEQ ID NO: 134437 - DNA, 75 bp, Artificial Sequence
  Synthetic
tctggagggtggcggcgacggagtatgcggaggtgacgcaacacggctcttgcgcgtacgtgacaggactaacaa

SEQ ID NO: 134438 - DNA, 75 bp, Artificial Sequence
  Synthetic
agggatgaggtctcgttcaccgtgggcctcaactcctacgtagtaggctcacagctcccttgtgagccagagccg

SEQ ID NO: 134439 - DNA, 75 bp, Artificial Sequence
  Synthetic
agggatgaggtctcgttcaccgtgggcctcaactcctacgtagtaggctcacagctcccttgtgagcctgagccg

SEQ ID NO: 134440 - DNA, 75 bp, Artificial Sequence
  Synthetic
agggatgaggtctcgttcaccgtgggcctcaactcctacgtagtaggctcacagctcccttgtgagcccgagccg

SEQ ID NO: 134441 - DNA, 75 bp, Artificial Sequence
  Synthetic
agggatgaggtctcgttcaccgtgggcctcaactcctacgtagtaggctcacagctcccttgtgagccggagccg

SEQ ID NO: 134442 - DNA, 75 bp, Artificial Sequence
  Synthetic
agggatgaggtctcgttcaccgtgggcctcaactcctacgtagtaggctctcagctcccttgtgagccagagccg

SEQ ID NO: 134443 - DNA, 75 bp, Artificial Sequence
  Synthetic
agggatgaggtctcgttcaccgtgggcctcaactcctacgtagtaggctctcagctcccttgtgagcctgagccg

SEQ ID NO: 134444 - DNA, 75 bp, Artificial Sequence
  Synthetic
agggatgaggtctcgttcaccgtgggcctcaactcctacgtagtaggctctcagctcccttgtgagcccgagccg

SEQ ID NO: 134445 - DNA, 75 bp, Artificial Sequence
  Synthetic
agggatgaggtctcgttcaccgtgggcctcaactcctacgtagtaggctctcagctcccttgtgagccggagccg

SEQ ID NO: 134446 - DNA, 75 bp, Artificial Sequence
  Synthetic
agggatgaggtctcgttcaccgtgggcctcaactcctacgtagtaggctcccagctcccttgtgagccagagccg

SEQ ID NO: 134447 - DNA, 75 bp, Artificial Sequence
  Synthetic
agggatgaggtctcgttcaccgtgggcctcaactcctacgtagtaggctcccagctcccttgtgagcctgagccg

SEQ ID NO: 134448 - DNA, 75 bp, Artificial Sequence
  Synthetic
agggatgaggtctcgttcaccgtgggcctcaactcctacgtagtaggctcccagctcccttgtgagcccgagccg

SEQ ID NO: 134449 - DNA, 75 bp, Artificial Sequence
  Synthetic
agggatgaggtctcgttcaccgtgggcctcaactcctacgtagtaggctcccagctcccttgtgagccggagccg

SEQ ID NO: 134450 - DNA, 75 bp, Artificial Sequence
  Synthetic
agggatgaggtctcgttcaccgtgggcctcaactcctacgtagtaggctcgcagctcccttgtgagccagagccg

SEQ ID NO: 134451 - DNA, 75 bp, Artificial Sequence
  Synthetic
agggatgaggtctcgttcaccgtgggcctcaactcctacgtagtaggctcgcagctcccttgtgagcctgagccg

SEQ ID NO: 134452 - DNA, 75 bp, Artificial Sequence
  Synthetic
agggatgaggtctcgttcaccgtgggcctcaactcctacgtagtaggctcgcagctcccttgtgagcccgagccg

SEQ ID NO: 134453 - DNA, 75 bp, Artificial Sequence
  Synthetic
agggatgaggtctcgttcaccgtgggcctcaactcctacgtagtaggctcgcagctcccttgtgagccggagccg

SEQ ID NO: 134454 - DNA, 75 bp, Artificial Sequence
  Synthetic
agggatgaggtctcgttcaccgtgggcctcaactcctacgtagttggctcacagctcccttgtgagccagagccg

SEQ ID NO: 134455 - DNA, 75 bp, Artificial Sequence
  Synthetic
agggatgaggtctcgttcaccgtgggcctcaactcctacgtagttggctcacagctcccttgtgagcctgagccg

SEQ ID NO: 134456 - DNA, 75 bp, Artificial Sequence
  Synthetic
agggatgaggtctcgttcaccgtgggcctcaactcctacgtagttggctcacagctcccttgtgagcccgagccg

SEQ ID NO: 134457 - DNA, 75 bp, Artificial Sequence
  Synthetic
agggatgaggtctcgttcaccgtgggcctcaactcctacgtagttggctcacagctcccttgtgagccggagccg

SEQ ID NO: 134458 - DNA, 75 bp, Artificial Sequence
  Synthetic
agggatgaggtctcgttcaccgtgggcctcaactcctacgtagttggctctcagctcccttgtgagccagagccg

SEQ ID NO: 134459 - DNA, 75 bp, Artificial Sequence
  Synthetic
agggatgaggtctcgttcaccgtgggcctcaactcctacgtagttggctctcagctcccttgtgagcctgagccg

SEQ ID NO: 134460 - DNA, 75 bp, Artificial Sequence
  Synthetic
agggatgaggtctcgttcaccgtgggcctcaactcctacgtagttggctctcagctcccttgtgagcccgagccg

SEQ ID NO: 134461 - DNA, 75 bp, Artificial Sequence
  Synthetic
agggatgaggtctcgttcaccgtgggcctcaactcctacgtagttggctctcagctcccttgtgagccggagccg

SEQ ID NO: 134462 - DNA, 75 bp, Artificial Sequence
  Synthetic
agggatgaggtctcgttcaccgtgggcctcaactcctacgtagttggctcccagctcccttgtgagccagagccg

SEQ ID NO: 134463 - DNA, 75 bp, Artificial Sequence
  Synthetic
agggatgaggtctcgttcaccgtgggcctcaactcctacgtagttggctcccagctcccttgtgagcctgagccg

SEQ ID NO: 134464 - DNA, 75 bp, Artificial Sequence
  Synthetic
agggatgaggtctcgttcaccgtgggcctcaactcctacgtagttggctcccagctcccttgtgagcccgagccg

SEQ ID NO: 134465 - DNA, 75 bp, Artificial Sequence
  Synthetic
agggatgaggtctcgttcaccgtgggcctcaactcctacgtagttggctcccagctcccttgtgagccggagccg

SEQ ID NO: 134466 - DNA, 75 bp, Artificial Sequence
  Synthetic
agggatgaggtctcgttcaccgtgggcctcaactcctacgtagttggctcgcagctcccttgtgagccagagccg

SEQ ID NO: 134467 - DNA, 75 bp, Artificial Sequence
  Synthetic
agggatgaggtctcgttcaccgtgggcctcaactcctacgtagttggctcgcagctcccttgtgagcctgagccg

SEQ ID NO: 134468 - DNA, 75 bp, Artificial Sequence
  Synthetic
agggatgaggtctcgttcaccgtgggcctcaactcctacgtagttggctcgcagctcccttgtgagcccgagccg

SEQ ID NO: 134469 - DNA, 75 bp, Artificial Sequence
  Synthetic
agggatgaggtctcgttcaccgtgggcctcaactcctacgtagttggctcgcagctcccttgtgagccggagccg

SEQ ID NO: 134470 - DNA, 75 bp, Artificial Sequence
  Synthetic
agggatgaggtctcgttcaccgtgggcctcaactcctacgtagtcggctcacagctcccttgtgagccagagccg

SEQ ID NO: 134471 - DNA, 75 bp, Artificial Sequence
  Synthetic
agggatgaggtctcgttcaccgtgggcctcaactcctacgtagtcggctcacagctcccttgtgagcctgagccg

SEQ ID NO: 134472 - DNA, 75 bp, Artificial Sequence
  Synthetic
agggatgaggtctcgttcaccgtgggcctcaactcctacgtagtcggctcacagctcccttgtgagcccgagccg

SEQ ID NO: 134473 - DNA, 75 bp, Artificial Sequence
  Synthetic
agggatgaggtctcgttcaccgtgggcctcaactcctacgtagtcggctcacagctcccttgtgagccggagccg

SEQ ID NO: 134474 - DNA, 75 bp, Artificial Sequence
  Synthetic
agggatgaggtctcgttcaccgtgggcctcaactcctacgtagtcggctctcagctcccttgtgagccagagccg

SEQ ID NO: 134475 - DNA, 75 bp, Artificial Sequence
  Synthetic
agggatgaggtctcgttcaccgtgggcctcaactcctacgtagtcggctctcagctcccttgtgagcctgagccg

SEQ ID NO: 134476 - DNA, 75 bp, Artificial Sequence
  Synthetic
agggatgaggtctcgttcaccgtgggcctcaactcctacgtagtcggctctcagctcccttgtgagcccgagccg

SEQ ID NO: 134477 - DNA, 75 bp, Artificial Sequence
  Synthetic
agggatgaggtctcgttcaccgtgggcctcaactcctacgtagtcggctctcagctcccttgtgagccggagccg

SEQ ID NO: 134478 - DNA, 75 bp, Artificial Sequence
  Synthetic
agggatgaggtctcgttcaccgtgggcctcaactcctacgtagtcggctcccagctcccttgtgagccagagccg

SEQ ID NO: 134479 - DNA, 75 bp, Artificial Sequence
  Synthetic
agggatgaggtctcgttcaccgtgggcctcaactcctacgtagtcggctcccagctcccttgtgagcctgagccg

SEQ ID NO: 134480 - DNA, 75 bp, Artificial Sequence
  Synthetic
agggatgaggtctcgttcaccgtgggcctcaactcctacgtagtcggctcccagctcccttgtgagcccgagccg

SEQ ID NO: 134481 - DNA, 75 bp, Artificial Sequence
  Synthetic
agggatgaggtctcgttcaccgtgggcctcaactcctacgtagtcggctcccagctcccttgtgagccggagccg

SEQ ID NO: 134482 - DNA, 75 bp, Artificial Sequence
  Synthetic
agggatgaggtctcgttcaccgtgggcctcaactcctacgtagtcggctcgcagctcccttgtgagccagagccg

SEQ ID NO: 134483 - DNA, 75 bp, Artificial Sequence
  Synthetic
agggatgaggtctcgttcaccgtgggcctcaactcctacgtagtcggctcgcagctcccttgtgagcctgagccg

SEQ ID NO: 134484 - DNA, 75 bp, Artificial Sequence
  Synthetic
agggatgaggtctcgttcaccgtgggcctcaactcctacgtagtcggctcgcagctcccttgtgagcccgagccg

SEQ ID NO: 134485 - DNA, 75 bp, Artificial Sequence
  Synthetic
agggatgaggtctcgttcaccgtgggcctcaactcctacgtagtcggctcgcagctcccttgtgagccggagccg

SEQ ID NO: 134486 - DNA, 75 bp, Artificial Sequence
  Synthetic
agggatgaggtctcgttcaccgtgggcctcaactcctacgtagtgggctcacagctcccttgtgagccagagccg

SEQ ID NO: 134487 - DNA, 75 bp, Artificial Sequence
  Synthetic
agggatgaggtctcgttcaccgtgggcctcaactcctacgtagtgggctcacagctcccttgtgagcctgagccg

SEQ ID NO: 134488 - DNA, 75 bp, Artificial Sequence
  Synthetic
agggatgaggtctcgttcaccgtgggcctcaactcctacgtagtgggctcacagctcccttgtgagcccgagccg

SEQ ID NO: 134489 - DNA, 75 bp, Artificial Sequence
  Synthetic
agggatgaggtctcgttcaccgtgggcctcaactcctacgtagtgggctcacagctcccttgtgagccggagccg

SEQ ID NO: 134490 - DNA, 75 bp, Artificial Sequence
  Synthetic
agggatgaggtctcgttcaccgtgggcctcaactcctacgtagtgggctctcagctcccttgtgagccagagccg

SEQ ID NO: 134491 - DNA, 75 bp, Artificial Sequence
  Synthetic
agggatgaggtctcgttcaccgtgggcctcaactcctacgtagtgggctctcagctcccttgtgagcctgagccg

SEQ ID NO: 134492 - DNA, 75 bp, Artificial Sequence
  Synthetic
agggatgaggtctcgttcaccgtgggcctcaactcctacgtagtgggctctcagctcccttgtgagcccgagccg

SEQ ID NO: 134493 - DNA, 75 bp, Artificial Sequence
  Synthetic
agggatgaggtctcgttcaccgtgggcctcaactcctacgtagtgggctctcagctcccttgtgagccggagccg

SEQ ID NO: 134494 - DNA, 75 bp, Artificial Sequence
  Synthetic
agggatgaggtctcgttcaccgtgggcctcaactcctacgtagtgggctcccagctcccttgtgagccagagccg

SEQ ID NO: 134495 - DNA, 75 bp, Artificial Sequence
  Synthetic
agggatgaggtctcgttcaccgtgggcctcaactcctacgtagtgggctcccagctcccttgtgagcctgagccg

SEQ ID NO: 134496 - DNA, 75 bp, Artificial Sequence
  Synthetic
agggatgaggtctcgttcaccgtgggcctcaactcctacgtagtgggctcccagctcccttgtgagcccgagccg

SEQ ID NO: 134497 - DNA, 75 bp, Artificial Sequence
  Synthetic
agggatgaggtctcgttcaccgtgggcctcaactcctacgtagtgggctcccagctcccttgtgagccggagccg

SEQ ID NO: 134498 - DNA, 75 bp, Artificial Sequence
  Synthetic
agggatgaggtctcgttcaccgtgggcctcaactcctacgtagtgggctcgcagctcccttgtgagccagagccg

SEQ ID NO: 134499 - DNA, 75 bp, Artificial Sequence
  Synthetic
agggatgaggtctcgttcaccgtgggcctcaactcctacgtagtgggctcgcagctcccttgtgagcctgagccg

SEQ ID NO: 134500 - DNA, 75 bp, Artificial Sequence
  Synthetic
agggatgaggtctcgttcaccgtgggcctcaactcctacgtagtgggctcgcagctcccttgtgagcccgagccg

SEQ ID NO: 134501 - DNA, 75 bp, Artificial Sequence
  Synthetic
agggatgaggtctcgttcaccgtgggcctcaactcctacgtagtgggctcgcagctcccttgtgagccggagccg

SEQ ID NO: 134502 - DNA, 75 bp, Artificial Sequence
  Synthetic
catagagcatgagaccaatgtcaccaatgatgaggacaccagaccttactgttggcattaccccccaaaaccatg

SEQ ID NO: 134503 - DNA, 75 bp, Artificial Sequence
  Synthetic
ggataatgccacacacccatcgggttctctaggtctgtgcttggcgtaagccagggcccggtgcccgtgcgggat

SEQ ID NO: 134504 - DNA, 75 bp, Artificial Sequence
  Synthetic
ctacaatacctattggccagacttgaggctatgatgcacgtctatgttccatccctagacgttaggggcgggcgg

SEQ ID NO: 134505 - DNA, 75 bp, Artificial Sequence
  Synthetic
gctcttctgctagtcagttgtcggcagtatccctgcgtgctacgtgcaccgctcatggtgagggtcctgacattg

SEQ ID NO: 134506 - DNA, 75 bp, Artificial Sequence
  Synthetic
gctcttctgctagtcagttgtcggcagtttccctgcgtgctacgtgcaccgctcatggtgagggtcctgacattg

SEQ ID NO: 134507 - DNA, 75 bp, Artificial Sequence
  Synthetic
gctcttctgctagtcagttgtcggcagtctccctgcgtgctacgtgcaccgctcatggtgagggtcctgacattg

SEQ ID NO: 134508 - DNA, 75 bp, Artificial Sequence
  Synthetic
gctcttctgctagtcagttgtcggcagtgtccctgcgtgctacgtgcaccgctcatggtgagggtcctgacattg

SEQ ID NO: 134509 - DNA, 75 bp, Artificial Sequence
  Synthetic
ctgacaacctgaaggtcccctgccaaataccatcccctgaattcttctcctgggtggacggcgtgcagatccatc

SEQ ID NO: 134510 - DNA, 75 bp, Artificial Sequence
  Synthetic
gccggacgtggaggtactggcgtccatgctaacagacccatcccatatcacggccgaggcggcagcaagacggtt

SEQ ID NO: 134511 - DNA, 75 bp, Artificial Sequence
  Synthetic
agctggggagagaatgaaacagatgtcttcctattgaacaacaccagaccgccgaaagggccttggtttggctgc

SEQ ID NO: 134512 - DNA, 75 bp, Artificial Sequence
  Synthetic
cctccctcctgcgcatcccttacttcgtgagggcgcacgcccttatcagaatgtgtgggttggtgcgaggagtgg

SEQ ID NO: 134513 - DNA, 75 bp, Artificial Sequence
  Synthetic
ggaggacgagcgagagccttccataccatcggaatacctactccccaagaagaggttcccaccagcactaccagt

SEQ ID NO: 134514 - DNA, 75 bp, Artificial Sequence
  Synthetic
gacggccacatctcaaatgtttgcctgtactgttcatccacacacaagcaaagcaccgcgctaccccccgagagt

SEQ ID NO: 134515 - DNA, 75 bp, Artificial Sequence
  Synthetic
atgctaacagacccatcccatatcacggccgaggcggcagcaagacggttggcgcgaggctcgcccccatcagaa

SEQ ID NO: 134516 - DNA, 75 bp, Artificial Sequence
  Synthetic
attgcttcaggaaacatccagaagctacgtacaccaagtgcggggctggaccctggttgacgcccaggtgcctgg

SEQ ID NO: 134517 - DNA, 75 bp, Artificial Sequence
  Synthetic
tcatggggggcgaaatcactcggatagagtccgagtccaaggtgatcatgctggactcccttgactcaatggccg

SEQ ID NO: 134518 - DNA, 75 bp, Artificial Sequence
  Synthetic
tggtctcaaggacctggcagtggctctagagcccatcatattcacacccatggagaagaaggtgattgtttgggg

SEQ ID NO: 134519 - DNA, 75 bp, Artificial Sequence
  Synthetic
aacaccccagtgccacctccgaggaggcggcgtactgtggtcctggaccagagtaccgtgggggaagcactcagg

SEQ ID NO: 134520 - DNA, 75 bp, Artificial Sequence
  Synthetic
gcagtagacgggcccacagactttcaagcgcaaccaatacaatgagggtctgggtggatagtgccagcattatgg

SEQ ID NO: 134521 - DNA, 75 bp, Artificial Sequence
  Synthetic
ctccatgtcatactcctggacgggggccctcataacaccatgtgggcccgaggaggagaagttgccaatcaaccc

SEQ ID NO: 134522 - DNA, 75 bp, Artificial Sequence
  Synthetic
agcatgcaacttcactcgcggggaccgctgcaatctggaggacagggataggggtcagcttagcccactgctgca

SEQ ID NO: 134523 - DNA, 75 bp, Artificial Sequence
  Synthetic
gcaggttggaggctactagcccccataaccgcatatgcgcagcagacccgaggacttctgggtaccattgtgacc

SEQ ID NO: 134524 - DNA, 75 bp, Artificial Sequence
  Synthetic
gcaggttggaggcttctagcccccataaccgcatatgcgcagcagacccgaggacttctgggtaccattgtgacc

SEQ ID NO: 134525 - DNA, 75 bp, Artificial Sequence
  Synthetic
gcaggttggaggctcctagcccccataaccgcatatgcgcagcagacccgaggacttctgggtaccattgtgacc

SEQ ID NO: 134526 - DNA, 75 bp, Artificial Sequence
  Synthetic
gcaggttggaggctgctagcccccataaccgcatatgcgcagcagacccgaggacttctgggtaccattgtgacc

SEQ ID NO: 134527 - DNA, 75 bp, Artificial Sequence
  Synthetic
aagagctcaatgactcagagacgagttccacgtcctccatgccccccctcgagggggagcctggggatcctgacc

SEQ ID NO: 134528 - DNA, 75 bp, Artificial Sequence
  Synthetic
gggctcctcatctttttgtgatagtagaagaggcccgcaataaacgcacacaaatcccattcgttgcaattcaag

SEQ ID NO: 134529 - DNA, 75 bp, Artificial Sequence
  Synthetic
ccgaggaggcggcgcgccgtggtattggaccagagcactgtgggggaagctctcagagagctggccatgaagagc

SEQ ID NO: 134530 - DNA, 75 bp, Artificial Sequence
  Synthetic
tacctgtatggcttgtcacctgccattaccaagtacatcgtcaaatgggagtgggtggtcttactgtttctgctg

SEQ ID NO: 134531 - DNA, 75 bp, Artificial Sequence
  Synthetic
ccgcgctcccacctctgcacacacaactcgcgtccactcctgaaaacatgattaggacgatctcgtggaaccggg

SEQ ID NO: 134532 - DNA, 75 bp, Artificial Sequence
  Synthetic
ggaccgtgtaacacggggccggcagtaaaaccatctgcggtccgaaaggacctgtgaaccagatgtacaccaatg

SEQ ID NO: 134533 - DNA, 75 bp, Artificial Sequence
  Synthetic
ggaccgtgtatcacggggccggcagtaaaaccatctgcggtccgaaaggacctgtgaaccagatgtacaccaatg

SEQ ID NO: 134534 - DNA, 75 bp, Artificial Sequence
  Synthetic
ggaccgtgtaccacggggccggcagtaaaaccatctgcggtccgaaaggacctgtgaaccagatgtacaccaatg

SEQ ID NO: 134535 - DNA, 75 bp, Artificial Sequence
  Synthetic
ggaccgtgtagcacggggccggcagtaaaaccatctgcggtccgaaaggacctgtgaaccagatgtacaccaatg

SEQ ID NO: 134536 - DNA, 75 bp, Artificial Sequence
  Synthetic
ttccgtggtctgttgttccatgtcttactcctggaccggggcgttgataactccctgtagtccggaggaggaaaa

SEQ ID NO: 134537 - DNA, 75 bp, Artificial Sequence
  Synthetic
aaacgggttccatgagctccatgccccccctcgagggggagcctggagacccagacttggagccaggaccggtcg

SEQ ID NO: 134538 - DNA, 75 bp, Artificial Sequence
  Synthetic
ctgccagtgctaatggagtgcattggtttggcatcttcttcatagcggcctggtacatcaaaggccgcctggtcc

SEQ ID NO: 134539 - DNA, 75 bp, Artificial Sequence
  Synthetic
tatcactagcccgattgcgggggagcagttgttctagtatagggttgccatacgatgtcctgagacatgaccagg

SEQ ID NO: 134540 - DNA, 75 bp, Artificial Sequence
  Synthetic
cgacgtgatacccgtgaggaggagaggtgacagtcgtggcgccttgctaagccccaggcccatctcaacacttaa

SEQ ID NO: 134541 - DNA, 75 bp, Artificial Sequence
  Synthetic
attgggactggccttgctagtgttgataaccgtgtttaccatcactccagcctacaaggttctcctacaacgcag

SEQ ID NO: 134542 - DNA, 75 bp, Artificial Sequence
  Synthetic
aattcacgactcgtgtccgttggcggggccaccaacatattgacatgtattgcctagctgcgccaggtcacacca

SEQ ID NO: 134543 - DNA, 75 bp, Artificial Sequence
  Synthetic
gtgccggtcgagtcccttgagacgaccatgcggtctccatcattctcagacaattccacacctccagctgttccc

SEQ ID NO: 134544 - DNA, 75 bp, Artificial Sequence
  Synthetic
gccctcaactgcaatgacagcttacagacgggtttcctagcttccctgttttacacccacaaattcaacagctct

SEQ ID NO: 134545 - DNA, 75 bp, Artificial Sequence
  Synthetic
gctgcggtgctattctgtccccacattatttttgacatcaccaaatggctactggcagtactcgggcctctttgg

SEQ ID NO: 134546 - DNA, 75 bp, Artificial Sequence
  Synthetic
cgtcgtcggcctcatacacaatgctcctgttggagcagtcgttggtaagcattatatggccagacgcattcctgt

SEQ ID NO: 134547 - DNA, 75 bp, Artificial Sequence
  Synthetic
tcaacccctctgttgcagccactctggggttcgggtcttacatgtctaaagcatacggcatcgacccgaacattc

SEQ ID NO: 134548 - DNA, 75 bp, Artificial Sequence
  Synthetic
gccgcaggttggacgactttcgtatcgggtggggaaccttggaatacgaggataaagtcaccaacgatggggaca

SEQ ID NO: 134549 - DNA, 75 bp, Artificial Sequence
  Synthetic
ctgtgtaaacccagccaagggtgggaaaaaagcagctcgcctcatagtatatccagaccttggtgttcgagtctg

SEQ ID NO: 134550 - DNA, 75 bp, Artificial Sequence
  Synthetic
tccagatggccataataacatttggcaggtggaccggcacctatatatatgatcacctctctcctatgtcaactt

SEQ ID NO: 134551 - DNA, 75 bp, Artificial Sequence
  Synthetic
gtcctcaagtgctctcacaccatgagcgagggctcttgcgacgccccctacaggggcgccgatgagcggaatgta

SEQ ID NO: 134552 - DNA, 75 bp, Artificial Sequence
  Synthetic
catcatctgtgatgaatgccactccgtggactctacaactattcttggcataggcacggttctggaccaggcgga

SEQ ID NO: 134553 - DNA, 75 bp, Artificial Sequence
  Synthetic
ctgtggggacatcctacacgggcttcccgtctctgcgcgcctgggccgggaggtcctgctgggccccgctgacga

SEQ ID NO: 134554 - DNA, 75 bp, Artificial Sequence
  Synthetic
cgatttccttctgcgagcatggaaggaaaagcgagaccccatggggttctcatatgacactcgctgcttcgactc

SEQ ID NO: 134555 - DNA, 75 bp, Artificial Sequence
  Synthetic
ggagaagtgcccttctacgggagggccatcccattggagctaatcaagggaggcagacatctcatcttctgccac

SEQ ID NO: 134556 - DNA, 75 bp, Artificial Sequence
  Synthetic
ccgcgggggggcaagagccatcctgcccaaccacagccctcattcccgtagaggggccaagggtacccgggctgg

SEQ ID NO: 134557 - DNA, 75 bp, Artificial Sequence
  Synthetic
gacaaaacggagtacgctggggaggtgcaagtgctgtccagcgtcacacagacattcctgggtacatcgatcagc

SEQ ID NO: 134558 - DNA, 75 bp, Artificial Sequence
  Synthetic
attgtgggcccctacgcggcaggacatatacttcaccaacgatctgcccgccagccgggaacttaacgttctttg

SEQ ID NO: 134559 - DNA, 75 bp, Artificial Sequence
  Synthetic
cgggggacgtcgtagtttgcgctacggacgccctcatgaccggattcaccggtgacttcgactccgtgatagact

SEQ ID NO: 134560 - DNA, 75 bp, Artificial Sequence
  Synthetic
taggatggcccgcaccccccgggacaaaatccctggacgtgtgcacctgcggagcctccgacttgtacctcgtca

SEQ ID NO: 134561 - DNA, 75 bp, Artificial Sequence
  Synthetic
tcaggcagtaccacaaggcctttcgcgacccaacactactcggctagtgatctcgcgggggcacgcccaaatttc

SEQ ID NO: 134562 - DNA, 75 bp, Artificial Sequence
  Synthetic
aagggggcgcactggtagagggaagctgggggtttaccgatatgtcaccccaggagaacgaccctctggcatgtt

SEQ ID NO: 134563 - DNA, 75 bp, Artificial Sequence
  Synthetic
tccggtcctctgtccaagagggcacgcagttgggatttttagagcggctgtttgttctcgaggggtcgcaaaatc

SEQ ID NO: 134564 - DNA, 75 bp, Artificial Sequence
  Synthetic
gggcctggaggctgcacgacactcgtactaacgccatggctagacgctttccgcgtgaagacagaagttcctcac

SEQ ID NO: 134565 - DNA, 75 bp, Artificial Sequence
  Synthetic
cgactttaagacctggctaaaagccaagctcatgccacaactgcctgggattccctttgtgtcctgccaacgcgg

SEQ ID NO: 134566 - DNA, 75 bp, Artificial Sequence
  Synthetic
ccaggcctccccgtttgtcaggaccatctggagttctgggagagcgtttttacgggcctaacccatatagacgct

SEQ ID NO: 134567 - DNA, 75 bp, Artificial Sequence
  Synthetic
tggcttttacagctgccgtcaccagcccactaaccactagccaaaccctcctcttcaacatattgggggggtggg

SEQ ID NO: 134568 - DNA, 75 bp, Artificial Sequence
  Synthetic
cagctctcagaaaacttggagcgccgcccctcagagcgtggaagagtcgagctcgagcggtgagggcgtccctca

SEQ ID NO: 134569 - DNA, 75 bp, Artificial Sequence
  Synthetic
gggtatttgcatgcccctactggcagtggaaaaagcaccaaggtcccagcggcatacgctgcgcagggctacaaa

SEQ ID NO: 134570 - DNA, 75 bp, Artificial Sequence
  Synthetic
gcccaggacaccctggatcaagatctcaattttgagatgtacggagcagtgtactcagtttcccctctggacctc

SEQ ID NO: 134571 - DNA, 75 bp, Artificial Sequence
  Synthetic
gggactctatgtggaagtgcctcatccgcctcaaacccaccttacaggggcctacccccctcctctacaggctgg

SEQ ID NO: 134572 - DNA, 75 bp, Artificial Sequence
  Synthetic
ctgtgacaactggagaccctatcacctactccacatatggcaaattcctcgcagacggaggctgctccgcaggag

SEQ ID NO: 134573 - DNA, 75 bp, Artificial Sequence
  Synthetic
ggtagggggggtcgtggcggccttggctgcttactgcttatctgtgggcagcgtggtagtggtcgggagggtggt

SEQ ID NO: 134574 - DNA, 75 bp, Artificial Sequence
  Synthetic
cggccatatgtggtcgctacctcttcaactgggcggtgaggacaaagctcaaactcactccattgcctgcggcgc

SEQ ID NO: 134575 - DNA, 75 bp, Artificial Sequence
  Synthetic
gcttgtggtcttagccactgctacacctccgggatctgtgaccacccctcaccccaacatagaggaggtggctct

SEQ ID NO: 134576 - DNA, 75 bp, Artificial Sequence
  Synthetic
gccttctggatctatccagttggttcaccgtcagtgcaggcgggggcgacatatatcacagcgtgtcgcgagccc

SEQ ID NO: 134577 - DNA, 75 bp, Artificial Sequence
  Synthetic
ggcatgcagatcgcagatcaattcaagcagaaagccctcggtgtgctgcaacttgctagcaagcaagcacaagag

SEQ ID NO: 134578 - DNA, 75 bp, Artificial Sequence
  Synthetic
tatggcaaggctatccctctagctcacatcaaaggagggaggcatctcatcttttgccattcaaggaagaagtgc

SEQ ID NO: 134579 - DNA, 75 bp, Artificial Sequence
  Synthetic
ccactctgcccgggaaccctgccatagcctcccttatgtcattcaccgccgctgtcactagccccctcaccaccc

SEQ ID NO: 134580 - DNA, 75 bp, Artificial Sequence
  Synthetic
ttgtcgccaccgatgcccttatgaccgggtacactggggacttcgactctgttatagactgcaatgttgcggtca

SEQ ID NO: 134581 - DNA, 75 bp, Artificial Sequence
  Synthetic
tgctgttggcagtgtaggcctggggaaaatcctggttgacatccttgcaggatacggtgccggtgttgccggcgc

SEQ ID NO: 134582 - DNA, 75 bp, Artificial Sequence
  Synthetic
tagggggaggttaggcgtctatagatacgtgtctgcaggtgaaagaccgtctgggatgttcgactccgtggtgct

SEQ ID NO: 134583 - DNA, 75 bp, Artificial Sequence
  Synthetic
gatacggtgccggtgttgccggcgctgttgtcaccttcaaaatcatgagcggcgaagtgccttccacggaggact

SEQ ID NO: 134584 - DNA, 75 bp, Artificial Sequence
  Synthetic
tacgtgtctgcaggtgaaagaccgtctgggatgttcgactccgtggtgctctgcgagtgctacgacgcgggagct

SEQ ID NO: 134585 - DNA, 75 bp, Artificial Sequence
  Synthetic
cgtgcaatggatgaaccgtcttattgctttcgcttcgcgaggcaatcacgtgtctcctacgcactacgttcccga

SEQ ID NO: 134586 - DNA, 75 bp, Artificial Sequence
  Synthetic
aggcagttttcaccggcctcacacacatagatgctcactttctctcccaaaccaagcagtcgggggaaaacttcg

SEQ ID NO: 134587 - DNA, 75 bp, Artificial Sequence
  Synthetic
ccgtgcgactcgagctggttccgggagatctgggactgggtctgcactgtcttaactgacttcaagaactggttg

SEQ ID NO: 134588 - DNA, 75 bp, Artificial Sequence
  Synthetic
taactgctcgctgtacccaggccacctcacaggacatcgaatggcttgggatatgatgatgaattggtcccccgc

SEQ ID NO: 134589 - DNA, 75 bp, Artificial Sequence
  Synthetic
gttggtgggtcccactcccctgctatatcggataggccctgtgaccaatgacgtcaccttaacacatcctgtgac

SEQ ID NO: 134590 - DNA, 75 bp, Artificial Sequence
  Synthetic
gcccgtgtggcgctgagctggcaggccatatcaagaacggctcgatgaggatcgtcgggccgaagacttgcagca

SEQ ID NO: 134591 - DNA, 75 bp, Artificial Sequence
  Synthetic
gcgaccgggtgcgtttccatcattggccgcctgtgtatcaaccataggacggtgattgctcccgacaaggaagtc

SEQ ID NO: 134592 - DNA, 75 bp, Artificial Sequence
  Synthetic
tgtcttggcgggcctagcttattattctatgcagggtaactgggccaaagtcgccatcattatggtcatgttttc

SEQ ID NO: 134593 - DNA, 75 bp, Artificial Sequence
  Synthetic
cgaggattatgtggaggtaaggagagtgggtgacttccactacatcaccggtgtaacacaagataacatcaagtg

SEQ ID NO: 134594 - DNA, 75 bp, Artificial Sequence
  Synthetic
gcctactccagcaggccacccggcaggcgcaggacatacagcccgccgtgcaagcatcatggcccaagctcgagc

SEQ ID NO: 134595 - DNA, 75 bp, Artificial Sequence
  Synthetic
atagctgggttgttttattatcataagttcaactctaccgggtgccctcaaatgctcaatagctgcagacccatc

SEQ ID NO: 134596 - DNA, 75 bp, Artificial Sequence
  Synthetic
gtggggaactgggcgaaggtcctggttgtgctgctgctattcgccggcgttgacgcggagacccatgtcaccggg

SEQ ID NO: 134597 - DNA, 75 bp, Artificial Sequence
  Synthetic
agttttagcgtcgggctcaacaatttcgtggtgggatcccagctcccctgcgagccggagccagacgtgagcgtc

SEQ ID NO: 134598 - DNA, 75 bp, Artificial Sequence
  Synthetic
cttcagtgctgccctcactagccctttatccaccagtaccaccatcctcctcaacatcatgggggggtggttggc

SEQ ID NO: 134599 - DNA, 75 bp, Artificial Sequence
  Synthetic
tgacgcggagacccatgtcaccgggggaactgccggccgcgacgcggctgggtttgttggattcttctcacaagg

SEQ ID NO: 134600 - DNA, 75 bp, Artificial Sequence
  Synthetic
ggcgtcagagttctggaggacggcgtgaactatgcaacagggaatcttcctggttgctccttttctatcttcctc

SEQ ID NO: 134601 - DNA, 75 bp, Artificial Sequence
  Synthetic
cttcgatccgcttgtggcggaggaagacgagcgggagatctccgtaccctcggagattctgcttaagtctcggaa

SEQ ID NO: 134602 - DNA, 75 bp, Artificial Sequence
  Synthetic
gccagctatctgctccatcactcaaggccacctgcacggcccatcatgactccccggatgctgatcttatcgaag

SEQ ID NO: 134603 - DNA, 75 bp, Artificial Sequence
  Synthetic
attttggctggatatggtgcaggcatttcaggggctctcgtcgcttttaagatcatgtccggcgagaagccctcc

SEQ ID NO: 134604 - DNA, 75 bp, Artificial Sequence
  Synthetic
ttgtgtacgagacaaaagacctcatcctacatgctcctgggtgtgtgccctgtgtcaacgagggcaacagggcga

SEQ ID NO: 134605 - DNA, 75 bp, Artificial Sequence
  Synthetic
tgtccgcttccacctccacggtcccctcctgtgcctccgcctcggaagaagcggacggtggtcctcaccgaatca

SEQ ID NO: 134606 - DNA, 75 bp, Artificial Sequence
  Synthetic
gtggatgaactccacggggtttgtcaagacgtgtggagcccccccttgtaacatctatgggggtgataaaacgag

SEQ ID NO: 134607 - DNA, 75 bp, Artificial Sequence
  Synthetic
ggaggaggacggtgagatctccgttcctgcagagatcctccgccggaccaaaaggttccctccagccatcccggt

SEQ ID NO: 134608 - DNA, 75 bp, Artificial Sequence
  Synthetic
gggagggcgcggtccagtggatgaataggctcatcgccttcacgtccaaggggaaccacgtcgccccgacccact

SEQ ID NO: 134609 - DNA, 75 bp, Artificial Sequence
  Synthetic
gctctgctcagccttgtatgtgggggacctctgcggctccgtcttccttgtcagccagctgttctccttctcccc

SEQ ID NO: 134610 - DNA, 75 bp, Artificial Sequence
  Synthetic
ccaactccagtccccccctcgaggaggaaacggatggttgcgctcaccgagtctaacgtctctgaagcgctggcc

SEQ ID NO: 134611 - DNA, 75 bp, Artificial Sequence
  Synthetic
ctaccccgtcccgtgcgccggatcctggcttcgggaggtgtgggactgggtttgccacatcctaacggacttcaa

SEQ ID NO: 134612 - DNA, 75 bp, Artificial Sequence
  Synthetic
acgactgcactgatagtggcgcagctcctccggatcccacagtccatcgtggatatggtagccggggcccactgg

SEQ ID NO: 134613 - DNA, 75 bp, Artificial Sequence
  Synthetic
agccagctgcagacgctgactctgggacggggttcacctctccaactgacacttcaaccccggactcccctgatg

SEQ ID NO: 134614 - DNA, 75 bp, Artificial Sequence
  Synthetic
actaccaggtgtccctgtggtgccgacatctcgggcaacgtccggatgggcactatgaagatcacaggccccaaa

SEQ ID NO: 134615 - DNA, 75 bp, Artificial Sequence
  Synthetic
tctcgggagggtcagtggctagacataccgctgggcttgttggctttctctccccgggggctaagcagaatgtcc

SEQ ID NO: 134616 - DNA, 75 bp, Artificial Sequence
  Synthetic
ggggtaaacactccggcctcttaggccacctcgtgtttttttttttttttttcccttttttttttcccccttttt

SEQ ID NO: 134617 - DNA, 75 bp, Artificial Sequence
  Synthetic
gagtggctgcggctgagtacgctgaggttacacgccaaggctcgtcctcgttcataacggggctgaccactgata

SEQ ID NO: 134618 - DNA, 75 bp, Artificial Sequence
  Synthetic
ggctttttgtgcagcgtggtatgtgaggggtaagcttgttccgctggtgacctatggcctgacgggtctttggtc

SEQ ID NO: 134619 - DNA, 75 bp, Artificial Sequence
  Synthetic
gtctttcaactcttcgggctgccctgataggctcgccagctgtcgcccccttgaccagttcgctcagggctgggg

SEQ ID NO: 134620 - DNA, 75 bp, Artificial Sequence
  Synthetic
aaggtcacttttgaccgccttcaagtgcttgatgaccactaccggactacactagaggaggttaaggcccgggca

SEQ ID NO: 134621 - DNA, 75 bp, Artificial Sequence
  Synthetic
ggacgaggtctctttctctgtaggtcttaacgactatgtcgtcggatctcagcttctttgcgagcccgagccaga

SEQ ID NO: 134622 - DNA, 75 bp, Artificial Sequence
  Synthetic
tttaccttgtcaccttggtataagcattggatcggccgcctcatgtggtggaaccagtacaccatatgtagatgt

SEQ ID NO: 134623 - DNA, 75 bp, Artificial Sequence
  Synthetic
ggcccggtgtactgtttcacccctagcccggtggtggtgggaacgaccgacaaggaaggcgtccccacttacacc

SEQ ID NO: 134624 - DNA, 75 bp, Artificial Sequence
  Synthetic
ccaggaggacgcggcgagcctgagagccttcacggaggctatgaccaggtactccgccccccccggggacccccc

SEQ ID NO: 134625 - DNA, 75 bp, Artificial Sequence
  Synthetic
tcatcggcaagccaactttccgctccatccttgaaggccacttgcaccacccacgcgaagacttttgacattgac

SEQ ID NO: 134626 - DNA, 75 bp, Artificial Sequence
  Synthetic
agacttgcggagcgcccccttgtaacattgggggcgtgggcaataacaccctgctctgtcccaccgactgtttcc

SEQ ID NO: 134627 - DNA, 75 bp, Artificial Sequence
  Synthetic
tacaacgttgtccaaaagctcccccaggctataatgggggaggcttacggcttccaatattctcctgcgcaacgg

SEQ ID NO: 134628 - DNA, 75 bp, Artificial Sequence
  Synthetic
tacaacgttgtccaaaagctcccccaggctataatgggggaggcttacggcttccaatattctcctgcgcatcgg

SEQ ID NO: 134629 - DNA, 75 bp, Artificial Sequence
  Synthetic
tacaacgttgtccaaaagctcccccaggctataatgggggaggcttacggcttccaatattctcctgcgcaccgg

SEQ ID NO: 134630 - DNA, 75 bp, Artificial Sequence
  Synthetic
tacaacgttgtccaaaagctcccccaggctataatgggggaggcttacggcttccaatattctcctgcgcagcgg

SEQ ID NO: 134631 - DNA, 75 bp, Artificial Sequence
  Synthetic
gacccgccccaaccagaatacgacttggagctgataacatcatgctcctccaatgtgtcggtcgcgcacgatgca

SEQ ID NO: 134632 - DNA, 75 bp, Artificial Sequence
  Synthetic
aggacgaacgggagccctcagtgccgtcagagtgtttgctcccacgcaagaggttccctccggccatccccgtct

SEQ ID NO: 134633 - DNA, 75 bp, Artificial Sequence
  Synthetic
cactgtcaactacactcagtttaagatcaggatgtatgtggggggggtcgaacataggctgaatgctgcctgcaa

SEQ ID NO: 134634 - DNA, 75 bp, Artificial Sequence
  Synthetic
cactgaacctgtaatatttagtcccatggaaatcaaggtcattacttggggcgcagacacggcggcttgcggaga

SEQ ID NO: 134635 - DNA, 75 bp, Artificial Sequence
  Synthetic
agaccgaagaagaggtgtatcagtgttgagacctggaccccgagactcgcaaagtaatatccgcccttacagaaa

SEQ ID NO: 134636 - DNA, 75 bp, Artificial Sequence
  Synthetic
agaccgaagaagaggtgtatcagtgttgtgacctggaccccgagactcgcaaagtaatatccgcccttacagaaa

SEQ ID NO: 134637 - DNA, 75 bp, Artificial Sequence
  Synthetic
agaccgaagaagaggtgtatcagtgttgcgacctggaccccgagactcgcaaagtaatatccgcccttacagaaa

SEQ ID NO: 134638 - DNA, 75 bp, Artificial Sequence
  Synthetic
agaccgaagaagaggtgtatcagtgttgggacctggaccccgagactcgcaaagtaatatccgcccttacagaaa

SEQ ID NO: 134639 - DNA, 75 bp, Artificial Sequence
  Synthetic
agtccgaagaagaggtgtatcagtgttgagacctggaccccgagactcgcaaagtaatatccgcccttacagaaa

SEQ ID NO: 134640 - DNA, 75 bp, Artificial Sequence
  Synthetic
agtccgaagaagaggtgtatcagtgttgtgacctggaccccgagactcgcaaagtaatatccgcccttacagaaa

SEQ ID NO: 134641 - DNA, 75 bp, Artificial Sequence
  Synthetic
agtccgaagaagaggtgtatcagtgttgcgacctggaccccgagactcgcaaagtaatatccgcccttacagaaa

SEQ ID NO: 134642 - DNA, 75 bp, Artificial Sequence
  Synthetic
agtccgaagaagaggtgtatcagtgttgggacctggaccccgagactcgcaaagtaatatccgcccttacagaaa

SEQ ID NO: 134643 - DNA, 75 bp, Artificial Sequence
  Synthetic
agcccgaagaagaggtgtatcagtgttgagacctggaccccgagactcgcaaagtaatatccgcccttacagaaa

SEQ ID NO: 134644 - DNA, 75 bp, Artificial Sequence
  Synthetic
agcccgaagaagaggtgtatcagtgttgtgacctggaccccgagactcgcaaagtaatatccgcccttacagaaa

SEQ ID NO: 134645 - DNA, 75 bp, Artificial Sequence
  Synthetic
agcccgaagaagaggtgtatcagtgttgcgacctggaccccgagactcgcaaagtaatatccgcccttacagaaa

SEQ ID NO: 134646 - DNA, 75 bp, Artificial Sequence
  Synthetic
agcccgaagaagaggtgtatcagtgttgggacctggaccccgagactcgcaaagtaatatccgcccttacagaaa

SEQ ID NO: 134647 - DNA, 75 bp, Artificial Sequence
  Synthetic
aggccgaagaagaggtgtatcagtgttgagacctggaccccgagactcgcaaagtaatatccgcccttacagaaa

SEQ ID NO: 134648 - DNA, 75 bp, Artificial Sequence
  Synthetic
aggccgaagaagaggtgtatcagtgttgtgacctggaccccgagactcgcaaagtaatatccgcccttacagaaa

SEQ ID NO: 134649 - DNA, 75 bp, Artificial Sequence
  Synthetic
aggccgaagaagaggtgtatcagtgttgcgacctggaccccgagactcgcaaagtaatatccgcccttacagaaa

SEQ ID NO: 134650 - DNA, 75 bp, Artificial Sequence
  Synthetic
aggccgaagaagaggtgtatcagtgttgggacctggaccccgagactcgcaaagtaatatccgcccttacagaaa

SEQ ID NO: 134651 - DNA, 75 bp, Artificial Sequence
  Synthetic
gaccccggtgccccctccgaggaggcggcgcgctgtggtgctgactgaaagtaacgtgggagaagtccttaaggg

SEQ ID NO: 134652 - DNA, 75 bp, Artificial Sequence
  Synthetic
ttcactaccctaccggccttgtccaccggccttatccacctccaccagaacatcgtggatgtgcaatacctatat

SEQ ID NO: 134653 - DNA, 75 bp, Artificial Sequence
  Synthetic
aacgccaacggtagctggcacatcaatcgtacggccctaaactgcaacgagagccttaacaccggctggttagca

SEQ ID NO: 134654 - DNA, 75 bp, Artificial Sequence
  Synthetic
atcacagcatatgcccagcaaactaggggcctttttgggactattgtgaccagcttgaccggcagggataagaat

SEQ ID NO: 134655 - DNA, 75 bp, Artificial Sequence
  Synthetic
actgacatgctacatcaaggccacggcagctgccaaggccgcgggcctgaagaacactaccatgctggtgtgtgg

SEQ ID NO: 134656 - DNA, 75 bp, Artificial Sequence
  Synthetic
ggagactctggctcggagacggggtcgctctcttcgatgcctcctctagaaggggaacctggggaccccgacctg

SEQ ID NO: 134657 - DNA, 75 bp, Artificial Sequence
  Synthetic
tgatgctactcatatcccaggcagaagcagccttggaaaacctcgtggtgctcaacgccgcatccctggctggga

SEQ ID NO: 134658 - DNA, 75 bp, Artificial Sequence
  Synthetic
ggtgacgccccgcaaccagcgtatgacttagagctgataacatcaagctcttccaatgtctcagtcgcgcatgat

SEQ ID NO: 134659 - DNA, 75 bp, Artificial Sequence
  Synthetic
ggtgacgccccgcaaccagcgtatgacttagagctgataacatcatgctcttccaatgtctcagtcgcgcatgat

SEQ ID NO: 134660 - DNA, 75 bp, Artificial Sequence
  Synthetic
ggtgacgccccgcaaccagcgtatgacttagagctgataacatcacgctcttccaatgtctcagtcgcgcatgat

SEQ ID NO: 134661 - DNA, 75 bp, Artificial Sequence
  Synthetic
ggtgacgccccgcaaccagcgtatgacttagagctgataacatcaggctcttccaatgtctcagtcgcgcatgat

SEQ ID NO: 134662 - DNA, 75 bp, Artificial Sequence
  Synthetic
ttccaatgtctcagtcgcgcatgatgggggagggaaaaaggtctactacctcacgagagaccctgaaatccccct

SEQ ID NO: 134663 - DNA, 75 bp, Artificial Sequence
  Synthetic
cagcccctccgggggctaagtctctcgagccgtgcacctgcggatctacagacttatacttggttacccgcgagg

SEQ ID NO: 134664 - DNA, 75 bp, Artificial Sequence
  Synthetic
ccatcatctgttgctccatgtcatactcttggactggtgccctcgtgaccccctgtgggccagaggaggaaaaat

SEQ ID NO: 134665 - DNA, 75 bp, Artificial Sequence
  Synthetic
tttgctcctgctccttttggcgttgcctcagcgggcgtacgccatggacacggaggtggccgcgtcgtgtggcgg

SEQ ID NO: 134666 - DNA, 75 bp, Artificial Sequence
  Synthetic
cacagattcaactctacaggctgtcccgagaggttggccagctgcaagcgcctcactgactttgcccagggctgg

SEQ ID NO: 134667 - DNA, 75 bp, Artificial Sequence
  Synthetic
tctacctgctccccaaccggtgaacggggagctaaacactccaggccaataggccatcctgtttttttttttttt

SEQ ID NO: 134668 - DNA, 75 bp, Artificial Sequence
  Synthetic
tgacagagtgcagatcttagacaaacattatgagtctgcacttgaggacgtaagagctgctgcttccaaggttag

SEQ ID NO: 134669 - DNA, 75 bp, Artificial Sequence
  Synthetic
agcactaaggtgccggctgcatatgcagcccaagggtacaaggtactcgtcctgaacccgtccgttgccgccacc

SEQ ID NO: 134670 - DNA, 75 bp, Artificial Sequence
  Synthetic
gaggcagcgttgcaggtgtgggcccccccccttaacgttcgggggggccgcgatgccatcatcctgcttatgtgt

SEQ ID NO: 134671 - DNA, 75 bp, Artificial Sequence
  Synthetic
agacatcgggccagagcagtacgcgccaagctcatcgcccagggaggaagagccaaaatatgcggcatctacctc

SEQ ID NO: 134672 - DNA, 75 bp, Artificial Sequence
  Synthetic
ttgtgcgcgttcaaggcctcctccgcctctgtgcgctagtgcgcaagatggcggggggccattacgtgcaattag

SEQ ID NO: 134673 - DNA, 75 bp, Artificial Sequence
  Synthetic
ccgtgtgggaggacctcctggaagaccaacaaacaccaattgacaccaccatcatggccaaaaatgaggtgttct

SEQ ID NO: 134674 - DNA, 75 bp, Artificial Sequence
  Synthetic
cctctgtgcgctagtgcgcaagatggcggggggccattacgtgcaattagtcatcatcaagttgggggcgctcac

SEQ ID NO: 134675 - DNA, 75 bp, Artificial Sequence
  Synthetic
ctacctcttccccaaccgatgaaggttggggtaaacactccggcctcttaggccatttcctggtttttttttttt

SEQ ID NO: 134676 - DNA, 75 bp, Artificial Sequence
  Synthetic
ccaaaagctcccacaagcagttatgggggaagcttatgggttccaatactctccggcccagcgggtcgacttcct

SEQ ID NO: 134677 - DNA, 75 bp, Artificial Sequence
  Synthetic
ctactcctactgtccgtaggggtaggcatctttctgctgcccgcccggtaggcgggtaacactccgaccttaggg

SEQ ID NO: 134678 - DNA, 75 bp, Artificial Sequence
  Synthetic
gggcagacaccgctgcatgcggggacatcatcgacggtctgcctgtctccgcccgaagaggcaaggagatattgc

SEQ ID NO: 134679 - DNA, 75 bp, Artificial Sequence
  Synthetic
tccatttaccaagcgtgctccctgtctaaggagacacggactgtcatacactcactaacagagagactctacgtg

SEQ ID NO: 134680 - DNA, 75 bp, Artificial Sequence
  Synthetic
cagcctcactggccgggacaagaaccaggtggagggtgagattcagatcgtatccaccgccacccagaccttcct

SEQ ID NO: 134681 - DNA, 75 bp, Artificial Sequence
  Synthetic
ggcaggcctgcgggtacaggcgttgtcgcgccagcggggttcttactactagcatgggaaataccatcacgtgct

SEQ ID NO: 134682 - DNA, 75 bp, Artificial Sequence
  Synthetic
cgcacttctctcgtgcttgaccgtcccggcctcagcagtcccctaccggaatgcctctggggtctatcatgtcac

SEQ ID NO: 134683 - DNA, 75 bp, Artificial Sequence
  Synthetic
tgcaactgttctatctaccccggccatataacgggtcaccgcatggcgtgggatatgatgatgaactggtcccct

SEQ ID NO: 134684 - DNA, 75 bp, Artificial Sequence
  Synthetic
gtggaccaagacctcgtgggctggccggcaccggcggggtcgcgctccctggtgccctgcacctgcggctcctca

SEQ ID NO: 134685 - DNA, 75 bp, Artificial Sequence
  Synthetic
tgctgggttcaaatcaccccctcgctgtcagccccgacctttggagcggttacggctcctcttcggagggccgtt

SEQ ID NO: 134686 - DNA, 75 bp, Artificial Sequence
  Synthetic
ggacatgatcgctggtgctcactggggagtcctagcgggcatagcgtatttctccatggtggggaactgggcgaa

SEQ ID NO: 134687 - DNA, 75 bp, Artificial Sequence
  Synthetic
caactcgtccggatgcccagagcgcatggccagctgtcgccccatcgacaagttcgcccaggggtggggtcccat

SEQ ID NO: 134688 - DNA, 75 bp, Artificial Sequence
  Synthetic
agggttcatcgggcggcccgctgttgtgcccctcgggtcatgctgtaggcatattcagagccgcagtatgtactc

SEQ ID NO: 134689 - DNA, 75 bp, Artificial Sequence
  Synthetic
cctaccactccactcgctagagcagcttgggaaacagcaaaacactcccctgtcaattcatggttgggaaacatc

SEQ ID NO: 134690 - DNA, 75 bp, Artificial Sequence
  Synthetic
ttcttgcagggtatggcgcgggcgtggcgggagctcttgtggcattcaagatcatgagcggtgaggtcccctcca

SEQ ID NO: 134691 - DNA, 75 bp, Artificial Sequence
  Synthetic
catttagacttttgggagagcgtcttcactggactgactcacatagatgcccactttctgtcacagactaagcag

SEQ ID NO: 134692 - DNA, 75 bp, Artificial Sequence
  Synthetic
ttgctctttctctatcttcctcttggcacttctctcgtgtctcaccacccccgcttcagcagttcattacagaaa

SEQ ID NO: 134693 - DNA, 75 bp, Artificial Sequence
  Synthetic
ccagacctaccaggtggcccacctacatgctcccactggcagtggtaagagcactaaggttccggctgcctacgc

SEQ ID NO: 134694 - DNA, 75 bp, Artificial Sequence
  Synthetic
acatcattgccgggggccactggggggtcttgttcgccgccgcgtacttcgcgtcagcggctaactgggccaagg

SEQ ID NO: 134695 - DNA, 75 bp, Artificial Sequence
  Synthetic
agatgtatggagcagtttactcagtttccccgctggatctcccagccataattcaaagactccatgggcttgacg

SEQ ID NO: 134696 - DNA, 75 bp, Artificial Sequence
  Synthetic
gcactaaggttccggctgcctacgcggcccaggggtacaaggtactggtgctcaacccctctgttgcttcaacct

SEQ ID NO: 134697 - DNA, 75 bp, Artificial Sequence
  Synthetic
gtcttcggacccctttggattcttcaagccagtttgcttaaagtgccctacttcgtgcgcgttcaaggccttctc

SEQ ID NO: 134698 - DNA, 75 bp, Artificial Sequence
  Synthetic
ggtcttgttcgccgccgcgtacttcgcgtcagcggctaactgggccaaggttgtgttggtcttgtttctgtttgc

SEQ ID NO: 134699 - DNA, 75 bp, Artificial Sequence
  Synthetic
gtcaggacgcacaacacgtcgcagtgctgggtccctgtttcccccaccctggctgttccgaacgcttcagtgccg

SEQ ID NO: 134700 - DNA, 75 bp, Artificial Sequence
  Synthetic
gcgtgcagtgagggcgtctctcatcgcccggggggggagggcggccgtctgtggccaatacctcttcaactgggc

SEQ ID NO: 134701 - DNA, 75 bp, Artificial Sequence
  Synthetic
gcccggggggggagggcggccgtctgtggccaatacctcttcaactgggcggtgagaaccaagctcaaactcact

SEQ ID NO: 134702 - DNA, 75 bp, Artificial Sequence
  Synthetic
ctcataaataccaacgggagctggcatatcaacagaactgccctcaattgcaatgacagcctccagactgggttt

SEQ ID NO: 134703 - DNA, 75 bp, Artificial Sequence
  Synthetic
ttacggcaagtttcttgctgacggtggttgttcggggggcgcttatgacataataatttgtgacgagtgccattc

SEQ ID NO: 134704 - DNA, 75 bp, Artificial Sequence
  Synthetic
gacagctctttaccttccagcccagaaagcatactaccacccaggattgcaattgttccatctataccggccacg

SEQ ID NO: 134705 - DNA, 75 bp, Artificial Sequence
  Synthetic
caatacgatgagatggaggagtgctcgcaagccgccccatatatcgaacaagctcaggtaatagcccaccagttc

SEQ ID NO: 134706 - DNA, 75 bp, Artificial Sequence
  Synthetic
tccatcacggtgccccactccaatatcgaggaggtcgctctgtccaccaccggagaaatccccttctatggcaaa

SEQ ID NO: 134707 - DNA, 75 bp, Artificial Sequence
  Synthetic
gataatactcgaggggcattggggtgtcatcggtgctttgctgtattacagcatgacggcgaattgggccaaagt

SEQ ID NO: 134708 - DNA, 75 bp, Artificial Sequence
  Synthetic
ttcaaagaagaagtgcgatgaacttgctacgaagctagtcagcatgggagtgaacgccgtggcctactatcgcgg

SEQ ID NO: 134709 - DNA, 75 bp, Artificial Sequence
  Synthetic
ttcaaagaagaagtgcgatgaacttgctacgaagctagtctgcatgggagtgaacgccgtggcctactatcgcgg

SEQ ID NO: 134710 - DNA, 75 bp, Artificial Sequence
  Synthetic
ttcaaagaagaagtgcgatgaacttgctacgaagctagtccgcatgggagtgaacgccgtggcctactatcgcgg

SEQ ID NO: 134711 - DNA, 75 bp, Artificial Sequence
  Synthetic
ttcaaagaagaagtgcgatgaacttgctacgaagctagtcggcatgggagtgaacgccgtggcctactatcgcgg

SEQ ID NO: 134712 - DNA, 75 bp, Artificial Sequence
  Synthetic
cccggcgctaggcaaaacctccagctcatcaacaccaacggtagctggcatatcaataggactgccctcaactgc

SEQ ID NO: 134713 - DNA, 75 bp, Artificial Sequence
  Synthetic
tcatcaacaccaacggtagctggcatatcaataggactgccctcaactgcaacgacagcctccagaccggcttta

SEQ ID NO: 134714 - DNA, 75 bp, Artificial Sequence
  Synthetic
ttggggcgcctccccttagagcgtggaagagtcgggcgcgtgctgtgagggcctcactcatcgcccagggaggga

SEQ ID NO: 134715 - DNA, 75 bp, Artificial Sequence
  Synthetic
cactcctcggtgcttggtggactacccttaccggttgtggcattatccgtgcaccgtaaactacaccatcttcaa

SEQ ID NO: 134716 - DNA, 75 bp, Artificial Sequence
  Synthetic
ccttaccggttgtggcattatccgtgcaccgtaaactacaccatcttcaaggtgcgcatgttcattgggggcata

SEQ ID NO: 134717 - DNA, 75 bp, Artificial Sequence
  Synthetic
tatccagtatgccaacatatccggtccttccgaggataagccgtactgctggcattacgcgcctaggccctgcca

SEQ ID NO: 134718 - DNA, 75 bp, Artificial Sequence
  Synthetic
ctatgacgcggggtgcgcttggtacgagctcactcccgctgagaccacagtcagactgcgagcatacatgaatac

SEQ ID NO: 134719 - DNA, 75 bp, Artificial Sequence
  Synthetic
ctcaatgcagcgtctctggccgggacgcacggtcttgcgtccttcctcgtgttcttctgctttgcatggtatctg

SEQ ID NO: 134720 - DNA, 75 bp, Artificial Sequence
  Synthetic
agggttgagtcagagaacaaagtggtgattctggactccttcgatccgcttgtggcggaggaggatgagcgggag

SEQ ID NO: 134721 - DNA, 75 bp, Artificial Sequence
  Synthetic
tggggggaaaatgagactgatgtgcttatcctgcagagtgccagacctcctcgtggcgtctggttcggatgcacc

SEQ ID NO: 134722 - DNA, 75 bp, Artificial Sequence
  Synthetic
agcggggagaattttccatatctggtagcataccaagccactgtgtgcgccagggctcgcgcccctcccccgtcg

SEQ ID NO: 134723 - DNA, 75 bp, Artificial Sequence
  Synthetic
agtggatcaatgaagactacccaagtccttgcagcggtgattggctgcgtaccatctgggactgggtttgcacga

SEQ ID NO: 134724 - DNA, 75 bp, Artificial Sequence
  Synthetic
tgggccgttaagtgggagtacgtggtactggtcttcttactactcgctgatgcccgtatctgtacttgcttatgg

SEQ ID NO: 134725 - DNA, 75 bp, Artificial Sequence
  Synthetic
gcttccgcaagcatccgggggcgacctacgcaagatgtgggtcggggccttggctcaccccccgatgcttggttg

SEQ ID NO: 134726 - DNA, 75 bp, Artificial Sequence
  Synthetic
gaagcgctactgcacgtgtgggtcccccccctcaatgtccgaggagggcgcgacgctgtcatcctgctcacgtgt

SEQ ID NO: 134727 - DNA, 75 bp, Artificial Sequence
  Synthetic
tgtgtggtcatagtgggcaggatcaatctctccgggaagccagcagttatacctgacagagaggtactctaccag

SEQ ID NO: 134728 - DNA, 75 bp, Artificial Sequence
  Synthetic
tgtgtggtcatagtgggcaggatcaatctctccgggaagccagcagttatacctgacagagaggttctctaccag

SEQ ID NO: 134729 - DNA, 75 bp, Artificial Sequence
  Synthetic
tgtgtggtcatagtgggcaggatcaatctctccgggaagccagcagttatacctgacagagaggtcctctaccag

SEQ ID NO: 134730 - DNA, 75 bp, Artificial Sequence
  Synthetic
tgtgtggtcatagtgggcaggatcaatctctccgggaagccagcagttatacctgacagagaggtgctctaccag

SEQ ID NO: 134731 - DNA, 75 bp, Artificial Sequence
  Synthetic
aacatgtggcacggcactttccccatcaatgagtacaccaccggacccagcacaccttgcccatcacccaactac

SEQ ID NO: 134732 - DNA, 75 bp, Artificial Sequence
  Synthetic
ttgcaactggacccgtggggaacggtgcgagttggatgacagggacagggtagagatgagtccactcctgttttc

SEQ ID NO: 134733 - DNA, 75 bp, Artificial Sequence
  Synthetic
aacacgcgtcccgccaggctgagaccattacccccattgttgagaccaactggcaaaagcttgagaccttctggg

SEQ ID NO: 134734 - DNA, 75 bp, Artificial Sequence
  Synthetic
ctctatggactgtctacggccgttgtgtcgtgggcgatcaagtgggagtacgtggtcctaacctttttggtgctg

SEQ ID NO: 134735 - DNA, 75 bp, Artificial Sequence
  Synthetic
tggcaaaagcttgagaccttctgggcgaaacacatgtggaatttcatcagtgggatacagtacctagcgggtctg

SEQ ID NO: 134736 - DNA, 75 bp, Artificial Sequence
  Synthetic
cctctttcaccctgccctggggtttgagatcacaaaaatcctcctcgggatattaggacccttgtacctgctgca

SEQ ID NO: 134737 - DNA, 75 bp, Artificial Sequence
  Synthetic
aggcagaagaaggtcacatttgacagactgcaagtcctggacagccattaccaggacgtgcttaaggaggttaag

SEQ ID NO: 134738 - DNA, 75 bp, Artificial Sequence
  Synthetic
actgcccgaattcaagcatagtgtatgaggccgaccatcacatcttgcaccttccaggttgcgtgccctgcgtga

SEQ ID NO: 134739 - DNA, 75 bp, Artificial Sequence
  Synthetic
ctagcaaccagggtctgcttttcgggttggctctcatctgcattgcgtggcatatccggggtagagccgtccccc

SEQ ID NO: 134740 - DNA, 75 bp, Artificial Sequence
  Synthetic
gttggctctcatctgcattgcgtggcatatccggggtagagccgtccccctgttcacctacgcttattttcagct

SEQ ID NO: 134741 - DNA, 75 bp, Artificial Sequence
  Synthetic
ggtggcccttactcctaccgtcgcagcgccatacatcggcgcgccgcttgagtccttacggagtcatgtggatct

SEQ ID NO: 134742 - DNA, 75 bp, Artificial Sequence
  Synthetic
aacatcaccggctcctctgatgacagaccgtattgctggcactatgcacctagaccttgtgacattgtctcggca

SEQ ID NO: 134743 - DNA, 75 bp, Artificial Sequence
  Synthetic
ctctcgtagcttttaaaatcatgagcggcgaggcccctaccgctgaggacatggtcaatctgctccctgccatcc

SEQ ID NO: 134744 - DNA, 75 bp, Artificial Sequence
  Synthetic
actatattcactctcaccccagcctacaaacagctgcttgttagcgtgctttggtggattcagtacttcattgca

SEQ ID NO: 134745 - DNA, 75 bp, Artificial Sequence
  Synthetic
ttggtggattcagtacttcattgcacgcgcagaggcagttgtccatgtgtgggtaccctccttgcaggttcgggg

SEQ ID NO: 134746 - DNA, 75 bp, Artificial Sequence
  Synthetic
ctagggccggccgacgacatcaaatcggcgggttggcgacttctcgcccctatcaccgcgtttgctcagcagacg

SEQ ID NO: 134747 - DNA, 75 bp, Artificial Sequence
  Synthetic
cggcgggttggcgacttctcgcccctatcaccgcgtttgctcagcagacgcgaggggtgttaggcgctataatcg

SEQ ID NO: 134748 - DNA, 75 bp, Artificial Sequence
  Synthetic
agcgttcgcctcaaggggaaatcacgtctcccccacgcactatgtgcctgagagcgacgcagctgcccgcgtcac

SEQ ID NO: 134749 - DNA, 75 bp, Artificial Sequence
  Synthetic
ctccaatatagtttgctcaagaccccctattttgtgcgcgcacagattctcttgcgcgcctgcctggccctccgt

SEQ ID NO: 134750 - DNA, 75 bp, Artificial Sequence
  Synthetic
cctattttgtgcgcgcacagattctcttgcgcgcctgcctggccctccgtaatattgcaggcggaaagtatgccc

SEQ ID NO: 134751 - DNA, 75 bp, Artificial Sequence
  Synthetic
gtggacagtcttccacggggccggctctaagacccttgctggccccaaaggcccggtagtgcaaatgtacaccaa

SEQ ID NO: 134752 - DNA, 75 bp, Artificial Sequence
  Synthetic
gcaagctaattgggccaaagtcatcttagtcctattcctctttgcaggggtcgacgctaacacctatacgactgg

SEQ ID NO: 134753 - DNA, 75 bp, Artificial Sequence
  Synthetic
gcaagctaattgggccaaagtcatcttagtcctattcctctttgcaggggtcgacgctaacacctatacgtctgg

SEQ ID NO: 134754 - DNA, 75 bp, Artificial Sequence
  Synthetic
gcaagctaattgggccaaagtcatcttagtcctattcctctttgcaggggtcgacgctaacacctatacgcctgg

SEQ ID NO: 134755 - DNA, 75 bp, Artificial Sequence
  Synthetic
gcaagctaattgggccaaagtcatcttagtcctattcctctttgcaggggtcgacgctaacacctatacggctgg

SEQ ID NO: 134756 - DNA, 75 bp, Artificial Sequence
  Synthetic
gagatctgggagtgggtgtgtgaggtgttgagcgacttcaagaactggctcaaagccaagctcatgccatcggtg

SEQ ID NO: 134757 - DNA, 75 bp, Artificial Sequence
  Synthetic
tgtcgctgtcgagcccgtcattttctctcccatggagaagaaagttatcacttggggcgctgataccgctgcatg

SEQ ID NO: 134758 - DNA, 75 bp, Artificial Sequence
  Synthetic
gacttgagttgtgactcttggtccaccgttagtgacagcgaggagcagagcgtggtctgctgctctatgtcgtac

SEQ ID NO: 134759 - DNA, 75 bp, Artificial Sequence
  Synthetic
ccagactaagcaggcaggagacaacttcccctacttggtagcataccaggctacggtgtgcgccagggctcaggc

SEQ ID NO: 134760 - DNA, 75 bp, Artificial Sequence
  Synthetic
gacatgtcaaaaacgggtcgatgaggattgttggcccaaggacctgcagaaacacctgggacgggtcgttcccca

SEQ ID NO: 134761 - DNA, 75 bp, Artificial Sequence
  Synthetic
aacagctcagggtgtccccagcggctttcaagctgcaggagccttgatagctttggccaaggttggggcccactt

SEQ ID NO: 134762 - DNA, 75 bp, Artificial Sequence
  Synthetic
aacagctcagggtgtccccagcggctttctagctgcaggagccttgatagctttggccaaggttggggcccactt

SEQ ID NO: 134763 - DNA, 75 bp, Artificial Sequence
  Synthetic
aacagctcagggtgtccccagcggctttccagctgcaggagccttgatagctttggccaaggttggggcccactt

SEQ ID NO: 134764 - DNA, 75 bp, Artificial Sequence
  Synthetic
aacagctcagggtgtccccagcggctttcgagctgcaggagccttgatagctttggccaaggttggggcccactt

SEQ ID NO: 134765 - DNA, 75 bp, Artificial Sequence
  Synthetic
tgttttcagggctgccgtgtgcacgcggggcgtcgcgaaggcgctcgagttcattccggttgaaaacctggaaac

SEQ ID NO: 134766 - DNA, 75 bp, Artificial Sequence
  Synthetic
gccccgatcactgcatacgcccagcagactaggggtttgttaggcacaatcgtcaccagccttactggccgtgat

SEQ ID NO: 134767 - DNA, 75 bp, Artificial Sequence
  Synthetic
agactaggggtttgttaggcacaatcgtcaccagccttactggccgtgataaggacgaagtggagggggagattc

SEQ ID NO: 134768 - DNA, 75 bp, Artificial Sequence
  Synthetic
agtgggggacttccattacgtaacgggcatgactacagacaaccttaagtgcccatgccaggtcccatcacccga

SEQ ID NO: 134769 - DNA, 75 bp, Artificial Sequence
  Synthetic
cttacattgaacaaggaatgcagctcgccgaacaattcaagcagaaggcactcgggttgttacagacagccacca

SEQ ID NO: 134770 - DNA, 75 bp, Artificial Sequence
  Synthetic
gctcgcatgctcactatcgaggaagcgtgcgcgctcgtccctccccactctgcccggtcgaagttcgggtatagt

SEQ ID NO: 134771 - DNA, 75 bp, Artificial Sequence
  Synthetic
aaaaggcccagtatgccaaatgtacaccaatgttgaccaggacctggtgggttggccagccccgcctggagcacg

SEQ ID NO: 134772 - DNA, 75 bp, Artificial Sequence
  Synthetic
gggaaccccgcaatagcatcactgatggcattcacagcctctatcaccagcccgctcaccacccaacacaccctc

SEQ ID NO: 134773 - DNA, 75 bp, Artificial Sequence
  Synthetic
tacctggtaggatcgcagttaccctgcgaacccgaaccagatgtggaagtgttgacgtccatgcttactgaccct

SEQ ID NO: 134774 - DNA, 75 bp, Artificial Sequence
  Synthetic
tcgagcgacctctatctcatcacgaggaatgccgatgttgtccctgcaaggcgcaggggtgatactcgggcggct

SEQ ID NO: 134775 - DNA, 75 bp, Artificial Sequence
  Synthetic
gccccactgattgtttcaggaagcacccggagaccacctatgccaaatgcgggtcagggccttggatcacgccac

SEQ ID NO: 134776 - DNA, 75 bp, Artificial Sequence
  Synthetic
aggctacatgcacggccaatcacgactcccctgacgccgatctcatagaagcaaatctcctgtggagacaggaga

SEQ ID NO: 134777 - DNA, 75 bp, Artificial Sequence
  Synthetic
gcaccaggggcgtggcaaagtctcttgattttgtccctgtggagagcatgcagtctaccgctcgctctccctcct

SEQ ID NO: 134778 - DNA, 75 bp, Artificial Sequence
  Synthetic
cagtgtgacaacgccccacccaaacatcgaggaggtggccctgccttcggagggggaaatccccttctacggcag

SEQ ID NO: 134779 - DNA, 75 bp, Artificial Sequence
  Synthetic
gcctgcagagatcttgcggaagaccaagaagttccccctcgccctacccatctgggctagggaggactacaatcc

SEQ ID NO: 134780 - DNA, 75 bp, Artificial Sequence
  Synthetic
accgacgcgctcatgacgggatttaccggcgactttgattctgttatagactgcaactccgccgtcactcagacg

SEQ ID NO: 134781 - DNA, 75 bp, Artificial Sequence
  Synthetic
aggaagcggccagtcacactgaccgattcaaccatatctactgccttggctgagctcgccgctaaatctttcggc

SEQ ID NO: 134782 - DNA, 75 bp, Artificial Sequence
  Synthetic
gatgggggttgctctggtggggcttatgacgtcatcatctgtgatgaatgccattcaacagatcctactactgtc

SEQ ID NO: 134783 - DNA, 75 bp, Artificial Sequence
  Synthetic
tgcaatggctggtatatcaagggtcggcttccggccgctgctacctacgctgcttgcggcatgtggcccatgctc

SEQ ID NO: 134784 - DNA, 75 bp, Artificial Sequence
  Synthetic
tgcaatggctggtatatcaagggtcggcttccggccgctgctacctacgctgcttgcggcatgtggcccttgctc

SEQ ID NO: 134785 - DNA, 75 bp, Artificial Sequence
  Synthetic
tgcaatggctggtatatcaagggtcggcttccggccgctgctacctacgctgcttgcggcatgtggcccctgctc

SEQ ID NO: 134786 - DNA, 75 bp, Artificial Sequence
  Synthetic
tgcaatggctggtatatcaagggtcggcttccggccgctgctacctacgctgcttgcggcatgtggcccgtgctc

SEQ ID NO: 134787 - DNA, 75 bp, Artificial Sequence
  Synthetic
tgcaatggctggtatttcaagggtcggcttccggccgctgctacctacgctgcttgcggcatgtggcccatgctc

SEQ ID NO: 134788 - DNA, 75 bp, Artificial Sequence
  Synthetic
tgcaatggctggtatttcaagggtcggcttccggccgctgctacctacgctgcttgcggcatgtggcccttgctc

SEQ ID NO: 134789 - DNA, 75 bp, Artificial Sequence
  Synthetic
tgcaatggctggtatttcaagggtcggcttccggccgctgctacctacgctgcttgcggcatgtggcccctgctc

SEQ ID NO: 134790 - DNA, 75 bp, Artificial Sequence
  Synthetic
tgcaatggctggtatttcaagggtcggcttccggccgctgctacctacgctgcttgcggcatgtggcccgtgctc

SEQ ID NO: 134791 - DNA, 75 bp, Artificial Sequence
  Synthetic
tgcaatggctggtatctcaagggtcggcttccggccgctgctacctacgctgcttgcggcatgtggcccatgctc

SEQ ID NO: 134792 - DNA, 75 bp, Artificial Sequence
  Synthetic
tgcaatggctggtatctcaagggtcggcttccggccgctgctacctacgctgcttgcggcatgtggcccttgctc

SEQ ID NO: 134793 - DNA, 75 bp, Artificial Sequence
  Synthetic
tgcaatggctggtatctcaagggtcggcttccggccgctgctacctacgctgcttgcggcatgtggcccctgctc

SEQ ID NO: 134794 - DNA, 75 bp, Artificial Sequence
  Synthetic
tgcaatggctggtatctcaagggtcggcttccggccgctgctacctacgctgcttgcggcatgtggcccgtgctc

SEQ ID NO: 134795 - DNA, 75 bp, Artificial Sequence
  Synthetic
tgcaatggctggtatgtcaagggtcggcttccggccgctgctacctacgctgcttgcggcatgtggcccatgctc

SEQ ID NO: 134796 - DNA, 75 bp, Artificial Sequence
  Synthetic
tgcaatggctggtatgtcaagggtcggcttccggccgctgctacctacgctgcttgcggcatgtggcccttgctc

SEQ ID NO: 134797 - DNA, 75 bp, Artificial Sequence
  Synthetic
tgcaatggctggtatgtcaagggtcggcttccggccgctgctacctacgctgcttgcggcatgtggcccctgctc

SEQ ID NO: 134798 - DNA, 75 bp, Artificial Sequence
  Synthetic
tgcaatggctggtatgtcaagggtcggcttccggccgctgctacctacgctgcttgcggcatgtggcccgtgctc

SEQ ID NO: 134799 - DNA, 75 bp, Artificial Sequence
  Synthetic
tgcattggctggtatatcaagggtcggcttccggccgctgctacctacgctgcttgcggcatgtggcccatgctc

SEQ ID NO: 134800 - DNA, 75 bp, Artificial Sequence
  Synthetic
tgcattggctggtatatcaagggtcggcttccggccgctgctacctacgctgcttgcggcatgtggcccttgctc

SEQ ID NO: 134801 - DNA, 75 bp, Artificial Sequence
  Synthetic
tgcattggctggtatatcaagggtcggcttccggccgctgctacctacgctgcttgcggcatgtggcccctgctc

SEQ ID NO: 134802 - DNA, 75 bp, Artificial Sequence
  Synthetic
tgcattggctggtatatcaagggtcggcttccggccgctgctacctacgctgcttgcggcatgtggcccgtgctc

SEQ ID NO: 134803 - DNA, 75 bp, Artificial Sequence
  Synthetic
tgcattggctggtatttcaagggtcggcttccggccgctgctacctacgctgcttgcggcatgtggcccatgctc

SEQ ID NO: 134804 - DNA, 75 bp, Artificial Sequence
  Synthetic
tgcattggctggtatttcaagggtcggcttccggccgctgctacctacgctgcttgcggcatgtggcccttgctc

SEQ ID NO: 134805 - DNA, 75 bp, Artificial Sequence
  Synthetic
tgcattggctggtatttcaagggtcggcttccggccgctgctacctacgctgcttgcggcatgtggcccctgctc

SEQ ID NO: 134806 - DNA, 75 bp, Artificial Sequence
  Synthetic
tgcattggctggtatttcaagggtcggcttccggccgctgctacctacgctgcttgcggcatgtggcccgtgctc

SEQ ID NO: 134807 - DNA, 75 bp, Artificial Sequence
  Synthetic
tgcattggctggtatctcaagggtcggcttccggccgctgctacctacgctgcttgcggcatgtggcccatgctc

SEQ ID NO: 134808 - DNA, 75 bp, Artificial Sequence
  Synthetic
tgcattggctggtatctcaagggtcggcttccggccgctgctacctacgctgcttgcggcatgtggcccttgctc

SEQ ID NO: 134809 - DNA, 75 bp, Artificial Sequence
  Synthetic
tgcattggctggtatctcaagggtcggcttccggccgctgctacctacgctgcttgcggcatgtggcccctgctc

SEQ ID NO: 134810 - DNA, 75 bp, Artificial Sequence
  Synthetic
tgcattggctggtatctcaagggtcggcttccggccgctgctacctacgctgcttgcggcatgtggcccgtgctc

SEQ ID NO: 134811 - DNA, 75 bp, Artificial Sequence
  Synthetic
tgcattggctggtatgtcaagggtcggcttccggccgctgctacctacgctgcttgcggcatgtggcccatgctc

SEQ ID NO: 134812 - DNA, 75 bp, Artificial Sequence
  Synthetic
tgcattggctggtatgtcaagggtcggcttccggccgctgctacctacgctgcttgcggcatgtggcccttgctc

SEQ ID NO: 134813 - DNA, 75 bp, Artificial Sequence
  Synthetic
tgcattggctggtatgtcaagggtcggcttccggccgctgctacctacgctgcttgcggcatgtggcccctgctc

SEQ ID NO: 134814 - DNA, 75 bp, Artificial Sequence
  Synthetic
tgcattggctggtatgtcaagggtcggcttccggccgctgctacctacgctgcttgcggcatgtggcccgtgctc

SEQ ID NO: 134815 - DNA, 75 bp, Artificial Sequence
  Synthetic
tgcactggctggtatatcaagggtcggcttccggccgctgctacctacgctgcttgcggcatgtggcccatgctc

SEQ ID NO: 134816 - DNA, 75 bp, Artificial Sequence
  Synthetic
tgcactggctggtatatcaagggtcggcttccggccgctgctacctacgctgcttgcggcatgtggcccttgctc

SEQ ID NO: 134817 - DNA, 75 bp, Artificial Sequence
  Synthetic
tgcactggctggtatatcaagggtcggcttccggccgctgctacctacgctgcttgcggcatgtggcccctgctc

SEQ ID NO: 134818 - DNA, 75 bp, Artificial Sequence
  Synthetic
tgcactggctggtatatcaagggtcggcttccggccgctgctacctacgctgcttgcggcatgtggcccgtgctc

SEQ ID NO: 134819 - DNA, 75 bp, Artificial Sequence
  Synthetic
tgcactggctggtatttcaagggtcggcttccggccgctgctacctacgctgcttgcggcatgtggcccatgctc

SEQ ID NO: 134820 - DNA, 75 bp, Artificial Sequence
  Synthetic
tgcactggctggtatttcaagggtcggcttccggccgctgctacctacgctgcttgcggcatgtggcccttgctc

SEQ ID NO: 134821 - DNA, 75 bp, Artificial Sequence
  Synthetic
tgcactggctggtatttcaagggtcggcttccggccgctgctacctacgctgcttgcggcatgtggcccctgctc

SEQ ID NO: 134822 - DNA, 75 bp, Artificial Sequence
  Synthetic
tgcactggctggtatttcaagggtcggcttccggccgctgctacctacgctgcttgcggcatgtggcccgtgctc

SEQ ID NO: 134823 - DNA, 75 bp, Artificial Sequence
  Synthetic
tgcactggctggtatctcaagggtcggcttccggccgctgctacctacgctgcttgcggcatgtggcccatgctc

SEQ ID NO: 134824 - DNA, 75 bp, Artificial Sequence
  Synthetic
tgcactggctggtatctcaagggtcggcttccggccgctgctacctacgctgcttgcggcatgtggcccttgctc

SEQ ID NO: 134825 - DNA, 75 bp, Artificial Sequence
  Synthetic
tgcactggctggtatctcaagggtcggcttccggccgctgctacctacgctgcttgcggcatgtggcccctgctc

SEQ ID NO: 134826 - DNA, 75 bp, Artificial Sequence
  Synthetic
tgcactggctggtatctcaagggtcggcttccggccgctgctacctacgctgcttgcggcatgtggcccgtgctc

SEQ ID NO: 134827 - DNA, 75 bp, Artificial Sequence
  Synthetic
tgcactggctggtatgtcaagggtcggcttccggccgctgctacctacgctgcttgcggcatgtggcccatgctc

SEQ ID NO: 134828 - DNA, 75 bp, Artificial Sequence
  Synthetic
tgcactggctggtatgtcaagggtcggcttccggccgctgctacctacgctgcttgcggcatgtggcccttgctc

SEQ ID NO: 134829 - DNA, 75 bp, Artificial Sequence
  Synthetic
tgcactggctggtatgtcaagggtcggcttccggccgctgctacctacgctgcttgcggcatgtggcccctgctc

SEQ ID NO: 134830 - DNA, 75 bp, Artificial Sequence
  Synthetic
tgcactggctggtatgtcaagggtcggcttccggccgctgctacctacgctgcttgcggcatgtggcccgtgctc

SEQ ID NO: 134831 - DNA, 75 bp, Artificial Sequence
  Synthetic
tgcagtggctggtatatcaagggtcggcttccggccgctgctacctacgctgcttgcggcatgtggcccatgctc

SEQ ID NO: 134832 - DNA, 75 bp, Artificial Sequence
  Synthetic
tgcagtggctggtatatcaagggtcggcttccggccgctgctacctacgctgcttgcggcatgtggcccttgctc

SEQ ID NO: 134833 - DNA, 75 bp, Artificial Sequence
  Synthetic
tgcagtggctggtatatcaagggtcggcttccggccgctgctacctacgctgcttgcggcatgtggcccctgctc

SEQ ID NO: 134834 - DNA, 75 bp, Artificial Sequence
  Synthetic
tgcagtggctggtatatcaagggtcggcttccggccgctgctacctacgctgcttgcggcatgtggcccgtgctc

SEQ ID NO: 134835 - DNA, 75 bp, Artificial Sequence
  Synthetic
tgcagtggctggtatttcaagggtcggcttccggccgctgctacctacgctgcttgcggcatgtggcccatgctc

SEQ ID NO: 134836 - DNA, 75 bp, Artificial Sequence
  Synthetic
tgcagtggctggtatttcaagggtcggcttccggccgctgctacctacgctgcttgcggcatgtggcccttgctc

SEQ ID NO: 134837 - DNA, 75 bp, Artificial Sequence
  Synthetic
tgcagtggctggtatttcaagggtcggcttccggccgctgctacctacgctgcttgcggcatgtggcccctgctc

SEQ ID NO: 134838 - DNA, 75 bp, Artificial Sequence
  Synthetic
tgcagtggctggtatttcaagggtcggcttccggccgctgctacctacgctgcttgcggcatgtggcccgtgctc

SEQ ID NO: 134839 - DNA, 75 bp, Artificial Sequence
  Synthetic
tgcagtggctggtatctcaagggtcggcttccggccgctgctacctacgctgcttgcggcatgtggcccatgctc

SEQ ID NO: 134840 - DNA, 75 bp, Artificial Sequence
  Synthetic
tgcagtggctggtatctcaagggtcggcttccggccgctgctacctacgctgcttgcggcatgtggcccttgctc

SEQ ID NO: 134841 - DNA, 75 bp, Artificial Sequence
  Synthetic
tgcagtggctggtatctcaagggtcggcttccggccgctgctacctacgctgcttgcggcatgtggcccctgctc

SEQ ID NO: 134842 - DNA, 75 bp, Artificial Sequence
  Synthetic
tgcagtggctggtatctcaagggtcggcttccggccgctgctacctacgctgcttgcggcatgtggcccgtgctc

SEQ ID NO: 134843 - DNA, 75 bp, Artificial Sequence
  Synthetic
tgcagtggctggtatgtcaagggtcggcttccggccgctgctacctacgctgcttgcggcatgtggcccatgctc

SEQ ID NO: 134844 - DNA, 75 bp, Artificial Sequence
  Synthetic
tgcagtggctggtatgtcaagggtcggcttccggccgctgctacctacgctgcttgcggcatgtggcccttgctc

SEQ ID NO: 134845 - DNA, 75 bp, Artificial Sequence
  Synthetic
tgcagtggctggtatgtcaagggtcggcttccggccgctgctacctacgctgcttgcggcatgtggcccctgctc

SEQ ID NO: 134846 - DNA, 75 bp, Artificial Sequence
  Synthetic
tgcagtggctggtatgtcaagggtcggcttccggccgctgctacctacgctgcttgcggcatgtggcccgtgctc

SEQ ID NO: 134847 - DNA, 75 bp, Artificial Sequence
  Synthetic
atgacgtcatcatctgtgatgaatgccattcaacagatcctactactgtcttgggtatagggactgtcttggacc

SEQ ID NO: 134848 - DNA, 75 bp, Artificial Sequence
  Synthetic
ggcacggcatataccggtatgtctcttctggggagagaccgtctggcattttcgactccgtggtgctctgtgagt

SEQ ID NO: 134849 - DNA, 75 bp, Artificial Sequence
  Synthetic
ccatgcccccccttgagggggagcctggggatccagatctcagtgacgggtcgtggtcgacggtcagcagcgagg

SEQ ID NO: 134850 - DNA, 75 bp, Artificial Sequence
  Synthetic
ttctggggagagaccgtctggcattttcgactccgtggtgctctgtgagtgctacgatgccggatgcgcatggta

SEQ ID NO: 134851 - DNA, 75 bp, Artificial Sequence
  Synthetic
tgtcaccacactacaaatcatggctggctaaggggctgtggtggattcaatattttatagctaggaccgaggcca

SEQ ID NO: 134852 - DNA, 75 bp, Artificial Sequence
  Synthetic
tgtctccacactacaaatcatggctggctaaggggctgtggtggattcaatattttatagctaggaccgaggcca

SEQ ID NO: 134853 - DNA, 75 bp, Artificial Sequence
  Synthetic
tgtccccacactacaaatcatggctggctaaggggctgtggtggattcaatattttatagctaggaccgaggcca

SEQ ID NO: 134854 - DNA, 75 bp, Artificial Sequence
  Synthetic
tgtcgccacactacaaatcatggctggctaaggggctgtggtggattcaatattttatagctaggaccgaggcca

SEQ ID NO: 134855 - DNA, 75 bp, Artificial Sequence
  Synthetic
caccactggggaaatacccttctatgggaaggcaatccccctagaattcatcaaggggggaagacatcttatctt

SEQ ID NO: 134856 - DNA, 75 bp, Artificial Sequence
  Synthetic
gggaaggcaatccccctagaattcatcaaggggggaagacatcttatcttttgccattccaagaaaaaatgtgat

SEQ ID NO: 134857 - DNA, 75 bp, Artificial Sequence
  Synthetic
cccccgggctccctgtctgtcaagatcatctggaattttgggagggggtgttcacagggcttactaacatcgacg

SEQ ID NO: 134858 - DNA, 75 bp, Artificial Sequence
  Synthetic
attgagcaattctctactgcgccaccacaacatggtgtattccacctcttcacgcagcgcggggcagaggcagaa

SEQ ID NO: 134859 - DNA, 75 bp, Artificial Sequence
  Synthetic
cccacatgctgtcacagaccaaacagggtggggagaacttcccataccttgtggcgtaccaagcaacagtctgtg

SEQ ID NO: 134860 - DNA, 75 bp, Artificial Sequence
  Synthetic
aaagtacctactggccatcttaggccccctctacgtactacaggcctcgctcctgcgcgttccttactttgtgag

SEQ ID NO: 134861 - DNA, 75 bp, Artificial Sequence
  Synthetic
aaagtacctactggccatcttaggccccctctacgtacttcaggcctcgctcctgcgcgttccttactttgtgag

SEQ ID NO: 134862 - DNA, 75 bp, Artificial Sequence
  Synthetic
aaagtacctactggccatcttaggccccctctacgtactccaggcctcgctcctgcgcgttccttactttgtgag

SEQ ID NO: 134863 - DNA, 75 bp, Artificial Sequence
  Synthetic
aaagtacctactggccatcttaggccccctctacgtactgcaggcctcgctcctgcgcgttccttactttgtgag

SEQ ID NO: 134864 - DNA, 75 bp, Artificial Sequence
  Synthetic
aaagtacctactggccatctttggccccctctacgtactacaggcctcgctcctgcgcgttccttactttgtgag

SEQ ID NO: 134865 - DNA, 75 bp, Artificial Sequence
  Synthetic
aaagtacctactggccatctttggccccctctacgtacttcaggcctcgctcctgcgcgttccttactttgtgag

SEQ ID NO: 134866 - DNA, 75 bp, Artificial Sequence
  Synthetic
aaagtacctactggccatctttggccccctctacgtactccaggcctcgctcctgcgcgttccttactttgtgag

SEQ ID NO: 134867 - DNA, 75 bp, Artificial Sequence
  Synthetic
aaagtacctactggccatctttggccccctctacgtactgcaggcctcgctcctgcgcgttccttactttgtgag

SEQ ID NO: 134868 - DNA, 75 bp, Artificial Sequence
  Synthetic
aaagtacctactggccatcttcggccccctctacgtactacaggcctcgctcctgcgcgttccttactttgtgag

SEQ ID NO: 134869 - DNA, 75 bp, Artificial Sequence
  Synthetic
aaagtacctactggccatcttcggccccctctacgtacttcaggcctcgctcctgcgcgttccttactttgtgag

SEQ ID NO: 134870 - DNA, 75 bp, Artificial Sequence
  Synthetic
aaagtacctactggccatcttcggccccctctacgtactccaggcctcgctcctgcgcgttccttactttgtgag

SEQ ID NO: 134871 - DNA, 75 bp, Artificial Sequence
  Synthetic
aaagtacctactggccatcttcggccccctctacgtactgcaggcctcgctcctgcgcgttccttactttgtgag

SEQ ID NO: 134872 - DNA, 75 bp, Artificial Sequence
  Synthetic
aaagtacctactggccatcttgggccccctctacgtactacaggcctcgctcctgcgcgttccttactttgtgag

SEQ ID NO: 134873 - DNA, 75 bp, Artificial Sequence
  Synthetic
aaagtacctactggccatcttgggccccctctacgtacttcaggcctcgctcctgcgcgttccttactttgtgag

SEQ ID NO: 134874 - DNA, 75 bp, Artificial Sequence
  Synthetic
aaagtacctactggccatcttgggccccctctacgtactccaggcctcgctcctgcgcgttccttactttgtgag

SEQ ID NO: 134875 - DNA, 75 bp, Artificial Sequence
  Synthetic
aaagtacctactggccatcttgggccccctctacgtactgcaggcctcgctcctgcgcgttccttactttgtgag

SEQ ID NO: 134876 - DNA, 75 bp, Artificial Sequence
  Synthetic
aaagtaccttctggccatcttaggccccctctacgtactacaggcctcgctcctgcgcgttccttactttgtgag

SEQ ID NO: 134877 - DNA, 75 bp, Artificial Sequence
  Synthetic
aaagtaccttctggccatcttaggccccctctacgtacttcaggcctcgctcctgcgcgttccttactttgtgag

SEQ ID NO: 134878 - DNA, 75 bp, Artificial Sequence
  Synthetic
aaagtaccttctggccatcttaggccccctctacgtactccaggcctcgctcctgcgcgttccttactttgtgag

SEQ ID NO: 134879 - DNA, 75 bp, Artificial Sequence
  Synthetic
aaagtaccttctggccatcttaggccccctctacgtactgcaggcctcgctcctgcgcgttccttactttgtgag

SEQ ID NO: 134880 - DNA, 75 bp, Artificial Sequence
  Synthetic
aaagtaccttctggccatctttggccccctctacgtactacaggcctcgctcctgcgcgttccttactttgtgag

SEQ ID NO: 134881 - DNA, 75 bp, Artificial Sequence
  Synthetic
aaagtaccttctggccatctttggccccctctacgtacttcaggcctcgctcctgcgcgttccttactttgtgag

SEQ ID NO: 134882 - DNA, 75 bp, Artificial Sequence
  Synthetic
aaagtaccttctggccatctttggccccctctacgtactccaggcctcgctcctgcgcgttccttactttgtgag

SEQ ID NO: 134883 - DNA, 75 bp, Artificial Sequence
  Synthetic
aaagtaccttctggccatctttggccccctctacgtactgcaggcctcgctcctgcgcgttccttactttgtgag

SEQ ID NO: 134884 - DNA, 75 bp, Artificial Sequence
  Synthetic
aaagtaccttctggccatcttcggccccctctacgtactacaggcctcgctcctgcgcgttccttactttgtgag

SEQ ID NO: 134885 - DNA, 75 bp, Artificial Sequence
  Synthetic
aaagtaccttctggccatcttcggccccctctacgtacttcaggcctcgctcctgcgcgttccttactttgtgag

SEQ ID NO: 134886 - DNA, 75 bp, Artificial Sequence
  Synthetic
aaagtaccttctggccatcttcggccccctctacgtactccaggcctcgctcctgcgcgttccttactttgtgag

SEQ ID NO: 134887 - DNA, 75 bp, Artificial Sequence
  Synthetic
aaagtaccttctggccatcttcggccccctctacgtactgcaggcctcgctcctgcgcgttccttactttgtgag

SEQ ID NO: 134888 - DNA, 75 bp, Artificial Sequence
  Synthetic
aaagtaccttctggccatcttgggccccctctacgtactacaggcctcgctcctgcgcgttccttactttgtgag

SEQ ID NO: 134889 - DNA, 75 bp, Artificial Sequence
  Synthetic
aaagtaccttctggccatcttgggccccctctacgtacttcaggcctcgctcctgcgcgttccttactttgtgag

SEQ ID NO: 134890 - DNA, 75 bp, Artificial Sequence
  Synthetic
aaagtaccttctggccatcttgggccccctctacgtactccaggcctcgctcctgcgcgttccttactttgtgag

SEQ ID NO: 134891 - DNA, 75 bp, Artificial Sequence
  Synthetic
aaagtaccttctggccatcttgggccccctctacgtactgcaggcctcgctcctgcgcgttccttactttgtgag

SEQ ID NO: 134892 - DNA, 75 bp, Artificial Sequence
  Synthetic
aaagtacctcctggccatcttaggccccctctacgtactacaggcctcgctcctgcgcgttccttactttgtgag

SEQ ID NO: 134893 - DNA, 75 bp, Artificial Sequence
  Synthetic
aaagtacctcctggccatcttaggccccctctacgtacttcaggcctcgctcctgcgcgttccttactttgtgag

SEQ ID NO: 134894 - DNA, 75 bp, Artificial Sequence
  Synthetic
aaagtacctcctggccatcttaggccccctctacgtactccaggcctcgctcctgcgcgttccttactttgtgag

SEQ ID NO: 134895 - DNA, 75 bp, Artificial Sequence
  Synthetic
aaagtacctcctggccatcttaggccccctctacgtactgcaggcctcgctcctgcgcgttccttactttgtgag

SEQ ID NO: 134896 - DNA, 75 bp, Artificial Sequence
  Synthetic
aaagtacctcctggccatctttggccccctctacgtactacaggcctcgctcctgcgcgttccttactttgtgag

SEQ ID NO: 134897 - DNA, 75 bp, Artificial Sequence
  Synthetic
aaagtacctcctggccatctttggccccctctacgtacttcaggcctcgctcctgcgcgttccttactttgtgag

SEQ ID NO: 134898 - DNA, 75 bp, Artificial Sequence
  Synthetic
aaagtacctcctggccatctttggccccctctacgtactccaggcctcgctcctgcgcgttccttactttgtgag

SEQ ID NO: 134899 - DNA, 75 bp, Artificial Sequence
  Synthetic
aaagtacctcctggccatctttggccccctctacgtactgcaggcctcgctcctgcgcgttccttactttgtgag

SEQ ID NO: 134900 - DNA, 75 bp, Artificial Sequence
  Synthetic
aaagtacctcctggccatcttcggccccctctacgtactacaggcctcgctcctgcgcgttccttactttgtgag

SEQ ID NO: 134901 - DNA, 75 bp, Artificial Sequence
  Synthetic
aaagtacctcctggccatcttcggccccctctacgtacttcaggcctcgctcctgcgcgttccttactttgtgag

SEQ ID NO: 134902 - DNA, 75 bp, Artificial Sequence
  Synthetic
aaagtacctcctggccatcttcggccccctctacgtactccaggcctcgctcctgcgcgttccttactttgtgag

SEQ ID NO: 134903 - DNA, 75 bp, Artificial Sequence
  Synthetic
aaagtacctcctggccatcttcggccccctctacgtactgcaggcctcgctcctgcgcgttccttactttgtgag

SEQ ID NO: 134904 - DNA, 75 bp, Artificial Sequence
  Synthetic
aaagtacctcctggccatcttgggccccctctacgtactacaggcctcgctcctgcgcgttccttactttgtgag

SEQ ID NO: 134905 - DNA, 75 bp, Artificial Sequence
  Synthetic
aaagtacctcctggccatcttgggccccctctacgtacttcaggcctcgctcctgcgcgttccttactttgtgag

SEQ ID NO: 134906 - DNA, 75 bp, Artificial Sequence
  Synthetic
aaagtacctcctggccatcttgggccccctctacgtactccaggcctcgctcctgcgcgttccttactttgtgag

SEQ ID NO: 134907 - DNA, 75 bp, Artificial Sequence
  Synthetic
aaagtacctcctggccatcttgggccccctctacgtactgcaggcctcgctcctgcgcgttccttactttgtgag

SEQ ID NO: 134908 - DNA, 75 bp, Artificial Sequence
  Synthetic
aaagtacctgctggccatcttaggccccctctacgtactacaggcctcgctcctgcgcgttccttactttgtgag

SEQ ID NO: 134909 - DNA, 75 bp, Artificial Sequence
  Synthetic
aaagtacctgctggccatcttaggccccctctacgtacttcaggcctcgctcctgcgcgttccttactttgtgag

SEQ ID NO: 134910 - DNA, 75 bp, Artificial Sequence
  Synthetic
aaagtacctgctggccatcttaggccccctctacgtactccaggcctcgctcctgcgcgttccttactttgtgag

SEQ ID NO: 134911 - DNA, 75 bp, Artificial Sequence
  Synthetic
aaagtacctgctggccatcttaggccccctctacgtactgcaggcctcgctcctgcgcgttccttactttgtgag

SEQ ID NO: 134912 - DNA, 75 bp, Artificial Sequence
  Synthetic
aaagtacctgctggccatctttggccccctctacgtactacaggcctcgctcctgcgcgttccttactttgtgag

SEQ ID NO: 134913 - DNA, 75 bp, Artificial Sequence
  Synthetic
aaagtacctgctggccatctttggccccctctacgtacttcaggcctcgctcctgcgcgttccttactttgtgag

SEQ ID NO: 134914 - DNA, 75 bp, Artificial Sequence
  Synthetic
aaagtacctgctggccatctttggccccctctacgtactccaggcctcgctcctgcgcgttccttactttgtgag

SEQ ID NO: 134915 - DNA, 75 bp, Artificial Sequence
  Synthetic
aaagtacctgctggccatctttggccccctctacgtactgcaggcctcgctcctgcgcgttccttactttgtgag

SEQ ID NO: 134916 - DNA, 75 bp, Artificial Sequence
  Synthetic
aaagtacctgctggccatcttcggccccctctacgtactacaggcctcgctcctgcgcgttccttactttgtgag

SEQ ID NO: 134917 - DNA, 75 bp, Artificial Sequence
  Synthetic
aaagtacctgctggccatcttcggccccctctacgtacttcaggcctcgctcctgcgcgttccttactttgtgag

SEQ ID NO: 134918 - DNA, 75 bp, Artificial Sequence
  Synthetic
aaagtacctgctggccatcttcggccccctctacgtactccaggcctcgctcctgcgcgttccttactttgtgag

SEQ ID NO: 134919 - DNA, 75 bp, Artificial Sequence
  Synthetic
aaagtacctgctggccatcttcggccccctctacgtactgcaggcctcgctcctgcgcgttccttactttgtgag

SEQ ID NO: 134920 - DNA, 75 bp, Artificial Sequence
  Synthetic
aaagtacctgctggccatcttgggccccctctacgtactacaggcctcgctcctgcgcgttccttactttgtgag

SEQ ID NO: 134921 - DNA, 75 bp, Artificial Sequence
  Synthetic
aaagtacctgctggccatcttgggccccctctacgtacttcaggcctcgctcctgcgcgttccttactttgtgag

SEQ ID NO: 134922 - DNA, 75 bp, Artificial Sequence
  Synthetic
aaagtacctgctggccatcttgggccccctctacgtactccaggcctcgctcctgcgcgttccttactttgtgag

SEQ ID NO: 134923 - DNA, 75 bp, Artificial Sequence
  Synthetic
aaagtacctgctggccatcttgggccccctctacgtactgcaggcctcgctcctgcgcgttccttactttgtgag

SEQ ID NO: 134924 - DNA, 75 bp, Artificial Sequence
  Synthetic
gtgccactgatgccctcatgactggctatacaggtgactttgactccgtgatagactgtaatgtttctgtcacac

SEQ ID NO: 134925 - DNA, 75 bp, Artificial Sequence
  Synthetic
ggcacaagcgctggttaagatctgcagcttgttgcgtggggtagcctgtggcaagtattgccaaatggctatgct

SEQ ID NO: 134926 - DNA, 75 bp, Artificial Sequence
  Synthetic
ggcacaagcgctggttaagatctgctgcttgttgcgtggggtagcctgtggcaagtattgccaaatggctatgct

SEQ ID NO: 134927 - DNA, 75 bp, Artificial Sequence
  Synthetic
ggcacaagcgctggttaagatctgccgcttgttgcgtggggtagcctgtggcaagtattgccaaatggctatgct

SEQ ID NO: 134928 - DNA, 75 bp, Artificial Sequence
  Synthetic
ggcacaagcgctggttaagatctgcggcttgttgcgtggggtagcctgtggcaagtattgccaaatggctatgct

SEQ ID NO: 134929 - DNA, 75 bp, Artificial Sequence
  Synthetic
ggcacatgcgctggttaagatctgcagcttgttgcgtggggtagcctgtggcaagtattgccaaatggctatgct

SEQ ID NO: 134930 - DNA, 75 bp, Artificial Sequence
  Synthetic
ggcacatgcgctggttaagatctgctgcttgttgcgtggggtagcctgtggcaagtattgccaaatggctatgct

SEQ ID NO: 134931 - DNA, 75 bp, Artificial Sequence
  Synthetic
ggcacatgcgctggttaagatctgccgcttgttgcgtggggtagcctgtggcaagtattgccaaatggctatgct

SEQ ID NO: 134932 - DNA, 75 bp, Artificial Sequence
  Synthetic
ggcacatgcgctggttaagatctgcggcttgttgcgtggggtagcctgtggcaagtattgccaaatggctatgct

SEQ ID NO: 134933 - DNA, 75 bp, Artificial Sequence
  Synthetic
ggcacacgcgctggttaagatctgcagcttgttgcgtggggtagcctgtggcaagtattgccaaatggctatgct

SEQ ID NO: 134934 - DNA, 75 bp, Artificial Sequence
  Synthetic
ggcacacgcgctggttaagatctgctgcttgttgcgtggggtagcctgtggcaagtattgccaaatggctatgct

SEQ ID NO: 134935 - DNA, 75 bp, Artificial Sequence
  Synthetic
ggcacacgcgctggttaagatctgccgcttgttgcgtggggtagcctgtggcaagtattgccaaatggctatgct

SEQ ID NO: 134936 - DNA, 75 bp, Artificial Sequence
  Synthetic
ggcacacgcgctggttaagatctgcggcttgttgcgtggggtagcctgtggcaagtattgccaaatggctatgct

SEQ ID NO: 134937 - DNA, 75 bp, Artificial Sequence
  Synthetic
ggcacaggcgctggttaagatctgcagcttgttgcgtggggtagcctgtggcaagtattgccaaatggctatgct

SEQ ID NO: 134938 - DNA, 75 bp, Artificial Sequence
  Synthetic
ggcacaggcgctggttaagatctgctgcttgttgcgtggggtagcctgtggcaagtattgccaaatggctatgct

SEQ ID NO: 134939 - DNA, 75 bp, Artificial Sequence
  Synthetic
ggcacaggcgctggttaagatctgccgcttgttgcgtggggtagcctgtggcaagtattgccaaatggctatgct

SEQ ID NO: 134940 - DNA, 75 bp, Artificial Sequence
  Synthetic
ggcacaggcgctggttaagatctgcggcttgttgcgtggggtagcctgtggcaagtattgccaaatggctatgct

SEQ ID NO: 134941 - DNA, 75 bp, Artificial Sequence
  Synthetic
ctgacgcaccccatcaccaagtacattatggcttgcatgtccgcggacttggaggtcattaccagcacttgggtt

SEQ ID NO: 134942 - DNA, 75 bp, Artificial Sequence
  Synthetic
ccggttgtgttcacgcccatggagaagaaaatcatcgtctggggcgctgacaccgccgcgtgtggtgacattata

SEQ ID NO: 134943 - DNA, 75 bp, Artificial Sequence
  Synthetic
aggcaagcacggggagtatagatacgtctcgcagggagaacgaccgtcgggcatgttcgacagcgtcgtcctatg

SEQ ID NO: 134944 - DNA, 75 bp, Artificial Sequence
  Synthetic
ttggtagggggcgtcgtggcggccctagcagcctactgcttgacggtgggctcagtagccatagtcggtagaatc

SEQ ID NO: 134945 - DNA, 75 bp, Artificial Sequence
  Synthetic
gcatgttcgacagcgtcgtcctatgcgaggcgtatgacacgggttgcgcgtggtatgaactaactcccgcggaaa

SEQ ID NO: 134946 - DNA, 75 bp, Artificial Sequence
  Synthetic
acgaggtcttctgcgtccaacctgaaaagggaggtcgcaagccagccaggctcatcgtgtaccccgatttgggcg

SEQ ID NO: 134947 - DNA, 75 bp, Artificial Sequence
  Synthetic
cacaccaggcgccaggcagaacatccagctgatcaacaccaacggcagttggcacatcaataggacggccttgaa

SEQ ID NO: 134948 - DNA, 75 bp, Artificial Sequence
  Synthetic
catacgcgcagcagacccgcggcttgttcagcaccatcataacgagcctaactggcagggacaccaatgaaaatt

SEQ ID NO: 134949 - DNA, 75 bp, Artificial Sequence
  Synthetic
catacgcgcagcagacccgcggcttgttcagcaccatcataacgagccttactggcagggacaccaatgaaaatt

SEQ ID NO: 134950 - DNA, 75 bp, Artificial Sequence
  Synthetic
catacgcgcagcagacccgcggcttgttcagcaccatcataacgagcctcactggcagggacaccaatgaaaatt

SEQ ID NO: 134951 - DNA, 75 bp, Artificial Sequence
  Synthetic
catacgcgcagcagacccgcggcttgttcagcaccatcataacgagcctgactggcagggacaccaatgaaaatt

SEQ ID NO: 134952 - DNA, 75 bp, Artificial Sequence
  Synthetic
ccgccatcggcagtgttggactggggaaggtcctcgtggacatccttgcagggtatggcgcgggcgtggcgggag

SEQ ID NO: 134953 - DNA, 75 bp, Artificial Sequence
  Synthetic
tgcgcgtggctgagaagatggccttgtacgacgtggtgaaaaaactacccgtcgccgtgatgggcccctcctatg

SEQ ID NO: 134954 - DNA, 75 bp, Artificial Sequence
  Synthetic
agatgctcactttctctctcaaacaaagcaacaaggagagaattttgcatatcttgtggcctatcaggctactgt

SEQ ID NO: 134955 - DNA, 75 bp, Artificial Sequence
  Synthetic
ggcgacactccaccatgaatcactcccctgtgaggaactactgtcttcacgcagaaagcgtctagccatggcgtt

SEQ ID NO: 134956 - DNA, 75 bp, Artificial Sequence
  Synthetic
aatcaaatgtataccaatgttgaccaagacttggtgggatggccagcgccccccggagtcagatctcttgcgccg

SEQ ID NO: 134957 - DNA, 75 bp, Artificial Sequence
  Synthetic
aggcttggtgcggtgcagaatgaaattgtcacaacacatccaatcaccaaatacatcatgacctgcatgtcagca

SEQ ID NO: 134958 - DNA, 75 bp, Artificial Sequence
  Synthetic
tttgggtaaggtcatcgatacccttacgtgcggcttcgccgacctcatggggtacattccgctcgtcggcgcccc

SEQ ID NO: 134959 - DNA, 75 bp, Artificial Sequence
  Synthetic
gacctatatccactcttaaggggtcttctggcggtccgctgctatgccccatgggacacgctgccggcatattcc

SEQ ID NO: 134960 - DNA, 75 bp, Artificial Sequence
  Synthetic
ggatcagcactacgggcaaacccgtgctaattccagatcgagaggtgatgtaccaacaatatgatgagatggagg

SEQ ID NO: 134961 - DNA, 75 bp, Artificial Sequence
  Synthetic
gctcaacgctgtagcgtactataggggtcttgatgtgtccgtcataccaacaacaggagacgtcgtagtttgcgc

SEQ ID NO: 134962 - DNA, 75 bp, Artificial Sequence
  Synthetic
agaagaacttaaaccggctgttcactccgcttggccaaaactcgagcagttctggcaaaaacatctgtggaattt

SEQ ID NO: 134963 - DNA, 75 bp, Artificial Sequence
  Synthetic
tctggcaaaaacatctgtggaattttgtcagcggcattcaatacttggcaggtctctcgaccttaccaggcaatc

SEQ ID NO: 134964 - DNA, 75 bp, Artificial Sequence
  Synthetic
tctggcaaaaacatctgtggaattttgtcagcggcattcaatacttggcaggtctctcgaccttacctggcaatc

SEQ ID NO: 134965 - DNA, 75 bp, Artificial Sequence
  Synthetic
tctggcaaaaacatctgtggaattttgtcagcggcattcaatacttggcaggtctctcgaccttacccggcaatc

SEQ ID NO: 134966 - DNA, 75 bp, Artificial Sequence
  Synthetic
tctggcaaaaacatctgtggaattttgtcagcggcattcaatacttggcaggtctctcgaccttaccgggcaatc

SEQ ID NO: 134967 - DNA, 75 bp, Artificial Sequence
  Synthetic
tgtgtccccgacacactatgtgcccgagacggatgcgtcggccaaagtcacgcaactgctcagctcactcacagt

SEQ ID NO: 134968 - DNA, 75 bp, Artificial Sequence
  Synthetic
ctgacccgcgaccccacaactcccctcgctcgtgcagcgtgggaaacagcaagacacactccagtcaactcctgg

SEQ ID NO: 134969 - DNA, 75 bp, Artificial Sequence
  Synthetic
acagctggcaaacccgactgcctccacggctttcgtggtgagcggcttggcaggtgcggcggtaggaagcattgg

SEQ ID NO: 134970 - DNA, 75 bp, Artificial Sequence
  Synthetic
cccccggtgaaagaccatctggaatgtttgactcagttgttctctgtgagtgctatgacgcgggctgttcgtggt

SEQ ID NO: 134971 - DNA, 75 bp, Artificial Sequence
  Synthetic
tggagtgcgcctagtcgtactcgcgaccgctaccccaccaggatcagtgaccacgccccactctaacatagagga

SEQ ID NO: 134972 - DNA, 75 bp, Artificial Sequence
  Synthetic
tggagtgcgcctagtcgtactcgcgaccgctacccctccaggatcagtgaccacgccccactctaacatagagga

SEQ ID NO: 134973 - DNA, 75 bp, Artificial Sequence
  Synthetic
tggagtgcgcctagtcgtactcgcgaccgctacccccccaggatcagtgaccacgccccactctaacatagagga

SEQ ID NO: 134974 - DNA, 75 bp, Artificial Sequence
  Synthetic
tggagtgcgcctagtcgtactcgcgaccgctaccccgccaggatcagtgaccacgccccactctaacatagagga

SEQ ID NO: 134975 - DNA, 75 bp, Artificial Sequence
  Synthetic
tggagtgcgcctagtcgttctcgcgaccgctaccccaccaggatcagtgaccacgccccactctaacatagagga

SEQ ID NO: 134976 - DNA, 75 bp, Artificial Sequence
  Synthetic
tggagtgcgcctagtcgttctcgcgaccgctacccctccaggatcagtgaccacgccccactctaacatagagga

SEQ ID NO: 134977 - DNA, 75 bp, Artificial Sequence
  Synthetic
tggagtgcgcctagtcgttctcgcgaccgctacccccccaggatcagtgaccacgccccactctaacatagagga

SEQ ID NO: 134978 - DNA, 75 bp, Artificial Sequence
  Synthetic
tggagtgcgcctagtcgttctcgcgaccgctaccccgccaggatcagtgaccacgccccactctaacatagagga

SEQ ID NO: 134979 - DNA, 75 bp, Artificial Sequence
  Synthetic
tggagtgcgcctagtcgtcctcgcgaccgctaccccaccaggatcagtgaccacgccccactctaacatagagga

SEQ ID NO: 134980 - DNA, 75 bp, Artificial Sequence
  Synthetic
tggagtgcgcctagtcgtcctcgcgaccgctacccctccaggatcagtgaccacgccccactctaacatagagga

SEQ ID NO: 134981 - DNA, 75 bp, Artificial Sequence
  Synthetic
tggagtgcgcctagtcgtcctcgcgaccgctacccccccaggatcagtgaccacgccccactctaacatagagga

SEQ ID NO: 134982 - DNA, 75 bp, Artificial Sequence
  Synthetic
tggagtgcgcctagtcgtcctcgcgaccgctaccccgccaggatcagtgaccacgccccactctaacatagagga

SEQ ID NO: 134983 - DNA, 75 bp, Artificial Sequence
  Synthetic
tggagtgcgcctagtcgtgctcgcgaccgctaccccaccaggatcagtgaccacgccccactctaacatagagga

SEQ ID NO: 134984 - DNA, 75 bp, Artificial Sequence
  Synthetic
tggagtgcgcctagtcgtgctcgcgaccgctacccctccaggatcagtgaccacgccccactctaacatagagga

SEQ ID NO: 134985 - DNA, 75 bp, Artificial Sequence
  Synthetic
tggagtgcgcctagtcgtgctcgcgaccgctacccccccaggatcagtgaccacgccccactctaacatagagga

SEQ ID NO: 134986 - DNA, 75 bp, Artificial Sequence
  Synthetic
tggagtgcgcctagtcgtgctcgcgaccgctaccccgccaggatcagtgaccacgccccactctaacatagagga

SEQ ID NO: 134987 - DNA, 75 bp, Artificial Sequence
  Synthetic
tggagtgcgccttgtcgtactcgcgaccgctaccccaccaggatcagtgaccacgccccactctaacatagagga

SEQ ID NO: 134988 - DNA, 75 bp, Artificial Sequence
  Synthetic
tggagtgcgccttgtcgtactcgcgaccgctacccctccaggatcagtgaccacgccccactctaacatagagga

SEQ ID NO: 134989 - DNA, 75 bp, Artificial Sequence
  Synthetic
tggagtgcgccttgtcgtactcgcgaccgctacccccccaggatcagtgaccacgccccactctaacatagagga

SEQ ID NO: 134990 - DNA, 75 bp, Artificial Sequence
  Synthetic
tggagtgcgccttgtcgtactcgcgaccgctaccccgccaggatcagtgaccacgccccactctaacatagagga

SEQ ID NO: 134991 - DNA, 75 bp, Artificial Sequence
  Synthetic
tggagtgcgccttgtcgttctcgcgaccgctaccccaccaggatcagtgaccacgccccactctaacatagagga

SEQ ID NO: 134992 - DNA, 75 bp, Artificial Sequence
  Synthetic
tggagtgcgccttgtcgttctcgcgaccgctacccctccaggatcagtgaccacgccccactctaacatagagga

SEQ ID NO: 134993 - DNA, 75 bp, Artificial Sequence
  Synthetic
tggagtgcgccttgtcgttctcgcgaccgctacccccccaggatcagtgaccacgccccactctaacatagagga

SEQ ID NO: 134994 - DNA, 75 bp, Artificial Sequence
  Synthetic
tggagtgcgccttgtcgttctcgcgaccgctaccccgccaggatcagtgaccacgccccactctaacatagagga

SEQ ID NO: 134995 - DNA, 75 bp, Artificial Sequence
  Synthetic
tggagtgcgccttgtcgtcctcgcgaccgctaccccaccaggatcagtgaccacgccccactctaacatagagga

SEQ ID NO: 134996 - DNA, 75 bp, Artificial Sequence
  Synthetic
tggagtgcgccttgtcgtcctcgcgaccgctacccctccaggatcagtgaccacgccccactctaacatagagga

SEQ ID NO: 134997 - DNA, 75 bp, Artificial Sequence
  Synthetic
tggagtgcgccttgtcgtcctcgcgaccgctacccccccaggatcagtgaccacgccccactctaacatagagga

SEQ ID NO: 134998 - DNA, 75 bp, Artificial Sequence
  Synthetic
tggagtgcgccttgtcgtcctcgcgaccgctaccccgccaggatcagtgaccacgccccactctaacatagagga

SEQ ID NO: 134999 - DNA, 75 bp, Artificial Sequence
  Synthetic
tggagtgcgccttgtcgtgctcgcgaccgctaccccaccaggatcagtgaccacgccccactctaacatagagga

SEQ ID NO: 135000 - DNA, 75 bp, Artificial Sequence
  Synthetic
tggagtgcgccttgtcgtgctcgcgaccgctacccctccaggatcagtgaccacgccccactctaacatagagga

SEQ ID NO: 135001 - DNA, 75 bp, Artificial Sequence
  Synthetic
tggagtgcgccttgtcgtgctcgcgaccgctacccccccaggatcagtgaccacgccccactctaacatagagga

SEQ ID NO: 135002 - DNA, 75 bp, Artificial Sequence
  Synthetic
tggagtgcgccttgtcgtgctcgcgaccgctaccccgccaggatcagtgaccacgccccactctaacatagagga

SEQ ID NO: 135003 - DNA, 75 bp, Artificial Sequence
  Synthetic
tggagtgcgcctcgtcgtactcgcgaccgctaccccaccaggatcagtgaccacgccccactctaacatagagga

SEQ ID NO: 135004 - DNA, 75 bp, Artificial Sequence
  Synthetic
tggagtgcgcctcgtcgtactcgcgaccgctacccctccaggatcagtgaccacgccccactctaacatagagga

SEQ ID NO: 135005 - DNA, 75 bp, Artificial Sequence
  Synthetic
tggagtgcgcctcgtcgtactcgcgaccgctacccccccaggatcagtgaccacgccccactctaacatagagga

SEQ ID NO: 135006 - DNA, 75 bp, Artificial Sequence
  Synthetic
tggagtgcgcctcgtcgtactcgcgaccgctaccccgccaggatcagtgaccacgccccactctaacatagagga

SEQ ID NO: 135007 - DNA, 75 bp, Artificial Sequence
  Synthetic
tggagtgcgcctcgtcgttctcgcgaccgctaccccaccaggatcagtgaccacgccccactctaacatagagga

SEQ ID NO: 135008 - DNA, 75 bp, Artificial Sequence
  Synthetic
tggagtgcgcctcgtcgttctcgcgaccgctacccctccaggatcagtgaccacgccccactctaacatagagga

SEQ ID NO: 135009 - DNA, 75 bp, Artificial Sequence
  Synthetic
tggagtgcgcctcgtcgttctcgcgaccgctacccccccaggatcagtgaccacgccccactctaacatagagga

SEQ ID NO: 135010 - DNA, 75 bp, Artificial Sequence
  Synthetic
tggagtgcgcctcgtcgttctcgcgaccgctaccccgccaggatcagtgaccacgccccactctaacatagagga

SEQ ID NO: 135011 - DNA, 75 bp, Artificial Sequence
  Synthetic
tggagtgcgcctcgtcgtcctcgcgaccgctaccccaccaggatcagtgaccacgccccactctaacatagagga

SEQ ID NO: 135012 - DNA, 75 bp, Artificial Sequence
  Synthetic
tggagtgcgcctcgtcgtcctcgcgaccgctacccctccaggatcagtgaccacgccccactctaacatagagga

SEQ ID NO: 135013 - DNA, 75 bp, Artificial Sequence
  Synthetic
tggagtgcgcctcgtcgtcctcgcgaccgctacccccccaggatcagtgaccacgccccactctaacatagagga

SEQ ID NO: 135014 - DNA, 75 bp, Artificial Sequence
  Synthetic
tggagtgcgcctcgtcgtcctcgcgaccgctaccccgccaggatcagtgaccacgccccactctaacatagagga

SEQ ID NO: 135015 - DNA, 75 bp, Artificial Sequence
  Synthetic
tggagtgcgcctcgtcgtgctcgcgaccgctaccccaccaggatcagtgaccacgccccactctaacatagagga

SEQ ID NO: 135016 - DNA, 75 bp, Artificial Sequence
  Synthetic
tggagtgcgcctcgtcgtgctcgcgaccgctacccctccaggatcagtgaccacgccccactctaacatagagga

SEQ ID NO: 135017 - DNA, 75 bp, Artificial Sequence
  Synthetic
tggagtgcgcctcgtcgtgctcgcgaccgctacccccccaggatcagtgaccacgccccactctaacatagagga

SEQ ID NO: 135018 - DNA, 75 bp, Artificial Sequence
  Synthetic
tggagtgcgcctcgtcgtgctcgcgaccgctaccccgccaggatcagtgaccacgccccactctaacatagagga

SEQ ID NO: 135019 - DNA, 75 bp, Artificial Sequence
  Synthetic
tggagtgcgcctggtcgtactcgcgaccgctaccccaccaggatcagtgaccacgccccactctaacatagagga

SEQ ID NO: 135020 - DNA, 75 bp, Artificial Sequence
  Synthetic
tggagtgcgcctggtcgtactcgcgaccgctacccctccaggatcagtgaccacgccccactctaacatagagga

SEQ ID NO: 135021 - DNA, 75 bp, Artificial Sequence
  Synthetic
tggagtgcgcctggtcgtactcgcgaccgctacccccccaggatcagtgaccacgccccactctaacatagagga

SEQ ID NO: 135022 - DNA, 75 bp, Artificial Sequence
  Synthetic
tggagtgcgcctggtcgtactcgcgaccgctaccccgccaggatcagtgaccacgccccactctaacatagagga

SEQ ID NO: 135023 - DNA, 75 bp, Artificial Sequence
  Synthetic
tggagtgcgcctggtcgttctcgcgaccgctaccccaccaggatcagtgaccacgccccactctaacatagagga

SEQ ID NO: 135024 - DNA, 75 bp, Artificial Sequence
  Synthetic
tggagtgcgcctggtcgttctcgcgaccgctacccctccaggatcagtgaccacgccccactctaacatagagga

SEQ ID NO: 135025 - DNA, 75 bp, Artificial Sequence
  Synthetic
tggagtgcgcctggtcgttctcgcgaccgctacccccccaggatcagtgaccacgccccactctaacatagagga

SEQ ID NO: 135026 - DNA, 75 bp, Artificial Sequence
  Synthetic
tggagtgcgcctggtcgttctcgcgaccgctaccccgccaggatcagtgaccacgccccactctaacatagagga

SEQ ID NO: 135027 - DNA, 75 bp, Artificial Sequence
  Synthetic
tggagtgcgcctggtcgtcctcgcgaccgctaccccaccaggatcagtgaccacgccccactctaacatagagga

SEQ ID NO: 135028 - DNA, 75 bp, Artificial Sequence
  Synthetic
tggagtgcgcctggtcgtcctcgcgaccgctacccctccaggatcagtgaccacgccccactctaacatagagga

SEQ ID NO: 135029 - DNA, 75 bp, Artificial Sequence
  Synthetic
tggagtgcgcctggtcgtcctcgcgaccgctacccccccaggatcagtgaccacgccccactctaacatagagga

SEQ ID NO: 135030 - DNA, 75 bp, Artificial Sequence
  Synthetic
tggagtgcgcctggtcgtcctcgcgaccgctaccccgccaggatcagtgaccacgccccactctaacatagagga

SEQ ID NO: 135031 - DNA, 75 bp, Artificial Sequence
  Synthetic
tggagtgcgcctggtcgtgctcgcgaccgctaccccaccaggatcagtgaccacgccccactctaacatagagga

SEQ ID NO: 135032 - DNA, 75 bp, Artificial Sequence
  Synthetic
tggagtgcgcctggtcgtgctcgcgaccgctacccctccaggatcagtgaccacgccccactctaacatagagga

SEQ ID NO: 135033 - DNA, 75 bp, Artificial Sequence
  Synthetic
tggagtgcgcctggtcgtgctcgcgaccgctacccccccaggatcagtgaccacgccccactctaacatagagga

SEQ ID NO: 135034 - DNA, 75 bp, Artificial Sequence
  Synthetic
tggagtgcgcctggtcgtgctcgcgaccgctaccccgccaggatcagtgaccacgccccactctaacatagagga

SEQ ID NO: 135035 - DNA, 75 bp, Artificial Sequence
  Synthetic
gaggacatggtgaatctgctcccagcccttctgtcacctggagccctagtggtaggcgtagtgtgtgcggctata

SEQ ID NO: 135036 - DNA, 75 bp, Artificial Sequence
  Synthetic
accatcttaccaatgactgccctaattcgagtattgtctatgaggcggacagtgtcatcatgcacagccctggat

SEQ ID NO: 135037 - DNA, 75 bp, Artificial Sequence
  Synthetic
tgcccgagacagacacctctcgccaaattatgactattctgagctccctcaccataaccagcttgttacgcaagc

SEQ ID NO: 135038 - DNA, 75 bp, Artificial Sequence
  Synthetic
cgctcacgtggatcttctcgtcggttcggcagctttatgctcagcactttacatcggagacctctgcggtggcgt

SEQ ID NO: 135039 - DNA, 75 bp, Artificial Sequence
  Synthetic
cctactcctacttgctgtaggggtaggcatctatctccttcccaaccgataaaggttgggctaaacactccggcc

SEQ ID NO: 135040 - DNA, 75 bp, Artificial Sequence
  Synthetic
ctggcttaaacaaaaacttgtgccgtcactgcccggagtcccctttctctcgtgtcaacgggggtttaggggtgt

SEQ ID NO: 135041 - DNA, 75 bp, Artificial Sequence
  Synthetic
atggcgtgggacatgatgatgaactggtccccgaccctgacctatgtcacctcttcgctgctgaggataccgcag

SEQ ID NO: 135042 - DNA, 75 bp, Artificial Sequence
  Synthetic
catcaacaggactgccctgaactgcaatgactccctccacactgggttccttgccgcgctgttctacgcgcacaa

SEQ ID NO: 135043 - DNA, 75 bp, Artificial Sequence
  Synthetic
ttgccgcgctgttctacgcgcacaagttcaactcgtccggatgcccggagcgcatgtccagctgccgctccattg

SEQ ID NO: 135044 - DNA, 75 bp, Artificial Sequence
  Synthetic
tgggctaaagtcctcgctgtcttggtccttttcgctggggtcgacggaactaccttcgttggccgcagtgtgggt

SEQ ID NO: 135045 - DNA, 75 bp, Artificial Sequence
  Synthetic
tgtagtaacatctggcacggcaccttccccatcaacgcgtccacgactggccccagcgtacccattcctgagccc

SEQ ID NO: 135046 - DNA, 75 bp, Artificial Sequence
  Synthetic
ggctaatctgctatggagacagtgcatgggaggcaatatcacgcgagtggaggccgagaacaaggtcgtgatcct

SEQ ID NO: 135047 - DNA, 75 bp, Artificial Sequence
  Synthetic
actggcaaaaacttgaggccttctggcacaagcatatgtggaattttgtgagtgggatccaatacctagcaggcc

SEQ ID NO: 135048 - DNA, 75 bp, Artificial Sequence
  Synthetic
accatccagacgcagacctcatagaggctaatctgctatggagacagtgcatgggaggcaatatcacgcgagtgg

SEQ ID NO: 135049 - DNA, 75 bp, Artificial Sequence
  Synthetic
aactataagagggctctttggagggtggccgctgaggagtacgttgaggtcgtgcgggtgggggacggccactat

SEQ ID NO: 135050 - DNA, 75 bp, Artificial Sequence
  Synthetic
tgactcctttgagccgctcaaggcggaagacgatgacagggaggtctccgtgtccgctgactgctttagaaaggg

SEQ ID NO: 135051 - DNA, 75 bp, Artificial Sequence
  Synthetic
tccttttcgctggggtcgacggaactaccttcgttggccgcagtgtgggtgcgcagacgcggggcatcgtcagca

SEQ ID NO: 135052 - DNA, 75 bp, Artificial Sequence
  Synthetic
cggcttcattgctggtttgttttacacccatcgcttcaactcttcgggttgccctgaacggttgagtaggtgtcg

SEQ ID NO: 135053 - DNA, 75 bp, Artificial Sequence
  Synthetic
ggagtgcgcattcaccgttatgcgcccgcgtgcaagcccctgttaagggatgaggtcaccttctccgtgggattg

SEQ ID NO: 135054 - DNA, 75 bp, Artificial Sequence
  Synthetic
atgaaggttggggtaaacactccggcctcctaggccatttcctgttttttttttttttttccccctttttttttt

SEQ ID NO: 135055 - DNA, 75 bp, Artificial Sequence
  Synthetic
tctgggtaaggtcatcgataccctgacttgcggctttgccgacctcatgggatacatcccgatcgtaggcgcccc

SEQ ID NO: 135056 - DNA, 75 bp, Artificial Sequence
  Synthetic
ctgctgcccgccgccttgctcgcgggtcccccccgtctctcgccagctcatctgcaagccaactatcagccccat

SEQ ID NO: 135057 - DNA, 75 bp, Artificial Sequence
  Synthetic
acgggatcaactatgcaacagggaatcttcctggttgctccttttctatcttccttttggcacttctctcgtgcc

SEQ ID NO: 135058 - DNA, 75 bp, Artificial Sequence
  Synthetic
tcttcctggttgctccttttctatcttccttttggcacttctctcgtgcctgaccgtccccgcatcggccgtaca

SEQ ID NO: 135059 - DNA, 75 bp, Artificial Sequence
  Synthetic
agatgtgttcctgctgcaggggaccaggcccccccaagggccgtggtttggctgcacctggatgaatgctacagg

SEQ ID NO: 135060 - DNA, 75 bp, Artificial Sequence
  Synthetic
cgatgagttcgatcaggggtggggtcccatcacttacgctgtgcctgacaactcggaccagaggccttattgttg

SEQ ID NO: 135061 - DNA, 75 bp, Artificial Sequence
  Synthetic
ggtagagtctgagaacaagatcgtcgtgctcgactcttttgaccccatcactcccgagtatgatgacagggagcc

SEQ ID NO: 135062 - DNA, 75 bp, Artificial Sequence
  Synthetic
cgattgcttccgtaaacatccagaagcaacttacgggaagtgcgggtcagggccgtggctcactcccaggtgctt

SEQ ID NO: 135063 - DNA, 75 bp, Artificial Sequence
  Synthetic
gtaccgtgtgtgaggaacgggaacgagtcaaggtgttgggtgtccttgtcccccacagtggcagccccgtacgtt

SEQ ID NO: 135064 - DNA, 75 bp, Artificial Sequence
  Synthetic
tgccaggcaatcctgccattgcttccctcatgtccttcaccgcagccgttacaagccctctgaccactcaacaaa

SEQ ID NO: 135065 - DNA, 75 bp, Artificial Sequence
  Synthetic
tgccaggcaatcctgccattgcttccctcatgtccttcaccgctgccgttacaagccctctgaccactcaacaaa

SEQ ID NO: 135066 - DNA, 75 bp, Artificial Sequence
  Synthetic
tgccaggcaatcctgccattgcttccctcatgtccttcaccgccgccgttacaagccctctgaccactcaacaaa

SEQ ID NO: 135067 - DNA, 75 bp, Artificial Sequence
  Synthetic
tgccaggcaatcctgccattgcttccctcatgtccttcaccgcggccgttacaagccctctgaccactcaacaaa

SEQ ID NO: 135068 - DNA, 75 bp, Artificial Sequence
  Synthetic
gaaacccgggtctccgggggagctgccgcccacgccacgcttggatttaccagcctcttctcaagtggtcccaag

SEQ ID NO: 135069 - DNA, 75 bp, Artificial Sequence
  Synthetic
tggaaagctccagattacgacccacccgtagtgcacgggtgtgccctacctcctccgaaggatattcctattcca

SEQ ID NO: 135070 - DNA, 75 bp, Artificial Sequence
  Synthetic
actacaagtcctcgatgaccactatagagaggttgtggacgagatgagacgattagcttccaaggtgaaagccag

SEQ ID NO: 135071 - DNA, 75 bp, Artificial Sequence
  Synthetic
aggctttatgtcgggggtcctcttaccaattcaaggggggaaaactgcggctatcgcaggtgccgcgcaagcggc

SEQ ID NO: 135072 - DNA, 75 bp, Artificial Sequence
  Synthetic
gctgcgtgcaactggacccgtggagaacggtgcgagttagatgatagggatagggttgagatgagccctctgcta

SEQ ID NO: 135073 - DNA, 75 bp, Artificial Sequence
  Synthetic
tcctccgaaggatattcctattccaccaccccggaggaagaagaccatacaacttaaccagtccacactatcact

SEQ ID NO: 135074 - DNA, 75 bp, Artificial Sequence
  Synthetic
cttctgtgctgcctggtacatcaagggcaggctggtccctggggcggcatatgctttctatggcgtatggccgct

SEQ ID NO: 135075 - DNA, 75 bp, Artificial Sequence
  Synthetic
ggtaccgatgacgttgaagttctctccgacgccggatcctacagctcgatgccaccgcttgagggggaacccggg

SEQ ID NO: 135076 - DNA, 75 bp, Artificial Sequence
  Synthetic
agtatctctatggagtctcctcgacagtcgtgtcgtgggctgtgaagtgggaatacgtcgtcttggcgtttctgg

SEQ ID NO: 135077 - DNA, 75 bp, Artificial Sequence
  Synthetic
cctagtagagctcctctctggaggccactggggtatcctcgtgggggtagcttacttcagcatgcaggctaattg

SEQ ID NO: 135078 - DNA, 75 bp, Artificial Sequence
  Synthetic
agtcgtgtcgtgggctgtgaagtgggaatacgtcgtcttggcgtttctggtcctagctgatgcacgggtttgtgc

SEQ ID NO: 135079 - DNA, 75 bp, Artificial Sequence
  Synthetic
agcacggctaatagtctaccccgaccttggagtccgcgtctgcgagaagcgggcattgtatgacatagctcaaaa

SEQ ID NO: 135080 - DNA, 75 bp, Artificial Sequence
  Synthetic
caccatgtgcaccagaggaggagaagttgccaatcaatcctttaagcaactccctcatccgccaccacaacctgg

SEQ ID NO: 135081 - DNA, 75 bp, Artificial Sequence
  Synthetic
caccatgtgcaccagaggaggagaagttgcctatcaatcctttaagcaactccctcatccgccaccacaacctgg

SEQ ID NO: 135082 - DNA, 75 bp, Artificial Sequence
  Synthetic
caccatgtgcaccagaggaggagaagttgcccatcaatcctttaagcaactccctcatccgccaccacaacctgg

SEQ ID NO: 135083 - DNA, 75 bp, Artificial Sequence
  Synthetic
caccatgtgcaccagaggaggagaagttgccgatcaatcctttaagcaactccctcatccgccaccacaacctgg

SEQ ID NO: 135084 - DNA, 75 bp, Artificial Sequence
  Synthetic
ccctcaacgttcgggggggccgtgatgccatcatcctcctcacgtgtgcggcccacccagagctaatctttgaca

SEQ ID NO: 135085 - DNA, 75 bp, Artificial Sequence
  Synthetic
tgctgctagtaaccaaggctgggtctgtgggatagctttcatctgtgccgcctggtacattcgcggcaagtgtgc

SEQ ID NO: 135086 - DNA, 75 bp, Artificial Sequence
  Synthetic
ttgttcagtcaggggcccaagcagaatatacagctggtgaattccaacggaagctggcacatcaacaggactgcc

SEQ ID NO: 135087 - DNA, 75 bp, Artificial Sequence
  Synthetic
gttgccaatcaatcctttaagcaactccctcatccgccaccacaacctggtgtattccacgacttctcggagcgc

SEQ ID NO: 135088 - DNA, 75 bp, Artificial Sequence
  Synthetic
gttgcctatcaatcctttaagcaactccctcatccgccaccacaacctggtgtattccacgacttctcggagcgc

SEQ ID NO: 135089 - DNA, 75 bp, Artificial Sequence
  Synthetic
gttgcccatcaatcctttaagcaactccctcatccgccaccacaacctggtgtattccacgacttctcggagcgc

SEQ ID NO: 135090 - DNA, 75 bp, Artificial Sequence
  Synthetic
gttgccgatcaatcctttaagcaactccctcatccgccaccacaacctggtgtattccacgacttctcggagcgc

SEQ ID NO: 135091 - DNA, 75 bp, Artificial Sequence
  Synthetic
tgtgggatagctttcatctgtgccgcctggtacattcgcggcaagtgtgcccctatcactctctatgctattctg

SEQ ID NO: 135092 - DNA, 75 bp, Artificial Sequence
  Synthetic
gtcctgacctcgatgttgagagacccttcccacatcaccgcagagacggcagcgcgccgtcttgcgcgcgggtcc

SEQ ID NO: 135093 - DNA, 75 bp, Artificial Sequence
  Synthetic
agcgccttggagagcttccccagggctggggtgcacttggagtcgccaacatcaacgactcctttgacactaggc

SEQ ID NO: 135094 - DNA, 75 bp, Artificial Sequence
  Synthetic
tggtcaccatcttcaccctcaccccggcatacaaaccacttctcataagcacgctctggtggattcagtatttca

SEQ ID NO: 135095 - DNA, 75 bp, Artificial Sequence
  Synthetic
acagccaaactcctcacaactgaggaggcttgtgaccttacccccccacactcagctcgatcgaagtttgggtat

SEQ ID NO: 135096 - DNA, 75 bp, Artificial Sequence
  Synthetic
ggggcaaaggacgtccggagtcatgccagcaaagccatcaaccacatcaactccgtgtgggaggacttgctggaa

SEQ ID NO: 135097 - DNA, 75 bp, Artificial Sequence
  Synthetic
acgctctggtggattcagtatttcattgcacgggcagaggccatcttgcatgtatgggtgcccccattgcaggtt

SEQ ID NO: 135098 - DNA, 75 bp, Artificial Sequence
  Synthetic
ctccgtgtgggaggacttgctggaagacaaccaaacaccgattcctacaaccattatggctaagaatgaggtatt

SEQ ID NO: 135099 - DNA, 75 bp, Artificial Sequence
  Synthetic
atcaacgactcctttgacactaggccatactgctgggattacgcgccacggccctgcggggtcgtgccggcctct

SEQ ID NO: 135100 - DNA, 75 bp, Artificial Sequence
  Synthetic
ccgacgtgtttatcctgaattcgaccaggccgcccaatggcgcttggttcggatgcgtgtggatgaacggcaccg

SEQ ID NO: 135101 - DNA, 75 bp, Artificial Sequence
  Synthetic
acattttgcagtacagcctgctcaagacgccgtacttcgtgcgagcgcacatccttttgcgcgcttgcttgtttg

SEQ ID NO: 135102 - DNA, 75 bp, Artificial Sequence
  Synthetic
accaaaaagctaccagtggcaacaatgggggccgcttacggcttccaatactcgcctaaacagcgagtggaacgt

SEQ ID NO: 135103 - DNA, 75 bp, Artificial Sequence
  Synthetic
ctcgcctaaacagcgagtggaacgtctgctcgggatgtggcgctcaaagaagaccccgatgggtttctcttatga

SEQ ID NO: 135104 - DNA, 75 bp, Artificial Sequence
  Synthetic
ttgggcgtgtgatggcctacgagatctggctgtcgccgtcgaacctgtcatcttctctcctatggagaagaaagt

SEQ ID NO: 135105 - DNA, 75 bp, Artificial Sequence
  Synthetic
tgggatcacaactcccatgcgagccagagccggacgtggctgtgttgacgtccatgctgacagacccatcacaca

SEQ ID NO: 135106 - DNA, 75 bp, Artificial Sequence
  Synthetic
gctgcgctagctgaaaaatcattcccgtcctcaaaacctcaggaagagaatagttcgtcctctggggtcgacaca

SEQ ID NO: 135107 - DNA, 75 bp, Artificial Sequence
  Synthetic
acatcattgactgagaggctatattgtggtggccccatgtacaactcacggggccaactctgcggaacacgcaga

SEQ ID NO: 135108 - DNA, 75 bp, Artificial Sequence
  Synthetic
cccggagcggcctacgccctctacgggatgtggcctctcctcctgctcctgttggcgttgccccagcgggcgtac

SEQ ID NO: 135109 - DNA, 75 bp, Artificial Sequence
  Synthetic
gatattcggggcggaggctggcgcctccttgccccgatcacggcatatgcccagcagaccagaggcctagtaggc

SEQ ID NO: 135110 - DNA, 75 bp, Artificial Sequence
  Synthetic
caccacacagtggcaggtccttccctgttcctttacaacccttcccgctctctccactggcttaatccaccttca

SEQ ID NO: 135111 - DNA, 75 bp, Artificial Sequence
  Synthetic
tgtcgcgcgagcggagtgctccccactagcttgggtaacactatgacgtgctatataaaggcacaagcagcgtgt

SEQ ID NO: 135112 - DNA, 75 bp, Artificial Sequence
  Synthetic
tccttgccccgatcacggcatatgcccagcagaccagaggcctagtaggcacaatcgtcactagccttaccggcc

SEQ ID NO: 135113 - DNA, 75 bp, Artificial Sequence
  Synthetic
tgtcatgggcactcaagtgggagtacatcgtgctcgcatttctgttgctcgcagacgccagggtctgcgcgtgcc

SEQ ID NO: 135114 - DNA, 75 bp, Artificial Sequence
  Synthetic
tggtgctgggtcaaagacattggccggcccgaaagggcccatttgccaaatgtacaccaacgtcgaccaagacct

SEQ ID NO: 135115 - DNA, 75 bp, Artificial Sequence
  Synthetic
gcagacgccagggtctgcgcgtgcctgtggatgatgatgatggtggcgcaggttgaagctgcccttgccaatctg

SEQ ID NO: 135116 - DNA, 75 bp, Artificial Sequence
  Synthetic
tcacggcctactcccaacagacgcggggcttacttggctgtatcatcactagcctcacaggccgggacaagaacc

SEQ ID NO: 135117 - DNA, 75 bp, Artificial Sequence
  Synthetic
ccgcgccccacctatgacctggaactaataacatcatgttcctcaaacgtctccgtagcccacgacgggactgga

SEQ ID NO: 135118 - DNA, 75 bp, Artificial Sequence
  Synthetic
tggaagcaacaggactacaagcctccaaccgtccacgggtgcgctatgcctcccagcaagcaaacccccgtccct

SEQ ID NO: 135119 - DNA, 75 bp, Artificial Sequence
  Synthetic
tggaagcaacaggactacaagcctccaaccgtccacgggtgcgctatgcctccctgcaagcaaacccccgtccct

SEQ ID NO: 135120 - DNA, 75 bp, Artificial Sequence
  Synthetic
tggaagcaacaggactacaagcctccaaccgtccacgggtgcgctatgcctccccgcaagcaaacccccgtccct

SEQ ID NO: 135121 - DNA, 75 bp, Artificial Sequence
  Synthetic
tggaagcaacaggactacaagcctccaaccgtccacgggtgcgctatgcctcccggcaagcaaacccccgtccct

SEQ ID NO: 135122 - DNA, 75 bp, Artificial Sequence
  Synthetic
tggaagcaacaggactacaagcctccaaccgtccacgggtgcgctttgcctcccagcaagcaaacccccgtccct

SEQ ID NO: 135123 - DNA, 75 bp, Artificial Sequence
  Synthetic
tggaagcaacaggactacaagcctccaaccgtccacgggtgcgctttgcctccctgcaagcaaacccccgtccct

SEQ ID NO: 135124 - DNA, 75 bp, Artificial Sequence
  Synthetic
tggaagcaacaggactacaagcctccaaccgtccacgggtgcgctttgcctccccgcaagcaaacccccgtccct

SEQ ID NO: 135125 - DNA, 75 bp, Artificial Sequence
  Synthetic
tggaagcaacaggactacaagcctccaaccgtccacgggtgcgctttgcctcccggcaagcaaacccccgtccct

SEQ ID NO: 135126 - DNA, 75 bp, Artificial Sequence
  Synthetic
tggaagcaacaggactacaagcctccaaccgtccacgggtgcgctctgcctcccagcaagcaaacccccgtccct

SEQ ID NO: 135127 - DNA, 75 bp, Artificial Sequence
  Synthetic
tggaagcaacaggactacaagcctccaaccgtccacgggtgcgctctgcctccctgcaagcaaacccccgtccct

SEQ ID NO: 135128 - DNA, 75 bp, Artificial Sequence
  Synthetic
tggaagcaacaggactacaagcctccaaccgtccacgggtgcgctctgcctccccgcaagcaaacccccgtccct

SEQ ID NO: 135129 - DNA, 75 bp, Artificial Sequence
  Synthetic
tggaagcaacaggactacaagcctccaaccgtccacgggtgcgctctgcctcccggcaagcaaacccccgtccct

SEQ ID NO: 135130 - DNA, 75 bp, Artificial Sequence
  Synthetic
tggaagcaacaggactacaagcctccaaccgtccacgggtgcgctgtgcctcccagcaagcaaacccccgtccct

SEQ ID NO: 135131 - DNA, 75 bp, Artificial Sequence
  Synthetic
tggaagcaacaggactacaagcctccaaccgtccacgggtgcgctgtgcctccctgcaagcaaacccccgtccct

SEQ ID NO: 135132 - DNA, 75 bp, Artificial Sequence
  Synthetic
tggaagcaacaggactacaagcctccaaccgtccacgggtgcgctgtgcctccccgcaagcaaacccccgtccct

SEQ ID NO: 135133 - DNA, 75 bp, Artificial Sequence
  Synthetic
tggaagcaacaggactacaagcctccaaccgtccacgggtgcgctgtgcctcccggcaagcaaacccccgtccct

SEQ ID NO: 135134 - DNA, 75 bp, Artificial Sequence
  Synthetic
tggaagcaacaggactacaagcctcctaccgtccacgggtgcgctatgcctcccagcaagcaaacccccgtccct

SEQ ID NO: 135135 - DNA, 75 bp, Artificial Sequence
  Synthetic
tggaagcaacaggactacaagcctcctaccgtccacgggtgcgctatgcctccctgcaagcaaacccccgtccct

SEQ ID NO: 135136 - DNA, 75 bp, Artificial Sequence
  Synthetic
tggaagcaacaggactacaagcctcctaccgtccacgggtgcgctatgcctccccgcaagcaaacccccgtccct

SEQ ID NO: 135137 - DNA, 75 bp, Artificial Sequence
  Synthetic
tggaagcaacaggactacaagcctcctaccgtccacgggtgcgctatgcctcccggcaagcaaacccccgtccct

SEQ ID NO: 135138 - DNA, 75 bp, Artificial Sequence
  Synthetic
tggaagcaacaggactacaagcctcctaccgtccacgggtgcgctttgcctcccagcaagcaaacccccgtccct

SEQ ID NO: 135139 - DNA, 75 bp, Artificial Sequence
  Synthetic
tggaagcaacaggactacaagcctcctaccgtccacgggtgcgctttgcctccctgcaagcaaacccccgtccct

SEQ ID NO: 135140 - DNA, 75 bp, Artificial Sequence
  Synthetic
tggaagcaacaggactacaagcctcctaccgtccacgggtgcgctttgcctccccgcaagcaaacccccgtccct

SEQ ID NO: 135141 - DNA, 75 bp, Artificial Sequence
  Synthetic
tggaagcaacaggactacaagcctcctaccgtccacgggtgcgctttgcctcccggcaagcaaacccccgtccct

SEQ ID NO: 135142 - DNA, 75 bp, Artificial Sequence
  Synthetic
tggaagcaacaggactacaagcctcctaccgtccacgggtgcgctctgcctcccagcaagcaaacccccgtccct

SEQ ID NO: 135143 - DNA, 75 bp, Artificial Sequence
  Synthetic
tggaagcaacaggactacaagcctcctaccgtccacgggtgcgctctgcctccctgcaagcaaacccccgtccct

SEQ ID NO: 135144 - DNA, 75 bp, Artificial Sequence
  Synthetic
tggaagcaacaggactacaagcctcctaccgtccacgggtgcgctctgcctccccgcaagcaaacccccgtccct

SEQ ID NO: 135145 - DNA, 75 bp, Artificial Sequence
  Synthetic
tggaagcaacaggactacaagcctcctaccgtccacgggtgcgctctgcctcccggcaagcaaacccccgtccct

SEQ ID NO: 135146 - DNA, 75 bp, Artificial Sequence
  Synthetic
tggaagcaacaggactacaagcctcctaccgtccacgggtgcgctgtgcctcccagcaagcaaacccccgtccct

SEQ ID NO: 135147 - DNA, 75 bp, Artificial Sequence
  Synthetic
tggaagcaacaggactacaagcctcctaccgtccacgggtgcgctgtgcctccctgcaagcaaacccccgtccct

SEQ ID NO: 135148 - DNA, 75 bp, Artificial Sequence
  Synthetic
tggaagcaacaggactacaagcctcctaccgtccacgggtgcgctgtgcctccccgcaagcaaacccccgtccct

SEQ ID NO: 135149 - DNA, 75 bp, Artificial Sequence
  Synthetic
tggaagcaacaggactacaagcctcctaccgtccacgggtgcgctgtgcctcccggcaagcaaacccccgtccct

SEQ ID NO: 135150 - DNA, 75 bp, Artificial Sequence
  Synthetic
tggaagcaacaggactacaagcctcccaccgtccacgggtgcgctatgcctcccagcaagcaaacccccgtccct

SEQ ID NO: 135151 - DNA, 75 bp, Artificial Sequence
  Synthetic
tggaagcaacaggactacaagcctcccaccgtccacgggtgcgctatgcctccctgcaagcaaacccccgtccct

SEQ ID NO: 135152 - DNA, 75 bp, Artificial Sequence
  Synthetic
tggaagcaacaggactacaagcctcccaccgtccacgggtgcgctatgcctccccgcaagcaaacccccgtccct

SEQ ID NO: 135153 - DNA, 75 bp, Artificial Sequence
  Synthetic
tggaagcaacaggactacaagcctcccaccgtccacgggtgcgctatgcctcccggcaagcaaacccccgtccct

SEQ ID NO: 135154 - DNA, 75 bp, Artificial Sequence
  Synthetic
tggaagcaacaggactacaagcctcccaccgtccacgggtgcgctttgcctcccagcaagcaaacccccgtccct

SEQ ID NO: 135155 - DNA, 75 bp, Artificial Sequence
  Synthetic
tggaagcaacaggactacaagcctcccaccgtccacgggtgcgctttgcctccctgcaagcaaacccccgtccct

SEQ ID NO: 135156 - DNA, 75 bp, Artificial Sequence
  Synthetic
tggaagcaacaggactacaagcctcccaccgtccacgggtgcgctttgcctccccgcaagcaaacccccgtccct

SEQ ID NO: 135157 - DNA, 75 bp, Artificial Sequence
  Synthetic
tggaagcaacaggactacaagcctcccaccgtccacgggtgcgctttgcctcccggcaagcaaacccccgtccct

SEQ ID NO: 135158 - DNA, 75 bp, Artificial Sequence
  Synthetic
tggaagcaacaggactacaagcctcccaccgtccacgggtgcgctctgcctcccagcaagcaaacccccgtccct

SEQ ID NO: 135159 - DNA, 75 bp, Artificial Sequence
  Synthetic
tggaagcaacaggactacaagcctcccaccgtccacgggtgcgctctgcctccctgcaagcaaacccccgtccct

SEQ ID NO: 135160 - DNA, 75 bp, Artificial Sequence
  Synthetic
tggaagcaacaggactacaagcctcccaccgtccacgggtgcgctctgcctccccgcaagcaaacccccgtccct

SEQ ID NO: 135161 - DNA, 75 bp, Artificial Sequence
  Synthetic
tggaagcaacaggactacaagcctcccaccgtccacgggtgcgctctgcctcccggcaagcaaacccccgtccct

SEQ ID NO: 135162 - DNA, 75 bp, Artificial Sequence
  Synthetic
tggaagcaacaggactacaagcctcccaccgtccacgggtgcgctgtgcctcccagcaagcaaacccccgtccct

SEQ ID NO: 135163 - DNA, 75 bp, Artificial Sequence
  Synthetic
tggaagcaacaggactacaagcctcccaccgtccacgggtgcgctgtgcctccctgcaagcaaacccccgtccct

SEQ ID NO: 135164 - DNA, 75 bp, Artificial Sequence
  Synthetic
tggaagcaacaggactacaagcctcccaccgtccacgggtgcgctgtgcctccccgcaagcaaacccccgtccct

SEQ ID NO: 135165 - DNA, 75 bp, Artificial Sequence
  Synthetic
tggaagcaacaggactacaagcctcccaccgtccacgggtgcgctgtgcctcccggcaagcaaacccccgtccct

SEQ ID NO: 135166 - DNA, 75 bp, Artificial Sequence
  Synthetic
tggaagcaacaggactacaagcctccgaccgtccacgggtgcgctatgcctcccagcaagcaaacccccgtccct

SEQ ID NO: 135167 - DNA, 75 bp, Artificial Sequence
  Synthetic
tggaagcaacaggactacaagcctccgaccgtccacgggtgcgctatgcctccctgcaagcaaacccccgtccct

SEQ ID NO: 135168 - DNA, 75 bp, Artificial Sequence
  Synthetic
tggaagcaacaggactacaagcctccgaccgtccacgggtgcgctatgcctccccgcaagcaaacccccgtccct

SEQ ID NO: 135169 - DNA, 75 bp, Artificial Sequence
  Synthetic
tggaagcaacaggactacaagcctccgaccgtccacgggtgcgctatgcctcccggcaagcaaacccccgtccct

SEQ ID NO: 135170 - DNA, 75 bp, Artificial Sequence
  Synthetic
tggaagcaacaggactacaagcctccgaccgtccacgggtgcgctttgcctcccagcaagcaaacccccgtccct

SEQ ID NO: 135171 - DNA, 75 bp, Artificial Sequence
  Synthetic
tggaagcaacaggactacaagcctccgaccgtccacgggtgcgctttgcctccctgcaagcaaacccccgtccct

SEQ ID NO: 135172 - DNA, 75 bp, Artificial Sequence
  Synthetic
tggaagcaacaggactacaagcctccgaccgtccacgggtgcgctttgcctccccgcaagcaaacccccgtccct

SEQ ID NO: 135173 - DNA, 75 bp, Artificial Sequence
  Synthetic
tggaagcaacaggactacaagcctccgaccgtccacgggtgcgctttgcctcccggcaagcaaacccccgtccct

SEQ ID NO: 135174 - DNA, 75 bp, Artificial Sequence
  Synthetic
tggaagcaacaggactacaagcctccgaccgtccacgggtgcgctctgcctcccagcaagcaaacccccgtccct

SEQ ID NO: 135175 - DNA, 75 bp, Artificial Sequence
  Synthetic
tggaagcaacaggactacaagcctccgaccgtccacgggtgcgctctgcctccctgcaagcaaacccccgtccct

SEQ ID NO: 135176 - DNA, 75 bp, Artificial Sequence
  Synthetic
tggaagcaacaggactacaagcctccgaccgtccacgggtgcgctctgcctccccgcaagcaaacccccgtccct

SEQ ID NO: 135177 - DNA, 75 bp, Artificial Sequence
  Synthetic
tggaagcaacaggactacaagcctccgaccgtccacgggtgcgctctgcctcccggcaagcaaacccccgtccct

SEQ ID NO: 135178 - DNA, 75 bp, Artificial Sequence
  Synthetic
tggaagcaacaggactacaagcctccgaccgtccacgggtgcgctgtgcctcccagcaagcaaacccccgtccct

SEQ ID NO: 135179 - DNA, 75 bp, Artificial Sequence
  Synthetic
tggaagcaacaggactacaagcctccgaccgtccacgggtgcgctgtgcctccctgcaagcaaacccccgtccct

SEQ ID NO: 135180 - DNA, 75 bp, Artificial Sequence
  Synthetic
tggaagcaacaggactacaagcctccgaccgtccacgggtgcgctgtgcctccccgcaagcaaacccccgtccct

SEQ ID NO: 135181 - DNA, 75 bp, Artificial Sequence
  Synthetic
tggaagcaacaggactacaagcctccgaccgtccacgggtgcgctgtgcctcccggcaagcaaacccccgtccct

SEQ ID NO: 135182 - DNA, 75 bp, Artificial Sequence
  Synthetic
tgtggatgatgatgatggtggcgcaggttgaagctgcccttgccaatctgattaccatcaatgctgtggcggcgg

SEQ ID NO: 135183 - DNA, 75 bp, Artificial Sequence
  Synthetic
ctgccacctatgcagcttgtgggatgtggcccttgctcctcctgctcttggcgttgcccagaagggcctacgctt

SEQ ID NO: 135184 - DNA, 75 bp, Artificial Sequence
  Synthetic
gtggcaacttgagggtgcggtactgcatgttcctggttgcgtcccctgcgagttactgggtaacatatcgcggtg

SEQ ID NO: 135185 - DNA, 75 bp, Artificial Sequence
  Synthetic
gtggcatcttgagggtgcggtactgcatgttcctggttgcgtcccctgcgagttactgggtaacatatcgcggtg

SEQ ID NO: 135186 - DNA, 75 bp, Artificial Sequence
  Synthetic
gtggcaccttgagggtgcggtactgcatgttcctggttgcgtcccctgcgagttactgggtaacatatcgcggtg

SEQ ID NO: 135187 - DNA, 75 bp, Artificial Sequence
  Synthetic
gtggcagcttgagggtgcggtactgcatgttcctggttgcgtcccctgcgagttactgggtaacatatcgcggtg

SEQ ID NO: 135188 - DNA, 75 bp, Artificial Sequence
  Synthetic
atgtagcggggatcttccgcgctgctgtgtgtactaggggtgtggctaagtcccttgactttgttcccgtggaga

SEQ ID NO: 135189 - DNA, 75 bp, Artificial Sequence
  Synthetic
cagactccggtgcagacctcaccaccccaacagagaccacagactcgggccccatcctcgtggatgacgcatctg

SEQ ID NO: 135190 - DNA, 75 bp, Artificial Sequence
  Synthetic
cagactccggtgcagacctcaccaccccaactgagaccacagactcgggccccatcctcgtggatgacgcatctg

SEQ ID NO: 135191 - DNA, 75 bp, Artificial Sequence
  Synthetic
cagactccggtgcagacctcaccaccccaaccgagaccacagactcgggccccatcctcgtggatgacgcatctg

SEQ ID NO: 135192 - DNA, 75 bp, Artificial Sequence
  Synthetic
cagactccggtgcagacctcaccaccccaacggagaccacagactcgggccccatcctcgtggatgacgcatctg

SEQ ID NO: 135193 - DNA, 75 bp, Artificial Sequence
  Synthetic
ttctttggaatactccaatctcaggagcaactccataaagcacttgacttcgacatctacggagtcacttactca

SEQ ID NO: 135194 - DNA, 75 bp, Artificial Sequence
  Synthetic
ctggtggatccagtacttcatcgcaaggatcgaggccattctgcatgtgtatgttccatcattcgacgtgcgtgg

SEQ ID NO: 135195 - DNA, 75 bp, Artificial Sequence
  Synthetic
ggcacagtcctggaccaagcggagacggctggagcgcggctcgtcgtgctcgccaccgctacgcctccgggatcg

SEQ ID NO: 135196 - DNA, 75 bp, Artificial Sequence
  Synthetic
tagtggtaagagcaccaaggtcccagccgcgtacgctgctcagggttacaaagttttggtgctcaatccctccgt

SEQ ID NO: 135197 - DNA, 75 bp, Artificial Sequence
  Synthetic
gctcgggcggtcagagcgaagctcattgctcagggagggaaagctgcgatatgcggcaagtacctcttcaactgg

SEQ ID NO: 135198 - DNA, 75 bp, Artificial Sequence
  Synthetic
tctttgacataacaaaatatctccttgctatgattggccccctctacctgctccagaactcgctgatgcatgtcc

SEQ ID NO: 135199 - DNA, 75 bp, Artificial Sequence
  Synthetic
cgtgtgctgctcaatgtcatattcatggactggggcgcttgtaacaccttgagcagctgaagaatcaaagctgcc

SEQ ID NO: 135200 - DNA, 75 bp, Artificial Sequence
  Synthetic
cgtgtgctgctcaatgtcatattcatggactggggcgcttgtaacaccttgagcagctgaagattcaaagctgcc

SEQ ID NO: 135201 - DNA, 75 bp, Artificial Sequence
  Synthetic
cgtgtgctgctcaatgtcatattcatggactggggcgcttgtaacaccttgagcagctgaagactcaaagctgcc

SEQ ID NO: 135202 - DNA, 75 bp, Artificial Sequence
  Synthetic
cgtgtgctgctcaatgtcatattcatggactggggcgcttgtaacaccttgagcagctgaagagtcaaagctgcc

SEQ ID NO: 135203 - DNA, 75 bp, Artificial Sequence
  Synthetic
cgtgtgctgctcaatgtcatattcatggactggggcgcttgtaacaccttgtgcagctgaagaatcaaagctgcc

SEQ ID NO: 135204 - DNA, 75 bp, Artificial Sequence
  Synthetic
cgtgtgctgctcaatgtcatattcatggactggggcgcttgtaacaccttgtgcagctgaagattcaaagctgcc

SEQ ID NO: 135205 - DNA, 75 bp, Artificial Sequence
  Synthetic
cgtgtgctgctcaatgtcatattcatggactggggcgcttgtaacaccttgtgcagctgaagactcaaagctgcc

SEQ ID NO: 135206 - DNA, 75 bp, Artificial Sequence
  Synthetic
cgtgtgctgctcaatgtcatattcatggactggggcgcttgtaacaccttgtgcagctgaagagtcaaagctgcc

SEQ ID NO: 135207 - DNA, 75 bp, Artificial Sequence
  Synthetic
cgtgtgctgctcaatgtcatattcatggactggggcgcttgtaacaccttgcgcagctgaagaatcaaagctgcc

SEQ ID NO: 135208 - DNA, 75 bp, Artificial Sequence
  Synthetic
cgtgtgctgctcaatgtcatattcatggactggggcgcttgtaacaccttgcgcagctgaagattcaaagctgcc

SEQ ID NO: 135209 - DNA, 75 bp, Artificial Sequence
  Synthetic
cgtgtgctgctcaatgtcatattcatggactggggcgcttgtaacaccttgcgcagctgaagactcaaagctgcc

SEQ ID NO: 135210 - DNA, 75 bp, Artificial Sequence
  Synthetic
cgtgtgctgctcaatgtcatattcatggactggggcgcttgtaacaccttgcgcagctgaagagtcaaagctgcc

SEQ ID NO: 135211 - DNA, 75 bp, Artificial Sequence
  Synthetic
cgtgtgctgctcaatgtcatattcatggactggggcgcttgtaacaccttgggcagctgaagaatcaaagctgcc

SEQ ID NO: 135212 - DNA, 75 bp, Artificial Sequence
  Synthetic
cgtgtgctgctcaatgtcatattcatggactggggcgcttgtaacaccttgggcagctgaagattcaaagctgcc

SEQ ID NO: 135213 - DNA, 75 bp, Artificial Sequence
  Synthetic
cgtgtgctgctcaatgtcatattcatggactggggcgcttgtaacaccttgggcagctgaagactcaaagctgcc

SEQ ID NO: 135214 - DNA, 75 bp, Artificial Sequence
  Synthetic
cgtgtgctgctcaatgtcatattcatggactggggcgcttgtaacaccttgggcagctgaagagtcaaagctgcc

SEQ ID NO: 135215 - DNA, 75 bp, Artificial Sequence
  Synthetic
acatactctacttatggcaaattcctcgctgatgggggctgctctggcggcgcctacgacatcatcatttgcgac

SEQ ID NO: 135216 - DNA, 75 bp, Artificial Sequence
  Synthetic
cttcaccggcacctacatttatgaccaccttaccccactgtcggattgggcttctgatggcttgaaagacctggc

SEQ ID NO: 135217 - DNA, 75 bp, Artificial Sequence
  Synthetic
acagcgtgtctcgagctcgaccccgcatgttactcctgtgcctactcctactctccgtaggggtaggcatctttt

SEQ ID NO: 135218 - DNA, 75 bp, Artificial Sequence
  Synthetic
tgggggccctatgtttaacagcaagggagcccagtgtggttaccgccgttgtcgtgctagcggagttttgcctac

SEQ ID NO: 135219 - DNA, 75 bp, Artificial Sequence
  Synthetic
cgggggcccgtcaaaacattcaactcatcaacaccaacggcagctggcacatcaaccgcactgccttgaattgca

SEQ ID NO: 135220 - DNA, 75 bp, Artificial Sequence
  Synthetic
cctggggtgctgacaccgccgcgtgcggtgacatcatcaaagggttgccagtttcggctaggttgggcaatgaaa

SEQ ID NO: 135221 - DNA, 75 bp, Artificial Sequence
  Synthetic
ctccccccgggtctgtcacagtccctcacccaaacatcactgagactgctttgccgagcacaggtgaggtgcctt

SEQ ID NO: 135222 - DNA, 75 bp, Artificial Sequence
  Synthetic
tgcgtcgttgttctatgacaacaaattcaactcctcgggttgtcctcagcgaatgtcctcctgccgcactatcga

SEQ ID NO: 135223 - DNA, 75 bp, Artificial Sequence
  Synthetic
tgcgtcgttgttctatgacaacaaattcaactcctcgggttgtcctcagcgaatgtcctcctgccgctctatcga

SEQ ID NO: 135224 - DNA, 75 bp, Artificial Sequence
  Synthetic
tgcgtcgttgttctatgacaacaaattcaactcctcgggttgtcctcagcgaatgtcctcctgccgccctatcga

SEQ ID NO: 135225 - DNA, 75 bp, Artificial Sequence
  Synthetic
tgcgtcgttgttctatgacaacaaattcaactcctcgggttgtcctcagcgaatgtcctcctgccgcgctatcga

SEQ ID NO: 135226 - DNA, 75 bp, Artificial Sequence
  Synthetic
tgcgtcgttgttctatgtcaacaaattcaactcctcgggttgtcctcagcgaatgtcctcctgccgcactatcga

SEQ ID NO: 135227 - DNA, 75 bp, Artificial Sequence
  Synthetic
tgcgtcgttgttctatgtcaacaaattcaactcctcgggttgtcctcagcgaatgtcctcctgccgctctatcga

SEQ ID NO: 135228 - DNA, 75 bp, Artificial Sequence
  Synthetic
tgcgtcgttgttctatgtcaacaaattcaactcctcgggttgtcctcagcgaatgtcctcctgccgccctatcga

SEQ ID NO: 135229 - DNA, 75 bp, Artificial Sequence
  Synthetic
tgcgtcgttgttctatgtcaacaaattcaactcctcgggttgtcctcagcgaatgtcctcctgccgcgctatcga

SEQ ID NO: 135230 - DNA, 75 bp, Artificial Sequence
  Synthetic
tgcgtcgttgttctatgccaacaaattcaactcctcgggttgtcctcagcgaatgtcctcctgccgcactatcga

SEQ ID NO: 135231 - DNA, 75 bp, Artificial Sequence
  Synthetic
tgcgtcgttgttctatgccaacaaattcaactcctcgggttgtcctcagcgaatgtcctcctgccgctctatcga

SEQ ID NO: 135232 - DNA, 75 bp, Artificial Sequence
  Synthetic
tgcgtcgttgttctatgccaacaaattcaactcctcgggttgtcctcagcgaatgtcctcctgccgccctatcga

SEQ ID NO: 135233 - DNA, 75 bp, Artificial Sequence
  Synthetic
tgcgtcgttgttctatgccaacaaattcaactcctcgggttgtcctcagcgaatgtcctcctgccgcgctatcga

SEQ ID NO: 135234 - DNA, 75 bp, Artificial Sequence
  Synthetic
tgcgtcgttgttctatggcaacaaattcaactcctcgggttgtcctcagcgaatgtcctcctgccgcactatcga

SEQ ID NO: 135235 - DNA, 75 bp, Artificial Sequence
  Synthetic
tgcgtcgttgttctatggcaacaaattcaactcctcgggttgtcctcagcgaatgtcctcctgccgctctatcga

SEQ ID NO: 135236 - DNA, 75 bp, Artificial Sequence
  Synthetic
tgcgtcgttgttctatggcaacaaattcaactcctcgggttgtcctcagcgaatgtcctcctgccgccctatcga

SEQ ID NO: 135237 - DNA, 75 bp, Artificial Sequence
  Synthetic
tgcgtcgttgttctatggcaacaaattcaactcctcgggttgtcctcagcgaatgtcctcctgccgcgctatcga

SEQ ID NO: 135238 - DNA, 75 bp, Artificial Sequence
  Synthetic
tcacccaaacatcactgagactgctttgccgagcacaggtgaggtgcctttctacggaaaggcgatccccctcga

SEQ ID NO: 135239 - DNA, 75 bp, Artificial Sequence
  Synthetic
tggccaaaaatgaggttttcgctgtaaacccagcgaagggaggtcggaagcctgctcgtctgatcgtgtatccgg

SEQ ID NO: 135240 - DNA, 75 bp, Artificial Sequence
  Synthetic
atctcttgggctcaatgcagtagcattctacaggggcgtcgacgtggcggtcatcccgacctcaggtgacgtcgt

SEQ ID NO: 135241 - DNA, 75 bp, Artificial Sequence
  Synthetic
gtggcccagtgtattgtttcacccccagtccagtcgtggtaggcaccaccgacaggtacggggcgccaacctaca

SEQ ID NO: 135242 - DNA, 75 bp, Artificial Sequence
  Synthetic
gtaatgtggactgtatatcatggggcaggtagcaagaccatctgcggcccgaaagggcctgtcaaccagatgtac

SEQ ID NO: 135243 - DNA, 75 bp, Artificial Sequence
  Synthetic
agggttgcccgtctgccaggaccatctggagttctgggagagcgtcttcacaggcctcacccacatagatgccca

SEQ ID NO: 135244 - DNA, 75 bp, Artificial Sequence
  Synthetic
gaccctacattcaccatagagaccaccactgtgccccaagacgccgtatcacggagtcagaggagaggtaggaca

SEQ ID NO: 135245 - DNA, 75 bp, Artificial Sequence
  Synthetic
tagcctatttcgccatgcagggagcgtgggccaaagtcattgtcatcctcctccttgtagcgggagtggacgcgc

SEQ ID NO: 135246 - DNA, 75 bp, Artificial Sequence
  Synthetic
ccactgtgccccaagacgccgtatcacggagtcagaggagaggtaggacagggagggggaaacacggggagtata

SEQ ID NO: 135247 - DNA, 75 bp, Artificial Sequence
  Synthetic
cgcataagaccagacttcaactccaccgaggacttgctgtgccccactgactgcttcaggaagcaccctgaggct

SEQ ID NO: 135248 - DNA, 75 bp, Artificial Sequence
  Synthetic
ccgcggggagcttggtttggatgcacatggatgaatggcactgggttcactaagacctgcggcgccccaccttgc

SEQ ID NO: 135249 - DNA, 75 bp, Artificial Sequence
  Synthetic
cctttgtgggtatcgaagatgccgcgcaagcggcgtctacacaaccagcttcggaaacacactgacgtgctatct

SEQ ID NO: 135250 - DNA, 75 bp, Artificial Sequence
  Synthetic
cctttgtgggtatcgtagatgccgcgcaagcggcgtctacacaaccagcttcggaaacacactgacgtgctatct

SEQ ID NO: 135251 - DNA, 75 bp, Artificial Sequence
  Synthetic
cctttgtgggtatcgcagatgccgcgcaagcggcgtctacacaaccagcttcggaaacacactgacgtgctatct

SEQ ID NO: 135252 - DNA, 75 bp, Artificial Sequence
  Synthetic
cctttgtgggtatcggagatgccgcgcaagcggcgtctacacaaccagcttcggaaacacactgacgtgctatct

SEQ ID NO: 135253 - DNA, 75 bp, Artificial Sequence
  Synthetic
tgcgaacccgaaccggatgtggccgtgttgacgtccatgcttactgatccctcccatataacggcagaggcggcc

SEQ ID NO: 135254 - DNA, 75 bp, Artificial Sequence
  Synthetic
tggcagttggcacataaaccggaccgccctcaactgcaatgatagcctgaatacgggtttcatcgcttccctgtt

SEQ ID NO: 135255 - DNA, 75 bp, Artificial Sequence
  Synthetic
cgaaacaaccgtacgactacgcgcctatttgaatacaccaggactccccgtctgtcaagaccacctggaattttg

SEQ ID NO: 135256 - DNA, 75 bp, Artificial Sequence
  Synthetic
gtgaattatgcaacagggaaccttcccggttgctccttttctatcttccttttggccctgctctcgtgcctaaca

SEQ ID NO: 135257 - DNA, 75 bp, Artificial Sequence
  Synthetic
catattgacgcccactttctctcgcagacaaagcagtcgggagaaaactttgcgtatcttgtcgcctaccaagcg

SEQ ID NO: 135258 - DNA, 75 bp, Artificial Sequence
  Synthetic
actgtttgcgcaagggccaaagccccccctccttcttgggacactatgtggaaatgccttattcgcctcaagcct

SEQ ID NO: 135259 - DNA, 75 bp, Artificial Sequence
  Synthetic
ttctccacctgccagggtgtgtaccttgcgtccgggagggcaacacctcgagatgctgggtatcactcaccccca

SEQ ID NO: 135260 - DNA, 75 bp, Artificial Sequence
  Synthetic
gaaatgccttattcgcctcaagcctatgcttacagggcctacccccttgctgtataggcttggcgctgtgcagaa

SEQ ID NO: 135261 - DNA, 75 bp, Artificial Sequence
  Synthetic
ggatctctgtggatcaatctacttggtggggcaactgttcaccttcacaccgcggaggtattggacagagcaggg

SEQ ID NO: 135262 - DNA, 75 bp, Artificial Sequence
  Synthetic
ctcgcggcgctagctgcctactgtttgtctgtgggttgcgtagtgatctgcggtaggattaccaccactggcaag

SEQ ID NO: 135263 - DNA, 75 bp, Artificial Sequence
  Synthetic
ccatcctttcgcccggagccctcgtggtcggtgtggtctgcgcagcaatactacgtcggcatgttggcccgggcg

SEQ ID NO: 135264 - DNA, 75 bp, Artificial Sequence
  Synthetic
ccgctggatctaccggcaatcattcaaagactccatggcttaagcgcatttacactgcacggatactctccacac

SEQ ID NO: 135265 - DNA, 75 bp, Artificial Sequence
  Synthetic
gtggggcaactgttcaccttcacaccgcggaggtattggacagagcagggctgcaactgttccatctatcctggg

SEQ ID NO: 135266 - DNA, 75 bp, Artificial Sequence
  Synthetic
ggcacatcaagggtcgagtggtccccctgactgcttactcgtacctcagcttgtggtctttcagtcttctactcc

SEQ ID NO: 135267 - DNA, 75 bp, Artificial Sequence
  Synthetic
ccaaatgcctggtggactacccttataggttgtggcactatccgtgcactgtgaattttaccatcttcaaggtgc

SEQ ID NO: 135268 - DNA, 75 bp, Artificial Sequence
  Synthetic
tggacatgattgccggctcccactggggtgtcctagcggggctggcttattattccatggtggggaactgggcca

SEQ ID NO: 135269 - DNA, 75 bp, Artificial Sequence
  Synthetic
cggccttatccaaactactaccaagcaagccgaagagcttaagcctgctgtccattctgcttggcccaaactcga

SEQ ID NO: 135270 - DNA, 75 bp, Artificial Sequence
  Synthetic
ccaacatagaggaggtcgccctgccgacgacgggagaaatacccttctacggcaaggctatacccctcgcttgta

SEQ ID NO: 135271 - DNA, 75 bp, Artificial Sequence
  Synthetic
tcgattctccgcggcatgcaatttcacacgaggagaccgctgcagattggacgatagggacaggggtcagcaaag

SEQ ID NO: 135272 - DNA, 75 bp, Artificial Sequence
  Synthetic
ttataagaccctcctctgccgtagtctatggtggttgtcctatttactggtccgggcggaagccttgatccaaca

SEQ ID NO: 135273 - DNA, 75 bp, Artificial Sequence
  Synthetic
ctatggtggttgtcctatttactggtccgggcggaagccttgatccaacagtgggtaccgcccttgcaggcacga

SEQ ID NO: 135274 - DNA, 75 bp, Artificial Sequence
  Synthetic
tgccccgggcgcccagcagcagcttcagcttataaacaccaatggcagctggcatctcaacaggacggccttgaa

SEQ ID NO: 135275 - DNA, 75 bp, Artificial Sequence
  Synthetic
tccttctcagcttccttgaccagcccgatgtcgacctctacaaccctcctgctcaacatcctggggggctgggtc

SEQ ID NO: 135276 - DNA, 75 bp, Artificial Sequence
  Synthetic
cgatgtcgacctctacaaccctcctgctcaacatcctggggggctgggtcgcttcccaactcgcaaaccccacag

SEQ ID NO: 135277 - DNA, 75 bp, Artificial Sequence
  Synthetic
gcgccactgatgccctcatgactggcttcaccggcgactttgactcagtgatagactgcaatacgtctgtcatac

SEQ ID NO: 135278 - DNA, 75 bp, Artificial Sequence
  Synthetic
tccttaggagtgtcctgacaagcgcgccatacttcgtcagagcacaagctctgttgaggatatgcgctgctgtaa

SEQ ID NO: 135279 - DNA, 75 bp, Artificial Sequence
  Synthetic
cccatcacccacttcgatcaggggtatgggcccatcacctatgtctctgccgccgataggtccgcacctgacaac

SEQ ID NO: 135280 - DNA, 75 bp, Artificial Sequence
  Synthetic
cgtgtccggggcactcgtcgcttttaagatcatgagcggtgagaccccctcagccgaggacatggtcaacctgct

SEQ ID NO: 135281 - DNA, 75 bp, Artificial Sequence
  Synthetic
taactgctcgctgtacccaggccatctttcaggacatcgaatggcttgggatatgatgatgaattggtcccccgc

SEQ ID NO: 135282 - DNA, 75 bp, Artificial Sequence
  Synthetic
gccagcgcggaatgtctgtgggccggtgttttgtttcacccccagccctgtggtggtgggggtaactgacatcag

SEQ ID NO: 135283 - DNA, 75 bp, Artificial Sequence
  Synthetic
tggtggtgggggtaactgacatcagtggcaatcccaccttcacctctggagccaatgacaccgacttcttcctgc

SEQ ID NO: 135284 - DNA, 75 bp, Artificial Sequence
  Synthetic
ctcctcctagtcctggccttaccacaacaggcttatgctctggacgccgctgaacaaggggagttagggctggcc

SEQ ID NO: 135285 - DNA, 75 bp, Artificial Sequence
  Synthetic
aaccggttgatagcttttgcctccaggggtaaccatgtatcgcccacgcactatgtgccagagacagacacctct

SEQ ID NO: 135286 - DNA, 75 bp, Artificial Sequence
  Synthetic
gtggtgcccccgcgtgcaacatcgggggcagcggcggtaaacaactgctctgccccacggattgtttccgcaaac

SEQ ID NO: 135287 - DNA, 75 bp, Artificial Sequence
  Synthetic
gaaattgcatgagtggatcaacagcgattggtctactccttgcagcgggtcatggctacgggagatctgggactg

SEQ ID NO: 135288 - DNA, 75 bp, Artificial Sequence
  Synthetic
cctagttgggacaccatgtggaaatgtctgattcgcctcaagcccacactacacgggcccactcccctcctttac

SEQ ID NO: 135289 - DNA, 75 bp, Artificial Sequence
  Synthetic
ggcgtgtggaggggtgacggcatttgtcacactacatgtccatgtggtgctgacatagtcggccacgttaagaat

SEQ ID NO: 135290 - DNA, 75 bp, Artificial Sequence
  Synthetic
gggtcctggtaggcggcatcctggcggctctagctgcgtactgcttgtcagtcggcagcgtggtgatcgtcggga

SEQ ID NO: 135291 - DNA, 75 bp, Artificial Sequence
  Synthetic
ccctactacgggtgccatactttgtgagggctcacgccctgctacgagcatgcatcctggtgaggcgcctcgcag

SEQ ID NO: 135292 - DNA, 75 bp, Artificial Sequence
  Synthetic
gcgcggcgacccctgcgccctggaggacagggacagagcagagttgagcccgctcctattatccaccacacagtg

SEQ ID NO: 135293 - DNA, 75 bp, Artificial Sequence
  Synthetic
tccttctaatgacagaccgtactgctggcactacgcacctaacccctgtgacgttgtccaggcatcaactgtctg

SEQ ID NO: 135294 - DNA, 75 bp, Artificial Sequence
  Synthetic
tgacatagtcggccacgttaagaatggatccatgaggatctccggtccgcggtggtgcagtaacatctggcatgg

SEQ ID NO: 135295 - DNA, 75 bp, Artificial Sequence
  Synthetic
agcccaactataagagggccctgtggagggtgtccgcagaggagtacgtcgaggtagtgaggatgggtgatagcc

SEQ ID NO: 135296 - DNA, 75 bp, Artificial Sequence
  Synthetic
cgagcatgggctgcagttggcagaacaattcaaacagaaagccctcggcgtgctgaacatcgctagcaagcaggc

SEQ ID NO: 135297 - DNA, 75 bp, Artificial Sequence
  Synthetic
ggctcagttgtcacctcctgggtcatcaagtgggagtatgttgtgctcctgttcctcttgctggcggacgctcgc

SEQ ID NO: 135298 - DNA, 75 bp, Artificial Sequence
  Synthetic
tttggagaacttgatcgtcctcaacgccgcgtccctcgctgggacgcacggtgtgggggcttttctcgttttctt

SEQ ID NO: 135299 - DNA, 75 bp, Artificial Sequence
  Synthetic
tgcgcctccctgcaaaccccttttaagggatgagatctccttttccgtagggctcaactcctacgcgatcgggtc

SEQ ID NO: 135300 - DNA, 75 bp, Artificial Sequence
  Synthetic
tctcctgggtgccatcgtggtcagcctaacgggccgcgacaaaaatgagcaggctgggcaggtccaggttctgtc

SEQ ID NO: 135301 - DNA, 75 bp, Artificial Sequence
  Synthetic
accactcagcagactctcctcttcaacatcctgggagggtgggtggcctcgcagatcgctacccccacagcgtct

SEQ ID NO: 135302 - DNA, 75 bp, Artificial Sequence
  Synthetic
agggatgagatctccttttccgtagggctcaactcctacgcgatcgggtctcaattgccatgtgaaccggagccg

SEQ ID NO: 135303 - DNA, 75 bp, Artificial Sequence
  Synthetic
gctcatcagcaagtcagctctcagccccatcactgaaagcaacatgcaccacgcatggggtgcatgccgatgcgg

SEQ ID NO: 135304 - DNA, 75 bp, Artificial Sequence
  Synthetic
ttaccgccgcttgcaactggaccaggggggagcgctgcgatatcgaggatcgtgaccgcagcgagcaacatccgc

SEQ ID NO: 135305 - DNA, 75 bp, Artificial Sequence
  Synthetic
ttgccaggatcatatggtggctccagtactttttgaccaagaccgaagccgcgttgcaagtatgggtcccccccc

SEQ ID NO: 135306 - DNA, 75 bp, Artificial Sequence
  Synthetic
acccgcgtggagtctgagaataaggtcatcgttctcgactcattcgacccgctggtacctgaatatgatgacaga

SEQ ID NO: 135307 - DNA, 75 bp, Artificial Sequence
  Synthetic
tgtcattccggtccggaggaaagatgaccggcggggtgcactactctcgccgaggcctctctcaaccctcaaggg

SEQ ID NO: 135308 - DNA, 75 bp, Artificial Sequence
  Synthetic
ccccatgtggctcttgcaggccagcctggtcaaagtgccgtaattcgtgcgcgcgcacgctctcctccgtgcttg

SEQ ID NO: 135309 - DNA, 75 bp, Artificial Sequence
  Synthetic
ccccatgtggctcttgcaggccagcctggtcaaagtgccgtatttcgtgcgcgcgcacgctctcctccgtgcttg

SEQ ID NO: 135310 - DNA, 75 bp, Artificial Sequence
  Synthetic
ccccatgtggctcttgcaggccagcctggtcaaagtgccgtacttcgtgcgcgcgcacgctctcctccgtgcttg

SEQ ID NO: 135311 - DNA, 75 bp, Artificial Sequence
  Synthetic
ccccatgtggctcttgcaggccagcctggtcaaagtgccgtagttcgtgcgcgcgcacgctctcctccgtgcttg

SEQ ID NO: 135312 - DNA, 75 bp, Artificial Sequence
  Synthetic
aaccatgtatcccccacgcattatgttccagaatccgacgcagcggcccgcgtatctgccatactgtcctccctc

SEQ ID NO: 135313 - DNA, 75 bp, Artificial Sequence
  Synthetic
agacttggaagaaaccagactataccccaccgctggttcacgggtgcgccctgccccccgcagggcagcctccag

SEQ ID NO: 135314 - DNA, 75 bp, Artificial Sequence
  Synthetic
tcccaccgcccaggaggaagaaagtggtgcacttggacgactccagcgtggcggaagctctggcagaactagcta

SEQ ID NO: 135315 - DNA, 75 bp, Artificial Sequence
  Synthetic
cgccaacgggcagcgggaagagcaccaaggtccctgccgcgtatgccagtcaggggtataaagtacttgtactaa

SEQ ID NO: 135316 - DNA, 75 bp, Artificial Sequence
  Synthetic
gtggctaaaggccaagcttatgcccaccatgccaggcatccccttcctctcctgccagagggggttcaaagggga

SEQ ID NO: 135317 - DNA, 75 bp, Artificial Sequence
  Synthetic
gcccctccaataccacctccgcggaggaagaggacggttgtcctgacagaatccaccgtgtcttctgccttggcg

SEQ ID NO: 135318 - DNA, 75 bp, Artificial Sequence
  Synthetic
tgagtccgctgcttttctcaactacgcagctcgccatactcccctgttcgttttccaccatgccggccctatcat

SEQ ID NO: 135319 - DNA, 75 bp, Artificial Sequence
  Synthetic
cggctctgacgcggggtcctacagctctatgccgccacttgagggtgagccgggtgatccggaccttgattcggg

SEQ ID NO: 135320 - DNA, 75 bp, Artificial Sequence
  Synthetic
gtggcgggagctcttgtggcattcaagatcatgagcggtgaggttccctccacagaggacctggtcaatctactg

SEQ ID NO: 135321 - DNA, 75 bp, Artificial Sequence
  Synthetic
gagaaattgcccataaacccattgagcaattccctcattcgacaccacaatctggtgtactccacaacatcccgg

SEQ ID NO: 135322 - DNA, 75 bp, Artificial Sequence
  Synthetic
gtcaccgggatgacccaagacaacatcaaatgtccctgccaggtccctgctcctgaattcttcacagaggtagat

SEQ ID NO: 135323 - DNA, 75 bp, Artificial Sequence
  Synthetic
gtttaccatggggcgggctcgagaaatctcgctggccccaaaggacccatcatccagatgtacaccaatgttgac

SEQ ID NO: 135324 - DNA, 75 bp, Artificial Sequence
  Synthetic
ctgtcggttggtggcgggcggtgcttttcctgtgctgtgtttgggatgtgaaagggcgtcttgtgcctgcgtgtg

SEQ ID NO: 135325 - DNA, 75 bp, Artificial Sequence
  Synthetic
aaggaggttaaggcccgggcctcagaggtaacggctaagctcctctcagttgaggaggcatgtgcccttacccct

SEQ ID NO: 135326 - DNA, 75 bp, Artificial Sequence
  Synthetic
cgcaaggggcccgatccctggttccatgcacctgtggtgctgcagacatgtatttggttaccaggcacgccgacg

SEQ ID NO: 135327 - DNA, 75 bp, Artificial Sequence
  Synthetic
tcatgctagcaaggccatcaaccatatcaactccgtatggaaggacttgctagaagacaaccaatcaccaattcc

SEQ ID NO: 135328 - DNA, 75 bp, Artificial Sequence
  Synthetic
cctcaggtgggccgctgctgtgcccctccggacacgtcgtgggcctatttagggctgcggtgtgcacccgcgggg

SEQ ID NO: 135329 - DNA, 75 bp, Artificial Sequence
  Synthetic
tagaagacaaccaatcaccaattcccacaaccatcatggcaaagaatgaggtgttctgcgtggacgcttctaagg

SEQ ID NO: 135330 - DNA, 75 bp, Artificial Sequence
  Synthetic
tcggctagtcagctgtctgctccatccttgaaggccacatgcgccgcccatgacacgccgggttccgacctcatt

SEQ ID NO: 135331 - DNA, 75 bp, Artificial Sequence
  Synthetic
cgtcgaggctctggaaacaaccatgaggtccccagtcttcactgataattccacaccaccggctgtgcctcaaac

SEQ ID NO: 135332 - DNA, 75 bp, Artificial Sequence
  Synthetic
tatcatgggagacgcttatggcttccaatactcacccaaacagcgggtggaccgtctgctcaaggtgtggcgctc

SEQ ID NO: 135333 - DNA, 75 bp, Artificial Sequence
  Synthetic
cccacggggagcggcaaaagcaccaaggtcccgtccgcctacgcggctcaggggtacaaggtcctcgtactgaac

SEQ ID NO: 135334 - DNA, 75 bp, Artificial Sequence
  Synthetic
cacagtctgcttaaagtgccttactttgtacgcgcccacgtacttctgcgtgcttgcctacttgttcgtaggcta

SEQ ID NO: 135335 - DNA, 75 bp, Artificial Sequence
  Synthetic
caatactcacccaaacagcgggtggaccgtctgctcaaggtgtggcgctccaagaagacccctatggggttttcc

SEQ ID NO: 135336 - DNA, 75 bp, Artificial Sequence
  Synthetic
caacaggactgccctgaactgcaatgactccctccagactgggttccttgccgcgctgttctacacgcacaagtt

SEQ ID NO: 135337 - DNA, 75 bp, Artificial Sequence
  Synthetic
ctatacgctccctcactgagcggctttacctaggaggccccatgtacaactcccggggccaattctgtgggacac

SEQ ID NO: 135338 - DNA, 75 bp, Artificial Sequence
  Synthetic
ctatacgctccctcactgagcggctttacctaggaggccccatgtacaactcccggggccaattctgtgggactc

SEQ ID NO: 135339 - DNA, 75 bp, Artificial Sequence
  Synthetic
ctatacgctccctcactgagcggctttacctaggaggccccatgtacaactcccggggccaattctgtgggaccc

SEQ ID NO: 135340 - DNA, 75 bp, Artificial Sequence
  Synthetic
ctatacgctccctcactgagcggctttacctaggaggccccatgtacaactcccggggccaattctgtgggacgc

SEQ ID NO: 135341 - DNA, 75 bp, Artificial Sequence
  Synthetic
ccgccataacatactctacctacggcaagttcttggccgatggtggttgcggggccggagcctatgacataatca

SEQ ID NO: 135342 - DNA, 75 bp, Artificial Sequence
  Synthetic
tcccggggccaattctgtgggacacgcaggtgccgcgcaagcggggtgcttaccactagcttaggaaacaccatg

SEQ ID NO: 135343 - DNA, 75 bp, Artificial Sequence
  Synthetic
tcccggggccaattctgtgggacacgcaggtgccgcgcaagcggggtgcttaccactagcttaggtaacaccatg

SEQ ID NO: 135344 - DNA, 75 bp, Artificial Sequence
  Synthetic
tcccggggccaattctgtgggacacgcaggtgccgcgcaagcggggtgcttaccactagcttaggcaacaccatg

SEQ ID NO: 135345 - DNA, 75 bp, Artificial Sequence
  Synthetic
tcccggggccaattctgtgggacacgcaggtgccgcgcaagcggggtgcttaccactagcttagggaacaccatg

SEQ ID NO: 135346 - DNA, 75 bp, Artificial Sequence
  Synthetic
tcccggggccaattctgtgggactcgcaggtgccgcgcaagcggggtgcttaccactagcttaggaaacaccatg

SEQ ID NO: 135347 - DNA, 75 bp, Artificial Sequence
  Synthetic
tcccggggccaattctgtgggactcgcaggtgccgcgcaagcggggtgcttaccactagcttaggtaacaccatg

SEQ ID NO: 135348 - DNA, 75 bp, Artificial Sequence
  Synthetic
tcccggggccaattctgtgggactcgcaggtgccgcgcaagcggggtgcttaccactagcttaggcaacaccatg

SEQ ID NO: 135349 - DNA, 75 bp, Artificial Sequence
  Synthetic
tcccggggccaattctgtgggactcgcaggtgccgcgcaagcggggtgcttaccactagcttagggaacaccatg

SEQ ID NO: 135350 - DNA, 75 bp, Artificial Sequence
  Synthetic
tcccggggccaattctgtgggacccgcaggtgccgcgcaagcggggtgcttaccactagcttaggaaacaccatg

SEQ ID NO: 135351 - DNA, 75 bp, Artificial Sequence
  Synthetic
tcccggggccaattctgtgggacccgcaggtgccgcgcaagcggggtgcttaccactagcttaggtaacaccatg

SEQ ID NO: 135352 - DNA, 75 bp, Artificial Sequence
  Synthetic
tcccggggccaattctgtgggacccgcaggtgccgcgcaagcggggtgcttaccactagcttaggcaacaccatg

SEQ ID NO: 135353 - DNA, 75 bp, Artificial Sequence
  Synthetic
tcccggggccaattctgtgggacccgcaggtgccgcgcaagcggggtgcttaccactagcttagggaacaccatg

SEQ ID NO: 135354 - DNA, 75 bp, Artificial Sequence
  Synthetic
tcccggggccaattctgtgggacgcgcaggtgccgcgcaagcggggtgcttaccactagcttaggaaacaccatg

SEQ ID NO: 135355 - DNA, 75 bp, Artificial Sequence
  Synthetic
tcccggggccaattctgtgggacgcgcaggtgccgcgcaagcggggtgcttaccactagcttaggtaacaccatg

SEQ ID NO: 135356 - DNA, 75 bp, Artificial Sequence
  Synthetic
tcccggggccaattctgtgggacgcgcaggtgccgcgcaagcggggtgcttaccactagcttaggcaacaccatg

SEQ ID NO: 135357 - DNA, 75 bp, Artificial Sequence
  Synthetic
tcccggggccaattctgtgggacgcgcaggtgccgcgcaagcggggtgcttaccactagcttagggaacaccatg

SEQ ID NO: 135358 - DNA, 75 bp, Artificial Sequence
  Synthetic
caacgcgtccgggtgcccagagcgcatggccagctgccgtcccatcgacgagttcgctcagggatggggtcccat

SEQ ID NO: 135359 - DNA, 75 bp, Artificial Sequence
  Synthetic
ggggatcgcccccttctctggccagctcctcggccagccagctgtccgctccatctctcaaggcaacttgcacca

SEQ ID NO: 135360 - DNA, 75 bp, Artificial Sequence
  Synthetic
caccgctacaccaccgggatcaatcactgtgccacacccgaacatcgaggaagttgccctgtccactacgggaga

SEQ ID NO: 135361 - DNA, 75 bp, Artificial Sequence
  Synthetic
ctggaggtcccgttatgtgcccttcggggcatgttgcggggatctttagggctgctgtgtgcaccagaggtgtag

SEQ ID NO: 135362 - DNA, 75 bp, Artificial Sequence
  Synthetic
actgtgccacacccgaacatcgaggaagttgccctgtccactacgggagaaatccctttctacggcaaagctata

SEQ ID NO: 135363 - DNA, 75 bp, Artificial Sequence
  Synthetic
acaccttgtgcagcagaggaatccaaactgccaattagccccctgagcaactcactcctgcgtcaccacaacatg

SEQ ID NO: 135364 - DNA, 75 bp, Artificial Sequence
  Synthetic
cggttgcctactaccgaggtcttgacgtttccgtcattccaactcaaggggacgttgtcgttgtggcgacggacg

SEQ ID NO: 135365 - DNA, 75 bp, Artificial Sequence
  Synthetic
cgtttccgtcattccaactcaaggggacgttgtcgttgtggcgacggacgctctgatgaccggatttaccggcga

SEQ ID NO: 135366 - DNA, 75 bp, Artificial Sequence
  Synthetic
cgggctgcatgggagacagctcgacacactccagtgaattcctggttagggaatataattatgtatgctcctacg

SEQ ID NO: 135367 - DNA, 75 bp, Artificial Sequence
  Synthetic
ccagcccatccccaaagatcggcgctccactggcaagtcctggggaaaaccaggatacccctggcccctatatgg

SEQ ID NO: 135368 - DNA, 75 bp, Artificial Sequence
  Synthetic
cccatttcttccagatactccaagcgcaggagcaattggatagggtacttgacttcgacatatacggagtcacat

SEQ ID NO: 135369 - DNA, 75 bp, Artificial Sequence
  Synthetic
gaagcttgcagcctgacgcccccccactcagccagatccaaatttggctacggggcaaaggacgtccgaagccac

SEQ ID NO: 135370 - DNA, 75 bp, Artificial Sequence
  Synthetic
gaaggcgcggctactcaccactgaggaagcttgcagcctgacgcccccccactcagccagatccaaatttggcta

SEQ ID NO: 135371 - DNA, 75 bp, Artificial Sequence
  Synthetic
cggggcaaaggacgtccgaagccactcccgcaaggccattaaccacatcaactccgtgtgggaggacttgctgga

SEQ ID NO: 135372 - DNA, 75 bp, Artificial Sequence
  Synthetic
gccgtgtctcgtacgcagcgtaggggtagaactggtaggggcaggcagggcatttacagatttgtggcgccgggg

SEQ ID NO: 135373 - DNA, 75 bp, Artificial Sequence
  Synthetic
acatcttccagggtgtgtcccgtgcctcaaaacaggcaatatatcacggtgctggcatcccgtttcaccaaccct

SEQ ID NO: 135374 - DNA, 75 bp, Artificial Sequence
  Synthetic
acatcttccagggtgtgtcccgtgcctcaaaacaggcaatatatctcggtgctggcatcccgtttcaccaaccct

SEQ ID NO: 135375 - DNA, 75 bp, Artificial Sequence
  Synthetic
acatcttccagggtgtgtcccgtgcctcaaaacaggcaatatatcccggtgctggcatcccgtttcaccaaccct

SEQ ID NO: 135376 - DNA, 75 bp, Artificial Sequence
  Synthetic
acatcttccagggtgtgtcccgtgcctcaaaacaggcaatatatcgcggtgctggcatcccgtttcaccaaccct

SEQ ID NO: 135377 - DNA, 75 bp, Artificial Sequence
  Synthetic
acatcttccagggtgtgtcccgtgcctcaaaacaggcaatttatcacggtgctggcatcccgtttcaccaaccct

SEQ ID NO: 135378 - DNA, 75 bp, Artificial Sequence
  Synthetic
acatcttccagggtgtgtcccgtgcctcaaaacaggcaatttatctcggtgctggcatcccgtttcaccaaccct

SEQ ID NO: 135379 - DNA, 75 bp, Artificial Sequence
  Synthetic
acatcttccagggtgtgtcccgtgcctcaaaacaggcaatttatcccggtgctggcatcccgtttcaccaaccct

SEQ ID NO: 135380 - DNA, 75 bp, Artificial Sequence
  Synthetic
acatcttccagggtgtgtcccgtgcctcaaaacaggcaatttatcgcggtgctggcatcccgtttcaccaaccct

SEQ ID NO: 135381 - DNA, 75 bp, Artificial Sequence
  Synthetic
acatcttccagggtgtgtcccgtgcctcaaaacaggcaatctatcacggtgctggcatcccgtttcaccaaccct

SEQ ID NO: 135382 - DNA, 75 bp, Artificial Sequence
  Synthetic
acatcttccagggtgtgtcccgtgcctcaaaacaggcaatctatctcggtgctggcatcccgtttcaccaaccct

SEQ ID NO: 135383 - DNA, 75 bp, Artificial Sequence
  Synthetic
acatcttccagggtgtgtcccgtgcctcaaaacaggcaatctatcccggtgctggcatcccgtttcaccaaccct

SEQ ID NO: 135384 - DNA, 75 bp, Artificial Sequence
  Synthetic
acatcttccagggtgtgtcccgtgcctcaaaacaggcaatctatcgcggtgctggcatcccgtttcaccaaccct

SEQ ID NO: 135385 - DNA, 75 bp, Artificial Sequence
  Synthetic
acatcttccagggtgtgtcccgtgcctcaaaacaggcaatgtatcacggtgctggcatcccgtttcaccaaccct

SEQ ID NO: 135386 - DNA, 75 bp, Artificial Sequence
  Synthetic
acatcttccagggtgtgtcccgtgcctcaaaacaggcaatgtatctcggtgctggcatcccgtttcaccaaccct

SEQ ID NO: 135387 - DNA, 75 bp, Artificial Sequence
  Synthetic
acatcttccagggtgtgtcccgtgcctcaaaacaggcaatgtatcccggtgctggcatcccgtttcaccaaccct

SEQ ID NO: 135388 - DNA, 75 bp, Artificial Sequence
  Synthetic
acatcttccagggtgtgtcccgtgcctcaaaacaggcaatgtatcgcggtgctggcatcccgtttcaccaaccct

SEQ ID NO: 135389 - DNA, 75 bp, Artificial Sequence
  Synthetic
acatcttccagggtgtgtcccgtgcctcaatacaggcaatatatcacggtgctggcatcccgtttcaccaaccct

SEQ ID NO: 135390 - DNA, 75 bp, Artificial Sequence
  Synthetic
acatcttccagggtgtgtcccgtgcctcaatacaggcaatatatctcggtgctggcatcccgtttcaccaaccct

SEQ ID NO: 135391 - DNA, 75 bp, Artificial Sequence
  Synthetic
acatcttccagggtgtgtcccgtgcctcaatacaggcaatatatcccggtgctggcatcccgtttcaccaaccct

SEQ ID NO: 135392 - DNA, 75 bp, Artificial Sequence
  Synthetic
acatcttccagggtgtgtcccgtgcctcaatacaggcaatatatcgcggtgctggcatcccgtttcaccaaccct

SEQ ID NO: 135393 - DNA, 75 bp, Artificial Sequence
  Synthetic
acatcttccagggtgtgtcccgtgcctcaatacaggcaatttatcacggtgctggcatcccgtttcaccaaccct

SEQ ID NO: 135394 - DNA, 75 bp, Artificial Sequence
  Synthetic
acatcttccagggtgtgtcccgtgcctcaatacaggcaatttatctcggtgctggcatcccgtttcaccaaccct

SEQ ID NO: 135395 - DNA, 75 bp, Artificial Sequence
  Synthetic
acatcttccagggtgtgtcccgtgcctcaatacaggcaatttatcccggtgctggcatcccgtttcaccaaccct

SEQ ID NO: 135396 - DNA, 75 bp, Artificial Sequence
  Synthetic
acatcttccagggtgtgtcccgtgcctcaatacaggcaatttatcgcggtgctggcatcccgtttcaccaaccct

SEQ ID NO: 135397 - DNA, 75 bp, Artificial Sequence
  Synthetic
acatcttccagggtgtgtcccgtgcctcaatacaggcaatctatcacggtgctggcatcccgtttcaccaaccct

SEQ ID NO: 135398 - DNA, 75 bp, Artificial Sequence
  Synthetic
acatcttccagggtgtgtcccgtgcctcaatacaggcaatctatctcggtgctggcatcccgtttcaccaaccct

SEQ ID NO: 135399 - DNA, 75 bp, Artificial Sequence
  Synthetic
acatcttccagggtgtgtcccgtgcctcaatacaggcaatctatcccggtgctggcatcccgtttcaccaaccct

SEQ ID NO: 135400 - DNA, 75 bp, Artificial Sequence
  Synthetic
acatcttccagggtgtgtcccgtgcctcaatacaggcaatctatcgcggtgctggcatcccgtttcaccaaccct

SEQ ID NO: 135401 - DNA, 75 bp, Artificial Sequence
  Synthetic
acatcttccagggtgtgtcccgtgcctcaatacaggcaatgtatcacggtgctggcatcccgtttcaccaaccct

SEQ ID NO: 135402 - DNA, 75 bp, Artificial Sequence
  Synthetic
acatcttccagggtgtgtcccgtgcctcaatacaggcaatgtatctcggtgctggcatcccgtttcaccaaccct

SEQ ID NO: 135403 - DNA, 75 bp, Artificial Sequence
  Synthetic
acatcttccagggtgtgtcccgtgcctcaatacaggcaatgtatcccggtgctggcatcccgtttcaccaaccct

SEQ ID NO: 135404 - DNA, 75 bp, Artificial Sequence
  Synthetic
acatcttccagggtgtgtcccgtgcctcaatacaggcaatgtatcgcggtgctggcatcccgtttcaccaaccct

SEQ ID NO: 135405 - DNA, 75 bp, Artificial Sequence
  Synthetic
acatcttccagggtgtgtcccgtgcctcaacacaggcaatatatcacggtgctggcatcccgtttcaccaaccct

SEQ ID NO: 135406 - DNA, 75 bp, Artificial Sequence
  Synthetic
acatcttccagggtgtgtcccgtgcctcaacacaggcaatatatctcggtgctggcatcccgtttcaccaaccct

SEQ ID NO: 135407 - DNA, 75 bp, Artificial Sequence
  Synthetic
acatcttccagggtgtgtcccgtgcctcaacacaggcaatatatcccggtgctggcatcccgtttcaccaaccct

SEQ ID NO: 135408 - DNA, 75 bp, Artificial Sequence
  Synthetic
acatcttccagggtgtgtcccgtgcctcaacacaggcaatatatcgcggtgctggcatcccgtttcaccaaccct

SEQ ID NO: 135409 - DNA, 75 bp, Artificial Sequence
  Synthetic
acatcttccagggtgtgtcccgtgcctcaacacaggcaatttatcacggtgctggcatcccgtttcaccaaccct

SEQ ID NO: 135410 - DNA, 75 bp, Artificial Sequence
  Synthetic
acatcttccagggtgtgtcccgtgcctcaacacaggcaatttatctcggtgctggcatcccgtttcaccaaccct

SEQ ID NO: 135411 - DNA, 75 bp, Artificial Sequence
  Synthetic
acatcttccagggtgtgtcccgtgcctcaacacaggcaatttatcccggtgctggcatcccgtttcaccaaccct

SEQ ID NO: 135412 - DNA, 75 bp, Artificial Sequence
  Synthetic
acatcttccagggtgtgtcccgtgcctcaacacaggcaatttatcgcggtgctggcatcccgtttcaccaaccct

SEQ ID NO: 135413 - DNA, 75 bp, Artificial Sequence
  Synthetic
acatcttccagggtgtgtcccgtgcctcaacacaggcaatctatcacggtgctggcatcccgtttcaccaaccct

SEQ ID NO: 135414 - DNA, 75 bp, Artificial Sequence
  Synthetic
acatcttccagggtgtgtcccgtgcctcaacacaggcaatctatctcggtgctggcatcccgtttcaccaaccct

SEQ ID NO: 135415 - DNA, 75 bp, Artificial Sequence
  Synthetic
acatcttccagggtgtgtcccgtgcctcaacacaggcaatctatcccggtgctggcatcccgtttcaccaaccct

SEQ ID NO: 135416 - DNA, 75 bp, Artificial Sequence
  Synthetic
acatcttccagggtgtgtcccgtgcctcaacacaggcaatctatcgcggtgctggcatcccgtttcaccaaccct

SEQ ID NO: 135417 - DNA, 75 bp, Artificial Sequence
  Synthetic
acatcttccagggtgtgtcccgtgcctcaacacaggcaatgtatcacggtgctggcatcccgtttcaccaaccct

SEQ ID NO: 135418 - DNA, 75 bp, Artificial Sequence
  Synthetic
acatcttccagggtgtgtcccgtgcctcaacacaggcaatgtatctcggtgctggcatcccgtttcaccaaccct

SEQ ID NO: 135419 - DNA, 75 bp, Artificial Sequence
  Synthetic
acatcttccagggtgtgtcccgtgcctcaacacaggcaatgtatcccggtgctggcatcccgtttcaccaaccct

SEQ ID NO: 135420 - DNA, 75 bp, Artificial Sequence
  Synthetic
acatcttccagggtgtgtcccgtgcctcaacacaggcaatgtatcgcggtgctggcatcccgtttcaccaaccct

SEQ ID NO: 135421 - DNA, 75 bp, Artificial Sequence
  Synthetic
acatcttccagggtgtgtcccgtgcctcaagacaggcaatatatcacggtgctggcatcccgtttcaccaaccct

SEQ ID NO: 135422 - DNA, 75 bp, Artificial Sequence
  Synthetic
acatcttccagggtgtgtcccgtgcctcaagacaggcaatatatctcggtgctggcatcccgtttcaccaaccct

SEQ ID NO: 135423 - DNA, 75 bp, Artificial Sequence
  Synthetic
acatcttccagggtgtgtcccgtgcctcaagacaggcaatatatcccggtgctggcatcccgtttcaccaaccct

SEQ ID NO: 135424 - DNA, 75 bp, Artificial Sequence
  Synthetic
acatcttccagggtgtgtcccgtgcctcaagacaggcaatatatcgcggtgctggcatcccgtttcaccaaccct

SEQ ID NO: 135425 - DNA, 75 bp, Artificial Sequence
  Synthetic
acatcttccagggtgtgtcccgtgcctcaagacaggcaatttatcacggtgctggcatcccgtttcaccaaccct

SEQ ID NO: 135426 - DNA, 75 bp, Artificial Sequence
  Synthetic
acatcttccagggtgtgtcccgtgcctcaagacaggcaatttatctcggtgctggcatcccgtttcaccaaccct

SEQ ID NO: 135427 - DNA, 75 bp, Artificial Sequence
  Synthetic
acatcttccagggtgtgtcccgtgcctcaagacaggcaatttatcccggtgctggcatcccgtttcaccaaccct

SEQ ID NO: 135428 - DNA, 75 bp, Artificial Sequence
  Synthetic
acatcttccagggtgtgtcccgtgcctcaagacaggcaatttatcgcggtgctggcatcccgtttcaccaaccct

SEQ ID NO: 135429 - DNA, 75 bp, Artificial Sequence
  Synthetic
acatcttccagggtgtgtcccgtgcctcaagacaggcaatctatcacggtgctggcatcccgtttcaccaaccct

SEQ ID NO: 135430 - DNA, 75 bp, Artificial Sequence
  Synthetic
acatcttccagggtgtgtcccgtgcctcaagacaggcaatctatctcggtgctggcatcccgtttcaccaaccct

SEQ ID NO: 135431 - DNA, 75 bp, Artificial Sequence
  Synthetic
acatcttccagggtgtgtcccgtgcctcaagacaggcaatctatcccggtgctggcatcccgtttcaccaaccct

SEQ ID NO: 135432 - DNA, 75 bp, Artificial Sequence
  Synthetic
acatcttccagggtgtgtcccgtgcctcaagacaggcaatctatcgcggtgctggcatcccgtttcaccaaccct

SEQ ID NO: 135433 - DNA, 75 bp, Artificial Sequence
  Synthetic
acatcttccagggtgtgtcccgtgcctcaagacaggcaatgtatcacggtgctggcatcccgtttcaccaaccct

SEQ ID NO: 135434 - DNA, 75 bp, Artificial Sequence
  Synthetic
acatcttccagggtgtgtcccgtgcctcaagacaggcaatgtatctcggtgctggcatcccgtttcaccaaccct

SEQ ID NO: 135435 - DNA, 75 bp, Artificial Sequence
  Synthetic
acatcttccagggtgtgtcccgtgcctcaagacaggcaatgtatcccggtgctggcatcccgtttcaccaaccct

SEQ ID NO: 135436 - DNA, 75 bp, Artificial Sequence
  Synthetic
acatcttccagggtgtgtcccgtgcctcaagacaggcaatgtatcgcggtgctggcatcccgtttcaccaaccct

SEQ ID NO: 135437 - DNA, 75 bp, Artificial Sequence
  Synthetic
tcctgtgcctccacctcggaagaagcggacggtggtcctcaccgaatcatccgtatccactgccttggccgaact

SEQ ID NO: 135438 - DNA, 75 bp, Artificial Sequence
  Synthetic
ttgtcagtggtctagtaggggcggccgtcggaagcataggcctgggcaagatactggtggacgttttggccgggt

SEQ ID NO: 135439 - DNA, 75 bp, Artificial Sequence
  Synthetic
actcccgccgagaccaccgtgaggctgcgggcatacctgaacaccccggggctgcccgtatgccaggaccatttg

SEQ ID NO: 135440 - DNA, 75 bp, Artificial Sequence
  Synthetic
gtctggcggggagacggcattatgcaaaccacctgcccatgtggtgcacaaatcaccggacatgtcaagaatggt

SEQ ID NO: 135441 - DNA, 75 bp, Artificial Sequence
  Synthetic
ctttgaggcggcgtcttcctcgtggcgcaggagttcgccttcagacccagcgtgcatcaggccgtccaggattgt

SEQ ID NO: 135442 - DNA, 75 bp, Artificial Sequence
  Synthetic
ctttgaggcggcgtcttcctcgtggcgcaggagttcgccttcagacccagcgtgcatcaggccgtccaggtttgt

SEQ ID NO: 135443 - DNA, 75 bp, Artificial Sequence
  Synthetic
ctttgaggcggcgtcttcctcgtggcgcaggagttcgccttcagacccagcgtgcatcaggccgtccaggcttgt

SEQ ID NO: 135444 - DNA, 75 bp, Artificial Sequence
  Synthetic
ctttgaggcggcgtcttcctcgtggcgcaggagttcgccttcagacccagcgtgcatcaggccgtccagggttgt

SEQ ID NO: 135445 - DNA, 75 bp, Artificial Sequence
  Synthetic
ctttgaggcggcgtcttcctcgtggcgcaggtgttcgccttcagacccagcgtgcatcaggccgtccaggattgt

SEQ ID NO: 135446 - DNA, 75 bp, Artificial Sequence
  Synthetic
ctttgaggcggcgtcttcctcgtggcgcaggtgttcgccttcagacccagcgtgcatcaggccgtccaggtttgt

SEQ ID NO: 135447 - DNA, 75 bp, Artificial Sequence
  Synthetic
ctttgaggcggcgtcttcctcgtggcgcaggtgttcgccttcagacccagcgtgcatcaggccgtccaggcttgt

SEQ ID NO: 135448 - DNA, 75 bp, Artificial Sequence
  Synthetic
ctttgaggcggcgtcttcctcgtggcgcaggtgttcgccttcagacccagcgtgcatcaggccgtccagggttgt

SEQ ID NO: 135449 - DNA, 75 bp, Artificial Sequence
  Synthetic
ctttgaggcggcgtcttcctcgtggcgcaggcgttcgccttcagacccagcgtgcatcaggccgtccaggattgt

SEQ ID NO: 135450 - DNA, 75 bp, Artificial Sequence
  Synthetic
ctttgaggcggcgtcttcctcgtggcgcaggcgttcgccttcagacccagcgtgcatcaggccgtccaggtttgt

SEQ ID NO: 135451 - DNA, 75 bp, Artificial Sequence
  Synthetic
ctttgaggcggcgtcttcctcgtggcgcaggcgttcgccttcagacccagcgtgcatcaggccgtccaggcttgt

SEQ ID NO: 135452 - DNA, 75 bp, Artificial Sequence
  Synthetic
ctttgaggcggcgtcttcctcgtggcgcaggcgttcgccttcagacccagcgtgcatcaggccgtccagggttgt

SEQ ID NO: 135453 - DNA, 75 bp, Artificial Sequence
  Synthetic
ctttgaggcggcgtcttcctcgtggcgcaggggttcgccttcagacccagcgtgcatcaggccgtccaggattgt

SEQ ID NO: 135454 - DNA, 75 bp, Artificial Sequence
  Synthetic
ctttgaggcggcgtcttcctcgtggcgcaggggttcgccttcagacccagcgtgcatcaggccgtccaggtttgt

SEQ ID NO: 135455 - DNA, 75 bp, Artificial Sequence
  Synthetic
ctttgaggcggcgtcttcctcgtggcgcaggggttcgccttcagacccagcgtgcatcaggccgtccaggcttgt

SEQ ID NO: 135456 - DNA, 75 bp, Artificial Sequence
  Synthetic
ctttgaggcggcgtcttcctcgtggcgcaggggttcgccttcagacccagcgtgcatcaggccgtccagggttgt

SEQ ID NO: 135457 - DNA, 75 bp, Artificial Sequence
  Synthetic
ctttgtggcggcgtcttcctcgtggcgcaggagttcgccttcagacccagcgtgcatcaggccgtccaggattgt

SEQ ID NO: 135458 - DNA, 75 bp, Artificial Sequence
  Synthetic
ctttgtggcggcgtcttcctcgtggcgcaggagttcgccttcagacccagcgtgcatcaggccgtccaggtttgt

SEQ ID NO: 135459 - DNA, 75 bp, Artificial Sequence
  Synthetic
ctttgtggcggcgtcttcctcgtggcgcaggagttcgccttcagacccagcgtgcatcaggccgtccaggcttgt

SEQ ID NO: 135460 - DNA, 75 bp, Artificial Sequence
  Synthetic
ctttgtggcggcgtcttcctcgtggcgcaggagttcgccttcagacccagcgtgcatcaggccgtccagggttgt

SEQ ID NO: 135461 - DNA, 75 bp, Artificial Sequence
  Synthetic
ctttgtggcggcgtcttcctcgtggcgcaggtgttcgccttcagacccagcgtgcatcaggccgtccaggattgt

SEQ ID NO: 135462 - DNA, 75 bp, Artificial Sequence
  Synthetic
ctttgtggcggcgtcttcctcgtggcgcaggtgttcgccttcagacccagcgtgcatcaggccgtccaggtttgt

SEQ ID NO: 135463 - DNA, 75 bp, Artificial Sequence
  Synthetic
ctttgtggcggcgtcttcctcgtggcgcaggtgttcgccttcagacccagcgtgcatcaggccgtccaggcttgt

SEQ ID NO: 135464 - DNA, 75 bp, Artificial Sequence
  Synthetic
ctttgtggcggcgtcttcctcgtggcgcaggtgttcgccttcagacccagcgtgcatcaggccgtccagggttgt

SEQ ID NO: 135465 - DNA, 75 bp, Artificial Sequence
  Synthetic
ctttgtggcggcgtcttcctcgtggcgcaggcgttcgccttcagacccagcgtgcatcaggccgtccaggattgt

SEQ ID NO: 135466 - DNA, 75 bp, Artificial Sequence
  Synthetic
ctttgtggcggcgtcttcctcgtggcgcaggcgttcgccttcagacccagcgtgcatcaggccgtccaggtttgt

SEQ ID NO: 135467 - DNA, 75 bp, Artificial Sequence
  Synthetic
ctttgtggcggcgtcttcctcgtggcgcaggcgttcgccttcagacccagcgtgcatcaggccgtccaggcttgt

SEQ ID NO: 135468 - DNA, 75 bp, Artificial Sequence
  Synthetic
ctttgtggcggcgtcttcctcgtggcgcaggcgttcgccttcagacccagcgtgcatcaggccgtccagggttgt

SEQ ID NO: 135469 - DNA, 75 bp, Artificial Sequence
  Synthetic
ctttgtggcggcgtcttcctcgtggcgcaggggttcgccttcagacccagcgtgcatcaggccgtccaggattgt

SEQ ID NO: 135470 - DNA, 75 bp, Artificial Sequence
  Synthetic
ctttgtggcggcgtcttcctcgtggcgcaggggttcgccttcagacccagcgtgcatcaggccgtccaggtttgt

SEQ ID NO: 135471 - DNA, 75 bp, Artificial Sequence
  Synthetic
ctttgtggcggcgtcttcctcgtggcgcaggggttcgccttcagacccagcgtgcatcaggccgtccaggcttgt

SEQ ID NO: 135472 - DNA, 75 bp, Artificial Sequence
  Synthetic
ctttgtggcggcgtcttcctcgtggcgcaggggttcgccttcagacccagcgtgcatcaggccgtccagggttgt

SEQ ID NO: 135473 - DNA, 75 bp, Artificial Sequence
  Synthetic
ctttgcggcggcgtcttcctcgtggcgcaggagttcgccttcagacccagcgtgcatcaggccgtccaggattgt

SEQ ID NO: 135474 - DNA, 75 bp, Artificial Sequence
  Synthetic
ctttgcggcggcgtcttcctcgtggcgcaggagttcgccttcagacccagcgtgcatcaggccgtccaggtttgt

SEQ ID NO: 135475 - DNA, 75 bp, Artificial Sequence
  Synthetic
ctttgcggcggcgtcttcctcgtggcgcaggagttcgccttcagacccagcgtgcatcaggccgtccaggcttgt

SEQ ID NO: 135476 - DNA, 75 bp, Artificial Sequence
  Synthetic
ctttgcggcggcgtcttcctcgtggcgcaggagttcgccttcagacccagcgtgcatcaggccgtccagggttgt

SEQ ID NO: 135477 - DNA, 75 bp, Artificial Sequence
  Synthetic
ctttgcggcggcgtcttcctcgtggcgcaggtgttcgccttcagacccagcgtgcatcaggccgtccaggattgt

SEQ ID NO: 135478 - DNA, 75 bp, Artificial Sequence
  Synthetic
ctttgcggcggcgtcttcctcgtggcgcaggtgttcgccttcagacccagcgtgcatcaggccgtccaggtttgt

SEQ ID NO: 135479 - DNA, 75 bp, Artificial Sequence
  Synthetic
ctttgcggcggcgtcttcctcgtggcgcaggtgttcgccttcagacccagcgtgcatcaggccgtccaggcttgt

SEQ ID NO: 135480 - DNA, 75 bp, Artificial Sequence
  Synthetic
ctttgcggcggcgtcttcctcgtggcgcaggtgttcgccttcagacccagcgtgcatcaggccgtccagggttgt

SEQ ID NO: 135481 - DNA, 75 bp, Artificial Sequence
  Synthetic
ctttgcggcggcgtcttcctcgtggcgcaggcgttcgccttcagacccagcgtgcatcaggccgtccaggattgt

SEQ ID NO: 135482 - DNA, 75 bp, Artificial Sequence
  Synthetic
ctttgcggcggcgtcttcctcgtggcgcaggcgttcgccttcagacccagcgtgcatcaggccgtccaggtttgt

SEQ ID NO: 135483 - DNA, 75 bp, Artificial Sequence
  Synthetic
ctttgcggcggcgtcttcctcgtggcgcaggcgttcgccttcagacccagcgtgcatcaggccgtccaggcttgt

SEQ ID NO: 135484 - DNA, 75 bp, Artificial Sequence
  Synthetic
ctttgcggcggcgtcttcctcgtggcgcaggcgttcgccttcagacccagcgtgcatcaggccgtccagggttgt

SEQ ID NO: 135485 - DNA, 75 bp, Artificial Sequence
  Synthetic
ctttgcggcggcgtcttcctcgtggcgcaggggttcgccttcagacccagcgtgcatcaggccgtccaggattgt

SEQ ID NO: 135486 - DNA, 75 bp, Artificial Sequence
  Synthetic
ctttgcggcggcgtcttcctcgtggcgcaggggttcgccttcagacccagcgtgcatcaggccgtccaggtttgt

SEQ ID NO: 135487 - DNA, 75 bp, Artificial Sequence
  Synthetic
ctttgcggcggcgtcttcctcgtggcgcaggggttcgccttcagacccagcgtgcatcaggccgtccaggcttgt

SEQ ID NO: 135488 - DNA, 75 bp, Artificial Sequence
  Synthetic
ctttgcggcggcgtcttcctcgtggcgcaggggttcgccttcagacccagcgtgcatcaggccgtccagggttgt

SEQ ID NO: 135489 - DNA, 75 bp, Artificial Sequence
  Synthetic
ctttggggcggcgtcttcctcgtggcgcaggagttcgccttcagacccagcgtgcatcaggccgtccaggattgt

SEQ ID NO: 135490 - DNA, 75 bp, Artificial Sequence
  Synthetic
ctttggggcggcgtcttcctcgtggcgcaggagttcgccttcagacccagcgtgcatcaggccgtccaggtttgt

SEQ ID NO: 135491 - DNA, 75 bp, Artificial Sequence
  Synthetic
ctttggggcggcgtcttcctcgtggcgcaggagttcgccttcagacccagcgtgcatcaggccgtccaggcttgt

SEQ ID NO: 135492 - DNA, 75 bp, Artificial Sequence
  Synthetic
ctttggggcggcgtcttcctcgtggcgcaggagttcgccttcagacccagcgtgcatcaggccgtccagggttgt

SEQ ID NO: 135493 - DNA, 75 bp, Artificial Sequence
  Synthetic
ctttggggcggcgtcttcctcgtggcgcaggtgttcgccttcagacccagcgtgcatcaggccgtccaggattgt

SEQ ID NO: 135494 - DNA, 75 bp, Artificial Sequence
  Synthetic
ctttggggcggcgtcttcctcgtggcgcaggtgttcgccttcagacccagcgtgcatcaggccgtccaggtttgt

SEQ ID NO: 135495 - DNA, 75 bp, Artificial Sequence
  Synthetic
ctttggggcggcgtcttcctcgtggcgcaggtgttcgccttcagacccagcgtgcatcaggccgtccaggcttgt

SEQ ID NO: 135496 - DNA, 75 bp, Artificial Sequence
  Synthetic
ctttggggcggcgtcttcctcgtggcgcaggtgttcgccttcagacccagcgtgcatcaggccgtccagggttgt

SEQ ID NO: 135497 - DNA, 75 bp, Artificial Sequence
  Synthetic
ctttggggcggcgtcttcctcgtggcgcaggcgttcgccttcagacccagcgtgcatcaggccgtccaggattgt

SEQ ID NO: 135498 - DNA, 75 bp, Artificial Sequence
  Synthetic
ctttggggcggcgtcttcctcgtggcgcaggcgttcgccttcagacccagcgtgcatcaggccgtccaggtttgt

SEQ ID NO: 135499 - DNA, 75 bp, Artificial Sequence
  Synthetic
ctttggggcggcgtcttcctcgtggcgcaggcgttcgccttcagacccagcgtgcatcaggccgtccaggcttgt

SEQ ID NO: 135500 - DNA, 75 bp, Artificial Sequence
  Synthetic
ctttggggcggcgtcttcctcgtggcgcaggcgttcgccttcagacccagcgtgcatcaggccgtccagggttgt

SEQ ID NO: 135501 - DNA, 75 bp, Artificial Sequence
  Synthetic
ctttggggcggcgtcttcctcgtggcgcaggggttcgccttcagacccagcgtgcatcaggccgtccaggattgt

SEQ ID NO: 135502 - DNA, 75 bp, Artificial Sequence
  Synthetic
ctttggggcggcgtcttcctcgtggcgcaggggttcgccttcagacccagcgtgcatcaggccgtccaggtttgt

SEQ ID NO: 135503 - DNA, 75 bp, Artificial Sequence
  Synthetic
ctttggggcggcgtcttcctcgtggcgcaggggttcgccttcagacccagcgtgcatcaggccgtccaggcttgt

SEQ ID NO: 135504 - DNA, 75 bp, Artificial Sequence
  Synthetic
ctttggggcggcgtcttcctcgtggcgcaggggttcgccttcagacccagcgtgcatcaggccgtccagggttgt

SEQ ID NO: 135505 - DNA, 75 bp, Artificial Sequence
  Synthetic
atgggagccgcttacggcttccaatactctccagcacagcgggtcgaatatcttctggccgcctggcggtcgaag

SEQ ID NO: 135506 - DNA, 75 bp, Artificial Sequence
  Synthetic
accaggcgactgtgtgcgccaaggccttggctccacctccatcatgggaccaacaatggaagtgcctaataaggc

SEQ ID NO: 135507 - DNA, 75 bp, Artificial Sequence
  Synthetic
gcattctttccttccttgtgttcttctgtgccgcctggtatattaagggcaggctggtccctggggtggcatatg

SEQ ID NO: 135508 - DNA, 75 bp, Artificial Sequence
  Synthetic
tgaggataccacagttgctcctcgaaattttcttcggggcacactggggcgttctcggggccgtgctgtactaca

SEQ ID NO: 135509 - DNA, 75 bp, Artificial Sequence
  Synthetic
gaagaggtctatcagtgctgtaatctggaacctgaggcgcgcaaagtcatatccgcccttacggagagactctac

SEQ ID NO: 135510 - DNA, 75 bp, Artificial Sequence
  Synthetic
ctggttcatgtggtgcctactcctactttctgtaggggtaggcatctatctgctccccaaccgatgaacggggag

SEQ ID NO: 135511 - DNA, 75 bp, Artificial Sequence
  Synthetic
ttgttctctgtgagtgctatgacgcgggctgctcgtggtacgatctgcagcccgctgagaccacagtcagactga

SEQ ID NO: 135512 - DNA, 75 bp, Artificial Sequence
  Synthetic
gtcaccagcacttgggtgctggtaggcggggttgtggccgcgctggccgcgtattgcctatccatgggttgcgtg

SEQ ID NO: 135513 - DNA, 75 bp, Artificial Sequence
  Synthetic
tcggtggcactcaggcacgcaccacacttgggcttaccagcttgttcaacacgggtccccaacagcacttaatgc

SEQ ID NO: 135514 - DNA, 75 bp, Artificial Sequence
  Synthetic
tctgtcaccgtcccccatcctaacataacagagacagccctcccgactacgggagagataccattttatggaaag

SEQ ID NO: 135515 - DNA, 75 bp, Artificial Sequence
  Synthetic
tcgctaagctcatatggtggttacaatatttcatcaccagagccgaggcgcacctgcaagtgtggatcccccccc

SEQ ID NO: 135516 - DNA, 75 bp, Artificial Sequence
  Synthetic
ttttgggagagcgtcttcactggactaactcacatagatgcccactttctgtcacagactaagcagcagggactt

SEQ ID NO: 135517 - DNA, 75 bp, Artificial Sequence
  Synthetic
aactgccctacatagaacaggggatgcagctggcagagcaattcaaacagaaagcgctcggactgctgcaaacag

SEQ ID NO: 135518 - DNA, 75 bp, Artificial Sequence
  Synthetic
gtcatcgataccctcacgtgcggcttcgccgacctcatggggtacattccgctcgtcggcgcccctcttgggggc

SEQ ID NO: 135519 - DNA, 75 bp, Artificial Sequence
  Synthetic
tgtccgcatgggtaccatgaaaataacaggcccgaagacctgcttgaacatgtggcaggggaccttccccatcaa

SEQ ID NO: 135520 - DNA, 75 bp, Artificial Sequence
  Synthetic
agccaacactacatggacctacgccccttctatatcggttggggcctgtccaaaatgaaatctgcttgacacacc

SEQ ID NO: 135521 - DNA, 75 bp, Artificial Sequence
  Synthetic
acagtacttggccgggttgtccacattacctggcaacccagctatagcatctctgatggcgtttacagctgccgt

SEQ ID NO: 135522 - DNA, 75 bp, Artificial Sequence
  Synthetic
atgatacccgctgctttgactccacggtcactgagagcgacatccgtacggaggaggcaatctaccaatgttgtg

SEQ ID NO: 135523 - DNA, 75 bp, Artificial Sequence
  Synthetic
ctgcctgggaaacagtccgacacactccagtcaactcctggttgggtaacatcatactgtacgcgcccacaatat

SEQ ID NO: 135524 - DNA, 75 bp, Artificial Sequence
  Synthetic
gggcccgtctactgctttacacctagtccggttgttgtcggcaccacagacaaaaaggggaatcctacgtacgcc

SEQ ID NO: 135525 - DNA, 75 bp, Artificial Sequence
  Synthetic
gggcccgtctactgctttacacctagtccggttgttgtcggcaccacagacaaaatggggaatcctacgtacgcc

SEQ ID NO: 135526 - DNA, 75 bp, Artificial Sequence
  Synthetic
gggcccgtctactgctttacacctagtccggttgttgtcggcaccacagacaaaacggggaatcctacgtacgcc

SEQ ID NO: 135527 - DNA, 75 bp, Artificial Sequence
  Synthetic
gggcccgtctactgctttacacctagtccggttgttgtcggcaccacagacaaaagggggaatcctacgtacgcc

SEQ ID NO: 135528 - DNA, 75 bp, Artificial Sequence
  Synthetic
gggcccgtctactgctttacacctagtccggttgttgtcggcaccactgacaaaaaggggaatcctacgtacgcc

SEQ ID NO: 135529 - DNA, 75 bp, Artificial Sequence
  Synthetic
gggcccgtctactgctttacacctagtccggttgttgtcggcaccactgacaaaatggggaatcctacgtacgcc

SEQ ID NO: 135530 - DNA, 75 bp, Artificial Sequence
  Synthetic
gggcccgtctactgctttacacctagtccggttgttgtcggcaccactgacaaaacggggaatcctacgtacgcc

SEQ ID NO: 135531 - DNA, 75 bp, Artificial Sequence
  Synthetic
gggcccgtctactgctttacacctagtccggttgttgtcggcaccactgacaaaagggggaatcctacgtacgcc

SEQ ID NO: 135532 - DNA, 75 bp, Artificial Sequence
  Synthetic
gggcccgtctactgctttacacctagtccggttgttgtcggcaccaccgacaaaaaggggaatcctacgtacgcc

SEQ ID NO: 135533 - DNA, 75 bp, Artificial Sequence
  Synthetic
gggcccgtctactgctttacacctagtccggttgttgtcggcaccaccgacaaaatggggaatcctacgtacgcc

SEQ ID NO: 135534 - DNA, 75 bp, Artificial Sequence
  Synthetic
gggcccgtctactgctttacacctagtccggttgttgtcggcaccaccgacaaaacggggaatcctacgtacgcc

SEQ ID NO: 135535 - DNA, 75 bp, Artificial Sequence
  Synthetic
gggcccgtctactgctttacacctagtccggttgttgtcggcaccaccgacaaaagggggaatcctacgtacgcc

SEQ ID NO: 135536 - DNA, 75 bp, Artificial Sequence
  Synthetic
gggcccgtctactgctttacacctagtccggttgttgtcggcaccacggacaaaaaggggaatcctacgtacgcc

SEQ ID NO: 135537 - DNA, 75 bp, Artificial Sequence
  Synthetic
gggcccgtctactgctttacacctagtccggttgttgtcggcaccacggacaaaatggggaatcctacgtacgcc

SEQ ID NO: 135538 - DNA, 75 bp, Artificial Sequence
  Synthetic
gggcccgtctactgctttacacctagtccggttgttgtcggcaccacggacaaaacggggaatcctacgtacgcc

SEQ ID NO: 135539 - DNA, 75 bp, Artificial Sequence
  Synthetic
gggcccgtctactgctttacacctagtccggttgttgtcggcaccacggacaaaagggggaatcctacgtacgcc

SEQ ID NO: 135540 - DNA, 75 bp, Artificial Sequence
  Synthetic
accctccttttcaatatcttgggagggtgggtggccgcccagctagcgacccctagcgccgcctccgccttcgtg

SEQ ID NO: 135541 - DNA, 75 bp, Artificial Sequence
  Synthetic
tccagtcaactcctggttgggtaacatcatactgtacgcgcccacaatatgggtgcgcatggtattgatgaccca

SEQ ID NO: 135542 - DNA, 75 bp, Artificial Sequence
  Synthetic
tgggtagcgtggggctcggtaagatgcttgtggacatacttgctggttatggcgctggagtggccggagcgctcg

SEQ ID NO: 135543 - DNA, 75 bp, Artificial Sequence
  Synthetic
aaacgtgcggggctcccccctgtctgacccgacccagcaaggagaacaacaccctggtgtgtcccaccgactgct

SEQ ID NO: 135544 - DNA, 75 bp, Artificial Sequence
  Synthetic
aacttgctccctgccattctatcgccaggtgcccttgtggtgggcgtggtttgcgctgccatcctacgccgccac

SEQ ID NO: 135545 - DNA, 75 bp, Artificial Sequence
  Synthetic
atcgcccagggggggagagccagaatctgtggcatatacctcttcaactgggcggtaaaaaccaagctcaaactc

SEQ ID NO: 135546 - DNA, 75 bp, Artificial Sequence
  Synthetic
ttgcactgtgaatttcaccacccataaggtcaggatgtatgtgggtggcgtcgagcataggtttgaagccgcctg

SEQ ID NO: 135547 - DNA, 75 bp, Artificial Sequence
  Synthetic
ttgcactgtgaatttcaccacccataaggtcaggatgtatgtgggtggcgtcgagcataggtttgatgccgcctg

SEQ ID NO: 135548 - DNA, 75 bp, Artificial Sequence
  Synthetic
ttgcactgtgaatttcaccacccataaggtcaggatgtatgtgggtggcgtcgagcataggtttgacgccgcctg

SEQ ID NO: 135549 - DNA, 75 bp, Artificial Sequence
  Synthetic
ttgcactgtgaatttcaccacccataaggtcaggatgtatgtgggtggcgtcgagcataggtttgaggccgcctg

SEQ ID NO: 135550 - DNA, 75 bp, Artificial Sequence
  Synthetic
gttgggccaggagagggcgctgtgcaatggatgaaccgcctcatcgctttcgcctcgcgggggaaccacgtttcc

SEQ ID NO: 135551 - DNA, 75 bp, Artificial Sequence
  Synthetic
aggcgccggcgggggggacatttatcacagcgtgtcccatgcccgaccccgctatttactcctgtgcctactcct

SEQ ID NO: 135552 - DNA, 75 bp, Artificial Sequence
  Synthetic
acgcggcggcccgtgtcacccaggtccttgcctccctcaccgttacccagctcctaaaaagactccataagtgga

SEQ ID NO: 135553 - DNA, 75 bp, Artificial Sequence
  Synthetic
cctgtgcctactcctactatccgtaggggtaggcatctttttgctgcctgctcgataggcagcttaacactccga

SEQ ID NO: 135554 - DNA, 75 bp, Artificial Sequence
  Synthetic
gctatttactcctgtgcctactcctactatccgtaggggtaggcatctttttgctgcctgctcgataggcagctt

SEQ ID NO: 135555 - DNA, 75 bp, Artificial Sequence
  Synthetic
taaatgaagactgctccaccccctgctctggctcatggctgagagatatatgggactgggtttgcgaagtgctgg

SEQ ID NO: 135556 - DNA, 75 bp, Artificial Sequence
  Synthetic
taaatgaagactgctccaccccctgctctggctcatggctgagagatatttgggactgggtttgcgaagtgctgg

SEQ ID NO: 135557 - DNA, 75 bp, Artificial Sequence
  Synthetic
taaatgaagactgctccaccccctgctctggctcatggctgagagatatctgggactgggtttgcgaagtgctgg

SEQ ID NO: 135558 - DNA, 75 bp, Artificial Sequence
  Synthetic
taaatgaagactgctccaccccctgctctggctcatggctgagagatatgtgggactgggtttgcgaagtgctgg

SEQ ID NO: 135559 - DNA, 75 bp, Artificial Sequence
  Synthetic
tcatttaccagcatgcctgcattgtcaactggtctaatccacctccaccagaacatagtggacgtacaatacatc

SEQ ID NO: 135560 - DNA, 75 bp, Artificial Sequence
  Synthetic
cactacctccctgggcccgtccagactacaaccctcccaccattgaaatatggaagaggccgggctatgcaccac

SEQ ID NO: 135561 - DNA, 75 bp, Artificial Sequence
  Synthetic
gatataggggtgtctggcggggagatggtgttatgaacaccgtttgcccctgtggagctcagatagctggacatg

SEQ ID NO: 135562 - DNA, 75 bp, Artificial Sequence
  Synthetic
ggctaatgttcttggtcggccaagcggaggctgcgttggagaacttggttgtccttaacgcagcctccgctgcca

SEQ ID NO: 135563 - DNA, 75 bp, Artificial Sequence
  Synthetic
gagttctctaactgtcacaagtctgctccggcggctacaccagtggatcaatgaagactacccaagtccttgcag

SEQ ID NO: 135564 - DNA, 75 bp, Artificial Sequence
  Synthetic
gcccctcctgttgttagtgctcactctacctcggagggcctacgcccaagacactgatcaggcagcgtcagcagg

SEQ ID NO: 135565 - DNA, 75 bp, Artificial Sequence
  Synthetic
cagccttctgacgagacatccgcttcagatgcggcatcactgctctgtaaaacgacggccagttcctgttttgat

SEQ ID NO: 135566 - DNA, 75 bp, Artificial Sequence
  Synthetic
cgacgattggctgcgtaccatctgggactgggtttgcttggtgttgtccgacttcaaggcatggctatctgctaa

SEQ ID NO: 135567 - DNA, 75 bp, Artificial Sequence
  Synthetic
gcgttgtggcgggtgtcagctgaggagtacgtcgagattaggcaggtgggggatttccattatgtaactggcatg

SEQ ID NO: 135568 - DNA, 75 bp, Artificial Sequence
  Synthetic
gttccatctacacagggcacatcactggccacagaatggcctgggacatgatgatgaactggagtccaacaacca

SEQ ID NO: 135569 - DNA, 75 bp, Artificial Sequence
  Synthetic
ctctcctacgggaggaagtcagtttccaggtcggccttcattcttacttggtgggatctcaactgccttgtgagc

SEQ ID NO: 135570 - DNA, 75 bp, Artificial Sequence
  Synthetic
gcagaagccacggtccaagagtgggtgccctcactccaggttaggggtggtcgtgaagcagtcattctacttgcc

SEQ ID NO: 135571 - DNA, 75 bp, Artificial Sequence
  Synthetic
gcagaagccacggtccaagagtgggtgccctcactcctggttaggggtggtcgtgaagcagtcattctacttgcc

SEQ ID NO: 135572 - DNA, 75 bp, Artificial Sequence
  Synthetic
gcagaagccacggtccaagagtgggtgccctcactcccggttaggggtggtcgtgaagcagtcattctacttgcc

SEQ ID NO: 135573 - DNA, 75 bp, Artificial Sequence
  Synthetic
gcagaagccacggtccaagagtgggtgccctcactccgggttaggggtggtcgtgaagcagtcattctacttgcc

SEQ ID NO: 135574 - DNA, 75 bp, Artificial Sequence
  Synthetic
gcagaagccacggtccaagagtgggtgccctctctccaggttaggggtggtcgtgaagcagtcattctacttgcc

SEQ ID NO: 135575 - DNA, 75 bp, Artificial Sequence
  Synthetic
gcagaagccacggtccaagagtgggtgccctctctcctggttaggggtggtcgtgaagcagtcattctacttgcc

SEQ ID NO: 135576 - DNA, 75 bp, Artificial Sequence
  Synthetic
gcagaagccacggtccaagagtgggtgccctctctcccggttaggggtggtcgtgaagcagtcattctacttgcc

SEQ ID NO: 135577 - DNA, 75 bp, Artificial Sequence
  Synthetic
gcagaagccacggtccaagagtgggtgccctctctccgggttaggggtggtcgtgaagcagtcattctacttgcc

SEQ ID NO: 135578 - DNA, 75 bp, Artificial Sequence
  Synthetic
gcagaagccacggtccaagagtgggtgccctccctccaggttaggggtggtcgtgaagcagtcattctacttgcc

SEQ ID NO: 135579 - DNA, 75 bp, Artificial Sequence
  Synthetic
gcagaagccacggtccaagagtgggtgccctccctcctggttaggggtggtcgtgaagcagtcattctacttgcc

SEQ ID NO: 135580 - DNA, 75 bp, Artificial Sequence
  Synthetic
gcagaagccacggtccaagagtgggtgccctccctcccggttaggggtggtcgtgaagcagtcattctacttgcc

SEQ ID NO: 135581 - DNA, 75 bp, Artificial Sequence
  Synthetic
gcagaagccacggtccaagagtgggtgccctccctccgggttaggggtggtcgtgaagcagtcattctacttgcc

SEQ ID NO: 135582 - DNA, 75 bp, Artificial Sequence
  Synthetic
gcagaagccacggtccaagagtgggtgccctcgctccaggttaggggtggtcgtgaagcagtcattctacttgcc

SEQ ID NO: 135583 - DNA, 75 bp, Artificial Sequence
  Synthetic
gcagaagccacggtccaagagtgggtgccctcgctcctggttaggggtggtcgtgaagcagtcattctacttgcc

SEQ ID NO: 135584 - DNA, 75 bp, Artificial Sequence
  Synthetic
gcagaagccacggtccaagagtgggtgccctcgctcccggttaggggtggtcgtgaagcagtcattctacttgcc

SEQ ID NO: 135585 - DNA, 75 bp, Artificial Sequence
  Synthetic
gcagaagccacggtccaagagtgggtgccctcgctccgggttaggggtggtcgtgaagcagtcattctacttgcc

SEQ ID NO: 135586 - DNA, 75 bp, Artificial Sequence
  Synthetic
gcagaagccacggtccatgagtgggtgccctcactccaggttaggggtggtcgtgaagcagtcattctacttgcc

SEQ ID NO: 135587 - DNA, 75 bp, Artificial Sequence
  Synthetic
gcagaagccacggtccatgagtgggtgccctcactcctggttaggggtggtcgtgaagcagtcattctacttgcc

SEQ ID NO: 135588 - DNA, 75 bp, Artificial Sequence
  Synthetic
gcagaagccacggtccatgagtgggtgccctcactcccggttaggggtggtcgtgaagcagtcattctacttgcc

SEQ ID NO: 135589 - DNA, 75 bp, Artificial Sequence
  Synthetic
gcagaagccacggtccatgagtgggtgccctcactccgggttaggggtggtcgtgaagcagtcattctacttgcc

SEQ ID NO: 135590 - DNA, 75 bp, Artificial Sequence
  Synthetic
gcagaagccacggtccatgagtgggtgccctctctccaggttaggggtggtcgtgaagcagtcattctacttgcc

SEQ ID NO: 135591 - DNA, 75 bp, Artificial Sequence
  Synthetic
gcagaagccacggtccatgagtgggtgccctctctcctggttaggggtggtcgtgaagcagtcattctacttgcc

SEQ ID NO: 135592 - DNA, 75 bp, Artificial Sequence
  Synthetic
gcagaagccacggtccatgagtgggtgccctctctcccggttaggggtggtcgtgaagcagtcattctacttgcc

SEQ ID NO: 135593 - DNA, 75 bp, Artificial Sequence
  Synthetic
gcagaagccacggtccatgagtgggtgccctctctccgggttaggggtggtcgtgaagcagtcattctacttgcc

SEQ ID NO: 135594 - DNA, 75 bp, Artificial Sequence
  Synthetic
gcagaagccacggtccatgagtgggtgccctccctccaggttaggggtggtcgtgaagcagtcattctacttgcc

SEQ ID NO: 135595 - DNA, 75 bp, Artificial Sequence
  Synthetic
gcagaagccacggtccatgagtgggtgccctccctcctggttaggggtggtcgtgaagcagtcattctacttgcc

SEQ ID NO: 135596 - DNA, 75 bp, Artificial Sequence
  Synthetic
gcagaagccacggtccatgagtgggtgccctccctcccggttaggggtggtcgtgaagcagtcattctacttgcc

SEQ ID NO: 135597 - DNA, 75 bp, Artificial Sequence
  Synthetic
gcagaagccacggtccatgagtgggtgccctccctccgggttaggggtggtcgtgaagcagtcattctacttgcc

SEQ ID NO: 135598 - DNA, 75 bp, Artificial Sequence
  Synthetic
gcagaagccacggtccatgagtgggtgccctcgctccaggttaggggtggtcgtgaagcagtcattctacttgcc

SEQ ID NO: 135599 - DNA, 75 bp, Artificial Sequence
  Synthetic
gcagaagccacggtccatgagtgggtgccctcgctcctggttaggggtggtcgtgaagcagtcattctacttgcc

SEQ ID NO: 135600 - DNA, 75 bp, Artificial Sequence
  Synthetic
gcagaagccacggtccatgagtgggtgccctcgctcccggttaggggtggtcgtgaagcagtcattctacttgcc

SEQ ID NO: 135601 - DNA, 75 bp, Artificial Sequence
  Synthetic
gcagaagccacggtccatgagtgggtgccctcgctccgggttaggggtggtcgtgaagcagtcattctacttgcc

SEQ ID NO: 135602 - DNA, 75 bp, Artificial Sequence
  Synthetic
gcagaagccacggtccacgagtgggtgccctcactccaggttaggggtggtcgtgaagcagtcattctacttgcc

SEQ ID NO: 135603 - DNA, 75 bp, Artificial Sequence
  Synthetic
gcagaagccacggtccacgagtgggtgccctcactcctggttaggggtggtcgtgaagcagtcattctacttgcc

SEQ ID NO: 135604 - DNA, 75 bp, Artificial Sequence
  Synthetic
gcagaagccacggtccacgagtgggtgccctcactcccggttaggggtggtcgtgaagcagtcattctacttgcc

SEQ ID NO: 135605 - DNA, 75 bp, Artificial Sequence
  Synthetic
gcagaagccacggtccacgagtgggtgccctcactccgggttaggggtggtcgtgaagcagtcattctacttgcc

SEQ ID NO: 135606 - DNA, 75 bp, Artificial Sequence
  Synthetic
gcagaagccacggtccacgagtgggtgccctctctccaggttaggggtggtcgtgaagcagtcattctacttgcc

SEQ ID NO: 135607 - DNA, 75 bp, Artificial Sequence
  Synthetic
gcagaagccacggtccacgagtgggtgccctctctcctggttaggggtggtcgtgaagcagtcattctacttgcc

SEQ ID NO: 135608 - DNA, 75 bp, Artificial Sequence
  Synthetic
gcagaagccacggtccacgagtgggtgccctctctcccggttaggggtggtcgtgaagcagtcattctacttgcc

SEQ ID NO: 135609 - DNA, 75 bp, Artificial Sequence
  Synthetic
gcagaagccacggtccacgagtgggtgccctctctccgggttaggggtggtcgtgaagcagtcattctacttgcc

SEQ ID NO: 135610 - DNA, 75 bp, Artificial Sequence
  Synthetic
gcagaagccacggtccacgagtgggtgccctccctccaggttaggggtggtcgtgaagcagtcattctacttgcc

SEQ ID NO: 135611 - DNA, 75 bp, Artificial Sequence
  Synthetic
gcagaagccacggtccacgagtgggtgccctccctcctggttaggggtggtcgtgaagcagtcattctacttgcc

SEQ ID NO: 135612 - DNA, 75 bp, Artificial Sequence
  Synthetic
gcagaagccacggtccacgagtgggtgccctccctcccggttaggggtggtcgtgaagcagtcattctacttgcc

SEQ ID NO: 135613 - DNA, 75 bp, Artificial Sequence
  Synthetic
gcagaagccacggtccacgagtgggtgccctccctccgggttaggggtggtcgtgaagcagtcattctacttgcc

SEQ ID NO: 135614 - DNA, 75 bp, Artificial Sequence
  Synthetic
gcagaagccacggtccacgagtgggtgccctcgctccaggttaggggtggtcgtgaagcagtcattctacttgcc

SEQ ID NO: 135615 - DNA, 75 bp, Artificial Sequence
  Synthetic
gcagaagccacggtccacgagtgggtgccctcgctcctggttaggggtggtcgtgaagcagtcattctacttgcc

SEQ ID NO: 135616 - DNA, 75 bp, Artificial Sequence
  Synthetic
gcagaagccacggtccacgagtgggtgccctcgctcccggttaggggtggtcgtgaagcagtcattctacttgcc

SEQ ID NO: 135617 - DNA, 75 bp, Artificial Sequence
  Synthetic
gcagaagccacggtccacgagtgggtgccctcgctccgggttaggggtggtcgtgaagcagtcattctacttgcc

SEQ ID NO: 135618 - DNA, 75 bp, Artificial Sequence
  Synthetic
gcagaagccacggtccaggagtgggtgccctcactccaggttaggggtggtcgtgaagcagtcattctacttgcc

SEQ ID NO: 135619 - DNA, 75 bp, Artificial Sequence
  Synthetic
gcagaagccacggtccaggagtgggtgccctcactcctggttaggggtggtcgtgaagcagtcattctacttgcc

SEQ ID NO: 135620 - DNA, 75 bp, Artificial Sequence
  Synthetic
gcagaagccacggtccaggagtgggtgccctcactcccggttaggggtggtcgtgaagcagtcattctacttgcc

SEQ ID NO: 135621 - DNA, 75 bp, Artificial Sequence
  Synthetic
gcagaagccacggtccaggagtgggtgccctcactccgggttaggggtggtcgtgaagcagtcattctacttgcc

SEQ ID NO: 135622 - DNA, 75 bp, Artificial Sequence
  Synthetic
gcagaagccacggtccaggagtgggtgccctctctccaggttaggggtggtcgtgaagcagtcattctacttgcc

SEQ ID NO: 135623 - DNA, 75 bp, Artificial Sequence
  Synthetic
gcagaagccacggtccaggagtgggtgccctctctcctggttaggggtggtcgtgaagcagtcattctacttgcc

SEQ ID NO: 135624 - DNA, 75 bp, Artificial Sequence
  Synthetic
gcagaagccacggtccaggagtgggtgccctctctcccggttaggggtggtcgtgaagcagtcattctacttgcc

SEQ ID NO: 135625 - DNA, 75 bp, Artificial Sequence
  Synthetic
gcagaagccacggtccaggagtgggtgccctctctccgggttaggggtggtcgtgaagcagtcattctacttgcc

SEQ ID NO: 135626 - DNA, 75 bp, Artificial Sequence
  Synthetic
gcagaagccacggtccaggagtgggtgccctccctccaggttaggggtggtcgtgaagcagtcattctacttgcc

SEQ ID NO: 135627 - DNA, 75 bp, Artificial Sequence
  Synthetic
gcagaagccacggtccaggagtgggtgccctccctcctggttaggggtggtcgtgaagcagtcattctacttgcc

SEQ ID NO: 135628 - DNA, 75 bp, Artificial Sequence
  Synthetic
gcagaagccacggtccaggagtgggtgccctccctcccggttaggggtggtcgtgaagcagtcattctacttgcc

SEQ ID NO: 135629 - DNA, 75 bp, Artificial Sequence
  Synthetic
gcagaagccacggtccaggagtgggtgccctccctccgggttaggggtggtcgtgaagcagtcattctacttgcc

SEQ ID NO: 135630 - DNA, 75 bp, Artificial Sequence
  Synthetic
gcagaagccacggtccaggagtgggtgccctcgctccaggttaggggtggtcgtgaagcagtcattctacttgcc

SEQ ID NO: 135631 - DNA, 75 bp, Artificial Sequence
  Synthetic
gcagaagccacggtccaggagtgggtgccctcgctcctggttaggggtggtcgtgaagcagtcattctacttgcc

SEQ ID NO: 135632 - DNA, 75 bp, Artificial Sequence
  Synthetic
gcagaagccacggtccaggagtgggtgccctcgctcccggttaggggtggtcgtgaagcagtcattctacttgcc

SEQ ID NO: 135633 - DNA, 75 bp, Artificial Sequence
  Synthetic
gcagaagccacggtccaggagtgggtgccctcgctccgggttaggggtggtcgtgaagcagtcattctacttgcc

SEQ ID NO: 135634 - DNA, 75 bp, Artificial Sequence
  Synthetic
gaacactagttctagctactacgccactaatgattgctctaacagcagcatcacctggcagctccaaaacgctgt

SEQ ID NO: 135635 - DNA, 75 bp, Artificial Sequence
  Synthetic
atcactgctgagaccgcaaagcgcagattagctagggggtcccccccctctctggccagttcctcggccagccag

SEQ ID NO: 135636 - DNA, 75 bp, Artificial Sequence
  Synthetic
cccatcacccaactacactcgcgcactatggcgcgtagctgccaacagctacgttgaggtgcgccgggtggggga

SEQ ID NO: 135637 - DNA, 75 bp, Artificial Sequence
  Synthetic
ctcactcgcagcctgcgaacacatgttgacgcgatcgtaacggcagctacggtctgctcggccctgtatgtggga

SEQ ID NO: 135638 - DNA, 75 bp, Artificial Sequence
  Synthetic
ggagtgggcaccatccatgcaggcgcgcggtggccgcgatggcatcatatgggccgccaccatattctgcccggg

SEQ ID NO: 135639 - DNA, 75 bp, Artificial Sequence
  Synthetic
acttcgtgcgagcgcacattctgctgcgggcctgcatgtttttccgaggcatagtttgaggcaaatatgctcaag

SEQ ID NO: 135640 - DNA, 75 bp, Artificial Sequence
  Synthetic
acttcgtgcgagcgcacattctgctgcgggcctgcatgtttttccgaggcatagtttgtggcaaatatgctcaag

SEQ ID NO: 135641 - DNA, 75 bp, Artificial Sequence
  Synthetic
acttcgtgcgagcgcacattctgctgcgggcctgcatgtttttccgaggcatagtttgcggcaaatatgctcaag

SEQ ID NO: 135642 - DNA, 75 bp, Artificial Sequence
  Synthetic
acttcgtgcgagcgcacattctgctgcgggcctgcatgtttttccgaggcatagtttggggcaaatatgctcaag

SEQ ID NO: 135643 - DNA, 75 bp, Artificial Sequence
  Synthetic
acttcgtgcgagcgcacattctgctgcgggcctgcatgtttttccgtggcatagtttgaggcaaatatgctcaag

SEQ ID NO: 135644 - DNA, 75 bp, Artificial Sequence
  Synthetic
acttcgtgcgagcgcacattctgctgcgggcctgcatgtttttccgtggcatagtttgtggcaaatatgctcaag

SEQ ID NO: 135645 - DNA, 75 bp, Artificial Sequence
  Synthetic
acttcgtgcgagcgcacattctgctgcgggcctgcatgtttttccgtggcatagtttgcggcaaatatgctcaag

SEQ ID NO: 135646 - DNA, 75 bp, Artificial Sequence
  Synthetic
acttcgtgcgagcgcacattctgctgcgggcctgcatgtttttccgtggcatagtttggggcaaatatgctcaag

SEQ ID NO: 135647 - DNA, 75 bp, Artificial Sequence
  Synthetic
acttcgtgcgagcgcacattctgctgcgggcctgcatgtttttccgcggcatagtttgaggcaaatatgctcaag

SEQ ID NO: 135648 - DNA, 75 bp, Artificial Sequence
  Synthetic
acttcgtgcgagcgcacattctgctgcgggcctgcatgtttttccgcggcatagtttgtggcaaatatgctcaag

SEQ ID NO: 135649 - DNA, 75 bp, Artificial Sequence
  Synthetic
acttcgtgcgagcgcacattctgctgcgggcctgcatgtttttccgcggcatagtttgcggcaaatatgctcaag

SEQ ID NO: 135650 - DNA, 75 bp, Artificial Sequence
  Synthetic
acttcgtgcgagcgcacattctgctgcgggcctgcatgtttttccgcggcatagtttggggcaaatatgctcaag

SEQ ID NO: 135651 - DNA, 75 bp, Artificial Sequence
  Synthetic
acttcgtgcgagcgcacattctgctgcgggcctgcatgtttttccggggcatagtttgaggcaaatatgctcaag

SEQ ID NO: 135652 - DNA, 75 bp, Artificial Sequence
  Synthetic
acttcgtgcgagcgcacattctgctgcgggcctgcatgtttttccggggcatagtttgtggcaaatatgctcaag

SEQ ID NO: 135653 - DNA, 75 bp, Artificial Sequence
  Synthetic
acttcgtgcgagcgcacattctgctgcgggcctgcatgtttttccggggcatagtttgcggcaaatatgctcaag

SEQ ID NO: 135654 - DNA, 75 bp, Artificial Sequence
  Synthetic
acttcgtgcgagcgcacattctgctgcgggcctgcatgtttttccggggcatagtttggggcaaatatgctcaag

SEQ ID NO: 135655 - DNA, 75 bp, Artificial Sequence
  Synthetic
acttcgtgcgtgcgcacattctgctgcgggcctgcatgtttttccgaggcatagtttgaggcaaatatgctcaag

SEQ ID NO: 135656 - DNA, 75 bp, Artificial Sequence
  Synthetic
acttcgtgcgtgcgcacattctgctgcgggcctgcatgtttttccgaggcatagtttgtggcaaatatgctcaag

SEQ ID NO: 135657 - DNA, 75 bp, Artificial Sequence
  Synthetic
acttcgtgcgtgcgcacattctgctgcgggcctgcatgtttttccgaggcatagtttgcggcaaatatgctcaag

SEQ ID NO: 135658 - DNA, 75 bp, Artificial Sequence
  Synthetic
acttcgtgcgtgcgcacattctgctgcgggcctgcatgtttttccgaggcatagtttggggcaaatatgctcaag

SEQ ID NO: 135659 - DNA, 75 bp, Artificial Sequence
  Synthetic
acttcgtgcgtgcgcacattctgctgcgggcctgcatgtttttccgtggcatagtttgaggcaaatatgctcaag

SEQ ID NO: 135660 - DNA, 75 bp, Artificial Sequence
  Synthetic
acttcgtgcgtgcgcacattctgctgcgggcctgcatgtttttccgtggcatagtttgtggcaaatatgctcaag

SEQ ID NO: 135661 - DNA, 75 bp, Artificial Sequence
  Synthetic
acttcgtgcgtgcgcacattctgctgcgggcctgcatgtttttccgtggcatagtttgcggcaaatatgctcaag

SEQ ID NO: 135662 - DNA, 75 bp, Artificial Sequence
  Synthetic
acttcgtgcgtgcgcacattctgctgcgggcctgcatgtttttccgtggcatagtttggggcaaatatgctcaag

SEQ ID NO: 135663 - DNA, 75 bp, Artificial Sequence
  Synthetic
acttcgtgcgtgcgcacattctgctgcgggcctgcatgtttttccgcggcatagtttgaggcaaatatgctcaag

SEQ ID NO: 135664 - DNA, 75 bp, Artificial Sequence
  Synthetic
acttcgtgcgtgcgcacattctgctgcgggcctgcatgtttttccgcggcatagtttgtggcaaatatgctcaag

SEQ ID NO: 135665 - DNA, 75 bp, Artificial Sequence
  Synthetic
acttcgtgcgtgcgcacattctgctgcgggcctgcatgtttttccgcggcatagtttgcggcaaatatgctcaag

SEQ ID NO: 135666 - DNA, 75 bp, Artificial Sequence
  Synthetic
acttcgtgcgtgcgcacattctgctgcgggcctgcatgtttttccgcggcatagtttggggcaaatatgctcaag

SEQ ID NO: 135667 - DNA, 75 bp, Artificial Sequence
  Synthetic
acttcgtgcgtgcgcacattctgctgcgggcctgcatgtttttccggggcatagtttgaggcaaatatgctcaag

SEQ ID NO: 135668 - DNA, 75 bp, Artificial Sequence
  Synthetic
acttcgtgcgtgcgcacattctgctgcgggcctgcatgtttttccggggcatagtttgtggcaaatatgctcaag

SEQ ID NO: 135669 - DNA, 75 bp, Artificial Sequence
  Synthetic
acttcgtgcgtgcgcacattctgctgcgggcctgcatgtttttccggggcatagtttgcggcaaatatgctcaag

SEQ ID NO: 135670 - DNA, 75 bp, Artificial Sequence
  Synthetic
acttcgtgcgtgcgcacattctgctgcgggcctgcatgtttttccggggcatagtttggggcaaatatgctcaag

SEQ ID NO: 135671 - DNA, 75 bp, Artificial Sequence
  Synthetic
acttcgtgcgcgcgcacattctgctgcgggcctgcatgtttttccgaggcatagtttgaggcaaatatgctcaag

SEQ ID NO: 135672 - DNA, 75 bp, Artificial Sequence
  Synthetic
acttcgtgcgcgcgcacattctgctgcgggcctgcatgtttttccgaggcatagtttgtggcaaatatgctcaag

SEQ ID NO: 135673 - DNA, 75 bp, Artificial Sequence
  Synthetic
acttcgtgcgcgcgcacattctgctgcgggcctgcatgtttttccgaggcatagtttgcggcaaatatgctcaag

SEQ ID NO: 135674 - DNA, 75 bp, Artificial Sequence
  Synthetic
acttcgtgcgcgcgcacattctgctgcgggcctgcatgtttttccgaggcatagtttggggcaaatatgctcaag

SEQ ID NO: 135675 - DNA, 75 bp, Artificial Sequence
  Synthetic
acttcgtgcgcgcgcacattctgctgcgggcctgcatgtttttccgtggcatagtttgaggcaaatatgctcaag

SEQ ID NO: 135676 - DNA, 75 bp, Artificial Sequence
  Synthetic
acttcgtgcgcgcgcacattctgctgcgggcctgcatgtttttccgtggcatagtttgtggcaaatatgctcaag

SEQ ID NO: 135677 - DNA, 75 bp, Artificial Sequence
  Synthetic
acttcgtgcgcgcgcacattctgctgcgggcctgcatgtttttccgtggcatagtttgcggcaaatatgctcaag

SEQ ID NO: 135678 - DNA, 75 bp, Artificial Sequence
  Synthetic
acttcgtgcgcgcgcacattctgctgcgggcctgcatgtttttccgtggcatagtttggggcaaatatgctcaag

SEQ ID NO: 135679 - DNA, 75 bp, Artificial Sequence
  Synthetic
acttcgtgcgcgcgcacattctgctgcgggcctgcatgtttttccgcggcatagtttgaggcaaatatgctcaag

SEQ ID NO: 135680 - DNA, 75 bp, Artificial Sequence
  Synthetic
acttcgtgcgcgcgcacattctgctgcgggcctgcatgtttttccgcggcatagtttgtggcaaatatgctcaag

SEQ ID NO: 135681 - DNA, 75 bp, Artificial Sequence
  Synthetic
acttcgtgcgcgcgcacattctgctgcgggcctgcatgtttttccgcggcatagtttgcggcaaatatgctcaag

SEQ ID NO: 135682 - DNA, 75 bp, Artificial Sequence
  Synthetic
acttcgtgcgcgcgcacattctgctgcgggcctgcatgtttttccgcggcatagtttggggcaaatatgctcaag

SEQ ID NO: 135683 - DNA, 75 bp, Artificial Sequence
  Synthetic
acttcgtgcgcgcgcacattctgctgcgggcctgcatgtttttccggggcatagtttgaggcaaatatgctcaag

SEQ ID NO: 135684 - DNA, 75 bp, Artificial Sequence
  Synthetic
acttcgtgcgcgcgcacattctgctgcgggcctgcatgtttttccggggcatagtttgtggcaaatatgctcaag

SEQ ID NO: 135685 - DNA, 75 bp, Artificial Sequence
  Synthetic
acttcgtgcgcgcgcacattctgctgcgggcctgcatgtttttccggggcatagtttgcggcaaatatgctcaag

SEQ ID NO: 135686 - DNA, 75 bp, Artificial Sequence
  Synthetic
acttcgtgcgcgcgcacattctgctgcgggcctgcatgtttttccggggcatagtttggggcaaatatgctcaag

SEQ ID NO: 135687 - DNA, 75 bp, Artificial Sequence
  Synthetic
acttcgtgcgggcgcacattctgctgcgggcctgcatgtttttccgaggcatagtttgaggcaaatatgctcaag

SEQ ID NO: 135688 - DNA, 75 bp, Artificial Sequence
  Synthetic
acttcgtgcgggcgcacattctgctgcgggcctgcatgtttttccgaggcatagtttgtggcaaatatgctcaag

SEQ ID NO: 135689 - DNA, 75 bp, Artificial Sequence
  Synthetic
acttcgtgcgggcgcacattctgctgcgggcctgcatgtttttccgaggcatagtttgcggcaaatatgctcaag

SEQ ID NO: 135690 - DNA, 75 bp, Artificial Sequence
  Synthetic
acttcgtgcgggcgcacattctgctgcgggcctgcatgtttttccgaggcatagtttggggcaaatatgctcaag

SEQ ID NO: 135691 - DNA, 75 bp, Artificial Sequence
  Synthetic
acttcgtgcgggcgcacattctgctgcgggcctgcatgtttttccgtggcatagtttgaggcaaatatgctcaag

SEQ ID NO: 135692 - DNA, 75 bp, Artificial Sequence
  Synthetic
acttcgtgcgggcgcacattctgctgcgggcctgcatgtttttccgtggcatagtttgtggcaaatatgctcaag

SEQ ID NO: 135693 - DNA, 75 bp, Artificial Sequence
  Synthetic
acttcgtgcgggcgcacattctgctgcgggcctgcatgtttttccgtggcatagtttgcggcaaatatgctcaag

SEQ ID NO: 135694 - DNA, 75 bp, Artificial Sequence
  Synthetic
acttcgtgcgggcgcacattctgctgcgggcctgcatgtttttccgtggcatagtttggggcaaatatgctcaag

SEQ ID NO: 135695 - DNA, 75 bp, Artificial Sequence
  Synthetic
acttcgtgcgggcgcacattctgctgcgggcctgcatgtttttccgcggcatagtttgaggcaaatatgctcaag

SEQ ID NO: 135696 - DNA, 75 bp, Artificial Sequence
  Synthetic
acttcgtgcgggcgcacattctgctgcgggcctgcatgtttttccgcggcatagtttgtggcaaatatgctcaag

SEQ ID NO: 135697 - DNA, 75 bp, Artificial Sequence
  Synthetic
acttcgtgcgggcgcacattctgctgcgggcctgcatgtttttccgcggcatagtttgcggcaaatatgctcaag

SEQ ID NO: 135698 - DNA, 75 bp, Artificial Sequence
  Synthetic
acttcgtgcgggcgcacattctgctgcgggcctgcatgtttttccgcggcatagtttggggcaaatatgctcaag

SEQ ID NO: 135699 - DNA, 75 bp, Artificial Sequence
  Synthetic
acttcgtgcgggcgcacattctgctgcgggcctgcatgtttttccggggcatagtttgaggcaaatatgctcaag

SEQ ID NO: 135700 - DNA, 75 bp, Artificial Sequence
  Synthetic
acttcgtgcgggcgcacattctgctgcgggcctgcatgtttttccggggcatagtttgtggcaaatatgctcaag

SEQ ID NO: 135701 - DNA, 75 bp, Artificial Sequence
  Synthetic
acttcgtgcgggcgcacattctgctgcgggcctgcatgtttttccggggcatagtttgcggcaaatatgctcaag

SEQ ID NO: 135702 - DNA, 75 bp, Artificial Sequence
  Synthetic
acttcgtgcgggcgcacattctgctgcgggcctgcatgtttttccggggcatagtttggggcaaatatgctcaag

SEQ ID NO: 135703 - DNA, 75 bp, Artificial Sequence
  Synthetic
gcaagctaattgggccaaagtcatcttagtcctattcctctttgcaggggttgacgctgagactcatgtgtctgg

SEQ ID NO: 135704 - DNA, 75 bp, Artificial Sequence
  Synthetic
ttgacgcgatcgtaacggcagctacggtctgctcggccctgtatgtgggagacatgtgcggggccgtgatgattg

SEQ ID NO: 135705 - DNA, 75 bp, Artificial Sequence
  Synthetic
gtaacatcactcgggtagagtcagagaacaaggtggtgatcctggactccttcgaccctctcaaggccgaagacg

SEQ ID NO: 135706 - DNA, 75 bp, Artificial Sequence
  Synthetic
tgtatgaggctgaagatttcatcatgcacctacctggttgtgtcccttgtgttcaggtggccaacgtatcatcat

SEQ ID NO: 135707 - DNA, 75 bp, Artificial Sequence
  Synthetic
cgcagtggagccggttgttttctctccgatggagaagaaggtcatcacctggggcgccgacacggccgcttgcgg

SEQ ID NO: 135708 - DNA, 75 bp, Artificial Sequence
  Synthetic
gaacaaggtggtgatcctggactccttcgaccctctcaaggccgaagacgatgaccgggaagtgtcggtacccgc

SEQ ID NO: 135709 - DNA, 75 bp, Artificial Sequence
  Synthetic
ggatctcaactcccctgtgagccagaaccagatgtttctgtgctgacctcgatgttgagagacccttctcatatc

SEQ ID NO: 135710 - DNA, 75 bp, Artificial Sequence
  Synthetic
ccaaatactttcttctcttaccatcaccagcctactccgcagattacaccagtgggtcaatgaagacgcgtccac

SEQ ID NO: 135711 - DNA, 75 bp, Artificial Sequence
  Synthetic
aacagctcagggtgtcccgaacggctcgcaagatgcaagaggcttgacagctttgaccaaggatggggcccactt

SEQ ID NO: 135712 - DNA, 75 bp, Artificial Sequence
  Synthetic
aacagctcagggtgtcccgaacggctcgcaagatgcatgaggcttgacagctttgaccaaggatggggcccactt

SEQ ID NO: 135713 - DNA, 75 bp, Artificial Sequence
  Synthetic
aacagctcagggtgtcccgaacggctcgcaagatgcacgaggcttgacagctttgaccaaggatggggcccactt

SEQ ID NO: 135714 - DNA, 75 bp, Artificial Sequence
  Synthetic
aacagctcagggtgtcccgaacggctcgcaagatgcaggaggcttgacagctttgaccaaggatggggcccactt

SEQ ID NO: 135715 - DNA, 75 bp, Artificial Sequence
  Synthetic
actggaggtgtggaagagaccgggctacgaaccacccgtagtgcatggctgtgcgcttcctcccccaagccagcc

SEQ ID NO: 135716 - DNA, 75 bp, Artificial Sequence
  Synthetic
ctgctctgccatgtacgtgggcgacctatgtggcggcatattcctggccgggcaactcttcaccttcaggccccg

SEQ ID NO: 135717 - DNA, 75 bp, Artificial Sequence
  Synthetic
cccattacggcgtacgcccagcagactcggggcttggtaggcgctattatcactagtcttacgggacgcgataag

SEQ ID NO: 135718 - DNA, 75 bp, Artificial Sequence
  Synthetic
cccggtaccaccaccccggaggaagaagacaatcacacttacagagtctactgtttctggcgccctggcagagct

SEQ ID NO: 135719 - DNA, 75 bp, Artificial Sequence
  Synthetic
ccgtatactgcttcacccccagcccagttgtggtcggaaccaccgatcgcctcggggtccctacttacacctggg

SEQ ID NO: 135720 - DNA, 75 bp, Artificial Sequence
  Synthetic
cactagtcttacgggacgcgataagaacgtagtggaaggagaaattcaggttgtgtcaacagccactcaatcttt

SEQ ID NO: 135721 - DNA, 75 bp, Artificial Sequence
  Synthetic
tgaggcacctcgcagggggtaggtacgtccagatggcgctattagcccttggtaggtggaccggcacttacatct

SEQ ID NO: 135722 - DNA, 75 bp, Artificial Sequence
  Synthetic
aattgattaacaccaatggcagctggcacataaaccggaccgccctcaattgcaacgacagcctgcagacggggt

SEQ ID NO: 135723 - DNA, 75 bp, Artificial Sequence
  Synthetic
gtcacacttattctagcatacgctacgcgtgtgcctcaggtggtcatcgacgtctttgtagggggccactggggc

SEQ ID NO: 135724 - DNA, 75 bp, Artificial Sequence
  Synthetic
gtcactcttattctagcatacgctacgcgtgtgcctcaggtggtcatcgacgtctttgtagggggccactggggc

SEQ ID NO: 135725 - DNA, 75 bp, Artificial Sequence
  Synthetic
gtcacccttattctagcatacgctacgcgtgtgcctcaggtggtcatcgacgtctttgtagggggccactggggc

SEQ ID NO: 135726 - DNA, 75 bp, Artificial Sequence
  Synthetic
gtcacgcttattctagcatacgctacgcgtgtgcctcaggtggtcatcgacgtctttgtagggggccactggggc

SEQ ID NO: 135727 - DNA, 75 bp, Artificial Sequence
  Synthetic
gggtcgaaccacttcggggtttgttagcatcttctcccctggtccccagcagaaaatccagctaatcaacgccaa

SEQ ID NO: 135728 - DNA, 75 bp, Artificial Sequence
  Synthetic
gacgccgagtcatggtcctcaatgccccccctcgagggggagccgggggatcctgaccttagcgaaggatcttgg

SEQ ID NO: 135729 - DNA, 75 bp, Artificial Sequence
  Synthetic
cctccagcccttcctatctgggctaggccagactacaaccctccactgttggaccgctggaaagcaccggattat

SEQ ID NO: 135730 - DNA, 75 bp, Artificial Sequence
  Synthetic
ggtgcgtggttcggatgcgtgtggatgaacggtaccgggttcacaaaaacctgtggcgctcctccatgcgtggtt

SEQ ID NO: 135731 - DNA, 75 bp, Artificial Sequence
  Synthetic
tggacgatttccgcatcgggtggggaaccttggagtacgagactaatgtcaccaacgatgaggacatgaggccgt

SEQ ID NO: 135732 - DNA, 75 bp, Artificial Sequence
  Synthetic
cagtccttcctcggaacatccattacgggggtcttgtggaccgtctaccatggagctggcaacaagactctagcc

SEQ ID NO: 135733 - DNA, 75 bp, Artificial Sequence
  Synthetic
cagtccttcctcggaacatccatttcgggggtcttgtggaccgtctaccatggagctggcaacaagactctagcc

SEQ ID NO: 135734 - DNA, 75 bp, Artificial Sequence
  Synthetic
cagtccttcctcggaacatccattccgggggtcttgtggaccgtctaccatggagctggcaacaagactctagcc

SEQ ID NO: 135735 - DNA, 75 bp, Artificial Sequence
  Synthetic
cagtccttcctcggaacatccattgcgggggtcttgtggaccgtctaccatggagctggcaacaagactctagcc

SEQ ID NO: 135736 - DNA, 75 bp, Artificial Sequence
  Synthetic
taattggcgccctaacaggtcagacattgtctggctttacgggtttgtttactactggggccaagcagaacatcc

SEQ ID NO: 135737 - DNA, 75 bp, Artificial Sequence
  Synthetic
ttaaagggtcctccggcggtcctatgctatgcccctctggccatgtcgcggggattttccgtgcggccgtgtgca

SEQ ID NO: 135738 - DNA, 75 bp, Artificial Sequence
  Synthetic
ctggtctactctacaacctcccgcagcgcgggccagaggcagaagaaagtcacctttgacaggctgcaggtctta

SEQ ID NO: 135739 - DNA, 75 bp, Artificial Sequence
  Synthetic
caactcgctgctgcgccataggaatctggtctactctacaacctcccgcagcgcgggccagaggcagaagaaagt

SEQ ID NO: 135740 - DNA, 75 bp, Artificial Sequence
  Synthetic
caaattcaactcttcggggtgtcccgagcgtctcagctcgtgtaagcctctcgcggcgtttgaccaagggtgggg

SEQ ID NO: 135741 - DNA, 75 bp, Artificial Sequence
  Synthetic
gaggaagcgtgtgacctgacgccccctcattcagccaaatcaaaatttggctacggggcgaaagacgtccgcaac

SEQ ID NO: 135742 - DNA, 75 bp, Artificial Sequence
  Synthetic
accgcagacctatcaggtagggtatcttcacgctcccacaggaagcgggaagagcaccaaagtcccggcggccta

SEQ ID NO: 135743 - DNA, 75 bp, Artificial Sequence
  Synthetic
accgcagacctatcaggtagggtatcttcacgctcccacaggaagcgggaagagcaccaatgtcccggcggccta

SEQ ID NO: 135744 - DNA, 75 bp, Artificial Sequence
  Synthetic
accgcagacctatcaggtagggtatcttcacgctcccacaggaagcgggaagagcaccaacgtcccggcggccta

SEQ ID NO: 135745 - DNA, 75 bp, Artificial Sequence
  Synthetic
accgcagacctatcaggtagggtatcttcacgctcccacaggaagcgggaagagcaccaaggtcccggcggccta

SEQ ID NO: 135746 - DNA, 75 bp, Artificial Sequence
  Synthetic
gcccatcacgtacgccaacgtgacggggtcatcagatgacagaccatactgctggcactatgcaccacgaccatg

SEQ ID NO: 135747 - DNA, 75 bp, Artificial Sequence
  Synthetic
ttttttttttttttttttttttttttttttttttttttatggtggctccatcttagccctagtcacggctagctg

SEQ ID NO: 135748 - DNA, 75 bp, Artificial Sequence
  Synthetic
ttttttttttttttttttttttttttttttttttttttttggtggctccatcttagccctagtcacggctagctg

SEQ ID NO: 135749 - DNA, 75 bp, Artificial Sequence
  Synthetic
ttttttttttttttttttttttttttttttttttttttctggtggctccatcttagccctagtcacggctagctg

SEQ ID NO: 135750 - DNA, 75 bp, Artificial Sequence
  Synthetic
ttttttttttttttttttttttttttttttttttttttgtggtggctccatcttagccctagtcacggctagctg

SEQ ID NO: 135751 - DNA, 75 bp, Artificial Sequence
  Synthetic
tcaaatctgtgtggcaagacctgctggaagacaatgagacaccacttgacactactatcatggcaaagaatgagg

SEQ ID NO: 135752 - DNA, 75 bp, Artificial Sequence
  Synthetic
aactggggtgagaatgagtctgacgtgctcctcctgcgcagcccccggcctccggcgggcggctggtatggttgc

SEQ ID NO: 135753 - DNA, 75 bp, Artificial Sequence
  Synthetic
aactggggtgtgaatgagtctgacgtgctcctcctgcgcagcccccggcctccggcgggcggctggtatggttgc

SEQ ID NO: 135754 - DNA, 75 bp, Artificial Sequence
  Synthetic
aactggggtgcgaatgagtctgacgtgctcctcctgcgcagcccccggcctccggcgggcggctggtatggttgc

SEQ ID NO: 135755 - DNA, 75 bp, Artificial Sequence
  Synthetic
aactggggtgggaatgagtctgacgtgctcctcctgcgcagcccccggcctccggcgggcggctggtatggttgc

SEQ ID NO: 135756 - DNA, 75 bp, Artificial Sequence
  Synthetic
ccaagctcatggcatagaacccaatatccgcaccggggtgaggactatcaccactggcggaaagattacttactc

SEQ ID NO: 135757 - DNA, 75 bp, Artificial Sequence
  Synthetic
ccaagctcatggcatagatcccaatatccgcaccggggtgaggactatcaccactggcggaaagattacttactc

SEQ ID NO: 135758 - DNA, 75 bp, Artificial Sequence
  Synthetic
ccaagctcatggcatagaccccaatatccgcaccggggtgaggactatcaccactggcggaaagattacttactc

SEQ ID NO: 135759 - DNA, 75 bp, Artificial Sequence
  Synthetic
ccaagctcatggcatagagcccaatatccgcaccggggtgaggactatcaccactggcggaaagattacttactc

SEQ ID NO: 135760 - DNA, 75 bp, Artificial Sequence
  Synthetic
tcttctgcgtcgctcctgaaaaggggggcaagaagccagctcgactgatcgtgtaccccgatctgggtgtgcggg

SEQ ID NO: 135761 - DNA, 75 bp, Artificial Sequence
  Synthetic
gggcaagaagccagctcgactgatcgtgtaccccgatctgggtgtgcgggtctgtgagaaaatggccttgtacga

SEQ ID NO: 135762 - DNA, 75 bp, Artificial Sequence
  Synthetic
ggactgggtacactaagacatgcggagcaccaccttgccgcattaggaaggacttcaatagcaccctcgatctat

SEQ ID NO: 135763 - DNA, 75 bp, Artificial Sequence
  Synthetic
gcactatccgtgcactgtgaattttaccatcttcaaggtgcggatgtatgtagggggggtggagcatcgattgac

SEQ ID NO: 135764 - DNA, 75 bp, Artificial Sequence
  Synthetic
ttaggaaacaccacgccgccacgtatgcgaagtgcggctctggcccctggctcacaccaaggtgcttggtcgact

SEQ ID NO: 135765 - DNA, 75 bp, Artificial Sequence
  Synthetic
gaccgctgcagattggaagatagggacaggtgtcagcaaagcccactgctgcattccaccactgagtgggcggtg

SEQ ID NO: 135766 - DNA, 75 bp, Artificial Sequence
  Synthetic
ctatcacaagatacatcgtgaagtgggaatgggtggtcctccttttcttgttgctggcggacgccagggtctgtg

SEQ ID NO: 135767 - DNA, 75 bp, Artificial Sequence
  Synthetic
gtggacgtgcagtacctctatggactttctccggctatcacaagatacatcgtgaagtgggaatgggtggtcctc

SEQ ID NO: 135768 - DNA, 75 bp, Artificial Sequence
  Synthetic
tatttcatagctaggaccgaggccatgctgcatgtctatgttccatccttcgacgtgcgcgggcctcgcgactca

SEQ ID NO: 135769 - DNA, 75 bp, Artificial Sequence
  Synthetic
tacgtcgggggccccctgactaattcaaagggcgagaactgcggctatcgcaggtgccgtgcaagcggcgtcctg

SEQ ID NO: 135770 - DNA, 75 bp, Artificial Sequence
  Synthetic
agggggggagacatctaatcttttgccactccaagaagaagtgcgacgaacttgccaaacagcttacatctctcg

SEQ ID NO: 135771 - DNA, 75 bp, Artificial Sequence
  Synthetic
aaattggacacgaggggaacgctgcgagttggaggacagagaacgggttgttatgagccccctcatgttctcaac

SEQ ID NO: 135772 - DNA, 75 bp, Artificial Sequence
  Synthetic
aaattggacacgaggggaacgctgcgagttggaggacagagatcgggttgttatgagccccctcatgttctcaac

SEQ ID NO: 135773 - DNA, 75 bp, Artificial Sequence
  Synthetic
aaattggacacgaggggaacgctgcgagttggaggacagagaccgggttgttatgagccccctcatgttctcaac

SEQ ID NO: 135774 - DNA, 75 bp, Artificial Sequence
  Synthetic
aaattggacacgaggggaacgctgcgagttggaggacagagagcgggttgttatgagccccctcatgttctcaac

SEQ ID NO: 135775 - DNA, 75 bp, Artificial Sequence
  Synthetic
aaattggacacgaggggatcgctgcgagttggaggacagagaacgggttgttatgagccccctcatgttctcaac

SEQ ID NO: 135776 - DNA, 75 bp, Artificial Sequence
  Synthetic
aaattggacacgaggggatcgctgcgagttggaggacagagatcgggttgttatgagccccctcatgttctcaac

SEQ ID NO: 135777 - DNA, 75 bp, Artificial Sequence
  Synthetic
aaattggacacgaggggatcgctgcgagttggaggacagagaccgggttgttatgagccccctcatgttctcaac

SEQ ID NO: 135778 - DNA, 75 bp, Artificial Sequence
  Synthetic
aaattggacacgaggggatcgctgcgagttggaggacagagagcgggttgttatgagccccctcatgttctcaac

SEQ ID NO: 135779 - DNA, 75 bp, Artificial Sequence
  Synthetic
aaattggacacgaggggaccgctgcgagttggaggacagagaacgggttgttatgagccccctcatgttctcaac

SEQ ID NO: 135780 - DNA, 75 bp, Artificial Sequence
  Synthetic
aaattggacacgaggggaccgctgcgagttggaggacagagatcgggttgttatgagccccctcatgttctcaac

SEQ ID NO: 135781 - DNA, 75 bp, Artificial Sequence
  Synthetic
aaattggacacgaggggaccgctgcgagttggaggacagagaccgggttgttatgagccccctcatgttctcaac

SEQ ID NO: 135782 - DNA, 75 bp, Artificial Sequence
  Synthetic
aaattggacacgaggggaccgctgcgagttggaggacagagagcgggttgttatgagccccctcatgttctcaac

SEQ ID NO: 135783 - DNA, 75 bp, Artificial Sequence
  Synthetic
aaattggacacgaggggagcgctgcgagttggaggacagagaacgggttgttatgagccccctcatgttctcaac

SEQ ID NO: 135784 - DNA, 75 bp, Artificial Sequence
  Synthetic
aaattggacacgaggggagcgctgcgagttggaggacagagatcgggttgttatgagccccctcatgttctcaac

SEQ ID NO: 135785 - DNA, 75 bp, Artificial Sequence
  Synthetic
aaattggacacgaggggagcgctgcgagttggaggacagagaccgggttgttatgagccccctcatgttctcaac

SEQ ID NO: 135786 - DNA, 75 bp, Artificial Sequence
  Synthetic
aaattggacacgaggggagcgctgcgagttggaggacagagagcgggttgttatgagccccctcatgttctcaac

SEQ ID NO: 135787 - DNA, 75 bp, Artificial Sequence
  Synthetic
aaattggactcgaggggaacgctgcgagttggaggacagagaacgggttgttatgagccccctcatgttctcaac

SEQ ID NO: 135788 - DNA, 75 bp, Artificial Sequence
  Synthetic
aaattggactcgaggggaacgctgcgagttggaggacagagatcgggttgttatgagccccctcatgttctcaac

SEQ ID NO: 135789 - DNA, 75 bp, Artificial Sequence
  Synthetic
aaattggactcgaggggaacgctgcgagttggaggacagagaccgggttgttatgagccccctcatgttctcaac

SEQ ID NO: 135790 - DNA, 75 bp, Artificial Sequence
  Synthetic
aaattggactcgaggggaacgctgcgagttggaggacagagagcgggttgttatgagccccctcatgttctcaac

SEQ ID NO: 135791 - DNA, 75 bp, Artificial Sequence
  Synthetic
aaattggactcgaggggatcgctgcgagttggaggacagagaacgggttgttatgagccccctcatgttctcaac

SEQ ID NO: 135792 - DNA, 75 bp, Artificial Sequence
  Synthetic
aaattggactcgaggggatcgctgcgagttggaggacagagatcgggttgttatgagccccctcatgttctcaac

SEQ ID NO: 135793 - DNA, 75 bp, Artificial Sequence
  Synthetic
aaattggactcgaggggatcgctgcgagttggaggacagagaccgggttgttatgagccccctcatgttctcaac

SEQ ID NO: 135794 - DNA, 75 bp, Artificial Sequence
  Synthetic
aaattggactcgaggggatcgctgcgagttggaggacagagagcgggttgttatgagccccctcatgttctcaac

SEQ ID NO: 135795 - DNA, 75 bp, Artificial Sequence
  Synthetic
aaattggactcgaggggaccgctgcgagttggaggacagagaacgggttgttatgagccccctcatgttctcaac

SEQ ID NO: 135796 - DNA, 75 bp, Artificial Sequence
  Synthetic
aaattggactcgaggggaccgctgcgagttggaggacagagatcgggttgttatgagccccctcatgttctcaac

SEQ ID NO: 135797 - DNA, 75 bp, Artificial Sequence
  Synthetic
aaattggactcgaggggaccgctgcgagttggaggacagagaccgggttgttatgagccccctcatgttctcaac

SEQ ID NO: 135798 - DNA, 75 bp, Artificial Sequence
  Synthetic
aaattggactcgaggggaccgctgcgagttggaggacagagagcgggttgttatgagccccctcatgttctcaac

SEQ ID NO: 135799 - DNA, 75 bp, Artificial Sequence
  Synthetic
aaattggactcgaggggagcgctgcgagttggaggacagagaacgggttgttatgagccccctcatgttctcaac

SEQ ID NO: 135800 - DNA, 75 bp, Artificial Sequence
  Synthetic
aaattggactcgaggggagcgctgcgagttggaggacagagatcgggttgttatgagccccctcatgttctcaac

SEQ ID NO: 135801 - DNA, 75 bp, Artificial Sequence
  Synthetic
aaattggactcgaggggagcgctgcgagttggaggacagagaccgggttgttatgagccccctcatgttctcaac

SEQ ID NO: 135802 - DNA, 75 bp, Artificial Sequence
  Synthetic
aaattggactcgaggggagcgctgcgagttggaggacagagagcgggttgttatgagccccctcatgttctcaac

SEQ ID NO: 135803 - DNA, 75 bp, Artificial Sequence
  Synthetic
aaattggacccgaggggaacgctgcgagttggaggacagagaacgggttgttatgagccccctcatgttctcaac

SEQ ID NO: 135804 - DNA, 75 bp, Artificial Sequence
  Synthetic
aaattggacccgaggggaacgctgcgagttggaggacagagatcgggttgttatgagccccctcatgttctcaac

SEQ ID NO: 135805 - DNA, 75 bp, Artificial Sequence
  Synthetic
aaattggacccgaggggaacgctgcgagttggaggacagagaccgggttgttatgagccccctcatgttctcaac

SEQ ID NO: 135806 - DNA, 75 bp, Artificial Sequence
  Synthetic
aaattggacccgaggggaacgctgcgagttggaggacagagagcgggttgttatgagccccctcatgttctcaac

SEQ ID NO: 135807 - DNA, 75 bp, Artificial Sequence
  Synthetic
aaattggacccgaggggatcgctgcgagttggaggacagagaacgggttgttatgagccccctcatgttctcaac

SEQ ID NO: 135808 - DNA, 75 bp, Artificial Sequence
  Synthetic
aaattggacccgaggggatcgctgcgagttggaggacagagatcgggttgttatgagccccctcatgttctcaac

SEQ ID NO: 135809 - DNA, 75 bp, Artificial Sequence
  Synthetic
aaattggacccgaggggatcgctgcgagttggaggacagagaccgggttgttatgagccccctcatgttctcaac

SEQ ID NO: 135810 - DNA, 75 bp, Artificial Sequence
  Synthetic
aaattggacccgaggggatcgctgcgagttggaggacagagagcgggttgttatgagccccctcatgttctcaac

SEQ ID NO: 135811 - DNA, 75 bp, Artificial Sequence
  Synthetic
aaattggacccgaggggaccgctgcgagttggaggacagagaacgggttgttatgagccccctcatgttctcaac

SEQ ID NO: 135812 - DNA, 75 bp, Artificial Sequence
  Synthetic
aaattggacccgaggggaccgctgcgagttggaggacagagatcgggttgttatgagccccctcatgttctcaac

SEQ ID NO: 135813 - DNA, 75 bp, Artificial Sequence
  Synthetic
aaattggacccgaggggaccgctgcgagttggaggacagagaccgggttgttatgagccccctcatgttctcaac

SEQ ID NO: 135814 - DNA, 75 bp, Artificial Sequence
  Synthetic
aaattggacccgaggggaccgctgcgagttggaggacagagagcgggttgttatgagccccctcatgttctcaac

SEQ ID NO: 135815 - DNA, 75 bp, Artificial Sequence
  Synthetic
aaattggacccgaggggagcgctgcgagttggaggacagagaacgggttgttatgagccccctcatgttctcaac

SEQ ID NO: 135816 - DNA, 75 bp, Artificial Sequence
  Synthetic
aaattggacccgaggggagcgctgcgagttggaggacagagatcgggttgttatgagccccctcatgttctcaac

SEQ ID NO: 135817 - DNA, 75 bp, Artificial Sequence
  Synthetic
aaattggacccgaggggagcgctgcgagttggaggacagagaccgggttgttatgagccccctcatgttctcaac

SEQ ID NO: 135818 - DNA, 75 bp, Artificial Sequence
  Synthetic
aaattggacccgaggggagcgctgcgagttggaggacagagagcgggttgttatgagccccctcatgttctcaac

SEQ ID NO: 135819 - DNA, 75 bp, Artificial Sequence
  Synthetic
aaattggacgcgaggggaacgctgcgagttggaggacagagaacgggttgttatgagccccctcatgttctcaac

SEQ ID NO: 135820 - DNA, 75 bp, Artificial Sequence
  Synthetic
aaattggacgcgaggggaacgctgcgagttggaggacagagatcgggttgttatgagccccctcatgttctcaac

SEQ ID NO: 135821 - DNA, 75 bp, Artificial Sequence
  Synthetic
aaattggacgcgaggggaacgctgcgagttggaggacagagaccgggttgttatgagccccctcatgttctcaac

SEQ ID NO: 135822 - DNA, 75 bp, Artificial Sequence
  Synthetic
aaattggacgcgaggggaacgctgcgagttggaggacagagagcgggttgttatgagccccctcatgttctcaac

SEQ ID NO: 135823 - DNA, 75 bp, Artificial Sequence
  Synthetic
aaattggacgcgaggggatcgctgcgagttggaggacagagaacgggttgttatgagccccctcatgttctcaac

SEQ ID NO: 135824 - DNA, 75 bp, Artificial Sequence
  Synthetic
aaattggacgcgaggggatcgctgcgagttggaggacagagatcgggttgttatgagccccctcatgttctcaac

SEQ ID NO: 135825 - DNA, 75 bp, Artificial Sequence
  Synthetic
aaattggacgcgaggggatcgctgcgagttggaggacagagaccgggttgttatgagccccctcatgttctcaac

SEQ ID NO: 135826 - DNA, 75 bp, Artificial Sequence
  Synthetic
aaattggacgcgaggggatcgctgcgagttggaggacagagagcgggttgttatgagccccctcatgttctcaac

SEQ ID NO: 135827 - DNA, 75 bp, Artificial Sequence
  Synthetic
aaattggacgcgaggggaccgctgcgagttggaggacagagaacgggttgttatgagccccctcatgttctcaac

SEQ ID NO: 135828 - DNA, 75 bp, Artificial Sequence
  Synthetic
aaattggacgcgaggggaccgctgcgagttggaggacagagatcgggttgttatgagccccctcatgttctcaac

SEQ ID NO: 135829 - DNA, 75 bp, Artificial Sequence
  Synthetic
aaattggacgcgaggggaccgctgcgagttggaggacagagaccgggttgttatgagccccctcatgttctcaac

SEQ ID NO: 135830 - DNA, 75 bp, Artificial Sequence
  Synthetic
aaattggacgcgaggggaccgctgcgagttggaggacagagagcgggttgttatgagccccctcatgttctcaac

SEQ ID NO: 135831 - DNA, 75 bp, Artificial Sequence
  Synthetic
aaattggacgcgaggggagcgctgcgagttggaggacagagaacgggttgttatgagccccctcatgttctcaac

SEQ ID NO: 135832 - DNA, 75 bp, Artificial Sequence
  Synthetic
aaattggacgcgaggggagcgctgcgagttggaggacagagatcgggttgttatgagccccctcatgttctcaac

SEQ ID NO: 135833 - DNA, 75 bp, Artificial Sequence
  Synthetic
aaattggacgcgaggggagcgctgcgagttggaggacagagaccgggttgttatgagccccctcatgttctcaac

SEQ ID NO: 135834 - DNA, 75 bp, Artificial Sequence
  Synthetic
aaattggacgcgaggggagcgctgcgagttggaggacagagagcgggttgttatgagccccctcatgttctcaac

SEQ ID NO: 135835 - DNA, 75 bp, Artificial Sequence
  Synthetic
gggtctgtgcatgtctttggatgctcattatactgggccaagccgaggcggcgcttgagaagcttatcatcttgc

SEQ ID NO: 135836 - DNA, 75 bp, Artificial Sequence
  Synthetic
tatggggtaacacccgctttggtgtcgtgggccattaagtgggagtacattgtcctcatctttctgctattagca

SEQ ID NO: 135837 - DNA, 75 bp, Artificial Sequence
  Synthetic
tatggggtaacacccgctttggtgtcgtgggccattaagtgggagtacattgtcctcatctttctgctatttgca

SEQ ID NO: 135838 - DNA, 75 bp, Artificial Sequence
  Synthetic
tatggggtaacacccgctttggtgtcgtgggccattaagtgggagtacattgtcctcatctttctgctattcgca

SEQ ID NO: 135839 - DNA, 75 bp, Artificial Sequence
  Synthetic
tatggggtaacacccgctttggtgtcgtgggccattaagtgggagtacattgtcctcatctttctgctattggca

SEQ ID NO: 135840 - DNA, 75 bp, Artificial Sequence
  Synthetic
tatggggtaacacccgctttggtgtcgtgggccattaagtgggagtacattgtcctcatctttctgcttttagca

SEQ ID NO: 135841 - DNA, 75 bp, Artificial Sequence
  Synthetic
tatggggtaacacccgctttggtgtcgtgggccattaagtgggagtacattgtcctcatctttctgctttttgca

SEQ ID NO: 135842 - DNA, 75 bp, Artificial Sequence
  Synthetic
tatggggtaacacccgctttggtgtcgtgggccattaagtgggagtacattgtcctcatctttctgcttttcgca

SEQ ID NO: 135843 - DNA, 75 bp, Artificial Sequence
  Synthetic
tatggggtaacacccgctttggtgtcgtgggccattaagtgggagtacattgtcctcatctttctgcttttggca

SEQ ID NO: 135844 - DNA, 75 bp, Artificial Sequence
  Synthetic
tatggggtaacacccgctttggtgtcgtgggccattaagtgggagtacattgtcctcatctttctgctcttagca

SEQ ID NO: 135845 - DNA, 75 bp, Artificial Sequence
  Synthetic
tatggggtaacacccgctttggtgtcgtgggccattaagtgggagtacattgtcctcatctttctgctctttgca

SEQ ID NO: 135846 - DNA, 75 bp, Artificial Sequence
  Synthetic
tatggggtaacacccgctttggtgtcgtgggccattaagtgggagtacattgtcctcatctttctgctcttcgca

SEQ ID NO: 135847 - DNA, 75 bp, Artificial Sequence
  Synthetic
tatggggtaacacccgctttggtgtcgtgggccattaagtgggagtacattgtcctcatctttctgctcttggca

SEQ ID NO: 135848 - DNA, 75 bp, Artificial Sequence
  Synthetic
tatggggtaacacccgctttggtgtcgtgggccattaagtgggagtacattgtcctcatctttctgctgttagca

SEQ ID NO: 135849 - DNA, 75 bp, Artificial Sequence
  Synthetic
tatggggtaacacccgctttggtgtcgtgggccattaagtgggagtacattgtcctcatctttctgctgtttgca

SEQ ID NO: 135850 - DNA, 75 bp, Artificial Sequence
  Synthetic
tatggggtaacacccgctttggtgtcgtgggccattaagtgggagtacattgtcctcatctttctgctgttcgca

SEQ ID NO: 135851 - DNA, 75 bp, Artificial Sequence
  Synthetic
tatggggtaacacccgctttggtgtcgtgggccattaagtgggagtacattgtcctcatctttctgctgttggca

SEQ ID NO: 135852 - DNA, 75 bp, Artificial Sequence
  Synthetic
tctatgggaaggcgattcccctgtcttacatcaagggagggagacacttgatcttctgccattcaaagaaaaagt

SEQ ID NO: 135853 - DNA, 75 bp, Artificial Sequence
  Synthetic
tcctacgcgtcccttactttgtgagggcacatgcgctggttaagatctgcagcttgttgcgtggagtagtctatg

SEQ ID NO: 135854 - DNA, 75 bp, Artificial Sequence
  Synthetic
tggcttgtggtccttcctcctcctagtcctggccttgccacaacaggcttatgctctggacgccactgaacaagg

SEQ ID NO: 135855 - DNA, 75 bp, Artificial Sequence
  Synthetic
caggtgccgtgcaagcggcgtcctgactactagctgtgggaacaccctcacatgttacttgaaagccactgcagc

SEQ ID NO: 135856 - DNA, 75 bp, Artificial Sequence
  Synthetic
ctgagagccttcacggaggctatgaccaggtattcggccccccctggggaccccccgcgaccagagtacgacttg

SEQ ID NO: 135857 - DNA, 75 bp, Artificial Sequence
  Synthetic
ccactgatgctttaatgactggctatacaggtgactttgacagcgtgatagactgcaatgtgtctgttacgcagg

SEQ ID NO: 135858 - DNA, 75 bp, Artificial Sequence
  Synthetic
gcatccacgggtggtcctattgtctcatcttcctgtgcttcgcgtggtatatcagggggcgggctgtccccctgg

SEQ ID NO: 135859 - DNA, 75 bp, Artificial Sequence
  Synthetic
gggcgtccaggaggatgaggccaacctgagagccttcacggaggctatgaccaggtattcggccccccctgggga

SEQ ID NO: 135860 - DNA, 75 bp, Artificial Sequence
  Synthetic
ccgcgacctggcggtggccctggagccagtcgtgttcacgcccatggagaagaaaatcattgtctggggcgctga

SEQ ID NO: 135861 - DNA, 75 bp, Artificial Sequence
  Synthetic
ctcttaccccagcatacaagactctcctgagccgttcggtgtggtggctgtcctacatgctggtcttggccgagg

SEQ ID NO: 135862 - DNA, 75 bp, Artificial Sequence
  Synthetic
cactgctgcgtgtggcgacatcataggggggttacccgtctcggccaggctgggcaatgaaatcctgctcgggcc

SEQ ID NO: 135863 - DNA, 75 bp, Artificial Sequence
  Synthetic
gatactggtgatcgtaggcatcaccatattcacaatgaccccagcttataagcacttgctcgttcagctgctatg

SEQ ID NO: 135864 - DNA, 75 bp, Artificial Sequence
  Synthetic
gatcatctcgagttctgggagggagtattcactggactgacccacattgacgcccatttcctatcacagacaaaa

SEQ ID NO: 135865 - DNA, 75 bp, Artificial Sequence
  Synthetic
tgtgggcgaggatggtactgatgactcacttcttttctatcctcatcgcccaggagcaactccacaaggccctcg

SEQ ID NO: 135866 - DNA, 75 bp, Artificial Sequence
  Synthetic
tgtctgttacatccagcactcggtttagacatcaccaaggtgctcttggcaatactgggccccccctaccttttg

SEQ ID NO: 135867 - DNA, 75 bp, Artificial Sequence
  Synthetic
tgtctgttacatccagcactcggttttgacatcaccaaggtgctcttggcaatactgggccccccctaccttttg

SEQ ID NO: 135868 - DNA, 75 bp, Artificial Sequence
  Synthetic
tgtctgttacatccagcactcggtttcgacatcaccaaggtgctcttggcaatactgggccccccctaccttttg

SEQ ID NO: 135869 - DNA, 75 bp, Artificial Sequence
  Synthetic
tgtctgttacatccagcactcggtttggacatcaccaaggtgctcttggcaatactgggccccccctaccttttg

SEQ ID NO: 135870 - DNA, 75 bp, Artificial Sequence
  Synthetic
tgtctgttacatccagctctcggtttagacatcaccaaggtgctcttggcaatactgggccccccctaccttttg

SEQ ID NO: 135871 - DNA, 75 bp, Artificial Sequence
  Synthetic
tgtctgttacatccagctctcggttttgacatcaccaaggtgctcttggcaatactgggccccccctaccttttg

SEQ ID NO: 135872 - DNA, 75 bp, Artificial Sequence
  Synthetic
tgtctgttacatccagctctcggtttcgacatcaccaaggtgctcttggcaatactgggccccccctaccttttg

SEQ ID NO: 135873 - DNA, 75 bp, Artificial Sequence
  Synthetic
tgtctgttacatccagctctcggtttggacatcaccaaggtgctcttggcaatactgggccccccctaccttttg

SEQ ID NO: 135874 - DNA, 75 bp, Artificial Sequence
  Synthetic
tgtctgttacatccagccctcggtttagacatcaccaaggtgctcttggcaatactgggccccccctaccttttg

SEQ ID NO: 135875 - DNA, 75 bp, Artificial Sequence
  Synthetic
tgtctgttacatccagccctcggttttgacatcaccaaggtgctcttggcaatactgggccccccctaccttttg

SEQ ID NO: 135876 - DNA, 75 bp, Artificial Sequence
  Synthetic
tgtctgttacatccagccctcggtttcgacatcaccaaggtgctcttggcaatactgggccccccctaccttttg

SEQ ID NO: 135877 - DNA, 75 bp, Artificial Sequence
  Synthetic
tgtctgttacatccagccctcggtttggacatcaccaaggtgctcttggcaatactgggccccccctaccttttg

SEQ ID NO: 135878 - DNA, 75 bp, Artificial Sequence
  Synthetic
tgtctgttacatccagcgctcggtttagacatcaccaaggtgctcttggcaatactgggccccccctaccttttg

SEQ ID NO: 135879 - DNA, 75 bp, Artificial Sequence
  Synthetic
tgtctgttacatccagcgctcggttttgacatcaccaaggtgctcttggcaatactgggccccccctaccttttg

SEQ ID NO: 135880 - DNA, 75 bp, Artificial Sequence
  Synthetic
tgtctgttacatccagcgctcggtttcgacatcaccaaggtgctcttggcaatactgggccccccctaccttttg

SEQ ID NO: 135881 - DNA, 75 bp, Artificial Sequence
  Synthetic
tgtctgttacatccagcgctcggtttggacatcaccaaggtgctcttggcaatactgggccccccctaccttttg

SEQ ID NO: 135882 - DNA, 75 bp, Artificial Sequence
  Synthetic
tgtctgttacatcctgcactcggtttagacatcaccaaggtgctcttggcaatactgggccccccctaccttttg

SEQ ID NO: 135883 - DNA, 75 bp, Artificial Sequence
  Synthetic
tgtctgttacatcctgcactcggttttgacatcaccaaggtgctcttggcaatactgggccccccctaccttttg

SEQ ID NO: 135884 - DNA, 75 bp, Artificial Sequence
  Synthetic
tgtctgttacatcctgcactcggtttcgacatcaccaaggtgctcttggcaatactgggccccccctaccttttg

SEQ ID NO: 135885 - DNA, 75 bp, Artificial Sequence
  Synthetic
tgtctgttacatcctgcactcggtttggacatcaccaaggtgctcttggcaatactgggccccccctaccttttg

SEQ ID NO: 135886 - DNA, 75 bp, Artificial Sequence
  Synthetic
tgtctgttacatcctgctctcggtttagacatcaccaaggtgctcttggcaatactgggccccccctaccttttg

SEQ ID NO: 135887 - DNA, 75 bp, Artificial Sequence
  Synthetic
tgtctgttacatcctgctctcggttttgacatcaccaaggtgctcttggcaatactgggccccccctaccttttg

SEQ ID NO: 135888 - DNA, 75 bp, Artificial Sequence
  Synthetic
tgtctgttacatcctgctctcggtttcgacatcaccaaggtgctcttggcaatactgggccccccctaccttttg

SEQ ID NO: 135889 - DNA, 75 bp, Artificial Sequence
  Synthetic
tgtctgttacatcctgctctcggtttggacatcaccaaggtgctcttggcaatactgggccccccctaccttttg

SEQ ID NO: 135890 - DNA, 75 bp, Artificial Sequence
  Synthetic
tgtctgttacatcctgccctcggtttagacatcaccaaggtgctcttggcaatactgggccccccctaccttttg

SEQ ID NO: 135891 - DNA, 75 bp, Artificial Sequence
  Synthetic
tgtctgttacatcctgccctcggttttgacatcaccaaggtgctcttggcaatactgggccccccctaccttttg

SEQ ID NO: 135892 - DNA, 75 bp, Artificial Sequence
  Synthetic
tgtctgttacatcctgccctcggtttcgacatcaccaaggtgctcttggcaatactgggccccccctaccttttg

SEQ ID NO: 135893 - DNA, 75 bp, Artificial Sequence
  Synthetic
tgtctgttacatcctgccctcggtttggacatcaccaaggtgctcttggcaatactgggccccccctaccttttg

SEQ ID NO: 135894 - DNA, 75 bp, Artificial Sequence
  Synthetic
tgtctgttacatcctgcgctcggtttagacatcaccaaggtgctcttggcaatactgggccccccctaccttttg

SEQ ID NO: 135895 - DNA, 75 bp, Artificial Sequence
  Synthetic
tgtctgttacatcctgcgctcggttttgacatcaccaaggtgctcttggcaatactgggccccccctaccttttg

SEQ ID NO: 135896 - DNA, 75 bp, Artificial Sequence
  Synthetic
tgtctgttacatcctgcgctcggtttcgacatcaccaaggtgctcttggcaatactgggccccccctaccttttg

SEQ ID NO: 135897 - DNA, 75 bp, Artificial Sequence
  Synthetic
tgtctgttacatcctgcgctcggtttggacatcaccaaggtgctcttggcaatactgggccccccctaccttttg

SEQ ID NO: 135898 - DNA, 75 bp, Artificial Sequence
  Synthetic
tgtctgttacatcccgcactcggtttagacatcaccaaggtgctcttggcaatactgggccccccctaccttttg

SEQ ID NO: 135899 - DNA, 75 bp, Artificial Sequence
  Synthetic
tgtctgttacatcccgcactcggttttgacatcaccaaggtgctcttggcaatactgggccccccctaccttttg

SEQ ID NO: 135900 - DNA, 75 bp, Artificial Sequence
  Synthetic
tgtctgttacatcccgcactcggtttcgacatcaccaaggtgctcttggcaatactgggccccccctaccttttg

SEQ ID NO: 135901 - DNA, 75 bp, Artificial Sequence
  Synthetic
tgtctgttacatcccgcactcggtttggacatcaccaaggtgctcttggcaatactgggccccccctaccttttg

SEQ ID NO: 135902 - DNA, 75 bp, Artificial Sequence
  Synthetic
tgtctgttacatcccgctctcggtttagacatcaccaaggtgctcttggcaatactgggccccccctaccttttg

SEQ ID NO: 135903 - DNA, 75 bp, Artificial Sequence
  Synthetic
tgtctgttacatcccgctctcggttttgacatcaccaaggtgctcttggcaatactgggccccccctaccttttg

SEQ ID NO: 135904 - DNA, 75 bp, Artificial Sequence
  Synthetic
tgtctgttacatcccgctctcggtttcgacatcaccaaggtgctcttggcaatactgggccccccctaccttttg

SEQ ID NO: 135905 - DNA, 75 bp, Artificial Sequence
  Synthetic
tgtctgttacatcccgctctcggtttggacatcaccaaggtgctcttggcaatactgggccccccctaccttttg

SEQ ID NO: 135906 - DNA, 75 bp, Artificial Sequence
  Synthetic
tgtctgttacatcccgccctcggtttagacatcaccaaggtgctcttggcaatactgggccccccctaccttttg

SEQ ID NO: 135907 - DNA, 75 bp, Artificial Sequence
  Synthetic
tgtctgttacatcccgccctcggttttgacatcaccaaggtgctcttggcaatactgggccccccctaccttttg

SEQ ID NO: 135908 - DNA, 75 bp, Artificial Sequence
  Synthetic
tgtctgttacatcccgccctcggtttcgacatcaccaaggtgctcttggcaatactgggccccccctaccttttg

SEQ ID NO: 135909 - DNA, 75 bp, Artificial Sequence
  Synthetic
tgtctgttacatcccgccctcggtttggacatcaccaaggtgctcttggcaatactgggccccccctaccttttg

SEQ ID NO: 135910 - DNA, 75 bp, Artificial Sequence
  Synthetic
tgtctgttacatcccgcgctcggtttagacatcaccaaggtgctcttggcaatactgggccccccctaccttttg

SEQ ID NO: 135911 - DNA, 75 bp, Artificial Sequence
  Synthetic
tgtctgttacatcccgcgctcggttttgacatcaccaaggtgctcttggcaatactgggccccccctaccttttg

SEQ ID NO: 135912 - DNA, 75 bp, Artificial Sequence
  Synthetic
tgtctgttacatcccgcgctcggtttcgacatcaccaaggtgctcttggcaatactgggccccccctaccttttg

SEQ ID NO: 135913 - DNA, 75 bp, Artificial Sequence
  Synthetic
tgtctgttacatcccgcgctcggtttggacatcaccaaggtgctcttggcaatactgggccccccctaccttttg

SEQ ID NO: 135914 - DNA, 75 bp, Artificial Sequence
  Synthetic
tgtctgttacatccggcactcggtttagacatcaccaaggtgctcttggcaatactgggccccccctaccttttg

SEQ ID NO: 135915 - DNA, 75 bp, Artificial Sequence
  Synthetic
tgtctgttacatccggcactcggttttgacatcaccaaggtgctcttggcaatactgggccccccctaccttttg

SEQ ID NO: 135916 - DNA, 75 bp, Artificial Sequence
  Synthetic
tgtctgttacatccggcactcggtttcgacatcaccaaggtgctcttggcaatactgggccccccctaccttttg

SEQ ID NO: 135917 - DNA, 75 bp, Artificial Sequence
  Synthetic
tgtctgttacatccggcactcggtttggacatcaccaaggtgctcttggcaatactgggccccccctaccttttg

SEQ ID NO: 135918 - DNA, 75 bp, Artificial Sequence
  Synthetic
tgtctgttacatccggctctcggtttagacatcaccaaggtgctcttggcaatactgggccccccctaccttttg

SEQ ID NO: 135919 - DNA, 75 bp, Artificial Sequence
  Synthetic
tgtctgttacatccggctctcggttttgacatcaccaaggtgctcttggcaatactgggccccccctaccttttg

SEQ ID NO: 135920 - DNA, 75 bp, Artificial Sequence
  Synthetic
tgtctgttacatccggctctcggtttcgacatcaccaaggtgctcttggcaatactgggccccccctaccttttg

SEQ ID NO: 135921 - DNA, 75 bp, Artificial Sequence
  Synthetic
tgtctgttacatccggctctcggtttggacatcaccaaggtgctcttggcaatactgggccccccctaccttttg

SEQ ID NO: 135922 - DNA, 75 bp, Artificial Sequence
  Synthetic
tgtctgttacatccggccctcggtttagacatcaccaaggtgctcttggcaatactgggccccccctaccttttg

SEQ ID NO: 135923 - DNA, 75 bp, Artificial Sequence
  Synthetic
tgtctgttacatccggccctcggttttgacatcaccaaggtgctcttggcaatactgggccccccctaccttttg

SEQ ID NO: 135924 - DNA, 75 bp, Artificial Sequence
  Synthetic
tgtctgttacatccggccctcggtttcgacatcaccaaggtgctcttggcaatactgggccccccctaccttttg

SEQ ID NO: 135925 - DNA, 75 bp, Artificial Sequence
  Synthetic
tgtctgttacatccggccctcggtttggacatcaccaaggtgctcttggcaatactgggccccccctaccttttg

SEQ ID NO: 135926 - DNA, 75 bp, Artificial Sequence
  Synthetic
tgtctgttacatccggcgctcggtttagacatcaccaaggtgctcttggcaatactgggccccccctaccttttg

SEQ ID NO: 135927 - DNA, 75 bp, Artificial Sequence
  Synthetic
tgtctgttacatccggcgctcggttttgacatcaccaaggtgctcttggcaatactgggccccccctaccttttg

SEQ ID NO: 135928 - DNA, 75 bp, Artificial Sequence
  Synthetic
tgtctgttacatccggcgctcggtttcgacatcaccaaggtgctcttggcaatactgggccccccctaccttttg

SEQ ID NO: 135929 - DNA, 75 bp, Artificial Sequence
  Synthetic
tgtctgttacatccggcgctcggtttggacatcaccaaggtgctcttggcaatactgggccccccctaccttttg

SEQ ID NO: 135930 - DNA, 75 bp, Artificial Sequence
  Synthetic
tcacacggctcaagcccatgctcacagggccgacccccctgttgtacaggctagggccggtacaaaatgagacta

SEQ ID NO: 135931 - DNA, 75 bp, Artificial Sequence
  Synthetic
taccgcccttgcgagcttggagacaccgggcccgaagcgtccgcgctaagctcctgtcccagggggggaaagccg

SEQ ID NO: 135932 - DNA, 75 bp, Artificial Sequence
  Synthetic
aatcaaatgtacaccaatgttgaccaagacatggtggggtggccagcccctcctggagtcaaatctctcgcgccg

SEQ ID NO: 135933 - DNA, 75 bp, Artificial Sequence
  Synthetic
aatcaaatgtacaccaatgttgaccaagacttggtggggtggccagcccctcctggagtcaaatctctcgcgccg

SEQ ID NO: 135934 - DNA, 75 bp, Artificial Sequence
  Synthetic
aatcaaatgtacaccaatgttgaccaagacctggtggggtggccagcccctcctggagtcaaatctctcgcgccg

SEQ ID NO: 135935 - DNA, 75 bp, Artificial Sequence
  Synthetic
aatcaaatgtacaccaatgttgaccaagacgtggtggggtggccagcccctcctggagtcaaatctctcgcgccg

SEQ ID NO: 135936 - DNA, 75 bp, Artificial Sequence
  Synthetic
ctcctgtcccagggggggaaagccgctatatgcggcaagtacctcttcaactgggcagtgagaacaaagctcaaa

SEQ ID NO: 135937 - DNA, 75 bp, Artificial Sequence
  Synthetic
catgcttgctgaagcttggatcctggaccggcacttacatatatgaccacttggcccctctctcaacatgggcca

SEQ ID NO: 135938 - DNA, 75 bp, Artificial Sequence
  Synthetic
catgcttgctgaagcttggatcctggaccggcacttacatttatgaccacttggcccctctctcaacatgggcca

SEQ ID NO: 135939 - DNA, 75 bp, Artificial Sequence
  Synthetic
catgcttgctgaagcttggatcctggaccggcacttacatctatgaccacttggcccctctctcaacatgggcca

SEQ ID NO: 135940 - DNA, 75 bp, Artificial Sequence
  Synthetic
catgcttgctgaagcttggatcctggaccggcacttacatgtatgaccacttggcccctctctcaacatgggcca

SEQ ID NO: 135941 - DNA, 75 bp, Artificial Sequence
  Synthetic
tgctagtggggggggtccttgcagccctagcagcctactgcatgtcagtgggctgtgtagtcatctgcggcagga

SEQ ID NO: 135942 - DNA, 75 bp, Artificial Sequence
  Synthetic
tgctagtggggggggtccttgcagccctagcagcctactgcttgtcagtgggctgtgtagtcatctgcggcagga

SEQ ID NO: 135943 - DNA, 75 bp, Artificial Sequence
  Synthetic
tgctagtggggggggtccttgcagccctagcagcctactgcctgtcagtgggctgtgtagtcatctgcggcagga

SEQ ID NO: 135944 - DNA, 75 bp, Artificial Sequence
  Synthetic
tgctagtggggggggtccttgcagccctagcagcctactgcgtgtcagtgggctgtgtagtcatctgcggcagga

SEQ ID NO: 135945 - DNA, 75 bp, Artificial Sequence
  Synthetic
tatcacagcgtgtctcatgcccggccccgctggtttctgttttgcctactcctactatctgtaggggtaggcatc

SEQ ID NO: 135946 - DNA, 75 bp, Artificial Sequence
  Synthetic
ttctggcggtccgctgctatgccccatgggacacgccgccggcatattccgcgcggcggtgtgtacccgaggggt

SEQ ID NO: 135947 - DNA, 75 bp, Artificial Sequence
  Synthetic
cccgctggtttctgttttgcctactcctactatctgtaggggtaggcatctacctgctccccaaccgatgaaggg

SEQ ID NO: 135948 - DNA, 75 bp, Artificial Sequence
  Synthetic
tgacattttggacggattgcctgtctctgcccgccgcggccgcctcctcctccttggtccagctgacgatatgag

SEQ ID NO: 135949 - DNA, 75 bp, Artificial Sequence
  Synthetic
gttttgcccagggctggggccctatcagttatgccaacggaagcggccccgaccagcgcccctactgctggcact

SEQ ID NO: 135950 - DNA, 75 bp, Artificial Sequence
  Synthetic
tatcaggtcgcgcacctgcatgcaccaacaggaagtggcaagagcaccaaagtcccggcagcgtacgcagcccag

SEQ ID NO: 135951 - DNA, 75 bp, Artificial Sequence
  Synthetic
aacgaggttgagggcgaggtgcaggtgatttccacggcgactcagacctttttaggcaccaccatcaatggtgtg

SEQ ID NO: 135952 - DNA, 75 bp, Artificial Sequence
  Synthetic
gcttgcatcgccgactgcttccaccagtttcgtggtaagcggattggcgggtgcggcagtggggagtattgggct

SEQ ID NO: 135953 - DNA, 75 bp, Artificial Sequence
  Synthetic
agtttcgtggtaagcggattggcgggtgcggcagtggggagtattgggctcgggaaggtcattgtggacacccta

SEQ ID NO: 135954 - DNA, 75 bp, Artificial Sequence
  Synthetic
ggccagccccacctggcgctaagtcattgacaccttgaacttgtggcgccagcgacctctatatggtgaccagga

SEQ ID NO: 135955 - DNA, 75 bp, Artificial Sequence
  Synthetic
ggccagccccacctggcgctaagtcattgacaccttgaacttgtggcgccagcgacctctatttggtgaccagga

SEQ ID NO: 135956 - DNA, 75 bp, Artificial Sequence
  Synthetic
ggccagccccacctggcgctaagtcattgacaccttgaacttgtggcgccagcgacctctatctggtgaccagga

SEQ ID NO: 135957 - DNA, 75 bp, Artificial Sequence
  Synthetic
ggccagccccacctggcgctaagtcattgacaccttgaacttgtggcgccagcgacctctatgtggtgaccagga

SEQ ID NO: 135958 - DNA, 75 bp, Artificial Sequence
  Synthetic
ggccagccccacctggcgctatgtcattgacaccttgaacttgtggcgccagcgacctctatatggtgaccagga

SEQ ID NO: 135959 - DNA, 75 bp, Artificial Sequence
  Synthetic
ggccagccccacctggcgctatgtcattgacaccttgaacttgtggcgccagcgacctctatttggtgaccagga

SEQ ID NO: 135960 - DNA, 75 bp, Artificial Sequence
  Synthetic
ggccagccccacctggcgctatgtcattgacaccttgaacttgtggcgccagcgacctctatctggtgaccagga

SEQ ID NO: 135961 - DNA, 75 bp, Artificial Sequence
  Synthetic
ggccagccccacctggcgctatgtcattgacaccttgaacttgtggcgccagcgacctctatgtggtgaccagga

SEQ ID NO: 135962 - DNA, 75 bp, Artificial Sequence
  Synthetic
ggccagccccacctggcgctacgtcattgacaccttgaacttgtggcgccagcgacctctatatggtgaccagga

SEQ ID NO: 135963 - DNA, 75 bp, Artificial Sequence
  Synthetic
ggccagccccacctggcgctacgtcattgacaccttgaacttgtggcgccagcgacctctatttggtgaccagga

SEQ ID NO: 135964 - DNA, 75 bp, Artificial Sequence
  Synthetic
ggccagccccacctggcgctacgtcattgacaccttgaacttgtggcgccagcgacctctatctggtgaccagga

SEQ ID NO: 135965 - DNA, 75 bp, Artificial Sequence
  Synthetic
ggccagccccacctggcgctacgtcattgacaccttgaacttgtggcgccagcgacctctatgtggtgaccagga

SEQ ID NO: 135966 - DNA, 75 bp, Artificial Sequence
  Synthetic
ggccagccccacctggcgctaggtcattgacaccttgaacttgtggcgccagcgacctctatatggtgaccagga

SEQ ID NO: 135967 - DNA, 75 bp, Artificial Sequence
  Synthetic
ggccagccccacctggcgctaggtcattgacaccttgaacttgtggcgccagcgacctctatttggtgaccagga

SEQ ID NO: 135968 - DNA, 75 bp, Artificial Sequence
  Synthetic
ggccagccccacctggcgctaggtcattgacaccttgaacttgtggcgccagcgacctctatctggtgaccagga

SEQ ID NO: 135969 - DNA, 75 bp, Artificial Sequence
  Synthetic
ggccagccccacctggcgctaggtcattgacaccttgaacttgtggcgccagcgacctctatgtggtgaccagga

SEQ ID NO: 135970 - DNA, 75 bp, Artificial Sequence
  Synthetic
ggccagcccctcctggcgctaagtcattgacaccttgaacttgtggcgccagcgacctctatatggtgaccagga

SEQ ID NO: 135971 - DNA, 75 bp, Artificial Sequence
  Synthetic
ggccagcccctcctggcgctaagtcattgacaccttgaacttgtggcgccagcgacctctatttggtgaccagga

SEQ ID NO: 135972 - DNA, 75 bp, Artificial Sequence
  Synthetic
ggccagcccctcctggcgctaagtcattgacaccttgaacttgtggcgccagcgacctctatctggtgaccagga

SEQ ID NO: 135973 - DNA, 75 bp, Artificial Sequence
  Synthetic
ggccagcccctcctggcgctaagtcattgacaccttgaacttgtggcgccagcgacctctatgtggtgaccagga

SEQ ID NO: 135974 - DNA, 75 bp, Artificial Sequence
  Synthetic
ggccagcccctcctggcgctatgtcattgacaccttgaacttgtggcgccagcgacctctatatggtgaccagga

SEQ ID NO: 135975 - DNA, 75 bp, Artificial Sequence
  Synthetic
ggccagcccctcctggcgctatgtcattgacaccttgaacttgtggcgccagcgacctctatttggtgaccagga

SEQ ID NO: 135976 - DNA, 75 bp, Artificial Sequence
  Synthetic
ggccagcccctcctggcgctatgtcattgacaccttgaacttgtggcgccagcgacctctatctggtgaccagga

SEQ ID NO: 135977 - DNA, 75 bp, Artificial Sequence
  Synthetic
ggccagcccctcctggcgctatgtcattgacaccttgaacttgtggcgccagcgacctctatgtggtgaccagga

SEQ ID NO: 135978 - DNA, 75 bp, Artificial Sequence
  Synthetic
ggccagcccctcctggcgctacgtcattgacaccttgaacttgtggcgccagcgacctctatatggtgaccagga

SEQ ID NO: 135979 - DNA, 75 bp, Artificial Sequence
  Synthetic
ggccagcccctcctggcgctacgtcattgacaccttgaacttgtggcgccagcgacctctatttggtgaccagga

SEQ ID NO: 135980 - DNA, 75 bp, Artificial Sequence
  Synthetic
ggccagcccctcctggcgctacgtcattgacaccttgaacttgtggcgccagcgacctctatctggtgaccagga

SEQ ID NO: 135981 - DNA, 75 bp, Artificial Sequence
  Synthetic
ggccagcccctcctggcgctacgtcattgacaccttgaacttgtggcgccagcgacctctatgtggtgaccagga

SEQ ID NO: 135982 - DNA, 75 bp, Artificial Sequence
  Synthetic
ggccagcccctcctggcgctaggtcattgacaccttgaacttgtggcgccagcgacctctatatggtgaccagga

SEQ ID NO: 135983 - DNA, 75 bp, Artificial Sequence
  Synthetic
ggccagcccctcctggcgctaggtcattgacaccttgaacttgtggcgccagcgacctctatttggtgaccagga

SEQ ID NO: 135984 - DNA, 75 bp, Artificial Sequence
  Synthetic
ggccagcccctcctggcgctaggtcattgacaccttgaacttgtggcgccagcgacctctatctggtgaccagga

SEQ ID NO: 135985 - DNA, 75 bp, Artificial Sequence
  Synthetic
ggccagcccctcctggcgctaggtcattgacaccttgaacttgtggcgccagcgacctctatgtggtgaccagga

SEQ ID NO: 135986 - DNA, 75 bp, Artificial Sequence
  Synthetic
ggccagccccccctggcgctaagtcattgacaccttgaacttgtggcgccagcgacctctatatggtgaccagga

SEQ ID NO: 135987 - DNA, 75 bp, Artificial Sequence
  Synthetic
ggccagccccccctggcgctaagtcattgacaccttgaacttgtggcgccagcgacctctatttggtgaccagga

SEQ ID NO: 135988 - DNA, 75 bp, Artificial Sequence
  Synthetic
ggccagccccccctggcgctaagtcattgacaccttgaacttgtggcgccagcgacctctatctggtgaccagga

SEQ ID NO: 135989 - DNA, 75 bp, Artificial Sequence
  Synthetic
ggccagccccccctggcgctaagtcattgacaccttgaacttgtggcgccagcgacctctatgtggtgaccagga

SEQ ID NO: 135990 - DNA, 75 bp, Artificial Sequence
  Synthetic
ggccagccccccctggcgctatgtcattgacaccttgaacttgtggcgccagcgacctctatatggtgaccagga

SEQ ID NO: 135991 - DNA, 75 bp, Artificial Sequence
  Synthetic
ggccagccccccctggcgctatgtcattgacaccttgaacttgtggcgccagcgacctctatttggtgaccagga

SEQ ID NO: 135992 - DNA, 75 bp, Artificial Sequence
  Synthetic
ggccagccccccctggcgctatgtcattgacaccttgaacttgtggcgccagcgacctctatctggtgaccagga

SEQ ID NO: 135993 - DNA, 75 bp, Artificial Sequence
  Synthetic
ggccagccccccctggcgctatgtcattgacaccttgaacttgtggcgccagcgacctctatgtggtgaccagga

SEQ ID NO: 135994 - DNA, 75 bp, Artificial Sequence
  Synthetic
ggccagccccccctggcgctacgtcattgacaccttgaacttgtggcgccagcgacctctatatggtgaccagga

SEQ ID NO: 135995 - DNA, 75 bp, Artificial Sequence
  Synthetic
ggccagccccccctggcgctacgtcattgacaccttgaacttgtggcgccagcgacctctatttggtgaccagga

SEQ ID NO: 135996 - DNA, 75 bp, Artificial Sequence
  Synthetic
ggccagccccccctggcgctacgtcattgacaccttgaacttgtggcgccagcgacctctatctggtgaccagga

SEQ ID NO: 135997 - DNA, 75 bp, Artificial Sequence
  Synthetic
ggccagccccccctggcgctacgtcattgacaccttgaacttgtggcgccagcgacctctatgtggtgaccagga

SEQ ID NO: 135998 - DNA, 75 bp, Artificial Sequence
  Synthetic
ggccagccccccctggcgctaggtcattgacaccttgaacttgtggcgccagcgacctctatatggtgaccagga

SEQ ID NO: 135999 - DNA, 75 bp, Artificial Sequence
  Synthetic
ggccagccccccctggcgctaggtcattgacaccttgaacttgtggcgccagcgacctctatttggtgaccagga

SEQ ID NO: 136000 - DNA, 75 bp, Artificial Sequence
  Synthetic
ggccagccccccctggcgctaggtcattgacaccttgaacttgtggcgccagcgacctctatctggtgaccagga

SEQ ID NO: 136001 - DNA, 75 bp, Artificial Sequence
  Synthetic
ggccagccccccctggcgctaggtcattgacaccttgaacttgtggcgccagcgacctctatgtggtgaccagga

SEQ ID NO: 136002 - DNA, 75 bp, Artificial Sequence
  Synthetic
ggccagccccgcctggcgctaagtcattgacaccttgaacttgtggcgccagcgacctctatatggtgaccagga

SEQ ID NO: 136003 - DNA, 75 bp, Artificial Sequence
  Synthetic
ggccagccccgcctggcgctaagtcattgacaccttgaacttgtggcgccagcgacctctatttggtgaccagga

SEQ ID NO: 136004 - DNA, 75 bp, Artificial Sequence
  Synthetic
ggccagccccgcctggcgctaagtcattgacaccttgaacttgtggcgccagcgacctctatctggtgaccagga

SEQ ID NO: 136005 - DNA, 75 bp, Artificial Sequence
  Synthetic
ggccagccccgcctggcgctaagtcattgacaccttgaacttgtggcgccagcgacctctatgtggtgaccagga

SEQ ID NO: 136006 - DNA, 75 bp, Artificial Sequence
  Synthetic
ggccagccccgcctggcgctatgtcattgacaccttgaacttgtggcgccagcgacctctatatggtgaccagga

SEQ ID NO: 136007 - DNA, 75 bp, Artificial Sequence
  Synthetic
ggccagccccgcctggcgctatgtcattgacaccttgaacttgtggcgccagcgacctctatttggtgaccagga

SEQ ID NO: 136008 - DNA, 75 bp, Artificial Sequence
  Synthetic
ggccagccccgcctggcgctatgtcattgacaccttgaacttgtggcgccagcgacctctatctggtgaccagga

SEQ ID NO: 136009 - DNA, 75 bp, Artificial Sequence
  Synthetic
ggccagccccgcctggcgctatgtcattgacaccttgaacttgtggcgccagcgacctctatgtggtgaccagga

SEQ ID NO: 136010 - DNA, 75 bp, Artificial Sequence
  Synthetic
ggccagccccgcctggcgctacgtcattgacaccttgaacttgtggcgccagcgacctctatatggtgaccagga

SEQ ID NO: 136011 - DNA, 75 bp, Artificial Sequence
  Synthetic
ggccagccccgcctggcgctacgtcattgacaccttgaacttgtggcgccagcgacctctatttggtgaccagga

SEQ ID NO: 136012 - DNA, 75 bp, Artificial Sequence
  Synthetic
ggccagccccgcctggcgctacgtcattgacaccttgaacttgtggcgccagcgacctctatctggtgaccagga

SEQ ID NO: 136013 - DNA, 75 bp, Artificial Sequence
  Synthetic
ggccagccccgcctggcgctacgtcattgacaccttgaacttgtggcgccagcgacctctatgtggtgaccagga

SEQ ID NO: 136014 - DNA, 75 bp, Artificial Sequence
  Synthetic
ggccagccccgcctggcgctaggtcattgacaccttgaacttgtggcgccagcgacctctatatggtgaccagga

SEQ ID NO: 136015 - DNA, 75 bp, Artificial Sequence
  Synthetic
ggccagccccgcctggcgctaggtcattgacaccttgaacttgtggcgccagcgacctctatttggtgaccagga

SEQ ID NO: 136016 - DNA, 75 bp, Artificial Sequence
  Synthetic
ggccagccccgcctggcgctaggtcattgacaccttgaacttgtggcgccagcgacctctatctggtgaccagga

SEQ ID NO: 136017 - DNA, 75 bp, Artificial Sequence
  Synthetic
ggccagccccgcctggcgctaggtcattgacaccttgaacttgtggcgccagcgacctctatgtggtgaccagga

SEQ ID NO: 136018 - DNA, 75 bp, Artificial Sequence
  Synthetic
tattgtcacctggagccctcgtagtgggagtggtctgcgctgcaataatgcggcgacacgccggtcccaccgagg

SEQ ID NO: 136019 - DNA, 75 bp, Artificial Sequence
  Synthetic
tattgtcacctggagccctcgtagtgggagtggtctgcgctgcaataatgcggcgtcacgccggtcccaccgagg

SEQ ID NO: 136020 - DNA, 75 bp, Artificial Sequence
  Synthetic
tattgtcacctggagccctcgtagtgggagtggtctgcgctgcaataatgcggcgccacgccggtcccaccgagg

SEQ ID NO: 136021 - DNA, 75 bp, Artificial Sequence
  Synthetic
tattgtcacctggagccctcgtagtgggagtggtctgcgctgcaataatgcggcggcacgccggtcccaccgagg

SEQ ID NO: 136022 - DNA, 75 bp, Artificial Sequence
  Synthetic
tattgtcacctggagccctcgtagtgggagtggtctgcgctgcaatattgcggcgacacgccggtcccaccgagg

SEQ ID NO: 136023 - DNA, 75 bp, Artificial Sequence
  Synthetic
tattgtcacctggagccctcgtagtgggagtggtctgcgctgcaatattgcggcgtcacgccggtcccaccgagg

SEQ ID NO: 136024 - DNA, 75 bp, Artificial Sequence
  Synthetic
tattgtcacctggagccctcgtagtgggagtggtctgcgctgcaatattgcggcgccacgccggtcccaccgagg

SEQ ID NO: 136025 - DNA, 75 bp, Artificial Sequence
  Synthetic
tattgtcacctggagccctcgtagtgggagtggtctgcgctgcaatattgcggcggcacgccggtcccaccgagg

SEQ ID NO: 136026 - DNA, 75 bp, Artificial Sequence
  Synthetic
tattgtcacctggagccctcgtagtgggagtggtctgcgctgcaatactgcggcgacacgccggtcccaccgagg

SEQ ID NO: 136027 - DNA, 75 bp, Artificial Sequence
  Synthetic
tattgtcacctggagccctcgtagtgggagtggtctgcgctgcaatactgcggcgtcacgccggtcccaccgagg

SEQ ID NO: 136028 - DNA, 75 bp, Artificial Sequence
  Synthetic
tattgtcacctggagccctcgtagtgggagtggtctgcgctgcaatactgcggcgccacgccggtcccaccgagg

SEQ ID NO: 136029 - DNA, 75 bp, Artificial Sequence
  Synthetic
tattgtcacctggagccctcgtagtgggagtggtctgcgctgcaatactgcggcggcacgccggtcccaccgagg

SEQ ID NO: 136030 - DNA, 75 bp, Artificial Sequence
  Synthetic
tattgtcacctggagccctcgtagtgggagtggtctgcgctgcaatagtgcggcgacacgccggtcccaccgagg

SEQ ID NO: 136031 - DNA, 75 bp, Artificial Sequence
  Synthetic
tattgtcacctggagccctcgtagtgggagtggtctgcgctgcaatagtgcggcgtcacgccggtcccaccgagg

SEQ ID NO: 136032 - DNA, 75 bp, Artificial Sequence
  Synthetic
tattgtcacctggagccctcgtagtgggagtggtctgcgctgcaatagtgcggcgccacgccggtcccaccgagg

SEQ ID NO: 136033 - DNA, 75 bp, Artificial Sequence
  Synthetic
tattgtcacctggagccctcgtagtgggagtggtctgcgctgcaatagtgcggcggcacgccggtcccaccgagg

SEQ ID NO: 136034 - DNA, 75 bp, Artificial Sequence
  Synthetic
tattgtcacctggagccctcgtagtgggagtggtctgcgctgctataatgcggcgacacgccggtcccaccgagg

SEQ ID NO: 136035 - DNA, 75 bp, Artificial Sequence
  Synthetic
tattgtcacctggagccctcgtagtgggagtggtctgcgctgctataatgcggcgtcacgccggtcccaccgagg

SEQ ID NO: 136036 - DNA, 75 bp, Artificial Sequence
  Synthetic
tattgtcacctggagccctcgtagtgggagtggtctgcgctgctataatgcggcgccacgccggtcccaccgagg

SEQ ID NO: 136037 - DNA, 75 bp, Artificial Sequence
  Synthetic
tattgtcacctggagccctcgtagtgggagtggtctgcgctgctataatgcggcggcacgccggtcccaccgagg

SEQ ID NO: 136038 - DNA, 75 bp, Artificial Sequence
  Synthetic
tattgtcacctggagccctcgtagtgggagtggtctgcgctgctatattgcggcgacacgccggtcccaccgagg

SEQ ID NO: 136039 - DNA, 75 bp, Artificial Sequence
  Synthetic
tattgtcacctggagccctcgtagtgggagtggtctgcgctgctatattgcggcgtcacgccggtcccaccgagg

SEQ ID NO: 136040 - DNA, 75 bp, Artificial Sequence
  Synthetic
tattgtcacctggagccctcgtagtgggagtggtctgcgctgctatattgcggcgccacgccggtcccaccgagg

SEQ ID NO: 136041 - DNA, 75 bp, Artificial Sequence
  Synthetic
tattgtcacctggagccctcgtagtgggagtggtctgcgctgctatattgcggcggcacgccggtcccaccgagg

SEQ ID NO: 136042 - DNA, 75 bp, Artificial Sequence
  Synthetic
tattgtcacctggagccctcgtagtgggagtggtctgcgctgctatactgcggcgacacgccggtcccaccgagg

SEQ ID NO: 136043 - DNA, 75 bp, Artificial Sequence
  Synthetic
tattgtcacctggagccctcgtagtgggagtggtctgcgctgctatactgcggcgtcacgccggtcccaccgagg

SEQ ID NO: 136044 - DNA, 75 bp, Artificial Sequence
  Synthetic
tattgtcacctggagccctcgtagtgggagtggtctgcgctgctatactgcggcgccacgccggtcccaccgagg

SEQ ID NO: 136045 - DNA, 75 bp, Artificial Sequence
  Synthetic
tattgtcacctggagccctcgtagtgggagtggtctgcgctgctatactgcggcggcacgccggtcccaccgagg

SEQ ID NO: 136046 - DNA, 75 bp, Artificial Sequence
  Synthetic
tattgtcacctggagccctcgtagtgggagtggtctgcgctgctatagtgcggcgacacgccggtcccaccgagg

SEQ ID NO: 136047 - DNA, 75 bp, Artificial Sequence
  Synthetic
tattgtcacctggagccctcgtagtgggagtggtctgcgctgctatagtgcggcgtcacgccggtcccaccgagg

SEQ ID NO: 136048 - DNA, 75 bp, Artificial Sequence
  Synthetic
tattgtcacctggagccctcgtagtgggagtggtctgcgctgctatagtgcggcgccacgccggtcccaccgagg

SEQ ID NO: 136049 - DNA, 75 bp, Artificial Sequence
  Synthetic
tattgtcacctggagccctcgtagtgggagtggtctgcgctgctatagtgcggcggcacgccggtcccaccgagg

SEQ ID NO: 136050 - DNA, 75 bp, Artificial Sequence
  Synthetic
tattgtcacctggagccctcgtagtgggagtggtctgcgctgccataatgcggcgacacgccggtcccaccgagg

SEQ ID NO: 136051 - DNA, 75 bp, Artificial Sequence
  Synthetic
tattgtcacctggagccctcgtagtgggagtggtctgcgctgccataatgcggcgtcacgccggtcccaccgagg

SEQ ID NO: 136052 - DNA, 75 bp, Artificial Sequence
  Synthetic
tattgtcacctggagccctcgtagtgggagtggtctgcgctgccataatgcggcgccacgccggtcccaccgagg

SEQ ID NO: 136053 - DNA, 75 bp, Artificial Sequence
  Synthetic
tattgtcacctggagccctcgtagtgggagtggtctgcgctgccataatgcggcggcacgccggtcccaccgagg

SEQ ID NO: 136054 - DNA, 75 bp, Artificial Sequence
  Synthetic
tattgtcacctggagccctcgtagtgggagtggtctgcgctgccatattgcggcgacacgccggtcccaccgagg

SEQ ID NO: 136055 - DNA, 75 bp, Artificial Sequence
  Synthetic
tattgtcacctggagccctcgtagtgggagtggtctgcgctgccatattgcggcgtcacgccggtcccaccgagg

SEQ ID NO: 136056 - DNA, 75 bp, Artificial Sequence
  Synthetic
tattgtcacctggagccctcgtagtgggagtggtctgcgctgccatattgcggcgccacgccggtcccaccgagg

SEQ ID NO: 136057 - DNA, 75 bp, Artificial Sequence
  Synthetic
tattgtcacctggagccctcgtagtgggagtggtctgcgctgccatattgcggcggcacgccggtcccaccgagg

SEQ ID NO: 136058 - DNA, 75 bp, Artificial Sequence
  Synthetic
tattgtcacctggagccctcgtagtgggagtggtctgcgctgccatactgcggcgacacgccggtcccaccgagg

SEQ ID NO: 136059 - DNA, 75 bp, Artificial Sequence
  Synthetic
tattgtcacctggagccctcgtagtgggagtggtctgcgctgccatactgcggcgtcacgccggtcccaccgagg

SEQ ID NO: 136060 - DNA, 75 bp, Artificial Sequence
  Synthetic
tattgtcacctggagccctcgtagtgggagtggtctgcgctgccatactgcggcgccacgccggtcccaccgagg

SEQ ID NO: 136061 - DNA, 75 bp, Artificial Sequence
  Synthetic
tattgtcacctggagccctcgtagtgggagtggtctgcgctgccatactgcggcggcacgccggtcccaccgagg

SEQ ID NO: 136062 - DNA, 75 bp, Artificial Sequence
  Synthetic
tattgtcacctggagccctcgtagtgggagtggtctgcgctgccatagtgcggcgacacgccggtcccaccgagg

SEQ ID NO: 136063 - DNA, 75 bp, Artificial Sequence
  Synthetic
tattgtcacctggagccctcgtagtgggagtggtctgcgctgccatagtgcggcgtcacgccggtcccaccgagg

SEQ ID NO: 136064 - DNA, 75 bp, Artificial Sequence
  Synthetic
tattgtcacctggagccctcgtagtgggagtggtctgcgctgccatagtgcggcgccacgccggtcccaccgagg

SEQ ID NO: 136065 - DNA, 75 bp, Artificial Sequence
  Synthetic
tattgtcacctggagccctcgtagtgggagtggtctgcgctgccatagtgcggcggcacgccggtcccaccgagg

SEQ ID NO: 136066 - DNA, 75 bp, Artificial Sequence
  Synthetic
tattgtcacctggagccctcgtagtgggagtggtctgcgctgcgataatgcggcgacacgccggtcccaccgagg

SEQ ID NO: 136067 - DNA, 75 bp, Artificial Sequence
  Synthetic
tattgtcacctggagccctcgtagtgggagtggtctgcgctgcgataatgcggcgtcacgccggtcccaccgagg

SEQ ID NO: 136068 - DNA, 75 bp, Artificial Sequence
  Synthetic
tattgtcacctggagccctcgtagtgggagtggtctgcgctgcgataatgcggcgccacgccggtcccaccgagg

SEQ ID NO: 136069 - DNA, 75 bp, Artificial Sequence
  Synthetic
tattgtcacctggagccctcgtagtgggagtggtctgcgctgcgataatgcggcggcacgccggtcccaccgagg

SEQ ID NO: 136070 - DNA, 75 bp, Artificial Sequence
  Synthetic
tattgtcacctggagccctcgtagtgggagtggtctgcgctgcgatattgcggcgacacgccggtcccaccgagg

SEQ ID NO: 136071 - DNA, 75 bp, Artificial Sequence
  Synthetic
tattgtcacctggagccctcgtagtgggagtggtctgcgctgcgatattgcggcgtcacgccggtcccaccgagg

SEQ ID NO: 136072 - DNA, 75 bp, Artificial Sequence
  Synthetic
tattgtcacctggagccctcgtagtgggagtggtctgcgctgcgatattgcggcgccacgccggtcccaccgagg

SEQ ID NO: 136073 - DNA, 75 bp, Artificial Sequence
  Synthetic
tattgtcacctggagccctcgtagtgggagtggtctgcgctgcgatattgcggcggcacgccggtcccaccgagg

SEQ ID NO: 136074 - DNA, 75 bp, Artificial Sequence
  Synthetic
tattgtcacctggagccctcgtagtgggagtggtctgcgctgcgatactgcggcgacacgccggtcccaccgagg

SEQ ID NO: 136075 - DNA, 75 bp, Artificial Sequence
  Synthetic
tattgtcacctggagccctcgtagtgggagtggtctgcgctgcgatactgcggcgtcacgccggtcccaccgagg

SEQ ID NO: 136076 - DNA, 75 bp, Artificial Sequence
  Synthetic
tattgtcacctggagccctcgtagtgggagtggtctgcgctgcgatactgcggcgccacgccggtcccaccgagg

SEQ ID NO: 136077 - DNA, 75 bp, Artificial Sequence
  Synthetic
tattgtcacctggagccctcgtagtgggagtggtctgcgctgcgatactgcggcggcacgccggtcccaccgagg

SEQ ID NO: 136078 - DNA, 75 bp, Artificial Sequence
  Synthetic
tattgtcacctggagccctcgtagtgggagtggtctgcgctgcgatagtgcggcgacacgccggtcccaccgagg

SEQ ID NO: 136079 - DNA, 75 bp, Artificial Sequence
  Synthetic
tattgtcacctggagccctcgtagtgggagtggtctgcgctgcgatagtgcggcgtcacgccggtcccaccgagg

SEQ ID NO: 136080 - DNA, 75 bp, Artificial Sequence
  Synthetic
tattgtcacctggagccctcgtagtgggagtggtctgcgctgcgatagtgcggcgccacgccggtcccaccgagg

SEQ ID NO: 136081 - DNA, 75 bp, Artificial Sequence
  Synthetic
tattgtcacctggagccctcgtagtgggagtggtctgcgctgcgatagtgcggcggcacgccggtcccaccgagg

SEQ ID NO: 136082 - DNA, 75 bp, Artificial Sequence
  Synthetic
cagtcctggaccaagcggagaccgctggagtgcgcctcgtcgtgctcgcgaccgctaccccgccaggatcagtga

SEQ ID NO: 136083 - DNA, 75 bp, Artificial Sequence
  Synthetic
cggtcttaacggacaattcatctcccccggccgtaccgcagacattccaaataggccatctacacgcccctactg

SEQ ID NO: 136084 - DNA, 75 bp, Artificial Sequence
  Synthetic
cggtctttacggacaattcatctcccccggccgtaccgcagacattccaaataggccatctacacgcccctactg

SEQ ID NO: 136085 - DNA, 75 bp, Artificial Sequence
  Synthetic
cggtcttcacggacaattcatctcccccggccgtaccgcagacattccaaataggccatctacacgcccctactg

SEQ ID NO: 136086 - DNA, 75 bp, Artificial Sequence
  Synthetic
cggtcttgacggacaattcatctcccccggccgtaccgcagacattccaaataggccatctacacgcccctactg

SEQ ID NO: 136087 - DNA, 75 bp, Artificial Sequence
  Synthetic
tatgtgtccatcgggtcatgtggttggcctattccgcgcagctgtttgcacgcgtggcgtggcgaaagcactgga

SEQ ID NO: 136088 - DNA, 75 bp, Artificial Sequence
  Synthetic
caagtctctccaacgcactacattcctgaaacggacacatcccagaaaatcaccaacatactcagatccttaacc

SEQ ID NO: 136089 - DNA, 75 bp, Artificial Sequence
  Synthetic
caagtctctccaacgcactacattcctgaaacggacacatcccagaaaatcaccaacatactcagttccttaacc

SEQ ID NO: 136090 - DNA, 75 bp, Artificial Sequence
  Synthetic
caagtctctccaacgcactacattcctgaaacggacacatcccagaaaatcaccaacatactcagctccttaacc

SEQ ID NO: 136091 - DNA, 75 bp, Artificial Sequence
  Synthetic
caagtctctccaacgcactacattcctgaaacggacacatcccagaaaatcaccaacatactcaggtccttaacc

SEQ ID NO: 136092 - DNA, 75 bp, Artificial Sequence
  Synthetic
caagtctctccaacgcactacattcctgaaacggacacttcccagaaaatcaccaacatactcagatccttaacc

SEQ ID NO: 136093 - DNA, 75 bp, Artificial Sequence
  Synthetic
caagtctctccaacgcactacattcctgaaacggacacttcccagaaaatcaccaacatactcagttccttaacc

SEQ ID NO: 136094 - DNA, 75 bp, Artificial Sequence
  Synthetic
caagtctctccaacgcactacattcctgaaacggacacttcccagaaaatcaccaacatactcagctccttaacc

SEQ ID NO: 136095 - DNA, 75 bp, Artificial Sequence
  Synthetic
caagtctctccaacgcactacattcctgaaacggacacttcccagaaaatcaccaacatactcaggtccttaacc

SEQ ID NO: 136096 - DNA, 75 bp, Artificial Sequence
  Synthetic
caagtctctccaacgcactacattcctgaaacggacacctcccagaaaatcaccaacatactcagatccttaacc

SEQ ID NO: 136097 - DNA, 75 bp, Artificial Sequence
  Synthetic
caagtctctccaacgcactacattcctgaaacggacacctcccagaaaatcaccaacatactcagttccttaacc

SEQ ID NO: 136098 - DNA, 75 bp, Artificial Sequence
  Synthetic
caagtctctccaacgcactacattcctgaaacggacacctcccagaaaatcaccaacatactcagctccttaacc

SEQ ID NO: 136099 - DNA, 75 bp, Artificial Sequence
  Synthetic
caagtctctccaacgcactacattcctgaaacggacacctcccagaaaatcaccaacatactcaggtccttaacc

SEQ ID NO: 136100 - DNA, 75 bp, Artificial Sequence
  Synthetic
caagtctctccaacgcactacattcctgaaacggacacgtcccagaaaatcaccaacatactcagatccttaacc

SEQ ID NO: 136101 - DNA, 75 bp, Artificial Sequence
  Synthetic
caagtctctccaacgcactacattcctgaaacggacacgtcccagaaaatcaccaacatactcagttccttaacc

SEQ ID NO: 136102 - DNA, 75 bp, Artificial Sequence
  Synthetic
caagtctctccaacgcactacattcctgaaacggacacgtcccagaaaatcaccaacatactcagctccttaacc

SEQ ID NO: 136103 - DNA, 75 bp, Artificial Sequence
  Synthetic
caagtctctccaacgcactacattcctgaaacggacacgtcccagaaaatcaccaacatactcaggtccttaacc

SEQ ID NO: 136104 - DNA, 75 bp, Artificial Sequence
  Synthetic
catgtctctccaacgcactacattcctgaaacggacacatcccagaaaatcaccaacatactcagatccttaacc

SEQ ID NO: 136105 - DNA, 75 bp, Artificial Sequence
  Synthetic
catgtctctccaacgcactacattcctgaaacggacacatcccagaaaatcaccaacatactcagttccttaacc

SEQ ID NO: 136106 - DNA, 75 bp, Artificial Sequence
  Synthetic
catgtctctccaacgcactacattcctgaaacggacacatcccagaaaatcaccaacatactcagctccttaacc

SEQ ID NO: 136107 - DNA, 75 bp, Artificial Sequence
  Synthetic
catgtctctccaacgcactacattcctgaaacggacacatcccagaaaatcaccaacatactcaggtccttaacc

SEQ ID NO: 136108 - DNA, 75 bp, Artificial Sequence
  Synthetic
catgtctctccaacgcactacattcctgaaacggacacttcccagaaaatcaccaacatactcagatccttaacc

SEQ ID NO: 136109 - DNA, 75 bp, Artificial Sequence
  Synthetic
catgtctctccaacgcactacattcctgaaacggacacttcccagaaaatcaccaacatactcagttccttaacc

SEQ ID NO: 136110 - DNA, 75 bp, Artificial Sequence
  Synthetic
catgtctctccaacgcactacattcctgaaacggacacttcccagaaaatcaccaacatactcagctccttaacc

SEQ ID NO: 136111 - DNA, 75 bp, Artificial Sequence
  Synthetic
catgtctctccaacgcactacattcctgaaacggacacttcccagaaaatcaccaacatactcaggtccttaacc

SEQ ID NO: 136112 - DNA, 75 bp, Artificial Sequence
  Synthetic
catgtctctccaacgcactacattcctgaaacggacacctcccagaaaatcaccaacatactcagatccttaacc

SEQ ID NO: 136113 - DNA, 75 bp, Artificial Sequence
  Synthetic
catgtctctccaacgcactacattcctgaaacggacacctcccagaaaatcaccaacatactcagttccttaacc

SEQ ID NO: 136114 - DNA, 75 bp, Artificial Sequence
  Synthetic
catgtctctccaacgcactacattcctgaaacggacacctcccagaaaatcaccaacatactcagctccttaacc

SEQ ID NO: 136115 - DNA, 75 bp, Artificial Sequence
  Synthetic
catgtctctccaacgcactacattcctgaaacggacacctcccagaaaatcaccaacatactcaggtccttaacc

SEQ ID NO: 136116 - DNA, 75 bp, Artificial Sequence
  Synthetic
catgtctctccaacgcactacattcctgaaacggacacgtcccagaaaatcaccaacatactcagatccttaacc

SEQ ID NO: 136117 - DNA, 75 bp, Artificial Sequence
  Synthetic
catgtctctccaacgcactacattcctgaaacggacacgtcccagaaaatcaccaacatactcagttccttaacc

SEQ ID NO: 136118 - DNA, 75 bp, Artificial Sequence
  Synthetic
catgtctctccaacgcactacattcctgaaacggacacgtcccagaaaatcaccaacatactcagctccttaacc

SEQ ID NO: 136119 - DNA, 75 bp, Artificial Sequence
  Synthetic
catgtctctccaacgcactacattcctgaaacggacacgtcccagaaaatcaccaacatactcaggtccttaacc

SEQ ID NO: 136120 - DNA, 75 bp, Artificial Sequence
  Synthetic
cacgtctctccaacgcactacattcctgaaacggacacatcccagaaaatcaccaacatactcagatccttaacc

SEQ ID NO: 136121 - DNA, 75 bp, Artificial Sequence
  Synthetic
cacgtctctccaacgcactacattcctgaaacggacacatcccagaaaatcaccaacatactcagttccttaacc

SEQ ID NO: 136122 - DNA, 75 bp, Artificial Sequence
  Synthetic
cacgtctctccaacgcactacattcctgaaacggacacatcccagaaaatcaccaacatactcagctccttaacc

SEQ ID NO: 136123 - DNA, 75 bp, Artificial Sequence
  Synthetic
cacgtctctccaacgcactacattcctgaaacggacacatcccagaaaatcaccaacatactcaggtccttaacc

SEQ ID NO: 136124 - DNA, 75 bp, Artificial Sequence
  Synthetic
cacgtctctccaacgcactacattcctgaaacggacacttcccagaaaatcaccaacatactcagatccttaacc

SEQ ID NO: 136125 - DNA, 75 bp, Artificial Sequence
  Synthetic
cacgtctctccaacgcactacattcctgaaacggacacttcccagaaaatcaccaacatactcagttccttaacc

SEQ ID NO: 136126 - DNA, 75 bp, Artificial Sequence
  Synthetic
cacgtctctccaacgcactacattcctgaaacggacacttcccagaaaatcaccaacatactcagctccttaacc

SEQ ID NO: 136127 - DNA, 75 bp, Artificial Sequence
  Synthetic
cacgtctctccaacgcactacattcctgaaacggacacttcccagaaaatcaccaacatactcaggtccttaacc

SEQ ID NO: 136128 - DNA, 75 bp, Artificial Sequence
  Synthetic
cacgtctctccaacgcactacattcctgaaacggacacctcccagaaaatcaccaacatactcagatccttaacc

SEQ ID NO: 136129 - DNA, 75 bp, Artificial Sequence
  Synthetic
cacgtctctccaacgcactacattcctgaaacggacacctcccagaaaatcaccaacatactcagttccttaacc

SEQ ID NO: 136130 - DNA, 75 bp, Artificial Sequence
  Synthetic
cacgtctctccaacgcactacattcctgaaacggacacctcccagaaaatcaccaacatactcagctccttaacc

SEQ ID NO: 136131 - DNA, 75 bp, Artificial Sequence
  Synthetic
cacgtctctccaacgcactacattcctgaaacggacacctcccagaaaatcaccaacatactcaggtccttaacc

SEQ ID NO: 136132 - DNA, 75 bp, Artificial Sequence
  Synthetic
cacgtctctccaacgcactacattcctgaaacggacacgtcccagaaaatcaccaacatactcagatccttaacc

SEQ ID NO: 136133 - DNA, 75 bp, Artificial Sequence
  Synthetic
cacgtctctccaacgcactacattcctgaaacggacacgtcccagaaaatcaccaacatactcagttccttaacc

SEQ ID NO: 136134 - DNA, 75 bp, Artificial Sequence
  Synthetic
cacgtctctccaacgcactacattcctgaaacggacacgtcccagaaaatcaccaacatactcagctccttaacc

SEQ ID NO: 136135 - DNA, 75 bp, Artificial Sequence
  Synthetic
cacgtctctccaacgcactacattcctgaaacggacacgtcccagaaaatcaccaacatactcaggtccttaacc

SEQ ID NO: 136136 - DNA, 75 bp, Artificial Sequence
  Synthetic
caggtctctccaacgcactacattcctgaaacggacacatcccagaaaatcaccaacatactcagatccttaacc

SEQ ID NO: 136137 - DNA, 75 bp, Artificial Sequence
  Synthetic
caggtctctccaacgcactacattcctgaaacggacacatcccagaaaatcaccaacatactcagttccttaacc

SEQ ID NO: 136138 - DNA, 75 bp, Artificial Sequence
  Synthetic
caggtctctccaacgcactacattcctgaaacggacacatcccagaaaatcaccaacatactcagctccttaacc

SEQ ID NO: 136139 - DNA, 75 bp, Artificial Sequence
  Synthetic
caggtctctccaacgcactacattcctgaaacggacacatcccagaaaatcaccaacatactcaggtccttaacc

SEQ ID NO: 136140 - DNA, 75 bp, Artificial Sequence
  Synthetic
caggtctctccaacgcactacattcctgaaacggacacttcccagaaaatcaccaacatactcagatccttaacc

SEQ ID NO: 136141 - DNA, 75 bp, Artificial Sequence
  Synthetic
caggtctctccaacgcactacattcctgaaacggacacttcccagaaaatcaccaacatactcagttccttaacc

SEQ ID NO: 136142 - DNA, 75 bp, Artificial Sequence
  Synthetic
caggtctctccaacgcactacattcctgaaacggacacttcccagaaaatcaccaacatactcagctccttaacc

SEQ ID NO: 136143 - DNA, 75 bp, Artificial Sequence
  Synthetic
caggtctctccaacgcactacattcctgaaacggacacttcccagaaaatcaccaacatactcaggtccttaacc

SEQ ID NO: 136144 - DNA, 75 bp, Artificial Sequence
  Synthetic
caggtctctccaacgcactacattcctgaaacggacacctcccagaaaatcaccaacatactcagatccttaacc

SEQ ID NO: 136145 - DNA, 75 bp, Artificial Sequence
  Synthetic
caggtctctccaacgcactacattcctgaaacggacacctcccagaaaatcaccaacatactcagttccttaacc

SEQ ID NO: 136146 - DNA, 75 bp, Artificial Sequence
  Synthetic
caggtctctccaacgcactacattcctgaaacggacacctcccagaaaatcaccaacatactcagctccttaacc

SEQ ID NO: 136147 - DNA, 75 bp, Artificial Sequence
  Synthetic
caggtctctccaacgcactacattcctgaaacggacacctcccagaaaatcaccaacatactcaggtccttaacc

SEQ ID NO: 136148 - DNA, 75 bp, Artificial Sequence
  Synthetic
caggtctctccaacgcactacattcctgaaacggacacgtcccagaaaatcaccaacatactcagatccttaacc

SEQ ID NO: 136149 - DNA, 75 bp, Artificial Sequence
  Synthetic
caggtctctccaacgcactacattcctgaaacggacacgtcccagaaaatcaccaacatactcagttccttaacc

SEQ ID NO: 136150 - DNA, 75 bp, Artificial Sequence
  Synthetic
caggtctctccaacgcactacattcctgaaacggacacgtcccagaaaatcaccaacatactcagctccttaacc

SEQ ID NO: 136151 - DNA, 75 bp, Artificial Sequence
  Synthetic
caggtctctccaacgcactacattcctgaaacggacacgtcccagaaaatcaccaacatactcaggtccttaacc

SEQ ID NO: 136152 - DNA, 75 bp, Artificial Sequence
  Synthetic
aaaaagtgtgatgaactggccaaacaactgtcatctctcggtctaaatgctgtagcctactacagaggcttagac

SEQ ID NO: 136153 - DNA, 75 bp, Artificial Sequence
  Synthetic
ctccatgccccaacgggtagtggaaaaagcaccaaagtaccagccgcatatgcctcacagggctacaaagtctta

SEQ ID NO: 136154 - DNA, 75 bp, Artificial Sequence
  Synthetic
ctccatgccccaacgggtagtggaaaaagcaccaaagtaccagccgcatatgcctcacagggctacaaagtcttt

SEQ ID NO: 136155 - DNA, 75 bp, Artificial Sequence
  Synthetic
ctccatgccccaacgggtagtggaaaaagcaccaaagtaccagccgcatatgcctcacagggctacaaagtcttc

SEQ ID NO: 136156 - DNA, 75 bp, Artificial Sequence
  Synthetic
ctccatgccccaacgggtagtggaaaaagcaccaaagtaccagccgcatatgcctcacagggctacaaagtcttg

SEQ ID NO: 136157 - DNA, 75 bp, Artificial Sequence
  Synthetic
ctccatgccccaacgggtagtggaaaaagcaccaaagtaccagccgcatatgcctctcagggctacaaagtctta

SEQ ID NO: 136158 - DNA, 75 bp, Artificial Sequence
  Synthetic
ctccatgccccaacgggtagtggaaaaagcaccaaagtaccagccgcatatgcctctcagggctacaaagtcttt

SEQ ID NO: 136159 - DNA, 75 bp, Artificial Sequence
  Synthetic
ctccatgccccaacgggtagtggaaaaagcaccaaagtaccagccgcatatgcctctcagggctacaaagtcttc

SEQ ID NO: 136160 - DNA, 75 bp, Artificial Sequence
  Synthetic
ctccatgccccaacgggtagtggaaaaagcaccaaagtaccagccgcatatgcctctcagggctacaaagtcttg

SEQ ID NO: 136161 - DNA, 75 bp, Artificial Sequence
  Synthetic
ctccatgccccaacgggtagtggaaaaagcaccaaagtaccagccgcatatgcctcccagggctacaaagtctta

SEQ ID NO: 136162 - DNA, 75 bp, Artificial Sequence
  Synthetic
ctccatgccccaacgggtagtggaaaaagcaccaaagtaccagccgcatatgcctcccagggctacaaagtcttt

SEQ ID NO: 136163 - DNA, 75 bp, Artificial Sequence
  Synthetic
ctccatgccccaacgggtagtggaaaaagcaccaaagtaccagccgcatatgcctcccagggctacaaagtcttc

SEQ ID NO: 136164 - DNA, 75 bp, Artificial Sequence
  Synthetic
ctccatgccccaacgggtagtggaaaaagcaccaaagtaccagccgcatatgcctcccagggctacaaagtcttg

SEQ ID NO: 136165 - DNA, 75 bp, Artificial Sequence
  Synthetic
ctccatgccccaacgggtagtggaaaaagcaccaaagtaccagccgcatatgcctcgcagggctacaaagtctta

SEQ ID NO: 136166 - DNA, 75 bp, Artificial Sequence
  Synthetic
ctccatgccccaacgggtagtggaaaaagcaccaaagtaccagccgcatatgcctcgcagggctacaaagtcttt

SEQ ID NO: 136167 - DNA, 75 bp, Artificial Sequence
  Synthetic
ctccatgccccaacgggtagtggaaaaagcaccaaagtaccagccgcatatgcctcgcagggctacaaagtcttc

SEQ ID NO: 136168 - DNA, 75 bp, Artificial Sequence
  Synthetic
ctccatgccccaacgggtagtggaaaaagcaccaaagtaccagccgcatatgcctcgcagggctacaaagtcttg

SEQ ID NO: 136169 - DNA, 75 bp, Artificial Sequence
  Synthetic
ctccatgccccaacgggtagtggtaaaagcaccaaagtaccagccgcatatgcctcacagggctacaaagtctta

SEQ ID NO: 136170 - DNA, 75 bp, Artificial Sequence
  Synthetic
ctccatgccccaacgggtagtggtaaaagcaccaaagtaccagccgcatatgcctcacagggctacaaagtcttt

SEQ ID NO: 136171 - DNA, 75 bp, Artificial Sequence
  Synthetic
ctccatgccccaacgggtagtggtaaaagcaccaaagtaccagccgcatatgcctcacagggctacaaagtcttc

SEQ ID NO: 136172 - DNA, 75 bp, Artificial Sequence
  Synthetic
ctccatgccccaacgggtagtggtaaaagcaccaaagtaccagccgcatatgcctcacagggctacaaagtcttg

SEQ ID NO: 136173 - DNA, 75 bp, Artificial Sequence
  Synthetic
ctccatgccccaacgggtagtggtaaaagcaccaaagtaccagccgcatatgcctctcagggctacaaagtctta

SEQ ID NO: 136174 - DNA, 75 bp, Artificial Sequence
  Synthetic
ctccatgccccaacgggtagtggtaaaagcaccaaagtaccagccgcatatgcctctcagggctacaaagtcttt

SEQ ID NO: 136175 - DNA, 75 bp, Artificial Sequence
  Synthetic
ctccatgccccaacgggtagtggtaaaagcaccaaagtaccagccgcatatgcctctcagggctacaaagtcttc

SEQ ID NO: 136176 - DNA, 75 bp, Artificial Sequence
  Synthetic
ctccatgccccaacgggtagtggtaaaagcaccaaagtaccagccgcatatgcctctcagggctacaaagtcttg

SEQ ID NO: 136177 - DNA, 75 bp, Artificial Sequence
  Synthetic
ctccatgccccaacgggtagtggtaaaagcaccaaagtaccagccgcatatgcctcccagggctacaaagtctta

SEQ ID NO: 136178 - DNA, 75 bp, Artificial Sequence
  Synthetic
ctccatgccccaacgggtagtggtaaaagcaccaaagtaccagccgcatatgcctcccagggctacaaagtcttt

SEQ ID NO: 136179 - DNA, 75 bp, Artificial Sequence
  Synthetic
ctccatgccccaacgggtagtggtaaaagcaccaaagtaccagccgcatatgcctcccagggctacaaagtcttc

SEQ ID NO: 136180 - DNA, 75 bp, Artificial Sequence
  Synthetic
ctccatgccccaacgggtagtggtaaaagcaccaaagtaccagccgcatatgcctcccagggctacaaagtcttg

SEQ ID NO: 136181 - DNA, 75 bp, Artificial Sequence
  Synthetic
ctccatgccccaacgggtagtggtaaaagcaccaaagtaccagccgcatatgcctcgcagggctacaaagtctta

SEQ ID NO: 136182 - DNA, 75 bp, Artificial Sequence
  Synthetic
ctccatgccccaacgggtagtggtaaaagcaccaaagtaccagccgcatatgcctcgcagggctacaaagtcttt

SEQ ID NO: 136183 - DNA, 75 bp, Artificial Sequence
  Synthetic
ctccatgccccaacgggtagtggtaaaagcaccaaagtaccagccgcatatgcctcgcagggctacaaagtcttc

SEQ ID NO: 136184 - DNA, 75 bp, Artificial Sequence
  Synthetic
ctccatgccccaacgggtagtggtaaaagcaccaaagtaccagccgcatatgcctcgcagggctacaaagtcttg

SEQ ID NO: 136185 - DNA, 75 bp, Artificial Sequence
  Synthetic
ctccatgccccaacgggtagtggcaaaagcaccaaagtaccagccgcatatgcctcacagggctacaaagtctta

SEQ ID NO: 136186 - DNA, 75 bp, Artificial Sequence
  Synthetic
ctccatgccccaacgggtagtggcaaaagcaccaaagtaccagccgcatatgcctcacagggctacaaagtcttt

SEQ ID NO: 136187 - DNA, 75 bp, Artificial Sequence
  Synthetic
ctccatgccccaacgggtagtggcaaaagcaccaaagtaccagccgcatatgcctcacagggctacaaagtcttc

SEQ ID NO: 136188 - DNA, 75 bp, Artificial Sequence
  Synthetic
ctccatgccccaacgggtagtggcaaaagcaccaaagtaccagccgcatatgcctcacagggctacaaagtcttg

SEQ ID NO: 136189 - DNA, 75 bp, Artificial Sequence
  Synthetic
ctccatgccccaacgggtagtggcaaaagcaccaaagtaccagccgcatatgcctctcagggctacaaagtctta

SEQ ID NO: 136190 - DNA, 75 bp, Artificial Sequence
  Synthetic
ctccatgccccaacgggtagtggcaaaagcaccaaagtaccagccgcatatgcctctcagggctacaaagtcttt

SEQ ID NO: 136191 - DNA, 75 bp, Artificial Sequence
  Synthetic
ctccatgccccaacgggtagtggcaaaagcaccaaagtaccagccgcatatgcctctcagggctacaaagtcttc

SEQ ID NO: 136192 - DNA, 75 bp, Artificial Sequence
  Synthetic
ctccatgccccaacgggtagtggcaaaagcaccaaagtaccagccgcatatgcctctcagggctacaaagtcttg

SEQ ID NO: 136193 - DNA, 75 bp, Artificial Sequence
  Synthetic
ctccatgccccaacgggtagtggcaaaagcaccaaagtaccagccgcatatgcctcccagggctacaaagtctta

SEQ ID NO: 136194 - DNA, 75 bp, Artificial Sequence
  Synthetic
ctccatgccccaacgggtagtggcaaaagcaccaaagtaccagccgcatatgcctcccagggctacaaagtcttt

SEQ ID NO: 136195 - DNA, 75 bp, Artificial Sequence
  Synthetic
ctccatgccccaacgggtagtggcaaaagcaccaaagtaccagccgcatatgcctcccagggctacaaagtcttc

SEQ ID NO: 136196 - DNA, 75 bp, Artificial Sequence
  Synthetic
ctccatgccccaacgggtagtggcaaaagcaccaaagtaccagccgcatatgcctcccagggctacaaagtcttg

SEQ ID NO: 136197 - DNA, 75 bp, Artificial Sequence
  Synthetic
ctccatgccccaacgggtagtggcaaaagcaccaaagtaccagccgcatatgcctcgcagggctacaaagtctta

SEQ ID NO: 136198 - DNA, 75 bp, Artificial Sequence
  Synthetic
ctccatgccccaacgggtagtggcaaaagcaccaaagtaccagccgcatatgcctcgcagggctacaaagtcttt

SEQ ID NO: 136199 - DNA, 75 bp, Artificial Sequence
  Synthetic
ctccatgccccaacgggtagtggcaaaagcaccaaagtaccagccgcatatgcctcgcagggctacaaagtcttc

SEQ ID NO: 136200 - DNA, 75 bp, Artificial Sequence
  Synthetic
ctccatgccccaacgggtagtggcaaaagcaccaaagtaccagccgcatatgcctcgcagggctacaaagtcttg

SEQ ID NO: 136201 - DNA, 75 bp, Artificial Sequence
  Synthetic
ctccatgccccaacgggtagtgggaaaagcaccaaagtaccagccgcatatgcctcacagggctacaaagtctta

SEQ ID NO: 136202 - DNA, 75 bp, Artificial Sequence
  Synthetic
ctccatgccccaacgggtagtgggaaaagcaccaaagtaccagccgcatatgcctcacagggctacaaagtcttt

SEQ ID NO: 136203 - DNA, 75 bp, Artificial Sequence
  Synthetic
ctccatgccccaacgggtagtgggaaaagcaccaaagtaccagccgcatatgcctcacagggctacaaagtcttc

SEQ ID NO: 136204 - DNA, 75 bp, Artificial Sequence
  Synthetic
ctccatgccccaacgggtagtgggaaaagcaccaaagtaccagccgcatatgcctcacagggctacaaagtcttg

SEQ ID NO: 136205 - DNA, 75 bp, Artificial Sequence
  Synthetic
ctccatgccccaacgggtagtgggaaaagcaccaaagtaccagccgcatatgcctctcagggctacaaagtctta

SEQ ID NO: 136206 - DNA, 75 bp, Artificial Sequence
  Synthetic
ctccatgccccaacgggtagtgggaaaagcaccaaagtaccagccgcatatgcctctcagggctacaaagtcttt

SEQ ID NO: 136207 - DNA, 75 bp, Artificial Sequence
  Synthetic
ctccatgccccaacgggtagtgggaaaagcaccaaagtaccagccgcatatgcctctcagggctacaaagtcttc

SEQ ID NO: 136208 - DNA, 75 bp, Artificial Sequence
  Synthetic
ctccatgccccaacgggtagtgggaaaagcaccaaagtaccagccgcatatgcctctcagggctacaaagtcttg

SEQ ID NO: 136209 - DNA, 75 bp, Artificial Sequence
  Synthetic
ctccatgccccaacgggtagtgggaaaagcaccaaagtaccagccgcatatgcctcccagggctacaaagtctta

SEQ ID NO: 136210 - DNA, 75 bp, Artificial Sequence
  Synthetic
ctccatgccccaacgggtagtgggaaaagcaccaaagtaccagccgcatatgcctcccagggctacaaagtcttt

SEQ ID NO: 136211 - DNA, 75 bp, Artificial Sequence
  Synthetic
ctccatgccccaacgggtagtgggaaaagcaccaaagtaccagccgcatatgcctcccagggctacaaagtcttc

SEQ ID NO: 136212 - DNA, 75 bp, Artificial Sequence
  Synthetic
ctccatgccccaacgggtagtgggaaaagcaccaaagtaccagccgcatatgcctcccagggctacaaagtcttg

SEQ ID NO: 136213 - DNA, 75 bp, Artificial Sequence
  Synthetic
ctccatgccccaacgggtagtgggaaaagcaccaaagtaccagccgcatatgcctcgcagggctacaaagtctta

SEQ ID NO: 136214 - DNA, 75 bp, Artificial Sequence
  Synthetic
ctccatgccccaacgggtagtgggaaaagcaccaaagtaccagccgcatatgcctcgcagggctacaaagtcttt

SEQ ID NO: 136215 - DNA, 75 bp, Artificial Sequence
  Synthetic
ctccatgccccaacgggtagtgggaaaagcaccaaagtaccagccgcatatgcctcgcagggctacaaagtcttc

SEQ ID NO: 136216 - DNA, 75 bp, Artificial Sequence
  Synthetic
ctccatgccccaacgggtagtgggaaaagcaccaaagtaccagccgcatatgcctcgcagggctacaaagtcttg

SEQ ID NO: 136217 - DNA, 75 bp, Artificial Sequence
  Synthetic
cttgccgatggtggttgctctgggggcgcctatgacatcataatatgtgatgagtgccactcaactgactcgacc

SEQ ID NO: 136218 - DNA, 75 bp, Artificial Sequence
  Synthetic
ctcttaccataactagcctactcaggagactccataactggattactgaggactgccccattccatgcgccggct

SEQ ID NO: 136219 - DNA, 75 bp, Artificial Sequence
  Synthetic
caacgggaggcccaatcacataatctacatatggcaaatttatggctgaaggagggtgctccggaggcgcctatg

SEQ ID NO: 136220 - DNA, 75 bp, Artificial Sequence
  Synthetic
caacgggaggcccaatcacataatctacatatggcaaatttatggctgaaggtgggtgctccggaggcgcctatg

SEQ ID NO: 136221 - DNA, 75 bp, Artificial Sequence
  Synthetic
caacgggaggcccaatcacataatctacatatggcaaatttatggctgaaggcgggtgctccggaggcgcctatg

SEQ ID NO: 136222 - DNA, 75 bp, Artificial Sequence
  Synthetic
caacgggaggcccaatcacataatctacatatggcaaatttatggctgaaggggggtgctccggaggcgcctatg

SEQ ID NO: 136223 - DNA, 75 bp, Artificial Sequence
  Synthetic
caacgggaggcccaatcacataatctacttatggcaaatttatggctgaaggagggtgctccggaggcgcctatg

SEQ ID NO: 136224 - DNA, 75 bp, Artificial Sequence
  Synthetic
caacgggaggcccaatcacataatctacttatggcaaatttatggctgaaggtgggtgctccggaggcgcctatg

SEQ ID NO: 136225 - DNA, 75 bp, Artificial Sequence
  Synthetic
caacgggaggcccaatcacataatctacttatggcaaatttatggctgaaggcgggtgctccggaggcgcctatg

SEQ ID NO: 136226 - DNA, 75 bp, Artificial Sequence
  Synthetic
caacgggaggcccaatcacataatctacttatggcaaatttatggctgaaggggggtgctccggaggcgcctatg

SEQ ID NO: 136227 - DNA, 75 bp, Artificial Sequence
  Synthetic
caacgggaggcccaatcacataatctacctatggcaaatttatggctgaaggagggtgctccggaggcgcctatg

SEQ ID NO: 136228 - DNA, 75 bp, Artificial Sequence
  Synthetic
caacgggaggcccaatcacataatctacctatggcaaatttatggctgaaggtgggtgctccggaggcgcctatg

SEQ ID NO: 136229 - DNA, 75 bp, Artificial Sequence
  Synthetic
caacgggaggcccaatcacataatctacctatggcaaatttatggctgaaggcgggtgctccggaggcgcctatg

SEQ ID NO: 136230 - DNA, 75 bp, Artificial Sequence
  Synthetic
caacgggaggcccaatcacataatctacctatggcaaatttatggctgaaggggggtgctccggaggcgcctatg

SEQ ID NO: 136231 - DNA, 75 bp, Artificial Sequence
  Synthetic
caacgggaggcccaatcacataatctacgtatggcaaatttatggctgaaggagggtgctccggaggcgcctatg

SEQ ID NO: 136232 - DNA, 75 bp, Artificial Sequence
  Synthetic
caacgggaggcccaatcacataatctacgtatggcaaatttatggctgaaggtgggtgctccggaggcgcctatg

SEQ ID NO: 136233 - DNA, 75 bp, Artificial Sequence
  Synthetic
caacgggaggcccaatcacataatctacgtatggcaaatttatggctgaaggcgggtgctccggaggcgcctatg

SEQ ID NO: 136234 - DNA, 75 bp, Artificial Sequence
  Synthetic
caacgggaggcccaatcacataatctacgtatggcaaatttatggctgaaggggggtgctccggaggcgcctatg

SEQ ID NO: 136235 - DNA, 75 bp, Artificial Sequence
  Synthetic
caacgggaggcccaatcacatattctacatatggcaaatttatggctgaaggagggtgctccggaggcgcctatg

SEQ ID NO: 136236 - DNA, 75 bp, Artificial Sequence
  Synthetic
caacgggaggcccaatcacatattctacatatggcaaatttatggctgaaggtgggtgctccggaggcgcctatg

SEQ ID NO: 136237 - DNA, 75 bp, Artificial Sequence
  Synthetic
caacgggaggcccaatcacatattctacatatggcaaatttatggctgaaggcgggtgctccggaggcgcctatg

SEQ ID NO: 136238 - DNA, 75 bp, Artificial Sequence
  Synthetic
caacgggaggcccaatcacatattctacatatggcaaatttatggctgaaggggggtgctccggaggcgcctatg

SEQ ID NO: 136239 - DNA, 75 bp, Artificial Sequence
  Synthetic
caacgggaggcccaatcacatattctacttatggcaaatttatggctgaaggagggtgctccggaggcgcctatg

SEQ ID NO: 136240 - DNA, 75 bp, Artificial Sequence
  Synthetic
caacgggaggcccaatcacatattctacttatggcaaatttatggctgaaggtgggtgctccggaggcgcctatg

SEQ ID NO: 136241 - DNA, 75 bp, Artificial Sequence
  Synthetic
caacgggaggcccaatcacatattctacttatggcaaatttatggctgaaggcgggtgctccggaggcgcctatg

SEQ ID NO: 136242 - DNA, 75 bp, Artificial Sequence
  Synthetic
caacgggaggcccaatcacatattctacttatggcaaatttatggctgaaggggggtgctccggaggcgcctatg

SEQ ID NO: 136243 - DNA, 75 bp, Artificial Sequence
  Synthetic
caacgggaggcccaatcacatattctacctatggcaaatttatggctgaaggagggtgctccggaggcgcctatg

SEQ ID NO: 136244 - DNA, 75 bp, Artificial Sequence
  Synthetic
caacgggaggcccaatcacatattctacctatggcaaatttatggctgaaggtgggtgctccggaggcgcctatg

SEQ ID NO: 136245 - DNA, 75 bp, Artificial Sequence
  Synthetic
caacgggaggcccaatcacatattctacctatggcaaatttatggctgaaggcgggtgctccggaggcgcctatg

SEQ ID NO: 136246 - DNA, 75 bp, Artificial Sequence
  Synthetic
caacgggaggcccaatcacatattctacctatggcaaatttatggctgaaggggggtgctccggaggcgcctatg

SEQ ID NO: 136247 - DNA, 75 bp, Artificial Sequence
  Synthetic
caacgggaggcccaatcacatattctacgtatggcaaatttatggctgaaggagggtgctccggaggcgcctatg

SEQ ID NO: 136248 - DNA, 75 bp, Artificial Sequence
  Synthetic
caacgggaggcccaatcacatattctacgtatggcaaatttatggctgaaggtgggtgctccggaggcgcctatg

SEQ ID NO: 136249 - DNA, 75 bp, Artificial Sequence
  Synthetic
caacgggaggcccaatcacatattctacgtatggcaaatttatggctgaaggcgggtgctccggaggcgcctatg

SEQ ID NO: 136250 - DNA, 75 bp, Artificial Sequence
  Synthetic
caacgggaggcccaatcacatattctacgtatggcaaatttatggctgaaggggggtgctccggaggcgcctatg

SEQ ID NO: 136251 - DNA, 75 bp, Artificial Sequence
  Synthetic
caacgggaggcccaatcacatactctacatatggcaaatttatggctgaaggagggtgctccggaggcgcctatg

SEQ ID NO: 136252 - DNA, 75 bp, Artificial Sequence
  Synthetic
caacgggaggcccaatcacatactctacatatggcaaatttatggctgaaggtgggtgctccggaggcgcctatg

SEQ ID NO: 136253 - DNA, 75 bp, Artificial Sequence
  Synthetic
caacgggaggcccaatcacatactctacatatggcaaatttatggctgaaggcgggtgctccggaggcgcctatg

SEQ ID NO: 136254 - DNA, 75 bp, Artificial Sequence
  Synthetic
caacgggaggcccaatcacatactctacatatggcaaatttatggctgaaggggggtgctccggaggcgcctatg

SEQ ID NO: 136255 - DNA, 75 bp, Artificial Sequence
  Synthetic
caacgggaggcccaatcacatactctacttatggcaaatttatggctgaaggagggtgctccggaggcgcctatg

SEQ ID NO: 136256 - DNA, 75 bp, Artificial Sequence
  Synthetic
caacgggaggcccaatcacatactctacttatggcaaatttatggctgaaggtgggtgctccggaggcgcctatg

SEQ ID NO: 136257 - DNA, 75 bp, Artificial Sequence
  Synthetic
caacgggaggcccaatcacatactctacttatggcaaatttatggctgaaggcgggtgctccggaggcgcctatg

SEQ ID NO: 136258 - DNA, 75 bp, Artificial Sequence
  Synthetic
caacgggaggcccaatcacatactctacttatggcaaatttatggctgaaggggggtgctccggaggcgcctatg

SEQ ID NO: 136259 - DNA, 75 bp, Artificial Sequence
  Synthetic
caacgggaggcccaatcacatactctacctatggcaaatttatggctgaaggagggtgctccggaggcgcctatg

SEQ ID NO: 136260 - DNA, 75 bp, Artificial Sequence
  Synthetic
caacgggaggcccaatcacatactctacctatggcaaatttatggctgaaggtgggtgctccggaggcgcctatg

SEQ ID NO: 136261 - DNA, 75 bp, Artificial Sequence
  Synthetic
caacgggaggcccaatcacatactctacctatggcaaatttatggctgaaggcgggtgctccggaggcgcctatg

SEQ ID NO: 136262 - DNA, 75 bp, Artificial Sequence
  Synthetic
caacgggaggcccaatcacatactctacctatggcaaatttatggctgaaggggggtgctccggaggcgcctatg

SEQ ID NO: 136263 - DNA, 75 bp, Artificial Sequence
  Synthetic
caacgggaggcccaatcacatactctacgtatggcaaatttatggctgaaggagggtgctccggaggcgcctatg

SEQ ID NO: 136264 - DNA, 75 bp, Artificial Sequence
  Synthetic
caacgggaggcccaatcacatactctacgtatggcaaatttatggctgaaggtgggtgctccggaggcgcctatg

SEQ ID NO: 136265 - DNA, 75 bp, Artificial Sequence
  Synthetic
caacgggaggcccaatcacatactctacgtatggcaaatttatggctgaaggcgggtgctccggaggcgcctatg

SEQ ID NO: 136266 - DNA, 75 bp, Artificial Sequence
  Synthetic
caacgggaggcccaatcacatactctacgtatggcaaatttatggctgaaggggggtgctccggaggcgcctatg

SEQ ID NO: 136267 - DNA, 75 bp, Artificial Sequence
  Synthetic
caacgggaggcccaatcacatagtctacatatggcaaatttatggctgaaggagggtgctccggaggcgcctatg

SEQ ID NO: 136268 - DNA, 75 bp, Artificial Sequence
  Synthetic
caacgggaggcccaatcacatagtctacatatggcaaatttatggctgaaggtgggtgctccggaggcgcctatg

SEQ ID NO: 136269 - DNA, 75 bp, Artificial Sequence
  Synthetic
caacgggaggcccaatcacatagtctacatatggcaaatttatggctgaaggcgggtgctccggaggcgcctatg

SEQ ID NO: 136270 - DNA, 75 bp, Artificial Sequence
  Synthetic
caacgggaggcccaatcacatagtctacatatggcaaatttatggctgaaggggggtgctccggaggcgcctatg

SEQ ID NO: 136271 - DNA, 75 bp, Artificial Sequence
  Synthetic
caacgggaggcccaatcacatagtctacttatggcaaatttatggctgaaggagggtgctccggaggcgcctatg

SEQ ID NO: 136272 - DNA, 75 bp, Artificial Sequence
  Synthetic
caacgggaggcccaatcacatagtctacttatggcaaatttatggctgaaggtgggtgctccggaggcgcctatg

SEQ ID NO: 136273 - DNA, 75 bp, Artificial Sequence
  Synthetic
caacgggaggcccaatcacatagtctacttatggcaaatttatggctgaaggcgggtgctccggaggcgcctatg

SEQ ID NO: 136274 - DNA, 75 bp, Artificial Sequence
  Synthetic
caacgggaggcccaatcacatagtctacttatggcaaatttatggctgaaggggggtgctccggaggcgcctatg

SEQ ID NO: 136275 - DNA, 75 bp, Artificial Sequence
  Synthetic
caacgggaggcccaatcacatagtctacctatggcaaatttatggctgaaggagggtgctccggaggcgcctatg

SEQ ID NO: 136276 - DNA, 75 bp, Artificial Sequence
  Synthetic
caacgggaggcccaatcacatagtctacctatggcaaatttatggctgaaggtgggtgctccggaggcgcctatg

SEQ ID NO: 136277 - DNA, 75 bp, Artificial Sequence
  Synthetic
caacgggaggcccaatcacatagtctacctatggcaaatttatggctgaaggcgggtgctccggaggcgcctatg

SEQ ID NO: 136278 - DNA, 75 bp, Artificial Sequence
  Synthetic
caacgggaggcccaatcacatagtctacctatggcaaatttatggctgaaggggggtgctccggaggcgcctatg

SEQ ID NO: 136279 - DNA, 75 bp, Artificial Sequence
  Synthetic
caacgggaggcccaatcacatagtctacgtatggcaaatttatggctgaaggagggtgctccggaggcgcctatg

SEQ ID NO: 136280 - DNA, 75 bp, Artificial Sequence
  Synthetic
caacgggaggcccaatcacatagtctacgtatggcaaatttatggctgaaggtgggtgctccggaggcgcctatg

SEQ ID NO: 136281 - DNA, 75 bp, Artificial Sequence
  Synthetic
caacgggaggcccaatcacatagtctacgtatggcaaatttatggctgaaggcgggtgctccggaggcgcctatg

SEQ ID NO: 136282 - DNA, 75 bp, Artificial Sequence
  Synthetic
caacgggaggcccaatcacatagtctacgtatggcaaatttatggctgaaggggggtgctccggaggcgcctatg

SEQ ID NO: 136283 - DNA, 75 bp, Artificial Sequence
  Synthetic
gaaggtgtccggttcaagttggtgcagcaacatctggcacgggactttccccatcaacgcgaccacgactggtcc

SEQ ID NO: 136284 - DNA, 75 bp, Artificial Sequence
  Synthetic
tggcctatttctccatgcaaggagcgtgggccaaagtcattgccatcctcctcctcgtcgcgggagtggacgcaa

SEQ ID NO: 136285 - DNA, 75 bp, Artificial Sequence
  Synthetic
agtcttagccacagcaactccccacggatcagtcaccgtcccacatccaaacatcagtgaagaggcattgcctac

SEQ ID NO: 136286 - DNA, 75 bp, Artificial Sequence
  Synthetic
agtcttagccacagcaactcccctcggatcagtcaccgtcccacatccaaacatcagtgaagaggcattgcctac

SEQ ID NO: 136287 - DNA, 75 bp, Artificial Sequence
  Synthetic
agtcttagccacagcaactccccccggatcagtcaccgtcccacatccaaacatcagtgaagaggcattgcctac

SEQ ID NO: 136288 - DNA, 75 bp, Artificial Sequence
  Synthetic
agtcttagccacagcaactccccgcggatcagtcaccgtcccacatccaaacatcagtgaagaggcattgcctac

SEQ ID NO: 136289 - DNA, 75 bp, Artificial Sequence
  Synthetic
agtctttgccacagcaactccccacggatcagtcaccgtcccacatccaaacatcagtgaagaggcattgcctac

SEQ ID NO: 136290 - DNA, 75 bp, Artificial Sequence
  Synthetic
agtctttgccacagcaactcccctcggatcagtcaccgtcccacatccaaacatcagtgaagaggcattgcctac

SEQ ID NO: 136291 - DNA, 75 bp, Artificial Sequence
  Synthetic
agtctttgccacagcaactccccccggatcagtcaccgtcccacatccaaacatcagtgaagaggcattgcctac

SEQ ID NO: 136292 - DNA, 75 bp, Artificial Sequence
  Synthetic
agtctttgccacagcaactccccgcggatcagtcaccgtcccacatccaaacatcagtgaagaggcattgcctac

SEQ ID NO: 136293 - DNA, 75 bp, Artificial Sequence
  Synthetic
agtcttcgccacagcaactccccacggatcagtcaccgtcccacatccaaacatcagtgaagaggcattgcctac

SEQ ID NO: 136294 - DNA, 75 bp, Artificial Sequence
  Synthetic
agtcttcgccacagcaactcccctcggatcagtcaccgtcccacatccaaacatcagtgaagaggcattgcctac

SEQ ID NO: 136295 - DNA, 75 bp, Artificial Sequence
  Synthetic
agtcttcgccacagcaactccccccggatcagtcaccgtcccacatccaaacatcagtgaagaggcattgcctac

SEQ ID NO: 136296 - DNA, 75 bp, Artificial Sequence
  Synthetic
agtcttcgccacagcaactccccgcggatcagtcaccgtcccacatccaaacatcagtgaagaggcattgcctac

SEQ ID NO: 136297 - DNA, 75 bp, Artificial Sequence
  Synthetic
agtcttggccacagcaactccccacggatcagtcaccgtcccacatccaaacatcagtgaagaggcattgcctac

SEQ ID NO: 136298 - DNA, 75 bp, Artificial Sequence
  Synthetic
agtcttggccacagcaactcccctcggatcagtcaccgtcccacatccaaacatcagtgaagaggcattgcctac

SEQ ID NO: 136299 - DNA, 75 bp, Artificial Sequence
  Synthetic
agtcttggccacagcaactccccccggatcagtcaccgtcccacatccaaacatcagtgaagaggcattgcctac

SEQ ID NO: 136300 - DNA, 75 bp, Artificial Sequence
  Synthetic
agtcttggccacagcaactccccgcggatcagtcaccgtcccacatccaaacatcagtgaagaggcattgcctac

SEQ ID NO: 136301 - DNA, 75 bp, Artificial Sequence
  Synthetic
acgggtaggggatagtcatttcgcggtgggcgctactaaggacgacctgaagtgcccatgccaggtccctgctcc

SEQ ID NO: 136302 - DNA, 75 bp, Artificial Sequence
  Synthetic
agaacgcatggccagctgccagtccattgataagtttgttcagggatggggtcccatcacctacgctgagaatgg

SEQ ID NO: 136303 - DNA, 75 bp, Artificial Sequence
  Synthetic
ctggcgggccagttacgatcccttggcctgaacgctgtagcattttataggggcattgacgtggcagtaattcca

SEQ ID NO: 136304 - DNA, 75 bp, Artificial Sequence
  Synthetic
ccttctccagagtttttttcctgggtggacggagtgcaaatccataggtttgctcccacaccaaagccgtttttc

SEQ ID NO: 136305 - DNA, 75 bp, Artificial Sequence
  Synthetic
ttaaggccacgtgcacgacgcacagccctcaccctgacgctgagatgattgaggcgaatctgttgtggaggcagg

SEQ ID NO: 136306 - DNA, 75 bp, Artificial Sequence
  Synthetic
tggtcgatttcagccttgaccccacctttaccattgagacaaccactgtcccccaggacgccgtctctcggagtc

SEQ ID NO: 136307 - DNA, 75 bp, Artificial Sequence
  Synthetic
ggtgccagctgaatgccatcggccgaataggccgaaatatccaccggcattgcccatttgggccagacctgacta

SEQ ID NO: 136308 - DNA, 75 bp, Artificial Sequence
  Synthetic
ggcgtacgatgttgggtgcgcatggttagaactgacaccatctgaaacaacagttagactacgcacgtaccttaa

SEQ ID NO: 136309 - DNA, 75 bp, Artificial Sequence
  Synthetic
ggcgtacgatgttgggtgcgcatggttagaactgacaccatctgaaacaacagttagactacgctcgtaccttaa

SEQ ID NO: 136310 - DNA, 75 bp, Artificial Sequence
  Synthetic
ggcgtacgatgttgggtgcgcatggttagaactgacaccatctgaaacaacagttagactacgcccgtaccttaa

SEQ ID NO: 136311 - DNA, 75 bp, Artificial Sequence
  Synthetic
ggcgtacgatgttgggtgcgcatggttagaactgacaccatctgaaacaacagttagactacgcgcgtaccttaa

SEQ ID NO: 136312 - DNA, 75 bp, Artificial Sequence
  Synthetic
ggcgtacgatgttgggtgcgcatggttagaactgacaccatctgaaacaacagttagacttcgcacgtaccttaa

SEQ ID NO: 136313 - DNA, 75 bp, Artificial Sequence
  Synthetic
ggcgtacgatgttgggtgcgcatggttagaactgacaccatctgaaacaacagttagacttcgctcgtaccttaa

SEQ ID NO: 136314 - DNA, 75 bp, Artificial Sequence
  Synthetic
ggcgtacgatgttgggtgcgcatggttagaactgacaccatctgaaacaacagttagacttcgcccgtaccttaa

SEQ ID NO: 136315 - DNA, 75 bp, Artificial Sequence
  Synthetic
ggcgtacgatgttgggtgcgcatggttagaactgacaccatctgaaacaacagttagacttcgcgcgtaccttaa

SEQ ID NO: 136316 - DNA, 75 bp, Artificial Sequence
  Synthetic
ggcgtacgatgttgggtgcgcatggttagaactgacaccatctgaaacaacagttagactccgcacgtaccttaa

SEQ ID NO: 136317 - DNA, 75 bp, Artificial Sequence
  Synthetic
ggcgtacgatgttgggtgcgcatggttagaactgacaccatctgaaacaacagttagactccgctcgtaccttaa

SEQ ID NO: 136318 - DNA, 75 bp, Artificial Sequence
  Synthetic
ggcgtacgatgttgggtgcgcatggttagaactgacaccatctgaaacaacagttagactccgcccgtaccttaa

SEQ ID NO: 136319 - DNA, 75 bp, Artificial Sequence
  Synthetic
ggcgtacgatgttgggtgcgcatggttagaactgacaccatctgaaacaacagttagactccgcgcgtaccttaa

SEQ ID NO: 136320 - DNA, 75 bp, Artificial Sequence
  Synthetic
ggcgtacgatgttgggtgcgcatggttagaactgacaccatctgaaacaacagttagactgcgcacgtaccttaa

SEQ ID NO: 136321 - DNA, 75 bp, Artificial Sequence
  Synthetic
ggcgtacgatgttgggtgcgcatggttagaactgacaccatctgaaacaacagttagactgcgctcgtaccttaa

SEQ ID NO: 136322 - DNA, 75 bp, Artificial Sequence
  Synthetic
ggcgtacgatgttgggtgcgcatggttagaactgacaccatctgaaacaacagttagactgcgcccgtaccttaa

SEQ ID NO: 136323 - DNA, 75 bp, Artificial Sequence
  Synthetic
ggcgtacgatgttgggtgcgcatggttagaactgacaccatctgaaacaacagttagactgcgcgcgtaccttaa

SEQ ID NO: 136324 - DNA, 75 bp, Artificial Sequence
  Synthetic
ggcgtacgatgttgggtgcgcatggttagaactgacaccatctgaaacaacagttagtctacgcacgtaccttaa

SEQ ID NO: 136325 - DNA, 75 bp, Artificial Sequence
  Synthetic
ggcgtacgatgttgggtgcgcatggttagaactgacaccatctgaaacaacagttagtctacgctcgtaccttaa

SEQ ID NO: 136326 - DNA, 75 bp, Artificial Sequence
  Synthetic
ggcgtacgatgttgggtgcgcatggttagaactgacaccatctgaaacaacagttagtctacgcccgtaccttaa

SEQ ID NO: 136327 - DNA, 75 bp, Artificial Sequence
  Synthetic
ggcgtacgatgttgggtgcgcatggttagaactgacaccatctgaaacaacagttagtctacgcgcgtaccttaa

SEQ ID NO: 136328 - DNA, 75 bp, Artificial Sequence
  Synthetic
ggcgtacgatgttgggtgcgcatggttagaactgacaccatctgaaacaacagttagtcttcgcacgtaccttaa

SEQ ID NO: 136329 - DNA, 75 bp, Artificial Sequence
  Synthetic
ggcgtacgatgttgggtgcgcatggttagaactgacaccatctgaaacaacagttagtcttcgctcgtaccttaa

SEQ ID NO: 136330 - DNA, 75 bp, Artificial Sequence
  Synthetic
ggcgtacgatgttgggtgcgcatggttagaactgacaccatctgaaacaacagttagtcttcgcccgtaccttaa

SEQ ID NO: 136331 - DNA, 75 bp, Artificial Sequence
  Synthetic
ggcgtacgatgttgggtgcgcatggttagaactgacaccatctgaaacaacagttagtcttcgcgcgtaccttaa

SEQ ID NO: 136332 - DNA, 75 bp, Artificial Sequence
  Synthetic
ggcgtacgatgttgggtgcgcatggttagaactgacaccatctgaaacaacagttagtctccgcacgtaccttaa

SEQ ID NO: 136333 - DNA, 75 bp, Artificial Sequence
  Synthetic
ggcgtacgatgttgggtgcgcatggttagaactgacaccatctgaaacaacagttagtctccgctcgtaccttaa

SEQ ID NO: 136334 - DNA, 75 bp, Artificial Sequence
  Synthetic
ggcgtacgatgttgggtgcgcatggttagaactgacaccatctgaaacaacagttagtctccgcccgtaccttaa

SEQ ID NO: 136335 - DNA, 75 bp, Artificial Sequence
  Synthetic
ggcgtacgatgttgggtgcgcatggttagaactgacaccatctgaaacaacagttagtctccgcgcgtaccttaa

SEQ ID NO: 136336 - DNA, 75 bp, Artificial Sequence
  Synthetic
ggcgtacgatgttgggtgcgcatggttagaactgacaccatctgaaacaacagttagtctgcgcacgtaccttaa

SEQ ID NO: 136337 - DNA, 75 bp, Artificial Sequence
  Synthetic
ggcgtacgatgttgggtgcgcatggttagaactgacaccatctgaaacaacagttagtctgcgctcgtaccttaa

SEQ ID NO: 136338 - DNA, 75 bp, Artificial Sequence
  Synthetic
ggcgtacgatgttgggtgcgcatggttagaactgacaccatctgaaacaacagttagtctgcgcccgtaccttaa

SEQ ID NO: 136339 - DNA, 75 bp, Artificial Sequence
  Synthetic
ggcgtacgatgttgggtgcgcatggttagaactgacaccatctgaaacaacagttagtctgcgcgcgtaccttaa

SEQ ID NO: 136340 - DNA, 75 bp, Artificial Sequence
  Synthetic
ggcgtacgatgttgggtgcgcatggttagaactgacaccatctgaaacaacagttagcctacgcacgtaccttaa

SEQ ID NO: 136341 - DNA, 75 bp, Artificial Sequence
  Synthetic
ggcgtacgatgttgggtgcgcatggttagaactgacaccatctgaaacaacagttagcctacgctcgtaccttaa

SEQ ID NO: 136342 - DNA, 75 bp, Artificial Sequence
  Synthetic
ggcgtacgatgttgggtgcgcatggttagaactgacaccatctgaaacaacagttagcctacgcccgtaccttaa

SEQ ID NO: 136343 - DNA, 75 bp, Artificial Sequence
  Synthetic
ggcgtacgatgttgggtgcgcatggttagaactgacaccatctgaaacaacagttagcctacgcgcgtaccttaa

SEQ ID NO: 136344 - DNA, 75 bp, Artificial Sequence
  Synthetic
ggcgtacgatgttgggtgcgcatggttagaactgacaccatctgaaacaacagttagccttcgcacgtaccttaa

SEQ ID NO: 136345 - DNA, 75 bp, Artificial Sequence
  Synthetic
ggcgtacgatgttgggtgcgcatggttagaactgacaccatctgaaacaacagttagccttcgctcgtaccttaa

SEQ ID NO: 136346 - DNA, 75 bp, Artificial Sequence
  Synthetic
ggcgtacgatgttgggtgcgcatggttagaactgacaccatctgaaacaacagttagccttcgcccgtaccttaa

SEQ ID NO: 136347 - DNA, 75 bp, Artificial Sequence
  Synthetic
ggcgtacgatgttgggtgcgcatggttagaactgacaccatctgaaacaacagttagccttcgcgcgtaccttaa

SEQ ID NO: 136348 - DNA, 75 bp, Artificial Sequence
  Synthetic
ggcgtacgatgttgggtgcgcatggttagaactgacaccatctgaaacaacagttagcctccgcacgtaccttaa

SEQ ID NO: 136349 - DNA, 75 bp, Artificial Sequence
  Synthetic
ggcgtacgatgttgggtgcgcatggttagaactgacaccatctgaaacaacagttagcctccgctcgtaccttaa

SEQ ID NO: 136350 - DNA, 75 bp, Artificial Sequence
  Synthetic
ggcgtacgatgttgggtgcgcatggttagaactgacaccatctgaaacaacagttagcctccgcccgtaccttaa

SEQ ID NO: 136351 - DNA, 75 bp, Artificial Sequence
  Synthetic
ggcgtacgatgttgggtgcgcatggttagaactgacaccatctgaaacaacagttagcctccgcgcgtaccttaa

SEQ ID NO: 136352 - DNA, 75 bp, Artificial Sequence
  Synthetic
ggcgtacgatgttgggtgcgcatggttagaactgacaccatctgaaacaacagttagcctgcgcacgtaccttaa

SEQ ID NO: 136353 - DNA, 75 bp, Artificial Sequence
  Synthetic
ggcgtacgatgttgggtgcgcatggttagaactgacaccatctgaaacaacagttagcctgcgctcgtaccttaa

SEQ ID NO: 136354 - DNA, 75 bp, Artificial Sequence
  Synthetic
ggcgtacgatgttgggtgcgcatggttagaactgacaccatctgaaacaacagttagcctgcgcccgtaccttaa

SEQ ID NO: 136355 - DNA, 75 bp, Artificial Sequence
  Synthetic
ggcgtacgatgttgggtgcgcatggttagaactgacaccatctgaaacaacagttagcctgcgcgcgtaccttaa

SEQ ID NO: 136356 - DNA, 75 bp, Artificial Sequence
  Synthetic
ggcgtacgatgttgggtgcgcatggttagaactgacaccatctgaaacaacagttaggctacgcacgtaccttaa

SEQ ID NO: 136357 - DNA, 75 bp, Artificial Sequence
  Synthetic
ggcgtacgatgttgggtgcgcatggttagaactgacaccatctgaaacaacagttaggctacgctcgtaccttaa

SEQ ID NO: 136358 - DNA, 75 bp, Artificial Sequence
  Synthetic
ggcgtacgatgttgggtgcgcatggttagaactgacaccatctgaaacaacagttaggctacgcccgtaccttaa

SEQ ID NO: 136359 - DNA, 75 bp, Artificial Sequence
  Synthetic
ggcgtacgatgttgggtgcgcatggttagaactgacaccatctgaaacaacagttaggctacgcgcgtaccttaa

SEQ ID NO: 136360 - DNA, 75 bp, Artificial Sequence
  Synthetic
ggcgtacgatgttgggtgcgcatggttagaactgacaccatctgaaacaacagttaggcttcgcacgtaccttaa

SEQ ID NO: 136361 - DNA, 75 bp, Artificial Sequence
  Synthetic
ggcgtacgatgttgggtgcgcatggttagaactgacaccatctgaaacaacagttaggcttcgctcgtaccttaa

SEQ ID NO: 136362 - DNA, 75 bp, Artificial Sequence
  Synthetic
ggcgtacgatgttgggtgcgcatggttagaactgacaccatctgaaacaacagttaggcttcgcccgtaccttaa

SEQ ID NO: 136363 - DNA, 75 bp, Artificial Sequence
  Synthetic
ggcgtacgatgttgggtgcgcatggttagaactgacaccatctgaaacaacagttaggcttcgcgcgtaccttaa

SEQ ID NO: 136364 - DNA, 75 bp, Artificial Sequence
  Synthetic
ggcgtacgatgttgggtgcgcatggttagaactgacaccatctgaaacaacagttaggctccgcacgtaccttaa

SEQ ID NO: 136365 - DNA, 75 bp, Artificial Sequence
  Synthetic
ggcgtacgatgttgggtgcgcatggttagaactgacaccatctgaaacaacagttaggctccgctcgtaccttaa

SEQ ID NO: 136366 - DNA, 75 bp, Artificial Sequence
  Synthetic
ggcgtacgatgttgggtgcgcatggttagaactgacaccatctgaaacaacagttaggctccgcccgtaccttaa

SEQ ID NO: 136367 - DNA, 75 bp, Artificial Sequence
  Synthetic
ggcgtacgatgttgggtgcgcatggttagaactgacaccatctgaaacaacagttaggctccgcgcgtaccttaa

SEQ ID NO: 136368 - DNA, 75 bp, Artificial Sequence
  Synthetic
ggcgtacgatgttgggtgcgcatggttagaactgacaccatctgaaacaacagttaggctgcgcacgtaccttaa

SEQ ID NO: 136369 - DNA, 75 bp, Artificial Sequence
  Synthetic
ggcgtacgatgttgggtgcgcatggttagaactgacaccatctgaaacaacagttaggctgcgctcgtaccttaa

SEQ ID NO: 136370 - DNA, 75 bp, Artificial Sequence
  Synthetic
ggcgtacgatgttgggtgcgcatggttagaactgacaccatctgaaacaacagttaggctgcgcccgtaccttaa

SEQ ID NO: 136371 - DNA, 75 bp, Artificial Sequence
  Synthetic
ggcgtacgatgttgggtgcgcatggttagaactgacaccatctgaaacaacagttaggctgcgcgcgtaccttaa

SEQ ID NO: 136372 - DNA, 75 bp, Artificial Sequence
  Synthetic
ccgcggcggaagagggtagtgcagctcgacgattccaacgtgtcggctgtgcttgctcagttggccgagaaaacc

SEQ ID NO: 136373 - DNA, 75 bp, Artificial Sequence
  Synthetic
cagggaggggaaaatttcgcatacctcgtagcttatcaggccactgtgtgtgcgcgagcaaaagcaccccccccc

SEQ ID NO: 136374 - DNA, 75 bp, Artificial Sequence
  Synthetic
cagggaggggaaaatttcgcatacctcgtagcttatcaggccactgtgtgtgcgcgagcaaaagctccccccccc

SEQ ID NO: 136375 - DNA, 75 bp, Artificial Sequence
  Synthetic
cagggaggggaaaatttcgcatacctcgtagcttatcaggccactgtgtgtgcgcgagcaaaagccccccccccc

SEQ ID NO: 136376 - DNA, 75 bp, Artificial Sequence
  Synthetic
cagggaggggaaaatttcgcatacctcgtagcttatcaggccactgtgtgtgcgcgagcaaaagcgccccccccc

SEQ ID NO: 136377 - DNA, 75 bp, Artificial Sequence
  Synthetic
cagggaggggaaaatttcgcatacctcgtagcttatcaggccactgtgtgtgcgcgagctaaagcaccccccccc

SEQ ID NO: 136378 - DNA, 75 bp, Artificial Sequence
  Synthetic
cagggaggggaaaatttcgcatacctcgtagcttatcaggccactgtgtgtgcgcgagctaaagctccccccccc

SEQ ID NO: 136379 - DNA, 75 bp, Artificial Sequence
  Synthetic
cagggaggggaaaatttcgcatacctcgtagcttatcaggccactgtgtgtgcgcgagctaaagccccccccccc

SEQ ID NO: 136380 - DNA, 75 bp, Artificial Sequence
  Synthetic
cagggaggggaaaatttcgcatacctcgtagcttatcaggccactgtgtgtgcgcgagctaaagcgccccccccc

SEQ ID NO: 136381 - DNA, 75 bp, Artificial Sequence
  Synthetic
cagggaggggaaaatttcgcatacctcgtagcttatcaggccactgtgtgtgcgcgagccaaagcaccccccccc

SEQ ID NO: 136382 - DNA, 75 bp, Artificial Sequence
  Synthetic
cagggaggggaaaatttcgcatacctcgtagcttatcaggccactgtgtgtgcgcgagccaaagctccccccccc

SEQ ID NO: 136383 - DNA, 75 bp, Artificial Sequence
  Synthetic
cagggaggggaaaatttcgcatacctcgtagcttatcaggccactgtgtgtgcgcgagccaaagccccccccccc

SEQ ID NO: 136384 - DNA, 75 bp, Artificial Sequence
  Synthetic
cagggaggggaaaatttcgcatacctcgtagcttatcaggccactgtgtgtgcgcgagccaaagcgccccccccc

SEQ ID NO: 136385 - DNA, 75 bp, Artificial Sequence
  Synthetic
cagggaggggaaaatttcgcatacctcgtagcttatcaggccactgtgtgtgcgcgagcgaaagcaccccccccc

SEQ ID NO: 136386 - DNA, 75 bp, Artificial Sequence
  Synthetic
cagggaggggaaaatttcgcatacctcgtagcttatcaggccactgtgtgtgcgcgagcgaaagctccccccccc

SEQ ID NO: 136387 - DNA, 75 bp, Artificial Sequence
  Synthetic
cagggaggggaaaatttcgcatacctcgtagcttatcaggccactgtgtgtgcgcgagcgaaagccccccccccc

SEQ ID NO: 136388 - DNA, 75 bp, Artificial Sequence
  Synthetic
cagggaggggaaaatttcgcatacctcgtagcttatcaggccactgtgtgtgcgcgagcgaaagcgccccccccc

SEQ ID NO: 136389 - DNA, 75 bp, Artificial Sequence
  Synthetic
cctcatgtcttttactgccgccgttacaagccctctgaccacccagcaaaccctccttttcaacatcttgggggg

SEQ ID NO: 136390 - DNA, 75 bp, Artificial Sequence
  Synthetic
aggctggctcttacagttccatgccgccccttgagggcgagccaggagatcctgaccttagttctggatcctggt

SEQ ID NO: 136391 - DNA, 75 bp, Artificial Sequence
  Synthetic
ccaccacacaccccatcaccaagtacatcatgacctgcatgtcagcagacctggaagtcattaccagcacttggg

SEQ ID NO: 136392 - DNA, 75 bp, Artificial Sequence
  Synthetic
gagcaccataggagatgctctccagcagctggccatcaagaccttcggccagcccccctcaaccggtgactcagg

SEQ ID NO: 136393 - DNA, 75 bp, Artificial Sequence
  Synthetic
tgagcggtttggcgggggcggcaatcggcagcgtgggccttggcaagatcttagtggacattctcgccggctacg

SEQ ID NO: 136394 - DNA, 75 bp, Artificial Sequence
  Synthetic
ccacggtcagtgaggagggcgacagcgtggtatgctgctcgtactcctatagctggacaggggcactcattacac

SEQ ID NO: 136395 - DNA, 75 bp, Artificial Sequence
  Synthetic
aatgcctgaccgggaggtgctctatcgggccttcgacgagatggaggagtgctcacagcgcatcccatacctcgt

SEQ ID NO: 136396 - DNA, 75 bp, Artificial Sequence
  Synthetic
tgggcccgggcgaaggggctgtgcagtggatgaaccgtttaattgcgttcgcatcgcgaggcaatcacgtgtctc

SEQ ID NO: 136397 - DNA, 75 bp, Artificial Sequence
  Synthetic
ttcacggcggcctggtacttaaagggtagggtggtccccatggccacgtactctattctcggcctgtggtccttt

SEQ ID NO: 136398 - DNA, 75 bp, Artificial Sequence
  Synthetic
gcctggcctaagcttgaagaattctggaggaagcacttttggaacttcgtcagcgggatacaatacctggccggt

SEQ ID NO: 136399 - DNA, 75 bp, Artificial Sequence
  Synthetic
tttgcctccagaggaaaccatgttgcccctacccactacgtggcggagtccgacgcctcacagcgcgtgacgcag

SEQ ID NO: 136400 - DNA, 75 bp, Artificial Sequence
  Synthetic
gggactgggtctgcaccgtactgagtgacttcaaaacgtggctaaaggccaagctgctgcctctcatgccaggcg

SEQ ID NO: 136401 - DNA, 75 bp, Artificial Sequence
  Synthetic
tcttgggggggtgggttgcatctcagcttgcaccaccatctgcctccacggcatttgttgtgagtgggctggccg

SEQ ID NO: 136402 - DNA, 75 bp, Artificial Sequence
  Synthetic
gggatcatctgggtggttgtcatcctacacccacgccttgtgttcgaggtcacgaaatggttattagcaattctg

SEQ ID NO: 136403 - DNA, 75 bp, Artificial Sequence
  Synthetic
acccaaacagcgagtggaacgcttgctcaagatgtggaaatctaagaaaaccccgatggggttctcctaagacac

SEQ ID NO: 136404 - DNA, 75 bp, Artificial Sequence
  Synthetic
acccaaacagcgagtggaacgcttgctcaagatgtggaaatctaagaaaaccccgatggggttctcctatgacac

SEQ ID NO: 136405 - DNA, 75 bp, Artificial Sequence
  Synthetic
acccaaacagcgagtggaacgcttgctcaagatgtggaaatctaagaaaaccccgatggggttctcctacgacac

SEQ ID NO: 136406 - DNA, 75 bp, Artificial Sequence
  Synthetic
acccaaacagcgagtggaacgcttgctcaagatgtggaaatctaagaaaaccccgatggggttctcctaggacac

SEQ ID NO: 136407 - DNA, 75 bp, Artificial Sequence
  Synthetic
gagcggcgaagctcccgccttagaggacatggtcaacctactacccgccttactttcacctggggccctggtcgt

SEQ ID NO: 136408 - DNA, 75 bp, Artificial Sequence
  Synthetic
tctctcaccgagaggctgtacgttggaggccccatgtacaactcaaagggccaactctgtggtcagcgcaggtgc

SEQ ID NO: 136409 - DNA, 75 bp, Artificial Sequence
  Synthetic
catgtctcgccgacgcattatgtgcctgaaacagacgcctcccgtgcagtgaccaacatactcagttccctcact

SEQ ID NO: 136410 - DNA, 75 bp, Artificial Sequence
  Synthetic
ttctcttgggtggacggggtgcaaatacaccgattcgcccccactccaggtcccttctttcgggatgaggtgacg

SEQ ID NO: 136411 - DNA, 75 bp, Artificial Sequence
  Synthetic
cggttctagctgacttcgagacatggataaaggcgaagctcgtacccgctttgccgggcgtcccgtttttctcgt

SEQ ID NO: 136412 - DNA, 75 bp, Artificial Sequence
  Synthetic
gaagatcgtgggtcctaagacttgtagcaatgtgtggcgcggcacctttcccatcaatgccactacgacaggccc

SEQ ID NO: 136413 - DNA, 75 bp, Artificial Sequence
  Synthetic
acgctccggcgtgcaaacctctcctgcgggatgaggtcacattccaggtcgggctcaaccaatacctggttgggt

SEQ ID NO: 136414 - DNA, 75 bp, Artificial Sequence
  Synthetic
cagtcacgcccctttcccgagcagcatgggagactgcacggcacactccagtaaattcgtggctgggaaacatca

SEQ ID NO: 136415 - DNA, 75 bp, Artificial Sequence
  Synthetic
cagtcacgcccctttcccgagcagcatgggagactgctcggcacactccagtaaattcgtggctgggaaacatca

SEQ ID NO: 136416 - DNA, 75 bp, Artificial Sequence
  Synthetic
cagtcacgcccctttcccgagcagcatgggagactgcccggcacactccagtaaattcgtggctgggaaacatca

SEQ ID NO: 136417 - DNA, 75 bp, Artificial Sequence
  Synthetic
cagtcacgcccctttcccgagcagcatgggagactgcgcggcacactccagtaaattcgtggctgggaaacatca

SEQ ID NO: 136418 - DNA, 75 bp, Artificial Sequence
  Synthetic
cagtcacgcccctttcccgagcagcttgggagactgcacggcacactccagtaaattcgtggctgggaaacatca

SEQ ID NO: 136419 - DNA, 75 bp, Artificial Sequence
  Synthetic
cagtcacgcccctttcccgagcagcttgggagactgctcggcacactccagtaaattcgtggctgggaaacatca

SEQ ID NO: 136420 - DNA, 75 bp, Artificial Sequence
  Synthetic
cagtcacgcccctttcccgagcagcttgggagactgcccggcacactccagtaaattcgtggctgggaaacatca

SEQ ID NO: 136421 - DNA, 75 bp, Artificial Sequence
  Synthetic
cagtcacgcccctttcccgagcagcttgggagactgcgcggcacactccagtaaattcgtggctgggaaacatca

SEQ ID NO: 136422 - DNA, 75 bp, Artificial Sequence
  Synthetic
cagtcacgcccctttcccgagcagcctgggagactgcacggcacactccagtaaattcgtggctgggaaacatca

SEQ ID NO: 136423 - DNA, 75 bp, Artificial Sequence
  Synthetic
cagtcacgcccctttcccgagcagcctgggagactgctcggcacactccagtaaattcgtggctgggaaacatca

SEQ ID NO: 136424 - DNA, 75 bp, Artificial Sequence
  Synthetic
cagtcacgcccctttcccgagcagcctgggagactgcccggcacactccagtaaattcgtggctgggaaacatca

SEQ ID NO: 136425 - DNA, 75 bp, Artificial Sequence
  Synthetic
cagtcacgcccctttcccgagcagcctgggagactgcgcggcacactccagtaaattcgtggctgggaaacatca

SEQ ID NO: 136426 - DNA, 75 bp, Artificial Sequence
  Synthetic
cagtcacgcccctttcccgagcagcgtgggagactgcacggcacactccagtaaattcgtggctgggaaacatca

SEQ ID NO: 136427 - DNA, 75 bp, Artificial Sequence
  Synthetic
cagtcacgcccctttcccgagcagcgtgggagactgctcggcacactccagtaaattcgtggctgggaaacatca

SEQ ID NO: 136428 - DNA, 75 bp, Artificial Sequence
  Synthetic
cagtcacgcccctttcccgagcagcgtgggagactgcccggcacactccagtaaattcgtggctgggaaacatca

SEQ ID NO: 136429 - DNA, 75 bp, Artificial Sequence
  Synthetic
cagtcacgcccctttcccgagcagcgtgggagactgcgcggcacactccagtaaattcgtggctgggaaacatca

SEQ ID NO: 136430 - DNA, 75 bp, Artificial Sequence
  Synthetic
gtggcggccacatctgacaacctaaagtgtccatgccaggtcccatcgccggagttcttcactgaggtcgacggg

SEQ ID NO: 136431 - DNA, 75 bp, Artificial Sequence
  Synthetic
tggaagcagcaggactacaaacctccgaccgtccacgggtgcgctttaccccccagtaagcaaccccccgtccct

SEQ ID NO: 136432 - DNA, 75 bp, Artificial Sequence
  Synthetic
catatacggagtcacttattcaatcactccgcttgatctcccagcaattatccaaagactccacggcatggccgc

SEQ ID NO: 136433 - DNA, 75 bp, Artificial Sequence
  Synthetic
tgtggccaaatctatcgacttcatccctgtcgaatctctcgatatcgccgcacggacgcccagtttctctgacaa

SEQ ID NO: 136434 - DNA, 75 bp, Artificial Sequence
  Synthetic
cttgtgagccggaacctgatgtcctggtattaacatccatgatgactgatcctgaccaaatcactgcagaggcgg

SEQ ID NO: 136435 - DNA, 75 bp, Artificial Sequence
  Synthetic
cttgtgagccggaacctgatgtcctggtattaacatccatgatgactgatcctgaccaaatcactgctgaggcgg

SEQ ID NO: 136436 - DNA, 75 bp, Artificial Sequence
  Synthetic
cttgtgagccggaacctgatgtcctggtattaacatccatgatgactgatcctgaccaaatcactgccgaggcgg

SEQ ID NO: 136437 - DNA, 75 bp, Artificial Sequence
  Synthetic
cttgtgagccggaacctgatgtcctggtattaacatccatgatgactgatcctgaccaaatcactgcggaggcgg

SEQ ID NO: 136438 - DNA, 75 bp, Artificial Sequence
  Synthetic
cttgtgagccggaacctgatgtcctggtattaacatccatgatgactgatcctgaccatatcactgcagaggcgg

SEQ ID NO: 136439 - DNA, 75 bp, Artificial Sequence
  Synthetic
cttgtgagccggaacctgatgtcctggtattaacatccatgatgactgatcctgaccatatcactgctgaggcgg

SEQ ID NO: 136440 - DNA, 75 bp, Artificial Sequence
  Synthetic
cttgtgagccggaacctgatgtcctggtattaacatccatgatgactgatcctgaccatatcactgccgaggcgg

SEQ ID NO: 136441 - DNA, 75 bp, Artificial Sequence
  Synthetic
cttgtgagccggaacctgatgtcctggtattaacatccatgatgactgatcctgaccatatcactgcggaggcgg

SEQ ID NO: 136442 - DNA, 75 bp, Artificial Sequence
  Synthetic
cttgtgagccggaacctgatgtcctggtattaacatccatgatgactgatcctgaccacatcactgcagaggcgg

SEQ ID NO: 136443 - DNA, 75 bp, Artificial Sequence
  Synthetic
cttgtgagccggaacctgatgtcctggtattaacatccatgatgactgatcctgaccacatcactgctgaggcgg

SEQ ID NO: 136444 - DNA, 75 bp, Artificial Sequence
  Synthetic
cttgtgagccggaacctgatgtcctggtattaacatccatgatgactgatcctgaccacatcactgccgaggcgg

SEQ ID NO: 136445 - DNA, 75 bp, Artificial Sequence
  Synthetic
cttgtgagccggaacctgatgtcctggtattaacatccatgatgactgatcctgaccacatcactgcggaggcgg

SEQ ID NO: 136446 - DNA, 75 bp, Artificial Sequence
  Synthetic
cttgtgagccggaacctgatgtcctggtattaacatccatgatgactgatcctgaccagatcactgcagaggcgg

SEQ ID NO: 136447 - DNA, 75 bp, Artificial Sequence
  Synthetic
cttgtgagccggaacctgatgtcctggtattaacatccatgatgactgatcctgaccagatcactgctgaggcgg

SEQ ID NO: 136448 - DNA, 75 bp, Artificial Sequence
  Synthetic
cttgtgagccggaacctgatgtcctggtattaacatccatgatgactgatcctgaccagatcactgccgaggcgg

SEQ ID NO: 136449 - DNA, 75 bp, Artificial Sequence
  Synthetic
cttgtgagccggaacctgatgtcctggtattaacatccatgatgactgatcctgaccagatcactgcggaggcgg

SEQ ID NO: 136450 - DNA, 75 bp, Artificial Sequence
  Synthetic
cttgtgagccggaacctgatgtcctggtattaacatccatgttgactgatcctgaccaaatcactgcagaggcgg

SEQ ID NO: 136451 - DNA, 75 bp, Artificial Sequence
  Synthetic
cttgtgagccggaacctgatgtcctggtattaacatccatgttgactgatcctgaccaaatcactgctgaggcgg

SEQ ID NO: 136452 - DNA, 75 bp, Artificial Sequence
  Synthetic
cttgtgagccggaacctgatgtcctggtattaacatccatgttgactgatcctgaccaaatcactgccgaggcgg

SEQ ID NO: 136453 - DNA, 75 bp, Artificial Sequence
  Synthetic
cttgtgagccggaacctgatgtcctggtattaacatccatgttgactgatcctgaccaaatcactgcggaggcgg

SEQ ID NO: 136454 - DNA, 75 bp, Artificial Sequence
  Synthetic
cttgtgagccggaacctgatgtcctggtattaacatccatgttgactgatcctgaccatatcactgcagaggcgg

SEQ ID NO: 136455 - DNA, 75 bp, Artificial Sequence
  Synthetic
cttgtgagccggaacctgatgtcctggtattaacatccatgttgactgatcctgaccatatcactgctgaggcgg

SEQ ID NO: 136456 - DNA, 75 bp, Artificial Sequence
  Synthetic
cttgtgagccggaacctgatgtcctggtattaacatccatgttgactgatcctgaccatatcactgccgaggcgg

SEQ ID NO: 136457 - DNA, 75 bp, Artificial Sequence
  Synthetic
cttgtgagccggaacctgatgtcctggtattaacatccatgttgactgatcctgaccatatcactgcggaggcgg

SEQ ID NO: 136458 - DNA, 75 bp, Artificial Sequence
  Synthetic
cttgtgagccggaacctgatgtcctggtattaacatccatgttgactgatcctgaccacatcactgcagaggcgg

SEQ ID NO: 136459 - DNA, 75 bp, Artificial Sequence
  Synthetic
cttgtgagccggaacctgatgtcctggtattaacatccatgttgactgatcctgaccacatcactgctgaggcgg

SEQ ID NO: 136460 - DNA, 75 bp, Artificial Sequence
  Synthetic
cttgtgagccggaacctgatgtcctggtattaacatccatgttgactgatcctgaccacatcactgccgaggcgg

SEQ ID NO: 136461 - DNA, 75 bp, Artificial Sequence
  Synthetic
cttgtgagccggaacctgatgtcctggtattaacatccatgttgactgatcctgaccacatcactgcggaggcgg

SEQ ID NO: 136462 - DNA, 75 bp, Artificial Sequence
  Synthetic
cttgtgagccggaacctgatgtcctggtattaacatccatgttgactgatcctgaccagatcactgcagaggcgg

SEQ ID NO: 136463 - DNA, 75 bp, Artificial Sequence
  Synthetic
cttgtgagccggaacctgatgtcctggtattaacatccatgttgactgatcctgaccagatcactgctgaggcgg

SEQ ID NO: 136464 - DNA, 75 bp, Artificial Sequence
  Synthetic
cttgtgagccggaacctgatgtcctggtattaacatccatgttgactgatcctgaccagatcactgccgaggcgg

SEQ ID NO: 136465 - DNA, 75 bp, Artificial Sequence
  Synthetic
cttgtgagccggaacctgatgtcctggtattaacatccatgttgactgatcctgaccagatcactgcggaggcgg

SEQ ID NO: 136466 - DNA, 75 bp, Artificial Sequence
  Synthetic
cttgtgagccggaacctgatgtcctggtattaacatccatgctgactgatcctgaccaaatcactgcagaggcgg

SEQ ID NO: 136467 - DNA, 75 bp, Artificial Sequence
  Synthetic
cttgtgagccggaacctgatgtcctggtattaacatccatgctgactgatcctgaccaaatcactgctgaggcgg

SEQ ID NO: 136468 - DNA, 75 bp, Artificial Sequence
  Synthetic
cttgtgagccggaacctgatgtcctggtattaacatccatgctgactgatcctgaccaaatcactgccgaggcgg

SEQ ID NO: 136469 - DNA, 75 bp, Artificial Sequence
  Synthetic
cttgtgagccggaacctgatgtcctggtattaacatccatgctgactgatcctgaccaaatcactgcggaggcgg

SEQ ID NO: 136470 - DNA, 75 bp, Artificial Sequence
  Synthetic
cttgtgagccggaacctgatgtcctggtattaacatccatgctgactgatcctgaccatatcactgcagaggcgg

SEQ ID NO: 136471 - DNA, 75 bp, Artificial Sequence
  Synthetic
cttgtgagccggaacctgatgtcctggtattaacatccatgctgactgatcctgaccatatcactgctgaggcgg

SEQ ID NO: 136472 - DNA, 75 bp, Artificial Sequence
  Synthetic
cttgtgagccggaacctgatgtcctggtattaacatccatgctgactgatcctgaccatatcactgccgaggcgg

SEQ ID NO: 136473 - DNA, 75 bp, Artificial Sequence
  Synthetic
cttgtgagccggaacctgatgtcctggtattaacatccatgctgactgatcctgaccatatcactgcggaggcgg

SEQ ID NO: 136474 - DNA, 75 bp, Artificial Sequence
  Synthetic
cttgtgagccggaacctgatgtcctggtattaacatccatgctgactgatcctgaccacatcactgcagaggcgg

SEQ ID NO: 136475 - DNA, 75 bp, Artificial Sequence
  Synthetic
cttgtgagccggaacctgatgtcctggtattaacatccatgctgactgatcctgaccacatcactgctgaggcgg

SEQ ID NO: 136476 - DNA, 75 bp, Artificial Sequence
  Synthetic
cttgtgagccggaacctgatgtcctggtattaacatccatgctgactgatcctgaccacatcactgccgaggcgg

SEQ ID NO: 136477 - DNA, 75 bp, Artificial Sequence
  Synthetic
cttgtgagccggaacctgatgtcctggtattaacatccatgctgactgatcctgaccacatcactgcggaggcgg

SEQ ID NO: 136478 - DNA, 75 bp, Artificial Sequence
  Synthetic
cttgtgagccggaacctgatgtcctggtattaacatccatgctgactgatcctgaccagatcactgcagaggcgg

SEQ ID NO: 136479 - DNA, 75 bp, Artificial Sequence
  Synthetic
cttgtgagccggaacctgatgtcctggtattaacatccatgctgactgatcctgaccagatcactgctgaggcgg

SEQ ID NO: 136480 - DNA, 75 bp, Artificial Sequence
  Synthetic
cttgtgagccggaacctgatgtcctggtattaacatccatgctgactgatcctgaccagatcactgccgaggcgg

SEQ ID NO: 136481 - DNA, 75 bp, Artificial Sequence
  Synthetic
cttgtgagccggaacctgatgtcctggtattaacatccatgctgactgatcctgaccagatcactgcggaggcgg

SEQ ID NO: 136482 - DNA, 75 bp, Artificial Sequence
  Synthetic
cttgtgagccggaacctgatgtcctggtattaacatccatggtgactgatcctgaccaaatcactgcagaggcgg

SEQ ID NO: 136483 - DNA, 75 bp, Artificial Sequence
  Synthetic
cttgtgagccggaacctgatgtcctggtattaacatccatggtgactgatcctgaccaaatcactgctgaggcgg

SEQ ID NO: 136484 - DNA, 75 bp, Artificial Sequence
  Synthetic
cttgtgagccggaacctgatgtcctggtattaacatccatggtgactgatcctgaccaaatcactgccgaggcgg

SEQ ID NO: 136485 - DNA, 75 bp, Artificial Sequence
  Synthetic
cttgtgagccggaacctgatgtcctggtattaacatccatggtgactgatcctgaccaaatcactgcggaggcgg

SEQ ID NO: 136486 - DNA, 75 bp, Artificial Sequence
  Synthetic
cttgtgagccggaacctgatgtcctggtattaacatccatggtgactgatcctgaccatatcactgcagaggcgg

SEQ ID NO: 136487 - DNA, 75 bp, Artificial Sequence
  Synthetic
cttgtgagccggaacctgatgtcctggtattaacatccatggtgactgatcctgaccatatcactgctgaggcgg

SEQ ID NO: 136488 - DNA, 75 bp, Artificial Sequence
  Synthetic
cttgtgagccggaacctgatgtcctggtattaacatccatggtgactgatcctgaccatatcactgccgaggcgg

SEQ ID NO: 136489 - DNA, 75 bp, Artificial Sequence
  Synthetic
cttgtgagccggaacctgatgtcctggtattaacatccatggtgactgatcctgaccatatcactgcggaggcgg

SEQ ID NO: 136490 - DNA, 75 bp, Artificial Sequence
  Synthetic
cttgtgagccggaacctgatgtcctggtattaacatccatggtgactgatcctgaccacatcactgcagaggcgg

SEQ ID NO: 136491 - DNA, 75 bp, Artificial Sequence
  Synthetic
cttgtgagccggaacctgatgtcctggtattaacatccatggtgactgatcctgaccacatcactgctgaggcgg

SEQ ID NO: 136492 - DNA, 75 bp, Artificial Sequence
  Synthetic
cttgtgagccggaacctgatgtcctggtattaacatccatggtgactgatcctgaccacatcactgccgaggcgg

SEQ ID NO: 136493 - DNA, 75 bp, Artificial Sequence
  Synthetic
cttgtgagccggaacctgatgtcctggtattaacatccatggtgactgatcctgaccacatcactgcggaggcgg

SEQ ID NO: 136494 - DNA, 75 bp, Artificial Sequence
  Synthetic
cttgtgagccggaacctgatgtcctggtattaacatccatggtgactgatcctgaccagatcactgcagaggcgg

SEQ ID NO: 136495 - DNA, 75 bp, Artificial Sequence
  Synthetic
cttgtgagccggaacctgatgtcctggtattaacatccatggtgactgatcctgaccagatcactgctgaggcgg

SEQ ID NO: 136496 - DNA, 75 bp, Artificial Sequence
  Synthetic
cttgtgagccggaacctgatgtcctggtattaacatccatggtgactgatcctgaccagatcactgccgaggcgg

SEQ ID NO: 136497 - DNA, 75 bp, Artificial Sequence
  Synthetic
cttgtgagccggaacctgatgtcctggtattaacatccatggtgactgatcctgaccagatcactgcggaggcgg

SEQ ID NO: 136498 - DNA, 75 bp, Artificial Sequence
  Synthetic
cagcccaagggtacaaggtgctcgtcctgaacccatccgttgccgccaccttaggttttggggcgtatatgtcta

SEQ ID NO: 136499 - DNA, 75 bp, Artificial Sequence
  Synthetic
caaacacccagacgccgagctgattgaggccaacttgctgtggaggcaagaggtaggtggcaatataacgcgggt

SEQ ID NO: 136500 - DNA, 75 bp, Artificial Sequence
  Synthetic
caaacaccctgacgccgagctgattgaggccaacttgctgtggaggcaagaggtaggtggcaatataacgcgggt

SEQ ID NO: 136501 - DNA, 75 bp, Artificial Sequence
  Synthetic
caaacaccccgacgccgagctgattgaggccaacttgctgtggaggcaagaggtaggtggcaatataacgcgggt

SEQ ID NO: 136502 - DNA, 75 bp, Artificial Sequence
  Synthetic
caaacacccggacgccgagctgattgaggccaacttgctgtggaggcaagaggtaggtggcaatataacgcgggt

SEQ ID NO: 136503 - DNA, 75 bp, Artificial Sequence
  Synthetic
caatcacccagacgccgagctgattgaggccaacttgctgtggaggcaagaggtaggtggcaatataacgcgggt

SEQ ID NO: 136504 - DNA, 75 bp, Artificial Sequence
  Synthetic
caatcaccctgacgccgagctgattgaggccaacttgctgtggaggcaagaggtaggtggcaatataacgcgggt

SEQ ID NO: 136505 - DNA, 75 bp, Artificial Sequence
  Synthetic
caatcaccccgacgccgagctgattgaggccaacttgctgtggaggcaagaggtaggtggcaatataacgcgggt

SEQ ID NO: 136506 - DNA, 75 bp, Artificial Sequence
  Synthetic
caatcacccggacgccgagctgattgaggccaacttgctgtggaggcaagaggtaggtggcaatataacgcgggt

SEQ ID NO: 136507 - DNA, 75 bp, Artificial Sequence
  Synthetic
caaccacccagacgccgagctgattgaggccaacttgctgtggaggcaagaggtaggtggcaatataacgcgggt

SEQ ID NO: 136508 - DNA, 75 bp, Artificial Sequence
  Synthetic
caaccaccctgacgccgagctgattgaggccaacttgctgtggaggcaagaggtaggtggcaatataacgcgggt

SEQ ID NO: 136509 - DNA, 75 bp, Artificial Sequence
  Synthetic
caaccaccccgacgccgagctgattgaggccaacttgctgtggaggcaagaggtaggtggcaatataacgcgggt

SEQ ID NO: 136510 - DNA, 75 bp, Artificial Sequence
  Synthetic
caaccacccggacgccgagctgattgaggccaacttgctgtggaggcaagaggtaggtggcaatataacgcgggt

SEQ ID NO: 136511 - DNA, 75 bp, Artificial Sequence
  Synthetic
caagcacccagacgccgagctgattgaggccaacttgctgtggaggcaagaggtaggtggcaatataacgcgggt

SEQ ID NO: 136512 - DNA, 75 bp, Artificial Sequence
  Synthetic
caagcaccctgacgccgagctgattgaggccaacttgctgtggaggcaagaggtaggtggcaatataacgcgggt

SEQ ID NO: 136513 - DNA, 75 bp, Artificial Sequence
  Synthetic
caagcaccccgacgccgagctgattgaggccaacttgctgtggaggcaagaggtaggtggcaatataacgcgggt

SEQ ID NO: 136514 - DNA, 75 bp, Artificial Sequence
  Synthetic
caagcacccggacgccgagctgattgaggccaacttgctgtggaggcaagaggtaggtggcaatataacgcgggt

SEQ ID NO: 136515 - DNA, 75 bp, Artificial Sequence
  Synthetic
cgttgggagctttgctggcctctttaagcttggtgcccaacagaacgtccaattaatcaataccaacggcagctg

SEQ ID NO: 136516 - DNA, 75 bp, Artificial Sequence
  Synthetic
cctaggcctaaatttccacccgcgttgcccatatgggcgcggcctgactacaacccacctctgctacaatcgtgg

SEQ ID NO: 136517 - DNA, 75 bp, Artificial Sequence
  Synthetic
cctaggcctaaatttccacccgcgttgcccatttgggcgcggcctgactacaacccacctctgctacaatcgtgg

SEQ ID NO: 136518 - DNA, 75 bp, Artificial Sequence
  Synthetic
cctaggcctaaatttccacccgcgttgcccatctgggcgcggcctgactacaacccacctctgctacaatcgtgg

SEQ ID NO: 136519 - DNA, 75 bp, Artificial Sequence
  Synthetic
cctaggcctaaatttccacccgcgttgcccatgtgggcgcggcctgactacaacccacctctgctacaatcgtgg

SEQ ID NO: 136520 - DNA, 75 bp, Artificial Sequence
  Synthetic
atcgaccaccgtgccacaccccaatattgaggaggtggcattgcccaacactggagagatccccttctatggcag

SEQ ID NO: 136521 - DNA, 75 bp, Artificial Sequence
  Synthetic
tagatgaagccagtgctgcccaggcattggctgatcttgcccggaagtccttcccgcccgacactgcaacttctc

SEQ ID NO: 136522 - DNA, 75 bp, Artificial Sequence
  Synthetic
gcctcccctcgagggtgagcctggagatcctgaccttgactcgggatcgtggtccacggtcagcgaggaaggtga

SEQ ID NO: 136523 - DNA, 75 bp, Artificial Sequence
  Synthetic
ggtccacggtcagcgaggaaggtgatagtgtcgtgtgctgttctatgtcatactcctggacgggggctcttatca

SEQ ID NO: 136524 - DNA, 75 bp, Artificial Sequence
  Synthetic
tacactctccggggtgtgtcccttgcgttcgcgagggtaacgcctcgagatgttgggtgccggtggcccccacag

SEQ ID NO: 136525 - DNA, 75 bp, Artificial Sequence
  Synthetic
caactacctgaggccgtgatgggagccgcttacggcttccagtactccccagcgcagcgggtggaatttcttttg

SEQ ID NO: 136526 - DNA, 75 bp, Artificial Sequence
  Synthetic
gtcccttcgccaaaagaaggtgacatttgaccgcctccaggtatttgaccaacactaacatgatgttctcaagga

SEQ ID NO: 136527 - DNA, 75 bp, Artificial Sequence
  Synthetic
gtcccttcgccaaaagaaggtgacatttgaccgcctccaggtatttgaccaacactatcatgatgttctcaagga

SEQ ID NO: 136528 - DNA, 75 bp, Artificial Sequence
  Synthetic
gtcccttcgccaaaagaaggtgacatttgaccgcctccaggtatttgaccaacactaccatgatgttctcaagga

SEQ ID NO: 136529 - DNA, 75 bp, Artificial Sequence
  Synthetic
gtcccttcgccaaaagaaggtgacatttgaccgcctccaggtatttgaccaacactagcatgatgttctcaagga

SEQ ID NO: 136530 - DNA, 75 bp, Artificial Sequence
  Synthetic
gtcccttcgccaaaagaaggtgacatttgaccgcctccaggtttttgaccaacactaacatgatgttctcaagga

SEQ ID NO: 136531 - DNA, 75 bp, Artificial Sequence
  Synthetic
gtcccttcgccaaaagaaggtgacatttgaccgcctccaggtttttgaccaacactatcatgatgttctcaagga

SEQ ID NO: 136532 - DNA, 75 bp, Artificial Sequence
  Synthetic
gtcccttcgccaaaagaaggtgacatttgaccgcctccaggtttttgaccaacactaccatgatgttctcaagga

SEQ ID NO: 136533 - DNA, 75 bp, Artificial Sequence
  Synthetic
gtcccttcgccaaaagaaggtgacatttgaccgcctccaggtttttgaccaacactagcatgatgttctcaagga

SEQ ID NO: 136534 - DNA, 75 bp, Artificial Sequence
  Synthetic
gtcccttcgccaaaagaaggtgacatttgaccgcctccaggtctttgaccaacactaacatgatgttctcaagga

SEQ ID NO: 136535 - DNA, 75 bp, Artificial Sequence
  Synthetic
gtcccttcgccaaaagaaggtgacatttgaccgcctccaggtctttgaccaacactatcatgatgttctcaagga

SEQ ID NO: 136536 - DNA, 75 bp, Artificial Sequence
  Synthetic
gtcccttcgccaaaagaaggtgacatttgaccgcctccaggtctttgaccaacactaccatgatgttctcaagga

SEQ ID NO: 136537 - DNA, 75 bp, Artificial Sequence
  Synthetic
gtcccttcgccaaaagaaggtgacatttgaccgcctccaggtctttgaccaacactagcatgatgttctcaagga

SEQ ID NO: 136538 - DNA, 75 bp, Artificial Sequence
  Synthetic
gtcccttcgccaaaagaaggtgacatttgaccgcctccaggtgtttgaccaacactaacatgatgttctcaagga

SEQ ID NO: 136539 - DNA, 75 bp, Artificial Sequence
  Synthetic
gtcccttcgccaaaagaaggtgacatttgaccgcctccaggtgtttgaccaacactatcatgatgttctcaagga

SEQ ID NO: 136540 - DNA, 75 bp, Artificial Sequence
  Synthetic
gtcccttcgccaaaagaaggtgacatttgaccgcctccaggtgtttgaccaacactaccatgatgttctcaagga

SEQ ID NO: 136541 - DNA, 75 bp, Artificial Sequence
  Synthetic
gtcccttcgccaaaagaaggtgacatttgaccgcctccaggtgtttgaccaacactagcatgatgttctcaagga

SEQ ID NO: 136542 - DNA, 75 bp, Artificial Sequence
  Synthetic
gtcccttcgccaaaagaaggtgacttttgaccgcctccaggtatttgaccaacactaacatgatgttctcaagga

SEQ ID NO: 136543 - DNA, 75 bp, Artificial Sequence
  Synthetic
gtcccttcgccaaaagaaggtgacttttgaccgcctccaggtatttgaccaacactatcatgatgttctcaagga

SEQ ID NO: 136544 - DNA, 75 bp, Artificial Sequence
  Synthetic
gtcccttcgccaaaagaaggtgacttttgaccgcctccaggtatttgaccaacactaccatgatgttctcaagga

SEQ ID NO: 136545 - DNA, 75 bp, Artificial Sequence
  Synthetic
gtcccttcgccaaaagaaggtgacttttgaccgcctccaggtatttgaccaacactagcatgatgttctcaagga

SEQ ID NO: 136546 - DNA, 75 bp, Artificial Sequence
  Synthetic
gtcccttcgccaaaagaaggtgacttttgaccgcctccaggtttttgaccaacactaacatgatgttctcaagga

SEQ ID NO: 136547 - DNA, 75 bp, Artificial Sequence
  Synthetic
gtcccttcgccaaaagaaggtgacttttgaccgcctccaggtttttgaccaacactatcatgatgttctcaagga

SEQ ID NO: 136548 - DNA, 75 bp, Artificial Sequence
  Synthetic
gtcccttcgccaaaagaaggtgacttttgaccgcctccaggtttttgaccaacactaccatgatgttctcaagga

SEQ ID NO: 136549 - DNA, 75 bp, Artificial Sequence
  Synthetic
gtcccttcgccaaaagaaggtgacttttgaccgcctccaggtttttgaccaacactagcatgatgttctcaagga

SEQ ID NO: 136550 - DNA, 75 bp, Artificial Sequence
  Synthetic
gtcccttcgccaaaagaaggtgacttttgaccgcctccaggtctttgaccaacactaacatgatgttctcaagga

SEQ ID NO: 136551 - DNA, 75 bp, Artificial Sequence
  Synthetic
gtcccttcgccaaaagaaggtgacttttgaccgcctccaggtctttgaccaacactatcatgatgttctcaagga

SEQ ID NO: 136552 - DNA, 75 bp, Artificial Sequence
  Synthetic
gtcccttcgccaaaagaaggtgacttttgaccgcctccaggtctttgaccaacactaccatgatgttctcaagga

SEQ ID NO: 136553 - DNA, 75 bp, Artificial Sequence
  Synthetic
gtcccttcgccaaaagaaggtgacttttgaccgcctccaggtctttgaccaacactagcatgatgttctcaagga

SEQ ID NO: 136554 - DNA, 75 bp, Artificial Sequence
  Synthetic
gtcccttcgccaaaagaaggtgacttttgaccgcctccaggtgtttgaccaacactaacatgatgttctcaagga

SEQ ID NO: 136555 - DNA, 75 bp, Artificial Sequence
  Synthetic
gtcccttcgccaaaagaaggtgacttttgaccgcctccaggtgtttgaccaacactatcatgatgttctcaagga

SEQ ID NO: 136556 - DNA, 75 bp, Artificial Sequence
  Synthetic
gtcccttcgccaaaagaaggtgacttttgaccgcctccaggtgtttgaccaacactaccatgatgttctcaagga

SEQ ID NO: 136557 - DNA, 75 bp, Artificial Sequence
  Synthetic
gtcccttcgccaaaagaaggtgacttttgaccgcctccaggtgtttgaccaacactagcatgatgttctcaagga

SEQ ID NO: 136558 - DNA, 75 bp, Artificial Sequence
  Synthetic
gtcccttcgccaaaagaaggtgacctttgaccgcctccaggtatttgaccaacactaacatgatgttctcaagga

SEQ ID NO: 136559 - DNA, 75 bp, Artificial Sequence
  Synthetic
gtcccttcgccaaaagaaggtgacctttgaccgcctccaggtatttgaccaacactatcatgatgttctcaagga

SEQ ID NO: 136560 - DNA, 75 bp, Artificial Sequence
  Synthetic
gtcccttcgccaaaagaaggtgacctttgaccgcctccaggtatttgaccaacactaccatgatgttctcaagga

SEQ ID NO: 136561 - DNA, 75 bp, Artificial Sequence
  Synthetic
gtcccttcgccaaaagaaggtgacctttgaccgcctccaggtatttgaccaacactagcatgatgttctcaagga

SEQ ID NO: 136562 - DNA, 75 bp, Artificial Sequence
  Synthetic
gtcccttcgccaaaagaaggtgacctttgaccgcctccaggtttttgaccaacactaacatgatgttctcaagga

SEQ ID NO: 136563 - DNA, 75 bp, Artificial Sequence
  Synthetic
gtcccttcgccaaaagaaggtgacctttgaccgcctccaggtttttgaccaacactatcatgatgttctcaagga

SEQ ID NO: 136564 - DNA, 75 bp, Artificial Sequence
  Synthetic
gtcccttcgccaaaagaaggtgacctttgaccgcctccaggtttttgaccaacactaccatgatgttctcaagga

SEQ ID NO: 136565 - DNA, 75 bp, Artificial Sequence
  Synthetic
gtcccttcgccaaaagaaggtgacctttgaccgcctccaggtttttgaccaacactagcatgatgttctcaagga

SEQ ID NO: 136566 - DNA, 75 bp, Artificial Sequence
  Synthetic
gtcccttcgccaaaagaaggtgacctttgaccgcctccaggtctttgaccaacactaacatgatgttctcaagga

SEQ ID NO: 136567 - DNA, 75 bp, Artificial Sequence
  Synthetic
gtcccttcgccaaaagaaggtgacctttgaccgcctccaggtctttgaccaacactatcatgatgttctcaagga

SEQ ID NO: 136568 - DNA, 75 bp, Artificial Sequence
  Synthetic
gtcccttcgccaaaagaaggtgacctttgaccgcctccaggtctttgaccaacactaccatgatgttctcaagga

SEQ ID NO: 136569 - DNA, 75 bp, Artificial Sequence
  Synthetic
gtcccttcgccaaaagaaggtgacctttgaccgcctccaggtctttgaccaacactagcatgatgttctcaagga

SEQ ID NO: 136570 - DNA, 75 bp, Artificial Sequence
  Synthetic
gtcccttcgccaaaagaaggtgacctttgaccgcctccaggtgtttgaccaacactaacatgatgttctcaagga

SEQ ID NO: 136571 - DNA, 75 bp, Artificial Sequence
  Synthetic
gtcccttcgccaaaagaaggtgacctttgaccgcctccaggtgtttgaccaacactatcatgatgttctcaagga

SEQ ID NO: 136572 - DNA, 75 bp, Artificial Sequence
  Synthetic
gtcccttcgccaaaagaaggtgacctttgaccgcctccaggtgtttgaccaacactaccatgatgttctcaagga

SEQ ID NO: 136573 - DNA, 75 bp, Artificial Sequence
  Synthetic
gtcccttcgccaaaagaaggtgacctttgaccgcctccaggtgtttgaccaacactagcatgatgttctcaagga

SEQ ID NO: 136574 - DNA, 75 bp, Artificial Sequence
  Synthetic
gtcccttcgccaaaagaaggtgacgtttgaccgcctccaggtatttgaccaacactaacatgatgttctcaagga

SEQ ID NO: 136575 - DNA, 75 bp, Artificial Sequence
  Synthetic
gtcccttcgccaaaagaaggtgacgtttgaccgcctccaggtatttgaccaacactatcatgatgttctcaagga

SEQ ID NO: 136576 - DNA, 75 bp, Artificial Sequence
  Synthetic
gtcccttcgccaaaagaaggtgacgtttgaccgcctccaggtatttgaccaacactaccatgatgttctcaagga

SEQ ID NO: 136577 - DNA, 75 bp, Artificial Sequence
  Synthetic
gtcccttcgccaaaagaaggtgacgtttgaccgcctccaggtatttgaccaacactagcatgatgttctcaagga

SEQ ID NO: 136578 - DNA, 75 bp, Artificial Sequence
  Synthetic
gtcccttcgccaaaagaaggtgacgtttgaccgcctccaggtttttgaccaacactaacatgatgttctcaagga

SEQ ID NO: 136579 - DNA, 75 bp, Artificial Sequence
  Synthetic
gtcccttcgccaaaagaaggtgacgtttgaccgcctccaggtttttgaccaacactatcatgatgttctcaagga

SEQ ID NO: 136580 - DNA, 75 bp, Artificial Sequence
  Synthetic
gtcccttcgccaaaagaaggtgacgtttgaccgcctccaggtttttgaccaacactaccatgatgttctcaagga

SEQ ID NO: 136581 - DNA, 75 bp, Artificial Sequence
  Synthetic
gtcccttcgccaaaagaaggtgacgtttgaccgcctccaggtttttgaccaacactagcatgatgttctcaagga

SEQ ID NO: 136582 - DNA, 75 bp, Artificial Sequence
  Synthetic
gtcccttcgccaaaagaaggtgacgtttgaccgcctccaggtctttgaccaacactaacatgatgttctcaagga

SEQ ID NO: 136583 - DNA, 75 bp, Artificial Sequence
  Synthetic
gtcccttcgccaaaagaaggtgacgtttgaccgcctccaggtctttgaccaacactatcatgatgttctcaagga

SEQ ID NO: 136584 - DNA, 75 bp, Artificial Sequence
  Synthetic
gtcccttcgccaaaagaaggtgacgtttgaccgcctccaggtctttgaccaacactaccatgatgttctcaagga

SEQ ID NO: 136585 - DNA, 75 bp, Artificial Sequence
  Synthetic
gtcccttcgccaaaagaaggtgacgtttgaccgcctccaggtctttgaccaacactagcatgatgttctcaagga

SEQ ID NO: 136586 - DNA, 75 bp, Artificial Sequence
  Synthetic
gtcccttcgccaaaagaaggtgacgtttgaccgcctccaggtgtttgaccaacactaacatgatgttctcaagga

SEQ ID NO: 136587 - DNA, 75 bp, Artificial Sequence
  Synthetic
gtcccttcgccaaaagaaggtgacgtttgaccgcctccaggtgtttgaccaacactatcatgatgttctcaagga

SEQ ID NO: 136588 - DNA, 75 bp, Artificial Sequence
  Synthetic
gtcccttcgccaaaagaaggtgacgtttgaccgcctccaggtgtttgaccaacactaccatgatgttctcaagga

SEQ ID NO: 136589 - DNA, 75 bp, Artificial Sequence
  Synthetic
gtcccttcgccaaaagaaggtgacgtttgaccgcctccaggtgtttgaccaacactagcatgatgttctcaagga

SEQ ID NO: 136590 - DNA, 75 bp, Artificial Sequence
  Synthetic
gagacgtggtggtcgtggccaccgatgccctaatgactggatacactggtgactttgactctgtcatcgactgca

SEQ ID NO: 136591 - DNA, 75 bp, Artificial Sequence
  Synthetic
ctttagcctagacccaacctttaccatcaccactcaaaccgtccctcaggacgctgtctcccgtagtcaacgtag

SEQ ID NO: 136592 - DNA, 75 bp, Artificial Sequence
  Synthetic
ctgctttgactccactgtaaccgaaaaggacatcagggttgaggaagaggtctatcagtgttgtgacctggagcc

SEQ ID NO: 136593 - DNA, 75 bp, Artificial Sequence
  Synthetic
tctatcagtgttgtgacctggagcctgaagcccgcaaggctattgctgccctcacagaaagactctacgtgggcg

SEQ ID NO: 136594 - DNA, 75 bp, Artificial Sequence
  Synthetic
ggtgcgaaggaagttcggagccatgctagcaaagccattaaccacatcaactccgtgtgggaggatttgctagaa

SEQ ID NO: 136595 - DNA, 75 bp, Artificial Sequence
  Synthetic
ggtgcgaaggatgttcggagccatgctagcaaagccattaaccacatcaactccgtgtgggaggatttgctagaa

SEQ ID NO: 136596 - DNA, 75 bp, Artificial Sequence
  Synthetic
ggtgcgaaggacgttcggagccatgctagcaaagccattaaccacatcaactccgtgtgggaggatttgctagaa

SEQ ID NO: 136597 - DNA, 75 bp, Artificial Sequence
  Synthetic
ggtgcgaaggaggttcggagccatgctagcaaagccattaaccacatcaactccgtgtgggaggatttgctagaa

SEQ ID NO: 136598 - DNA, 75 bp, Artificial Sequence
  Synthetic
tgcagcctccaggacccccccctccccgggagagccatagtggtctgcggaaccggtgagtacaccggaattgcc

SEQ ID NO: 136599 - DNA, 75 bp, Artificial Sequence
  Synthetic
ataggggtcagcagagtccactgctgcactccaccactgagtgggcggtgttgccatgctccttctccgacctac

SEQ ID NO: 136600 - DNA, 75 bp, Artificial Sequence
  Synthetic
aactgtcatacactcgctcactgagagactttacgtaggagggcccatgacaaacagcaaggggcaatcctgcgg

SEQ ID NO: 136601 - DNA, 75 bp, Artificial Sequence
  Synthetic
accctgatctgggagtgagggtctgcgagaagcgggccctctatgacatcgcgcagaagctgcccactgctgtga

SEQ ID NO: 136602 - DNA, 75 bp, Artificial Sequence
  Synthetic
ctgatcaacaccaatggcagttggcacatcaatcgcactgccttgaactgcaatgcgagcctcgacactggctgg

SEQ ID NO: 136603 - DNA, 75 bp, Artificial Sequence
  Synthetic
caccagatgcttagactcgacggttacggagcgcgacatccgcaccgaggaggatatctaccagtgttgccaatt

SEQ ID NO: 136604 - DNA, 75 bp, Artificial Sequence
  Synthetic
caccagatgctttgactcgacggttacggagcgcgacatccgcaccgaggaggatatctaccagtgttgccaatt

SEQ ID NO: 136605 - DNA, 75 bp, Artificial Sequence
  Synthetic
caccagatgcttcgactcgacggttacggagcgcgacatccgcaccgaggaggatatctaccagtgttgccaatt

SEQ ID NO: 136606 - DNA, 75 bp, Artificial Sequence
  Synthetic
caccagatgcttggactcgacggttacggagcgcgacatccgcaccgaggaggatatctaccagtgttgccaatt

SEQ ID NO: 136607 - DNA, 75 bp, Artificial Sequence
  Synthetic
gtatactacctgacccgagaccctgaaactcccttggcgcgagccgcatgggagacagtccgacacactccagtc

SEQ ID NO: 136608 - DNA, 75 bp, Artificial Sequence
  Synthetic
tgcagggccagtggtgtcttcaccactagtatggggaacaccttgacctgctacctgaaagcacaagcagcgtgc

SEQ ID NO: 136609 - DNA, 75 bp, Artificial Sequence
  Synthetic
agctgtccgctccatctctcaaggcaacttgcaccaccaaccatgactcccctgacgccgagctcatagaggcta

SEQ ID NO: 136610 - DNA, 75 bp, Artificial Sequence
  Synthetic
atcatatccatctttactcttaccccagcatacaagattctcctgagccgttcagtgtggtggctgtcctacatg

SEQ ID NO: 136611 - DNA, 75 bp, Artificial Sequence
  Synthetic
gagccttcacggaggcaatgaccaggtactcggctccccccggcgacgaaccacacccggaatacgaccttgagc

SEQ ID NO: 136612 - DNA, 75 bp, Artificial Sequence
  Synthetic
gagccttcacggaggctatgaccaggtactcggctccccccggcgacgaaccacacccggaatacgaccttgagc

SEQ ID NO: 136613 - DNA, 75 bp, Artificial Sequence
  Synthetic
gagccttcacggaggccatgaccaggtactcggctccccccggcgacgaaccacacccggaatacgaccttgagc

SEQ ID NO: 136614 - DNA, 75 bp, Artificial Sequence
  Synthetic
gagccttcacggaggcgatgaccaggtactcggctccccccggcgacgaaccacacccggaatacgaccttgagc

SEQ ID NO: 136615 - DNA, 75 bp, Artificial Sequence
  Synthetic
atacgacgccacgtcgatttgctcgttggggcggctgctttctgctccgctatgtacgtgggggatctctgcgga

SEQ ID NO: 136616 - DNA, 75 bp, Artificial Sequence
  Synthetic
ggcttgggaaaccgctcgtcacactccagtaaactcatggcttggcaacatcatcatgtacgcgcccacaatatg

SEQ ID NO: 136617 - DNA, 75 bp, Artificial Sequence
  Synthetic
ggcttgggaaaccgctcgtcacactccagtaaactcatggcttggcaacatcatcatgtacgcgcccactatatg

SEQ ID NO: 136618 - DNA, 75 bp, Artificial Sequence
  Synthetic
ggcttgggaaaccgctcgtcacactccagtaaactcatggcttggcaacatcatcatgtacgcgcccaccatatg

SEQ ID NO: 136619 - DNA, 75 bp, Artificial Sequence
  Synthetic
ggcttgggaaaccgctcgtcacactccagtaaactcatggcttggcaacatcatcatgtacgcgcccacgatatg

SEQ ID NO: 136620 - DNA, 75 bp, Artificial Sequence
  Synthetic
accgcatggcttgggatatgatgatgaactggtcacctacaacagccctagtggtatcgcagttactccggatcc

SEQ ID NO: 136621 - DNA, 75 bp, Artificial Sequence
  Synthetic
tgatcaacaccaatggcagttggcacatcaatcgcacggccttgaactgtaatgacagcctcaacaccggctggc

SEQ ID NO: 136622 - DNA, 75 bp, Artificial Sequence
  Synthetic
atcactccaatagacctgccatgcatcattcagcgaatgcatggcatggccgccttctcactccacggatactct

SEQ ID NO: 136623 - DNA, 75 bp, Artificial Sequence
  Synthetic
atcactccaatagacctgccatgcatcattcagcgattgcatggcatggccgccttctcactccacggatactct

SEQ ID NO: 136624 - DNA, 75 bp, Artificial Sequence
  Synthetic
atcactccaatagacctgccatgcatcattcagcgactgcatggcatggccgccttctcactccacggatactct

SEQ ID NO: 136625 - DNA, 75 bp, Artificial Sequence
  Synthetic
atcactccaatagacctgccatgcatcattcagcgagtgcatggcatggccgccttctcactccacggatactct

SEQ ID NO: 136626 - DNA, 75 bp, Artificial Sequence
  Synthetic
atcactccaatagacctgccttgcatcattcagcgaatgcatggcatggccgccttctcactccacggatactct

SEQ ID NO: 136627 - DNA, 75 bp, Artificial Sequence
  Synthetic
atcactccaatagacctgccttgcatcattcagcgattgcatggcatggccgccttctcactccacggatactct

SEQ ID NO: 136628 - DNA, 75 bp, Artificial Sequence
  Synthetic
atcactccaatagacctgccttgcatcattcagcgactgcatggcatggccgccttctcactccacggatactct

SEQ ID NO: 136629 - DNA, 75 bp, Artificial Sequence
  Synthetic
atcactccaatagacctgccttgcatcattcagcgagtgcatggcatggccgccttctcactccacggatactct

SEQ ID NO: 136630 - DNA, 75 bp, Artificial Sequence
  Synthetic
atcactccaatagacctgccctgcatcattcagcgaatgcatggcatggccgccttctcactccacggatactct

SEQ ID NO: 136631 - DNA, 75 bp, Artificial Sequence
  Synthetic
atcactccaatagacctgccctgcatcattcagcgattgcatggcatggccgccttctcactccacggatactct

SEQ ID NO: 136632 - DNA, 75 bp, Artificial Sequence
  Synthetic
atcactccaatagacctgccctgcatcattcagcgactgcatggcatggccgccttctcactccacggatactct

SEQ ID NO: 136633 - DNA, 75 bp, Artificial Sequence
  Synthetic
atcactccaatagacctgccctgcatcattcagcgagtgcatggcatggccgccttctcactccacggatactct

SEQ ID NO: 136634 - DNA, 75 bp, Artificial Sequence
  Synthetic
atcactccaatagacctgccgtgcatcattcagcgaatgcatggcatggccgccttctcactccacggatactct

SEQ ID NO: 136635 - DNA, 75 bp, Artificial Sequence
  Synthetic
atcactccaatagacctgccgtgcatcattcagcgattgcatggcatggccgccttctcactccacggatactct

SEQ ID NO: 136636 - DNA, 75 bp, Artificial Sequence
  Synthetic
atcactccaatagacctgccgtgcatcattcagcgactgcatggcatggccgccttctcactccacggatactct

SEQ ID NO: 136637 - DNA, 75 bp, Artificial Sequence
  Synthetic
atcactccaatagacctgccgtgcatcattcagcgagtgcatggcatggccgccttctcactccacggatactct

SEQ ID NO: 136638 - DNA, 75 bp, Artificial Sequence
  Synthetic
atcactccattagacctgccatgcatcattcagcgaatgcatggcatggccgccttctcactccacggatactct

SEQ ID NO: 136639 - DNA, 75 bp, Artificial Sequence
  Synthetic
atcactccattagacctgccatgcatcattcagcgattgcatggcatggccgccttctcactccacggatactct

SEQ ID NO: 136640 - DNA, 75 bp, Artificial Sequence
  Synthetic
atcactccattagacctgccatgcatcattcagcgactgcatggcatggccgccttctcactccacggatactct

SEQ ID NO: 136641 - DNA, 75 bp, Artificial Sequence
  Synthetic
atcactccattagacctgccatgcatcattcagcgagtgcatggcatggccgccttctcactccacggatactct

SEQ ID NO: 136642 - DNA, 75 bp, Artificial Sequence
  Synthetic
atcactccattagacctgccttgcatcattcagcgaatgcatggcatggccgccttctcactccacggatactct

SEQ ID NO: 136643 - DNA, 75 bp, Artificial Sequence
  Synthetic
atcactccattagacctgccttgcatcattcagcgattgcatggcatggccgccttctcactccacggatactct

SEQ ID NO: 136644 - DNA, 75 bp, Artificial Sequence
  Synthetic
atcactccattagacctgccttgcatcattcagcgactgcatggcatggccgccttctcactccacggatactct

SEQ ID NO: 136645 - DNA, 75 bp, Artificial Sequence
  Synthetic
atcactccattagacctgccttgcatcattcagcgagtgcatggcatggccgccttctcactccacggatactct

SEQ ID NO: 136646 - DNA, 75 bp, Artificial Sequence
  Synthetic
atcactccattagacctgccctgcatcattcagcgaatgcatggcatggccgccttctcactccacggatactct

SEQ ID NO: 136647 - DNA, 75 bp, Artificial Sequence
  Synthetic
atcactccattagacctgccctgcatcattcagcgattgcatggcatggccgccttctcactccacggatactct

SEQ ID NO: 136648 - DNA, 75 bp, Artificial Sequence
  Synthetic
atcactccattagacctgccctgcatcattcagcgactgcatggcatggccgccttctcactccacggatactct

SEQ ID NO: 136649 - DNA, 75 bp, Artificial Sequence
  Synthetic
atcactccattagacctgccctgcatcattcagcgagtgcatggcatggccgccttctcactccacggatactct

SEQ ID NO: 136650 - DNA, 75 bp, Artificial Sequence
  Synthetic
atcactccattagacctgccgtgcatcattcagcgaatgcatggcatggccgccttctcactccacggatactct

SEQ ID NO: 136651 - DNA, 75 bp, Artificial Sequence
  Synthetic
atcactccattagacctgccgtgcatcattcagcgattgcatggcatggccgccttctcactccacggatactct

SEQ ID NO: 136652 - DNA, 75 bp, Artificial Sequence
  Synthetic
atcactccattagacctgccgtgcatcattcagcgactgcatggcatggccgccttctcactccacggatactct

SEQ ID NO: 136653 - DNA, 75 bp, Artificial Sequence
  Synthetic
atcactccattagacctgccgtgcatcattcagcgagtgcatggcatggccgccttctcactccacggatactct

SEQ ID NO: 136654 - DNA, 75 bp, Artificial Sequence
  Synthetic
atcactccactagacctgccatgcatcattcagcgaatgcatggcatggccgccttctcactccacggatactct

SEQ ID NO: 136655 - DNA, 75 bp, Artificial Sequence
  Synthetic
atcactccactagacctgccatgcatcattcagcgattgcatggcatggccgccttctcactccacggatactct

SEQ ID NO: 136656 - DNA, 75 bp, Artificial Sequence
  Synthetic
atcactccactagacctgccatgcatcattcagcgactgcatggcatggccgccttctcactccacggatactct

SEQ ID NO: 136657 - DNA, 75 bp, Artificial Sequence
  Synthetic
atcactccactagacctgccatgcatcattcagcgagtgcatggcatggccgccttctcactccacggatactct

SEQ ID NO: 136658 - DNA, 75 bp, Artificial Sequence
  Synthetic
atcactccactagacctgccttgcatcattcagcgaatgcatggcatggccgccttctcactccacggatactct

SEQ ID NO: 136659 - DNA, 75 bp, Artificial Sequence
  Synthetic
atcactccactagacctgccttgcatcattcagcgattgcatggcatggccgccttctcactccacggatactct

SEQ ID NO: 136660 - DNA, 75 bp, Artificial Sequence
  Synthetic
atcactccactagacctgccttgcatcattcagcgactgcatggcatggccgccttctcactccacggatactct

SEQ ID NO: 136661 - DNA, 75 bp, Artificial Sequence
  Synthetic
atcactccactagacctgccttgcatcattcagcgagtgcatggcatggccgccttctcactccacggatactct

SEQ ID NO: 136662 - DNA, 75 bp, Artificial Sequence
  Synthetic
atcactccactagacctgccctgcatcattcagcgaatgcatggcatggccgccttctcactccacggatactct

SEQ ID NO: 136663 - DNA, 75 bp, Artificial Sequence
  Synthetic
atcactccactagacctgccctgcatcattcagcgattgcatggcatggccgccttctcactccacggatactct

SEQ ID NO: 136664 - DNA, 75 bp, Artificial Sequence
  Synthetic
atcactccactagacctgccctgcatcattcagcgactgcatggcatggccgccttctcactccacggatactct

SEQ ID NO: 136665 - DNA, 75 bp, Artificial Sequence
  Synthetic
atcactccactagacctgccctgcatcattcagcgagtgcatggcatggccgccttctcactccacggatactct

SEQ ID NO: 136666 - DNA, 75 bp, Artificial Sequence
  Synthetic
atcactccactagacctgccgtgcatcattcagcgaatgcatggcatggccgccttctcactccacggatactct

SEQ ID NO: 136667 - DNA, 75 bp, Artificial Sequence
  Synthetic
atcactccactagacctgccgtgcatcattcagcgattgcatggcatggccgccttctcactccacggatactct

SEQ ID NO: 136668 - DNA, 75 bp, Artificial Sequence
  Synthetic
atcactccactagacctgccgtgcatcattcagcgactgcatggcatggccgccttctcactccacggatactct

SEQ ID NO: 136669 - DNA, 75 bp, Artificial Sequence
  Synthetic
atcactccactagacctgccgtgcatcattcagcgagtgcatggcatggccgccttctcactccacggatactct

SEQ ID NO: 136670 - DNA, 75 bp, Artificial Sequence
  Synthetic
atcactccagtagacctgccatgcatcattcagcgaatgcatggcatggccgccttctcactccacggatactct

SEQ ID NO: 136671 - DNA, 75 bp, Artificial Sequence
  Synthetic
atcactccagtagacctgccatgcatcattcagcgattgcatggcatggccgccttctcactccacggatactct

SEQ ID NO: 136672 - DNA, 75 bp, Artificial Sequence
  Synthetic
atcactccagtagacctgccatgcatcattcagcgactgcatggcatggccgccttctcactccacggatactct

SEQ ID NO: 136673 - DNA, 75 bp, Artificial Sequence
  Synthetic
atcactccagtagacctgccatgcatcattcagcgagtgcatggcatggccgccttctcactccacggatactct

SEQ ID NO: 136674 - DNA, 75 bp, Artificial Sequence
  Synthetic
atcactccagtagacctgccttgcatcattcagcgaatgcatggcatggccgccttctcactccacggatactct

SEQ ID NO: 136675 - DNA, 75 bp, Artificial Sequence
  Synthetic
atcactccagtagacctgccttgcatcattcagcgattgcatggcatggccgccttctcactccacggatactct

SEQ ID NO: 136676 - DNA, 75 bp, Artificial Sequence
  Synthetic
atcactccagtagacctgccttgcatcattcagcgactgcatggcatggccgccttctcactccacggatactct

SEQ ID NO: 136677 - DNA, 75 bp, Artificial Sequence
  Synthetic
atcactccagtagacctgccttgcatcattcagcgagtgcatggcatggccgccttctcactccacggatactct

SEQ ID NO: 136678 - DNA, 75 bp, Artificial Sequence
  Synthetic
atcactccagtagacctgccctgcatcattcagcgaatgcatggcatggccgccttctcactccacggatactct

SEQ ID NO: 136679 - DNA, 75 bp, Artificial Sequence
  Synthetic
atcactccagtagacctgccctgcatcattcagcgattgcatggcatggccgccttctcactccacggatactct

SEQ ID NO: 136680 - DNA, 75 bp, Artificial Sequence
  Synthetic
atcactccagtagacctgccctgcatcattcagcgactgcatggcatggccgccttctcactccacggatactct

SEQ ID NO: 136681 - DNA, 75 bp, Artificial Sequence
  Synthetic
atcactccagtagacctgccctgcatcattcagcgagtgcatggcatggccgccttctcactccacggatactct

SEQ ID NO: 136682 - DNA, 75 bp, Artificial Sequence
  Synthetic
atcactccagtagacctgccgtgcatcattcagcgaatgcatggcatggccgccttctcactccacggatactct

SEQ ID NO: 136683 - DNA, 75 bp, Artificial Sequence
  Synthetic
atcactccagtagacctgccgtgcatcattcagcgattgcatggcatggccgccttctcactccacggatactct

SEQ ID NO: 136684 - DNA, 75 bp, Artificial Sequence
  Synthetic
atcactccagtagacctgccgtgcatcattcagcgactgcatggcatggccgccttctcactccacggatactct

SEQ ID NO: 136685 - DNA, 75 bp, Artificial Sequence
  Synthetic
atcactccagtagacctgccgtgcatcattcagcgagtgcatggcatggccgccttctcactccacggatactct

SEQ ID NO: 136686 - DNA, 75 bp, Artificial Sequence
  Synthetic
ctggtgtattccaccacttcacgcagtgctagccaaaggcagaagaaagtcacatttgacagactgcaagttctg

SEQ ID NO: 136687 - DNA, 75 bp, Artificial Sequence
  Synthetic
gccagggcggtcagggcaaaactcattgcccaggggggaaaggctgcaatatgtggtctctacctctttaactgg

SEQ ID NO: 136688 - DNA, 75 bp, Artificial Sequence
  Synthetic
cgcgacaaaaatgagcaggccgggcaggtccaggttctgtcctccgtcacacaatccttcttggggacatctatt

SEQ ID NO: 136689 - DNA, 75 bp, Artificial Sequence
  Synthetic
acagcgtgtccgaggcccgaccccgcgtattactcctgtgcctactcctacttactgtaggggtaggcatctttt

SEQ ID NO: 136690 - DNA, 75 bp, Artificial Sequence
  Synthetic
ctgcagagcgccaggcctcctcgtggtgcctggtttggatgcacctggatgaattccaccggctatgtcaaaaca

SEQ ID NO: 136691 - DNA, 75 bp, Artificial Sequence
  Synthetic
ttggggcagctgctttctgctccgctatgtatgtgggggatctctgcggatctgttttcctcgtctcccagctgt

SEQ ID NO: 136692 - DNA, 75 bp, Artificial Sequence
  Synthetic
cggctcggaccagaggccctactgctggcactacgcacctcgaaagtgtggtgttgtgcccgcgtcgcaggtgtg

SEQ ID NO: 136693 - DNA, 75 bp, Artificial Sequence
  Synthetic
gagcaactccctcattcgacaccataacttggtgtactctacaacatctcggagtgctgcgatgcggcagaagaa

SEQ ID NO: 136694 - DNA, 75 bp, Artificial Sequence
  Synthetic
ggtaggtgggtgcccggagcggcctacgccctctacgggatgtggcctttcctcctgctcctgctggcgttgccc

SEQ ID NO: 136695 - DNA, 75 bp, Artificial Sequence
  Synthetic
atcaggaggaggaagttcccaccggcactgcctccttgggcccatccaaactacaaccctcccgtgatcgaggca

SEQ ID NO: 136696 - DNA, 75 bp, Artificial Sequence
  Synthetic
aatatttcatcgcacgggcggaagcagttatccatgtgtgggtaccatccttacaggtccggggtggccgtgatg

SEQ ID NO: 136697 - DNA, 75 bp, Artificial Sequence
  Synthetic
gcagctggcacatcaacaggactgccctgaactgcaatgactccctccagactgggttccttgccgcgctgttct

SEQ ID NO: 136698 - DNA, 75 bp, Artificial Sequence
  Synthetic
actgggttccttgccgcgctgttctacacacacaagttcaacgcgtccggatgcccggagcgcatggccagctgc

SEQ ID NO: 136699 - DNA, 75 bp, Artificial Sequence
  Synthetic
tgagcccgttgtcttctctgccatggagaccaagatcatcacctggggggcagacactgcggcgtgtggggacat

SEQ ID NO: 136700 - DNA, 75 bp, Artificial Sequence
  Synthetic
cagacactgcggcgtgtggggacatcatcttgggtctacccgtctccgcccgaagggggagggagatacttctgg

SEQ ID NO: 136701 - DNA, 75 bp, Artificial Sequence
  Synthetic
ttatgccaatgtgacgggaagctcgcaagacaggccctattgctggcactatgcacctaaaccgtgcactgtcat

SEQ ID NO: 136702 - DNA, 75 bp, Artificial Sequence
  Synthetic
tatcaccagagccgaagcgcacttgcaagtgtgggtcccccctctcaacgttcgggggggccgcgatgccatcat

SEQ ID NO: 136703 - DNA, 75 bp, Artificial Sequence
  Synthetic
ccattgagacaaccacgcttccccaggatgccgtctcccgcactcaacgtcggggtaggactggcagggggaagc

SEQ ID NO: 136704 - DNA, 75 bp, Artificial Sequence
  Synthetic
cggttacccctggcccctgtacgggaatgagggttgcggctgggcagggtggctcctgtctccccgtggttctcg

SEQ ID NO: 136705 - DNA, 75 bp, Artificial Sequence
  Synthetic
aaatacccttctatgggaaggcaatcccccttgaattcatcaaggggggtagacatctcatcttttgccattcca

SEQ ID NO: 136706 - DNA, 75 bp, Artificial Sequence
  Synthetic
acaagagcggcatttaccaccttaccaacgactgtccgaatggcagtattgtgtacgaggctgagcaactcatcc

SEQ ID NO: 136707 - DNA, 75 bp, Artificial Sequence
  Synthetic
ctcctagcgttgccccctcgggcgttcgcattggacggagagcaggctgctaccataggggcccttgtcaccctg

SEQ ID NO: 136708 - DNA, 75 bp, Artificial Sequence
  Synthetic
caaatggctctcatgaagctggccgcgctgacaggcacgtacgtttatgatcatcttactccactgcgggactgg

SEQ ID NO: 136709 - DNA, 75 bp, Artificial Sequence
  Synthetic
ggggtcactatcttcaccctgtcccccgcttataagagtatgctcatacacctgatttggtggctacagtatttc

SEQ ID NO: 136710 - DNA, 75 bp, Artificial Sequence
  Synthetic
catcagcgggttccgcactcacttagatcttattgtgggcgctgctgctttttgctcggccatgtacgtgggaga

SEQ ID NO: 136711 - DNA, 75 bp, Artificial Sequence
  Synthetic
gtcaccggccacaggatggcatgggacatgatgatgaattggtcgcctaccgtcaccttggtggtttctagcgtt

SEQ ID NO: 136712 - DNA, 75 bp, Artificial Sequence
  Synthetic
tcatcttaatcctgttcttgtttgcgggggttgaagctacgaccactgttgggcatgcagtgggccggcaagcat

SEQ ID NO: 136713 - DNA, 75 bp, Artificial Sequence
  Synthetic
ggggtcttgatgtgtccgtcataccgaccagcggagacgtcgttgtcgtggcaacagacgctctaatgacgggct

SEQ ID NO: 136714 - DNA, 75 bp, Artificial Sequence
  Synthetic
tgactcgctgaaaaccgggtttatagcaggcctgctctactaccacaaattcaactcctcgggatgtccagaacg

SEQ ID NO: 136715 - DNA, 75 bp, Artificial Sequence
  Synthetic
gccgtccaaaacgaggtcaccctcacacaccccataaccaaattcatcatggcatgcatgtcggctgacctagag

SEQ ID NO: 136716 - DNA, 75 bp, Artificial Sequence
  Synthetic
cgccctaattggggccccaacgacccccggcgtcggtctcgcaatttgggtaaggtcatcgataccctaacgtgc

SEQ ID NO: 136717 - DNA, 75 bp, Artificial Sequence
  Synthetic
cattacccaccaagaccatgcactactgtgtcagctcgtagtgtttgtggccctgtctactgctttacaccaagc

SEQ ID NO: 136718 - DNA, 75 bp, Artificial Sequence
  Synthetic
ccggaggatggtacggttgcacgtggatgaacggttcagggtttgtcaagacatgtggcgcaccaccatgtgaca

SEQ ID NO: 136719 - DNA, 75 bp, Artificial Sequence
  Synthetic
caactccagcgggttgtaccatctcactaatgattgccccaactccagtattgtgctggaggcggagactatgat

SEQ ID NO: 136720 - DNA, 75 bp, Artificial Sequence
  Synthetic
cccatggcttactcccaggtgcctggtagactatccttacaggctgtggcactacccctgcactgtcaacttaac

SEQ ID NO: 136721 - DNA, 75 bp, Artificial Sequence
  Synthetic
cccatggcttactcccaggtgcctggtagactatccttacaggctgtggcactacccctgcactgtcaactttac

SEQ ID NO: 136722 - DNA, 75 bp, Artificial Sequence
  Synthetic
cccatggcttactcccaggtgcctggtagactatccttacaggctgtggcactacccctgcactgtcaacttcac

SEQ ID NO: 136723 - DNA, 75 bp, Artificial Sequence
  Synthetic
cccatggcttactcccaggtgcctggtagactatccttacaggctgtggcactacccctgcactgtcaacttgac

SEQ ID NO: 136724 - DNA, 75 bp, Artificial Sequence
  Synthetic
gagcgtgggccaaagtcattgccatcctccttcttgtcgcgggagtggatgcaaccacctattccaccggcgcgc

SEQ ID NO: 136725 - DNA, 75 bp, Artificial Sequence
  Synthetic
cccgcgagtgggttccgtagacacgtggacctccttgcgggcgctgcagtgttctgttcttcgatgtatatcgga

SEQ ID NO: 136726 - DNA, 75 bp, Artificial Sequence
  Synthetic
attctgttatctgctgctccatgtcatactcctggacaggagccctcataacaccatgtgggcccgaggaggaga

SEQ ID NO: 136727 - DNA, 75 bp, Artificial Sequence
  Synthetic
agaattgagatgagcccgctaatgttctcaaccaccgaactttccatcttgccgtgttcgttcacgactatgccg

SEQ ID NO: 136728 - DNA, 75 bp, Artificial Sequence
  Synthetic
agaattgagatgagcccgctattgttctcaaccaccgaactttccatcttgccgtgttcgttcacgactatgccg

SEQ ID NO: 136729 - DNA, 75 bp, Artificial Sequence
  Synthetic
agaattgagatgagcccgctactgttctcaaccaccgaactttccatcttgccgtgttcgttcacgactatgccg

SEQ ID NO: 136730 - DNA, 75 bp, Artificial Sequence
  Synthetic
agaattgagatgagcccgctagtgttctcaaccaccgaactttccatcttgccgtgttcgttcacgactatgccg

SEQ ID NO: 136731 - DNA, 75 bp, Artificial Sequence
  Synthetic
atgttaccggccatagaatggcgtgggatatgatgatgaactggtcacccacctcaaccttggtcctgtcaagca

SEQ ID NO: 136732 - DNA, 75 bp, Artificial Sequence
  Synthetic
ctcggactcaatgctgtagcatattaccggggtcttgatgtgtccgtcataccgactagcggagacgtcgttgtc

SEQ ID NO: 136733 - DNA, 75 bp, Artificial Sequence
  Synthetic
agtaagtcgtcctcatgtttctggtgctggcagatgctcgcatttgtgcggtcatatggctggcaatgctcgtgg

SEQ ID NO: 136734 - DNA, 75 bp, Artificial Sequence
  Synthetic
agtatgtcgtcctcatgtttctggtgctggcagatgctcgcatttgtgcggtcatatggctggcaatgctcgtgg

SEQ ID NO: 136735 - DNA, 75 bp, Artificial Sequence
  Synthetic
agtacgtcgtcctcatgtttctggtgctggcagatgctcgcatttgtgcggtcatatggctggcaatgctcgtgg

SEQ ID NO: 136736 - DNA, 75 bp, Artificial Sequence
  Synthetic
agtaggtcgtcctcatgtttctggtgctggcagatgctcgcatttgtgcggtcatatggctggcaatgctcgtgg

SEQ ID NO: 136737 - DNA, 75 bp, Artificial Sequence
  Synthetic
ggtcatggccgtgttgtttctgttcgcgggagtggaagcacacatcaccaccatcggctctgccgcggccggtac

SEQ ID NO: 136738 - DNA, 75 bp, Artificial Sequence
  Synthetic
ctcggataagacggtttgcggcccgttttattgttatactcctagccctgttgtcgtaggcaccagtgacaagca

SEQ ID NO: 136739 - DNA, 75 bp, Artificial Sequence
  Synthetic
gtggcatatacggggtcggttggtccctgctaccgcgtacggaattttccagatatggcctctcttgctgctgct

SEQ ID NO: 136740 - DNA, 75 bp, Artificial Sequence
  Synthetic
tgctcgccaccgctacccctccgggctccgtcactgtgccccatcctaacatcgaggaggttgctctgtccacca

SEQ ID NO: 136741 - DNA, 75 bp, Artificial Sequence
  Synthetic
tgcaacgacagcatcaacactgggtttatagctgggctcttttacacgcaccggtttaactccacgggctgtccg

SEQ ID NO: 136742 - DNA, 75 bp, Artificial Sequence
  Synthetic
acctacaggacattgctagcgcgggttttatggtggattcagtatttcatagctcggaccgaggcctacttgcat

SEQ ID NO: 136743 - DNA, 75 bp, Artificial Sequence
  Synthetic
actgctggcactatgctcccaggcactgtgacgtggtatccgcgaagtcagtgtgcggtccggtctactgtttca

SEQ ID NO: 136744 - DNA, 75 bp, Artificial Sequence
  Synthetic
tgctagcattgattggaccaatgtatcttctgcaggccagcctcctgcgagtgccctactacgtacgcgcgcaag

SEQ ID NO: 136745 - DNA, 75 bp, Artificial Sequence
  Synthetic
tgctagcattgattggaccaatgtatcttctgcaggccagcctcctgcgagtgccctactacgtacgcgcgcatg

SEQ ID NO: 136746 - DNA, 75 bp, Artificial Sequence
  Synthetic
tgctagcattgattggaccaatgtatcttctgcaggccagcctcctgcgagtgccctactacgtacgcgcgcacg

SEQ ID NO: 136747 - DNA, 75 bp, Artificial Sequence
  Synthetic
tgctagcattgattggaccaatgtatcttctgcaggccagcctcctgcgagtgccctactacgtacgcgcgcagg

SEQ ID NO: 136748 - DNA, 75 bp, Artificial Sequence
  Synthetic
tgctagcattgattggaccaatgtatcttctgcaggccagcctcctgcgagtgccctactacgttcgcgcgcaag

SEQ ID NO: 136749 - DNA, 75 bp, Artificial Sequence
  Synthetic
tgctagcattgattggaccaatgtatcttctgcaggccagcctcctgcgagtgccctactacgttcgcgcgcatg

SEQ ID NO: 136750 - DNA, 75 bp, Artificial Sequence
  Synthetic
tgctagcattgattggaccaatgtatcttctgcaggccagcctcctgcgagtgccctactacgttcgcgcgcacg

SEQ ID NO: 136751 - DNA, 75 bp, Artificial Sequence
  Synthetic
tgctagcattgattggaccaatgtatcttctgcaggccagcctcctgcgagtgccctactacgttcgcgcgcagg

SEQ ID NO: 136752 - DNA, 75 bp, Artificial Sequence
  Synthetic
tgctagcattgattggaccaatgtatcttctgcaggccagcctcctgcgagtgccctactacgtccgcgcgcaag

SEQ ID NO: 136753 - DNA, 75 bp, Artificial Sequence
  Synthetic
tgctagcattgattggaccaatgtatcttctgcaggccagcctcctgcgagtgccctactacgtccgcgcgcatg

SEQ ID NO: 136754 - DNA, 75 bp, Artificial Sequence
  Synthetic
tgctagcattgattggaccaatgtatcttctgcaggccagcctcctgcgagtgccctactacgtccgcgcgcacg

SEQ ID NO: 136755 - DNA, 75 bp, Artificial Sequence
  Synthetic
tgctagcattgattggaccaatgtatcttctgcaggccagcctcctgcgagtgccctactacgtccgcgcgcagg

SEQ ID NO: 136756 - DNA, 75 bp, Artificial Sequence
  Synthetic
tgctagcattgattggaccaatgtatcttctgcaggccagcctcctgcgagtgccctactacgtgcgcgcgcaag

SEQ ID NO: 136757 - DNA, 75 bp, Artificial Sequence
  Synthetic
tgctagcattgattggaccaatgtatcttctgcaggccagcctcctgcgagtgccctactacgtgcgcgcgcatg

SEQ ID NO: 136758 - DNA, 75 bp, Artificial Sequence
  Synthetic
tgctagcattgattggaccaatgtatcttctgcaggccagcctcctgcgagtgccctactacgtgcgcgcgcacg

SEQ ID NO: 136759 - DNA, 75 bp, Artificial Sequence
  Synthetic
tgctagcattgattggaccaatgtatcttctgcaggccagcctcctgcgagtgccctactacgtgcgcgcgcagg

SEQ ID NO: 136760 - DNA, 75 bp, Artificial Sequence
  Synthetic
atgtgttcatgctgaccagtttgcgccccccgcagggggggtggttcgggtgcacatggatgaacgccacaggat

SEQ ID NO: 136761 - DNA, 75 bp, Artificial Sequence
  Synthetic
tgaccatctggcccccttaaccacctgggctagcgctggtttacgtgacctcgccgtagccgtggagcctgttgt

SEQ ID NO: 136762 - DNA, 75 bp, Artificial Sequence
  Synthetic
tccggaagctacttaccagcggtgtgggtcgggaccctggctgacacctaggtgtctggtggattacccttacag

SEQ ID NO: 136763 - DNA, 75 bp, Artificial Sequence
  Synthetic
ctggtccttcttgggcccgcagatgacgttaaggacaaggggtggtcactacttgctcccattaccgcctacgct

SEQ ID NO: 136764 - DNA, 75 bp, Artificial Sequence
  Synthetic
cgaggcgaccgttgtgacttacatgacagggacagggtagagatgagcccactgcttttctcgaccacgcagctt

SEQ ID NO: 136765 - DNA, 75 bp, Artificial Sequence
  Synthetic
ggccgtgatgggaagctcctacggattccaatactcaccaggacagcgggttgaattcctcgtgcaagcgtggaa

SEQ ID NO: 136766 - DNA, 75 bp, Artificial Sequence
  Synthetic
cttcttcacagcggcctggtacttaaagggcagggtggtccccgtggccacgtactctgttctcggcttgtggtc

SEQ ID NO: 136767 - DNA, 75 bp, Artificial Sequence
  Synthetic
agacctttctcgggactaacgtcaacggtgtaatgtggactgtctatcacggcgcaggctcaaagaccctggcgg

SEQ ID NO: 136768 - DNA, 75 bp, Artificial Sequence
  Synthetic
cctcgagcttggtctcgtgggctgtgaagtgggagtatgtcgtcctcatgtttctagtcctggcagacgctcgga

SEQ ID NO: 136769 - DNA, 75 bp, Artificial Sequence
  Synthetic
tggtgccagcgacctgttcctcatcacgcgggaaggcgatgtcattccagcccgtcgtcgcggtgacaaccgagc

SEQ ID NO: 136770 - DNA, 75 bp, Artificial Sequence
  Synthetic
ttggtggtgggccctcatcttcttgtgctgcgcttggtacataaagggtcgtttcgtccccgtatgtacctacgc

SEQ ID NO: 136771 - DNA, 75 bp, Artificial Sequence
  Synthetic
gtttgcacgcgtggcgttgccaaagcactcgaatttgtacctgtcgagggtatggagacaactatgaggtctcca

SEQ ID NO: 136772 - DNA, 75 bp, Artificial Sequence
  Synthetic
ctcgtggtgttgactctcttcaccatcacccctatgtacaaacagctgctcatgcgcgccatttggtggaaccaa

SEQ ID NO: 136773 - DNA, 75 bp, Artificial Sequence
  Synthetic
tggcctatgcctcccagggctataaggtgctcgtgctcaatccatcagttgctgctactctgtcattcggtgcgt

SEQ ID NO: 136774 - DNA, 75 bp, Artificial Sequence
  Synthetic
acccacatcttggctttgaaatcaccaagatattgttagccatcttagcccccctgcacatcctccaacacagtc

SEQ ID NO: 136775 - DNA, 75 bp, Artificial Sequence
  Synthetic
acccacatcttggctttgaaatcaccaagattttgttagccatcttagcccccctgcacatcctccaacacagtc

SEQ ID NO: 136776 - DNA, 75 bp, Artificial Sequence
  Synthetic
acccacatcttggctttgaaatcaccaagatcttgttagccatcttagcccccctgcacatcctccaacacagtc

SEQ ID NO: 136777 - DNA, 75 bp, Artificial Sequence
  Synthetic
acccacatcttggctttgaaatcaccaagatgttgttagccatcttagcccccctgcacatcctccaacacagtc

SEQ ID NO: 136778 - DNA, 75 bp, Artificial Sequence
  Synthetic
tcctaacatcaggactggggtcaggacaatcaccacaggggcacccatcacatattccacctatggcaaattttt

SEQ ID NO: 136779 - DNA, 75 bp, Artificial Sequence
  Synthetic
ctgccactgtggggctgagatcactggacatgtcaaaaacgggacgatgaggatcgtcggtcccaggacctgcag

SEQ ID NO: 136780 - DNA, 75 bp, Artificial Sequence
  Synthetic
gaggttgggtgcctggaccggtacttatgtgtatgaccatctcagccccctttctgactgggccagcgacggctt

SEQ ID NO: 136781 - DNA, 75 bp, Artificial Sequence
  Synthetic
gaccaggctgagacggctggctgtcgcctcacggtgctagctaccgccacaccacccggatctgttacggtccct

SEQ ID NO: 136782 - DNA, 75 bp, Artificial Sequence
  Synthetic
aagggcctccctgtgtcggctagacaagggaacttggtgctgctcggacccgcagatgacatgcgtcgcggaggc

SEQ ID NO: 136783 - DNA, 75 bp, Artificial Sequence
  Synthetic
aagggcctccctgtgtcggctagactagggaacttggtgctgctcggacccgcagatgacatgcgtcgcggaggc

SEQ ID NO: 136784 - DNA, 75 bp, Artificial Sequence
  Synthetic
aagggcctccctgtgtcggctagaccagggaacttggtgctgctcggacccgcagatgacatgcgtcgcggaggc

SEQ ID NO: 136785 - DNA, 75 bp, Artificial Sequence
  Synthetic
aagggcctccctgtgtcggctagacgagggaacttggtgctgctcggacccgcagatgacatgcgtcgcggaggc

SEQ ID NO: 136786 - DNA, 75 bp, Artificial Sequence
  Synthetic
tattttgccactcgaagaaaaagtgcgacgagctatctagccaactcaggaacatgggcttgaatgctgttgcct

SEQ ID NO: 136787 - DNA, 75 bp, Artificial Sequence
  Synthetic
cgcagatgacatgcgtcgcggaggctggaggctattggcacccatcactgcatacgcacaacaaacgcgggggct

SEQ ID NO: 136788 - DNA, 75 bp, Artificial Sequence
  Synthetic
cgcagatgacatgcgtcgcggaggctggaggcttttggcacccatcactgcatacgcacaacaaacgcgggggct

SEQ ID NO: 136789 - DNA, 75 bp, Artificial Sequence
  Synthetic
cgcagatgacatgcgtcgcggaggctggaggctcttggcacccatcactgcatacgcacaacaaacgcgggggct

SEQ ID NO: 136790 - DNA, 75 bp, Artificial Sequence
  Synthetic
cgcagatgacatgcgtcgcggaggctggaggctgttggcacccatcactgcatacgcacaacaaacgcgggggct

SEQ ID NO: 136791 - DNA, 75 bp, Artificial Sequence
  Synthetic
aacatcaatggtgtcatgtggactgtttaccacggtgccggctcaaaaaatcttgccggaccgaaaggacccata

SEQ ID NO: 136792 - DNA, 75 bp, Artificial Sequence
  Synthetic
cgtgatcgactgcaacgttgcagtgacacaagttgttgatttcagcctggatcccactttcaccattgagaccac

SEQ ID NO: 136793 - DNA, 75 bp, Artificial Sequence
  Synthetic
tcgagtattgtgtacgaggcggccgatgccatcctgcacactccggggtgtgtcccttgcgttcgcgagggtaac

SEQ ID NO: 136794 - DNA, 75 bp, Artificial Sequence
  Synthetic
acttggtcaccaggggtgccgatgttattcctgcacgtcgcaggggtgacagtcgcgctgccctcctgtctccca

SEQ ID NO: 136795 - DNA, 75 bp, Artificial Sequence
  Synthetic
tcgggaatgttcgatacggtcgtcctctgtgaggcgtacgatgccggggccgcgtggtatgagctaacacccgca

SEQ ID NO: 136796 - DNA, 75 bp, Artificial Sequence
  Synthetic
atgcccatatgggcacgcccggattacaaccctccactgctagagtcctggaaggacccggactacgtccctccg

SEQ ID NO: 136797 - DNA, 75 bp, Artificial Sequence
  Synthetic
ggctaaggccttggattttgtccctgtggagaatatggagacaaccatgcggtcccctgtgtttactgacaattc

SEQ ID NO: 136798 - DNA, 75 bp, Artificial Sequence
  Synthetic
acatagacgcccactttctgtctcagacgaagcaggcgggggaaaacctcgcatacctagtggcctaccaggcca

SEQ ID NO: 136799 - DNA, 75 bp, Artificial Sequence
  Synthetic
gggtacaaggtgttggtcctgaacccatccgtagcggcaacgctaagttttggggcctacatgagcaaagcccaa

SEQ ID NO: 136800 - DNA, 75 bp, Artificial Sequence
  Synthetic
gggtacaaggtgttggtcctgaacccatccgtagcggcaacgctaagttttggggcctacatgagcaaagcccat

SEQ ID NO: 136801 - DNA, 75 bp, Artificial Sequence
  Synthetic
gggtacaaggtgttggtcctgaacccatccgtagcggcaacgctaagttttggggcctacatgagcaaagcccac

SEQ ID NO: 136802 - DNA, 75 bp, Artificial Sequence
  Synthetic
gggtacaaggtgttggtcctgaacccatccgtagcggcaacgctaagttttggggcctacatgagcaaagcccag

SEQ ID NO: 136803 - DNA, 75 bp, Artificial Sequence
  Synthetic
gtacaggctgggacccgtacaaaatgaagtgataacaactcaccccatcaccaagtacatcatgacttgcatggc

SEQ ID NO: 136804 - DNA, 75 bp, Artificial Sequence
  Synthetic
gagtcacgtattcaatcactccacttgatctcccagaaatcattcaaagactccatggcatggccgctttttcac

SEQ ID NO: 136805 - DNA, 75 bp, Artificial Sequence
  Synthetic
tagcgcattttcactccatagttactctccaggtgaaatcaatagggtggccgcatgcctcaggaaacttggggt

SEQ ID NO: 136806 - DNA, 75 bp, Artificial Sequence
  Synthetic
tctcgacgtctccgttataccaactcaaggagacgtggtggtcgtcgccaccgatgccctaatgactggatacac

SEQ ID NO: 136807 - DNA, 75 bp, Artificial Sequence
  Synthetic
caggtggagcatatgacatcatcatttgtgacgagtgccattccacagaccccacaacggtacttggtataggta

SEQ ID NO: 136808 - DNA, 75 bp, Artificial Sequence
  Synthetic
caggtggagcatatgacatcatcatttgtgacgagtgccattccactgaccccacaacggtacttggtataggta

SEQ ID NO: 136809 - DNA, 75 bp, Artificial Sequence
  Synthetic
caggtggagcatatgacatcatcatttgtgacgagtgccattccaccgaccccacaacggtacttggtataggta

SEQ ID NO: 136810 - DNA, 75 bp, Artificial Sequence
  Synthetic
caggtggagcatatgacatcatcatttgtgacgagtgccattccacggaccccacaacggtacttggtataggta

SEQ ID NO: 136811 - DNA, 75 bp, Artificial Sequence
  Synthetic
ggaagggtcaccacgtctggcagaccagcaattgtgcccgaccgggaggttatgtaccaacagtatgatgaaatg

SEQ ID NO: 136812 - DNA, 75 bp, Artificial Sequence
  Synthetic
gcatctttctccttcccgcccgataggcgggaacaataaagctacactccattagctttcctgtttttttttttt

SEQ ID NO: 136813 - DNA, 75 bp, Artificial Sequence
  Synthetic
gactgctctcccgtccactggggagataccattttatggtaaggctatcccccttgagttcatcaagggggggag

SEQ ID NO: 136814 - DNA, 75 bp, Artificial Sequence
  Synthetic
aagcagaagagcttaaaccggccgtccactctgcctggccaaagctcgaacaattttggcacaagcacatgtgga

SEQ ID NO: 136815 - DNA, 75 bp, Artificial Sequence
  Synthetic
cgtcgcattctatagaggtgtcgatgtggccgtaattcccacctcaggcgacgtcgtcatatgtgcgacagacgc

SEQ ID NO: 136816 - DNA, 75 bp, Artificial Sequence
  Synthetic
attaacaacatcacagaccctccttctaaatatattaggggggtgggtggcgtctcaactgtccagccctgtgcc

SEQ ID NO: 136817 - DNA, 75 bp, Artificial Sequence
  Synthetic
gacaacctatccccaaggctcgccggcccgagggcaggacctgggctcagcccgggtatccttggcccctctatg

SEQ ID NO: 136818 - DNA, 75 bp, Artificial Sequence
  Synthetic
gagaccactactgtcccccaagacgcggtcgcgcggagccaacgacgcggtcgcacagggcgggggaagccgggg

SEQ ID NO: 136819 - DNA, 75 bp, Artificial Sequence
  Synthetic
gtgtcaggggctctcgtagctttcaagatcatgagcggcgagactccgtcagcggaggatatggtcaatttgcta

SEQ ID NO: 136820 - DNA, 75 bp, Artificial Sequence
  Synthetic
cccctgctgagactaccgttaggctgcgtgcctacttgaacactcctgggttacccgtctgccaagaacatctag

SEQ ID NO: 136821 - DNA, 75 bp, Artificial Sequence
  Synthetic
cccctgctgagactaccgttaggctgcgtgcctacttgaacactcctgggttacccgtctgccaagaacatcttg

SEQ ID NO: 136822 - DNA, 75 bp, Artificial Sequence
  Synthetic
cccctgctgagactaccgttaggctgcgtgcctacttgaacactcctgggttacccgtctgccaagaacatctcg

SEQ ID NO: 136823 - DNA, 75 bp, Artificial Sequence
  Synthetic
cccctgctgagactaccgttaggctgcgtgcctacttgaacactcctgggttacccgtctgccaagaacatctgg

SEQ ID NO: 136824 - DNA, 75 bp, Artificial Sequence
  Synthetic
cccctgctgagactaccgttaggctgcgtgcctacttgaacactcctgggttacccgtctgccaagatcatctag

SEQ ID NO: 136825 - DNA, 75 bp, Artificial Sequence
  Synthetic
cccctgctgagactaccgttaggctgcgtgcctacttgaacactcctgggttacccgtctgccaagatcatcttg

SEQ ID NO: 136826 - DNA, 75 bp, Artificial Sequence
  Synthetic
cccctgctgagactaccgttaggctgcgtgcctacttgaacactcctgggttacccgtctgccaagatcatctcg

SEQ ID NO: 136827 - DNA, 75 bp, Artificial Sequence
  Synthetic
cccctgctgagactaccgttaggctgcgtgcctacttgaacactcctgggttacccgtctgccaagatcatctgg

SEQ ID NO: 136828 - DNA, 75 bp, Artificial Sequence
  Synthetic
cccctgctgagactaccgttaggctgcgtgcctacttgaacactcctgggttacccgtctgccaagaccatctag

SEQ ID NO: 136829 - DNA, 75 bp, Artificial Sequence
  Synthetic
cccctgctgagactaccgttaggctgcgtgcctacttgaacactcctgggttacccgtctgccaagaccatcttg

SEQ ID NO: 136830 - DNA, 75 bp, Artificial Sequence
  Synthetic
cccctgctgagactaccgttaggctgcgtgcctacttgaacactcctgggttacccgtctgccaagaccatctcg

SEQ ID NO: 136831 - DNA, 75 bp, Artificial Sequence
  Synthetic
cccctgctgagactaccgttaggctgcgtgcctacttgaacactcctgggttacccgtctgccaagaccatctgg

SEQ ID NO: 136832 - DNA, 75 bp, Artificial Sequence
  Synthetic
cccctgctgagactaccgttaggctgcgtgcctacttgaacactcctgggttacccgtctgccaagagcatctag

SEQ ID NO: 136833 - DNA, 75 bp, Artificial Sequence
  Synthetic
cccctgctgagactaccgttaggctgcgtgcctacttgaacactcctgggttacccgtctgccaagagcatcttg

SEQ ID NO: 136834 - DNA, 75 bp, Artificial Sequence
  Synthetic
cccctgctgagactaccgttaggctgcgtgcctacttgaacactcctgggttacccgtctgccaagagcatctcg

SEQ ID NO: 136835 - DNA, 75 bp, Artificial Sequence
  Synthetic
cccctgctgagactaccgttaggctgcgtgcctacttgaacactcctgggttacccgtctgccaagagcatctgg

SEQ ID NO: 136836 - DNA, 75 bp, Artificial Sequence
  Synthetic
accgcctgatagcttttgcatcaagaggcaaccacgtgtcacctacacactatgtgcccgagaccgatgcgtcac

SEQ ID NO: 136837 - DNA, 75 bp, Artificial Sequence
  Synthetic
acctgaatgatcaggtagttgtggcccctgacaaggaaatcttatatgaggcctttgatgagatggaagaatgcg

SEQ ID NO: 136838 - DNA, 75 bp, Artificial Sequence
  Synthetic
tcaggccacggtgtgtgccagggctaaagcccccccgccgtcatgggatacaatgtggaagtgtcttatcagact

SEQ ID NO: 136839 - DNA, 75 bp, Artificial Sequence
  Synthetic
gtggctcaggcagatctgggactgggtgtgcggcatcctgactgactttaaaacctggctcaaagctaaactcct

SEQ ID NO: 136840 - DNA, 75 bp, Artificial Sequence
  Synthetic
cgcgcaggggcccccggttgggtgtgcgcgcgacgaggaagacttctgaacggtcccagcccagaggtaggcgcc

SEQ ID NO: 136841 - DNA, 75 bp, Artificial Sequence
  Synthetic
aatatccagctgatcaacaccaacggcagttggcacatcaatcgcacagccttgaactgtaatgcgagcctcgac

SEQ ID NO: 136842 - DNA, 75 bp, Artificial Sequence
  Synthetic
tgcatgtccgcggacttggaagtcatcaccagtacgtgggtgcttgtgggaggcgtcctcgccgcattggcagcc

SEQ ID NO: 136843 - DNA, 75 bp, Artificial Sequence
  Synthetic
actgtgattctgcaccttcccggatgcaccccttgcgtcaaaactggcaacaaatctgtctgctgggtatctacc

SEQ ID NO: 136844 - DNA, 75 bp, Artificial Sequence
  Synthetic
gatattgcgggccatgttaagaacggaactatgagaatagtaggccctcgcagttgcagcaacgtgtggcatggt

SEQ ID NO: 136845 - DNA, 75 bp, Artificial Sequence
  Synthetic
acgagatggaggagtgttccaggcacattccctatcttgtcgagggccaacagattgctgagcagttcaggcaga

SEQ ID NO: 136846 - DNA, 75 bp, Artificial Sequence
  Synthetic
acgtgggagacctctgtggtggggttttcctagttgggcaacttttcaccatgaggccccgattgcatcagaccg

SEQ ID NO: 136847 - DNA, 75 bp, Artificial Sequence
  Synthetic
aggttaggaaggtgggagaaaaccactacattacaggggtcacagctgacaaccttaagtgcccctgtcaggtcc

SEQ ID NO: 136848 - DNA, 75 bp, Artificial Sequence
  Synthetic
gtcagggccgtagaggacgggattaactacgcaacagggaaccttcccggttgctccttttctatcttcctcttg

SEQ ID NO: 136849 - DNA, 75 bp, Artificial Sequence
  Synthetic
gggagcccactggggagtcctggcgggcctcgcctactattccatggtggggaactgggctaaggtcttgattgt

SEQ ID NO: 136850 - DNA, 75 bp, Artificial Sequence
  Synthetic
catgtggaatttcattagtgggattcagtatctggcaggcttgtcaactctgccgggaaaccccgctgtggcgtc

SEQ ID NO: 136851 - DNA, 75 bp, Artificial Sequence
  Synthetic
gtcctatgcaatgcgagtgccccagcttctgatcgacattttcatcggaggtcattggggcgtgatcgctggcct

SEQ ID NO: 136852 - DNA, 75 bp, Artificial Sequence
  Synthetic
gctatctacttacgtggtgggctcgcagctcccctgcgagcccgagccggatgagctagtagtaacatcactgct

SEQ ID NO: 136853 - DNA, 75 bp, Artificial Sequence
  Synthetic
gcacatcaacaggactgccctgaattgcaatgactcccttaacaccgggttccttgccgcgctgttctacacacg

SEQ ID NO: 136854 - DNA, 75 bp, Artificial Sequence
  Synthetic
tgtacgaggcggaagatttcatcatgcacctacctgggtgtgtcccgtgtatcaagtcaggtaacgggtctagct

SEQ ID NO: 136855 - DNA, 75 bp, Artificial Sequence
  Synthetic
gcggaagatggccggaggccattacgtgcaaatggccatcatcaagttaggggcgcttactggcacctatgtcta

SEQ ID NO: 136856 - DNA, 75 bp, Artificial Sequence
  Synthetic
ccttccgcttcgacagcctttgtcgtgagcggtctggcgggagccgcggtgggtagcatcggactagggaaggtc

SEQ ID NO: 136857 - DNA, 75 bp, Artificial Sequence
  Synthetic
ggcagaaccctgaaagctgtcgccagcctgttccaagcgggccccagccagaagctccaactcataaacaccgat

SEQ ID NO: 136858 - DNA, 75 bp, Artificial Sequence
  Synthetic
ccatcgctcaaagccacgtgcaccactcaccgcgaacaccccgatgcggaattgatagaggcaaatctcctatgg

SEQ ID NO: 136859 - DNA, 75 bp, Artificial Sequence
  Synthetic
ccatcgctcaaagccacgtgcaccactcaccgcgatcaccccgatgcggaattgatagaggcaaatctcctatgg

SEQ ID NO: 136860 - DNA, 75 bp, Artificial Sequence
  Synthetic
ccatcgctcaaagccacgtgcaccactcaccgcgaccaccccgatgcggaattgatagaggcaaatctcctatgg

SEQ ID NO: 136861 - DNA, 75 bp, Artificial Sequence
  Synthetic
ccatcgctcaaagccacgtgcaccactcaccgcgagcaccccgatgcggaattgatagaggcaaatctcctatgg

SEQ ID NO: 136862 - DNA, 75 bp, Artificial Sequence
  Synthetic
ttgctccgctatgtatgtgggcgacctctgtggaggcatctttttggtcggacagctcttctccttcaatccccg

SEQ ID NO: 136863 - DNA, 75 bp, Artificial Sequence
  Synthetic
gtccggatgcccggagcgcatggccagctgccgccccattgacaagttcgctcaggggtggggtcccatcactta

SEQ ID NO: 136864 - DNA, 75 bp, Artificial Sequence
  Synthetic
tgagcggtctggcgggagccgcggtgggtagcatcggactagggaaggtcatagtcgatgttcttgccgggtacg

SEQ ID NO: 136865 - DNA, 75 bp, Artificial Sequence
  Synthetic
gacgtttgggattgggtttgttccattctcacagactttaagaactggctgtcttcaaaattgctccccaagatg

SEQ ID NO: 136866 - DNA, 75 bp, Artificial Sequence
  Synthetic
ctcaacactgggttcattgccgcgctgttctacgcccacagattcaacgcgtccggatgcccggagcgcatggcc

SEQ ID NO: 136867 - DNA, 75 bp, Artificial Sequence
  Synthetic
aggagcactcgtggtgggggtcgtatgcgctgccattctgaggcgtcacgttggcccctctgaaggtgccaacca

SEQ ID NO: 136868 - DNA, 75 bp, Artificial Sequence
  Synthetic
ggtgttctgatcgcatggcagcctgcaagaacatcagggattttaaacagggatggggtcctctaacctacgcca

SEQ ID NO: 136869 - DNA, 75 bp, Artificial Sequence
  Synthetic
gcaaccctggtcttgtcgtatgtcatgcgaatacctcaggtgatcatggacatcttcactggcggtcactggggc

SEQ ID NO: 136870 - DNA, 75 bp, Artificial Sequence
  Synthetic
cagaacatccagctgatcaacaccaacggcagttggcacatcaatagcacggccctgaactgcaacgacagcctt

SEQ ID NO: 136871 - DNA, 75 bp, Artificial Sequence
  Synthetic
agatctcggtggctgctgagtgccatagaccaccaaggcctcggtacccccctgcgctccccatatgggctcggc

SEQ ID NO: 136872 - DNA, 75 bp, Artificial Sequence
  Synthetic
tgtttcaccccaagccccgttgtggtggggacgaccgatcgtttcggcgcccctacgtataactggggggagaat

SEQ ID NO: 136873 - DNA, 75 bp, Artificial Sequence
  Synthetic
tgcgctgccattctgaggcgtcacgttggcccctctgaaggtgccaaccagtggatgaacaggctaatagccttc

SEQ ID NO: 136874 - DNA, 75 bp, Artificial Sequence
  Synthetic
ctcagctcacttaccatcaccagcttacttcgtaggctgcaccagtggattcacgaggacgcgtccactccctgt

SEQ ID NO: 136875 - DNA, 75 bp, Artificial Sequence
  Synthetic
cttcaccccaagccctgtggtcgtgggcacaacggaccgcggggggacaccaactttcacttggggtgccaataa

SEQ ID NO: 136876 - DNA, 75 bp, Artificial Sequence
  Synthetic
ccggagcacaggcggcgcgcgcgacgctgggctttacaggcttatttcagaccggggccaagcagaatatccacc

SEQ ID NO: 136877 - DNA, 75 bp, Artificial Sequence
  Synthetic
tccgcctcctaggaggaagaaactggtggtgcttgataactccaatgtggggcaagttttagcccaactggctga

SEQ ID NO: 136878 - DNA, 75 bp, Artificial Sequence
  Synthetic
tcccctttatttcctgccaaacgggttatagaggagtttgggctggtgacggggtgtgccacaccacctgccctt

SEQ ID NO: 136879 - DNA, 75 bp, Artificial Sequence
  Synthetic
tcccctttatttcctgccaatcgggttatagaggagtttgggctggtgacggggtgtgccacaccacctgccctt

SEQ ID NO: 136880 - DNA, 75 bp, Artificial Sequence
  Synthetic
tcccctttatttcctgccaaccgggttatagaggagtttgggctggtgacggggtgtgccacaccacctgccctt

SEQ ID NO: 136881 - DNA, 75 bp, Artificial Sequence
  Synthetic
tcccctttatttcctgccaagcgggttatagaggagtttgggctggtgacggggtgtgccacaccacctgccctt

SEQ ID NO: 136882 - DNA, 75 bp, Artificial Sequence
  Synthetic
cctccgtgctgcactaggccggacaacaacaatgacacacttgtctgtcccacggattgtttcaggaaacacccg

SEQ ID NO: 136883 - DNA, 75 bp, Artificial Sequence
  Synthetic
attcaactccacaggatgtcccgagcgccttagcgcctgcaagtccatcacacaattcgcccaggggtggggacc

SEQ ID NO: 136884 - DNA, 75 bp, Artificial Sequence
  Synthetic
aatggcgctgactctgtcaccatattacaagcactatatcagctggtgcttatggtggcttcagtatttcctgac

SEQ ID NO: 136885 - DNA, 75 bp, Artificial Sequence
  Synthetic
aactcagacgctgcctcgtatagttccatgccaccactcgaaggcgaacctggtgaccctgacctcttagatgag

SEQ ID NO: 136886 - DNA, 75 bp, Artificial Sequence
  Synthetic
agccagctctccgccccgtccttgaaggctacctgtaccacccataagatggcatatgattgtgacatggtggat

SEQ ID NO: 136887 - DNA, 75 bp, Artificial Sequence
  Synthetic
cacaacaactggtcctagtgtgccggtcccagctcctaactacaaacgcgctctctggcgggtgtctgccgaaga

SEQ ID NO: 136888 - DNA, 75 bp, Artificial Sequence
  Synthetic
ttaccatccataaggtacgcctctacgtgggcggagtcgagcacaggttcgacgctgcctgcaactggacccgcg

SEQ ID NO: 136889 - DNA, 75 bp, Artificial Sequence
  Synthetic
ggtccggtgtattgtttcactcccagccccgtggtcgtaggcaccaccgaccgaaggggagtaccaacttacacg

SEQ ID NO: 136890 - DNA, 75 bp, Artificial Sequence
  Synthetic
ctgcggaagaggataagttgccaataagccctttaagcaattcgcttatacggcatcacaacttggtgtactcaa

SEQ ID NO: 136891 - DNA, 75 bp, Artificial Sequence
  Synthetic
actgaagtagacggcgtgaggttacaccgctacgcgccgccttgcaagcccctgctcagagatgaggtatgcttc

SEQ ID NO: 136892 - DNA, 75 bp, Artificial Sequence
  Synthetic
actgaagttgacggcgtgaggttacaccgctacgcgccgccttgcaagcccctgctcagagatgaggtatgcttc

SEQ ID NO: 136893 - DNA, 75 bp, Artificial Sequence
  Synthetic
actgaagtcgacggcgtgaggttacaccgctacgcgccgccttgcaagcccctgctcagagatgaggtatgcttc

SEQ ID NO: 136894 - DNA, 75 bp, Artificial Sequence
  Synthetic
actgaagtggacggcgtgaggttacaccgctacgcgccgccttgcaagcccctgctcagagatgaggtatgcttc

SEQ ID NO: 136895 - DNA, 75 bp, Artificial Sequence
  Synthetic
gccggctttgtctactgggttgatacacctccaccaaaacattgtggacgtccagtatttgtacgggatctcacc

SEQ ID NO: 136896 - DNA, 75 bp, Artificial Sequence
  Synthetic
agacatgtggtgctccaccatgccacattgggccacccgatcagttctgccccaccgattgcttccggaagcacc

SEQ ID NO: 136897 - DNA, 75 bp, Artificial Sequence
  Synthetic
ccgggcgtcaactgtaagcgctaggctcctcagcattgaggacgcctgcgatctcacaccaccgcattcggcccg

SEQ ID NO: 136898 - DNA, 75 bp, Artificial Sequence
  Synthetic
gtgtgtcacccagacagtcgatttcagccttgaccctaccttcaccattgagacaaccacgctcccccaggatgc

SEQ ID NO: 136899 - DNA, 75 bp, Artificial Sequence
  Synthetic
ttactgcagagacagctgcccggcgcttgaggagggggtctcccccctctctggcaagctcttctgccagccagt

SEQ ID NO: 136900 - DNA, 75 bp, Artificial Sequence
  Synthetic
ctacaccatccacaaggttcgcctcttcatcaatggtttggagcacaggttcgatgcagcgtgcaactggacccg

SEQ ID NO: 136901 - DNA, 75 bp, Artificial Sequence
  Synthetic
ataggccaggccgaggcggcgcttgagaacctgattgtcctcaacgccgcctcggccgccagcatgcagggcatg

SEQ ID NO: 136902 - DNA, 75 bp, Artificial Sequence
  Synthetic
acacccattcctaccacaataatggccaagaatgaagtgttttgcgtggacacttctaaaggaggtcgcaaacca

SEQ ID NO: 136903 - DNA, 75 bp, Artificial Sequence
  Synthetic
cctgctggcgttgccaccacgagcatacgccatggaccgggagatggccgcatcgtgcggaggcgcggtttttat

SEQ ID NO: 136904 - DNA, 75 bp, Artificial Sequence
  Synthetic
caacatcactcgtgttgagtcggagaacaaggtcatcgtcctcgactcattcgaccctctggtaccggaatatga

SEQ ID NO: 136905 - DNA, 75 bp, Artificial Sequence
  Synthetic
tcgtgttggcgttgccccagagggcatacgcacaggaccacgagcaggccgcttgcattggaatctcagtcatct

SEQ ID NO: 136906 - DNA, 75 bp, Artificial Sequence
  Synthetic
atgccagccttgtcaactggactggtacacctgcaccagaacatagtggacatccagtacttgtacgggttggcc

SEQ ID NO: 136907 - DNA, 75 bp, Artificial Sequence
  Synthetic
catatggtttccagtactcgcccgcccaaagggttgagtatctcctcaaaatgtggcgatcgaagaagacaccta

SEQ ID NO: 136908 - DNA, 75 bp, Artificial Sequence
  Synthetic
accaatgctgcaaattggaccctgcagcccgcaaagccatttcatcgcttaccgagcggttgtatgtaggaggcc

SEQ ID NO: 136909 - DNA, 75 bp, Artificial Sequence
  Synthetic
ctcttacagaaatggcagatgcctggatacgagcctcccgttgtgtccgggtgcgcattgcctccaactaaacag

SEQ ID NO: 136910 - DNA, 75 bp, Artificial Sequence
  Synthetic
acaggtgtgggtaccgagccttgcagtccgtgggggccgtgatgctgtcatactccttacctgcttgttccaccc

SEQ ID NO: 136911 - DNA, 75 bp, Artificial Sequence
  Synthetic
tcatatcacaagtagaggcagcgcttgagaacctaatcgttctcaatgctgcttctgctgctagcagccaggggt

SEQ ID NO: 136912 - DNA, 75 bp, Artificial Sequence
  Synthetic
gatgtggaagtgcttgacccgcctcaagcccaccctccatgggccaacacctctgctatacagactgggcgctgt

SEQ ID NO: 136913 - DNA, 75 bp, Artificial Sequence
  Synthetic
gggcagacaccgcggcgtgtggggacatcatctctggcctacccgtctccgcccggaggggaagggagatactcc

SEQ ID NO: 136914 - DNA, 75 bp, Artificial Sequence
  Synthetic
atgccagcaccccggcactgagctccggcttggggggatcaatatccagtccattgtcctctgaaccatcggcac

SEQ ID NO: 136915 - DNA, 75 bp, Artificial Sequence
  Synthetic
cacgcactaatacgggccttactcctcgtgcgcaaggccgctggcgcgaagtatgtccaaatgttcctccttaaa

SEQ ID NO: 136916 - DNA, 75 bp, Artificial Sequence
  Synthetic
cctggttctagcgttgccccagcgggcttacgctcaagatcgggagcagggggcatccatcggggtggtcgtcat

SEQ ID NO: 136917 - DNA, 75 bp, Artificial Sequence
  Synthetic
ggcctcaagaactttgacatgttggtctgcggagacgatttagtggtcatctctgagagtctcgggatctctgag

SEQ ID NO: 136918 - DNA, 75 bp, Artificial Sequence
  Synthetic
cttgctcctccaacgtatccgtggcccacgaccacaccggacagagatattactacctcacacgtgacccgacca

SEQ ID NO: 136919 - DNA, 75 bp, Artificial Sequence
  Synthetic
cagcggggaggacaatctcatctgctgttccatgtcctattcctggacgggggccttgatcacaccatgcgctgc

SEQ ID NO: 136920 - DNA, 75 bp, Artificial Sequence
  Synthetic
attcagcagtgggtcccgagtctccgggtccggggaggtcgtgatgctgtgatcctgctcacatgcctgctacat

SEQ ID NO: 136921 - DNA, 75 bp, Artificial Sequence
  Synthetic
tcgtgttctcccctatggagagaaaagttatcacctggagggctgacacagcagcatgcggagacatactggctg

SEQ ID NO: 136922 - DNA, 75 bp, Artificial Sequence
  Synthetic
tcgtgttctcccctatggagagaaaagttatcacctggtgggctgacacagcagcatgcggagacatactggctg

SEQ ID NO: 136923 - DNA, 75 bp, Artificial Sequence
  Synthetic
tcgtgttctcccctatggagagaaaagttatcacctggcgggctgacacagcagcatgcggagacatactggctg

SEQ ID NO: 136924 - DNA, 75 bp, Artificial Sequence
  Synthetic
tcgtgttctcccctatggagagaaaagttatcacctggggggctgacacagcagcatgcggagacatactggctg

SEQ ID NO: 136925 - DNA, 75 bp, Artificial Sequence
  Synthetic
caaggccttctccggttatgcgcgctagcgcggaagctggccggaggccattacgtgcaaatggccatcatcaag

SEQ ID NO: 136926 - DNA, 75 bp, Artificial Sequence
  Synthetic
atcacgcagtgccagcctccgccagaagaaagtcacatttgacagacttcaggtagttgaccaacactaccatga

SEQ ID NO: 136927 - DNA, 75 bp, Artificial Sequence
  Synthetic
tgctcagcagacacgcggtttgttgggaacgatagtcaccagcctcaccggacgggacaagaatgaggttgaagg

SEQ ID NO: 136928 - DNA, 75 bp, Artificial Sequence
  Synthetic
cgcacgccctgttgcgagtgtgcatccttgtgcggcgcgtcgcaggcggcaaatacattcaggccgctcttctga

SEQ ID NO: 136929 - DNA, 75 bp, Artificial Sequence
  Synthetic
gcgggccctaaggggcctatctgccagatgtacaccaatgtagaccaggacatggtaggatggcctgcgccccca

SEQ ID NO: 136930 - DNA, 75 bp, Artificial Sequence
  Synthetic
agtcaccttctcgcctatggagaagaaaattatcacctggggtgcagacactgcagcgtgtggcgatatcctggc

SEQ ID NO: 136931 - DNA, 75 bp, Artificial Sequence
  Synthetic
ggttaatagtctacccagacctgtccgtgcgagtttgtgaaaagatggcactctacgaggtcacgcagaagctcc

SEQ ID NO: 136932 - DNA, 75 bp, Artificial Sequence
  Synthetic
gcgcgggccttttatcccccaggccggtaagcacactcaagggctcatcgggggggcccgtcatgtgcccttctg

SEQ ID NO: 136933 - DNA, 75 bp, Artificial Sequence
  Synthetic
tactgccaacagactcgtggattactgggaacaattgttaccagcctcaccggccgggataggaatgtggttgaa

SEQ ID NO: 136934 - DNA, 75 bp, Artificial Sequence
  Synthetic
ccggtcttcacggacaactcgtcccctccggccgtaccgcagacattccaagtggcccatctacacgctcccact

SEQ ID NO: 136935 - DNA, 75 bp, Artificial Sequence
  Synthetic
tctgtgcctactcctacttacagtaggggtaggcatctttttactccccgcccgataatcgggcggccctaagca

SEQ ID NO: 136936 - DNA, 75 bp, Artificial Sequence
  Synthetic
gttttcttacgacaccaggtgctttgattcaaccgtcacagagcgggatatccgaactgaggaagacatctacca

SEQ ID NO: 136937 - DNA, 75 bp, Artificial Sequence
  Synthetic
gcccctacaatctgggtccggatggtcataatgacccacttcttttccatactattggcccaggacactctgaac

SEQ ID NO: 136938 - DNA, 75 bp, Artificial Sequence
  Synthetic
gccggtcttcactgacaactcttcgccgcctgctgtcccgaactcgtatcaggtgggatacctccacgccccgac

SEQ ID NO: 136939 - DNA, 75 bp, Artificial Sequence
  Synthetic
tagctggccctaagggaccagtgtgccagatgtacaccaacgtggaccaggacatggttggctggcctgcacctc

SEQ ID NO: 136940 - DNA, 75 bp, Artificial Sequence
  Synthetic
gattcaaccgtcacagagcgggatatccgaactgaggaagacatctaccaatcttgtcagctggaccctacagcg

SEQ ID NO: 136941 - DNA, 75 bp, Artificial Sequence
  Synthetic
gggtgttcaccactagtatgggaaacacccttacatgctatcttaaagcacaggcggcgtgtagggcggccagta

SEQ ID NO: 136942 - DNA, 75 bp, Artificial Sequence
  Synthetic
tcctacatgagcaaagcttatggaatagaccccaacatcagaaccggagtcaggaccgttacaacgggagcgccc

SEQ ID NO: 136943 - DNA, 75 bp, Artificial Sequence
  Synthetic
tcgtgccggcttgcttagccccagaccgctgagcacgctcaagggatcgtcgggaggacctcttatgtgtccctc

SEQ ID NO: 136944 - DNA, 75 bp, Artificial Sequence
  Synthetic
agctatgaccagatactcagctcctccaggagatgtgccacagcccgcatatgaccttgagcatataacatcttg

SEQ ID NO: 136945 - DNA, 75 bp, Artificial Sequence
  Synthetic
cgacggtcctggggattgggactgtgctggaccaggcggagacggctggggccaggctcactgtcctggctacag

SEQ ID NO: 136946 - DNA, 75 bp, Artificial Sequence
  Synthetic
tctcccgtcttcactgacaactcaactccaccggcagtaccccaaacataccaagtggggtacctccatgctcca

SEQ ID NO: 136947 - DNA, 75 bp, Artificial Sequence
  Synthetic
agcccatccctaaagatcggcgttccactggcaagtcctggggacgtccaggatacccctggcccctgtatggga

SEQ ID NO: 136948 - DNA, 75 bp, Artificial Sequence
  Synthetic
gctcgtcacactccagtcaactcgtggttaggcaacattattatgtttgctcccgcgatatgggtgcgcatggtt

SEQ ID NO: 136949 - DNA, 75 bp, Artificial Sequence
  Synthetic
gcagctacatgagcacagcccacggcatcgaccctaacatcaggaccggcgtcaggactattacaacagggggtc

SEQ ID NO: 136950 - DNA, 75 bp, Artificial Sequence
  Synthetic
ggaatacattaaaggcggcaggcacttgattttctgccactcaaaaaagaagtgcgacgaactatccaagcagct

SEQ ID NO: 136951 - DNA, 75 bp, Artificial Sequence
  Synthetic
atgactggatatacaggtgatttcgactcggtcatcgactgcaatgttgcggtcacacaagtcgtggatttcagc

SEQ ID NO: 136952 - DNA, 75 bp, Artificial Sequence
  Synthetic
gaccacggtcctaggaatcggcaccgtcttggatcaggcagaaacagctggtgtacgcctcaccgtcctagcgac

SEQ ID NO: 136953 - DNA, 75 bp, Artificial Sequence
  Synthetic
atgcacttgccggggtgcgtcccttgcgtaaaaacagggaacgtgtcccggtgctgggtggccctgactcccact

SEQ ID NO: 136954 - DNA, 75 bp, Artificial Sequence
  Synthetic
acttggggcaccacccctgagagcttggagacatcgagccagagcagtcagagctaagctcatcgcccaaggtgg

SEQ ID NO: 136955 - DNA, 75 bp, Artificial Sequence
  Synthetic
acttggggcaccacccctgagagcttggagacatcgagccagagctgtcagagctaagctcatcgcccaaggtgg

SEQ ID NO: 136956 - DNA, 75 bp, Artificial Sequence
  Synthetic
acttggggcaccacccctgagagcttggagacatcgagccagagccgtcagagctaagctcatcgcccaaggtgg

SEQ ID NO: 136957 - DNA, 75 bp, Artificial Sequence
  Synthetic
acttggggcaccacccctgagagcttggagacatcgagccagagcggtcagagctaagctcatcgcccaaggtgg

SEQ ID NO: 136958 - DNA, 75 bp, Artificial Sequence
  Synthetic
ataggtatgtctcgcaaggggagaggccgtcgggcatgttcgattcagtcatcctctgcgaggcatacgataccg

SEQ ID NO: 136959 - DNA, 75 bp, Artificial Sequence
  Synthetic
ctggagtgcatcaaaggtggtagacatctgatcttctgtcactcaaagaaaaagtgcgacgaattggccaagcaa

SEQ ID NO: 136960 - DNA, 75 bp, Artificial Sequence
  Synthetic
tggttcgtggcaggctacgacgggggggacatttatcacagcgtgtcccaggctcgaccccgtctattactcctt

SEQ ID NO: 136961 - DNA, 75 bp, Artificial Sequence
  Synthetic
tggttcgtggcaggctacgacgggggggacatttatcacagcgtgtcccaggctcgaccccgtcttttactcctt

SEQ ID NO: 136962 - DNA, 75 bp, Artificial Sequence
  Synthetic
tggttcgtggcaggctacgacgggggggacatttatcacagcgtgtcccaggctcgaccccgtctcttactcctt

SEQ ID NO: 136963 - DNA, 75 bp, Artificial Sequence
  Synthetic
tggttcgtggcaggctacgacgggggggacatttatcacagcgtgtcccaggctcgaccccgtctgttactcctt

SEQ ID NO: 136964 - DNA, 75 bp, Artificial Sequence
  Synthetic
cgtggcaacttcagggtgcggtacttcatgtccctggctgtgtcccttgcgaggaggtgggcaatcgaacacagt

SEQ ID NO: 136965 - DNA, 75 bp, Artificial Sequence
  Synthetic
atctctgtgggggtgttttcttggtgggtcagatgttttctttccaaccacgccggcattggaccactcaggact

SEQ ID NO: 136966 - DNA, 75 bp, Artificial Sequence
  Synthetic
ctgggagggggtatttacgggcctcactcacatcgatgcccatttcctctcacaggctaaacaaggaggggagaa

SEQ ID NO: 136967 - DNA, 75 bp, Artificial Sequence
  Synthetic
tcatgaccgggtacacgggcgatttcgactctgtgattgactgcaatgtcgcagtgactcagatagttgatttta

SEQ ID NO: 136968 - DNA, 75 bp, Artificial Sequence
  Synthetic
accaagggcctgcgggcgcacatcgacttgatcgtgatgtccgccacgctttgctccgccctttacgtaggggac

SEQ ID NO: 136969 - DNA, 75 bp, Artificial Sequence
  Synthetic
tatgaggatccctgctactctcggtgagttgctcgccgggggtcattggggggtcctggctggcttggcttattt

SEQ ID NO: 136970 - DNA, 75 bp, Artificial Sequence
  Synthetic
cccatgctcgtggggcccacccctttgttgtacaggcttggagcagtgcagaatgatatcatcacaacgcacccc

SEQ ID NO: 136971 - DNA, 75 bp, Artificial Sequence
  Synthetic
gtaccgatacgtctcacaaggtgaacggccgtctggcatgtttgacactgtcgttctttgcgaggcgtatgatgt

SEQ ID NO: 136972 - DNA, 75 bp, Artificial Sequence
  Synthetic
acccagtcgttcgcctcgatcttcactcctgggccccagcagaagctacagctcattaacagcaatggaagctgg

SEQ ID NO: 136973 - DNA, 75 bp, Artificial Sequence
  Synthetic
acccagtcgttcgcctcgatcttcactcctgggccccagcagaagcttcagctcattaacagcaatggaagctgg

SEQ ID NO: 136974 - DNA, 75 bp, Artificial Sequence
  Synthetic
acccagtcgttcgcctcgatcttcactcctgggccccagcagaagctccagctcattaacagcaatggaagctgg

SEQ ID NO: 136975 - DNA, 75 bp, Artificial Sequence
  Synthetic
acccagtcgttcgcctcgatcttcactcctgggccccagcagaagctgcagctcattaacagcaatggaagctgg

SEQ ID NO: 136976 - DNA, 75 bp, Artificial Sequence
  Synthetic
gcttatgcgtaggcagtgccgtcatttgcggcaggatcgtcacctccggacgacccgcggtcgtgcctgaccgag

SEQ ID NO: 136977 - DNA, 75 bp, Artificial Sequence
  Synthetic
ttttgggagggagtgttcaccggtatgactcatatcgatgctcatttcctatcccaaactaaacagggaggggag

SEQ ID NO: 136978 - DNA, 75 bp, Artificial Sequence
  Synthetic
cgttgccattctcctgctgtctgcgggagtcgacgccgaatctaccaggacaattggtggtagcgcggccgctac

SEQ ID NO: 136979 - DNA, 75 bp, Artificial Sequence
  Synthetic
agaggctcgctgcatgcaagcgtctggaggactttcagcagggctggggcaagctaggggtgtctgatgtctctg

SEQ ID NO: 136980 - DNA, 75 bp, Artificial Sequence
  Synthetic
tcttggactgctacaaaccacggccaagcaggctgaagaaataaaacctgcagttcaaacagcctggcccaagct

SEQ ID NO: 136981 - DNA, 75 bp, Artificial Sequence
  Synthetic
ccggcataggtcgcgtaatttgggtaaggtcatcgataccctcacatgtggctttgccgacctcatggggtacat

SEQ ID NO: 136982 - DNA, 75 bp, Artificial Sequence
  Synthetic
agcctatgcttacgggcccaacacccctcttgtatagacttggtgccgttcaaaatgagattatcaccactcatc

SEQ ID NO: 136983 - DNA, 75 bp, Artificial Sequence
  Synthetic
tgcaatgattcattgaacacaggtttcattgcagctctgttttatgccaacagattcaactcctcgggttgcccc

SEQ ID NO: 136984 - DNA, 75 bp, Artificial Sequence
  Synthetic
cagtcccgtggtggtcggtaccaccgatcgcctcggggcccccacctatagctggggagagaatgagactgatgt

SEQ ID NO: 136985 - DNA, 75 bp, Artificial Sequence
  Synthetic
atgtccttcactgcggcattaaccagcccgctgcgaactgagactaccctcctccttaacatcttagggggttgg

SEQ ID NO: 136986 - DNA, 75 bp, Artificial Sequence
  Synthetic
ttgtctgacagtgggcagtgtcgtgatctgcggcagaatagtcacgtcagggaagcctgtgccgctacctgatag

SEQ ID NO: 136987 - DNA, 75 bp, Artificial Sequence
  Synthetic
tagctcttctatcttgcatgtctgtgccagtgtcctctgtggtggtcaagaacaccagcgtgagctacatggtca

SEQ ID NO: 136988 - DNA, 75 bp, Artificial Sequence
  Synthetic
aaagtgtcgaccttcaatggtacttgggattgcccgaccgattgcttcaggaaacatccggagacgacctacacc

SEQ ID NO: 136989 - DNA, 75 bp, Artificial Sequence
  Synthetic
actgctggcattatccgcccagaccatgcggcattgttcccgcgaagagcgtgtgcggcccggtgtattgtttca

SEQ ID NO: 136990 - DNA, 75 bp, Artificial Sequence
  Synthetic
ttgacattctggccgggtacggtgcaggcgtggctggggctctcgtggccttcaagatcatgtgcggcgaaactc

SEQ ID NO: 136991 - DNA, 75 bp, Artificial Sequence
  Synthetic
atccttggactgttgcagaacactgccaagcaagcagaggacctgaagccagcggttcagtccgcatggcctaag

SEQ ID NO: 136992 - DNA, 75 bp, Artificial Sequence
  Synthetic
ctgctggataccagttaccccgaacgtggccgtaaaagaacgcggagcgcttaccaagggcttgcggacgcacat

SEQ ID NO: 136993 - DNA, 75 bp, Artificial Sequence
  Synthetic
tcagaatgtttgttggcggaatcgaacatcgactggacgccgcgtgcaactggacccggggagagccatgtggac

SEQ ID NO: 136994 - DNA, 75 bp, Artificial Sequence
  Synthetic
acctccgcggggagcttggtttggatgcacatggatgaacggcactggatttactaagacttgcggcgcaccacc

SEQ ID NO: 136995 - DNA, 75 bp, Artificial Sequence
  Synthetic
tccctctgagggggctaaccagtggatgaacagactcatagcgttcgcgtcgcgtggtaaccacgtgtcgcctac

SEQ ID NO: 136996 - DNA, 75 bp, Artificial Sequence
  Synthetic
taatgtccttctccgccgccctgactagcccgctttctacgtcaacgaccctcctgctcaacatcttgggcgggt

SEQ ID NO: 136997 - DNA, 75 bp, Artificial Sequence
  Synthetic
aagcaccaccgcttcgagcagaactgcaactgttccatctatccaggccatatcacaggacatcgcatggcatgg

SEQ ID NO: 136998 - DNA, 75 bp, Artificial Sequence
  Synthetic
gggccatggttgacccctaaatgtctggtccactacccctacaggctgtggcattacccgtgtaccgtcaatttc

SEQ ID NO: 136999 - DNA, 75 bp, Artificial Sequence
  Synthetic
tggattaattcacctccaccagaacattgttgacgttcagtacatctacggcattgggtcggctgtggtgtcgtg

SEQ ID NO: 137000 - DNA, 75 bp, Artificial Sequence
  Synthetic
ggagattggtcatcaccctgtgccacgtcttggctaagggacgtttgggactggatttgcacagtcttggcagac

SEQ ID NO: 137001 - DNA, 75 bp, Artificial Sequence
  Synthetic
cattgacattttagcgggttatggggcaggggtttcgggagcccttgtagcttttaagatcatgagcggcgaggc

SEQ ID NO: 137002 - DNA, 75 bp, Artificial Sequence
  Synthetic
gcgtgatgtttggtctggcctacttctccatgcagggagcttgggcgaaggtcatagccattctcctgctaactg

SEQ ID NO: 137003 - DNA, 75 bp, Artificial Sequence
  Synthetic
ataggagtcagcttagcccgttgctgcattccaccactgagtgggctattctcccatgtacctttgctgacatgc

SEQ ID NO: 137004 - DNA, 75 bp, Artificial Sequence
  Synthetic
gcggcgttggccaacttgatcaacctcaatgccatgtcagctgccggctcacacggagccggctacgcctttgcc

SEQ ID NO: 137005 - DNA, 75 bp, Artificial Sequence
  Synthetic
tatgccggaccacttgcccctgcggagccgacatcaccggccatgtgaaaaacgggacaatgaagatcttgggcc

SEQ ID NO: 137006 - DNA, 75 bp, Artificial Sequence
  Synthetic
ggcccatctgaaggggctacccagtggatgaacagactcatagctttcgcttcgcggggcaaccatgtgtctcca

SEQ ID NO: 137007 - DNA, 75 bp, Artificial Sequence
  Synthetic
acttatcaacacaaatggcagctggcacatcaaccgtactgctctgaactgcaatgatagccttaagaccggctt

SEQ ID NO: 137008 - DNA, 75 bp, Artificial Sequence
  Synthetic
ggagtgggtggtcctcttatttctgctccttgcagacgccagaatctgcgcgtgcttgtggatgctcctcttgct

SEQ ID NO: 137009 - DNA, 75 bp, Artificial Sequence
  Synthetic
ctgagagggcgtatgcgagcagcggggaggtggcggggtctcttggtgccggcgtcatagtgttcatcatgatgt

SEQ ID NO: 137010 - DNA, 75 bp, Artificial Sequence
  Synthetic
gtggagggtatccgctgaggagtatgttgaggtggtacgcgtgggagacagccattacgttgtgggggcgacagc

SEQ ID NO: 137011 - DNA, 75 bp, Artificial Sequence
  Synthetic
gcggggactggtcagcaccatgttcctgttcttggttaaaggatgtttgggattgggtctgtacggtattgtctg

SEQ ID NO: 137012 - DNA, 75 bp, Artificial Sequence
  Synthetic
aatctggaatacgagaccaacgttaccaacgacgaggatatgagaccttactgctggcattatccacccaagcca

SEQ ID NO: 137013 - DNA, 75 bp, Artificial Sequence
  Synthetic
gcctggcacatcaagggtcgaacggtccctctggctgcttactcgtaccttggcatgtggtccttttgccttcta

SEQ ID NO: 137014 - DNA, 75 bp, Artificial Sequence
  Synthetic
tcccttggaggtcagaggcagtcgggacgctataatcatccttgcggccctattccaccctcggcttgtttttga

SEQ ID NO: 137015 - DNA, 75 bp, Artificial Sequence
  Synthetic
ctcagggatgagataacattcagtgtggggctctccagctacgttgttgggtctcaattgccctgcgaccctgag

SEQ ID NO: 137016 - DNA, 75 bp, Artificial Sequence
  Synthetic
cgtgaactacaccacctgctcatgtggtgcaaacatcacaggccacgtaaagaatgggtcaatgaagatcgtagg

SEQ ID NO: 137017 - DNA, 75 bp, Artificial Sequence
  Synthetic
atacttggggggagaatgagaccgatgtgtttctgttgaacagcacgcgacctccgaggggagcctggttcggat

SEQ ID NO: 137018 - DNA, 75 bp, Artificial Sequence
  Synthetic
cggcttacaagatccttctttgccgcagcttatggtggttgtcctacttgctggtccaggcggaagccttgatcc

SEQ ID NO: 137019 - DNA, 75 bp, Artificial Sequence
  Synthetic
gtttgtgggttgctacgagggatgacccacggcaggtatttccagatggcccttctcaagcttggagccctgact

SEQ ID NO: 137020 - DNA, 75 bp, Artificial Sequence
  Synthetic
ctggtccaggcggaagccttgatccaagtgtgggtaccaccactgcaggcgcggggcggccgtgacggcatcata

SEQ ID NO: 137021 - DNA, 75 bp, Artificial Sequence
  Synthetic
ccagctcctcggctagccagctttccgcaccttctctcaaagccacctgtactacgggtggaattcacccagatg

SEQ ID NO: 137022 - DNA, 75 bp, Artificial Sequence
  Synthetic
ccagctcctcggctagccagctttccgcaccttctctcaaagccacctgtactacgggtggtattcacccagatg

SEQ ID NO: 137023 - DNA, 75 bp, Artificial Sequence
  Synthetic
ccagctcctcggctagccagctttccgcaccttctctcaaagccacctgtactacgggtggcattcacccagatg

SEQ ID NO: 137024 - DNA, 75 bp, Artificial Sequence
  Synthetic
ccagctcctcggctagccagctttccgcaccttctctcaaagccacctgtactacgggtgggattcacccagatg

SEQ ID NO: 137025 - DNA, 75 bp, Artificial Sequence
  Synthetic
ttgtggagggtctctgcggaggactacgttgaggtcgtgcgcgttaatgaccaccactacatagtgggggccact

SEQ ID NO: 137026 - DNA, 75 bp, Artificial Sequence
  Synthetic
tgactgcttcagaaagcaccccgaagccacttacatcagatgtggggctggaccgtggctaactcctaaatgctt

SEQ ID NO: 137027 - DNA, 75 bp, Artificial Sequence
  Synthetic
tggagaagaaagtgatagtctggggtgctgacacggcagcatgcggtgacatcgtgaaaggcttgcctgtctcag

SEQ ID NO: 137028 - DNA, 75 bp, Artificial Sequence
  Synthetic
ccctctagtcgccgaaaccgacgatagagagatctctgtggcggctgagtgccatagaccacctagaccgaagta

SEQ ID NO: 137029 - DNA, 75 bp, Artificial Sequence
  Synthetic
tcatgagggatgacataacattctcagtagggctctctacttacgtagtaggctctcagcttccctgcgaacctg

SEQ ID NO: 137030 - DNA, 75 bp, Artificial Sequence
  Synthetic
gcagcatgcaacttcacccgcggggatcgctgtaacttggaagacagagacaggggacagctaagcccactgcta

SEQ ID NO: 137031 - DNA, 75 bp, Artificial Sequence
  Synthetic
aggcttaatgggcaccattgtgaccagtctaacggggagagacgccaatgagatctgtggcgagattcaagtgtt

SEQ ID NO: 137032 - DNA, 75 bp, Artificial Sequence
  Synthetic
actgggctgctagtggactgcgcgaccttgcggtcgctgtagaacctgtcatattcagcccaatggagaagaaaa

SEQ ID NO: 137033 - DNA, 75 bp, Artificial Sequence
  Synthetic
cgcgacgaggaagacttccgaacggtcccagccacgtggaaggcgccagcccatcccaaaagatcggcgcaccac

SEQ ID NO: 137034 - DNA, 75 bp, Artificial Sequence
  Synthetic
gcgctcccccccaagagtgcaccgcccataccaccacctaggaagaagaggctcgtgcatcttgatgaatcatca

SEQ ID NO: 137035 - DNA, 75 bp, Artificial Sequence
  Synthetic
tgccagttcatctgcaagccagctgtctgctccatccttgaaagccacgtgtacaacggctggcaaacaccccga

SEQ ID NO: 137036 - DNA, 75 bp, Artificial Sequence
  Synthetic
agtacctgtacggcctatcaccggccattacaaagtacatagtcaaatgggaatgggtggtcctgctgtttctgc

SEQ ID NO: 137037 - DNA, 75 bp, Artificial Sequence
  Synthetic
cccgtcaaccaaatgtataccaatgttgaccaagacctggtgggttggccatccccccctggggctaagtctctg

SEQ ID NO: 137038 - DNA, 75 bp, Artificial Sequence
  Synthetic
gcgatgcaccatccgctgagagtgaagaagcagcatcagacgacggctcatacagctccatgcccccccttgagg

SEQ ID NO: 137039 - DNA, 75 bp, Artificial Sequence
  Synthetic
gatcccctgatagccgagacggacgacagggagatatccgtgggtgccgaatgtttcaacccccctcggccaaag

SEQ ID NO: 137040 - DNA, 75 bp, Artificial Sequence
  Synthetic
tgctgccagctctggaggcatattctggtttgccgtcttcttcatagccgcctggcatgtcaaaggccgcgccgt

SEQ ID NO: 137041 - DNA, 75 bp, Artificial Sequence
  Synthetic
tcgggggtcctgtggacggtcttccacggcgctgggaacaaaacgctggctggctctcgagggcctgtcacacag

SEQ ID NO: 137042 - DNA, 75 bp, Artificial Sequence
  Synthetic
gccccaggcccatcgcaacgcttaagggatcctcgggcggtccgctgctgtgccccctagggcacgccgtcggca

SEQ ID NO: 137043 - DNA, 75 bp, Artificial Sequence
  Synthetic
tctctgccgtacaagtcaagaacacgagcgagtcctatatggtgaccaacgattgctccaacagcagcatcgttt

SEQ ID NO: 137044 - DNA, 75 bp, Artificial Sequence
  Synthetic
gattccagtcactccatgcgccgctgaagaggagaagttgcctatcagtccgctgagcaattctctcatcagaca

SEQ ID NO: 137045 - DNA, 75 bp, Artificial Sequence
  Synthetic
gcgctttgcctcccaagggcttgcccccagtgccaccccctcggaaaaaaagagtagtgcagctcgacgaggggt

SEQ ID NO: 137046 - DNA, 75 bp, Artificial Sequence
  Synthetic
cagatcggggtgttcctgctgggcgtcatatccatcttcacgctcaccccagcttataagatcctccttacccgc

SEQ ID NO: 137047 - DNA, 75 bp, Artificial Sequence
  Synthetic
tcacccgaaatgccgacgtcatcccggcacggagacaaggagaccggcgaggagcgctgctctccccaaggcccc

SEQ ID NO: 137048 - DNA, 75 bp, Artificial Sequence
  Synthetic
caattccacccctccggctgttcctcagacttaccaggtcgcccatctgcacgcgcccacggggagcggcaagag

SEQ ID NO: 137049 - DNA, 75 bp, Artificial Sequence
  Synthetic
ggataccggtcacacccaacgtggccattagccaacccggtgccctcacaagggggctacggacgcacatcgaca

SEQ ID NO: 137050 - DNA, 75 bp, Artificial Sequence
  Synthetic
ggtagtggaccagcactaccaggatgtactttcggaggttaaggctcgggcaagaggggtgagcgctaggctcct

SEQ ID NO: 137051 - DNA, 75 bp, Artificial Sequence
  Synthetic
tgacatgacgcctcctcgcgaggaggctgacagggcttcagacgatggctcctacagctccatgccgcccttgga

SEQ ID NO: 137052 - DNA, 75 bp, Artificial Sequence
  Synthetic
gggccgcggtcatgttctgtccgggcgtggtgtttgaaatatccaagtggcttctggcaatcttgggacccggct

SEQ ID NO: 137053 - DNA, 75 bp, Artificial Sequence
  Synthetic
gtccatcgacttcatacccatcgagtcgctcgatgttatcatcaggtcccccaacttcactgacaacagtacacc

SEQ ID NO: 137054 - DNA, 75 bp, Artificial Sequence
  Synthetic
agattttcatcgtctcgccgcagcaccacacattcgtgcaggactgcaattgctccatatacccaggccacatta

SEQ ID NO: 137055 - DNA, 75 bp, Artificial Sequence
  Synthetic
gcgcacggcatcgacccgaacatacggtcgggtgctaggaccatcaccacaggcgcgcctatcacatactccacc

SEQ ID NO: 137056 - DNA, 75 bp, Artificial Sequence
  Synthetic
acaggtcgggccaggccacctacagctggggtgagaaagagaccgacgtcttcgtccttaacaacaccaggccgc

SEQ ID NO: 137057 - DNA, 75 bp, Artificial Sequence
  Synthetic
gtagcgggaagagcaccaaggtgcccgccgcttacgctgctcaggggtataaggtactagtactaaacccctctg

SEQ ID NO: 137058 - DNA, 75 bp, Artificial Sequence
  Synthetic
ggggcgctcatcacaccatgcgctgccgaggaggaaaagttgcctattagtccattgagcaacgccctcattcgc

SEQ ID NO: 137059 - DNA, 75 bp, Artificial Sequence
  Synthetic
cgtccaaatgatgctgataacccttggtagatggactggcacatacatctatgaccatctttctccaatgtcaaa

SEQ ID NO: 137060 - DNA, 75 bp, Artificial Sequence
  Synthetic
taggcaccgtcctagaccaagcagagaccagcggggtgcgcctcgtggtgctcgcaacagccacaccaccaggat

SEQ ID NO: 137061 - DNA, 75 bp, Artificial Sequence
  Synthetic
catcaccggaggacattggggtgtcatgtttggcttggcctatttttccatgcaaggggcgtgggcaaaggttat

SEQ ID NO: 137062 - DNA, 75 bp, Artificial Sequence
  Synthetic
tgtatgacatcacacagaagttgcccattgccgcaatgggcgacgcctatggtttccaatactcccccaaacagc

SEQ ID NO: 137063 - DNA, 75 bp, Artificial Sequence
  Synthetic
aaccacatcaactccgtgtgggaggacttgttggaagacaattctacacccatccctactaccataatggcaaag

SEQ ID NO: 137064 - DNA, 75 bp, Artificial Sequence
  Synthetic
tacatattccacctatggcaaattcctcgctgacggaggctgctcaggcggagcctatgacgtcataatatgcga

SEQ ID NO: 137065 - DNA, 75 bp, Artificial Sequence
  Synthetic
caggtggtcgaccaacactactatgatgttctcaaggagattaagaccaaggcttccggggttagcgcgaagctc

SEQ ID NO: 137066 - DNA, 75 bp, Artificial Sequence
  Synthetic
gcgtgtggtgacattctgcatggcctgcctgtttctgcccgcctgggtcatgaggtgttgttgggcccagccgac

SEQ ID NO: 137067 - DNA, 75 bp, Artificial Sequence
  Synthetic
aggtagacacctcatcttatgccattccaagaaaaagtgtgacgagttggttaaacagttatcagcccaaggcat

SEQ ID NO: 137068 - DNA, 75 bp, Artificial Sequence
  Synthetic
aggtagacacctcatcttttgccattccaagaaaaagtgtgacgagttggttaaacagttatcagcccaaggcat

SEQ ID NO: 137069 - DNA, 75 bp, Artificial Sequence
  Synthetic
aggtagacacctcatcttctgccattccaagaaaaagtgtgacgagttggttaaacagttatcagcccaaggcat

SEQ ID NO: 137070 - DNA, 75 bp, Artificial Sequence
  Synthetic
aggtagacacctcatcttgtgccattccaagaaaaagtgtgacgagttggttaaacagttatcagcccaaggcat

SEQ ID NO: 137071 - DNA, 75 bp, Artificial Sequence
  Synthetic
ggggccaaacagaacattcagctcatcaacaccaacggcagctggcacatcaaccgtacagctctgaactgtaat

SEQ ID NO: 137072 - DNA, 75 bp, Artificial Sequence
  Synthetic
tcggactgagggtgatatctaccagtgctgcgatttagatcctgcagcgcggaaggtcatcacatcactcacaga

SEQ ID NO: 137073 - DNA, 75 bp, Artificial Sequence
  Synthetic
taggctcacagtcttggccacggccacacctcctgggtctgtaacgaccccccaccctaacatagaggaggtagc

SEQ ID NO: 137074 - DNA, 75 bp, Artificial Sequence
  Synthetic
tcaaccacatcaactccgtgtgggaggacttgctggaagacaattctacaccaatacctactaccatcatggcca

SEQ ID NO: 137075 - DNA, 75 bp, Artificial Sequence
  Synthetic
ctcgctgacggaggctgctcaggcggagcctatgacgtcataatatgcgacgaatgccactcaaccgatgcaacc

SEQ ID NO: 137076 - DNA, 75 bp, Artificial Sequence
  Synthetic
gtgacaggacggaccatgctggggaagtccaagttctgtcaacagtcacccagtctttccttgggacatcaatat

SEQ ID NO: 137077 - DNA, 75 bp, Artificial Sequence
  Synthetic
ggcaacttcgactcagtaatagaatgcaacacatccgtcatacaaactgtggatttcggtttagaccccaccttc

SEQ ID NO: 137078 - DNA, 75 bp, Artificial Sequence
  Synthetic
ggcaacttcgactcagtaatagattgcaacacatccgtcatacaaactgtggatttcggtttagaccccaccttc

SEQ ID NO: 137079 - DNA, 75 bp, Artificial Sequence
  Synthetic
ggcaacttcgactcagtaatagactgcaacacatccgtcatacaaactgtggatttcggtttagaccccaccttc

SEQ ID NO: 137080 - DNA, 75 bp, Artificial Sequence
  Synthetic
ggcaacttcgactcagtaatagagtgcaacacatccgtcatacaaactgtggatttcggtttagaccccaccttc

SEQ ID NO: 137081 - DNA, 75 bp, Artificial Sequence
  Synthetic
acttccgcgttggatggggagccctagtgcacgaggacaacgttatcaacagtgatgacgcgaggccctactgct

SEQ ID NO: 137082 - DNA, 75 bp, Artificial Sequence
  Synthetic
actctgacctgctacattaaggcatgcgcagcgtgcaaggccgctgggatcagcaactatgacatgttggtgtgc

SEQ ID NO: 137083 - DNA, 75 bp, Artificial Sequence
  Synthetic
tgcgatgagctcgcagccgctctacggggcatgggcttaaacgcagttgcttactacagagggctcgacgtctcc

SEQ ID NO: 137084 - DNA, 75 bp, Artificial Sequence
  Synthetic
cctttatgacgtcacgcagaaattacccatcgcagtgatgggagcagcatatggtttccaatactctcccaagca

SEQ ID NO: 137085 - DNA, 75 bp, Artificial Sequence
  Synthetic
tgtggggtggcctagccctcctggtactaagtcactggacccctgcacatgtggtgctgtcgacctctaccttgt

SEQ ID NO: 137086 - DNA, 75 bp, Artificial Sequence
  Synthetic
caggtgaaagaccgtctggcatgtttgacacctctgttctttgtgaatgctatgacgcggggtgtgcttggtatg

SEQ ID NO: 137087 - DNA, 75 bp, Artificial Sequence
  Synthetic
ctgtgcccgcttcagcctaccaagtgcgcaactcctcggggctctaccatgtcaccaatgattgccccaactcga

SEQ ID NO: 137088 - DNA, 75 bp, Artificial Sequence
  Synthetic
gacagggtttactggggacttcgactcagtggtcgactgcaatgtcgcagtcacacagaccgttgacttcagttt

SEQ ID NO: 137089 - DNA, 75 bp, Artificial Sequence
  Synthetic
caagcgcggagtgcccacttactcctggggggagaatgagactgacgtcttcctactgaacagcacccgaccacc

SEQ ID NO: 137090 - DNA, 75 bp, Artificial Sequence
  Synthetic
ccggagacgtcccacatcctgagtacgatctcgagctgataacatcctgctcgtccaacgtttccgtggcacacg

SEQ ID NO: 137091 - DNA, 75 bp, Artificial Sequence
  Synthetic
tggatgaatagcactgggttcactaagacctgcggcgcaccaccctgtcgcattagggaagacttcaatgccagt

SEQ ID NO: 137092 - DNA, 75 bp, Artificial Sequence
  Synthetic
ggaccagtgctttgccccaggggccacgctgtgggaatcttccgagcggctgtatgctccagaggggtcgcaaag

SEQ ID NO: 137093 - DNA, 75 bp, Artificial Sequence
  Synthetic
gagcggctgtactgtggcgggcctatgtacaactcaagaggccagtcatgcggctaccgcaggtgtcgtgctagc

SEQ ID NO: 137094 - DNA, 75 bp, Artificial Sequence
  Synthetic
tacgggtttaacccatatagacgcccacttcctttcccagacgaagcagcagggtgaaaatttcccctacctggt

SEQ ID NO: 137095 - DNA, 75 bp, Artificial Sequence
  Synthetic
gttgggcaacattatcatgtacgcgcccgctatctgggtccgcatggtgatgatgacacatttctttgggatact

SEQ ID NO: 137096 - DNA, 75 bp, Artificial Sequence
  Synthetic
gttgggcaacattatcatgtacgcgcccgctatctgggtccgcttggtgatgatgacacatttctttgggatact

SEQ ID NO: 137097 - DNA, 75 bp, Artificial Sequence
  Synthetic
gttgggcaacattatcatgtacgcgcccgctatctgggtccgcctggtgatgatgacacatttctttgggatact

SEQ ID NO: 137098 - DNA, 75 bp, Artificial Sequence
  Synthetic
gttgggcaacattatcatgtacgcgcccgctatctgggtccgcgtggtgatgatgacacatttctttgggatact

SEQ ID NO: 137099 - DNA, 75 bp, Artificial Sequence
  Synthetic
aggcaggggtagattgggcatatacaggtacgtctcctctggagagcgagcctccggcatgttcgactccgtagt

SEQ ID NO: 137100 - DNA, 75 bp, Artificial Sequence
  Synthetic
tgtacaactcaagaggccagtcatgcggctaccgcaggtgtcgtgctagcggcgtgctcactaccagtctgggca

SEQ ID NO: 137101 - DNA, 75 bp, Artificial Sequence
  Synthetic
tagggtacctgcatgctcccaccggtagcgggaagagcactaaggtgccagccgcctatgcggctcaggggtaca

SEQ ID NO: 137102 - DNA, 75 bp, Artificial Sequence
  Synthetic
gcggagacgaccttgtggtcatttccgagagtatgggggtcgccgaggatgctagtgcactgagagctttcacgg

SEQ ID NO: 137103 - DNA, 75 bp, Artificial Sequence
  Synthetic
cccaccccccttctgtatagactgggggctgtgcagaacgaggtcacgctgacccatcccatcaccaaatacatc

SEQ ID NO: 137104 - DNA, 75 bp, Artificial Sequence
  Synthetic
cacggtatggccgctttctcgctacatgggtattcccctggtgagctcaatcgcgtggcatcaagcctcaggaag

SEQ ID NO: 137105 - DNA, 75 bp, Artificial Sequence
  Synthetic
cacggtttggccgctttctcgctacatgggtattcccctggtgagctcaatcgcgtggcatcaagcctcaggaag

SEQ ID NO: 137106 - DNA, 75 bp, Artificial Sequence
  Synthetic
cacggtctggccgctttctcgctacatgggtattcccctggtgagctcaatcgcgtggcatcaagcctcaggaag

SEQ ID NO: 137107 - DNA, 75 bp, Artificial Sequence
  Synthetic
cacggtgtggccgctttctcgctacatgggtattcccctggtgagctcaatcgcgtggcatcaagcctcaggaag

SEQ ID NO: 137108 - DNA, 75 bp, Artificial Sequence
  Synthetic
ttcaagatacggatgtatgtagggggagttgagcacaggctgcaagcagcctgcaatttcacccgcggggaccgc

SEQ ID NO: 137109 - DNA, 75 bp, Artificial Sequence
  Synthetic
tttgtgcgcgttcaaggccttctccggatctgcgcgctagcgcggaagatggccggaggccattacgtgcagatg

SEQ ID NO: 137110 - DNA, 75 bp, Artificial Sequence
  Synthetic
gtgtgtcaggaccacttggagttctgggaggcagtcttcactggcctcacacacatagatgcccacttcctctcc

SEQ ID NO: 137111 - DNA, 75 bp, Artificial Sequence
  Synthetic
gaccgtgacaactggagagtctatcacatactccacgtacggcaaattcctcgctgatggaggctgctcaggcgg

SEQ ID NO: 137112 - DNA, 75 bp, Artificial Sequence
  Synthetic
tgacggcgctgggcagagatattactacctcacacgagatccattgaccccattgtctcgggctgcctgggaaac

SEQ ID NO: 137113 - DNA, 75 bp, Artificial Sequence
  Synthetic
ggaaatgcctgatacgactcaagcccacgctcactggcccaacacctctactatatcgcttaggccctgtcacca

SEQ ID NO: 137114 - DNA, 75 bp, Artificial Sequence
  Synthetic
tcttcaactgggcggttaaaacaaaggtcaaactcactccactgcgcggcgctgccaacctggatttgtccggat

SEQ ID NO: 137115 - DNA, 75 bp, Artificial Sequence
  Synthetic
gcgtggtggtggtcggacgagtcatcctgtcgggacagcctgccatcataccggaccgcgaggcattataccagc

SEQ ID NO: 137116 - DNA, 75 bp, Artificial Sequence
  Synthetic
acgagaccactctcacacaccccatgaccaaatacatcgccacgtgcatgcaagctgacctcgaggtcatgacaa

SEQ ID NO: 137117 - DNA, 75 bp, Artificial Sequence
  Synthetic
tgtccaccggcctcctacacctccaccagaacatcgtggacgtgcagtacatgtatggtttgtcaccagccatca

SEQ ID NO: 137118 - DNA, 75 bp, Artificial Sequence
  Synthetic
aggctgacggtcctagccacggccacacctcctgggtctataacaaccccccatcccaatatagaagaggtggct

SEQ ID NO: 137119 - DNA, 75 bp, Artificial Sequence
  Synthetic
ctccaatcccaggaaatactccataaagcacttgacttcgacatgtacggagtcacatattccgtcactccactt

SEQ ID NO: 137120 - DNA, 75 bp, Artificial Sequence
  Synthetic
ggttgaagcagcattggagaaattaatcatcctgcacgcggctagcgccgctagctccaatggcttgctgtgctt

SEQ ID NO: 137121 - DNA, 75 bp, Artificial Sequence
  Synthetic
actcgccggcagccgggctcgggaggcgacgccggtggtggagtccaactttgccaagctcgaacaattctgggc

SEQ ID NO: 137122 - DNA, 75 bp, Artificial Sequence
  Synthetic
gaccataattgcccctgataaggaagtcctgtatgaggcgtttgatgagatggaggaatgcgcttccagggctct

SEQ ID NO: 137123 - DNA, 75 bp, Artificial Sequence
  Synthetic
gcccgaccccgcatctacctcttttgcctactcctgctcgtagcaggggtaggcatcttcctgcttcctgcccgg

SEQ ID NO: 137124 - DNA, 75 bp, Artificial Sequence
  Synthetic
cttcttgttctttgtggcggcctggtacatcaaaggccgggtggtccccctcaccacctattctttactaggctt

SEQ ID NO: 137125 - DNA, 75 bp, Artificial Sequence
  Synthetic
gcgacgagctcgcgactgcccttcggggcatgggcttaaacgcagttgcctattacagggggctcgacgtttccg

SEQ ID NO: 137126 - DNA, 75 bp, Artificial Sequence
  Synthetic
agcttggggcaccacccctaagagcctggaggcaccgagccagggcagtcagagctaagctcatcgcccaagggg

SEQ ID NO: 137127 - DNA, 75 bp, Artificial Sequence
  Synthetic
gccgtcaccagccccctcaccacgcagcagaccctcctattcaacatcttaggggggtgggttgcctcgcaaata

SEQ ID NO: 137128 - DNA, 75 bp, Artificial Sequence
  Synthetic
tgcaactgttccatctacccaggccatgtaacgggccaccgtatggcgtgggacatgatgatgaattggtcacct

SEQ ID NO: 137129 - DNA, 75 bp, Artificial Sequence
  Synthetic
gtacaagctacctggcccaagctagaacaattctgggccaagcacatgtggaacttcattagcggtatccagtat

SEQ ID NO: 137130 - DNA, 75 bp, Artificial Sequence
  Synthetic
aacaattctgggccaagcacatgtggaacttcattagcggtatccagtatctagcaggactttccacgttacctg

SEQ ID NO: 137131 - DNA, 75 bp, Artificial Sequence
  Synthetic
ggcccactggggagtcctggcgggccttgcctactattccatggtggggaactgggctaaggttctggttgtgat

SEQ ID NO: 137132 - DNA, 75 bp, Artificial Sequence
  Synthetic
cacccagtctgtagacttcagtttggaccctaccttcactataaccacacagactgtcccccaggacgctgtctc

SEQ ID NO: 137133 - DNA, 75 bp, Artificial Sequence
  Synthetic
gttacggtgccggcgtggccggtgccgtcgtcactttcaagatcatgagcggcgaggtcccaacgacagaggatt

SEQ ID NO: 137134 - DNA, 75 bp, Artificial Sequence
  Synthetic
caactacgcaacagggaatcttcccggttgctccttttctatctttctcttggcacttctctcgtgcctgacaac

SEQ ID NO: 137135 - DNA, 75 bp, Artificial Sequence
  Synthetic
actccatggtggcgaactgggcgaaggtcctgatcgtgttgctgctgttcactggcgtcgacgcgaggaccaggg

SEQ ID NO: 137136 - DNA, 75 bp, Artificial Sequence
  Synthetic
tatttgacatcaccaaatggcttttggcgatcctcggacctggctacctcctcagacatgtcctggcgactgtac

SEQ ID NO: 137137 - DNA, 75 bp, Artificial Sequence
  Synthetic
agcttcccaaatcgccccgcccgcgggggccaccggctttgtcgtaagcggcttagtaggggccgccgtgggcag

SEQ ID NO: 137138 - DNA, 75 bp, Artificial Sequence
  Synthetic
accggcgtccgcggtaaattaccggaacgcctcgggcgtctatcatatcaccaaagactgcccgaactccagcat

SEQ ID NO: 137139 - DNA, 75 bp, Artificial Sequence
  Synthetic
accggcgtccgcggtaaattaccggaacgcctcgggcgtctatcatatcaccaatgactgcccgaactccagcat

SEQ ID NO: 137140 - DNA, 75 bp, Artificial Sequence
  Synthetic
accggcgtccgcggtaaattaccggaacgcctcgggcgtctatcatatcaccaacgactgcccgaactccagcat

SEQ ID NO: 137141 - DNA, 75 bp, Artificial Sequence
  Synthetic
accggcgtccgcggtaaattaccggaacgcctcgggcgtctatcatatcaccaaggactgcccgaactccagcat

SEQ ID NO: 137142 - DNA, 75 bp, Artificial Sequence
  Synthetic
ctctgtgagtgctatgatgccggggctgcttggtatgagctcacgccggcggagactactgtcaggctcagggcg

SEQ ID NO: 137143 - DNA, 75 bp, Artificial Sequence
  Synthetic
tgtgcagtggatgaatcgcctcattgcattcgcctcgcgaggcaaccatgtgtccccgacgcactacgtcccaga

SEQ ID NO: 137144 - DNA, 75 bp, Artificial Sequence
  Synthetic
tataggtttgggtaaaatactggtggacgtcttggcaggctatggcgccggcatttcgggggctcttgtcgcatt

SEQ ID NO: 137145 - DNA, 75 bp, Artificial Sequence
  Synthetic
gcacgtcaacagaactgccctaaattgcaatgactcccttaataccgggttcatcgccgcgctgttatacacgcg

SEQ ID NO: 137146 - DNA, 75 bp, Artificial Sequence
  Synthetic
gcacgtcaacagaactgccctaaattgcaatgactcccttaataccgggttcatcgccgcgctgttttacacgcg

SEQ ID NO: 137147 - DNA, 75 bp, Artificial Sequence
  Synthetic
gcacgtcaacagaactgccctaaattgcaatgactcccttaataccgggttcatcgccgcgctgttctacacgcg

SEQ ID NO: 137148 - DNA, 75 bp, Artificial Sequence
  Synthetic
gcacgtcaacagaactgccctaaattgcaatgactcccttaataccgggttcatcgccgcgctgttgtacacgcg

SEQ ID NO: 137149 - DNA, 75 bp, Artificial Sequence
  Synthetic
ctggactggcacatacatttatgaccacctctcccctatgactgactgggctgctgccggcttacgagatctggc

SEQ ID NO: 137150 - DNA, 75 bp, Artificial Sequence
  Synthetic
gtagctgcgccctaccctaatgcaccactggagtccatgcgtaggcatgtagacttgatggtgggcgccgcgact

SEQ ID NO: 137151 - DNA, 75 bp, Artificial Sequence
  Synthetic
cacctctcccctatgactgactgggctgctgccggcttacgagatctggctgtcgccgtagagcccatagtcttc

SEQ ID NO: 137152 - DNA, 75 bp, Artificial Sequence
  Synthetic
aaacgaagcaggcgggggacaatttcccatacttagtggcttaccaagccacggtgtgtgctagggccaaggccc

SEQ ID NO: 137153 - DNA, 75 bp, Artificial Sequence
  Synthetic
ccctgtgacaccagctggttgcgggagatttgggattgggtctgtaccgtcctgagtgactttaaaacgtggctc

SEQ ID NO: 137154 - DNA, 75 bp, Artificial Sequence
  Synthetic
gagaggatggctagttgccggcccattacagactttgcccaagggtcgggccccatcacgtatgccaacgtcgac

SEQ ID NO: 137155 - DNA, 75 bp, Artificial Sequence
  Synthetic
gggccaaatgttctccttccaacctcgccgacattggactacccaggactgcaattgttccatctactccgggca

SEQ ID NO: 137156 - DNA, 75 bp, Artificial Sequence
  Synthetic
gctttgccgacctcatggggtacatacccgtcgtgggcgcgccagttggcggcgtcgccagagctctagcccatg

SEQ ID NO: 137157 - DNA, 75 bp, Artificial Sequence
  Synthetic
ttctactgggccctgcagacgagtacgtctccaggggatggaggctccttgctcccatcaccgcttatgctcagc

SEQ ID NO: 137158 - DNA, 75 bp, Artificial Sequence
  Synthetic
agaggcaatcatgtcgccccgactcactacgtggcggagtctgatgcgtcacagcgggtgacacagctacttggc

SEQ ID NO: 137159 - DNA, 75 bp, Artificial Sequence
  Synthetic
tgatgtcactcttacgcaccccgtaaccaagtacatcgccacgtgtatgcaggctgatcttgagatcatgactag

SEQ ID NO: 137160 - DNA, 75 bp, Artificial Sequence
  Synthetic
ggaggctccatgcctggattaccgaggactgcccaatcccatgcgctggctcttggcttcgcgacatatgggact

SEQ ID NO: 137161 - DNA, 75 bp, Artificial Sequence
  Synthetic
gcccctgcggcgcagacattgccggccacatcaaaaatggttcgatgaggatcgtcgggccaaggacttgcagta

SEQ ID NO: 137162 - DNA, 75 bp, Artificial Sequence
  Synthetic
gacatgttcgccggaggtcactggggggtcctagcaggactggcctttttctccatgcagggcaattgggctaaa

SEQ ID NO: 137163 - DNA, 75 bp, Artificial Sequence
  Synthetic
gggtctgcaccattctgactgacttcaagaattggctgtctaccaaactacttccaaaaatgcccggcctcccct

SEQ ID NO: 137164 - DNA, 75 bp, Artificial Sequence
  Synthetic
ctttcttggaacatcaatctcgggggtcctctggactgttttccatggtgctggaaacaaaacgctggctggctc

SEQ ID NO: 137165 - DNA, 75 bp, Artificial Sequence
  Synthetic
attcaactcttcaggctgtcccgagaggttggccagctgccgaccccttaccgactttgaccagggctggggccc

SEQ ID NO: 137166 - DNA, 75 bp, Artificial Sequence
  Synthetic
accgtagttgaccccgatagggaagtcttgtatgaagcgttcgatgagatggaggagtgcgcttccaggacagcc

SEQ ID NO: 137167 - DNA, 75 bp, Artificial Sequence
  Synthetic
accgtagttgaccccgatagggaagtcttgtatgaagcgttcgatgagatggaggagtgcgcttccaggactgcc

SEQ ID NO: 137168 - DNA, 75 bp, Artificial Sequence
  Synthetic
accgtagttgaccccgatagggaagtcttgtatgaagcgttcgatgagatggaggagtgcgcttccaggaccgcc

SEQ ID NO: 137169 - DNA, 75 bp, Artificial Sequence
  Synthetic
accgtagttgaccccgatagggaagtcttgtatgaagcgttcgatgagatggaggagtgcgcttccaggacggcc

SEQ ID NO: 137170 - DNA, 75 bp, Artificial Sequence
  Synthetic
accgtagttgaccccgatagggatgtcttgtatgaagcgttcgatgagatggaggagtgcgcttccaggacagcc

SEQ ID NO: 137171 - DNA, 75 bp, Artificial Sequence
  Synthetic
accgtagttgaccccgatagggatgtcttgtatgaagcgttcgatgagatggaggagtgcgcttccaggactgcc

SEQ ID NO: 137172 - DNA, 75 bp, Artificial Sequence
  Synthetic
accgtagttgaccccgatagggatgtcttgtatgaagcgttcgatgagatggaggagtgcgcttccaggaccgcc

SEQ ID NO: 137173 - DNA, 75 bp, Artificial Sequence
  Synthetic
accgtagttgaccccgatagggatgtcttgtatgaagcgttcgatgagatggaggagtgcgcttccaggacggcc

SEQ ID NO: 137174 - DNA, 75 bp, Artificial Sequence
  Synthetic
accgtagttgaccccgatagggacgtcttgtatgaagcgttcgatgagatggaggagtgcgcttccaggacagcc

SEQ ID NO: 137175 - DNA, 75 bp, Artificial Sequence
  Synthetic
accgtagttgaccccgatagggacgtcttgtatgaagcgttcgatgagatggaggagtgcgcttccaggactgcc

SEQ ID NO: 137176 - DNA, 75 bp, Artificial Sequence
  Synthetic
accgtagttgaccccgatagggacgtcttgtatgaagcgttcgatgagatggaggagtgcgcttccaggaccgcc

SEQ ID NO: 137177 - DNA, 75 bp, Artificial Sequence
  Synthetic
accgtagttgaccccgatagggacgtcttgtatgaagcgttcgatgagatggaggagtgcgcttccaggacggcc

SEQ ID NO: 137178 - DNA, 75 bp, Artificial Sequence
  Synthetic
accgtagttgaccccgatagggaggtcttgtatgaagcgttcgatgagatggaggagtgcgcttccaggacagcc

SEQ ID NO: 137179 - DNA, 75 bp, Artificial Sequence
  Synthetic
accgtagttgaccccgatagggaggtcttgtatgaagcgttcgatgagatggaggagtgcgcttccaggactgcc

SEQ ID NO: 137180 - DNA, 75 bp, Artificial Sequence
  Synthetic
accgtagttgaccccgatagggaggtcttgtatgaagcgttcgatgagatggaggagtgcgcttccaggaccgcc

SEQ ID NO: 137181 - DNA, 75 bp, Artificial Sequence
  Synthetic
accgtagttgaccccgatagggaggtcttgtatgaagcgttcgatgagatggaggagtgcgcttccaggacggcc

SEQ ID NO: 137182 - DNA, 75 bp, Artificial Sequence
  Synthetic
accgtagttgtccccgatagggaagtcttgtatgaagcgttcgatgagatggaggagtgcgcttccaggacagcc

SEQ ID NO: 137183 - DNA, 75 bp, Artificial Sequence
  Synthetic
accgtagttgtccccgatagggaagtcttgtatgaagcgttcgatgagatggaggagtgcgcttccaggactgcc

SEQ ID NO: 137184 - DNA, 75 bp, Artificial Sequence
  Synthetic
accgtagttgtccccgatagggaagtcttgtatgaagcgttcgatgagatggaggagtgcgcttccaggaccgcc

SEQ ID NO: 137185 - DNA, 75 bp, Artificial Sequence
  Synthetic
accgtagttgtccccgatagggaagtcttgtatgaagcgttcgatgagatggaggagtgcgcttccaggacggcc

SEQ ID NO: 137186 - DNA, 75 bp, Artificial Sequence
  Synthetic
accgtagttgtccccgatagggatgtcttgtatgaagcgttcgatgagatggaggagtgcgcttccaggacagcc

SEQ ID NO: 137187 - DNA, 75 bp, Artificial Sequence
  Synthetic
accgtagttgtccccgatagggatgtcttgtatgaagcgttcgatgagatggaggagtgcgcttccaggactgcc

SEQ ID NO: 137188 - DNA, 75 bp, Artificial Sequence
  Synthetic
accgtagttgtccccgatagggatgtcttgtatgaagcgttcgatgagatggaggagtgcgcttccaggaccgcc

SEQ ID NO: 137189 - DNA, 75 bp, Artificial Sequence
  Synthetic
accgtagttgtccccgatagggatgtcttgtatgaagcgttcgatgagatggaggagtgcgcttccaggacggcc

SEQ ID NO: 137190 - DNA, 75 bp, Artificial Sequence
  Synthetic
accgtagttgtccccgatagggacgtcttgtatgaagcgttcgatgagatggaggagtgcgcttccaggacagcc

SEQ ID NO: 137191 - DNA, 75 bp, Artificial Sequence
  Synthetic
accgtagttgtccccgatagggacgtcttgtatgaagcgttcgatgagatggaggagtgcgcttccaggactgcc

SEQ ID NO: 137192 - DNA, 75 bp, Artificial Sequence
  Synthetic
accgtagttgtccccgatagggacgtcttgtatgaagcgttcgatgagatggaggagtgcgcttccaggaccgcc

SEQ ID NO: 137193 - DNA, 75 bp, Artificial Sequence
  Synthetic
accgtagttgtccccgatagggacgtcttgtatgaagcgttcgatgagatggaggagtgcgcttccaggacggcc

SEQ ID NO: 137194 - DNA, 75 bp, Artificial Sequence
  Synthetic
accgtagttgtccccgatagggaggtcttgtatgaagcgttcgatgagatggaggagtgcgcttccaggacagcc

SEQ ID NO: 137195 - DNA, 75 bp, Artificial Sequence
  Synthetic
accgtagttgtccccgatagggaggtcttgtatgaagcgttcgatgagatggaggagtgcgcttccaggactgcc

SEQ ID NO: 137196 - DNA, 75 bp, Artificial Sequence
  Synthetic
accgtagttgtccccgatagggaggtcttgtatgaagcgttcgatgagatggaggagtgcgcttccaggaccgcc

SEQ ID NO: 137197 - DNA, 75 bp, Artificial Sequence
  Synthetic
accgtagttgtccccgatagggaggtcttgtatgaagcgttcgatgagatggaggagtgcgcttccaggacggcc

SEQ ID NO: 137198 - DNA, 75 bp, Artificial Sequence
  Synthetic
accgtagttgcccccgatagggaagtcttgtatgaagcgttcgatgagatggaggagtgcgcttccaggacagcc

SEQ ID NO: 137199 - DNA, 75 bp, Artificial Sequence
  Synthetic
accgtagttgcccccgatagggaagtcttgtatgaagcgttcgatgagatggaggagtgcgcttccaggactgcc

SEQ ID NO: 137200 - DNA, 75 bp, Artificial Sequence
  Synthetic
accgtagttgcccccgatagggaagtcttgtatgaagcgttcgatgagatggaggagtgcgcttccaggaccgcc

SEQ ID NO: 137201 - DNA, 75 bp, Artificial Sequence
  Synthetic
accgtagttgcccccgatagggaagtcttgtatgaagcgttcgatgagatggaggagtgcgcttccaggacggcc

SEQ ID NO: 137202 - DNA, 75 bp, Artificial Sequence
  Synthetic
accgtagttgcccccgatagggatgtcttgtatgaagcgttcgatgagatggaggagtgcgcttccaggacagcc

SEQ ID NO: 137203 - DNA, 75 bp, Artificial Sequence
  Synthetic
accgtagttgcccccgatagggatgtcttgtatgaagcgttcgatgagatggaggagtgcgcttccaggactgcc

SEQ ID NO: 137204 - DNA, 75 bp, Artificial Sequence
  Synthetic
accgtagttgcccccgatagggatgtcttgtatgaagcgttcgatgagatggaggagtgcgcttccaggaccgcc

SEQ ID NO: 137205 - DNA, 75 bp, Artificial Sequence
  Synthetic
accgtagttgcccccgatagggatgtcttgtatgaagcgttcgatgagatggaggagtgcgcttccaggacggcc

SEQ ID NO: 137206 - DNA, 75 bp, Artificial Sequence
  Synthetic
accgtagttgcccccgatagggacgtcttgtatgaagcgttcgatgagatggaggagtgcgcttccaggacagcc

SEQ ID NO: 137207 - DNA, 75 bp, Artificial Sequence
  Synthetic
accgtagttgcccccgatagggacgtcttgtatgaagcgttcgatgagatggaggagtgcgcttccaggactgcc

SEQ ID NO: 137208 - DNA, 75 bp, Artificial Sequence
  Synthetic
accgtagttgcccccgatagggacgtcttgtatgaagcgttcgatgagatggaggagtgcgcttccaggaccgcc

SEQ ID NO: 137209 - DNA, 75 bp, Artificial Sequence
  Synthetic
accgtagttgcccccgatagggacgtcttgtatgaagcgttcgatgagatggaggagtgcgcttccaggacggcc

SEQ ID NO: 137210 - DNA, 75 bp, Artificial Sequence
  Synthetic
accgtagttgcccccgatagggaggtcttgtatgaagcgttcgatgagatggaggagtgcgcttccaggacagcc

SEQ ID NO: 137211 - DNA, 75 bp, Artificial Sequence
  Synthetic
accgtagttgcccccgatagggaggtcttgtatgaagcgttcgatgagatggaggagtgcgcttccaggactgcc

SEQ ID NO: 137212 - DNA, 75 bp, Artificial Sequence
  Synthetic
accgtagttgcccccgatagggaggtcttgtatgaagcgttcgatgagatggaggagtgcgcttccaggaccgcc

SEQ ID NO: 137213 - DNA, 75 bp, Artificial Sequence
  Synthetic
accgtagttgcccccgatagggaggtcttgtatgaagcgttcgatgagatggaggagtgcgcttccaggacggcc

SEQ ID NO: 137214 - DNA, 75 bp, Artificial Sequence
  Synthetic
accgtagttggccccgatagggaagtcttgtatgaagcgttcgatgagatggaggagtgcgcttccaggacagcc

SEQ ID NO: 137215 - DNA, 75 bp, Artificial Sequence
  Synthetic
accgtagttggccccgatagggaagtcttgtatgaagcgttcgatgagatggaggagtgcgcttccaggactgcc

SEQ ID NO: 137216 - DNA, 75 bp, Artificial Sequence
  Synthetic
accgtagttggccccgatagggaagtcttgtatgaagcgttcgatgagatggaggagtgcgcttccaggaccgcc

SEQ ID NO: 137217 - DNA, 75 bp, Artificial Sequence
  Synthetic
accgtagttggccccgatagggaagtcttgtatgaagcgttcgatgagatggaggagtgcgcttccaggacggcc

SEQ ID NO: 137218 - DNA, 75 bp, Artificial Sequence
  Synthetic
accgtagttggccccgatagggatgtcttgtatgaagcgttcgatgagatggaggagtgcgcttccaggacagcc

SEQ ID NO: 137219 - DNA, 75 bp, Artificial Sequence
  Synthetic
accgtagttggccccgatagggatgtcttgtatgaagcgttcgatgagatggaggagtgcgcttccaggactgcc

SEQ ID NO: 137220 - DNA, 75 bp, Artificial Sequence
  Synthetic
accgtagttggccccgatagggatgtcttgtatgaagcgttcgatgagatggaggagtgcgcttccaggaccgcc

SEQ ID NO: 137221 - DNA, 75 bp, Artificial Sequence
  Synthetic
accgtagttggccccgatagggatgtcttgtatgaagcgttcgatgagatggaggagtgcgcttccaggacggcc

SEQ ID NO: 137222 - DNA, 75 bp, Artificial Sequence
  Synthetic
accgtagttggccccgatagggacgtcttgtatgaagcgttcgatgagatggaggagtgcgcttccaggacagcc

SEQ ID NO: 137223 - DNA, 75 bp, Artificial Sequence
  Synthetic
accgtagttggccccgatagggacgtcttgtatgaagcgttcgatgagatggaggagtgcgcttccaggactgcc

SEQ ID NO: 137224 - DNA, 75 bp, Artificial Sequence
  Synthetic
accgtagttggccccgatagggacgtcttgtatgaagcgttcgatgagatggaggagtgcgcttccaggaccgcc

SEQ ID NO: 137225 - DNA, 75 bp, Artificial Sequence
  Synthetic
accgtagttggccccgatagggacgtcttgtatgaagcgttcgatgagatggaggagtgcgcttccaggacggcc

SEQ ID NO: 137226 - DNA, 75 bp, Artificial Sequence
  Synthetic
accgtagttggccccgatagggaggtcttgtatgaagcgttcgatgagatggaggagtgcgcttccaggacagcc

SEQ ID NO: 137227 - DNA, 75 bp, Artificial Sequence
  Synthetic
accgtagttggccccgatagggaggtcttgtatgaagcgttcgatgagatggaggagtgcgcttccaggactgcc

SEQ ID NO: 137228 - DNA, 75 bp, Artificial Sequence
  Synthetic
accgtagttggccccgatagggaggtcttgtatgaagcgttcgatgagatggaggagtgcgcttccaggaccgcc

SEQ ID NO: 137229 - DNA, 75 bp, Artificial Sequence
  Synthetic
accgtagttggccccgatagggaggtcttgtatgaagcgttcgatgagatggaggagtgcgcttccaggacggcc

SEQ ID NO: 137230 - DNA, 75 bp, Artificial Sequence
  Synthetic
catcgggggatggggcgacaacaacactttgacttgccctactgattgcttccgcaaacatccggaggctactta

SEQ ID NO: 137231 - DNA, 75 bp, Artificial Sequence
  Synthetic
cgaagagtacgtggaggtgaggagagtgggcgacttccactatatcaccggcatgacgcaagacaacatcaaatg

SEQ ID NO: 137232 - DNA, 75 bp, Artificial Sequence
  Synthetic
gtccgggggccaagcagaatatccagctcatctacaccaacgggagttggcatgtcaacaggaccgcactcaatt

SEQ ID NO: 137233 - DNA, 75 bp, Artificial Sequence
  Synthetic
gtccgggggccaagcagaatttccagctcatctacaccaacgggagttggcatgtcaacaggaccgcactcaatt

SEQ ID NO: 137234 - DNA, 75 bp, Artificial Sequence
  Synthetic
gtccgggggccaagcagaatctccagctcatctacaccaacgggagttggcatgtcaacaggaccgcactcaatt

SEQ ID NO: 137235 - DNA, 75 bp, Artificial Sequence
  Synthetic
gtccgggggccaagcagaatgtccagctcatctacaccaacgggagttggcatgtcaacaggaccgcactcaatt

SEQ ID NO: 137236 - DNA, 75 bp, Artificial Sequence
  Synthetic
cggctccatgagaataaccggacctaagacctgcatgaatacctggcaggggaccttccccatcaactgctacac

SEQ ID NO: 137237 - DNA, 75 bp, Artificial Sequence
  Synthetic
gctgttgatctctacctcgtcactcggaatgccgatgtcatcccggtccggaggcggggagaccgccggggagca

SEQ ID NO: 137238 - DNA, 75 bp, Artificial Sequence
  Synthetic
aagacctgcatgaatacctggcaggggaccttccccatcaactgctacacagagggccaatgcgtaccacagccc

SEQ ID NO: 137239 - DNA, 75 bp, Artificial Sequence
  Synthetic
ttcatgccacttggcccaagctggaacagttctgggcaaaacacatgtggaacttcatcagcggcatccagtact

SEQ ID NO: 137240 - DNA, 75 bp, Artificial Sequence
  Synthetic
aaggtccggatgtatgtgggcggggtggagcacaggctggaagccgcgtgcaactggacccgaggggagcgctgc

SEQ ID NO: 137241 - DNA, 75 bp, Artificial Sequence
  Synthetic
tcgttcagcgtggggcttaacacgtttgtagtaggctctcagctcccctgtgagccggagccggatgtgcatgtc

SEQ ID NO: 137242 - DNA, 75 bp, Artificial Sequence
  Synthetic
aaattcaactcctccggttgcccccaaaggctcgcctcgtgcaagaggttgagagactttgatcaaggctggggg

SEQ ID NO: 137243 - DNA, 75 bp, Artificial Sequence
  Synthetic
aaattcaactcctccggttgcccccaaaggctcgcctcgtgcaagaggttgagtgactttgatcaaggctggggg

SEQ ID NO: 137244 - DNA, 75 bp, Artificial Sequence
  Synthetic
aaattcaactcctccggttgcccccaaaggctcgcctcgtgcaagaggttgagcgactttgatcaaggctggggg

SEQ ID NO: 137245 - DNA, 75 bp, Artificial Sequence
  Synthetic
aaattcaactcctccggttgcccccaaaggctcgcctcgtgcaagaggttgagggactttgatcaaggctggggg

SEQ ID NO: 137246 - DNA, 75 bp, Artificial Sequence
  Synthetic
acctatgtgacagggttgacagacgacaacctcaaagtcccctgtcagttgccagcaccagagttcttctcctgg

SEQ ID NO: 137247 - DNA, 75 bp, Artificial Sequence
  Synthetic
ctgctctctccgcggcccttgtcatctcttaaggggtcgtcgggcgggccggttctctgccccagggggcacgca

SEQ ID NO: 137248 - DNA, 75 bp, Artificial Sequence
  Synthetic
cctgaacatcatggggggctggttggcttcccagattgcgccgcccgcgggggccactggctttgtcgtcagtgg

SEQ ID NO: 137249 - DNA, 75 bp, Artificial Sequence
  Synthetic
tcactgacaacagcacgcctccagctgtgccccagacctaccaggtggggtacttgcacgctcccaccggcagtg

SEQ ID NO: 137250 - DNA, 75 bp, Artificial Sequence
  Synthetic
gtggccccgtgtactgcttcacacccagtcccgtagtggtcggtactaccgatcgcttagggcaccccacgtaca

SEQ ID NO: 137251 - DNA, 75 bp, Artificial Sequence
  Synthetic
ccacaggcctaatccacctccaccaaaacatcgtggatatacagtacctgtatggagtagggtcggcagttgtga

SEQ ID NO: 137252 - DNA, 75 bp, Artificial Sequence
  Synthetic
gccagctctccgctccgtctcttaaagctacttgcaccgctcaccatgattctcctgacgccgacctcattgaag

SEQ ID NO: 137253 - DNA, 75 bp, Artificial Sequence
  Synthetic
gtggatggagtccaaatccacaggtttgctcccgttccaaagccgttcattagggatgaggtctcgtttaccgtg

SEQ ID NO: 137254 - DNA, 75 bp, Artificial Sequence
  Synthetic
cagtcccgtagtggtcggtactaccgatcgcttagggcaccccacgtacagctggggggaaaatgagactgatgt

SEQ ID NO: 137255 - DNA, 75 bp, Artificial Sequence
  Synthetic
aagatcatgtccggcgagaagccttccgtggaggatgtcgtcaatctgctacctgggatcctgtctcccggtgcg

SEQ ID NO: 137256 - DNA, 75 bp, Artificial Sequence
  Synthetic
cggaggcagcggctaggcgcttagcacgaggctcgcctccatccgaggccagctcctctgcgagtcaactttcag

SEQ ID NO: 137257 - DNA, 75 bp, Artificial Sequence
  Synthetic
ggaagcggctctggagaacctggtggtattgaacgcagcgtccctcgccgggacgcacggcgtcattcccttcct

SEQ ID NO: 137258 - DNA, 75 bp, Artificial Sequence
  Synthetic
gggaatgcccaaccgattgcttcaggaaacatccggatgcgacctacgccaagtgcgggtcaggaccctggctta

SEQ ID NO: 137259 - DNA, 75 bp, Artificial Sequence
  Synthetic
gggaatgcccaaccgattgcttcaggaaacatccggatgcgacctacgccaagtgcgggtcaggtccctggctta

SEQ ID NO: 137260 - DNA, 75 bp, Artificial Sequence
  Synthetic
gggaatgcccaaccgattgcttcaggaaacatccggatgcgacctacgccaagtgcgggtcaggcccctggctta

SEQ ID NO: 137261 - DNA, 75 bp, Artificial Sequence
  Synthetic
gggaatgcccaaccgattgcttcaggaaacatccggatgcgacctacgccaagtgcgggtcagggccctggctta

SEQ ID NO: 137262 - DNA, 75 bp, Artificial Sequence
  Synthetic
ctccacttatggcaaatttctcgcagatggaggctgctctgggggagcctatgacatcataatatgcgatgaatg

SEQ ID NO: 137263 - DNA, 75 bp, Artificial Sequence
  Synthetic
gcgctgtggagggtgtctgcggaggaatacgtggaaataaggcaggtgggggacttccactacgtgacgggtatg

SEQ ID NO: 137264 - DNA, 75 bp, Artificial Sequence
  Synthetic
gccggacgatgttgagatctccacggccgcagaagttatgcgccgtgtcaaaaagtttccgccggccctgccgat

SEQ ID NO: 137265 - DNA, 75 bp, Artificial Sequence
  Synthetic
gaggtaaccatgttgccccaacccattacgtggcggaatctgacgcgtcgcagcgagtcacacaactactcggtt

SEQ ID NO: 137266 - DNA, 75 bp, Artificial Sequence
  Synthetic
ttgcctcaaagggcatacgcagcagaccgggaagtagccgcatcctgtggcggtgctgtcctcgtttgccttatg

SEQ ID NO: 137267 - DNA, 75 bp, Artificial Sequence
  Synthetic
ccagcccccgtgcctcctccgaggaggaaacgggttgtcgcgctgtctgaatcaaacgtttccagcgcgctggca

SEQ ID NO: 137268 - DNA, 75 bp, Artificial Sequence
  Synthetic
ggtggtcctggcaacagcgacgccacccggctccgtgaccactccacacccgaatatagaggaagtggctctcgg

SEQ ID NO: 137269 - DNA, 75 bp, Artificial Sequence
  Synthetic
gtgtggatcccccccctcaacgttcgggggggccgcgatgccatcatcctcctcacgtgcgcggtccacccagag

SEQ ID NO: 137270 - DNA, 75 bp, Artificial Sequence
  Synthetic
acatcggctcgacgcggcgtgcaactggaccaggggggagccctgcggactcgaggatagagaccgcacggagtt

SEQ ID NO: 137271 - DNA, 75 bp, Artificial Sequence
  Synthetic
gtccccactgctcctatccactacccagtggcaggtgcttccttgctctttcacgactctcccggccctatcaac

SEQ ID NO: 137272 - DNA, 75 bp, Artificial Sequence
  Synthetic
ggtttgcatcatcctgaccgactttaagaactggctgtcctcaaagttgtttccaaaattgcccgggattccctt

SEQ ID NO: 137273 - DNA, 75 bp, Artificial Sequence
  Synthetic
ctgggtgtgctctccccccccggactatggccccaacgcccccgcccaggaggcgacgggtcgtagccctgaacc

SEQ ID NO: 137274 - DNA, 75 bp, Artificial Sequence
  Synthetic
acgatagatctgatgacgggtccttctcgtcgatgcctccgctcgagggggaaccgggtgatcctgatctgactt

SEQ ID NO: 137275 - DNA, 75 bp, Artificial Sequence
  Synthetic
cttgcgttcctgctgctcgcagacgccagggtctgcgcctgcctctggatgatgttgctagtgtcgcaagtcgag

SEQ ID NO: 137276 - DNA, 75 bp, Artificial Sequence
  Synthetic
cttgcgttcctgctgctcgcagacgccagggtctgcgcctgcctctggatgatgttgcttgtgtcgcaagtcgag

SEQ ID NO: 137277 - DNA, 75 bp, Artificial Sequence
  Synthetic
cttgcgttcctgctgctcgcagacgccagggtctgcgcctgcctctggatgatgttgctcgtgtcgcaagtcgag

SEQ ID NO: 137278 - DNA, 75 bp, Artificial Sequence
  Synthetic
cttgcgttcctgctgctcgcagacgccagggtctgcgcctgcctctggatgatgttgctggtgtcgcaagtcgag

SEQ ID NO: 137279 - DNA, 75 bp, Artificial Sequence
  Synthetic
ccagcccaaggagatgtggtggttgtcgccacggatgcccttatgacggggtacactggtgacttcgactctgta

SEQ ID NO: 137280 - DNA, 75 bp, Artificial Sequence
  Synthetic
ggctctatgagaataacggggcctaagacctgtatgaacacctggcagggaacgttccccatcaattgttacaca

SEQ ID NO: 137281 - DNA, 75 bp, Artificial Sequence
  Synthetic
cgatgctgctgaccagccagctttagaggaaaccgccgactcagaagcaggctctgattcctccatgcctcccct

SEQ ID NO: 137282 - DNA, 75 bp, Artificial Sequence
  Synthetic
gccaaaactaccaatcagcccactgagcaactctctgttgcgtcaccacaacatggtgtacgctacgacgtcacg

SEQ ID NO: 137283 - DNA, 75 bp, Artificial Sequence
  Synthetic
acttcgtgcgcgcccaaggccttatccgcatgtgcatgttggcgcgcaagcttgtggggggccattacgtgcaaa

SEQ ID NO: 137284 - DNA, 75 bp, Artificial Sequence
  Synthetic
caccttcaccataaccacacaaactgtccctcaagatgctgtgtctcgcagccaacgtcgaggaaggacgggcag

SEQ ID NO: 137285 - DNA, 75 bp, Artificial Sequence
  Synthetic
tcaacgccatgtcggccgctggaacgtatgggctcccctatgctctcctcttcttttgcgtagcttggtacatca

SEQ ID NO: 137286 - DNA, 75 bp, Artificial Sequence
  Synthetic
cctatgtaacggggttaacagatgacaacttgaaagtcccttgtcagctgccagcaccagaattcctctcctggg

SEQ ID NO: 137287 - DNA, 75 bp, Artificial Sequence
  Synthetic
tgggccacatgttctgaggaggagggttccgaagtctgctgctccatgtcctactcctggaccggggcgctaata

SEQ ID NO: 137288 - DNA, 75 bp, Artificial Sequence
  Synthetic
gtcaccttcgaccgactccaagtggtcgacgaccactatcatgctacactaaaggagatcaaggcacgagcatct

SEQ ID NO: 137289 - DNA, 75 bp, Artificial Sequence
  Synthetic
agaagtcgcaggatccctcggcggagccgtcatctgtttattaaccatcttgacgctgtccccgtggtacaagcg

SEQ ID NO: 137290 - DNA, 75 bp, Artificial Sequence
  Synthetic
gcctatcccgcaaggccattgaccacatcaactccgtgtgggaggacttgcgggaagactctgtcacccccatcg

SEQ ID NO: 137291 - DNA, 75 bp, Artificial Sequence
  Synthetic
acagttgccttgtgaacctgagcctgacacggaggtgttggcgtcgatgctaacagacccatctcatattacggc

SEQ ID NO: 137292 - DNA, 75 bp, Artificial Sequence
  Synthetic
cttcacaacgggctaaaaaggtaacttttgacagggtgcagctacttgactcccattatgaccaagtcttgaagg

SEQ ID NO: 137293 - DNA, 75 bp, Artificial Sequence
  Synthetic
aggctcttctgaatgtctacatcccgcccctagaagttaggggcggccgagattccctgatcatcctcgcggcct

SEQ ID NO: 137294 - DNA, 75 bp, Artificial Sequence
  Synthetic
aggctcttctgaatgtctacttcccgcccctagaagttaggggcggccgagattccctgatcatcctcgcggcct

SEQ ID NO: 137295 - DNA, 75 bp, Artificial Sequence
  Synthetic
aggctcttctgaatgtctacctcccgcccctagaagttaggggcggccgagattccctgatcatcctcgcggcct

SEQ ID NO: 137296 - DNA, 75 bp, Artificial Sequence
  Synthetic
aggctcttctgaatgtctacgtcccgcccctagaagttaggggcggccgagattccctgatcatcctcgcggcct

SEQ ID NO: 137297 - DNA, 75 bp, Artificial Sequence
  Synthetic
aggctcttctgtatgtctacatcccgcccctagaagttaggggcggccgagattccctgatcatcctcgcggcct

SEQ ID NO: 137298 - DNA, 75 bp, Artificial Sequence
  Synthetic
aggctcttctgtatgtctacttcccgcccctagaagttaggggcggccgagattccctgatcatcctcgcggcct

SEQ ID NO: 137299 - DNA, 75 bp, Artificial Sequence
  Synthetic
aggctcttctgtatgtctacctcccgcccctagaagttaggggcggccgagattccctgatcatcctcgcggcct

SEQ ID NO: 137300 - DNA, 75 bp, Artificial Sequence
  Synthetic
aggctcttctgtatgtctacgtcccgcccctagaagttaggggcggccgagattccctgatcatcctcgcggcct

SEQ ID NO: 137301 - DNA, 75 bp, Artificial Sequence
  Synthetic
aggctcttctgcatgtctacatcccgcccctagaagttaggggcggccgagattccctgatcatcctcgcggcct

SEQ ID NO: 137302 - DNA, 75 bp, Artificial Sequence
  Synthetic
aggctcttctgcatgtctacttcccgcccctagaagttaggggcggccgagattccctgatcatcctcgcggcct

SEQ ID NO: 137303 - DNA, 75 bp, Artificial Sequence
  Synthetic
aggctcttctgcatgtctacctcccgcccctagaagttaggggcggccgagattccctgatcatcctcgcggcct

SEQ ID NO: 137304 - DNA, 75 bp, Artificial Sequence
  Synthetic
aggctcttctgcatgtctacgtcccgcccctagaagttaggggcggccgagattccctgatcatcctcgcggcct

SEQ ID NO: 137305 - DNA, 75 bp, Artificial Sequence
  Synthetic
aggctcttctggatgtctacatcccgcccctagaagttaggggcggccgagattccctgatcatcctcgcggcct

SEQ ID NO: 137306 - DNA, 75 bp, Artificial Sequence
  Synthetic
aggctcttctggatgtctacttcccgcccctagaagttaggggcggccgagattccctgatcatcctcgcggcct

SEQ ID NO: 137307 - DNA, 75 bp, Artificial Sequence
  Synthetic
aggctcttctggatgtctacctcccgcccctagaagttaggggcggccgagattccctgatcatcctcgcggcct

SEQ ID NO: 137308 - DNA, 75 bp, Artificial Sequence
  Synthetic
aggctcttctggatgtctacgtcccgcccctagaagttaggggcggccgagattccctgatcatcctcgcggcct

SEQ ID NO: 137309 - DNA, 75 bp, Artificial Sequence
  Synthetic
ttttgacagggtgcagctacttgactcccattatgaccaagtcttgaaggacattaagctagccgcctctaaagt

SEQ ID NO: 137310 - DNA, 75 bp, Artificial Sequence
  Synthetic
gatcacgaaacatctgctggccatcatgggaccgctttacgtgctgcaggcctccctcctacgcattccctactt

SEQ ID NO: 137311 - DNA, 75 bp, Artificial Sequence
  Synthetic
gatcacgaaacatctgctggccatcttgggaccgctttacgtgctgcaggcctccctcctacgcattccctactt

SEQ ID NO: 137312 - DNA, 75 bp, Artificial Sequence
  Synthetic
gatcacgaaacatctgctggccatcctgggaccgctttacgtgctgcaggcctccctcctacgcattccctactt

SEQ ID NO: 137313 - DNA, 75 bp, Artificial Sequence
  Synthetic
gatcacgaaacatctgctggccatcgtgggaccgctttacgtgctgcaggcctccctcctacgcattccctactt

SEQ ID NO: 137314 - DNA, 75 bp, Artificial Sequence
  Synthetic
ggtatgcgagaagcgggcactttacaacgtcatccagaagctccctcaggccatcatgggggaagcttacggctt

SEQ ID NO: 137315 - DNA, 75 bp, Artificial Sequence
  Synthetic
acccatccaaaaggctacgacattgacatggtagatgccagcctcttcatggggagtgacgtcactcggatagaa

SEQ ID NO: 137316 - DNA, 75 bp, Artificial Sequence
  Synthetic
agtccgtgtgggaagacctcctggaagaccaacaatcaccaattcctacaaccatcatggccaagaatgaggtgt

SEQ ID NO: 137317 - DNA, 75 bp, Artificial Sequence
  Synthetic
ggcacgtatgtgtatgaccatctcactccgttgtcggattgggctgccgatggcctgaaggacctagcggtggcc

SEQ ID NO: 137318 - DNA, 75 bp, Artificial Sequence
  Synthetic
gggtcctcgcgggaggggtgttggccgccgtagctgcctactgtctagcgaccggctgtgttgtcatcattggtc

SEQ ID NO: 137319 - DNA, 75 bp, Artificial Sequence
  Synthetic
agaagtttccaactgcactacccccctgggcgaggcctgattacaatccgccactcgtggaaacttggaaaaggc

SEQ ID NO: 137320 - DNA, 75 bp, Artificial Sequence
  Synthetic
acggtgactgaaagggacatacaggtagaggaggagatctaccagtgttgtgacctggatcccgagacccgcaag

SEQ ID NO: 137321 - DNA, 75 bp, Artificial Sequence
  Synthetic
ctagactgggcaatgagatactgctcggtcctgcggacggcgagcgcgcgaaggggtggaggcttctcgctccca

SEQ ID NO: 137322 - DNA, 75 bp, Artificial Sequence
  Synthetic
cctcctacgagcgtggaaggaaaagaaagaccctatgggtttttcgtatgatacccgctgttttgactcaacagt

SEQ ID NO: 137323 - DNA, 75 bp, Artificial Sequence
  Synthetic
gagcaacgtgggggaagctctccaggagctggccatcaagagctttggccaacccccccccagcggtgactcagg

SEQ ID NO: 137324 - DNA, 75 bp, Artificial Sequence
  Synthetic
cgaggaggggcagcgaatagcagaaatgctaaagtctaagattcaaggcctattgcagcaggcctcgagacaggc

SEQ ID NO: 137325 - DNA, 75 bp, Artificial Sequence
  Synthetic
tcaccacgagttttgggaacacactgacatgctacctcaaggccacagccgccgccaaggctgcaggtctgaagg

SEQ ID NO: 137326 - DNA, 75 bp, Artificial Sequence
  Synthetic
cttcgtgcccgtggagtctatggagaccacaatgcgctctccagttttcactgacaatttatctccgcctgttgt

SEQ ID NO: 137327 - DNA, 75 bp, Artificial Sequence
  Synthetic
tattgcagcaggcctcgagacaggcccaagacatacaacccgctgtccagtcatcctggcccaagctagagcagt

SEQ ID NO: 137328 - DNA, 75 bp, Artificial Sequence
  Synthetic
gtccacgactacccagtccttcttgggtacatcgatcaacggtgtgttgtggacggtgtatcacggagccggcag

SEQ ID NO: 137329 - DNA, 75 bp, Artificial Sequence
  Synthetic
acactcattaactgagagactttacgtaggcgggcccatgatgaacagcaagggccagtcctgcggttacaggcg

SEQ ID NO: 137330 - DNA, 75 bp, Artificial Sequence
  Synthetic
gaaggggagccgggggatcccgacctggagcctgggccggtagagcatcagtccccctccgaggagggggacaca

SEQ ID NO: 137331 - DNA, 75 bp, Artificial Sequence
  Synthetic
gacgaggtactcggcccctccaggagacgtcccgcagccagcatatgacttagagctgataacatcatgctcttc

SEQ ID NO: 137332 - DNA, 75 bp, Artificial Sequence
  Synthetic
gtccccctccgaggagggggacacagctcccgacccagactccggctcgtgggccacgtgttccgacgaaagcga

SEQ ID NO: 137333 - DNA, 75 bp, Artificial Sequence
  Synthetic
gctacgtgaaggccctggcggcttgtaaggccgcagggattgtagctcccaccatgttggtgtgcggcgacgacc

SEQ ID NO: 137334 - DNA, 75 bp, Artificial Sequence
  Synthetic
tagaccaagacctagtgggttggcctgctccttctggtactaagtccctagtcccgtgctcttgcggggcttcgg

SEQ ID NO: 137335 - DNA, 75 bp, Artificial Sequence
  Synthetic
tagaccaagacctagtgggttggcctgctccttctggttctaagtccctagtcccgtgctcttgcggggcttcgg

SEQ ID NO: 137336 - DNA, 75 bp, Artificial Sequence
  Synthetic
tagaccaagacctagtgggttggcctgctccttctggtcctaagtccctagtcccgtgctcttgcggggcttcgg

SEQ ID NO: 137337 - DNA, 75 bp, Artificial Sequence
  Synthetic
tagaccaagacctagtgggttggcctgctccttctggtgctaagtccctagtcccgtgctcttgcggggcttcgg

SEQ ID NO: 137338 - DNA, 75 bp, Artificial Sequence
  Synthetic
actggctttgtcgtcagcggcctagtgggggctgccataggcagcataggcctaggcaagatattggtggacatt

SEQ ID NO: 137339 - DNA, 75 bp, Artificial Sequence
  Synthetic
cacactccagtgaactcctggctcgggaacatcatagtctacgcgcccacaatttgggcgcggatgatactgatg

SEQ ID NO: 137340 - DNA, 75 bp, Artificial Sequence
  Synthetic
ggcattggcacggtcctggaccaggcagagacggctggagtacgtcttaccgtgctcgccactgccacgcctcca

SEQ ID NO: 137341 - DNA, 75 bp, Artificial Sequence
  Synthetic
agctgaggaggatgagcgaaatctgagagtcttcacggaggctatgaccaggaattccgctccccccggcgatcc

SEQ ID NO: 137342 - DNA, 75 bp, Artificial Sequence
  Synthetic
tcattgttgcggtatcacaacaaggtgtacagcacaacatcacgtagtgcatcacagcgggccaaaaaggtgact

SEQ ID NO: 137343 - DNA, 75 bp, Artificial Sequence
  Synthetic
gtcccgtgctcttgcggggcttcggacaagtacctggtgaccaggaacgctgatgtgatacccgtacggaggagg

SEQ ID NO: 137344 - DNA, 75 bp, Artificial Sequence
  Synthetic
gtcccgtgctcttgcggggcttcggacatgtacctggtgaccaggaacgctgatgtgatacccgtacggaggagg

SEQ ID NO: 137345 - DNA, 75 bp, Artificial Sequence
  Synthetic
gtcccgtgctcttgcggggcttcggacacgtacctggtgaccaggaacgctgatgtgatacccgtacggaggagg

SEQ ID NO: 137346 - DNA, 75 bp, Artificial Sequence
  Synthetic
gtcccgtgctcttgcggggcttcggacaggtacctggtgaccaggaacgctgatgtgatacccgtacggaggagg

SEQ ID NO: 137347 - DNA, 75 bp, Artificial Sequence
  Synthetic
tgggggctgccataggcagcataggcctaggcaagatattggtggacattctggccggatacggtgctgggatct

SEQ ID NO: 137348 - DNA, 75 bp, Artificial Sequence
  Synthetic
tcttccgcgctgcggtgtgcacccggggcgtggcgaaggctgtagactttgtaccagttgagtccctcgaaacaa

SEQ ID NO: 137349 - DNA, 75 bp, Artificial Sequence
  Synthetic
tttgacagggtgcagctactggactcctactatgaccaagtcttgaaggacgttaagctagctgcctctaaggtt

SEQ ID NO: 137350 - DNA, 75 bp, Artificial Sequence
  Synthetic
agggggggagacacctcatattttgccattccaagaaaaagtgtgacgagctcgctgcgaagttgtcctcgatgg

SEQ ID NO: 137351 - DNA, 75 bp, Artificial Sequence
  Synthetic
ggccctaccactccgctcgccagggctgcctgggagacagttagacactcccctgtcaattcatggctgggaaac

SEQ ID NO: 137352 - DNA, 75 bp, Artificial Sequence
  Synthetic
ccctgtcaattcatggctgggaaacatcatccaatacgccccaactatatgggtgcgcatggtcctcatgacaca

SEQ ID NO: 137353 - DNA, 75 bp, Artificial Sequence
  Synthetic
caattccacgcctccggctgtgccacaaacctaccaagtggcccatttgcacgccccgacggggagtggcaagag

SEQ ID NO: 137354 - DNA, 75 bp, Artificial Sequence
  Synthetic
caattccacgcctccggctgtgcctcaaacctaccaagtggcccatttgcacgccccgacggggagtggcaagag

SEQ ID NO: 137355 - DNA, 75 bp, Artificial Sequence
  Synthetic
caattccacgcctccggctgtgccccaaacctaccaagtggcccatttgcacgccccgacggggagtggcaagag

SEQ ID NO: 137356 - DNA, 75 bp, Artificial Sequence
  Synthetic
caattccacgcctccggctgtgccgcaaacctaccaagtggcccatttgcacgccccgacggggagtggcaagag

SEQ ID NO: 137357 - DNA, 75 bp, Artificial Sequence
  Synthetic
gggtgcgcatggtcctcatgacacatttcttctccatcctcatggctcaggaaaccctggaccaagacctcaact

SEQ ID NO: 137358 - DNA, 75 bp, Artificial Sequence
  Synthetic
cagccataattcaaagactccacggcttgagcgcgtttacactccatggatactctccacatgagctcaatcggg

SEQ ID NO: 137359 - DNA, 75 bp, Artificial Sequence
  Synthetic
accataaccagtctgcttaggaggctacatcagtggattaccgaggactgccccgtcccgtgtagtggctcttgg

SEQ ID NO: 137360 - DNA, 75 bp, Artificial Sequence
  Synthetic
aaggcgcggtccagtggatgaataggctcatcgcctttgcgtccagggggaaccacgtcgccccgacccattacg

SEQ ID NO: 137361 - DNA, 75 bp, Artificial Sequence
  Synthetic
cttcgcgacgcatgggactgggtttgtaccatcttggctgacttcagagcctggctgtcatccaaattgctccca

SEQ ID NO: 137362 - DNA, 75 bp, Artificial Sequence
  Synthetic
gcgcatggcatcgacccgaacatacggtcaggtgtcaggaccatcactacaggcgcgccgatcacatattctact

SEQ ID NO: 137363 - DNA, 75 bp, Artificial Sequence
  Synthetic
tcccagacctcggagtgagagtctgtgagaaaatggccctttatgatataacacagaagctaccccaggcagtga

SEQ ID NO: 137364 - DNA, 75 bp, Artificial Sequence
  Synthetic
acctcgctattttctcctgtgcctactcctacttaccgtaggggtaggcatctttttattgcccgcccgataggg

SEQ ID NO: 137365 - DNA, 75 bp, Artificial Sequence
  Synthetic
ggcacgtgcggtgagggcatcgctcatctcccagggagggagagcggccacttgtggcttctatctcttcaactg

SEQ ID NO: 137366 - DNA, 75 bp, Artificial Sequence
  Synthetic
ttggcacggtcttagatcaagcagagaccgctggagcacgcctcgtagtgcttgcaactgctactccgcctggat

SEQ ID NO: 137367 - DNA, 75 bp, Artificial Sequence
  Synthetic
tgcatgaacacctggcagggaacattccctatcaactgctacacagagggccaatgtgtgcctaagcccgcacct

SEQ ID NO: 137368 - DNA, 75 bp, Artificial Sequence
  Synthetic
cactcgctgtttcgactcaacagtgacggagagggacatcagaaccgaggagtccatatatcaggcctgctcgtt

SEQ ID NO: 137369 - DNA, 75 bp, Artificial Sequence
  Synthetic
tcttcaccggcctcacccacatagatgcccattttctgtcccagacaaagcaggcaggggaaaacttcccctacc

SEQ ID NO: 137370 - DNA, 75 bp, Artificial Sequence
  Synthetic
gggcagacacctcatcttttgccattccaagaaaaagtgagatgagttagccaagcagctgtcctctctcggcct

SEQ ID NO: 137371 - DNA, 75 bp, Artificial Sequence
  Synthetic
gggcagacacctcatcttttgccattccaagaaaaagtgtgatgagttagccaagcagctgtcctctctcggcct

SEQ ID NO: 137372 - DNA, 75 bp, Artificial Sequence
  Synthetic
gggcagacacctcatcttttgccattccaagaaaaagtgcgatgagttagccaagcagctgtcctctctcggcct

SEQ ID NO: 137373 - DNA, 75 bp, Artificial Sequence
  Synthetic
gggcagacacctcatcttttgccattccaagaaaaagtgggatgagttagccaagcagctgtcctctctcggcct

SEQ ID NO: 137374 - DNA, 75 bp, Artificial Sequence
  Synthetic
gggcagacacctcatcttttgccattccaagaataagtgagatgagttagccaagcagctgtcctctctcggcct

SEQ ID NO: 137375 - DNA, 75 bp, Artificial Sequence
  Synthetic
gggcagacacctcatcttttgccattccaagaataagtgtgatgagttagccaagcagctgtcctctctcggcct

SEQ ID NO: 137376 - DNA, 75 bp, Artificial Sequence
  Synthetic
gggcagacacctcatcttttgccattccaagaataagtgcgatgagttagccaagcagctgtcctctctcggcct

SEQ ID NO: 137377 - DNA, 75 bp, Artificial Sequence
  Synthetic
gggcagacacctcatcttttgccattccaagaataagtgggatgagttagccaagcagctgtcctctctcggcct

SEQ ID NO: 137378 - DNA, 75 bp, Artificial Sequence
  Synthetic
gggcagacacctcatcttttgccattccaagaacaagtgagatgagttagccaagcagctgtcctctctcggcct

SEQ ID NO: 137379 - DNA, 75 bp, Artificial Sequence
  Synthetic
gggcagacacctcatcttttgccattccaagaacaagtgtgatgagttagccaagcagctgtcctctctcggcct

SEQ ID NO: 137380 - DNA, 75 bp, Artificial Sequence
  Synthetic
gggcagacacctcatcttttgccattccaagaacaagtgcgatgagttagccaagcagctgtcctctctcggcct

SEQ ID NO: 137381 - DNA, 75 bp, Artificial Sequence
  Synthetic
gggcagacacctcatcttttgccattccaagaacaagtgggatgagttagccaagcagctgtcctctctcggcct

SEQ ID NO: 137382 - DNA, 75 bp, Artificial Sequence
  Synthetic
gggcagacacctcatcttttgccattccaagaagaagtgagatgagttagccaagcagctgtcctctctcggcct

SEQ ID NO: 137383 - DNA, 75 bp, Artificial Sequence
  Synthetic
gggcagacacctcatcttttgccattccaagaagaagtgtgatgagttagccaagcagctgtcctctctcggcct

SEQ ID NO: 137384 - DNA, 75 bp, Artificial Sequence
  Synthetic
gggcagacacctcatcttttgccattccaagaagaagtgcgatgagttagccaagcagctgtcctctctcggcct

SEQ ID NO: 137385 - DNA, 75 bp, Artificial Sequence
  Synthetic
gggcagacacctcatcttttgccattccaagaagaagtgggatgagttagccaagcagctgtcctctctcggcct

SEQ ID NO: 137386 - DNA, 75 bp, Artificial Sequence
  Synthetic
tgtcgcgccagcggagtgctcaccacaagcatgggaaacaccatcacgtgctatgtaaaagcccaagcagcttgt

SEQ ID NO: 137387 - DNA, 75 bp, Artificial Sequence
  Synthetic
tgaggtgtcgtttagcgtgggcctcaactccttcgtggtcggatctcagcttccttgtgaacctgagcctgacac

SEQ ID NO: 137388 - DNA, 75 bp, Artificial Sequence
  Synthetic
ggcaacttcgactcagtaatagactgcaacacgtctgtcatccagaccgtggacttcagcttggaccccactttt

SEQ ID NO: 137389 - DNA, 75 bp, Artificial Sequence
  Synthetic
ggcaacttcgactcagttatagactgcaacacgtctgtcatccagaccgtggacttcagcttggaccccactttt

SEQ ID NO: 137390 - DNA, 75 bp, Artificial Sequence
  Synthetic
ggcaacttcgactcagtcatagactgcaacacgtctgtcatccagaccgtggacttcagcttggaccccactttt

SEQ ID NO: 137391 - DNA, 75 bp, Artificial Sequence
  Synthetic
ggcaacttcgactcagtgatagactgcaacacgtctgtcatccagaccgtggacttcagcttggaccccactttt

SEQ ID NO: 137392 - DNA, 75 bp, Artificial Sequence
  Synthetic
ggcaacttcgactctgtaatagactgcaacacgtctgtcatccagaccgtggacttcagcttggaccccactttt

SEQ ID NO: 137393 - DNA, 75 bp, Artificial Sequence
  Synthetic
ggcaacttcgactctgttatagactgcaacacgtctgtcatccagaccgtggacttcagcttggaccccactttt

SEQ ID NO: 137394 - DNA, 75 bp, Artificial Sequence
  Synthetic
ggcaacttcgactctgtcatagactgcaacacgtctgtcatccagaccgtggacttcagcttggaccccactttt

SEQ ID NO: 137395 - DNA, 75 bp, Artificial Sequence
  Synthetic
ggcaacttcgactctgtgatagactgcaacacgtctgtcatccagaccgtggacttcagcttggaccccactttt

SEQ ID NO: 137396 - DNA, 75 bp, Artificial Sequence
  Synthetic
ggcaacttcgactccgtaatagactgcaacacgtctgtcatccagaccgtggacttcagcttggaccccactttt

SEQ ID NO: 137397 - DNA, 75 bp, Artificial Sequence
  Synthetic
ggcaacttcgactccgttatagactgcaacacgtctgtcatccagaccgtggacttcagcttggaccccactttt

SEQ ID NO: 137398 - DNA, 75 bp, Artificial Sequence
  Synthetic
ggcaacttcgactccgtcatagactgcaacacgtctgtcatccagaccgtggacttcagcttggaccccactttt

SEQ ID NO: 137399 - DNA, 75 bp, Artificial Sequence
  Synthetic
ggcaacttcgactccgtgatagactgcaacacgtctgtcatccagaccgtggacttcagcttggaccccactttt

SEQ ID NO: 137400 - DNA, 75 bp, Artificial Sequence
  Synthetic
ggcaacttcgactcggtaatagactgcaacacgtctgtcatccagaccgtggacttcagcttggaccccactttt

SEQ ID NO: 137401 - DNA, 75 bp, Artificial Sequence
  Synthetic
ggcaacttcgactcggttatagactgcaacacgtctgtcatccagaccgtggacttcagcttggaccccactttt

SEQ ID NO: 137402 - DNA, 75 bp, Artificial Sequence
  Synthetic
ggcaacttcgactcggtcatagactgcaacacgtctgtcatccagaccgtggacttcagcttggaccccactttt

SEQ ID NO: 137403 - DNA, 75 bp, Artificial Sequence
  Synthetic
ggcaacttcgactcggtgatagactgcaacacgtctgtcatccagaccgtggacttcagcttggaccccactttt

SEQ ID NO: 137404 - DNA, 75 bp, Artificial Sequence
  Synthetic
aggttgggtgtgcgcgcgacgaggaagacttccgagcggtcgcaacctcgaggcagacgtcagcctatccccaag

SEQ ID NO: 137405 - DNA, 75 bp, Artificial Sequence
  Synthetic
accgaggaggatgagaggaatctgagagtcttcacggaggctatgaccagatattccgctccccccggtgaccct

SEQ ID NO: 137406 - DNA, 75 bp, Artificial Sequence
  Synthetic
tctatagaaaccacaaccgtgcctcaggatgcagtgtctcggagtcaacgaagggggcgcactggtagggggagg

SEQ ID NO: 137407 - DNA, 75 bp, Artificial Sequence
  Synthetic
tgcctgggaaacagtcagacactcacctgtcaattcatggcttgggaacatcatcctgtatgccccgaccatctg

SEQ ID NO: 137408 - DNA, 75 bp, Artificial Sequence
  Synthetic
tgcctgggaaacagtcagacactctcctgtcaattcatggcttgggaacatcatcctgtatgccccgaccatctg

SEQ ID NO: 137409 - DNA, 75 bp, Artificial Sequence
  Synthetic
tgcctgggaaacagtcagacactcccctgtcaattcatggcttgggaacatcatcctgtatgccccgaccatctg

SEQ ID NO: 137410 - DNA, 75 bp, Artificial Sequence
  Synthetic
tgcctgggaaacagtcagacactcgcctgtcaattcatggcttgggaacatcatcctgtatgccccgaccatctg

SEQ ID NO: 137411 - DNA, 75 bp, Artificial Sequence
  Synthetic
agctcacaccagcggagactacgactaggttaagggcttatttcaacacaccaggcctccccgtctgccaggacc

SEQ ID NO: 137412 - DNA, 75 bp, Artificial Sequence
  Synthetic
gtgagtcctctggacctcccagccataattgaaaggctacacgggcttgacgccttctcactgcacacatacact

SEQ ID NO: 137413 - DNA, 75 bp, Artificial Sequence
  Synthetic
cgcgtatcaggccacagtctgcgccagagctacagccccccccccatcgtgggataccatgtggaagtgcctcat

SEQ ID NO: 137414 - DNA, 75 bp, Artificial Sequence
  Synthetic
cttggagaactggaaaaaaccggactatcagccaccgacagtggcggggtgtgcccttccccccccacaacaacc

SEQ ID NO: 137415 - DNA, 75 bp, Artificial Sequence
  Synthetic
gaaactgggctaaggtattgattgtgatgctactttttgccggcgttgacggggagacccacgtgacaggagggg

SEQ ID NO: 137416 - DNA, 75 bp, Artificial Sequence
  Synthetic
tccggtgccgcctccgcggaggcggcgggctatagtcctggaccagagtaccgtgggggaggctcttaaggagct

SEQ ID NO: 137417 - DNA, 75 bp, Artificial Sequence
  Synthetic
atggcatgcatgtcggcagacctagaagtggtgactagcacgtgggttatagtgggaggcgtcgtggcagcctta

SEQ ID NO: 137418 - DNA, 75 bp, Artificial Sequence
  Synthetic
gctcatcaacaccaatggcagttggcacatcaaccgcaccgccctgaactgcaatgactctttgcacaccggctt

SEQ ID NO: 137419 - DNA, 75 bp, Artificial Sequence
  Synthetic
agttcgacgaaatggaggagtgctctaggtacatccccgtggtcgagcatggcatgcagctcgctgaacaattca

SEQ ID NO: 137420 - DNA, 75 bp, Artificial Sequence
  Synthetic
ttttttttttttttttttttttttttttttttttttttctttccttcttacttttttttaacctattttcttact

SEQ ID NO: 137421 - DNA, 75 bp, Artificial Sequence
  Synthetic
gcaacaccggttgtgcagtccaatattgctaagctcgagcaattctgggcaaagcatatgtggaacttcatcagt

SEQ ID NO: 137422 - DNA, 75 bp, Artificial Sequence
  Synthetic
tgcgctccagaagaggagaagttgcctatcaatcccttgagcaactcactgttgcggttccacaacaaggtgtat

SEQ ID NO: 137423 - DNA, 75 bp, Artificial Sequence
  Synthetic
tgcacaacatccaaaagcgcctcattgagggcaaagaaggtaacttttgacagagtgcagctactggactcatac

SEQ ID NO: 137424 - DNA, 75 bp, Artificial Sequence
  Synthetic
caccggctggttagcggggctcttctactaccacaaattcaactcttcaggctgccctgagaggatggccagctg

SEQ ID NO: 137425 - DNA, 75 bp, Artificial Sequence
  Synthetic
agcagaccctcctattcaacattctaggagggtgggttgcttcgcagatagcgacccccacggcctccacagctt

SEQ ID NO: 137426 - DNA, 75 bp, Artificial Sequence
  Synthetic
gcgacccccacggcctccacagctttcgttgtgagtggccttgctggagctgcggtcggcagcgtgggcctgggg

SEQ ID NO: 137427 - DNA, 75 bp, Artificial Sequence
  Synthetic
tgcggtcggcagcgtgggcctggggaagatcctggtcgacatcctcgccggctacggtgccggtgtagccggtgc

SEQ ID NO: 137428 - DNA, 75 bp, Artificial Sequence
  Synthetic
ccatcttcaaaataaggatgtatgtggggggggtcgagcacaggctcacggctgcgtgcaatttcactcgtgggg

SEQ ID NO: 137429 - DNA, 75 bp, Artificial Sequence
  Synthetic
agtaacacgtggcatggtacgtttcccattaacgcttacaccacgggcccttgcactcccgccccggcgcacaat

SEQ ID NO: 137430 - DNA, 75 bp, Artificial Sequence
  Synthetic
ggcagctcggctcatcgtgtaccccgacctcggtgtcagggtttgcgagaaaatagccttgtatgacatcacgca

SEQ ID NO: 137431 - DNA, 75 bp, Artificial Sequence
  Synthetic
gttgtctgtgcggctatattgaggcgccatgtgggccctggagagggggccgtacagtggatgaaccgcctcatt

SEQ ID NO: 137432 - DNA, 75 bp, Artificial Sequence
  Synthetic
gccttcgcgtctcggggcaatcacgtgtcgcccacacactatgtccctgagaccgatgctgccgcccgtgtgacg

SEQ ID NO: 137433 - DNA, 75 bp, Artificial Sequence
  Synthetic
gggaggaggtcgtattccaggtcgggctcaaccaatacctggtcgggtcacagctcccatgcgagcccgaaccgg

SEQ ID NO: 137434 - DNA, 75 bp, Artificial Sequence
  Synthetic
ggccaggccgaagcagcactagagaagttggtcgtcttgcacgctgcgagcgcagctagctgcaatggcttccta

SEQ ID NO: 137435 - DNA, 75 bp, Artificial Sequence
  Synthetic
agatttgggactgggtctgcactgtcctgagtgacttcaagtcgtggcttaaggctaagctcatgccctccatgc

SEQ ID NO: 137436 - DNA, 75 bp, Artificial Sequence
  Synthetic
cctcatcgaggccaacctcctgtggcggcaggagatgggcgggaacatcacccgcgtggagtcagagaataaggt

SEQ ID NO: 137437 - DNA, 75 bp, Artificial Sequence
  Synthetic
ccacatcaagaatggttcgatgagaatagtcgggcccaagacttgcagtaatacctggcacggcacctttcccat

SEQ ID NO: 137438 - DNA, 75 bp, Artificial Sequence
  Synthetic
aaatgggcggaaacatcacccgtgtggaatctgagaacaaggtggtcatcctggactcttttgacccactggtgg

SEQ ID NO: 137439 - DNA, 75 bp, Artificial Sequence
  Synthetic
atagtcgggcccaagacttgcagtaatacctggcacggcacctttcccatcaatgcgtctaccactggagccggc

SEQ ID NO: 137440 - DNA, 75 bp, Artificial Sequence
  Synthetic
acagggggggaggcgggccataccaccagcatcctcacatccatgttttcatctgggtcggctcagaaggtccag

SEQ ID NO: 137441 - DNA, 75 bp, Artificial Sequence
  Synthetic
gtatgacgcaagacaacatcaagtgcccttgccaggtacctgctcctgaattcttcactgaagtggacggggtca

SEQ ID NO: 137442 - DNA, 75 bp, Artificial Sequence
  Synthetic
tcctcccctgctggagccctggaagagggatgactacgtaccaccagtagtccacggttgccctcttccgcccag

SEQ ID NO: 137443 - DNA, 75 bp, Artificial Sequence
  Synthetic
gtttcaactcgtccggatgcccagagcgcatggccagctgccgccccattagcgagttcgctcaggggtggggtc

SEQ ID NO: 137444 - DNA, 75 bp, Artificial Sequence
  Synthetic
cggcagccctccggtgccgcccccacggaggaagaagaaaaccatcgcgctcactgagtccaccgtgtctactgt

SEQ ID NO: 137445 - DNA, 75 bp, Artificial Sequence
  Synthetic
caggtactacctgaccagagaccctaccactccactcgccagagcagcctgggaaactgtaaagcactcccctgt

SEQ ID NO: 137446 - DNA, 75 bp, Artificial Sequence
  Synthetic
ttgtggtaggctcccagctcccctgtgagccagagccagatgtgcaggttttgacatctatgctgacagacccat

SEQ ID NO: 137447 - DNA, 75 bp, Artificial Sequence
  Synthetic
cctggaccagaggccctattgctggcactacgcacctcgacagtgtggtatcgtacccgcgtcgcaggtgtgtgg

SEQ ID NO: 137448 - DNA, 75 bp, Artificial Sequence
  Synthetic
gacacagggtccgacgctgggtcgtactcctccatgccccccctcgagggggagccgggggatcccgacctcagc

SEQ ID NO: 137449 - DNA, 75 bp, Artificial Sequence
  Synthetic
ccggaggttggcccgagggtccccaccctcggaggccagctcctcggcgagccagctttctgctccatccctcaa

SEQ ID NO: 137450 - DNA, 75 bp, Artificial Sequence
  Synthetic
cctctcgcagcgccggccagaggcagaagaaagtcacatttgacaggatgcaggtcctggacgctcattaccagg

SEQ ID NO: 137451 - DNA, 75 bp, Artificial Sequence
  Synthetic
agaggttccccagtccgctaccaatttgggcgcgcccggactacaatcctccgctaatccaaccgtggaagcagc

SEQ ID NO: 137452 - DNA, 75 bp, Artificial Sequence
  Synthetic
cagtccttcctcggaacaaccatctcgggggtcttatggactgtctaccatggagctggcaacaagactctagcc

SEQ ID NO: 137453 - DNA, 75 bp, Artificial Sequence
  Synthetic
gtgtcgcgagcccgaccccgcctcttactcttaagcctacaactactttgcgtaggggtaggcatcgttttactc

SEQ ID NO: 137454 - DNA, 75 bp, Artificial Sequence
  Synthetic
gtcgaacgtctccagcgccctggctgatctggcagcaaaggccttcagccagccgagcgctgatgttgactctgg

SEQ ID NO: 137455 - DNA, 75 bp, Artificial Sequence
  Synthetic
accaaatctttggagccgtgcacgtgtggagcggtcgacctatacctggtcacgcgaaacgctgatgtcatcccg

SEQ ID NO: 137456 - DNA, 75 bp, Artificial Sequence
  Synthetic
agcccgctgctgctgtctacaacagagtggcagatactaccctgctccttcaccaccctaccggctctatccact

SEQ ID NO: 137457 - DNA, 75 bp, Artificial Sequence
  Synthetic
ggggagccaggcgacccggatttgacctctgactcgtggtccactgtcagcggttcggaggacgttgtgtgttgc

SEQ ID NO: 137458 - DNA, 75 bp, Artificial Sequence
  Synthetic
cggttcggaggacgttgtgtgttgctcaatgtcatactcatggacaggggcgctcgttacgccctgtgcggccga

SEQ ID NO: 137459 - DNA, 75 bp, Artificial Sequence
  Synthetic
cgctcgttacgccctgtgcggccgaagagccgaaactgccaatcagtcctttgagcaactccttactgcgccacc

SEQ ID NO: 137460 - DNA, 75 bp, Artificial Sequence
  Synthetic
aagtgctagtgcttaatccctcggtggctgccaccctggggtttggggcgtacttgtccaaggcacatggcatca

SEQ ID NO: 137461 - DNA, 75 bp, Artificial Sequence
  Synthetic
ggctgccaccctggggtttggggcgtacttgtccaaggcacatggcatcaatcccaacattaggactggggtcag

SEQ ID NO: 137462 - DNA, 75 bp, Artificial Sequence
  Synthetic
actcaaggagattaaggcacgggcatctggagtgaaggcaccaaccctctctgttgaggaggcttgcgccctgac

SEQ ID NO: 137463 - DNA, 75 bp, Artificial Sequence
  Synthetic
tttggctatggggcaaaagatgtccggagcctagcccgcaaggccgttaaccacatcaactccgtgtgggaggac

SEQ ID NO: 137464 - DNA, 75 bp, Artificial Sequence
  Synthetic
cgcctatgacatcatcatatgcgatgaatgccatgccgtggactctaccaccattctcggcatcggaacagtcct

SEQ ID NO: 137465 - DNA, 75 bp, Artificial Sequence
  Synthetic
tcatcgtatatcctgatcttggagtcagggtgtgcgaaaagcgggctctttacaacgtggtccagaatctccccc

SEQ ID NO: 137466 - DNA, 75 bp, Artificial Sequence
  Synthetic
cacgtatgaaacccgctgctttgactcaacagtgactgaaagagacattcaggtcgaggaagaggtctatcagtg

SEQ ID NO: 137467 - DNA, 75 bp, Artificial Sequence
  Synthetic
cacgtatgaaacccgctgctttgactctacagtgactgaaagagacattcaggtcgaggaagaggtctatcagtg

SEQ ID NO: 137468 - DNA, 75 bp, Artificial Sequence
  Synthetic
cacgtatgaaacccgctgctttgactccacagtgactgaaagagacattcaggtcgaggaagaggtctatcagtg

SEQ ID NO: 137469 - DNA, 75 bp, Artificial Sequence
  Synthetic
cacgtatgaaacccgctgctttgactcgacagtgactgaaagagacattcaggtcgaggaagaggtctatcagtg

SEQ ID NO: 137470 - DNA, 75 bp, Artificial Sequence
  Synthetic
cacgtatgatacccgctgctttgactcaacagtgactgaaagagacattcaggtcgaggaagaggtctatcagtg

SEQ ID NO: 137471 - DNA, 75 bp, Artificial Sequence
  Synthetic
cacgtatgatacccgctgctttgactctacagtgactgaaagagacattcaggtcgaggaagaggtctatcagtg

SEQ ID NO: 137472 - DNA, 75 bp, Artificial Sequence
  Synthetic
cacgtatgatacccgctgctttgactccacagtgactgaaagagacattcaggtcgaggaagaggtctatcagtg

SEQ ID NO: 137473 - DNA, 75 bp, Artificial Sequence
  Synthetic
cacgtatgatacccgctgctttgactcgacagtgactgaaagagacattcaggtcgaggaagaggtctatcagtg

SEQ ID NO: 137474 - DNA, 75 bp, Artificial Sequence
  Synthetic
cacgtatgacacccgctgctttgactcaacagtgactgaaagagacattcaggtcgaggaagaggtctatcagtg

SEQ ID NO: 137475 - DNA, 75 bp, Artificial Sequence
  Synthetic
cacgtatgacacccgctgctttgactctacagtgactgaaagagacattcaggtcgaggaagaggtctatcagtg

SEQ ID NO: 137476 - DNA, 75 bp, Artificial Sequence
  Synthetic
cacgtatgacacccgctgctttgactccacagtgactgaaagagacattcaggtcgaggaagaggtctatcagtg

SEQ ID NO: 137477 - DNA, 75 bp, Artificial Sequence
  Synthetic
cacgtatgacacccgctgctttgactcgacagtgactgaaagagacattcaggtcgaggaagaggtctatcagtg

SEQ ID NO: 137478 - DNA, 75 bp, Artificial Sequence
  Synthetic
cacgtatgagacccgctgctttgactcaacagtgactgaaagagacattcaggtcgaggaagaggtctatcagtg

SEQ ID NO: 137479 - DNA, 75 bp, Artificial Sequence
  Synthetic
cacgtatgagacccgctgctttgactctacagtgactgaaagagacattcaggtcgaggaagaggtctatcagtg

SEQ ID NO: 137480 - DNA, 75 bp, Artificial Sequence
  Synthetic
cacgtatgagacccgctgctttgactccacagtgactgaaagagacattcaggtcgaggaagaggtctatcagtg

SEQ ID NO: 137481 - DNA, 75 bp, Artificial Sequence
  Synthetic
cacgtatgagacccgctgctttgactcgacagtgactgaaagagacattcaggtcgaggaagaggtctatcagtg

SEQ ID NO: 137482 - DNA, 75 bp, Artificial Sequence
  Synthetic
ctcgtatgaaacccgctgctttgactcaacagtgactgaaagagacattcaggtcgaggaagaggtctatcagtg

SEQ ID NO: 137483 - DNA, 75 bp, Artificial Sequence
  Synthetic
ctcgtatgaaacccgctgctttgactctacagtgactgaaagagacattcaggtcgaggaagaggtctatcagtg

SEQ ID NO: 137484 - DNA, 75 bp, Artificial Sequence
  Synthetic
ctcgtatgaaacccgctgctttgactccacagtgactgaaagagacattcaggtcgaggaagaggtctatcagtg

SEQ ID NO: 137485 - DNA, 75 bp, Artificial Sequence
  Synthetic
ctcgtatgaaacccgctgctttgactcgacagtgactgaaagagacattcaggtcgaggaagaggtctatcagtg

SEQ ID NO: 137486 - DNA, 75 bp, Artificial Sequence
  Synthetic
ctcgtatgatacccgctgctttgactcaacagtgactgaaagagacattcaggtcgaggaagaggtctatcagtg

SEQ ID NO: 137487 - DNA, 75 bp, Artificial Sequence
  Synthetic
ctcgtatgatacccgctgctttgactctacagtgactgaaagagacattcaggtcgaggaagaggtctatcagtg

SEQ ID NO: 137488 - DNA, 75 bp, Artificial Sequence
  Synthetic
ctcgtatgatacccgctgctttgactccacagtgactgaaagagacattcaggtcgaggaagaggtctatcagtg

SEQ ID NO: 137489 - DNA, 75 bp, Artificial Sequence
  Synthetic
ctcgtatgatacccgctgctttgactcgacagtgactgaaagagacattcaggtcgaggaagaggtctatcagtg

SEQ ID NO: 137490 - DNA, 75 bp, Artificial Sequence
  Synthetic
ctcgtatgacacccgctgctttgactcaacagtgactgaaagagacattcaggtcgaggaagaggtctatcagtg

SEQ ID NO: 137491 - DNA, 75 bp, Artificial Sequence
  Synthetic
ctcgtatgacacccgctgctttgactctacagtgactgaaagagacattcaggtcgaggaagaggtctatcagtg

SEQ ID NO: 137492 - DNA, 75 bp, Artificial Sequence
  Synthetic
ctcgtatgacacccgctgctttgactccacagtgactgaaagagacattcaggtcgaggaagaggtctatcagtg

SEQ ID NO: 137493 - DNA, 75 bp, Artificial Sequence
  Synthetic
ctcgtatgacacccgctgctttgactcgacagtgactgaaagagacattcaggtcgaggaagaggtctatcagtg

SEQ ID NO: 137494 - DNA, 75 bp, Artificial Sequence
  Synthetic
ctcgtatgagacccgctgctttgactcaacagtgactgaaagagacattcaggtcgaggaagaggtctatcagtg

SEQ ID NO: 137495 - DNA, 75 bp, Artificial Sequence
  Synthetic
ctcgtatgagacccgctgctttgactctacagtgactgaaagagacattcaggtcgaggaagaggtctatcagtg

SEQ ID NO: 137496 - DNA, 75 bp, Artificial Sequence
  Synthetic
ctcgtatgagacccgctgctttgactccacagtgactgaaagagacattcaggtcgaggaagaggtctatcagtg

SEQ ID NO: 137497 - DNA, 75 bp, Artificial Sequence
  Synthetic
ctcgtatgagacccgctgctttgactcgacagtgactgaaagagacattcaggtcgaggaagaggtctatcagtg

SEQ ID NO: 137498 - DNA, 75 bp, Artificial Sequence
  Synthetic
cccgtatgaaacccgctgctttgactcaacagtgactgaaagagacattcaggtcgaggaagaggtctatcagtg

SEQ ID NO: 137499 - DNA, 75 bp, Artificial Sequence
  Synthetic
cccgtatgaaacccgctgctttgactctacagtgactgaaagagacattcaggtcgaggaagaggtctatcagtg

SEQ ID NO: 137500 - DNA, 75 bp, Artificial Sequence
  Synthetic
cccgtatgaaacccgctgctttgactccacagtgactgaaagagacattcaggtcgaggaagaggtctatcagtg

SEQ ID NO: 137501 - DNA, 75 bp, Artificial Sequence
  Synthetic
cccgtatgaaacccgctgctttgactcgacagtgactgaaagagacattcaggtcgaggaagaggtctatcagtg

SEQ ID NO: 137502 - DNA, 75 bp, Artificial Sequence
  Synthetic
cccgtatgatacccgctgctttgactcaacagtgactgaaagagacattcaggtcgaggaagaggtctatcagtg

SEQ ID NO: 137503 - DNA, 75 bp, Artificial Sequence
  Synthetic
cccgtatgatacccgctgctttgactctacagtgactgaaagagacattcaggtcgaggaagaggtctatcagtg

SEQ ID NO: 137504 - DNA, 75 bp, Artificial Sequence
  Synthetic
cccgtatgatacccgctgctttgactccacagtgactgaaagagacattcaggtcgaggaagaggtctatcagtg

SEQ ID NO: 137505 - DNA, 75 bp, Artificial Sequence
  Synthetic
cccgtatgatacccgctgctttgactcgacagtgactgaaagagacattcaggtcgaggaagaggtctatcagtg

SEQ ID NO: 137506 - DNA, 75 bp, Artificial Sequence
  Synthetic
cccgtatgacacccgctgctttgactcaacagtgactgaaagagacattcaggtcgaggaagaggtctatcagtg

SEQ ID NO: 137507 - DNA, 75 bp, Artificial Sequence
  Synthetic
cccgtatgacacccgctgctttgactctacagtgactgaaagagacattcaggtcgaggaagaggtctatcagtg

SEQ ID NO: 137508 - DNA, 75 bp, Artificial Sequence
  Synthetic
cccgtatgacacccgctgctttgactccacagtgactgaaagagacattcaggtcgaggaagaggtctatcagtg

SEQ ID NO: 137509 - DNA, 75 bp, Artificial Sequence
  Synthetic
cccgtatgacacccgctgctttgactcgacagtgactgaaagagacattcaggtcgaggaagaggtctatcagtg

SEQ ID NO: 137510 - DNA, 75 bp, Artificial Sequence
  Synthetic
cccgtatgagacccgctgctttgactcaacagtgactgaaagagacattcaggtcgaggaagaggtctatcagtg

SEQ ID NO: 137511 - DNA, 75 bp, Artificial Sequence
  Synthetic
cccgtatgagacccgctgctttgactctacagtgactgaaagagacattcaggtcgaggaagaggtctatcagtg

SEQ ID NO: 137512 - DNA, 75 bp, Artificial Sequence
  Synthetic
cccgtatgagacccgctgctttgactccacagtgactgaaagagacattcaggtcgaggaagaggtctatcagtg

SEQ ID NO: 137513 - DNA, 75 bp, Artificial Sequence
  Synthetic
cccgtatgagacccgctgctttgactcgacagtgactgaaagagacattcaggtcgaggaagaggtctatcagtg

SEQ ID NO: 137514 - DNA, 75 bp, Artificial Sequence
  Synthetic
cgcgtatgaaacccgctgctttgactcaacagtgactgaaagagacattcaggtcgaggaagaggtctatcagtg

SEQ ID NO: 137515 - DNA, 75 bp, Artificial Sequence
  Synthetic
cgcgtatgaaacccgctgctttgactctacagtgactgaaagagacattcaggtcgaggaagaggtctatcagtg

SEQ ID NO: 137516 - DNA, 75 bp, Artificial Sequence
  Synthetic
cgcgtatgaaacccgctgctttgactccacagtgactgaaagagacattcaggtcgaggaagaggtctatcagtg

SEQ ID NO: 137517 - DNA, 75 bp, Artificial Sequence
  Synthetic
cgcgtatgaaacccgctgctttgactcgacagtgactgaaagagacattcaggtcgaggaagaggtctatcagtg

SEQ ID NO: 137518 - DNA, 75 bp, Artificial Sequence
  Synthetic
cgcgtatgatacccgctgctttgactcaacagtgactgaaagagacattcaggtcgaggaagaggtctatcagtg

SEQ ID NO: 137519 - DNA, 75 bp, Artificial Sequence
  Synthetic
cgcgtatgatacccgctgctttgactctacagtgactgaaagagacattcaggtcgaggaagaggtctatcagtg

SEQ ID NO: 137520 - DNA, 75 bp, Artificial Sequence
  Synthetic
cgcgtatgatacccgctgctttgactccacagtgactgaaagagacattcaggtcgaggaagaggtctatcagtg

SEQ ID NO: 137521 - DNA, 75 bp, Artificial Sequence
  Synthetic
cgcgtatgatacccgctgctttgactcgacagtgactgaaagagacattcaggtcgaggaagaggtctatcagtg

SEQ ID NO: 137522 - DNA, 75 bp, Artificial Sequence
  Synthetic
cgcgtatgacacccgctgctttgactcaacagtgactgaaagagacattcaggtcgaggaagaggtctatcagtg

SEQ ID NO: 137523 - DNA, 75 bp, Artificial Sequence
  Synthetic
cgcgtatgacacccgctgctttgactctacagtgactgaaagagacattcaggtcgaggaagaggtctatcagtg

SEQ ID NO: 137524 - DNA, 75 bp, Artificial Sequence
  Synthetic
cgcgtatgacacccgctgctttgactccacagtgactgaaagagacattcaggtcgaggaagaggtctatcagtg

SEQ ID NO: 137525 - DNA, 75 bp, Artificial Sequence
  Synthetic
cgcgtatgacacccgctgctttgactcgacagtgactgaaagagacattcaggtcgaggaagaggtctatcagtg

SEQ ID NO: 137526 - DNA, 75 bp, Artificial Sequence
  Synthetic
cgcgtatgagacccgctgctttgactcaacagtgactgaaagagacattcaggtcgaggaagaggtctatcagtg

SEQ ID NO: 137527 - DNA, 75 bp, Artificial Sequence
  Synthetic
cgcgtatgagacccgctgctttgactctacagtgactgaaagagacattcaggtcgaggaagaggtctatcagtg

SEQ ID NO: 137528 - DNA, 75 bp, Artificial Sequence
  Synthetic
cgcgtatgagacccgctgctttgactccacagtgactgaaagagacattcaggtcgaggaagaggtctatcagtg

SEQ ID NO: 137529 - DNA, 75 bp, Artificial Sequence
  Synthetic
cgcgtatgagacccgctgctttgactcgacagtgactgaaagagacattcaggtcgaggaagaggtctatcagtg

SEQ ID NO: 137530 - DNA, 75 bp, Artificial Sequence
  Synthetic
ggtcgtcgccaccgacgccctcatgacggggtttactggagactttgactccgtgatcgactgcaacgtagcggt

SEQ ID NO: 137531 - DNA, 75 bp, Artificial Sequence
  Synthetic
cggcagttggcacatcaatcgcacggccttgaactgtaatgcgagcctcgagactggctggatagcggggctctt

SEQ ID NO: 137532 - DNA, 75 bp, Artificial Sequence
  Synthetic
tcaacagtgactgaaagagacattcaggtcgaggaagaggtctatcagtgttgtgacctagacccggaagctcgc

SEQ ID NO: 137533 - DNA, 75 bp, Artificial Sequence
  Synthetic
tctacagtgactgaaagagacattcaggtcgaggaagaggtctatcagtgttgtgacctagacccggaagctcgc

SEQ ID NO: 137534 - DNA, 75 bp, Artificial Sequence
  Synthetic
tccacagtgactgaaagagacattcaggtcgaggaagaggtctatcagtgttgtgacctagacccggaagctcgc

SEQ ID NO: 137535 - DNA, 75 bp, Artificial Sequence
  Synthetic
tcgacagtgactgaaagagacattcaggtcgaggaagaggtctatcagtgttgtgacctagacccggaagctcgc

SEQ ID NO: 137536 - DNA, 75 bp, Artificial Sequence
  Synthetic
tcttcaccacaagctttggaaacacactgacttgctatctcaaggccacagcggctgccagggccgctggcctga

SEQ ID NO: 137537 - DNA, 75 bp, Artificial Sequence
  Synthetic
aggccctccgagctttcacggaagccatgacgaggtactcagctcccccaggcgacgccccacagccagcgtacg

SEQ ID NO: 137538 - DNA, 75 bp, Artificial Sequence
  Synthetic
ggccccgctggttctggttttgcctactcctgctcgctgcaggggtaggcatctacctcctccccaaccggtgaa

SEQ ID NO: 137539 - DNA, 75 bp, Artificial Sequence
  Synthetic
acctggaattgataacatcttgctcttccaacgtctcagtggcacatgacgcggcgggaaaacgggtctactatc

SEQ ID NO: 137540 - DNA, 75 bp, Artificial Sequence
  Synthetic
caccatgcacctgcggcagctcggacctctacttggtcacgagacatgccgacgtcatcccggtgcgccggcggg

SEQ ID NO: 137541 - DNA, 75 bp, Artificial Sequence
  Synthetic
cgacacactccagtgaactcctggttggggaacatcatactctacgcgcccaccatatgggtgcgcatggtattg

SEQ ID NO: 137542 - DNA, 75 bp, Artificial Sequence
  Synthetic
agttcaacgcgtccggatgcccggagcgcatggccagctgccgccccatcagtgagttcgctcaggggtggggtc

SEQ ID NO: 137543 - DNA, 75 bp, Artificial Sequence
  Synthetic
taccagccatcattcagagactccacggcttgagcgcatttacactccatgggtactctccgcacgaactcaatc

SEQ ID NO: 137544 - DNA, 75 bp, Artificial Sequence
  Synthetic
tccaactcaagcattgtgtatgaggcagcggacatgatcatgcacacccccgggtgcgtgccctgcgttcgggag

SEQ ID NO: 137545 - DNA, 75 bp, Artificial Sequence
  Synthetic
agacatcgggccagagctgtccgcgccaagctgatcgcccagggtgggagagccaggatatgtggcatctacctc

SEQ ID NO: 137546 - DNA, 75 bp, Artificial Sequence
  Synthetic
ccatcctgcgccgacacgtgggaccgggggaaggcgctgtccaatggatgaataggctcattgcctttgcttcca

SEQ ID NO: 137547 - DNA, 75 bp, Artificial Sequence
  Synthetic
tcgatgcgatcacctatacctccggggggagtgccgctcatgccgcgtatgggctcagcagtcttttcaatgtgg

SEQ ID NO: 137548 - DNA, 75 bp, Artificial Sequence
  Synthetic
agatactgctcggaccggccgatggaatggtctccaaggggtggaggttgctggcgcccatcacggcgtatgccc

SEQ ID NO: 137549 - DNA, 75 bp, Artificial Sequence
  Synthetic
tcacccgcgtggagtcagagaataaggtagtaattctggactcttttgacccgcttcgagcggaggaggatgaga

SEQ ID NO: 137550 - DNA, 75 bp, Artificial Sequence
  Synthetic
ggtcgtcacgagcacctgggtgctggtgggcggagtccttgcagctctggccgcgtattgtctgacaacaggcag

SEQ ID NO: 137551 - DNA, 75 bp, Artificial Sequence
  Synthetic
gatcaacaccaacggcagctggcacatcaatagaacggccttgaactgcaatgatagccttaacaccggctggat

SEQ ID NO: 137552 - DNA, 75 bp, Artificial Sequence
  Synthetic
tgctcacgccacgcgtcaatttgtcgacatcttctcgccgggctcacagcagaacgtccagctgatcaacaccga

SEQ ID NO: 137553 - DNA, 75 bp, Artificial Sequence
  Synthetic
aacggaagcggccccgaccagcgcccatactgctggcactacgccccaaaaccttgtggtatcgtacccgcaaga

SEQ ID NO: 137554 - DNA, 75 bp, Artificial Sequence
  Synthetic
ccgggaaatggctgcatcatgcggaggcgcggttttcataggtctggcactcttgaccttgtcaccacactataa

SEQ ID NO: 137555 - DNA, 75 bp, Artificial Sequence
  Synthetic
caccgccgcatgcggtgacatcatcaacggcttgcccgtctctgcccgcaggggccgagagatactgctcgggcc

SEQ ID NO: 137556 - DNA, 75 bp, Artificial Sequence
  Synthetic
cccccccctcaatgttcgggggggccgcgatgccatcatcctcctcatgtgtgcggtccacccagagctaatctt

SEQ ID NO: 137557 - DNA, 75 bp, Artificial Sequence
  Synthetic
aagaccctatgggtttttcgtatgatacccgatgctttgactcaaccgtcactgagagagacatcaggactgagg

SEQ ID NO: 137558 - DNA, 75 bp, Artificial Sequence
  Synthetic
tggccgggacgcacggtcttgtgtccttcctcgtgttcttctgctttgcatggtatctgaagggtaagtgggtgc

SEQ ID NO: 137559 - DNA, 75 bp, Artificial Sequence
  Synthetic
cggcggagatcctgcggaaatccaggaagtttcccccagcgctgcccatatgggcacgcccggattacaaccctc

SEQ ID NO: 137560 - DNA, 75 bp, Artificial Sequence
  Synthetic
gggtgcccactgccacctaccaaggcccctccaataccaccaccgcggaaaaagaggacggttgtcctgacagag

SEQ ID NO: 137561 - DNA, 75 bp, Artificial Sequence
  Synthetic
aaagaggacggttgtcctgacagagtccactgtgtcttctgccttggcggagctcgccactaagaccttcggcag

SEQ ID NO: 137562 - DNA, 75 bp, Artificial Sequence
  Synthetic
tctcccgtggggggagagcggccgtttgcggccgatatctcttcaactgggcggtgaagaccaagctcaaactca

SEQ ID NO: 137563 - DNA, 75 bp, Artificial Sequence
  Synthetic
gcatcttccgggccgctgtgtgcacccggggggttgcgaaggcagtggactttgtgcccgttgagtccatggaaa

SEQ ID NO: 137564 - DNA, 75 bp, Artificial Sequence
  Synthetic
ctaaattctatatccatatttctaaattatctaatatttccctataaatatttatatctatttcatactatattt

SEQ ID NO: 137565 - DNA, 75 bp, Artificial Sequence
  Synthetic
tttatatctatttcatactatatttatctatagtgttagttaatgtggatcgctcgtgtgctagttaatttccca

SEQ ID NO: 137566 - DNA, 75 bp, Artificial Sequence
  Synthetic
cttgcactgccccactgattgtttccgcaagcatccggaagccacatactctcggtgcggctccggtccctggat

SEQ ID NO: 137567 - DNA, 75 bp, Artificial Sequence
  Synthetic
cctgacgcacccaatcaccaaatacattatgacatgcatgtcggccgacctggaggtcgtcacgagcacctgggt

SEQ ID NO: 137568 - DNA, 75 bp, Artificial Sequence
  Synthetic
atgactgccctaacaccagcatcacttggcagcttcaagaggcagtgcttcacgttcctgggtgcgtcccctgcg

SEQ ID NO: 137569 - DNA, 75 bp, Artificial Sequence
  Synthetic
ggcgaagcatatgtggaacttcatcagtgggatacagtacttggcgggcttgtcaacgttgcctggtaaccctgc

SEQ ID NO: 137570 - DNA, 75 bp, Artificial Sequence
  Synthetic
agatcactggacatgtcaaaaacgggacgatgaggatcgtcggtcccaggacctgcaggaacatgtggagtggga

SEQ ID NO: 137571 - DNA, 75 bp, Artificial Sequence
  Synthetic
ggcatcgctggcgcggctgttggcagcataggccttgggaaggtgcttgtggacattctggcgggctatggagca

SEQ ID NO: 137572 - DNA, 75 bp, Artificial Sequence
  Synthetic
gctgtaaagcagcgcggtgctctcaccagaggtttgcggactcacatcgatatcgttgtgatgtccgccacactt

SEQ ID NO: 137573 - DNA, 75 bp, Artificial Sequence
  Synthetic
tgatgttcggcctagcctacttctccatgcagggggcgtgggctaaggttattgtcatcctcttgctgaccgcgg

SEQ ID NO: 137574 - DNA, 75 bp, Artificial Sequence
  Synthetic
ccggagcccagcagaatattcaactgatcaatagcaatggcagttggcacataaaccgtactgccctcaattgca

SEQ ID NO: 137575 - DNA, 75 bp, Artificial Sequence
  Synthetic
ctcgtggacatccttgcaggatatggcgcgggcgtggcgggagctctcgtagcattcaagatcatgagcggcgag

SEQ ID NO: 137576 - DNA, 75 bp, Artificial Sequence
  Synthetic
gcctctatcaccagcccgctcaccacccaacataccctcctgtttaacatcttggggggatgggtggctgcccaa

SEQ ID NO: 137577 - DNA, 75 bp, Artificial Sequence
  Synthetic
gtggtccagtgtactgtttcactcccaccccggtggtcgtgggcacgaccgacaggctcggggtgcctacttaca

SEQ ID NO: 137578 - DNA, 75 bp, Artificial Sequence
  Synthetic
ccgcctcggaagaagcggacggtggtcctcaccgaatcaaccgtatctactgccttggccgagcttgccaccaaa

SEQ ID NO: 137579 - DNA, 75 bp, Artificial Sequence
  Synthetic
gctcaccgacccctcccacatcacagcagaaacggctaagcgtaggctggccagggggtctcccccctccttggc

SEQ ID NO: 137580 - DNA, 75 bp, Artificial Sequence
  Synthetic
caagacttgcggtgcaccaccctgccgcattaggccggatttcaacgccagtgaggatttactgtgccccacgga

SEQ ID NO: 137581 - DNA, 75 bp, Artificial Sequence
  Synthetic
tggcggcaggagatgggcgggaacatcacccgcgtggagtcagagaataaggtagtgattctggactctttcgaa

SEQ ID NO: 137582 - DNA, 75 bp, Artificial Sequence
  Synthetic
tatccgtgcacggtcaactacaccatcttcaagatacggatgtacgtggggggaattgaacataggtttgaagca

SEQ ID NO: 137583 - DNA, 75 bp, Artificial Sequence
  Synthetic
gggaattgaacataggtttgaagcagcatgcaatttcacccgtggggatccctgcaacttggaaaacagggacag

SEQ ID NO: 137584 - DNA, 75 bp, Artificial Sequence
  Synthetic
caccagaacatcgtggacgtgcagtacttatatggcctgtcgccagcccttacaaaatacattgtcaaatgggag

SEQ ID NO: 137585 - DNA, 75 bp, Artificial Sequence
  Synthetic
tgatcgttctgcacgcggcaagcgccgccagcgcgcacggcgtcgcctggttcgtcatcttcttcatagctgctt

SEQ ID NO: 137586 - DNA, 75 bp, Artificial Sequence
  Synthetic
ttttgacgcggctgagcaagggcaagttggtctgggcttgcttgtgatcataacgctcttcacactgaccccggc

SEQ ID NO: 137587 - DNA, 75 bp, Artificial Sequence
  Synthetic
actaatgtcaccaacgaggagaacatgaggccatactgctggcattacccaccgaagccttgcggtatcgtcccg

SEQ ID NO: 137588 - DNA, 75 bp, Artificial Sequence
  Synthetic
ggcggccgtgatggtgtcgtatgggccatgactatgttttgccccgggctggtatttgacatcaccaaatggctc

SEQ ID NO: 137589 - DNA, 75 bp, Artificial Sequence
  Synthetic
ggtatttgacatcaccaaatggctcctggcgatccttggacctggcttcctcctcaaggacgtcttgctatggac

SEQ ID NO: 137590 - DNA, 75 bp, Artificial Sequence
  Synthetic
cgccaagcagaacatccagctggtcaacaccaacggcagttggcacatcaatcgcacagccttgaactgcaatgc

SEQ ID NO: 137591 - DNA, 75 bp, Artificial Sequence
  Synthetic
gcggttgccgtggagcctatcatcttcagtccaatggagaaaaaggtgattgtctgtggggcggagacgacagcc

SEQ ID NO: 137592 - DNA, 75 bp, Artificial Sequence
  Synthetic
tgtgccccacagactgttttaggaagcacccagatactacctatcttaagtgtggagcagggccctggctaaccc

SEQ ID NO: 137593 - DNA, 75 bp, Artificial Sequence
  Synthetic
gtgaattttaccatcttcaaagtgcggatgtatgtagggggggtggagcatcgattttccgcagcatgtaacttc

SEQ ID NO: 137594 - DNA, 75 bp, Artificial Sequence
  Synthetic
tcgcgcccatcactgcttacactcagcagacacggggtgttttgggtgccatagtggtgagcctgacaggacgtg

SEQ ID NO: 137595 - DNA, 75 bp, Artificial Sequence
  Synthetic
tgctgggaacaaaacgctggccggctcgcgagggccggtcactcaaatgtattccagcgctgagggagacctcgt

SEQ ID NO: 137596 - DNA, 75 bp, Artificial Sequence
  Synthetic
ccaaccgatgaaggttggggtaaacactccggcctcttaggccatttcctgtttttttttttttttttttttttt

SEQ ID NO: 137597 - DNA, 75 bp, Artificial Sequence
  Synthetic
ggggtggcctagtcctcctggtactagatccttggacccgtgcacgtgcggggccgtagatctgtaccttgtcac

SEQ ID NO: 137598 - DNA, 75 bp, Artificial Sequence
  Synthetic
cactgactgtttccgcaagcatccggaggccacatatgctcggtgtggctccggtccctggctcacgcccaggtg

SEQ ID NO: 137599 - DNA, 75 bp, Artificial Sequence
  Synthetic
gcagggtggtccctgtggccacgtactccgttctcggattgtggtcctttctcctcctggtcttggccctaccac

SEQ ID NO: 137600 - DNA, 75 bp, Artificial Sequence
  Synthetic
ggtacctgcatgcccctactggcagcgggaagagcaccaaagtccctgcagcgtacgccgcccaaggctataagg

SEQ ID NO: 137601 - DNA, 75 bp, Artificial Sequence
  Synthetic
cacgaaatggttgttggcactcctggggcctgcctacctcctccaggcgtccttgctacggataccatactttgt

SEQ ID NO: 137602 - DNA, 75 bp, Artificial Sequence
  Synthetic
gttgctccttttctatcttccttcttgctctgttctcttgcttaatccatccagcagctagtctagagtggcgga

SEQ ID NO: 137603 - DNA, 75 bp, Artificial Sequence
  Synthetic
ttctcggtatcggaacggtccttgatcaggctgaaacggcgggtgttaggctggtagtcttggccacggccacac

SEQ ID NO: 137604 - DNA, 75 bp, Artificial Sequence
  Synthetic
tttacgggacctggcagtcgccgtggagcccgtggtgttcagcccaatggagaagaaggtaattgtgtggggggc

SEQ ID NO: 137605 - DNA, 75 bp, Artificial Sequence
  Synthetic
ctgcatggcctcccggtttccgcgaggctaggtagggaagttctgctcggccccgctgatggctacacctcgaag

SEQ ID NO: 137606 - DNA, 75 bp, Artificial Sequence
  Synthetic
ccacggtggccaccagggacggcaagctccccacaacgcagcttcgacgtcatatcgatctgcttgtcgggagcg

SEQ ID NO: 137607 - DNA, 75 bp, Artificial Sequence
  Synthetic
ccaccagggacggcaaactccccacaacgcagcttcgacgtcacatcgatctgcttgtcgggagcgccaccctct

SEQ ID NO: 137608 - DNA, 75 bp, Artificial Sequence
  Synthetic
agacacactccagttaactcctggctaggcaacattatcatgtatgcgcccactttgtgggcaaggatggttctg

SEQ ID NO: 137609 - DNA, 75 bp, Artificial Sequence
  Synthetic
aggggttgatgccagcacacacgtcaccgctggccaagcagctcgtaatgcctatgggataactagtttattttc

SEQ ID NO: 137610 - DNA, 75 bp, Artificial Sequence
  Synthetic
gactactgtcaggcttcgggcatatttcaacacgcctggcttgcctgtgtgccaggaccatttagagttctggga

SEQ ID NO: 137611 - DNA, 75 bp, Artificial Sequence
  Synthetic
cctaggggacacgctgtgggcttgttcagagcggccgtgtgcaccaggggtgtggccaaatctattgacttcatc

SEQ ID NO: 137612 - DNA, 75 bp, Artificial Sequence
  Synthetic
gtgtgcgctagggccaaggccccccctccatcttgggataccatgtggaaatgcttgattcggctcaagcccaca

SEQ ID NO: 137613 - DNA, 75 bp, Artificial Sequence
  Synthetic
gaactgtaatgatagcctcaacaccggctggctagcagggctcttctattaccacaaattcaactcttcaggctg

SEQ ID NO: 137614 - DNA, 75 bp, Artificial Sequence
  Synthetic
gcgcgcgacgaggaagacctccgaacggtcccagcccagaggcaggcgccagcccataccaaaggcgcgccagtc

SEQ ID NO: 137615 - DNA, 75 bp, Artificial Sequence
  Synthetic
ggtcactctcacgcaccctgtgacgaagtacatcgccgcctgcatgcaggcagatcttgagatcatgacgagcac

SEQ ID NO: 137616 - DNA, 75 bp, Artificial Sequence
  Synthetic
tgtggcggctgccttagcacacggtgtgagggcagtcgaagacgggattaactatgcgaccgggaatctccctgg

SEQ ID NO: 137617 - DNA, 75 bp, Artificial Sequence
  Synthetic
aatgactgccccaattccagcatcgtttatgaggcggatgatgtcattctgcatacccctgggtgtgtgccgtgt

SEQ ID NO: 137618 - DNA, 75 bp, Artificial Sequence
  Synthetic
atcttctcgttggctcggcagcgttttgctcggcgctttacatcggagacctatgtggcggcgtgttcctggcag

SEQ ID NO: 137619 - DNA, 75 bp, Artificial Sequence
  Synthetic
tatactgccttgctctttcacgcccatgcctgcattgtcaacaggtctaatacacctccaccaaaacatcgtgga

SEQ ID NO: 137620 - DNA, 75 bp, Artificial Sequence
  Synthetic
agaacattgtggacgtgcagtacttgtacggggtaggatcaagcattgtgtcctgggccatcaagtgggagtacg

SEQ ID NO: 137621 - DNA, 75 bp, Artificial Sequence
  Synthetic
aatgatgctgaactggtccccgaccctaacctttgtcacatcttcactactgagggtgccgcagttgctcctcga

SEQ ID NO: 137622 - DNA, 75 bp, Artificial Sequence
  Synthetic
tatgatgctgaactggtccccgaccctaacctttgtcacatcttcactactgagggtgccgcagttgctcctcga

SEQ ID NO: 137623 - DNA, 75 bp, Artificial Sequence
  Synthetic
catgatgctgaactggtccccgaccctaacctttgtcacatcttcactactgagggtgccgcagttgctcctcga

SEQ ID NO: 137624 - DNA, 75 bp, Artificial Sequence
  Synthetic
gatgatgctgaactggtccccgaccctaacctttgtcacatcttcactactgagggtgccgcagttgctcctcga

SEQ ID NO: 137625 - DNA, 75 bp, Artificial Sequence
  Synthetic
cgtgacggagtcagatgcgtcgcagcgggtaacacagctgctcggctctctcaccataaccagcctgctgaggag

SEQ ID NO: 137626 - DNA, 75 bp, Artificial Sequence
  Synthetic
tggaattctgggaggcagtctttacaggtctcacacacatcgatgcccacttcctctcccagacgaagcaaggag

SEQ ID NO: 137627 - DNA, 75 bp, Artificial Sequence
  Synthetic
ggtgttgaagggcataccaccatcggccattctgcgagccgcacagcaatcagcattactagcctgttttcgccc

SEQ ID NO: 137628 - DNA, 75 bp, Artificial Sequence
  Synthetic
ggtgttgaagggcataccaccatcggccattctgcgagccgcacagcaatctgcattactagcctgttttcgccc

SEQ ID NO: 137629 - DNA, 75 bp, Artificial Sequence
  Synthetic
ggtgttgaagggcataccaccatcggccattctgcgagccgcacagcaatccgcattactagcctgttttcgccc

SEQ ID NO: 137630 - DNA, 75 bp, Artificial Sequence
  Synthetic
ggtgttgaagggcataccaccatcggccattctgcgagccgcacagcaatcggcattactagcctgttttcgccc

SEQ ID NO: 137631 - DNA, 75 bp, Artificial Sequence
  Synthetic
ggtgttgaagggcataccaccatcggccattctgcgagccgcacagcattcagcattactagcctgttttcgccc

SEQ ID NO: 137632 - DNA, 75 bp, Artificial Sequence
  Synthetic
ggtgttgaagggcataccaccatcggccattctgcgagccgcacagcattctgcattactagcctgttttcgccc

SEQ ID NO: 137633 - DNA, 75 bp, Artificial Sequence
  Synthetic
ggtgttgaagggcataccaccatcggccattctgcgagccgcacagcattccgcattactagcctgttttcgccc

SEQ ID NO: 137634 - DNA, 75 bp, Artificial Sequence
  Synthetic
ggtgttgaagggcataccaccatcggccattctgcgagccgcacagcattcggcattactagcctgttttcgccc

SEQ ID NO: 137635 - DNA, 75 bp, Artificial Sequence
  Synthetic
ggtgttgaagggcataccaccatcggccattctgcgagccgcacagcactcagcattactagcctgttttcgccc

SEQ ID NO: 137636 - DNA, 75 bp, Artificial Sequence
  Synthetic
ggtgttgaagggcataccaccatcggccattctgcgagccgcacagcactctgcattactagcctgttttcgccc

SEQ ID NO: 137637 - DNA, 75 bp, Artificial Sequence
  Synthetic
ggtgttgaagggcataccaccatcggccattctgcgagccgcacagcactccgcattactagcctgttttcgccc

SEQ ID NO: 137638 - DNA, 75 bp, Artificial Sequence
  Synthetic
ggtgttgaagggcataccaccatcggccattctgcgagccgcacagcactcggcattactagcctgttttcgccc

SEQ ID NO: 137639 - DNA, 75 bp, Artificial Sequence
  Synthetic
ggtgttgaagggcataccaccatcggccattctgcgagccgcacagcagtcagcattactagcctgttttcgccc

SEQ ID NO: 137640 - DNA, 75 bp, Artificial Sequence
  Synthetic
ggtgttgaagggcataccaccatcggccattctgcgagccgcacagcagtctgcattactagcctgttttcgccc

SEQ ID NO: 137641 - DNA, 75 bp, Artificial Sequence
  Synthetic
ggtgttgaagggcataccaccatcggccattctgcgagccgcacagcagtccgcattactagcctgttttcgccc

SEQ ID NO: 137642 - DNA, 75 bp, Artificial Sequence
  Synthetic
ggtgttgaagggcataccaccatcggccattctgcgagccgcacagcagtcggcattactagcctgttttcgccc

SEQ ID NO: 137643 - DNA, 75 bp, Artificial Sequence
  Synthetic
tgacgggtctttggtccctagcattgctcgtcctcttgctcccccaacgggcgtacgcttggtcgggtgaagaca

SEQ ID NO: 137644 - DNA, 75 bp, Artificial Sequence
  Synthetic
cttgccgcgctgttctacacacacaggttcaacgcgtccggatgcccagaacgcatggccagctgccgccccatc

SEQ ID NO: 137645 - DNA, 75 bp, Artificial Sequence
  Synthetic
aactggctctcttccaagctactcccgaggatgcctggcatacccttcatctcatgccagaagggctacagggga

SEQ ID NO: 137646 - DNA, 75 bp, Artificial Sequence
  Synthetic
ccggcttgttttataccaataggtttaactcctcgggttgtcccgagcgtttgagcagttgtcggccactacatg

SEQ ID NO: 137647 - DNA, 75 bp, Artificial Sequence
  Synthetic
tgtctcagcgcagactgtctgcggtcctgtgtattgtttcacgcccagcccggttgtggttggtaccaccgaccg

SEQ ID NO: 137648 - DNA, 75 bp, Artificial Sequence
  Synthetic
cttaaaagtcccctgccaattgccagctccagagttcttctcgtgggtggacggggtccaaatccacaggtttgc

SEQ ID NO: 137649 - DNA, 75 bp, Artificial Sequence
  Synthetic
atgaactccacggggttcgtcaagacgtgcggcgcgccaccatgtaacatccagccgttgtccaagagtaacaac

SEQ ID NO: 137650 - DNA, 75 bp, Artificial Sequence
  Synthetic
cggcagcttgcggagatattctttgcgggctgcccgtctctgcgcgattaggccgtgaggtgttgttgggacctg

SEQ ID NO: 137651 - DNA, 75 bp, Artificial Sequence
  Synthetic
acagaggtattggcgtcaatgctgacagacccatcacacatcacagcggagacagcagcgcgtcgcttggcacgg

SEQ ID NO: 137652 - DNA, 75 bp, Artificial Sequence
  Synthetic
atccctacagattatggcactacccctgcaccgtgaacttcaccctccacaaggtaagaatgtatgtgggcggcg

SEQ ID NO: 137653 - DNA, 75 bp, Artificial Sequence
  Synthetic
caactggacccgtggggaacggtgcgacttagaggatagagacagggtcgagatgagccctctgttgttttcaac

SEQ ID NO: 137654 - DNA, 75 bp, Artificial Sequence
  Synthetic
ggcaattggttcggttgcacctggatgaactcatctggatttaccaaagtgtgcggagcgcctccttgtgtcatc

SEQ ID NO: 137655 - DNA, 75 bp, Artificial Sequence
  Synthetic
cgtagcttttaagatcatgagcggcgagaagccttcggtagaagatgtcgtaaatctcctgcctgctatcctgtc

SEQ ID NO: 137656 - DNA, 75 bp, Artificial Sequence
  Synthetic
ggacgagcgcgaaccctcaattccctcggaatatttgcttcccagaaagaagaaatttccaccagcactaccagt

SEQ ID NO: 137657 - DNA, 75 bp, Artificial Sequence
  Synthetic
tatggaatttcctcggccgtcgtgtcgtgggcagtgaagtgggagtacgtggtcctagcgttcctggtcttggct

SEQ ID NO: 137658 - DNA, 75 bp, Artificial Sequence
  Synthetic
acggctccgacgcctcctcctaggaggcgtcgaactgtggtcttggaccagagcaatgtgggggaagccctccaa

SEQ ID NO: 137659 - DNA, 75 bp, Artificial Sequence
  Synthetic
ggcgtcgaactgtggtcttggaccagagcaatgtgggggaagccctccaagcgttggccgccaagaccttcagcc

SEQ ID NO: 137660 - DNA, 75 bp, Artificial Sequence
  Synthetic
gtaaccagggatggctgtgcgggatagcattcatctgcgccgcttggtacatccgcggcaggcttgtccccgtaa

SEQ ID NO: 137661 - DNA, 75 bp, Artificial Sequence
  Synthetic
atctggatgacagggacaggtccgagctcagtccgttgctgctgtccaccacacagtggcaggtccttccgtgct

SEQ ID NO: 137662 - DNA, 75 bp, Artificial Sequence
  Synthetic
ggcacaattgcaaacgtggatccctcccctcaacgctcgggggggccgcgacgccatcatcctccttacatgtgc

SEQ ID NO: 137663 - DNA, 75 bp, Artificial Sequence
  Synthetic
gttgttaactgttgccatcatcactgtgtttaccatcactccagcatataaatctctccttgtgagcacgctctg

SEQ ID NO: 137664 - DNA, 75 bp, Artificial Sequence
  Synthetic
gaaggcgagccgggggatcctgacttggagcctgcgtcggctgaccaccacaccccctcgcaagaggaggaggcg

SEQ ID NO: 137665 - DNA, 75 bp, Artificial Sequence
  Synthetic
cccggtctctgctgtccaagtgaagaacaccagtgacatctacatggtgactaatgactgttccaatgacagcat

SEQ ID NO: 137666 - DNA, 75 bp, Artificial Sequence
  Synthetic
gtgcgcgctcaagggctcattcgtgcatgcatgctggtgcggaaagtcgctgggggccactatgtccaaatggct

SEQ ID NO: 137667 - DNA, 75 bp, Artificial Sequence
  Synthetic
tgcctgttccacccagcgctggggttcgaggtcaccaagatcatcttggccataattggccctatttacatctta

SEQ ID NO: 137668 - DNA, 75 bp, Artificial Sequence
  Synthetic
gttaccaataaaccctctgagcaattcgctgttgcgctatcacaacaaagtgtactgcacaacatcaaggagcgc

SEQ ID NO: 137669 - DNA, 75 bp, Artificial Sequence
  Synthetic
gtgctggataccggtctcaccaaacgtggctgtgcggcagcgcggcgccctcacgcagggcttgcggacgcacat

SEQ ID NO: 137670 - DNA, 75 bp, Artificial Sequence
  Synthetic
acttcgtgcgggcgcagatcctcctacgcgcatgcctggctctccgaggagtggcaggcggtaagtacgcccaag

SEQ ID NO: 137671 - DNA, 75 bp, Artificial Sequence
  Synthetic
cgctgttgaacctgtcatattctctcctatggagaagaaggtcattacctggggcgccgacacggctgcatgcgg

SEQ ID NO: 137672 - DNA, 75 bp, Artificial Sequence
  Synthetic
ttgcgtggaccccgcgaagggcgggaaaaaggcagctcgcctcatcgtattccctgacctcagcgtcagggtttg

SEQ ID NO: 137673 - DNA, 75 bp, Artificial Sequence
  Synthetic
ctccatgcaaggagcgtgggcgaaggtcgctgtcatccttctgttgaccgctggggttgacgcgcacaccgtcac

SEQ ID NO: 137674 - DNA, 75 bp, Artificial Sequence
  Synthetic
ccaatcacagcatatgcccaacaaaccagaggcgtcgtcggcacaattgtcaccagcctcaccggccgcgacaag

SEQ ID NO: 137675 - DNA, 75 bp, Artificial Sequence
  Synthetic
ccagaggcgtcgtcggcacaattgtcaccagcctcaccggccgcgacaagaatgaggtggagggtgagatccagg

SEQ ID NO: 137676 - DNA, 75 bp, Artificial Sequence
  Synthetic
accttttcatgggaggtgatgtgacccggattgagtccgactccaaggtgatcgttctcgattccctcgactcta

SEQ ID NO: 137677 - DNA, 75 bp, Artificial Sequence
  Synthetic
acctcaagcctcaccgcccttttcgttcgtggcccccagcagaaaattcagctcattaacaacaatggcagttgg

SEQ ID NO: 137678 - DNA, 75 bp, Artificial Sequence
  Synthetic
tggtcggaggccattacgtgcaaatggctatcatcaagttaggggcgcttactggcacctatgtttataaccatc

SEQ ID NO: 137679 - DNA, 75 bp, Artificial Sequence
  Synthetic
ggggcccatatgccaaatgtacaccaatgtcgaccaagacctggtaggctggcctgcaccacctgggtcccgttc

SEQ ID NO: 137680 - DNA, 75 bp, Artificial Sequence
  Synthetic
gcttaccccatgcgcctgtggctcaagcgacctttacctcgtgacaaggaacgccgatgttattcctgcgaggcg

SEQ ID NO: 137681 - DNA, 75 bp, Artificial Sequence
  Synthetic
tgggagggcctatgtctaacagcaaaggccagtcctgcggatacagacgatgccgcgccagcggggtactcacca

SEQ ID NO: 137682 - DNA, 75 bp, Artificial Sequence
  Synthetic
tgccgcgccagcggggtactcaccactagcatgggaaacactctcacgtgctatgtgaaagcccaagcagcctgc

SEQ ID NO: 137683 - DNA, 75 bp, Artificial Sequence
  Synthetic
gcaaggggatcgcccccttctgtggccagctcctcggccagccagctgtccgctccatctctcaaggcaacttgc

SEQ ID NO: 137684 - DNA, 75 bp, Artificial Sequence
  Synthetic
gggattttccgcgcggctgtgtgcactaggggtgtagcgaagtctctcgattttgtcccggtagagagcatgcaa

SEQ ID NO: 137685 - DNA, 75 bp, Artificial Sequence
  Synthetic
gagtcttcacggaggctatgaccaggtattctgccccccccggggatccccccaaacctgaatatgacctggagc

SEQ ID NO: 137686 - DNA, 75 bp, Artificial Sequence
  Synthetic
cagacaacacaactccaccagcggtcccccaaacataccaagtgggatacctccacgcccctacgggcagtggca

SEQ ID NO: 137687 - DNA, 75 bp, Artificial Sequence
  Synthetic
ccctcgggttcgggtcatatatgtccactgcccatggcatagaccccaacatccgcaccggggtgaggaccatca

SEQ ID NO: 137688 - DNA, 75 bp, Artificial Sequence
  Synthetic
ccctcgggttcgggtcttatatgtccactgcccatggcatagaccccaacatccgcaccggggtgaggaccatca

SEQ ID NO: 137689 - DNA, 75 bp, Artificial Sequence
  Synthetic
ccctcgggttcgggtcctatatgtccactgcccatggcatagaccccaacatccgcaccggggtgaggaccatca

SEQ ID NO: 137690 - DNA, 75 bp, Artificial Sequence
  Synthetic
ccctcgggttcgggtcgtatatgtccactgcccatggcatagaccccaacatccgcaccggggtgaggaccatca

SEQ ID NO: 137691 - DNA, 75 bp, Artificial Sequence
  Synthetic
tctactgccttggccgagcttgccaccaagagctttggcagctcctcaacttccggtattacgggcgacaatacg

SEQ ID NO: 137692 - DNA, 75 bp, Artificial Sequence
  Synthetic
ttcaacagatcctactactatattgggcattgggaccgtgttggaccaagcggaaacggccggagtcaggcttac

SEQ ID NO: 137693 - DNA, 75 bp, Artificial Sequence
  Synthetic
acatcactgaaacagccttaccaaccactggtgagatacctttttatggaaaggcaattccccttgaatacatca

SEQ ID NO: 137694 - DNA, 75 bp, Artificial Sequence
  Synthetic
ggacttgtccagctggttcaccgtcagcgccggcgggggcgacatatatcacagcgtgtcgcgagcccgaccccg

SEQ ID NO: 137695 - DNA, 75 bp, Artificial Sequence
  Synthetic
gggcgttgatgtggcggtcattccgacttcaggcgatgtcgtcgtctgcgccactgatgctcttatgactggcta

SEQ ID NO: 137696 - DNA, 75 bp, Artificial Sequence
  Synthetic
gttcaccatagagaccaccactgtaacccaagacgctgtctcacgcagccagaggaggggcaggacgggtagagg

SEQ ID NO: 137697 - DNA, 75 bp, Artificial Sequence
  Synthetic
gggtcgccaccatactttgcccgggcgtggtgtttgacataaccaagtggctcttggcggtgcttgggtctagtt

SEQ ID NO: 137698 - DNA, 75 bp, Artificial Sequence
  Synthetic
accaacgcccctactgctggcactaccctccaaagccttgcggcattgtgcccgcaaagagcgtgtgtggcccgg

SEQ ID NO: 137699 - DNA, 75 bp, Artificial Sequence
  Synthetic
gaccatctagaattctgggagggcgtctttacggggttgacccatatcgatgcccacttcctctcacaaacgaaa

SEQ ID NO: 137700 - DNA, 75 bp, Artificial Sequence
  Synthetic
acttcaaaacatggctctccgctaagattatgccagcgctccctgggctgcccttcatttcctgtcagaagggat

SEQ ID NO: 137701 - DNA, 75 bp, Artificial Sequence
  Synthetic
cttggtgcggtgcaaaatgagatcatcacaacgcaccccatcacaaaatacatcatgacatgcatgtccgcagac

SEQ ID NO: 137702 - DNA, 75 bp, Artificial Sequence
  Synthetic
gcccacttcctatcccagacaaagcagagtggggagaaccttccttacctggtagcgtaccaagccaccgtgtgc

SEQ ID NO: 137703 - DNA, 75 bp, Artificial Sequence
  Synthetic
tttccaccactggcaagccggcactcatcactgaccgggaggtgctttatcaacagttcgatgagatggaggagt

SEQ ID NO: 137704 - DNA, 75 bp, Artificial Sequence
  Synthetic
tttccaccactggcaagccggcactcatctctgaccgggaggtgctttatcaacagttcgatgagatggaggagt

SEQ ID NO: 137705 - DNA, 75 bp, Artificial Sequence
  Synthetic
tttccaccactggcaagccggcactcatccctgaccgggaggtgctttatcaacagttcgatgagatggaggagt

SEQ ID NO: 137706 - DNA, 75 bp, Artificial Sequence
  Synthetic
tttccaccactggcaagccggcactcatcgctgaccgggaggtgctttatcaacagttcgatgagatggaggagt

SEQ ID NO: 137707 - DNA, 75 bp, Artificial Sequence
  Synthetic
catcactgaccgggaggtgctttatcaacagttcgatgagatggaggagtgctcaagacacatcccttacctcgt

SEQ ID NO: 137708 - DNA, 75 bp, Artificial Sequence
  Synthetic
catctctgaccgggaggtgctttatcaacagttcgatgagatggaggagtgctcaagacacatcccttacctcgt

SEQ ID NO: 137709 - DNA, 75 bp, Artificial Sequence
  Synthetic
catccctgaccgggaggtgctttatcaacagttcgatgagatggaggagtgctcaagacacatcccttacctcgt

SEQ ID NO: 137710 - DNA, 75 bp, Artificial Sequence
  Synthetic
catcgctgaccgggaggtgctttatcaacagttcgatgagatggaggagtgctcaagacacatcccttacctcgt

SEQ ID NO: 137711 - DNA, 75 bp, Artificial Sequence
  Synthetic
ttctcgcccccatcactgcttacgcccagcagacacggggtctcttgggcaccatagtggtgagcatgacggggc

SEQ ID NO: 137712 - DNA, 75 bp, Artificial Sequence
  Synthetic
gcctggcctaaacttgaacagttctggcagaagcacctgtggaactttgtcagtggcatacaatatctggctggc

SEQ ID NO: 137713 - DNA, 75 bp, Artificial Sequence
  Synthetic
agcctcactgaccagcccattccagactaccacaaccctcctactaaacatcttaggagggtgggtcgcctcgca

SEQ ID NO: 137714 - DNA, 75 bp, Artificial Sequence
  Synthetic
gccggctatggagcaggtgtgtcgggagcactcgtcgcttttaagatcatgagtggcgagaccccgtcggcggag

SEQ ID NO: 137715 - DNA, 75 bp, Artificial Sequence
  Synthetic
gccggctatggtgcaggtgtgtcgggagcactcgtcgcttttaagatcatgagtggcgagaccccgtcggcggag

SEQ ID NO: 137716 - DNA, 75 bp, Artificial Sequence
  Synthetic
gccggctatggcgcaggtgtgtcgggagcactcgtcgcttttaagatcatgagtggcgagaccccgtcggcggag

SEQ ID NO: 137717 - DNA, 75 bp, Artificial Sequence
  Synthetic
gccggctatggggcaggtgtgtcgggagcactcgtcgcttttaagatcatgagtggcgagaccccgtcggcggag

SEQ ID NO: 137718 - DNA, 75 bp, Artificial Sequence
  Synthetic
gagcactcgtcgcttttaagatcatgagtggcgagaccccgtcggcggaggacatggtcaacttactcccagctc

SEQ ID NO: 137719 - DNA, 75 bp, Artificial Sequence
  Synthetic
tgtccgcggcgctagctgcgctagcggaaaaatcattcccgtcctcgaaaccgcaggaagagaatagctcatcct

SEQ ID NO: 137720 - DNA, 75 bp, Artificial Sequence
  Synthetic
gatagcatttgcctctagaggtaaccatgtgtcgcccacacattatgtgcccgagactgacacctcccggcaaat

SEQ ID NO: 137721 - DNA, 75 bp, Artificial Sequence
  Synthetic
cacaccaagtagcgggtcttggttgcgagacatctgggactgggtgtgtactgtgctttctgacttcaaagtctg

SEQ ID NO: 137722 - DNA, 75 bp, Artificial Sequence
  Synthetic
cacaccatgtagcgggtcttggttgcgagacatctgggactgggtgtgtactgtgctttctgacttcaaagtctg

SEQ ID NO: 137723 - DNA, 75 bp, Artificial Sequence
  Synthetic
cacaccacgtagcgggtcttggttgcgagacatctgggactgggtgtgtactgtgctttctgacttcaaagtctg

SEQ ID NO: 137724 - DNA, 75 bp, Artificial Sequence
  Synthetic
cacaccaggtagcgggtcttggttgcgagacatctgggactgggtgtgtactgtgctttctgacttcaaagtctg

SEQ ID NO: 137725 - DNA, 75 bp, Artificial Sequence
  Synthetic
cactccaagtagcgggtcttggttgcgagacatctgggactgggtgtgtactgtgctttctgacttcaaagtctg

SEQ ID NO: 137726 - DNA, 75 bp, Artificial Sequence
  Synthetic
cactccatgtagcgggtcttggttgcgagacatctgggactgggtgtgtactgtgctttctgacttcaaagtctg

SEQ ID NO: 137727 - DNA, 75 bp, Artificial Sequence
  Synthetic
cactccacgtagcgggtcttggttgcgagacatctgggactgggtgtgtactgtgctttctgacttcaaagtctg

SEQ ID NO: 137728 - DNA, 75 bp, Artificial Sequence
  Synthetic
cactccaggtagcgggtcttggttgcgagacatctgggactgggtgtgtactgtgctttctgacttcaaagtctg

SEQ ID NO: 137729 - DNA, 75 bp, Artificial Sequence
  Synthetic
caccccaagtagcgggtcttggttgcgagacatctgggactgggtgtgtactgtgctttctgacttcaaagtctg

SEQ ID NO: 137730 - DNA, 75 bp, Artificial Sequence
  Synthetic
caccccatgtagcgggtcttggttgcgagacatctgggactgggtgtgtactgtgctttctgacttcaaagtctg

SEQ ID NO: 137731 - DNA, 75 bp, Artificial Sequence
  Synthetic
caccccacgtagcgggtcttggttgcgagacatctgggactgggtgtgtactgtgctttctgacttcaaagtctg

SEQ ID NO: 137732 - DNA, 75 bp, Artificial Sequence
  Synthetic
caccccaggtagcgggtcttggttgcgagacatctgggactgggtgtgtactgtgctttctgacttcaaagtctg

SEQ ID NO: 137733 - DNA, 75 bp, Artificial Sequence
  Synthetic
cacgccaagtagcgggtcttggttgcgagacatctgggactgggtgtgtactgtgctttctgacttcaaagtctg

SEQ ID NO: 137734 - DNA, 75 bp, Artificial Sequence
  Synthetic
cacgccatgtagcgggtcttggttgcgagacatctgggactgggtgtgtactgtgctttctgacttcaaagtctg

SEQ ID NO: 137735 - DNA, 75 bp, Artificial Sequence
  Synthetic
cacgccacgtagcgggtcttggttgcgagacatctgggactgggtgtgtactgtgctttctgacttcaaagtctg

SEQ ID NO: 137736 - DNA, 75 bp, Artificial Sequence
  Synthetic
cacgccaggtagcgggtcttggttgcgagacatctgggactgggtgtgtactgtgctttctgacttcaaagtctg

SEQ ID NO: 137737 - DNA, 75 bp, Artificial Sequence
  Synthetic
cgcctatgacatcatcatatgcgacgaatgccatgctgtggatgctaccaccattctcggcatcggaacagttct

SEQ ID NO: 137738 - DNA, 75 bp, Artificial Sequence
  Synthetic
ctgctctatgtcgtactcttggaccggcgccctgataacaccatgtagtgctgaggaggagaaactgcccatcag

SEQ ID NO: 137739 - DNA, 75 bp, Artificial Sequence
  Synthetic
ccattctcggcatcggaacagttcttgaccaagcagagacagccggggtcaggctaactgtgctggccacggcca

SEQ ID NO: 137740 - DNA, 75 bp, Artificial Sequence
  Synthetic
ctcccgggggtgcctttcttctcatgccaaccggggttccgcggtgtgtggaggggtgacggggtatgccgcacc

SEQ ID NO: 137741 - DNA, 75 bp, Artificial Sequence
  Synthetic
agcaacatctggcacggcaccttccccatcaatgctacgacaactggtcctagcgtgcccatccctgagcccaac

SEQ ID NO: 137742 - DNA, 75 bp, Artificial Sequence
  Synthetic
tagcgtgcccatccctgagcccaactacaaaagggccctctggagggtatccgcagaggaatacgtcgaagtgct

SEQ ID NO: 137743 - DNA, 75 bp, Artificial Sequence
  Synthetic
aactggggctgttgccgcgagcaacgctagaggcctcgccagtttgttcacttctggacctaagcagaacattca

SEQ ID NO: 137744 - DNA, 75 bp, Artificial Sequence
  Synthetic
ggacttgctggaagacaccacaactccaattccaaccaccatcatggcgaagaacgaggtgttttgtgtggaccc

SEQ ID NO: 137745 - DNA, 75 bp, Artificial Sequence
  Synthetic
gtgcgcatacatcgttacgcgcctccctgcaagcccctcctaagggatgaaatttctttctcggtggggctcaac

SEQ ID NO: 137746 - DNA, 75 bp, Artificial Sequence
  Synthetic
cgcttcaactcgtcaggatgtcccgaacgcctgtccgtgtgccgcaatatcgaggccttccggataggatggggc

SEQ ID NO: 137747 - DNA, 75 bp, Artificial Sequence
  Synthetic
ctgctcgccgcctcgcgcgtgggtcccctccatcccttgccagctcatcagcgagccagctctcagctccatcac

SEQ ID NO: 137748 - DNA, 75 bp, Artificial Sequence
  Synthetic
ccctccatcccttgccagctcatcagcgagccagctctcagctccatcactaaaggcaacgtgtaccacgcacgg

SEQ ID NO: 137749 - DNA, 75 bp, Artificial Sequence
  Synthetic
ggttctcgtatgatacccgttgctttgactcaactgtcactggacaggacatcagggtggaagaggcggtttacc

SEQ ID NO: 137750 - DNA, 75 bp, Artificial Sequence
  Synthetic
aggttctgatctacgggggttcgttagcctctttagcccgggtcccaggcagcaactccagttagtcaacaacaa

SEQ ID NO: 137751 - DNA, 75 bp, Artificial Sequence
  Synthetic
cttgactcgttcgaccccttgacacctgagtatgatgatagggaaccatctgtgccggctgaatgccacaggcca

SEQ ID NO: 137752 - DNA, 75 bp, Artificial Sequence
  Synthetic
caatccacccttaattgagacctggaagagaccggactaagacccaccgctagttcgagggtgcgccatgcctcc

SEQ ID NO: 137753 - DNA, 75 bp, Artificial Sequence
  Synthetic
caatccacccttaattgagacctggaagagaccggactatgacccaccgctagttcgagggtgcgccatgcctcc

SEQ ID NO: 137754 - DNA, 75 bp, Artificial Sequence
  Synthetic
caatccacccttaattgagacctggaagagaccggactacgacccaccgctagttcgagggtgcgccatgcctcc

SEQ ID NO: 137755 - DNA, 75 bp, Artificial Sequence
  Synthetic
caatccacccttaattgagacctggaagagaccggactaggacccaccgctagttcgagggtgcgccatgcctcc

SEQ ID NO: 137756 - DNA, 75 bp, Artificial Sequence
  Synthetic
ggtcgactacccctacaggctctggcattacccctgcacagttaactataccatcttcaaggtaaggatgtacgt

SEQ ID NO: 137757 - DNA, 75 bp, Artificial Sequence
  Synthetic
ataaacaccaacggcagctggcacattaacaggactgctctgaactgcaatgactccctcaacaccgggttcctt

SEQ ID NO: 137758 - DNA, 75 bp, Artificial Sequence
  Synthetic
agagcaaccctgagagccttcacggaggctatgaccaggtattctgctccacccggagatgctccacagcccacc

SEQ ID NO: 137759 - DNA, 75 bp, Artificial Sequence
  Synthetic
aggctatgaccaggtattctgctccacccggagatgctccacagcccacctacgaccttgagctcattacatctt

SEQ ID NO: 137760 - DNA, 75 bp, Artificial Sequence
  Synthetic
ttcccgacgtcgactccccccacaactaactcagactctggtcaccctacaaccagcaagagctcagaccaagcc

SEQ ID NO: 137761 - DNA, 75 bp, Artificial Sequence
  Synthetic
tcacctacaccgagcccccccgctcggatcagaggccctattgctggcactacgcgcctcgcccgtgcggtattg

SEQ ID NO: 137762 - DNA, 75 bp, Artificial Sequence
  Synthetic
caactacaccctgttcaaagtcaggatgtatgtgggaggggtcgagcacaggctggaagttgcttgcaactggac

SEQ ID NO: 137763 - DNA, 75 bp, Artificial Sequence
  Synthetic
ctactgttagtgaggagggtgacagcgtcgtgtgctgttccatgtcatacagttggacgggggcgctggttacac

SEQ ID NO: 137764 - DNA, 75 bp, Artificial Sequence
  Synthetic
aacttcattagcggcattcaatacctcgcaggactgtcaacactgccagggaaccccgctgtggcttccatgatg

SEQ ID NO: 137765 - DNA, 75 bp, Artificial Sequence
  Synthetic
ctcattcgacaccacaacctggtgtactccacaacgtctcggagtgctgcactgcggcaaaagaaggtcaccttt

SEQ ID NO: 137766 - DNA, 75 bp, Artificial Sequence
  Synthetic
ttctagcactgccccaacaggcttacgcctatgacgcatctgtgcacggacagataggcgcggctttgttgatac

SEQ ID NO: 137767 - DNA, 75 bp, Artificial Sequence
  Synthetic
aagaccaaactcactccactgccagccgctggccagttggatttatccagctggtttacggttggcgtcggcggg

SEQ ID NO: 137768 - DNA, 75 bp, Artificial Sequence
  Synthetic
cgtatggaaggacttgctagaagacaaccaaacaccaatacccacaaccatcatggcaaagaacgaagtgttctg

SEQ ID NO: 137769 - DNA, 75 bp, Artificial Sequence
  Synthetic
ctggtttacggttggcgtcggcgggaacgacatttatcacagcgtgtcacgtgcccgaacccgctatttgctgct

SEQ ID NO: 137770 - DNA, 75 bp, Artificial Sequence
  Synthetic
cctgctcctgctggcgttgccccaacgggcatacgcgctggacacggagatggccgcgtcgtgtggcggcgttgt

SEQ ID NO: 137771 - DNA, 75 bp, Artificial Sequence
  Synthetic
cgcaaactgccaactgccatcatgggagacgcttatggcttccagtactcccccaagcagcgggtagaccgcctg

SEQ ID NO: 137772 - DNA, 75 bp, Artificial Sequence
  Synthetic
cacctatggggttttcttatgacaccaagtgctttgactccacagtcactgaacatgacatcaagactgagcggg

SEQ ID NO: 137773 - DNA, 75 bp, Artificial Sequence
  Synthetic
ccaactatgtgggacccgcaggtgccgcgcaagcggagtgcttaccaccagcttgggtaacaccatgacctgcta

SEQ ID NO: 137774 - DNA, 75 bp, Artificial Sequence
  Synthetic
caacatctctggcaatgtccgcctgggctccatgagaatcacagggcctaaaacctgcatgaacacctggcaggg

SEQ ID NO: 137775 - DNA, 75 bp, Artificial Sequence
  Synthetic
gcagcaggcctcaccaactatgacatgttggtctgcggagacgacctggtggtcattgccgagagcgctggagtt

SEQ ID NO: 137776 - DNA, 75 bp, Artificial Sequence
  Synthetic
taacatcctgctcctccaacgtatccgtggcccacgaccacactggacagagatattactacctcacacgtgacc

SEQ ID NO: 137777 - DNA, 75 bp, Artificial Sequence
  Synthetic
cgtggcccacgaccacactggacagagatattactacctcacacgtgaccctaccatacctttatctcgggccgc

SEQ ID NO: 137778 - DNA, 75 bp, Artificial Sequence
  Synthetic
attcaactcttcaggctgtcctgagaggctggccagctgccgaccccttaccgattttgaccagggctggggccc

SEQ ID NO: 137779 - DNA, 75 bp, Artificial Sequence
  Synthetic
tcctgggatgtataattaccagcctgaccggccgggacaagaaccaggtggaaggtgaggttcagattgtgtcaa

SEQ ID NO: 137780 - DNA, 75 bp, Artificial Sequence
  Synthetic
gacgctgacgtgttgacgtccatgctaacggatccgtcccatataacggcggaggccgcagcgcgtcgcttagcg

SEQ ID NO: 137781 - DNA, 75 bp, Artificial Sequence
  Synthetic
ttccagatcctccagtcacaggagcaattggatagggcactcgacttcgatatatacggagtcacttactccatt

SEQ ID NO: 137782 - DNA, 75 bp, Artificial Sequence
  Synthetic
aattggatagggcactcgacttcgatatatacggagtcacttactccattaatccactccagctcccacaaatca

SEQ ID NO: 137783 - DNA, 75 bp, Artificial Sequence
  Synthetic
gcctcagaaaacttggggcccctccattgagagcttggaggcatcgagcccgcgcggtcagagcgaagcttattg

SEQ ID NO: 137784 - DNA, 75 bp, Artificial Sequence
  Synthetic
gaggggcgatgtgactcggatagagtctgagtccaaagtggtctttctggactatctcgacccagtggtcgaaga

SEQ ID NO: 137785 - DNA, 75 bp, Artificial Sequence
  Synthetic
cttgtcaggctggttcgtgtctggcttcagcgggggggacatttatcacagcgtgtcccaggctcgaccccgcat

SEQ ID NO: 137786 - DNA, 75 bp, Artificial Sequence
  Synthetic
cagattaccaaccgcccactgttgcgggctgtgctctccccccccccaagaagaccccgacgcctcccccaagga

SEQ ID NO: 137787 - DNA, 75 bp, Artificial Sequence
  Synthetic
gggctgtgctctccccccccccaagaagaccccgacgcctcccccaaggagacgccggacagtgggtttgagcga

SEQ ID NO: 137788 - DNA, 75 bp, Artificial Sequence
  Synthetic
ctcccggcaaattataaccatactcagctctctcactgtgaccagcctactacggcgtctgcacgagtggatcaa

SEQ ID NO: 137789 - DNA, 75 bp, Artificial Sequence
  Synthetic
ctggcactacccccctaggccttgtaacgccgtcccagcaaaatccgtctgtggaccggtctattgtttcacacc

SEQ ID NO: 137790 - DNA, 75 bp, Artificial Sequence
  Synthetic
cgacgccgtcatcttactcatgtgtgttgtacacccgactctggtatttgacatcaccaaactactgctggccgt

SEQ ID NO: 137791 - DNA, 75 bp, Artificial Sequence
  Synthetic
tgggtgtgcgcgcgacgagaaagacttccgagcgatcccagcccagaggcaggcgccaacctataccaaaggcgc

SEQ ID NO: 137792 - DNA, 75 bp, Artificial Sequence
  Synthetic
ccgctcgtcggcgctcccgtagggggcgtcgcaagagctctcgcgcatggcgtgagggcccttgaagacgggata

SEQ ID NO: 137793 - DNA, 75 bp, Artificial Sequence
  Synthetic
ccagaagctacatacagtcggtgcgggtccggtccctggctcacaccgaggtgcttggttgactacccataccgg

SEQ ID NO: 137794 - DNA, 75 bp, Artificial Sequence
  Synthetic
attaagcaaccgggaatcttcctggttgctccttttctatcttcctcttggcactcttttcgtgcctcaccactc

SEQ ID NO: 137795 - DNA, 75 bp, Artificial Sequence
  Synthetic
attatgcaaccgggaatcttcctggttgctccttttctatcttcctcttggcactcttttcgtgcctcaccactc

SEQ ID NO: 137796 - DNA, 75 bp, Artificial Sequence
  Synthetic
attacgcaaccgggaatcttcctggttgctccttttctatcttcctcttggcactcttttcgtgcctcaccactc

SEQ ID NO: 137797 - DNA, 75 bp, Artificial Sequence
  Synthetic
attaggcaaccgggaatcttcctggttgctccttttctatcttcctcttggcactcttttcgtgcctcaccactc

SEQ ID NO: 137798 - DNA, 75 bp, Artificial Sequence
  Synthetic
gcacacccctgggtgcgtaccctgtgttaagactggcaataagtcgcaatgttgggtaccggtggcccctacgct

SEQ ID NO: 137799 - DNA, 75 bp, Artificial Sequence
  Synthetic
atcggtcaccgtgccacatcccaatatcgaggaggtggccctgtccaacattggagagatccccttctacggcaa

SEQ ID NO: 137800 - DNA, 75 bp, Artificial Sequence
  Synthetic
ctctgcggtggtgtgttcttggtaggacaactcttcacgttcaggcctcggcagcataccaccgtccaggaatgt

SEQ ID NO: 137801 - DNA, 75 bp, Artificial Sequence
  Synthetic
cggggatctgtgcggctctctcttcttggcgggacaactattcaccttccagccccgccgtcattggaccgtgca

SEQ ID NO: 137802 - DNA, 75 bp, Artificial Sequence
  Synthetic
acaaaatacatcgccacatgcatgcaagctgaccttgaggtcatgaccagcacgtgggtcctggctgggggagtc

SEQ ID NO: 137803 - DNA, 75 bp, Artificial Sequence
  Synthetic
tgaggataccgcaactgcttcttgagatatttctcgagggccactggggtgtcatcggagccatactgtactaca

SEQ ID NO: 137804 - DNA, 75 bp, Artificial Sequence
  Synthetic
tccatgcagggcaactgggccaaggtcgctatcatcatggttatgttttcaggggtcgatgccactacatatacc

SEQ ID NO: 137805 - DNA, 75 bp, Artificial Sequence
  Synthetic
gtggagtggctaaggcggtggactttatccctgtggagagcctagagacaaccatgaggtccccggtgtttacgg

SEQ ID NO: 137806 - DNA, 75 bp, Artificial Sequence
  Synthetic
tgccgcgccagcggggtgctcaccactagcatggggaataccatcacatgctatgtgaaagccctagcggcttgc

SEQ ID NO: 137807 - DNA, 75 bp, Artificial Sequence
  Synthetic
tgagcaagcggcatccctcggagctgttggtctattggttatcaccatcttcaccatcacccccatgtacaagaa

SEQ ID NO: 137808 - DNA, 75 bp, Artificial Sequence
  Synthetic
gcttaccagcctctttgaccttgggcccagccagcacatccagctgattaacaccaatggcagctggcacatcaa

SEQ ID NO: 137809 - DNA, 75 bp, Artificial Sequence
  Synthetic
agcaaatgccgaccactgcacgcttttgaccagggttgggggccgctctcatatgccaatatatctggaccatct

SEQ ID NO: 137810 - DNA, 75 bp, Artificial Sequence
  Synthetic
cgttgtcaactagcaccactatccttctcaacatcttgggaggctggctggcgtcccaaattgcgccgcccgcgg

SEQ ID NO: 137811 - DNA, 75 bp, Artificial Sequence
  Synthetic
tcgccagtggttgtgggcactactgatgctgagggcgtcccaacctatacctggggtggaaataagacagacgtg

SEQ ID NO: 137812 - DNA, 75 bp, Artificial Sequence
  Synthetic
ctcgggcccctctgacgaccgtccctactgttggcattacgctcctaggccatgtgacgtggtgccggccagcac

SEQ ID NO: 137813 - DNA, 75 bp, Artificial Sequence
  Synthetic
tagtgattggcaccactgaccggaaagggctccccacatatacttggggggagaacgagtccgatgttttcttgc

SEQ ID NO: 137814 - DNA, 75 bp, Artificial Sequence
  Synthetic
ctggggtggaaataagacagacgtgttcctgctgaagtccttgcggcctcccaacggtcagtggtttgggtgcac

SEQ ID NO: 137815 - DNA, 75 bp, Artificial Sequence
  Synthetic
ttgatgagatggaggaatgcgcctccaaagccgccctcattgaggaagggcagcggatggcggagatgctcaagt

SEQ ID NO: 137816 - DNA, 75 bp, Artificial Sequence
  Synthetic
gtcgagccggtcattttctctcccatggagaagaaaatcatcacctggggtgcggatactgccgcgtgtggtgac

SEQ ID NO: 137817 - DNA, 75 bp, Artificial Sequence
  Synthetic
gccgtcgggcgtcggcaacaacactttgatatgtcccactgactgcttccgaaaacacccggaagctacctatga

SEQ ID NO: 137818 - DNA, 75 bp, Artificial Sequence
  Synthetic
atccggaagctacataccagcggtgtggatcgggaccctgggtaacacctaggtgtctggtggattacccttaca

SEQ ID NO: 137819 - DNA, 75 bp, Artificial Sequence
  Synthetic
gtccgaatgtttgtgggcggcatccaacatcagttcgaagctgcttgcaactggactcgtggagagcggtgtgag

SEQ ID NO: 137820 - DNA, 75 bp, Artificial Sequence
  Synthetic
ctggattaatccacctacaccagaacattgtggacgttcagtacctctatggagtctcctcggctgtagtgtcgt

SEQ ID NO: 137821 - DNA, 75 bp, Artificial Sequence
  Synthetic
aatgggagttcgtcgtcctcgttttcctcctcctagcagacgcacgcgtgtgcgttgctctttggctgatgctga

SEQ ID NO: 137822 - DNA, 75 bp, Artificial Sequence
  Synthetic
tgcgttgctctttggctgatgctgatgatatcacaagcagaagcagccttggagaaccttgtcacgctgaacgcc

SEQ ID NO: 137823 - DNA, 75 bp, Artificial Sequence
  Synthetic
ggcggcgttggagaacctcatcgtcctcaatgccgcttcagccgccagcaaccaaggatggctttgtgggatagc

SEQ ID NO: 137824 - DNA, 75 bp, Artificial Sequence
  Synthetic
atcaagtgggctacttgcacgcgcctaccggtagtggtaagagcaccaaggtccctgccgcctatgtggcacaag

SEQ ID NO: 137825 - DNA, 75 bp, Artificial Sequence
  Synthetic
tgctcataagcaacgttgaagcagcagtggagaggcttgtcgtcctcaacgcggctagcgccgccggcactgccg

SEQ ID NO: 137826 - DNA, 75 bp, Artificial Sequence
  Synthetic
ccacgcagggcgtatgctgataacgtggaggcggcggcttcactgggactgttgacaatcgctgtcattaccata

SEQ ID NO: 137827 - DNA, 75 bp, Artificial Sequence
  Synthetic
tcaccctggtataagcattggatcggccgcctcatgtggtggaaccagtacaccatatgtagatgcgaggccgcc

SEQ ID NO: 137828 - DNA, 75 bp, Artificial Sequence
  Synthetic
gacctgggctcagcccgggtacccttggcccctctatggcaatgagggctgcgggtgggcaggatggctcctgtc

SEQ ID NO: 137829 - DNA, 75 bp, Artificial Sequence
  Synthetic
ctccgctacaggttcgcggtggacgcgatgcggttatactgcttacctgcttgctgcatccacagctggggtttg

SEQ ID NO: 137830 - DNA, 75 bp, Artificial Sequence
  Synthetic
actgctgacaaccttaaatgcccatgccaggtcccatcgcccgaatttttcacagaactggacggggtgcgcctg

SEQ ID NO: 137831 - DNA, 75 bp, Artificial Sequence
  Synthetic
tgcttgcatgttccttcgtggcgtcgcaggcgggagatacgtccaggccgcgctcctgcggctgggcgcgtggac

SEQ ID NO: 137832 - DNA, 75 bp, Artificial Sequence
  Synthetic
ctgggcacggcctgattacaacccgccacttgtggaatcatggaagaggcccgattatcaaccgccgacggttgc

SEQ ID NO: 137833 - DNA, 75 bp, Artificial Sequence
  Synthetic
tgtagagcctgtcatcttctcccccatggagaagaaggtcatcacctggggggctgacacggttgcgtgtggtga

SEQ ID NO: 137834 - DNA, 75 bp, Artificial Sequence
  Synthetic
ggccgtgaggtgttgttgggacctgctgatgattaccgggagatgggttggcgcctgttggccccaatcacagca

SEQ ID NO: 137835 - DNA, 75 bp, Artificial Sequence
  Synthetic
tgaccgaggtagaggatgatcgtgagccttctgtaccatcagagtacttgatcaagaggaggaagttcccaccgg

SEQ ID NO: 137836 - DNA, 75 bp, Artificial Sequence
  Synthetic
attacggcctatgcccagcagaccagaggcctagtgggcacaattgtcaccagccttacaggccgcgacaaaaat

SEQ ID NO: 137837 - DNA, 75 bp, Artificial Sequence
  Synthetic
agaaatcctgcggaagtctcggagatttagcccggccctgcccatttgggcacggccggactacaaccccccgtt

SEQ ID NO: 137838 - DNA, 75 bp, Artificial Sequence
  Synthetic
cgaagacgctggcaggcccgaaagggcctatatgccagatgtataccaacgtcgatcaagacctggtgggttggc

SEQ ID NO: 137839 - DNA, 75 bp, Artificial Sequence
  Synthetic
caggggctaagtctcttgaaccgtgcacctgcgggtctgcagacttatacttggttacccgcgatgctgacgtca

SEQ ID NO: 137840 - DNA, 75 bp, Artificial Sequence
  Synthetic
tgccagcacagaacgtatgtggcccagtgtattgcttcactcctagccccgtggtggtgggaacgaccgacaagt

SEQ ID NO: 137841 - DNA, 75 bp, Artificial Sequence
  Synthetic
gggtgacactcgtgcggcgcttctcagtccacggccgataagcaccctaaagggatcttcgggtggtcctatgtt

SEQ ID NO: 137842 - DNA, 75 bp, Artificial Sequence
  Synthetic
aagctgctcagaaaacggctgcgatcgccggcctcttcaatcgaggcgccaaccaggacatccatctgatcaact

SEQ ID NO: 137843 - DNA, 75 bp, Artificial Sequence
  Synthetic
agggccaaagcccccccgccttcttgggatacgatgtggaagtgtctcatcagactcaaacccacccttaccggc

SEQ ID NO: 137844 - DNA, 75 bp, Artificial Sequence
  Synthetic
ggggcaaaggaggttcgcagcttgtccgggagggccgtcaaccacatcaagtccgtgtggaaggacctcctggaa

SEQ ID NO: 137845 - DNA, 75 bp, Artificial Sequence
  Synthetic
accgtgcgatctccgtccttctctgacaacacaaccccaccagcggtaccgcagacataccaagtagggtacctc

SEQ ID NO: 137846 - DNA, 75 bp, Artificial Sequence
  Synthetic
gcaccaaagttcccgcagcatacgctgcccagggttacaaggttttggtactcaacccttctgtggcggccacgc

SEQ ID NO: 137847 - DNA, 75 bp, Artificial Sequence
  Synthetic
tgagcgactttaagacctggctaaaagccaagctcatgccgcaactgcctgggattccctttgtgtcctgccagc

SEQ ID NO: 137848 - DNA, 75 bp, Artificial Sequence
  Synthetic
ctatggcaagtttctcgcggacgggggctgctctggcggcgcctatgacgtcatcatttgcgatgagtgccattc

SEQ ID NO: 137849 - DNA, 75 bp, Artificial Sequence
  Synthetic
ctagccccctaaccaccaaccagaccatgttctttaacatactggggggctgggttgccacccacttggcgggac

SEQ ID NO: 137850 - DNA, 75 bp, Artificial Sequence
  Synthetic
ctcatcgtataccccgaccttggggtcagggtgtgcgagaagatggccctctatgacattgcacaaaagcttccc

SEQ ID NO: 137851 - DNA, 75 bp, Artificial Sequence
  Synthetic
tcagttacagtaccccaacctaacatcactgaggaggccttgcccaccaccggtgaggtgcccttctaagggaga

SEQ ID NO: 137852 - DNA, 75 bp, Artificial Sequence
  Synthetic
tcagttacagtaccccaacctaacatcactgaggaggccttgcccaccaccggtgaggtgcccttctatgggaga

SEQ ID NO: 137853 - DNA, 75 bp, Artificial Sequence
  Synthetic
tcagttacagtaccccaacctaacatcactgaggaggccttgcccaccaccggtgaggtgcccttctacgggaga

SEQ ID NO: 137854 - DNA, 75 bp, Artificial Sequence
  Synthetic
tcagttacagtaccccaacctaacatcactgaggaggccttgcccaccaccggtgaggtgcccttctaggggaga

SEQ ID NO: 137855 - DNA, 75 bp, Artificial Sequence
  Synthetic
tcagttacagtaccccatcctaacatcactgaggaggccttgcccaccaccggtgaggtgcccttctaagggaga

SEQ ID NO: 137856 - DNA, 75 bp, Artificial Sequence
  Synthetic
tcagttacagtaccccatcctaacatcactgaggaggccttgcccaccaccggtgaggtgcccttctatgggaga

SEQ ID NO: 137857 - DNA, 75 bp, Artificial Sequence
  Synthetic
tcagttacagtaccccatcctaacatcactgaggaggccttgcccaccaccggtgaggtgcccttctacgggaga

SEQ ID NO: 137858 - DNA, 75 bp, Artificial Sequence
  Synthetic
tcagttacagtaccccatcctaacatcactgaggaggccttgcccaccaccggtgaggtgcccttctaggggaga

SEQ ID NO: 137859 - DNA, 75 bp, Artificial Sequence
  Synthetic
tcagttacagtaccccaccctaacatcactgaggaggccttgcccaccaccggtgaggtgcccttctaagggaga

SEQ ID NO: 137860 - DNA, 75 bp, Artificial Sequence
  Synthetic
tcagttacagtaccccaccctaacatcactgaggaggccttgcccaccaccggtgaggtgcccttctatgggaga

SEQ ID NO: 137861 - DNA, 75 bp, Artificial Sequence
  Synthetic
tcagttacagtaccccaccctaacatcactgaggaggccttgcccaccaccggtgaggtgcccttctacgggaga

SEQ ID NO: 137862 - DNA, 75 bp, Artificial Sequence
  Synthetic
tcagttacagtaccccaccctaacatcactgaggaggccttgcccaccaccggtgaggtgcccttctaggggaga

SEQ ID NO: 137863 - DNA, 75 bp, Artificial Sequence
  Synthetic
tcagttacagtaccccagcctaacatcactgaggaggccttgcccaccaccggtgaggtgcccttctaagggaga

SEQ ID NO: 137864 - DNA, 75 bp, Artificial Sequence
  Synthetic
tcagttacagtaccccagcctaacatcactgaggaggccttgcccaccaccggtgaggtgcccttctatgggaga

SEQ ID NO: 137865 - DNA, 75 bp, Artificial Sequence
  Synthetic
tcagttacagtaccccagcctaacatcactgaggaggccttgcccaccaccggtgaggtgcccttctacgggaga

SEQ ID NO: 137866 - DNA, 75 bp, Artificial Sequence
  Synthetic
tcagttacagtaccccagcctaacatcactgaggaggccttgcccaccaccggtgaggtgcccttctaggggaga

SEQ ID NO: 137867 - DNA, 75 bp, Artificial Sequence
  Synthetic
tcagttacagttccccaacctaacatcactgaggaggccttgcccaccaccggtgaggtgcccttctaagggaga

SEQ ID NO: 137868 - DNA, 75 bp, Artificial Sequence
  Synthetic
tcagttacagttccccaacctaacatcactgaggaggccttgcccaccaccggtgaggtgcccttctatgggaga

SEQ ID NO: 137869 - DNA, 75 bp, Artificial Sequence
  Synthetic
tcagttacagttccccaacctaacatcactgaggaggccttgcccaccaccggtgaggtgcccttctacgggaga

SEQ ID NO: 137870 - DNA, 75 bp, Artificial Sequence
  Synthetic
tcagttacagttccccaacctaacatcactgaggaggccttgcccaccaccggtgaggtgcccttctaggggaga

SEQ ID NO: 137871 - DNA, 75 bp, Artificial Sequence
  Synthetic
tcagttacagttccccatcctaacatcactgaggaggccttgcccaccaccggtgaggtgcccttctaagggaga

SEQ ID NO: 137872 - DNA, 75 bp, Artificial Sequence
  Synthetic
tcagttacagttccccatcctaacatcactgaggaggccttgcccaccaccggtgaggtgcccttctatgggaga

SEQ ID NO: 137873 - DNA, 75 bp, Artificial Sequence
  Synthetic
tcagttacagttccccatcctaacatcactgaggaggccttgcccaccaccggtgaggtgcccttctacgggaga

SEQ ID NO: 137874 - DNA, 75 bp, Artificial Sequence
  Synthetic
tcagttacagttccccatcctaacatcactgaggaggccttgcccaccaccggtgaggtgcccttctaggggaga

SEQ ID NO: 137875 - DNA, 75 bp, Artificial Sequence
  Synthetic
tcagttacagttccccaccctaacatcactgaggaggccttgcccaccaccggtgaggtgcccttctaagggaga

SEQ ID NO: 137876 - DNA, 75 bp, Artificial Sequence
  Synthetic
tcagttacagttccccaccctaacatcactgaggaggccttgcccaccaccggtgaggtgcccttctatgggaga

SEQ ID NO: 137877 - DNA, 75 bp, Artificial Sequence
  Synthetic
tcagttacagttccccaccctaacatcactgaggaggccttgcccaccaccggtgaggtgcccttctacgggaga

SEQ ID NO: 137878 - DNA, 75 bp, Artificial Sequence
  Synthetic
tcagttacagttccccaccctaacatcactgaggaggccttgcccaccaccggtgaggtgcccttctaggggaga

SEQ ID NO: 137879 - DNA, 75 bp, Artificial Sequence
  Synthetic
tcagttacagttccccagcctaacatcactgaggaggccttgcccaccaccggtgaggtgcccttctaagggaga

SEQ ID NO: 137880 - DNA, 75 bp, Artificial Sequence
  Synthetic
tcagttacagttccccagcctaacatcactgaggaggccttgcccaccaccggtgaggtgcccttctatgggaga

SEQ ID NO: 137881 - DNA, 75 bp, Artificial Sequence
  Synthetic
tcagttacagttccccagcctaacatcactgaggaggccttgcccaccaccggtgaggtgcccttctacgggaga

SEQ ID NO: 137882 - DNA, 75 bp, Artificial Sequence
  Synthetic
tcagttacagttccccagcctaacatcactgaggaggccttgcccaccaccggtgaggtgcccttctaggggaga

SEQ ID NO: 137883 - DNA, 75 bp, Artificial Sequence
  Synthetic
tcagttacagtcccccaacctaacatcactgaggaggccttgcccaccaccggtgaggtgcccttctaagggaga

SEQ ID NO: 137884 - DNA, 75 bp, Artificial Sequence
  Synthetic
tcagttacagtcccccaacctaacatcactgaggaggccttgcccaccaccggtgaggtgcccttctatgggaga

SEQ ID NO: 137885 - DNA, 75 bp, Artificial Sequence
  Synthetic
tcagttacagtcccccaacctaacatcactgaggaggccttgcccaccaccggtgaggtgcccttctacgggaga

SEQ ID NO: 137886 - DNA, 75 bp, Artificial Sequence
  Synthetic
tcagttacagtcccccaacctaacatcactgaggaggccttgcccaccaccggtgaggtgcccttctaggggaga

SEQ ID NO: 137887 - DNA, 75 bp, Artificial Sequence
  Synthetic
tcagttacagtcccccatcctaacatcactgaggaggccttgcccaccaccggtgaggtgcccttctaagggaga

SEQ ID NO: 137888 - DNA, 75 bp, Artificial Sequence
  Synthetic
tcagttacagtcccccatcctaacatcactgaggaggccttgcccaccaccggtgaggtgcccttctatgggaga

SEQ ID NO: 137889 - DNA, 75 bp, Artificial Sequence
  Synthetic
tcagttacagtcccccatcctaacatcactgaggaggccttgcccaccaccggtgaggtgcccttctacgggaga

SEQ ID NO: 137890 - DNA, 75 bp, Artificial Sequence
  Synthetic
tcagttacagtcccccatcctaacatcactgaggaggccttgcccaccaccggtgaggtgcccttctaggggaga

SEQ ID NO: 137891 - DNA, 75 bp, Artificial Sequence
  Synthetic
tcagttacagtcccccaccctaacatcactgaggaggccttgcccaccaccggtgaggtgcccttctaagggaga

SEQ ID NO: 137892 - DNA, 75 bp, Artificial Sequence
  Synthetic
tcagttacagtcccccaccctaacatcactgaggaggccttgcccaccaccggtgaggtgcccttctatgggaga

SEQ ID NO: 137893 - DNA, 75 bp, Artificial Sequence
  Synthetic
tcagttacagtcccccaccctaacatcactgaggaggccttgcccaccaccggtgaggtgcccttctacgggaga

SEQ ID NO: 137894 - DNA, 75 bp, Artificial Sequence
  Synthetic
tcagttacagtcccccaccctaacatcactgaggaggccttgcccaccaccggtgaggtgcccttctaggggaga

SEQ ID NO: 137895 - DNA, 75 bp, Artificial Sequence
  Synthetic
tcagttacagtcccccagcctaacatcactgaggaggccttgcccaccaccggtgaggtgcccttctaagggaga

SEQ ID NO: 137896 - DNA, 75 bp, Artificial Sequence
  Synthetic
tcagttacagtcccccagcctaacatcactgaggaggccttgcccaccaccggtgaggtgcccttctatgggaga

SEQ ID NO: 137897 - DNA, 75 bp, Artificial Sequence
  Synthetic
tcagttacagtcccccagcctaacatcactgaggaggccttgcccaccaccggtgaggtgcccttctacgggaga

SEQ ID NO: 137898 - DNA, 75 bp, Artificial Sequence
  Synthetic
tcagttacagtcccccagcctaacatcactgaggaggccttgcccaccaccggtgaggtgcccttctaggggaga

SEQ ID NO: 137899 - DNA, 75 bp, Artificial Sequence
  Synthetic
tcagttacagtgccccaacctaacatcactgaggaggccttgcccaccaccggtgaggtgcccttctaagggaga

SEQ ID NO: 137900 - DNA, 75 bp, Artificial Sequence
  Synthetic
tcagttacagtgccccaacctaacatcactgaggaggccttgcccaccaccggtgaggtgcccttctatgggaga

SEQ ID NO: 137901 - DNA, 75 bp, Artificial Sequence
  Synthetic
tcagttacagtgccccaacctaacatcactgaggaggccttgcccaccaccggtgaggtgcccttctacgggaga

SEQ ID NO: 137902 - DNA, 75 bp, Artificial Sequence
  Synthetic
tcagttacagtgccccaacctaacatcactgaggaggccttgcccaccaccggtgaggtgcccttctaggggaga

SEQ ID NO: 137903 - DNA, 75 bp, Artificial Sequence
  Synthetic
tcagttacagtgccccatcctaacatcactgaggaggccttgcccaccaccggtgaggtgcccttctaagggaga

SEQ ID NO: 137904 - DNA, 75 bp, Artificial Sequence
  Synthetic
tcagttacagtgccccatcctaacatcactgaggaggccttgcccaccaccggtgaggtgcccttctatgggaga

SEQ ID NO: 137905 - DNA, 75 bp, Artificial Sequence
  Synthetic
tcagttacagtgccccatcctaacatcactgaggaggccttgcccaccaccggtgaggtgcccttctacgggaga

SEQ ID NO: 137906 - DNA, 75 bp, Artificial Sequence
  Synthetic
tcagttacagtgccccatcctaacatcactgaggaggccttgcccaccaccggtgaggtgcccttctaggggaga

SEQ ID NO: 137907 - DNA, 75 bp, Artificial Sequence
  Synthetic
tcagttacagtgccccaccctaacatcactgaggaggccttgcccaccaccggtgaggtgcccttctaagggaga

SEQ ID NO: 137908 - DNA, 75 bp, Artificial Sequence
  Synthetic
tcagttacagtgccccaccctaacatcactgaggaggccttgcccaccaccggtgaggtgcccttctatgggaga

SEQ ID NO: 137909 - DNA, 75 bp, Artificial Sequence
  Synthetic
tcagttacagtgccccaccctaacatcactgaggaggccttgcccaccaccggtgaggtgcccttctacgggaga

SEQ ID NO: 137910 - DNA, 75 bp, Artificial Sequence
  Synthetic
tcagttacagtgccccaccctaacatcactgaggaggccttgcccaccaccggtgaggtgcccttctaggggaga

SEQ ID NO: 137911 - DNA, 75 bp, Artificial Sequence
  Synthetic
tcagttacagtgccccagcctaacatcactgaggaggccttgcccaccaccggtgaggtgcccttctaagggaga

SEQ ID NO: 137912 - DNA, 75 bp, Artificial Sequence
  Synthetic
tcagttacagtgccccagcctaacatcactgaggaggccttgcccaccaccggtgaggtgcccttctatgggaga

SEQ ID NO: 137913 - DNA, 75 bp, Artificial Sequence
  Synthetic
tcagttacagtgccccagcctaacatcactgaggaggccttgcccaccaccggtgaggtgcccttctacgggaga

SEQ ID NO: 137914 - DNA, 75 bp, Artificial Sequence
  Synthetic
tcagttacagtgccccagcctaacatcactgaggaggccttgcccaccaccggtgaggtgcccttctaggggaga

SEQ ID NO: 137915 - DNA, 75 bp, Artificial Sequence
  Synthetic
ctcagaggcatggggctcaacgctgtagcattctataggggtcttgatgtgtccatcataccaacagcaggagac

SEQ ID NO: 137916 - DNA, 75 bp, Artificial Sequence
  Synthetic
tcaacgctgtagcattctataggggcgtagacgtgtctgttattcccacctcaggcgacgtcgttgtgtgtgcca

SEQ ID NO: 137917 - DNA, 75 bp, Artificial Sequence
  Synthetic
caccattgagaccaccaccgtgccccaggacgctgtttcgcgaagccaaaggagagggaggacgggtagggggaa

SEQ ID NO: 137918 - DNA, 75 bp, Artificial Sequence
  Synthetic
gagctgactccatctgaaacaactgtaagactacgcgcctacctgaataccccggggctccccgtctgtcaagac

SEQ ID NO: 137919 - DNA, 75 bp, Artificial Sequence
  Synthetic
gttgtggcgcgtggcttctgacagctatgtggaggtgcgtcgggtgggggacgcccactacattgtaggggccac

SEQ ID NO: 137920 - DNA, 75 bp, Artificial Sequence
  Synthetic
tggcataccaggctaccgtctgcgcgagagctaaagccccccccccttcctgggacacaatgtggaaatgcctta

SEQ ID NO: 137921 - DNA, 75 bp, Artificial Sequence
  Synthetic
cgggtggcagcaactctcagaaaacttggagcgcctcccctcagagcgtggaagagtcgggcgcgtgctgtgagg

SEQ ID NO: 137922 - DNA, 75 bp, Artificial Sequence
  Synthetic
aatgactgtcccaattccagcatcgtgtacgaggcagatactatgatcttacaccttccgggatgcgtcccgtgt

SEQ ID NO: 137923 - DNA, 75 bp, Artificial Sequence
  Synthetic
catgacctgcatgtcagcagacttggaggttataaccagcacttgggtactagtgggcggagtcgtcgcagcgct

SEQ ID NO: 137924 - DNA, 75 bp, Artificial Sequence
  Synthetic
agcgcgctctttggcgggtatccgccgaggactacgttgaggtacggaggttgggcgactgccactatgtggtag

SEQ ID NO: 137925 - DNA, 75 bp, Artificial Sequence
  Synthetic
ctcgcacgaggttctcctccatcggaagctagctcctctgccagtcagctgtcagctccgtcgatgaaggccacg

SEQ ID NO: 137926 - DNA, 75 bp, Artificial Sequence
  Synthetic
caatttgacgagatggaagagtgttccagacacattccctatctcgtagagggccaacaccttgcagagcagttc

SEQ ID NO: 137927 - DNA, 75 bp, Artificial Sequence
  Synthetic
aaaaacacttgtggaactttgtgagcggtgtacaatatttggccggcttgtccaccctaccgggcaacccagctg

SEQ ID NO: 137928 - DNA, 75 bp, Artificial Sequence
  Synthetic
ccggcgaaggtcccgcaatttgggtaaggtcatcgataccctcacgtgtggattcgccgacctcatggggtacat

SEQ ID NO: 137929 - DNA, 75 bp, Artificial Sequence
  Synthetic
gggttgctacccatttggcagggccccagagctcttccgcattcgtggtaagcggcttggccggcgctgccatag

SEQ ID NO: 137930 - DNA, 75 bp, Artificial Sequence
  Synthetic
acgtgggctcaccggcctcttcacactagggccgcagcagaatttgcagcttattaacaccaatggcagttggca

SEQ ID NO: 137931 - DNA, 75 bp, Artificial Sequence
  Synthetic
agcaaacccagtgggctccactgcgttcgtggtgagtggtctggcaggcgccgcggtcggcagtattggcctcgg

SEQ ID NO: 137932 - DNA, 75 bp, Artificial Sequence
  Synthetic
tccaacacaagtattgtgtatgaggcagcggacgtcatcatgcatattcccgggtgcgtaccctgcgttcgggaa

SEQ ID NO: 137933 - DNA, 75 bp, Artificial Sequence
  Synthetic
cccagaccttcctggcaacctgcatcaacggggtgtgctggactgtctaccacggggccggaacaaggaccatcg

SEQ ID NO: 137934 - DNA, 75 bp, Artificial Sequence
  Synthetic
gctggtgtctcaggcgccttggtggcttttaagatcatgggaggagaactccccactgctgaggacatggtcaac

SEQ ID NO: 137935 - DNA, 75 bp, Artificial Sequence
  Synthetic
cgcatgggtagctgtaaaaccctggaccagtttgaccagggctggggaccgctttcatatgccaacataagcggc

SEQ ID NO: 137936 - DNA, 75 bp, Artificial Sequence
  Synthetic
atggtcaacttgcttccagcgttactatctcctggagcactggtagtgggtgtggtgtgtgcgggtatactgaga

SEQ ID NO: 137937 - DNA, 75 bp, Artificial Sequence
  Synthetic
ccatctgaggaaaaaccctactgctggcattacccgccaaggccctgtggtgttgtcccagcgcaatcggtctgc

SEQ ID NO: 137938 - DNA, 75 bp, Artificial Sequence
  Synthetic
ggacctggggagggggcggtgcagtggatgaacaggctcatcgcattcgcatcccggggtaaccacgtctcaccg

SEQ ID NO: 137939 - DNA, 75 bp, Artificial Sequence
  Synthetic
agactgacacctctcggcagattatgaccatcctctcctctcttaccgtaaccagccttctccggaagctgcatg

SEQ ID NO: 137940 - DNA, 75 bp, Artificial Sequence
  Synthetic
gggggcccactggggagtcctggcgggccttgcctactattccatggtagggaactgggctaaggttttgattgt

SEQ ID NO: 137941 - DNA, 75 bp, Artificial Sequence
  Synthetic
acgcgtcaaaaaatgtgactcagatactcacttctcttaccatcaccagcctactccgtagattacatcagtggg

SEQ ID NO: 137942 - DNA, 75 bp, Artificial Sequence
  Synthetic
caagaccaagcttgtaccagctttgcctggggtccctttcctctcgtgccaacggggcttccgtggcatatggag

SEQ ID NO: 137943 - DNA, 75 bp, Artificial Sequence
  Synthetic
aacatctggcatggcactttccccatcaacgcaacgacgactggtcctagcgtacctgtcccggagcccaattat

SEQ ID NO: 137944 - DNA, 75 bp, Artificial Sequence
  Synthetic
gtcagaggactttcttctttgctcagtccgggccccaagcagaaactggagctgatcaacaccaacggatcgtgg

SEQ ID NO: 137945 - DNA, 75 bp, Artificial Sequence
  Synthetic
tactcagatggcaattctcccctgttcattcacaaccatgcctgcgctgtcgaccggcctaatccaccttcacca

SEQ ID NO: 137946 - DNA, 75 bp, Artificial Sequence
  Synthetic
tactcagatggcaattctcccctgttcattcactaccatgcctgcgctgtcgaccggcctaatccaccttcacca

SEQ ID NO: 137947 - DNA, 75 bp, Artificial Sequence
  Synthetic
tactcagatggcaattctcccctgttcattcaccaccatgcctgcgctgtcgaccggcctaatccaccttcacca

SEQ ID NO: 137948 - DNA, 75 bp, Artificial Sequence
  Synthetic
tactcagatggcaattctcccctgttcattcacgaccatgcctgcgctgtcgaccggcctaatccaccttcacca

SEQ ID NO: 137949 - DNA, 75 bp, Artificial Sequence
  Synthetic
gtccctgccaggtgccggctccagagtttttcactgaagtggacggtgtgcgactacatcgttacgcacccgctt

SEQ ID NO: 137950 - DNA, 75 bp, Artificial Sequence
  Synthetic
cccttggcagatgctaacatcaccggctcttctgatgacagaccgtactgctggcactacgcacctagaccttgt

SEQ ID NO: 137951 - DNA, 75 bp, Artificial Sequence
  Synthetic
gatccgtcgaagggtggacgcaagccggcacgcctaatagtttacccagacttgggcgtgcgggtctgcgagaag

SEQ ID NO: 137952 - DNA, 75 bp, Artificial Sequence
  Synthetic
ggttacatcaatgttggttgacccgtcgcatgtgaccgcggaggctgcagctcgccgcctcgcgcgcgggtcccc

SEQ ID NO: 137953 - DNA, 75 bp, Artificial Sequence
  Synthetic
ttgcgcgtgggtcccctccatcagaggcaagctcatccgccagccaactgtcggctccgtcgttgaaggccactt

SEQ ID NO: 137954 - DNA, 75 bp, Artificial Sequence
  Synthetic
gttgccagggcctgttatggggcctgattttcatctgctgcgcctggcatgtgcgtgggcgcttcgtgccccttt

SEQ ID NO: 137955 - DNA, 75 bp, Artificial Sequence
  Synthetic
gtgcgtgggcgcttcgtgcccctttccacctacgcagtcttgcagctatggccccttctgctgttagtgcttgcc

SEQ ID NO: 137956 - DNA, 75 bp, Artificial Sequence
  Synthetic
gccccagccagcacatccagctgatcaactccaatggcagttggcacatcaatcgcacggctctgaactgtaatg

SEQ ID NO: 137957 - DNA, 75 bp, Artificial Sequence
  Synthetic
gcgaacttgctatggagacaggaaatgggaggcaacatcacccgggtggagtctgagaacaaggtcgtcgtcctc

SEQ ID NO: 137958 - DNA, 75 bp, Artificial Sequence
  Synthetic
aaaggttgtgattcttgattcattcgaacctctgagagccgaaactgatgacgccgagctctcggtggctgcaga

SEQ ID NO: 137959 - DNA, 75 bp, Artificial Sequence
  Synthetic
acgccgagctctcggtggctgcagagtgtttcaagaagcctcccaagtatcctccagcccttcctatctgggcta

SEQ ID NO: 137960 - DNA, 75 bp, Artificial Sequence
  Synthetic
agtatattgtttcactcccagtcctgtggtggtgggaacgaccgacaggtcgggcgcgcctacctacaactgggg

SEQ ID NO: 137961 - DNA, 75 bp, Artificial Sequence
  Synthetic
aactcttcaggctgtcccgagagaatggccagctgtcgacctctcaccgagtttgcccagggctggggccctatc

SEQ ID NO: 137962 - DNA, 75 bp, Artificial Sequence
  Synthetic
cgatctgggcgcggcctgattacaacccgcctctgcttgagacttggaagaaaccaggctacaccccgccgttgg

SEQ ID NO: 137963 - DNA, 75 bp, Artificial Sequence
  Synthetic
aagcttgggagcccccccctaagagcgtggagacaccgggcacgagcagtgcgcgccaaactcatcgcccaggga

SEQ ID NO: 137964 - DNA, 75 bp, Artificial Sequence
  Synthetic
cagtacagtttccttaaaacaccatactttgtccgagcacacattctgctgcgcgcgtgcatgcttttccgcggt

SEQ ID NO: 137965 - DNA, 75 bp, Artificial Sequence
  Synthetic
tcaactacaccatattcaaagtcaggatgtacgtgggaggggtcgagcacaggctggaagctgcctgcaactgga

SEQ ID NO: 137966 - DNA, 75 bp, Artificial Sequence
  Synthetic
atctgaactggcccaagcgccctcctcggcgccatcgtcctccgcgacagaccaagactcgggccacccaaccac

SEQ ID NO: 137967 - DNA, 75 bp, Artificial Sequence
  Synthetic
catgcccggtcccgccatttgctgctttgcctactcctactcaccgtgggggtaggcatctttctcttaccggct

SEQ ID NO: 137968 - DNA, 75 bp, Artificial Sequence
  Synthetic
gagacagcccgccacactccagtcaattcgtggttgggcaacatcattatgtttgcccccacgatatgggtgcgt

SEQ ID NO: 137969 - DNA, 75 bp, Artificial Sequence
  Synthetic
gccactgcgtcgatccgcagacatgtggatttgttagtgggtgcggctacgctgtgttcggcactttatgttgga

SEQ ID NO: 137970 - DNA, 75 bp, Artificial Sequence
  Synthetic
gatctcagttcgggatcgtggtctacggtcagtgaggagggcgatagcgtcgtgtgctgctccatgtcttataat

SEQ ID NO: 137971 - DNA, 75 bp, Artificial Sequence
  Synthetic
aggcaaaggatggaggctcctcgctccgattactgcatacgcccagcagactcgaggcttgatgggcaccatcgt

SEQ ID NO: 137972 - DNA, 75 bp, Artificial Sequence
  Synthetic
ccaccacatcccggagtgctgcaacgcggcaaaagaaggtcacctttgaccgcgtacaagttcttgatcaacact

SEQ ID NO: 137973 - DNA, 75 bp, Artificial Sequence
  Synthetic
cggctgggcttacttcactcttcacacaggggccccagcagaaaatccaactggtcaacaccaacggcagctggc

SEQ ID NO: 137974 - DNA, 75 bp, Artificial Sequence
  Synthetic
gagctaatctttgacatcaccaaactcctgctcgccatactcggtccgctcatggtgctccaggctgccataact

SEQ ID NO: 137975 - DNA, 75 bp, Artificial Sequence
  Synthetic
accaagacgtagtgaaggaggttaagctccgagccacaggggtaacggctaagctcctctccattgaggaagctt

SEQ ID NO: 137976 - DNA, 75 bp, Artificial Sequence
  Synthetic
ctctggacagtctatcatggggccggctcgaagactctcgccggcccaaaaggccccatttgtcagatgtacacc

SEQ ID NO: 137977 - DNA, 75 bp, Artificial Sequence
  Synthetic
gtgggaggacttgctagaagacacccaaacaccaatctctacaaccatcatggcaaagaatgaggtcttttgcgt

SEQ ID NO: 137978 - DNA, 75 bp, Artificial Sequence
  Synthetic
atgaggtcaacatgtccggatgcttaggacgtatggccagctgccgctccatcgatgagttcactcaggggtggg

SEQ ID NO: 137979 - DNA, 75 bp, Artificial Sequence
  Synthetic
aaattaccgactgccattatggggaatgcctacggcttccagtactcgcccaagcaacgggtggattacctgctc

SEQ ID NO: 137980 - DNA, 75 bp, Artificial Sequence
  Synthetic
cgcgtccaaggccttctccggatctgcgcgctagcgcggaagatggccggaggccattacgtgcaaatggtcatc

SEQ ID NO: 137981 - DNA, 75 bp, Artificial Sequence
  Synthetic
gcgcgctagcgcggaagatggccggaggccattacgtgcaaatggtcatcatcaagttaggggcgcttactggca

SEQ ID NO: 137982 - DNA, 75 bp, Artificial Sequence
  Synthetic
gtccggatgcccggagcgcatggccagctgccgccccattgacaagtttgctcaggggtggggtcccatcactta

SEQ ID NO: 137983 - DNA, 75 bp, Artificial Sequence
  Synthetic
tctacctatcttgcaatttagaccctatggctaggaaggccataatgtctctcaccgacaggctctacgtagggg

SEQ ID NO: 137984 - DNA, 75 bp, Artificial Sequence
  Synthetic
tctacctatcttgcaatttagaccctatggctaggaaggccataatgtctctcaccgacaggctctacgttgggg

SEQ ID NO: 137985 - DNA, 75 bp, Artificial Sequence
  Synthetic
tctacctatcttgcaatttagaccctatggctaggaaggccataatgtctctcaccgacaggctctacgtcgggg

SEQ ID NO: 137986 - DNA, 75 bp, Artificial Sequence
  Synthetic
tctacctatcttgcaatttagaccctatggctaggaaggccataatgtctctcaccgacaggctctacgtggggg

SEQ ID NO: 137987 - DNA, 75 bp, Artificial Sequence
  Synthetic
tctacctatcttgcaatttagaccctttggctaggaaggccataatgtctctcaccgacaggctctacgtagggg

SEQ ID NO: 137988 - DNA, 75 bp, Artificial Sequence
  Synthetic
tctacctatcttgcaatttagaccctttggctaggaaggccataatgtctctcaccgacaggctctacgttgggg

SEQ ID NO: 137989 - DNA, 75 bp, Artificial Sequence
  Synthetic
tctacctatcttgcaatttagaccctttggctaggaaggccataatgtctctcaccgacaggctctacgtcgggg

SEQ ID NO: 137990 - DNA, 75 bp, Artificial Sequence
  Synthetic
tctacctatcttgcaatttagaccctttggctaggaaggccataatgtctctcaccgacaggctctacgtggggg

SEQ ID NO: 137991 - DNA, 75 bp, Artificial Sequence
  Synthetic
tctacctatcttgcaatttagaccctctggctaggaaggccataatgtctctcaccgacaggctctacgtagggg

SEQ ID NO: 137992 - DNA, 75 bp, Artificial Sequence
  Synthetic
tctacctatcttgcaatttagaccctctggctaggaaggccataatgtctctcaccgacaggctctacgttgggg

SEQ ID NO: 137993 - DNA, 75 bp, Artificial Sequence
  Synthetic
tctacctatcttgcaatttagaccctctggctaggaaggccataatgtctctcaccgacaggctctacgtcgggg

SEQ ID NO: 137994 - DNA, 75 bp, Artificial Sequence
  Synthetic
tctacctatcttgcaatttagaccctctggctaggaaggccataatgtctctcaccgacaggctctacgtggggg

SEQ ID NO: 137995 - DNA, 75 bp, Artificial Sequence
  Synthetic
tctacctatcttgcaatttagaccctgtggctaggaaggccataatgtctctcaccgacaggctctacgtagggg

SEQ ID NO: 137996 - DNA, 75 bp, Artificial Sequence
  Synthetic
tctacctatcttgcaatttagaccctgtggctaggaaggccataatgtctctcaccgacaggctctacgttgggg

SEQ ID NO: 137997 - DNA, 75 bp, Artificial Sequence
  Synthetic
tctacctatcttgcaatttagaccctgtggctaggaaggccataatgtctctcaccgacaggctctacgtcgggg

SEQ ID NO: 137998 - DNA, 75 bp, Artificial Sequence
  Synthetic
tctacctatcttgcaatttagaccctgtggctaggaaggccataatgtctctcaccgacaggctctacgtggggg

SEQ ID NO: 137999 - DNA, 75 bp, Artificial Sequence
  Synthetic
tgattcaaccgtcaccgagcgggatatccggactgagaacgacatctatcagtcttgccagctggatcccgtggc

SEQ ID NO: 138000 - DNA, 75 bp, Artificial Sequence
  Synthetic
ctcaggggtggggtcccatcacttacgctgagccgcccagcttggaccagaagccctattgttggcactacgcac

SEQ ID NO: 138001 - DNA, 75 bp, Artificial Sequence
  Synthetic
gaacggctctacgtaggtggccccatggtaaactccaagggacagtcatgtggctaccgtagatgccgcgccagt

SEQ ID NO: 138002 - DNA, 75 bp, Artificial Sequence
  Synthetic
tgctctttttctatcttcctcttggcacttctctcgtgcctgactgtccccgcttctgccgttaactatcgtaac

SEQ ID NO: 138003 - DNA, 75 bp, Artificial Sequence
  Synthetic
aaaagctgaagccgcctgccgagctgcaggccttaccaattatgacatgttggtctgcggagatgatttggtagt

SEQ ID NO: 138004 - DNA, 75 bp, Artificial Sequence
  Synthetic
gcaggccttaccaattatgacatgttggtctgcggagatgatttggtagtcattgctgaaagtgctggagtccag

SEQ ID NO: 138005 - DNA, 75 bp, Artificial Sequence
  Synthetic
ttatgcaacagggaatcttcccggttgctctttttctatcttcctcttggcacttctctcgtgcctgactgtccc

SEQ ID NO: 138006 - DNA, 75 bp, Artificial Sequence
  Synthetic
ccctggcccgtgcggcttgggaaacagctcgtcacactccagttaactcctggttgggcaacatcatcatgtacg

SEQ ID NO: 138007 - DNA, 75 bp, Artificial Sequence
  Synthetic
agctcgtcacactccagttaactcctggttgggcaacatcatcatgtacgcgcctaccatctgggtgcgcatggt

SEQ ID NO: 138008 - DNA, 75 bp, Artificial Sequence
  Synthetic
catggtgctcatgacccatttcttccagataatccaagcgcaggagcaactagacaaggtgcttgacttcgatat

SEQ ID NO: 138009 - DNA, 75 bp, Artificial Sequence
  Synthetic
gggttgatgctggaacttatgcttctgggggcgcggctggtcacaccctcttcacagtgtctaacctcttcacca

SEQ ID NO: 138010 - DNA, 75 bp, Artificial Sequence
  Synthetic
gagagcttggagacaccgagcccgtgcggtccgagctaagcttattgctcaagggggaggcgcagcaatttgcgg

SEQ ID NO: 138011 - DNA, 75 bp, Artificial Sequence
  Synthetic
cggttcgactgcgcgcttacctcaacaccccaggacttcccgtctgccaagaccatcttgagttctgggagggag

SEQ ID NO: 138012 - DNA, 75 bp, Artificial Sequence
  Synthetic
cggacgtggccgtgttgacgtccatgctcactgatccctcccatataacagcagaggcggctgggaggaggttag

SEQ ID NO: 138013 - DNA, 75 bp, Artificial Sequence
  Synthetic
actcctgtgcccactcctactttctgtaggagtaggcatcttcttgctgcccgctcgataggcgggtagcctaac

SEQ ID NO: 138014 - DNA, 75 bp, Artificial Sequence
  Synthetic
cgctgggggccattatgtccaaatggctctcatgaagctggccgcgctgacaggtacgtacgtttatgaccacct

SEQ ID NO: 138015 - DNA, 75 bp, Artificial Sequence
  Synthetic
attgtgccggcactcagtgtgtgtggccccgtgtattgctttactcccagccctgtcgtggtcggaacaactgat

SEQ ID NO: 138016 - DNA, 75 bp, Artificial Sequence
  Synthetic
gttccagccatatcccttacctccctgaggcccaagccatcgctgagcaattcaagcagaaggttcttggcctca

SEQ ID NO: 138017 - DNA, 75 bp, Artificial Sequence
  Synthetic
cctgccccactgactgtttcaggaagcatccggagaccacctacgccaaatgcgggtcaggcccctggatcacac

SEQ ID NO: 138018 - DNA, 75 bp, Artificial Sequence
  Synthetic
gcatccggagaccacctacgccaaatgcgggtcaggcccctggatcacaccacgatgcttgattcactatccata

SEQ ID NO: 138019 - DNA, 75 bp, Artificial Sequence
  Synthetic
tcggatggaggcagcatgcaactggaccaggggggaagtctgcggcttggagcatagggatcgcgcagaactgtc

SEQ ID NO: 138020 - DNA, 75 bp, Artificial Sequence
  Synthetic
gcgtcagggtcctggaagacggcgtgaactatgcaacagggaatcttcctggttgctctttctctatcttcctct

SEQ ID NO: 138021 - DNA, 75 bp, Artificial Sequence
  Synthetic
acttctacgaccctcttgcttaatattttaggcgggtgggttgcgtcgcagctcgcggcgccggctgcttctact

SEQ ID NO: 138022 - DNA, 75 bp, Artificial Sequence
  Synthetic
tccagcctccgcctatgaagttcgcaatgtctcgggcatctaccacgttaccaacgactgtagcaactccagcat

SEQ ID NO: 138023 - DNA, 75 bp, Artificial Sequence
  Synthetic
ttggcagcataggccttgggaaggtgcttgtggacatcctggcgggttatggggcaggggtggctggcgcacttg

SEQ ID NO: 138024 - DNA, 75 bp, Artificial Sequence
  Synthetic
ctcgcggcgcgatacgccagctaccctacccagtcgatccgacgtcatgtcgatctgctggtgggaactgctgtg

SEQ ID NO: 138025 - DNA, 75 bp, Artificial Sequence
  Synthetic
gagtctctgcttgcctatggatgatggttatggtagctcaggttgaggcagctctgtccaacctgatcaacatca

SEQ ID NO: 138026 - DNA, 75 bp, Artificial Sequence
  Synthetic
tggcttctggtacgccatcttcttcatctgcatcgcctggcacgtcaagggtcggcttccggctgctgctaccta

SEQ ID NO: 138027 - DNA, 75 bp, Artificial Sequence
  Synthetic
cacgtgtctccgacgcactacgtccctgagactgatgcatctcaaaaggtcacagctatactcagttccctcacc

SEQ ID NO: 138028 - DNA, 75 bp, Artificial Sequence
  Synthetic
ctgagactgatgcatctcaaaaggtcacagctatactcagttccctcaccgtgaccagtcttctacggaagctac

SEQ ID NO: 138029 - DNA, 75 bp, Artificial Sequence
  Synthetic
gcaattgttccatctacgcgggccatatcaccggccaccgtatggcatgggacatgatgatgaactggtctccta

SEQ ID NO: 138030 - DNA, 75 bp, Artificial Sequence
  Synthetic
gtcgttgttgcgctgaccatcctgacactgtctccccactacaagtcatggctggctaagggactatggtggatt

SEQ ID NO: 138031 - DNA, 75 bp, Artificial Sequence
  Synthetic
ttccatggcaggcaattgggccaaggtagtggtcgtgctgctcctcttcgctggcgtcgatgcgaccacttacac

SEQ ID NO: 138032 - DNA, 75 bp, Artificial Sequence
  Synthetic
gaagatagctggacccaagtggtgtagcaacacctggcacggtactttccccatcaatgcaaccacgaccggccc

SEQ ID NO: 138033 - DNA, 75 bp, Artificial Sequence
  Synthetic
ccgcctcagccgcgcactacaccaacaagtctggtctttaccacctgaccaatgactgccctaacagcagcatca

SEQ ID NO: 138034 - DNA, 75 bp, Artificial Sequence
  Synthetic
cacatcaaccgcaccgccctgaattgcaatgatagcctccagactggcttcctggctggcctattctacgccaac

SEQ ID NO: 138035 - DNA, 75 bp, Artificial Sequence
  Synthetic
cacatcaaccgcaccgccctgaattgcaatgatagcctccagactggcttcctggctggccttttctacgccaac

SEQ ID NO: 138036 - DNA, 75 bp, Artificial Sequence
  Synthetic
cacatcaaccgcaccgccctgaattgcaatgatagcctccagactggcttcctggctggcctcttctacgccaac

SEQ ID NO: 138037 - DNA, 75 bp, Artificial Sequence
  Synthetic
cacatcaaccgcaccgccctgaattgcaatgatagcctccagactggcttcctggctggcctgttctacgccaac

SEQ ID NO: 138038 - DNA, 75 bp, Artificial Sequence
  Synthetic
gggcccctctacatactccaggcctcgctcctgcgcgtcccttacttcgtgagggcacacgcgctcgttaagatc

SEQ ID NO: 138039 - DNA, 75 bp, Artificial Sequence
  Synthetic
agctgcggcaacaccctcacttgctacatcaaggccaaggcagcctgtcgagccgcagggctccgggactgcacc

SEQ ID NO: 138040 - DNA, 75 bp, Artificial Sequence
  Synthetic
gcttaaaatgggggccctgactggtacttacatctatgaccaccttactcccctgtcagactgggccgctgaggg

SEQ ID NO: 138041 - DNA, 75 bp, Artificial Sequence
  Synthetic
ccctgtcagactgggccgctgagggcctccgcgatttagcggtagccctggagccggttgtgttcacgcccatgg

SEQ ID NO: 138042 - DNA, 75 bp, Artificial Sequence
  Synthetic
ccaggaggatgcagcgagcctgagagccttcacggaggctatgaccaggtactccgctccccccggggacccccc

SEQ ID NO: 138043 - DNA, 75 bp, Artificial Sequence
  Synthetic
gtgactgggaggccagggaccagcggccatactgctggcactacgccccgcgctcttgtggggtggtgccggcgc

SEQ ID NO: 138044 - DNA, 75 bp, Artificial Sequence
  Synthetic
gacaggtcgtcacgatcaggcctcgcttacatcagaccgtccaggagtgcaactgttccatctacacaggccaga

SEQ ID NO: 138045 - DNA, 75 bp, Artificial Sequence
  Synthetic
catcacattctccgtaggtatgtcttcctacgcgatggggtctcagctcccgtgcgagcctgagccggaagtcgt

SEQ ID NO: 138046 - DNA, 75 bp, Artificial Sequence
  Synthetic
catcacattctccgtaggtatgtcttcctacgcgatggggtctcagctcccgtgcgagcctgagccggatgtcgt

SEQ ID NO: 138047 - DNA, 75 bp, Artificial Sequence
  Synthetic
catcacattctccgtaggtatgtcttcctacgcgatggggtctcagctcccgtgcgagcctgagccggacgtcgt

SEQ ID NO: 138048 - DNA, 75 bp, Artificial Sequence
  Synthetic
catcacattctccgtaggtatgtcttcctacgcgatggggtctcagctcccgtgcgagcctgagccggaggtcgt

SEQ ID NO: 138049 - DNA, 75 bp, Artificial Sequence
  Synthetic
aagactctcctggtgcagatctcatagaggctaacctcttgtggggtacaactgctaccaggatcgagactgaga

SEQ ID NO: 138050 - DNA, 75 bp, Artificial Sequence
  Synthetic
gaccgatgtcttcattctaaacagcaccagaccgcctgccggagggtggtttggttgcacatggatgaacagcag

SEQ ID NO: 138051 - DNA, 75 bp, Artificial Sequence
  Synthetic
gcacaaatcaccggacatgtcaaaaacggttccatgaggatcgttgggcctaaaacctgcagcaacacgtggcac

SEQ ID NO: 138052 - DNA, 75 bp, Artificial Sequence
  Synthetic
ctcactggcagggacaccaatgaaaattgtggtgaagtacaggtcctgtccaccgccacgcagtccttcctgggt

SEQ ID NO: 138053 - DNA, 75 bp, Artificial Sequence
  Synthetic
catatttgtgggcggtcattggggggtgctggctggaatattatactatagcatggtagccaactgggccaaggt

SEQ ID NO: 138054 - DNA, 75 bp, Artificial Sequence
  Synthetic
gccagtcagctctcagcaccatcacttaaggctacgtgcacaacgcacggccctcatcctgatgctgagctgatc

SEQ ID NO: 138055 - DNA, 75 bp, Artificial Sequence
  Synthetic
gccacttatgctaggtgtggctccggcccgtggctcaccccgagatgcctagtgcactatgaatatagactatgg

SEQ ID NO: 138056 - DNA, 75 bp, Artificial Sequence
  Synthetic
cagaatatgatgacagagaaccatcagtgtcagctgaatgccaccggccgaataggccgaagtatccaccagcat

SEQ ID NO: 138057 - DNA, 75 bp, Artificial Sequence
  Synthetic
cagaatatgatgacagagaaccatcagtgtcagctgaatgccaccggccgaataggccgaagtatccacctgcat

SEQ ID NO: 138058 - DNA, 75 bp, Artificial Sequence
  Synthetic
cagaatatgatgacagagaaccatcagtgtcagctgaatgccaccggccgaataggccgaagtatccacccgcat

SEQ ID NO: 138059 - DNA, 75 bp, Artificial Sequence
  Synthetic
cagaatatgatgacagagaaccatcagtgtcagctgaatgccaccggccgaataggccgaagtatccaccggcat

SEQ ID NO: 138060 - DNA, 75 bp, Artificial Sequence
  Synthetic
tcacaactcccatgcgagcccgaaccggatgtagcagtgctcacttccatgctcaccgacccctcccacattaca

SEQ ID NO: 138061 - DNA, 75 bp, Artificial Sequence
  Synthetic
acaggccccagccagagactccagctcgtgaataccaacgggagctggcacattaataggactgccttgaactgt

SEQ ID NO: 138062 - DNA, 75 bp, Artificial Sequence
  Synthetic
tacccatttgggctaggcctgactacaatccacctcttttggaaccctggaagtctcctgactatgatccaccaa

SEQ ID NO: 138063 - DNA, 75 bp, Artificial Sequence
  Synthetic
ttcccatttgggctaggcctgactacaatccacctcttttggaaccctggaagtctcctgactatgatccaccaa

SEQ ID NO: 138064 - DNA, 75 bp, Artificial Sequence
  Synthetic
tccccatttgggctaggcctgactacaatccacctcttttggaaccctggaagtctcctgactatgatccaccaa

SEQ ID NO: 138065 - DNA, 75 bp, Artificial Sequence
  Synthetic
tgcccatttgggctaggcctgactacaatccacctcttttggaaccctggaagtctcctgactatgatccaccaa

SEQ ID NO: 138066 - DNA, 75 bp, Artificial Sequence
  Synthetic
aaccgtgtgccctagaggacagagacagagcagagctgagccccctgctgcttagtaccacccagtggcaggtgc

SEQ ID NO: 138067 - DNA, 75 bp, Artificial Sequence
  Synthetic
gacaccaggggagctcttttgagccccaggcccatatccactcttaaggggtcttctggtggtccgctgctgtgc

SEQ ID NO: 138068 - DNA, 75 bp, Artificial Sequence
  Synthetic
cagagcagagctgagccccctgctgcttagtaccacccagtggcaggtgcttccatgctcatttacaaccttgcc

SEQ ID NO: 138069 - DNA, 75 bp, Artificial Sequence
  Synthetic
ggcactacccaccaagaccacgcgaggtggtgccggccttacaagtgtgcggccctgtttactgctttacaccaa

SEQ ID NO: 138070 - DNA, 75 bp, Artificial Sequence
  Synthetic
tgagatcaccagtgttcactgacaactcaacaccccctgcggtgcctcagacctatcaggtcgcgcacttgcatg

SEQ ID NO: 138071 - DNA, 75 bp, Artificial Sequence
  Synthetic
ccttgtttcatgggccatcaagtgggagtacgtggtgctcttgttcctgctgctcgcagacgctcgcgtctgcgc

SEQ ID NO: 138072 - DNA, 75 bp, Artificial Sequence
  Synthetic
gcttttctcatcttcttctgcgccgcatggtacatcaagggcagatgggttcctgtgactgcgtatgccgtccac

SEQ ID NO: 138073 - DNA, 75 bp, Artificial Sequence
  Synthetic
attccacctcctcaaaaagcgcaggtctacgccaaaagaaggtgacctttgacagagtccagcttctggaccaac

SEQ ID NO: 138074 - DNA, 75 bp, Artificial Sequence
  Synthetic
gcctgaccatcctctccctctctccggcctacaaaaacctgattgtcctcgccatctggtggctccagtacttcc

SEQ ID NO: 138075 - DNA, 75 bp, Artificial Sequence
  Synthetic
ctacccttgcactgtgaacttcactgttcataaggtccgcatgtatgtgggaggactggagcacaggtttagcgc

SEQ ID NO: 138076 - DNA, 75 bp, Artificial Sequence
  Synthetic
gactccacgacgatccttggcataggcacggtcctggaccaagcggagactgctggagtgcgcctcgtcgtgctc

SEQ ID NO: 138077 - DNA, 75 bp, Artificial Sequence
  Synthetic
cctaatgtttgacatcaccaagctcctgttggccatcctggggcctgcctggattctgcaggccagcctcctgag

SEQ ID NO: 138078 - DNA, 75 bp, Artificial Sequence
  Synthetic
tccccctagaactaatcaaggggggcagacacctcatcttttgccactcaaagaaaaagtgtgatgaactggcca

SEQ ID NO: 138079 - DNA, 75 bp, Artificial Sequence
  Synthetic
gatgagcgggagatctccgtacccgcagagatcctgcggaagtcccggagattcaccccggccctgcccatttgg

SEQ ID NO: 138080 - DNA, 75 bp, Artificial Sequence
  Synthetic
ggagcgtgggcagggacgtatgtatatgaccatctgacaccactacacacctgggctcacaatgggctgcgtgac

SEQ ID NO: 138081 - DNA, 75 bp, Artificial Sequence
  Synthetic
acgcggtatcccgcagccagcggagaggccgcactggtaggggaaggttgggcatataccggtatgtcaccccag

SEQ ID NO: 138082 - DNA, 75 bp, Artificial Sequence
  Synthetic
tacctgtttctgcccgcaggggtagagaggtcctcttaggaccggctgaccgctttacaagcaagggctggaggc

SEQ ID NO: 138083 - DNA, 75 bp, Artificial Sequence
  Synthetic
ttggcactgccccaacgggcgtttgcatacgatcaagagcaagcggcctctatcggtgcagcagtgctggtaacc

SEQ ID NO: 138084 - DNA, 75 bp, Artificial Sequence
  Synthetic
gatccaaattttgtccaccgccactcagacattcctaggaacaactgtcaaaggcgtcacttggtccgtctacca

SEQ ID NO: 138085 - DNA, 75 bp, Artificial Sequence
  Synthetic
gatccaaattttgtccaccgccactcagacattcctaggaacaactgtcaatggcgtcacttggtccgtctacca

SEQ ID NO: 138086 - DNA, 75 bp, Artificial Sequence
  Synthetic
gatccaaattttgtccaccgccactcagacattcctaggaacaactgtcaacggcgtcacttggtccgtctacca

SEQ ID NO: 138087 - DNA, 75 bp, Artificial Sequence
  Synthetic
gatccaaattttgtccaccgccactcagacattcctaggaacaactgtcaagggcgtcacttggtccgtctacca

SEQ ID NO: 138088 - DNA, 75 bp, Artificial Sequence
  Synthetic
gctcgcgtggaggctcaattgcaggtgtgggtcccaagcctctcggtccgaggaggtcgtgatgctgtcatccta

SEQ ID NO: 138089 - DNA, 75 bp, Artificial Sequence
  Synthetic
gctctggcacccccaccaagctgggacaccatgtggaagtgcctaatccgcctcaagcctaccctgcatggcccc

SEQ ID NO: 138090 - DNA, 75 bp, Artificial Sequence
  Synthetic
aggggcagcctgctttcgccccggcccatttcctacttgaaaggctcctcggggggtccgctgctgtgccccgcg

SEQ ID NO: 138091 - DNA, 75 bp, Artificial Sequence
  Synthetic
cctcaagcctaccctgcatggccccacacctctcctctacagactggggtccgtgcagaatgaagtgacacttac

SEQ ID NO: 138092 - DNA, 75 bp, Artificial Sequence
  Synthetic
gcgcgctctctcacgccgtgcacgtgcgggtcctcggatctgtacctggtcacgagacacgccgatgttgtccct

SEQ ID NO: 138093 - DNA, 75 bp, Artificial Sequence
  Synthetic
ctgggagactgcccggcacactccagttaactcgtggctggggaacatcatcatgtacgctcctgctatttgggt

SEQ ID NO: 138094 - DNA, 75 bp, Artificial Sequence
  Synthetic
acgttgcgggcctcttcagggccgcggtgtgcacgcgtggagtcgcgaaggcggtcgacttcgtgcccgtggaag

SEQ ID NO: 138095 - DNA, 75 bp, Artificial Sequence
  Synthetic
ttctcgcctatggagaagaagatcatcacatggggggcggacacagccgcgtgtggcgacatactggctggcttg

SEQ ID NO: 138096 - DNA, 75 bp, Artificial Sequence
  Synthetic
ccagctgtaccccagacttaccaggtggcccacctacacgctcccacggggagcggaaagagcaccaaggtaccg

SEQ ID NO: 138097 - DNA, 75 bp, Artificial Sequence
  Synthetic
ccaaacttgaacagttctgggcgaaacacatgtggaatttcatcagcggcattcaatatctcgctggactgtcca

SEQ ID NO: 138098 - DNA, 75 bp, Artificial Sequence
  Synthetic
aaaccctccttttcaacatcttggggggatgggtggcctcacagattgcaactccgacggcttctacagcattcg

SEQ ID NO: 138099 - DNA, 75 bp, Artificial Sequence
  Synthetic
tccgaagggtccggtgtgccagatgtatactaatgttgaccaagacatggtgggatggccagctcctccgggtgc

SEQ ID NO: 138100 - DNA, 75 bp, Artificial Sequence
  Synthetic
ggttacttttaagatcatgagcggcgagatgccatccacagaggacttggtaaacttgctcccagccattctatc

SEQ ID NO: 138101 - DNA, 75 bp, Artificial Sequence
  Synthetic
ctgaccaacgatggggaagtccccttctaaggcaaggccataccccttgcagtcatcaagggtggaaggcacctc

SEQ ID NO: 138102 - DNA, 75 bp, Artificial Sequence
  Synthetic
ctgaccaacgatggggaagtccccttctatggcaaggccataccccttgcagtcatcaagggtggaaggcacctc

SEQ ID NO: 138103 - DNA, 75 bp, Artificial Sequence
  Synthetic
ctgaccaacgatggggaagtccccttctacggcaaggccataccccttgcagtcatcaagggtggaaggcacctc

SEQ ID NO: 138104 - DNA, 75 bp, Artificial Sequence
  Synthetic
ctgaccaacgatggggaagtccccttctagggcaaggccataccccttgcagtcatcaagggtggaaggcacctc

SEQ ID NO: 138105 - DNA, 75 bp, Artificial Sequence
  Synthetic
tcataccatctagcggggacgtcgtcgttgtggcgaccgatgctctgatgactggcttcaccggcgattttgact

SEQ ID NO: 138106 - DNA, 75 bp, Artificial Sequence
  Synthetic
atactatcatccctcactgtgacatcccttctcagacgcctccacaagtggatcaatgaagattgttccactccg

SEQ ID NO: 138107 - DNA, 75 bp, Artificial Sequence
  Synthetic
tcgatcacagcggcggggcagaaccgggagagggaggcacggcatctacaggtttgtgtcgcccggggagcgacc

SEQ ID NO: 138108 - DNA, 75 bp, Artificial Sequence
  Synthetic
tacctaaatacaccagggttgcccgtatgccaggaccacctggagttctgggaaggcgtgttcacaggcctcacc

SEQ ID NO: 138109 - DNA, 75 bp, Artificial Sequence
  Synthetic
ggaaggcgtgttcacaggcctcacccatattgatgcccacttcctttctcagaccaagcaggggggggagaactt

SEQ ID NO: 138110 - DNA, 75 bp, Artificial Sequence
  Synthetic
accttgcacgggcctacccccttgctatacagactgggtgctgtgcaaaatgaggtaaccctcacacaccctgtg

SEQ ID NO: 138111 - DNA, 75 bp, Artificial Sequence
  Synthetic
acccttgctgcgggacgaagtgtcgttctcggtaggactcaattcgttcgtggtgggatcccaactcccatgcga

SEQ ID NO: 138112 - DNA, 75 bp, Artificial Sequence
  Synthetic
tgaggtaaccctcacacaccctgtgaccaaatacataatgacatgcatggcagccgacttggaggtcgtcaccag

SEQ ID NO: 138113 - DNA, 75 bp, Artificial Sequence
  Synthetic
acatccatgttgacagacccatcacacataacggcggaaacggcgagccggagactggctcgagggtcaccaccc

SEQ ID NO: 138114 - DNA, 75 bp, Artificial Sequence
  Synthetic
ggctttggcattatccttgtaccatcaattacaccatattcaaagtcaggatgtacgtgggaggggtcgagcaca

SEQ ID NO: 138115 - DNA, 75 bp, Artificial Sequence
  Synthetic
atgtacgtgggaggggtcgagcacaggctggaagctgcctgcaactggacgcggggcgaacgctgcgatctggaa

SEQ ID NO: 138116 - DNA, 75 bp, Artificial Sequence
  Synthetic
cctgcagttgtaccagacagagaggccctctaccaggagttcgatgagatggaggaatgcgccgcccatgtgccc

SEQ ID NO: 138117 - DNA, 75 bp, Artificial Sequence
  Synthetic
cctggtactgatctcctcgaggctaacctcttgtgggggtctaccgctaccagggttgagacagacgagaaggtg

SEQ ID NO: 138118 - DNA, 75 bp, Artificial Sequence
  Synthetic
acctcttgtgggggtctaccgctaccagggttgagacagacgagaaggtgataatattggactcttttgagccac

SEQ ID NO: 138119 - DNA, 75 bp, Artificial Sequence
  Synthetic
gtgtggctgaaccagatgatgacagggaggtctcggtcgccgcggaaatcctgcgtccgactaagaagtttcccc

SEQ ID NO: 138120 - DNA, 75 bp, Artificial Sequence
  Synthetic
tgcaatcacactggcagaagcttgaaaccttctgggcaaaacacatgtggaacttcatcagtgggatacaatacc

SEQ ID NO: 138121 - DNA, 75 bp, Artificial Sequence
  Synthetic
ctgcgtccgactaagaagtttcccccagctctaccgatctgggctcgaccagattacaatccacctctcactgag

SEQ ID NO: 138122 - DNA, 75 bp, Artificial Sequence
  Synthetic
aaccttctgggcaaaacacatgtggaacttcatcagtgggatacaatacctagcaggactatcaacactgcctgg

SEQ ID NO: 138123 - DNA, 75 bp, Artificial Sequence
  Synthetic
ggaggtctcggtcgccgcggaaatcctgcgtccgactaagaagtttcccccagctctaccgatctgggctcgacc

SEQ ID NO: 138124 - DNA, 75 bp, Artificial Sequence
  Synthetic
ctttaacatcttgggagggtgggtggctgcccaacttgccgccccgggcgctgcttcggccttcgtcggcgccgg

SEQ ID NO: 138125 - DNA, 75 bp, Artificial Sequence
  Synthetic
cattgtcggtgccgctgttggcagcattggtgtcggaaagatgcttgtggacatccttgcagggtacggtgctgg

SEQ ID NO: 138126 - DNA, 75 bp, Artificial Sequence
  Synthetic
tcaactatgcaacagggaaccttcccggttgctccttttctatcttccttttggcccttctctcatgcctgacag

SEQ ID NO: 138127 - DNA, 75 bp, Artificial Sequence
  Synthetic
ctagtggtgggcgtagtgtgcgcagcagtactgcgccgccacgtgggcccgggcgagggtgctgtgcagtggatg

SEQ ID NO: 138128 - DNA, 75 bp, Artificial Sequence
  Synthetic
ctctaccaacaattcgacgagatggaggagtgctcacatcgcattccctatcttgttgagggtcaccaacttgct

SEQ ID NO: 138129 - DNA, 75 bp, Artificial Sequence
  Synthetic
cttacatctgccgggatgcgtgccctgcgtccgcgagggcaacgtctctagatgctggataatgttcacccctac

SEQ ID NO: 138130 - DNA, 75 bp, Artificial Sequence
  Synthetic
ccctcactgtcacccagctactgagaaggctccacacatggatcactgaggactgcaccacaccatgctctgggt

SEQ ID NO: 138131 - DNA, 75 bp, Artificial Sequence
  Synthetic
tgcgtccgcgagggcaacgtctctagatgctggataatgttcacccctacgctcgcggcacgggacccaggcttc

SEQ ID NO: 138132 - DNA, 75 bp, Artificial Sequence
  Synthetic
tgccacaaatgcccggaatccccttcctgtcatgccaacgcgggtacaggggagtctggcggggcgatggcgtca

SEQ ID NO: 138133 - DNA, 75 bp, Artificial Sequence
  Synthetic
gcgaaggatgttcgcagccattcccgcaaggccattaaccacatcaactccgtgtgggaggacttgctggaagac

SEQ ID NO: 138134 - DNA, 75 bp, Artificial Sequence
  Synthetic
tgggccaactgttcaccttctctccccgcaaacactggaccacccaggactgcaactgttccatctatgcaggcc

SEQ ID NO: 138135 - DNA, 75 bp, Artificial Sequence
  Synthetic
acataatagctggagctcactggggcgtcttggcgggcctagcttattattctatgcagggtaactgggccaaag

SEQ ID NO: 138136 - DNA, 75 bp, Artificial Sequence
  Synthetic
tgcaactgttccatctatgcaggccacgtcaccggccatcgtatggcgtgggacatgatgatgaactggtccccc

SEQ ID NO: 138137 - DNA, 75 bp, Artificial Sequence
  Synthetic
cgtcttggcgggcctagcttattattctatgcagggtaactgggccaaagtcaccatcatcatgatcatgtttgc

SEQ ID NO: 138138 - DNA, 75 bp, Artificial Sequence
  Synthetic
acgactccctccacaccgggttcattgctgcgctgttttacgcaaacagtttcaactcatccgcatgcccacatc

SEQ ID NO: 138139 - DNA, 75 bp, Artificial Sequence
  Synthetic
ggcgttctagcggggttggcttactattccatggttggcaattgggccaaggtggtggttgtgttgctgctcttc

SEQ ID NO: 138140 - DNA, 75 bp, Artificial Sequence
  Synthetic
gaggtaaggcgagtgggtgattcccactacgtaacaggtatgacatcagacaacctcaaatgcccgtgccaggtc

SEQ ID NO: 138141 - DNA, 75 bp, Artificial Sequence
  Synthetic
gtcctgaggcgccacataggaccatcagaaggcgccgcacagtggatgaacaggctcatagcgtttgcgtcgcgg

SEQ ID NO: 138142 - DNA, 75 bp, Artificial Sequence
  Synthetic
gtcctgaggcgccacataggaccatcagaaggcgccgctcagtggatgaacaggctcatagcgtttgcgtcgcgg

SEQ ID NO: 138143 - DNA, 75 bp, Artificial Sequence
  Synthetic
gtcctgaggcgccacataggaccatcagaaggcgccgcccagtggatgaacaggctcatagcgtttgcgtcgcgg

SEQ ID NO: 138144 - DNA, 75 bp, Artificial Sequence
  Synthetic
gtcctgaggcgccacataggaccatcagaaggcgccgcgcagtggatgaacaggctcatagcgtttgcgtcgcgg

SEQ ID NO: 138145 - DNA, 75 bp, Artificial Sequence
  Synthetic
caggctcatagcgtttgcgtcgcggggtaaccacgtgtctcccacgcattacgtcccagagacagacgcttcccg

SEQ ID NO: 138146 - DNA, 75 bp, Artificial Sequence
  Synthetic
agcttatcaacaccaatggcagctggcatatcaaccgcactgccttgagctgcaatgacagcctcaacaccggct

SEQ ID NO: 138147 - DNA, 75 bp, Artificial Sequence
  Synthetic
gcctcaacacctttgtggtggggtcccagctcccctgcgagccagagccggacgtagcggtgctaacgtccatgc

SEQ ID NO: 138148 - DNA, 75 bp, Artificial Sequence
  Synthetic
caggctctatagctgcaagcccatcacttacttcaatcaggggtggggccccctgacagacgccaacatcactgg

SEQ ID NO: 138149 - DNA, 75 bp, Artificial Sequence
  Synthetic
gacgtagcggtgctaacgtccatgctcacagacccatcacacatcaccgcagagactgcaaagcgcaggctaggt

SEQ ID NO: 138150 - DNA, 75 bp, Artificial Sequence
  Synthetic
caactgtcccagcattgaatgtctgcggccctgtgtactgcttcacaccatcgccggtggttgtgggcactactg

SEQ ID NO: 138151 - DNA, 75 bp, Artificial Sequence
  Synthetic
gccgatcaccttcaacgggtctgaccgtggacagaacatcgaggaccagcggccgtattgctggcactaccctcc

SEQ ID NO: 138152 - DNA, 75 bp, Artificial Sequence
  Synthetic
tggctgagggacgtgtgggactgggtgtgtatggttctatctgacttaaagacttggctcaaggcaaagcttatg

SEQ ID NO: 138153 - DNA, 75 bp, Artificial Sequence
  Synthetic
tggctgagggacgtgtgggactgggtgtgtatggttctatctgactttaagacttggctcaaggcaaagcttatg

SEQ ID NO: 138154 - DNA, 75 bp, Artificial Sequence
  Synthetic
tggctgagggacgtgtgggactgggtgtgtatggttctatctgacttcaagacttggctcaaggcaaagcttatg

SEQ ID NO: 138155 - DNA, 75 bp, Artificial Sequence
  Synthetic
tggctgagggacgtgtgggactgggtgtgtatggttctatctgacttgaagacttggctcaaggcaaagcttatg

SEQ ID NO: 138156 - DNA, 75 bp, Artificial Sequence
  Synthetic
tcttccttctggccctgctctcttgcctgaccgtgcccgcttcagcctaccaagtgcgcaactcctcggggcttt

SEQ ID NO: 138157 - DNA, 75 bp, Artificial Sequence
  Synthetic
gacttggctcaaggcaaagcttatgccctccctaccgggtatccccttcctctcatgccagaggggttttagggg

SEQ ID NO: 138158 - DNA, 75 bp, Artificial Sequence
  Synthetic
acctcatcgaggccaacctcctgtggaggcaggagatgggtggaaacatcaccagggtggagtcggagaacaagg

SEQ ID NO: 138159 - DNA, 75 bp, Artificial Sequence
  Synthetic
ctagtggccgatggtttgggtgcgtgtggatgaactccacggggtttgtcaagacgtgtggagctcccccttgta

SEQ ID NO: 138160 - DNA, 75 bp, Artificial Sequence
  Synthetic
aggacagggatagatcagagctcagcccgctgctgctgtctacaacagagtggcaggtactgccctgttccttca

SEQ ID NO: 138161 - DNA, 75 bp, Artificial Sequence
  Synthetic
cccacgtacaactggggagcgaacgtctcagacgttgtcatcctgaacagcaccaggccgcccggtggggcgtgg

SEQ ID NO: 138162 - DNA, 75 bp, Artificial Sequence
  Synthetic
gtggatgaactccacggggtttgtcaagacgtgtggagctcccccttgtaacatctacgggggtgctaaagaaag

SEQ ID NO: 138163 - DNA, 75 bp, Artificial Sequence
  Synthetic
gaggaggacaaccgagccctccgagccttcacggaggctatgacgagatactcggctccccccggagacgccccg

SEQ ID NO: 138164 - DNA, 75 bp, Artificial Sequence
  Synthetic
ttgcctacccgtgtgggcttcaccgagctacaacccaccattgctggagacatggaaggagcccgactacgagcc

SEQ ID NO: 138165 - DNA, 75 bp, Artificial Sequence
  Synthetic
tgagacggacgtcttcgtccttaacaacaccaggccaccgctgggcaattggttcggttgcacctggatgaactc

SEQ ID NO: 138166 - DNA, 75 bp, Artificial Sequence
  Synthetic
acacctcgatgcctggttgattatccataccggctttggcatttcccatgtactgtcaacttcacattgtttaag

SEQ ID NO: 138167 - DNA, 75 bp, Artificial Sequence
  Synthetic
ggtcgtccagatcaaggactgccactacatagtgggggcaaccactgacaacctcaagtgcccatgtcaagtgcc

SEQ ID NO: 138168 - DNA, 75 bp, Artificial Sequence
  Synthetic
ccgactgcttccgcaagcatccggaggctacttacaccaaatgtggctctggcccctggctcacccccaggtgtc

SEQ ID NO: 138169 - DNA, 75 bp, Artificial Sequence
  Synthetic
ccgcccgccaagccccctccggtaccacctccaaggaggaggaagcaggtcgttttgacagagtccaccgtgtca

SEQ ID NO: 138170 - DNA, 75 bp, Artificial Sequence
  Synthetic
ggcacccgagtttttcacggaagttgacggagtgagactgcacaggtacgcacctgcatgcggccccctcttgag

SEQ ID NO: 138171 - DNA, 75 bp, Artificial Sequence
  Synthetic
tactccggatcccacaagctatcgtggatatgatagctggtgcccactggggtgtcctagcgggcctggcatact

SEQ ID NO: 138172 - DNA, 75 bp, Artificial Sequence
  Synthetic
tccatctttaaggtcaggatgtttgtgggaggggttgagcacaggttggatgtagcgtgcaattggacgcggggc

SEQ ID NO: 138173 - DNA, 75 bp, Artificial Sequence
  Synthetic
gatctgacgcagggtctgaggctgagtcattttcttccatgccccccctcgagggggagcctggggatcccgacc

SEQ ID NO: 138174 - DNA, 75 bp, Artificial Sequence
  Synthetic
cctcgttttcctcctcctggcagacgcgcgcgtgtgcgttgccctttggttgatgctgatgatatcacaagcaga

SEQ ID NO: 138175 - DNA, 75 bp, Artificial Sequence
  Synthetic
ccgccatatcgaccggtctgatccatctgcaccaaaacatcgtggacgtgcagtacttgtacgggatagggtcgg

SEQ ID NO: 138176 - DNA, 75 bp, Artificial Sequence
  Synthetic
cctcgctaagctcatatggtggttgcagtatttcatcaccagagccgaggcgcatttgcaagtgtggatcccccc

SEQ ID NO: 138177 - DNA, 75 bp, Artificial Sequence
  Synthetic
ggcagttggcacatcaacagcacggccttgaactgcaacgcaagccttgagaccggctggttagcaggactcttt

SEQ ID NO: 138178 - DNA, 75 bp, Artificial Sequence
  Synthetic
atgcgctgcggaggagtccaaactaccaatcaacgcgctgagcaactcgctcttgcgccatcacaacatggtcta

SEQ ID NO: 138179 - DNA, 75 bp, Artificial Sequence
  Synthetic
tcctcagctagtcagctttctgcgccttccctgaaggcaacatgccccactgctatggaccaccctgacgccgaa

SEQ ID NO: 138180 - DNA, 75 bp, Artificial Sequence
  Synthetic
aggggtaagcttgttccgctggtgacctacagcctgacgggtctttggtccttagcgttgcttgtcctcctactc

SEQ ID NO: 138181 - DNA, 75 bp, Artificial Sequence
  Synthetic
gtcccaggcggaggcagccttggagaacctgatcgtgcttaacgcggcatcattggccggggtgcacggcaccgt

SEQ ID NO: 138182 - DNA, 75 bp, Artificial Sequence
  Synthetic
cagaggcagaaaaaagtaacatttgacagaatgcaagtccttgatgaccattacagggacgtgctaaaggaggta

SEQ ID NO: 138183 - DNA, 75 bp, Artificial Sequence
  Synthetic
cgaaagacgtccggagccttgccagcaaagccgtacgccacatcaactccgtgtggcaagacttgctggaagaca

SEQ ID NO: 138184 - DNA, 75 bp, Artificial Sequence
  Synthetic
ttggtagcactgccccagcgggcgtatgccttcaaccaggagatggctgcgtcatgtggaggcgtcgtcctcgtc

SEQ ID NO: 138185 - DNA, 75 bp, Artificial Sequence
  Synthetic
atgccttcaaccaggagatggctgcgtcatgtggaggcgtcgtcctcgtctgcctgaccatcctttccctgactc

SEQ ID NO: 138186 - DNA, 75 bp, Artificial Sequence
  Synthetic
ggaggcgcttgccgagctagcccggaaatcatttccaccagatccatcaaaatccggagaatccggcgcggggac

SEQ ID NO: 138187 - DNA, 75 bp, Artificial Sequence
  Synthetic
cgacctgggggtgcgagtgtgcgagaagagagctttatatgatgtcaccaaaaagctccccatagccgtgatggg

SEQ ID NO: 138188 - DNA, 75 bp, Artificial Sequence
  Synthetic
cagggggggccgcgacgccatcatcctcctcatgtgtgtgctccacccgcacctggtgtttgacattactaagta

SEQ ID NO: 138189 - DNA, 75 bp, Artificial Sequence
  Synthetic
ctcctcatgtgtgtgctccacccgcacctggtgtttgacattactaagtatatattggccgtcctcgggcccgct

SEQ ID NO: 138190 - DNA, 75 bp, Artificial Sequence
  Synthetic
ctcctcatgtgtgtgctccacccgcacctggtgtttgacattactaagtatttattggccgtcctcgggcccgct

SEQ ID NO: 138191 - DNA, 75 bp, Artificial Sequence
  Synthetic
ctcctcatgtgtgtgctccacccgcacctggtgtttgacattactaagtatctattggccgtcctcgggcccgct

SEQ ID NO: 138192 - DNA, 75 bp, Artificial Sequence
  Synthetic
ctcctcatgtgtgtgctccacccgcacctggtgtttgacattactaagtatgtattggccgtcctcgggcccgct

SEQ ID NO: 138193 - DNA, 75 bp, Artificial Sequence
  Synthetic
ggagatcccgatctaagttcggggtcatggtctacagtcagtgatgaagatgacagtgttgtgtgttgctctatg

SEQ ID NO: 138194 - DNA, 75 bp, Artificial Sequence
  Synthetic
ccagcagctagtctagagtggcggaacgcgtccggcctctatgtcctcaccaacgactgttccaacagcagtatt

SEQ ID NO: 138195 - DNA, 75 bp, Artificial Sequence
  Synthetic
tcttactcatgtgtgttgtacacccgaccttggtattcgacatcaccaaactgctgctggccgtcttcggtcccc

SEQ ID NO: 138196 - DNA, 75 bp, Artificial Sequence
  Synthetic
cgctgttttgactcaacagtcactgaggctgatatccggacggaggagtccatataccaatgctgtgacctgcac

SEQ ID NO: 138197 - DNA, 75 bp, Artificial Sequence
  Synthetic
gcccggaaggttgcgggcggccagtatgtgcagatggcactcatcaaactcggtgcgtggacgggcacctacata

SEQ ID NO: 138198 - DNA, 75 bp, Artificial Sequence
  Synthetic
cggtgacatcatcaacggcttgcccgtctctgcccgtagaggccgagagatactgctcgggccagctgatggaat

SEQ ID NO: 138199 - DNA, 75 bp, Artificial Sequence
  Synthetic
gcgccagcggcgtcttaacgaccagctgcggtaacaccctcacctgctacatcaaggccctagcagcctgtagag

SEQ ID NO: 138200 - DNA, 75 bp, Artificial Sequence
  Synthetic
tgattaccactggggcagatgcagcggcgtgcggcgacatcatccagggcctgcctgtctctgcccgcaggggca

SEQ ID NO: 138201 - DNA, 75 bp, Artificial Sequence
  Synthetic
gtgagcgccaggctcctctcaacggaggaagcctgtaagctcacccccccgcactcggctcgctccaagttcggg

SEQ ID NO: 138202 - DNA, 75 bp, Artificial Sequence
  Synthetic
cttcacggaggctatgaccaggtattcagccccccccggggatcccccccaaccagaatacgacctggagcgcat

SEQ ID NO: 138203 - DNA, 75 bp, Artificial Sequence
  Synthetic
gtgcattgtcaccagcctcactggccgagacaagaacacagtggagggggaagtgcagattgtgtcgactgcaaa

SEQ ID NO: 138204 - DNA, 75 bp, Artificial Sequence
  Synthetic
aggggtcgatgcctctacacacaccgtcggtggcagtgaggctcgtggcgccagtgcaatctccaacctctttag

SEQ ID NO: 138205 - DNA, 75 bp, Artificial Sequence
  Synthetic
atgtacaccaacgtcgaccaagacctagtgggatggcaggccccagctggggcgcgctcccttacaccttgcaca

SEQ ID NO: 138206 - DNA, 75 bp, Artificial Sequence
  Synthetic
atgtacaccaacgtcgaccaagaccttgtgggatggcaggccccagctggggcgcgctcccttacaccttgcaca

SEQ ID NO: 138207 - DNA, 75 bp, Artificial Sequence
  Synthetic
atgtacaccaacgtcgaccaagacctcgtgggatggcaggccccagctggggcgcgctcccttacaccttgcaca

SEQ ID NO: 138208 - DNA, 75 bp, Artificial Sequence
  Synthetic
atgtacaccaacgtcgaccaagacctggtgggatggcaggccccagctggggcgcgctcccttacaccttgcaca

SEQ ID NO: 138209 - DNA, 75 bp, Artificial Sequence
  Synthetic
aatgtttgcccccacactgtgggtgaggatgattctgatgacccactttttctccatcctcatcacccaggagca

SEQ ID NO: 138210 - DNA, 75 bp, Artificial Sequence
  Synthetic
tgtcttacttcaagggttcatccggcggaccattgctctgcccttccgggcacatcgcgggcctttttagggccg

SEQ ID NO: 138211 - DNA, 75 bp, Artificial Sequence
  Synthetic
tgtcttacttcaagggttcatccggcggtccattgctctgcccttccgggcacatcgcgggcctttttagggccg

SEQ ID NO: 138212 - DNA, 75 bp, Artificial Sequence
  Synthetic
tgtcttacttcaagggttcatccggcggcccattgctctgcccttccgggcacatcgcgggcctttttagggccg

SEQ ID NO: 138213 - DNA, 75 bp, Artificial Sequence
  Synthetic
tgtcttacttcaagggttcatccggcgggccattgctctgcccttccgggcacatcgcgggcctttttagggccg

SEQ ID NO: 138214 - DNA, 75 bp, Artificial Sequence
  Synthetic
ttcttcaaaccagtttgcttaaggtaccctactttgtgcgcgttcagggccttctccggttctgcgcactagcgc

SEQ ID NO: 138215 - DNA, 75 bp, Artificial Sequence
  Synthetic
gtgaaatcaatagggtggccgcatgcctcagaaaacttggggtaccgcccttgcgaacttggagacaccgggccc

SEQ ID NO: 138216 - DNA, 75 bp, Artificial Sequence
  Synthetic
cctcagaaaacttggggtaccgcccttgcgaacttggagacaccgggcccggtctgttcgcgccaggctactgtc

SEQ ID NO: 138217 - DNA, 75 bp, Artificial Sequence
  Synthetic
tcctccccaaccgatgaaggttggggtaaacactccggcctcttaggccatttcctttttttttttttttttttt

SEQ ID NO: 138218 - DNA, 75 bp, Artificial Sequence
  Synthetic
tggcactacgcgcctagaccttgtgagactgtccgggcgttaaatgtctgcggccctgtatactgtttcacacca

SEQ ID NO: 138219 - DNA, 75 bp, Artificial Sequence
  Synthetic
cggaccattgctctgcccttccgggcacatcgcgggcctttttagggccgcggtgtgcacgcgtggggtcgcaaa

SEQ ID NO: 138220 - DNA, 75 bp, Artificial Sequence
  Synthetic
cggtccattgctctgcccttccgggcacatcgcgggcctttttagggccgcggtgtgcacgcgtggggtcgcaaa

SEQ ID NO: 138221 - DNA, 75 bp, Artificial Sequence
  Synthetic
cggcccattgctctgcccttccgggcacatcgcgggcctttttagggccgcggtgtgcacgcgtggggtcgcaaa

SEQ ID NO: 138222 - DNA, 75 bp, Artificial Sequence
  Synthetic
cgggccattgctctgcccttccgggcacatcgcgggcctttttagggccgcggtgtgcacgcgtggggtcgcaaa

SEQ ID NO: 138223 - DNA, 75 bp, Artificial Sequence
  Synthetic
ttgacatgttggtctgcggagacgaccttgtcgttatttcggagagtctgggggtctcggaggacgctagtgcac

SEQ ID NO: 138224 - DNA, 75 bp, Artificial Sequence
  Synthetic
gtggcgcacctgcacgccccaacagggagcgggaaaagcactaaggtgccagccgcatacgcagctcaggggtac

SEQ ID NO: 138225 - DNA, 75 bp, Artificial Sequence
  Synthetic
cggcagcggcaagagcaccaaggtcccggctgcatatgcggcccagggctacaaggtgctagtgctcaacccctc

SEQ ID NO: 138226 - DNA, 75 bp, Artificial Sequence
  Synthetic
tagctgccaccctgggttttggagcttacatgtccaaggcccatgggatagatcccaacatcaggaccggggtgc

SEQ ID NO: 138227 - DNA, 75 bp, Artificial Sequence
  Synthetic
tagctgccaccctgggttttggagcttacatgtccaaggcccatgggattgatcccaacatcaggaccggggtgc

SEQ ID NO: 138228 - DNA, 75 bp, Artificial Sequence
  Synthetic
tagctgccaccctgggttttggagcttacatgtccaaggcccatgggatcgatcccaacatcaggaccggggtgc

SEQ ID NO: 138229 - DNA, 75 bp, Artificial Sequence
  Synthetic
tagctgccaccctgggttttggagcttacatgtccaaggcccatgggatggatcccaacatcaggaccggggtgc

SEQ ID NO: 138230 - DNA, 75 bp, Artificial Sequence
  Synthetic
tagctgccaccctgggttttggagcttacatgtccatggcccatgggatagatcccaacatcaggaccggggtgc

SEQ ID NO: 138231 - DNA, 75 bp, Artificial Sequence
  Synthetic
tagctgccaccctgggttttggagcttacatgtccatggcccatgggattgatcccaacatcaggaccggggtgc

SEQ ID NO: 138232 - DNA, 75 bp, Artificial Sequence
  Synthetic
tagctgccaccctgggttttggagcttacatgtccatggcccatgggatcgatcccaacatcaggaccggggtgc

SEQ ID NO: 138233 - DNA, 75 bp, Artificial Sequence
  Synthetic
tagctgccaccctgggttttggagcttacatgtccatggcccatgggatggatcccaacatcaggaccggggtgc

SEQ ID NO: 138234 - DNA, 75 bp, Artificial Sequence
  Synthetic
tagctgccaccctgggttttggagcttacatgtccacggcccatgggatagatcccaacatcaggaccggggtgc

SEQ ID NO: 138235 - DNA, 75 bp, Artificial Sequence
  Synthetic
tagctgccaccctgggttttggagcttacatgtccacggcccatgggattgatcccaacatcaggaccggggtgc

SEQ ID NO: 138236 - DNA, 75 bp, Artificial Sequence
  Synthetic
tagctgccaccctgggttttggagcttacatgtccacggcccatgggatcgatcccaacatcaggaccggggtgc

SEQ ID NO: 138237 - DNA, 75 bp, Artificial Sequence
  Synthetic
tagctgccaccctgggttttggagcttacatgtccacggcccatgggatggatcccaacatcaggaccggggtgc

SEQ ID NO: 138238 - DNA, 75 bp, Artificial Sequence
  Synthetic
tagctgccaccctgggttttggagcttacatgtccagggcccatgggatagatcccaacatcaggaccggggtgc

SEQ ID NO: 138239 - DNA, 75 bp, Artificial Sequence
  Synthetic
tagctgccaccctgggttttggagcttacatgtccagggcccatgggattgatcccaacatcaggaccggggtgc

SEQ ID NO: 138240 - DNA, 75 bp, Artificial Sequence
  Synthetic
tagctgccaccctgggttttggagcttacatgtccagggcccatgggatcgatcccaacatcaggaccggggtgc

SEQ ID NO: 138241 - DNA, 75 bp, Artificial Sequence
  Synthetic
tagctgccaccctgggttttggagcttacatgtccagggcccatgggatggatcccaacatcaggaccggggtgc

SEQ ID NO: 138242 - DNA, 75 bp, Artificial Sequence
  Synthetic
ttgctgccaccctgggttttggagcttacatgtccaaggcccatgggatagatcccaacatcaggaccggggtgc

SEQ ID NO: 138243 - DNA, 75 bp, Artificial Sequence
  Synthetic
ttgctgccaccctgggttttggagcttacatgtccaaggcccatgggattgatcccaacatcaggaccggggtgc

SEQ ID NO: 138244 - DNA, 75 bp, Artificial Sequence
  Synthetic
ttgctgccaccctgggttttggagcttacatgtccaaggcccatgggatcgatcccaacatcaggaccggggtgc

SEQ ID NO: 138245 - DNA, 75 bp, Artificial Sequence
  Synthetic
ttgctgccaccctgggttttggagcttacatgtccaaggcccatgggatggatcccaacatcaggaccggggtgc

SEQ ID NO: 138246 - DNA, 75 bp, Artificial Sequence
  Synthetic
ttgctgccaccctgggttttggagcttacatgtccatggcccatgggatagatcccaacatcaggaccggggtgc

SEQ ID NO: 138247 - DNA, 75 bp, Artificial Sequence
  Synthetic
ttgctgccaccctgggttttggagcttacatgtccatggcccatgggattgatcccaacatcaggaccggggtgc

SEQ ID NO: 138248 - DNA, 75 bp, Artificial Sequence
  Synthetic
ttgctgccaccctgggttttggagcttacatgtccatggcccatgggatcgatcccaacatcaggaccggggtgc

SEQ ID NO: 138249 - DNA, 75 bp, Artificial Sequence
  Synthetic
ttgctgccaccctgggttttggagcttacatgtccatggcccatgggatggatcccaacatcaggaccggggtgc

SEQ ID NO: 138250 - DNA, 75 bp, Artificial Sequence
  Synthetic
ttgctgccaccctgggttttggagcttacatgtccacggcccatgggatagatcccaacatcaggaccggggtgc

SEQ ID NO: 138251 - DNA, 75 bp, Artificial Sequence
  Synthetic
ttgctgccaccctgggttttggagcttacatgtccacggcccatgggattgatcccaacatcaggaccggggtgc

SEQ ID NO: 138252 - DNA, 75 bp, Artificial Sequence
  Synthetic
ttgctgccaccctgggttttggagcttacatgtccacggcccatgggatcgatcccaacatcaggaccggggtgc

SEQ ID NO: 138253 - DNA, 75 bp, Artificial Sequence
  Synthetic
ttgctgccaccctgggttttggagcttacatgtccacggcccatgggatggatcccaacatcaggaccggggtgc

SEQ ID NO: 138254 - DNA, 75 bp, Artificial Sequence
  Synthetic
ttgctgccaccctgggttttggagcttacatgtccagggcccatgggatagatcccaacatcaggaccggggtgc

SEQ ID NO: 138255 - DNA, 75 bp, Artificial Sequence
  Synthetic
ttgctgccaccctgggttttggagcttacatgtccagggcccatgggattgatcccaacatcaggaccggggtgc

SEQ ID NO: 138256 - DNA, 75 bp, Artificial Sequence
  Synthetic
ttgctgccaccctgggttttggagcttacatgtccagggcccatgggatcgatcccaacatcaggaccggggtgc

SEQ ID NO: 138257 - DNA, 75 bp, Artificial Sequence
  Synthetic
ttgctgccaccctgggttttggagcttacatgtccagggcccatgggatggatcccaacatcaggaccggggtgc

SEQ ID NO: 138258 - DNA, 75 bp, Artificial Sequence
  Synthetic
tcgctgccaccctgggttttggagcttacatgtccaaggcccatgggatagatcccaacatcaggaccggggtgc

SEQ ID NO: 138259 - DNA, 75 bp, Artificial Sequence
  Synthetic
tcgctgccaccctgggttttggagcttacatgtccaaggcccatgggattgatcccaacatcaggaccggggtgc

SEQ ID NO: 138260 - DNA, 75 bp, Artificial Sequence
  Synthetic
tcgctgccaccctgggttttggagcttacatgtccaaggcccatgggatcgatcccaacatcaggaccggggtgc

SEQ ID NO: 138261 - DNA, 75 bp, Artificial Sequence
  Synthetic
tcgctgccaccctgggttttggagcttacatgtccaaggcccatgggatggatcccaacatcaggaccggggtgc

SEQ ID NO: 138262 - DNA, 75 bp, Artificial Sequence
  Synthetic
tcgctgccaccctgggttttggagcttacatgtccatggcccatgggatagatcccaacatcaggaccggggtgc

SEQ ID NO: 138263 - DNA, 75 bp, Artificial Sequence
  Synthetic
tcgctgccaccctgggttttggagcttacatgtccatggcccatgggattgatcccaacatcaggaccggggtgc

SEQ ID NO: 138264 - DNA, 75 bp, Artificial Sequence
  Synthetic
tcgctgccaccctgggttttggagcttacatgtccatggcccatgggatcgatcccaacatcaggaccggggtgc

SEQ ID NO: 138265 - DNA, 75 bp, Artificial Sequence
  Synthetic
tcgctgccaccctgggttttggagcttacatgtccatggcccatgggatggatcccaacatcaggaccggggtgc

SEQ ID NO: 138266 - DNA, 75 bp, Artificial Sequence
  Synthetic
tcgctgccaccctgggttttggagcttacatgtccacggcccatgggatagatcccaacatcaggaccggggtgc

SEQ ID NO: 138267 - DNA, 75 bp, Artificial Sequence
  Synthetic
tcgctgccaccctgggttttggagcttacatgtccacggcccatgggattgatcccaacatcaggaccggggtgc

SEQ ID NO: 138268 - DNA, 75 bp, Artificial Sequence
  Synthetic
tcgctgccaccctgggttttggagcttacatgtccacggcccatgggatcgatcccaacatcaggaccggggtgc

SEQ ID NO: 138269 - DNA, 75 bp, Artificial Sequence
  Synthetic
tcgctgccaccctgggttttggagcttacatgtccacggcccatgggatggatcccaacatcaggaccggggtgc

SEQ ID NO: 138270 - DNA, 75 bp, Artificial Sequence
  Synthetic
tcgctgccaccctgggttttggagcttacatgtccagggcccatgggatagatcccaacatcaggaccggggtgc

SEQ ID NO: 138271 - DNA, 75 bp, Artificial Sequence
  Synthetic
tcgctgccaccctgggttttggagcttacatgtccagggcccatgggattgatcccaacatcaggaccggggtgc

SEQ ID NO: 138272 - DNA, 75 bp, Artificial Sequence
  Synthetic
tcgctgccaccctgggttttggagcttacatgtccagggcccatgggatcgatcccaacatcaggaccggggtgc

SEQ ID NO: 138273 - DNA, 75 bp, Artificial Sequence
  Synthetic
tcgctgccaccctgggttttggagcttacatgtccagggcccatgggatggatcccaacatcaggaccggggtgc

SEQ ID NO: 138274 - DNA, 75 bp, Artificial Sequence
  Synthetic
tggctgccaccctgggttttggagcttacatgtccaaggcccatgggatagatcccaacatcaggaccggggtgc

SEQ ID NO: 138275 - DNA, 75 bp, Artificial Sequence
  Synthetic
tggctgccaccctgggttttggagcttacatgtccaaggcccatgggattgatcccaacatcaggaccggggtgc

SEQ ID NO: 138276 - DNA, 75 bp, Artificial Sequence
  Synthetic
tggctgccaccctgggttttggagcttacatgtccaaggcccatgggatcgatcccaacatcaggaccggggtgc

SEQ ID NO: 138277 - DNA, 75 bp, Artificial Sequence
  Synthetic
tggctgccaccctgggttttggagcttacatgtccaaggcccatgggatggatcccaacatcaggaccggggtgc

SEQ ID NO: 138278 - DNA, 75 bp, Artificial Sequence
  Synthetic
tggctgccaccctgggttttggagcttacatgtccatggcccatgggatagatcccaacatcaggaccggggtgc

SEQ ID NO: 138279 - DNA, 75 bp, Artificial Sequence
  Synthetic
tggctgccaccctgggttttggagcttacatgtccatggcccatgggattgatcccaacatcaggaccggggtgc

SEQ ID NO: 138280 - DNA, 75 bp, Artificial Sequence
  Synthetic
tggctgccaccctgggttttggagcttacatgtccatggcccatgggatcgatcccaacatcaggaccggggtgc

SEQ ID NO: 138281 - DNA, 75 bp, Artificial Sequence
  Synthetic
tggctgccaccctgggttttggagcttacatgtccatggcccatgggatggatcccaacatcaggaccggggtgc

SEQ ID NO: 138282 - DNA, 75 bp, Artificial Sequence
  Synthetic
tggctgccaccctgggttttggagcttacatgtccacggcccatgggatagatcccaacatcaggaccggggtgc

SEQ ID NO: 138283 - DNA, 75 bp, Artificial Sequence
  Synthetic
tggctgccaccctgggttttggagcttacatgtccacggcccatgggattgatcccaacatcaggaccggggtgc

SEQ ID NO: 138284 - DNA, 75 bp, Artificial Sequence
  Synthetic
tggctgccaccctgggttttggagcttacatgtccacggcccatgggatcgatcccaacatcaggaccggggtgc

SEQ ID NO: 138285 - DNA, 75 bp, Artificial Sequence
  Synthetic
tggctgccaccctgggttttggagcttacatgtccacggcccatgggatggatcccaacatcaggaccggggtgc

SEQ ID NO: 138286 - DNA, 75 bp, Artificial Sequence
  Synthetic
tggctgccaccctgggttttggagcttacatgtccagggcccatgggatagatcccaacatcaggaccggggtgc

SEQ ID NO: 138287 - DNA, 75 bp, Artificial Sequence
  Synthetic
tggctgccaccctgggttttggagcttacatgtccagggcccatgggattgatcccaacatcaggaccggggtgc

SEQ ID NO: 138288 - DNA, 75 bp, Artificial Sequence
  Synthetic
tggctgccaccctgggttttggagcttacatgtccagggcccatgggatcgatcccaacatcaggaccggggtgc

SEQ ID NO: 138289 - DNA, 75 bp, Artificial Sequence
  Synthetic
tggctgccaccctgggttttggagcttacatgtccagggcccatgggatggatcccaacatcaggaccggggtgc

SEQ ID NO: 138290 - DNA, 75 bp, Artificial Sequence
  Synthetic
ttctggttctgcctactcctactttccgtaggggtaggcatctacctgctccccaaccgataggtggggagctaa

SEQ ID NO: 138291 - DNA, 75 bp, Artificial Sequence
  Synthetic
gtggatgaactccacggggtttctcaagacgtgcggggctcccccttgcaacatctatgggggtggggagctcaa

SEQ ID NO: 138292 - DNA, 75 bp, Artificial Sequence
  Synthetic
cgagtgccactccactgactccacgagtatcttgggaataggcaccgtcttggaccaggcggaaacggctggagc

SEQ ID NO: 138293 - DNA, 75 bp, Artificial Sequence
  Synthetic
tgcatggtcgactacccgtaccgactttggcattacccatgtactgtcaattttacactatttaaggtgaggatg

SEQ ID NO: 138294 - DNA, 75 bp, Artificial Sequence
  Synthetic
ttttacactatttaaggtgaggatgtttgtgggcgggattgaacatcggttcagtgccgcttgcaattggaccag

SEQ ID NO: 138295 - DNA, 75 bp, Artificial Sequence
  Synthetic
cccactcaaacatagaggaagtggcgttgacccatgagggggagatccccttctatggcaaggccattcctcttg

SEQ ID NO: 138296 - DNA, 75 bp, Artificial Sequence
  Synthetic
cccactctaacatagaggaagtggcgttgacccatgagggggagatccccttctatggcaaggccattcctcttg

SEQ ID NO: 138297 - DNA, 75 bp, Artificial Sequence
  Synthetic
cccactccaacatagaggaagtggcgttgacccatgagggggagatccccttctatggcaaggccattcctcttg

SEQ ID NO: 138298 - DNA, 75 bp, Artificial Sequence
  Synthetic
cccactcgaacatagaggaagtggcgttgacccatgagggggagatccccttctatggcaaggccattcctcttg

SEQ ID NO: 138299 - DNA, 75 bp, Artificial Sequence
  Synthetic
cgctcattgacaccctgcacctgcggctcctcggacctttatctggtcacgaggcacgccgatgtcattcccgtg

SEQ ID NO: 138300 - DNA, 75 bp, Artificial Sequence
  Synthetic
catcatgcctcaggaaacttggggctccccccttgagagcttggagacaccgagcccgagcggtcagggccaaac

SEQ ID NO: 138301 - DNA, 75 bp, Artificial Sequence
  Synthetic
ctattacagagggcttgacgtctccgttataccaaccagcggagacgtcgtcgtcgtggcgaccgacgccttgat

SEQ ID NO: 138302 - DNA, 75 bp, Artificial Sequence
  Synthetic
ttgacttcagcttggaccccaccttttccattgagactcgcactgctccccaagacgcagtttcccgcagccaac

SEQ ID NO: 138303 - DNA, 75 bp, Artificial Sequence
  Synthetic
gttataccaaccagcggagacgtcgtcgtcgtggcgaccgacgccttgatgaccggctacaccggcgacttcgac

SEQ ID NO: 138304 - DNA, 75 bp, Artificial Sequence
  Synthetic
tgaaggttggggtaaacactccggcctcttaggccatttcctgtttttttttccctttttttggttttttttttt

SEQ ID NO: 138305 - DNA, 75 bp, Artificial Sequence
  Synthetic
ggagaaccttgtcacactgaatgccatcgctgctgccggtacacacggcatcggttggtacctgatagctttttg

SEQ ID NO: 138306 - DNA, 75 bp, Artificial Sequence
  Synthetic
cccgcgcgcagcggcggggtaggaccgggagagggaggcatggcgtctacaggttcgtgtcgccgggggagcgac

SEQ ID NO: 138307 - DNA, 75 bp, Artificial Sequence
  Synthetic
cgggagagggaggcatggcgtctacaggttcgtgtcgccgggggagcgaccatctggcatgtttgactcgtcggt

SEQ ID NO: 138308 - DNA, 75 bp, Artificial Sequence
  Synthetic
gtgtgccaggatcacctggagttttgggaaggtgttttcacaggccttacccacattgacgcgcactttctctct

SEQ ID NO: 138309 - DNA, 75 bp, Artificial Sequence
  Synthetic
tggcagctggcacataaaccggaccgccctcaattgcaatgacagcttgcagacgggtttcatcgcttccctgtt

SEQ ID NO: 138310 - DNA, 75 bp, Artificial Sequence
  Synthetic
ggaagtgcttgatcaggttgaagcctaccttgcacgggcccacccccctactgtacagactgggagctgtccaga

SEQ ID NO: 138311 - DNA, 75 bp, Artificial Sequence
  Synthetic
taccttgcacgggcccacccccctactgtacagactgggagctgtccagaatgaagtgactctgacacacccaat

SEQ ID NO: 138312 - DNA, 75 bp, Artificial Sequence
  Synthetic
cacatatattggttcgcctttgtatgttcgtgcgcaccgtgacgggggggaaatacttccagatggtcatgttga

SEQ ID NO: 138313 - DNA, 75 bp, Artificial Sequence
  Synthetic
cctggccgctctggccgcgtattgcctggcgacgggctccgtggtcatagtgggcaggatagtcctttccaacaa

SEQ ID NO: 138314 - DNA, 75 bp, Artificial Sequence
  Synthetic
gcccgcggtcatacctgacagagaggtcctctatcaagagtttgatgagatggaagaatgtgctgcccatttgcc

SEQ ID NO: 138315 - DNA, 75 bp, Artificial Sequence
  Synthetic
gcccgcggtcatacctgacagagaggtcctctatcaagagtttgatgagatggaagattgtgctgcccatttgcc

SEQ ID NO: 138316 - DNA, 75 bp, Artificial Sequence
  Synthetic
gcccgcggtcatacctgacagagaggtcctctatcaagagtttgatgagatggaagactgtgctgcccatttgcc

SEQ ID NO: 138317 - DNA, 75 bp, Artificial Sequence
  Synthetic
gcccgcggtcatacctgacagagaggtcctctatcaagagtttgatgagatggaagagtgtgctgcccatttgcc

SEQ ID NO: 138318 - DNA, 75 bp, Artificial Sequence
  Synthetic
tggcaaaagcttgaaaccttttggcacaagcatatgtggaactttgtgagcgggatccagtacttagcaggcctc

SEQ ID NO: 138319 - DNA, 75 bp, Artificial Sequence
  Synthetic
gtgcaatccaactggcagaaggtcgaggctttctgggcaaaacacatgtggaacttcattagtgggatacaatac

SEQ ID NO: 138320 - DNA, 75 bp, Artificial Sequence
  Synthetic
ttcagtcaccagtcccctgacgaccaaccaaactatgttttttaacatactcggggggtgggttgctacccattt

SEQ ID NO: 138321 - DNA, 75 bp, Artificial Sequence
  Synthetic
ctagcaggactgtcaacactgcccggtaatccggccatagcatcgctaatggcatttactgcatcagtcaccagc

SEQ ID NO: 138322 - DNA, 75 bp, Artificial Sequence
  Synthetic
gcatcgtcggcgccgccgtcggcagcatcggaatcgggaaaatgcttgtggacatcctcgccggttatggcgcgg

SEQ ID NO: 138323 - DNA, 75 bp, Artificial Sequence
  Synthetic
catcggaatcgggaaaatgcttgtggacatcctcgccggttatggcgcgggggtggcgggagcccttgtagcctt

SEQ ID NO: 138324 - DNA, 75 bp, Artificial Sequence
  Synthetic
ctcgtcggctggccggcgccccccggggcgcgttccttgacaccatgcacctgcggcagctcggacctttatttg

SEQ ID NO: 138325 - DNA, 75 bp, Artificial Sequence
  Synthetic
aacggcagttggcacatcaatcgaacggccctgaattgtaatgcgagcctcgatactggttgggtggcggggctc

SEQ ID NO: 138326 - DNA, 75 bp, Artificial Sequence
  Synthetic
aacggcagttggcacatcaatcgtacggccctgaattgtaatgcgagcctcgatactggttgggtggcggggctc

SEQ ID NO: 138327 - DNA, 75 bp, Artificial Sequence
  Synthetic
aacggcagttggcacatcaatcgcacggccctgaattgtaatgcgagcctcgatactggttgggtggcggggctc

SEQ ID NO: 138328 - DNA, 75 bp, Artificial Sequence
  Synthetic
aacggcagttggcacatcaatcggacggccctgaattgtaatgcgagcctcgatactggttgggtggcggggctc

SEQ ID NO: 138329 - DNA, 75 bp, Artificial Sequence
  Synthetic
gccatactacgccgccacgtgggcccgggcgagggtgctgtgcagtggatgaaccggctgatagcatttgcttcc

SEQ ID NO: 138330 - DNA, 75 bp, Artificial Sequence
  Synthetic
cgggcgagggtgctgtgcagtggatgaaccggctgatagcatttgcttcccgaggcaaccatgtctccccaacgc

SEQ ID NO: 138331 - DNA, 75 bp, Artificial Sequence
  Synthetic
ctctgctaagatcatgccggcactccctgggttgccctttatttcttgtcaaaagggatataagggcgtgtggcg

SEQ ID NO: 138332 - DNA, 75 bp, Artificial Sequence
  Synthetic
ggcgactccacacatggatcaatgaagactgcaccacgccatgctccggctcctggctcagcgagatctgggact

SEQ ID NO: 138333 - DNA, 75 bp, Artificial Sequence
  Synthetic
ctaccccaactaccaggagtccccttcctgtcctgccaacgcgggtacagaggggtctggcggggggatggtgtc

SEQ ID NO: 138334 - DNA, 75 bp, Artificial Sequence
  Synthetic
aagggtaagctggtccctggggcggcgtatgctttctatggcgtatggccgctgcttctgctcctgttggcgttg

SEQ ID NO: 138335 - DNA, 75 bp, Artificial Sequence
  Synthetic
ggtcgtttcccataaacgccttcaccacgggcccctgcacacccacccccgcgccgaactattcgcgcgcgttgt

SEQ ID NO: 138336 - DNA, 75 bp, Artificial Sequence
  Synthetic
gagggctcacgctctgctacgagtgtgtaccctggtgagacacctcgcaggagctaggtacatccagatgctgct

SEQ ID NO: 138337 - DNA, 75 bp, Artificial Sequence
  Synthetic
cccatcacctgaattcttcaccgagctggacggggtgcgccttcacaggtacgccccgccatgcaaacctctgct

SEQ ID NO: 138338 - DNA, 75 bp, Artificial Sequence
  Synthetic
tggcgtactataggggtcttgatgtatccgtcataccaacagcaggagacgtcgtagtttgcgctactgacgccc

SEQ ID NO: 138339 - DNA, 75 bp, Artificial Sequence
  Synthetic
gtgagcctgaaccggacgtttctgtgctgacctcgatgctgagagacccctcccatatcaccgctgagacggcag

SEQ ID NO: 138340 - DNA, 75 bp, Artificial Sequence
  Synthetic
ctcacagacccatcacacatcaccgcagagactgcgaggcggaggctaaaccgagggtcccctccctctttggcc

SEQ ID NO: 138341 - DNA, 75 bp, Artificial Sequence
  Synthetic
gccaatttgctatggcgacaagagatgggtagtaacatcacacgggtagagtctgaaacaaaggttgtgattctt

SEQ ID NO: 138342 - DNA, 75 bp, Artificial Sequence
  Synthetic
gcccggagtggcctacgccgtctacgggatgtggcctctcctcctgctcctgttggcgttgccccaacgggcata

SEQ ID NO: 138343 - DNA, 75 bp, Artificial Sequence
  Synthetic
gggatgtggcctctcctcctgctcctgttggcgttgccccaacgggcatacgcactggacacggaggtggccgcg

SEQ ID NO: 138344 - DNA, 75 bp, Artificial Sequence
  Synthetic
ggaggcaggagatgggcggaaacatcaccagggtggagtcggagaacaaagtggttgtcttggattcctttgacc

SEQ ID NO: 138345 - DNA, 75 bp, Artificial Sequence
  Synthetic
cccccccgggactaagtcattagacccctgtacctgcggggctgtggacctctacctggtcacccgaaacgctga

SEQ ID NO: 138346 - DNA, 75 bp, Artificial Sequence
  Synthetic
ccggattatgtaccaccaactgtccatgggtgcgctttaccaccacgaggtgctcctccggtgcctcctcctcgg

SEQ ID NO: 138347 - DNA, 75 bp, Artificial Sequence
  Synthetic
ggtgtctgcagaggaatacgtggagataaggcaggtgggggacttccactacgtgacgggtatgactactgacaa

SEQ ID NO: 138348 - DNA, 75 bp, Artificial Sequence
  Synthetic
cagttacaatccaccattgctcgagccatggaagagacccggctacgagccgcctgtggtccacgggtgtccact

SEQ ID NO: 138349 - DNA, 75 bp, Artificial Sequence
  Synthetic
caaagaccctagccggcccaaaaggtccaatcacccaaatgtacaccaatgtagaccaggacctcgtcggctggc

SEQ ID NO: 138350 - DNA, 75 bp, Artificial Sequence
  Synthetic
ccgtcacaaaatacatcatggcatgcatgtcagctgatctggaagtaaccaccagcacctgggtgttgcttggag

SEQ ID NO: 138351 - DNA, 75 bp, Artificial Sequence
  Synthetic
aagtcctttggccagccaactccttcaggtgtcaccagcgatacgccatccccggcgccggaggaggggctccac

SEQ ID NO: 138352 - DNA, 75 bp, Artificial Sequence
  Synthetic
tgacgcagttctccaccttcctggatgcgtcccatgtgagaatgataatggcaccttgcgctgctggatacaagt

SEQ ID NO: 138353 - DNA, 75 bp, Artificial Sequence
  Synthetic
agagggggagcctggagaccccgacctcagcgacgggtcctggtcgaccgtgagctccaccaacggttccgagga

SEQ ID NO: 138354 - DNA, 75 bp, Artificial Sequence
  Synthetic
tcagccagatccaagtttggctatggggcaaaagacgtccgttgccatgccagaaaggccgtaaaccacatcaac

SEQ ID NO: 138355 - DNA, 75 bp, Artificial Sequence
  Synthetic
gaacacatgtcgacatgatcgtaatggcggctacggtctgctcggccttgtacgtgggagatgtgtgcggggccg

SEQ ID NO: 138356 - DNA, 75 bp, Artificial Sequence
  Synthetic
ctcttgcgccaccacaacatggtctattccaccacctctcgcagcgcgggccagaggcagaaaaaagtcactttt

SEQ ID NO: 138357 - DNA, 75 bp, Artificial Sequence
  Synthetic
cccagcaacaagctatcattgagcctatagtagttaccaactggcaaaagcttgaagccttctggcacaagcata

SEQ ID NO: 138358 - DNA, 75 bp, Artificial Sequence
  Synthetic
attacaaggacgtggtaaaggagataaaggcaaaggcgtccacagtcagggcggacttgctgtccgttgaggaag

SEQ ID NO: 138359 - DNA, 75 bp, Artificial Sequence
  Synthetic
aatgactgccccaacagcagcattgtgtatgaggcatctgatgtcattctgcacctccctggatgcgtcccttgc

SEQ ID NO: 138360 - DNA, 75 bp, Artificial Sequence
  Synthetic
tgtatgaggcatctgatgtcattctgcacctccctggatgcgtcccttgcacgaggtctggtaacacctccatgt

SEQ ID NO: 138361 - DNA, 75 bp, Artificial Sequence
  Synthetic
acgccgccactggaccacccaagactgcaattgttccatctacacaggacatatcacaggacacagaatggcttg

SEQ ID NO: 138362 - DNA, 75 bp, Artificial Sequence
  Synthetic
acgccgccactggaccacccaagactgcaattgttccatctactcaggacatatcacaggacacagaatggcttg

SEQ ID NO: 138363 - DNA, 75 bp, Artificial Sequence
  Synthetic
acgccgccactggaccacccaagactgcaattgttccatctacccaggacatatcacaggacacagaatggcttg

SEQ ID NO: 138364 - DNA, 75 bp, Artificial Sequence
  Synthetic
acgccgccactggaccacccaagactgcaattgttccatctacgcaggacatatcacaggacacagaatggcttg

SEQ ID NO: 138365 - DNA, 75 bp, Artificial Sequence
  Synthetic
tggcagctggcacataaaccggaccgccctcaactgcaatgacagcttgcagacgggtttcatcgcttccctgtt

SEQ ID NO: 138366 - DNA, 75 bp, Artificial Sequence
  Synthetic
ttgttcggccatgtacgtaggggatctatgtgggggtgccttcctcgtcggccagctcttcgtgttcagaccgcg

SEQ ID NO: 138367 - DNA, 75 bp, Artificial Sequence
  Synthetic
ccgacctgggggtacgggtgtgcgagaagagggctttatatgacgtagtcaagaagctccctctggccgtgatgg

SEQ ID NO: 138368 - DNA, 75 bp, Artificial Sequence
  Synthetic
cacaaccagaatacgacttggagctcataacatcctgctcctccaacgtgtcagtcgcccacgacggcgctggaa

SEQ ID NO: 138369 - DNA, 75 bp, Artificial Sequence
  Synthetic
gcgctctcgtcgtcggcgtgatatgcgctgccattttacgtcgacacgtaggacccggggagggggcggtacaat

SEQ ID NO: 138370 - DNA, 75 bp, Artificial Sequence
  Synthetic
gaagagggctttatatgacgtagtcaagaagctccctctggccgtgatggggggctcttacgggttccagtactc

SEQ ID NO: 138371 - DNA, 75 bp, Artificial Sequence
  Synthetic
ggcattctggttggcatagcgtacttcagcatgcaagctaattgggccaaggttatcctggtcctgtttcttttt

SEQ ID NO: 138372 - DNA, 75 bp, Artificial Sequence
  Synthetic
accaccctgattgtgtcctacgctctcagggtgcctcagttgattgtcgacatttttgtcggtggtcattggggt

SEQ ID NO: 138373 - DNA, 75 bp, Artificial Sequence
  Synthetic
cgtagagggagaactgggagggggcgactgggcatttataggtatgtctcgtcgggcgagaggccgtctgggatg

SEQ ID NO: 138374 - DNA, 75 bp, Artificial Sequence
  Synthetic
gctaggacggtttgcgggccggtctactgttttactcccagccctgtcgtcgtgggcaccactgacaagcagggc

SEQ ID NO: 138375 - DNA, 75 bp, Artificial Sequence
  Synthetic
ccccgacgcacgtgttgccatcaaaaatctcactgagagattgtacgtcggagggcccctgaccaattcaaaagg

SEQ ID NO: 138376 - DNA, 75 bp, Artificial Sequence
  Synthetic
agctcattaacaccaatgggagctggcatatcaataggactgccctcaattgtaatgacagcctgaacaaaggat

SEQ ID NO: 138377 - DNA, 75 bp, Artificial Sequence
  Synthetic
agctcattaacaccaatgggagctggcatatcaataggactgccctcaattgtaatgacagcctgaacataggat

SEQ ID NO: 138378 - DNA, 75 bp, Artificial Sequence
  Synthetic
agctcattaacaccaatgggagctggcatatcaataggactgccctcaattgtaatgacagcctgaacacaggat

SEQ ID NO: 138379 - DNA, 75 bp, Artificial Sequence
  Synthetic
agctcattaacaccaatgggagctggcatatcaataggactgccctcaattgtaatgacagcctgaacagaggat

SEQ ID NO: 138380 - DNA, 75 bp, Artificial Sequence
  Synthetic
ccggttccgctgtaggtgaccaggcgcgcgggttcgctaatatattccagtttgggcctaggcagaacattcagc

SEQ ID NO: 138381 - DNA, 75 bp, Artificial Sequence
  Synthetic
gagaggctatctagctgtaaaagacttgacaacctcacacagggctggggccctcttgggatataccaggctaat

SEQ ID NO: 138382 - DNA, 75 bp, Artificial Sequence
  Synthetic
gagaggctatctagctgtaaaagacttgacaacctcacacagggctggggccctcttgggatttaccaggctaat

SEQ ID NO: 138383 - DNA, 75 bp, Artificial Sequence
  Synthetic
gagaggctatctagctgtaaaagacttgacaacctcacacagggctggggccctcttgggatctaccaggctaat

SEQ ID NO: 138384 - DNA, 75 bp, Artificial Sequence
  Synthetic
gagaggctatctagctgtaaaagacttgacaacctcacacagggctggggccctcttgggatgtaccaggctaat

SEQ ID NO: 138385 - DNA, 75 bp, Artificial Sequence
  Synthetic
gagaggctatctagctgtaaaagacttgacaacctctcacagggctggggccctcttgggatataccaggctaat

SEQ ID NO: 138386 - DNA, 75 bp, Artificial Sequence
  Synthetic
gagaggctatctagctgtaaaagacttgacaacctctcacagggctggggccctcttgggatttaccaggctaat

SEQ ID NO: 138387 - DNA, 75 bp, Artificial Sequence
  Synthetic
gagaggctatctagctgtaaaagacttgacaacctctcacagggctggggccctcttgggatctaccaggctaat

SEQ ID NO: 138388 - DNA, 75 bp, Artificial Sequence
  Synthetic
gagaggctatctagctgtaaaagacttgacaacctctcacagggctggggccctcttgggatgtaccaggctaat

SEQ ID NO: 138389 - DNA, 75 bp, Artificial Sequence
  Synthetic
gagaggctatctagctgtaaaagacttgacaacctcccacagggctggggccctcttgggatataccaggctaat

SEQ ID NO: 138390 - DNA, 75 bp, Artificial Sequence
  Synthetic
gagaggctatctagctgtaaaagacttgacaacctcccacagggctggggccctcttgggatttaccaggctaat

SEQ ID NO: 138391 - DNA, 75 bp, Artificial Sequence
  Synthetic
gagaggctatctagctgtaaaagacttgacaacctcccacagggctggggccctcttgggatctaccaggctaat

SEQ ID NO: 138392 - DNA, 75 bp, Artificial Sequence
  Synthetic
gagaggctatctagctgtaaaagacttgacaacctcccacagggctggggccctcttgggatgtaccaggctaat

SEQ ID NO: 138393 - DNA, 75 bp, Artificial Sequence
  Synthetic
gagaggctatctagctgtaaaagacttgacaacctcgcacagggctggggccctcttgggatataccaggctaat

SEQ ID NO: 138394 - DNA, 75 bp, Artificial Sequence
  Synthetic
gagaggctatctagctgtaaaagacttgacaacctcgcacagggctggggccctcttgggatttaccaggctaat

SEQ ID NO: 138395 - DNA, 75 bp, Artificial Sequence
  Synthetic
gagaggctatctagctgtaaaagacttgacaacctcgcacagggctggggccctcttgggatctaccaggctaat

SEQ ID NO: 138396 - DNA, 75 bp, Artificial Sequence
  Synthetic
gagaggctatctagctgtaaaagacttgacaacctcgcacagggctggggccctcttgggatgtaccaggctaat

SEQ ID NO: 138397 - DNA, 75 bp, Artificial Sequence
  Synthetic
gagaggctatctagctgtaaaagacttgactacctcacacagggctggggccctcttgggatataccaggctaat

SEQ ID NO: 138398 - DNA, 75 bp, Artificial Sequence
  Synthetic
gagaggctatctagctgtaaaagacttgactacctcacacagggctggggccctcttgggatttaccaggctaat

SEQ ID NO: 138399 - DNA, 75 bp, Artificial Sequence
  Synthetic
gagaggctatctagctgtaaaagacttgactacctcacacagggctggggccctcttgggatctaccaggctaat

SEQ ID NO: 138400 - DNA, 75 bp, Artificial Sequence
  Synthetic
gagaggctatctagctgtaaaagacttgactacctcacacagggctggggccctcttgggatgtaccaggctaat

SEQ ID NO: 138401 - DNA, 75 bp, Artificial Sequence
  Synthetic
gagaggctatctagctgtaaaagacttgactacctctcacagggctggggccctcttgggatataccaggctaat

SEQ ID NO: 138402 - DNA, 75 bp, Artificial Sequence
  Synthetic
gagaggctatctagctgtaaaagacttgactacctctcacagggctggggccctcttgggatttaccaggctaat

SEQ ID NO: 138403 - DNA, 75 bp, Artificial Sequence
  Synthetic
gagaggctatctagctgtaaaagacttgactacctctcacagggctggggccctcttgggatctaccaggctaat

SEQ ID NO: 138404 - DNA, 75 bp, Artificial Sequence
  Synthetic
gagaggctatctagctgtaaaagacttgactacctctcacagggctggggccctcttgggatgtaccaggctaat

SEQ ID NO: 138405 - DNA, 75 bp, Artificial Sequence
  Synthetic
gagaggctatctagctgtaaaagacttgactacctcccacagggctggggccctcttgggatataccaggctaat

SEQ ID NO: 138406 - DNA, 75 bp, Artificial Sequence
  Synthetic
gagaggctatctagctgtaaaagacttgactacctcccacagggctggggccctcttgggatttaccaggctaat

SEQ ID NO: 138407 - DNA, 75 bp, Artificial Sequence
  Synthetic
gagaggctatctagctgtaaaagacttgactacctcccacagggctggggccctcttgggatctaccaggctaat

SEQ ID NO: 138408 - DNA, 75 bp, Artificial Sequence
  Synthetic
gagaggctatctagctgtaaaagacttgactacctcccacagggctggggccctcttgggatgtaccaggctaat

SEQ ID NO: 138409 - DNA, 75 bp, Artificial Sequence
  Synthetic
gagaggctatctagctgtaaaagacttgactacctcgcacagggctggggccctcttgggatataccaggctaat

SEQ ID NO: 138410 - DNA, 75 bp, Artificial Sequence
  Synthetic
gagaggctatctagctgtaaaagacttgactacctcgcacagggctggggccctcttgggatttaccaggctaat

SEQ ID NO: 138411 - DNA, 75 bp, Artificial Sequence
  Synthetic
gagaggctatctagctgtaaaagacttgactacctcgcacagggctggggccctcttgggatctaccaggctaat

SEQ ID NO: 138412 - DNA, 75 bp, Artificial Sequence
  Synthetic
gagaggctatctagctgtaaaagacttgactacctcgcacagggctggggccctcttgggatgtaccaggctaat

SEQ ID NO: 138413 - DNA, 75 bp, Artificial Sequence
  Synthetic
gagaggctatctagctgtaaaagacttgaccacctcacacagggctggggccctcttgggatataccaggctaat

SEQ ID NO: 138414 - DNA, 75 bp, Artificial Sequence
  Synthetic
gagaggctatctagctgtaaaagacttgaccacctcacacagggctggggccctcttgggatttaccaggctaat

SEQ ID NO: 138415 - DNA, 75 bp, Artificial Sequence
  Synthetic
gagaggctatctagctgtaaaagacttgaccacctcacacagggctggggccctcttgggatctaccaggctaat

SEQ ID NO: 138416 - DNA, 75 bp, Artificial Sequence
  Synthetic
gagaggctatctagctgtaaaagacttgaccacctcacacagggctggggccctcttgggatgtaccaggctaat

SEQ ID NO: 138417 - DNA, 75 bp, Artificial Sequence
  Synthetic
gagaggctatctagctgtaaaagacttgaccacctctcacagggctggggccctcttgggatataccaggctaat

SEQ ID NO: 138418 - DNA, 75 bp, Artificial Sequence
  Synthetic
gagaggctatctagctgtaaaagacttgaccacctctcacagggctggggccctcttgggatttaccaggctaat

SEQ ID NO: 138419 - DNA, 75 bp, Artificial Sequence
  Synthetic
gagaggctatctagctgtaaaagacttgaccacctctcacagggctggggccctcttgggatctaccaggctaat

SEQ ID NO: 138420 - DNA, 75 bp, Artificial Sequence
  Synthetic
gagaggctatctagctgtaaaagacttgaccacctctcacagggctggggccctcttgggatgtaccaggctaat

SEQ ID NO: 138421 - DNA, 75 bp, Artificial Sequence
  Synthetic
gagaggctatctagctgtaaaagacttgaccacctcccacagggctggggccctcttgggatataccaggctaat

SEQ ID NO: 138422 - DNA, 75 bp, Artificial Sequence
  Synthetic
gagaggctatctagctgtaaaagacttgaccacctcccacagggctggggccctcttgggatttaccaggctaat

SEQ ID NO: 138423 - DNA, 75 bp, Artificial Sequence
  Synthetic
gagaggctatctagctgtaaaagacttgaccacctcccacagggctggggccctcttgggatctaccaggctaat

SEQ ID NO: 138424 - DNA, 75 bp, Artificial Sequence
  Synthetic
gagaggctatctagctgtaaaagacttgaccacctcccacagggctggggccctcttgggatgtaccaggctaat

SEQ ID NO: 138425 - DNA, 75 bp, Artificial Sequence
  Synthetic
gagaggctatctagctgtaaaagacttgaccacctcgcacagggctggggccctcttgggatataccaggctaat

SEQ ID NO: 138426 - DNA, 75 bp, Artificial Sequence
  Synthetic
gagaggctatctagctgtaaaagacttgaccacctcgcacagggctggggccctcttgggatttaccaggctaat

SEQ ID NO: 138427 - DNA, 75 bp, Artificial Sequence
  Synthetic
gagaggctatctagctgtaaaagacttgaccacctcgcacagggctggggccctcttgggatctaccaggctaat

SEQ ID NO: 138428 - DNA, 75 bp, Artificial Sequence
  Synthetic
gagaggctatctagctgtaaaagacttgaccacctcgcacagggctggggccctcttgggatgtaccaggctaat

SEQ ID NO: 138429 - DNA, 75 bp, Artificial Sequence
  Synthetic
gagaggctatctagctgtaaaagacttgacgacctcacacagggctggggccctcttgggatataccaggctaat

SEQ ID NO: 138430 - DNA, 75 bp, Artificial Sequence
  Synthetic
gagaggctatctagctgtaaaagacttgacgacctcacacagggctggggccctcttgggatttaccaggctaat

SEQ ID NO: 138431 - DNA, 75 bp, Artificial Sequence
  Synthetic
gagaggctatctagctgtaaaagacttgacgacctcacacagggctggggccctcttgggatctaccaggctaat

SEQ ID NO: 138432 - DNA, 75 bp, Artificial Sequence
  Synthetic
gagaggctatctagctgtaaaagacttgacgacctcacacagggctggggccctcttgggatgtaccaggctaat

SEQ ID NO: 138433 - DNA, 75 bp, Artificial Sequence
  Synthetic
gagaggctatctagctgtaaaagacttgacgacctctcacagggctggggccctcttgggatataccaggctaat

SEQ ID NO: 138434 - DNA, 75 bp, Artificial Sequence
  Synthetic
gagaggctatctagctgtaaaagacttgacgacctctcacagggctggggccctcttgggatttaccaggctaat

SEQ ID NO: 138435 - DNA, 75 bp, Artificial Sequence
  Synthetic
gagaggctatctagctgtaaaagacttgacgacctctcacagggctggggccctcttgggatctaccaggctaat

SEQ ID NO: 138436 - DNA, 75 bp, Artificial Sequence
  Synthetic
gagaggctatctagctgtaaaagacttgacgacctctcacagggctggggccctcttgggatgtaccaggctaat

SEQ ID NO: 138437 - DNA, 75 bp, Artificial Sequence
  Synthetic
gagaggctatctagctgtaaaagacttgacgacctcccacagggctggggccctcttgggatataccaggctaat

SEQ ID NO: 138438 - DNA, 75 bp, Artificial Sequence
  Synthetic
gagaggctatctagctgtaaaagacttgacgacctcccacagggctggggccctcttgggatttaccaggctaat

SEQ ID NO: 138439 - DNA, 75 bp, Artificial Sequence
  Synthetic
gagaggctatctagctgtaaaagacttgacgacctcccacagggctggggccctcttgggatctaccaggctaat

SEQ ID NO: 138440 - DNA, 75 bp, Artificial Sequence
  Synthetic
gagaggctatctagctgtaaaagacttgacgacctcccacagggctggggccctcttgggatgtaccaggctaat

SEQ ID NO: 138441 - DNA, 75 bp, Artificial Sequence
  Synthetic
gagaggctatctagctgtaaaagacttgacgacctcgcacagggctggggccctcttgggatataccaggctaat

SEQ ID NO: 138442 - DNA, 75 bp, Artificial Sequence
  Synthetic
gagaggctatctagctgtaaaagacttgacgacctcgcacagggctggggccctcttgggatttaccaggctaat

SEQ ID NO: 138443 - DNA, 75 bp, Artificial Sequence
  Synthetic
gagaggctatctagctgtaaaagacttgacgacctcgcacagggctggggccctcttgggatctaccaggctaat

SEQ ID NO: 138444 - DNA, 75 bp, Artificial Sequence
  Synthetic
gagaggctatctagctgtaaaagacttgacgacctcgcacagggctggggccctcttgggatgtaccaggctaat

SEQ ID NO: 138445 - DNA, 75 bp, Artificial Sequence
  Synthetic
gtttaattcctccgggtgtgttgagcggatgagcgcttgcagaaagctcgcaagcttttctcaagggtcgggccc

SEQ ID NO: 138446 - DNA, 75 bp, Artificial Sequence
  Synthetic
ggaactacacgcctcggccctgctggacggtgcctgcatctaccgtgtgtggccccgtatattgttttacaccca

SEQ ID NO: 138447 - DNA, 75 bp, Artificial Sequence
  Synthetic
gccctgtggtggtcgggacgaccgatcgccttggggctccaacatacacgtggggcgagaatgagactgatgtgt

SEQ ID NO: 138448 - DNA, 75 bp, Artificial Sequence
  Synthetic
agctccccctggccgtgatgggaagctcctacggattccaatactcaccaggacagcgggttgagttcctcgtgc

SEQ ID NO: 138449 - DNA, 75 bp, Artificial Sequence
  Synthetic
ggtccggtgtactgcttcacgcccagccccgtggtcgtggggacgaccgaccggagaggtcaccccacctactcc

SEQ ID NO: 138450 - DNA, 75 bp, Artificial Sequence
  Synthetic
accagggttgcccgtctgccaggaccatctggagttctgggagagtgtcttcacaggcctcacccatatagatgc

SEQ ID NO: 138451 - DNA, 75 bp, Artificial Sequence
  Synthetic
ggatgtccaactgactgcttcagaaaacatccagatgccacttacaccaaatgtggctcagggccttggcttacg

SEQ ID NO: 138452 - DNA, 75 bp, Artificial Sequence
  Synthetic
aaacatgtggggcacctccttgccgcatcacacctctggaagtgacacccaatgattccctgacatgccctactg

SEQ ID NO: 138453 - DNA, 75 bp, Artificial Sequence
  Synthetic
gccctcatgaccggttataccggcgatttcgactcggtgatagactgtaacacgtgtgtcacccagacagtcgac

SEQ ID NO: 138454 - DNA, 75 bp, Artificial Sequence
  Synthetic
ctacccatgcactgtgaactacaccgtacacaaggtgcgtatgttcgtgggaggagtagagcacaggttccaggc

SEQ ID NO: 138455 - DNA, 75 bp, Artificial Sequence
  Synthetic
tgcatgcaactggacacggggggagccatgcgagctggaagaccgggacagggtcgaaatgagtcccctcctgtt

SEQ ID NO: 138456 - DNA, 75 bp, Artificial Sequence
  Synthetic
aacaccagtagcggttacatggtgacaaatgactgctccaatgacagcatcacctggcagcttgaggccgcggtc

SEQ ID NO: 138457 - DNA, 75 bp, Artificial Sequence
  Synthetic
cctcacacctcccttacatcgaacagggaatgcagctcgccgaacaattcaaacagaaggcgctcgggttgctgc

SEQ ID NO: 138458 - DNA, 75 bp, Artificial Sequence
  Synthetic
tccgtaggggtaggcgttttcctgctccccaaccggtaggtggggagttaaacactccagcctcataggctaacc

SEQ ID NO: 138459 - DNA, 75 bp, Artificial Sequence
  Synthetic
ctggcggatgcgcgcatatgcgcgtgcctttggctcatgatgctagtaggtcaagtggaggcagccctggagaat

SEQ ID NO: 138460 - DNA, 75 bp, Artificial Sequence
  Synthetic
atgccgcatgcgggttgtggcccctgctgctcctggtcttgatgatgcccgagagggcgtacgccttcgatcggg

SEQ ID NO: 138461 - DNA, 75 bp, Artificial Sequence
  Synthetic
atgccgcatgcgggttgtggcccctgctgctcctggtcttgatgttgcccgagagggcgtacgccttcgatcggg

SEQ ID NO: 138462 - DNA, 75 bp, Artificial Sequence
  Synthetic
atgccgcatgcgggttgtggcccctgctgctcctggtcttgatgctgcccgagagggcgtacgccttcgatcggg

SEQ ID NO: 138463 - DNA, 75 bp, Artificial Sequence
  Synthetic
atgccgcatgcgggttgtggcccctgctgctcctggtcttgatggtgcccgagagggcgtacgccttcgatcggg

SEQ ID NO: 138464 - DNA, 75 bp, Artificial Sequence
  Synthetic
acagtccagctggacagctccaatgtgtctgtggcgctagctgcgctagcggaaagatcattcccatcctcgaag

SEQ ID NO: 138465 - DNA, 75 bp, Artificial Sequence
  Synthetic
gggcctgcctacctccttaaagcgtctctgctgcgggtaccatactttgtgagagctcacgctctgctacgagtg

SEQ ID NO: 138466 - DNA, 75 bp, Artificial Sequence
  Synthetic
ttgcatcgtctttgtctgtgccgtatggtatatcaaaggtcgggtggtgccaggtatgacctacatcctattaca

SEQ ID NO: 138467 - DNA, 75 bp, Artificial Sequence
  Synthetic
accttgtctccacattacaaacagtggctagctcgaggtatttggtggatgcaatacttcattgccagagccgag

SEQ ID NO: 138468 - DNA, 75 bp, Artificial Sequence
  Synthetic
accttgtctccacattacaaacagtggctagctcgaggtatttggtggttgcaatacttcattgccagagccgag

SEQ ID NO: 138469 - DNA, 75 bp, Artificial Sequence
  Synthetic
accttgtctccacattacaaacagtggctagctcgaggtatttggtggctgcaatacttcattgccagagccgag

SEQ ID NO: 138470 - DNA, 75 bp, Artificial Sequence
  Synthetic
accttgtctccacattacaaacagtggctagctcgaggtatttggtgggtgcaatacttcattgccagagccgag

SEQ ID NO: 138471 - DNA, 75 bp, Artificial Sequence
  Synthetic
accttgtctccacattacaaacagtggcttgctcgaggtatttggtggatgcaatacttcattgccagagccgag

SEQ ID NO: 138472 - DNA, 75 bp, Artificial Sequence
  Synthetic
accttgtctccacattacaaacagtggcttgctcgaggtatttggtggttgcaatacttcattgccagagccgag

SEQ ID NO: 138473 - DNA, 75 bp, Artificial Sequence
  Synthetic
accttgtctccacattacaaacagtggcttgctcgaggtatttggtggctgcaatacttcattgccagagccgag

SEQ ID NO: 138474 - DNA, 75 bp, Artificial Sequence
  Synthetic
accttgtctccacattacaaacagtggcttgctcgaggtatttggtgggtgcaatacttcattgccagagccgag

SEQ ID NO: 138475 - DNA, 75 bp, Artificial Sequence
  Synthetic
accttgtctccacattacaaacagtggctcgctcgaggtatttggtggatgcaatacttcattgccagagccgag

SEQ ID NO: 138476 - DNA, 75 bp, Artificial Sequence
  Synthetic
accttgtctccacattacaaacagtggctcgctcgaggtatttggtggttgcaatacttcattgccagagccgag

SEQ ID NO: 138477 - DNA, 75 bp, Artificial Sequence
  Synthetic
accttgtctccacattacaaacagtggctcgctcgaggtatttggtggctgcaatacttcattgccagagccgag

SEQ ID NO: 138478 - DNA, 75 bp, Artificial Sequence
  Synthetic
accttgtctccacattacaaacagtggctcgctcgaggtatttggtgggtgcaatacttcattgccagagccgag

SEQ ID NO: 138479 - DNA, 75 bp, Artificial Sequence
  Synthetic
accttgtctccacattacaaacagtggctggctcgaggtatttggtggatgcaatacttcattgccagagccgag

SEQ ID NO: 138480 - DNA, 75 bp, Artificial Sequence
  Synthetic
accttgtctccacattacaaacagtggctggctcgaggtatttggtggttgcaatacttcattgccagagccgag

SEQ ID NO: 138481 - DNA, 75 bp, Artificial Sequence
  Synthetic
accttgtctccacattacaaacagtggctggctcgaggtatttggtggctgcaatacttcattgccagagccgag

SEQ ID NO: 138482 - DNA, 75 bp, Artificial Sequence
  Synthetic
accttgtctccacattacaaacagtggctggctcgaggtatttggtgggtgcaatacttcattgccagagccgag

SEQ ID NO: 138483 - DNA, 75 bp, Artificial Sequence
  Synthetic
cttacatgtttgctccatccatccttggggtttgacattaccaaggtgctgctggccatattgggctctcaatac

SEQ ID NO: 138484 - DNA, 75 bp, Artificial Sequence
  Synthetic
tgtggtaagtattgtcagatggccctattgaaaataggggcgctgaccggaacatacatctacaaccacctaact

SEQ ID NO: 138485 - DNA, 75 bp, Artificial Sequence
  Synthetic
tgtggtaagtattgtcagatggccctattgaaaataggggcgctgaccggaacatacatctacaaccaccttact

SEQ ID NO: 138486 - DNA, 75 bp, Artificial Sequence
  Synthetic
tgtggtaagtattgtcagatggccctattgaaaataggggcgctgaccggaacatacatctacaaccacctcact

SEQ ID NO: 138487 - DNA, 75 bp, Artificial Sequence
  Synthetic
tgtggtaagtattgtcagatggccctattgaaaataggggcgctgaccggaacatacatctacaaccacctgact

SEQ ID NO: 138488 - DNA, 75 bp, Artificial Sequence
  Synthetic
ggccttccggataggatggggtaccttgcaatacgaggataatgtcaccaatccagaagatatgagaccatattg

SEQ ID NO: 138489 - DNA, 75 bp, Artificial Sequence
  Synthetic
cctcctgggtgccatcgtggtcagcctaacgggccgcgacaaaaatgagcaggctgggcaagtccaggttctgtc

SEQ ID NO: 138490 - DNA, 75 bp, Artificial Sequence
  Synthetic
aacatacatctacaaccacctaactcctttatcagactgggctgctgaggggcttagtgacctaacggtggcact

SEQ ID NO: 138491 - DNA, 75 bp, Artificial Sequence
  Synthetic
aacatacatctacaaccacctaactcctttatcagactgggctgctgaggggcttagtgacctatcggtggcact

SEQ ID NO: 138492 - DNA, 75 bp, Artificial Sequence
  Synthetic
aacatacatctacaaccacctaactcctttatcagactgggctgctgaggggcttagtgacctaccggtggcact

SEQ ID NO: 138493 - DNA, 75 bp, Artificial Sequence
  Synthetic
aacatacatctacaaccacctaactcctttatcagactgggctgctgaggggcttagtgacctagcggtggcact

SEQ ID NO: 138494 - DNA, 75 bp, Artificial Sequence
  Synthetic
aacatacatctacaaccaccttactcctttatcagactgggctgctgaggggcttagtgacctaacggtggcact

SEQ ID NO: 138495 - DNA, 75 bp, Artificial Sequence
  Synthetic
aacatacatctacaaccaccttactcctttatcagactgggctgctgaggggcttagtgacctatcggtggcact

SEQ ID NO: 138496 - DNA, 75 bp, Artificial Sequence
  Synthetic
aacatacatctacaaccaccttactcctttatcagactgggctgctgaggggcttagtgacctaccggtggcact

SEQ ID NO: 138497 - DNA, 75 bp, Artificial Sequence
  Synthetic
aacatacatctacaaccaccttactcctttatcagactgggctgctgaggggcttagtgacctagcggtggcact

SEQ ID NO: 138498 - DNA, 75 bp, Artificial Sequence
  Synthetic
aacatacatctacaaccacctcactcctttatcagactgggctgctgaggggcttagtgacctaacggtggcact

SEQ ID NO: 138499 - DNA, 75 bp, Artificial Sequence
  Synthetic
aacatacatctacaaccacctcactcctttatcagactgggctgctgaggggcttagtgacctatcggtggcact

SEQ ID NO: 138500 - DNA, 75 bp, Artificial Sequence
  Synthetic
aacatacatctacaaccacctcactcctttatcagactgggctgctgaggggcttagtgacctaccggtggcact

SEQ ID NO: 138501 - DNA, 75 bp, Artificial Sequence
  Synthetic
aacatacatctacaaccacctcactcctttatcagactgggctgctgaggggcttagtgacctagcggtggcact

SEQ ID NO: 138502 - DNA, 75 bp, Artificial Sequence
  Synthetic
aacatacatctacaaccacctgactcctttatcagactgggctgctgaggggcttagtgacctaacggtggcact

SEQ ID NO: 138503 - DNA, 75 bp, Artificial Sequence
  Synthetic
aacatacatctacaaccacctgactcctttatcagactgggctgctgaggggcttagtgacctatcggtggcact

SEQ ID NO: 138504 - DNA, 75 bp, Artificial Sequence
  Synthetic
aacatacatctacaaccacctgactcctttatcagactgggctgctgaggggcttagtgacctaccggtggcact

SEQ ID NO: 138505 - DNA, 75 bp, Artificial Sequence
  Synthetic
aacatacatctacaaccacctgactcctttatcagactgggctgctgaggggcttagtgacctagcggtggcact

SEQ ID NO: 138506 - DNA, 75 bp, Artificial Sequence
  Synthetic
gagaagaaaatcataacttggggcgctgacaccgctgcatgcggtgacattctccagggcctgcctgtctcggcg

SEQ ID NO: 138507 - DNA, 75 bp, Artificial Sequence
  Synthetic
gagaagaaaatcataacttggggcgctgacaccgctgcttgcggtgacattctccagggcctgcctgtctcggcg

SEQ ID NO: 138508 - DNA, 75 bp, Artificial Sequence
  Synthetic
gagaagaaaatcataacttggggcgctgacaccgctgcctgcggtgacattctccagggcctgcctgtctcggcg

SEQ ID NO: 138509 - DNA, 75 bp, Artificial Sequence
  Synthetic
gagaagaaaatcataacttggggcgctgacaccgctgcgtgcggtgacattctccagggcctgcctgtctcggcg

SEQ ID NO: 138510 - DNA, 75 bp, Artificial Sequence
  Synthetic
gagaagaatatcataacttggggcgctgacaccgctgcatgcggtgacattctccagggcctgcctgtctcggcg

SEQ ID NO: 138511 - DNA, 75 bp, Artificial Sequence
  Synthetic
gagaagaatatcataacttggggcgctgacaccgctgcttgcggtgacattctccagggcctgcctgtctcggcg

SEQ ID NO: 138512 - DNA, 75 bp, Artificial Sequence
  Synthetic
gagaagaatatcataacttggggcgctgacaccgctgcctgcggtgacattctccagggcctgcctgtctcggcg

SEQ ID NO: 138513 - DNA, 75 bp, Artificial Sequence
  Synthetic
gagaagaatatcataacttggggcgctgacaccgctgcgtgcggtgacattctccagggcctgcctgtctcggcg

SEQ ID NO: 138514 - DNA, 75 bp, Artificial Sequence
  Synthetic
gagaagaacatcataacttggggcgctgacaccgctgcatgcggtgacattctccagggcctgcctgtctcggcg

SEQ ID NO: 138515 - DNA, 75 bp, Artificial Sequence
  Synthetic
gagaagaacatcataacttggggcgctgacaccgctgcttgcggtgacattctccagggcctgcctgtctcggcg

SEQ ID NO: 138516 - DNA, 75 bp, Artificial Sequence
  Synthetic
gagaagaacatcataacttggggcgctgacaccgctgcctgcggtgacattctccagggcctgcctgtctcggcg

SEQ ID NO: 138517 - DNA, 75 bp, Artificial Sequence
  Synthetic
gagaagaacatcataacttggggcgctgacaccgctgcgtgcggtgacattctccagggcctgcctgtctcggcg

SEQ ID NO: 138518 - DNA, 75 bp, Artificial Sequence
  Synthetic
gagaagaagatcataacttggggcgctgacaccgctgcatgcggtgacattctccagggcctgcctgtctcggcg

SEQ ID NO: 138519 - DNA, 75 bp, Artificial Sequence
  Synthetic
gagaagaagatcataacttggggcgctgacaccgctgcttgcggtgacattctccagggcctgcctgtctcggcg

SEQ ID NO: 138520 - DNA, 75 bp, Artificial Sequence
  Synthetic
gagaagaagatcataacttggggcgctgacaccgctgcctgcggtgacattctccagggcctgcctgtctcggcg

SEQ ID NO: 138521 - DNA, 75 bp, Artificial Sequence
  Synthetic
gagaagaagatcataacttggggcgctgacaccgctgcgtgcggtgacattctccagggcctgcctgtctcggcg

SEQ ID NO: 138522 - DNA, 75 bp, Artificial Sequence
  Synthetic
gaagttcgggtatagtgcgaaggatgttcgctccttgtccaacaaggccattaaccagatccgctccgtctggga

SEQ ID NO: 138523 - DNA, 75 bp, Artificial Sequence
  Synthetic
ggggtggaggctgcttgcccccatcactgcgtatgcgcagcagacccgagggatgctgggcaccataatcacaag

SEQ ID NO: 138524 - DNA, 75 bp, Artificial Sequence
  Synthetic
tacttttcctaggcccggcagatgacatgaaggacaaaggttggaaattgctggcccctataacagcttattgcc

SEQ ID NO: 138525 - DNA, 75 bp, Artificial Sequence
  Synthetic
catgaaggacaaaggttggaaattgctggcccctataacagcttattgccagcaaacacgtggtctgctgggcac

SEQ ID NO: 138526 - DNA, 75 bp, Artificial Sequence
  Synthetic
cctaggggacatgccgtgggcttgttcagagcggccgtgtgtgccaggggtgtggccaaatctattgacttcatc

SEQ ID NO: 138527 - DNA, 75 bp, Artificial Sequence
  Synthetic
cagcacgccaccagctgtaccccagacttaccaggtgggctacttgcacgcaccaacaggcagcgggaagagcac

SEQ ID NO: 138528 - DNA, 75 bp, Artificial Sequence
  Synthetic
gttgcgacttggaggacagggacagaagtcaactgtctcctttgttgcactccaccacggaatgggccattttgc

SEQ ID NO: 138529 - DNA, 75 bp, Artificial Sequence
  Synthetic
cccaggccgatctcaactcttaagggatcatccggtgggccactgttgtgccccctgggtcacgtcgcaggcatc

SEQ ID NO: 138530 - DNA, 75 bp, Artificial Sequence
  Synthetic
cccaggccgatctcaactcttaagggatcatccggtgggccactgttgtgccccctgggtcacgtcgctggcatc

SEQ ID NO: 138531 - DNA, 75 bp, Artificial Sequence
  Synthetic
cccaggccgatctcaactcttaagggatcatccggtgggccactgttgtgccccctgggtcacgtcgccggcatc

SEQ ID NO: 138532 - DNA, 75 bp, Artificial Sequence
  Synthetic
cccaggccgatctcaactcttaagggatcatccggtgggccactgttgtgccccctgggtcacgtcgcgggcatc

SEQ ID NO: 138533 - DNA, 75 bp, Artificial Sequence
  Synthetic
cccaggccgatctcaactcttaagggatcttccggtgggccactgttgtgccccctgggtcacgtcgcaggcatc

SEQ ID NO: 138534 - DNA, 75 bp, Artificial Sequence
  Synthetic
cccaggccgatctcaactcttaagggatcttccggtgggccactgttgtgccccctgggtcacgtcgctggcatc

SEQ ID NO: 138535 - DNA, 75 bp, Artificial Sequence
  Synthetic
cccaggccgatctcaactcttaagggatcttccggtgggccactgttgtgccccctgggtcacgtcgccggcatc

SEQ ID NO: 138536 - DNA, 75 bp, Artificial Sequence
  Synthetic
cccaggccgatctcaactcttaagggatcttccggtgggccactgttgtgccccctgggtcacgtcgcgggcatc

SEQ ID NO: 138537 - DNA, 75 bp, Artificial Sequence
  Synthetic
cccaggccgatctcaactcttaagggatcctccggtgggccactgttgtgccccctgggtcacgtcgcaggcatc

SEQ ID NO: 138538 - DNA, 75 bp, Artificial Sequence
  Synthetic
cccaggccgatctcaactcttaagggatcctccggtgggccactgttgtgccccctgggtcacgtcgctggcatc

SEQ ID NO: 138539 - DNA, 75 bp, Artificial Sequence
  Synthetic
cccaggccgatctcaactcttaagggatcctccggtgggccactgttgtgccccctgggtcacgtcgccggcatc

SEQ ID NO: 138540 - DNA, 75 bp, Artificial Sequence
  Synthetic
cccaggccgatctcaactcttaagggatcctccggtgggccactgttgtgccccctgggtcacgtcgcgggcatc

SEQ ID NO: 138541 - DNA, 75 bp, Artificial Sequence
  Synthetic
cccaggccgatctcaactcttaagggatcgtccggtgggccactgttgtgccccctgggtcacgtcgcaggcatc

SEQ ID NO: 138542 - DNA, 75 bp, Artificial Sequence
  Synthetic
cccaggccgatctcaactcttaagggatcgtccggtgggccactgttgtgccccctgggtcacgtcgctggcatc

SEQ ID NO: 138543 - DNA, 75 bp, Artificial Sequence
  Synthetic
cccaggccgatctcaactcttaagggatcgtccggtgggccactgttgtgccccctgggtcacgtcgccggcatc

SEQ ID NO: 138544 - DNA, 75 bp, Artificial Sequence
  Synthetic
cccaggccgatctcaactcttaagggatcgtccggtgggccactgttgtgccccctgggtcacgtcgcgggcatc

SEQ ID NO: 138545 - DNA, 75 bp, Artificial Sequence
  Synthetic
gccggttgaatctcttgagaccaccatgaggtcaccagtattctctgacaattccactcctcctgccgtgcccca

SEQ ID NO: 138546 - DNA, 75 bp, Artificial Sequence
  Synthetic
gccggttgaatctcttgagaccaccatgaggtcaccagttttctctgacaattccactcctcctgccgtgcccca

SEQ ID NO: 138547 - DNA, 75 bp, Artificial Sequence
  Synthetic
gccggttgaatctcttgagaccaccatgaggtcaccagtcttctctgacaattccactcctcctgccgtgcccca

SEQ ID NO: 138548 - DNA, 75 bp, Artificial Sequence
  Synthetic
gccggttgaatctcttgagaccaccatgaggtcaccagtgttctctgacaattccactcctcctgccgtgcccca

SEQ ID NO: 138549 - DNA, 75 bp, Artificial Sequence
  Synthetic
gccggttgaatctcttgagaccaccatgaggtctccagtattctctgacaattccactcctcctgccgtgcccca

SEQ ID NO: 138550 - DNA, 75 bp, Artificial Sequence
  Synthetic
gccggttgaatctcttgagaccaccatgaggtctccagttttctctgacaattccactcctcctgccgtgcccca

SEQ ID NO: 138551 - DNA, 75 bp, Artificial Sequence
  Synthetic
gccggttgaatctcttgagaccaccatgaggtctccagtcttctctgacaattccactcctcctgccgtgcccca

SEQ ID NO: 138552 - DNA, 75 bp, Artificial Sequence
  Synthetic
gccggttgaatctcttgagaccaccatgaggtctccagtgttctctgacaattccactcctcctgccgtgcccca

SEQ ID NO: 138553 - DNA, 75 bp, Artificial Sequence
  Synthetic
gccggttgaatctcttgagaccaccatgaggtccccagtattctctgacaattccactcctcctgccgtgcccca

SEQ ID NO: 138554 - DNA, 75 bp, Artificial Sequence
  Synthetic
gccggttgaatctcttgagaccaccatgaggtccccagttttctctgacaattccactcctcctgccgtgcccca

SEQ ID NO: 138555 - DNA, 75 bp, Artificial Sequence
  Synthetic
gccggttgaatctcttgagaccaccatgaggtccccagtcttctctgacaattccactcctcctgccgtgcccca

SEQ ID NO: 138556 - DNA, 75 bp, Artificial Sequence
  Synthetic
gccggttgaatctcttgagaccaccatgaggtccccagtgttctctgacaattccactcctcctgccgtgcccca

SEQ ID NO: 138557 - DNA, 75 bp, Artificial Sequence
  Synthetic
gccggttgaatctcttgagaccaccatgaggtcgccagtattctctgacaattccactcctcctgccgtgcccca

SEQ ID NO: 138558 - DNA, 75 bp, Artificial Sequence
  Synthetic
gccggttgaatctcttgagaccaccatgaggtcgccagttttctctgacaattccactcctcctgccgtgcccca

SEQ ID NO: 138559 - DNA, 75 bp, Artificial Sequence
  Synthetic
gccggttgaatctcttgagaccaccatgaggtcgccagtcttctctgacaattccactcctcctgccgtgcccca

SEQ ID NO: 138560 - DNA, 75 bp, Artificial Sequence
  Synthetic
gccggttgaatctcttgagaccaccatgaggtcgccagtgttctctgacaattccactcctcctgccgtgcccca

SEQ ID NO: 138561 - DNA, 75 bp, Artificial Sequence
  Synthetic
ccagactacaaccctcctgtgatcgagacatggaagaggccggactatgaaccacccactgtcctaggctgtgcc

SEQ ID NO: 138562 - DNA, 75 bp, Artificial Sequence
  Synthetic
accggtcatgtgcccatctggacacgctgtcgggctcttccgcgctgctgtgtgtacacggggtgtagccaaggc

SEQ ID NO: 138563 - DNA, 75 bp, Artificial Sequence
  Synthetic
gcgccaacgggaagtggcaagagcacaaaagtccctgccgcatatgcggctcaaggctacaaagtgctagtgcta

SEQ ID NO: 138564 - DNA, 75 bp, Artificial Sequence
  Synthetic
actagccgttgcctactttggtatggctggcaactggctaaaagttctggctgttctgttcttatttgcaggggt

SEQ ID NO: 138565 - DNA, 75 bp, Artificial Sequence
  Synthetic
tttgtcatctttttcgtggctgcttggcaaatcaagggtcgggcggtccccttagctgcctattcccttactggc

SEQ ID NO: 138566 - DNA, 75 bp, Artificial Sequence
  Synthetic
tttgtcatctttttcgtggctgcttggcatatcaagggtcgggcggtccccttagctgcctattcccttactggc

SEQ ID NO: 138567 - DNA, 75 bp, Artificial Sequence
  Synthetic
tttgtcatctttttcgtggctgcttggcacatcaagggtcgggcggtccccttagctgcctattcccttactggc

SEQ ID NO: 138568 - DNA, 75 bp, Artificial Sequence
  Synthetic
tttgtcatctttttcgtggctgcttggcagatcaagggtcgggcggtccccttagctgcctattcccttactggc

SEQ ID NO: 138569 - DNA, 75 bp, Artificial Sequence
  Synthetic
gtgggaaaagcacgaaagtgccagcttcctacgcagcccagggttacagcgtgttggtgttgaacccctctgtgg

SEQ ID NO: 138570 - DNA, 75 bp, Artificial Sequence
  Synthetic
accaatggcagctggcacataaacaggactgctttgaactgcaatgattccctccagacggggttcttagcgtca

SEQ ID NO: 138571 - DNA, 75 bp, Artificial Sequence
  Synthetic
cgcttcagaagcgggatcactgtcctccatgcctccccttgagggagagccgggggaccctgacctggagtttga

SEQ ID NO: 138572 - DNA, 75 bp, Artificial Sequence
  Synthetic
cttctcaataggcgccaagcagaacatccagctgattaacaccaacggcagttggcacatcaaccgcacggcctt

SEQ ID NO: 138573 - DNA, 75 bp, Artificial Sequence
  Synthetic
gtgttggtgttgaacccctctgtggctgctactctaggctttggcgcatacatgcgcactgcctatggtgtggag

SEQ ID NO: 138574 - DNA, 75 bp, Artificial Sequence
  Synthetic
aggaggtcgctttgccgacgacgggagagatacccttctatggcaaggcaatccccctatctttggtcaaggggg

SEQ ID NO: 138575 - DNA, 75 bp, Artificial Sequence
  Synthetic
gatggtttgggtgcacgtggatgaactctacgggctttaccaagacctgtggtgccccgccatgtcagatagtcc

SEQ ID NO: 138576 - DNA, 75 bp, Artificial Sequence
  Synthetic
cgagcttttgtgccccaccgactgcttccgtaaacatccggaagctacataccagcggtgtggatcgggaccctg

SEQ ID NO: 138577 - DNA, 75 bp, Artificial Sequence
  Synthetic
cacacccggtcaccaagtacatcatggcctgcatgtctgccgatcttgaggttgtgacaagcacgtgggtcatgg

SEQ ID NO: 138578 - DNA, 75 bp, Artificial Sequence
  Synthetic
cacacccggtcaccaagtacatcatggcctgcatgtctgccgatcttgaggttgtgactagcacgtgggtcatgg

SEQ ID NO: 138579 - DNA, 75 bp, Artificial Sequence
  Synthetic
cacacccggtcaccaagtacatcatggcctgcatgtctgccgatcttgaggttgtgaccagcacgtgggtcatgg

SEQ ID NO: 138580 - DNA, 75 bp, Artificial Sequence
  Synthetic
cacacccggtcaccaagtacatcatggcctgcatgtctgccgatcttgaggttgtgacgagcacgtgggtcatgg

SEQ ID NO: 138581 - DNA, 75 bp, Artificial Sequence
  Synthetic
cgcagcgatcgccgcttactgcctgacagtgggcagtgttgtcatctgcggcaggatcataacatcagggaaacc

SEQ ID NO: 138582 - DNA, 75 bp, Artificial Sequence
  Synthetic
acgaccttgtcgttatctgtgaaagcgcgggaacccaagaggatgcggcgagcctacgagtcttcacggaggcta

SEQ ID NO: 138583 - DNA, 75 bp, Artificial Sequence
  Synthetic
gccaacggaagcggccccgaccaacgcccctactgctggcactaccccccaaaaccttgtggtattgtgcccgca

SEQ ID NO: 138584 - DNA, 75 bp, Artificial Sequence
  Synthetic
cttggctgagggtcaacagattgctgagcagttcaagcagaagatcctgggcctgttgcagagcgctaccaagca

SEQ ID NO: 138585 - DNA, 75 bp, Artificial Sequence
  Synthetic
gcagtacagtttgctcaaagtgccttactttgtgcgcgcccacatactcctgcgtgcttgcctgcttgttcgtag

SEQ ID NO: 138586 - DNA, 75 bp, Artificial Sequence
  Synthetic
ccagtggatgaacagactgatcgcctttgcctccagaggaaaccatgttgcccctacccactacgtggcggagtc

SEQ ID NO: 138587 - DNA, 75 bp, Artificial Sequence
  Synthetic
accggctggatagcagggctcttctatcaccacaaattcaactcttcaggctgtcccgagaggatggccagctgc

SEQ ID NO: 138588 - DNA, 75 bp, Artificial Sequence
  Synthetic
ttctgccactcaaagaaaaagtgtgacgagctcgcggcggcccttcggggcatgggcttgaacgctgtggcatac

SEQ ID NO: 138589 - DNA, 75 bp, Artificial Sequence
  Synthetic
gcccatcacggcgtacgcccagcagacaaggggcctcctagggtgcataatcaccagcctgactggccgggacaa

SEQ ID NO: 138590 - DNA, 75 bp, Artificial Sequence
  Synthetic
gatcatgagcggcgagtgtccgactggggaggacatggtcaacatgctgccggccctcctgtcacctggggcttt

SEQ ID NO: 138591 - DNA, 75 bp, Artificial Sequence
  Synthetic
tcaagtcgtggacttcagcttggaccccacctttaccataaccacacagactgtcccccaggacgctgtctcacg

SEQ ID NO: 138592 - DNA, 75 bp, Artificial Sequence
  Synthetic
ggcaatcatgtgtcacctacccactacgtgcccgagactaacgcctcccaagcagtgactgctatacttagctct

SEQ ID NO: 138593 - DNA, 75 bp, Artificial Sequence
  Synthetic
tggctaagggacatctgggattgggtctgcacgatgttgtctgatttcaaaacttggctcaaagccaagcttgtg

SEQ ID NO: 138594 - DNA, 75 bp, Artificial Sequence
  Synthetic
gccaagaccatcttgagttttgggaggcggttttcaccggcctcacacacatagatgctcacttcctctcccaaa

SEQ ID NO: 138595 - DNA, 75 bp, Artificial Sequence
  Synthetic
cctctctcctaggcccataagcaccttgaaaggctcctcgggaggccccattatgtgtccctcggggcacgttgt

SEQ ID NO: 138596 - DNA, 75 bp, Artificial Sequence
  Synthetic
gcaggggtgacagccgtgctgccctcctctctcctaggcccataagcaccttgaaaggctcctcgggaggcccca

SEQ ID NO: 138597 - DNA, 75 bp, Artificial Sequence
  Synthetic
tatcgtgccaacgaggatttcggggggtctggcgaggggacggtgtcaacaacacaacatgtccgtgtggggcgg

SEQ ID NO: 138598 - DNA, 75 bp, Artificial Sequence
  Synthetic
tttgcgctgtggagggtatccgcggaggagtacgtggaggttcgcagagtaggggagttccattatatcaccggg

SEQ ID NO: 138599 - DNA, 75 bp, Artificial Sequence
  Synthetic
aggagtacgtggaggttcgcagagtaggggagttccattatatcaccggggtcacacaggataacatcaagtgcc

SEQ ID NO: 138600 - DNA, 75 bp, Artificial Sequence
  Synthetic
aagagcaccaaggtcccggctgcgtacgcagctcagggctataaggtgctggtgctcaacccctctgttgctgca

SEQ ID NO: 138601 - DNA, 75 bp, Artificial Sequence
  Synthetic
acgctagccagggctacaaggtgttggtcttgaacccatcggtggcggcaacgcttagcttcggctcttatatga

SEQ ID NO: 138602 - DNA, 75 bp, Artificial Sequence
  Synthetic
acggtcccagcccagaggcaggcgccagcctattccccaggtgcgccgtcaaacgggccgagcctggggacaacc

SEQ ID NO: 138603 - DNA, 75 bp, Artificial Sequence
  Synthetic
atcaccagagttcttcacggaggtggatggggtgaggttacatcggtatgcccccccctgccgaccactcatccg

SEQ ID NO: 138604 - DNA, 75 bp, Artificial Sequence
  Synthetic
gtcgttgcaccggacaaggaggtcctctatgaggcttttgatgagatggaggaatgtgcctctagagcggctctc

SEQ ID NO: 138605 - DNA, 75 bp, Artificial Sequence
  Synthetic
gtaggctgggaagggggtcaccgccctccttggccagctcctcggcgagccagctatctgccccatccttaaaag

SEQ ID NO: 138606 - DNA, 75 bp, Artificial Sequence
  Synthetic
ctttcgagctacgccctggggtcccaactcccatgcgagccggaaccagacactgtggtactcacagccatgctg

SEQ ID NO: 138607 - DNA, 75 bp, Artificial Sequence
  Synthetic
aaccttctctggggtacccacgctaccaggattgagtcagaggataaggtgctgatcttggactcttttgagccc

SEQ ID NO: 138608 - DNA, 75 bp, Artificial Sequence
  Synthetic
aaccttctctggggtacccacgctaccaggtttgagtcagaggataaggtgctgatcttggactcttttgagccc

SEQ ID NO: 138609 - DNA, 75 bp, Artificial Sequence
  Synthetic
aaccttctctggggtacccacgctaccaggcttgagtcagaggataaggtgctgatcttggactcttttgagccc

SEQ ID NO: 138610 - DNA, 75 bp, Artificial Sequence
  Synthetic
aaccttctctggggtacccacgctaccagggttgagtcagaggataaggtgctgatcttggactcttttgagccc

SEQ ID NO: 138611 - DNA, 75 bp, Artificial Sequence
  Synthetic
ccaggattgagtcagaggataaggtgctgatcttggactcttttgagccccttgtggccgagacggatgacaggg

SEQ ID NO: 138612 - DNA, 75 bp, Artificial Sequence
  Synthetic
ccaggtttgagtcagaggataaggtgctgatcttggactcttttgagccccttgtggccgagacggatgacaggg

SEQ ID NO: 138613 - DNA, 75 bp, Artificial Sequence
  Synthetic
ccaggcttgagtcagaggataaggtgctgatcttggactcttttgagccccttgtggccgagacggatgacaggg

SEQ ID NO: 138614 - DNA, 75 bp, Artificial Sequence
  Synthetic
ccagggttgagtcagaggataaggtgctgatcttggactcttttgagccccttgtggccgagacggatgacaggg

SEQ ID NO: 138615 - DNA, 75 bp, Artificial Sequence
  Synthetic
ctacgggagaaataccattttatggaaaggccatcccccttgagtacatcaaagggggaagacatctcatattct

SEQ ID NO: 138616 - DNA, 75 bp, Artificial Sequence
  Synthetic
cgtcagggctgtcgaggacggggttaactacgcaacagggaaccttcctggttgctccttttctatcttcctctt

SEQ ID NO: 138617 - DNA, 75 bp, Artificial Sequence
  Synthetic
tctaagtcgtggtccacagtctctgatcaagaggattctgtcatctgctgctccatgtcatactcctggacaggg

SEQ ID NO: 138618 - DNA, 75 bp, Artificial Sequence
  Synthetic
gggcgaaggtcttggtagtgctgctgctattcgccggcgttgacgcggaaaccaccgtctccggaggatctgccg

SEQ ID NO: 138619 - DNA, 75 bp, Artificial Sequence
  Synthetic
cttataacccaccactcattgagacgtggaaacaaccggaatacgaaccaccagttgttcatggctgcgcactgc

SEQ ID NO: 138620 - DNA, 75 bp, Artificial Sequence
  Synthetic
cttataacccaccactcattgagacgtggaaacaaccggattacgaaccaccagttgttcatggctgcgcactgc

SEQ ID NO: 138621 - DNA, 75 bp, Artificial Sequence
  Synthetic
cttataacccaccactcattgagacgtggaaacaaccggactacgaaccaccagttgttcatggctgcgcactgc

SEQ ID NO: 138622 - DNA, 75 bp, Artificial Sequence
  Synthetic
cttataacccaccactcattgagacgtggaaacaaccggagtacgaaccaccagttgttcatggctgcgcactgc

SEQ ID NO: 138623 - DNA, 75 bp, Artificial Sequence
  Synthetic
cttataacccacctctcattgagacgtggaaacaaccggaatacgaaccaccagttgttcatggctgcgcactgc

SEQ ID NO: 138624 - DNA, 75 bp, Artificial Sequence
  Synthetic
cttataacccacctctcattgagacgtggaaacaaccggattacgaaccaccagttgttcatggctgcgcactgc

SEQ ID NO: 138625 - DNA, 75 bp, Artificial Sequence
  Synthetic
cttataacccacctctcattgagacgtggaaacaaccggactacgaaccaccagttgttcatggctgcgcactgc

SEQ ID NO: 138626 - DNA, 75 bp, Artificial Sequence
  Synthetic
cttataacccacctctcattgagacgtggaaacaaccggagtacgaaccaccagttgttcatggctgcgcactgc

SEQ ID NO: 138627 - DNA, 75 bp, Artificial Sequence
  Synthetic
cttataacccacccctcattgagacgtggaaacaaccggaatacgaaccaccagttgttcatggctgcgcactgc

SEQ ID NO: 138628 - DNA, 75 bp, Artificial Sequence
  Synthetic
cttataacccacccctcattgagacgtggaaacaaccggattacgaaccaccagttgttcatggctgcgcactgc

SEQ ID NO: 138629 - DNA, 75 bp, Artificial Sequence
  Synthetic
cttataacccacccctcattgagacgtggaaacaaccggactacgaaccaccagttgttcatggctgcgcactgc

SEQ ID NO: 138630 - DNA, 75 bp, Artificial Sequence
  Synthetic
cttataacccacccctcattgagacgtggaaacaaccggagtacgaaccaccagttgttcatggctgcgcactgc

SEQ ID NO: 138631 - DNA, 75 bp, Artificial Sequence
  Synthetic
cttataacccaccgctcattgagacgtggaaacaaccggaatacgaaccaccagttgttcatggctgcgcactgc

SEQ ID NO: 138632 - DNA, 75 bp, Artificial Sequence
  Synthetic
cttataacccaccgctcattgagacgtggaaacaaccggattacgaaccaccagttgttcatggctgcgcactgc

SEQ ID NO: 138633 - DNA, 75 bp, Artificial Sequence
  Synthetic
cttataacccaccgctcattgagacgtggaaacaaccggactacgaaccaccagttgttcatggctgcgcactgc

SEQ ID NO: 138634 - DNA, 75 bp, Artificial Sequence
  Synthetic
cttataacccaccgctcattgagacgtggaaacaaccggagtacgaaccaccagttgttcatggctgcgcactgc

SEQ ID NO: 138635 - DNA, 75 bp, Artificial Sequence
  Synthetic
ccaccggcttcgtcgtcagtggcctggtgggggctgccgtaggcagcataggcctgggtaaggtgctggtggaca

SEQ ID NO: 138636 - DNA, 75 bp, Artificial Sequence
  Synthetic
caccacatcatgcacctcccaggctgtgtgccctgtgtgatgaccgggaacaagtcgcgctgctgggtagctcta

SEQ ID NO: 138637 - DNA, 75 bp, Artificial Sequence
  Synthetic
gtttatgaggcggagggaattatcttgcacttgcctggttgcgtcccttgcacaaaggacaatggctcggccacc

SEQ ID NO: 138638 - DNA, 75 bp, Artificial Sequence
  Synthetic
ccctacttcgtgcgcgttcaaggccttctccggatctgtgcgctagcgcggaagatggctggaggccattacgtg

SEQ ID NO: 138639 - DNA, 75 bp, Artificial Sequence
  Synthetic
gcacgttggcccgggcgagggagcagtgcagtggatgaaccggctgatagccttcgcctcccgggggaaccatgt

SEQ ID NO: 138640 - DNA, 75 bp, Artificial Sequence
  Synthetic
gggggtgggtggctgcccagctcgcagcccccggtgccgctaccgcctttgtgggcgctggtttagctggcgccg

SEQ ID NO: 138641 - DNA, 75 bp, Artificial Sequence
  Synthetic
actaccacaaattcaactcttcaggctgtcccgagagaatggccagctgtcgacctcttaccgattttgcccagg

SEQ ID NO: 138642 - DNA, 75 bp, Artificial Sequence
  Synthetic
acatcggagacctctgcggaggtgtcttcctaatgggccagatgttcaccttccagccgcggcgccattggacca

SEQ ID NO: 138643 - DNA, 75 bp, Artificial Sequence
  Synthetic
tctgttcagccatgtacatcggggacctatgcgggggcgtctttttggccgcccagcttatcaccttcagacccc

SEQ ID NO: 138644 - DNA, 75 bp, Artificial Sequence
  Synthetic
gacgacggatcttactcgtcaatgcctccacttgaaagggagcctggtgacccagacttgacatcagactcttgg

SEQ ID NO: 138645 - DNA, 75 bp, Artificial Sequence
  Synthetic
gacgacggatcttactcgtcaatgcctccacttgaaagggagcctggtgaccctgacttgacatcagactcttgg

SEQ ID NO: 138646 - DNA, 75 bp, Artificial Sequence
  Synthetic
gacgacggatcttactcgtcaatgcctccacttgaaagggagcctggtgaccccgacttgacatcagactcttgg

SEQ ID NO: 138647 - DNA, 75 bp, Artificial Sequence
  Synthetic
gacgacggatcttactcgtcaatgcctccacttgaaagggagcctggtgacccggacttgacatcagactcttgg

SEQ ID NO: 138648 - DNA, 75 bp, Artificial Sequence
  Synthetic
gacgacggttcttactcgtcaatgcctccacttgaaagggagcctggtgacccagacttgacatcagactcttgg

SEQ ID NO: 138649 - DNA, 75 bp, Artificial Sequence
  Synthetic
gacgacggttcttactcgtcaatgcctccacttgaaagggagcctggtgaccctgacttgacatcagactcttgg

SEQ ID NO: 138650 - DNA, 75 bp, Artificial Sequence
  Synthetic
gacgacggttcttactcgtcaatgcctccacttgaaagggagcctggtgaccccgacttgacatcagactcttgg

SEQ ID NO: 138651 - DNA, 75 bp, Artificial Sequence
  Synthetic
gacgacggttcttactcgtcaatgcctccacttgaaagggagcctggtgacccggacttgacatcagactcttgg

SEQ ID NO: 138652 - DNA, 75 bp, Artificial Sequence
  Synthetic
gacgacggctcttactcgtcaatgcctccacttgaaagggagcctggtgacccagacttgacatcagactcttgg

SEQ ID NO: 138653 - DNA, 75 bp, Artificial Sequence
  Synthetic
gacgacggctcttactcgtcaatgcctccacttgaaagggagcctggtgaccctgacttgacatcagactcttgg

SEQ ID NO: 138654 - DNA, 75 bp, Artificial Sequence
  Synthetic
gacgacggctcttactcgtcaatgcctccacttgaaagggagcctggtgaccccgacttgacatcagactcttgg

SEQ ID NO: 138655 - DNA, 75 bp, Artificial Sequence
  Synthetic
gacgacggctcttactcgtcaatgcctccacttgaaagggagcctggtgacccggacttgacatcagactcttgg

SEQ ID NO: 138656 - DNA, 75 bp, Artificial Sequence
  Synthetic
gacgacgggtcttactcgtcaatgcctccacttgaaagggagcctggtgacccagacttgacatcagactcttgg

SEQ ID NO: 138657 - DNA, 75 bp, Artificial Sequence
  Synthetic
gacgacgggtcttactcgtcaatgcctccacttgaaagggagcctggtgaccctgacttgacatcagactcttgg

SEQ ID NO: 138658 - DNA, 75 bp, Artificial Sequence
  Synthetic
gacgacgggtcttactcgtcaatgcctccacttgaaagggagcctggtgaccccgacttgacatcagactcttgg

SEQ ID NO: 138659 - DNA, 75 bp, Artificial Sequence
  Synthetic
gacgacgggtcttactcgtcaatgcctccacttgaaagggagcctggtgacccggacttgacatcagactcttgg

SEQ ID NO: 138660 - DNA, 75 bp, Artificial Sequence
  Synthetic
ccccccagggaggttgccgccagtgccgccgccgaggcggaaaaggcttgtgaagctcgacgactcagcggcggc

SEQ ID NO: 138661 - DNA, 75 bp, Artificial Sequence
  Synthetic
ctcccaaggggagaggccttcgggtatgttcgacaccgtcgtcctgtgtgaggcttatgacacgggatgcgcatg

SEQ ID NO: 138662 - DNA, 75 bp, Artificial Sequence
  Synthetic
aggcttatgacacgggatgcgcatggtacgagctaaccccttctgaaacaactgtcaggttgagggcctatatga

SEQ ID NO: 138663 - DNA, 75 bp, Artificial Sequence
  Synthetic
cctgaccctagtcacctccagtatgttgaggataccgcagatagtcttcgacgtcttcgctgggggtcactgggg

SEQ ID NO: 138664 - DNA, 75 bp, Artificial Sequence
  Synthetic
tgcccagctcatgagggttccggaggtcctcgttgacatgttcaccgggggccactggggcgtcttggcagggtt

SEQ ID NO: 138665 - DNA, 75 bp, Artificial Sequence
  Synthetic
ccgccgccgaggcggaaaaggcttgtgaagctcgacgactcagcggcggcagcagcacttgctgagctggcccgc

SEQ ID NO: 138666 - DNA, 75 bp, Artificial Sequence
  Synthetic
gcaggcgggtgagaacttcgcgtacctcgtggcataccaggctacagtgtgcgccagggccaaagcccccccgcc

SEQ ID NO: 138667 - DNA, 75 bp, Artificial Sequence
  Synthetic
aaggcaataatggggccatcctatgggttccaatactctcctgcagaacgggtcgattttctcctcaaagcttgg

SEQ ID NO: 138668 - DNA, 75 bp, Artificial Sequence
  Synthetic
aggcacgagcctccacagtgaaggcgcggttactcacggttgaggaagcctgcagcctgacgcccccccactcgg

SEQ ID NO: 138669 - DNA, 75 bp, Artificial Sequence
  Synthetic
ggccagcaggcgtctgggcttaccgggctcttcagtccaggggctaagcagaacatccagctcgttaataccaac

SEQ ID NO: 138670 - DNA, 75 bp, Artificial Sequence
  Synthetic
ggcgcaactgccggccagcaaagttatagcctcacacggctgttcaccgcgggccctagccagaaattgcagctc

SEQ ID NO: 138671 - DNA, 75 bp, Artificial Sequence
  Synthetic
tgggggacttccactacgtgacgggcatgactgctgacaatcttaagtgcccgtgccaggtcccatcgcccgaat

SEQ ID NO: 138672 - DNA, 75 bp, Artificial Sequence
  Synthetic
gtgacatttgaccgagtccagattctcgatcaacactaccaagatgtactcaaggagattaaggtccgagcctcc

SEQ ID NO: 138673 - DNA, 75 bp, Artificial Sequence
  Synthetic
tcaattccacgggatgtcccgaacggttagcggcgtgtaaggaccttagacggttcccccaggggtggggcccta

SEQ ID NO: 138674 - DNA, 75 bp, Artificial Sequence
  Synthetic
ggtgcccagagcggcttgcttcatgcaagcggttggaagacttcggccagggttggggccggcccggggtagcca

SEQ ID NO: 138675 - DNA, 75 bp, Artificial Sequence
  Synthetic
gacctgggggtgcgggtgtgcgagaagagggccttatatgacgccgtcaaacaactttctctggccgtgatggga

SEQ ID NO: 138676 - DNA, 75 bp, Artificial Sequence
  Synthetic
gttttcactaccagcatggggaatactatgacgtgctacatcaaagcccttgcagcatgcaaagctgcagggatc

SEQ ID NO: 138677 - DNA, 75 bp, Artificial Sequence
  Synthetic
acctgtgtattgcttcacccccagtcctgtggtcctgggcaccacagacaagttgggagcccccacttacaactt

SEQ ID NO: 138678 - DNA, 75 bp, Artificial Sequence
  Synthetic
cttcacgcccagccctgtggtcgttggcacaaccaatcggctcggcgtacccacatacaactggggagagaatga

SEQ ID NO: 138679 - DNA, 75 bp, Artificial Sequence
  Synthetic
ctgagggccagcagatcgccgaacagttcagacaaaaggtgttgggactcctccaagcgagcgctaagcaggcag

SEQ ID NO: 138680 - DNA, 75 bp, Artificial Sequence
  Synthetic
cccctgacgccgagctcatagaggctaacctcctgtggaggcaggagatgggcggtaacatcaccagggttgagt

SEQ ID NO: 138681 - DNA, 75 bp, Artificial Sequence
  Synthetic
tggaggaagcacatgtggaactttgtcagcgggattcagtacttggcgggcttatccactctgcccggcaaccca

SEQ ID NO: 138682 - DNA, 75 bp, Artificial Sequence
  Synthetic
acctgtggtgctcctccgtgtgagacccgaccagatggcaacaacacgctgaaatgccccaccgactgctttagg

SEQ ID NO: 138683 - DNA, 75 bp, Artificial Sequence
  Synthetic
ccaccatgcttggtgaacacggcgaacgaaagttggccatgtcctactgactgcttcaggaaacacccggagact

SEQ ID NO: 138684 - DNA, 75 bp, Artificial Sequence
  Synthetic
cttatccactctgcccggcaacccagctgtggcatcattgatgtcatttacagcgtcgctgaccagtcctctgag

SEQ ID NO: 138685 - DNA, 75 bp, Artificial Sequence
  Synthetic
tttgggaacacactgacgtgctatcttaaggccaacgcagccatcagggctgcaggcctaaaagactgcaccatg

SEQ ID NO: 138686 - DNA, 75 bp, Artificial Sequence
  Synthetic
tttgggaacacactgacgtgctatcttaaggccatcgcagccatcagggctgcaggcctaaaagactgcaccatg

SEQ ID NO: 138687 - DNA, 75 bp, Artificial Sequence
  Synthetic
tttgggaacacactgacgtgctatcttaaggccaccgcagccatcagggctgcaggcctaaaagactgcaccatg

SEQ ID NO: 138688 - DNA, 75 bp, Artificial Sequence
  Synthetic
tttgggaacacactgacgtgctatcttaaggccagcgcagccatcagggctgcaggcctaaaagactgcaccatg

SEQ ID NO: 138689 - DNA, 75 bp, Artificial Sequence
  Synthetic
ccatcaatttcactctgcataaggtccgcatgtacatcggcggggtggaacacaggttcgaagctgcctgcaact

SEQ ID NO: 138690 - DNA, 75 bp, Artificial Sequence
  Synthetic
tcttcaaggtcaggacatatgtcggcggggttgagcaccgccttgaggcggcatgcaattggaccaggggagagc

SEQ ID NO: 138691 - DNA, 75 bp, Artificial Sequence
  Synthetic
cgcgcccatgcctgcactttctaccggactcatccatctccaccagaatgtggtcgacgtgcagtacctttatgg

SEQ ID NO: 138692 - DNA, 75 bp, Artificial Sequence
  Synthetic
tctttcgaccggcttgatccacctccaccagaacatcgtggatgtgcaatacctatatggcattgggtccaccgt

SEQ ID NO: 138693 - DNA, 75 bp, Artificial Sequence
  Synthetic
ggtgctaaccagtggatgaacaggctaatagcctttgcatcaagaggcaaccacgtgtccccgacgcactacgtg

SEQ ID NO: 138694 - DNA, 75 bp, Artificial Sequence
  Synthetic
atgctgcttgtgagccaagttgaggccgcgctagagaacctggtgcgtctcaacgcggccgcagctgccgctgcc

SEQ ID NO: 138695 - DNA, 75 bp, Artificial Sequence
  Synthetic
caggttgaggctgctatggccaacttgatcaccatcaatgccatgtcggccgccagcactcacggtttcttctat

SEQ ID NO: 138696 - DNA, 75 bp, Artificial Sequence
  Synthetic
agttggctctttcggagacaggttctatctcctccatgccccccctcgagggggagcctggggacccagacctgg

SEQ ID NO: 138697 - DNA, 75 bp, Artificial Sequence
  Synthetic
aagcggacggtggtcctcaccgaatcagtcgtgtctactgccttggccgagcttgccaccaagagctttggcagc

SEQ ID NO: 138698 - DNA, 75 bp, Artificial Sequence
  Synthetic
tcttgctgctattgctggcgttgcccccccgggcgttcgcctacgatggcacgcaagccgcgtcaatcggctgtg

SEQ ID NO: 138699 - DNA, 75 bp, Artificial Sequence
  Synthetic
tcgccttgccccagagagcgtacgcgttcgacggggagacggctgggtctctgggttgctgtgtcatagtcttag

SEQ ID NO: 138700 - DNA, 75 bp, Artificial Sequence
  Synthetic
ggctacgctacaggtatgggtcccctctcttcaggttcggggcggccgagatgcggttattctctttacatgctt

SEQ ID NO: 138701 - DNA, 75 bp, Artificial Sequence
  Synthetic
ctatataccacctctagaggtcaggggcggccgagacgcggtgattgtccttgcagccttgttccacccccaact

SEQ ID NO: 138702 - DNA, 75 bp, Artificial Sequence
  Synthetic
aagtgcccttgtcaggtgcctgcgcctgaattcttcactgaggtcgatggcgtgaggatacaccgttacgcgcca

SEQ ID NO: 138703 - DNA, 75 bp, Artificial Sequence
  Synthetic
ctgaattcttcactgaggtcgatggcgtgaggatacaccgttacgcgccaccttgcaagcccttgctcagggacg

SEQ ID NO: 138704 - DNA, 75 bp, Artificial Sequence
  Synthetic
gtgcgcgctcatgtgctcctgcgcacttgcctgctagtccggcgcttagcgggggggaggtacgtccaagcagca

SEQ ID NO: 138705 - DNA, 75 bp, Artificial Sequence
  Synthetic
ctaatcaagatctgtggacttgtgcgtggggcgttgtatggtaagtatgtccaaatggttctgctcaggcttgcc

SEQ ID NO: 138706 - DNA, 75 bp, Artificial Sequence
  Synthetic
ttgagcccgtggtattctcacccatggagaagagagtcatcacttggggcgctgataccgctgcctgcggcgaca

SEQ ID NO: 138707 - DNA, 75 bp, Artificial Sequence
  Synthetic
tcactccgatggagaagagggtgataacatggggggccgacgcggctgcgtgcggtgatatcctcaagggcctgc

SEQ ID NO: 138708 - DNA, 75 bp, Artificial Sequence
  Synthetic
aaaaacacccggaaatggaactcctccaagccaacctcctctggaagcacgaaatgggaagccacatccctcgag

SEQ ID NO: 138709 - DNA, 75 bp, Artificial Sequence
  Synthetic
gatactactcggtccggccgacactgaggttcaagggggatggaggctcctcgccccaatcaccgcttacgctca

SEQ ID NO: 138710 - DNA, 75 bp, Artificial Sequence
  Synthetic
tacagcgtacgctcagcagacgcggggattgctaggcaccattgtgaccagcctcacgggccgggacaaaaatga

SEQ ID NO: 138711 - DNA, 75 bp, Artificial Sequence
  Synthetic
acttgactcctttgagctctacccgcttgagtatgaggagagggaaatttcagtatcagttgagtgccacaggca

SEQ ID NO: 138712 - DNA, 75 bp, Artificial Sequence
  Synthetic
accttccttggcactgggataaatggcgtcatgtggactgtgtaccatggagccggcagtaagaccctctgcggc

SEQ ID NO: 138713 - DNA, 75 bp, Artificial Sequence
  Synthetic
aagaccttggcgggtccgaagggccccgtctgtcaaatgtacaccaatgtagaccaggatatggtcggttggccg

SEQ ID NO: 138714 - DNA, 75 bp, Artificial Sequence
  Synthetic
gtgcttcagacttgtacctcgtcactcggcgcgcagacgtgatccccgtgcgccggaggggggacactcggggcg

SEQ ID NO: 138715 - DNA, 75 bp, Artificial Sequence
  Synthetic
gcgacagccgtgctggactcatcagcccacgaccgttgtccatactgaaagggtcctccgggggaccactcctgt

SEQ ID NO: 138716 - DNA, 75 bp, Artificial Sequence
  Synthetic
tatggcatgggacatgatgctaaactggtcaccaactcttaccatgatcctcgcctatgctgctcgtgttcctga

SEQ ID NO: 138717 - DNA, 75 bp, Artificial Sequence
  Synthetic
gtgcacgcggggcgtggcaaaatcagtggactttgtgccggtcgagtcccttgaaactaccatgaggtcccccac

SEQ ID NO: 138718 - DNA, 75 bp, Artificial Sequence
  Synthetic
cgcgaggtccccctccttcaccgacaattccacgccaccggccgtgccccagacttatcaggtgggctacctaca

SEQ ID NO: 138719 - DNA, 75 bp, Artificial Sequence
  Synthetic
tattctaccacatcacgcagcgccagcctccgccagaagaaggtcacatttgacagagtgcaagtgttcgaccaa

SEQ ID NO: 138720 - DNA, 75 bp, Artificial Sequence
  Synthetic
gcatacgctgcgcagggctacaaagtgcttgtgctcaacccctccgttgctgcaacgttgggcttcggaagctat

SEQ ID NO: 138721 - DNA, 75 bp, Artificial Sequence
  Synthetic
tctttcggtgcttacatgtccaaagcctacggcattgaccccaatattagaactggggtcaggaccatcaccacc

SEQ ID NO: 138722 - DNA, 75 bp, Artificial Sequence
  Synthetic
ccgatgggggctgtagtgggggggcctatgacatcatcatttgtgacgagtgccactctaccgatgctacatcag

SEQ ID NO: 138723 - DNA, 75 bp, Artificial Sequence
  Synthetic
cggaccccacaacggtcctgggaataggaactgccctggatcaggccgagaccgctggttgccgtctccttgtcc

SEQ ID NO: 138724 - DNA, 75 bp, Artificial Sequence
  Synthetic
tcccaatatcgaggaggtcgccctgccgacaacaggtgaaattcctttctacggtaaggcgatccctctggcaac

SEQ ID NO: 138725 - DNA, 75 bp, Artificial Sequence
  Synthetic
tatccccctcgagtacatcaaagggggaaggcatctcatattttgccattccaagaagaaatgcgacgagcttgc

SEQ ID NO: 138726 - DNA, 75 bp, Artificial Sequence
  Synthetic
gtgtggcccggtatattgcttcactcccagccccgtggtggtgggaacgaccgacaggtcgggcgcgccaaccta

SEQ ID NO: 138727 - DNA, 75 bp, Artificial Sequence
  Synthetic
ggtccggcatacggattccagtactcccctaaccagagggttgagtacttgctcaaaatgtggcggtcaaagaag

SEQ ID NO: 138728 - DNA, 75 bp, Artificial Sequence
  Synthetic
gctcaaaatgtggcggtcaaagaaggtgcccatgggcttttcttacgacaccagatgttttgattcaaccgtcac

SEQ ID NO: 138729 - DNA, 75 bp, Artificial Sequence
  Synthetic
tacaggggtttagacgtctcggtgattccaacgtctggggacgtcgtggtttgcgccacggacgccctcatgact

SEQ ID NO: 138730 - DNA, 75 bp, Artificial Sequence
  Synthetic
gacgcccttatgacgggatacaccggcgacttcgacagtgtcattgattgcaatgttgcagtcacacaagccgtc

SEQ ID NO: 138731 - DNA, 75 bp, Artificial Sequence
  Synthetic
ggtttcactggcgactttgactccgtgatagactgcaacacatccgtcatacagactgtggactttagccttgac

SEQ ID NO: 138732 - DNA, 75 bp, Artificial Sequence
  Synthetic
agcatgggaaacaccctcacatgctatctgaaggcacaggccgcctgcagggcggccaacatcaaggactgtgac

SEQ ID NO: 138733 - DNA, 75 bp, Artificial Sequence
  Synthetic
cgggagtgtacaggtatgttgcgcagggcgagcgaccgtccggtatgttcgacaccgctgtcctctgcgaggcgt

SEQ ID NO: 138734 - DNA, 75 bp, Artificial Sequence
  Synthetic
caaagtcaggatgtacgtgggaggggtcgagcacaggctggaagctgcctgcaactggacgcggggcgaacgttg

SEQ ID NO: 138735 - DNA, 75 bp, Artificial Sequence
  Synthetic
gcccatcaacgcactgagcaactcgttgctacgtcatcacaatctggtgtattccaccacctcacgcagtgcttg

SEQ ID NO: 138736 - DNA, 75 bp, Artificial Sequence
  Synthetic
tttggagttctgggaggcagtctttaccggactgacacacatagatgcccacttcttgtcccaaacgaaacaggg

SEQ ID NO: 138737 - DNA, 75 bp, Artificial Sequence
  Synthetic
accaagtacgcaactcctcgggcctttaccatgtcaccaatgattgccctaactcgagtattgtgtacgagacgg

SEQ ID NO: 138738 - DNA, 75 bp, Artificial Sequence
  Synthetic
aagcgtctttacgggcttgactcatatagatgctcacttcttgtcccagacgaagcagtcaggtgagaatttgcc

SEQ ID NO: 138739 - DNA, 75 bp, Artificial Sequence
  Synthetic
gcaacctacgtatgacctcgagctcataacatcgtgctcgtccaatgtttccgtcgcccacgaaggcaatgggaa

SEQ ID NO: 138740 - DNA, 75 bp, Artificial Sequence
  Synthetic
cctgggagacagcccgccacactccagtcaattcctggttgggcaacatcattatgtttgcccccacgatatggg

SEQ ID NO: 138741 - DNA, 75 bp, Artificial Sequence
  Synthetic
aggctaaaaccaaccttgcacgggcccaccccgttgctatataggcttggaggagttcaaaatgaagtagtgaca

SEQ ID NO: 138742 - DNA, 75 bp, Artificial Sequence
  Synthetic
ctccacgggcccactcccctactatatcggttagggggtgtgcaaaatgaggtgacactaacccaccccgtcact

SEQ ID NO: 138743 - DNA, 75 bp, Artificial Sequence
  Synthetic
gtggtccatggctgcccgcttccgcctccacagtcccctcctgtgcctccacctcggaagaagcggacggtggtc

SEQ ID NO: 138744 - DNA, 75 bp, Artificial Sequence
  Synthetic
actcggaccagaggccctattgctggcactacgcgcctcgaccgtgtggtatcgtacccgcgtcgcaggtgtgtg

SEQ ID NO: 138745 - DNA, 75 bp, Artificial Sequence
  Synthetic
atcgtacccgcgtcgcaggtgtgtggtccagtgtattgcttcaccccaagccctgttgtagtggggacgaccgat

SEQ ID NO: 138746 - DNA, 75 bp, Artificial Sequence
  Synthetic
ttctccacttgatctcccagcaatcattcaacgactccatggtatggcagcattttcactccacggatactctcc

SEQ ID NO: 138747 - DNA, 75 bp, Artificial Sequence
  Synthetic
ccgcgtactgtctcacaacaggtagcgccgtcatttgcgggcgaatcaccaccagtagccggcccgcggtcgtgc

SEQ ID NO: 138748 - DNA, 75 bp, Artificial Sequence
  Synthetic
cagtgggcggcgtggtgatcaccggaagggtccttctgtcgggacaacccgccatcattcccgatcgagacgtgc

SEQ ID NO: 138749 - DNA, 75 bp, Artificial Sequence
  Synthetic
cagagctgtcagagccaaactcattgcccaaggggggaaagcggctatatgcggtaagtacctctttaactgggc

SEQ ID NO: 138750 - DNA, 75 bp, Artificial Sequence
  Synthetic
gcagaaagcgcttggtctactccagtctacggcgaagcaggcggaggagcttaagccggcagtccattcggcctg

SEQ ID NO: 138751 - DNA, 75 bp, Artificial Sequence
  Synthetic
cattctgcagtccgccggccgccaggctcaggaagcagcaccagtggttcaatccaactttgccaagctcgagca

SEQ ID NO: 138752 - DNA, 75 bp, Artificial Sequence
  Synthetic
ctacgacgggggggacatttatcacagcgtgtcccaggcccgaccccgtttcttactccttggcctactcctact

SEQ ID NO: 138753 - DNA, 75 bp, Artificial Sequence
  Synthetic
gcctcgatgatgtcttttactgcctccctcaccagtcctctgaccacatcacaaacgctcctgcttaatgtgttg

SEQ ID NO: 138754 - DNA, 75 bp, Artificial Sequence
  Synthetic
ttcactgccgccgtcaccagtcctctaaccacccagcaaaccctccttttcaacatattaggggggtgggtcgcc

SEQ ID NO: 138755 - DNA, 75 bp, Artificial Sequence
  Synthetic
gtgagtacaccggaattgccaggacgaccgggtcctttcttggataaacccgctcaatgcctggagatttgggcg

SEQ ID NO: 138756 - DNA, 75 bp, Artificial Sequence
  Synthetic
ccttgcggtatcgtgtccgcaaagaccgtgtgtggcccggtatattgctttacacccagccctgtggcggtgggg

SEQ ID NO: 138757 - DNA, 75 bp, Artificial Sequence
  Synthetic
gggtaatcgttgatatcctcgccggctatggggccggcgtagcaggagccctcgtggcctttaagatcatgagtg

SEQ ID NO: 138758 - DNA, 75 bp, Artificial Sequence
  Synthetic
tcctcgctggctacggagccggcgtggctggcgctgtcgtcaccttcaagatcatgagtggcgaggtaccatcat

SEQ ID NO: 138759 - DNA, 75 bp, Artificial Sequence
  Synthetic
gcacgtaggccctagtgagggggccgcccagtggatgaaccgcctgatagccttcgcctctcgcggtaaccacgt

SEQ ID NO: 138760 - DNA, 75 bp, Artificial Sequence
  Synthetic
cgagggggctgtccagtggatgaaccgcctcatcgcctttgcgtcgcggggcaaccacgtttcccccacgcacta

SEQ ID NO: 138761 - DNA, 75 bp, Artificial Sequence
  Synthetic
tggatcacggaggatcacacttcattgtgtgcaacatcatggcttagagatatctgggattgggtatgcactgtc

SEQ ID NO: 138762 - DNA, 75 bp, Artificial Sequence
  Synthetic
tgctccactccgtgtgactcctcatggctaagggaggtttgggactgggtttgctctgtgctgtctgacttcaaa

SEQ ID NO: 138763 - DNA, 75 bp, Artificial Sequence
  Synthetic
gaccgacggggtgcactactctcgccaaggcctctctcaaccctcaaaggatcatccggcggacccgtgctctgt

SEQ ID NO: 138764 - DNA, 75 bp, Artificial Sequence
  Synthetic
ggaggggtcgagcacaggctggaagctgcttgcaactggacgcggggcgagcgttgtgatctggacgacagggac

SEQ ID NO: 138765 - DNA, 75 bp, Artificial Sequence
  Synthetic
gcgatgggatctgccataccacctgcccttgtggcgccatcataacggggcatgttaagaatgggaccatgaaat

SEQ ID NO: 138766 - DNA, 75 bp, Artificial Sequence
  Synthetic
ataccacgtgcccctgcggtgctgagttagccggccacatcaagaatggctcaatgaggatcatcgggccgaaga

SEQ ID NO: 138767 - DNA, 75 bp, Artificial Sequence
  Synthetic
cctgtgcccccgccccggaagaagcggacggtggtcctcaccgaatcacttgtatcttctgccttggccgagctt

SEQ ID NO: 138768 - DNA, 75 bp, Artificial Sequence
  Synthetic
cggcaccgtccttgaccaagcagagactgcgggggcgagactggttgtgctcgccaccgctacccctccgggctc

SEQ ID NO: 138769 - DNA, 75 bp, Artificial Sequence
  Synthetic
caccaacaggcagcgggaagagcaccaaggtccctgccgcatatgccagtcaggggtataaagtactcgtactaa

SEQ ID NO: 138770 - DNA, 75 bp, Artificial Sequence
  Synthetic
tcagcctaccaagtgcgcaattccacggggctttaccatgtcaccaacgattgccctaactcgagtattgtgtac

SEQ ID NO: 138771 - DNA, 75 bp, Artificial Sequence
  Synthetic
aagagcgctgtggagggttaatgctgaggagtacgtcgaggttacgcgggtgcatgacttccattacatcacggg

SEQ ID NO: 138772 - DNA, 75 bp, Artificial Sequence
  Synthetic
ggtgtcagccgaggagtacgtggaggttcgtcgggtgggagacttccattacgtggtgggggtaacacaggataa

SEQ ID NO: 138773 - DNA, 75 bp, Artificial Sequence
  Synthetic
aagcctctcctgcgggatgagataacatttagcgtggggctctcaacttacgtagttgggtcgcagctgccttgt

SEQ ID NO: 138774 - DNA, 75 bp, Artificial Sequence
  Synthetic
gaagaggtgacctttagcgtgggccttaactcttatgcagtagggtcccagctcccttgtgagccggagcccgat

SEQ ID NO: 138775 - DNA, 75 bp, Artificial Sequence
  Synthetic
catctctcgctagctcatcggccagccagttgtcatcgctatccctcaaacccacgtgcgcaacgcacggtgacc

SEQ ID NO: 138776 - DNA, 75 bp, Artificial Sequence
  Synthetic
cttcggccagccagctctccgccccatccctcaaggctacttgcaccactcaccacgactcccctgatgccgacc

SEQ ID NO: 138777 - DNA, 75 bp, Artificial Sequence
  Synthetic
ctcgtttgaaccgctccgtgccgaggtcgaggatagggaaatctcaatagctgccgagtgtcaccggccaccgag

SEQ ID NO: 138778 - DNA, 75 bp, Artificial Sequence
  Synthetic
tgtggccgaagacgatgacaaggagatttctgtggctgcagaaatactccgcaagacaaagaaatttccgccagc

SEQ ID NO: 138779 - DNA, 75 bp, Artificial Sequence
  Synthetic
gcagggtgtgcgctccctcctcagggactgcctcccataccgccgccacggagaaagaaggtcgtgcgcctcgat

SEQ ID NO: 138780 - DNA, 75 bp, Artificial Sequence
  Synthetic
cctagcacggcccccgtccccccctcccccggacggaagcgggcgatcgtgctggatgagtccaacgtcgccggg

SEQ ID NO: 138781 - DNA, 75 bp, Artificial Sequence
  Synthetic
atggtccagcgtcgtgtcccgccaccgacgaagatgctgcctccgatgctgggtcgtatagttccatgccgcccc

SEQ ID NO: 138782 - DNA, 75 bp, Artificial Sequence
  Synthetic
ctcccccggtggacggcggctcagacgatgagtcctactcgtcgatgcccccacttgagggagagcccggggatc

SEQ ID NO: 138783 - DNA, 75 bp, Artificial Sequence
  Synthetic
atactcctggacaggagctctgatcacaccttgcgctgcggaggaggaaaagttgcccataaatgcactgagcaa

SEQ ID NO: 138784 - DNA, 75 bp, Artificial Sequence
  Synthetic
cgctgctgaggagaccaaactacccatcagtccactgagcaactcactgctgcgacaccacaacatggtgtacgc

SEQ ID NO: 138785 - DNA, 75 bp, Artificial Sequence
  Synthetic
cggcagaagaaggtcacatttgaccgcctccaggtggtcgacaaccactaccacgatgtcttaaaggagattaag

SEQ ID NO: 138786 - DNA, 75 bp, Artificial Sequence
  Synthetic
caacattaccatgatgttgtcaaggaggtgaagctgcgggcgtctggggtgaaggcgaggctcctcagcactgag

SEQ ID NO: 138787 - DNA, 75 bp, Artificial Sequence
  Synthetic
ggccgttaaccacatcaactccgtgtgggaggacttgctggaagacgctgacacccccatcccaaccaccatcat

SEQ ID NO: 138788 - DNA, 75 bp, Artificial Sequence
  Synthetic
gctccgtgtgggaggatttgctagaagacgcagtcacgcccatccctaccacaataatggcaaagaacgaggtgt

SEQ ID NO: 138789 - DNA, 75 bp, Artificial Sequence
  Synthetic
gcctctcctcctgctcctgctggcgttgcctcaacgggcatacgcgctggacacggagatggccgcgtcgtgtgg

SEQ ID NO: 138790 - DNA, 75 bp, Artificial Sequence
  Synthetic
aaagcgctttatgaccccatccagaagcttcctaaggcaatcatgggggatgcctatggtttccaatattcccca

SEQ ID NO: 138791 - DNA, 75 bp, Artificial Sequence
  Synthetic
aacatgcaagttgccggtggccgttatgggtccagcctatgggttccaatactcccccaaccagagggtggaacg

SEQ ID NO: 138792 - DNA, 75 bp, Artificial Sequence
  Synthetic
gggacatcagggtcgaagaagagatctaccagtgttgtgatctggatccagaggctcgtaaggtgatatccgccc

SEQ ID NO: 138793 - DNA, 75 bp, Artificial Sequence
  Synthetic
gaatccatataccagagctgtcaactggacccagaggcgaagaaggccataagcgcactcaccgaacgactgtac

SEQ ID NO: 138794 - DNA, 75 bp, Artificial Sequence
  Synthetic
ctagcggagtgtacaccacgagcttcgggaatacagtcacgtgctacctaaaggctacagcagccaccagggctg

SEQ ID NO: 138795 - DNA, 75 bp, Artificial Sequence
  Synthetic
aggccaagctcatgccacaactgcctgggattccctttgtgtcctgccaacgcgggtataggggggtctggcgag

SEQ ID NO: 138796 - DNA, 75 bp, Artificial Sequence
  Synthetic
gctacataaaggcaacggctgcctgtagggccgccggcctcaaggactttgacatgttggtttgcggagacgacc

SEQ ID NO: 138797 - DNA, 75 bp, Artificial Sequence
  Synthetic
tttacgaacatgttcagccccggggcgtctcagaatatccagcttataaacaccaacggcagctggcacatcaac

SEQ ID NO: 138798 - DNA, 75 bp, Artificial Sequence
  Synthetic
acgtcggccagggagagggagcggtccagtggatgaacagactgatcgcctttgcttccagaggaaaccatgttg

SEQ ID NO: 138799 - DNA, 75 bp, Artificial Sequence
  Synthetic
gacatgttggtttgcggagacgacctggtgatcatatccgagagtttgggggtctcggaggacgtaggtgccctg

SEQ ID NO: 138800 - DNA, 75 bp, Artificial Sequence
  Synthetic
tacgctaagccgagcgacccggatcagaggccttattgctggcactacgcgcctcaaccgtgcggtgtcgtaccc

SEQ ID NO: 138801 - DNA, 75 bp, Artificial Sequence
  Synthetic
gcgcacgacgctactgggaaaagggtatactatcttacccgtgaccctgagacccccctggcacgagctgcctgg

SEQ ID NO: 138802 - DNA, 75 bp, Artificial Sequence
  Synthetic
tttccgtggcccacgacaacaacggacagagatattactacctcacacgtgacccaaccactcctattgctagag

SEQ ID NO: 138803 - DNA, 75 bp, Artificial Sequence
  Synthetic
ttttttcggaatactccagtcccaagagcaactccacaaagcactcgatttcgacatgtacggagtaacgtacag

SEQ ID NO: 138804 - DNA, 75 bp, Artificial Sequence
  Synthetic
caattctccaaagccaggaggcccttgaaaaagcactcgacttcgacatgtacggagtcacatactctatcactc

SEQ ID NO: 138805 - DNA, 75 bp, Artificial Sequence
  Synthetic
gccgatggaatggtctccaaggggtggaggttgctggcgcccatcacggcgtacgcccagcagacaaggggcctc

SEQ ID NO: 138806 - DNA, 75 bp, Artificial Sequence
  Synthetic
gcatgcctcaggaaacttggggctccacccttgcgagcctggagacatcgggccagggcagtcagagctaggctt

SEQ ID NO: 138807 - DNA, 75 bp, Artificial Sequence
  Synthetic
gggagggagagccaaaatctgtggcatatatctcttcaactgggcggtaaaaaccaagctcaaactcactccatt

SEQ ID NO: 138808 - DNA, 75 bp, Artificial Sequence
  Synthetic
gtcctatgcccgaccccgcttcttactccttggcctactcctactcacggtaggggtaggcattttcctgctgcc

SEQ ID NO: 138809 - DNA, 75 bp, Artificial Sequence
  Synthetic
acgacagggggagcgacagcccaaggtgctagggggttagtgtccttcttcgcctccgggccgtctcagaaaatc

SEQ ID NO: 138810 - DNA, 75 bp, Artificial Sequence
  Synthetic
ggcgggcctgtcaacgttgcctggtaatcccgctattgcatcattgatggcttttacagctgccgtcaccagccc

SEQ ID NO: 138811 - DNA, 75 bp, Artificial Sequence
  Synthetic
ctatggcgtatggcctctgttcctgctcctgctggcgttgccaccacgagcatacgccttggaccgggagatggc

SEQ ID NO: 138812 - DNA, 75 bp, Artificial Sequence
  Synthetic
catacgccttggaccgggagatggctgcatcgtgtggaggcgcggtttttgtaggtctgatattcctgaccttgt

SEQ ID NO: 138813 - DNA, 75 bp, Artificial Sequence
  Synthetic
ggtcctcagggagatggcagacaaagtgctcagccctctccaagaccacaatgactccggtcactccactggagc

SEQ ID NO: 138814 - DNA, 75 bp, Artificial Sequence
  Synthetic
atgactccggtcactccactggagcggacaccggaggagacagcgtccagcagccctctgacgagactgccgcct

SEQ ID NO: 138815 - DNA, 75 bp, Artificial Sequence
  Synthetic
ccaggtccccaacagaagctccagcttgtgaataccaatgggagttggcacatcaacaggactgccttaaactgt

SEQ ID NO: 138816 - DNA, 75 bp, Artificial Sequence
  Synthetic
cctatttcgaccaaggttggggccccgtcagctatgctaatataagcgggagctcagaagataggccctattgct

SEQ ID NO: 138817 - DNA, 75 bp, Artificial Sequence
  Synthetic
ggcactacccaccaagaccatgtgaggtggtgccggcctcgcaggtgtgcggccctgtttattgctttacaccaa

SEQ ID NO: 138818 - DNA, 75 bp, Artificial Sequence
  Synthetic
ctattgcatcgttgatggcttttacagctgccgtcaccagcccactaaccactagccaaactctcctcttcaaca

SEQ ID NO: 138819 - DNA, 75 bp, Artificial Sequence
  Synthetic
caagggtggttggtacgggtgcacctggatgaattccaccgggtttgtgaaaacatgtggtgcgcctccatgcaa

SEQ ID NO: 138820 - DNA, 75 bp, Artificial Sequence
  Synthetic
gtcatatgctaggtgtggttcaggtccctggcttaccccacggtgcctagttcattatccttataggctgtggca

SEQ ID NO: 138821 - DNA, 75 bp, Artificial Sequence
  Synthetic
gtcctcaccgaatcaaccgtatccactgccttggccgagcttgccaccaagagctttggcagctcctcaacttcc

SEQ ID NO: 138822 - DNA, 75 bp, Artificial Sequence
  Synthetic
atgtggaacttcatcagtgggatacaatacttggcgggcctgtcaacgttgcctggtaaccccgccattgcttca

SEQ ID NO: 138823 - DNA, 75 bp, Artificial Sequence
  Synthetic
ccctgttcgttcacgacaatgccggcactttccactgggctgatacacctgcatcagaacatagtggacgtccag

SEQ ID NO: 138824 - DNA, 75 bp, Artificial Sequence
  Synthetic
cgaccccgcctattactcctttgcctactcctactcagcgtaggggtaggcatctttttactccccgctcggtag

SEQ ID NO: 138825 - DNA, 75 bp, Artificial Sequence
  Synthetic
gtttttggcttatgttactcattggccaggccgaggccgcactggagaacttgatcgtcctcaatgctgcctcgg

SEQ ID NO: 138826 - DNA, 75 bp, Artificial Sequence
  Synthetic
aaacgagggctgcggctgggcaggttggctcctgtccccccgcgggtctcgtcctacttggggccccactgaccc

SEQ ID NO: 138827 - DNA, 75 bp, Artificial Sequence
  Synthetic
tgtgggtcccaagcctttcggttcgggggggccgtgatgctatcatcctactcacgtgcttgttgcacccctccc

SEQ ID NO: 138828 - DNA, 75 bp, Artificial Sequence
  Synthetic
gcctacgctgcacgggccaacacccctgctgtataggctaggagccgtccaaaatgaggtcaccctcacacaccc

SEQ ID NO: 138829 - DNA, 75 bp, Artificial Sequence
  Synthetic
tttgttgcgggcttgcttgctagcgcgacgactttgcgctggcaaatacgtgcaggctgccctgttgcgggttgg

SEQ ID NO: 138830 - DNA, 75 bp, Artificial Sequence
  Synthetic
ttctcgcctatggagaagaaggtcattacatggggggcggacactgccgcgtgcggtgacatactggctggcttg

SEQ ID NO: 138831 - DNA, 75 bp, Artificial Sequence
  Synthetic
aacctcctatggaggcaggagatgggcggcaacattaccagggttgagtcagagaacaaagtggtgattctggac

SEQ ID NO: 138832 - DNA, 75 bp, Artificial Sequence
  Synthetic
gtccgctccatctctcaaggcaacttgcaccgccaaccacgactcccctgacgccgagctcatagaggccaacct

SEQ ID NO: 138833 - DNA, 75 bp, Artificial Sequence
  Synthetic
ggagtactatggactgtttaccatggcgccggctccaagaccttagccggtccgaagggtccagtgtgccaaatg

SEQ ID NO: 138834 - DNA, 75 bp, Artificial Sequence
  Synthetic
cagacgcaggggtgacacccgtgcagggctccttagtcccagacccttgtcgactctcaaaggctcatccggcgg

SEQ ID NO: 138835 - DNA, 75 bp, Artificial Sequence
  Synthetic
caggggtggcaggcgcactcgtagctttcaagatcatgagcggcgaggtgccctccaccgaggacctggtcaact

SEQ ID NO: 138836 - DNA, 75 bp, Artificial Sequence
  Synthetic
tgcacctacccggatgtgtgccctgcgtcgcaaccgacaacggaacatcgtgctggacaccagtgtcaccaacag

SEQ ID NO: 138837 - DNA, 75 bp, Artificial Sequence
  Synthetic
cccccgcaaggagcttggtttggctgcacttggatgaacgggactgggtttactaagacatgcggcgcaccacct

SEQ ID NO: 138838 - DNA, 75 bp, Artificial Sequence
  Synthetic
ggatacctccatgctccaacaggcagtgggaagagcacgaaggtgccggcggcatatgcctcacagggttataag

SEQ ID NO: 138839 - DNA, 75 bp, Artificial Sequence
  Synthetic
cctctgtggggccgtgttcctcgtgggacaagcattcaccttcagaccccgccgacacacgactgcacagacgtg

SEQ ID NO: 138840 - DNA, 75 bp, Artificial Sequence
  Synthetic
atgcgattgccccaaaccttctttgatctggtcataggggcccactggggcgtgatggcaggcctcgcctatttc

SEQ ID NO: 138841 - DNA, 75 bp, Artificial Sequence
  Synthetic
atgcgtttgccccaaaccttctttgatctggtcataggggcccactggggcgtgatggcaggcctcgcctatttc

SEQ ID NO: 138842 - DNA, 75 bp, Artificial Sequence
  Synthetic
atgcgcttgccccaaaccttctttgatctggtcataggggcccactggggcgtgatggcaggcctcgcctatttc

SEQ ID NO: 138843 - DNA, 75 bp, Artificial Sequence
  Synthetic
atgcggttgccccaaaccttctttgatctggtcataggggcccactggggcgtgatggcaggcctcgcctatttc

SEQ ID NO: 138844 - DNA, 75 bp, Artificial Sequence
  Synthetic
ccttactgtcctagccacagccacacctcctgggtcggtcaccgtcccccatccaaacatcacagaggttgctct

SEQ ID NO: 138845 - DNA, 75 bp, Artificial Sequence
  Synthetic
cctcctgggtcggtcaccgtcccccatccaaacatcacagaggttgctctaccaaccacaggggagatcccattc

SEQ ID NO: 138846 - DNA, 75 bp, Artificial Sequence
  Synthetic
ctcgcgatgttgtgagcctgtttactcgaggcccgcgccagaacctgcatttggtgaatactaacgggtcgtggc

SEQ ID NO: 138847 - DNA, 75 bp, Artificial Sequence
  Synthetic
accaaccacaggggagatcccattctacgggaagtgtattcccctcgactgcatcaagggtggtaggcatctgat

SEQ ID NO: 138848 - DNA, 75 bp, Artificial Sequence
  Synthetic
tctacgggatgtggcctctcctcctgctcctgttggcgttgccccagcgggcatacgcgctggacacggaggtgg

SEQ ID NO: 138849 - DNA, 75 bp, Artificial Sequence
  Synthetic
ccaaccaccatcatggcaaaaaacgaggtctttgctgtggccccccataaggggggtcgtaagccagcccgcctg

SEQ ID NO: 138850 - DNA, 75 bp, Artificial Sequence
  Synthetic
gtccccttagctacctattccctcactggcctgtggtcctttagcctactgctcctagcattgccccaacaggct

SEQ ID NO: 138851 - DNA, 75 bp, Artificial Sequence
  Synthetic
tcgaatgaccagctgcaagcccatcacagccttcaagcaggggtggggttcactaaaagatgtcaacatatctgg

SEQ ID NO: 138852 - DNA, 75 bp, Artificial Sequence
  Synthetic
caacgcgtccggatgcccggagcgcatggccagctgccgctccattgacaagttcgatcaggggtggggtcccat

SEQ ID NO: 138853 - DNA, 75 bp, Artificial Sequence
  Synthetic
tggctacacaggcgacttcgactccgtcatagactgcaatgtggctgtgacacaggtggttgattttagcctgga

SEQ ID NO: 138854 - DNA, 75 bp, Artificial Sequence
  Synthetic
cactaaaagatgtcaacatatctggtcccagcgaagacaaaccatactgctggcactacgcacccagaccctgct

SEQ ID NO: 138855 - DNA, 75 bp, Artificial Sequence
  Synthetic
gtgtattgcttcaccccaagccctgttgtggtggggacgaccgatcgtttcggcgcccccacgtataactggggg

SEQ ID NO: 138856 - DNA, 75 bp, Artificial Sequence
  Synthetic
aacatacaagaccctcctggcccgctcactgtggtggctgacctacatgctgaccttggccgaggctcagatcca

SEQ ID NO: 138857 - DNA, 75 bp, Artificial Sequence
  Synthetic
tacgtctcgcaaggggaacggccgtctggattgttcgacaccgttgtgctctgcgaggcgtatgatacaggatgc

SEQ ID NO: 138858 - DNA, 75 bp, Artificial Sequence
  Synthetic
agaccacagtcagactacgcgcatacctgaatacccctgggctgcctgtatgccaagaccaccttgagttctggg

SEQ ID NO: 138859 - DNA, 75 bp, Artificial Sequence
  Synthetic
cctgaatacccctgggctgcctgtatgccaagaccaccttgagttctgggagggagtgtttactgggctcaccca

SEQ ID NO: 138860 - DNA, 75 bp, Artificial Sequence
  Synthetic
tgccctacagattgttttaggaagcaccccgctgccacgtacacccgctgcgggtctggaccctggcttacgcca

SEQ ID NO: 138861 - DNA, 75 bp, Artificial Sequence
  Synthetic
ggttgtggcactacccttgcactcataacttcaccatattcaaagtcagaatgtttgtgggaggagcggaacatc

SEQ ID NO: 138862 - DNA, 75 bp, Artificial Sequence
  Synthetic
aaaatacatcatgacctgcatgtcagcagacctagaggtaatcactagcacgtgggtaatcgcaggggggattct

SEQ ID NO: 138863 - DNA, 75 bp, Artificial Sequence
  Synthetic
tcctagctcccatcactgcctatgtgcagcaaacacggggcctattgggcaccatcgtcacgagcctcactggta

SEQ ID NO: 138864 - DNA, 75 bp, Artificial Sequence
  Synthetic
cgcgctggtgcctgacagagaagtactctaccagcaattcgacgagatggaggagtgctctcgacacatccctta

SEQ ID NO: 138865 - DNA, 75 bp, Artificial Sequence
  Synthetic
tggagctgggtcaaagaccctggccggcccaaagaaacccatatgccaaatgtacaccaatgtggaccaagacct

SEQ ID NO: 138866 - DNA, 75 bp, Artificial Sequence
  Synthetic
ggcccaaagaaacccatatgccaaatgtacaccaatgtggaccaagacctagtgggatggcccgcccccgcaggc

SEQ ID NO: 138867 - DNA, 75 bp, Artificial Sequence
  Synthetic
ccgcccttgcgagcttggagacaccgggcccggaatgtccgcgctaggcttctgtccaggggaggcagggctgcc

SEQ ID NO: 138868 - DNA, 75 bp, Artificial Sequence
  Synthetic
ggcaggcgtaggggggacaatcgcgcaggactcctaagcccacgaccaattagcacgctaaagggttcgtcgggc

SEQ ID NO: 138869 - DNA, 75 bp, Artificial Sequence
  Synthetic
gggcccgtcctctgcccctcggggcacgtgatgggcattttccgcgcggccgtctgcactaggggcgttgccaag

SEQ ID NO: 138870 - DNA, 75 bp, Artificial Sequence
  Synthetic
tcaacagcatttgtcgtaagcggcattgctggtgctgccgtgggtagcatcggtttgagtaaggtcattgttgac

SEQ ID NO: 138871 - DNA, 75 bp, Artificial Sequence
  Synthetic
tagggtacctccacgctccgaccggaagcgggaagagcactaaggtccctgcggcttacgccagtcagggatata

SEQ ID NO: 138872 - DNA, 75 bp, Artificial Sequence
  Synthetic
gacaatcacgacaggcggtcccattacttactcaacctacggcaaattccttgccgatggcgggtgtagtggggg

SEQ ID NO: 138873 - DNA, 75 bp, Artificial Sequence
  Synthetic
acttactcaacctacggcaaattccttgccgatggcgggtgtagtgggggcgcgtatgacataataatctgcgat

SEQ ID NO: 138874 - DNA, 75 bp, Artificial Sequence
  Synthetic
atcgttggtggagtttacttgttgccgcgcaggggcccgcgtttgggtgtgcgcgcgacgaggaagacttcagaa

SEQ ID NO: 138875 - DNA, 75 bp, Artificial Sequence
  Synthetic
tggctgagagacgtgtgggactgggtgtgtacagtactatctgactttaagacttggctcaaggcaaagctcatg

SEQ ID NO: 138876 - DNA, 75 bp, Artificial Sequence
  Synthetic
gagtgccattctacggaccctaccaccgtcctaggtataggtacggtcttggaccaggcagaaactgcgggcgcc

SEQ ID NO: 138877 - DNA, 75 bp, Artificial Sequence
  Synthetic
gacttggctcaaggcaaagctcatgccctccctaccaggcatccccttcttctcatgtcagaggggttttagggg

SEQ ID NO: 138878 - DNA, 75 bp, Artificial Sequence
  Synthetic
gacttggctcaaggcaaagctcatgccctcccttccaggcatccccttcttctcatgtcagaggggttttagggg

SEQ ID NO: 138879 - DNA, 75 bp, Artificial Sequence
  Synthetic
gacttggctcaaggcaaagctcatgccctccctcccaggcatccccttcttctcatgtcagaggggttttagggg

SEQ ID NO: 138880 - DNA, 75 bp, Artificial Sequence
  Synthetic
gacttggctcaaggcaaagctcatgccctccctgccaggcatccccttcttctcatgtcagaggggttttagggg

SEQ ID NO: 138881 - DNA, 75 bp, Artificial Sequence
  Synthetic
cagctgataattacaagacgatggggtggcgcctattgtctccaatctcagcatatgcccagcagacccgaggac

SEQ ID NO: 138882 - DNA, 75 bp, Artificial Sequence
  Synthetic
gttgtcgtcgtggcaaccgatgctctcatgaccggctttaccggcgacttcgactcggtgatagactgcaacacg

SEQ ID NO: 138883 - DNA, 75 bp, Artificial Sequence
  Synthetic
ttttcggaaccattgttaccagcttgacaggtagggacaaaaacgtagtgactggtgaagtgcaagtgctgtcca

SEQ ID NO: 138884 - DNA, 75 bp, Artificial Sequence
  Synthetic
gtctcccgcactcaacgtcggggcaggactggcagggggaagccaggcatctacagatttgtggcaccgggggag

SEQ ID NO: 138885 - DNA, 75 bp, Artificial Sequence
  Synthetic
ttcgccgatctcatggggtacattcctgtcgtcggcgcccccctggggggcgtagcggcggcccttgcacacggt

SEQ ID NO: 138886 - DNA, 75 bp, Artificial Sequence
  Synthetic
gctccaaatgtacaccaatgtggaccaggacctggtgggttggccagcgcctgcggggacgaagtctcttgaccc

SEQ ID NO: 138887 - DNA, 75 bp, Artificial Sequence
  Synthetic
actggttatacgggcgatttcgatagcgtaatcgactgcaacgtcgccgtcacgcaggtcgtcgacttcagtctg

SEQ ID NO: 138888 - DNA, 75 bp, Artificial Sequence
  Synthetic
cctctggaggtcccatcatgtgcccctcgggacacgtggtggggatcttcagggcggctgtgtgcaccagaggcg

SEQ ID NO: 138889 - DNA, 75 bp, Artificial Sequence
  Synthetic
acatctccctggttgtgtaccttgcgtcagaaatggcaacatcagcaagtgttggacaccggcctcgcccacgtt

SEQ ID NO: 138890 - DNA, 75 bp, Artificial Sequence
  Synthetic
aggtctccatctttcagtgacaattctaccccccccgccgtgccagagtcctaccaggtaggataccttcatgcc

SEQ ID NO: 138891 - DNA, 75 bp, Artificial Sequence
  Synthetic
aactgctccatctacgctggccacgtcaccggccaccgaatggcatgggacatgatgatgaattggtcacccacc

SEQ ID NO: 138892 - DNA, 75 bp, Artificial Sequence
  Synthetic
cccccccctcctgggaccaaatgtggaaatgtctcatcaggctcaagcctaccctcacagggcccacgcccttgc

SEQ ID NO: 138893 - DNA, 75 bp, Artificial Sequence
  Synthetic
acggtgctggatcaagcggagacagctggagtgaggttgacagtgctggcaacagcgaccccccccggcagcatc

SEQ ID NO: 138894 - DNA, 75 bp, Artificial Sequence
  Synthetic
gcatggttgccaactgggccaaggttatcgccatcttgttgctgttcactggcgtggacgcagagacccgcaccg

SEQ ID NO: 138895 - DNA, 75 bp, Artificial Sequence
  Synthetic
cccccaccgtatcggggtgcgcgcttcccccaaaggggttgccgcccatacccccgcctcggcggaagagggtca

SEQ ID NO: 138896 - DNA, 75 bp, Artificial Sequence
  Synthetic
atacagactttggcactacccctgcacagtcaatttttccatcttcaaggttaggatgtatgtggggggcgtgga

SEQ ID NO: 138897 - DNA, 75 bp, Artificial Sequence
  Synthetic
ggaggcgctcgccgagctagcccggaaattatttccatcagatccatcaaaatccgaagaatccggcgtgggggc

SEQ ID NO: 138898 - DNA, 75 bp, Artificial Sequence
  Synthetic
tatcaataggacagcactcaactgtaacgacagcctccacaccggctttgtgacagcgctgttctaaagccacaa

SEQ ID NO: 138899 - DNA, 75 bp, Artificial Sequence
  Synthetic
tatcaataggacagcactcaactgtaacgacagcctccacaccggctttgtgacagcgctgttctatagccacaa

SEQ ID NO: 138900 - DNA, 75 bp, Artificial Sequence
  Synthetic
tatcaataggacagcactcaactgtaacgacagcctccacaccggctttgtgacagcgctgttctacagccacaa

SEQ ID NO: 138901 - DNA, 75 bp, Artificial Sequence
  Synthetic
tatcaataggacagcactcaactgtaacgacagcctccacaccggctttgtgacagcgctgttctagagccacaa

SEQ ID NO: 138902 - DNA, 75 bp, Artificial Sequence
  Synthetic
ctgcatttgaccaggggtggggccctataacatacgccaacataaccggctcgtcgccagacaagccgtattgct

SEQ ID NO: 138903 - DNA, 75 bp, Artificial Sequence
  Synthetic
ctgcatttgtccaggggtggggccctataacatacgccaacataaccggctcgtcgccagacaagccgtattgct

SEQ ID NO: 138904 - DNA, 75 bp, Artificial Sequence
  Synthetic
ctgcatttgcccaggggtggggccctataacatacgccaacataaccggctcgtcgccagacaagccgtattgct

SEQ ID NO: 138905 - DNA, 75 bp, Artificial Sequence
  Synthetic
ctgcatttggccaggggtggggccctataacatacgccaacataaccggctcgtcgccagacaagccgtattgct

SEQ ID NO: 138906 - DNA, 75 bp, Artificial Sequence
  Synthetic
ctgcttttgaccaggggtggggccctataacatacgccaacataaccggctcgtcgccagacaagccgtattgct

SEQ ID NO: 138907 - DNA, 75 bp, Artificial Sequence
  Synthetic
ctgcttttgtccaggggtggggccctataacatacgccaacataaccggctcgtcgccagacaagccgtattgct

SEQ ID NO: 138908 - DNA, 75 bp, Artificial Sequence
  Synthetic
ctgcttttgcccaggggtggggccctataacatacgccaacataaccggctcgtcgccagacaagccgtattgct

SEQ ID NO: 138909 - DNA, 75 bp, Artificial Sequence
  Synthetic
ctgcttttggccaggggtggggccctataacatacgccaacataaccggctcgtcgccagacaagccgtattgct

SEQ ID NO: 138910 - DNA, 75 bp, Artificial Sequence
  Synthetic
ctgcctttgaccaggggtggggccctataacatacgccaacataaccggctcgtcgccagacaagccgtattgct

SEQ ID NO: 138911 - DNA, 75 bp, Artificial Sequence
  Synthetic
ctgcctttgtccaggggtggggccctataacatacgccaacataaccggctcgtcgccagacaagccgtattgct

SEQ ID NO: 138912 - DNA, 75 bp, Artificial Sequence
  Synthetic
ctgcctttgcccaggggtggggccctataacatacgccaacataaccggctcgtcgccagacaagccgtattgct

SEQ ID NO: 138913 - DNA, 75 bp, Artificial Sequence
  Synthetic
ctgcctttggccaggggtggggccctataacatacgccaacataaccggctcgtcgccagacaagccgtattgct

SEQ ID NO: 138914 - DNA, 75 bp, Artificial Sequence
  Synthetic
ctgcgtttgaccaggggtggggccctataacatacgccaacataaccggctcgtcgccagacaagccgtattgct

SEQ ID NO: 138915 - DNA, 75 bp, Artificial Sequence
  Synthetic
ctgcgtttgtccaggggtggggccctataacatacgccaacataaccggctcgtcgccagacaagccgtattgct

SEQ ID NO: 138916 - DNA, 75 bp, Artificial Sequence
  Synthetic
ctgcgtttgcccaggggtggggccctataacatacgccaacataaccggctcgtcgccagacaagccgtattgct

SEQ ID NO: 138917 - DNA, 75 bp, Artificial Sequence
  Synthetic
ctgcgtttggccaggggtggggccctataacatacgccaacataaccggctcgtcgccagacaagccgtattgct

SEQ ID NO: 138918 - DNA, 75 bp, Artificial Sequence
  Synthetic
aacttcatcagcggaatacagtatctggcgggcttatccaccttgcccggcaatccggctgtagctgctctcatg

SEQ ID NO: 138919 - DNA, 75 bp, Artificial Sequence
  Synthetic
tggcgggcttatccaccttgcccggcaatccggctgtagctgctctcatgtccttctcggcctcattgacgagcc

SEQ ID NO: 138920 - DNA, 75 bp, Artificial Sequence
  Synthetic
tcggaaggggaacccaacgtacacctggggtgagaatgagaccgacgtgttcatcttaaacagcctgcggccgcc

SEQ ID NO: 138921 - DNA, 75 bp, Artificial Sequence
  Synthetic
catctacaggtttgtgactccaggagaacggccctcgggcatgttcgattcctcggtcctgtgtgagtgctatga

SEQ ID NO: 138922 - DNA, 75 bp, Artificial Sequence
  Synthetic
tggatgaattcctcggggttcaccaagacgtgcggggcgcccccttgtaacatcgggccaagaggcaacaacacc

SEQ ID NO: 138923 - DNA, 75 bp, Artificial Sequence
  Synthetic
gtggtggtgggaacgaccgacaggtcgggcgcgcctacctacaactggggtgaaaatgatacggacgtcttcgtc

SEQ ID NO: 138924 - DNA, 75 bp, Artificial Sequence
  Synthetic
tacggggccaaggaggtccgaagccttgccagtaaggccgtgaaccacatcaactccgtgtgggaggacttgctg

SEQ ID NO: 138925 - DNA, 75 bp, Artificial Sequence
  Synthetic
cctacaggctatggcactacccgtgcaccgtcaactttaccatccacaaggtgcgcattttccttggagggctcg

SEQ ID NO: 138926 - DNA, 75 bp, Artificial Sequence
  Synthetic
tgaagccgaatctgcatggtcccacccctctcctgtataggctaggagcaatccaaagtgacatctgcacaacac

SEQ ID NO: 138927 - DNA, 75 bp, Artificial Sequence
  Synthetic
atcacatgcaagctgccttcagcggtgatgggggccgcttacggtttccaatactcgccgaagcagcgcgtggac

SEQ ID NO: 138928 - DNA, 75 bp, Artificial Sequence
  Synthetic
cgagctttcgatcttaccgtgctcattttccactatgccagccctatcgactggtttgatacatctccatcagaa

SEQ ID NO: 138929 - DNA, 75 bp, Artificial Sequence
  Synthetic
ctgggggccattatgtccaaatggctctcatgaagctggccgcactgacgggcacgtacgtttatgaccatctta

SEQ ID NO: 138930 - DNA, 75 bp, Artificial Sequence
  Synthetic
agcatgacatctaccagtgctgccagttggagcccgcagcgcggacggccattacatcgctcactgaccgattgt

SEQ ID NO: 138931 - DNA, 75 bp, Artificial Sequence
  Synthetic
attacatcgctcactgaccgattgtactgcggtggtcccatgcacaactctaagggtcaagcatgtggataccgc

SEQ ID NO: 138932 - DNA, 75 bp, Artificial Sequence
  Synthetic
cttatggactgctgcagctgtggccgctcctgctccttgtattggcgttgcctcagcgggctttcgcctttgata

SEQ ID NO: 138933 - DNA, 75 bp, Artificial Sequence
  Synthetic
cacctttcccatcaatgcgaccacgactggtccaagtgtaccagccccctcgcccaactacaccagagccttgtg

SEQ ID NO: 138934 - DNA, 75 bp, Artificial Sequence
  Synthetic
agttgcttgtacagctcatgtggtggacccaatacttcatagcgcggatggaagctgcgctacaagtatgggtcc

SEQ ID NO: 138935 - DNA, 75 bp, Artificial Sequence
  Synthetic
cctagggccactataccttttccaagccagcctactccgcataccatattacgtgcgagcacacgcccttctgcg

SEQ ID NO: 138936 - DNA, 75 bp, Artificial Sequence
  Synthetic
cctagggccactataccttttccaagccagcctactccgcataccatattacgtgcgagctcacgcccttctgcg

SEQ ID NO: 138937 - DNA, 75 bp, Artificial Sequence
  Synthetic
cctagggccactataccttttccaagccagcctactccgcataccatattacgtgcgagcccacgcccttctgcg

SEQ ID NO: 138938 - DNA, 75 bp, Artificial Sequence
  Synthetic
cctagggccactataccttttccaagccagcctactccgcataccatattacgtgcgagcgcacgcccttctgcg

SEQ ID NO: 138939 - DNA, 75 bp, Artificial Sequence
  Synthetic
ggaggcggcacggcggcgcctcgccagaggctctcctccatcgctcgccagctcctccgccagccagttgtctgc

SEQ ID NO: 138940 - DNA, 75 bp, Artificial Sequence
  Synthetic
aactcatcaccgctaatctcctgtggagacaggagatgggcggaaacatcaccagggtggagtcagagaacaaaa

SEQ ID NO: 138941 - DNA, 75 bp, Artificial Sequence
  Synthetic
gcacccctctctgactgggccagcgatggtttgcgcgagcttgccgttgctgttgagccagtcatcttctcgccc

SEQ ID NO: 138942 - DNA, 75 bp, Artificial Sequence
  Synthetic
tatttgcggtaaatacctcttcaactgggcggtgaagaccaagctcaaactcactccaatacccggtgcgggcac

SEQ ID NO: 138943 - DNA, 75 bp, Artificial Sequence
  Synthetic
accccgtgcgctgcggaagaacagaaactgcccatcaacgcactgagcaactcgttgctacgtcaccacaatatg

SEQ ID NO: 138944 - DNA, 75 bp, Artificial Sequence
  Synthetic
ttggcccagccgatgacgcccgagaccttgggtggaagttgctagcccccatcactgcataccatcagcagaccc

SEQ ID NO: 138945 - DNA, 75 bp, Artificial Sequence
  Synthetic
ataaacaggactgccctcaactgcaatgacagcttgaacactgggttcttggctagcttgttctacacccacaag

SEQ ID NO: 138946 - DNA, 75 bp, Artificial Sequence
  Synthetic
ccgcatgttactcctgtgcctactcctactctccgtaggggtaggcatcttcctgcttcccgctcggtaagcggg

SEQ ID NO: 138947 - DNA, 75 bp, Artificial Sequence
  Synthetic
ggctagcttgttctacacccacaagttcaacagctcagggtgtcccgaacgactcgcaagctgcaaaagccttga

SEQ ID NO: 138948 - DNA, 75 bp, Artificial Sequence
  Synthetic
tagcctcacgggccgtgacaaaaacgaagtcgagggcgaggtgcaagtgctatccacggcaactcagaccttctt

SEQ ID NO: 138949 - DNA, 75 bp, Artificial Sequence
  Synthetic
ggtacaagggggtgtggcgaggggatggtgtgatgacaacacgctgcccttgcggacgggaaataacagggcacg

SEQ ID NO: 138950 - DNA, 75 bp, Artificial Sequence
  Synthetic
agaaacacactccgccgcccaaagaacgttaagttcccggctggcgggcagatcgttggtgaagtatatgtcctg

SEQ ID NO: 138951 - DNA, 75 bp, Artificial Sequence
  Synthetic
gcccaagctttggcggagctggcatctcggccgttccaagcacctccagagcaggttgtcaccaactctgattca

SEQ ID NO: 138952 - DNA, 75 bp, Artificial Sequence
  Synthetic
cggcatcatgcagaccacctgcccatgtggagcacagatcaccggacatgtcaagaacggttccatgaggatcgt

SEQ ID NO: 138953 - DNA, 75 bp, Artificial Sequence
  Synthetic
ctaagacgttggccggcccgaaagggccggtttgccagatgtacaccaatgtagaccaagacttggtggggtggc

SEQ ID NO: 138954 - DNA, 75 bp, Artificial Sequence
  Synthetic
ctctgttctcggcttgtggtcctttctcctcctagttctagccttaccacagcaggcttatgccctggacgccgc

SEQ ID NO: 138955 - DNA, 75 bp, Artificial Sequence
  Synthetic
ggggtcagccctatgcgccaacatgtggtacggcacttttcccatcaatgaatacaccaccgggccgagcacgcc

SEQ ID NO: 138956 - DNA, 75 bp, Artificial Sequence
  Synthetic
gactcgcaagctgcaaaagccttgatacgttcgaccaaggctggggcccacttggggtcgctgacatcggaggcc

SEQ ID NO: 138957 - DNA, 75 bp, Artificial Sequence
  Synthetic
gacgccttgcacctgcggcgggtgcgacctttatttggtgacccgcaccgccgatgtcattccagcgaggcgcag

SEQ ID NO: 138958 - DNA, 75 bp, Artificial Sequence
  Synthetic
caggagatcctgacctgagctcgggatcgtggtccacggtcagtgatgatggaaccagcgtagtttgctgttcca

SEQ ID NO: 138959 - DNA, 75 bp, Artificial Sequence
  Synthetic
gacctttatttggtgacccgcaccgccgatgtcattccagcgaggcgcaggggtgacactcgtgccagtctccta

SEQ ID NO: 138960 - DNA, 75 bp, Artificial Sequence
  Synthetic
tcctacatgctggtcttggccgaggcccaaattcagcaatgggttccccccctggaggcccgaggggggcgtgac

SEQ ID NO: 138961 - DNA, 75 bp, Artificial Sequence
  Synthetic
gcaacggcctcctacggcaccacaacctggtgtattccaccacctcccgcagcgcacctctgcgccagaaaaagg

SEQ ID NO: 138962 - DNA, 75 bp, Artificial Sequence
  Synthetic
ccgagccagacgtcgcagtgttgacctcgatgttgcgagatcctgcccacatcacagccgctacggcggcccggc

SEQ ID NO: 138963 - DNA, 75 bp, Artificial Sequence
  Synthetic
ggaagctagctcctctgccagccagctctcagctccgtcgttgaaggccacttgtcaaacgcataagctgcaccc

SEQ ID NO: 138964 - DNA, 75 bp, Artificial Sequence
  Synthetic
gagctaagtacatccagatgctgttgatcaccgtgggcaggtggactggcacttacatctatgaccacctctccc

SEQ ID NO: 138965 - DNA, 75 bp, Artificial Sequence
  Synthetic
agaggaggcttgtgacctcactcccccgcgatcggcccggtccaagtttggatacggggcgaaggatgtcagggc

SEQ ID NO: 138966 - DNA, 75 bp, Artificial Sequence
  Synthetic
gagtaaaggccagactcctctctacagaggaggcttgtgacctcactcccccgcgatcggcccggtccaagtttg

SEQ ID NO: 138967 - DNA, 75 bp, Artificial Sequence
  Synthetic
tgcacttacccggatgcgtgccctgcgtcgaaaccgacaacaacaacacatcgtgctggacaccgatttcaccga

SEQ ID NO: 138968 - DNA, 75 bp, Artificial Sequence
  Synthetic
tgaggactgggaacgtgtcgcgttgctggacgccagtaacacctacagtggctgtcgcatacgcgggcgccccgc

SEQ ID NO: 138969 - DNA, 75 bp, Artificial Sequence
  Synthetic
ggcctacgggatagacccgaacatcagaaccggtgtcaggaccatcacgaccggaggggccattacatactcaac

SEQ ID NO: 138970 - DNA, 75 bp, Artificial Sequence
  Synthetic
gtggacgtccagtacctctacggtgttggatctgcagtggtatcttgggccctcaagtgggaatatgtggtgctc

SEQ ID NO: 138971 - DNA, 75 bp, Artificial Sequence
  Synthetic
ttgagtctttccggcggcatgtggacctaatggtaggcgcggccactttgtgttctgccctatatgttggggacc

SEQ ID NO: 138972 - DNA, 75 bp, Artificial Sequence
  Synthetic
tatgattgtgacatggtggatgctaaccttttcatgggaggcgatgtgacccggattgagtccgactctaaggtg

SEQ ID NO: 138973 - DNA, 75 bp, Artificial Sequence
  Synthetic
atcggtacagtcctggaccaggcggagacggctggcgcccgcctaaccgtgctcgctacggcgacaccgccgggc

SEQ ID NO: 138974 - DNA, 75 bp, Artificial Sequence
  Synthetic
agacgccttcggggccgtgtcccttgtgggacaagcgttcacctttagacctcgccaacacaagactgtgcagac

SEQ ID NO: 138975 - DNA, 75 bp, Artificial Sequence
  Synthetic
gtgtgcgaaaagagagctctctacgacattacgcagaagttgcccgtggccatcatgggagccgcttacggcttc

SEQ ID NO: 138976 - DNA, 75 bp, Artificial Sequence
  Synthetic
tcggtgacagtcccacacccgaacatcacagaaacagctctgtccacgacgggggagattcccttttatgggaag

SEQ ID NO: 138977 - DNA, 75 bp, Artificial Sequence
  Synthetic
gtgggacaagcgttcacctttagacctcgccaacacaagactgtgcagacgtgcaactgctcaatatacccaggt

SEQ ID NO: 138978 - DNA, 75 bp, Artificial Sequence
  Synthetic
tatgacaccaggtgttttgattcaacagtgactgagcgcgacatccgcactgaggagtccatttaccaatgctgc

SEQ ID NO: 138979 - DNA, 75 bp, Artificial Sequence
  Synthetic
ggcggaaagatccttcccgtcgacgaaatcggaggggaaaggcgcttcctcctcaggagtcggtacagagtccac

SEQ ID NO: 138980 - DNA, 75 bp, Artificial Sequence
  Synthetic
ggcggaaagatccttcccgtcgacgaaatcggaggggataggcgcttcctcctcaggagtcggtacagagtccac

SEQ ID NO: 138981 - DNA, 75 bp, Artificial Sequence
  Synthetic
ggcggaaagatccttcccgtcgacgaaatcggaggggacaggcgcttcctcctcaggagtcggtacagagtccac

SEQ ID NO: 138982 - DNA, 75 bp, Artificial Sequence
  Synthetic
ggcggaaagatccttcccgtcgacgaaatcggaggggagaggcgcttcctcctcaggagtcggtacagagtccac

SEQ ID NO: 138983 - DNA, 75 bp, Artificial Sequence
  Synthetic
ggagtccatataccaggcctgctccctgcccgaggaggcccgcactgccatacactcgctgactgagagacttta

SEQ ID NO: 138984 - DNA, 75 bp, Artificial Sequence
  Synthetic
cctcaggagtcggtacagagtccactactgagtccggcgactcgcctgaaactggcgaagggtcggacgcagagt

SEQ ID NO: 138985 - DNA, 75 bp, Artificial Sequence
  Synthetic
ttaatgccgtcgccttctacaggggcgttgacgtggccgtcattcccactagtggggacgttgtcatctgcgcca

SEQ ID NO: 138986 - DNA, 75 bp, Artificial Sequence
  Synthetic
gccttggtccttttcctctttgctggggtggacgcctccacgagcatcaccgggggcaccgtggcccatggagct

SEQ ID NO: 138987 - DNA, 75 bp, Artificial Sequence
  Synthetic
gccgatgcagggccagcggggttcttccaactagcttaggcaacaccatgacatgttacatcaaagctatggcag

SEQ ID NO: 138988 - DNA, 75 bp, Artificial Sequence
  Synthetic
cgggggcaccgtggcccatggagcttctgggctggctggcctatttacatctgggcctaaacaaaatctccagtt

SEQ ID NO: 138989 - DNA, 75 bp, Artificial Sequence
  Synthetic
cacccgaggtccaagtcagaatttgcaattggtcaactcaaatgggtcatggcacattaacagcactgccttgaa

SEQ ID NO: 138990 - DNA, 75 bp, Artificial Sequence
  Synthetic
gcccgggtacccttggcccctctatggcaatgagggctgcgggtgggcgggatggctcctgtccccccgcggctc

SEQ ID NO: 138991 - DNA, 75 bp, Artificial Sequence
  Synthetic
tgcaacgtggcagtcactcaggtggttgatttcagcctggaccctacctttacaattgagactaccactgtccca

SEQ ID NO: 138992 - DNA, 75 bp, Artificial Sequence
  Synthetic
tgtggccaaatccattgacttcatccctgttgactctctcaatatcgccgcacggacgcccagtttctctgacaa

SEQ ID NO: 138993 - DNA, 75 bp, Artificial Sequence
  Synthetic
gggcccctctacatactccaggcctcgctcctgcgcgttccttacttcgtgagggcacacgcactgctcaagatc

SEQ ID NO: 138994 - DNA, 75 bp, Artificial Sequence
  Synthetic
gggcccctctacatactccaggcctcgctcctgcgcgttccttacttcgtgagggcacacgcactgctcaagttc

SEQ ID NO: 138995 - DNA, 75 bp, Artificial Sequence
  Synthetic
gggcccctctacatactccaggcctcgctcctgcgcgttccttacttcgtgagggcacacgcactgctcaagctc

SEQ ID NO: 138996 - DNA, 75 bp, Artificial Sequence
  Synthetic
gggcccctctacatactccaggcctcgctcctgcgcgttccttacttcgtgagggcacacgcactgctcaaggtc

SEQ ID NO: 138997 - DNA, 75 bp, Artificial Sequence
  Synthetic
acccggggtatacaggtacgtctcgcagggcgagcggccgtctggcatgttcgactccatcgtcctctgcgaggc

SEQ ID NO: 138998 - DNA, 75 bp, Artificial Sequence
  Synthetic
atcacatatttcaatcaggggtggggcccattgacagatgctaacataaatggtcccagtgaggacagaccatat

SEQ ID NO: 138999 - DNA, 75 bp, Artificial Sequence
  Synthetic
aacgtctccgtagcccatgaccacaatggacgtaggtactactacctcacgcgcgacccagttacacctctagcc

SEQ ID NO: 139000 - DNA, 75 bp, Artificial Sequence
  Synthetic
catcttgagttctgggagggggtattcactgggctcacccacattgatgcccacttcctctcacaaacaaaacag

SEQ ID NO: 139001 - DNA, 75 bp, Artificial Sequence
  Synthetic
gccccgtgtactgcttcacgcccagccctgtggtcgtcggcacaaccgacgcgcttggggtacccacctacgact

SEQ ID NO: 139002 - DNA, 75 bp, Artificial Sequence
  Synthetic
ctgatattaaaggcctgccaacttataggtttggtgtgaacgagtcagatgtcttcttgttgacctctttgagac

SEQ ID NO: 139003 - DNA, 75 bp, Artificial Sequence
  Synthetic
cacatttcttcggaatactccagtcccaagaaacgctccatcaagcactcgacttcgatctttacggagtcacat

SEQ ID NO: 139004 - DNA, 75 bp, Artificial Sequence
  Synthetic
agtctgcggggcccctccctgtttggtgcaaacctccaatggatcctgggcgtgccccaccgactgcttccggaa

SEQ ID NO: 139005 - DNA, 75 bp, Artificial Sequence
  Synthetic
cattgaagcaaatcaaacccaccttaaatgccctaccgattgtttcaggaagcaccatgatgccacgtttacccg

SEQ ID NO: 139006 - DNA, 75 bp, Artificial Sequence
  Synthetic
ccacacacccaatcacaaaatacatcatgacctgtatgtctgctgacctcgaggtgataactagcatgtgggtac

SEQ ID NO: 139007 - DNA, 75 bp, Artificial Sequence
  Synthetic
ggtctccacccttcctcaggccgtgatgggcccctcatacggattccagtactctcctgggcagcgggtcgagtt

SEQ ID NO: 139008 - DNA, 75 bp, Artificial Sequence
  Synthetic
cacgatgcatgatccattacccataccgattatggcactacccatgtacagtcaattacacagtattcaagacca

SEQ ID NO: 139009 - DNA, 75 bp, Artificial Sequence
  Synthetic
agcaccatgatgccacgtttacccgctgcgggtccgggccctggcttacgccaaggtgtctggtagactacccgt

SEQ ID NO: 139010 - DNA, 75 bp, Artificial Sequence
  Synthetic
actctcccggcgaactcaaccgagtggcttcatgtctcaggaagcttgggatgcccccgttgagagcttggagac

SEQ ID NO: 139011 - DNA, 75 bp, Artificial Sequence
  Synthetic
gccggaccgagaggtactttaccagcaatacgacgagatggaggaatgctcacagcgcataccctacctcgtcga

SEQ ID NO: 139012 - DNA, 75 bp, Artificial Sequence
  Synthetic
caatacgacgagatggaggaatgctcacagcgcataccctacctcgtcgagggacaacacctggcagagcagttc

SEQ ID NO: 139013 - DNA, 75 bp, Artificial Sequence
  Synthetic
tgccgttgcctactacaggggtctcgacgtctccgttataccaactcaaggagacgtggtggtcgtcgccaccga

SEQ ID NO: 139014 - DNA, 75 bp, Artificial Sequence
  Synthetic
ccccgcgtattactcctgtgcctactcctactcaccgtaggggtaggcatcttcctgcttcctgctcgataagca

SEQ ID NO: 139015 - DNA, 75 bp, Artificial Sequence
  Synthetic
cctaatccacctccaccagaacatcgtggacgtccagtatctttatggtataggatccactgtggtgtcatgggc

SEQ ID NO: 139016 - DNA, 75 bp, Artificial Sequence
  Synthetic
tggcctaaggtcgaacagttctggcaaaaacacctgtggaacttagtcagcggggtacagtatctcgccggcttg

SEQ ID NO: 139017 - DNA, 75 bp, Artificial Sequence
  Synthetic
tggcctaaggtcgaacagttctggcaaaaacacctgtggaactttgtcagcggggtacagtatctcgccggcttg

SEQ ID NO: 139018 - DNA, 75 bp, Artificial Sequence
  Synthetic
tggcctaaggtcgaacagttctggcaaaaacacctgtggaacttcgtcagcggggtacagtatctcgccggcttg

SEQ ID NO: 139019 - DNA, 75 bp, Artificial Sequence
  Synthetic
tggcctaaggtcgaacagttctggcaaaaacacctgtggaacttggtcagcggggtacagtatctcgccggcttg

SEQ ID NO: 139020 - DNA, 75 bp, Artificial Sequence
  Synthetic
cgtggacgtgcaatacctctatggtgttggttctgccgtagtgggctgggctctcaagtgggagttcgtcgtcct

SEQ ID NO: 139021 - DNA, 75 bp, Artificial Sequence
  Synthetic
ctctcaagtgggagttcgtcgtcctcgtcttcctccttctggcggacgcacgcgtgtgtgtggccctctggatga

SEQ ID NO: 139022 - DNA, 75 bp, Artificial Sequence
  Synthetic
aggtcatcgataccctcacgtgcggcttcgccgacctcatggggtacatcccgctcgtcggcgcccctctaggag

SEQ ID NO: 139023 - DNA, 75 bp, Artificial Sequence
  Synthetic
taggggggtgggtggcgtctcagctggcgccaccctcagcctccacggctttcgtcgtgagtgggctcgccgggg

SEQ ID NO: 139024 - DNA, 75 bp, Artificial Sequence
  Synthetic
ttggggggtgggtggcgtctcagctggcgccaccctcagcctccacggctttcgtcgtgagtgggctcgccgggg

SEQ ID NO: 139025 - DNA, 75 bp, Artificial Sequence
  Synthetic
tcggggggtgggtggcgtctcagctggcgccaccctcagcctccacggctttcgtcgtgagtgggctcgccgggg

SEQ ID NO: 139026 - DNA, 75 bp, Artificial Sequence
  Synthetic
tgggggggtgggtggcgtctcagctggcgccaccctcagcctccacggctttcgtcgtgagtgggctcgccgggg

SEQ ID NO: 139027 - DNA, 75 bp, Artificial Sequence
  Synthetic
cagcgtagtgctctgcgagtgctatgattccggggcagcctggtatgaacttacgcctgctgagactacagtgag

SEQ ID NO: 139028 - DNA, 75 bp, Artificial Sequence
  Synthetic
attctgcgccgcatggcacatccgggggaagctcgttccgctgataacctatggtttgacaggcctgtggcccct

SEQ ID NO: 139029 - DNA, 75 bp, Artificial Sequence
  Synthetic
gactgcccgccacactccagtcaactcctggttggggaatatcatcatgttcgcccctaccatttgggtgcgtat

SEQ ID NO: 139030 - DNA, 75 bp, Artificial Sequence
  Synthetic
agagagcgtacgcttttgatggagaggtagcggggtctctggggggcggcattgtagtcttattgactatattga

SEQ ID NO: 139031 - DNA, 75 bp, Artificial Sequence
  Synthetic
ggatacggggcaggtgtctctggtgctttagtggcctttaagatcatgagtggagaggcaccggcaatcgaagac

SEQ ID NO: 139032 - DNA, 75 bp, Artificial Sequence
  Synthetic
ccagcttccgcttatgaagtgcgcaacgtgtccggagtgtaccatgtcacgaacgactgctccaacacaagcatt

SEQ ID NO: 139033 - DNA, 75 bp, Artificial Sequence
  Synthetic
atactccaagcccaggagcagcttgaaaaagccctagacttcgaaatgtacggggctacctactcagtcactcca

SEQ ID NO: 139034 - DNA, 75 bp, Artificial Sequence
  Synthetic
accttatcaccatggtataagcactggattggccgtcttatctggtggaaccagtatgccatatgcaggggtgag

SEQ ID NO: 139035 - DNA, 75 bp, Artificial Sequence
  Synthetic
ctgtggtacactgctatgttccatccttgagggtcaggggttcccgggactccctagtcatccttgtggcccttt

SEQ ID NO: 139036 - DNA, 75 bp, Artificial Sequence
  Synthetic
ctactcagtggatgaacaggctcatagcgttcgcctctagaggcaaccacgtgtcacccacgcactacgtgcccg

SEQ ID NO: 139037 - DNA, 75 bp, Artificial Sequence
  Synthetic
cggcacattggcccaactgagggggctactcagtggatgaacaggctcatagcgttcgcctctagaggcaaccac

SEQ ID NO: 139038 - DNA, 75 bp, Artificial Sequence
  Synthetic
agcgttcgcctctagaggcaaccacgtgtcacccacgcactacgtgcccgagacggacgcctctcgagctgtcac

SEQ ID NO: 139039 - DNA, 75 bp, Artificial Sequence
  Synthetic
tcacaaagctgctgatagccgtccttgggccactgtatttaatacaagccgcactcaccagcaccccctactttg

SEQ ID NO: 139040 - DNA, 75 bp, Artificial Sequence
  Synthetic
cggggtgtgtcccttgcgttcgcgagggtaacgtctcgaggtgttgggtggcggtgacccccacggtggccacca

SEQ ID NO: 139041 - DNA, 75 bp, Artificial Sequence
  Synthetic
tgactacaccccattccaatatagaggaggtcgccctgccgacaacgggggaaatacccttttacggcaaggcga

SEQ ID NO: 139042 - DNA, 75 bp, Artificial Sequence
  Synthetic
tccgcgcccacgtgttgattcgtatctgcatgttggtgcgctctgcaatgggagggaagtacgtccaaatggccg

SEQ ID NO: 139043 - DNA, 75 bp, Artificial Sequence
  Synthetic
cgcgtgcccgaacccgccatttactcctttgcctactcctacttgccgtaggggtaggcgtatttctcctacctg

SEQ ID NO: 139044 - DNA, 75 bp, Artificial Sequence
  Synthetic
cgcgtgcccgaacccgccatttactcctttgcctactcctacttgccgtaggggtaggcgtttttctcctacctg

SEQ ID NO: 139045 - DNA, 75 bp, Artificial Sequence
  Synthetic
cgcgtgcccgaacccgccatttactcctttgcctactcctacttgccgtaggggtaggcgtctttctcctacctg

SEQ ID NO: 139046 - DNA, 75 bp, Artificial Sequence
  Synthetic
cgcgtgcccgaacccgccatttactcctttgcctactcctacttgccgtaggggtaggcgtgtttctcctacctg

SEQ ID NO: 139047 - DNA, 75 bp, Artificial Sequence
  Synthetic
agcgggggtttaggggggtttggcgcggagacggcgtgtgctacaccacctgtggctgcggagccaatatcacgg

SEQ ID NO: 139048 - DNA, 75 bp, Artificial Sequence
  Synthetic
aatgtctggcatggcaggtttcccatcaacgctaccacgaccggccccagcgtacccatccccgagcctaactac

SEQ ID NO: 139049 - DNA, 75 bp, Artificial Sequence
  Synthetic
cttgtgcgggttgcccgtttcggcgcggttgggccgcgagttgttgctgggtccggctgacgattacaagaagat

SEQ ID NO: 139050 - DNA, 75 bp, Artificial Sequence
  Synthetic
gtgactggtgaggtgcaggtgctgtccacggccacccagaccttcttgggtacgacagtagggggggtcatgtgg

SEQ ID NO: 139051 - DNA, 75 bp, Artificial Sequence
  Synthetic
ccccccgggggtcaagtctttgacgccgtgtgcctgcggcgcctcagacctcttcctggtcacccggcacgcaga

SEQ ID NO: 139052 - DNA, 75 bp, Artificial Sequence
  Synthetic
gtgaaccagagcctgatgtcgtggcggtcacctccatgctcgttgacccagcccacatcacggcggagtcggcac

SEQ ID NO: 139053 - DNA, 75 bp, Artificial Sequence
  Synthetic
gaccaggacctggtaggttggccagcgcctgcggggaccaagtcccttgacccctgcacgtgcggttcttccgac

SEQ ID NO: 139054 - DNA, 75 bp, Artificial Sequence
  Synthetic
cgtgatcccagtgcggcggcgaggcgacacccggggcgcccttctgagccccaggccactctccaccctcaaggg

SEQ ID NO: 139055 - DNA, 75 bp, Artificial Sequence
  Synthetic
tcatccggatgcggagttaattgaggccaacctgctttggcgccaggaggtcggaggtaacatcacgcgggtcga

SEQ ID NO: 139056 - DNA, 75 bp, Artificial Sequence
  Synthetic
gttcttctgggggtcctgtcatgtgcccttcggggcacgtggtggggatcttcagggcggcagtgtgcaccagag

SEQ ID NO: 139057 - DNA, 75 bp, Artificial Sequence
  Synthetic
ttcagggcggcagtgtgcaccagaggtgtcgcaaaagccctgcagttcataccagtggaaactctgagtacgcag

SEQ ID NO: 139058 - DNA, 75 bp, Artificial Sequence
  Synthetic
agacccaaatacccaccggcgttgcccatatgggcgaggcctgactacaatccaccgttggtggaggtctggaag

SEQ ID NO: 139059 - DNA, 75 bp, Artificial Sequence
  Synthetic
ccaaagtccccgccgcttatgttgcacagggatattctgtcctagtgctaaatccatcggtagcggctaccctgg

SEQ ID NO: 139060 - DNA, 75 bp, Artificial Sequence
  Synthetic
gttttggcacgtacatgtcaaaagcctatgggattgaccccaacatccgtacggggacacgcaccatcacaaccg

SEQ ID NO: 139061 - DNA, 75 bp, Artificial Sequence
  Synthetic
cggaggaagaaggtcgtgcagctaaatgactcagctgccgcagctgcactcgcggagcttgctcgcaagagcttt

SEQ ID NO: 139062 - DNA, 75 bp, Artificial Sequence
  Synthetic
cggaggaagaaggtcgtgcagcttaatgactcagctgccgcagctgcactcgcggagcttgctcgcaagagcttt

SEQ ID NO: 139063 - DNA, 75 bp, Artificial Sequence
  Synthetic
cggaggaagaaggtcgtgcagctcaatgactcagctgccgcagctgcactcgcggagcttgctcgcaagagcttt

SEQ ID NO: 139064 - DNA, 75 bp, Artificial Sequence
  Synthetic
cggaggaagaaggtcgtgcagctgaatgactcagctgccgcagctgcactcgcggagcttgctcgcaagagcttt

SEQ ID NO: 139065 - DNA, 75 bp, Artificial Sequence
  Synthetic
acgccggttcgtacagttcaatgccaccacttgagggagagccgggagacccagacctcagttcggggtcatggt

SEQ ID NO: 139066 - DNA, 75 bp, Artificial Sequence
  Synthetic
aaaccctcctttttaacatcttggggggatgggtggcctcacagatcgcaactccgacggcttctacagcatttg

SEQ ID NO: 139067 - DNA, 75 bp, Artificial Sequence
  Synthetic
tgcccagggctggggccccatcagctatgccaacggaagcggccccgaccaacgcccttactgctggcactaccc

SEQ ID NO: 139068 - DNA, 75 bp, Artificial Sequence
  Synthetic
ggcacggtgctggatcaagcagagacagccggggtgaggctgacggtactggcaaccgcgacccctcccggcagc

SEQ ID NO: 139069 - DNA, 75 bp, Artificial Sequence
  Synthetic
tgcgatgactccctccacaccgggttccttgctgcgctgttttacgcgcacaagttcaactcgtccggatgctcg

SEQ ID NO: 139070 - DNA, 75 bp, Artificial Sequence
  Synthetic
gaagacaccttgtattctgccattcaaaggaaaaatgtgacgagctggccagcaagctcagagggatgggggtca

SEQ ID NO: 139071 - DNA, 75 bp, Artificial Sequence
  Synthetic
agcaagctcagagggatgggggtcaacgctgtagcgttttatagaggcctcgacgtgtccgtgatacctgtatcc

SEQ ID NO: 139072 - DNA, 75 bp, Artificial Sequence
  Synthetic
cgctctcatgacgggtttcaccggcgactttgactcagtgatagattgcaacacgtccgtcgtacaaactgtaga

SEQ ID NO: 139073 - DNA, 75 bp, Artificial Sequence
  Synthetic
gctaggctcctctcaacggaggatgcctgcagcttgacccccccccactcggctcgttctagattcgggtacggg

SEQ ID NO: 139074 - DNA, 75 bp, Artificial Sequence
  Synthetic
tatcgtacccgcgtcgcaggtgtgtggcccagtgtattgcttcaccccgagccctgtcgtggtggggacgaccga

SEQ ID NO: 139075 - DNA, 75 bp, Artificial Sequence
  Synthetic
acttcagtctagaccccactttctccattgagacacgcacggttccccaggacgcggtgtcccgaagtcaacgca

SEQ ID NO: 139076 - DNA, 75 bp, Artificial Sequence
  Synthetic
cgtgtgggaggacttgctggaagacagttctacacctatacctacaaccatcatggctaagaatgaggtgttctg

SEQ ID NO: 139077 - DNA, 75 bp, Artificial Sequence
  Synthetic
ggggagcggccgtccggcatgtttgactcggtggtgctatgtgagtgctatgacgcaggttgttcctggtatgac

SEQ ID NO: 139078 - DNA, 75 bp, Artificial Sequence
  Synthetic
tcggtccgctcatggtgctccaggctggcataaccaaagtgccgtactttgtgcgcgcccacgggctcattcgtg

SEQ ID NO: 139079 - DNA, 75 bp, Artificial Sequence
  Synthetic
cagaagctgcccagggcggttatgggatcatcgtatgggttccaatactcgccgaaacaacgggtggattacctc

SEQ ID NO: 139080 - DNA, 75 bp, Artificial Sequence
  Synthetic
ccacctcggaggcgccgcgccaaagtcctgactcaggacaatgtggagggggtccttagggagatggcgaacaaa

SEQ ID NO: 139081 - DNA, 75 bp, Artificial Sequence
  Synthetic
ctaccaagctacggtctgtgccagggcaaaagcccccccaccatcgtgggacaccatgtggaagtgcctcatccg

SEQ ID NO: 139082 - DNA, 75 bp, Artificial Sequence
  Synthetic
ggagtacgtggaggttcgcagagtgggtgatttccattacgtcaccggggtaacacaagataacatcaagtgccc

SEQ ID NO: 139083 - DNA, 75 bp, Artificial Sequence
  Synthetic
gatgagatgtggaaatgtctcatacgcctgaagccgactctgcaaggccctactcctctcctgtataggttagga

SEQ ID NO: 139084 - DNA, 75 bp, Artificial Sequence
  Synthetic
acatctacatgtgctgcaaactagaccctgcagcgcgcaaagccattacatcactcaccgagcggctgtattgtg

SEQ ID NO: 139085 - DNA, 75 bp, Artificial Sequence
  Synthetic
ggactgggcgcacaacggcctgcgagatctggccgtggccgtagagccagtcgtcttctcccagatggagaccaa

SEQ ID NO: 139086 - DNA, 75 bp, Artificial Sequence
  Synthetic
ctggtttgatccacctccaccagaacatcgtggacgtgcaatacctgtacggtgtggggtcagtggttgtctccg

SEQ ID NO: 139087 - DNA, 75 bp, Artificial Sequence
  Synthetic
ggcttgcatgtcagctgacttggaagtcaccacgagcgcctgggtgctggttggtggtgttctagcagccctcgc

SEQ ID NO: 139088 - DNA, 75 bp, Artificial Sequence
  Synthetic
cataaaagcccaagcggcttgcaaagcagccaagctcgagaactttgacatgttggtttgcggagacgacttggt

SEQ ID NO: 139089 - DNA, 75 bp, Artificial Sequence
  Synthetic
acaggctatcgctcagcaattcaaggacaaagtcctcggcttgctgcaaagggcgagccaacaagaagctgaaat

SEQ ID NO: 139090 - DNA, 75 bp, Artificial Sequence
  Synthetic
cacccagaatacgacctggagctgataacatcatgctcttcaaacgtatccgtagcccacgatgacagaggacag

SEQ ID NO: 139091 - DNA, 75 bp, Artificial Sequence
  Synthetic
cgaccacaccactatcccgggccgcctgggaaacggcccggcacactccagtgaactcgtggttgggaaacatca

SEQ ID NO: 139092 - DNA, 75 bp, Artificial Sequence
  Synthetic
ctgggaaacggcccggcacactccagtgaactcgtggttgggaaacatcatcatgtacgcgcccacgatatgggt

SEQ ID NO: 139093 - DNA, 75 bp, Artificial Sequence
  Synthetic
ccctgcctggcaaccccgccatcgcctcacttatgtcattcactgctgccgtcaccagccccttaaccacccagc

SEQ ID NO: 139094 - DNA, 75 bp, Artificial Sequence
  Synthetic
acactgccaggcaaccctgccgtggcttcccttatggccttcaccgcctctgtaaccagccccctcacaaccaac

SEQ ID NO: 139095 - DNA, 75 bp, Artificial Sequence
  Synthetic
cgaccgtccacgggtgtgccttgcctcccagcaagcaaccccctgtccctcctcccaggaggaagcgaacggttc

SEQ ID NO: 139096 - DNA, 75 bp, Artificial Sequence
  Synthetic
ggcattacccctgcactgtcaactttaccatcttcaaggtcaggatgtatgtagggggcgtggagcacaggctca

SEQ ID NO: 139097 - DNA, 75 bp, Artificial Sequence
  Synthetic
ctgtgggaggcataggcattggcagggtgttgcttgacgtgcttgccgggtatggggctggggtctccggcgccc

SEQ ID NO: 139098 - DNA, 75 bp, Artificial Sequence
  Synthetic
gtccttgtcgacatcctcgctggctacggcgctggcgtggctggcgccgtggtcacattcaagatcatgagcggc

SEQ ID NO: 139099 - DNA, 75 bp, Artificial Sequence
  Synthetic
tatggggctggggtctccggcgccctagtggccttcaaaatcatgggaggagagctccctaccacagaggacatg

SEQ ID NO: 139100 - DNA, 75 bp, Artificial Sequence
  Synthetic
cccatcctcgtggatgatgcatccgatgacggatcttattcgtcaatgcctccactagagggggagcccggtgac

SEQ ID NO: 139101 - DNA, 75 bp, Artificial Sequence
  Synthetic
gttcgcatctcgggggaaccatgtatcaccaacacactatgtccccgagagcgacgcggcagcaaaagtaacagc

SEQ ID NO: 139102 - DNA, 75 bp, Artificial Sequence
  Synthetic
gcgcgccccgggcccgaccccgcatgttactcctgtgcctactcctactttccgtaggggtaggcatcttcctgc

SEQ ID NO: 139103 - DNA, 75 bp, Artificial Sequence
  Synthetic
tccgtaggggtaggcatcttcctgcttcccgctcggtaagcgggaagccaaaagcaacactccaataattcgcct

SEQ ID NO: 139104 - DNA, 75 bp, Artificial Sequence
  Synthetic
tccgtaggggtaggcatcttcctgcttcccgctcggtaagcgggaagcctaaagcaacactccaataattcgcct

SEQ ID NO: 139105 - DNA, 75 bp, Artificial Sequence
  Synthetic
tccgtaggggtaggcatcttcctgcttcccgctcggtaagcgggaagcccaaagcaacactccaataattcgcct

SEQ ID NO: 139106 - DNA, 75 bp, Artificial Sequence
  Synthetic
tccgtaggggtaggcatcttcctgcttcccgctcggtaagcgggaagccgaaagcaacactccaataattcgcct

SEQ ID NO: 139107 - DNA, 75 bp, Artificial Sequence
  Synthetic
tctgggactgggtctgcactgtactgtctgacttcagaacgtggctcaaggccaagctcatgccccgcttgcctg

SEQ ID NO: 139108 - DNA, 75 bp, Artificial Sequence
  Synthetic
atctgggactgggtctgtatcgtacttagtgactttaagacctggctttcggccaagatcatgcccaaggtgcca

SEQ ID NO: 139109 - DNA, 75 bp, Artificial Sequence
  Synthetic
acgtaaggaatgggtccatgaggatagcaggatcaggcctctgcgctaacatgtggcatggcaccttccccatca

SEQ ID NO: 139110 - DNA, 75 bp, Artificial Sequence
  Synthetic
agttggcacatcaataggacggccctgaactgcaatgatagccttaacaccggctggatagcagggcttttctac

SEQ ID NO: 139111 - DNA, 75 bp, Artificial Sequence
  Synthetic
gacgctctaatgacgggctttaccggcgactttgactcggtgatcgactgtaatacatgtgtcacccagacagtc

SEQ ID NO: 139112 - DNA, 75 bp, Artificial Sequence
  Synthetic
acccgtccccgcgcacaattactcgcgtgccctgtggcgcgtgacctccgacagttatgtcgaggtgcgtagggt

SEQ ID NO: 139113 - DNA, 75 bp, Artificial Sequence
  Synthetic
ctgggggtcattatgtccaaatggctctcatgaagctagccgcactgacaggcacgtacgtttatgaccatctta

SEQ ID NO: 139114 - DNA, 75 bp, Artificial Sequence
  Synthetic
ggagatttccactatgtgacgggggtaactcaggacaacatcaagtgcccctgccaggttccatcgcccgagttt

SEQ ID NO: 139115 - DNA, 75 bp, Artificial Sequence
  Synthetic
aagggctcattcgtgcatgcatgttagtgcggaaagtcgccgggggtcattatgtccaaatggccttcatgaaac

SEQ ID NO: 139116 - DNA, 75 bp, Artificial Sequence
  Synthetic
ttgtggggtcccagctcccttgtgagcctgagcccgatgtagcggttctgacatcaatgcttaccgacccatctc

SEQ ID NO: 139117 - DNA, 75 bp, Artificial Sequence
  Synthetic
tcacggcctactcccaacagacgcggggcctacttggctgcatcatcactagcctcacaggccgggacaagaacc

SEQ ID NO: 139118 - DNA, 75 bp, Artificial Sequence
  Synthetic
agcctcacaggccgggacaagaaccaggtcgagggggaggtccaagtggtctccaccgcaacacaatccttcctg

SEQ ID NO: 139119 - DNA, 75 bp, Artificial Sequence
  Synthetic
ggcgccttgcgcgcggttcacctccatcggaagctagctcctctgccagccagctctcagctccgtcactgaaag

SEQ ID NO: 139120 - DNA, 75 bp, Artificial Sequence
  Synthetic
aacctgcaccactcaccatgactcccctgatgctgacctaatcgaagccaatctcttgtggaggcaggagatggg

SEQ ID NO: 139121 - DNA, 75 bp, Artificial Sequence
  Synthetic
atctcttgtggaggcaggagatgggaggcaacattaccagggtagagtccgagaacaaggtggtggttttggact

SEQ ID NO: 139122 - DNA, 75 bp, Artificial Sequence
  Synthetic
cgagacgaaggtggtgatccttgactctttcgagcccctgagggccgaagaagacgacacagagctctcgatacc

SEQ ID NO: 139123 - DNA, 75 bp, Artificial Sequence
  Synthetic
acgagggctgcggatgggcagggtggctcctgtccccccgcggctctcgtcctaactggggccccaatgaccccc

SEQ ID NO: 139124 - DNA, 75 bp, Artificial Sequence
  Synthetic
tcaggttgtgctgagagaatggccagctgccgatccctcactgattttgaccagggctggggccccatcagctat

SEQ ID NO: 139125 - DNA, 75 bp, Artificial Sequence
  Synthetic
cgtggtcattgtgggcaggatcatcttgtccgggaagccggctatcattcccgacagggaagtcctctaccagga

SEQ ID NO: 139126 - DNA, 75 bp, Artificial Sequence
  Synthetic
acctacgagccgcccgcagttcacgggtgtgccttgccaccaactcgtcccgcaccagtgcctcccccccgcaga

SEQ ID NO: 139127 - DNA, 75 bp, Artificial Sequence
  Synthetic
gagctggcggctaagtcctttggccggtccgaaccagacaccgattccggaaccggcctaaccaccccaactgac

SEQ ID NO: 139128 - DNA, 75 bp, Artificial Sequence
  Synthetic
cctggcagagagatctttcccgtcgacgaaaccggaagggacaggcacatcctcctcaggagtaggtacagaatc

SEQ ID NO: 139129 - DNA, 75 bp, Artificial Sequence
  Synthetic
atcaatcgcactgccttgaactgcaatgcgagcctcgacaccggctgggtagcggggctcttctattaccacaaa

SEQ ID NO: 139130 - DNA, 75 bp, Artificial Sequence
  Synthetic
ggggagccaggcgatcctgatttgactgcggactcatggtctactgtcagcagcagcgaggacgtcgtgtgttgc

SEQ ID NO: 139131 - DNA, 75 bp, Artificial Sequence
  Synthetic
ctggatgctgactcttggtccaccgtcagtgactccgaagagcagagcgtggtttgctgttctatgtcatactcc

SEQ ID NO: 139132 - DNA, 75 bp, Artificial Sequence
  Synthetic
ctcctcccagcgccgcttctgctttcgtaggcgccggcatcgccggtgcggctgttggcagcataggccttggga

SEQ ID NO: 139133 - DNA, 75 bp, Artificial Sequence
  Synthetic
gatctttctcgagggacactggggtgttatcggtgctgtgttgtattatagtatggttgcaaattgggctaaggt

SEQ ID NO: 139134 - DNA, 75 bp, Artificial Sequence
  Synthetic
ctgcttgcggacgcgcgcgtctgctcttgcttgtggatgatgttactcatatcccaagcggaggcggctttggag

SEQ ID NO: 139135 - DNA, 75 bp, Artificial Sequence
  Synthetic
caaaccttcctcgggactaccatctcaggagtcttgtggaccgtctaccacggggctggcaacaagaccctagcc

SEQ ID NO: 139136 - DNA, 75 bp, Artificial Sequence
  Synthetic
ggggcccaacagaacatccagttgattaacaccaatggtagttggcatgtcaaccgcactgctcttaactgcaat

SEQ ID NO: 139137 - DNA, 75 bp, Artificial Sequence
  Synthetic
acgagtttgcgagaaaaaggcgctctacaatgtcatccaggaactgccgaaggcagtaatgggagacgcctacgg

SEQ ID NO: 139138 - DNA, 75 bp, Artificial Sequence
  Synthetic
acgcgccctatatgacgtgatacagaagttgtcaattgcaacgatggggcctgcctacgggttccaatactcgcc

SEQ ID NO: 139139 - DNA, 75 bp, Artificial Sequence
  Synthetic
tctctcgacagaccgtattgttggcattatccacctaagccctgtgacatcttgcctgcggcaactgtctgtggt

SEQ ID NO: 139140 - DNA, 75 bp, Artificial Sequence
  Synthetic
catatgctcgcggggcgtggccaagtccatagatttcatccccgttgaggcaattgacatcgtcacgcgctcccc

SEQ ID NO: 139141 - DNA, 75 bp, Artificial Sequence
  Synthetic
acgttgatttgccccactgattgcttccgcaaacacccagaagctacctatgcaaagtgtgggtcaggaccgtgg

SEQ ID NO: 139142 - DNA, 75 bp, Artificial Sequence
  Synthetic
gaagacagaacagccctgcgagccttcacggaggccatgaccagatattctgctccccctggagacgccccacag

SEQ ID NO: 139143 - DNA, 75 bp, Artificial Sequence
  Synthetic
cttgaaaggctcctcggggggtccgctgttgtgccccgcgggacacgccgtgggcatattcagggccgcggtgtg

SEQ ID NO: 139144 - DNA, 75 bp, Artificial Sequence
  Synthetic
acccttacaggctgtggcactacccctgcaccgtgaactttaccatccacaaggtgcggatgtatgtggccggcg

SEQ ID NO: 139145 - DNA, 75 bp, Artificial Sequence
  Synthetic
agactcccttagcccgtgcggcttgggagactgctcgccacactccagttaactcctggttgggaaatatcatca

SEQ ID NO: 139146 - DNA, 75 bp, Artificial Sequence
  Synthetic
ccaccggcctgatccatcttcaccagaacgtcgtggacgtacagtacctctatggagtctcttcggcccttgtgt

SEQ ID NO: 139147 - DNA, 75 bp, Artificial Sequence
  Synthetic
agacatcgggccagagctgtccgcgccaagctgattgcccagggggggagagccagaatatgtggcatatacctc

SEQ ID NO: 139148 - DNA, 75 bp, Artificial Sequence
  Synthetic
cattttcatctgctttgcctggcatgttcgtggcaggcttgtccctctcaccacttatgctttgctacagatgtg

SEQ ID NO: 139149 - DNA, 75 bp, Artificial Sequence
  Synthetic
attccgttttccccccggaaaggttttacccagggcgttattaggagtttgggccaccttccagacccccccctc

SEQ ID NO: 139150 - DNA, 75 bp, Artificial Sequence
  Synthetic
tcgacttgctcgttggggcggctgctttctgctccgctatgtacgtgggggatctctgcggatctgttttcctcg

SEQ ID NO: 139151 - DNA, 75 bp, Artificial Sequence
  Synthetic
cctggcgggtcctctctacgtgcttcagtatagcttgctcaaaataccatactttgtaagagcaagcgtcttgct

SEQ ID NO: 139152 - DNA, 75 bp, Artificial Sequence
  Synthetic
gctatggggcaaaggacgtccggaacctatccagcaaggccgttaaccacatccgctccgtgtggaaggacttgc

SEQ ID NO: 139153 - DNA, 75 bp, Artificial Sequence
  Synthetic
caggggtgacaatcgtgcagccctcctcagtccgaggcctatcagcacactgaaggggtcgtcaggcggtcctat

SEQ ID NO: 139154 - DNA, 75 bp, Artificial Sequence
  Synthetic
tgaaggggtcgtcaggcggtcctatgctgtgcccctccggacatgtcgtggggattttccgcgcggctgtatgca

SEQ ID NO: 139155 - DNA, 75 bp, Artificial Sequence
  Synthetic
gctgggtagcgctcactcccacgctcgcggccaggaacgccagcgtccccaccacgacaatacgacgtcacgtcg

SEQ ID NO: 139156 - DNA, 75 bp, Artificial Sequence
  Synthetic
catcaacaggaccgctctgaactgcaatgactccctccagaccgggttcttcgccgcgctgttctacgtaagcag

SEQ ID NO: 139157 - DNA, 75 bp, Artificial Sequence
  Synthetic
acggaccagaggccctactgttggcactacgcacctcgaccgtgcggtattgtacccgcgtcgcaggtgtgtggt

SEQ ID NO: 139158 - DNA, 75 bp, Artificial Sequence
  Synthetic
ttgtcgacttcagccttgatcccaccttcacaattgagaccaccactctgccccaagatgcagtgtctcggagcc

SEQ ID NO: 139159 - DNA, 75 bp, Artificial Sequence
  Synthetic
aggcaactggttcggctgtacatggatgaatagcactgggttcaccaagacgtgcgggggccccccgtgtaacat

SEQ ID NO: 139160 - DNA, 75 bp, Artificial Sequence
  Synthetic
acccctgctgtccagaccaactggcagagactcgagaccttctgggcgaagcatatgtggaacttcatcagtggg

SEQ ID NO: 139161 - DNA, 75 bp, Artificial Sequence
  Synthetic
gcggtcgcaacctcgcggacggcgtcagcctatccccaaggcgcgcccacgcgagggccggtcctgggctcagcc

SEQ ID NO: 139162 - DNA, 75 bp, Artificial Sequence
  Synthetic
gcgagggccggtcctgggctcagcctgggtacccttggcccctctacgggaatgagggctgcggttgggcaggat

SEQ ID NO: 139163 - DNA, 75 bp, Artificial Sequence
  Synthetic
gcactaaagtgccggctgcgtatgcagcccaagggtacaaggtgctcgtcctgaacccgtccgttgccgccacct

SEQ ID NO: 139164 - DNA, 75 bp, Artificial Sequence
  Synthetic
ctgtggcgtcactgatgtctttctcggcatccctcacaagcccgctgtcaacctccacgaccctcctactgaaca

SEQ ID NO: 139165 - DNA, 75 bp, Artificial Sequence
  Synthetic
acaggacggccctgaactgcaacgacagcctcaacaccggctttatagcaggcctcttatacgccaatagattca

SEQ ID NO: 139166 - DNA, 75 bp, Artificial Sequence
  Synthetic
tttgcccagggctggggctctatcgggtacgccagtggaagcaacagcgaacatcgcccctactgctggcactac

SEQ ID NO: 139167 - DNA, 75 bp, Artificial Sequence
  Synthetic
tgcacttacccggatgtgtgccttgcgtcgaagcggacaaccgaacatcgtgctggacaccaatttcaccgacag

SEQ ID NO: 139168 - DNA, 75 bp, Artificial Sequence
  Synthetic
gacatggtcaacctacttccagccctgttatcaccaggcgcgctggtagtgggcgtcgtgtgtgcgggcatcctg

SEQ ID NO: 139169 - DNA, 75 bp, Artificial Sequence
  Synthetic
gggcgtctcagaaaatccagcttataaacaccaatggcagttggcacatcaacaggactgccctgaactgcaatg

SEQ ID NO: 139170 - DNA, 75 bp, Artificial Sequence
  Synthetic
gcctacgagaccttgcggtggcagttgagcccgtcgtcttctctgacatggagaccaagatcatcacctgggggg

SEQ ID NO: 139171 - DNA, 75 bp, Artificial Sequence
  Synthetic
tgagcccgtcgtcttctctgacatggagaccaagatcatcacctggggggcagacaccgcggcgtgtggggacat

SEQ ID NO: 139172 - DNA, 75 bp, Artificial Sequence
  Synthetic
cctctgcggggccgtgttccttgtgggacaagcattcacctttaggccccgtcgacacgtgaccatgcagacgtg

SEQ ID NO: 139173 - DNA, 75 bp, Artificial Sequence
  Synthetic
taatgaatccataaacaccgggttcttagctgggttgttttattatcataagttcaactctaccgggtgctctca

SEQ ID NO: 139174 - DNA, 75 bp, Artificial Sequence
  Synthetic
gactccatgtgctggttcatggttgcgggacatctgggactgggtctgcaccgtgctctccgacttcaagagctg

SEQ ID NO: 139175 - DNA, 75 bp, Artificial Sequence
  Synthetic
atgcgggtgccccagactttctttgacctggttgctggagcccactggggcgtgatggcaggtctcgcctacttt

SEQ ID NO: 139176 - DNA, 75 bp, Artificial Sequence
  Synthetic
gtttcaactcgtccggatgcccagagcgcatggccagctgccgccccatcgatgagttcgctcaggggtggggtc

SEQ ID NO: 139177 - DNA, 75 bp, Artificial Sequence
  Synthetic
tccatgcaaggcaattgggccaaggtcggtattgtgctgatcatgttctcgggagtggatgcggaaacaaacagc

SEQ ID NO: 139178 - DNA, 75 bp, Artificial Sequence
  Synthetic
tccatgcaaggcaattgggccaaggtcggtattgtgctgatcatgttctcgggagtggatgcggaaacatacagc

SEQ ID NO: 139179 - DNA, 75 bp, Artificial Sequence
  Synthetic
tccatgcaaggcaattgggccaaggtcggtattgtgctgatcatgttctcgggagtggatgcggaaacacacagc

SEQ ID NO: 139180 - DNA, 75 bp, Artificial Sequence
  Synthetic
tccatgcaaggcaattgggccaaggtcggtattgtgctgatcatgttctcgggagtggatgcggaaacagacagc

SEQ ID NO: 139181 - DNA, 75 bp, Artificial Sequence
  Synthetic
ttccagtgtggacaggccgtattgttggcactacccacccaggccctgcggtacaaccaatgcatcgacagtttg

SEQ ID NO: 139182 - DNA, 75 bp, Artificial Sequence
  Synthetic
cctgcaagcccctcttgagggatgagatctccttttccgtggggcttaactcctacgcaatcgggtcccaactcc

SEQ ID NO: 139183 - DNA, 75 bp, Artificial Sequence
  Synthetic
ttcttgctggcctccttgagaccccccaaaggtcgatggttcgggtgcgtgtggatgaacagtacggggtatgtg

SEQ ID NO: 139184 - DNA, 75 bp, Artificial Sequence
  Synthetic
accccgatgccacgtacgctcgctgcgggtctgggccgtggctcacgccaaggtgtctagtagactacccgtacc

SEQ ID NO: 139185 - DNA, 75 bp, Artificial Sequence
  Synthetic
accccgatgccacgtacgctcgctgcgggtctgggccgtggctcacgccaaggtgtctagttgactacccgtacc

SEQ ID NO: 139186 - DNA, 75 bp, Artificial Sequence
  Synthetic
accccgatgccacgtacgctcgctgcgggtctgggccgtggctcacgccaaggtgtctagtcgactacccgtacc

SEQ ID NO: 139187 - DNA, 75 bp, Artificial Sequence
  Synthetic
accccgatgccacgtacgctcgctgcgggtctgggccgtggctcacgccaaggtgtctagtggactacccgtacc

SEQ ID NO: 139188 - DNA, 75 bp, Artificial Sequence
  Synthetic
cttgactcatttgaccccgtcacgcctgaatatgatgacagagaaccatccgtgcccgcggagtgtcataggcct

SEQ ID NO: 139189 - DNA, 75 bp, Artificial Sequence
  Synthetic
gagaggggagcgctgcaaccttgaagaccgtgaccgcagcgaacaacatccattgctccactcaacgactgagct

SEQ ID NO: 139190 - DNA, 75 bp, Artificial Sequence
  Synthetic
gagaggggagcgctgctaccttgaagaccgtgaccgcagcgaacaacatccattgctccactcaacgactgagct

SEQ ID NO: 139191 - DNA, 75 bp, Artificial Sequence
  Synthetic
gagaggggagcgctgccaccttgaagaccgtgaccgcagcgaacaacatccattgctccactcaacgactgagct

SEQ ID NO: 139192 - DNA, 75 bp, Artificial Sequence
  Synthetic
gagaggggagcgctgcgaccttgaagaccgtgaccgcagcgaacaacatccattgctccactcaacgactgagct

SEQ ID NO: 139193 - DNA, 75 bp, Artificial Sequence
  Synthetic
gagtggggagcgctgcaaccttgaagaccgtgaccgcagcgaacaacatccattgctccactcaacgactgagct

SEQ ID NO: 139194 - DNA, 75 bp, Artificial Sequence
  Synthetic
gagtggggagcgctgctaccttgaagaccgtgaccgcagcgaacaacatccattgctccactcaacgactgagct

SEQ ID NO: 139195 - DNA, 75 bp, Artificial Sequence
  Synthetic
gagtggggagcgctgccaccttgaagaccgtgaccgcagcgaacaacatccattgctccactcaacgactgagct

SEQ ID NO: 139196 - DNA, 75 bp, Artificial Sequence
  Synthetic
gagtggggagcgctgcgaccttgaagaccgtgaccgcagcgaacaacatccattgctccactcaacgactgagct

SEQ ID NO: 139197 - DNA, 75 bp, Artificial Sequence
  Synthetic
gagcggggagcgctgcaaccttgaagaccgtgaccgcagcgaacaacatccattgctccactcaacgactgagct

SEQ ID NO: 139198 - DNA, 75 bp, Artificial Sequence
  Synthetic
gagcggggagcgctgctaccttgaagaccgtgaccgcagcgaacaacatccattgctccactcaacgactgagct

SEQ ID NO: 139199 - DNA, 75 bp, Artificial Sequence
  Synthetic
gagcggggagcgctgccaccttgaagaccgtgaccgcagcgaacaacatccattgctccactcaacgactgagct

SEQ ID NO: 139200 - DNA, 75 bp, Artificial Sequence
  Synthetic
gagcggggagcgctgcgaccttgaagaccgtgaccgcagcgaacaacatccattgctccactcaacgactgagct

SEQ ID NO: 139201 - DNA, 75 bp, Artificial Sequence
  Synthetic
gaggggggagcgctgcaaccttgaagaccgtgaccgcagcgaacaacatccattgctccactcaacgactgagct

SEQ ID NO: 139202 - DNA, 75 bp, Artificial Sequence
  Synthetic
gaggggggagcgctgctaccttgaagaccgtgaccgcagcgaacaacatccattgctccactcaacgactgagct

SEQ ID NO: 139203 - DNA, 75 bp, Artificial Sequence
  Synthetic
gaggggggagcgctgccaccttgaagaccgtgaccgcagcgaacaacatccattgctccactcaacgactgagct

SEQ ID NO: 139204 - DNA, 75 bp, Artificial Sequence
  Synthetic
gaggggggagcgctgcgaccttgaagaccgtgaccgcagcgaacaacatccattgctccactcaacgactgagct

SEQ ID NO: 139205 - DNA, 75 bp, Artificial Sequence
  Synthetic
tggtccatgggtgtgctttgccctcttcccagccggttccggtaccgccgcccaggctgaagaaggtcgtacgcc

SEQ ID NO: 139206 - DNA, 75 bp, Artificial Sequence
  Synthetic
cgccatatgtagatgcgaggccgctcttcaagtgtgggtcccccccctgcttgcgcgtgggagtagggacggtgt

SEQ ID NO: 139207 - DNA, 75 bp, Artificial Sequence
  Synthetic
cccaggctgaagaaggtcgtacgcctggataattctacagtatcacaagcgcttgcacaactagccaaagagtcc

SEQ ID NO: 139208 - DNA, 75 bp, Artificial Sequence
  Synthetic
gggtctggcgtggtgggctgggctctcaaatgggagttcgtcgtccttgtgttccttctactagcggatgcacgc

SEQ ID NO: 139209 - DNA, 75 bp, Artificial Sequence
  Synthetic
gggtctggcgtggtgggctgggctctcaaatgggagttcgtcgtccttgtgttccttcttctagcggatgcacgc

SEQ ID NO: 139210 - DNA, 75 bp, Artificial Sequence
  Synthetic
gggtctggcgtggtgggctgggctctcaaatgggagttcgtcgtccttgtgttccttctcctagcggatgcacgc

SEQ ID NO: 139211 - DNA, 75 bp, Artificial Sequence
  Synthetic
gggtctggcgtggtgggctgggctctcaaatgggagttcgtcgtccttgtgttccttctgctagcggatgcacgc

SEQ ID NO: 139212 - DNA, 75 bp, Artificial Sequence
  Synthetic
ccccttaatgttcgggggggccgcgatgccatcatccttctcacgtgtgcagtccatccagatctaatctttgac

SEQ ID NO: 139213 - DNA, 75 bp, Artificial Sequence
  Synthetic
gttacctctggtacctggttgtggtttgcgctgcgtggcacatccgaggaaggcttgttccgctgataacttatg

SEQ ID NO: 139214 - DNA, 75 bp, Artificial Sequence
  Synthetic
atttcagcttggaccctaccttcaccattgagacaacgaccgtgccccaagacgcagtgtcgcgctcgcagcggc

SEQ ID NO: 139215 - DNA, 75 bp, Artificial Sequence
  Synthetic
gctcctgctcttcggttttttcaccttgtcaccgtggtataaacactggattggccgtctcatctggtggatcca

SEQ ID NO: 139216 - DNA, 75 bp, Artificial Sequence
  Synthetic
aaactcctctcagtagaggaggcgtgtgacctcactcccccgcactccgcccgttcaaaattcgggtacggggcg

SEQ ID NO: 139217 - DNA, 75 bp, Artificial Sequence
  Synthetic
ggaccggccgatagccttgaaggccaggggtggcgactccttgcgcctatcacggcctattcccaacagacgcgg

SEQ ID NO: 139218 - DNA, 75 bp, Artificial Sequence
  Synthetic
tacccctccctaatttttgacatcacaaaactgctgatagccgtccttgggccactgtacttagtgcaaacagca

SEQ ID NO: 139219 - DNA, 75 bp, Artificial Sequence
  Synthetic
gccactgtacttagtgcaaacagcactcacttgtaccccttactttgtacgcgctcacgtgctgatccgtatctg

SEQ ID NO: 139220 - DNA, 75 bp, Artificial Sequence
  Synthetic
atgcgggactgggctgctgaaggtctcaaagaattggcagtggccacagagcccgtcatcttcagtcctatggag

SEQ ID NO: 139221 - DNA, 75 bp, Artificial Sequence
  Synthetic
caagcaacgggtggatcgattgctcggcatgtggcgctctaagaagacgcccatgggtttttcctatgacaccaa

SEQ ID NO: 139222 - DNA, 75 bp, Artificial Sequence
  Synthetic
tgtggacctattagtaggcgcggccacgatgtgctctgcgctctacgtgggcgatatgtgtggtgctgtcttcct

SEQ ID NO: 139223 - DNA, 75 bp, Artificial Sequence
  Synthetic
gtcgggagcgccaccctctgttcggccctctacgtgggggacctgtgcgggtctgtctttcttgtcggtcaactg

SEQ ID NO: 139224 - DNA, 75 bp, Artificial Sequence
  Synthetic
ccacctttcaggacatcgaatggcttgggacatgatgatgaactggtcccccgctgttggcatggtagtggcgca

SEQ ID NO: 139225 - DNA, 75 bp, Artificial Sequence
  Synthetic
ggtgccggctgcatatgcagcccaagggtacaaggtacttgtcctgaacccgtccgttgccgccactttaggctt

SEQ ID NO: 139226 - DNA, 75 bp, Artificial Sequence
  Synthetic
caggacctagtgggttggccggcgcctgcgggggctaagtctcttgacccctgcacgtgtggctcttccgacctg

SEQ ID NO: 139227 - DNA, 75 bp, Artificial Sequence
  Synthetic
gggcatagcgtatttttccatggtggggaactgggcgaaggtcctggtagtgctgctgctatttgccggcgtcga

SEQ ID NO: 139228 - DNA, 75 bp, Artificial Sequence
  Synthetic
caagcaggacatccagctgatcaacaccaacggcagttggcacatcaatcgcacggccttgaactgcaatgatag

SEQ ID NO: 139229 - DNA, 75 bp, Artificial Sequence
  Synthetic
ccatagtggtctgcggaaccggtgagtacaccggaattgccaggacgaccgggtcctttcttggataaacccgct

SEQ ID NO: 139230 - DNA, 75 bp, Artificial Sequence
  Synthetic
ctaccaggtaggatatcttcatgcccccactggaagcggtaaaagcaccaaagtccccgctgcttatgtagcaca

SEQ ID NO: 139231 - DNA, 75 bp, Artificial Sequence
  Synthetic
ccatcagtggcggctaccctgggctttggcacgtatatgtcaaaagcctatgggattgaccccaacatccgcaca

SEQ ID NO: 139232 - DNA, 75 bp, Artificial Sequence
  Synthetic
tctgtgatgaatgtcatgcgcaagacgccacctccatactgggcataggcacggtgctggatcaagcagagacag

SEQ ID NO: 139233 - DNA, 75 bp, Artificial Sequence
  Synthetic
agcgggggggacatttatcacagcgtgtcccgggctcgaccccgcatgttactcctgtgcctactcctactttcc

SEQ ID NO: 139234 - DNA, 75 bp, Artificial Sequence
  Synthetic
ccttctcgtggtcggtggtttgggtgcgcgtggatgaactccacggggtttctcaagacgtgcggggctccccct

SEQ ID NO: 139235 - DNA, 75 bp, Artificial Sequence
  Synthetic
acggtgctggatcaagcagagacagctggggtgaggctaacagtgctggcaaccgcaaccccccccggcagtatc

SEQ ID NO: 139236 - DNA, 75 bp, Artificial Sequence
  Synthetic
tgtcccgggctcgaccccgcatgttactcctgtgcctactcctactttccgtaggggtaggcatctttctgctcc

SEQ ID NO: 139237 - DNA, 75 bp, Artificial Sequence
  Synthetic
aagctcagagggatgggggtcaacgcggtggcgttttatagaggcctcgacgtatccgtgataccaacatccgga

SEQ ID NO: 139238 - DNA, 75 bp, Artificial Sequence
  Synthetic
cttgccgcgttgttctacacacacagtttcaactcgtccggatgcccggagcgtatgtccagctgccgccccatc

SEQ ID NO: 139239 - DNA, 75 bp, Artificial Sequence
  Synthetic
ttagtctagacccaaccttcaccattgagacacgcacagccccccaagacgcggtatcccgaagccaacgcaggg

SEQ ID NO: 139240 - DNA, 75 bp, Artificial Sequence
  Synthetic
gggggcccactggggagtcctggcgggccttgcctactattccatggtggggaactgggctaaggttttgattgt

SEQ ID NO: 139241 - DNA, 75 bp, Artificial Sequence
  Synthetic
ggccttgcctactattccatggtggggaactgggctaaggttttgattgtgatgctactctttgccggcgttgac

SEQ ID NO: 139242 - DNA, 75 bp, Artificial Sequence
  Synthetic
gggtgagggttctggaggacgggataaattatgcaacggggaatttgcccggttgctccttttctatctttcttt

SEQ ID NO: 139243 - DNA, 75 bp, Artificial Sequence
  Synthetic
caacctgctgagaccacagtacgactgagagcatacctgtccaccccaggcttgcctgtatgtcaggaccatctg

SEQ ID NO: 139244 - DNA, 75 bp, Artificial Sequence
  Synthetic
aacaccagcagttcatacatggcgaccaacgattgctctaactccagcatcgtttggcagctcgaaggcgcagtg

SEQ ID NO: 139245 - DNA, 75 bp, Artificial Sequence
  Synthetic
gggttgctacccatttggcagggccccagagctcttccgcattcgtggtgagcggcttggccggagctgccatag

SEQ ID NO: 139246 - DNA, 75 bp, Artificial Sequence
  Synthetic
ctgtatgtcggccgacttggaagtcaccacgagcgcttgggtactagttggtggtgtattggcggccctcgcagc

SEQ ID NO: 139247 - DNA, 75 bp, Artificial Sequence
  Synthetic
gcacggcgaccgctcctcctgaccagccctccgacgacggcgacgcaggatccgacgttgagtcgtactcctcca

SEQ ID NO: 139248 - DNA, 75 bp, Artificial Sequence
  Synthetic
gatgagatggaagaatgctcccagtctgctccctacatcgagcaagcccaagccattgcccagcagttcaaggac

SEQ ID NO: 139249 - DNA, 75 bp, Artificial Sequence
  Synthetic
agccattgcccagcagttcaaggacaaagtcctcggcctgctgcaaagggcaagtcaacaagaagctgacatccg

SEQ ID NO: 139250 - DNA, 75 bp, Artificial Sequence
  Synthetic
gtcgtcgtcatcctcttgttgaccgctggggtggaggcatccacctacaccaccggggcggttgtcggaagaagc

SEQ ID NO: 139251 - DNA, 75 bp, Artificial Sequence
  Synthetic
gtggatgaaccggctgatagcgttcgcctcgcggggtaaccacgtctcccccacgcactatgtgcctgagagcga

SEQ ID NO: 139252 - DNA, 75 bp, Artificial Sequence
  Synthetic
catgtcaaaaacggttccatgaggatcgctgggcctaaaacctgcagcaacacgtggcatgggacattccccatc

SEQ ID NO: 139253 - DNA, 75 bp, Artificial Sequence
  Synthetic
gcaacgacagtctggaaaccggcttcctcgcggccctgttctataccagctcctttaacagctcaggatgccccg

SEQ ID NO: 139254 - DNA, 75 bp, Artificial Sequence
  Synthetic
gttgcttgacgtgcttgctggatatggggcaggggtctccggtgccttagtggccttcaagatcatggggggaga

SEQ ID NO: 139255 - DNA, 75 bp, Artificial Sequence
  Synthetic
ccaatgatgcagacatgagaccgtactgctggcattatcctcctagaccttgtggcatagttcctgcacggactg

SEQ ID NO: 139256 - DNA, 75 bp, Artificial Sequence
  Synthetic
gcctgcttgtggatgatgctgctgatagcccaggctgaggccgccttagagaacctggtggtcctcaatgcggcg

SEQ ID NO: 139257 - DNA, 75 bp, Artificial Sequence
  Synthetic
gtagggcctggggaaggagcagtgcagtggatgaacagactcatagcgtttgcatctcggggcaaccatgtgtca

SEQ ID NO: 139258 - DNA, 75 bp, Artificial Sequence
  Synthetic
tgtcttcctgctcaacagcacccgcccaccgaagggtgcttggtttgggtgcacgtggatgaacggcaccgggtt

SEQ ID NO: 139259 - DNA, 75 bp, Artificial Sequence
  Synthetic
gcgacctacatcaaatgtggggctgggccgtggttaacaccccggtgcctagtcgattacccctacaggctgtgg

SEQ ID NO: 139260 - DNA, 75 bp, Artificial Sequence
  Synthetic
aatgcggcgtctttggccgggacgcacggtcttgcgtccttcctcgtatttttctgctttgcctggtatctgaag

SEQ ID NO: 139261 - DNA, 75 bp, Artificial Sequence
  Synthetic
gatacaagggggtatggcggggagatggggtgatgacaacacgctgcccttgcggaaaggagctaacaggacatg

SEQ ID NO: 139262 - DNA, 75 bp, Artificial Sequence
  Synthetic
accgctgcaatctcgaggacagggataggagtcagctaagcccgctgctgcactccaccactgaatgggctattc

SEQ ID NO: 139263 - DNA, 75 bp, Artificial Sequence
  Synthetic
aagggctcattcgcgcatgcatgttagtgcggaaaattgccggaggccaatatgtccagatggccttcatgaagc

SEQ ID NO: 139264 - DNA, 75 bp, Artificial Sequence
  Synthetic
cgtccccccccacaattactcacgcgccctgtggcgcgtggcctctgacagttatgtcgaggtgcgaagggtagg

SEQ ID NO: 139265 - DNA, 75 bp, Artificial Sequence
  Synthetic
cgtccccccccacaattactcacgcgccctgtggcgcgtggcctctgacagttatgtcgaggtgcgtagggtagg

SEQ ID NO: 139266 - DNA, 75 bp, Artificial Sequence
  Synthetic
cgtccccccccacaattactcacgcgccctgtggcgcgtggcctctgacagttatgtcgaggtgcgcagggtagg

SEQ ID NO: 139267 - DNA, 75 bp, Artificial Sequence
  Synthetic
cgtccccccccacaattactcacgcgccctgtggcgcgtggcctctgacagttatgtcgaggtgcggagggtagg

SEQ ID NO: 139268 - DNA, 75 bp, Artificial Sequence
  Synthetic
ggctggggccctatcagctacaccaacggaagcggccccgaacaccgcccctattgctggcactaccccccaaag

SEQ ID NO: 139269 - DNA, 75 bp, Artificial Sequence
  Synthetic
agtggcccatctacacgcccccactggcagcggcaagagcactaaggtgccggctgcgtatgcagcccaagggta

SEQ ID NO: 139270 - DNA, 75 bp, Artificial Sequence
  Synthetic
catcacgaagtacgtcgtcaagtgggagtgggtcgttcttctgttcctgcttttggcggacgccagggtttgtgc

SEQ ID NO: 139271 - DNA, 75 bp, Artificial Sequence
  Synthetic
tccctgtctccgcccggctcggtcgggagatcttgctaggtcccgcagatgaatacacatctaaaggttggagac

SEQ ID NO: 139272 - DNA, 75 bp, Artificial Sequence
  Synthetic
tccctgtctccgcccggctcggtcgggagatcttgctaggtcccgcagatgaatacacttctaaaggttggagac

SEQ ID NO: 139273 - DNA, 75 bp, Artificial Sequence
  Synthetic
tccctgtctccgcccggctcggtcgggagatcttgctaggtcccgcagatgaatacacctctaaaggttggagac

SEQ ID NO: 139274 - DNA, 75 bp, Artificial Sequence
  Synthetic
tccctgtctccgcccggctcggtcgggagatcttgctaggtcccgcagatgaatacacgtctaaaggttggagac

SEQ ID NO: 139275 - DNA, 75 bp, Artificial Sequence
  Synthetic
tccctgtctccgcccggctcggtcgggagatcttgctaggtcccgctgatgaatacacatctaaaggttggagac

SEQ ID NO: 139276 - DNA, 75 bp, Artificial Sequence
  Synthetic
tccctgtctccgcccggctcggtcgggagatcttgctaggtcccgctgatgaatacacttctaaaggttggagac

SEQ ID NO: 139277 - DNA, 75 bp, Artificial Sequence
  Synthetic
tccctgtctccgcccggctcggtcgggagatcttgctaggtcccgctgatgaatacacctctaaaggttggagac

SEQ ID NO: 139278 - DNA, 75 bp, Artificial Sequence
  Synthetic
tccctgtctccgcccggctcggtcgggagatcttgctaggtcccgctgatgaatacacgtctaaaggttggagac

SEQ ID NO: 139279 - DNA, 75 bp, Artificial Sequence
  Synthetic
tccctgtctccgcccggctcggtcgggagatcttgctaggtcccgccgatgaatacacatctaaaggttggagac

SEQ ID NO: 139280 - DNA, 75 bp, Artificial Sequence
  Synthetic
tccctgtctccgcccggctcggtcgggagatcttgctaggtcccgccgatgaatacacttctaaaggttggagac

SEQ ID NO: 139281 - DNA, 75 bp, Artificial Sequence
  Synthetic
tccctgtctccgcccggctcggtcgggagatcttgctaggtcccgccgatgaatacacctctaaaggttggagac

SEQ ID NO: 139282 - DNA, 75 bp, Artificial Sequence
  Synthetic
tccctgtctccgcccggctcggtcgggagatcttgctaggtcccgccgatgaatacacgtctaaaggttggagac

SEQ ID NO: 139283 - DNA, 75 bp, Artificial Sequence
  Synthetic
tccctgtctccgcccggctcggtcgggagatcttgctaggtcccgcggatgaatacacatctaaaggttggagac

SEQ ID NO: 139284 - DNA, 75 bp, Artificial Sequence
  Synthetic
tccctgtctccgcccggctcggtcgggagatcttgctaggtcccgcggatgaatacacttctaaaggttggagac

SEQ ID NO: 139285 - DNA, 75 bp, Artificial Sequence
  Synthetic
tccctgtctccgcccggctcggtcgggagatcttgctaggtcccgcggatgaatacacctctaaaggttggagac

SEQ ID NO: 139286 - DNA, 75 bp, Artificial Sequence
  Synthetic
tccctgtctccgcccggctcggtcgggagatcttgctaggtcccgcggatgaatacacgtctaaaggttggagac

SEQ ID NO: 139287 - DNA, 75 bp, Artificial Sequence
  Synthetic
caccgttatgctcctccctgcaagcccttactgagggatgagatcaccttcagcgtgggattgcactcatacgca

SEQ ID NO: 139288 - DNA, 75 bp, Artificial Sequence
  Synthetic
ccgcaggaagagaacaactcgtcctcaggggtcgacactcagtccagcgctacttccaaggtgcccccctctccg

SEQ ID NO: 139289 - DNA, 75 bp, Artificial Sequence
  Synthetic
tatttcatcctcttctttgtagccgcttggtgtattaaaggtcgtgcggtcccgatggtaacgtataccttactg

SEQ ID NO: 139290 - DNA, 75 bp, Artificial Sequence
  Synthetic
ctagagtcctggaaagacccggactacgtccctccagtggtacacgggtgcccattaccacctaccaaggccccc

SEQ ID NO: 139291 - DNA, 75 bp, Artificial Sequence
  Synthetic
cacctatgtttataaccatctcacccctcttcgggactgggcgcacaacggcctacgagatctggccgtggctgt

SEQ ID NO: 139292 - DNA, 75 bp, Artificial Sequence
  Synthetic
gccttgcacgcggttcccctccatcggaagctagctcttctgccagccagctctcagctccgtcgatgaaggcca

SEQ ID NO: 139293 - DNA, 75 bp, Artificial Sequence
  Synthetic
ccataaccgccttcacgatcacaccggcatacaaaatccttctcagccgatgtttgtggtggacgtgctacatgc

SEQ ID NO: 139294 - DNA, 75 bp, Artificial Sequence
  Synthetic
ttcagcctggatcccaccttttccattgagactcgcactgctccccaagacgcagtttcccgcagtcaacgccgg

SEQ ID NO: 139295 - DNA, 75 bp, Artificial Sequence
  Synthetic
cgtctagaagcgcctctcaacgtcagaagaaggtcaccttcgacagactgcaggtgctcgacgaccattacaaga

SEQ ID NO: 139296 - DNA, 75 bp, Artificial Sequence
  Synthetic
gacgaaggtggtgatccttgactcattcgaacccctgagagctgaagaagacgatgctgagctctcagtggcggc

SEQ ID NO: 139297 - DNA, 75 bp, Artificial Sequence
  Synthetic
ggggagcctactttcccccaggcctatttcctacttgaagggctcttctggcggcccactgctctgcccctcggg

SEQ ID NO: 139298 - DNA, 75 bp, Artificial Sequence
  Synthetic
gaagttcgggtacagtgcgaaggacgttcgctccttgtccagcaaggccgttaaccagatccgctccgtctggga

SEQ ID NO: 139299 - DNA, 75 bp, Artificial Sequence
  Synthetic
tacgagccacctgtggttcatggttgtgctctaccaccaactcgtcctacgccggtgcctcccccccgcaaaaag

SEQ ID NO: 139300 - DNA, 75 bp, Artificial Sequence
  Synthetic
ggcggagagaactttcccgtcgacgaaatcggaggggacaggcacttcctcctcaggagtcggtacagaatccac

SEQ ID NO: 139301 - DNA, 75 bp, Artificial Sequence
  Synthetic
taccaagccactgtgtgcgctcgcgcgcaagctcctcccccgagttgggacgagatgtggaagtgtctcgtgcgg

SEQ ID NO: 139302 - DNA, 75 bp, Artificial Sequence
  Synthetic
ggtatctgaagggtaggtgggtgcccggagcggcctacgccttctacgggatgtggcctctcctcctgctcctgt

SEQ ID NO: 139303 - DNA, 75 bp, Artificial Sequence
  Synthetic
ttgctgttccatgtcatactcctggactggcgctataataacaccgtgtagtgccgaggaggaaaaactacctat

SEQ ID NO: 139304 - DNA, 75 bp, Artificial Sequence
  Synthetic
cttctatgggaaagccatccccatcgaggtcatcaaggggggaaggcatctcatcttttgccattccaagaagaa

SEQ ID NO: 139305 - DNA, 75 bp, Artificial Sequence
  Synthetic
gggcctgtcctctgccctaggggccacgccgtcggaatcttccgggcggccgtgtgctccaggggggtcgccaag

SEQ ID NO: 139306 - DNA, 75 bp, Artificial Sequence
  Synthetic
tgcggcgacatcatcaacggcttgcccgtctctgcccgtaggggccgagagatactgctcgggccggccgatgga

SEQ ID NO: 139307 - DNA, 75 bp, Artificial Sequence
  Synthetic
tgggatatctccatgctcccaccggtagcgggaagagtaccaaagtccccgcagcgtatgctgctcaggggtaca

SEQ ID NO: 139308 - DNA, 75 bp, Artificial Sequence
  Synthetic
gtggctttcaagatcatgggaggagagttccccactgctgaagacatggtcaacctattacccgccatactttct

SEQ ID NO: 139309 - DNA, 75 bp, Artificial Sequence
  Synthetic
cacggtgacaactggggatgccatcacctactccacgtacggcaaattcctcgcggatggaggctgctccggcgg

SEQ ID NO: 139310 - DNA, 75 bp, Artificial Sequence
  Synthetic
tatgcgctgccattttacgtcgacacgtaggacccggggagggggcggtacaatggatgaacaggctcatcgcat

SEQ ID NO: 139311 - DNA, 75 bp, Artificial Sequence
  Synthetic
cgtaggacccggggagggggcggtacaatggatgaacaggctcatcgcatttgcatcccggggcaatcacgtctc

SEQ ID NO: 139312 - DNA, 75 bp, Artificial Sequence
  Synthetic
gtgcggctaccgccgctgccgcgccagcggcgtcctgcctaccagctttggtaatacaataacctgttacattaa

SEQ ID NO: 139313 - DNA, 75 bp, Artificial Sequence
  Synthetic
tgaccaagctgagacggcaggggttaggttgacagtcctggccacagcaaccccaccagggtctgtgacaactcc

SEQ ID NO: 139314 - DNA, 75 bp, Artificial Sequence
  Synthetic
caatgactccctcaagaccgggttcatcgccgggctgatctacaagtacaagttcaactcgaccggatgcccaga

SEQ ID NO: 139315 - DNA, 75 bp, Artificial Sequence
  Synthetic
gacagaacaactctgcgagccttcacggaggctatgaccagatattctgcccctcccggagacgccccacagccc

SEQ ID NO: 139316 - DNA, 75 bp, Artificial Sequence
  Synthetic
ggttacagcgggggagacatatatcacagcctgtctcgtgcccgaccccgctggttcatgttgtgcctactccta

SEQ ID NO: 139317 - DNA, 75 bp, Artificial Sequence
  Synthetic
ctaagatcatgccaacactccctggactgccctttatttcctgtcaaaagggatataagggcgtgtggcgggggg

SEQ ID NO: 139318 - DNA, 75 bp, Artificial Sequence
  Synthetic
cggttcggaccagaggccctattgctggcactacgcacccaaaccgtgtagtgttgtgcccgcgtcgcaggtgtg

SEQ ID NO: 139319 - DNA, 75 bp, Artificial Sequence
  Synthetic
cacccaagtcgtggacttcagtttagaccctacttttaccataaccacacaaactgtcccccaggactccgtgtc

SEQ ID NO: 139320 - DNA, 75 bp, Artificial Sequence
  Synthetic
atactgcaagcccaggagcagcttgaaaaagccctagactttgaaatgtacggggctacctattcagtcactccg

SEQ ID NO: 139321 - DNA, 75 bp, Artificial Sequence
  Synthetic
cttccacctccacagtcccctcctgtgcctccgcctcggaagaagcggacggtggtcctcaccgaatcaacccta

SEQ ID NO: 139322 - DNA, 75 bp, Artificial Sequence
  Synthetic
agttaggatgtatgtagggggtgtagaacacaggctcaacgccgcgtgcaattggactcggggagagcgctgcaa

SEQ ID NO: 139323 - DNA, 75 bp, Artificial Sequence
  Synthetic
atctcagcgacgggtcatggtcgacggtcagtagtgaggccggcacggaggatgtcgtgtgctgctcaatgtctt

SEQ ID NO: 139324 - DNA, 75 bp, Artificial Sequence
  Synthetic
tagttggtttacggtcggcgtcggcgggaacgacatttatcacagcgtgtcgcgtgcccgagcccgccatttact

SEQ ID NO: 139325 - DNA, 75 bp, Artificial Sequence
  Synthetic
tccatggtggggaactgggctaaggtcttgattgtgatgctactctttgccggcgttgacgggacgacccacacg

SEQ ID NO: 139326 - DNA, 75 bp, Artificial Sequence
  Synthetic
ccgacgctgagctagtggatgccaacttgctatggcgacaagagatgggtagtaacatcacacgggtagagtctg

SEQ ID NO: 139327 - DNA, 75 bp, Artificial Sequence
  Synthetic
cctgtgcctactcctactcactgtaggggtaggcattttcctcctacccgctcggtgagccggtaggtcaacact

SEQ ID NO: 139328 - DNA, 75 bp, Artificial Sequence
  Synthetic
cttgtaaacaccaacggcagctggcacatcaacagaactgccctgaactgcaacgactccctcaacaccgggttc

SEQ ID NO: 139329 - DNA, 75 bp, Artificial Sequence
  Synthetic
caacgactccctcaacaccgggttcattgccgcgctgttctatgcacataggtttaactcgtctggatgctcaga

SEQ ID NO: 139330 - DNA, 75 bp, Artificial Sequence
  Synthetic
taatggcagctacggtctgttcggccttgtacgtgggagacgtgtgcggggccgtgatgatcgtgtcgcaggctt

SEQ ID NO: 139331 - DNA, 75 bp, Artificial Sequence
  Synthetic
tcctttatgaggcatttgatgagatggaggaatgtgcctctaggaccgccctcatcgaggaggggcatcggatag

SEQ ID NO: 139332 - DNA, 75 bp, Artificial Sequence
  Synthetic
tgttcttctgcgctgcctggtacatcaagggcagactggtccccggggtggcatatgccttctacggcgtatggc

SEQ ID NO: 139333 - DNA, 75 bp, Artificial Sequence
  Synthetic
gctggaagacactgagacaccaattgacactaccatcatggcaaagaatgaggttttctgcgtccaaccagagaa

SEQ ID NO: 139334 - DNA, 75 bp, Artificial Sequence
  Synthetic
gcaattctgggccaagcacatgtggaacttcatcagtggcatccagtaccttgcggggctgtccacgttaccggg

SEQ ID NO: 139335 - DNA, 75 bp, Artificial Sequence
  Synthetic
cgaggcccttttgcaagtgtgggtcccccccctcaacgtccggggaggccgcgatgccatcatcctcctcacgtg

SEQ ID NO: 139336 - DNA, 75 bp, Artificial Sequence
  Synthetic
gacctgccccacggactgcttccggaagcaccccgaggccacttacaccaaatgcggttcggggccttggctgac

SEQ ID NO: 139337 - DNA, 75 bp, Artificial Sequence
  Synthetic
ccttaacatcatgggggggtggctcgcttcccaaattgctccccctgcaggggccactggcttcgtcgtcagtgg

SEQ ID NO: 139338 - DNA, 75 bp, Artificial Sequence
  Synthetic
gtgcgcgctcaagggctcattcgtgcgtgcatgttggtgcggaaagttgctgggggtcattacgtccagatggct

SEQ ID NO: 139339 - DNA, 75 bp, Artificial Sequence
  Synthetic
acccccaggtgcctgatagaatacccttataggctgtggcattatccgtgcactgtaaatttcaccatcttcaag

SEQ ID NO: 139340 - DNA, 75 bp, Artificial Sequence
  Synthetic
ttgcactccgctagcgccgctagtgccaatgggccgctgtggttcttcatcttctttacagcggcctggtactta

SEQ ID NO: 139341 - DNA, 75 bp, Artificial Sequence
  Synthetic
gcgcgtctgcgcctgcttgtggatgatgctgctgatagctcaggctgaggccgccttagagaacctggtggtcct

SEQ ID NO: 139342 - DNA, 75 bp, Artificial Sequence
  Synthetic
tggcgccaggagatgggcgggaacatcacccgtgtggagtcagagaataaggtagtaatcctggactcttttgac

SEQ ID NO: 139343 - DNA, 75 bp, Artificial Sequence
  Synthetic
gcgtctctgctacgggtaccatactttgtgagggctcacgctctgctacgagtgtgcaccctggtgagacacctc

SEQ ID NO: 139344 - DNA, 75 bp, Artificial Sequence
  Synthetic
gggacatgggccggtactggtattatgactacacggtgtccatgcggtgccaacatcaccggcaacgtccgcttg

SEQ ID NO: 139345 - DNA, 75 bp, Artificial Sequence
  Synthetic
ggcaccatgagaatatcaggacctaagacctgcttgaatacctggcaggggacattccccatcaactgttacacg

SEQ ID NO: 139346 - DNA, 75 bp, Artificial Sequence
  Synthetic
cgtatgtgacagggttgacagcagacaacctaaaggttccttgccagctgccatgtccggagtttttctcctggg

SEQ ID NO: 139347 - DNA, 75 bp, Artificial Sequence
  Synthetic
gagcaggctgggcaggtccaggttctgtcctctgtcacacaatctttcttggggacatctatttcgggggtcctc

SEQ ID NO: 139348 - DNA, 75 bp, Artificial Sequence
  Synthetic
gacacggaggtgttggcatccatgctgacagacccgtcccacattacggccgaggcggcggcgagacgcctggcc

SEQ ID NO: 139349 - DNA, 75 bp, Artificial Sequence
  Synthetic
tggaggtcattatgtccaaatggccttcatgaagctggccgcactgacaggtacgtacgtttatgaccatcttac

SEQ ID NO: 139350 - DNA, 75 bp, Artificial Sequence
  Synthetic
acatggtggatgccaatctcttctgctggtgtactatgggaggcaatatgactcgcatagagtctgagtctaagg

SEQ ID NO: 139351 - DNA, 75 bp, Artificial Sequence
  Synthetic
caagttcaactcatccagagccgagagcgtattggccagctgccgcttcatcgacgagttcgatcagggatgggg

SEQ ID NO: 139352 - DNA, 75 bp, Artificial Sequence
  Synthetic
gagccttcaataccatcagagtacttgcttcccaaaagcagattcccaccagcactaccaccctgggcgcggcct

SEQ ID NO: 139353 - DNA, 75 bp, Artificial Sequence
  Synthetic
ttcggaggcgggatccgtgtcttccatgcccccccttgagggggagcctggagacccagacctggagcctgagca

SEQ ID NO: 139354 - DNA, 75 bp, Artificial Sequence
  Synthetic
ttggaggacagggatagatcagagcttagtccgctgctgctgtctacgacagagtggcagatactgccctgttcc

SEQ ID NO: 139355 - DNA, 75 bp, Artificial Sequence
  Synthetic
gtcaaggagtgcctcacaacgggcgaaaaaggtgactttcgacagggtgcaactactagactctcattatgaatc

SEQ ID NO: 139356 - DNA, 75 bp, Artificial Sequence
  Synthetic
cagccttgtccaccggcctcatccacctccaccagaacatcgtggacgtgcagtacctgtacggggtggggtcaa

SEQ ID NO: 139357 - DNA, 75 bp, Artificial Sequence
  Synthetic
tccactctaccgggaaatcccgcagtggcatcaatgatggctttcagcgccgcattgactagcccactacccacc

SEQ ID NO: 139358 - DNA, 75 bp, Artificial Sequence
  Synthetic
ctcacacaccccataaccaaatacatcatggcatgcatgtcggctgacctggaggtcgtcacgagcacctgggtg

SEQ ID NO: 139359 - DNA, 75 bp, Artificial Sequence
  Synthetic
cgcattgactagcccactacccaccagcaccaccatcctcttgaacatcatggggggatggttggcctcccagat

SEQ ID NO: 139360 - DNA, 75 bp, Artificial Sequence
  Synthetic
gccgcgatgatcgtgtcgcaggctctcatagtatcgccagagcgccacaacttcacccaagagtgcaactgttcc

SEQ ID NO: 139361 - DNA, 75 bp, Artificial Sequence
  Synthetic
gctgctcctgctcctgctggcgttaccaccacgagcttacgccatggaccgggagatggctgcatcgtgcggagg

SEQ ID NO: 139362 - DNA, 75 bp, Artificial Sequence
  Synthetic
ctctatgacataacacagaagcttcccgtcgcagtgatggggcagtcctacggattccagtactctccagcccag

SEQ ID NO: 139363 - DNA, 75 bp, Artificial Sequence
  Synthetic
ggagttcgatgagatggaagagtgtgcctcacacctcccttacatcgaacaggggatgcagctcgccgagcaatt

SEQ ID NO: 139364 - DNA, 75 bp, Artificial Sequence
  Synthetic
ggcttggcctatttctccatgcagggagcgtgggccaaagtcattgccatcctccttcttgttgcgggagtggat

SEQ ID NO: 139365 - DNA, 75 bp, Artificial Sequence
  Synthetic
tgctcacctctttgcccgtggtccccaacagaagctccatttagtcaatagcaatggcagctggcacataaaccg

SEQ ID NO: 139366 - DNA, 75 bp, Artificial Sequence
  Synthetic
cgaactgctatacactcactgactgagagactatacgtagggggccccatgacaaacagcaaagggcaatcctgc

SEQ ID NO: 139367 - DNA, 75 bp, Artificial Sequence
  Synthetic
cgtgccaaaaccccctcctaattataagaccgcaatttggagggtggcagcgtcggagtacgttgaggtcacgca

SEQ ID NO: 139368 - DNA, 75 bp, Artificial Sequence
  Synthetic
aatggcgctgactctgtcaccacattacaagcactatatcagctggtgcttgtggtggcttcagtattttctgac

SEQ ID NO: 139369 - DNA, 75 bp, Artificial Sequence
  Synthetic
agcttggttcggctgcacttggatgaacgggactgggttcaccaagacatgcggagcaccaccttgccgcattag

SEQ ID NO: 139370 - DNA, 75 bp, Artificial Sequence
  Synthetic
actcgccagggctgcctgggagacagcaagacactcccctgtcaattcatggctgggaaacatcatccagtacgc

SEQ ID NO: 139371 - DNA, 75 bp, Artificial Sequence
  Synthetic
gcggagcaccaccttgccgcattaggagagactacaacagcactcttgatctattgtgccccacagactgtttta

SEQ ID NO: 139372 - DNA, 75 bp, Artificial Sequence
  Synthetic
ctaatgacacacttcttctccgtcttgatggcccaggataccctggaccaggatctcaacttcgaaatgtacgga

SEQ ID NO: 139373 - DNA, 75 bp, Artificial Sequence
  Synthetic
gtgcggatgtatgtagggggggtggagcatcggttgtccgcagcatgtaacttcacgcgcggagaccgctgcaga

SEQ ID NO: 139374 - DNA, 75 bp, Artificial Sequence
  Synthetic
gggggatgggtggccgcccaactcgctccccccagcgctgcctctgccttcgtgggcgccggcatcgccggtgcg

SEQ ID NO: 139375 - DNA, 75 bp, Artificial Sequence
  Synthetic
ggcctactcctgctttgcgtaggggtaggcatcttcctactccccgctcggtagagcggcacatttagctacact

SEQ ID NO: 139376 - DNA, 75 bp, Artificial Sequence
  Synthetic
gctgaggagtatgtggaggttacgcgggtaggggatttccactacgtgacgggcatgaccactgacaacgtaaag

SEQ ID NO: 139377 - DNA, 75 bp, Artificial Sequence
  Synthetic
cccgaggaggagaagttgccgatcaaccctctgagtaattcgctcatgcggttccataacaaggtgtactccact

SEQ ID NO: 139378 - DNA, 75 bp, Artificial Sequence
  Synthetic
tgcgcgcgacgaggaagacttcggaacggtcccaggccagaggtaggcgccaaccaatacctaaggcgcgccaga

SEQ ID NO: 139379 - DNA, 75 bp, Artificial Sequence
  Synthetic
tcgcctcatcgtataccccgaccttggggtcagggtgtgcgaaaagatggccctctatgacattgcacaaaagct

SEQ ID NO: 139380 - DNA, 75 bp, Artificial Sequence
  Synthetic
atggggcgccttgcaatatgaggataatgtcaccaatccagaggatatgagaccctattgctggcactacccacc

SEQ ID NO: 139381 - DNA, 75 bp, Artificial Sequence
  Synthetic
acggtcccaggccagaggtaggcgccaaccaatacctaaggcgcgccagaaccaaggccgaacctgggctcagcc

SEQ ID NO: 139382 - DNA, 75 bp, Artificial Sequence
  Synthetic
ccaacggcagctggcacatcaacaggactgccctgaactgcaatgactccctccaaactgggttccttgccgcgc

SEQ ID NO: 139383 - DNA, 75 bp, Artificial Sequence
  Synthetic
gccatccccatcgaggtcatcaaggggggaaggcatctcatcttctgccattccaagaagaagtgtgacgagctc

SEQ ID NO: 139384 - DNA, 75 bp, Artificial Sequence
  Synthetic
ctccaaactgggttccttgccgcgctgttctacacacacaggttcaacgcgtccggatgcccagagcgtatggcc

SEQ ID NO: 139385 - DNA, 75 bp, Artificial Sequence
  Synthetic
cagagagccaaggtaacgaggaggacgagcgaaacctgagagctttcacggaggctatgaccaggtattccgccc

SEQ ID NO: 139386 - DNA, 75 bp, Artificial Sequence
  Synthetic
catgtcaaaaacggttccatgaggatcgtcgggcctagaacctgcagcaacacgtggcatggaacgttccccatc

SEQ ID NO: 139387 - DNA, 75 bp, Artificial Sequence
  Synthetic
tcgtcgggcctagaacctgcagcaacacgtggcatggaacgttccccatcaacgcgtacaccacgggcccctgca

SEQ ID NO: 139388 - DNA, 75 bp, Artificial Sequence
  Synthetic
ggcacttctctcttgcctcaccacacctgcctcagcactaaattatgccaacaagtctgggctgtatcacctaac

SEQ ID NO: 139389 - DNA, 75 bp, Artificial Sequence
  Synthetic
gactgggcgcacaacggcctacgagatctggccgtagctgtggagccagtcgtcttctcccgaatggagaccaag

SEQ ID NO: 139390 - DNA, 75 bp, Artificial Sequence
  Synthetic
tgcacctcccgggctgtgtcccctgtgtgaagaccggcaatctgactaagtgttggttgtcggcctctccgacac

SEQ ID NO: 139391 - DNA, 75 bp, Artificial Sequence
  Synthetic
acacgcggccgccgcaaggcaactggttcggctgtacatggatgaatagcaccgggttcaccaagacgtgcgggg

SEQ ID NO: 139392 - DNA, 75 bp, Artificial Sequence
  Synthetic
tggcggtgcggaatgcgtcggtgcccatcagggggatccgcgaacatgtggacctcttggtgggtgctgctgcgt

SEQ ID NO: 139393 - DNA, 75 bp, Artificial Sequence
  Synthetic
tggacagtataccatggggctggcaataagaccttggccggccccaagggaccagtcactcagatgtacaccagc

SEQ ID NO: 139394 - DNA, 75 bp, Artificial Sequence
  Synthetic
accagtcactcagatgtacaccagcgcagagggggacctcgtgggatggcctagcccccccgggactaagtcatt

SEQ ID NO: 139395 - DNA, 75 bp, Artificial Sequence
  Synthetic
taactgttccatttatgcgggccacatcaccgggcaccggatggcgtgggacatgatgatgaattggtcaccaac

SEQ ID NO: 139396 - DNA, 75 bp, Artificial Sequence
  Synthetic
ttcctgctcttagcggacgccagggtttgcgcctgcttatggatgctcatcttgttgggccaggccgaagcagca

SEQ ID NO: 139397 - DNA, 75 bp, Artificial Sequence
  Synthetic
cgtgctcgctgggctgctgtattacagcatggcgaccaactgggctaaggttatcggcatcctcctcctgttctc

SEQ ID NO: 139398 - DNA, 75 bp, Artificial Sequence
  Synthetic
tcccgacagggaagtcctctaccgggagttcgatgaaatggaagagtgcgcttcacacctcccttacatcgaaca

SEQ ID NO: 139399 - DNA, 75 bp, Artificial Sequence
  Synthetic
ctgatcaataccaacggaagctggcacatcaacaggacagcgttgaactgcaatgatagccttaacaccggctgg

SEQ ID NO: 139400 - DNA, 75 bp, Artificial Sequence
  Synthetic
ccatcacatacgagaacatcagtggtccctcagaagacaggccatactgttggcactacgcacctagaccatgca

SEQ ID NO: 139401 - DNA, 75 bp, Artificial Sequence
  Synthetic
gtggcagcttgagggtgcggtactacatgttcctggttgtatcccctgtgaattgataggcaacgtgtcgcggtg

SEQ ID NO: 139402 - DNA, 75 bp, Artificial Sequence
  Synthetic
gtggcagcttgagggtgcggtactacatgttcctggttgtatcccctgtgatttgataggcaacgtgtcgcggtg

SEQ ID NO: 139403 - DNA, 75 bp, Artificial Sequence
  Synthetic
gtggcagcttgagggtgcggtactacatgttcctggttgtatcccctgtgacttgataggcaacgtgtcgcggtg

SEQ ID NO: 139404 - DNA, 75 bp, Artificial Sequence
  Synthetic
gtggcagcttgagggtgcggtactacatgttcctggttgtatcccctgtgagttgataggcaacgtgtcgcggtg

SEQ ID NO: 139405 - DNA, 75 bp, Artificial Sequence
  Synthetic
gtggcagcttgagggtgcggtacttcatgttcctggttgtatcccctgtgaattgataggcaacgtgtcgcggtg

SEQ ID NO: 139406 - DNA, 75 bp, Artificial Sequence
  Synthetic
gtggcagcttgagggtgcggtacttcatgttcctggttgtatcccctgtgatttgataggcaacgtgtcgcggtg

SEQ ID NO: 139407 - DNA, 75 bp, Artificial Sequence
  Synthetic
gtggcagcttgagggtgcggtacttcatgttcctggttgtatcccctgtgacttgataggcaacgtgtcgcggtg

SEQ ID NO: 139408 - DNA, 75 bp, Artificial Sequence
  Synthetic
gtggcagcttgagggtgcggtacttcatgttcctggttgtatcccctgtgagttgataggcaacgtgtcgcggtg

SEQ ID NO: 139409 - DNA, 75 bp, Artificial Sequence
  Synthetic
gtggcagcttgagggtgcggtactccatgttcctggttgtatcccctgtgaattgataggcaacgtgtcgcggtg

SEQ ID NO: 139410 - DNA, 75 bp, Artificial Sequence
  Synthetic
gtggcagcttgagggtgcggtactccatgttcctggttgtatcccctgtgatttgataggcaacgtgtcgcggtg

SEQ ID NO: 139411 - DNA, 75 bp, Artificial Sequence
  Synthetic
gtggcagcttgagggtgcggtactccatgttcctggttgtatcccctgtgacttgataggcaacgtgtcgcggtg

SEQ ID NO: 139412 - DNA, 75 bp, Artificial Sequence
  Synthetic
gtggcagcttgagggtgcggtactccatgttcctggttgtatcccctgtgagttgataggcaacgtgtcgcggtg

SEQ ID NO: 139413 - DNA, 75 bp, Artificial Sequence
  Synthetic
gtggcagcttgagggtgcggtactgcatgttcctggttgtatcccctgtgaattgataggcaacgtgtcgcggtg

SEQ ID NO: 139414 - DNA, 75 bp, Artificial Sequence
  Synthetic
gtggcagcttgagggtgcggtactgcatgttcctggttgtatcccctgtgatttgataggcaacgtgtcgcggtg

SEQ ID NO: 139415 - DNA, 75 bp, Artificial Sequence
  Synthetic
gtggcagcttgagggtgcggtactgcatgttcctggttgtatcccctgtgacttgataggcaacgtgtcgcggtg

SEQ ID NO: 139416 - DNA, 75 bp, Artificial Sequence
  Synthetic
gtggcagcttgagggtgcggtactgcatgttcctggttgtatcccctgtgagttgataggcaacgtgtcgcggtg

SEQ ID NO: 139417 - DNA, 75 bp, Artificial Sequence
  Synthetic
caacggtcaccgagaatgacatccgtgttgaggagtcaatttaccaatgttgtgacttggcccccgaagccagac

SEQ ID NO: 139418 - DNA, 75 bp, Artificial Sequence
  Synthetic
tgctccgccctttacgtaggggatgtttgtggtgcgataatgatagcggcccaagcattcatcatttcgccgcag

SEQ ID NO: 139419 - DNA, 75 bp, Artificial Sequence
  Synthetic
tgctccgccctttacgtaggggatgtttgtggtgcgattatgatagcggcccaagcattcatcatttcgccgcag

SEQ ID NO: 139420 - DNA, 75 bp, Artificial Sequence
  Synthetic
tgctccgccctttacgtaggggatgtttgtggtgcgatcatgatagcggcccaagcattcatcatttcgccgcag

SEQ ID NO: 139421 - DNA, 75 bp, Artificial Sequence
  Synthetic
tgctccgccctttacgtaggggatgtttgtggtgcgatgatgatagcggcccaagcattcatcatttcgccgcag

SEQ ID NO: 139422 - DNA, 75 bp, Artificial Sequence
  Synthetic
tgctccgccctttacgtaggggatgtttgtggtgcgttaatgatagcggcccaagcattcatcatttcgccgcag

SEQ ID NO: 139423 - DNA, 75 bp, Artificial Sequence
  Synthetic
tgctccgccctttacgtaggggatgtttgtggtgcgtttatgatagcggcccaagcattcatcatttcgccgcag

SEQ ID NO: 139424 - DNA, 75 bp, Artificial Sequence
  Synthetic
tgctccgccctttacgtaggggatgtttgtggtgcgttcatgatagcggcccaagcattcatcatttcgccgcag

SEQ ID NO: 139425 - DNA, 75 bp, Artificial Sequence
  Synthetic
tgctccgccctttacgtaggggatgtttgtggtgcgttgatgatagcggcccaagcattcatcatttcgccgcag

SEQ ID NO: 139426 - DNA, 75 bp, Artificial Sequence
  Synthetic
tgctccgccctttacgtaggggatgtttgtggtgcgctaatgatagcggcccaagcattcatcatttcgccgcag

SEQ ID NO: 139427 - DNA, 75 bp, Artificial Sequence
  Synthetic
tgctccgccctttacgtaggggatgtttgtggtgcgcttatgatagcggcccaagcattcatcatttcgccgcag

SEQ ID NO: 139428 - DNA, 75 bp, Artificial Sequence
  Synthetic
tgctccgccctttacgtaggggatgtttgtggtgcgctcatgatagcggcccaagcattcatcatttcgccgcag

SEQ ID NO: 139429 - DNA, 75 bp, Artificial Sequence
  Synthetic
tgctccgccctttacgtaggggatgtttgtggtgcgctgatgatagcggcccaagcattcatcatttcgccgcag

SEQ ID NO: 139430 - DNA, 75 bp, Artificial Sequence
  Synthetic
tgctccgccctttacgtaggggatgtttgtggtgcggtaatgatagcggcccaagcattcatcatttcgccgcag

SEQ ID NO: 139431 - DNA, 75 bp, Artificial Sequence
  Synthetic
tgctccgccctttacgtaggggatgtttgtggtgcggttatgatagcggcccaagcattcatcatttcgccgcag

SEQ ID NO: 139432 - DNA, 75 bp, Artificial Sequence
  Synthetic
tgctccgccctttacgtaggggatgtttgtggtgcggtcatgatagcggcccaagcattcatcatttcgccgcag

SEQ ID NO: 139433 - DNA, 75 bp, Artificial Sequence
  Synthetic
tgctccgccctttacgtaggggatgtttgtggtgcggtgatgatagcggcccaagcattcatcatttcgccgcag

SEQ ID NO: 139434 - DNA, 75 bp, Artificial Sequence
  Synthetic
ttggggtgagaatgagactgacgtgttcctgctcgagagtttgcggccaccgaagggaggatggtacggctgcac

SEQ ID NO: 139435 - DNA, 75 bp, Artificial Sequence
  Synthetic
gtggatgaactctacggggttcgtcaaaacgtgcggtgcgccaccatgtaacattgggccgccctctaacagcac

SEQ ID NO: 139436 - DNA, 75 bp, Artificial Sequence
  Synthetic
cactcgtggcctttaaggtcatgagtggcgaggtgccctccaccgaggatctggttaatttacttcctgccatcc

SEQ ID NO: 139437 - DNA, 75 bp, Artificial Sequence
  Synthetic
ttcgggggggccgcgatgccatcatcctcctcatgtgtgtggcccatccagagctaatttttgaaatcaccaaaa

SEQ ID NO: 139438 - DNA, 75 bp, Artificial Sequence
  Synthetic
ccacgatgatcatggcgtacctcatgcgcatccctgaagtcgttctggacatcatcacaggagcgcactggggcg

SEQ ID NO: 139439 - DNA, 75 bp, Artificial Sequence
  Synthetic
ccacgatgatcatggcgtacctcatgcgcatccctgaagtcgttctggacatcatcactggagcgcactggggcg

SEQ ID NO: 139440 - DNA, 75 bp, Artificial Sequence
  Synthetic
ccacgatgatcatggcgtacctcatgcgcatccctgaagtcgttctggacatcatcaccggagcgcactggggcg

SEQ ID NO: 139441 - DNA, 75 bp, Artificial Sequence
  Synthetic
ccacgatgatcatggcgtacctcatgcgcatccctgaagtcgttctggacatcatcacgggagcgcactggggcg

SEQ ID NO: 139442 - DNA, 75 bp, Artificial Sequence
  Synthetic
ccacgatgatcatggcgtacctcatgcgcatccctgaagtcgttctggacttcatcacaggagcgcactggggcg

SEQ ID NO: 139443 - DNA, 75 bp, Artificial Sequence
  Synthetic
ccacgatgatcatggcgtacctcatgcgcatccctgaagtcgttctggacttcatcactggagcgcactggggcg

SEQ ID NO: 139444 - DNA, 75 bp, Artificial Sequence
  Synthetic
ccacgatgatcatggcgtacctcatgcgcatccctgaagtcgttctggacttcatcaccggagcgcactggggcg

SEQ ID NO: 139445 - DNA, 75 bp, Artificial Sequence
  Synthetic
ccacgatgatcatggcgtacctcatgcgcatccctgaagtcgttctggacttcatcacgggagcgcactggggcg

SEQ ID NO: 139446 - DNA, 75 bp, Artificial Sequence
  Synthetic
ccacgatgatcatggcgtacctcatgcgcatccctgaagtcgttctggacctcatcacaggagcgcactggggcg

SEQ ID NO: 139447 - DNA, 75 bp, Artificial Sequence
  Synthetic
ccacgatgatcatggcgtacctcatgcgcatccctgaagtcgttctggacctcatcactggagcgcactggggcg

SEQ ID NO: 139448 - DNA, 75 bp, Artificial Sequence
  Synthetic
ccacgatgatcatggcgtacctcatgcgcatccctgaagtcgttctggacctcatcaccggagcgcactggggcg

SEQ ID NO: 139449 - DNA, 75 bp, Artificial Sequence
  Synthetic
ccacgatgatcatggcgtacctcatgcgcatccctgaagtcgttctggacctcatcacgggagcgcactggggcg

SEQ ID NO: 139450 - DNA, 75 bp, Artificial Sequence
  Synthetic
ccacgatgatcatggcgtacctcatgcgcatccctgaagtcgttctggacgtcatcacaggagcgcactggggcg

SEQ ID NO: 139451 - DNA, 75 bp, Artificial Sequence
  Synthetic
ccacgatgatcatggcgtacctcatgcgcatccctgaagtcgttctggacgtcatcactggagcgcactggggcg

SEQ ID NO: 139452 - DNA, 75 bp, Artificial Sequence
  Synthetic
ccacgatgatcatggcgtacctcatgcgcatccctgaagtcgttctggacgtcatcaccggagcgcactggggcg

SEQ ID NO: 139453 - DNA, 75 bp, Artificial Sequence
  Synthetic
ccacgatgatcatggcgtacctcatgcgcatccctgaagtcgttctggacgtcatcacgggagcgcactggggcg

SEQ ID NO: 139454 - DNA, 75 bp, Artificial Sequence
  Synthetic
ccacgatgatcttggcgtacctcatgcgcatccctgaagtcgttctggacatcatcacaggagcgcactggggcg

SEQ ID NO: 139455 - DNA, 75 bp, Artificial Sequence
  Synthetic
ccacgatgatcttggcgtacctcatgcgcatccctgaagtcgttctggacatcatcactggagcgcactggggcg

SEQ ID NO: 139456 - DNA, 75 bp, Artificial Sequence
  Synthetic
ccacgatgatcttggcgtacctcatgcgcatccctgaagtcgttctggacatcatcaccggagcgcactggggcg

SEQ ID NO: 139457 - DNA, 75 bp, Artificial Sequence
  Synthetic
ccacgatgatcttggcgtacctcatgcgcatccctgaagtcgttctggacatcatcacgggagcgcactggggcg

SEQ ID NO: 139458 - DNA, 75 bp, Artificial Sequence
  Synthetic
ccacgatgatcttggcgtacctcatgcgcatccctgaagtcgttctggacttcatcacaggagcgcactggggcg

SEQ ID NO: 139459 - DNA, 75 bp, Artificial Sequence
  Synthetic
ccacgatgatcttggcgtacctcatgcgcatccctgaagtcgttctggacttcatcactggagcgcactggggcg

SEQ ID NO: 139460 - DNA, 75 bp, Artificial Sequence
  Synthetic
ccacgatgatcttggcgtacctcatgcgcatccctgaagtcgttctggacttcatcaccggagcgcactggggcg

SEQ ID NO: 139461 - DNA, 75 bp, Artificial Sequence
  Synthetic
ccacgatgatcttggcgtacctcatgcgcatccctgaagtcgttctggacttcatcacgggagcgcactggggcg

SEQ ID NO: 139462 - DNA, 75 bp, Artificial Sequence
  Synthetic
ccacgatgatcttggcgtacctcatgcgcatccctgaagtcgttctggacctcatcacaggagcgcactggggcg

SEQ ID NO: 139463 - DNA, 75 bp, Artificial Sequence
  Synthetic
ccacgatgatcttggcgtacctcatgcgcatccctgaagtcgttctggacctcatcactggagcgcactggggcg

SEQ ID NO: 139464 - DNA, 75 bp, Artificial Sequence
  Synthetic
ccacgatgatcttggcgtacctcatgcgcatccctgaagtcgttctggacctcatcaccggagcgcactggggcg

SEQ ID NO: 139465 - DNA, 75 bp, Artificial Sequence
  Synthetic
ccacgatgatcttggcgtacctcatgcgcatccctgaagtcgttctggacctcatcacgggagcgcactggggcg

SEQ ID NO: 139466 - DNA, 75 bp, Artificial Sequence
  Synthetic
ccacgatgatcttggcgtacctcatgcgcatccctgaagtcgttctggacgtcatcacaggagcgcactggggcg

SEQ ID NO: 139467 - DNA, 75 bp, Artificial Sequence
  Synthetic
ccacgatgatcttggcgtacctcatgcgcatccctgaagtcgttctggacgtcatcactggagcgcactggggcg

SEQ ID NO: 139468 - DNA, 75 bp, Artificial Sequence
  Synthetic
ccacgatgatcttggcgtacctcatgcgcatccctgaagtcgttctggacgtcatcaccggagcgcactggggcg

SEQ ID NO: 139469 - DNA, 75 bp, Artificial Sequence
  Synthetic
ccacgatgatcttggcgtacctcatgcgcatccctgaagtcgttctggacgtcatcacgggagcgcactggggcg

SEQ ID NO: 139470 - DNA, 75 bp, Artificial Sequence
  Synthetic
ccacgatgatcctggcgtacctcatgcgcatccctgaagtcgttctggacatcatcacaggagcgcactggggcg

SEQ ID NO: 139471 - DNA, 75 bp, Artificial Sequence
  Synthetic
ccacgatgatcctggcgtacctcatgcgcatccctgaagtcgttctggacatcatcactggagcgcactggggcg

SEQ ID NO: 139472 - DNA, 75 bp, Artificial Sequence
  Synthetic
ccacgatgatcctggcgtacctcatgcgcatccctgaagtcgttctggacatcatcaccggagcgcactggggcg

SEQ ID NO: 139473 - DNA, 75 bp, Artificial Sequence
  Synthetic
ccacgatgatcctggcgtacctcatgcgcatccctgaagtcgttctggacatcatcacgggagcgcactggggcg

SEQ ID NO: 139474 - DNA, 75 bp, Artificial Sequence
  Synthetic
ccacgatgatcctggcgtacctcatgcgcatccctgaagtcgttctggacttcatcacaggagcgcactggggcg

SEQ ID NO: 139475 - DNA, 75 bp, Artificial Sequence
  Synthetic
ccacgatgatcctggcgtacctcatgcgcatccctgaagtcgttctggacttcatcactggagcgcactggggcg

SEQ ID NO: 139476 - DNA, 75 bp, Artificial Sequence
  Synthetic
ccacgatgatcctggcgtacctcatgcgcatccctgaagtcgttctggacttcatcaccggagcgcactggggcg

SEQ ID NO: 139477 - DNA, 75 bp, Artificial Sequence
  Synthetic
ccacgatgatcctggcgtacctcatgcgcatccctgaagtcgttctggacttcatcacgggagcgcactggggcg

SEQ ID NO: 139478 - DNA, 75 bp, Artificial Sequence
  Synthetic
ccacgatgatcctggcgtacctcatgcgcatccctgaagtcgttctggacctcatcacaggagcgcactggggcg

SEQ ID NO: 139479 - DNA, 75 bp, Artificial Sequence
  Synthetic
ccacgatgatcctggcgtacctcatgcgcatccctgaagtcgttctggacctcatcactggagcgcactggggcg

SEQ ID NO: 139480 - DNA, 75 bp, Artificial Sequence
  Synthetic
ccacgatgatcctggcgtacctcatgcgcatccctgaagtcgttctggacctcatcaccggagcgcactggggcg

SEQ ID NO: 139481 - DNA, 75 bp, Artificial Sequence
  Synthetic
ccacgatgatcctggcgtacctcatgcgcatccctgaagtcgttctggacctcatcacgggagcgcactggggcg

SEQ ID NO: 139482 - DNA, 75 bp, Artificial Sequence
  Synthetic
ccacgatgatcctggcgtacctcatgcgcatccctgaagtcgttctggacgtcatcacaggagcgcactggggcg

SEQ ID NO: 139483 - DNA, 75 bp, Artificial Sequence
  Synthetic
ccacgatgatcctggcgtacctcatgcgcatccctgaagtcgttctggacgtcatcactggagcgcactggggcg

SEQ ID NO: 139484 - DNA, 75 bp, Artificial Sequence
  Synthetic
ccacgatgatcctggcgtacctcatgcgcatccctgaagtcgttctggacgtcatcaccggagcgcactggggcg

SEQ ID NO: 139485 - DNA, 75 bp, Artificial Sequence
  Synthetic
ccacgatgatcctggcgtacctcatgcgcatccctgaagtcgttctggacgtcatcacgggagcgcactggggcg

SEQ ID NO: 139486 - DNA, 75 bp, Artificial Sequence
  Synthetic
ccacgatgatcgtggcgtacctcatgcgcatccctgaagtcgttctggacatcatcacaggagcgcactggggcg

SEQ ID NO: 139487 - DNA, 75 bp, Artificial Sequence
  Synthetic
ccacgatgatcgtggcgtacctcatgcgcatccctgaagtcgttctggacatcatcactggagcgcactggggcg

SEQ ID NO: 139488 - DNA, 75 bp, Artificial Sequence
  Synthetic
ccacgatgatcgtggcgtacctcatgcgcatccctgaagtcgttctggacatcatcaccggagcgcactggggcg

SEQ ID NO: 139489 - DNA, 75 bp, Artificial Sequence
  Synthetic
ccacgatgatcgtggcgtacctcatgcgcatccctgaagtcgttctggacatcatcacgggagcgcactggggcg

SEQ ID NO: 139490 - DNA, 75 bp, Artificial Sequence
  Synthetic
ccacgatgatcgtggcgtacctcatgcgcatccctgaagtcgttctggacttcatcacaggagcgcactggggcg

SEQ ID NO: 139491 - DNA, 75 bp, Artificial Sequence
  Synthetic
ccacgatgatcgtggcgtacctcatgcgcatccctgaagtcgttctggacttcatcactggagcgcactggggcg

SEQ ID NO: 139492 - DNA, 75 bp, Artificial Sequence
  Synthetic
ccacgatgatcgtggcgtacctcatgcgcatccctgaagtcgttctggacttcatcaccggagcgcactggggcg

SEQ ID NO: 139493 - DNA, 75 bp, Artificial Sequence
  Synthetic
ccacgatgatcgtggcgtacctcatgcgcatccctgaagtcgttctggacttcatcacgggagcgcactggggcg

SEQ ID NO: 139494 - DNA, 75 bp, Artificial Sequence
  Synthetic
ccacgatgatcgtggcgtacctcatgcgcatccctgaagtcgttctggacctcatcacaggagcgcactggggcg

SEQ ID NO: 139495 - DNA, 75 bp, Artificial Sequence
  Synthetic
ccacgatgatcgtggcgtacctcatgcgcatccctgaagtcgttctggacctcatcactggagcgcactggggcg

SEQ ID NO: 139496 - DNA, 75 bp, Artificial Sequence
  Synthetic
ccacgatgatcgtggcgtacctcatgcgcatccctgaagtcgttctggacctcatcaccggagcgcactggggcg

SEQ ID NO: 139497 - DNA, 75 bp, Artificial Sequence
  Synthetic
ccacgatgatcgtggcgtacctcatgcgcatccctgaagtcgttctggacctcatcacgggagcgcactggggcg

SEQ ID NO: 139498 - DNA, 75 bp, Artificial Sequence
  Synthetic
ccacgatgatcgtggcgtacctcatgcgcatccctgaagtcgttctggacgtcatcacaggagcgcactggggcg

SEQ ID NO: 139499 - DNA, 75 bp, Artificial Sequence
  Synthetic
ccacgatgatcgtggcgtacctcatgcgcatccctgaagtcgttctggacgtcatcactggagcgcactggggcg

SEQ ID NO: 139500 - DNA, 75 bp, Artificial Sequence
  Synthetic
ccacgatgatcgtggcgtacctcatgcgcatccctgaagtcgttctggacgtcatcaccggagcgcactggggcg

SEQ ID NO: 139501 - DNA, 75 bp, Artificial Sequence
  Synthetic
ccacgatgatcgtggcgtacctcatgcgcatccctgaagtcgttctggacgtcatcacgggagcgcactggggcg

SEQ ID NO: 139502 - DNA, 75 bp, Artificial Sequence
  Synthetic
cacggacttcccgtgtccgcccgacttggtcgggaggtcctccttggcccagctgatggctatacctccaagggg

SEQ ID NO: 139503 - DNA, 75 bp, Artificial Sequence
  Synthetic
tgatgttcggcctagcttacttctctatgcagggagcctgggccaaggtcgtcgtaatcctcctaataacagcgg

SEQ ID NO: 139504 - DNA, 75 bp, Artificial Sequence
  Synthetic
tgatgttcggcctagcttacttctctatgcagggagcctgggccaaggtcgtcgtaatcctcctaataactgcgg

SEQ ID NO: 139505 - DNA, 75 bp, Artificial Sequence
  Synthetic
tgatgttcggcctagcttacttctctatgcagggagcctgggccaaggtcgtcgtaatcctcctaataaccgcgg

SEQ ID NO: 139506 - DNA, 75 bp, Artificial Sequence
  Synthetic
tgatgttcggcctagcttacttctctatgcagggagcctgggccaaggtcgtcgtaatcctcctaataacggcgg

SEQ ID NO: 139507 - DNA, 75 bp, Artificial Sequence
  Synthetic
tgatgttcggcctagcttacttctctatgcagggagcctgggccaaggtcgtcgtaatcctcctattaacagcgg

SEQ ID NO: 139508 - DNA, 75 bp, Artificial Sequence
  Synthetic
tgatgttcggcctagcttacttctctatgcagggagcctgggccaaggtcgtcgtaatcctcctattaactgcgg

SEQ ID NO: 139509 - DNA, 75 bp, Artificial Sequence
  Synthetic
tgatgttcggcctagcttacttctctatgcagggagcctgggccaaggtcgtcgtaatcctcctattaaccgcgg

SEQ ID NO: 139510 - DNA, 75 bp, Artificial Sequence
  Synthetic
tgatgttcggcctagcttacttctctatgcagggagcctgggccaaggtcgtcgtaatcctcctattaacggcgg

SEQ ID NO: 139511 - DNA, 75 bp, Artificial Sequence
  Synthetic
tgatgttcggcctagcttacttctctatgcagggagcctgggccaaggtcgtcgtaatcctcctactaacagcgg

SEQ ID NO: 139512 - DNA, 75 bp, Artificial Sequence
  Synthetic
tgatgttcggcctagcttacttctctatgcagggagcctgggccaaggtcgtcgtaatcctcctactaactgcgg

SEQ ID NO: 139513 - DNA, 75 bp, Artificial Sequence
  Synthetic
tgatgttcggcctagcttacttctctatgcagggagcctgggccaaggtcgtcgtaatcctcctactaaccgcgg

SEQ ID NO: 139514 - DNA, 75 bp, Artificial Sequence
  Synthetic
tgatgttcggcctagcttacttctctatgcagggagcctgggccaaggtcgtcgtaatcctcctactaacggcgg

SEQ ID NO: 139515 - DNA, 75 bp, Artificial Sequence
  Synthetic
tgatgttcggcctagcttacttctctatgcagggagcctgggccaaggtcgtcgtaatcctcctagtaacagcgg

SEQ ID NO: 139516 - DNA, 75 bp, Artificial Sequence
  Synthetic
tgatgttcggcctagcttacttctctatgcagggagcctgggccaaggtcgtcgtaatcctcctagtaactgcgg

SEQ ID NO: 139517 - DNA, 75 bp, Artificial Sequence
  Synthetic
tgatgttcggcctagcttacttctctatgcagggagcctgggccaaggtcgtcgtaatcctcctagtaaccgcgg

SEQ ID NO: 139518 - DNA, 75 bp, Artificial Sequence
  Synthetic
tgatgttcggcctagcttacttctctatgcagggagcctgggccaaggtcgtcgtaatcctcctagtaacggcgg

SEQ ID NO: 139519 - DNA, 75 bp, Artificial Sequence
  Synthetic
tgatgttcggcctagcttacttctctatgcagggagcctgggccaaggtcgtcgttatcctcctaataacagcgg

SEQ ID NO: 139520 - DNA, 75 bp, Artificial Sequence
  Synthetic
tgatgttcggcctagcttacttctctatgcagggagcctgggccaaggtcgtcgttatcctcctaataactgcgg

SEQ ID NO: 139521 - DNA, 75 bp, Artificial Sequence
  Synthetic
tgatgttcggcctagcttacttctctatgcagggagcctgggccaaggtcgtcgttatcctcctaataaccgcgg

SEQ ID NO: 139522 - DNA, 75 bp, Artificial Sequence
  Synthetic
tgatgttcggcctagcttacttctctatgcagggagcctgggccaaggtcgtcgttatcctcctaataacggcgg

SEQ ID NO: 139523 - DNA, 75 bp, Artificial Sequence
  Synthetic
tgatgttcggcctagcttacttctctatgcagggagcctgggccaaggtcgtcgttatcctcctattaacagcgg

SEQ ID NO: 139524 - DNA, 75 bp, Artificial Sequence
  Synthetic
tgatgttcggcctagcttacttctctatgcagggagcctgggccaaggtcgtcgttatcctcctattaactgcgg

SEQ ID NO: 139525 - DNA, 75 bp, Artificial Sequence
  Synthetic
tgatgttcggcctagcttacttctctatgcagggagcctgggccaaggtcgtcgttatcctcctattaaccgcgg

SEQ ID NO: 139526 - DNA, 75 bp, Artificial Sequence
  Synthetic
tgatgttcggcctagcttacttctctatgcagggagcctgggccaaggtcgtcgttatcctcctattaacggcgg

SEQ ID NO: 139527 - DNA, 75 bp, Artificial Sequence
  Synthetic
tgatgttcggcctagcttacttctctatgcagggagcctgggccaaggtcgtcgttatcctcctactaacagcgg

SEQ ID NO: 139528 - DNA, 75 bp, Artificial Sequence
  Synthetic
tgatgttcggcctagcttacttctctatgcagggagcctgggccaaggtcgtcgttatcctcctactaactgcgg

SEQ ID NO: 139529 - DNA, 75 bp, Artificial Sequence
  Synthetic
tgatgttcggcctagcttacttctctatgcagggagcctgggccaaggtcgtcgttatcctcctactaaccgcgg

SEQ ID NO: 139530 - DNA, 75 bp, Artificial Sequence
  Synthetic
tgatgttcggcctagcttacttctctatgcagggagcctgggccaaggtcgtcgttatcctcctactaacggcgg

SEQ ID NO: 139531 - DNA, 75 bp, Artificial Sequence
  Synthetic
tgatgttcggcctagcttacttctctatgcagggagcctgggccaaggtcgtcgttatcctcctagtaacagcgg

SEQ ID NO: 139532 - DNA, 75 bp, Artificial Sequence
  Synthetic
tgatgttcggcctagcttacttctctatgcagggagcctgggccaaggtcgtcgttatcctcctagtaactgcgg

SEQ ID NO: 139533 - DNA, 75 bp, Artificial Sequence
  Synthetic
tgatgttcggcctagcttacttctctatgcagggagcctgggccaaggtcgtcgttatcctcctagtaaccgcgg

SEQ ID NO: 139534 - DNA, 75 bp, Artificial Sequence
  Synthetic
tgatgttcggcctagcttacttctctatgcagggagcctgggccaaggtcgtcgttatcctcctagtaacggcgg

SEQ ID NO: 139535 - DNA, 75 bp, Artificial Sequence
  Synthetic
tgatgttcggcctagcttacttctctatgcagggagcctgggccaaggtcgtcgtcatcctcctaataacagcgg

SEQ ID NO: 139536 - DNA, 75 bp, Artificial Sequence
  Synthetic
tgatgttcggcctagcttacttctctatgcagggagcctgggccaaggtcgtcgtcatcctcctaataactgcgg

SEQ ID NO: 139537 - DNA, 75 bp, Artificial Sequence
  Synthetic
tgatgttcggcctagcttacttctctatgcagggagcctgggccaaggtcgtcgtcatcctcctaataaccgcgg

SEQ ID NO: 139538 - DNA, 75 bp, Artificial Sequence
  Synthetic
tgatgttcggcctagcttacttctctatgcagggagcctgggccaaggtcgtcgtcatcctcctaataacggcgg

SEQ ID NO: 139539 - DNA, 75 bp, Artificial Sequence
  Synthetic
tgatgttcggcctagcttacttctctatgcagggagcctgggccaaggtcgtcgtcatcctcctattaacagcgg

SEQ ID NO: 139540 - DNA, 75 bp, Artificial Sequence
  Synthetic
tgatgttcggcctagcttacttctctatgcagggagcctgggccaaggtcgtcgtcatcctcctattaactgcgg

SEQ ID NO: 139541 - DNA, 75 bp, Artificial Sequence
  Synthetic
tgatgttcggcctagcttacttctctatgcagggagcctgggccaaggtcgtcgtcatcctcctattaaccgcgg

SEQ ID NO: 139542 - DNA, 75 bp, Artificial Sequence
  Synthetic
tgatgttcggcctagcttacttctctatgcagggagcctgggccaaggtcgtcgtcatcctcctattaacggcgg

SEQ ID NO: 139543 - DNA, 75 bp, Artificial Sequence
  Synthetic
tgatgttcggcctagcttacttctctatgcagggagcctgggccaaggtcgtcgtcatcctcctactaacagcgg

SEQ ID NO: 139544 - DNA, 75 bp, Artificial Sequence
  Synthetic
tgatgttcggcctagcttacttctctatgcagggagcctgggccaaggtcgtcgtcatcctcctactaactgcgg

SEQ ID NO: 139545 - DNA, 75 bp, Artificial Sequence
  Synthetic
tgatgttcggcctagcttacttctctatgcagggagcctgggccaaggtcgtcgtcatcctcctactaaccgcgg

SEQ ID NO: 139546 - DNA, 75 bp, Artificial Sequence
  Synthetic
tgatgttcggcctagcttacttctctatgcagggagcctgggccaaggtcgtcgtcatcctcctactaacggcgg

SEQ ID NO: 139547 - DNA, 75 bp, Artificial Sequence
  Synthetic
tgatgttcggcctagcttacttctctatgcagggagcctgggccaaggtcgtcgtcatcctcctagtaacagcgg

SEQ ID NO: 139548 - DNA, 75 bp, Artificial Sequence
  Synthetic
tgatgttcggcctagcttacttctctatgcagggagcctgggccaaggtcgtcgtcatcctcctagtaactgcgg

SEQ ID NO: 139549 - DNA, 75 bp, Artificial Sequence
  Synthetic
tgatgttcggcctagcttacttctctatgcagggagcctgggccaaggtcgtcgtcatcctcctagtaaccgcgg

SEQ ID NO: 139550 - DNA, 75 bp, Artificial Sequence
  Synthetic
tgatgttcggcctagcttacttctctatgcagggagcctgggccaaggtcgtcgtcatcctcctagtaacggcgg

SEQ ID NO: 139551 - DNA, 75 bp, Artificial Sequence
  Synthetic
tgatgttcggcctagcttacttctctatgcagggagcctgggccaaggtcgtcgtgatcctcctaataacagcgg

SEQ ID NO: 139552 - DNA, 75 bp, Artificial Sequence
  Synthetic
tgatgttcggcctagcttacttctctatgcagggagcctgggccaaggtcgtcgtgatcctcctaataactgcgg

SEQ ID NO: 139553 - DNA, 75 bp, Artificial Sequence
  Synthetic
tgatgttcggcctagcttacttctctatgcagggagcctgggccaaggtcgtcgtgatcctcctaataaccgcgg

SEQ ID NO: 139554 - DNA, 75 bp, Artificial Sequence
  Synthetic
tgatgttcggcctagcttacttctctatgcagggagcctgggccaaggtcgtcgtgatcctcctaataacggcgg

SEQ ID NO: 139555 - DNA, 75 bp, Artificial Sequence
  Synthetic
tgatgttcggcctagcttacttctctatgcagggagcctgggccaaggtcgtcgtgatcctcctattaacagcgg

SEQ ID NO: 139556 - DNA, 75 bp, Artificial Sequence
  Synthetic
tgatgttcggcctagcttacttctctatgcagggagcctgggccaaggtcgtcgtgatcctcctattaactgcgg

SEQ ID NO: 139557 - DNA, 75 bp, Artificial Sequence
  Synthetic
tgatgttcggcctagcttacttctctatgcagggagcctgggccaaggtcgtcgtgatcctcctattaaccgcgg

SEQ ID NO: 139558 - DNA, 75 bp, Artificial Sequence
  Synthetic
tgatgttcggcctagcttacttctctatgcagggagcctgggccaaggtcgtcgtgatcctcctattaacggcgg

SEQ ID NO: 139559 - DNA, 75 bp, Artificial Sequence
  Synthetic
tgatgttcggcctagcttacttctctatgcagggagcctgggccaaggtcgtcgtgatcctcctactaacagcgg

SEQ ID NO: 139560 - DNA, 75 bp, Artificial Sequence
  Synthetic
tgatgttcggcctagcttacttctctatgcagggagcctgggccaaggtcgtcgtgatcctcctactaactgcgg

SEQ ID NO: 139561 - DNA, 75 bp, Artificial Sequence
  Synthetic
tgatgttcggcctagcttacttctctatgcagggagcctgggccaaggtcgtcgtgatcctcctactaaccgcgg

SEQ ID NO: 139562 - DNA, 75 bp, Artificial Sequence
  Synthetic
tgatgttcggcctagcttacttctctatgcagggagcctgggccaaggtcgtcgtgatcctcctactaacggcgg

SEQ ID NO: 139563 - DNA, 75 bp, Artificial Sequence
  Synthetic
tgatgttcggcctagcttacttctctatgcagggagcctgggccaaggtcgtcgtgatcctcctagtaacagcgg

SEQ ID NO: 139564 - DNA, 75 bp, Artificial Sequence
  Synthetic
tgatgttcggcctagcttacttctctatgcagggagcctgggccaaggtcgtcgtgatcctcctagtaactgcgg

SEQ ID NO: 139565 - DNA, 75 bp, Artificial Sequence
  Synthetic
tgatgttcggcctagcttacttctctatgcagggagcctgggccaaggtcgtcgtgatcctcctagtaaccgcgg

SEQ ID NO: 139566 - DNA, 75 bp, Artificial Sequence
  Synthetic
tgatgttcggcctagcttacttctctatgcagggagcctgggccaaggtcgtcgtgatcctcctagtaacggcgg

SEQ ID NO: 139567 - DNA, 75 bp, Artificial Sequence
  Synthetic
ccctataggctgtggcactatccgtgcactgtcaattataccatccacaaggtgaggttatacttagggggactt

SEQ ID NO: 139568 - DNA, 75 bp, Artificial Sequence
  Synthetic
atgagccctcttctgcactcaacaactgagctcgcgatactcccatgtacattcaccactatgccagccttatca

SEQ ID NO: 139569 - DNA, 75 bp, Artificial Sequence
  Synthetic
tcctcgccttccttgtgttggctgacgcgcgcatctgtgcgtgtctttggcttatgttactcataggccaggcgg

SEQ ID NO: 139570 - DNA, 75 bp, Artificial Sequence
  Synthetic
cagaggtcgctttgtgcctgcagtcacatacgggctcttacagatatggccactattactgcttgtcttggccct

SEQ ID NO: 139571 - DNA, 75 bp, Artificial Sequence
  Synthetic
ggactccacgagtacccggtggggtcgcaattaccttgcgagcccgaaccggatgtggccgtgttgacgtccatg

SEQ ID NO: 139572 - DNA, 75 bp, Artificial Sequence
  Synthetic
cgcatgcttgtgctgttaatttggtggatacagtatttcattgcacgaatagaggctactctgcaagtgtgggtt

SEQ ID NO: 139573 - DNA, 75 bp, Artificial Sequence
  Synthetic
cgcatgcttgtgctgttaatttggtggattcagtatttcattgcacgaatagaggctactctgcaagtgtgggtt

SEQ ID NO: 139574 - DNA, 75 bp, Artificial Sequence
  Synthetic
cgcatgcttgtgctgttaatttggtggatccagtatttcattgcacgaatagaggctactctgcaagtgtgggtt

SEQ ID NO: 139575 - DNA, 75 bp, Artificial Sequence
  Synthetic
cgcatgcttgtgctgttaatttggtggatgcagtatttcattgcacgaatagaggctactctgcaagtgtgggtt

SEQ ID NO: 139576 - DNA, 75 bp, Artificial Sequence
  Synthetic
ccgcctcggccatacactatcgcaatgcttcgggtgtctaccacatcaccaacgactgcccgaattccagcatag

SEQ ID NO: 139577 - DNA, 75 bp, Artificial Sequence
  Synthetic
gacatcaccaaggtgctgctggctcttctggggcctctttacttggtgcaggcgagcttgctgtgcgtgccctac

SEQ ID NO: 139578 - DNA, 75 bp, Artificial Sequence
  Synthetic
tttatctactggtctattacacctccaccaaaacaatgtggacgtgcagtacttgtagggactatcgccggctat

SEQ ID NO: 139579 - DNA, 75 bp, Artificial Sequence
  Synthetic
tttatctactggtctattacacctccaccaaaacaatgtggacgtgcagtacttgtagggtctatcgccggctat

SEQ ID NO: 139580 - DNA, 75 bp, Artificial Sequence
  Synthetic
tttatctactggtctattacacctccaccaaaacaatgtggacgtgcagtacttgtagggcctatcgccggctat

SEQ ID NO: 139581 - DNA, 75 bp, Artificial Sequence
  Synthetic
tttatctactggtctattacacctccaccaaaacaatgtggacgtgcagtacttgtaggggctatcgccggctat

SEQ ID NO: 139582 - DNA, 75 bp, Artificial Sequence
  Synthetic
tttatctactggtctattacacctccaccaaaacattgtggacgtgcagtacttgtagggactatcgccggctat

SEQ ID NO: 139583 - DNA, 75 bp, Artificial Sequence
  Synthetic
tttatctactggtctattacacctccaccaaaacattgtggacgtgcagtacttgtagggtctatcgccggctat

SEQ ID NO: 139584 - DNA, 75 bp, Artificial Sequence
  Synthetic
tttatctactggtctattacacctccaccaaaacattgtggacgtgcagtacttgtagggcctatcgccggctat

SEQ ID NO: 139585 - DNA, 75 bp, Artificial Sequence
  Synthetic
tttatctactggtctattacacctccaccaaaacattgtggacgtgcagtacttgtaggggctatcgccggctat

SEQ ID NO: 139586 - DNA, 75 bp, Artificial Sequence
  Synthetic
tttatctactggtctattacacctccaccaaaacactgtggacgtgcagtacttgtagggactatcgccggctat

SEQ ID NO: 139587 - DNA, 75 bp, Artificial Sequence
  Synthetic
tttatctactggtctattacacctccaccaaaacactgtggacgtgcagtacttgtagggtctatcgccggctat

SEQ ID NO: 139588 - DNA, 75 bp, Artificial Sequence
  Synthetic
tttatctactggtctattacacctccaccaaaacactgtggacgtgcagtacttgtagggcctatcgccggctat

SEQ ID NO: 139589 - DNA, 75 bp, Artificial Sequence
  Synthetic
tttatctactggtctattacacctccaccaaaacactgtggacgtgcagtacttgtaggggctatcgccggctat

SEQ ID NO: 139590 - DNA, 75 bp, Artificial Sequence
  Synthetic
tttatctactggtctattacacctccaccaaaacagtgtggacgtgcagtacttgtagggactatcgccggctat

SEQ ID NO: 139591 - DNA, 75 bp, Artificial Sequence
  Synthetic
tttatctactggtctattacacctccaccaaaacagtgtggacgtgcagtacttgtagggtctatcgccggctat

SEQ ID NO: 139592 - DNA, 75 bp, Artificial Sequence
  Synthetic
tttatctactggtctattacacctccaccaaaacagtgtggacgtgcagtacttgtagggcctatcgccggctat

SEQ ID NO: 139593 - DNA, 75 bp, Artificial Sequence
  Synthetic
tttatctactggtctattacacctccaccaaaacagtgtggacgtgcagtacttgtaggggctatcgccggctat

SEQ ID NO: 139594 - DNA, 75 bp, Artificial Sequence
  Synthetic
tttatctactggtcttttacacctccaccaaaacaatgtggacgtgcagtacttgtagggactatcgccggctat

SEQ ID NO: 139595 - DNA, 75 bp, Artificial Sequence
  Synthetic
tttatctactggtcttttacacctccaccaaaacaatgtggacgtgcagtacttgtagggtctatcgccggctat

SEQ ID NO: 139596 - DNA, 75 bp, Artificial Sequence
  Synthetic
tttatctactggtcttttacacctccaccaaaacaatgtggacgtgcagtacttgtagggcctatcgccggctat

SEQ ID NO: 139597 - DNA, 75 bp, Artificial Sequence
  Synthetic
tttatctactggtcttttacacctccaccaaaacaatgtggacgtgcagtacttgtaggggctatcgccggctat

SEQ ID NO: 139598 - DNA, 75 bp, Artificial Sequence
  Synthetic
tttatctactggtcttttacacctccaccaaaacattgtggacgtgcagtacttgtagggactatcgccggctat

SEQ ID NO: 139599 - DNA, 75 bp, Artificial Sequence
  Synthetic
tttatctactggtcttttacacctccaccaaaacattgtggacgtgcagtacttgtagggtctatcgccggctat

SEQ ID NO: 139600 - DNA, 75 bp, Artificial Sequence
  Synthetic
tttatctactggtcttttacacctccaccaaaacattgtggacgtgcagtacttgtagggcctatcgccggctat

SEQ ID NO: 139601 - DNA, 75 bp, Artificial Sequence
  Synthetic
tttatctactggtcttttacacctccaccaaaacattgtggacgtgcagtacttgtaggggctatcgccggctat

SEQ ID NO: 139602 - DNA, 75 bp, Artificial Sequence
  Synthetic
tttatctactggtcttttacacctccaccaaaacactgtggacgtgcagtacttgtagggactatcgccggctat

SEQ ID NO: 139603 - DNA, 75 bp, Artificial Sequence
  Synthetic
tttatctactggtcttttacacctccaccaaaacactgtggacgtgcagtacttgtagggtctatcgccggctat

SEQ ID NO: 139604 - DNA, 75 bp, Artificial Sequence
  Synthetic
tttatctactggtcttttacacctccaccaaaacactgtggacgtgcagtacttgtagggcctatcgccggctat

SEQ ID NO: 139605 - DNA, 75 bp, Artificial Sequence
  Synthetic
tttatctactggtcttttacacctccaccaaaacactgtggacgtgcagtacttgtaggggctatcgccggctat

SEQ ID NO: 139606 - DNA, 75 bp, Artificial Sequence
  Synthetic
tttatctactggtcttttacacctccaccaaaacagtgtggacgtgcagtacttgtagggactatcgccggctat

SEQ ID NO: 139607 - DNA, 75 bp, Artificial Sequence
  Synthetic
tttatctactggtcttttacacctccaccaaaacagtgtggacgtgcagtacttgtagggtctatcgccggctat

SEQ ID NO: 139608 - DNA, 75 bp, Artificial Sequence
  Synthetic
tttatctactggtcttttacacctccaccaaaacagtgtggacgtgcagtacttgtagggcctatcgccggctat

SEQ ID NO: 139609 - DNA, 75 bp, Artificial Sequence
  Synthetic
tttatctactggtcttttacacctccaccaaaacagtgtggacgtgcagtacttgtaggggctatcgccggctat

SEQ ID NO: 139610 - DNA, 75 bp, Artificial Sequence
  Synthetic
tttatctactggtctcttacacctccaccaaaacaatgtggacgtgcagtacttgtagggactatcgccggctat

SEQ ID NO: 139611 - DNA, 75 bp, Artificial Sequence
  Synthetic
tttatctactggtctcttacacctccaccaaaacaatgtggacgtgcagtacttgtagggtctatcgccggctat

SEQ ID NO: 139612 - DNA, 75 bp, Artificial Sequence
  Synthetic
tttatctactggtctcttacacctccaccaaaacaatgtggacgtgcagtacttgtagggcctatcgccggctat

SEQ ID NO: 139613 - DNA, 75 bp, Artificial Sequence
  Synthetic
tttatctactggtctcttacacctccaccaaaacaatgtggacgtgcagtacttgtaggggctatcgccggctat

SEQ ID NO: 139614 - DNA, 75 bp, Artificial Sequence
  Synthetic
tttatctactggtctcttacacctccaccaaaacattgtggacgtgcagtacttgtagggactatcgccggctat

SEQ ID NO: 139615 - DNA, 75 bp, Artificial Sequence
  Synthetic
tttatctactggtctcttacacctccaccaaaacattgtggacgtgcagtacttgtagggtctatcgccggctat

SEQ ID NO: 139616 - DNA, 75 bp, Artificial Sequence
  Synthetic
tttatctactggtctcttacacctccaccaaaacattgtggacgtgcagtacttgtagggcctatcgccggctat

SEQ ID NO: 139617 - DNA, 75 bp, Artificial Sequence
  Synthetic
tttatctactggtctcttacacctccaccaaaacattgtggacgtgcagtacttgtaggggctatcgccggctat

SEQ ID NO: 139618 - DNA, 75 bp, Artificial Sequence
  Synthetic
tttatctactggtctcttacacctccaccaaaacactgtggacgtgcagtacttgtagggactatcgccggctat

SEQ ID NO: 139619 - DNA, 75 bp, Artificial Sequence
  Synthetic
tttatctactggtctcttacacctccaccaaaacactgtggacgtgcagtacttgtagggtctatcgccggctat

SEQ ID NO: 139620 - DNA, 75 bp, Artificial Sequence
  Synthetic
tttatctactggtctcttacacctccaccaaaacactgtggacgtgcagtacttgtagggcctatcgccggctat

SEQ ID NO: 139621 - DNA, 75 bp, Artificial Sequence
  Synthetic
tttatctactggtctcttacacctccaccaaaacactgtggacgtgcagtacttgtaggggctatcgccggctat

SEQ ID NO: 139622 - DNA, 75 bp, Artificial Sequence
  Synthetic
tttatctactggtctcttacacctccaccaaaacagtgtggacgtgcagtacttgtagggactatcgccggctat

SEQ ID NO: 139623 - DNA, 75 bp, Artificial Sequence
  Synthetic
tttatctactggtctcttacacctccaccaaaacagtgtggacgtgcagtacttgtagggtctatcgccggctat

SEQ ID NO: 139624 - DNA, 75 bp, Artificial Sequence
  Synthetic
tttatctactggtctcttacacctccaccaaaacagtgtggacgtgcagtacttgtagggcctatcgccggctat

SEQ ID NO: 139625 - DNA, 75 bp, Artificial Sequence
  Synthetic
tttatctactggtctcttacacctccaccaaaacagtgtggacgtgcagtacttgtaggggctatcgccggctat

SEQ ID NO: 139626 - DNA, 75 bp, Artificial Sequence
  Synthetic
tttatctactggtctgttacacctccaccaaaacaatgtggacgtgcagtacttgtagggactatcgccggctat

SEQ ID NO: 139627 - DNA, 75 bp, Artificial Sequence
  Synthetic
tttatctactggtctgttacacctccaccaaaacaatgtggacgtgcagtacttgtagggtctatcgccggctat

SEQ ID NO: 139628 - DNA, 75 bp, Artificial Sequence
  Synthetic
tttatctactggtctgttacacctccaccaaaacaatgtggacgtgcagtacttgtagggcctatcgccggctat

SEQ ID NO: 139629 - DNA, 75 bp, Artificial Sequence
  Synthetic
tttatctactggtctgttacacctccaccaaaacaatgtggacgtgcagtacttgtaggggctatcgccggctat

SEQ ID NO: 139630 - DNA, 75 bp, Artificial Sequence
  Synthetic
tttatctactggtctgttacacctccaccaaaacattgtggacgtgcagtacttgtagggactatcgccggctat

SEQ ID NO: 139631 - DNA, 75 bp, Artificial Sequence
  Synthetic
tttatctactggtctgttacacctccaccaaaacattgtggacgtgcagtacttgtagggtctatcgccggctat

SEQ ID NO: 139632 - DNA, 75 bp, Artificial Sequence
  Synthetic
tttatctactggtctgttacacctccaccaaaacattgtggacgtgcagtacttgtagggcctatcgccggctat

SEQ ID NO: 139633 - DNA, 75 bp, Artificial Sequence
  Synthetic
tttatctactggtctgttacacctccaccaaaacattgtggacgtgcagtacttgtaggggctatcgccggctat

SEQ ID NO: 139634 - DNA, 75 bp, Artificial Sequence
  Synthetic
tttatctactggtctgttacacctccaccaaaacactgtggacgtgcagtacttgtagggactatcgccggctat

SEQ ID NO: 139635 - DNA, 75 bp, Artificial Sequence
  Synthetic
tttatctactggtctgttacacctccaccaaaacactgtggacgtgcagtacttgtagggtctatcgccggctat

SEQ ID NO: 139636 - DNA, 75 bp, Artificial Sequence
  Synthetic
tttatctactggtctgttacacctccaccaaaacactgtggacgtgcagtacttgtagggcctatcgccggctat

SEQ ID NO: 139637 - DNA, 75 bp, Artificial Sequence
  Synthetic
tttatctactggtctgttacacctccaccaaaacactgtggacgtgcagtacttgtaggggctatcgccggctat

SEQ ID NO: 139638 - DNA, 75 bp, Artificial Sequence
  Synthetic
tttatctactggtctgttacacctccaccaaaacagtgtggacgtgcagtacttgtagggactatcgccggctat

SEQ ID NO: 139639 - DNA, 75 bp, Artificial Sequence
  Synthetic
tttatctactggtctgttacacctccaccaaaacagtgtggacgtgcagtacttgtagggtctatcgccggctat

SEQ ID NO: 139640 - DNA, 75 bp, Artificial Sequence
  Synthetic
tttatctactggtctgttacacctccaccaaaacagtgtggacgtgcagtacttgtagggcctatcgccggctat

SEQ ID NO: 139641 - DNA, 75 bp, Artificial Sequence
  Synthetic
tttatctactggtctgttacacctccaccaaaacagtgtggacgtgcagtacttgtaggggctatcgccggctat

SEQ ID NO: 139642 - DNA, 75 bp, Artificial Sequence
  Synthetic
gtcaggactggcaatacatcgcggtgttgggtagctttgacccccactgtggcggctccctaccttaatgctcca

SEQ ID NO: 139643 - DNA, 75 bp, Artificial Sequence
  Synthetic
agtggcccatctacatgcccccactggcagcggcaagagcactaaggtgccagctgcatatgcagcccaagggta

SEQ ID NO: 139644 - DNA, 75 bp, Artificial Sequence
  Synthetic
ctggtacatacatctacaaccacctagctcccctctctgactgggccagcgacgggttgagagaccttgccgttg

SEQ ID NO: 139645 - DNA, 75 bp, Artificial Sequence
  Synthetic
gccagcttttcacattccagccgcgtcgccattggaccacgcaggattgcaactgttccatctacactggtcaca

SEQ ID NO: 139646 - DNA, 75 bp, Artificial Sequence
  Synthetic
cggtggagccggtcgtcttctccccgatggagaagaaggtcatcacttggggagcagacactgcagcttgcggtg

SEQ ID NO: 139647 - DNA, 75 bp, Artificial Sequence
  Synthetic
gatggagaagaaggtcatcacttggggagcagacactgcagcttgcggtgatatactgcaaggcttgccggtttc

SEQ ID NO: 139648 - DNA, 75 bp, Artificial Sequence
  Synthetic
ttgtggtccttcagccttctactcctggcacttccccaacaggcctatgcccttgatacaacggaacaggggcat

SEQ ID NO: 139649 - DNA, 75 bp, Artificial Sequence
  Synthetic
tttactctcaggagggcattggggcatcctggctggtgtggcgtacttcagcatgcaggctaactgggccaaggt

SEQ ID NO: 139650 - DNA, 75 bp, Artificial Sequence
  Synthetic
tcctggacaggcgcacttatcaccccgtgtgccgcggaagaacaaaaattgcctatcaacgcactgagcaactcg

SEQ ID NO: 139651 - DNA, 75 bp, Artificial Sequence
  Synthetic
ccacaccccaatattgaggaggtggccttatccaacactggagaggttcccttctacggcaaagccatccccctc

SEQ ID NO: 139652 - DNA, 75 bp, Artificial Sequence
  Synthetic
atatggtggttgtcctatctgttggtccgagcggaagccctggtccaagagtgggtaccgcctttgcaggcgcga

SEQ ID NO: 139653 - DNA, 75 bp, Artificial Sequence
  Synthetic
atatggtggttgtcctatctgttggtccgtgcggaagccctggtccaagagtgggtaccgcctttgcaggcgcga

SEQ ID NO: 139654 - DNA, 75 bp, Artificial Sequence
  Synthetic
atatggtggttgtcctatctgttggtccgcgcggaagccctggtccaagagtgggtaccgcctttgcaggcgcga

SEQ ID NO: 139655 - DNA, 75 bp, Artificial Sequence
  Synthetic
atatggtggttgtcctatctgttggtccgggcggaagccctggtccaagagtgggtaccgcctttgcaggcgcga

SEQ ID NO: 139656 - DNA, 75 bp, Artificial Sequence
  Synthetic
aatcctggtcttgttcttgtttgccggagttgacgcgcatacccataccacaggtggggcggcaggtaaaacggt

SEQ ID NO: 139657 - DNA, 75 bp, Artificial Sequence
  Synthetic
cgcggcctacttgggacaattgtcaccagcctcacaggccgtgacaaaaatgaggtcgagggcgaggtacaagta

SEQ ID NO: 139658 - DNA, 75 bp, Artificial Sequence
  Synthetic
gccctgtttgccaaatgtacactaatgtagaccaggacatggtgggttggccggcacccccaggtgctagatcgc

SEQ ID NO: 139659 - DNA, 75 bp, Artificial Sequence
  Synthetic
cgtactaccgaggccttgatgtgtccgtcataccgacaagcggagacgtcgttgtcgtggcaacagacgctctaa

SEQ ID NO: 139660 - DNA, 75 bp, Artificial Sequence
  Synthetic
cgatctctatttggtcaccaggaatgcggatgttatccctgcaagacgcaggggggacactcgcgctggactcct

SEQ ID NO: 139661 - DNA, 75 bp, Artificial Sequence
  Synthetic
cgatctctatttggtcaccaggaatgcggatgttatccctgcaagacgcaggggggtcactcgcgctggactcct

SEQ ID NO: 139662 - DNA, 75 bp, Artificial Sequence
  Synthetic
cgatctctatttggtcaccaggaatgcggatgttatccctgcaagacgcaggggggccactcgcgctggactcct

SEQ ID NO: 139663 - DNA, 75 bp, Artificial Sequence
  Synthetic
cgatctctatttggtcaccaggaatgcggatgttatccctgcaagacgcagggggggcactcgcgctggactcct

SEQ ID NO: 139664 - DNA, 75 bp, Artificial Sequence
  Synthetic
gtcacccagacagtcgacttcagcttggaccccaccttcaccatcgagacgacgaccgtgccccaagacgcggtg

SEQ ID NO: 139665 - DNA, 75 bp, Artificial Sequence
  Synthetic
gagagtgaccagaggccctactgctggaactactcgccacagccgtgcggggtggtaccagcgggtacagtctgt

SEQ ID NO: 139666 - DNA, 75 bp, Artificial Sequence
  Synthetic
ggaactactcgccacagccgtgcggggtggtaccagcgggtacagtctgtggcccggtatactgtttcacgccta

SEQ ID NO: 139667 - DNA, 75 bp, Artificial Sequence
  Synthetic
acatgcccctacgggcagcgggaagagcacaaaggtgccggcagcatacgctagccagggctacaaggtgctagt

SEQ ID NO: 139668 - DNA, 75 bp, Artificial Sequence
  Synthetic
gggaggagcatggtttggatgcacatggatgaacggtacaggtttcactaagacctgcggcggacctccgtgcag

SEQ ID NO: 139669 - DNA, 75 bp, Artificial Sequence
  Synthetic
gtgccaagcagaacatccaactcgtcaactccaatggcagctggcacgtcaatagtacggccttgaactgtaaca

SEQ ID NO: 139670 - DNA, 75 bp, Artificial Sequence
  Synthetic
acgggaggtcccatcacctactccacctatggaaaattcttggctgatggaggttgttccggcggggcgtatgac

SEQ ID NO: 139671 - DNA, 75 bp, Artificial Sequence
  Synthetic
aggtgcctggttgactatccgtaccgcttgtggcattatccctgcactgtcaactacaccgtctttaaggtcagg

SEQ ID NO: 139672 - DNA, 75 bp, Artificial Sequence
  Synthetic
agctgctccggatcccacaagccatcttggacatgatcgctggtgcccactggggagtcctagcgggcatagcgt

SEQ ID NO: 139673 - DNA, 75 bp, Artificial Sequence
  Synthetic
caccgggaccgtgcagaactgtcacccttgctcctatctaccacgcagtggcagattctcccctgctcctttacc

SEQ ID NO: 139674 - DNA, 75 bp, Artificial Sequence
  Synthetic
ttctagcaaccgccactcctcccggatcagtcacggtgccgcatccaaacatctcggaagtcgctctacccacca

SEQ ID NO: 139675 - DNA, 75 bp, Artificial Sequence
  Synthetic
gggaatccccctagaatacatcaagggcggtaggcaccttattttctgtcactcaaagaagaaatgcgatgagct

SEQ ID NO: 139676 - DNA, 75 bp, Artificial Sequence
  Synthetic
gtttgtgtgtgtctttggatgatgctgctggtggcacaagtggaggcggctcttaccaacctgatcaacatcaat

SEQ ID NO: 139677 - DNA, 75 bp, Artificial Sequence
  Synthetic
accgatgctctcatgactggctatacaggtgatttcgactccgtcatagactgcaatgtcgcggtaacgcaggta

SEQ ID NO: 139678 - DNA, 75 bp, Artificial Sequence
  Synthetic
accgatgctctcatgactggctatacaggtgatttcgactccgtcatagactgcaatgtcgcggttacgcaggta

SEQ ID NO: 139679 - DNA, 75 bp, Artificial Sequence
  Synthetic
accgatgctctcatgactggctatacaggtgatttcgactccgtcatagactgcaatgtcgcggtcacgcaggta

SEQ ID NO: 139680 - DNA, 75 bp, Artificial Sequence
  Synthetic
accgatgctctcatgactggctatacaggtgatttcgactccgtcatagactgcaatgtcgcggtgacgcaggta

SEQ ID NO: 139681 - DNA, 75 bp, Artificial Sequence
  Synthetic
caggtgatttcgactccgtcatagactgcaatgtcgcggtaacgcaggtagttgatttcagcctggatcccactt

SEQ ID NO: 139682 - DNA, 75 bp, Artificial Sequence
  Synthetic
caggtgatttcgactccgtcatagactgcaatgtcgcggttacgcaggtagttgatttcagcctggatcccactt

SEQ ID NO: 139683 - DNA, 75 bp, Artificial Sequence
  Synthetic
caggtgatttcgactccgtcatagactgcaatgtcgcggtcacgcaggtagttgatttcagcctggatcccactt

SEQ ID NO: 139684 - DNA, 75 bp, Artificial Sequence
  Synthetic
caggtgatttcgactccgtcatagactgcaatgtcgcggtgacgcaggtagttgatttcagcctggatcccactt

SEQ ID NO: 139685 - DNA, 75 bp, Artificial Sequence
  Synthetic
agccaggggtgtacaggtacgtctcgcaaggtgaacgaccatcgggcacatttgacaccgtcgtcctttgtgaag

SEQ ID NO: 139686 - DNA, 75 bp, Artificial Sequence
  Synthetic
gttaggctgcgcgcgtaccttaacacacctgggctgcctgtgtgccaagaccatcttgagttctgggagggagtg

SEQ ID NO: 139687 - DNA, 75 bp, Artificial Sequence
  Synthetic
ttgttgcacgtctatattccatctatggaggtgcgcgggccccgagattcaatcatcattctcacggtcctggcc

SEQ ID NO: 139688 - DNA, 75 bp, Artificial Sequence
  Synthetic
tcttgggcatcggcacagttttggaacaggcagagacggctggagcgcggcttgtcgtgctcgccactgccacgc

SEQ ID NO: 139689 - DNA, 75 bp, Artificial Sequence
  Synthetic
tcttgggcatcggcacagttttggatcaggcagagacggctggagcgcggcttgtcgtgctcgccactgccacgc

SEQ ID NO: 139690 - DNA, 75 bp, Artificial Sequence
  Synthetic
tcttgggcatcggcacagttttggaccaggcagagacggctggagcgcggcttgtcgtgctcgccactgccacgc

SEQ ID NO: 139691 - DNA, 75 bp, Artificial Sequence
  Synthetic
tcttgggcatcggcacagttttggagcaggcagagacggctggagcgcggcttgtcgtgctcgccactgccacgc

SEQ ID NO: 139692 - DNA, 75 bp, Artificial Sequence
  Synthetic
ccagtttgctcaaagtaccctacttcgtgcgcgttcaaggccttctccggatctgcgcgctagtgcggaagatgg

SEQ ID NO: 139693 - DNA, 75 bp, Artificial Sequence
  Synthetic
cgcgcgccaaagcccccccgccatcatgggacaacatgtggaagtgtcttctgcggctaaagcctatgcttgtgg

SEQ ID NO: 139694 - DNA, 75 bp, Artificial Sequence
  Synthetic
atacatatatgaccatctcaccccgctgtcagactgggccgctaccggcctcagggatttggcggtggcggttga

SEQ ID NO: 139695 - DNA, 75 bp, Artificial Sequence
  Synthetic
accactcatccaatcactaagtacatcatgacctgcatgtcagctgacctcgaggtgatcactagcgcttgggtg

SEQ ID NO: 139696 - DNA, 75 bp, Artificial Sequence
  Synthetic
tgcccgaccgcgaggtcctataccagcagtttgatgagatggaggagtgctcacaccgcatcccttacttagtcg

SEQ ID NO: 139697 - DNA, 75 bp, Artificial Sequence
  Synthetic
cagaatacagccaagcaggcagaagaactgaaaccagcggttcagtctgcttggcccaagctcgagcagttttgg

SEQ ID NO: 139698 - DNA, 75 bp, Artificial Sequence
  Synthetic
gtatgcgccagggcgcaggccccaccaccatcgtgggaacaaatgtggaagtgtctcacgcggctaaaacctacg

SEQ ID NO: 139699 - DNA, 75 bp, Artificial Sequence
  Synthetic
gtatgcgccagggcgcaggccccaccaccatcgtgggatcaaatgtggaagtgtctcacgcggctaaaacctacg

SEQ ID NO: 139700 - DNA, 75 bp, Artificial Sequence
  Synthetic
gtatgcgccagggcgcaggccccaccaccatcgtgggaccaaatgtggaagtgtctcacgcggctaaaacctacg

SEQ ID NO: 139701 - DNA, 75 bp, Artificial Sequence
  Synthetic
gtatgcgccagggcgcaggccccaccaccatcgtgggagcaaatgtggaagtgtctcacgcggctaaaacctacg

SEQ ID NO: 139702 - DNA, 75 bp, Artificial Sequence
  Synthetic
gtatgcgccagggcgcaggccccacctccatcgtgggaacaaatgtggaagtgtctcacgcggctaaaacctacg

SEQ ID NO: 139703 - DNA, 75 bp, Artificial Sequence
  Synthetic
gtatgcgccagggcgcaggccccacctccatcgtgggatcaaatgtggaagtgtctcacgcggctaaaacctacg

SEQ ID NO: 139704 - DNA, 75 bp, Artificial Sequence
  Synthetic
gtatgcgccagggcgcaggccccacctccatcgtgggaccaaatgtggaagtgtctcacgcggctaaaacctacg

SEQ ID NO: 139705 - DNA, 75 bp, Artificial Sequence
  Synthetic
gtatgcgccagggcgcaggccccacctccatcgtgggagcaaatgtggaagtgtctcacgcggctaaaacctacg

SEQ ID NO: 139706 - DNA, 75 bp, Artificial Sequence
  Synthetic
gtatgcgccagggcgcaggccccacccccatcgtgggaacaaatgtggaagtgtctcacgcggctaaaacctacg

SEQ ID NO: 139707 - DNA, 75 bp, Artificial Sequence
  Synthetic
gtatgcgccagggcgcaggccccacccccatcgtgggatcaaatgtggaagtgtctcacgcggctaaaacctacg

SEQ ID NO: 139708 - DNA, 75 bp, Artificial Sequence
  Synthetic
gtatgcgccagggcgcaggccccacccccatcgtgggaccaaatgtggaagtgtctcacgcggctaaaacctacg

SEQ ID NO: 139709 - DNA, 75 bp, Artificial Sequence
  Synthetic
gtatgcgccagggcgcaggccccacccccatcgtgggagcaaatgtggaagtgtctcacgcggctaaaacctacg

SEQ ID NO: 139710 - DNA, 75 bp, Artificial Sequence
  Synthetic
gtatgcgccagggcgcaggccccaccgccatcgtgggaacaaatgtggaagtgtctcacgcggctaaaacctacg

SEQ ID NO: 139711 - DNA, 75 bp, Artificial Sequence
  Synthetic
gtatgcgccagggcgcaggccccaccgccatcgtgggatcaaatgtggaagtgtctcacgcggctaaaacctacg

SEQ ID NO: 139712 - DNA, 75 bp, Artificial Sequence
  Synthetic
gtatgcgccagggcgcaggccccaccgccatcgtgggaccaaatgtggaagtgtctcacgcggctaaaacctacg

SEQ ID NO: 139713 - DNA, 75 bp, Artificial Sequence
  Synthetic
gtatgcgccagggcgcaggccccaccgccatcgtgggagcaaatgtggaagtgtctcacgcggctaaaacctacg

SEQ ID NO: 139714 - DNA, 75 bp, Artificial Sequence
  Synthetic
gtttgcgccagggcgcaggccccaccaccatcgtgggaacaaatgtggaagtgtctcacgcggctaaaacctacg

SEQ ID NO: 139715 - DNA, 75 bp, Artificial Sequence
  Synthetic
gtttgcgccagggcgcaggccccaccaccatcgtgggatcaaatgtggaagtgtctcacgcggctaaaacctacg

SEQ ID NO: 139716 - DNA, 75 bp, Artificial Sequence
  Synthetic
gtttgcgccagggcgcaggccccaccaccatcgtgggaccaaatgtggaagtgtctcacgcggctaaaacctacg

SEQ ID NO: 139717 - DNA, 75 bp, Artificial Sequence
  Synthetic
gtttgcgccagggcgcaggccccaccaccatcgtgggagcaaatgtggaagtgtctcacgcggctaaaacctacg

SEQ ID NO: 139718 - DNA, 75 bp, Artificial Sequence
  Synthetic
gtttgcgccagggcgcaggccccacctccatcgtgggaacaaatgtggaagtgtctcacgcggctaaaacctacg

SEQ ID NO: 139719 - DNA, 75 bp, Artificial Sequence
  Synthetic
gtttgcgccagggcgcaggccccacctccatcgtgggatcaaatgtggaagtgtctcacgcggctaaaacctacg

SEQ ID NO: 139720 - DNA, 75 bp, Artificial Sequence
  Synthetic
gtttgcgccagggcgcaggccccacctccatcgtgggaccaaatgtggaagtgtctcacgcggctaaaacctacg

SEQ ID NO: 139721 - DNA, 75 bp, Artificial Sequence
  Synthetic
gtttgcgccagggcgcaggccccacctccatcgtgggagcaaatgtggaagtgtctcacgcggctaaaacctacg

SEQ ID NO: 139722 - DNA, 75 bp, Artificial Sequence
  Synthetic
gtttgcgccagggcgcaggccccacccccatcgtgggaacaaatgtggaagtgtctcacgcggctaaaacctacg

SEQ ID NO: 139723 - DNA, 75 bp, Artificial Sequence
  Synthetic
gtttgcgccagggcgcaggccccacccccatcgtgggatcaaatgtggaagtgtctcacgcggctaaaacctacg

SEQ ID NO: 139724 - DNA, 75 bp, Artificial Sequence
  Synthetic
gtttgcgccagggcgcaggccccacccccatcgtgggaccaaatgtggaagtgtctcacgcggctaaaacctacg

SEQ ID NO: 139725 - DNA, 75 bp, Artificial Sequence
  Synthetic
gtttgcgccagggcgcaggccccacccccatcgtgggagcaaatgtggaagtgtctcacgcggctaaaacctacg

SEQ ID NO: 139726 - DNA, 75 bp, Artificial Sequence
  Synthetic
gtttgcgccagggcgcaggccccaccgccatcgtgggaacaaatgtggaagtgtctcacgcggctaaaacctacg

SEQ ID NO: 139727 - DNA, 75 bp, Artificial Sequence
  Synthetic
gtttgcgccagggcgcaggccccaccgccatcgtgggatcaaatgtggaagtgtctcacgcggctaaaacctacg

SEQ ID NO: 139728 - DNA, 75 bp, Artificial Sequence
  Synthetic
gtttgcgccagggcgcaggccccaccgccatcgtgggaccaaatgtggaagtgtctcacgcggctaaaacctacg

SEQ ID NO: 139729 - DNA, 75 bp, Artificial Sequence
  Synthetic
gtttgcgccagggcgcaggccccaccgccatcgtgggagcaaatgtggaagtgtctcacgcggctaaaacctacg

SEQ ID NO: 139730 - DNA, 75 bp, Artificial Sequence
  Synthetic
gtctgcgccagggcgcaggccccaccaccatcgtgggaacaaatgtggaagtgtctcacgcggctaaaacctacg

SEQ ID NO: 139731 - DNA, 75 bp, Artificial Sequence
  Synthetic
gtctgcgccagggcgcaggccccaccaccatcgtgggatcaaatgtggaagtgtctcacgcggctaaaacctacg

SEQ ID NO: 139732 - DNA, 75 bp, Artificial Sequence
  Synthetic
gtctgcgccagggcgcaggccccaccaccatcgtgggaccaaatgtggaagtgtctcacgcggctaaaacctacg

SEQ ID NO: 139733 - DNA, 75 bp, Artificial Sequence
  Synthetic
gtctgcgccagggcgcaggccccaccaccatcgtgggagcaaatgtggaagtgtctcacgcggctaaaacctacg

SEQ ID NO: 139734 - DNA, 75 bp, Artificial Sequence
  Synthetic
gtctgcgccagggcgcaggccccacctccatcgtgggaacaaatgtggaagtgtctcacgcggctaaaacctacg

SEQ ID NO: 139735 - DNA, 75 bp, Artificial Sequence
  Synthetic
gtctgcgccagggcgcaggccccacctccatcgtgggatcaaatgtggaagtgtctcacgcggctaaaacctacg

SEQ ID NO: 139736 - DNA, 75 bp, Artificial Sequence
  Synthetic
gtctgcgccagggcgcaggccccacctccatcgtgggaccaaatgtggaagtgtctcacgcggctaaaacctacg

SEQ ID NO: 139737 - DNA, 75 bp, Artificial Sequence
  Synthetic
gtctgcgccagggcgcaggccccacctccatcgtgggagcaaatgtggaagtgtctcacgcggctaaaacctacg

SEQ ID NO: 139738 - DNA, 75 bp, Artificial Sequence
  Synthetic
gtctgcgccagggcgcaggccccacccccatcgtgggaacaaatgtggaagtgtctcacgcggctaaaacctacg

SEQ ID NO: 139739 - DNA, 75 bp, Artificial Sequence
  Synthetic
gtctgcgccagggcgcaggccccacccccatcgtgggatcaaatgtggaagtgtctcacgcggctaaaacctacg

SEQ ID NO: 139740 - DNA, 75 bp, Artificial Sequence
  Synthetic
gtctgcgccagggcgcaggccccacccccatcgtgggaccaaatgtggaagtgtctcacgcggctaaaacctacg

SEQ ID NO: 139741 - DNA, 75 bp, Artificial Sequence
  Synthetic
gtctgcgccagggcgcaggccccacccccatcgtgggagcaaatgtggaagtgtctcacgcggctaaaacctacg

SEQ ID NO: 139742 - DNA, 75 bp, Artificial Sequence
  Synthetic
gtctgcgccagggcgcaggccccaccgccatcgtgggaacaaatgtggaagtgtctcacgcggctaaaacctacg

SEQ ID NO: 139743 - DNA, 75 bp, Artificial Sequence
  Synthetic
gtctgcgccagggcgcaggccccaccgccatcgtgggatcaaatgtggaagtgtctcacgcggctaaaacctacg

SEQ ID NO: 139744 - DNA, 75 bp, Artificial Sequence
  Synthetic
gtctgcgccagggcgcaggccccaccgccatcgtgggaccaaatgtggaagtgtctcacgcggctaaaacctacg

SEQ ID NO: 139745 - DNA, 75 bp, Artificial Sequence
  Synthetic
gtctgcgccagggcgcaggccccaccgccatcgtgggagcaaatgtggaagtgtctcacgcggctaaaacctacg

SEQ ID NO: 139746 - DNA, 75 bp, Artificial Sequence
  Synthetic
gtgtgcgccagggcgcaggccccaccaccatcgtgggaacaaatgtggaagtgtctcacgcggctaaaacctacg

SEQ ID NO: 139747 - DNA, 75 bp, Artificial Sequence
  Synthetic
gtgtgcgccagggcgcaggccccaccaccatcgtgggatcaaatgtggaagtgtctcacgcggctaaaacctacg

SEQ ID NO: 139748 - DNA, 75 bp, Artificial Sequence
  Synthetic
gtgtgcgccagggcgcaggccccaccaccatcgtgggaccaaatgtggaagtgtctcacgcggctaaaacctacg

SEQ ID NO: 139749 - DNA, 75 bp, Artificial Sequence
  Synthetic
gtgtgcgccagggcgcaggccccaccaccatcgtgggagcaaatgtggaagtgtctcacgcggctaaaacctacg

SEQ ID NO: 139750 - DNA, 75 bp, Artificial Sequence
  Synthetic
gtgtgcgccagggcgcaggccccacctccatcgtgggaacaaatgtggaagtgtctcacgcggctaaaacctacg

SEQ ID NO: 139751 - DNA, 75 bp, Artificial Sequence
  Synthetic
gtgtgcgccagggcgcaggccccacctccatcgtgggatcaaatgtggaagtgtctcacgcggctaaaacctacg

SEQ ID NO: 139752 - DNA, 75 bp, Artificial Sequence
  Synthetic
gtgtgcgccagggcgcaggccccacctccatcgtgggaccaaatgtggaagtgtctcacgcggctaaaacctacg

SEQ ID NO: 139753 - DNA, 75 bp, Artificial Sequence
  Synthetic
gtgtgcgccagggcgcaggccccacctccatcgtgggagcaaatgtggaagtgtctcacgcggctaaaacctacg

SEQ ID NO: 139754 - DNA, 75 bp, Artificial Sequence
  Synthetic
gtgtgcgccagggcgcaggccccacccccatcgtgggaacaaatgtggaagtgtctcacgcggctaaaacctacg

SEQ ID NO: 139755 - DNA, 75 bp, Artificial Sequence
  Synthetic
gtgtgcgccagggcgcaggccccacccccatcgtgggatcaaatgtggaagtgtctcacgcggctaaaacctacg

SEQ ID NO: 139756 - DNA, 75 bp, Artificial Sequence
  Synthetic
gtgtgcgccagggcgcaggccccacccccatcgtgggaccaaatgtggaagtgtctcacgcggctaaaacctacg

SEQ ID NO: 139757 - DNA, 75 bp, Artificial Sequence
  Synthetic
gtgtgcgccagggcgcaggccccacccccatcgtgggagcaaatgtggaagtgtctcacgcggctaaaacctacg

SEQ ID NO: 139758 - DNA, 75 bp, Artificial Sequence
  Synthetic
gtgtgcgccagggcgcaggccccaccgccatcgtgggaacaaatgtggaagtgtctcacgcggctaaaacctacg

SEQ ID NO: 139759 - DNA, 75 bp, Artificial Sequence
  Synthetic
gtgtgcgccagggcgcaggccccaccgccatcgtgggatcaaatgtggaagtgtctcacgcggctaaaacctacg

SEQ ID NO: 139760 - DNA, 75 bp, Artificial Sequence
  Synthetic
gtgtgcgccagggcgcaggccccaccgccatcgtgggaccaaatgtggaagtgtctcacgcggctaaaacctacg

SEQ ID NO: 139761 - DNA, 75 bp, Artificial Sequence
  Synthetic
gtgtgcgccagggcgcaggccccaccgccatcgtgggagcaaatgtggaagtgtctcacgcggctaaaacctacg

SEQ ID NO: 139762 - DNA, 75 bp, Artificial Sequence
  Synthetic
cagctctgacaagccctttaagcacatccacaaccctcctcctcaacatcttaggaggttgggtagcatcccagt

SEQ ID NO: 139763 - DNA, 75 bp, Artificial Sequence
  Synthetic
accccaatggggttctcgtatgatacccgctgctttgactccacagtcactgagagcgacatccgtacggaggag

SEQ ID NO: 139764 - DNA, 75 bp, Artificial Sequence
  Synthetic
aggccgatatccaccctcaaggggtcctcaggaggtccgctgctgtgccccctaggtcacgccgtcggcattttc

SEQ ID NO: 139765 - DNA, 75 bp, Artificial Sequence
  Synthetic
gcagccgtaggcagtatcggattaggccgagtcatcgtcgacattttggcgggctacggggcgggagtgtctggc

SEQ ID NO: 139766 - DNA, 75 bp, Artificial Sequence
  Synthetic
gctgccgtaggcagtatcggattaggccgagtcatcgtcgacattttggcgggctacggggcgggagtgtctggc

SEQ ID NO: 139767 - DNA, 75 bp, Artificial Sequence
  Synthetic
gccgccgtaggcagtatcggattaggccgagtcatcgtcgacattttggcgggctacggggcgggagtgtctggc

SEQ ID NO: 139768 - DNA, 75 bp, Artificial Sequence
  Synthetic
gcggccgtaggcagtatcggattaggccgagtcatcgtcgacattttggcgggctacggggcgggagtgtctggc

SEQ ID NO: 139769 - DNA, 75 bp, Artificial Sequence
  Synthetic
gctcaccgacccctcccacatcacagcagagacggctaagcgtaggctggccagagggtctcctccctctttggc

SEQ ID NO: 139770 - DNA, 75 bp, Artificial Sequence
  Synthetic
aggtctccggtgttcactgacaactccacccccccagctgtgccccagacctatcaagtagcccatctgcatgca

SEQ ID NO: 139771 - DNA, 75 bp, Artificial Sequence
  Synthetic
gtgtagtgtgtgctgctgtgctgcgccgccacgtcggcccctccgagggggcgacccagtggatgaacaggctca

SEQ ID NO: 139772 - DNA, 75 bp, Artificial Sequence
  Synthetic
caaaatctcaattttgagatgtacggggcagtatattcggtcaatccattagacctaccggccataattgaaagg

SEQ ID NO: 139773 - DNA, 75 bp, Artificial Sequence
  Synthetic
tcggggcttacatgtcaaaagcatacggcatcgatcccaacatccgatcaggtgtcaggaccattaccacaggtg

SEQ ID NO: 139774 - DNA, 75 bp, Artificial Sequence
  Synthetic
caccagcctactacgtagactccatgagtggattactagtgactggacgacaccatgctccacgacctggttgag

SEQ ID NO: 139775 - DNA, 75 bp, Artificial Sequence
  Synthetic
agacatctgggactgggtctgcaccgtgttgtcagacttcaaaacctggcttaagactaagcttatgccatccct

SEQ ID NO: 139776 - DNA, 75 bp, Artificial Sequence
  Synthetic
accacctccacggaggaagaggacggttgtcctgacagaatccaccgtgtcttctgccttggcggagcttgctac

SEQ ID NO: 139777 - DNA, 75 bp, Artificial Sequence
  Synthetic
ggtcatgtaaagaatgggtccatgaagatctcggggccaaaaacatgtagcaatgtctggcatggcaggtttcca

SEQ ID NO: 139778 - DNA, 75 bp, Artificial Sequence
  Synthetic
ggataaatgactgccattatgtggtaggagccactgccgacaatctgaaatgcccttgccaggtgccagcaccag

SEQ ID NO: 139779 - DNA, 75 bp, Artificial Sequence
  Synthetic
ccctcatgacaggcttcactggtgactttgactctgtgatagactgtaacacgtctgtcgtacaaactgttgact

SEQ ID NO: 139780 - DNA, 75 bp, Artificial Sequence
  Synthetic
ctatgccatggggtcacagctcccttgcgagcctgagcctgacgtgatggtgctcacgtccatgctctctgaccc

SEQ ID NO: 139781 - DNA, 75 bp, Artificial Sequence
  Synthetic
gctcggcgcctcgcacgagggtcccctccatctttggccagttcctcggcaagccagctctctgcaccatctttg

SEQ ID NO: 139782 - DNA, 75 bp, Artificial Sequence
  Synthetic
ctccatctttggccagttcctcggcaagccagctctctgcaccatctttgagggctacgggtaccaccgcccacg

SEQ ID NO: 139783 - DNA, 75 bp, Artificial Sequence
  Synthetic
cgactcctttgaccctcttgtcgccgagccggatgatagggagatatctgtggctgctgagtgtcatagaccacc

SEQ ID NO: 139784 - DNA, 75 bp, Artificial Sequence
  Synthetic
gtttcgggctgtgctctccctcccaagagtataccacctgtgccaccacctaggaggaagaaagtcgtacagctc

SEQ ID NO: 139785 - DNA, 75 bp, Artificial Sequence
  Synthetic
gtttcgggctgtgctctccctcccatgagtataccacctgtgccaccacctaggaggaagaaagtcgtacagctc

SEQ ID NO: 139786 - DNA, 75 bp, Artificial Sequence
  Synthetic
gtttcgggctgtgctctccctcccacgagtataccacctgtgccaccacctaggaggaagaaagtcgtacagctc

SEQ ID NO: 139787 - DNA, 75 bp, Artificial Sequence
  Synthetic
gtttcgggctgtgctctccctcccaggagtataccacctgtgccaccacctaggaggaagaaagtcgtacagctc

SEQ ID NO: 139788 - DNA, 75 bp, Artificial Sequence
  Synthetic
gtggcatcctggcggccttagctgcgtactgcttgtcggtgggcagcgtagtgatcgtcgggagggtcgtcttgt

SEQ ID NO: 139789 - DNA, 75 bp, Artificial Sequence
  Synthetic
ttcccacttccactgaggcagagtcctctggcggtgtagagacggcgtctgacgctgatttatacagctctatgc

SEQ ID NO: 139790 - DNA, 75 bp, Artificial Sequence
  Synthetic
ctctggcggtgtagagacggcgtctgacgctgatttatacagctctatgccgcctctggagggggaacctgggga

SEQ ID NO: 139791 - DNA, 75 bp, Artificial Sequence
  Synthetic
gcaactagctgagcagttcaaacaaaaagccctcggcgtgataggcgttgccagcaagcaggtccaggaagcagc

SEQ ID NO: 139792 - DNA, 75 bp, Artificial Sequence
  Synthetic
ttgcctagtaaccctgccattgcttcccttatgtcattcactgctgcagttacaagccctctgaccactcagcag

SEQ ID NO: 139793 - DNA, 75 bp, Artificial Sequence
  Synthetic
ggtgtactacctcacccgtgaccccaccaccccccttgcgcgggctgcgtgggagacagccagacacactccagt

SEQ ID NO: 139794 - DNA, 75 bp, Artificial Sequence
  Synthetic
cactacgatagtgtccttaaggagattaaggctcgagcttctggagtgaaggccaagcttctcaccacggaggaa

SEQ ID NO: 139795 - DNA, 75 bp, Artificial Sequence
  Synthetic
gccctggcggagcttgctacaaagaccttcggcagctccggatcgtcggccgttgacagcggcacggcgaccgca

SEQ ID NO: 139796 - DNA, 75 bp, Artificial Sequence
  Synthetic
gccctggcggagcttgctacaaagaccttcggcagctccggatcgtcggccgttgacagcggcacggcgaccgct

SEQ ID NO: 139797 - DNA, 75 bp, Artificial Sequence
  Synthetic
gccctggcggagcttgctacaaagaccttcggcagctccggatcgtcggccgttgacagcggcacggcgaccgcc

SEQ ID NO: 139798 - DNA, 75 bp, Artificial Sequence
  Synthetic
gccctggcggagcttgctacaaagaccttcggcagctccggatcgtcggccgttgacagcggcacggcgaccgcg

SEQ ID NO: 139799 - DNA, 75 bp, Artificial Sequence
  Synthetic
atgtatgcgcccaccttatgggcaaggatgattctgatgactcacttcttctccatccttctagctcaggagcaa

SEQ ID NO: 139800 - DNA, 75 bp, Artificial Sequence
  Synthetic
ggtgccggcgtagccggcgccgtggtcacatttaaaatcatgagtggcgaggtgccgtcaacagaagacctagtc

SEQ ID NO: 139801 - DNA, 75 bp, Artificial Sequence
  Synthetic
ccgtgtgggaagacttgctagaggacaacacaacacctattccaacaaccatcatggcaaagaatgaagtgttct

SEQ ID NO: 139802 - DNA, 75 bp, Artificial Sequence
  Synthetic
ccctggtcgtcggagtcgtgtgcgcagcaatactgcgtcgacacgtgggcccgggagagggggctgtgcagtgga

SEQ ID NO: 139803 - DNA, 75 bp, Artificial Sequence
  Synthetic
cctgatcttggagtgagggtgtgcgaaaagagggctctgtatgatcttgcacagaaactacccgaggcaataatg

SEQ ID NO: 139804 - DNA, 75 bp, Artificial Sequence
  Synthetic
agtggatgaaccgactcatcgcgttcgcatcacgaggcaatcatgtctcacccacgcactacgtccccgagactg

SEQ ID NO: 139805 - DNA, 75 bp, Artificial Sequence
  Synthetic
tggggtcccatcacttacgttgagcctcacagctcggaccagaggccctactgctggcactatgcacctcgaccg

SEQ ID NO: 139806 - DNA, 75 bp, Artificial Sequence
  Synthetic
ctgtctcgtgcccgaccccgctggttcatgtggtgcctactcctactttctgtaggggtaggcatctacctgctc

SEQ ID NO: 139807 - DNA, 75 bp, Artificial Sequence
  Synthetic
actccaccatagatcactcccctgtgaggaactactgtcttcacgcagaaagcgtctagccatggcgttagtatg

SEQ ID NO: 139808 - DNA, 75 bp, Artificial Sequence
  Synthetic
ggtggccccatgtacaactctcgaggccagtcgtgtgggtaccgcaggtgccgggctagtggtgttttcaccaca

SEQ ID NO: 139809 - DNA, 75 bp, Artificial Sequence
  Synthetic
ccgggctagtggtgttttcaccacaagcttgggtaataccatgacatgctacctgaaggctcaagcggcttgtag

SEQ ID NO: 139810 - DNA, 75 bp, Artificial Sequence
  Synthetic
accacctccacggagaaagaggacggttgtcctgacagaatccaccgtgtcttctgccttggcggagcttgctac

SEQ ID NO: 139811 - DNA, 75 bp, Artificial Sequence
  Synthetic
gtcttcacggaggctatgaccaggtattcggcccccccaggggatgaaccacgcccagagtacgatctggagcta

SEQ ID NO: 139812 - DNA, 75 bp, Artificial Sequence
  Synthetic
aatacgtggaggttcgtagggttggtgatttccattacatcacaggggtaacacaagacaccatcaagtgcccct

SEQ ID NO: 139813 - DNA, 75 bp, Artificial Sequence
  Synthetic
attcggcccccccaggggatgaaccacgcccagagtacgatctggagctaataacatcatgctcgtccaacgtct

SEQ ID NO: 139814 - DNA, 75 bp, Artificial Sequence
  Synthetic
tgctgcccaaactttcctggcaacgtgcatcaacggggtatgctggactgtctaccacggggccggaacgaggac

SEQ ID NO: 139815 - DNA, 75 bp, Artificial Sequence
  Synthetic
atcatgttcgcgcccacgatttgggtgcgcatggtgctgatgacacacttctttggaatactccaatcccaagaa

SEQ ID NO: 139816 - DNA, 75 bp, Artificial Sequence
  Synthetic
gctggccagctcatcggcgagtcagttgtcggccccatctctgaaagccacctgccctgccgatcatgactcccc

SEQ ID NO: 139817 - DNA, 75 bp, Artificial Sequence
  Synthetic
gtcctgttgcttttcctccttttggcggacgcgcgcgtatgtgcatgtttgtggatgatgctgttaatagctcag

SEQ ID NO: 139818 - DNA, 75 bp, Artificial Sequence
  Synthetic
attcagcggttgcatggcatggccgccttttcactccatggttactctccaggcgaactcaactgggtggcagcc

SEQ ID NO: 139819 - DNA, 75 bp, Artificial Sequence
  Synthetic
tggcctatttctccatgcagggagcgtgggccaaagtcattgccatcctccttcttgtcgcaggagtggatgcaa

SEQ ID NO: 139820 - DNA, 75 bp, Artificial Sequence
  Synthetic
agggccgaaccagacgacagggagatctccgtcgctgcagaggtcctccgcccctcaaagagattcccacccgcc

SEQ ID NO: 139821 - DNA, 75 bp, Artificial Sequence
  Synthetic
gcggccgatacctattcaactgggctgtgaagacaaagctcaaactcactccactccgcgatgcagctaacctgg

SEQ ID NO: 139822 - DNA, 75 bp, Artificial Sequence
  Synthetic
agcgcgtcccgggcccgaccccgcactttactcctgtgcctactcctactaacagtaggggtaggcatcttcctg

SEQ ID NO: 139823 - DNA, 75 bp, Artificial Sequence
  Synthetic
ccagtaagacgacccccgttcccccccccaggaggaagcgggcagtcgtactttctgagtctgtcatttccagcg

SEQ ID NO: 139824 - DNA, 75 bp, Artificial Sequence
  Synthetic
ccccaggaggaagcgggcagtcgtactttctgagtctgtcatttccagcgctttggcggatctggcagcgaagag

SEQ ID NO: 139825 - DNA, 75 bp, Artificial Sequence
  Synthetic
tcaggctgccccgagaggatggccagctgtaagccccttgccgatttcaaccagggctggggccctatcagctac

SEQ ID NO: 139826 - DNA, 75 bp, Artificial Sequence
  Synthetic
tacctccaatcattcaaagactccatggccttagcgcattttcactccatagttactctccaggtgaaatcaata

SEQ ID NO: 139827 - DNA, 75 bp, Artificial Sequence
  Synthetic
gattacccggtggggtcgcagttaccttgcgagcccgaaccggatgtggccgtgttgacgtccatgctcactgat

SEQ ID NO: 139828 - DNA, 75 bp, Artificial Sequence
  Synthetic
ccagctcataaacaccaacggtagctggcacatcaacaggactgccctgaactgcaatgactccctcaacaccgg

SEQ ID NO: 139829 - DNA, 75 bp, Artificial Sequence
  Synthetic
tcccgggtggcggacagatcgttggtggagtttacttgttgccgcgcaggggccctagattgggtgtgcgcgcga

SEQ ID NO: 139830 - DNA, 75 bp, Artificial Sequence
  Synthetic
ggatgtatgtaggaggggtggagcatcgattgtccgcagcatgcaacttcacgcgcggagatcgctgcagattgg

SEQ ID NO: 139831 - DNA, 75 bp, Artificial Sequence
  Synthetic
cgtccatgctcactgatccctcccatataacagcagagacggccaagagaaggttggcgaggggatcaccccctt

SEQ ID NO: 139832 - DNA, 75 bp, Artificial Sequence
  Synthetic
aacctgaaaagggtggtcgaaaacctgcgcgtctaatcgtataccctgacctgggggtccgggtgtgcgagaaga

SEQ ID NO: 139833 - DNA, 75 bp, Artificial Sequence
  Synthetic
tcacgcagggcttgcggacgcacatcgacatggttgtgatgtccgccacgctctgctccgctctctacgtggggg

SEQ ID NO: 139834 - DNA, 75 bp, Artificial Sequence
  Synthetic
cagggaatctacccggttgctctttttctatcttcttacttgctcttctgtcgtgcgtcacagtgccagtgtctg

SEQ ID NO: 139835 - DNA, 75 bp, Artificial Sequence
  Synthetic
caagttcaactcgtctgggtgccgggagcgcatggccagatgcagccccatcggcgagtttgatcaggggtgggg

SEQ ID NO: 139836 - DNA, 75 bp, Artificial Sequence
  Synthetic
caagacatgcgggggccccccgtgtaacatcggggggggcggcaataacaccttgacctgccctacggactgttt

SEQ ID NO: 139837 - DNA, 75 bp, Artificial Sequence
  Synthetic
gcgtcatgttcggcctagcctacttctctatgcagggagcgtgggcgaaggtcgttgtcatcctattgctcaccg

SEQ ID NO: 139838 - DNA, 75 bp, Artificial Sequence
  Synthetic
gccctggcgcccggcagaaaatccagctcatttataccaacggcagttggcacatcaaccgcactgccctgaatt

SEQ ID NO: 139839 - DNA, 75 bp, Artificial Sequence
  Synthetic
caccaaatggttgttagcactcctggggaccgctcacctccttaaagcgtccctgctaaaggtaccatactttgt

SEQ ID NO: 139840 - DNA, 75 bp, Artificial Sequence
  Synthetic
cggcggccattggggtgtggtgtttggcttggcctatttctccatgcagggagcgtgggccaaagtcattgccat

SEQ ID NO: 139841 - DNA, 75 bp, Artificial Sequence
  Synthetic
tgacgccttccggataggatggggcactttggaatacgaggataatgtcaccaattcgggggacatgagaccata

SEQ ID NO: 139842 - DNA, 75 bp, Artificial Sequence
  Synthetic
ccaattcgggggacatgagaccatattgctggcactatccaccaaaaccgtgtggcatagtccccgcgaaaactg

SEQ ID NO: 139843 - DNA, 75 bp, Artificial Sequence
  Synthetic
ctctggctgtcccgagcgcttgtcttcctgccgtgggctggacgattttcgtatcgggtggggaaccttggaata

SEQ ID NO: 139844 - DNA, 75 bp, Artificial Sequence
  Synthetic
agcttggttcggctgcacttggatgaacgggactgggttcactaagacatgcggagcaccaccttgccgcattag

SEQ ID NO: 139845 - DNA, 75 bp, Artificial Sequence
  Synthetic
aacgggactgggttcactaagacatgcggagcaccaccttgccgcattaggagggactacaacagcactctcgat

SEQ ID NO: 139846 - DNA, 75 bp, Artificial Sequence
  Synthetic
cagaagtcaactgtcccccttgttgcattccaccacggaatgggccattctaccctgctctttctcagacttgcc

SEQ ID NO: 139847 - DNA, 75 bp, Artificial Sequence
  Synthetic
acccccaggtgcctgatagactacccttatagactgtggcattatccgtgcactgtaaactttaccatcttcaag

SEQ ID NO: 139848 - DNA, 75 bp, Artificial Sequence
  Synthetic
ttggaagatagggataggggtcagcagagcccactgctgcattccaccactgagtgggcggtgttgccatgctcc

SEQ ID NO: 139849 - DNA, 75 bp, Artificial Sequence
  Synthetic
agatcaccaaaatcttgctcgccatactcggtccgctcacggtgctccaggccagcataatcagggtgccgtact

SEQ ID NO: 139850 - DNA, 75 bp, Artificial Sequence
  Synthetic
tcctgaacccgtccgttgccgctaccttgggttttggggcgtatatgtctaaggcacatggtatcgaccccaaca

SEQ ID NO: 139851 - DNA, 75 bp, Artificial Sequence
  Synthetic
gaaggttggggtaaacactccggcctcttaggccattcctgttttttttttttcccttttttttttttttttttt

SEQ ID NO: 139852 - DNA, 75 bp, Artificial Sequence
  Synthetic
tacagtgctgactgacttcaagacctggctccagaccaagcttttgccgcggttgccgggagtcccattcatctc

SEQ ID NO: 139853 - DNA, 75 bp, Artificial Sequence
  Synthetic
gacagggacaggtccgagctcagcccgttgctgctgtccaccacacagtggcaggtccttccgtgctccttcacg

SEQ ID NO: 139854 - DNA, 75 bp, Artificial Sequence
  Synthetic
gcggcggggtaggactggtaggggcaggagaggcatctacaggtttgtgactccaggagaacggccctcgggcat

SEQ ID NO: 139855 - DNA, 75 bp, Artificial Sequence
  Synthetic
caggtactccgcccctcccggggaccccccacaaccagaatacgacttggagctcataacatcatgctcctccaa

SEQ ID NO: 139856 - DNA, 75 bp, Artificial Sequence
  Synthetic
ctcagcactgggtttcttgccgcgctgttctacacacacaggttcaactcgtccggatgcccggggcgtatggcc

SEQ ID NO: 139857 - DNA, 75 bp, Artificial Sequence
  Synthetic
ggcgccaaacagaacgtccagctgatcaacaccaacggcagttggcacatcaatagcacagccttgaactgcaat

SEQ ID NO: 139858 - DNA, 75 bp, Artificial Sequence
  Synthetic
gatcgcttagggcaccccacgtacagctggggggaaaatgagactgatgtcatcatattgaactccaccaggcct

SEQ ID NO: 139859 - DNA, 75 bp, Artificial Sequence
  Synthetic
tgcccgccatcctttcgcccggagccctcgtagtcggtgtggtttgcgcagcaatactacgccggcacgttggtc

SEQ ID NO: 139860 - DNA, 75 bp, Artificial Sequence
  Synthetic
atgcctccggactctacacggtaaccaacgactgtagtaacggtagcatcgtgtatgaggccggggatgttatcc

SEQ ID NO: 139861 - DNA, 75 bp, Artificial Sequence
  Synthetic
atggcgtatggccgctgctcctgctcctactggcgttaccaccacgagcatacgccatggaccgggagatggccg

SEQ ID NO: 139862 - DNA, 75 bp, Artificial Sequence
  Synthetic
tcccagatggagaccaagctcatcacgtggggggcggacaccgccgcatgcggcgacatcatcaacggcttgccc

SEQ ID NO: 139863 - DNA, 75 bp, Artificial Sequence
  Synthetic
cgtgatggccggtgtggcttactactccatgcaagggaattgggccaaggtgtttctcgtgttatgtctattctc

SEQ ID NO: 139864 - DNA, 75 bp, Artificial Sequence
  Synthetic
tggcatacagtacctggcgggactctccaccttaccggggaatcccgcagtggcatcaatgatggctttcagcgc

SEQ ID NO: 139865 - DNA, 75 bp, Artificial Sequence
  Synthetic
cattggggccagctaacatctctggcccttcatctgaaaagccatactgctggcattatgcacctagaccttgcg

SEQ ID NO: 139866 - DNA, 75 bp, Artificial Sequence
  Synthetic
attcttcacggaagtggatggggtgcggctgcacaggtacgctccggcgtgcaagcctctcctacgggaggaggt

SEQ ID NO: 139867 - DNA, 75 bp, Artificial Sequence
  Synthetic
tcgggacaagaaccaggtcgagggggaggttcaggtggtctccaccgcgacgcaatctttcctggcgacctgcgt

SEQ ID NO: 139868 - DNA, 75 bp, Artificial Sequence
  Synthetic
ccagcttccgcttatgaggtgcgcaacgtgtccggggtgtaccatgtcacgaacgactgctccaactcaagcatt

SEQ ID NO: 139869 - DNA, 75 bp, Artificial Sequence
  Synthetic
ctggggggagaatgaatcagacgtgttcctgttggaatcagcacggccccctacggagccctggttcgggtgcac

SEQ ID NO: 139870 - DNA, 75 bp, Artificial Sequence
  Synthetic
acggactgtttcaggaaacaccccgatgccacctacaatcgttgcggtgctggcccgtggttaacaccaaggtgt

SEQ ID NO: 139871 - DNA, 75 bp, Artificial Sequence
  Synthetic
acgccgcctgcaactggactagaggagagcgttgcaacctggaggaccgggatcgcagcgaaatgtatcctctgc

SEQ ID NO: 139872 - DNA, 75 bp, Artificial Sequence
  Synthetic
tacactcaaccacagaacaagcaatactaccttgctcttttgtgccaatacccgccctatcaacaggtctcatac

SEQ ID NO: 139873 - DNA, 75 bp, Artificial Sequence
  Synthetic
caaatacaccgattcgcccccactccaggccccttcttccgggatgaggtaacgttcaccgtaggcctaaattcc

SEQ ID NO: 139874 - DNA, 75 bp, Artificial Sequence
  Synthetic
gcgaccctgagccggacaccgaggtattggcctccatgttgacagacccgtcccacatcaccgcggaggcggcag

SEQ ID NO: 139875 - DNA, 75 bp, Artificial Sequence
  Synthetic
acaacatggtctatgctacaacatcccgcagcgcaggcctacggcagaagaaggtcacctttgacagactgcaag

SEQ ID NO: 139876 - DNA, 75 bp, Artificial Sequence
  Synthetic
aaggtcacctttgacagactgcaagtcctggacgaccactaccgggacgtgctcaaggagatgaaggcgaaggcg

SEQ ID NO: 139877 - DNA, 75 bp, Artificial Sequence
  Synthetic
tccatgactgaggtagaggacgatcgtgagccttctgtaccatcagagtacttgatcaggaggagaaagttccca

SEQ ID NO: 139878 - DNA, 75 bp, Artificial Sequence
  Synthetic
tcttgttagcaatactagggcctctttacatcctacaagccagccttgttcgcgtcccctactttgtgcgggccc

SEQ ID NO: 139879 - DNA, 75 bp, Artificial Sequence
  Synthetic
ccattaccaggacgtgctcaaggaggttaaggcagcggcgtcaaaagtgaaggctaacttgctatccgtagagga

SEQ ID NO: 139880 - DNA, 75 bp, Artificial Sequence
  Synthetic
tgctgacgaccagctgcggtaatacccttacatgttacttgaaggcctctgcagcctgtcgagctgcaaagctcc

SEQ ID NO: 139881 - DNA, 75 bp, Artificial Sequence
  Synthetic
cgcagacgttcttgggcacatcagtggggggggtcatgtggaccgtctaccacggagctggttctaggacattag

SEQ ID NO: 139882 - DNA, 75 bp, Artificial Sequence
  Synthetic
gggtgtgtcccttgcgtccgcgagggtaacacctcgaaatgttgggtggcggtggcccccacagtggccaccagg

SEQ ID NO: 139883 - DNA, 75 bp, Artificial Sequence
  Synthetic
cgtgaagtgggaatgggtggtcctccttttcctgttgctggcagacgccagggtctgtgcatgtctttggatgct

SEQ ID NO: 139884 - DNA, 75 bp, Artificial Sequence
  Synthetic
ctggtaataagagaccagctctgcaaatgtacaccaacgtagaccaggacttggtcggctggccctctccacccg

SEQ ID NO: 139885 - DNA, 75 bp, Artificial Sequence
  Synthetic
cgggtggggaaccttggaatacgagactaatgtcaccaatgatgaggacatgaggccgtactgctggcattaccc

SEQ ID NO: 139886 - DNA, 75 bp, Artificial Sequence
  Synthetic
tcgctgcaggggtaggcatctacctcctccccaaccgataaaggttggggtaaacactccggcctcttaggccat

SEQ ID NO: 139887 - DNA, 75 bp, Artificial Sequence
  Synthetic
cgaccctaacgtgcgcaccggcacccgcaccataaccaccggcgcaaagctcacatactcaacatatgggaagtt

SEQ ID NO: 139888 - DNA, 75 bp, Artificial Sequence
  Synthetic
gcataggccttgggaaggtgcttgtggacatcctggcgggttatggagcgggggtggcaggcgcactcgtggcct

SEQ ID NO: 139889 - DNA, 75 bp, Artificial Sequence
  Synthetic
tcacatactcaacatatgggaagtttctagccgatggggggtgttcgggcggtgcttatgatgtcatcatttgtg

SEQ ID NO: 139890 - DNA, 75 bp, Artificial Sequence
  Synthetic
cacggctagctgtgaaaggtccgtgagccgcatgactgcagagagtgctgatactggcctctctgcagatcatgt

SEQ ID NO: 139891 - DNA, 75 bp, Artificial Sequence
  Synthetic
acatcactgggcgtcaacgctgtagcattttacaggggtcttgatgtgtccgtgataccaacacaaggagatgtc

SEQ ID NO: 139892 - DNA, 75 bp, Artificial Sequence
  Synthetic
gcagagtggtccctgtggccacgtactctgttctcggcttgtggtcctttctcctcctagtcctggccctaccac

SEQ ID NO: 139893 - DNA, 75 bp, Artificial Sequence
  Synthetic
cctgccgcggctaccgggaatccccttcctttcatgccaacgtgggtacaagggagtttggcggggagatggcgt

SEQ ID NO: 139894 - DNA, 75 bp, Artificial Sequence
  Synthetic
ttgaccctacgttttctattgagacccacacagtccctcaagacgcggtgtccagaagtcagagaaggggccgca

SEQ ID NO: 139895 - DNA, 75 bp, Artificial Sequence
  Synthetic
tccagaagtcagagaaggggccgcaccggtcgaggcaaaagtggcacttatcgctacgtctcgcccggtgaacgg

SEQ ID NO: 139896 - DNA, 75 bp, Artificial Sequence
  Synthetic
gtgtgagggtcctggaggacggggtaaattatgcgacagggaatttgcccggttgctctttttctatcttcctct

SEQ ID NO: 139897 - DNA, 75 bp, Artificial Sequence
  Synthetic
aacgtttcgcggtgctgggtggcgctaacccccaccgtggcggctccttacctcaatgctccagttgacgccttg

SEQ ID NO: 139898 - DNA, 75 bp, Artificial Sequence
  Synthetic
cgtttggcagctgcaggacgccgttctccatgttccaggatgtgttccatgcgagcggtggggcaatgcgtcccg

SEQ ID NO: 139899 - DNA, 75 bp, Artificial Sequence
  Synthetic
tctcccccctagctgggacgagacgtggaaatgcctcatccggctcaagccaactctgcacgggcccacacccct

SEQ ID NO: 139900 - DNA, 75 bp, Artificial Sequence
  Synthetic
ccttccaaccgcgccgccattggaccactcaagaatgcaattgttccatctacgctggacacatcacgggccaca

SEQ ID NO: 139901 - DNA, 75 bp, Artificial Sequence
  Synthetic
atagccattagccaacccggtgccctcacaaaggggctacggacgcacattgataccatcgtagtgtctgccacg

SEQ ID NO: 139902 - DNA, 75 bp, Artificial Sequence
  Synthetic
agcgcctgggtgttgcttgggggggtgatggcggcgctaacagcctactgtttgtcagtgggtagcgttgtcatc

SEQ ID NO: 139903 - DNA, 75 bp, Artificial Sequence
  Synthetic
gagtcattggggcgtactcgcagggctagcatacttcagcatgcaagccaattgggcgaaagttctcttggtcct

SEQ ID NO: 139904 - DNA, 75 bp, Artificial Sequence
  Synthetic
gtaactgttccatatacccaggccacattacaggacaacgtatggcgtgggatatgatgatgaattggtcaccaa

SEQ ID NO: 139905 - DNA, 75 bp, Artificial Sequence
  Synthetic
cttacatcgagcaagctcaggggatagcccaacagtttaaggagaaggtcatcggccttctccaacaagctgacc

SEQ ID NO: 139906 - DNA, 75 bp, Artificial Sequence
  Synthetic
gtcactcagatgtacaccagcgcagagggggacctcgtgggatggcctagcccccccgggactaagtctttagac

SEQ ID NO: 139907 - DNA, 75 bp, Artificial Sequence
  Synthetic
cagagggtgcagcttatcaacaccaatggaagctggcacgtcaacaggactgcccttaattgcaatgacagcctt

SEQ ID NO: 139908 - DNA, 75 bp, Artificial Sequence
  Synthetic
ttccatgcaaggggcatgggcaaaggtcattgtcatcatactcctgaccgcgggagtagaggcgactaccaacgt

SEQ ID NO: 139909 - DNA, 75 bp, Artificial Sequence
  Synthetic
ttccatgcaaggggcatgggcaaaggtcattgtcatcttactcctgaccgcgggagtagaggcgactaccaacgt

SEQ ID NO: 139910 - DNA, 75 bp, Artificial Sequence
  Synthetic
ttccatgcaaggggcatgggcaaaggtcattgtcatcctactcctgaccgcgggagtagaggcgactaccaacgt

SEQ ID NO: 139911 - DNA, 75 bp, Artificial Sequence
  Synthetic
ttccatgcaaggggcatgggcaaaggtcattgtcatcgtactcctgaccgcgggagtagaggcgactaccaacgt

SEQ ID NO: 139912 - DNA, 75 bp, Artificial Sequence
  Synthetic
aacacggggtggttggctggcttgttctacacctacaagttcaacagctccgggtgtcctgagcgaactgctagt

SEQ ID NO: 139913 - DNA, 75 bp, Artificial Sequence
  Synthetic
cttggccggattgtccaccttacccggtaatcctgctatagcatctctcatggcatttactgcatctgtgaccag

SEQ ID NO: 139914 - DNA, 75 bp, Artificial Sequence
  Synthetic
tcagagcggccgtgtgtgccaggggtgtggccaaatctattgacttcatccctgttgaatctctcgatatcgcca

SEQ ID NO: 139915 - DNA, 75 bp, Artificial Sequence
  Synthetic
cacatcaaccgcacagctttgaactgtaatgacagtctgcacactggtttcatcgcgtccctgttctacacccac

SEQ ID NO: 139916 - DNA, 75 bp, Artificial Sequence
  Synthetic
ccaaaagcggtgacatgagaccttactgctggcattacccgcctaaaccatgcggcatagtacccgcaaggtctg

SEQ ID NO: 139917 - DNA, 75 bp, Artificial Sequence
  Synthetic
ccaatagcggtgacatgagaccttactgctggcattacccgcctaaaccatgcggcatagtacccgcaaggtctg

SEQ ID NO: 139918 - DNA, 75 bp, Artificial Sequence
  Synthetic
ccaacagcggtgacatgagaccttactgctggcattacccgcctaaaccatgcggcatagtacccgcaaggtctg

SEQ ID NO: 139919 - DNA, 75 bp, Artificial Sequence
  Synthetic
ccaagagcggtgacatgagaccttactgctggcattacccgcctaaaccatgcggcatagtacccgcaaggtctg

SEQ ID NO: 139920 - DNA, 75 bp, Artificial Sequence
  Synthetic
gttcgggtgtgtttggatgaacggcactggattcaccaaggcatgtggtggccctccgtgcagagtgaaaaccag

SEQ ID NO: 139921 - DNA, 75 bp, Artificial Sequence
  Synthetic
tgtcttcctactgaacagtactcggccaccacagggtgcttggtttgggtgtacctggatgaatggcaccgggtt

SEQ ID NO: 139922 - DNA, 75 bp, Artificial Sequence
  Synthetic
gttcactatgcgtaccggctatggcactacccgtgcactgtgaacttcaccatcttcaaagtcaggatgtatatc

SEQ ID NO: 139923 - DNA, 75 bp, Artificial Sequence
  Synthetic
cagcgaaggttacagcactgctaagctctttgaccgttacacagctcctccgccggctccaccagtggatcaacg

SEQ ID NO: 139924 - DNA, 75 bp, Artificial Sequence
  Synthetic
caccaaaacctgcggcgcaccaccctgccgtgtcaggggagacttcaatgccagtgtggacttgttgtgccccac

SEQ ID NO: 139925 - DNA, 75 bp, Artificial Sequence
  Synthetic
caccaaaacctgcggcgcaccaccctgccgtgtcaggggtgacttcaatgccagtgtggacttgttgtgccccac

SEQ ID NO: 139926 - DNA, 75 bp, Artificial Sequence
  Synthetic
caccaaaacctgcggcgcaccaccctgccgtgtcaggggcgacttcaatgccagtgtggacttgttgtgccccac

SEQ ID NO: 139927 - DNA, 75 bp, Artificial Sequence
  Synthetic
caccaaaacctgcggcgcaccaccctgccgtgtcaggggggacttcaatgccagtgtggacttgttgtgccccac

SEQ ID NO: 139928 - DNA, 75 bp, Artificial Sequence
  Synthetic
ggatgaccgggtcctttcttggatcaacccgctcaatgcccggaaatttgggcgtgcccccgcaagactgctagc

SEQ ID NO: 139929 - DNA, 75 bp, Artificial Sequence
  Synthetic
gagatccctttttatggcaaggctatccccctagcttacatcaaggggggcagacacctgatcttttgccattca

SEQ ID NO: 139930 - DNA, 75 bp, Artificial Sequence
  Synthetic
cttgcccaagatgccaggtatccctttcctttcttgtcagaagggatacaggggtacttggcgaggcgatggagt

SEQ ID NO: 139931 - DNA, 75 bp, Artificial Sequence
  Synthetic
accgctgcgagttgcaggacagggacaggagtcagctgagtccactgctacacagcaccacagagtgggccgtcc

SEQ ID NO: 139932 - DNA, 75 bp, Artificial Sequence
  Synthetic
gccgtcggttgccacgactggttttacgccattctcttcatctgtgttgcttggcacattaagggcaagttccca

SEQ ID NO: 139933 - DNA, 75 bp, Artificial Sequence
  Synthetic
ccatcgggggtggtgtcttagccttgctgaccatcttgacgctatccccatactacaagcagtggctagcacgag

SEQ ID NO: 139934 - DNA, 75 bp, Artificial Sequence
  Synthetic
ggggttgaactcctacgtaataggatcgcagctcccctgtgagcctgagccggacgtcgcggtggtgacctcaat

SEQ ID NO: 139935 - DNA, 75 bp, Artificial Sequence
  Synthetic
tacttctttttgttttttgtgacggcctggaacatcaagggccgagtggttcctttcactacctattccttgcta

SEQ ID NO: 139936 - DNA, 75 bp, Artificial Sequence
  Synthetic
tacttctttttgttttttgtgacggcctggtacatcaagggccgagtggttcctttcactacctattccttgcta

SEQ ID NO: 139937 - DNA, 75 bp, Artificial Sequence
  Synthetic
tacttctttttgttttttgtgacggcctggcacatcaagggccgagtggttcctttcactacctattccttgcta

SEQ ID NO: 139938 - DNA, 75 bp, Artificial Sequence
  Synthetic
tacttctttttgttttttgtgacggcctgggacatcaagggccgagtggttcctttcactacctattccttgcta

SEQ ID NO: 139939 - DNA, 75 bp, Artificial Sequence
  Synthetic
tctcgcaactatagcctatccttctctggtctttgaggttactaagcatttgctcgcactgctgggtcccctgta

SEQ ID NO: 139940 - DNA, 75 bp, Artificial Sequence
  Synthetic
gccccgtcgaggaaagctacgtgcactacgcacggacggcatccagacgctgagcttatcactgccaatttgttg

SEQ ID NO: 139941 - DNA, 75 bp, Artificial Sequence
  Synthetic
tcatctctgacgtcacgctaaccccggcgtataagatcctcatttgccggtgcttgtggtggctgagctatatgc

SEQ ID NO: 139942 - DNA, 75 bp, Artificial Sequence
  Synthetic
tcatctctgtcgtcacgctaaccccggcgtataagatcctcatttgccggtgcttgtggtggctgagctatatgc

SEQ ID NO: 139943 - DNA, 75 bp, Artificial Sequence
  Synthetic
tcatctctgccgtcacgctaaccccggcgtataagatcctcatttgccggtgcttgtggtggctgagctatatgc

SEQ ID NO: 139944 - DNA, 75 bp, Artificial Sequence
  Synthetic
tcatctctggcgtcacgctaaccccggcgtataagatcctcatttgccggtgcttgtggtggctgagctatatgc

SEQ ID NO: 139945 - DNA, 75 bp, Artificial Sequence
  Synthetic
ggcgtataagatcctcatttgccggtgcttgtggtggctgagctatatgctagtcttggcagaagccctgatcca

SEQ ID NO: 139946 - DNA, 75 bp, Artificial Sequence
  Synthetic
ggcgtataagatcctcatttgccggtgcttgtggtggctgagctatatgctagtcttggcagatgccctgatcca

SEQ ID NO: 139947 - DNA, 75 bp, Artificial Sequence
  Synthetic
ggcgtataagatcctcatttgccggtgcttgtggtggctgagctatatgctagtcttggcagacgccctgatcca

SEQ ID NO: 139948 - DNA, 75 bp, Artificial Sequence
  Synthetic
ggcgtataagatcctcatttgccggtgcttgtggtggctgagctatatgctagtcttggcagaggccctgatcca

SEQ ID NO: 139949 - DNA, 75 bp, Artificial Sequence
  Synthetic
cggggcggccgtgatggcatgatatgggccgcaaccatgttatgtccaggcgtggtgtttgacataaccaagtgg

SEQ ID NO: 139950 - DNA, 75 bp, Artificial Sequence
  Synthetic
cggggcggccgtgatggcatgatatgggccgcaaccatgttttgtccaggcgtggtgtttgacataaccaagtgg

SEQ ID NO: 139951 - DNA, 75 bp, Artificial Sequence
  Synthetic
cggggcggccgtgatggcatgatatgggccgcaaccatgttctgtccaggcgtggtgtttgacataaccaagtgg

SEQ ID NO: 139952 - DNA, 75 bp, Artificial Sequence
  Synthetic
cggggcggccgtgatggcatgatatgggccgcaaccatgttgtgtccaggcgtggtgtttgacataaccaagtgg

SEQ ID NO: 139953 - DNA, 75 bp, Artificial Sequence
  Synthetic
cggggcggccgtgatggcatgatatgggccgctaccatgttatgtccaggcgtggtgtttgacataaccaagtgg

SEQ ID NO: 139954 - DNA, 75 bp, Artificial Sequence
  Synthetic
cggggcggccgtgatggcatgatatgggccgctaccatgttttgtccaggcgtggtgtttgacataaccaagtgg

SEQ ID NO: 139955 - DNA, 75 bp, Artificial Sequence
  Synthetic
cggggcggccgtgatggcatgatatgggccgctaccatgttctgtccaggcgtggtgtttgacataaccaagtgg

SEQ ID NO: 139956 - DNA, 75 bp, Artificial Sequence
  Synthetic
cggggcggccgtgatggcatgatatgggccgctaccatgttgtgtccaggcgtggtgtttgacataaccaagtgg

SEQ ID NO: 139957 - DNA, 75 bp, Artificial Sequence
  Synthetic
cggggcggccgtgatggcatgatatgggccgccaccatgttatgtccaggcgtggtgtttgacataaccaagtgg

SEQ ID NO: 139958 - DNA, 75 bp, Artificial Sequence
  Synthetic
cggggcggccgtgatggcatgatatgggccgccaccatgttttgtccaggcgtggtgtttgacataaccaagtgg

SEQ ID NO: 139959 - DNA, 75 bp, Artificial Sequence
  Synthetic
cggggcggccgtgatggcatgatatgggccgccaccatgttctgtccaggcgtggtgtttgacataaccaagtgg

SEQ ID NO: 139960 - DNA, 75 bp, Artificial Sequence
  Synthetic
cggggcggccgtgatggcatgatatgggccgccaccatgttgtgtccaggcgtggtgtttgacataaccaagtgg

SEQ ID NO: 139961 - DNA, 75 bp, Artificial Sequence
  Synthetic
cggggcggccgtgatggcatgatatgggccgcgaccatgttatgtccaggcgtggtgtttgacataaccaagtgg

SEQ ID NO: 139962 - DNA, 75 bp, Artificial Sequence
  Synthetic
cggggcggccgtgatggcatgatatgggccgcgaccatgttttgtccaggcgtggtgtttgacataaccaagtgg

SEQ ID NO: 139963 - DNA, 75 bp, Artificial Sequence
  Synthetic
cggggcggccgtgatggcatgatatgggccgcgaccatgttctgtccaggcgtggtgtttgacataaccaagtgg

SEQ ID NO: 139964 - DNA, 75 bp, Artificial Sequence
  Synthetic
cggggcggccgtgatggcatgatatgggccgcgaccatgttgtgtccaggcgtggtgtttgacataaccaagtgg

SEQ ID NO: 139965 - DNA, 75 bp, Artificial Sequence
  Synthetic
gcagacaccgcggcgtgtggggacatcatctcgggcctacccgtctccgcccgaagggggagggagatacttctg

SEQ ID NO: 139966 - DNA, 75 bp, Artificial Sequence
  Synthetic
acgagctctcagtagctgctgagtgtttcaagaaaccaccgaagtatcctccggcccttcccatttgggccagac

SEQ ID NO: 139967 - DNA, 75 bp, Artificial Sequence
  Synthetic
atgatgatgaactggagccccaccgcgacgctaatcctcgcccagatcatgaggattcctgcggtcgtggttgac

SEQ ID NO: 139968 - DNA, 75 bp, Artificial Sequence
  Synthetic
gacaaggagatcttatatgaggcctttgatgagatggaagagtgcgcctccaaagccgccctcattgaggaaggg

SEQ ID NO: 139969 - DNA, 75 bp, Artificial Sequence
  Synthetic
tgaagcacctcgccgggggcaagtacatccagatggcgctaatcgccattggcaactggactggcacatacatct

SEQ ID NO: 139970 - DNA, 75 bp, Artificial Sequence
  Synthetic
ccgggcccggagcgtccgcgctaggcttctgtccagaggaggcagggctgccatatgtggcaaatacctcttcaa

SEQ ID NO: 139971 - DNA, 75 bp, Artificial Sequence
  Synthetic
gccacctccgcgcaggaagagaaccatcgttctcagcgagtctacagtgtcaaaagcactggccagcttagctga

SEQ ID NO: 139972 - DNA, 75 bp, Artificial Sequence
  Synthetic
gagtagacgccgacacccgcgttaccgggggagcagtaggccataccgttcaaggctttgctagcctatttgcgg

SEQ ID NO: 139973 - DNA, 75 bp, Artificial Sequence
  Synthetic
catcatctggggggcagagacggcagcatgtggtgacatcatatatggactccccgtgtccgctcgattgggccg

SEQ ID NO: 139974 - DNA, 75 bp, Artificial Sequence
  Synthetic
catcatctggggggcagagacggcagcttgtggtgacatcatatatggactccccgtgtccgctcgattgggccg

SEQ ID NO: 139975 - DNA, 75 bp, Artificial Sequence
  Synthetic
catcatctggggggcagagacggcagcctgtggtgacatcatatatggactccccgtgtccgctcgattgggccg

SEQ ID NO: 139976 - DNA, 75 bp, Artificial Sequence
  Synthetic
catcatctggggggcagagacggcagcgtgtggtgacatcatatatggactccccgtgtccgctcgattgggccg

SEQ ID NO: 139977 - DNA, 75 bp, Artificial Sequence
  Synthetic
gacgactcggacaacgagtctcattcatctatgccccctcttgaaggagagccgggcgatccggacctaagttcc

SEQ ID NO: 139978 - DNA, 75 bp, Artificial Sequence
  Synthetic
ggctggcttgttatacgcccacaagtttaacagctccgggtgccctgaaaggctcgccagctgcaagaagctcga

SEQ ID NO: 139979 - DNA, 75 bp, Artificial Sequence
  Synthetic
catctatgccccctcttgaaggagagccgggcgatccggacctaagttccggttcttggtccacggtcagcgggg

SEQ ID NO: 139980 - DNA, 75 bp, Artificial Sequence
  Synthetic
gctatagtggtgagtttgacggggcgagacaaaacggagtgtgccggagaggttcaagtcctgtccacagttact

SEQ ID NO: 139981 - DNA, 75 bp, Artificial Sequence
  Synthetic
gctatagtggtgagtttgacggggcgtgacaaaacggagtgtgccggagaggttcaagtcctgtccacagttact

SEQ ID NO: 139982 - DNA, 75 bp, Artificial Sequence
  Synthetic
gctatagtggtgagtttgacggggcgcgacaaaacggagtgtgccggagaggttcaagtcctgtccacagttact

SEQ ID NO: 139983 - DNA, 75 bp, Artificial Sequence
  Synthetic
gctatagtggtgagtttgacggggcgggacaaaacggagtgtgccggagaggttcaagtcctgtccacagttact

SEQ ID NO: 139984 - DNA, 75 bp, Artificial Sequence
  Synthetic
tgcggagtggagccagcgtccaaggtatgcgggcccgtgtattgcttcacgcccagccctgtagtagtcgggacg

SEQ ID NO: 139985 - DNA, 75 bp, Artificial Sequence
  Synthetic
actaggcatgcagacgttattcctgttcgcaggagaggtgacaatcgaggtgccctcctcagccctagaccaata

SEQ ID NO: 139986 - DNA, 75 bp, Artificial Sequence
  Synthetic
ccccggcgtaggtcacgtaatttgggtaaggtcatcgatacccttacatgtggcttcgccgacctcatggggtac

SEQ ID NO: 139987 - DNA, 75 bp, Artificial Sequence
  Synthetic
tgtataccagcgccgaaggagacctagtggggtggcctagcccccccggaaccaagtccttcgagccatgcacat

SEQ ID NO: 139988 - DNA, 75 bp, Artificial Sequence
  Synthetic
tgtataccagcgccgaaggagaccttgtggggtggcctagcccccccggaaccaagtccttcgagccatgcacat

SEQ ID NO: 139989 - DNA, 75 bp, Artificial Sequence
  Synthetic
tgtataccagcgccgaaggagacctcgtggggtggcctagcccccccggaaccaagtccttcgagccatgcacat

SEQ ID NO: 139990 - DNA, 75 bp, Artificial Sequence
  Synthetic
tgtataccagcgccgaaggagacctggtggggtggcctagcccccccggaaccaagtccttcgagccatgcacat

SEQ ID NO: 139991 - DNA, 75 bp, Artificial Sequence
  Synthetic
gtgtgtggatgaacaagactgggttcacgaaagcatgtggcggccctccgtgtggcgtgcgtgtcagcaacggca

SEQ ID NO: 139992 - DNA, 75 bp, Artificial Sequence
  Synthetic
cacgaaagcatgtggcggccctccgtgtggcgtgcgtgtcagcaacggcagcacgtggcactgccctaccgattg

SEQ ID NO: 139993 - DNA, 75 bp, Artificial Sequence
  Synthetic
cttggccctgctttcgtgcctaacagtcccgacctcggctttggaagtgcgcaatgtctctgggatctaccacgt

SEQ ID NO: 139994 - DNA, 75 bp, Artificial Sequence
  Synthetic
gatcactgaagattgcccagtcccatgttcggggtcttggctccaggacatttgggattgggtttgttccattct

SEQ ID NO: 139995 - DNA, 75 bp, Artificial Sequence
  Synthetic
ctgcagtgccccaatcctaccaagtcgcccatctgcacgcaccgacgggaagtggcaagagcaccaaagtaccgg

SEQ ID NO: 139996 - DNA, 75 bp, Artificial Sequence
  Synthetic
atcgtctctaaaagggtcatcgggaggaccggtcctctgcacaagggggcatgcagttggaattttccgggcggc

SEQ ID NO: 139997 - DNA, 75 bp, Artificial Sequence
  Synthetic
atcgtctctaaaagggtcatcgggaggaccggtcctctgcactagggggcatgcagttggaattttccgggcggc

SEQ ID NO: 139998 - DNA, 75 bp, Artificial Sequence
  Synthetic
atcgtctctaaaagggtcatcgggaggaccggtcctctgcaccagggggcatgcagttggaattttccgggcggc

SEQ ID NO: 139999 - DNA, 75 bp, Artificial Sequence
  Synthetic
atcgtctctaaaagggtcatcgggaggaccggtcctctgcacgagggggcatgcagttggaattttccgggcggc

SEQ ID NO: 140000 - DNA, 75 bp, Artificial Sequence
  Synthetic
atcgtctctaaaagggtcatcgggaggaccggtcctctgctcaagggggcatgcagttggaattttccgggcggc

SEQ ID NO: 140001 - DNA, 75 bp, Artificial Sequence
  Synthetic
atcgtctctaaaagggtcatcgggaggaccggtcctctgctctagggggcatgcagttggaattttccgggcggc

SEQ ID NO: 140002 - DNA, 75 bp, Artificial Sequence
  Synthetic
atcgtctctaaaagggtcatcgggaggaccggtcctctgctccagggggcatgcagttggaattttccgggcggc

SEQ ID NO: 140003 - DNA, 75 bp, Artificial Sequence
  Synthetic
atcgtctctaaaagggtcatcgggaggaccggtcctctgctcgagggggcatgcagttggaattttccgggcggc

SEQ ID NO: 140004 - DNA, 75 bp, Artificial Sequence
  Synthetic
atcgtctctaaaagggtcatcgggaggaccggtcctctgcccaagggggcatgcagttggaattttccgggcggc

SEQ ID NO: 140005 - DNA, 75 bp, Artificial Sequence
  Synthetic
atcgtctctaaaagggtcatcgggaggaccggtcctctgccctagggggcatgcagttggaattttccgggcggc

SEQ ID NO: 140006 - DNA, 75 bp, Artificial Sequence
  Synthetic
atcgtctctaaaagggtcatcgggaggaccggtcctctgccccagggggcatgcagttggaattttccgggcggc

SEQ ID NO: 140007 - DNA, 75 bp, Artificial Sequence
  Synthetic
atcgtctctaaaagggtcatcgggaggaccggtcctctgcccgagggggcatgcagttggaattttccgggcggc

SEQ ID NO: 140008 - DNA, 75 bp, Artificial Sequence
  Synthetic
atcgtctctaaaagggtcatcgggaggaccggtcctctgcgcaagggggcatgcagttggaattttccgggcggc

SEQ ID NO: 140009 - DNA, 75 bp, Artificial Sequence
  Synthetic
atcgtctctaaaagggtcatcgggaggaccggtcctctgcgctagggggcatgcagttggaattttccgggcggc

SEQ ID NO: 140010 - DNA, 75 bp, Artificial Sequence
  Synthetic
atcgtctctaaaagggtcatcgggaggaccggtcctctgcgccagggggcatgcagttggaattttccgggcggc

SEQ ID NO: 140011 - DNA, 75 bp, Artificial Sequence
  Synthetic
atcgtctctaaaagggtcatcgggaggaccggtcctctgcgcgagggggcatgcagttggaattttccgggcggc

SEQ ID NO: 140012 - DNA, 75 bp, Artificial Sequence
  Synthetic
ccttgcaccatcaactttaccatctttaaagtcaggatgtacgttggcggcctggagcatcggttggaggcggcg

SEQ ID NO: 140013 - DNA, 75 bp, Artificial Sequence
  Synthetic
ggggggccgcgatgccatcatcctcctcacgtgcgcgatccacccagagctgatctttgacatcaccaaactcct

SEQ ID NO: 140014 - DNA, 75 bp, Artificial Sequence
  Synthetic
tgtggatcccccccctcaacgttcgggggggccgcgatgccatcatcctcctcacgtgcgcgatccacccagagc

SEQ ID NO: 140015 - DNA, 75 bp, Artificial Sequence
  Synthetic
agatgctgggtgtcgctcacccccaccttagccgccagggacagcaccgtccccgtcagggcgatcagagaccac

SEQ ID NO: 140016 - DNA, 75 bp, Artificial Sequence
  Synthetic
gtgtggttttgccgacctcatggggtacatccctgtcgttggcgccccggtcggaggcgtcgccagagctctggc

SEQ ID NO: 140017 - DNA, 75 bp, Artificial Sequence
  Synthetic
acatgtccaaggcacatggcatcgacccgaacatacggtcaggtgtcagaaccatcaccacaggcgcaccaatca

SEQ ID NO: 140018 - DNA, 75 bp, Artificial Sequence
  Synthetic
ccagctgtgccccagacttaccaagtggggtacttgcacgctcccactggtagtgggaaaagcaccaaggtccct

SEQ ID NO: 140019 - DNA, 75 bp, Artificial Sequence
  Synthetic
ccagctgtgccccagtcttaccaagtggggtacttgcacgctcccactggtagtgggaaaagcaccaaggtccct

SEQ ID NO: 140020 - DNA, 75 bp, Artificial Sequence
  Synthetic
ccagctgtgccccagccttaccaagtggggtacttgcacgctcccactggtagtgggaaaagcaccaaggtccct

SEQ ID NO: 140021 - DNA, 75 bp, Artificial Sequence
  Synthetic
ccagctgtgccccaggcttaccaagtggggtacttgcacgctcccactggtagtgggaaaagcaccaaggtccct

SEQ ID NO: 140022 - DNA, 75 bp, Artificial Sequence
  Synthetic
cgcactgacaggtacgtacgtttatgaccatctcgccccactgcagcattgggcccacgcgggcttacgagatct

SEQ ID NO: 140023 - DNA, 75 bp, Artificial Sequence
  Synthetic
cctattcctctttgctggagttgatgccgaaacccaggtgtctgggggctcggttgcccgagccgccaacggcct

SEQ ID NO: 140024 - DNA, 75 bp, Artificial Sequence
  Synthetic
gctgcatacgcagcccagggatacaaggtgctggtgctgaacccctccgtggctgccaccctgggatttggggcc

SEQ ID NO: 140025 - DNA, 75 bp, Artificial Sequence
  Synthetic
gctgcatacgctgcccagggatacaaggtgctggtgctgaacccctccgtggctgccaccctgggatttggggcc

SEQ ID NO: 140026 - DNA, 75 bp, Artificial Sequence
  Synthetic
gctgcatacgccgcccagggatacaaggtgctggtgctgaacccctccgtggctgccaccctgggatttggggcc

SEQ ID NO: 140027 - DNA, 75 bp, Artificial Sequence
  Synthetic
gctgcatacgcggcccagggatacaaggtgctggtgctgaacccctccgtggctgccaccctgggatttggggcc

SEQ ID NO: 140028 - DNA, 75 bp, Artificial Sequence
  Synthetic
ccttagccgccagggacagcaccgtccccgtcagggcgatcagagaccacgtcgacttgctggtcggggctgcca

SEQ ID NO: 140029 - DNA, 75 bp, Artificial Sequence
  Synthetic
aatccttggcataggcacggtcttagaccaggcagaaactgctggagttcgcctcgtcgtactcgcaactgccac

SEQ ID NO: 140030 - DNA, 75 bp, Artificial Sequence
  Synthetic
ctgcaattgctctatctatcccgggcatgtcaccggccatcgtatggcctgggatatgatgatgaactggtcccc

SEQ ID NO: 140031 - DNA, 75 bp, Artificial Sequence
  Synthetic
ttaaacactgggttctttgctagcctgttctacaccaacaaattcaacagctcagggtgtcccgaacgactcgca

SEQ ID NO: 140032 - DNA, 75 bp, Artificial Sequence
  Synthetic
cggatgccagggtttgtgcgtgcctctggatgatgctgctggtttcgcaagtcgaggcggcgatggctaatttga

SEQ ID NO: 140033 - DNA, 75 bp, Artificial Sequence
  Synthetic
cacgcaaatatagaggaggtcgccctgccgacgacaggagaaatacctttctacggtagggctatccctctggca

SEQ ID NO: 140034 - DNA, 75 bp, Artificial Sequence
  Synthetic
acctgcaaaagccttggtactttcaaccagggctggggtccacttagggtcgccaacatcaacggctcatctgaa

SEQ ID NO: 140035 - DNA, 75 bp, Artificial Sequence
  Synthetic
ttgcgctgctggatacaagtaacacctaatgtggctgtgaaacatcgcggcgcactcactcacaacctgcgaaca

SEQ ID NO: 140036 - DNA, 75 bp, Artificial Sequence
  Synthetic
agcctatgacatcataatatgcgatgaatgccatgctgtggattccacaacaattcttggcattgggacagttct

SEQ ID NO: 140037 - DNA, 75 bp, Artificial Sequence
  Synthetic
agcctatgacatcataatatgcgatgaatgccatgctgtggattccacaactattcttggcattgggacagttct

SEQ ID NO: 140038 - DNA, 75 bp, Artificial Sequence
  Synthetic
agcctatgacatcataatatgcgatgaatgccatgctgtggattccacaaccattcttggcattgggacagttct

SEQ ID NO: 140039 - DNA, 75 bp, Artificial Sequence
  Synthetic
agcctatgacatcataatatgcgatgaatgccatgctgtggattccacaacgattcttggcattgggacagttct

SEQ ID NO: 140040 - DNA, 75 bp, Artificial Sequence
  Synthetic
ctaatgtggctgtgaaacatcgcggcgcactcactcacaacctgcgaacacatgtcgacgtgatcgtaatggcag

SEQ ID NO: 140041 - DNA, 75 bp, Artificial Sequence
  Synthetic
tgctgcttacgcggcttgtggaatgtggcctctgctcctcctgctccttgcactgcccgaaagggcatatgctat

SEQ ID NO: 140042 - DNA, 75 bp, Artificial Sequence
  Synthetic
actataggggtctggacgtctcagtaatacctacatctggagacgtagtggtatgtgccacagatgccctcatga

SEQ ID NO: 140043 - DNA, 75 bp, Artificial Sequence
  Synthetic
ctttagcccgggcgcccagcagagcctccagcttataaacaccaatggcagctggcacctcaacaggacggccct

SEQ ID NO: 140044 - DNA, 75 bp, Artificial Sequence
  Synthetic
ctcggccatgagggggagatccccttctacgggaaggccattcctcttgctaacatcaagggagggaggcatttg

SEQ ID NO: 140045 - DNA, 75 bp, Artificial Sequence
  Synthetic
cgccagaacgccacaacttcacccaagagtgcaactgttccatctaccaaggccatatcaccggccatcgcatgg

SEQ ID NO: 140046 - DNA, 75 bp, Artificial Sequence
  Synthetic
agtcattgactgcaatacctctgtaatacagactgtggacttcagcttggatccaaccttctccatagagaccac

SEQ ID NO: 140047 - DNA, 75 bp, Artificial Sequence
  Synthetic
tggtggatgcagtatttcatcgccagagccgaagcccttctccacgtgtacgttccatcctttgaaccgcgtgga

SEQ ID NO: 140048 - DNA, 75 bp, Artificial Sequence
  Synthetic
taacatcaagggagggaggcatttgatcttttgccactcaaagaaaaaatgcgatgagctagcagccgcattacg

SEQ ID NO: 140049 - DNA, 75 bp, Artificial Sequence
  Synthetic
caacaatggaacctggtcctgccccactgattgtttcaggaagcatccggagaccacctacgccaaatgcgggtc

SEQ ID NO: 140050 - DNA, 75 bp, Artificial Sequence
  Synthetic
catcccatcactcactttgctcaggggtatgggcctatcacctatgtctctgatgcccgtgaggccgtgaacagc

SEQ ID NO: 140051 - DNA, 75 bp, Artificial Sequence
  Synthetic
acggggtacactggtgacttcgactctgtgatagattgcaatgtagcagtcacccaggtcgttgacttcagctta

SEQ ID NO: 140052 - DNA, 75 bp, Artificial Sequence
  Synthetic
acggggtacactggtgacttcgactctgtgattgattgcaatgtagcagtcacccaggtcgttgacttcagctta

SEQ ID NO: 140053 - DNA, 75 bp, Artificial Sequence
  Synthetic
acggggtacactggtgacttcgactctgtgatcgattgcaatgtagcagtcacccaggtcgttgacttcagctta

SEQ ID NO: 140054 - DNA, 75 bp, Artificial Sequence
  Synthetic
acggggtacactggtgacttcgactctgtgatggattgcaatgtagcagtcacccaggtcgttgacttcagctta

SEQ ID NO: 140055 - DNA, 75 bp, Artificial Sequence
  Synthetic
tccaggcttcgctcttgcgagtcccttacttcgtgagggcgcacgctctgatcaagctctgcagcctggtgaaag

SEQ ID NO: 140056 - DNA, 75 bp, Artificial Sequence
  Synthetic
acttcaatacaccaggcctacccgtttgtcaagaccatcttgagttttgggagagcgtcttcacaggtttaacca

SEQ ID NO: 140057 - DNA, 75 bp, Artificial Sequence
  Synthetic
ggtatgtatctgccggtgagagagcatcaggaatgttagactccgtggtgctctgtgaatgctacgacgctggtg

SEQ ID NO: 140058 - DNA, 75 bp, Artificial Sequence
  Synthetic
ggtatgtatctgccggtgagagagcatcaggaatgtttgactccgtggtgctctgtgaatgctacgacgctggtg

SEQ ID NO: 140059 - DNA, 75 bp, Artificial Sequence
  Synthetic
ggtatgtatctgccggtgagagagcatcaggaatgttcgactccgtggtgctctgtgaatgctacgacgctggtg

SEQ ID NO: 140060 - DNA, 75 bp, Artificial Sequence
  Synthetic
ggtatgtatctgccggtgagagagcatcaggaatgttggactccgtggtgctctgtgaatgctacgacgctggtg

SEQ ID NO: 140061 - DNA, 75 bp, Artificial Sequence
  Synthetic
ggtatgtatctgccggtgagagagcttcaggaatgttagactccgtggtgctctgtgaatgctacgacgctggtg

SEQ ID NO: 140062 - DNA, 75 bp, Artificial Sequence
  Synthetic
ggtatgtatctgccggtgagagagcttcaggaatgtttgactccgtggtgctctgtgaatgctacgacgctggtg

SEQ ID NO: 140063 - DNA, 75 bp, Artificial Sequence
  Synthetic
ggtatgtatctgccggtgagagagcttcaggaatgttcgactccgtggtgctctgtgaatgctacgacgctggtg

SEQ ID NO: 140064 - DNA, 75 bp, Artificial Sequence
  Synthetic
ggtatgtatctgccggtgagagagcttcaggaatgttggactccgtggtgctctgtgaatgctacgacgctggtg

SEQ ID NO: 140065 - DNA, 75 bp, Artificial Sequence
  Synthetic
ggtatgtatctgccggtgagagagcctcaggaatgttagactccgtggtgctctgtgaatgctacgacgctggtg

SEQ ID NO: 140066 - DNA, 75 bp, Artificial Sequence
  Synthetic
ggtatgtatctgccggtgagagagcctcaggaatgtttgactccgtggtgctctgtgaatgctacgacgctggtg

SEQ ID NO: 140067 - DNA, 75 bp, Artificial Sequence
  Synthetic
ggtatgtatctgccggtgagagagcctcaggaatgttcgactccgtggtgctctgtgaatgctacgacgctggtg

SEQ ID NO: 140068 - DNA, 75 bp, Artificial Sequence
  Synthetic
ggtatgtatctgccggtgagagagcctcaggaatgttggactccgtggtgctctgtgaatgctacgacgctggtg

SEQ ID NO: 140069 - DNA, 75 bp, Artificial Sequence
  Synthetic
ggtatgtatctgccggtgagagagcgtcaggaatgttagactccgtggtgctctgtgaatgctacgacgctggtg

SEQ ID NO: 140070 - DNA, 75 bp, Artificial Sequence
  Synthetic
ggtatgtatctgccggtgagagagcgtcaggaatgtttgactccgtggtgctctgtgaatgctacgacgctggtg

SEQ ID NO: 140071 - DNA, 75 bp, Artificial Sequence
  Synthetic
ggtatgtatctgccggtgagagagcgtcaggaatgttcgactccgtggtgctctgtgaatgctacgacgctggtg

SEQ ID NO: 140072 - DNA, 75 bp, Artificial Sequence
  Synthetic
ggtatgtatctgccggtgagagagcgtcaggaatgttggactccgtggtgctctgtgaatgctacgacgctggtg

SEQ ID NO: 140073 - DNA, 75 bp, Artificial Sequence
  Synthetic
ggtatgtttctgccggtgagagagcatcaggaatgttagactccgtggtgctctgtgaatgctacgacgctggtg

SEQ ID NO: 140074 - DNA, 75 bp, Artificial Sequence
  Synthetic
ggtatgtttctgccggtgagagagcatcaggaatgtttgactccgtggtgctctgtgaatgctacgacgctggtg

SEQ ID NO: 140075 - DNA, 75 bp, Artificial Sequence
  Synthetic
ggtatgtttctgccggtgagagagcatcaggaatgttcgactccgtggtgctctgtgaatgctacgacgctggtg

SEQ ID NO: 140076 - DNA, 75 bp, Artificial Sequence
  Synthetic
ggtatgtttctgccggtgagagagcatcaggaatgttggactccgtggtgctctgtgaatgctacgacgctggtg

SEQ ID NO: 140077 - DNA, 75 bp, Artificial Sequence
  Synthetic
ggtatgtttctgccggtgagagagcttcaggaatgttagactccgtggtgctctgtgaatgctacgacgctggtg

SEQ ID NO: 140078 - DNA, 75 bp, Artificial Sequence
  Synthetic
ggtatgtttctgccggtgagagagcttcaggaatgtttgactccgtggtgctctgtgaatgctacgacgctggtg

SEQ ID NO: 140079 - DNA, 75 bp, Artificial Sequence
  Synthetic
ggtatgtttctgccggtgagagagcttcaggaatgttcgactccgtggtgctctgtgaatgctacgacgctggtg

SEQ ID NO: 140080 - DNA, 75 bp, Artificial Sequence
  Synthetic
ggtatgtttctgccggtgagagagcttcaggaatgttggactccgtggtgctctgtgaatgctacgacgctggtg

SEQ ID NO: 140081 - DNA, 75 bp, Artificial Sequence
  Synthetic
ggtatgtttctgccggtgagagagcctcaggaatgttagactccgtggtgctctgtgaatgctacgacgctggtg

SEQ ID NO: 140082 - DNA, 75 bp, Artificial Sequence
  Synthetic
ggtatgtttctgccggtgagagagcctcaggaatgtttgactccgtggtgctctgtgaatgctacgacgctggtg

SEQ ID NO: 140083 - DNA, 75 bp, Artificial Sequence
  Synthetic
ggtatgtttctgccggtgagagagcctcaggaatgttcgactccgtggtgctctgtgaatgctacgacgctggtg

SEQ ID NO: 140084 - DNA, 75 bp, Artificial Sequence
  Synthetic
ggtatgtttctgccggtgagagagcctcaggaatgttggactccgtggtgctctgtgaatgctacgacgctggtg

SEQ ID NO: 140085 - DNA, 75 bp, Artificial Sequence
  Synthetic
ggtatgtttctgccggtgagagagcgtcaggaatgttagactccgtggtgctctgtgaatgctacgacgctggtg

SEQ ID NO: 140086 - DNA, 75 bp, Artificial Sequence
  Synthetic
ggtatgtttctgccggtgagagagcgtcaggaatgtttgactccgtggtgctctgtgaatgctacgacgctggtg

SEQ ID NO: 140087 - DNA, 75 bp, Artificial Sequence
  Synthetic
ggtatgtttctgccggtgagagagcgtcaggaatgttcgactccgtggtgctctgtgaatgctacgacgctggtg

SEQ ID NO: 140088 - DNA, 75 bp, Artificial Sequence
  Synthetic
ggtatgtttctgccggtgagagagcgtcaggaatgttggactccgtggtgctctgtgaatgctacgacgctggtg

SEQ ID NO: 140089 - DNA, 75 bp, Artificial Sequence
  Synthetic
ggtatgtctctgccggtgagagagcatcaggaatgttagactccgtggtgctctgtgaatgctacgacgctggtg

SEQ ID NO: 140090 - DNA, 75 bp, Artificial Sequence
  Synthetic
ggtatgtctctgccggtgagagagcatcaggaatgtttgactccgtggtgctctgtgaatgctacgacgctggtg

SEQ ID NO: 140091 - DNA, 75 bp, Artificial Sequence
  Synthetic
ggtatgtctctgccggtgagagagcatcaggaatgttcgactccgtggtgctctgtgaatgctacgacgctggtg

SEQ ID NO: 140092 - DNA, 75 bp, Artificial Sequence
  Synthetic
ggtatgtctctgccggtgagagagcatcaggaatgttggactccgtggtgctctgtgaatgctacgacgctggtg

SEQ ID NO: 140093 - DNA, 75 bp, Artificial Sequence
  Synthetic
ggtatgtctctgccggtgagagagcttcaggaatgttagactccgtggtgctctgtgaatgctacgacgctggtg

SEQ ID NO: 140094 - DNA, 75 bp, Artificial Sequence
  Synthetic
ggtatgtctctgccggtgagagagcttcaggaatgtttgactccgtggtgctctgtgaatgctacgacgctggtg

SEQ ID NO: 140095 - DNA, 75 bp, Artificial Sequence
  Synthetic
ggtatgtctctgccggtgagagagcttcaggaatgttcgactccgtggtgctctgtgaatgctacgacgctggtg

SEQ ID NO: 140096 - DNA, 75 bp, Artificial Sequence
  Synthetic
ggtatgtctctgccggtgagagagcttcaggaatgttggactccgtggtgctctgtgaatgctacgacgctggtg

SEQ ID NO: 140097 - DNA, 75 bp, Artificial Sequence
  Synthetic
ggtatgtctctgccggtgagagagcctcaggaatgttagactccgtggtgctctgtgaatgctacgacgctggtg

SEQ ID NO: 140098 - DNA, 75 bp, Artificial Sequence
  Synthetic
ggtatgtctctgccggtgagagagcctcaggaatgtttgactccgtggtgctctgtgaatgctacgacgctggtg

SEQ ID NO: 140099 - DNA, 75 bp, Artificial Sequence
  Synthetic
ggtatgtctctgccggtgagagagcctcaggaatgttcgactccgtggtgctctgtgaatgctacgacgctggtg

SEQ ID NO: 140100 - DNA, 75 bp, Artificial Sequence
  Synthetic
ggtatgtctctgccggtgagagagcctcaggaatgttggactccgtggtgctctgtgaatgctacgacgctggtg

SEQ ID NO: 140101 - DNA, 75 bp, Artificial Sequence
  Synthetic
ggtatgtctctgccggtgagagagcgtcaggaatgttagactccgtggtgctctgtgaatgctacgacgctggtg

SEQ ID NO: 140102 - DNA, 75 bp, Artificial Sequence
  Synthetic
ggtatgtctctgccggtgagagagcgtcaggaatgtttgactccgtggtgctctgtgaatgctacgacgctggtg

SEQ ID NO: 140103 - DNA, 75 bp, Artificial Sequence
  Synthetic
ggtatgtctctgccggtgagagagcgtcaggaatgttcgactccgtggtgctctgtgaatgctacgacgctggtg

SEQ ID NO: 140104 - DNA, 75 bp, Artificial Sequence
  Synthetic
ggtatgtctctgccggtgagagagcgtcaggaatgttggactccgtggtgctctgtgaatgctacgacgctggtg

SEQ ID NO: 140105 - DNA, 75 bp, Artificial Sequence
  Synthetic
ggtatgtgtctgccggtgagagagcatcaggaatgttagactccgtggtgctctgtgaatgctacgacgctggtg

SEQ ID NO: 140106 - DNA, 75 bp, Artificial Sequence
  Synthetic
ggtatgtgtctgccggtgagagagcatcaggaatgtttgactccgtggtgctctgtgaatgctacgacgctggtg

SEQ ID NO: 140107 - DNA, 75 bp, Artificial Sequence
  Synthetic
ggtatgtgtctgccggtgagagagcatcaggaatgttcgactccgtggtgctctgtgaatgctacgacgctggtg

SEQ ID NO: 140108 - DNA, 75 bp, Artificial Sequence
  Synthetic
ggtatgtgtctgccggtgagagagcatcaggaatgttggactccgtggtgctctgtgaatgctacgacgctggtg

SEQ ID NO: 140109 - DNA, 75 bp, Artificial Sequence
  Synthetic
ggtatgtgtctgccggtgagagagcttcaggaatgttagactccgtggtgctctgtgaatgctacgacgctggtg

SEQ ID NO: 140110 - DNA, 75 bp, Artificial Sequence
  Synthetic
ggtatgtgtctgccggtgagagagcttcaggaatgtttgactccgtggtgctctgtgaatgctacgacgctggtg

SEQ ID NO: 140111 - DNA, 75 bp, Artificial Sequence
  Synthetic
ggtatgtgtctgccggtgagagagcttcaggaatgttcgactccgtggtgctctgtgaatgctacgacgctggtg

SEQ ID NO: 140112 - DNA, 75 bp, Artificial Sequence
  Synthetic
ggtatgtgtctgccggtgagagagcttcaggaatgttggactccgtggtgctctgtgaatgctacgacgctggtg

SEQ ID NO: 140113 - DNA, 75 bp, Artificial Sequence
  Synthetic
ggtatgtgtctgccggtgagagagcctcaggaatgttagactccgtggtgctctgtgaatgctacgacgctggtg

SEQ ID NO: 140114 - DNA, 75 bp, Artificial Sequence
  Synthetic
ggtatgtgtctgccggtgagagagcctcaggaatgtttgactccgtggtgctctgtgaatgctacgacgctggtg

SEQ ID NO: 140115 - DNA, 75 bp, Artificial Sequence
  Synthetic
ggtatgtgtctgccggtgagagagcctcaggaatgttcgactccgtggtgctctgtgaatgctacgacgctggtg

SEQ ID NO: 140116 - DNA, 75 bp, Artificial Sequence
  Synthetic
ggtatgtgtctgccggtgagagagcctcaggaatgttggactccgtggtgctctgtgaatgctacgacgctggtg

SEQ ID NO: 140117 - DNA, 75 bp, Artificial Sequence
  Synthetic
ggtatgtgtctgccggtgagagagcgtcaggaatgttagactccgtggtgctctgtgaatgctacgacgctggtg

SEQ ID NO: 140118 - DNA, 75 bp, Artificial Sequence
  Synthetic
ggtatgtgtctgccggtgagagagcgtcaggaatgtttgactccgtggtgctctgtgaatgctacgacgctggtg

SEQ ID NO: 140119 - DNA, 75 bp, Artificial Sequence
  Synthetic
ggtatgtgtctgccggtgagagagcgtcaggaatgttcgactccgtggtgctctgtgaatgctacgacgctggtg

SEQ ID NO: 140120 - DNA, 75 bp, Artificial Sequence
  Synthetic
ggtatgtgtctgccggtgagagagcgtcaggaatgttggactccgtggtgctctgtgaatgctacgacgctggtg

SEQ ID NO: 140121 - DNA, 75 bp, Artificial Sequence
  Synthetic
cgccgacggccttggcgatttagcggtggcgcttgagccagtcatattcacgccaatggaaaagcgggtgatagt

SEQ ID NO: 140122 - DNA, 75 bp, Artificial Sequence
  Synthetic
ctctgtgaatgctacgacgctggtgccgcgtggtatgagctcacaccagcggagacaacagttaggctccgagcg

SEQ ID NO: 140123 - DNA, 75 bp, Artificial Sequence
  Synthetic
cgggggcagcggcaataacaccttgcaatgccccacggattgtttccggaaacacccaggagctacctataccaa

SEQ ID NO: 140124 - DNA, 75 bp, Artificial Sequence
  Synthetic
gcttgcctatggatgatgtttatggtatctcaggtcgaggcggctctgtccaacctgattaacatcaatgctgct

SEQ ID NO: 140125 - DNA, 75 bp, Artificial Sequence
  Synthetic
gtggggtgccgacactgctgcgtgtggtgacatcatcaatggtctaccagtgtcggctaggctaggcagagagat

SEQ ID NO: 140126 - DNA, 75 bp, Artificial Sequence
  Synthetic
gtacaattggggggagaatgagacggacgtgctgcttctcaacaacacgcggccgccgcaaggcaactggttcgg

SEQ ID NO: 140127 - DNA, 75 bp, Artificial Sequence
  Synthetic
ccggctgccgctacctatgtggcctgcgggatgtggcccctgcttctcctacttctcatgctgcccgaaagggct

SEQ ID NO: 140128 - DNA, 75 bp, Artificial Sequence
  Synthetic
gtgacaagcctcaccggcagggataccaatgagaactgtggcgaggtccaagtgctgtctaccaccacgcaatcc

SEQ ID NO: 140129 - DNA, 75 bp, Artificial Sequence
  Synthetic
acgtgggtcctggtgggtggcatcctggcagccttggctgcgtattgcttgtcagtaggcagcgtggtaattgtc

SEQ ID NO: 140130 - DNA, 75 bp, Artificial Sequence
  Synthetic
cacgacagggacagggcagagttgagcccgctcctactaagcaccacacaatggcaggttctcccctgcagcttc

SEQ ID NO: 140131 - DNA, 75 bp, Artificial Sequence
  Synthetic
tgtatcgccttggagcagtcagcaatgaggtcaccctcacccaccccgtgacaaagtacatcgccacgtgcatgc

SEQ ID NO: 140132 - DNA, 75 bp, Artificial Sequence
  Synthetic
tgtatcgccttggtgcagtcagcaatgaggtcaccctcacccaccccgtgacaaagtacatcgccacgtgcatgc

SEQ ID NO: 140133 - DNA, 75 bp, Artificial Sequence
  Synthetic
tgtatcgccttggcgcagtcagcaatgaggtcaccctcacccaccccgtgacaaagtacatcgccacgtgcatgc

SEQ ID NO: 140134 - DNA, 75 bp, Artificial Sequence
  Synthetic
tgtatcgccttggggcagtcagcaatgaggtcaccctcacccaccccgtgacaaagtacatcgccacgtgcatgc

SEQ ID NO: 140135 - DNA, 75 bp, Artificial Sequence
  Synthetic
ggtctcttggcggcgtgatcattgtcgcgctgactattctgacattgtctccccattacaagtcatggctggcta

SEQ ID NO: 140136 - DNA, 75 bp, Artificial Sequence
  Synthetic
gaagagtgctcaaagcatctcccattgatcgatcatggcttgcaactggcagaccagttcaagcaaaaagctctt

SEQ ID NO: 140137 - DNA, 75 bp, Artificial Sequence
  Synthetic
gggtttactaagacatgcggagcaccaccgtgccgcattaggagggaccacaacagcactcttgatctactgtgc

SEQ ID NO: 140138 - DNA, 75 bp, Artificial Sequence
  Synthetic
tctgagtaattcgcttatgcggttccataacaaggtgtactccacaacctcgaggagtgcctctctgagggcaaa

SEQ ID NO: 140139 - DNA, 75 bp, Artificial Sequence
  Synthetic
ctggctgccgtagctgcctactgcctagcgaccggctgtgttgtcatcattggtcgcgtgtgtgtcaaccaaagg

SEQ ID NO: 140140 - DNA, 75 bp, Artificial Sequence
  Synthetic
ctggctgccgtagctgcctactgcctagcgaccggctgtgttgtcatcattggtcgcgtgtgtgtcaaccatagg

SEQ ID NO: 140141 - DNA, 75 bp, Artificial Sequence
  Synthetic
ctggctgccgtagctgcctactgcctagcgaccggctgtgttgtcatcattggtcgcgtgtgtgtcaaccacagg

SEQ ID NO: 140142 - DNA, 75 bp, Artificial Sequence
  Synthetic
ctggctgccgtagctgcctactgcctagcgaccggctgtgttgtcatcattggtcgcgtgtgtgtcaaccagagg

SEQ ID NO: 140143 - DNA, 75 bp, Artificial Sequence
  Synthetic
catccttgctgtcctggcatgcccacacctgatatttgacatcacaaagtatctcctagccatcttggggcccct

SEQ ID NO: 140144 - DNA, 75 bp, Artificial Sequence
  Synthetic
aatcctgctattgcttccctcatgtcattcaccgcagcggtcacaagtcctctgaccacccagcaaactctcctt

SEQ ID NO: 140145 - DNA, 75 bp, Artificial Sequence
  Synthetic
ccgaaatgctaaagtccaagatacaaggcctagtacaacaggcttcaaggcaggcccaagacatacaaccaaccg

SEQ ID NO: 140146 - DNA, 75 bp, Artificial Sequence
  Synthetic
gactttgtgcctgtcgagtccctagaaaccaccatgaggtctccagtctttactgacaactccactccgcccgca

SEQ ID NO: 140147 - DNA, 75 bp, Artificial Sequence
  Synthetic
caacgggcatacgctatggatcgggagatggcggcatcctgcgggggcctagtcctcatctgcctgatgctcctg

SEQ ID NO: 140148 - DNA, 75 bp, Artificial Sequence
  Synthetic
ttgcggggctctccacgttaccagggaaccctgccgtggcctcaatgatggcattcagcgcggcccttactagcc

SEQ ID NO: 140149 - DNA, 75 bp, Artificial Sequence
  Synthetic
cattctcgctgggtacggcgccggcgttgccggcgcagtagtcaccttcaagatcatgagcggcgagatgccgac

SEQ ID NO: 140150 - DNA, 75 bp, Artificial Sequence
  Synthetic
cttgttgctggcagacgccagggtctgtgcatgcctttggatgctcattatactgggccaagccgaggcggcgct

SEQ ID NO: 140151 - DNA, 75 bp, Artificial Sequence
  Synthetic
gctgcctgtctcggctaggttgggcaatgagatcttgctcgggccggccgactcagaaacatccaaggggtggag

SEQ ID NO: 140152 - DNA, 75 bp, Artificial Sequence
  Synthetic
cactttgggttttggggcatacatgtccaaggcatacggcatcgacccaaacatacggtcgggtgtcaggaccat

SEQ ID NO: 140153 - DNA, 75 bp, Artificial Sequence
  Synthetic
ctctaaacgtacggggggggcgggacgccatcatcttgctcacgtgcgcggtccatccctacctaatttttgaca

SEQ ID NO: 140154 - DNA, 75 bp, Artificial Sequence
  Synthetic
cttagtgggggctgccataggcagcataggtctgggcaagataatggtggacgtcttggccgggtacggtgccgg

SEQ ID NO: 140155 - DNA, 75 bp, Artificial Sequence
  Synthetic
cttagtgggggctgccataggcagcataggtctgggcaagatattggtggacgtcttggccgggtacggtgccgg

SEQ ID NO: 140156 - DNA, 75 bp, Artificial Sequence
  Synthetic
cttagtgggggctgccataggcagcataggtctgggcaagatactggtggacgtcttggccgggtacggtgccgg

SEQ ID NO: 140157 - DNA, 75 bp, Artificial Sequence
  Synthetic
cttagtgggggctgccataggcagcataggtctgggcaagatagtggtggacgtcttggccgggtacggtgccgg

SEQ ID NO: 140158 - DNA, 75 bp, Artificial Sequence
  Synthetic
gtccatccctacctaatttttgacatcaccaaattgttgctggccgtagtgggccctatgtggcttttgcagacc

SEQ ID NO: 140159 - DNA, 75 bp, Artificial Sequence
  Synthetic
tccaaggcatacggcatcgacccaaacatacggtcgggtgtcaggaccatcaatacgggtgcgtcaatcacgtac

SEQ ID NO: 140160 - DNA, 75 bp, Artificial Sequence
  Synthetic
ccgcatgcggcgacatcataggggggctgcctgtctcggctaggttgggcaatgagatcttgctcgggccggccg

SEQ ID NO: 140161 - DNA, 75 bp, Artificial Sequence
  Synthetic
tatgtccctgaatccgacgcagcagcccgcgtgacaaccatactatcatctctcactgtgacctccctgctcagg

SEQ ID NO: 140162 - DNA, 75 bp, Artificial Sequence
  Synthetic
ccgtggaggatgtcgtcaacttgctgcccggtatcctctctcctggcgccctggtggtgggagtcatctgcgcgg

SEQ ID NO: 140163 - DNA, 75 bp, Artificial Sequence
  Synthetic
tccttaagttgggggcggccaccggcacttacatatacaaccacctcactccactggcggactgggcccataaca

SEQ ID NO: 140164 - DNA, 75 bp, Artificial Sequence
  Synthetic
gatttgcaccatcttagttgacttcaagaaatggctgtcatccaaattattcccaaaaatgcctggcatcccctt

SEQ ID NO: 140165 - DNA, 75 bp, Artificial Sequence
  Synthetic
gatttgcaccatcttagttgacttcaagaaatggctgtcatccaaatttttcccaaaaatgcctggcatcccctt

SEQ ID NO: 140166 - DNA, 75 bp, Artificial Sequence
  Synthetic
gatttgcaccatcttagttgacttcaagaaatggctgtcatccaaattcttcccaaaaatgcctggcatcccctt

SEQ ID NO: 140167 - DNA, 75 bp, Artificial Sequence
  Synthetic
gatttgcaccatcttagttgacttcaagaaatggctgtcatccaaattgttcccaaaaatgcctggcatcccctt

SEQ ID NO: 140168 - DNA, 75 bp, Artificial Sequence
  Synthetic
gatttgcaccatcttagttgacttcaagaattggctgtcatccaaattattcccaaaaatgcctggcatcccctt

SEQ ID NO: 140169 - DNA, 75 bp, Artificial Sequence
  Synthetic
gatttgcaccatcttagttgacttcaagaattggctgtcatccaaatttttcccaaaaatgcctggcatcccctt

SEQ ID NO: 140170 - DNA, 75 bp, Artificial Sequence
  Synthetic
gatttgcaccatcttagttgacttcaagaattggctgtcatccaaattcttcccaaaaatgcctggcatcccctt

SEQ ID NO: 140171 - DNA, 75 bp, Artificial Sequence
  Synthetic
gatttgcaccatcttagttgacttcaagaattggctgtcatccaaattgttcccaaaaatgcctggcatcccctt

SEQ ID NO: 140172 - DNA, 75 bp, Artificial Sequence
  Synthetic
gatttgcaccatcttagttgacttcaagaactggctgtcatccaaattattcccaaaaatgcctggcatcccctt

SEQ ID NO: 140173 - DNA, 75 bp, Artificial Sequence
  Synthetic
gatttgcaccatcttagttgacttcaagaactggctgtcatccaaatttttcccaaaaatgcctggcatcccctt

SEQ ID NO: 140174 - DNA, 75 bp, Artificial Sequence
  Synthetic
gatttgcaccatcttagttgacttcaagaactggctgtcatccaaattcttcccaaaaatgcctggcatcccctt

SEQ ID NO: 140175 - DNA, 75 bp, Artificial Sequence
  Synthetic
gatttgcaccatcttagttgacttcaagaactggctgtcatccaaattgttcccaaaaatgcctggcatcccctt

SEQ ID NO: 140176 - DNA, 75 bp, Artificial Sequence
  Synthetic
gatttgcaccatcttagttgacttcaagaagtggctgtcatccaaattattcccaaaaatgcctggcatcccctt

SEQ ID NO: 140177 - DNA, 75 bp, Artificial Sequence
  Synthetic
gatttgcaccatcttagttgacttcaagaagtggctgtcatccaaatttttcccaaaaatgcctggcatcccctt

SEQ ID NO: 140178 - DNA, 75 bp, Artificial Sequence
  Synthetic
gatttgcaccatcttagttgacttcaagaagtggctgtcatccaaattcttcccaaaaatgcctggcatcccctt

SEQ ID NO: 140179 - DNA, 75 bp, Artificial Sequence
  Synthetic
gatttgcaccatcttagttgacttcaagaagtggctgtcatccaaattgttcccaaaaatgcctggcatcccctt

SEQ ID NO: 140180 - DNA, 75 bp, Artificial Sequence
  Synthetic
gatttgctccatcttagttgacttcaagaaatggctgtcatccaaattattcccaaaaatgcctggcatcccctt

SEQ ID NO: 140181 - DNA, 75 bp, Artificial Sequence
  Synthetic
gatttgctccatcttagttgacttcaagaaatggctgtcatccaaatttttcccaaaaatgcctggcatcccctt

SEQ ID NO: 140182 - DNA, 75 bp, Artificial Sequence
  Synthetic
gatttgctccatcttagttgacttcaagaaatggctgtcatccaaattcttcccaaaaatgcctggcatcccctt

SEQ ID NO: 140183 - DNA, 75 bp, Artificial Sequence
  Synthetic
gatttgctccatcttagttgacttcaagaaatggctgtcatccaaattgttcccaaaaatgcctggcatcccctt

SEQ ID NO: 140184 - DNA, 75 bp, Artificial Sequence
  Synthetic
gatttgctccatcttagttgacttcaagaattggctgtcatccaaattattcccaaaaatgcctggcatcccctt

SEQ ID NO: 140185 - DNA, 75 bp, Artificial Sequence
  Synthetic
gatttgctccatcttagttgacttcaagaattggctgtcatccaaatttttcccaaaaatgcctggcatcccctt

SEQ ID NO: 140186 - DNA, 75 bp, Artificial Sequence
  Synthetic
gatttgctccatcttagttgacttcaagaattggctgtcatccaaattcttcccaaaaatgcctggcatcccctt

SEQ ID NO: 140187 - DNA, 75 bp, Artificial Sequence
  Synthetic
gatttgctccatcttagttgacttcaagaattggctgtcatccaaattgttcccaaaaatgcctggcatcccctt

SEQ ID NO: 140188 - DNA, 75 bp, Artificial Sequence
  Synthetic
gatttgctccatcttagttgacttcaagaactggctgtcatccaaattattcccaaaaatgcctggcatcccctt

SEQ ID NO: 140189 - DNA, 75 bp, Artificial Sequence
  Synthetic
gatttgctccatcttagttgacttcaagaactggctgtcatccaaatttttcccaaaaatgcctggcatcccctt

SEQ ID NO: 140190 - DNA, 75 bp, Artificial Sequence
  Synthetic
gatttgctccatcttagttgacttcaagaactggctgtcatccaaattcttcccaaaaatgcctggcatcccctt

SEQ ID NO: 140191 - DNA, 75 bp, Artificial Sequence
  Synthetic
gatttgctccatcttagttgacttcaagaactggctgtcatccaaattgttcccaaaaatgcctggcatcccctt

SEQ ID NO: 140192 - DNA, 75 bp, Artificial Sequence
  Synthetic
gatttgctccatcttagttgacttcaagaagtggctgtcatccaaattattcccaaaaatgcctggcatcccctt

SEQ ID NO: 140193 - DNA, 75 bp, Artificial Sequence
  Synthetic
gatttgctccatcttagttgacttcaagaagtggctgtcatccaaatttttcccaaaaatgcctggcatcccctt

SEQ ID NO: 140194 - DNA, 75 bp, Artificial Sequence
  Synthetic
gatttgctccatcttagttgacttcaagaagtggctgtcatccaaattcttcccaaaaatgcctggcatcccctt

SEQ ID NO: 140195 - DNA, 75 bp, Artificial Sequence
  Synthetic
gatttgctccatcttagttgacttcaagaagtggctgtcatccaaattgttcccaaaaatgcctggcatcccctt

SEQ ID NO: 140196 - DNA, 75 bp, Artificial Sequence
  Synthetic
gatttgccccatcttagttgacttcaagaaatggctgtcatccaaattattcccaaaaatgcctggcatcccctt

SEQ ID NO: 140197 - DNA, 75 bp, Artificial Sequence
  Synthetic
gatttgccccatcttagttgacttcaagaaatggctgtcatccaaatttttcccaaaaatgcctggcatcccctt

SEQ ID NO: 140198 - DNA, 75 bp, Artificial Sequence
  Synthetic
gatttgccccatcttagttgacttcaagaaatggctgtcatccaaattcttcccaaaaatgcctggcatcccctt

SEQ ID NO: 140199 - DNA, 75 bp, Artificial Sequence
  Synthetic
gatttgccccatcttagttgacttcaagaaatggctgtcatccaaattgttcccaaaaatgcctggcatcccctt

SEQ ID NO: 140200 - DNA, 75 bp, Artificial Sequence
  Synthetic
gatttgccccatcttagttgacttcaagaattggctgtcatccaaattattcccaaaaatgcctggcatcccctt

SEQ ID NO: 140201 - DNA, 75 bp, Artificial Sequence
  Synthetic
gatttgccccatcttagttgacttcaagaattggctgtcatccaaatttttcccaaaaatgcctggcatcccctt

SEQ ID NO: 140202 - DNA, 75 bp, Artificial Sequence
  Synthetic
gatttgccccatcttagttgacttcaagaattggctgtcatccaaattcttcccaaaaatgcctggcatcccctt

SEQ ID NO: 140203 - DNA, 75 bp, Artificial Sequence
  Synthetic
gatttgccccatcttagttgacttcaagaattggctgtcatccaaattgttcccaaaaatgcctggcatcccctt

SEQ ID NO: 140204 - DNA, 75 bp, Artificial Sequence
  Synthetic
gatttgccccatcttagttgacttcaagaactggctgtcatccaaattattcccaaaaatgcctggcatcccctt

SEQ ID NO: 140205 - DNA, 75 bp, Artificial Sequence
  Synthetic
gatttgccccatcttagttgacttcaagaactggctgtcatccaaatttttcccaaaaatgcctggcatcccctt

SEQ ID NO: 140206 - DNA, 75 bp, Artificial Sequence
  Synthetic
gatttgccccatcttagttgacttcaagaactggctgtcatccaaattcttcccaaaaatgcctggcatcccctt

SEQ ID NO: 140207 - DNA, 75 bp, Artificial Sequence
  Synthetic
gatttgccccatcttagttgacttcaagaactggctgtcatccaaattgttcccaaaaatgcctggcatcccctt

SEQ ID NO: 140208 - DNA, 75 bp, Artificial Sequence
  Synthetic
gatttgccccatcttagttgacttcaagaagtggctgtcatccaaattattcccaaaaatgcctggcatcccctt

SEQ ID NO: 140209 - DNA, 75 bp, Artificial Sequence
  Synthetic
gatttgccccatcttagttgacttcaagaagtggctgtcatccaaatttttcccaaaaatgcctggcatcccctt

SEQ ID NO: 140210 - DNA, 75 bp, Artificial Sequence
  Synthetic
gatttgccccatcttagttgacttcaagaagtggctgtcatccaaattcttcccaaaaatgcctggcatcccctt

SEQ ID NO: 140211 - DNA, 75 bp, Artificial Sequence
  Synthetic
gatttgccccatcttagttgacttcaagaagtggctgtcatccaaattgttcccaaaaatgcctggcatcccctt

SEQ ID NO: 140212 - DNA, 75 bp, Artificial Sequence
  Synthetic
gatttgcgccatcttagttgacttcaagaaatggctgtcatccaaattattcccaaaaatgcctggcatcccctt

SEQ ID NO: 140213 - DNA, 75 bp, Artificial Sequence
  Synthetic
gatttgcgccatcttagttgacttcaagaaatggctgtcatccaaatttttcccaaaaatgcctggcatcccctt

SEQ ID NO: 140214 - DNA, 75 bp, Artificial Sequence
  Synthetic
gatttgcgccatcttagttgacttcaagaaatggctgtcatccaaattcttcccaaaaatgcctggcatcccctt

SEQ ID NO: 140215 - DNA, 75 bp, Artificial Sequence
  Synthetic
gatttgcgccatcttagttgacttcaagaaatggctgtcatccaaattgttcccaaaaatgcctggcatcccctt

SEQ ID NO: 140216 - DNA, 75 bp, Artificial Sequence
  Synthetic
gatttgcgccatcttagttgacttcaagaattggctgtcatccaaattattcccaaaaatgcctggcatcccctt

SEQ ID NO: 140217 - DNA, 75 bp, Artificial Sequence
  Synthetic
gatttgcgccatcttagttgacttcaagaattggctgtcatccaaatttttcccaaaaatgcctggcatcccctt

SEQ ID NO: 140218 - DNA, 75 bp, Artificial Sequence
  Synthetic
gatttgcgccatcttagttgacttcaagaattggctgtcatccaaattcttcccaaaaatgcctggcatcccctt

SEQ ID NO: 140219 - DNA, 75 bp, Artificial Sequence
  Synthetic
gatttgcgccatcttagttgacttcaagaattggctgtcatccaaattgttcccaaaaatgcctggcatcccctt

SEQ ID NO: 140220 - DNA, 75 bp, Artificial Sequence
  Synthetic
gatttgcgccatcttagttgacttcaagaactggctgtcatccaaattattcccaaaaatgcctggcatcccctt

SEQ ID NO: 140221 - DNA, 75 bp, Artificial Sequence
  Synthetic
gatttgcgccatcttagttgacttcaagaactggctgtcatccaaatttttcccaaaaatgcctggcatcccctt

SEQ ID NO: 140222 - DNA, 75 bp, Artificial Sequence
  Synthetic
gatttgcgccatcttagttgacttcaagaactggctgtcatccaaattcttcccaaaaatgcctggcatcccctt

SEQ ID NO: 140223 - DNA, 75 bp, Artificial Sequence
  Synthetic
gatttgcgccatcttagttgacttcaagaactggctgtcatccaaattgttcccaaaaatgcctggcatcccctt

SEQ ID NO: 140224 - DNA, 75 bp, Artificial Sequence
  Synthetic
gatttgcgccatcttagttgacttcaagaagtggctgtcatccaaattattcccaaaaatgcctggcatcccctt

SEQ ID NO: 140225 - DNA, 75 bp, Artificial Sequence
  Synthetic
gatttgcgccatcttagttgacttcaagaagtggctgtcatccaaatttttcccaaaaatgcctggcatcccctt

SEQ ID NO: 140226 - DNA, 75 bp, Artificial Sequence
  Synthetic
gatttgcgccatcttagttgacttcaagaagtggctgtcatccaaattcttcccaaaaatgcctggcatcccctt

SEQ ID NO: 140227 - DNA, 75 bp, Artificial Sequence
  Synthetic
gatttgcgccatcttagttgacttcaagaagtggctgtcatccaaattgttcccaaaaatgcctggcatcccctt

SEQ ID NO: 140228 - DNA, 75 bp, Artificial Sequence
  Synthetic
gctcgatgaggatcactgggccgaagacatgcagcaacacctggcatggaaccttccccatcaatgcttacacca

SEQ ID NO: 140229 - DNA, 75 bp, Artificial Sequence
  Synthetic
acggcctacgcacaacaaacgcgaggcctactgggatgcatcatcaccagcctcacgggccgggacaaaaaccag

SEQ ID NO: 140230 - DNA, 75 bp, Artificial Sequence
  Synthetic
aagcggtggacttcgtcccggtcgaatctcttgagactacaatgagatcaccagtgttcactgacaactcaacac

SEQ ID NO: 140231 - DNA, 75 bp, Artificial Sequence
  Synthetic
gcctactgggatgcatcatcaccagcctcacgggccgggacaaaaaccaggtggagggggaggttcagatcgtct

SEQ ID NO: 140232 - DNA, 75 bp, Artificial Sequence
  Synthetic
catcatccagatgtacaccaatgttgacttggacctcgtcggctggcaggccccgcaaggggcccgatccctggt

SEQ ID NO: 140233 - DNA, 75 bp, Artificial Sequence
  Synthetic
gagataacacagcatggtccctatgcatatgtgacaggattgacaacagacaaccttaagctcccttgccagata

SEQ ID NO: 140234 - DNA, 75 bp, Artificial Sequence
  Synthetic
gagataacacagcatggtccctatgcatatgtgacaggtttgacaacagacaaccttaagctcccttgccagata

SEQ ID NO: 140235 - DNA, 75 bp, Artificial Sequence
  Synthetic
gagataacacagcatggtccctatgcatatgtgacaggcttgacaacagacaaccttaagctcccttgccagata

SEQ ID NO: 140236 - DNA, 75 bp, Artificial Sequence
  Synthetic
gagataacacagcatggtccctatgcatatgtgacagggttgacaacagacaaccttaagctcccttgccagata

SEQ ID NO: 140237 - DNA, 75 bp, Artificial Sequence
  Synthetic
cagctcccctgtgaaccggagccagacgtagctgtattaacatccatgctgacagatccatctcacgtgacagcg

SEQ ID NO: 140238 - DNA, 75 bp, Artificial Sequence
  Synthetic
acgtagctgtattaacatccatgctgacagatccatctcacgtgacagcggaagcagcccgccgcaggctggcca

SEQ ID NO: 140239 - DNA, 75 bp, Artificial Sequence
  Synthetic
ggggcatacgacataatcatctgtgacgagtgccattccactgactccacgacgatccttggcataggcacggtc

SEQ ID NO: 140240 - DNA, 75 bp, Artificial Sequence
  Synthetic
acgagtgccattccactgactccacgacgatccttggcataggcacggtcttggaccaagcggagaccgctggag

SEQ ID NO: 140241 - DNA, 75 bp, Artificial Sequence
  Synthetic
gcctcaactccttcgtggtcggatctcagcttccttgtgaccctgagcccgacacggaggtgctggcgtccatgt

SEQ ID NO: 140242 - DNA, 75 bp, Artificial Sequence
  Synthetic
ggtacagctgctaccaggattgagactgagaacaaggtggtggtactggactctttcgagccagcggttgccgag

SEQ ID NO: 140243 - DNA, 75 bp, Artificial Sequence
  Synthetic
cccgtcactgcgggctacctgcaccgaacacggtgaaggccccgacgttgacatggtagatgtcaaccttttcat

SEQ ID NO: 140244 - DNA, 75 bp, Artificial Sequence
  Synthetic
cccgtcactgcgggctacctgcaccgaacacggtgaaggccccgacgttgacatggtagatgtcatccttttcat

SEQ ID NO: 140245 - DNA, 75 bp, Artificial Sequence
  Synthetic
cccgtcactgcgggctacctgcaccgaacacggtgaaggccccgacgttgacatggtagatgtcacccttttcat

SEQ ID NO: 140246 - DNA, 75 bp, Artificial Sequence
  Synthetic
cccgtcactgcgggctacctgcaccgaacacggtgaaggccccgacgttgacatggtagatgtcagccttttcat

SEQ ID NO: 140247 - DNA, 75 bp, Artificial Sequence
  Synthetic
cccgtcactgcgggctacctgcaccgtacacggtgaaggccccgacgttgacatggtagatgtcaaccttttcat

SEQ ID NO: 140248 - DNA, 75 bp, Artificial Sequence
  Synthetic
cccgtcactgcgggctacctgcaccgtacacggtgaaggccccgacgttgacatggtagatgtcatccttttcat

SEQ ID NO: 140249 - DNA, 75 bp, Artificial Sequence
  Synthetic
cccgtcactgcgggctacctgcaccgtacacggtgaaggccccgacgttgacatggtagatgtcacccttttcat

SEQ ID NO: 140250 - DNA, 75 bp, Artificial Sequence
  Synthetic
cccgtcactgcgggctacctgcaccgtacacggtgaaggccccgacgttgacatggtagatgtcagccttttcat

SEQ ID NO: 140251 - DNA, 75 bp, Artificial Sequence
  Synthetic
cccgtcactgcgggctacctgcaccgcacacggtgaaggccccgacgttgacatggtagatgtcaaccttttcat

SEQ ID NO: 140252 - DNA, 75 bp, Artificial Sequence
  Synthetic
cccgtcactgcgggctacctgcaccgcacacggtgaaggccccgacgttgacatggtagatgtcatccttttcat

SEQ ID NO: 140253 - DNA, 75 bp, Artificial Sequence
  Synthetic
cccgtcactgcgggctacctgcaccgcacacggtgaaggccccgacgttgacatggtagatgtcacccttttcat

SEQ ID NO: 140254 - DNA, 75 bp, Artificial Sequence
  Synthetic
cccgtcactgcgggctacctgcaccgcacacggtgaaggccccgacgttgacatggtagatgtcagccttttcat

SEQ ID NO: 140255 - DNA, 75 bp, Artificial Sequence
  Synthetic
cccgtcactgcgggctacctgcaccggacacggtgaaggccccgacgttgacatggtagatgtcaaccttttcat

SEQ ID NO: 140256 - DNA, 75 bp, Artificial Sequence
  Synthetic
cccgtcactgcgggctacctgcaccggacacggtgaaggccccgacgttgacatggtagatgtcatccttttcat

SEQ ID NO: 140257 - DNA, 75 bp, Artificial Sequence
  Synthetic
cccgtcactgcgggctacctgcaccggacacggtgaaggccccgacgttgacatggtagatgtcacccttttcat

SEQ ID NO: 140258 - DNA, 75 bp, Artificial Sequence
  Synthetic
cccgtcactgcgggctacctgcaccggacacggtgaaggccccgacgttgacatggtagatgtcagccttttcat

SEQ ID NO: 140259 - DNA, 75 bp, Artificial Sequence
  Synthetic
attgtgtacgaggcgggtgacgccatcctccacaccccggggtgcgttccttgcgttcgcgaggggaacgtgtcc

SEQ ID NO: 140260 - DNA, 75 bp, Artificial Sequence
  Synthetic
caccgctggttgagaagtggaagcagtcggactacgatccaccggtcgtgagcggctgcgccttacctcccaacg

SEQ ID NO: 140261 - DNA, 75 bp, Artificial Sequence
  Synthetic
ggtcgtcctatcgggccaacctgctgttatccccaaccgagaggcgctctatcaacagttcgacgagatggaaga

SEQ ID NO: 140262 - DNA, 75 bp, Artificial Sequence
  Synthetic
ccatccgagtatttgctccccaagaagaggtttccaccggcactaccgccctgggcgcggcctgattacaaccca

SEQ ID NO: 140263 - DNA, 75 bp, Artificial Sequence
  Synthetic
ccatccgagtatttgctccccaagaagaggtttccaccggcactaccgccctgggcgcggcctgattacaaccct

SEQ ID NO: 140264 - DNA, 75 bp, Artificial Sequence
  Synthetic
ccatccgagtatttgctccccaagaagaggtttccaccggcactaccgccctgggcgcggcctgattacaacccc

SEQ ID NO: 140265 - DNA, 75 bp, Artificial Sequence
  Synthetic
ccatccgagtatttgctccccaagaagaggtttccaccggcactaccgccctgggcgcggcctgattacaacccg

SEQ ID NO: 140266 - DNA, 75 bp, Artificial Sequence
  Synthetic
ccatccgagtatttgctccccaagatgaggtttccaccggcactaccgccctgggcgcggcctgattacaaccca

SEQ ID NO: 140267 - DNA, 75 bp, Artificial Sequence
  Synthetic
ccatccgagtatttgctccccaagatgaggtttccaccggcactaccgccctgggcgcggcctgattacaaccct

SEQ ID NO: 140268 - DNA, 75 bp, Artificial Sequence
  Synthetic
ccatccgagtatttgctccccaagatgaggtttccaccggcactaccgccctgggcgcggcctgattacaacccc

SEQ ID NO: 140269 - DNA, 75 bp, Artificial Sequence
  Synthetic
ccatccgagtatttgctccccaagatgaggtttccaccggcactaccgccctgggcgcggcctgattacaacccg

SEQ ID NO: 140270 - DNA, 75 bp, Artificial Sequence
  Synthetic
ccatccgagtatttgctccccaagacgaggtttccaccggcactaccgccctgggcgcggcctgattacaaccca

SEQ ID NO: 140271 - DNA, 75 bp, Artificial Sequence
  Synthetic
ccatccgagtatttgctccccaagacgaggtttccaccggcactaccgccctgggcgcggcctgattacaaccct

SEQ ID NO: 140272 - DNA, 75 bp, Artificial Sequence
  Synthetic
ccatccgagtatttgctccccaagacgaggtttccaccggcactaccgccctgggcgcggcctgattacaacccc

SEQ ID NO: 140273 - DNA, 75 bp, Artificial Sequence
  Synthetic
ccatccgagtatttgctccccaagacgaggtttccaccggcactaccgccctgggcgcggcctgattacaacccg

SEQ ID NO: 140274 - DNA, 75 bp, Artificial Sequence
  Synthetic
ccatccgagtatttgctccccaagaggaggtttccaccggcactaccgccctgggcgcggcctgattacaaccca

SEQ ID NO: 140275 - DNA, 75 bp, Artificial Sequence
  Synthetic
ccatccgagtatttgctccccaagaggaggtttccaccggcactaccgccctgggcgcggcctgattacaaccct

SEQ ID NO: 140276 - DNA, 75 bp, Artificial Sequence
  Synthetic
ccatccgagtatttgctccccaagaggaggtttccaccggcactaccgccctgggcgcggcctgattacaacccc

SEQ ID NO: 140277 - DNA, 75 bp, Artificial Sequence
  Synthetic
ccatccgagtatttgctccccaagaggaggtttccaccggcactaccgccctgggcgcggcctgattacaacccg

SEQ ID NO: 140278 - DNA, 75 bp, Artificial Sequence
  Synthetic
ccctttgttcggctctctacgtgggggacctctgtggcggcattttccttgtcggccagctgttcaccttctccc

SEQ ID NO: 140279 - DNA, 75 bp, Artificial Sequence
  Synthetic
gagtccaacgttctgtctgaactggccggagcgtcctttagccagggaccgccaacatctgactccggaacgggg

SEQ ID NO: 140280 - DNA, 75 bp, Artificial Sequence
  Synthetic
catgaggctacaccagtggtgaagtctagcctggagaagctagagcagttttgggcgaagcatatgtggaatttc

SEQ ID NO: 140281 - DNA, 75 bp, Artificial Sequence
  Synthetic
ctggtagggggaggttgggcatataccggtatgtcaccccaggggagagaccatcaggcatattcgacacttcag

SEQ ID NO: 140282 - DNA, 75 bp, Artificial Sequence
  Synthetic
gacggcggcctgtagtcctcgatcagagcactgtgggggaggctcttaaggaattggccataaaaagctttggcc

SEQ ID NO: 140283 - DNA, 75 bp, Artificial Sequence
  Synthetic
gacggcggcctgttgtcctcgatcagagcactgtgggggaggctcttaaggaattggccataaaaagctttggcc

SEQ ID NO: 140284 - DNA, 75 bp, Artificial Sequence
  Synthetic
gacggcggcctgtcgtcctcgatcagagcactgtgggggaggctcttaaggaattggccataaaaagctttggcc

SEQ ID NO: 140285 - DNA, 75 bp, Artificial Sequence
  Synthetic
gacggcggcctgtggtcctcgatcagagcactgtgggggaggctcttaaggaattggccataaaaagctttggcc

SEQ ID NO: 140286 - DNA, 75 bp, Artificial Sequence
  Synthetic
gacactggcgttggtgacgtcacagctgctccgtgtcccacaggccatcgtggacatgatatccggggctcactg

SEQ ID NO: 140287 - DNA, 75 bp, Artificial Sequence
  Synthetic
agccggaccccataatcgtggacgacagatctgatgacggatctttctcgtcgatgcctccacttgaaggggaac

SEQ ID NO: 140288 - DNA, 75 bp, Artificial Sequence
  Synthetic
catcttagggggttgggttgcctcgcagatcgcgacccccaccgcgtccacggcttttgtcgtgagcggccttgc

SEQ ID NO: 140289 - DNA, 75 bp, Artificial Sequence
  Synthetic
atccctatcctccatgccccccatagagggtgagcctggagatcctgacctagagcatgagacggtagagcgcca

SEQ ID NO: 140290 - DNA, 75 bp, Artificial Sequence
  Synthetic
atccctatcctccatgccccccatagagggtgagcctggagatcctgacctagagcatgagacggtagagcgcct

SEQ ID NO: 140291 - DNA, 75 bp, Artificial Sequence
  Synthetic
atccctatcctccatgccccccatagagggtgagcctggagatcctgacctagagcatgagacggtagagcgccc

SEQ ID NO: 140292 - DNA, 75 bp, Artificial Sequence
  Synthetic
atccctatcctccatgccccccatagagggtgagcctggagatcctgacctagagcatgagacggtagagcgccg

SEQ ID NO: 140293 - DNA, 75 bp, Artificial Sequence
  Synthetic
atccctatcctccatgccccccttagagggtgagcctggagatcctgacctagagcatgagacggtagagcgcca

SEQ ID NO: 140294 - DNA, 75 bp, Artificial Sequence
  Synthetic
atccctatcctccatgccccccttagagggtgagcctggagatcctgacctagagcatgagacggtagagcgcct

SEQ ID NO: 140295 - DNA, 75 bp, Artificial Sequence
  Synthetic
atccctatcctccatgccccccttagagggtgagcctggagatcctgacctagagcatgagacggtagagcgccc

SEQ ID NO: 140296 - DNA, 75 bp, Artificial Sequence
  Synthetic
atccctatcctccatgccccccttagagggtgagcctggagatcctgacctagagcatgagacggtagagcgccg

SEQ ID NO: 140297 - DNA, 75 bp, Artificial Sequence
  Synthetic
atccctatcctccatgccccccctagagggtgagcctggagatcctgacctagagcatgagacggtagagcgcca

SEQ ID NO: 140298 - DNA, 75 bp, Artificial Sequence
  Synthetic
atccctatcctccatgccccccctagagggtgagcctggagatcctgacctagagcatgagacggtagagcgcct

SEQ ID NO: 140299 - DNA, 75 bp, Artificial Sequence
  Synthetic
atccctatcctccatgccccccctagagggtgagcctggagatcctgacctagagcatgagacggtagagcgccc

SEQ ID NO: 140300 - DNA, 75 bp, Artificial Sequence
  Synthetic
atccctatcctccatgccccccctagagggtgagcctggagatcctgacctagagcatgagacggtagagcgccg

SEQ ID NO: 140301 - DNA, 75 bp, Artificial Sequence
  Synthetic
atccctatcctccatgccccccgtagagggtgagcctggagatcctgacctagagcatgagacggtagagcgcca

SEQ ID NO: 140302 - DNA, 75 bp, Artificial Sequence
  Synthetic
atccctatcctccatgccccccgtagagggtgagcctggagatcctgacctagagcatgagacggtagagcgcct

SEQ ID NO: 140303 - DNA, 75 bp, Artificial Sequence
  Synthetic
atccctatcctccatgccccccgtagagggtgagcctggagatcctgacctagagcatgagacggtagagcgccc

SEQ ID NO: 140304 - DNA, 75 bp, Artificial Sequence
  Synthetic
atccctatcctccatgccccccgtagagggtgagcctggagatcctgacctagagcatgagacggtagagcgccg

SEQ ID NO: 140305 - DNA, 75 bp, Artificial Sequence
  Synthetic
gtgacgggaggggcggtcgcccactcgacccggagcctcactggtctcttctcccctggggcaaaacagaacatc

SEQ ID NO: 140306 - DNA, 75 bp, Artificial Sequence
  Synthetic
atctatgatttgctgttctatgtcatactcctggacaggagcactaataacacctagtgctccagaggaggagaa

SEQ ID NO: 140307 - DNA, 75 bp, Artificial Sequence
  Synthetic
atctatgatttgctgttctatgtcatactcctggactggagcactaataacacctagtgctccagaggaggagaa

SEQ ID NO: 140308 - DNA, 75 bp, Artificial Sequence
  Synthetic
atctatgatttgctgttctatgtcatactcctggaccggagcactaataacacctagtgctccagaggaggagaa

SEQ ID NO: 140309 - DNA, 75 bp, Artificial Sequence
  Synthetic
atctatgatttgctgttctatgtcatactcctggacgggagcactaataacacctagtgctccagaggaggagaa

SEQ ID NO: 140310 - DNA, 75 bp, Artificial Sequence
  Synthetic
atctttgatttgctgttctatgtcatactcctggacaggagcactaataacacctagtgctccagaggaggagaa

SEQ ID NO: 140311 - DNA, 75 bp, Artificial Sequence
  Synthetic
atctttgatttgctgttctatgtcatactcctggactggagcactaataacacctagtgctccagaggaggagaa

SEQ ID NO: 140312 - DNA, 75 bp, Artificial Sequence
  Synthetic
atctttgatttgctgttctatgtcatactcctggaccggagcactaataacacctagtgctccagaggaggagaa

SEQ ID NO: 140313 - DNA, 75 bp, Artificial Sequence
  Synthetic
atctttgatttgctgttctatgtcatactcctggacgggagcactaataacacctagtgctccagaggaggagaa

SEQ ID NO: 140314 - DNA, 75 bp, Artificial Sequence
  Synthetic
atctctgatttgctgttctatgtcatactcctggacaggagcactaataacacctagtgctccagaggaggagaa

SEQ ID NO: 140315 - DNA, 75 bp, Artificial Sequence
  Synthetic
atctctgatttgctgttctatgtcatactcctggactggagcactaataacacctagtgctccagaggaggagaa

SEQ ID NO: 140316 - DNA, 75 bp, Artificial Sequence
  Synthetic
atctctgatttgctgttctatgtcatactcctggaccggagcactaataacacctagtgctccagaggaggagaa

SEQ ID NO: 140317 - DNA, 75 bp, Artificial Sequence
  Synthetic
atctctgatttgctgttctatgtcatactcctggacgggagcactaataacacctagtgctccagaggaggagaa

SEQ ID NO: 140318 - DNA, 75 bp, Artificial Sequence
  Synthetic
atctgtgatttgctgttctatgtcatactcctggacaggagcactaataacacctagtgctccagaggaggagaa

SEQ ID NO: 140319 - DNA, 75 bp, Artificial Sequence
  Synthetic
atctgtgatttgctgttctatgtcatactcctggactggagcactaataacacctagtgctccagaggaggagaa

SEQ ID NO: 140320 - DNA, 75 bp, Artificial Sequence
  Synthetic
atctgtgatttgctgttctatgtcatactcctggaccggagcactaataacacctagtgctccagaggaggagaa

SEQ ID NO: 140321 - DNA, 75 bp, Artificial Sequence
  Synthetic
atctgtgatttgctgttctatgtcatactcctggacgggagcactaataacacctagtgctccagaggaggagaa

SEQ ID NO: 140322 - DNA, 75 bp, Artificial Sequence
  Synthetic
ttctatgatttgctgttctatgtcatactcctggacaggagcactaataacacctagtgctccagaggaggagaa

SEQ ID NO: 140323 - DNA, 75 bp, Artificial Sequence
  Synthetic
ttctatgatttgctgttctatgtcatactcctggactggagcactaataacacctagtgctccagaggaggagaa

SEQ ID NO: 140324 - DNA, 75 bp, Artificial Sequence
  Synthetic
ttctatgatttgctgttctatgtcatactcctggaccggagcactaataacacctagtgctccagaggaggagaa

SEQ ID NO: 140325 - DNA, 75 bp, Artificial Sequence
  Synthetic
ttctatgatttgctgttctatgtcatactcctggacgggagcactaataacacctagtgctccagaggaggagaa

SEQ ID NO: 140326 - DNA, 75 bp, Artificial Sequence
  Synthetic
ttctttgatttgctgttctatgtcatactcctggacaggagcactaataacacctagtgctccagaggaggagaa

SEQ ID NO: 140327 - DNA, 75 bp, Artificial Sequence
  Synthetic
ttctttgatttgctgttctatgtcatactcctggactggagcactaataacacctagtgctccagaggaggagaa

SEQ ID NO: 140328 - DNA, 75 bp, Artificial Sequence
  Synthetic
ttctttgatttgctgttctatgtcatactcctggaccggagcactaataacacctagtgctccagaggaggagaa

SEQ ID NO: 140329 - DNA, 75 bp, Artificial Sequence
  Synthetic
ttctttgatttgctgttctatgtcatactcctggacgggagcactaataacacctagtgctccagaggaggagaa

SEQ ID NO: 140330 - DNA, 75 bp, Artificial Sequence
  Synthetic
ttctctgatttgctgttctatgtcatactcctggacaggagcactaataacacctagtgctccagaggaggagaa

SEQ ID NO: 140331 - DNA, 75 bp, Artificial Sequence
  Synthetic
ttctctgatttgctgttctatgtcatactcctggactggagcactaataacacctagtgctccagaggaggagaa

SEQ ID NO: 140332 - DNA, 75 bp, Artificial Sequence
  Synthetic
ttctctgatttgctgttctatgtcatactcctggaccggagcactaataacacctagtgctccagaggaggagaa

SEQ ID NO: 140333 - DNA, 75 bp, Artificial Sequence
  Synthetic
ttctctgatttgctgttctatgtcatactcctggacgggagcactaataacacctagtgctccagaggaggagaa

SEQ ID NO: 140334 - DNA, 75 bp, Artificial Sequence
  Synthetic
ttctgtgatttgctgttctatgtcatactcctggacaggagcactaataacacctagtgctccagaggaggagaa

SEQ ID NO: 140335 - DNA, 75 bp, Artificial Sequence
  Synthetic
ttctgtgatttgctgttctatgtcatactcctggactggagcactaataacacctagtgctccagaggaggagaa

SEQ ID NO: 140336 - DNA, 75 bp, Artificial Sequence
  Synthetic
ttctgtgatttgctgttctatgtcatactcctggaccggagcactaataacacctagtgctccagaggaggagaa

SEQ ID NO: 140337 - DNA, 75 bp, Artificial Sequence
  Synthetic
ttctgtgatttgctgttctatgtcatactcctggacgggagcactaataacacctagtgctccagaggaggagaa

SEQ ID NO: 140338 - DNA, 75 bp, Artificial Sequence
  Synthetic
ctctatgatttgctgttctatgtcatactcctggacaggagcactaataacacctagtgctccagaggaggagaa

SEQ ID NO: 140339 - DNA, 75 bp, Artificial Sequence
  Synthetic
ctctatgatttgctgttctatgtcatactcctggactggagcactaataacacctagtgctccagaggaggagaa

SEQ ID NO: 140340 - DNA, 75 bp, Artificial Sequence
  Synthetic
ctctatgatttgctgttctatgtcatactcctggaccggagcactaataacacctagtgctccagaggaggagaa

SEQ ID NO: 140341 - DNA, 75 bp, Artificial Sequence
  Synthetic
ctctatgatttgctgttctatgtcatactcctggacgggagcactaataacacctagtgctccagaggaggagaa

SEQ ID NO: 140342 - DNA, 75 bp, Artificial Sequence
  Synthetic
ctctttgatttgctgttctatgtcatactcctggacaggagcactaataacacctagtgctccagaggaggagaa

SEQ ID NO: 140343 - DNA, 75 bp, Artificial Sequence
  Synthetic
ctctttgatttgctgttctatgtcatactcctggactggagcactaataacacctagtgctccagaggaggagaa

SEQ ID NO: 140344 - DNA, 75 bp, Artificial Sequence
  Synthetic
ctctttgatttgctgttctatgtcatactcctggaccggagcactaataacacctagtgctccagaggaggagaa

SEQ ID NO: 140345 - DNA, 75 bp, Artificial Sequence
  Synthetic
ctctttgatttgctgttctatgtcatactcctggacgggagcactaataacacctagtgctccagaggaggagaa

SEQ ID NO: 140346 - DNA, 75 bp, Artificial Sequence
  Synthetic
ctctctgatttgctgttctatgtcatactcctggacaggagcactaataacacctagtgctccagaggaggagaa

SEQ ID NO: 140347 - DNA, 75 bp, Artificial Sequence
  Synthetic
ctctctgatttgctgttctatgtcatactcctggactggagcactaataacacctagtgctccagaggaggagaa

SEQ ID NO: 140348 - DNA, 75 bp, Artificial Sequence
  Synthetic
ctctctgatttgctgttctatgtcatactcctggaccggagcactaataacacctagtgctccagaggaggagaa

SEQ ID NO: 140349 - DNA, 75 bp, Artificial Sequence
  Synthetic
ctctctgatttgctgttctatgtcatactcctggacgggagcactaataacacctagtgctccagaggaggagaa

SEQ ID NO: 140350 - DNA, 75 bp, Artificial Sequence
  Synthetic
ctctgtgatttgctgttctatgtcatactcctggacaggagcactaataacacctagtgctccagaggaggagaa

SEQ ID NO: 140351 - DNA, 75 bp, Artificial Sequence
  Synthetic
ctctgtgatttgctgttctatgtcatactcctggactggagcactaataacacctagtgctccagaggaggagaa

SEQ ID NO: 140352 - DNA, 75 bp, Artificial Sequence
  Synthetic
ctctgtgatttgctgttctatgtcatactcctggaccggagcactaataacacctagtgctccagaggaggagaa

SEQ ID NO: 140353 - DNA, 75 bp, Artificial Sequence
  Synthetic
ctctgtgatttgctgttctatgtcatactcctggacgggagcactaataacacctagtgctccagaggaggagaa

SEQ ID NO: 140354 - DNA, 75 bp, Artificial Sequence
  Synthetic
gtctatgatttgctgttctatgtcatactcctggacaggagcactaataacacctagtgctccagaggaggagaa

SEQ ID NO: 140355 - DNA, 75 bp, Artificial Sequence
  Synthetic
gtctatgatttgctgttctatgtcatactcctggactggagcactaataacacctagtgctccagaggaggagaa

SEQ ID NO: 140356 - DNA, 75 bp, Artificial Sequence
  Synthetic
gtctatgatttgctgttctatgtcatactcctggaccggagcactaataacacctagtgctccagaggaggagaa

SEQ ID NO: 140357 - DNA, 75 bp, Artificial Sequence
  Synthetic
gtctatgatttgctgttctatgtcatactcctggacgggagcactaataacacctagtgctccagaggaggagaa

SEQ ID NO: 140358 - DNA, 75 bp, Artificial Sequence
  Synthetic
gtctttgatttgctgttctatgtcatactcctggacaggagcactaataacacctagtgctccagaggaggagaa

SEQ ID NO: 140359 - DNA, 75 bp, Artificial Sequence
  Synthetic
gtctttgatttgctgttctatgtcatactcctggactggagcactaataacacctagtgctccagaggaggagaa

SEQ ID NO: 140360 - DNA, 75 bp, Artificial Sequence
  Synthetic
gtctttgatttgctgttctatgtcatactcctggaccggagcactaataacacctagtgctccagaggaggagaa

SEQ ID NO: 140361 - DNA, 75 bp, Artificial Sequence
  Synthetic
gtctttgatttgctgttctatgtcatactcctggacgggagcactaataacacctagtgctccagaggaggagaa

SEQ ID NO: 140362 - DNA, 75 bp, Artificial Sequence
  Synthetic
gtctctgatttgctgttctatgtcatactcctggacaggagcactaataacacctagtgctccagaggaggagaa

SEQ ID NO: 140363 - DNA, 75 bp, Artificial Sequence
  Synthetic
gtctctgatttgctgttctatgtcatactcctggactggagcactaataacacctagtgctccagaggaggagaa

SEQ ID NO: 140364 - DNA, 75 bp, Artificial Sequence
  Synthetic
gtctctgatttgctgttctatgtcatactcctggaccggagcactaataacacctagtgctccagaggaggagaa

SEQ ID NO: 140365 - DNA, 75 bp, Artificial Sequence
  Synthetic
gtctctgatttgctgttctatgtcatactcctggacgggagcactaataacacctagtgctccagaggaggagaa

SEQ ID NO: 140366 - DNA, 75 bp, Artificial Sequence
  Synthetic
gtctgtgatttgctgttctatgtcatactcctggacaggagcactaataacacctagtgctccagaggaggagaa

SEQ ID NO: 140367 - DNA, 75 bp, Artificial Sequence
  Synthetic
gtctgtgatttgctgttctatgtcatactcctggactggagcactaataacacctagtgctccagaggaggagaa

SEQ ID NO: 140368 - DNA, 75 bp, Artificial Sequence
  Synthetic
gtctgtgatttgctgttctatgtcatactcctggaccggagcactaataacacctagtgctccagaggaggagaa

SEQ ID NO: 140369 - DNA, 75 bp, Artificial Sequence
  Synthetic
gtctgtgatttgctgttctatgtcatactcctggacgggagcactaataacacctagtgctccagaggaggagaa

SEQ ID NO: 140370 - DNA, 75 bp, Artificial Sequence
  Synthetic
ggggacgttgtcgtcgtggcgacggacgctctgatgaccgggtacaccggcgattttgactcggtgatagactgc

SEQ ID NO: 140371 - DNA, 75 bp, Artificial Sequence
  Synthetic
acaagttcaactccacgggctgccccgagaggttagccagctgtcgttccctatccgactttgctcagggttggg

SEQ ID NO: 140372 - DNA, 75 bp, Artificial Sequence
  Synthetic
ctcattgagggcaaagaaggtgacttttgacagagtgcagctacttgactcataatatgactcaaccctgaagga

SEQ ID NO: 140373 - DNA, 75 bp, Artificial Sequence
  Synthetic
ctcattgagggcaaagaaggtgacttttgacagagtgcagctacttgactcatattatgactcaaccctgaagga

SEQ ID NO: 140374 - DNA, 75 bp, Artificial Sequence
  Synthetic
ctcattgagggcaaagaaggtgacttttgacagagtgcagctacttgactcatactatgactcaaccctgaagga

SEQ ID NO: 140375 - DNA, 75 bp, Artificial Sequence
  Synthetic
ctcattgagggcaaagaaggtgacttttgacagagtgcagctacttgactcatagtatgactcaaccctgaagga

SEQ ID NO: 140376 - DNA, 75 bp, Artificial Sequence
  Synthetic
gacgccgtgtcacgtacgcagcgtaggggcagaactggcaggggcaggcagggcatttacagatttgtggcaccg

SEQ ID NO: 140377 - DNA, 75 bp, Artificial Sequence
  Synthetic
tgcggcgccacgtggggcccggtgagggggctgtgcagtggatgaaccgcctcattgccttcgcatcgcgaggca

SEQ ID NO: 140378 - DNA, 75 bp, Artificial Sequence
  Synthetic
gggggctgtgcagtggatgaaccgcctcattgccttcgcatcgcgaggcaatcacgtgtctcctacgcactacgt

SEQ ID NO: 140379 - DNA, 75 bp, Artificial Sequence
  Synthetic
cggtcctgtgtattgtttcactcccagccccgtcgtggtgggtacgaccgactacaagggcaatcccacgtacag

SEQ ID NO: 140380 - DNA, 75 bp, Artificial Sequence
  Synthetic
tcctggcagccctagctgcttactgtctttcagtgggcagcgtggtgattgtcgggagagttgtcctgtcgggcc

SEQ ID NO: 140381 - DNA, 75 bp, Artificial Sequence
  Synthetic
ctcactcccgccgagaccaccgtgaggctgcgggcatacctaaacactccggggttgcccgtatgccaggatcat

SEQ ID NO: 140382 - DNA, 75 bp, Artificial Sequence
  Synthetic
ctgtgacatccctgctcagacgcctccacaagtggatcaacgaggattgttccactccatgtgacaccagctggc

SEQ ID NO: 140383 - DNA, 75 bp, Artificial Sequence
  Synthetic
cactagtcgagaaacgggtacacctggcagagcaattcaagcagaaggccctaggtcttctaagttccgctggca

SEQ ID NO: 140384 - DNA, 75 bp, Artificial Sequence
  Synthetic
aagacgtgtggagctcctccctgcaacattggcgggtcgggcaataacaccctgctctgccccaccgattgcttc

SEQ ID NO: 140385 - DNA, 75 bp, Artificial Sequence
  Synthetic
gatgggagcctcttacggcttccagtactcaccagcacagcgggttgaatatcttctggccgcatggcggtcgaa

SEQ ID NO: 140386 - DNA, 75 bp, Artificial Sequence
  Synthetic
cgtaccaggcgactgtgtgcgctagggctcaggctccacctccatcatgggaccaacagtggaaatgcctcataa

SEQ ID NO: 140387 - DNA, 75 bp, Artificial Sequence
  Synthetic
acacaaaaactccctcaggcagtgatgggggaatcctacgggttccagtactctcctgcacagcgggtggattta

SEQ ID NO: 140388 - DNA, 75 bp, Artificial Sequence
  Synthetic
acacaaaaactccctcaggcagtgatgggggaatcctacgggttccagtactctcctgcacagcgggtggatttt

SEQ ID NO: 140389 - DNA, 75 bp, Artificial Sequence
  Synthetic
acacaaaaactccctcaggcagtgatgggggaatcctacgggttccagtactctcctgcacagcgggtggatttc

SEQ ID NO: 140390 - DNA, 75 bp, Artificial Sequence
  Synthetic
acacaaaaactccctcaggcagtgatgggggaatcctacgggttccagtactctcctgcacagcgggtggatttg

SEQ ID NO: 140391 - DNA, 75 bp, Artificial Sequence
  Synthetic
gggagaggtctaccagtgttgtgacctggaaccggaggcccgcaaggtgatagacgcgctcacggagagactcta

SEQ ID NO: 140392 - DNA, 75 bp, Artificial Sequence
  Synthetic
gcactatcaactacaccctgttccaagtcaggatgtacgtggggggagttgagcacaggttgacggctgcatgca

SEQ ID NO: 140393 - DNA, 75 bp, Artificial Sequence
  Synthetic
aaagccctatgggtttttcatatgacacccgctgcttcgattcaacagtgacggagagtgacatcagaaccgagg

SEQ ID NO: 140394 - DNA, 75 bp, Artificial Sequence
  Synthetic
gagcacaggttgacggctgcatgcaactggacgcggggagagcgttgtgagttggaggatagggacaggtccgaa

SEQ ID NO: 140395 - DNA, 75 bp, Artificial Sequence
  Synthetic
taggaggggtcgtggctgcgctggccgcgtattgcctatccacgggctgcgtggtcatagtgggccgactcgtcc

SEQ ID NO: 140396 - DNA, 75 bp, Artificial Sequence
  Synthetic
cctgagttcttcactgaggtggacggcgttaggctccaccgcttcgcacctccatgcaaacccttgctgagggac

SEQ ID NO: 140397 - DNA, 75 bp, Artificial Sequence
  Synthetic
acattgtggacgtgcaatatttgtacggagtggggtctagcatcgtgtcctgggccattaagtgggagtatgtca

SEQ ID NO: 140398 - DNA, 75 bp, Artificial Sequence
  Synthetic
cagctctggccgcgtactgcctgacaacaggcagcgtggtcattgtgggcaggatcatcttgtccgggaagccgg

SEQ ID NO: 140399 - DNA, 75 bp, Artificial Sequence
  Synthetic
cagaagctcgaagccttctgggccaagcacatgtggaacttcattagcgggatacagtacttggccgggttgtcc

SEQ ID NO: 140400 - DNA, 75 bp, Artificial Sequence
  Synthetic
gctcaacgctgcctcactggccgggacgcatggtatcttgcccttccttgtgttcttctgcttcgcgtggtacct

SEQ ID NO: 140401 - DNA, 75 bp, Artificial Sequence
  Synthetic
gctgaggaggacgagcggaacctgagagtcttcacggaggctatgaccaggtactccgccccccccggcgatccc

SEQ ID NO: 140402 - DNA, 75 bp, Artificial Sequence
  Synthetic
tgaaccgtcttattgcgttcgcatcgcgaggcaatcacgtgtctcccacgcactacgtccctgagtccgacgcgg

SEQ ID NO: 140403 - DNA, 75 bp, Artificial Sequence
  Synthetic
cgccgcagatactatctgactagagaccctaccactccacttgccagagcagcctgggaaactgcaaaacactcc

SEQ ID NO: 140404 - DNA, 75 bp, Artificial Sequence
  Synthetic
actgaggtggccgcgacgtgtggcggagccgtcctcatctgcttgacggtggtgactctatcgccgtattacaag

SEQ ID NO: 140405 - DNA, 75 bp, Artificial Sequence
  Synthetic
acatcctggaccaaaatcttaattttgaaatgtatggggccgtatactcagtcactccactggatcttcctgcca

SEQ ID NO: 140406 - DNA, 75 bp, Artificial Sequence
  Synthetic
tcccgccagccttaccaatttgggctcggcctgagtacaacccacctttggtggagacatggaaacagcaagatt

SEQ ID NO: 140407 - DNA, 75 bp, Artificial Sequence
  Synthetic
gcagagctggcaggccacatcaagaacggctcgatgagaatcactgggccgaaaacttgcagcaacacatggcat

SEQ ID NO: 140408 - DNA, 75 bp, Artificial Sequence
  Synthetic
gtgatgccattatcttgctcatgtgcgctatccatccaaatatgctctttgacatcaccaaactgctactggcca

SEQ ID NO: 140409 - DNA, 75 bp, Artificial Sequence
  Synthetic
cccccgttgagagcgtggagacatcgggcccgagcagtccgcgctaagctcatcgctcagggagggaaagccaga

SEQ ID NO: 140410 - DNA, 75 bp, Artificial Sequence
  Synthetic
ttattgaaaggctgcatggccttgaggccttttcactgcatacgtactctccccatgaactcacaagggtggcag

SEQ ID NO: 140411 - DNA, 75 bp, Artificial Sequence
  Synthetic
acgacccaccggccgttcatggctgtgccctgcctcccagcaagccgacccccgttcccccccccaggaggaagc

SEQ ID NO: 140412 - DNA, 75 bp, Artificial Sequence
  Synthetic
ggtcggtggccactacgtccagatggctatcattaagctgggggcccttactggcacctacatctacaaccacct

SEQ ID NO: 140413 - DNA, 75 bp, Artificial Sequence
  Synthetic
atttgggactgggtctgcgaagtgctgggcgactttaaaaggtggctcagtgccaagcttatgccccagatgcca

SEQ ID NO: 140414 - DNA, 75 bp, Artificial Sequence
  Synthetic
ggagcggacaccgccgcgtgcggcgatatcatcaacggcctgccggtttccgcgcggagggggaaggagatactg

SEQ ID NO: 140415 - DNA, 75 bp, Artificial Sequence
  Synthetic
caagctgccgatcagtcccctgagcaactcactgctgcgtcaccataacatggtgtacgccacaacctctcgctc

SEQ ID NO: 140416 - DNA, 75 bp, Artificial Sequence
  Synthetic
atgtcaaaaacgggactatgaggatttccggtcctagaacatgcagtaacacctggcatgggacgttccccatca

SEQ ID NO: 140417 - DNA, 75 bp, Artificial Sequence
  Synthetic
ccagcctcacaggccgggacaagaaccaagtggagggtgagatccagattgtgtcaaccgccacccagaccttcc

SEQ ID NO: 140418 - DNA, 75 bp, Artificial Sequence
  Synthetic
tatgtacgtgggggatctctgcggatctgttttcctcgtctcccagctgttcaccttctcgcctcgccggcatga

SEQ ID NO: 140419 - DNA, 75 bp, Artificial Sequence
  Synthetic
cgatctcctcgaggctaacctcttgtgggggtctaccgctaccagggttgagacagacgagaaggtgataatact

SEQ ID NO: 140420 - DNA, 75 bp, Artificial Sequence
  Synthetic
acccgtccctacgcccgactatagtcgcgcgttgtggcgggtgtcagctgaggagtacgtcgagattaggcgggt

SEQ ID NO: 140421 - DNA, 75 bp, Artificial Sequence
  Synthetic
tgggggtctaccgctaccagggttgagacagacgagaaggtgataatactggactcttttgagccacgtgtggct

SEQ ID NO: 140422 - DNA, 75 bp, Artificial Sequence
  Synthetic
cagcccactaaccactagccaaaccctcctcttcaacatcttgggggggtgggtggctgcccagctcgcagcccc

SEQ ID NO: 140423 - DNA, 75 bp, Artificial Sequence
  Synthetic
cgcgcgttgtggcgggtgtcagctgaggagtacgtcgagattaggcgggtgggggatttccattatgtgaccggc

SEQ ID NO: 140424 - DNA, 75 bp, Artificial Sequence
  Synthetic
tgtggaccaggacctcgtgggctggccagcgcctgccggctcacgctctctacagccctgcacctgtggctcctc

SEQ ID NO: 140425 - DNA, 75 bp, Artificial Sequence
  Synthetic
gggggatttccattatgtgaccggcatgacgaccgacaacatcaagtgtccatgtcaagtcccatccccagaatt

SEQ ID NO: 140426 - DNA, 75 bp, Artificial Sequence
  Synthetic
ctacacaggtacgccccgtcgtgtaaacctcttctacgggacgaggtcagtttccaggtcgggctccactcctac

SEQ ID NO: 140427 - DNA, 75 bp, Artificial Sequence
  Synthetic
aagggctcttcgggcggtccattgctgtgtccgttaggccatgccgtaggcttatttagagccgcggtatgtacc

SEQ ID NO: 140428 - DNA, 75 bp, Artificial Sequence
  Synthetic
acagagtccgttgtttccactgctttggcagagctggccgcaaagaccttcggccaatctgagctgggttcagac

SEQ ID NO: 140429 - DNA, 75 bp, Artificial Sequence
  Synthetic
cccagaccttccaggtggcccatctacacgctcccactggcagtggtaagagtaccaaggtgccggctgcttatg

SEQ ID NO: 140430 - DNA, 75 bp, Artificial Sequence
  Synthetic
cctggagcctgaggcccgcaaggtaataaccgccctcacggagagactctatgtgggcggccccatgtataacag

SEQ ID NO: 140431 - DNA, 75 bp, Artificial Sequence
  Synthetic
cttgacatcagattcttggtccactgttagcggatcggaggacgtcgtgtgttgctcaatgtcatattcatggac

SEQ ID NO: 140432 - DNA, 75 bp, Artificial Sequence
  Synthetic
caccaatgattgccccaactcgagtattgtgtacgagacggccgataccattctacactctccggggtgtgtccc

SEQ ID NO: 140433 - DNA, 75 bp, Artificial Sequence
  Synthetic
caggactggggtgaggaccatcactactggcagcccggtcacgtactccacttacggcaagttccttgctgacgg

SEQ ID NO: 140434 - DNA, 75 bp, Artificial Sequence
  Synthetic
cggcagctggcacataaaccggaccgccctcaattgcaatgacagcttacaaacgggtttcatcgcttccctgtt

SEQ ID NO: 140435 - DNA, 75 bp, Artificial Sequence
  Synthetic
gactacgaaccacctgtagtacatggctgtgcactccctcccccaagccagcctccggtaccaccacctcggagg

SEQ ID NO: 140436 - DNA, 75 bp, Artificial Sequence
  Synthetic
gagacagctggagcacggcttgttgtgctcgctaccgccacccctccaggctctatcacagtgccacatgctaat

SEQ ID NO: 140437 - DNA, 75 bp, Artificial Sequence
  Synthetic
gagacagctggagcacggcttgttgtgctcgctaccgccacccctccaggctctatcactgtgccacatgctaat

SEQ ID NO: 140438 - DNA, 75 bp, Artificial Sequence
  Synthetic
gagacagctggagcacggcttgttgtgctcgctaccgccacccctccaggctctatcaccgtgccacatgctaat

SEQ ID NO: 140439 - DNA, 75 bp, Artificial Sequence
  Synthetic
gagacagctggagcacggcttgttgtgctcgctaccgccacccctccaggctctatcacggtgccacatgctaat

SEQ ID NO: 140440 - DNA, 75 bp, Artificial Sequence
  Synthetic
gagactgctggagcacggcttgttgtgctcgctaccgccacccctccaggctctatcacagtgccacatgctaat

SEQ ID NO: 140441 - DNA, 75 bp, Artificial Sequence
  Synthetic
gagactgctggagcacggcttgttgtgctcgctaccgccacccctccaggctctatcactgtgccacatgctaat

SEQ ID NO: 140442 - DNA, 75 bp, Artificial Sequence
  Synthetic
gagactgctggagcacggcttgttgtgctcgctaccgccacccctccaggctctatcaccgtgccacatgctaat

SEQ ID NO: 140443 - DNA, 75 bp, Artificial Sequence
  Synthetic
gagactgctggagcacggcttgttgtgctcgctaccgccacccctccaggctctatcacggtgccacatgctaat

SEQ ID NO: 140444 - DNA, 75 bp, Artificial Sequence
  Synthetic
gagaccgctggagcacggcttgttgtgctcgctaccgccacccctccaggctctatcacagtgccacatgctaat

SEQ ID NO: 140445 - DNA, 75 bp, Artificial Sequence
  Synthetic
gagaccgctggagcacggcttgttgtgctcgctaccgccacccctccaggctctatcactgtgccacatgctaat

SEQ ID NO: 140446 - DNA, 75 bp, Artificial Sequence
  Synthetic
gagaccgctggagcacggcttgttgtgctcgctaccgccacccctccaggctctatcaccgtgccacatgctaat

SEQ ID NO: 140447 - DNA, 75 bp, Artificial Sequence
  Synthetic
gagaccgctggagcacggcttgttgtgctcgctaccgccacccctccaggctctatcacggtgccacatgctaat

SEQ ID NO: 140448 - DNA, 75 bp, Artificial Sequence
  Synthetic
gagacggctggagcacggcttgttgtgctcgctaccgccacccctccaggctctatcacagtgccacatgctaat

SEQ ID NO: 140449 - DNA, 75 bp, Artificial Sequence
  Synthetic
gagacggctggagcacggcttgttgtgctcgctaccgccacccctccaggctctatcactgtgccacatgctaat

SEQ ID NO: 140450 - DNA, 75 bp, Artificial Sequence
  Synthetic
gagacggctggagcacggcttgttgtgctcgctaccgccacccctccaggctctatcaccgtgccacatgctaat

SEQ ID NO: 140451 - DNA, 75 bp, Artificial Sequence
  Synthetic
gagacggctggagcacggcttgttgtgctcgctaccgccacccctccaggctctatcacggtgccacatgctaat

SEQ ID NO: 140452 - DNA, 75 bp, Artificial Sequence
  Synthetic
gaaggacccggactacgtccctccggtggtacacgggtgcccattgccacctaccaaggcccctccaataccacc

SEQ ID NO: 140453 - DNA, 75 bp, Artificial Sequence
  Synthetic
ggcactacccctgcactgtcaactttaccatcttcaaggttaggatgtatgtggggggcgtggagcacaggctca

SEQ ID NO: 140454 - DNA, 75 bp, Artificial Sequence
  Synthetic
attcaaaaaagaaatgtgatgagctcgctgcgaaactagtcggcatgggcgtcaacgccgtggcttactaccgcg

SEQ ID NO: 140455 - DNA, 75 bp, Artificial Sequence
  Synthetic
attcaaaaaagaaatgtgatgagctcgctgcgaaactagtcggcttgggcgtcaacgccgtggcttactaccgcg

SEQ ID NO: 140456 - DNA, 75 bp, Artificial Sequence
  Synthetic
attcaaaaaagaaatgtgatgagctcgctgcgaaactagtcggcctgggcgtcaacgccgtggcttactaccgcg

SEQ ID NO: 140457 - DNA, 75 bp, Artificial Sequence
  Synthetic
attcaaaaaagaaatgtgatgagctcgctgcgaaactagtcggcgtgggcgtcaacgccgtggcttactaccgcg

SEQ ID NO: 140458 - DNA, 75 bp, Artificial Sequence
  Synthetic
ggatcctgaccttagcgaaggatcttggtcgactgtgagcagtgagggtgctggagaggacgtcgtgtgttgctc

SEQ ID NO: 140459 - DNA, 75 bp, Artificial Sequence
  Synthetic
ccaggctggcataactagagtgccgtactttgtgcgcgctcaagggctcattcgtgcatgcatgttggtgcggaa

SEQ ID NO: 140460 - DNA, 75 bp, Artificial Sequence
  Synthetic
gggaacacgctgacgtgctatctcaaagccacagccgctatcaaagccggcagggctgaagactgcaccatgctg

SEQ ID NO: 140461 - DNA, 75 bp, Artificial Sequence
  Synthetic
cctgctggcgttaccaccacgagcatacgccatggaccgggagatggctgcatcgtgcggaggcgcggttttcgt

SEQ ID NO: 140462 - DNA, 75 bp, Artificial Sequence
  Synthetic
gtagcgtaccaagccaccgtatgcgctagggcccaggctccacctccatcatgggatcaaatgtggaagtgtctg

SEQ ID NO: 140463 - DNA, 75 bp, Artificial Sequence
  Synthetic
gcaaagaagacccctatggggttttcgtatgacacccgctgctttgactcaacagtcactgaggctgacatccgt

SEQ ID NO: 140464 - DNA, 75 bp, Artificial Sequence
  Synthetic
tcatgacatgcatgtcggctgacctggaagtcgtcacaagctcttgggtgttggtggggggcgtcctggctgctc

SEQ ID NO: 140465 - DNA, 75 bp, Artificial Sequence
  Synthetic
ttcagtgtcctcatagccagggatcacgcttgtaacaggccgctatgtattagcgaaatttatcggggcattgct

SEQ ID NO: 140466 - DNA, 75 bp, Artificial Sequence
  Synthetic
agtcaggatgtacgtgggaggagtcgagcacaggctggaagctgcttgcaactggacgcggggcgagcgttgcaa

SEQ ID NO: 140467 - DNA, 75 bp, Artificial Sequence
  Synthetic
ggagttcgatgagagggaagagtgctccgcgcacctcccgtacatcgagcatgggatggcccttgccgaacagtt

SEQ ID NO: 140468 - DNA, 75 bp, Artificial Sequence
  Synthetic
tctggaagacagggacaggtccgagctcagcccgctgctgctgtccaccacacagtggcaggtccttccgtgttc

SEQ ID NO: 140469 - DNA, 75 bp, Artificial Sequence
  Synthetic
gcgaaacacatgtggaatttcatcagcgggatacagtatctggcggggctgtcaacactaccaggcaaccccgcg

SEQ ID NO: 140470 - DNA, 75 bp, Artificial Sequence
  Synthetic
gcgaaacacatgtggaatttcatcagcgggatacagtatctggcggggctgtcaacactacctggcaaccccgcg

SEQ ID NO: 140471 - DNA, 75 bp, Artificial Sequence
  Synthetic
gcgaaacacatgtggaatttcatcagcgggatacagtatctggcggggctgtcaacactacccggcaaccccgcg

SEQ ID NO: 140472 - DNA, 75 bp, Artificial Sequence
  Synthetic
gcgaaacacatgtggaatttcatcagcgggatacagtatctggcggggctgtcaacactaccgggcaaccccgcg

SEQ ID NO: 140473 - DNA, 75 bp, Artificial Sequence
  Synthetic
ggaggtagagccaaaatctgtggcatatacctctttaactgggcggtaaaaaccaagctcaaactcactccattg

SEQ ID NO: 140474 - DNA, 75 bp, Artificial Sequence
  Synthetic
cgcggcgcactcactcacaacctgcgaacacatgtcgacatgatcgtaatggcagctacggtctgctcggccttg

SEQ ID NO: 140475 - DNA, 75 bp, Artificial Sequence
  Synthetic
ttgcctcccctggcgcctctacatcctttgtaggtgccggtatagccggcgctgttgttggcagtgtggggctgg

SEQ ID NO: 140476 - DNA, 75 bp, Artificial Sequence
  Synthetic
ggggtacggcgcaggcgtggcgggagccctcgtggcctttaagatcatgagcggagaggtccctaccaccgaaga

SEQ ID NO: 140477 - DNA, 75 bp, Artificial Sequence
  Synthetic
ggggtacggcgcaggcgtggcgggagccctcgtggcctttaagatcatgagcggtgaggtccctaccaccgaaga

SEQ ID NO: 140478 - DNA, 75 bp, Artificial Sequence
  Synthetic
ggggtacggcgcaggcgtggcgggagccctcgtggcctttaagatcatgagcggcgaggtccctaccaccgaaga

SEQ ID NO: 140479 - DNA, 75 bp, Artificial Sequence
  Synthetic
ggggtacggcgcaggcgtggcgggagccctcgtggcctttaagatcatgagcggggaggtccctaccaccgaaga

SEQ ID NO: 140480 - DNA, 75 bp, Artificial Sequence
  Synthetic
gcggtgcagtggatgaaccggctgatagcctttgcctcccgagggaaccacgtctcccccacgcactatgtgcct

SEQ ID NO: 140481 - DNA, 75 bp, Artificial Sequence
  Synthetic
ctccatgttccggttcctggttgagagacatttgggactggatatgcgaggtgctcagtgactttaaaacctggt

SEQ ID NO: 140482 - DNA, 75 bp, Artificial Sequence
  Synthetic
ctgtccgtgtggagccgatataactggacatgtcaagaacgggacgatgaggatcgttggccccaaaacttgcag

SEQ ID NO: 140483 - DNA, 75 bp, Artificial Sequence
  Synthetic
gcagaggagtacgtggaggtgacgagagtgggagacttccactacgtgacgggcatgacaactgacaaccttaag

SEQ ID NO: 140484 - DNA, 75 bp, Artificial Sequence
  Synthetic
taagcttcagagtgggactccacgaatatccagtggggtcgcaattgccttgcgagccggaaccggacgtagcgg

SEQ ID NO: 140485 - DNA, 75 bp, Artificial Sequence
  Synthetic
ttccgcaaacatccggaagccacatactctcggtgcggctccggtccctggattacacccaggtgcctggtcgac

SEQ ID NO: 140486 - DNA, 75 bp, Artificial Sequence
  Synthetic
tagccagttgtccgccccatccttgaaggcaacttgcactacccaccatgactcccctgatgttgacctcatcga

SEQ ID NO: 140487 - DNA, 75 bp, Artificial Sequence
  Synthetic
cagtacaggactgcaattgctcaatctatcccggccacgtgtcaggccatcgcatggcttgggatatgatgatga

SEQ ID NO: 140488 - DNA, 75 bp, Artificial Sequence
  Synthetic
ccgacctaccggcactatctactggcctattgcacctccaccaaaacatcgtggacgtgcagtacctctatggac

SEQ ID NO: 140489 - DNA, 75 bp, Artificial Sequence
  Synthetic
ggtcatcgacaccctgacttgcggcctagccgacctcatggggtacatccccgtcctaggcgggccactcggtgg

SEQ ID NO: 140490 - DNA, 75 bp, Artificial Sequence
  Synthetic
tgtgccccgcgggacacgccgtaggcatattcagggccgcggtgtgcacccgtggagtggctaaggcggtggact

SEQ ID NO: 140491 - DNA, 75 bp, Artificial Sequence
  Synthetic
ccgagttggggcccaaatgacccccggcgaaggtcccgcaatctgggtaaggtcatcgacaccctgacttgcggc

SEQ ID NO: 140492 - DNA, 75 bp, Artificial Sequence
  Synthetic
gaggaggatgaacgcgaggtgtccgtcccagcggagatcctgcggaaggggcggaagttccccgcggccatgccc

SEQ ID NO: 140493 - DNA, 75 bp, Artificial Sequence
  Synthetic
gcactgctctcgtgcctcaccacccctgcatctgcaatccacgtcaggaatgcatcaggaatctaccatctcacc

SEQ ID NO: 140494 - DNA, 75 bp, Artificial Sequence
  Synthetic
aacctgctcctgtaccaccgcctcggaaaaagcggacggtggttctgacagaatcgactgtgtcttctgccttag

SEQ ID NO: 140495 - DNA, 75 bp, Artificial Sequence
  Synthetic
gctggcttcctgtttcaccaaccttggcagtcccgaacggttcagtgccgattcatgggtttcgtagacatgtgg

SEQ ID NO: 140496 - DNA, 75 bp, Artificial Sequence
  Synthetic
tgaacaaggggaactagggctggtcatactagtagtcatatccatctttactcttaccccagcatacaagattct

SEQ ID NO: 140497 - DNA, 75 bp, Artificial Sequence
  Synthetic
agagtccgacgctgagtcctactcttccatgcctcccctagagggggagcctggggatccggaccttagtgatgg

SEQ ID NO: 140498 - DNA, 75 bp, Artificial Sequence
  Synthetic
agtgcatatgactgtccaggaatgcaattgctccatctacaccggccacgtcaccggccacaggatggcatggga

SEQ ID NO: 140499 - DNA, 75 bp, Artificial Sequence
  Synthetic
cttgccgcgctgttctatacgcgcagattcaacgcgtctggatgcccagagcgtatggccagctgtcgctccatc

SEQ ID NO: 140500 - DNA, 75 bp, Artificial Sequence
  Synthetic
gaggagaccaaattgccagtcaacgctctcagcaactcgctgctgcgccatcacaatatggtctattccaccagt

SEQ ID NO: 140501 - DNA, 75 bp, Artificial Sequence
  Synthetic
gttctcggagccgtagtatattactgcatggtggcgaactgggcgaaggtgatcgctgttctcctcctgttcgca

SEQ ID NO: 140502 - DNA, 75 bp, Artificial Sequence
  Synthetic
gttctcggagccgtagtttattactgcatggtggcgaactgggcgaaggtgatcgctgttctcctcctgttcgca

SEQ ID NO: 140503 - DNA, 75 bp, Artificial Sequence
  Synthetic
gttctcggagccgtagtctattactgcatggtggcgaactgggcgaaggtgatcgctgttctcctcctgttcgca

SEQ ID NO: 140504 - DNA, 75 bp, Artificial Sequence
  Synthetic
gttctcggagccgtagtgtattactgcatggtggcgaactgggcgaaggtgatcgctgttctcctcctgttcgca

SEQ ID NO: 140505 - DNA, 75 bp, Artificial Sequence
  Synthetic
cgtctaaagtgaaggccagattgctctccgtcgaggaagcttgtgacctcacgcccccgcactcggccaaatcaa

SEQ ID NO: 140506 - DNA, 75 bp, Artificial Sequence
  Synthetic
tcatcaacaccaacggcagctggcatatcaaccgcaccgcactgaattgcaatgattccctgcagacagggttca

SEQ ID NO: 140507 - DNA, 75 bp, Artificial Sequence
  Synthetic
gttcaactccacggggtgccctgctcgcatgagcagctgtaggcccttagattcattcgaccagggttggggccc

SEQ ID NO: 140508 - DNA, 75 bp, Artificial Sequence
  Synthetic
aatagacaccaccatcatggcaaagaacgaggtattctgcgtccagcccgaaaaagggggccgcaagccagctcg

SEQ ID NO: 140509 - DNA, 75 bp, Artificial Sequence
  Synthetic
ggcactacgcacctaggccttgcgccgtcgttcctgcgggatcggtgtgcgggcccgtctactgctttacaccca

SEQ ID NO: 140510 - DNA, 75 bp, Artificial Sequence
  Synthetic
tggggggagaacgagaccgatgtgtttttgctctccagcgcacgccctcctggcgggccgtggttcgggtgcacg

SEQ ID NO: 140511 - DNA, 75 bp, Artificial Sequence
  Synthetic
gggtttcagtactcacctgcacagcgggtcgaattcctcgtgaatacgtggaagtccaagaaaaccccgatgggg

SEQ ID NO: 140512 - DNA, 75 bp, Artificial Sequence
  Synthetic
tcctggcggacgcgcgcgtctgtgcctgcttgtggatgatgctgctggtagctcaggccgaggctgccttagaga

SEQ ID NO: 140513 - DNA, 75 bp, Artificial Sequence
  Synthetic
gaagtccaagaaaaccccgatggggttctcatatgacacccgctgttttgactcaacggtcactgaggctgatat

SEQ ID NO: 140514 - DNA, 75 bp, Artificial Sequence
  Synthetic
aggactgctccacgccatgctccggctcgtggctaagggatgtctgggactggatatgcacggtgttgactgact

SEQ ID NO: 140515 - DNA, 75 bp, Artificial Sequence
  Synthetic
tccgcaaacacccggaagcgacctttgagagatgcggctctgggccctggctcaccccacgatgcttggtggact

SEQ ID NO: 140516 - DNA, 75 bp, Artificial Sequence
  Synthetic
tctacctggtcacccgaaacgctgacgtcatcccggtccggaggaaagacgaacggcggggtgctctactctcgc

SEQ ID NO: 140517 - DNA, 75 bp, Artificial Sequence
  Synthetic
gtagcgtaccaagccaccgtgtgcgctagggctcaagcccctcccccgtcgtgggaccagatgtggaagtgcttg

SEQ ID NO: 140518 - DNA, 75 bp, Artificial Sequence
  Synthetic
gctatcgcaggtgccgcgcaagcggcgtcctgacgactagatgcggcaaaactctcacttgctacctcaaagcca

SEQ ID NO: 140519 - DNA, 75 bp, Artificial Sequence
  Synthetic
gctatcgcaggtgccgcgcaagcggcgtcctgacgactagatgcggcaatactctcacttgctacctcaaagcca

SEQ ID NO: 140520 - DNA, 75 bp, Artificial Sequence
  Synthetic
gctatcgcaggtgccgcgcaagcggcgtcctgacgactagatgcggcaacactctcacttgctacctcaaagcca

SEQ ID NO: 140521 - DNA, 75 bp, Artificial Sequence
  Synthetic
gctatcgcaggtgccgcgcaagcggcgtcctgacgactagatgcggcaagactctcacttgctacctcaaagcca

SEQ ID NO: 140522 - DNA, 75 bp, Artificial Sequence
  Synthetic
gctatcgcaggtgccgcgcaagcggcgtcctgacgactagttgcggcaaaactctcacttgctacctcaaagcca

SEQ ID NO: 140523 - DNA, 75 bp, Artificial Sequence
  Synthetic
gctatcgcaggtgccgcgcaagcggcgtcctgacgactagttgcggcaatactctcacttgctacctcaaagcca

SEQ ID NO: 140524 - DNA, 75 bp, Artificial Sequence
  Synthetic
gctatcgcaggtgccgcgcaagcggcgtcctgacgactagttgcggcaacactctcacttgctacctcaaagcca

SEQ ID NO: 140525 - DNA, 75 bp, Artificial Sequence
  Synthetic
gctatcgcaggtgccgcgcaagcggcgtcctgacgactagttgcggcaagactctcacttgctacctcaaagcca

SEQ ID NO: 140526 - DNA, 75 bp, Artificial Sequence
  Synthetic
gctatcgcaggtgccgcgcaagcggcgtcctgacgactagctgcggcaaaactctcacttgctacctcaaagcca

SEQ ID NO: 140527 - DNA, 75 bp, Artificial Sequence
  Synthetic
gctatcgcaggtgccgcgcaagcggcgtcctgacgactagctgcggcaatactctcacttgctacctcaaagcca

SEQ ID NO: 140528 - DNA, 75 bp, Artificial Sequence
  Synthetic
gctatcgcaggtgccgcgcaagcggcgtcctgacgactagctgcggcaacactctcacttgctacctcaaagcca

SEQ ID NO: 140529 - DNA, 75 bp, Artificial Sequence
  Synthetic
gctatcgcaggtgccgcgcaagcggcgtcctgacgactagctgcggcaagactctcacttgctacctcaaagcca

SEQ ID NO: 140530 - DNA, 75 bp, Artificial Sequence
  Synthetic
gctatcgcaggtgccgcgcaagcggcgtcctgacgactaggtgcggcaaaactctcacttgctacctcaaagcca

SEQ ID NO: 140531 - DNA, 75 bp, Artificial Sequence
  Synthetic
gctatcgcaggtgccgcgcaagcggcgtcctgacgactaggtgcggcaatactctcacttgctacctcaaagcca

SEQ ID NO: 140532 - DNA, 75 bp, Artificial Sequence
  Synthetic
gctatcgcaggtgccgcgcaagcggcgtcctgacgactaggtgcggcaacactctcacttgctacctcaaagcca

SEQ ID NO: 140533 - DNA, 75 bp, Artificial Sequence
  Synthetic
gctatcgcaggtgccgcgcaagcggcgtcctgacgactaggtgcggcaagactctcacttgctacctcaaagcca

SEQ ID NO: 140534 - DNA, 75 bp, Artificial Sequence
  Synthetic
caactggactcgcggggaccggtgtgagttggaggacagggacagggtcgacatgagccccctcctgttctccac

SEQ ID NO: 140535 - DNA, 75 bp, Artificial Sequence
  Synthetic
tatggggtctccacggctatcgtgtcgtgggcactcaaatgggagtacgtagtcctcgctttcctggttctggcg

SEQ ID NO: 140536 - DNA, 75 bp, Artificial Sequence
  Synthetic
cctgacccgtgaccccacaactcccctcgcgcgcgccgcgtgggaaacagcaagacacactccagtcaactcctg

SEQ ID NO: 140537 - DNA, 75 bp, Artificial Sequence
  Synthetic
gggctcattcgtgcatgcatgctggtgcggaaagtcgctgggggccattatgtccaaatggctctcatgaagctg

SEQ ID NO: 140538 - DNA, 75 bp, Artificial Sequence
  Synthetic
gctgccagggcatactttgggggttggctttcatctgctgcgcatggcacatacgcgggcgggttgtccccctcg

SEQ ID NO: 140539 - DNA, 75 bp, Artificial Sequence
  Synthetic
tttcttagctctgggtctcatcaccatcttcaccctcaccccggcctacaagaatcttcttgtaaacgcgctttg

SEQ ID NO: 140540 - DNA, 75 bp, Artificial Sequence
  Synthetic
tttcttagctctgggtctcatcaccatcttcaccctcaccccggcctacaagtatcttcttgtaaacgcgctttg

SEQ ID NO: 140541 - DNA, 75 bp, Artificial Sequence
  Synthetic
tttcttagctctgggtctcatcaccatcttcaccctcaccccggcctacaagcatcttcttgtaaacgcgctttg

SEQ ID NO: 140542 - DNA, 75 bp, Artificial Sequence
  Synthetic
tttcttagctctgggtctcatcaccatcttcaccctcaccccggcctacaaggatcttcttgtaaacgcgctttg

SEQ ID NO: 140543 - DNA, 75 bp, Artificial Sequence
  Synthetic
acggaggaagaggacggttgtcctgacagaatccactgtgtcttctgccttggcggagcttgctacaaagacctt

SEQ ID NO: 140544 - DNA, 75 bp, Artificial Sequence
  Synthetic
aaagctgccacttgcggcaagtacctcttcaattgggcagtaaaaactaagcttaaactcactccaatcccgggc

SEQ ID NO: 140545 - DNA, 75 bp, Artificial Sequence
  Synthetic
tgcttgttacatcctcaacttgggttcgaggtgacaaagatactgcttgccatgcttggttccatgtatctactt

SEQ ID NO: 140546 - DNA, 75 bp, Artificial Sequence
  Synthetic
tgcttgttacatcctcaacttgggttcgaggtgacaaagattctgcttgccatgcttggttccatgtatctactt

SEQ ID NO: 140547 - DNA, 75 bp, Artificial Sequence
  Synthetic
tgcttgttacatcctcaacttgggttcgaggtgacaaagatcctgcttgccatgcttggttccatgtatctactt

SEQ ID NO: 140548 - DNA, 75 bp, Artificial Sequence
  Synthetic
tgcttgttacatcctcaacttgggttcgaggtgacaaagatgctgcttgccatgcttggttccatgtatctactt

SEQ ID NO: 140549 - DNA, 75 bp, Artificial Sequence
  Synthetic
ctatattgctgcggcttggggcgtggactggtacatacatctatgaccacctcagtcctcttactgaatgggcct

SEQ ID NO: 140550 - DNA, 75 bp, Artificial Sequence
  Synthetic
ctatattgctgcggcttggggcgtggactggtacatacatctatgaccacctcagtcctcttactgattgggcct

SEQ ID NO: 140551 - DNA, 75 bp, Artificial Sequence
  Synthetic
ctatattgctgcggcttggggcgtggactggtacatacatctatgaccacctcagtcctcttactgactgggcct

SEQ ID NO: 140552 - DNA, 75 bp, Artificial Sequence
  Synthetic
ctatattgctgcggcttggggcgtggactggtacatacatctatgaccacctcagtcctcttactgagtgggcct

SEQ ID NO: 140553 - DNA, 75 bp, Artificial Sequence
  Synthetic
cctctcaacgttcgggggggccgcgatgccatcatcctcctcacgtgtgcggtccacccagagctaatttttgag

SEQ ID NO: 140554 - DNA, 75 bp, Artificial Sequence
  Synthetic
tgcagtggagccagttgttttctctcctatggagaagaaggtcatcacctggggcgctgatacggccgcttgcgg

SEQ ID NO: 140555 - DNA, 75 bp, Artificial Sequence
  Synthetic
ttctgggccccgctgatgacgtcaagggcacaggatggcgtctccttgctccgatcacggcgtatgcacaacaaa

SEQ ID NO: 140556 - DNA, 75 bp, Artificial Sequence
  Synthetic
gggcacaggatggcgtctccttgctccgatcacggcgtatgcacaacaaactcgaggcttggtgggcaccatcgt

SEQ ID NO: 140557 - DNA, 75 bp, Artificial Sequence
  Synthetic
ttacaaccctcctgtgatcgagacatggaagaggccgggctatgaaccacccactgtcctgggctgtgcccttcc

SEQ ID NO: 140558 - DNA, 75 bp, Artificial Sequence
  Synthetic
tccagcattgtgctggaggcggatgctatgattttgcatttgcctggatgcttgccttgtgtgagggtcggtaat

SEQ ID NO: 140559 - DNA, 75 bp, Artificial Sequence
  Synthetic
gcttactgcctggcgaccggctgcatttccatcattggccgcatacacctgaatgatcaggtagttgtggcccct

SEQ ID NO: 140560 - DNA, 75 bp, Artificial Sequence
  Synthetic
aatgtcgaccaggacctcgtaggctggcccgcgccccccgggtcgcgctccctaacgccgtgcaattgcggctca

SEQ ID NO: 140561 - DNA, 75 bp, Artificial Sequence
  Synthetic
caggggagacaaccgagcagctctactcagcccacggcccataagcactctgaaaggctcatcgggaggtcccgt

SEQ ID NO: 140562 - DNA, 75 bp, Artificial Sequence
  Synthetic
caggggagacaaccgagcagctctactcagcccacggcccataagcactctgaaaggctcttcgggaggtcccgt

SEQ ID NO: 140563 - DNA, 75 bp, Artificial Sequence
  Synthetic
caggggagacaaccgagcagctctactcagcccacggcccataagcactctgaaaggctcctcgggaggtcccgt

SEQ ID NO: 140564 - DNA, 75 bp, Artificial Sequence
  Synthetic
caggggagacaaccgagcagctctactcagcccacggcccataagcactctgaaaggctcgtcgggaggtcccgt

SEQ ID NO: 140565 - DNA, 75 bp, Artificial Sequence
  Synthetic
gacaggccataaggtcgctcacagagcggctttatatcgggggtcccctgactaattcaaaagggcagaactgcg

SEQ ID NO: 140566 - DNA, 75 bp, Artificial Sequence
  Synthetic
actacccagaggtctccatccttttctgacaactcatcaccaccagccgtaccacaaacctaccaggtgggatat

SEQ ID NO: 140567 - DNA, 75 bp, Artificial Sequence
  Synthetic
ctgacaactcatcaccaccagccgtaccacaaacctaccaggtgggatatctacacgcacccacagggagcggga

SEQ ID NO: 140568 - DNA, 75 bp, Artificial Sequence
  Synthetic
ctgacaactcatcaccaccagccgtaccacaaacctaccaggtgggatatcttcacgcacccacagggagcggga

SEQ ID NO: 140569 - DNA, 75 bp, Artificial Sequence
  Synthetic
ctgacaactcatcaccaccagccgtaccacaaacctaccaggtgggatatctccacgcacccacagggagcggga

SEQ ID NO: 140570 - DNA, 75 bp, Artificial Sequence
  Synthetic
ctgacaactcatcaccaccagccgtaccacaaacctaccaggtgggatatctgcacgcacccacagggagcggga

SEQ ID NO: 140571 - DNA, 75 bp, Artificial Sequence
  Synthetic
accacaaacctaccaggtgggatatctacacgcacccacagggagcgggaagagcacaaaagtcccggcggccta

SEQ ID NO: 140572 - DNA, 75 bp, Artificial Sequence
  Synthetic
accacaaacctaccaggtgggatatctacacgcacccacagggagcgggaagagcactaaagtcccggcggccta

SEQ ID NO: 140573 - DNA, 75 bp, Artificial Sequence
  Synthetic
accacaaacctaccaggtgggatatctacacgcacccacagggagcgggaagagcaccaaagtcccggcggccta

SEQ ID NO: 140574 - DNA, 75 bp, Artificial Sequence
  Synthetic
accacaaacctaccaggtgggatatctacacgcacccacagggagcgggaagagcacgaaagtcccggcggccta

SEQ ID NO: 140575 - DNA, 75 bp, Artificial Sequence
  Synthetic
accacaaacctaccaggtgggatatcttcacgcacccacagggagcgggaagagcacaaaagtcccggcggccta

SEQ ID NO: 140576 - DNA, 75 bp, Artificial Sequence
  Synthetic
accacaaacctaccaggtgggatatcttcacgcacccacagggagcgggaagagcactaaagtcccggcggccta

SEQ ID NO: 140577 - DNA, 75 bp, Artificial Sequence
  Synthetic
accacaaacctaccaggtgggatatcttcacgcacccacagggagcgggaagagcaccaaagtcccggcggccta

SEQ ID NO: 140578 - DNA, 75 bp, Artificial Sequence
  Synthetic
accacaaacctaccaggtgggatatcttcacgcacccacagggagcgggaagagcacgaaagtcccggcggccta

SEQ ID NO: 140579 - DNA, 75 bp, Artificial Sequence
  Synthetic
accacaaacctaccaggtgggatatctccacgcacccacagggagcgggaagagcacaaaagtcccggcggccta

SEQ ID NO: 140580 - DNA, 75 bp, Artificial Sequence
  Synthetic
accacaaacctaccaggtgggatatctccacgcacccacagggagcgggaagagcactaaagtcccggcggccta

SEQ ID NO: 140581 - DNA, 75 bp, Artificial Sequence
  Synthetic
accacaaacctaccaggtgggatatctccacgcacccacagggagcgggaagagcaccaaagtcccggcggccta

SEQ ID NO: 140582 - DNA, 75 bp, Artificial Sequence
  Synthetic
accacaaacctaccaggtgggatatctccacgcacccacagggagcgggaagagcacgaaagtcccggcggccta

SEQ ID NO: 140583 - DNA, 75 bp, Artificial Sequence
  Synthetic
accacaaacctaccaggtgggatatctgcacgcacccacagggagcgggaagagcacaaaagtcccggcggccta

SEQ ID NO: 140584 - DNA, 75 bp, Artificial Sequence
  Synthetic
accacaaacctaccaggtgggatatctgcacgcacccacagggagcgggaagagcactaaagtcccggcggccta

SEQ ID NO: 140585 - DNA, 75 bp, Artificial Sequence
  Synthetic
accacaaacctaccaggtgggatatctgcacgcacccacagggagcgggaagagcaccaaagtcccggcggccta

SEQ ID NO: 140586 - DNA, 75 bp, Artificial Sequence
  Synthetic
accacaaacctaccaggtgggatatctgcacgcacccacagggagcgggaagagcacgaaagtcccggcggccta

SEQ ID NO: 140587 - DNA, 75 bp, Artificial Sequence
  Synthetic
gtatttgacatcaccaagctgctgctggccgtcttcggacccctttggattcttcaaaccagtctgctcaaagtg

SEQ ID NO: 140588 - DNA, 75 bp, Artificial Sequence
  Synthetic
gtccgcaccggggtaaggaccataaccaccggcggaaaaatcacctactccacttatggcaagtttctcgctgat

SEQ ID NO: 140589 - DNA, 75 bp, Artificial Sequence
  Synthetic
gtccgcaccggggtaaggaccataaccaccggcggtaaaatcacctactccacttatggcaagtttctcgctgat

SEQ ID NO: 140590 - DNA, 75 bp, Artificial Sequence
  Synthetic
gtccgcaccggggtaaggaccataaccaccggcggcaaaatcacctactccacttatggcaagtttctcgctgat

SEQ ID NO: 140591 - DNA, 75 bp, Artificial Sequence
  Synthetic
gtccgcaccggggtaaggaccataaccaccggcgggaaaatcacctactccacttatggcaagtttctcgctgat

SEQ ID NO: 140592 - DNA, 75 bp, Artificial Sequence
  Synthetic
gtccgcaccggggtaaggaccattaccaccggcggaaaaatcacctactccacttatggcaagtttctcgctgat

SEQ ID NO: 140593 - DNA, 75 bp, Artificial Sequence
  Synthetic
gtccgcaccggggtaaggaccattaccaccggcggtaaaatcacctactccacttatggcaagtttctcgctgat

SEQ ID NO: 140594 - DNA, 75 bp, Artificial Sequence
  Synthetic
gtccgcaccggggtaaggaccattaccaccggcggcaaaatcacctactccacttatggcaagtttctcgctgat

SEQ ID NO: 140595 - DNA, 75 bp, Artificial Sequence
  Synthetic
gtccgcaccggggtaaggaccattaccaccggcgggaaaatcacctactccacttatggcaagtttctcgctgat

SEQ ID NO: 140596 - DNA, 75 bp, Artificial Sequence
  Synthetic
gtccgcaccggggtaaggaccatcaccaccggcggaaaaatcacctactccacttatggcaagtttctcgctgat

SEQ ID NO: 140597 - DNA, 75 bp, Artificial Sequence
  Synthetic
gtccgcaccggggtaaggaccatcaccaccggcggtaaaatcacctactccacttatggcaagtttctcgctgat

SEQ ID NO: 140598 - DNA, 75 bp, Artificial Sequence
  Synthetic
gtccgcaccggggtaaggaccatcaccaccggcggcaaaatcacctactccacttatggcaagtttctcgctgat

SEQ ID NO: 140599 - DNA, 75 bp, Artificial Sequence
  Synthetic
gtccgcaccggggtaaggaccatcaccaccggcgggaaaatcacctactccacttatggcaagtttctcgctgat

SEQ ID NO: 140600 - DNA, 75 bp, Artificial Sequence
  Synthetic
gtccgcaccggggtaaggaccatgaccaccggcggaaaaatcacctactccacttatggcaagtttctcgctgat

SEQ ID NO: 140601 - DNA, 75 bp, Artificial Sequence
  Synthetic
gtccgcaccggggtaaggaccatgaccaccggcggtaaaatcacctactccacttatggcaagtttctcgctgat

SEQ ID NO: 140602 - DNA, 75 bp, Artificial Sequence
  Synthetic
gtccgcaccggggtaaggaccatgaccaccggcggcaaaatcacctactccacttatggcaagtttctcgctgat

SEQ ID NO: 140603 - DNA, 75 bp, Artificial Sequence
  Synthetic
gtccgcaccggggtaaggaccatgaccaccggcgggaaaatcacctactccacttatggcaagtttctcgctgat

SEQ ID NO: 140604 - DNA, 75 bp, Artificial Sequence
  Synthetic
atcctaggggggtgggtggccgcccagctcgccgcccccggtgccgctaccgcctttgtgggcgctggcttagct

SEQ ID NO: 140605 - DNA, 75 bp, Artificial Sequence
  Synthetic
cggagacaagcggagtgagactcacagtcctcgcaaccgctaccccccccggttcggtcacggtccctcacccca

SEQ ID NO: 140606 - DNA, 75 bp, Artificial Sequence
  Synthetic
cggagactagcggagtgagactcacagtcctcgcaaccgctaccccccccggttcggtcacggtccctcacccca

SEQ ID NO: 140607 - DNA, 75 bp, Artificial Sequence
  Synthetic
cggagaccagcggagtgagactcacagtcctcgcaaccgctaccccccccggttcggtcacggtccctcacccca

SEQ ID NO: 140608 - DNA, 75 bp, Artificial Sequence
  Synthetic
cggagacgagcggagtgagactcacagtcctcgcaaccgctaccccccccggttcggtcacggtccctcacccca

SEQ ID NO: 140609 - DNA, 75 bp, Artificial Sequence
  Synthetic
ttgctctgggggcgcctatgacatcataatatgtgatgagtgccattcaactgactcgacttccatcctgggcat

SEQ ID NO: 140610 - DNA, 75 bp, Artificial Sequence
  Synthetic
ccactctaaaaagaagtgcgacgagcttgccaagcaactcacgatgcaaggcgttaacgccgtcgcattctatag

SEQ ID NO: 140611 - DNA, 75 bp, Artificial Sequence
  Synthetic
ccactgatgctttaatgactggctacacaggcaacttcgacagtgtgatagactgcaacgtgtctgtcacgcaag

SEQ ID NO: 140612 - DNA, 75 bp, Artificial Sequence
  Synthetic
ttttactatagaaaccaccactgtgccccaggacgctgtctcccgcagtcagaggagaggtagaacaggaagggg

SEQ ID NO: 140613 - DNA, 75 bp, Artificial Sequence
  Synthetic
ccccaggacgctgtctcccgcagtcagaggagaggtagaacaggaaggggaaaacatggggtatacaggtacgtc

SEQ ID NO: 140614 - DNA, 75 bp, Artificial Sequence
  Synthetic
ggctggcccgctccccaaggtgcccgctcattgacaccctgcacctgcggctcctcggacctttacctggtcacg

SEQ ID NO: 140615 - DNA, 75 bp, Artificial Sequence
  Synthetic
cggttcgcctgcgcgcctacctaaacaccccagggcttcctgtgtgccaggaccaccttgagttctgggagggag

SEQ ID NO: 140616 - DNA, 75 bp, Artificial Sequence
  Synthetic
caatcaggagagaattttgcgtaccttgttgcctatcaggccacagtgtgcgcaagggcgaaagcccccccacct

SEQ ID NO: 140617 - DNA, 75 bp, Artificial Sequence
  Synthetic
caatcaggagagaattttgcgtaccttgttgcctatcaggccacagtgtgcgctagggcgaaagcccccccacct

SEQ ID NO: 140618 - DNA, 75 bp, Artificial Sequence
  Synthetic
caatcaggagagaattttgcgtaccttgttgcctatcaggccacagtgtgcgccagggcgaaagcccccccacct

SEQ ID NO: 140619 - DNA, 75 bp, Artificial Sequence
  Synthetic
caatcaggagagaattttgcgtaccttgttgcctatcaggccacagtgtgcgcgagggcgaaagcccccccacct

SEQ ID NO: 140620 - DNA, 75 bp, Artificial Sequence
  Synthetic
caatcaggagagaattttgcgtaccttgttgcctatcaggccactgtgtgcgcaagggcgaaagcccccccacct

SEQ ID NO: 140621 - DNA, 75 bp, Artificial Sequence
  Synthetic
caatcaggagagaattttgcgtaccttgttgcctatcaggccactgtgtgcgctagggcgaaagcccccccacct

SEQ ID NO: 140622 - DNA, 75 bp, Artificial Sequence
  Synthetic
caatcaggagagaattttgcgtaccttgttgcctatcaggccactgtgtgcgccagggcgaaagcccccccacct

SEQ ID NO: 140623 - DNA, 75 bp, Artificial Sequence
  Synthetic
caatcaggagagaattttgcgtaccttgttgcctatcaggccactgtgtgcgcgagggcgaaagcccccccacct

SEQ ID NO: 140624 - DNA, 75 bp, Artificial Sequence
  Synthetic
caatcaggagagaattttgcgtaccttgttgcctatcaggccaccgtgtgcgcaagggcgaaagcccccccacct

SEQ ID NO: 140625 - DNA, 75 bp, Artificial Sequence
  Synthetic
caatcaggagagaattttgcgtaccttgttgcctatcaggccaccgtgtgcgctagggcgaaagcccccccacct

SEQ ID NO: 140626 - DNA, 75 bp, Artificial Sequence
  Synthetic
caatcaggagagaattttgcgtaccttgttgcctatcaggccaccgtgtgcgccagggcgaaagcccccccacct

SEQ ID NO: 140627 - DNA, 75 bp, Artificial Sequence
  Synthetic
caatcaggagagaattttgcgtaccttgttgcctatcaggccaccgtgtgcgcgagggcgaaagcccccccacct

SEQ ID NO: 140628 - DNA, 75 bp, Artificial Sequence
  Synthetic
caatcaggagagaattttgcgtaccttgttgcctatcaggccacggtgtgcgcaagggcgaaagcccccccacct

SEQ ID NO: 140629 - DNA, 75 bp, Artificial Sequence
  Synthetic
caatcaggagagaattttgcgtaccttgttgcctatcaggccacggtgtgcgctagggcgaaagcccccccacct

SEQ ID NO: 140630 - DNA, 75 bp, Artificial Sequence
  Synthetic
caatcaggagagaattttgcgtaccttgttgcctatcaggccacggtgtgcgccagggcgaaagcccccccacct

SEQ ID NO: 140631 - DNA, 75 bp, Artificial Sequence
  Synthetic
caatcaggagagaattttgcgtaccttgttgcctatcaggccacggtgtgcgcgagggcgaaagcccccccacct

SEQ ID NO: 140632 - DNA, 75 bp, Artificial Sequence
  Synthetic
ttgttgcctatcaggccacagtgtgcgcaagggcgaaagcccccccaccttcatgggacgtcatgtggaaatgcc

SEQ ID NO: 140633 - DNA, 75 bp, Artificial Sequence
  Synthetic
ttgttgcctatcaggccacagtgtgcgctagggcgaaagcccccccaccttcatgggacgtcatgtggaaatgcc

SEQ ID NO: 140634 - DNA, 75 bp, Artificial Sequence
  Synthetic
ttgttgcctatcaggccacagtgtgcgccagggcgaaagcccccccaccttcatgggacgtcatgtggaaatgcc

SEQ ID NO: 140635 - DNA, 75 bp, Artificial Sequence
  Synthetic
ttgttgcctatcaggccacagtgtgcgcgagggcgaaagcccccccaccttcatgggacgtcatgtggaaatgcc

SEQ ID NO: 140636 - DNA, 75 bp, Artificial Sequence
  Synthetic
ttgttgcctatcaggccactgtgtgcgcaagggcgaaagcccccccaccttcatgggacgtcatgtggaaatgcc

SEQ ID NO: 140637 - DNA, 75 bp, Artificial Sequence
  Synthetic
ttgttgcctatcaggccactgtgtgcgctagggcgaaagcccccccaccttcatgggacgtcatgtggaaatgcc

SEQ ID NO: 140638 - DNA, 75 bp, Artificial Sequence
  Synthetic
ttgttgcctatcaggccactgtgtgcgccagggcgaaagcccccccaccttcatgggacgtcatgtggaaatgcc

SEQ ID NO: 140639 - DNA, 75 bp, Artificial Sequence
  Synthetic
ttgttgcctatcaggccactgtgtgcgcgagggcgaaagcccccccaccttcatgggacgtcatgtggaaatgcc

SEQ ID NO: 140640 - DNA, 75 bp, Artificial Sequence
  Synthetic
ttgttgcctatcaggccaccgtgtgcgcaagggcgaaagcccccccaccttcatgggacgtcatgtggaaatgcc

SEQ ID NO: 140641 - DNA, 75 bp, Artificial Sequence
  Synthetic
ttgttgcctatcaggccaccgtgtgcgctagggcgaaagcccccccaccttcatgggacgtcatgtggaaatgcc

SEQ ID NO: 140642 - DNA, 75 bp, Artificial Sequence
  Synthetic
ttgttgcctatcaggccaccgtgtgcgccagggcgaaagcccccccaccttcatgggacgtcatgtggaaatgcc

SEQ ID NO: 140643 - DNA, 75 bp, Artificial Sequence
  Synthetic
ttgttgcctatcaggccaccgtgtgcgcgagggcgaaagcccccccaccttcatgggacgtcatgtggaaatgcc

SEQ ID NO: 140644 - DNA, 75 bp, Artificial Sequence
  Synthetic
ttgttgcctatcaggccacggtgtgcgcaagggcgaaagcccccccaccttcatgggacgtcatgtggaaatgcc

SEQ ID NO: 140645 - DNA, 75 bp, Artificial Sequence
  Synthetic
ttgttgcctatcaggccacggtgtgcgctagggcgaaagcccccccaccttcatgggacgtcatgtggaaatgcc

SEQ ID NO: 140646 - DNA, 75 bp, Artificial Sequence
  Synthetic
ttgttgcctatcaggccacggtgtgcgccagggcgaaagcccccccaccttcatgggacgtcatgtggaaatgcc

SEQ ID NO: 140647 - DNA, 75 bp, Artificial Sequence
  Synthetic
ttgttgcctatcaggccacggtgtgcgcgagggcgaaagcccccccaccttcatgggacgtcatgtggaaatgcc

SEQ ID NO: 140648 - DNA, 75 bp, Artificial Sequence
  Synthetic
gctttgccgacctcatggggtacattcccgttgtgggcgccccggtaggtggcgtggccagagcccttgcgcatg

SEQ ID NO: 140649 - DNA, 75 bp, Artificial Sequence
  Synthetic
tatcatgacctgcatgtctgcagacctagaggtagttactagcacgtgggtactagtggggggagtccttgctgc

SEQ ID NO: 140650 - DNA, 75 bp, Artificial Sequence
  Synthetic
gccagtttcagccgtggaggtcaagaacaacagtgacacctacatggccactaacgactgctctaatagcagcat

SEQ ID NO: 140651 - DNA, 75 bp, Artificial Sequence
  Synthetic
ggctgtgtggtcatctgcggcagaatctccaccactggtaaaccagtgctaattcctgatcgggaggtgttgtac

SEQ ID NO: 140652 - DNA, 75 bp, Artificial Sequence
  Synthetic
ggctgtgtggtcatctgcggcagaatctccaccactggttaaccagtgctaattcctgatcgggaggtgttgtac

SEQ ID NO: 140653 - DNA, 75 bp, Artificial Sequence
  Synthetic
ggctgtgtggtcatctgcggcagaatctccaccactggtcaaccagtgctaattcctgatcgggaggtgttgtac

SEQ ID NO: 140654 - DNA, 75 bp, Artificial Sequence
  Synthetic
ggctgtgtggtcatctgcggcagaatctccaccactggtgaaccagtgctaattcctgatcgggaggtgttgtac

SEQ ID NO: 140655 - DNA, 75 bp, Artificial Sequence
  Synthetic
attgccgtaaggcaaagcggtgcccttaccaaagggttgcgggcgcacattgacatcattgtaatgtccgcaacg

SEQ ID NO: 140656 - DNA, 75 bp, Artificial Sequence
  Synthetic
ttcagtcctctgccaagcaggcggaggagctaaaaccagcagtcaatgcagcatggccaaaacttgaacaattct

SEQ ID NO: 140657 - DNA, 75 bp, Artificial Sequence
  Synthetic
gcaattgttccatctacccgggccacgtatcagggcatcgcatggcatgggacatgatgatgaactggtcaccaa

SEQ ID NO: 140658 - DNA, 75 bp, Artificial Sequence
  Synthetic
ggcctcgctcacaagcccactatctacctctgcaactttgttgcttaacatcttaggtgggtgggtagcttctca

SEQ ID NO: 140659 - DNA, 75 bp, Artificial Sequence
  Synthetic
ggcctcgctcacaagcccactttctacctctgcaactttgttgcttaacatcttaggtgggtgggtagcttctca

SEQ ID NO: 140660 - DNA, 75 bp, Artificial Sequence
  Synthetic
ggcctcgctcacaagcccactctctacctctgcaactttgttgcttaacatcttaggtgggtgggtagcttctca

SEQ ID NO: 140661 - DNA, 75 bp, Artificial Sequence
  Synthetic
ggcctcgctcacaagcccactgtctacctctgcaactttgttgcttaacatcttaggtgggtgggtagcttctca

SEQ ID NO: 140662 - DNA, 75 bp, Artificial Sequence
  Synthetic
cactacgcgcctcaaccgtgtggtatcgtacccgcgtcacaggtgtgtggtccagtgtactgtttcaccccaagc

SEQ ID NO: 140663 - DNA, 75 bp, Artificial Sequence
  Synthetic
tcttaggtgggtgggtagcttctcagcttgcaaacccaaccgcctccactagttttgtggtaagcggtttggcag

SEQ ID NO: 140664 - DNA, 75 bp, Artificial Sequence
  Synthetic
tcttaggtgggtgggtagcttctcagcttgcaatcccaaccgcctccactagttttgtggtaagcggtttggcag

SEQ ID NO: 140665 - DNA, 75 bp, Artificial Sequence
  Synthetic
tcttaggtgggtgggtagcttctcagcttgcaaccccaaccgcctccactagttttgtggtaagcggtttggcag

SEQ ID NO: 140666 - DNA, 75 bp, Artificial Sequence
  Synthetic
tcttaggtgggtgggtagcttctcagcttgcaagcccaaccgcctccactagttttgtggtaagcggtttggcag

SEQ ID NO: 140667 - DNA, 75 bp, Artificial Sequence
  Synthetic
tacacgattacccggtggggtcgcaattaccttgcgagcctgaaccggacgtggccgtgttgacgtccatgctca

SEQ ID NO: 140668 - DNA, 75 bp, Artificial Sequence
  Synthetic
ctctatgcagggagcgtgggccaaagttatctgtatcctactgctgaccgccggggttgacgcaaccacgcacac

SEQ ID NO: 140669 - DNA, 75 bp, Artificial Sequence
  Synthetic
gtgcggcgagaccccttctgccgaggacatggttaacctgctccctgctctcctgtcacctggagccctcgtagt

SEQ ID NO: 140670 - DNA, 75 bp, Artificial Sequence
  Synthetic
cacatcaaccgcaccgccttaaactgcaacgacagcctgaacaccggcttcctcgccagcctcttttacacccat

SEQ ID NO: 140671 - DNA, 75 bp, Artificial Sequence
  Synthetic
gagcaagtcagtggatgaacaggctgatagctttcgcctccaggggaaaccatgtgtctccaactcactacatcc

SEQ ID NO: 140672 - DNA, 75 bp, Artificial Sequence
  Synthetic
gagcaagtcagtggatgaacaggctgatagctttcgcctccaggggaaaccatgtgtctcctactcactacatcc

SEQ ID NO: 140673 - DNA, 75 bp, Artificial Sequence
  Synthetic
gagcaagtcagtggatgaacaggctgatagctttcgcctccaggggaaaccatgtgtctcccactcactacatcc

SEQ ID NO: 140674 - DNA, 75 bp, Artificial Sequence
  Synthetic
gagcaagtcagtggatgaacaggctgatagctttcgcctccaggggaaaccatgtgtctccgactcactacatcc

SEQ ID NO: 140675 - DNA, 75 bp, Artificial Sequence
  Synthetic
gagcaagtcagtggatgaacaggctgatagctttcgcctccaggggtaaccatgtgtctccaactcactacatcc

SEQ ID NO: 140676 - DNA, 75 bp, Artificial Sequence
  Synthetic
gagcaagtcagtggatgaacaggctgatagctttcgcctccaggggtaaccatgtgtctcctactcactacatcc

SEQ ID NO: 140677 - DNA, 75 bp, Artificial Sequence
  Synthetic
gagcaagtcagtggatgaacaggctgatagctttcgcctccaggggtaaccatgtgtctcccactcactacatcc

SEQ ID NO: 140678 - DNA, 75 bp, Artificial Sequence
  Synthetic
gagcaagtcagtggatgaacaggctgatagctttcgcctccaggggtaaccatgtgtctccgactcactacatcc

SEQ ID NO: 140679 - DNA, 75 bp, Artificial Sequence
  Synthetic
gagcaagtcagtggatgaacaggctgatagctttcgcctccaggggcaaccatgtgtctccaactcactacatcc

SEQ ID NO: 140680 - DNA, 75 bp, Artificial Sequence
  Synthetic
gagcaagtcagtggatgaacaggctgatagctttcgcctccaggggcaaccatgtgtctcctactcactacatcc

SEQ ID NO: 140681 - DNA, 75 bp, Artificial Sequence
  Synthetic
gagcaagtcagtggatgaacaggctgatagctttcgcctccaggggcaaccatgtgtctcccactcactacatcc

SEQ ID NO: 140682 - DNA, 75 bp, Artificial Sequence
  Synthetic
gagcaagtcagtggatgaacaggctgatagctttcgcctccaggggcaaccatgtgtctccgactcactacatcc

SEQ ID NO: 140683 - DNA, 75 bp, Artificial Sequence
  Synthetic
gagcaagtcagtggatgaacaggctgatagctttcgcctccagggggaaccatgtgtctccaactcactacatcc

SEQ ID NO: 140684 - DNA, 75 bp, Artificial Sequence
  Synthetic
gagcaagtcagtggatgaacaggctgatagctttcgcctccagggggaaccatgtgtctcctactcactacatcc

SEQ ID NO: 140685 - DNA, 75 bp, Artificial Sequence
  Synthetic
gagcaagtcagtggatgaacaggctgatagctttcgcctccagggggaaccatgtgtctcccactcactacatcc

SEQ ID NO: 140686 - DNA, 75 bp, Artificial Sequence
  Synthetic
gagcaagtcagtggatgaacaggctgatagctttcgcctccagggggaaccatgtgtctccgactcactacatcc

SEQ ID NO: 140687 - DNA, 75 bp, Artificial Sequence
  Synthetic
catgtgtctccaactcactacatccccgaaacggacacttcccagaaaattaccaacatactcagttccctgacc

SEQ ID NO: 140688 - DNA, 75 bp, Artificial Sequence
  Synthetic
catgtgtctcctactcactacatccccgaaacggacacttcccagaaaattaccaacatactcagttccctgacc

SEQ ID NO: 140689 - DNA, 75 bp, Artificial Sequence
  Synthetic
catgtgtctcccactcactacatccccgaaacggacacttcccagaaaattaccaacatactcagttccctgacc

SEQ ID NO: 140690 - DNA, 75 bp, Artificial Sequence
  Synthetic
catgtgtctccgactcactacatccccgaaacggacacttcccagaaaattaccaacatactcagttccctgacc

SEQ ID NO: 140691 - DNA, 75 bp, Artificial Sequence
  Synthetic
ccaatgaggaggacatgagaccgtactgctggcattatccacccaaaccgtgtggcattgtccctgctaggtcag

SEQ ID NO: 140692 - DNA, 75 bp, Artificial Sequence
  Synthetic
cggtgctactagacttcaaaacctggctcaagacaaaactcgttccggcactgccaggagtccctttcttctcgt

SEQ ID NO: 140693 - DNA, 75 bp, Artificial Sequence
  Synthetic
cggtgctactagacttcaaaacctggctcaagacaatactcgttccggcactgccaggagtccctttcttctcgt

SEQ ID NO: 140694 - DNA, 75 bp, Artificial Sequence
  Synthetic
cggtgctactagacttcaaaacctggctcaagacaacactcgttccggcactgccaggagtccctttcttctcgt

SEQ ID NO: 140695 - DNA, 75 bp, Artificial Sequence
  Synthetic
cggtgctactagacttcaaaacctggctcaagacaagactcgttccggcactgccaggagtccctttcttctcgt

SEQ ID NO: 140696 - DNA, 75 bp, Artificial Sequence
  Synthetic
gctcctcgggaggccccattatgtgtccctcggggcacgttgtgggactcttccgagctgccgtatgcacaaggg

SEQ ID NO: 140697 - DNA, 75 bp, Artificial Sequence
  Synthetic
ccacatcacagcagagacggctaagcgtaggctggccagagggtcccccccctccttggccagctcttcagctag

SEQ ID NO: 140698 - DNA, 75 bp, Artificial Sequence
  Synthetic
tgtatttctgttgaacagcacgcgaccaccgcgggggggctggttcggatgcacgtggatgaattctactgggtt

SEQ ID NO: 140699 - DNA, 75 bp, Artificial Sequence
  Synthetic
tcccgggtggtggccagatcgttggcggagtttacttgttgccgcgcaggggccccaggttgggtgtgcgcgcga

SEQ ID NO: 140700 - DNA, 75 bp, Artificial Sequence
  Synthetic
gcaatcaaatgggagtatatcctgttgctcttcctcctcctggcggacgcgcgcgtctgcgcctgtttgtggatg

SEQ ID NO: 140701 - DNA, 75 bp, Artificial Sequence
  Synthetic
gaaagtgtctggttccagctggtgcagcaacatctggcacggtaccttccccatcaatgcgactacgaccggtcc

SEQ ID NO: 140702 - DNA, 75 bp, Artificial Sequence
  Synthetic
gaaagtgtctggttccagctggtgcagcaacatctggcacggtaccttccccatcaatgcgtctacgaccggtcc

SEQ ID NO: 140703 - DNA, 75 bp, Artificial Sequence
  Synthetic
gaaagtgtctggttccagctggtgcagcaacatctggcacggtaccttccccatcaatgcgcctacgaccggtcc

SEQ ID NO: 140704 - DNA, 75 bp, Artificial Sequence
  Synthetic
gaaagtgtctggttccagctggtgcagcaacatctggcacggtaccttccccatcaatgcggctacgaccggtcc

SEQ ID NO: 140705 - DNA, 75 bp, Artificial Sequence
  Synthetic
ggtgtcctggcgggcttggcttactattccatggtggggaactgggccaaggtctttgctgtgctgctactcttt

SEQ ID NO: 140706 - DNA, 75 bp, Artificial Sequence
  Synthetic
acctcgtggcaggcgtcagcctatccccaaggcacgtccgtccgagggcaggtcctgggctcagcccgggtaccc

SEQ ID NO: 140707 - DNA, 75 bp, Artificial Sequence
  Synthetic
caacctcctgtggcggcaggagatgggcgggaacatcacccgcgtggagtcagagaataaggtagtaattttgga

SEQ ID NO: 140708 - DNA, 75 bp, Artificial Sequence
  Synthetic
gccacctacagcaagtgtggagctggaccttggctaacaccaaagtgtctagtccactatgcgtataggctatgg

SEQ ID NO: 140709 - DNA, 75 bp, Artificial Sequence
  Synthetic
gttggagctactgcggacaacctaaaatgcccatgtcaggtcccagcccctgagttcttcaccgaggttgatggc

SEQ ID NO: 140710 - DNA, 75 bp, Artificial Sequence
  Synthetic
gttggtgctactgcggacaacctaaaatgcccatgtcaggtcccagcccctgagttcttcaccgaggttgatggc

SEQ ID NO: 140711 - DNA, 75 bp, Artificial Sequence
  Synthetic
gttggcgctactgcggacaacctaaaatgcccatgtcaggtcccagcccctgagttcttcaccgaggttgatggc

SEQ ID NO: 140712 - DNA, 75 bp, Artificial Sequence
  Synthetic
gttggggctactgcggacaacctaaaatgcccatgtcaggtcccagcccctgagttcttcaccgaggttgatggc

SEQ ID NO: 140713 - DNA, 75 bp, Artificial Sequence
  Synthetic
atcgctgcaacctggaagacagggacaggagtcaacttagtcccttgctgcactccaccactgagtgggctatcc

SEQ ID NO: 140714 - DNA, 75 bp, Artificial Sequence
  Synthetic
catgcgaacctgaaccagacgtcatggtcgtcacgtcgatgttgacggatccgtcacatgtgaccgctgagaccg

SEQ ID NO: 140715 - DNA, 75 bp, Artificial Sequence
  Synthetic
ggtcgtcacgtcgatgttgacggatccgtcacatgtgaccgctgagaccgcggcgcgacgcttggggcgcggttc

SEQ ID NO: 140716 - DNA, 75 bp, Artificial Sequence
  Synthetic
aatcaccaagtatatcatcaagtgggaatgggtcgtcctccttttcctacttttggctgatgctagagtgtctgc

SEQ ID NO: 140717 - DNA, 75 bp, Artificial Sequence
  Synthetic
cccaaattccagcatagtgtatgaggctgaccaccacatcatgcacttaccagggtgcgtgccttgtgtgaggac

SEQ ID NO: 140718 - DNA, 75 bp, Artificial Sequence
  Synthetic
gaggcgaatttgctgtggaggcaggagatgggcagtaacatcacccgggtggagtctgagaacaaggtcgtcata

SEQ ID NO: 140719 - DNA, 75 bp, Artificial Sequence
  Synthetic
cctttaacacctactgtggctgccccttacatcggcgcgccgcttgaatccatgcgacgacacgtggacctgatg

SEQ ID NO: 140720 - DNA, 75 bp, Artificial Sequence
  Synthetic
tacttcatcatcttcttcatcgccgcgtggcacttcaagggcagggtggtccccatggccacctactccctcctc

SEQ ID NO: 140721 - DNA, 75 bp, Artificial Sequence
  Synthetic
cggcagaagaaggtcacctttgacagactgcaagtcctggacgaccattaccgggacgtgctcaaggagatgaag

SEQ ID NO: 140722 - DNA, 75 bp, Artificial Sequence
  Synthetic
tacccatctgggctaggcctgactacaacccgcctcttgtggagccgtggaagtctccggactacgatcctcctg

SEQ ID NO: 140723 - DNA, 75 bp, Artificial Sequence
  Synthetic
ggactacccaggactgtaactgctccatctatgttggccacatcaccggccataggatggcttgggacatgatga

SEQ ID NO: 140724 - DNA, 75 bp, Artificial Sequence
  Synthetic
tcatgactctccttacactctctccagcttataagaccctcctcagccggtgcttatggtggttgtgctatctgc

SEQ ID NO: 140725 - DNA, 75 bp, Artificial Sequence
  Synthetic
caacccgcctcttgtggagccgtggaagtctccggactacgatcctcctgtggtccatggttgcgccttacctcc

SEQ ID NO: 140726 - DNA, 75 bp, Artificial Sequence
  Synthetic
aagtctccggactacgatcctcctgtggtccatggttgcgccttacctccttcggccgcaactcccattccgcca

SEQ ID NO: 140727 - DNA, 75 bp, Artificial Sequence
  Synthetic
gcctcacaggccgggacaagaaccaggtagagggggaggtccaagtggtttccaccgcaacacaatccttcctgg

SEQ ID NO: 140728 - DNA, 75 bp, Artificial Sequence
  Synthetic
cgggatacgggtcagatcaggccactcgcagcacgggttcaggggagcggtccgaggacgacggcgccgcatctg

SEQ ID NO: 140729 - DNA, 75 bp, Artificial Sequence
  Synthetic
ggggcttgcgttcttcggtatgcaggccaattgggccaaggtgatcttgatcttgttcttgttcgccggggtcga

SEQ ID NO: 140730 - DNA, 75 bp, Artificial Sequence
  Synthetic
ggtggtgtttgacataaccaagtggttgttggcaattttgggacctggctacctccttaaggatgtcttgacgcg

SEQ ID NO: 140731 - DNA, 75 bp, Artificial Sequence
  Synthetic
tcgcagcacgggttcaggggagcggtccgaggacgacggcgccgcatctgaggcagattcctacagttccatgcc

SEQ ID NO: 140732 - DNA, 75 bp, Artificial Sequence
  Synthetic
tccaacgggagctggcacatcaacaggactgccctcaattgcaacgacagcctgaacacggggttcatcgctggc

SEQ ID NO: 140733 - DNA, 75 bp, Artificial Sequence
  Synthetic
gtgtgcgcgcgacgaggaagacttctgaacgatcccagcccagaggcaggcgccagcccataccaaaggcgcgcc

SEQ ID NO: 140734 - DNA, 75 bp, Artificial Sequence
  Synthetic
agctggacaggggcacttattacaccttgtgccgccgaagaagagaagttacctataaaccctctgagtaactct

SEQ ID NO: 140735 - DNA, 75 bp, Artificial Sequence
  Synthetic
ggtagatggaccggcacatacatctatgaccatctctcccctatgtccgattgggccgccaacggactgcgggac

SEQ ID NO: 140736 - DNA, 75 bp, Artificial Sequence
  Synthetic
gctctgggtgcccagagaggcttgcgtcatgcaaacgcctggaggacttccctcaaggctggggccaactcaccg

SEQ ID NO: 140737 - DNA, 75 bp, Artificial Sequence
  Synthetic
cttgcgccaaaagaaggtgacttttgaccgagttcagctcgtggaccaacattactatgacactttacaggagat

SEQ ID NO: 140738 - DNA, 75 bp, Artificial Sequence
  Synthetic
tacccgtttccgcccggctcgcccaggaagtcttgctgggccctgccgatgagtacacttccaaagggtggaggc

SEQ ID NO: 140739 - DNA, 75 bp, Artificial Sequence
  Synthetic
ctactgttttacacccagccccgtggtagtcggcacaactgacccgtccgggtcccccacttacaactgggggga

SEQ ID NO: 140740 - DNA, 75 bp, Artificial Sequence
  Synthetic
agtccaggttctatccacagtgactcagtccttcctcggaacaacgatctccgggattctctggactgtctacca

SEQ ID NO: 140741 - DNA, 75 bp, Artificial Sequence
  Synthetic
ggcggcccaccctgctcagtcaacagcaactggtcgtgccccactgactgtttcaggaagcacccggacgccact

SEQ ID NO: 140742 - DNA, 75 bp, Artificial Sequence
  Synthetic
gaaataccactgggatataccatctcaccaacgactgcccgaactccagcatcgtttatgaggcggacaccatga

SEQ ID NO: 140743 - DNA, 75 bp, Artificial Sequence
  Synthetic
gaaattccactgggatataccatctcaccaacgactgcccgaactccagcatcgtttatgaggcggacaccatga

SEQ ID NO: 140744 - DNA, 75 bp, Artificial Sequence
  Synthetic
gaaatcccactgggatataccatctcaccaacgactgcccgaactccagcatcgtttatgaggcggacaccatga

SEQ ID NO: 140745 - DNA, 75 bp, Artificial Sequence
  Synthetic
gaaatgccactgggatataccatctcaccaacgactgcccgaactccagcatcgtttatgaggcggacaccatga

SEQ ID NO: 140746 - DNA, 75 bp, Artificial Sequence
  Synthetic
gcaactggtcgtgccccactgactgtttcaggaagcacccggacgccacttacctcaagtgtggttcaggcccgt

SEQ ID NO: 140747 - DNA, 75 bp, Artificial Sequence
  Synthetic
accaggtccttggagccctgcacctgtggggccgttgatctctacctcgtcacccggaacgctgatgtcatcccg

SEQ ID NO: 140748 - DNA, 75 bp, Artificial Sequence
  Synthetic
gagatgcttacggtttccaatattcacctaagcagcgagtggagcgcttgctaaaaatgtggaaatctaagaaga

SEQ ID NO: 140749 - DNA, 75 bp, Artificial Sequence
  Synthetic
gccagcgagggggttccgcactcatgtggacctccttgttggttcggctgcgctctgctcggccttgtacgtcgg

SEQ ID NO: 140750 - DNA, 75 bp, Artificial Sequence
  Synthetic
ggtcgaacatcggctagaggcagcgtgcaattggactaggggggagccttgtggcttggagcacagagatcgcac

SEQ ID NO: 140751 - DNA, 75 bp, Artificial Sequence
  Synthetic
atgctgtcggcatcttccgagcagccgtatgctccagaggagtggcgaagtctatcgactttatccctgtcgaga

SEQ ID NO: 140752 - DNA, 75 bp, Artificial Sequence
  Synthetic
ttcgcccagggctggggccctatcagctatgccaacggaagcggccccgaacaccgcccctactgctggcactac

SEQ ID NO: 140753 - DNA, 75 bp, Artificial Sequence
  Synthetic
cagaacatcgtggacatccagtacctttatggcgtcgggtccgcagtagtgtcgtgggcgcttaagtgggagtac

SEQ ID NO: 140754 - DNA, 75 bp, Artificial Sequence
  Synthetic
cttaaaagcatcagctgcgtgccgcgcagcgggcttcactgattttgacatgttggtctgcggagatgatttggt

SEQ ID NO: 140755 - DNA, 75 bp, Artificial Sequence
  Synthetic
cagtgggaagagcaccaaggtccccgcggcatatgcggctcagggctacaaagtactagtactaaacccctctgt

SEQ ID NO: 140756 - DNA, 75 bp, Artificial Sequence
  Synthetic
ttggatgatgatgcttgtggcgcaggttgaagccgccttggctgatctggtcaccctcaacgccatgtcggctgc

SEQ ID NO: 140757 - DNA, 75 bp, Artificial Sequence
  Synthetic
gcagcgggcttcactgattttgacatgttggtctgcggagatgatttggtggtcgtagttgaaagcgatggagtc

SEQ ID NO: 140758 - DNA, 75 bp, Artificial Sequence
  Synthetic
acatactctacatacggcaaattcctcgcagatggaggctgcgctggcggagcctatgatatcataatatgcgat

SEQ ID NO: 140759 - DNA, 75 bp, Artificial Sequence
  Synthetic
tggcccctgctccttctcctcatcatgctcccccacagggcgtatgcttttgacggggaggttgcagggtccatg

SEQ ID NO: 140760 - DNA, 75 bp, Artificial Sequence
  Synthetic
cagtcacgcctcttgctcgagcagcttgggagactgctcgtcacactccagtaaactcgtggctggggaacatca

SEQ ID NO: 140761 - DNA, 75 bp, Artificial Sequence
  Synthetic
cacctcccgggtcggtgacaaccccccatcccaacatagaggaggttggacttagccatgagggcgagatcccct

SEQ ID NO: 140762 - DNA, 75 bp, Artificial Sequence
  Synthetic
ggtctgaggccttggtgcatgtttacatcccgtctctggtggttaggggcccacgagattccataattcttctca

SEQ ID NO: 140763 - DNA, 75 bp, Artificial Sequence
  Synthetic
gcaattgttccatctaccaaggtcatatcaccggccaccgcatggcatgggacatgatgttaaactggtcaccaa

SEQ ID NO: 140764 - DNA, 75 bp, Artificial Sequence
  Synthetic
cggcatgggcttgaacgcagtggcttattacagaggtctggacgtctccgtgataccatcccaaggagacgtggt

SEQ ID NO: 140765 - DNA, 75 bp, Artificial Sequence
  Synthetic
tgcaagagtcgctactgtgcatcccttactacgtgagggctcatgcactggtcaggatttgcgggctcgcgcgtg

SEQ ID NO: 140766 - DNA, 75 bp, Artificial Sequence
  Synthetic
gaagttgtcttcggcggccattggggtgtggtgtttggcttggcctatttctccatgcagggagcatgggccaaa

SEQ ID NO: 140767 - DNA, 75 bp, Artificial Sequence
  Synthetic
cccggatacgagcctccagtcgtgtctgggtgtgccgtcgccccacctaaaccggcaccaattcccccgccgagg

SEQ ID NO: 140768 - DNA, 75 bp, Artificial Sequence
  Synthetic
cggcaagtacctcttcaactgggcggtaaaaaccaaactcaaactcactccattgcgtggcgcgtccgacctaga

SEQ ID NO: 140769 - DNA, 75 bp, Artificial Sequence
  Synthetic
gacccaaccttcaccataacaacacaaactgttcctcaggacgccgtctcgcgcagccagcgtcgaggacggacg

SEQ ID NO: 140770 - DNA, 75 bp, Artificial Sequence
  Synthetic
tgccgagggtcttaaagacttagcggtggccacggaaccagtcatattcacccccatggagaagagagtgatagt

SEQ ID NO: 140771 - DNA, 75 bp, Artificial Sequence
  Synthetic
cagttggacttgtccaactggttcgttgctggctacagcgggggagacatatatcacagcctgtctcgtgcccga

SEQ ID NO: 140772 - DNA, 75 bp, Artificial Sequence
  Synthetic
cccccatggagaagagagtgatagtctggggtgctgacacagctgcgtgcggagacatcatcaacggccttccag

SEQ ID NO: 140773 - DNA, 75 bp, Artificial Sequence
  Synthetic
tctaattcacaccaatggcagttggcacataaaccggactgccctcaattgcaatgacagcttgcatacgggttt

SEQ ID NO: 140774 - DNA, 75 bp, Artificial Sequence
  Synthetic
gttactcctgtgcctactcctactttctgtaggggtaggcatcttcctgctcccagcccggtaggctgagagccc

SEQ ID NO: 140775 - DNA, 75 bp, Artificial Sequence
  Synthetic
gcgtgtcccgggctcgaccccgcatgttactcctgtgcctactcctactttctgtaggggtaggcatcttcctgc

SEQ ID NO: 140776 - DNA, 75 bp, Artificial Sequence
  Synthetic
ccgcatggtatgaattaacaccagcggaggttaccgttaggctgcgggcttacttcaacacgcccggcctacccg

SEQ ID NO: 140777 - DNA, 75 bp, Artificial Sequence
  Synthetic
tctgtaggggtaggcatcttcctgctcccagcccggtaggctgagagccccacactccacacaattttgccgttt

SEQ ID NO: 140778 - DNA, 75 bp, Artificial Sequence
  Synthetic
ggaaaaagcctgactacgaaccacctgtggtccatggctgcccgcttccacctccacagtcccctcctgtgcctc

SEQ ID NO: 140779 - DNA, 75 bp, Artificial Sequence
  Synthetic
aacacggggcttgctgggcactattgtgaccagcctcaccggcagagacaccaatgagaactgcggcgaggtcca

SEQ ID NO: 140780 - DNA, 75 bp, Artificial Sequence
  Synthetic
cctgtcctaggcgcccccctagggggcgttgccagggctctggcacatggtgttagagttctggaggacggggtc

SEQ ID NO: 140781 - DNA, 75 bp, Artificial Sequence
  Synthetic
tgcgtacctaacggcctatcaagccacagtgtgcgccagagctaaagcccctcccccctcctgggataccatgtg

SEQ ID NO: 140782 - DNA, 75 bp, Artificial Sequence
  Synthetic
ttcctcgggactgggataaatggcgtcatgtggactgtgtaccatggagccggcagtaagaccatctgtggccca

SEQ ID NO: 140783 - DNA, 75 bp, Artificial Sequence
  Synthetic
actccagtggagtctatcatctcaccaatgactgccccaacgctagtatagtctatgaaacagacaacgccatcc

SEQ ID NO: 140784 - DNA, 75 bp, Artificial Sequence
  Synthetic
actccagtggtgtctatcatctcaccaatgactgccccaacgctagtatagtctatgaaacagacaacgccatcc

SEQ ID NO: 140785 - DNA, 75 bp, Artificial Sequence
  Synthetic
actccagtggcgtctatcatctcaccaatgactgccccaacgctagtatagtctatgaaacagacaacgccatcc

SEQ ID NO: 140786 - DNA, 75 bp, Artificial Sequence
  Synthetic
actccagtggggtctatcatctcaccaatgactgccccaacgctagtatagtctatgaaacagacaacgccatcc

SEQ ID NO: 140787 - DNA, 75 bp, Artificial Sequence
  Synthetic
cctcggacctgttcttggtcactcgccgcgcagacgtcatccccgtgcggcggagaggggacactcggggcgccc

SEQ ID NO: 140788 - DNA, 75 bp, Artificial Sequence
  Synthetic
cactaagacatgcggtgcaccaccttgccgcattaggagggactacaacggaaccctcgatctgttgtgccccac

SEQ ID NO: 140789 - DNA, 75 bp, Artificial Sequence
  Synthetic
tactgacgatttgcggacgcatattgacctagtggtggcgtcagctaccctgtgctccgccttgtacgtggggga

SEQ ID NO: 140790 - DNA, 75 bp, Artificial Sequence
  Synthetic
ttttgagccccaagcccatcgctgtcctcaagggatcttctggcgggccgctactatgctctaaaggacacgccg

SEQ ID NO: 140791 - DNA, 75 bp, Artificial Sequence
  Synthetic
tcctatatgaagcatttgatgagatggaggagtgtgcttctggggccgccctcattgaggaagggcaaaggatag

SEQ ID NO: 140792 - DNA, 75 bp, Artificial Sequence
  Synthetic
gtcaccggccacaggatggcgtgggacatgatgcagaactgggcgccggccttgtcaatggttgccgcttacgct

SEQ ID NO: 140793 - DNA, 75 bp, Artificial Sequence
  Synthetic
tgtgttcactctcaccccagcttacaaacaactgctcgtaagtgtgatttggtggctacaatatttcatcgcacg

SEQ ID NO: 140794 - DNA, 75 bp, Artificial Sequence
  Synthetic
cactgacaactccacccccccggctgtgccccaaacataccaggttgctcacttgcatgctcctacggggagcgg

SEQ ID NO: 140795 - DNA, 75 bp, Artificial Sequence
  Synthetic
gtgccccaaacataccaggttgctcacttgcatgctcctacggggagcggcaagagcaccaaggtcccggccgca

SEQ ID NO: 140796 - DNA, 75 bp, Artificial Sequence
  Synthetic
caactcttcgggggtgtaccatgtcaccaatgattgccccaatgcgtctgttgtgtacgagacagatagcttgat

SEQ ID NO: 140797 - DNA, 75 bp, Artificial Sequence
  Synthetic
acaattctgggccaagcacatgtggaacttcatcagtggtattcagtacctcgcaggcttgtcaacgctgccggg

SEQ ID NO: 140798 - DNA, 75 bp, Artificial Sequence
  Synthetic
taatactcatcatgctactcatgtccggcgtcgacgcggaaaccatggccgtcggggctagggccgctcacacca

SEQ ID NO: 140799 - DNA, 75 bp, Artificial Sequence
  Synthetic
cgccaagcagaacatccagctgatcaacaccaacggcagttggcacatcaataggacggccttgaactgcaatga

SEQ ID NO: 140800 - DNA, 75 bp, Artificial Sequence
  Synthetic
accaatgattgccccaatgcgtctgttgtgtacgagacagatagcttgatcatacatctgccggggtgtgtgccc

SEQ ID NO: 140801 - DNA, 75 bp, Artificial Sequence
  Synthetic
ggtgctgggtctcccttagtcctactgttgccgctaaggatccgggcgtcccggtcaacgagattcggcgtcacg

SEQ ID NO: 140802 - DNA, 75 bp, Artificial Sequence
  Synthetic
tccacgtacgggaagttcctggccgatggaggctgtggggggggagcttacgacatcatcatttgtgacgaatgc

SEQ ID NO: 140803 - DNA, 75 bp, Artificial Sequence
  Synthetic
gcttctcaaatagctccccctccgggggctactggcttagtggtcagtggtctcgtgggggcagctgtgggtagc

SEQ ID NO: 140804 - DNA, 75 bp, Artificial Sequence
  Synthetic
gcttctcaaatagctccccctccgggggctactggctttgtggtcagtggtctcgtgggggcagctgtgggtagc

SEQ ID NO: 140805 - DNA, 75 bp, Artificial Sequence
  Synthetic
gcttctcaaatagctccccctccgggggctactggcttcgtggtcagtggtctcgtgggggcagctgtgggtagc

SEQ ID NO: 140806 - DNA, 75 bp, Artificial Sequence
  Synthetic
gcttctcaaatagctccccctccgggggctactggcttggtggtcagtggtctcgtgggggcagctgtgggtagc

SEQ ID NO: 140807 - DNA, 75 bp, Artificial Sequence
  Synthetic
atgcctttggatgctcatcatactgggccaagccgaggcggcgcttgagaagcttatcatcttgcactctgctag

SEQ ID NO: 140808 - DNA, 75 bp, Artificial Sequence
  Synthetic
caatgactctttgcagacagggttcatagcggccctcttctacacacataggttcaattctagtggctgtcccga

SEQ ID NO: 140809 - DNA, 75 bp, Artificial Sequence
  Synthetic
cacttatgcggttccatcttcctcgttggccagcttttcaccctctcccctaggcgccactggacaacacaagac

SEQ ID NO: 140810 - DNA, 75 bp, Artificial Sequence
  Synthetic
catctcgggggctcttgtcgcctttaagatcatgtctggcgaaaagccctctatggaagacgtagtcaacctttt

SEQ ID NO: 140811 - DNA, 75 bp, Artificial Sequence
  Synthetic
cggggtctgtgaccactcctcacgcaaacatcgaggaggtagccctgccaacgacgggggaggtgcccttctacg

SEQ ID NO: 140812 - DNA, 75 bp, Artificial Sequence
  Synthetic
tggttcttcatcttcttcatagcggcctggtacttaaagggcagggtggtccccatggccacgtactctgttctt

SEQ ID NO: 140813 - DNA, 75 bp, Artificial Sequence
  Synthetic
tggcactacgcgccatcgccgtgtggtattgtgccggctaaggatgtttgcggtccggtctactgctttacacca

SEQ ID NO: 140814 - DNA, 75 bp, Artificial Sequence
  Synthetic
caaggggggcaggcacctcatcttctgtcattccaaaaagaagtgtgacgagttggctaagcagttgtcctctct

SEQ ID NO: 140815 - DNA, 75 bp, Artificial Sequence
  Synthetic
aataggctcattgcctttgcttccagaggtaaccacgtcgccccaacccactacgtgggggagtcggacgcctca

SEQ ID NO: 140816 - DNA, 75 bp, Artificial Sequence
  Synthetic
tcagtatggtggctgtcctacatgctggtcttggccgaggcccagattcagcaatgggttccccccctggaagcc

SEQ ID NO: 140817 - DNA, 75 bp, Artificial Sequence
  Synthetic
agcctggagacatcgagccagagctgtcagagccaaactcattgcccaaggggggaaagcggctatatgcggcaa

SEQ ID NO: 140818 - DNA, 75 bp, Artificial Sequence
  Synthetic
cgccacggacgcactgatgactggttacaccggcgactttgactctgtgatagactgcaacacgtccgtcataca

SEQ ID NO: 140819 - DNA, 75 bp, Artificial Sequence
  Synthetic
cgcaaggcagttggtttgggtgctcatggatgaacacaacggggttcacgaagacctgcggaggtcctccgtgca

SEQ ID NO: 140820 - DNA, 75 bp, Artificial Sequence
  Synthetic
catggcttcgcgatgtttgggattgggtttgtaccatcctcactgacttcaagaactggctgtcctccaagctgt

SEQ ID NO: 140821 - DNA, 75 bp, Artificial Sequence
  Synthetic
cttgctcttctatcctgcctgacagtccctgcttcggccgtcgaagtgcgcaactcttcggggatataccatgtc

SEQ ID NO: 140822 - DNA, 75 bp, Artificial Sequence
  Synthetic
tacaccggcgactttgactctgtgatagactgcaacacgtccgtcatacaaactgtggatttcagtctggaccct

SEQ ID NO: 140823 - DNA, 75 bp, Artificial Sequence
  Synthetic
ggtttgtaccatcctcactgacttcaagaactggctgtcctccaagctgttcccaaaaatgcctggcatcccctt

SEQ ID NO: 140824 - DNA, 75 bp, Artificial Sequence
  Synthetic
tccgtggttgacacctagatgcatggtccattacccctatagactgtggcactacccgtgtacagtcaacttcac

SEQ ID NO: 140825 - DNA, 75 bp, Artificial Sequence
  Synthetic
catccagatgctgttgatcaccataggcaggtggactggtacttacatctatgaccacctctcccctttatcaac

SEQ ID NO: 140826 - DNA, 75 bp, Artificial Sequence
  Synthetic
catgtttgacacttcagtgctctgtgagtgctatgacgccggctgcgcttggtacgagctgacgccggctgagac

SEQ ID NO: 140827 - DNA, 75 bp, Artificial Sequence
  Synthetic
ggctccatgaggataacaggacccaagacctgcatgaacacctggcagggaaccttccctatcaactgctacaca

SEQ ID NO: 140828 - DNA, 75 bp, Artificial Sequence
  Synthetic
agggtggacatgtcccccctgctccattccactacggagctcgcaatacttccgtgttcctttgtgccgcttccg

SEQ ID NO: 140829 - DNA, 75 bp, Artificial Sequence
  Synthetic
tgtctttacggggttaactcatatagacgctcacttcctatcccagacaaaacaggcgggggataacttccccta

SEQ ID NO: 140830 - DNA, 75 bp, Artificial Sequence
  Synthetic
gacctatgtggctccatcttcctcgttggccagcttttcaccttctctcccagacgccactggacgacgcaggac

SEQ ID NO: 140831 - DNA, 75 bp, Artificial Sequence
  Synthetic
gacctatgtggctccatcttcctcgttggccagcttttcaccttctctcccagtcgccactggacgacgcaggac

SEQ ID NO: 140832 - DNA, 75 bp, Artificial Sequence
  Synthetic
gacctatgtggctccatcttcctcgttggccagcttttcaccttctctcccagccgccactggacgacgcaggac

SEQ ID NO: 140833 - DNA, 75 bp, Artificial Sequence
  Synthetic
gacctatgtggctccatcttcctcgttggccagcttttcaccttctctcccaggcgccactggacgacgcaggac

SEQ ID NO: 140834 - DNA, 75 bp, Artificial Sequence
  Synthetic
cgtacgtgacagggttgacagatgacaacctaaaggtcccctgccagctgccatcaccagaatttttctcatggg

SEQ ID NO: 140835 - DNA, 75 bp, Artificial Sequence
  Synthetic
agtgggtagtcctcgttttcctactcctggcggacgcgcggatctgcgcctgcctttggatgatgatgcttatgg

SEQ ID NO: 140836 - DNA, 75 bp, Artificial Sequence
  Synthetic
catgggcccactcctctcctctaccgaatagggtccgtgcagaatgaggtgactttgacccaccctgtgactaag

SEQ ID NO: 140837 - DNA, 75 bp, Artificial Sequence
  Synthetic
gaatagggtccgtgcagaatgaggtgactttgacccaccctgtgactaagtacatcatggcctgcatgtcagcgg

SEQ ID NO: 140838 - DNA, 75 bp, Artificial Sequence
  Synthetic
tcagctcccttgtgagcctgagccagacacagaggtgttggcgtcgatgctaacggatccgtcccatataacggc

SEQ ID NO: 140839 - DNA, 75 bp, Artificial Sequence
  Synthetic
atcaggatgtttgtgggcggggttgagcacaggctcgacgccgcgtgcaactggacgcggggagagcgctgcgac

SEQ ID NO: 140840 - DNA, 75 bp, Artificial Sequence
  Synthetic
ttggcatctacgaggcagggttgtccctctggtgacgtatgggatatgcgggatgtggcccttcttcctcatgtt

SEQ ID NO: 140841 - DNA, 75 bp, Artificial Sequence
  Synthetic
caaccaggcgctaagcaaaacatccagctcataaataccaacggcagctggcacatcaacaggactgccttgaac

SEQ ID NO: 140842 - DNA, 75 bp, Artificial Sequence
  Synthetic
acccatgggaaaaattatgacatagacatggtagatgccaacctctttcttggaagcgacgtgactcggatcgaa

SEQ ID NO: 140843 - DNA, 75 bp, Artificial Sequence
  Synthetic
cactacaagagacttctagcccttattctctggtgggtcacatatttccttacaaggtgtgaagcagcactccaa

SEQ ID NO: 140844 - DNA, 75 bp, Artificial Sequence
  Synthetic
ttaccaacttcggccaaggctgggggcccattacttacggggggtctcctgacaatgaacaacggccatattgct

SEQ ID NO: 140845 - DNA, 75 bp, Artificial Sequence
  Synthetic
ttaccaacttcggccaaggctgggggcccattacttacggggggtctcctgacattgaacaacggccatattgct

SEQ ID NO: 140846 - DNA, 75 bp, Artificial Sequence
  Synthetic
ttaccaacttcggccaaggctgggggcccattacttacggggggtctcctgacactgaacaacggccatattgct

SEQ ID NO: 140847 - DNA, 75 bp, Artificial Sequence
  Synthetic
ttaccaacttcggccaaggctgggggcccattacttacggggggtctcctgacagtgaacaacggccatattgct

SEQ ID NO: 140848 - DNA, 75 bp, Artificial Sequence
  Synthetic
ttacctacttcggccaaggctgggggcccattacttacggggggtctcctgacaatgaacaacggccatattgct

SEQ ID NO: 140849 - DNA, 75 bp, Artificial Sequence
  Synthetic
ttacctacttcggccaaggctgggggcccattacttacggggggtctcctgacattgaacaacggccatattgct

SEQ ID NO: 140850 - DNA, 75 bp, Artificial Sequence
  Synthetic
ttacctacttcggccaaggctgggggcccattacttacggggggtctcctgacactgaacaacggccatattgct

SEQ ID NO: 140851 - DNA, 75 bp, Artificial Sequence
  Synthetic
ttacctacttcggccaaggctgggggcccattacttacggggggtctcctgacagtgaacaacggccatattgct

SEQ ID NO: 140852 - DNA, 75 bp, Artificial Sequence
  Synthetic
ttacccacttcggccaaggctgggggcccattacttacggggggtctcctgacaatgaacaacggccatattgct

SEQ ID NO: 140853 - DNA, 75 bp, Artificial Sequence
  Synthetic
ttacccacttcggccaaggctgggggcccattacttacggggggtctcctgacattgaacaacggccatattgct

SEQ ID NO: 140854 - DNA, 75 bp, Artificial Sequence
  Synthetic
ttacccacttcggccaaggctgggggcccattacttacggggggtctcctgacactgaacaacggccatattgct

SEQ ID NO: 140855 - DNA, 75 bp, Artificial Sequence
  Synthetic
ttacccacttcggccaaggctgggggcccattacttacggggggtctcctgacagtgaacaacggccatattgct

SEQ ID NO: 140856 - DNA, 75 bp, Artificial Sequence
  Synthetic
ttaccgacttcggccaaggctgggggcccattacttacggggggtctcctgacaatgaacaacggccatattgct

SEQ ID NO: 140857 - DNA, 75 bp, Artificial Sequence
  Synthetic
ttaccgacttcggccaaggctgggggcccattacttacggggggtctcctgacattgaacaacggccatattgct

SEQ ID NO: 140858 - DNA, 75 bp, Artificial Sequence
  Synthetic
ttaccgacttcggccaaggctgggggcccattacttacggggggtctcctgacactgaacaacggccatattgct

SEQ ID NO: 140859 - DNA, 75 bp, Artificial Sequence
  Synthetic
ttaccgacttcggccaaggctgggggcccattacttacggggggtctcctgacagtgaacaacggccatattgct

SEQ ID NO: 140860 - DNA, 75 bp, Artificial Sequence
  Synthetic
agaggtttccaccagcactgccagtctgggcttcacctagttacaacccaccactcgtggagtcctggaaaaaac

SEQ ID NO: 140861 - DNA, 75 bp, Artificial Sequence
  Synthetic
tgccattgcatcgctcatgtcattcaccgccgcagtcactagccccctgaccacccagcaaaccctcctctttaa

SEQ ID NO: 140862 - DNA, 75 bp, Artificial Sequence
  Synthetic
tgctggtcatgatgtgccctctctacctcctccagttgtgtttggtgaggactccatactttgtgagggcccagg

SEQ ID NO: 140863 - DNA, 75 bp, Artificial Sequence
  Synthetic
taggaccggcgttccaacctactcatggggcgagaatgagacagatgtactactcctcaacaactctaggccgcc

SEQ ID NO: 140864 - DNA, 75 bp, Artificial Sequence
  Synthetic
taggaccggcgttcctacctactcatggggcgagaatgagacagatgtactactcctcaacaactctaggccgcc

SEQ ID NO: 140865 - DNA, 75 bp, Artificial Sequence
  Synthetic
taggaccggcgttcccacctactcatggggcgagaatgagacagatgtactactcctcaacaactctaggccgcc

SEQ ID NO: 140866 - DNA, 75 bp, Artificial Sequence
  Synthetic
taggaccggcgttccgacctactcatggggcgagaatgagacagatgtactactcctcaacaactctaggccgcc

SEQ ID NO: 140867 - DNA, 75 bp, Artificial Sequence
  Synthetic
atccaacgtgggggaagctcttaaggccctggctactaagagctttggtccaccaccccccagtggtgattcggg

SEQ ID NO: 140868 - DNA, 75 bp, Artificial Sequence
  Synthetic
atccaacgtgggggaagctcttaaggccctggctactaagagctttggtccacctccccccagtggtgattcggg

SEQ ID NO: 140869 - DNA, 75 bp, Artificial Sequence
  Synthetic
atccaacgtgggggaagctcttaaggccctggctactaagagctttggtccacccccccccagtggtgattcggg

SEQ ID NO: 140870 - DNA, 75 bp, Artificial Sequence
  Synthetic
atccaacgtgggggaagctcttaaggccctggctactaagagctttggtccaccgccccccagtggtgattcggg

SEQ ID NO: 140871 - DNA, 75 bp, Artificial Sequence
  Synthetic
accttttggagacaagtgtaacaccaatagacccttccctcttgggtaagaacgaagttttttgcgttcaacctg

SEQ ID NO: 140872 - DNA, 75 bp, Artificial Sequence
  Synthetic
gccctgaactgtaatgacagcctcaacaccggctggctagcggggctcttctactaccacaaattcaactcttca

SEQ ID NO: 140873 - DNA, 75 bp, Artificial Sequence
  Synthetic
taaccatctcgcccccctggaaacatgggccgccggcggcctacgggatttggccgttgcagtcgagcccgtgat

SEQ ID NO: 140874 - DNA, 75 bp, Artificial Sequence
  Synthetic
tggatgaattccaccggcttcaccaagacgtgcggggctcctgcctgtaacatcggcgggaatgggaacaagacc

SEQ ID NO: 140875 - DNA, 75 bp, Artificial Sequence
  Synthetic
atgccccccctcgagggggagccgggggacccagacctggagtccggagcagtagagcgcccaccctcccctgag

SEQ ID NO: 140876 - DNA, 75 bp, Artificial Sequence
  Synthetic
gcctgtctcagctcggctcggcagggaagtcctgctagggcccgcggatgactacaggtccatgggatggcaact

SEQ ID NO: 140877 - DNA, 75 bp, Artificial Sequence
  Synthetic
catacaggctctggcactacccctgcacagtcaattacacccttttcaaggtcaggatgttcgtgggcggggttg

SEQ ID NO: 140878 - DNA, 75 bp, Artificial Sequence
  Synthetic
tacggcgacacgtggggcccggcgagggggccgtgcagtggatgaaccgtctcattgctttcgcatcgcgaggca

SEQ ID NO: 140879 - DNA, 75 bp, Artificial Sequence
  Synthetic
gtcaggatgttcgtgggcggggttgagcacaggctcaccgccgcgtgcaactggacgcggggagagcgttgcgat

SEQ ID NO: 140880 - DNA, 75 bp, Artificial Sequence
  Synthetic
gagcactaatcactccttgtggtcctgaggaggaaaagttgcctataaacccgttgagcaactcactgttgcgat

SEQ ID NO: 140881 - DNA, 75 bp, Artificial Sequence
  Synthetic
gtgcaggtgttgtccacctcaacgcagaccttcctggggaccaatgtgggcggtgtcatgtggggaccttatcac

SEQ ID NO: 140882 - DNA, 75 bp, Artificial Sequence
  Synthetic
attttcagggccgcggtgtgcacccgtggggtcgcaaaggcggtcgactttgtgcccgttgagtccttagagacc

SEQ ID NO: 140883 - DNA, 75 bp, Artificial Sequence
  Synthetic
ccataagtggatcaacgaggattgttccactccctgtgactcatcatggctgagggagatctgggattgggtttg

SEQ ID NO: 140884 - DNA, 75 bp, Artificial Sequence
  Synthetic
aactttaaaggacattaagttagcagcttccaaggttagtgttaggctcctctccatagaggaggcatgtgcact

SEQ ID NO: 140885 - DNA, 75 bp, Artificial Sequence
  Synthetic
ccaagtccctcgagccctgctcgtgcgggtcagcagacctttacttggtgacgcgcaatgctgacgtccttcctc

SEQ ID NO: 140886 - DNA, 75 bp, Artificial Sequence
  Synthetic
tggaggggggacggagtgatgcatacagtgtgcccatgtggcgcaagcatagccggccatataaagaatggctca

SEQ ID NO: 140887 - DNA, 75 bp, Artificial Sequence
  Synthetic
tgatgcttctcatatctcaggtagaggcggcgctagagaacttgatagtcctcaacgctgcttccctggctggga

SEQ ID NO: 140888 - DNA, 75 bp, Artificial Sequence
  Synthetic
agccggccatataaagaatggctcaatgagaatcgttgggcccaagacatgcagcaacacttggcacgggacctt

SEQ ID NO: 140889 - DNA, 75 bp, Artificial Sequence
  Synthetic
gacctcttggaagaccaagacacaccaattcctacaaccatcatggccaaaaatgaggtgttctgtgtggacccc

SEQ ID NO: 140890 - DNA, 75 bp, Artificial Sequence
  Synthetic
ttgcgttggcatcttcagagctgctgtctgcacccgcggtgtagccaaagcagttcagtttgttcccatcgagaa

SEQ ID NO: 140891 - DNA, 75 bp, Artificial Sequence
  Synthetic
ccccaacgggcgtacgccttggatcaggagttggccgcgtcgtgtgggaccgtggtcttcgtctgcctagcggta

SEQ ID NO: 140892 - DNA, 75 bp, Artificial Sequence
  Synthetic
agtggacgccacctcgattctgggcatagggaccgtcttggaccaagcggagacggcgggggtcaggctcactgt

SEQ ID NO: 140893 - DNA, 75 bp, Artificial Sequence
  Synthetic
cccaagcaataatgggagcttcgtatggattccagtactctccggcacaacgggtcgaatttctcttgcaggcat

SEQ ID NO: 140894 - DNA, 75 bp, Artificial Sequence
  Synthetic
atccagactaccaccaagcaagcagaggagcttaaaccggctgtccattccgcttggccgaagctcgagcagttt

SEQ ID NO: 140895 - DNA, 75 bp, Artificial Sequence
  Synthetic
cctcgccaccgctacaccacctggttccgtcaccgtgccacattccaacatcgaggaagttgcactgtccgctga

SEQ ID NO: 140896 - DNA, 75 bp, Artificial Sequence
  Synthetic
agcggcaagagcactaaggtccctgcggcgtatgccagccagggctacaaagtgctcgtgcttaatccatcagtc

SEQ ID NO: 140897 - DNA, 75 bp, Artificial Sequence
  Synthetic
ggaagggaaagaagagccccatgggcttttcatatgacacccggtgctttgactcgacagtcactgagagcgaca

SEQ ID NO: 140898 - DNA, 75 bp, Artificial Sequence
  Synthetic
cctcgctcaacgcccgaggagggcgtgatggagtcatactgcttatgtgtgtgctccacccgcacttgctctttg

SEQ ID NO: 140899 - DNA, 75 bp, Artificial Sequence
  Synthetic
gaagtgtccttcagcgtggggctaaacacatttgtggtggggtctcagctcccctgtgaaccggagcccgacgtg

SEQ ID NO: 140900 - DNA, 75 bp, Artificial Sequence
  Synthetic
cagcttcccttactagcccgctatccacctccacaaccctcctgctcaacatcttaggagggtgggttgcgtcac

SEQ ID NO: 140901 - DNA, 75 bp, Artificial Sequence
  Synthetic
cttactcaacctatgggaagttccttgccgacgggggttgttcaggtggtgcctatgatataatcatatgtgatg

SEQ ID NO: 140902 - DNA, 75 bp, Artificial Sequence
  Synthetic
gcttaacagcaaggggcagtcctgcggatacaggcgttgccgcgccagcggagtgctcaccactagcatggggaa

SEQ ID NO: 140903 - DNA, 75 bp, Artificial Sequence
  Synthetic
cggcaagccagctttctgctccatctctcaaggccacatgcaccgctcatcatgactcccctgacgctgatctca

SEQ ID NO: 140904 - DNA, 75 bp, Artificial Sequence
  Synthetic
tccatggtggggaactgggctaaggtcttgattgtgatgctactcttcgccggcgttgacggggacacccgcgtg

SEQ ID NO: 140905 - DNA, 75 bp, Artificial Sequence
  Synthetic
ccgacgccttgatgactggcttcaccggagatttcgactctgtgatagactgcaacacctgtgtcgtccagacag

SEQ ID NO: 140906 - DNA, 75 bp, Artificial Sequence
  Synthetic
cccccccggaagcgttacggtgccccaccccaacatcgaggaggtcgcccttggcaacgatggggaaattccctt

SEQ ID NO: 140907 - DNA, 75 bp, Artificial Sequence
  Synthetic
ggctgaaactgatgacaaggaggtctccgtggcggcggaaattctgcgcaagaccaggaagttcccgcgggccat

SEQ ID NO: 140908 - DNA, 75 bp, Artificial Sequence
  Synthetic
agcagaacctgagagccttcacggaggccatgaccaggtactctgcccctcccggcgatccccccaaacccgaat

SEQ ID NO: 140909 - DNA, 75 bp, Artificial Sequence
  Synthetic
gggcagacaccgcggcctgtggagacatcatcaacgggctgcctgtctctgcccggaggggaagagaggtgttgc

SEQ ID NO: 140910 - DNA, 75 bp, Artificial Sequence
  Synthetic
tcattggggctgactgccgttgcttactatagggggttggatgtttcggtgatcccaacgtctggcgatgtagtc

SEQ ID NO: 140911 - DNA, 75 bp, Artificial Sequence
  Synthetic
tgtccacgggtgcgctttgcccgctggcggtctgccccccgtccctcccccacggaggaagcgggcggtggtgct

SEQ ID NO: 140912 - DNA, 75 bp, Artificial Sequence
  Synthetic
aatcgccagggctgcctgggaaaccgcaagacactcccccgtcaattcatggctgggcaacatcatccagtacgc

SEQ ID NO: 140913 - DNA, 75 bp, Artificial Sequence
  Synthetic
accccaccttcactattgagaccaccacagtcccgcaagattctgtctcgcgctctcagagacgtgggaggacag

SEQ ID NO: 140914 - DNA, 75 bp, Artificial Sequence
  Synthetic
actgacacttctaaaccagactcctccgaggcggacgatcaatcagacgacgggtcatactcgtcgatgcctcca

SEQ ID NO: 140915 - DNA, 75 bp, Artificial Sequence
  Synthetic
tggactgtgtatcatggggccggatcaaggaccctcgcttcggcgtcgggccctgtgatccagatgtacaccaac

SEQ ID NO: 140916 - DNA, 75 bp, Artificial Sequence
  Synthetic
gcggtgtactcagttaaccccttggacctcccggccataattgaaagactccatgggcttcatgccttttcactg

SEQ ID NO: 140917 - DNA, 75 bp, Artificial Sequence
  Synthetic
cgggtcatactcgtcgatgcctccactcgaaggggagccaggtgatcctgacttgacctcagactcgtggtccac

SEQ ID NO: 140918 - DNA, 75 bp, Artificial Sequence
  Synthetic
gcttcagtatttcctgaccagagcagaagcgctactgcacgtgtgggttccccccctcaacgtccgaggggggcg

SEQ ID NO: 140919 - DNA, 75 bp, Artificial Sequence
  Synthetic
ctcgtggtatgaactaacgcccagtgaaaccaccacgcgcctcagagcctacctcaattgccctggtcttccagt

SEQ ID NO: 140920 - DNA, 75 bp, Artificial Sequence
  Synthetic
tggaagagtcgggcaagagcagtgagggcgtccctcatcacccggggggggaaggcggccatttgtggtcgctac

SEQ ID NO: 140921 - DNA, 75 bp, Artificial Sequence
  Synthetic
aaccccctgagcaactctctactgcgccaccacaacatggtgtacgcaacgacctcccgctcagcaactacccgt

SEQ ID NO: 140922 - DNA, 75 bp, Artificial Sequence
  Synthetic
attttcagggccgcagtatgcacccgcggggttgcaaaggcggtcgactttgtgcccgttgaatccttagaaacc

SEQ ID NO: 140923 - DNA, 75 bp, Artificial Sequence
  Synthetic
attttctgggccgcagtatgcacccgcggggttgcaaaggcggtcgactttgtgcccgttgaatccttagaaacc

SEQ ID NO: 140924 - DNA, 75 bp, Artificial Sequence
  Synthetic
attttccgggccgcagtatgcacccgcggggttgcaaaggcggtcgactttgtgcccgttgaatccttagaaacc

SEQ ID NO: 140925 - DNA, 75 bp, Artificial Sequence
  Synthetic
attttcggggccgcagtatgcacccgcggggttgcaaaggcggtcgactttgtgcccgttgaatccttagaaacc

SEQ ID NO: 140926 - DNA, 75 bp, Artificial Sequence
  Synthetic
gcgtacctgactgcataccaagctacagtgtgcgcccgggcgaaagcccccccgccctcctgggacgtccagtgg

SEQ ID NO: 140927 - DNA, 75 bp, Artificial Sequence
  Synthetic
acccaagggtcctgttatccagatgtataccaatgtagaccaagacctcgtaggctggcccgctcctcaaggtgc

SEQ ID NO: 140928 - DNA, 75 bp, Artificial Sequence
  Synthetic
gagtttgatgagatggaggagtgcgccgcccacgtcccctacctcgagcaggggatgcatttggcggagcagttc

SEQ ID NO: 140929 - DNA, 75 bp, Artificial Sequence
  Synthetic
cagaagaaggtcacctttgaccgtctccaggtggttgacgcccactaccacgaagtcttaaaggagattaaggcg

SEQ ID NO: 140930 - DNA, 75 bp, Artificial Sequence
  Synthetic
cccgccctcctgggacgtccagtggaagtgtctccaaagactaaagccactgttagtagggcccacgcccttgct

SEQ ID NO: 140931 - DNA, 75 bp, Artificial Sequence
  Synthetic
catgcacccaccggaagtggtaagagcacgaaggtgccggccgcctatgcagctcaggggtacaaggtacttgtg

SEQ ID NO: 140932 - DNA, 75 bp, Artificial Sequence
  Synthetic
gcacgaaggtgccggccgcctatgcagctcaggggtacaaggtacttgtgctgaacccgtctgttgctgccacct

SEQ ID NO: 140933 - DNA, 75 bp, Artificial Sequence
  Synthetic
acctgggtgatcgtaggtggcgtcctcgccgccgtggccgcatattgcatgtctactggcagtgttgttgtggtt

SEQ ID NO: 140934 - DNA, 75 bp, Artificial Sequence
  Synthetic
gggcgtgcgagtctgcgagaaaaaggcactctacaacgtcatccaggagttgcctaaggccataatgggggaagc

SEQ ID NO: 140935 - DNA, 75 bp, Artificial Sequence
  Synthetic
tgccgccccagccgccgccacagccttcgttggcgcaggcattactggcgccgttgttggcagtgtgggcctagg

SEQ ID NO: 140936 - DNA, 75 bp, Artificial Sequence
  Synthetic
tgctgaaacacgcccaaaccatcggcggaatgttcaaggacaaggccctcgccgtcttggatacgctcaagccgg

SEQ ID NO: 140937 - DNA, 75 bp, Artificial Sequence
  Synthetic
tttgactccacggtgactgaaagggacatcaggaccgaggaagagatctaccaatgctgcgacctggagcccgaa

SEQ ID NO: 140938 - DNA, 75 bp, Artificial Sequence
  Synthetic
gccatccccctaagttatatcaggggggggaggcatctcattttctgccattccaagaagaagtgcgacgagctc

SEQ ID NO: 140939 - DNA, 75 bp, Artificial Sequence
  Synthetic
agctgggctatccacactgccaggtaatccaactgtggcctcactgatggccttcaccgcctcagttactagccc

SEQ ID NO: 140940 - DNA, 75 bp, Artificial Sequence
  Synthetic
gcggggtctacaccaccagcttcgggaacactgtaacgtgttacctcaaggccgttgcggctaccagggccgcag

SEQ ID NO: 140941 - DNA, 75 bp, Artificial Sequence
  Synthetic
ctcgcaggggcggcagtgggtagtgttggcttgggcaaggtcttagttgatgtcctggccggctatggcgccggc

SEQ ID NO: 140942 - DNA, 75 bp, Artificial Sequence
  Synthetic
ggaggctatgacgaggtactcagctccccccggagacgccccgcagccagcgtacgatctcgagctaataacatc

SEQ ID NO: 140943 - DNA, 75 bp, Artificial Sequence
  Synthetic
tacggcaaggctatccccctcgaggtgatcaaggggggaagacacctcatcttctgccactcaaagaagaagtgc

SEQ ID NO: 140944 - DNA, 75 bp, Artificial Sequence
  Synthetic
gaaagagggtctattaccttacccgtgaccctacaactcccctcgcgagagctgcgtgggagacagcaagacaca

SEQ ID NO: 140945 - DNA, 75 bp, Artificial Sequence
  Synthetic
tagttgtgggagttgtttgtgccgcgatcatcaaacggcataccggcactagtgagggagtcacgcagtggatga

SEQ ID NO: 140946 - DNA, 75 bp, Artificial Sequence
  Synthetic
gggcgagggcatcgtgcacactcgttgcccgtgtggggccaatataactggacatgtcaagaacggttcgatgag

SEQ ID NO: 140947 - DNA, 75 bp, Artificial Sequence
  Synthetic
acccctggcacgagccgcctgggaaacagctcgacacactccagttaattcctggttgggcaacatcattcttta

SEQ ID NO: 140948 - DNA, 75 bp, Artificial Sequence
  Synthetic
ctacccggtggggtcgcaattgccctgcgagcccgaaccggacgtggccgtgttgacgtccatgctcactgatcc

SEQ ID NO: 140949 - DNA, 75 bp, Artificial Sequence
  Synthetic
tgcgagcccgaaccggacgtggccgtgttgacgtccatgctcactgatccctcccacataacagcagaggcggcc

SEQ ID NO: 140950 - DNA, 75 bp, Artificial Sequence
  Synthetic
tacatacaggatgatgatgcgtcaaaacgcgtcatggggatactcagctcccttaccatcaccagcctcataaaa

SEQ ID NO: 140951 - DNA, 75 bp, Artificial Sequence
  Synthetic
actcccctgacgccgagctcatagaggccaacctcctgtggaggcaggagatgggcggcaacatcaccagggttg

SEQ ID NO: 140952 - DNA, 75 bp, Artificial Sequence
  Synthetic
tcccacatcactgcaaagacggcggcgcgtaggctgaagcgggggtctcccccctccctggccagttcttctgcc

SEQ ID NO: 140953 - DNA, 75 bp, Artificial Sequence
  Synthetic
cgggatacaatacctggcgggcctgtcaacgctgcccggcaaccccgctatagcgtcgctgatgtcgtttacggc

SEQ ID NO: 140954 - DNA, 75 bp, Artificial Sequence
  Synthetic
aagcagtttccccccgccatgcccatatgggcacggccggattataatcctccccttgtggaaccgtggaagcgc

SEQ ID NO: 140955 - DNA, 75 bp, Artificial Sequence
  Synthetic
ccacaatctggtgtattccaccacctcacgcagcgcttgccaaaggcagaagaaagtcacatttgacagactgca

SEQ ID NO: 140956 - DNA, 75 bp, Artificial Sequence
  Synthetic
tcccgaggacgcagcccacctgcgagctttcacggaagccatgaccaggtattctgctcctccgggggacgaacc

SEQ ID NO: 140957 - DNA, 75 bp, Artificial Sequence
  Synthetic
gcggcaagagcaccaaggtcccggctgcgtacgcggctcagggctacaaggtgctagtgctcaacccttctgttg

SEQ ID NO: 140958 - DNA, 75 bp, Artificial Sequence
  Synthetic
cgcggggacccacgtcaccgggggaagcgtcgccagaaccacagcgtcactcgccggtctcttcagtccaggtcc

SEQ ID NO: 140959 - DNA, 75 bp, Artificial Sequence
  Synthetic
agtgaattcctggttggggaacattatcatgtatgctcctacaatctgggtgcgcatggtcttgtgcactcaatt

SEQ ID NO: 140960 - DNA, 75 bp, Artificial Sequence
  Synthetic
agtgaattcctggttggggaacattatcatgtatgctcctacaatctgggtgcgcatggtcttgtgcactcattt

SEQ ID NO: 140961 - DNA, 75 bp, Artificial Sequence
  Synthetic
agtgaattcctggttggggaacattatcatgtatgctcctacaatctgggtgcgcatggtcttgtgcactcactt

SEQ ID NO: 140962 - DNA, 75 bp, Artificial Sequence
  Synthetic
agtgaattcctggttggggaacattatcatgtatgctcctacaatctgggtgcgcatggtcttgtgcactcagtt

SEQ ID NO: 140963 - DNA, 75 bp, Artificial Sequence
  Synthetic
cttgtctgatggctcttggtcaacagtcagcaccagatctgacgtgatttgctgttccatgtcctactcatggac

SEQ ID NO: 140964 - DNA, 75 bp, Artificial Sequence
  Synthetic
cacgccctccccggcgccgaactacacgttcgcgctatggagggtgtccgcagaggagtacgtagaggtaaggcg

SEQ ID NO: 140965 - DNA, 75 bp, Artificial Sequence
  Synthetic
acatcacgctcagcttcacaaagagcaaaaaaagtgacttttgacagattgcaagtcctagacgaccactacaaa

SEQ ID NO: 140966 - DNA, 75 bp, Artificial Sequence
  Synthetic
tttcctatgacacccgttgctttgactcaacagtcactgaggctgatatccgtacggaggaagacctctatcaat

SEQ ID NO: 140967 - DNA, 75 bp, Artificial Sequence
  Synthetic
tgccatggtggggaactgggctaaggtattgattgtgatgctactctttgccggcgttgatggacaaacctatgt

SEQ ID NO: 140968 - DNA, 75 bp, Artificial Sequence
  Synthetic
cgccttgtgcctgcgtgtacctacatggcactgggaatgtggccgttgctcctgacaatcttggccctgcctcgc

SEQ ID NO: 140969 - DNA, 75 bp, Artificial Sequence
  Synthetic
cggctacacaggtacgcccccccctgcaaacctttgctacgggatgaggtgacgtttagcgtcgggtgcaatgac

SEQ ID NO: 140970 - DNA, 75 bp, Artificial Sequence
  Synthetic
ccaattctaagggacaaaactgcggctatcggcgatgccgcgcaagcggcgtgctgaccactagctgcggtaaca

SEQ ID NO: 140971 - DNA, 75 bp, Artificial Sequence
  Synthetic
ctaagtttgggtacggggcaaaggaagtcagatctcttgcgcccaaggcaatgtctcacatcaaagaggtctgga

SEQ ID NO: 140972 - DNA, 75 bp, Artificial Sequence
  Synthetic
gcgaacccgagccagacgtagcagttctgacatctatgcttacagacccctcccacatcactgctgagacggcgg

SEQ ID NO: 140973 - DNA, 75 bp, Artificial Sequence
  Synthetic
ccttgccgcgctgttctacacacacaggttcaacgcgtctggatgtccagagcgcatggccagctgccgccccat

SEQ ID NO: 140974 - DNA, 75 bp, Artificial Sequence
  Synthetic
tagactgattgtttaccctgacctaggtgtgagggtatgcgagaagcgggctttgtacgacatagctcaaaagct

SEQ ID NO: 140975 - DNA, 75 bp, Artificial Sequence
  Synthetic
gacatgtcaagaacgggacgatgaggatcgtcggtcctaagacctgcaggaacatgtggagtggaaccttcccca

SEQ ID NO: 140976 - DNA, 75 bp, Artificial Sequence
  Synthetic
ctctccagacgctgacctcatagaagccaacctcctgtggaggcaggagatgggggggaacatcaccagggtgga

SEQ ID NO: 140977 - DNA, 75 bp, Artificial Sequence
  Synthetic
ggttatccctggcccctttacggtaacgagggctgcgggtgggcagggtggctcctgtccccccgcggctctcgt

SEQ ID NO: 140978 - DNA, 75 bp, Artificial Sequence
  Synthetic
ggcttctcatatgacacccgctgctttgattccactgtcacagaacaagacatccgcactgagagcgagatctat

SEQ ID NO: 140979 - DNA, 75 bp, Artificial Sequence
  Synthetic
ggcggaggtcccgcaacttgggtaaggtcatcgataccctgacttgcggtttcgccgatctcatggggtacattc

SEQ ID NO: 140980 - DNA, 75 bp, Artificial Sequence
  Synthetic
tcggttatcgaaggtgcagagccagcggagttttccccaccagcatgggaaacactatgacgtgctacatcaaag

SEQ ID NO: 140981 - DNA, 75 bp, Artificial Sequence
  Synthetic
atacgcgctggacacggagatggccgcgtcgtgtggcggcgttgttcttgtcgggttgatggcgctgactctgtc

SEQ ID NO: 140982 - DNA, 75 bp, Artificial Sequence
  Synthetic
ttgctccttttctatctttctgttggcacttctctcgtgcctcaccacacccgcctcagcaatgcattataggaa

SEQ ID NO: 140983 - DNA, 75 bp, Artificial Sequence
  Synthetic
tagggcggacctgcaagcctttgcagcggcaatgaccaggtactccgctccacccggggacatgccccagcccgc

SEQ ID NO: 140984 - DNA, 75 bp, Artificial Sequence
  Synthetic
gtcaacaatgggaacaagtcgcaatgctgggtgccagtagctcccaccctcgctgtcgcaaatacttccatctcg

SEQ ID NO: 140985 - DNA, 75 bp, Artificial Sequence
  Synthetic
gtcaacaatgggatcaagtcgcaatgctgggtgccagtagctcccaccctcgctgtcgcaaatacttccatctcg

SEQ ID NO: 140986 - DNA, 75 bp, Artificial Sequence
  Synthetic
gtcaacaatgggaccaagtcgcaatgctgggtgccagtagctcccaccctcgctgtcgcaaatacttccatctcg

SEQ ID NO: 140987 - DNA, 75 bp, Artificial Sequence
  Synthetic
gtcaacaatgggagcaagtcgcaatgctgggtgccagtagctcccaccctcgctgtcgcaaatacttccatctcg

SEQ ID NO: 140988 - DNA, 75 bp, Artificial Sequence
  Synthetic
ccactatccagggcagcttgggagaccgcccgtcactcacctgtaaactcctgggtgggcaacataatcatgttt

SEQ ID NO: 140989 - DNA, 75 bp, Artificial Sequence
  Synthetic
ggcagatgttcaccctacggccccgattacacaccattgtccaagagtgcaattgttccatctacaccgggcgca

SEQ ID NO: 140990 - DNA, 75 bp, Artificial Sequence
  Synthetic
ggcagatgttcacccttcggccccgattacacaccattgtccaagagtgcaattgttccatctacaccgggcgca

SEQ ID NO: 140991 - DNA, 75 bp, Artificial Sequence
  Synthetic
ggcagatgttcaccctccggccccgattacacaccattgtccaagagtgcaattgttccatctacaccgggcgca

SEQ ID NO: 140992 - DNA, 75 bp, Artificial Sequence
  Synthetic
ggcagatgttcaccctgcggccccgattacacaccattgtccaagagtgcaattgttccatctacaccgggcgca

SEQ ID NO: 140993 - DNA, 75 bp, Artificial Sequence
  Synthetic
ccaaccgatagacggttgggcaaccactccaggcctttaggccctatttaaacactccaggcctttaggccccgt

SEQ ID NO: 140994 - DNA, 75 bp, Artificial Sequence
  Synthetic
gtgcaacctacacggtctgcccaacagacttaccagacattatacaaagactccatgggctccgcgcatttgaac

SEQ ID NO: 140995 - DNA, 75 bp, Artificial Sequence
  Synthetic
gatatttcttgaggggcattggggcgtcatcggtgcattgctgtattacagcatggttgcgaactgggccaaggt

SEQ ID NO: 140996 - DNA, 75 bp, Artificial Sequence
  Synthetic
gactccgacgctgagtcctgttcttccatgccccccctggagggggagcctggggatccggatcttagcgacggg

SEQ ID NO: 140997 - DNA, 75 bp, Artificial Sequence
  Synthetic
ccgcgcggggctgataggccaggggggcagggctcgcatatgcggtctctacctcttcaactgggctgtcaggac

SEQ ID NO: 140998 - DNA, 75 bp, Artificial Sequence
  Synthetic
ggaccttctcaacaactccagctcatcaataccaacggtagctggcacataaacaggacggcactcaattgcaat

SEQ ID NO: 140999 - DNA, 75 bp, Artificial Sequence
  Synthetic
ggaccttctcaacaactccagctcatcaataccaacggtagctggcacattaacaggacggcactcaattgcaat

SEQ ID NO: 141000 - DNA, 75 bp, Artificial Sequence
  Synthetic
ggaccttctcaacaactccagctcatcaataccaacggtagctggcacatcaacaggacggcactcaattgcaat

SEQ ID NO: 141001 - DNA, 75 bp, Artificial Sequence
  Synthetic
ggaccttctcaacaactccagctcatcaataccaacggtagctggcacatgaacaggacggcactcaattgcaat

SEQ ID NO: 141002 - DNA, 75 bp, Artificial Sequence
  Synthetic
tgaccttgtcaccgcactacaaagtgttcctcgctaggctcatatggtggttacaatattttatcaccagagccg

SEQ ID NO: 141003 - DNA, 75 bp, Artificial Sequence
  Synthetic
gttcctcgctaggctcatatggtggttacaatattttatcaccagagccgaggcgcacttgcaagtgtgggtccc

SEQ ID NO: 141004 - DNA, 75 bp, Artificial Sequence
  Synthetic
agagcccatcctcgcccattactcctgtgcctactcctacttgccgtaggggtaggcattttcctcctacccgct

SEQ ID NO: 141005 - DNA, 75 bp, Artificial Sequence
  Synthetic
tgtgcctactcctacttgccgtaggggtaggcattttcctcctacccgctcggtaagcgggtaacactccaggct

SEQ ID NO: 141006 - DNA, 75 bp, Artificial Sequence
  Synthetic
cgtttgaccagggttgggggcccttgtcatatgccaccataaatggctcatccaatgacaaaccttattgctggc

SEQ ID NO: 141007 - DNA, 75 bp, Artificial Sequence
  Synthetic
ctaacgactgctctaatgacagcatcacctggcagctccaggccgcggtcctccacgtccccgggtgcgtcccgt

SEQ ID NO: 141008 - DNA, 75 bp, Artificial Sequence
  Synthetic
gtgctggataccggtttcaccaaacgtagctgtgcagcggcccggcgccctcacgcagggcttgcggacgcacat

SEQ ID NO: 141009 - DNA, 75 bp, Artificial Sequence
  Synthetic
gagaggcgccccaacatacacctgggggacaaacgagaccgatgtgttcctgttgcagagcactaggcccccacg

SEQ ID NO: 141010 - DNA, 75 bp, Artificial Sequence
  Synthetic
ggcttggcctatttctccatgcagggagcgtgggccaaagtcatcgccatcctcctccttgtcgcaggagtggac

SEQ ID NO: 141011 - DNA, 75 bp, Artificial Sequence
  Synthetic
ctcagggatggggtcccatcacttatgctgagcctgacagcccggaccagaggccttattgctggcactacgcac

SEQ ID NO: 141012 - DNA, 75 bp, Artificial Sequence
  Synthetic
ttggtatgtcccactgattgcttccgaaaacatccagaggcaacttatggaaagtgcggatcgggaccgtagctc

SEQ ID NO: 141013 - DNA, 75 bp, Artificial Sequence
  Synthetic
ttggtatgtcccactgattgcttccgaaaacatccagaggcaacttatggaaagtgcggatcgggaccgttgctc

SEQ ID NO: 141014 - DNA, 75 bp, Artificial Sequence
  Synthetic
ttggtatgtcccactgattgcttccgaaaacatccagaggcaacttatggaaagtgcggatcgggaccgtcgctc

SEQ ID NO: 141015 - DNA, 75 bp, Artificial Sequence
  Synthetic
ttggtatgtcccactgattgcttccgaaaacatccagaggcaacttatggaaagtgcggatcgggaccgtggctc

SEQ ID NO: 141016 - DNA, 75 bp, Artificial Sequence
  Synthetic
gcaattgttccatctaccctggcaccatcactggacatcgtatggcatgggatatgatgatgaactggtcgccca

SEQ ID NO: 141017 - DNA, 75 bp, Artificial Sequence
  Synthetic
gacatcattagcggggctcactggggcgtcatgttcggcttagcctacttctctatgcagggagcgtgggcgaaa

SEQ ID NO: 141018 - DNA, 75 bp, Artificial Sequence
  Synthetic
gcgtcatgttcggcttagcctacttctctatgcagggagcgtgggcgaaagtcgttgtcatccttctgctggccg

SEQ ID NO: 141019 - DNA, 75 bp, Artificial Sequence
  Synthetic
agcatcgattcgaagctgcctgcaattggactcgtggagaccggtgcgagttagatgatagagatagggttgaga

SEQ ID NO: 141020 - DNA, 75 bp, Artificial Sequence
  Synthetic
agcatcgattcgaagctgcctgcaattggactcgtggtgaccggtgcgagttagatgatagagatagggttgaga

SEQ ID NO: 141021 - DNA, 75 bp, Artificial Sequence
  Synthetic
agcatcgattcgaagctgcctgcaattggactcgtggcgaccggtgcgagttagatgatagagatagggttgaga

SEQ ID NO: 141022 - DNA, 75 bp, Artificial Sequence
  Synthetic
agcatcgattcgaagctgcctgcaattggactcgtggggaccggtgcgagttagatgatagagatagggttgaga

SEQ ID NO: 141023 - DNA, 75 bp, Artificial Sequence
  Synthetic
agcatcgtttcgaagctgcctgcaattggactcgtggagaccggtgcgagttagatgatagagatagggttgaga

SEQ ID NO: 141024 - DNA, 75 bp, Artificial Sequence
  Synthetic
agcatcgtttcgaagctgcctgcaattggactcgtggtgaccggtgcgagttagatgatagagatagggttgaga

SEQ ID NO: 141025 - DNA, 75 bp, Artificial Sequence
  Synthetic
agcatcgtttcgaagctgcctgcaattggactcgtggcgaccggtgcgagttagatgatagagatagggttgaga

SEQ ID NO: 141026 - DNA, 75 bp, Artificial Sequence
  Synthetic
agcatcgtttcgaagctgcctgcaattggactcgtggggaccggtgcgagttagatgatagagatagggttgaga

SEQ ID NO: 141027 - DNA, 75 bp, Artificial Sequence
  Synthetic
agcatcgcttcgaagctgcctgcaattggactcgtggagaccggtgcgagttagatgatagagatagggttgaga

SEQ ID NO: 141028 - DNA, 75 bp, Artificial Sequence
  Synthetic
agcatcgcttcgaagctgcctgcaattggactcgtggtgaccggtgcgagttagatgatagagatagggttgaga

SEQ ID NO: 141029 - DNA, 75 bp, Artificial Sequence
  Synthetic
agcatcgcttcgaagctgcctgcaattggactcgtggcgaccggtgcgagttagatgatagagatagggttgaga

SEQ ID NO: 141030 - DNA, 75 bp, Artificial Sequence
  Synthetic
agcatcgcttcgaagctgcctgcaattggactcgtggggaccggtgcgagttagatgatagagatagggttgaga

SEQ ID NO: 141031 - DNA, 75 bp, Artificial Sequence
  Synthetic
agcatcggttcgaagctgcctgcaattggactcgtggagaccggtgcgagttagatgatagagatagggttgaga

SEQ ID NO: 141032 - DNA, 75 bp, Artificial Sequence
  Synthetic
agcatcggttcgaagctgcctgcaattggactcgtggtgaccggtgcgagttagatgatagagatagggttgaga

SEQ ID NO: 141033 - DNA, 75 bp, Artificial Sequence
  Synthetic
agcatcggttcgaagctgcctgcaattggactcgtggcgaccggtgcgagttagatgatagagatagggttgaga

SEQ ID NO: 141034 - DNA, 75 bp, Artificial Sequence
  Synthetic
agcatcggttcgaagctgcctgcaattggactcgtggggaccggtgcgagttagatgatagagatagggttgaga

SEQ ID NO: 141035 - DNA, 75 bp, Artificial Sequence
  Synthetic
ctctatgcagggagcgtgggcgaaagtcgttgtcatccttctgctggccgctggggtggacgcgagcactcaaac

SEQ ID NO: 141036 - DNA, 75 bp, Artificial Sequence
  Synthetic
agagtggcggaatacgtctggcctctacgtccttaccaacgactgtcccaatagcagtattgtgtatgaggccga

SEQ ID NO: 141037 - DNA, 75 bp, Artificial Sequence
  Synthetic
cgtagtagacgtgcaatacctctatggtatctcctcgaccattgtgtcgtgggctatcaagtgggagtacgttgt

SEQ ID NO: 141038 - DNA, 75 bp, Artificial Sequence
  Synthetic
cgttgtagacgtgcaatacctctatggtatctcctcgaccattgtgtcgtgggctatcaagtgggagtacgttgt

SEQ ID NO: 141039 - DNA, 75 bp, Artificial Sequence
  Synthetic
cgtcgtagacgtgcaatacctctatggtatctcctcgaccattgtgtcgtgggctatcaagtgggagtacgttgt

SEQ ID NO: 141040 - DNA, 75 bp, Artificial Sequence
  Synthetic
cgtggtagacgtgcaatacctctatggtatctcctcgaccattgtgtcgtgggctatcaagtgggagtacgttgt

SEQ ID NO: 141041 - DNA, 75 bp, Artificial Sequence
  Synthetic
cacatcaaccgcactgccctaaactgcaatgactctttgaacaccggctttatcacgtccctattctacacccat

SEQ ID NO: 141042 - DNA, 75 bp, Artificial Sequence
  Synthetic
atagcccaggagcaccttgaaaaggctctagattgcgaaatctatggagccgtacactccgtccaaccgttggac

SEQ ID NO: 141043 - DNA, 75 bp, Artificial Sequence
  Synthetic
cgcggccacgatgtgctctgcgctctacgtgggtgatatgtgtggggccgtcttcctcgtgggacaagccttcac

SEQ ID NO: 141044 - DNA, 75 bp, Artificial Sequence
  Synthetic
ctcaatgctacttctgctgccagcagccagggatggatttgtggaatagttttcatctgtgctgcctggtatgtt

SEQ ID NO: 141045 - DNA, 75 bp, Artificial Sequence
  Synthetic
ctacctcctccccaaccgataaaggttggggtaaacactccggcctcttaggcctttttcgtgattttttttttc

SEQ ID NO: 141046 - DNA, 75 bp, Artificial Sequence
  Synthetic
cactgtgaacttcaccatcttcaaggtgcggatgtatataggaggggtggagcatcgattgaacgcagcgtgcaa

SEQ ID NO: 141047 - DNA, 75 bp, Artificial Sequence
  Synthetic
accgacagacgtggagtgcctacttacacgtggggagagaatgagacggatgtcttcctgttgaacagcacccga

SEQ ID NO: 141048 - DNA, 75 bp, Artificial Sequence
  Synthetic
gacaggaggctgcatctctaggtctgctaacaattgttgtcatcaccatatttaccctcactccggcatacaagt

SEQ ID NO: 141049 - DNA, 75 bp, Artificial Sequence
  Synthetic
cgacgcactcatattgcttacttgtttgttgcacccacagctggggtttgaggtcactaagattatattggcctt

SEQ ID NO: 141050 - DNA, 75 bp, Artificial Sequence
  Synthetic
ctaggcgggaagtacgcccaagctgctcttttgcggctaggcgcatggactggcacatacatctataaccatcta

SEQ ID NO: 141051 - DNA, 75 bp, Artificial Sequence
  Synthetic
cagaagtcaattgtctcccttgttgcactccaccacggagtgggccattttaccttgctcctactcagacttgcc

SEQ ID NO: 141052 - DNA, 75 bp, Artificial Sequence
  Synthetic
ccatccccatcgaggccatcaagggggggaggcacctcattttctgccactccaagaagaaatgtgacgagctcg

SEQ ID NO: 141053 - DNA, 75 bp, Artificial Sequence
  Synthetic
gcgcagatacagttgcctgcggcgacataatttctgggctgccagtgtcagctaggaggggaaacctcatattcc

SEQ ID NO: 141054 - DNA, 75 bp, Artificial Sequence
  Synthetic
gcgcagatacagttgcctgcggcgacataatttctgggctgccagtgtcagctaggaggggaaacctcattttcc

SEQ ID NO: 141055 - DNA, 75 bp, Artificial Sequence
  Synthetic
gcgcagatacagttgcctgcggcgacataatttctgggctgccagtgtcagctaggaggggaaacctcatcttcc

SEQ ID NO: 141056 - DNA, 75 bp, Artificial Sequence
  Synthetic
gcgcagatacagttgcctgcggcgacataatttctgggctgccagtgtcagctaggaggggaaacctcatgttcc

SEQ ID NO: 141057 - DNA, 75 bp, Artificial Sequence
  Synthetic
gagtgggtagtgctcttattcctgctcttagcggacgccagggtttgcgcctgcttatggatgctcatcttactg

SEQ ID NO: 141058 - DNA, 75 bp, Artificial Sequence
  Synthetic
cagcctcactggccgtgataagaatgaggtggagggtgagatccaggttgtctctactgctacccagtcctttct

SEQ ID NO: 141059 - DNA, 75 bp, Artificial Sequence
  Synthetic
agccggtgtggcgcggggccttggttaacacctcgatgcttggtcgactatccgtaccggctttggcattaccct

SEQ ID NO: 141060 - DNA, 75 bp, Artificial Sequence
  Synthetic
gtcgaccaggacctggtaggctggcccgcaccacctggggcccgttcacttaccccatgcacctgtggctcgtgt

SEQ ID NO: 141061 - DNA, 75 bp, Artificial Sequence
  Synthetic
tgattaccctctttacactcaccccggggtataagaccctccttagccggtgtctgtggtggttgtgttacctcc

SEQ ID NO: 141062 - DNA, 75 bp, Artificial Sequence
  Synthetic
atatcgaggatcgtgaccgcagcgagcaacatccgctgctgcattcaacaactgagcttgctatactgccttgct

SEQ ID NO: 141063 - DNA, 75 bp, Artificial Sequence
  Synthetic
agggatcgtccggtggtcctgtgctatgcccctcaggccacgtcgtagggattttccgtgcggccgtgtgcacta

SEQ ID NO: 141064 - DNA, 75 bp, Artificial Sequence
  Synthetic
ttctccatggtggggaactgggtgaaggtcatagcggtgctgttgctgtttgccggcgtcgatgcgcagacccag

SEQ ID NO: 141065 - DNA, 75 bp, Artificial Sequence
  Synthetic
atctcctaagagatgctttgacacgcgtgccgtatttcgtcagagctcacgctctgctgaggatgtgcactatgg

SEQ ID NO: 141066 - DNA, 75 bp, Artificial Sequence
  Synthetic
acaaacataccaagtaggataccttcatgctcccacgggtagcgggaagagcaccaaagttcctgcagcatatgc

SEQ ID NO: 141067 - DNA, 75 bp, Artificial Sequence
  Synthetic
acaaacttaccaagtaggataccttcatgctcccacgggtagcgggaagagcaccaaagttcctgcagcatatgc

SEQ ID NO: 141068 - DNA, 75 bp, Artificial Sequence
  Synthetic
acaaacctaccaagtaggataccttcatgctcccacgggtagcgggaagagcaccaaagttcctgcagcatatgc

SEQ ID NO: 141069 - DNA, 75 bp, Artificial Sequence
  Synthetic
acaaacgtaccaagtaggataccttcatgctcccacgggtagcgggaagagcaccaaagttcctgcagcatatgc

SEQ ID NO: 141070 - DNA, 75 bp, Artificial Sequence
  Synthetic
gcaccaaagttcctgcagcatatgccgctcagggttacaaagtcttagtgctcaacccctcagtggctgccaccc

SEQ ID NO: 141071 - DNA, 75 bp, Artificial Sequence
  Synthetic
ttgggctgccagtggcctgcgggacttagcggtcgccgtggagcctatcatcttcagcccgatggagaagaaagt

SEQ ID NO: 141072 - DNA, 75 bp, Artificial Sequence
  Synthetic
tccctagcattgctcgtcctcttgctcccccaacgggcgtatgcttggtcgggtgaagacagcgctactctcggc

SEQ ID NO: 141073 - DNA, 75 bp, Artificial Sequence
  Synthetic
ctaggaccacgtctgggatcaccagttttctctctcagggcgccaagcaggatatccagctgatcaacaccaatg

SEQ ID NO: 141074 - DNA, 75 bp, Artificial Sequence
  Synthetic
tcccccaacgggcgtatgcttggtcgggtgaagacagcgctactctcggcgctgggatcttggtcctcttcggct

SEQ ID NO: 141075 - DNA, 75 bp, Artificial Sequence
  Synthetic
gctgggatcttggtcctcttcggcttctttaccttatcaccttggtataagcattggatcagccgcctcatgtgg

SEQ ID NO: 141076 - DNA, 75 bp, Artificial Sequence
  Synthetic
tggcactaccccccaaagccttgtggtatcgtgccggcacagactgtatgtggcccagtgtattgcttcactccc

SEQ ID NO: 141077 - DNA, 75 bp, Artificial Sequence
  Synthetic
tcgccaaggcctctctcaaccctcaaaggatcatccggcggacccgtgctctgccctaggggacatgccgtgggc

SEQ ID NO: 141078 - DNA, 75 bp, Artificial Sequence
  Synthetic
agggacggtgtcatcctgctaacaagcctgctttatccatctttaatttttgacatcactaagctgctgatagca

SEQ ID NO: 141079 - DNA, 75 bp, Artificial Sequence
  Synthetic
gcctgctttatccatctttaatttttgacatcactaagctgctgatagcaatattgggcccattatacttaatac

SEQ ID NO: 141080 - DNA, 75 bp, Artificial Sequence
  Synthetic
tcagtcacggtccctcacccgaacatcactgagacagccttgccaactaccggcgaggtgcccttctacgggaaa

SEQ ID NO: 141081 - DNA, 75 bp, Artificial Sequence
  Synthetic
ggtagggtggcccagccctcctgggactaaatctttggagccgtgcacgtgtggagcggtcgacctgtacctggt

SEQ ID NO: 141082 - DNA, 75 bp, Artificial Sequence
  Synthetic
tcaacgcagtagcattctataggggtgtcgatgtggcggtcattccgacctcaggcgacgtcgttgtgtgtgcta

SEQ ID NO: 141083 - DNA, 75 bp, Artificial Sequence
  Synthetic
tcaacgcagtagcattctataggggtgtcgatgtggcggtcattccgtcctcaggcgacgtcgttgtgtgtgcta

SEQ ID NO: 141084 - DNA, 75 bp, Artificial Sequence
  Synthetic
tcaacgcagtagcattctataggggtgtcgatgtggcggtcattccgccctcaggcgacgtcgttgtgtgtgcta

SEQ ID NO: 141085 - DNA, 75 bp, Artificial Sequence
  Synthetic
tcaacgcagtagcattctataggggtgtcgatgtggcggtcattccggcctcaggcgacgtcgttgtgtgtgcta

SEQ ID NO: 141086 - DNA, 75 bp, Artificial Sequence
  Synthetic
tcaacgcagtagctttctataggggtgtcgatgtggcggtcattccgacctcaggcgacgtcgttgtgtgtgcta

SEQ ID NO: 141087 - DNA, 75 bp, Artificial Sequence
  Synthetic
tcaacgcagtagctttctataggggtgtcgatgtggcggtcattccgtcctcaggcgacgtcgttgtgtgtgcta

SEQ ID NO: 141088 - DNA, 75 bp, Artificial Sequence
  Synthetic
tcaacgcagtagctttctataggggtgtcgatgtggcggtcattccgccctcaggcgacgtcgttgtgtgtgcta

SEQ ID NO: 141089 - DNA, 75 bp, Artificial Sequence
  Synthetic
tcaacgcagtagctttctataggggtgtcgatgtggcggtcattccggcctcaggcgacgtcgttgtgtgtgcta

SEQ ID NO: 141090 - DNA, 75 bp, Artificial Sequence
  Synthetic
tcaacgcagtagccttctataggggtgtcgatgtggcggtcattccgacctcaggcgacgtcgttgtgtgtgcta

SEQ ID NO: 141091 - DNA, 75 bp, Artificial Sequence
  Synthetic
tcaacgcagtagccttctataggggtgtcgatgtggcggtcattccgtcctcaggcgacgtcgttgtgtgtgcta

SEQ ID NO: 141092 - DNA, 75 bp, Artificial Sequence
  Synthetic
tcaacgcagtagccttctataggggtgtcgatgtggcggtcattccgccctcaggcgacgtcgttgtgtgtgcta

SEQ ID NO: 141093 - DNA, 75 bp, Artificial Sequence
  Synthetic
tcaacgcagtagccttctataggggtgtcgatgtggcggtcattccggcctcaggcgacgtcgttgtgtgtgcta

SEQ ID NO: 141094 - DNA, 75 bp, Artificial Sequence
  Synthetic
tcaacgcagtagcgttctataggggtgtcgatgtggcggtcattccgacctcaggcgacgtcgttgtgtgtgcta

SEQ ID NO: 141095 - DNA, 75 bp, Artificial Sequence
  Synthetic
tcaacgcagtagcgttctataggggtgtcgatgtggcggtcattccgtcctcaggcgacgtcgttgtgtgtgcta

SEQ ID NO: 141096 - DNA, 75 bp, Artificial Sequence
  Synthetic
tcaacgcagtagcgttctataggggtgtcgatgtggcggtcattccgccctcaggcgacgtcgttgtgtgtgcta

SEQ ID NO: 141097 - DNA, 75 bp, Artificial Sequence
  Synthetic
tcaacgcagtagcgttctataggggtgtcgatgtggcggtcattccggcctcaggcgacgtcgttgtgtgtgcta

SEQ ID NO: 141098 - DNA, 75 bp, Artificial Sequence
  Synthetic
tcaacgcagttgcattctataggggtgtcgatgtggcggtcattccgacctcaggcgacgtcgttgtgtgtgcta

SEQ ID NO: 141099 - DNA, 75 bp, Artificial Sequence
  Synthetic
tcaacgcagttgcattctataggggtgtcgatgtggcggtcattccgtcctcaggcgacgtcgttgtgtgtgcta

SEQ ID NO: 141100 - DNA, 75 bp, Artificial Sequence
  Synthetic
tcaacgcagttgcattctataggggtgtcgatgtggcggtcattccgccctcaggcgacgtcgttgtgtgtgcta

SEQ ID NO: 141101 - DNA, 75 bp, Artificial Sequence
  Synthetic
tcaacgcagttgcattctataggggtgtcgatgtggcggtcattccggcctcaggcgacgtcgttgtgtgtgcta

SEQ ID NO: 141102 - DNA, 75 bp, Artificial Sequence
  Synthetic
tcaacgcagttgctttctataggggtgtcgatgtggcggtcattccgacctcaggcgacgtcgttgtgtgtgcta

SEQ ID NO: 141103 - DNA, 75 bp, Artificial Sequence
  Synthetic
tcaacgcagttgctttctataggggtgtcgatgtggcggtcattccgtcctcaggcgacgtcgttgtgtgtgcta

SEQ ID NO: 141104 - DNA, 75 bp, Artificial Sequence
  Synthetic
tcaacgcagttgctttctataggggtgtcgatgtggcggtcattccgccctcaggcgacgtcgttgtgtgtgcta

SEQ ID NO: 141105 - DNA, 75 bp, Artificial Sequence
  Synthetic
tcaacgcagttgctttctataggggtgtcgatgtggcggtcattccggcctcaggcgacgtcgttgtgtgtgcta

SEQ ID NO: 141106 - DNA, 75 bp, Artificial Sequence
  Synthetic
tcaacgcagttgccttctataggggtgtcgatgtggcggtcattccgacctcaggcgacgtcgttgtgtgtgcta

SEQ ID NO: 141107 - DNA, 75 bp, Artificial Sequence
  Synthetic
tcaacgcagttgccttctataggggtgtcgatgtggcggtcattccgtcctcaggcgacgtcgttgtgtgtgcta

SEQ ID NO: 141108 - DNA, 75 bp, Artificial Sequence
  Synthetic
tcaacgcagttgccttctataggggtgtcgatgtggcggtcattccgccctcaggcgacgtcgttgtgtgtgcta

SEQ ID NO: 141109 - DNA, 75 bp, Artificial Sequence
  Synthetic
tcaacgcagttgccttctataggggtgtcgatgtggcggtcattccggcctcaggcgacgtcgttgtgtgtgcta

SEQ ID NO: 141110 - DNA, 75 bp, Artificial Sequence
  Synthetic
tcaacgcagttgcgttctataggggtgtcgatgtggcggtcattccgacctcaggcgacgtcgttgtgtgtgcta

SEQ ID NO: 141111 - DNA, 75 bp, Artificial Sequence
  Synthetic
tcaacgcagttgcgttctataggggtgtcgatgtggcggtcattccgtcctcaggcgacgtcgttgtgtgtgcta

SEQ ID NO: 141112 - DNA, 75 bp, Artificial Sequence
  Synthetic
tcaacgcagttgcgttctataggggtgtcgatgtggcggtcattccgccctcaggcgacgtcgttgtgtgtgcta

SEQ ID NO: 141113 - DNA, 75 bp, Artificial Sequence
  Synthetic
tcaacgcagttgcgttctataggggtgtcgatgtggcggtcattccggcctcaggcgacgtcgttgtgtgtgcta

SEQ ID NO: 141114 - DNA, 75 bp, Artificial Sequence
  Synthetic
tcaacgcagtcgcattctataggggtgtcgatgtggcggtcattccgacctcaggcgacgtcgttgtgtgtgcta

SEQ ID NO: 141115 - DNA, 75 bp, Artificial Sequence
  Synthetic
tcaacgcagtcgcattctataggggtgtcgatgtggcggtcattccgtcctcaggcgacgtcgttgtgtgtgcta

SEQ ID NO: 141116 - DNA, 75 bp, Artificial Sequence
  Synthetic
tcaacgcagtcgcattctataggggtgtcgatgtggcggtcattccgccctcaggcgacgtcgttgtgtgtgcta

SEQ ID NO: 141117 - DNA, 75 bp, Artificial Sequence
  Synthetic
tcaacgcagtcgcattctataggggtgtcgatgtggcggtcattccggcctcaggcgacgtcgttgtgtgtgcta

SEQ ID NO: 141118 - DNA, 75 bp, Artificial Sequence
  Synthetic
tcaacgcagtcgctttctataggggtgtcgatgtggcggtcattccgacctcaggcgacgtcgttgtgtgtgcta

SEQ ID NO: 141119 - DNA, 75 bp, Artificial Sequence
  Synthetic
tcaacgcagtcgctttctataggggtgtcgatgtggcggtcattccgtcctcaggcgacgtcgttgtgtgtgcta

SEQ ID NO: 141120 - DNA, 75 bp, Artificial Sequence
  Synthetic
tcaacgcagtcgctttctataggggtgtcgatgtggcggtcattccgccctcaggcgacgtcgttgtgtgtgcta

SEQ ID NO: 141121 - DNA, 75 bp, Artificial Sequence
  Synthetic
tcaacgcagtcgctttctataggggtgtcgatgtggcggtcattccggcctcaggcgacgtcgttgtgtgtgcta

SEQ ID NO: 141122 - DNA, 75 bp, Artificial Sequence
  Synthetic
tcaacgcagtcgccttctataggggtgtcgatgtggcggtcattccgacctcaggcgacgtcgttgtgtgtgcta

SEQ ID NO: 141123 - DNA, 75 bp, Artificial Sequence
  Synthetic
tcaacgcagtcgccttctataggggtgtcgatgtggcggtcattccgtcctcaggcgacgtcgttgtgtgtgcta

SEQ ID NO: 141124 - DNA, 75 bp, Artificial Sequence
  Synthetic
tcaacgcagtcgccttctataggggtgtcgatgtggcggtcattccgccctcaggcgacgtcgttgtgtgtgcta

SEQ ID NO: 141125 - DNA, 75 bp, Artificial Sequence
  Synthetic
tcaacgcagtcgccttctataggggtgtcgatgtggcggtcattccggcctcaggcgacgtcgttgtgtgtgcta

SEQ ID NO: 141126 - DNA, 75 bp, Artificial Sequence
  Synthetic
tcaacgcagtcgcgttctataggggtgtcgatgtggcggtcattccgacctcaggcgacgtcgttgtgtgtgcta

SEQ ID NO: 141127 - DNA, 75 bp, Artificial Sequence
  Synthetic
tcaacgcagtcgcgttctataggggtgtcgatgtggcggtcattccgtcctcaggcgacgtcgttgtgtgtgcta

SEQ ID NO: 141128 - DNA, 75 bp, Artificial Sequence
  Synthetic
tcaacgcagtcgcgttctataggggtgtcgatgtggcggtcattccgccctcaggcgacgtcgttgtgtgtgcta

SEQ ID NO: 141129 - DNA, 75 bp, Artificial Sequence
  Synthetic
tcaacgcagtcgcgttctataggggtgtcgatgtggcggtcattccggcctcaggcgacgtcgttgtgtgtgcta

SEQ ID NO: 141130 - DNA, 75 bp, Artificial Sequence
  Synthetic
tcaacgcagtggcattctataggggtgtcgatgtggcggtcattccgacctcaggcgacgtcgttgtgtgtgcta

SEQ ID NO: 141131 - DNA, 75 bp, Artificial Sequence
  Synthetic
tcaacgcagtggcattctataggggtgtcgatgtggcggtcattccgtcctcaggcgacgtcgttgtgtgtgcta

SEQ ID NO: 141132 - DNA, 75 bp, Artificial Sequence
  Synthetic
tcaacgcagtggcattctataggggtgtcgatgtggcggtcattccgccctcaggcgacgtcgttgtgtgtgcta

SEQ ID NO: 141133 - DNA, 75 bp, Artificial Sequence
  Synthetic
tcaacgcagtggcattctataggggtgtcgatgtggcggtcattccggcctcaggcgacgtcgttgtgtgtgcta

SEQ ID NO: 141134 - DNA, 75 bp, Artificial Sequence
  Synthetic
tcaacgcagtggctttctataggggtgtcgatgtggcggtcattccgacctcaggcgacgtcgttgtgtgtgcta

SEQ ID NO: 141135 - DNA, 75 bp, Artificial Sequence
  Synthetic
tcaacgcagtggctttctataggggtgtcgatgtggcggtcattccgtcctcaggcgacgtcgttgtgtgtgcta

SEQ ID NO: 141136 - DNA, 75 bp, Artificial Sequence
  Synthetic
tcaacgcagtggctttctataggggtgtcgatgtggcggtcattccgccctcaggcgacgtcgttgtgtgtgcta

SEQ ID NO: 141137 - DNA, 75 bp, Artificial Sequence
  Synthetic
tcaacgcagtggctttctataggggtgtcgatgtggcggtcattccggcctcaggcgacgtcgttgtgtgtgcta

SEQ ID NO: 141138 - DNA, 75 bp, Artificial Sequence
  Synthetic
tcaacgcagtggccttctataggggtgtcgatgtggcggtcattccgacctcaggcgacgtcgttgtgtgtgcta

SEQ ID NO: 141139 - DNA, 75 bp, Artificial Sequence
  Synthetic
tcaacgcagtggccttctataggggtgtcgatgtggcggtcattccgtcctcaggcgacgtcgttgtgtgtgcta

SEQ ID NO: 141140 - DNA, 75 bp, Artificial Sequence
  Synthetic
tcaacgcagtggccttctataggggtgtcgatgtggcggtcattccgccctcaggcgacgtcgttgtgtgtgcta

SEQ ID NO: 141141 - DNA, 75 bp, Artificial Sequence
  Synthetic
tcaacgcagtggccttctataggggtgtcgatgtggcggtcattccggcctcaggcgacgtcgttgtgtgtgcta

SEQ ID NO: 141142 - DNA, 75 bp, Artificial Sequence
  Synthetic
tcaacgcagtggcgttctataggggtgtcgatgtggcggtcattccgacctcaggcgacgtcgttgtgtgtgcta

SEQ ID NO: 141143 - DNA, 75 bp, Artificial Sequence
  Synthetic
tcaacgcagtggcgttctataggggtgtcgatgtggcggtcattccgtcctcaggcgacgtcgttgtgtgtgcta

SEQ ID NO: 141144 - DNA, 75 bp, Artificial Sequence
  Synthetic
tcaacgcagtggcgttctataggggtgtcgatgtggcggtcattccgccctcaggcgacgtcgttgtgtgtgcta

SEQ ID NO: 141145 - DNA, 75 bp, Artificial Sequence
  Synthetic
tcaacgcagtggcgttctataggggtgtcgatgtggcggtcattccggcctcaggcgacgtcgttgtgtgtgcta

SEQ ID NO: 141146 - DNA, 75 bp, Artificial Sequence
  Synthetic
ggccgttggcagcataggccttgggaaagtgcttgtggacatcctggcgggctatggggcaggggtggcaggcgc

SEQ ID NO: 141147 - DNA, 75 bp, Artificial Sequence
  Synthetic
acagaagatccagctaatcaacaccaatggcagttggcatatcaataggacggccttgaactgtgatgaaagtct

SEQ ID NO: 141148 - DNA, 75 bp, Artificial Sequence
  Synthetic
gccactgaacctataatatttagtcccatggaaatcaaggttatcacctggggcgcggatacagcagcttgcgga

SEQ ID NO: 141149 - DNA, 75 bp, Artificial Sequence
  Synthetic
caccatagagaccaccacagtgccccaagacgctgtctcgagaagtcaaaggagaggcaggacgggaagggggaa

SEQ ID NO: 141150 - DNA, 75 bp, Artificial Sequence
  Synthetic
caccatagagaccaccactgtgccccaagacgctgtctcgagaagtcaaaggagaggcaggacgggaagggggaa

SEQ ID NO: 141151 - DNA, 75 bp, Artificial Sequence
  Synthetic
caccatagagaccaccaccgtgccccaagacgctgtctcgagaagtcaaaggagaggcaggacgggaagggggaa

SEQ ID NO: 141152 - DNA, 75 bp, Artificial Sequence
  Synthetic
caccatagagaccaccacggtgccccaagacgctgtctcgagaagtcaaaggagaggcaggacgggaagggggaa

SEQ ID NO: 141153 - DNA, 75 bp, Artificial Sequence
  Synthetic
caccattgagaccaccacagtgccccaagacgctgtctcgagaagtcaaaggagaggcaggacgggaagggggaa

SEQ ID NO: 141154 - DNA, 75 bp, Artificial Sequence
  Synthetic
caccattgagaccaccactgtgccccaagacgctgtctcgagaagtcaaaggagaggcaggacgggaagggggaa

SEQ ID NO: 141155 - DNA, 75 bp, Artificial Sequence
  Synthetic
caccattgagaccaccaccgtgccccaagacgctgtctcgagaagtcaaaggagaggcaggacgggaagggggaa

SEQ ID NO: 141156 - DNA, 75 bp, Artificial Sequence
  Synthetic
caccattgagaccaccacggtgccccaagacgctgtctcgagaagtcaaaggagaggcaggacgggaagggggaa

SEQ ID NO: 141157 - DNA, 75 bp, Artificial Sequence
  Synthetic
caccatcgagaccaccacagtgccccaagacgctgtctcgagaagtcaaaggagaggcaggacgggaagggggaa

SEQ ID NO: 141158 - DNA, 75 bp, Artificial Sequence
  Synthetic
caccatcgagaccaccactgtgccccaagacgctgtctcgagaagtcaaaggagaggcaggacgggaagggggaa

SEQ ID NO: 141159 - DNA, 75 bp, Artificial Sequence
  Synthetic
caccatcgagaccaccaccgtgccccaagacgctgtctcgagaagtcaaaggagaggcaggacgggaagggggaa

SEQ ID NO: 141160 - DNA, 75 bp, Artificial Sequence
  Synthetic
caccatcgagaccaccacggtgccccaagacgctgtctcgagaagtcaaaggagaggcaggacgggaagggggaa

SEQ ID NO: 141161 - DNA, 75 bp, Artificial Sequence
  Synthetic
caccatggagaccaccacagtgccccaagacgctgtctcgagaagtcaaaggagaggcaggacgggaagggggaa

SEQ ID NO: 141162 - DNA, 75 bp, Artificial Sequence
  Synthetic
caccatggagaccaccactgtgccccaagacgctgtctcgagaagtcaaaggagaggcaggacgggaagggggaa

SEQ ID NO: 141163 - DNA, 75 bp, Artificial Sequence
  Synthetic
caccatggagaccaccaccgtgccccaagacgctgtctcgagaagtcaaaggagaggcaggacgggaagggggaa

SEQ ID NO: 141164 - DNA, 75 bp, Artificial Sequence
  Synthetic
caccatggagaccaccacggtgccccaagacgctgtctcgagaagtcaaaggagaggcaggacgggaagggggaa

SEQ ID NO: 141165 - DNA, 75 bp, Artificial Sequence
  Synthetic
tcgatagacttcatccccgttgagacgctcgacatcgttacgcggtctcccaccttcaacgacaacagctcgcca

SEQ ID NO: 141166 - DNA, 75 bp, Artificial Sequence
  Synthetic
gagatgactccatctgaaacaactgtaagattacgcgcttacctgaataccccagggcttcctgtttgtcaagac

SEQ ID NO: 141167 - DNA, 75 bp, Artificial Sequence
  Synthetic
gagttgactccatctgaaacaactgtaagattacgcgcttacctgaataccccagggcttcctgtttgtcaagac

SEQ ID NO: 141168 - DNA, 75 bp, Artificial Sequence
  Synthetic
gagctgactccatctgaaacaactgtaagattacgcgcttacctgaataccccagggcttcctgtttgtcaagac

SEQ ID NO: 141169 - DNA, 75 bp, Artificial Sequence
  Synthetic
gaggtgactccatctgaaacaactgtaagattacgcgcttacctgaataccccagggcttcctgtttgtcaagac

SEQ ID NO: 141170 - DNA, 75 bp, Artificial Sequence
  Synthetic
taagattacgcgcttacctgaataccccagggcttcctgtttgtcaagaccatctggaattttgggagggcgtct

SEQ ID NO: 141171 - DNA, 75 bp, Artificial Sequence
  Synthetic
tgcagacgcgcgcatctgcgcctgtttgtggatgatgctactcatatcccaagcagaggcagctttggaaaacct

SEQ ID NO: 141172 - DNA, 75 bp, Artificial Sequence
  Synthetic
gaggtagtaaccagcacctgggtattggtgggtggagtcctcgcagcgctggcggcctactgcttgtctgtgggc

SEQ ID NO: 141173 - DNA, 75 bp, Artificial Sequence
  Synthetic
gaggttgtaaccagcacctgggtattggtgggtggagtcctcgcagcgctggcggcctactgcttgtctgtgggc

SEQ ID NO: 141174 - DNA, 75 bp, Artificial Sequence
  Synthetic
gaggtcgtaaccagcacctgggtattggtgggtggagtcctcgcagcgctggcggcctactgcttgtctgtgggc

SEQ ID NO: 141175 - DNA, 75 bp, Artificial Sequence
  Synthetic
gaggtggtaaccagcacctgggtattggtgggtggagtcctcgcagcgctggcggcctactgcttgtctgtgggc

SEQ ID NO: 141176 - DNA, 75 bp, Artificial Sequence
  Synthetic
ttacatcaagggagggagacacctgatcttctgccactcgaagaaaaagtgtgacgagctcgcggcggcccttcg

SEQ ID NO: 141177 - DNA, 75 bp, Artificial Sequence
  Synthetic
ccaaacacattccctacctcgttgagggccaacatcttgcagagcaattcaagcagaaggtcctgggccttattc

SEQ ID NO: 141178 - DNA, 75 bp, Artificial Sequence
  Synthetic
ggctgcacaggtacgctccggcgtgcaagcctctcctacgggacgaggtctcattccaggtcgggctccaccaat

SEQ ID NO: 141179 - DNA, 75 bp, Artificial Sequence
  Synthetic
acgcagccagcgccgggggcgcacgggcagaggaagactgggcacttataggtacgtttccactggtgagcgagc

SEQ ID NO: 141180 - DNA, 75 bp, Artificial Sequence
  Synthetic
catgtgtgttgtgcacccggccttggtatttgacatcaccaagctgctgctggccgtcctcggacccctttggat

SEQ ID NO: 141181 - DNA, 75 bp, Artificial Sequence
  Synthetic
tggcatacagtatttggctggcatgtccaccatgccaggaaatccagcagtggcctcactgatgtccttttcggc

SEQ ID NO: 141182 - DNA, 75 bp, Artificial Sequence
  Synthetic
tggcatacagtatttggctggcatgtccaccatgccaggtaatccagcagtggcctcactgatgtccttttcggc

SEQ ID NO: 141183 - DNA, 75 bp, Artificial Sequence
  Synthetic
tggcatacagtatttggctggcatgtccaccatgccaggcaatccagcagtggcctcactgatgtccttttcggc

SEQ ID NO: 141184 - DNA, 75 bp, Artificial Sequence
  Synthetic
tggcatacagtatttggctggcatgtccaccatgccagggaatccagcagtggcctcactgatgtccttttcggc

SEQ ID NO: 141185 - DNA, 75 bp, Artificial Sequence
  Synthetic
tggcatacagtatttggctggcatgtccaccttgccaggaaatccagcagtggcctcactgatgtccttttcggc

SEQ ID NO: 141186 - DNA, 75 bp, Artificial Sequence
  Synthetic
tggcatacagtatttggctggcatgtccaccttgccaggtaatccagcagtggcctcactgatgtccttttcggc

SEQ ID NO: 141187 - DNA, 75 bp, Artificial Sequence
  Synthetic
tggcatacagtatttggctggcatgtccaccttgccaggcaatccagcagtggcctcactgatgtccttttcggc

SEQ ID NO: 141188 - DNA, 75 bp, Artificial Sequence
  Synthetic
tggcatacagtatttggctggcatgtccaccttgccagggaatccagcagtggcctcactgatgtccttttcggc

SEQ ID NO: 141189 - DNA, 75 bp, Artificial Sequence
  Synthetic
tggcatacagtatttggctggcatgtccaccctgccaggaaatccagcagtggcctcactgatgtccttttcggc

SEQ ID NO: 141190 - DNA, 75 bp, Artificial Sequence
  Synthetic
tggcatacagtatttggctggcatgtccaccctgccaggtaatccagcagtggcctcactgatgtccttttcggc

SEQ ID NO: 141191 - DNA, 75 bp, Artificial Sequence
  Synthetic
tggcatacagtatttggctggcatgtccaccctgccaggcaatccagcagtggcctcactgatgtccttttcggc

SEQ ID NO: 141192 - DNA, 75 bp, Artificial Sequence
  Synthetic
tggcatacagtatttggctggcatgtccaccctgccagggaatccagcagtggcctcactgatgtccttttcggc

SEQ ID NO: 141193 - DNA, 75 bp, Artificial Sequence
  Synthetic
tggcatacagtatttggctggcatgtccaccgtgccaggaaatccagcagtggcctcactgatgtccttttcggc

SEQ ID NO: 141194 - DNA, 75 bp, Artificial Sequence
  Synthetic
tggcatacagtatttggctggcatgtccaccgtgccaggtaatccagcagtggcctcactgatgtccttttcggc

SEQ ID NO: 141195 - DNA, 75 bp, Artificial Sequence
  Synthetic
tggcatacagtatttggctggcatgtccaccgtgccaggcaatccagcagtggcctcactgatgtccttttcggc

SEQ ID NO: 141196 - DNA, 75 bp, Artificial Sequence
  Synthetic
tggcatacagtatttggctggcatgtccaccgtgccagggaatccagcagtggcctcactgatgtccttttcggc

SEQ ID NO: 141197 - DNA, 75 bp, Artificial Sequence
  Synthetic
tggcatacagtatttggctggcttgtccaccatgccaggaaatccagcagtggcctcactgatgtccttttcggc

SEQ ID NO: 141198 - DNA, 75 bp, Artificial Sequence
  Synthetic
tggcatacagtatttggctggcttgtccaccatgccaggtaatccagcagtggcctcactgatgtccttttcggc

SEQ ID NO: 141199 - DNA, 75 bp, Artificial Sequence
  Synthetic
tggcatacagtatttggctggcttgtccaccatgccaggcaatccagcagtggcctcactgatgtccttttcggc

SEQ ID NO: 141200 - DNA, 75 bp, Artificial Sequence
  Synthetic
tggcatacagtatttggctggcttgtccaccatgccagggaatccagcagtggcctcactgatgtccttttcggc

SEQ ID NO: 141201 - DNA, 75 bp, Artificial Sequence
  Synthetic
tggcatacagtatttggctggcttgtccaccttgccaggaaatccagcagtggcctcactgatgtccttttcggc

SEQ ID NO: 141202 - DNA, 75 bp, Artificial Sequence
  Synthetic
tggcatacagtatttggctggcttgtccaccttgccaggtaatccagcagtggcctcactgatgtccttttcggc

SEQ ID NO: 141203 - DNA, 75 bp, Artificial Sequence
  Synthetic
tggcatacagtatttggctggcttgtccaccttgccaggcaatccagcagtggcctcactgatgtccttttcggc

SEQ ID NO: 141204 - DNA, 75 bp, Artificial Sequence
  Synthetic
tggcatacagtatttggctggcttgtccaccttgccagggaatccagcagtggcctcactgatgtccttttcggc

SEQ ID NO: 141205 - DNA, 75 bp, Artificial Sequence
  Synthetic
tggcatacagtatttggctggcttgtccaccctgccaggaaatccagcagtggcctcactgatgtccttttcggc

SEQ ID NO: 141206 - DNA, 75 bp, Artificial Sequence
  Synthetic
tggcatacagtatttggctggcttgtccaccctgccaggtaatccagcagtggcctcactgatgtccttttcggc

SEQ ID NO: 141207 - DNA, 75 bp, Artificial Sequence
  Synthetic
tggcatacagtatttggctggcttgtccaccctgccaggcaatccagcagtggcctcactgatgtccttttcggc

SEQ ID NO: 141208 - DNA, 75 bp, Artificial Sequence
  Synthetic
tggcatacagtatttggctggcttgtccaccctgccagggaatccagcagtggcctcactgatgtccttttcggc

SEQ ID NO: 141209 - DNA, 75 bp, Artificial Sequence
  Synthetic
tggcatacagtatttggctggcttgtccaccgtgccaggaaatccagcagtggcctcactgatgtccttttcggc

SEQ ID NO: 141210 - DNA, 75 bp, Artificial Sequence
  Synthetic
tggcatacagtatttggctggcttgtccaccgtgccaggtaatccagcagtggcctcactgatgtccttttcggc

SEQ ID NO: 141211 - DNA, 75 bp, Artificial Sequence
  Synthetic
tggcatacagtatttggctggcttgtccaccgtgccaggcaatccagcagtggcctcactgatgtccttttcggc

SEQ ID NO: 141212 - DNA, 75 bp, Artificial Sequence
  Synthetic
tggcatacagtatttggctggcttgtccaccgtgccagggaatccagcagtggcctcactgatgtccttttcggc

SEQ ID NO: 141213 - DNA, 75 bp, Artificial Sequence
  Synthetic
tggcatacagtatttggctggcctgtccaccatgccaggaaatccagcagtggcctcactgatgtccttttcggc

SEQ ID NO: 141214 - DNA, 75 bp, Artificial Sequence
  Synthetic
tggcatacagtatttggctggcctgtccaccatgccaggtaatccagcagtggcctcactgatgtccttttcggc

SEQ ID NO: 141215 - DNA, 75 bp, Artificial Sequence
  Synthetic
tggcatacagtatttggctggcctgtccaccatgccaggcaatccagcagtggcctcactgatgtccttttcggc

SEQ ID NO: 141216 - DNA, 75 bp, Artificial Sequence
  Synthetic
tggcatacagtatttggctggcctgtccaccatgccagggaatccagcagtggcctcactgatgtccttttcggc

SEQ ID NO: 141217 - DNA, 75 bp, Artificial Sequence
  Synthetic
tggcatacagtatttggctggcctgtccaccttgccaggaaatccagcagtggcctcactgatgtccttttcggc

SEQ ID NO: 141218 - DNA, 75 bp, Artificial Sequence
  Synthetic
tggcatacagtatttggctggcctgtccaccttgccaggtaatccagcagtggcctcactgatgtccttttcggc

SEQ ID NO: 141219 - DNA, 75 bp, Artificial Sequence
  Synthetic
tggcatacagtatttggctggcctgtccaccttgccaggcaatccagcagtggcctcactgatgtccttttcggc

SEQ ID NO: 141220 - DNA, 75 bp, Artificial Sequence
  Synthetic
tggcatacagtatttggctggcctgtccaccttgccagggaatccagcagtggcctcactgatgtccttttcggc

SEQ ID NO: 141221 - DNA, 75 bp, Artificial Sequence
  Synthetic
tggcatacagtatttggctggcctgtccaccctgccaggaaatccagcagtggcctcactgatgtccttttcggc

SEQ ID NO: 141222 - DNA, 75 bp, Artificial Sequence
  Synthetic
tggcatacagtatttggctggcctgtccaccctgccaggtaatccagcagtggcctcactgatgtccttttcggc

SEQ ID NO: 141223 - DNA, 75 bp, Artificial Sequence
  Synthetic
tggcatacagtatttggctggcctgtccaccctgccaggcaatccagcagtggcctcactgatgtccttttcggc

SEQ ID NO: 141224 - DNA, 75 bp, Artificial Sequence
  Synthetic
tggcatacagtatttggctggcctgtccaccctgccagggaatccagcagtggcctcactgatgtccttttcggc

SEQ ID NO: 141225 - DNA, 75 bp, Artificial Sequence
  Synthetic
tggcatacagtatttggctggcctgtccaccgtgccaggaaatccagcagtggcctcactgatgtccttttcggc

SEQ ID NO: 141226 - DNA, 75 bp, Artificial Sequence
  Synthetic
tggcatacagtatttggctggcctgtccaccgtgccaggtaatccagcagtggcctcactgatgtccttttcggc

SEQ ID NO: 141227 - DNA, 75 bp, Artificial Sequence
  Synthetic
tggcatacagtatttggctggcctgtccaccgtgccaggcaatccagcagtggcctcactgatgtccttttcggc

SEQ ID NO: 141228 - DNA, 75 bp, Artificial Sequence
  Synthetic
tggcatacagtatttggctggcctgtccaccgtgccagggaatccagcagtggcctcactgatgtccttttcggc

SEQ ID NO: 141229 - DNA, 75 bp, Artificial Sequence
  Synthetic
tggcatacagtatttggctggcgtgtccaccatgccaggaaatccagcagtggcctcactgatgtccttttcggc

SEQ ID NO: 141230 - DNA, 75 bp, Artificial Sequence
  Synthetic
tggcatacagtatttggctggcgtgtccaccatgccaggtaatccagcagtggcctcactgatgtccttttcggc

SEQ ID NO: 141231 - DNA, 75 bp, Artificial Sequence
  Synthetic
tggcatacagtatttggctggcgtgtccaccatgccaggcaatccagcagtggcctcactgatgtccttttcggc

SEQ ID NO: 141232 - DNA, 75 bp, Artificial Sequence
  Synthetic
tggcatacagtatttggctggcgtgtccaccatgccagggaatccagcagtggcctcactgatgtccttttcggc

SEQ ID NO: 141233 - DNA, 75 bp, Artificial Sequence
  Synthetic
tggcatacagtatttggctggcgtgtccaccttgccaggaaatccagcagtggcctcactgatgtccttttcggc

SEQ ID NO: 141234 - DNA, 75 bp, Artificial Sequence
  Synthetic
tggcatacagtatttggctggcgtgtccaccttgccaggtaatccagcagtggcctcactgatgtccttttcggc

SEQ ID NO: 141235 - DNA, 75 bp, Artificial Sequence
  Synthetic
tggcatacagtatttggctggcgtgtccaccttgccaggcaatccagcagtggcctcactgatgtccttttcggc

SEQ ID NO: 141236 - DNA, 75 bp, Artificial Sequence
  Synthetic
tggcatacagtatttggctggcgtgtccaccttgccagggaatccagcagtggcctcactgatgtccttttcggc

SEQ ID NO: 141237 - DNA, 75 bp, Artificial Sequence
  Synthetic
tggcatacagtatttggctggcgtgtccaccctgccaggaaatccagcagtggcctcactgatgtccttttcggc

SEQ ID NO: 141238 - DNA, 75 bp, Artificial Sequence
  Synthetic
tggcatacagtatttggctggcgtgtccaccctgccaggtaatccagcagtggcctcactgatgtccttttcggc

SEQ ID NO: 141239 - DNA, 75 bp, Artificial Sequence
  Synthetic
tggcatacagtatttggctggcgtgtccaccctgccaggcaatccagcagtggcctcactgatgtccttttcggc

SEQ ID NO: 141240 - DNA, 75 bp, Artificial Sequence
  Synthetic
tggcatacagtatttggctggcgtgtccaccctgccagggaatccagcagtggcctcactgatgtccttttcggc

SEQ ID NO: 141241 - DNA, 75 bp, Artificial Sequence
  Synthetic
tggcatacagtatttggctggcgtgtccaccgtgccaggaaatccagcagtggcctcactgatgtccttttcggc

SEQ ID NO: 141242 - DNA, 75 bp, Artificial Sequence
  Synthetic
tggcatacagtatttggctggcgtgtccaccgtgccaggtaatccagcagtggcctcactgatgtccttttcggc

SEQ ID NO: 141243 - DNA, 75 bp, Artificial Sequence
  Synthetic
tggcatacagtatttggctggcgtgtccaccgtgccaggcaatccagcagtggcctcactgatgtccttttcggc

SEQ ID NO: 141244 - DNA, 75 bp, Artificial Sequence
  Synthetic
tggcatacagtatttggctggcgtgtccaccgtgccagggaatccagcagtggcctcactgatgtccttttcggc

SEQ ID NO: 141245 - DNA, 75 bp, Artificial Sequence
  Synthetic
gcccaagacgctactagcatattgggtataggcacggtcttagatcaggctgagacggctggggtgaggctgacg

SEQ ID NO: 141246 - DNA, 75 bp, Artificial Sequence
  Synthetic
gtataggcacggtcttagatcaggctgagacggctggggtgaggctgacggttttagcaacggcaactcccccag

SEQ ID NO: 141247 - DNA, 75 bp, Artificial Sequence
  Synthetic
acatcatcaacggcttgcccgtctctgcccgtaggggccgagagatactgctcggaccggccgatggaatggtct

SEQ ID NO: 141248 - DNA, 75 bp, Artificial Sequence
  Synthetic
ctgtttaacatcttggggggatgggtggctgcccaactcgccccccccagtgctgcttcggctttcgtgggcgcc

SEQ ID NO: 141249 - DNA, 75 bp, Artificial Sequence
  Synthetic
tttgtggtgagcgggatggcaggggccgcagtcggcagcattggcttgggaaaggttttggtggacgtgatagct

SEQ ID NO: 141250 - DNA, 75 bp, Artificial Sequence
  Synthetic
tttgtggtgagcgggatggcaggggccgcagtcggcagcattggcttgggaaaggttttggtggacgtgattgct

SEQ ID NO: 141251 - DNA, 75 bp, Artificial Sequence
  Synthetic
tttgtggtgagcgggatggcaggggccgcagtcggcagcattggcttgggaaaggttttggtggacgtgatcgct

SEQ ID NO: 141252 - DNA, 75 bp, Artificial Sequence
  Synthetic
tttgtggtgagcgggatggcaggggccgcagtcggcagcattggcttgggaaaggttttggtggacgtgatggct

SEQ ID NO: 141253 - DNA, 75 bp, Artificial Sequence
  Synthetic
tttgtggtgagcgggttggcaggggccgcagtcggcagcattggcttgggaaaggttttggtggacgtgatagct

SEQ ID NO: 141254 - DNA, 75 bp, Artificial Sequence
  Synthetic
tttgtggtgagcgggttggcaggggccgcagtcggcagcattggcttgggaaaggttttggtggacgtgattgct

SEQ ID NO: 141255 - DNA, 75 bp, Artificial Sequence
  Synthetic
tttgtggtgagcgggttggcaggggccgcagtcggcagcattggcttgggaaaggttttggtggacgtgatcgct

SEQ ID NO: 141256 - DNA, 75 bp, Artificial Sequence
  Synthetic
tttgtggtgagcgggttggcaggggccgcagtcggcagcattggcttgggaaaggttttggtggacgtgatggct

SEQ ID NO: 141257 - DNA, 75 bp, Artificial Sequence
  Synthetic
tttgtggtgagcgggctggcaggggccgcagtcggcagcattggcttgggaaaggttttggtggacgtgatagct

SEQ ID NO: 141258 - DNA, 75 bp, Artificial Sequence
  Synthetic
tttgtggtgagcgggctggcaggggccgcagtcggcagcattggcttgggaaaggttttggtggacgtgattgct

SEQ ID NO: 141259 - DNA, 75 bp, Artificial Sequence
  Synthetic
tttgtggtgagcgggctggcaggggccgcagtcggcagcattggcttgggaaaggttttggtggacgtgatcgct

SEQ ID NO: 141260 - DNA, 75 bp, Artificial Sequence
  Synthetic
tttgtggtgagcgggctggcaggggccgcagtcggcagcattggcttgggaaaggttttggtggacgtgatggct

SEQ ID NO: 141261 - DNA, 75 bp, Artificial Sequence
  Synthetic
tttgtggtgagcggggtggcaggggccgcagtcggcagcattggcttgggaaaggttttggtggacgtgatagct

SEQ ID NO: 141262 - DNA, 75 bp, Artificial Sequence
  Synthetic
tttgtggtgagcggggtggcaggggccgcagtcggcagcattggcttgggaaaggttttggtggacgtgattgct

SEQ ID NO: 141263 - DNA, 75 bp, Artificial Sequence
  Synthetic
tttgtggtgagcggggtggcaggggccgcagtcggcagcattggcttgggaaaggttttggtggacgtgatcgct

SEQ ID NO: 141264 - DNA, 75 bp, Artificial Sequence
  Synthetic
tttgtggtgagcggggtggcaggggccgcagtcggcagcattggcttgggaaaggttttggtggacgtgatggct

SEQ ID NO: 141265 - DNA, 75 bp, Artificial Sequence
  Synthetic
acccgtggagtggctaaggcggtggactttatccctgtggagaacctagagacaaccatgaggtccccggtgttc

SEQ ID NO: 141266 - DNA, 75 bp, Artificial Sequence
  Synthetic
tatctcctggagcactggtagtgggtgtagtgtgtgcggctatcttgagacgacacgttgggcccgctgaagggg

SEQ ID NO: 141267 - DNA, 75 bp, Artificial Sequence
  Synthetic
ggccctccaataccacctccacggaggaagaagacggttgtcctgacagaatccaccgtgtcttctgccttggcg

SEQ ID NO: 141268 - DNA, 75 bp, Artificial Sequence
  Synthetic
aagctgaccttgaggtcatgaccagcacgtgggtcctagctgggggagtcttggcagccgtcgccgcgtattgcc

SEQ ID NO: 141269 - DNA, 75 bp, Artificial Sequence
  Synthetic
gaccatactcagctcccttaccgtgaccagccttctacggaagttgcatgagtggatcaacagtgattggtctac

SEQ ID NO: 141270 - DNA, 75 bp, Artificial Sequence
  Synthetic
gaccatactcagctcccttaccgtgaccagccttcttcggaagttgcatgagtggatcaacagtgattggtctac

SEQ ID NO: 141271 - DNA, 75 bp, Artificial Sequence
  Synthetic
gaccatactcagctcccttaccgtgaccagccttctccggaagttgcatgagtggatcaacagtgattggtctac

SEQ ID NO: 141272 - DNA, 75 bp, Artificial Sequence
  Synthetic
gaccatactcagctcccttaccgtgaccagccttctgcggaagttgcatgagtggatcaacagtgattggtctac

SEQ ID NO: 141273 - DNA, 75 bp, Artificial Sequence
  Synthetic
ggaggaatgtgcctctaaagcggctctcattgaagaggggcagcgaatagccgagatgctgaagtccaagatcca

SEQ ID NO: 141274 - DNA, 75 bp, Artificial Sequence
  Synthetic
ccaggcgtgcccttcctatcgtgtcaacgagggttccgcggcgtgtggagaggcgacggtatctgtcgcaccaca

SEQ ID NO: 141275 - DNA, 75 bp, Artificial Sequence
  Synthetic
ctcattgaagaggggcagcgaatagccgagatgctgaagtccaagatccaaggcttattgcagcaagcctctaaa

SEQ ID NO: 141276 - DNA, 75 bp, Artificial Sequence
  Synthetic
tcgcaggactgtcaacactgccagggaaccccgctgtggcttccatgatggcattcagtgccgccctcaccagtc

SEQ ID NO: 141277 - DNA, 75 bp, Artificial Sequence
  Synthetic
aactgcctaccaagccactgtgtgcgcccgcgcgcaggctcctcccccgagttgggacgagacgtggaaatgtct

SEQ ID NO: 141278 - DNA, 75 bp, Artificial Sequence
  Synthetic
tcaacgcgacgacgactggcccgagcgtacctatccctgggcccaattataaaagggccctgtggagggtggctg

SEQ ID NO: 141279 - DNA, 75 bp, Artificial Sequence
  Synthetic
attcttcacagaggtagatggcgtgcggctgcaccgctatgctcctgcatgcaagcctctcctgagggatgagat

SEQ ID NO: 141280 - DNA, 75 bp, Artificial Sequence
  Synthetic
attcttcactgaggtagatggcgtgcggctgcaccgctatgctcctgcatgcaagcctctcctgagggatgagat

SEQ ID NO: 141281 - DNA, 75 bp, Artificial Sequence
  Synthetic
attcttcaccgaggtagatggcgtgcggctgcaccgctatgctcctgcatgcaagcctctcctgagggatgagat

SEQ ID NO: 141282 - DNA, 75 bp, Artificial Sequence
  Synthetic
attcttcacggaggtagatggcgtgcggctgcaccgctatgctcctgcatgcaagcctctcctgagggatgagat

SEQ ID NO: 141283 - DNA, 75 bp, Artificial Sequence
  Synthetic
tttcttcacagaggtagatggcgtgcggctgcaccgctatgctcctgcatgcaagcctctcctgagggatgagat

SEQ ID NO: 141284 - DNA, 75 bp, Artificial Sequence
  Synthetic
tttcttcactgaggtagatggcgtgcggctgcaccgctatgctcctgcatgcaagcctctcctgagggatgagat

SEQ ID NO: 141285 - DNA, 75 bp, Artificial Sequence
  Synthetic
tttcttcaccgaggtagatggcgtgcggctgcaccgctatgctcctgcatgcaagcctctcctgagggatgagat

SEQ ID NO: 141286 - DNA, 75 bp, Artificial Sequence
  Synthetic
tttcttcacggaggtagatggcgtgcggctgcaccgctatgctcctgcatgcaagcctctcctgagggatgagat

SEQ ID NO: 141287 - DNA, 75 bp, Artificial Sequence
  Synthetic
cttcttcacagaggtagatggcgtgcggctgcaccgctatgctcctgcatgcaagcctctcctgagggatgagat

SEQ ID NO: 141288 - DNA, 75 bp, Artificial Sequence
  Synthetic
cttcttcactgaggtagatggcgtgcggctgcaccgctatgctcctgcatgcaagcctctcctgagggatgagat

SEQ ID NO: 141289 - DNA, 75 bp, Artificial Sequence
  Synthetic
cttcttcaccgaggtagatggcgtgcggctgcaccgctatgctcctgcatgcaagcctctcctgagggatgagat

SEQ ID NO: 141290 - DNA, 75 bp, Artificial Sequence
  Synthetic
cttcttcacggaggtagatggcgtgcggctgcaccgctatgctcctgcatgcaagcctctcctgagggatgagat

SEQ ID NO: 141291 - DNA, 75 bp, Artificial Sequence
  Synthetic
gttcttcacagaggtagatggcgtgcggctgcaccgctatgctcctgcatgcaagcctctcctgagggatgagat

SEQ ID NO: 141292 - DNA, 75 bp, Artificial Sequence
  Synthetic
gttcttcactgaggtagatggcgtgcggctgcaccgctatgctcctgcatgcaagcctctcctgagggatgagat

SEQ ID NO: 141293 - DNA, 75 bp, Artificial Sequence
  Synthetic
gttcttcaccgaggtagatggcgtgcggctgcaccgctatgctcctgcatgcaagcctctcctgagggatgagat

SEQ ID NO: 141294 - DNA, 75 bp, Artificial Sequence
  Synthetic
gttcttcacggaggtagatggcgtgcggctgcaccgctatgctcctgcatgcaagcctctcctgagggatgagat

SEQ ID NO: 141295 - DNA, 75 bp, Artificial Sequence
  Synthetic
tcgcacatcactgcggagactgctgcccgtcgtctggcacgtgggtcccctccgtctcttgctagttcatcggcg

SEQ ID NO: 141296 - DNA, 75 bp, Artificial Sequence
  Synthetic
tggggggcaacatcacccgcgtagagtctgagaacaaagtcatcgttctcgactctttcgaccccctgacagccg

SEQ ID NO: 141297 - DNA, 75 bp, Artificial Sequence
  Synthetic
tactttctttcttggtggctccatcttagccctagtcacggctagctgtgaaaggtccgtgagccgcatgactgc

SEQ ID NO: 141298 - DNA, 75 bp, Artificial Sequence
  Synthetic
cgagctcgccgcgaaactggtcgcgctgggcgtcaacgccgtggcctactaccgcggccttgacgtgtccgtcat

SEQ ID NO: 141299 - DNA, 75 bp, Artificial Sequence
  Synthetic
cccgcccttacttgagacatggaagaagccagactactccccaccgctggttcatggttgcgcactgcccccttc

SEQ ID NO: 141300 - DNA, 75 bp, Artificial Sequence
  Synthetic
gcctgtcgagctgcaaagctccaggactgcacgatgctcgtgtgcggagacgaccttgtcgttatctgtgaaagc

SEQ ID NO: 141301 - DNA, 75 bp, Artificial Sequence
  Synthetic
gacctttcctatcaattgctacacggagggccagtgcgtgccgaaacctgcgccaaacttcaagaccgccatctg

SEQ ID NO: 141302 - DNA, 75 bp, Artificial Sequence
  Synthetic
ccgatgacgccgagccccgcaaccgactcagactcaggccaccctacaaccagcaagagctcggaccaagatgac

SEQ ID NO: 141303 - DNA, 75 bp, Artificial Sequence
  Synthetic
ccgatgacgccgagccccgcaaccgactcagactcaggccaccctactaccagcaagagctcggaccaagatgac

SEQ ID NO: 141304 - DNA, 75 bp, Artificial Sequence
  Synthetic
ccgatgacgccgagccccgcaaccgactcagactcaggccaccctaccaccagcaagagctcggaccaagatgac

SEQ ID NO: 141305 - DNA, 75 bp, Artificial Sequence
  Synthetic
ccgatgacgccgagccccgcaaccgactcagactcaggccaccctacgaccagcaagagctcggaccaagatgac

SEQ ID NO: 141306 - DNA, 75 bp, Artificial Sequence
  Synthetic
ctaggcgattggccaggggatctcccccctcacaggccagctcttcagcgagccagctctccgccccgtccttga

SEQ ID NO: 141307 - DNA, 75 bp, Artificial Sequence
  Synthetic
acgccaacggaagtggccccgaacaccgcccctactgctggcactaccccccaaagccttgcggtatcgtgccag

SEQ ID NO: 141308 - DNA, 75 bp, Artificial Sequence
  Synthetic
cagtcagtgaagagggcgacagcgtcgtctgttgttccatgtcatacagttggacaggagcattaatcacaccct

SEQ ID NO: 141309 - DNA, 75 bp, Artificial Sequence
  Synthetic
cagtcagtgatgagggcgacagcgtcgtctgttgttccatgtcatacagttggacaggagcattaatcacaccct

SEQ ID NO: 141310 - DNA, 75 bp, Artificial Sequence
  Synthetic
cagtcagtgacgagggcgacagcgtcgtctgttgttccatgtcatacagttggacaggagcattaatcacaccct

SEQ ID NO: 141311 - DNA, 75 bp, Artificial Sequence
  Synthetic
cagtcagtgaggagggcgacagcgtcgtctgttgttccatgtcatacagttggacaggagcattaatcacaccct

SEQ ID NO: 141312 - DNA, 75 bp, Artificial Sequence
  Synthetic
ctgtcagtgaagagggcgacagcgtcgtctgttgttccatgtcatacagttggacaggagcattaatcacaccct

SEQ ID NO: 141313 - DNA, 75 bp, Artificial Sequence
  Synthetic
ctgtcagtgatgagggcgacagcgtcgtctgttgttccatgtcatacagttggacaggagcattaatcacaccct

SEQ ID NO: 141314 - DNA, 75 bp, Artificial Sequence
  Synthetic
ctgtcagtgacgagggcgacagcgtcgtctgttgttccatgtcatacagttggacaggagcattaatcacaccct

SEQ ID NO: 141315 - DNA, 75 bp, Artificial Sequence
  Synthetic
ctgtcagtgaggagggcgacagcgtcgtctgttgttccatgtcatacagttggacaggagcattaatcacaccct

SEQ ID NO: 141316 - DNA, 75 bp, Artificial Sequence
  Synthetic
ccgtcagtgaagagggcgacagcgtcgtctgttgttccatgtcatacagttggacaggagcattaatcacaccct

SEQ ID NO: 141317 - DNA, 75 bp, Artificial Sequence
  Synthetic
ccgtcagtgatgagggcgacagcgtcgtctgttgttccatgtcatacagttggacaggagcattaatcacaccct

SEQ ID NO: 141318 - DNA, 75 bp, Artificial Sequence
  Synthetic
ccgtcagtgacgagggcgacagcgtcgtctgttgttccatgtcatacagttggacaggagcattaatcacaccct

SEQ ID NO: 141319 - DNA, 75 bp, Artificial Sequence
  Synthetic
ccgtcagtgaggagggcgacagcgtcgtctgttgttccatgtcatacagttggacaggagcattaatcacaccct

SEQ ID NO: 141320 - DNA, 75 bp, Artificial Sequence
  Synthetic
cggtcagtgaagagggcgacagcgtcgtctgttgttccatgtcatacagttggacaggagcattaatcacaccct

SEQ ID NO: 141321 - DNA, 75 bp, Artificial Sequence
  Synthetic
cggtcagtgatgagggcgacagcgtcgtctgttgttccatgtcatacagttggacaggagcattaatcacaccct

SEQ ID NO: 141322 - DNA, 75 bp, Artificial Sequence
  Synthetic
cggtcagtgacgagggcgacagcgtcgtctgttgttccatgtcatacagttggacaggagcattaatcacaccct

SEQ ID NO: 141323 - DNA, 75 bp, Artificial Sequence
  Synthetic
cggtcagtgaggagggcgacagcgtcgtctgttgttccatgtcatacagttggacaggagcattaatcacaccct

SEQ ID NO: 141324 - DNA, 75 bp, Artificial Sequence
  Synthetic
cgggatgaggtttcgttctgcattgggctcaattcatttgtggtcgggtctcagcttccttgtgatcctgagccc

SEQ ID NO: 141325 - DNA, 75 bp, Artificial Sequence
  Synthetic
gcgagccttccgtaccatcagagtacttgatcaggaggaaaaagttcccatcggcactacctccctgggctcgcc

SEQ ID NO: 141326 - DNA, 75 bp, Artificial Sequence
  Synthetic
tcagcttccttgtgatcctgagcccgacacagatgtattgatgtccatgctaacagatccatcccacatcacggc

SEQ ID NO: 141327 - DNA, 75 bp, Artificial Sequence
  Synthetic
acggcagaagaaggttacctttgaccgcacacaggttttagaccaacactacaataatgtagtgaaggagattaa

SEQ ID NO: 141328 - DNA, 75 bp, Artificial Sequence
  Synthetic
gctcctcagcgagccagctatcagcaccatcgctgcgagccacctgtaccacccatggcaaggcctatgatgtgg

SEQ ID NO: 141329 - DNA, 75 bp, Artificial Sequence
  Synthetic
gtggcagcgccctacgctaatgctccgcttgactccatgcggcgtcatgtggacttgatggtgggcgcggctaca

SEQ ID NO: 141330 - DNA, 75 bp, Artificial Sequence
  Synthetic
ccagcagccctctgacgagactgccgcttcagaagcgggatcactgtcctccatgcctccccttgagggagagcc

SEQ ID NO: 141331 - DNA, 75 bp, Artificial Sequence
  Synthetic
gcaactgttccatctatgcaggacacatcacaggtcaccgaatggcctgggatatgatgatgaattggagcccca

SEQ ID NO: 141332 - DNA, 75 bp, Artificial Sequence
  Synthetic
atgggaggacttgctagaagacaaccaaacaccaatccccacaaccatcatggcaaagaacgaggtgttctgcgt

SEQ ID NO: 141333 - DNA, 75 bp, Artificial Sequence
  Synthetic
aagttgcctactgccatcatgggagatgcctatggtttccagtactcgcccaagcagcgggtggaacgcctgctc

SEQ ID NO: 141334 - DNA, 75 bp, Artificial Sequence
  Synthetic
ggcgccggacagtgggtctgagtgagagcaccataggagatgccctccaacagctggccgttaagacctttggcc

SEQ ID NO: 141335 - DNA, 75 bp, Artificial Sequence
  Synthetic
cagcatgcaggcaaactgggccaaagtcatcttggtcctcttcctctttgccggggttgacgcgtccacccacac

SEQ ID NO: 141336 - DNA, 75 bp, Artificial Sequence
  Synthetic
tctacctatcctgcaagctagaaccagaagccaaggtagccatagagtctctcacagagcggctctatttgggag

SEQ ID NO: 141337 - DNA, 75 bp, Artificial Sequence
  Synthetic
tctacctatcctgcaagctagaaccagaagccaaggtagccatagagtctctcactgagcggctctatttgggag

SEQ ID NO: 141338 - DNA, 75 bp, Artificial Sequence
  Synthetic
tctacctatcctgcaagctagaaccagaagccaaggtagccatagagtctctcaccgagcggctctatttgggag

SEQ ID NO: 141339 - DNA, 75 bp, Artificial Sequence
  Synthetic
tctacctatcctgcaagctagaaccagaagccaaggtagccatagagtctctcacggagcggctctatttgggag

SEQ ID NO: 141340 - DNA, 75 bp, Artificial Sequence
  Synthetic
tctacctatcctgcaagctagaaccagaagccaaggttgccatagagtctctcacagagcggctctatttgggag

SEQ ID NO: 141341 - DNA, 75 bp, Artificial Sequence
  Synthetic
tctacctatcctgcaagctagaaccagaagccaaggttgccatagagtctctcactgagcggctctatttgggag

SEQ ID NO: 141342 - DNA, 75 bp, Artificial Sequence
  Synthetic
tctacctatcctgcaagctagaaccagaagccaaggttgccatagagtctctcaccgagcggctctatttgggag

SEQ ID NO: 141343 - DNA, 75 bp, Artificial Sequence
  Synthetic
tctacctatcctgcaagctagaaccagaagccaaggttgccatagagtctctcacggagcggctctatttgggag

SEQ ID NO: 141344 - DNA, 75 bp, Artificial Sequence
  Synthetic
tctacctatcctgcaagctagaaccagaagccaaggtcgccatagagtctctcacagagcggctctatttgggag

SEQ ID NO: 141345 - DNA, 75 bp, Artificial Sequence
  Synthetic
tctacctatcctgcaagctagaaccagaagccaaggtcgccatagagtctctcactgagcggctctatttgggag

SEQ ID NO: 141346 - DNA, 75 bp, Artificial Sequence
  Synthetic
tctacctatcctgcaagctagaaccagaagccaaggtcgccatagagtctctcaccgagcggctctatttgggag

SEQ ID NO: 141347 - DNA, 75 bp, Artificial Sequence
  Synthetic
tctacctatcctgcaagctagaaccagaagccaaggtcgccatagagtctctcacggagcggctctatttgggag

SEQ ID NO: 141348 - DNA, 75 bp, Artificial Sequence
  Synthetic
tctacctatcctgcaagctagaaccagaagccaaggtggccatagagtctctcacagagcggctctatttgggag

SEQ ID NO: 141349 - DNA, 75 bp, Artificial Sequence
  Synthetic
tctacctatcctgcaagctagaaccagaagccaaggtggccatagagtctctcactgagcggctctatttgggag

SEQ ID NO: 141350 - DNA, 75 bp, Artificial Sequence
  Synthetic
tctacctatcctgcaagctagaaccagaagccaaggtggccatagagtctctcaccgagcggctctatttgggag

SEQ ID NO: 141351 - DNA, 75 bp, Artificial Sequence
  Synthetic
tctacctatcctgcaagctagaaccagaagccaaggtggccatagagtctctcacggagcggctctatttgggag

SEQ ID NO: 141352 - DNA, 75 bp, Artificial Sequence
  Synthetic
tctacctatcctgcaagcttgaaccagaagccaaggtagccatagagtctctcacagagcggctctatttgggag

SEQ ID NO: 141353 - DNA, 75 bp, Artificial Sequence
  Synthetic
tctacctatcctgcaagcttgaaccagaagccaaggtagccatagagtctctcactgagcggctctatttgggag

SEQ ID NO: 141354 - DNA, 75 bp, Artificial Sequence
  Synthetic
tctacctatcctgcaagcttgaaccagaagccaaggtagccatagagtctctcaccgagcggctctatttgggag

SEQ ID NO: 141355 - DNA, 75 bp, Artificial Sequence
  Synthetic
tctacctatcctgcaagcttgaaccagaagccaaggtagccatagagtctctcacggagcggctctatttgggag

SEQ ID NO: 141356 - DNA, 75 bp, Artificial Sequence
  Synthetic
tctacctatcctgcaagcttgaaccagaagccaaggttgccatagagtctctcacagagcggctctatttgggag

SEQ ID NO: 141357 - DNA, 75 bp, Artificial Sequence
  Synthetic
tctacctatcctgcaagcttgaaccagaagccaaggttgccatagagtctctcactgagcggctctatttgggag

SEQ ID NO: 141358 - DNA, 75 bp, Artificial Sequence
  Synthetic
tctacctatcctgcaagcttgaaccagaagccaaggttgccatagagtctctcaccgagcggctctatttgggag

SEQ ID NO: 141359 - DNA, 75 bp, Artificial Sequence
  Synthetic
tctacctatcctgcaagcttgaaccagaagccaaggttgccatagagtctctcacggagcggctctatttgggag

SEQ ID NO: 141360 - DNA, 75 bp, Artificial Sequence
  Synthetic
tctacctatcctgcaagcttgaaccagaagccaaggtcgccatagagtctctcacagagcggctctatttgggag

SEQ ID NO: 141361 - DNA, 75 bp, Artificial Sequence
  Synthetic
tctacctatcctgcaagcttgaaccagaagccaaggtcgccatagagtctctcactgagcggctctatttgggag

SEQ ID NO: 141362 - DNA, 75 bp, Artificial Sequence
  Synthetic
tctacctatcctgcaagcttgaaccagaagccaaggtcgccatagagtctctcaccgagcggctctatttgggag

SEQ ID NO: 141363 - DNA, 75 bp, Artificial Sequence
  Synthetic
tctacctatcctgcaagcttgaaccagaagccaaggtcgccatagagtctctcacggagcggctctatttgggag

SEQ ID NO: 141364 - DNA, 75 bp, Artificial Sequence
  Synthetic
tctacctatcctgcaagcttgaaccagaagccaaggtggccatagagtctctcacagagcggctctatttgggag

SEQ ID NO: 141365 - DNA, 75 bp, Artificial Sequence
  Synthetic
tctacctatcctgcaagcttgaaccagaagccaaggtggccatagagtctctcactgagcggctctatttgggag

SEQ ID NO: 141366 - DNA, 75 bp, Artificial Sequence
  Synthetic
tctacctatcctgcaagcttgaaccagaagccaaggtggccatagagtctctcaccgagcggctctatttgggag

SEQ ID NO: 141367 - DNA, 75 bp, Artificial Sequence
  Synthetic
tctacctatcctgcaagcttgaaccagaagccaaggtggccatagagtctctcacggagcggctctatttgggag

SEQ ID NO: 141368 - DNA, 75 bp, Artificial Sequence
  Synthetic
tctacctatcctgcaagctcgaaccagaagccaaggtagccatagagtctctcacagagcggctctatttgggag

SEQ ID NO: 141369 - DNA, 75 bp, Artificial Sequence
  Synthetic
tctacctatcctgcaagctcgaaccagaagccaaggtagccatagagtctctcactgagcggctctatttgggag

SEQ ID NO: 141370 - DNA, 75 bp, Artificial Sequence
  Synthetic
tctacctatcctgcaagctcgaaccagaagccaaggtagccatagagtctctcaccgagcggctctatttgggag

SEQ ID NO: 141371 - DNA, 75 bp, Artificial Sequence
  Synthetic
tctacctatcctgcaagctcgaaccagaagccaaggtagccatagagtctctcacggagcggctctatttgggag

SEQ ID NO: 141372 - DNA, 75 bp, Artificial Sequence
  Synthetic
tctacctatcctgcaagctcgaaccagaagccaaggttgccatagagtctctcacagagcggctctatttgggag

SEQ ID NO: 141373 - DNA, 75 bp, Artificial Sequence
  Synthetic
tctacctatcctgcaagctcgaaccagaagccaaggttgccatagagtctctcactgagcggctctatttgggag

SEQ ID NO: 141374 - DNA, 75 bp, Artificial Sequence
  Synthetic
tctacctatcctgcaagctcgaaccagaagccaaggttgccatagagtctctcaccgagcggctctatttgggag

SEQ ID NO: 141375 - DNA, 75 bp, Artificial Sequence
  Synthetic
tctacctatcctgcaagctcgaaccagaagccaaggttgccatagagtctctcacggagcggctctatttgggag

SEQ ID NO: 141376 - DNA, 75 bp, Artificial Sequence
  Synthetic
tctacctatcctgcaagctcgaaccagaagccaaggtcgccatagagtctctcacagagcggctctatttgggag

SEQ ID NO: 141377 - DNA, 75 bp, Artificial Sequence
  Synthetic
tctacctatcctgcaagctcgaaccagaagccaaggtcgccatagagtctctcactgagcggctctatttgggag

SEQ ID NO: 141378 - DNA, 75 bp, Artificial Sequence
  Synthetic
tctacctatcctgcaagctcgaaccagaagccaaggtcgccatagagtctctcaccgagcggctctatttgggag

SEQ ID NO: 141379 - DNA, 75 bp, Artificial Sequence
  Synthetic
tctacctatcctgcaagctcgaaccagaagccaaggtcgccatagagtctctcacggagcggctctatttgggag

SEQ ID NO: 141380 - DNA, 75 bp, Artificial Sequence
  Synthetic
tctacctatcctgcaagctcgaaccagaagccaaggtggccatagagtctctcacagagcggctctatttgggag

SEQ ID NO: 141381 - DNA, 75 bp, Artificial Sequence
  Synthetic
tctacctatcctgcaagctcgaaccagaagccaaggtggccatagagtctctcactgagcggctctatttgggag

SEQ ID NO: 141382 - DNA, 75 bp, Artificial Sequence
  Synthetic
tctacctatcctgcaagctcgaaccagaagccaaggtggccatagagtctctcaccgagcggctctatttgggag

SEQ ID NO: 141383 - DNA, 75 bp, Artificial Sequence
  Synthetic
tctacctatcctgcaagctcgaaccagaagccaaggtggccatagagtctctcacggagcggctctatttgggag

SEQ ID NO: 141384 - DNA, 75 bp, Artificial Sequence
  Synthetic
tctacctatcctgcaagctggaaccagaagccaaggtagccatagagtctctcacagagcggctctatttgggag

SEQ ID NO: 141385 - DNA, 75 bp, Artificial Sequence
  Synthetic
tctacctatcctgcaagctggaaccagaagccaaggtagccatagagtctctcactgagcggctctatttgggag

SEQ ID NO: 141386 - DNA, 75 bp, Artificial Sequence
  Synthetic
tctacctatcctgcaagctggaaccagaagccaaggtagccatagagtctctcaccgagcggctctatttgggag

SEQ ID NO: 141387 - DNA, 75 bp, Artificial Sequence
  Synthetic
tctacctatcctgcaagctggaaccagaagccaaggtagccatagagtctctcacggagcggctctatttgggag

SEQ ID NO: 141388 - DNA, 75 bp, Artificial Sequence
  Synthetic
tctacctatcctgcaagctggaaccagaagccaaggttgccatagagtctctcacagagcggctctatttgggag

SEQ ID NO: 141389 - DNA, 75 bp, Artificial Sequence
  Synthetic
tctacctatcctgcaagctggaaccagaagccaaggttgccatagagtctctcactgagcggctctatttgggag

SEQ ID NO: 141390 - DNA, 75 bp, Artificial Sequence
  Synthetic
tctacctatcctgcaagctggaaccagaagccaaggttgccatagagtctctcaccgagcggctctatttgggag

SEQ ID NO: 141391 - DNA, 75 bp, Artificial Sequence
  Synthetic
tctacctatcctgcaagctggaaccagaagccaaggttgccatagagtctctcacggagcggctctatttgggag

SEQ ID NO: 141392 - DNA, 75 bp, Artificial Sequence
  Synthetic
tctacctatcctgcaagctggaaccagaagccaaggtcgccatagagtctctcacagagcggctctatttgggag

SEQ ID NO: 141393 - DNA, 75 bp, Artificial Sequence
  Synthetic
tctacctatcctgcaagctggaaccagaagccaaggtcgccatagagtctctcactgagcggctctatttgggag

SEQ ID NO: 141394 - DNA, 75 bp, Artificial Sequence
  Synthetic
tctacctatcctgcaagctggaaccagaagccaaggtcgccatagagtctctcaccgagcggctctatttgggag

SEQ ID NO: 141395 - DNA, 75 bp, Artificial Sequence
  Synthetic
tctacctatcctgcaagctggaaccagaagccaaggtcgccatagagtctctcacggagcggctctatttgggag

SEQ ID NO: 141396 - DNA, 75 bp, Artificial Sequence
  Synthetic
tctacctatcctgcaagctggaaccagaagccaaggtggccatagagtctctcacagagcggctctatttgggag

SEQ ID NO: 141397 - DNA, 75 bp, Artificial Sequence
  Synthetic
tctacctatcctgcaagctggaaccagaagccaaggtggccatagagtctctcactgagcggctctatttgggag

SEQ ID NO: 141398 - DNA, 75 bp, Artificial Sequence
  Synthetic
tctacctatcctgcaagctggaaccagaagccaaggtggccatagagtctctcaccgagcggctctatttgggag

SEQ ID NO: 141399 - DNA, 75 bp, Artificial Sequence
  Synthetic
tctacctatcctgcaagctggaaccagaagccaaggtggccatagagtctctcacggagcggctctatttgggag

SEQ ID NO: 141400 - DNA, 75 bp, Artificial Sequence
  Synthetic
cacatcaacaggacatccctcaattgcaacgacagtctaaacaccgggttccttgctggattaatttactatcat

SEQ ID NO: 141401 - DNA, 75 bp, Artificial Sequence
  Synthetic
ctccatctcctccatgccccccctcgagggggagcctggggatccagacctagagcccgagcaggtagagcccca

SEQ ID NO: 141402 - DNA, 75 bp, Artificial Sequence
  Synthetic
aaaagctgaagcggcctgccgagcagcgggccttaccaactatgacatgatggtctgcggagaagacttggtggt

SEQ ID NO: 141403 - DNA, 75 bp, Artificial Sequence
  Synthetic
aaaagctgaagcggcctgccgagcagcgggccttaccaactatgacatgatggtctgcggagatgacttggtggt

SEQ ID NO: 141404 - DNA, 75 bp, Artificial Sequence
  Synthetic
aaaagctgaagcggcctgccgagcagcgggccttaccaactatgacatgatggtctgcggagacgacttggtggt

SEQ ID NO: 141405 - DNA, 75 bp, Artificial Sequence
  Synthetic
aaaagctgaagcggcctgccgagcagcgggccttaccaactatgacatgatggtctgcggagaggacttggtggt

SEQ ID NO: 141406 - DNA, 75 bp, Artificial Sequence
  Synthetic
aaaagctgaagcggcctgccgagcagcgggccttaccaactatgacatgttggtctgcggagaagacttggtggt

SEQ ID NO: 141407 - DNA, 75 bp, Artificial Sequence
  Synthetic
aaaagctgaagcggcctgccgagcagcgggccttaccaactatgacatgttggtctgcggagatgacttggtggt

SEQ ID NO: 141408 - DNA, 75 bp, Artificial Sequence
  Synthetic
aaaagctgaagcggcctgccgagcagcgggccttaccaactatgacatgttggtctgcggagacgacttggtggt

SEQ ID NO: 141409 - DNA, 75 bp, Artificial Sequence
  Synthetic
aaaagctgaagcggcctgccgagcagcgggccttaccaactatgacatgttggtctgcggagaggacttggtggt

SEQ ID NO: 141410 - DNA, 75 bp, Artificial Sequence
  Synthetic
aaaagctgaagcggcctgccgagcagcgggccttaccaactatgacatgctggtctgcggagaagacttggtggt

SEQ ID NO: 141411 - DNA, 75 bp, Artificial Sequence
  Synthetic
aaaagctgaagcggcctgccgagcagcgggccttaccaactatgacatgctggtctgcggagatgacttggtggt

SEQ ID NO: 141412 - DNA, 75 bp, Artificial Sequence
  Synthetic
aaaagctgaagcggcctgccgagcagcgggccttaccaactatgacatgctggtctgcggagacgacttggtggt

SEQ ID NO: 141413 - DNA, 75 bp, Artificial Sequence
  Synthetic
aaaagctgaagcggcctgccgagcagcgggccttaccaactatgacatgctggtctgcggagaggacttggtggt

SEQ ID NO: 141414 - DNA, 75 bp, Artificial Sequence
  Synthetic
aaaagctgaagcggcctgccgagcagcgggccttaccaactatgacatggtggtctgcggagaagacttggtggt

SEQ ID NO: 141415 - DNA, 75 bp, Artificial Sequence
  Synthetic
aaaagctgaagcggcctgccgagcagcgggccttaccaactatgacatggtggtctgcggagatgacttggtggt

SEQ ID NO: 141416 - DNA, 75 bp, Artificial Sequence
  Synthetic
aaaagctgaagcggcctgccgagcagcgggccttaccaactatgacatggtggtctgcggagacgacttggtggt

SEQ ID NO: 141417 - DNA, 75 bp, Artificial Sequence
  Synthetic
aaaagctgaagcggcctgccgagcagcgggccttaccaactatgacatggtggtctgcggagaggacttggtggt

SEQ ID NO: 141418 - DNA, 75 bp, Artificial Sequence
  Synthetic
aaaagctgaagcggcctgccgagctgcgggccttaccaactatgacatgatggtctgcggagaagacttggtggt

SEQ ID NO: 141419 - DNA, 75 bp, Artificial Sequence
  Synthetic
aaaagctgaagcggcctgccgagctgcgggccttaccaactatgacatgatggtctgcggagatgacttggtggt

SEQ ID NO: 141420 - DNA, 75 bp, Artificial Sequence
  Synthetic
aaaagctgaagcggcctgccgagctgcgggccttaccaactatgacatgatggtctgcggagacgacttggtggt

SEQ ID NO: 141421 - DNA, 75 bp, Artificial Sequence
  Synthetic
aaaagctgaagcggcctgccgagctgcgggccttaccaactatgacatgatggtctgcggagaggacttggtggt

SEQ ID NO: 141422 - DNA, 75 bp, Artificial Sequence
  Synthetic
aaaagctgaagcggcctgccgagctgcgggccttaccaactatgacatgttggtctgcggagaagacttggtggt

SEQ ID NO: 141423 - DNA, 75 bp, Artificial Sequence
  Synthetic
aaaagctgaagcggcctgccgagctgcgggccttaccaactatgacatgttggtctgcggagatgacttggtggt

SEQ ID NO: 141424 - DNA, 75 bp, Artificial Sequence
  Synthetic
aaaagctgaagcggcctgccgagctgcgggccttaccaactatgacatgttggtctgcggagacgacttggtggt

SEQ ID NO: 141425 - DNA, 75 bp, Artificial Sequence
  Synthetic
aaaagctgaagcggcctgccgagctgcgggccttaccaactatgacatgttggtctgcggagaggacttggtggt

SEQ ID NO: 141426 - DNA, 75 bp, Artificial Sequence
  Synthetic
aaaagctgaagcggcctgccgagctgcgggccttaccaactatgacatgctggtctgcggagaagacttggtggt

SEQ ID NO: 141427 - DNA, 75 bp, Artificial Sequence
  Synthetic
aaaagctgaagcggcctgccgagctgcgggccttaccaactatgacatgctggtctgcggagatgacttggtggt

SEQ ID NO: 141428 - DNA, 75 bp, Artificial Sequence
  Synthetic
aaaagctgaagcggcctgccgagctgcgggccttaccaactatgacatgctggtctgcggagacgacttggtggt

SEQ ID NO: 141429 - DNA, 75 bp, Artificial Sequence
  Synthetic
aaaagctgaagcggcctgccgagctgcgggccttaccaactatgacatgctggtctgcggagaggacttggtggt

SEQ ID NO: 141430 - DNA, 75 bp, Artificial Sequence
  Synthetic
aaaagctgaagcggcctgccgagctgcgggccttaccaactatgacatggtggtctgcggagaagacttggtggt

SEQ ID NO: 141431 - DNA, 75 bp, Artificial Sequence
  Synthetic
aaaagctgaagcggcctgccgagctgcgggccttaccaactatgacatggtggtctgcggagatgacttggtggt

SEQ ID NO: 141432 - DNA, 75 bp, Artificial Sequence
  Synthetic
aaaagctgaagcggcctgccgagctgcgggccttaccaactatgacatggtggtctgcggagacgacttggtggt

SEQ ID NO: 141433 - DNA, 75 bp, Artificial Sequence
  Synthetic
aaaagctgaagcggcctgccgagctgcgggccttaccaactatgacatggtggtctgcggagaggacttggtggt

SEQ ID NO: 141434 - DNA, 75 bp, Artificial Sequence
  Synthetic
aaaagctgaagcggcctgccgagccgcgggccttaccaactatgacatgatggtctgcggagaagacttggtggt

SEQ ID NO: 141435 - DNA, 75 bp, Artificial Sequence
  Synthetic
aaaagctgaagcggcctgccgagccgcgggccttaccaactatgacatgatggtctgcggagatgacttggtggt

SEQ ID NO: 141436 - DNA, 75 bp, Artificial Sequence
  Synthetic
aaaagctgaagcggcctgccgagccgcgggccttaccaactatgacatgatggtctgcggagacgacttggtggt

SEQ ID NO: 141437 - DNA, 75 bp, Artificial Sequence
  Synthetic
aaaagctgaagcggcctgccgagccgcgggccttaccaactatgacatgatggtctgcggagaggacttggtggt

SEQ ID NO: 141438 - DNA, 75 bp, Artificial Sequence
  Synthetic
aaaagctgaagcggcctgccgagccgcgggccttaccaactatgacatgttggtctgcggagaagacttggtggt

SEQ ID NO: 141439 - DNA, 75 bp, Artificial Sequence
  Synthetic
aaaagctgaagcggcctgccgagccgcgggccttaccaactatgacatgttggtctgcggagatgacttggtggt

SEQ ID NO: 141440 - DNA, 75 bp, Artificial Sequence
  Synthetic
aaaagctgaagcggcctgccgagccgcgggccttaccaactatgacatgttggtctgcggagacgacttggtggt

SEQ ID NO: 141441 - DNA, 75 bp, Artificial Sequence
  Synthetic
aaaagctgaagcggcctgccgagccgcgggccttaccaactatgacatgttggtctgcggagaggacttggtggt

SEQ ID NO: 141442 - DNA, 75 bp, Artificial Sequence
  Synthetic
aaaagctgaagcggcctgccgagccgcgggccttaccaactatgacatgctggtctgcggagaagacttggtggt

SEQ ID NO: 141443 - DNA, 75 bp, Artificial Sequence
  Synthetic
aaaagctgaagcggcctgccgagccgcgggccttaccaactatgacatgctggtctgcggagatgacttggtggt

SEQ ID NO: 141444 - DNA, 75 bp, Artificial Sequence
  Synthetic
aaaagctgaagcggcctgccgagccgcgggccttaccaactatgacatgctggtctgcggagacgacttggtggt

SEQ ID NO: 141445 - DNA, 75 bp, Artificial Sequence
  Synthetic
aaaagctgaagcggcctgccgagccgcgggccttaccaactatgacatgctggtctgcggagaggacttggtggt

SEQ ID NO: 141446 - DNA, 75 bp, Artificial Sequence
  Synthetic
aaaagctgaagcggcctgccgagccgcgggccttaccaactatgacatggtggtctgcggagaagacttggtggt

SEQ ID NO: 141447 - DNA, 75 bp, Artificial Sequence
  Synthetic
aaaagctgaagcggcctgccgagccgcgggccttaccaactatgacatggtggtctgcggagatgacttggtggt

SEQ ID NO: 141448 - DNA, 75 bp, Artificial Sequence
  Synthetic
aaaagctgaagcggcctgccgagccgcgggccttaccaactatgacatggtggtctgcggagacgacttggtggt

SEQ ID NO: 141449 - DNA, 75 bp, Artificial Sequence
  Synthetic
aaaagctgaagcggcctgccgagccgcgggccttaccaactatgacatggtggtctgcggagaggacttggtggt

SEQ ID NO: 141450 - DNA, 75 bp, Artificial Sequence
  Synthetic
aaaagctgaagcggcctgccgagcggcgggccttaccaactatgacatgatggtctgcggagaagacttggtggt

SEQ ID NO: 141451 - DNA, 75 bp, Artificial Sequence
  Synthetic
aaaagctgaagcggcctgccgagcggcgggccttaccaactatgacatgatggtctgcggagatgacttggtggt

SEQ ID NO: 141452 - DNA, 75 bp, Artificial Sequence
  Synthetic
aaaagctgaagcggcctgccgagcggcgggccttaccaactatgacatgatggtctgcggagacgacttggtggt

SEQ ID NO: 141453 - DNA, 75 bp, Artificial Sequence
  Synthetic
aaaagctgaagcggcctgccgagcggcgggccttaccaactatgacatgatggtctgcggagaggacttggtggt

SEQ ID NO: 141454 - DNA, 75 bp, Artificial Sequence
  Synthetic
aaaagctgaagcggcctgccgagcggcgggccttaccaactatgacatgttggtctgcggagaagacttggtggt

SEQ ID NO: 141455 - DNA, 75 bp, Artificial Sequence
  Synthetic
aaaagctgaagcggcctgccgagcggcgggccttaccaactatgacatgttggtctgcggagatgacttggtggt

SEQ ID NO: 141456 - DNA, 75 bp, Artificial Sequence
  Synthetic
aaaagctgaagcggcctgccgagcggcgggccttaccaactatgacatgttggtctgcggagacgacttggtggt

SEQ ID NO: 141457 - DNA, 75 bp, Artificial Sequence
  Synthetic
aaaagctgaagcggcctgccgagcggcgggccttaccaactatgacatgttggtctgcggagaggacttggtggt

SEQ ID NO: 141458 - DNA, 75 bp, Artificial Sequence
  Synthetic
aaaagctgaagcggcctgccgagcggcgggccttaccaactatgacatgctggtctgcggagaagacttggtggt

SEQ ID NO: 141459 - DNA, 75 bp, Artificial Sequence
  Synthetic
aaaagctgaagcggcctgccgagcggcgggccttaccaactatgacatgctggtctgcggagatgacttggtggt

SEQ ID NO: 141460 - DNA, 75 bp, Artificial Sequence
  Synthetic
aaaagctgaagcggcctgccgagcggcgggccttaccaactatgacatgctggtctgcggagacgacttggtggt

SEQ ID NO: 141461 - DNA, 75 bp, Artificial Sequence
  Synthetic
aaaagctgaagcggcctgccgagcggcgggccttaccaactatgacatgctggtctgcggagaggacttggtggt

SEQ ID NO: 141462 - DNA, 75 bp, Artificial Sequence
  Synthetic
aaaagctgaagcggcctgccgagcggcgggccttaccaactatgacatggtggtctgcggagaagacttggtggt

SEQ ID NO: 141463 - DNA, 75 bp, Artificial Sequence
  Synthetic
aaaagctgaagcggcctgccgagcggcgggccttaccaactatgacatggtggtctgcggagatgacttggtggt

SEQ ID NO: 141464 - DNA, 75 bp, Artificial Sequence
  Synthetic
aaaagctgaagcggcctgccgagcggcgggccttaccaactatgacatggtggtctgcggagacgacttggtggt

SEQ ID NO: 141465 - DNA, 75 bp, Artificial Sequence
  Synthetic
aaaagctgaagcggcctgccgagcggcgggccttaccaactatgacatggtggtctgcggagaggacttggtggt

SEQ ID NO: 141466 - DNA, 75 bp, Artificial Sequence
  Synthetic
acccccttggtaacaggccctactgctggcattacccgcctcaacagtgcaaagttgtgccggcaagtgaggtat

SEQ ID NO: 141467 - DNA, 75 bp, Artificial Sequence
  Synthetic
aggacctcctggaagaccaacatactccaattgacacaactatcatggccaaaaatgaggtgttctgtattgatc

SEQ ID NO: 141468 - DNA, 75 bp, Artificial Sequence
  Synthetic
tggtctgcggagaagacttggtggtcattgccgagagtgccggtgtccaggaggatgcatctagcctaagagctt

SEQ ID NO: 141469 - DNA, 75 bp, Artificial Sequence
  Synthetic
tggtctgcggagatgacttggtggtcattgccgagagtgccggtgtccaggaggatgcatctagcctaagagctt

SEQ ID NO: 141470 - DNA, 75 bp, Artificial Sequence
  Synthetic
tggtctgcggagacgacttggtggtcattgccgagagtgccggtgtccaggaggatgcatctagcctaagagctt

SEQ ID NO: 141471 - DNA, 75 bp, Artificial Sequence
  Synthetic
tggtctgcggagaggacttggtggtcattgccgagagtgccggtgtccaggaggatgcatctagcctaagagctt

SEQ ID NO: 141472 - DNA, 75 bp, Artificial Sequence
  Synthetic
gttcatcttgaactcaacgcggcccccagggggcgcttggttcggatgttcatggatgaattccaccggatttac

SEQ ID NO: 141473 - DNA, 75 bp, Artificial Sequence
  Synthetic
ggcccacgaccatactggacagagatattactacctcacacgagaccctgtcatacctctatctcgggctgcatg

SEQ ID NO: 141474 - DNA, 75 bp, Artificial Sequence
  Synthetic
ggacatgtcaaaaacgggacgatgaggatcgtcggtcctaagacctgcaggaacatgtggagtgggaccttcccc

SEQ ID NO: 141475 - DNA, 75 bp, Artificial Sequence
  Synthetic
gaacatgtggagtgggaccttccccatcaacgcctacaccacgggcccctgtaccccccttcctgcgccgaacta

SEQ ID NO: 141476 - DNA, 75 bp, Artificial Sequence
  Synthetic
aagtgcgggtcaggaccctggctcacgccgaggtgcatggttgattatccatatcggttgtggcactacccctgc

SEQ ID NO: 141477 - DNA, 75 bp, Artificial Sequence
  Synthetic
cagatactccaagcgcaggagcaactagacagggtacttgacttcgatatgtacggagtcacctactccattaat

SEQ ID NO: 141478 - DNA, 75 bp, Artificial Sequence
  Synthetic
ttgagcatagagaccgtgcggatctgtcgcctttgctcctttccaccacgcagtggcaagtacttccttgcagct

SEQ ID NO: 141479 - DNA, 75 bp, Artificial Sequence
  Synthetic
tcagaaagcttggggcccctccattgagagcctggagacatcgagcccgcgcggtccgagcgaagcttatcgccc

SEQ ID NO: 141480 - DNA, 75 bp, Artificial Sequence
  Synthetic
ggcctcttcacacgaggtgccaaacagcagattaatctgatcaacaccaacggcagttggcacatcaatagaacg

SEQ ID NO: 141481 - DNA, 75 bp, Artificial Sequence
  Synthetic
atatgacttggagcttataacatcctgctcctcaaacgtatcggtagcgctggaccctcggggtcgccgccggta

SEQ ID NO: 141482 - DNA, 75 bp, Artificial Sequence
  Synthetic
ggcgcttaaatgggagtacatcgtgcttgccttcctgctgctcgcagatgctaaggtctgcgcatgcctctggat

SEQ ID NO: 141483 - DNA, 75 bp, Artificial Sequence
  Synthetic
gtgcgaaggacgttcgctccttgtccagcagggccattaaccagatccgctccgtctgggaggacttgctggaag

SEQ ID NO: 141484 - DNA, 75 bp, Artificial Sequence
  Synthetic
ttcatctgtgtgacttggtatgtgaaaggcaggcttccagccgccgccacttacgcggcctgcgggatgtggccc

SEQ ID NO: 141485 - DNA, 75 bp, Artificial Sequence
  Synthetic
tcacgctctcaccacgctataaacactacctggccatggtgatgtggtggctccagtacatgatagccagacttg

SEQ ID NO: 141486 - DNA, 75 bp, Artificial Sequence
  Synthetic
accctaccactccacttgcccgggctgcctgggaaacagttagacactcccctgtcaattcatggctgggaaaca

SEQ ID NO: 141487 - DNA, 75 bp, Artificial Sequence
  Synthetic
acaggcagcggcaagagcaccaaggtcccagctgcatacgcagctcagggctataaggtgctagtgctcaacccc

SEQ ID NO: 141488 - DNA, 75 bp, Artificial Sequence
  Synthetic
aacaacaccttgcactgccccactgattgtttccgcaagcatccggaagccacgtactctcggtgcggctccggt

SEQ ID NO: 141489 - DNA, 75 bp, Artificial Sequence
  Synthetic
agtcacaaagtacctcctggctcttctgggccccctttgcctgctccaagcatcattgctgcgcgtcccttacta

SEQ ID NO: 141490 - DNA, 75 bp, Artificial Sequence
  Synthetic
ggttcgcatggtcctgatgacacacttcttctccattctcatggctcaagacaccctggaccagaaccttaattt

SEQ ID NO: 141491 - DNA, 75 bp, Artificial Sequence
  Synthetic
ctgggcgaaggtcctgctggtgctgttgctgtttgctggcgttgatgcggctacttacacctctggggggtccct

SEQ ID NO: 141492 - DNA, 75 bp, Artificial Sequence
  Synthetic
ggaacttacatctacgaccatctggcccccctgtcaggttgggccgcggacggcctcaaagatttggcggtggcc

SEQ ID NO: 141493 - DNA, 75 bp, Artificial Sequence
  Synthetic
cccggctcggcaatgagatcttgcttgggccggctgacacggaggccaggggaggttggagactccttgccccca

SEQ ID NO: 141494 - DNA, 75 bp, Artificial Sequence
  Synthetic
accttctggaagacagtgtaacaccaatagacactaccatcatggctaagaacgaagttttctgcgttcagcctg

SEQ ID NO: 141495 - DNA, 75 bp, Artificial Sequence
  Synthetic
tactccccgctcggtagagcggcacacattagctacactccatagctaactgttttttttttttttttttttttt

SEQ ID NO: 141496 - DNA, 75 bp, Artificial Sequence
  Synthetic
gtccacggccacgcagtcctttttgggcacagcagtcaatggcgtgatgtggaccgtataccatggagcgggcag

SEQ ID NO: 141497 - DNA, 75 bp, Artificial Sequence
  Synthetic
actccgtgtgcctgtggcgcatcggacctgtttctggtcaccaggaacgcggacgttgtgcctgtgcgcaggagg

SEQ ID NO: 141498 - DNA, 75 bp, Artificial Sequence
  Synthetic
tattccgtgcggcggtgtgtacccgaggtgtggcaaaagcagtggactttgtgcctgttgagtccctcgagacct

SEQ ID NO: 141499 - DNA, 75 bp, Artificial Sequence
  Synthetic
gtgtcggcgggaacgacatttatcacagcgtgtcacgtgcccgaacccgccatttgctgctttgcctactcctac

SEQ ID NO: 141500 - DNA, 75 bp, Artificial Sequence
  Synthetic
cgatatccgtacggaggaggcaatctaccaatgttgtgacctggacccccaagcccgcgtggccatcaagtccct

SEQ ID NO: 141501 - DNA, 75 bp, Artificial Sequence
  Synthetic
cactagggtccccgccgcgtatgcggcccagggctataaagtgctggtgctcaacccctcggttgcggccacgct

SEQ ID NO: 141502 - DNA, 75 bp, Artificial Sequence
  Synthetic
aggttttggggcatacatgtccaaggcgcatggcatcgacccaaacatccggtcaggtgtcaggaccattacaac

SEQ ID NO: 141503 - DNA, 75 bp, Artificial Sequence
  Synthetic
tagactgtggcattatccgtgcactgtgaattttaccatcttcaaggtgcggatgtacgtaggaggggtggagca

SEQ ID NO: 141504 - DNA, 75 bp, Artificial Sequence
  Synthetic
actgactcgacaacgatcctcggcataggcacggtcttggaccaagcggagaccgctggagcgcgacttgttgtg

SEQ ID NO: 141505 - DNA, 75 bp, Artificial Sequence
  Synthetic
aggacggcgtgaactatgcaacagggaatctgcccggttgctctttctctatcttcctcttagctttgctgtctt

SEQ ID NO: 141506 - DNA, 75 bp, Artificial Sequence
  Synthetic
ccattcctctggcactaattaagggggggagacatcatatcttttgtcactcaaaaaagaaatgtgacgaggtgg

SEQ ID NO: 141507 - DNA, 75 bp, Artificial Sequence
  Synthetic
ccattcctctggcactaattaagggggggagacatcttatcttttgtcactcaaaaaagaaatgtgacgaggtgg

SEQ ID NO: 141508 - DNA, 75 bp, Artificial Sequence
  Synthetic
ccattcctctggcactaattaagggggggagacatcctatcttttgtcactcaaaaaagaaatgtgacgaggtgg

SEQ ID NO: 141509 - DNA, 75 bp, Artificial Sequence
  Synthetic
ccattcctctggcactaattaagggggggagacatcgtatcttttgtcactcaaaaaagaaatgtgacgaggtgg

SEQ ID NO: 141510 - DNA, 75 bp, Artificial Sequence
  Synthetic
cgaggccttctgggcgaagcatatgtggaacttcatcagtgggatacaatatttggcgggcctgtcaacgttgcc

SEQ ID NO: 141511 - DNA, 75 bp, Artificial Sequence
  Synthetic
cgttcgggagaacaactcctcccgctgctgggtagcgctcacccccacgctcgcggccaggaacgctagcgtccc

SEQ ID NO: 141512 - DNA, 75 bp, Artificial Sequence
  Synthetic
agacgctcttatgacaggctatactggtgactttgactcggtgatagattgtaacacatctgtcatccagacagt

SEQ ID NO: 141513 - DNA, 75 bp, Artificial Sequence
  Synthetic
ggtgactttgactcggtgatagattgtaacacatctgtcatccagacagtcgacttcagcttggatccaaccttt

SEQ ID NO: 141514 - DNA, 75 bp, Artificial Sequence
  Synthetic
gccagcgtcgatgcaaaaacctacaccaccggggggagtgtcgctcagggcgcgtctgggttcgtctcttttctt

SEQ ID NO: 141515 - DNA, 75 bp, Artificial Sequence
  Synthetic
cgggggagagaccgtccggcatgtttgacacctcagtactctgtgaatgctatgatgccggttgcgcctggtacg

SEQ ID NO: 141516 - DNA, 75 bp, Artificial Sequence
  Synthetic
aaccggtgaaggttgggataatcactccggcctcttaggccatctctggtggttttttttttctttttttttttt

SEQ ID NO: 141517 - DNA, 75 bp, Artificial Sequence
  Synthetic
tgcaactgttctatctaccccggccacataacgggtcaccgtatggcatgggatatgatgatgaactggtcccct

SEQ ID NO: 141518 - DNA, 75 bp, Artificial Sequence
  Synthetic
tacaggactaactaatatagacgcccacttcttatcccagactaagcaggcgggagataactacccctacttggt

SEQ ID NO: 141519 - DNA, 75 bp, Artificial Sequence
  Synthetic
cacgaaatggttgttagcgatcctggggcctgcccatcttctcaaagcttctgtactacgggtgccatactttgt

SEQ ID NO: 141520 - DNA, 75 bp, Artificial Sequence
  Synthetic
cctcagaaaacttggggtcccgcccttgcgagcttggagacaccgggcccggagcgtccgcgctaggcttctgtc

SEQ ID NO: 141521 - DNA, 75 bp, Artificial Sequence
  Synthetic
cccactcccctcctctacaggttggggtcagtgcagaatgaagtaacactcacccatcctatcacaaaatacatc

SEQ ID NO: 141522 - DNA, 75 bp, Artificial Sequence
  Synthetic
aacttctgtcttcacgcggaaagcgtctagccatggcgttagtacgagtgtcgtgcagcctccaggaccccccct

SEQ ID NO: 141523 - DNA, 75 bp, Artificial Sequence
  Synthetic
gcgtcgtgatcgtcgggagggttgtcctatcgggccagcctgctatcatccccgaccgagaggtgctttatcaac

SEQ ID NO: 141524 - DNA, 75 bp, Artificial Sequence
  Synthetic
ttgcgttcgcgagggtaacacctcgaggtgttgggtggcggtgacccccacggtggccaccagggacggcagact

SEQ ID NO: 141525 - DNA, 75 bp, Artificial Sequence
  Synthetic
atggcgtccgggttctggaagacggcgtgaactatgcaacagggaatcttcccggttgctctttctctatcttcc

SEQ ID NO: 141526 - DNA, 75 bp, Artificial Sequence
  Synthetic
tgggtacccttggcccctctatggtaacgagggctgcgggtgggcagggtggctcctgtccccacgcggctcccg

SEQ ID NO: 141527 - DNA, 75 bp, Artificial Sequence
  Synthetic
caccgctggcaaccaagcaatagaggctaagcccttggtacagtccactttcagcaagctcgaacagttttgggc

SEQ ID NO: 141528 - DNA, 75 bp, Artificial Sequence
  Synthetic
gcagtcacaagtcccttgacgacccaacagaccctcctctttaatatcttaggagggtgggtagccgcacagatc

SEQ ID NO: 141529 - DNA, 75 bp, Artificial Sequence
  Synthetic
gctatggggccggcgtagctggggctgtggtcacctttaagatcatgagtggtgaaacaccatcaacagaggacc

SEQ ID NO: 141530 - DNA, 75 bp, Artificial Sequence
  Synthetic
caacgactgtcccaatagcagtattgtgtatgaggctgatgacgttattctgcacacacccggctgtgtaccttg

SEQ ID NO: 141531 - DNA, 75 bp, Artificial Sequence
  Synthetic
tatagggtcagcggttgtctcctttgcaatcaagtgggagtatgtcctgttgctcttccttctcctggcggacgc

SEQ ID NO: 141532 - DNA, 75 bp, Artificial Sequence
  Synthetic
caccgcttcgatacgtgatcatgtggacctattagtaggcgcagccacgatgtgttctgcactctacgtgggcga

SEQ ID NO: 141533 - DNA, 75 bp, Artificial Sequence
  Synthetic
tgtgcagtggatgaatcgtctcattgcgttcgcatcgcgaggcaatcacgtatctcccacgcactacgttcccga

SEQ ID NO: 141534 - DNA, 75 bp, Artificial Sequence
  Synthetic
atgctgctgataacccaggctgaggccgccttagagaacctggtggtcctcaatgcagcgtccgtggccggagcg

SEQ ID NO: 141535 - DNA, 75 bp, Artificial Sequence
  Synthetic
gcttcagtatttcctgaccagagtagaagcgcaactgcacacgtgggttccccccctcaacgtccggggggggcg

SEQ ID NO: 141536 - DNA, 75 bp, Artificial Sequence
  Synthetic
ggacaagccttcacgttcagaccccgttaccatcaaacggtccagacctgcaactgctcactatacccaggccac

SEQ ID NO: 141537 - DNA, 75 bp, Artificial Sequence
  Synthetic
gggtagcgggagcgcttgtggccttcaagatcatgagcggcgaggtcccttccaccgaggacctggtcaatttac

SEQ ID NO: 141538 - DNA, 75 bp, Artificial Sequence
  Synthetic
tcttttgtgctgcctggtacatcaagggcaggctggtccctggggcggcatatgctttttatggcgtatggccgc

SEQ ID NO: 141539 - DNA, 75 bp, Artificial Sequence
  Synthetic
tcgcaccgggcgccaagcagaacgtccagctggtcaactccaacggcagttggcatatcaatagcacggccctga

SEQ ID NO: 141540 - DNA, 75 bp, Artificial Sequence
  Synthetic
ccgtgtggcacctcatggctctgggaaatctgggactgggtctgcacagtactgagtgacttcaaaacgtggctt

SEQ ID NO: 141541 - DNA, 75 bp, Artificial Sequence
  Synthetic
tggcatatcaatagcacggccctgaactgtaatgacagcctcaacaccggctggctagcagggctcttctactac

SEQ ID NO: 141542 - DNA, 75 bp, Artificial Sequence
  Synthetic
actgtaatgacagcctcaacaccggctggctagcagggctcttctactaccacaaattcaactcttcaggctgtc

SEQ ID NO: 141543 - DNA, 75 bp, Artificial Sequence
  Synthetic
atgcgcctcccggggcgcgttcccttacaccatgcacctgcggtagctcggacctctatctggtcacgagacatg

SEQ ID NO: 141544 - DNA, 75 bp, Artificial Sequence
  Synthetic
gcccttgcggtgcagagatagccggtcacatcaaaaacggctcaatgaggatcgttgggccgaagacctgtagca

SEQ ID NO: 141545 - DNA, 75 bp, Artificial Sequence
  Synthetic
atacctggcatggcaccttccccatcaatgcgtataccaccggtcctggcgtacccatcccggggccgaactaca

SEQ ID NO: 141546 - DNA, 75 bp, Artificial Sequence
  Synthetic
gacatcaccaaactgctgctggccgtcttcggacccctctggattcttcaagccagtttgcttaaagtgccctac

SEQ ID NO: 141547 - DNA, 75 bp, Artificial Sequence
  Synthetic
ctggttaacaccaatggctcgtggcacatcaacagcaccgccttgaactgtaacgattccataaacactgggttc

SEQ ID NO: 141548 - DNA, 75 bp, Artificial Sequence
  Synthetic
cccctgccaggttcctgctcctgaattcttcacggaggtggatggtgtcaggctccaccgtcacgcccccagttg

SEQ ID NO: 141549 - DNA, 75 bp, Artificial Sequence
  Synthetic
tggcactacccacctagaccttgtggaatcgtcccggcagcgagtgtctgcggccccgtatactgtttcacacca

SEQ ID NO: 141550 - DNA, 75 bp, Artificial Sequence
  Synthetic
gggcccacgcgggcctacgagaccttgcggtggcagtagagcccgtcgtcttctctgacatggagactaagatca

SEQ ID NO: 141551 - DNA, 75 bp, Artificial Sequence
  Synthetic
ctgacatccatgctgacggacccatcccacataactgctgagacagcgcgccggcgactaggtagggggtctcca

SEQ ID NO: 141552 - DNA, 75 bp, Artificial Sequence
  Synthetic
gtggatgaattccacggggtttctcaagacgtgcggggcccccccttgtaatatctatgggggtgagaaaaggga

SEQ ID NO: 141553 - DNA, 75 bp, Artificial Sequence
  Synthetic
caaatcttatatggggcaataaagtaaccagggttgagtctgagagcaaggtgctagtgctcgattcattcgaac

SEQ ID NO: 141554 - DNA, 75 bp, Artificial Sequence
  Synthetic
caaatcttttatggggcaataaagtaaccagggttgagtctgagagcaaggtgctagtgctcgattcattcgaac

SEQ ID NO: 141555 - DNA, 75 bp, Artificial Sequence
  Synthetic
caaatcttctatggggcaataaagtaaccagggttgagtctgagagcaaggtgctagtgctcgattcattcgaac

SEQ ID NO: 141556 - DNA, 75 bp, Artificial Sequence
  Synthetic
caaatcttgtatggggcaataaagtaaccagggttgagtctgagagcaaggtgctagtgctcgattcattcgaac

SEQ ID NO: 141557 - DNA, 75 bp, Artificial Sequence
  Synthetic
tggcaacgtgcatcaatggggtatgctggactgtctaccacggggccggaacgaggaccatcgcatcacccaagg

SEQ ID NO: 141558 - DNA, 75 bp, Artificial Sequence
  Synthetic
cctcgatgcatggttgattacccataccggctttggcattacccgtgcaccgtcaactatacactgtttaaggtg

SEQ ID NO: 141559 - DNA, 75 bp, Artificial Sequence
  Synthetic
cgctattgcatcattgatggcttttacagctgccgtcaccagcccactaaccactagccagactctcctcttcaa

SEQ ID NO: 141560 - DNA, 75 bp, Artificial Sequence
  Synthetic
tgactacaatccaccgttagtcgaaacgtggaaacgacccgactacaagcctccggtcgtccacggttgcgctct

SEQ ID NO: 141561 - DNA, 75 bp, Artificial Sequence
  Synthetic
aggatgtttgtgggtgggcttgaacaccggttcgacgccgcttgcaattggaccaggggagagcgctgcgatatc

SEQ ID NO: 141562 - DNA, 75 bp, Artificial Sequence
  Synthetic
aagtccttcggcccgccaaaggccgaaactgactccggggcgtatctcacaacatcaacagacacttctgacccg

SEQ ID NO: 141563 - DNA, 75 bp, Artificial Sequence
  Synthetic
ggtccaccgttagcggttcggaggacgtcgtgtgttgttcaatgtcctactcatggacaggggcgctggtaacac

SEQ ID NO: 141564 - DNA, 75 bp, Artificial Sequence
  Synthetic
cctacggcaagttccttgccgacggcgggtgctcagggggcgcctatgacataataatttgtgacgagtgccact

SEQ ID NO: 141565 - DNA, 75 bp, Artificial Sequence
  Synthetic
aatgcggcagaagaaagtcaccttcgaccgcatgcaagtggtggacagtcactaccatgcagtacttaaggagat

SEQ ID NO: 141566 - DNA, 75 bp, Artificial Sequence
  Synthetic
aggtccactatatctaatacaggcagcccttactattaccccctacttcgtgcgtgcacatatactggttcgcct

SEQ ID NO: 141567 - DNA, 75 bp, Artificial Sequence
  Synthetic
gcccttactattaccccctacttcgtgcgtgcacatatactggttcgcctttgtatgttcgtgcgcactgtgacg

SEQ ID NO: 141568 - DNA, 75 bp, Artificial Sequence
  Synthetic
cggacttaagcgttcgggtgtgcgagaagagagcgctgtatgaagtcgtcaaaaaactcgccgacgccacaatgg

SEQ ID NO: 141569 - DNA, 75 bp, Artificial Sequence
  Synthetic
cggacttatgcgttcgggtgtgcgagaagagagcgctgtatgaagtcgtcaaaaaactcgccgacgccacaatgg

SEQ ID NO: 141570 - DNA, 75 bp, Artificial Sequence
  Synthetic
cggacttacgcgttcgggtgtgcgagaagagagcgctgtatgaagtcgtcaaaaaactcgccgacgccacaatgg

SEQ ID NO: 141571 - DNA, 75 bp, Artificial Sequence
  Synthetic
cggacttaggcgttcgggtgtgcgagaagagagcgctgtatgaagtcgtcaaaaaactcgccgacgccacaatgg

SEQ ID NO: 141572 - DNA, 75 bp, Artificial Sequence
  Synthetic
ctatgacgcgggttgtgcttggtatgagctcacacccgccgagaccacagtcaggctacgagcatacatgaacac

SEQ ID NO: 141573 - DNA, 75 bp, Artificial Sequence
  Synthetic
gcccaaactggggcccaaacgacccccggcgcagatcccgcaatttaggtaaagtcatcgacaccttgacttgcg

SEQ ID NO: 141574 - DNA, 75 bp, Artificial Sequence
  Synthetic
cgcgctagcggcgtatttaccaccagtttcgggaacacactgacttgctaccttaaggcgtccgcggccattaag

SEQ ID NO: 141575 - DNA, 75 bp, Artificial Sequence
  Synthetic
aaactatgcaacagggaaccttcctggttgctccttttctatcttccttctagcacttctttcgtgcttgaccgt

SEQ ID NO: 141576 - DNA, 75 bp, Artificial Sequence
  Synthetic
ggacacttgcgggcgttaaacatcctgcgctccaaatgtacacaaatgtagaccaggatctcgtcgggtggccag

SEQ ID NO: 141577 - DNA, 75 bp, Artificial Sequence
  Synthetic
ccttcacggaggctatgacgaggtactcagcgccccccggagacgcccctcaaccagcttatgacctcgagctca

SEQ ID NO: 141578 - DNA, 75 bp, Artificial Sequence
  Synthetic
acctgacagggaagtcctctaccgggagttcgatgagatggaagagtgctctcagcacttgccgtacatcgagca

SEQ ID NO: 141579 - DNA, 75 bp, Artificial Sequence
  Synthetic
ttacacttgcccgggtgcataccgtgtgttaggactgagaataattccaaatgctgggttgcagccacacccacg

SEQ ID NO: 141580 - DNA, 75 bp, Artificial Sequence
  Synthetic
ggtagcacatgatgctgcaggcaagagggtctactatctgacccgcgaccctgaaactcccctggcgagagccgc

SEQ ID NO: 141581 - DNA, 75 bp, Artificial Sequence
  Synthetic
cccggaagaagcggacggtggtccttaccgactcaactgtgtccactgccttggccgagcttgccactaagagct

SEQ ID NO: 141582 - DNA, 75 bp, Artificial Sequence
  Synthetic
atttgtgcggaggtgtcttcctcgcaggtcaactcttcacattccgccctcgcgtacaccaaactgtgcagggct

SEQ ID NO: 141583 - DNA, 75 bp, Artificial Sequence
  Synthetic
cctgaggacgccgcagatcttgctcgacattttcatcggtggtcactggggcatcattggtgccgtgctgtacta

SEQ ID NO: 141584 - DNA, 75 bp, Artificial Sequence
  Synthetic
caacggcagttggcacatcaataggacggccttgaactgcaatgacagcctccacaccggctgggtagcagggct

SEQ ID NO: 141585 - DNA, 75 bp, Artificial Sequence
  Synthetic
tgctccgggggagcatatgatgtgatcatctgtgatgaatgtcacgctcaggacgctactagcatattgggtata

SEQ ID NO: 141586 - DNA, 75 bp, Artificial Sequence
  Synthetic
cacacactcacatcaatgttcaatcaaggcccctctcaaaccatccagctcatcaacaccaacggtagctggcac

SEQ ID NO: 141587 - DNA, 75 bp, Artificial Sequence
  Synthetic
cacacactcacatcaatgttcaatctaggcccctctcaaaccatccagctcatcaacaccaacggtagctggcac

SEQ ID NO: 141588 - DNA, 75 bp, Artificial Sequence
  Synthetic
cacacactcacatcaatgttcaatccaggcccctctcaaaccatccagctcatcaacaccaacggtagctggcac

SEQ ID NO: 141589 - DNA, 75 bp, Artificial Sequence
  Synthetic
cacacactcacatcaatgttcaatcgaggcccctctcaaaccatccagctcatcaacaccaacggtagctggcac

SEQ ID NO: 141590 - DNA, 75 bp, Artificial Sequence
  Synthetic
accggcgacttcgactcggtgatagattgcaacacatgtgtcacccagacagtcgatttcagccttgaccctacc

SEQ ID NO: 141591 - DNA, 75 bp, Artificial Sequence
  Synthetic
ctccgaccttagggtccttctgtttcgaacactccacttcctgttcctaacactccgacctcagggtctcgattt

SEQ ID NO: 141592 - DNA, 75 bp, Artificial Sequence
  Synthetic
ggatggccgcctgcagggacctgggctatttccatcagggctggggccctattacctacgctaacatcagtggcc

SEQ ID NO: 141593 - DNA, 75 bp, Artificial Sequence
  Synthetic
ccccgtggtgctgggcaccactgaccggagaggcaaaccgacctatacctggggggagaacgagaccgatgtttt

SEQ ID NO: 141594 - DNA, 75 bp, Artificial Sequence
  Synthetic
tgtttgggactggatatgcacggtgttgactgacttcaagacctggctccaatccaagctcctgccgcggttacc

SEQ ID NO: 141595 - DNA, 75 bp, Artificial Sequence
  Synthetic
tgcagcagagatcctgcgaaaatccaagaagttcccccccgcgttgcccatatgggcacgcccggattacaaccc

SEQ ID NO: 141596 - DNA, 75 bp, Artificial Sequence
  Synthetic
atcaggcctgcccccaatgagacagatccacggaccctgaggtgccccacagactgcttccgaaaacatccagaa

SEQ ID NO: 141597 - DNA, 75 bp, Artificial Sequence
  Synthetic
atcaggcctgcccccaatgagacagatccacggaccctgaggtgccccactgactgcttccgaaaacatccagaa

SEQ ID NO: 141598 - DNA, 75 bp, Artificial Sequence
  Synthetic
atcaggcctgcccccaatgagacagatccacggaccctgaggtgccccaccgactgcttccgaaaacatccagaa

SEQ ID NO: 141599 - DNA, 75 bp, Artificial Sequence
  Synthetic
atcaggcctgcccccaatgagacagatccacggaccctgaggtgccccacggactgcttccgaaaacatccagaa

SEQ ID NO: 141600 - DNA, 75 bp, Artificial Sequence
  Synthetic
tgacgcaggttgctcgtggtatgacttgcagcccgctgagaccacagtcagactgagagcttacttatccacgcc

SEQ ID NO: 141601 - DNA, 75 bp, Artificial Sequence
  Synthetic
gcccatgccaggtcccatcgcccgaatttttcacagaactggacggggtgcgcctgcataggttcgcgccccctt

SEQ ID NO: 141602 - DNA, 75 bp, Artificial Sequence
  Synthetic
ccattcactcggttcggatgtatgtggccggagttgagcacaggttcgacgccgcctgcaactggacgcgaggcg

SEQ ID NO: 141603 - DNA, 75 bp, Artificial Sequence
  Synthetic
ttccgccatgtacgtgggggatctctgcggatctgttttcctcgtctcccagctgttcaccttctcgcctcgccg

SEQ ID NO: 141604 - DNA, 75 bp, Artificial Sequence
  Synthetic
ggcgctgtccacgggcttaatacacctccaccagaatgtggtggacgtacagtatctgtacggtgtgtcgagctc

SEQ ID NO: 141605 - DNA, 75 bp, Artificial Sequence
  Synthetic
cctggttgggtcacaactcccatgtgaacccgaaccggatgtagcagtgctcacttccatgctcaccgacccctc

SEQ ID NO: 141606 - DNA, 75 bp, Artificial Sequence
  Synthetic
ggccaagctgaggcagcgttagaaaacctcatagttctcaacgctgcttcagcttcggcaacccatgggtggtgg

SEQ ID NO: 141607 - DNA, 75 bp, Artificial Sequence
  Synthetic
tcctcctactgcccccccgagcctacgcctacgacgctgcacaagcaacgtcgattggcgttagtgttattctgg

SEQ ID NO: 141608 - DNA, 75 bp, Artificial Sequence
  Synthetic
gatccagtacctggcaggcctctccactctgcccggcaaccctgctgtggcgtctcttatggcgttcactgcttc

SEQ ID NO: 141609 - DNA, 75 bp, Artificial Sequence
  Synthetic
ccaatgggtcccgtcccttcgcgtgcgtgggggccgagatgcaatcatcttacttacctgtctacttcatccagc

SEQ ID NO: 141610 - DNA, 75 bp, Artificial Sequence
  Synthetic
ccaatgggtcccgtcccttcgcgtgcgtgggggccgtgatgcaatcatcttacttacctgtctacttcatccagc

SEQ ID NO: 141611 - DNA, 75 bp, Artificial Sequence
  Synthetic
ccaatgggtcccgtcccttcgcgtgcgtgggggccgcgatgcaatcatcttacttacctgtctacttcatccagc

SEQ ID NO: 141612 - DNA, 75 bp, Artificial Sequence
  Synthetic
ccaatgggtcccgtcccttcgcgtgcgtgggggccgggatgcaatcatcttacttacctgtctacttcatccagc

SEQ ID NO: 141613 - DNA, 75 bp, Artificial Sequence
  Synthetic
acgcacctcaaccgtgtggtatcgtacccgcgttgcaggtgtgtggtccagtgtattgcttcaccccaagccccg

SEQ ID NO: 141614 - DNA, 75 bp, Artificial Sequence
  Synthetic
actgggcgcacaacggcctgcgagatctggccgtggctgtagagccagtcgtcttctcccaaatggagaccaagc

SEQ ID NO: 141615 - DNA, 75 bp, Artificial Sequence
  Synthetic
gcgctcgtgcgcttgtgtatgctcgttaagcgtctggcaggagggaagtactttcaagctgcactcctcaaggtt

SEQ ID NO: 141616 - DNA, 75 bp, Artificial Sequence
  Synthetic
tcttctctcccatggagaagaaggtcattacatggggggcggacacggctgcctgtggtgacattctcgcaggcc

SEQ ID NO: 141617 - DNA, 75 bp, Artificial Sequence
  Synthetic
gcagcaaacgcgtgggctgctgggcacaatagtgactagcctcactggtcgtgataggaatgaggtggcgggcga

SEQ ID NO: 141618 - DNA, 75 bp, Artificial Sequence
  Synthetic
ggccccaaggggcccatctgtcaaatgtacaccaatgtggatcaagacatggtgggctggcctgctccgcccggg

SEQ ID NO: 141619 - DNA, 75 bp, Artificial Sequence
  Synthetic
agttcctggtgaatgcctggaaatcaaagaaatgccctatgggcttctcatatgacacccgctgttttgactcaa

SEQ ID NO: 141620 - DNA, 75 bp, Artificial Sequence
  Synthetic
tgcaggaccgcggacatgtgctaacatgtggcacggcacctttcccatcaatgagtacaccaccggacccggcac

SEQ ID NO: 141621 - DNA, 75 bp, Artificial Sequence
  Synthetic
ctggcctcctcagtccgcggccgataagcacactcaagggatcctccgggggtccactcctttgtgcgtcaggcc

SEQ ID NO: 141622 - DNA, 75 bp, Artificial Sequence
  Synthetic
ctggcctcctcagtccgcggccgataagcacactcaagggttcctccgggggtccactcctttgtgcgtcaggcc

SEQ ID NO: 141623 - DNA, 75 bp, Artificial Sequence
  Synthetic
ctggcctcctcagtccgcggccgataagcacactcaagggctcctccgggggtccactcctttgtgcgtcaggcc

SEQ ID NO: 141624 - DNA, 75 bp, Artificial Sequence
  Synthetic
ctggcctcctcagtccgcggccgataagcacactcaaggggtcctccgggggtccactcctttgtgcgtcaggcc

SEQ ID NO: 141625 - DNA, 75 bp, Artificial Sequence
  Synthetic
ttcagactggctggatagcagggcttttctattacaacaaattcaactcttcaggctgtcccgagaggttggcca

SEQ ID NO: 141626 - DNA, 75 bp, Artificial Sequence
  Synthetic
cgcttcggcctacaactatcgcaacagctcgggtgtctaccatgtcaccaacgactgcccgaactcgagcatagt

SEQ ID NO: 141627 - DNA, 75 bp, Artificial Sequence
  Synthetic
cttgctcctgctggcgttaccaccacgggcatacgccatggaccgagagatggctgcatcatgcgggggcgcggt

SEQ ID NO: 141628 - DNA, 75 bp, Artificial Sequence
  Synthetic
ctctttcactgacaactcttcgccaccagccgtgccccagacctaccaagttgggtacctccatgcacccacggg

SEQ ID NO: 141629 - DNA, 75 bp, Artificial Sequence
  Synthetic
tacctgagcaaggcctatggtatcgatcctaacattagaactggggttaggaccatcacaacaggaggccctatt

SEQ ID NO: 141630 - DNA, 75 bp, Artificial Sequence
  Synthetic
tccgctcatggtgctccaagccggcctaatcagagtgccgtacttcgtgcgcgcgcaagggctcgtgcgtgcatg

SEQ ID NO: 141631 - DNA, 75 bp, Artificial Sequence
  Synthetic
cagtattggggataggaactgtgctggaccaagcggagacggccggttgtcgccttacggttttagccactgcta

SEQ ID NO: 141632 - DNA, 75 bp, Artificial Sequence
  Synthetic
ttctggttggcatagcgtacttcagcatgcaagctaattgggccaaagtcatcctggtcctgtttctcttcgctg

SEQ ID NO: 141633 - DNA, 75 bp, Artificial Sequence
  Synthetic
gtacatcaaggggggcaggcacttaatcttttgtcaatctaaaaagaagtgcgacgagctcgccgggcaactcag

SEQ ID NO: 141634 - DNA, 75 bp, Artificial Sequence
  Synthetic
gtacatcaaggggggcaggcacttaatcttttgtcattctaaaaagaagtgcgacgagctcgccgggcaactcag

SEQ ID NO: 141635 - DNA, 75 bp, Artificial Sequence
  Synthetic
gtacatcaaggggggcaggcacttaatcttttgtcactctaaaaagaagtgcgacgagctcgccgggcaactcag

SEQ ID NO: 141636 - DNA, 75 bp, Artificial Sequence
  Synthetic
gtacatcaaggggggcaggcacttaatcttttgtcagtctaaaaagaagtgcgacgagctcgccgggcaactcag

SEQ ID NO: 141637 - DNA, 75 bp, Artificial Sequence
  Synthetic
agggtggccgcatgcctcaggaaacttggggtaccgcccttgcgagcttggagacaccgggcccggagcgtccgc

SEQ ID NO: 141638 - DNA, 75 bp, Artificial Sequence
  Synthetic
cattaacaccaatgggagctggcacatcaacaggaccgccctcaattgtaacgacagcctgaacacaggattcat

SEQ ID NO: 141639 - DNA, 75 bp, Artificial Sequence
  Synthetic
gctagcggaaaaagcatttccatcctcgaaaccgcaggaggagagtagctcatcttcaggggtcgatacacagtc

SEQ ID NO: 141640 - DNA, 75 bp, Artificial Sequence
  Synthetic
ggctagccagctgcagcggccttgacagcctcccacaaggctggggccctcttgggacttatcaggctaatgagt

SEQ ID NO: 141641 - DNA, 75 bp, Artificial Sequence
  Synthetic
acagggtacacgggtgattttgacagcgtgatagactgcaacgttgcagtaacgcaagttgtcgacttcagcttg

SEQ ID NO: 141642 - DNA, 75 bp, Artificial Sequence
  Synthetic
ggcatctacctccttcccaaccgatgaaggttgggataaacactccggcctcttaggccatttctgttttttttt

SEQ ID NO: 141643 - DNA, 75 bp, Artificial Sequence
  Synthetic
ggtacgtctcgcaaggagaacgaccgtcgggaatgttcgacacggtcgtcctatgcgaggcatatgacactggag

SEQ ID NO: 141644 - DNA, 75 bp, Artificial Sequence
  Synthetic
ggtgcttggtttggctgcacgtggatgaacggcacagggtttacaaaatcctgcggcggccctccctgcagtgta

SEQ ID NO: 141645 - DNA, 75 bp, Artificial Sequence
  Synthetic
ggaggcagttttcaccggacttacacacatagacgcccactttctgtcccagacaaagcaggggggggaaaactt

SEQ ID NO: 141646 - DNA, 75 bp, Artificial Sequence
  Synthetic
tgtatgtcggcgggatagagcatcggctggacgtggcctgcaactggaccagaggagagccctgcgacctggaac

SEQ ID NO: 141647 - DNA, 75 bp, Artificial Sequence
  Synthetic
accttgaatgggcccactccattactatacagactgggtggtgtgcaaaatgagataacaacaacacatcctgtc

SEQ ID NO: 141648 - DNA, 75 bp, Artificial Sequence
  Synthetic
accttgaatgggcccactccattactatacagtctgggtggtgtgcaaaatgagataacaacaacacatcctgtc

SEQ ID NO: 141649 - DNA, 75 bp, Artificial Sequence
  Synthetic
accttgaatgggcccactccattactatacagcctgggtggtgtgcaaaatgagataacaacaacacatcctgtc

SEQ ID NO: 141650 - DNA, 75 bp, Artificial Sequence
  Synthetic
accttgaatgggcccactccattactatacaggctgggtggtgtgcaaaatgagataacaacaacacatcctgtc

SEQ ID NO: 141651 - DNA, 75 bp, Artificial Sequence
  Synthetic
ttcggacgtctaccacatcactaacgactgtccgaattccagcatagtctatgaatccgagcaccacatcttaca

SEQ ID NO: 141652 - DNA, 75 bp, Artificial Sequence
  Synthetic
gactgtccgaattccagcatagtctatgaatccgagcaccacatcttacatcttccggggtgtgtaccctgtgtg

SEQ ID NO: 141653 - DNA, 75 bp, Artificial Sequence
  Synthetic
tgacagtgggcagcgtagtcatctgcgggaggatcaccacctcaggaaaacctgccgttgtgccagatagggagg

SEQ ID NO: 141654 - DNA, 75 bp, Artificial Sequence
  Synthetic
tgacagtgggcagcgtagtcatctgcgggaggatcaccacctctggaaaacctgccgttgtgccagatagggagg

SEQ ID NO: 141655 - DNA, 75 bp, Artificial Sequence
  Synthetic
tgacagtgggcagcgtagtcatctgcgggaggatcaccacctccggaaaacctgccgttgtgccagatagggagg

SEQ ID NO: 141656 - DNA, 75 bp, Artificial Sequence
  Synthetic
tgacagtgggcagcgtagtcatctgcgggaggatcaccacctcgggaaaacctgccgttgtgccagatagggagg

SEQ ID NO: 141657 - DNA, 75 bp, Artificial Sequence
  Synthetic
taagtgggagtacattgtgcttgctttcctgctgttggcagacgccaagctctgtgcgtgcttgtggatgatgct

SEQ ID NO: 141658 - DNA, 75 bp, Artificial Sequence
  Synthetic
tctgtgcgtgcttgtggatgatgctgctggtttcgcaggtcgaggcagcgctcgccaacttgatcaccatcaatg

SEQ ID NO: 141659 - DNA, 75 bp, Artificial Sequence
  Synthetic
cggcttaattcaggctacaacaaagcaggccgaggagctcaagccggcggtccactctgcttggcctaagctcga

SEQ ID NO: 141660 - DNA, 75 bp, Artificial Sequence
  Synthetic
cgggccacaggatggcttgggacatgatgatgaactggagccccaccacaacgctaatcctcgcccagatcatga

SEQ ID NO: 141661 - DNA, 75 bp, Artificial Sequence
  Synthetic
tcattcacagcatctctaaccagtccactcacaacatcacagaccctcctcctgaacgtattgggagggtgggtc

SEQ ID NO: 141662 - DNA, 75 bp, Artificial Sequence
  Synthetic
tttggtcctgttcctgtttgctggagtagacgccaatacccacgtcaccggggggtccatggcccgaggcaccaa

SEQ ID NO: 141663 - DNA, 75 bp, Artificial Sequence
  Synthetic
acatccttgccgggtatggcgctggtgtttcgggtgctcttgtggcttttaagatcatgagcggcgaggccccgt

SEQ ID NO: 141664 - DNA, 75 bp, Artificial Sequence
  Synthetic
tcccacacgtggcatttgaaaccacaaaacatctccttgccatccttggtcctttgtacatactccaagcctcac

SEQ ID NO: 141665 - DNA, 75 bp, Artificial Sequence
  Synthetic
aaaacatctccttgccatccttggtcctttgtacatactccaagcctcactcctgcgcgtcccttacttcgtgag

SEQ ID NO: 141666 - DNA, 75 bp, Artificial Sequence
  Synthetic
gacagcctcaacacgggtttcatagctggcttgctttactaccataagtttaacagctctgggtgccctgaaaga

SEQ ID NO: 141667 - DNA, 75 bp, Artificial Sequence
  Synthetic
tagcgagggggctgtccagtggatgaaccgcttgatagccttcgcgtcacggggtaatcatgtgtcgcccactca

SEQ ID NO: 141668 - DNA, 75 bp, Artificial Sequence
  Synthetic
caccacaaccgtgcgaagaggtgaacgcatccacggtgtgtggccccgtgtattgcttcacgcctagtcctgtgg

SEQ ID NO: 141669 - DNA, 75 bp, Artificial Sequence
  Synthetic
ttgaactgcaatgctagccttagcaccggctggatagcaggccttttctattacaacaagttcaactcttcaggc

SEQ ID NO: 141670 - DNA, 75 bp, Artificial Sequence
  Synthetic
gattacgccacaccatgagggtcaacgtggatgagggacatctgggactgggtgtgcacagttttatctgacttc

SEQ ID NO: 141671 - DNA, 75 bp, Artificial Sequence
  Synthetic
gattacgccacaccatgagggtcaacgtggttgagggacatctgggactgggtgtgcacagttttatctgacttc

SEQ ID NO: 141672 - DNA, 75 bp, Artificial Sequence
  Synthetic
gattacgccacaccatgagggtcaacgtggctgagggacatctgggactgggtgtgcacagttttatctgacttc

SEQ ID NO: 141673 - DNA, 75 bp, Artificial Sequence
  Synthetic
gattacgccacaccatgagggtcaacgtgggtgagggacatctgggactgggtgtgcacagttttatctgacttc

SEQ ID NO: 141674 - DNA, 75 bp, Artificial Sequence
  Synthetic
gattacgccacaccatgtgggtcaacgtggatgagggacatctgggactgggtgtgcacagttttatctgacttc

SEQ ID NO: 141675 - DNA, 75 bp, Artificial Sequence
  Synthetic
gattacgccacaccatgtgggtcaacgtggttgagggacatctgggactgggtgtgcacagttttatctgacttc

SEQ ID NO: 141676 - DNA, 75 bp, Artificial Sequence
  Synthetic
gattacgccacaccatgtgggtcaacgtggctgagggacatctgggactgggtgtgcacagttttatctgacttc

SEQ ID NO: 141677 - DNA, 75 bp, Artificial Sequence
  Synthetic
gattacgccacaccatgtgggtcaacgtgggtgagggacatctgggactgggtgtgcacagttttatctgacttc

SEQ ID NO: 141678 - DNA, 75 bp, Artificial Sequence
  Synthetic
gattacgccacaccatgcgggtcaacgtggatgagggacatctgggactgggtgtgcacagttttatctgacttc

SEQ ID NO: 141679 - DNA, 75 bp, Artificial Sequence
  Synthetic
gattacgccacaccatgcgggtcaacgtggttgagggacatctgggactgggtgtgcacagttttatctgacttc

SEQ ID NO: 141680 - DNA, 75 bp, Artificial Sequence
  Synthetic
gattacgccacaccatgcgggtcaacgtggctgagggacatctgggactgggtgtgcacagttttatctgacttc

SEQ ID NO: 141681 - DNA, 75 bp, Artificial Sequence
  Synthetic
gattacgccacaccatgcgggtcaacgtgggtgagggacatctgggactgggtgtgcacagttttatctgacttc

SEQ ID NO: 141682 - DNA, 75 bp, Artificial Sequence
  Synthetic
gattacgccacaccatgggggtcaacgtggatgagggacatctgggactgggtgtgcacagttttatctgacttc

SEQ ID NO: 141683 - DNA, 75 bp, Artificial Sequence
  Synthetic
gattacgccacaccatgggggtcaacgtggttgagggacatctgggactgggtgtgcacagttttatctgacttc

SEQ ID NO: 141684 - DNA, 75 bp, Artificial Sequence
  Synthetic
gattacgccacaccatgggggtcaacgtggctgagggacatctgggactgggtgtgcacagttttatctgacttc

SEQ ID NO: 141685 - DNA, 75 bp, Artificial Sequence
  Synthetic
gattacgccacaccatgggggtcaacgtgggtgagggacatctgggactgggtgtgcacagttttatctgacttc

SEQ ID NO: 141686 - DNA, 75 bp, Artificial Sequence
  Synthetic
gcttataaacaccaatggcagctggcacattaacaggactgccctgaactgcaatgactccctccagactgggtt

SEQ ID NO: 141687 - DNA, 75 bp, Artificial Sequence
  Synthetic
ttggtttgggtgtgtgtggatgaacgggactgggttcacggaagcgtgtggcggccctccgtgcggcgtgcgtac

SEQ ID NO: 141688 - DNA, 75 bp, Artificial Sequence
  Synthetic
cgtatgcgcagcagacccgagggatgctaggcaccataatcacaagcctcaccggcagagacaccaacgagaact

SEQ ID NO: 141689 - DNA, 75 bp, Artificial Sequence
  Synthetic
aagttcaactcgtccggatgcccagagcgcatggccagctgccgctccattgacaagttcgatcaggggtggggt

SEQ ID NO: 141690 - DNA, 75 bp, Artificial Sequence
  Synthetic
gccatacgacttgcccttgtggtgcgcaaatcgcaggacatgtgaagaacgggacgatgaagatagtcggacctc

SEQ ID NO: 141691 - DNA, 75 bp, Artificial Sequence
  Synthetic
gccatacgacttgcccttgtggtgcgcaaatcgcaggtcatgtgaagaacgggacgatgaagatagtcggacctc

SEQ ID NO: 141692 - DNA, 75 bp, Artificial Sequence
  Synthetic
gccatacgacttgcccttgtggtgcgcaaatcgcaggccatgtgaagaacgggacgatgaagatagtcggacctc

SEQ ID NO: 141693 - DNA, 75 bp, Artificial Sequence
  Synthetic
gccatacgacttgcccttgtggtgcgcaaatcgcagggcatgtgaagaacgggacgatgaagatagtcggacctc

SEQ ID NO: 141694 - DNA, 75 bp, Artificial Sequence
  Synthetic
taattggcatcctccttttgtttgcaggggtggacgcgaccacgtacatcaccggcggtgccgccagccatacca

SEQ ID NO: 141695 - DNA, 75 bp, Artificial Sequence
  Synthetic
tgtatggttcactatccataccggctgtggcacttcccttgcaccgtcaactttaccatcttcaaagtcagaatg

SEQ ID NO: 141696 - DNA, 75 bp, Artificial Sequence
  Synthetic
gagggtgagcgctgaagaatacgtcgaagtcgtccgggtgagagacaaccattacatcgtgggggttacagctga

SEQ ID NO: 141697 - DNA, 75 bp, Artificial Sequence
  Synthetic
tccgggagtgaagtccttggccccatgcacctgtggctcgtcggacctgttcctggttaccaggcacgccgacgt

SEQ ID NO: 141698 - DNA, 75 bp, Artificial Sequence
  Synthetic
aacaccagcaacgcctatatggcgactaacgactgttccaatgacagcatcacttggcagcttgaggccgcagtc

SEQ ID NO: 141699 - DNA, 75 bp, Artificial Sequence
  Synthetic
caatgacaccttgcagaccgggttcatggctgccctgttttatacgaacaagttcaactccacagggtgcccaga

SEQ ID NO: 141700 - DNA, 75 bp, Artificial Sequence
  Synthetic
tgctcctttctaccacccaatggcaggtgctcccctgctcctttacaactatgcctgctctctcgacaggcctgg

SEQ ID NO: 141701 - DNA, 75 bp, Artificial Sequence
  Synthetic
agttcaactccacagggtgcccagagcggctgtcgtcctgcaagcccctcacctattttgatcagggttggggtc

SEQ ID NO: 141702 - DNA, 75 bp, Artificial Sequence
  Synthetic
agggacgaggtgtcgttcagtgtgggcctatccacttacgtggtgggatcgcaactaccctgtgaacctgagcca

SEQ ID NO: 141703 - DNA, 75 bp, Artificial Sequence
  Synthetic
cgacatggtcgtgttgtccgccacgctctgctccgctctctacgtgggggacctctgtggcggggtgatgctcgc

SEQ ID NO: 141704 - DNA, 75 bp, Artificial Sequence
  Synthetic
tttgctgctcgcagatgccagggtttgtgcgtgcctttggatgatgctgctggtctcgcaagtcgaggcggcgat

SEQ ID NO: 141705 - DNA, 75 bp, Artificial Sequence
  Synthetic
gttcgtcggccagtcagctatcagcaccatctctgaaagccacatgcactgcacatccggaccatccggacgcgg

SEQ ID NO: 141706 - DNA, 75 bp, Artificial Sequence
  Synthetic
ctccccgctgctgccgcttacgcggcttgtggaatgtggcccctgctcctcctgctcctcgcattgcctgaaagg

SEQ ID NO: 141707 - DNA, 75 bp, Artificial Sequence
  Synthetic
gcttaaggcggaatatgatgacagggagatgtcagtggcagcggagtgccacagacctccaagaccccggtaccc

SEQ ID NO: 141708 - DNA, 75 bp, Artificial Sequence
  Synthetic
cccggggggtgtggtggatgcagtacttcatcgccagagccgaagccctcctccacgtgtatgtcccatcctttg

SEQ ID NO: 141709 - DNA, 75 bp, Artificial Sequence
  Synthetic
gctcattaataccaatggtagctggcacatcaaccgcaccgccctgaattgcaacgattccttgcacaccggctt

SEQ ID NO: 141710 - DNA, 75 bp, Artificial Sequence
  Synthetic
tggagcgcgtcttgtcgtgctcgcgaccgccacgccacccggatcggtgacaacgccccactccaatatagagga

SEQ ID NO: 141711 - DNA, 75 bp, Artificial Sequence
  Synthetic
gctttggccgcgtattgcctgtcaacaggctgcgtggtcatagtgggcaggattgtcttgtccgggaagccggca

SEQ ID NO: 141712 - DNA, 75 bp, Artificial Sequence
  Synthetic
cttcctccacagggtttaccccctgttccaccaccgaggaagaaaaaacttgtccagctggacgagtcggccgca

SEQ ID NO: 141713 - DNA, 75 bp, Artificial Sequence
  Synthetic
cctctacgtgctccaggcctcgctcttgcgagtcccttacttcgtgagggcacacgctctgatcaagttctgcag

SEQ ID NO: 141714 - DNA, 75 bp, Artificial Sequence
  Synthetic
cgaggacttccggataggatggggcgccctgcaatacgacgacaatgtcaccaatccagaagatatgaggccata

SEQ ID NO: 141715 - DNA, 75 bp, Artificial Sequence
  Synthetic
caacaccatcagcggaggatgatgacccctcagaggctgactcatatagctccatgccgcccctcgagggcgagc

SEQ ID NO: 141716 - DNA, 75 bp, Artificial Sequence
  Synthetic
atgtggtgcttgccttcttgctgctagctgacgcgcgtatttgtgcatgcctttggcttatgttactcataggcc

SEQ ID NO: 141717 - DNA, 75 bp, Artificial Sequence
  Synthetic
atgtggtgcttgccttcttgctgctagctgacgcgcgtatttgtgcttgcctttggcttatgttactcataggcc

SEQ ID NO: 141718 - DNA, 75 bp, Artificial Sequence
  Synthetic
atgtggtgcttgccttcttgctgctagctgacgcgcgtatttgtgcctgcctttggcttatgttactcataggcc

SEQ ID NO: 141719 - DNA, 75 bp, Artificial Sequence
  Synthetic
atgtggtgcttgccttcttgctgctagctgacgcgcgtatttgtgcgtgcctttggcttatgttactcataggcc

SEQ ID NO: 141720 - DNA, 75 bp, Artificial Sequence
  Synthetic
tcggactgggccgccgacggccttaacgagctagcggtggcacttgagccagtcatattcacaccaatggagaaa

SEQ ID NO: 141721 - DNA, 75 bp, Artificial Sequence
  Synthetic
accgatagacttggagtgcctacttacacgtggggagagaatgagacagatgtcttcctattgaacagcacccga

SEQ ID NO: 141722 - DNA, 75 bp, Artificial Sequence
  Synthetic
gacgggagctcttgttaccccatgcgctgctgaggaagagaagctacctataagccctctgagcaatacgctcat

SEQ ID NO: 141723 - DNA, 75 bp, Artificial Sequence
  Synthetic
aggactgcaactgttccatttacagtggccatatcaccggccaccggatggcatgggacatgatgatgaattggt

SEQ ID NO: 141724 - DNA, 75 bp, Artificial Sequence
  Synthetic
gtatgtcaagggtcgcttggttcccgctaccacctacgggcttctgcagctatggccactcctgctgctagtgtt

SEQ ID NO: 141725 - DNA, 75 bp, Artificial Sequence
  Synthetic
gtatgtcaagggtcgcttggttcccgctaccacctacgggcttctgcagctatggccactcctgctgcttgtgtt

SEQ ID NO: 141726 - DNA, 75 bp, Artificial Sequence
  Synthetic
gtatgtcaagggtcgcttggttcccgctaccacctacgggcttctgcagctatggccactcctgctgctcgtgtt

SEQ ID NO: 141727 - DNA, 75 bp, Artificial Sequence
  Synthetic
gtatgtcaagggtcgcttggttcccgctaccacctacgggcttctgcagctatggccactcctgctgctggtgtt

SEQ ID NO: 141728 - DNA, 75 bp, Artificial Sequence
  Synthetic
ctgctgcatgcggtgatatcatcaggggtctacccgtgtcggctaggctaggcagagagatcttgcttggccctg

SEQ ID NO: 141729 - DNA, 75 bp, Artificial Sequence
  Synthetic
ccagttgttacggattccccaggtggtcattgacatcattgccggggcccactggggggtcttgttcgccgccgc

SEQ ID NO: 141730 - DNA, 75 bp, Artificial Sequence
  Synthetic
agaggccatccggcatatttgacacctcagtactctgcgagtgctacgatgctggatgcgcttggtatgaactga

SEQ ID NO: 141731 - DNA, 75 bp, Artificial Sequence
  Synthetic
ggactgttttagaaaacatcctgaagccacttacatcaaatgtggttccgggccttggctcacgccaaagtgtct

SEQ ID NO: 141732 - DNA, 75 bp, Artificial Sequence
  Synthetic
catgatgttctgaaggaggtaaagacccgggcgtctacagtgagtgcaaagctcctcagcgtagaggaagcctgc

SEQ ID NO: 141733 - DNA, 75 bp, Artificial Sequence
  Synthetic
tacgaccaggagcaggcagcgtcaatcggtgctgcagtaatagtggccatcaccatcttcacgcttacaccgcaa

SEQ ID NO: 141734 - DNA, 75 bp, Artificial Sequence
  Synthetic
tacgaccaggagcaggcagcgtcaatcggtgctgcagtaatagtggccatcaccatcttcacgcttacaccgcat

SEQ ID NO: 141735 - DNA, 75 bp, Artificial Sequence
  Synthetic
tacgaccaggagcaggcagcgtcaatcggtgctgcagtaatagtggccatcaccatcttcacgcttacaccgcac

SEQ ID NO: 141736 - DNA, 75 bp, Artificial Sequence
  Synthetic
tacgaccaggagcaggcagcgtcaatcggtgctgcagtaatagtggccatcaccatcttcacgcttacaccgcag

SEQ ID NO: 141737 - DNA, 75 bp, Artificial Sequence
  Synthetic
tacgaccaggagcaggcagcgtctatcggtgctgcagtaatagtggccatcaccatcttcacgcttacaccgcaa

SEQ ID NO: 141738 - DNA, 75 bp, Artificial Sequence
  Synthetic
tacgaccaggagcaggcagcgtctatcggtgctgcagtaatagtggccatcaccatcttcacgcttacaccgcat

SEQ ID NO: 141739 - DNA, 75 bp, Artificial Sequence
  Synthetic
tacgaccaggagcaggcagcgtctatcggtgctgcagtaatagtggccatcaccatcttcacgcttacaccgcac

SEQ ID NO: 141740 - DNA, 75 bp, Artificial Sequence
  Synthetic
tacgaccaggagcaggcagcgtctatcggtgctgcagtaatagtggccatcaccatcttcacgcttacaccgcag

SEQ ID NO: 141741 - DNA, 75 bp, Artificial Sequence
  Synthetic
tacgaccaggagcaggcagcgtccatcggtgctgcagtaatagtggccatcaccatcttcacgcttacaccgcaa

SEQ ID NO: 141742 - DNA, 75 bp, Artificial Sequence
  Synthetic
tacgaccaggagcaggcagcgtccatcggtgctgcagtaatagtggccatcaccatcttcacgcttacaccgcat

SEQ ID NO: 141743 - DNA, 75 bp, Artificial Sequence
  Synthetic
tacgaccaggagcaggcagcgtccatcggtgctgcagtaatagtggccatcaccatcttcacgcttacaccgcac

SEQ ID NO: 141744 - DNA, 75 bp, Artificial Sequence
  Synthetic
tacgaccaggagcaggcagcgtccatcggtgctgcagtaatagtggccatcaccatcttcacgcttacaccgcag

SEQ ID NO: 141745 - DNA, 75 bp, Artificial Sequence
  Synthetic
tacgaccaggagcaggcagcgtcgatcggtgctgcagtaatagtggccatcaccatcttcacgcttacaccgcaa

SEQ ID NO: 141746 - DNA, 75 bp, Artificial Sequence
  Synthetic
tacgaccaggagcaggcagcgtcgatcggtgctgcagtaatagtggccatcaccatcttcacgcttacaccgcat

SEQ ID NO: 141747 - DNA, 75 bp, Artificial Sequence
  Synthetic
tacgaccaggagcaggcagcgtcgatcggtgctgcagtaatagtggccatcaccatcttcacgcttacaccgcac

SEQ ID NO: 141748 - DNA, 75 bp, Artificial Sequence
  Synthetic
tacgaccaggagcaggcagcgtcgatcggtgctgcagtaatagtggccatcaccatcttcacgcttacaccgcag

SEQ ID NO: 141749 - DNA, 75 bp, Artificial Sequence
  Synthetic
gggaggacttgctggaagacaacaccacacctattgtcaccactataatggctaagaacgaagtgttttgcgtgg

SEQ ID NO: 141750 - DNA, 75 bp, Artificial Sequence
  Synthetic
gacctggtggggtggccagcacccccgggagtaaagtcccttacgccatgcacttgtggtgcatcggacttattc

SEQ ID NO: 141751 - DNA, 75 bp, Artificial Sequence
  Synthetic
ttggcacccccacccagttgggacacaatgtggaaatgcctcctccgcctcaaaccaaccttgcggggcccgacc

SEQ ID NO: 141752 - DNA, 75 bp, Artificial Sequence
  Synthetic
ccgtactacgtacgggcgcatgctttgttgcgggcttgcttgctcgtacggcgcttctgcgccggtaagtatgtg

SEQ ID NO: 141753 - DNA, 75 bp, Artificial Sequence
  Synthetic
ccgtactacgtacgggcgcatgctttgttgcgggcttgcttgctcgttcggcgcttctgcgccggtaagtatgtg

SEQ ID NO: 141754 - DNA, 75 bp, Artificial Sequence
  Synthetic
ccgtactacgtacgggcgcatgctttgttgcgggcttgcttgctcgtccggcgcttctgcgccggtaagtatgtg

SEQ ID NO: 141755 - DNA, 75 bp, Artificial Sequence
  Synthetic
ccgtactacgtacgggcgcatgctttgttgcgggcttgcttgctcgtgcggcgcttctgcgccggtaagtatgtg

SEQ ID NO: 141756 - DNA, 75 bp, Artificial Sequence
  Synthetic
ggcccgcctgatcgtatacccggaccttagtgtgcgggtgtgcgaaaagagagccttatatgacatcacacgcaa

SEQ ID NO: 141757 - DNA, 75 bp, Artificial Sequence
  Synthetic
cacttgtggtgcatcggacttattcctggtcaccaggcacgcagacgtgatccctgttcgcagacgcggtgacac

SEQ ID NO: 141758 - DNA, 75 bp, Artificial Sequence
  Synthetic
gagtgggtagtactcttattcctgctcctagcggacgccagggtctgcgcctgcttgtggatgctcatcttgctg

SEQ ID NO: 141759 - DNA, 75 bp, Artificial Sequence
  Synthetic
gcggcgatatgcacccggggtgtggctaaagcggtggactttgtgcctgtcgagtccctagaaaccaccatgagg

SEQ ID NO: 141760 - DNA, 75 bp, Artificial Sequence
  Synthetic
cgagtccctagaaaccaccatgaggtccccagtttttactgacaactccactccacctgcagtgccccagaccta

SEQ ID NO: 141761 - DNA, 75 bp, Artificial Sequence
  Synthetic
tgacatctttctcttgaacaacacgaggccccctactggcaactggtttggctgcacctggatgaattccacagg

SEQ ID NO: 141762 - DNA, 75 bp, Artificial Sequence
  Synthetic
cttggcacatcaagggtagggtggtccccttggctgcttattcccttactggcctgtggccgttctgcctactgc

SEQ ID NO: 141763 - DNA, 75 bp, Artificial Sequence
  Synthetic
cctgcggctaccgccggtgccgggctagtggagtccttcccaccagtttgggcaatactctgacttgctatataa

SEQ ID NO: 141764 - DNA, 75 bp, Artificial Sequence
  Synthetic
tctgtagcggctactttgggctttggggcgtatatgtccaaggcatacggcatcgacccgaacatacggtcaggt

SEQ ID NO: 141765 - DNA, 75 bp, Artificial Sequence
  Synthetic
aaaacccgcggtctactggggacgatagttaccagcctgactggcagggacaaaaatgaggttgagggcgaggtc

SEQ ID NO: 141766 - DNA, 75 bp, Artificial Sequence
  Synthetic
gggcgtatatgtccaaggcatacggcatcgacccgaacatacggtcaggtgtcagaaccatcaccacgggtgcgt

SEQ ID NO: 141767 - DNA, 75 bp, Artificial Sequence
  Synthetic
ggacgctagtgccctgcgagcgttcacggacgctatgaccaggtactcagctcctcctggagacgagccgcatcc

SEQ ID NO: 141768 - DNA, 75 bp, Artificial Sequence
  Synthetic
ggaatacgaccttgagcacatcacatcttgctcttccaacgtctccgtagcccacgacgccaccggacagagata

SEQ ID NO: 141769 - DNA, 75 bp, Artificial Sequence
  Synthetic
acgctcccactggcagcggcaagagcactaaggtgccggctgcgtatgcagcccaagggtacaaggtgctcgtcc

SEQ ID NO: 141770 - DNA, 75 bp, Artificial Sequence
  Synthetic
acctcctaagaggtgctttgacgcgcgtgccatatttcgtcagagcccacgctctgctgagaatgtgcactatgg

SEQ ID NO: 141771 - DNA, 75 bp, Artificial Sequence
  Synthetic
ttgccttgccgacaacgggggaaatacccttttacggcagagcaatccctctcgaattggttaaagggggtagac

SEQ ID NO: 141772 - DNA, 75 bp, Artificial Sequence
  Synthetic
ttgggctgctagcggcctgcgggacttggcggtcgctgtggagcctatcatcttcagtccgatggagaagaaagt

SEQ ID NO: 141773 - DNA, 75 bp, Artificial Sequence
  Synthetic
aatactccagtcccaagaaacactccacaaagcacttgacttcgacatgtacggagtcacatatagtatcactcc

SEQ ID NO: 141774 - DNA, 75 bp, Artificial Sequence
  Synthetic
caggctgaagcagccctggagaacgtcattgtcctaaacgcggctgcggctgcggggactcatgggtttttctgg

SEQ ID NO: 141775 - DNA, 75 bp, Artificial Sequence
  Synthetic
aggaaacttgggtcgccacccttacgagcctggagacatcgggcgagggcagtcagagctaagcttatcgctcag

SEQ ID NO: 141776 - DNA, 75 bp, Artificial Sequence
  Synthetic
ggctacacctccaaggggtggaagcttctcgcccccatcaccgcttacgcccagcagacacgaggtctcttgggc

SEQ ID NO: 141777 - DNA, 75 bp, Artificial Sequence
  Synthetic
agtcagagctaagcttatcgctcagggtgggaaagccgctgtatgcggcgtgtacctcttcaactgggcggtaaa

SEQ ID NO: 141778 - DNA, 75 bp, Artificial Sequence
  Synthetic
atatcggttcgttactccaggagaaaggccatccggcatatttgacacctcagtgctctgcgagtgctacgatgc

SEQ ID NO: 141779 - DNA, 75 bp, Artificial Sequence
  Synthetic
aggccatccggcatatttgacacctcagtgctctgcgagtgctacgatgcaggatgtgcctggtacgaactgaca

SEQ ID NO: 141780 - DNA, 75 bp, Artificial Sequence
  Synthetic
cagtccttcctcggaacatccatttcgggggtcttatggactgtttaccacggagctggcaacaagacactagcc

SEQ ID NO: 141781 - DNA, 75 bp, Artificial Sequence
  Synthetic
gattccctttgtgtcctgccaacgcgggtataggggggtctggcgaggggacggcatcatgcacactcgctgcca

SEQ ID NO: 141782 - DNA, 75 bp, Artificial Sequence
  Synthetic
tcctgtgcctactcctacttaccgtaggggtaggcatctttttgctccccgcccgataaagggcggcactaagca

SEQ ID NO: 141783 - DNA, 75 bp, Artificial Sequence
  Synthetic
cacgcggaacgctgatgtcatcccggctcgaagacgcggggacaagcggggagcgctgctctccccgagacccct

SEQ ID NO: 141784 - DNA, 75 bp, Artificial Sequence
  Synthetic
gcaggcggccttgctccaccttggtaggctgaccggaacgtacatttatgaccaccttgcccccatgaaggattg

SEQ ID NO: 141785 - DNA, 75 bp, Artificial Sequence
  Synthetic
cacaggataacatcaagtgcccctgccaggtacccgcacctgagttcttcactgaggtggatggcgtcaggctcc

SEQ ID NO: 141786 - DNA, 75 bp, Artificial Sequence
  Synthetic
tgcgctactgacgccctcatgactggctttacaggcgacttcgactccgtcatagactgcaatgtagctgtgacg

SEQ ID NO: 141787 - DNA, 75 bp, Artificial Sequence
  Synthetic
catgctgagggatgaggtgtcctttacagtgggcctcaacacttttgtggtggggtcccagctcccctgcgagcc

SEQ ID NO: 141788 - DNA, 75 bp, Artificial Sequence
  Synthetic
tgtcccacaggaagccgtgtctagaagccaacggcgcggacgtacaggcagaggtaaacaggggatatatagata

SEQ ID NO: 141789 - DNA, 75 bp, Artificial Sequence
  Synthetic
tgtcccacaggaagccgtgtctagaagccaacggcgcggacgtacaggcagtggtaaacaggggatatatagata

SEQ ID NO: 141790 - DNA, 75 bp, Artificial Sequence
  Synthetic
tgtcccacaggaagccgtgtctagaagccaacggcgcggacgtacaggcagcggtaaacaggggatatatagata

SEQ ID NO: 141791 - DNA, 75 bp, Artificial Sequence
  Synthetic
tgtcccacaggaagccgtgtctagaagccaacggcgcggacgtacaggcaggggtaaacaggggatatatagata

SEQ ID NO: 141792 - DNA, 75 bp, Artificial Sequence
  Synthetic
tgtcccacaggatgccgtgtctagaagccaacggcgcggacgtacaggcagaggtaaacaggggatatatagata

SEQ ID NO: 141793 - DNA, 75 bp, Artificial Sequence
  Synthetic
tgtcccacaggatgccgtgtctagaagccaacggcgcggacgtacaggcagtggtaaacaggggatatatagata

SEQ ID NO: 141794 - DNA, 75 bp, Artificial Sequence
  Synthetic
tgtcccacaggatgccgtgtctagaagccaacggcgcggacgtacaggcagcggtaaacaggggatatatagata

SEQ ID NO: 141795 - DNA, 75 bp, Artificial Sequence
  Synthetic
tgtcccacaggatgccgtgtctagaagccaacggcgcggacgtacaggcaggggtaaacaggggatatatagata

SEQ ID NO: 141796 - DNA, 75 bp, Artificial Sequence
  Synthetic
tgtcccacaggacgccgtgtctagaagccaacggcgcggacgtacaggcagaggtaaacaggggatatatagata

SEQ ID NO: 141797 - DNA, 75 bp, Artificial Sequence
  Synthetic
tgtcccacaggacgccgtgtctagaagccaacggcgcggacgtacaggcagtggtaaacaggggatatatagata

SEQ ID NO: 141798 - DNA, 75 bp, Artificial Sequence
  Synthetic
tgtcccacaggacgccgtgtctagaagccaacggcgcggacgtacaggcagcggtaaacaggggatatatagata

SEQ ID NO: 141799 - DNA, 75 bp, Artificial Sequence
  Synthetic
tgtcccacaggacgccgtgtctagaagccaacggcgcggacgtacaggcaggggtaaacaggggatatatagata

SEQ ID NO: 141800 - DNA, 75 bp, Artificial Sequence
  Synthetic
tgtcccacaggaggccgtgtctagaagccaacggcgcggacgtacaggcagaggtaaacaggggatatatagata

SEQ ID NO: 141801 - DNA, 75 bp, Artificial Sequence
  Synthetic
tgtcccacaggaggccgtgtctagaagccaacggcgcggacgtacaggcagtggtaaacaggggatatatagata

SEQ ID NO: 141802 - DNA, 75 bp, Artificial Sequence
  Synthetic
tgtcccacaggaggccgtgtctagaagccaacggcgcggacgtacaggcagcggtaaacaggggatatatagata

SEQ ID NO: 141803 - DNA, 75 bp, Artificial Sequence
  Synthetic
tgtcccacaggaggccgtgtctagaagccaacggcgcggacgtacaggcaggggtaaacaggggatatatagata

SEQ ID NO: 141804 - DNA, 75 bp, Artificial Sequence
  Synthetic
agaggcgctctaccagcagtttgacgaaatggaagagtgctctaagcacctcccactagtcgaacatggcctgca

SEQ ID NO: 141805 - DNA, 75 bp, Artificial Sequence
  Synthetic
ccaacacccctgctgtacaggctaggagccgtccaaaacgagatcaccctcacgcaccccataaccaaatacatc

SEQ ID NO: 141806 - DNA, 75 bp, Artificial Sequence
  Synthetic
acatactccacgtatggtaaattcctcgccgatgggggctgcgcaggcggcgcctatgacatcatcatatgcgat

SEQ ID NO: 141807 - DNA, 75 bp, Artificial Sequence
  Synthetic
cttgagcagttctgggcaaagcatatgtggaatttcatcagcggtatccaataccttgctgggttgtccaccctg

SEQ ID NO: 141808 - DNA, 75 bp, Artificial Sequence
  Synthetic
atggcatgcatgtcggccgacctggaggtcgtcacgagcacctgggtgctagtaggcggagtccttgcagctctg

SEQ ID NO: 141809 - DNA, 75 bp, Artificial Sequence
  Synthetic
tacttgacggcctaccaggccacagtgtgcgctcgcgccaaagcccctcccccatcgtgggacaatatgtggaag

SEQ ID NO: 141810 - DNA, 75 bp, Artificial Sequence
  Synthetic
ccttcaaaataatgagcggtgagatgccgacaacagaggacatagtgaacctgctcccggccatactatcgccgg

SEQ ID NO: 141811 - DNA, 75 bp, Artificial Sequence
  Synthetic
ggacctggaagtgatcaccagcacttgggtacttgcaggggggatccttgccgcgttggcggcgtactgccttac

SEQ ID NO: 141812 - DNA, 75 bp, Artificial Sequence
  Synthetic
tggaaaccacgatgcgctcgcccgtgttcactgacaacagcacaccccccgcggtccctcacgagttccaagtgg

SEQ ID NO: 141813 - DNA, 75 bp, Artificial Sequence
  Synthetic
tggactggggaaggtcctcgtggacattcttgcagggtatggcgcgggcgtggcgggagctcttgtagcattcaa

SEQ ID NO: 141814 - DNA, 75 bp, Artificial Sequence
  Synthetic
gagtgctcacaacgcattccttatctcgttgagggccaacagctcgccgagcagttcaaacagaaagttcttggc

SEQ ID NO: 141815 - DNA, 75 bp, Artificial Sequence
  Synthetic
ggtcctggtggtgctgctgctatttgctggcgtcgacgcggaaacccacgtcaccgggggatcagccggctatgc

SEQ ID NO: 141816 - DNA, 75 bp, Artificial Sequence
  Synthetic
tcgtcagcgggatacattatcttgctggcctatccacgctgccaggaaatccagcagtggcttctttgatgtctt

SEQ ID NO: 141817 - DNA, 75 bp, Artificial Sequence
  Synthetic
tcgtcagcgggatacattatcttgctggcctatccacgctgccaggaaatcctgcagtggcttctttgatgtctt

SEQ ID NO: 141818 - DNA, 75 bp, Artificial Sequence
  Synthetic
tcgtcagcgggatacattatcttgctggcctatccacgctgccaggaaatcccgcagtggcttctttgatgtctt

SEQ ID NO: 141819 - DNA, 75 bp, Artificial Sequence
  Synthetic
tcgtcagcgggatacattatcttgctggcctatccacgctgccaggaaatccggcagtggcttctttgatgtctt

SEQ ID NO: 141820 - DNA, 75 bp, Artificial Sequence
  Synthetic
tcgtcagcgggatacattatcttgctggcctatccacgctgcctggaaatccagcagtggcttctttgatgtctt

SEQ ID NO: 141821 - DNA, 75 bp, Artificial Sequence
  Synthetic
tcgtcagcgggatacattatcttgctggcctatccacgctgcctggaaatcctgcagtggcttctttgatgtctt

SEQ ID NO: 141822 - DNA, 75 bp, Artificial Sequence
  Synthetic
tcgtcagcgggatacattatcttgctggcctatccacgctgcctggaaatcccgcagtggcttctttgatgtctt

SEQ ID NO: 141823 - DNA, 75 bp, Artificial Sequence
  Synthetic
tcgtcagcgggatacattatcttgctggcctatccacgctgcctggaaatccggcagtggcttctttgatgtctt

SEQ ID NO: 141824 - DNA, 75 bp, Artificial Sequence
  Synthetic
tcgtcagcgggatacattatcttgctggcctatccacgctgcccggaaatccagcagtggcttctttgatgtctt

SEQ ID NO: 141825 - DNA, 75 bp, Artificial Sequence
  Synthetic
tcgtcagcgggatacattatcttgctggcctatccacgctgcccggaaatcctgcagtggcttctttgatgtctt

SEQ ID NO: 141826 - DNA, 75 bp, Artificial Sequence
  Synthetic
tcgtcagcgggatacattatcttgctggcctatccacgctgcccggaaatcccgcagtggcttctttgatgtctt

SEQ ID NO: 141827 - DNA, 75 bp, Artificial Sequence
  Synthetic
tcgtcagcgggatacattatcttgctggcctatccacgctgcccggaaatccggcagtggcttctttgatgtctt

SEQ ID NO: 141828 - DNA, 75 bp, Artificial Sequence
  Synthetic
tcgtcagcgggatacattatcttgctggcctatccacgctgccgggaaatccagcagtggcttctttgatgtctt

SEQ ID NO: 141829 - DNA, 75 bp, Artificial Sequence
  Synthetic
tcgtcagcgggatacattatcttgctggcctatccacgctgccgggaaatcctgcagtggcttctttgatgtctt

SEQ ID NO: 141830 - DNA, 75 bp, Artificial Sequence
  Synthetic
tcgtcagcgggatacattatcttgctggcctatccacgctgccgggaaatcccgcagtggcttctttgatgtctt

SEQ ID NO: 141831 - DNA, 75 bp, Artificial Sequence
  Synthetic
tcgtcagcgggatacattatcttgctggcctatccacgctgccgggaaatccggcagtggcttctttgatgtctt

SEQ ID NO: 141832 - DNA, 75 bp, Artificial Sequence
  Synthetic
tcgtcagcgggatacattatcttgctggcctttccacgctgccaggaaatccagcagtggcttctttgatgtctt

SEQ ID NO: 141833 - DNA, 75 bp, Artificial Sequence
  Synthetic
tcgtcagcgggatacattatcttgctggcctttccacgctgccaggaaatcctgcagtggcttctttgatgtctt

SEQ ID NO: 141834 - DNA, 75 bp, Artificial Sequence
  Synthetic
tcgtcagcgggatacattatcttgctggcctttccacgctgccaggaaatcccgcagtggcttctttgatgtctt

SEQ ID NO: 141835 - DNA, 75 bp, Artificial Sequence
  Synthetic
tcgtcagcgggatacattatcttgctggcctttccacgctgccaggaaatccggcagtggcttctttgatgtctt

SEQ ID NO: 141836 - DNA, 75 bp, Artificial Sequence
  Synthetic
tcgtcagcgggatacattatcttgctggcctttccacgctgcctggaaatccagcagtggcttctttgatgtctt

SEQ ID NO: 141837 - DNA, 75 bp, Artificial Sequence
  Synthetic
tcgtcagcgggatacattatcttgctggcctttccacgctgcctggaaatcctgcagtggcttctttgatgtctt

SEQ ID NO: 141838 - DNA, 75 bp, Artificial Sequence
  Synthetic
tcgtcagcgggatacattatcttgctggcctttccacgctgcctggaaatcccgcagtggcttctttgatgtctt

SEQ ID NO: 141839 - DNA, 75 bp, Artificial Sequence
  Synthetic
tcgtcagcgggatacattatcttgctggcctttccacgctgcctggaaatccggcagtggcttctttgatgtctt

SEQ ID NO: 141840 - DNA, 75 bp, Artificial Sequence
  Synthetic
tcgtcagcgggatacattatcttgctggcctttccacgctgcccggaaatccagcagtggcttctttgatgtctt

SEQ ID NO: 141841 - DNA, 75 bp, Artificial Sequence
  Synthetic
tcgtcagcgggatacattatcttgctggcctttccacgctgcccggaaatcctgcagtggcttctttgatgtctt

SEQ ID NO: 141842 - DNA, 75 bp, Artificial Sequence
  Synthetic
tcgtcagcgggatacattatcttgctggcctttccacgctgcccggaaatcccgcagtggcttctttgatgtctt

SEQ ID NO: 141843 - DNA, 75 bp, Artificial Sequence
  Synthetic
tcgtcagcgggatacattatcttgctggcctttccacgctgcccggaaatccggcagtggcttctttgatgtctt

SEQ ID NO: 141844 - DNA, 75 bp, Artificial Sequence
  Synthetic
tcgtcagcgggatacattatcttgctggcctttccacgctgccgggaaatccagcagtggcttctttgatgtctt

SEQ ID NO: 141845 - DNA, 75 bp, Artificial Sequence
  Synthetic
tcgtcagcgggatacattatcttgctggcctttccacgctgccgggaaatcctgcagtggcttctttgatgtctt

SEQ ID NO: 141846 - DNA, 75 bp, Artificial Sequence
  Synthetic
tcgtcagcgggatacattatcttgctggcctttccacgctgccgggaaatcccgcagtggcttctttgatgtctt

SEQ ID NO: 141847 - DNA, 75 bp, Artificial Sequence
  Synthetic
tcgtcagcgggatacattatcttgctggcctttccacgctgccgggaaatccggcagtggcttctttgatgtctt

SEQ ID NO: 141848 - DNA, 75 bp, Artificial Sequence
  Synthetic
tcgtcagcgggatacattatcttgctggcctctccacgctgccaggaaatccagcagtggcttctttgatgtctt

SEQ ID NO: 141849 - DNA, 75 bp, Artificial Sequence
  Synthetic
tcgtcagcgggatacattatcttgctggcctctccacgctgccaggaaatcctgcagtggcttctttgatgtctt

SEQ ID NO: 141850 - DNA, 75 bp, Artificial Sequence
  Synthetic
tcgtcagcgggatacattatcttgctggcctctccacgctgccaggaaatcccgcagtggcttctttgatgtctt

SEQ ID NO: 141851 - DNA, 75 bp, Artificial Sequence
  Synthetic
tcgtcagcgggatacattatcttgctggcctctccacgctgccaggaaatccggcagtggcttctttgatgtctt

SEQ ID NO: 141852 - DNA, 75 bp, Artificial Sequence
  Synthetic
tcgtcagcgggatacattatcttgctggcctctccacgctgcctggaaatccagcagtggcttctttgatgtctt

SEQ ID NO: 141853 - DNA, 75 bp, Artificial Sequence
  Synthetic
tcgtcagcgggatacattatcttgctggcctctccacgctgcctggaaatcctgcagtggcttctttgatgtctt

SEQ ID NO: 141854 - DNA, 75 bp, Artificial Sequence
  Synthetic
tcgtcagcgggatacattatcttgctggcctctccacgctgcctggaaatcccgcagtggcttctttgatgtctt

SEQ ID NO: 141855 - DNA, 75 bp, Artificial Sequence
  Synthetic
tcgtcagcgggatacattatcttgctggcctctccacgctgcctggaaatccggcagtggcttctttgatgtctt

SEQ ID NO: 141856 - DNA, 75 bp, Artificial Sequence
  Synthetic
tcgtcagcgggatacattatcttgctggcctctccacgctgcccggaaatccagcagtggcttctttgatgtctt

SEQ ID NO: 141857 - DNA, 75 bp, Artificial Sequence
  Synthetic
tcgtcagcgggatacattatcttgctggcctctccacgctgcccggaaatcctgcagtggcttctttgatgtctt

SEQ ID NO: 141858 - DNA, 75 bp, Artificial Sequence
  Synthetic
tcgtcagcgggatacattatcttgctggcctctccacgctgcccggaaatcccgcagtggcttctttgatgtctt

SEQ ID NO: 141859 - DNA, 75 bp, Artificial Sequence
  Synthetic
tcgtcagcgggatacattatcttgctggcctctccacgctgcccggaaatccggcagtggcttctttgatgtctt

SEQ ID NO: 141860 - DNA, 75 bp, Artificial Sequence
  Synthetic
tcgtcagcgggatacattatcttgctggcctctccacgctgccgggaaatccagcagtggcttctttgatgtctt

SEQ ID NO: 141861 - DNA, 75 bp, Artificial Sequence
  Synthetic
tcgtcagcgggatacattatcttgctggcctctccacgctgccgggaaatcctgcagtggcttctttgatgtctt

SEQ ID NO: 141862 - DNA, 75 bp, Artificial Sequence
  Synthetic
tcgtcagcgggatacattatcttgctggcctctccacgctgccgggaaatcccgcagtggcttctttgatgtctt

SEQ ID NO: 141863 - DNA, 75 bp, Artificial Sequence
  Synthetic
tcgtcagcgggatacattatcttgctggcctctccacgctgccgggaaatccggcagtggcttctttgatgtctt

SEQ ID NO: 141864 - DNA, 75 bp, Artificial Sequence
  Synthetic
tcgtcagcgggatacattatcttgctggcctgtccacgctgccaggaaatccagcagtggcttctttgatgtctt

SEQ ID NO: 141865 - DNA, 75 bp, Artificial Sequence
  Synthetic
tcgtcagcgggatacattatcttgctggcctgtccacgctgccaggaaatcctgcagtggcttctttgatgtctt

SEQ ID NO: 141866 - DNA, 75 bp, Artificial Sequence
  Synthetic
tcgtcagcgggatacattatcttgctggcctgtccacgctgccaggaaatcccgcagtggcttctttgatgtctt

SEQ ID NO: 141867 - DNA, 75 bp, Artificial Sequence
  Synthetic
tcgtcagcgggatacattatcttgctggcctgtccacgctgccaggaaatccggcagtggcttctttgatgtctt

SEQ ID NO: 141868 - DNA, 75 bp, Artificial Sequence
  Synthetic
tcgtcagcgggatacattatcttgctggcctgtccacgctgcctggaaatccagcagtggcttctttgatgtctt

SEQ ID NO: 141869 - DNA, 75 bp, Artificial Sequence
  Synthetic
tcgtcagcgggatacattatcttgctggcctgtccacgctgcctggaaatcctgcagtggcttctttgatgtctt

SEQ ID NO: 141870 - DNA, 75 bp, Artificial Sequence
  Synthetic
tcgtcagcgggatacattatcttgctggcctgtccacgctgcctggaaatcccgcagtggcttctttgatgtctt

SEQ ID NO: 141871 - DNA, 75 bp, Artificial Sequence
  Synthetic
tcgtcagcgggatacattatcttgctggcctgtccacgctgcctggaaatccggcagtggcttctttgatgtctt

SEQ ID NO: 141872 - DNA, 75 bp, Artificial Sequence
  Synthetic
tcgtcagcgggatacattatcttgctggcctgtccacgctgcccggaaatccagcagtggcttctttgatgtctt

SEQ ID NO: 141873 - DNA, 75 bp, Artificial Sequence
  Synthetic
tcgtcagcgggatacattatcttgctggcctgtccacgctgcccggaaatcctgcagtggcttctttgatgtctt

SEQ ID NO: 141874 - DNA, 75 bp, Artificial Sequence
  Synthetic
tcgtcagcgggatacattatcttgctggcctgtccacgctgcccggaaatcccgcagtggcttctttgatgtctt

SEQ ID NO: 141875 - DNA, 75 bp, Artificial Sequence
  Synthetic
tcgtcagcgggatacattatcttgctggcctgtccacgctgcccggaaatccggcagtggcttctttgatgtctt

SEQ ID NO: 141876 - DNA, 75 bp, Artificial Sequence
  Synthetic
tcgtcagcgggatacattatcttgctggcctgtccacgctgccgggaaatccagcagtggcttctttgatgtctt

SEQ ID NO: 141877 - DNA, 75 bp, Artificial Sequence
  Synthetic
tcgtcagcgggatacattatcttgctggcctgtccacgctgccgggaaatcctgcagtggcttctttgatgtctt

SEQ ID NO: 141878 - DNA, 75 bp, Artificial Sequence
  Synthetic
tcgtcagcgggatacattatcttgctggcctgtccacgctgccgggaaatcccgcagtggcttctttgatgtctt

SEQ ID NO: 141879 - DNA, 75 bp, Artificial Sequence
  Synthetic
tcgtcagcgggatacattatcttgctggcctgtccacgctgccgggaaatccggcagtggcttctttgatgtctt

SEQ ID NO: 141880 - DNA, 75 bp, Artificial Sequence
  Synthetic
agagggaagtatccgttccggcggaaatcttgcggaaatccaagagcttccccccggcgttgcccatatgggcac

SEQ ID NO: 141881 - DNA, 75 bp, Artificial Sequence
  Synthetic
cccttcctctcctgccagagggggtacaagggggagtggcgaggggacggcgtaatgcacactacgtgtccttgc

SEQ ID NO: 141882 - DNA, 75 bp, Artificial Sequence
  Synthetic
gtcgacttctaccaccctcctacttaacatactaggaggatgggtagcatcccaaatggcaccgccgaccgcttc

SEQ ID NO: 141883 - DNA, 75 bp, Artificial Sequence
  Synthetic
gtcgacttctaccaccctcctacttaacatactaggaggatgggtagcatcccaaatggctccgccgaccgcttc

SEQ ID NO: 141884 - DNA, 75 bp, Artificial Sequence
  Synthetic
gtcgacttctaccaccctcctacttaacatactaggaggatgggtagcatcccaaatggccccgccgaccgcttc

SEQ ID NO: 141885 - DNA, 75 bp, Artificial Sequence
  Synthetic
gtcgacttctaccaccctcctacttaacatactaggaggatgggtagcatcccaaatggcgccgccgaccgcttc

SEQ ID NO: 141886 - DNA, 75 bp, Artificial Sequence
  Synthetic
gtcgacttctaccaccctcctacttaacatactaggaggatgggtagcttcccaaatggcaccgccgaccgcttc

SEQ ID NO: 141887 - DNA, 75 bp, Artificial Sequence
  Synthetic
gtcgacttctaccaccctcctacttaacatactaggaggatgggtagcttcccaaatggctccgccgaccgcttc

SEQ ID NO: 141888 - DNA, 75 bp, Artificial Sequence
  Synthetic
gtcgacttctaccaccctcctacttaacatactaggaggatgggtagcttcccaaatggccccgccgaccgcttc

SEQ ID NO: 141889 - DNA, 75 bp, Artificial Sequence
  Synthetic
gtcgacttctaccaccctcctacttaacatactaggaggatgggtagcttcccaaatggcgccgccgaccgcttc

SEQ ID NO: 141890 - DNA, 75 bp, Artificial Sequence
  Synthetic
gtcgacttctaccaccctcctacttaacatactaggaggatgggtagcctcccaaatggcaccgccgaccgcttc

SEQ ID NO: 141891 - DNA, 75 bp, Artificial Sequence
  Synthetic
gtcgacttctaccaccctcctacttaacatactaggaggatgggtagcctcccaaatggctccgccgaccgcttc

SEQ ID NO: 141892 - DNA, 75 bp, Artificial Sequence
  Synthetic
gtcgacttctaccaccctcctacttaacatactaggaggatgggtagcctcccaaatggccccgccgaccgcttc

SEQ ID NO: 141893 - DNA, 75 bp, Artificial Sequence
  Synthetic
gtcgacttctaccaccctcctacttaacatactaggaggatgggtagcctcccaaatggcgccgccgaccgcttc

SEQ ID NO: 141894 - DNA, 75 bp, Artificial Sequence
  Synthetic
gtcgacttctaccaccctcctacttaacatactaggaggatgggtagcgtcccaaatggcaccgccgaccgcttc

SEQ ID NO: 141895 - DNA, 75 bp, Artificial Sequence
  Synthetic
gtcgacttctaccaccctcctacttaacatactaggaggatgggtagcgtcccaaatggctccgccgaccgcttc

SEQ ID NO: 141896 - DNA, 75 bp, Artificial Sequence
  Synthetic
gtcgacttctaccaccctcctacttaacatactaggaggatgggtagcgtcccaaatggccccgccgaccgcttc

SEQ ID NO: 141897 - DNA, 75 bp, Artificial Sequence
  Synthetic
gtcgacttctaccaccctcctacttaacatactaggaggatgggtagcgtcccaaatggcgccgccgaccgcttc

SEQ ID NO: 141898 - DNA, 75 bp, Artificial Sequence
  Synthetic
gtcgacttctaccaccctccttcttaacatactaggaggatgggtagcatcccaaatggcaccgccgaccgcttc

SEQ ID NO: 141899 - DNA, 75 bp, Artificial Sequence
  Synthetic
gtcgacttctaccaccctccttcttaacatactaggaggatgggtagcatcccaaatggctccgccgaccgcttc

SEQ ID NO: 141900 - DNA, 75 bp, Artificial Sequence
  Synthetic
gtcgacttctaccaccctccttcttaacatactaggaggatgggtagcatcccaaatggccccgccgaccgcttc

SEQ ID NO: 141901 - DNA, 75 bp, Artificial Sequence
  Synthetic
gtcgacttctaccaccctccttcttaacatactaggaggatgggtagcatcccaaatggcgccgccgaccgcttc

SEQ ID NO: 141902 - DNA, 75 bp, Artificial Sequence
  Synthetic
gtcgacttctaccaccctccttcttaacatactaggaggatgggtagcttcccaaatggcaccgccgaccgcttc

SEQ ID NO: 141903 - DNA, 75 bp, Artificial Sequence
  Synthetic
gtcgacttctaccaccctccttcttaacatactaggaggatgggtagcttcccaaatggctccgccgaccgcttc

SEQ ID NO: 141904 - DNA, 75 bp, Artificial Sequence
  Synthetic
gtcgacttctaccaccctccttcttaacatactaggaggatgggtagcttcccaaatggccccgccgaccgcttc

SEQ ID NO: 141905 - DNA, 75 bp, Artificial Sequence
  Synthetic
gtcgacttctaccaccctccttcttaacatactaggaggatgggtagcttcccaaatggcgccgccgaccgcttc

SEQ ID NO: 141906 - DNA, 75 bp, Artificial Sequence
  Synthetic
gtcgacttctaccaccctccttcttaacatactaggaggatgggtagcctcccaaatggcaccgccgaccgcttc

SEQ ID NO: 141907 - DNA, 75 bp, Artificial Sequence
  Synthetic
gtcgacttctaccaccctccttcttaacatactaggaggatgggtagcctcccaaatggctccgccgaccgcttc

SEQ ID NO: 141908 - DNA, 75 bp, Artificial Sequence
  Synthetic
gtcgacttctaccaccctccttcttaacatactaggaggatgggtagcctcccaaatggccccgccgaccgcttc

SEQ ID NO: 141909 - DNA, 75 bp, Artificial Sequence
  Synthetic
gtcgacttctaccaccctccttcttaacatactaggaggatgggtagcctcccaaatggcgccgccgaccgcttc

SEQ ID NO: 141910 - DNA, 75 bp, Artificial Sequence
  Synthetic
gtcgacttctaccaccctccttcttaacatactaggaggatgggtagcgtcccaaatggcaccgccgaccgcttc

SEQ ID NO: 141911 - DNA, 75 bp, Artificial Sequence
  Synthetic
gtcgacttctaccaccctccttcttaacatactaggaggatgggtagcgtcccaaatggctccgccgaccgcttc

SEQ ID NO: 141912 - DNA, 75 bp, Artificial Sequence
  Synthetic
gtcgacttctaccaccctccttcttaacatactaggaggatgggtagcgtcccaaatggccccgccgaccgcttc

SEQ ID NO: 141913 - DNA, 75 bp, Artificial Sequence
  Synthetic
gtcgacttctaccaccctccttcttaacatactaggaggatgggtagcgtcccaaatggcgccgccgaccgcttc

SEQ ID NO: 141914 - DNA, 75 bp, Artificial Sequence
  Synthetic
gtcgacttctaccaccctcctccttaacatactaggaggatgggtagcatcccaaatggcaccgccgaccgcttc

SEQ ID NO: 141915 - DNA, 75 bp, Artificial Sequence
  Synthetic
gtcgacttctaccaccctcctccttaacatactaggaggatgggtagcatcccaaatggctccgccgaccgcttc

SEQ ID NO: 141916 - DNA, 75 bp, Artificial Sequence
  Synthetic
gtcgacttctaccaccctcctccttaacatactaggaggatgggtagcatcccaaatggccccgccgaccgcttc

SEQ ID NO: 141917 - DNA, 75 bp, Artificial Sequence
  Synthetic
gtcgacttctaccaccctcctccttaacatactaggaggatgggtagcatcccaaatggcgccgccgaccgcttc

SEQ ID NO: 141918 - DNA, 75 bp, Artificial Sequence
  Synthetic
gtcgacttctaccaccctcctccttaacatactaggaggatgggtagcttcccaaatggcaccgccgaccgcttc

SEQ ID NO: 141919 - DNA, 75 bp, Artificial Sequence
  Synthetic
gtcgacttctaccaccctcctccttaacatactaggaggatgggtagcttcccaaatggctccgccgaccgcttc

SEQ ID NO: 141920 - DNA, 75 bp, Artificial Sequence
  Synthetic
gtcgacttctaccaccctcctccttaacatactaggaggatgggtagcttcccaaatggccccgccgaccgcttc

SEQ ID NO: 141921 - DNA, 75 bp, Artificial Sequence
  Synthetic
gtcgacttctaccaccctcctccttaacatactaggaggatgggtagcttcccaaatggcgccgccgaccgcttc

SEQ ID NO: 141922 - DNA, 75 bp, Artificial Sequence
  Synthetic
gtcgacttctaccaccctcctccttaacatactaggaggatgggtagcctcccaaatggcaccgccgaccgcttc

SEQ ID NO: 141923 - DNA, 75 bp, Artificial Sequence
  Synthetic
gtcgacttctaccaccctcctccttaacatactaggaggatgggtagcctcccaaatggctccgccgaccgcttc

SEQ ID NO: 141924 - DNA, 75 bp, Artificial Sequence
  Synthetic
gtcgacttctaccaccctcctccttaacatactaggaggatgggtagcctcccaaatggccccgccgaccgcttc

SEQ ID NO: 141925 - DNA, 75 bp, Artificial Sequence
  Synthetic
gtcgacttctaccaccctcctccttaacatactaggaggatgggtagcctcccaaatggcgccgccgaccgcttc

SEQ ID NO: 141926 - DNA, 75 bp, Artificial Sequence
  Synthetic
gtcgacttctaccaccctcctccttaacatactaggaggatgggtagcgtcccaaatggcaccgccgaccgcttc

SEQ ID NO: 141927 - DNA, 75 bp, Artificial Sequence
  Synthetic
gtcgacttctaccaccctcctccttaacatactaggaggatgggtagcgtcccaaatggctccgccgaccgcttc

SEQ ID NO: 141928 - DNA, 75 bp, Artificial Sequence
  Synthetic
gtcgacttctaccaccctcctccttaacatactaggaggatgggtagcgtcccaaatggccccgccgaccgcttc

SEQ ID NO: 141929 - DNA, 75 bp, Artificial Sequence
  Synthetic
gtcgacttctaccaccctcctccttaacatactaggaggatgggtagcgtcccaaatggcgccgccgaccgcttc

SEQ ID NO: 141930 - DNA, 75 bp, Artificial Sequence
  Synthetic
gtcgacttctaccaccctcctgcttaacatactaggaggatgggtagcatcccaaatggcaccgccgaccgcttc

SEQ ID NO: 141931 - DNA, 75 bp, Artificial Sequence
  Synthetic
gtcgacttctaccaccctcctgcttaacatactaggaggatgggtagcatcccaaatggctccgccgaccgcttc

SEQ ID NO: 141932 - DNA, 75 bp, Artificial Sequence
  Synthetic
gtcgacttctaccaccctcctgcttaacatactaggaggatgggtagcatcccaaatggccccgccgaccgcttc

SEQ ID NO: 141933 - DNA, 75 bp, Artificial Sequence
  Synthetic
gtcgacttctaccaccctcctgcttaacatactaggaggatgggtagcatcccaaatggcgccgccgaccgcttc

SEQ ID NO: 141934 - DNA, 75 bp, Artificial Sequence
  Synthetic
gtcgacttctaccaccctcctgcttaacatactaggaggatgggtagcttcccaaatggcaccgccgaccgcttc

SEQ ID NO: 141935 - DNA, 75 bp, Artificial Sequence
  Synthetic
gtcgacttctaccaccctcctgcttaacatactaggaggatgggtagcttcccaaatggctccgccgaccgcttc

SEQ ID NO: 141936 - DNA, 75 bp, Artificial Sequence
  Synthetic
gtcgacttctaccaccctcctgcttaacatactaggaggatgggtagcttcccaaatggccccgccgaccgcttc

SEQ ID NO: 141937 - DNA, 75 bp, Artificial Sequence
  Synthetic
gtcgacttctaccaccctcctgcttaacatactaggaggatgggtagcttcccaaatggcgccgccgaccgcttc

SEQ ID NO: 141938 - DNA, 75 bp, Artificial Sequence
  Synthetic
gtcgacttctaccaccctcctgcttaacatactaggaggatgggtagcctcccaaatggcaccgccgaccgcttc

SEQ ID NO: 141939 - DNA, 75 bp, Artificial Sequence
  Synthetic
gtcgacttctaccaccctcctgcttaacatactaggaggatgggtagcctcccaaatggctccgccgaccgcttc

SEQ ID NO: 141940 - DNA, 75 bp, Artificial Sequence
  Synthetic
gtcgacttctaccaccctcctgcttaacatactaggaggatgggtagcctcccaaatggccccgccgaccgcttc

SEQ ID NO: 141941 - DNA, 75 bp, Artificial Sequence
  Synthetic
gtcgacttctaccaccctcctgcttaacatactaggaggatgggtagcctcccaaatggcgccgccgaccgcttc

SEQ ID NO: 141942 - DNA, 75 bp, Artificial Sequence
  Synthetic
gtcgacttctaccaccctcctgcttaacatactaggaggatgggtagcgtcccaaatggcaccgccgaccgcttc

SEQ ID NO: 141943 - DNA, 75 bp, Artificial Sequence
  Synthetic
gtcgacttctaccaccctcctgcttaacatactaggaggatgggtagcgtcccaaatggctccgccgaccgcttc

SEQ ID NO: 141944 - DNA, 75 bp, Artificial Sequence
  Synthetic
gtcgacttctaccaccctcctgcttaacatactaggaggatgggtagcgtcccaaatggccccgccgaccgcttc

SEQ ID NO: 141945 - DNA, 75 bp, Artificial Sequence
  Synthetic
gtcgacttctaccaccctcctgcttaacatactaggaggatgggtagcgtcccaaatggcgccgccgaccgcttc

SEQ ID NO: 141946 - DNA, 75 bp, Artificial Sequence
  Synthetic
tgcaatgctagcctcgaaactggctggatagcaggtctcttctactaccacaggttcaactcttcaggctgtccc

SEQ ID NO: 141947 - DNA, 75 bp, Artificial Sequence
  Synthetic
ccattaaccacatcaactccgtgtgggaggacttgcgggaagacaacactacccccatccctacaacaatcatgg

SEQ ID NO: 141948 - DNA, 75 bp, Artificial Sequence
  Synthetic
ggtggccaccagggatggcaaactccccacaacgcagcttcgacgccacatcgatctgcttgtcgggagcgccac

SEQ ID NO: 141949 - DNA, 75 bp, Artificial Sequence
  Synthetic
ccaaggcgtcaacgccgtggcatactacagaggactagacgtcgccgtcatacccgcgacaggagatgtggtcgt

SEQ ID NO: 141950 - DNA, 75 bp, Artificial Sequence
  Synthetic
acgtggaggttcgcagggtgggcgagttccattacatcaccggggtaacacaggacaacattaagtgcccctgcc

SEQ ID NO: 141951 - DNA, 75 bp, Artificial Sequence
  Synthetic
tggggttttcatatgacacccgctgctttgactccactgtaaccgaaaaggacatcagggtcgaggaggaggtct

SEQ ID NO: 141952 - DNA, 75 bp, Artificial Sequence
  Synthetic
gacatcagggtcgaggaggaggtctatcagtgttgtgacctagagcccgaagcccgcaaggtgatatccgccctc

SEQ ID NO: 141953 - DNA, 75 bp, Artificial Sequence
  Synthetic
gcactgcccacccggactttcctggtagcgacctcattgaggctaacctcttgtggtgttcagagtacgccggag

SEQ ID NO: 141954 - DNA, 75 bp, Artificial Sequence
  Synthetic
ttccctgccgggcatccccttcctctcatgccagagggggttcaggggtacctggcgtggtgacggcatatgcta

SEQ ID NO: 141955 - DNA, 75 bp, Artificial Sequence
  Synthetic
agcacaggttggaagctgcctgcaactggacgcggggcgaacgttgcgatctggaagacagggacaggtccgagc

SEQ ID NO: 141956 - DNA, 75 bp, Artificial Sequence
  Synthetic
tctgcagcctaagaagagattcccatcagctttaccagtgtgggctcggcctgagtacaatccgcctttgctgga

SEQ ID NO: 141957 - DNA, 75 bp, Artificial Sequence
  Synthetic
tgctgtttgccggcgtcgatgcaaaaactaccgtcaccgggggggccgctgctcacagcacgtcgaggttcactg

SEQ ID NO: 141958 - DNA, 75 bp, Artificial Sequence
  Synthetic
aacatggaaacggcaggattacagcccaccggctgtccatggctgtgccctacctcccaacaagccgacccccgt

SEQ ID NO: 141959 - DNA, 75 bp, Artificial Sequence
  Synthetic
ctgaaatgcccctgccaggtgcctgcacccgagttcttcacagaggtggatggggtgagaatacacagatatgca

SEQ ID NO: 141960 - DNA, 75 bp, Artificial Sequence
  Synthetic
ctgaattgcccctgccaggtgcctgcacccgagttcttcacagaggtggatggggtgagaatacacagatatgca

SEQ ID NO: 141961 - DNA, 75 bp, Artificial Sequence
  Synthetic
ctgaactgcccctgccaggtgcctgcacccgagttcttcacagaggtggatggggtgagaatacacagatatgca

SEQ ID NO: 141962 - DNA, 75 bp, Artificial Sequence
  Synthetic
ctgaagtgcccctgccaggtgcctgcacccgagttcttcacagaggtggatggggtgagaatacacagatatgca

SEQ ID NO: 141963 - DNA, 75 bp, Artificial Sequence
  Synthetic
agctccgactccggtgccgggcttgccacccccactgacagctccgggccggagcccgaaatcatcgacgacaag

SEQ ID NO: 141964 - DNA, 75 bp, Artificial Sequence
  Synthetic
ggctggggccccatcagctacgccaacggaagcggccccgaacaccgcccttactgctggcactaccccccaaag

SEQ ID NO: 141965 - DNA, 75 bp, Artificial Sequence
  Synthetic
tgcccccgcttgagggggaacccggcgatccagacttggcatcagactcttggtccaccgtcagcagttcggagg

SEQ ID NO: 141966 - DNA, 75 bp, Artificial Sequence
  Synthetic
cgtccatgtggaacagggctgagcagttctgggcaaaacacatgtggaactttgtcagtgggatccaatacttgg

SEQ ID NO: 141967 - DNA, 75 bp, Artificial Sequence
  Synthetic
ttacccggcagaagaaggtgaccttcgaccgcttacaggtggtagacaaccactacaatgcagtacttaaggaga

SEQ ID NO: 141968 - DNA, 75 bp, Artificial Sequence
  Synthetic
tcctgtgcctactcctactttccgtaggggtaggcatcttcctgctgcctgctcgataggcagcttaacactccg

SEQ ID NO: 141969 - DNA, 75 bp, Artificial Sequence
  Synthetic
gagagtggcggcctcagagtacgcggaagtgacgcagcacggatcatatgcctatataacagggctgaccactga

SEQ ID NO: 141970 - DNA, 75 bp, Artificial Sequence
  Synthetic
tgatcacgccatgcgctgcggaggaaagcaagctgcccatcaatgcgttgagcaactctttgctgcgtcaccaca

SEQ ID NO: 141971 - DNA, 75 bp, Artificial Sequence
  Synthetic
ggctggagcgctcgtcgccttcaagatcatgtgcggggagaagccgacagccgaagacctagtaaacctcctgcc

SEQ ID NO: 141972 - DNA, 75 bp, Artificial Sequence
  Synthetic
atcatgtgcggggagaagccgacagccgaagacctagtaaacctcctgccttcaatactctgccctggagcccta

SEQ ID NO: 141973 - DNA, 75 bp, Artificial Sequence
  Synthetic
cgcccccacaccaaagccgtttttccgggatgaggtctcgttcagcgttgggctcaattcatttgtcgtcgggtc

SEQ ID NO: 141974 - DNA, 75 bp, Artificial Sequence
  Synthetic
aaaagagggcgcttcatgacgtcgtcaagaaacttcctgaagccgtgatgggagccgcttatggcttccaatact

SEQ ID NO: 141975 - DNA, 75 bp, Artificial Sequence
  Synthetic
ggaggctgcagcgcggcgtttagcgcgggggtcacccccatctgaggcaagctcctcagcgagccagctgtcggc

SEQ ID NO: 141976 - DNA, 75 bp, Artificial Sequence
  Synthetic
gatatctggccacgtgaaaaacggaaccatgaggatcgtcggcccgaagctgtgcagcaacacctggcacggaac

SEQ ID NO: 141977 - DNA, 75 bp, Artificial Sequence
  Synthetic
tcgtcattgctgaaagcggtggcgtggaagaggatgcccgagccctccgagccttcacggaggctatgacgaggt

SEQ ID NO: 141978 - DNA, 75 bp, Artificial Sequence
  Synthetic
tcaactccgtgtgggaggacttgctggaagacaattccacacctatccctaccaccatcatggctaagaatgagg

SEQ ID NO: 141979 - DNA, 75 bp, Artificial Sequence
  Synthetic
gagcaccataggagatgccctccaacagctggccatcaagtcctttggccagccccccccaagcggcgattcagg

SEQ ID NO: 141980 - DNA, 75 bp, Artificial Sequence
  Synthetic
cagctggccatcaagtcctttggccagccccccccaagcggcgattcaggcctttccacgggggcggacgccgcc

SEQ ID NO: 141981 - DNA, 75 bp, Artificial Sequence
  Synthetic
aagggtctactacctgacccgagaccctgaaactcccctggcacgggctgcttgggagacagtcagacacactcc

SEQ ID NO: 141982 - DNA, 75 bp, Artificial Sequence
  Synthetic
acgagttggctctttcggagacaggttctacctcctccatgccccccctcgagggggagcctggggacccagacc

SEQ ID NO: 141983 - DNA, 75 bp, Artificial Sequence
  Synthetic
tgtgcgagaagagggcgctttacgacatcacatgcaatctgcccgtggctgtaatgggagccgcatacggtttcc

SEQ ID NO: 141984 - DNA, 75 bp, Artificial Sequence
  Synthetic
ggtctacttgctccgaggaggatgactccgtcgtgtgctgctccatgtcatattcctggaccggggctctaataa

SEQ ID NO: 141985 - DNA, 75 bp, Artificial Sequence
  Synthetic
gggccggctcagaaaatccagcttgtaaacactaacggcagctggcacatcaacaggactgccctcaactgcaat

SEQ ID NO: 141986 - DNA, 75 bp, Artificial Sequence
  Synthetic
agtcacggagcgcgacatccagacggaacattcaatttaccagtgctgccaattagagccggcagcacggaaagc

SEQ ID NO: 141987 - DNA, 75 bp, Artificial Sequence
  Synthetic
gtggcgtgtacctctttaactgggcggtgaaaaccaagctcaaactcactccattgcctgccgctgccaaactcg

SEQ ID NO: 141988 - DNA, 75 bp, Artificial Sequence
  Synthetic
ttggaggacagggatagatcagagcttagcccgctgctgctgtctacaacagagtggcaagtactgccctgttcc

SEQ ID NO: 141989 - DNA, 75 bp, Artificial Sequence
  Synthetic
gggggtctcggaggatgtcagtgcactgcgagctttcacggaagctatgaccaggtactcggctcctcctggaga

SEQ ID NO: 141990 - DNA, 75 bp, Artificial Sequence
  Synthetic
ctctgcaagatccaagtatgggtttggggctaaggaggtccgcagcttgtccgggagggccgtcaaccacatcaa

SEQ ID NO: 141991 - DNA, 75 bp, Artificial Sequence
  Synthetic
tcggggggggcgacagcccgcacgacctacaggcttacgtccctcttttcacgtgggtcggctcagaagattcag

SEQ ID NO: 141992 - DNA, 75 bp, Artificial Sequence
  Synthetic
ctccacggaggaagaggaaaccggtggtgctatctgactccaacgtgtcccaagtcctggccgacttggcgcacg

SEQ ID NO: 141993 - DNA, 75 bp, Artificial Sequence
  Synthetic
gcaggggtaggcatctacctcctccccaaccggtgaaggttggggtaaacactccggcctcttaggccatttcct

SEQ ID NO: 141994 - DNA, 75 bp, Artificial Sequence
  Synthetic
ggcctgaggagaagcgtgatgatgactcggacgcggcttcatattcttccatgcctccgctggagggcgagcctg

SEQ ID NO: 141995 - DNA, 75 bp, Artificial Sequence
  Synthetic
ctcggacgcggcttcatattcttccatgcctccgctggagggcgagcctggggaccctgacctttcatcagggtc

SEQ ID NO: 141996 - DNA, 75 bp, Artificial Sequence
  Synthetic
tcacttctttggaatactccagtcccaagaaatgctccataaagcgcttgacttcgatatgtacggagtcacgta

SEQ ID NO: 141997 - DNA, 75 bp, Artificial Sequence
  Synthetic
cccttgctccgcggaggaggaaaaattacctatcaatcctttaagcaacaccctattgcgccaccacaatcttgt

SEQ ID NO: 141998 - DNA, 75 bp, Artificial Sequence
  Synthetic
ggtgcggaaggtcgccgggggtcattatgtccaaatggccttcatgaagctggccgcactgacaggtacgtacgt

SEQ ID NO: 141999 - DNA, 75 bp, Artificial Sequence
  Synthetic
agcttgtgggttaacaccaccccattccgcccgttccaagtatggatacggcgctaaggaggttcgctctctcga

SEQ ID NO: 142000 - DNA, 75 bp, Artificial Sequence
  Synthetic
gcacttctctcgtgcctcactacccccgtctccgcaattcatgccaagaacgcgtcaggggtttatcatctcacc

SEQ ID NO: 142001 - DNA, 75 bp, Artificial Sequence
  Synthetic
aatgactgtcccaattccagcatcgtgtacgaggcagagagtataatcttgcaccttccgggatgcgtcccgtgc

SEQ ID NO: 142002 - DNA, 75 bp, Artificial Sequence
  Synthetic
cctactatccgtaggagtaggcatctttttacttccagctcggtaagctggaagcccaaagctacactccaatac

SEQ ID NO: 142003 - DNA, 75 bp, Artificial Sequence
  Synthetic
actctgataccccattgccgacaaccatcatggcaaaaaacgaggtgttcgcagtggagccgtccaaggggggga

SEQ ID NO: 142004 - DNA, 75 bp, Artificial Sequence
  Synthetic
gagaagcgggcattgtatgacatagctcaaaaactgccaacagcccttatggggccctcgtacgggtttcagtac

SEQ ID NO: 142005 - DNA, 75 bp, Artificial Sequence
  Synthetic
accttatcgttggcgctgcagccttttgttctgccatgtatattggagatctttgtggcggcgttttccttgtgg

SEQ ID NO: 142006 - DNA, 75 bp, Artificial Sequence
  Synthetic
catgatgatgaactggtctcctaccgtgacttatgtggtctccagtgccttgagaacgccacagttgctcctcga

SEQ ID NO: 142007 - DNA, 75 bp, Artificial Sequence
  Synthetic
tgtgcgcgcgactcggaagacttcggagcggtcgcaacctcgtggaaggcgccaacctatccccaaggcgcgtcg

SEQ ID NO: 142008 - DNA, 75 bp, Artificial Sequence
  Synthetic
gcatggtggcgaattgggccaaggtcttagtcgttctcctcatgtttgcgggggtggatgcttctacctacattt

SEQ ID NO: 142009 - DNA, 75 bp, Artificial Sequence
  Synthetic
gccgcgccagcggcgtcttcaccactagtatgggcaacaccatgacgtgctacattaaggccttagcctcctgta

SEQ ID NO: 142010 - DNA, 75 bp, Artificial Sequence
  Synthetic
cgtcaaccgcactgcgcttaactgcaatgactctctgcagacggggttctttgttccgttattctacaagcagaa

SEQ ID NO: 142011 - DNA, 75 bp, Artificial Sequence
  Synthetic
gcccgtcgtcttctctgacatggagaccaagatcatcacctggggggcggacaccgcggcgtgtggggacatcat

SEQ ID NO: 142012 - DNA, 75 bp, Artificial Sequence
  Synthetic
cggttgctccttttctatcttccttttggcacttctctcgtgcctgactgtccccgcttcagccgtgcactatcg

SEQ ID NO: 142013 - DNA, 75 bp, Artificial Sequence
  Synthetic
ccgcccacaggacgtcaagttcccgggcggtggccagatcgttggtggagtttacctgttgccgcgcaggggccc

SEQ ID NO: 142014 - DNA, 75 bp, Artificial Sequence
  Synthetic
cgaccccaacatcagaactggggtaaggaccatcaccacgggcgcccctatcacatactccacctatggcaagtt

SEQ ID NO: 142015 - DNA, 75 bp, Artificial Sequence
  Synthetic
ccatctgaggaaaggccctactgctggcattacccgccgaggccctgtgaggttgtcccagcggaatcggtctgc

SEQ ID NO: 142016 - DNA, 75 bp, Artificial Sequence
  Synthetic
tacttggctgtatcatcactagcctcacaggccgagacaaaaaccaggtcgagggggaggttcaagtggtctcca

SEQ ID NO: 142017 - DNA, 75 bp, Artificial Sequence
  Synthetic
cagttaactcctggttggggaacatcatcatgtacgctccgaccctgtgggctcggatagtgctgatgacgcact

SEQ ID NO: 142018 - DNA, 75 bp, Artificial Sequence
  Synthetic
catcatgtacgctccgaccctgtgggctcggatagtgctgatgacgcactttttcagcgtactgcagagccagga

SEQ ID NO: 142019 - DNA, 75 bp, Artificial Sequence
  Synthetic
gcaccaaggtgccggccgcatatgcggcccaagggtacaaggtgctcgttctgaacccatccgttgccgccacct

SEQ ID NO: 142020 - DNA, 75 bp, Artificial Sequence
  Synthetic
tgtgtgaggacggggaacaagtcacaatgttgggtggcgctaacccccactgtggcggcgccctacctcaacgct

SEQ ID NO: 142021 - DNA, 75 bp, Artificial Sequence
  Synthetic
tcctgcttgggagcgcacggcctccgcaggggtcttggttcggatgcacctggatgaacggtaccggctatgtca

SEQ ID NO: 142022 - DNA, 75 bp, Artificial Sequence
  Synthetic
cacgctcctactggcagcggcaagagcaccaaggtgccggccgcatatgcggcccaagggtacaaggtgctcgtt

SEQ ID NO: 142023 - DNA, 75 bp, Artificial Sequence
  Synthetic
cgggccaactgttcacctaccagccacgccgccactggaccacccaagactgcaattgctccatctatcctggac

SEQ ID NO: 142024 - DNA, 75 bp, Artificial Sequence
  Synthetic
accctggtgtgccctaccgattgtttccgaaaacacccggacactacctttggcaaatgcggatcaggcccttgg

SEQ ID NO: 142025 - DNA, 75 bp, Artificial Sequence
  Synthetic
aggggtggcgactccttgcgcctatcacggcctactcccaacagacgcggggcctacttggctgcatcatcacta

SEQ ID NO: 142026 - DNA, 75 bp, Artificial Sequence
  Synthetic
acccttaccggctgtggcactatccttgcactgtgaatttcaccatacacaaggtcaggatgttcgtgggcggca

SEQ ID NO: 142027 - DNA, 75 bp, Artificial Sequence
  Synthetic
cgacctgctctctgggggccattggggcgttctagcgggcctggcgtactacagcatgcaagccaactgggccaa

SEQ ID NO: 142028 - DNA, 75 bp, Artificial Sequence
  Synthetic
acattcactaccatgcctgcgctgtcgaccggcctaatccaccttcaccagaatatcgtggacgtgcaatacctc

SEQ ID NO: 142029 - DNA, 75 bp, Artificial Sequence
  Synthetic
taaacactccataactcctgttttttttttttttttttttttttttttcttttttttttcttttcctgttctttt

SEQ ID NO: 142030 - DNA, 75 bp, Artificial Sequence
  Synthetic
tcgcccgggggtaggcaagacataaggctcataaacaccaatgggagctggcatgtcaacaggacttctctcaac

SEQ ID NO: 142031 - DNA, 75 bp, Artificial Sequence
  Synthetic
cgtgggcattgaagtgggagtatgtagtccttgctttcctggttctggctgactcgcgcttgtgtgcgtgtttgt

SEQ ID NO: 142032 - DNA, 75 bp, Artificial Sequence
  Synthetic
agtccttgctttcctggttctggctgactcgcgcttgtgtgcgtgtttgtggttgatgtttctggttggccaggc

SEQ ID NO: 142033 - DNA, 75 bp, Artificial Sequence
  Synthetic
tcgacgagatggagcagggatggggacagctcggcgtcgacgacaactcgtcttccgagtcaaggccttactgtt

SEQ ID NO: 142034 - DNA, 75 bp, Artificial Sequence
  Synthetic
agcacctgggtgctggtaggcggagtccttgcagctctggccgcatattgcttgacaacaggcagcgtggtcatt

SEQ ID NO: 142035 - DNA, 75 bp, Artificial Sequence
  Synthetic
cagccgcgggacccccacgtacaactggggtgaaaacgacactgatgtcatcatcatgaacgcaacaaggcctcc

SEQ ID NO: 142036 - DNA, 75 bp, Artificial Sequence
  Synthetic
atctttactctcaccccagcctataaacaacttcttgtaggtgtgctgtggtggacccaatatttcatcgcacgt

SEQ ID NO: 142037 - DNA, 75 bp, Artificial Sequence
  Synthetic
ttgcctactattccatggcggggaactgggccaaggttttgattgtgatgctactctttgccggcgttgatgggg

SEQ ID NO: 142038 - DNA, 75 bp, Artificial Sequence
  Synthetic
tcacaggcctcacccacatagatgcccatttcctgtcccagactaaacaggcaggggacaacttcccctacctgg

SEQ ID NO: 142039 - DNA, 75 bp, Artificial Sequence
  Synthetic
gtcccctcctgtgcctccgcctcggaagaagcggacggtggtcctcaccgaatcaactgtatctactgccttggc

SEQ ID NO: 142040 - DNA, 75 bp, Artificial Sequence
  Synthetic
ccctgtcccaccgattgcttcaggaagcatccggatgccacctacgccaggtgcggctcggggccatggctcacg

SEQ ID NO: 142041 - DNA, 75 bp, Artificial Sequence
  Synthetic
tgcttgttccaccctcagcttgggtttgaggtgacaaagatcctgatggccttgctcggttcaatgtacttgctc

SEQ ID NO: 142042 - DNA, 75 bp, Artificial Sequence
  Synthetic
ggatgcaaagagcgcctggccagctgccgctccatcgacaagttcaatcaaggatggggccccatcacctatacc

SEQ ID NO: 142043 - DNA, 75 bp, Artificial Sequence
  Synthetic
accgcctagaagcagcatgcaactggaccaggggagagccctgcggtctcgaacacagggatcgtacggagttgt

SEQ ID NO: 142044 - DNA, 75 bp, Artificial Sequence
  Synthetic
accgccttgaagcagcatgcaactggaccaggggagagccctgcggtctcgaacacagggatcgtacggagttgt

SEQ ID NO: 142045 - DNA, 75 bp, Artificial Sequence
  Synthetic
accgcctcgaagcagcatgcaactggaccaggggagagccctgcggtctcgaacacagggatcgtacggagttgt

SEQ ID NO: 142046 - DNA, 75 bp, Artificial Sequence
  Synthetic
accgcctggaagcagcatgcaactggaccaggggagagccctgcggtctcgaacacagggatcgtacggagttgt

SEQ ID NO: 142047 - DNA, 75 bp, Artificial Sequence
  Synthetic
gactggcacttatgtgtatgaccatctcaccccccttactgattgggcctgtgacgggttgcgagaccttgccgt

SEQ ID NO: 142048 - DNA, 75 bp, Artificial Sequence
  Synthetic
gtgacgggttgcgagaccttgccgttgcagtggagccggtcgtcttctctccaatggagaagaaagtcatcactt

SEQ ID NO: 142049 - DNA, 75 bp, Artificial Sequence
  Synthetic
ggcattgccggtgcggctgttggcagcataggccttgggaaggtgcttgtggacatcttggcgggctatggggca

SEQ ID NO: 142050 - DNA, 75 bp, Artificial Sequence
  Synthetic
cgtggacgtccagtacctctacggtgttagctctgcagtggtgtcgtgggcactcaagtgggagtacgtggtgct

SEQ ID NO: 142051 - DNA, 75 bp, Artificial Sequence
  Synthetic
aatgctatggcggccgctggctgccacggttactgctatgccttcctcttcatctgcgtggcttggtacatcaaa

SEQ ID NO: 142052 - DNA, 75 bp, Artificial Sequence
  Synthetic
tcggggccttggttgacacctaggtgcctggttgactacccatacaggctctggcactacccctgcactgtcaac

SEQ ID NO: 142053 - DNA, 75 bp, Artificial Sequence
  Synthetic
cagccttaccatcactcagctgctgaagaggctccaccagtggatcaatgaggactgctccacgccatgctccgg

SEQ ID NO: 142054 - DNA, 75 bp, Artificial Sequence
  Synthetic
aggtggcgggttctgtcggcggtggtgtcctgatcctgctaacagtcctaacgctgtcgccgcactacaagcggt

SEQ ID NO: 142055 - DNA, 75 bp, Artificial Sequence
  Synthetic
tcaagacctggctccagtccaagctcctgccgcggttgccgggagtccctttcctctcatgccaacgtgggtaca

SEQ ID NO: 142056 - DNA, 75 bp, Artificial Sequence
  Synthetic
tctgacaccatgctcgtgcgggtcgagtgacctctatctggtcacaaggaacgctgatgtcattcccgccaggcg

SEQ ID NO: 142057 - DNA, 75 bp, Artificial Sequence
  Synthetic
agtgacctctatctggtcacaaggaacgctgatgtcattcccgccaggcgcaggggggatagccgagctgctctc

SEQ ID NO: 142058 - DNA, 75 bp, Artificial Sequence
  Synthetic
ctctatgatcatcctcctggccatattccatccctacctggcctttgagatcactaaacacctgctagcactgct

SEQ ID NO: 142059 - DNA, 75 bp, Artificial Sequence
  Synthetic
caaggggcgtggccaagtcgctggattttgtgccggtggagaacatgcagaccgtccagcggtccccatctttct

SEQ ID NO: 142060 - DNA, 75 bp, Artificial Sequence
  Synthetic
aatagcccaggccgaggccgccttagagaacctggtggtcctcaatgcggcgtctgtagccggaacacatggcat

SEQ ID NO: 142061 - DNA, 75 bp, Artificial Sequence
  Synthetic
gccgcaaacctatcaggtagggtacctccacgctcccacggggagtgggaagagtacgaaagttccagcggctta

SEQ ID NO: 142062 - DNA, 75 bp, Artificial Sequence
  Synthetic
tatggcaagtactgccaaatggctctactcaggctaggtgccctaaccggcacatacatctacaaccacctcacc

SEQ ID NO: 142063 - DNA, 75 bp, Artificial Sequence
  Synthetic
atccgcaccggggtgaggaccattacaaccggcgggccgatcacctactctacttatgggaaattcctcgccgac

SEQ ID NO: 142064 - DNA, 75 bp, Artificial Sequence
  Synthetic
ctgacacagctgcgtgcggtgacatcataaagggcctacctgtgtcggccagactaggcaacgaggtgttgcttg

SEQ ID NO: 142065 - DNA, 75 bp, Artificial Sequence
  Synthetic
ggcgggtgctctggtggggcttatgacatcattatctgtgatgaatgccattcgaccgatcctaccacgattcta

SEQ ID NO: 142066 - DNA, 75 bp, Artificial Sequence
  Synthetic
cctcactggcagagacaccaatgagaactgcggcgaggtccaggtattgtccactgccacacagtccttcttagg

SEQ ID NO: 142067 - DNA, 75 bp, Artificial Sequence
  Synthetic
acatcacggaggaggccctgcccaccaccggcgagatccccttctacgggaaggggattccccttgacttcatca

SEQ ID NO: 142068 - DNA, 75 bp, Artificial Sequence
  Synthetic
caccggcgagatccccttctacgggaaggggattccccttgacttcatcaaaggggggagacacttgatcttttg

SEQ ID NO: 142069 - DNA, 75 bp, Artificial Sequence
  Synthetic
gaccaagacctggtggggtggccagcgcctccaggggtaaagtcacttgcgccgtgcacttgcggtgcgtcggac

SEQ ID NO: 142070 - DNA, 75 bp, Artificial Sequence
  Synthetic
gaccaagacctggtggggtggccagcgcctccaggggtaaagtctcttgcgccgtgcacttgcggtgcgtcggac

SEQ ID NO: 142071 - DNA, 75 bp, Artificial Sequence
  Synthetic
gaccaagacctggtggggtggccagcgcctccaggggtaaagtcccttgcgccgtgcacttgcggtgcgtcggac

SEQ ID NO: 142072 - DNA, 75 bp, Artificial Sequence
  Synthetic
gaccaagacctggtggggtggccagcgcctccaggggtaaagtcgcttgcgccgtgcacttgcggtgcgtcggac

SEQ ID NO: 142073 - DNA, 75 bp, Artificial Sequence
  Synthetic
acagacggtgacgtggtcgtctgcgccacggacgcattgatgaccggctacacaggcaacttcgacactgtgata

SEQ ID NO: 142074 - DNA, 75 bp, Artificial Sequence
  Synthetic
caacctatccccaaggcgcgccgaaacgaggggcgtacctgggcgcagcctgggtacccttggcccctttatggt

SEQ ID NO: 142075 - DNA, 75 bp, Artificial Sequence
  Synthetic
gctcttcgggcggtccgctgctgtgcccccagggtcacgccgtcggtatcttccgagcggccgtgtgcacccggg

SEQ ID NO: 142076 - DNA, 75 bp, Artificial Sequence
  Synthetic
agaggagaggcaggaccggcagagggaagcacggggtgtatcgatacgtctcgttaggggaacgaccgtcggggt

SEQ ID NO: 142077 - DNA, 75 bp, Artificial Sequence
  Synthetic
gacctatcaggtcgcccatttgcatgcgccaacggggagcggcaagagcaccaaagttcctgcagcttacgctgc

SEQ ID NO: 142078 - DNA, 75 bp, Artificial Sequence
  Synthetic
ggcgtatgatacgggttgcgcgtggtatgaattaactccagctgagaccacggttcgactgcgcgcatacctcaa

SEQ ID NO: 142079 - DNA, 75 bp, Artificial Sequence
  Synthetic
cggttcgactgcgcgcatacctcaacaccccaggccttcccgtctgccaggaccatctcgagttctgggagggag

SEQ ID NO: 142080 - DNA, 75 bp, Artificial Sequence
  Synthetic
aattatgcaacggggaatcttcctggttgctctttctctatcttcctcttggccatactgtcatgcctgaccgtc

SEQ ID NO: 142081 - DNA, 75 bp, Artificial Sequence
  Synthetic
gttgctctttctctatcttcctcttggccatactgtcatgcctgaccgtccctgcgtccgggctggtatatcgca

SEQ ID NO: 142082 - DNA, 75 bp, Artificial Sequence
  Synthetic
gtatggcatcgacccgaacatacggtcaggtgtcaggaccatcaccacaggagcgcctattacatactccaccta

SEQ ID NO: 142083 - DNA, 75 bp, Artificial Sequence
  Synthetic
gagacggcatcatgcaaaccacctgcccatgtggagcacaaatcaccggacatgtcaaaaacggttccatgagga

SEQ ID NO: 142084 - DNA, 75 bp, Artificial Sequence
  Synthetic
caaatgtacaccaatgtagaccaggacctcgtcggttggcaggcgccccccggggcgcgctccctgacaccatgc

SEQ ID NO: 142085 - DNA, 75 bp, Artificial Sequence
  Synthetic
tatgggcacggccggactacaaccctccattactagagtcctggaaggacccggactacgtccctccggtggtac

SEQ ID NO: 142086 - DNA, 75 bp, Artificial Sequence
  Synthetic
cgccagggcgaaagccccccccccctcatgggacgtcatgtggaagtgtctcctacgcctcaagcccacgctcac

SEQ ID NO: 142087 - DNA, 75 bp, Artificial Sequence
  Synthetic
ggcccctccaataccacctccacggaggaagaggacggttgtcctgacagaatccaccgtatcttctgccttggc

SEQ ID NO: 142088 - DNA, 75 bp, Artificial Sequence
  Synthetic
cgtaaagtctgccaacacatcgcattgctggatccctgtaacacctactgttgccgtgcgcgccccgggcgttat

SEQ ID NO: 142089 - DNA, 75 bp, Artificial Sequence
  Synthetic
ggcacggtcctagaccaggcagagaccgctggagcgcgccttgtcgtgctcgcgactgccacgccgccagggtcg

SEQ ID NO: 142090 - DNA, 75 bp, Artificial Sequence
  Synthetic
catgacatgcatgtcggctgacctggaagtcgtcacgagcacctgggtgctcgttggcggcgttctggctgcttt

SEQ ID NO: 142091 - DNA, 75 bp, Artificial Sequence
  Synthetic
catcatgacctgcatgtccgcggacttggaggtagtcacaagtacttgggtgctagtgggaggtgtccttgccgc

SEQ ID NO: 142092 - DNA, 75 bp, Artificial Sequence
  Synthetic
tgggggatttccactacgtgacgggcatgactactgacaacctgaaatgcccatgccaggtcccagcccccgaat

SEQ ID NO: 142093 - DNA, 75 bp, Artificial Sequence
  Synthetic
gggcaagctttcaggttccgtcaacgccaacattggacaacacaggactgcaactgttccatgtatccgggccac

SEQ ID NO: 142094 - DNA, 75 bp, Artificial Sequence
  Synthetic
ggaggcatctcattttctgccattcaagaaagaaatgtgacgagttggccaaacagctgtcatctcttggcctca

SEQ ID NO: 142095 - DNA, 75 bp, Artificial Sequence
  Synthetic
cggcagttcgatgagatggaggaatgttccagtcatattccttacctccctgaggcccaagccatcgctgagcaa

SEQ ID NO: 142096 - DNA, 75 bp, Artificial Sequence
  Synthetic
acttgctcgttgggtcccactggggcgtccttgccggtcttgcttacttctccatgcaaggcaattgggccaaag

SEQ ID NO: 142097 - DNA, 75 bp, Artificial Sequence
  Synthetic
tgactttgactcagtcatagactgtaacacctcagtcacacagactgtagatttcagcctggacccaaccttttc

SEQ ID NO: 142098 - DNA, 75 bp, Artificial Sequence
  Synthetic
accggcatccgctgtgcattaccggaatgcctcgggcatctatcacatcaccaatgattgccccaactccagcat

SEQ ID NO: 142099 - DNA, 75 bp, Artificial Sequence
  Synthetic
cagtggtattcaatacctggctggcctgtcaacattgccaggtaacccggcaatagcttccctcatgtccttctc

SEQ ID NO: 142100 - DNA, 75 bp, Artificial Sequence
  Synthetic
tccaggcgcccaacagaacatccagctcatcaacagcaacgggtcttggcacatcaatcggacagcactcaactg

SEQ ID NO: 142101 - DNA, 75 bp, Artificial Sequence
  Synthetic
ggggaaagaccatccggcatgtttgactccgcagtgctttgcgagtgttacgatgccgggtgtgcttggtatgaa

SEQ ID NO: 142102 - DNA, 75 bp, Artificial Sequence
  Synthetic
gtggcctcgccctacccgaatgcaccattagaatccatgcgcaggcatgtggacttgatggtaggcgcagccact

SEQ ID NO: 142103 - DNA, 75 bp, Artificial Sequence
  Synthetic
gtggcctcgccctacccgaatgcaccattagaatccatgcgcaggcatgtggacttgatggttggcgcagccact

SEQ ID NO: 142104 - DNA, 75 bp, Artificial Sequence
  Synthetic
gtggcctcgccctacccgaatgcaccattagaatccatgcgcaggcatgtggacttgatggtcggcgcagccact

SEQ ID NO: 142105 - DNA, 75 bp, Artificial Sequence
  Synthetic
gtggcctcgccctacccgaatgcaccattagaatccatgcgcaggcatgtggacttgatggtgggcgcagccact

SEQ ID NO: 142106 - DNA, 75 bp, Artificial Sequence
  Synthetic
ctcatcaacagcaacgggtcttggcacatcaatcggacagcactcaactgcaacgattcccttaacaccgggttc

SEQ ID NO: 142107 - DNA, 75 bp, Artificial Sequence
  Synthetic
ggcgaagatcgcgtaatttgggtaaagtcatcgataccctcacatgcggtttcgccgacctcatgggatacatcc

SEQ ID NO: 142108 - DNA, 75 bp, Artificial Sequence
  Synthetic
tgggcacgcccggattacaatcctccactgctagagtcttggaagaacccggactacgtccctccagtggtacac

SEQ ID NO: 142109 - DNA, 75 bp, Artificial Sequence
  Synthetic
ccttaaaagatgctaacatcacagacacaatggacatcaggccctattgctggcattacgcccctaagccgtgtg

SEQ ID NO: 142110 - DNA, 75 bp, Artificial Sequence
  Synthetic
gggcacttgttggcttcaaaatcatgtgcggcgagactccatctgccgaggacatggtcaacctgctccccgcct

SEQ ID NO: 142111 - DNA, 75 bp, Artificial Sequence
  Synthetic
ccggcctagttaacatcgacggccatttcctatctcagaccaagaagtcgggtgagaacttcccgtacctggtag

SEQ ID NO: 142112 - DNA, 75 bp, Artificial Sequence
  Synthetic
gcaattgttccatctactccggccacatcaccggccataggatggcttgggacatgatgatgaattggagcccta

SEQ ID NO: 142113 - DNA, 75 bp, Artificial Sequence
  Synthetic
gcacttctctcgtgcctgaccgtcccggcctcggctcagcattatcggaatgtttcgggcatctaccatgtcacc

SEQ ID NO: 142114 - DNA, 75 bp, Artificial Sequence
  Synthetic
ttgcgctttctctatcttcatcttggcacttctctcgtgcctgaccgtcccggcctcggctcagcattatcggaa

SEQ ID NO: 142115 - DNA, 75 bp, Artificial Sequence
  Synthetic
tacaccccttctgtacagactaggggccgtacaaaatgaggtgactctcacacatcccataacaaagtacatcat

SEQ ID NO: 142116 - DNA, 75 bp, Artificial Sequence
  Synthetic
ctgcatgcaggctaattgggccaaggtcatcctggtcctattcctcttcgcaggagtagagggaaccacccatgt

SEQ ID NO: 142117 - DNA, 75 bp, Artificial Sequence
  Synthetic
tccatgctccggttcctggttgagagacatctgggactggatatgcgaggtgctgagcgattttaagacctggtt

SEQ ID NO: 142118 - DNA, 75 bp, Artificial Sequence
  Synthetic
ctggggcgagaatgagaccgatgtcttccttcttaagtccacaaaacccccggctgggcggtggtttggctgcac

SEQ ID NO: 142119 - DNA, 75 bp, Artificial Sequence
  Synthetic
acacctaccagggtgtgtaccctgtgtgaaggccgggaacgtctcgcgctgctgggtggccttaacacctactgt

SEQ ID NO: 142120 - DNA, 75 bp, Artificial Sequence
  Synthetic
actgattgcttcaggaaacacccagatgccacttatagccggtgcgggtccggcccatggctcacgccacggtgc

SEQ ID NO: 142121 - DNA, 75 bp, Artificial Sequence
  Synthetic
gtggtagttgtcgggagagtcgtcctatctggccaacctgctgtcattccaaatcgggagatgctctaccaacag

SEQ ID NO: 142122 - DNA, 75 bp, Artificial Sequence
  Synthetic
ctctgcgggggtgctttcctagtggggcagatgttcaccttccagccgcgtcgccactggactgtccaagactgc

SEQ ID NO: 142123 - DNA, 75 bp, Artificial Sequence
  Synthetic
catatcaacaggaccgccctcaattgtgatgactctctcaacacgggctttgtggccggcctgttctaccaccac

SEQ ID NO: 142124 - DNA, 75 bp, Artificial Sequence
  Synthetic
cgtgacgtctgggactgggactgcacggtgttgtcagacttcaaaacctggctcaaagcaaaacttgttccagcg

SEQ ID NO: 142125 - DNA, 75 bp, Artificial Sequence
  Synthetic
cgtgacgtctgggactgggtctgcacggtgttgtcagacttcaaaacctggctcaaagcaaaacttgttccagcg

SEQ ID NO: 142126 - DNA, 75 bp, Artificial Sequence
  Synthetic
cgtgacgtctgggactgggcctgcacggtgttgtcagacttcaaaacctggctcaaagcaaaacttgttccagcg

SEQ ID NO: 142127 - DNA, 75 bp, Artificial Sequence
  Synthetic
cgtgacgtctgggactggggctgcacggtgttgtcagacttcaaaacctggctcaaagcaaaacttgttccagcg

SEQ ID NO: 142128 - DNA, 75 bp, Artificial Sequence
  Synthetic
gctcatctgacgaaaagccctactgctggcattatgcaccgcggccttgcggggtggtgcctgcatcaagcgtgt

SEQ ID NO: 142129 - DNA, 75 bp, Artificial Sequence
  Synthetic
tcgccggcagacaggcccaagaagctacaccagtggtgaagtccagcctcgagaagctcgagcagttctgggcga

SEQ ID NO: 142130 - DNA, 75 bp, Artificial Sequence
  Synthetic
acgtggcatgcaattggactcgtggggagcgttgtgatctctctgaccgggatcgctcagagatacagcccctac

SEQ ID NO: 142131 - DNA, 75 bp, Artificial Sequence
  Synthetic
tgaggatcccctccgcccttgttgacatgctcagcgggggccattggggtgtcctagcaggcctcgcgttcttcg

SEQ ID NO: 142132 - DNA, 75 bp, Artificial Sequence
  Synthetic
tacactctaccactgagctcgccattctaccttgctccttcacgcccatgccggccctgtctactgggcttatac

SEQ ID NO: 142133 - DNA, 75 bp, Artificial Sequence
  Synthetic
catgctcagcgggggccattggggtgtcctagcaggcctcgcgttcttcgggatgcaggccaactgggccaaggt

SEQ ID NO: 142134 - DNA, 75 bp, Artificial Sequence
  Synthetic
tagcgtacccattcctgagcccaattatacccgggctctgtggagggtctctgctgaggactatgttgaggttaa

SEQ ID NO: 142135 - DNA, 75 bp, Artificial Sequence
  Synthetic
cttcatactgaactccaccaggccccccggaggggcttggtttggatgtacatggatgaatggcaccggcttcgt

SEQ ID NO: 142136 - DNA, 75 bp, Artificial Sequence
  Synthetic
agtcacgagtcctctcaccacccagcagaccctcctgttcaacatcttgggggggtgggtggcgtcgcagattgc

SEQ ID NO: 142137 - DNA, 75 bp, Artificial Sequence
  Synthetic
cgcgggctgcgtgggagacagctagacacactccagtcaactcctggctaggcaacatcatcatgtatgcgccca

SEQ ID NO: 142138 - DNA, 75 bp, Artificial Sequence
  Synthetic
agctagccttaccagccttttcacccccgggtctatgcagaatatcatgctaattaacaccaacgggagctggca

SEQ ID NO: 142139 - DNA, 75 bp, Artificial Sequence
  Synthetic
gctcttggcggacgcccgggtttgtgtttgcatctggatgctcttgctcgtcacccaagcagaggcggctttgga

SEQ ID NO: 142140 - DNA, 75 bp, Artificial Sequence
  Synthetic
gtgggcgctactgaggataacctaaagtgcccatgccaagtgccagctccagagttcttcactgaggttgatggt

SEQ ID NO: 142141 - DNA, 75 bp, Artificial Sequence
  Synthetic
aagtgcggggcgggtccttggctcaccccgagatgtctggtcaattacccataccggctgtggcattacccatgc

SEQ ID NO: 142142 - DNA, 75 bp, Artificial Sequence
  Synthetic
tatggcgccggggttgctggcgccgtagtcacttttaagatcatgagcggcgagatgccgaccacagaggactta

SEQ ID NO: 142143 - DNA, 75 bp, Artificial Sequence
  Synthetic
aatcacattctccgtaggtatgtcctcctacgcaatggggtctcaactcccgtgtgagcccgagccggacgtcat

SEQ ID NO: 142144 - DNA, 75 bp, Artificial Sequence
  Synthetic
aggcttgccgcgtgcaagggtctagaagccttcgcacagggctggggcgagcttggggtcgctaacgtcagtgga

SEQ ID NO: 142145 - DNA, 75 bp, Artificial Sequence
  Synthetic
gtcccgttaaccacgtacaccctgactgggctctggtcccttgctctgctcgtcctgatgctaccgacccgggca

SEQ ID NO: 142146 - DNA, 75 bp, Artificial Sequence
  Synthetic
tccaccatagggaccgcactgagttatcacctctactcctgtcgaccactcagtggcaggtgctcccctgctctt

SEQ ID NO: 142147 - DNA, 75 bp, Artificial Sequence
  Synthetic
tgcagtggatgaaccgtcttattgccttcgcatcgcgaggtaatcacgtgtcacctacgcactatgttcctgaat

SEQ ID NO: 142148 - DNA, 75 bp, Artificial Sequence
  Synthetic
ccctcatcctgatgctgagctgatcgaagctaacctactgtggaggcaggagatgggtaacaacataactcgagt

SEQ ID NO: 142149 - DNA, 75 bp, Artificial Sequence
  Synthetic
gtcccgtggtcgtcggcacgaccgaccggcttggagcccctacctattcctggggggacaacgagaccgatgtgc

SEQ ID NO: 142150 - DNA, 75 bp, Artificial Sequence
  Synthetic
gtatcatctggtggaaccaatatgccatcgcacgatgtgaggctgctttacaggtttgggttccccccctcctcg

SEQ ID NO: 142151 - DNA, 75 bp, Artificial Sequence
  Synthetic
ggctcttaagtgggagtacattgtactggctttcctgctgctcgcagacgccagggtctgcgcatgcctctggat

SEQ ID NO: 142152 - DNA, 75 bp, Artificial Sequence
  Synthetic
taacggcgggtggtacgggtgcgcctggatgaacagcactgggttcacaaagacctgcggggcccccccctgctc

SEQ ID NO: 142153 - DNA, 75 bp, Artificial Sequence
  Synthetic
atgcgacacatcttggttgcgggagatctgggactgggtctgcaccgtactgagtgacttcaagacgtggctcaa

SEQ ID NO: 142154 - DNA, 75 bp, Artificial Sequence
  Synthetic
gtatcttctccaggctgccttgacacgcacgccctattttgtgcgcgcccacgcgcttgtgcgtttgtgcattct

SEQ ID NO: 142155 - DNA, 75 bp, Artificial Sequence
  Synthetic
cagcataggccttgggaaggtgcttgtggacattctggcgggctatggggcgggggtggctggcgcgctcgtggc

SEQ ID NO: 142156 - DNA, 75 bp, Artificial Sequence
  Synthetic
ttcttctgcgtcgcatggtacatcaaaggcagagcccctgcggccgtgacttacgcggcctgcgggatgtggcca

SEQ ID NO: 142157 - DNA, 75 bp, Artificial Sequence
  Synthetic
atggcaacttgagggtgcggtacttcatgttcctggttgcataccctgcgagcaggcggacaacaaatcgcggtg

SEQ ID NO: 142158 - DNA, 75 bp, Artificial Sequence
  Synthetic
ccctgcggtgcggagctggccggccatgtcaagaacggctcgatgagggtcgttggaccaaagacttgcagtaac

SEQ ID NO: 142159 - DNA, 75 bp, Artificial Sequence
  Synthetic
tacccatttgggctaggcctgactacaacccgcctcttttggaaccatggaagtctcctgactataacccaccaa

SEQ ID NO: 142160 - DNA, 75 bp, Artificial Sequence
  Synthetic
tcacactttctccccgctacaaggcatggcttgcttggataatgtggtggatacaatattaccttactagaactg

SEQ ID NO: 142161 - DNA, 75 bp, Artificial Sequence
  Synthetic
gcttgctcagctagctgagaaaacatttccgcagcccgcgtctcttacgacagggtgcggatctggccaagctgc

SEQ ID NO: 142162 - DNA, 75 bp, Artificial Sequence
  Synthetic
gactgggcagctgagggccttgcagatctcgctgcggctacagaaccagtggtcttctccaagatggagacaaag

SEQ ID NO: 142163 - DNA, 75 bp, Artificial Sequence
  Synthetic
atctacctgctccccaaccgatagacggggacctaaacactccggcccactaggccatcctgtttttttcccttt

SEQ ID NO: 142164 - DNA, 75 bp, Artificial Sequence
  Synthetic
cgccgctgctgctttccaccacacagtggcagattctcccctgctctttcaccactatgcccgccctctcgaccg

SEQ ID NO: 142165 - DNA, 75 bp, Artificial Sequence
  Synthetic
aggaatacgtggaagttcgcaaggtgggagagttccattacatcactggggtgacgcaagacaacatcaagtgcc

SEQ ID NO: 142166 - DNA, 75 bp, Artificial Sequence
  Synthetic
aggctgattcttacagttccatgccgcctcttgaaggcgagccgggcgaccctgacctcagctcagggtcatggt

SEQ ID NO: 142167 - DNA, 75 bp, Artificial Sequence
  Synthetic
gatcactaaacatcttctggccatccttgggcccattgctatactacaggcctctctcctgcggatcccctactt

SEQ ID NO: 142168 - DNA, 75 bp, Artificial Sequence
  Synthetic
tgctccgccctctacataggagacatttgtggtgcggttatgatagcggcccaagcagtcatcatttcaccgcag

SEQ ID NO: 142169 - DNA, 75 bp, Artificial Sequence
  Synthetic
actcccagtgtccgctcggctgggtaaggaggtgctactaggacccgccgaaaactacaagcacatggggtggcg

SEQ ID NO: 142170 - DNA, 75 bp, Artificial Sequence
  Synthetic
actcccagtgtccgctcggctgggtaaggaggtgctactaggacccgccgataactacaagcacatggggtggcg

SEQ ID NO: 142171 - DNA, 75 bp, Artificial Sequence
  Synthetic
actcccagtgtccgctcggctgggtaaggaggtgctactaggacccgccgacaactacaagcacatggggtggcg

SEQ ID NO: 142172 - DNA, 75 bp, Artificial Sequence
  Synthetic
actcccagtgtccgctcggctgggtaaggaggtgctactaggacccgccgagaactacaagcacatggggtggcg

SEQ ID NO: 142173 - DNA, 75 bp, Artificial Sequence
  Synthetic
gttgggtccgccgttgtatcatgggcactcaagtgggaatacgtagtgcttgccttcctgctactcgcagatgct

SEQ ID NO: 142174 - DNA, 75 bp, Artificial Sequence
  Synthetic
agctggacaggagcactcatcactccatgtgcagccgaagaggagaagctacccatcaatcctctgagcaactcc

SEQ ID NO: 142175 - DNA, 75 bp, Artificial Sequence
  Synthetic
gttttcggtgggtctcaactccttcgtcatagggtcccaactcccctgtgaaccggagccagacgtagccgtact

SEQ ID NO: 142176 - DNA, 75 bp, Artificial Sequence
  Synthetic
cacgtgcaagtcctctccacctccacccagacattcctgggtacgacggtggggggggtcatgtggacagtctac

SEQ ID NO: 142177 - DNA, 75 bp, Artificial Sequence
  Synthetic
ggaacgtacgtgtacgaccaccttgctcctctgtcagattgggcagcagacggcctcagagatctggctgtggcc

SEQ ID NO: 142178 - DNA, 75 bp, Artificial Sequence
  Synthetic
ggaacgtacgtgtacgaccaccttgctcctctgtcagattgggctgcagacggcctcagagatctggctgtggcc

SEQ ID NO: 142179 - DNA, 75 bp, Artificial Sequence
  Synthetic
ggaacgtacgtgtacgaccaccttgctcctctgtcagattgggccgcagacggcctcagagatctggctgtggcc

SEQ ID NO: 142180 - DNA, 75 bp, Artificial Sequence
  Synthetic
ggaacgtacgtgtacgaccaccttgctcctctgtcagattgggcggcagacggcctcagagatctggctgtggcc

SEQ ID NO: 142181 - DNA, 75 bp, Artificial Sequence
  Synthetic
ggtacgtacgtgtacgaccaccttgctcctctgtcagattgggcagcagacggcctcagagatctggctgtggcc

SEQ ID NO: 142182 - DNA, 75 bp, Artificial Sequence
  Synthetic
ggtacgtacgtgtacgaccaccttgctcctctgtcagattgggctgcagacggcctcagagatctggctgtggcc

SEQ ID NO: 142183 - DNA, 75 bp, Artificial Sequence
  Synthetic
ggtacgtacgtgtacgaccaccttgctcctctgtcagattgggccgcagacggcctcagagatctggctgtggcc

SEQ ID NO: 142184 - DNA, 75 bp, Artificial Sequence
  Synthetic
ggtacgtacgtgtacgaccaccttgctcctctgtcagattgggcggcagacggcctcagagatctggctgtggcc

SEQ ID NO: 142185 - DNA, 75 bp, Artificial Sequence
  Synthetic
ggcacgtacgtgtacgaccaccttgctcctctgtcagattgggcagcagacggcctcagagatctggctgtggcc

SEQ ID NO: 142186 - DNA, 75 bp, Artificial Sequence
  Synthetic
ggcacgtacgtgtacgaccaccttgctcctctgtcagattgggctgcagacggcctcagagatctggctgtggcc

SEQ ID NO: 142187 - DNA, 75 bp, Artificial Sequence
  Synthetic
ggcacgtacgtgtacgaccaccttgctcctctgtcagattgggccgcagacggcctcagagatctggctgtggcc

SEQ ID NO: 142188 - DNA, 75 bp, Artificial Sequence
  Synthetic
ggcacgtacgtgtacgaccaccttgctcctctgtcagattgggcggcagacggcctcagagatctggctgtggcc

SEQ ID NO: 142189 - DNA, 75 bp, Artificial Sequence
  Synthetic
gggacgtacgtgtacgaccaccttgctcctctgtcagattgggcagcagacggcctcagagatctggctgtggcc

SEQ ID NO: 142190 - DNA, 75 bp, Artificial Sequence
  Synthetic
gggacgtacgtgtacgaccaccttgctcctctgtcagattgggctgcagacggcctcagagatctggctgtggcc

SEQ ID NO: 142191 - DNA, 75 bp, Artificial Sequence
  Synthetic
gggacgtacgtgtacgaccaccttgctcctctgtcagattgggccgcagacggcctcagagatctggctgtggcc

SEQ ID NO: 142192 - DNA, 75 bp, Artificial Sequence
  Synthetic
gggacgtacgtgtacgaccaccttgctcctctgtcagattgggcggcagacggcctcagagatctggctgtggcc

SEQ ID NO: 142193 - DNA, 75 bp, Artificial Sequence
  Synthetic
ccaccatggttttggcgtacctcatgcgcgtccccgaggtcattctggagatcattaccgaagcgcactggggcg

SEQ ID NO: 142194 - DNA, 75 bp, Artificial Sequence
  Synthetic
aggcggtcgtgcggctcaagctacgtctagcttcgtcaacctgttcagttccgggcctcaacaacacctccagct

SEQ ID NO: 142195 - DNA, 75 bp, Artificial Sequence
  Synthetic
cagctatctgccccatccttgaaggctacatgccctgctgaccacaactctcctggtaccgacctcattgaggcc

SEQ ID NO: 142196 - DNA, 75 bp, Artificial Sequence
  Synthetic
gagccaggtcgtcagacccctgcacatgtggttcttctgacctatatttggtcacacgggacgcagacgtcattc

SEQ ID NO: 142197 - DNA, 75 bp, Artificial Sequence
  Synthetic
ctaggctaggcaacgagatattgcttggtccggccgatgccgagagcgcagcggggtggaggcttctcgccccca

SEQ ID NO: 142198 - DNA, 75 bp, Artificial Sequence
  Synthetic
gctaggcttctcacgaccgaggaagcctgtgatctgaccccctcgcattcagctcgttccaagtttggatacggg

SEQ ID NO: 142199 - DNA, 75 bp, Artificial Sequence
  Synthetic
atgtggttcttctgacctatatttggtcacacgggacgcagacgtcattccagccagacgtagaggagactccac

SEQ ID NO: 142200 - DNA, 75 bp, Artificial Sequence
  Synthetic
ttcaactcctcgggttgcccccaacgaatgtcctcatgccgctctattgaggagtttaggataggctggggcagc

SEQ ID NO: 142201 - DNA, 75 bp, Artificial Sequence
  Synthetic
agatatctgtcgccgcggaaatcctgtgtcctaccaggaaattcccgccggctctcccggtctgggcccggcccg

SEQ ID NO: 142202 - DNA, 75 bp, Artificial Sequence
  Synthetic
gcagtactttatagctagggccgaggccatgctacatgtatacgttccaccactggaggttaggggctctcgaga

SEQ ID NO: 142203 - DNA, 75 bp, Artificial Sequence
  Synthetic
gccgtagtcaccaggggggtggccaagtccttacaattcatacctgtagagaccttgagcactcaagctcggtct

SEQ ID NO: 142204 - DNA, 75 bp, Artificial Sequence
  Synthetic
gtccacggccactcagtccttcttaggcactggggtaaacggggtcctatggacagtgtatcatggggccggcag

SEQ ID NO: 142205 - DNA, 75 bp, Artificial Sequence
  Synthetic
gtccacggccactcagtccttcttaggcactggggttaacggggtcctatggacagtgtatcatggggccggcag

SEQ ID NO: 142206 - DNA, 75 bp, Artificial Sequence
  Synthetic
gtccacggccactcagtccttcttaggcactggggtcaacggggtcctatggacagtgtatcatggggccggcag

SEQ ID NO: 142207 - DNA, 75 bp, Artificial Sequence
  Synthetic
gtccacggccactcagtccttcttaggcactggggtgaacggggtcctatggacagtgtatcatggggccggcag

SEQ ID NO: 142208 - DNA, 75 bp, Artificial Sequence
  Synthetic
acccaaacaccaatccctacaaccatcatggcaaagaacgaagtcttctgcgtggatacgtcgaagggagggcgt

SEQ ID NO: 142209 - DNA, 75 bp, Artificial Sequence
  Synthetic
gcctaccaagtgcgcaactccacggggctttaccatgtcaccaatgattgccctaactcgagtattgtgtacgag

SEQ ID NO: 142210 - DNA, 75 bp, Artificial Sequence
  Synthetic
ctgaagtatgaggagaatgtcaccaatgacgagaacatgaggccctattgctggcattatccgccccggccgtgt

SEQ ID NO: 142211 - DNA, 75 bp, Artificial Sequence
  Synthetic
gggacgcttacggcttccaatactcacccaagcagcgagtggaacgcttgctcaggatgtggcgctctaagaaga

SEQ ID NO: 142212 - DNA, 75 bp, Artificial Sequence
  Synthetic
cgtgtgggttccccccctcaacgtccggggggggcgcgacgccgtcatcttactcatgtgtgttgtacacccgac

SEQ ID NO: 142213 - DNA, 75 bp, Artificial Sequence
  Synthetic
cccacccaggaggaaacggacggtcgtgctcactgagtccagcatctccacggccctgtcagatttggccgcaaa

SEQ ID NO: 142214 - DNA, 75 bp, Artificial Sequence
  Synthetic
acaccatgcacgtgtggcgcctcggacctgttcctcgtgaccaggcacgcggatgtgatacctgtgaggaggagg

SEQ ID NO: 142215 - DNA, 75 bp, Artificial Sequence
  Synthetic
acaccttgcacgtgtggcgcctcggacctgttcctcgtgaccaggcacgcggatgtgatacctgtgaggaggagg

SEQ ID NO: 142216 - DNA, 75 bp, Artificial Sequence
  Synthetic
acaccctgcacgtgtggcgcctcggacctgttcctcgtgaccaggcacgcggatgtgatacctgtgaggaggagg

SEQ ID NO: 142217 - DNA, 75 bp, Artificial Sequence
  Synthetic
acaccgtgcacgtgtggcgcctcggacctgttcctcgtgaccaggcacgcggatgtgatacctgtgaggaggagg

SEQ ID NO: 142218 - DNA, 75 bp, Artificial Sequence
  Synthetic
tcacttttgcgcgtcccttactatgtgagggcccacgccttaattaagatctgtggttttgcgcgcaacgtagca

SEQ ID NO: 142219 - DNA, 75 bp, Artificial Sequence
  Synthetic
ccgcagcgtacgttgcacaagggtacagcgtcctggtattgaatccatctgtggccgcgacgttggggttcggcg

SEQ ID NO: 142220 - DNA, 75 bp, Artificial Sequence
  Synthetic
acatatatctgtgatgccagctggacccagaagcccaacaggctatcaagtctcttaccgagaggctttatgttg

SEQ ID NO: 142221 - DNA, 75 bp, Artificial Sequence
  Synthetic
acatatatctgtgttgccagctggacccagaagcccaacaggctatcaagtctcttaccgagaggctttatgttg

SEQ ID NO: 142222 - DNA, 75 bp, Artificial Sequence
  Synthetic
acatatatctgtgctgccagctggacccagaagcccaacaggctatcaagtctcttaccgagaggctttatgttg

SEQ ID NO: 142223 - DNA, 75 bp, Artificial Sequence
  Synthetic
acatatatctgtggtgccagctggacccagaagcccaacaggctatcaagtctcttaccgagaggctttatgttg

SEQ ID NO: 142224 - DNA, 75 bp, Artificial Sequence
  Synthetic
gacgacgggtcatactcgtcgatgcctccacttgaaggggagccaggcgacccagacttgacaaacgattcctgg

SEQ ID NO: 142225 - DNA, 75 bp, Artificial Sequence
  Synthetic
taagacctgtggcgcgccgccttgccgtataagaccagacttcaactccactgcggacctgttgtgccccactga

SEQ ID NO: 142226 - DNA, 75 bp, Artificial Sequence
  Synthetic
tattccgtgccgcggtgtgcacccggggtgtggctaaagctgtggactttgtacccgtcgagtcccttgagacga

SEQ ID NO: 142227 - DNA, 75 bp, Artificial Sequence
  Synthetic
gtggccgcgacgttggggttcggcgcctacatgtctaaagcgtgcggcatcgacccaaacatacgcactggcacc

SEQ ID NO: 142228 - DNA, 75 bp, Artificial Sequence
  Synthetic
acgaatgccatgcgcaggatgctacctccatactggggatcgggactgtactagaccaggcggagacagcagggg

SEQ ID NO: 142229 - DNA, 75 bp, Artificial Sequence
  Synthetic
cgacgtcacatcgatctgcttgtcgggagcgccaccctctgctcggccctctacgtgggggacctgtgcgggtcc

SEQ ID NO: 142230 - DNA, 75 bp, Artificial Sequence
  Synthetic
tctgaaagcgaaagccgcttgccgcgctgcgggcttcaccaactttgacatgttggtctgcggagacgacttggt

SEQ ID NO: 142231 - DNA, 75 bp, Artificial Sequence
  Synthetic
cgatcagccacctgagcaattcactgttacgccatcacaacttggtgtatgccacgacttcccgctctgccactg

SEQ ID NO: 142232 - DNA, 75 bp, Artificial Sequence
  Synthetic
cgatcagcctcctgagcaattcactgttacgccatcacaacttggtgtatgccacgacttcccgctctgccactg

SEQ ID NO: 142233 - DNA, 75 bp, Artificial Sequence
  Synthetic
cgatcagccccctgagcaattcactgttacgccatcacaacttggtgtatgccacgacttcccgctctgccactg

SEQ ID NO: 142234 - DNA, 75 bp, Artificial Sequence
  Synthetic
cgatcagccgcctgagcaattcactgttacgccatcacaacttggtgtatgccacgacttcccgctctgccactg

SEQ ID NO: 142235 - DNA, 75 bp, Artificial Sequence
  Synthetic
gggctggaggctccttgcccccattacagcgtacgcacagcagacgcgaggcctattaggcaccatcgtgaccag

SEQ ID NO: 142236 - DNA, 75 bp, Artificial Sequence
  Synthetic
cactaaagtgccctcagcctacgcggcacagggttacaaagtgttggtgctcaacccctcggttgcggcaacatt

SEQ ID NO: 142237 - DNA, 75 bp, Artificial Sequence
  Synthetic
ggttgctccttttctatcttcctgctagctctcttgtcttgcatctcagtgccagtttctgccgtagaggtcaag

SEQ ID NO: 142238 - DNA, 75 bp, Artificial Sequence
  Synthetic
attctatggtaaggccattcccctctcagtcatcaagggcgggcgtcaccttattttttgccattctaagaagaa

SEQ ID NO: 142239 - DNA, 75 bp, Artificial Sequence
  Synthetic
ctaggcaaaagaaggtcacatttgaccgcatgcaggtggttgacaatcactaccatgaagtgctaaaggagatta

SEQ ID NO: 142240 - DNA, 75 bp, Artificial Sequence
  Synthetic
ctaggcaaaagaaggtcacatttgaccgcatgcaggtggttgacaatcactaccatgatgtgctaaaggagatta

SEQ ID NO: 142241 - DNA, 75 bp, Artificial Sequence
  Synthetic
ctaggcaaaagaaggtcacatttgaccgcatgcaggtggttgacaatcactaccatgacgtgctaaaggagatta

SEQ ID NO: 142242 - DNA, 75 bp, Artificial Sequence
  Synthetic
ctaggcaaaagaaggtcacatttgaccgcatgcaggtggttgacaatcactaccatgaggtgctaaaggagatta

SEQ ID NO: 142243 - DNA, 75 bp, Artificial Sequence
  Synthetic
ctaggcataagaaggtcacatttgaccgcatgcaggtggttgacaatcactaccatgaagtgctaaaggagatta

SEQ ID NO: 142244 - DNA, 75 bp, Artificial Sequence
  Synthetic
ctaggcataagaaggtcacatttgaccgcatgcaggtggttgacaatcactaccatgatgtgctaaaggagatta

SEQ ID NO: 142245 - DNA, 75 bp, Artificial Sequence
  Synthetic
ctaggcataagaaggtcacatttgaccgcatgcaggtggttgacaatcactaccatgacgtgctaaaggagatta

SEQ ID NO: 142246 - DNA, 75 bp, Artificial Sequence
  Synthetic
ctaggcataagaaggtcacatttgaccgcatgcaggtggttgacaatcactaccatgaggtgctaaaggagatta

SEQ ID NO: 142247 - DNA, 75 bp, Artificial Sequence
  Synthetic
ctaggcacaagaaggtcacatttgaccgcatgcaggtggttgacaatcactaccatgaagtgctaaaggagatta

SEQ ID NO: 142248 - DNA, 75 bp, Artificial Sequence
  Synthetic
ctaggcacaagaaggtcacatttgaccgcatgcaggtggttgacaatcactaccatgatgtgctaaaggagatta

SEQ ID NO: 142249 - DNA, 75 bp, Artificial Sequence
  Synthetic
ctaggcacaagaaggtcacatttgaccgcatgcaggtggttgacaatcactaccatgacgtgctaaaggagatta

SEQ ID NO: 142250 - DNA, 75 bp, Artificial Sequence
  Synthetic
ctaggcacaagaaggtcacatttgaccgcatgcaggtggttgacaatcactaccatgaggtgctaaaggagatta

SEQ ID NO: 142251 - DNA, 75 bp, Artificial Sequence
  Synthetic
ctaggcagaagaaggtcacatttgaccgcatgcaggtggttgacaatcactaccatgaagtgctaaaggagatta

SEQ ID NO: 142252 - DNA, 75 bp, Artificial Sequence
  Synthetic
ctaggcagaagaaggtcacatttgaccgcatgcaggtggttgacaatcactaccatgatgtgctaaaggagatta

SEQ ID NO: 142253 - DNA, 75 bp, Artificial Sequence
  Synthetic
ctaggcagaagaaggtcacatttgaccgcatgcaggtggttgacaatcactaccatgacgtgctaaaggagatta

SEQ ID NO: 142254 - DNA, 75 bp, Artificial Sequence
  Synthetic
ctaggcagaagaaggtcacatttgaccgcatgcaggtggttgacaatcactaccatgaggtgctaaaggagatta

SEQ ID NO: 142255 - DNA, 75 bp, Artificial Sequence
  Synthetic
agcccgtcgtatgacctagagctgataacatcatgctcttcaaacgtttccgtggcccatgatggagacggcaga

SEQ ID NO: 142256 - DNA, 75 bp, Artificial Sequence
  Synthetic
tatgggaaattcctggctgatggtggttgctcaggaggggcatatgacatcatcatctgtgatgaatgccactcc

SEQ ID NO: 142257 - DNA, 75 bp, Artificial Sequence
  Synthetic
gcgagagagaaggcaattcatctcggtgttggacgccggtcacgcctaatatagccgttaggcgggctggcgcgc

SEQ ID NO: 142258 - DNA, 75 bp, Artificial Sequence
  Synthetic
cttactatcgtggtctggatgtctccgtgattccaacgactggagacgttgtagtctgctcaactgacgcattga

SEQ ID NO: 142259 - DNA, 75 bp, Artificial Sequence
  Synthetic
aaggccattaaccacatcaactccgtgtgggaggacttgctggaagacaacaatacccccattccaacaacaatc

SEQ ID NO: 142260 - DNA, 75 bp, Artificial Sequence
  Synthetic
atagccgttaggcgggctggcgcgctcaccagcggtttgcgacaacatattgacgcaaccgtgatggctgccacg

SEQ ID NO: 142261 - DNA, 75 bp, Artificial Sequence
  Synthetic
acgtcatccccgtgcgccgaaggggagacactcgtggagcgctccttagccccaggccaatcgccacgctcaagg

SEQ ID NO: 142262 - DNA, 75 bp, Artificial Sequence
  Synthetic
caggccgaggcggcgttggagaagctagtcattctacatgcggccagcgccgcgagtcttaatggcatagtttgt

SEQ ID NO: 142263 - DNA, 75 bp, Artificial Sequence
  Synthetic
ccgcaccgtcccccaggacgcggtttcccgcagccagcgccggggccgtacggggcgaggtaggcacggcatcta

SEQ ID NO: 142264 - DNA, 75 bp, Artificial Sequence
  Synthetic
cagtgactacaccccaccccaacatcgaggaagtcgccttgtctacaacgggggaggtgcccttctatgggaagg

SEQ ID NO: 142265 - DNA, 75 bp, Artificial Sequence
  Synthetic
cccaggccaatcgccacgctcaagggatcctctggcggtccgttgctatgcgcaaaagggcatgccgtaggcata

SEQ ID NO: 142266 - DNA, 75 bp, Artificial Sequence
  Synthetic
gacctaggggtccgggtgtgcgagaagagagcgctgtatgacgccgtcaaacaacttcctgaggccgtgatggga

SEQ ID NO: 142267 - DNA, 75 bp, Artificial Sequence
  Synthetic
gcaactgctccatctatccaggccatgtcacgggtcagcgtatggcgtgggatatgatgatgaactggtcaccta

SEQ ID NO: 142268 - DNA, 75 bp, Artificial Sequence
  Synthetic
tggcacttccccaacaagcctatgctcttgacacaactgagcaggggcagataggcctggtccttttggtggtca

SEQ ID NO: 142269 - DNA, 75 bp, Artificial Sequence
  Synthetic
tcttgacacaactgagcaggggcagataggcctggtccttttggtggtcatatcaattttcacacttagcccggc

SEQ ID NO: 142270 - DNA, 75 bp, Artificial Sequence
  Synthetic
actcaacacccccggctgtgccccaaacataccaggttgcccatctgcacgcaccgacgggaagtggcaagagca

SEQ ID NO: 142271 - DNA, 75 bp, Artificial Sequence
  Synthetic
caatgcggtggcttactacaggggtctagatgtctcggtgataccgacgtcgggggacgtcgtggtctgcgccac

SEQ ID NO: 142272 - DNA, 75 bp, Artificial Sequence
  Synthetic
gcagagaccaccacacggcttcgagcatacttcaacacccctggcctcccagtgtgtcaagaccacctagagttc

SEQ ID NO: 142273 - DNA, 75 bp, Artificial Sequence
  Synthetic
ctccatgcagggggcgtgggcaaaggtcgttgtcatccttttgctgatggccggggtggacgcgaacacctacac

SEQ ID NO: 142274 - DNA, 75 bp, Artificial Sequence
  Synthetic
tttgagagcctggagacaccgagcccgagcggtcagagcccagctgatcacccggggggggaaagccgcaatatg

SEQ ID NO: 142275 - DNA, 75 bp, Artificial Sequence
  Synthetic
cctcacagagagactctacgtgggcggccccatgtacaacagcaagggtgacctatgcggtgtccgcaggtgtcg

SEQ ID NO: 142276 - DNA, 75 bp, Artificial Sequence
  Synthetic
ccacggtttgtgcgcgggctcacgccccgcctccatcatgggacgaaacgtggaagtgtctcataaggctgaaac

SEQ ID NO: 142277 - DNA, 75 bp, Artificial Sequence
  Synthetic
tccatagagaccactactgtgccccaggactccgtgtcccgaagccaacgaaggggccgcactggaagggggaga

SEQ ID NO: 142278 - DNA, 75 bp, Artificial Sequence
  Synthetic
cacatcaatcgtactgccctgaactgcaatgacagcctgcataccggcttcctcgcagctctgttctacgtggac

SEQ ID NO: 142279 - DNA, 75 bp, Artificial Sequence
  Synthetic
gccatacttcgtcagagcgcaagttttgttgagaatctgcgctgctgcaaaacatctctcaggtggtaagtacgt

SEQ ID NO: 142280 - DNA, 75 bp, Artificial Sequence
  Synthetic
ctggtctgcggtgatgacttggtcgtcatcgcggaaagcaatggcgtggaagaggacagccaagctctccgagcc

SEQ ID NO: 142281 - DNA, 75 bp, Artificial Sequence
  Synthetic
acggtgggggtaggcatctttttgctcccagctcggtaggctgagagcttaacactccaaacatctgtttttttt

SEQ ID NO: 142282 - DNA, 75 bp, Artificial Sequence
  Synthetic
gtcagcagatcttgaggtcaccaccagtacctgggtgcttgtgggtggcgtcctcgcagctttagctgcgtactg

SEQ ID NO: 142283 - DNA, 75 bp, Artificial Sequence
  Synthetic
aactgacgccggcggagaccacggccaggctgagagcatacttcaacacaccaggcctccccgtttgccaagacc

SEQ ID NO: 142284 - DNA, 75 bp, Artificial Sequence
  Synthetic
cggctggcgcacgcctcgtcgtactcgcaaccgccacgccaccagggtctgtaacaacaccccatgctaacatcg

SEQ ID NO: 142285 - DNA, 75 bp, Artificial Sequence
  Synthetic
cggctggcgcacgcctcgtcgtactcgcaaccgccacgccaccagggtctgtaactacaccccatgctaacatcg

SEQ ID NO: 142286 - DNA, 75 bp, Artificial Sequence
  Synthetic
cggctggcgcacgcctcgtcgtactcgcaaccgccacgccaccagggtctgtaaccacaccccatgctaacatcg

SEQ ID NO: 142287 - DNA, 75 bp, Artificial Sequence
  Synthetic
cggctggcgcacgcctcgtcgtactcgcaaccgccacgccaccagggtctgtaacgacaccccatgctaacatcg

SEQ ID NO: 142288 - DNA, 75 bp, Artificial Sequence
  Synthetic
ccaacactgaggacatgaggccttactgctggcattacccaccgcagcagtgcggtgtggttcctgctcacacgg

SEQ ID NO: 142289 - DNA, 75 bp, Artificial Sequence
  Synthetic
agtacctgggtgcttgtgggtggcgtcctcgcagctttagctgcgtactgcttgtccgtgggttctgtcgtcatc

SEQ ID NO: 142290 - DNA, 75 bp, Artificial Sequence
  Synthetic
ggtctactacctgacccgagaccctgaaacccccctggcacgtgctgcctgggagacagttcgccacactccagt

SEQ ID NO: 142291 - DNA, 75 bp, Artificial Sequence
  Synthetic
ggtctactacctgacccgagaccctgatacccccctggcacgtgctgcctgggagacagttcgccacactccagt

SEQ ID NO: 142292 - DNA, 75 bp, Artificial Sequence
  Synthetic
ggtctactacctgacccgagaccctgacacccccctggcacgtgctgcctgggagacagttcgccacactccagt

SEQ ID NO: 142293 - DNA, 75 bp, Artificial Sequence
  Synthetic
ggtctactacctgacccgagaccctgagacccccctggcacgtgctgcctgggagacagttcgccacactccagt

SEQ ID NO: 142294 - DNA, 75 bp, Artificial Sequence
  Synthetic
ggcctaccaggccacagtctgtgctagagccgcagctcccccaccctcgtgggacacaatgtggaagtgcctcat

SEQ ID NO: 142295 - DNA, 75 bp, Artificial Sequence
  Synthetic
ggcctaccaggccacagtctgtgctagagccgcagctcccccaccctcgtgggacactatgtggaagtgcctcat

SEQ ID NO: 142296 - DNA, 75 bp, Artificial Sequence
  Synthetic
ggcctaccaggccacagtctgtgctagagccgcagctcccccaccctcgtgggacaccatgtggaagtgcctcat

SEQ ID NO: 142297 - DNA, 75 bp, Artificial Sequence
  Synthetic
ggcctaccaggccacagtctgtgctagagccgcagctcccccaccctcgtgggacacgatgtggaagtgcctcat

SEQ ID NO: 142298 - DNA, 75 bp, Artificial Sequence
  Synthetic
ggcctaccaggccacagtctgtgctagagccgcagctccccctccctcgtgggacacaatgtggaagtgcctcat

SEQ ID NO: 142299 - DNA, 75 bp, Artificial Sequence
  Synthetic
ggcctaccaggccacagtctgtgctagagccgcagctccccctccctcgtgggacactatgtggaagtgcctcat

SEQ ID NO: 142300 - DNA, 75 bp, Artificial Sequence
  Synthetic
ggcctaccaggccacagtctgtgctagagccgcagctccccctccctcgtgggacaccatgtggaagtgcctcat

SEQ ID NO: 142301 - DNA, 75 bp, Artificial Sequence
  Synthetic
ggcctaccaggccacagtctgtgctagagccgcagctccccctccctcgtgggacacgatgtggaagtgcctcat

SEQ ID NO: 142302 - DNA, 75 bp, Artificial Sequence
  Synthetic
ggcctaccaggccacagtctgtgctagagccgcagctccccccccctcgtgggacacaatgtggaagtgcctcat

SEQ ID NO: 142303 - DNA, 75 bp, Artificial Sequence
  Synthetic
ggcctaccaggccacagtctgtgctagagccgcagctccccccccctcgtgggacactatgtggaagtgcctcat

SEQ ID NO: 142304 - DNA, 75 bp, Artificial Sequence
  Synthetic
ggcctaccaggccacagtctgtgctagagccgcagctccccccccctcgtgggacaccatgtggaagtgcctcat

SEQ ID NO: 142305 - DNA, 75 bp, Artificial Sequence
  Synthetic
ggcctaccaggccacagtctgtgctagagccgcagctccccccccctcgtgggacacgatgtggaagtgcctcat

SEQ ID NO: 142306 - DNA, 75 bp, Artificial Sequence
  Synthetic
ggcctaccaggccacagtctgtgctagagccgcagctcccccgccctcgtgggacacaatgtggaagtgcctcat

SEQ ID NO: 142307 - DNA, 75 bp, Artificial Sequence
  Synthetic
ggcctaccaggccacagtctgtgctagagccgcagctcccccgccctcgtgggacactatgtggaagtgcctcat

SEQ ID NO: 142308 - DNA, 75 bp, Artificial Sequence
  Synthetic
ggcctaccaggccacagtctgtgctagagccgcagctcccccgccctcgtgggacaccatgtggaagtgcctcat

SEQ ID NO: 142309 - DNA, 75 bp, Artificial Sequence
  Synthetic
ggcctaccaggccacagtctgtgctagagccgcagctcccccgccctcgtgggacacgatgtggaagtgcctcat

SEQ ID NO: 142310 - DNA, 75 bp, Artificial Sequence
  Synthetic
ggcctaccaggccacagtctgtgctagagccgctgctcccccaccctcgtgggacacaatgtggaagtgcctcat

SEQ ID NO: 142311 - DNA, 75 bp, Artificial Sequence
  Synthetic
ggcctaccaggccacagtctgtgctagagccgctgctcccccaccctcgtgggacactatgtggaagtgcctcat

SEQ ID NO: 142312 - DNA, 75 bp, Artificial Sequence
  Synthetic
ggcctaccaggccacagtctgtgctagagccgctgctcccccaccctcgtgggacaccatgtggaagtgcctcat

SEQ ID NO: 142313 - DNA, 75 bp, Artificial Sequence
  Synthetic
ggcctaccaggccacagtctgtgctagagccgctgctcccccaccctcgtgggacacgatgtggaagtgcctcat

SEQ ID NO: 142314 - DNA, 75 bp, Artificial Sequence
  Synthetic
ggcctaccaggccacagtctgtgctagagccgctgctccccctccctcgtgggacacaatgtggaagtgcctcat

SEQ ID NO: 142315 - DNA, 75 bp, Artificial Sequence
  Synthetic
ggcctaccaggccacagtctgtgctagagccgctgctccccctccctcgtgggacactatgtggaagtgcctcat

SEQ ID NO: 142316 - DNA, 75 bp, Artificial Sequence
  Synthetic
ggcctaccaggccacagtctgtgctagagccgctgctccccctccctcgtgggacaccatgtggaagtgcctcat

SEQ ID NO: 142317 - DNA, 75 bp, Artificial Sequence
  Synthetic
ggcctaccaggccacagtctgtgctagagccgctgctccccctccctcgtgggacacgatgtggaagtgcctcat

SEQ ID NO: 142318 - DNA, 75 bp, Artificial Sequence
  Synthetic
ggcctaccaggccacagtctgtgctagagccgctgctccccccccctcgtgggacacaatgtggaagtgcctcat

SEQ ID NO: 142319 - DNA, 75 bp, Artificial Sequence
  Synthetic
ggcctaccaggccacagtctgtgctagagccgctgctccccccccctcgtgggacactatgtggaagtgcctcat

SEQ ID NO: 142320 - DNA, 75 bp, Artificial Sequence
  Synthetic
ggcctaccaggccacagtctgtgctagagccgctgctccccccccctcgtgggacaccatgtggaagtgcctcat

SEQ ID NO: 142321 - DNA, 75 bp, Artificial Sequence
  Synthetic
ggcctaccaggccacagtctgtgctagagccgctgctccccccccctcgtgggacacgatgtggaagtgcctcat

SEQ ID NO: 142322 - DNA, 75 bp, Artificial Sequence
  Synthetic
ggcctaccaggccacagtctgtgctagagccgctgctcccccgccctcgtgggacacaatgtggaagtgcctcat

SEQ ID NO: 142323 - DNA, 75 bp, Artificial Sequence
  Synthetic
ggcctaccaggccacagtctgtgctagagccgctgctcccccgccctcgtgggacactatgtggaagtgcctcat

SEQ ID NO: 142324 - DNA, 75 bp, Artificial Sequence
  Synthetic
ggcctaccaggccacagtctgtgctagagccgctgctcccccgccctcgtgggacaccatgtggaagtgcctcat

SEQ ID NO: 142325 - DNA, 75 bp, Artificial Sequence
  Synthetic
ggcctaccaggccacagtctgtgctagagccgctgctcccccgccctcgtgggacacgatgtggaagtgcctcat

SEQ ID NO: 142326 - DNA, 75 bp, Artificial Sequence
  Synthetic
ggcctaccaggccacagtctgtgctagagccgccgctcccccaccctcgtgggacacaatgtggaagtgcctcat

SEQ ID NO: 142327 - DNA, 75 bp, Artificial Sequence
  Synthetic
ggcctaccaggccacagtctgtgctagagccgccgctcccccaccctcgtgggacactatgtggaagtgcctcat

SEQ ID NO: 142328 - DNA, 75 bp, Artificial Sequence
  Synthetic
ggcctaccaggccacagtctgtgctagagccgccgctcccccaccctcgtgggacaccatgtggaagtgcctcat

SEQ ID NO: 142329 - DNA, 75 bp, Artificial Sequence
  Synthetic
ggcctaccaggccacagtctgtgctagagccgccgctcccccaccctcgtgggacacgatgtggaagtgcctcat

SEQ ID NO: 142330 - DNA, 75 bp, Artificial Sequence
  Synthetic
ggcctaccaggccacagtctgtgctagagccgccgctccccctccctcgtgggacacaatgtggaagtgcctcat

SEQ ID NO: 142331 - DNA, 75 bp, Artificial Sequence
  Synthetic
ggcctaccaggccacagtctgtgctagagccgccgctccccctccctcgtgggacactatgtggaagtgcctcat

SEQ ID NO: 142332 - DNA, 75 bp, Artificial Sequence
  Synthetic
ggcctaccaggccacagtctgtgctagagccgccgctccccctccctcgtgggacaccatgtggaagtgcctcat

SEQ ID NO: 142333 - DNA, 75 bp, Artificial Sequence
  Synthetic
ggcctaccaggccacagtctgtgctagagccgccgctccccctccctcgtgggacacgatgtggaagtgcctcat

SEQ ID NO: 142334 - DNA, 75 bp, Artificial Sequence
  Synthetic
ggcctaccaggccacagtctgtgctagagccgccgctccccccccctcgtgggacacaatgtggaagtgcctcat

SEQ ID NO: 142335 - DNA, 75 bp, Artificial Sequence
  Synthetic
ggcctaccaggccacagtctgtgctagagccgccgctccccccccctcgtgggacactatgtggaagtgcctcat

SEQ ID NO: 142336 - DNA, 75 bp, Artificial Sequence
  Synthetic
ggcctaccaggccacagtctgtgctagagccgccgctccccccccctcgtgggacaccatgtggaagtgcctcat

SEQ ID NO: 142337 - DNA, 75 bp, Artificial Sequence
  Synthetic
ggcctaccaggccacagtctgtgctagagccgccgctccccccccctcgtgggacacgatgtggaagtgcctcat

SEQ ID NO: 142338 - DNA, 75 bp, Artificial Sequence
  Synthetic
ggcctaccaggccacagtctgtgctagagccgccgctcccccgccctcgtgggacacaatgtggaagtgcctcat

SEQ ID NO: 142339 - DNA, 75 bp, Artificial Sequence
  Synthetic
ggcctaccaggccacagtctgtgctagagccgccgctcccccgccctcgtgggacactatgtggaagtgcctcat

SEQ ID NO: 142340 - DNA, 75 bp, Artificial Sequence
  Synthetic
ggcctaccaggccacagtctgtgctagagccgccgctcccccgccctcgtgggacaccatgtggaagtgcctcat

SEQ ID NO: 142341 - DNA, 75 bp, Artificial Sequence
  Synthetic
ggcctaccaggccacagtctgtgctagagccgccgctcccccgccctcgtgggacacgatgtggaagtgcctcat

SEQ ID NO: 142342 - DNA, 75 bp, Artificial Sequence
  Synthetic
ggcctaccaggccacagtctgtgctagagccgcggctcccccaccctcgtgggacacaatgtggaagtgcctcat

SEQ ID NO: 142343 - DNA, 75 bp, Artificial Sequence
  Synthetic
ggcctaccaggccacagtctgtgctagagccgcggctcccccaccctcgtgggacactatgtggaagtgcctcat

SEQ ID NO: 142344 - DNA, 75 bp, Artificial Sequence
  Synthetic
ggcctaccaggccacagtctgtgctagagccgcggctcccccaccctcgtgggacaccatgtggaagtgcctcat

SEQ ID NO: 142345 - DNA, 75 bp, Artificial Sequence
  Synthetic
ggcctaccaggccacagtctgtgctagagccgcggctcccccaccctcgtgggacacgatgtggaagtgcctcat

SEQ ID NO: 142346 - DNA, 75 bp, Artificial Sequence
  Synthetic
ggcctaccaggccacagtctgtgctagagccgcggctccccctccctcgtgggacacaatgtggaagtgcctcat

SEQ ID NO: 142347 - DNA, 75 bp, Artificial Sequence
  Synthetic
ggcctaccaggccacagtctgtgctagagccgcggctccccctccctcgtgggacactatgtggaagtgcctcat

SEQ ID NO: 142348 - DNA, 75 bp, Artificial Sequence
  Synthetic
ggcctaccaggccacagtctgtgctagagccgcggctccccctccctcgtgggacaccatgtggaagtgcctcat

SEQ ID NO: 142349 - DNA, 75 bp, Artificial Sequence
  Synthetic
ggcctaccaggccacagtctgtgctagagccgcggctccccctccctcgtgggacacgatgtggaagtgcctcat

SEQ ID NO: 142350 - DNA, 75 bp, Artificial Sequence
  Synthetic
ggcctaccaggccacagtctgtgctagagccgcggctccccccccctcgtgggacacaatgtggaagtgcctcat

SEQ ID NO: 142351 - DNA, 75 bp, Artificial Sequence
  Synthetic
ggcctaccaggccacagtctgtgctagagccgcggctccccccccctcgtgggacactatgtggaagtgcctcat

SEQ ID NO: 142352 - DNA, 75 bp, Artificial Sequence
  Synthetic
ggcctaccaggccacagtctgtgctagagccgcggctccccccccctcgtgggacaccatgtggaagtgcctcat

SEQ ID NO: 142353 - DNA, 75 bp, Artificial Sequence
  Synthetic
ggcctaccaggccacagtctgtgctagagccgcggctccccccccctcgtgggacacgatgtggaagtgcctcat

SEQ ID NO: 142354 - DNA, 75 bp, Artificial Sequence
  Synthetic
ggcctaccaggccacagtctgtgctagagccgcggctcccccgccctcgtgggacacaatgtggaagtgcctcat

SEQ ID NO: 142355 - DNA, 75 bp, Artificial Sequence
  Synthetic
ggcctaccaggccacagtctgtgctagagccgcggctcccccgccctcgtgggacactatgtggaagtgcctcat

SEQ ID NO: 142356 - DNA, 75 bp, Artificial Sequence
  Synthetic
ggcctaccaggccacagtctgtgctagagccgcggctcccccgccctcgtgggacaccatgtggaagtgcctcat

SEQ ID NO: 142357 - DNA, 75 bp, Artificial Sequence
  Synthetic
ggcctaccaggccacagtctgtgctagagccgcggctcccccgccctcgtgggacacgatgtggaagtgcctcat

SEQ ID NO: 142358 - DNA, 75 bp, Artificial Sequence
  Synthetic
catacattgaacaagcgcaagtcatcgcgcagcaatttaaagaaaaggttgtgggtctcctccaacatgctggta

SEQ ID NO: 142359 - DNA, 75 bp, Artificial Sequence
  Synthetic
cgtgttcctgctaaacagcactcggccccctcaagggggctggttcgggtgcacgtggatgaatagcaccgggtt

SEQ ID NO: 142360 - DNA, 75 bp, Artificial Sequence
  Synthetic
atggcatgcatgtcagctgacttagaggtggtcaccagcacgtgggtcctggtggggggtgtattggcagcccta

SEQ ID NO: 142361 - DNA, 75 bp, Artificial Sequence
  Synthetic
atggcatgcatgtcagctgacttagaggtggtcaccagcacgtgggtcctggtggggggtgttttggcagcccta

SEQ ID NO: 142362 - DNA, 75 bp, Artificial Sequence
  Synthetic
atggcatgcatgtcagctgacttagaggtggtcaccagcacgtgggtcctggtggggggtgtcttggcagcccta

SEQ ID NO: 142363 - DNA, 75 bp, Artificial Sequence
  Synthetic
atggcatgcatgtcagctgacttagaggtggtcaccagcacgtgggtcctggtggggggtgtgttggcagcccta

SEQ ID NO: 142364 - DNA, 75 bp, Artificial Sequence
  Synthetic
atggcatgcatgtcagctgactttgaggtggtcaccagcacgtgggtcctggtggggggtgtattggcagcccta

SEQ ID NO: 142365 - DNA, 75 bp, Artificial Sequence
  Synthetic
atggcatgcatgtcagctgactttgaggtggtcaccagcacgtgggtcctggtggggggtgttttggcagcccta

SEQ ID NO: 142366 - DNA, 75 bp, Artificial Sequence
  Synthetic
atggcatgcatgtcagctgactttgaggtggtcaccagcacgtgggtcctggtggggggtgtcttggcagcccta

SEQ ID NO: 142367 - DNA, 75 bp, Artificial Sequence
  Synthetic
atggcatgcatgtcagctgactttgaggtggtcaccagcacgtgggtcctggtggggggtgtgttggcagcccta

SEQ ID NO: 142368 - DNA, 75 bp, Artificial Sequence
  Synthetic
atggcatgcatgtcagctgacttcgaggtggtcaccagcacgtgggtcctggtggggggtgtattggcagcccta

SEQ ID NO: 142369 - DNA, 75 bp, Artificial Sequence
  Synthetic
atggcatgcatgtcagctgacttcgaggtggtcaccagcacgtgggtcctggtggggggtgttttggcagcccta

SEQ ID NO: 142370 - DNA, 75 bp, Artificial Sequence
  Synthetic
atggcatgcatgtcagctgacttcgaggtggtcaccagcacgtgggtcctggtggggggtgtcttggcagcccta

SEQ ID NO: 142371 - DNA, 75 bp, Artificial Sequence
  Synthetic
atggcatgcatgtcagctgacttcgaggtggtcaccagcacgtgggtcctggtggggggtgtgttggcagcccta

SEQ ID NO: 142372 - DNA, 75 bp, Artificial Sequence
  Synthetic
atggcatgcatgtcagctgacttggaggtggtcaccagcacgtgggtcctggtggggggtgtattggcagcccta

SEQ ID NO: 142373 - DNA, 75 bp, Artificial Sequence
  Synthetic
atggcatgcatgtcagctgacttggaggtggtcaccagcacgtgggtcctggtggggggtgttttggcagcccta

SEQ ID NO: 142374 - DNA, 75 bp, Artificial Sequence
  Synthetic
atggcatgcatgtcagctgacttggaggtggtcaccagcacgtgggtcctggtggggggtgtcttggcagcccta

SEQ ID NO: 142375 - DNA, 75 bp, Artificial Sequence
  Synthetic
atggcatgcatgtcagctgacttggaggtggtcaccagcacgtgggtcctggtggggggtgtgttggcagcccta

SEQ ID NO: 142376 - DNA, 75 bp, Artificial Sequence
  Synthetic
atggcatgcatgtctgctgacttagaggtggtcaccagcacgtgggtcctggtggggggtgtattggcagcccta

SEQ ID NO: 142377 - DNA, 75 bp, Artificial Sequence
  Synthetic
atggcatgcatgtctgctgacttagaggtggtcaccagcacgtgggtcctggtggggggtgttttggcagcccta

SEQ ID NO: 142378 - DNA, 75 bp, Artificial Sequence
  Synthetic
atggcatgcatgtctgctgacttagaggtggtcaccagcacgtgggtcctggtggggggtgtcttggcagcccta

SEQ ID NO: 142379 - DNA, 75 bp, Artificial Sequence
  Synthetic
atggcatgcatgtctgctgacttagaggtggtcaccagcacgtgggtcctggtggggggtgtgttggcagcccta

SEQ ID NO: 142380 - DNA, 75 bp, Artificial Sequence
  Synthetic
atggcatgcatgtctgctgactttgaggtggtcaccagcacgtgggtcctggtggggggtgtattggcagcccta

SEQ ID NO: 142381 - DNA, 75 bp, Artificial Sequence
  Synthetic
atggcatgcatgtctgctgactttgaggtggtcaccagcacgtgggtcctggtggggggtgttttggcagcccta

SEQ ID NO: 142382 - DNA, 75 bp, Artificial Sequence
  Synthetic
atggcatgcatgtctgctgactttgaggtggtcaccagcacgtgggtcctggtggggggtgtcttggcagcccta

SEQ ID NO: 142383 - DNA, 75 bp, Artificial Sequence
  Synthetic
atggcatgcatgtctgctgactttgaggtggtcaccagcacgtgggtcctggtggggggtgtgttggcagcccta

SEQ ID NO: 142384 - DNA, 75 bp, Artificial Sequence
  Synthetic
atggcatgcatgtctgctgacttcgaggtggtcaccagcacgtgggtcctggtggggggtgtattggcagcccta

SEQ ID NO: 142385 - DNA, 75 bp, Artificial Sequence
  Synthetic
atggcatgcatgtctgctgacttcgaggtggtcaccagcacgtgggtcctggtggggggtgttttggcagcccta

SEQ ID NO: 142386 - DNA, 75 bp, Artificial Sequence
  Synthetic
atggcatgcatgtctgctgacttcgaggtggtcaccagcacgtgggtcctggtggggggtgtcttggcagcccta

SEQ ID NO: 142387 - DNA, 75 bp, Artificial Sequence
  Synthetic
atggcatgcatgtctgctgacttcgaggtggtcaccagcacgtgggtcctggtggggggtgtgttggcagcccta

SEQ ID NO: 142388 - DNA, 75 bp, Artificial Sequence
  Synthetic
atggcatgcatgtctgctgacttggaggtggtcaccagcacgtgggtcctggtggggggtgtattggcagcccta

SEQ ID NO: 142389 - DNA, 75 bp, Artificial Sequence
  Synthetic
atggcatgcatgtctgctgacttggaggtggtcaccagcacgtgggtcctggtggggggtgttttggcagcccta

SEQ ID NO: 142390 - DNA, 75 bp, Artificial Sequence
  Synthetic
atggcatgcatgtctgctgacttggaggtggtcaccagcacgtgggtcctggtggggggtgtcttggcagcccta

SEQ ID NO: 142391 - DNA, 75 bp, Artificial Sequence
  Synthetic
atggcatgcatgtctgctgacttggaggtggtcaccagcacgtgggtcctggtggggggtgtgttggcagcccta

SEQ ID NO: 142392 - DNA, 75 bp, Artificial Sequence
  Synthetic
atggcatgcatgtccgctgacttagaggtggtcaccagcacgtgggtcctggtggggggtgtattggcagcccta

SEQ ID NO: 142393 - DNA, 75 bp, Artificial Sequence
  Synthetic
atggcatgcatgtccgctgacttagaggtggtcaccagcacgtgggtcctggtggggggtgttttggcagcccta

SEQ ID NO: 142394 - DNA, 75 bp, Artificial Sequence
  Synthetic
atggcatgcatgtccgctgacttagaggtggtcaccagcacgtgggtcctggtggggggtgtcttggcagcccta

SEQ ID NO: 142395 - DNA, 75 bp, Artificial Sequence
  Synthetic
atggcatgcatgtccgctgacttagaggtggtcaccagcacgtgggtcctggtggggggtgtgttggcagcccta

SEQ ID NO: 142396 - DNA, 75 bp, Artificial Sequence
  Synthetic
atggcatgcatgtccgctgactttgaggtggtcaccagcacgtgggtcctggtggggggtgtattggcagcccta

SEQ ID NO: 142397 - DNA, 75 bp, Artificial Sequence
  Synthetic
atggcatgcatgtccgctgactttgaggtggtcaccagcacgtgggtcctggtggggggtgttttggcagcccta

SEQ ID NO: 142398 - DNA, 75 bp, Artificial Sequence
  Synthetic
atggcatgcatgtccgctgactttgaggtggtcaccagcacgtgggtcctggtggggggtgtcttggcagcccta

SEQ ID NO: 142399 - DNA, 75 bp, Artificial Sequence
  Synthetic
atggcatgcatgtccgctgactttgaggtggtcaccagcacgtgggtcctggtggggggtgtgttggcagcccta

SEQ ID NO: 142400 - DNA, 75 bp, Artificial Sequence
  Synthetic
atggcatgcatgtccgctgacttcgaggtggtcaccagcacgtgggtcctggtggggggtgtattggcagcccta

SEQ ID NO: 142401 - DNA, 75 bp, Artificial Sequence
  Synthetic
atggcatgcatgtccgctgacttcgaggtggtcaccagcacgtgggtcctggtggggggtgttttggcagcccta

SEQ ID NO: 142402 - DNA, 75 bp, Artificial Sequence
  Synthetic
atggcatgcatgtccgctgacttcgaggtggtcaccagcacgtgggtcctggtggggggtgtcttggcagcccta

SEQ ID NO: 142403 - DNA, 75 bp, Artificial Sequence
  Synthetic
atggcatgcatgtccgctgacttcgaggtggtcaccagcacgtgggtcctggtggggggtgtgttggcagcccta

SEQ ID NO: 142404 - DNA, 75 bp, Artificial Sequence
  Synthetic
atggcatgcatgtccgctgacttggaggtggtcaccagcacgtgggtcctggtggggggtgtattggcagcccta

SEQ ID NO: 142405 - DNA, 75 bp, Artificial Sequence
  Synthetic
atggcatgcatgtccgctgacttggaggtggtcaccagcacgtgggtcctggtggggggtgttttggcagcccta

SEQ ID NO: 142406 - DNA, 75 bp, Artificial Sequence
  Synthetic
atggcatgcatgtccgctgacttggaggtggtcaccagcacgtgggtcctggtggggggtgtcttggcagcccta

SEQ ID NO: 142407 - DNA, 75 bp, Artificial Sequence
  Synthetic
atggcatgcatgtccgctgacttggaggtggtcaccagcacgtgggtcctggtggggggtgtgttggcagcccta

SEQ ID NO: 142408 - DNA, 75 bp, Artificial Sequence
  Synthetic
atggcatgcatgtcggctgacttagaggtggtcaccagcacgtgggtcctggtggggggtgtattggcagcccta

SEQ ID NO: 142409 - DNA, 75 bp, Artificial Sequence
  Synthetic
atggcatgcatgtcggctgacttagaggtggtcaccagcacgtgggtcctggtggggggtgttttggcagcccta

SEQ ID NO: 142410 - DNA, 75 bp, Artificial Sequence
  Synthetic
atggcatgcatgtcggctgacttagaggtggtcaccagcacgtgggtcctggtggggggtgtcttggcagcccta

SEQ ID NO: 142411 - DNA, 75 bp, Artificial Sequence
  Synthetic
atggcatgcatgtcggctgacttagaggtggtcaccagcacgtgggtcctggtggggggtgtgttggcagcccta

SEQ ID NO: 142412 - DNA, 75 bp, Artificial Sequence
  Synthetic
atggcatgcatgtcggctgactttgaggtggtcaccagcacgtgggtcctggtggggggtgtattggcagcccta

SEQ ID NO: 142413 - DNA, 75 bp, Artificial Sequence
  Synthetic
atggcatgcatgtcggctgactttgaggtggtcaccagcacgtgggtcctggtggggggtgttttggcagcccta

SEQ ID NO: 142414 - DNA, 75 bp, Artificial Sequence
  Synthetic
atggcatgcatgtcggctgactttgaggtggtcaccagcacgtgggtcctggtggggggtgtcttggcagcccta

SEQ ID NO: 142415 - DNA, 75 bp, Artificial Sequence
  Synthetic
atggcatgcatgtcggctgactttgaggtggtcaccagcacgtgggtcctggtggggggtgtgttggcagcccta

SEQ ID NO: 142416 - DNA, 75 bp, Artificial Sequence
  Synthetic
atggcatgcatgtcggctgacttcgaggtggtcaccagcacgtgggtcctggtggggggtgtattggcagcccta

SEQ ID NO: 142417 - DNA, 75 bp, Artificial Sequence
  Synthetic
atggcatgcatgtcggctgacttcgaggtggtcaccagcacgtgggtcctggtggggggtgttttggcagcccta

SEQ ID NO: 142418 - DNA, 75 bp, Artificial Sequence
  Synthetic
atggcatgcatgtcggctgacttcgaggtggtcaccagcacgtgggtcctggtggggggtgtcttggcagcccta

SEQ ID NO: 142419 - DNA, 75 bp, Artificial Sequence
  Synthetic
atggcatgcatgtcggctgacttcgaggtggtcaccagcacgtgggtcctggtggggggtgtgttggcagcccta

SEQ ID NO: 142420 - DNA, 75 bp, Artificial Sequence
  Synthetic
atggcatgcatgtcggctgacttggaggtggtcaccagcacgtgggtcctggtggggggtgtattggcagcccta

SEQ ID NO: 142421 - DNA, 75 bp, Artificial Sequence
  Synthetic
atggcatgcatgtcggctgacttggaggtggtcaccagcacgtgggtcctggtggggggtgttttggcagcccta

SEQ ID NO: 142422 - DNA, 75 bp, Artificial Sequence
  Synthetic
atggcatgcatgtcggctgacttggaggtggtcaccagcacgtgggtcctggtggggggtgtcttggcagcccta

SEQ ID NO: 142423 - DNA, 75 bp, Artificial Sequence
  Synthetic
atggcatgcatgtcggctgacttggaggtggtcaccagcacgtgggtcctggtggggggtgtgttggcagcccta

SEQ ID NO: 142424 - DNA, 75 bp, Artificial Sequence
  Synthetic
tacacttccagggggtggaagcttcttgcgcccatcaccgcttatgcccagcagacgcgcggcttgctgggtacc

SEQ ID NO: 142425 - DNA, 75 bp, Artificial Sequence
  Synthetic
cgactttgactccgtaatagactgtaacacgtctgtcatacagactgtggacttcagcttggaccctacattttc

SEQ ID NO: 142426 - DNA, 75 bp, Artificial Sequence
  Synthetic
tctggccggtctttccaccttgcccggcaatcctgcgattgcttccttgatggccttcactgcctcagtcaccag

SEQ ID NO: 142427 - DNA, 75 bp, Artificial Sequence
  Synthetic
gccacctacctcaagtgtggagctgggccctggctgacacccaggtgcctggtcgactacccctacagattgtgg

SEQ ID NO: 142428 - DNA, 75 bp, Artificial Sequence
  Synthetic
aatttgatgagatggaggagtgctccaagcacatcccgctgctcgagcatggcatgcagctcgctgagcagttca

SEQ ID NO: 142429 - DNA, 75 bp, Artificial Sequence
  Synthetic
gggtcctgtggacggtcttccacggtgctgggaacaaaacgctggccggcccgcgagggcccgttacgcagatgt

SEQ ID NO: 142430 - DNA, 75 bp, Artificial Sequence
  Synthetic
tcactctgcacggatactctccacacgaactcaatcgggtggcaggaagcctcagaaaacttggggtacccccgt

SEQ ID NO: 142431 - DNA, 75 bp, Artificial Sequence
  Synthetic
caccttccaggttgcgtgccctgcgtgagaacggggaatcagtcacgttgctgggtggcccttactcctaccgtc

SEQ ID NO: 142432 - DNA, 75 bp, Artificial Sequence
  Synthetic
tgagaacggggaatcagtcacgttgctgggtggcccttactcctaccgtcgcagcgccatacatcggcgcgccgc

SEQ ID NO: 142433 - DNA, 75 bp, Artificial Sequence
  Synthetic
tggccttcactgcctcagtcaccagccccctttctactaaccagaccctgctctttaacattttgggtggatggg

SEQ ID NO: 142434 - DNA, 75 bp, Artificial Sequence
  Synthetic
ggatatactagcaggttacggcgcaggcgtagccggggctttggtcgcttttaagatcatgagcggggaggcccc

SEQ ID NO: 142435 - DNA, 75 bp, Artificial Sequence
  Synthetic
taagcacatgtggaacttcatcagcggcattcaataccttgccggcttgtccaccctacctggaaacccagccat

SEQ ID NO: 142436 - DNA, 75 bp, Artificial Sequence
  Synthetic
atcgctgcaacttggaggatagggacagagcccagctaagtcccttgctgcactctactaccgagtgggccatcc

SEQ ID NO: 142437 - DNA, 75 bp, Artificial Sequence
  Synthetic
ccgaaatgccgacgtcatcccggctcggagacaaggggaccggcggggagccctgctctctccaaggcctctttc

SEQ ID NO: 142438 - DNA, 75 bp, Artificial Sequence
  Synthetic
tagcttgaaggggtcctcggggggaccggtgctctgccctagaggccatgctgtggggattttccgggcggctat

SEQ ID NO: 142439 - DNA, 75 bp, Artificial Sequence
  Synthetic
cgtaggggtaggcatcttactgctgcctgcccgataggcagctaacactccgaccttagggtcttactgcttttt

SEQ ID NO: 142440 - DNA, 75 bp, Artificial Sequence
  Synthetic
cgtaggggtaggcatctttctgctgcctgcccgataggcagctaacactccgaccttagggtcttactgcttttt

SEQ ID NO: 142441 - DNA, 75 bp, Artificial Sequence
  Synthetic
cgtaggggtaggcatcttcctgctgcctgcccgataggcagctaacactccgaccttagggtcttactgcttttt

SEQ ID NO: 142442 - DNA, 75 bp, Artificial Sequence
  Synthetic
cgtaggggtaggcatcttgctgctgcctgcccgataggcagctaacactccgaccttagggtcttactgcttttt

SEQ ID NO: 142443 - DNA, 75 bp, Artificial Sequence
  Synthetic
cccggggagggggcagtacagtggatgaacaggctaatagccttcgcctcacgtgggaaccatgtgtcacctact

SEQ ID NO: 142444 - DNA, 75 bp, Artificial Sequence
  Synthetic
gcgacccccacggcctccacggcgttcgtcgtgagtggtctcgctggggcggcagtcggcagcgtgggtctgggg

SEQ ID NO: 142445 - DNA, 75 bp, Artificial Sequence
  Synthetic
tattactaagtacgttgtccgctgggagtgggtggtcctcctcttcctgcttctggctgacgcccgagtctgcgc

SEQ ID NO: 142446 - DNA, 75 bp, Artificial Sequence
  Synthetic
cactggacacagaatggcctgggacatgatgatgaactggagtccaacaactaccctagtccttagccaggtcat

SEQ ID NO: 142447 - DNA, 75 bp, Artificial Sequence
  Synthetic
tgaacaggctaatagccttcgcctcacgtgggaaccatgtgtcacctactcattacgttcccgaaagcgatgctg

SEQ ID NO: 142448 - DNA, 75 bp, Artificial Sequence
  Synthetic
gttatggcgctggcgttgccggcgctgtggtcaccttcaagatcatgagcggcgagatgccaacaacagaggacc

SEQ ID NO: 142449 - DNA, 75 bp, Artificial Sequence
  Synthetic
tgggaagagtactaaggtgcccgccgcttacgccgctcaagggtataaggtattagtgctaaacccctccgtggc

SEQ ID NO: 142450 - DNA, 75 bp, Artificial Sequence
  Synthetic
tggtttgtcatcttcttcattgccgcctggtacatcagaggacgcatagtccccctgctgacccactcccttctc

SEQ ID NO: 142451 - DNA, 75 bp, Artificial Sequence
  Synthetic
ggagtggttgtgcgacgtttggtcctggatttgcactgtgctttctgacttcaagacttggctatcagccaagct

SEQ ID NO: 142452 - DNA, 75 bp, Artificial Sequence
  Synthetic
tggatttgcactgtgctttctgacttcaagacttggctatcagccaagctcatgcctgcccttcctggcataccc

SEQ ID NO: 142453 - DNA, 75 bp, Artificial Sequence
  Synthetic
tcaagacttggctatcagccaagctcatgcctgcccttcctggcatacccttcttgtcatgtcagaagggattca

SEQ ID NO: 142454 - DNA, 75 bp, Artificial Sequence
  Synthetic
catgcaggccaattgggccaaagtcatcttggtcctattcctctttgcaggggtcgacgctagaacccatgtgtc

SEQ ID NO: 142455 - DNA, 75 bp, Artificial Sequence
  Synthetic
tatcagggcagcccgccgtcattcccgaccgggaggtgctctatcaacagtttgatgagatggaggaatgttcca

SEQ ID NO: 142456 - DNA, 75 bp, Artificial Sequence
  Synthetic
cgttaacaccaatgggagctggcatataaacaggactgccctcaactgcaatgatagtctaaacactgggttctt

SEQ ID NO: 142457 - DNA, 75 bp, Artificial Sequence
  Synthetic
cggcagctggcacataaaccggaccgccctcaattgcaatgacagcttgcaaacgggtttcctcgcttccctgtt

SEQ ID NO: 142458 - DNA, 75 bp, Artificial Sequence
  Synthetic
tttgatgagatggaggaatgttccaaccatatcccgctgattgagcacggcttgcaattggcagagcagttcaag

SEQ ID NO: 142459 - DNA, 75 bp, Artificial Sequence
  Synthetic
ttatatctgtcatcaccctcaccccagcatacaagaccatccttagcaaatgcctgtggtggctgtgctatatgc

SEQ ID NO: 142460 - DNA, 75 bp, Artificial Sequence
  Synthetic
ccgcaggtgcgccaacctctggcacggcactttccccatcaacgagtatacagtcggcccatgtgtgcccatccc

SEQ ID NO: 142461 - DNA, 75 bp, Artificial Sequence
  Synthetic
tgtgcagtggatgaaccgtctcattgccttcgcttcgcgcggcaatcacgtgtcgcccacgcactacgtcccgga

SEQ ID NO: 142462 - DNA, 75 bp, Artificial Sequence
  Synthetic
ccatgtgacacgagctggctacgggaaatctgggattgggtctgcaccgtcttgagtgactttaagacctggcta

SEQ ID NO: 142463 - DNA, 75 bp, Artificial Sequence
  Synthetic
cccctggatctgtaacgaccccccatcccaacatagaggagatagctcttgggcacgagggcgaaatcccctttt

SEQ ID NO: 142464 - DNA, 75 bp, Artificial Sequence
  Synthetic
tgtggtgtttgatgtgaccaagtggctcttggcggtcctcgggcctggctatctccttagagaggttttgacagg

SEQ ID NO: 142465 - DNA, 75 bp, Artificial Sequence
  Synthetic
gccagattagaacaattctgggcaaaacatatgtggaacttcatcagtggcattcaatatttggccgggttatcc

SEQ ID NO: 142466 - DNA, 75 bp, Artificial Sequence
  Synthetic
gatcaaaggggggaggcatttgatcttctgtcactctaagaagaagtgcgatgagctcgcgactgcccttcgggg

SEQ ID NO: 142467 - DNA, 75 bp, Artificial Sequence
  Synthetic
gatgggttggaatgtccatgccaggtgccaacggccgagttcttcacagaggtggacggtgttaggctacacagg

SEQ ID NO: 142468 - DNA, 75 bp, Artificial Sequence
  Synthetic
gcccatgcggcgcagatttggctggacacatcaaaaatggttcgatgaggatcgtcggaccaaagacttgcagca

SEQ ID NO: 142469 - DNA, 75 bp, Artificial Sequence
  Synthetic
ggcaggtggactggcacctacatctatgaccaccttgcccccatgtcagactgggctgccgccggcctgcgggac

SEQ ID NO: 142470 - DNA, 75 bp, Artificial Sequence
  Synthetic
ctgacgtgaccgtcctgacatccatgctcagagacccttctcatatcactgctgaggctgcggcgcgtcgccttg

SEQ ID NO: 142471 - DNA, 75 bp, Artificial Sequence
  Synthetic
tacggtgccggtgtggccggcgccgtggtcaccttcaagatcatgagcggcgaaacaccatcaacagaagaccta

SEQ ID NO: 142472 - DNA, 75 bp, Artificial Sequence
  Synthetic
tgatgaatacgtggaggttaggagggtgggtgatttccactacgtcaccggcatgacacaggataacatcaagtg

SEQ ID NO: 142473 - DNA, 75 bp, Artificial Sequence
  Synthetic
tccccgtctctgcccgtttagggcgagaggttttgctcggcccagccgacgagtacacctccaaggggtggaagc

SEQ ID NO: 142474 - DNA, 75 bp, Artificial Sequence
  Synthetic
agagctagtagacgccaacttgctgtggagacaagagatggggagtaacatcaccagggtagagtctgaaacgaa

SEQ ID NO: 142475 - DNA, 75 bp, Artificial Sequence
  Synthetic
aggtggcccacctgcatgctcccaccggcagcggcaagagcaccaaggtcccggctgcatacgcagctcagggct

SEQ ID NO: 142476 - DNA, 75 bp, Artificial Sequence
  Synthetic
agctactccgtgggacttaactctttcgtggtgggatcccaactcccctgcgagccggagcctgatgtgcaagtt

SEQ ID NO: 142477 - DNA, 75 bp, Artificial Sequence
  Synthetic
agcatagggatcgcgcagaactgtcgcctctgctcctttccactacaacgtggcaagtcctcccctgctctttca

SEQ ID NO: 142478 - DNA, 75 bp, Artificial Sequence
  Synthetic
catactctcatccctaactgtgacttccctccttaggaggctccacaaatggatcaatgaggactgctccacccc

SEQ ID NO: 142479 - DNA, 75 bp, Artificial Sequence
  Synthetic
gatccaagtgctctccacagtcacccagacatttctcgggacgtccgtttcgggggttctctggaccgtctacca

SEQ ID NO: 142480 - DNA, 75 bp, Artificial Sequence
  Synthetic
ccggcgctaccagtctgggccagacctgactacaacccccccctgcttgagccgtggaaggcaccggggtatgaa

SEQ ID NO: 142481 - DNA, 75 bp, Artificial Sequence
  Synthetic
accagaggggaagtctgcggcttggagcatagggatcgcgcagaactgtcgcctctgctcctttccactacaacg

SEQ ID NO: 142482 - DNA, 75 bp, Artificial Sequence
  Synthetic
gccagctatctgctccatccctcaaagctacctgcactgctcaccatgactccccggacgccgacctaatcgagg

SEQ ID NO: 142483 - DNA, 75 bp, Artificial Sequence
  Synthetic
tgactgactttaagacatggctcaaagctaagctgctacctcgcttgcctggcatccccttcctttcctgccaga

SEQ ID NO: 142484 - DNA, 75 bp, Artificial Sequence
  Synthetic
actaagtccctagaaccttgaacgtgcggggcggttgaactctacctcgtcacccggaacgctgacgtcgtcccg

SEQ ID NO: 142485 - DNA, 75 bp, Artificial Sequence
  Synthetic
actaagtccctagaaccttgaacgtgcggggcggttgatctctacctcgtcacccggaacgctgacgtcgtcccg

SEQ ID NO: 142486 - DNA, 75 bp, Artificial Sequence
  Synthetic
actaagtccctagaaccttgaacgtgcggggcggttgacctctacctcgtcacccggaacgctgacgtcgtcccg

SEQ ID NO: 142487 - DNA, 75 bp, Artificial Sequence
  Synthetic
actaagtccctagaaccttgaacgtgcggggcggttgagctctacctcgtcacccggaacgctgacgtcgtcccg

SEQ ID NO: 142488 - DNA, 75 bp, Artificial Sequence
  Synthetic
actaagtccctagaaccttgtacgtgcggggcggttgaactctacctcgtcacccggaacgctgacgtcgtcccg

SEQ ID NO: 142489 - DNA, 75 bp, Artificial Sequence
  Synthetic
actaagtccctagaaccttgtacgtgcggggcggttgatctctacctcgtcacccggaacgctgacgtcgtcccg

SEQ ID NO: 142490 - DNA, 75 bp, Artificial Sequence
  Synthetic
actaagtccctagaaccttgtacgtgcggggcggttgacctctacctcgtcacccggaacgctgacgtcgtcccg

SEQ ID NO: 142491 - DNA, 75 bp, Artificial Sequence
  Synthetic
actaagtccctagaaccttgtacgtgcggggcggttgagctctacctcgtcacccggaacgctgacgtcgtcccg

SEQ ID NO: 142492 - DNA, 75 bp, Artificial Sequence
  Synthetic
actaagtccctagaaccttgcacgtgcggggcggttgaactctacctcgtcacccggaacgctgacgtcgtcccg

SEQ ID NO: 142493 - DNA, 75 bp, Artificial Sequence
  Synthetic
actaagtccctagaaccttgcacgtgcggggcggttgatctctacctcgtcacccggaacgctgacgtcgtcccg

SEQ ID NO: 142494 - DNA, 75 bp, Artificial Sequence
  Synthetic
actaagtccctagaaccttgcacgtgcggggcggttgacctctacctcgtcacccggaacgctgacgtcgtcccg

SEQ ID NO: 142495 - DNA, 75 bp, Artificial Sequence
  Synthetic
actaagtccctagaaccttgcacgtgcggggcggttgagctctacctcgtcacccggaacgctgacgtcgtcccg

SEQ ID NO: 142496 - DNA, 75 bp, Artificial Sequence
  Synthetic
actaagtccctagaaccttggacgtgcggggcggttgaactctacctcgtcacccggaacgctgacgtcgtcccg

SEQ ID NO: 142497 - DNA, 75 bp, Artificial Sequence
  Synthetic
actaagtccctagaaccttggacgtgcggggcggttgatctctacctcgtcacccggaacgctgacgtcgtcccg

SEQ ID NO: 142498 - DNA, 75 bp, Artificial Sequence
  Synthetic
actaagtccctagaaccttggacgtgcggggcggttgacctctacctcgtcacccggaacgctgacgtcgtcccg

SEQ ID NO: 142499 - DNA, 75 bp, Artificial Sequence
  Synthetic
actaagtccctagaaccttggacgtgcggggcggttgagctctacctcgtcacccggaacgctgacgtcgtcccg

SEQ ID NO: 142500 - DNA, 75 bp, Artificial Sequence
  Synthetic
ctcaggagctagcccgcctcgccgacaaaaccttcggagaggccggcagttcgagcgaagcaccatctacttcgg

SEQ ID NO: 142501 - DNA, 75 bp, Artificial Sequence
  Synthetic
ggtcactctcacgcaccccataactaaatacatcgctacgtgcatgcaagctgaccttgaggtcatgacgagtac

SEQ ID NO: 142502 - DNA, 75 bp, Artificial Sequence
  Synthetic
gccggaggacggcgaggtttccgtggctgcggagatcttacgccgtaccaaaaagttccctccggccatgccaat

SEQ ID NO: 142503 - DNA, 75 bp, Artificial Sequence
  Synthetic
acgccgtcgggattttccgggcggctgtgtgctccaggggggtggcgaaggccatcgactttatccccgtcgagt

SEQ ID NO: 142504 - DNA, 75 bp, Artificial Sequence
  Synthetic
gcccggcgacccagacctgagctcgggctcttggtccacggtgagtggggatgaggatggcgtggtatgctgctc

SEQ ID NO: 142505 - DNA, 75 bp, Artificial Sequence
  Synthetic
aactgttccatctacactggtcatgttacgggacataggatggcctgggatatgatgatgaattggtccccgaca

SEQ ID NO: 142506 - DNA, 75 bp, Artificial Sequence
  Synthetic
ccaacccctgtcccccctccgaggaggaagcggacggttgtgcttacggagtcgaccgtctccagcgcactggcc

SEQ ID NO: 142507 - DNA, 75 bp, Artificial Sequence
  Synthetic
gtcacacaagacaacatcaagtgtccctgccaggttccctccccagaattcttcactgaggtggacggggtcaaa

SEQ ID NO: 142508 - DNA, 75 bp, Artificial Sequence
  Synthetic
tagcgggaagagtaccaaggtccctgcggcgtatgccgctcaggggtacaaggtgttggtgttgaacccctctgt

SEQ ID NO: 142509 - DNA, 75 bp, Artificial Sequence
  Synthetic
ttacggcaaggctatccccctcgaggtaatcaagggggggagacatctcatcttctgtcactcaaagaagaagtg

SEQ ID NO: 142510 - DNA, 75 bp, Artificial Sequence
  Synthetic
cagtattttatagctagggccgaggccttgctgcatgtctatgttccatctctcgatgtgcgcgggtctcgcgac

SEQ ID NO: 142511 - DNA, 75 bp, Artificial Sequence
  Synthetic
aatcttgtgtattccaccagctcgcgtagtgccgggctgcgccagaagaaggttaccttcgacaggctgcaggtc

SEQ ID NO: 142512 - DNA, 75 bp, Artificial Sequence
  Synthetic
cagatgacaaatctgacgatgggtcattttcatcaatgcccccccttgagggagaaccgggcgaccctgacttga

SEQ ID NO: 142513 - DNA, 75 bp, Artificial Sequence
  Synthetic
ttcattagcggtgtccagtatttggcgggactttccacgcttcctgggaatcctgccgtggctgcaatgatggcg

SEQ ID NO: 142514 - DNA, 75 bp, Artificial Sequence
  Synthetic
acatactccacgtatggcaaatttctcgcagacggaggctgctcagctggagcctatgatgtcataatatgcgat

SEQ ID NO: 142515 - DNA, 75 bp, Artificial Sequence
  Synthetic
gtggtgggttcccagctcccttgcgagccggagcctgacgtggcggtgttaacatccatgctgaccgacccgtcc

SEQ ID NO: 142516 - DNA, 75 bp, Artificial Sequence
  Synthetic
cttgtccacaccttttatttgacatcacaaagcatctcctggccattttagggcccctctacatacttcaggcct

SEQ ID NO: 142517 - DNA, 75 bp, Artificial Sequence
  Synthetic
cgccccactcggccaggtcgaagtatgggtacggggccaaagaggtgcgctccttggctagtaaggccgtcaacc

SEQ ID NO: 142518 - DNA, 75 bp, Artificial Sequence
  Synthetic
agagtcgaagctaccaatcagcccactgagcaattctttgctgcgccatcacaacatggtgtatgccacgactac

SEQ ID NO: 142519 - DNA, 75 bp, Artificial Sequence
  Synthetic
atggcaagtattgccaaatggtcgtgcttaaaatgggggccctgactggtacttacatctatgatcaccttactc

SEQ ID NO: 142520 - DNA, 75 bp, Artificial Sequence
  Synthetic
attcaactcgtcggggtgtcctgaacgcatgtcttcctgcaagccgatcacctcttttgaccagggttggggccc

SEQ ID NO: 142521 - DNA, 75 bp, Artificial Sequence
  Synthetic
gctagcagactcaaccacaccaataccgacaacggtcatggcaaaaaacgaggttttcgccgttaacccgagtaa

SEQ ID NO: 142522 - DNA, 75 bp, Artificial Sequence
  Synthetic
cacctcctgggtctgtgacgacccctcatcccaacatagaggagataagcctcggtcaggaaggcgaggtccctt

SEQ ID NO: 142523 - DNA, 75 bp, Artificial Sequence
  Synthetic
ccggtctgccacgactcgacagaagaaggtcacctttgaccgccttcaagtagtcgatgaccactaccaagctgt

SEQ ID NO: 142524 - DNA, 75 bp, Artificial Sequence
  Synthetic
ggtgcatggtccactacccttatagactttggcattatccttgtaccatcaattacaccatattcagggtcagga

SEQ ID NO: 142525 - DNA, 75 bp, Artificial Sequence
  Synthetic
tgcggagtgcctgcgcacatctaagcggttccctaaacctctgccggtatgggcccgcccggactacaacccacc

SEQ ID NO: 142526 - DNA, 75 bp, Artificial Sequence
  Synthetic
catagtaccagcaagagaggtttgcggacctgtgtattgctttacacctagccctgtggtcattggaactaccga

SEQ ID NO: 142527 - DNA, 75 bp, Artificial Sequence
  Synthetic
gggtctgggtttgaatgccgtcgcctactacagagggctcgacgtctccgtcataccgactcaaggagacgtggt

SEQ ID NO: 142528 - DNA, 75 bp, Artificial Sequence
  Synthetic
tttggctacggggcgaaagatgtccggagcctatcccgcaaggccgttaaccacatcaactccgtgtgggaggac

SEQ ID NO: 142529 - DNA, 75 bp, Artificial Sequence
  Synthetic
atcgtgttccctgacttgtccgtgcgcgtttgtgaaaaacgcgcactgtatgacgtgacacggaagctgcctact

SEQ ID NO: 142530 - DNA, 75 bp, Artificial Sequence
  Synthetic
cctggggatccggatctcagcgacgggtcatggtcaacggtcagtagtgaggccggcacggaggacgtcgtgtgc

SEQ ID NO: 142531 - DNA, 75 bp, Artificial Sequence
  Synthetic
catatgacacccgctgttttgactccaccgtcactgagcaggacattagagtcgaggaatcaatataccaatcat

SEQ ID NO: 142532 - DNA, 75 bp, Artificial Sequence
  Synthetic
tcccccatcgtgggaccagatgtggaagtgtttgatccgcctcaagcccaccctccatgggccaacacctctgct

SEQ ID NO: 142533 - DNA, 75 bp, Artificial Sequence
  Synthetic
tcctgctgcaaaacgccagacctcctcgtggtgcctggtttgggtgtacgtggatgaattccaccggttatgtca

SEQ ID NO: 142534 - DNA, 75 bp, Artificial Sequence
  Synthetic
gaccccacatttaccataaccacacagactgttccacaggacgccgtctcgcgtagccaacgtcgcggacggacc

SEQ ID NO: 142535 - DNA, 75 bp, Artificial Sequence
  Synthetic
gctccatacctggatcaccgaagactgcccagtcccatgcgcgggctcttggctgcgcgacatatgggactggat

SEQ ID NO: 142536 - DNA, 75 bp, Artificial Sequence
  Synthetic
gtcgaggaatcaatataccaatcatgtcaactcacaccagaggctagagtggcaataaaggccctaactgagcgc

SEQ ID NO: 142537 - DNA, 75 bp, Artificial Sequence
  Synthetic
accatctcactcctcttcgggactgggcgcacaacggcctgcgagatctggccgtggctgtagagccagtcgtct

SEQ ID NO: 142538 - DNA, 75 bp, Artificial Sequence
  Synthetic
gaccatcagcggcccgaagggacctgtcaatcaaatgtacaccaatgttgaccaagacctggtggggtggccagc

SEQ ID NO: 142539 - DNA, 75 bp, Artificial Sequence
  Synthetic
tacaatgttgtccagcagctcccccaggccatcatgggggaagcttatggctttcaatactctccagcacagcgg

SEQ ID NO: 142540 - DNA, 75 bp, Artificial Sequence
  Synthetic
ttacctgttacatcaaggcgatggctgcttgtcgagctgcaaagctccaagatccgtcgttccttgtatgtgggg

SEQ ID NO: 142541 - DNA, 75 bp, Artificial Sequence
  Synthetic
actcatcgatgcctccgctcgagggggagccaggtgatcctgatttgacttcggactcgtggtctacggttagcg

SEQ ID NO: 142542 - DNA, 75 bp, Artificial Sequence
  Synthetic
ggtaggggaaaaatgggcatatataggtatgtctccagtggcgaacgcgcctcagggatgttcgatagcgtggtg

SEQ ID NO: 142543 - DNA, 75 bp, Artificial Sequence
  Synthetic
ctgtaccatcttgactgacttcaagaactggttgtccaccaaactgtttccaaaaatgcccggcctccccttcat

SEQ ID NO: 142544 - DNA, 75 bp, Artificial Sequence
  Synthetic
aggccgaggcggaggtttaccagtgttgtgacctggacccagacgcccgcagggtaataaccgcccttacagaga

SEQ ID NO: 142545 - DNA, 75 bp, Artificial Sequence
  Synthetic
aggccgaggcggaggtttaccagtgttgtgacctggaccctgacgcccgcagggtaataaccgcccttacagaga

SEQ ID NO: 142546 - DNA, 75 bp, Artificial Sequence
  Synthetic
aggccgaggcggaggtttaccagtgttgtgacctggaccccgacgcccgcagggtaataaccgcccttacagaga

SEQ ID NO: 142547 - DNA, 75 bp, Artificial Sequence
  Synthetic
aggccgaggcggaggtttaccagtgttgtgacctggacccggacgcccgcagggtaataaccgcccttacagaga

SEQ ID NO: 142548 - DNA, 75 bp, Artificial Sequence
  Synthetic
tgcttgtcgagctgcaaagctccaagatccgtcgttccttgtatgtggggacgatttggtggtggtcgctgagag

SEQ ID NO: 142549 - DNA, 75 bp, Artificial Sequence
  Synthetic
gagcaactctctcttgcgccaccacaacatggtgtacgcaacgacctcccgctcagcaactgcccggcagaaaaa

SEQ ID NO: 142550 - DNA, 75 bp, Artificial Sequence
  Synthetic
ctggagctaataacatcatgctcctccaacgtctccgtggcccatgacgctgcagggaagcggtactactacctc

SEQ ID NO: 142551 - DNA, 75 bp, Artificial Sequence
  Synthetic
ccaacgtctccgtggcccatgacgctgcagggaagcggtactactacctcacacgtgatccagaaataccgcttg

SEQ ID NO: 142552 - DNA, 75 bp, Artificial Sequence
  Synthetic
ggtgtgtccacggtacttctatcgtgggctatcaagtgggagtacgtagttttagcttttctggtgttggccgac

SEQ ID NO: 142553 - DNA, 75 bp, Artificial Sequence
  Synthetic
actgacctgttacctcaaagccacagcggcggccagagccgccggcctgaaagaccacaacatgctggtttgcgg

SEQ ID NO: 142554 - DNA, 75 bp, Artificial Sequence
  Synthetic
gaaatgtctaatccggctcaagcccaccctcgttggccccacgcccttgctataccgattgggcgcagtcaccaa

SEQ ID NO: 142555 - DNA, 75 bp, Artificial Sequence
  Synthetic
acgtgacggggttgacagatgacaatctcaaagtcccttgccaactgcctgcaccggagttcttctcctgggtgg

SEQ ID NO: 142556 - DNA, 75 bp, Artificial Sequence
  Synthetic
atggagttcagattcacaggtttgctcccgcaccaaagccgttctttagagatgaggtcacgtttaccgtgggcc

SEQ ID NO: 142557 - DNA, 75 bp, Artificial Sequence
  Synthetic
cagggttataaagtgttagtgcttaacccctcggttgcggccacactgggatttggggcgtacatgtccaaggca

SEQ ID NO: 142558 - DNA, 75 bp, Artificial Sequence
  Synthetic
aacccattttttctcaattctccaatcccaggagcagttagggaaagctctcgacttcgagatgtacggagctac

SEQ ID NO: 142559 - DNA, 75 bp, Artificial Sequence
  Synthetic
ctagccgccgttgccgcgtattgcttggcgaccggctgcgtgaccatcattggccgtttatgcgtcaaccagagg

SEQ ID NO: 142560 - DNA, 75 bp, Artificial Sequence
  Synthetic
tttcatctgtatcgcgtggcacatacggggcagagctgcccccctatttgcctatgcttgtcttcagttgtggcc

SEQ ID NO: 142561 - DNA, 75 bp, Artificial Sequence
  Synthetic
cattcttgcagggtatggcgcgggcgtggcgggagctcttgtagcattcaagatcatgagcggtgaggtcccctc

SEQ ID NO: 142562 - DNA, 75 bp, Artificial Sequence
  Synthetic
aagtcttctccgtgaagccggagaagggtggccggaagccagctcgcttgatagtatacccggatttgggtgtgc

SEQ ID NO: 142563 - DNA, 75 bp, Artificial Sequence
  Synthetic
tatgaagaggtactcggccccccccggcgacgcgccgcagccagcatatgacctggagctaataacatcatgctc

SEQ ID NO: 142564 - DNA, 75 bp, Artificial Sequence
  Synthetic
gtagcgggggccctcaggaagcttggggcgccccccctacgagcttggaaacatcgggcaaggcaagttcgcgct

SEQ ID NO: 142565 - DNA, 75 bp, Artificial Sequence
  Synthetic
ttttggggcctacatgtccaaagcccacgggatcaaccccaacatcagaaccggggtacggactgtgaccacggg

SEQ ID NO: 142566 - DNA, 75 bp, Artificial Sequence
  Synthetic
ccgaaatgttcaagtccaaaatacaaggcctgcttcagcaagcgtcgaggcaggcccaagacattcaaccagcag

SEQ ID NO: 142567 - DNA, 75 bp, Artificial Sequence
  Synthetic
gctcttgcttttagtgttatgcttaccccgtagggctttcgctcacaccaatgaggaggcagcttctcttgggtt

SEQ ID NO: 142568 - DNA, 75 bp, Artificial Sequence
  Synthetic
gcggtgatgggagatgcctacggcttccaatactcaccagcgcagcgggtcgactatctcctgaaatcctggaaa

SEQ ID NO: 142569 - DNA, 75 bp, Artificial Sequence
  Synthetic
ggctcgcctccatccgaggccagctcctctgcgagtcaactttcagcgccgtcattgcgagctacctgtaccacc

SEQ ID NO: 142570 - DNA, 75 bp, Artificial Sequence
  Synthetic
gaagcagttgtccatgtgtggataccatctttacaggttcggggtggccgcgatgctgtcatacttcttgcttgc

SEQ ID NO: 142571 - DNA, 75 bp, Artificial Sequence
  Synthetic
tggggaacatcatactttacgcgcccacaatatgggtgcgaatggtattgatgacccacttcttctcaatactcc

SEQ ID NO: 142572 - DNA, 75 bp, Artificial Sequence
  Synthetic
aaactcactccattgccagacgcgggtcggctggacttatccagctggttcaccgtcggcgccggcgggggcgac

SEQ ID NO: 142573 - DNA, 75 bp, Artificial Sequence
  Synthetic
caaccccgccgtggcctcgatgatggccttcagcgctgcccttaccagcccactatctaccagcaccaccatcct

SEQ ID NO: 142574 - DNA, 75 bp, Artificial Sequence
  Synthetic
ctctcgacccttcggttgaagaggaggacgagcgcgaaccttcaataccatcagaatatcttctccccaagaaga

SEQ ID NO: 142575 - DNA, 75 bp, Artificial Sequence
  Synthetic
atctttctgctgccagcccgataggctggtagctaacactccataacactcccttttcccgtgtttttttttttt

SEQ ID NO: 142576 - DNA, 75 bp, Artificial Sequence
  Synthetic
atgtgccctccctcctcagactgtgaccccaacgcctccgcccaggaggcgacgggccatagtcttgaaccagaa

SEQ ID NO: 142577 - DNA, 75 bp, Artificial Sequence
  Synthetic
atcggtctgggtaaaatactggtggacatcttggccgggtatggtgcaggtatctcaggagccttggtcgccttc

SEQ ID NO: 142578 - DNA, 75 bp, Artificial Sequence
  Synthetic
atcggtctgggtaaaatactggtggacatcttggccgggtatggtgctggtatctcaggagccttggtcgccttc

SEQ ID NO: 142579 - DNA, 75 bp, Artificial Sequence
  Synthetic
atcggtctgggtaaaatactggtggacatcttggccgggtatggtgccggtatctcaggagccttggtcgccttc

SEQ ID NO: 142580 - DNA, 75 bp, Artificial Sequence
  Synthetic
atcggtctgggtaaaatactggtggacatcttggccgggtatggtgcgggtatctcaggagccttggtcgccttc

SEQ ID NO: 142581 - DNA, 75 bp, Artificial Sequence
  Synthetic
cgttgagcccgtcatattttctccaatggagaaaaaggttatcacctggggtgctgacactgctgcatgtggaga

SEQ ID NO: 142582 - DNA, 75 bp, Artificial Sequence
  Synthetic
tgacgaggtactcggctccccctggagacgctccgcagccagcatatgatctcgagctaataacatcttgctcat

SEQ ID NO: 142583 - DNA, 75 bp, Artificial Sequence
  Synthetic
gccatcgaccagccaactttgagggaatctgctgactcggaagcaggctctgattcctctatgcctcccctcgag

SEQ ID NO: 142584 - DNA, 75 bp, Artificial Sequence
  Synthetic
ctactcctactttcagtaggggtaggcatatttttactgcccgcccgataggcgggtaacactccgaccctaggg

SEQ ID NO: 142585 - DNA, 75 bp, Artificial Sequence
  Synthetic
aatctgctgactcggaagcaggctctgattcctctatgcctcccctcgagggggagccaggagaccctgacctag

SEQ ID NO: 142586 - DNA, 75 bp, Artificial Sequence
  Synthetic
aataggctcattgcctttgcttccaaaggaaaccatgtcgccccaactcactacgtgacggagtcagatgcgtcg

SEQ ID NO: 142587 - DNA, 75 bp, Artificial Sequence
  Synthetic
aataggctcattgcctttgcttccaaaggaaaccatgtcgcccctactcactacgtgacggagtcagatgcgtcg

SEQ ID NO: 142588 - DNA, 75 bp, Artificial Sequence
  Synthetic
aataggctcattgcctttgcttccaaaggaaaccatgtcgcccccactcactacgtgacggagtcagatgcgtcg

SEQ ID NO: 142589 - DNA, 75 bp, Artificial Sequence
  Synthetic
aataggctcattgcctttgcttccaaaggaaaccatgtcgccccgactcactacgtgacggagtcagatgcgtcg

SEQ ID NO: 142590 - DNA, 75 bp, Artificial Sequence
  Synthetic
attactgcatacactcagcagaccaggggtctattgggcacgattgtcaccagccttaccggccgagacaagaat

SEQ ID NO: 142591 - DNA, 75 bp, Artificial Sequence
  Synthetic
cttggctccgcgacatatgggagtgggtttgtaccatcttgactgactttaaaaattggctatcctctaagctgc

SEQ ID NO: 142592 - DNA, 75 bp, Artificial Sequence
  Synthetic
cgctacctctgtcaacagagttctttggacggtctaccatggcgctggctccaaaacgctggctggcccgaaggg

SEQ ID NO: 142593 - DNA, 75 bp, Artificial Sequence
  Synthetic
ttcctatcccagaccaagcaatcgggtgagaatttcccataccttgttgcttatcaggccacagtatgcgccaga

SEQ ID NO: 142594 - DNA, 75 bp, Artificial Sequence
  Synthetic
atactctccacacgaactcaatcgggtggcgggaagcctcaggaaacttggggtccccccattgagagcgtggag

SEQ ID NO: 142595 - DNA, 75 bp, Artificial Sequence
  Synthetic
attatgcaaccggtaatttacctggttgctccttctctatcttcctcttggcactactctcgtgcctcaccaccc

SEQ ID NO: 142596 - DNA, 75 bp, Artificial Sequence
  Synthetic
gacctctatcttgtcacgaggaatgccgatgtcatccctgcaaggcgcagaggcgataatcgggcagctctcctc

SEQ ID NO: 142597 - DNA, 75 bp, Artificial Sequence
  Synthetic
caacatctctggcaacgtgcgtctgggcacaatgaggataacgggaccaaagacttgcatgaacacctggcaagg

SEQ ID NO: 142598 - DNA, 75 bp, Artificial Sequence
  Synthetic
gcaaaggaggtccgcagcttatccaggagggccgttaaccacatcaagtccgtgtgggaggacctcctggaagac

SEQ ID NO: 142599 - DNA, 75 bp, Artificial Sequence
  Synthetic
gtgggtggctgcccagctcgccgcccccggtgccgctaccgcctttgtgggcgctggcttagctggcgctgccat

SEQ ID NO: 142600 - DNA, 75 bp, Artificial Sequence
  Synthetic
tttccatcattggccgcctacacctgaatgatcgggtggttgtgacccctgacaaggaaatcttatatgaggcct

SEQ ID NO: 142601 - DNA, 75 bp, Artificial Sequence
  Synthetic
atcttccgcgcggccgtatgcaccaggggcgtggcaaagtctctcgattttgtccctgtggagggcatgcagtcc

SEQ ID NO: 142602 - DNA, 75 bp, Artificial Sequence
  Synthetic
gaggtcacacgccatggcagttactcatatgtgacaggactgacaaacgacaacttgaaggtcccctgccaattg

SEQ ID NO: 142603 - DNA, 75 bp, Artificial Sequence
  Synthetic
tgtccctgtggagggcatgcagtccaccgctcgctctccctccttctcagataacacatcccctcctgctgtacc

SEQ ID NO: 142604 - DNA, 75 bp, Artificial Sequence
  Synthetic
tcgatgaaatggaggagtgctccaagcatcttccactagtcgagcacgggttacaactggcagagcaattcaagc

SEQ ID NO: 142605 - DNA, 75 bp, Artificial Sequence
  Synthetic
gcctaaactccttcgtggtcgggtctcagctcccttgtgagccggaacccgatacggaggtattagcgtctatgc

SEQ ID NO: 142606 - DNA, 75 bp, Artificial Sequence
  Synthetic
tccaacgcaagcattgtgtatgaggcagcggacatgatcatgcatacccccgggtgcgtgccctgcgttcgggag

SEQ ID NO: 142607 - DNA, 75 bp, Artificial Sequence
  Synthetic
ctgaatccatcggtagcggccacacttgggttcggggcatatatgtctcaagcccatggcatagatcccaacata

SEQ ID NO: 142608 - DNA, 75 bp, Artificial Sequence
  Synthetic
gccctcgctgcgggctacctgtaccaatcatggcaagacctatgacgtcgacatggtggacgccagccttttcat

SEQ ID NO: 142609 - DNA, 75 bp, Artificial Sequence
  Synthetic
tcatcatctgtgacgagtgtcattcaacagatcctaccacagtcttaggtattgggactgtcttggatcaagcgg

SEQ ID NO: 142610 - DNA, 75 bp, Artificial Sequence
  Synthetic
cagatttgcaagcctcttttccctaggagcccaacagaatatccagttgatcaacaccaatggcagctggcatgt

SEQ ID NO: 142611 - DNA, 75 bp, Artificial Sequence
  Synthetic
ccatcagagtatttgctccccaagaaacggttcccaccagcgttgccgccatgggcacggcctgactacaaccca

SEQ ID NO: 142612 - DNA, 75 bp, Artificial Sequence
  Synthetic
tccattactgttccacatcccaatattacggagtcagctctccctaccactggagaaatacccttctatgggaag

SEQ ID NO: 142613 - DNA, 75 bp, Artificial Sequence
  Synthetic
ttccaagaagaagtgtgatgagctcgctaaacagctaacgtcgcttggcttaaatgccgtggccttttatagggg

SEQ ID NO: 142614 - DNA, 75 bp, Artificial Sequence
  Synthetic
ggcgccgggctacagtcctgacccagagtaatgtggccgaggccctgatggagctggccgtgaagagcttcggcc

SEQ ID NO: 142615 - DNA, 75 bp, Artificial Sequence
  Synthetic
cgacgcggcagcccgcgtgacccagatactatcatccctcactgtgacatcccttctcagacgcctccacaagtg

SEQ ID NO: 142616 - DNA, 75 bp, Artificial Sequence
  Synthetic
tgcaatgtttctgtcactcagattgttgacttcagtctcgacccaactttctccatagagaccaccacggtaccc

SEQ ID NO: 142617 - DNA, 75 bp, Artificial Sequence
  Synthetic
atccagttggtcaacaccaacggcagctggcatatcaataggacggccttgaattgcaacgaaagccttaacacc

SEQ ID NO: 142618 - DNA, 75 bp, Artificial Sequence
  Synthetic
gcgtatggtcctcatgacacactttttctccgtgctgatggcccaggaaaccctggaccaagacctaaactttga

SEQ ID NO: 142619 - DNA, 75 bp, Artificial Sequence
  Synthetic
ctctgtgtgctccatgccccccctcgagggggaacctggagaccccgacctggagtccgaaccggtagagcgcca

SEQ ID NO: 142620 - DNA, 75 bp, Artificial Sequence
  Synthetic
ttgacagcgtcgtcctgtgcgaggcgtacgatacaggttgtgcatggtatgaactgaccccagcggaaacaaccg

SEQ ID NO: 142621 - DNA, 75 bp, Artificial Sequence
  Synthetic
tactcttggactggggcggtaataaccccctgttcccgagaggaggaaaagttacccataaatcccttgagcaac

SEQ ID NO: 142622 - DNA, 75 bp, Artificial Sequence
  Synthetic
tactcttggactggggcggtaataaccccctgttcccgagaggaggaaaagtttcccataaatcccttgagcaac

SEQ ID NO: 142623 - DNA, 75 bp, Artificial Sequence
  Synthetic
tactcttggactggggcggtaataaccccctgttcccgagaggaggaaaagttccccataaatcccttgagcaac

SEQ ID NO: 142624 - DNA, 75 bp, Artificial Sequence
  Synthetic
tactcttggactggggcggtaataaccccctgttcccgagaggaggaaaagttgcccataaatcccttgagcaac

SEQ ID NO: 142625 - DNA, 75 bp, Artificial Sequence
  Synthetic
aaatcagtttgattaacaccaatggcagctggcatataaaccggaccgccctcaattgcaatgacagcttgagta

SEQ ID NO: 142626 - DNA, 75 bp, Artificial Sequence
  Synthetic
acccttataggctgtggcactacccctgcaccgtgaacttcaccatccacaaggtgcggatgtatgtgggcggcg

SEQ ID NO: 142627 - DNA, 75 bp, Artificial Sequence
  Synthetic
acccttataggctgtggcactacccctgcaccgtgaacttcaccatccacatggtgcggatgtatgtgggcggcg

SEQ ID NO: 142628 - DNA, 75 bp, Artificial Sequence
  Synthetic
acccttataggctgtggcactacccctgcaccgtgaacttcaccatccacacggtgcggatgtatgtgggcggcg

SEQ ID NO: 142629 - DNA, 75 bp, Artificial Sequence
  Synthetic
acccttataggctgtggcactacccctgcaccgtgaacttcaccatccacagggtgcggatgtatgtgggcggcg

SEQ ID NO: 142630 - DNA, 75 bp, Artificial Sequence
  Synthetic
acccttataggctgtggcactacccctgcaccgtgaacttcaccttccacaaggtgcggatgtatgtgggcggcg

SEQ ID NO: 142631 - DNA, 75 bp, Artificial Sequence
  Synthetic
acccttataggctgtggcactacccctgcaccgtgaacttcaccttccacatggtgcggatgtatgtgggcggcg

SEQ ID NO: 142632 - DNA, 75 bp, Artificial Sequence
  Synthetic
acccttataggctgtggcactacccctgcaccgtgaacttcaccttccacacggtgcggatgtatgtgggcggcg

SEQ ID NO: 142633 - DNA, 75 bp, Artificial Sequence
  Synthetic
acccttataggctgtggcactacccctgcaccgtgaacttcaccttccacagggtgcggatgtatgtgggcggcg

SEQ ID NO: 142634 - DNA, 75 bp, Artificial Sequence
  Synthetic
acccttataggctgtggcactacccctgcaccgtgaacttcaccctccacaaggtgcggatgtatgtgggcggcg

SEQ ID NO: 142635 - DNA, 75 bp, Artificial Sequence
  Synthetic
acccttataggctgtggcactacccctgcaccgtgaacttcaccctccacatggtgcggatgtatgtgggcggcg

SEQ ID NO: 142636 - DNA, 75 bp, Artificial Sequence
  Synthetic
acccttataggctgtggcactacccctgcaccgtgaacttcaccctccacacggtgcggatgtatgtgggcggcg

SEQ ID NO: 142637 - DNA, 75 bp, Artificial Sequence
  Synthetic
acccttataggctgtggcactacccctgcaccgtgaacttcaccctccacagggtgcggatgtatgtgggcggcg

SEQ ID NO: 142638 - DNA, 75 bp, Artificial Sequence
  Synthetic
acccttataggctgtggcactacccctgcaccgtgaacttcaccgtccacaaggtgcggatgtatgtgggcggcg

SEQ ID NO: 142639 - DNA, 75 bp, Artificial Sequence
  Synthetic
acccttataggctgtggcactacccctgcaccgtgaacttcaccgtccacatggtgcggatgtatgtgggcggcg

SEQ ID NO: 142640 - DNA, 75 bp, Artificial Sequence
  Synthetic
acccttataggctgtggcactacccctgcaccgtgaacttcaccgtccacacggtgcggatgtatgtgggcggcg

SEQ ID NO: 142641 - DNA, 75 bp, Artificial Sequence
  Synthetic
acccttataggctgtggcactacccctgcaccgtgaacttcaccgtccacagggtgcggatgtatgtgggcggcg

SEQ ID NO: 142642 - DNA, 75 bp, Artificial Sequence
  Synthetic
tgcccaacgcgctaaaaaggtgacttttgacagggtacagctgcttgactcacattatgactcagtcttgaagga

SEQ ID NO: 142643 - DNA, 75 bp, Artificial Sequence
  Synthetic
tggcctatcaggccactgtatgtgcaagagcgaaagctccccctccctcttgggatacaatgtggaagtgcctca

SEQ ID NO: 142644 - DNA, 75 bp, Artificial Sequence
  Synthetic
ggaggaatgtgcctctagggcggctctcatcgaagaggggcagcggatagccgagatgttgaagtccaagatcca

SEQ ID NO: 142645 - DNA, 75 bp, Artificial Sequence
  Synthetic
catgacctgcatgtcagcggacttagaggtcatcaccagcacctgggtgcttgtgggcggggtcctcgcagccct

SEQ ID NO: 142646 - DNA, 75 bp, Artificial Sequence
  Synthetic
ctgggtttactaagacatgcggtgcaccaccttgccgcattaggaaggatcacaacagcaccgtcgatctactgt

SEQ ID NO: 142647 - DNA, 75 bp, Artificial Sequence
  Synthetic
ctgggtttactaagacatgcggtgcaccaccttgccgcattaggatggatcacaacagcaccgtcgatctactgt

SEQ ID NO: 142648 - DNA, 75 bp, Artificial Sequence
  Synthetic
ctgggtttactaagacatgcggtgcaccaccttgccgcattaggacggatcacaacagcaccgtcgatctactgt

SEQ ID NO: 142649 - DNA, 75 bp, Artificial Sequence
  Synthetic
ctgggtttactaagacatgcggtgcaccaccttgccgcattaggagggatcacaacagcaccgtcgatctactgt

SEQ ID NO: 142650 - DNA, 75 bp, Artificial Sequence
  Synthetic
acataacggcggaagcggcgagccggagactggctcgagggtcaccaccctcgttagctagttcctcggctagcc

SEQ ID NO: 142651 - DNA, 75 bp, Artificial Sequence
  Synthetic
gagactggctcgagggtcaccaccctcgttagctagttcctcggctagccagctgtccgccccgtctcttaaggc

SEQ ID NO: 142652 - DNA, 75 bp, Artificial Sequence
  Synthetic
accctgacctcggcgtcagggtgtgcgagaagatggccctttatgacattacacaaaagcttccccaggcagtaa

SEQ ID NO: 142653 - DNA, 75 bp, Artificial Sequence
  Synthetic
caatatgatgagatggaggaatgctccaagcacatcccctatcttgctgagggccagctcatagcagaacaattc

SEQ ID NO: 142654 - DNA, 75 bp, Artificial Sequence
  Synthetic
cacatgcaccgctcgccatgactcccctggtactgatctcctcgaggccaacctcttgtgggggtctaccgctac

SEQ ID NO: 142655 - DNA, 75 bp, Artificial Sequence
  Synthetic
ggttttcatctgtttcgcctggcacattcgtggcaggatcgtccccctcactacttacactttgctacagatgtg

SEQ ID NO: 142656 - DNA, 75 bp, Artificial Sequence
  Synthetic
gcgatattgccatgctctttctccgacttaccggcgctgtccactggtctgttgcacctccaccaaaaaatcgtg

SEQ ID NO: 142657 - DNA, 75 bp, Artificial Sequence
  Synthetic
gcgatattgccatgctctttctccgacttaccggcgctgtccactggtctgttgcacctccaccaaaatatcgtg

SEQ ID NO: 142658 - DNA, 75 bp, Artificial Sequence
  Synthetic
gcgatattgccatgctctttctccgacttaccggcgctgtccactggtctgttgcacctccaccaaaacatcgtg

SEQ ID NO: 142659 - DNA, 75 bp, Artificial Sequence
  Synthetic
gcgatattgccatgctctttctccgacttaccggcgctgtccactggtctgttgcacctccaccaaaagatcgtg

SEQ ID NO: 142660 - DNA, 75 bp, Artificial Sequence
  Synthetic
gtgttcaccctcactccggcatacaagcaccttcttgtcaacactgtctggtggattcagtacttcattgcgcgt

SEQ ID NO: 142661 - DNA, 75 bp, Artificial Sequence
  Synthetic
ttccctcactagcccgctgtccacctccacaaccctcctgctcaacatcttaggagggtgggttgcgtcacaatt

SEQ ID NO: 142662 - DNA, 75 bp, Artificial Sequence
  Synthetic
ctccgaccgtccacgggtgtgccttgcctcccagcaagcaaccccccgtccctcctcccaggagaaagcgaacgg

SEQ ID NO: 142663 - DNA, 75 bp, Artificial Sequence
  Synthetic
ggtcaccgcatggcatgggatatgatgatgaactggtcccctacgacggcgttggtagtagctcagctgctccgg

SEQ ID NO: 142664 - DNA, 75 bp, Artificial Sequence
  Synthetic
tgcccccattacgtgttcgtggcggacgtgaagctgtcatcttgctcacttgcctactgcaaccgcaattggggt

SEQ ID NO: 142665 - DNA, 75 bp, Artificial Sequence
  Synthetic
tgcccccattacgtgttcgtggcggacgtgaagctgtcatcttgctcacttgcctactgcatccgcaattggggt

SEQ ID NO: 142666 - DNA, 75 bp, Artificial Sequence
  Synthetic
tgcccccattacgtgttcgtggcggacgtgaagctgtcatcttgctcacttgcctactgcacccgcaattggggt

SEQ ID NO: 142667 - DNA, 75 bp, Artificial Sequence
  Synthetic
tgcccccattacgtgttcgtggcggacgtgaagctgtcatcttgctcacttgcctactgcagccgcaattggggt

SEQ ID NO: 142668 - DNA, 75 bp, Artificial Sequence
  Synthetic
tgcccccattacgtgttcgtggcggacgtgatgctgtcatcttgctcacttgcctactgcaaccgcaattggggt

SEQ ID NO: 142669 - DNA, 75 bp, Artificial Sequence
  Synthetic
tgcccccattacgtgttcgtggcggacgtgatgctgtcatcttgctcacttgcctactgcatccgcaattggggt

SEQ ID NO: 142670 - DNA, 75 bp, Artificial Sequence
  Synthetic
tgcccccattacgtgttcgtggcggacgtgatgctgtcatcttgctcacttgcctactgcacccgcaattggggt

SEQ ID NO: 142671 - DNA, 75 bp, Artificial Sequence
  Synthetic
tgcccccattacgtgttcgtggcggacgtgatgctgtcatcttgctcacttgcctactgcagccgcaattggggt

SEQ ID NO: 142672 - DNA, 75 bp, Artificial Sequence
  Synthetic
tgcccccattacgtgttcgtggcggacgtgacgctgtcatcttgctcacttgcctactgcaaccgcaattggggt

SEQ ID NO: 142673 - DNA, 75 bp, Artificial Sequence
  Synthetic
tgcccccattacgtgttcgtggcggacgtgacgctgtcatcttgctcacttgcctactgcatccgcaattggggt

SEQ ID NO: 142674 - DNA, 75 bp, Artificial Sequence
  Synthetic
tgcccccattacgtgttcgtggcggacgtgacgctgtcatcttgctcacttgcctactgcacccgcaattggggt

SEQ ID NO: 142675 - DNA, 75 bp, Artificial Sequence
  Synthetic
tgcccccattacgtgttcgtggcggacgtgacgctgtcatcttgctcacttgcctactgcagccgcaattggggt

SEQ ID NO: 142676 - DNA, 75 bp, Artificial Sequence
  Synthetic
tgcccccattacgtgttcgtggcggacgtgaggctgtcatcttgctcacttgcctactgcaaccgcaattggggt

SEQ ID NO: 142677 - DNA, 75 bp, Artificial Sequence
  Synthetic
tgcccccattacgtgttcgtggcggacgtgaggctgtcatcttgctcacttgcctactgcatccgcaattggggt

SEQ ID NO: 142678 - DNA, 75 bp, Artificial Sequence
  Synthetic
tgcccccattacgtgttcgtggcggacgtgaggctgtcatcttgctcacttgcctactgcacccgcaattggggt

SEQ ID NO: 142679 - DNA, 75 bp, Artificial Sequence
  Synthetic
tgcccccattacgtgttcgtggcggacgtgaggctgtcatcttgctcacttgcctactgcagccgcaattggggt

SEQ ID NO: 142680 - DNA, 75 bp, Artificial Sequence
  Synthetic
tgcccccatttcgtgttcgtggcggacgtgaagctgtcatcttgctcacttgcctactgcaaccgcaattggggt

SEQ ID NO: 142681 - DNA, 75 bp, Artificial Sequence
  Synthetic
tgcccccatttcgtgttcgtggcggacgtgaagctgtcatcttgctcacttgcctactgcatccgcaattggggt

SEQ ID NO: 142682 - DNA, 75 bp, Artificial Sequence
  Synthetic
tgcccccatttcgtgttcgtggcggacgtgaagctgtcatcttgctcacttgcctactgcacccgcaattggggt

SEQ ID NO: 142683 - DNA, 75 bp, Artificial Sequence
  Synthetic
tgcccccatttcgtgttcgtggcggacgtgaagctgtcatcttgctcacttgcctactgcagccgcaattggggt

SEQ ID NO: 142684 - DNA, 75 bp, Artificial Sequence
  Synthetic
tgcccccatttcgtgttcgtggcggacgtgatgctgtcatcttgctcacttgcctactgcaaccgcaattggggt

SEQ ID NO: 142685 - DNA, 75 bp, Artificial Sequence
  Synthetic
tgcccccatttcgtgttcgtggcggacgtgatgctgtcatcttgctcacttgcctactgcatccgcaattggggt

SEQ ID NO: 142686 - DNA, 75 bp, Artificial Sequence
  Synthetic
tgcccccatttcgtgttcgtggcggacgtgatgctgtcatcttgctcacttgcctactgcacccgcaattggggt

SEQ ID NO: 142687 - DNA, 75 bp, Artificial Sequence
  Synthetic
tgcccccatttcgtgttcgtggcggacgtgatgctgtcatcttgctcacttgcctactgcagccgcaattggggt

SEQ ID NO: 142688 - DNA, 75 bp, Artificial Sequence
  Synthetic
tgcccccatttcgtgttcgtggcggacgtgacgctgtcatcttgctcacttgcctactgcaaccgcaattggggt

SEQ ID NO: 142689 - DNA, 75 bp, Artificial Sequence
  Synthetic
tgcccccatttcgtgttcgtggcggacgtgacgctgtcatcttgctcacttgcctactgcatccgcaattggggt

SEQ ID NO: 142690 - DNA, 75 bp, Artificial Sequence
  Synthetic
tgcccccatttcgtgttcgtggcggacgtgacgctgtcatcttgctcacttgcctactgcacccgcaattggggt

SEQ ID NO: 142691 - DNA, 75 bp, Artificial Sequence
  Synthetic
tgcccccatttcgtgttcgtggcggacgtgacgctgtcatcttgctcacttgcctactgcagccgcaattggggt

SEQ ID NO: 142692 - DNA, 75 bp, Artificial Sequence
  Synthetic
tgcccccatttcgtgttcgtggcggacgtgaggctgtcatcttgctcacttgcctactgcaaccgcaattggggt

SEQ ID NO: 142693 - DNA, 75 bp, Artificial Sequence
  Synthetic
tgcccccatttcgtgttcgtggcggacgtgaggctgtcatcttgctcacttgcctactgcatccgcaattggggt

SEQ ID NO: 142694 - DNA, 75 bp, Artificial Sequence
  Synthetic
tgcccccatttcgtgttcgtggcggacgtgaggctgtcatcttgctcacttgcctactgcacccgcaattggggt

SEQ ID NO: 142695 - DNA, 75 bp, Artificial Sequence
  Synthetic
tgcccccatttcgtgttcgtggcggacgtgaggctgtcatcttgctcacttgcctactgcagccgcaattggggt

SEQ ID NO: 142696 - DNA, 75 bp, Artificial Sequence
  Synthetic
tgcccccattccgtgttcgtggcggacgtgaagctgtcatcttgctcacttgcctactgcaaccgcaattggggt

SEQ ID NO: 142697 - DNA, 75 bp, Artificial Sequence
  Synthetic
tgcccccattccgtgttcgtggcggacgtgaagctgtcatcttgctcacttgcctactgcatccgcaattggggt

SEQ ID NO: 142698 - DNA, 75 bp, Artificial Sequence
  Synthetic
tgcccccattccgtgttcgtggcggacgtgaagctgtcatcttgctcacttgcctactgcacccgcaattggggt

SEQ ID NO: 142699 - DNA, 75 bp, Artificial Sequence
  Synthetic
tgcccccattccgtgttcgtggcggacgtgaagctgtcatcttgctcacttgcctactgcagccgcaattggggt

SEQ ID NO: 142700 - DNA, 75 bp, Artificial Sequence
  Synthetic
tgcccccattccgtgttcgtggcggacgtgatgctgtcatcttgctcacttgcctactgcaaccgcaattggggt

SEQ ID NO: 142701 - DNA, 75 bp, Artificial Sequence
  Synthetic
tgcccccattccgtgttcgtggcggacgtgatgctgtcatcttgctcacttgcctactgcatccgcaattggggt

SEQ ID NO: 142702 - DNA, 75 bp, Artificial Sequence
  Synthetic
tgcccccattccgtgttcgtggcggacgtgatgctgtcatcttgctcacttgcctactgcacccgcaattggggt

SEQ ID NO: 142703 - DNA, 75 bp, Artificial Sequence
  Synthetic
tgcccccattccgtgttcgtggcggacgtgatgctgtcatcttgctcacttgcctactgcagccgcaattggggt

SEQ ID NO: 142704 - DNA, 75 bp, Artificial Sequence
  Synthetic
tgcccccattccgtgttcgtggcggacgtgacgctgtcatcttgctcacttgcctactgcaaccgcaattggggt

SEQ ID NO: 142705 - DNA, 75 bp, Artificial Sequence
  Synthetic
tgcccccattccgtgttcgtggcggacgtgacgctgtcatcttgctcacttgcctactgcatccgcaattggggt

SEQ ID NO: 142706 - DNA, 75 bp, Artificial Sequence
  Synthetic
tgcccccattccgtgttcgtggcggacgtgacgctgtcatcttgctcacttgcctactgcacccgcaattggggt

SEQ ID NO: 142707 - DNA, 75 bp, Artificial Sequence
  Synthetic
tgcccccattccgtgttcgtggcggacgtgacgctgtcatcttgctcacttgcctactgcagccgcaattggggt

SEQ ID NO: 142708 - DNA, 75 bp, Artificial Sequence
  Synthetic
tgcccccattccgtgttcgtggcggacgtgaggctgtcatcttgctcacttgcctactgcaaccgcaattggggt

SEQ ID NO: 142709 - DNA, 75 bp, Artificial Sequence
  Synthetic
tgcccccattccgtgttcgtggcggacgtgaggctgtcatcttgctcacttgcctactgcatccgcaattggggt

SEQ ID NO: 142710 - DNA, 75 bp, Artificial Sequence
  Synthetic
tgcccccattccgtgttcgtggcggacgtgaggctgtcatcttgctcacttgcctactgcacccgcaattggggt

SEQ ID NO: 142711 - DNA, 75 bp, Artificial Sequence
  Synthetic
tgcccccattccgtgttcgtggcggacgtgaggctgtcatcttgctcacttgcctactgcagccgcaattggggt

SEQ ID NO: 142712 - DNA, 75 bp, Artificial Sequence
  Synthetic
tgcccccattgcgtgttcgtggcggacgtgaagctgtcatcttgctcacttgcctactgcaaccgcaattggggt

SEQ ID NO: 142713 - DNA, 75 bp, Artificial Sequence
  Synthetic
tgcccccattgcgtgttcgtggcggacgtgaagctgtcatcttgctcacttgcctactgcatccgcaattggggt

SEQ ID NO: 142714 - DNA, 75 bp, Artificial Sequence
  Synthetic
tgcccccattgcgtgttcgtggcggacgtgaagctgtcatcttgctcacttgcctactgcacccgcaattggggt

SEQ ID NO: 142715 - DNA, 75 bp, Artificial Sequence
  Synthetic
tgcccccattgcgtgttcgtggcggacgtgaagctgtcatcttgctcacttgcctactgcagccgcaattggggt

SEQ ID NO: 142716 - DNA, 75 bp, Artificial Sequence
  Synthetic
tgcccccattgcgtgttcgtggcggacgtgatgctgtcatcttgctcacttgcctactgcaaccgcaattggggt

SEQ ID NO: 142717 - DNA, 75 bp, Artificial Sequence
  Synthetic
tgcccccattgcgtgttcgtggcggacgtgatgctgtcatcttgctcacttgcctactgcatccgcaattggggt

SEQ ID NO: 142718 - DNA, 75 bp, Artificial Sequence
  Synthetic
tgcccccattgcgtgttcgtggcggacgtgatgctgtcatcttgctcacttgcctactgcacccgcaattggggt

SEQ ID NO: 142719 - DNA, 75 bp, Artificial Sequence
  Synthetic
tgcccccattgcgtgttcgtggcggacgtgatgctgtcatcttgctcacttgcctactgcagccgcaattggggt

SEQ ID NO: 142720 - DNA, 75 bp, Artificial Sequence
  Synthetic
tgcccccattgcgtgttcgtggcggacgtgacgctgtcatcttgctcacttgcctactgcaaccgcaattggggt

SEQ ID NO: 142721 - DNA, 75 bp, Artificial Sequence
  Synthetic
tgcccccattgcgtgttcgtggcggacgtgacgctgtcatcttgctcacttgcctactgcatccgcaattggggt

SEQ ID NO: 142722 - DNA, 75 bp, Artificial Sequence
  Synthetic
tgcccccattgcgtgttcgtggcggacgtgacgctgtcatcttgctcacttgcctactgcacccgcaattggggt

SEQ ID NO: 142723 - DNA, 75 bp, Artificial Sequence
  Synthetic
tgcccccattgcgtgttcgtggcggacgtgacgctgtcatcttgctcacttgcctactgcagccgcaattggggt

SEQ ID NO: 142724 - DNA, 75 bp, Artificial Sequence
  Synthetic
tgcccccattgcgtgttcgtggcggacgtgaggctgtcatcttgctcacttgcctactgcaaccgcaattggggt

SEQ ID NO: 142725 - DNA, 75 bp, Artificial Sequence
  Synthetic
tgcccccattgcgtgttcgtggcggacgtgaggctgtcatcttgctcacttgcctactgcatccgcaattggggt

SEQ ID NO: 142726 - DNA, 75 bp, Artificial Sequence
  Synthetic
tgcccccattgcgtgttcgtggcggacgtgaggctgtcatcttgctcacttgcctactgcacccgcaattggggt

SEQ ID NO: 142727 - DNA, 75 bp, Artificial Sequence
  Synthetic
tgcccccattgcgtgttcgtggcggacgtgaggctgtcatcttgctcacttgcctactgcagccgcaattggggt

SEQ ID NO: 142728 - DNA, 75 bp, Artificial Sequence
  Synthetic
gggtacggcgctggcgtgtcgggagcgcttgtcgcgtttaagatcatgagcggcgagacacccgcagctgaggac

SEQ ID NO: 142729 - DNA, 75 bp, Artificial Sequence
  Synthetic
cactccaactgagaccacagactcgggccccatcctcgtggatgacgcatccgatgacggatcttattcgtcaat

SEQ ID NO: 142730 - DNA, 75 bp, Artificial Sequence
  Synthetic
gttgagcaagacgaacgaaacctgagagtcttcacagaggccatgaccaggtattctgctcctcccggcgaccac

SEQ ID NO: 142731 - DNA, 75 bp, Artificial Sequence
  Synthetic
gttgagcaagacgaacgaaacctgagagtcttcactgaggccatgaccaggtattctgctcctcccggcgaccac

SEQ ID NO: 142732 - DNA, 75 bp, Artificial Sequence
  Synthetic
gttgagcaagacgaacgaaacctgagagtcttcaccgaggccatgaccaggtattctgctcctcccggcgaccac

SEQ ID NO: 142733 - DNA, 75 bp, Artificial Sequence
  Synthetic
gttgagcaagacgaacgaaacctgagagtcttcacggaggccatgaccaggtattctgctcctcccggcgaccac

SEQ ID NO: 142734 - DNA, 75 bp, Artificial Sequence
  Synthetic
acccgaccactccactctcccgggctgcctgggagactgttagacactcccccgtcaattcatggctgggcaaca

SEQ ID NO: 142735 - DNA, 75 bp, Artificial Sequence
  Synthetic
cttgtgcggctgaggaatcaaagctgccaattagccccctgagcaattcactcctgcgtcaccacaacatggtgt

SEQ ID NO: 142736 - DNA, 75 bp, Artificial Sequence
  Synthetic
agacagacacttcacgccaaatcatgaccatcctaagttcccttaccataaccagtctactgcgtaagctgcatg

SEQ ID NO: 142737 - DNA, 75 bp, Artificial Sequence
  Synthetic
atcatctggctggctgtcattctacacccgcgcctcgtatttgaggtcacgaagtggttaatagcagtcctgggg

SEQ ID NO: 142738 - DNA, 75 bp, Artificial Sequence
  Synthetic
atcatctggctggctgtcattctacacccgcgcctcgtatttgaggtcacgaagtggttattagcagtcctgggg

SEQ ID NO: 142739 - DNA, 75 bp, Artificial Sequence
  Synthetic
atcatctggctggctgtcattctacacccgcgcctcgtatttgaggtcacgaagtggttactagcagtcctgggg

SEQ ID NO: 142740 - DNA, 75 bp, Artificial Sequence
  Synthetic
atcatctggctggctgtcattctacacccgcgcctcgtatttgaggtcacgaagtggttagtagcagtcctgggg

SEQ ID NO: 142741 - DNA, 75 bp, Artificial Sequence
  Synthetic
atcatctggctggctgtcattctacacccgcgcctcgtttttgaggtcacgaagtggttaatagcagtcctgggg

SEQ ID NO: 142742 - DNA, 75 bp, Artificial Sequence
  Synthetic
atcatctggctggctgtcattctacacccgcgcctcgtttttgaggtcacgaagtggttattagcagtcctgggg

SEQ ID NO: 142743 - DNA, 75 bp, Artificial Sequence
  Synthetic
atcatctggctggctgtcattctacacccgcgcctcgtttttgaggtcacgaagtggttactagcagtcctgggg

SEQ ID NO: 142744 - DNA, 75 bp, Artificial Sequence
  Synthetic
atcatctggctggctgtcattctacacccgcgcctcgtttttgaggtcacgaagtggttagtagcagtcctgggg

SEQ ID NO: 142745 - DNA, 75 bp, Artificial Sequence
  Synthetic
atcatctggctggctgtcattctacacccgcgcctcgtctttgaggtcacgaagtggttaatagcagtcctgggg

SEQ ID NO: 142746 - DNA, 75 bp, Artificial Sequence
  Synthetic
atcatctggctggctgtcattctacacccgcgcctcgtctttgaggtcacgaagtggttattagcagtcctgggg

SEQ ID NO: 142747 - DNA, 75 bp, Artificial Sequence
  Synthetic
atcatctggctggctgtcattctacacccgcgcctcgtctttgaggtcacgaagtggttactagcagtcctgggg

SEQ ID NO: 142748 - DNA, 75 bp, Artificial Sequence
  Synthetic
atcatctggctggctgtcattctacacccgcgcctcgtctttgaggtcacgaagtggttagtagcagtcctgggg

SEQ ID NO: 142749 - DNA, 75 bp, Artificial Sequence
  Synthetic
atcatctggctggctgtcattctacacccgcgcctcgtgtttgaggtcacgaagtggttaatagcagtcctgggg

SEQ ID NO: 142750 - DNA, 75 bp, Artificial Sequence
  Synthetic
atcatctggctggctgtcattctacacccgcgcctcgtgtttgaggtcacgaagtggttattagcagtcctgggg

SEQ ID NO: 142751 - DNA, 75 bp, Artificial Sequence
  Synthetic
atcatctggctggctgtcattctacacccgcgcctcgtgtttgaggtcacgaagtggttactagcagtcctgggg

SEQ ID NO: 142752 - DNA, 75 bp, Artificial Sequence
  Synthetic
atcatctggctggctgtcattctacacccgcgcctcgtgtttgaggtcacgaagtggttagtagcagtcctgggg

SEQ ID NO: 142753 - DNA, 75 bp, Artificial Sequence
  Synthetic
tgagatgtatggggcggtgtactcggtgtgcccattggatctcccagccataattgaaaggctgcatgggctaga

SEQ ID NO: 142754 - DNA, 75 bp, Artificial Sequence
  Synthetic
tgttgtctgattttaagacctggcttaaggcaaagctcgtgccgtcattgcccggagtccccttcctctcatgcc

SEQ ID NO: 142755 - DNA, 75 bp, Artificial Sequence
  Synthetic
ctttggacagtttaccacggtgcagggtcaaggacgctagctggcccgaaagggccggtgtgccaaatgtacacc

SEQ ID NO: 142756 - DNA, 75 bp, Artificial Sequence
  Synthetic
tcccctcaggacgtggaagagccgggcacgcgcagtgagagcagccctcattgcccgaggggggagggcggccat

SEQ ID NO: 142757 - DNA, 75 bp, Artificial Sequence
  Synthetic
gcagggccattaaccacatcaactccgtgtgggaggacttgctggaagacaacaataccccaataccaacaacaa

SEQ ID NO: 142758 - DNA, 75 bp, Artificial Sequence
  Synthetic
tatctcaggttcgcgatggtgcagcaacatctggcacggcaccttccccataaacgcgtccacgaccggccccag

SEQ ID NO: 142759 - DNA, 75 bp, Artificial Sequence
  Synthetic
aacatctggcacggcaccttccccataaacgcgtccacgaccggccccagcgtgcccatcccagagcccaattac

SEQ ID NO: 142760 - DNA, 75 bp, Artificial Sequence
  Synthetic
attgacaccatgtagctgcggctcgagtgacctctacctcatcacgaggaatgccgacgtcatacctgcaagacg

SEQ ID NO: 142761 - DNA, 75 bp, Artificial Sequence
  Synthetic
aacaataccccaataccaacaacaatcatggccaaaaatgaggttttcgctgtaaacccagcgaaaggaggtcgg

SEQ ID NO: 142762 - DNA, 75 bp, Artificial Sequence
  Synthetic
ggcgccggcgggggcgacatttatcacagcgtgtcgcgagcccgaccccgcttattactcctttgcctactccta

SEQ ID NO: 142763 - DNA, 75 bp, Artificial Sequence
  Synthetic
gcccatgtcaagtaccggctccagagttcttcacggaggttgacggggtgcgaattcatcgatacgcgcccgaat

SEQ ID NO: 142764 - DNA, 75 bp, Artificial Sequence
  Synthetic
tccagcgcagcgggtggaatttcttctgacttcctggaagtcgaagaagactcctatggggttctcttatgatac

SEQ ID NO: 142765 - DNA, 75 bp, Artificial Sequence
  Synthetic
gcacatcaacagaactgccctgaactgcaatgactccctccagactgggttccttgccgcgctgttctacacata

SEQ ID NO: 142766 - DNA, 75 bp, Artificial Sequence
  Synthetic
ggaacgaggaccatcgcatcacccaagggtcctgttatccagatgtataccaatgtggacaaagaccttgtgggc

SEQ ID NO: 142767 - DNA, 75 bp, Artificial Sequence
  Synthetic
aggttgctctgtccaccaccggagagatccccttttacggcaaggctatcccccttgaggtaatcaaggggggga

SEQ ID NO: 142768 - DNA, 75 bp, Artificial Sequence
  Synthetic
cgtaacatcaatgctgacagatccatcacacataacggctgagtctgctgcccgccgcctcgcgcgcgggtctcc

SEQ ID NO: 142769 - DNA, 75 bp, Artificial Sequence
  Synthetic
gcaaacctgctgtggaggcaggagatggggagtaatataactcgggtggagtctgagaccaaggtgattgtgctc

SEQ ID NO: 142770 - DNA, 75 bp, Artificial Sequence
  Synthetic
gttggcatatcaacaggaccgccctgaactgcaatgactccctccgcactgggttcctctccgcgctgttttatg

SEQ ID NO: 142771 - DNA, 75 bp, Artificial Sequence
  Synthetic
tacctatggtaagttcctcgctgacggtggctgttcaggtggggcctatgacgtcatcatttgtgatgagtgcca

SEQ ID NO: 142772 - DNA, 75 bp, Artificial Sequence
  Synthetic
gaactgcaatgactccctccgcactgggttcctctccgcgctgttttatgcgcacaagttcaactcgtctgggtg

SEQ ID NO: 142773 - DNA, 75 bp, Artificial Sequence
  Synthetic
ccatctgggctcggccggattacaacccgccattgctcgagacgtggaaggctccagattatgaaccacctgtgg

SEQ ID NO: 142774 - DNA, 75 bp, Artificial Sequence
  Synthetic
ctgcctcggccctacattataccaataagtctggtctttacaacctaaccaatgactgtcccaacagcagtatcg

SEQ ID NO: 142775 - DNA, 75 bp, Artificial Sequence
  Synthetic
ctgcctcggccctacattataccaataagtctggtctttactacctaaccaatgactgtcccaacagcagtatcg

SEQ ID NO: 142776 - DNA, 75 bp, Artificial Sequence
  Synthetic
ctgcctcggccctacattataccaataagtctggtctttaccacctaaccaatgactgtcccaacagcagtatcg

SEQ ID NO: 142777 - DNA, 75 bp, Artificial Sequence
  Synthetic
ctgcctcggccctacattataccaataagtctggtctttacgacctaaccaatgactgtcccaacagcagtatcg

SEQ ID NO: 142778 - DNA, 75 bp, Artificial Sequence
  Synthetic
ctgcctcggccctacattattccaataagtctggtctttacaacctaaccaatgactgtcccaacagcagtatcg

SEQ ID NO: 142779 - DNA, 75 bp, Artificial Sequence
  Synthetic
ctgcctcggccctacattattccaataagtctggtctttactacctaaccaatgactgtcccaacagcagtatcg

SEQ ID NO: 142780 - DNA, 75 bp, Artificial Sequence
  Synthetic
ctgcctcggccctacattattccaataagtctggtctttaccacctaaccaatgactgtcccaacagcagtatcg

SEQ ID NO: 142781 - DNA, 75 bp, Artificial Sequence
  Synthetic
ctgcctcggccctacattattccaataagtctggtctttacgacctaaccaatgactgtcccaacagcagtatcg

SEQ ID NO: 142782 - DNA, 75 bp, Artificial Sequence
  Synthetic
ctgcctcggccctacattatcccaataagtctggtctttacaacctaaccaatgactgtcccaacagcagtatcg

SEQ ID NO: 142783 - DNA, 75 bp, Artificial Sequence
  Synthetic
ctgcctcggccctacattatcccaataagtctggtctttactacctaaccaatgactgtcccaacagcagtatcg

SEQ ID NO: 142784 - DNA, 75 bp, Artificial Sequence
  Synthetic
ctgcctcggccctacattatcccaataagtctggtctttaccacctaaccaatgactgtcccaacagcagtatcg

SEQ ID NO: 142785 - DNA, 75 bp, Artificial Sequence
  Synthetic
ctgcctcggccctacattatcccaataagtctggtctttacgacctaaccaatgactgtcccaacagcagtatcg

SEQ ID NO: 142786 - DNA, 75 bp, Artificial Sequence
  Synthetic
ctgcctcggccctacattatgccaataagtctggtctttacaacctaaccaatgactgtcccaacagcagtatcg

SEQ ID NO: 142787 - DNA, 75 bp, Artificial Sequence
  Synthetic
ctgcctcggccctacattatgccaataagtctggtctttactacctaaccaatgactgtcccaacagcagtatcg

SEQ ID NO: 142788 - DNA, 75 bp, Artificial Sequence
  Synthetic
ctgcctcggccctacattatgccaataagtctggtctttaccacctaaccaatgactgtcccaacagcagtatcg

SEQ ID NO: 142789 - DNA, 75 bp, Artificial Sequence
  Synthetic
ctgcctcggccctacattatgccaataagtctggtctttacgacctaaccaatgactgtcccaacagcagtatcg

SEQ ID NO: 142790 - DNA, 75 bp, Artificial Sequence
  Synthetic
cgcgcagcttgctgagaagtcgtttccaacaccttcatcgtcatccacagacccggactcgggttgcccagtcaa

SEQ ID NO: 142791 - DNA, 75 bp, Artificial Sequence
  Synthetic
gccttaacgctgtggccttctataggggcattgatgtggcggttataccaacctcaggcgacgttgtcatctgcg

SEQ ID NO: 142792 - DNA, 75 bp, Artificial Sequence
  Synthetic
gactgcaacgtttcggttactcaggttgtcgacttcagccttgatcccactttcacaattgagactaccattgtg

SEQ ID NO: 142793 - DNA, 75 bp, Artificial Sequence
  Synthetic
tatacatcaaaccgtccaggagtgcaattgttccatctacacgggccgcattagtggccatcgcatggcgtggga

SEQ ID NO: 142794 - DNA, 75 bp, Artificial Sequence
  Synthetic
cattgcctgccgctgccaagctcgatttatcgagttggttcacggtgggcgccggcgggggagacatttatcaca

SEQ ID NO: 142795 - DNA, 75 bp, Artificial Sequence
  Synthetic
gtgttggccggaatactatactacagcatggtagccaactgggccaaggtcatcggcatccttctcttgtttgca

SEQ ID NO: 142796 - DNA, 75 bp, Artificial Sequence
  Synthetic
aaagatgtccggagtcatactagcaaggccattaaccacatcagctccgtgtgggaggacttgttagaagacaat

SEQ ID NO: 142797 - DNA, 75 bp, Artificial Sequence
  Synthetic
cggtaatattgccagcctgttcagcccaggctcccggcagaacctgcagcttataaactccaatggaagctggca

SEQ ID NO: 142798 - DNA, 75 bp, Artificial Sequence
  Synthetic
ctgaggccgccttggagaacctggtggtcctcaatgcggcgtctgtggccggagcgcatggcattctctccttcc

SEQ ID NO: 142799 - DNA, 75 bp, Artificial Sequence
  Synthetic
ggagcgcatggcattctctccttccttgtgttcttttgtgctgcctggtacatcaaaggcaggctggtccctggg

SEQ ID NO: 142800 - DNA, 75 bp, Artificial Sequence
  Synthetic
gtatgagctcacgcccgccgagaccacagttaggctacgagcgtacatgaacaccccggggctccccgtgtgcca

SEQ ID NO: 142801 - DNA, 75 bp, Artificial Sequence
  Synthetic
cgcatgagttcctgcaagcccctgacctatttcgatcagggctggggccccattagctacgctaatgtgagcggg

SEQ ID NO: 142802 - DNA, 75 bp, Artificial Sequence
  Synthetic
gctaccaccacgggcatatgccatggaccgggagatggccgcgtcgtgcggaggcacggtcctcataggtctggt

SEQ ID NO: 142803 - DNA, 75 bp, Artificial Sequence
  Synthetic
gattgttaccagcttgaccggcagggacaaaaatgaggttgagggtgaagtccaggtggtttctacagccacgca

SEQ ID NO: 142804 - DNA, 75 bp, Artificial Sequence
  Synthetic
aaaatgtggcgcgcaaggaagaacccgatgggtttctcctatgacaccagatgttttgactcaacagtcactgag

SEQ ID NO: 142805 - DNA, 75 bp, Artificial Sequence
  Synthetic
gccccatgtacaactcacggggccaactctgcggaatacgcaggtgccgcgcaagtggggtacttcccactagtt

SEQ ID NO: 142806 - DNA, 75 bp, Artificial Sequence
  Synthetic
cataaagcctgatgcctccagctcaaataccaccctgacttgtcccaccgattgcttccgaaaacatccggaggc

SEQ ID NO: 142807 - DNA, 75 bp, Artificial Sequence
  Synthetic
aataccaccctgacttgtcccaccgattgcttccgaaaacatccggaggcaacgtatactagatgtggttcaggt

SEQ ID NO: 142808 - DNA, 75 bp, Artificial Sequence
  Synthetic
ccgggagttcgatgagatggaagagtgctctcagcacttaccgtacatcgagcaagggatgatgctcgccgagca

SEQ ID NO: 142809 - DNA, 75 bp, Artificial Sequence
  Synthetic
taaacaccaatggcagctggcacatcaacaggactgccctgaattgcaatgactccctcaacaccgggttccttg

SEQ ID NO: 142810 - DNA, 75 bp, Artificial Sequence
  Synthetic
gttggcgactcctaccgcctccacagcttttgtggtgagcgggttggcaggcgccgcagttggtagtgtaggact

SEQ ID NO: 142811 - DNA, 75 bp, Artificial Sequence
  Synthetic
agatacaaggcctcttacaacaggccacaagacaggcccaagacatacagccagccatacagtcatcatggccca

SEQ ID NO: 142812 - DNA, 75 bp, Artificial Sequence
  Synthetic
ctccacgactgagctagcgattctcccctgctcgttcacgacgatgccagcactttctacggggttgatacactt

SEQ ID NO: 142813 - DNA, 75 bp, Artificial Sequence
  Synthetic
acgcggggtctgctcggctgcatcatcaccagcctcacaggccgggataagaaccaggttgagggggaggttcaa

SEQ ID NO: 142814 - DNA, 75 bp, Artificial Sequence
  Synthetic
ctgaaactgacacctcccgccagatcacagccatactcagatccctcactataaccagcctccttcgcaagttgc

SEQ ID NO: 142815 - DNA, 75 bp, Artificial Sequence
  Synthetic
ctgaaactgacacctcccgccagatcacagccatactcagttccctcactataaccagcctccttcgcaagttgc

SEQ ID NO: 142816 - DNA, 75 bp, Artificial Sequence
  Synthetic
ctgaaactgacacctcccgccagatcacagccatactcagctccctcactataaccagcctccttcgcaagttgc

SEQ ID NO: 142817 - DNA, 75 bp, Artificial Sequence
  Synthetic
ctgaaactgacacctcccgccagatcacagccatactcaggtccctcactataaccagcctccttcgcaagttgc

SEQ ID NO: 142818 - DNA, 75 bp, Artificial Sequence
  Synthetic
ctggccgatgcgcgcatttgcgcgtgtctttggcttatgctactcattggccaagccgaggccgcgttagagaac

SEQ ID NO: 142819 - DNA, 75 bp, Artificial Sequence
  Synthetic
agcggcctggtacttaaagggcagggtggtccccgcggccacgtactctgttctcggcttgtggtcctttctcct

SEQ ID NO: 142820 - DNA, 75 bp, Artificial Sequence
  Synthetic
aaggggaactagggctggccatattagtaatcatatccatctttactcttaccccagcatacaagactctcctaa

SEQ ID NO: 142821 - DNA, 75 bp, Artificial Sequence
  Synthetic
aacaccatgtagcggttcatggttgcgagacatttgggactgggtttgcaccgtgctctccgacttcaaaacctg

SEQ ID NO: 142822 - DNA, 75 bp, Artificial Sequence
  Synthetic
aacaccatgtagcggttcatggttgcgtgacatttgggactgggtttgcaccgtgctctccgacttcaaaacctg

SEQ ID NO: 142823 - DNA, 75 bp, Artificial Sequence
  Synthetic
aacaccatgtagcggttcatggttgcgcgacatttgggactgggtttgcaccgtgctctccgacttcaaaacctg

SEQ ID NO: 142824 - DNA, 75 bp, Artificial Sequence
  Synthetic
aacaccatgtagcggttcatggttgcgggacatttgggactgggtttgcaccgtgctctccgacttcaaaacctg

SEQ ID NO: 142825 - DNA, 75 bp, Artificial Sequence
  Synthetic
tcagtggtctagtgggggcagctgtcggaagtataggtctgggcaagatattggtggacgtcttggcagggtacg

SEQ ID NO: 142826 - DNA, 75 bp, Artificial Sequence
  Synthetic
tcagtggtctagtgggggcagctgtcggaagtataggtctgggcaagatattggtggacgtcttggctgggtacg

SEQ ID NO: 142827 - DNA, 75 bp, Artificial Sequence
  Synthetic
tcagtggtctagtgggggcagctgtcggaagtataggtctgggcaagatattggtggacgtcttggccgggtacg

SEQ ID NO: 142828 - DNA, 75 bp, Artificial Sequence
  Synthetic
tcagtggtctagtgggggcagctgtcggaagtataggtctgggcaagatattggtggacgtcttggcggggtacg

SEQ ID NO: 142829 - DNA, 75 bp, Artificial Sequence
  Synthetic
gcggtcagagccaaactcatagcccagggcgggaaagccgctatatgcggcaagtacctattcaactgggctgtg

SEQ ID NO: 142830 - DNA, 75 bp, Artificial Sequence
  Synthetic
gttgtggtggtgccagtatttcatagctcgtgtggaggctatgctccaggtgtgggtcccaagcctgtcagtccg

SEQ ID NO: 142831 - DNA, 75 bp, Artificial Sequence
  Synthetic
taccgcagacattccaagtggcccatctacacgcccccactggcagcggcaagagcaccaaggtgccggctgcat

SEQ ID NO: 142832 - DNA, 75 bp, Artificial Sequence
  Synthetic
tcggattcgacataaccaaggtgcttctggcaatcattggccccacttaccttctgcaggccagcctgttgtatg

SEQ ID NO: 142833 - DNA, 75 bp, Artificial Sequence
  Synthetic
cccgtctctgctcggcggggcaaattggtgttggtaggtccagctgacaacatgcaagatcagggctggaggttg

SEQ ID NO: 142834 - DNA, 75 bp, Artificial Sequence
  Synthetic
tggatgactctacagtatcacaagcacttgcacaactagccgaaaagtcctttccgacaccatcgacaaccacaa

SEQ ID NO: 142835 - DNA, 75 bp, Artificial Sequence
  Synthetic
cccgaagggcccagtgtgccaaatgtacaccaatgttgaccaggatttggtaggatggccggctcctccgggtgc

SEQ ID NO: 142836 - DNA, 75 bp, Artificial Sequence
  Synthetic
cgactgtaatacatgtgtcacccaaacagtcgatttcagcttggatcctaccttcaccattgagaccacgaccgt

SEQ ID NO: 142837 - DNA, 75 bp, Artificial Sequence
  Synthetic
ggtgccagtgacctctacttggtaacccgaaatgccgatgtcatccctgctagacgcaggggagatactcgtgca

SEQ ID NO: 142838 - DNA, 75 bp, Artificial Sequence
  Synthetic
acgtggaatcctatagctccatgccaccgcttgagggaaaaccgggaaatccggaccttagttcgggatcctggt

SEQ ID NO: 142839 - DNA, 75 bp, Artificial Sequence
  Synthetic
acgtggaatcctatagctccatgccaccgcttgagggaaaaccgggatatccggaccttagttcgggatcctggt

SEQ ID NO: 142840 - DNA, 75 bp, Artificial Sequence
  Synthetic
acgtggaatcctatagctccatgccaccgcttgagggaaaaccgggacatccggaccttagttcgggatcctggt

SEQ ID NO: 142841 - DNA, 75 bp, Artificial Sequence
  Synthetic
acgtggaatcctatagctccatgccaccgcttgagggaaaaccgggagatccggaccttagttcgggatcctggt

SEQ ID NO: 142842 - DNA, 75 bp, Artificial Sequence
  Synthetic
acgtggaatcctatagctccatgccaccgcttgagggataaccgggaaatccggaccttagttcgggatcctggt

SEQ ID NO: 142843 - DNA, 75 bp, Artificial Sequence
  Synthetic
acgtggaatcctatagctccatgccaccgcttgagggataaccgggatatccggaccttagttcgggatcctggt

SEQ ID NO: 142844 - DNA, 75 bp, Artificial Sequence
  Synthetic
acgtggaatcctatagctccatgccaccgcttgagggataaccgggacatccggaccttagttcgggatcctggt

SEQ ID NO: 142845 - DNA, 75 bp, Artificial Sequence
  Synthetic
acgtggaatcctatagctccatgccaccgcttgagggataaccgggagatccggaccttagttcgggatcctggt

SEQ ID NO: 142846 - DNA, 75 bp, Artificial Sequence
  Synthetic
acgtggaatcctatagctccatgccaccgcttgagggacaaccgggaaatccggaccttagttcgggatcctggt

SEQ ID NO: 142847 - DNA, 75 bp, Artificial Sequence
  Synthetic
acgtggaatcctatagctccatgccaccgcttgagggacaaccgggatatccggaccttagttcgggatcctggt

SEQ ID NO: 142848 - DNA, 75 bp, Artificial Sequence
  Synthetic
acgtggaatcctatagctccatgccaccgcttgagggacaaccgggacatccggaccttagttcgggatcctggt

SEQ ID NO: 142849 - DNA, 75 bp, Artificial Sequence
  Synthetic
acgtggaatcctatagctccatgccaccgcttgagggacaaccgggagatccggaccttagttcgggatcctggt

SEQ ID NO: 142850 - DNA, 75 bp, Artificial Sequence
  Synthetic
acgtggaatcctatagctccatgccaccgcttgagggagaaccgggaaatccggaccttagttcgggatcctggt

SEQ ID NO: 142851 - DNA, 75 bp, Artificial Sequence
  Synthetic
acgtggaatcctatagctccatgccaccgcttgagggagaaccgggatatccggaccttagttcgggatcctggt

SEQ ID NO: 142852 - DNA, 75 bp, Artificial Sequence
  Synthetic
acgtggaatcctatagctccatgccaccgcttgagggagaaccgggacatccggaccttagttcgggatcctggt

SEQ ID NO: 142853 - DNA, 75 bp, Artificial Sequence
  Synthetic
acgtggaatcctatagctccatgccaccgcttgagggagaaccgggagatccggaccttagttcgggatcctggt

SEQ ID NO: 142854 - DNA, 75 bp, Artificial Sequence
  Synthetic
ggagtcctagcgggccttgcctactattccatggtggggaactgggctaaggttttgattgtgatgctacttttt

SEQ ID NO: 142855 - DNA, 75 bp, Artificial Sequence
  Synthetic
atgagccaaagttccgaacaaggatccgcgggagagcagatcagcgcccgagaggggtaagtcggtaaagagcat

SEQ ID NO: 142856 - DNA, 75 bp, Artificial Sequence
  Synthetic
tggaacgtcagagatacaactcccaagaaggaaaaaagagaaggcaagaagcggatgcatttccccacaacgccg

SEQ ID NO: 142857 - DNA, 75 bp, Artificial Sequence
  Synthetic
tgaaactctaggaaggggaaagagggaaggtggaagagaaggaggcgggcctcccgatccgaggggcccggcggc

SEQ ID NO: 142858 - DNA, 75 bp, Artificial Sequence
  Synthetic
gggccggctactcttctttcccttctctcgtcttcctcggtcaacctcttaagttcctcttcttcttccttgctg

SEQ ID NO: 142859 - DNA, 75 bp, Artificial Sequence
  Synthetic
aagggttgagagtaccccagagggaggaagccacacggagtagaacagagaaatcacctccagaggaccccttca

SEQ ID NO: 142860 - DNA, 75 bp, Artificial Sequence
  Synthetic
ggaagccacacggagtagaacagagaaatcacctccagaggaccccttcagcgaacagaagggcgcatcgcggga

SEQ ID NO: 142861 - DNA, 75 bp, Artificial Sequence
  Synthetic
gggagtagaccatagcgataggaggggatgctaggagttaggggagaccgaagcgaggaggaaagcaaagaaagc

SEQ ID NO: 142862 - DNA, 75 bp, Artificial Sequence
  Synthetic
ccttcgtcggtgatcctgcctctccttgtcggagaaccctcccctgagaggcctcttcctaggcccggagtctac

SEQ ID NO: 142863 - DNA, 75 bp, Artificial Sequence
  Synthetic
ttcgccgggggagccccctctccatccttatctttctttccgagaattcctttgatgtttcccagccagggatta

SEQ ID NO: 142864 - DNA, 75 bp, Artificial Sequence
  Synthetic
gagccatgggatgctcttcccgattccgcccaaactccttccccccaagggtcgcccaggaatggcgggacccca

SEQ ID NO: 142865 - DNA, 75 bp, Artificial Sequence
  Synthetic
atgaaccaagttccgaacgaagatccgcgagggggagggatcaccgaccgagaggggatgaacgacaaggtgcgg

SEQ ID NO: 142866 - DNA, 75 bp, Artificial Sequence
  Synthetic
atgatccaagttccgaacgaagatccgcgagggggagggatcaccgaccgagaggggatgaacgacaaggtgcgg

SEQ ID NO: 142867 - DNA, 75 bp, Artificial Sequence
  Synthetic
atgacccaagttccgaacgaagatccgcgagggggagggatcaccgaccgagaggggatgaacgacaaggtgcgg

SEQ ID NO: 142868 - DNA, 75 bp, Artificial Sequence
  Synthetic
atgagccaagttccgaacgaagatccgcgagggggagggatcaccgaccgagaggggatgaacgacaaggtgcgg

SEQ ID NO: 142869 - DNA, 75 bp, Artificial Sequence
  Synthetic
cgcgagggggagggatcaccgaccgagaggggatgaacgacaaggtgcggggaaccaggagaaatcactcccaag

SEQ ID NO: 142870 - DNA, 75 bp, Artificial Sequence
  Synthetic
cgcgagggggagggatcaccgaccgagaggggatgaacgacaaggtgcggggaacctggagaaatcactcccaag

SEQ ID NO: 142871 - DNA, 75 bp, Artificial Sequence
  Synthetic
cgcgagggggagggatcaccgaccgagaggggatgaacgacaaggtgcggggaacccggagaaatcactcccaag

SEQ ID NO: 142872 - DNA, 75 bp, Artificial Sequence
  Synthetic
cgcgagggggagggatcaccgaccgagaggggatgaacgacaaggtgcggggaaccgggagaaatcactcccaag

SEQ ID NO: 142873 - DNA, 75 bp, Artificial Sequence
  Synthetic
ggcaacattccgaggggaccgtcccctcggtaatggcgaatgggacccacaaatctctctagattcccagagaga

SEQ ID NO: 142874 - DNA, 75 bp, Artificial Sequence
  Synthetic
agaggggatgaacgacaaggtgcggggaaccaggagaaatcactcccaagaaggtaagagagaactcaagaaccg

SEQ ID NO: 142875 - DNA, 75 bp, Artificial Sequence
  Synthetic
agaggggatgaacgacaaggtgcggggaacctggagaaatcactcccaagaaggtaagagagaactcaagaaccg

SEQ ID NO: 142876 - DNA, 75 bp, Artificial Sequence
  Synthetic
agaggggatgaacgacaaggtgcggggaacccggagaaatcactcccaagaaggtaagagagaactcaagaaccg

SEQ ID NO: 142877 - DNA, 75 bp, Artificial Sequence
  Synthetic
agaggggatgaacgacaaggtgcggggaaccgggagaaatcactcccaagaaggtaagagagaactcaagaaccg

SEQ ID NO: 142878 - DNA, 75 bp, Artificial Sequence
  Synthetic
ccagcctcctcgctggcgccggctgggcaacattccgaggggaccgtcccctcggtaatggcgaatgggacccac

SEQ ID NO: 142879 - DNA, 75 bp, Artificial Sequence
  Synthetic
gaagatttcccgagaacgctggaggcatctcggaatgggaaggagggaaggtgaaaaagaaggagcgggcctccc

SEQ ID NO: 142880 - DNA, 75 bp, Artificial Sequence
  Synthetic
gatccgaggggcccaactgccgagtttggagagcactccgggccgtacggtcgagtgttccccagagggaggaag

SEQ ID NO: 142881 - DNA, 75 bp, Artificial Sequence
  Synthetic
ttggagagcactccgggccgtacggtcgagtgttccccagagggaggaagccacacggagtagaacagagaaatc

SEQ ID NO: 142882 - DNA, 75 bp, Artificial Sequence
  Synthetic
cgcgaacctgtgagtggaaacccgctttattcactggggtcgacaactctggggagagaagggagggtcggctgg

SEQ ID NO: 142883 - DNA, 75 bp, Artificial Sequence
  Synthetic
ggggagagaagggagggtcggctgggaagagtatatcctatgggaatccctggtttccccttatgtccagtccct

SEQ ID NO: 142884 - DNA, 75 bp, Artificial Sequence
  Synthetic
acctccagaggaccccttcagcgaacagaagagccttgccgggataggagtaagaccatagcgatggggggagat

SEQ ID NO: 142885 - DNA, 75 bp, Artificial Sequence
  Synthetic
tggtttccccttatgtccagtccctccccggtccgagtaaagggggactccgggactccttgcatgctggggacg

SEQ ID NO: 142886 - DNA, 75 bp, Artificial Sequence
  Synthetic
cagaagagccttgccgggataggagtaagaccatagcgatggggggagatgctaggagtgggagggaccagagcg

SEQ ID NO: 142887 - DNA, 75 bp, Artificial Sequence
  Synthetic
cgcatagcagagcccgggccccctccaaaaaggaccgagggtggagcttggagcgcgggggaggccgccggagcc

SEQ ID NO: 142888 - DNA, 75 bp, Artificial Sequence
  Synthetic
gccgatagctgcttcttcttgttcttgagggccttccttcgtcggtgatcctgcctctccctgtcggtgaatcct

SEQ ID NO: 142889 - DNA, 75 bp, Artificial Sequence
  Synthetic
atgggatgctcctcccgattccgtccatccctcccccaggagggtcgcccaggaatgacgagaactccactcctc

SEQ ID NO: 142890 - DNA, 75 bp, Artificial Sequence
  Synthetic
ctgcctctccctgtcggtgaatcctcccctgagaggcctcttcctaggtccggagtctacttccatctggtccgt

SEQ ID NO: 142891 - DNA, 75 bp, Artificial Sequence
  Synthetic
ggtctctcttgagttcctctaacttctttcttccgctcacccactgctcgagaacctcttctctctccccgcgct

SEQ ID NO: 142892 - DNA, 75 bp, Artificial Sequence
  Synthetic
atgagccctagttccgggcgaggagaccgcgcggggaagagggaagacccgagagggagtaaatggtaaagagca

SEQ ID NO: 142893 - DNA, 75 bp, Artificial Sequence
  Synthetic
atgagccctagttccgggcgaggagaccgcgcggggaagagggaagacccgagagggagttaatggtaaagagca

SEQ ID NO: 142894 - DNA, 75 bp, Artificial Sequence
  Synthetic
atgagccctagttccgggcgaggagaccgcgcggggaagagggaagacccgagagggagtcaatggtaaagagca

SEQ ID NO: 142895 - DNA, 75 bp, Artificial Sequence
  Synthetic
atgagccctagttccgggcgaggagaccgcgcggggaagagggaagacccgagagggagtgaatggtaaagagca

SEQ ID NO: 142896 - DNA, 75 bp, Artificial Sequence
  Synthetic
accgcgcggggaagagggaagacccgagagggagtaaatggtaaagagcattggaacgtcggagaaaattctccc

SEQ ID NO: 142897 - DNA, 75 bp, Artificial Sequence
  Synthetic
accgcgcggggaagagggaagacccgagagggagttaatggtaaagagcattggaacgtcggagaaaattctccc

SEQ ID NO: 142898 - DNA, 75 bp, Artificial Sequence
  Synthetic
accgcgcggggaagagggaagacccgagagggagtcaatggtaaagagcattggaacgtcggagaaaattctccc

SEQ ID NO: 142899 - DNA, 75 bp, Artificial Sequence
  Synthetic
accgcgcggggaagagggaagacccgagagggagtgaatggtaaagagcattggaacgtcggagaaaattctccc

SEQ ID NO: 142900 - DNA, 75 bp, Artificial Sequence
  Synthetic
gagagggagtaaatggtaaagagcattggaacgtcggagaaaattctcccgcgaaggaaaaaagagtaaggcaag

SEQ ID NO: 142901 - DNA, 75 bp, Artificial Sequence
  Synthetic
gagagggagttaatggtaaagagcattggaacgtcggagaaaattctcccgcgaaggaaaaaagagtaaggcaag

SEQ ID NO: 142902 - DNA, 75 bp, Artificial Sequence
  Synthetic
gagagggagtcaatggtaaagagcattggaacgtcggagaaaattctcccgcgaaggaaaaaagagtaaggcaag

SEQ ID NO: 142903 - DNA, 75 bp, Artificial Sequence
  Synthetic
gagagggagtgaatggtaaagagcattggaacgtcggagaaaattctcccgcgaaggaaaaaagagtaaggcaag

SEQ ID NO: 142904 - DNA, 75 bp, Artificial Sequence
  Synthetic
agaaaagggaggatcggatgggaagagtatatcctatgggaatccgcggtctcccctcacgtccagcccatcccc

SEQ ID NO: 142905 - DNA, 75 bp, Artificial Sequence
  Synthetic
aaacggacagaacccccacgacgctggagacaccttggaaggggaaagaggatggatggaagaaggaggcgggcc

SEQ ID NO: 142906 - DNA, 75 bp, Artificial Sequence
  Synthetic
aaacggactgaacccccacgacgctggagacaccttggaaggggaaagaggatggatggaagaaggaggcgggcc

SEQ ID NO: 142907 - DNA, 75 bp, Artificial Sequence
  Synthetic
aaacggaccgaacccccacgacgctggagacaccttggaaggggaaagaggatggatggaagaaggaggcgggcc

SEQ ID NO: 142908 - DNA, 75 bp, Artificial Sequence
  Synthetic
aaacggacggaacccccacgacgctggagacaccttggaaggggaaagaggatggatggaagaaggaggcgggcc

SEQ ID NO: 142909 - DNA, 75 bp, Artificial Sequence
  Synthetic
ggagacaccttggaaggggaaagaggatggatggaagaaggaggcgggccccctgaaccgaggggcccgaccacc

SEQ ID NO: 142910 - DNA, 75 bp, Artificial Sequence
  Synthetic
aagtttggagagcactccgggccgaagggttgacaggcgtccagagagagaaatccacacggagaaagaagacaa

SEQ ID NO: 142911 - DNA, 75 bp, Artificial Sequence
  Synthetic
aagtttggagagcactccgggccgaagggttgacaggcgtccagagtgagaaatccacacggagaaagaagacaa

SEQ ID NO: 142912 - DNA, 75 bp, Artificial Sequence
  Synthetic
aagtttggagagcactccgggccgaagggttgacaggcgtccagagcgagaaatccacacggagaaagaagacaa

SEQ ID NO: 142913 - DNA, 75 bp, Artificial Sequence
  Synthetic
aagtttggagagcactccgggccgaagggttgacaggcgtccagagggagaaatccacacggagaaagaagacaa

SEQ ID NO: 142914 - DNA, 75 bp, Artificial Sequence
  Synthetic
ttttcttcttttccttccggaggtctctctcgagctcctcagctttcttccttgagttcacccacttctcgagga

SEQ ID NO: 142915 - DNA, 75 bp, Artificial Sequence
  Synthetic
cttatcccggggaaatcgacttatcgtccccacatagcagagcccggagccccttctaaagtgaccgggggggga

SEQ ID NO: 142916 - DNA, 75 bp, Artificial Sequence
  Synthetic
cttatcccggggaattcgacttatcgtccccacatagcagagcccggagccccttctaaagtgaccgggggggga

SEQ ID NO: 142917 - DNA, 75 bp, Artificial Sequence
  Synthetic
cttatcccggggaactcgacttatcgtccccacatagcagagcccggagccccttctaaagtgaccgggggggga

SEQ ID NO: 142918 - DNA, 75 bp, Artificial Sequence
  Synthetic
cttatcccggggaagtcgacttatcgtccccacatagcagagcccggagccccttctaaagtgaccgggggggga

SEQ ID NO: 142919 - DNA, 75 bp, Artificial Sequence
  Synthetic
cttgagttcacccacttctcgaggatgtcttctctccctccgcgggctttcttcgattcggaccggctcatttcg

SEQ ID NO: 142920 - DNA, 75 bp, Artificial Sequence
  Synthetic
gcttggagcataggagacgcagtggagccatgggatgcccttcccgattccgtccatccccactcccagagggtc

SEQ ID NO: 142921 - DNA, 75 bp, Artificial Sequence
  Synthetic
atgagccaagctccgagcgaagggaccgcgggggagagaataacaccggagagggagtgaacaacaaggggcgag

SEQ ID NO: 142922 - DNA, 75 bp, Artificial Sequence
  Synthetic
atgagccaagctccgagcgaagggaccgcgggggagagaatatcaccggagagggagtgaacaacaaggggcgag

SEQ ID NO: 142923 - DNA, 75 bp, Artificial Sequence
  Synthetic
atgagccaagctccgagcgaagggaccgcgggggagagaataccaccggagagggagtgaacaacaaggggcgag

SEQ ID NO: 142924 - DNA, 75 bp, Artificial Sequence
  Synthetic
atgagccaagctccgagcgaagggaccgcgggggagagaatagcaccggagagggagtgaacaacaaggggcgag

SEQ ID NO: 142925 - DNA, 75 bp, Artificial Sequence
  Synthetic
ccgcgggggagagaataacaccggagagggagtgaacaacaaggggcgaggaacctcgaagggaactctcccaag

SEQ ID NO: 142926 - DNA, 75 bp, Artificial Sequence
  Synthetic
ccgcgggggagagaatatcaccggagagggagtgaacaacaaggggcgaggaacctcgaagggaactctcccaag

SEQ ID NO: 142927 - DNA, 75 bp, Artificial Sequence
  Synthetic
ccgcgggggagagaataccaccggagagggagtgaacaacaaggggcgaggaacctcgaagggaactctcccaag

SEQ ID NO: 142928 - DNA, 75 bp, Artificial Sequence
  Synthetic
ccgcgggggagagaatagcaccggagagggagtgaacaacaaggggcgaggaacctcgaagggaactctcccaag

SEQ ID NO: 142929 - DNA, 75 bp, Artificial Sequence
  Synthetic
gagggagtgaacaacaaggggcgaggaacctcgaagggaactctcccaagaagcaaagagaatccaagaatcgga

SEQ ID NO: 142930 - DNA, 75 bp, Artificial Sequence
  Synthetic
agctttccccatgacgccggagacatctcggaaggggaaagacggaaggtggaaaagaaggggtgggctctccga

SEQ ID NO: 142931 - DNA, 75 bp, Artificial Sequence
  Synthetic
cgagagaaaactggctctcccttagccatccgagtggacgtgcgtcctccttcggatgcccaggtcggaccgcga

SEQ ID NO: 142932 - DNA, 75 bp, Artificial Sequence
  Synthetic
tctcggaaggggaaagacggaaggtggaaaagaaggggtgggctctccgatccgaggggcccaaccaccaagttt

SEQ ID NO: 142933 - DNA, 75 bp, Artificial Sequence
  Synthetic
ggagagcactccggcccaaatggttgagtagcattcagagggaggagtccacacggagttgggcagagaaatcac

SEQ ID NO: 142934 - DNA, 75 bp, Artificial Sequence
  Synthetic
acacggagttgggcagagaaatcacctccggaggaccccttcaacgaacagaagagctctgctcggaataggagt

SEQ ID NO: 142935 - DNA, 75 bp, Artificial Sequence
  Synthetic
ctagccgtcaggtgttccgccccccgagagggaaggagtgaggcttatcccggggaactcggcaatcgtccccgc

SEQ ID NO: 142936 - DNA, 75 bp, Artificial Sequence
  Synthetic
atggcagagaccgagtcccccttcaaaaaggaccggaggagggagctaggagcgtggggggggcggtggagccat

SEQ ID NO: 142937 - DNA, 75 bp, Artificial Sequence
  Synthetic
tttccttagctcgtcttcctcggtcaacctcttgagttcctcttcttcctccttgctgaggctcttccctcccgc

SEQ ID NO: 142938 - DNA, 75 bp, Artificial Sequence
  Synthetic
tttcctttgctcgtcttcctcggtcaacctcttgagttcctcttcttcctccttgctgaggctcttccctcccgc

SEQ ID NO: 142939 - DNA, 75 bp, Artificial Sequence
  Synthetic
tttccttcgctcgtcttcctcggtcaacctcttgagttcctcttcttcctccttgctgaggctcttccctcccgc

SEQ ID NO: 142940 - DNA, 75 bp, Artificial Sequence
  Synthetic
tttccttggctcgtcttcctcggtcaacctcttgagttcctcttcttcctccttgctgaggctcttccctcccgc

SEQ ID NO: 142941 - DNA, 75 bp, Artificial Sequence
  Synthetic
agcgtggggggggcggtggagccatgggatgcacctcccgattccgcccatccccacccccaagagggtcgccca

SEQ ID NO: 142942 - DNA, 75 bp, Artificial Sequence
  Synthetic
agcgtggggggggcggtggagccatgggatgctcctcccgattccgcccatccccacccccaagagggtcgccca

SEQ ID NO: 142943 - DNA, 75 bp, Artificial Sequence
  Synthetic
agcgtggggggggcggtggagccatgggatgcccctcccgattccgcccatccccacccccaagagggtcgccca

SEQ ID NO: 142944 - DNA, 75 bp, Artificial Sequence
  Synthetic
agcgtggggggggcggtggagccatgggatgcgcctcccgattccgcccatccccacccccaagagggtcgccca

SEQ ID NO: 142945 - DNA, 75 bp, Artificial Sequence
  Synthetic
aacctcttgagttcctcttcttcctccttgctgaggctcttccctcccgcgctgagctggttcttcttgttctcg

SEQ ID NO: 142946 - DNA, 75 bp, Artificial Sequence
  Synthetic
agggccttccttcgtcggtggtccttcctctccttgtcggtgaactctcccctggagcgcgtcttcccaggtccg

SEQ ID NO: 142947 - DNA, 75 bp, Artificial Sequence
  Synthetic
gagtctacctccatctggtctgtccgggccctcttcgccgggggagccccctccccatccttatccttctttccg

SEQ ID NO: 142948 - DNA, 75 bp, Artificial Sequence
  Synthetic
aggggtttgtgtcctcaagtttcttgatcttcttcttaaccttctggaggtctctctcgagttcctctaacttct

SEQ ID NO: 142949 - DNA, 75 bp, Artificial Sequence
  Synthetic
aggggtttgtgtcctcaagtttcttgatcttcttcttaaccttctggaggtctctctcgagttcctcttacttct

SEQ ID NO: 142950 - DNA, 75 bp, Artificial Sequence
  Synthetic
aggggtttgtgtcctcaagtttcttgatcttcttcttaaccttctggaggtctctctcgagttcctctcacttct

SEQ ID NO: 142951 - DNA, 75 bp, Artificial Sequence
  Synthetic
aggggtttgtgtcctcaagtttcttgatcttcttcttaaccttctggaggtctctctcgagttcctctgacttct

SEQ ID NO: 142952 - DNA, 75 bp, Artificial Sequence
  Synthetic
gatcttcttcttaaccttctggaggtctctctcgagttcctctaacttctttcttccattcacccactgctcgag

SEQ ID NO: 142953 - DNA, 75 bp, Artificial Sequence
  Synthetic
gatcttcttcttaaccttctggaggtctctctcgagttcctctaacttctttcttccattctcccactgctcgag

SEQ ID NO: 142954 - DNA, 75 bp, Artificial Sequence
  Synthetic
gatcttcttcttaaccttctggaggtctctctcgagttcctctaacttctttcttccattcccccactgctcgag

SEQ ID NO: 142955 - DNA, 75 bp, Artificial Sequence
  Synthetic
gatcttcttcttaaccttctggaggtctctctcgagttcctctaacttctttcttccattcgcccactgctcgag

SEQ ID NO: 142956 - DNA, 75 bp, Artificial Sequence
  Synthetic
gatcttcttcttaaccttctggaggtctctctcgagttcctcttacttctttcttccattcacccactgctcgag

SEQ ID NO: 142957 - DNA, 75 bp, Artificial Sequence
  Synthetic
gatcttcttcttaaccttctggaggtctctctcgagttcctcttacttctttcttccattctcccactgctcgag

SEQ ID NO: 142958 - DNA, 75 bp, Artificial Sequence
  Synthetic
gatcttcttcttaaccttctggaggtctctctcgagttcctcttacttctttcttccattcccccactgctcgag

SEQ ID NO: 142959 - DNA, 75 bp, Artificial Sequence
  Synthetic
gatcttcttcttaaccttctggaggtctctctcgagttcctcttacttctttcttccattcgcccactgctcgag

SEQ ID NO: 142960 - DNA, 75 bp, Artificial Sequence
  Synthetic
gatcttcttcttaaccttctggaggtctctctcgagttcctctcacttctttcttccattcacccactgctcgag

SEQ ID NO: 142961 - DNA, 75 bp, Artificial Sequence
  Synthetic
gatcttcttcttaaccttctggaggtctctctcgagttcctctcacttctttcttccattctcccactgctcgag

SEQ ID NO: 142962 - DNA, 75 bp, Artificial Sequence
  Synthetic
gatcttcttcttaaccttctggaggtctctctcgagttcctctcacttctttcttccattcccccactgctcgag

SEQ ID NO: 142963 - DNA, 75 bp, Artificial Sequence
  Synthetic
gatcttcttcttaaccttctggaggtctctctcgagttcctctcacttctttcttccattcgcccactgctcgag

SEQ ID NO: 142964 - DNA, 75 bp, Artificial Sequence
  Synthetic
gatcttcttcttaaccttctggaggtctctctcgagttcctctgacttctttcttccattcacccactgctcgag

SEQ ID NO: 142965 - DNA, 75 bp, Artificial Sequence
  Synthetic
gatcttcttcttaaccttctggaggtctctctcgagttcctctgacttctttcttccattctcccactgctcgag

SEQ ID NO: 142966 - DNA, 75 bp, Artificial Sequence
  Synthetic
gatcttcttcttaaccttctggaggtctctctcgagttcctctgacttctttcttccattcccccactgctcgag

SEQ ID NO: 142967 - DNA, 75 bp, Artificial Sequence
  Synthetic
gatcttcttcttaaccttctggaggtctctctcgagttcctctgacttctttcttccattcgcccactgctcgag

SEQ ID NO: 142968 - DNA, 75 bp, Artificial Sequence
  Synthetic
tgcccaggtcggaccgcgaggaggtggagatgccatgccgacccgaagaggaaagaagaacgcgagacgcgaacc

SEQ ID NO: 142969 - DNA, 75 bp, Artificial Sequence
  Synthetic
tgcccaggtcggaccgcgtggaggtggagatgccatgccgacccgaagaggaaagaagaacgcgagacgcgaacc

SEQ ID NO: 142970 - DNA, 75 bp, Artificial Sequence
  Synthetic
tgcccaggtcggaccgcgcggaggtggagatgccatgccgacccgaagaggaaagaagaacgcgagacgcgaacc

SEQ ID NO: 142971 - DNA, 75 bp, Artificial Sequence
  Synthetic
tgcccaggtcggaccgcggggaggtggagatgccatgccgacccgaagaggaaagaagaacgcgagacgcgaacc

SEQ ID NO: 142972 - DNA, 75 bp, Artificial Sequence
  Synthetic
gacctcctctctccccccgcggctcttcctcgactcggaccggctcatctcgacaagaggcgaagcggtcctcag

SEQ ID NO: 142973 - DNA, 75 bp, Artificial Sequence
  Synthetic
cgacaagaggcgaagcggtcctcagtgctcttactcttttctgtaaagaggagactgctggactcgacgcccaag

SEQ ID NO: 142974 - DNA, 75 bp, Artificial Sequence
  Synthetic
cgacaagaggcgaagcggtcctcagtgctcttactcttttctgtaaagaggagactgctggactcgtcgcccaag

SEQ ID NO: 142975 - DNA, 75 bp, Artificial Sequence
  Synthetic
cgacaagaggcgaagcggtcctcagtgctcttactcttttctgtaaagaggagactgctggactcgccgcccaag

SEQ ID NO: 142976 - DNA, 75 bp, Artificial Sequence
  Synthetic
cgacaagaggcgaagcggtcctcagtgctcttactcttttctgtaaagaggagactgctggactcggcgcccaag

SEQ ID NO: 142977 - DNA, 75 bp, Artificial Sequence
  Synthetic
aagggagggtcggatgggaagagtatatcctatgggaatccccgtccacccgtcacgtccagcccctccccgtgt

SEQ ID NO: 142978 - DNA, 75 bp, Artificial Sequence
  Synthetic
agtgggccacaagccggcggagagatcgaggatttggggaggagaggggaaccgaggggggttcgaactcaagaa

SEQ ID NO: 142979 - DNA, 75 bp, Artificial Sequence
  Synthetic
tcgaggatttggggaggagaggggaaccgaggggggttcgaactcaagaagagaagattttcgaggaaatactcc

SEQ ID NO: 142980 - DNA, 75 bp, Artificial Sequence
  Synthetic
accgaggggggttcgaactcaagaagagaagattttcgaggaaatactcccaagaagttcccggagggatccaag

SEQ ID NO: 142981 - DNA, 75 bp, Artificial Sequence
  Synthetic
agacggaagactttccccaattggttgggaaaagtcccggaaccaggaaatgggaaagagacggtagaaaagagc

SEQ ID NO: 142982 - DNA, 75 bp, Artificial Sequence
  Synthetic
agacggaagactttcccctattggttgggaaaagtcccggaaccaggaaatgggaaagagacggtagaaaagagc

SEQ ID NO: 142983 - DNA, 75 bp, Artificial Sequence
  Synthetic
agacggaagactttcccccattggttgggaaaagtcccggaaccaggaaatgggaaagagacggtagaaaagagc

SEQ ID NO: 142984 - DNA, 75 bp, Artificial Sequence
  Synthetic
agacggaagactttccccgattggttgggaaaagtcccggaaccaggaaatgggaaagagacggtagaaaagagc

SEQ ID NO: 142985 - DNA, 75 bp, Artificial Sequence
  Synthetic
agacggatgactttccccaattggttgggaaaagtcccggaaccaggaaatgggaaagagacggtagaaaagagc

SEQ ID NO: 142986 - DNA, 75 bp, Artificial Sequence
  Synthetic
agacggatgactttcccctattggttgggaaaagtcccggaaccaggaaatgggaaagagacggtagaaaagagc

SEQ ID NO: 142987 - DNA, 75 bp, Artificial Sequence
  Synthetic
agacggatgactttcccccattggttgggaaaagtcccggaaccaggaaatgggaaagagacggtagaaaagagc

SEQ ID NO: 142988 - DNA, 75 bp, Artificial Sequence
  Synthetic
agacggatgactttccccgattggttgggaaaagtcccggaaccaggaaatgggaaagagacggtagaaaagagc

SEQ ID NO: 142989 - DNA, 75 bp, Artificial Sequence
  Synthetic
agacggacgactttccccaattggttgggaaaagtcccggaaccaggaaatgggaaagagacggtagaaaagagc

SEQ ID NO: 142990 - DNA, 75 bp, Artificial Sequence
  Synthetic
agacggacgactttcccctattggttgggaaaagtcccggaaccaggaaatgggaaagagacggtagaaaagagc

SEQ ID NO: 142991 - DNA, 75 bp, Artificial Sequence
  Synthetic
agacggacgactttcccccattggttgggaaaagtcccggaaccaggaaatgggaaagagacggtagaaaagagc

SEQ ID NO: 142992 - DNA, 75 bp, Artificial Sequence
  Synthetic
agacggacgactttccccgattggttgggaaaagtcccggaaccaggaaatgggaaagagacggtagaaaagagc

SEQ ID NO: 142993 - DNA, 75 bp, Artificial Sequence
  Synthetic
agacggaggactttccccaattggttgggaaaagtcccggaaccaggaaatgggaaagagacggtagaaaagagc

SEQ ID NO: 142994 - DNA, 75 bp, Artificial Sequence
  Synthetic
agacggaggactttcccctattggttgggaaaagtcccggaaccaggaaatgggaaagagacggtagaaaagagc

SEQ ID NO: 142995 - DNA, 75 bp, Artificial Sequence
  Synthetic
agacggaggactttcccccattggttgggaaaagtcccggaaccaggaaatgggaaagagacggtagaaaagagc

SEQ ID NO: 142996 - DNA, 75 bp, Artificial Sequence
  Synthetic
agacggaggactttccccgattggttgggaaaagtcccggaaccaggaaatgggaaagagacggtagaaaagagc

SEQ ID NO: 142997 - DNA, 75 bp, Artificial Sequence
  Synthetic
tgggaaaagtcccggaaccaggaaatgggaaagagacggtagaaaagagcgagcctcccagttttcgagtagtcc

SEQ ID NO: 142998 - DNA, 75 bp, Artificial Sequence
  Synthetic
cggacctatctaaattggagtcatccgaccgtatggagaaaatttccgacaagaggtgatccactgagggtttgc

SEQ ID NO: 142999 - DNA, 75 bp, Artificial Sequence
  Synthetic
cgaccgtatggagaaaatttccgacaagaggtgatccactgagggtttgcggaaaaatcacctccagaggacccc

SEQ ID NO: 143000 - DNA, 75 bp, Artificial Sequence
  Synthetic
ttcagcgaacggaagagactggaagccccagaggaagaccatagccatggggagagatgctaggagtggggggcg

SEQ ID NO: 143001 - DNA, 75 bp, Artificial Sequence
  Synthetic
tcttcgccgggggtgccccctctccatccttatccttctttccgagaattcctttgatgttccccagccagggat

SEQ ID NO: 143002 - DNA, 75 bp, Artificial Sequence
  Synthetic
gagcaacggggctagcgagtggatgttccgcctccccggggagccgagtgaggcttatcccggagtgccgggcaa

SEQ ID NO: 143003 - DNA, 75 bp, Artificial Sequence
  Synthetic
tcgagctcctccgctttcttccttgcgctcacccactgctcaaggatgatttcccttcccccgcgactcttcttc

SEQ ID NO: 143004 - DNA, 75 bp, Artificial Sequence
  Synthetic
tcgagctcctccgctttcttccttgcgctcacccactgctcaaggatgttttcccttcccccgcgactcttcttc

SEQ ID NO: 143005 - DNA, 75 bp, Artificial Sequence
  Synthetic
tcgagctcctccgctttcttccttgcgctcacccactgctcaaggatgctttcccttcccccgcgactcttcttc

SEQ ID NO: 143006 - DNA, 75 bp, Artificial Sequence
  Synthetic
tcgagctcctccgctttcttccttgcgctcacccactgctcaaggatggtttcccttcccccgcgactcttcttc

SEQ ID NO: 143007 - DNA, 75 bp, Artificial Sequence
  Synthetic
gtccccccatgcccgttccacggctcccttccagaagggcgggggtggcctggagcgtcgggccccagcagtccg

SEQ ID NO: 143008 - DNA, 75 bp, Artificial Sequence
  Synthetic
cgctcacccactgctcaaggatgatttcccttcccccgcgactcttcttcgactcggaccggctcatttcggcta

SEQ ID NO: 143009 - DNA, 75 bp, Artificial Sequence
  Synthetic
cgctcacccactgctcaaggatgttttcccttcccccgcgactcttcttcgactcggaccggctcatttcggcta

SEQ ID NO: 143010 - DNA, 75 bp, Artificial Sequence
  Synthetic
cgctcacccactgctcaaggatgctttcccttcccccgcgactcttcttcgactcggaccggctcatttcggcta

SEQ ID NO: 143011 - DNA, 75 bp, Artificial Sequence
  Synthetic
cgctcacccactgctcaaggatggtttcccttcccccgcgactcttcttcgactcggaccggctcatttcggcta

SEQ ID NO: 143012 - DNA, 75 bp, Artificial Sequence
  Synthetic
tggaattcaccctcttaccgcttctccacactccttcccccctgcgggctccccccataagatgacgaggacccc

SEQ ID NO: 143013 - DNA, 75 bp, Artificial Sequence
  Synthetic
gaggcggcagtcctcagtactcttactcttttctgttaaagaggagactgctggactcgccgcccaagcccgaac

SEQ ID NO: 143014 - DNA, 75 bp, Artificial Sequence
  Synthetic
ccccccataagatgacgaggaccccactcatcggggtccgcagtctcatcctttcttacctgatggccggcatgg

SEQ ID NO: 143015 - DNA, 75 bp, Artificial Sequence
  Synthetic
aacgcgggggaaggatcatatgacgagaggggatgagctggtaaagaggggtggaacgtcgggtggaagcactcc

SEQ ID NO: 143016 - DNA, 75 bp, Artificial Sequence
  Synthetic
aggggccaaaatgccgaacgaagggaacgcgggggaaggatcatatgacgagaggggatgagctggtaaagaggg

SEQ ID NO: 143017 - DNA, 75 bp, Artificial Sequence
  Synthetic
tcccagcctcctcgctggcgccggctgggcaacattccgaggggaccgtccctcggaaatggcgaatgggaccca

SEQ ID NO: 143018 - DNA, 75 bp, Artificial Sequence
  Synthetic
tcccagcctcctcgctggcgccggctgggcaacattccgaggggaccgtccctcggtaatggcgaatgggaccca

SEQ ID NO: 143019 - DNA, 75 bp, Artificial Sequence
  Synthetic
tcccagcctcctcgctggcgccggctgggcaacattccgaggggaccgtccctcggcaatggcgaatgggaccca

SEQ ID NO: 143020 - DNA, 75 bp, Artificial Sequence
  Synthetic
tcccagcctcctcgctggcgccggctgggcaacattccgaggggaccgtccctcgggaatggcgaatgggaccca

SEQ ID NO: 143021 - DNA, 75 bp, Artificial Sequence
  Synthetic
tgggcaacattccgaggggaccgtccctcggaaatggcgaatgggacccagaactctctcagaatctagggagat

SEQ ID NO: 143022 - DNA, 75 bp, Artificial Sequence
  Synthetic
tgggcaacattccgaggggaccgtccctcggtaatggcgaatgggacccagaactctctcagaatctagggagat

SEQ ID NO: 143023 - DNA, 75 bp, Artificial Sequence
  Synthetic
tgggcaacattccgaggggaccgtccctcggcaatggcgaatgggacccagaactctctcagaatctagggagat

SEQ ID NO: 143024 - DNA, 75 bp, Artificial Sequence
  Synthetic
tgggcaacattccgaggggaccgtccctcgggaatggcgaatgggacccagaactctctcagaatctagggagat

SEQ ID NO: 143025 - DNA, 75 bp, Artificial Sequence
  Synthetic
atcggacgatttccccatgacgctggagacatcctggaaggggaaagaggagggtggaagaaaaaggggtgggcc

SEQ ID NO: 143026 - DNA, 75 bp, Artificial Sequence
  Synthetic
gagacatcctggaaggggaaagaggagggtggaagaaaaaggggtgggcccccccgatccgaggggcccgactgc

SEQ ID NO: 143027 - DNA, 75 bp, Artificial Sequence
  Synthetic
agaggggatgagctggtaaagaggggtggaacgtcgggtggaagcactcccaagaagagcagagagaaggcaaga

SEQ ID NO: 143028 - DNA, 75 bp, Artificial Sequence
  Synthetic
aacctcgttctttattggggagtacactcgaggagtggaaggcggggagggcggggaggagtgttacccaacggg

SEQ ID NO: 143029 - DNA, 75 bp, Artificial Sequence
  Synthetic
aacctcgttctttattggggagtacactcgaggagtggaaggcggggagggcggggaggagtgttaccctacggg

SEQ ID NO: 143030 - DNA, 75 bp, Artificial Sequence
  Synthetic
aacctcgttctttattggggagtacactcgaggagtggaaggcggggagggcggggaggagtgttaccccacggg

SEQ ID NO: 143031 - DNA, 75 bp, Artificial Sequence
  Synthetic
aacctcgttctttattggggagtacactcgaggagtggaaggcggggagggcggggaggagtgttacccgacggg

SEQ ID NO: 143032 - DNA, 75 bp, Artificial Sequence
  Synthetic
aggagtaagaccatagcgatagggagagatgctaggagttagaggagaccgaagcgaggaggaaagcaaagaaag

SEQ ID NO: 143033 - DNA, 75 bp, Artificial Sequence
  Synthetic
gagatgctaggagttagaggagaccgaagcgaggaggaaagcaaagaaagcaacggggctagccgtcaggtgttc

SEQ ID NO: 143034 - DNA, 75 bp, Artificial Sequence
  Synthetic
actcgaggagtggaaggcggggagggcggggaggagtgttacccaacgggaactgctgagtgcccctgacgtcca

SEQ ID NO: 143035 - DNA, 75 bp, Artificial Sequence
  Synthetic
actcgaggagtggaaggcggggagggcggggaggagtgttaccctacgggaactgctgagtgcccctgacgtcca

SEQ ID NO: 143036 - DNA, 75 bp, Artificial Sequence
  Synthetic
actcgaggagtggaaggcggggagggcggggaggagtgttaccccacgggaactgctgagtgcccctgacgtcca

SEQ ID NO: 143037 - DNA, 75 bp, Artificial Sequence
  Synthetic
actcgaggagtggaaggcggggagggcggggaggagtgttacccgacgggaactgctgagtgcccctgacgtcca

SEQ ID NO: 143038 - DNA, 75 bp, Artificial Sequence
  Synthetic
gggacgaagccccctccgggcgctcccctcggatctccgccgggtgggttcacatccccaacccgcgggccggct

SEQ ID NO: 143039 - DNA, 75 bp, Artificial Sequence
  Synthetic
cccccttctaaaatgaccgagagggggtgctaggaacacgggggcccagtggagccatgggatgctcctcccgat

SEQ ID NO: 143040 - DNA, 75 bp, Artificial Sequence
  Synthetic
gttcttcttttcctttgctcgtcttccccggtcagcctcccgagttcctcttcttcttccctgctgaggttcttc

SEQ ID NO: 143041 - DNA, 75 bp, Artificial Sequence
  Synthetic
tccgtccaaccccttcccccgagggtcgcccaggaatggcgggacccactcgactggggtccgcgttccatcctt

SEQ ID NO: 143042 - DNA, 75 bp, Artificial Sequence
  Synthetic
aaacccgacttgtgcggctttcccctaggtccggaatcgacctccatttgatccgtccgggccttcttcgttggg

SEQ ID NO: 143043 - DNA, 75 bp, Artificial Sequence
  Synthetic
taggtccggaatcgacctccatttgatccgtccgggccttcttcgttgggggtgctccctccccgtcctttccct

SEQ ID NO: 143044 - DNA, 75 bp, Artificial Sequence
  Synthetic
ttcttatgattccgatgatattccccaaccagggattgtcatcctcgagtttcttgaggcccttctgggtcttcc

SEQ ID NO: 143045 - DNA, 75 bp, Artificial Sequence
  Synthetic
caaccagggattgtcatcctcgagtttcttgaggcccttctgggtcttccggagcttcctttcgagatcctctcg

SEQ ID NO: 143046 - DNA, 75 bp, Artificial Sequence
  Synthetic
tttattcactggggtcgacagctctggggagaaaagggaggatcggatgggaagagtatatcccatgggaatccc

SEQ ID NO: 143047 - DNA, 75 bp, Artificial Sequence
  Synthetic
attttttcttagttccacccacttctcgaggatctcttccctcccacctcgttttctcttctgctcggcggggcc

SEQ ID NO: 143048 - DNA, 75 bp, Artificial Sequence
  Synthetic
ggggcggcgtcctcagtactctcttactttctcaagaaaagaggagactgctggtcgcccgcccccgtgttcgag

SEQ ID NO: 143049 - DNA, 75 bp, Artificial Sequence
  Synthetic
atgggcctcgagccgacgaagagccggagagggaggggtcggggaacccgaggaggaaaccaagcaaagaagggg

SEQ ID NO: 143050 - DNA, 75 bp, Artificial Sequence
  Synthetic
atgggcctcgagccgacgaagagccggagagggaggggtcggggaacccgaggaggtaaccaagcaaagaagggg

SEQ ID NO: 143051 - DNA, 75 bp, Artificial Sequence
  Synthetic
atgggcctcgagccgacgaagagccggagagggaggggtcggggaacccgaggaggcaaccaagcaaagaagggg

SEQ ID NO: 143052 - DNA, 75 bp, Artificial Sequence
  Synthetic
atgggcctcgagccgacgaagagccggagagggaggggtcggggaacccgaggagggaaccaagcaaagaagggg

SEQ ID NO: 143053 - DNA, 75 bp, Artificial Sequence
  Synthetic
atgggcctcgagccgacgaagagccggagagggaggggtcggggatcccgaggaggaaaccaagcaaagaagggg

SEQ ID NO: 143054 - DNA, 75 bp, Artificial Sequence
  Synthetic
atgggcctcgagccgacgaagagccggagagggaggggtcggggatcccgaggaggtaaccaagcaaagaagggg

SEQ ID NO: 143055 - DNA, 75 bp, Artificial Sequence
  Synthetic
atgggcctcgagccgacgaagagccggagagggaggggtcggggatcccgaggaggcaaccaagcaaagaagggg

SEQ ID NO: 143056 - DNA, 75 bp, Artificial Sequence
  Synthetic
atgggcctcgagccgacgaagagccggagagggaggggtcggggatcccgaggagggaaccaagcaaagaagggg

SEQ ID NO: 143057 - DNA, 75 bp, Artificial Sequence
  Synthetic
atgggcctcgagccgacgaagagccggagagggaggggtcggggaccccgaggaggaaaccaagcaaagaagggg

SEQ ID NO: 143058 - DNA, 75 bp, Artificial Sequence
  Synthetic
atgggcctcgagccgacgaagagccggagagggaggggtcggggaccccgaggaggtaaccaagcaaagaagggg

SEQ ID NO: 143059 - DNA, 75 bp, Artificial Sequence
  Synthetic
atgggcctcgagccgacgaagagccggagagggaggggtcggggaccccgaggaggcaaccaagcaaagaagggg

SEQ ID NO: 143060 - DNA, 75 bp, Artificial Sequence
  Synthetic
atgggcctcgagccgacgaagagccggagagggaggggtcggggaccccgaggagggaaccaagcaaagaagggg

SEQ ID NO: 143061 - DNA, 75 bp, Artificial Sequence
  Synthetic
atgggcctcgagccgacgaagagccggagagggaggggtcggggagcccgaggaggaaaccaagcaaagaagggg

SEQ ID NO: 143062 - DNA, 75 bp, Artificial Sequence
  Synthetic
atgggcctcgagccgacgaagagccggagagggaggggtcggggagcccgaggaggtaaccaagcaaagaagggg

SEQ ID NO: 143063 - DNA, 75 bp, Artificial Sequence
  Synthetic
atgggcctcgagccgacgaagagccggagagggaggggtcggggagcccgaggaggcaaccaagcaaagaagggg

SEQ ID NO: 143064 - DNA, 75 bp, Artificial Sequence
  Synthetic
atgggcctcgagccgacgaagagccggagagggaggggtcggggagcccgaggagggaaccaagcaaagaagggg

SEQ ID NO: 143065 - DNA, 75 bp, Artificial Sequence
  Synthetic
ggagagggaggggtcggggaacccgaggaggaaaccaagcaaagaaggggagactcccgaggaaagctatctcct

SEQ ID NO: 143066 - DNA, 75 bp, Artificial Sequence
  Synthetic
ggagagggaggggtcggggaacccgaggaggaaaccaagcaaagaaggggagactcccgaggtaagctatctcct

SEQ ID NO: 143067 - DNA, 75 bp, Artificial Sequence
  Synthetic
ggagagggaggggtcggggaacccgaggaggaaaccaagcaaagaaggggagactcccgaggcaagctatctcct

SEQ ID NO: 143068 - DNA, 75 bp, Artificial Sequence
  Synthetic
ggagagggaggggtcggggaacccgaggaggaaaccaagcaaagaaggggagactcccgagggaagctatctcct

SEQ ID NO: 143069 - DNA, 75 bp, Artificial Sequence
  Synthetic
ggagagggaggggtcggggaacccgaggaggtaaccaagcaaagaaggggagactcccgaggaaagctatctcct

SEQ ID NO: 143070 - DNA, 75 bp, Artificial Sequence
  Synthetic
ggagagggaggggtcggggaacccgaggaggtaaccaagcaaagaaggggagactcccgaggtaagctatctcct

SEQ ID NO: 143071 - DNA, 75 bp, Artificial Sequence
  Synthetic
ggagagggaggggtcggggaacccgaggaggtaaccaagcaaagaaggggagactcccgaggcaagctatctcct

SEQ ID NO: 143072 - DNA, 75 bp, Artificial Sequence
  Synthetic
ggagagggaggggtcggggaacccgaggaggtaaccaagcaaagaaggggagactcccgagggaagctatctcct

SEQ ID NO: 143073 - DNA, 75 bp, Artificial Sequence
  Synthetic
ggagagggaggggtcggggaacccgaggaggcaaccaagcaaagaaggggagactcccgaggaaagctatctcct

SEQ ID NO: 143074 - DNA, 75 bp, Artificial Sequence
  Synthetic
ggagagggaggggtcggggaacccgaggaggcaaccaagcaaagaaggggagactcccgaggtaagctatctcct

SEQ ID NO: 143075 - DNA, 75 bp, Artificial Sequence
  Synthetic
ggagagggaggggtcggggaacccgaggaggcaaccaagcaaagaaggggagactcccgaggcaagctatctcct

SEQ ID NO: 143076 - DNA, 75 bp, Artificial Sequence
  Synthetic
ggagagggaggggtcggggaacccgaggaggcaaccaagcaaagaaggggagactcccgagggaagctatctcct

SEQ ID NO: 143077 - DNA, 75 bp, Artificial Sequence
  Synthetic
ggagagggaggggtcggggaacccgaggagggaaccaagcaaagaaggggagactcccgaggaaagctatctcct

SEQ ID NO: 143078 - DNA, 75 bp, Artificial Sequence
  Synthetic
ggagagggaggggtcggggaacccgaggagggaaccaagcaaagaaggggagactcccgaggtaagctatctcct

SEQ ID NO: 143079 - DNA, 75 bp, Artificial Sequence
  Synthetic
ggagagggaggggtcggggaacccgaggagggaaccaagcaaagaaggggagactcccgaggcaagctatctcct

SEQ ID NO: 143080 - DNA, 75 bp, Artificial Sequence
  Synthetic
ggagagggaggggtcggggaacccgaggagggaaccaagcaaagaaggggagactcccgagggaagctatctcct

SEQ ID NO: 143081 - DNA, 75 bp, Artificial Sequence
  Synthetic
ggagagggaggggtcggggatcccgaggaggaaaccaagcaaagaaggggagactcccgaggaaagctatctcct

SEQ ID NO: 143082 - DNA, 75 bp, Artificial Sequence
  Synthetic
ggagagggaggggtcggggatcccgaggaggaaaccaagcaaagaaggggagactcccgaggtaagctatctcct

SEQ ID NO: 143083 - DNA, 75 bp, Artificial Sequence
  Synthetic
ggagagggaggggtcggggatcccgaggaggaaaccaagcaaagaaggggagactcccgaggcaagctatctcct

SEQ ID NO: 143084 - DNA, 75 bp, Artificial Sequence
  Synthetic
ggagagggaggggtcggggatcccgaggaggaaaccaagcaaagaaggggagactcccgagggaagctatctcct

SEQ ID NO: 143085 - DNA, 75 bp, Artificial Sequence
  Synthetic
ggagagggaggggtcggggatcccgaggaggtaaccaagcaaagaaggggagactcccgaggaaagctatctcct

SEQ ID NO: 143086 - DNA, 75 bp, Artificial Sequence
  Synthetic
ggagagggaggggtcggggatcccgaggaggtaaccaagcaaagaaggggagactcccgaggtaagctatctcct

SEQ ID NO: 143087 - DNA, 75 bp, Artificial Sequence
  Synthetic
ggagagggaggggtcggggatcccgaggaggtaaccaagcaaagaaggggagactcccgaggcaagctatctcct

SEQ ID NO: 143088 - DNA, 75 bp, Artificial Sequence
  Synthetic
ggagagggaggggtcggggatcccgaggaggtaaccaagcaaagaaggggagactcccgagggaagctatctcct

SEQ ID NO: 143089 - DNA, 75 bp, Artificial Sequence
  Synthetic
ggagagggaggggtcggggatcccgaggaggcaaccaagcaaagaaggggagactcccgaggaaagctatctcct

SEQ ID NO: 143090 - DNA, 75 bp, Artificial Sequence
  Synthetic
ggagagggaggggtcggggatcccgaggaggcaaccaagcaaagaaggggagactcccgaggtaagctatctcct

SEQ ID NO: 143091 - DNA, 75 bp, Artificial Sequence
  Synthetic
ggagagggaggggtcggggatcccgaggaggcaaccaagcaaagaaggggagactcccgaggcaagctatctcct

SEQ ID NO: 143092 - DNA, 75 bp, Artificial Sequence
  Synthetic
ggagagggaggggtcggggatcccgaggaggcaaccaagcaaagaaggggagactcccgagggaagctatctcct

SEQ ID NO: 143093 - DNA, 75 bp, Artificial Sequence
  Synthetic
ggagagggaggggtcggggatcccgaggagggaaccaagcaaagaaggggagactcccgaggaaagctatctcct

SEQ ID NO: 143094 - DNA, 75 bp, Artificial Sequence
  Synthetic
ggagagggaggggtcggggatcccgaggagggaaccaagcaaagaaggggagactcccgaggtaagctatctcct

SEQ ID NO: 143095 - DNA, 75 bp, Artificial Sequence
  Synthetic
ggagagggaggggtcggggatcccgaggagggaaccaagcaaagaaggggagactcccgaggcaagctatctcct

SEQ ID NO: 143096 - DNA, 75 bp, Artificial Sequence
  Synthetic
ggagagggaggggtcggggatcccgaggagggaaccaagcaaagaaggggagactcccgagggaagctatctcct

SEQ ID NO: 143097 - DNA, 75 bp, Artificial Sequence
  Synthetic
ggagagggaggggtcggggaccccgaggaggaaaccaagcaaagaaggggagactcccgaggaaagctatctcct

SEQ ID NO: 143098 - DNA, 75 bp, Artificial Sequence
  Synthetic
ggagagggaggggtcggggaccccgaggaggaaaccaagcaaagaaggggagactcccgaggtaagctatctcct

SEQ ID NO: 143099 - DNA, 75 bp, Artificial Sequence
  Synthetic
ggagagggaggggtcggggaccccgaggaggaaaccaagcaaagaaggggagactcccgaggcaagctatctcct

SEQ ID NO: 143100 - DNA, 75 bp, Artificial Sequence
  Synthetic
ggagagggaggggtcggggaccccgaggaggaaaccaagcaaagaaggggagactcccgagggaagctatctcct

SEQ ID NO: 143101 - DNA, 75 bp, Artificial Sequence
  Synthetic
ggagagggaggggtcggggaccccgaggaggtaaccaagcaaagaaggggagactcccgaggaaagctatctcct

SEQ ID NO: 143102 - DNA, 75 bp, Artificial Sequence
  Synthetic
ggagagggaggggtcggggaccccgaggaggtaaccaagcaaagaaggggagactcccgaggtaagctatctcct

SEQ ID NO: 143103 - DNA, 75 bp, Artificial Sequence
  Synthetic
ggagagggaggggtcggggaccccgaggaggtaaccaagcaaagaaggggagactcccgaggcaagctatctcct

SEQ ID NO: 143104 - DNA, 75 bp, Artificial Sequence
  Synthetic
ggagagggaggggtcggggaccccgaggaggtaaccaagcaaagaaggggagactcccgagggaagctatctcct

SEQ ID NO: 143105 - DNA, 75 bp, Artificial Sequence
  Synthetic
ggagagggaggggtcggggaccccgaggaggcaaccaagcaaagaaggggagactcccgaggaaagctatctcct

SEQ ID NO: 143106 - DNA, 75 bp, Artificial Sequence
  Synthetic
ggagagggaggggtcggggaccccgaggaggcaaccaagcaaagaaggggagactcccgaggtaagctatctcct

SEQ ID NO: 143107 - DNA, 75 bp, Artificial Sequence
  Synthetic
ggagagggaggggtcggggaccccgaggaggcaaccaagcaaagaaggggagactcccgaggcaagctatctcct

SEQ ID NO: 143108 - DNA, 75 bp, Artificial Sequence
  Synthetic
ggagagggaggggtcggggaccccgaggaggcaaccaagcaaagaaggggagactcccgagggaagctatctcct

SEQ ID NO: 143109 - DNA, 75 bp, Artificial Sequence
  Synthetic
ggagagggaggggtcggggaccccgaggagggaaccaagcaaagaaggggagactcccgaggaaagctatctcct

SEQ ID NO: 143110 - DNA, 75 bp, Artificial Sequence
  Synthetic
ggagagggaggggtcggggaccccgaggagggaaccaagcaaagaaggggagactcccgaggtaagctatctcct

SEQ ID NO: 143111 - DNA, 75 bp, Artificial Sequence
  Synthetic
ggagagggaggggtcggggaccccgaggagggaaccaagcaaagaaggggagactcccgaggcaagctatctcct

SEQ ID NO: 143112 - DNA, 75 bp, Artificial Sequence
  Synthetic
ggagagggaggggtcggggaccccgaggagggaaccaagcaaagaaggggagactcccgagggaagctatctcct

SEQ ID NO: 143113 - DNA, 75 bp, Artificial Sequence
  Synthetic
ggagagggaggggtcggggagcccgaggaggaaaccaagcaaagaaggggagactcccgaggaaagctatctcct

SEQ ID NO: 143114 - DNA, 75 bp, Artificial Sequence
  Synthetic
ggagagggaggggtcggggagcccgaggaggaaaccaagcaaagaaggggagactcccgaggtaagctatctcct

SEQ ID NO: 143115 - DNA, 75 bp, Artificial Sequence
  Synthetic
ggagagggaggggtcggggagcccgaggaggaaaccaagcaaagaaggggagactcccgaggcaagctatctcct

SEQ ID NO: 143116 - DNA, 75 bp, Artificial Sequence
  Synthetic
ggagagggaggggtcggggagcccgaggaggaaaccaagcaaagaaggggagactcccgagggaagctatctcct

SEQ ID NO: 143117 - DNA, 75 bp, Artificial Sequence
  Synthetic
ggagagggaggggtcggggagcccgaggaggtaaccaagcaaagaaggggagactcccgaggaaagctatctcct

SEQ ID NO: 143118 - DNA, 75 bp, Artificial Sequence
  Synthetic
ggagagggaggggtcggggagcccgaggaggtaaccaagcaaagaaggggagactcccgaggtaagctatctcct

SEQ ID NO: 143119 - DNA, 75 bp, Artificial Sequence
  Synthetic
ggagagggaggggtcggggagcccgaggaggtaaccaagcaaagaaggggagactcccgaggcaagctatctcct

SEQ ID NO: 143120 - DNA, 75 bp, Artificial Sequence
  Synthetic
ggagagggaggggtcggggagcccgaggaggtaaccaagcaaagaaggggagactcccgagggaagctatctcct

SEQ ID NO: 143121 - DNA, 75 bp, Artificial Sequence
  Synthetic
ggagagggaggggtcggggagcccgaggaggcaaccaagcaaagaaggggagactcccgaggaaagctatctcct

SEQ ID NO: 143122 - DNA, 75 bp, Artificial Sequence
  Synthetic
ggagagggaggggtcggggagcccgaggaggcaaccaagcaaagaaggggagactcccgaggtaagctatctcct

SEQ ID NO: 143123 - DNA, 75 bp, Artificial Sequence
  Synthetic
ggagagggaggggtcggggagcccgaggaggcaaccaagcaaagaaggggagactcccgaggcaagctatctcct

SEQ ID NO: 143124 - DNA, 75 bp, Artificial Sequence
  Synthetic
ggagagggaggggtcggggagcccgaggaggcaaccaagcaaagaaggggagactcccgagggaagctatctcct

SEQ ID NO: 143125 - DNA, 75 bp, Artificial Sequence
  Synthetic
ggagagggaggggtcggggagcccgaggagggaaccaagcaaagaaggggagactcccgaggaaagctatctcct

SEQ ID NO: 143126 - DNA, 75 bp, Artificial Sequence
  Synthetic
ggagagggaggggtcggggagcccgaggagggaaccaagcaaagaaggggagactcccgaggtaagctatctcct

SEQ ID NO: 143127 - DNA, 75 bp, Artificial Sequence
  Synthetic
ggagagggaggggtcggggagcccgaggagggaaccaagcaaagaaggggagactcccgaggcaagctatctcct

SEQ ID NO: 143128 - DNA, 75 bp, Artificial Sequence
  Synthetic
ggagagggaggggtcggggagcccgaggagggaaccaagcaaagaaggggagactcccgagggaagctatctcct

SEQ ID NO: 143129 - DNA, 75 bp, Artificial Sequence
  Synthetic
aggaggaaaccaagcaaagaaggggagactcccgaggaaagatatctcctaagaagagtcgagaaaattctcaag

SEQ ID NO: 143130 - DNA, 75 bp, Artificial Sequence
  Synthetic
aggaggaaaccaagcaaagaaggggagactcccgaggaaagttatctcctaagaagagtcgagaaaattctcaag

SEQ ID NO: 143131 - DNA, 75 bp, Artificial Sequence
  Synthetic
aggaggaaaccaagcaaagaaggggagactcccgaggaaagctatctcctaagaagagtcgagaaaattctcaag

SEQ ID NO: 143132 - DNA, 75 bp, Artificial Sequence
  Synthetic
aggaggaaaccaagcaaagaaggggagactcccgaggaaaggtatctcctaagaagagtcgagaaaattctcaag

SEQ ID NO: 143133 - DNA, 75 bp, Artificial Sequence
  Synthetic
aggaggaaaccaagcaaagaaggggagactcccgaggtaagatatctcctaagaagagtcgagaaaattctcaag

SEQ ID NO: 143134 - DNA, 75 bp, Artificial Sequence
  Synthetic
aggaggaaaccaagcaaagaaggggagactcccgaggtaagttatctcctaagaagagtcgagaaaattctcaag

SEQ ID NO: 143135 - DNA, 75 bp, Artificial Sequence
  Synthetic
aggaggaaaccaagcaaagaaggggagactcccgaggtaagctatctcctaagaagagtcgagaaaattctcaag

SEQ ID NO: 143136 - DNA, 75 bp, Artificial Sequence
  Synthetic
aggaggaaaccaagcaaagaaggggagactcccgaggtaaggtatctcctaagaagagtcgagaaaattctcaag

SEQ ID NO: 143137 - DNA, 75 bp, Artificial Sequence
  Synthetic
aggaggaaaccaagcaaagaaggggagactcccgaggcaagatatctcctaagaagagtcgagaaaattctcaag

SEQ ID NO: 143138 - DNA, 75 bp, Artificial Sequence
  Synthetic
aggaggaaaccaagcaaagaaggggagactcccgaggcaagttatctcctaagaagagtcgagaaaattctcaag

SEQ ID NO: 143139 - DNA, 75 bp, Artificial Sequence
  Synthetic
aggaggaaaccaagcaaagaaggggagactcccgaggcaagctatctcctaagaagagtcgagaaaattctcaag

SEQ ID NO: 143140 - DNA, 75 bp, Artificial Sequence
  Synthetic
aggaggaaaccaagcaaagaaggggagactcccgaggcaaggtatctcctaagaagagtcgagaaaattctcaag

SEQ ID NO: 143141 - DNA, 75 bp, Artificial Sequence
  Synthetic
aggaggaaaccaagcaaagaaggggagactcccgagggaagatatctcctaagaagagtcgagaaaattctcaag

SEQ ID NO: 143142 - DNA, 75 bp, Artificial Sequence
  Synthetic
aggaggaaaccaagcaaagaaggggagactcccgagggaagttatctcctaagaagagtcgagaaaattctcaag

SEQ ID NO: 143143 - DNA, 75 bp, Artificial Sequence
  Synthetic
aggaggaaaccaagcaaagaaggggagactcccgagggaagctatctcctaagaagagtcgagaaaattctcaag

SEQ ID NO: 143144 - DNA, 75 bp, Artificial Sequence
  Synthetic
aggaggaaaccaagcaaagaaggggagactcccgagggaaggtatctcctaagaagagtcgagaaaattctcaag

SEQ ID NO: 143145 - DNA, 75 bp, Artificial Sequence
  Synthetic
aggaggtaaccaagcaaagaaggggagactcccgaggaaagatatctcctaagaagagtcgagaaaattctcaag

SEQ ID NO: 143146 - DNA, 75 bp, Artificial Sequence
  Synthetic
aggaggtaaccaagcaaagaaggggagactcccgaggaaagttatctcctaagaagagtcgagaaaattctcaag

SEQ ID NO: 143147 - DNA, 75 bp, Artificial Sequence
  Synthetic
aggaggtaaccaagcaaagaaggggagactcccgaggaaagctatctcctaagaagagtcgagaaaattctcaag

SEQ ID NO: 143148 - DNA, 75 bp, Artificial Sequence
  Synthetic
aggaggtaaccaagcaaagaaggggagactcccgaggaaaggtatctcctaagaagagtcgagaaaattctcaag

SEQ ID NO: 143149 - DNA, 75 bp, Artificial Sequence
  Synthetic
aggaggtaaccaagcaaagaaggggagactcccgaggtaagatatctcctaagaagagtcgagaaaattctcaag

SEQ ID NO: 143150 - DNA, 75 bp, Artificial Sequence
  Synthetic
aggaggtaaccaagcaaagaaggggagactcccgaggtaagttatctcctaagaagagtcgagaaaattctcaag

SEQ ID NO: 143151 - DNA, 75 bp, Artificial Sequence
  Synthetic
aggaggtaaccaagcaaagaaggggagactcccgaggtaagctatctcctaagaagagtcgagaaaattctcaag

SEQ ID NO: 143152 - DNA, 75 bp, Artificial Sequence
  Synthetic
aggaggtaaccaagcaaagaaggggagactcccgaggtaaggtatctcctaagaagagtcgagaaaattctcaag

SEQ ID NO: 143153 - DNA, 75 bp, Artificial Sequence
  Synthetic
aggaggtaaccaagcaaagaaggggagactcccgaggcaagatatctcctaagaagagtcgagaaaattctcaag

SEQ ID NO: 143154 - DNA, 75 bp, Artificial Sequence
  Synthetic
aggaggtaaccaagcaaagaaggggagactcccgaggcaagttatctcctaagaagagtcgagaaaattctcaag

SEQ ID NO: 143155 - DNA, 75 bp, Artificial Sequence
  Synthetic
aggaggtaaccaagcaaagaaggggagactcccgaggcaagctatctcctaagaagagtcgagaaaattctcaag

SEQ ID NO: 143156 - DNA, 75 bp, Artificial Sequence
  Synthetic
aggaggtaaccaagcaaagaaggggagactcccgaggcaaggtatctcctaagaagagtcgagaaaattctcaag

SEQ ID NO: 143157 - DNA, 75 bp, Artificial Sequence
  Synthetic
aggaggtaaccaagcaaagaaggggagactcccgagggaagatatctcctaagaagagtcgagaaaattctcaag

SEQ ID NO: 143158 - DNA, 75 bp, Artificial Sequence
  Synthetic
aggaggtaaccaagcaaagaaggggagactcccgagggaagttatctcctaagaagagtcgagaaaattctcaag

SEQ ID NO: 143159 - DNA, 75 bp, Artificial Sequence
  Synthetic
aggaggtaaccaagcaaagaaggggagactcccgagggaagctatctcctaagaagagtcgagaaaattctcaag

SEQ ID NO: 143160 - DNA, 75 bp, Artificial Sequence
  Synthetic
aggaggtaaccaagcaaagaaggggagactcccgagggaaggtatctcctaagaagagtcgagaaaattctcaag

SEQ ID NO: 143161 - DNA, 75 bp, Artificial Sequence
  Synthetic
aggaggcaaccaagcaaagaaggggagactcccgaggaaagatatctcctaagaagagtcgagaaaattctcaag

SEQ ID NO: 143162 - DNA, 75 bp, Artificial Sequence
  Synthetic
aggaggcaaccaagcaaagaaggggagactcccgaggaaagttatctcctaagaagagtcgagaaaattctcaag

SEQ ID NO: 143163 - DNA, 75 bp, Artificial Sequence
  Synthetic
aggaggcaaccaagcaaagaaggggagactcccgaggaaagctatctcctaagaagagtcgagaaaattctcaag

SEQ ID NO: 143164 - DNA, 75 bp, Artificial Sequence
  Synthetic
aggaggcaaccaagcaaagaaggggagactcccgaggaaaggtatctcctaagaagagtcgagaaaattctcaag

SEQ ID NO: 143165 - DNA, 75 bp, Artificial Sequence
  Synthetic
aggaggcaaccaagcaaagaaggggagactcccgaggtaagatatctcctaagaagagtcgagaaaattctcaag

SEQ ID NO: 143166 - DNA, 75 bp, Artificial Sequence
  Synthetic
aggaggcaaccaagcaaagaaggggagactcccgaggtaagttatctcctaagaagagtcgagaaaattctcaag

SEQ ID NO: 143167 - DNA, 75 bp, Artificial Sequence
  Synthetic
aggaggcaaccaagcaaagaaggggagactcccgaggtaagctatctcctaagaagagtcgagaaaattctcaag

SEQ ID NO: 143168 - DNA, 75 bp, Artificial Sequence
  Synthetic
aggaggcaaccaagcaaagaaggggagactcccgaggtaaggtatctcctaagaagagtcgagaaaattctcaag

SEQ ID NO: 143169 - DNA, 75 bp, Artificial Sequence
  Synthetic
aggaggcaaccaagcaaagaaggggagactcccgaggcaagatatctcctaagaagagtcgagaaaattctcaag

SEQ ID NO: 143170 - DNA, 75 bp, Artificial Sequence
  Synthetic
aggaggcaaccaagcaaagaaggggagactcccgaggcaagttatctcctaagaagagtcgagaaaattctcaag

SEQ ID NO: 143171 - DNA, 75 bp, Artificial Sequence
  Synthetic
aggaggcaaccaagcaaagaaggggagactcccgaggcaagctatctcctaagaagagtcgagaaaattctcaag

SEQ ID NO: 143172 - DNA, 75 bp, Artificial Sequence
  Synthetic
aggaggcaaccaagcaaagaaggggagactcccgaggcaaggtatctcctaagaagagtcgagaaaattctcaag

SEQ ID NO: 143173 - DNA, 75 bp, Artificial Sequence
  Synthetic
aggaggcaaccaagcaaagaaggggagactcccgagggaagatatctcctaagaagagtcgagaaaattctcaag

SEQ ID NO: 143174 - DNA, 75 bp, Artificial Sequence
  Synthetic
aggaggcaaccaagcaaagaaggggagactcccgagggaagttatctcctaagaagagtcgagaaaattctcaag

SEQ ID NO: 143175 - DNA, 75 bp, Artificial Sequence
  Synthetic
aggaggcaaccaagcaaagaaggggagactcccgagggaagctatctcctaagaagagtcgagaaaattctcaag

SEQ ID NO: 143176 - DNA, 75 bp, Artificial Sequence
  Synthetic
aggaggcaaccaagcaaagaaggggagactcccgagggaaggtatctcctaagaagagtcgagaaaattctcaag

SEQ ID NO: 143177 - DNA, 75 bp, Artificial Sequence
  Synthetic
aggagggaaccaagcaaagaaggggagactcccgaggaaagatatctcctaagaagagtcgagaaaattctcaag

SEQ ID NO: 143178 - DNA, 75 bp, Artificial Sequence
  Synthetic
aggagggaaccaagcaaagaaggggagactcccgaggaaagttatctcctaagaagagtcgagaaaattctcaag

SEQ ID NO: 143179 - DNA, 75 bp, Artificial Sequence
  Synthetic
aggagggaaccaagcaaagaaggggagactcccgaggaaagctatctcctaagaagagtcgagaaaattctcaag

SEQ ID NO: 143180 - DNA, 75 bp, Artificial Sequence
  Synthetic
aggagggaaccaagcaaagaaggggagactcccgaggaaaggtatctcctaagaagagtcgagaaaattctcaag

SEQ ID NO: 143181 - DNA, 75 bp, Artificial Sequence
  Synthetic
aggagggaaccaagcaaagaaggggagactcccgaggtaagatatctcctaagaagagtcgagaaaattctcaag

SEQ ID NO: 143182 - DNA, 75 bp, Artificial Sequence
  Synthetic
aggagggaaccaagcaaagaaggggagactcccgaggtaagttatctcctaagaagagtcgagaaaattctcaag

SEQ ID NO: 143183 - DNA, 75 bp, Artificial Sequence
  Synthetic
aggagggaaccaagcaaagaaggggagactcccgaggtaagctatctcctaagaagagtcgagaaaattctcaag

SEQ ID NO: 143184 - DNA, 75 bp, Artificial Sequence
  Synthetic
aggagggaaccaagcaaagaaggggagactcccgaggtaaggtatctcctaagaagagtcgagaaaattctcaag

SEQ ID NO: 143185 - DNA, 75 bp, Artificial Sequence
  Synthetic
aggagggaaccaagcaaagaaggggagactcccgaggcaagatatctcctaagaagagtcgagaaaattctcaag

SEQ ID NO: 143186 - DNA, 75 bp, Artificial Sequence
  Synthetic
aggagggaaccaagcaaagaaggggagactcccgaggcaagttatctcctaagaagagtcgagaaaattctcaag

SEQ ID NO: 143187 - DNA, 75 bp, Artificial Sequence
  Synthetic
aggagggaaccaagcaaagaaggggagactcccgaggcaagctatctcctaagaagagtcgagaaaattctcaag

SEQ ID NO: 143188 - DNA, 75 bp, Artificial Sequence
  Synthetic
aggagggaaccaagcaaagaaggggagactcccgaggcaaggtatctcctaagaagagtcgagaaaattctcaag

SEQ ID NO: 143189 - DNA, 75 bp, Artificial Sequence
  Synthetic
aggagggaaccaagcaaagaaggggagactcccgagggaagatatctcctaagaagagtcgagaaaattctcaag

SEQ ID NO: 143190 - DNA, 75 bp, Artificial Sequence
  Synthetic
aggagggaaccaagcaaagaaggggagactcccgagggaagttatctcctaagaagagtcgagaaaattctcaag

SEQ ID NO: 143191 - DNA, 75 bp, Artificial Sequence
  Synthetic
aggagggaaccaagcaaagaaggggagactcccgagggaagctatctcctaagaagagtcgagaaaattctcaag

SEQ ID NO: 143192 - DNA, 75 bp, Artificial Sequence
  Synthetic
aggagggaaccaagcaaagaaggggagactcccgagggaaggtatctcctaagaagagtcgagaaaattctcaag

SEQ ID NO: 143193 - DNA, 75 bp, Artificial Sequence
  Synthetic
aggaggaggaatcccctcaaagctgacggaactccgggaacaaggaaaaaggagaaggaacggtagaaaagagcg

SEQ ID NO: 143194 - DNA, 75 bp, Artificial Sequence
  Synthetic
aggaggaggaatcccctcaaagctgacggaactccgggaacaaggaaataggagaaggaacggtagaaaagagcg

SEQ ID NO: 143195 - DNA, 75 bp, Artificial Sequence
  Synthetic
aggaggaggaatcccctcaaagctgacggaactccgggaacaaggaaacaggagaaggaacggtagaaaagagcg

SEQ ID NO: 143196 - DNA, 75 bp, Artificial Sequence
  Synthetic
aggaggaggaatcccctcaaagctgacggaactccgggaacaaggaaagaggagaaggaacggtagaaaagagcg

SEQ ID NO: 143197 - DNA, 75 bp, Artificial Sequence
  Synthetic
aggaggaggtatcccctcaaagctgacggaactccgggaacaaggaaaaaggagaaggaacggtagaaaagagcg

SEQ ID NO: 143198 - DNA, 75 bp, Artificial Sequence
  Synthetic
aggaggaggtatcccctcaaagctgacggaactccgggaacaaggaaataggagaaggaacggtagaaaagagcg

SEQ ID NO: 143199 - DNA, 75 bp, Artificial Sequence
  Synthetic
aggaggaggtatcccctcaaagctgacggaactccgggaacaaggaaacaggagaaggaacggtagaaaagagcg

SEQ ID NO: 143200 - DNA, 75 bp, Artificial Sequence
  Synthetic
aggaggaggtatcccctcaaagctgacggaactccgggaacaaggaaagaggagaaggaacggtagaaaagagcg

SEQ ID NO: 143201 - DNA, 75 bp, Artificial Sequence
  Synthetic
aggaggaggcatcccctcaaagctgacggaactccgggaacaaggaaaaaggagaaggaacggtagaaaagagcg

SEQ ID NO: 143202 - DNA, 75 bp, Artificial Sequence
  Synthetic
aggaggaggcatcccctcaaagctgacggaactccgggaacaaggaaataggagaaggaacggtagaaaagagcg

SEQ ID NO: 143203 - DNA, 75 bp, Artificial Sequence
  Synthetic
aggaggaggcatcccctcaaagctgacggaactccgggaacaaggaaacaggagaaggaacggtagaaaagagcg

SEQ ID NO: 143204 - DNA, 75 bp, Artificial Sequence
  Synthetic
aggaggaggcatcccctcaaagctgacggaactccgggaacaaggaaagaggagaaggaacggtagaaaagagcg

SEQ ID NO: 143205 - DNA, 75 bp, Artificial Sequence
  Synthetic
aggaggagggatcccctcaaagctgacggaactccgggaacaaggaaaaaggagaaggaacggtagaaaagagcg

SEQ ID NO: 143206 - DNA, 75 bp, Artificial Sequence
  Synthetic
aggaggagggatcccctcaaagctgacggaactccgggaacaaggaaataggagaaggaacggtagaaaagagcg

SEQ ID NO: 143207 - DNA, 75 bp, Artificial Sequence
  Synthetic
aggaggagggatcccctcaaagctgacggaactccgggaacaaggaaacaggagaaggaacggtagaaaagagcg

SEQ ID NO: 143208 - DNA, 75 bp, Artificial Sequence
  Synthetic
aggaggagggatcccctcaaagctgacggaactccgggaacaaggaaagaggagaaggaacggtagaaaagagcg

SEQ ID NO: 143209 - DNA, 75 bp, Artificial Sequence
  Synthetic
acggaactccgggaacaaggaaaaaggagaaggaacggtagaaaagagcgagcctcccgatccgaggggcccgga

SEQ ID NO: 143210 - DNA, 75 bp, Artificial Sequence
  Synthetic
acggaactccgggaacaaggaaataggagaaggaacggtagaaaagagcgagcctcccgatccgaggggcccgga

SEQ ID NO: 143211 - DNA, 75 bp, Artificial Sequence
  Synthetic
acggaactccgggaacaaggaaacaggagaaggaacggtagaaaagagcgagcctcccgatccgaggggcccgga

SEQ ID NO: 143212 - DNA, 75 bp, Artificial Sequence
  Synthetic
acggaactccgggaacaaggaaagaggagaaggaacggtagaaaagagcgagcctcccgatccgaggggcccgga

SEQ ID NO: 143213 - DNA, 75 bp, Artificial Sequence
  Synthetic
cacctcggctctggagtcctccgacctgtgaggtcgagaacctccgcgcagggagacagccaccaggagaaggca

SEQ ID NO: 143214 - DNA, 75 bp, Artificial Sequence
  Synthetic
aggaggagatgctaggagtgggcggcgaccaaagcgaggatcgaaagtaaagaaagcaacggggctagcaggtgg

SEQ ID NO: 143215 - DNA, 75 bp, Artificial Sequence
  Synthetic
aggaggagatgctaggagtgggcggcgacctaagcgaggatcgaaagtaaagaaagcaacggggctagcaggtgg

SEQ ID NO: 143216 - DNA, 75 bp, Artificial Sequence
  Synthetic
aggaggagatgctaggagtgggcggcgacccaagcgaggatcgaaagtaaagaaagcaacggggctagcaggtgg

SEQ ID NO: 143217 - DNA, 75 bp, Artificial Sequence
  Synthetic
aggaggagatgctaggagtgggcggcgaccgaagcgaggatcgaaagtaaagaaagcaacggggctagcaggtgg

SEQ ID NO: 143218 - DNA, 75 bp, Artificial Sequence
  Synthetic
cgaccaaagcgaggatcgaaagtaaagaaagcaacggggctagcaggtggatgttccgcctccccagggtcccga

SEQ ID NO: 143219 - DNA, 75 bp, Artificial Sequence
  Synthetic
cgacctaagcgaggatcgaaagtaaagaaagcaacggggctagcaggtggatgttccgcctccccagggtcccga

SEQ ID NO: 143220 - DNA, 75 bp, Artificial Sequence
  Synthetic
cgacccaagcgaggatcgaaagtaaagaaagcaacggggctagcaggtggatgttccgcctccccagggtcccga

SEQ ID NO: 143221 - DNA, 75 bp, Artificial Sequence
  Synthetic
cgaccgaagcgaggatcgaaagtaaagaaagcaacggggctagcaggtggatgttccgcctccccagggtcccga

SEQ ID NO: 143222 - DNA, 75 bp, Artificial Sequence
  Synthetic
gtgaggcttatcccggggaacccggctaagccccgaaatgtctggttccgccggctccacttccaaaaggaggag

SEQ ID NO: 143223 - DNA, 75 bp, Artificial Sequence
  Synthetic
ctttcttccactcacccacttctcgagaatatcttctcttccatcgcgcttcttcttcgattcggatcggctcat

SEQ ID NO: 143224 - DNA, 75 bp, Artificial Sequence
  Synthetic
ctaagccccgaaatgtctggttccgccggctccacttccaaaaggaggagcggggggacttggaacgaaaggggc

SEQ ID NO: 143225 - DNA, 75 bp, Artificial Sequence
  Synthetic
ctaagccccgaaatgtctggttccgccggctccacttccaaaaggaggagcggggggacttggaacgtaaggggc

SEQ ID NO: 143226 - DNA, 75 bp, Artificial Sequence
  Synthetic
ctaagccccgaaatgtctggttccgccggctccacttccaaaaggaggagcggggggacttggaacgcaaggggc

SEQ ID NO: 143227 - DNA, 75 bp, Artificial Sequence
  Synthetic
ctaagccccgaaatgtctggttccgccggctccacttccaaaaggaggagcggggggacttggaacggaaggggc

SEQ ID NO: 143228 - DNA, 75 bp, Artificial Sequence
  Synthetic
ctaagccccgaaatgtctggttccgccggctccacttccaaaaggaggagcggggggacttggatcgaaaggggc

SEQ ID NO: 143229 - DNA, 75 bp, Artificial Sequence
  Synthetic
ctaagccccgaaatgtctggttccgccggctccacttccaaaaggaggagcggggggacttggatcgtaaggggc

SEQ ID NO: 143230 - DNA, 75 bp, Artificial Sequence
  Synthetic
ctaagccccgaaatgtctggttccgccggctccacttccaaaaggaggagcggggggacttggatcgcaaggggc

SEQ ID NO: 143231 - DNA, 75 bp, Artificial Sequence
  Synthetic
ctaagccccgaaatgtctggttccgccggctccacttccaaaaggaggagcggggggacttggatcggaaggggc

SEQ ID NO: 143232 - DNA, 75 bp, Artificial Sequence
  Synthetic
ctaagccccgaaatgtctggttccgccggctccacttccaaaaggaggagcggggggacttggaccgaaaggggc

SEQ ID NO: 143233 - DNA, 75 bp, Artificial Sequence
  Synthetic
ctaagccccgaaatgtctggttccgccggctccacttccaaaaggaggagcggggggacttggaccgtaaggggc

SEQ ID NO: 143234 - DNA, 75 bp, Artificial Sequence
  Synthetic
ctaagccccgaaatgtctggttccgccggctccacttccaaaaggaggagcggggggacttggaccgcaaggggc

SEQ ID NO: 143235 - DNA, 75 bp, Artificial Sequence
  Synthetic
ctaagccccgaaatgtctggttccgccggctccacttccaaaaggaggagcggggggacttggaccggaaggggc

SEQ ID NO: 143236 - DNA, 75 bp, Artificial Sequence
  Synthetic
ctaagccccgaaatgtctggttccgccggctccacttccaaaaggaggagcggggggacttggagcgaaaggggc

SEQ ID NO: 143237 - DNA, 75 bp, Artificial Sequence
  Synthetic
ctaagccccgaaatgtctggttccgccggctccacttccaaaaggaggagcggggggacttggagcgtaaggggc

SEQ ID NO: 143238 - DNA, 75 bp, Artificial Sequence
  Synthetic
ctaagccccgaaatgtctggttccgccggctccacttccaaaaggaggagcggggggacttggagcgcaaggggc

SEQ ID NO: 143239 - DNA, 75 bp, Artificial Sequence
  Synthetic
ctaagccccgaaatgtctggttccgccggctccacttccaaaaggaggagcggggggacttggagcggaaggggc

SEQ ID NO: 143240 - DNA, 75 bp, Artificial Sequence
  Synthetic
ctcgacaagaggcggcggtcctcagtgctcttactctttgtttgtaaagaggagactgctggactcgccgcccaa

SEQ ID NO: 143241 - DNA, 75 bp, Artificial Sequence
  Synthetic
cagttcagtccgtggggattaccccggagctcccgttctccacactccttccccccgcgggacccccaataatat

SEQ ID NO: 143242 - DNA, 75 bp, Artificial Sequence
  Synthetic
cagttcagtccgtggggattaccccggagctcccgttctccacactccttccccccgcgggacccccaataattt

SEQ ID NO: 143243 - DNA, 75 bp, Artificial Sequence
  Synthetic
cagttcagtccgtggggattaccccggagctcccgttctccacactccttccccccgcgggacccccaataatct

SEQ ID NO: 143244 - DNA, 75 bp, Artificial Sequence
  Synthetic
cagttcagtccgtggggattaccccggagctcccgttctccacactccttccccccgcgggacccccaataatgt

SEQ ID NO: 143245 - DNA, 75 bp, Artificial Sequence
  Synthetic
cagttcagtccgtggggtttaccccggagctcccgttctccacactccttccccccgcgggacccccaataatat

SEQ ID NO: 143246 - DNA, 75 bp, Artificial Sequence
  Synthetic
cagttcagtccgtggggtttaccccggagctcccgttctccacactccttccccccgcgggacccccaataattt

SEQ ID NO: 143247 - DNA, 75 bp, Artificial Sequence
  Synthetic
cagttcagtccgtggggtttaccccggagctcccgttctccacactccttccccccgcgggacccccaataatct

SEQ ID NO: 143248 - DNA, 75 bp, Artificial Sequence
  Synthetic
cagttcagtccgtggggtttaccccggagctcccgttctccacactccttccccccgcgggacccccaataatgt

SEQ ID NO: 143249 - DNA, 75 bp, Artificial Sequence
  Synthetic
cagttcagtccgtggggcttaccccggagctcccgttctccacactccttccccccgcgggacccccaataatat

SEQ ID NO: 143250 - DNA, 75 bp, Artificial Sequence
  Synthetic
cagttcagtccgtggggcttaccccggagctcccgttctccacactccttccccccgcgggacccccaataattt

SEQ ID NO: 143251 - DNA, 75 bp, Artificial Sequence
  Synthetic
cagttcagtccgtggggcttaccccggagctcccgttctccacactccttccccccgcgggacccccaataatct

SEQ ID NO: 143252 - DNA, 75 bp, Artificial Sequence
  Synthetic
cagttcagtccgtggggcttaccccggagctcccgttctccacactccttccccccgcgggacccccaataatgt

SEQ ID NO: 143253 - DNA, 75 bp, Artificial Sequence
  Synthetic
cagttcagtccgtgggggttaccccggagctcccgttctccacactccttccccccgcgggacccccaataatat

SEQ ID NO: 143254 - DNA, 75 bp, Artificial Sequence
  Synthetic
cagttcagtccgtgggggttaccccggagctcccgttctccacactccttccccccgcgggacccccaataattt

SEQ ID NO: 143255 - DNA, 75 bp, Artificial Sequence
  Synthetic
cagttcagtccgtgggggttaccccggagctcccgttctccacactccttccccccgcgggacccccaataatct

SEQ ID NO: 143256 - DNA, 75 bp, Artificial Sequence
  Synthetic
cagttcagtccgtgggggttaccccggagctcccgttctccacactccttccccccgcgggacccccaataatgt

SEQ ID NO: 143257 - DNA, 75 bp, Artificial Sequence
  Synthetic
ggagctcccgttctccacactccttccccccgcgggacccccaataatatggtaagaacccacccactggggtcc

SEQ ID NO: 143258 - DNA, 75 bp, Artificial Sequence
  Synthetic
ggagctcccgttctccacactccttccccccgcgggacccccaataatttggtaagaacccacccactggggtcc

SEQ ID NO: 143259 - DNA, 75 bp, Artificial Sequence
  Synthetic
ggagctcccgttctccacactccttccccccgcgggacccccaataatctggtaagaacccacccactggggtcc

SEQ ID NO: 143260 - DNA, 75 bp, Artificial Sequence
  Synthetic
ggagctcccgttctccacactccttccccccgcgggacccccaataatgtggtaagaacccacccactggggtcc

SEQ ID NO: 143261 - DNA, 75 bp, Artificial Sequence
  Synthetic
ggtcgagaagtcccagagggaggaaccacgcggagataagcggagaaaccacctccagaggaccccttcagcgaa

SEQ ID NO: 143262 - DNA, 75 bp, Artificial Sequence
  Synthetic
ctggctctcccttagccatccgagtggacgtctgtcctccttcggatgcccaggtcggaccgcggggaggtggag

SEQ ID NO: 143263 - DNA, 75 bp, Artificial Sequence
  Synthetic
ggacgtctgtcctccttcggatgcccaggtcggaccgcggggaggtggagatgccatgccgacccgaagaggaaa

SEQ ID NO: 143264 - DNA, 75 bp, Artificial Sequence
  Synthetic
acctccagaggaccccttcagcgaacagagggcactgcgcgagcaggagtaagagcgtagcgatggggggagatg

SEQ ID NO: 143265 - DNA, 75 bp, Artificial Sequence
  Synthetic
gaaggactcggacgcgaacccgtgagtggaaccttattcctttattggggagtacactcgaggagtggaaggcgg

SEQ ID NO: 143266 - DNA, 75 bp, Artificial Sequence
  Synthetic
acgggaactgctggttcccccttatgtccagtccctctcccgtcctggtgaaggaagactcgggaacgttcagca

SEQ ID NO: 143267 - DNA, 75 bp, Artificial Sequence
  Synthetic
acgggaactgctggttcccccttatgtccagtccctctcccgtcctggtgaaggtagactcgggaacgttcagca

SEQ ID NO: 143268 - DNA, 75 bp, Artificial Sequence
  Synthetic
acgggaactgctggttcccccttatgtccagtccctctcccgtcctggtgaaggcagactcgggaacgttcagca

SEQ ID NO: 143269 - DNA, 75 bp, Artificial Sequence
  Synthetic
acgggaactgctggttcccccttatgtccagtccctctcccgtcctggtgaagggagactcgggaacgttcagca

SEQ ID NO: 143270 - DNA, 75 bp, Artificial Sequence
  Synthetic
gtcttcatcggtcaacctcccgagttcctcttcttcctccttgctgagtgactttccacccgcgttcagctgttt

SEQ ID NO: 143271 - DNA, 75 bp, Artificial Sequence
  Synthetic
gtcttcatcggtcaacctcccgagttcctcttcttcctccttgctgagtgactttcctcccgcgttcagctgttt

SEQ ID NO: 143272 - DNA, 75 bp, Artificial Sequence
  Synthetic
gtcttcatcggtcaacctcccgagttcctcttcttcctccttgctgagtgactttccccccgcgttcagctgttt

SEQ ID NO: 143273 - DNA, 75 bp, Artificial Sequence
  Synthetic
gtcttcatcggtcaacctcccgagttcctcttcttcctccttgctgagtgactttccgcccgcgttcagctgttt

SEQ ID NO: 143274 - DNA, 75 bp, Artificial Sequence
  Synthetic
gtcttcttcggtcaacctcccgagttcctcttcttcctccttgctgagtgactttccacccgcgttcagctgttt

SEQ ID NO: 143275 - DNA, 75 bp, Artificial Sequence
  Synthetic
gtcttcttcggtcaacctcccgagttcctcttcttcctccttgctgagtgactttcctcccgcgttcagctgttt

SEQ ID NO: 143276 - DNA, 75 bp, Artificial Sequence
  Synthetic
gtcttcttcggtcaacctcccgagttcctcttcttcctccttgctgagtgactttccccccgcgttcagctgttt

SEQ ID NO: 143277 - DNA, 75 bp, Artificial Sequence
  Synthetic
gtcttcttcggtcaacctcccgagttcctcttcttcctccttgctgagtgactttccgcccgcgttcagctgttt

SEQ ID NO: 143278 - DNA, 75 bp, Artificial Sequence
  Synthetic
gtcttcctcggtcaacctcccgagttcctcttcttcctccttgctgagtgactttccacccgcgttcagctgttt

SEQ ID NO: 143279 - DNA, 75 bp, Artificial Sequence
  Synthetic
gtcttcctcggtcaacctcccgagttcctcttcttcctccttgctgagtgactttcctcccgcgttcagctgttt

SEQ ID NO: 143280 - DNA, 75 bp, Artificial Sequence
  Synthetic
gtcttcctcggtcaacctcccgagttcctcttcttcctccttgctgagtgactttccccccgcgttcagctgttt

SEQ ID NO: 143281 - DNA, 75 bp, Artificial Sequence
  Synthetic
gtcttcctcggtcaacctcccgagttcctcttcttcctccttgctgagtgactttccgcccgcgttcagctgttt

SEQ ID NO: 143282 - DNA, 75 bp, Artificial Sequence
  Synthetic
gtcttcgtcggtcaacctcccgagttcctcttcttcctccttgctgagtgactttccacccgcgttcagctgttt

SEQ ID NO: 143283 - DNA, 75 bp, Artificial Sequence
  Synthetic
gtcttcgtcggtcaacctcccgagttcctcttcttcctccttgctgagtgactttcctcccgcgttcagctgttt

SEQ ID NO: 143284 - DNA, 75 bp, Artificial Sequence
  Synthetic
gtcttcgtcggtcaacctcccgagttcctcttcttcctccttgctgagtgactttccccccgcgttcagctgttt

SEQ ID NO: 143285 - DNA, 75 bp, Artificial Sequence
  Synthetic
gtcttcgtcggtcaacctcccgagttcctcttcttcctccttgctgagtgactttccgcccgcgttcagctgttt

SEQ ID NO: 143286 - DNA, 75 bp, Artificial Sequence
  Synthetic
cctgtgagtggaaacccgctttattcactggggtcgacaactctggggagaaaagggaggatcggatgggaagag

SEQ ID NO: 143287 - DNA, 75 bp, Artificial Sequence
  Synthetic
cgagtctcttgatggttctcttggtcttccggagccttatctcgaggtcatccgcatcttttcttgcttggagcc

SEQ ID NO: 143288 - DNA, 75 bp, Artificial Sequence
  Synthetic
cgagtctcttgatggttctcttggtcttccggagccttatctcgaggtcatccgcttcttttcttgcttggagcc

SEQ ID NO: 143289 - DNA, 75 bp, Artificial Sequence
  Synthetic
cgagtctcttgatggttctcttggtcttccggagccttatctcgaggtcatccgcctcttttcttgcttggagcc

SEQ ID NO: 143290 - DNA, 75 bp, Artificial Sequence
  Synthetic
cgagtctcttgatggttctcttggtcttccggagccttatctcgaggtcatccgcgtcttttcttgcttggagcc

SEQ ID NO: 143291 - DNA, 75 bp, Artificial Sequence
  Synthetic
cgagtctcttgatggttctcttggtcttccggagccttatctcgaggtcttccgcatcttttcttgcttggagcc

SEQ ID NO: 143292 - DNA, 75 bp, Artificial Sequence
  Synthetic
cgagtctcttgatggttctcttggtcttccggagccttatctcgaggtcttccgcttcttttcttgcttggagcc

SEQ ID NO: 143293 - DNA, 75 bp, Artificial Sequence
  Synthetic
cgagtctcttgatggttctcttggtcttccggagccttatctcgaggtcttccgcctcttttcttgcttggagcc

SEQ ID NO: 143294 - DNA, 75 bp, Artificial Sequence
  Synthetic
cgagtctcttgatggttctcttggtcttccggagccttatctcgaggtcttccgcgtcttttcttgcttggagcc

SEQ ID NO: 143295 - DNA, 75 bp, Artificial Sequence
  Synthetic
cgagtctcttgatggttctcttggtcttccggagccttatctcgaggtcctccgcatcttttcttgcttggagcc

SEQ ID NO: 143296 - DNA, 75 bp, Artificial Sequence
  Synthetic
cgagtctcttgatggttctcttggtcttccggagccttatctcgaggtcctccgcttcttttcttgcttggagcc

SEQ ID NO: 143297 - DNA, 75 bp, Artificial Sequence
  Synthetic
cgagtctcttgatggttctcttggtcttccggagccttatctcgaggtcctccgcctcttttcttgcttggagcc

SEQ ID NO: 143298 - DNA, 75 bp, Artificial Sequence
  Synthetic
cgagtctcttgatggttctcttggtcttccggagccttatctcgaggtcctccgcgtcttttcttgcttggagcc

SEQ ID NO: 143299 - DNA, 75 bp, Artificial Sequence
  Synthetic
cgagtctcttgatggttctcttggtcttccggagccttatctcgaggtcgtccgcatcttttcttgcttggagcc

SEQ ID NO: 143300 - DNA, 75 bp, Artificial Sequence
  Synthetic
cgagtctcttgatggttctcttggtcttccggagccttatctcgaggtcgtccgcttcttttcttgcttggagcc

SEQ ID NO: 143301 - DNA, 75 bp, Artificial Sequence
  Synthetic
cgagtctcttgatggttctcttggtcttccggagccttatctcgaggtcgtccgcctcttttcttgcttggagcc

SEQ ID NO: 143302 - DNA, 75 bp, Artificial Sequence
  Synthetic
cgagtctcttgatggttctcttggtcttccggagccttatctcgaggtcgtccgcgtcttttcttgcttggagcc

SEQ ID NO: 143303 - DNA, 75 bp, Artificial Sequence
  Synthetic
cgagtctcttgatggttctcttggtcttccggagccttttctcgaggtcatccgcatcttttcttgcttggagcc

SEQ ID NO: 143304 - DNA, 75 bp, Artificial Sequence
  Synthetic
cgagtctcttgatggttctcttggtcttccggagccttttctcgaggtcatccgcttcttttcttgcttggagcc

SEQ ID NO: 143305 - DNA, 75 bp, Artificial Sequence
  Synthetic
cgagtctcttgatggttctcttggtcttccggagccttttctcgaggtcatccgcctcttttcttgcttggagcc

SEQ ID NO: 143306 - DNA, 75 bp, Artificial Sequence
  Synthetic
cgagtctcttgatggttctcttggtcttccggagccttttctcgaggtcatccgcgtcttttcttgcttggagcc

SEQ ID NO: 143307 - DNA, 75 bp, Artificial Sequence
  Synthetic
cgagtctcttgatggttctcttggtcttccggagccttttctcgaggtcttccgcatcttttcttgcttggagcc

SEQ ID NO: 143308 - DNA, 75 bp, Artificial Sequence
  Synthetic
cgagtctcttgatggttctcttggtcttccggagccttttctcgaggtcttccgcttcttttcttgcttggagcc

SEQ ID NO: 143309 - DNA, 75 bp, Artificial Sequence
  Synthetic
cgagtctcttgatggttctcttggtcttccggagccttttctcgaggtcttccgcctcttttcttgcttggagcc

SEQ ID NO: 143310 - DNA, 75 bp, Artificial Sequence
  Synthetic
cgagtctcttgatggttctcttggtcttccggagccttttctcgaggtcttccgcgtcttttcttgcttggagcc

SEQ ID NO: 143311 - DNA, 75 bp, Artificial Sequence
  Synthetic
cgagtctcttgatggttctcttggtcttccggagccttttctcgaggtcctccgcatcttttcttgcttggagcc

SEQ ID NO: 143312 - DNA, 75 bp, Artificial Sequence
  Synthetic
cgagtctcttgatggttctcttggtcttccggagccttttctcgaggtcctccgcttcttttcttgcttggagcc

SEQ ID NO: 143313 - DNA, 75 bp, Artificial Sequence
  Synthetic
cgagtctcttgatggttctcttggtcttccggagccttttctcgaggtcctccgcctcttttcttgcttggagcc

SEQ ID NO: 143314 - DNA, 75 bp, Artificial Sequence
  Synthetic
cgagtctcttgatggttctcttggtcttccggagccttttctcgaggtcctccgcgtcttttcttgcttggagcc

SEQ ID NO: 143315 - DNA, 75 bp, Artificial Sequence
  Synthetic
cgagtctcttgatggttctcttggtcttccggagccttttctcgaggtcgtccgcatcttttcttgcttggagcc

SEQ ID NO: 143316 - DNA, 75 bp, Artificial Sequence
  Synthetic
cgagtctcttgatggttctcttggtcttccggagccttttctcgaggtcgtccgcttcttttcttgcttggagcc

SEQ ID NO: 143317 - DNA, 75 bp, Artificial Sequence
  Synthetic
cgagtctcttgatggttctcttggtcttccggagccttttctcgaggtcgtccgcctcttttcttgcttggagcc

SEQ ID NO: 143318 - DNA, 75 bp, Artificial Sequence
  Synthetic
cgagtctcttgatggttctcttggtcttccggagccttttctcgaggtcgtccgcgtcttttcttgcttggagcc

SEQ ID NO: 143319 - DNA, 75 bp, Artificial Sequence
  Synthetic
cgagtctcttgatggttctcttggtcttccggagccttctctcgaggtcatccgcatcttttcttgcttggagcc

SEQ ID NO: 143320 - DNA, 75 bp, Artificial Sequence
  Synthetic
cgagtctcttgatggttctcttggtcttccggagccttctctcgaggtcatccgcttcttttcttgcttggagcc

SEQ ID NO: 143321 - DNA, 75 bp, Artificial Sequence
  Synthetic
cgagtctcttgatggttctcttggtcttccggagccttctctcgaggtcatccgcctcttttcttgcttggagcc

SEQ ID NO: 143322 - DNA, 75 bp, Artificial Sequence
  Synthetic
cgagtctcttgatggttctcttggtcttccggagccttctctcgaggtcatccgcgtcttttcttgcttggagcc

SEQ ID NO: 143323 - DNA, 75 bp, Artificial Sequence
  Synthetic
cgagtctcttgatggttctcttggtcttccggagccttctctcgaggtcttccgcatcttttcttgcttggagcc

SEQ ID NO: 143324 - DNA, 75 bp, Artificial Sequence
  Synthetic
cgagtctcttgatggttctcttggtcttccggagccttctctcgaggtcttccgcttcttttcttgcttggagcc

SEQ ID NO: 143325 - DNA, 75 bp, Artificial Sequence
  Synthetic
cgagtctcttgatggttctcttggtcttccggagccttctctcgaggtcttccgcctcttttcttgcttggagcc

SEQ ID NO: 143326 - DNA, 75 bp, Artificial Sequence
  Synthetic
cgagtctcttgatggttctcttggtcttccggagccttctctcgaggtcttccgcgtcttttcttgcttggagcc

SEQ ID NO: 143327 - DNA, 75 bp, Artificial Sequence
  Synthetic
cgagtctcttgatggttctcttggtcttccggagccttctctcgaggtcctccgcatcttttcttgcttggagcc

SEQ ID NO: 143328 - DNA, 75 bp, Artificial Sequence
  Synthetic
cgagtctcttgatggttctcttggtcttccggagccttctctcgaggtcctccgcttcttttcttgcttggagcc

SEQ ID NO: 143329 - DNA, 75 bp, Artificial Sequence
  Synthetic
cgagtctcttgatggttctcttggtcttccggagccttctctcgaggtcctccgcctcttttcttgcttggagcc

SEQ ID NO: 143330 - DNA, 75 bp, Artificial Sequence
  Synthetic
cgagtctcttgatggttctcttggtcttccggagccttctctcgaggtcctccgcgtcttttcttgcttggagcc

SEQ ID NO: 143331 - DNA, 75 bp, Artificial Sequence
  Synthetic
cgagtctcttgatggttctcttggtcttccggagccttctctcgaggtcgtccgcatcttttcttgcttggagcc

SEQ ID NO: 143332 - DNA, 75 bp, Artificial Sequence
  Synthetic
cgagtctcttgatggttctcttggtcttccggagccttctctcgaggtcgtccgcttcttttcttgcttggagcc

SEQ ID NO: 143333 - DNA, 75 bp, Artificial Sequence
  Synthetic
cgagtctcttgatggttctcttggtcttccggagccttctctcgaggtcgtccgcctcttttcttgcttggagcc

SEQ ID NO: 143334 - DNA, 75 bp, Artificial Sequence
  Synthetic
cgagtctcttgatggttctcttggtcttccggagccttctctcgaggtcgtccgcgtcttttcttgcttggagcc

SEQ ID NO: 143335 - DNA, 75 bp, Artificial Sequence
  Synthetic
cgagtctcttgatggttctcttggtcttccggagccttgtctcgaggtcatccgcatcttttcttgcttggagcc

SEQ ID NO: 143336 - DNA, 75 bp, Artificial Sequence
  Synthetic
cgagtctcttgatggttctcttggtcttccggagccttgtctcgaggtcatccgcttcttttcttgcttggagcc

SEQ ID NO: 143337 - DNA, 75 bp, Artificial Sequence
  Synthetic
cgagtctcttgatggttctcttggtcttccggagccttgtctcgaggtcatccgcctcttttcttgcttggagcc

SEQ ID NO: 143338 - DNA, 75 bp, Artificial Sequence
  Synthetic
cgagtctcttgatggttctcttggtcttccggagccttgtctcgaggtcatccgcgtcttttcttgcttggagcc

SEQ ID NO: 143339 - DNA, 75 bp, Artificial Sequence
  Synthetic
cgagtctcttgatggttctcttggtcttccggagccttgtctcgaggtcttccgcatcttttcttgcttggagcc

SEQ ID NO: 143340 - DNA, 75 bp, Artificial Sequence
  Synthetic
cgagtctcttgatggttctcttggtcttccggagccttgtctcgaggtcttccgcttcttttcttgcttggagcc

SEQ ID NO: 143341 - DNA, 75 bp, Artificial Sequence
  Synthetic
cgagtctcttgatggttctcttggtcttccggagccttgtctcgaggtcttccgcctcttttcttgcttggagcc

SEQ ID NO: 143342 - DNA, 75 bp, Artificial Sequence
  Synthetic
cgagtctcttgatggttctcttggtcttccggagccttgtctcgaggtcttccgcgtcttttcttgcttggagcc

SEQ ID NO: 143343 - DNA, 75 bp, Artificial Sequence
  Synthetic
cgagtctcttgatggttctcttggtcttccggagccttgtctcgaggtcctccgcatcttttcttgcttggagcc

SEQ ID NO: 143344 - DNA, 75 bp, Artificial Sequence
  Synthetic
cgagtctcttgatggttctcttggtcttccggagccttgtctcgaggtcctccgcttcttttcttgcttggagcc

SEQ ID NO: 143345 - DNA, 75 bp, Artificial Sequence
  Synthetic
cgagtctcttgatggttctcttggtcttccggagccttgtctcgaggtcctccgcctcttttcttgcttggagcc

SEQ ID NO: 143346 - DNA, 75 bp, Artificial Sequence
  Synthetic
cgagtctcttgatggttctcttggtcttccggagccttgtctcgaggtcctccgcgtcttttcttgcttggagcc

SEQ ID NO: 143347 - DNA, 75 bp, Artificial Sequence
  Synthetic
cgagtctcttgatggttctcttggtcttccggagccttgtctcgaggtcgtccgcatcttttcttgcttggagcc

SEQ ID NO: 143348 - DNA, 75 bp, Artificial Sequence
  Synthetic
cgagtctcttgatggttctcttggtcttccggagccttgtctcgaggtcgtccgcttcttttcttgcttggagcc

SEQ ID NO: 143349 - DNA, 75 bp, Artificial Sequence
  Synthetic
cgagtctcttgatggttctcttggtcttccggagccttgtctcgaggtcgtccgcctcttttcttgcttggagcc

SEQ ID NO: 143350 - DNA, 75 bp, Artificial Sequence
  Synthetic
cgagtctcttgatggttctcttggtcttccggagccttgtctcgaggtcgtccgcgtcttttcttgcttggagcc

SEQ ID NO: 143351 - DNA, 75 bp, Artificial Sequence
  Synthetic
cttccggagccttatctcgaggtcatccgcttcttttcttgcttggatccatttctcgaggatctcctcccttcc

SEQ ID NO: 143352 - DNA, 75 bp, Artificial Sequence
  Synthetic
cttccggagccttatctcgaggtcatccgcttcttttcttgcttggatccatttctcgaggttctcctcccttcc

SEQ ID NO: 143353 - DNA, 75 bp, Artificial Sequence
  Synthetic
cttccggagccttatctcgaggtcatccgcttcttttcttgcttggatccatttctcgaggctctcctcccttcc

SEQ ID NO: 143354 - DNA, 75 bp, Artificial Sequence
  Synthetic
cttccggagccttatctcgaggtcatccgcttcttttcttgcttggatccatttctcgagggtctcctcccttcc

SEQ ID NO: 143355 - DNA, 75 bp, Artificial Sequence
  Synthetic
cttccggagccttatctcgaggtcttccgcttcttttcttgcttggatccatttctcgaggatctcctcccttcc

SEQ ID NO: 143356 - DNA, 75 bp, Artificial Sequence
  Synthetic
cttccggagccttatctcgaggtcttccgcttcttttcttgcttggatccatttctcgaggttctcctcccttcc

SEQ ID NO: 143357 - DNA, 75 bp, Artificial Sequence
  Synthetic
cttccggagccttatctcgaggtcttccgcttcttttcttgcttggatccatttctcgaggctctcctcccttcc

SEQ ID NO: 143358 - DNA, 75 bp, Artificial Sequence
  Synthetic
cttccggagccttatctcgaggtcttccgcttcttttcttgcttggatccatttctcgagggtctcctcccttcc

SEQ ID NO: 143359 - DNA, 75 bp, Artificial Sequence
  Synthetic
cttccggagccttatctcgaggtcctccgcttcttttcttgcttggatccatttctcgaggatctcctcccttcc

SEQ ID NO: 143360 - DNA, 75 bp, Artificial Sequence
  Synthetic
cttccggagccttatctcgaggtcctccgcttcttttcttgcttggatccatttctcgaggttctcctcccttcc

SEQ ID NO: 143361 - DNA, 75 bp, Artificial Sequence
  Synthetic
cttccggagccttatctcgaggtcctccgcttcttttcttgcttggatccatttctcgaggctctcctcccttcc

SEQ ID NO: 143362 - DNA, 75 bp, Artificial Sequence
  Synthetic
cttccggagccttatctcgaggtcctccgcttcttttcttgcttggatccatttctcgagggtctcctcccttcc

SEQ ID NO: 143363 - DNA, 75 bp, Artificial Sequence
  Synthetic
cttccggagccttatctcgaggtcgtccgcttcttttcttgcttggatccatttctcgaggatctcctcccttcc

SEQ ID NO: 143364 - DNA, 75 bp, Artificial Sequence
  Synthetic
cttccggagccttatctcgaggtcgtccgcttcttttcttgcttggatccatttctcgaggttctcctcccttcc

SEQ ID NO: 143365 - DNA, 75 bp, Artificial Sequence
  Synthetic
cttccggagccttatctcgaggtcgtccgcttcttttcttgcttggatccatttctcgaggctctcctcccttcc

SEQ ID NO: 143366 - DNA, 75 bp, Artificial Sequence
  Synthetic
cttccggagccttatctcgaggtcgtccgcttcttttcttgcttggatccatttctcgagggtctcctcccttcc

SEQ ID NO: 143367 - DNA, 75 bp, Artificial Sequence
  Synthetic
cttccggagccttttctcgaggtcatccgcttcttttcttgcttggatccatttctcgaggatctcctcccttcc

SEQ ID NO: 143368 - DNA, 75 bp, Artificial Sequence
  Synthetic
cttccggagccttttctcgaggtcatccgcttcttttcttgcttggatccatttctcgaggttctcctcccttcc

SEQ ID NO: 143369 - DNA, 75 bp, Artificial Sequence
  Synthetic
cttccggagccttttctcgaggtcatccgcttcttttcttgcttggatccatttctcgaggctctcctcccttcc

SEQ ID NO: 143370 - DNA, 75 bp, Artificial Sequence
  Synthetic
cttccggagccttttctcgaggtcatccgcttcttttcttgcttggatccatttctcgagggtctcctcccttcc

SEQ ID NO: 143371 - DNA, 75 bp, Artificial Sequence
  Synthetic
cttccggagccttttctcgaggtcttccgcttcttttcttgcttggatccatttctcgaggatctcctcccttcc

SEQ ID NO: 143372 - DNA, 75 bp, Artificial Sequence
  Synthetic
cttccggagccttttctcgaggtcttccgcttcttttcttgcttggatccatttctcgaggttctcctcccttcc

SEQ ID NO: 143373 - DNA, 75 bp, Artificial Sequence
  Synthetic
cttccggagccttttctcgaggtcttccgcttcttttcttgcttggatccatttctcgaggctctcctcccttcc

SEQ ID NO: 143374 - DNA, 75 bp, Artificial Sequence
  Synthetic
cttccggagccttttctcgaggtcttccgcttcttttcttgcttggatccatttctcgagggtctcctcccttcc

SEQ ID NO: 143375 - DNA, 75 bp, Artificial Sequence
  Synthetic
cttccggagccttttctcgaggtcctccgcttcttttcttgcttggatccatttctcgaggatctcctcccttcc

SEQ ID NO: 143376 - DNA, 75 bp, Artificial Sequence
  Synthetic
cttccggagccttttctcgaggtcctccgcttcttttcttgcttggatccatttctcgaggttctcctcccttcc

SEQ ID NO: 143377 - DNA, 75 bp, Artificial Sequence
  Synthetic
cttccggagccttttctcgaggtcctccgcttcttttcttgcttggatccatttctcgaggctctcctcccttcc

SEQ ID NO: 143378 - DNA, 75 bp, Artificial Sequence
  Synthetic
cttccggagccttttctcgaggtcctccgcttcttttcttgcttggatccatttctcgagggtctcctcccttcc

SEQ ID NO: 143379 - DNA, 75 bp, Artificial Sequence
  Synthetic
cttccggagccttttctcgaggtcgtccgcttcttttcttgcttggatccatttctcgaggatctcctcccttcc

SEQ ID NO: 143380 - DNA, 75 bp, Artificial Sequence
  Synthetic
cttccggagccttttctcgaggtcgtccgcttcttttcttgcttggatccatttctcgaggttctcctcccttcc

SEQ ID NO: 143381 - DNA, 75 bp, Artificial Sequence
  Synthetic
cttccggagccttttctcgaggtcgtccgcttcttttcttgcttggatccatttctcgaggctctcctcccttcc

SEQ ID NO: 143382 - DNA, 75 bp, Artificial Sequence
  Synthetic
cttccggagccttttctcgaggtcgtccgcttcttttcttgcttggatccatttctcgagggtctcctcccttcc

SEQ ID NO: 143383 - DNA, 75 bp, Artificial Sequence
  Synthetic
cttccggagccttctctcgaggtcatccgcttcttttcttgcttggatccatttctcgaggatctcctcccttcc

SEQ ID NO: 143384 - DNA, 75 bp, Artificial Sequence
  Synthetic
cttccggagccttctctcgaggtcatccgcttcttttcttgcttggatccatttctcgaggttctcctcccttcc

SEQ ID NO: 143385 - DNA, 75 bp, Artificial Sequence
  Synthetic
cttccggagccttctctcgaggtcatccgcttcttttcttgcttggatccatttctcgaggctctcctcccttcc

SEQ ID NO: 143386 - DNA, 75 bp, Artificial Sequence
  Synthetic
cttccggagccttctctcgaggtcatccgcttcttttcttgcttggatccatttctcgagggtctcctcccttcc

SEQ ID NO: 143387 - DNA, 75 bp, Artificial Sequence
  Synthetic
cttccggagccttctctcgaggtcttccgcttcttttcttgcttggatccatttctcgaggatctcctcccttcc

SEQ ID NO: 143388 - DNA, 75 bp, Artificial Sequence
  Synthetic
cttccggagccttctctcgaggtcttccgcttcttttcttgcttggatccatttctcgaggttctcctcccttcc

SEQ ID NO: 143389 - DNA, 75 bp, Artificial Sequence
  Synthetic
cttccggagccttctctcgaggtcttccgcttcttttcttgcttggatccatttctcgaggctctcctcccttcc

SEQ ID NO: 143390 - DNA, 75 bp, Artificial Sequence
  Synthetic
cttccggagccttctctcgaggtcttccgcttcttttcttgcttggatccatttctcgagggtctcctcccttcc

SEQ ID NO: 143391 - DNA, 75 bp, Artificial Sequence
  Synthetic
cttccggagccttctctcgaggtcctccgcttcttttcttgcttggatccatttctcgaggatctcctcccttcc

SEQ ID NO: 143392 - DNA, 75 bp, Artificial Sequence
  Synthetic
cttccggagccttctctcgaggtcctccgcttcttttcttgcttggatccatttctcgaggttctcctcccttcc

SEQ ID NO: 143393 - DNA, 75 bp, Artificial Sequence
  Synthetic
cttccggagccttctctcgaggtcctccgcttcttttcttgcttggatccatttctcgaggctctcctcccttcc

SEQ ID NO: 143394 - DNA, 75 bp, Artificial Sequence
  Synthetic
cttccggagccttctctcgaggtcctccgcttcttttcttgcttggatccatttctcgagggtctcctcccttcc

SEQ ID NO: 143395 - DNA, 75 bp, Artificial Sequence
  Synthetic
cttccggagccttctctcgaggtcgtccgcttcttttcttgcttggatccatttctcgaggatctcctcccttcc

SEQ ID NO: 143396 - DNA, 75 bp, Artificial Sequence
  Synthetic
cttccggagccttctctcgaggtcgtccgcttcttttcttgcttggatccatttctcgaggttctcctcccttcc

SEQ ID NO: 143397 - DNA, 75 bp, Artificial Sequence
  Synthetic
cttccggagccttctctcgaggtcgtccgcttcttttcttgcttggatccatttctcgaggctctcctcccttcc

SEQ ID NO: 143398 - DNA, 75 bp, Artificial Sequence
  Synthetic
cttccggagccttctctcgaggtcgtccgcttcttttcttgcttggatccatttctcgagggtctcctcccttcc

SEQ ID NO: 143399 - DNA, 75 bp, Artificial Sequence
  Synthetic
cttccggagccttgtctcgaggtcatccgcttcttttcttgcttggatccatttctcgaggatctcctcccttcc

SEQ ID NO: 143400 - DNA, 75 bp, Artificial Sequence
  Synthetic
cttccggagccttgtctcgaggtcatccgcttcttttcttgcttggatccatttctcgaggttctcctcccttcc

SEQ ID NO: 143401 - DNA, 75 bp, Artificial Sequence
  Synthetic
cttccggagccttgtctcgaggtcatccgcttcttttcttgcttggatccatttctcgaggctctcctcccttcc

SEQ ID NO: 143402 - DNA, 75 bp, Artificial Sequence
  Synthetic
cttccggagccttgtctcgaggtcatccgcttcttttcttgcttggatccatttctcgagggtctcctcccttcc

SEQ ID NO: 143403 - DNA, 75 bp, Artificial Sequence
  Synthetic
cttccggagccttgtctcgaggtcttccgcttcttttcttgcttggatccatttctcgaggatctcctcccttcc

SEQ ID NO: 143404 - DNA, 75 bp, Artificial Sequence
  Synthetic
cttccggagccttgtctcgaggtcttccgcttcttttcttgcttggatccatttctcgaggttctcctcccttcc

SEQ ID NO: 143405 - DNA, 75 bp, Artificial Sequence
  Synthetic
cttccggagccttgtctcgaggtcttccgcttcttttcttgcttggatccatttctcgaggctctcctcccttcc

SEQ ID NO: 143406 - DNA, 75 bp, Artificial Sequence
  Synthetic
cttccggagccttgtctcgaggtcttccgcttcttttcttgcttggatccatttctcgagggtctcctcccttcc

SEQ ID NO: 143407 - DNA, 75 bp, Artificial Sequence
  Synthetic
cttccggagccttgtctcgaggtcctccgcttcttttcttgcttggatccatttctcgaggatctcctcccttcc

SEQ ID NO: 143408 - DNA, 75 bp, Artificial Sequence
  Synthetic
cttccggagccttgtctcgaggtcctccgcttcttttcttgcttggatccatttctcgaggttctcctcccttcc

SEQ ID NO: 143409 - DNA, 75 bp, Artificial Sequence
  Synthetic
cttccggagccttgtctcgaggtcctccgcttcttttcttgcttggatccatttctcgaggctctcctcccttcc

SEQ ID NO: 143410 - DNA, 75 bp, Artificial Sequence
  Synthetic
cttccggagccttgtctcgaggtcctccgcttcttttcttgcttggatccatttctcgagggtctcctcccttcc

SEQ ID NO: 143411 - DNA, 75 bp, Artificial Sequence
  Synthetic
cttccggagccttgtctcgaggtcgtccgcttcttttcttgcttggatccatttctcgaggatctcctcccttcc

SEQ ID NO: 143412 - DNA, 75 bp, Artificial Sequence
  Synthetic
cttccggagccttgtctcgaggtcgtccgcttcttttcttgcttggatccatttctcgaggttctcctcccttcc

SEQ ID NO: 143413 - DNA, 75 bp, Artificial Sequence
  Synthetic
cttccggagccttgtctcgaggtcgtccgcttcttttcttgcttggatccatttctcgaggctctcctcccttcc

SEQ ID NO: 143414 - DNA, 75 bp, Artificial Sequence
  Synthetic
cttccggagccttgtctcgaggtcgtccgcttcttttcttgcttggatccatttctcgagggtctcctcccttcc

SEQ ID NO: 143415 - DNA, 75 bp, Artificial Sequence
  Synthetic
tcccctccgggatttcttctgttcggactggctcatcctcggatagggggcgacggcgtctgttctctattttct

SEQ ID NO: 143416 - DNA, 75 bp, Artificial Sequence
  Synthetic
gggcgacggcgtctgttctctattttcttcgttctaagaagaggagaaagcgtgccgcccgcccccagccccggg

SEQ ID NO: 143417 - DNA, 75 bp, Artificial Sequence
  Synthetic
gggcgacggcgtctgttctctattttcttcgttctaagaagaggagatagcgtgccgcccgcccccagccccggg

SEQ ID NO: 143418 - DNA, 75 bp, Artificial Sequence
  Synthetic
gggcgacggcgtctgttctctattttcttcgttctaagaagaggagacagcgtgccgcccgcccccagccccggg

SEQ ID NO: 143419 - DNA, 75 bp, Artificial Sequence
  Synthetic
gggcgacggcgtctgttctctattttcttcgttctaagaagaggagagagcgtgccgcccgcccccagccccggg

SEQ ID NO: 143420 - DNA, 75 bp, Artificial Sequence
  Synthetic
ccaggagaaggcagaaaaaccacctccagaggaccccttcagcgaacagagaagcactctgaggcgtcaggagag

SEQ ID NO: 143421 - DNA, 75 bp, Artificial Sequence
  Synthetic
ccaggagaaggcagaaaaaccacctccagaggaccccttcagcgaacagagaagcactctgaggcgtctggagag

SEQ ID NO: 143422 - DNA, 75 bp, Artificial Sequence
  Synthetic
ccaggagaaggcagaaaaaccacctccagaggaccccttcagcgaacagagaagcactctgaggcgtccggagag

SEQ ID NO: 143423 - DNA, 75 bp, Artificial Sequence
  Synthetic
ccaggagaaggcagaaaaaccacctccagaggaccccttcagcgaacagagaagcactctgaggcgtcgggagag

SEQ ID NO: 143424 - DNA, 75 bp, Artificial Sequence
  Synthetic
ccaggagaaggcagataaaccacctccagaggaccccttcagcgaacagagaagcactctgaggcgtcaggagag

SEQ ID NO: 143425 - DNA, 75 bp, Artificial Sequence
  Synthetic
ccaggagaaggcagataaaccacctccagaggaccccttcagcgaacagagaagcactctgaggcgtctggagag

SEQ ID NO: 143426 - DNA, 75 bp, Artificial Sequence
  Synthetic
ccaggagaaggcagataaaccacctccagaggaccccttcagcgaacagagaagcactctgaggcgtccggagag

SEQ ID NO: 143427 - DNA, 75 bp, Artificial Sequence
  Synthetic
ccaggagaaggcagataaaccacctccagaggaccccttcagcgaacagagaagcactctgaggcgtcgggagag

SEQ ID NO: 143428 - DNA, 75 bp, Artificial Sequence
  Synthetic
ccaggagaaggcagacaaaccacctccagaggaccccttcagcgaacagagaagcactctgaggcgtcaggagag

SEQ ID NO: 143429 - DNA, 75 bp, Artificial Sequence
  Synthetic
ccaggagaaggcagacaaaccacctccagaggaccccttcagcgaacagagaagcactctgaggcgtctggagag

SEQ ID NO: 143430 - DNA, 75 bp, Artificial Sequence
  Synthetic
ccaggagaaggcagacaaaccacctccagaggaccccttcagcgaacagagaagcactctgaggcgtccggagag

SEQ ID NO: 143431 - DNA, 75 bp, Artificial Sequence
  Synthetic
ccaggagaaggcagacaaaccacctccagaggaccccttcagcgaacagagaagcactctgaggcgtcgggagag

SEQ ID NO: 143432 - DNA, 75 bp, Artificial Sequence
  Synthetic
ccaggagaaggcagagaaaccacctccagaggaccccttcagcgaacagagaagcactctgaggcgtcaggagag

SEQ ID NO: 143433 - DNA, 75 bp, Artificial Sequence
  Synthetic
ccaggagaaggcagagaaaccacctccagaggaccccttcagcgaacagagaagcactctgaggcgtctggagag

SEQ ID NO: 143434 - DNA, 75 bp, Artificial Sequence
  Synthetic
ccaggagaaggcagagaaaccacctccagaggaccccttcagcgaacagagaagcactctgaggcgtccggagag

SEQ ID NO: 143435 - DNA, 75 bp, Artificial Sequence
  Synthetic
ccaggagaaggcagagaaaccacctccagaggaccccttcagcgaacagagaagcactctgaggcgtcgggagag

SEQ ID NO: 143436 - DNA, 75 bp, Artificial Sequence
  Synthetic
tttggagagcactccgggccgaagggttgagtagcactcagagggaggaatccactcggagtagaacagagaaat

SEQ ID NO: 143437 - DNA, 75 bp, Artificial Sequence
  Synthetic
gttgagtagcactcagagggaggaatccactcggagtagaacagagaaatcacctccagaggaccccttcagcga

SEQ ID NO: 143438 - DNA, 75 bp, Artificial Sequence
  Synthetic
ccatccttatccttctttccgagaattcctttgatgtttcccagccagggattgtcctcctcaagtttcttgagt

SEQ ID NO: 143439 - DNA, 75 bp, Artificial Sequence
  Synthetic
gcgaggaggaaagtaaagaaagcaacggggctagccgtcaggtgttccaccccccgagaggggacgagtgaggct

SEQ ID NO: 143440 - DNA, 75 bp, Artificial Sequence
  Synthetic
ttcttctttgtcttccggagatccctctcgagatcctcgactttttttcttccactcacccactgctcgagaatc

SEQ ID NO: 143441 - DNA, 75 bp, Artificial Sequence
  Synthetic
tatcccggggaactcggcgaatcgtccccacatagcagctcccaggacccccttccaaaagtgaccgaagggggt

SEQ ID NO: 143442 - DNA, 75 bp, Artificial Sequence
  Synthetic
atgggccaagtccgacgaagagatcgaggacttggggagaggacaggtcccgaggaggggttcgaactttaagaa

SEQ ID NO: 143443 - DNA, 75 bp, Artificial Sequence
  Synthetic
gaggacttggggagaggacaggtcccgaggaggggttcgaactttaagaagggaagatcgtcgaggaaatactcc

SEQ ID NO: 143444 - DNA, 75 bp, Artificial Sequence
  Synthetic
cgaggaggggttcgaactttaagaagggaagatcgtcgaggaaatactcccaagaattcccggaggcatgccaag

SEQ ID NO: 143445 - DNA, 75 bp, Artificial Sequence
  Synthetic
aagcggaagaatctcccccagggcttcggaagagtcagggaaccaggaaatgggaaagaaatggtagaaaagagc

SEQ ID NO: 143446 - DNA, 75 bp, Artificial Sequence
  Synthetic
tcggaagagtcagggaaccaggaaatgggaaagaaatggtagaaaagagcgagcctcccgaatccgagttgcccc

SEQ ID NO: 143447 - DNA, 75 bp, Artificial Sequence
  Synthetic
ggacctatctaaattggagtcatccgaccgataaggagaaaggttccgacaagaggtgatccactgagggtttgc

SEQ ID NO: 143448 - DNA, 75 bp, Artificial Sequence
  Synthetic
ggacctatctaaattggagtcatccgaccgataaggagtaaggttccgacaagaggtgatccactgagggtttgc

SEQ ID NO: 143449 - DNA, 75 bp, Artificial Sequence
  Synthetic
ggacctatctaaattggagtcatccgaccgataaggagcaaggttccgacaagaggtgatccactgagggtttgc

SEQ ID NO: 143450 - DNA, 75 bp, Artificial Sequence
  Synthetic
ggacctatctaaattggagtcatccgaccgataaggaggaaggttccgacaagaggtgatccactgagggtttgc

SEQ ID NO: 143451 - DNA, 75 bp, Artificial Sequence
  Synthetic
ctctctagattccgatagagaatcgagagaaaactggctctcccttagccatccgaggtggacgtctgtcctcct

SEQ ID NO: 143452 - DNA, 75 bp, Artificial Sequence
  Synthetic
gaccgataaggagaaaggttccgacaagaggtgatccactgagggtttgcggagaaaccacctccagaagaaccc

SEQ ID NO: 143453 - DNA, 75 bp, Artificial Sequence
  Synthetic
gaccgataaggagtaaggttccgacaagaggtgatccactgagggtttgcggagaaaccacctccagaagaaccc

SEQ ID NO: 143454 - DNA, 75 bp, Artificial Sequence
  Synthetic
gaccgataaggagcaaggttccgacaagaggtgatccactgagggtttgcggagaaaccacctccagaagaaccc

SEQ ID NO: 143455 - DNA, 75 bp, Artificial Sequence
  Synthetic
gaccgataaggaggaaggttccgacaagaggtgatccactgagggtttgcggagaaaccacctccagaagaaccc

SEQ ID NO: 143456 - DNA, 75 bp, Artificial Sequence
  Synthetic
cttcagcgaacagaagagactgagttccccagaggaagaccatagcgatagggggagatgctaggagtctggggc

SEQ ID NO: 143457 - DNA, 75 bp, Artificial Sequence
  Synthetic
tccccagaggaagaccatagcgatagggggagatgctaggagtctggggcggccagaacgagaggcaaagtaaag

SEQ ID NO: 143458 - DNA, 75 bp, Artificial Sequence
  Synthetic
aaagcaacggggctagcgagtggatgttccgcctccccggggagccgagtgaggcttatcccgggggaaacggct

SEQ ID NO: 143459 - DNA, 75 bp, Artificial Sequence
  Synthetic
tttcccctcacgtccagcccctccccggtccgagtgaagggggactccgggatgccttgcatgctggggacgaag

SEQ ID NO: 143460 - DNA, 75 bp, Artificial Sequence
  Synthetic
aagtccctccatgacccgctccacggctcccttccaaaggtcggggaggactggaacgtagggctccagcagtcc

SEQ ID NO: 143461 - DNA, 75 bp, Artificial Sequence
  Synthetic
aagtccctccatgtcccgctccacggctcccttccaaaggtcggggaggactggaacgtagggctccagcagtcc

SEQ ID NO: 143462 - DNA, 75 bp, Artificial Sequence
  Synthetic
aagtccctccatgccccgctccacggctcccttccaaaggtcggggaggactggaacgtagggctccagcagtcc

SEQ ID NO: 143463 - DNA, 75 bp, Artificial Sequence
  Synthetic
aagtccctccatggcccgctccacggctcccttccaaaggtcggggaggactggaacgtagggctccagcagtcc

SEQ ID NO: 143464 - DNA, 75 bp, Artificial Sequence
  Synthetic
ccgcccccgggcgctcccctcgatccaccttcgagggggttcacacctccagtcggcgggccggctactcttctt

SEQ ID NO: 143465 - DNA, 75 bp, Artificial Sequence
  Synthetic
cctttcttacctgatggccggcatggtcccagcctcctcgctggcgccggctgggcaacattccgaggggaccgt

SEQ ID NO: 143466 - DNA, 75 bp, Artificial Sequence
  Synthetic
cctctccttgtcggtgaatcctcccctgagaggcctcttcctaggcccggagtctacctccatctggtctgttcg

SEQ ID NO: 143467 - DNA, 75 bp, Artificial Sequence
  Synthetic
ctgagaggcctcttcctaggcccggagtctacctccatctggtctgttcgggccctcttcgccgggggagccccc

SEQ ID NO: 143468 - DNA, 75 bp, Artificial Sequence
  Synthetic
tctccgtctttgtccttctttccgagaattcctttgatgtttcccagccagggattttcgtcctcagtttcttga

SEQ ID NO: 143469 - DNA, 75 bp, Artificial Sequence
  Synthetic
ttttcttctttgtcttccggagctccctctcgagttcttctaacttttttcttccactcacccactgctcgagaa

SEQ ID NO: 143470 - DNA, 75 bp, Artificial Sequence
  Synthetic
gttctttattggggagtacactcgaggagtggaaggcggggagggcggggaggagtgttaccccatgggaactgc

SEQ ID NO: 143471 - DNA, 75 bp, Artificial Sequence
  Synthetic
ggagtggaaggcggggagggcggggaggagtgttaccccatgggaactgctggattcccctcacgtccagcccgt

SEQ ID NO: 143472 - DNA, 75 bp, Artificial Sequence
  Synthetic
ggagtggaaggcggggagggcggggaggagtgttaccccatgggaactgctggtttcccctcacgtccagcccgt

SEQ ID NO: 143473 - DNA, 75 bp, Artificial Sequence
  Synthetic
ggagtggaaggcggggagggcggggaggagtgttaccccatgggaactgctggcttcccctcacgtccagcccgt

SEQ ID NO: 143474 - DNA, 75 bp, Artificial Sequence
  Synthetic
ggagtggaaggcggggagggcggggaggagtgttaccccatgggaactgctgggttcccctcacgtccagcccgt

SEQ ID NO: 143475 - DNA, 75 bp, Artificial Sequence
  Synthetic
cctctcgagttcttctaacttttttcttccactcacccactgctcgagaatctcttctctttccatcgcgcttct

SEQ ID NO: 143476 - DNA, 75 bp, Artificial Sequence
  Synthetic
ctcccgtccgggagaatggagattcgggaacgtgaagcatggttgggacgaagccccctccgggcgctcccctcg

SEQ ID NO: 143477 - DNA, 75 bp, Artificial Sequence
  Synthetic
ctcccgtccgggagaatggagattcgggaacgtgtagcatggttgggacgaagccccctccgggcgctcccctcg

SEQ ID NO: 143478 - DNA, 75 bp, Artificial Sequence
  Synthetic
ctcccgtccgggagaatggagattcgggaacgtgcagcatggttgggacgaagccccctccgggcgctcccctcg

SEQ ID NO: 143479 - DNA, 75 bp, Artificial Sequence
  Synthetic
ctcccgtccgggagaatggagattcgggaacgtggagcatggttgggacgaagccccctccgggcgctcccctcg

SEQ ID NO: 143480 - DNA, 75 bp, Artificial Sequence
  Synthetic
gagcatgagccaattgccgaacgaggatggcgcgagaggaaggatcagaggacgagaggggatgagatggtaaag

SEQ ID NO: 143481 - DNA, 75 bp, Artificial Sequence
  Synthetic
gatggcgcgagaggaaggatcagaggacgagaggggatgagatggtaaagaagcgaggaacgccgaggggatgtc

SEQ ID NO: 143482 - DNA, 75 bp, Artificial Sequence
  Synthetic
cttttcctttgctcgtcatccttggccagcctcaggagttcctcttcttcctccttgctgaggctcttccctccg

SEQ ID NO: 143483 - DNA, 75 bp, Artificial Sequence
  Synthetic
tcccaagaaggcaaagagaaggcaagaatcggacgctctccccacgacgctggagacatcctggaaggggaaaga

SEQ ID NO: 143484 - DNA, 75 bp, Artificial Sequence
  Synthetic
tggagacatcctggaaggggaaagaggcaaaacggaagagaagggggggcctcccgatccgaggggcccaaccac

SEQ ID NO: 143485 - DNA, 75 bp, Artificial Sequence
  Synthetic
cttgagccaagttccgagcgaggagacgcggggggaggatcagctcccgagaggggatgtcacggtaaagagcat

SEQ ID NO: 143486 - DNA, 75 bp, Artificial Sequence
  Synthetic
acgcggggggaggatcagctcccgagaggggatgtcacggtaaagagcattggaacgtcggagaaactactccca

SEQ ID NO: 143487 - DNA, 75 bp, Artificial Sequence
  Synthetic
gacttgtgcggcatcccccaaggtccggagtcgatctccattagatccgtccggggcttcttcgccgggggagct

SEQ ID NO: 143488 - DNA, 75 bp, Artificial Sequence
  Synthetic
gacttgtgcggcatcccccaaggtccggagtcgatctccatttgatccgtccggggcttcttcgccgggggagct

SEQ ID NO: 143489 - DNA, 75 bp, Artificial Sequence
  Synthetic
gacttgtgcggcatcccccaaggtccggagtcgatctccattcgatccgtccggggcttcttcgccgggggagct

SEQ ID NO: 143490 - DNA, 75 bp, Artificial Sequence
  Synthetic
gacttgtgcggcatcccccaaggtccggagtcgatctccattggatccgtccggggcttcttcgccgggggagct

SEQ ID NO: 143491 - DNA, 75 bp, Artificial Sequence
  Synthetic
gacttgtgcggcatccccctaggtccggagtcgatctccattagatccgtccggggcttcttcgccgggggagct

SEQ ID NO: 143492 - DNA, 75 bp, Artificial Sequence
  Synthetic
gacttgtgcggcatccccctaggtccggagtcgatctccatttgatccgtccggggcttcttcgccgggggagct

SEQ ID NO: 143493 - DNA, 75 bp, Artificial Sequence
  Synthetic
gacttgtgcggcatccccctaggtccggagtcgatctccattcgatccgtccggggcttcttcgccgggggagct

SEQ ID NO: 143494 - DNA, 75 bp, Artificial Sequence
  Synthetic
gacttgtgcggcatccccctaggtccggagtcgatctccattggatccgtccggggcttcttcgccgggggagct

SEQ ID NO: 143495 - DNA, 75 bp, Artificial Sequence
  Synthetic
gacttgtgcggcatccccccaggtccggagtcgatctccattagatccgtccggggcttcttcgccgggggagct

SEQ ID NO: 143496 - DNA, 75 bp, Artificial Sequence
  Synthetic
gacttgtgcggcatccccccaggtccggagtcgatctccatttgatccgtccggggcttcttcgccgggggagct

SEQ ID NO: 143497 - DNA, 75 bp, Artificial Sequence
  Synthetic
gacttgtgcggcatccccccaggtccggagtcgatctccattcgatccgtccggggcttcttcgccgggggagct

SEQ ID NO: 143498 - DNA, 75 bp, Artificial Sequence
  Synthetic
gacttgtgcggcatccccccaggtccggagtcgatctccattggatccgtccggggcttcttcgccgggggagct

SEQ ID NO: 143499 - DNA, 75 bp, Artificial Sequence
  Synthetic
gacttgtgcggcatcccccgaggtccggagtcgatctccattagatccgtccggggcttcttcgccgggggagct

SEQ ID NO: 143500 - DNA, 75 bp, Artificial Sequence
  Synthetic
gacttgtgcggcatcccccgaggtccggagtcgatctccatttgatccgtccggggcttcttcgccgggggagct

SEQ ID NO: 143501 - DNA, 75 bp, Artificial Sequence
  Synthetic
gacttgtgcggcatcccccgaggtccggagtcgatctccattcgatccgtccggggcttcttcgccgggggagct

SEQ ID NO: 143502 - DNA, 75 bp, Artificial Sequence
  Synthetic
gacttgtgcggcatcccccgaggtccggagtcgatctccattggatccgtccggggcttcttcgccgggggagct

SEQ ID NO: 143503 - DNA, 75 bp, Artificial Sequence
  Synthetic
gacttgtgcggcttcccccaaggtccggagtcgatctccattagatccgtccggggcttcttcgccgggggagct

SEQ ID NO: 143504 - DNA, 75 bp, Artificial Sequence
  Synthetic
gacttgtgcggcttcccccaaggtccggagtcgatctccatttgatccgtccggggcttcttcgccgggggagct

SEQ ID NO: 143505 - DNA, 75 bp, Artificial Sequence
  Synthetic
gacttgtgcggcttcccccaaggtccggagtcgatctccattcgatccgtccggggcttcttcgccgggggagct

SEQ ID NO: 143506 - DNA, 75 bp, Artificial Sequence
  Synthetic
gacttgtgcggcttcccccaaggtccggagtcgatctccattggatccgtccggggcttcttcgccgggggagct

SEQ ID NO: 143507 - DNA, 75 bp, Artificial Sequence
  Synthetic
gacttgtgcggcttccccctaggtccggagtcgatctccattagatccgtccggggcttcttcgccgggggagct

SEQ ID NO: 143508 - DNA, 75 bp, Artificial Sequence
  Synthetic
gacttgtgcggcttccccctaggtccggagtcgatctccatttgatccgtccggggcttcttcgccgggggagct

SEQ ID NO: 143509 - DNA, 75 bp, Artificial Sequence
  Synthetic
gacttgtgcggcttccccctaggtccggagtcgatctccattcgatccgtccggggcttcttcgccgggggagct

SEQ ID NO: 143510 - DNA, 75 bp, Artificial Sequence
  Synthetic
gacttgtgcggcttccccctaggtccggagtcgatctccattggatccgtccggggcttcttcgccgggggagct

SEQ ID NO: 143511 - DNA, 75 bp, Artificial Sequence
  Synthetic
gacttgtgcggcttccccccaggtccggagtcgatctccattagatccgtccggggcttcttcgccgggggagct

SEQ ID NO: 143512 - DNA, 75 bp, Artificial Sequence
  Synthetic
gacttgtgcggcttccccccaggtccggagtcgatctccatttgatccgtccggggcttcttcgccgggggagct

SEQ ID NO: 143513 - DNA, 75 bp, Artificial Sequence
  Synthetic
gacttgtgcggcttccccccaggtccggagtcgatctccattcgatccgtccggggcttcttcgccgggggagct

SEQ ID NO: 143514 - DNA, 75 bp, Artificial Sequence
  Synthetic
gacttgtgcggcttccccccaggtccggagtcgatctccattggatccgtccggggcttcttcgccgggggagct

SEQ ID NO: 143515 - DNA, 75 bp, Artificial Sequence
  Synthetic
gacttgtgcggcttcccccgaggtccggagtcgatctccattagatccgtccggggcttcttcgccgggggagct

SEQ ID NO: 143516 - DNA, 75 bp, Artificial Sequence
  Synthetic
gacttgtgcggcttcccccgaggtccggagtcgatctccatttgatccgtccggggcttcttcgccgggggagct

SEQ ID NO: 143517 - DNA, 75 bp, Artificial Sequence
  Synthetic
gacttgtgcggcttcccccgaggtccggagtcgatctccattcgatccgtccggggcttcttcgccgggggagct

SEQ ID NO: 143518 - DNA, 75 bp, Artificial Sequence
  Synthetic
gacttgtgcggcttcccccgaggtccggagtcgatctccattggatccgtccggggcttcttcgccgggggagct

SEQ ID NO: 143519 - DNA, 75 bp, Artificial Sequence
  Synthetic
gacttgtgcggcctcccccaaggtccggagtcgatctccattagatccgtccggggcttcttcgccgggggagct

SEQ ID NO: 143520 - DNA, 75 bp, Artificial Sequence
  Synthetic
gacttgtgcggcctcccccaaggtccggagtcgatctccatttgatccgtccggggcttcttcgccgggggagct

SEQ ID NO: 143521 - DNA, 75 bp, Artificial Sequence
  Synthetic
gacttgtgcggcctcccccaaggtccggagtcgatctccattcgatccgtccggggcttcttcgccgggggagct

SEQ ID NO: 143522 - DNA, 75 bp, Artificial Sequence
  Synthetic
gacttgtgcggcctcccccaaggtccggagtcgatctccattggatccgtccggggcttcttcgccgggggagct

SEQ ID NO: 143523 - DNA, 75 bp, Artificial Sequence
  Synthetic
gacttgtgcggcctccccctaggtccggagtcgatctccattagatccgtccggggcttcttcgccgggggagct

SEQ ID NO: 143524 - DNA, 75 bp, Artificial Sequence
  Synthetic
gacttgtgcggcctccccctaggtccggagtcgatctccatttgatccgtccggggcttcttcgccgggggagct

SEQ ID NO: 143525 - DNA, 75 bp, Artificial Sequence
  Synthetic
gacttgtgcggcctccccctaggtccggagtcgatctccattcgatccgtccggggcttcttcgccgggggagct

SEQ ID NO: 143526 - DNA, 75 bp, Artificial Sequence
  Synthetic
gacttgtgcggcctccccctaggtccggagtcgatctccattggatccgtccggggcttcttcgccgggggagct

SEQ ID NO: 143527 - DNA, 75 bp, Artificial Sequence
  Synthetic
gacttgtgcggcctccccccaggtccggagtcgatctccattagatccgtccggggcttcttcgccgggggagct

SEQ ID NO: 143528 - DNA, 75 bp, Artificial Sequence
  Synthetic
gacttgtgcggcctccccccaggtccggagtcgatctccatttgatccgtccggggcttcttcgccgggggagct

SEQ ID NO: 143529 - DNA, 75 bp, Artificial Sequence
  Synthetic
gacttgtgcggcctccccccaggtccggagtcgatctccattcgatccgtccggggcttcttcgccgggggagct

SEQ ID NO: 143530 - DNA, 75 bp, Artificial Sequence
  Synthetic
gacttgtgcggcctccccccaggtccggagtcgatctccattggatccgtccggggcttcttcgccgggggagct

SEQ ID NO: 143531 - DNA, 75 bp, Artificial Sequence
  Synthetic
gacttgtgcggcctcccccgaggtccggagtcgatctccattagatccgtccggggcttcttcgccgggggagct

SEQ ID NO: 143532 - DNA, 75 bp, Artificial Sequence
  Synthetic
gacttgtgcggcctcccccgaggtccggagtcgatctccatttgatccgtccggggcttcttcgccgggggagct

SEQ ID NO: 143533 - DNA, 75 bp, Artificial Sequence
  Synthetic
gacttgtgcggcctcccccgaggtccggagtcgatctccattcgatccgtccggggcttcttcgccgggggagct

SEQ ID NO: 143534 - DNA, 75 bp, Artificial Sequence
  Synthetic
gacttgtgcggcctcccccgaggtccggagtcgatctccattggatccgtccggggcttcttcgccgggggagct

SEQ ID NO: 143535 - DNA, 75 bp, Artificial Sequence
  Synthetic
gacttgtgcggcgtcccccaaggtccggagtcgatctccattagatccgtccggggcttcttcgccgggggagct

SEQ ID NO: 143536 - DNA, 75 bp, Artificial Sequence
  Synthetic
gacttgtgcggcgtcccccaaggtccggagtcgatctccatttgatccgtccggggcttcttcgccgggggagct

SEQ ID NO: 143537 - DNA, 75 bp, Artificial Sequence
  Synthetic
gacttgtgcggcgtcccccaaggtccggagtcgatctccattcgatccgtccggggcttcttcgccgggggagct

SEQ ID NO: 143538 - DNA, 75 bp, Artificial Sequence
  Synthetic
gacttgtgcggcgtcccccaaggtccggagtcgatctccattggatccgtccggggcttcttcgccgggggagct

SEQ ID NO: 143539 - DNA, 75 bp, Artificial Sequence
  Synthetic
gacttgtgcggcgtccccctaggtccggagtcgatctccattagatccgtccggggcttcttcgccgggggagct

SEQ ID NO: 143540 - DNA, 75 bp, Artificial Sequence
  Synthetic
gacttgtgcggcgtccccctaggtccggagtcgatctccatttgatccgtccggggcttcttcgccgggggagct

SEQ ID NO: 143541 - DNA, 75 bp, Artificial Sequence
  Synthetic
gacttgtgcggcgtccccctaggtccggagtcgatctccattcgatccgtccggggcttcttcgccgggggagct

SEQ ID NO: 143542 - DNA, 75 bp, Artificial Sequence
  Synthetic
gacttgtgcggcgtccccctaggtccggagtcgatctccattggatccgtccggggcttcttcgccgggggagct

SEQ ID NO: 143543 - DNA, 75 bp, Artificial Sequence
  Synthetic
gacttgtgcggcgtccccccaggtccggagtcgatctccattagatccgtccggggcttcttcgccgggggagct

SEQ ID NO: 143544 - DNA, 75 bp, Artificial Sequence
  Synthetic
gacttgtgcggcgtccccccaggtccggagtcgatctccatttgatccgtccggggcttcttcgccgggggagct

SEQ ID NO: 143545 - DNA, 75 bp, Artificial Sequence
  Synthetic
gacttgtgcggcgtccccccaggtccggagtcgatctccattcgatccgtccggggcttcttcgccgggggagct

SEQ ID NO: 143546 - DNA, 75 bp, Artificial Sequence
  Synthetic
gacttgtgcggcgtccccccaggtccggagtcgatctccattggatccgtccggggcttcttcgccgggggagct

SEQ ID NO: 143547 - DNA, 75 bp, Artificial Sequence
  Synthetic
gacttgtgcggcgtcccccgaggtccggagtcgatctccattagatccgtccggggcttcttcgccgggggagct

SEQ ID NO: 143548 - DNA, 75 bp, Artificial Sequence
  Synthetic
gacttgtgcggcgtcccccgaggtccggagtcgatctccatttgatccgtccggggcttcttcgccgggggagct

SEQ ID NO: 143549 - DNA, 75 bp, Artificial Sequence
  Synthetic
gacttgtgcggcgtcccccgaggtccggagtcgatctccattcgatccgtccggggcttcttcgccgggggagct

SEQ ID NO: 143550 - DNA, 75 bp, Artificial Sequence
  Synthetic
gacttgtgcggcgtcccccgaggtccggagtcgatctccattggatccgtccggggcttcttcgccgggggagct

SEQ ID NO: 143551 - DNA, 75 bp, Artificial Sequence
  Synthetic
gaggggatgtcacggtaaagagcattggaacgtcggagaaactactcccaagaagcaaagagaggtctcaggaag

SEQ ID NO: 143552 - DNA, 75 bp, Artificial Sequence
  Synthetic
cggacgagttccccacaacgctggagaatctctggaaggggaaagaggaaggtggaagaaaaaggggcgggcctc

SEQ ID NO: 143553 - DNA, 75 bp, Artificial Sequence
  Synthetic
tcctttcgagatcatcccggttttttcttagttctacccacttctcgaggacatcttccctcccacctcgctttc

SEQ ID NO: 143554 - DNA, 75 bp, Artificial Sequence
  Synthetic
tcttagttctacccacttctcgaggacatcttccctcccacctcgctttctcttcggatcggcgtggctcatctc

SEQ ID NO: 143555 - DNA, 75 bp, Artificial Sequence
  Synthetic
ggcgagggggcagcttcctcagttctctcttatttcctaaggaaaaggagactgctggtcgcctgcccccgggct

SEQ ID NO: 143556 - DNA, 75 bp, Artificial Sequence
  Synthetic
catgggccaattccgagcgaagagtccgcgggggaaggatcagtgcccgagaggggtaaagtggtaaagagtatt

SEQ ID NO: 143557 - DNA, 75 bp, Artificial Sequence
  Synthetic
agtaagaccatagcgataggaggagatgctaggagtagggggagaccgaagcgaggaggaaagtaaagaaagcaa

SEQ ID NO: 143558 - DNA, 75 bp, Artificial Sequence
  Synthetic
cccccgagaggggacgagtgaggcttatcccggggaactcgacttatcgtccccatctagcgggaccccggaccc

SEQ ID NO: 143559 - DNA, 75 bp, Artificial Sequence
  Synthetic
ccttcgaaagtgaccggagggggtgctaggaacaccggggaccagtggagccatgggatgcccttcccgatgctc

SEQ ID NO: 143560 - DNA, 75 bp, Artificial Sequence
  Synthetic
cgcccaggaatggcgggaccccactctgcagggtccgcgttccatcctttcttacctgatggccggcatggtccc

SEQ ID NO: 143561 - DNA, 75 bp, Artificial Sequence
  Synthetic
agaggcgcttcgagcggtaggagtaaggccatagcgataggaggagatgctaggagtagggggagaccgaagcga

SEQ ID NO: 143562 - DNA, 75 bp, Artificial Sequence
  Synthetic
gctagccggtgggtgttccgccccccgagaggggacgagtgaggcttatcccggggaactcgacttatcgtcccc

SEQ ID NO: 143563 - DNA, 75 bp, Artificial Sequence
  Synthetic
cggtaatggcgaatgggacccacaaatctctctagattccgatagagaatcgagagaaaagtggctctcccttag

SEQ ID NO: 143564 - DNA, 75 bp, Artificial Sequence
  Synthetic
cgaaagtgaccggagggggtgctgggaacaccggggaccagtggagccatgggatgcccttcccgatgctcgatt

SEQ ID NO: 143565 - DNA, 75 bp, Artificial Sequence
  Synthetic
ccaccttcgagggggttcacacccccaaccggcgggccggctactcttctttcccttctctcgtcttcctcggtc

SEQ ID NO: 143566 - DNA, 75 bp, Artificial Sequence
  Synthetic
cctgagaggcctcttcctaggtccggagtctacctccatctggtccgttcgggccctcttcgccgggggagcccc

SEQ ID NO: 143567 - DNA, 75 bp, Artificial Sequence
  Synthetic
gagtctacctccatctggtccgttcgggccctcttcgccgggggagccccctctccatccttatccttctttccg

SEQ ID NO: 143568 - DNA, 75 bp, Artificial Sequence
  Synthetic
tctctctcgagttcctctaacttctttcttccggccacccactgctcgaggatctcttctctccctccgcggttc

SEQ ID NO: 143569 - DNA, 75 bp, Artificial Sequence
  Synthetic
cggctagaggcggcagtcctcagtactcttactcttttctgtaaagaggagactgctggactcgccgcccgagcc

SEQ ID NO: 143570 - DNA, 75 bp, Artificial Sequence
  Synthetic
catgggccaattccgagcgaagagtccgcgggggaaggatcagtgcccgagaggggatgaactggtaaagaggcg

SEQ ID NO: 143571 - DNA, 75 bp, Artificial Sequence
  Synthetic
gaggggatgaactggtaaagaggcgaggaacgcgaggggatatctcccaagatggcaaggagaaggcaagagtcg

SEQ ID NO: 143572 - DNA, 75 bp, Artificial Sequence
  Synthetic
ttcttctttgtcttccggagatccctctcgagttcctccgctttctttcttccactcacccacttctcgagaata

SEQ ID NO: 143573 - DNA, 75 bp, Artificial Sequence
  Synthetic
gatgactttccccataacgctggagacatcctggaaggggaaagggacaggcggaagaaaaaggggcgggccccc

SEQ ID NO: 143574 - DNA, 75 bp, Artificial Sequence
  Synthetic
acatcctggaaggggaaagggacaggcggaagaaaaaggggcgggccccccgatccgaggggcccggccaccagg

SEQ ID NO: 143575 - DNA, 75 bp, Artificial Sequence
  Synthetic
aagaggcggcagtcctcagtgctcttactcttttctgataaagaggagactgctggactcgccgcccaagttcga

SEQ ID NO: 143576 - DNA, 75 bp, Artificial Sequence
  Synthetic
catgggccaattccgagcgaagaactcgcgggggaaggatcagcgcccgagaggggtcagtggtaaagagcattg

SEQ ID NO: 143577 - DNA, 75 bp, Artificial Sequence
  Synthetic
atccacgcagagtagaacggagaaatcacctccagaggaccccttcagcgaacagagagcaccgagcgagaggag

SEQ ID NO: 143578 - DNA, 75 bp, Artificial Sequence
  Synthetic
gctaggagtaggaggagaccgaagcgaggaggaaagcaaagaaagcaacggggctagccgtcaggtgttccgccc

SEQ ID NO: 143579 - DNA, 75 bp, Artificial Sequence
  Synthetic
tggaacgcgggggaccagtggatccatgggatgcttttcccgattccgtcctatccccacccccgagggtcgccc

SEQ ID NO: 143580 - DNA, 75 bp, Artificial Sequence
  Synthetic
tcctcgctggcgccggctgggcaacattccgaggggaccgtcccctcggtaatggcgaatgggacccagaaatct

SEQ ID NO: 143581 - DNA, 75 bp, Artificial Sequence
  Synthetic
ccgagtggacgtctgtcctccttcggatgcccaggtcggaccgcgaggaggtggagatgccatgccgacccgaag

SEQ ID NO: 143582 - DNA, 75 bp, Artificial Sequence
  Synthetic
gtggagatgccatgccgacccgaagaggaaagaaggacgcgagacggtgaacctgtgagtggaaacccgctttat

SEQ ID NO: 143583 - DNA, 75 bp, Artificial Sequence
  Synthetic
tcccctgatgtccagcccctccccggtccgagtgaagggggactccgggactccttgcatgctggggacgaagcc

SEQ ID NO: 143584 - DNA, 75 bp, Artificial Sequence
  Synthetic
agtaaatcctatgggaatccctggttccccctgacgtccagcccctccccggtccgagagaagggggactccgga

SEQ ID NO: 143585 - DNA, 75 bp, Artificial Sequence
  Synthetic
ccttctctcgtcttcctcggtcaacctcctgagttcctcttcctcctccttgctcaggttcttccctccgccgct

SEQ ID NO: 143586 - DNA, 75 bp, Artificial Sequence
  Synthetic
cagttgctttctcttgttcttgagggccttccttcgtcggtgatcctgcctctccctgtcggtgaatcctcccct

SEQ ID NO: 143587 - DNA, 75 bp, Artificial Sequence
  Synthetic
tccgtccttgtccttctttccgataattcctttgatgtttcccagccagggattgtcatcctcaagtctcttgat

SEQ ID NO: 143588 - DNA, 75 bp, Artificial Sequence
  Synthetic
gatgggccccaatgccgacgaggagtccgcaggtgggaggatcagccaccggcgagggacgcgatggtaagagtg

SEQ ID NO: 143589 - DNA, 75 bp, Artificial Sequence
  Synthetic
catgagccaattccgagcgaggggtacgcgggaggaaggatcacatgacgagagggagtgtatggtaagaggcgg

SEQ ID NO: 143590 - DNA, 75 bp, Artificial Sequence
  Synthetic
ggcaaggaattggtagaaaagagcgagcctcccgaatacgagttggccaggacccatcaagtttggagtcatccg

SEQ ID NO: 143591 - DNA, 75 bp, Artificial Sequence
  Synthetic
aagaaggtgaagagaaggcaagaatcggacgttttccccataacgctggagacgtcctggaaggggaaagagata

SEQ ID NO: 143592 - DNA, 75 bp, Artificial Sequence
  Synthetic
cggagaacccacctccagaggaccccttctgcgaacggagaagctcttcctcctcgggagtggagccgtagcgat

SEQ ID NO: 143593 - DNA, 75 bp, Artificial Sequence
  Synthetic
ctggacctccgggagccatgggatccgtggagtacccgggccatccccttctccacactccttcccccctgcggg

SEQ ID NO: 143594 - DNA, 75 bp, Artificial Sequence
  Synthetic
cgtggagtacccgggccatccccttctccacactccttcccccctgcggggcccccccataagatggcgagaaat

SEQ ID NO: 143595 - DNA, 75 bp, Artificial Sequence
  Synthetic
aggagtggaaggcggggagaggggcgcccagggtcaacctacggaaatccctgagttcctcggatgtccaggccg

SEQ ID NO: 143596 - DNA, 75 bp, Artificial Sequence
  Synthetic
gcccagggtcaacctacggaaatccctgagttcctcggatgtccaggccgtcccctcttctagagaagggagact

SEQ ID NO: 143597 - DNA, 75 bp, Artificial Sequence
  Synthetic
attcactggggtcgacagctctggggagaaaagggaggatcggatgggaagagtatatcctatgggaatccctgg

SEQ ID NO: 143598 - DNA, 75 bp, Artificial Sequence
  Synthetic
tccagggccttccttcttcggtggtcccgcctctcctgttcggtgaaccctcccgggtgtttcctcttcctaggt

SEQ ID NO: 143599 - DNA, 75 bp, Artificial Sequence
  Synthetic
cccgcctctcctgttcggtgaaccctcccgggtgtttcctcttcctaggtccggagtcgacctccatctgatccg

SEQ ID NO: 143600 - DNA, 75 bp, Artificial Sequence
  Synthetic
tcgaagagggcggacggtcccgagatctcttatcttcctacttagaagaggagtctcctggacgcctccgcccac

SEQ ID NO: 143601 - DNA, 75 bp, Artificial Sequence
  Synthetic
atgagccaagttccgaacgaaggaccgcaggggggagggttcagcgaccgagaggggatgaacgacaaggtgcga

SEQ ID NO: 143602 - DNA, 75 bp, Artificial Sequence
  Synthetic
cgcaggggggagggttcagcgaccgagaggggatgaacgacaaggtgcgaggaacctcgaagaggtgactcccaa

SEQ ID NO: 143603 - DNA, 75 bp, Artificial Sequence
  Synthetic
agaggggatgaacgacaaggtgcgaggaacctcgaagaggtgactcccaagaaggtaagagaggattcaggaatt

SEQ ID NO: 143604 - DNA, 75 bp, Artificial Sequence
  Synthetic
ggaagctttcccagtgacgctggaggcatctcggaatgggaaagagggaaggtggaagagaagggggaggctccc

SEQ ID NO: 143605 - DNA, 75 bp, Artificial Sequence
  Synthetic
gcgaggaggaaagtaaagagagcaacggggctagccgtcaggtgttccgcctcccgagaggggacgagtgaggct

SEQ ID NO: 143606 - DNA, 75 bp, Artificial Sequence
  Synthetic
gatccgaggggcccagccaccgggtttggaggacactccggcccatatggtcgagaagttcccagagggaggaat

SEQ ID NO: 143607 - DNA, 75 bp, Artificial Sequence
  Synthetic
gatccgaggggcccagccaccgggtttggaggacactccggcccttatggtcgagaagttcccagagggaggaat

SEQ ID NO: 143608 - DNA, 75 bp, Artificial Sequence
  Synthetic
gatccgaggggcccagccaccgggtttggaggacactccggcccctatggtcgagaagttcccagagggaggaat

SEQ ID NO: 143609 - DNA, 75 bp, Artificial Sequence
  Synthetic
gatccgaggggcccagccaccgggtttggaggacactccggcccgtatggtcgagaagttcccagagggaggaat

SEQ ID NO: 143610 - DNA, 75 bp, Artificial Sequence
  Synthetic
ccccacatagcaggacccggggcccccttccgaagtgaccgaaggggggtgctaggaccgtggggggaccagcgg

SEQ ID NO: 143611 - DNA, 75 bp, Artificial Sequence
  Synthetic
cccacatagcagagcccggacccccttccaaaaggaccggagggggggcttgaagcacgggggggcccaatcgga

SEQ ID NO: 143612 - DNA, 75 bp, Artificial Sequence
  Synthetic
tgtccaccttcgagggggttcacacctccaggcggcgggccggctactcttctttcccttctctcgtcttcatcg

SEQ ID NO: 143613 - DNA, 75 bp, Artificial Sequence
  Synthetic
tgtccaccttcgagggggttcacacctccaggcggcgggccggctactcttctttcccttctctcgtcttcttcg

SEQ ID NO: 143614 - DNA, 75 bp, Artificial Sequence
  Synthetic
tgtccaccttcgagggggttcacacctccaggcggcgggccggctactcttctttcccttctctcgtcttcctcg

SEQ ID NO: 143615 - DNA, 75 bp, Artificial Sequence
  Synthetic
tgtccaccttcgagggggttcacacctccaggcggcgggccggctactcttctttcccttctctcgtcttcgtcg

SEQ ID NO: 143616 - DNA, 75 bp, Artificial Sequence
  Synthetic
tgtcctccttcgagggggttcacacctccaggcggcgggccggctactcttctttcccttctctcgtcttcatcg

SEQ ID NO: 143617 - DNA, 75 bp, Artificial Sequence
  Synthetic
tgtcctccttcgagggggttcacacctccaggcggcgggccggctactcttctttcccttctctcgtcttcttcg

SEQ ID NO: 143618 - DNA, 75 bp, Artificial Sequence
  Synthetic
tgtcctccttcgagggggttcacacctccaggcggcgggccggctactcttctttcccttctctcgtcttcctcg

SEQ ID NO: 143619 - DNA, 75 bp, Artificial Sequence
  Synthetic
tgtcctccttcgagggggttcacacctccaggcggcgggccggctactcttctttcccttctctcgtcttcgtcg

SEQ ID NO: 143620 - DNA, 75 bp, Artificial Sequence
  Synthetic
tgtcccccttcgagggggttcacacctccaggcggcgggccggctactcttctttcccttctctcgtcttcatcg

SEQ ID NO: 143621 - DNA, 75 bp, Artificial Sequence
  Synthetic
tgtcccccttcgagggggttcacacctccaggcggcgggccggctactcttctttcccttctctcgtcttcttcg

SEQ ID NO: 143622 - DNA, 75 bp, Artificial Sequence
  Synthetic
tgtcccccttcgagggggttcacacctccaggcggcgggccggctactcttctttcccttctctcgtcttcctcg

SEQ ID NO: 143623 - DNA, 75 bp, Artificial Sequence
  Synthetic
tgtcccccttcgagggggttcacacctccaggcggcgggccggctactcttctttcccttctctcgtcttcgtcg

SEQ ID NO: 143624 - DNA, 75 bp, Artificial Sequence
  Synthetic
tgtccgccttcgagggggttcacacctccaggcggcgggccggctactcttctttcccttctctcgtcttcatcg

SEQ ID NO: 143625 - DNA, 75 bp, Artificial Sequence
  Synthetic
tgtccgccttcgagggggttcacacctccaggcggcgggccggctactcttctttcccttctctcgtcttcttcg

SEQ ID NO: 143626 - DNA, 75 bp, Artificial Sequence
  Synthetic
tgtccgccttcgagggggttcacacctccaggcggcgggccggctactcttctttcccttctctcgtcttcctcg

SEQ ID NO: 143627 - DNA, 75 bp, Artificial Sequence
  Synthetic
tgtccgccttcgagggggttcacacctccaggcggcgggccggctactcttctttcccttctctcgtcttcgtcg

SEQ ID NO: 143628 - DNA, 75 bp, Artificial Sequence
  Synthetic
cctccctgctgaggctcttccctcccccggccagctgcttcttcttgttctcgagggccttccttcgtcggtgat

SEQ ID NO: 143629 - DNA, 75 bp, Artificial Sequence
  Synthetic
atccctctcgagttcctctaacttttttcttccgttcacccattgctcgagaatctcttctcttccctcgcgctt

SEQ ID NO: 143630 - DNA, 75 bp, Artificial Sequence
  Synthetic
cttcctcgattcggaccggctcatctcgacaagaggcggcagtcctcagtgctcttactcttttctgtaaagagg

SEQ ID NO: 143631 - DNA, 75 bp, Artificial Sequence
  Synthetic
ccgagaattcctttgatgtttcccagccagggattttcttcctctaatttcctgattttcttcttttccttccgg

SEQ ID NO: 143632 - DNA, 75 bp, Artificial Sequence
  Synthetic
agatctctttcgagctcctcagcttttttccttgagttcacccacttctcgaggacctcttccctccctccgcga

SEQ ID NO: 143633 - DNA, 75 bp, Artificial Sequence
  Synthetic
agttctctttcgagctcctcagcttttttccttgagttcacccacttctcgaggacctcttccctccctccgcga

SEQ ID NO: 143634 - DNA, 75 bp, Artificial Sequence
  Synthetic
agctctctttcgagctcctcagcttttttccttgagttcacccacttctcgaggacctcttccctccctccgcga

SEQ ID NO: 143635 - DNA, 75 bp, Artificial Sequence
  Synthetic
aggtctctttcgagctcctcagcttttttccttgagttcacccacttctcgaggacctcttccctccctccgcga

SEQ ID NO: 143636 - DNA, 75 bp, Artificial Sequence
  Synthetic
aggataacgcgagaggaaggatcagaggacgagaagggatgatcggtaaagaagccgagaaacgccgaggggacc

SEQ ID NO: 143637 - DNA, 75 bp, Artificial Sequence
  Synthetic
tctcgacaagaggcggcagtcctcagtgctcttactcttttctgtaaagaggagactgctggactcgccgcccga

SEQ ID NO: 143638 - DNA, 75 bp, Artificial Sequence
  Synthetic
gaagccgagaaacgccgaggggaccacctcccaagaaggcgaagagaaggcaagaatcggacgactttccccata

SEQ ID NO: 143639 - DNA, 75 bp, Artificial Sequence
  Synthetic
ggtcccccctcgtgtccagcccctccccgcgtctagagaagggggactccggaactccttgcatgctggggacga

SEQ ID NO: 143640 - DNA, 75 bp, Artificial Sequence
  Synthetic
acgctggagacatcctggaaggggaaagaggtaagacggaagagaaggggggggcctcccgatccgaggggccca

SEQ ID NO: 143641 - DNA, 75 bp, Artificial Sequence
  Synthetic
cggatcgataggaagtgggaggcccgagaggggctccaagcaaagagaggaggaatcccggggaaaaattctccc

SEQ ID NO: 143642 - DNA, 75 bp, Artificial Sequence
  Synthetic
catgggccatctccgaacgaagatcccgcggggggcaggatcagcgcccgagaggggtagatggcaaagagcatt

SEQ ID NO: 143643 - DNA, 75 bp, Artificial Sequence
  Synthetic
ccgcggggggcaggatcagcgcccgagaggggtagatggcaaagagcattggaacgtcgaaggaaccactcccaa

SEQ ID NO: 143644 - DNA, 75 bp, Artificial Sequence
  Synthetic
atgggcctccgtgccgacgaagaatcggatcgataggaagtgggaggcccgagaggggctccaagcaaagagagg

SEQ ID NO: 143645 - DNA, 75 bp, Artificial Sequence
  Synthetic
ggaacgtcgaaggaaccactcccaagaaggaaaaagagaagacaagaatcggacggattccccatgacgctggag

SEQ ID NO: 143646 - DNA, 75 bp, Artificial Sequence
  Synthetic
aagaggagatttcccagacgccggtggagcaccagggaacaaggaaacaggagaggaacggtagaaaagagcgag

SEQ ID NO: 143647 - DNA, 75 bp, Artificial Sequence
  Synthetic
gagaggggctccaagcaaagagaggaggaatcccggggaaaaattctcccaagaagagtcgagagtaatctcaag

SEQ ID NO: 143648 - DNA, 75 bp, Artificial Sequence
  Synthetic
ggagcaccagggaacaaggaaacaggagaggaacggtagaaaagagcgagcctcccgatccgagggggccctgga

SEQ ID NO: 143649 - DNA, 75 bp, Artificial Sequence
  Synthetic
cccctcagctctggagtcctccgacccgtgaggtcgaggatccccgcgcagggagacagccacccggagaagaca

SEQ ID NO: 143650 - DNA, 75 bp, Artificial Sequence
  Synthetic
ccgtgaggtcgaggatccccgcgcagggagacagccacccggagaagacagagaaatcacctccagagaaaccct

SEQ ID NO: 143651 - DNA, 75 bp, Artificial Sequence
  Synthetic
gttgagagtacccagagggaggaatccacacggagaaaagcagataaatcacctccagaggaccccttcagcgaa

SEQ ID NO: 143652 - DNA, 75 bp, Artificial Sequence
  Synthetic
ctcagcgaacaaagaggcgctctgaggcgttggggcgagtccatagcgatgggaggggatgctaggagtcggcag

SEQ ID NO: 143653 - DNA, 75 bp, Artificial Sequence
  Synthetic
ggcgttggggcgagtccatagcgatgggaggggatgctaggagtcggcagcgaccgaagcgaggagaaaagtaaa

SEQ ID NO: 143654 - DNA, 75 bp, Artificial Sequence
  Synthetic
gaaagcaacggggctagcaggtggatgttccgcctccccggaggtcccgagtgaggcttatcccggggaactcgg

SEQ ID NO: 143655 - DNA, 75 bp, Artificial Sequence
  Synthetic
tgttccgcctccccggaggtcccgagtgaggcttatcccggggaactcggctaagccccgaaatgtctagttcca

SEQ ID NO: 143656 - DNA, 75 bp, Artificial Sequence
  Synthetic
ggctagccggtaggtgttccgcctcccgagaggggacgagtgaggcttatcccggggaactcggcgaatcgtccc

SEQ ID NO: 143657 - DNA, 75 bp, Artificial Sequence
  Synthetic
ccgagaggggacgagtgaggcttatcccggggaactcggcgaatcgtccccacatagcagctcccaggaccccct

SEQ ID NO: 143658 - DNA, 75 bp, Artificial Sequence
  Synthetic
ctgtctccacttccaaagggaggagcgggtggacctggaacatgaggggaccagtcaatccgtgggattgccccg

SEQ ID NO: 143659 - DNA, 75 bp, Artificial Sequence
  Synthetic
tccaaaatggtccgaggggggtggcttggaacgcagggaaccagtggagccatgggatgctcatcccgatgctcg

SEQ ID NO: 143660 - DNA, 75 bp, Artificial Sequence
  Synthetic
gacctccggatctccacactccttcccccctgcgggcttcccagtaaaatgaaagaaacccacccactggggtcc

SEQ ID NO: 143661 - DNA, 75 bp, Artificial Sequence
  Synthetic
gacctccggttctccacactccttcccccctgcgggcttcccagtaaaatgaaagaaacccacccactggggtcc

SEQ ID NO: 143662 - DNA, 75 bp, Artificial Sequence
  Synthetic
gacctccggctctccacactccttcccccctgcgggcttcccagtaaaatgaaagaaacccacccactggggtcc

SEQ ID NO: 143663 - DNA, 75 bp, Artificial Sequence
  Synthetic
gacctccgggtctccacactccttcccccctgcgggcttcccagtaaaatgaaagaaacccacccactggggtcc

SEQ ID NO: 143664 - DNA, 75 bp, Artificial Sequence
  Synthetic
aagccatgccgacccgaagaaggaaagaaggactcggacgcgaacccgtgagtggaactctttatcttttactgg

SEQ ID NO: 143665 - DNA, 75 bp, Artificial Sequence
  Synthetic
atgccatgccgacccgaagaaggaaagaaggactcggacgcgaacccgtgagtggaactctttatcttttactgg

SEQ ID NO: 143666 - DNA, 75 bp, Artificial Sequence
  Synthetic
acgccatgccgacccgaagaaggaaagaaggactcggacgcgaacccgtgagtggaactctttatcttttactgg

SEQ ID NO: 143667 - DNA, 75 bp, Artificial Sequence
  Synthetic
aggccatgccgacccgaagaaggaaagaaggactcggacgcgaacccgtgagtggaactctttatcttttactgg

SEQ ID NO: 143668 - DNA, 75 bp, Artificial Sequence
  Synthetic
agaaggactcggacgcgaacccgtgagtggaactctttatcttttactggggagtacactcgaggagtggaaggc

SEQ ID NO: 143669 - DNA, 75 bp, Artificial Sequence
  Synthetic
ggggaggccggggtcccgggtctacccacgggaattgctggtttccccttacgtccagtccacttcccgtcctgg

SEQ ID NO: 143670 - DNA, 75 bp, Artificial Sequence
  Synthetic
ccacgggaattgctggtttccccttacgtccagtccacttcccgtcctggagaagggagactcgggaacatctag

SEQ ID NO: 143671 - DNA, 75 bp, Artificial Sequence
  Synthetic
catttgagggacaaagccgcccccgggcgctcccctcggaggtccctcgggtgggttcacatccccaacccgcgg

SEQ ID NO: 143672 - DNA, 75 bp, Artificial Sequence
  Synthetic
tcgtcttcctcggtcaacttccggagttcctcttcctcctccctgctgagtgactttccccccgcgctcagctga

SEQ ID NO: 143673 - DNA, 75 bp, Artificial Sequence
  Synthetic
ttcttcttgttctcgagggctttccttcttcggtgatcctttctctcctggtcggtgaagtctcccgctcgggtc

SEQ ID NO: 143674 - DNA, 75 bp, Artificial Sequence
  Synthetic
ctcttcctaggtccggagtcgacctccatctgatccgtccgggcccttttcgccgggggagctccctccccgtcc

SEQ ID NO: 143675 - DNA, 75 bp, Artificial Sequence
  Synthetic
tgttccccagccagggattttcatcctcgagtttcttgatggttctcttggtcttccggagcattttctcgagat

SEQ ID NO: 143676 - DNA, 75 bp, Artificial Sequence
  Synthetic
tgttccccagccagggattttcatcctcgagtttcttgatggttctcttggtcttccggagctttttctcgagat

SEQ ID NO: 143677 - DNA, 75 bp, Artificial Sequence
  Synthetic
tgttccccagccagggattttcatcctcgagtttcttgatggttctcttggtcttccggagccttttctcgagat

SEQ ID NO: 143678 - DNA, 75 bp, Artificial Sequence
  Synthetic
tgttccccagccagggattttcatcctcgagtttcttgatggttctcttggtcttccggagcgttttctcgagat

SEQ ID NO: 143679 - DNA, 75 bp, Artificial Sequence
  Synthetic
cctccgagtcttttcttgcttgcacccacttctcgaggatctcctcccttcctcctctccgagctttcttcgatt

SEQ ID NO: 143680 - DNA, 75 bp, Artificial Sequence
  Synthetic
ccacttctcgaggatctcctcccttcctcctctccgagctttcttcgattcggactggctcatcctcggataggg

SEQ ID NO: 143681 - DNA, 75 bp, Artificial Sequence
  Synthetic
ccctttcgagttcctctaacttctttcttccattcacccactgctcgagaacctcttctctgccatcgcggtgtt

SEQ ID NO: 143682 - DNA, 75 bp, Artificial Sequence
  Synthetic
gggggagacggcttctgttctcttattcttccttttcgaagaggagacagcttgccgcccctcccccaccccggg

SEQ ID NO: 143683 - DNA, 75 bp, Artificial Sequence
  Synthetic
tcttcgattcggaacggctcatctcgacaagaggcggggctcctcagttctcttactcttttctgtaaagaggag

SEQ ID NO: 143684 - DNA, 75 bp, Artificial Sequence
  Synthetic
ccaaggaggagaaggagggacccccgaagggactcgaagctaaagagtggaaactcacgagaaggaggggttccc

SEQ ID NO: 143685 - DNA, 75 bp, Artificial Sequence
  Synthetic
gacaagaggcggggctcctcagttctcttactcttttctgtaaagaggagactgctggagtccccgcccaagttc

SEQ ID NO: 143686 - DNA, 75 bp, Artificial Sequence
  Synthetic
atgggccacagctccgaacgaagggtccgacgggggaggaatccatcccgagaggggttacctggtaaagaggcg

SEQ ID NO: 143687 - DNA, 75 bp, Artificial Sequence
  Synthetic
tccgacgggggaggaatccatcccgagaggggttacctggtaaagaggcggggaaagtcgagagaaattgtccta

SEQ ID NO: 143688 - DNA, 75 bp, Artificial Sequence
  Synthetic
aagaggatggatccccgagacgctggaaactcccggaacaaggaaaatggggatgggataggaaaagaagagcga

SEQ ID NO: 143689 - DNA, 75 bp, Artificial Sequence
  Synthetic
atgagccaagatccgacgaagagccccaaggaggagaaggagggacccccgaagggactcgaagctaaagagtgg

SEQ ID NO: 143690 - DNA, 75 bp, Artificial Sequence
  Synthetic
agaaggtccaagagaaaacccaagaaggaggacctttccccaaaacgctgcggaaactctcggaataggaaagag

SEQ ID NO: 143691 - DNA, 75 bp, Artificial Sequence
  Synthetic
aggaggacctttccccaaaacgctgcggaaactctcggaataggaaagaggaaggcgaagaaaaaggggcggggc

SEQ ID NO: 143692 - DNA, 75 bp, Artificial Sequence
  Synthetic
acctatcaggtttggagtcctccgagcttagggtcgaaatgggtacaatgggaggaatccaccaggagtcggaga

SEQ ID NO: 143693 - DNA, 75 bp, Artificial Sequence
  Synthetic
gaagggactcgaagctaaagagtggaaactcacgagaaggaggggttcccaagaggacgagagaagctcctcaag

SEQ ID NO: 143694 - DNA, 75 bp, Artificial Sequence
  Synthetic
ccccgatccgaggggtccggcgccgagttttggagagaactccgggccgaatggtcgagtagcacacagagggag

SEQ ID NO: 143695 - DNA, 75 bp, Artificial Sequence
  Synthetic
caagccacctccagaggaccccttcagcgaacagaagagccttctcccggaggaggggaacatagcgataggagg

SEQ ID NO: 143696 - DNA, 75 bp, Artificial Sequence
  Synthetic
agttttggagagaactccgggccgaatggtcgagtagcacacagagggagaaagccacacggaggtgagcggaga

SEQ ID NO: 143697 - DNA, 75 bp, Artificial Sequence
  Synthetic
gaaactcccggaacaaggaaaatggggatgggataggaaaagaagagcgagcccaccgatccgagtttgccctga

SEQ ID NO: 143698 - DNA, 75 bp, Artificial Sequence
  Synthetic
aaccacctccagaggaccccttcagcgaacagaagacgctcacggacggtaggagtaagaccgtagcgataggag

SEQ ID NO: 143699 - DNA, 75 bp, Artificial Sequence
  Synthetic
agcgaacagaagagccttctcccggaggaggggaacatagcgataggaggagatgctaggagtagggggagaccg

SEQ ID NO: 143700 - DNA, 75 bp, Artificial Sequence
  Synthetic
agcggggctagcaggagggtgttccgccccccggcggggccaagtgaggcttatcccggggaactcggctaagtc

SEQ ID NO: 143701 - DNA, 75 bp, Artificial Sequence
  Synthetic
aggatgctaggagttaggggcgaccaaagcgaggagaaaagtaaagagagcaacggggctagcaggtgggtgttc

SEQ ID NO: 143702 - DNA, 75 bp, Artificial Sequence
  Synthetic
aaagcgaggagaaaagtaaagagagcaacggggctagcaggtgggtgttcctccccccgagaggggacgagtgag

SEQ ID NO: 143703 - DNA, 75 bp, Artificial Sequence
  Synthetic
caacggggctagcaggtgggtgttcctccccccgagaggggacgagtgaggcttatcccggggaactcggcgaat

SEQ ID NO: 143704 - DNA, 75 bp, Artificial Sequence
  Synthetic
ccggatcgccggctccaggactccactccaaaggaccgagggtaggacttggagcaccggggatcccaggcagtt

SEQ ID NO: 143705 - DNA, 75 bp, Artificial Sequence
  Synthetic
ctccaaaggaccgagggtaggacttggagcaccggggatcccaggcagttccatggtggacaccgtcccccttct

SEQ ID NO: 143706 - DNA, 75 bp, Artificial Sequence
  Synthetic
ccacactccttccccccgcgggcccccccataaagcagagaaccccactctacagggtccgcgccctcccccttt

SEQ ID NO: 143707 - DNA, 75 bp, Artificial Sequence
  Synthetic
gctaggagcgcgggggggaccactggagccgtgggatgctcctcccgattccgtccaaccccacccccgagaggt

SEQ ID NO: 143708 - DNA, 75 bp, Artificial Sequence
  Synthetic
ccccataaagcagagaaccccactctacagggtccgcgccctcccccttttcttacctttggccggcatggtccc

SEQ ID NO: 143709 - DNA, 75 bp, Artificial Sequence
  Synthetic
agcctcctcgcggcgccggctgggcaacattccgagggggccgtcccctcgtaatggcagatgggacccaggctt

SEQ ID NO: 143710 - DNA, 75 bp, Artificial Sequence
  Synthetic
gtaatggcagatgggacccaggcttcccccggattcccttatgggaatcgaggagaaaaagtggctctcccttag

SEQ ID NO: 143711 - DNA, 75 bp, Artificial Sequence
  Synthetic
tcggtaatggcgaatgggacccagaactctctctgattccgatagagaatcgagagaaaactggctctcccttag

SEQ ID NO: 143712 - DNA, 75 bp, Artificial Sequence
  Synthetic
tctttattgggggtacactcgaggagtggaaggcggggagggggggatggagcttgtccctatggaaactgctgg

SEQ ID NO: 143713 - DNA, 75 bp, Artificial Sequence
  Synthetic
gtggaaggcggggagggggggatggagcttgtccctatggaaactgctggtttcccctgatgtccagtccatccc

SEQ ID NO: 143714 - DNA, 75 bp, Artificial Sequence
  Synthetic
ggagaaaagggtggatcggatgggaagagtatatcctacgggaatccgtgttcccctctcgtgtccagcccctcc

SEQ ID NO: 143715 - DNA, 75 bp, Artificial Sequence
  Synthetic
cgtgtctggtgaatggagactccggaacaccaagcatcctagggacgaagccacccccgggcgctccccttggac

SEQ ID NO: 143716 - DNA, 75 bp, Artificial Sequence
  Synthetic
aacaccaagcatcctagggacgaagccacccccgggcgctccccttggacttcctccgggagggttcacaccccc

SEQ ID NO: 143717 - DNA, 75 bp, Artificial Sequence
  Synthetic
atcctgcgggccggccaaccttcttttccttttctcgtcttcctcggtcaacctctcgagttcctcttcttcctc

SEQ ID NO: 143718 - DNA, 75 bp, Artificial Sequence
  Synthetic
ccaccttcgagggggttcacacccccaacctgcgggccggctgttcttcttttcctttcctcgtcttccttggtc

SEQ ID NO: 143719 - DNA, 75 bp, Artificial Sequence
  Synthetic
ttccttttctcgtcttcctcggtcaacctctcgagttcctcttcttcctccttgctgaggttcttccctccggcg

SEQ ID NO: 143720 - DNA, 75 bp, Artificial Sequence
  Synthetic
gaaagctgcttcttcttgttctcgagggccttccttcttcggtgagccctcctctcctcgtcggagaatactccc

SEQ ID NO: 143721 - DNA, 75 bp, Artificial Sequence
  Synthetic
ccttgctgaggttcttccctcctccggagagctgtttcttcttgttctcgagggccttccttcttcggtggtccc

SEQ ID NO: 143722 - DNA, 75 bp, Artificial Sequence
  Synthetic
aacctcttaagttcctcttcctcctccttgctgaggttcttccctcctccggagagctgtttcttcttgttctcg

SEQ ID NO: 143723 - DNA, 75 bp, Artificial Sequence
  Synthetic
gggccttccttcttcggtgagccctcctctcctcgtcggagaatactcccttgttactcttcttccccggaccgg

SEQ ID NO: 143724 - DNA, 75 bp, Artificial Sequence
  Synthetic
agtcaacctccatccgatctgttcgggctctcttcgccgggggagctccctctcctccactcccctttcttatta

SEQ ID NO: 143725 - DNA, 75 bp, Artificial Sequence
  Synthetic
gcctctccttgtcggtgaaatctcccctgtgaggcctcttcctaggtccggaatctacctccatctcgtctgtcc

SEQ ID NO: 143726 - DNA, 75 bp, Artificial Sequence
  Synthetic
gaatctacctccatctcgtctgtccgggccctcttcgccgggggagcccccccttcgctcttttccttctttccg

SEQ ID NO: 143727 - DNA, 75 bp, Artificial Sequence
  Synthetic
ttccgaggatgttccccagccagggattgtcatcctcgagtttcttgatggttcttctcgtcttccggatcctcc

SEQ ID NO: 143728 - DNA, 75 bp, Artificial Sequence
  Synthetic
attattcctttgatgtttcccagccagggattgtcgtcctcgagtttcttgattttcttcttggtcttccggact

SEQ ID NO: 143729 - DNA, 75 bp, Artificial Sequence
  Synthetic
agggattgtcgtcctcgagtttcttgattttcttcttggtcttccggacttttctctcgagctcctcaagctctt

SEQ ID NO: 143730 - DNA, 75 bp, Artificial Sequence
  Synthetic
ttcttccagagacccactgctcgaggatgtcttctcgtccccctcggttcttcttcgattcgggccggctcatct

SEQ ID NO: 143731 - DNA, 75 bp, Artificial Sequence
  Synthetic
tggcagagggcggcagtcctcagtgctcttactctttcttttgaagaggagactgctggacccgccgccccagcc

SEQ ID NO: 143732 - DNA, 75 bp, Artificial Sequence
  Synthetic
aacgcgggaggaaggatcacatgacgagagggagtgtatggtaagaggcggggaacgccgagtagggttttctcc

SEQ ID NO: 143733 - DNA, 75 bp, Artificial Sequence
  Synthetic
cctcccgatccgaggggcccggcggccaagtttggagggcactccggcccgaagggttgagacaccccagaggga

SEQ ID NO: 143734 - DNA, 75 bp, Artificial Sequence
  Synthetic
tcggacgacttccccatgacgctggagacgtcctggaaggggaaagagataggtggaaaagaaagggggcgggcc

SEQ ID NO: 143735 - DNA, 75 bp, Artificial Sequence
  Synthetic
tcccgatccgaggggcccgactgccaagtttggaaagcactccgggccgaagggttgagtagcactcagagggag

SEQ ID NO: 143736 - DNA, 75 bp, Artificial Sequence
  Synthetic
agggttgagtagcactcagagggaggaaccacacggagtagaacagagaaatcacctccagaggaccccttcagc

SEQ ID NO: 143737 - DNA, 75 bp, Artificial Sequence
  Synthetic
atcacctccagaggaccccttcagcgaacagaagagctctgcacgggataggagtaagaccatagcgatgggagg

SEQ ID NO: 143738 - DNA, 75 bp, Artificial Sequence
  Synthetic
ttattcactggggtcgacaactctggggagagaagggagggtcggctgggaagagtatatcctatgggaatccct

SEQ ID NO: 143739 - DNA, 75 bp, Artificial Sequence
  Synthetic
tttcccttctctcgtcttcctcggtcaacctcttaagttcctcttcctcctccttgctgaggttctttccccccg

SEQ ID NO: 143740 - DNA, 75 bp, Artificial Sequence
  Synthetic
tttcttccgctcacccactgctcgaggatctcttctctccccccgcggtctttccttctttcggaccggctcatc

SEQ ID NO: 143741 - DNA, 75 bp, Artificial Sequence
  Synthetic
cagggattttcgtcctcaagtttcttgattttcttcttcgtcttccggaggtccctctcgagttcctctaacctt

SEQ ID NO: 143742 - DNA, 75 bp, Artificial Sequence
  Synthetic
aaggcggagtcttggtaaagaggcgaggaaagtcgaagagggaatcgcccaagaaggccaagagaactccaagag

SEQ ID NO: 143743 - DNA, 75 bp, Artificial Sequence
  Synthetic
aggaaagtcgaagagggaatcgcccaagaaggccaagagaactccaagaggaggagacttccccatgacgctgga

SEQ ID NO: 143744 - DNA, 75 bp, Artificial Sequence
  Synthetic
tgttcctccccccgagggtcccgagtgaggcttatcccggggatcggcctctgctcctccatggtggactccagg

SEQ ID NO: 143745 - DNA, 75 bp, Artificial Sequence
  Synthetic
ggcatcttggaaggggaaagaggaaggcggaagaaaaggagggagccctccgaatctcgaggaggcccaaccacc

SEQ ID NO: 143746 - DNA, 75 bp, Artificial Sequence
  Synthetic
ggcggaagaaaaggagggagccctccgaatctcgaggaggcccaaccaccggatttggagagaactccggcccga

SEQ ID NO: 143747 - DNA, 75 bp, Artificial Sequence
  Synthetic
agggttgagtagcacacagagggaggaatcctcacggagaaaagcggaaaaatcacctccagaggaccccttcag

SEQ ID NO: 143748 - DNA, 75 bp, Artificial Sequence
  Synthetic
agggttgagtagcactcagagggaggaatcctcacggagaaaagcggaaaaatcacctccagaggaccccttcag

SEQ ID NO: 143749 - DNA, 75 bp, Artificial Sequence
  Synthetic
agggttgagtagcacccagagggaggaatcctcacggagaaaagcggaaaaatcacctccagaggaccccttcag

SEQ ID NO: 143750 - DNA, 75 bp, Artificial Sequence
  Synthetic
agggttgagtagcacgcagagggaggaatcctcacggagaaaagcggaaaaatcacctccagaggaccccttcag

SEQ ID NO: 143751 - DNA, 75 bp, Artificial Sequence
  Synthetic
cgaacagaaggatctctcactcggtaggagtaagaccatagcgatagggggagatgctaggagtaggggcgaccg

SEQ ID NO: 143752 - DNA, 75 bp, Artificial Sequence
  Synthetic
ccccttccaagtgaccggagggggtccttggagcgccaggggcctcgtgctctccgtgggatgctcttcccgatt

SEQ ID NO: 143753 - DNA, 75 bp, Artificial Sequence
  Synthetic
ccttggagcgccaggggcctcgtgctctccgtgggatgctcttcccgattccgaccaacccccaccccaatgagg

SEQ ID NO: 143754 - DNA, 75 bp, Artificial Sequence
  Synthetic
tcgaagagggcggacggtcctgagatctcatatcttcttacttagaagaggagtctcctggacgctcccgcccac

SEQ ID NO: 143755 - DNA, 75 bp, Artificial Sequence
  Synthetic
gggagagaagggaggatcggatgggaaaagtaaatcctacgggaagagccgggttcccgtggtgtccagtccctc

SEQ ID NO: 143756 - DNA, 75 bp, Artificial Sequence
  Synthetic
gcgcgggggaggaggaaacacccgagggggagtgagttggtaaagagcaggggaacctcggagaaactactccca

SEQ ID NO: 143757 - DNA, 75 bp, Artificial Sequence
  Synthetic
atgggcctcgttccgggcgaagggagcgcgggggaggaggaaacacccgagggggagtgagttggtaaagagcag

SEQ ID NO: 143758 - DNA, 75 bp, Artificial Sequence
  Synthetic
agaaggaaaaaagagaactcaagaggcgggagacctccccacgacgctgcagacatcctggaaggggaaagagga

SEQ ID NO: 143759 - DNA, 75 bp, Artificial Sequence
  Synthetic
aggagagttgcttcttcttgttctcgagggccttccttcttcggtgatcccgcctctcctgatcggagaaccctc

SEQ ID NO: 143760 - DNA, 75 bp, Artificial Sequence
  Synthetic
ccctgagaggcctcttcctaggtccggagtctacctccattcggtcggttcgggccttcttcgccggaggggctc

SEQ ID NO: 143761 - DNA, 75 bp, Artificial Sequence
  Synthetic
tgatcttcttcttggtcttccggagatccctctcgagctcctctaacctttttcttccagagacccactgttcga

SEQ ID NO: 143762 - DNA, 75 bp, Artificial Sequence
  Synthetic
atccctctcgagctcctctaacctttttcttccagagacccactgttcgaggacctcctcccttccctctcggtt

SEQ ID NO: 143763 - DNA, 75 bp, Artificial Sequence
  Synthetic
tggagcctggggggtcccagtggagccatgggatgcccttcccgattctgacctaccccctcccagtagggtcgc

SEQ ID NO: 143764 - DNA, 75 bp, Artificial Sequence
  Synthetic
tcgacaaagggcggcagtcctcagtactcttactcttttctgtaaagaggagactgctggactcgtcgcccaagt

SEQ ID NO: 143765 - DNA, 75 bp, Artificial Sequence
  Synthetic
gggggaaggggagagcccgaaggcggagtcttggtaaagaggcgaggaaagtcgaagagggaatcgcccaagaag

SEQ ID NO: 143766 - DNA, 75 bp, Artificial Sequence
  Synthetic
tcttcgccggaggggctccttctccgtccttatccttctttccgagaattcctttgatgtttcccagccagggat

SEQ ID NO: 143767 - DNA, 75 bp, Artificial Sequence
  Synthetic
atgggccaaatccgagcgaaggggccgaacggggagggggtcgccccgagaggggatcaatggtaaagaggcgag

SEQ ID NO: 143768 - DNA, 75 bp, Artificial Sequence
  Synthetic
cgaacggggagggggtcgccccgagaggggatcaatggtaaagaggcgaggaaatcggtagaaactactcccaag

SEQ ID NO: 143769 - DNA, 75 bp, Artificial Sequence
  Synthetic
aggggatcaatggtaaagaggcgaggaaatcggtagaaactactcccaagaaggaccagaaggggagatcaggaa

SEQ ID NO: 143770 - DNA, 75 bp, Artificial Sequence
  Synthetic
ggatgcccaggtcggaccgcgaggaggtggagatgccatgccgacccgaagaggaaagaaggacgcggacgcgaa

SEQ ID NO: 143771 - DNA, 75 bp, Artificial Sequence
  Synthetic
gaggaggatccccagaacgctggtggactcttggaagcggaagaaaggaaggcggaagagaaggggtgggctctc

SEQ ID NO: 143772 - DNA, 75 bp, Artificial Sequence
  Synthetic
gactcttggaagcggaagaaaggaaggcggaagagaaggggtgggctctccgatccgaggggcccgacgccccga

SEQ ID NO: 143773 - DNA, 75 bp, Artificial Sequence
  Synthetic
gttgagtagcactcagagggaggaatccactcggagatgagcagagaaatcacctccagaggaccccttcagcga

SEQ ID NO: 143774 - DNA, 75 bp, Artificial Sequence
  Synthetic
tccactcggagatgagcagagaaatcacctccagaggaccccttcagcgaacagaagactctcttcccggtggga

SEQ ID NO: 143775 - DNA, 75 bp, Artificial Sequence
  Synthetic
tgctaggagttaggggagaccgaagcgaggaggaaagcaaagaaagcaacggggctagccggtgggtgttcctcc

SEQ ID NO: 143776 - DNA, 75 bp, Artificial Sequence
  Synthetic
atcccggggaactcggcgaatcgtccccacatagcagagcccggctccccttcaaaaaggaccggagggggcgct

SEQ ID NO: 143777 - DNA, 75 bp, Artificial Sequence
  Synthetic
tggagcgtggggggacccgggtaggatccgtgggatgcccttcccgattccgtccatcccttccccccgagaggt

SEQ ID NO: 143778 - DNA, 75 bp, Artificial Sequence
  Synthetic
tccactcacccactgctcgaggatttcctctcttcccccgcgattcttcttcgactcggaccggctcatctcgac

SEQ ID NO: 143779 - DNA, 75 bp, Artificial Sequence
  Synthetic
atgggccacagctccgaacgaagggtccgacgggggggaagccaccccgagaggggttaactggtaaagaggcga

SEQ ID NO: 143780 - DNA, 75 bp, Artificial Sequence
  Synthetic
tccgacgggggggaagccaccccgagaggggttaactggtaaagaggcgaggaaagtcgagaaaaactgtcccaa

SEQ ID NO: 143781 - DNA, 75 bp, Artificial Sequence
  Synthetic
tccgacgggggggaagccaccccgagaggggttaactggtaaagaggcgaggaaagtcgagaaaatctgtcccaa

SEQ ID NO: 143782 - DNA, 75 bp, Artificial Sequence
  Synthetic
tccgacgggggggaagccaccccgagaggggttaactggtaaagaggcgaggaaagtcgagaaaacctgtcccaa

SEQ ID NO: 143783 - DNA, 75 bp, Artificial Sequence
  Synthetic
tccgacgggggggaagccaccccgagaggggttaactggtaaagaggcgaggaaagtcgagaaaagctgtcccaa

SEQ ID NO: 143784 - DNA, 75 bp, Artificial Sequence
  Synthetic
tccgacgggggggaagccaccccgagaggggttaactggtaaagaggcgaggaaagtcgagataaactgtcccaa

SEQ ID NO: 143785 - DNA, 75 bp, Artificial Sequence
  Synthetic
tccgacgggggggaagccaccccgagaggggttaactggtaaagaggcgaggaaagtcgagataatctgtcccaa

SEQ ID NO: 143786 - DNA, 75 bp, Artificial Sequence
  Synthetic
tccgacgggggggaagccaccccgagaggggttaactggtaaagaggcgaggaaagtcgagataacctgtcccaa

SEQ ID NO: 143787 - DNA, 75 bp, Artificial Sequence
  Synthetic
tccgacgggggggaagccaccccgagaggggttaactggtaaagaggcgaggaaagtcgagataagctgtcccaa

SEQ ID NO: 143788 - DNA, 75 bp, Artificial Sequence
  Synthetic
tccgacgggggggaagccaccccgagaggggttaactggtaaagaggcgaggaaagtcgagacaaactgtcccaa

SEQ ID NO: 143789 - DNA, 75 bp, Artificial Sequence
  Synthetic
tccgacgggggggaagccaccccgagaggggttaactggtaaagaggcgaggaaagtcgagacaatctgtcccaa

SEQ ID NO: 143790 - DNA, 75 bp, Artificial Sequence
  Synthetic
tccgacgggggggaagccaccccgagaggggttaactggtaaagaggcgaggaaagtcgagacaacctgtcccaa

SEQ ID NO: 143791 - DNA, 75 bp, Artificial Sequence
  Synthetic
tccgacgggggggaagccaccccgagaggggttaactggtaaagaggcgaggaaagtcgagacaagctgtcccaa

SEQ ID NO: 143792 - DNA, 75 bp, Artificial Sequence
  Synthetic
tccgacgggggggaagccaccccgagaggggttaactggtaaagaggcgaggaaagtcgagagaaactgtcccaa

SEQ ID NO: 143793 - DNA, 75 bp, Artificial Sequence
  Synthetic
tccgacgggggggaagccaccccgagaggggttaactggtaaagaggcgaggaaagtcgagagaatctgtcccaa

SEQ ID NO: 143794 - DNA, 75 bp, Artificial Sequence
  Synthetic
tccgacgggggggaagccaccccgagaggggttaactggtaaagaggcgaggaaagtcgagagaacctgtcccaa

SEQ ID NO: 143795 - DNA, 75 bp, Artificial Sequence
  Synthetic
tccgacgggggggaagccaccccgagaggggttaactggtaaagaggcgaggaaagtcgagagaagctgtcccaa

SEQ ID NO: 143796 - DNA, 75 bp, Artificial Sequence
  Synthetic
gaggggttaactggtaaagaggcgaggaaagtcgagaaaaactgtcccaagaagactcaagagaaaaactgagaa

SEQ ID NO: 143797 - DNA, 75 bp, Artificial Sequence
  Synthetic
gaggggttaactggtaaagaggcgaggaaagtcgagaaaaactgtcccaagaagactcaagagaaaatctgagaa

SEQ ID NO: 143798 - DNA, 75 bp, Artificial Sequence
  Synthetic
gaggggttaactggtaaagaggcgaggaaagtcgagaaaaactgtcccaagaagactcaagagaaaacctgagaa

SEQ ID NO: 143799 - DNA, 75 bp, Artificial Sequence
  Synthetic
gaggggttaactggtaaagaggcgaggaaagtcgagaaaaactgtcccaagaagactcaagagaaaagctgagaa

SEQ ID NO: 143800 - DNA, 75 bp, Artificial Sequence
  Synthetic
gaggggttaactggtaaagaggcgaggaaagtcgagaaaaactgtcccaagaagtctcaagagaaaaactgagaa

SEQ ID NO: 143801 - DNA, 75 bp, Artificial Sequence
  Synthetic
gaggggttaactggtaaagaggcgaggaaagtcgagaaaaactgtcccaagaagtctcaagagaaaatctgagaa

SEQ ID NO: 143802 - DNA, 75 bp, Artificial Sequence
  Synthetic
gaggggttaactggtaaagaggcgaggaaagtcgagaaaaactgtcccaagaagtctcaagagaaaacctgagaa

SEQ ID NO: 143803 - DNA, 75 bp, Artificial Sequence
  Synthetic
gaggggttaactggtaaagaggcgaggaaagtcgagaaaaactgtcccaagaagtctcaagagaaaagctgagaa

SEQ ID NO: 143804 - DNA, 75 bp, Artificial Sequence
  Synthetic
gaggggttaactggtaaagaggcgaggaaagtcgagaaaaactgtcccaagaagcctcaagagaaaaactgagaa

SEQ ID NO: 143805 - DNA, 75 bp, Artificial Sequence
  Synthetic
gaggggttaactggtaaagaggcgaggaaagtcgagaaaaactgtcccaagaagcctcaagagaaaatctgagaa

SEQ ID NO: 143806 - DNA, 75 bp, Artificial Sequence
  Synthetic
gaggggttaactggtaaagaggcgaggaaagtcgagaaaaactgtcccaagaagcctcaagagaaaacctgagaa

SEQ ID NO: 143807 - DNA, 75 bp, Artificial Sequence
  Synthetic
gaggggttaactggtaaagaggcgaggaaagtcgagaaaaactgtcccaagaagcctcaagagaaaagctgagaa

SEQ ID NO: 143808 - DNA, 75 bp, Artificial Sequence
  Synthetic
gaggggttaactggtaaagaggcgaggaaagtcgagaaaaactgtcccaagaaggctcaagagaaaaactgagaa

SEQ ID NO: 143809 - DNA, 75 bp, Artificial Sequence
  Synthetic
gaggggttaactggtaaagaggcgaggaaagtcgagaaaaactgtcccaagaaggctcaagagaaaatctgagaa

SEQ ID NO: 143810 - DNA, 75 bp, Artificial Sequence
  Synthetic
gaggggttaactggtaaagaggcgaggaaagtcgagaaaaactgtcccaagaaggctcaagagaaaacctgagaa

SEQ ID NO: 143811 - DNA, 75 bp, Artificial Sequence
  Synthetic
gaggggttaactggtaaagaggcgaggaaagtcgagaaaaactgtcccaagaaggctcaagagaaaagctgagaa

SEQ ID NO: 143812 - DNA, 75 bp, Artificial Sequence
  Synthetic
gaggggttaactggtaaagaggcgaggaaagtcgagaaaatctgtcccaagaagactcaagagaaaaactgagaa

SEQ ID NO: 143813 - DNA, 75 bp, Artificial Sequence
  Synthetic
gaggggttaactggtaaagaggcgaggaaagtcgagaaaatctgtcccaagaagactcaagagaaaatctgagaa

SEQ ID NO: 143814 - DNA, 75 bp, Artificial Sequence
  Synthetic
gaggggttaactggtaaagaggcgaggaaagtcgagaaaatctgtcccaagaagactcaagagaaaacctgagaa

SEQ ID NO: 143815 - DNA, 75 bp, Artificial Sequence
  Synthetic
gaggggttaactggtaaagaggcgaggaaagtcgagaaaatctgtcccaagaagactcaagagaaaagctgagaa

SEQ ID NO: 143816 - DNA, 75 bp, Artificial Sequence
  Synthetic
gaggggttaactggtaaagaggcgaggaaagtcgagaaaatctgtcccaagaagtctcaagagaaaaactgagaa

SEQ ID NO: 143817 - DNA, 75 bp, Artificial Sequence
  Synthetic
gaggggttaactggtaaagaggcgaggaaagtcgagaaaatctgtcccaagaagtctcaagagaaaatctgagaa

SEQ ID NO: 143818 - DNA, 75 bp, Artificial Sequence
  Synthetic
gaggggttaactggtaaagaggcgaggaaagtcgagaaaatctgtcccaagaagtctcaagagaaaacctgagaa

SEQ ID NO: 143819 - DNA, 75 bp, Artificial Sequence
  Synthetic
gaggggttaactggtaaagaggcgaggaaagtcgagaaaatctgtcccaagaagtctcaagagaaaagctgagaa

SEQ ID NO: 143820 - DNA, 75 bp, Artificial Sequence
  Synthetic
gaggggttaactggtaaagaggcgaggaaagtcgagaaaatctgtcccaagaagcctcaagagaaaaactgagaa

SEQ ID NO: 143821 - DNA, 75 bp, Artificial Sequence
  Synthetic
gaggggttaactggtaaagaggcgaggaaagtcgagaaaatctgtcccaagaagcctcaagagaaaatctgagaa

SEQ ID NO: 143822 - DNA, 75 bp, Artificial Sequence
  Synthetic
gaggggttaactggtaaagaggcgaggaaagtcgagaaaatctgtcccaagaagcctcaagagaaaacctgagaa

SEQ ID NO: 143823 - DNA, 75 bp, Artificial Sequence
  Synthetic
gaggggttaactggtaaagaggcgaggaaagtcgagaaaatctgtcccaagaagcctcaagagaaaagctgagaa

SEQ ID NO: 143824 - DNA, 75 bp, Artificial Sequence
  Synthetic
gaggggttaactggtaaagaggcgaggaaagtcgagaaaatctgtcccaagaaggctcaagagaaaaactgagaa

SEQ ID NO: 143825 - DNA, 75 bp, Artificial Sequence
  Synthetic
gaggggttaactggtaaagaggcgaggaaagtcgagaaaatctgtcccaagaaggctcaagagaaaatctgagaa

SEQ ID NO: 143826 - DNA, 75 bp, Artificial Sequence
  Synthetic
gaggggttaactggtaaagaggcgaggaaagtcgagaaaatctgtcccaagaaggctcaagagaaaacctgagaa

SEQ ID NO: 143827 - DNA, 75 bp, Artificial Sequence
  Synthetic
gaggggttaactggtaaagaggcgaggaaagtcgagaaaatctgtcccaagaaggctcaagagaaaagctgagaa

SEQ ID NO: 143828 - DNA, 75 bp, Artificial Sequence
  Synthetic
gaggggttaactggtaaagaggcgaggaaagtcgagaaaacctgtcccaagaagactcaagagaaaaactgagaa

SEQ ID NO: 143829 - DNA, 75 bp, Artificial Sequence
  Synthetic
gaggggttaactggtaaagaggcgaggaaagtcgagaaaacctgtcccaagaagactcaagagaaaatctgagaa

SEQ ID NO: 143830 - DNA, 75 bp, Artificial Sequence
  Synthetic
gaggggttaactggtaaagaggcgaggaaagtcgagaaaacctgtcccaagaagactcaagagaaaacctgagaa

SEQ ID NO: 143831 - DNA, 75 bp, Artificial Sequence
  Synthetic
gaggggttaactggtaaagaggcgaggaaagtcgagaaaacctgtcccaagaagactcaagagaaaagctgagaa

SEQ ID NO: 143832 - DNA, 75 bp, Artificial Sequence
  Synthetic
gaggggttaactggtaaagaggcgaggaaagtcgagaaaacctgtcccaagaagtctcaagagaaaaactgagaa

SEQ ID NO: 143833 - DNA, 75 bp, Artificial Sequence
  Synthetic
gaggggttaactggtaaagaggcgaggaaagtcgagaaaacctgtcccaagaagtctcaagagaaaatctgagaa

SEQ ID NO: 143834 - DNA, 75 bp, Artificial Sequence
  Synthetic
gaggggttaactggtaaagaggcgaggaaagtcgagaaaacctgtcccaagaagtctcaagagaaaacctgagaa

SEQ ID NO: 143835 - DNA, 75 bp, Artificial Sequence
  Synthetic
gaggggttaactggtaaagaggcgaggaaagtcgagaaaacctgtcccaagaagtctcaagagaaaagctgagaa

SEQ ID NO: 143836 - DNA, 75 bp, Artificial Sequence
  Synthetic
gaggggttaactggtaaagaggcgaggaaagtcgagaaaacctgtcccaagaagcctcaagagaaaaactgagaa

SEQ ID NO: 143837 - DNA, 75 bp, Artificial Sequence
  Synthetic
gaggggttaactggtaaagaggcgaggaaagtcgagaaaacctgtcccaagaagcctcaagagaaaatctgagaa

SEQ ID NO: 143838 - DNA, 75 bp, Artificial Sequence
  Synthetic
gaggggttaactggtaaagaggcgaggaaagtcgagaaaacctgtcccaagaagcctcaagagaaaacctgagaa

SEQ ID NO: 143839 - DNA, 75 bp, Artificial Sequence
  Synthetic
gaggggttaactggtaaagaggcgaggaaagtcgagaaaacctgtcccaagaagcctcaagagaaaagctgagaa

SEQ ID NO: 143840 - DNA, 75 bp, Artificial Sequence
  Synthetic
gaggggttaactggtaaagaggcgaggaaagtcgagaaaacctgtcccaagaaggctcaagagaaaaactgagaa

SEQ ID NO: 143841 - DNA, 75 bp, Artificial Sequence
  Synthetic
gaggggttaactggtaaagaggcgaggaaagtcgagaaaacctgtcccaagaaggctcaagagaaaatctgagaa

SEQ ID NO: 143842 - DNA, 75 bp, Artificial Sequence
  Synthetic
gaggggttaactggtaaagaggcgaggaaagtcgagaaaacctgtcccaagaaggctcaagagaaaacctgagaa

SEQ ID NO: 143843 - DNA, 75 bp, Artificial Sequence
  Synthetic
gaggggttaactggtaaagaggcgaggaaagtcgagaaaacctgtcccaagaaggctcaagagaaaagctgagaa

SEQ ID NO: 143844 - DNA, 75 bp, Artificial Sequence
  Synthetic
gaggggttaactggtaaagaggcgaggaaagtcgagaaaagctgtcccaagaagactcaagagaaaaactgagaa

SEQ ID NO: 143845 - DNA, 75 bp, Artificial Sequence
  Synthetic
gaggggttaactggtaaagaggcgaggaaagtcgagaaaagctgtcccaagaagactcaagagaaaatctgagaa

SEQ ID NO: 143846 - DNA, 75 bp, Artificial Sequence
  Synthetic
gaggggttaactggtaaagaggcgaggaaagtcgagaaaagctgtcccaagaagactcaagagaaaacctgagaa

SEQ ID NO: 143847 - DNA, 75 bp, Artificial Sequence
  Synthetic
gaggggttaactggtaaagaggcgaggaaagtcgagaaaagctgtcccaagaagactcaagagaaaagctgagaa

SEQ ID NO: 143848 - DNA, 75 bp, Artificial Sequence
  Synthetic
gaggggttaactggtaaagaggcgaggaaagtcgagaaaagctgtcccaagaagtctcaagagaaaaactgagaa

SEQ ID NO: 143849 - DNA, 75 bp, Artificial Sequence
  Synthetic
gaggggttaactggtaaagaggcgaggaaagtcgagaaaagctgtcccaagaagtctcaagagaaaatctgagaa

SEQ ID NO: 143850 - DNA, 75 bp, Artificial Sequence
  Synthetic
gaggggttaactggtaaagaggcgaggaaagtcgagaaaagctgtcccaagaagtctcaagagaaaacctgagaa

SEQ ID NO: 143851 - DNA, 75 bp, Artificial Sequence
  Synthetic
gaggggttaactggtaaagaggcgaggaaagtcgagaaaagctgtcccaagaagtctcaagagaaaagctgagaa

SEQ ID NO: 143852 - DNA, 75 bp, Artificial Sequence
  Synthetic
gaggggttaactggtaaagaggcgaggaaagtcgagaaaagctgtcccaagaagcctcaagagaaaaactgagaa

SEQ ID NO: 143853 - DNA, 75 bp, Artificial Sequence
  Synthetic
gaggggttaactggtaaagaggcgaggaaagtcgagaaaagctgtcccaagaagcctcaagagaaaatctgagaa

SEQ ID NO: 143854 - DNA, 75 bp, Artificial Sequence
  Synthetic
gaggggttaactggtaaagaggcgaggaaagtcgagaaaagctgtcccaagaagcctcaagagaaaacctgagaa

SEQ ID NO: 143855 - DNA, 75 bp, Artificial Sequence
  Synthetic
gaggggttaactggtaaagaggcgaggaaagtcgagaaaagctgtcccaagaagcctcaagagaaaagctgagaa

SEQ ID NO: 143856 - DNA, 75 bp, Artificial Sequence
  Synthetic
gaggggttaactggtaaagaggcgaggaaagtcgagaaaagctgtcccaagaaggctcaagagaaaaactgagaa

SEQ ID NO: 143857 - DNA, 75 bp, Artificial Sequence
  Synthetic
gaggggttaactggtaaagaggcgaggaaagtcgagaaaagctgtcccaagaaggctcaagagaaaatctgagaa

SEQ ID NO: 143858 - DNA, 75 bp, Artificial Sequence
  Synthetic
gaggggttaactggtaaagaggcgaggaaagtcgagaaaagctgtcccaagaaggctcaagagaaaacctgagaa

SEQ ID NO: 143859 - DNA, 75 bp, Artificial Sequence
  Synthetic
gaggggttaactggtaaagaggcgaggaaagtcgagaaaagctgtcccaagaaggctcaagagaaaagctgagaa

SEQ ID NO: 143860 - DNA, 75 bp, Artificial Sequence
  Synthetic
tattcactggggacgacaactctggggagaaaagggaggatcggatgggaagagtatatcctacgggaatccccc

SEQ ID NO: 143861 - DNA, 75 bp, Artificial Sequence
  Synthetic
ggagaaaagggaggatcggatgggaagagtatatcctacgggaatcccccggtccctctcacgtccagcccctcc

SEQ ID NO: 143862 - DNA, 75 bp, Artificial Sequence
  Synthetic
ggaggacctatccccaagacgctgtggagactctcggaaggggaaagaggaaggcgagaagaaaaaggggtgggc

SEQ ID NO: 143863 - DNA, 75 bp, Artificial Sequence
  Synthetic
ggaggacctttccccaagacgctgtggagactctcggaaggggaaagaggaaggcgagaagaaaaaggggtgggc

SEQ ID NO: 143864 - DNA, 75 bp, Artificial Sequence
  Synthetic
ggaggacctctccccaagacgctgtggagactctcggaaggggaaagaggaaggcgagaagaaaaaggggtgggc

SEQ ID NO: 143865 - DNA, 75 bp, Artificial Sequence
  Synthetic
ggaggacctgtccccaagacgctgtggagactctcggaaggggaaagaggaaggcgagaagaaaaaggggtgggc

SEQ ID NO: 143866 - DNA, 75 bp, Artificial Sequence
  Synthetic
ggagactctcggaaggggaaagaggaaggcgagaagaaaaaggggtgggcccccgatccgaggggtccggcgtcg

SEQ ID NO: 143867 - DNA, 75 bp, Artificial Sequence
  Synthetic
aactttggagagagctccgggccgaatggtcgagtagcacacggagggagaaagccacacggagatgagcagaaa

SEQ ID NO: 143868 - DNA, 75 bp, Artificial Sequence
  Synthetic
atggtcgagtagcacacggagggagaaagccacacggagatgagcagaaaaaccacctccagaggaccccttcaa

SEQ ID NO: 143869 - DNA, 75 bp, Artificial Sequence
  Synthetic
atggtcgagtagcacacggagggagaaagccacacggagatgagcagaaaaaccacctccagaggaccccttcta

SEQ ID NO: 143870 - DNA, 75 bp, Artificial Sequence
  Synthetic
atggtcgagtagcacacggagggagaaagccacacggagatgagcagaaaaaccacctccagaggaccccttcca

SEQ ID NO: 143871 - DNA, 75 bp, Artificial Sequence
  Synthetic
atggtcgagtagcacacggagggagaaagccacacggagatgagcagaaaaaccacctccagaggaccccttcga

SEQ ID NO: 143872 - DNA, 75 bp, Artificial Sequence
  Synthetic
gcgaacagaggacgctctcggacggcaggagtaagaccgtagcgataggagaggatgctaggaggcgggagcgac

SEQ ID NO: 143873 - DNA, 75 bp, Artificial Sequence
  Synthetic
ggagagctgtttcttcttgttctcgagggccttccttcgtcggtgatcctgcctctccttgtcggtgaatcctcc

SEQ ID NO: 143874 - DNA, 75 bp, Artificial Sequence
  Synthetic
ggcttatcccggggaactcggcgaatcgtccccacatagcagctcctcggacccccttccaaaggaccgaggggg

SEQ ID NO: 143875 - DNA, 75 bp, Artificial Sequence
  Synthetic
tcgtccccacatagcagctcctcggacccccttccaaaggaccgaggggggagctaggagcgtgggggggaccgt

SEQ ID NO: 143876 - DNA, 75 bp, Artificial Sequence
  Synthetic
gatcttcttcttggccttccggaggtctctctcgagctcctctatccttcttcttccattgacccactgctcgag

SEQ ID NO: 143877 - DNA, 75 bp, Artificial Sequence
  Synthetic
tctctctcgagctcctctatccttcttcttccattgacccactgctcgagggcgtcctccctgccccctcggttc

SEQ ID NO: 143878 - DNA, 75 bp, Artificial Sequence
  Synthetic
ttcttcgactcggtccggctcatcccggcaagaggcggcagtcctcagtgctcttactctttcctataaagagga

SEQ ID NO: 143879 - DNA, 75 bp, Artificial Sequence
  Synthetic
cggcaagaggcggcagtcctcagtgctcttactctttcctataaagaggagactgctggactcgccgcccaagcc

SEQ ID NO: 143880 - DNA, 75 bp, Artificial Sequence
  Synthetic
catgagccacgttccgagcgaagagacgcggggggaggatcagcgcccgagagggagtgagacggtaaagagcat

SEQ ID NO: 143881 - DNA, 75 bp, Artificial Sequence
  Synthetic
acgcggggggaggatcagcgcccgagagggagtgagacggtaaagagcattggatcgtcggaggagttctcccaa

SEQ ID NO: 143882 - DNA, 75 bp, Artificial Sequence
  Synthetic
gaagagagaagaggagacaagaggtggacgaggtccccaagacgctggagacacccttggaaggggaaagaggag

SEQ ID NO: 143883 - DNA, 75 bp, Artificial Sequence
  Synthetic
cgatccgaggggcccaaccaccaagtttggagggcactccgggccgaagggttgagtagcacccagagggggggg

SEQ ID NO: 143884 - DNA, 75 bp, Artificial Sequence
  Synthetic
gaagagtatatcctacgggaatccgcgatcccccctcacgtccagcccctccccgtgtctggtgaagggggactc

SEQ ID NO: 143885 - DNA, 75 bp, Artificial Sequence
  Synthetic
tccactcggagtggaacagagaaatcacctccagaggaccccttcagcgaacagaagagcgctcgggtggtagga

SEQ ID NO: 143886 - DNA, 75 bp, Artificial Sequence
  Synthetic
tcaacttcagaagttcctcttcctcctccttgctgaggctcttccctcctccggcgagctgtttcctcttgttct

SEQ ID NO: 143887 - DNA, 75 bp, Artificial Sequence
  Synthetic
tcaacttctgaagttcctcttcctcctccttgctgaggctcttccctcctccggcgagctgtttcctcttgttct

SEQ ID NO: 143888 - DNA, 75 bp, Artificial Sequence
  Synthetic
tcaacttccgaagttcctcttcctcctccttgctgaggctcttccctcctccggcgagctgtttcctcttgttct

SEQ ID NO: 143889 - DNA, 75 bp, Artificial Sequence
  Synthetic
tcaacttcggaagttcctcttcctcctccttgctgaggctcttccctcctccggcgagctgtttcctcttgttct

SEQ ID NO: 143890 - DNA, 75 bp, Artificial Sequence
  Synthetic
cgagggccttccttcttcggtggtcctgcctctccttgtcggtgaagtctcccccgtgaggcctcttcctaggtc

SEQ ID NO: 143891 - DNA, 75 bp, Artificial Sequence
  Synthetic
ttccaaagtgaccgggggggtcacttggagcgcaagggagccggtggagccatgggatgctcctcccgatgctcg

SEQ ID NO: 143892 - DNA, 75 bp, Artificial Sequence
  Synthetic
cggagtctacttccatatcgtccgtccgggccctcttcgccgggggagcccccctctcgtccttttccttctttc

SEQ ID NO: 143893 - DNA, 75 bp, Artificial Sequence
  Synthetic
catggcagagggcaacggtcctcagtactcttactctttcctataaagaggagactgctggactcgtgccccagc

SEQ ID NO: 143894 - DNA, 75 bp, Artificial Sequence
  Synthetic
cttggcagagggcaacggtcctcagtactcttactctttcctataaagaggagactgctggactcgtgccccagc

SEQ ID NO: 143895 - DNA, 75 bp, Artificial Sequence
  Synthetic
cctggcagagggcaacggtcctcagtactcttactctttcctataaagaggagactgctggactcgtgccccagc

SEQ ID NO: 143896 - DNA, 75 bp, Artificial Sequence
  Synthetic
cgtggcagagggcaacggtcctcagtactcttactctttcctataaagaggagactgctggactcgtgccccagc

SEQ ID NO: 143897 - DNA, 75 bp, Artificial Sequence
  Synthetic
ctccttgcatgctggggacgaagccgcccccgggcgctcccctcgatgctccttcgagggggttcacacccccaa

SEQ ID NO: 143898 - DNA, 75 bp, Artificial Sequence
  Synthetic
tatcccggggaactcggcgaaacgtccccacatagcagatcccaggaccccctttcgaaaagaccgaggggggtg

SEQ ID NO: 143899 - DNA, 75 bp, Artificial Sequence
  Synthetic
gctaggaacacgggggggccagtggagccatgggatgctcttcccgattccgtccatcccctccccccgagcgtc

SEQ ID NO: 143900 - DNA, 75 bp, Artificial Sequence
  Synthetic
tccatccctgtccttctttccgagaattcctttgatgtttcccagccagggattgtcgtcctctaacttcttgat

SEQ ID NO: 143901 - DNA, 75 bp, Artificial Sequence
  Synthetic
tttcttcttcgccttccggagttccctctcgagatcctctaacttctttcttccgctcacccactgctcgagaac

SEQ ID NO: 143902 - DNA, 75 bp, Artificial Sequence
  Synthetic
catgagccaagtccgaacgagggagcgccctggggaggaatcagacaacgagaggggatgaactggtaaagaggc

SEQ ID NO: 143903 - DNA, 75 bp, Artificial Sequence
  Synthetic
cgccctggggaggaatcagacaacgagaggggatgaactggtaaagaggcgaggaacggcgaggggatgtctccc

SEQ ID NO: 143904 - DNA, 75 bp, Artificial Sequence
  Synthetic
agaggggatgaactggtaaagaggcgaggaacggcgaggggatgtctcccaagaaggtcaaagagaaggcaagaa

SEQ ID NO: 143905 - DNA, 75 bp, Artificial Sequence
  Synthetic
tcggaggatttccccaaaacgctggagacatcctggaaggggaaagaggacagatggaagaaaaaggggcgggcc

SEQ ID NO: 143906 - DNA, 75 bp, Artificial Sequence
  Synthetic
agacatcctggaaggggaaagaggacagatggaagaaaaaggggcgggcccccccgatccgaggggcccgactgc

SEQ ID NO: 143907 - DNA, 75 bp, Artificial Sequence
  Synthetic
aaatcacctccagaggaccccttcagcgaacaaagagcgccctggggaggaataagaccatagcgataggagggg

SEQ ID NO: 143908 - DNA, 75 bp, Artificial Sequence
  Synthetic
atctctctcgagctcctcctgctttcttcttccagttacccactgctcgaggatttcttcccttcccccgcgatt

SEQ ID NO: 143909 - DNA, 75 bp, Artificial Sequence
  Synthetic
aagggtccgcggggggagggatcaactcccgagagggagtcactggcaagaaagggggaacctcgaggagatgcc

SEQ ID NO: 143910 - DNA, 75 bp, Artificial Sequence
  Synthetic
aaagggggaacctcgaggagatgcctcccaagaaggcagagagaagacaagaatcggaagactctccccaagacg

SEQ ID NO: 143911 - DNA, 75 bp, Artificial Sequence
  Synthetic
ctggagtcatcctggaaggggaaagaggacgggtggaaaagaaggggcgggcctcccgatccgaggggcccaacc

SEQ ID NO: 143912 - DNA, 75 bp, Artificial Sequence
  Synthetic
catgggccaattccgaacgaagagtcgcgcggcggaaggatcagcaaccgagagggagtagatggcaaaggggat

SEQ ID NO: 143913 - DNA, 75 bp, Artificial Sequence
  Synthetic
ccgagtggacgttgtcctccttcggatgcccaggtcggaccgcgaggaggtggagatgccatgccgacccgaaga

SEQ ID NO: 143914 - DNA, 75 bp, Artificial Sequence
  Synthetic
agagggagtagatggcaaaggggattggaacgccgggaggacgactcccaagaagaaaagagaagagacaagaga

SEQ ID NO: 143915 - DNA, 75 bp, Artificial Sequence
  Synthetic
cggacgaatccccccaagacgctagagacatcctggaatgagaaagaggaaggtggaaaaagaggaggcgggccc

SEQ ID NO: 143916 - DNA, 75 bp, Artificial Sequence
  Synthetic
cccgatccgaggggcccggccaccaggatttggagagcactccggcccgtatggtcgagtagcacccagagggag

SEQ ID NO: 143917 - DNA, 75 bp, Artificial Sequence
  Synthetic
ggatttggagagcactccggcccgtatggtcgagtagcacccagagggaggagaccacgcagagaaagcggagaa

SEQ ID NO: 143918 - DNA, 75 bp, Artificial Sequence
  Synthetic
atcacctccagaggaccccttcagcgaacagaagaccctctcactcgataggagtaagaccatagcgatgggggg

SEQ ID NO: 143919 - DNA, 75 bp, Artificial Sequence
  Synthetic
ggagtaagaccatagcgatggggggagatgctaggagttagaggagaccgaagcgaggaggaaagtaaagaaagc

SEQ ID NO: 143920 - DNA, 75 bp, Artificial Sequence
  Synthetic
cttctctcgtcttcctcggtcaacctcttgagttcctcttcctcctccttgctcaggcgcttccctccactgctc

SEQ ID NO: 143921 - DNA, 75 bp, Artificial Sequence
  Synthetic
tccccccgagaggggaagagtgaggcttatcccggggaactcgacgtagcgtccccatctagcaggatcccggac

SEQ ID NO: 143922 - DNA, 75 bp, Artificial Sequence
  Synthetic
agcttcgaacggaggggaccggtggatccgttggaagcgctcccccccgttccgcccaaacccacctcccccaag

SEQ ID NO: 143923 - DNA, 75 bp, Artificial Sequence
  Synthetic
tcttccctcccctggcgtcttttcctcgattcggcccggctcatctcgacaagaggcggcgatcctcagtgctct

SEQ ID NO: 143924 - DNA, 75 bp, Artificial Sequence
  Synthetic
catgagccaattccgaacgagaggaacgcgttcggagggatcagcgccggagaggggtgaattccaaagaagcgg

SEQ ID NO: 143925 - DNA, 75 bp, Artificial Sequence
  Synthetic
acgcgttcggagggatcagcgccggagaggggtgaattccaaagaagcggggaatttcggagaaaattctcccaa

SEQ ID NO: 143926 - DNA, 75 bp, Artificial Sequence
  Synthetic
agaggggtgaattccaaagaagcggggaatttcggagaaaattctcccaagatggggaagagaagacaagaatcg

SEQ ID NO: 143927 - DNA, 75 bp, Artificial Sequence
  Synthetic
gggaagagcaggtcctacgggaatccccggtctcccctcacgtccagcccctccccggttctggagaagggggac

SEQ ID NO: 143928 - DNA, 75 bp, Artificial Sequence
  Synthetic
ggtggaaaagaaggggcgggcctcccgatccgaggggcccaactaccaagtttggagagcactccgggccgaagg

SEQ ID NO: 143929 - DNA, 75 bp, Artificial Sequence
  Synthetic
cgatccgaggggcccaactaccaagtttggagagcactccgggccgaaggggagagtagtctccagagggaggaa

SEQ ID NO: 143930 - DNA, 75 bp, Artificial Sequence
  Synthetic
tccacacggagtagaacagagaaatcacctccagaggaccccttcagcgaacagaagagccttgcacgggatagg

SEQ ID NO: 143931 - DNA, 75 bp, Artificial Sequence
  Synthetic
acagaagagccttgcacgggataggagtaagaccatagcgatggggggacatgctaggagtgggaagcgaccaaa

SEQ ID NO: 143932 - DNA, 75 bp, Artificial Sequence
  Synthetic
tcctgcctctccctgtcggtgaatcctcccctgagaggcctcttcctaggtccggagtctacctccatctggtcc

SEQ ID NO: 143933 - DNA, 75 bp, Artificial Sequence
  Synthetic
ccccacatagcagagtcccgagccccttccgaaagtgaccgaggggggagcttggagcgcgggggaccagtggag

SEQ ID NO: 143934 - DNA, 75 bp, Artificial Sequence
  Synthetic
ccatgggatgctcctcccgattccgtccatccccacccccaggagggtcgcccaggaatggcgggaccccactca

SEQ ID NO: 143935 - DNA, 75 bp, Artificial Sequence
  Synthetic
gaggtccctctcgagttcctctaacctttttcttccattcacccactgctcgagaatgtcttctcttcccccgcg

SEQ ID NO: 143936 - DNA, 75 bp, Artificial Sequence
  Synthetic
ttgagccccatccgggcgaagagtccgacggggaagaggaacaacccgagaggggacccagcgataaagatgcga

SEQ ID NO: 143937 - DNA, 75 bp, Artificial Sequence
  Synthetic
cgacggggaagaggaacaacccgagaggggacccagcgataaagatgcgaggaacgccgacggatgtcctcccaa

SEQ ID NO: 143938 - DNA, 75 bp, Artificial Sequence
  Synthetic
aggggacccagcgataaagatgcgaggaacgccgacggatgtcctcccaagaagacccaagagaagacgcaagaa

SEQ ID NO: 143939 - DNA, 75 bp, Artificial Sequence
  Synthetic
gaggaattttccctaggacgctggtggactcttggaaggggaaagaggaaggtggaagagaggagggagccttcc

SEQ ID NO: 143940 - DNA, 75 bp, Artificial Sequence
  Synthetic
ggactcttggaaggggaaagaggaaggtggaagagaggagggagccttccgattcgaatggccagactgccaagt

SEQ ID NO: 143941 - DNA, 75 bp, Artificial Sequence
  Synthetic
ttggagatcttcggcccgaaaggttgagtagcccccagagggagaaaaccacaccgagagtgtcagagaaatcac

SEQ ID NO: 143942 - DNA, 75 bp, Artificial Sequence
  Synthetic
gagtagcccccagagggagaaaaccacaccgagagtgtcagagaaatcacctccagaggaccccttcagcgaaca

SEQ ID NO: 143943 - DNA, 75 bp, Artificial Sequence
  Synthetic
gaagacctctcactcggtgggagtaagaccatagcgatggggggagatgctaggagttagaggggaccaaagcga

SEQ ID NO: 143944 - DNA, 75 bp, Artificial Sequence
  Synthetic
aggcggcgggccggctactcttctttcccttctctcgtcttcaatggtcaacttctcgagttcctcttgttcctc

SEQ ID NO: 143945 - DNA, 75 bp, Artificial Sequence
  Synthetic
agaccatagcgatggggggagatgctaggagttagaggggaccaaagcgaggaggaaagtaaaaagagcagcggg

SEQ ID NO: 143946 - DNA, 75 bp, Artificial Sequence
  Synthetic
agaccatagcgatggggggagatgctaggagttagaggggaccaaagcgaggaggaaagtaaatagagcagcggg

SEQ ID NO: 143947 - DNA, 75 bp, Artificial Sequence
  Synthetic
agaccatagcgatggggggagatgctaggagttagaggggaccaaagcgaggaggaaagtaaacagagcagcggg

SEQ ID NO: 143948 - DNA, 75 bp, Artificial Sequence
  Synthetic
agaccatagcgatggggggagatgctaggagttagaggggaccaaagcgaggaggaaagtaaagagagcagcggg

SEQ ID NO: 143949 - DNA, 75 bp, Artificial Sequence
  Synthetic
gctagccggtgggtgttccgcctcccgagggggacgagtgaggcttatcccggggaactcggcgaatcgtcccca

SEQ ID NO: 143950 - DNA, 75 bp, Artificial Sequence
  Synthetic
cgagggggacgagtgaggcttatcccggggaactcggcgaatcgtccccacatagcagatccacggacccccttc

SEQ ID NO: 143951 - DNA, 75 bp, Artificial Sequence
  Synthetic
caaaagactggggggaggatccttagagcaccgggagacgcgcgggtccgtgggatgctcctcccgattccgccc

SEQ ID NO: 143952 - DNA, 75 bp, Artificial Sequence
  Synthetic
tctccatccttatccttctttccgagaattcctttgatgtttcccagccagggattgtcttcctctagtttcttg

SEQ ID NO: 143953 - DNA, 75 bp, Artificial Sequence
  Synthetic
tgggatgctcctcccgattccgcccatcccacccccccgggaggtccccccaggaatggcgggacccctctcatc

SEQ ID NO: 143954 - DNA, 75 bp, Artificial Sequence
  Synthetic
gaattcctttgatgtttcccagccagggattgtcttcctctagtttcttgattttcttcttctccttccggagat

SEQ ID NO: 143955 - DNA, 75 bp, Artificial Sequence
  Synthetic
attttcttcttctccttccggagatttctctcgagatcctcgactaactttcttgaattcacccacttctcaaga

SEQ ID NO: 143956 - DNA, 75 bp, Artificial Sequence
  Synthetic
ttctctcgagatcctcgactaactttcttgaattcacccacttctcaagaacctcttcccttccgtcgcgcttcc

SEQ ID NO: 143957 - DNA, 75 bp, Artificial Sequence
  Synthetic
atgagccaatgctgatcgaagatcccgcgaggggaagggtcagcgctcgagaggggatagaaggtaaagagcatt

SEQ ID NO: 143958 - DNA, 75 bp, Artificial Sequence
  Synthetic
cgcgaggggaagggtcagcgctcgagaggggatagaaggtaaagagcattggaacgccgggaggaattctcccaa

SEQ ID NO: 143959 - DNA, 75 bp, Artificial Sequence
  Synthetic
gaggggatagaaggtaaagagcattggaacgccgggaggaattctcccaagaagccaagagagtatcgggaagga

SEQ ID NO: 143960 - DNA, 75 bp, Artificial Sequence
  Synthetic
ggactatccccaggacgctggagtcatctcggaatgggaaacagggaagcttgaagagaaggggggggcccccga

SEQ ID NO: 143961 - DNA, 75 bp, Artificial Sequence
  Synthetic
atctcggaatgggaaacagggaagcttgaagagaaggggggggcccccgatccgagggtcccggctaccgagttt

SEQ ID NO: 143962 - DNA, 75 bp, Artificial Sequence
  Synthetic
ggagagcactccgggccgaagggttgagtagcacacggagggagacatccactcggagaaagcagaaaaaccacc

SEQ ID NO: 143963 - DNA, 75 bp, Artificial Sequence
  Synthetic
tccagaggacccattcagcgaacagagagcccccgcacgggataggagtaagaccatagcgatagggggagatgc

SEQ ID NO: 143964 - DNA, 75 bp, Artificial Sequence
  Synthetic
gctagccgtcaggtgttccaccccccgagaggggacgagtgaggcttatcccggggaacccggcgaatcgtcccc

SEQ ID NO: 143965 - DNA, 75 bp, Artificial Sequence
  Synthetic
ctcttcgccggaggtgctccttctccatccttatccttctttccgattattcctttgatgttccccagccaggga

SEQ ID NO: 143966 - DNA, 75 bp, Artificial Sequence
  Synthetic
cgagaggggacgagtgaggcttatcccggggaacccggcgaatcgtccccacatagcgagttcccggaccccctt

SEQ ID NO: 143967 - DNA, 75 bp, Artificial Sequence
  Synthetic
catccttatccttctttccgattattcctttgatgttccccagccagggattttcttcctcgagtttcttgacct

SEQ ID NO: 143968 - DNA, 75 bp, Artificial Sequence
  Synthetic
ccaaagtgaccgaggggggagctaggaactcgggggaccagtggatcctacatgggatgctcttcccgattccgt

SEQ ID NO: 143969 - DNA, 75 bp, Artificial Sequence
  Synthetic
tcttcttgctcttccggaggttccgctcgagttcctcgacttttcttctttcgctgacccactgctcgaggatgt

SEQ ID NO: 143970 - DNA, 75 bp, Artificial Sequence
  Synthetic
ctcgagttcctcgacttttcttctttcgctgacccactgctcgaggatgttctccctgtcccctcggttcttctt

SEQ ID NO: 143971 - DNA, 75 bp, Artificial Sequence
  Synthetic
cgactcggaacggctcatctcggcaagaggcggcgatccctaggttctcttactcttttctgtaaagaggagacc

SEQ ID NO: 143972 - DNA, 75 bp, Artificial Sequence
  Synthetic
agaggcggcgatccctaggttctcttactcttttctgtaaagaggagaccgctgggtccgccgccccagtccgag

SEQ ID NO: 143973 - DNA, 75 bp, Artificial Sequence
  Synthetic
cctgtcgagtgaagggggactccgggactccttgcatgctggggacgaagccgcccccgggcgctcccctcgatc

SEQ ID NO: 143974 - DNA, 75 bp, Artificial Sequence
  Synthetic
ccgcagatgggaggatcagccaccggtgagggacgcgatggcaagagtggaggaaagttcgagggaaatcccaag

SEQ ID NO: 143975 - DNA, 75 bp, Artificial Sequence
  Synthetic
ttcgagggggttcacacctccaggcggcgggccggctactcttcttttcctttcctcgtcttctttggtcaactt

SEQ ID NO: 143976 - DNA, 75 bp, Artificial Sequence
  Synthetic
tttcctcgtcttctttggtcaacttcgcgagttccccttcttcctccttgctgaggctcttccctcccccggcga

SEQ ID NO: 143977 - DNA, 75 bp, Artificial Sequence
  Synthetic
tccttgtcggtgaagtctcccccgtgaggcctcttcctaggtccggagtctacctccatccggtccgctcggggc

SEQ ID NO: 143978 - DNA, 75 bp, Artificial Sequence
  Synthetic
catccttatacttctttccgagaattcctttgatgttccccagccagggattatcgtcctctaacttcttgatct

SEQ ID NO: 143979 - DNA, 75 bp, Artificial Sequence
  Synthetic
catccttatacttctttccgagaattcctttgatgttccccagccagggattttcgtcctctaacttcttgatct

SEQ ID NO: 143980 - DNA, 75 bp, Artificial Sequence
  Synthetic
catccttatacttctttccgagaattcctttgatgttccccagccagggattctcgtcctctaacttcttgatct

SEQ ID NO: 143981 - DNA, 75 bp, Artificial Sequence
  Synthetic
catccttatacttctttccgagaattcctttgatgttccccagccagggattgtcgtcctctaacttcttgatct

SEQ ID NO: 143982 - DNA, 75 bp, Artificial Sequence
  Synthetic
catccttatacttctttccgagtattcctttgatgttccccagccagggattatcgtcctctaacttcttgatct

SEQ ID NO: 143983 - DNA, 75 bp, Artificial Sequence
  Synthetic
catccttatacttctttccgagtattcctttgatgttccccagccagggattttcgtcctctaacttcttgatct

SEQ ID NO: 143984 - DNA, 75 bp, Artificial Sequence
  Synthetic
catccttatacttctttccgagtattcctttgatgttccccagccagggattctcgtcctctaacttcttgatct

SEQ ID NO: 143985 - DNA, 75 bp, Artificial Sequence
  Synthetic
catccttatacttctttccgagtattcctttgatgttccccagccagggattgtcgtcctctaacttcttgatct

SEQ ID NO: 143986 - DNA, 75 bp, Artificial Sequence
  Synthetic
catccttatacttctttccgagcattcctttgatgttccccagccagggattatcgtcctctaacttcttgatct

SEQ ID NO: 143987 - DNA, 75 bp, Artificial Sequence
  Synthetic
catccttatacttctttccgagcattcctttgatgttccccagccagggattttcgtcctctaacttcttgatct

SEQ ID NO: 143988 - DNA, 75 bp, Artificial Sequence
  Synthetic
catccttatacttctttccgagcattcctttgatgttccccagccagggattctcgtcctctaacttcttgatct

SEQ ID NO: 143989 - DNA, 75 bp, Artificial Sequence
  Synthetic
catccttatacttctttccgagcattcctttgatgttccccagccagggattgtcgtcctctaacttcttgatct

SEQ ID NO: 143990 - DNA, 75 bp, Artificial Sequence
  Synthetic
catccttatacttctttccgaggattcctttgatgttccccagccagggattatcgtcctctaacttcttgatct

SEQ ID NO: 143991 - DNA, 75 bp, Artificial Sequence
  Synthetic
catccttatacttctttccgaggattcctttgatgttccccagccagggattttcgtcctctaacttcttgatct

SEQ ID NO: 143992 - DNA, 75 bp, Artificial Sequence
  Synthetic
catccttatacttctttccgaggattcctttgatgttccccagccagggattctcgtcctctaacttcttgatct

SEQ ID NO: 143993 - DNA, 75 bp, Artificial Sequence
  Synthetic
catccttatacttctttccgaggattcctttgatgttccccagccagggattgtcgtcctctaacttcttgatct

SEQ ID NO: 143994 - DNA, 75 bp, Artificial Sequence
  Synthetic
tcttcttggtcttccggaggtccctctcgagttcctctaacttctttcttccttccacccactgctcgagaacgt

SEQ ID NO: 143995 - DNA, 75 bp, Artificial Sequence
  Synthetic
ctcgagttcctctaacttctttcttccttccacccactgctcgagaacgttctctcttcccccgcggcttttctt

SEQ ID NO: 143996 - DNA, 75 bp, Artificial Sequence
  Synthetic
cgaatcagctcggctcatctcgacaagaggcggcggtcctcagtgctcttactctttcttgataagaggagactg

SEQ ID NO: 143997 - DNA, 75 bp, Artificial Sequence
  Synthetic
agaggcggcggtcctcagtgctcttactctttcttgataagaggagactgctggacccgccgcccaagttcgagc

SEQ ID NO: 143998 - DNA, 75 bp, Artificial Sequence
  Synthetic
gatgggcctcagtgccgacgaggggtccgcaagcgggaggatcagccaccggtgagggacgcgatggcaagagtg

SEQ ID NO: 143999 - DNA, 75 bp, Artificial Sequence
  Synthetic
gaggaaagttcggagggaaatcccaagagggtcactcgagattcaagcggtgaggagggatccccgagacgctgg

SEQ ID NO: 144000 - DNA, 75 bp, Artificial Sequence
  Synthetic
tgaggagggatccccgagacgctggtggagccccgggaaaaagaaaaagaaggcaagggattggtagaaaagagc

SEQ ID NO: 144001 - DNA, 75 bp, Artificial Sequence
  Synthetic
aggcaagggattggtagaaaagagcgagcctcccgatacgagtttgccaggacctatcaagtttggagtcatccg

SEQ ID NO: 144002 - DNA, 75 bp, Artificial Sequence
  Synthetic
gagcctcccgatacgagtttgccaggacctatcaagtttggagtcatccgggccgtaggggagaatagaacaccg

SEQ ID NO: 144003 - DNA, 75 bp, Artificial Sequence
  Synthetic
tcttctttcccttctctcgtcttcctcggtcaacctccgaagttcctcttcttcctccctgctgaggctctttcc

SEQ ID NO: 144004 - DNA, 75 bp, Artificial Sequence
  Synthetic
tgaggcttatcccggggatcggcctctgttcctccatggaggactccaggacccccgaaagggaggggggtgggc

SEQ ID NO: 144005 - DNA, 75 bp, Artificial Sequence
  Synthetic
cttgagattcttgttgaccttccggagctccctctcgagttcctcctttcttcttcttccatcgatccacttccc

SEQ ID NO: 144006 - DNA, 75 bp, Artificial Sequence
  Synthetic
gtgggccacagttctggacgaagagccgcacggggagggttcagcgcccgagaggggatggatcgcaaaggtgcg

SEQ ID NO: 144007 - DNA, 75 bp, Artificial Sequence
  Synthetic
ccgcacggggagggttcagcgcccgagaggggatggatcgcaaaggtgcggggaattcggataagttatctccta

SEQ ID NO: 144008 - DNA, 75 bp, Artificial Sequence
  Synthetic
agaggggatggatcgcaaaggtgcggggaattcggataagttatctcctaagaaggtaagagagaagtacaagag

SEQ ID NO: 144009 - DNA, 75 bp, Artificial Sequence
  Synthetic
ctggaagttttcccgaagacgctggagacatctcggaataggaaggagggaaggtggaaaagaaggggcgggcct

SEQ ID NO: 144010 - DNA, 75 bp, Artificial Sequence
  Synthetic
ggacgcgaaccgtgagtggaaccctcgatcctttattggggggtacactcgaggagtggaaggcggggagagggg

SEQ ID NO: 144011 - DNA, 75 bp, Artificial Sequence
  Synthetic
aaggtggaaaagaaggggcgggccttccaatccgaatggtcccgactgccaagtttggatagcactccggcccga

SEQ ID NO: 144012 - DNA, 75 bp, Artificial Sequence
  Synthetic
cgatcctttattggggggtacactcgaggagtggaaggcggggagaggggcgcccagggtcaacctacgggaatc

SEQ ID NO: 144013 - DNA, 75 bp, Artificial Sequence
  Synthetic
cgcccagggtcaacctacgggaatccctgagttcctctgatgtccaggccgtcccctcctctagtaaagggagac

SEQ ID NO: 144014 - DNA, 75 bp, Artificial Sequence
  Synthetic
ggagtaagaccatagcgatgggtggagatgctaggagttagaggaggccgaagcgaggaggaaagcaaagaaagc

SEQ ID NO: 144015 - DNA, 75 bp, Artificial Sequence
  Synthetic
gtccccacatagcagctcccggacccccttccaaaggaccggagggggagctaggagcgcgggggggagcgctgg

SEQ ID NO: 144016 - DNA, 75 bp, Artificial Sequence
  Synthetic
agccatgggatgctcctcccgattccgtccatccctcccccaggagggtcgcccaggaatggcaggaactccact

SEQ ID NO: 144017 - DNA, 75 bp, Artificial Sequence
  Synthetic
tccggagtcgacctccatctgatccgtcctggctctcttcgccgggggagctccctccccatccttgtcctttct

SEQ ID NO: 144018 - DNA, 75 bp, Artificial Sequence
  Synthetic
ttcgacgagagcgggcggtcctgagaactcttatcttcctacttagaagaggagtctcctggacgcccccgcctg

SEQ ID NO: 144019 - DNA, 75 bp, Artificial Sequence
  Synthetic
cgcccctcacgtccagcccctccccgtgtctaacgaagggggactccgggatgccttgcatgctagggacgaagc

SEQ ID NO: 144020 - DNA, 75 bp, Artificial Sequence
  Synthetic
cgcccctcacgtccagcccctccccgtgtctaacgaagggggactccgggatgccttgcatgcttgggacgaagc

SEQ ID NO: 144021 - DNA, 75 bp, Artificial Sequence
  Synthetic
cgcccctcacgtccagcccctccccgtgtctaacgaagggggactccgggatgccttgcatgctcgggacgaagc

SEQ ID NO: 144022 - DNA, 75 bp, Artificial Sequence
  Synthetic
cgcccctcacgtccagcccctccccgtgtctaacgaagggggactccgggatgccttgcatgctggggacgaagc

SEQ ID NO: 144023 - DNA, 75 bp, Artificial Sequence
  Synthetic
acgcgtttggaaggatcagaggacgagaggggatgaggtggtaaagagcattggaacatcgaggggacacctccc

SEQ ID NO: 144024 - DNA, 75 bp, Artificial Sequence
  Synthetic
agaggggatgaggtggtaaagagcattggaacatcgaggggacacctcccaagagggcaaagagaaggcaagaat

SEQ ID NO: 144025 - DNA, 75 bp, Artificial Sequence
  Synthetic
atgggccaactgccgaacgaggagaacgcgtttggaaggatcagaggacgagaggggatgaggtggtaaagagca

SEQ ID NO: 144026 - DNA, 75 bp, Artificial Sequence
  Synthetic
gggttgagtagcacccagagggaggaatccacacggagtagaacagagaaatcacctccagaggaccccttcagc

SEQ ID NO: 144027 - DNA, 75 bp, Artificial Sequence
  Synthetic
atcacctccagaggaccccttcagcgaacagaagagcctagcacgggataggagtaagaccatagcgataggaag

SEQ ID NO: 144028 - DNA, 75 bp, Artificial Sequence
  Synthetic
gaacagaagagcctagcacgggataggagtaagaccatagcgataggaagagatgctaggagtcgaagaagaccg

SEQ ID NO: 144029 - DNA, 75 bp, Artificial Sequence
  Synthetic
gaacagaagagcctagcacgggataggagtaagaccatagcgataggaagagatgctaggagtcgaagtagaccg

SEQ ID NO: 144030 - DNA, 75 bp, Artificial Sequence
  Synthetic
gaacagaagagcctagcacgggataggagtaagaccatagcgataggaagagatgctaggagtcgaagcagaccg

SEQ ID NO: 144031 - DNA, 75 bp, Artificial Sequence
  Synthetic
gaacagaagagcctagcacgggataggagtaagaccatagcgataggaagagatgctaggagtcgaaggagaccg

SEQ ID NO: 144032 - DNA, 75 bp, Artificial Sequence
  Synthetic
gccctcttcgctggaggggccccctctccatccttatccttctttccaattattcctttgatgtttcccagccag

SEQ ID NO: 144033 - DNA, 75 bp, Artificial Sequence
  Synthetic
ggattttcttcctcgagcttcttgattttcttcttttccttccggaggcttttctcgagttcctcagctttcttc

SEQ ID NO: 144034 - DNA, 75 bp, Artificial Sequence
  Synthetic
ttttcttcttttccttccggaggcttttctcgagttcctcagctttcttccttgcgtcaacccacttctcgagga

SEQ ID NO: 144035 - DNA, 75 bp, Artificial Sequence
  Synthetic
ttttcttcttttccttccggaggcttttctcgagttcctcagctttcttccttgcgtctacccacttctcgagga

SEQ ID NO: 144036 - DNA, 75 bp, Artificial Sequence
  Synthetic
ttttcttcttttccttccggaggcttttctcgagttcctcagctttcttccttgcgtccacccacttctcgagga

SEQ ID NO: 144037 - DNA, 75 bp, Artificial Sequence
  Synthetic
ttttcttcttttccttccggaggcttttctcgagttcctcagctttcttccttgcgtcgacccacttctcgagga

SEQ ID NO: 144038 - DNA, 75 bp, Artificial Sequence
  Synthetic
tctcttccctctccgggcgagtcttcttcgatccagaccggctcatcctggcgagggcggcagtcctcagtgctc

SEQ ID NO: 144039 - DNA, 75 bp, Artificial Sequence
  Synthetic
agctaggaccgtgggggaccaatgggagccatgggatgctcctcccgattccgtccatccctcccccctgagggt

SEQ ID NO: 144040 - DNA, 75 bp, Artificial Sequence
  Synthetic
gcgagggcggcagtcctcagtgctcttactcttttctgtaaagaggagactgctggactcgccgcccgggcctgg

SEQ ID NO: 144041 - DNA, 75 bp, Artificial Sequence
  Synthetic
atgagccaactgccgggcgaagggagcgcggggggaggatcagcaaccgagagggagtaaatggcaaagaggcgg

SEQ ID NO: 144042 - DNA, 75 bp, Artificial Sequence
  Synthetic
gcgcggggggaggatcagcaaccgagagggagtaaatggcaaagaggcggggaacgccgacaggaatcctcccaa

SEQ ID NO: 144043 - DNA, 75 bp, Artificial Sequence
  Synthetic
gagggagtaaatggcaaagaggcggggaacgccgacaggaatcctcccaagaggagggaagagtatctaagagac

SEQ ID NO: 144044 - DNA, 75 bp, Artificial Sequence
  Synthetic
ggaggagcatccccaaaacgctggagacgtcttggaaggggaaagaggctggatggaagagatggagcgggcctc

SEQ ID NO: 144045 - DNA, 75 bp, Artificial Sequence
  Synthetic
gacgtcttggaaggggaaagaggctggatggaagagatggagcgggcctcccgatccgagggggcccgaccacca

SEQ ID NO: 144046 - DNA, 75 bp, Artificial Sequence
  Synthetic
agtttggaggcaccccgggccgaagggttgagaaaacatatcagagggagagaccacacggagtagagcagagaa

SEQ ID NO: 144047 - DNA, 75 bp, Artificial Sequence
  Synthetic
agtttggaggcaccccgggccgaagggttgagaaaacatttcagagggagagaccacacggagtagagcagagaa

SEQ ID NO: 144048 - DNA, 75 bp, Artificial Sequence
  Synthetic
agtttggaggcaccccgggccgaagggttgagaaaacatctcagagggagagaccacacggagtagagcagagaa

SEQ ID NO: 144049 - DNA, 75 bp, Artificial Sequence
  Synthetic
agtttggaggcaccccgggccgaagggttgagaaaacatgtcagagggagagaccacacggagtagagcagagaa

SEQ ID NO: 144050 - DNA, 75 bp, Artificial Sequence
  Synthetic
tttattcactggggtcgacaactctggggagaaaagggaggatcggatgggaagagtatatcctatgggaatccc

SEQ ID NO: 144051 - DNA, 75 bp, Artificial Sequence
  Synthetic
agaccacacggagtagagcagagaaatcacctccagaggaccccttcagcgaacagaagagtctctccggggtag

SEQ ID NO: 144052 - DNA, 75 bp, Artificial Sequence
  Synthetic
atccaccttcgagggggttcacacctccagtcggcgggccggctattcttctttcccttctctcgtcttcctcgg

SEQ ID NO: 144053 - DNA, 75 bp, Artificial Sequence
  Synthetic
ttatcccggggaactcggcgaatcgtccccacatagcagctccgggagcccccttcaaaaaacgaccggaggcgg

SEQ ID NO: 144054 - DNA, 75 bp, Artificial Sequence
  Synthetic
cggagtctatctccatctggtctgttcgggccctcttcgccgggggagccccctctccgtccttgtccttctttc

SEQ ID NO: 144055 - DNA, 75 bp, Artificial Sequence
  Synthetic
cgagaattcctttgatgtttcccagccagggattttcgtcctcaagtttcttgattttcttctttgtcttccgga

SEQ ID NO: 144056 - DNA, 75 bp, Artificial Sequence
  Synthetic
ccagggattttcgtcctcaagtttcttgattttcttctttgtcttccggagatccctctcgagttcctctaactt

SEQ ID NO: 144057 - DNA, 75 bp, Artificial Sequence
  Synthetic
ctcgacaagaggcggcggtcctcagtgctcttactcttttctgtaaagaggagactgctggactcgccgcccaag

SEQ ID NO: 144058 - DNA, 75 bp, Artificial Sequence
  Synthetic
tccccgtgtcgatggaagggggactccgggatgccttgcatgatggggacgaagccgcccccgggcgctcccctc

SEQ ID NO: 144059 - DNA, 75 bp, Artificial Sequence
  Synthetic
tccccgtgtcgatggaagggggactccgggatgccttgcatgttggggacgaagccgcccccgggcgctcccctc

SEQ ID NO: 144060 - DNA, 75 bp, Artificial Sequence
  Synthetic
tccccgtgtcgatggaagggggactccgggatgccttgcatgctggggacgaagccgcccccgggcgctcccctc

SEQ ID NO: 144061 - DNA, 75 bp, Artificial Sequence
  Synthetic
tccccgtgtcgatggaagggggactccgggatgccttgcatggtggggacgaagccgcccccgggcgctcccctc

SEQ ID NO: 144062 - DNA, 75 bp, Artificial Sequence
  Synthetic
atgagccaactgccgaacgaggggtacgcgggaggaaggatcacatgacgagagggagtgtatggcaagaggcgg

SEQ ID NO: 144063 - DNA, 75 bp, Artificial Sequence
  Synthetic
agaggcggcggtcctcagtgctcttactcttttctgtaaagaggagactgctggactcgccgcccaagttcgagc

SEQ ID NO: 144064 - DNA, 75 bp, Artificial Sequence
  Synthetic
ggaacgccgagtagggttctctcccaagaaggtgaagagaaggcaagaatcggacgtcttccccataacgctgga

SEQ ID NO: 144065 - DNA, 75 bp, Artificial Sequence
  Synthetic
tctttccctttcctcgtcttctctggtcaacctcttaagttcctcttcttcctccctgctgaggctcttccctcc

SEQ ID NO: 144066 - DNA, 75 bp, Artificial Sequence
  Synthetic
aagaaggtgaagagaaggcaagaatcggacgtcttccccataacgctggagacgccctggaaggggaaaggggat

SEQ ID NO: 144067 - DNA, 75 bp, Artificial Sequence
  Synthetic
aggtggaaaagaaaggggcgggcctcccgatccgaggggcccgactaccaagtttggagagcactccgggccgaa

SEQ ID NO: 144068 - DNA, 75 bp, Artificial Sequence
  Synthetic
agtttggagagcactccgggccgaagggttgagtagcactcagagggaggaatccacacggagtatgaacagaca

SEQ ID NO: 144069 - DNA, 75 bp, Artificial Sequence
  Synthetic
gagtaagaccatagcgataggaggagatgctaggagtagggggagaccgaagcgaggaggaaagcaaagaaagca

SEQ ID NO: 144070 - DNA, 75 bp, Artificial Sequence
  Synthetic
cttgattttcttccttatcctccggagttccttctcgagttcctcagctttctttcttccatttatccactgctc

SEQ ID NO: 144071 - DNA, 75 bp, Artificial Sequence
  Synthetic
acggggctagccggtgggtgttccgccccccgagaggggacgagtgaggcttatcccggggaactcgacttatcg

SEQ ID NO: 144072 - DNA, 75 bp, Artificial Sequence
  Synthetic
agttccttctcgagttcctcagctttctttcttccatttatccactgctcgagagcctcttctctccctccgcgg

SEQ ID NO: 144073 - DNA, 75 bp, Artificial Sequence
  Synthetic
agttccttctcgagttcctcagctttctttcttccatttatccactgctcgagtgcctcttctctccctccgcgg

SEQ ID NO: 144074 - DNA, 75 bp, Artificial Sequence
  Synthetic
agttccttctcgagttcctcagctttctttcttccatttatccactgctcgagcgcctcttctctccctccgcgg

SEQ ID NO: 144075 - DNA, 75 bp, Artificial Sequence
  Synthetic
agttccttctcgagttcctcagctttctttcttccatttatccactgctcgagggcctcttctctccctccgcgg

SEQ ID NO: 144076 - DNA, 75 bp, Artificial Sequence
  Synthetic
agaggcggcgaacctcagtactcttactcttttctgtaaagaggagactgctggttccgccgcccaagttcgagc

SEQ ID NO: 144077 - DNA, 75 bp, Artificial Sequence
  Synthetic
cggaagattaccccttaagacgctggagacatcctggagaggggaaagtggataggaggaaaagaaaggagcggc

SEQ ID NO: 144078 - DNA, 75 bp, Artificial Sequence
  Synthetic
ccgccgatccgagagtaccgctccagatttccaaagtatgcgagcactccggtccaaaggttgagagtacgcaga

SEQ ID NO: 144079 - DNA, 75 bp, Artificial Sequence
  Synthetic
acatagcagctccaggacccccttccgaaaagactgaggggggatcttggagcgtggaggacccagtggaacctt

SEQ ID NO: 144080 - DNA, 75 bp, Artificial Sequence
  Synthetic
tttcttccattcacccactgctcgagaatgtcttctcttcccccgcgctgcttcctcgattcggatcggctcatc

SEQ ID NO: 144081 - DNA, 75 bp, Artificial Sequence
  Synthetic
ggtggaagaaaaaggggcgggcctcccgatccgaggggcccgatcccagatctggagagcactccggcccgaagg

SEQ ID NO: 144082 - DNA, 75 bp, Artificial Sequence
  Synthetic
gttgagtagcactcagagggaggaattcactcggagatgagcagtgatcccacctccagaggaccccttcagcga

SEQ ID NO: 144083 - DNA, 75 bp, Artificial Sequence
  Synthetic
atagccgaagtgccgaggaagagccggaggaggagaggcaagagatcccgagggggcttcaggctaaagagtgga

SEQ ID NO: 144084 - DNA, 75 bp, Artificial Sequence
  Synthetic
ggaggaggagaggcaagagatcccgagggggcttcaggctaaagagtggacgattttcggggaaggtctcccaag

SEQ ID NO: 144085 - DNA, 75 bp, Artificial Sequence
  Synthetic
agggggcttcaggctaaagagtggacgattttcggggaaggtctcccaagaagaaccaggaacaccacaagaaga

SEQ ID NO: 144086 - DNA, 75 bp, Artificial Sequence
  Synthetic
agggggcttcaggctaaagagtggacgattttcggggaaggtctcccaagaagaaccaggaacacctcaagaaga

SEQ ID NO: 144087 - DNA, 75 bp, Artificial Sequence
  Synthetic
agggggcttcaggctaaagagtggacgattttcggggaaggtctcccaagaagaaccaggaacaccccaagaaga

SEQ ID NO: 144088 - DNA, 75 bp, Artificial Sequence
  Synthetic
agggggcttcaggctaaagagtggacgattttcggggaaggtctcccaagaagaaccaggaacaccgcaagaaga

SEQ ID NO: 144089 - DNA, 75 bp, Artificial Sequence
  Synthetic
ggagacttccccaagggtaggtggaacgccagggaacaaggaaataggagaaggaacggtagaaaagagcgagcc

SEQ ID NO: 144090 - DNA, 75 bp, Artificial Sequence
  Synthetic
acgccagggaacaaggaaataggagaaggaacggtagaaaagagcgagccctccgatccgatggggccctggacc

SEQ ID NO: 144091 - DNA, 75 bp, Artificial Sequence
  Synthetic
cctcagctctggagacttccgacctgtgaggtcgaggattccccgtggagggagacagccaccgggataggacag

SEQ ID NO: 144092 - DNA, 75 bp, Artificial Sequence
  Synthetic
gtgaggtcgaggattccccgtggagggagacagccaccgggataggacagagaaatcacctccagaggacccctt

SEQ ID NO: 144093 - DNA, 75 bp, Artificial Sequence
  Synthetic
cagcgaacatgaagcgcactgagccgccaggatgagtccatagcgataggaggggatgctaggagtcggcggcga

SEQ ID NO: 144094 - DNA, 75 bp, Artificial Sequence
  Synthetic
tccgcctccccagggtcccgagtgaggcttatcccggggaactcggcccagtcccgagatagccgcgtccgaggt

SEQ ID NO: 144095 - DNA, 75 bp, Artificial Sequence
  Synthetic
tccgcctccccagggtcccgagtgaggcttatcccggggaactcggcccagtcccgagattgccgcgtccgaggt

SEQ ID NO: 144096 - DNA, 75 bp, Artificial Sequence
  Synthetic
tccgcctccccagggtcccgagtgaggcttatcccggggaactcggcccagtcccgagatcgccgcgtccgaggt

SEQ ID NO: 144097 - DNA, 75 bp, Artificial Sequence
  Synthetic
tccgcctccccagggtcccgagtgaggcttatcccggggaactcggcccagtcccgagatggccgcgtccgaggt

SEQ ID NO: 144098 - DNA, 75 bp, Artificial Sequence
  Synthetic
tcccattcaaaggggagagggggggacttggagcacaggggtccagttcagtccgtgggattaccccggatctcc

SEQ ID NO: 144099 - DNA, 75 bp, Artificial Sequence
  Synthetic
agtatatcctatggaaatccctggtttcccctgatgtccagcccctccccggtccgagagaagggggactccggg

SEQ ID NO: 144100 - DNA, 75 bp, Artificial Sequence
  Synthetic
cgttctccacactccttccccccccgggctcctccaataaaaaggaaagacccacccactggggtccgacgtccc

SEQ ID NO: 144101 - DNA, 75 bp, Artificial Sequence
  Synthetic
cgacccgaagaggaaagaaggactcggacgcgaacccgtaaggtgaaactttcacatttattggggagtacactc

SEQ ID NO: 144102 - DNA, 75 bp, Artificial Sequence
  Synthetic
gaggagtggaaggcggggagacggggatcccgggcttacccacgggaactgctggattcccctgatgtccagtcc

SEQ ID NO: 144103 - DNA, 75 bp, Artificial Sequence
  Synthetic
gaggagtggaaggcggggagacggggatcccgggcttacccacgggaactgctggtttcccctgatgtccagtcc

SEQ ID NO: 144104 - DNA, 75 bp, Artificial Sequence
  Synthetic
gaggagtggaaggcggggagacggggatcccgggcttacccacgggaactgctggcttcccctgatgtccagtcc

SEQ ID NO: 144105 - DNA, 75 bp, Artificial Sequence
  Synthetic
gaggagtggaaggcggggagacggggatcccgggcttacccacgggaactgctgggttcccctgatgtccagtcc

SEQ ID NO: 144106 - DNA, 75 bp, Artificial Sequence
  Synthetic
gatcccgggcttacccacgggaactgctggattcccctgatgtccagtccctccccgatcctggagaagggagac

SEQ ID NO: 144107 - DNA, 75 bp, Artificial Sequence
  Synthetic
gatcccgggcttacccacgggaactgctggattcccctgatgtccagtccctccccgttcctggagaagggagac

SEQ ID NO: 144108 - DNA, 75 bp, Artificial Sequence
  Synthetic
gatcccgggcttacccacgggaactgctggattcccctgatgtccagtccctccccgctcctggagaagggagac

SEQ ID NO: 144109 - DNA, 75 bp, Artificial Sequence
  Synthetic
gatcccgggcttacccacgggaactgctggattcccctgatgtccagtccctccccggtcctggagaagggagac

SEQ ID NO: 144110 - DNA, 75 bp, Artificial Sequence
  Synthetic
gatcccgggcttacccacgggaactgctggtttcccctgatgtccagtccctccccgatcctggagaagggagac

SEQ ID NO: 144111 - DNA, 75 bp, Artificial Sequence
  Synthetic
gatcccgggcttacccacgggaactgctggtttcccctgatgtccagtccctccccgttcctggagaagggagac

SEQ ID NO: 144112 - DNA, 75 bp, Artificial Sequence
  Synthetic
gatcccgggcttacccacgggaactgctggtttcccctgatgtccagtccctccccgctcctggagaagggagac

SEQ ID NO: 144113 - DNA, 75 bp, Artificial Sequence
  Synthetic
gatcccgggcttacccacgggaactgctggtttcccctgatgtccagtccctccccggtcctggagaagggagac

SEQ ID NO: 144114 - DNA, 75 bp, Artificial Sequence
  Synthetic
gatcccgggcttacccacgggaactgctggcttcccctgatgtccagtccctccccgatcctggagaagggagac

SEQ ID NO: 144115 - DNA, 75 bp, Artificial Sequence
  Synthetic
gatcccgggcttacccacgggaactgctggcttcccctgatgtccagtccctccccgttcctggagaagggagac

SEQ ID NO: 144116 - DNA, 75 bp, Artificial Sequence
  Synthetic
gatcccgggcttacccacgggaactgctggcttcccctgatgtccagtccctccccgctcctggagaagggagac

SEQ ID NO: 144117 - DNA, 75 bp, Artificial Sequence
  Synthetic
gatcccgggcttacccacgggaactgctggcttcccctgatgtccagtccctccccggtcctggagaagggagac

SEQ ID NO: 144118 - DNA, 75 bp, Artificial Sequence
  Synthetic
gatcccgggcttacccacgggaactgctgggttcccctgatgtccagtccctccccgatcctggagaagggagac

SEQ ID NO: 144119 - DNA, 75 bp, Artificial Sequence
  Synthetic
gatcccgggcttacccacgggaactgctgggttcccctgatgtccagtccctccccgttcctggagaagggagac

SEQ ID NO: 144120 - DNA, 75 bp, Artificial Sequence
  Synthetic
gatcccgggcttacccacgggaactgctgggttcccctgatgtccagtccctccccgctcctggagaagggagac

SEQ ID NO: 144121 - DNA, 75 bp, Artificial Sequence
  Synthetic
gatcccgggcttacccacgggaactgctgggttcccctgatgtccagtccctccccggtcctggagaagggagac

SEQ ID NO: 144122 - DNA, 75 bp, Artificial Sequence
  Synthetic
tcgggaacgcctagcatctgagggacaaagccgcccccgggcgctcccctcggagatccactgggtgggttcaca

SEQ ID NO: 144123 - DNA, 75 bp, Artificial Sequence
  Synthetic
tcgggaacgcctagcatctgagggacaaagccgcccccgggcgctcccctcggagttccactgggtgggttcaca

SEQ ID NO: 144124 - DNA, 75 bp, Artificial Sequence
  Synthetic
tcgggaacgcctagcatctgagggacaaagccgcccccgggcgctcccctcggagctccactgggtgggttcaca

SEQ ID NO: 144125 - DNA, 75 bp, Artificial Sequence
  Synthetic
tcgggaacgcctagcatctgagggacaaagccgcccccgggcgctcccctcggaggtccactgggtgggttcaca

SEQ ID NO: 144126 - DNA, 75 bp, Artificial Sequence
  Synthetic
tcgggaacgcctagcatctgagggactaagccgcccccgggcgctcccctcggagatccactgggtgggttcaca

SEQ ID NO: 144127 - DNA, 75 bp, Artificial Sequence
  Synthetic
tcgggaacgcctagcatctgagggactaagccgcccccgggcgctcccctcggagttccactgggtgggttcaca

SEQ ID NO: 144128 - DNA, 75 bp, Artificial Sequence
  Synthetic
tcgggaacgcctagcatctgagggactaagccgcccccgggcgctcccctcggagctccactgggtgggttcaca

SEQ ID NO: 144129 - DNA, 75 bp, Artificial Sequence
  Synthetic
tcgggaacgcctagcatctgagggactaagccgcccccgggcgctcccctcggaggtccactgggtgggttcaca

SEQ ID NO: 144130 - DNA, 75 bp, Artificial Sequence
  Synthetic
tcgggaacgcctagcatctgagggaccaagccgcccccgggcgctcccctcggagatccactgggtgggttcaca

SEQ ID NO: 144131 - DNA, 75 bp, Artificial Sequence
  Synthetic
tcgggaacgcctagcatctgagggaccaagccgcccccgggcgctcccctcggagttccactgggtgggttcaca

SEQ ID NO: 144132 - DNA, 75 bp, Artificial Sequence
  Synthetic
tcgggaacgcctagcatctgagggaccaagccgcccccgggcgctcccctcggagctccactgggtgggttcaca

SEQ ID NO: 144133 - DNA, 75 bp, Artificial Sequence
  Synthetic
tcgggaacgcctagcatctgagggaccaagccgcccccgggcgctcccctcggaggtccactgggtgggttcaca

SEQ ID NO: 144134 - DNA, 75 bp, Artificial Sequence
  Synthetic
tcgggaacgcctagcatctgagggacgaagccgcccccgggcgctcccctcggagatccactgggtgggttcaca

SEQ ID NO: 144135 - DNA, 75 bp, Artificial Sequence
  Synthetic
tcgggaacgcctagcatctgagggacgaagccgcccccgggcgctcccctcggagttccactgggtgggttcaca

SEQ ID NO: 144136 - DNA, 75 bp, Artificial Sequence
  Synthetic
tcgggaacgcctagcatctgagggacgaagccgcccccgggcgctcccctcggagctccactgggtgggttcaca

SEQ ID NO: 144137 - DNA, 75 bp, Artificial Sequence
  Synthetic
tcgggaacgcctagcatctgagggacgaagccgcccccgggcgctcccctcggaggtccactgggtgggttcaca

SEQ ID NO: 144138 - DNA, 75 bp, Artificial Sequence
  Synthetic
cggagatccactgggtgggttcacatccccaacccgcgggccggctgttcttctttctctttcctcgtcttcctc

SEQ ID NO: 144139 - DNA, 75 bp, Artificial Sequence
  Synthetic
cggagttccactgggtgggttcacatccccaacccgcgggccggctgttcttctttctctttcctcgtcttcctc

SEQ ID NO: 144140 - DNA, 75 bp, Artificial Sequence
  Synthetic
cggagctccactgggtgggttcacatccccaacccgcgggccggctgttcttctttctctttcctcgtcttcctc

SEQ ID NO: 144141 - DNA, 75 bp, Artificial Sequence
  Synthetic
cggaggtccactgggtgggttcacatccccaacccgcgggccggctgttcttctttctctttcctcgtcttcctc

SEQ ID NO: 144142 - DNA, 75 bp, Artificial Sequence
  Synthetic
cggaggggacgcgatgccaaagagtgggggaaatctcgcgagggaaatcccaagaaggtcgagaagtctcaagcg

SEQ ID NO: 144143 - DNA, 75 bp, Artificial Sequence
  Synthetic
ctcgagggccttccttcttcggtgatccttcctctccctgtcggtgaagtctcccgcacgagtcctcttcctagg

SEQ ID NO: 144144 - DNA, 75 bp, Artificial Sequence
  Synthetic
ctcgagggccttccttcttcggtgatccttcctctccctgtcggtgaagtctcccgcacgtgtcctcttcctagg

SEQ ID NO: 144145 - DNA, 75 bp, Artificial Sequence
  Synthetic
ctcgagggccttccttcttcggtgatccttcctctccctgtcggtgaagtctcccgcacgcgtcctcttcctagg

SEQ ID NO: 144146 - DNA, 75 bp, Artificial Sequence
  Synthetic
ctcgagggccttccttcttcggtgatccttcctctccctgtcggtgaagtctcccgcacgggtcctcttcctagg

SEQ ID NO: 144147 - DNA, 75 bp, Artificial Sequence
  Synthetic
gtccgggccctcttcgtcgggggagctccctccccgtccttcccttttcttattattccgatgatgttccccaac

SEQ ID NO: 144148 - DNA, 75 bp, Artificial Sequence
  Synthetic
ctccctccccgtccttcccttttcttattattccgatgatgttccccaaccagggattgtcctcctcgagtttct

SEQ ID NO: 144149 - DNA, 75 bp, Artificial Sequence
  Synthetic
cctatcaagtttggagtcatccgggccctaaggtagaatagaacaccggggggtgatccaccaggagatgaacgg

SEQ ID NO: 144150 - DNA, 75 bp, Artificial Sequence
  Synthetic
tgatggttctcttggccttccggagccttctctcgagatcgtccgcatcctttcttgcctgcacccacttttcga

SEQ ID NO: 144151 - DNA, 75 bp, Artificial Sequence
  Synthetic
ccttctctcgagatcgtccgcatcctttcttgcctgcacccacttttcgaggatgtcttcccttcctcccctccg

SEQ ID NO: 144152 - DNA, 75 bp, Artificial Sequence
  Synthetic
ggatttcttctgatcggactggctcatcctcggaaacgggggcggcggcgtccgttctctattcttttcttttga

SEQ ID NO: 144153 - DNA, 75 bp, Artificial Sequence
  Synthetic
ccgaagcgaggaggaaagcaaagaaagcaacggggctagcgagtggatgttccgccccccgagggggccgagtga

SEQ ID NO: 144154 - DNA, 75 bp, Artificial Sequence
  Synthetic
gggggcggcggcgtccgttctctattcttttcttttgaaagaggagacgggtctccgcccgcccccagccccggg

SEQ ID NO: 144155 - DNA, 75 bp, Artificial Sequence
  Synthetic
atgggccatctccgacgaagaggtcgaaggtaggagagggatgagcccccaaagggattcgaagctaaagagtgg

SEQ ID NO: 144156 - DNA, 75 bp, Artificial Sequence
  Synthetic
gaaggtaggagagggatgagcccccaaagggattcgaagctaaagagtggagacacacgagaaagagagcgtccc

SEQ ID NO: 144157 - DNA, 75 bp, Artificial Sequence
  Synthetic
ccttccgaacgagggggacggtccttgaaccctcagggggcccatggagccgtgggaatccccagacctcccttc

SEQ ID NO: 144158 - DNA, 75 bp, Artificial Sequence
  Synthetic
aagagggcgaggggagttctcaggagggaggatgattccccgagacgctgggagactcccggaacaaggaaagag

SEQ ID NO: 144159 - DNA, 75 bp, Artificial Sequence
  Synthetic
ggataggaaggtagaaaagagcgagcctcccgatccgagtttgccctgaacctatcgagtttggagtcctccgac

SEQ ID NO: 144160 - DNA, 75 bp, Artificial Sequence
  Synthetic
cccccccataagatggcgagatctccactcattgggtccttcgtccatctccttttcttacctttggccggcatg

SEQ ID NO: 144161 - DNA, 75 bp, Artificial Sequence
  Synthetic
cctcccgatccgagtttgccctgaacctatcgagtttggagtcctccgacttagggtcgaatggagcgcaaggag

SEQ ID NO: 144162 - DNA, 75 bp, Artificial Sequence
  Synthetic
ccgggcaacattccgaggggaccgtccctcggtaatggcgaatgggacccagaaatctcctttgattcccagaga

SEQ ID NO: 144163 - DNA, 75 bp, Artificial Sequence
  Synthetic
agacacctccagaggaccccttcagcgaacagaagagtctatccccagatgagaagatcgtagctaaagggggag

SEQ ID NO: 144164 - DNA, 75 bp, Artificial Sequence
  Synthetic
cgaacagaagagtctatccccagatgagaagatcgtagctaaagggggagatgctaggagttaggggagaccgaa

SEQ ID NO: 144165 - DNA, 75 bp, Artificial Sequence
  Synthetic
cggggctagcaggagggtgttccgccccccggcggggccgagtgaggcttatcccggggaactcggactagtccc

SEQ ID NO: 144166 - DNA, 75 bp, Artificial Sequence
  Synthetic
ggactgccggctccaggactccactccaaaaggaccgagggtaggtctcggagtaccgggaattccagtgcaatt

SEQ ID NO: 144167 - DNA, 75 bp, Artificial Sequence
  Synthetic
tcccctctccgagtgaagggagactccgggatgtcgtgcatgctggggacgaacccgcctccgggcgctcccctc

SEQ ID NO: 144168 - DNA, 75 bp, Artificial Sequence
  Synthetic
caacattccgaggggaccgtcccccggaaatggcagatgggacccaagctctccccggattccctcttggggatc

SEQ ID NO: 144169 - DNA, 75 bp, Artificial Sequence
  Synthetic
caacattccgaggggaccgtcccccggtaatggcagatgggacccaagctctccccggattccctcttggggatc

SEQ ID NO: 144170 - DNA, 75 bp, Artificial Sequence
  Synthetic
caacattccgaggggaccgtcccccggcaatggcagatgggacccaagctctccccggattccctcttggggatc

SEQ ID NO: 144171 - DNA, 75 bp, Artificial Sequence
  Synthetic
caacattccgaggggaccgtcccccgggaatggcagatgggacccaagctctccccggattccctcttggggatc

SEQ ID NO: 144172 - DNA, 75 bp, Artificial Sequence
  Synthetic
agtggaaggcggggaggggggggcggttgttgtccccatggaaattgctggtctccccggatgtccagaccatcc

SEQ ID NO: 144173 - DNA, 75 bp, Artificial Sequence
  Synthetic
ttcttgcatcgatccactttccgagtgtctcttctctccccctccggggtctcctcgaatcgggctggctcatcc

SEQ ID NO: 144174 - DNA, 75 bp, Artificial Sequence
  Synthetic
gatgggcctcgtgccgacgaggagtccgcaagtgggaggatcagccaccggtgagggacgcgatggcaagagtgg

SEQ ID NO: 144175 - DNA, 75 bp, Artificial Sequence
  Synthetic
gaggatcactcgagattcaattggtgaggagggatccccgagacgctggtggagccccgggaaaaaaagaaaaaa

SEQ ID NO: 144176 - DNA, 75 bp, Artificial Sequence
  Synthetic
cttgcgactcctcttccccggaccggagtcaacctccatctgatctgttcgggctctcttcgccgggggagctcc

SEQ ID NO: 144177 - DNA, 75 bp, Artificial Sequence
  Synthetic
ttctcgaggtcctccagatctttccttgcttcgacccattttgcaagggtctcctcccgtcctccccttcgttct

SEQ ID NO: 144178 - DNA, 75 bp, Artificial Sequence
  Synthetic
ttgcttcgacccattttgcaagggtctcctcccgtcctccccttcgttctctcttcggatcggaacggctcatct

SEQ ID NO: 144179 - DNA, 75 bp, Artificial Sequence
  Synthetic
cgacgagggcggcgatcctcagtgctcttactcttttcgatagaaagaggagactgctggacgccccgcccgggt

SEQ ID NO: 144180 - DNA, 75 bp, Artificial Sequence
  Synthetic
ggcctcggaccccagggagccatgggatccgtggagtacccgggccatccccttctccacactccttccccccta

SEQ ID NO: 144181 - DNA, 75 bp, Artificial Sequence
  Synthetic
gcggggcccccccataagatggcgagaaatccactcgtgggtccgtcgtccatctctttcttacctttggccggc

SEQ ID NO: 144182 - DNA, 75 bp, Artificial Sequence
  Synthetic
agagggtcactcgagattcaagaggtgaggagggatccccgagacgctggaagaacgccgggaaacataaaagaa

SEQ ID NO: 144183 - DNA, 75 bp, Artificial Sequence
  Synthetic
aaagcaacggggctagcgagtggatgttcctccccccgagggtcccgagtgaggcttatcccggggatcggcctc

SEQ ID NO: 144184 - DNA, 75 bp, Artificial Sequence
  Synthetic
ctcggtcaacctccgaagttcctcttcttcctccctgctgaggctctttcctccggaggagagctgctttttctt

SEQ ID NO: 144185 - DNA, 75 bp, Artificial Sequence
  Synthetic
atcttcgacgagaggcgggcgatcctgagaactcttatcttcctgcttagaagaggagtctcctggacgcccccg

SEQ ID NO: 144186 - DNA, 75 bp, Artificial Sequence
  Synthetic
atgggcctcagttccgagcgaagagacgagacggggagggatcagcgcccgagagggagtcaatggtaaagagtg

SEQ ID NO: 144187 - DNA, 75 bp, Artificial Sequence
  Synthetic
acgagacggggagggatcagcgcccgagagggagtcaatggtaaagagtgggagatcgtcggagggaatcatcct

SEQ ID NO: 144188 - DNA, 75 bp, Artificial Sequence
  Synthetic
gagagggagtcaatggtaaagagtgggagatcgtcggagggaatcatccttccgggccaagagaagggaaaaaac

SEQ ID NO: 144189 - DNA, 75 bp, Artificial Sequence
  Synthetic
ggaagcttttccccataacgctggtaaaatcttggaagaggaagaaggaaggtggaaagaaaggagggaccctcc

SEQ ID NO: 144190 - DNA, 75 bp, Artificial Sequence
  Synthetic
ggtggaaagaaaggagggaccctcccgatccgagtggcccggccaccgagtttggagggcactccgggctcaacg

SEQ ID NO: 144191 - DNA, 75 bp, Artificial Sequence
  Synthetic
ctcaaggagggcgggcggtcctgagaactcttatcttcctgcttagaagaggagtctcctggacgcccccgccct

SEQ ID NO: 144192 - DNA, 75 bp, Artificial Sequence
  Synthetic
caaaggaccatcagagcggcaggagtgagaccatagcgataggaggggatgctaggagttaggggagacccgagc

SEQ ID NO: 144193 - DNA, 75 bp, Artificial Sequence
  Synthetic
tcccggggaactcggcgaatcgtccccacatagcagagccccggacccccttccaaaaagaccgaggggggtggc

SEQ ID NO: 144194 - DNA, 75 bp, Artificial Sequence
  Synthetic
taggaacaaagggaccggggggtccgtgggatgcttttcccgattccgcccaaccaaccccccaagaggtccccc

SEQ ID NO: 144195 - DNA, 75 bp, Artificial Sequence
  Synthetic
ggatgcccaggtcggaccgcgaggaggtggagatgccatgccgacccgaagaggaaagaaggacgcgagacgcga

SEQ ID NO: 144196 - DNA, 75 bp, Artificial Sequence
  Synthetic
ccttcgagggggttcacacctccaacctgcgggccggctactcttcttttcctttcctcgtcttcccgggtcaac

SEQ ID NO: 144197 - DNA, 75 bp, Artificial Sequence
  Synthetic
cctgcgggccggctactcttcttttcctttcctcgtcttcccgggtcaacctcttaagttcctcttcctcctcct

SEQ ID NO: 144198 - DNA, 75 bp, Artificial Sequence
  Synthetic
cctttcctcgtcttcccgggtcaacctcttaagttcctcttcctcctccttgctgaggttcttgcctcccgagct

SEQ ID NO: 144199 - DNA, 75 bp, Artificial Sequence
  Synthetic
gagaggcctcttcctaggtccggagtctacttccatccggtccgctcgggccttcttcgccgggggggctccttc

SEQ ID NO: 144200 - DNA, 75 bp, Artificial Sequence
  Synthetic
cccatccttatccttctttccaagtattcctttgatatttcccagccagggattatcttcctctagtttcttgat

SEQ ID NO: 144201 - DNA, 75 bp, Artificial Sequence
  Synthetic
attcctttgatatttcccagccagggattatcttcctctagtttcttgatcttcttcttgaccttttggagttcc

SEQ ID NO: 144202 - DNA, 75 bp, Artificial Sequence
  Synthetic
ctttcgagatcttcctgttttcttcttccattgacccactgctcgagaacctcttctctcccccctcgcttcttc

SEQ ID NO: 144203 - DNA, 75 bp, Artificial Sequence
  Synthetic
acaaagggcggcagtcctcagtactcttactcttttctgtaaagaggagactgctggaccttccgcccaagttcg

SEQ ID NO: 144204 - DNA, 75 bp, Artificial Sequence
  Synthetic
tcttcgactcggaccggctcatctcgacaagaggcggcagtcctcagtactcttactcttttctgtaaagaggag

SEQ ID NO: 144205 - DNA, 75 bp, Artificial Sequence
  Synthetic
gaatctctggaaggggaaagaggaaggtggaagaaaaaggggcgggcctcccgatccgaggggcccaacttaatc

SEQ ID NO: 144206 - DNA, 75 bp, Artificial Sequence
  Synthetic
tccagatctggagagcactccggcccgaagggttgagagtaccccagaggaggaagccacacggagtagaacaga

SEQ ID NO: 144207 - DNA, 75 bp, Artificial Sequence
  Synthetic
cgaagggttgagagtaccccagaggaggaagccacacggagtagaacagaaaaatcacctccagaggaccccttc

SEQ ID NO: 144208 - DNA, 75 bp, Artificial Sequence
  Synthetic
agcgaacagagagcgcatcgcagagggagtagaccatagcgataggaggggatgctaggagttaggggagaccaa

SEQ ID NO: 144209 - DNA, 75 bp, Artificial Sequence
  Synthetic
ggagtagaccatagcgataggaggggatgctaggagttaggggagaccaagcgaggagaaagtaaagaagcaacg

SEQ ID NO: 144210 - DNA, 75 bp, Artificial Sequence
  Synthetic
gggctagcaggtgggtgttccgcctcccgagagacgagtgaggcttatcccggggaactcgacttatcgtcccca

SEQ ID NO: 144211 - DNA, 75 bp, Artificial Sequence
  Synthetic
cccgagagacgagtgaggcttatcccggggaactcgacttatcgtccccacatagcagggaccccggaccccctt

SEQ ID NO: 144212 - DNA, 75 bp, Artificial Sequence
  Synthetic
cgaaaggtaccggaggggggtgactcgaacaccggggaccagtggagccatgggatgctcttcccgatgctcgat

SEQ ID NO: 144213 - DNA, 75 bp, Artificial Sequence
  Synthetic
atgggccaagtccgacgaagggatcgaggacttggggagtggaggggcccgaagggggggaacgagactgggaag

SEQ ID NO: 144214 - DNA, 75 bp, Artificial Sequence
  Synthetic
gaggacttggggagtggaggggcccgaagggggggaacgagactgggaagagagaaccgacgaggaaattctccc

SEQ ID NO: 144215 - DNA, 75 bp, Artificial Sequence
  Synthetic
gaagggggggaacgagactgggaagagagaaccgacgaggaaattctcccaagaggtcccgggggcatgccaaga

SEQ ID NO: 144216 - DNA, 75 bp, Artificial Sequence
  Synthetic
aacggaagagtttccccctttggactgggagactcaccgaaccaggaaatgggaaagagatggtagaaaagagcg

SEQ ID NO: 144217 - DNA, 75 bp, Artificial Sequence
  Synthetic
tgggagactcaccgaaccaggaaatgggaaagagatggtagaaaagagcgagcctcccgaacatcgaggagtccc

SEQ ID NO: 144218 - DNA, 75 bp, Artificial Sequence
  Synthetic
gagcgcctctaaattggagtcctccgaccgcaggggaaaattaccgacaagtggtgatccactgagggtgcggag

SEQ ID NO: 144219 - DNA, 75 bp, Artificial Sequence
  Synthetic
gagcgcctctaaattggagtcctccgaccgcaggggaaaattaccgacaagtggtgttccactgagggtgcggag

SEQ ID NO: 144220 - DNA, 75 bp, Artificial Sequence
  Synthetic
gagcgcctctaaattggagtcctccgaccgcaggggaaaattaccgacaagtggtgctccactgagggtgcggag

SEQ ID NO: 144221 - DNA, 75 bp, Artificial Sequence
  Synthetic
gagcgcctctaaattggagtcctccgaccgcaggggaaaattaccgacaagtggtggtccactgagggtgcggag

SEQ ID NO: 144222 - DNA, 75 bp, Artificial Sequence
  Synthetic
cgggccggctactcttctttcccttctctcgtcttcctcggtcaacctcctgagttcctcttcttcctccttgct

SEQ ID NO: 144223 - DNA, 75 bp, Artificial Sequence
  Synthetic
aaatcacctccagaagaaccccttcagcgaacagaagagtctgagttccccagaggaaggccatagcgatggggg

SEQ ID NO: 144224 - DNA, 75 bp, Artificial Sequence
  Synthetic
agcgaacagaagagtctgagttccccagaggaaggccatagcgatggggggagatgctaggagtggtgaggcgcc

SEQ ID NO: 144225 - DNA, 75 bp, Artificial Sequence
  Synthetic
cggagcgaggagaaaagcaaagaaagcaacggggctagcgagtggatgttccgcctccccggggagccgagtgag

SEQ ID NO: 144226 - DNA, 75 bp, Artificial Sequence
  Synthetic
gcaacggggctagcgagtggatgttccgcctccccggggagccgagtgaggcttatcccggagtctgtggctaag

SEQ ID NO: 144227 - DNA, 75 bp, Artificial Sequence
  Synthetic
tcccccatgccccgctccacggctcccttccgaagtgtcgggggggggctggaacgcagggcccggcgttccatg

SEQ ID NO: 144228 - DNA, 75 bp, Artificial Sequence
  Synthetic
cttcgccgggggagccccctctccatccttatccttctttccgagaattcctttgatgttccccagccagggatt

SEQ ID NO: 144229 - DNA, 75 bp, Artificial Sequence
  Synthetic
gaattcggcctctttccgcttctccacactccttcccccccgtgggccccccccataagatgacgaggacccctc

SEQ ID NO: 144230 - DNA, 75 bp, Artificial Sequence
  Synthetic
actcggaccggctcatctcggctagaggcggcagtcctcagtactcttactcttttctgtaaagaggagactgct

SEQ ID NO: 144231 - DNA, 75 bp, Artificial Sequence
  Synthetic
ttattggggggtgcactctaggagtggaaggcggggagagcggggaggaccgttaccccatggaaactgccggtc

SEQ ID NO: 144232 - DNA, 75 bp, Artificial Sequence
  Synthetic
tccctccccgtccttgtcttttcttattattcctcggatgtttcccagccaggggttatcctcctcaagtctctt

SEQ ID NO: 144233 - DNA, 75 bp, Artificial Sequence
  Synthetic
cgttaccccatggaaactgccggtctccccttacgtccagaccatcccccgaccgggtgaatggagaatcgggaa

SEQ ID NO: 144234 - DNA, 75 bp, Artificial Sequence
  Synthetic
cgttaccccatggaaactgccggtctccccttacgtccagaccatcccccgaccgggtgaatggagattcgggaa

SEQ ID NO: 144235 - DNA, 75 bp, Artificial Sequence
  Synthetic
cgttaccccatggaaactgccggtctccccttacgtccagaccatcccccgaccgggtgaatggagactcgggaa

SEQ ID NO: 144236 - DNA, 75 bp, Artificial Sequence
  Synthetic
cgttaccccatggaaactgccggtctccccttacgtccagaccatcccccgaccgggtgaatggagagtcgggaa

SEQ ID NO: 144237 - DNA, 75 bp, Artificial Sequence
  Synthetic
tttggaaagcactccggcccgaagggttgagtagcttccagagggagacatccacacggagaagaacagcgacaa

SEQ ID NO: 144238 - DNA, 75 bp, Artificial Sequence
  Synthetic
gttgagtagcttccagagggagacatccacacggagaagaacagcgacaacacccccccagaaccccttcagcga

SEQ ID NO: 144239 - DNA, 75 bp, Artificial Sequence
  Synthetic
acagaggagcctcccacgcgataggagtaagcccataacgatagggggagatgctaggagttagaggagaccaag

SEQ ID NO: 144240 - DNA, 75 bp, Artificial Sequence
  Synthetic
ccttctctcgtcttccccggtcaacctcgcaagttcctcttcttcctccctgctgaggttcttccctccggcgct

SEQ ID NO: 144241 - DNA, 75 bp, Artificial Sequence
  Synthetic
cagttgcttcttcttgttctcgagggctttccttcgtcggtgatcccgcctctcctcgtcggtgaaacccgactt

SEQ ID NO: 144242 - DNA, 75 bp, Artificial Sequence
  Synthetic
tttcccggggggagctccctatcgtccccacatagcagagcccgggagccccttctaaagtgaccggggggggta

SEQ ID NO: 144243 - DNA, 75 bp, Artificial Sequence
  Synthetic
cccatcctttccctttcttatgattccgatgatgttccctatccagggattttcttcctctagtttcttgagtcc

SEQ ID NO: 144244 - DNA, 75 bp, Artificial Sequence
  Synthetic
ccgatgatgttccctatccagggattttcttcctctagtttcttgagtcccctctgggtcttccggagcttcctt

SEQ ID NO: 144245 - DNA, 75 bp, Artificial Sequence
  Synthetic
tcgagttcatctcgattttttctcagctcgacccacttttcgaggacctcttccctcccacctcgttttctcttc

SEQ ID NO: 144246 - DNA, 75 bp, Artificial Sequence
  Synthetic
gctcgacccacttttcgaggacctcttccctcccacctcgttttctcttcggatcggcgaggctcatctcgacga

SEQ ID NO: 144247 - DNA, 75 bp, Artificial Sequence
  Synthetic
tattcactggggtcgacaactctgaggagagaagggaggatcggatgggaagagtatatcctatgggaatccctg

SEQ ID NO: 144248 - DNA, 75 bp, Artificial Sequence
  Synthetic
gggggcggcgtcctcagaactctcttaccttcctaagaagtgaggagactgctggtcgcccgcccccgagttcga

SEQ ID NO: 144249 - DNA, 75 bp, Artificial Sequence
  Synthetic
gggggcggcgtcctcagatctctcttaccttcctaagaagtgaggagactgctggtcgcccgcccccgagttcga

SEQ ID NO: 144250 - DNA, 75 bp, Artificial Sequence
  Synthetic
gggggcggcgtcctcagacctctcttaccttcctaagaagtgaggagactgctggtcgcccgcccccgagttcga

SEQ ID NO: 144251 - DNA, 75 bp, Artificial Sequence
  Synthetic
gggggcggcgtcctcagagctctcttaccttcctaagaagtgaggagactgctggtcgcccgcccccgagttcga

SEQ ID NO: 144252 - DNA, 75 bp, Artificial Sequence
  Synthetic
acatcttggaaggggaaagaaggaaggtggaaaagaaggggcgggcctcccgatccgaggggcccaactaccaag

SEQ ID NO: 144253 - DNA, 75 bp, Artificial Sequence
  Synthetic
cgatccgaggggcccaactaccaagtttggagagcactccgggcccaagggttgagagtacccagagggaggaat

SEQ ID NO: 144254 - DNA, 75 bp, Artificial Sequence
  Synthetic
gctgaggtggttcctcttgttctcgagggccttccttcgtcggtggtcctccctctccttgtcggtgaagtctcc

SEQ ID NO: 144255 - DNA, 75 bp, Artificial Sequence
  Synthetic
aagaggaaagaaggacgcgagacggtgaacctgtgagtggaaacccgctttattcactggggacgacaactctgg

SEQ ID NO: 144256 - DNA, 75 bp, Artificial Sequence
  Synthetic
gattttcttcttaaccttccggaggtctctctcgagttcctctaacttctttcttccattcacccactgctcgag

SEQ ID NO: 144257 - DNA, 75 bp, Artificial Sequence
  Synthetic
agggatcgcggggggaggaaggaaaacccgagagggagtggatggcaaagaagcattggaacgtcggagggaatt

SEQ ID NO: 144258 - DNA, 75 bp, Artificial Sequence
  Synthetic
acccgagagggagtggatggcaaagaagcattggaacgtcggagggaattctcccaagaaggaaaaaagagaaga

SEQ ID NO: 144259 - DNA, 75 bp, Artificial Sequence
  Synthetic
caagagacggacgaaacccccacgacgctggagacaccttggaaggggaaagaggatggatggaagaaaggaggc

SEQ ID NO: 144260 - DNA, 75 bp, Artificial Sequence
  Synthetic
agggccttccttcgtcggtgatcctgcctctccttgtcggtgaatcctcccctgagaggcctcttcctaggcccg

SEQ ID NO: 144261 - DNA, 75 bp, Artificial Sequence
  Synthetic
cgctggagacaccttggaaggggaaagaggatggatggaagaaaggaggcgggcctcccgatccgaggggcccga

SEQ ID NO: 144262 - DNA, 75 bp, Artificial Sequence
  Synthetic
ggtcagttgctttcttttgttctcgagggccttccttcgtcggtgatcctgcctctccttgtcggtgaatcctcc

SEQ ID NO: 144263 - DNA, 75 bp, Artificial Sequence
  Synthetic
attcactggggtcgacaactctggggagaaaagggaggatcggctgggaagagtatatcctatgggaatccctgg

SEQ ID NO: 144264 - DNA, 75 bp, Artificial Sequence
  Synthetic
atgggccacagctccgaacgaagggttcgacgggggaggaggccaccccgaggggggttacctggcaaagaggcg

SEQ ID NO: 144265 - DNA, 75 bp, Artificial Sequence
  Synthetic
ttcgacgggggaggaggccaccccgaggggggttacctggcaaagaggcgaggaaagtcgagagaaaatgtccca

SEQ ID NO: 144266 - DNA, 75 bp, Artificial Sequence
  Synthetic
ttcgacgggggaggaggccaccccgaggggggttacctggcaaagaggcgaggaaagtcgagagaaattgtccca

SEQ ID NO: 144267 - DNA, 75 bp, Artificial Sequence
  Synthetic
ttcgacgggggaggaggccaccccgaggggggttacctggcaaagaggcgaggaaagtcgagagaaactgtccca

SEQ ID NO: 144268 - DNA, 75 bp, Artificial Sequence
  Synthetic
ttcgacgggggaggaggccaccccgaggggggttacctggcaaagaggcgaggaaagtcgagagaaagtgtccca

SEQ ID NO: 144269 - DNA, 75 bp, Artificial Sequence
  Synthetic
ttcgacgggggaggaggccaccccgaggggggttacctggcaaagaggcgaggaaagtcgtgagaaaatgtccca

SEQ ID NO: 144270 - DNA, 75 bp, Artificial Sequence
  Synthetic
ttcgacgggggaggaggccaccccgaggggggttacctggcaaagaggcgaggaaagtcgtgagaaattgtccca

SEQ ID NO: 144271 - DNA, 75 bp, Artificial Sequence
  Synthetic
ttcgacgggggaggaggccaccccgaggggggttacctggcaaagaggcgaggaaagtcgtgagaaactgtccca

SEQ ID NO: 144272 - DNA, 75 bp, Artificial Sequence
  Synthetic
ttcgacgggggaggaggccaccccgaggggggttacctggcaaagaggcgaggaaagtcgtgagaaagtgtccca

SEQ ID NO: 144273 - DNA, 75 bp, Artificial Sequence
  Synthetic
ttcgacgggggaggaggccaccccgaggggggttacctggcaaagaggcgaggaaagtcgcgagaaaatgtccca

SEQ ID NO: 144274 - DNA, 75 bp, Artificial Sequence
  Synthetic
ttcgacgggggaggaggccaccccgaggggggttacctggcaaagaggcgaggaaagtcgcgagaaattgtccca

SEQ ID NO: 144275 - DNA, 75 bp, Artificial Sequence
  Synthetic
ttcgacgggggaggaggccaccccgaggggggttacctggcaaagaggcgaggaaagtcgcgagaaactgtccca

SEQ ID NO: 144276 - DNA, 75 bp, Artificial Sequence
  Synthetic
ttcgacgggggaggaggccaccccgaggggggttacctggcaaagaggcgaggaaagtcgcgagaaagtgtccca

SEQ ID NO: 144277 - DNA, 75 bp, Artificial Sequence
  Synthetic
ttcgacgggggaggaggccaccccgaggggggttacctggcaaagaggcgaggaaagtcgggagaaaatgtccca

SEQ ID NO: 144278 - DNA, 75 bp, Artificial Sequence
  Synthetic
ttcgacgggggaggaggccaccccgaggggggttacctggcaaagaggcgaggaaagtcgggagaaattgtccca

SEQ ID NO: 144279 - DNA, 75 bp, Artificial Sequence
  Synthetic
ttcgacgggggaggaggccaccccgaggggggttacctggcaaagaggcgaggaaagtcgggagaaactgtccca

SEQ ID NO: 144280 - DNA, 75 bp, Artificial Sequence
  Synthetic
ttcgacgggggaggaggccaccccgaggggggttacctggcaaagaggcgaggaaagtcgggagaaagtgtccca

SEQ ID NO: 144281 - DNA, 75 bp, Artificial Sequence
  Synthetic
aggggggttacctggcaaagaggcgaggaaagtcgagagaaaatgtcccaagaaggcccaagagaaaactcagga

SEQ ID NO: 144282 - DNA, 75 bp, Artificial Sequence
  Synthetic
aggggggttacctggcaaagaggcgaggaaagtcgagagaaattgtcccaagaaggcccaagagaaaactcagga

SEQ ID NO: 144283 - DNA, 75 bp, Artificial Sequence
  Synthetic
aggggggttacctggcaaagaggcgaggaaagtcgagagaaactgtcccaagaaggcccaagagaaaactcagga

SEQ ID NO: 144284 - DNA, 75 bp, Artificial Sequence
  Synthetic
aggggggttacctggcaaagaggcgaggaaagtcgagagaaagtgtcccaagaaggcccaagagaaaactcagga

SEQ ID NO: 144285 - DNA, 75 bp, Artificial Sequence
  Synthetic
aggggggttacctggcaaagaggcgaggaaagtcgtgagaaaatgtcccaagaaggcccaagagaaaactcagga

SEQ ID NO: 144286 - DNA, 75 bp, Artificial Sequence
  Synthetic
aggggggttacctggcaaagaggcgaggaaagtcgtgagaaattgtcccaagaaggcccaagagaaaactcagga

SEQ ID NO: 144287 - DNA, 75 bp, Artificial Sequence
  Synthetic
aggggggttacctggcaaagaggcgaggaaagtcgtgagaaactgtcccaagaaggcccaagagaaaactcagga

SEQ ID NO: 144288 - DNA, 75 bp, Artificial Sequence
  Synthetic
aggggggttacctggcaaagaggcgaggaaagtcgtgagaaagtgtcccaagaaggcccaagagaaaactcagga

SEQ ID NO: 144289 - DNA, 75 bp, Artificial Sequence
  Synthetic
aggggggttacctggcaaagaggcgaggaaagtcgcgagaaaatgtcccaagaaggcccaagagaaaactcagga

SEQ ID NO: 144290 - DNA, 75 bp, Artificial Sequence
  Synthetic
aggggggttacctggcaaagaggcgaggaaagtcgcgagaaattgtcccaagaaggcccaagagaaaactcagga

SEQ ID NO: 144291 - DNA, 75 bp, Artificial Sequence
  Synthetic
aggggggttacctggcaaagaggcgaggaaagtcgcgagaaactgtcccaagaaggcccaagagaaaactcagga

SEQ ID NO: 144292 - DNA, 75 bp, Artificial Sequence
  Synthetic
aggggggttacctggcaaagaggcgaggaaagtcgcgagaaagtgtcccaagaaggcccaagagaaaactcagga

SEQ ID NO: 144293 - DNA, 75 bp, Artificial Sequence
  Synthetic
aggggggttacctggcaaagaggcgaggaaagtcgggagaaaatgtcccaagaaggcccaagagaaaactcagga

SEQ ID NO: 144294 - DNA, 75 bp, Artificial Sequence
  Synthetic
aggggggttacctggcaaagaggcgaggaaagtcgggagaaattgtcccaagaaggcccaagagaaaactcagga

SEQ ID NO: 144295 - DNA, 75 bp, Artificial Sequence
  Synthetic
aggggggttacctggcaaagaggcgaggaaagtcgggagaaactgtcccaagaaggcccaagagaaaactcagga

SEQ ID NO: 144296 - DNA, 75 bp, Artificial Sequence
  Synthetic
aggggggttacctggcaaagaggcgaggaaagtcgggagaaagtgtcccaagaaggcccaagagaaaactcagga

SEQ ID NO: 144297 - DNA, 75 bp, Artificial Sequence
  Synthetic
agtctatctccatctggtccgtccgggccctcttcgccgggggagccccctctccatccttatccttctttccga

SEQ ID NO: 144298 - DNA, 75 bp, Artificial Sequence
  Synthetic
agttttggagagaactccgggccgaatggtcgagtagcacacagagggagaaagccacacagagatgagcagaaa

SEQ ID NO: 144299 - DNA, 75 bp, Artificial Sequence
  Synthetic
agttttggagagaactccgggccgaatggtcgagtagcacacagagggagaaagccacacagagatgagcagata

SEQ ID NO: 144300 - DNA, 75 bp, Artificial Sequence
  Synthetic
agttttggagagaactccgggccgaatggtcgagtagcacacagagggagaaagccacacagagatgagcagaca

SEQ ID NO: 144301 - DNA, 75 bp, Artificial Sequence
  Synthetic
agttttggagagaactccgggccgaatggtcgagtagcacacagagggagaaagccacacagagatgagcagaga

SEQ ID NO: 144302 - DNA, 75 bp, Artificial Sequence
  Synthetic
agttttggagagaactccgggccgaatggtcgtgtagcacacagagggagaaagccacacagagatgagcagaaa

SEQ ID NO: 144303 - DNA, 75 bp, Artificial Sequence
  Synthetic
agttttggagagaactccgggccgaatggtcgtgtagcacacagagggagaaagccacacagagatgagcagata

SEQ ID NO: 144304 - DNA, 75 bp, Artificial Sequence
  Synthetic
agttttggagagaactccgggccgaatggtcgtgtagcacacagagggagaaagccacacagagatgagcagaca

SEQ ID NO: 144305 - DNA, 75 bp, Artificial Sequence
  Synthetic
agttttggagagaactccgggccgaatggtcgtgtagcacacagagggagaaagccacacagagatgagcagaga

SEQ ID NO: 144306 - DNA, 75 bp, Artificial Sequence
  Synthetic
agttttggagagaactccgggccgaatggtcgcgtagcacacagagggagaaagccacacagagatgagcagaaa

SEQ ID NO: 144307 - DNA, 75 bp, Artificial Sequence
  Synthetic
agttttggagagaactccgggccgaatggtcgcgtagcacacagagggagaaagccacacagagatgagcagata

SEQ ID NO: 144308 - DNA, 75 bp, Artificial Sequence
  Synthetic
agttttggagagaactccgggccgaatggtcgcgtagcacacagagggagaaagccacacagagatgagcagaca

SEQ ID NO: 144309 - DNA, 75 bp, Artificial Sequence
  Synthetic
agttttggagagaactccgggccgaatggtcgcgtagcacacagagggagaaagccacacagagatgagcagaga

SEQ ID NO: 144310 - DNA, 75 bp, Artificial Sequence
  Synthetic
agttttggagagaactccgggccgaatggtcgggtagcacacagagggagaaagccacacagagatgagcagaaa

SEQ ID NO: 144311 - DNA, 75 bp, Artificial Sequence
  Synthetic
agttttggagagaactccgggccgaatggtcgggtagcacacagagggagaaagccacacagagatgagcagata

SEQ ID NO: 144312 - DNA, 75 bp, Artificial Sequence
  Synthetic
agttttggagagaactccgggccgaatggtcgggtagcacacagagggagaaagccacacagagatgagcagaca

SEQ ID NO: 144313 - DNA, 75 bp, Artificial Sequence
  Synthetic
agttttggagagaactccgggccgaatggtcgggtagcacacagagggagaaagccacacagagatgagcagaga

SEQ ID NO: 144314 - DNA, 75 bp, Artificial Sequence
  Synthetic
ggccacctccagaggaccccttcagcgaacagaagacgctctcggacggtaggagtaagaccatagcgataggag

SEQ ID NO: 144315 - DNA, 75 bp, Artificial Sequence
  Synthetic
cacctccagaggaccccttcagcgaacagaagaccaccagacgcgataggagtaagaccatagcgatgggaggag

SEQ ID NO: 144316 - DNA, 75 bp, Artificial Sequence
  Synthetic
aggagtaagaccatagcgataggagaggatgctaggaggtaggggcgaccgaagcgaggagaaagtcaaagagag

SEQ ID NO: 144317 - DNA, 75 bp, Artificial Sequence
  Synthetic
tatcccggggaactcgacttatcgtccccacatagcagagcccggggccccttccaaaagcgaccgaggggggag

SEQ ID NO: 144318 - DNA, 75 bp, Artificial Sequence
  Synthetic
ccccccaggaatggcgggaccccactctgcagggtccgcgtaccatcctttcttacctgatggccggcatggtcc

SEQ ID NO: 144319 - DNA, 75 bp, Artificial Sequence
  Synthetic
tttggagagcactccggcccgaaaggatgagaagtccccagagggaggaatccacacggagaaaagcagaaaaat

SEQ ID NO: 144320 - DNA, 75 bp, Artificial Sequence
  Synthetic
gatgagaagtccccagagggaggaatccacacggagaaaagcagaaaaatcacctccagaggaccccttcagcga

SEQ ID NO: 144321 - DNA, 75 bp, Artificial Sequence
  Synthetic
tccacacggagaaaagcagaaaaatcacctccagaggaccccttcagcgaacagagagcaccgagacgcgatagg

SEQ ID NO: 144322 - DNA, 75 bp, Artificial Sequence
  Synthetic
cccccgagaggggacgagtgaggcttatcccggagcattcggcgaatcgtccccacatagcaggttccaggaccc

SEQ ID NO: 144323 - DNA, 75 bp, Artificial Sequence
  Synthetic
ccccacatagcaggttccaggacccccttccaaaataaccgaggggggtggcttggaccctgggggggccactgg

SEQ ID NO: 144324 - DNA, 75 bp, Artificial Sequence
  Synthetic
atgggccaagttccgaacgaagagtccgcgggggaggaacggcgacccgagaggggatcagtggtaaagatgcgg

SEQ ID NO: 144325 - DNA, 75 bp, Artificial Sequence
  Synthetic
ccgcgggggaggaacggcgacccgagaggggatcagtggtaaagatgcggggaacctcggagaaaattctcccaa

SEQ ID NO: 144326 - DNA, 75 bp, Artificial Sequence
  Synthetic
gaggggatcagtggtaaagatgcggggaacctcggagaaaattctcccaagaagggaagaggggatcgggaagag

SEQ ID NO: 144327 - DNA, 75 bp, Artificial Sequence
  Synthetic
gaaggtctctacaagacgctggagtccttcctggaatgggaaggaagaaaggtggaaaagaaggaaaggaccttc

SEQ ID NO: 144328 - DNA, 75 bp, Artificial Sequence
  Synthetic
ccttcctggaatgggaaggaagaaaggtggaaaagaaggaaaggaccttccgatccgaggggccggacttccgag

SEQ ID NO: 144329 - DNA, 75 bp, Artificial Sequence
  Synthetic
tcttggagagcactccgggccgaagggaagagaagcacccagagggaggaatccactcggagaaagcagacaaat

SEQ ID NO: 144330 - DNA, 75 bp, Artificial Sequence
  Synthetic
atccactcggagaaagcagacaaatcacctccagaggaccccttcagcgaacagaagagccttgcacgggaagga

SEQ ID NO: 144331 - DNA, 75 bp, Artificial Sequence
  Synthetic
agagtatatcctatgggaatccgtggtttcccctcacgtccagcccctccccggttctggcgaagggggactccg

SEQ ID NO: 144332 - DNA, 75 bp, Artificial Sequence
  Synthetic
cgaggagaaaagcaaagaaagcaacggggctagccgtcaggtgttccgccccccgagaggggaagagtgaggctt

SEQ ID NO: 144333 - DNA, 75 bp, Artificial Sequence
  Synthetic
ggggctagccgtcaggtgttccgccccccgagaggggaagagtgaggcttatcccggggaactcggcgaatcgtc

SEQ ID NO: 144334 - DNA, 75 bp, Artificial Sequence
  Synthetic
ccccgagaggggaagagtgaggcttatcccggggaactcggcgaatcgtccccacatagcagagcccggaccccc

SEQ ID NO: 144335 - DNA, 75 bp, Artificial Sequence
  Synthetic
aggagcgcgggggagccgtggggccatgggatgctccttccgattccgtccatccccctccccccgagggtcgcc

SEQ ID NO: 144336 - DNA, 75 bp, Artificial Sequence
  Synthetic
atgggatgctccttccgattccgtccatccccctccccccgagggtcgcccaggaatggcgggacaccactctac

SEQ ID NO: 144337 - DNA, 75 bp, Artificial Sequence
  Synthetic
tctctctcgagttcctctaacttctttcttccatctacccactgctcgaggatctgctctctgcccccgcggttc

SEQ ID NO: 144338 - DNA, 75 bp, Artificial Sequence
  Synthetic
gatgcccaggtcggaccgcggggaggtggagatgccatgccgacccgaagaggaaagaagaacgcgagacgcgaa

SEQ ID NO: 144339 - DNA, 75 bp, Artificial Sequence
  Synthetic
aaaagggaggatcggagggaaagagtatatccaatggaaatccccggtcacccctcgtgtccagcccgtccccgt

SEQ ID NO: 144340 - DNA, 75 bp, Artificial Sequence
  Synthetic
aaaagggaggatcggagggaaagagtatatcctatggaaatccccggtcacccctcgtgtccagcccgtccccgt

SEQ ID NO: 144341 - DNA, 75 bp, Artificial Sequence
  Synthetic
aaaagggaggatcggagggaaagagtatatcccatggaaatccccggtcacccctcgtgtccagcccgtccccgt

SEQ ID NO: 144342 - DNA, 75 bp, Artificial Sequence
  Synthetic
aaaagggaggatcggagggaaagagtatatccgatggaaatccccggtcacccctcgtgtccagcccgtccccgt

SEQ ID NO: 144343 - DNA, 75 bp, Artificial Sequence
  Synthetic
ggagatcgcgaggggcaggaacagctcccgagaggggataaatggtaaagaagcattggaacgtcggagaaaacc

SEQ ID NO: 144344 - DNA, 75 bp, Artificial Sequence
  Synthetic
tcccgagaggggataaatggtaaagaagcattggaacgtcggagaaaaccctcccaagaaggaaaaaagagaaag

SEQ ID NO: 144345 - DNA, 75 bp, Artificial Sequence
  Synthetic
caagaagcggacgattttccccataacgctggagacgtcctggaaggggaaagaggacgagcggaataaaggggg

SEQ ID NO: 144346 - DNA, 75 bp, Artificial Sequence
  Synthetic
acgctggagacgtcctggaaggggaaagaggacgagcggaataaagggggcgggcctcccgatccgaggggccca

SEQ ID NO: 144347 - DNA, 75 bp, Artificial Sequence
  Synthetic
cggcgggccggctactcttcttttcctttcctcgtcttccccggtcaaccttctgagttcctcttcctcctcctt

SEQ ID NO: 144348 - DNA, 75 bp, Artificial Sequence
  Synthetic
gtgagcctcgtgccgaccgaagggcgcgatgggggagggggatcctccgagaggggatacccactaaagagaggg

SEQ ID NO: 144349 - DNA, 75 bp, Artificial Sequence
  Synthetic
gcgatgggggagggggatcctccgagaggggatacccactaaagagagggagataccctgagggagactgctccc

SEQ ID NO: 144350 - DNA, 75 bp, Artificial Sequence
  Synthetic
gaggggatacccactaaagagagggagataccctgagggagactgctcccaagaagttccaagagaatctcaaga

SEQ ID NO: 144351 - DNA, 75 bp, Artificial Sequence
  Synthetic
atgaggaggatccccaggacgctggagaaatctaggaatgggaaagaggagggcggaaaaaatggagcggcctcc

SEQ ID NO: 144352 - DNA, 75 bp, Artificial Sequence
  Synthetic
agaaatctaggaatgggaaagaggagggcggaaaaaatggagcggcctcccgattcgaacggcccgacgccagaa

SEQ ID NO: 144353 - DNA, 75 bp, Artificial Sequence
  Synthetic
ctggagagcactccgggccgtacggtcgggaaccctccagagggaagaagccacacggagtagaacggaaaaatc

SEQ ID NO: 144354 - DNA, 75 bp, Artificial Sequence
  Synthetic
tcgggaaccctccagagggaagaagccacacggagtagaacggaaaaatcacctccagaggaccccttcagcgaa

SEQ ID NO: 144355 - DNA, 75 bp, Artificial Sequence
  Synthetic
ccatccttatccttctttccgattattcctttgatgttccccagccagggattctcatcctctaacttactgatc

SEQ ID NO: 144356 - DNA, 75 bp, Artificial Sequence
  Synthetic
ccatccttatccttctttccgattattcctttgatgttccccagccagggattctcatcctctaactttctgatc

SEQ ID NO: 144357 - DNA, 75 bp, Artificial Sequence
  Synthetic
ccatccttatccttctttccgattattcctttgatgttccccagccagggattctcatcctctaacttcctgatc

SEQ ID NO: 144358 - DNA, 75 bp, Artificial Sequence
  Synthetic
ccatccttatccttctttccgattattcctttgatgttccccagccagggattctcatcctctaacttgctgatc

SEQ ID NO: 144359 - DNA, 75 bp, Artificial Sequence
  Synthetic
ttcttcttcgtcttccggaggtctctctcgagctcctcgactttctttcttccactcacccactgctcgaggacg

SEQ ID NO: 144360 - DNA, 75 bp, Artificial Sequence
  Synthetic
cagaaggctctctcacgcggcaggagtaagaccatagcgtaggaagagatgctaggagttgggggagaccgaagc

SEQ ID NO: 144361 - DNA, 75 bp, Artificial Sequence
  Synthetic
tctcgagctcctcgactttctttcttccactcacccactgctcgaggacgtcttcccttcccccgcggttcttct

SEQ ID NO: 144362 - DNA, 75 bp, Artificial Sequence
  Synthetic
tcgattcggaccggctcatctcggcaaagggcggcagtcctcagtgctcttactcttttcttgtaaagaggagac

SEQ ID NO: 144363 - DNA, 75 bp, Artificial Sequence
  Synthetic
gaggagaaaagtaaagagagcaacggggctagccagtgggtgttccgccccccaagaggcacgagtgaggcttat

SEQ ID NO: 144364 - DNA, 75 bp, Artificial Sequence
  Synthetic
aaagggcggcagtcctcagtgctcttactcttttcttgtaaagaggagactgctggactcgccgcccaagtccga

SEQ ID NO: 144365 - DNA, 75 bp, Artificial Sequence
  Synthetic
gatgggccgcagttcccgacgaggagcccgcaagtgggaggatcagccaccggaggggacgcgatgccaaagagt

SEQ ID NO: 144366 - DNA, 75 bp, Artificial Sequence
  Synthetic
gcccgcaagtgggaggatcagccaccggaggggacgcgatgccaaagagtgggggaaatctcggagggtgatccc

SEQ ID NO: 144367 - DNA, 75 bp, Artificial Sequence
  Synthetic
cggaggggacgcgatgccaaagagtgggggaaatctcggagggtgatcccaagaaggccacggggactcaagcga

SEQ ID NO: 144368 - DNA, 75 bp, Artificial Sequence
  Synthetic
tggagcgtgggggagccgtgggtccgtgggatgctcctcccgattccgtccaatccccccccccgagaggtcccc

SEQ ID NO: 144369 - DNA, 75 bp, Artificial Sequence
  Synthetic
caggaatggcgggaccccactcggcagggtccgcgtaccatcctttcttacctgatggccggcatggtcccagcc

SEQ ID NO: 144370 - DNA, 75 bp, Artificial Sequence
  Synthetic
cgggagtaagaccatagcgatggggggagatgctaggagtcagaggagaccgaagcgaggaggaaagcaaagaaa

SEQ ID NO: 144371 - DNA, 75 bp, Artificial Sequence
  Synthetic
ggagatgctaggagtcagaggagaccgaagcgaggaggaaagcaaagaaagcaacggggctagcgagtggatgtt

SEQ ID NO: 144372 - DNA, 75 bp, Artificial Sequence
  Synthetic
ctggggacgacaactctggggagagaagggaggatcggatgggaagagtatatcctacgggaatccccggtctcc

SEQ ID NO: 144373 - DNA, 75 bp, Artificial Sequence
  Synthetic
cccaacatagcggaccccaggaccccttccgaacgagggggacggtccttgaactcccaggggtcccatggaacc

SEQ ID NO: 144374 - DNA, 75 bp, Artificial Sequence
  Synthetic
gtgggaatccccagcactcccttctccacactccttcccccctgtggggcccccccataagatggcgagatctcc

SEQ ID NO: 144375 - DNA, 75 bp, Artificial Sequence
  Synthetic
gcgggccggctgttcttcttttcctttcctcgtcttctccggtcaacctcctaagttcctcttcttcttccttgc

SEQ ID NO: 144376 - DNA, 75 bp, Artificial Sequence
  Synthetic
tcccagcctcctcgtcggcgccggccgggcaacattccgaggggaccgtccctcggtaatggcgaatgggaccca

SEQ ID NO: 144377 - DNA, 75 bp, Artificial Sequence
  Synthetic
ctgcttcttcttgttctcgagggccttccttcttcggtgatcccgcctctcctgatcggtgaatcttcccctgag

SEQ ID NO: 144378 - DNA, 75 bp, Artificial Sequence
  Synthetic
ctgcttcttcttgttctcgagggccttccttcttcggtgatcccgcctctcctgttcggtgaatcttcccctgag

SEQ ID NO: 144379 - DNA, 75 bp, Artificial Sequence
  Synthetic
ctgcttcttcttgttctcgagggccttccttcttcggtgatcccgcctctcctgctcggtgaatcttcccctgag

SEQ ID NO: 144380 - DNA, 75 bp, Artificial Sequence
  Synthetic
ctgcttcttcttgttctcgagggccttccttcttcggtgatcccgcctctcctggtcggtgaatcttcccctgag

SEQ ID NO: 144381 - DNA, 75 bp, Artificial Sequence
  Synthetic
aggtccctttccgggtccggagtctacctccatcctgtccgtccgggccctcttcgccgggggagccccttctcc

SEQ ID NO: 144382 - DNA, 75 bp, Artificial Sequence
  Synthetic
acctccatcctgtccgtccgggccctcttcgccgggggagccccttctccgtccctatccttctttccaattatt

SEQ ID NO: 144383 - DNA, 75 bp, Artificial Sequence
  Synthetic
cctttgatgtttcccagccagggattatcatcctcgagcttcttgatcttcttcttggccttccggagatctctc

SEQ ID NO: 144384 - DNA, 75 bp, Artificial Sequence
  Synthetic
tatcatcctcgagcttcttgatcttcttcttggccttccggagatctctctcgagttctcctattcttcctcttg

SEQ ID NO: 144385 - DNA, 75 bp, Artificial Sequence
  Synthetic
ctgagggctaacctacggaaattcctgagttcccctggtgtccaggccgtcccctctccgagtgaagggagactc

SEQ ID NO: 144386 - DNA, 75 bp, Artificial Sequence
  Synthetic
tggatacccactgctcgagaatgtcctcccgtcctcctcgcttctccttcttgtcggaccggctcatctcggcaa

SEQ ID NO: 144387 - DNA, 75 bp, Artificial Sequence
  Synthetic
tgagttcccctggtgtccaggccgtcccctctccgagtgaagggagactccgggactcccagcatgcttgggacg

SEQ ID NO: 144388 - DNA, 75 bp, Artificial Sequence
  Synthetic
agaggcggacggtcctcagtgctcttactcttttctgtaaagaggagactgctggactcgtcgccccagtccgag

SEQ ID NO: 144389 - DNA, 75 bp, Artificial Sequence
  Synthetic
atgggccacagctccgaacgaagggttcgacgggggaggaggccatcccgagaggggtcacctggtaaagaggcg

SEQ ID NO: 144390 - DNA, 75 bp, Artificial Sequence
  Synthetic
ttcgacgggggaggaggccatcccgagaggggtcacctggtaaagaggcgtaggaaagtcgagagaaatagtccc

SEQ ID NO: 144391 - DNA, 75 bp, Artificial Sequence
  Synthetic
agaggggtcacctggtaaagaggcgtaggaaagtcgagagaaatagtcccaagaaggttcaagagaaaatccaag

SEQ ID NO: 144392 - DNA, 75 bp, Artificial Sequence
  Synthetic
aaggaggacctttccccacgacgctgtggaagctctcggaaggggaaagaggaaggcgaaagaaaaggggcgggg

SEQ ID NO: 144393 - DNA, 75 bp, Artificial Sequence
  Synthetic
ctccctgctgaggttcttccctcccgaggagagttgctttttcttgttctccagggccttccttcttcggtgatc

SEQ ID NO: 144394 - DNA, 75 bp, Artificial Sequence
  Synthetic
gagttttggagagaactccgggccagatggtcgagtagcacacagagggagaaagccacacagagatgagcagag

SEQ ID NO: 144395 - DNA, 75 bp, Artificial Sequence
  Synthetic
aagccacctccagaggaccccctcagcgaacagaagacgctctcggacggcggagaaaggccatagcgataggag

SEQ ID NO: 144396 - DNA, 75 bp, Artificial Sequence
  Synthetic
aagccacctccagaggaccccctcagcgaacagaagacgctctcggacggcggagtaaggccatagcgataggag

SEQ ID NO: 144397 - DNA, 75 bp, Artificial Sequence
  Synthetic
aagccacctccagaggaccccctcagcgaacagaagacgctctcggacggcggagcaaggccatagcgataggag

SEQ ID NO: 144398 - DNA, 75 bp, Artificial Sequence
  Synthetic
aagccacctccagaggaccccctcagcgaacagaagacgctctcggacggcggaggaaggccatagcgataggag

SEQ ID NO: 144399 - DNA, 75 bp, Artificial Sequence
  Synthetic
cgcccccacatagcagttcctcggaccccttccaaaggaccgaagggggagctaggagcgcgggggggacccgcc

SEQ ID NO: 144400 - DNA, 75 bp, Artificial Sequence
  Synthetic
tgggccgcagccgacaagaagggccgaaagtgcgaaaggaggaaccgctccgagagttgggagaagaaagagagc

SEQ ID NO: 144401 - DNA, 75 bp, Artificial Sequence
  Synthetic
tgggccgcagccgtcaagaagggccgaaagtgcgaaaggaggaaccgctccgagagttgggagaagaaagagagc

SEQ ID NO: 144402 - DNA, 75 bp, Artificial Sequence
  Synthetic
tgggccgcagccgccaagaagggccgaaagtgcgaaaggaggaaccgctccgagagttgggagaagaaagagagc

SEQ ID NO: 144403 - DNA, 75 bp, Artificial Sequence
  Synthetic
tgggccgcagccggcaagaagggccgaaagtgcgaaaggaggaaccgctccgagagttgggagaagaaagagagc

SEQ ID NO: 144404 - DNA, 75 bp, Artificial Sequence
  Synthetic
cgagagttgggagaagaaagagagcgaatgtgtccggaaggaacccccaagctttcaacagaggaagagagcaag

SEQ ID NO: 144405 - DNA, 75 bp, Artificial Sequence
  Synthetic
ggagccgtgggatgcccttcccgattccgtccgaccccacccccgagaggtccccccaggaatggcgggacccca

SEQ ID NO: 144406 - DNA, 75 bp, Artificial Sequence
  Synthetic
gctttcaacagaggaagagagcaagatagaggagcccccgtgacactggcagcgtcgcggactgggagaggagag

SEQ ID NO: 144407 - DNA, 75 bp, Artificial Sequence
  Synthetic
atcgaatggccgtaggcagaggaacctctggagtcctctagaccgcaaggaggaaattaccagcagggggtgatc

SEQ ID NO: 144408 - DNA, 75 bp, Artificial Sequence
  Synthetic
ctctggagtcctctagaccgcaaggaggaaattaccagcagggggtgatccacccggagatgagcggacaagcca

SEQ ID NO: 144409 - DNA, 75 bp, Artificial Sequence
  Synthetic
ttattcactggggacgacaactctggggagagaagggtggatcggatgggaagagtatatcctacgggaatccgc

SEQ ID NO: 144410 - DNA, 75 bp, Artificial Sequence
  Synthetic
taggagtcgggggaagccagaacgactgggaaagaaaagaaagcaacggggctagctgccgggtgttccatccat

SEQ ID NO: 144411 - DNA, 75 bp, Artificial Sequence
  Synthetic
ctgggaaagaaaagaaagcaacggggctagctgccgggtgttccatccatgggatcggtgccgagtgaggcttat

SEQ ID NO: 144412 - DNA, 75 bp, Artificial Sequence
  Synthetic
gctagctgccgggtgttccatccatgggatcggtgccgagtgaggcttatcccggggggattgcctcgaccccct

SEQ ID NO: 144413 - DNA, 75 bp, Artificial Sequence
  Synthetic
gggatcggtgccgagtgaggcttatcccggggggattgcctcgaccccctccctaacacgggagtcccgggcccc

SEQ ID NO: 144414 - DNA, 75 bp, Artificial Sequence
  Synthetic
gggacaccttgcatgttgggggcgaagccgcccccgagcgctcccctcgatccaccttcgagggggttcacatcc

SEQ ID NO: 144415 - DNA, 75 bp, Artificial Sequence
  Synthetic
gggacaccttgcatgttgggggcgaagccgcccccgtgcgctcccctcgatccaccttcgagggggttcacatcc

SEQ ID NO: 144416 - DNA, 75 bp, Artificial Sequence
  Synthetic
gggacaccttgcatgttgggggcgaagccgcccccgcgcgctcccctcgatccaccttcgagggggttcacatcc

SEQ ID NO: 144417 - DNA, 75 bp, Artificial Sequence
  Synthetic
gggacaccttgcatgttgggggcgaagccgcccccgggcgctcccctcgatccaccttcgagggggttcacatcc

SEQ ID NO: 144418 - DNA, 75 bp, Artificial Sequence
  Synthetic
ctcccaggaatggagacggggggaaatcgaccgggtcccgcagaacccgatggagtcccccgccatcccctgacg

SEQ ID NO: 144419 - DNA, 75 bp, Artificial Sequence
  Synthetic
gataaaactggtcccgataggggcacccacaataggatggcaggaggggactgcgggtccgtcgttccatccttt

SEQ ID NO: 144420 - DNA, 75 bp, Artificial Sequence
  Synthetic
tcttaccttgtggccggcatggccccagcctcctcgctggcgccggctgggcaacgatccgaggggactatccct

SEQ ID NO: 144421 - DNA, 75 bp, Artificial Sequence
  Synthetic
cagcctcctcgctggcgccggctgggcaacgatccgaggggactatccctctcgagaatcggcaaatggggcccc

SEQ ID NO: 144422 - DNA, 75 bp, Artificial Sequence
  Synthetic
catccgaggggactacgtcctccttacggatgcccaggtcggaccgcgaggaggtggagatcccatgccgacccg

SEQ ID NO: 144423 - DNA, 75 bp, Artificial Sequence
  Synthetic
gaggtggagatcccatgccgacccgaagaggaaaggaggacacggacgacaaaccgtaagttctactgcccttta

SEQ ID NO: 144424 - DNA, 75 bp, Artificial Sequence
  Synthetic
tgattttcttcttggtcttccgggcttttctctcgagctcctctagctcttttcttccagacacccacatttcga

SEQ ID NO: 144425 - DNA, 75 bp, Artificial Sequence
  Synthetic
tgattttcttcttggtcttccgggcttttctctcgagctcctctagctcttttcttccagtcacccacatttcga

SEQ ID NO: 144426 - DNA, 75 bp, Artificial Sequence
  Synthetic
tgattttcttcttggtcttccgggcttttctctcgagctcctctagctcttttcttccagccacccacatttcga

SEQ ID NO: 144427 - DNA, 75 bp, Artificial Sequence
  Synthetic
tgattttcttcttggtcttccgggcttttctctcgagctcctctagctcttttcttccaggcacccacatttcga

SEQ ID NO: 144428 - DNA, 75 bp, Artificial Sequence
  Synthetic
ttgttgggtgcaccctgggacccagtaatacccggggggaggcggggtaaacccatactatgggaactgctgggt

SEQ ID NO: 144429 - DNA, 75 bp, Artificial Sequence
  Synthetic
ggatttcctcccttccccctcgattcttcttcgattcgggccggctcatcttggcagaaggcggcggtcctcagt

SEQ ID NO: 144430 - DNA, 75 bp, Artificial Sequence
  Synthetic
acccatactatgggaactgctgggttcctcggatgtcgatcccctctcccgttcgggaaaagggggactccggaa

SEQ ID NO: 144431 - DNA, 75 bp, Artificial Sequence
  Synthetic
cagttgcttcttcttgttctcgagggccttccttcttctgtggtcccgcctctcctggtcggtgaatcccctggc

SEQ ID NO: 144432 - DNA, 75 bp, Artificial Sequence
  Synthetic
gggatcggtgccgagtgaggcttatcccggggggattgcctcggccccctccctaacacgggagtacccgggccc

SEQ ID NO: 144433 - DNA, 75 bp, Artificial Sequence
  Synthetic
gggatcggtgccgagtgaggcttatcccggggggattgcctcggccccctccctaacacgggagttcccgggccc

SEQ ID NO: 144434 - DNA, 75 bp, Artificial Sequence
  Synthetic
gggatcggtgccgagtgaggcttatcccggggggattgcctcggccccctccctaacacgggagtccccgggccc

SEQ ID NO: 144435 - DNA, 75 bp, Artificial Sequence
  Synthetic
gggatcggtgccgagtgaggcttatcccggggggattgcctcggccccctccctaacacgggagtgcccgggccc

SEQ ID NO: 144436 - DNA, 75 bp, Artificial Sequence
  Synthetic
tttggatttcctcccaggtgtagaatcaatctccatgtcctctcgcctggccctcttcgccgggggtcctccctc

SEQ ID NO: 144437 - DNA, 75 bp, Artificial Sequence
  Synthetic
ggagctccttctcggctattcgctttttcttcctttcctctacccactgttcgagggcctcctccctcgccttcg

SEQ ID NO: 144438 - DNA, 75 bp, Artificial Sequence
  Synthetic
gatgggccacagtgccgacgaggaaaccgcaggtgggaggatcagccaccggcgagggacgcgatggtaagagtg

SEQ ID NO: 144439 - DNA, 75 bp, Artificial Sequence
  Synthetic
gaggaaagttcggagggaaatcccaagaagatcactcgagattcaagaggtgaggagggatccccgagacgctgg

SEQ ID NO: 144440 - DNA, 75 bp, Artificial Sequence
  Synthetic
agaagatcactcgagattcaagaggtgaggagggatccccgagacgctggaggaacgccgggaaaaagaaaagaa

SEQ ID NO: 144441 - DNA, 75 bp, Artificial Sequence
  Synthetic
ggggtgatccaccaggagaagtagcggagaacccacctccagaggaccccttctgcgaacagaaaagctcttccc

SEQ ID NO: 144442 - DNA, 75 bp, Artificial Sequence
  Synthetic
ggagaacccacctccagaggaccccttctgcgaacagaaaagctcttccccctcgggagtaggaccgtagcgatg

SEQ ID NO: 144443 - DNA, 75 bp, Artificial Sequence
  Synthetic
gaggcttatcccggggatcggcctctgttcctccatggtggactccaggacccccaaaaggaggggggtgggcct

SEQ ID NO: 144444 - DNA, 75 bp, Artificial Sequence
  Synthetic
cccccaaaaggaggggggtgggccttggacctccgggagccatgggatccgtggagtacccggggccattccctt

SEQ ID NO: 144445 - DNA, 75 bp, Artificial Sequence
  Synthetic
ttcttccatcgatccacttcccgagtgtctcttctctccccctccggaccttcctcgtatcggacaggctcatct

SEQ ID NO: 144446 - DNA, 75 bp, Artificial Sequence
  Synthetic
tccgcctcccccatggtggcctccaggacccccgaaaggaggggggtgggccttggacccccaggggtccatggg

SEQ ID NO: 144447 - DNA, 75 bp, Artificial Sequence
  Synthetic
tgggccgcaaccgggagaagagggcgaagtggggagggggagatcccgaggaggatctccaactaaagagtggaa

SEQ ID NO: 144448 - DNA, 75 bp, Artificial Sequence
  Synthetic
gaggatctccaactaaagagtggaagaaatctcggaaagcttctcccaagaagaaccggggacgcctcaagaggg

SEQ ID NO: 144449 - DNA, 75 bp, Artificial Sequence
  Synthetic
gtaacggagaaaggagcgggcctcccgatccgagtggtccgcagcgtatcgagactggagtcatccggacgaagg

SEQ ID NO: 144450 - DNA, 75 bp, Artificial Sequence
  Synthetic
gttgaaacaacccacagtcgggtgatccaccaggagggcggaggaggactcacctccagaggaccccttcagcga

SEQ ID NO: 144451 - DNA, 75 bp, Artificial Sequence
  Synthetic
tccaccaggagggcggaggaggactcacctccagaggaccccttcagcgaacggaagagcctcttccttcggaga

SEQ ID NO: 144452 - DNA, 75 bp, Artificial Sequence
  Synthetic
gaaagaccatagcgatggggggagatgctaggagtgggcggcgaccgaagcgagggggaaagtaaagaaagcaac

SEQ ID NO: 144453 - DNA, 75 bp, Artificial Sequence
  Synthetic
cgagggggaaagtaaagaaagcaacggggctagcgggtggatgttccaccccccggcggggccgagtgaggctta

SEQ ID NO: 144454 - DNA, 75 bp, Artificial Sequence
  Synthetic
ggggctagcgggtggatgttccaccccccggcggggccgagtgaggcttatcccggggatcggcgaatcgtcccg

SEQ ID NO: 144455 - DNA, 75 bp, Artificial Sequence
  Synthetic
atccctgagtccctctggtgtccaggccgtcccctcttctagagaagggagactccggaacgccttccatggtgg

SEQ ID NO: 144456 - DNA, 75 bp, Artificial Sequence
  Synthetic
acatccccaacccgcgggccggctactcttctttcccttctctcgtcttcctcggtcaacctccgaagttcctct

SEQ ID NO: 144457 - DNA, 75 bp, Artificial Sequence
  Synthetic
cacactccttcccccctgcggggcccccccataagatggcaggaacccactcattggggtccgctgttccattct

SEQ ID NO: 144458 - DNA, 75 bp, Artificial Sequence
  Synthetic
gagctccctctcgagttcctcctttcttcttcttccatcgatccactttccgagtgtctcttctctccccttccg

SEQ ID NO: 144459 - DNA, 75 bp, Artificial Sequence
  Synthetic
ttattggggggtacactcgaggagtggaaggcgttgttgggggggagatgggcgtacctacgggaatccctggtt

SEQ ID NO: 144460 - DNA, 75 bp, Artificial Sequence
  Synthetic
cgaaccgtgagtggaaccctgttctttattggggggtacactcgaggagtggaaggcgttgttgggggggagatg

SEQ ID NO: 144461 - DNA, 75 bp, Artificial Sequence
  Synthetic
atcttcgatagggcggacggtcccgagagctcttatcttccttcttagaagaggagtctcctggacgcttccgct

SEQ ID NO: 144462 - DNA, 75 bp, Artificial Sequence
  Synthetic
tcccctgatgtccagtccctcccccgtccgagcgaagggggactccggaacaccttccatccgagggacgaagcc

SEQ ID NO: 144463 - DNA, 75 bp, Artificial Sequence
  Synthetic
catgggccacagttccgagcgaggagacgcgggtggaagggatggtgcccgaaaggggacaaacggtaaagagca

SEQ ID NO: 144464 - DNA, 75 bp, Artificial Sequence
  Synthetic
gacgcgggtggaagggatggtgcccgaaaggggacaaacggtaaagagcattggaacgtcgaggagatgcctccc

SEQ ID NO: 144465 - DNA, 75 bp, Artificial Sequence
  Synthetic
gaaaggggacaaacggtaaagagcattggaacgtcgaggagatgcctcccaagaaggaaaagagaattcaagaga

SEQ ID NO: 144466 - DNA, 75 bp, Artificial Sequence
  Synthetic
cctttcctcgtcttcagcggtcaacctcccgagttcctcttcttcctccctgctgaggctctttcctcccgagga

SEQ ID NO: 144467 - DNA, 75 bp, Artificial Sequence
  Synthetic
cggacgagttccccataacgctggagacatctcggaaggggaaagagggaaggtggaaaagaaggggcgggcctc

SEQ ID NO: 144468 - DNA, 75 bp, Artificial Sequence
  Synthetic
aggtggaaaagaaggggcgggcctcccgatccgaggggcccaacgccagatctgggggacatgccggcccgaagg

SEQ ID NO: 144469 - DNA, 75 bp, Artificial Sequence
  Synthetic
tctccttgtcggtgaacccgctcttgtgaggcttcttcccagtcccggagtcgacctccatctgatccgtccggg

SEQ ID NO: 144470 - DNA, 75 bp, Artificial Sequence
  Synthetic
cccgtccttcccttttctgattattccgaggatgttccccagccagggattttcatcctcgagtctcttgatggt

SEQ ID NO: 144471 - DNA, 75 bp, Artificial Sequence
  Synthetic
gggctagccgtcaggtgttccgccccccgagaggggacgagtgaggcttatcccggggaactcggcgaatcgtcc

SEQ ID NO: 144472 - DNA, 75 bp, Artificial Sequence
  Synthetic
ttgtgatccatctctcgaggatgtcctccctttgtccccttcggtttctcttcgactcggattggctcatcctcg

SEQ ID NO: 144473 - DNA, 75 bp, Artificial Sequence
  Synthetic
agaggggtaagtcggtaaagagcattggaacgtcggagatacaactcccaagaaggaaaaaagagaaagcaagaa

SEQ ID NO: 144474 - DNA, 75 bp, Artificial Sequence
  Synthetic
gcggaagaatttccccatgacgccggtgaaactctaggaaggggaaagagggaaggtggaagagaaggaggcggg

SEQ ID NO: 144475 - DNA, 75 bp, Artificial Sequence
  Synthetic
aggaagccacacggagtagaacagagaaatcaccaccagaggaccccttcagcgaacagagacgcatcgcgagag

SEQ ID NO: 144476 - DNA, 75 bp, Artificial Sequence
  Synthetic
aggaagccacacggagtagaacagagaaatcacctccagaggaccccttcagcgaacagagacgcatcgcgagag

SEQ ID NO: 144477 - DNA, 75 bp, Artificial Sequence
  Synthetic
aggaagccacacggagtagaacagagaaatcacccccagaggaccccttcagcgaacagagacgcatcgcgagag

SEQ ID NO: 144478 - DNA, 75 bp, Artificial Sequence
  Synthetic
aggaagccacacggagtagaacagagaaatcaccgccagaggaccccttcagcgaacagagacgcatcgcgagag

SEQ ID NO: 144479 - DNA, 75 bp, Artificial Sequence
  Synthetic
ttatcccggggaactcgacttatcgtccccacatagcagactcccggaccccctttcaaagtgaccgaggggggt

SEQ ID NO: 144480 - DNA, 75 bp, Artificial Sequence
  Synthetic
ccctttcaaagtgaccgaggggggtgactttgaacattggggaccagtggagccatgggatgctcttcccgattc

SEQ ID NO: 144481 - DNA, 75 bp, Artificial Sequence
  Synthetic
agattcccagagagaatcgagagaaaactggctctcccttagccatccgagtggacgttcgtcctccttcggatg

SEQ ID NO: 144482 - DNA, 75 bp, Artificial Sequence
  Synthetic
tgattttcttcttaaccttccggaggtctctctcgagttcctctaacttctttcttccgctcacccactgctcga

SEQ ID NO: 144483 - DNA, 75 bp, Artificial Sequence
  Synthetic
tggaacgtcggagatacactcccaagaaggaaaaaagagagagcaagaatcggatgattctccccatgacgccgg

SEQ ID NO: 144484 - DNA, 75 bp, Artificial Sequence
  Synthetic
cggaagatttccccttatgacgctggagacatcctggaaaggggaaagtggataggaggaaaaaaaaggagcggc

SEQ ID NO: 144485 - DNA, 75 bp, Artificial Sequence
  Synthetic
tccccgatccgaaacctcccatcccgatttccaaagtttgggaacactccggcccaaaggccttgagtacccaga

SEQ ID NO: 144486 - DNA, 75 bp, Artificial Sequence
  Synthetic
gatttccaaagtttgggaacactccggcccaaaggccttgagtacccagagggaggagatccactcttagaaagc

SEQ ID NO: 144487 - DNA, 75 bp, Artificial Sequence
  Synthetic
cgaacagaagagcgtcagacgcgtcaggagtaagagatagggggagatgcttggagttagaggagaccgaaggga

SEQ ID NO: 144488 - DNA, 75 bp, Artificial Sequence
  Synthetic
gactaggaacaccggggaccagtggagccatgggatgctcttcccgattccgcccaactccttccacccaagggt

SEQ ID NO: 144489 - DNA, 75 bp, Artificial Sequence
  Synthetic
gactaggaacaccggggaccagtggagccatgggatgctcttcccgattccgcccaactccttcctcccaagggt

SEQ ID NO: 144490 - DNA, 75 bp, Artificial Sequence
  Synthetic
gactaggaacaccggggaccagtggagccatgggatgctcttcccgattccgcccaactccttccccccaagggt

SEQ ID NO: 144491 - DNA, 75 bp, Artificial Sequence
  Synthetic
gactaggaacaccggggaccagtggagccatgggatgctcttcccgattccgcccaactccttccgcccaagggt

SEQ ID NO: 144492 - DNA, 75 bp, Artificial Sequence
  Synthetic
gggatgcccttcccgattccgaacccatcccttcccccgagggtccgcccaggaatggaacccactcagttgggg

SEQ ID NO: 144493 - DNA, 75 bp, Artificial Sequence
  Synthetic
aggaatggaacccactcagttggggtccgcgttccatcctttcttacctgtggccggcatggtccagcctcctcg

SEQ ID NO: 144494 - DNA, 75 bp, Artificial Sequence
  Synthetic
tggccggcatggtccagcctcctcgctggcgccggctgggcaacattccgaggggacccgtccctcggtaatggc

SEQ ID NO: 144495 - DNA, 75 bp, Artificial Sequence
  Synthetic
aggggacccgtccctcggtaatggcgaatgggacccagaaatctctagattcccatagagaatcggagaaaactg

SEQ ID NO: 144496 - DNA, 75 bp, Artificial Sequence
  Synthetic
tccaccttcgagggggttcacacccccaacctgcgggccggctactcttcttttccttctctcgtcttcctcggt

SEQ ID NO: 144497 - DNA, 75 bp, Artificial Sequence
  Synthetic
ggctctcccttagccatccgagtggacgtccgctcctccttcggatgcccaggtcggaccgcgaggaggtggagg

SEQ ID NO: 144498 - DNA, 75 bp, Artificial Sequence
  Synthetic
aggtcggaccgcgaggaggtggaggtggagatgccatgccgaccccgaagaggaaagaaggacgcgagacggtga

SEQ ID NO: 144499 - DNA, 75 bp, Artificial Sequence
  Synthetic
atgggccacgaaccgacgaagagtccgaaggtaggagaaggaggggcccccaaagggattcgaagctaaagagtg

SEQ ID NO: 144500 - DNA, 75 bp, Artificial Sequence
  Synthetic
cgaaggtaggagaaggaggggcccccaaagggattcgaagctaaagagtggagacacacgagaagggaggtgtcc

SEQ ID NO: 144501 - DNA, 75 bp, Artificial Sequence
  Synthetic
gctgaggctcttccctcccgcgctgagctgcttcttcttgttcttgagggccttccttcgtcggtgatcctgcct

SEQ ID NO: 144502 - DNA, 75 bp, Artificial Sequence
  Synthetic
caagagggcgaggggaggtctcaaggagaggagggatccccgagacgctggagactcccggaacaaggaaagtgg

SEQ ID NO: 144503 - DNA, 75 bp, Artificial Sequence
  Synthetic
agaggcctcttcctaggcccggagtctatctccatctggtccgtccgggccctcttcgccgggggagccccctct

SEQ ID NO: 144504 - DNA, 75 bp, Artificial Sequence
  Synthetic
aagacacctccagaggaccccttcagcgaacagaagagtctatccccagatgagaggaccgtagccgagggggag

SEQ ID NO: 144505 - DNA, 75 bp, Artificial Sequence
  Synthetic
ttcctttgacgtttcccagccagggattgtcgtcctcgagtttcttgatcttcttcctagccctccggagttccc

SEQ ID NO: 144506 - DNA, 75 bp, Artificial Sequence
  Synthetic
tctcgagttcctctaacttctttcttccattcacccactgctcgaggacctcttctcttcctccgcgattcttct

SEQ ID NO: 144507 - DNA, 75 bp, Artificial Sequence
  Synthetic
tcttctcttcctccgcgattcttcttcgactcggaccggctcatctcgacaagaggcggcaatcctcagtactct

SEQ ID NO: 144508 - DNA, 75 bp, Artificial Sequence
  Synthetic
ggactgccggctccaggaatccgttccaaaggaccgagggtaggacttggagcaccggggattccaagcaaaccc

SEQ ID NO: 144509 - DNA, 75 bp, Artificial Sequence
  Synthetic
ggactgccggctccaggaatccgttccaaaggaccgagggtaggacttggagcaccggggattccatgcaaaccc

SEQ ID NO: 144510 - DNA, 75 bp, Artificial Sequence
  Synthetic
ggactgccggctccaggaatccgttccaaaggaccgagggtaggacttggagcaccggggattccacgcaaaccc

SEQ ID NO: 144511 - DNA, 75 bp, Artificial Sequence
  Synthetic
ggactgccggctccaggaatccgttccaaaggaccgagggtaggacttggagcaccggggattccaggcaaaccc

SEQ ID NO: 144512 - DNA, 75 bp, Artificial Sequence
  Synthetic
catgggccaattccgaacgaagggtcgcgcggcggaaggatcagcgaccgagagggagtagatggcaaaggggat

SEQ ID NO: 144513 - DNA, 75 bp, Artificial Sequence
  Synthetic
cgcgcggcggaaggatcagcgaccgagagggagtagatggcaaaggggattggaacgccgggaagacaactccca

SEQ ID NO: 144514 - DNA, 75 bp, Artificial Sequence
  Synthetic
agaagaaaagagaggagtcaagagacggacgaatccccccaaaacgctagagacatcctggaatgggaaagagga

SEQ ID NO: 144515 - DNA, 75 bp, Artificial Sequence
  Synthetic
cattccgaggggaccgtcccctcggtaatggcagatgggacccgagcttcccccggatcctctcttggggatcga

SEQ ID NO: 144516 - DNA, 75 bp, Artificial Sequence
  Synthetic
cggacgaatccccccaaaacgctagagacatcctggaatgggaaagaggaaggtggaaaaaaagaggaggggccc

SEQ ID NO: 144517 - DNA, 75 bp, Artificial Sequence
  Synthetic
ccccgatccgaaaggcccgacgcccaagtttggagagcactccggccgaagggttgagaacaccagagggaggaa

SEQ ID NO: 144518 - DNA, 75 bp, Artificial Sequence
  Synthetic
agtggaaggcggggaggggggggcggactctgtccctatggaaattgctggtttcccctgacgtccagtccatcc

SEQ ID NO: 144519 - DNA, 75 bp, Artificial Sequence
  Synthetic
gggctagccgtcgggtgttcctccccccgagaggggaagagtgaagcttatcccggggaactcgacttatcgtcc

SEQ ID NO: 144520 - DNA, 75 bp, Artificial Sequence
  Synthetic
ttcagaaaagaccgaggggggagcttcgaacggaggggaccagtggatccgttggaagcgctccctcccgttccg

SEQ ID NO: 144521 - DNA, 75 bp, Artificial Sequence
  Synthetic
tcgaacggaggggaccagtggatccgttggaagcgctccctcccgttccgtccgaacccacctcccccgcagggt

SEQ ID NO: 144522 - DNA, 75 bp, Artificial Sequence
  Synthetic
ccttgctgaggctcttccctccggaggatagttgcttcttcttgttctcgagggccttccttcttcggtgatccc

SEQ ID NO: 144523 - DNA, 75 bp, Artificial Sequence
  Synthetic
ggaggtggagatgccatgccgacccgaagaggaaagaaggacgcgagacgcgaacctgtgagtggaaacccgctt

SEQ ID NO: 144524 - DNA, 75 bp, Artificial Sequence
  Synthetic
ctccccttccttcccctttcttattattccgaggatgttccccagccagggattgtcctcctcgagtttcttgat

SEQ ID NO: 144525 - DNA, 75 bp, Artificial Sequence
  Synthetic
tattcactggggtcgacaactctgaggagaaaagggaggatcggatgggaaaagtaaatcctatgggaatccctg

SEQ ID NO: 144526 - DNA, 75 bp, Artificial Sequence
  Synthetic
ggtcctcctcgtcttccggatcttcctctcgaggtcctccagatctttccttgcttcgacccattttgtgagggt

SEQ ID NO: 144527 - DNA, 75 bp, Artificial Sequence
  Synthetic
cggcgagggcggcgatcctcagtgctcttactcttcacgatagaaagaggagactgctggatgccccgcccgggt

SEQ ID NO: 144528 - DNA, 75 bp, Artificial Sequence
  Synthetic
agggttgaatggagcgcaggagagggaagccaccaggagccggagacaagacacctccagaggaccccttcagcg

SEQ ID NO: 144529 - DNA, 75 bp, Artificial Sequence
  Synthetic
ggaggaaagcaaagaaagcaacggggctagccggtgaatgttccgcccaacgagaggggacgagtgaggcttatc

SEQ ID NO: 144530 - DNA, 75 bp, Artificial Sequence
  Synthetic
tccttctcgagttcctccgaccttttccttccatttacccactgctcgagaacatcttccttccccgtgcggctt

SEQ ID NO: 144531 - DNA, 75 bp, Artificial Sequence
  Synthetic
cgagaggggacgagtgaggcttatcccgaggaactcggctaatcgtccttacatagcagctccaggacccccttc

SEQ ID NO: 144532 - DNA, 75 bp, Artificial Sequence
  Synthetic
tttggggggcactctcgggccgaagggttgagtagcactcagagggagaaaccacacggagtagaacagagaaat

SEQ ID NO: 144533 - DNA, 75 bp, Artificial Sequence
  Synthetic
cctgtgagtggaaacccgccttattcactagggacgacaattctggggagaggagggtggatcagatgggaagag

SEQ ID NO: 144534 - DNA, 75 bp, Artificial Sequence
  Synthetic
ggttgagtagcactcagagggagaaaccacacggagtagaacagagaaatcacctccagaggaccccttcagcga

SEQ ID NO: 144535 - DNA, 75 bp, Artificial Sequence
  Synthetic
cccacatagcagctcccgagccccctcctaaaatgaccggaggtggagcttggagcgcgaggggacccagcggag

SEQ ID NO: 144536 - DNA, 75 bp, Artificial Sequence
  Synthetic
tggagcgcgaggggacccagcggagccatgggatgctcttcccgattccgtccatcccccaccccgagagggtcg

SEQ ID NO: 144537 - DNA, 75 bp, Artificial Sequence
  Synthetic
gggggtgatccaccaggagaaggagcggagaacccacctccagaggaccccttcagcgaacagagaagctcctcc

SEQ ID NO: 144538 - DNA, 75 bp, Artificial Sequence
  Synthetic
gaattcctttgatgttccccagccagggattttcatcctcaagtttcttgattttcttcctgatcttccggagat

SEQ ID NO: 144539 - DNA, 75 bp, Artificial Sequence
  Synthetic
ccctctcgagttcctcctgtttctttcttccatttacccactgctcgaggatctcttctcttcccccgcgatcct

SEQ ID NO: 144540 - DNA, 75 bp, Artificial Sequence
  Synthetic
tcttccatttacccactgctcgaggatctcttctcttcccccgcgatccttcttcgactcgtgccggctcatctc

SEQ ID NO: 144541 - DNA, 75 bp, Artificial Sequence
  Synthetic
tctttcccttctctcgtcttcttcggtcaacctccgaagttcctcttcctcctccctgctgagggtctttccccc

SEQ ID NO: 144542 - DNA, 75 bp, Artificial Sequence
  Synthetic
ggcaagagggggcggacctcagtgctcttactcttttctgtaaagaggagactgctggtcccgccccccaagccc

SEQ ID NO: 144543 - DNA, 75 bp, Artificial Sequence
  Synthetic
tcttactcttttctgtaaagaggagactgctggtcccgccccccaagcccgagcatgagccaatgtcacgagcga

SEQ ID NO: 144544 - DNA, 75 bp, Artificial Sequence
  Synthetic
agagttcgcagggggaaggatcagctcccgagagtggaaaatggtaaagagtgggggaatttcgatggattactc

SEQ ID NO: 144545 - DNA, 75 bp, Artificial Sequence
  Synthetic
tcccgagagtggaaaatggtaaagagtgggggaatttcgatggattactcccaagaagaaccaaggagaactcaa

SEQ ID NO: 144546 - DNA, 75 bp, Artificial Sequence
  Synthetic
gaatcggaagaatttccccataacgctggagacatcttggaaggggaaagaggaaagtggaaaagaaggggcggg

SEQ ID NO: 144547 - DNA, 75 bp, Artificial Sequence
  Synthetic
ctggagacatcttggaaggggaaagaggaaagtggaaaagaaggggcgggcctcccgatccgagggctccgactg

SEQ ID NO: 144548 - DNA, 75 bp, Artificial Sequence
  Synthetic
atgagccaattccgagcgaagggaccgccgggggagacgggtcgtcccgagagggaatcaatggcaaagatgcga

SEQ ID NO: 144549 - DNA, 75 bp, Artificial Sequence
  Synthetic
atgagccaattccgagcgaagggaccgccgggggagacgggtcgtcccgagagggtatcaatggcaaagatgcga

SEQ ID NO: 144550 - DNA, 75 bp, Artificial Sequence
  Synthetic
atgagccaattccgagcgaagggaccgccgggggagacgggtcgtcccgagagggcatcaatggcaaagatgcga

SEQ ID NO: 144551 - DNA, 75 bp, Artificial Sequence
  Synthetic
atgagccaattccgagcgaagggaccgccgggggagacgggtcgtcccgagaggggatcaatggcaaagatgcga

SEQ ID NO: 144552 - DNA, 75 bp, Artificial Sequence
  Synthetic
cgccgggggagacgggtcgtcccgagagggaatcaatggcaaagatgcgaggatcccggagaaaattctcccaag

SEQ ID NO: 144553 - DNA, 75 bp, Artificial Sequence
  Synthetic
cgccgggggagacgggtcgtcccgagagggtatcaatggcaaagatgcgaggatcccggagaaaattctcccaag

SEQ ID NO: 144554 - DNA, 75 bp, Artificial Sequence
  Synthetic
cgccgggggagacgggtcgtcccgagagggcatcaatggcaaagatgcgaggatcccggagaaaattctcccaag

SEQ ID NO: 144555 - DNA, 75 bp, Artificial Sequence
  Synthetic
cgccgggggagacgggtcgtcccgagaggggatcaatggcaaagatgcgaggatcccggagaaaattctcccaag

SEQ ID NO: 144556 - DNA, 75 bp, Artificial Sequence
  Synthetic
atggaccaagtgccgaacaaggattcgcggggaggaaagatcagcgcccgagaggggtaagtcggtaaagagcat

SEQ ID NO: 144557 - DNA, 75 bp, Artificial Sequence
  Synthetic
atggaccaagtgccgaacaaggattcgcggggaggatagatcagcgcccgagaggggtaagtcggtaaagagcat

SEQ ID NO: 144558 - DNA, 75 bp, Artificial Sequence
  Synthetic
atggaccaagtgccgaacaaggattcgcggggaggacagatcagcgcccgagaggggtaagtcggtaaagagcat

SEQ ID NO: 144559 - DNA, 75 bp, Artificial Sequence
  Synthetic
atggaccaagtgccgaacaaggattcgcggggaggagagatcagcgcccgagaggggtaagtcggtaaagagcat

SEQ ID NO: 144560 - DNA, 75 bp, Artificial Sequence
  Synthetic
atggtccaagtgccgaacaaggattcgcggggaggaaagatcagcgcccgagaggggtaagtcggtaaagagcat

SEQ ID NO: 144561 - DNA, 75 bp, Artificial Sequence
  Synthetic
atggtccaagtgccgaacaaggattcgcggggaggatagatcagcgcccgagaggggtaagtcggtaaagagcat

SEQ ID NO: 144562 - DNA, 75 bp, Artificial Sequence
  Synthetic
atggtccaagtgccgaacaaggattcgcggggaggacagatcagcgcccgagaggggtaagtcggtaaagagcat

SEQ ID NO: 144563 - DNA, 75 bp, Artificial Sequence
  Synthetic
atggtccaagtgccgaacaaggattcgcggggaggagagatcagcgcccgagaggggtaagtcggtaaagagcat

SEQ ID NO: 144564 - DNA, 75 bp, Artificial Sequence
  Synthetic
atggcccaagtgccgaacaaggattcgcggggaggaaagatcagcgcccgagaggggtaagtcggtaaagagcat

SEQ ID NO: 144565 - DNA, 75 bp, Artificial Sequence
  Synthetic
atggcccaagtgccgaacaaggattcgcggggaggatagatcagcgcccgagaggggtaagtcggtaaagagcat

SEQ ID NO: 144566 - DNA, 75 bp, Artificial Sequence
  Synthetic
atggcccaagtgccgaacaaggattcgcggggaggacagatcagcgcccgagaggggtaagtcggtaaagagcat

SEQ ID NO: 144567 - DNA, 75 bp, Artificial Sequence
  Synthetic
atggcccaagtgccgaacaaggattcgcggggaggagagatcagcgcccgagaggggtaagtcggtaaagagcat

SEQ ID NO: 144568 - DNA, 75 bp, Artificial Sequence
  Synthetic
atgggccaagtgccgaacaaggattcgcggggaggaaagatcagcgcccgagaggggtaagtcggtaaagagcat

SEQ ID NO: 144569 - DNA, 75 bp, Artificial Sequence
  Synthetic
atgggccaagtgccgaacaaggattcgcggggaggatagatcagcgcccgagaggggtaagtcggtaaagagcat

SEQ ID NO: 144570 - DNA, 75 bp, Artificial Sequence
  Synthetic
atgggccaagtgccgaacaaggattcgcggggaggacagatcagcgcccgagaggggtaagtcggtaaagagcat

SEQ ID NO: 144571 - DNA, 75 bp, Artificial Sequence
  Synthetic
atgggccaagtgccgaacaaggattcgcggggaggagagatcagcgcccgagaggggtaagtcggtaaagagcat

SEQ ID NO: 144572 - DNA, 75 bp, Artificial Sequence
  Synthetic
gagggaatcaatggcaaagatgcgaggatcccggagaaaattctcccaagagtaccaagagaaagtcaagaagag

SEQ ID NO: 144573 - DNA, 75 bp, Artificial Sequence
  Synthetic
gagggaatcaatggcaaagatgcgaggatcccggagaaaattctcccaagagtaccaagagatagtcaagaagag

SEQ ID NO: 144574 - DNA, 75 bp, Artificial Sequence
  Synthetic
gagggaatcaatggcaaagatgcgaggatcccggagaaaattctcccaagagtaccaagagacagtcaagaagag

SEQ ID NO: 144575 - DNA, 75 bp, Artificial Sequence
  Synthetic
gagggaatcaatggcaaagatgcgaggatcccggagaaaattctcccaagagtaccaagagagagtcaagaagag

SEQ ID NO: 144576 - DNA, 75 bp, Artificial Sequence
  Synthetic
gagggaatcaatggcaaagatgcgaggatcccggagaaaattctcccaagagttccaagagaaagtcaagaagag

SEQ ID NO: 144577 - DNA, 75 bp, Artificial Sequence
  Synthetic
gagggaatcaatggcaaagatgcgaggatcccggagaaaattctcccaagagttccaagagatagtcaagaagag

SEQ ID NO: 144578 - DNA, 75 bp, Artificial Sequence
  Synthetic
gagggaatcaatggcaaagatgcgaggatcccggagaaaattctcccaagagttccaagagacagtcaagaagag

SEQ ID NO: 144579 - DNA, 75 bp, Artificial Sequence
  Synthetic
gagggaatcaatggcaaagatgcgaggatcccggagaaaattctcccaagagttccaagagagagtcaagaagag

SEQ ID NO: 144580 - DNA, 75 bp, Artificial Sequence
  Synthetic
gagggaatcaatggcaaagatgcgaggatcccggagaaaattctcccaagagtcccaagagaaagtcaagaagag

SEQ ID NO: 144581 - DNA, 75 bp, Artificial Sequence
  Synthetic
gagggaatcaatggcaaagatgcgaggatcccggagaaaattctcccaagagtcccaagagatagtcaagaagag

SEQ ID NO: 144582 - DNA, 75 bp, Artificial Sequence
  Synthetic
gagggaatcaatggcaaagatgcgaggatcccggagaaaattctcccaagagtcccaagagacagtcaagaagag

SEQ ID NO: 144583 - DNA, 75 bp, Artificial Sequence
  Synthetic
gagggaatcaatggcaaagatgcgaggatcccggagaaaattctcccaagagtcccaagagagagtcaagaagag

SEQ ID NO: 144584 - DNA, 75 bp, Artificial Sequence
  Synthetic
gagggaatcaatggcaaagatgcgaggatcccggagaaaattctcccaagagtgccaagagaaagtcaagaagag

SEQ ID NO: 144585 - DNA, 75 bp, Artificial Sequence
  Synthetic
gagggaatcaatggcaaagatgcgaggatcccggagaaaattctcccaagagtgccaagagatagtcaagaagag

SEQ ID NO: 144586 - DNA, 75 bp, Artificial Sequence
  Synthetic
gagggaatcaatggcaaagatgcgaggatcccggagaaaattctcccaagagtgccaagagacagtcaagaagag

SEQ ID NO: 144587 - DNA, 75 bp, Artificial Sequence
  Synthetic
gagggaatcaatggcaaagatgcgaggatcccggagaaaattctcccaagagtgccaagagagagtcaagaagag

SEQ ID NO: 144588 - DNA, 75 bp, Artificial Sequence
  Synthetic
gagggtatcaatggcaaagatgcgaggatcccggagaaaattctcccaagagtaccaagagaaagtcaagaagag

SEQ ID NO: 144589 - DNA, 75 bp, Artificial Sequence
  Synthetic
gagggtatcaatggcaaagatgcgaggatcccggagaaaattctcccaagagtaccaagagatagtcaagaagag

SEQ ID NO: 144590 - DNA, 75 bp, Artificial Sequence
  Synthetic
gagggtatcaatggcaaagatgcgaggatcccggagaaaattctcccaagagtaccaagagacagtcaagaagag

SEQ ID NO: 144591 - DNA, 75 bp, Artificial Sequence
  Synthetic
gagggtatcaatggcaaagatgcgaggatcccggagaaaattctcccaagagtaccaagagagagtcaagaagag

SEQ ID NO: 144592 - DNA, 75 bp, Artificial Sequence
  Synthetic
gagggtatcaatggcaaagatgcgaggatcccggagaaaattctcccaagagttccaagagaaagtcaagaagag

SEQ ID NO: 144593 - DNA, 75 bp, Artificial Sequence
  Synthetic
gagggtatcaatggcaaagatgcgaggatcccggagaaaattctcccaagagttccaagagatagtcaagaagag

SEQ ID NO: 144594 - DNA, 75 bp, Artificial Sequence
  Synthetic
gagggtatcaatggcaaagatgcgaggatcccggagaaaattctcccaagagttccaagagacagtcaagaagag

SEQ ID NO: 144595 - DNA, 75 bp, Artificial Sequence
  Synthetic
gagggtatcaatggcaaagatgcgaggatcccggagaaaattctcccaagagttccaagagagagtcaagaagag

SEQ ID NO: 144596 - DNA, 75 bp, Artificial Sequence
  Synthetic
gagggtatcaatggcaaagatgcgaggatcccggagaaaattctcccaagagtcccaagagaaagtcaagaagag

SEQ ID NO: 144597 - DNA, 75 bp, Artificial Sequence
  Synthetic
gagggtatcaatggcaaagatgcgaggatcccggagaaaattctcccaagagtcccaagagatagtcaagaagag

SEQ ID NO: 144598 - DNA, 75 bp, Artificial Sequence
  Synthetic
gagggtatcaatggcaaagatgcgaggatcccggagaaaattctcccaagagtcccaagagacagtcaagaagag

SEQ ID NO: 144599 - DNA, 75 bp, Artificial Sequence
  Synthetic
gagggtatcaatggcaaagatgcgaggatcccggagaaaattctcccaagagtcccaagagagagtcaagaagag

SEQ ID NO: 144600 - DNA, 75 bp, Artificial Sequence
  Synthetic
gagggtatcaatggcaaagatgcgaggatcccggagaaaattctcccaagagtgccaagagaaagtcaagaagag

SEQ ID NO: 144601 - DNA, 75 bp, Artificial Sequence
  Synthetic
gagggtatcaatggcaaagatgcgaggatcccggagaaaattctcccaagagtgccaagagatagtcaagaagag

SEQ ID NO: 144602 - DNA, 75 bp, Artificial Sequence
  Synthetic
gagggtatcaatggcaaagatgcgaggatcccggagaaaattctcccaagagtgccaagagacagtcaagaagag

SEQ ID NO: 144603 - DNA, 75 bp, Artificial Sequence
  Synthetic
gagggtatcaatggcaaagatgcgaggatcccggagaaaattctcccaagagtgccaagagagagtcaagaagag

SEQ ID NO: 144604 - DNA, 75 bp, Artificial Sequence
  Synthetic
gagggcatcaatggcaaagatgcgaggatcccggagaaaattctcccaagagtaccaagagaaagtcaagaagag

SEQ ID NO: 144605 - DNA, 75 bp, Artificial Sequence
  Synthetic
gagggcatcaatggcaaagatgcgaggatcccggagaaaattctcccaagagtaccaagagatagtcaagaagag

SEQ ID NO: 144606 - DNA, 75 bp, Artificial Sequence
  Synthetic
gagggcatcaatggcaaagatgcgaggatcccggagaaaattctcccaagagtaccaagagacagtcaagaagag

SEQ ID NO: 144607 - DNA, 75 bp, Artificial Sequence
  Synthetic
gagggcatcaatggcaaagatgcgaggatcccggagaaaattctcccaagagtaccaagagagagtcaagaagag

SEQ ID NO: 144608 - DNA, 75 bp, Artificial Sequence
  Synthetic
gagggcatcaatggcaaagatgcgaggatcccggagaaaattctcccaagagttccaagagaaagtcaagaagag

SEQ ID NO: 144609 - DNA, 75 bp, Artificial Sequence
  Synthetic
gagggcatcaatggcaaagatgcgaggatcccggagaaaattctcccaagagttccaagagatagtcaagaagag

SEQ ID NO: 144610 - DNA, 75 bp, Artificial Sequence
  Synthetic
gagggcatcaatggcaaagatgcgaggatcccggagaaaattctcccaagagttccaagagacagtcaagaagag

SEQ ID NO: 144611 - DNA, 75 bp, Artificial Sequence
  Synthetic
gagggcatcaatggcaaagatgcgaggatcccggagaaaattctcccaagagttccaagagagagtcaagaagag

SEQ ID NO: 144612 - DNA, 75 bp, Artificial Sequence
  Synthetic
gagggcatcaatggcaaagatgcgaggatcccggagaaaattctcccaagagtcccaagagaaagtcaagaagag

SEQ ID NO: 144613 - DNA, 75 bp, Artificial Sequence
  Synthetic
gagggcatcaatggcaaagatgcgaggatcccggagaaaattctcccaagagtcccaagagatagtcaagaagag

SEQ ID NO: 144614 - DNA, 75 bp, Artificial Sequence
  Synthetic
gagggcatcaatggcaaagatgcgaggatcccggagaaaattctcccaagagtcccaagagacagtcaagaagag

SEQ ID NO: 144615 - DNA, 75 bp, Artificial Sequence
  Synthetic
gagggcatcaatggcaaagatgcgaggatcccggagaaaattctcccaagagtcccaagagagagtcaagaagag

SEQ ID NO: 144616 - DNA, 75 bp, Artificial Sequence
  Synthetic
gagggcatcaatggcaaagatgcgaggatcccggagaaaattctcccaagagtgccaagagaaagtcaagaagag

SEQ ID NO: 144617 - DNA, 75 bp, Artificial Sequence
  Synthetic
gagggcatcaatggcaaagatgcgaggatcccggagaaaattctcccaagagtgccaagagatagtcaagaagag

SEQ ID NO: 144618 - DNA, 75 bp, Artificial Sequence
  Synthetic
gagggcatcaatggcaaagatgcgaggatcccggagaaaattctcccaagagtgccaagagacagtcaagaagag

SEQ ID NO: 144619 - DNA, 75 bp, Artificial Sequence
  Synthetic
gagggcatcaatggcaaagatgcgaggatcccggagaaaattctcccaagagtgccaagagagagtcaagaagag

SEQ ID NO: 144620 - DNA, 75 bp, Artificial Sequence
  Synthetic
gaggggatcaatggcaaagatgcgaggatcccggagaaaattctcccaagagtaccaagagaaagtcaagaagag

SEQ ID NO: 144621 - DNA, 75 bp, Artificial Sequence
  Synthetic
gaggggatcaatggcaaagatgcgaggatcccggagaaaattctcccaagagtaccaagagatagtcaagaagag

SEQ ID NO: 144622 - DNA, 75 bp, Artificial Sequence
  Synthetic
gaggggatcaatggcaaagatgcgaggatcccggagaaaattctcccaagagtaccaagagacagtcaagaagag

SEQ ID NO: 144623 - DNA, 75 bp, Artificial Sequence
  Synthetic
gaggggatcaatggcaaagatgcgaggatcccggagaaaattctcccaagagtaccaagagagagtcaagaagag

SEQ ID NO: 144624 - DNA, 75 bp, Artificial Sequence
  Synthetic
gaggggatcaatggcaaagatgcgaggatcccggagaaaattctcccaagagttccaagagaaagtcaagaagag

SEQ ID NO: 144625 - DNA, 75 bp, Artificial Sequence
  Synthetic
gaggggatcaatggcaaagatgcgaggatcccggagaaaattctcccaagagttccaagagatagtcaagaagag

SEQ ID NO: 144626 - DNA, 75 bp, Artificial Sequence
  Synthetic
gaggggatcaatggcaaagatgcgaggatcccggagaaaattctcccaagagttccaagagacagtcaagaagag

SEQ ID NO: 144627 - DNA, 75 bp, Artificial Sequence
  Synthetic
gaggggatcaatggcaaagatgcgaggatcccggagaaaattctcccaagagttccaagagagagtcaagaagag

SEQ ID NO: 144628 - DNA, 75 bp, Artificial Sequence
  Synthetic
gaggggatcaatggcaaagatgcgaggatcccggagaaaattctcccaagagtcccaagagaaagtcaagaagag

SEQ ID NO: 144629 - DNA, 75 bp, Artificial Sequence
  Synthetic
gaggggatcaatggcaaagatgcgaggatcccggagaaaattctcccaagagtcccaagagatagtcaagaagag

SEQ ID NO: 144630 - DNA, 75 bp, Artificial Sequence
  Synthetic
gaggggatcaatggcaaagatgcgaggatcccggagaaaattctcccaagagtcccaagagacagtcaagaagag

SEQ ID NO: 144631 - DNA, 75 bp, Artificial Sequence
  Synthetic
gaggggatcaatggcaaagatgcgaggatcccggagaaaattctcccaagagtcccaagagagagtcaagaagag

SEQ ID NO: 144632 - DNA, 75 bp, Artificial Sequence
  Synthetic
gaggggatcaatggcaaagatgcgaggatcccggagaaaattctcccaagagtgccaagagaaagtcaagaagag

SEQ ID NO: 144633 - DNA, 75 bp, Artificial Sequence
  Synthetic
gaggggatcaatggcaaagatgcgaggatcccggagaaaattctcccaagagtgccaagagatagtcaagaagag

SEQ ID NO: 144634 - DNA, 75 bp, Artificial Sequence
  Synthetic
gaggggatcaatggcaaagatgcgaggatcccggagaaaattctcccaagagtgccaagagacagtcaagaagag

SEQ ID NO: 144635 - DNA, 75 bp, Artificial Sequence
  Synthetic
gaggggatcaatggcaaagatgcgaggatcccggagaaaattctcccaagagtgccaagagagagtcaagaagag

SEQ ID NO: 144636 - DNA, 75 bp, Artificial Sequence
  Synthetic
gaagcatccccaagacgccggggaactctcggaaggggaaagagggaaggtggaagagaaaaggaggagatcccc

SEQ ID NO: 144637 - DNA, 75 bp, Artificial Sequence
  Synthetic
gaagcatccccaagacgccggggatctctcggaaggggaaagagggaaggtggaagagaaaaggaggagatcccc

SEQ ID NO: 144638 - DNA, 75 bp, Artificial Sequence
  Synthetic
gaagcatccccaagacgccggggacctctcggaaggggaaagagggaaggtggaagagaaaaggaggagatcccc

SEQ ID NO: 144639 - DNA, 75 bp, Artificial Sequence
  Synthetic
gaagcatccccaagacgccggggagctctcggaaggggaaagagggaaggtggaagagaaaaggaggagatcccc

SEQ ID NO: 144640 - DNA, 75 bp, Artificial Sequence
  Synthetic
gaagcttccccaagacgccggggaactctcggaaggggaaagagggaaggtggaagagaaaaggaggagatcccc

SEQ ID NO: 144641 - DNA, 75 bp, Artificial Sequence
  Synthetic
gaagcttccccaagacgccggggatctctcggaaggggaaagagggaaggtggaagagaaaaggaggagatcccc

SEQ ID NO: 144642 - DNA, 75 bp, Artificial Sequence
  Synthetic
gaagcttccccaagacgccggggacctctcggaaggggaaagagggaaggtggaagagaaaaggaggagatcccc

SEQ ID NO: 144643 - DNA, 75 bp, Artificial Sequence
  Synthetic
gaagcttccccaagacgccggggagctctcggaaggggaaagagggaaggtggaagagaaaaggaggagatcccc

SEQ ID NO: 144644 - DNA, 75 bp, Artificial Sequence
  Synthetic
gaagcctccccaagacgccggggaactctcggaaggggaaagagggaaggtggaagagaaaaggaggagatcccc

SEQ ID NO: 144645 - DNA, 75 bp, Artificial Sequence
  Synthetic
gaagcctccccaagacgccggggatctctcggaaggggaaagagggaaggtggaagagaaaaggaggagatcccc

SEQ ID NO: 144646 - DNA, 75 bp, Artificial Sequence
  Synthetic
gaagcctccccaagacgccggggacctctcggaaggggaaagagggaaggtggaagagaaaaggaggagatcccc

SEQ ID NO: 144647 - DNA, 75 bp, Artificial Sequence
  Synthetic
gaagcctccccaagacgccggggagctctcggaaggggaaagagggaaggtggaagagaaaaggaggagatcccc

SEQ ID NO: 144648 - DNA, 75 bp, Artificial Sequence
  Synthetic
gaagcgtccccaagacgccggggaactctcggaaggggaaagagggaaggtggaagagaaaaggaggagatcccc

SEQ ID NO: 144649 - DNA, 75 bp, Artificial Sequence
  Synthetic
gaagcgtccccaagacgccggggatctctcggaaggggaaagagggaaggtggaagagaaaaggaggagatcccc

SEQ ID NO: 144650 - DNA, 75 bp, Artificial Sequence
  Synthetic
gaagcgtccccaagacgccggggacctctcggaaggggaaagagggaaggtggaagagaaaaggaggagatcccc

SEQ ID NO: 144651 - DNA, 75 bp, Artificial Sequence
  Synthetic
gaagcgtccccaagacgccggggagctctcggaaggggaaagagggaaggtggaagagaaaaggaggagatcccc

SEQ ID NO: 144652 - DNA, 75 bp, Artificial Sequence
  Synthetic
cagaagagcctcccgcgcggtgaggagcgagaccatagcgataggaggggatgctaggagtaggggcgaccgaag

SEQ ID NO: 144653 - DNA, 75 bp, Artificial Sequence
  Synthetic
ccccgagaggggaagagtgaggcttatcccggggaactcggcgaatcgtccccacatagcggacttccggacccc

SEQ ID NO: 144654 - DNA, 75 bp, Artificial Sequence
  Synthetic
cttcgaaagtgaccgggggtggagcttagaacggaggggagcagtgcactccgtgggatgctcatcccgattccg

SEQ ID NO: 144655 - DNA, 75 bp, Artificial Sequence
  Synthetic
cttcgaaagtgaccgggggtggagcttagaacggaggggagcagtgcactccgtgggatgctcttcccgattccg

SEQ ID NO: 144656 - DNA, 75 bp, Artificial Sequence
  Synthetic
cttcgaaagtgaccgggggtggagcttagaacggaggggagcagtgcactccgtgggatgctcctcccgattccg

SEQ ID NO: 144657 - DNA, 75 bp, Artificial Sequence
  Synthetic
cttcgaaagtgaccgggggtggagcttagaacggaggggagcagtgcactccgtgggatgctcgtcccgattccg

SEQ ID NO: 144658 - DNA, 75 bp, Artificial Sequence
  Synthetic
ccgtgggatgctcatcccgattccgtccaaccccctcccccagaaggtccccccaggaatagcagaaccccactc

SEQ ID NO: 144659 - DNA, 75 bp, Artificial Sequence
  Synthetic
ccgtgggatgctcatcccgattccgtccaaccccctcccccagaaggtccccccaggaattgcagaaccccactc

SEQ ID NO: 144660 - DNA, 75 bp, Artificial Sequence
  Synthetic
ccgtgggatgctcatcccgattccgtccaaccccctcccccagaaggtccccccaggaatcgcagaaccccactc

SEQ ID NO: 144661 - DNA, 75 bp, Artificial Sequence
  Synthetic
ccgtgggatgctcatcccgattccgtccaaccccctcccccagaaggtccccccaggaatggcagaaccccactc

SEQ ID NO: 144662 - DNA, 75 bp, Artificial Sequence
  Synthetic
ccgtgggatgctcttcccgattccgtccaaccccctcccccagaaggtccccccaggaatagcagaaccccactc

SEQ ID NO: 144663 - DNA, 75 bp, Artificial Sequence
  Synthetic
ccgtgggatgctcttcccgattccgtccaaccccctcccccagaaggtccccccaggaattgcagaaccccactc

SEQ ID NO: 144664 - DNA, 75 bp, Artificial Sequence
  Synthetic
ccgtgggatgctcttcccgattccgtccaaccccctcccccagaaggtccccccaggaatcgcagaaccccactc

SEQ ID NO: 144665 - DNA, 75 bp, Artificial Sequence
  Synthetic
ccgtgggatgctcttcccgattccgtccaaccccctcccccagaaggtccccccaggaatggcagaaccccactc

SEQ ID NO: 144666 - DNA, 75 bp, Artificial Sequence
  Synthetic
ccgtgggatgctcctcccgattccgtccaaccccctcccccagaaggtccccccaggaatagcagaaccccactc

SEQ ID NO: 144667 - DNA, 75 bp, Artificial Sequence
  Synthetic
ccgtgggatgctcctcccgattccgtccaaccccctcccccagaaggtccccccaggaattgcagaaccccactc

SEQ ID NO: 144668 - DNA, 75 bp, Artificial Sequence
  Synthetic
ccgtgggatgctcctcccgattccgtccaaccccctcccccagaaggtccccccaggaatcgcagaaccccactc

SEQ ID NO: 144669 - DNA, 75 bp, Artificial Sequence
  Synthetic
ccgtgggatgctcctcccgattccgtccaaccccctcccccagaaggtccccccaggaatggcagaaccccactc

SEQ ID NO: 144670 - DNA, 75 bp, Artificial Sequence
  Synthetic
ccgtgggatgctcgtcccgattccgtccaaccccctcccccagaaggtccccccaggaatagcagaaccccactc

SEQ ID NO: 144671 - DNA, 75 bp, Artificial Sequence
  Synthetic
ccgtgggatgctcgtcccgattccgtccaaccccctcccccagaaggtccccccaggaattgcagaaccccactc

SEQ ID NO: 144672 - DNA, 75 bp, Artificial Sequence
  Synthetic
ccgtgggatgctcgtcccgattccgtccaaccccctcccccagaaggtccccccaggaatcgcagaaccccactc

SEQ ID NO: 144673 - DNA, 75 bp, Artificial Sequence
  Synthetic
ccgtgggatgctcgtcccgattccgtccaaccccctcccccagaaggtccccccaggaatggcagaaccccactc

SEQ ID NO: 144674 - DNA, 75 bp, Artificial Sequence
  Synthetic
aggtggagatgccatgccgaccagaagaggaaagaaggacgcgaacgcaaacccgtgagtggaaatctgtttatt

SEQ ID NO: 144675 - DNA, 75 bp, Artificial Sequence
  Synthetic
aggtggagatgccatgccgaccagaagaggaaagaaggacgcgaacgcaaacccgtgagtggaaatctgtttttt

SEQ ID NO: 144676 - DNA, 75 bp, Artificial Sequence
  Synthetic
aggtggagatgccatgccgaccagaagaggaaagaaggacgcgaacgcaaacccgtgagtggaaatctgtttctt

SEQ ID NO: 144677 - DNA, 75 bp, Artificial Sequence
  Synthetic
aggtggagatgccatgccgaccagaagaggaaagaaggacgcgaacgcaaacccgtgagtggaaatctgtttgtt

SEQ ID NO: 144678 - DNA, 75 bp, Artificial Sequence
  Synthetic
aggtggagatgccatgccgacctgaagaggaaagaaggacgcgaacgcaaacccgtgagtggaaatctgtttatt

SEQ ID NO: 144679 - DNA, 75 bp, Artificial Sequence
  Synthetic
aggtggagatgccatgccgacctgaagaggaaagaaggacgcgaacgcaaacccgtgagtggaaatctgtttttt

SEQ ID NO: 144680 - DNA, 75 bp, Artificial Sequence
  Synthetic
aggtggagatgccatgccgacctgaagaggaaagaaggacgcgaacgcaaacccgtgagtggaaatctgtttctt

SEQ ID NO: 144681 - DNA, 75 bp, Artificial Sequence
  Synthetic
aggtggagatgccatgccgacctgaagaggaaagaaggacgcgaacgcaaacccgtgagtggaaatctgtttgtt

SEQ ID NO: 144682 - DNA, 75 bp, Artificial Sequence
  Synthetic
aggtggagatgccatgccgacccgaagaggaaagaaggacgcgaacgcaaacccgtgagtggaaatctgtttatt

SEQ ID NO: 144683 - DNA, 75 bp, Artificial Sequence
  Synthetic
aggtggagatgccatgccgacccgaagaggaaagaaggacgcgaacgcaaacccgtgagtggaaatctgtttttt

SEQ ID NO: 144684 - DNA, 75 bp, Artificial Sequence
  Synthetic
aggtggagatgccatgccgacccgaagaggaaagaaggacgcgaacgcaaacccgtgagtggaaatctgtttctt

SEQ ID NO: 144685 - DNA, 75 bp, Artificial Sequence
  Synthetic
aggtggagatgccatgccgacccgaagaggaaagaaggacgcgaacgcaaacccgtgagtggaaatctgtttgtt

SEQ ID NO: 144686 - DNA, 75 bp, Artificial Sequence
  Synthetic
aggtggagatgccatgccgaccggaagaggaaagaaggacgcgaacgcaaacccgtgagtggaaatctgtttatt

SEQ ID NO: 144687 - DNA, 75 bp, Artificial Sequence
  Synthetic
aggtggagatgccatgccgaccggaagaggaaagaaggacgcgaacgcaaacccgtgagtggaaatctgtttttt

SEQ ID NO: 144688 - DNA, 75 bp, Artificial Sequence
  Synthetic
aggtggagatgccatgccgaccggaagaggaaagaaggacgcgaacgcaaacccgtgagtggaaatctgtttctt

SEQ ID NO: 144689 - DNA, 75 bp, Artificial Sequence
  Synthetic
aggtggagatgccatgccgaccggaagaggaaagaaggacgcgaacgcaaacccgtgagtggaaatctgtttgtt

SEQ ID NO: 144690 - DNA, 75 bp, Artificial Sequence
  Synthetic
cactggggacgacaactctggggagaaaagggaggatcggatgggaaaagtatatcctacgggaagtgcctgttt

SEQ ID NO: 144691 - DNA, 75 bp, Artificial Sequence
  Synthetic
cactggggacgacaactctggggagaaaagggaggatcggatgggaatagtatatcctacgggaagtgcctgttt

SEQ ID NO: 144692 - DNA, 75 bp, Artificial Sequence
  Synthetic
cactggggacgacaactctggggagaaaagggaggatcggatgggaacagtatatcctacgggaagtgcctgttt

SEQ ID NO: 144693 - DNA, 75 bp, Artificial Sequence
  Synthetic
cactggggacgacaactctggggagaaaagggaggatcggatgggaagagtatatcctacgggaagtgcctgttt

SEQ ID NO: 144694 - DNA, 75 bp, Artificial Sequence
  Synthetic
tcagcgcccgagaggggtaagtcggtaaagagcattggaacgttggagatacaactcccaagaaggaattaagag

SEQ ID NO: 144695 - DNA, 75 bp, Artificial Sequence
  Synthetic
atgggcctcgtgccgaggaaggtccggagaaggaggagtcaggaccccgaagggggctccaagcaaagagtggga

SEQ ID NO: 144696 - DNA, 75 bp, Artificial Sequence
  Synthetic
ggagaaggaggagtcaggaccccgaagggggctccaagcaaagagtgggagatcctcggggaatgtctcccaaga

SEQ ID NO: 144697 - DNA, 75 bp, Artificial Sequence
  Synthetic
agggggctccaagcaaagagtgggagatcctcggggaatgtctcccaagaagaaccaggggacgacctcaagaag

SEQ ID NO: 144698 - DNA, 75 bp, Artificial Sequence
  Synthetic
tcctaagttcctcttcctcctccttgctgaggttcttgcctcccgcggagagctgcttcttcttgttctcgaggg

SEQ ID NO: 144699 - DNA, 75 bp, Artificial Sequence
  Synthetic
tccttagttcctcttcctcctccttgctgaggttcttgcctcccgcggagagctgcttcttcttgttctcgaggg

SEQ ID NO: 144700 - DNA, 75 bp, Artificial Sequence
  Synthetic
tcctcagttcctcttcctcctccttgctgaggttcttgcctcccgcggagagctgcttcttcttgttctcgaggg

SEQ ID NO: 144701 - DNA, 75 bp, Artificial Sequence
  Synthetic
tcctgagttcctcttcctcctccttgctgaggttcttgcctcccgcggagagctgcttcttcttgttctcgaggg

SEQ ID NO: 144702 - DNA, 75 bp, Artificial Sequence
  Synthetic
aggagatttcccaaacgccggtggagcatcggggaacaaggaaacaggagagggaacggtagaaaagagcagctc

SEQ ID NO: 144703 - DNA, 75 bp, Artificial Sequence
  Synthetic
aggagttttcccaaacgccggtggagcatcggggaacaaggaaacaggagagggaacggtagaaaagagcagctc

SEQ ID NO: 144704 - DNA, 75 bp, Artificial Sequence
  Synthetic
aggagctttcccaaacgccggtggagcatcggggaacaaggaaacaggagagggaacggtagaaaagagcagctc

SEQ ID NO: 144705 - DNA, 75 bp, Artificial Sequence
  Synthetic
aggaggtttcccaaacgccggtggagcatcggggaacaaggaaacaggagagggaacggtagaaaagagcagctc

SEQ ID NO: 144706 - DNA, 75 bp, Artificial Sequence
  Synthetic
agctgcttcttcttgttctcgagggccttccttcgtcggtgatcctgcctctccttgtcggtgaatcctcccctg

SEQ ID NO: 144707 - DNA, 75 bp, Artificial Sequence
  Synthetic
ccttccttcgtcggtgatcctgcctctccttgtcggtgaatcctcccctgagaggcctcttcctaggtccggagt

SEQ ID NO: 144708 - DNA, 75 bp, Artificial Sequence
  Synthetic
gcatcggggaacaaggaaacaggagagggaacggtagaaaagagcagctcctcccaatccgaggggccccggact

SEQ ID NO: 144709 - DNA, 75 bp, Artificial Sequence
  Synthetic
cctcagctctggagtcctccgccctgtgaagtcgaggttctccgcgcagggaggcagccacccggaaagaacgga

SEQ ID NO: 144710 - DNA, 75 bp, Artificial Sequence
  Synthetic
gtgaagtcgaggttctccgcgcagggaggcagccacccggaaagaacggaaaaatcacctccagaggaccccttc

SEQ ID NO: 144711 - DNA, 75 bp, Artificial Sequence
  Synthetic
aacgaacaaagaagcgagctgggacgccaggatgaggccatagcgataggaggagatgctaggagtgggcggcga

SEQ ID NO: 144712 - DNA, 75 bp, Artificial Sequence
  Synthetic
aacgaacaaagaagcgagctgggacgccaggatgaggccttagcgataggaggagatgctaggagtgggcggcga

SEQ ID NO: 144713 - DNA, 75 bp, Artificial Sequence
  Synthetic
aacgaacaaagaagcgagctgggacgccaggatgaggccctagcgataggaggagatgctaggagtgggcggcga

SEQ ID NO: 144714 - DNA, 75 bp, Artificial Sequence
  Synthetic
aacgaacaaagaagcgagctgggacgccaggatgaggccgtagcgataggaggagatgctaggagtgggcggcga

SEQ ID NO: 144715 - DNA, 75 bp, Artificial Sequence
  Synthetic
atcgaacaaagaagcgagctgggacgccaggatgaggccatagcgataggaggagatgctaggagtgggcggcga

SEQ ID NO: 144716 - DNA, 75 bp, Artificial Sequence
  Synthetic
atcgaacaaagaagcgagctgggacgccaggatgaggccttagcgataggaggagatgctaggagtgggcggcga

SEQ ID NO: 144717 - DNA, 75 bp, Artificial Sequence
  Synthetic
atcgaacaaagaagcgagctgggacgccaggatgaggccctagcgataggaggagatgctaggagtgggcggcga

SEQ ID NO: 144718 - DNA, 75 bp, Artificial Sequence
  Synthetic
atcgaacaaagaagcgagctgggacgccaggatgaggccgtagcgataggaggagatgctaggagtgggcggcga

SEQ ID NO: 144719 - DNA, 75 bp, Artificial Sequence
  Synthetic
accgaacaaagaagcgagctgggacgccaggatgaggccatagcgataggaggagatgctaggagtgggcggcga

SEQ ID NO: 144720 - DNA, 75 bp, Artificial Sequence
  Synthetic
accgaacaaagaagcgagctgggacgccaggatgaggccttagcgataggaggagatgctaggagtgggcggcga

SEQ ID NO: 144721 - DNA, 75 bp, Artificial Sequence
  Synthetic
accgaacaaagaagcgagctgggacgccaggatgaggccctagcgataggaggagatgctaggagtgggcggcga

SEQ ID NO: 144722 - DNA, 75 bp, Artificial Sequence
  Synthetic
accgaacaaagaagcgagctgggacgccaggatgaggccgtagcgataggaggagatgctaggagtgggcggcga

SEQ ID NO: 144723 - DNA, 75 bp, Artificial Sequence
  Synthetic
agcgaacaaagaagcgagctgggacgccaggatgaggccatagcgataggaggagatgctaggagtgggcggcga

SEQ ID NO: 144724 - DNA, 75 bp, Artificial Sequence
  Synthetic
agcgaacaaagaagcgagctgggacgccaggatgaggccttagcgataggaggagatgctaggagtgggcggcga

SEQ ID NO: 144725 - DNA, 75 bp, Artificial Sequence
  Synthetic
agcgaacaaagaagcgagctgggacgccaggatgaggccctagcgataggaggagatgctaggagtgggcggcga

SEQ ID NO: 144726 - DNA, 75 bp, Artificial Sequence
  Synthetic
agcgaacaaagaagcgagctgggacgccaggatgaggccgtagcgataggaggagatgctaggagtgggcggcga

SEQ ID NO: 144727 - DNA, 75 bp, Artificial Sequence
  Synthetic
ttcctttgatgttccctagccagggattgtcttcctcgagtttcttgagcttcttcttggtcctccggagctctc

SEQ ID NO: 144728 - DNA, 75 bp, Artificial Sequence
  Synthetic
gccaggatgaggccatagcgataggaggagatgctaggagtgggcggcgaccaaagcgaggagcgaaagaaagaa

SEQ ID NO: 144729 - DNA, 75 bp, Artificial Sequence
  Synthetic
gccaggatgaggccttagcgataggaggagatgctaggagtgggcggcgaccaaagcgaggagcgaaagaaagaa

SEQ ID NO: 144730 - DNA, 75 bp, Artificial Sequence
  Synthetic
gccaggatgaggccctagcgataggaggagatgctaggagtgggcggcgaccaaagcgaggagcgaaagaaagaa

SEQ ID NO: 144731 - DNA, 75 bp, Artificial Sequence
  Synthetic
gccaggatgaggccgtagcgataggaggagatgctaggagtgggcggcgaccaaagcgaggagcgaaagaaagaa

SEQ ID NO: 144732 - DNA, 75 bp, Artificial Sequence
  Synthetic
tctcgagatcctctgctttctttcttccattgacccactgctcgaggacatcctctctgccccctcggttcttct

SEQ ID NO: 144733 - DNA, 75 bp, Artificial Sequence
  Synthetic
tctcgagatcctctgctttctttcttccattgacccactgctcgaggacttcctctctgccccctcggttcttct

SEQ ID NO: 144734 - DNA, 75 bp, Artificial Sequence
  Synthetic
tctcgagatcctctgctttctttcttccattgacccactgctcgaggacctcctctctgccccctcggttcttct

SEQ ID NO: 144735 - DNA, 75 bp, Artificial Sequence
  Synthetic
tctcgagatcctctgctttctttcttccattgacccactgctcgaggacgtcctctctgccccctcggttcttct

SEQ ID NO: 144736 - DNA, 75 bp, Artificial Sequence
  Synthetic
agcaacggggctagcgagtggatgttccgcctccccggggccccgagtgaggcttatcccggggaactcggccaa

SEQ ID NO: 144737 - DNA, 75 bp, Artificial Sequence
  Synthetic
tccattgacccactgctcgaggacatcctctctgccccctcggttcttcttcgactcggaccggctcatctcgac

SEQ ID NO: 144738 - DNA, 75 bp, Artificial Sequence
  Synthetic
tccattgacccactgctcgaggacttcctctctgccccctcggttcttcttcgactcggaccggctcatctcgac

SEQ ID NO: 144739 - DNA, 75 bp, Artificial Sequence
  Synthetic
tccattgacccactgctcgaggacctcctctctgccccctcggttcttcttcgactcggaccggctcatctcgac

SEQ ID NO: 144740 - DNA, 75 bp, Artificial Sequence
  Synthetic
tccattgacccactgctcgaggacgtcctctctgccccctcggttcttcttcgactcggaccggctcatctcgac

SEQ ID NO: 144741 - DNA, 75 bp, Artificial Sequence
  Synthetic
agaggcggaggttccctcagttctcttatctttctttgaataagaggagactgctgggttccccgcccgagttcg

SEQ ID NO: 144742 - DNA, 75 bp, Artificial Sequence
  Synthetic
gccccggaatgactggttcccacggctccacttccaaaaggaggagcgggtggacttggaacatgaggggccagt

SEQ ID NO: 144743 - DNA, 75 bp, Artificial Sequence
  Synthetic
catgagccaggtccgaacgagggagcgccctggggaggaatcagaggacgagaggggatgagctggtaaagaggc

SEQ ID NO: 144744 - DNA, 75 bp, Artificial Sequence
  Synthetic
cgccctggggaggaatcagaggacgagaggggatgagctggtaaagaggcggggaacggcaagggaatttttccc

SEQ ID NO: 144745 - DNA, 75 bp, Artificial Sequence
  Synthetic
ctcccgatctccacactccttcccccctgcgggccccccaataagatggtaagaacccacccactggggtccgac

SEQ ID NO: 144746 - DNA, 75 bp, Artificial Sequence
  Synthetic
agaggggatgagctggtaaagaggcggggaacggcaagggaatttttcccaaaaaggtcaaaagagaagggcaaa

SEQ ID NO: 144747 - DNA, 75 bp, Artificial Sequence
  Synthetic
ctccacttccaaaaggaggagcgggtggacttggaacatgaggggccagtccagtccgtgggaattgccccggac

SEQ ID NO: 144748 - DNA, 75 bp, Artificial Sequence
  Synthetic
attcgaaggtttttccccaaaacgttggaaacatccggaaagggaaaaaggtaagaggaaaaaaaaagggggggc

SEQ ID NO: 144749 - DNA, 75 bp, Artificial Sequence
  Synthetic
cggcatggtcccagcctcctcgctggcgccggctgggcaacattccgaggggaccgtccctcggtaatggcgaat

SEQ ID NO: 144750 - DNA, 75 bp, Artificial Sequence
  Synthetic
tggaaacatccggaaagggaaaaaggtaagaggaaaaaaaaagggggggccccccagatccgaaagggcccaccg

SEQ ID NO: 144751 - DNA, 75 bp, Artificial Sequence
  Synthetic
ccaaatttgaaaagcaccccgggccgaagggttgagaacaccccagagggaggaacacacacggagtagaacaga

SEQ ID NO: 144752 - DNA, 75 bp, Artificial Sequence
  Synthetic
gaaatcacctccagaaggaccccttcagcgaacagaagagctctgagcggagaggagtaagtccatagcgatagg

SEQ ID NO: 144753 - DNA, 75 bp, Artificial Sequence
  Synthetic
gaactgctggtcccccctcacgtccagtccatctcccgtcctggagaagggagactcgggaacaccaagcattcg

SEQ ID NO: 144754 - DNA, 75 bp, Artificial Sequence
  Synthetic
gaactgctggtcccccctcacgtccagtccatctcccgtcctggagaagggagactcgggaacacctagcattcg

SEQ ID NO: 144755 - DNA, 75 bp, Artificial Sequence
  Synthetic
gaactgctggtcccccctcacgtccagtccatctcccgtcctggagaagggagactcgggaacacccagcattcg

SEQ ID NO: 144756 - DNA, 75 bp, Artificial Sequence
  Synthetic
gaactgctggtcccccctcacgtccagtccatctcccgtcctggagaagggagactcgggaacaccgagcattcg

SEQ ID NO: 144757 - DNA, 75 bp, Artificial Sequence
  Synthetic
gaactgctggtcccccctcacgtccagtccatctcccgtcctggagaagggagactcgggaactccaagcattcg

SEQ ID NO: 144758 - DNA, 75 bp, Artificial Sequence
  Synthetic
gaactgctggtcccccctcacgtccagtccatctcccgtcctggagaagggagactcgggaactcctagcattcg

SEQ ID NO: 144759 - DNA, 75 bp, Artificial Sequence
  Synthetic
gaactgctggtcccccctcacgtccagtccatctcccgtcctggagaagggagactcgggaactcccagcattcg

SEQ ID NO: 144760 - DNA, 75 bp, Artificial Sequence
  Synthetic
gaactgctggtcccccctcacgtccagtccatctcccgtcctggagaagggagactcgggaactccgagcattcg

SEQ ID NO: 144761 - DNA, 75 bp, Artificial Sequence
  Synthetic
gaactgctggtcccccctcacgtccagtccatctcccgtcctggagaagggagactcgggaaccccaagcattcg

SEQ ID NO: 144762 - DNA, 75 bp, Artificial Sequence
  Synthetic
gaactgctggtcccccctcacgtccagtccatctcccgtcctggagaagggagactcgggaacccctagcattcg

SEQ ID NO: 144763 - DNA, 75 bp, Artificial Sequence
  Synthetic
gaactgctggtcccccctcacgtccagtccatctcccgtcctggagaagggagactcgggaacccccagcattcg

SEQ ID NO: 144764 - DNA, 75 bp, Artificial Sequence
  Synthetic
gaactgctggtcccccctcacgtccagtccatctcccgtcctggagaagggagactcgggaaccccgagcattcg

SEQ ID NO: 144765 - DNA, 75 bp, Artificial Sequence
  Synthetic
gaactgctggtcccccctcacgtccagtccatctcccgtcctggagaagggagactcgggaacgccaagcattcg

SEQ ID NO: 144766 - DNA, 75 bp, Artificial Sequence
  Synthetic
gaactgctggtcccccctcacgtccagtccatctcccgtcctggagaagggagactcgggaacgcctagcattcg

SEQ ID NO: 144767 - DNA, 75 bp, Artificial Sequence
  Synthetic
gaactgctggtcccccctcacgtccagtccatctcccgtcctggagaagggagactcgggaacgcccagcattcg

SEQ ID NO: 144768 - DNA, 75 bp, Artificial Sequence
  Synthetic
gaactgctggtcccccctcacgtccagtccatctcccgtcctggagaagggagactcgggaacgccgagcattcg

SEQ ID NO: 144769 - DNA, 75 bp, Artificial Sequence
  Synthetic
tactcttctttccctctgctcgtcttccttggtcaacctcccgagttcctcttcttcctccttgctgaggacctt

SEQ ID NO: 144770 - DNA, 75 bp, Artificial Sequence
  Synthetic
tggagccatgggatgctcttcccgattccgtccaatccccacccccgagggtcgcccaggaatggcgggacccca

SEQ ID NO: 144771 - DNA, 75 bp, Artificial Sequence
  Synthetic
gtcgcccaggaatggcgggaccccactccactggggtccgcgttccatcctttcttacctgatggccggcatggt

SEQ ID NO: 144772 - DNA, 75 bp, Artificial Sequence
  Synthetic
ggtgatcccgtctttccctgtcggtgaagtctcccgcgcgagtcctcttcttagggccggaatcgacctccatct

SEQ ID NO: 144773 - DNA, 75 bp, Artificial Sequence
  Synthetic
cccagcctcctcgctggcgccggctgggcaacattccgaggggaccgtcccctcggtaatggcgaatgggaccca

SEQ ID NO: 144774 - DNA, 75 bp, Artificial Sequence
  Synthetic
gatcagtccggggtctcttcgagggaggcgctccctccccgtccttcccttttcttattattccgacgatgttcc

SEQ ID NO: 144775 - DNA, 75 bp, Artificial Sequence
  Synthetic
gatctgtccggggtctcttcgagggaggcgctccctccccgtccttcccttttcttattattccgacgatgttcc

SEQ ID NO: 144776 - DNA, 75 bp, Artificial Sequence
  Synthetic
gatccgtccggggtctcttcgagggaggcgctccctccccgtccttcccttttcttattattccgacgatgttcc

SEQ ID NO: 144777 - DNA, 75 bp, Artificial Sequence
  Synthetic
gatcggtccggggtctcttcgagggaggcgctccctccccgtccttcccttttcttattattccgacgatgttcc

SEQ ID NO: 144778 - DNA, 75 bp, Artificial Sequence
  Synthetic
aggcgctccctccccgtccttcccttttcttattattccgacgatgttccccagccagggattatcatcctcgag

SEQ ID NO: 144779 - DNA, 75 bp, Artificial Sequence
  Synthetic
aggcgctccctccccgtccttcccttttcttattattccgacgatgttccccagccagggattttcatcctcgag

SEQ ID NO: 144780 - DNA, 75 bp, Artificial Sequence
  Synthetic
aggcgctccctccccgtccttcccttttcttattattccgacgatgttccccagccagggattctcatcctcgag

SEQ ID NO: 144781 - DNA, 75 bp, Artificial Sequence
  Synthetic
aggcgctccctccccgtccttcccttttcttattattccgacgatgttccccagccagggattgtcatcctcgag

SEQ ID NO: 144782 - DNA, 75 bp, Artificial Sequence
  Synthetic
tttcttgatggtcctcctggccttccggagccttctctcgagatcctccgcatcttttcttgcttggacccactt

SEQ ID NO: 144783 - DNA, 75 bp, Artificial Sequence
  Synthetic
cggagccttctctcgagatcctccgcatcttttcttgcttggacccacttctcgagggtttcctctcttcctccc

SEQ ID NO: 144784 - DNA, 75 bp, Artificial Sequence
  Synthetic
ctccgagacttcttcgattcggactggctcatcttcggaaaagggggcggcggcgtctgttctcttatcttcctg

SEQ ID NO: 144785 - DNA, 75 bp, Artificial Sequence
  Synthetic
agggggcggcggcgtctgttctcttatcttcctgttgaaagaggagacagcttgccgcctgcccccagctccgag

SEQ ID NO: 144786 - DNA, 75 bp, Artificial Sequence
  Synthetic
actcggacgcgaacccgtgagtggaaccttaatcctttattggggagtacactcgaggagtggaaggcggggagg

SEQ ID NO: 144787 - DNA, 75 bp, Artificial Sequence
  Synthetic
ctccccggtccgagcgaagggggactccgggactccttgcatgctggggacgaagccgcccccgggcgctcccct

SEQ ID NO: 144788 - DNA, 75 bp, Artificial Sequence
  Synthetic
atgggccacagctccgaacgaagggaccgacggggaggaatccaccccgagaggggttacctggcaaagagcgag

SEQ ID NO: 144789 - DNA, 75 bp, Artificial Sequence
  Synthetic
accgacggggaggaatccaccccgagaggggttacctggcaaagagcgaggaaagtcgagagaaattgccctaag

SEQ ID NO: 144790 - DNA, 75 bp, Artificial Sequence
  Synthetic
gaggggttacctggcaaagagcgaggaaagtcgagagaaattgccctaagaaggtccaagagaaagtccaagaaa

SEQ ID NO: 144791 - DNA, 75 bp, Artificial Sequence
  Synthetic
ggggtcccgggtttacccacgggaactgctggtcccccctcacgtccagtccatctcccgtcctggagaagggag

SEQ ID NO: 144792 - DNA, 75 bp, Artificial Sequence
  Synthetic
gaggacctttccccataacgctgtggaaactctcggaaggggaaagaggaaggcgaagaaaaaaggggcggggcc

SEQ ID NO: 144793 - DNA, 75 bp, Artificial Sequence
  Synthetic
gaaactctcggaaggggaaagaggaaggcgaagaaaaaaggggcggggcccccgatccgaggggtccggcgcgcg

SEQ ID NO: 144794 - DNA, 75 bp, Artificial Sequence
  Synthetic
ctcgagggccttccttcgtcggtgatcctgcctctccctgtcggtgaatcctcccctgagaggcctcttcctagg

SEQ ID NO: 144795 - DNA, 75 bp, Artificial Sequence
  Synthetic
agtttttggagagaactccgggccaaatggttgagtaacacacagagggagaaagccacacggagatgagcggag

SEQ ID NO: 144796 - DNA, 75 bp, Artificial Sequence
  Synthetic
agtttttggagagaactccgggccaaatggttgagtatcacacagagggagaaagccacacggagatgagcggag

SEQ ID NO: 144797 - DNA, 75 bp, Artificial Sequence
  Synthetic
agtttttggagagaactccgggccaaatggttgagtaccacacagagggagaaagccacacggagatgagcggag

SEQ ID NO: 144798 - DNA, 75 bp, Artificial Sequence
  Synthetic
agtttttggagagaactccgggccaaatggttgagtagcacacagagggagaaagccacacggagatgagcggag

SEQ ID NO: 144799 - DNA, 75 bp, Artificial Sequence
  Synthetic
gtccgggccctcttcgccgggggagccccctctccatccttttccttctttccgagaattcctttgatgtttccc

SEQ ID NO: 144800 - DNA, 75 bp, Artificial Sequence
  Synthetic
taggagtaagaccgtagcgataggagaggatgctaggaggtaagggcgaccaaagcgaggaggaaaagtaaagag

SEQ ID NO: 144801 - DNA, 75 bp, Artificial Sequence
  Synthetic
taggagtaagaccgtagcgataggagaggatgctaggaggtatgggcgaccaaagcgaggaggaaaagtaaagag

SEQ ID NO: 144802 - DNA, 75 bp, Artificial Sequence
  Synthetic
taggagtaagaccgtagcgataggagaggatgctaggaggtacgggcgaccaaagcgaggaggaaaagtaaagag

SEQ ID NO: 144803 - DNA, 75 bp, Artificial Sequence
  Synthetic
taggagtaagaccgtagcgataggagaggatgctaggaggtaggggcgaccaaagcgaggaggaaaagtaaagag

SEQ ID NO: 144804 - DNA, 75 bp, Artificial Sequence
  Synthetic
tcttgactttcttctttgtcttccggaggtccctctcgagttcccccatcctttttcttccactcacccactgct

SEQ ID NO: 144805 - DNA, 75 bp, Artificial Sequence
  Synthetic
gatgggccccgtgccgacgaggaggccgcaggtgggaggatcagccccggtgagggacgcgatggcaagagtgga

SEQ ID NO: 144806 - DNA, 75 bp, Artificial Sequence
  Synthetic
aagatcattcgagattcaagcggtgaggagggatccccgagacgctggtggagctccgggaaaaaaagaaaaaaa

SEQ ID NO: 144807 - DNA, 75 bp, Artificial Sequence
  Synthetic
ttcagcgaacagagaggctcctcctctgcgggagtagaaccgtagcgatggggggagatgctaggagttggagga

SEQ ID NO: 144808 - DNA, 75 bp, Artificial Sequence
  Synthetic
tccccgtgtctggtgaagggggactccgggacaccttgcatgctggggacgaagccgcccccgggcgctcccctc

SEQ ID NO: 144809 - DNA, 75 bp, Artificial Sequence
  Synthetic
gccttggactctcagggagccatgggatccgtggagtacccgggccatccccttctccacactccttcccccctg

SEQ ID NO: 144810 - DNA, 75 bp, Artificial Sequence
  Synthetic
gatccgtggagtacccgggccatccccttctccacactccttcccccctgacggggcccccccataagatggcga

SEQ ID NO: 144811 - DNA, 75 bp, Artificial Sequence
  Synthetic
tcccctgtgaggcctcttcctaggtccggagtctacctccatctcgtccgtccgggccctcttcgccgggggagc

SEQ ID NO: 144812 - DNA, 75 bp, Artificial Sequence
  Synthetic
catggtcccagcctcctcgctggcgccggctgggcaacattccgaaggggaccgtccctcggtaatggcgaatgg

SEQ ID NO: 144813 - DNA, 75 bp, Artificial Sequence
  Synthetic
ctcccttagccatccgagtggacgtccgtcctccttcggatgcccaggtcggaccgcgaggaggtggagatgcca

SEQ ID NO: 144814 - DNA, 75 bp, Artificial Sequence
  Synthetic
cttgattttcttcttggtcttccggacttttctctcgagctcctctagctcttttcttccagagacccactgctc

SEQ ID NO: 144815 - DNA, 75 bp, Artificial Sequence
  Synthetic
tcctggcagagggcggcagtcctcagtgctcttactctttcctataaagaggagactgctggactcgccgcccca

SEQ ID NO: 144816 - DNA, 75 bp, Artificial Sequence
  Synthetic
actcgaggagtggaaggcggggagaggggcgcccagggtcaacctacgggaatccctgtgttcctctgatgtcca

SEQ ID NO: 144817 - DNA, 75 bp, Artificial Sequence
  Synthetic
atgagccaagtagccgagcgaagacccgcgagggggaggaatcagcaaccgagaggggatgaacaacaaggtgcg

SEQ ID NO: 144818 - DNA, 75 bp, Artificial Sequence
  Synthetic
ccgcgagggggaggaatcagcaaccgagaggggatgaacaacaaggtgcgaggaacctcggagagattactccca

SEQ ID NO: 144819 - DNA, 75 bp, Artificial Sequence
  Synthetic
agactccggaactccttccatggaggggacgaagccgccgccgggcgctcccctcggaggtccgtcgagggggtt

SEQ ID NO: 144820 - DNA, 75 bp, Artificial Sequence
  Synthetic
gagaggggatgaacaacaaggtgcgaggaacctcggagagattactcccaagaaggtaggagaagtatcagaagt

SEQ ID NO: 144821 - DNA, 75 bp, Artificial Sequence
  Synthetic
tggaagtttccccgaggacgctggaaacttctcggaatgggaaagaaggagggagaaaaagaaggggcgggcctc

SEQ ID NO: 144822 - DNA, 75 bp, Artificial Sequence
  Synthetic
aacttctcggaatgggaaagaaggagggagaaaaagaaggggcgggcctcccgatccgaggggcccgactgccag

SEQ ID NO: 144823 - DNA, 75 bp, Artificial Sequence
  Synthetic
cctccggaggagagctgcttcttcttgttctccagggccttccttcttcggtggtcccgcctctcctgttcggtg

SEQ ID NO: 144824 - DNA, 75 bp, Artificial Sequence
  Synthetic
gattggggggcactccggcccgtaaggtggaactatccccagagggaggaaaccacacggagaaaagcagagaaa

SEQ ID NO: 144825 - DNA, 75 bp, Artificial Sequence
  Synthetic
tgttctccagggccttccttcttcggtggtcccgcctctcctgttcggtgaaccctcccgggtgtttcctcttcc

SEQ ID NO: 144826 - DNA, 75 bp, Artificial Sequence
  Synthetic
tatcccggggaactcgacgaatcgtccccacatagcagaagccggaccccctccaaaaaggaccgggagcggagc

SEQ ID NO: 144827 - DNA, 75 bp, Artificial Sequence
  Synthetic
tatcccggggaactcgtcgaatcgtccccacatagcagaagccggaccccctccaaaaaggaccgggagcggagc

SEQ ID NO: 144828 - DNA, 75 bp, Artificial Sequence
  Synthetic
tatcccggggaactcgccgaatcgtccccacatagcagaagccggaccccctccaaaaaggaccgggagcggagc

SEQ ID NO: 144829 - DNA, 75 bp, Artificial Sequence
  Synthetic
tatcccggggaactcggcgaatcgtccccacatagcagaagccggaccccctccaaaaaggaccgggagcggagc

SEQ ID NO: 144830 - DNA, 75 bp, Artificial Sequence
  Synthetic
ttggagcgcggggagggccgctggagccatgggatgctccctccgattccgtccatccctcccccaggagggtcg

SEQ ID NO: 144831 - DNA, 75 bp, Artificial Sequence
  Synthetic
catcttcgacgagaggcgggcgatcccgagaactcttatcttcctgcttagaagaggagtctcctggacgccctc

SEQ ID NO: 144832 - DNA, 75 bp, Artificial Sequence
  Synthetic
catgagccaagttccgagcgaagagtccgcgggggagacggatcagaccccgagagtgagagaaccatcaaggtg

SEQ ID NO: 144833 - DNA, 75 bp, Artificial Sequence
  Synthetic
tccgcgggggagacggatcagaccccgagagtgagagaaccatcaaggtgcgaggaacctcggagacaatgctcc

SEQ ID NO: 144834 - DNA, 75 bp, Artificial Sequence
  Synthetic
cgagagtgagagaaccatcaaggtgcgaggaacctcggagacaatgctcccaagaagcaaagaagaatccaagat

SEQ ID NO: 144835 - DNA, 75 bp, Artificial Sequence
  Synthetic
tcggatgattctcccgaagacgctagaggtcatcttggaaggggaaagtggataggtggaaaagaaggaggcggg

SEQ ID NO: 144836 - DNA, 75 bp, Artificial Sequence
  Synthetic
ggtaatggcgaatgggacccagaaactctctctagattccaatagagaatcgagagaaaatctggctctccctta

SEQ ID NO: 144837 - DNA, 75 bp, Artificial Sequence
  Synthetic
gaggtcatcttggaaggggaaagtggataggtggaaaagaaggaggcgggctccccgatccgaggggcccgacca

SEQ ID NO: 144838 - DNA, 75 bp, Artificial Sequence
  Synthetic
ccaagtttggagagcacttcgggccgaagggttgagaagccttcagagggaggaagccacacagagaaagcagaa

SEQ ID NO: 144839 - DNA, 75 bp, Artificial Sequence
  Synthetic
gaagggttgagaagccttcagagggaggaagccacacagagaaagcagaaaaatcacctccagaggaccccttca

SEQ ID NO: 144840 - DNA, 75 bp, Artificial Sequence
  Synthetic
gcgaacagaagagccctggccgagcgggggtaagaccatagcgatggggggagatgctaggagtggtaggagacc

SEQ ID NO: 144841 - DNA, 75 bp, Artificial Sequence
  Synthetic
gcttatcccggggaactcggcgaatcgtccccacatagcagagtccggaccccctccaaaaaggaccgggggggg

SEQ ID NO: 144842 - DNA, 75 bp, Artificial Sequence
  Synthetic
agctcgggaacgcgggggggcccgcggagccatgggatgctcctcccgattccgcccatccccacccccgagagg

SEQ ID NO: 144843 - DNA, 75 bp, Artificial Sequence
  Synthetic
ggagccatgggatgctcctcccgattccgcccatccccacccccgagaggtcgcccaggaatggcagaccccact

SEQ ID NO: 144844 - DNA, 75 bp, Artificial Sequence
  Synthetic
ggagtctacctccatctggtccgttcgggccctcttcgccgggggagccccctcatcccccttgtctttctttcc

SEQ ID NO: 144845 - DNA, 75 bp, Artificial Sequence
  Synthetic
cgggccctcttcgccgggggagccccctcatcccccttgtctttctttccgataattcctttgatgttccccagc

SEQ ID NO: 144846 - DNA, 75 bp, Artificial Sequence
  Synthetic
caggggttttcttcctctatcttcctgattttcttcctctccttccggaggtctctctcgagctcctcagctctt

SEQ ID NO: 144847 - DNA, 75 bp, Artificial Sequence
  Synthetic
gtctctctcgagctcctcagctcttttccttgcgctcacccacttctcgagaagctcttccctccctccgcggga

SEQ ID NO: 144848 - DNA, 75 bp, Artificial Sequence
  Synthetic
cgtgtctgtggaagggggactccggaactccttgcatgctggggacgaagccgcccccgggcgctcccctctgtc

SEQ ID NO: 144849 - DNA, 75 bp, Artificial Sequence
  Synthetic
aactccttgcatgctggggacgaagccgcccccgggcgctcccctctgtccgccttcgagggggttcacacctcc

SEQ ID NO: 144850 - DNA, 75 bp, Artificial Sequence
  Synthetic
ctctctcgagctcctcagctttcttccttgagttcacccactgctcgaggacctcttcccttcccccgcgattct

SEQ ID NO: 144851 - DNA, 75 bp, Artificial Sequence
  Synthetic
cctcgggagtagagccgtagcgatgggaggggatgctaggagttgggggagaccgaagcgaggaggaaagcaaag

SEQ ID NO: 144852 - DNA, 75 bp, Artificial Sequence
  Synthetic
cccctcttctagagaagggagactccggaactccttccatggttgggacgaagccgccgccgggcgctcccctcg

SEQ ID NO: 144853 - DNA, 75 bp, Artificial Sequence
  Synthetic
aagccgccgccgggcgctcccctcggaggtccctcgagggggttcacatccccaacccgcgggccggctactctt

SEQ ID NO: 144854 - DNA, 75 bp, Artificial Sequence
  Synthetic
tcttccatcgatccacttcccgagtgtctcttctctccccctccggtttttcctctgttcggactggctcatcct

SEQ ID NO: 144855 - DNA, 75 bp, Artificial Sequence
  Synthetic
atgggccgcaaccgggcgaaagaggcgaagtggggagggggagatcccgaggaggatctccaactaaagagtgga

SEQ ID NO: 144856 - DNA, 75 bp, Artificial Sequence
  Synthetic
ggaggatctccaactaaagagtggaggaaatctcggaaagcttcccccaagaagaaccgggacagctctcaagaa

SEQ ID NO: 144857 - DNA, 75 bp, Artificial Sequence
  Synthetic
tcgagtttggagtcatccggacgaagggttgagatgacccacagtcgggtgatccaccaggagggtggaggaggg

SEQ ID NO: 144858 - DNA, 75 bp, Artificial Sequence
  Synthetic
gggttgagatgacccacagtcgggtgatccaccaggagggtggaggagggttcacctccagaggaccccttcagc

SEQ ID NO: 144859 - DNA, 75 bp, Artificial Sequence
  Synthetic
gatccaccaggagggtggaggagggttcacctccagaggaccccttcagcgaacagaagagctccctcctcctcc

SEQ ID NO: 144860 - DNA, 75 bp, Artificial Sequence
  Synthetic
gttccaccccccagctgccgagtgaggcttatcccggggatcggtgaatcgtcccgggatggggtctccgaggac

SEQ ID NO: 144861 - DNA, 75 bp, Artificial Sequence
  Synthetic
ccttccgaagcgacgggggggggtcactaggaacacgggggaccagtggatccgtgggattaccctctccaccct

SEQ ID NO: 144862 - DNA, 75 bp, Artificial Sequence
  Synthetic
actaggaacacgggggaccagtggatccgtgggattaccctctccaccctcctaacacactccttcccccctgcg

SEQ ID NO: 144863 - DNA, 75 bp, Artificial Sequence
  Synthetic
cggaacaccttccatccgagggacgaagccgccaccgggcgctcccctcggacctcctccggagaggttcacatc

SEQ ID NO: 144864 - DNA, 75 bp, Artificial Sequence
  Synthetic
ctccctgctgaggttctttcctcccgaggagagctgcttcttcttgttctcgagggccttccttctgcggtgatc

SEQ ID NO: 144865 - DNA, 75 bp, Artificial Sequence
  Synthetic
ccctccccgtccttcccttttctgattattccgatgatgttccccagccagggattttcatcctcgagtttcttg

SEQ ID NO: 144866 - DNA, 75 bp, Artificial Sequence
  Synthetic
tcttgttgtgatccatttctcgaggatgtcctccctacccccccttcgattcttcttcgactcggattggctcat

SEQ ID NO: 144867 - DNA, 75 bp, Artificial Sequence
  Synthetic
gaggcgagggtcctcagttctctctattctttccttttgaaagaggagactgctggaccaaacgcccgagccggg

SEQ ID NO: 144868 - DNA, 75 bp, Artificial Sequence
  Synthetic
tttggaaagcactccgggccgaagggttgagagcaccccagtgggggaagccactcggagttcagcagaaaaaac

SEQ ID NO: 144869 - DNA, 75 bp, Artificial Sequence
  Synthetic
gttgagagcaccccagtgggggaagccactcggagttcagcagaaaaaacacctccagaggaccccttcagcgaa

SEQ ID NO: 144870 - DNA, 75 bp, Artificial Sequence
  Synthetic
cccgagaggggacgagtgaggcttatcccggggaactcgacttatcgtccccacatagcagagcccggaccccct

SEQ ID NO: 144871 - DNA, 75 bp, Artificial Sequence
  Synthetic
ccacatagcagagcccggacccccttcaaaaatgaccgaggggggagctaggagcgtaggggggccagcggagcc

SEQ ID NO: 144872 - DNA, 75 bp, Artificial Sequence
  Synthetic
cattccgaggggaccgtcccctcggtaatggcgaatgggaccccagtccttcttcccactgagaagaaggttact

SEQ ID NO: 144873 - DNA, 75 bp, Artificial Sequence
  Synthetic
gtccagcccctccccgtgtctgtggaagggggactccggaactccttgcatgctggggacgaagccgcccccggg

SEQ ID NO: 144874 - DNA, 75 bp, Artificial Sequence
  Synthetic
aagggggactccggaactccttgcatgctggggacgaagccgcccccgggcgctcccctcgttccaccttcgagg

SEQ ID NO: 144875 - DNA, 75 bp, Artificial Sequence
  Synthetic
cggctactcttctttcccttctctcgtcttcctcggtcaacctcttgagttcctcttcttcttccttgctcaggc

SEQ ID NO: 144876 - DNA, 75 bp, Artificial Sequence
  Synthetic
gtcttcctcggtcaacctcttgagttcctcttcttcttccttgctcaggctcttccctcctccagatagttgctt

SEQ ID NO: 144877 - DNA, 75 bp, Artificial Sequence
  Synthetic
cttcttgttctcgagggccttccttcgtcggtgttcctgcctctccttgtcggtgaaatcccccctggagggtct

SEQ ID NO: 144878 - DNA, 75 bp, Artificial Sequence
  Synthetic
cttcctaggtccggagtctatctccatctggtccgtccgggccctcttcgccgggggtgccccctctccatcctt

SEQ ID NO: 144879 - DNA, 75 bp, Artificial Sequence
  Synthetic
atccttctttccgagaattcctttgatgtttcccagccagggattgtcgtcctcaagtttcttgattttcttctt

SEQ ID NO: 144880 - DNA, 75 bp, Artificial Sequence
  Synthetic
gaccggctcatcttcgacgaagggcggggatcctcagtgctcttactcttttctttagaaagaggagactgctgg

SEQ ID NO: 144881 - DNA, 75 bp, Artificial Sequence
  Synthetic
ggggatcctcagtgctcttactcttttctttagaaagaggagactgctggactctccgcccaagttcgagatggg

SEQ ID NO: 144882 - DNA, 75 bp, Artificial Sequence
  Synthetic
ccatagttccgaacgaggattccgcgagtggaaggatcagcgcccgagagggagtgacggcaaagagcattggaa

SEQ ID NO: 144883 - DNA, 75 bp, Artificial Sequence
  Synthetic
gagtggaaggatcagcgcccgagagggagtgacggcaaagagcattggaacgccgaagggatgactcccaagaag

SEQ ID NO: 144884 - DNA, 75 bp, Artificial Sequence
  Synthetic
gaaaaagagaattcaagagacgggcgactctccccataacgctggagacatcctggaaggggaaagaggatgggt

SEQ ID NO: 144885 - DNA, 75 bp, Artificial Sequence
  Synthetic
catcctggaaggggaaagaggatgggtggaagagaaggaggcgggccccccgatccgaggggcccggcggccaag

SEQ ID NO: 144886 - DNA, 75 bp, Artificial Sequence
  Synthetic
ttgagccaattgccgaacgaggatgacgcgaaaggaagagttcagaggacaagggggatgagatggtaaagaggc

SEQ ID NO: 144887 - DNA, 75 bp, Artificial Sequence
  Synthetic
ttgagccaattgccgaacgaggatgacgcgataggaagagttcagaggacaagggggatgagatggtaaagaggc

SEQ ID NO: 144888 - DNA, 75 bp, Artificial Sequence
  Synthetic
ttgagccaattgccgaacgaggatgacgcgacaggaagagttcagaggacaagggggatgagatggtaaagaggc

SEQ ID NO: 144889 - DNA, 75 bp, Artificial Sequence
  Synthetic
ttgagccaattgccgaacgaggatgacgcgagaggaagagttcagaggacaagggggatgagatggtaaagaggc

SEQ ID NO: 144890 - DNA, 75 bp, Artificial Sequence
  Synthetic
acgcgaaaggaagagttcagaggacaagggggatgagatggtaaagaggcgagaaacgccgaggggatgcctccc

SEQ ID NO: 144891 - DNA, 75 bp, Artificial Sequence
  Synthetic
acgcgataggaagagttcagaggacaagggggatgagatggtaaagaggcgagaaacgccgaggggatgcctccc

SEQ ID NO: 144892 - DNA, 75 bp, Artificial Sequence
  Synthetic
acgcgacaggaagagttcagaggacaagggggatgagatggtaaagaggcgagaaacgccgaggggatgcctccc

SEQ ID NO: 144893 - DNA, 75 bp, Artificial Sequence
  Synthetic
acgcgagaggaagagttcagaggacaagggggatgagatggtaaagaggcgagaaacgccgaggggatgcctccc

SEQ ID NO: 144894 - DNA, 75 bp, Artificial Sequence
  Synthetic
aagggggatgagatggtaaagaggcgagaaacgccgaggggatgcctcccaagagggcaaagagaaggcaagaat

SEQ ID NO: 144895 - DNA, 75 bp, Artificial Sequence
  Synthetic
cggacgacttccccatgacgccggagtcatcatggaaggggaaagaggaaaggcggaagagaagggggggcctcc

SEQ ID NO: 144896 - DNA, 75 bp, Artificial Sequence
  Synthetic
cgatccgaggggcccaaccaccgaggtttggaggcacttctggccgaagggttgagtagcactcagagggaggaa

SEQ ID NO: 144897 - DNA, 75 bp, Artificial Sequence
  Synthetic
ctaggatcgtggggagaccagcggagccatgggatgctcttcccgattcccgtccatccctaccccccgagggtc

SEQ ID NO: 144898 - DNA, 75 bp, Artificial Sequence
  Synthetic
ctaggatcgtggggtgaccagcggagccatgggatgctcttcccgattcccgtccatccctaccccccgagggtc

SEQ ID NO: 144899 - DNA, 75 bp, Artificial Sequence
  Synthetic
ctaggatcgtggggcgaccagcggagccatgggatgctcttcccgattcccgtccatccctaccccccgagggtc

SEQ ID NO: 144900 - DNA, 75 bp, Artificial Sequence
  Synthetic
ctaggatcgtggggggaccagcggagccatgggatgctcttcccgattcccgtccatccctaccccccgagggtc

SEQ ID NO: 144901 - DNA, 75 bp, Artificial Sequence
  Synthetic
ctcgacaagaggcggcgttcctcagtactctcaatcttcttcagaaagaggagactgctggattcgccgccccag

SEQ ID NO: 144902 - DNA, 75 bp, Artificial Sequence
  Synthetic
catgggccatctccgagcgaagggggcgcgctggaagggtcggctcccgagaggggataaacggtaaagagcgtt

SEQ ID NO: 144903 - DNA, 75 bp, Artificial Sequence
  Synthetic
gcgcgctggaagggtcggctcccgagaggggataaacggtaaagagcgttggatctctgagggtagaaccccaag

SEQ ID NO: 144904 - DNA, 75 bp, Artificial Sequence
  Synthetic
aagaaaaaaagagaaagcaagagacggacgatttccccatgacgctggagacatcctggaaggggaaagagggaa

SEQ ID NO: 144905 - DNA, 75 bp, Artificial Sequence
  Synthetic
ggacgatttccccatgacgctggagacatcctggaaggggaaagagggaaggtggaaaagaaggggcgggcctcc

SEQ ID NO: 144906 - DNA, 75 bp, Artificial Sequence
  Synthetic
gagaggggacgagtgaggcttatcccggggaactcggcgaatcgtccccacatagcagctcccggagccccttcc

SEQ ID NO: 144907 - DNA, 75 bp, Artificial Sequence
  Synthetic
catagcagctcccggagccccttccaaaatgaccgaggggggtggctaggaacgcgggggaccagtggagccatg

SEQ ID NO: 144908 - DNA, 75 bp, Artificial Sequence
  Synthetic
gggtccgcgttccatcctttcttacctgatggccggcatggtcccagcctcctcgctggcgccggctgggcaaca

SEQ ID NO: 144909 - DNA, 75 bp, Artificial Sequence
  Synthetic
catccttatccttctttccgagaattcctttgatgtttcccagccagggattttcgtcctcaagtttcttgattt

SEQ ID NO: 144910 - DNA, 75 bp, Artificial Sequence
  Synthetic
cgactcggaacggctcatctcgacaagaggcggcggtcctcagtgctcttactcttttctgtaaagaggagactg

SEQ ID NO: 144911 - DNA, 75 bp, Artificial Sequence
  Synthetic
atcgcgggggaaggatcagctcccgagaggggatggacggtaaagagcattggaacgccgaggagatgtctccca

SEQ ID NO: 144912 - DNA, 75 bp, Artificial Sequence
  Synthetic
tggaacgccgaggagatgtctcccaagagggaaaagagaattcaagattcggagggtctccccataacgctggag

SEQ ID NO: 144913 - DNA, 75 bp, Artificial Sequence
  Synthetic
tggaacgccgaggagatgtctcccaagagggaaaagagaattcaagattcggagggtctccccattacgctggag

SEQ ID NO: 144914 - DNA, 75 bp, Artificial Sequence
  Synthetic
tggaacgccgaggagatgtctcccaagagggaaaagagaattcaagattcggagggtctccccatcacgctggag

SEQ ID NO: 144915 - DNA, 75 bp, Artificial Sequence
  Synthetic
tggaacgccgaggagatgtctcccaagagggaaaagagaattcaagattcggagggtctccccatgacgctggag

SEQ ID NO: 144916 - DNA, 75 bp, Artificial Sequence
  Synthetic
acatcttggaaggggaaagaggtcggatggaagagaggaggcgggctctccgattcgaggggcccggcgcccaag

SEQ ID NO: 144917 - DNA, 75 bp, Artificial Sequence
  Synthetic
cgattcgaggggcccggcgcccaagtttggagagcactccgggccgaagggttgagtagcacccagagggaggaa

SEQ ID NO: 144918 - DNA, 75 bp, Artificial Sequence
  Synthetic
acagaagagcgctggacgcgataggagtaagaccatagcgatggggggagatgctgggagttagaggagaccgaa

SEQ ID NO: 144919 - DNA, 75 bp, Artificial Sequence
  Synthetic
agtaagaccatagcgatggggggagatgctgggagttagaggagaccgaagcgaggagaaagcaaagaaagcagc

SEQ ID NO: 144920 - DNA, 75 bp, Artificial Sequence
  Synthetic
agtaagaccatagcgatggggggagatgctgggagttagaggagaccgaagcgaggagaaagcaaagaatgcagc

SEQ ID NO: 144921 - DNA, 75 bp, Artificial Sequence
  Synthetic
agtaagaccatagcgatggggggagatgctgggagttagaggagaccgaagcgaggagaaagcaaagaacgcagc

SEQ ID NO: 144922 - DNA, 75 bp, Artificial Sequence
  Synthetic
agtaagaccatagcgatggggggagatgctgggagttagaggagaccgaagcgaggagaaagcaaagaaggcagc

SEQ ID NO: 144923 - DNA, 75 bp, Artificial Sequence
  Synthetic
cccgagaggggacgagtgaggcttatcccggggaactcgacttatcgtccccacatagcagagccccggaccccc

SEQ ID NO: 144924 - DNA, 75 bp, Artificial Sequence
  Synthetic
ccacatagcagagccccggacccccttccaaagtgaccgggggggtcgcttggaacccaagggaatctctggagc

SEQ ID NO: 144925 - DNA, 75 bp, Artificial Sequence
  Synthetic
cattccgaggggaccgtcccctcagtaatggcgaatgggaccccagatttccttccgattgcgaaggaaattact

SEQ ID NO: 144926 - DNA, 75 bp, Artificial Sequence
  Synthetic
cattccgaggggaccgtcccctctgtaatggcgaatgggaccccagatttccttccgattgcgaaggaaattact

SEQ ID NO: 144927 - DNA, 75 bp, Artificial Sequence
  Synthetic
cattccgaggggaccgtcccctccgtaatggcgaatgggaccccagatttccttccgattgcgaaggaaattact

SEQ ID NO: 144928 - DNA, 75 bp, Artificial Sequence
  Synthetic
cattccgaggggaccgtcccctcggtaatggcgaatgggaccccagatttccttccgattgcgaaggaaattact

SEQ ID NO: 144929 - DNA, 75 bp, Artificial Sequence
  Synthetic
ggcactcccttagccatccgagttggacgttcgtcctccttcggatgcccaggtcggaccgcgaggaggtggaga

SEQ ID NO: 144930 - DNA, 75 bp, Artificial Sequence
  Synthetic
gtcgacaactctggggagaaaagggaggatcggatgggaggagtatatcacatgggaatccgaggtttcctcttg

SEQ ID NO: 144931 - DNA, 75 bp, Artificial Sequence
  Synthetic
gtcgacaactctggggagaaaagggaggatcggatgggaggagtatatcacatgggaatccgtggtttcctcttg

SEQ ID NO: 144932 - DNA, 75 bp, Artificial Sequence
  Synthetic
gtcgacaactctggggagaaaagggaggatcggatgggaggagtatatcacatgggaatccgcggtttcctcttg

SEQ ID NO: 144933 - DNA, 75 bp, Artificial Sequence
  Synthetic
gtcgacaactctggggagaaaagggaggatcggatgggaggagtatatcacatgggaatccggggtttcctcttg

SEQ ID NO: 144934 - DNA, 75 bp, Artificial Sequence
  Synthetic
gtcgacaactctggggagaaaagggaggatcggatgggaggagtatatctcatgggaatccgaggtttcctcttg

SEQ ID NO: 144935 - DNA, 75 bp, Artificial Sequence
  Synthetic
gtcgacaactctggggagaaaagggaggatcggatgggaggagtatatctcatgggaatccgtggtttcctcttg

SEQ ID NO: 144936 - DNA, 75 bp, Artificial Sequence
  Synthetic
gtcgacaactctggggagaaaagggaggatcggatgggaggagtatatctcatgggaatccgcggtttcctcttg

SEQ ID NO: 144937 - DNA, 75 bp, Artificial Sequence
  Synthetic
gtcgacaactctggggagaaaagggaggatcggatgggaggagtatatctcatgggaatccggggtttcctcttg

SEQ ID NO: 144938 - DNA, 75 bp, Artificial Sequence
  Synthetic
gtcgacaactctggggagaaaagggaggatcggatgggaggagtatatcccatgggaatccgaggtttcctcttg

SEQ ID NO: 144939 - DNA, 75 bp, Artificial Sequence
  Synthetic
gtcgacaactctggggagaaaagggaggatcggatgggaggagtatatcccatgggaatccgtggtttcctcttg

SEQ ID NO: 144940 - DNA, 75 bp, Artificial Sequence
  Synthetic
gtcgacaactctggggagaaaagggaggatcggatgggaggagtatatcccatgggaatccgcggtttcctcttg

SEQ ID NO: 144941 - DNA, 75 bp, Artificial Sequence
  Synthetic
gtcgacaactctggggagaaaagggaggatcggatgggaggagtatatcccatgggaatccggggtttcctcttg

SEQ ID NO: 144942 - DNA, 75 bp, Artificial Sequence
  Synthetic
gtcgacaactctggggagaaaagggaggatcggatgggaggagtatatcgcatgggaatccgaggtttcctcttg

SEQ ID NO: 144943 - DNA, 75 bp, Artificial Sequence
  Synthetic
gtcgacaactctggggagaaaagggaggatcggatgggaggagtatatcgcatgggaatccgtggtttcctcttg

SEQ ID NO: 144944 - DNA, 75 bp, Artificial Sequence
  Synthetic
gtcgacaactctggggagaaaagggaggatcggatgggaggagtatatcgcatgggaatccgcggtttcctcttg

SEQ ID NO: 144945 - DNA, 75 bp, Artificial Sequence
  Synthetic
gtcgacaactctggggagaaaagggaggatcggatgggaggagtatatcgcatgggaatccggggtttcctcttg

SEQ ID NO: 144946 - DNA, 75 bp, Artificial Sequence
  Synthetic
tgaccatccggaggtctctctcgagttcctctcacttctttcttccgttcaccctctgctcgagcaactcttctc

SEQ ID NO: 144947 - DNA, 75 bp, Artificial Sequence
  Synthetic
tgaccatccggaggtctctctcgagttcctctcacttctttcttccgttcaccctctgctcgagcatctcttctc

SEQ ID NO: 144948 - DNA, 75 bp, Artificial Sequence
  Synthetic
tgaccatccggaggtctctctcgagttcctctcacttctttcttccgttcaccctctgctcgagcacctcttctc

SEQ ID NO: 144949 - DNA, 75 bp, Artificial Sequence
  Synthetic
tgaccatccggaggtctctctcgagttcctctcacttctttcttccgttcaccctctgctcgagcagctcttctc

SEQ ID NO: 144950 - DNA, 75 bp, Artificial Sequence
  Synthetic
tgaccatccggaggtctctctcgtgttcctctcacttctttcttccgttcaccctctgctcgagcaactcttctc

SEQ ID NO: 144951 - DNA, 75 bp, Artificial Sequence
  Synthetic
tgaccatccggaggtctctctcgtgttcctctcacttctttcttccgttcaccctctgctcgagcatctcttctc

SEQ ID NO: 144952 - DNA, 75 bp, Artificial Sequence
  Synthetic
tgaccatccggaggtctctctcgtgttcctctcacttctttcttccgttcaccctctgctcgagcacctcttctc

SEQ ID NO: 144953 - DNA, 75 bp, Artificial Sequence
  Synthetic
tgaccatccggaggtctctctcgtgttcctctcacttctttcttccgttcaccctctgctcgagcagctcttctc

SEQ ID NO: 144954 - DNA, 75 bp, Artificial Sequence
  Synthetic
tgaccatccggaggtctctctcgcgttcctctcacttctttcttccgttcaccctctgctcgagcaactcttctc

SEQ ID NO: 144955 - DNA, 75 bp, Artificial Sequence
  Synthetic
tgaccatccggaggtctctctcgcgttcctctcacttctttcttccgttcaccctctgctcgagcatctcttctc

SEQ ID NO: 144956 - DNA, 75 bp, Artificial Sequence
  Synthetic
tgaccatccggaggtctctctcgcgttcctctcacttctttcttccgttcaccctctgctcgagcacctcttctc

SEQ ID NO: 144957 - DNA, 75 bp, Artificial Sequence
  Synthetic
tgaccatccggaggtctctctcgcgttcctctcacttctttcttccgttcaccctctgctcgagcagctcttctc

SEQ ID NO: 144958 - DNA, 75 bp, Artificial Sequence
  Synthetic
tgaccatccggaggtctctctcgggttcctctcacttctttcttccgttcaccctctgctcgagcaactcttctc

SEQ ID NO: 144959 - DNA, 75 bp, Artificial Sequence
  Synthetic
tgaccatccggaggtctctctcgggttcctctcacttctttcttccgttcaccctctgctcgagcatctcttctc

SEQ ID NO: 144960 - DNA, 75 bp, Artificial Sequence
  Synthetic
tgaccatccggaggtctctctcgggttcctctcacttctttcttccgttcaccctctgctcgagcacctcttctc

SEQ ID NO: 144961 - DNA, 75 bp, Artificial Sequence
  Synthetic
tgaccatccggaggtctctctcgggttcctctcacttctttcttccgttcaccctctgctcgagcagctcttctc

SEQ ID NO: 144962 - DNA, 75 bp, Artificial Sequence
  Synthetic
tgaccttccggaggtctctctcgagttcctctcacttctttcttccgttcaccctctgctcgagcaactcttctc

SEQ ID NO: 144963 - DNA, 75 bp, Artificial Sequence
  Synthetic
tgaccttccggaggtctctctcgagttcctctcacttctttcttccgttcaccctctgctcgagcatctcttctc

SEQ ID NO: 144964 - DNA, 75 bp, Artificial Sequence
  Synthetic
tgaccttccggaggtctctctcgagttcctctcacttctttcttccgttcaccctctgctcgagcacctcttctc

SEQ ID NO: 144965 - DNA, 75 bp, Artificial Sequence
  Synthetic
tgaccttccggaggtctctctcgagttcctctcacttctttcttccgttcaccctctgctcgagcagctcttctc

SEQ ID NO: 144966 - DNA, 75 bp, Artificial Sequence
  Synthetic
tgaccttccggaggtctctctcgtgttcctctcacttctttcttccgttcaccctctgctcgagcaactcttctc

SEQ ID NO: 144967 - DNA, 75 bp, Artificial Sequence
  Synthetic
tgaccttccggaggtctctctcgtgttcctctcacttctttcttccgttcaccctctgctcgagcatctcttctc

SEQ ID NO: 144968 - DNA, 75 bp, Artificial Sequence
  Synthetic
tgaccttccggaggtctctctcgtgttcctctcacttctttcttccgttcaccctctgctcgagcacctcttctc

SEQ ID NO: 144969 - DNA, 75 bp, Artificial Sequence
  Synthetic
tgaccttccggaggtctctctcgtgttcctctcacttctttcttccgttcaccctctgctcgagcagctcttctc

SEQ ID NO: 144970 - DNA, 75 bp, Artificial Sequence
  Synthetic
tgaccttccggaggtctctctcgcgttcctctcacttctttcttccgttcaccctctgctcgagcaactcttctc

SEQ ID NO: 144971 - DNA, 75 bp, Artificial Sequence
  Synthetic
tgaccttccggaggtctctctcgcgttcctctcacttctttcttccgttcaccctctgctcgagcatctcttctc

SEQ ID NO: 144972 - DNA, 75 bp, Artificial Sequence
  Synthetic
tgaccttccggaggtctctctcgcgttcctctcacttctttcttccgttcaccctctgctcgagcacctcttctc

SEQ ID NO: 144973 - DNA, 75 bp, Artificial Sequence
  Synthetic
tgaccttccggaggtctctctcgcgttcctctcacttctttcttccgttcaccctctgctcgagcagctcttctc

SEQ ID NO: 144974 - DNA, 75 bp, Artificial Sequence
  Synthetic
tgaccttccggaggtctctctcgggttcctctcacttctttcttccgttcaccctctgctcgagcaactcttctc

SEQ ID NO: 144975 - DNA, 75 bp, Artificial Sequence
  Synthetic
tgaccttccggaggtctctctcgggttcctctcacttctttcttccgttcaccctctgctcgagcatctcttctc

SEQ ID NO: 144976 - DNA, 75 bp, Artificial Sequence
  Synthetic
tgaccttccggaggtctctctcgggttcctctcacttctttcttccgttcaccctctgctcgagcacctcttctc

SEQ ID NO: 144977 - DNA, 75 bp, Artificial Sequence
  Synthetic
tgaccttccggaggtctctctcgggttcctctcacttctttcttccgttcaccctctgctcgagcagctcttctc

SEQ ID NO: 144978 - DNA, 75 bp, Artificial Sequence
  Synthetic
tgaccctccggaggtctctctcgagttcctctcacttctttcttccgttcaccctctgctcgagcaactcttctc

SEQ ID NO: 144979 - DNA, 75 bp, Artificial Sequence
  Synthetic
tgaccctccggaggtctctctcgagttcctctcacttctttcttccgttcaccctctgctcgagcatctcttctc

SEQ ID NO: 144980 - DNA, 75 bp, Artificial Sequence
  Synthetic
tgaccctccggaggtctctctcgagttcctctcacttctttcttccgttcaccctctgctcgagcacctcttctc

SEQ ID NO: 144981 - DNA, 75 bp, Artificial Sequence
  Synthetic
tgaccctccggaggtctctctcgagttcctctcacttctttcttccgttcaccctctgctcgagcagctcttctc

SEQ ID NO: 144982 - DNA, 75 bp, Artificial Sequence
  Synthetic
tgaccctccggaggtctctctcgtgttcctctcacttctttcttccgttcaccctctgctcgagcaactcttctc

SEQ ID NO: 144983 - DNA, 75 bp, Artificial Sequence
  Synthetic
tgaccctccggaggtctctctcgtgttcctctcacttctttcttccgttcaccctctgctcgagcatctcttctc

SEQ ID NO: 144984 - DNA, 75 bp, Artificial Sequence
  Synthetic
tgaccctccggaggtctctctcgtgttcctctcacttctttcttccgttcaccctctgctcgagcacctcttctc

SEQ ID NO: 144985 - DNA, 75 bp, Artificial Sequence
  Synthetic
tgaccctccggaggtctctctcgtgttcctctcacttctttcttccgttcaccctctgctcgagcagctcttctc

SEQ ID NO: 144986 - DNA, 75 bp, Artificial Sequence
  Synthetic
tgaccctccggaggtctctctcgcgttcctctcacttctttcttccgttcaccctctgctcgagcaactcttctc

SEQ ID NO: 144987 - DNA, 75 bp, Artificial Sequence
  Synthetic
tgaccctccggaggtctctctcgcgttcctctcacttctttcttccgttcaccctctgctcgagcatctcttctc

SEQ ID NO: 144988 - DNA, 75 bp, Artificial Sequence
  Synthetic
tgaccctccggaggtctctctcgcgttcctctcacttctttcttccgttcaccctctgctcgagcacctcttctc

SEQ ID NO: 144989 - DNA, 75 bp, Artificial Sequence
  Synthetic
tgaccctccggaggtctctctcgcgttcctctcacttctttcttccgttcaccctctgctcgagcagctcttctc

SEQ ID NO: 144990 - DNA, 75 bp, Artificial Sequence
  Synthetic
tgaccctccggaggtctctctcgggttcctctcacttctttcttccgttcaccctctgctcgagcaactcttctc

SEQ ID NO: 144991 - DNA, 75 bp, Artificial Sequence
  Synthetic
tgaccctccggaggtctctctcgggttcctctcacttctttcttccgttcaccctctgctcgagcatctcttctc

SEQ ID NO: 144992 - DNA, 75 bp, Artificial Sequence
  Synthetic
tgaccctccggaggtctctctcgggttcctctcacttctttcttccgttcaccctctgctcgagcacctcttctc

SEQ ID NO: 144993 - DNA, 75 bp, Artificial Sequence
  Synthetic
tgaccctccggaggtctctctcgggttcctctcacttctttcttccgttcaccctctgctcgagcagctcttctc

SEQ ID NO: 144994 - DNA, 75 bp, Artificial Sequence
  Synthetic
tgaccgtccggaggtctctctcgagttcctctcacttctttcttccgttcaccctctgctcgagcaactcttctc

SEQ ID NO: 144995 - DNA, 75 bp, Artificial Sequence
  Synthetic
tgaccgtccggaggtctctctcgagttcctctcacttctttcttccgttcaccctctgctcgagcatctcttctc

SEQ ID NO: 144996 - DNA, 75 bp, Artificial Sequence
  Synthetic
tgaccgtccggaggtctctctcgagttcctctcacttctttcttccgttcaccctctgctcgagcacctcttctc

SEQ ID NO: 144997 - DNA, 75 bp, Artificial Sequence
  Synthetic
tgaccgtccggaggtctctctcgagttcctctcacttctttcttccgttcaccctctgctcgagcagctcttctc

SEQ ID NO: 144998 - DNA, 75 bp, Artificial Sequence
  Synthetic
tgaccgtccggaggtctctctcgtgttcctctcacttctttcttccgttcaccctctgctcgagcaactcttctc

SEQ ID NO: 144999 - DNA, 75 bp, Artificial Sequence
  Synthetic
tgaccgtccggaggtctctctcgtgttcctctcacttctttcttccgttcaccctctgctcgagcatctcttctc

SEQ ID NO: 145000 - DNA, 75 bp, Artificial Sequence
  Synthetic
tgaccgtccggaggtctctctcgtgttcctctcacttctttcttccgttcaccctctgctcgagcacctcttctc

SEQ ID NO: 145001 - DNA, 75 bp, Artificial Sequence
  Synthetic
tgaccgtccggaggtctctctcgtgttcctctcacttctttcttccgttcaccctctgctcgagcagctcttctc

SEQ ID NO: 145002 - DNA, 75 bp, Artificial Sequence
  Synthetic
tgaccgtccggaggtctctctcgcgttcctctcacttctttcttccgttcaccctctgctcgagcaactcttctc

SEQ ID NO: 145003 - DNA, 75 bp, Artificial Sequence
  Synthetic
tgaccgtccggaggtctctctcgcgttcctctcacttctttcttccgttcaccctctgctcgagcatctcttctc

SEQ ID NO: 145004 - DNA, 75 bp, Artificial Sequence
  Synthetic
tgaccgtccggaggtctctctcgcgttcctctcacttctttcttccgttcaccctctgctcgagcacctcttctc

SEQ ID NO: 145005 - DNA, 75 bp, Artificial Sequence
  Synthetic
tgaccgtccggaggtctctctcgcgttcctctcacttctttcttccgttcaccctctgctcgagcagctcttctc

SEQ ID NO: 145006 - DNA, 75 bp, Artificial Sequence
  Synthetic
tgaccgtccggaggtctctctcgggttcctctcacttctttcttccgttcaccctctgctcgagcaactcttctc

SEQ ID NO: 145007 - DNA, 75 bp, Artificial Sequence
  Synthetic
tgaccgtccggaggtctctctcgggttcctctcacttctttcttccgttcaccctctgctcgagcatctcttctc

SEQ ID NO: 145008 - DNA, 75 bp, Artificial Sequence
  Synthetic
tgaccgtccggaggtctctctcgggttcctctcacttctttcttccgttcaccctctgctcgagcacctcttctc

SEQ ID NO: 145009 - DNA, 75 bp, Artificial Sequence
  Synthetic
tgaccgtccggaggtctctctcgggttcctctcacttctttcttccgttcaccctctgctcgagcagctcttctc

SEQ ID NO: 145010 - DNA, 75 bp, Artificial Sequence
  Synthetic
ttcctctaacttctttcttccgttcaccctctgctcgagaaactcttctcttcctccgcggttcttcttcgactc

SEQ ID NO: 145011 - DNA, 75 bp, Artificial Sequence
  Synthetic
ttcctctaacttctttcttccgttcaccctctgctcgagaatctcttctcttcctccgcggttcttcttcgactc

SEQ ID NO: 145012 - DNA, 75 bp, Artificial Sequence
  Synthetic
ttcctctaacttctttcttccgttcaccctctgctcgagaacctcttctcttcctccgcggttcttcttcgactc

SEQ ID NO: 145013 - DNA, 75 bp, Artificial Sequence
  Synthetic
ttcctctaacttctttcttccgttcaccctctgctcgagaagctcttctcttcctccgcggttcttcttcgactc

SEQ ID NO: 145014 - DNA, 75 bp, Artificial Sequence
  Synthetic
ttcctctaacttctttcttccgttcaccctctgctcgagtaactcttctcttcctccgcggttcttcttcgactc

SEQ ID NO: 145015 - DNA, 75 bp, Artificial Sequence
  Synthetic
ttcctctaacttctttcttccgttcaccctctgctcgagtatctcttctcttcctccgcggttcttcttcgactc

SEQ ID NO: 145016 - DNA, 75 bp, Artificial Sequence
  Synthetic
ttcctctaacttctttcttccgttcaccctctgctcgagtacctcttctcttcctccgcggttcttcttcgactc

SEQ ID NO: 145017 - DNA, 75 bp, Artificial Sequence
  Synthetic
ttcctctaacttctttcttccgttcaccctctgctcgagtagctcttctcttcctccgcggttcttcttcgactc

SEQ ID NO: 145018 - DNA, 75 bp, Artificial Sequence
  Synthetic
ttcctctaacttctttcttccgttcaccctctgctcgagcaactcttctcttcctccgcggttcttcttcgactc

SEQ ID NO: 145019 - DNA, 75 bp, Artificial Sequence
  Synthetic
ttcctctaacttctttcttccgttcaccctctgctcgagcatctcttctcttcctccgcggttcttcttcgactc

SEQ ID NO: 145020 - DNA, 75 bp, Artificial Sequence
  Synthetic
ttcctctaacttctttcttccgttcaccctctgctcgagcacctcttctcttcctccgcggttcttcttcgactc

SEQ ID NO: 145021 - DNA, 75 bp, Artificial Sequence
  Synthetic
ttcctctaacttctttcttccgttcaccctctgctcgagcagctcttctcttcctccgcggttcttcttcgactc

SEQ ID NO: 145022 - DNA, 75 bp, Artificial Sequence
  Synthetic
ttcctctaacttctttcttccgttcaccctctgctcgaggaactcttctcttcctccgcggttcttcttcgactc

SEQ ID NO: 145023 - DNA, 75 bp, Artificial Sequence
  Synthetic
ttcctctaacttctttcttccgttcaccctctgctcgaggatctcttctcttcctccgcggttcttcttcgactc

SEQ ID NO: 145024 - DNA, 75 bp, Artificial Sequence
  Synthetic
ttcctctaacttctttcttccgttcaccctctgctcgaggacctcttctcttcctccgcggttcttcttcgactc

SEQ ID NO: 145025 - DNA, 75 bp, Artificial Sequence
  Synthetic
ttcctctaacttctttcttccgttcaccctctgctcgaggagctcttctcttcctccgcggttcttcttcgactc

SEQ ID NO: 145026 - DNA, 75 bp, Artificial Sequence
  Synthetic
ttcctcttacttctttcttccgttcaccctctgctcgagaaactcttctcttcctccgcggttcttcttcgactc

SEQ ID NO: 145027 - DNA, 75 bp, Artificial Sequence
  Synthetic
ttcctcttacttctttcttccgttcaccctctgctcgagaatctcttctcttcctccgcggttcttcttcgactc

SEQ ID NO: 145028 - DNA, 75 bp, Artificial Sequence
  Synthetic
ttcctcttacttctttcttccgttcaccctctgctcgagaacctcttctcttcctccgcggttcttcttcgactc

SEQ ID NO: 145029 - DNA, 75 bp, Artificial Sequence
  Synthetic
ttcctcttacttctttcttccgttcaccctctgctcgagaagctcttctcttcctccgcggttcttcttcgactc

SEQ ID NO: 145030 - DNA, 75 bp, Artificial Sequence
  Synthetic
ttcctcttacttctttcttccgttcaccctctgctcgagtaactcttctcttcctccgcggttcttcttcgactc

SEQ ID NO: 145031 - DNA, 75 bp, Artificial Sequence
  Synthetic
ttcctcttacttctttcttccgttcaccctctgctcgagtatctcttctcttcctccgcggttcttcttcgactc

SEQ ID NO: 145032 - DNA, 75 bp, Artificial Sequence
  Synthetic
ttcctcttacttctttcttccgttcaccctctgctcgagtacctcttctcttcctccgcggttcttcttcgactc

SEQ ID NO: 145033 - DNA, 75 bp, Artificial Sequence
  Synthetic
ttcctcttacttctttcttccgttcaccctctgctcgagtagctcttctcttcctccgcggttcttcttcgactc

SEQ ID NO: 145034 - DNA, 75 bp, Artificial Sequence
  Synthetic
ttcctcttacttctttcttccgttcaccctctgctcgagcaactcttctcttcctccgcggttcttcttcgactc

SEQ ID NO: 145035 - DNA, 75 bp, Artificial Sequence
  Synthetic
ttcctcttacttctttcttccgttcaccctctgctcgagcatctcttctcttcctccgcggttcttcttcgactc

SEQ ID NO: 145036 - DNA, 75 bp, Artificial Sequence
  Synthetic
ttcctcttacttctttcttccgttcaccctctgctcgagcacctcttctcttcctccgcggttcttcttcgactc

SEQ ID NO: 145037 - DNA, 75 bp, Artificial Sequence
  Synthetic
ttcctcttacttctttcttccgttcaccctctgctcgagcagctcttctcttcctccgcggttcttcttcgactc

SEQ ID NO: 145038 - DNA, 75 bp, Artificial Sequence
  Synthetic
ttcctcttacttctttcttccgttcaccctctgctcgaggaactcttctcttcctccgcggttcttcttcgactc

SEQ ID NO: 145039 - DNA, 75 bp, Artificial Sequence
  Synthetic
ttcctcttacttctttcttccgttcaccctctgctcgaggatctcttctcttcctccgcggttcttcttcgactc

SEQ ID NO: 145040 - DNA, 75 bp, Artificial Sequence
  Synthetic
ttcctcttacttctttcttccgttcaccctctgctcgaggacctcttctcttcctccgcggttcttcttcgactc

SEQ ID NO: 145041 - DNA, 75 bp, Artificial Sequence
  Synthetic
ttcctcttacttctttcttccgttcaccctctgctcgaggagctcttctcttcctccgcggttcttcttcgactc

SEQ ID NO: 145042 - DNA, 75 bp, Artificial Sequence
  Synthetic
ttcctctcacttctttcttccgttcaccctctgctcgagaaactcttctcttcctccgcggttcttcttcgactc

SEQ ID NO: 145043 - DNA, 75 bp, Artificial Sequence
  Synthetic
ttcctctcacttctttcttccgttcaccctctgctcgagaatctcttctcttcctccgcggttcttcttcgactc

SEQ ID NO: 145044 - DNA, 75 bp, Artificial Sequence
  Synthetic
ttcctctcacttctttcttccgttcaccctctgctcgagaacctcttctcttcctccgcggttcttcttcgactc

SEQ ID NO: 145045 - DNA, 75 bp, Artificial Sequence
  Synthetic
ttcctctcacttctttcttccgttcaccctctgctcgagaagctcttctcttcctccgcggttcttcttcgactc

SEQ ID NO: 145046 - DNA, 75 bp, Artificial Sequence
  Synthetic
ttcctctcacttctttcttccgttcaccctctgctcgagtaactcttctcttcctccgcggttcttcttcgactc

SEQ ID NO: 145047 - DNA, 75 bp, Artificial Sequence
  Synthetic
ttcctctcacttctttcttccgttcaccctctgctcgagtatctcttctcttcctccgcggttcttcttcgactc

SEQ ID NO: 145048 - DNA, 75 bp, Artificial Sequence
  Synthetic
ttcctctcacttctttcttccgttcaccctctgctcgagtacctcttctcttcctccgcggttcttcttcgactc

SEQ ID NO: 145049 - DNA, 75 bp, Artificial Sequence
  Synthetic
ttcctctcacttctttcttccgttcaccctctgctcgagtagctcttctcttcctccgcggttcttcttcgactc

SEQ ID NO: 145050 - DNA, 75 bp, Artificial Sequence
  Synthetic
ttcctctcacttctttcttccgttcaccctctgctcgagcaactcttctcttcctccgcggttcttcttcgactc

SEQ ID NO: 145051 - DNA, 75 bp, Artificial Sequence
  Synthetic
ttcctctcacttctttcttccgttcaccctctgctcgagcatctcttctcttcctccgcggttcttcttcgactc

SEQ ID NO: 145052 - DNA, 75 bp, Artificial Sequence
  Synthetic
ttcctctcacttctttcttccgttcaccctctgctcgagcacctcttctcttcctccgcggttcttcttcgactc

SEQ ID NO: 145053 - DNA, 75 bp, Artificial Sequence
  Synthetic
ttcctctcacttctttcttccgttcaccctctgctcgagcagctcttctcttcctccgcggttcttcttcgactc

SEQ ID NO: 145054 - DNA, 75 bp, Artificial Sequence
  Synthetic
ttcctctcacttctttcttccgttcaccctctgctcgaggaactcttctcttcctccgcggttcttcttcgactc

SEQ ID NO: 145055 - DNA, 75 bp, Artificial Sequence
  Synthetic
ttcctctcacttctttcttccgttcaccctctgctcgaggatctcttctcttcctccgcggttcttcttcgactc

SEQ ID NO: 145056 - DNA, 75 bp, Artificial Sequence
  Synthetic
ttcctctcacttctttcttccgttcaccctctgctcgaggacctcttctcttcctccgcggttcttcttcgactc

SEQ ID NO: 145057 - DNA, 75 bp, Artificial Sequence
  Synthetic
ttcctctcacttctttcttccgttcaccctctgctcgaggagctcttctcttcctccgcggttcttcttcgactc

SEQ ID NO: 145058 - DNA, 75 bp, Artificial Sequence
  Synthetic
ttcctctgacttctttcttccgttcaccctctgctcgagaaactcttctcttcctccgcggttcttcttcgactc

SEQ ID NO: 145059 - DNA, 75 bp, Artificial Sequence
  Synthetic
ttcctctgacttctttcttccgttcaccctctgctcgagaatctcttctcttcctccgcggttcttcttcgactc

SEQ ID NO: 145060 - DNA, 75 bp, Artificial Sequence
  Synthetic
ttcctctgacttctttcttccgttcaccctctgctcgagaacctcttctcttcctccgcggttcttcttcgactc

SEQ ID NO: 145061 - DNA, 75 bp, Artificial Sequence
  Synthetic
ttcctctgacttctttcttccgttcaccctctgctcgagaagctcttctcttcctccgcggttcttcttcgactc

SEQ ID NO: 145062 - DNA, 75 bp, Artificial Sequence
  Synthetic
ttcctctgacttctttcttccgttcaccctctgctcgagtaactcttctcttcctccgcggttcttcttcgactc

SEQ ID NO: 145063 - DNA, 75 bp, Artificial Sequence
  Synthetic
ttcctctgacttctttcttccgttcaccctctgctcgagtatctcttctcttcctccgcggttcttcttcgactc

SEQ ID NO: 145064 - DNA, 75 bp, Artificial Sequence
  Synthetic
ttcctctgacttctttcttccgttcaccctctgctcgagtacctcttctcttcctccgcggttcttcttcgactc

SEQ ID NO: 145065 - DNA, 75 bp, Artificial Sequence
  Synthetic
ttcctctgacttctttcttccgttcaccctctgctcgagtagctcttctcttcctccgcggttcttcttcgactc

SEQ ID NO: 145066 - DNA, 75 bp, Artificial Sequence
  Synthetic
ttcctctgacttctttcttccgttcaccctctgctcgagcaactcttctcttcctccgcggttcttcttcgactc

SEQ ID NO: 145067 - DNA, 75 bp, Artificial Sequence
  Synthetic
ttcctctgacttctttcttccgttcaccctctgctcgagcatctcttctcttcctccgcggttcttcttcgactc

SEQ ID NO: 145068 - DNA, 75 bp, Artificial Sequence
  Synthetic
ttcctctgacttctttcttccgttcaccctctgctcgagcacctcttctcttcctccgcggttcttcttcgactc

SEQ ID NO: 145069 - DNA, 75 bp, Artificial Sequence
  Synthetic
ttcctctgacttctttcttccgttcaccctctgctcgagcagctcttctcttcctccgcggttcttcttcgactc

SEQ ID NO: 145070 - DNA, 75 bp, Artificial Sequence
  Synthetic
ttcctctgacttctttcttccgttcaccctctgctcgaggaactcttctcttcctccgcggttcttcttcgactc

SEQ ID NO: 145071 - DNA, 75 bp, Artificial Sequence
  Synthetic
ttcctctgacttctttcttccgttcaccctctgctcgaggatctcttctcttcctccgcggttcttcttcgactc

SEQ ID NO: 145072 - DNA, 75 bp, Artificial Sequence
  Synthetic
ttcctctgacttctttcttccgttcaccctctgctcgaggacctcttctcttcctccgcggttcttcttcgactc

SEQ ID NO: 145073 - DNA, 75 bp, Artificial Sequence
  Synthetic
ttcctctgacttctttcttccgttcaccctctgctcgaggagctcttctcttcctccgcggttcttcttcgactc

SEQ ID NO: 145074 - DNA, 75 bp, Artificial Sequence
  Synthetic
ggaccggcacatctcgacaaggggcggcggtcctcagtactcttactcttttctgtaaagaggagactgctggac

SEQ ID NO: 145075 - DNA, 75 bp, Artificial Sequence
  Synthetic
ggaccggcacatctcgacaaggggcggcggtcctcagttctcttactcttttctgtaaagaggagactgctggac

SEQ ID NO: 145076 - DNA, 75 bp, Artificial Sequence
  Synthetic
ggaccggcacatctcgacaaggggcggcggtcctcagtcctcttactcttttctgtaaagaggagactgctggac

SEQ ID NO: 145077 - DNA, 75 bp, Artificial Sequence
  Synthetic
ggaccggcacatctcgacaaggggcggcggtcctcagtgctcttactcttttctgtaaagaggagactgctggac

SEQ ID NO: 145078 - DNA, 75 bp, Artificial Sequence
  Synthetic
ggaccggctcatctcgacaaggggcggcggtcctcagtactcttactcttttctgtaaagaggagactgctggac

SEQ ID NO: 145079 - DNA, 75 bp, Artificial Sequence
  Synthetic
ggaccggctcatctcgacaaggggcggcggtcctcagttctcttactcttttctgtaaagaggagactgctggac

SEQ ID NO: 145080 - DNA, 75 bp, Artificial Sequence
  Synthetic
ggaccggctcatctcgacaaggggcggcggtcctcagtcctcttactcttttctgtaaagaggagactgctggac

SEQ ID NO: 145081 - DNA, 75 bp, Artificial Sequence
  Synthetic
ggaccggctcatctcgacaaggggcggcggtcctcagtgctcttactcttttctgtaaagaggagactgctggac

SEQ ID NO: 145082 - DNA, 75 bp, Artificial Sequence
  Synthetic
ggaccggcccatctcgacaaggggcggcggtcctcagtactcttactcttttctgtaaagaggagactgctggac

SEQ ID NO: 145083 - DNA, 75 bp, Artificial Sequence
  Synthetic
ggaccggcccatctcgacaaggggcggcggtcctcagttctcttactcttttctgtaaagaggagactgctggac

SEQ ID NO: 145084 - DNA, 75 bp, Artificial Sequence
  Synthetic
ggaccggcccatctcgacaaggggcggcggtcctcagtcctcttactcttttctgtaaagaggagactgctggac

SEQ ID NO: 145085 - DNA, 75 bp, Artificial Sequence
  Synthetic
ggaccggcccatctcgacaaggggcggcggtcctcagtgctcttactcttttctgtaaagaggagactgctggac

SEQ ID NO: 145086 - DNA, 75 bp, Artificial Sequence
  Synthetic
ggaccggcgcatctcgacaaggggcggcggtcctcagtactcttactcttttctgtaaagaggagactgctggac

SEQ ID NO: 145087 - DNA, 75 bp, Artificial Sequence
  Synthetic
ggaccggcgcatctcgacaaggggcggcggtcctcagttctcttactcttttctgtaaagaggagactgctggac

SEQ ID NO: 145088 - DNA, 75 bp, Artificial Sequence
  Synthetic
ggaccggcgcatctcgacaaggggcggcggtcctcagtcctcttactcttttctgtaaagaggagactgctggac

SEQ ID NO: 145089 - DNA, 75 bp, Artificial Sequence
  Synthetic
ggaccggcgcatctcgacaaggggcggcggtcctcagtgctcttactcttttctgtaaagaggagactgctggac

SEQ ID NO: 145090 - DNA, 75 bp, Artificial Sequence
  Synthetic
catctcgacaaggggcggcggtcctcagtactcttactcttttctgtaaagaggagactgctggacgctccgccc

SEQ ID NO: 145091 - DNA, 75 bp, Artificial Sequence
  Synthetic
catctcgacaaggggcggcggtcctcagttctcttactcttttctgtaaagaggagactgctggacgctccgccc

SEQ ID NO: 145092 - DNA, 75 bp, Artificial Sequence
  Synthetic
catctcgacaaggggcggcggtcctcagtcctcttactcttttctgtaaagaggagactgctggacgctccgccc

SEQ ID NO: 145093 - DNA, 75 bp, Artificial Sequence
  Synthetic
catctcgacaaggggcggcggtcctcagtgctcttactcttttctgtaaagaggagactgctggacgctccgccc

SEQ ID NO: 145094 - DNA, 75 bp, Artificial Sequence
  Synthetic
atgggccaattccgagcgaagggaacgcgggaggaaggatcagcgcccgagagggagtaacggtaaagaggcggg

SEQ ID NO: 145095 - DNA, 75 bp, Artificial Sequence
  Synthetic
cgcgggaggaaggatcagcgcccgagagggagtaacggtaaagaggcggggaacgtcgattggagttcctcctgg

SEQ ID NO: 145096 - DNA, 75 bp, Artificial Sequence
  Synthetic
gagggagtaacggtaaagaggcggggaacgtcgattggagttcctcctggaggaaaagagaagattcaagaggtg

SEQ ID NO: 145097 - DNA, 75 bp, Artificial Sequence
  Synthetic
gtggaaaaagaaggggcgggccccccgatccgaggggcccgactaccaagtttggaaagcactccgggccgaagg

SEQ ID NO: 145098 - DNA, 75 bp, Artificial Sequence
  Synthetic
gttgagtagcatccagagggagagaaccacacggagtagaacagagaaatcacctccagaggaccccttcagcga

SEQ ID NO: 145099 - DNA, 75 bp, Artificial Sequence
  Synthetic
accacacggagtagaacagagaaatcacctccagaggaccccttcagcgaacagaagagtcttgtcggaaaagga

SEQ ID NO: 145100 - DNA, 75 bp, Artificial Sequence
  Synthetic
accacacggagtagaacagagaaatcacctccagaggaccccttcagcgaacagaagagtcttgtcggaatagga

SEQ ID NO: 145101 - DNA, 75 bp, Artificial Sequence
  Synthetic
accacacggagtagaacagagaaatcacctccagaggaccccttcagcgaacagaagagtcttgtcggaacagga

SEQ ID NO: 145102 - DNA, 75 bp, Artificial Sequence
  Synthetic
accacacggagtagaacagagaaatcacctccagaggaccccttcagcgaacagaagagtcttgtcggaagagga

SEQ ID NO: 145103 - DNA, 75 bp, Artificial Sequence
  Synthetic
agtatatccaatgggaatccctgcgtccctctcacgtccagcccctccccgtgtcgatggaagggggactccggg

SEQ ID NO: 145104 - DNA, 75 bp, Artificial Sequence
  Synthetic
agtatatcctatgggaatccctgcgtccctctcacgtccagcccctccccgtgtcgatggaagggggactccggg

SEQ ID NO: 145105 - DNA, 75 bp, Artificial Sequence
  Synthetic
agtatatcccatgggaatccctgcgtccctctcacgtccagcccctccccgtgtcgatggaagggggactccggg

SEQ ID NO: 145106 - DNA, 75 bp, Artificial Sequence
  Synthetic
agtatatccgatgggaatccctgcgtccctctcacgtccagcccctccccgtgtcgatggaagggggactccggg

SEQ ID NO: 145107 - DNA, 75 bp, Artificial Sequence
  Synthetic
cgcccccgggcgctcccctcgatccaccttcgagggggttcacacctccaggcggcgggccggctactcttcttt

SEQ ID NO: 145108 - DNA, 75 bp, Artificial Sequence
  Synthetic
gtttcttctttgtcttccggaggtccctttcgagttcctccgctctttttcttccgcttacccactgctcgagga

SEQ ID NO: 145109 - DNA, 75 bp, Artificial Sequence
  Synthetic
acaagaggcggcaaacctcagtactcttactctttttctgaaaagaggagactgctggttctgccgcccaagctc

SEQ ID NO: 145110 - DNA, 75 bp, Artificial Sequence
  Synthetic
catgggccacagctccgagcgaagagaccccgggggaggaaggggacccgagaggggatgggacgctaaagagca

SEQ ID NO: 145111 - DNA, 75 bp, Artificial Sequence
  Synthetic
gaccccgggggaggaaggggacccgagaggggatgggacgctaaagagcattggaacgccgagagaatctctccc

SEQ ID NO: 145112 - DNA, 75 bp, Artificial Sequence
  Synthetic
agaggggatgggacgctaaagagcattggaacgccgagagaatctctcccaagaagaaccaagagatctcaagaa

SEQ ID NO: 145113 - DNA, 75 bp, Artificial Sequence
  Synthetic
gcggaagattttccccacaacgccggagaagctctaggaaggggagaaaggagggaggaaaaaaaaggggcgggc

SEQ ID NO: 145114 - DNA, 75 bp, Artificial Sequence
  Synthetic
gagaagctctaggaaggggagaaaggagggaggaaaaaaaaggggcgggccccccgatccgaggggcccagccac

SEQ ID NO: 145115 - DNA, 75 bp, Artificial Sequence
  Synthetic
caagtttggagaacactccgggccgaatggtcgagtagcattcagagggagaaagccacacggagatgagcggag

SEQ ID NO: 145116 - DNA, 75 bp, Artificial Sequence
  Synthetic
gaaagccacacggagatgagcggagaaatcacctccagaggaccccttcagcgaacagagagcgcttcgtgcggt

SEQ ID NO: 145117 - DNA, 75 bp, Artificial Sequence
  Synthetic
gagatgctaggagtagggagcgaccgaagcgaggaggaaagcaaagaaagcaacggggctagcgagtgggtgttc

SEQ ID NO: 145118 - DNA, 75 bp, Artificial Sequence
  Synthetic
gcttatcccggggaattcgacttatcgtccccacatagcagagccccggacccccttccaaagcgaccgaggggg

SEQ ID NO: 145119 - DNA, 75 bp, Artificial Sequence
  Synthetic
gtggcttggacgcgggggacccagtggatccatgggatgctcttcccgattccgatacgactccctccccccagg

SEQ ID NO: 145120 - DNA, 75 bp, Artificial Sequence
  Synthetic
gggcaacattccgaggggaccgtcccctcggtaatggcgaatgggacccacaaccccctctggattccaagagag

SEQ ID NO: 145121 - DNA, 75 bp, Artificial Sequence
  Synthetic
ggtctctctcgagttcctctaacttctttcttgcgcccacccactgctcgaggatttcctcccttcccccgcgat

SEQ ID NO: 145122 - DNA, 75 bp, Artificial Sequence
  Synthetic
catgagccaattccgagcgaggatccctcgggggaaggatcagcgcccgagaggggattggtgctaaagagcatt

SEQ ID NO: 145123 - DNA, 75 bp, Artificial Sequence
  Synthetic
cctcgggggaaggatcagcgcccgagaggggattggtgctaaagagcattggaacgccaaggagagtattcccaa

SEQ ID NO: 145124 - DNA, 75 bp, Artificial Sequence
  Synthetic
gaggggattggtgctaaagagcattggaacgccaaggagagtattcccaagaaggcagagagaagtccaagaatc

SEQ ID NO: 145125 - DNA, 75 bp, Artificial Sequence
  Synthetic
ggatgactctccccatgacgctggaaacgccttgggaggggaaagaggagggatggaagagaagaggtggccctc

SEQ ID NO: 145126 - DNA, 75 bp, Artificial Sequence
  Synthetic
aacgccttgggaggggaaagaggagggatggaagagaagaggtggccctccccagatacgaatggcccggctacc

SEQ ID NO: 145127 - DNA, 75 bp, Artificial Sequence
  Synthetic
aaatctggaggacactccggccgaagggttgagtagcacccagagggaggagtccacacggagaaagcagacaaa

SEQ ID NO: 145128 - DNA, 75 bp, Artificial Sequence
  Synthetic
agtccacacggagaaagcagacaaatcacctccagaggaccccttcagcgaacagaagagcgctatcgcgtgagg

SEQ ID NO: 145129 - DNA, 75 bp, Artificial Sequence
  Synthetic
agtaagaccatagcgataggaagagatgctaggagtagggagagaccgaagcgaggaggaaagcaaagaaagcaa

SEQ ID NO: 145130 - DNA, 75 bp, Artificial Sequence
  Synthetic
atgctaggagtagggagagaccgaagcgaggaggaaagcaaagaaagcaacggggctagcaggtgggtgttccgc

SEQ ID NO: 145131 - DNA, 75 bp, Artificial Sequence
  Synthetic
gctaggacgtgggggcgccggtggatccgtgggatgcccttcccgattctgacctaacccctcccccagcagggt

SEQ ID NO: 145132 - DNA, 75 bp, Artificial Sequence
  Synthetic
gggagagaagggaggatcagctgggaagagcacatcccacgggaatccccggtctcctctcaggtccagcccctc

SEQ ID NO: 145133 - DNA, 75 bp, Artificial Sequence
  Synthetic
ggagtctatctccatctggtccgtccgggccctcttcgctgggggggccccctctccatccttgtccttctttcc

SEQ ID NO: 145134 - DNA, 75 bp, Artificial Sequence
  Synthetic
cgggccctcttcgctgggggggccccctctccatccttgtccttctttccgagaatccctttgatgtttcccagc

SEQ ID NO: 145135 - DNA, 75 bp, Artificial Sequence
  Synthetic
cagggattctcatcctcaagcttcttgactttcttctttgtcttccggagctctctctcgagttcctctaacttc

SEQ ID NO: 145136 - DNA, 75 bp, Artificial Sequence
  Synthetic
ctctctctcgagttcctctaacttctttcttgcacccacccactgctcgagaacatcttctcttcccccgcggtg

SEQ ID NO: 145137 - DNA, 75 bp, Artificial Sequence
  Synthetic
catgagccaattccgaacgaggggtacgcgggaggaggatcactgaccgagaggggtgtagtggtaaagaggcgg

SEQ ID NO: 145138 - DNA, 75 bp, Artificial Sequence
  Synthetic
aggtggaagagaagggggcgggcctcccgatccgaggggcccgactaccaattttggaaagcactccgggcgaag

SEQ ID NO: 145139 - DNA, 75 bp, Artificial Sequence
  Synthetic
attttggaaagcactccgggcgaagggttgattaccactcagggaggaacacacggagttagaacagagaaatca

SEQ ID NO: 145140 - DNA, 75 bp, Artificial Sequence
  Synthetic
tcccggggaactcggcgaatcgtccccacatagcaggacccaggacccccttccaaagtgaccgaggggggagct

SEQ ID NO: 145141 - DNA, 75 bp, Artificial Sequence
  Synthetic
attccgaggggaccgtcccctcggtaatggcgaatgggacccagagctctctctagattccgatagagaatcgag

SEQ ID NO: 145142 - DNA, 75 bp, Artificial Sequence
  Synthetic
ccttcgagggggttcacacctccagtcggcgggccggctactcttcttttccttctctcgtcttcctcggtcaac

SEQ ID NO: 145143 - DNA, 75 bp, Artificial Sequence
  Synthetic
ccttctctcgtcttcctcggtcaacctcttaagttcctcttcttcctccctgctgagcttcttccctcctccggc

SEQ ID NO: 145144 - DNA, 75 bp, Artificial Sequence
  Synthetic
atgggccaagttccgagcgaagagatcgcgggggaaggatcagctcccgagaggggatggacggtaaagagcatt

SEQ ID NO: 145145 - DNA, 75 bp, Artificial Sequence
  Synthetic
gaggggatggacggtaaagagcattggaacgtcgaggagatgtctcccaagaaggaaaagagaattcaagattcg

SEQ ID NO: 145146 - DNA, 75 bp, Artificial Sequence
  Synthetic
ggaacgtcgaggagatgtctcccaagaaggaaaagagaattcaagattcggaggaattccccataacgctggaga

SEQ ID NO: 145147 - DNA, 75 bp, Artificial Sequence
  Synthetic
ttgagtagcacccagagggaggaagccacacggagttgacagagaaatcacctccagaggaccccttcagcgaac

SEQ ID NO: 145148 - DNA, 75 bp, Artificial Sequence
  Synthetic
ttccaaagtgaccgggggggtcgcttagagcgcagggggaggcggtggagccatgggatgcccttcccgattccg

SEQ ID NO: 145149 - DNA, 75 bp, Artificial Sequence
  Synthetic
gcggggtccgcgttccatcctttcttacctgatggccggcatggtcccagcctcctcgctggcgccggctgggca

SEQ ID NO: 145150 - DNA, 75 bp, Artificial Sequence
  Synthetic
gaagggggactccgggactccttgcatgttggggacgaagccgcccccgggcgctcccctcgatccaccttcgag

SEQ ID NO: 145151 - DNA, 75 bp, Artificial Sequence
  Synthetic
ccggctactcttctttcccttctctcgtcttcctcggtcaacctcttaagttcctcttcttcttccctgctgagg

SEQ ID NO: 145152 - DNA, 75 bp, Artificial Sequence
  Synthetic
tgtccttctttccgagaattcctttgatgtttcccagccagggattctcctcctcaagtttcttgatcttcttct

SEQ ID NO: 145153 - DNA, 75 bp, Artificial Sequence
  Synthetic
ttcctctaacttctttcttccgttcacccactgctcgaggacctcttctcttcccccgcggttcttcttcgactc

SEQ ID NO: 145154 - DNA, 75 bp, Artificial Sequence
  Synthetic
ggaccggctcatctcgacgaagggcggcggtcctcagtactcttactcttttctgtaaagaggagactgctggac

SEQ ID NO: 145155 - DNA, 75 bp, Artificial Sequence
  Synthetic
atgggcctcagtgccgacaaggagcccgcaggtgggaggatcagctaccggagagggacgcgatggcaagagtgg

SEQ ID NO: 145156 - DNA, 75 bp, Artificial Sequence
  Synthetic
ccgcaggtgggaggatcagctaccggagagggacgcgatggcaagagtgggggaaatctcggagggtgatcccaa

SEQ ID NO: 145157 - DNA, 75 bp, Artificial Sequence
  Synthetic
gagagggacgcgatggcaagagtgggggaaatctcggagggtgatcccaagaaggccaaagaagattcaagcgac

SEQ ID NO: 145158 - DNA, 75 bp, Artificial Sequence
  Synthetic
gaggggggatccccgagacgctggagacgcccgggaacaaggaaacagaacaaggaacggtagaaaagagcgagc

SEQ ID NO: 145159 - DNA, 75 bp, Artificial Sequence
  Synthetic
caaggaacggtagaaaagagcgagcctcccgatacgagtttgccaggacctatcaagtttggagtcatccgggcc

SEQ ID NO: 145160 - DNA, 75 bp, Artificial Sequence
  Synthetic
ctaaggtagaatagaacaccggggggtgatccaccaggagatgaacggagaaatcacctccagaggaccccttca

SEQ ID NO: 145161 - DNA, 75 bp, Artificial Sequence
  Synthetic
ccaacatagcagaccccaggaccccttccgaacgagggggacggtccttgaactcccagggggtcccatggagcc

SEQ ID NO: 145162 - DNA, 75 bp, Artificial Sequence
  Synthetic
atgggcccagtccgacaaaaaggccggagagggagaggagaaggaacccccgaagggacaaggacgggagagcgg

SEQ ID NO: 145163 - DNA, 75 bp, Artificial Sequence
  Synthetic
atgggcccagtccgacaaataggccggagagggagaggagaaggaacccccgaagggacaaggacgggagagcgg

SEQ ID NO: 145164 - DNA, 75 bp, Artificial Sequence
  Synthetic
atgggcccagtccgacaaacaggccggagagggagaggagaaggaacccccgaagggacaaggacgggagagcgg

SEQ ID NO: 145165 - DNA, 75 bp, Artificial Sequence
  Synthetic
atgggcccagtccgacaaagaggccggagagggagaggagaaggaacccccgaagggacaaggacgggagagcgg

SEQ ID NO: 145166 - DNA, 75 bp, Artificial Sequence
  Synthetic
ggagagggagaggagaaggaacccccgaagggacaaggacgggagagcgggaacactccgaggaaagacccccaa

SEQ ID NO: 145167 - DNA, 75 bp, Artificial Sequence
  Synthetic
gagaacggatccccatgacgctggaagggcgtctcggaatgagggaaaaaggccaagatggtagaaaagagcgag

SEQ ID NO: 145168 - DNA, 75 bp, Artificial Sequence
  Synthetic
gagaacggatccccatgacgctggaagggcgtctcggaatgagggaaaatggccaagatggtagaaaagagcgag

SEQ ID NO: 145169 - DNA, 75 bp, Artificial Sequence
  Synthetic
gagaacggatccccatgacgctggaagggcgtctcggaatgagggaaaacggccaagatggtagaaaagagcgag

SEQ ID NO: 145170 - DNA, 75 bp, Artificial Sequence
  Synthetic
gagaacggatccccatgacgctggaagggcgtctcggaatgagggaaaagggccaagatggtagaaaagagcgag

SEQ ID NO: 145171 - DNA, 75 bp, Artificial Sequence
  Synthetic
agggcgtctcggaatgagggaaaaaggccaagatggtagaaaagagcgagcctcccgatccgaggtttccctgaa

SEQ ID NO: 145172 - DNA, 75 bp, Artificial Sequence
  Synthetic
agggcgtctcggaatgagggaaaatggccaagatggtagaaaagagcgagcctcccgatccgaggtttccctgaa

SEQ ID NO: 145173 - DNA, 75 bp, Artificial Sequence
  Synthetic
agggcgtctcggaatgagggaaaacggccaagatggtagaaaagagcgagcctcccgatccgaggtttccctgaa

SEQ ID NO: 145174 - DNA, 75 bp, Artificial Sequence
  Synthetic
agggcgtctcggaatgagggaaaagggccaagatggtagaaaagagcgagcctcccgatccgaggtttccctgaa

SEQ ID NO: 145175 - DNA, 75 bp, Artificial Sequence
  Synthetic
cctattggatctggagactccggtcccgaggggtcaaaggaagggcagggaggcaatccaccaggagatctcgga

SEQ ID NO: 145176 - DNA, 75 bp, Artificial Sequence
  Synthetic
ccgaggggtcaaaggaagggcagggaggcaatccaccaggagatctcggagaaaccacctccagaggaccccttc

SEQ ID NO: 145177 - DNA, 75 bp, Artificial Sequence
  Synthetic
agcgaacagaagagcctgccccggtcgaattgtcccgtagcgatgggaggagatgctaggagtagggagagaccg

SEQ ID NO: 145178 - DNA, 75 bp, Artificial Sequence
  Synthetic
cgaattgtcccgtagcgatgggaggagatgctaggagtagggagagaccgaagcgagagagcaagacaagagagc

SEQ ID NO: 145179 - DNA, 75 bp, Artificial Sequence
  Synthetic
cgaattgtcccgtagcgatgggaggagatgctaggagtagggagagaccgatgcgagagagcaagacaagagagc

SEQ ID NO: 145180 - DNA, 75 bp, Artificial Sequence
  Synthetic
cgaattgtcccgtagcgatgggaggagatgctaggagtagggagagaccgacgcgagagagcaagacaagagagc

SEQ ID NO: 145181 - DNA, 75 bp, Artificial Sequence
  Synthetic
cgaattgtcccgtagcgatgggaggagatgctaggagtagggagagaccgaggcgagagagcaagacaagagagc

SEQ ID NO: 145182 - DNA, 75 bp, Artificial Sequence
  Synthetic
aacggggctagcgagtggatgttccgcccctcgttggctccgagtgaggcttatcccggggaactcggccctctt

SEQ ID NO: 145183 - DNA, 75 bp, Artificial Sequence
  Synthetic
gcccctcgttggctccgagtgaggcttatcccggggaactcggccctcttccccaactagccggtccagggtccc

SEQ ID NO: 145184 - DNA, 75 bp, Artificial Sequence
  Synthetic
gcccctcgttggctccgagtgaggcttatcccggggaactcggccctcttccccaactagccggtcctgggtccc

SEQ ID NO: 145185 - DNA, 75 bp, Artificial Sequence
  Synthetic
gcccctcgttggctccgagtgaggcttatcccggggaactcggccctcttccccaactagccggtcccgggtccc

SEQ ID NO: 145186 - DNA, 75 bp, Artificial Sequence
  Synthetic
gcccctcgttggctccgagtgaggcttatcccggggaactcggccctcttccccaactagccggtccggggtccc

SEQ ID NO: 145187 - DNA, 75 bp, Artificial Sequence
  Synthetic
cgttccaaaagaagggggggcctggcaactcggggagccagcagcgccatggtggacccccgcagcccccctgtc

SEQ ID NO: 145188 - DNA, 75 bp, Artificial Sequence
  Synthetic
ggtggacccccgcagcccccctgtccacactccttcccccccgcggggccccccatctaaaggaaaagactccac

SEQ ID NO: 145189 - DNA, 75 bp, Artificial Sequence
  Synthetic
gcaacattccgaggggaccgctcctcggtaatggcgaatgggacccaagacctccttgattcccagagagaatca

SEQ ID NO: 145190 - DNA, 75 bp, Artificial Sequence
  Synthetic
ggaggtgactgggcattccctttgccatccgagtgaacgttcgtcctccttcggatgcccaggtcggaccgcggg

SEQ ID NO: 145191 - DNA, 75 bp, Artificial Sequence
  Synthetic
tcggatgcccaggtcggaccgcggggaggtggagatgccatgccgacccgaagaggaaagaaggattcggacaca

SEQ ID NO: 145192 - DNA, 75 bp, Artificial Sequence
  Synthetic
gaggtggagatgccatgccgacccgaagaggaaagaaggattcggacacaaacctgtgagtggaagtctttcttt

SEQ ID NO: 145193 - DNA, 75 bp, Artificial Sequence
  Synthetic
attggggggtacactcgaggagtggaaggcggggagggggggtcggactaggtccccatgggaactgctggtttc

SEQ ID NO: 145194 - DNA, 75 bp, Artificial Sequence
  Synthetic
attggggggtacactcgaggagtggaaggcggggagggggggtcggactaggtccccatgggtactgctggtttc

SEQ ID NO: 145195 - DNA, 75 bp, Artificial Sequence
  Synthetic
attggggggtacactcgaggagtggaaggcggggagggggggtcggactaggtccccatgggcactgctggtttc

SEQ ID NO: 145196 - DNA, 75 bp, Artificial Sequence
  Synthetic
attggggggtacactcgaggagtggaaggcggggagggggggtcggactaggtccccatggggactgctggtttc

SEQ ID NO: 145197 - DNA, 75 bp, Artificial Sequence
  Synthetic
aaggcggggagggggggtcggactaggtccccatgggaactgctggtttcctcggaagtccagtccgtcccccgt

SEQ ID NO: 145198 - DNA, 75 bp, Artificial Sequence
  Synthetic
aaggcggggagggggggtcggactaggtccccatgggaactgctggtttcctcggatgtccagtccgtcccccgt

SEQ ID NO: 145199 - DNA, 75 bp, Artificial Sequence
  Synthetic
aaggcggggagggggggtcggactaggtccccatgggaactgctggtttcctcggacgtccagtccgtcccccgt

SEQ ID NO: 145200 - DNA, 75 bp, Artificial Sequence
  Synthetic
aaggcggggagggggggtcggactaggtccccatgggaactgctggtttcctcggaggtccagtccgtcccccgt

SEQ ID NO: 145201 - DNA, 75 bp, Artificial Sequence
  Synthetic
aaggcggggagggggggtcggactaggtccccatgggtactgctggtttcctcggaagtccagtccgtcccccgt

SEQ ID NO: 145202 - DNA, 75 bp, Artificial Sequence
  Synthetic
aaggcggggagggggggtcggactaggtccccatgggtactgctggtttcctcggatgtccagtccgtcccccgt

SEQ ID NO: 145203 - DNA, 75 bp, Artificial Sequence
  Synthetic
aaggcggggagggggggtcggactaggtccccatgggtactgctggtttcctcggacgtccagtccgtcccccgt

SEQ ID NO: 145204 - DNA, 75 bp, Artificial Sequence
  Synthetic
aaggcggggagggggggtcggactaggtccccatgggtactgctggtttcctcggaggtccagtccgtcccccgt

SEQ ID NO: 145205 - DNA, 75 bp, Artificial Sequence
  Synthetic
aaggcggggagggggggtcggactaggtccccatgggcactgctggtttcctcggaagtccagtccgtcccccgt

SEQ ID NO: 145206 - DNA, 75 bp, Artificial Sequence
  Synthetic
aaggcggggagggggggtcggactaggtccccatgggcactgctggtttcctcggatgtccagtccgtcccccgt

SEQ ID NO: 145207 - DNA, 75 bp, Artificial Sequence
  Synthetic
aaggcggggagggggggtcggactaggtccccatgggcactgctggtttcctcggacgtccagtccgtcccccgt

SEQ ID NO: 145208 - DNA, 75 bp, Artificial Sequence
  Synthetic
aaggcggggagggggggtcggactaggtccccatgggcactgctggtttcctcggaggtccagtccgtcccccgt

SEQ ID NO: 145209 - DNA, 75 bp, Artificial Sequence
  Synthetic
aaggcggggagggggggtcggactaggtccccatggggactgctggtttcctcggaagtccagtccgtcccccgt

SEQ ID NO: 145210 - DNA, 75 bp, Artificial Sequence
  Synthetic
aaggcggggagggggggtcggactaggtccccatggggactgctggtttcctcggatgtccagtccgtcccccgt

SEQ ID NO: 145211 - DNA, 75 bp, Artificial Sequence
  Synthetic
aaggcggggagggggggtcggactaggtccccatggggactgctggtttcctcggacgtccagtccgtcccccgt

SEQ ID NO: 145212 - DNA, 75 bp, Artificial Sequence
  Synthetic
aaggcggggagggggggtcggactaggtccccatggggactgctggtttcctcggaggtccagtccgtcccccgt

SEQ ID NO: 145213 - DNA, 75 bp, Artificial Sequence
  Synthetic
tctggagaacggcgactccgggactcctagcagttgaggaacgaagccgcccccgggcgctcccctcggtggtcc

SEQ ID NO: 145214 - DNA, 75 bp, Artificial Sequence
  Synthetic
ccccgggcgctcccctcggtggtccctcgagagggttcacatccccaacccgcgggccggctattcttcttgttc

SEQ ID NO: 145215 - DNA, 75 bp, Artificial Sequence
  Synthetic
ctcgagagggttcacatccccaacccgcgggccggctattcttcttgttcttttctcgtcttcctcggtcaactt

SEQ ID NO: 145216 - DNA, 75 bp, Artificial Sequence
  Synthetic
cctgagttcctcttcttcctccttgctgagggactttcctcccgcggacagctgcttcttcttgttctcgagggc

SEQ ID NO: 145217 - DNA, 75 bp, Artificial Sequence
  Synthetic
gctgcttcttcttgttctcgagggccttccttcgtcggtggtcccgtctctcctcgtcggtgaagcctcccttgc

SEQ ID NO: 145218 - DNA, 75 bp, Artificial Sequence
  Synthetic
cttccttcgtcggtggtcccgtctctcctcgtcggtgaagcctcccttgctactctttttccctggcccagagtc

SEQ ID NO: 145219 - DNA, 75 bp, Artificial Sequence
  Synthetic
cttccttcgtcggtggtcccgtctctcctcgtcggtgaagcctcccttgctactctttttccctggccctgagtc

SEQ ID NO: 145220 - DNA, 75 bp, Artificial Sequence
  Synthetic
cttccttcgtcggtggtcccgtctctcctcgtcggtgaagcctcccttgctactctttttccctggccccgagtc

SEQ ID NO: 145221 - DNA, 75 bp, Artificial Sequence
  Synthetic
cttccttcgtcggtggtcccgtctctcctcgtcggtgaagcctcccttgctactctttttccctggcccggagtc

SEQ ID NO: 145222 - DNA, 75 bp, Artificial Sequence
  Synthetic
gacctccatccgatctgttcgggatctcttcgccgggggagctccctccccactcttgtcctttccgattattcc

SEQ ID NO: 145223 - DNA, 75 bp, Artificial Sequence
  Synthetic
ctcttcgccgggggagctccctccccactcttgtcctttccgattattcctttgacgtttcctagccagggatag

SEQ ID NO: 145224 - DNA, 75 bp, Artificial Sequence
  Synthetic
ctcttcgccgggggagctccctccccactcttgtcctttccgattattcctttgacgtttcctagccagggattg

SEQ ID NO: 145225 - DNA, 75 bp, Artificial Sequence
  Synthetic
ctcttcgccgggggagctccctccccactcttgtcctttccgattattcctttgacgtttcctagccagggatcg

SEQ ID NO: 145226 - DNA, 75 bp, Artificial Sequence
  Synthetic
ctcttcgccgggggagctccctccccactcttgtcctttccgattattcctttgacgtttcctagccagggatgg

SEQ ID NO: 145227 - DNA, 75 bp, Artificial Sequence
  Synthetic
tcgtcctctagcttcttgatagtcattattgccttccggagcttcctctcgaggtcctccgcttcctctctcgac

SEQ ID NO: 145228 - DNA, 75 bp, Artificial Sequence
  Synthetic
tcgtcctctagcttcttgatagtcattattgccttccggagcttcctctcgaggtcctccgcttcctctctcgtc

SEQ ID NO: 145229 - DNA, 75 bp, Artificial Sequence
  Synthetic
tcgtcctctagcttcttgatagtcattattgccttccggagcttcctctcgaggtcctccgcttcctctctcgcc

SEQ ID NO: 145230 - DNA, 75 bp, Artificial Sequence
  Synthetic
tcgtcctctagcttcttgatagtcattattgccttccggagcttcctctcgaggtcctccgcttcctctctcggc

SEQ ID NO: 145231 - DNA, 75 bp, Artificial Sequence
  Synthetic
tcgtcctctagcttcttgatagtcatttttgccttccggagcttcctctcgaggtcctccgcttcctctctcgac

SEQ ID NO: 145232 - DNA, 75 bp, Artificial Sequence
  Synthetic
tcgtcctctagcttcttgatagtcatttttgccttccggagcttcctctcgaggtcctccgcttcctctctcgtc

SEQ ID NO: 145233 - DNA, 75 bp, Artificial Sequence
  Synthetic
tcgtcctctagcttcttgatagtcatttttgccttccggagcttcctctcgaggtcctccgcttcctctctcgcc

SEQ ID NO: 145234 - DNA, 75 bp, Artificial Sequence
  Synthetic
tcgtcctctagcttcttgatagtcatttttgccttccggagcttcctctcgaggtcctccgcttcctctctcggc

SEQ ID NO: 145235 - DNA, 75 bp, Artificial Sequence
  Synthetic
tcgtcctctagcttcttgatagtcattcttgccttccggagcttcctctcgaggtcctccgcttcctctctcgac

SEQ ID NO: 145236 - DNA, 75 bp, Artificial Sequence
  Synthetic
tcgtcctctagcttcttgatagtcattcttgccttccggagcttcctctcgaggtcctccgcttcctctctcgtc

SEQ ID NO: 145237 - DNA, 75 bp, Artificial Sequence
  Synthetic
tcgtcctctagcttcttgatagtcattcttgccttccggagcttcctctcgaggtcctccgcttcctctctcgcc

SEQ ID NO: 145238 - DNA, 75 bp, Artificial Sequence
  Synthetic
tcgtcctctagcttcttgatagtcattcttgccttccggagcttcctctcgaggtcctccgcttcctctctcggc

SEQ ID NO: 145239 - DNA, 75 bp, Artificial Sequence
  Synthetic
tcgtcctctagcttcttgatagtcattgttgccttccggagcttcctctcgaggtcctccgcttcctctctcgac

SEQ ID NO: 145240 - DNA, 75 bp, Artificial Sequence
  Synthetic
tcgtcctctagcttcttgatagtcattgttgccttccggagcttcctctcgaggtcctccgcttcctctctcgtc

SEQ ID NO: 145241 - DNA, 75 bp, Artificial Sequence
  Synthetic
tcgtcctctagcttcttgatagtcattgttgccttccggagcttcctctcgaggtcctccgcttcctctctcgcc

SEQ ID NO: 145242 - DNA, 75 bp, Artificial Sequence
  Synthetic
tcgtcctctagcttcttgatagtcattgttgccttccggagcttcctctcgaggtcctccgcttcctctctcggc

SEQ ID NO: 145243 - DNA, 75 bp, Artificial Sequence
  Synthetic
tcgtcctctagcttcttgatagtctttattgccttccggagcttcctctcgaggtcctccgcttcctctctcgac

SEQ ID NO: 145244 - DNA, 75 bp, Artificial Sequence
  Synthetic
tcgtcctctagcttcttgatagtctttattgccttccggagcttcctctcgaggtcctccgcttcctctctcgtc

SEQ ID NO: 145245 - DNA, 75 bp, Artificial Sequence
  Synthetic
tcgtcctctagcttcttgatagtctttattgccttccggagcttcctctcgaggtcctccgcttcctctctcgcc

SEQ ID NO: 145246 - DNA, 75 bp, Artificial Sequence
  Synthetic
tcgtcctctagcttcttgatagtctttattgccttccggagcttcctctcgaggtcctccgcttcctctctcggc

SEQ ID NO: 145247 - DNA, 75 bp, Artificial Sequence
  Synthetic
tcgtcctctagcttcttgatagtcttttttgccttccggagcttcctctcgaggtcctccgcttcctctctcgac

SEQ ID NO: 145248 - DNA, 75 bp, Artificial Sequence
  Synthetic
tcgtcctctagcttcttgatagtcttttttgccttccggagcttcctctcgaggtcctccgcttcctctctcgtc

SEQ ID NO: 145249 - DNA, 75 bp, Artificial Sequence
  Synthetic
tcgtcctctagcttcttgatagtcttttttgccttccggagcttcctctcgaggtcctccgcttcctctctcgcc

SEQ ID NO: 145250 - DNA, 75 bp, Artificial Sequence
  Synthetic
tcgtcctctagcttcttgatagtcttttttgccttccggagcttcctctcgaggtcctccgcttcctctctcggc

SEQ ID NO: 145251 - DNA, 75 bp, Artificial Sequence
  Synthetic
tcgtcctctagcttcttgatagtctttcttgccttccggagcttcctctcgaggtcctccgcttcctctctcgac

SEQ ID NO: 145252 - DNA, 75 bp, Artificial Sequence
  Synthetic
tcgtcctctagcttcttgatagtctttcttgccttccggagcttcctctcgaggtcctccgcttcctctctcgtc

SEQ ID NO: 145253 - DNA, 75 bp, Artificial Sequence
  Synthetic
tcgtcctctagcttcttgatagtctttcttgccttccggagcttcctctcgaggtcctccgcttcctctctcgcc

SEQ ID NO: 145254 - DNA, 75 bp, Artificial Sequence
  Synthetic
tcgtcctctagcttcttgatagtctttcttgccttccggagcttcctctcgaggtcctccgcttcctctctcggc

SEQ ID NO: 145255 - DNA, 75 bp, Artificial Sequence
  Synthetic
tcgtcctctagcttcttgatagtctttgttgccttccggagcttcctctcgaggtcctccgcttcctctctcgac

SEQ ID NO: 145256 - DNA, 75 bp, Artificial Sequence
  Synthetic
tcgtcctctagcttcttgatagtctttgttgccttccggagcttcctctcgaggtcctccgcttcctctctcgtc

SEQ ID NO: 145257 - DNA, 75 bp, Artificial Sequence
  Synthetic
tcgtcctctagcttcttgatagtctttgttgccttccggagcttcctctcgaggtcctccgcttcctctctcgcc

SEQ ID NO: 145258 - DNA, 75 bp, Artificial Sequence
  Synthetic
tcgtcctctagcttcttgatagtctttgttgccttccggagcttcctctcgaggtcctccgcttcctctctcggc

SEQ ID NO: 145259 - DNA, 75 bp, Artificial Sequence
  Synthetic
tcgtcctctagcttcttgatagtccttattgccttccggagcttcctctcgaggtcctccgcttcctctctcgac

SEQ ID NO: 145260 - DNA, 75 bp, Artificial Sequence
  Synthetic
tcgtcctctagcttcttgatagtccttattgccttccggagcttcctctcgaggtcctccgcttcctctctcgtc

SEQ ID NO: 145261 - DNA, 75 bp, Artificial Sequence
  Synthetic
tcgtcctctagcttcttgatagtccttattgccttccggagcttcctctcgaggtcctccgcttcctctctcgcc

SEQ ID NO: 145262 - DNA, 75 bp, Artificial Sequence
  Synthetic
tcgtcctctagcttcttgatagtccttattgccttccggagcttcctctcgaggtcctccgcttcctctctcggc

SEQ ID NO: 145263 - DNA, 75 bp, Artificial Sequence
  Synthetic
tcgtcctctagcttcttgatagtcctttttgccttccggagcttcctctcgaggtcctccgcttcctctctcgac

SEQ ID NO: 145264 - DNA, 75 bp, Artificial Sequence
  Synthetic
tcgtcctctagcttcttgatagtcctttttgccttccggagcttcctctcgaggtcctccgcttcctctctcgtc

SEQ ID NO: 145265 - DNA, 75 bp, Artificial Sequence
  Synthetic
tcgtcctctagcttcttgatagtcctttttgccttccggagcttcctctcgaggtcctccgcttcctctctcgcc

SEQ ID NO: 145266 - DNA, 75 bp, Artificial Sequence
  Synthetic
tcgtcctctagcttcttgatagtcctttttgccttccggagcttcctctcgaggtcctccgcttcctctctcggc

SEQ ID NO: 145267 - DNA, 75 bp, Artificial Sequence
  Synthetic
tcgtcctctagcttcttgatagtccttcttgccttccggagcttcctctcgaggtcctccgcttcctctctcgac

SEQ ID NO: 145268 - DNA, 75 bp, Artificial Sequence
  Synthetic
tcgtcctctagcttcttgatagtccttcttgccttccggagcttcctctcgaggtcctccgcttcctctctcgtc

SEQ ID NO: 145269 - DNA, 75 bp, Artificial Sequence
  Synthetic
tcgtcctctagcttcttgatagtccttcttgccttccggagcttcctctcgaggtcctccgcttcctctctcgcc

SEQ ID NO: 145270 - DNA, 75 bp, Artificial Sequence
  Synthetic
tcgtcctctagcttcttgatagtccttcttgccttccggagcttcctctcgaggtcctccgcttcctctctcggc

SEQ ID NO: 145271 - DNA, 75 bp, Artificial Sequence
  Synthetic
tcgtcctctagcttcttgatagtccttgttgccttccggagcttcctctcgaggtcctccgcttcctctctcgac

SEQ ID NO: 145272 - DNA, 75 bp, Artificial Sequence
  Synthetic
tcgtcctctagcttcttgatagtccttgttgccttccggagcttcctctcgaggtcctccgcttcctctctcgtc

SEQ ID NO: 145273 - DNA, 75 bp, Artificial Sequence
  Synthetic
tcgtcctctagcttcttgatagtccttgttgccttccggagcttcctctcgaggtcctccgcttcctctctcgcc

SEQ ID NO: 145274 - DNA, 75 bp, Artificial Sequence
  Synthetic
tcgtcctctagcttcttgatagtccttgttgccttccggagcttcctctcgaggtcctccgcttcctctctcggc

SEQ ID NO: 145275 - DNA, 75 bp, Artificial Sequence
  Synthetic
tcgtcctctagcttcttgatagtcgttattgccttccggagcttcctctcgaggtcctccgcttcctctctcgac

SEQ ID NO: 145276 - DNA, 75 bp, Artificial Sequence
  Synthetic
tcgtcctctagcttcttgatagtcgttattgccttccggagcttcctctcgaggtcctccgcttcctctctcgtc

SEQ ID NO: 145277 - DNA, 75 bp, Artificial Sequence
  Synthetic
tcgtcctctagcttcttgatagtcgttattgccttccggagcttcctctcgaggtcctccgcttcctctctcgcc

SEQ ID NO: 145278 - DNA, 75 bp, Artificial Sequence
  Synthetic
tcgtcctctagcttcttgatagtcgttattgccttccggagcttcctctcgaggtcctccgcttcctctctcggc

SEQ ID NO: 145279 - DNA, 75 bp, Artificial Sequence
  Synthetic
tcgtcctctagcttcttgatagtcgtttttgccttccggagcttcctctcgaggtcctccgcttcctctctcgac

SEQ ID NO: 145280 - DNA, 75 bp, Artificial Sequence
  Synthetic
tcgtcctctagcttcttgatagtcgtttttgccttccggagcttcctctcgaggtcctccgcttcctctctcgtc

SEQ ID NO: 145281 - DNA, 75 bp, Artificial Sequence
  Synthetic
tcgtcctctagcttcttgatagtcgtttttgccttccggagcttcctctcgaggtcctccgcttcctctctcgcc

SEQ ID NO: 145282 - DNA, 75 bp, Artificial Sequence
  Synthetic
tcgtcctctagcttcttgatagtcgtttttgccttccggagcttcctctcgaggtcctccgcttcctctctcggc

SEQ ID NO: 145283 - DNA, 75 bp, Artificial Sequence
  Synthetic
tcgtcctctagcttcttgatagtcgttcttgccttccggagcttcctctcgaggtcctccgcttcctctctcgac

SEQ ID NO: 145284 - DNA, 75 bp, Artificial Sequence
  Synthetic
tcgtcctctagcttcttgatagtcgttcttgccttccggagcttcctctcgaggtcctccgcttcctctctcgtc

SEQ ID NO: 145285 - DNA, 75 bp, Artificial Sequence
  Synthetic
tcgtcctctagcttcttgatagtcgttcttgccttccggagcttcctctcgaggtcctccgcttcctctctcgcc

SEQ ID NO: 145286 - DNA, 75 bp, Artificial Sequence
  Synthetic
tcgtcctctagcttcttgatagtcgttcttgccttccggagcttcctctcgaggtcctccgcttcctctctcggc

SEQ ID NO: 145287 - DNA, 75 bp, Artificial Sequence
  Synthetic
tcgtcctctagcttcttgatagtcgttgttgccttccggagcttcctctcgaggtcctccgcttcctctctcgac

SEQ ID NO: 145288 - DNA, 75 bp, Artificial Sequence
  Synthetic
tcgtcctctagcttcttgatagtcgttgttgccttccggagcttcctctcgaggtcctccgcttcctctctcgtc

SEQ ID NO: 145289 - DNA, 75 bp, Artificial Sequence
  Synthetic
tcgtcctctagcttcttgatagtcgttgttgccttccggagcttcctctcgaggtcctccgcttcctctctcgcc

SEQ ID NO: 145290 - DNA, 75 bp, Artificial Sequence
  Synthetic
tcgtcctctagcttcttgatagtcgttgttgccttccggagcttcctctcgaggtcctccgcttcctctctcggc

SEQ ID NO: 145291 - DNA, 75 bp, Artificial Sequence
  Synthetic
ttattgccttccggagcttcctctcgaggtcctccgcttcctctctcgacttgacccatttcgagaggatctcct

SEQ ID NO: 145292 - DNA, 75 bp, Artificial Sequence
  Synthetic
ttattgccttccggagcttcctctcgaggtcctccgcttcctctctcgtcttgacccatttcgagaggatctcct

SEQ ID NO: 145293 - DNA, 75 bp, Artificial Sequence
  Synthetic
ttattgccttccggagcttcctctcgaggtcctccgcttcctctctcgccttgacccatttcgagaggatctcct

SEQ ID NO: 145294 - DNA, 75 bp, Artificial Sequence
  Synthetic
ttattgccttccggagcttcctctcgaggtcctccgcttcctctctcggcttgacccatttcgagaggatctcct

SEQ ID NO: 145295 - DNA, 75 bp, Artificial Sequence
  Synthetic
tttttgccttccggagcttcctctcgaggtcctccgcttcctctctcgacttgacccatttcgagaggatctcct

SEQ ID NO: 145296 - DNA, 75 bp, Artificial Sequence
  Synthetic
tttttgccttccggagcttcctctcgaggtcctccgcttcctctctcgtcttgacccatttcgagaggatctcct

SEQ ID NO: 145297 - DNA, 75 bp, Artificial Sequence
  Synthetic
tttttgccttccggagcttcctctcgaggtcctccgcttcctctctcgccttgacccatttcgagaggatctcct

SEQ ID NO: 145298 - DNA, 75 bp, Artificial Sequence
  Synthetic
tttttgccttccggagcttcctctcgaggtcctccgcttcctctctcggcttgacccatttcgagaggatctcct

SEQ ID NO: 145299 - DNA, 75 bp, Artificial Sequence
  Synthetic
ttcttgccttccggagcttcctctcgaggtcctccgcttcctctctcgacttgacccatttcgagaggatctcct

SEQ ID NO: 145300 - DNA, 75 bp, Artificial Sequence
  Synthetic
ttcttgccttccggagcttcctctcgaggtcctccgcttcctctctcgtcttgacccatttcgagaggatctcct

SEQ ID NO: 145301 - DNA, 75 bp, Artificial Sequence
  Synthetic
ttcttgccttccggagcttcctctcgaggtcctccgcttcctctctcgccttgacccatttcgagaggatctcct

SEQ ID NO: 145302 - DNA, 75 bp, Artificial Sequence
  Synthetic
ttcttgccttccggagcttcctctcgaggtcctccgcttcctctctcggcttgacccatttcgagaggatctcct

SEQ ID NO: 145303 - DNA, 75 bp, Artificial Sequence
  Synthetic
ttgttgccttccggagcttcctctcgaggtcctccgcttcctctctcgacttgacccatttcgagaggatctcct

SEQ ID NO: 145304 - DNA, 75 bp, Artificial Sequence
  Synthetic
ttgttgccttccggagcttcctctcgaggtcctccgcttcctctctcgtcttgacccatttcgagaggatctcct

SEQ ID NO: 145305 - DNA, 75 bp, Artificial Sequence
  Synthetic
ttgttgccttccggagcttcctctcgaggtcctccgcttcctctctcgccttgacccatttcgagaggatctcct

SEQ ID NO: 145306 - DNA, 75 bp, Artificial Sequence
  Synthetic
ttgttgccttccggagcttcctctcgaggtcctccgcttcctctctcggcttgacccatttcgagaggatctcct

SEQ ID NO: 145307 - DNA, 75 bp, Artificial Sequence
  Synthetic
ccctacctcccctccgggatctcttcgaatcggcaaggctcatctcggcagaggcggcaatcctcagtactctta

SEQ ID NO: 145308 - DNA, 75 bp, Artificial Sequence
  Synthetic
ccctacctcccctccgggatctcttcgaatcggcaaggctcatctcggcagaggcggcaatcctcagttctctta

SEQ ID NO: 145309 - DNA, 75 bp, Artificial Sequence
  Synthetic
ccctacctcccctccgggatctcttcgaatcggcaaggctcatctcggcagaggcggcaatcctcagtcctctta

SEQ ID NO: 145310 - DNA, 75 bp, Artificial Sequence
  Synthetic
ccctacctcccctccgggatctcttcgaatcggcaaggctcatctcggcagaggcggcaatcctcagtgctctta

SEQ ID NO: 145311 - DNA, 75 bp, Artificial Sequence
  Synthetic
ccctacctcccctccgggatctcttcgaatcggcaaggctcatctcggcagaggcggctatcctcagtactctta

SEQ ID NO: 145312 - DNA, 75 bp, Artificial Sequence
  Synthetic
ccctacctcccctccgggatctcttcgaatcggcaaggctcatctcggcagaggcggctatcctcagttctctta

SEQ ID NO: 145313 - DNA, 75 bp, Artificial Sequence
  Synthetic
ccctacctcccctccgggatctcttcgaatcggcaaggctcatctcggcagaggcggctatcctcagtcctctta

SEQ ID NO: 145314 - DNA, 75 bp, Artificial Sequence
  Synthetic
ccctacctcccctccgggatctcttcgaatcggcaaggctcatctcggcagaggcggctatcctcagtgctctta

SEQ ID NO: 145315 - DNA, 75 bp, Artificial Sequence
  Synthetic
ccctacctcccctccgggatctcttcgaatcggcaaggctcatctcggcagaggcggccatcctcagtactctta

SEQ ID NO: 145316 - DNA, 75 bp, Artificial Sequence
  Synthetic
ccctacctcccctccgggatctcttcgaatcggcaaggctcatctcggcagaggcggccatcctcagttctctta

SEQ ID NO: 145317 - DNA, 75 bp, Artificial Sequence
  Synthetic
ccctacctcccctccgggatctcttcgaatcggcaaggctcatctcggcagaggcggccatcctcagtcctctta

SEQ ID NO: 145318 - DNA, 75 bp, Artificial Sequence
  Synthetic
ccctacctcccctccgggatctcttcgaatcggcaaggctcatctcggcagaggcggccatcctcagtgctctta

SEQ ID NO: 145319 - DNA, 75 bp, Artificial Sequence
  Synthetic
ccctacctcccctccgggatctcttcgaatcggcaaggctcatctcggcagaggcggcgatcctcagtactctta

SEQ ID NO: 145320 - DNA, 75 bp, Artificial Sequence
  Synthetic
ccctacctcccctccgggatctcttcgaatcggcaaggctcatctcggcagaggcggcgatcctcagttctctta

SEQ ID NO: 145321 - DNA, 75 bp, Artificial Sequence
  Synthetic
ccctacctcccctccgggatctcttcgaatcggcaaggctcatctcggcagaggcggcgatcctcagtcctctta

SEQ ID NO: 145322 - DNA, 75 bp, Artificial Sequence
  Synthetic
ccctacctcccctccgggatctcttcgaatcggcaaggctcatctcggcagaggcggcgatcctcagtgctctta

SEQ ID NO: 145323 - DNA, 75 bp, Artificial Sequence
  Synthetic
agaggcggcaatcctcagtactcttactcttttcttgaaagaggagactgctggacgccccgcccgagtccgagc

SEQ ID NO: 145324 - DNA, 75 bp, Artificial Sequence
  Synthetic
agaggcggcaatcctcagttctcttactcttttcttgaaagaggagactgctggacgccccgcccgagtccgagc

SEQ ID NO: 145325 - DNA, 75 bp, Artificial Sequence
  Synthetic
agaggcggcaatcctcagtcctcttactcttttcttgaaagaggagactgctggacgccccgcccgagtccgagc

SEQ ID NO: 145326 - DNA, 75 bp, Artificial Sequence
  Synthetic
agaggcggcaatcctcagtgctcttactcttttcttgaaagaggagactgctggacgccccgcccgagtccgagc

SEQ ID NO: 145327 - DNA, 75 bp, Artificial Sequence
  Synthetic
agaggcggctatcctcagtactcttactcttttcttgaaagaggagactgctggacgccccgcccgagtccgagc

SEQ ID NO: 145328 - DNA, 75 bp, Artificial Sequence
  Synthetic
agaggcggctatcctcagttctcttactcttttcttgaaagaggagactgctggacgccccgcccgagtccgagc

SEQ ID NO: 145329 - DNA, 75 bp, Artificial Sequence
  Synthetic
agaggcggctatcctcagtcctcttactcttttcttgaaagaggagactgctggacgccccgcccgagtccgagc

SEQ ID NO: 145330 - DNA, 75 bp, Artificial Sequence
  Synthetic
agaggcggctatcctcagtgctcttactcttttcttgaaagaggagactgctggacgccccgcccgagtccgagc

SEQ ID NO: 145331 - DNA, 75 bp, Artificial Sequence
  Synthetic
agaggcggccatcctcagtactcttactcttttcttgaaagaggagactgctggacgccccgcccgagtccgagc

SEQ ID NO: 145332 - DNA, 75 bp, Artificial Sequence
  Synthetic
agaggcggccatcctcagttctcttactcttttcttgaaagaggagactgctggacgccccgcccgagtccgagc

SEQ ID NO: 145333 - DNA, 75 bp, Artificial Sequence
  Synthetic
agaggcggccatcctcagtcctcttactcttttcttgaaagaggagactgctggacgccccgcccgagtccgagc

SEQ ID NO: 145334 - DNA, 75 bp, Artificial Sequence
  Synthetic
agaggcggccatcctcagtgctcttactcttttcttgaaagaggagactgctggacgccccgcccgagtccgagc

SEQ ID NO: 145335 - DNA, 75 bp, Artificial Sequence
  Synthetic
agaggcggcgatcctcagtactcttactcttttcttgaaagaggagactgctggacgccccgcccgagtccgagc

SEQ ID NO: 145336 - DNA, 75 bp, Artificial Sequence
  Synthetic
agaggcggcgatcctcagttctcttactcttttcttgaaagaggagactgctggacgccccgcccgagtccgagc

SEQ ID NO: 145337 - DNA, 75 bp, Artificial Sequence
  Synthetic
agaggcggcgatcctcagtcctcttactcttttcttgaaagaggagactgctggacgccccgcccgagtccgagc

SEQ ID NO: 145338 - DNA, 75 bp, Artificial Sequence
  Synthetic
agaggcggcgatcctcagtgctcttactcttttcttgaaagaggagactgctggacgccccgcccgagtccgagc

SEQ ID NO: 145339 - DNA, 75 bp, Artificial Sequence
  Synthetic
aggagaaggaacccccgaagggacaaggacgggagagcgggaacactccgaggaaagacccccaagaagacaaga

SEQ ID NO: 145340 - DNA, 75 bp, Artificial Sequence
  Synthetic
aggagaaggaacccccgaagggacaaggacgggagagcgggaacactccgaggaaagacccccaagaagtcaaga

SEQ ID NO: 145341 - DNA, 75 bp, Artificial Sequence
  Synthetic
aggagaaggaacccccgaagggacaaggacgggagagcgggaacactccgaggaaagacccccaagaagccaaga

SEQ ID NO: 145342 - DNA, 75 bp, Artificial Sequence
  Synthetic
aggagaaggaacccccgaagggacaaggacgggagagcgggaacactccgaggaaagacccccaagaaggcaaga

SEQ ID NO: 145343 - DNA, 75 bp, Artificial Sequence
  Synthetic
gatgggcctcagtgccgacgaggagtccgcaggtgggaggatcagccaccggagagggacgcgatggtaagagtg

SEQ ID NO: 145344 - DNA, 75 bp, Artificial Sequence
  Synthetic
agaagatcattcgagattcaagaggtgaggagggatcccccagacgctgaaggagcaccgggaagaaagaaaaaa

SEQ ID NO: 145345 - DNA, 75 bp, Artificial Sequence
  Synthetic
ggagaacccacctccagaggaccccttcagcgaacagaagagctcctcctcctcgggagtgggtccgtagcgatg

SEQ ID NO: 145346 - DNA, 75 bp, Artificial Sequence
  Synthetic
gttcctccccccgaaggtcccgagtgaggcttatcccggggatcggcctccgctcctccatggtggatccaggtc

SEQ ID NO: 145347 - DNA, 75 bp, Artificial Sequence
  Synthetic
ccagcctcctcgttggcgccggctgggcaacattccgaaggggaccgtccctcggtaatggcgaatgggacccag

SEQ ID NO: 145348 - DNA, 75 bp, Artificial Sequence
  Synthetic
atgggccgcttccggcgaacggtcccgaattggggagggtggagaactcccgagagctgggagacagaaagagag

SEQ ID NO: 145349 - DNA, 75 bp, Artificial Sequence
  Synthetic
cgagagctgggagacagaaagagagcgaatggcctcgggtggatcccccaagctgccaacagaggaagaaaacaa

SEQ ID NO: 145350 - DNA, 75 bp, Artificial Sequence
  Synthetic
cgaatggcctcgggtggatcccccaagctgccaacagaggaagaaaacaagaaggaggagcccccatgacgctga

SEQ ID NO: 145351 - DNA, 75 bp, Artificial Sequence
  Synthetic
cgaaccatcgcgagctgggagaggagtggcgaagaaattggcggagaccccggtccgaatgcccatcggcgtcaa

SEQ ID NO: 145352 - DNA, 75 bp, Artificial Sequence
  Synthetic
gtggcgaagaaattggcggagaccccggtccgaatgcccatcggcgtcaagctcctctggagtcttccggagcca

SEQ ID NO: 145353 - DNA, 75 bp, Artificial Sequence
  Synthetic
aaggagaaaactaccggcggagggcgatccacccggagctggacggacaagccacatccagaggaccccttcggc

SEQ ID NO: 145354 - DNA, 75 bp, Artificial Sequence
  Synthetic
gccacatccagaggaccccttcggcgaacagaagaccctggtaccggggggaatagcccatagtacgaggggaga

SEQ ID NO: 145355 - DNA, 75 bp, Artificial Sequence
  Synthetic
tatcccgggggtgacgcctcggtcctcccttagcatcggagtcccgggccccctcccaggaataggaacaggggg

SEQ ID NO: 145356 - DNA, 75 bp, Artificial Sequence
  Synthetic
tcccttagcatcggagtcccgggccccctcccaggaataggaacagggggagatcgaccgggacccgcagaaccc

SEQ ID NO: 145357 - DNA, 75 bp, Artificial Sequence
  Synthetic
gatggagttcccccaccaaccccttccggatagaaccggtcccgataggggcacccacaataggatggcaggagg

SEQ ID NO: 145358 - DNA, 75 bp, Artificial Sequence
  Synthetic
ggactctcgggtccgtcgttccatccttttcttaccttgtggccggcatggccccagcctcctcgctggcgccgg

SEQ ID NO: 145359 - DNA, 75 bp, Artificial Sequence
  Synthetic
caggccgcgggccggctactcttctttctctttcgtcgtcatccttggccagcctctggagttcctcttcttcct

SEQ ID NO: 145360 - DNA, 75 bp, Artificial Sequence
  Synthetic
gcctctcctggtcggtgaaccccctggccttgggtttcctcccagctccggaatcaatctccatggcttcccgcc

SEQ ID NO: 145361 - DNA, 75 bp, Artificial Sequence
  Synthetic
ggttttcatcctcaagcttcttgatcttcctgttggttcgccggagatccttctcgagtattcgctttttcttcc

SEQ ID NO: 145362 - DNA, 75 bp, Artificial Sequence
  Synthetic
tttcttctacccactgttcgaggatctcctctctctccttcgaggacgggttcgcgacgggttggctcatcctga

SEQ ID NO: 145363 - DNA, 75 bp, Artificial Sequence
  Synthetic
gaccggggagcttcgatgatctctctattctcttgaaagaggaaggagctctcgaacgccctcccgttccctcgg

SEQ ID NO: 145364 - DNA, 75 bp, Artificial Sequence
  Synthetic
agtaagaccatagcgataggaggagatgctaggagtaggaggagaccgaagcgaggaggaaagtaaagaaagcaa

SEQ ID NO: 145365 - DNA, 75 bp, Artificial Sequence
  Synthetic
ccggtccgagagaagggggactccgggactccctgcagactggggacgaagccgcccccgggcctcccctcgatc

SEQ ID NO: 145366 - DNA, 75 bp, Artificial Sequence
  Synthetic
atctggagagcactccggcccgaagggttgagtagcactcagagggaggaatccactcggagatgagcagagaaa

SEQ ID NO: 145367 - DNA, 75 bp, Artificial Sequence
  Synthetic
catgggccatctccgagcgaagaggacgcgccggaaggatcagctcccgagaggggtaagacggtaaagagcatt

SEQ ID NO: 145368 - DNA, 75 bp, Artificial Sequence
  Synthetic
acgcgccggaaggatcagctcccgagaggggtaagacggtaaagagcattggaacgccgagagtgagtctcccaa

SEQ ID NO: 145369 - DNA, 75 bp, Artificial Sequence
  Synthetic
ctcacggagaaaagcagacaaatcacctccagaggaccccttcagcgaacagagagctctgacgcgcgaggagta

SEQ ID NO: 145370 - DNA, 75 bp, Artificial Sequence
  Synthetic
gctagccggtgggtgttccacctcccgagaggggacgagtgaggcttatcccggggaactcggcgcgaatcgtcc
